United States Patent 12,644,137 (MATERIALS AND METHODS FOR TREATMENT OF HEMOGLOBINOPATHIES) - sequence listing, part 5

SEQ ID NO: 88789 - DNA, 22 bp, Artificial Sequence
  Synthetic oligonucleotide; CTT chr11 5250575 5250596 5250592 5250597 +
agaaaaatatttgattccatat

SEQ ID NO: 88790 - DNA, 22 bp, Artificial Sequence
  Synthetic oligonucleotide; TTA chr11 5250576 5250597 5250593 5250598 +
gaaaaatatttgattccatatt

SEQ ID NO: 88791 - DNA, 22 bp, Artificial Sequence
  Synthetic oligonucleotide; TTT chr11 5250587 5250608 5250604 5250609 +
gattccatattcaggtatgtat

SEQ ID NO: 88792 - DNA, 22 bp, Artificial Sequence
  Synthetic oligonucleotide; TTG chr11 5250588 5250609 5250605 5250610 +
attccatattcaggtatgtatg

SEQ ID NO: 88793 - DNA, 22 bp, Artificial Sequence
  Synthetic oligonucleotide; TTC chr11 5250592 5250613 5250609 5250614 +
catattcaggtatgtatgtata

SEQ ID NO: 88794 - DNA, 22 bp, Artificial Sequence
  Synthetic oligonucleotide; TTC chr11 5250599 5250620 5250616 5250621 +
aggtatgtatgtatacaccaga

SEQ ID NO: 88795 - DNA, 22 bp, Artificial Sequence
  Synthetic oligonucleotide; TTT chr11 5250633 5250654 5250650 5250655 +
accactggataagtgtgtgtgc

SEQ ID NO: 88796 - DNA, 22 bp, Artificial Sequence
  Synthetic oligonucleotide; TTA chr11 5250634 5250655 5250651 5250656 +
ccactggataagtgtgtgtgct

SEQ ID NO: 88797 - DNA, 22 bp, Artificial Sequence
  Synthetic oligonucleotide; CTG chr11 5250640 5250661 5250657 5250662 +
gataagtgtgtgtgctggctga

SEQ ID NO: 88798 - DNA, 22 bp, Artificial Sequence
  Synthetic oligonucleotide; CTG chr11 5250657 5250678 5250674 5250679 +
gctgatgacccagggttttggc

SEQ ID NO: 88799 - DNA, 22 bp, Artificial Sequence
  Synthetic oligonucleotide; CTG chr11 5250661 5250682 5250678 5250683 +
atgacccagggttttggcgtag

SEQ ID NO: 88800 - DNA, 22 bp, Artificial Sequence
  Synthetic oligonucleotide; TTT chr11 5250675 5250696 5250692 5250697 +
tggcgtagctcttctatgctca

SEQ ID NO: 88801 - DNA, 22 bp, Artificial Sequence
  Synthetic oligonucleotide; TTT chr11 5250676 5250697 5250693 5250698 +
ggcgtagctcttctatgctcag

SEQ ID NO: 88802 - DNA, 22 bp, Artificial Sequence
  Synthetic oligonucleotide; TTG chr11 5250677 5250698 5250694 5250699 +
gcgtagctcttctatgctcagt

SEQ ID NO: 88803 - DNA, 22 bp, Artificial Sequence
  Synthetic oligonucleotide; CTC chr11 5250686 5250707 5250703 5250708 +
ttctatgctcagtaaagatgat

SEQ ID NO: 88804 - DNA, 22 bp, Artificial Sequence
  Synthetic oligonucleotide; CTT chr11 5250688 5250709 5250705 5250710 +
ctatgctcagtaaagatgatgg

SEQ ID NO: 88805 - DNA, 22 bp, Artificial Sequence
  Synthetic oligonucleotide; TTC chr11 5250689 5250710 5250706 5250711 +
tatgctcagtaaagatgatggt

SEQ ID NO: 88806 - DNA, 22 bp, Artificial Sequence
  Synthetic oligonucleotide; CTA chr11 5250691 5250712 5250708 5250713 +
tgctcagtaaagatgatggtag

SEQ ID NO: 88807 - DNA, 22 bp, Artificial Sequence
  Synthetic oligonucleotide; CTC chr11 5250696 5250717 5250713 5250718 +
agtaaagatgatggtagaatgt

SEQ ID NO: 88808 - DNA, 22 bp, Artificial Sequence
  Synthetic oligonucleotide; TTC chr11 5250720 5250741 5250737 5250742 +
tttggcaggtactgtggattag

SEQ ID NO: 88809 - DNA, 22 bp, Artificial Sequence
  Synthetic oligonucleotide; CTT chr11 5250722 5250743 5250739 5250744 +
tggcaggtactgtggattagaa

SEQ ID NO: 88810 - DNA, 22 bp, Artificial Sequence
  Synthetic oligonucleotide; TTT chr11 5250723 5250744 5250740 5250745 +
ggcaggtactgtggattagaat

SEQ ID NO: 88811 - DNA, 22 bp, Artificial Sequence
  Synthetic oligonucleotide; TTG chr11 5250724 5250745 5250741 5250746 +
gcaggtactgtggattagaatt

SEQ ID NO: 88812 - DNA, 22 bp, Artificial Sequence
  Synthetic oligonucleotide; CTG chr11 5250734 5250755 5250751 5250756 +
tggattagaattaattatcttg

SEQ ID NO: 88813 - DNA, 22 bp, Artificial Sequence
  Synthetic oligonucleotide; TTA chr11 5250741 5250762 5250758 5250763 +
gaattaattatcttgtataaat

SEQ ID NO: 88814 - DNA, 22 bp, Artificial Sequence
  Synthetic oligonucleotide; TTA chr11 5250747 5250768 5250764 5250769 +
attatcttgtataaatgctagg

SEQ ID NO: 88815 - DNA, 22 bp, Artificial Sequence
  Synthetic oligonucleotide; TTA chr11 5250751 5250772 5250768 5250773 +
tcttgtataaatgctaggttca

SEQ ID NO: 88816 - DNA, 22 bp, Artificial Sequence
  Synthetic oligonucleotide; CTT chr11 5250755 5250776 5250772 5250777 +
gtataaatgctaggttcacttc

SEQ ID NO: 88817 - DNA, 22 bp, Artificial Sequence
  Synthetic oligonucleotide; TTG chr11 5250756 5250777 5250773 5250778 +
tataaatgctaggttcacttct

SEQ ID NO: 88818 - DNA, 22 bp, Artificial Sequence
  Synthetic oligonucleotide; CTA chr11 5250767 5250788 5250784 5250789 +
ggttcacttctcagggaatctt

SEQ ID NO: 88819 - DNA, 22 bp, Artificial Sequence
  Synthetic oligonucleotide; TTC chr11 5250772 5250793 5250789 5250794 +
acttctcagggaatcttactct

SEQ ID NO: 88820 - DNA, 22 bp, Artificial Sequence
  Synthetic oligonucleotide; CTT chr11 5250776 5250797 5250793 5250798 +
ctcagggaatcttactctaaga

SEQ ID NO: 88821 - DNA, 22 bp, Artificial Sequence
  Synthetic oligonucleotide; TTC chr11 5250777 5250798 5250794 5250799 +
tcagggaatcttactctaagac

SEQ ID NO: 88822 - DNA, 22 bp, Artificial Sequence
  Synthetic oligonucleotide; CTC chr11 5250779 5250800 5250796 5250801 +
agggaatcttactctaagacat

SEQ ID NO: 88823 - DNA, 22 bp, Artificial Sequence
  Synthetic oligonucleotide; CTT chr11 5250789 5250810 5250806 5250811 +
actctaagacataagatgtgcg

SEQ ID NO: 88824 - DNA, 22 bp, Artificial Sequence
  Synthetic oligonucleotide; TTA chr11 5250790 5250811 5250807 5250812 +
ctctaagacataagatgtgcgt

SEQ ID NO: 88825 - DNA, 22 bp, Artificial Sequence
  Synthetic oligonucleotide; CTC chr11 5250793 5250814 5250810 5250815 +
taagacataagatgtgcgtgta

SEQ ID NO: 88826 - DNA, 22 bp, Artificial Sequence
  Synthetic oligonucleotide; CTA chr11 5250795 5250816 5250812 5250817 +
agacataagatgtgcgtgtaca

SEQ ID NO: 88827 - DNA, 22 bp, Artificial Sequence
  Synthetic oligonucleotide; CTC chr11 5250830 5250851 5250847 5250852 +
taaagaggcaagggttgttttt

SEQ ID NO: 88828 - DNA, 22 bp, Artificial Sequence
  Synthetic oligonucleotide; CTA chr11 5250832 5250853 5250849 5250854 +
aagaggcaagggttgtttttat

SEQ ID NO: 88829 - DNA, 22 bp, Artificial Sequence
  Synthetic oligonucleotide; TTG chr11 5250847 5250868 5250864 5250869 +
tttttattgactaatagtccac

SEQ ID NO: 88830 - DNA, 22 bp, Artificial Sequence
  Synthetic oligonucleotide; TTT chr11 5250850 5250871 5250867 5250872 +
ttattgactaatagtccacaca

SEQ ID NO: 88831 - DNA, 22 bp, Artificial Sequence
  Synthetic oligonucleotide; TTT chr11 5250851 5250872 5250868 5250873 +
tattgactaatagtccacacac

SEQ ID NO: 88832 - DNA, 22 bp, Artificial Sequence
  Synthetic oligonucleotide; TTT chr11 5250852 5250873 5250869 5250874 +
attgactaatagtccacacact

SEQ ID NO: 88833 - DNA, 22 bp, Artificial Sequence
  Synthetic oligonucleotide; TTA chr11 5250853 5250874 5250870 5250875 +
ttgactaatagtccacacacta

SEQ ID NO: 88834 - DNA, 22 bp, Artificial Sequence
  Synthetic oligonucleotide; TTG chr11 5250856 5250877 5250873 5250878 +
actaatagtccacacactatta

SEQ ID NO: 88835 - DNA, 22 bp, Artificial Sequence
  Synthetic oligonucleotide; CTA chr11 5250860 5250881 5250877 5250882 +
atagtccacacactattataac

SEQ ID NO: 88836 - DNA, 22 bp, Artificial Sequence
  Synthetic oligonucleotide; CTA chr11 5250875 5250896 5250892 5250897 +
ttataactcgaatattagtgta

SEQ ID NO: 88837 - DNA, 22 bp, Artificial Sequence
  Synthetic oligonucleotide; TTA chr11 5250878 5250899 5250895 5250900 +
taactcgaatattagtgtactt

SEQ ID NO: 88838 - DNA, 22 bp, Artificial Sequence
  Synthetic oligonucleotide; CTC chr11 5250884 5250905 5250901 5250906 +
gaatattagtgtactttagaca

SEQ ID NO: 88839 - DNA, 22 bp, Artificial Sequence
  Synthetic oligonucleotide; TTA chr11 5250892 5250913 5250909 5250914 +
gtgtactttagacagctttatt

SEQ ID NO: 88840 - DNA, 22 bp, Artificial Sequence
  Synthetic oligonucleotide; CTT chr11 5250900 5250921 5250917 5250922 +
tagacagctttatttctaacac

SEQ ID NO: 88841 - DNA, 22 bp, Artificial Sequence
  Synthetic oligonucleotide; TTT chr11 5250901 5250922 5250918 5250923 +
agacagctttatttctaacaca

SEQ ID NO: 88842 - DNA, 22 bp, Artificial Sequence
  Synthetic oligonucleotide; TTA chr11 5250902 5250923 5250919 5250924 +
gacagctttatttctaacacag

SEQ ID NO: 88843 - DNA, 22 bp, Artificial Sequence
  Synthetic oligonucleotide; CTT chr11 5250910 5250931 5250927 5250932 +
tatttctaacacagtgctgttt

SEQ ID NO: 88844 - DNA, 22 bp, Artificial Sequence
  Synthetic oligonucleotide; TTT chr11 5250911 5250932 5250928 5250933 +
atttctaacacagtgctgtttc

SEQ ID NO: 88845 - DNA, 22 bp, Artificial Sequence
  Synthetic oligonucleotide; TTA chr11 5250912 5250933 5250929 5250934 +
tttctaacacagtgctgtttct

SEQ ID NO: 88846 - DNA, 22 bp, Artificial Sequence
  Synthetic oligonucleotide; TTT chr11 5250915 5250936 5250932 5250937 +
ctaacacagtgctgtttctgac

SEQ ID NO: 88847 - DNA, 22 bp, Artificial Sequence
  Synthetic oligonucleotide; TTC chr11 5250916 5250937 5250933 5250938 +
taacacagtgctgtttctgaca

SEQ ID NO: 88848 - DNA, 22 bp, Artificial Sequence
  Synthetic oligonucleotide; CTA chr11 5250918 5250939 5250935 5250940 +
acacagtgctgtttctgacata

SEQ ID NO: 88849 - DNA, 22 bp, Artificial Sequence
  Synthetic oligonucleotide; CTG chr11 5250929 5250950 5250946 5250951 +
tttctgacatattggaccatta

SEQ ID NO: 88850 - DNA, 22 bp, Artificial Sequence
  Synthetic oligonucleotide; TTT chr11 5250932 5250953 5250949 5250954 +
ctgacatattggaccattaaca

SEQ ID NO: 88851 - DNA, 22 bp, Artificial Sequence
  Synthetic oligonucleotide; TTC chr11 5250933 5250954 5250950 5250955 +
tgacatattggaccattaacag

SEQ ID NO: 88852 - DNA, 22 bp, Artificial Sequence
  Synthetic oligonucleotide; CTG chr11 5250935 5250956 5250952 5250957 +
acatattggaccattaacaggg

SEQ ID NO: 88853 - DNA, 22 bp, Artificial Sequence
  Synthetic oligonucleotide; TTG chr11 5250943 5250964 5250960 5250965 +
gaccattaacagggtaggaagt

SEQ ID NO: 88854 - DNA, 22 bp, Artificial Sequence
  Synthetic oligonucleotide; TTA chr11 5250951 5250972 5250968 5250973 +
acagggtaggaagtatttatgg

SEQ ID NO: 88855 - DNA, 22 bp, Artificial Sequence
  Synthetic oligonucleotide; TTT chr11 5250969 5250990 5250986 5250991 +
atggtggttttttggttctgtt

SEQ ID NO: 88856 - DNA, 22 bp, Artificial Sequence
  Synthetic oligonucleotide; TTA chr11 5250970 5250991 5250987 5250992 +
tggtggttttttggttctgttt

SEQ ID NO: 88857 - DNA, 22 bp, Artificial Sequence
  Synthetic oligonucleotide; TTT chr11 5250979 5251000 5250996 5251001 +
tttggttctgttttgcttttgg

SEQ ID NO: 88858 - DNA, 22 bp, Artificial Sequence
  Synthetic oligonucleotide; TTT chr11 5250980 5251001 5250997 5251002 +
ttggttctgttttgcttttggt

SEQ ID NO: 88859 - DNA, 22 bp, Artificial Sequence
  Synthetic oligonucleotide; TTT chr11 5250981 5251002 5250998 5251003 +
tggttctgttttgcttttggtt

SEQ ID NO: 88860 - DNA, 22 bp, Artificial Sequence
  Synthetic oligonucleotide; TTT chr11 5250982 5251003 5250999 5251004 +
ggttctgttttgcttttggtta

SEQ ID NO: 88861 - DNA, 22 bp, Artificial Sequence
  Synthetic oligonucleotide; TTG chr11 5250983 5251004 5251000 5251005 +
gttctgttttgcttttggttag

SEQ ID NO: 88862 - DNA, 22 bp, Artificial Sequence
  Synthetic oligonucleotide; TTC chr11 5250987 5251008 5251004 5251009 +
tgttttgcttttggttagtttg

SEQ ID NO: 88863 - DNA, 22 bp, Artificial Sequence
  Synthetic oligonucleotide; CTG chr11 5250989 5251010 5251006 5251011 +
ttttgcttttggttagtttgtt

SEQ ID NO: 88864 - DNA, 22 bp, Artificial Sequence
  Synthetic oligonucleotide; TTT chr11 5250992 5251013 5251009 5251014 +
tgcttttggttagtttgttttt

SEQ ID NO: 88865 - DNA, 22 bp, Artificial Sequence
  Synthetic oligonucleotide; TTT chr11 5250993 5251014 5251010 5251015 +
gcttttggttagtttgtttttg

SEQ ID NO: 88866 - DNA, 22 bp, Artificial Sequence
  Synthetic oligonucleotide; TTG chr11 5250994 5251015 5251011 5251016 +
cttttggttagtttgtttttgt

SEQ ID NO: 88867 - DNA, 22 bp, Artificial Sequence
  Synthetic oligonucleotide; CTT chr11 5250997 5251018 5251014 5251019 +
ttggttagtttgtttttgtttt

SEQ ID NO: 88868 - DNA, 22 bp, Artificial Sequence
  Synthetic oligonucleotide; TTT chr11 5250998 5251019 5251015 5251020 +
tggttagtttgtttttgttttt

SEQ ID NO: 88869 - DNA, 22 bp, Artificial Sequence
  Synthetic oligonucleotide; TTT chr11 5250999 5251020 5251016 5251021 +
ggttagtttgtttttgtttttc

SEQ ID NO: 88870 - DNA, 22 bp, Artificial Sequence
  Synthetic oligonucleotide; TTG chr11 5251000 5251021 5251017 5251022 +
gttagtttgtttttgtttttct

SEQ ID NO: 88871 - DNA, 22 bp, Artificial Sequence
  Synthetic oligonucleotide; TTA chr11 5251004 5251025 5251021 5251026 +
gtttgtttttgtttttctctga

SEQ ID NO: 88872 - DNA, 22 bp, Artificial Sequence
  Synthetic oligonucleotide; TTT chr11 5251008 5251029 5251025 5251030 +
gtttttgtttttctctgaaagt

SEQ ID NO: 88873 - DNA, 22 bp, Artificial Sequence
  Synthetic oligonucleotide; TTG chr11 5251009 5251030 5251026 5251031 +
tttttgtttttctctgaaagtg

SEQ ID NO: 88874 - DNA, 22 bp, Artificial Sequence
  Synthetic oligonucleotide; TTT chr11 5251012 5251033 5251029 5251034 +
ttgtttttctctgaaagtgatc

SEQ ID NO: 88875 - DNA, 22 bp, Artificial Sequence
  Synthetic oligonucleotide; TTT chr11 5251013 5251034 5251030 5251035 +
tgtttttctctgaaagtgatcc

SEQ ID NO: 88876 - DNA, 22 bp, Artificial Sequence
  Synthetic oligonucleotide; TTT chr11 5251014 5251035 5251031 5251036 +
gtttttctctgaaagtgatcca

SEQ ID NO: 88877 - DNA, 22 bp, Artificial Sequence
  Synthetic oligonucleotide; TTG chr11 5251015 5251036 5251032 5251037 +
tttttctctgaaagtgatccat

SEQ ID NO: 88878 - DNA, 22 bp, Artificial Sequence
  Synthetic oligonucleotide; TTT chr11 5251018 5251039 5251035 5251040 +
ttctctgaaagtgatccatgat

SEQ ID NO: 88879 - DNA, 22 bp, Artificial Sequence
  Synthetic oligonucleotide; TTT chr11 5251019 5251040 5251036 5251041 +
tctctgaaagtgatccatgatc

SEQ ID NO: 88880 - DNA, 22 bp, Artificial Sequence
  Synthetic oligonucleotide; TTT chr11 5251020 5251041 5251037 5251042 +
ctctgaaagtgatccatgatct

SEQ ID NO: 88881 - DNA, 22 bp, Artificial Sequence
  Synthetic oligonucleotide; TTC chr11 5251021 5251042 5251038 5251043 +
tctgaaagtgatccatgatctc

SEQ ID NO: 88882 - DNA, 22 bp, Artificial Sequence
  Synthetic oligonucleotide; CTC chr11 5251023 5251044 5251040 5251045 +
tgaaagtgatccatgatctcta

SEQ ID NO: 88883 - DNA, 22 bp, Artificial Sequence
  Synthetic oligonucleotide; CTG chr11 5251025 5251046 5251042 5251047 +
aaagtgatccatgatctctaac

SEQ ID NO: 88884 - DNA, 22 bp, Artificial Sequence
  Synthetic oligonucleotide; CTC chr11 5251043 5251064 5251060 5251065 +
taaccttgctagattataatgc

SEQ ID NO: 88885 - DNA, 22 bp, Artificial Sequence
  Synthetic oligonucleotide; CTA chr11 5251045 5251066 5251062 5251067 +
accttgctagattataatgcca

SEQ ID NO: 88886 - DNA, 22 bp, Artificial Sequence
  Synthetic oligonucleotide; CTT chr11 5251050 5251071 5251067 5251072 +
gctagattataatgccagaagc

SEQ ID NO: 88887 - DNA, 22 bp, Artificial Sequence
  Synthetic oligonucleotide; TTG chr11 5251051 5251072 5251068 5251073 +
ctagattataatgccagaagct

SEQ ID NO: 88888 - DNA, 22 bp, Artificial Sequence
  Synthetic oligonucleotide; CTA chr11 5251054 5251075 5251071 5251076 +
gattataatgccagaagctctg

SEQ ID NO: 88889 - DNA, 22 bp, Artificial Sequence
  Synthetic oligonucleotide; TTA chr11 5251059 5251080 5251076 5251081 +
taatgccagaagctctggaatt

SEQ ID NO: 88890 - DNA, 22 bp, Artificial Sequence
  Synthetic oligonucleotide; CTC chr11 5251074 5251095 5251091 5251096 +
tggaattctggcttatcggagg

SEQ ID NO: 88891 - DNA, 22 bp, Artificial Sequence
  Synthetic oligonucleotide; CTG chr11 5251076 5251097 5251093 5251098 +
gaattctggcttatcggaggca

SEQ ID NO: 88892 - DNA, 22 bp, Artificial Sequence
  Synthetic oligonucleotide; TTC chr11 5251082 5251103 5251099 5251104 +
tggcttatcggaggcaagctgt

SEQ ID NO: 88893 - DNA, 22 bp, Artificial Sequence
  Synthetic oligonucleotide; CTG chr11 5251084 5251105 5251101 5251106 +
gcttatcggaggcaagctgtat

SEQ ID NO: 88894 - DNA, 22 bp, Artificial Sequence
  Synthetic oligonucleotide; CTT chr11 5251088 5251109 5251105 5251110 +
atcggaggcaagctgtatcttc

SEQ ID NO: 88895 - DNA, 22 bp, Artificial Sequence
  Synthetic oligonucleotide; TTA chr11 5251089 5251110 5251106 5251111 +
tcggaggcaagctgtatcttca

SEQ ID NO: 88896 - DNA, 22 bp, Artificial Sequence
  Synthetic oligonucleotide; CTG chr11 5251103 5251124 5251120 5251125 +
tatcttcaaattagtttatccc

SEQ ID NO: 88897 - DNA, 22 bp, Artificial Sequence
  Synthetic oligonucleotide; CTT chr11 5251109 5251130 5251126 5251131 +
caaattagtttatcccctaagc

SEQ ID NO: 88898 - DNA, 22 bp, Artificial Sequence
  Synthetic oligonucleotide; TTC chr11 5251110 5251131 5251127 5251132 +
aaattagtttatcccctaagct

SEQ ID NO: 88899 - DNA, 22 bp, Artificial Sequence
  Synthetic oligonucleotide; TTA chr11 5251116 5251137 5251133 5251138 +
gtttatcccctaagctatcagg

SEQ ID NO: 88900 - DNA, 22 bp, Artificial Sequence
  Synthetic oligonucleotide; TTT chr11 5251120 5251141 5251137 5251142 +
atcccctaagctatcaggttga

SEQ ID NO: 88901 - DNA, 22 bp, Artificial Sequence
  Synthetic oligonucleotide; TTA chr11 5251121 5251142 5251138 5251143 +
tcccctaagctatcaggttgat

SEQ ID NO: 88902 - DNA, 22 bp, Artificial Sequence
  Synthetic oligonucleotide; CTA chr11 5251128 5251149 5251145 5251150 +
agctatcaggttgattgaaatt

SEQ ID NO: 88903 - DNA, 22 bp, Artificial Sequence
  Synthetic oligonucleotide; CTA chr11 5251133 5251154 5251150 5251155 +
tcaggttgattgaaattattat

SEQ ID NO: 88904 - DNA, 22 bp, Artificial Sequence
  Synthetic oligonucleotide; TTG chr11 5251141 5251162 5251158 5251163 +
attgaaattattataatattgg

SEQ ID NO: 88905 - DNA, 22 bp, Artificial Sequence
  Synthetic oligonucleotide; TTG chr11 5251145 5251166 5251162 5251167 +
aaattattataatattggtgaa

SEQ ID NO: 88906 - DNA, 22 bp, Artificial Sequence
  Synthetic oligonucleotide; TTA chr11 5251151 5251172 5251168 5251173 +
ttataatattggtgaaattctt

SEQ ID NO: 88907 - DNA, 22 bp, Artificial Sequence
  Synthetic oligonucleotide; TTA chr11 5251154 5251175 5251171 5251176 +
taatattggtgaaattctttca

SEQ ID NO: 88908 - DNA, 22 bp, Artificial Sequence
  Synthetic oligonucleotide; TTG chr11 5251162 5251183 5251179 5251184 +
gtgaaattctttcatccttcat

SEQ ID NO: 88909 - DNA, 22 bp, Artificial Sequence
  Synthetic oligonucleotide; TTC chr11 5251171 5251192 5251188 5251193 +
tttcatccttcatgatcctgtg

SEQ ID NO: 88910 - DNA, 22 bp, Artificial Sequence
  Synthetic oligonucleotide; CTT chr11 5251173 5251194 5251190 5251195 +
tcatccttcatgatcctgtgta

SEQ ID NO: 88911 - DNA, 22 bp, Artificial Sequence
  Synthetic oligonucleotide; TTT chr11 5251174 5251195 5251191 5251196 +
catccttcatgatcctgtgtaa

SEQ ID NO: 88912 - DNA, 22 bp, Artificial Sequence
  Synthetic oligonucleotide; TTC chr11 5251175 5251196 5251192 5251197 +
atccttcatgatcctgtgtaaa

SEQ ID NO: 88913 - DNA, 22 bp, Artificial Sequence
  Synthetic oligonucleotide; CTT chr11 5251181 5251202 5251198 5251203 +
catgatcctgtgtaaagcttat

SEQ ID NO: 88914 - DNA, 22 bp, Artificial Sequence
  Synthetic oligonucleotide; TTC chr11 5251182 5251203 5251199 5251204 +
atgatcctgtgtaaagcttata

SEQ ID NO: 88915 - DNA, 22 bp, Artificial Sequence
  Synthetic oligonucleotide; CTG chr11 5251191 5251212 5251208 5251213 +
tgtaaagcttatatctgctcat

SEQ ID NO: 88916 - DNA, 22 bp, Artificial Sequence
  Synthetic oligonucleotide; CTT chr11 5251201 5251222 5251218 5251223 +
atatctgctcattgatacagat

SEQ ID NO: 88917 - DNA, 22 bp, Artificial Sequence
  Synthetic oligonucleotide; TTA chr11 5251202 5251223 5251219 5251224 +
tatctgctcattgatacagatg

SEQ ID NO: 88918 - DNA, 22 bp, Artificial Sequence
  Synthetic oligonucleotide; CTG chr11 5251208 5251229 5251225 5251230 +
ctcattgatacagatggctaaa

SEQ ID NO: 88919 - DNA, 22 bp, Artificial Sequence
  Synthetic oligonucleotide; CTC chr11 5251211 5251232 5251228 5251233 +
attgatacagatggctaaaagg

SEQ ID NO: 88920 - DNA, 22 bp, Artificial Sequence
  Synthetic oligonucleotide; TTG chr11 5251215 5251236 5251232 5251237 +
atacagatggctaaaaggccag

SEQ ID NO: 88921 - DNA, 22 bp, Artificial Sequence
  Synthetic oligonucleotide; CTA chr11 5251228 5251249 5251245 5251250 +
aaaggccagaaagacacacatt

SEQ ID NO: 88922 - DNA, 22 bp, Artificial Sequence
  Synthetic oligonucleotide; TTT chr11 5251251 5251272 5251268 5251273 +
acccatgtaacaagcctgcaca

SEQ ID NO: 88923 - DNA, 22 bp, Artificial Sequence
  Synthetic oligonucleotide; TTA chr11 5251252 5251273 5251269 5251274 +
cccatgtaacaagcctgcacat

SEQ ID NO: 88924 - DNA, 22 bp, Artificial Sequence
  Synthetic oligonucleotide; CTG chr11 5251269 5251290 5251286 5251291 +
cacatcctgcacatgtaccttc

SEQ ID NO: 88925 - DNA, 22 bp, Artificial Sequence
  Synthetic oligonucleotide; CTG chr11 5251278 5251299 5251295 5251300 +
cacatgtaccttcgaaattaaa

SEQ ID NO: 88926 - DNA, 22 bp, Artificial Sequence
  Synthetic oligonucleotide; CTT chr11 5251290 5251311 5251307 5251312 +
cgaaattaaaatgaaatgaaat

SEQ ID NO: 88927 - DNA, 22 bp, Artificial Sequence
  Synthetic oligonucleotide; TTC chr11 5251291 5251312 5251308 5251313 +
gaaattaaaatgaaatgaaata

SEQ ID NO: 88928 - DNA, 22 bp, Artificial Sequence
  Synthetic oligonucleotide; TTA chr11 5251298 5251319 5251315 5251320 +
aaatgaaatgaaataaaattaa

SEQ ID NO: 88929 - DNA, 22 bp, Artificial Sequence
  Synthetic oligonucleotide; TTA chr11 5251319 5251340 5251336 5251341 +
aaaggaaaaaaatgccatggca

SEQ ID NO: 88930 - DNA, 22 bp, Artificial Sequence
  Synthetic oligonucleotide; TTA chr11 5251355 5251376 5251372 5251377 +
tcttttatggtctaaaaatggg

SEQ ID NO: 88931 - DNA, 22 bp, Artificial Sequence
  Synthetic oligonucleotide; CTT chr11 5251359 5251380 5251376 5251381 +
ttatggtctaaaaatgggcagc

SEQ ID NO: 88932 - DNA, 22 bp, Artificial Sequence
  Synthetic oligonucleotide; TTT chr11 5251360 5251381 5251377 5251382 +
tatggtctaaaaatgggcagca

SEQ ID NO: 88933 - DNA, 22 bp, Artificial Sequence
  Synthetic oligonucleotide; TTT chr11 5251361 5251382 5251378 5251383 +
atggtctaaaaatgggcagcat

SEQ ID NO: 88934 - DNA, 22 bp, Artificial Sequence
  Synthetic oligonucleotide; TTA chr11 5251362 5251383 5251379 5251384 +
tggtctaaaaatgggcagcata

SEQ ID NO: 88935 - DNA, 22 bp, Artificial Sequence
  Synthetic oligonucleotide; CTA chr11 5251369 5251390 5251386 5251391 +
aaaatgggcagcataaataatc

SEQ ID NO: 88936 - DNA, 22 bp, Artificial Sequence
  Synthetic oligonucleotide; CTA chr11 5251393 5251414 5251410 5251415 +
ccccttgtttagcatactattg

SEQ ID NO: 88937 - DNA, 22 bp, Artificial Sequence
  Synthetic oligonucleotide; CTT chr11 5251399 5251420 5251416 5251421 +
gtttagcatactattgaaaaat

SEQ ID NO: 88938 - DNA, 22 bp, Artificial Sequence
  Synthetic oligonucleotide; TTG chr11 5251400 5251421 5251417 5251422 +
tttagcatactattgaaaaata

SEQ ID NO: 88939 - DNA, 22 bp, Artificial Sequence
  Synthetic oligonucleotide; TTT chr11 5251403 5251424 5251420 5251425 +
agcatactattgaaaaataaca

SEQ ID NO: 88940 - DNA, 22 bp, Artificial Sequence
  Synthetic oligonucleotide; TTA chr11 5251404 5251425 5251421 5251426 +
gcatactattgaaaaataacaa

SEQ ID NO: 88941 - DNA, 22 bp, Artificial Sequence
  Synthetic oligonucleotide; CTA chr11 5251412 5251433 5251429 5251434 +
ttgaaaaataacaataaaaatc

SEQ ID NO: 88942 - DNA, 22 bp, Artificial Sequence
  Synthetic oligonucleotide; TTG chr11 5251415 5251436 5251432 5251437 +
aaaaataacaataaaaatcggc

SEQ ID NO: 88943 - DNA, 22 bp, Artificial Sequence
  Synthetic oligonucleotide; CTT chr11 5251451 5251472 5251468 5251473 +
gcgtctactctgcctatgaagt

SEQ ID NO: 88944 - DNA, 22 bp, Artificial Sequence
  Synthetic oligonucleotide; TTG chr11 5251452 5251473 5251469 5251474 +
cgtctactctgcctatgaagta

SEQ ID NO: 88945 - DNA, 22 bp, Artificial Sequence
  Synthetic oligonucleotide; CTA chr11 5251458 5251479 5251475 5251480 +
ctctgcctatgaagtagccatt

SEQ ID NO: 88946 - DNA, 22 bp, Artificial Sequence
  Synthetic oligonucleotide; CTC chr11 5251461 5251482 5251478 5251483 +
tgcctatgaagtagccattcat

SEQ ID NO: 88947 - DNA, 22 bp, Artificial Sequence
  Synthetic oligonucleotide; CTG chr11 5251463 5251484 5251480 5251485 +
cctatgaagtagccattcattt

SEQ ID NO: 88948 - DNA, 22 bp, Artificial Sequence
  Synthetic oligonucleotide; CTA chr11 5251467 5251488 5251484 5251489 +
tgaagtagccattcatttattc

SEQ ID NO: 88949 - DNA, 22 bp, Artificial Sequence
  Synthetic oligonucleotide; TTC chr11 5251481 5251502 5251498 5251503 +
atttattccttcaattttttat

SEQ ID NO: 88950 - DNA, 22 bp, Artificial Sequence
  Synthetic oligonucleotide; TTT chr11 5251485 5251506 5251502 5251507 +
attccttcaattttttataaac

SEQ ID NO: 88951 - DNA, 22 bp, Artificial Sequence
  Synthetic oligonucleotide; TTA chr11 5251486 5251507 5251503 5251508 +
ttccttcaattttttataaact

SEQ ID NO: 88952 - DNA, 22 bp, Artificial Sequence
  Synthetic oligonucleotide; TTC chr11 5251489 5251510 5251506 5251511 +
cttcaattttttataaacttgt

SEQ ID NO: 88953 - DNA, 22 bp, Artificial Sequence
  Synthetic oligonucleotide; CTT chr11 5251492 5251513 5251509 5251514 +
caattttttataaacttgtttt

SEQ ID NO: 88954 - DNA, 22 bp, Artificial Sequence
  Synthetic oligonucleotide; TTC chr11 5251493 5251514 5251510 5251515 +
aattttttataaacttgtttta

SEQ ID NO: 88955 - DNA, 22 bp, Artificial Sequence
  Synthetic oligonucleotide; TTT chr11 5251498 5251519 5251515 5251520 +
tttataaacttgttttactaaa

SEQ ID NO: 88956 - DNA, 22 bp, Artificial Sequence
  Synthetic oligonucleotide; TTT chr11 5251499 5251520 5251516 5251521 +
ttataaacttgttttactaaaa

SEQ ID NO: 88957 - DNA, 22 bp, Artificial Sequence
  Synthetic oligonucleotide; TTT chr11 5251500 5251521 5251517 5251522 +
tataaacttgttttactaaaaa

SEQ ID NO: 88958 - DNA, 22 bp, Artificial Sequence
  Synthetic oligonucleotide; TTT chr11 5251501 5251522 5251518 5251523 +
ataaacttgttttactaaaaaa

SEQ ID NO: 88959 - DNA, 22 bp, Artificial Sequence
  Synthetic oligonucleotide; TTA chr11 5251502 5251523 5251519 5251524 +
taaacttgttttactaaaaaaa

SEQ ID NO: 88960 - DNA, 22 bp, Artificial Sequence
  Synthetic oligonucleotide; CTT chr11 5251509 5251530 5251526 5251531 +
gttttactaaaaaaaaaaagga

SEQ ID NO: 88961 - DNA, 22 bp, Artificial Sequence
  Synthetic oligonucleotide; TTG chr11 5251510 5251531 5251527 5251532 +
ttttactaaaaaaaaaaaggac

SEQ ID NO: 88962 - DNA, 22 bp, Artificial Sequence
  Synthetic oligonucleotide; TTT chr11 5251513 5251534 5251530 5251535 +
tactaaaaaaaaaaaggacaaa

SEQ ID NO: 88963 - DNA, 22 bp, Artificial Sequence
  Synthetic oligonucleotide; TTT chr11 5251514 5251535 5251531 5251536 +
actaaaaaaaaaaaggacaaag

SEQ ID NO: 88964 - DNA, 22 bp, Artificial Sequence
  Synthetic oligonucleotide; TTA chr11 5251515 5251536 5251532 5251537 +
ctaaaaaaaaaaaggacaaaga

SEQ ID NO: 88965 - DNA, 22 bp, Artificial Sequence
  Synthetic oligonucleotide; CTA chr11 5251518 5251539 5251535 5251540 +
aaaaaaaaaaggacaaagaaag

SEQ ID NO: 88966 - DNA, 22 bp, Artificial Sequence
  Synthetic oligonucleotide; TTG chr11 5251553 5251574 5251570 5251575 +
tgaaatggtagtgagtgatggc

SEQ ID NO: 88967 - DNA, 22 bp, Artificial Sequence
  Synthetic oligonucleotide; TTT chr11 5251579 5251600 5251596 5251601 +
gaagtgggtcctttatgatttg

SEQ ID NO: 88968 - DNA, 22 bp, Artificial Sequence
  Synthetic oligonucleotide; TTG chr11 5251580 5251601 5251597 5251602 +
aagtgggtcctttatgatttga

SEQ ID NO: 88969 - DNA, 22 bp, Artificial Sequence
  Synthetic oligonucleotide; CTT chr11 5251592 5251613 5251609 5251614 +
tatgatttgatggagccaggca

SEQ ID NO: 88970 - DNA, 22 bp, Artificial Sequence
  Synthetic oligonucleotide; TTT chr11 5251593 5251614 5251610 5251615 +
atgatttgatggagccaggcag

SEQ ID NO: 88971 - DNA, 22 bp, Artificial Sequence
  Synthetic oligonucleotide; TTA chr11 5251594 5251615 5251611 5251616 +
tgatttgatggagccaggcaga

SEQ ID NO: 88972 - DNA, 22 bp, Artificial Sequence
  Synthetic oligonucleotide; TTT chr11 5251600 5251621 5251617 5251622 +
gatggagccaggcagaagacgt

SEQ ID NO: 88973 - DNA, 22 bp, Artificial Sequence
  Synthetic oligonucleotide; TTG chr11 5251601 5251622 5251618 5251623 +
atggagccaggcagaagacgtt

SEQ ID NO: 88974 - DNA, 22 bp, Artificial Sequence
  Synthetic oligonucleotide; TTT chr11 5251624 5251645 5251641 5251646 +
ggagaaagaagttcctgaaagt

SEQ ID NO: 88975 - DNA, 22 bp, Artificial Sequence
  Synthetic oligonucleotide; TTG chr11 5251625 5251646 5251642 5251647 +
gagaaagaagttcctgaaagta

SEQ ID NO: 88976 - DNA, 22 bp, Artificial Sequence
  Synthetic oligonucleotide; TTC chr11 5251638 5251659 5251655 5251660 +
ctgaaagtaggaagggcatgtg

SEQ ID NO: 88977 - DNA, 22 bp, Artificial Sequence
  Synthetic oligonucleotide; CTG chr11 5251641 5251662 5251658 5251663 +
aaagtaggaagggcatgtggaa

SEQ ID NO: 88978 - DNA, 22 bp, Artificial Sequence
  Synthetic oligonucleotide; CTC chr11 5251668 5251689 5251685 5251690 +
tgaggctgaggaaaaaaaagaa

SEQ ID NO: 88979 - DNA, 22 bp, Artificial Sequence
  Synthetic oligonucleotide; CTG chr11 5251670 5251691 5251687 5251692 +
aggctgaggaaaaaaaagaaag

SEQ ID NO: 88980 - DNA, 22 bp, Artificial Sequence
  Synthetic oligonucleotide; CTG chr11 5251676 5251697 5251693 5251698 +
aggaaaaaaaagaaagaaagaa

SEQ ID NO: 88981 - DNA, 22 bp, Artificial Sequence
  Synthetic oligonucleotide; CTT chr11 5251715 5251736 5251732 5251737 +
gacatttcactgtatataaaca

SEQ ID NO: 88982 - DNA, 22 bp, Artificial Sequence
  Synthetic oligonucleotide; TTG chr11 5251716 5251737 5251733 5251738 +
acatttcactgtatataaacac

SEQ ID NO: 88983 - DNA, 22 bp, Artificial Sequence
  Synthetic oligonucleotide; TTT chr11 5251722 5251743 5251739 5251744 +
cactgtatataaacacattaca

SEQ ID NO: 88984 - DNA, 22 bp, Artificial Sequence
  Synthetic oligonucleotide; TTC chr11 5251723 5251744 5251740 5251745 +
actgtatataaacacattacaa

SEQ ID NO: 88985 - DNA, 22 bp, Artificial Sequence
  Synthetic oligonucleotide; CTG chr11 5251727 5251748 5251744 5251749 +
tatataaacacattacaagcct

SEQ ID NO: 88986 - DNA, 22 bp, Artificial Sequence
  Synthetic oligonucleotide; TTA chr11 5251742 5251763 5251759 5251764 +
caagcctaaagtacgttgaaga

SEQ ID NO: 88987 - DNA, 22 bp, Artificial Sequence
  Synthetic oligonucleotide; CTA chr11 5251750 5251771 5251767 5251772 +
aagtacgttgaagaaaaaatag

SEQ ID NO: 88988 - DNA, 22 bp, Artificial Sequence
  Synthetic oligonucleotide; TTG chr11 5251760 5251781 5251777 5251782 +
aagaaaaaatagaattcaaagt

SEQ ID NO: 88989 - DNA, 22 bp, Artificial Sequence
  Synthetic oligonucleotide; TTC chr11 5251777 5251798 5251794 5251799 +
aaagttagacagaagggctcag

SEQ ID NO: 88990 - DNA, 22 bp, Artificial Sequence
  Synthetic oligonucleotide; TTA chr11 5251784 5251805 5251801 5251806 +
gacagaagggctcaggcttact

SEQ ID NO: 88991 - DNA, 22 bp, Artificial Sequence
  Synthetic oligonucleotide; CTC chr11 5251797 5251818 5251814 5251819 +
aggcttactatttgcatcttac

SEQ ID NO: 88992 - DNA, 22 bp, Artificial Sequence
  Synthetic oligonucleotide; CTT chr11 5251803 5251824 5251820 5251825 +
actatttgcatcttacagatga

SEQ ID NO: 88993 - DNA, 22 bp, Artificial Sequence
  Synthetic oligonucleotide; TTA chr11 5251804 5251825 5251821 5251826 +
ctatttgcatcttacagatgag

SEQ ID NO: 88994 - DNA, 22 bp, Artificial Sequence
  Synthetic oligonucleotide; CTA chr11 5251807 5251828 5251824 5251829 +
tttgcatcttacagatgagagt

SEQ ID NO: 88995 - DNA, 22 bp, Artificial Sequence
  Synthetic oligonucleotide; TTT chr11 5251810 5251831 5251827 5251832 +
gcatcttacagatgagagtagt

SEQ ID NO: 88996 - DNA, 22 bp, Artificial Sequence
  Synthetic oligonucleotide; TTG chr11 5251811 5251832 5251828 5251833 +
catcttacagatgagagtagta

SEQ ID NO: 88997 - DNA, 22 bp, Artificial Sequence
  Synthetic oligonucleotide; CTT chr11 5251817 5251838 5251834 5251839 +
acagatgagagtagtagagttg

SEQ ID NO: 88998 - DNA, 22 bp, Artificial Sequence
  Synthetic oligonucleotide; TTA chr11 5251818 5251839 5251835 5251840 +
cagatgagagtagtagagttgg

SEQ ID NO: 88999 - DNA, 22 bp, Artificial Sequence
  Synthetic oligonucleotide; TTG chr11 5251839 5251860 5251856 5251861 +
gtattttattctgaaacacaga

SEQ ID NO: 89000 - DNA, 22 bp, Artificial Sequence
  Synthetic oligonucleotide; TTT chr11 5251845 5251866 5251862 5251867 +
tattctgaaacacagaggacaa

SEQ ID NO: 89001 - DNA, 22 bp, Artificial Sequence
  Synthetic oligonucleotide; TTT chr11 5251846 5251867 5251863 5251868 +
attctgaaacacagaggacaag

SEQ ID NO: 89002 - DNA, 22 bp, Artificial Sequence
  Synthetic oligonucleotide; TTA chr11 5251847 5251868 5251864 5251869 +
ttctgaaacacagaggacaagt

SEQ ID NO: 89003 - DNA, 22 bp, Artificial Sequence
  Synthetic oligonucleotide; TTC chr11 5251850 5251871 5251867 5251872 +
tgaaacacagaggacaagtgga

SEQ ID NO: 89004 - DNA, 22 bp, Artificial Sequence
  Synthetic oligonucleotide; CTG chr11 5251852 5251873 5251869 5251874 +
aaacacagaggacaagtggaga

SEQ ID NO: 89005 - DNA, 22 bp, Artificial Sequence
  Synthetic oligonucleotide; TTT chr11 5251877 5251898 5251894 5251899 +
gtaaacctgagataaacatggt

SEQ ID NO: 89006 - DNA, 22 bp, Artificial Sequence
  Synthetic oligonucleotide; TTG chr11 5251878 5251899 5251895 5251900 +
taaacctgagataaacatggtt

SEQ ID NO: 89007 - DNA, 22 bp, Artificial Sequence
  Synthetic oligonucleotide; CTG chr11 5251886 5251907 5251903 5251908 +
agataaacatggtttctaatcc

SEQ ID NO: 89008 - DNA, 22 bp, Artificial Sequence
  Synthetic oligonucleotide; TTT chr11 5251901 5251922 5251918 5251923 +
ctaatccactgaacaccgaagc

SEQ ID NO: 89009 - DNA, 22 bp, Artificial Sequence
  Synthetic oligonucleotide; TTC chr11 5251902 5251923 5251919 5251924 +
taatccactgaacaccgaagct

SEQ ID NO: 89010 - DNA, 22 bp, Artificial Sequence
  Synthetic oligonucleotide; CTA chr11 5251904 5251925 5251921 5251926 +
atccactgaacaccgaagctta

SEQ ID NO: 89011 - DNA, 22 bp, Artificial Sequence
  Synthetic oligonucleotide; CTG chr11 5251912 5251933 5251929 5251934 +
aacaccgaagcttatttttttc

SEQ ID NO: 89012 - DNA, 22 bp, Artificial Sequence
  Synthetic oligonucleotide; CTT chr11 5251925 5251946 5251942 5251947 +
atttttttctctttcttcatct

SEQ ID NO: 89013 - DNA, 22 bp, Artificial Sequence
  Synthetic oligonucleotide; TTA chr11 5251926 5251947 5251943 5251948 +
tttttttctctttcttcatctg

SEQ ID NO: 89014 - DNA, 22 bp, Artificial Sequence
  Synthetic oligonucleotide; TTT chr11 5251929 5251950 5251946 5251951 +
ttttctctttcttcatctgcct

SEQ ID NO: 89015 - DNA, 22 bp, Artificial Sequence
  Synthetic oligonucleotide; TTT chr11 5251930 5251951 5251947 5251952 +
tttctctttcttcatctgcctt

SEQ ID NO: 89016 - DNA, 22 bp, Artificial Sequence
  Synthetic oligonucleotide; TTT chr11 5251931 5251952 5251948 5251953 +
ttctctttcttcatctgcctta

SEQ ID NO: 89017 - DNA, 22 bp, Artificial Sequence
  Synthetic oligonucleotide; TTT chr11 5251932 5251953 5251949 5251954 +
tctctttcttcatctgccttac

SEQ ID NO: 89018 - DNA, 22 bp, Artificial Sequence
  Synthetic oligonucleotide; TTT chr11 5251933 5251954 5251950 5251955 +
ctctttcttcatctgccttact

SEQ ID NO: 89019 - DNA, 22 bp, Artificial Sequence
  Synthetic oligonucleotide; TTC chr11 5251934 5251955 5251951 5251956 +
tctttcttcatctgccttactt

SEQ ID NO: 89020 - DNA, 22 bp, Artificial Sequence
  Synthetic oligonucleotide; CTC chr11 5251936 5251957 5251953 5251958 +
tttcttcatctgccttacttag

SEQ ID NO: 89021 - DNA, 22 bp, Artificial Sequence
  Synthetic oligonucleotide; CTT chr11 5251938 5251959 5251955 5251960 +
tcttcatctgccttacttagtg

SEQ ID NO: 89022 - DNA, 22 bp, Artificial Sequence
  Synthetic oligonucleotide; TTT chr11 5251939 5251960 5251956 5251961 +
cttcatctgccttacttagtgc

SEQ ID NO: 89023 - DNA, 22 bp, Artificial Sequence
  Synthetic oligonucleotide; TTC chr11 5251940 5251961 5251957 5251962 +
ttcatctgccttacttagtgca

SEQ ID NO: 89024 - DNA, 22 bp, Artificial Sequence
  Synthetic oligonucleotide; CTT chr11 5251942 5251963 5251959 5251964 +
catctgccttacttagtgcaag

SEQ ID NO: 89025 - DNA, 22 bp, Artificial Sequence
  Synthetic oligonucleotide; TTC chr11 5251943 5251964 5251960 5251965 +
atctgccttacttagtgcaagg

SEQ ID NO: 89026 - DNA, 22 bp, Artificial Sequence
  Synthetic oligonucleotide; CTG chr11 5251948 5251969 5251965 5251970 +
ccttacttagtgcaaggtgcta

SEQ ID NO: 89027 - DNA, 22 bp, Artificial Sequence
  Synthetic oligonucleotide; CTT chr11 5251952 5251973 5251969 5251974 +
acttagtgcaaggtgctataac

SEQ ID NO: 89028 - DNA, 22 bp, Artificial Sequence
  Synthetic oligonucleotide; TTA chr11 5251953 5251974 5251970 5251975 +
cttagtgcaaggtgctataaca

SEQ ID NO: 89029 - DNA, 22 bp, Artificial Sequence
  Synthetic oligonucleotide; CTT chr11 5251956 5251977 5251973 5251978 +
agtgcaaggtgctataacaaaa

SEQ ID NO: 89030 - DNA, 22 bp, Artificial Sequence
  Synthetic oligonucleotide; TTA chr11 5251957 5251978 5251974 5251979 +
gtgcaaggtgctataacaaaat

SEQ ID NO: 89031 - DNA, 22 bp, Artificial Sequence
  Synthetic oligonucleotide; CTA chr11 5251970 5251991 5251987 5251992 +
taacaaaatagcatagactggg

SEQ ID NO: 89032 - DNA, 22 bp, Artificial Sequence
  Synthetic oligonucleotide; CTG chr11 5251990 5252011 5252007 5252012 +
ggtgacttcaacaacaggattt

SEQ ID NO: 89033 - DNA, 22 bp, Artificial Sequence
  Synthetic oligonucleotide; CTT chr11 5251998 5252019 5252015 5252020 +
caacaacaggattttttctcac

SEQ ID NO: 89034 - DNA, 22 bp, Artificial Sequence
  Synthetic oligonucleotide; TTC chr11 5251999 5252020 5252016 5252021 +
aacaacaggattttttctcact

SEQ ID NO: 89035 - DNA, 22 bp, Artificial Sequence
  Synthetic oligonucleotide; TTT chr11 5252012 5252033 5252029 5252034 +
tttctcacttttctgctggttc

SEQ ID NO: 89036 - DNA, 22 bp, Artificial Sequence
  Synthetic oligonucleotide; TTT chr11 5252013 5252034 5252030 5252035 +
ttctcacttttctgctggttcc

SEQ ID NO: 89037 - DNA, 22 bp, Artificial Sequence
  Synthetic oligonucleotide; TTT chr11 5252014 5252035 5252031 5252036 +
tctcacttttctgctggttcct

SEQ ID NO: 89038 - DNA, 22 bp, Artificial Sequence
  Synthetic oligonucleotide; TTT chr11 5252015 5252036 5252032 5252037 +
ctcacttttctgctggttcctg

SEQ ID NO: 89039 - DNA, 22 bp, Artificial Sequence
  Synthetic oligonucleotide; TTC chr11 5252016 5252037 5252033 5252038 +
tcacttttctgctggttcctgg

SEQ ID NO: 89040 - DNA, 22 bp, Artificial Sequence
  Synthetic oligonucleotide; CTC chr11 5252018 5252039 5252035 5252040 +
acttttctgctggttcctggtc

SEQ ID NO: 89041 - DNA, 22 bp, Artificial Sequence
  Synthetic oligonucleotide; CTT chr11 5252022 5252043 5252039 5252044 +
ttctgctggttcctggtcaggg

SEQ ID NO: 89042 - DNA, 22 bp, Artificial Sequence
  Synthetic oligonucleotide; TTT chr11 5252023 5252044 5252040 5252045 +
tctgctggttcctggtcagggc

SEQ ID NO: 89043 - DNA, 22 bp, Artificial Sequence
  Synthetic oligonucleotide; TTT chr11 5252024 5252045 5252041 5252046 +
ctgctggttcctggtcagggct

SEQ ID NO: 89044 - DNA, 22 bp, Artificial Sequence
  Synthetic oligonucleotide; TTC chr11 5252025 5252046 5252042 5252047 +
tgctggttcctggtcagggctc

SEQ ID NO: 89045 - DNA, 22 bp, Artificial Sequence
  Synthetic oligonucleotide; CTG chr11 5252027 5252048 5252044 5252049 +
ctggttcctggtcagggctctc

SEQ ID NO: 89046 - DNA, 22 bp, Artificial Sequence
  Synthetic oligonucleotide; CTG chr11 5252030 5252051 5252047 5252052 +
gttcctggtcagggctctcttc

SEQ ID NO: 89047 - DNA, 22 bp, Artificial Sequence
  Synthetic oligonucleotide; TTC chr11 5252034 5252055 5252051 5252056 +
ctggtcagggctctcttcctgg

SEQ ID NO: 89048 - DNA, 22 bp, Artificial Sequence
  Synthetic oligonucleotide; CTG chr11 5252037 5252058 5252054 5252059 +
gtcagggctctcttcctgggtt

SEQ ID NO: 89049 - DNA, 22 bp, Artificial Sequence
  Synthetic oligonucleotide; CTC chr11 5252047 5252068 5252064 5252069 +
tcttcctgggttgcaggtggct

SEQ ID NO: 89050 - DNA, 22 bp, Artificial Sequence
  Synthetic oligonucleotide; CTC chr11 5252049 5252070 5252066 5252071 +
ttcctgggttgcaggtggctga

SEQ ID NO: 89051 - DNA, 22 bp, Artificial Sequence
  Synthetic oligonucleotide; CTT chr11 5252051 5252072 5252068 5252073 +
cctgggttgcaggtggctgact

SEQ ID NO: 89052 - DNA, 22 bp, Artificial Sequence
  Synthetic oligonucleotide; TTC chr11 5252052 5252073 5252069 5252074 +
ctgggttgcaggtggctgactt

SEQ ID NO: 89053 - DNA, 22 bp, Artificial Sequence
  Synthetic oligonucleotide; CTG chr11 5252055 5252076 5252072 5252077 +
ggttgcaggtggctgacttccc

SEQ ID NO: 89054 - DNA, 22 bp, Artificial Sequence
  Synthetic oligonucleotide; TTG chr11 5252060 5252081 5252077 5252082 +
caggtggctgacttcccactgt

SEQ ID NO: 89055 - DNA, 22 bp, Artificial Sequence
  Synthetic oligonucleotide; CTG chr11 5252070 5252091 5252087 5252092 +
acttcccactgtgtcctcacca

SEQ ID NO: 89056 - DNA, 22 bp, Artificial Sequence
  Synthetic oligonucleotide; CTT chr11 5252074 5252095 5252091 5252096 +
cccactgtgtcctcaccagaag

SEQ ID NO: 89057 - DNA, 22 bp, Artificial Sequence
  Synthetic oligonucleotide; TTC chr11 5252075 5252096 5252092 5252097 +
ccactgtgtcctcaccagaagg

SEQ ID NO: 89058 - DNA, 22 bp, Artificial Sequence
  Synthetic oligonucleotide; CTG chr11 5252081 5252102 5252098 5252103 +
tgtcctcaccagaaggaagaga

SEQ ID NO: 89059 - DNA, 22 bp, Artificial Sequence
  Synthetic oligonucleotide; CTC chr11 5252088 5252109 5252105 5252110 +
accagaaggaagagaaatggct

SEQ ID NO: 89060 - DNA, 22 bp, Artificial Sequence
  Synthetic oligonucleotide; CTA chr11 5252111 5252132 5252128 5252133 +
atctctctgcttctgatgagga

SEQ ID NO: 89061 - DNA, 22 bp, Artificial Sequence
  Synthetic oligonucleotide; CTC chr11 5252116 5252137 5252133 5252138 +
tctgcttctgatgaggaaaata

SEQ ID NO: 89062 - DNA, 22 bp, Artificial Sequence
  Synthetic oligonucleotide; CTC chr11 5252118 5252139 5252135 5252140 +
tgcttctgatgaggaaaataat

SEQ ID NO: 89063 - DNA, 22 bp, Artificial Sequence
  Synthetic oligonucleotide; CTG chr11 5252120 5252141 5252137 5252142 +
cttctgatgaggaaaataattc

SEQ ID NO: 89064 - DNA, 22 bp, Artificial Sequence
  Synthetic oligonucleotide; CTT chr11 5252123 5252144 5252140 5252145 +
ctgatgaggaaaataattctat

SEQ ID NO: 89065 - DNA, 22 bp, Artificial Sequence
  Synthetic oligonucleotide; TTC chr11 5252124 5252145 5252141 5252146 +
tgatgaggaaaataattctatg

SEQ ID NO: 89066 - DNA, 22 bp, Artificial Sequence
  Synthetic oligonucleotide; CTG chr11 5252126 5252147 5252143 5252148 +
atgaggaaaataattctatgat

SEQ ID NO: 89067 - DNA, 22 bp, Artificial Sequence
  Synthetic oligonucleotide; TTC chr11 5252142 5252163 5252159 5252164 +
tatgatggggatctgctctcat

SEQ ID NO: 89068 - DNA, 22 bp, Artificial Sequence
  Synthetic oligonucleotide; CTA chr11 5252144 5252165 5252161 5252166 +
tgatggggatctgctctcatga

SEQ ID NO: 89069 - DNA, 22 bp, Artificial Sequence
  Synthetic oligonucleotide; CTG chr11 5252157 5252178 5252174 5252179 +
ctctcatgagctcctctaaacc

SEQ ID NO: 89070 - DNA, 22 bp, Artificial Sequence
  Synthetic oligonucleotide; CTC chr11 5252160 5252181 5252177 5252182 +
tcatgagctcctctaaacctga

SEQ ID NO: 89071 - DNA, 22 bp, Artificial Sequence
  Synthetic oligonucleotide; CTC chr11 5252162 5252183 5252179 5252184 +
atgagctcctctaaacctgatt

SEQ ID NO: 89072 - DNA, 22 bp, Artificial Sequence
  Synthetic oligonucleotide; CTC chr11 5252170 5252191 5252187 5252192 +
ctctaaacctgattacttttcc

SEQ ID NO: 89073 - DNA, 22 bp, Artificial Sequence
  Synthetic oligonucleotide; CTC chr11 5252173 5252194 5252190 5252195 +
taaacctgattacttttccaaa

SEQ ID NO: 89074 - DNA, 22 bp, Artificial Sequence
  Synthetic oligonucleotide; CTA chr11 5252175 5252196 5252192 5252197 +
aacctgattacttttccaaagc

SEQ ID NO: 89075 - DNA, 22 bp, Artificial Sequence
  Synthetic oligonucleotide; CTG chr11 5252181 5252202 5252198 5252203 +
attacttttccaaagcctcccc

SEQ ID NO: 89076 - DNA, 22 bp, Artificial Sequence
  Synthetic oligonucleotide; TTA chr11 5252185 5252206 5252202 5252207 +
cttttccaaagcctcccccaca

SEQ ID NO: 89077 - DNA, 22 bp, Artificial Sequence
  Synthetic oligonucleotide; CTT chr11 5252188 5252209 5252205 5252210 +
ttccaaagcctcccccacaaat

SEQ ID NO: 89078 - DNA, 22 bp, Artificial Sequence
  Synthetic oligonucleotide; TTT chr11 5252189 5252210 5252206 5252211 +
tccaaagcctcccccacaaatg

SEQ ID NO: 89079 - DNA, 22 bp, Artificial Sequence
  Synthetic oligonucleotide; TTT chr11 5252190 5252211 5252207 5252212 +
ccaaagcctcccccacaaatgg

SEQ ID NO: 89080 - DNA, 22 bp, Artificial Sequence
  Synthetic oligonucleotide; TTC chr11 5252191 5252212 5252208 5252213 +
caaagcctcccccacaaatgga

SEQ ID NO: 89081 - DNA, 22 bp, Artificial Sequence
  Synthetic oligonucleotide; CTC chr11 5252200 5252221 5252217 5252222 +
ccccacaaatggagccaattgg

SEQ ID NO: 89082 - DNA, 22 bp, Artificial Sequence
  Synthetic oligonucleotide; TTG chr11 5252221 5252242 5252238 5252243 +
ggagttggggattcagcatgtg

SEQ ID NO: 89083 - DNA, 22 bp, Artificial Sequence
  Synthetic oligonucleotide; TTG chr11 5252228 5252249 5252245 5252250 +
gggattcagcatgtgaattttc

SEQ ID NO: 89084 - DNA, 22 bp, Artificial Sequence
  Synthetic oligonucleotide; TTC chr11 5252235 5252256 5252252 5252257 +
agcatgtgaattttctggagac

SEQ ID NO: 89085 - DNA, 22 bp, Artificial Sequence
  Synthetic oligonucleotide; TTT chr11 5252248 5252269 5252265 5252270 +
tctggagacacaagcgttaagt

SEQ ID NO: 89086 - DNA, 22 bp, Artificial Sequence
  Synthetic oligonucleotide; TTT chr11 5252249 5252270 5252266 5252271 +
ctggagacacaagcgttaagtt

SEQ ID NO: 89087 - DNA, 22 bp, Artificial Sequence
  Synthetic oligonucleotide; TTC chr11 5252250 5252271 5252267 5252272 +
tggagacacaagcgttaagttc

SEQ ID NO: 89088 - DNA, 22 bp, Artificial Sequence
  Synthetic oligonucleotide; CTG chr11 5252252 5252273 5252269 5252274 +
gagacacaagcgttaagttcat

SEQ ID NO: 89089 - DNA, 22 bp, Artificial Sequence
  Synthetic oligonucleotide; TTA chr11 5252267 5252288 5252284 5252289 +
agttcataacaccatcacatta

SEQ ID NO: 89090 - DNA, 22 bp, Artificial Sequence
  Synthetic oligonucleotide; TTC chr11 5252272 5252293 5252289 5252294 +
ataacaccatcacattaaacta

SEQ ID NO: 89091 - DNA, 22 bp, Artificial Sequence
  Synthetic oligonucleotide; TTA chr11 5252289 5252310 5252306 5252311 +
aactaaactcttgcttattaac

SEQ ID NO: 89092 - DNA, 22 bp, Artificial Sequence
  Synthetic oligonucleotide; CTA chr11 5252294 5252315 5252311 5252316 +
aactcttgcttattaacgtgca

SEQ ID NO: 89093 - DNA, 22 bp, Artificial Sequence
  Synthetic oligonucleotide; CTC chr11 5252299 5252320 5252316 5252321 +
ttgcttattaacgtgcattaac

SEQ ID NO: 89094 - DNA, 22 bp, Artificial Sequence
  Synthetic oligonucleotide; CTT chr11 5252301 5252322 5252318 5252323 +
gcttattaacgtgcattaactt

SEQ ID NO: 89095 - DNA, 22 bp, Artificial Sequence
  Synthetic oligonucleotide; TTG chr11 5252302 5252323 5252319 5252324 +
cttattaacgtgcattaacttt

SEQ ID NO: 89096 - DNA, 22 bp, Artificial Sequence
  Synthetic oligonucleotide; CTT chr11 5252305 5252326 5252322 5252327 +
attaacgtgcattaactttcaa

SEQ ID NO: 89097 - DNA, 22 bp, Artificial Sequence
  Synthetic oligonucleotide; TTA chr11 5252306 5252327 5252323 5252328 +
ttaacgtgcattaactttcaat

SEQ ID NO: 89098 - DNA, 22 bp, Artificial Sequence
  Synthetic oligonucleotide; TTA chr11 5252309 5252330 5252326 5252331 +
acgtgcattaactttcaattat

SEQ ID NO: 89099 - DNA, 22 bp, Artificial Sequence
  Synthetic oligonucleotide; TTA chr11 5252319 5252340 5252336 5252341 +
actttcaattatataagaactc

SEQ ID NO: 89100 - DNA, 22 bp, Artificial Sequence
  Synthetic oligonucleotide; CTT chr11 5252323 5252344 5252340 5252345 +
tcaattatataagaactccagt

SEQ ID NO: 89101 - DNA, 22 bp, Artificial Sequence
  Synthetic oligonucleotide; TTT chr11 5252324 5252345 5252341 5252346 +
caattatataagaactccagtg

SEQ ID NO: 89102 - DNA, 22 bp, Artificial Sequence
  Synthetic oligonucleotide; TTC chr11 5252325 5252346 5252342 5252347 +
aattatataagaactccagtga

SEQ ID NO: 89103 - DNA, 22 bp, Artificial Sequence
  Synthetic oligonucleotide; TTA chr11 5252330 5252351 5252347 5252352 +
tataagaactccagtgaatctg

SEQ ID NO: 89104 - DNA, 22 bp, Artificial Sequence
  Synthetic oligonucleotide; CTC chr11 5252341 5252362 5252358 5252363 +
cagtgaatctgccttctcaatt

SEQ ID NO: 89105 - DNA, 22 bp, Artificial Sequence
  Synthetic oligonucleotide; CTG chr11 5252352 5252373 5252369 5252374 +
ccttctcaattaatgttataca

SEQ ID NO: 89106 - DNA, 22 bp, Artificial Sequence
  Synthetic oligonucleotide; CTT chr11 5252356 5252377 5252373 5252378 +
ctcaattaatgttatacaaatt

SEQ ID NO: 89107 - DNA, 22 bp, Artificial Sequence
  Synthetic oligonucleotide; TTC chr11 5252357 5252378 5252374 5252379 +
tcaattaatgttatacaaattc

SEQ ID NO: 89108 - DNA, 22 bp, Artificial Sequence
  Synthetic oligonucleotide; CTC chr11 5252359 5252380 5252376 5252381 +
aattaatgttatacaaattctt

SEQ ID NO: 89109 - DNA, 22 bp, Artificial Sequence
  Synthetic oligonucleotide; TTA chr11 5252364 5252385 5252381 5252386 +
atgttatacaaattcttcacac

SEQ ID NO: 89110 - DNA, 22 bp, Artificial Sequence
  Synthetic oligonucleotide; TTA chr11 5252370 5252391 5252387 5252392 +
tacaaattcttcacactatatt

SEQ ID NO: 89111 - DNA, 22 bp, Artificial Sequence
  Synthetic oligonucleotide; TTC chr11 5252379 5252400 5252396 5252401 +
ttcacactatattttcatctga

SEQ ID NO: 89112 - DNA, 22 bp, Artificial Sequence
  Synthetic oligonucleotide; CTT chr11 5252381 5252402 5252398 5252403 +
cacactatattttcatctgacc

SEQ ID NO: 89113 - DNA, 22 bp, Artificial Sequence
  Synthetic oligonucleotide; TTC chr11 5252382 5252403 5252399 5252404 +
acactatattttcatctgaccg

SEQ ID NO: 89114 - DNA, 22 bp, Artificial Sequence
  Synthetic oligonucleotide; CTA chr11 5252388 5252409 5252405 5252410 +
tattttcatctgaccgtgctgt

SEQ ID NO: 89115 - DNA, 22 bp, Artificial Sequence
  Synthetic oligonucleotide; TTT chr11 5252393 5252414 5252410 5252415 +
tcatctgaccgtgctgttctgc

SEQ ID NO: 89116 - DNA, 22 bp, Artificial Sequence
  Synthetic oligonucleotide; TTT chr11 5252394 5252415 5252411 5252416 +
catctgaccgtgctgttctgct

SEQ ID NO: 89117 - DNA, 22 bp, Artificial Sequence
  Synthetic oligonucleotide; TTC chr11 5252395 5252416 5252412 5252417 +
atctgaccgtgctgttctgctg

SEQ ID NO: 89118 - DNA, 22 bp, Artificial Sequence
  Synthetic oligonucleotide; CTG chr11 5252400 5252421 5252417 5252422 +
accgtgctgttctgctgctgag

SEQ ID NO: 89119 - DNA, 22 bp, Artificial Sequence
  Synthetic oligonucleotide; CTG chr11 5252409 5252430 5252426 5252431 +
ttctgctgctgagacatgacac

SEQ ID NO: 89120 - DNA, 22 bp, Artificial Sequence
  Synthetic oligonucleotide; TTC chr11 5252412 5252433 5252429 5252434 +
tgctgctgagacatgacacgct

SEQ ID NO: 89121 - DNA, 22 bp, Artificial Sequence
  Synthetic oligonucleotide; CTG chr11 5252414 5252435 5252431 5252436 +
ctgctgagacatgacacgctga

SEQ ID NO: 89122 - DNA, 22 bp, Artificial Sequence
  Synthetic oligonucleotide; CTG chr11 5252417 5252438 5252434 5252439 +
ctgagacatgacacgctgatgc

SEQ ID NO: 89123 - DNA, 22 bp, Artificial Sequence
  Synthetic oligonucleotide; CTG chr11 5252420 5252441 5252437 5252442 +
agacatgacacgctgatgctga

SEQ ID NO: 89124 - DNA, 22 bp, Artificial Sequence
  Synthetic oligonucleotide; CTG chr11 5252435 5252456 5252452 5252457 +
atgctgacttgtgagcttctgc

SEQ ID NO: 89125 - DNA, 22 bp, Artificial Sequence
  Synthetic oligonucleotide; CTG chr11 5252441 5252462 5252458 5252463 +
acttgtgagcttctgctggctc

SEQ ID NO: 89126 - DNA, 22 bp, Artificial Sequence
  Synthetic oligonucleotide; CTT chr11 5252445 5252466 5252462 5252467 +
gtgagcttctgctggctcattt

SEQ ID NO: 89127 - DNA, 22 bp, Artificial Sequence
  Synthetic oligonucleotide; TTG chr11 5252446 5252467 5252463 5252468 +
tgagcttctgctggctcatttc

SEQ ID NO: 89128 - DNA, 22 bp, Artificial Sequence
  Synthetic oligonucleotide; CTT chr11 5252453 5252474 5252470 5252475 +
ctgctggctcatttccttcacc

SEQ ID NO: 89129 - DNA, 22 bp, Artificial Sequence
  Synthetic oligonucleotide; TTC chr11 5252454 5252475 5252471 5252476 +
tgctggctcatttccttcacct

SEQ ID NO: 89130 - DNA, 22 bp, Artificial Sequence
  Synthetic oligonucleotide; CTG chr11 5252456 5252477 5252473 5252478 +
ctggctcatttccttcacctaa

SEQ ID NO: 89131 - DNA, 22 bp, Artificial Sequence
  Synthetic oligonucleotide; CTG chr11 5252459 5252480 5252476 5252481 +
gctcatttccttcacctaagtc

SEQ ID NO: 89132 - DNA, 22 bp, Artificial Sequence
  Synthetic oligonucleotide; CTC chr11 5252463 5252484 5252480 5252485 +
atttccttcacctaagtcccca

SEQ ID NO: 89133 - DNA, 22 bp, Artificial Sequence
  Synthetic oligonucleotide; TTT chr11 5252467 5252488 5252484 5252489 +
ccttcacctaagtccccacctc

SEQ ID NO: 89134 - DNA, 22 bp, Artificial Sequence
  Synthetic oligonucleotide; TTC chr11 5252468 5252489 5252485 5252490 +
cttcacctaagtccccacctcc

SEQ ID NO: 89135 - DNA, 22 bp, Artificial Sequence
  Synthetic oligonucleotide; CTT chr11 5252471 5252492 5252488 5252493 +
cacctaagtccccacctcccta

SEQ ID NO: 89136 - DNA, 22 bp, Artificial Sequence
  Synthetic oligonucleotide; TTC chr11 5252472 5252493 5252489 5252494 +
acctaagtccccacctccctag

SEQ ID NO: 89137 - DNA, 22 bp, Artificial Sequence
  Synthetic oligonucleotide; CTA chr11 5252477 5252498 5252494 5252499 +
agtccccacctccctagaagct

SEQ ID NO: 89138 - DNA, 22 bp, Artificial Sequence
  Synthetic oligonucleotide; CTC chr11 5252489 5252510 5252506 5252511 +
cctagaagcttacaatgaggtc

SEQ ID NO: 89139 - DNA, 22 bp, Artificial Sequence
  Synthetic oligonucleotide; CTA chr11 5252493 5252514 5252510 5252515 +
gaagcttacaatgaggtctcct

SEQ ID NO: 89140 - DNA, 22 bp, Artificial Sequence
  Synthetic oligonucleotide; CTT chr11 5252500 5252521 5252517 5252522 +
acaatgaggtctcctccttgaa

SEQ ID NO: 89141 - DNA, 22 bp, Artificial Sequence
  Synthetic oligonucleotide; TTA chr11 5252501 5252522 5252518 5252523 +
caatgaggtctcctccttgaaa

SEQ ID NO: 89142 - DNA, 22 bp, Artificial Sequence
  Synthetic oligonucleotide; CTC chr11 5252513 5252534 5252530 5252535 +
ctccttgaaatgctgtgaccag

SEQ ID NO: 89143 - DNA, 22 bp, Artificial Sequence
  Synthetic oligonucleotide; CTC chr11 5252516 5252537 5252533 5252538 +
cttgaaatgctgtgaccagtct

SEQ ID NO: 89144 - DNA, 22 bp, Artificial Sequence
  Synthetic oligonucleotide; CTT chr11 5252519 5252540 5252536 5252541 +
gaaatgctgtgaccagtctgta

SEQ ID NO: 89145 - DNA, 22 bp, Artificial Sequence
  Synthetic oligonucleotide; TTG chr11 5252520 5252541 5252537 5252542 +
aaatgctgtgaccagtctgtag

SEQ ID NO: 89146 - DNA, 22 bp, Artificial Sequence
  Synthetic oligonucleotide; CTG chr11 5252528 5252549 5252545 5252550 +
tgaccagtctgtagacttaagg

SEQ ID NO: 89147 - DNA, 22 bp, Artificial Sequence
  Synthetic oligonucleotide; CTG chr11 5252539 5252560 5252556 5252561 +
tagacttaagggtatgggatta

SEQ ID NO: 89148 - DNA, 22 bp, Artificial Sequence
  Synthetic oligonucleotide; CTT chr11 5252546 5252567 5252563 5252568 +
aagggtatgggattaatttcac

SEQ ID NO: 89149 - DNA, 22 bp, Artificial Sequence
  Synthetic oligonucleotide; TTA chr11 5252547 5252568 5252564 5252569 +
agggtatgggattaatttcacc

SEQ ID NO: 89150 - DNA, 22 bp, Artificial Sequence
  Synthetic oligonucleotide; TTA chr11 5252561 5252582 5252578 5252583 +
atttcacctctttaggcatgcg

SEQ ID NO: 89151 - DNA, 22 bp, Artificial Sequence
  Synthetic oligonucleotide; TTT chr11 5252565 5252586 5252582 5252587 +
cacctctttaggcatgcgtcaa

SEQ ID NO: 89152 - DNA, 22 bp, Artificial Sequence
  Synthetic oligonucleotide; TTC chr11 5252566 5252587 5252583 5252588 +
acctctttaggcatgcgtcaac

SEQ ID NO: 89153 - DNA, 22 bp, Artificial Sequence
  Synthetic oligonucleotide; CTC chr11 5252571 5252592 5252588 5252593 +
tttaggcatgcgtcaacactta

SEQ ID NO: 89154 - DNA, 22 bp, Artificial Sequence
  Synthetic oligonucleotide; CTT chr11 5252573 5252594 5252590 5252595 +
taggcatgcgtcaacacttaaa

SEQ ID NO: 89155 - DNA, 22 bp, Artificial Sequence
  Synthetic oligonucleotide; TTT chr11 5252574 5252595 5252591 5252596 +
aggcatgcgtcaacacttaaaa

SEQ ID NO: 89156 - DNA, 22 bp, Artificial Sequence
  Synthetic oligonucleotide; TTA chr11 5252575 5252596 5252592 5252597 +
ggcatgcgtcaacacttaaaat

SEQ ID NO: 89157 - DNA, 22 bp, Artificial Sequence
  Synthetic oligonucleotide; CTT chr11 5252592 5252613 5252609 5252614 +
aaaatgaaaagttccttagtaa

SEQ ID NO: 89158 - DNA, 22 bp, Artificial Sequence
  Synthetic oligonucleotide; TTA chr11 5252593 5252614 5252610 5252615 +
aaatgaaaagttccttagtaaa

SEQ ID NO: 89159 - DNA, 22 bp, Artificial Sequence
  Synthetic oligonucleotide; TTC chr11 5252606 5252627 5252623 5252628 +
cttagtaaagtaaggatcactt

SEQ ID NO: 89160 - DNA, 22 bp, Artificial Sequence
  Synthetic oligonucleotide; CTT chr11 5252609 5252630 5252626 5252631 +
agtaaagtaaggatcacttcat

SEQ ID NO: 89161 - DNA, 22 bp, Artificial Sequence
  Synthetic oligonucleotide; TTA chr11 5252610 5252631 5252627 5252632 +
gtaaagtaaggatcacttcatt

SEQ ID NO: 89162 - DNA, 22 bp, Artificial Sequence
  Synthetic oligonucleotide; CTT chr11 5252628 5252649 5252645 5252650 +
cattgtagttaccgtggaaaga

SEQ ID NO: 89163 - DNA, 22 bp, Artificial Sequence
  Synthetic oligonucleotide; TTC chr11 5252629 5252650 5252646 5252651 +
attgtagttaccgtggaaagaa

SEQ ID NO: 89164 - DNA, 22 bp, Artificial Sequence
  Synthetic oligonucleotide; TTG chr11 5252633 5252654 5252650 5252655 +
tagttaccgtggaaagaaaaac

SEQ ID NO: 89165 - DNA, 22 bp, Artificial Sequence
  Synthetic oligonucleotide; TTA chr11 5252639 5252660 5252656 5252661 +
ccgtggaaagaaaaacctgttt

SEQ ID NO: 89166 - DNA, 22 bp, Artificial Sequence
  Synthetic oligonucleotide; CTG chr11 5252658 5252679 5252675 5252680 +
tttcctgctctgatctctaaca

SEQ ID NO: 89167 - DNA, 22 bp, Artificial Sequence
  Synthetic oligonucleotide; TTT chr11 5252661 5252682 5252678 5252683 +
cctgctctgatctctaacacct

SEQ ID NO: 89168 - DNA, 22 bp, Artificial Sequence
  Synthetic oligonucleotide; TTC chr11 5252662 5252683 5252679 5252684 +
ctgctctgatctctaacacctc

SEQ ID NO: 89169 - DNA, 22 bp, Artificial Sequence
  Synthetic oligonucleotide; CTG chr11 5252665 5252686 5252682 5252687 +
ctctgatctctaacacctcaac

SEQ ID NO: 89170 - DNA, 22 bp, Artificial Sequence
  Synthetic oligonucleotide; CTC chr11 5252668 5252689 5252685 5252690 +
tgatctctaacacctcaacctc

SEQ ID NO: 89171 - DNA, 22 bp, Artificial Sequence
  Synthetic oligonucleotide; CTG chr11 5252670 5252691 5252687 5252692 +
atctctaacacctcaacctccc

SEQ ID NO: 89172 - DNA, 22 bp, Artificial Sequence
  Synthetic oligonucleotide; CTC chr11 5252675 5252696 5252692 5252697 +
taacacctcaacctccctgtag

SEQ ID NO: 89173 - DNA, 22 bp, Artificial Sequence
  Synthetic oligonucleotide; CTA chr11 5252677 5252698 5252694 5252699 +
acacctcaacctccctgtagag

SEQ ID NO: 89174 - DNA, 22 bp, Artificial Sequence
  Synthetic oligonucleotide; CTC chr11 5252684 5252705 5252701 5252706 +
aacctccctgtagagcctcaca

SEQ ID NO: 89175 - DNA, 22 bp, Artificial Sequence
  Synthetic oligonucleotide; CTC chr11 5252690 5252711 5252707 5252712 +
cctgtagagcctcacaagggct

SEQ ID NO: 89176 - DNA, 22 bp, Artificial Sequence
  Synthetic oligonucleotide; CTG chr11 5252694 5252715 5252711 5252716 +
tagagcctcacaagggctgaga

SEQ ID NO: 89177 - DNA, 22 bp, Artificial Sequence
  Synthetic oligonucleotide; CTC chr11 5252703 5252724 5252720 5252725 +
acaagggctgagaaaagccaga

SEQ ID NO: 89178 - DNA, 22 bp, Artificial Sequence
  Synthetic oligonucleotide; CTG chr11 5252713 5252734 5252730 5252735 +
agaaaagccagatgccgttgga

SEQ ID NO: 89179 - DNA, 22 bp, Artificial Sequence
  Synthetic oligonucleotide; TTG chr11 5252733 5252754 5252750 5252755 +
gaaatagtattgcccctaataa

SEQ ID NO: 89180 - DNA, 22 bp, Artificial Sequence
  Synthetic oligonucleotide; TTG chr11 5252745 5252766 5252762 5252767 +
cccctaataaaatagaatggct

SEQ ID NO: 89181 - DNA, 22 bp, Artificial Sequence
  Synthetic oligonucleotide; CTA chr11 5252751 5252772 5252768 5252773 +
ataaaatagaatggctatccct

SEQ ID NO: 89182 - DNA, 22 bp, Artificial Sequence
  Synthetic oligonucleotide; CTA chr11 5252768 5252789 5252785 5252790 +
tccctgcctaaaccttgacttc

SEQ ID NO: 89183 - DNA, 22 bp, Artificial Sequence
  Synthetic oligonucleotide; CTG chr11 5252774 5252795 5252791 5252796 +
cctaaaccttgacttcctaaag

SEQ ID NO: 89184 - DNA, 22 bp, Artificial Sequence
  Synthetic oligonucleotide; CTA chr11 5252778 5252799 5252795 5252800 +
aaccttgacttcctaaagcttg

SEQ ID NO: 89185 - DNA, 22 bp, Artificial Sequence
  Synthetic oligonucleotide; CTT chr11 5252784 5252805 5252801 5252806 +
gacttcctaaagcttggaacac

SEQ ID NO: 89186 - DNA, 22 bp, Artificial Sequence
  Synthetic oligonucleotide; TTG chr11 5252785 5252806 5252802 5252807 +
acttcctaaagcttggaacact

SEQ ID NO: 89187 - DNA, 22 bp, Artificial Sequence
  Synthetic oligonucleotide; CTT chr11 5252789 5252810 5252806 5252811 +
cctaaagcttggaacacttttt

SEQ ID NO: 89188 - DNA, 22 bp, Artificial Sequence
  Synthetic oligonucleotide; TTC chr11 5252790 5252811 5252807 5252812 +
ctaaagcttggaacactttttc

SEQ ID NO: 89189 - DNA, 22 bp, Artificial Sequence
  Synthetic oligonucleotide; CTA chr11 5252793 5252814 5252810 5252815 +
aagcttggaacactttttcttc

SEQ ID NO: 89190 - DNA, 22 bp, Artificial Sequence
  Synthetic oligonucleotide; CTT chr11 5252799 5252820 5252816 5252821 +
ggaacactttttcttcgttgag

SEQ ID NO: 89191 - DNA, 22 bp, Artificial Sequence
  Synthetic oligonucleotide; TTG chr11 5252800 5252821 5252817 5252822 +
gaacactttttcttcgttgagc

SEQ ID NO: 89192 - DNA, 22 bp, Artificial Sequence
  Synthetic oligonucleotide; CTT chr11 5252808 5252829 5252825 5252830 +
tttcttcgttgagccccttcct

SEQ ID NO: 89193 - DNA, 22 bp, Artificial Sequence
  Synthetic oligonucleotide; TTT chr11 5252809 5252830 5252826 5252831 +
ttcttcgttgagccccttcctc

SEQ ID NO: 89194 - DNA, 22 bp, Artificial Sequence
  Synthetic oligonucleotide; TTT chr11 5252810 5252831 5252827 5252832 +
tcttcgttgagccccttcctcg

SEQ ID NO: 89195 - DNA, 22 bp, Artificial Sequence
  Synthetic oligonucleotide; TTT chr11 5252811 5252832 5252828 5252833 +
cttcgttgagccccttcctcgc

SEQ ID NO: 89196 - DNA, 22 bp, Artificial Sequence
  Synthetic oligonucleotide; TTC chr11 5252812 5252833 5252829 5252834 +
ttcgttgagccccttcctcgct

SEQ ID NO: 89197 - DNA, 22 bp, Artificial Sequence
  Synthetic oligonucleotide; CTT chr11 5252814 5252835 5252831 5252836 +
cgttgagccccttcctcgctgc

SEQ ID NO: 89198 - DNA, 22 bp, Artificial Sequence
  Synthetic oligonucleotide; TTC chr11 5252815 5252836 5252832 5252837 +
gttgagccccttcctcgctgct

SEQ ID NO: 89199 - DNA, 22 bp, Artificial Sequence
  Synthetic oligonucleotide; TTG chr11 5252819 5252840 5252836 5252841 +
agccccttcctcgctgctgtgc

SEQ ID NO: 89200 - DNA, 22 bp, Artificial Sequence
  Synthetic oligonucleotide; CTT chr11 5252827 5252848 5252844 5252849 +
cctcgctgctgtgctgcaatcc

SEQ ID NO: 89201 - DNA, 22 bp, Artificial Sequence
  Synthetic oligonucleotide; TTC chr11 5252828 5252849 5252845 5252850 +
ctcgctgctgtgctgcaatcca

SEQ ID NO: 89202 - DNA, 22 bp, Artificial Sequence
  Synthetic oligonucleotide; CTC chr11 5252831 5252852 5252848 5252853 +
gctgctgtgctgcaatccaggg

SEQ ID NO: 89203 - DNA, 22 bp, Artificial Sequence
  Synthetic oligonucleotide; CTG chr11 5252835 5252856 5252852 5252857 +
ctgtgctgcaatccagggaagg

SEQ ID NO: 89204 - DNA, 22 bp, Artificial Sequence
  Synthetic oligonucleotide; CTG chr11 5252838 5252859 5252855 5252860 +
tgctgcaatccagggaaggggg

SEQ ID NO: 89205 - DNA, 22 bp, Artificial Sequence
  Synthetic oligonucleotide; CTG chr11 5252843 5252864 5252860 5252865 +
caatccagggaagggggttcag

SEQ ID NO: 89206 - DNA, 22 bp, Artificial Sequence
  Synthetic oligonucleotide; TTC chr11 5252863 5252884 5252880 5252885 +
agcccccttcactgaacctttc

SEQ ID NO: 89207 - DNA, 22 bp, Artificial Sequence
  Synthetic oligonucleotide; CTT chr11 5252872 5252893 5252889 5252894 +
cactgaacctttccccatctct

SEQ ID NO: 89208 - DNA, 22 bp, Artificial Sequence
  Synthetic oligonucleotide; TTC chr11 5252873 5252894 5252890 5252895 +
actgaacctttccccatctctt

SEQ ID NO: 89209 - DNA, 22 bp, Artificial Sequence
  Synthetic oligonucleotide; CTG chr11 5252877 5252898 5252894 5252899 +
aacctttccccatctcttccaa

SEQ ID NO: 89210 - DNA, 22 bp, Artificial Sequence
  Synthetic oligonucleotide; CTT chr11 5252883 5252904 5252900 5252905 +
tccccatctcttccaaaacatc

SEQ ID NO: 89211 - DNA, 22 bp, Artificial Sequence
  Synthetic oligonucleotide; TTT chr11 5252884 5252905 5252901 5252906 +
ccccatctcttccaaaacatct

SEQ ID NO: 89212 - DNA, 22 bp, Artificial Sequence
  Synthetic oligonucleotide; TTC chr11 5252885 5252906 5252902 5252907 +
cccatctcttccaaaacatctg

SEQ ID NO: 89213 - DNA, 22 bp, Artificial Sequence
  Synthetic oligonucleotide; CTC chr11 5252893 5252914 5252910 5252915 +
ttccaaaacatctgtttctgag

SEQ ID NO: 89214 - DNA, 22 bp, Artificial Sequence
  Synthetic oligonucleotide; CTT chr11 5252895 5252916 5252912 5252917 +
ccaaaacatctgtttctgagga

SEQ ID NO: 89215 - DNA, 22 bp, Artificial Sequence
  Synthetic oligonucleotide; TTC chr11 5252896 5252917 5252913 5252918 +
caaaacatctgtttctgaggag

SEQ ID NO: 89216 - DNA, 22 bp, Artificial Sequence
  Synthetic oligonucleotide; CTG chr11 5252907 5252928 5252924 5252929 +
tttctgaggagtcctgtcctat

SEQ ID NO: 89217 - DNA, 22 bp, Artificial Sequence
  Synthetic oligonucleotide; TTT chr11 5252910 5252931 5252927 5252932 +
ctgaggagtcctgtcctataga

SEQ ID NO: 89218 - DNA, 22 bp, Artificial Sequence
  Synthetic oligonucleotide; TTC chr11 5252911 5252932 5252928 5252933 +
tgaggagtcctgtcctatagag

SEQ ID NO: 89219 - DNA, 22 bp, Artificial Sequence
  Synthetic oligonucleotide; CTG chr11 5252913 5252934 5252930 5252935 +
aggagtcctgtcctatagaggt

SEQ ID NO: 89220 - DNA, 22 bp, Artificial Sequence
  Synthetic oligonucleotide; CTG chr11 5252923 5252944 5252940 5252945 +
tcctatagaggtctttcttcca

SEQ ID NO: 89221 - DNA, 22 bp, Artificial Sequence
  Synthetic oligonucleotide; CTA chr11 5252928 5252949 5252945 5252950 +
tagaggtctttcttccaaccag

SEQ ID NO: 89222 - DNA, 22 bp, Artificial Sequence
  Synthetic oligonucleotide; CTT chr11 5252938 5252959 5252955 5252960 +
tcttccaaccagatttctcctg

SEQ ID NO: 89223 - DNA, 22 bp, Artificial Sequence
  Synthetic oligonucleotide; TTT chr11 5252939 5252960 5252956 5252961 +
cttccaaccagatttctcctgc

SEQ ID NO: 89224 - DNA, 22 bp, Artificial Sequence
  Synthetic oligonucleotide; TTC chr11 5252940 5252961 5252957 5252962 +
ttccaaccagatttctcctgca

SEQ ID NO: 89225 - DNA, 22 bp, Artificial Sequence
  Synthetic oligonucleotide; CTT chr11 5252942 5252963 5252959 5252964 +
ccaaccagatttctcctgcacc

SEQ ID NO: 89226 - DNA, 22 bp, Artificial Sequence
  Synthetic oligonucleotide; TTC chr11 5252943 5252964 5252960 5252965 +
caaccagatttctcctgcacct

SEQ ID NO: 89227 - DNA, 22 bp, Artificial Sequence
  Synthetic oligonucleotide; TTT chr11 5252954 5252975 5252971 5252976 +
ctcctgcaccttttactcccac

SEQ ID NO: 89228 - DNA, 22 bp, Artificial Sequence
  Synthetic oligonucleotide; TTC chr11 5252955 5252976 5252972 5252977 +
tcctgcaccttttactcccact

SEQ ID NO: 89229 - DNA, 22 bp, Artificial Sequence
  Synthetic oligonucleotide; CTC chr11 5252957 5252978 5252974 5252979 +
ctgcaccttttactcccacttg

SEQ ID NO: 89230 - DNA, 22 bp, Artificial Sequence
  Synthetic oligonucleotide; CTG chr11 5252960 5252981 5252977 5252982 +
caccttttactcccacttgcag

SEQ ID NO: 89231 - DNA, 22 bp, Artificial Sequence
  Synthetic oligonucleotide; CTT chr11 5252966 5252987 5252983 5252988 +
ttactcccacttgcagaactcc

SEQ ID NO: 89232 - DNA, 22 bp, Artificial Sequence
  Synthetic oligonucleotide; TTT chr11 5252967 5252988 5252984 5252989 +
tactcccacttgcagaactccc

SEQ ID NO: 89233 - DNA, 22 bp, Artificial Sequence
  Synthetic oligonucleotide; TTT chr11 5252968 5252989 5252985 5252990 +
actcccacttgcagaactccca

SEQ ID NO: 89234 - DNA, 22 bp, Artificial Sequence
  Synthetic oligonucleotide; TTA chr11 5252969 5252990 5252986 5252991 +
ctcccacttgcagaactcccat

SEQ ID NO: 89235 - DNA, 22 bp, Artificial Sequence
  Synthetic oligonucleotide; CTC chr11 5252972 5252993 5252989 5252994 +
ccacttgcagaactcccatgta

SEQ ID NO: 89236 - DNA, 22 bp, Artificial Sequence
  Synthetic oligonucleotide; CTT chr11 5252978 5252999 5252995 5253000 +
gcagaactcccatgtacaagtt

SEQ ID NO: 89237 - DNA, 22 bp, Artificial Sequence
  Synthetic oligonucleotide; TTG chr11 5252979 5253000 5252996 5253001 +
cagaactcccatgtacaagttt

SEQ ID NO: 89238 - DNA, 22 bp, Artificial Sequence
  Synthetic oligonucleotide; CTC chr11 5252987 5253008 5253004 5253009 +
ccatgtacaagtttctttattg

SEQ ID NO: 89239 - DNA, 22 bp, Artificial Sequence
  Synthetic oligonucleotide; TTT chr11 5253001 5253022 5253018 5253023 +
ctttattgcctagttcttttat

SEQ ID NO: 89240 - DNA, 22 bp, Artificial Sequence
  Synthetic oligonucleotide; TTC chr11 5253002 5253023 5253019 5253024 +
tttattgcctagttcttttatt

SEQ ID NO: 89241 - DNA, 22 bp, Artificial Sequence
  Synthetic oligonucleotide; CTT chr11 5253004 5253025 5253021 5253026 +
tattgcctagttcttttatttg

SEQ ID NO: 89242 - DNA, 22 bp, Artificial Sequence
  Synthetic oligonucleotide; TTT chr11 5253005 5253026 5253022 5253027 +
attgcctagttcttttatttgc

SEQ ID NO: 89243 - DNA, 22 bp, Artificial Sequence
  Synthetic oligonucleotide; TTA chr11 5253006 5253027 5253023 5253028 +
ttgcctagttcttttatttgct

SEQ ID NO: 89244 - DNA, 22 bp, Artificial Sequence
  Synthetic oligonucleotide; TTG chr11 5253009 5253030 5253026 5253031 +
cctagttcttttatttgctcat

SEQ ID NO: 89245 - DNA, 22 bp, Artificial Sequence
  Synthetic oligonucleotide; CTA chr11 5253013 5253034 5253030 5253035 +
gttcttttatttgctcatcaaa

SEQ ID NO: 89246 - DNA, 22 bp, Artificial Sequence
  Synthetic oligonucleotide; TTC chr11 5253017 5253038 5253034 5253039 +
ttttatttgctcatcaaaaccc

SEQ ID NO: 89247 - DNA, 22 bp, Artificial Sequence
  Synthetic oligonucleotide; CTT chr11 5253019 5253040 5253036 5253041 +
ttatttgctcatcaaaacccac

SEQ ID NO: 89248 - DNA, 22 bp, Artificial Sequence
  Synthetic oligonucleotide; TTT chr11 5253020 5253041 5253037 5253042 +
tatttgctcatcaaaacccaca

SEQ ID NO: 89249 - DNA, 22 bp, Artificial Sequence
  Synthetic oligonucleotide; TTT chr11 5253021 5253042 5253038 5253043 +
atttgctcatcaaaacccacat

SEQ ID NO: 89250 - DNA, 22 bp, Artificial Sequence
  Synthetic oligonucleotide; TTA chr11 5253022 5253043 5253039 5253044 +
tttgctcatcaaaacccacatc

SEQ ID NO: 89251 - DNA, 22 bp, Artificial Sequence
  Synthetic oligonucleotide; TTT chr11 5253025 5253046 5253042 5253047 +
gctcatcaaaacccacatctaa

SEQ ID NO: 89252 - DNA, 22 bp, Artificial Sequence
  Synthetic oligonucleotide; TTG chr11 5253026 5253047 5253043 5253048 +
ctcatcaaaacccacatctaac

SEQ ID NO: 89253 - DNA, 22 bp, Artificial Sequence
  Synthetic oligonucleotide; CTC chr11 5253029 5253050 5253046 5253051 +
atcaaaacccacatctaacgta

SEQ ID NO: 89254 - DNA, 22 bp, Artificial Sequence
  Synthetic oligonucleotide; CTA chr11 5253046 5253067 5253063 5253068 +
acgtaaacaaaaaagtgtggag

SEQ ID NO: 89255 - DNA, 22 bp, Artificial Sequence
  Synthetic oligonucleotide; CTC chr11 5253125 5253146 5253142 5253147 +
aacataaaaccctttgtggctc

SEQ ID NO: 89256 - DNA, 22 bp, Artificial Sequence
  Synthetic oligonucleotide; CTT chr11 5253139 5253160 5253156 5253161 +
tgtggctcatatatttaaaaag

SEQ ID NO: 89257 - DNA, 22 bp, Artificial Sequence
  Synthetic oligonucleotide; TTT chr11 5253140 5253161 5253157 5253162 +
gtggctcatatatttaaaaaga

SEQ ID NO: 89258 - DNA, 22 bp, Artificial Sequence
  Synthetic oligonucleotide; TTG chr11 5253141 5253162 5253158 5253163 +
tggctcatatatttaaaaagac

SEQ ID NO: 89259 - DNA, 22 bp, Artificial Sequence
  Synthetic oligonucleotide; CTC chr11 5253147 5253168 5253164 5253169 +
atatatttaaaaagacataaaa

SEQ ID NO: 89260 - DNA, 22 bp, Artificial Sequence
  Synthetic oligonucleotide; TTT chr11 5253155 5253176 5253172 5253177 +
aaaaagacataaaaaaagaact

SEQ ID NO: 89261 - DNA, 22 bp, Artificial Sequence
  Synthetic oligonucleotide; TTA chr11 5253156 5253177 5253173 5253178 +
aaaagacataaaaaaagaactg

SEQ ID NO: 89262 - DNA, 22 bp, Artificial Sequence
  Synthetic oligonucleotide; CTG chr11 5253178 5253199 5253195 5253200 +
aagacaaccatgtgtgatctct

SEQ ID NO: 89263 - DNA, 22 bp, Artificial Sequence
  Synthetic oligonucleotide; CTC chr11 5253199 5253220 5253216 5253221 +
ttagcagaatagatttattatt

SEQ ID NO: 89264 - DNA, 22 bp, Artificial Sequence
  Synthetic oligonucleotide; CTT chr11 5253201 5253222 5253218 5253223 +
agcagaatagatttattatttg

SEQ ID NO: 89265 - DNA, 22 bp, Artificial Sequence
  Synthetic oligonucleotide; TTA chr11 5253202 5253223 5253219 5253224 +
gcagaatagatttattatttga

SEQ ID NO: 89266 - DNA, 22 bp, Artificial Sequence
  Synthetic oligonucleotide; TTT chr11 5253215 5253236 5253232 5253237 +
attatttgattgcttgcagaat

SEQ ID NO: 89267 - DNA, 22 bp, Artificial Sequence
  Synthetic oligonucleotide; TTA chr11 5253216 5253237 5253233 5253238 +
ttatttgattgcttgcagaata

SEQ ID NO: 89268 - DNA, 22 bp, Artificial Sequence
  Synthetic oligonucleotide; TTA chr11 5253219 5253240 5253236 5253241 +
tttgattgcttgcagaataaag

SEQ ID NO: 89269 - DNA, 22 bp, Artificial Sequence
  Synthetic oligonucleotide; TTT chr11 5253222 5253243 5253239 5253244 +
gattgcttgcagaataaagcct

SEQ ID NO: 89270 - DNA, 22 bp, Artificial Sequence
  Synthetic oligonucleotide; TTG chr11 5253223 5253244 5253240 5253245 +
attgcttgcagaataaagccta

SEQ ID NO: 89271 - DNA, 22 bp, Artificial Sequence
  Synthetic oligonucleotide; TTG chr11 5253227 5253248 5253244 5253249 +
cttgcagaataaagcctatcct

SEQ ID NO: 89272 - DNA, 22 bp, Artificial Sequence
  Synthetic oligonucleotide; CTT chr11 5253230 5253251 5253247 5253252 +
gcagaataaagcctatccttga

SEQ ID NO: 89273 - DNA, 22 bp, Artificial Sequence
  Synthetic oligonucleotide; TTG chr11 5253231 5253252 5253248 5253253 +
cagaataaagcctatccttgaa

SEQ ID NO: 89274 - DNA, 22 bp, Artificial Sequence
  Synthetic oligonucleotide; CTA chr11 5253245 5253266 5253262 5253267 +
tccttgaaagctctgcatcatg

SEQ ID NO: 89275 - DNA, 22 bp, Artificial Sequence
  Synthetic oligonucleotide; CTT chr11 5253250 5253271 5253267 5253272 +
gaaagctctgcatcatgggcag

SEQ ID NO: 89276 - DNA, 22 bp, Artificial Sequence
  Synthetic oligonucleotide; TTG chr11 5253251 5253272 5253268 5253273 +
aaagctctgcatcatgggcagt

SEQ ID NO: 89277 - DNA, 22 bp, Artificial Sequence
  Synthetic oligonucleotide; CTC chr11 5253258 5253279 5253275 5253280 +
tgcatcatgggcagtgagctca

SEQ ID NO: 89278 - DNA, 22 bp, Artificial Sequence
  Synthetic oligonucleotide; CTG chr11 5253260 5253281 5253277 5253282 +
catcatgggcagtgagctcagt

SEQ ID NO: 89279 - DNA, 22 bp, Artificial Sequence
  Synthetic oligonucleotide; CTC chr11 5253279 5253300 5253296 5253301 +
agtggtatctggaggacagggc

SEQ ID NO: 89280 - DNA, 22 bp, Artificial Sequence
  Synthetic oligonucleotide; CTG chr11 5253290 5253311 5253307 5253312 +
gaggacagggcactggccactc

SEQ ID NO: 89281 - DNA, 22 bp, Artificial Sequence
  Synthetic oligonucleotide; CTG chr11 5253305 5253326 5253322 5253327 +
gccactccagtcaccatcttct

SEQ ID NO: 89282 - DNA, 22 bp, Artificial Sequence
  Synthetic oligonucleotide; CTC chr11 5253312 5253333 5253329 5253334 +
cagtcaccatcttctgccagga

SEQ ID NO: 89283 - DNA, 22 bp, Artificial Sequence
  Synthetic oligonucleotide; CTT chr11 5253325 5253346 5253342 5253347 +
ctgccaggaagcctgcacctca

SEQ ID NO: 89284 - DNA, 22 bp, Artificial Sequence
  Synthetic oligonucleotide; TTC chr11 5253326 5253347 5253343 5253348 +
tgccaggaagcctgcacctcag

SEQ ID NO: 89285 - DNA, 22 bp, Artificial Sequence
  Synthetic oligonucleotide; CTG chr11 5253328 5253349 5253345 5253350 +
ccaggaagcctgcacctcaggg

SEQ ID NO: 89286 - DNA, 22 bp, Artificial Sequence
  Synthetic oligonucleotide; CTG chr11 5253340 5253361 5253357 5253362 +
cacctcaggggtgaattctttg

SEQ ID NO: 89287 - DNA, 22 bp, Artificial Sequence
  Synthetic oligonucleotide; CTC chr11 5253346 5253367 5253363 5253368 +
aggggtgaattctttgccgaaa

SEQ ID NO: 89288 - DNA, 22 bp, Artificial Sequence
  Synthetic oligonucleotide; TTC chr11 5253358 5253379 5253375 5253380 +
tttgccgaaatggattgccaaa

SEQ ID NO: 89289 - DNA, 22 bp, Artificial Sequence
  Synthetic oligonucleotide; CTT chr11 5253360 5253381 5253377 5253382 +
tgccgaaatggattgccaaaac

SEQ ID NO: 89290 - DNA, 22 bp, Artificial Sequence
  Synthetic oligonucleotide; TTT chr11 5253361 5253382 5253378 5253383 +
gccgaaatggattgccaaaacg

SEQ ID NO: 89291 - DNA, 22 bp, Artificial Sequence
  Synthetic oligonucleotide; TTG chr11 5253362 5253383 5253379 5253384 +
ccgaaatggattgccaaaacgg

SEQ ID NO: 89292 - DNA, 22 bp, Artificial Sequence
  Synthetic oligonucleotide; TTG chr11 5253375 5253396 5253392 5253397 +
ccaaaacggtcaccagcacatt

SEQ ID NO: 89293 - DNA, 22 bp, Artificial Sequence
  Synthetic oligonucleotide; TTT chr11 5253398 5253419 5253415 5253420 +
cccaggagctgttgagatgaaa

SEQ ID NO: 89294 - DNA, 22 bp, Artificial Sequence
  Synthetic oligonucleotide; TTC chr11 5253399 5253420 5253416 5253421 +
ccaggagctgttgagatgaaag

SEQ ID NO: 89295 - DNA, 22 bp, Artificial Sequence
  Synthetic oligonucleotide; CTG chr11 5253409 5253430 5253426 5253431 +
ttgagatgaaaggagacaataa

SEQ ID NO: 89296 - DNA, 22 bp, Artificial Sequence
  Synthetic oligonucleotide; TTG chr11 5253412 5253433 5253429 5253434 +
agatgaaaggagacaataaaga

SEQ ID NO: 89297 - DNA, 22 bp, Artificial Sequence
  Synthetic oligonucleotide; CTG chr11 5253452 5253473 5253469 5253474 +
agagctccagcctggcctccag

SEQ ID NO: 89298 - DNA, 22 bp, Artificial Sequence
  Synthetic oligonucleotide; CTC chr11 5253459 5253480 5253476 5253481 +
cagcctggcctccagataacta

SEQ ID NO: 89299 - DNA, 22 bp, Artificial Sequence
  Synthetic oligonucleotide; CTG chr11 5253466 5253487 5253483 5253488 +
gcctccagataactacacacca

SEQ ID NO: 89300 - DNA, 22 bp, Artificial Sequence
  Synthetic oligonucleotide; CTC chr11 5253471 5253492 5253488 5253493 +
cagataactacacaccaagctt

SEQ ID NO: 89301 - DNA, 22 bp, Artificial Sequence
  Synthetic oligonucleotide; CTA chr11 5253481 5253502 5253498 5253503 +
cacaccaagcttccacccagaa

SEQ ID NO: 89302 - DNA, 22 bp, Artificial Sequence
  Synthetic oligonucleotide; CTT chr11 5253493 5253514 5253510 5253515 +
ccacccagaatcaagcctatgt

SEQ ID NO: 89303 - DNA, 22 bp, Artificial Sequence
  Synthetic oligonucleotide; TTC chr11 5253494 5253515 5253511 5253516 +
cacccagaatcaagcctatgtt

SEQ ID NO: 89304 - DNA, 22 bp, Artificial Sequence
  Synthetic oligonucleotide; CTA chr11 5253512 5253533 5253529 5253534 +
tgttaacttccctcaaagcctg

SEQ ID NO: 89305 - DNA, 22 bp, Artificial Sequence
  Synthetic oligonucleotide; TTA chr11 5253517 5253538 5253534 5253539 +
acttccctcaaagcctgagatt

SEQ ID NO: 89306 - DNA, 22 bp, Artificial Sequence
  Synthetic oligonucleotide; CTT chr11 5253521 5253542 5253538 5253543 +
ccctcaaagcctgagattttgc

SEQ ID NO: 89307 - DNA, 22 bp, Artificial Sequence
  Synthetic oligonucleotide; TTC chr11 5253522 5253543 5253539 5253544 +
cctcaaagcctgagattttgct

SEQ ID NO: 89308 - DNA, 22 bp, Artificial Sequence
  Synthetic oligonucleotide; CTC chr11 5253526 5253547 5253543 5253548 +
aaagcctgagattttgctttcc

SEQ ID NO: 89309 - DNA, 22 bp, Artificial Sequence
  Synthetic oligonucleotide; CTG chr11 5253534 5253555 5253551 5253556 +
agattttgctttcccattaaat

SEQ ID NO: 89310 - DNA, 22 bp, Artificial Sequence
  Synthetic oligonucleotide; TTT chr11 5253540 5253561 5253557 5253562 +
tgctttcccattaaatgcaggt

SEQ ID NO: 89311 - DNA, 22 bp, Artificial Sequence
  Synthetic oligonucleotide; TTT chr11 5253541 5253562 5253558 5253563 +
gctttcccattaaatgcaggta

SEQ ID NO: 89312 - DNA, 22 bp, Artificial Sequence
  Synthetic oligonucleotide; TTG chr11 5253542 5253563 5253559 5253564 +
ctttcccattaaatgcaggtag

SEQ ID NO: 89313 - DNA, 22 bp, Artificial Sequence
  Synthetic oligonucleotide; CTT chr11 5253545 5253566 5253562 5253567 +
tcccattaaatgcaggtagttg

SEQ ID NO: 89314 - DNA, 22 bp, Artificial Sequence
  Synthetic oligonucleotide; TTT chr11 5253546 5253567 5253563 5253568 +
cccattaaatgcaggtagttgt

SEQ ID NO: 89315 - DNA, 22 bp, Artificial Sequence
  Synthetic oligonucleotide; TTC chr11 5253547 5253568 5253564 5253569 +
ccattaaatgcaggtagttgtt

SEQ ID NO: 89316 - DNA, 22 bp, Artificial Sequence
  Synthetic oligonucleotide; TTA chr11 5253553 5253574 5253570 5253575 +
aatgcaggtagttgttcttctt

SEQ ID NO: 89317 - DNA, 22 bp, Artificial Sequence
  Synthetic oligonucleotide; TTG chr11 5253567 5253588 5253584 5253589 +
ttcttcttgcagcactagtcac

SEQ ID NO: 89318 - DNA, 22 bp, Artificial Sequence
  Synthetic oligonucleotide; TTC chr11 5253570 5253591 5253587 5253592 +
ttcttgcagcactagtcactgg

SEQ ID NO: 89319 - DNA, 22 bp, Artificial Sequence
  Synthetic oligonucleotide; CTT chr11 5253572 5253593 5253589 5253594 +
cttgcagcactagtcactggcc

SEQ ID NO: 89320 - DNA, 22 bp, Artificial Sequence
  Synthetic oligonucleotide; TTC chr11 5253573 5253594 5253590 5253595 +
ttgcagcactagtcactggcca

SEQ ID NO: 89321 - DNA, 22 bp, Artificial Sequence
  Synthetic oligonucleotide; CTT chr11 5253575 5253596 5253592 5253597 +
gcagcactagtcactggccata

SEQ ID NO: 89322 - DNA, 22 bp, Artificial Sequence
  Synthetic oligonucleotide; TTG chr11 5253576 5253597 5253593 5253598 +
cagcactagtcactggccataa

SEQ ID NO: 89323 - DNA, 22 bp, Artificial Sequence
  Synthetic oligonucleotide; CTA chr11 5253584 5253605 5253601 5253606 +
gtcactggccataatttaaatc

SEQ ID NO: 89324 - DNA, 22 bp, Artificial Sequence
  Synthetic oligonucleotide; CTG chr11 5253591 5253612 5253608 5253613 +
gccataatttaaatcttgttat

SEQ ID NO: 89325 - DNA, 22 bp, Artificial Sequence
  Synthetic oligonucleotide; TTT chr11 5253601 5253622 5253618 5253623 +
aaatcttgttatcttcttgcca

SEQ ID NO: 89326 - DNA, 22 bp, Artificial Sequence
  Synthetic oligonucleotide; TTA chr11 5253602 5253623 5253619 5253624 +
aatcttgttatcttcttgccac

SEQ ID NO: 89327 - DNA, 22 bp, Artificial Sequence
  Synthetic oligonucleotide; CTT chr11 5253608 5253629 5253625 5253630 +
gttatcttcttgccaccatgaa

SEQ ID NO: 89328 - DNA, 22 bp, Artificial Sequence
  Synthetic oligonucleotide; TTG chr11 5253609 5253630 5253626 5253631 +
ttatcttcttgccaccatgaac

SEQ ID NO: 89329 - DNA, 22 bp, Artificial Sequence
  Synthetic oligonucleotide; TTA chr11 5253612 5253633 5253629 5253634 +
tcttcttgccaccatgaaccct

SEQ ID NO: 89330 - DNA, 22 bp, Artificial Sequence
  Synthetic oligonucleotide; CTT chr11 5253616 5253637 5253633 5253638 +
cttgccaccatgaaccctgtat

SEQ ID NO: 89331 - DNA, 22 bp, Artificial Sequence
  Synthetic oligonucleotide; TTC chr11 5253617 5253638 5253634 5253639 +
ttgccaccatgaaccctgtatg

SEQ ID NO: 89332 - DNA, 22 bp, Artificial Sequence
  Synthetic oligonucleotide; CTT chr11 5253619 5253640 5253636 5253641 +
gccaccatgaaccctgtatgct

SEQ ID NO: 89333 - DNA, 22 bp, Artificial Sequence
  Synthetic oligonucleotide; TTG chr11 5253620 5253641 5253637 5253642 +
ccaccatgaaccctgtatgctg

SEQ ID NO: 89334 - DNA, 22 bp, Artificial Sequence
  Synthetic oligonucleotide; CTG chr11 5253635 5253656 5253652 5253657 +
tatgctgtaggctgaaaacgtt

SEQ ID NO: 89335 - DNA, 22 bp, Artificial Sequence
  Synthetic oligonucleotide; CTG chr11 5253642 5253663 5253659 5253664 +
taggctgaaaacgttaaaagaa

SEQ ID NO: 89336 - DNA, 22 bp, Artificial Sequence
  Synthetic oligonucleotide; CTG chr11 5253649 5253670 5253666 5253671 +
aaaacgttaaaagaaacacacg

SEQ ID NO: 89337 - DNA, 22 bp, Artificial Sequence
  Synthetic oligonucleotide; TTA chr11 5253658 5253679 5253675 5253680 +
aaagaaacacacgctctcacac

SEQ ID NO: 89338 - DNA, 22 bp, Artificial Sequence
  Synthetic oligonucleotide; CTC chr11 5253674 5253695 5253691 5253696 +
tcacacacacacaaacacacgc

SEQ ID NO: 89339 - DNA, 22 bp, Artificial Sequence
  Synthetic oligonucleotide; CTC chr11 5253676 5253697 5253693 5253698 +
acacacacacaaacacacgcgc

SEQ ID NO: 89340 - DNA, 22 bp, Artificial Sequence
  Synthetic oligonucleotide; CTG chr11 5253727 5253748 5253744 5253749 +
actttcaaaatctactccagcc

SEQ ID NO: 89341 - DNA, 22 bp, Artificial Sequence
  Synthetic oligonucleotide; CTT chr11 5253731 5253752 5253748 5253753 +
tcaaaatctactccagcccaaa

SEQ ID NO: 89342 - DNA, 22 bp, Artificial Sequence
  Synthetic oligonucleotide; TTT chr11 5253732 5253753 5253749 5253754 +
caaaatctactccagcccaaat

SEQ ID NO: 89343 - DNA, 22 bp, Artificial Sequence
  Synthetic oligonucleotide; TTC chr11 5253733 5253754 5253750 5253755 +
aaaatctactccagcccaaatg

SEQ ID NO: 89344 - DNA, 22 bp, Artificial Sequence
  Synthetic oligonucleotide; CTA chr11 5253741 5253762 5253758 5253763 +
ctccagcccaaatgtttcaatt

SEQ ID NO: 89345 - DNA, 22 bp, Artificial Sequence
  Synthetic oligonucleotide; CTC chr11 5253744 5253765 5253761 5253766 +
cagcccaaatgtttcaattgtt

SEQ ID NO: 89346 - DNA, 22 bp, Artificial Sequence
  Synthetic oligonucleotide; TTT chr11 5253758 5253779 5253775 5253780 +
caattgttcctcacccctggac

SEQ ID NO: 89347 - DNA, 22 bp, Artificial Sequence
  Synthetic oligonucleotide; TTC chr11 5253759 5253780 5253776 5253781 +
aattgttcctcacccctggaca

SEQ ID NO: 89348 - DNA, 22 bp, Artificial Sequence
  Synthetic oligonucleotide; TTG chr11 5253764 5253785 5253781 5253786 +
ttcctcacccctggacatactt

SEQ ID NO: 89349 - DNA, 22 bp, Artificial Sequence
  Synthetic oligonucleotide; TTC chr11 5253767 5253788 5253784 5253789 +
ctcacccctggacatactttgc

SEQ ID NO: 89350 - DNA, 22 bp, Artificial Sequence
  Synthetic oligonucleotide; CTC chr11 5253770 5253791 5253787 5253792 +
acccctggacatactttgcccc

SEQ ID NO: 89351 - DNA, 22 bp, Artificial Sequence
  Synthetic oligonucleotide; CTG chr11 5253777 5253798 5253794 5253799 +
gacatactttgcccccatctgg

SEQ ID NO: 89352 - DNA, 22 bp, Artificial Sequence
  Synthetic oligonucleotide; CTT chr11 5253786 5253807 5253803 5253808 +
tgcccccatctggaattaaagg

SEQ ID NO: 89353 - DNA, 22 bp, Artificial Sequence
  Synthetic oligonucleotide; TTT chr11 5253787 5253808 5253804 5253809 +
gcccccatctggaattaaagga

SEQ ID NO: 89354 - DNA, 22 bp, Artificial Sequence
  Synthetic oligonucleotide; TTG chr11 5253788 5253809 5253805 5253810 +
cccccatctggaattaaaggat

SEQ ID NO: 89355 - DNA, 22 bp, Artificial Sequence
  Synthetic oligonucleotide; CTG chr11 5253798 5253819 5253815 5253820 +
gaattaaaggatataagtttgt

SEQ ID NO: 89356 - DNA, 22 bp, Artificial Sequence
  Synthetic oligonucleotide; TTA chr11 5253804 5253825 5253821 5253826 +
aaggatataagtttgtaatgaa

SEQ ID NO: 89357 - DNA, 22 bp, Artificial Sequence
  Synthetic oligonucleotide; TTT chr11 5253818 5253839 5253835 5253840 +
gtaatgaagcattagcagcatt

SEQ ID NO: 89358 - DNA, 22 bp, Artificial Sequence
  Synthetic oligonucleotide; TTG chr11 5253819 5253840 5253836 5253841 +
taatgaagcattagcagcattt

SEQ ID NO: 89359 - DNA, 22 bp, Artificial Sequence
  Synthetic oligonucleotide; TTA chr11 5253832 5253853 5253849 5253854 +
gcagcattttatatgtgtccag

SEQ ID NO: 89360 - DNA, 22 bp, Artificial Sequence
  Synthetic oligonucleotide; TTT chr11 5253841 5253862 5253858 5253863 +
tatatgtgtccagctgatatag

SEQ ID NO: 89361 - DNA, 22 bp, Artificial Sequence
  Synthetic oligonucleotide; TTT chr11 5253842 5253863 5253859 5253864 +
atatgtgtccagctgatatagg

SEQ ID NO: 89362 - DNA, 22 bp, Artificial Sequence
  Synthetic oligonucleotide; TTA chr11 5253843 5253864 5253860 5253865 +
tatgtgtccagctgatatagga

SEQ ID NO: 89363 - DNA, 22 bp, Artificial Sequence
  Synthetic oligonucleotide; CTG chr11 5253857 5253878 5253874 5253879 +
atataggaatagccttagcaat

SEQ ID NO: 89364 - DNA, 22 bp, Artificial Sequence
  Synthetic oligonucleotide; CTT chr11 5253873 5253894 5253890 5253895 +
agcaatgtatgtttggccacca

SEQ ID NO: 89365 - DNA, 22 bp, Artificial Sequence
  Synthetic oligonucleotide; TTA chr11 5253874 5253895 5253891 5253896 +
gcaatgtatgtttggccaccaa

SEQ ID NO: 89366 - DNA, 22 bp, Artificial Sequence
  Synthetic oligonucleotide; TTT chr11 5253887 5253908 5253904 5253909 +
ggccaccaaagttccccacttt

SEQ ID NO: 89367 - DNA, 22 bp, Artificial Sequence
  Synthetic oligonucleotide; TTG chr11 5253888 5253909 5253905 5253910 +
gccaccaaagttccccactttg

SEQ ID NO: 89368 - DNA, 22 bp, Artificial Sequence
  Synthetic oligonucleotide; TTC chr11 5253901 5253922 5253918 5253923 +
cccactttgactgagccaatat

SEQ ID NO: 89369 - DNA, 22 bp, Artificial Sequence
  Synthetic oligonucleotide; CTT chr11 5253908 5253929 5253925 5253930 +
tgactgagccaatatatgcctt

SEQ ID NO: 89370 - DNA, 22 bp, Artificial Sequence
  Synthetic oligonucleotide; TTT chr11 5253909 5253930 5253926 5253931 +
gactgagccaatatatgccttc

SEQ ID NO: 89371 - DNA, 22 bp, Artificial Sequence
  Synthetic oligonucleotide; TTG chr11 5253910 5253931 5253927 5253932 +
actgagccaatatatgccttct

SEQ ID NO: 89372 - DNA, 22 bp, Artificial Sequence
  Synthetic oligonucleotide; CTG chr11 5253914 5253935 5253931 5253936 +
agccaatatatgccttctgcct

SEQ ID NO: 89373 - DNA, 22 bp, Artificial Sequence
  Synthetic oligonucleotide; CTT chr11 5253930 5253951 5253947 5253952 +
ctgcctgcatctttttaatgac

SEQ ID NO: 89374 - DNA, 22 bp, Artificial Sequence
  Synthetic oligonucleotide; TTC chr11 5253931 5253952 5253948 5253953 +
tgcctgcatctttttaatgacc

SEQ ID NO: 89375 - DNA, 22 bp, Artificial Sequence
  Synthetic oligonucleotide; CTG chr11 5253933 5253954 5253950 5253955 +
cctgcatctttttaatgaccat

SEQ ID NO: 89376 - DNA, 22 bp, Artificial Sequence
  Synthetic oligonucleotide; CTG chr11 5253937 5253958 5253954 5253959 +
catctttttaatgaccatactt

SEQ ID NO: 89377 - DNA, 22 bp, Artificial Sequence
  Synthetic oligonucleotide; CTT chr11 5253943 5253964 5253960 5253965 +
tttaatgaccatacttgtcctg

SEQ ID NO: 89378 - DNA, 22 bp, Artificial Sequence
  Synthetic oligonucleotide; TTT chr11 5253944 5253965 5253961 5253966 +
ttaatgaccatacttgtcctgc

SEQ ID NO: 89379 - DNA, 22 bp, Artificial Sequence
  Synthetic oligonucleotide; TTT chr11 5253945 5253966 5253962 5253967 +
taatgaccatacttgtcctgcc

SEQ ID NO: 89380 - DNA, 22 bp, Artificial Sequence
  Synthetic oligonucleotide; TTT chr11 5253946 5253967 5253963 5253968 +
aatgaccatacttgtcctgcct

SEQ ID NO: 89381 - DNA, 22 bp, Artificial Sequence
  Synthetic oligonucleotide; TTA chr11 5253947 5253968 5253964 5253969 +
atgaccatacttgtcctgcctc

SEQ ID NO: 89382 - DNA, 22 bp, Artificial Sequence
  Synthetic oligonucleotide; CTT chr11 5253959 5253980 5253976 5253981 +
gtcctgcctccagatagatgtt

SEQ ID NO: 89383 - DNA, 22 bp, Artificial Sequence
  Synthetic oligonucleotide; TTG chr11 5253960 5253981 5253977 5253982 +
tcctgcctccagatagatgttt

SEQ ID NO: 89384 - DNA, 22 bp, Artificial Sequence
  Synthetic oligonucleotide; CTG chr11 5253965 5253986 5253982 5253987 +
cctccagatagatgttttaaaa

SEQ ID NO: 89385 - DNA, 22 bp, Artificial Sequence
  Synthetic oligonucleotide; CTC chr11 5253969 5253990 5253986 5253991 +
cagatagatgttttaaaacgaa

SEQ ID NO: 89386 - DNA, 22 bp, Artificial Sequence
  Synthetic oligonucleotide; TTT chr11 5253982 5254003 5253999 5254004 +
taaaacgaataacaaaaatagg

SEQ ID NO: 89387 - DNA, 22 bp, Artificial Sequence
  Synthetic oligonucleotide; TTT chr11 5253983 5254004 5254000 5254005 +
aaaacgaataacaaaaataggg

SEQ ID NO: 89388 - DNA, 22 bp, Artificial Sequence
  Synthetic oligonucleotide; TTA chr11 5253984 5254005 5254001 5254006 +
aaacgaataacaaaaatagggg

SEQ ID NO: 89389 - DNA, 22 bp, Artificial Sequence
  Synthetic oligonucleotide; TTC chr11 5254020 5254041 5254037 5254042 +
tttctaccgaaatctaataaag

SEQ ID NO: 89390 - DNA, 22 bp, Artificial Sequence
  Synthetic oligonucleotide; CTT chr11 5254022 5254043 5254039 5254044 +
tctaccgaaatctaataaagaa

SEQ ID NO: 89391 - DNA, 22 bp, Artificial Sequence
  Synthetic oligonucleotide; TTT chr11 5254023 5254044 5254040 5254045 +
ctaccgaaatctaataaagaaa

SEQ ID NO: 89392 - DNA, 22 bp, Artificial Sequence
  Synthetic oligonucleotide; TTC chr11 5254024 5254045 5254041 5254046 +
taccgaaatctaataaagaaaa

SEQ ID NO: 89393 - DNA, 22 bp, Artificial Sequence
  Synthetic oligonucleotide; CTA chr11 5254026 5254047 5254043 5254048 +
ccgaaatctaataaagaaaagt

SEQ ID NO: 89394 - DNA, 22 bp, Artificial Sequence
  Synthetic oligonucleotide; CTA chr11 5254036 5254057 5254053 5254058 +
ataaagaaaagtcattttcctc

SEQ ID NO: 89395 - DNA, 22 bp, Artificial Sequence
  Synthetic oligonucleotide; TTT chr11 5254053 5254074 5254070 5254075 +
tcctcatttccacctctctttt

SEQ ID NO: 89396 - DNA, 22 bp, Artificial Sequence
  Synthetic oligonucleotide; TTT chr11 5254054 5254075 5254071 5254076 +
cctcatttccacctctcttttc

SEQ ID NO: 89397 - DNA, 22 bp, Artificial Sequence
  Synthetic oligonucleotide; TTC chr11 5254055 5254076 5254072 5254077 +
ctcatttccacctctcttttct

SEQ ID NO: 89398 - DNA, 22 bp, Artificial Sequence
  Synthetic oligonucleotide; CTC chr11 5254058 5254079 5254075 5254080 +
atttccacctctcttttctcaa

SEQ ID NO: 89399 - DNA, 22 bp, Artificial Sequence
  Synthetic oligonucleotide; TTT chr11 5254062 5254083 5254079 5254084 +
ccacctctcttttctcaaagtc

SEQ ID NO: 89400 - DNA, 22 bp, Artificial Sequence
  Synthetic oligonucleotide; TTC chr11 5254063 5254084 5254080 5254085 +
cacctctcttttctcaaagtca

SEQ ID NO: 89401 - DNA, 22 bp, Artificial Sequence
  Synthetic oligonucleotide; CTC chr11 5254069 5254090 5254086 5254091 +
tcttttctcaaagtcaaagttg

SEQ ID NO: 89402 - DNA, 22 bp, Artificial Sequence
  Synthetic oligonucleotide; CTC chr11 5254071 5254092 5254088 5254093 +
ttttctcaaagtcaaagttgtc

SEQ ID NO: 89403 - DNA, 22 bp, Artificial Sequence
  Synthetic oligonucleotide; CTT chr11 5254073 5254094 5254090 5254095 +
ttctcaaagtcaaagttgtcca

SEQ ID NO: 89404 - DNA, 22 bp, Artificial Sequence
  Synthetic oligonucleotide; TTT chr11 5254074 5254095 5254091 5254096 +
tctcaaagtcaaagttgtccat

SEQ ID NO: 89405 - DNA, 22 bp, Artificial Sequence
  Synthetic oligonucleotide; TTT chr11 5254075 5254096 5254092 5254097 +
ctcaaagtcaaagttgtccatc

SEQ ID NO: 89406 - DNA, 22 bp, Artificial Sequence
  Synthetic oligonucleotide; TTC chr11 5254076 5254097 5254093 5254098 +
tcaaagtcaaagttgtccatct

SEQ ID NO: 89407 - DNA, 22 bp, Artificial Sequence
  Synthetic oligonucleotide; CTC chr11 5254078 5254099 5254095 5254100 +
aaagtcaaagttgtccatctag

SEQ ID NO: 89408 - DNA, 22 bp, Artificial Sequence
  Synthetic oligonucleotide; TTG chr11 5254091 5254112 5254108 5254113 +
tccatctagattttcagaggca

SEQ ID NO: 89409 - DNA, 22 bp, Artificial Sequence
  Synthetic oligonucleotide; CTA chr11 5254099 5254120 5254116 5254121 +
gattttcagaggcactccttag

SEQ ID NO: 89410 - DNA, 22 bp, Artificial Sequence
  Synthetic oligonucleotide; TTT chr11 5254104 5254125 5254121 5254126 +
tcagaggcactccttaggccct

SEQ ID NO: 89411 - DNA, 22 bp, Artificial Sequence
  Synthetic oligonucleotide; TTT chr11 5254105 5254126 5254122 5254127 +
cagaggcactccttaggcccta

SEQ ID NO: 89412 - DNA, 22 bp, Artificial Sequence
  Synthetic oligonucleotide; TTC chr11 5254106 5254127 5254123 5254128 +
agaggcactccttaggccctaa

SEQ ID NO: 89413 - DNA, 22 bp, Artificial Sequence
  Synthetic oligonucleotide; CTC chr11 5254116 5254137 5254133 5254138 +
cttaggccctaaaacattgcca

SEQ ID NO: 89414 - DNA, 22 bp, Artificial Sequence
  Synthetic oligonucleotide; CTT chr11 5254119 5254140 5254136 5254141 +
aggccctaaaacattgccactg

SEQ ID NO: 89415 - DNA, 22 bp, Artificial Sequence
  Synthetic oligonucleotide; TTA chr11 5254120 5254141 5254137 5254142 +
ggccctaaaacattgccactgg

SEQ ID NO: 89416 - DNA, 22 bp, Artificial Sequence
  Synthetic oligonucleotide; CTA chr11 5254127 5254148 5254144 5254149 +
aaacattgccactgggtctcag

SEQ ID NO: 89417 - DNA, 22 bp, Artificial Sequence
  Synthetic oligonucleotide; TTG chr11 5254135 5254156 5254152 5254157 +
ccactgggtctcagcccagtta

SEQ ID NO: 89418 - DNA, 22 bp, Artificial Sequence
  Synthetic oligonucleotide; CTG chr11 5254141 5254162 5254158 5254163 +
ggtctcagcccagttagtcctc

SEQ ID NO: 89419 - DNA, 22 bp, Artificial Sequence
  Synthetic oligonucleotide; CTC chr11 5254147 5254168 5254164 5254169 +
agcccagttagtcctctgcagt

SEQ ID NO: 89420 - DNA, 22 bp, Artificial Sequence
  Synthetic oligonucleotide; TTA chr11 5254157 5254178 5254174 5254179 +
gtcctctgcagtttcttcactc

SEQ ID NO: 89421 - DNA, 22 bp, Artificial Sequence
  Synthetic oligonucleotide; CTC chr11 5254163 5254184 5254180 5254185 +
tgcagtttcttcactcccaacc

SEQ ID NO: 89422 - DNA, 22 bp, Artificial Sequence
  Synthetic oligonucleotide; CTG chr11 5254165 5254186 5254182 5254187 +
cagtttcttcactcccaacccc

SEQ ID NO: 89423 - DNA, 22 bp, Artificial Sequence
  Synthetic oligonucleotide; TTT chr11 5254171 5254192 5254188 5254193 +
cttcactcccaaccccagtatc

SEQ ID NO: 89424 - DNA, 22 bp, Artificial Sequence
  Synthetic oligonucleotide; TTC chr11 5254172 5254193 5254189 5254194 +
ttcactcccaaccccagtatct

SEQ ID NO: 89425 - DNA, 22 bp, Artificial Sequence
  Synthetic oligonucleotide; CTT chr11 5254174 5254195 5254191 5254196 +
cactcccaaccccagtatcttc

SEQ ID NO: 89426 - DNA, 22 bp, Artificial Sequence
  Synthetic oligonucleotide; TTC chr11 5254175 5254196 5254192 5254197 +
actcccaaccccagtatcttca

SEQ ID NO: 89427 - DNA, 22 bp, Artificial Sequence
  Synthetic oligonucleotide; CTC chr11 5254179 5254200 5254196 5254201 +
ccaaccccagtatcttcaaaca

SEQ ID NO: 89428 - DNA, 22 bp, Artificial Sequence
  Synthetic oligonucleotide; CTT chr11 5254195 5254216 5254212 5254217 +
caaacagctcacaccctgctgt

SEQ ID NO: 89429 - DNA, 22 bp, Artificial Sequence
  Synthetic oligonucleotide; TTC chr11 5254196 5254217 5254213 5254218 +
aaacagctcacaccctgctgtg

SEQ ID NO: 89430 - DNA, 22 bp, Artificial Sequence
  Synthetic oligonucleotide; CTC chr11 5254205 5254226 5254222 5254227 +
acaccctgctgtgctcagatca

SEQ ID NO: 89431 - DNA, 22 bp, Artificial Sequence
  Synthetic oligonucleotide; CTG chr11 5254213 5254234 5254230 5254235 +
ctgtgctcagatcaatactcag

SEQ ID NO: 89432 - DNA, 22 bp, Artificial Sequence
  Synthetic oligonucleotide; CTG chr11 5254216 5254237 5254233 5254238 +
tgctcagatcaatactcagttg

SEQ ID NO: 89433 - DNA, 22 bp, Artificial Sequence
  Synthetic oligonucleotide; CTC chr11 5254221 5254242 5254238 5254243 +
agatcaatactcagttgtctaa

SEQ ID NO: 89434 - DNA, 22 bp, Artificial Sequence
  Synthetic oligonucleotide; CTC chr11 5254233 5254254 5254250 5254255 +
agttgtctaagttgcctcgaga

SEQ ID NO: 89435 - DNA, 22 bp, Artificial Sequence
  Synthetic oligonucleotide; TTG chr11 5254238 5254259 5254255 5254260 +
tctaagttgcctcgagactaaa

SEQ ID NO: 89436 - DNA, 22 bp, Artificial Sequence
  Synthetic oligonucleotide; CTA chr11 5254242 5254263 5254259 5254264 +
agttgcctcgagactaaaggca

SEQ ID NO: 89437 - DNA, 22 bp, Artificial Sequence
  Synthetic oligonucleotide; TTG chr11 5254247 5254268 5254264 5254269 +
cctcgagactaaaggcaacagt

SEQ ID NO: 89438 - DNA, 22 bp, Artificial Sequence
  Synthetic oligonucleotide; CTC chr11 5254251 5254272 5254268 5254273 +
gagactaaaggcaacagtgctg

SEQ ID NO: 89439 - DNA, 22 bp, Artificial Sequence
  Synthetic oligonucleotide; CTA chr11 5254258 5254279 5254275 5254280 +
aaggcaacagtgctgaaacatc

SEQ ID NO: 89440 - DNA, 22 bp, Artificial Sequence
  Synthetic oligonucleotide; CTG chr11 5254273 5254294 5254290 5254295 +
aaacatctcctggactcacctt

SEQ ID NO: 89441 - DNA, 22 bp, Artificial Sequence
  Synthetic oligonucleotide; CTC chr11 5254282 5254303 5254299 5254304 +
ctggactcaccttgaagttctc

SEQ ID NO: 89442 - DNA, 22 bp, Artificial Sequence
  Synthetic oligonucleotide; CTG chr11 5254285 5254306 5254302 5254307 +
gactcaccttgaagttctcagg

SEQ ID NO: 89443 - DNA, 22 bp, Artificial Sequence
  Synthetic oligonucleotide; CTC chr11 5254290 5254311 5254307 5254312 +
accttgaagttctcaggatcca

SEQ ID NO: 89444 - DNA, 22 bp, Artificial Sequence
  Synthetic oligonucleotide; CTT chr11 5254295 5254316 5254312 5254317 +
gaagttctcaggatccacatgc

SEQ ID NO: 89445 - DNA, 22 bp, Artificial Sequence
  Synthetic oligonucleotide; TTG chr11 5254296 5254317 5254313 5254318 +
aagttctcaggatccacatgca

SEQ ID NO: 89446 - DNA, 22 bp, Artificial Sequence
  Synthetic oligonucleotide; TTC chr11 5254302 5254323 5254319 5254324 +
tcaggatccacatgcagcttgt

SEQ ID NO: 89447 - DNA, 22 bp, Artificial Sequence
  Synthetic oligonucleotide; CTC chr11 5254304 5254325 5254321 5254326 +
aggatccacatgcagcttgtca

SEQ ID NO: 89448 - DNA, 22 bp, Artificial Sequence
  Synthetic oligonucleotide; CTT chr11 5254322 5254343 5254339 5254344 +
gtcacagtgcagttcactcagc

SEQ ID NO: 89449 - DNA, 22 bp, Artificial Sequence
  Synthetic oligonucleotide; TTG chr11 5254323 5254344 5254340 5254345 +
tcacagtgcagttcactcagct

SEQ ID NO: 89450 - DNA, 22 bp, Artificial Sequence
  Synthetic oligonucleotide; TTC chr11 5254337 5254358 5254354 5254359 +
actcagctgggcaaaggtgccc

SEQ ID NO: 89451 - DNA, 22 bp, Artificial Sequence
  Synthetic oligonucleotide; CTC chr11 5254341 5254362 5254358 5254363 +
agctgggcaaaggtgcccttga

SEQ ID NO: 89452 - DNA, 22 bp, Artificial Sequence
  Synthetic oligonucleotide; CTG chr11 5254346 5254367 5254363 5254368 +
ggcaaaggtgcccttgagatca

SEQ ID NO: 89453 - DNA, 22 bp, Artificial Sequence
  Synthetic oligonucleotide; CTT chr11 5254361 5254382 5254378 5254383 +
gagatcatccaggtgctttatg

SEQ ID NO: 89454 - DNA, 22 bp, Artificial Sequence
  Synthetic oligonucleotide; TTG chr11 5254362 5254383 5254379 5254384 +
agatcatccaggtgctttatgg

SEQ ID NO: 89455 - DNA, 22 bp, Artificial Sequence
  Synthetic oligonucleotide; CTT chr11 5254379 5254400 5254396 5254401 +
tatggcatctcccaaggaagtc

SEQ ID NO: 89456 - DNA, 22 bp, Artificial Sequence
  Synthetic oligonucleotide; TTT chr11 5254380 5254401 5254397 5254402 +
atggcatctcccaaggaagtca

SEQ ID NO: 89457 - DNA, 22 bp, Artificial Sequence
  Synthetic oligonucleotide; TTA chr11 5254381 5254402 5254398 5254403 +
tggcatctcccaaggaagtcag

SEQ ID NO: 89458 - DNA, 22 bp, Artificial Sequence
  Synthetic oligonucleotide; CTC chr11 5254390 5254411 5254407 5254412 +
ccaaggaagtcagcaccttctt

SEQ ID NO: 89459 - DNA, 22 bp, Artificial Sequence
  Synthetic oligonucleotide; CTT chr11 5254409 5254430 5254426 5254431 +
cttgccatgtgccttgactttg

SEQ ID NO: 89460 - DNA, 22 bp, Artificial Sequence
  Synthetic oligonucleotide; TTC chr11 5254410 5254431 5254427 5254432 +
ttgccatgtgccttgactttgg

SEQ ID NO: 89461 - DNA, 22 bp, Artificial Sequence
  Synthetic oligonucleotide; CTT chr11 5254412 5254433 5254429 5254434 +
gccatgtgccttgactttgggg

SEQ ID NO: 89462 - DNA, 22 bp, Artificial Sequence
  Synthetic oligonucleotide; TTG chr11 5254413 5254434 5254430 5254435 +
ccatgtgccttgactttggggt

SEQ ID NO: 89463 - DNA, 22 bp, Artificial Sequence
  Synthetic oligonucleotide; CTT chr11 5254424 5254445 5254441 5254446 +
gactttggggttgcccatgatg

SEQ ID NO: 89464 - DNA, 22 bp, Artificial Sequence
  Synthetic oligonucleotide; TTG chr11 5254425 5254446 5254442 5254447 +
actttggggttgcccatgatgg

SEQ ID NO: 89465 - DNA, 22 bp, Artificial Sequence
  Synthetic oligonucleotide; CTT chr11 5254429 5254450 5254446 5254451 +
tggggttgcccatgatggcaga

SEQ ID NO: 89466 - DNA, 22 bp, Artificial Sequence
  Synthetic oligonucleotide; TTT chr11 5254430 5254451 5254447 5254452 +
ggggttgcccatgatggcagag

SEQ ID NO: 89467 - DNA, 22 bp, Artificial Sequence
  Synthetic oligonucleotide; TTG chr11 5254431 5254452 5254448 5254453 +
gggttgcccatgatggcagagg

SEQ ID NO: 89468 - DNA, 22 bp, Artificial Sequence
  Synthetic oligonucleotide; TTG chr11 5254437 5254458 5254454 5254459 +
cccatgatggcagaggcagagg

SEQ ID NO: 89469 - DNA, 22 bp, Artificial Sequence
  Synthetic oligonucleotide; TTG chr11 5254467 5254488 5254484 5254489 +
ccaaagctgtcaaagaacctct

SEQ ID NO: 89470 - DNA, 22 bp, Artificial Sequence
  Synthetic oligonucleotide; CTG chr11 5254476 5254497 5254493 5254498 +
tcaaagaacctctgggtccatg

SEQ ID NO: 89471 - DNA, 22 bp, Artificial Sequence
  Synthetic oligonucleotide; CTC chr11 5254488 5254509 5254505 5254510 +
tgggtccatgggtagacaacca

SEQ ID NO: 89472 - DNA, 22 bp, Artificial Sequence
  Synthetic oligonucleotide; CTG chr11 5254490 5254511 5254507 5254512 +
ggtccatgggtagacaaccagg

SEQ ID NO: 89473 - DNA, 22 bp, Artificial Sequence
  Synthetic oligonucleotide; CTG chr11 5254518 5254539 5254535 5254540 +
tgagattgacaagaacagtttg

SEQ ID NO: 89474 - DNA, 22 bp, Artificial Sequence
  Synthetic oligonucleotide; TTG chr11 5254526 5254547 5254543 5254548 +
acaagaacagtttgacagtcag

SEQ ID NO: 89475 - DNA, 22 bp, Artificial Sequence
  Synthetic oligonucleotide; TTT chr11 5254539 5254560 5254556 5254561 +
gacagtcagaaggtgccacaaa

SEQ ID NO: 89476 - DNA, 22 bp, Artificial Sequence
  Synthetic oligonucleotide; TTG chr11 5254540 5254561 5254557 5254562 +
acagtcagaaggtgccacaaat

SEQ ID NO: 89477 - DNA, 22 bp, Artificial Sequence
  Synthetic oligonucleotide; CTG chr11 5254566 5254587 5254583 5254588 +
agaagcgacctggacttttgcc

SEQ ID NO: 89478 - DNA, 22 bp, Artificial Sequence
  Synthetic oligonucleotide; CTG chr11 5254578 5254599 5254595 5254600 +
gacttttgccaggcacagggtc

SEQ ID NO: 89479 - DNA, 22 bp, Artificial Sequence
  Synthetic oligonucleotide; CTT chr11 5254583 5254604 5254600 5254605 +
ttgccaggcacagggtccttcc

SEQ ID NO: 89480 - DNA, 22 bp, Artificial Sequence
  Synthetic oligonucleotide; TTT chr11 5254584 5254605 5254601 5254606 +
tgccaggcacagggtccttcct

SEQ ID NO: 89481 - DNA, 22 bp, Artificial Sequence
  Synthetic oligonucleotide; TTT chr11 5254585 5254606 5254602 5254607 +
gccaggcacagggtccttcctt

SEQ ID NO: 89482 - DNA, 22 bp, Artificial Sequence
  Synthetic oligonucleotide; TTG chr11 5254586 5254607 5254603 5254608 +
ccaggcacagggtccttccttc

SEQ ID NO: 89483 - DNA, 22 bp, Artificial Sequence
  Synthetic oligonucleotide; CTT chr11 5254603 5254624 5254620 5254625 +
ccttccctcccttgtcctggtc

SEQ ID NO: 89484 - DNA, 22 bp, Artificial Sequence
  Synthetic oligonucleotide; TTC chr11 5254604 5254625 5254621 5254626 +
cttccctcccttgtcctggtca

SEQ ID NO: 89485 - DNA, 22 bp, Artificial Sequence
  Synthetic oligonucleotide; CTT chr11 5254607 5254628 5254624 5254629 +
ccctcccttgtcctggtcacca

SEQ ID NO: 89486 - DNA, 22 bp, Artificial Sequence
  Synthetic oligonucleotide; TTC chr11 5254608 5254629 5254625 5254630 +
cctcccttgtcctggtcaccag

SEQ ID NO: 89487 - DNA, 22 bp, Artificial Sequence
  Synthetic oligonucleotide; CTC chr11 5254612 5254633 5254629 5254634 +
ccttgtcctggtcaccagagcc

SEQ ID NO: 89488 - DNA, 22 bp, Artificial Sequence
  Synthetic oligonucleotide; CTT chr11 5254616 5254637 5254633 5254638 +
gtcctggtcaccagagcctacc

SEQ ID NO: 89489 - DNA, 22 bp, Artificial Sequence
  Synthetic oligonucleotide; TTG chr11 5254617 5254638 5254634 5254639 +
tcctggtcaccagagcctacct

SEQ ID NO: 89490 - DNA, 22 bp, Artificial Sequence
  Synthetic oligonucleotide; CTG chr11 5254622 5254643 5254639 5254644 +
gtcaccagagcctaccttccca

SEQ ID NO: 89491 - DNA, 22 bp, Artificial Sequence
  Synthetic oligonucleotide; CTA chr11 5254636 5254657 5254653 5254658 +
ccttcccagggtttctcctcca

SEQ ID NO: 89492 - DNA, 22 bp, Artificial Sequence
  Synthetic oligonucleotide; CTT chr11 5254640 5254661 5254657 5254662 +
cccagggtttctcctccagcat

SEQ ID NO: 89493 - DNA, 22 bp, Artificial Sequence
  Synthetic oligonucleotide; TTC chr11 5254641 5254662 5254658 5254663 +
ccagggtttctcctccagcatc

SEQ ID NO: 89494 - DNA, 22 bp, Artificial Sequence
  Synthetic oligonucleotide; TTT chr11 5254650 5254671 5254667 5254672 +
ctcctccagcatcttccacatt

SEQ ID NO: 89495 - DNA, 22 bp, Artificial Sequence
  Synthetic oligonucleotide; TTC chr11 5254651 5254672 5254668 5254673 +
tcctccagcatcttccacattc

SEQ ID NO: 89496 - DNA, 22 bp, Artificial Sequence
  Synthetic oligonucleotide; CTC chr11 5254653 5254674 5254670 5254675 +
ctccagcatcttccacattcac

SEQ ID NO: 89497 - DNA, 22 bp, Artificial Sequence
  Synthetic oligonucleotide; CTC chr11 5254656 5254677 5254673 5254678 +
cagcatcttccacattcacctt

SEQ ID NO: 89498 - DNA, 22 bp, Artificial Sequence
  Synthetic oligonucleotide; CTT chr11 5254665 5254686 5254682 5254687 +
ccacattcaccttgccccacag

SEQ ID NO: 89499 - DNA, 22 bp, Artificial Sequence
  Synthetic oligonucleotide; TTC chr11 5254666 5254687 5254683 5254688 +
cacattcaccttgccccacagg

SEQ ID NO: 89500 - DNA, 22 bp, Artificial Sequence
  Synthetic oligonucleotide; TTC chr11 5254673 5254694 5254690 5254695 +
accttgccccacaggcttgtga

SEQ ID NO: 89501 - DNA, 22 bp, Artificial Sequence
  Synthetic oligonucleotide; CTT chr11 5254678 5254699 5254695 5254700 +
gccccacaggcttgtgatagta

SEQ ID NO: 89502 - DNA, 22 bp, Artificial Sequence
  Synthetic oligonucleotide; TTG chr11 5254679 5254700 5254696 5254701 +
ccccacaggcttgtgatagtag

SEQ ID NO: 89503 - DNA, 22 bp, Artificial Sequence
  Synthetic oligonucleotide; CTT chr11 5254691 5254712 5254708 5254713 +
gtgatagtagccttgtcctcct

SEQ ID NO: 89504 - DNA, 22 bp, Artificial Sequence
  Synthetic oligonucleotide; TTG chr11 5254692 5254713 5254709 5254714 +
tgatagtagccttgtcctcctc

SEQ ID NO: 89505 - DNA, 22 bp, Artificial Sequence
  Synthetic oligonucleotide; CTT chr11 5254705 5254726 5254722 5254727 +
gtcctcctctgtgaaatgaccc

SEQ ID NO: 89506 - DNA, 22 bp, Artificial Sequence
  Synthetic oligonucleotide; TTG chr11 5254706 5254727 5254723 5254728 +
tcctcctctgtgaaatgaccca

SEQ ID NO: 89507 - DNA, 22 bp, Artificial Sequence
  Synthetic oligonucleotide; CTC chr11 5254711 5254732 5254728 5254733 +
ctctgtgaaatgacccatggcg

SEQ ID NO: 89508 - DNA, 22 bp, Artificial Sequence
  Synthetic oligonucleotide; CTC chr11 5254714 5254735 5254731 5254736 +
tgtgaaatgacccatggcgtct

SEQ ID NO: 89509 - DNA, 22 bp, Artificial Sequence
  Synthetic oligonucleotide; CTG chr11 5254716 5254737 5254733 5254738 +
tgaaatgacccatggcgtctgg

SEQ ID NO: 89510 - DNA, 22 bp, Artificial Sequence
  Synthetic oligonucleotide; CTG chr11 5254737 5254758 5254754 5254759 +
gactaggagcttattgataacc

SEQ ID NO: 89511 - DNA, 22 bp, Artificial Sequence
  Synthetic oligonucleotide; CTA chr11 5254742 5254763 5254759 5254764 +
ggagcttattgataacctcaga

SEQ ID NO: 89512 - DNA, 22 bp, Artificial Sequence
  Synthetic oligonucleotide; CTT chr11 5254749 5254770 5254766 5254771 +
attgataacctcagacgttcca

SEQ ID NO: 89513 - DNA, 22 bp, Artificial Sequence
  Synthetic oligonucleotide; TTA chr11 5254750 5254771 5254767 5254772 +
ttgataacctcagacgttccag

SEQ ID NO: 89514 - DNA, 22 bp, Artificial Sequence
  Synthetic oligonucleotide; TTG chr11 5254753 5254774 5254770 5254775 +
ataacctcagacgttccagaag

SEQ ID NO: 89515 - DNA, 22 bp, Artificial Sequence
  Synthetic oligonucleotide; CTC chr11 5254761 5254782 5254778 5254783 +
agacgttccagaagcgagtgtg

SEQ ID NO: 89516 - DNA, 22 bp, Artificial Sequence
  Synthetic oligonucleotide; TTC chr11 5254769 5254790 5254786 5254791 +
cagaagcgagtgtgtggaactg

SEQ ID NO: 89517 - DNA, 22 bp, Artificial Sequence
  Synthetic oligonucleotide; CTG chr11 5254791 5254812 5254808 5254813 +
ctgaagggtgcttccttttatt

SEQ ID NO: 89518 - DNA, 22 bp, Artificial Sequence
  Synthetic oligonucleotide; CTG chr11 5254794 5254815 5254811 5254816 +
aagggtgcttccttttattctt

SEQ ID NO: 89519 - DNA, 22 bp, Artificial Sequence
  Synthetic oligonucleotide; CTT chr11 5254804 5254825 5254821 5254826 +
ccttttattcttcatccctagc

SEQ ID NO: 89520 - DNA, 22 bp, Artificial Sequence
  Synthetic oligonucleotide; TTC chr11 5254805 5254826 5254822 5254827 +
cttttattcttcatccctagcc

SEQ ID NO: 89521 - DNA, 22 bp, Artificial Sequence
  Synthetic oligonucleotide; CTT chr11 5254808 5254829 5254825 5254830 +
ttattcttcatccctagccagc

SEQ ID NO: 89522 - DNA, 22 bp, Artificial Sequence
  Synthetic oligonucleotide; TTT chr11 5254809 5254830 5254826 5254831 +
tattcttcatccctagccagcc

SEQ ID NO: 89523 - DNA, 22 bp, Artificial Sequence
  Synthetic oligonucleotide; TTT chr11 5254810 5254831 5254827 5254832 +
attcttcatccctagccagccg

SEQ ID NO: 89524 - DNA, 22 bp, Artificial Sequence
  Synthetic oligonucleotide; TTA chr11 5254811 5254832 5254828 5254833 +
ttcttcatccctagccagccgc

SEQ ID NO: 89525 - DNA, 22 bp, Artificial Sequence
  Synthetic oligonucleotide; TTC chr11 5254814 5254835 5254831 5254836 +
ttcatccctagccagccgccgg

SEQ ID NO: 89526 - DNA, 22 bp, Artificial Sequence
  Synthetic oligonucleotide; CTT chr11 5254816 5254837 5254833 5254838 +
catccctagccagccgccggcc

SEQ ID NO: 89527 - DNA, 22 bp, Artificial Sequence
  Synthetic oligonucleotide; TTC chr11 5254817 5254838 5254834 5254839 +
atccctagccagccgccggccc

SEQ ID NO: 89528 - DNA, 22 bp, Artificial Sequence
  Synthetic oligonucleotide; CTA chr11 5254824 5254845 5254841 5254846 +
gccagccgccggcccctggcct

SEQ ID NO: 89529 - DNA, 22 bp, Artificial Sequence
  Synthetic oligonucleotide; CTG chr11 5254842 5254863 5254859 5254864 +
gcctcactggatactctaagac

SEQ ID NO: 89530 - DNA, 22 bp, Artificial Sequence
  Synthetic oligonucleotide; CTC chr11 5254847 5254868 5254864 5254869 +
actggatactctaagactattg

SEQ ID NO: 89531 - DNA, 22 bp, Artificial Sequence
  Synthetic oligonucleotide; CTG chr11 5254851 5254872 5254868 5254873 +
gatactctaagactattggtca

SEQ ID NO: 89532 - DNA, 22 bp, Artificial Sequence
  Synthetic oligonucleotide; CTC chr11 5254858 5254879 5254875 5254880 +
taagactattggtcaagtttgc

SEQ ID NO: 89533 - DNA, 22 bp, Artificial Sequence
  Synthetic oligonucleotide; CTA chr11 5254860 5254881 5254877 5254882 +
agactattggtcaagtttgcct

SEQ ID NO: 89534 - DNA, 22 bp, Artificial Sequence
  Synthetic oligonucleotide; CTA chr11 5254866 5254887 5254883 5254888 +
ttggtcaagtttgccttgtcaa

SEQ ID NO: 89535 - DNA, 22 bp, Artificial Sequence
  Synthetic oligonucleotide; TTG chr11 5254869 5254890 5254886 5254891 +
gtcaagtttgccttgtcaaggc

SEQ ID NO: 89536 - DNA, 22 bp, Artificial Sequence
  Synthetic oligonucleotide; TTT chr11 5254878 5254899 5254895 5254900 +
gccttgtcaaggctattggtca

SEQ ID NO: 89537 - DNA, 22 bp, Artificial Sequence
  Synthetic oligonucleotide; TTG chr11 5254879 5254900 5254896 5254901 +
ccttgtcaaggctattggtcaa

SEQ ID NO: 89538 - DNA, 22 bp, Artificial Sequence
  Synthetic oligonucleotide; CTT chr11 5254883 5254904 5254900 5254905 +
gtcaaggctattggtcaaggca

SEQ ID NO: 89539 - DNA, 22 bp, Artificial Sequence
  Synthetic oligonucleotide; TTG chr11 5254884 5254905 5254901 5254906 +
tcaaggctattggtcaaggcaa

SEQ ID NO: 89540 - DNA, 22 bp, Artificial Sequence
  Synthetic oligonucleotide; CTA chr11 5254893 5254914 5254910 5254915 +
ttggtcaaggcaaggctggcca

SEQ ID NO: 89541 - DNA, 22 bp, Artificial Sequence
  Synthetic oligonucleotide; TTG chr11 5254896 5254917 5254913 5254918 +
gtcaaggcaaggctggccaacc

SEQ ID NO: 89542 - DNA, 22 bp, Artificial Sequence
  Synthetic oligonucleotide; CTG chr11 5254911 5254932 5254928 5254933 +
gccaacccatgggtggagttta

SEQ ID NO: 89543 - DNA, 22 bp, Artificial Sequence
  Synthetic oligonucleotide; TTT chr11 5254932 5254953 5254949 5254954 +
agccagggaccgtttcagacag

SEQ ID NO: 89544 - DNA, 22 bp, Artificial Sequence
  Synthetic oligonucleotide; TTA chr11 5254933 5254954 5254950 5254955 +
gccagggaccgtttcagacaga

SEQ ID NO: 89545 - DNA, 22 bp, Artificial Sequence
  Synthetic oligonucleotide; TTT chr11 5254947 5254968 5254964 5254969 +
cagacagatatttgcattgaga

SEQ ID NO: 89546 - DNA, 22 bp, Artificial Sequence
  Synthetic oligonucleotide; TTC chr11 5254948 5254969 5254965 5254970 +
agacagatatttgcattgagat

SEQ ID NO: 89547 - DNA, 22 bp, Artificial Sequence
  Synthetic oligonucleotide; TTT chr11 5254960 5254981 5254977 5254982 +
gcattgagatagtgtggggaag

SEQ ID NO: 89548 - DNA, 22 bp, Artificial Sequence
  Synthetic oligonucleotide; TTG chr11 5254961 5254982 5254978 5254983 +
cattgagatagtgtggggaagg

SEQ ID NO: 89549 - DNA, 22 bp, Artificial Sequence
  Synthetic oligonucleotide; TTG chr11 5254966 5254987 5254983 5254988 +
agatagtgtggggaaggggccc

SEQ ID NO: 89550 - DNA, 22 bp, Artificial Sequence
  Synthetic oligonucleotide; CTG chr11 5255002 5255023 5255019 5255024 +
ctgcttaattttttttatagcc

SEQ ID NO: 89551 - DNA, 22 bp, Artificial Sequence
  Synthetic oligonucleotide; CTG chr11 5255005 5255026 5255022 5255027 +
cttaattttttttatagccttt

SEQ ID NO: 89552 - DNA, 22 bp, Artificial Sequence
  Synthetic oligonucleotide; CTT chr11 5255008 5255029 5255025 5255030 +
aattttttttatagcctttgcc

SEQ ID NO: 89553 - DNA, 22 bp, Artificial Sequence
  Synthetic oligonucleotide; TTA chr11 5255009 5255030 5255026 5255031 +
attttttttatagcctttgcct

SEQ ID NO: 89554 - DNA, 22 bp, Artificial Sequence
  Synthetic oligonucleotide; TTT chr11 5255013 5255034 5255030 5255035 +
tttttatagcctttgccttgtt

SEQ ID NO: 89555 - DNA, 22 bp, Artificial Sequence
  Synthetic oligonucleotide; TTT chr11 5255014 5255035 5255031 5255036 +
ttttatagcctttgccttgttc

SEQ ID NO: 89556 - DNA, 22 bp, Artificial Sequence
  Synthetic oligonucleotide; TTT chr11 5255015 5255036 5255032 5255037 +
tttatagcctttgccttgttcc

SEQ ID NO: 89557 - DNA, 22 bp, Artificial Sequence
  Synthetic oligonucleotide; TTT chr11 5255016 5255037 5255033 5255038 +
ttatagcctttgccttgttccg

SEQ ID NO: 89558 - DNA, 22 bp, Artificial Sequence
  Synthetic oligonucleotide; TTT chr11 5255017 5255038 5255034 5255039 +
tatagcctttgccttgttccga

SEQ ID NO: 89559 - DNA, 22 bp, Artificial Sequence
  Synthetic oligonucleotide; TTT chr11 5255018 5255039 5255035 5255040 +
atagcctttgccttgttccgat

SEQ ID NO: 89560 - DNA, 22 bp, Artificial Sequence
  Synthetic oligonucleotide; TTA chr11 5255019 5255040 5255036 5255041 +
tagcctttgccttgttccgatt

SEQ ID NO: 89561 - DNA, 22 bp, Artificial Sequence
  Synthetic oligonucleotide; CTT chr11 5255026 5255047 5255043 5255048 +
tgccttgttccgattcagtcat

SEQ ID NO: 89562 - DNA, 22 bp, Artificial Sequence
  Synthetic oligonucleotide; TTT chr11 5255027 5255048 5255044 5255049 +
gccttgttccgattcagtcatt

SEQ ID NO: 89563 - DNA, 22 bp, Artificial Sequence
  Synthetic oligonucleotide; TTG chr11 5255028 5255049 5255045 5255050 +
ccttgttccgattcagtcattc

SEQ ID NO: 89564 - DNA, 22 bp, Artificial Sequence
  Synthetic oligonucleotide; CTT chr11 5255032 5255053 5255049 5255054 +
gttccgattcagtcattccaat

SEQ ID NO: 89565 - DNA, 22 bp, Artificial Sequence
  Synthetic oligonucleotide; TTG chr11 5255033 5255054 5255050 5255055 +
ttccgattcagtcattccaatt

SEQ ID NO: 89566 - DNA, 22 bp, Artificial Sequence
  Synthetic oligonucleotide; TTC chr11 5255036 5255057 5255053 5255058 +
cgattcagtcattccaattttt

SEQ ID NO: 89567 - DNA, 22 bp, Artificial Sequence
  Synthetic oligonucleotide; TTC chr11 5255042 5255063 5255059 5255064 +
agtcattccaatttttctctaa

SEQ ID NO: 89568 - DNA, 22 bp, Artificial Sequence
  Synthetic oligonucleotide; TTC chr11 5255050 5255071 5255067 5255072 +
caatttttctctaatttattct

SEQ ID NO: 89569 - DNA, 22 bp, Artificial Sequence
  Synthetic oligonucleotide; TTT chr11 5255056 5255077 5255073 5255078 +
ttctctaatttattcttccctt

SEQ ID NO: 89570 - DNA, 22 bp, Artificial Sequence
  Synthetic oligonucleotide; TTT chr11 5255057 5255078 5255074 5255079 +
tctctaatttattcttcccttt

SEQ ID NO: 89571 - DNA, 22 bp, Artificial Sequence
  Synthetic oligonucleotide; TTT chr11 5255058 5255079 5255075 5255080 +
ctctaatttattcttcccttta

SEQ ID NO: 89572 - DNA, 22 bp, Artificial Sequence
  Synthetic oligonucleotide; TTC chr11 5255059 5255080 5255076 5255081 +
tctaatttattcttccctttag

SEQ ID NO: 89573 - DNA, 22 bp, Artificial Sequence
  Synthetic oligonucleotide; CTC chr11 5255061 5255082 5255078 5255083 +
taatttattcttccctttagct

SEQ ID NO: 89574 - DNA, 22 bp, Artificial Sequence
  Synthetic oligonucleotide; CTA chr11 5255063 5255084 5255080 5255085 +
atttattcttccctttagctag

SEQ ID NO: 89575 - DNA, 22 bp, Artificial Sequence
  Synthetic oligonucleotide; TTT chr11 5255067 5255088 5255084 5255089 +
attcttccctttagctagtttt

SEQ ID NO: 89576 - DNA, 22 bp, Artificial Sequence
  Synthetic oligonucleotide; TTA chr11 5255068 5255089 5255085 5255090 +
ttcttccctttagctagttttc

SEQ ID NO: 89577 - DNA, 22 bp, Artificial Sequence
  Synthetic oligonucleotide; TTC chr11 5255071 5255092 5255088 5255093 +
ttccctttagctagttttcttc

SEQ ID NO: 89578 - DNA, 22 bp, Artificial Sequence
  Synthetic oligonucleotide; CTT chr11 5255073 5255094 5255090 5255095 +
ccctttagctagttttcttctc

SEQ ID NO: 89579 - DNA, 22 bp, Artificial Sequence
  Synthetic oligonucleotide; TTC chr11 5255074 5255095 5255091 5255096 +
cctttagctagttttcttctcc

SEQ ID NO: 89580 - DNA, 22 bp, Artificial Sequence
  Synthetic oligonucleotide; CTT chr11 5255078 5255099 5255095 5255100 +
tagctagttttcttctcccacc

SEQ ID NO: 89581 - DNA, 22 bp, Artificial Sequence
  Synthetic oligonucleotide; TTT chr11 5255079 5255100 5255096 5255101 +
agctagttttcttctcccacca

SEQ ID NO: 89582 - DNA, 22 bp, Artificial Sequence
  Synthetic oligonucleotide; TTA chr11 5255080 5255101 5255097 5255102 +
gctagttttcttctcccaccat

SEQ ID NO: 89583 - DNA, 22 bp, Artificial Sequence
  Synthetic oligonucleotide; CTA chr11 5255084 5255105 5255101 5255106 +
gttttcttctcccaccatagaa

SEQ ID NO: 89584 - DNA, 22 bp, Artificial Sequence
  Synthetic oligonucleotide; TTT chr11 5255088 5255109 5255105 5255110 +
tcttctcccaccatagaagata

SEQ ID NO: 89585 - DNA, 22 bp, Artificial Sequence
  Synthetic oligonucleotide; TTT chr11 5255089 5255110 5255106 5255111 +
cttctcccaccatagaagatac

SEQ ID NO: 89586 - DNA, 22 bp, Artificial Sequence
  Synthetic oligonucleotide; TTC chr11 5255090 5255111 5255107 5255112 +
ttctcccaccatagaagatacc

SEQ ID NO: 89587 - DNA, 22 bp, Artificial Sequence
  Synthetic oligonucleotide; CTT chr11 5255092 5255113 5255109 5255114 +
ctcccaccatagaagataccag

SEQ ID NO: 89588 - DNA, 22 bp, Artificial Sequence
  Synthetic oligonucleotide; TTC chr11 5255093 5255114 5255110 5255115 +
tcccaccatagaagataccagg

SEQ ID NO: 89589 - DNA, 22 bp, Artificial Sequence
  Synthetic oligonucleotide; CTC chr11 5255095 5255116 5255112 5255117 +
ccaccatagaagataccaggac

SEQ ID NO: 89590 - DNA, 22 bp, Artificial Sequence
  Synthetic oligonucleotide; CTT chr11 5255119 5255140 5255136 5255141 +
cttttgtcagccgtttttcacc

SEQ ID NO: 89591 - DNA, 22 bp, Artificial Sequence
  Synthetic oligonucleotide; TTC chr11 5255120 5255141 5255137 5255142 +
ttttgtcagccgtttttcacct

SEQ ID NO: 89592 - DNA, 22 bp, Artificial Sequence
  Synthetic oligonucleotide; CTT chr11 5255122 5255143 5255139 5255144 +
ttgtcagccgtttttcaccttc

SEQ ID NO: 89593 - DNA, 22 bp, Artificial Sequence
  Synthetic oligonucleotide; TTT chr11 5255123 5255144 5255140 5255145 +
tgtcagccgtttttcaccttct

SEQ ID NO: 89594 - DNA, 22 bp, Artificial Sequence
  Synthetic oligonucleotide; TTT chr11 5255124 5255145 5255141 5255146 +
gtcagccgtttttcaccttctt

SEQ ID NO: 89595 - DNA, 22 bp, Artificial Sequence
  Synthetic oligonucleotide; TTG chr11 5255125 5255146 5255142 5255147 +
tcagccgtttttcaccttcttg

SEQ ID NO: 89596 - DNA, 22 bp, Artificial Sequence
  Synthetic oligonucleotide; TTT chr11 5255135 5255156 5255152 5255157 +
ttcaccttcttgtctgtagctc

SEQ ID NO: 89597 - DNA, 22 bp, Artificial Sequence
  Synthetic oligonucleotide; TTT chr11 5255136 5255157 5255153 5255158 +
tcaccttcttgtctgtagctcc

SEQ ID NO: 89598 - DNA, 22 bp, Artificial Sequence
  Synthetic oligonucleotide; TTT chr11 5255137 5255158 5255154 5255159 +
caccttcttgtctgtagctcca

SEQ ID NO: 89599 - DNA, 22 bp, Artificial Sequence
  Synthetic oligonucleotide; TTC chr11 5255138 5255159 5255155 5255160 +
accttcttgtctgtagctccag

SEQ ID NO: 89600 - DNA, 22 bp, Artificial Sequence
  Synthetic oligonucleotide; CTT chr11 5255143 5255164 5255160 5255165 +
cttgtctgtagctccagtgagg

SEQ ID NO: 89601 - DNA, 22 bp, Artificial Sequence
  Synthetic oligonucleotide; TTC chr11 5255144 5255165 5255161 5255166 +
ttgtctgtagctccagtgaggc

SEQ ID NO: 89602 - DNA, 22 bp, Artificial Sequence
  Synthetic oligonucleotide; CTT chr11 5255146 5255167 5255163 5255168 +
gtctgtagctccagtgaggcct

SEQ ID NO: 89603 - DNA, 22 bp, Artificial Sequence
  Synthetic oligonucleotide; TTG chr11 5255147 5255168 5255164 5255169 +
tctgtagctccagtgaggcctg

SEQ ID NO: 89604 - DNA, 22 bp, Artificial Sequence
  Synthetic oligonucleotide; CTG chr11 5255151 5255172 5255168 5255173 +
tagctccagtgaggcctgtagt

SEQ ID NO: 89605 - DNA, 22 bp, Artificial Sequence
  Synthetic oligonucleotide; CTC chr11 5255157 5255178 5255174 5255179 +
cagtgaggcctgtagtttaaag

SEQ ID NO: 89606 - DNA, 22 bp, Artificial Sequence
  Synthetic oligonucleotide; CTG chr11 5255169 5255190 5255186 5255191 +
tagtttaaagttaaagcatgta

SEQ ID NO: 89607 - DNA, 22 bp, Artificial Sequence
  Synthetic oligonucleotide; TTT chr11 5255175 5255196 5255192 5255197 +
aaagttaaagcatgtaccaatt

SEQ ID NO: 89608 - DNA, 22 bp, Artificial Sequence
  Synthetic oligonucleotide; TTA chr11 5255176 5255197 5255193 5255198 +
aagttaaagcatgtaccaattt

SEQ ID NO: 89609 - DNA, 22 bp, Artificial Sequence
  Synthetic oligonucleotide; TTA chr11 5255182 5255203 5255199 5255204 +
aagcatgtaccaatttttgaaa

SEQ ID NO: 89610 - DNA, 22 bp, Artificial Sequence
  Synthetic oligonucleotide; TTT chr11 5255198 5255219 5255215 5255220 +
ttgaaaagttcagggattgtga

SEQ ID NO: 89611 - DNA, 22 bp, Artificial Sequence
  Synthetic oligonucleotide; TTT chr11 5255199 5255220 5255216 5255221 +
tgaaaagttcagggattgtgaa

SEQ ID NO: 89612 - DNA, 22 bp, Artificial Sequence
  Synthetic oligonucleotide; TTT chr11 5255200 5255221 5255217 5255222 +
gaaaagttcagggattgtgaaa

SEQ ID NO: 89613 - DNA, 22 bp, Artificial Sequence
  Synthetic oligonucleotide; TTG chr11 5255201 5255222 5255218 5255223 +
aaaagttcagggattgtgaaat

SEQ ID NO: 89614 - DNA, 22 bp, Artificial Sequence
  Synthetic oligonucleotide; TTC chr11 5255209 5255230 5255226 5255231 +
agggattgtgaaatgtgtttta

SEQ ID NO: 89615 - DNA, 22 bp, Artificial Sequence
  Synthetic oligonucleotide; TTG chr11 5255217 5255238 5255234 5255239 +
tgaaatgtgttttaggcatagg

SEQ ID NO: 89616 - DNA, 22 bp, Artificial Sequence
  Synthetic oligonucleotide; TTT chr11 5255229 5255250 5255246 5255251 +
taggcataggtccaggattttt

SEQ ID NO: 89617 - DNA, 22 bp, Artificial Sequence
  Synthetic oligonucleotide; TTT chr11 5255230 5255251 5255247 5255252 +
aggcataggtccaggatttttg

SEQ ID NO: 89618 - DNA, 22 bp, Artificial Sequence
  Synthetic oligonucleotide; TTA chr11 5255231 5255252 5255248 5255253 +
ggcataggtccaggatttttga

SEQ ID NO: 89619 - DNA, 22 bp, Artificial Sequence
  Synthetic oligonucleotide; TTT chr11 5255249 5255270 5255266 5255271 +
ttgatgggacacgtcttagtct

SEQ ID NO: 89620 - DNA, 22 bp, Artificial Sequence
  Synthetic oligonucleotide; TTT chr11 5255250 5255271 5255267 5255272 +
tgatgggacacgtcttagtctc

SEQ ID NO: 89621 - DNA, 22 bp, Artificial Sequence
  Synthetic oligonucleotide; TTT chr11 5255251 5255272 5255268 5255273 +
gatgggacacgtcttagtctca

SEQ ID NO: 89622 - DNA, 22 bp, Artificial Sequence
  Synthetic oligonucleotide; TTG chr11 5255252 5255273 5255269 5255274 +
atgggacacgtcttagtctcat

SEQ ID NO: 89623 - DNA, 22 bp, Artificial Sequence
  Synthetic oligonucleotide; CTT chr11 5255266 5255287 5255283 5255288 +
agtctcatttagtaagcattgg

SEQ ID NO: 89624 - DNA, 22 bp, Artificial Sequence
  Synthetic oligonucleotide; TTA chr11 5255267 5255288 5255284 5255289 +
gtctcatttagtaagcattggt

SEQ ID NO: 89625 - DNA, 22 bp, Artificial Sequence
  Synthetic oligonucleotide; CTC chr11 5255272 5255293 5255289 5255294 +
atttagtaagcattggtttcca

SEQ ID NO: 89626 - DNA, 22 bp, Artificial Sequence
  Synthetic oligonucleotide; TTT chr11 5255276 5255297 5255293 5255298 +
agtaagcattggtttccaaata

SEQ ID NO: 89627 - DNA, 22 bp, Artificial Sequence
  Synthetic oligonucleotide; TTA chr11 5255277 5255298 5255294 5255299 +
gtaagcattggtttccaaataa

SEQ ID NO: 89628 - DNA, 22 bp, Artificial Sequence
  Synthetic oligonucleotide; TTG chr11 5255287 5255308 5255304 5255309 +
gtttccaaataagaagtgctat

SEQ ID NO: 89629 - DNA, 22 bp, Artificial Sequence
  Synthetic oligonucleotide; TTT chr11 5255291 5255312 5255308 5255313 +
ccaaataagaagtgctatactt

SEQ ID NO: 89630 - DNA, 22 bp, Artificial Sequence
  Synthetic oligonucleotide; TTC chr11 5255292 5255313 5255309 5255314 +
caaataagaagtgctatactta

SEQ ID NO: 89631 - DNA, 22 bp, Artificial Sequence
  Synthetic oligonucleotide; CTA chr11 5255308 5255329 5255325 5255330 +
tacttatctttgaatatactct

SEQ ID NO: 89632 - DNA, 22 bp, Artificial Sequence
  Synthetic oligonucleotide; CTT chr11 5255313 5255334 5255330 5255335 +
atctttgaatatactctctgtg

SEQ ID NO: 89633 - DNA, 22 bp, Artificial Sequence
  Synthetic oligonucleotide; TTA chr11 5255314 5255335 5255331 5255336 +
tctttgaatatactctctgtgg

SEQ ID NO: 89634 - DNA, 22 bp, Artificial Sequence
  Synthetic oligonucleotide; CTT chr11 5255318 5255339 5255335 5255340 +
tgaatatactctctgtggtttt

SEQ ID NO: 89635 - DNA, 22 bp, Artificial Sequence
  Synthetic oligonucleotide; TTT chr11 5255319 5255340 5255336 5255341 +
gaatatactctctgtggtttta

SEQ ID NO: 89636 - DNA, 22 bp, Artificial Sequence
  Synthetic oligonucleotide; TTG chr11 5255320 5255341 5255337 5255342 +
aatatactctctgtggttttag

SEQ ID NO: 89637 - DNA, 22 bp, Artificial Sequence
  Synthetic oligonucleotide; CTC chr11 5255329 5255350 5255346 5255351 +
tctgtggttttaggccattatc

SEQ ID NO: 89638 - DNA, 22 bp, Artificial Sequence
  Synthetic oligonucleotide; CTC chr11 5255331 5255352 5255348 5255353 +
tgtggttttaggccattatctc

SEQ ID NO: 89639 - DNA, 22 bp, Artificial Sequence
  Synthetic oligonucleotide; CTG chr11 5255333 5255354 5255350 5255355 +
tggttttaggccattatctctt

SEQ ID NO: 89640 - DNA, 22 bp, Artificial Sequence
  Synthetic oligonucleotide; TTT chr11 5255339 5255360 5255356 5255361 +
taggccattatctcttaagttc

SEQ ID NO: 89641 - DNA, 22 bp, Artificial Sequence
  Synthetic oligonucleotide; TTT chr11 5255340 5255361 5255357 5255362 +
aggccattatctcttaagttct

SEQ ID NO: 89642 - DNA, 22 bp, Artificial Sequence
  Synthetic oligonucleotide; TTA chr11 5255341 5255362 5255358 5255363 +
ggccattatctcttaagttctc

SEQ ID NO: 89643 - DNA, 22 bp, Artificial Sequence
  Synthetic oligonucleotide; TTA chr11 5255349 5255370 5255366 5255371 +
tctcttaagttctcattagtgt

SEQ ID NO: 89644 - DNA, 22 bp, Artificial Sequence
  Synthetic oligonucleotide; CTC chr11 5255353 5255374 5255370 5255375 +
ttaagttctcattagtgtagtg

SEQ ID NO: 89645 - DNA, 22 bp, Artificial Sequence
  Synthetic oligonucleotide; CTT chr11 5255355 5255376 5255372 5255377 +
aagttctcattagtgtagtgaa

SEQ ID NO: 89646 - DNA, 22 bp, Artificial Sequence
  Synthetic oligonucleotide; TTA chr11 5255356 5255377 5255373 5255378 +
agttctcattagtgtagtgaaa

SEQ ID NO: 89647 - DNA, 22 bp, Artificial Sequence
  Synthetic oligonucleotide; TTC chr11 5255361 5255382 5255378 5255383 +
tcattagtgtagtgaaaaatcc

SEQ ID NO: 89648 - DNA, 22 bp, Artificial Sequence
  Synthetic oligonucleotide; CTC chr11 5255363 5255384 5255380 5255385 +
attagtgtagtgaaaaatccta

SEQ ID NO: 89649 - DNA, 22 bp, Artificial Sequence
  Synthetic oligonucleotide; TTA chr11 5255367 5255388 5255384 5255389 +
gtgtagtgaaaaatcctataaa

SEQ ID NO: 89650 - DNA, 22 bp, Artificial Sequence
  Synthetic oligonucleotide; CTA chr11 5255385 5255406 5255402 5255407 +
taaagcaacagtttcagtgcag

SEQ ID NO: 89651 - DNA, 22 bp, Artificial Sequence
  Synthetic oligonucleotide; TTT chr11 5255399 5255420 5255416 5255421 +
cagtgcaggaatagattaatgt

SEQ ID NO: 89652 - DNA, 22 bp, Artificial Sequence
  Synthetic oligonucleotide; TTC chr11 5255400 5255421 5255417 5255422 +
agtgcaggaatagattaatgtt

SEQ ID NO: 89653 - DNA, 22 bp, Artificial Sequence
  Synthetic oligonucleotide; TTA chr11 5255417 5255438 5255434 5255439 +
atgttatgtaatataatataag

SEQ ID NO: 89654 - DNA, 22 bp, Artificial Sequence
  Synthetic oligonucleotide; TTA chr11 5255423 5255444 5255440 5255445 +
tgtaatataatataagactgaa

SEQ ID NO: 89655 - DNA, 22 bp, Artificial Sequence
  Synthetic oligonucleotide; CTG chr11 5255443 5255464 5255460 5255465 +
aatccttacttcaatatctact

SEQ ID NO: 89656 - DNA, 22 bp, Artificial Sequence
  Synthetic oligonucleotide; CTT chr11 5255450 5255471 5255467 5255472 +
acttcaatatctacttatccgt

SEQ ID NO: 89657 - DNA, 22 bp, Artificial Sequence
  Synthetic oligonucleotide; TTA chr11 5255451 5255472 5255468 5255473 +
cttcaatatctacttatccgta

SEQ ID NO: 89658 - DNA, 22 bp, Artificial Sequence
  Synthetic oligonucleotide; CTT chr11 5255454 5255475 5255471 5255476 +
caatatctacttatccgtacct

SEQ ID NO: 89659 - DNA, 22 bp, Artificial Sequence
  Synthetic oligonucleotide; TTC chr11 5255455 5255476 5255472 5255477 +
aatatctacttatccgtaccta

SEQ ID NO: 89660 - DNA, 22 bp, Artificial Sequence
  Synthetic oligonucleotide; CTA chr11 5255463 5255484 5255480 5255485 +
cttatccgtacctatttgaaat

SEQ ID NO: 89661 - DNA, 22 bp, Artificial Sequence
  Synthetic oligonucleotide; CTT chr11 5255466 5255487 5255483 5255488 +
atccgtacctatttgaaataaa

SEQ ID NO: 89662 - DNA, 22 bp, Artificial Sequence
  Synthetic oligonucleotide; TTA chr11 5255467 5255488 5255484 5255489 +
tccgtacctatttgaaataaat

SEQ ID NO: 89663 - DNA, 22 bp, Artificial Sequence
  Synthetic oligonucleotide; CTA chr11 5255477 5255498 5255494 5255499 +
tttgaaataaatcacgcctgtt

SEQ ID NO: 89664 - DNA, 22 bp, Artificial Sequence
  Synthetic oligonucleotide; TTT chr11 5255480 5255501 5255497 5255502 +
gaaataaatcacgcctgtttca

SEQ ID NO: 89665 - DNA, 22 bp, Artificial Sequence
  Synthetic oligonucleotide; TTG chr11 5255481 5255502 5255498 5255503 +
aaataaatcacgcctgtttcat

SEQ ID NO: 89666 - DNA, 22 bp, Artificial Sequence
  Synthetic oligonucleotide; CTG chr11 5255497 5255518 5255514 5255519 +
tttcatctcagcaaaagtattt

SEQ ID NO: 89667 - DNA, 22 bp, Artificial Sequence
  Synthetic oligonucleotide; TTT chr11 5255500 5255521 5255517 5255522 +
catctcagcaaaagtatttttt

SEQ ID NO: 89668 - DNA, 22 bp, Artificial Sequence
  Synthetic oligonucleotide; TTC chr11 5255501 5255522 5255518 5255523 +
atctcagcaaaagtattttttt

SEQ ID NO: 89669 - DNA, 22 bp, Artificial Sequence
  Synthetic oligonucleotide; CTC chr11 5255506 5255527 5255523 5255528 +
agcaaaagtattttttttatat

SEQ ID NO: 89670 - DNA, 22 bp, Artificial Sequence
  Synthetic oligonucleotide; TTT chr11 5255519 5255540 5255536 5255541 +
tttttatattcaggtatgtatg

SEQ ID NO: 89671 - DNA, 22 bp, Artificial Sequence
  Synthetic oligonucleotide; TTT chr11 5255520 5255541 5255537 5255542 +
ttttatattcaggtatgtatgt

SEQ ID NO: 89672 - DNA, 22 bp, Artificial Sequence
  Synthetic oligonucleotide; TTT chr11 5255521 5255542 5255538 5255543 +
tttatattcaggtatgtatgta

SEQ ID NO: 89673 - DNA, 22 bp, Artificial Sequence
  Synthetic oligonucleotide; TTT chr11 5255522 5255543 5255539 5255544 +
ttatattcaggtatgtatgtag

SEQ ID NO: 89674 - DNA, 22 bp, Artificial Sequence
  Synthetic oligonucleotide; TTT chr11 5255523 5255544 5255540 5255545 +
tatattcaggtatgtatgtagg

SEQ ID NO: 89675 - DNA, 22 bp, Artificial Sequence
  Synthetic oligonucleotide; TTT chr11 5255524 5255545 5255541 5255546 +
atattcaggtatgtatgtaggc

SEQ ID NO: 89676 - DNA, 22 bp, Artificial Sequence
  Synthetic oligonucleotide; TTA chr11 5255525 5255546 5255542 5255547 +
tattcaggtatgtatgtaggca

SEQ ID NO: 89677 - DNA, 22 bp, Artificial Sequence
  Synthetic oligonucleotide; TTC chr11 5255530 5255551 5255547 5255552 +
aggtatgtatgtaggcacccga

SEQ ID NO: 89678 - DNA, 22 bp, Artificial Sequence
  Synthetic oligonucleotide; TTT chr11 5255564 5255585 5255581 5255586 +
atcactggataagtgtatgtgc

SEQ ID NO: 89679 - DNA, 22 bp, Artificial Sequence
  Synthetic oligonucleotide; TTA chr11 5255565 5255586 5255582 5255587 +
tcactggataagtgtatgtgct

SEQ ID NO: 89680 - DNA, 22 bp, Artificial Sequence
  Synthetic oligonucleotide; CTG chr11 5255571 5255592 5255588 5255593 +
gataagtgtatgtgctggctga

SEQ ID NO: 89681 - DNA, 22 bp, Artificial Sequence
  Synthetic oligonucleotide; CTG chr11 5255588 5255609 5255605 5255610 +
gctgatgacccagggttttggt

SEQ ID NO: 89682 - DNA, 22 bp, Artificial Sequence
  Synthetic oligonucleotide; CTG chr11 5255592 5255613 5255609 5255614 +
atgacccagggttttggtgtag

SEQ ID NO: 89683 - DNA, 22 bp, Artificial Sequence
  Synthetic oligonucleotide; TTT chr11 5255606 5255627 5255623 5255628 +
tggtgtagctcttctatgctcg

SEQ ID NO: 89684 - DNA, 22 bp, Artificial Sequence
  Synthetic oligonucleotide; TTT chr11 5255607 5255628 5255624 5255629 +
ggtgtagctcttctatgctcgg

SEQ ID NO: 89685 - DNA, 22 bp, Artificial Sequence
  Synthetic oligonucleotide; TTG chr11 5255608 5255629 5255625 5255630 +
gtgtagctcttctatgctcggt

SEQ ID NO: 89686 - DNA, 22 bp, Artificial Sequence
  Synthetic oligonucleotide; CTC chr11 5255617 5255638 5255634 5255639 +
ttctatgctcggtaaagatgat

SEQ ID NO: 89687 - DNA, 22 bp, Artificial Sequence
  Synthetic oligonucleotide; CTT chr11 5255619 5255640 5255636 5255641 +
ctatgctcggtaaagatgatgg

SEQ ID NO: 89688 - DNA, 22 bp, Artificial Sequence
  Synthetic oligonucleotide; TTC chr11 5255620 5255641 5255637 5255642 +
tatgctcggtaaagatgatggt

SEQ ID NO: 89689 - DNA, 22 bp, Artificial Sequence
  Synthetic oligonucleotide; CTA chr11 5255622 5255643 5255639 5255644 +
tgctcggtaaagatgatggtag

SEQ ID NO: 89690 - DNA, 22 bp, Artificial Sequence
  Synthetic oligonucleotide; CTC chr11 5255627 5255648 5255644 5255649 +
ggtaaagatgatggtagaatgc

SEQ ID NO: 89691 - DNA, 22 bp, Artificial Sequence
  Synthetic oligonucleotide; CTC chr11 5255651 5255672 5255668 5255673 +
tttaccagatactatggattag

SEQ ID NO: 89692 - DNA, 22 bp, Artificial Sequence
  Synthetic oligonucleotide; CTT chr11 5255653 5255674 5255670 5255675 +
taccagatactatggattagaa

SEQ ID NO: 89693 - DNA, 22 bp, Artificial Sequence
  Synthetic oligonucleotide; TTT chr11 5255654 5255675 5255671 5255676 +
accagatactatggattagaat

SEQ ID NO: 89694 - DNA, 22 bp, Artificial Sequence
  Synthetic oligonucleotide; TTA chr11 5255655 5255676 5255672 5255677 +
ccagatactatggattagaatt

SEQ ID NO: 89695 - DNA, 22 bp, Artificial Sequence
  Synthetic oligonucleotide; CTA chr11 5255665 5255686 5255682 5255687 +
tggattagaattaattatcttg

SEQ ID NO: 89696 - DNA, 22 bp, Artificial Sequence
  Synthetic oligonucleotide; TTA chr11 5255672 5255693 5255689 5255694 +
gaattaattatcttgtataaat

SEQ ID NO: 89697 - DNA, 22 bp, Artificial Sequence
  Synthetic oligonucleotide; TTA chr11 5255678 5255699 5255695 5255700 +
attatcttgtataaatgctagg

SEQ ID NO: 89698 - DNA, 22 bp, Artificial Sequence
  Synthetic oligonucleotide; TTA chr11 5255682 5255703 5255699 5255704 +
tcttgtataaatgctaggttca

SEQ ID NO: 89699 - DNA, 22 bp, Artificial Sequence
  Synthetic oligonucleotide; CTT chr11 5255686 5255707 5255703 5255708 +
gtataaatgctaggttcacttc

SEQ ID NO: 89700 - DNA, 22 bp, Artificial Sequence
  Synthetic oligonucleotide; TTG chr11 5255687 5255708 5255704 5255709 +
tataaatgctaggttcacttct

SEQ ID NO: 89701 - DNA, 22 bp, Artificial Sequence
  Synthetic oligonucleotide; CTA chr11 5255698 5255719 5255715 5255720 +
ggttcacttcttagggaatctt

SEQ ID NO: 89702 - DNA, 22 bp, Artificial Sequence
  Synthetic oligonucleotide; TTC chr11 5255703 5255724 5255720 5255725 +
acttcttagggaatcttattct

SEQ ID NO: 89703 - DNA, 22 bp, Artificial Sequence
  Synthetic oligonucleotide; CTT chr11 5255707 5255728 5255724 5255729 +
cttagggaatcttattctaaga

SEQ ID NO: 89704 - DNA, 22 bp, Artificial Sequence
  Synthetic oligonucleotide; TTC chr11 5255708 5255729 5255725 5255730 +
ttagggaatcttattctaagac

SEQ ID NO: 89705 - DNA, 22 bp, Artificial Sequence
  Synthetic oligonucleotide; CTT chr11 5255710 5255731 5255727 5255732 +
agggaatcttattctaagacat

SEQ ID NO: 89706 - DNA, 22 bp, Artificial Sequence
  Synthetic oligonucleotide; TTA chr11 5255711 5255732 5255728 5255733 +
gggaatcttattctaagacata

SEQ ID NO: 89707 - DNA, 22 bp, Artificial Sequence
  Synthetic oligonucleotide; CTT chr11 5255720 5255741 5255737 5255742 +
attctaagacataagacatgta

SEQ ID NO: 89708 - DNA, 22 bp, Artificial Sequence
  Synthetic oligonucleotide; TTA chr11 5255721 5255742 5255738 5255743 +
ttctaagacataagacatgtat

SEQ ID NO: 89709 - DNA, 22 bp, Artificial Sequence
  Synthetic oligonucleotide; TTC chr11 5255724 5255745 5255741 5255746 +
taagacataagacatgtatttg

SEQ ID NO: 89710 - DNA, 22 bp, Artificial Sequence
  Synthetic oligonucleotide; CTA chr11 5255726 5255747 5255743 5255748 +
agacataagacatgtatttgca

SEQ ID NO: 89711 - DNA, 22 bp, Artificial Sequence
  Synthetic oligonucleotide; TTT chr11 5255745 5255766 5255762 5255767 +
gcatggaaaacaactcttaaga

SEQ ID NO: 89712 - DNA, 22 bp, Artificial Sequence
  Synthetic oligonucleotide; TTG chr11 5255746 5255767 5255763 5255768 +
catggaaaacaactcttaagag

SEQ ID NO: 89713 - DNA, 22 bp, Artificial Sequence
  Synthetic oligonucleotide; CTC chr11 5255761 5255782 5255778 5255783 +
ttaagaggcagggactgtttta

SEQ ID NO: 89714 - DNA, 22 bp, Artificial Sequence
  Synthetic oligonucleotide; CTT chr11 5255763 5255784 5255780 5255785 +
aagaggcagggactgttttatt

SEQ ID NO: 89715 - DNA, 22 bp, Artificial Sequence
  Synthetic oligonucleotide; TTA chr11 5255764 5255785 5255781 5255786 +
agaggcagggactgttttattg

SEQ ID NO: 89716 - DNA, 22 bp, Artificial Sequence
  Synthetic oligonucleotide; CTG chr11 5255778 5255799 5255795 5255800 +
ttttattgactaatagtccaca

SEQ ID NO: 89717 - DNA, 22 bp, Artificial Sequence
  Synthetic oligonucleotide; TTT chr11 5255781 5255802 5255798 5255803 +
tattgactaatagtccacacac

SEQ ID NO: 89718 - DNA, 22 bp, Artificial Sequence
  Synthetic oligonucleotide; TTT chr11 5255782 5255803 5255799 5255804 +
attgactaatagtccacacact

SEQ ID NO: 89719 - DNA, 22 bp, Artificial Sequence
  Synthetic oligonucleotide; TTA chr11 5255783 5255804 5255800 5255805 +
ttgactaatagtccacacactg

SEQ ID NO: 89720 - DNA, 22 bp, Artificial Sequence
  Synthetic oligonucleotide; TTG chr11 5255786 5255807 5255803 5255808 +
actaatagtccacacactgtga

SEQ ID NO: 89721 - DNA, 22 bp, Artificial Sequence
  Synthetic oligonucleotide; CTA chr11 5255790 5255811 5255807 5255812 +
atagtccacacactgtgacagc

SEQ ID NO: 89722 - DNA, 22 bp, Artificial Sequence
  Synthetic oligonucleotide; CTG chr11 5255805 5255826 5255822 5255827 +
tgacagctgggatgtcactgta

SEQ ID NO: 89723 - DNA, 22 bp, Artificial Sequence
  Synthetic oligonucleotide; CTG chr11 5255814 5255835 5255831 5255836 +
ggatgtcactgtagtttagaca

SEQ ID NO: 89724 - DNA, 22 bp, Artificial Sequence
  Synthetic oligonucleotide; CTG chr11 5255825 5255846 5255842 5255847 +
tagtttagacatctttatctgt

SEQ ID NO: 89725 - DNA, 22 bp, Artificial Sequence
  Synthetic oligonucleotide; TTT chr11 5255831 5255852 5255848 5255853 +
agacatctttatctgtaactca

SEQ ID NO: 89726 - DNA, 22 bp, Artificial Sequence
  Synthetic oligonucleotide; TTA chr11 5255832 5255853 5255849 5255854 +
gacatctttatctgtaactcag

SEQ ID NO: 89727 - DNA, 22 bp, Artificial Sequence
  Synthetic oligonucleotide; CTT chr11 5255840 5255861 5255857 5255862 +
tatctgtaactcagtgctgttt

SEQ ID NO: 89728 - DNA, 22 bp, Artificial Sequence
  Synthetic oligonucleotide; TTT chr11 5255841 5255862 5255858 5255863 +
atctgtaactcagtgctgtttc

SEQ ID NO: 89729 - DNA, 22 bp, Artificial Sequence
  Synthetic oligonucleotide; TTA chr11 5255842 5255863 5255859 5255864 +
tctgtaactcagtgctgtttct

SEQ ID NO: 89730 - DNA, 22 bp, Artificial Sequence
  Synthetic oligonucleotide; CTG chr11 5255846 5255867 5255863 5255868 +
taactcagtgctgtttctgaca

SEQ ID NO: 89731 - DNA, 22 bp, Artificial Sequence
  Synthetic oligonucleotide; CTC chr11 5255852 5255873 5255869 5255874 +
agtgctgtttctgacatattgg

SEQ ID NO: 89732 - DNA, 22 bp, Artificial Sequence
  Synthetic oligonucleotide; CTG chr11 5255859 5255880 5255876 5255881 +
tttctgacatattggccactta

SEQ ID NO: 89733 - DNA, 22 bp, Artificial Sequence
  Synthetic oligonucleotide; TTT chr11 5255862 5255883 5255879 5255884 +
ctgacatattggccacttaaca

SEQ ID NO: 89734 - DNA, 22 bp, Artificial Sequence
  Synthetic oligonucleotide; TTC chr11 5255863 5255884 5255880 5255885 +
tgacatattggccacttaacat

SEQ ID NO: 89735 - DNA, 22 bp, Artificial Sequence
  Synthetic oligonucleotide; CTG chr11 5255865 5255886 5255882 5255887 +
acatattggccacttaacatgg

SEQ ID NO: 89736 - DNA, 22 bp, Artificial Sequence
  Synthetic oligonucleotide; TTG chr11 5255873 5255894 5255890 5255895 +
gccacttaacatggcaggaagt

SEQ ID NO: 89737 - DNA, 22 bp, Artificial Sequence
  Synthetic oligonucleotide; CTT chr11 5255880 5255901 5255897 5255902 +
aacatggcaggaagtattcatg

SEQ ID NO: 89738 - DNA, 22 bp, Artificial Sequence
  Synthetic oligonucleotide; TTA chr11 5255881 5255902 5255898 5255903 +
acatggcaggaagtattcatgc

SEQ ID NO: 89739 - DNA, 22 bp, Artificial Sequence
  Synthetic oligonucleotide; TTC chr11 5255899 5255920 5255916 5255921 +
atgctgtttttttctttatttt

SEQ ID NO: 89740 - DNA, 22 bp, Artificial Sequence
  Synthetic oligonucleotide; CTG chr11 5255905 5255926 5255922 5255927 +
tttttttctttattttttcttt

SEQ ID NO: 89741 - DNA, 22 bp, Artificial Sequence
  Synthetic oligonucleotide; TTT chr11 5255908 5255929 5255925 5255930 +
ttttctttattttttctttggg

SEQ ID NO: 89742 - DNA, 22 bp, Artificial Sequence
  Synthetic oligonucleotide; TTT chr11 5255909 5255930 5255926 5255931 +
tttctttattttttctttggga

SEQ ID NO: 89743 - DNA, 22 bp, Artificial Sequence
  Synthetic oligonucleotide; TTT chr11 5255910 5255931 5255927 5255932 +
ttctttattttttctttgggat

SEQ ID NO: 89744 - DNA, 22 bp, Artificial Sequence
  Synthetic oligonucleotide; TTT chr11 5255911 5255932 5255928 5255933 +
tctttattttttctttgggatt

SEQ ID NO: 89745 - DNA, 22 bp, Artificial Sequence
  Synthetic oligonucleotide; TTT chr11 5255912 5255933 5255929 5255934 +
ctttattttttctttgggattt

SEQ ID NO: 89746 - DNA, 22 bp, Artificial Sequence
  Synthetic oligonucleotide; TTC chr11 5255913 5255934 5255930 5255935 +
tttattttttctttgggatttt

SEQ ID NO: 89747 - DNA, 22 bp, Artificial Sequence
  Synthetic oligonucleotide; CTT chr11 5255915 5255936 5255932 5255937 +
tattttttctttgggattttta

SEQ ID NO: 89748 - DNA, 22 bp, Artificial Sequence
  Synthetic oligonucleotide; TTT chr11 5255916 5255937 5255933 5255938 +
attttttctttgggatttttat

SEQ ID NO: 89749 - DNA, 22 bp, Artificial Sequence
  Synthetic oligonucleotide; TTA chr11 5255917 5255938 5255934 5255939 +
ttttttctttgggatttttatt

SEQ ID NO: 89750 - DNA, 22 bp, Artificial Sequence
  Synthetic oligonucleotide; TTT chr11 5255920 5255941 5255937 5255942 +
tttctttgggatttttattttt

SEQ ID NO: 89751 - DNA, 22 bp, Artificial Sequence
  Synthetic oligonucleotide; TTT chr11 5255921 5255942 5255938 5255943 +
ttctttgggatttttatttttt

SEQ ID NO: 89752 - DNA, 22 bp, Artificial Sequence
  Synthetic oligonucleotide; TTT chr11 5255922 5255943 5255939 5255944 +
tctttgggatttttattttttg

SEQ ID NO: 89753 - DNA, 22 bp, Artificial Sequence
  Synthetic oligonucleotide; TTT chr11 5255923 5255944 5255940 5255945 +
ctttgggatttttattttttgg

SEQ ID NO: 89754 - DNA, 22 bp, Artificial Sequence
  Synthetic oligonucleotide; TTC chr11 5255924 5255945 5255941 5255946 +
tttgggatttttattttttggt

SEQ ID NO: 89755 - DNA, 22 bp, Artificial Sequence
  Synthetic oligonucleotide; CTT chr11 5255926 5255947 5255943 5255948 +
tgggatttttattttttggtag

SEQ ID NO: 89756 - DNA, 22 bp, Artificial Sequence
  Synthetic oligonucleotide; TTT chr11 5255927 5255948 5255944 5255949 +
gggatttttattttttggtagg

SEQ ID NO: 89757 - DNA, 22 bp, Artificial Sequence
  Synthetic oligonucleotide; TTG chr11 5255928 5255949 5255945 5255950 +
ggatttttattttttggtaggt

SEQ ID NO: 89758 - DNA, 22 bp, Artificial Sequence
  Synthetic oligonucleotide; TTT chr11 5255934 5255955 5255951 5255956 +
ttattttttggtaggtttggtt

SEQ ID NO: 89759 - DNA, 22 bp, Artificial Sequence
  Synthetic oligonucleotide; TTT chr11 5255935 5255956 5255952 5255957 +
tattttttggtaggtttggttt

SEQ ID NO: 89760 - DNA, 22 bp, Artificial Sequence
  Synthetic oligonucleotide; TTT chr11 5255936 5255957 5255953 5255958 +
attttttggtaggtttggtttt

SEQ ID NO: 89761 - DNA, 22 bp, Artificial Sequence
  Synthetic oligonucleotide; TTA chr11 5255937 5255958 5255954 5255959 +
ttttttggtaggtttggttttg

SEQ ID NO: 89762 - DNA, 22 bp, Artificial Sequence
  Synthetic oligonucleotide; TTT chr11 5255940 5255961 5255957 5255962 +
tttggtaggtttggttttgctt

SEQ ID NO: 89763 - DNA, 22 bp, Artificial Sequence
  Synthetic oligonucleotide; TTT chr11 5255941 5255962 5255958 5255963 +
ttggtaggtttggttttgcttt

SEQ ID NO: 89764 - DNA, 22 bp, Artificial Sequence
  Synthetic oligonucleotide; TTT chr11 5255942 5255963 5255959 5255964 +
tggtaggtttggttttgctttt

SEQ ID NO: 89765 - DNA, 22 bp, Artificial Sequence
  Synthetic oligonucleotide; TTT chr11 5255943 5255964 5255960 5255965 +
ggtaggtttggttttgcttttg

SEQ ID NO: 89766 - DNA, 22 bp, Artificial Sequence
  Synthetic oligonucleotide; TTG chr11 5255944 5255965 5255961 5255966 +
gtaggtttggttttgcttttgt

SEQ ID NO: 89767 - DNA, 22 bp, Artificial Sequence
  Synthetic oligonucleotide; TTT chr11 5255952 5255973 5255969 5255974 +
ggttttgcttttgttttttctc

SEQ ID NO: 89768 - DNA, 22 bp, Artificial Sequence
  Synthetic oligonucleotide; TTG chr11 5255953 5255974 5255970 5255975 +
gttttgcttttgttttttctct

SEQ ID NO: 89769 - DNA, 22 bp, Artificial Sequence
  Synthetic oligonucleotide; TTT chr11 5255957 5255978 5255974 5255979 +
tgcttttgttttttctctgaac

SEQ ID NO: 89770 - DNA, 22 bp, Artificial Sequence
  Synthetic oligonucleotide; TTT chr11 5255958 5255979 5255975 5255980 +
gcttttgttttttctctgaact

SEQ ID NO: 89771 - DNA, 22 bp, Artificial Sequence
  Synthetic oligonucleotide; TTG chr11 5255959 5255980 5255976 5255981 +
cttttgttttttctctgaactc

SEQ ID NO: 89772 - DNA, 22 bp, Artificial Sequence
  Synthetic oligonucleotide; CTT chr11 5255962 5255983 5255979 5255984 +
ttgttttttctctgaactcgat

SEQ ID NO: 89773 - DNA, 22 bp, Artificial Sequence
  Synthetic oligonucleotide; TTT chr11 5255963 5255984 5255980 5255985 +
tgttttttctctgaactcgatc

SEQ ID NO: 89774 - DNA, 22 bp, Artificial Sequence
  Synthetic oligonucleotide; TTT chr11 5255964 5255985 5255981 5255986 +
gttttttctctgaactcgatcc

SEQ ID NO: 89775 - DNA, 22 bp, Artificial Sequence
  Synthetic oligonucleotide; TTG chr11 5255965 5255986 5255982 5255987 +
ttttttctctgaactcgatcca

SEQ ID NO: 89776 - DNA, 22 bp, Artificial Sequence
  Synthetic oligonucleotide; TTT chr11 5255968 5255989 5255985 5255990 +
tttctctgaactcgatccatga

SEQ ID NO: 89777 - DNA, 22 bp, Artificial Sequence
  Synthetic oligonucleotide; TTT chr11 5255969 5255990 5255986 5255991 +
ttctctgaactcgatccatgac

SEQ ID NO: 89778 - DNA, 22 bp, Artificial Sequence
  Synthetic oligonucleotide; TTT chr11 5255970 5255991 5255987 5255992 +
tctctgaactcgatccatgacc

SEQ ID NO: 89779 - DNA, 22 bp, Artificial Sequence
  Synthetic oligonucleotide; TTT chr11 5255971 5255992 5255988 5255993 +
ctctgaactcgatccatgacct

SEQ ID NO: 89780 - DNA, 22 bp, Artificial Sequence
  Synthetic oligonucleotide; TTC chr11 5255972 5255993 5255989 5255994 +
tctgaactcgatccatgacctt

SEQ ID NO: 89781 - DNA, 22 bp, Artificial Sequence
  Synthetic oligonucleotide; CTC chr11 5255974 5255995 5255991 5255996 +
tgaactcgatccatgaccttgg

SEQ ID NO: 89782 - DNA, 22 bp, Artificial Sequence
  Synthetic oligonucleotide; CTG chr11 5255976 5255997 5255993 5255998 +
aactcgatccatgaccttggta

SEQ ID NO: 89783 - DNA, 22 bp, Artificial Sequence
  Synthetic oligonucleotide; CTC chr11 5255981 5256002 5255998 5256003 +
gatccatgaccttggtagatta

SEQ ID NO: 89784 - DNA, 22 bp, Artificial Sequence
  Synthetic oligonucleotide; CTT chr11 5255994 5256015 5256011 5256016 +
ggtagattatgacgtcagaaac

SEQ ID NO: 89785 - DNA, 22 bp, Artificial Sequence
  Synthetic oligonucleotide; TTG chr11 5255995 5256016 5256012 5256017 +
gtagattatgacgtcagaaact

SEQ ID NO: 89786 - DNA, 22 bp, Artificial Sequence
  Synthetic oligonucleotide; TTA chr11 5256003 5256024 5256020 5256025 +
tgacgtcagaaactctggaaat

SEQ ID NO: 89787 - DNA, 22 bp, Artificial Sequence
  Synthetic oligonucleotide; CTC chr11 5256018 5256039 5256035 5256040 +
tggaaatctggcttattggagg

SEQ ID NO: 89788 - DNA, 22 bp, Artificial Sequence
  Synthetic oligonucleotide; CTG chr11 5256020 5256041 5256037 5256042 +
gaaatctggcttattggaggag

SEQ ID NO: 89789 - DNA, 22 bp, Artificial Sequence
  Synthetic oligonucleotide; CTG chr11 5256028 5256049 5256045 5256050 +
gcttattggaggagagctctac

SEQ ID NO: 89790 - DNA, 22 bp, Artificial Sequence
  Synthetic oligonucleotide; CTT chr11 5256032 5256053 5256049 5256054 +
attggaggagagctctaccttc

SEQ ID NO: 89791 - DNA, 22 bp, Artificial Sequence
  Synthetic oligonucleotide; TTA chr11 5256033 5256054 5256050 5256055 +
ttggaggagagctctaccttcc

SEQ ID NO: 89792 - DNA, 22 bp, Artificial Sequence
  Synthetic oligonucleotide; TTG chr11 5256036 5256057 5256053 5256058 +
gaggagagctctaccttcccct

SEQ ID NO: 89793 - DNA, 22 bp, Artificial Sequence
  Synthetic oligonucleotide; CTC chr11 5256047 5256068 5256064 5256069 +
taccttcccctaacctatcagg

SEQ ID NO: 89794 - DNA, 22 bp, Artificial Sequence
  Synthetic oligonucleotide; CTA chr11 5256049 5256070 5256066 5256071 +
ccttcccctaacctatcaggtt

SEQ ID NO: 89795 - DNA, 22 bp, Artificial Sequence
  Synthetic oligonucleotide; CTT chr11 5256053 5256074 5256070 5256075 +
cccctaacctatcaggttgata

SEQ ID NO: 89796 - DNA, 22 bp, Artificial Sequence
  Synthetic oligonucleotide; TTC chr11 5256054 5256075 5256071 5256076 +
ccctaacctatcaggttgatag

SEQ ID NO: 89797 - DNA, 22 bp, Artificial Sequence
  Synthetic oligonucleotide; CTA chr11 5256059 5256080 5256076 5256081 +
acctatcaggttgataggaatt

SEQ ID NO: 89798 - DNA, 22 bp, Artificial Sequence
  Synthetic oligonucleotide; CTA chr11 5256064 5256085 5256081 5256086 +
tcaggttgataggaattataat

SEQ ID NO: 89799 - DNA, 22 bp, Artificial Sequence
  Synthetic oligonucleotide; TTG chr11 5256072 5256093 5256089 5256094 +
ataggaattataataatattgg

SEQ ID NO: 89800 - DNA, 22 bp, Artificial Sequence
  Synthetic oligonucleotide; TTA chr11 5256082 5256103 5256099 5256104 +
taataatattggtggaatcctt

SEQ ID NO: 89801 - DNA, 22 bp, Artificial Sequence
  Synthetic oligonucleotide; TTG chr11 5256093 5256114 5256110 5256115 +
gtggaatcctttcagacttcat

SEQ ID NO: 89802 - DNA, 22 bp, Artificial Sequence
  Synthetic oligonucleotide; CTT chr11 5256104 5256125 5256121 5256126 +
tcagacttcataatcctgtgta

SEQ ID NO: 89803 - DNA, 22 bp, Artificial Sequence
  Synthetic oligonucleotide; TTT chr11 5256105 5256126 5256122 5256127 +
cagacttcataatcctgtgtaa

SEQ ID NO: 89804 - DNA, 22 bp, Artificial Sequence
  Synthetic oligonucleotide; TTC chr11 5256106 5256127 5256123 5256128 +
agacttcataatcctgtgtaag

SEQ ID NO: 89805 - DNA, 22 bp, Artificial Sequence
  Synthetic oligonucleotide; CTT chr11 5256112 5256133 5256129 5256134 +
cataatcctgtgtaaggcttat

SEQ ID NO: 89806 - DNA, 22 bp, Artificial Sequence
  Synthetic oligonucleotide; TTC chr11 5256113 5256134 5256130 5256135 +
ataatcctgtgtaaggcttata

SEQ ID NO: 89807 - DNA, 22 bp, Artificial Sequence
  Synthetic oligonucleotide; CTG chr11 5256122 5256143 5256139 5256144 +
tgtaaggcttatatctgctcaa

SEQ ID NO: 89808 - DNA, 22 bp, Artificial Sequence
  Synthetic oligonucleotide; CTT chr11 5256132 5256153 5256149 5256154 +
atatctgctcaaagtgttaggc

SEQ ID NO: 89809 - DNA, 22 bp, Artificial Sequence
  Synthetic oligonucleotide; TTA chr11 5256133 5256154 5256150 5256155 +
tatctgctcaaagtgttaggcg

SEQ ID NO: 89810 - DNA, 22 bp, Artificial Sequence
  Synthetic oligonucleotide; CTG chr11 5256139 5256160 5256156 5256161 +
ctcaaagtgttaggcggctaaa

SEQ ID NO: 89811 - DNA, 22 bp, Artificial Sequence
  Synthetic oligonucleotide; CTC chr11 5256142 5256163 5256159 5256164 +
aaagtgttaggcggctaaaaga

SEQ ID NO: 89812 - DNA, 22 bp, Artificial Sequence
  Synthetic oligonucleotide; TTA chr11 5256151 5256172 5256168 5256173 +
ggcggctaaaagaccagaaaga

SEQ ID NO: 89813 - DNA, 22 bp, Artificial Sequence
  Synthetic oligonucleotide; CTA chr11 5256159 5256180 5256176 5256181 +
aaagaccagaaagatacatgtt

SEQ ID NO: 89814 - DNA, 22 bp, Artificial Sequence
  Synthetic oligonucleotide; TTG chr11 5256182 5256203 5256199 5256204 +
acctgcgcaacaaagctgcaca

SEQ ID NO: 89815 - DNA, 22 bp, Artificial Sequence
  Synthetic oligonucleotide; CTG chr11 5256187 5256208 5256204 5256209 +
cgcaacaaagctgcacatattg

SEQ ID NO: 89816 - DNA, 22 bp, Artificial Sequence
  Synthetic oligonucleotide; CTG chr11 5256200 5256221 5256217 5256222 +
cacatattgcacttgttctttg

SEQ ID NO: 89817 - DNA, 22 bp, Artificial Sequence
  Synthetic oligonucleotide; TTG chr11 5256209 5256230 5256226 5256231 +
cacttgttctttggaagttaaa

SEQ ID NO: 89818 - DNA, 22 bp, Artificial Sequence
  Synthetic oligonucleotide; CTT chr11 5256214 5256235 5256231 5256236 +
gttctttggaagttaaaataaa

SEQ ID NO: 89819 - DNA, 22 bp, Artificial Sequence
  Synthetic oligonucleotide; TTG chr11 5256215 5256236 5256232 5256237 +
ttctttggaagttaaaataaaa

SEQ ID NO: 89820 - DNA, 22 bp, Artificial Sequence
  Synthetic oligonucleotide; TTC chr11 5256218 5256239 5256235 5256240 +
tttggaagttaaaataaaagtt

SEQ ID NO: 89821 - DNA, 22 bp, Artificial Sequence
  Synthetic oligonucleotide; CTT chr11 5256220 5256241 5256237 5256242 +
tggaagttaaaataaaagttga

SEQ ID NO: 89822 - DNA, 22 bp, Artificial Sequence
  Synthetic oligonucleotide; TTT chr11 5256221 5256242 5256238 5256243 +
ggaagttaaaataaaagttgaa

SEQ ID NO: 89823 - DNA, 22 bp, Artificial Sequence
  Synthetic oligonucleotide; TTG chr11 5256222 5256243 5256239 5256244 +
gaagttaaaataaaagttgaat

SEQ ID NO: 89824 - DNA, 22 bp, Artificial Sequence
  Synthetic oligonucleotide; TTA chr11 5256229 5256250 5256246 5256251 +
aaataaaagttgaataagaaag

SEQ ID NO: 89825 - DNA, 22 bp, Artificial Sequence
  Synthetic oligonucleotide; TTG chr11 5256241 5256262 5256258 5256263 +
aataagaaaggaaagaaaaaga

SEQ ID NO: 89826 - DNA, 22 bp, Artificial Sequence
  Synthetic oligonucleotide; TTT chr11 5256266 5256287 5256283 5256288 +
gtcaacttatcagtatcttcca

SEQ ID NO: 89827 - DNA, 22 bp, Artificial Sequence
  Synthetic oligonucleotide; TTG chr11 5256267 5256288 5256284 5256289 +
tcaacttatcagtatcttccag

SEQ ID NO: 89828 - DNA, 22 bp, Artificial Sequence
  Synthetic oligonucleotide; CTT chr11 5256274 5256295 5256291 5256296 +
atcagtatcttccagttactca

SEQ ID NO: 89829 - DNA, 22 bp, Artificial Sequence
  Synthetic oligonucleotide; TTA chr11 5256275 5256296 5256292 5256297 +
tcagtatcttccagttactcac

SEQ ID NO: 89830 - DNA, 22 bp, Artificial Sequence
  Synthetic oligonucleotide; CTT chr11 5256285 5256306 5256302 5256307 +
ccagttactcacataataataa

SEQ ID NO: 89831 - DNA, 22 bp, Artificial Sequence
  Synthetic oligonucleotide; TTC chr11 5256286 5256307 5256303 5256308 +
cagttactcacataataataag

SEQ ID NO: 89832 - DNA, 22 bp, Artificial Sequence
  Synthetic oligonucleotide; TTA chr11 5256292 5256313 5256309 5256314 +
ctcacataataataagtgactt

SEQ ID NO: 89833 - DNA, 22 bp, Artificial Sequence
  Synthetic oligonucleotide; CTC chr11 5256295 5256316 5256312 5256317 +
acataataataagtgacttctc

SEQ ID NO: 89834 - DNA, 22 bp, Artificial Sequence
  Synthetic oligonucleotide; CTT chr11 5256314 5256335 5256331 5256336 +
ctctcaatctaaggatgggtga

SEQ ID NO: 89835 - DNA, 22 bp, Artificial Sequence
  Synthetic oligonucleotide; TTC chr11 5256315 5256336 5256332 5256337 +
tctcaatctaaggatgggtgag

SEQ ID NO: 89836 - DNA, 22 bp, Artificial Sequence
  Synthetic oligonucleotide; CTC chr11 5256317 5256338 5256334 5256339 +
tcaatctaaggatgggtgagaa

SEQ ID NO: 89837 - DNA, 22 bp, Artificial Sequence
  Synthetic oligonucleotide; CTC chr11 5256319 5256340 5256336 5256341 +
aatctaaggatgggtgagaaag

SEQ ID NO: 89838 - DNA, 22 bp, Artificial Sequence
  Synthetic oligonucleotide; CTA chr11 5256325 5256346 5256342 5256347 +
aggatgggtgagaaagattttt

SEQ ID NO: 89839 - DNA, 22 bp, Artificial Sequence
  Synthetic oligonucleotide; TTT chr11 5256345 5256366 5256362 5256367 +
ttattggtatgctggtacagat

SEQ ID NO: 89840 - DNA, 22 bp, Artificial Sequence
  Synthetic oligonucleotide; TTT chr11 5256346 5256367 5256363 5256368 +
tattggtatgctggtacagatt

SEQ ID NO: 89841 - DNA, 22 bp, Artificial Sequence
  Synthetic oligonucleotide; TTT chr11 5256347 5256368 5256364 5256369 +
attggtatgctggtacagatta

SEQ ID NO: 89842 - DNA, 22 bp, Artificial Sequence
  Synthetic oligonucleotide; TTA chr11 5256348 5256369 5256365 5256370 +
ttggtatgctggtacagattat

SEQ ID NO: 89843 - DNA, 22 bp, Artificial Sequence
  Synthetic oligonucleotide; TTG chr11 5256351 5256372 5256368 5256373 +
gtatgctggtacagattataga

SEQ ID NO: 89844 - DNA, 22 bp, Artificial Sequence
  Synthetic oligonucleotide; CTG chr11 5256359 5256380 5256376 5256381 +
gtacagattatagagactgagg

SEQ ID NO: 89845 - DNA, 22 bp, Artificial Sequence
  Synthetic oligonucleotide; TTA chr11 5256369 5256390 5256386 5256391 +
tagagactgaggtgaacccaaa

SEQ ID NO: 89846 - DNA, 22 bp, Artificial Sequence
  Synthetic oligonucleotide; CTG chr11 5256378 5256399 5256395 5256400 +
aggtgaacccaaattagggtct

SEQ ID NO: 89847 - DNA, 22 bp, Artificial Sequence
  Synthetic oligonucleotide; TTA chr11 5256394 5256415 5256411 5256416 +
gggtctctttaagataggggat

SEQ ID NO: 89848 - DNA, 22 bp, Artificial Sequence
  Synthetic oligonucleotide; CTC chr11 5256401 5256422 5256418 5256423 +
tttaagataggggatctgtgag

SEQ ID NO: 89849 - DNA, 22 bp, Artificial Sequence
  Synthetic oligonucleotide; CTT chr11 5256403 5256424 5256420 5256425 +
taagataggggatctgtgagat

SEQ ID NO: 89850 - DNA, 22 bp, Artificial Sequence
  Synthetic oligonucleotide; TTT chr11 5256404 5256425 5256421 5256426 +
aagataggggatctgtgagatg

SEQ ID NO: 89851 - DNA, 22 bp, Artificial Sequence
  Synthetic oligonucleotide; TTA chr11 5256405 5256426 5256422 5256427 +
agataggggatctgtgagatgg

SEQ ID NO: 89852 - DNA, 22 bp, Artificial Sequence
  Synthetic oligonucleotide; CTG chr11 5256419 5256440 5256436 5256441 +
tgagatgggtgtgtatagatct

SEQ ID NO: 89853 - DNA, 22 bp, Artificial Sequence
  Synthetic oligonucleotide; CTT chr11 5256442 5256463 5256459 5256464 +
tggccatatctgagagtctggt

SEQ ID NO: 89854 - DNA, 22 bp, Artificial Sequence
  Synthetic oligonucleotide; TTT chr11 5256443 5256464 5256460 5256465 +
ggccatatctgagagtctggtt

SEQ ID NO: 89855 - DNA, 22 bp, Artificial Sequence
  Synthetic oligonucleotide; TTG chr11 5256444 5256465 5256461 5256466 +
gccatatctgagagtctggttg

SEQ ID NO: 89856 - DNA, 22 bp, Artificial Sequence
  Synthetic oligonucleotide; CTG chr11 5256454 5256475 5256471 5256476 +
agagtctggttgggttccattt

SEQ ID NO: 89857 - DNA, 22 bp, Artificial Sequence
  Synthetic oligonucleotide; CTG chr11 5256462 5256483 5256479 5256484 +
gttgggttccatttgtagagcc

SEQ ID NO: 89858 - DNA, 22 bp, Artificial Sequence
  Synthetic oligonucleotide; TTG chr11 5256466 5256487 5256483 5256488 +
ggttccatttgtagagcctgac

SEQ ID NO: 89859 - DNA, 22 bp, Artificial Sequence
  Synthetic oligonucleotide; TTC chr11 5256471 5256492 5256488 5256493 +
catttgtagagcctgaccttta

SEQ ID NO: 89860 - DNA, 22 bp, Artificial Sequence
  Synthetic oligonucleotide; TTT chr11 5256476 5256497 5256493 5256498 +
gtagagcctgacctttaagaat

SEQ ID NO: 89861 - DNA, 22 bp, Artificial Sequence
  Synthetic oligonucleotide; TTG chr11 5256477 5256498 5256494 5256499 +
tagagcctgacctttaagaatg

SEQ ID NO: 89862 - DNA, 22 bp, Artificial Sequence
  Synthetic oligonucleotide; CTG chr11 5256486 5256507 5256503 5256508 +
acctttaagaatgtgtcagaga

SEQ ID NO: 89863 - DNA, 22 bp, Artificial Sequence
  Synthetic oligonucleotide; CTT chr11 5256491 5256512 5256508 5256513 +
taagaatgtgtcagagactggt

SEQ ID NO: 89864 - DNA, 22 bp, Artificial Sequence
  Synthetic oligonucleotide; TTT chr11 5256492 5256513 5256509 5256514 +
aagaatgtgtcagagactggtg

SEQ ID NO: 89865 - DNA, 22 bp, Artificial Sequence
  Synthetic oligonucleotide; TTA chr11 5256493 5256514 5256510 5256515 +
agaatgtgtcagagactggtgt

SEQ ID NO: 89866 - DNA, 22 bp, Artificial Sequence
  Synthetic oligonucleotide; CTG chr11 5256511 5256532 5256528 5256533 +
gtgtctaagcccgctaaggcct

SEQ ID NO: 89867 - DNA, 22 bp, Artificial Sequence
  Synthetic oligonucleotide; CTA chr11 5256518 5256539 5256535 5256540 +
agcccgctaaggcctaaacaag

SEQ ID NO: 89868 - DNA, 22 bp, Artificial Sequence
  Synthetic oligonucleotide; CTA chr11 5256527 5256548 5256544 5256549 +
aggcctaaacaagtgaatcttt

SEQ ID NO: 89869 - DNA, 22 bp, Artificial Sequence
  Synthetic oligonucleotide; CTA chr11 5256534 5256555 5256551 5256556 +
aacaagtgaatcttttgaatct

SEQ ID NO: 89870 - DNA, 22 bp, Artificial Sequence
  Synthetic oligonucleotide; CTT chr11 5256548 5256569 5256565 5256570 +
ttgaatctctcttttttttttt

SEQ ID NO: 89871 - DNA, 22 bp, Artificial Sequence
  Synthetic oligonucleotide; TTT chr11 5256549 5256570 5256566 5256571 +
tgaatctctctttttttttttt

SEQ ID NO: 89872 - DNA, 22 bp, Artificial Sequence
  Synthetic oligonucleotide; TTT chr11 5256550 5256571 5256567 5256572 +
gaatctctcttttttttttttg

SEQ ID NO: 89873 - DNA, 22 bp, Artificial Sequence
  Synthetic oligonucleotide; TTG chr11 5256551 5256572 5256568 5256573 +
aatctctcttttttttttttga

SEQ ID NO: 89874 - DNA, 22 bp, Artificial Sequence
  Synthetic oligonucleotide; CTC chr11 5256557 5256578 5256574 5256579 +
tcttttttttttttgagacaga

SEQ ID NO: 89875 - DNA, 22 bp, Artificial Sequence
  Synthetic oligonucleotide; CTC chr11 5256559 5256580 5256576 5256581 +
ttttttttttttgagacagagt

SEQ ID NO: 89876 - DNA, 22 bp, Artificial Sequence
  Synthetic oligonucleotide; CTT chr11 5256561 5256582 5256578 5256583 +
ttttttttttgagacagagtct

SEQ ID NO: 89877 - DNA, 22 bp, Artificial Sequence
  Synthetic oligonucleotide; TTT chr11 5256562 5256583 5256579 5256584 +
tttttttttgagacagagtctt

SEQ ID NO: 89878 - DNA, 22 bp, Artificial Sequence
  Synthetic oligonucleotide; TTT chr11 5256563 5256584 5256580 5256585 +
ttttttttgagacagagtcttg

SEQ ID NO: 89879 - DNA, 22 bp, Artificial Sequence
  Synthetic oligonucleotide; TTT chr11 5256564 5256585 5256581 5256586 +
tttttttgagacagagtcttgt

SEQ ID NO: 89880 - DNA, 22 bp, Artificial Sequence
  Synthetic oligonucleotide; TTT chr11 5256565 5256586 5256582 5256587 +
ttttttgagacagagtcttgtt

SEQ ID NO: 89881 - DNA, 22 bp, Artificial Sequence
  Synthetic oligonucleotide; TTT chr11 5256566 5256587 5256583 5256588 +
tttttgagacagagtcttgttc

SEQ ID NO: 89882 - DNA, 22 bp, Artificial Sequence
  Synthetic oligonucleotide; TTT chr11 5256567 5256588 5256584 5256589 +
ttttgagacagagtcttgttct

SEQ ID NO: 89883 - DNA, 22 bp, Artificial Sequence
  Synthetic oligonucleotide; TTT chr11 5256568 5256589 5256585 5256590 +
tttgagacagagtcttgttctg

SEQ ID NO: 89884 - DNA, 22 bp, Artificial Sequence
  Synthetic oligonucleotide; TTT chr11 5256569 5256590 5256586 5256591 +
ttgagacagagtcttgttctgt

SEQ ID NO: 89885 - DNA, 22 bp, Artificial Sequence
  Synthetic oligonucleotide; TTT chr11 5256570 5256591 5256587 5256592 +
tgagacagagtcttgttctgtc

SEQ ID NO: 89886 - DNA, 22 bp, Artificial Sequence
  Synthetic oligonucleotide; TTT chr11 5256571 5256592 5256588 5256593 +
gagacagagtcttgttctgtca

SEQ ID NO: 89887 - DNA, 22 bp, Artificial Sequence
  Synthetic oligonucleotide; TTG chr11 5256572 5256593 5256589 5256594 +
agacagagtcttgttctgtcac

SEQ ID NO: 89888 - DNA, 22 bp, Artificial Sequence
  Synthetic oligonucleotide; CTT chr11 5256584 5256605 5256601 5256606 +
gttctgtcacccaggctggagt

SEQ ID NO: 89889 - DNA, 22 bp, Artificial Sequence
  Synthetic oligonucleotide; TTG chr11 5256585 5256606 5256602 5256607 +
ttctgtcacccaggctggagtg

SEQ ID NO: 89890 - DNA, 22 bp, Artificial Sequence
  Synthetic oligonucleotide; TTC chr11 5256588 5256609 5256605 5256610 +
tgtcacccaggctggagtgcag

SEQ ID NO: 89891 - DNA, 22 bp, Artificial Sequence
  Synthetic oligonucleotide; CTG chr11 5256590 5256611 5256607 5256612 +
tcacccaggctggagtgcagtg

SEQ ID NO: 89892 - DNA, 22 bp, Artificial Sequence
  Synthetic oligonucleotide; CTG chr11 5256602 5256623 5256619 5256624 +
gagtgcagtggtatgatctcgg

SEQ ID NO: 89893 - DNA, 22 bp, Artificial Sequence
  Synthetic oligonucleotide; CTC chr11 5256622 5256643 5256639 5256644 +
ggctcactgcaactcctgcctt

SEQ ID NO: 89894 - DNA, 22 bp, Artificial Sequence
  Synthetic oligonucleotide; CTC chr11 5256627 5256648 5256644 5256649 +
actgcaactcctgccttccagg

SEQ ID NO: 89895 - DNA, 22 bp, Artificial Sequence
  Synthetic oligonucleotide; CTG chr11 5256631 5256652 5256648 5256653 +
caactcctgccttccaggttca

SEQ ID NO: 89896 - DNA, 22 bp, Artificial Sequence
  Synthetic oligonucleotide; CTC chr11 5256637 5256658 5256654 5256659 +
ctgccttccaggttcaagcaat

SEQ ID NO: 89897 - DNA, 22 bp, Artificial Sequence
  Synthetic oligonucleotide; CTG chr11 5256640 5256661 5256657 5256662 +
ccttccaggttcaagcaattct

SEQ ID NO: 89898 - DNA, 22 bp, Artificial Sequence
  Synthetic oligonucleotide; CTT chr11 5256644 5256665 5256661 5256666 +
ccaggttcaagcaattctcctt

SEQ ID NO: 89899 - DNA, 22 bp, Artificial Sequence
  Synthetic oligonucleotide; TTC chr11 5256645 5256666 5256662 5256667 +
caggttcaagcaattctccttc

SEQ ID NO: 89900 - DNA, 22 bp, Artificial Sequence
  Synthetic oligonucleotide; TTC chr11 5256652 5256673 5256669 5256674 +
aagcaattctccttcctcagcc

SEQ ID NO: 89901 - DNA, 22 bp, Artificial Sequence
  Synthetic oligonucleotide; TTC chr11 5256661 5256682 5256678 5256683 +
tccttcctcagcctcccaagta

SEQ ID NO: 89902 - DNA, 22 bp, Artificial Sequence
  Synthetic oligonucleotide; CTC chr11 5256663 5256684 5256680 5256685 +
cttcctcagcctcccaagtagc

SEQ ID NO: 89903 - DNA, 22 bp, Artificial Sequence
  Synthetic oligonucleotide; CTT chr11 5256666 5256687 5256683 5256688 +
cctcagcctcccaagtagctgg

SEQ ID NO: 89904 - DNA, 22 bp, Artificial Sequence
  Synthetic oligonucleotide; TTC chr11 5256667 5256688 5256684 5256689 +
ctcagcctcccaagtagctggg

SEQ ID NO: 89905 - DNA, 22 bp, Artificial Sequence
  Synthetic oligonucleotide; CTC chr11 5256670 5256691 5256687 5256692 +
agcctcccaagtagctgggatt

SEQ ID NO: 89906 - DNA, 22 bp, Artificial Sequence
  Synthetic oligonucleotide; CTC chr11 5256676 5256697 5256693 5256698 +
ccaagtagctgggattacaggc

SEQ ID NO: 89907 - DNA, 22 bp, Artificial Sequence
  Synthetic oligonucleotide; CTG chr11 5256687 5256708 5256704 5256709 +
ggattacaggcacttgccatca

SEQ ID NO: 89908 - DNA, 22 bp, Artificial Sequence
  Synthetic oligonucleotide; TTA chr11 5256693 5256714 5256710 5256715 +
caggcacttgccatcatgcctg

SEQ ID NO: 89909 - DNA, 22 bp, Artificial Sequence
  Synthetic oligonucleotide; CTT chr11 5256702 5256723 5256719 5256724 +
gccatcatgcctgtctaatttt

SEQ ID NO: 89910 - DNA, 22 bp, Artificial Sequence
  Synthetic oligonucleotide; TTG chr11 5256703 5256724 5256720 5256725 +
ccatcatgcctgtctaattttt

SEQ ID NO: 89911 - DNA, 22 bp, Artificial Sequence
  Synthetic oligonucleotide; CTG chr11 5256715 5256736 5256732 5256737 +
tctaatttttgtatttttgtag

SEQ ID NO: 89912 - DNA, 22 bp, Artificial Sequence
  Synthetic oligonucleotide; CTA chr11 5256719 5256740 5256736 5256741 +
atttttgtatttttgtagagat

SEQ ID NO: 89913 - DNA, 22 bp, Artificial Sequence
  Synthetic oligonucleotide; TTT chr11 5256723 5256744 5256740 5256745 +
ttgtatttttgtagagatggga

SEQ ID NO: 89914 - DNA, 22 bp, Artificial Sequence
  Synthetic oligonucleotide; TTT chr11 5256724 5256745 5256741 5256746 +
tgtatttttgtagagatgggat

SEQ ID NO: 89915 - DNA, 22 bp, Artificial Sequence
  Synthetic oligonucleotide; TTT chr11 5256725 5256746 5256742 5256747 +
gtatttttgtagagatgggatt

SEQ ID NO: 89916 - DNA, 22 bp, Artificial Sequence
  Synthetic oligonucleotide; TTG chr11 5256726 5256747 5256743 5256748 +
tatttttgtagagatgggattt

SEQ ID NO: 89917 - DNA, 22 bp, Artificial Sequence
  Synthetic oligonucleotide; TTT chr11 5256731 5256752 5256748 5256753 +
ttgtagagatgggatttcacca

SEQ ID NO: 89918 - DNA, 22 bp, Artificial Sequence
  Synthetic oligonucleotide; TTT chr11 5256732 5256753 5256749 5256754 +
tgtagagatgggatttcaccat

SEQ ID NO: 89919 - DNA, 22 bp, Artificial Sequence
  Synthetic oligonucleotide; TTT chr11 5256733 5256754 5256750 5256755 +
gtagagatgggatttcaccatg

SEQ ID NO: 89920 - DNA, 22 bp, Artificial Sequence
  Synthetic oligonucleotide; TTG chr11 5256734 5256755 5256751 5256756 +
tagagatgggatttcaccatgt

SEQ ID NO: 89921 - DNA, 22 bp, Artificial Sequence
  Synthetic oligonucleotide; TTT chr11 5256748 5256769 5256765 5256770 +
caccatgttggccaggttggtc

SEQ ID NO: 89922 - DNA, 22 bp, Artificial Sequence
  Synthetic oligonucleotide; TTC chr11 5256749 5256770 5256766 5256771 +
accatgttggccaggttggtct

SEQ ID NO: 89923 - DNA, 22 bp, Artificial Sequence
  Synthetic oligonucleotide; TTG chr11 5256758 5256779 5256775 5256780 +
gccaggttggtcttgaactctt

SEQ ID NO: 89924 - DNA, 22 bp, Artificial Sequence
  Synthetic oligonucleotide; TTG chr11 5256767 5256788 5256784 5256789 +
gtcttgaactcttgacctcagg

SEQ ID NO: 89925 - DNA, 22 bp, Artificial Sequence
  Synthetic oligonucleotide; CTT chr11 5256772 5256793 5256789 5256794 +
gaactcttgacctcaggtgatc

SEQ ID NO: 89926 - DNA, 22 bp, Artificial Sequence
  Synthetic oligonucleotide; TTG chr11 5256773 5256794 5256790 5256795 +
aactcttgacctcaggtgatct

SEQ ID NO: 89927 - DNA, 22 bp, Artificial Sequence
  Synthetic oligonucleotide; CTC chr11 5256778 5256799 5256795 5256800 +
ttgacctcaggtgatctgcctg

SEQ ID NO: 89928 - DNA, 22 bp, Artificial Sequence
  Synthetic oligonucleotide; CTT chr11 5256780 5256801 5256797 5256802 +
gacctcaggtgatctgcctgcc

SEQ ID NO: 89929 - DNA, 22 bp, Artificial Sequence
  Synthetic oligonucleotide; TTG chr11 5256781 5256802 5256798 5256803 +
acctcaggtgatctgcctgcct

SEQ ID NO: 89930 - DNA, 22 bp, Artificial Sequence
  Synthetic oligonucleotide; CTC chr11 5256786 5256807 5256803 5256808 +
aggtgatctgcctgccttggcc

SEQ ID NO: 89931 - DNA, 22 bp, Artificial Sequence
  Synthetic oligonucleotide; CTG chr11 5256796 5256817 5256813 5256818 +
cctgccttggcctcccaaaatt

SEQ ID NO: 89932 - DNA, 22 bp, Artificial Sequence
  Synthetic oligonucleotide; CTG chr11 5256800 5256821 5256817 5256822 +
ccttggcctcccaaaattctgg

SEQ ID NO: 89933 - DNA, 22 bp, Artificial Sequence
  Synthetic oligonucleotide; CTT chr11 5256804 5256825 5256821 5256826 +
ggcctcccaaaattctgggatt

SEQ ID NO: 89934 - DNA, 22 bp, Artificial Sequence
  Synthetic oligonucleotide; TTG chr11 5256805 5256826 5256822 5256827 +
gcctcccaaaattctgggatta

SEQ ID NO: 89935 - DNA, 22 bp, Artificial Sequence
  Synthetic oligonucleotide; CTC chr11 5256810 5256831 5256827 5256832 +
ccaaaattctgggattacaggc

SEQ ID NO: 89936 - DNA, 22 bp, Artificial Sequence
  Synthetic oligonucleotide; TTC chr11 5256819 5256840 5256836 5256841 +
tgggattacaggcgtgagccac

SEQ ID NO: 89937 - DNA, 22 bp, Artificial Sequence
  Synthetic oligonucleotide; CTG chr11 5256821 5256842 5256838 5256843 +
ggattacaggcgtgagccacca

SEQ ID NO: 89938 - DNA, 22 bp, Artificial Sequence
  Synthetic oligonucleotide; TTA chr11 5256827 5256848 5256844 5256849 +
caggcgtgagccaccactccca

SEQ ID NO: 89939 - DNA, 22 bp, Artificial Sequence
  Synthetic oligonucleotide; CTC chr11 5256846 5256867 5256863 5256868 +
ccagcctctaaacaagtgaatc

SEQ ID NO: 89940 - DNA, 22 bp, Artificial Sequence
  Synthetic oligonucleotide; CTC chr11 5256854 5256875 5256871 5256876 +
taaacaagtgaatcttaattgc

SEQ ID NO: 89941 - DNA, 22 bp, Artificial Sequence
  Synthetic oligonucleotide; CTA chr11 5256856 5256877 5256873 5256878 +
aacaagtgaatcttaattgctc

SEQ ID NO: 89942 - DNA, 22 bp, Artificial Sequence
  Synthetic oligonucleotide; CTT chr11 5256870 5256891 5256887 5256892 +
aattgctcctcctcagactaag

SEQ ID NO: 89943 - DNA, 22 bp, Artificial Sequence
  Synthetic oligonucleotide; TTA chr11 5256871 5256892 5256888 5256893 +
attgctcctcctcagactaagg

SEQ ID NO: 89944 - DNA, 22 bp, Artificial Sequence
  Synthetic oligonucleotide; TTG chr11 5256875 5256896 5256892 5256897 +
ctcctcctcagactaaggaata

SEQ ID NO: 89945 - DNA, 22 bp, Artificial Sequence
  Synthetic oligonucleotide; CTC chr11 5256878 5256899 5256895 5256900 +
ctcctcagactaaggaatatct

SEQ ID NO: 89946 - DNA, 22 bp, Artificial Sequence
  Synthetic oligonucleotide; CTC chr11 5256881 5256902 5256898 5256903 +
ctcagactaaggaatatctagg

SEQ ID NO: 89947 - DNA, 22 bp, Artificial Sequence
  Synthetic oligonucleotide; CTC chr11 5256884 5256905 5256901 5256906 +
agactaaggaatatctaggatc

SEQ ID NO: 89948 - DNA, 22 bp, Artificial Sequence
  Synthetic oligonucleotide; CTA chr11 5256890 5256911 5256907 5256912 +
aggaatatctaggatccctcct

SEQ ID NO: 89949 - DNA, 22 bp, Artificial Sequence
  Synthetic oligonucleotide; CTA chr11 5256901 5256922 5256918 5256923 +
ggatccctcctgttttcaaaca

SEQ ID NO: 89950 - DNA, 22 bp, Artificial Sequence
  Synthetic oligonucleotide; CTC chr11 5256910 5256931 5256927 5256932 +
ctgttttcaaacaacttcccca

SEQ ID NO: 89951 - DNA, 22 bp, Artificial Sequence
  Synthetic oligonucleotide; CTG chr11 5256913 5256934 5256930 5256935 +
ttttcaaacaacttccccattt

SEQ ID NO: 89952 - DNA, 22 bp, Artificial Sequence
  Synthetic oligonucleotide; TTT chr11 5256916 5256937 5256933 5256938 +
tcaaacaacttccccatttatc

SEQ ID NO: 89953 - DNA, 22 bp, Artificial Sequence
  Synthetic oligonucleotide; TTT chr11 5256917 5256938 5256934 5256939 +
caaacaacttccccatttatcc

SEQ ID NO: 89954 - DNA, 22 bp, Artificial Sequence
  Synthetic oligonucleotide; TTC chr11 5256918 5256939 5256935 5256940 +
aaacaacttccccatttatcca

SEQ ID NO: 89955 - DNA, 22 bp, Artificial Sequence
  Synthetic oligonucleotide; CTT chr11 5256927 5256948 5256944 5256949 +
ccccatttatccaaaaaccaag

SEQ ID NO: 89956 - DNA, 22 bp, Artificial Sequence
  Synthetic oligonucleotide; TTC chr11 5256928 5256949 5256945 5256950 +
cccatttatccaaaaaccaagg

SEQ ID NO: 89957 - DNA, 22 bp, Artificial Sequence
  Synthetic oligonucleotide; TTT chr11 5256935 5256956 5256952 5256957 +
atccaaaaaccaaggcagtgtt

SEQ ID NO: 89958 - DNA, 22 bp, Artificial Sequence
  Synthetic oligonucleotide; TTA chr11 5256936 5256957 5256953 5256958 +
tccaaaaaccaaggcagtgttc

SEQ ID NO: 89959 - DNA, 22 bp, Artificial Sequence
  Synthetic oligonucleotide; TTC chr11 5256958 5256979 5256975 5256980 +
taaaagtcatgtataaaccctt

SEQ ID NO: 89960 - DNA, 22 bp, Artificial Sequence
  Synthetic oligonucleotide; CTA chr11 5256960 5256981 5256977 5256982 +
aaagtcatgtataaacccttat

SEQ ID NO: 89961 - DNA, 22 bp, Artificial Sequence
  Synthetic oligonucleotide; CTT chr11 5256980 5257001 5256997 5257002 +
atttcctcttatgcttttgagg

SEQ ID NO: 89962 - DNA, 22 bp, Artificial Sequence
  Synthetic oligonucleotide; TTA chr11 5256981 5257002 5256998 5257003 +
tttcctcttatgcttttgaggc

SEQ ID NO: 89963 - DNA, 22 bp, Artificial Sequence
  Synthetic oligonucleotide; TTT chr11 5256984 5257005 5257001 5257006 +
cctcttatgcttttgaggcaat

SEQ ID NO: 89964 - DNA, 22 bp, Artificial Sequence
  Synthetic oligonucleotide; TTC chr11 5256985 5257006 5257002 5257007 +
ctcttatgcttttgaggcaata

SEQ ID NO: 89965 - DNA, 22 bp, Artificial Sequence
  Synthetic oligonucleotide; CTC chr11 5256988 5257009 5257005 5257010 +
ttatgcttttgaggcaatatct

SEQ ID NO: 89966 - DNA, 22 bp, Artificial Sequence
  Synthetic oligonucleotide; CTT chr11 5256990 5257011 5257007 5257012 +
atgcttttgaggcaatatcttt

SEQ ID NO: 89967 - DNA, 22 bp, Artificial Sequence
  Synthetic oligonucleotide; TTA chr11 5256991 5257012 5257008 5257013 +
tgcttttgaggcaatatctttt

SEQ ID NO: 89968 - DNA, 22 bp, Artificial Sequence
  Synthetic oligonucleotide; CTT chr11 5256996 5257017 5257013 5257018 +
ttgaggcaatatcttttaagag

SEQ ID NO: 89969 - DNA, 22 bp, Artificial Sequence
  Synthetic oligonucleotide; TTT chr11 5256997 5257018 5257014 5257019 +
tgaggcaatatcttttaagagt

SEQ ID NO: 89970 - DNA, 22 bp, Artificial Sequence
  Synthetic oligonucleotide; TTT chr11 5256998 5257019 5257015 5257020 +
gaggcaatatcttttaagagtt

SEQ ID NO: 89971 - DNA, 22 bp, Artificial Sequence
  Synthetic oligonucleotide; TTG chr11 5256999 5257020 5257016 5257021 +
aggcaatatcttttaagagttt

SEQ ID NO: 89972 - DNA, 22 bp, Artificial Sequence
  Synthetic oligonucleotide; CTT chr11 5257011 5257032 5257028 5257033 +
ttaagagtttgttgatttctcc

SEQ ID NO: 89973 - DNA, 22 bp, Artificial Sequence
  Synthetic oligonucleotide; TTT chr11 5257012 5257033 5257029 5257034 +
taagagtttgttgatttctcct

SEQ ID NO: 89974 - DNA, 22 bp, Artificial Sequence
  Synthetic oligonucleotide; TTT chr11 5257013 5257034 5257030 5257035 +
aagagtttgttgatttctcctt

SEQ ID NO: 89975 - DNA, 22 bp, Artificial Sequence
  Synthetic oligonucleotide; TTA chr11 5257014 5257035 5257031 5257036 +
agagtttgttgatttctcctta

SEQ ID NO: 89976 - DNA, 22 bp, Artificial Sequence
  Synthetic oligonucleotide; TTT chr11 5257021 5257042 5257038 5257043 +
gttgatttctccttatccataa

SEQ ID NO: 89977 - DNA, 22 bp, Artificial Sequence
  Synthetic oligonucleotide; TTG chr11 5257022 5257043 5257039 5257044 +
ttgatttctccttatccataac

SEQ ID NO: 89978 - DNA, 22 bp, Artificial Sequence
  Synthetic oligonucleotide; TTG chr11 5257025 5257046 5257042 5257047 +
atttctccttatccataactgt

SEQ ID NO: 89979 - DNA, 22 bp, Artificial Sequence
  Synthetic oligonucleotide; TTT chr11 5257029 5257050 5257046 5257051 +
ctccttatccataactgtctta

SEQ ID NO: 89980 - DNA, 22 bp, Artificial Sequence
  Synthetic oligonucleotide; TTC chr11 5257030 5257051 5257047 5257052 +
tccttatccataactgtcttat

SEQ ID NO: 89981 - DNA, 22 bp, Artificial Sequence
  Synthetic oligonucleotide; CTC chr11 5257032 5257053 5257049 5257054 +
cttatccataactgtcttattc

SEQ ID NO: 89982 - DNA, 22 bp, Artificial Sequence
  Synthetic oligonucleotide; CTT chr11 5257035 5257056 5257052 5257057 +
atccataactgtcttattcctc

SEQ ID NO: 89983 - DNA, 22 bp, Artificial Sequence
  Synthetic oligonucleotide; TTA chr11 5257036 5257057 5257053 5257058 +
tccataactgtcttattcctcg

SEQ ID NO: 89984 - DNA, 22 bp, Artificial Sequence
  Synthetic oligonucleotide; CTG chr11 5257046 5257067 5257063 5257068 +
tcttattcctcgatttttccta

SEQ ID NO: 89985 - DNA, 22 bp, Artificial Sequence
  Synthetic oligonucleotide; CTT chr11 5257050 5257071 5257067 5257072 +
attcctcgatttttcctatatc

SEQ ID NO: 89986 - DNA, 22 bp, Artificial Sequence
  Synthetic oligonucleotide; TTA chr11 5257051 5257072 5257068 5257073 +
ttcctcgatttttcctatatca

SEQ ID NO: 89987 - DNA, 22 bp, Artificial Sequence
  Synthetic oligonucleotide; TTC chr11 5257054 5257075 5257071 5257076 +
ctcgatttttcctatatcattg

SEQ ID NO: 89988 - DNA, 22 bp, Artificial Sequence
  Synthetic oligonucleotide; CTC chr11 5257057 5257078 5257074 5257079 +
gatttttcctatatcattgctt

SEQ ID NO: 89989 - DNA, 22 bp, Artificial Sequence
  Synthetic oligonucleotide; TTT chr11 5257062 5257083 5257079 5257084 +
ttcctatatcattgcttctgac

SEQ ID NO: 89990 - DNA, 22 bp, Artificial Sequence
  Synthetic oligonucleotide; TTT chr11 5257063 5257084 5257080 5257085 +
tcctatatcattgcttctgaca

SEQ ID NO: 89991 - DNA, 22 bp, Artificial Sequence
  Synthetic oligonucleotide; TTT chr11 5257064 5257085 5257081 5257086 +
cctatatcattgcttctgacat

SEQ ID NO: 89992 - DNA, 22 bp, Artificial Sequence
  Synthetic oligonucleotide; TTC chr11 5257065 5257086 5257082 5257087 +
ctatatcattgcttctgacatt

SEQ ID NO: 89993 - DNA, 22 bp, Artificial Sequence
  Synthetic oligonucleotide; CTA chr11 5257068 5257089 5257085 5257090 +
tatcattgcttctgacattgat

SEQ ID NO: 89994 - DNA, 22 bp, Artificial Sequence
  Synthetic oligonucleotide; TTG chr11 5257076 5257097 5257093 5257098 +
cttctgacattgattaaatcct

SEQ ID NO: 89995 - DNA, 22 bp, Artificial Sequence
  Synthetic oligonucleotide; CTT chr11 5257079 5257100 5257096 5257101 +
ctgacattgattaaatcctaac

SEQ ID NO: 89996 - DNA, 22 bp, Artificial Sequence
  Synthetic oligonucleotide; TTC chr11 5257080 5257101 5257097 5257102 +
tgacattgattaaatcctaact

SEQ ID NO: 89997 - DNA, 22 bp, Artificial Sequence
  Synthetic oligonucleotide; CTG chr11 5257082 5257103 5257099 5257104 +
acattgattaaatcctaactga

SEQ ID NO: 89998 - DNA, 22 bp, Artificial Sequence
  Synthetic oligonucleotide; TTG chr11 5257088 5257109 5257105 5257110 +
attaaatcctaactgataaaac

SEQ ID NO: 89999 - DNA, 22 bp, Artificial Sequence
  Synthetic oligonucleotide; TTA chr11 5257092 5257113 5257109 5257114 +
aatcctaactgataaaactgtt

SEQ ID NO: 90000 - DNA, 22 bp, Artificial Sequence
  Synthetic oligonucleotide; CTA chr11 5257099 5257120 5257116 5257121 +
actgataaaactgtttctttac

SEQ ID NO: 90001 - DNA, 22 bp, Artificial Sequence
  Synthetic oligonucleotide; CTG chr11 5257103 5257124 5257120 5257125 +
ataaaactgtttctttacacaa

SEQ ID NO: 90002 - DNA, 22 bp, Artificial Sequence
  Synthetic oligonucleotide; CTG chr11 5257112 5257133 5257129 5257134 +
tttctttacacaagcaatttca

SEQ ID NO: 90003 - DNA, 22 bp, Artificial Sequence
  Synthetic oligonucleotide; TTT chr11 5257115 5257136 5257132 5257137 +
ctttacacaagcaatttcaagt

SEQ ID NO: 90004 - DNA, 22 bp, Artificial Sequence
  Synthetic oligonucleotide; TTC chr11 5257116 5257137 5257133 5257138 +
tttacacaagcaatttcaagtg

SEQ ID NO: 90005 - DNA, 22 bp, Artificial Sequence
  Synthetic oligonucleotide; CTT chr11 5257118 5257139 5257135 5257140 +
tacacaagcaatttcaagtgtt

SEQ ID NO: 90006 - DNA, 22 bp, Artificial Sequence
  Synthetic oligonucleotide; TTT chr11 5257119 5257140 5257136 5257141 +
acacaagcaatttcaagtgttt

SEQ ID NO: 90007 - DNA, 22 bp, Artificial Sequence
  Synthetic oligonucleotide; TTA chr11 5257120 5257141 5257137 5257142 +
cacaagcaatttcaagtgtttt

SEQ ID NO: 90008 - DNA, 22 bp, Artificial Sequence
  Synthetic oligonucleotide; TTT chr11 5257132 5257153 5257149 5257154 +
caagtgttttcaagcattcttt

SEQ ID NO: 90009 - DNA, 22 bp, Artificial Sequence
  Synthetic oligonucleotide; TTC chr11 5257133 5257154 5257150 5257155 +
aagtgttttcaagcattctttc

SEQ ID NO: 90010 - DNA, 22 bp, Artificial Sequence
  Synthetic oligonucleotide; TTT chr11 5257141 5257162 5257158 5257163 +
tcaagcattctttcccatgtat

SEQ ID NO: 90011 - DNA, 22 bp, Artificial Sequence
  Synthetic oligonucleotide; TTT chr11 5257142 5257163 5257159 5257164 +
caagcattctttcccatgtatt

SEQ ID NO: 90012 - DNA, 22 bp, Artificial Sequence
  Synthetic oligonucleotide; TTC chr11 5257143 5257164 5257160 5257165 +
aagcattctttcccatgtattt

SEQ ID NO: 90013 - DNA, 22 bp, Artificial Sequence
  Synthetic oligonucleotide; TTC chr11 5257151 5257172 5257168 5257173 +
tttcccatgtattttcaaacat

SEQ ID NO: 90014 - DNA, 22 bp, Artificial Sequence
  Synthetic oligonucleotide; CTT chr11 5257153 5257174 5257170 5257175 +
tcccatgtattttcaaacattt

SEQ ID NO: 90015 - DNA, 22 bp, Artificial Sequence
  Synthetic oligonucleotide; TTT chr11 5257154 5257175 5257171 5257176 +
cccatgtattttcaaacatttg

SEQ ID NO: 90016 - DNA, 22 bp, Artificial Sequence
  Synthetic oligonucleotide; TTC chr11 5257155 5257176 5257172 5257177 +
ccatgtattttcaaacatttgt

SEQ ID NO: 90017 - DNA, 22 bp, Artificial Sequence
  Synthetic oligonucleotide; TTT chr11 5257165 5257186 5257182 5257187 +
tcaaacatttgttcagcaaata

SEQ ID NO: 90018 - DNA, 22 bp, Artificial Sequence
  Synthetic oligonucleotide; TTT chr11 5257166 5257187 5257183 5257188 +
caaacatttgttcagcaaatat

SEQ ID NO: 90019 - DNA, 22 bp, Artificial Sequence
  Synthetic oligonucleotide; TTC chr11 5257167 5257188 5257184 5257189 +
aaacatttgttcagcaaatatc

SEQ ID NO: 90020 - DNA, 22 bp, Artificial Sequence
  Synthetic oligonucleotide; TTT chr11 5257175 5257196 5257192 5257197 +
gttcagcaaatatctgttaaat

SEQ ID NO: 90021 - DNA, 22 bp, Artificial Sequence
  Synthetic oligonucleotide; TTG chr11 5257176 5257197 5257193 5257198 +
ttcagcaaatatctgttaaata

SEQ ID NO: 90022 - DNA, 22 bp, Artificial Sequence
  Synthetic oligonucleotide; TTC chr11 5257179 5257200 5257196 5257201 +
agcaaatatctgttaaataaat

SEQ ID NO: 90023 - DNA, 22 bp, Artificial Sequence
  Synthetic oligonucleotide; CTG chr11 5257191 5257212 5257208 5257213 +
ttaaataaatgtcataattttt

SEQ ID NO: 90024 - DNA, 22 bp, Artificial Sequence
  Synthetic oligonucleotide; TTA chr11 5257194 5257215 5257211 5257216 +
aataaatgtcataatttttaaa

SEQ ID NO: 90025 - DNA, 22 bp, Artificial Sequence
  Synthetic oligonucleotide; TTT chr11 5257211 5257232 5257228 5257233 +
ttaaagtagtgggcatttaagt

SEQ ID NO: 90026 - DNA, 22 bp, Artificial Sequence
  Synthetic oligonucleotide; TTT chr11 5257212 5257233 5257229 5257234 +
taaagtagtgggcatttaagtt

SEQ ID NO: 90027 - DNA, 22 bp, Artificial Sequence
  Synthetic oligonucleotide; TTT chr11 5257213 5257234 5257230 5257235 +
aaagtagtgggcatttaagtta

SEQ ID NO: 90028 - DNA, 22 bp, Artificial Sequence
  Synthetic oligonucleotide; TTA chr11 5257214 5257235 5257231 5257236 +
aagtagtgggcatttaagttaa

SEQ ID NO: 90029 - DNA, 22 bp, Artificial Sequence
  Synthetic oligonucleotide; TTT chr11 5257229 5257250 5257246 5257251 +
aagttaaataagtcagagaata

SEQ ID NO: 90030 - DNA, 22 bp, Artificial Sequence
  Synthetic oligonucleotide; TTA chr11 5257230 5257251 5257247 5257252 +
agttaaataagtcagagaataa

SEQ ID NO: 90031 - DNA, 22 bp, Artificial Sequence
  Synthetic oligonucleotide; TTA chr11 5257235 5257256 5257252 5257257 +
aataagtcagagaataaaactt

SEQ ID NO: 90032 - DNA, 22 bp, Artificial Sequence
  Synthetic oligonucleotide; CTT chr11 5257257 5257278 5257274 5257279 +
tcctctgaagattataatctag

SEQ ID NO: 90033 - DNA, 22 bp, Artificial Sequence
  Synthetic oligonucleotide; TTT chr11 5257258 5257279 5257275 5257280 +
cctctgaagattataatctagg

SEQ ID NO: 90034 - DNA, 22 bp, Artificial Sequence
  Synthetic oligonucleotide; TTC chr11 5257259 5257280 5257276 5257281 +
ctctgaagattataatctaggt

SEQ ID NO: 90035 - DNA, 22 bp, Artificial Sequence
  Synthetic oligonucleotide; CTC chr11 5257262 5257283 5257279 5257284 +
tgaagattataatctaggtaga

SEQ ID NO: 90036 - DNA, 22 bp, Artificial Sequence
  Synthetic oligonucleotide; CTG chr11 5257264 5257285 5257281 5257286 +
aagattataatctaggtagaac

SEQ ID NO: 90037 - DNA, 22 bp, Artificial Sequence
  Synthetic oligonucleotide; TTA chr11 5257271 5257292 5257288 5257293 +
taatctaggtagaacatacata

SEQ ID NO: 90038 - DNA, 22 bp, Artificial Sequence
  Synthetic oligonucleotide; CTA chr11 5257278 5257299 5257295 5257300 +
ggtagaacatacataaaattaa

SEQ ID NO: 90039 - DNA, 22 bp, Artificial Sequence
  Synthetic oligonucleotide; TTA chr11 5257299 5257320 5257316 5257321 +
ataattaagttaaacaacaaaa

SEQ ID NO: 90040 - DNA, 22 bp, Artificial Sequence
  Synthetic oligonucleotide; TTA chr11 5257306 5257327 5257323 5257328 +
agttaaacaacaaaataatttc

SEQ ID NO: 90041 - DNA, 22 bp, Artificial Sequence
  Synthetic oligonucleotide; TTA chr11 5257311 5257332 5257328 5257333 +
aacaacaaaataatttcagata

SEQ ID NO: 90042 - DNA, 22 bp, Artificial Sequence
  Synthetic oligonucleotide; TTT chr11 5257327 5257348 5257344 5257349 +
cagatattattaactaagaatg

SEQ ID NO: 90043 - DNA, 22 bp, Artificial Sequence
  Synthetic oligonucleotide; TTC chr11 5257328 5257349 5257345 5257350 +
agatattattaactaagaatga

SEQ ID NO: 90044 - DNA, 22 bp, Artificial Sequence
  Synthetic oligonucleotide; TTA chr11 5257336 5257357 5257353 5257358 +
ttaactaagaatgaaattaagg

SEQ ID NO: 90045 - DNA, 22 bp, Artificial Sequence
  Synthetic oligonucleotide; TTA chr11 5257339 5257360 5257356 5257361 +
actaagaatgaaattaaggaga

SEQ ID NO: 90046 - DNA, 22 bp, Artificial Sequence
  Synthetic oligonucleotide; CTA chr11 5257343 5257364 5257360 5257365 +
agaatgaaattaaggagaaagt

SEQ ID NO: 90047 - DNA, 22 bp, Artificial Sequence
  Synthetic oligonucleotide; TTA chr11 5257355 5257376 5257372 5257377 +
aggagaaagtattcgaacagag

SEQ ID NO: 90048 - DNA, 22 bp, Artificial Sequence
  Synthetic oligonucleotide; TTC chr11 5257369 5257390 5257386 5257391 +
gaacagaggcaaaatgacagaa

SEQ ID NO: 90049 - DNA, 22 bp, Artificial Sequence
  Synthetic oligonucleotide; CTG chr11 5257399 5257420 5257416 5257421 +
ccatgggaaggcattgccaaat

SEQ ID NO: 90050 - DNA, 22 bp, Artificial Sequence
  Synthetic oligonucleotide; TTG chr11 5257415 5257436 5257432 5257437 +
ccaaataaagtttagaagctga

SEQ ID NO: 90051 - DNA, 22 bp, Artificial Sequence
  Synthetic oligonucleotide; TTT chr11 5257428 5257449 5257445 5257450 +
agaagctgaaatagtaaattca

SEQ ID NO: 90052 - DNA, 22 bp, Artificial Sequence
  Synthetic oligonucleotide; TTA chr11 5257429 5257450 5257446 5257451 +
gaagctgaaatagtaaattcaa

SEQ ID NO: 90053 - DNA, 22 bp, Artificial Sequence
  Synthetic oligonucleotide; CTG chr11 5257436 5257457 5257453 5257458 +
aaatagtaaattcaaagctctg

SEQ ID NO: 90054 - DNA, 22 bp, Artificial Sequence
  Synthetic oligonucleotide; TTC chr11 5257449 5257470 5257466 5257471 +
aaagctctgaagcagaagaaaa

SEQ ID NO: 90055 - DNA, 22 bp, Artificial Sequence
  Synthetic oligonucleotide; CTC chr11 5257456 5257477 5257473 5257478 +
tgaagcagaagaaaacaaactc

SEQ ID NO: 90056 - DNA, 22 bp, Artificial Sequence
  Synthetic oligonucleotide; CTG chr11 5257458 5257479 5257475 5257480 +
aagcagaagaaaacaaactcct

SEQ ID NO: 90057 - DNA, 22 bp, Artificial Sequence
  Synthetic oligonucleotide; CTC chr11 5257478 5257499 5257495 5257500 +
ctgctgtgccagagagttagat

SEQ ID NO: 90058 - DNA, 22 bp, Artificial Sequence
  Synthetic oligonucleotide; CTG chr11 5257481 5257502 5257498 5257503 +
ctgtgccagagagttagataaa

SEQ ID NO: 90059 - DNA, 22 bp, Artificial Sequence
  Synthetic oligonucleotide; CTG chr11 5257484 5257505 5257501 5257506 +
tgccagagagttagataaagaa

SEQ ID NO: 90060 - DNA, 22 bp, Artificial Sequence
  Synthetic oligonucleotide; TTA chr11 5257497 5257518 5257514 5257519 +
gataaagaaccagtgccgttga

SEQ ID NO: 90061 - DNA, 22 bp, Artificial Sequence
  Synthetic oligonucleotide; TTG chr11 5257518 5257539 5257535 5257540 +
atatgtaaagtggagaatagca

SEQ ID NO: 90062 - DNA, 22 bp, Artificial Sequence
  Synthetic oligonucleotide; TTG chr11 5257550 5257571 5257567 5257572 +
tttcagggaagcataaacctaa

SEQ ID NO: 90063 - DNA, 22 bp, Artificial Sequence
  Synthetic oligonucleotide; TTT chr11 5257553 5257574 5257570 5257575 +
cagggaagcataaacctaagga

SEQ ID NO: 90064 - DNA, 22 bp, Artificial Sequence
  Synthetic oligonucleotide; TTC chr11 5257554 5257575 5257571 5257576 +
agggaagcataaacctaaggac

SEQ ID NO: 90065 - DNA, 22 bp, Artificial Sequence
  Synthetic oligonucleotide; CTA chr11 5257571 5257592 5257588 5257593 +
aggacataaacttgtcctcagt

SEQ ID NO: 90066 - DNA, 22 bp, Artificial Sequence
  Synthetic oligonucleotide; CTT chr11 5257584 5257605 5257601 5257606 +
gtcctcagtggtagggagtgag

SEQ ID NO: 90067 - DNA, 22 bp, Artificial Sequence
  Synthetic oligonucleotide; TTG chr11 5257585 5257606 5257602 5257607 +
tcctcagtggtagggagtgaga

SEQ ID NO: 90068 - DNA, 22 bp, Artificial Sequence
  Synthetic oligonucleotide; CTC chr11 5257590 5257611 5257607 5257612 +
agtggtagggagtgagaagcca

SEQ ID NO: 90069 - DNA, 22 bp, Artificial Sequence
  Synthetic oligonucleotide; TTA chr11 5257615 5257636 5257632 5257637 +
tagaattttaactctggtaatg

SEQ ID NO: 90070 - DNA, 22 bp, Artificial Sequence
  Synthetic oligonucleotide; TTT chr11 5257623 5257644 5257640 5257645 +
taactctggtaatgacataatc

SEQ ID NO: 90071 - DNA, 22 bp, Artificial Sequence
  Synthetic oligonucleotide; TTT chr11 5257624 5257645 5257641 5257646 +
aactctggtaatgacataatct

SEQ ID NO: 90072 - DNA, 22 bp, Artificial Sequence
  Synthetic oligonucleotide; TTA chr11 5257625 5257646 5257642 5257647 +
actctggtaatgacataatctc

SEQ ID NO: 90073 - DNA, 22 bp, Artificial Sequence
  Synthetic oligonucleotide; CTC chr11 5257629 5257650 5257646 5257651 +
tggtaatgacataatctctaag

SEQ ID NO: 90074 - DNA, 22 bp, Artificial Sequence
  Synthetic oligonucleotide; CTG chr11 5257631 5257652 5257648 5257653 +
gtaatgacataatctctaagca

SEQ ID NO: 90075 - DNA, 22 bp, Artificial Sequence
  Synthetic oligonucleotide; CTC chr11 5257647 5257668 5257664 5257669 +
taagcaacctgtactattggct

SEQ ID NO: 90076 - DNA, 22 bp, Artificial Sequence
  Synthetic oligonucleotide; CTA chr11 5257649 5257670 5257666 5257671 +
agcaacctgtactattggctgg

SEQ ID NO: 90077 - DNA, 22 bp, Artificial Sequence
  Synthetic oligonucleotide; CTG chr11 5257658 5257679 5257675 5257680 +
tactattggctggattactatt

SEQ ID NO: 90078 - DNA, 22 bp, Artificial Sequence
  Synthetic oligonucleotide; CTA chr11 5257663 5257684 5257680 5257685 +
ttggctggattactattctaag

SEQ ID NO: 90079 - DNA, 22 bp, Artificial Sequence
  Synthetic oligonucleotide; TTG chr11 5257666 5257687 5257683 5257688 +
gctggattactattctaagaat

SEQ ID NO: 90080 - DNA, 22 bp, Artificial Sequence
  Synthetic oligonucleotide; CTG chr11 5257670 5257691 5257687 5257692 +
gattactattctaagaatgacc

SEQ ID NO: 90081 - DNA, 22 bp, Artificial Sequence
  Synthetic oligonucleotide; TTA chr11 5257675 5257696 5257692 5257697 +
ctattctaagaatgacctgttt

SEQ ID NO: 90082 - DNA, 22 bp, Artificial Sequence
  Synthetic oligonucleotide; CTA chr11 5257678 5257699 5257695 5257700 +
ttctaagaatgacctgtttatc

SEQ ID NO: 90083 - DNA, 22 bp, Artificial Sequence
  Synthetic oligonucleotide; TTC chr11 5257681 5257702 5257698 5257703 +
taagaatgacctgtttatcaca

SEQ ID NO: 90084 - DNA, 22 bp, Artificial Sequence
  Synthetic oligonucleotide; CTA chr11 5257683 5257704 5257700 5257705 +
agaatgacctgtttatcacaac

SEQ ID NO: 90085 - DNA, 22 bp, Artificial Sequence
  Synthetic oligonucleotide; CTG chr11 5257694 5257715 5257711 5257716 +
tttatcacaactgttttgctta

SEQ ID NO: 90086 - DNA, 22 bp, Artificial Sequence
  Synthetic oligonucleotide; TTT chr11 5257697 5257718 5257714 5257719 +
atcacaactgttttgcttaaaa

SEQ ID NO: 90087 - DNA, 22 bp, Artificial Sequence
  Synthetic oligonucleotide; TTA chr11 5257698 5257719 5257715 5257720 +
tcacaactgttttgcttaaaaa

SEQ ID NO: 90088 - DNA, 22 bp, Artificial Sequence
  Synthetic oligonucleotide; CTG chr11 5257707 5257728 5257724 5257729 +
ttttgcttaaaaagcccttatt

SEQ ID NO: 90089 - DNA, 22 bp, Artificial Sequence
  Synthetic oligonucleotide; TTT chr11 5257710 5257731 5257727 5257732 +
tgcttaaaaagcccttattgcc

SEQ ID NO: 90090 - DNA, 22 bp, Artificial Sequence
  Synthetic oligonucleotide; TTT chr11 5257711 5257732 5257728 5257733 +
gcttaaaaagcccttattgcct

SEQ ID NO: 90091 - DNA, 22 bp, Artificial Sequence
  Synthetic oligonucleotide; TTG chr11 5257712 5257733 5257729 5257734 +
cttaaaaagcccttattgcctg

SEQ ID NO: 90092 - DNA, 22 bp, Artificial Sequence
  Synthetic oligonucleotide; CTT chr11 5257715 5257736 5257732 5257737 +
aaaaagcccttattgcctgtgg

SEQ ID NO: 90093 - DNA, 22 bp, Artificial Sequence
  Synthetic oligonucleotide; TTA chr11 5257716 5257737 5257733 5257738 +
aaaagcccttattgcctgtgga

SEQ ID NO: 90094 - DNA, 22 bp, Artificial Sequence
  Synthetic oligonucleotide; CTT chr11 5257726 5257747 5257743 5257748 +
attgcctgtggacaattattag

SEQ ID NO: 90095 - DNA, 22 bp, Artificial Sequence
  Synthetic oligonucleotide; TTA chr11 5257727 5257748 5257744 5257749 +
ttgcctgtggacaattattagt

SEQ ID NO: 90096 - DNA, 22 bp, Artificial Sequence
  Synthetic oligonucleotide; TTG chr11 5257730 5257751 5257747 5257752 +
cctgtggacaattattagttat

SEQ ID NO: 90097 - DNA, 22 bp, Artificial Sequence
  Synthetic oligonucleotide; CTG chr11 5257734 5257755 5257751 5257756 +
tggacaattattagttattctt

SEQ ID NO: 90098 - DNA, 22 bp, Artificial Sequence
  Synthetic oligonucleotide; TTA chr11 5257744 5257765 5257761 5257766 +
ttagttattctttcaactatta

SEQ ID NO: 90099 - DNA, 22 bp, Artificial Sequence
  Synthetic oligonucleotide; TTA chr11 5257747 5257768 5257764 5257769 +
gttattctttcaactattaaaa

SEQ ID NO: 90100 - DNA, 22 bp, Artificial Sequence
  Synthetic oligonucleotide; TTA chr11 5257751 5257772 5257768 5257773 +
ttctttcaactattaaaaatct

SEQ ID NO: 90101 - DNA, 22 bp, Artificial Sequence
  Synthetic oligonucleotide; TTC chr11 5257754 5257775 5257771 5257776 +
tttcaactattaaaaatcttgt

SEQ ID NO: 90102 - DNA, 22 bp, Artificial Sequence
  Synthetic oligonucleotide; CTT chr11 5257756 5257777 5257773 5257778 +
tcaactattaaaaatcttgtca

SEQ ID NO: 90103 - DNA, 22 bp, Artificial Sequence
  Synthetic oligonucleotide; TTT chr11 5257757 5257778 5257774 5257779 +
caactattaaaaatcttgtcat

SEQ ID NO: 90104 - DNA, 22 bp, Artificial Sequence
  Synthetic oligonucleotide; TTC chr11 5257758 5257779 5257775 5257780 +
aactattaaaaatcttgtcatg

SEQ ID NO: 90105 - DNA, 22 bp, Artificial Sequence
  Synthetic oligonucleotide; CTA chr11 5257763 5257784 5257780 5257785 +
ttaaaaatcttgtcatgcagat

SEQ ID NO: 90106 - DNA, 22 bp, Artificial Sequence
  Synthetic oligonucleotide; TTA chr11 5257766 5257787 5257783 5257788 +
aaaatcttgtcatgcagatgtg

SEQ ID NO: 90107 - DNA, 22 bp, Artificial Sequence
  Synthetic oligonucleotide; CTT chr11 5257774 5257795 5257791 5257796 +
gtcatgcagatgtgtgtgtgtg

SEQ ID NO: 90108 - DNA, 22 bp, Artificial Sequence
  Synthetic oligonucleotide; TTG chr11 5257775 5257796 5257792 5257797 +
tcatgcagatgtgtgtgtgtgt

SEQ ID NO: 90109 - DNA, 22 bp, Artificial Sequence
  Synthetic oligonucleotide; TTC chr11 5257807 5257828 5257824 5257829 +
attatgaatttgctttcaatta

SEQ ID NO: 90110 - DNA, 22 bp, Artificial Sequence
  Synthetic oligonucleotide; TTA chr11 5257811 5257832 5257828 5257833 +
tgaatttgctttcaattaagtt

SEQ ID NO: 90111 - DNA, 22 bp, Artificial Sequence
  Synthetic oligonucleotide; TTT chr11 5257818 5257839 5257835 5257840 +
gctttcaattaagttatcttga

SEQ ID NO: 90112 - DNA, 22 bp, Artificial Sequence
  Synthetic oligonucleotide; TTG chr11 5257819 5257840 5257836 5257841 +
ctttcaattaagttatcttgaa

SEQ ID NO: 90113 - DNA, 22 bp, Artificial Sequence
  Synthetic oligonucleotide; CTT chr11 5257822 5257843 5257839 5257844 +
tcaattaagttatcttgaattg

SEQ ID NO: 90114 - DNA, 22 bp, Artificial Sequence
  Synthetic oligonucleotide; TTT chr11 5257823 5257844 5257840 5257845 +
caattaagttatcttgaattgg

SEQ ID NO: 90115 - DNA, 22 bp, Artificial Sequence
  Synthetic oligonucleotide; TTC chr11 5257824 5257845 5257841 5257846 +
aattaagttatcttgaattggc

SEQ ID NO: 90116 - DNA, 22 bp, Artificial Sequence
  Synthetic oligonucleotide; TTA chr11 5257829 5257850 5257846 5257851 +
agttatcttgaattggcaatat

SEQ ID NO: 90117 - DNA, 22 bp, Artificial Sequence
  Synthetic oligonucleotide; TTA chr11 5257834 5257855 5257851 5257856 +
tcttgaattggcaatatctaaa

SEQ ID NO: 90118 - DNA, 22 bp, Artificial Sequence
  Synthetic oligonucleotide; CTT chr11 5257838 5257859 5257855 5257860 +
gaattggcaatatctaaatcta

SEQ ID NO: 90119 - DNA, 22 bp, Artificial Sequence
  Synthetic oligonucleotide; TTG chr11 5257839 5257860 5257856 5257861 +
aattggcaatatctaaatctag

SEQ ID NO: 90120 - DNA, 22 bp, Artificial Sequence
  Synthetic oligonucleotide; TTG chr11 5257844 5257865 5257861 5257866 +
gcaatatctaaatctagatata

SEQ ID NO: 90121 - DNA, 22 bp, Artificial Sequence
  Synthetic oligonucleotide; CTA chr11 5257854 5257875 5257871 5257876 +
aatctagatatagctccctaag

SEQ ID NO: 90122 - DNA, 22 bp, Artificial Sequence
  Synthetic oligonucleotide; CTA chr11 5257860 5257881 5257877 5257882 +
gatatagctccctaaggggtaa

SEQ ID NO: 90123 - DNA, 22 bp, Artificial Sequence
  Synthetic oligonucleotide; CTC chr11 5257870 5257891 5257887 5257892 +
cctaaggggtaaagagtgtatc

SEQ ID NO: 90124 - DNA, 22 bp, Artificial Sequence
  Synthetic oligonucleotide; CTA chr11 5257874 5257895 5257891 5257896 +
aggggtaaagagtgtatccact

SEQ ID NO: 90125 - DNA, 22 bp, Artificial Sequence
  Synthetic oligonucleotide; CTG chr11 5257897 5257918 5257914 5257919 +
cccacccctcaacatcacgtcc

SEQ ID NO: 90126 - DNA, 22 bp, Artificial Sequence
  Synthetic oligonucleotide; CTC chr11 5257907 5257928 5257924 5257929 +
aacatcacgtccttgattcctt

SEQ ID NO: 90127 - DNA, 22 bp, Artificial Sequence
  Synthetic oligonucleotide; CTT chr11 5257921 5257942 5257938 5257943 +
gattccttgatatcaaagggca

SEQ ID NO: 90128 - DNA, 22 bp, Artificial Sequence
  Synthetic oligonucleotide; TTG chr11 5257922 5257943 5257939 5257944 +
attccttgatatcaaagggcag

SEQ ID NO: 90129 - DNA, 22 bp, Artificial Sequence
  Synthetic oligonucleotide; TTC chr11 5257926 5257947 5257943 5257948 +
cttgatatcaaagggcagtata

SEQ ID NO: 90130 - DNA, 22 bp, Artificial Sequence
  Synthetic oligonucleotide; CTT chr11 5257929 5257950 5257946 5257951 +
gatatcaaagggcagtatagtt

SEQ ID NO: 90131 - DNA, 22 bp, Artificial Sequence
  Synthetic oligonucleotide; TTG chr11 5257930 5257951 5257947 5257952 +
atatcaaagggcagtatagttt

SEQ ID NO: 90132 - DNA, 22 bp, Artificial Sequence
  Synthetic oligonucleotide; TTT chr11 5257952 5257973 5257969 5257974 +
tgggggagaagaaaaagagaga

SEQ ID NO: 90133 - DNA, 22 bp, Artificial Sequence
  Synthetic oligonucleotide; TTT chr11 5257953 5257974 5257970 5257975 +
gggggagaagaaaaagagagag

SEQ ID NO: 90134 - DNA, 22 bp, Artificial Sequence
  Synthetic oligonucleotide; TTG chr11 5257954 5257975 5257971 5257976 +
ggggagaagaaaaagagagaga

SEQ ID NO: 90135 - DNA, 22 bp, Artificial Sequence
  Synthetic oligonucleotide; TTG chr11 5257991 5258012 5258008 5258013 +
attaaaaatgcatattaccgac

SEQ ID NO: 90136 - DNA, 22 bp, Artificial Sequence
  Synthetic oligonucleotide; TTA chr11 5257995 5258016 5258012 5258017 +
aaaatgcatattaccgacaaat

SEQ ID NO: 90137 - DNA, 22 bp, Artificial Sequence
  Synthetic oligonucleotide; TTA chr11 5258008 5258029 5258025 5258030 +
ccgacaaattagagggtgatgg

SEQ ID NO: 90138 - DNA, 22 bp, Artificial Sequence
  Synthetic oligonucleotide; TTA chr11 5258019 5258040 5258036 5258041 +
gagggtgatggcagatgggagg

SEQ ID NO: 90139 - DNA, 22 bp, Artificial Sequence
  Synthetic oligonucleotide; TTG chr11 5258057 5258078 5258074 5258079 +
cagctcccactcggatgcacag

SEQ ID NO: 90140 - DNA, 22 bp, Artificial Sequence
  Synthetic oligonucleotide; CTC chr11 5258063 5258084 5258080 5258085 +
ccactcggatgcacagagcagc

SEQ ID NO: 90141 - DNA, 22 bp, Artificial Sequence
  Synthetic oligonucleotide; CTC chr11 5258069 5258090 5258086 5258091 +
ggatgcacagagcagcatgtga

SEQ ID NO: 90142 - DNA, 22 bp, Artificial Sequence
  Synthetic oligonucleotide; CTC chr11 5258097 5258118 5258114 5258119 +
ccatcaggaattttttttgcag

SEQ ID NO: 90143 - DNA, 22 bp, Artificial Sequence
  Synthetic oligonucleotide; TTT chr11 5258110 5258131 5258127 5258132 +
tttttgcagaaccacctgcaga

SEQ ID NO: 90144 - DNA, 22 bp, Artificial Sequence
  Synthetic oligonucleotide; TTT chr11 5258111 5258132 5258128 5258133 +
ttttgcagaaccacctgcagaa

SEQ ID NO: 90145 - DNA, 22 bp, Artificial Sequence
  Synthetic oligonucleotide; TTT chr11 5258112 5258133 5258129 5258134 +
tttgcagaaccacctgcagaaa

SEQ ID NO: 90146 - DNA, 22 bp, Artificial Sequence
  Synthetic oligonucleotide; TTT chr11 5258113 5258134 5258130 5258135 +
ttgcagaaccacctgcagaaat

SEQ ID NO: 90147 - DNA, 22 bp, Artificial Sequence
  Synthetic oligonucleotide; TTT chr11 5258114 5258135 5258131 5258136 +
tgcagaaccacctgcagaaata

SEQ ID NO: 90148 - DNA, 22 bp, Artificial Sequence
  Synthetic oligonucleotide; TTT chr11 5258115 5258136 5258132 5258137 +
gcagaaccacctgcagaaataa

SEQ ID NO: 90149 - DNA, 22 bp, Artificial Sequence
  Synthetic oligonucleotide; TTG chr11 5258116 5258137 5258133 5258138 +
cagaaccacctgcagaaataaa

SEQ ID NO: 90150 - DNA, 22 bp, Artificial Sequence
  Synthetic oligonucleotide; CTG chr11 5258128 5258149 5258145 5258150 +
cagaaataaatcaagaaagctg

SEQ ID NO: 90151 - DNA, 22 bp, Artificial Sequence
  Synthetic oligonucleotide; CTG chr11 5258150 5258171 5258167 5258172 +
agagaacgcacacaccctctga

SEQ ID NO: 90152 - DNA, 22 bp, Artificial Sequence
  Synthetic oligonucleotide; CTC chr11 5258169 5258190 5258186 5258191 +
tgaaagaagcagattgctcctg

SEQ ID NO: 90153 - DNA, 22 bp, Artificial Sequence
  Synthetic oligonucleotide; CTG chr11 5258171 5258192 5258188 5258193 +
aaagaagcagattgctcctgca

SEQ ID NO: 90154 - DNA, 22 bp, Artificial Sequence
  Synthetic oligonucleotide; TTG chr11 5258185 5258206 5258202 5258207 +
ctcctgcaggacccgggaaaca

SEQ ID NO: 90155 - DNA, 22 bp, Artificial Sequence
  Synthetic oligonucleotide; CTC chr11 5258188 5258209 5258205 5258210 +
ctgcaggacccgggaaacaccc

SEQ ID NO: 90156 - DNA, 22 bp, Artificial Sequence
  Synthetic oligonucleotide; CTG chr11 5258191 5258212 5258208 5258213 +
caggacccgggaaacaccccaa

SEQ ID NO: 90157 - DNA, 22 bp, Artificial Sequence
  Synthetic oligonucleotide; TTG chr11 5258219 5258240 5258236 5258241 +
tgagtgcccaaactgtggaagt

SEQ ID NO: 90158 - DNA, 22 bp, Artificial Sequence
  Synthetic oligonucleotide; CTG chr11 5258234 5258255 5258251 5258256 +
tggaagtggaaaagggggaccg

SEQ ID NO: 90159 - DNA, 22 bp, Artificial Sequence
  Synthetic oligonucleotide; CTA chr11 5258260 5258281 5258277 5258282 +
cccccaaacacacatcctcact

SEQ ID NO: 90160 - DNA, 22 bp, Artificial Sequence
  Synthetic oligonucleotide; CTC chr11 5258279 5258300 5258296 5258301 +
actggggaacctgaagatctag

SEQ ID NO: 90161 - DNA, 22 bp, Artificial Sequence
  Synthetic oligonucleotide; CTG chr11 5258283 5258304 5258300 5258305 +
gggaacctgaagatctagacca

SEQ ID NO: 90162 - DNA, 22 bp, Artificial Sequence
  Synthetic oligonucleotide; CTG chr11 5258292 5258313 5258309 5258314 +
aagatctagaccacaggagaag

SEQ ID NO: 90163 - DNA, 22 bp, Artificial Sequence
  Synthetic oligonucleotide; CTA chr11 5258300 5258321 5258317 5258322 +
gaccacaggagaagattctgac

SEQ ID NO: 90164 - DNA, 22 bp, Artificial Sequence
  Synthetic oligonucleotide; TTC chr11 5258318 5258339 5258335 5258340 +
tgaccttacctggagctgagtc

SEQ ID NO: 90165 - DNA, 22 bp, Artificial Sequence
  Synthetic oligonucleotide; CTG chr11 5258320 5258341 5258337 5258342 +
accttacctggagctgagtcaa

SEQ ID NO: 90166 - DNA, 22 bp, Artificial Sequence
  Synthetic oligonucleotide; CTT chr11 5258325 5258346 5258342 5258347 +
acctggagctgagtcaatttag

SEQ ID NO: 90167 - DNA, 22 bp, Artificial Sequence
  Synthetic oligonucleotide; TTA chr11 5258326 5258347 5258343 5258348 +
cctggagctgagtcaatttaga

SEQ ID NO: 90168 - DNA, 22 bp, Artificial Sequence
  Synthetic oligonucleotide; CTG chr11 5258330 5258351 5258347 5258352 +
gagctgagtcaatttagagggc

SEQ ID NO: 90169 - DNA, 22 bp, Artificial Sequence
  Synthetic oligonucleotide; CTG chr11 5258336 5258357 5258353 5258358 +
agtcaatttagagggccaagca

SEQ ID NO: 90170 - DNA, 22 bp, Artificial Sequence
  Synthetic oligonucleotide; TTT chr11 5258345 5258366 5258362 5258367 +
agagggccaagcaaaatacagg

SEQ ID NO: 90171 - DNA, 22 bp, Artificial Sequence
  Synthetic oligonucleotide; TTA chr11 5258346 5258367 5258363 5258368 +
gagggccaagcaaaatacaggg

SEQ ID NO: 90172 - DNA, 22 bp, Artificial Sequence
  Synthetic oligonucleotide; CTG chr11 5258395 5258416 5258412 5258417 +
tgggctctctgggtcccctagg

SEQ ID NO: 90173 - DNA, 22 bp, Artificial Sequence
  Synthetic oligonucleotide; CTC chr11 5258402 5258423 5258419 5258424 +
tctgggtcccctaggaagccat

SEQ ID NO: 90174 - DNA, 22 bp, Artificial Sequence
  Synthetic oligonucleotide; CTC chr11 5258404 5258425 5258421 5258426 +
tgggtcccctaggaagccattt

SEQ ID NO: 90175 - DNA, 22 bp, Artificial Sequence
  Synthetic oligonucleotide; CTG chr11 5258406 5258427 5258423 5258428 +
ggtcccctaggaagccatttct

SEQ ID NO: 90176 - DNA, 22 bp, Artificial Sequence
  Synthetic oligonucleotide; CTA chr11 5258415 5258436 5258432 5258437 +
ggaagccatttctgccttgcct

SEQ ID NO: 90177 - DNA, 22 bp, Artificial Sequence
  Synthetic oligonucleotide; TTT chr11 5258426 5258447 5258443 5258448 +
ctgccttgcctcacaggggtca

SEQ ID NO: 90178 - DNA, 22 bp, Artificial Sequence
  Synthetic oligonucleotide; TTC chr11 5258427 5258448 5258444 5258449 +
tgccttgcctcacaggggtcat

SEQ ID NO: 90179 - DNA, 22 bp, Artificial Sequence
  Synthetic oligonucleotide; CTG chr11 5258429 5258450 5258446 5258451 +
ccttgcctcacaggggtcattt

SEQ ID NO: 90180 - DNA, 22 bp, Artificial Sequence
  Synthetic oligonucleotide; CTT chr11 5258433 5258454 5258450 5258455 +
gcctcacaggggtcatttggga

SEQ ID NO: 90181 - DNA, 22 bp, Artificial Sequence
  Synthetic oligonucleotide; TTG chr11 5258434 5258455 5258451 5258456 +
cctcacaggggtcatttgggag

SEQ ID NO: 90182 - DNA, 22 bp, Artificial Sequence
  Synthetic oligonucleotide; CTC chr11 5258438 5258459 5258455 5258460 +
acaggggtcatttgggagggct

SEQ ID NO: 90183 - DNA, 22 bp, Artificial Sequence
  Synthetic oligonucleotide; TTT chr11 5258451 5258472 5258468 5258473 +
gggagggctgccagaggaactg

SEQ ID NO: 90184 - DNA, 22 bp, Artificial Sequence
  Synthetic oligonucleotide; TTG chr11 5258452 5258473 5258469 5258474 +
ggagggctgccagaggaactgg

SEQ ID NO: 90185 - DNA, 22 bp, Artificial Sequence
  Synthetic oligonucleotide; CTG chr11 5258461 5258482 5258478 5258483 +
ccagaggaactgggaaaagatg

SEQ ID NO: 90186 - DNA, 22 bp, Artificial Sequence
  Synthetic oligonucleotide; CTG chr11 5258473 5258494 5258490 5258495 +
ggaaaagatgacaggaaaaaga

SEQ ID NO: 90187 - DNA, 22 bp, Artificial Sequence
  Synthetic oligonucleotide; CTC chr11 5258502 5258523 5258519 5258524 +
cacctggccagatctaggggct

SEQ ID NO: 90188 - DNA, 22 bp, Artificial Sequence
  Synthetic oligonucleotide; CTG chr11 5258508 5258529 5258525 5258530 +
gccagatctaggggctgggcag

SEQ ID NO: 90189 - DNA, 22 bp, Artificial Sequence
  Synthetic oligonucleotide; CTA chr11 5258518 5258539 5258535 5258540 +
ggggctgggcagtgggggggtt

SEQ ID NO: 90190 - DNA, 22 bp, Artificial Sequence
  Synthetic oligonucleotide; CTG chr11 5258525 5258546 5258542 5258547 +
ggcagtgggggggttggtgggg

SEQ ID NO: 90191 - DNA, 22 bp, Artificial Sequence
  Synthetic oligonucleotide; TTG chr11 5258541 5258562 5258558 5258563 +
gtggggggacatgaatttggtg

SEQ ID NO: 90192 - DNA, 22 bp, Artificial Sequence
  Synthetic oligonucleotide; TTT chr11 5258559 5258580 5258576 5258581 +
ggtgtgcagactccactggcag

SEQ ID NO: 90193 - DNA, 22 bp, Artificial Sequence
  Synthetic oligonucleotide; TTG chr11 5258560 5258581 5258577 5258582 +
gtgtgcagactccactggcagg

SEQ ID NO: 90194 - DNA, 22 bp, Artificial Sequence
  Synthetic oligonucleotide; CTC chr11 5258572 5258593 5258589 5258594 +
cactggcagggaagtaggacag

SEQ ID NO: 90195 - DNA, 22 bp, Artificial Sequence
  Synthetic oligonucleotide; CTG chr11 5258577 5258598 5258594 5258599 +
gcagggaagtaggacagcccta

SEQ ID NO: 90196 - DNA, 22 bp, Artificial Sequence
  Synthetic oligonucleotide; CTA chr11 5258599 5258620 5258616 5258621 +
cttggtttcgcagctggtagcc

SEQ ID NO: 90197 - DNA, 22 bp, Artificial Sequence
  Synthetic oligonucleotide; CTT chr11 5258602 5258623 5258619 5258624 +
ggtttcgcagctggtagcctgg

SEQ ID NO: 90198 - DNA, 22 bp, Artificial Sequence
  Synthetic oligonucleotide; TTG chr11 5258603 5258624 5258620 5258625 +
gtttcgcagctggtagcctggg

SEQ ID NO: 90199 - DNA, 22 bp, Artificial Sequence
  Synthetic oligonucleotide; TTT chr11 5258607 5258628 5258624 5258629 +
cgcagctggtagcctggggcaa

SEQ ID NO: 90200 - DNA, 22 bp, Artificial Sequence
  Synthetic oligonucleotide; TTC chr11 5258608 5258629 5258625 5258630 +
gcagctggtagcctggggcaag

SEQ ID NO: 90201 - DNA, 22 bp, Artificial Sequence
  Synthetic oligonucleotide; CTG chr11 5258615 5258636 5258632 5258637 +
gtagcctggggcaagttctcag

SEQ ID NO: 90202 - DNA, 22 bp, Artificial Sequence
  Synthetic oligonucleotide; CTG chr11 5258623 5258644 5258640 5258645 +
gggcaagttctcagccttgctc

SEQ ID NO: 90203 - DNA, 22 bp, Artificial Sequence
  Synthetic oligonucleotide; TTC chr11 5258633 5258654 5258650 5258655 +
tcagccttgctcactgactgca

SEQ ID NO: 90204 - DNA, 22 bp, Artificial Sequence
  Synthetic oligonucleotide; CTC chr11 5258635 5258656 5258652 5258657 +
agccttgctcactgactgcatg

SEQ ID NO: 90205 - DNA, 22 bp, Artificial Sequence
  Synthetic oligonucleotide; CTT chr11 5258641 5258662 5258658 5258663 +
gctcactgactgcatggaaaca

SEQ ID NO: 90206 - DNA, 22 bp, Artificial Sequence
  Synthetic oligonucleotide; TTG chr11 5258642 5258663 5258659 5258664 +
ctcactgactgcatggaaacag

SEQ ID NO: 90207 - DNA, 22 bp, Artificial Sequence
  Synthetic oligonucleotide; CTC chr11 5258645 5258666 5258662 5258667 +
actgactgcatggaaacagatt

SEQ ID NO: 90208 - DNA, 22 bp, Artificial Sequence
  Synthetic oligonucleotide; CTG chr11 5258649 5258670 5258666 5258671 +
actgcatggaaacagattcggt

SEQ ID NO: 90209 - DNA, 22 bp, Artificial Sequence
  Synthetic oligonucleotide; CTG chr11 5258653 5258674 5258670 5258675 +
catggaaacagattcggtgctg

SEQ ID NO: 90210 - DNA, 22 bp, Artificial Sequence
  Synthetic oligonucleotide; TTC chr11 5258668 5258689 5258685 5258690 +
ggtgctgttgcgggggagggtg

SEQ ID NO: 90211 - DNA, 22 bp, Artificial Sequence
  Synthetic oligonucleotide; CTG chr11 5258675 5258696 5258692 5258697 +
ttgcgggggagggtgcacgctg

SEQ ID NO: 90212 - DNA, 22 bp, Artificial Sequence
  Synthetic oligonucleotide; TTG chr11 5258678 5258699 5258695 5258700 +
cgggggagggtgcacgctggaa

SEQ ID NO: 90213 - DNA, 22 bp, Artificial Sequence
  Synthetic oligonucleotide; CTG chr11 5258697 5258718 5258714 5258719 +
gaagtgagaccaaccttttgag

SEQ ID NO: 90214 - DNA, 22 bp, Artificial Sequence
  Synthetic oligonucleotide; CTT chr11 5258714 5258735 5258731 5258736 +
ttgagttgcatgggagctgggc

SEQ ID NO: 90215 - DNA, 22 bp, Artificial Sequence
  Synthetic oligonucleotide; TTT chr11 5258715 5258736 5258732 5258737 +
tgagttgcatgggagctgggca

SEQ ID NO: 90216 - DNA, 22 bp, Artificial Sequence
  Synthetic oligonucleotide; TTT chr11 5258716 5258737 5258733 5258738 +
gagttgcatgggagctgggcaa

SEQ ID NO: 90217 - DNA, 22 bp, Artificial Sequence
  Synthetic oligonucleotide; TTG chr11 5258717 5258738 5258734 5258739 +
agttgcatgggagctgggcaag

SEQ ID NO: 90218 - DNA, 22 bp, Artificial Sequence
  Synthetic oligonucleotide; TTG chr11 5258722 5258743 5258739 5258744 +
catgggagctgggcaagtcacg

SEQ ID NO: 90219 - DNA, 22 bp, Artificial Sequence
  Synthetic oligonucleotide; CTG chr11 5258733 5258754 5258750 5258755 +
ggcaagtcacgtgactgcttgc

SEQ ID NO: 90220 - DNA, 22 bp, Artificial Sequence
  Synthetic oligonucleotide; CTG chr11 5258750 5258771 5258767 5258772 +
cttgctttcccccactttcctg

SEQ ID NO: 90221 - DNA, 22 bp, Artificial Sequence
  Synthetic oligonucleotide; CTT chr11 5258753 5258774 5258770 5258775 +
gctttcccccactttcctgatg

SEQ ID NO: 90222 - DNA, 22 bp, Artificial Sequence
  Synthetic oligonucleotide; TTG chr11 5258754 5258775 5258771 5258776 +
ctttcccccactttcctgatga

SEQ ID NO: 90223 - DNA, 22 bp, Artificial Sequence
  Synthetic oligonucleotide; CTT chr11 5258757 5258778 5258774 5258779 +
tcccccactttcctgatgacct

SEQ ID NO: 90224 - DNA, 22 bp, Artificial Sequence
  Synthetic oligonucleotide; TTT chr11 5258758 5258779 5258775 5258780 +
cccccactttcctgatgacctg

SEQ ID NO: 90225 - DNA, 22 bp, Artificial Sequence
  Synthetic oligonucleotide; TTC chr11 5258759 5258780 5258776 5258781 +
ccccactttcctgatgacctgc

SEQ ID NO: 90226 - DNA, 22 bp, Artificial Sequence
  Synthetic oligonucleotide; CTT chr11 5258767 5258788 5258784 5258789 +
tcctgatgacctgcatgacaca

SEQ ID NO: 90227 - DNA, 22 bp, Artificial Sequence
  Synthetic oligonucleotide; TTT chr11 5258768 5258789 5258785 5258790 +
cctgatgacctgcatgacacag

SEQ ID NO: 90228 - DNA, 22 bp, Artificial Sequence
  Synthetic oligonucleotide; TTC chr11 5258769 5258790 5258786 5258791 +
ctgatgacctgcatgacacagc

SEQ ID NO: 90229 - DNA, 22 bp, Artificial Sequence
  Synthetic oligonucleotide; CTG chr11 5258772 5258793 5258789 5258794 +
atgacctgcatgacacagcaga

SEQ ID NO: 90230 - DNA, 22 bp, Artificial Sequence
  Synthetic oligonucleotide; CTG chr11 5258780 5258801 5258797 5258802 +
catgacacagcagaggcagcca

SEQ ID NO: 90231 - DNA, 22 bp, Artificial Sequence
  Synthetic oligonucleotide; TTG chr11 5258808 5258829 5258825 5258830 +
tcctaggaacataaatccattg

SEQ ID NO: 90232 - DNA, 22 bp, Artificial Sequence
  Synthetic oligonucleotide; CTA chr11 5258813 5258834 5258830 5258835 +
ggaacataaatccattgacctg

SEQ ID NO: 90233 - DNA, 22 bp, Artificial Sequence
  Synthetic oligonucleotide; TTG chr11 5258830 5258851 5258847 5258852 +
acctggaaactacacccccatc

SEQ ID NO: 90234 - DNA, 22 bp, Artificial Sequence
  Synthetic oligonucleotide; CTG chr11 5258835 5258856 5258852 5258857 +
gaaactacacccccatcctccc

SEQ ID NO: 90235 - DNA, 22 bp, Artificial Sequence
  Synthetic oligonucleotide; CTA chr11 5258842 5258863 5258859 5258864 +
cacccccatcctcccacagtag

SEQ ID NO: 90236 - DNA, 22 bp, Artificial Sequence
  Synthetic oligonucleotide; CTC chr11 5258855 5258876 5258872 5258877 +
ccacagtagccacagaaagacc

SEQ ID NO: 90237 - DNA, 22 bp, Artificial Sequence
  Synthetic oligonucleotide; CTG chr11 5258879 5258900 5258896 5258901 +
cccaaggagactctgagctcag

SEQ ID NO: 90238 - DNA, 22 bp, Artificial Sequence
  Synthetic oligonucleotide; CTC chr11 5258892 5258913 5258909 5258914 +
tgagctcagacacgactagtcc

SEQ ID NO: 90239 - DNA, 22 bp, Artificial Sequence
  Synthetic oligonucleotide; CTG chr11 5258894 5258915 5258911 5258916 +
agctcagacacgactagtcctg

SEQ ID NO: 90240 - DNA, 22 bp, Artificial Sequence
  Synthetic oligonucleotide; CTC chr11 5258899 5258920 5258916 5258921 +
agacacgactagtcctgccccc

SEQ ID NO: 90241 - DNA, 22 bp, Artificial Sequence
  Synthetic oligonucleotide; CTA chr11 5258910 5258931 5258927 5258932 +
gtcctgcccccacctgatggtc

SEQ ID NO: 90242 - DNA, 22 bp, Artificial Sequence
  Synthetic oligonucleotide; CTG chr11 5258916 5258937 5258933 5258938 +
cccccacctgatggtccttcct

SEQ ID NO: 90243 - DNA, 22 bp, Artificial Sequence
  Synthetic oligonucleotide; CTG chr11 5258926 5258947 5258943 5258948 +
atggtccttccttactcaccct

SEQ ID NO: 90244 - DNA, 22 bp, Artificial Sequence
  Synthetic oligonucleotide; CTT chr11 5258935 5258956 5258952 5258957 +
ccttactcaccctggtagctga

SEQ ID NO: 90245 - DNA, 22 bp, Artificial Sequence
  Synthetic oligonucleotide; TTC chr11 5258936 5258957 5258953 5258958 +
cttactcaccctggtagctgaa

SEQ ID NO: 90246 - DNA, 22 bp, Artificial Sequence
  Synthetic oligonucleotide; CTT chr11 5258939 5258960 5258956 5258961 +
actcaccctggtagctgaagac

SEQ ID NO: 90247 - DNA, 22 bp, Artificial Sequence
  Synthetic oligonucleotide; TTA chr11 5258940 5258961 5258957 5258962 +
ctcaccctggtagctgaagaca

SEQ ID NO: 90248 - DNA, 22 bp, Artificial Sequence
  Synthetic oligonucleotide; CTC chr11 5258943 5258964 5258960 5258965 +
accctggtagctgaagacaaag

SEQ ID NO: 90249 - DNA, 22 bp, Artificial Sequence
  Synthetic oligonucleotide; CTG chr11 5258949 5258970 5258966 5258971 +
gtagctgaagacaaagggcata

SEQ ID NO: 90250 - DNA, 22 bp, Artificial Sequence
  Synthetic oligonucleotide; CTG chr11 5258956 5258977 5258973 5258978 +
aagacaaagggcatatattctt

SEQ ID NO: 90251 - DNA, 22 bp, Artificial Sequence
  Synthetic oligonucleotide; TTC chr11 5258976 5258997 5258993 5258998 +
ttgggagttctagggtgcccca

SEQ ID NO: 90252 - DNA, 22 bp, Artificial Sequence
  Synthetic oligonucleotide; CTT chr11 5258978 5258999 5258995 5259000 +
gggagttctagggtgccccagc

SEQ ID NO: 90253 - DNA, 22 bp, Artificial Sequence
  Synthetic oligonucleotide; TTG chr11 5258979 5259000 5258996 5259001 +
ggagttctagggtgccccagcc

SEQ ID NO: 90254 - DNA, 22 bp, Artificial Sequence
  Synthetic oligonucleotide; TTC chr11 5258986 5259007 5259003 5259008 +
tagggtgccccagcccccccag

SEQ ID NO: 90255 - DNA, 22 bp, Artificial Sequence
  Synthetic oligonucleotide; CTA chr11 5258988 5259009 5259005 5259010 +
gggtgccccagcccccccagcc

SEQ ID NO: 90256 - DNA, 22 bp, Artificial Sequence
  Synthetic oligonucleotide; CTG chr11 5259021 5259042 5259038 5259043 +
actgcctctgctgatgctttct

SEQ ID NO: 90257 - DNA, 22 bp, Artificial Sequence
  Synthetic oligonucleotide; CTG chr11 5259025 5259046 5259042 5259047 +
cctctgctgatgctttctagaa

SEQ ID NO: 90258 - DNA, 22 bp, Artificial Sequence
  Synthetic oligonucleotide; CTC chr11 5259029 5259050 5259046 5259051 +
tgctgatgctttctagaaagtg

SEQ ID NO: 90259 - DNA, 22 bp, Artificial Sequence
  Synthetic oligonucleotide; CTG chr11 5259031 5259052 5259048 5259053 +
ctgatgctttctagaaagtgcc

SEQ ID NO: 90260 - DNA, 22 bp, Artificial Sequence
  Synthetic oligonucleotide; CTG chr11 5259034 5259055 5259051 5259056 +
atgctttctagaaagtgccacc

SEQ ID NO: 90261 - DNA, 22 bp, Artificial Sequence
  Synthetic oligonucleotide; CTT chr11 5259040 5259061 5259057 5259062 +
tctagaaagtgccacctcctgg

SEQ ID NO: 90262 - DNA, 22 bp, Artificial Sequence
  Synthetic oligonucleotide; TTT chr11 5259041 5259062 5259058 5259063 +
ctagaaagtgccacctcctggc

SEQ ID NO: 90263 - DNA, 22 bp, Artificial Sequence
  Synthetic oligonucleotide; TTC chr11 5259042 5259063 5259059 5259064 +
tagaaagtgccacctcctggca

SEQ ID NO: 90264 - DNA, 22 bp, Artificial Sequence
  Synthetic oligonucleotide; CTA chr11 5259044 5259065 5259061 5259066 +
gaaagtgccacctcctggcagg

SEQ ID NO: 90265 - DNA, 22 bp, Artificial Sequence
  Synthetic oligonucleotide; CTC chr11 5259058 5259079 5259075 5259080 +
ctggcaggaggccaaccagcac

SEQ ID NO: 90266 - DNA, 22 bp, Artificial Sequence
  Synthetic oligonucleotide; CTG chr11 5259061 5259082 5259078 5259083 +
gcaggaggccaaccagcacaaa

SEQ ID NO: 90267 - DNA, 22 bp, Artificial Sequence
  Synthetic oligonucleotide; TTG chr11 5259095 5259116 5259112 5259117 +
aacaaccaaaagtaaggaccct

SEQ ID NO: 90268 - DNA, 22 bp, Artificial Sequence
  Synthetic oligonucleotide; CTC chr11 5259118 5259139 5259135 5259140 +
acagagtccatttcatcctctg

SEQ ID NO: 90269 - DNA, 22 bp, Artificial Sequence
  Synthetic oligonucleotide; TTT chr11 5259131 5259152 5259148 5259153 +
catcctctgccacctccattgg

SEQ ID NO: 90270 - DNA, 22 bp, Artificial Sequence
  Synthetic oligonucleotide; TTC chr11 5259132 5259153 5259149 5259154 +
atcctctgccacctccattgga

SEQ ID NO: 90271 - DNA, 22 bp, Artificial Sequence
  Synthetic oligonucleotide; CTC chr11 5259138 5259159 5259155 5259160 +
tgccacctccattggagcaggt

SEQ ID NO: 90272 - DNA, 22 bp, Artificial Sequence
  Synthetic oligonucleotide; CTG chr11 5259140 5259161 5259157 5259162 +
ccacctccattggagcaggtgg

SEQ ID NO: 90273 - DNA, 22 bp, Artificial Sequence
  Synthetic oligonucleotide; CTC chr11 5259147 5259168 5259164 5259169 +
cattggagcaggtggttgtatc

SEQ ID NO: 90274 - DNA, 22 bp, Artificial Sequence
  Synthetic oligonucleotide; TTG chr11 5259152 5259173 5259169 5259174 +
gagcaggtggttgtatctatgg

SEQ ID NO: 90275 - DNA, 22 bp, Artificial Sequence
  Synthetic oligonucleotide; TTG chr11 5259165 5259186 5259182 5259187 +
tatctatggctgagagacccac

SEQ ID NO: 90276 - DNA, 22 bp, Artificial Sequence
  Synthetic oligonucleotide; CTA chr11 5259171 5259192 5259188 5259193 +
tggctgagagacccacagatgg

SEQ ID NO: 90277 - DNA, 22 bp, Artificial Sequence
  Synthetic oligonucleotide; CTG chr11 5259177 5259198 5259194 5259199 +
agagacccacagatggttcacg

SEQ ID NO: 90278 - DNA, 22 bp, Artificial Sequence
  Synthetic oligonucleotide; TTC chr11 5259196 5259217 5259213 5259218 +
acgtcacaagactctgtgcaga

SEQ ID NO: 90279 - DNA, 22 bp, Artificial Sequence
  Synthetic oligonucleotide; CTC chr11 5259210 5259231 5259227 5259232 +
tgtgcagacaaaccccagtacc

SEQ ID NO: 90280 - DNA, 22 bp, Artificial Sequence
  Synthetic oligonucleotide; CTG chr11 5259212 5259233 5259229 5259234 +
tgcagacaaaccccagtaccag

SEQ ID NO: 90281 - DNA, 22 bp, Artificial Sequence
  Synthetic oligonucleotide; CTG chr11 5259238 5259259 5259255 5259260 +
gagtctggtagacctgatgggt

SEQ ID NO: 90282 - DNA, 22 bp, Artificial Sequence
  Synthetic oligonucleotide; CTG chr11 5259245 5259266 5259262 5259267 +
gtagacctgatgggtggctaga

SEQ ID NO: 90283 - DNA, 22 bp, Artificial Sequence
  Synthetic oligonucleotide; CTG chr11 5259254 5259275 5259271 5259276 +
atgggtggctagatccagaaga

SEQ ID NO: 90284 - DNA, 22 bp, Artificial Sequence
  Synthetic oligonucleotide; CTA chr11 5259265 5259286 5259282 5259287 +
gatccagaagagagataacaat

SEQ ID NO: 90285 - DNA, 22 bp, Artificial Sequence
  Synthetic oligonucleotide; CTA chr11 5259292 5259313 5259309 5259314 +
cagttcggctctcaggaagccc

SEQ ID NO: 90286 - DNA, 22 bp, Artificial Sequence
  Synthetic oligonucleotide; TTC chr11 5259298 5259319 5259315 5259320 +
ggctctcaggaagccccacgcc

SEQ ID NO: 90287 - DNA, 22 bp, Artificial Sequence
  Synthetic oligonucleotide; CTC chr11 5259303 5259324 5259320 5259325 +
tcaggaagccccacgcctagga

SEQ ID NO: 90288 - DNA, 22 bp, Artificial Sequence
  Synthetic oligonucleotide; CTC chr11 5259305 5259326 5259322 5259327 +
aggaagccccacgcctaggaaa

SEQ ID NO: 90289 - DNA, 22 bp, Artificial Sequence
  Synthetic oligonucleotide; CTA chr11 5259322 5259343 5259339 5259344 +
ggaaaagggggactgtgctaca

SEQ ID NO: 90290 - DNA, 22 bp, Artificial Sequence
  Synthetic oligonucleotide; CTG chr11 5259337 5259358 5259354 5259359 +
tgctacatcaagggaacacctc

SEQ ID NO: 90291 - DNA, 22 bp, Artificial Sequence
  Synthetic oligonucleotide; CTA chr11 5259342 5259363 5259359 5259364 +
catcaagggaacacctcatggg

SEQ ID NO: 90292 - DNA, 22 bp, Artificial Sequence
  Synthetic oligonucleotide; CTC chr11 5259359 5259380 5259376 5259381 +
atgggacaaaagtctcagcctt

SEQ ID NO: 90293 - DNA, 22 bp, Artificial Sequence
  Synthetic oligonucleotide; CTC chr11 5259375 5259396 5259392 5259397 +
agccttgaggcctagactttcc

SEQ ID NO: 90294 - DNA, 22 bp, Artificial Sequence
  Synthetic oligonucleotide; CTT chr11 5259381 5259402 5259398 5259403 +
gaggcctagactttccctctga

SEQ ID NO: 90295 - DNA, 22 bp, Artificial Sequence
  Synthetic oligonucleotide; TTG chr11 5259382 5259403 5259399 5259404 +
aggcctagactttccctctgac

SEQ ID NO: 90296 - DNA, 22 bp, Artificial Sequence
  Synthetic oligonucleotide; CTA chr11 5259389 5259410 5259406 5259411 +
gactttccctctgacagagcct

SEQ ID NO: 90297 - DNA, 22 bp, Artificial Sequence
  Synthetic oligonucleotide; CTT chr11 5259394 5259415 5259411 5259416 +
tccctctgacagagcctaccca

SEQ ID NO: 90298 - DNA, 22 bp, Artificial Sequence
  Synthetic oligonucleotide; TTT chr11 5259395 5259416 5259412 5259417 +
ccctctgacagagcctacccaa

SEQ ID NO: 90299 - DNA, 22 bp, Artificial Sequence
  Synthetic oligonucleotide; TTC chr11 5259396 5259417 5259413 5259418 +
cctctgacagagcctacccaag

SEQ ID NO: 90300 - DNA, 22 bp, Artificial Sequence
  Synthetic oligonucleotide; CTC chr11 5259400 5259421 5259417 5259422 +
tgacagagcctacccaagtgag

SEQ ID NO: 90301 - DNA, 22 bp, Artificial Sequence
  Synthetic oligonucleotide; CTG chr11 5259402 5259423 5259419 5259424 +
acagagcctacccaagtgagaa

SEQ ID NO: 90302 - DNA, 22 bp, Artificial Sequence
  Synthetic oligonucleotide; CTA chr11 5259412 5259433 5259429 5259434 +
cccaagtgagaaggaaccagaa

SEQ ID NO: 90303 - DNA, 22 bp, Artificial Sequence
  Synthetic oligonucleotide; CTA chr11 5259439 5259460 5259456 5259461 +
actctggtaatatgaaaaacaa

SEQ ID NO: 90304 - DNA, 22 bp, Artificial Sequence
  Synthetic oligonucleotide; CTC chr11 5259443 5259464 5259460 5259465 +
tggtaatatgaaaaacaaggtt

SEQ ID NO: 90305 - DNA, 22 bp, Artificial Sequence
  Synthetic oligonucleotide; CTG chr11 5259445 5259466 5259462 5259467 +
gtaatatgaaaaacaaggttct

SEQ ID NO: 90306 - DNA, 22 bp, Artificial Sequence
  Synthetic oligonucleotide; TTC chr11 5259466 5259487 5259483 5259488 +
tttaacaccccccaaaaaatca

SEQ ID NO: 90307 - DNA, 22 bp, Artificial Sequence
  Synthetic oligonucleotide; CTT chr11 5259468 5259489 5259485 5259490 +
taacaccccccaaaaaatcata

SEQ ID NO: 90308 - DNA, 22 bp, Artificial Sequence
  Synthetic oligonucleotide; TTT chr11 5259469 5259490 5259486 5259491 +
aacaccccccaaaaaatcatac

SEQ ID NO: 90309 - DNA, 22 bp, Artificial Sequence
  Synthetic oligonucleotide; TTA chr11 5259470 5259491 5259487 5259492 +
acaccccccaaaaaatcatact

SEQ ID NO: 90310 - DNA, 22 bp, Artificial Sequence
  Synthetic oligonucleotide; CTA chr11 5259493 5259514 5259510 5259515 +
gctcaccagcaatgcatccaaa

SEQ ID NO: 90311 - DNA, 22 bp, Artificial Sequence
  Synthetic oligonucleotide; CTC chr11 5259497 5259518 5259514 5259519 +
accagcaatgcatccaaaccaa

SEQ ID NO: 90312 - DNA, 22 bp, Artificial Sequence
  Synthetic oligonucleotide; CTG chr11 5259532 5259553 5259549 5259554 +
atttacctgaaaaataattcag

SEQ ID NO: 90313 - DNA, 22 bp, Artificial Sequence
  Synthetic oligonucleotide; TTT chr11 5259536 5259557 5259553 5259558 +
acctgaaaaataattcagaagg

SEQ ID NO: 90314 - DNA, 22 bp, Artificial Sequence
  Synthetic oligonucleotide; TTA chr11 5259537 5259558 5259554 5259559 +
cctgaaaaataattcagaaggt

SEQ ID NO: 90315 - DNA, 22 bp, Artificial Sequence
  Synthetic oligonucleotide; CTG chr11 5259541 5259562 5259558 5259563 +
aaaaataattcagaaggtcagt

SEQ ID NO: 90316 - DNA, 22 bp, Artificial Sequence
  Synthetic oligonucleotide; TTC chr11 5259552 5259573 5259569 5259574 +
agaaggtcagttattaagctaa

SEQ ID NO: 90317 - DNA, 22 bp, Artificial Sequence
  Synthetic oligonucleotide; TTA chr11 5259565 5259586 5259582 5259587 +
ttaagctaatcaaggaggcatc

SEQ ID NO: 90318 - DNA, 22 bp, Artificial Sequence
  Synthetic oligonucleotide; TTA chr11 5259568 5259589 5259585 5259590 +
agctaatcaaggaggcatccga

SEQ ID NO: 90319 - DNA, 22 bp, Artificial Sequence
  Synthetic oligonucleotide; CTA chr11 5259573 5259594 5259590 5259595 +
atcaaggaggcatccgaggaag

SEQ ID NO: 90320 - DNA, 22 bp, Artificial Sequence
  Synthetic oligonucleotide; TTT chr11 5259609 5259630 5259626 5259631 +
taaaaaaaccaaaaatatgata

SEQ ID NO: 90321 - DNA, 22 bp, Artificial Sequence
  Synthetic oligonucleotide; TTT chr11 5259610 5259631 5259627 5259632 +
aaaaaaaccaaaaatatgatac

SEQ ID NO: 90322 - DNA, 22 bp, Artificial Sequence
  Synthetic oligonucleotide; TTA chr11 5259611 5259632 5259628 5259633 +
aaaaaaccaaaaatatgataca

SEQ ID NO: 90323 - DNA, 22 bp, Artificial Sequence
  Synthetic oligonucleotide; CTT chr11 5259654 5259675 5259671 5259676 +
cagttaaagagatagcataaat

SEQ ID NO: 90324 - DNA, 22 bp, Artificial Sequence
  Synthetic oligonucleotide; TTC chr11 5259655 5259676 5259672 5259677 +
agttaaagagatagcataaata

SEQ ID NO: 90325 - DNA, 22 bp, Artificial Sequence
  Synthetic oligonucleotide; TTA chr11 5259660 5259681 5259677 5259682 +
aagagatagcataaataaaaaa

SEQ ID NO: 90326 - DNA, 22 bp, Artificial Sequence
  Synthetic oligonucleotide; TTC chr11 5259687 5259708 5259704 5259709 +
aaaacttcaggaaacaatggat

SEQ ID NO: 90327 - DNA, 22 bp, Artificial Sequence
  Synthetic oligonucleotide; CTT chr11 5259694 5259715 5259711 5259716 +
caggaaacaatggatgaatgga

SEQ ID NO: 90328 - DNA, 22 bp, Artificial Sequence
  Synthetic oligonucleotide; TTC chr11 5259695 5259716 5259712 5259717 +
aggaaacaatggatgaatggat

SEQ ID NO: 90329 - DNA, 22 bp, Artificial Sequence
  Synthetic oligonucleotide; CTT chr11 5259723 5259744 5259740 5259745 +
atagaaatgcaaaatgctctag

SEQ ID NO: 90330 - DNA, 22 bp, Artificial Sequence
  Synthetic oligonucleotide; TTA chr11 5259724 5259745 5259741 5259746 +
tagaaatgcaaaatgctctaga

SEQ ID NO: 90331 - DNA, 22 bp, Artificial Sequence
  Synthetic oligonucleotide; CTC chr11 5259742 5259763 5259759 5259764 +
tagaaagtctcagcaatagaat

SEQ ID NO: 90332 - DNA, 22 bp, Artificial Sequence
  Synthetic oligonucleotide; CTA chr11 5259744 5259765 5259761 5259766 +
gaaagtctcagcaatagaatcc

SEQ ID NO: 90333 - DNA, 22 bp, Artificial Sequence
  Synthetic oligonucleotide; CTC chr11 5259753 5259774 5259770 5259775 +
agcaatagaatccaagcagaag

SEQ ID NO: 90334 - DNA, 22 bp, Artificial Sequence
  Synthetic oligonucleotide; TTC chr11 5259781 5259802 5259798 5259803 +
agagcttgaagacaaagttttt

SEQ ID NO: 90335 - DNA, 22 bp, Artificial Sequence
  Synthetic oligonucleotide; CTT chr11 5259788 5259809 5259805 5259810 +
gaagacaaagtttttgaattaa

SEQ ID NO: 90336 - DNA, 22 bp, Artificial Sequence
  Synthetic oligonucleotide; TTG chr11 5259789 5259810 5259806 5259811 +
aagacaaagtttttgaattaac

SEQ ID NO: 90337 - DNA, 22 bp, Artificial Sequence
  Synthetic oligonucleotide; TTT chr11 5259801 5259822 5259818 5259823 +
ttgaattaacccaatccaacaa

SEQ ID NO: 90338 - DNA, 22 bp, Artificial Sequence
  Synthetic oligonucleotide; TTT chr11 5259802 5259823 5259819 5259824 +
tgaattaacccaatccaacaaa

SEQ ID NO: 90339 - DNA, 22 bp, Artificial Sequence
  Synthetic oligonucleotide; TTT chr11 5259803 5259824 5259820 5259825 +
gaattaacccaatccaacaaag

SEQ ID NO: 90340 - DNA, 22 bp, Artificial Sequence
  Synthetic oligonucleotide; TTG chr11 5259804 5259825 5259821 5259826 +
aattaacccaatccaacaaaga

SEQ ID NO: 90341 - DNA, 22 bp, Artificial Sequence
  Synthetic oligonucleotide; TTA chr11 5259809 5259830 5259826 5259831 +
acccaatccaacaaagacaaag

SEQ ID NO: 90342 - DNA, 22 bp, Artificial Sequence
  Synthetic oligonucleotide; CTC chr11 5259863 5259884 5259880 5259885 +
caagaaatctgggattatgtta

SEQ ID NO: 90343 - DNA, 22 bp, Artificial Sequence
  Synthetic oligonucleotide; CTG chr11 5259874 5259895 5259891 5259896 +
ggattatgttaaacaatcaaac

SEQ ID NO: 90344 - DNA, 22 bp, Artificial Sequence
  Synthetic oligonucleotide; TTA chr11 5259880 5259901 5259897 5259902 +
tgttaaacaatcaaacctaaga

SEQ ID NO: 90345 - DNA, 22 bp, Artificial Sequence
  Synthetic oligonucleotide; TTA chr11 5259885 5259906 5259902 5259907 +
aacaatcaaacctaagaataat

SEQ ID NO: 90346 - DNA, 22 bp, Artificial Sequence
  Synthetic oligonucleotide; CTA chr11 5259899 5259920 5259916 5259921 +
agaataatcagcattcctgaga

SEQ ID NO: 90347 - DNA, 22 bp, Artificial Sequence
  Synthetic oligonucleotide; TTC chr11 5259915 5259936 5259932 5259937 +
ctgagaaagaagagaaatctaa

SEQ ID NO: 90348 - DNA, 22 bp, Artificial Sequence
  Synthetic oligonucleotide; CTG chr11 5259918 5259939 5259935 5259940 +
agaaagaagagaaatctaaaag

SEQ ID NO: 90349 - DNA, 22 bp, Artificial Sequence
  Synthetic oligonucleotide; CTA chr11 5259936 5259957 5259953 5259958 +
aaagtttggaaaacttatccag

SEQ ID NO: 90350 - DNA, 22 bp, Artificial Sequence
  Synthetic oligonucleotide; TTT chr11 5259943 5259964 5259960 5259965 +
ggaaaacttatccagggaaata

SEQ ID NO: 90351 - DNA, 22 bp, Artificial Sequence
  Synthetic oligonucleotide; TTG chr11 5259944 5259965 5259961 5259966 +
gaaaacttatccagggaaataa

SEQ ID NO: 90352 - DNA, 22 bp, Artificial Sequence
  Synthetic oligonucleotide; CTT chr11 5259952 5259973 5259969 5259974 +
atccagggaaataatcaaggaa

SEQ ID NO: 90353 - DNA, 22 bp, Artificial Sequence
  Synthetic oligonucleotide; TTA chr11 5259953 5259974 5259970 5259975 +
tccagggaaataatcaaggaaa

SEQ ID NO: 90354 - DNA, 22 bp, Artificial Sequence
  Synthetic oligonucleotide; CTT chr11 5259979 5260000 5259996 5260001 +
cccccaccttgctagagaccta

SEQ ID NO: 90355 - DNA, 22 bp, Artificial Sequence
  Synthetic oligonucleotide; TTC chr11 5259980 5260001 5259997 5260002 +
ccccaccttgctagagacctag

SEQ ID NO: 90356 - DNA, 22 bp, Artificial Sequence
  Synthetic oligonucleotide; CTT chr11 5259989 5260010 5260006 5260011 +
gctagagacctagatatccaaa

SEQ ID NO: 90357 - DNA, 22 bp, Artificial Sequence
  Synthetic oligonucleotide; TTG chr11 5259990 5260011 5260007 5260012 +
ctagagacctagatatccaaat

SEQ ID NO: 90358 - DNA, 22 bp, Artificial Sequence
  Synthetic oligonucleotide; CTA chr11 5259993 5260014 5260010 5260015 +
gagacctagatatccaaataca

SEQ ID NO: 90359 - DNA, 22 bp, Artificial Sequence
  Synthetic oligonucleotide; CTA chr11 5260001 5260022 5260018 5260023 +
gatatccaaatacaagaagctc

SEQ ID NO: 90360 - DNA, 22 bp, Artificial Sequence
  Synthetic oligonucleotide; CTC chr11 5260023 5260044 5260040 5260045 +
aataaacacctgggaaattcat

SEQ ID NO: 90361 - DNA, 22 bp, Artificial Sequence
  Synthetic oligonucleotide; CTG chr11 5260035 5260056 5260052 5260057 +
ggaaattcattgcaaaaatatc

SEQ ID NO: 90362 - DNA, 22 bp, Artificial Sequence
  Synthetic oligonucleotide; TTC chr11 5260043 5260064 5260060 5260065 +
attgcaaaaatatcattgccta

SEQ ID NO: 90363 - DNA, 22 bp, Artificial Sequence
  Synthetic oligonucleotide; TTG chr11 5260047 5260068 5260064 5260069 +
caaaaatatcattgcctaggta

SEQ ID NO: 90364 - DNA, 22 bp, Artificial Sequence
  Synthetic oligonucleotide; TTG chr11 5260061 5260082 5260078 5260083 +
cctaggtacattgtcatcagag

SEQ ID NO: 90365 - DNA, 22 bp, Artificial Sequence
  Synthetic oligonucleotide; CTA chr11 5260065 5260086 5260082 5260087 +
ggtacattgtcatcagagtatc

SEQ ID NO: 90366 - DNA, 22 bp, Artificial Sequence
  Synthetic oligonucleotide; TTG chr11 5260074 5260095 5260091 5260096 +
tcatcagagtatccaaagttat

SEQ ID NO: 90367 - DNA, 22 bp, Artificial Sequence
  Synthetic oligonucleotide; TTA chr11 5260095 5260116 5260112 5260117 +
tctaaagacaaagagaatctta

SEQ ID NO: 90368 - DNA, 22 bp, Artificial Sequence
  Synthetic oligonucleotide; CTA chr11 5260099 5260120 5260116 5260121 +
aagacaaagagaatcttaagag

SEQ ID NO: 90369 - DNA, 22 bp, Artificial Sequence
  Synthetic oligonucleotide; CTT chr11 5260116 5260137 5260133 5260138 +
aagagctgtgaggtgaaactac

SEQ ID NO: 90370 - DNA, 22 bp, Artificial Sequence
  Synthetic oligonucleotide; TTA chr11 5260117 5260138 5260134 5260139 +
agagctgtgaggtgaaactacc

SEQ ID NO: 90371 - DNA, 22 bp, Artificial Sequence
  Synthetic oligonucleotide; CTG chr11 5260124 5260145 5260141 5260146 +
tgaggtgaaactaccaggtaac

SEQ ID NO: 90372 - DNA, 22 bp, Artificial Sequence
  Synthetic oligonucleotide; CTA chr11 5260137 5260158 5260154 5260159 +
ccaggtaacctatgaaagaaaa

SEQ ID NO: 90373 - DNA, 22 bp, Artificial Sequence
  Synthetic oligonucleotide; CTA chr11 5260149 5260170 5260166 5260171 +
tgaaagaaaacctatcagatta

SEQ ID NO: 90374 - DNA, 22 bp, Artificial Sequence
  Synthetic oligonucleotide; CTA chr11 5260163 5260184 5260180 5260185 +
tcagattaacagcagatttctc

SEQ ID NO: 90375 - DNA, 22 bp, Artificial Sequence
  Synthetic oligonucleotide; TTA chr11 5260171 5260192 5260188 5260193 +
acagcagatttctcagcagaaa

SEQ ID NO: 90376 - DNA, 22 bp, Artificial Sequence
  Synthetic oligonucleotide; TTT chr11 5260182 5260203 5260199 5260204 +
ctcagcagaaaccgtaaaagct

SEQ ID NO: 90377 - DNA, 22 bp, Artificial Sequence
  Synthetic oligonucleotide; TTC chr11 5260183 5260204 5260200 5260205 +
tcagcagaaaccgtaaaagcta

SEQ ID NO: 90378 - DNA, 22 bp, Artificial Sequence
  Synthetic oligonucleotide; CTC chr11 5260185 5260206 5260202 5260207 +
agcagaaaccgtaaaagctaga

SEQ ID NO: 90379 - DNA, 22 bp, Artificial Sequence
  Synthetic oligonucleotide; CTA chr11 5260205 5260226 5260222 5260227 +
gaagtgaatatggccctatctt

SEQ ID NO: 90380 - DNA, 22 bp, Artificial Sequence
  Synthetic oligonucleotide; CTA chr11 5260223 5260244 5260240 5260245 +
tcttcagccttcttaaacaaaa

SEQ ID NO: 90381 - DNA, 22 bp, Artificial Sequence
  Synthetic oligonucleotide; CTT chr11 5260227 5260248 5260244 5260249 +
cagccttcttaaacaaaacaat

SEQ ID NO: 90382 - DNA, 22 bp, Artificial Sequence
  Synthetic oligonucleotide; TTC chr11 5260228 5260249 5260245 5260250 +
agccttcttaaacaaaacaatt

SEQ ID NO: 90383 - DNA, 22 bp, Artificial Sequence
  Synthetic oligonucleotide; CTT chr11 5260234 5260255 5260251 5260256 +
cttaaacaaaacaattatcagc

SEQ ID NO: 90384 - DNA, 22 bp, Artificial Sequence
  Synthetic oligonucleotide; TTC chr11 5260235 5260256 5260252 5260257 +
ttaaacaaaacaattatcagcc

SEQ ID NO: 90385 - DNA, 22 bp, Artificial Sequence
  Synthetic oligonucleotide; CTT chr11 5260237 5260258 5260254 5260259 +
aaacaaaacaattatcagccaa

SEQ ID NO: 90386 - DNA, 22 bp, Artificial Sequence
  Synthetic oligonucleotide; TTA chr11 5260238 5260259 5260255 5260260 +
aacaaaacaattatcagccaag

SEQ ID NO: 90387 - DNA, 22 bp, Artificial Sequence
  Synthetic oligonucleotide; TTA chr11 5260251 5260272 5260268 5260273 +
tcagccaagaattttatatcca

SEQ ID NO: 90388 - DNA, 22 bp, Artificial Sequence
  Synthetic oligonucleotide; TTT chr11 5260265 5260286 5260282 5260287 +
tatatccagtgaaactaagctt

SEQ ID NO: 90389 - DNA, 22 bp, Artificial Sequence
  Synthetic oligonucleotide; TTT chr11 5260266 5260287 5260283 5260288 +
atatccagtgaaactaagcttc

SEQ ID NO: 90390 - DNA, 22 bp, Artificial Sequence
  Synthetic oligonucleotide; TTA chr11 5260267 5260288 5260284 5260289 +
tatccagtgaaactaagcttca

SEQ ID NO: 90391 - DNA, 22 bp, Artificial Sequence
  Synthetic oligonucleotide; CTA chr11 5260282 5260303 5260299 5260304 +
agcttcacaaatgaagaaaata

SEQ ID NO: 90392 - DNA, 22 bp, Artificial Sequence
  Synthetic oligonucleotide; CTT chr11 5260287 5260308 5260304 5260309 +
cacaaatgaagaaaatacacag

SEQ ID NO: 90393 - DNA, 22 bp, Artificial Sequence
  Synthetic oligonucleotide; TTC chr11 5260288 5260309 5260305 5260310 +
acaaatgaagaaaatacacagt

SEQ ID NO: 90394 - DNA, 22 bp, Artificial Sequence
  Synthetic oligonucleotide; TTT chr11 5260314 5260335 5260331 5260336 +
ttcagaaaaacaaatgctgaga

SEQ ID NO: 90395 - DNA, 22 bp, Artificial Sequence
  Synthetic oligonucleotide; TTT chr11 5260315 5260336 5260332 5260337 +
tcagaaaaacaaatgctgagag

SEQ ID NO: 90396 - DNA, 22 bp, Artificial Sequence
  Synthetic oligonucleotide; TTT chr11 5260316 5260337 5260333 5260338 +
cagaaaaacaaatgctgagaga

SEQ ID NO: 90397 - DNA, 22 bp, Artificial Sequence
  Synthetic oligonucleotide; TTC chr11 5260317 5260338 5260334 5260339 +
agaaaaacaaatgctgagagaa

SEQ ID NO: 90398 - DNA, 22 bp, Artificial Sequence
  Synthetic oligonucleotide; CTG chr11 5260333 5260354 5260350 5260355 +
agagaattcggcactaccaagc

SEQ ID NO: 90399 - DNA, 22 bp, Artificial Sequence
  Synthetic oligonucleotide; TTC chr11 5260342 5260363 5260359 5260364 +
ggcactaccaagccaacactac

SEQ ID NO: 90400 - DNA, 22 bp, Artificial Sequence
  Synthetic oligonucleotide; CTA chr11 5260349 5260370 5260366 5260371 +
ccaagccaacactacaagaact

SEQ ID NO: 90401 - DNA, 22 bp, Artificial Sequence
  Synthetic oligonucleotide; CTA chr11 5260363 5260384 5260380 5260385 +
caagaactgataaaaggagctc

SEQ ID NO: 90402 - DNA, 22 bp, Artificial Sequence
  Synthetic oligonucleotide; CTG chr11 5260372 5260393 5260389 5260394 +
ataaaaggagctctaaatcttg

SEQ ID NO: 90403 - DNA, 22 bp, Artificial Sequence
  Synthetic oligonucleotide; CTC chr11 5260385 5260406 5260402 5260407 +
taaatcttgaaataaaccctgg

SEQ ID NO: 90404 - DNA, 22 bp, Artificial Sequence
  Synthetic oligonucleotide; CTA chr11 5260387 5260408 5260404 5260409 +
aatcttgaaataaaccctggaa

SEQ ID NO: 90405 - DNA, 22 bp, Artificial Sequence
  Synthetic oligonucleotide; CTT chr11 5260393 5260414 5260410 5260415 +
gaaataaaccctggaagcacat

SEQ ID NO: 90406 - DNA, 22 bp, Artificial Sequence
  Synthetic oligonucleotide; TTG chr11 5260394 5260415 5260411 5260416 +
aaataaaccctggaagcacatc

SEQ ID NO: 90407 - DNA, 22 bp, Artificial Sequence
  Synthetic oligonucleotide; CTG chr11 5260406 5260427 5260423 5260428 +
gaagcacatcaaaacagaacct

SEQ ID NO: 90408 - DNA, 22 bp, Artificial Sequence
  Synthetic oligonucleotide; CTC chr11 5260429 5260450 5260446 5260451 +
tttaaagcataaatcccatagg

SEQ ID NO: 90409 - DNA, 22 bp, Artificial Sequence
  Synthetic oligonucleotide; CTT chr11 5260431 5260452 5260448 5260453 +
taaagcataaatcccataggac

SEQ ID NO: 90410 - DNA, 22 bp, Artificial Sequence
  Synthetic oligonucleotide; TTT chr11 5260432 5260453 5260449 5260454 +
aaagcataaatcccataggaca

SEQ ID NO: 90411 - DNA, 22 bp, Artificial Sequence
  Synthetic oligonucleotide; TTA chr11 5260433 5260454 5260450 5260455 +
aagcataaatcccataggacat

SEQ ID NO: 90412 - DNA, 22 bp, Artificial Sequence
  Synthetic oligonucleotide; CTC chr11 5260522 5260543 5260539 5260544 +
acacctcaatactgatgttgaa

SEQ ID NO: 90413 - DNA, 22 bp, Artificial Sequence
  Synthetic oligonucleotide; CTC chr11 5260529 5260550 5260546 5260551 +
aatactgatgttgaatgtaaat

SEQ ID NO: 90414 - DNA, 22 bp, Artificial Sequence
  Synthetic oligonucleotide; CTG chr11 5260536 5260557 5260553 5260558 +
atgttgaatgtaaatggactaa

SEQ ID NO: 90415 - DNA, 22 bp, Artificial Sequence
  Synthetic oligonucleotide; TTG chr11 5260542 5260563 5260559 5260564 +
aatgtaaatggactaaatgctc

SEQ ID NO: 90416 - DNA, 22 bp, Artificial Sequence
  Synthetic oligonucleotide; CTA chr11 5260557 5260578 5260574 5260579 +
aatgctccacttaaaagataca

SEQ ID NO: 90417 - DNA, 22 bp, Artificial Sequence
  Synthetic oligonucleotide; CTC chr11 5260564 5260585 5260581 5260586 +
cacttaaaagatacagaattgc

SEQ ID NO: 90418 - DNA, 22 bp, Artificial Sequence
  Synthetic oligonucleotide; CTT chr11 5260569 5260590 5260586 5260591 +
aaaagatacagaattgcagaat

SEQ ID NO: 90419 - DNA, 22 bp, Artificial Sequence
  Synthetic oligonucleotide; TTA chr11 5260570 5260591 5260587 5260592 +
aaagatacagaattgcagaatg

SEQ ID NO: 90420 - DNA, 22 bp, Artificial Sequence
  Synthetic oligonucleotide; TTG chr11 5260585 5260606 5260602 5260607 +
cagaatgaataagaattcacca

SEQ ID NO: 90421 - DNA, 22 bp, Artificial Sequence
  Synthetic oligonucleotide; TTC chr11 5260603 5260624 5260620 5260625 +
accaaccagttatctgccgcct

SEQ ID NO: 90422 - DNA, 22 bp, Artificial Sequence
  Synthetic oligonucleotide; TTA chr11 5260615 5260636 5260632 5260637 +
tctgccgccttcaggagactca

SEQ ID NO: 90423 - DNA, 22 bp, Artificial Sequence
  Synthetic oligonucleotide; CTG chr11 5260619 5260640 5260636 5260641 +
ccgccttcaggagactcaccta

SEQ ID NO: 90424 - DNA, 22 bp, Artificial Sequence
  Synthetic oligonucleotide; CTT chr11 5260626 5260647 5260643 5260648 +
caggagactcacctaacacata

SEQ ID NO: 90425 - DNA, 22 bp, Artificial Sequence
  Synthetic oligonucleotide; TTC chr11 5260627 5260648 5260644 5260649 +
aggagactcacctaacacataa

SEQ ID NO: 90426 - DNA, 22 bp, Artificial Sequence
  Synthetic oligonucleotide; CTC chr11 5260636 5260657 5260653 5260658 +
acctaacacataaggactcaca

SEQ ID NO: 90427 - DNA, 22 bp, Artificial Sequence
  Synthetic oligonucleotide; CTA chr11 5260641 5260662 5260658 5260663 +
acacataaggactcacataaac

SEQ ID NO: 90428 - DNA, 22 bp, Artificial Sequence
  Synthetic oligonucleotide; CTC chr11 5260655 5260676 5260672 5260677 +
acataaacttaaggtaaagggg

SEQ ID NO: 90429 - DNA, 22 bp, Artificial Sequence
  Synthetic oligonucleotide; CTT chr11 5260665 5260686 5260682 5260687 +
aaggtaaaggggtggaaaatga

SEQ ID NO: 90430 - DNA, 22 bp, Artificial Sequence
  Synthetic oligonucleotide; TTA chr11 5260666 5260687 5260683 5260688 +
aggtaaaggggtggaaaatgac

SEQ ID NO: 90431 - DNA, 22 bp, Artificial Sequence
  Synthetic oligonucleotide; TTC chr11 5260692 5260713 5260709 5260714 +
cacacaaatggacaccaaaagc

SEQ ID NO: 90432 - DNA, 22 bp, Artificial Sequence
  Synthetic oligonucleotide; CTA chr11 5260729 5260750 5260746 5260751 +
ttcttatgtcagacaaaacaaa

SEQ ID NO: 90433 - DNA, 22 bp, Artificial Sequence
  Synthetic oligonucleotide; TTC chr11 5260732 5260753 5260749 5260754 +
ttatgtcagacaaaacaaactt

SEQ ID NO: 90434 - DNA, 22 bp, Artificial Sequence
  Synthetic oligonucleotide; CTT chr11 5260734 5260755 5260751 5260756 +
atgtcagacaaaacaaacttta

SEQ ID NO: 90435 - DNA, 22 bp, Artificial Sequence
  Synthetic oligonucleotide; TTA chr11 5260735 5260756 5260752 5260757 +
tgtcagacaaaacaaactttaa

SEQ ID NO: 90436 - DNA, 22 bp, Artificial Sequence
  Synthetic oligonucleotide; CTT chr11 5260754 5260775 5260771 5260776 +
taaagaaacagcagttaaaaaa

SEQ ID NO: 90437 - DNA, 22 bp, Artificial Sequence
  Synthetic oligonucleotide; TTT chr11 5260755 5260776 5260772 5260777 +
aaagaaacagcagttaaaaaag

SEQ ID NO: 90438 - DNA, 22 bp, Artificial Sequence
  Synthetic oligonucleotide; TTA chr11 5260756 5260777 5260773 5260778 +
aagaaacagcagttaaaaaaga

SEQ ID NO: 90439 - DNA, 22 bp, Artificial Sequence
  Synthetic oligonucleotide; TTA chr11 5260771 5260792 5260788 5260793 +
aaaaagacaaagagggacatca

SEQ ID NO: 90440 - DNA, 22 bp, Artificial Sequence
  Synthetic oligonucleotide; CTT chr11 5260812 5260833 5260829 5260834 +
gtccaatgggagaatattacaa

SEQ ID NO: 90441 - DNA, 22 bp, Artificial Sequence
  Synthetic oligonucleotide; TTG chr11 5260813 5260834 5260830 5260835 +
tccaatgggagaatattacaat

SEQ ID NO: 90442 - DNA, 22 bp, Artificial Sequence
  Synthetic oligonucleotide; TTA chr11 5260831 5260852 5260848 5260853 +
caattcttaatatatatgcatc

SEQ ID NO: 90443 - DNA, 22 bp, Artificial Sequence
  Synthetic oligonucleotide; TTC chr11 5260837 5260858 5260854 5260859 +
ttaatatatatgcatctaatac

SEQ ID NO: 90444 - DNA, 22 bp, Artificial Sequence
  Synthetic oligonucleotide; CTT chr11 5260839 5260860 5260856 5260861 +
aatatatatgcatctaatactg

SEQ ID NO: 90445 - DNA, 22 bp, Artificial Sequence
  Synthetic oligonucleotide; TTA chr11 5260840 5260861 5260857 5260862 +
atatatatgcatctaatactgg

SEQ ID NO: 90446 - DNA, 22 bp, Artificial Sequence
  Synthetic oligonucleotide; CTA chr11 5260855 5260876 5260872 5260877 +
atactggagatcccaaatttat

SEQ ID NO: 90447 - DNA, 22 bp, Artificial Sequence
  Synthetic oligonucleotide; CTG chr11 5260861 5260882 5260878 5260883 +
gagatcccaaatttataaaaca

SEQ ID NO: 90448 - DNA, 22 bp, Artificial Sequence
  Synthetic oligonucleotide; TTT chr11 5260875 5260896 5260892 5260897 +
ataaaacaattactactagact

SEQ ID NO: 90449 - DNA, 22 bp, Artificial Sequence
  Synthetic oligonucleotide; TTA chr11 5260876 5260897 5260893 5260898 +
taaaacaattactactagacta

SEQ ID NO: 90450 - DNA, 22 bp, Artificial Sequence
  Synthetic oligonucleotide; TTA chr11 5260887 5260908 5260904 5260909 +
ctactagactagacagcaacat

SEQ ID NO: 90451 - DNA, 22 bp, Artificial Sequence
  Synthetic oligonucleotide; CTA chr11 5260890 5260911 5260907 5260912 +
ctagactagacagcaacataat

SEQ ID NO: 90452 - DNA, 22 bp, Artificial Sequence
  Synthetic oligonucleotide; CTA chr11 5260893 5260914 5260910 5260915 +
gactagacagcaacataataat

SEQ ID NO: 90453 - DNA, 22 bp, Artificial Sequence
  Synthetic oligonucleotide; CTA chr11 5260898 5260919 5260915 5260920 +
gacagcaacataataatagtgg

SEQ ID NO: 90454 - DNA, 22 bp, Artificial Sequence
  Synthetic oligonucleotide; CTT chr11 5260927 5260948 5260944 5260949 +
caatactccactgactgcacta

SEQ ID NO: 90455 - DNA, 22 bp, Artificial Sequence
  Synthetic oligonucleotide; TTC chr11 5260928 5260949 5260945 5260950 +
aatactccactgactgcactag

SEQ ID NO: 90456 - DNA, 22 bp, Artificial Sequence
  Synthetic oligonucleotide; CTC chr11 5260935 5260956 5260952 5260957 +
cactgactgcactaggcaggtc

SEQ ID NO: 90457 - DNA, 22 bp, Artificial Sequence
  Synthetic oligonucleotide; CTG chr11 5260940 5260961 5260957 5260962 +
actgcactaggcaggtcatcaa

SEQ ID NO: 90458 - DNA, 22 bp, Artificial Sequence
  Synthetic oligonucleotide; CTG chr11 5260944 5260965 5260961 5260966 +
cactaggcaggtcatcaagaca

SEQ ID NO: 90459 - DNA, 22 bp, Artificial Sequence
  Synthetic oligonucleotide; CTA chr11 5260949 5260970 5260966 5260971 +
ggcaggtcatcaagacagtcta

SEQ ID NO: 90460 - DNA, 22 bp, Artificial Sequence
  Synthetic oligonucleotide; CTA chr11 5260971 5260992 5260988 5260993 +
caaagaaacaatggatttaaag

SEQ ID NO: 90461 - DNA, 22 bp, Artificial Sequence
  Synthetic oligonucleotide; TTT chr11 5260989 5261010 5261006 5261011 +
aaagaacaaatggacttaacag

SEQ ID NO: 90462 - DNA, 22 bp, Artificial Sequence
  Synthetic oligonucleotide; TTA chr11 5260990 5261011 5261007 5261012 +
aagaacaaatggacttaacaga

SEQ ID NO: 90463 - DNA, 22 bp, Artificial Sequence
  Synthetic oligonucleotide; CTT chr11 5261006 5261027 5261023 5261028 +
aacagatatttacaggacattc

SEQ ID NO: 90464 - DNA, 22 bp, Artificial Sequence
  Synthetic oligonucleotide; TTA chr11 5261007 5261028 5261024 5261029 +
acagatatttacaggacattct

SEQ ID NO: 90465 - DNA, 22 bp, Artificial Sequence
  Synthetic oligonucleotide; TTT chr11 5261017 5261038 5261034 5261039 +
acaggacattctacccaacaac

SEQ ID NO: 90466 - DNA, 22 bp, Artificial Sequence
  Synthetic oligonucleotide; TTA chr11 5261018 5261039 5261035 5261040 +
caggacattctacccaacaact

SEQ ID NO: 90467 - DNA, 22 bp, Artificial Sequence
  Synthetic oligonucleotide; TTC chr11 5261028 5261049 5261045 5261050 +
tacccaacaactgcagaataca

SEQ ID NO: 90468 - DNA, 22 bp, Artificial Sequence
  Synthetic oligonucleotide; CTA chr11 5261030 5261051 5261047 5261052 +
cccaacaactgcagaatacaca

SEQ ID NO: 90469 - DNA, 22 bp, Artificial Sequence
  Synthetic oligonucleotide; CTG chr11 5261041 5261062 5261058 5261063 +
cagaatacacattctattcatc

SEQ ID NO: 90470 - DNA, 22 bp, Artificial Sequence
  Synthetic oligonucleotide; TTC chr11 5261055 5261076 5261072 5261077 +
tattcatcagcacatggaactt

SEQ ID NO: 90471 - DNA, 22 bp, Artificial Sequence
  Synthetic oligonucleotide; CTA chr11 5261057 5261078 5261074 5261079 +
ttcatcagcacatggaactttc

SEQ ID NO: 90472 - DNA, 22 bp, Artificial Sequence
  Synthetic oligonucleotide; TTC chr11 5261060 5261081 5261077 5261082 +
atcagcacatggaactttctcc

SEQ ID NO: 90473 - DNA, 22 bp, Artificial Sequence
  Synthetic oligonucleotide; CTT chr11 5261077 5261098 5261094 5261099 +
tctccaagataggccatatgat

SEQ ID NO: 90474 - DNA, 22 bp, Artificial Sequence
  Synthetic oligonucleotide; TTT chr11 5261078 5261099 5261095 5261100 +
ctccaagataggccatatgata

SEQ ID NO: 90475 - DNA, 22 bp, Artificial Sequence
  Synthetic oligonucleotide; TTC chr11 5261079 5261100 5261096 5261101 +
tccaagataggccatatgatat

SEQ ID NO: 90476 - DNA, 22 bp, Artificial Sequence
  Synthetic oligonucleotide; CTC chr11 5261081 5261102 5261098 5261103 +
caagataggccatatgatatgc

SEQ ID NO: 90477 - DNA, 22 bp, Artificial Sequence
  Synthetic oligonucleotide; CTC chr11 5261118 5261139 5261135 5261140 +
aataaatttttaaaaattgaaa

SEQ ID NO: 90478 - DNA, 22 bp, Artificial Sequence
  Synthetic oligonucleotide; TTT chr11 5261127 5261148 5261144 5261149 +
ttaaaaattgaaattatatcaa

SEQ ID NO: 90479 - DNA, 22 bp, Artificial Sequence
  Synthetic oligonucleotide; TTT chr11 5261128 5261149 5261145 5261150 +
taaaaattgaaattatatcaag

SEQ ID NO: 90480 - DNA, 22 bp, Artificial Sequence
  Synthetic oligonucleotide; TTT chr11 5261129 5261150 5261146 5261151 +
aaaaattgaaattatatcaagc

SEQ ID NO: 90481 - DNA, 22 bp, Artificial Sequence
  Synthetic oligonucleotide; TTA chr11 5261130 5261151 5261147 5261152 +
aaaattgaaattatatcaagca

SEQ ID NO: 90482 - DNA, 22 bp, Artificial Sequence
  Synthetic oligonucleotide; TTG chr11 5261137 5261158 5261154 5261159 +
aaattatatcaagcactctctc

SEQ ID NO: 90483 - DNA, 22 bp, Artificial Sequence
  Synthetic oligonucleotide; TTA chr11 5261143 5261164 5261160 5261165 +
tatcaagcactctctcagacca

SEQ ID NO: 90484 - DNA, 22 bp, Artificial Sequence
  Synthetic oligonucleotide; CTC chr11 5261155 5261176 5261172 5261177 +
tctcagaccacagtagaataaa

SEQ ID NO: 90485 - DNA, 22 bp, Artificial Sequence
  Synthetic oligonucleotide; CTC chr11 5261157 5261178 5261174 5261179 +
tcagaccacagtagaataaaat

SEQ ID NO: 90486 - DNA, 22 bp, Artificial Sequence
  Synthetic oligonucleotide; CTC chr11 5261159 5261180 5261176 5261181 +
agaccacagtagaataaaattg

SEQ ID NO: 90487 - DNA, 22 bp, Artificial Sequence
  Synthetic oligonucleotide; TTG chr11 5261181 5261202 5261198 5261203 +
gaaatcaactacaaaaggaacc

SEQ ID NO: 90488 - DNA, 22 bp, Artificial Sequence
  Synthetic oligonucleotide; CTA chr11 5261192 5261213 5261209 5261214 +
caaaaggaaccttcaaaaccat

SEQ ID NO: 90489 - DNA, 22 bp, Artificial Sequence
  Synthetic oligonucleotide; CTT chr11 5261205 5261226 5261222 5261227 +
caaaaccatgcaaatacaggga

SEQ ID NO: 90490 - DNA, 22 bp, Artificial Sequence
  Synthetic oligonucleotide; TTC chr11 5261206 5261227 5261223 5261228 +
aaaaccatgcaaatacagggaa

SEQ ID NO: 90491 - DNA, 22 bp, Artificial Sequence
  Synthetic oligonucleotide; TTA chr11 5261232 5261253 5261249 5261254 +
aataacctgctcctgaatgatc

SEQ ID NO: 90492 - DNA, 22 bp, Artificial Sequence
  Synthetic oligonucleotide; CTG chr11 5261241 5261262 5261258 5261263 +
ctcctgaatgatcattgggtca

SEQ ID NO: 90493 - DNA, 22 bp, Artificial Sequence
  Synthetic oligonucleotide; CTC chr11 5261244 5261265 5261261 5261266 +
ctgaatgatcattgggtcaaca

SEQ ID NO: 90494 - DNA, 22 bp, Artificial Sequence
  Synthetic oligonucleotide; CTG chr11 5261247 5261268 5261264 5261269 +
aatgatcattgggtcaacaatg

SEQ ID NO: 90495 - DNA, 22 bp, Artificial Sequence
  Synthetic oligonucleotide; TTG chr11 5261258 5261279 5261275 5261280 +
ggtcaacaatgaaatcaagatg

SEQ ID NO: 90496 - DNA, 22 bp, Artificial Sequence
  Synthetic oligonucleotide; TTT chr11 5261287 5261308 5261304 5261309 +
aaaaatcatttgctttgaaaac

SEQ ID NO: 90497 - DNA, 22 bp, Artificial Sequence
  Synthetic oligonucleotide; TTA chr11 5261288 5261309 5261305 5261310 +
aaaatcatttgctttgaaaacc

SEQ ID NO: 90498 - DNA, 22 bp, Artificial Sequence
  Synthetic oligonucleotide; TTT chr11 5261298 5261319 5261315 5261320 +
gctttgaaaaccggcacaagac

SEQ ID NO: 90499 - DNA, 22 bp, Artificial Sequence
  Synthetic oligonucleotide; TTG chr11 5261299 5261320 5261316 5261321 +
ctttgaaaaccggcacaagaca

SEQ ID NO: 90500 - DNA, 22 bp, Artificial Sequence
  Synthetic oligonucleotide; CTT chr11 5261302 5261323 5261319 5261324 +
tgaaaaccggcacaagacaagg

SEQ ID NO: 90501 - DNA, 22 bp, Artificial Sequence
  Synthetic oligonucleotide; TTT chr11 5261303 5261324 5261320 5261325 +
gaaaaccggcacaagacaagga

SEQ ID NO: 90502 - DNA, 22 bp, Artificial Sequence
  Synthetic oligonucleotide; TTG chr11 5261304 5261325 5261321 5261326 +
aaaaccggcacaagacaaggat

SEQ ID NO: 90503 - DNA, 22 bp, Artificial Sequence
  Synthetic oligonucleotide; CTC chr11 5261332 5261353 5261349 5261354 +
tcgccactcttactcaacatag

SEQ ID NO: 90504 - DNA, 22 bp, Artificial Sequence
  Synthetic oligonucleotide; CTC chr11 5261334 5261355 5261351 5261356 +
gccactcttactcaacatagta

SEQ ID NO: 90505 - DNA, 22 bp, Artificial Sequence
  Synthetic oligonucleotide; CTC chr11 5261341 5261362 5261358 5261363 +
ttactcaacatagtattggaag

SEQ ID NO: 90506 - DNA, 22 bp, Artificial Sequence
  Synthetic oligonucleotide; CTT chr11 5261343 5261364 5261360 5261365 +
actcaacatagtattggaagtt

SEQ ID NO: 90507 - DNA, 22 bp, Artificial Sequence
  Synthetic oligonucleotide; TTA chr11 5261344 5261365 5261361 5261366 +
ctcaacatagtattggaagttc

SEQ ID NO: 90508 - DNA, 22 bp, Artificial Sequence
  Synthetic oligonucleotide; CTC chr11 5261347 5261368 5261364 5261369 +
aacatagtattggaagttctcg

SEQ ID NO: 90509 - DNA, 22 bp, Artificial Sequence
  Synthetic oligonucleotide; TTG chr11 5261359 5261380 5261376 5261381 +
gaagttctcgccaggacaatca

SEQ ID NO: 90510 - DNA, 22 bp, Artificial Sequence
  Synthetic oligonucleotide; TTC chr11 5261366 5261387 5261383 5261388 +
tcgccaggacaatcaggcaaga

SEQ ID NO: 90511 - DNA, 22 bp, Artificial Sequence
  Synthetic oligonucleotide; CTC chr11 5261368 5261389 5261385 5261390 +
gccaggacaatcaggcaagaga

SEQ ID NO: 90512 - DNA, 22 bp, Artificial Sequence
  Synthetic oligonucleotide; TTC chr11 5261408 5261429 5261425 5261430 +
aaataggaagagaggaagtcaa

SEQ ID NO: 90513 - DNA, 22 bp, Artificial Sequence
  Synthetic oligonucleotide; TTG chr11 5261434 5261455 5261451 5261456 +
tctctgtttgcagatgacatga

SEQ ID NO: 90514 - DNA, 22 bp, Artificial Sequence
  Synthetic oligonucleotide; CTC chr11 5261438 5261459 5261455 5261460 +
tgtttgcagatgacatgattgt

SEQ ID NO: 90515 - DNA, 22 bp, Artificial Sequence
  Synthetic oligonucleotide; CTG chr11 5261440 5261461 5261457 5261462 +
tttgcagatgacatgattgtat

SEQ ID NO: 90516 - DNA, 22 bp, Artificial Sequence
  Synthetic oligonucleotide; TTT chr11 5261443 5261464 5261460 5261465 +
gcagatgacatgattgtatatt

SEQ ID NO: 90517 - DNA, 22 bp, Artificial Sequence
  Synthetic oligonucleotide; TTG chr11 5261444 5261465 5261461 5261466 +
cagatgacatgattgtatattt

SEQ ID NO: 90518 - DNA, 22 bp, Artificial Sequence
  Synthetic oligonucleotide; TTG chr11 5261459 5261480 5261476 5261481 +
tatatttagaagaccctgtcat

SEQ ID NO: 90519 - DNA, 22 bp, Artificial Sequence
  Synthetic oligonucleotide; TTT chr11 5261466 5261487 5261483 5261488 +
agaagaccctgtcatctcagcc

SEQ ID NO: 90520 - DNA, 22 bp, Artificial Sequence
  Synthetic oligonucleotide; TTA chr11 5261467 5261488 5261484 5261489 +
gaagaccctgtcatctcagccc

SEQ ID NO: 90521 - DNA, 22 bp, Artificial Sequence
  Synthetic oligonucleotide; CTG chr11 5261477 5261498 5261494 5261499 +
tcatctcagcccaaaatcttaa

SEQ ID NO: 90522 - DNA, 22 bp, Artificial Sequence
  Synthetic oligonucleotide; CTC chr11 5261484 5261505 5261501 5261506 +
agcccaaaatcttaagctgata

SEQ ID NO: 90523 - DNA, 22 bp, Artificial Sequence
  Synthetic oligonucleotide; CTT chr11 5261497 5261518 5261514 5261519 +
aagctgataaacagcttcagca

SEQ ID NO: 90524 - DNA, 22 bp, Artificial Sequence
  Synthetic oligonucleotide; TTA chr11 5261498 5261519 5261515 5261520 +
agctgataaacagcttcagcaa

SEQ ID NO: 90525 - DNA, 22 bp, Artificial Sequence
  Synthetic oligonucleotide; CTG chr11 5261503 5261524 5261520 5261525 +
ataaacagcttcagcaaagtct

SEQ ID NO: 90526 - DNA, 22 bp, Artificial Sequence
  Synthetic oligonucleotide; CTT chr11 5261514 5261535 5261531 5261536 +
cagcaaagtctcaagatacaaa

SEQ ID NO: 90527 - DNA, 22 bp, Artificial Sequence
  Synthetic oligonucleotide; TTC chr11 5261515 5261536 5261532 5261537 +
agcaaagtctcaagatacaaaa

SEQ ID NO: 90528 - DNA, 22 bp, Artificial Sequence
  Synthetic oligonucleotide; CTC chr11 5261526 5261547 5261543 5261548 +
aagatacaaaatcagtgtgcag

SEQ ID NO: 90529 - DNA, 22 bp, Artificial Sequence
  Synthetic oligonucleotide; TTC chr11 5261563 5261584 5261580 5261585 +
ctatacaccaataatagacaag

SEQ ID NO: 90530 - DNA, 22 bp, Artificial Sequence
  Synthetic oligonucleotide; CTA chr11 5261566 5261587 5261583 5261588 +
tacaccaataatagacaagcag

SEQ ID NO: 90531 - DNA, 22 bp, Artificial Sequence
  Synthetic oligonucleotide; CTC chr11 5261611 5261632 5261628 5261633 +
ccattcacaattgctgcaaaga

SEQ ID NO: 90532 - DNA, 22 bp, Artificial Sequence
  Synthetic oligonucleotide; TTC chr11 5261617 5261638 5261634 5261639 +
acaattgctgcaaagagaataa

SEQ ID NO: 90533 - DNA, 22 bp, Artificial Sequence
  Synthetic oligonucleotide; TTG chr11 5261624 5261645 5261641 5261646 +
ctgcaaagagaataaaataaaa

SEQ ID NO: 90534 - DNA, 22 bp, Artificial Sequence
  Synthetic oligonucleotide; CTG chr11 5261627 5261648 5261644 5261649 +
caaagagaataaaataaaatac

SEQ ID NO: 90535 - DNA, 22 bp, Artificial Sequence
  Synthetic oligonucleotide; CTA chr11 5261652 5261673 5261669 5261674 +
gaaatacaacttctaagggatg

SEQ ID NO: 90536 - DNA, 22 bp, Artificial Sequence
  Synthetic oligonucleotide; CTT chr11 5261664 5261685 5261681 5261686 +
ctaagggatgtgaagaacctct

SEQ ID NO: 90537 - DNA, 22 bp, Artificial Sequence
  Synthetic oligonucleotide; TTC chr11 5261665 5261686 5261682 5261687 +
taagggatgtgaagaacctctt

SEQ ID NO: 90538 - DNA, 22 bp, Artificial Sequence
  Synthetic oligonucleotide; CTA chr11 5261667 5261688 5261684 5261689 +
agggatgtgaagaacctcttca

SEQ ID NO: 90539 - DNA, 22 bp, Artificial Sequence
  Synthetic oligonucleotide; CTC chr11 5261685 5261706 5261702 5261707 +
ttcaaggagagctacaaaccac

SEQ ID NO: 90540 - DNA, 22 bp, Artificial Sequence
  Synthetic oligonucleotide; CTT chr11 5261687 5261708 5261704 5261709 +
caaggagagctacaaaccactc

SEQ ID NO: 90541 - DNA, 22 bp, Artificial Sequence
  Synthetic oligonucleotide; TTC chr11 5261688 5261709 5261705 5261710 +
aaggagagctacaaaccactca

SEQ ID NO: 90542 - DNA, 22 bp, Artificial Sequence
  Synthetic oligonucleotide; CTA chr11 5261699 5261720 5261716 5261721 +
caaaccactcactgctcaagga

SEQ ID NO: 90543 - DNA, 22 bp, Artificial Sequence
  Synthetic oligonucleotide; CTC chr11 5261709 5261730 5261726 5261731 +
actgctcaaggaaataagagag

SEQ ID NO: 90544 - DNA, 22 bp, Artificial Sequence
  Synthetic oligonucleotide; CTG chr11 5261713 5261734 5261730 5261735 +
ctcaaggaaataagagaggaca

SEQ ID NO: 90545 - DNA, 22 bp, Artificial Sequence
  Synthetic oligonucleotide; CTC chr11 5261716 5261737 5261733 5261738 +
aaggaaataagagaggacacaa

SEQ ID NO: 90546 - DNA, 22 bp, Artificial Sequence
  Synthetic oligonucleotide; TTC chr11 5261756 5261777 5261773 5261778 +
catgctcatagatagaaagaat

SEQ ID NO: 90547 - DNA, 22 bp, Artificial Sequence
  Synthetic oligonucleotide; CTC chr11 5261763 5261784 5261780 5261785 +
atagatagaaagaatcaatatc

SEQ ID NO: 90548 - DNA, 22 bp, Artificial Sequence
  Synthetic oligonucleotide; CTT chr11 5261787 5261808 5261804 5261809 +
taaaatggccatactgcccaaa

SEQ ID NO: 90549 - DNA, 22 bp, Artificial Sequence
  Synthetic oligonucleotide; TTT chr11 5261788 5261809 5261805 5261810 +
aaaatggccatactgcccaaag

SEQ ID NO: 90550 - DNA, 22 bp, Artificial Sequence
  Synthetic oligonucleotide; TTA chr11 5261789 5261810 5261806 5261811 +
aaatggccatactgcccaaagt

SEQ ID NO: 90551 - DNA, 22 bp, Artificial Sequence
  Synthetic oligonucleotide; CTG chr11 5261803 5261824 5261820 5261825 +
cccaaagtaatttatagattca

SEQ ID NO: 90552 - DNA, 22 bp, Artificial Sequence
  Synthetic oligonucleotide; TTT chr11 5261816 5261837 5261833 5261838 +
atagattcaatgctatccccat

SEQ ID NO: 90553 - DNA, 22 bp, Artificial Sequence
  Synthetic oligonucleotide; TTA chr11 5261817 5261838 5261834 5261839 +
tagattcaatgctatccccatc

SEQ ID NO: 90554 - DNA, 22 bp, Artificial Sequence
  Synthetic oligonucleotide; TTC chr11 5261824 5261845 5261841 5261846 +
aatgctatccccatcaagctac

SEQ ID NO: 90555 - DNA, 22 bp, Artificial Sequence
  Synthetic oligonucleotide; CTA chr11 5261831 5261852 5261848 5261853 +
tccccatcaagctaccactgac

SEQ ID NO: 90556 - DNA, 22 bp, Artificial Sequence
  Synthetic oligonucleotide; CTA chr11 5261845 5261866 5261862 5261867 +
ccactgacttttttcaaagaat

SEQ ID NO: 90557 - DNA, 22 bp, Artificial Sequence
  Synthetic oligonucleotide; CTG chr11 5261851 5261872 5261868 5261873 +
acttttttcaaagaattagaaa

SEQ ID NO: 90558 - DNA, 22 bp, Artificial Sequence
  Synthetic oligonucleotide; CTT chr11 5261855 5261876 5261872 5261877 +
ttttcaaagaattagaaaaaac

SEQ ID NO: 90559 - DNA, 22 bp, Artificial Sequence
  Synthetic oligonucleotide; TTT chr11 5261856 5261877 5261873 5261878 +
tttcaaagaattagaaaaaact

SEQ ID NO: 90560 - DNA, 22 bp, Artificial Sequence
  Synthetic oligonucleotide; TTT chr11 5261857 5261878 5261874 5261879 +
ttcaaagaattagaaaaaacta

SEQ ID NO: 90561 - DNA, 22 bp, Artificial Sequence
  Synthetic oligonucleotide; TTT chr11 5261858 5261879 5261875 5261880 +
tcaaagaattagaaaaaactac

SEQ ID NO: 90562 - DNA, 22 bp, Artificial Sequence
  Synthetic oligonucleotide; TTT chr11 5261859 5261880 5261876 5261881 +
caaagaattagaaaaaactact

SEQ ID NO: 90563 - DNA, 22 bp, Artificial Sequence
  Synthetic oligonucleotide; TTC chr11 5261860 5261881 5261877 5261882 +
aaagaattagaaaaaactactt

SEQ ID NO: 90564 - DNA, 22 bp, Artificial Sequence
  Synthetic oligonucleotide; TTA chr11 5261869 5261890 5261886 5261891 +
gaaaaaactactttaaatgtca

SEQ ID NO: 90565 - DNA, 22 bp, Artificial Sequence
  Synthetic oligonucleotide; CTA chr11 5261879 5261900 5261896 5261901 +
ctttaaatgtcatatggaatca

SEQ ID NO: 90566 - DNA, 22 bp, Artificial Sequence
  Synthetic oligonucleotide; CTT chr11 5261882 5261903 5261899 5261904 +
taaatgtcatatggaatcaaaa

SEQ ID NO: 90567 - DNA, 22 bp, Artificial Sequence
  Synthetic oligonucleotide; TTT chr11 5261883 5261904 5261900 5261905 +
aaatgtcatatggaatcaaaaa

SEQ ID NO: 90568 - DNA, 22 bp, Artificial Sequence
  Synthetic oligonucleotide; TTA chr11 5261884 5261905 5261901 5261906 +
aatgtcatatggaatcaaaaaa

SEQ ID NO: 90569 - DNA, 22 bp, Artificial Sequence
  Synthetic oligonucleotide; CTA chr11 5261932 5261953 5261949 5261954 +
aacaaaaagaacaaagctggag

SEQ ID NO: 90570 - DNA, 22 bp, Artificial Sequence
  Synthetic oligonucleotide; CTG chr11 5261951 5261972 5261968 5261973 +
gaggcatgatgctacctgactt

SEQ ID NO: 90571 - DNA, 22 bp, Artificial Sequence
  Synthetic oligonucleotide; CTA chr11 5261965 5261986 5261982 5261987 +
cctgacttcaaactatactaca

SEQ ID NO: 90572 - DNA, 22 bp, Artificial Sequence
  Synthetic oligonucleotide; CTG chr11 5261969 5261990 5261986 5261991 +
acttcaaactatactacaaggc

SEQ ID NO: 90573 - DNA, 22 bp, Artificial Sequence
  Synthetic oligonucleotide; CTT chr11 5261973 5261994 5261990 5261995 +
caaactatactacaaggctaca

SEQ ID NO: 90574 - DNA, 22 bp, Artificial Sequence
  Synthetic oligonucleotide; TTC chr11 5261974 5261995 5261991 5261996 +
aaactatactacaaggctacag

SEQ ID NO: 90575 - DNA, 22 bp, Artificial Sequence
  Synthetic oligonucleotide; CTA chr11 5261980 5262001 5261997 5262002 +
tactacaaggctacagtaacaa

SEQ ID NO: 90576 - DNA, 22 bp, Artificial Sequence
  Synthetic oligonucleotide; CTA chr11 5261985 5262006 5262002 5262007 +
caaggctacagtaacaaaaaca

SEQ ID NO: 90577 - DNA, 22 bp, Artificial Sequence
  Synthetic oligonucleotide; CTA chr11 5261993 5262014 5262010 5262015 +
cagtaacaaaaacagcatggta

SEQ ID NO: 90578 - DNA, 22 bp, Artificial Sequence
  Synthetic oligonucleotide; CTG chr11 5262018 5262039 5262035 5262040 +
gtaccaaaacagatatatagac

SEQ ID NO: 90579 - DNA, 22 bp, Artificial Sequence
  Synthetic oligonucleotide; CTC chr11 5262063 5262084 5262080 5262085 +
agaaataatgccacacatctac

SEQ ID NO: 90580 - DNA, 22 bp, Artificial Sequence
  Synthetic oligonucleotide; CTA chr11 5262084 5262105 5262101 5262106 +
cgaccatctgatctttgacaaa

SEQ ID NO: 90581 - DNA, 22 bp, Artificial Sequence
  Synthetic oligonucleotide; CTG chr11 5262094 5262115 5262111 5262116 +
atctttgacaaacatcacaaaa

SEQ ID NO: 90582 - DNA, 22 bp, Artificial Sequence
  Synthetic oligonucleotide; CTT chr11 5262099 5262120 5262116 5262121 +
tgacaaacatcacaaaagcaat

SEQ ID NO: 90583 - DNA, 22 bp, Artificial Sequence
  Synthetic oligonucleotide; TTT chr11 5262100 5262121 5262117 5262122 +
gacaaacatcacaaaagcaatg

SEQ ID NO: 90584 - DNA, 22 bp, Artificial Sequence
  Synthetic oligonucleotide; TTG chr11 5262101 5262122 5262118 5262123 +
acaaacatcacaaaagcaatgg

SEQ ID NO: 90585 - DNA, 22 bp, Artificial Sequence
  Synthetic oligonucleotide; TTC chr11 5262134 5262155 5262151 5262156 +
cctatttaataaatggtgctgg

SEQ ID NO: 90586 - DNA, 22 bp, Artificial Sequence
  Synthetic oligonucleotide; CTA chr11 5262138 5262159 5262155 5262160 +
tttaataaatggtgctggaaaa

SEQ ID NO: 90587 - DNA, 22 bp, Artificial Sequence
  Synthetic oligonucleotide; TTT chr11 5262141 5262162 5262158 5262163 +
aataaatggtgctggaaaaact

SEQ ID NO: 90588 - DNA, 22 bp, Artificial Sequence
  Synthetic oligonucleotide; TTA chr11 5262142 5262163 5262159 5262164 +
ataaatggtgctggaaaaactg

SEQ ID NO: 90589 - DNA, 22 bp, Artificial Sequence
  Synthetic oligonucleotide; CTG chr11 5262155 5262176 5262172 5262177 +
gaaaaactggctagcaatatgc

SEQ ID NO: 90590 - DNA, 22 bp, Artificial Sequence
  Synthetic oligonucleotide; CTG chr11 5262164 5262185 5262181 5262186 +
gctagcaatatgcataaaactg

SEQ ID NO: 90591 - DNA, 22 bp, Artificial Sequence
  Synthetic oligonucleotide; CTA chr11 5262168 5262189 5262185 5262190 +
gcaatatgcataaaactgaaac

SEQ ID NO: 90592 - DNA, 22 bp, Artificial Sequence
  Synthetic oligonucleotide; CTG chr11 5262186 5262207 5262203 5262208 +
aaactgtaccccttccttacac

SEQ ID NO: 90593 - DNA, 22 bp, Artificial Sequence
  Synthetic oligonucleotide; CTG chr11 5262192 5262213 5262209 5262214 +
taccccttccttacaccttata

SEQ ID NO: 90594 - DNA, 22 bp, Artificial Sequence
  Synthetic oligonucleotide; CTT chr11 5262200 5262221 5262217 5262222 +
ccttacaccttatacaaaaatt

SEQ ID NO: 90595 - DNA, 22 bp, Artificial Sequence
  Synthetic oligonucleotide; TTC chr11 5262201 5262222 5262218 5262223 +
cttacaccttatacaaaaatta

SEQ ID NO: 90596 - DNA, 22 bp, Artificial Sequence
  Synthetic oligonucleotide; CTT chr11 5262204 5262225 5262221 5262226 +
acaccttatacaaaaattaact

SEQ ID NO: 90597 - DNA, 22 bp, Artificial Sequence
  Synthetic oligonucleotide; TTA chr11 5262205 5262226 5262222 5262227 +
caccttatacaaaaattaactc

SEQ ID NO: 90598 - DNA, 22 bp, Artificial Sequence
  Synthetic oligonucleotide; CTT chr11 5262211 5262232 5262228 5262233 +
atacaaaaattaactcaaggtg

SEQ ID NO: 90599 - DNA, 22 bp, Artificial Sequence
  Synthetic oligonucleotide; TTA chr11 5262212 5262233 5262229 5262234 +
tacaaaaattaactcaaggtgg

SEQ ID NO: 90600 - DNA, 22 bp, Artificial Sequence
  Synthetic oligonucleotide; TTA chr11 5262223 5262244 5262240 5262245 +
actcaaggtggattaaagactt

SEQ ID NO: 90601 - DNA, 22 bp, Artificial Sequence
  Synthetic oligonucleotide; CTC chr11 5262227 5262248 5262244 5262249 +
aaggtggattaaagacttaaat

SEQ ID NO: 90602 - DNA, 22 bp, Artificial Sequence
  Synthetic oligonucleotide; TTA chr11 5262238 5262259 5262255 5262260 +
aagacttaaatgtgcaacctaa

SEQ ID NO: 90603 - DNA, 22 bp, Artificial Sequence
  Synthetic oligonucleotide; CTT chr11 5262245 5262266 5262262 5262267 +
aaatgtgcaacctaaaaccata

SEQ ID NO: 90604 - DNA, 22 bp, Artificial Sequence
  Synthetic oligonucleotide; TTA chr11 5262246 5262267 5262263 5262268 +
aatgtgcaacctaaaaccataa

SEQ ID NO: 90605 - DNA, 22 bp, Artificial Sequence
  Synthetic oligonucleotide; CTA chr11 5262259 5262280 5262276 5262281 +
aaaccataaaaatcctagaaga

SEQ ID NO: 90606 - DNA, 22 bp, Artificial Sequence
  Synthetic oligonucleotide; CTA chr11 5262276 5262297 5262293 5262298 +
gaagataacctaggcaatacca

SEQ ID NO: 90607 - DNA, 22 bp, Artificial Sequence
  Synthetic oligonucleotide; CTA chr11 5262288 5262309 5262305 5262310 +
ggcaataccattcaggacatag

SEQ ID NO: 90608 - DNA, 22 bp, Artificial Sequence
  Synthetic oligonucleotide; TTC chr11 5262301 5262322 5262318 5262323 +
aggacataggcatgggcaaaaa

SEQ ID NO: 90609 - DNA, 22 bp, Artificial Sequence
  Synthetic oligonucleotide; TTC chr11 5262326 5262347 5262343 5262348 +
acgactaaaacatcaaaagcaa

SEQ ID NO: 90610 - DNA, 22 bp, Artificial Sequence
  Synthetic oligonucleotide; CTA chr11 5262333 5262354 5262350 5262355 +
aaacatcaaaagcaatgacaac

SEQ ID NO: 90611 - DNA, 22 bp, Artificial Sequence
  Synthetic oligonucleotide; TTG chr11 5262369 5262390 5262386 5262391 +
acatatgggatctaattaaact

SEQ ID NO: 90612 - DNA, 22 bp, Artificial Sequence
  Synthetic oligonucleotide; CTA chr11 5262383 5262404 5262400 5262405 +
attaaactaaagagcttctgca

SEQ ID NO: 90613 - DNA, 22 bp, Artificial Sequence
  Synthetic oligonucleotide; TTA chr11 5262387 5262408 5262404 5262409 +
aactaaagagcttctgcacagc

SEQ ID NO: 90614 - DNA, 22 bp, Artificial Sequence
  Synthetic oligonucleotide; CTA chr11 5262392 5262413 5262409 5262414 +
aagagcttctgcacagcaaaag

SEQ ID NO: 90615 - DNA, 22 bp, Artificial Sequence
  Synthetic oligonucleotide; CTT chr11 5262400 5262421 5262417 5262422 +
ctgcacagcaaaagactatcat

SEQ ID NO: 90616 - DNA, 22 bp, Artificial Sequence
  Synthetic oligonucleotide; TTC chr11 5262401 5262422 5262418 5262423 +
tgcacagcaaaagactatcatc

SEQ ID NO: 90617 - DNA, 22 bp, Artificial Sequence
  Synthetic oligonucleotide; CTG chr11 5262403 5262424 5262420 5262425 +
cacagcaaaagactatcatcag

SEQ ID NO: 90618 - DNA, 22 bp, Artificial Sequence
  Synthetic oligonucleotide; CTA chr11 5262418 5262439 5262435 5262440 +
tcatcagagtgaacaggcaacc

SEQ ID NO: 90619 - DNA, 22 bp, Artificial Sequence
  Synthetic oligonucleotide; CTA chr11 5262442 5262463 5262459 5262464 +
cagaatgggagaaaatttttgc

SEQ ID NO: 90620 - DNA, 22 bp, Artificial Sequence
  Synthetic oligonucleotide; TTT chr11 5262460 5262481 5262477 5262482 +
ttgcaatctatccatctgacaa

SEQ ID NO: 90621 - DNA, 22 bp, Artificial Sequence
  Synthetic oligonucleotide; TTT chr11 5262461 5262482 5262478 5262483 +
tgcaatctatccatctgacaaa

SEQ ID NO: 90622 - DNA, 22 bp, Artificial Sequence
  Synthetic oligonucleotide; TTT chr11 5262462 5262483 5262479 5262484 +
gcaatctatccatctgacaaag

SEQ ID NO: 90623 - DNA, 22 bp, Artificial Sequence
  Synthetic oligonucleotide; TTG chr11 5262463 5262484 5262480 5262485 +
caatctatccatctgacaaagg

SEQ ID NO: 90624 - DNA, 22 bp, Artificial Sequence
  Synthetic oligonucleotide; CTA chr11 5262470 5262491 5262487 5262492 +
tccatctgacaaagggctaaca

SEQ ID NO: 90625 - DNA, 22 bp, Artificial Sequence
  Synthetic oligonucleotide; CTG chr11 5262478 5262499 5262495 5262500 +
acaaagggctaacatccaaaat

SEQ ID NO: 90626 - DNA, 22 bp, Artificial Sequence
  Synthetic oligonucleotide; CTA chr11 5262489 5262510 5262506 5262511 +
acatccaaaatctacaaagaac

SEQ ID NO: 90627 - DNA, 22 bp, Artificial Sequence
  Synthetic oligonucleotide; CTA chr11 5262503 5262524 5262520 5262525 +
caaagaacttcaacaaatttac

SEQ ID NO: 90628 - DNA, 22 bp, Artificial Sequence
  Synthetic oligonucleotide; CTT chr11 5262513 5262534 5262530 5262535 +
caacaaatttacaagaaaaaac

SEQ ID NO: 90629 - DNA, 22 bp, Artificial Sequence
  Synthetic oligonucleotide; TTC chr11 5262514 5262535 5262531 5262536 +
aacaaatttacaagaaaaaacc

SEQ ID NO: 90630 - DNA, 22 bp, Artificial Sequence
  Synthetic oligonucleotide; TTT chr11 5262523 5262544 5262540 5262545 +
acaagaaaaaacctaacgaccc

SEQ ID NO: 90631 - DNA, 22 bp, Artificial Sequence
  Synthetic oligonucleotide; TTA chr11 5262524 5262545 5262541 5262546 +
caagaaaaaacctaacgacccc

SEQ ID NO: 90632 - DNA, 22 bp, Artificial Sequence
  Synthetic oligonucleotide; CTA chr11 5262538 5262559 5262555 5262560 +
acgaccccatcaaaaagtggac

SEQ ID NO: 90633 - DNA, 22 bp, Artificial Sequence
  Synthetic oligonucleotide; CTT chr11 5262581 5262602 5262598 5262603 +
ctctaaagaagtcatttatgtg

SEQ ID NO: 90634 - DNA, 22 bp, Artificial Sequence
  Synthetic oligonucleotide; TTC chr11 5262582 5262603 5262599 5262604 +
tctaaagaagtcatttatgtgg

SEQ ID NO: 90635 - DNA, 22 bp, Artificial Sequence
  Synthetic oligonucleotide; CTC chr11 5262584 5262605 5262601 5262606 +
taaagaagtcatttatgtggcc

SEQ ID NO: 90636 - DNA, 22 bp, Artificial Sequence
  Synthetic oligonucleotide; CTA chr11 5262586 5262607 5262603 5262608 +
aagaagtcatttatgtggccaa

SEQ ID NO: 90637 - DNA, 22 bp, Artificial Sequence
  Synthetic oligonucleotide; TTT chr11 5262598 5262619 5262615 5262620 +
atgtggccaagaaacacatgaa

SEQ ID NO: 90638 - DNA, 22 bp, Artificial Sequence
  Synthetic oligonucleotide; TTA chr11 5262599 5262620 5262616 5262621 +
tgtggccaagaaacacatgaaa

SEQ ID NO: 90639 - DNA, 22 bp, Artificial Sequence
  Synthetic oligonucleotide; CTC chr11 5262629 5262650 5262646 5262651 +
atcatcactggtcattagagaa

SEQ ID NO: 90640 - DNA, 22 bp, Artificial Sequence
  Synthetic oligonucleotide; CTG chr11 5262639 5262660 5262656 5262661 +
gtcattagagaaatgcaaatca

SEQ ID NO: 90641 - DNA, 22 bp, Artificial Sequence
  Synthetic oligonucleotide; TTA chr11 5262646 5262667 5262663 5262668 +
gagaaatgcaaatcaaaaccac

SEQ ID NO: 90642 - DNA, 22 bp, Artificial Sequence
  Synthetic oligonucleotide; CTC chr11 5262684 5262705 5262701 5262706 +
atgccagttagaatggcaatta

SEQ ID NO: 90643 - DNA, 22 bp, Artificial Sequence
  Synthetic oligonucleotide; TTA chr11 5262694 5262715 5262711 5262716 +
gaatggcaattattaaaaagtc

SEQ ID NO: 90644 - DNA, 22 bp, Artificial Sequence
  Synthetic oligonucleotide; TTA chr11 5262706 5262727 5262723 5262728 +
ttaaaaagtcaggaaacaaaag

SEQ ID NO: 90645 - DNA, 22 bp, Artificial Sequence
  Synthetic oligonucleotide; TTA chr11 5262709 5262730 5262726 5262731 +
aaaagtcaggaaacaaaaggtg

SEQ ID NO: 90646 - DNA, 22 bp, Artificial Sequence
  Synthetic oligonucleotide; CTG chr11 5262734 5262755 5262751 5262756 +
gagaggatgtggaagaatagga

SEQ ID NO: 90647 - DNA, 22 bp, Artificial Sequence
  Synthetic oligonucleotide; TTT chr11 5262763 5262784 5262780 5262785 +
tacactgttgatgggtgtgtaa

SEQ ID NO: 90648 - DNA, 22 bp, Artificial Sequence
  Synthetic oligonucleotide; TTT chr11 5262764 5262785 5262781 5262786 +
acactgttgatgggtgtgtaaa

SEQ ID NO: 90649 - DNA, 22 bp, Artificial Sequence
  Synthetic oligonucleotide; TTA chr11 5262765 5262786 5262782 5262787 +
cactgttgatgggtgtgtaaat

SEQ ID NO: 90650 - DNA, 22 bp, Artificial Sequence
  Synthetic oligonucleotide; CTG chr11 5262770 5262791 5262787 5262792 +
ttgatgggtgtgtaaattagtt

SEQ ID NO: 90651 - DNA, 22 bp, Artificial Sequence
  Synthetic oligonucleotide; TTG chr11 5262773 5262794 5262790 5262795 +
atgggtgtgtaaattagttcaa

SEQ ID NO: 90652 - DNA, 22 bp, Artificial Sequence
  Synthetic oligonucleotide; TTA chr11 5262789 5262810 5262806 5262811 +
gttcaaccattgtggaagacag

SEQ ID NO: 90653 - DNA, 22 bp, Artificial Sequence
  Synthetic oligonucleotide; TTC chr11 5262793 5262814 5262810 5262815 +
aaccattgtggaagacagtgtg

SEQ ID NO: 90654 - DNA, 22 bp, Artificial Sequence
  Synthetic oligonucleotide; TTG chr11 5262801 5262822 5262818 5262823 +
tggaagacagtgtggcgattcc

SEQ ID NO: 90655 - DNA, 22 bp, Artificial Sequence
  Synthetic oligonucleotide; TTC chr11 5262822 5262843 5262839 5262844 +
ctcaaggatctagaaccagaaa

SEQ ID NO: 90656 - DNA, 22 bp, Artificial Sequence
  Synthetic oligonucleotide; CTC chr11 5262825 5262846 5262842 5262847 +
aaggatctagaaccagaaatac

SEQ ID NO: 90657 - DNA, 22 bp, Artificial Sequence
  Synthetic oligonucleotide; CTA chr11 5262834 5262855 5262851 5262856 +
gaaccagaaatactgtttgacc

SEQ ID NO: 90658 - DNA, 22 bp, Artificial Sequence
  Synthetic oligonucleotide; CTG chr11 5262849 5262870 5262866 5262871 +
tttgacccagcaatcccattac

SEQ ID NO: 90659 - DNA, 22 bp, Artificial Sequence
  Synthetic oligonucleotide; TTT chr11 5262852 5262873 5262869 5262874 +
gacccagcaatcccattactgg

SEQ ID NO: 90660 - DNA, 22 bp, Artificial Sequence
  Synthetic oligonucleotide; TTG chr11 5262853 5262874 5262870 5262875 +
acccagcaatcccattactggg

SEQ ID NO: 90661 - DNA, 22 bp, Artificial Sequence
  Synthetic oligonucleotide; TTA chr11 5262870 5262891 5262887 5262892 +
ctgggtatatacccaaagaatt

SEQ ID NO: 90662 - DNA, 22 bp, Artificial Sequence
  Synthetic oligonucleotide; CTG chr11 5262873 5262894 5262890 5262895 +
ggtatatacccaaagaattaga

SEQ ID NO: 90663 - DNA, 22 bp, Artificial Sequence
  Synthetic oligonucleotide; TTA chr11 5262893 5262914 5262910 5262915 +
gaaatcattctactataaagac

SEQ ID NO: 90664 - DNA, 22 bp, Artificial Sequence
  Synthetic oligonucleotide; TTC chr11 5262903 5262924 5262920 5262925 +
tactataaagacacgtgcacac

SEQ ID NO: 90665 - DNA, 22 bp, Artificial Sequence
  Synthetic oligonucleotide; CTA chr11 5262905 5262926 5262922 5262927 +
ctataaagacacgtgcacacgt

SEQ ID NO: 90666 - DNA, 22 bp, Artificial Sequence
  Synthetic oligonucleotide; CTA chr11 5262908 5262929 5262925 5262930 +
taaagacacgtgcacacgtatg

SEQ ID NO: 90667 - DNA, 22 bp, Artificial Sequence
  Synthetic oligonucleotide; TTT chr11 5262933 5262954 5262950 5262955 +
attgtggcactattcacaatag

SEQ ID NO: 90668 - DNA, 22 bp, Artificial Sequence
  Synthetic oligonucleotide; TTA chr11 5262934 5262955 5262951 5262956 +
ttgtggcactattcacaatagc

SEQ ID NO: 90669 - DNA, 22 bp, Artificial Sequence
  Synthetic oligonucleotide; TTG chr11 5262937 5262958 5262954 5262959 +
tggcactattcacaatagcaaa

SEQ ID NO: 90670 - DNA, 22 bp, Artificial Sequence
  Synthetic oligonucleotide; CTA chr11 5262945 5262966 5262962 5262967 +
ttcacaatagcaaagacttgga

SEQ ID NO: 90671 - DNA, 22 bp, Artificial Sequence
  Synthetic oligonucleotide; TTC chr11 5262948 5262969 5262965 5262970 +
acaatagcaaagacttggaacc

SEQ ID NO: 90672 - DNA, 22 bp, Artificial Sequence
  Synthetic oligonucleotide; CTT chr11 5262964 5262985 5262981 5262986 +
ggaaccaacccaaatggccatc

SEQ ID NO: 90673 - DNA, 22 bp, Artificial Sequence
  Synthetic oligonucleotide; TTG chr11 5262965 5262986 5262982 5262987 +
gaaccaacccaaatggccatca

SEQ ID NO: 90674 - DNA, 22 bp, Artificial Sequence
  Synthetic oligonucleotide; CTA chr11 5263037 5263058 5263054 5263059 +
tgcagccataaaaatgatgagt

SEQ ID NO: 90675 - DNA, 22 bp, Artificial Sequence
  Synthetic oligonucleotide; TTC chr11 5263061 5263082 5263078 5263083 +
atgtctttgcagggacatggat

SEQ ID NO: 90676 - DNA, 22 bp, Artificial Sequence
  Synthetic oligonucleotide; CTT chr11 5263068 5263089 5263085 5263090 +
tgcagggacatggatgaaggtg

SEQ ID NO: 90677 - DNA, 22 bp, Artificial Sequence
  Synthetic oligonucleotide; TTT chr11 5263069 5263090 5263086 5263091 +
gcagggacatggatgaaggtgg

SEQ ID NO: 90678 - DNA, 22 bp, Artificial Sequence
  Synthetic oligonucleotide; TTG chr11 5263070 5263091 5263087 5263092 +
cagggacatggatgaaggtgga

SEQ ID NO: 90679 - DNA, 22 bp, Artificial Sequence
  Synthetic oligonucleotide; TTC chr11 5263103 5263124 5263120 5263125 +
tgagcaaactaacacaggaaca

SEQ ID NO: 90680 - DNA, 22 bp, Artificial Sequence
  Synthetic oligonucleotide; CTG chr11 5263105 5263126 5263122 5263127 +
agcaaactaacacaggaacaga

SEQ ID NO: 90681 - DNA, 22 bp, Artificial Sequence
  Synthetic oligonucleotide; CTA chr11 5263114 5263135 5263131 5263136 +
acacaggaacagagaaaccaaa

SEQ ID NO: 90682 - DNA, 22 bp, Artificial Sequence
  Synthetic oligonucleotide; TTC chr11 5263148 5263169 5263165 5263170 +
tcactcataagtgggagttgaa

SEQ ID NO: 90683 - DNA, 22 bp, Artificial Sequence
  Synthetic oligonucleotide; CTC chr11 5263150 5263171 5263167 5263172 +
actcataagtgggagttgaaca

SEQ ID NO: 90684 - DNA, 22 bp, Artificial Sequence
  Synthetic oligonucleotide; CTC chr11 5263154 5263175 5263171 5263176 +
ataagtgggagttgaacaatga

SEQ ID NO: 90685 - DNA, 22 bp, Artificial Sequence
  Synthetic oligonucleotide; TTG chr11 5263168 5263189 5263185 5263190 +
aacaatgagaacacatggacac

SEQ ID NO: 90686 - DNA, 22 bp, Artificial Sequence
  Synthetic oligonucleotide; CTG chr11 5263220 5263241 5263237 5263242 +
tcggggggtgagggggttagga

SEQ ID NO: 90687 - DNA, 22 bp, Artificial Sequence
  Synthetic oligonucleotide; TTA chr11 5263239 5263260 5263256 5263261 +
ggagagggataacattaaaaga

SEQ ID NO: 90688 - DNA, 22 bp, Artificial Sequence
  Synthetic oligonucleotide; TTA chr11 5263256 5263277 5263273 5263278 +
aaagaaatacctaatgtagatg

SEQ ID NO: 90689 - DNA, 22 bp, Artificial Sequence
  Synthetic oligonucleotide; CTA chr11 5263269 5263290 5263286 5263291 +
atgtagatgacaggttgatggg

SEQ ID NO: 90690 - DNA, 22 bp, Artificial Sequence
  Synthetic oligonucleotide; TTG chr11 5263286 5263307 5263303 5263308 +
atgggtgcagcaaaccaccatg

SEQ ID NO: 90691 - DNA, 22 bp, Artificial Sequence
  Synthetic oligonucleotide; CTA chr11 5263317 5263338 5263334 5263339 +
tacctatgtaacaaacctgcac

SEQ ID NO: 90692 - DNA, 22 bp, Artificial Sequence
  Synthetic oligonucleotide; CTA chr11 5263323 5263344 5263340 5263345 +
tgtaacaaacctgcacattctg

SEQ ID NO: 90693 - DNA, 22 bp, Artificial Sequence
  Synthetic oligonucleotide; CTG chr11 5263336 5263357 5263353 5263358 +
cacattctgcacatgtatccca

SEQ ID NO: 90694 - DNA, 22 bp, Artificial Sequence
  Synthetic oligonucleotide; TTC chr11 5263343 5263364 5263360 5263365 +
tgcacatgtatcccagaactta

SEQ ID NO: 90695 - DNA, 22 bp, Artificial Sequence
  Synthetic oligonucleotide; CTG chr11 5263345 5263366 5263362 5263367 +
cacatgtatcccagaacttaaa

SEQ ID NO: 90696 - DNA, 22 bp, Artificial Sequence
  Synthetic oligonucleotide; CTT chr11 5263364 5263385 5263381 5263386 +
aaagtataataagaacaacaaa

SEQ ID NO: 90697 - DNA, 22 bp, Artificial Sequence
  Synthetic oligonucleotide; TTA chr11 5263365 5263386 5263382 5263387 +
aagtataataagaacaacaaaa

SEQ ID NO: 90698 - DNA, 22 bp, Artificial Sequence
  Synthetic oligonucleotide; TTA chr11 5263390 5263411 5263407 5263412 +
cttgaactgaccgacaatagtg

SEQ ID NO: 90699 - DNA, 22 bp, Artificial Sequence
  Synthetic oligonucleotide; CTT chr11 5263393 5263414 5263410 5263415 +
gaactgaccgacaatagtgaca

SEQ ID NO: 90700 - DNA, 22 bp, Artificial Sequence
  Synthetic oligonucleotide; TTG chr11 5263394 5263415 5263411 5263416 +
aactgaccgacaatagtgacac

SEQ ID NO: 90701 - DNA, 22 bp, Artificial Sequence
  Synthetic oligonucleotide; CTG chr11 5263399 5263420 5263416 5263421 +
accgacaatagtgacacaacct

SEQ ID NO: 90702 - DNA, 22 bp, Artificial Sequence
  Synthetic oligonucleotide; CTA chr11 5263422 5263443 5263439 5263444 +
tcaaaacctctaggatacagca

SEQ ID NO: 90703 - DNA, 22 bp, Artificial Sequence
  Synthetic oligonucleotide; CTC chr11 5263432 5263453 5263449 5263454 +
taggatacagcaaagatggtgc

SEQ ID NO: 90704 - DNA, 22 bp, Artificial Sequence
  Synthetic oligonucleotide; CTA chr11 5263434 5263455 5263451 5263456 +
ggatacagcaaagatggtgcta

SEQ ID NO: 90705 - DNA, 22 bp, Artificial Sequence
  Synthetic oligonucleotide; CTA chr11 5263456 5263477 5263473 5263478 +
aaaggaaagttcacagccctaa

SEQ ID NO: 90706 - DNA, 22 bp, Artificial Sequence
  Synthetic oligonucleotide; TTC chr11 5263468 5263489 5263485 5263490 +
acagccctaaatgtcgatgtca

SEQ ID NO: 90707 - DNA, 22 bp, Artificial Sequence
  Synthetic oligonucleotide; CTA chr11 5263477 5263498 5263494 5263499 +
aatgtcgatgtcaaagagtctg

SEQ ID NO: 90708 - DNA, 22 bp, Artificial Sequence
  Synthetic oligonucleotide; CTG chr11 5263499 5263520 5263516 5263521 +
aaagaggacagacagacaatat

SEQ ID NO: 90709 - DNA, 22 bp, Artificial Sequence
  Synthetic oligonucleotide; CTA chr11 5263543 5263564 5263560 5263565 +
gagaaacaaaaacaaacagaac

SEQ ID NO: 90710 - DNA, 22 bp, Artificial Sequence
  Synthetic oligonucleotide; CTA chr11 5263595 5263616 5263612 5263617 +
agataagaggagaactaaatga

SEQ ID NO: 90711 - DNA, 22 bp, Artificial Sequence
  Synthetic oligonucleotide; CTA chr11 5263612 5263633 5263629 5263634 +
aatgaaattaaaacaactgcaa

SEQ ID NO: 90712 - DNA, 22 bp, Artificial Sequence
  Synthetic oligonucleotide; TTA chr11 5263622 5263643 5263639 5263644 +
aaacaactgcaaaaaaatacaa

SEQ ID NO: 90713 - DNA, 22 bp, Artificial Sequence
  Synthetic oligonucleotide; CTG chr11 5263631 5263652 5263648 5263653 +
caaaaaaatacaaaagctaaat

SEQ ID NO: 90714 - DNA, 22 bp, Artificial Sequence
  Synthetic oligonucleotide; CTA chr11 5263650 5263671 5263667 5263672 +
aatgaaataaaaagctggttct

SEQ ID NO: 90715 - DNA, 22 bp, Artificial Sequence
  Synthetic oligonucleotide; CTG chr11 5263667 5263688 5263684 5263689 +
gttctttgaaaagataaataaa

SEQ ID NO: 90716 - DNA, 22 bp, Artificial Sequence
  Synthetic oligonucleotide; TTC chr11 5263671 5263692 5263688 5263693 +
tttgaaaagataaataaaactg

SEQ ID NO: 90717 - DNA, 22 bp, Artificial Sequence
  Synthetic oligonucleotide; CTT chr11 5263673 5263694 5263690 5263695 +
tgaaaagataaataaaactgat

SEQ ID NO: 90718 - DNA, 22 bp, Artificial Sequence
  Synthetic oligonucleotide; TTT chr11 5263674 5263695 5263691 5263696 +
gaaaagataaataaaactgata

SEQ ID NO: 90719 - DNA, 22 bp, Artificial Sequence
  Synthetic oligonucleotide; TTG chr11 5263675 5263696 5263692 5263697 +
aaaagataaataaaactgatag

SEQ ID NO: 90720 - DNA, 22 bp, Artificial Sequence
  Synthetic oligonucleotide; CTG chr11 5263693 5263714 5263710 5263715 +
atagaccattagcaagattaac

SEQ ID NO: 90721 - DNA, 22 bp, Artificial Sequence
  Synthetic oligonucleotide; TTA chr11 5263704 5263725 5263721 5263726 +
gcaagattaaccaagaaaagag

SEQ ID NO: 90722 - DNA, 22 bp, Artificial Sequence
  Synthetic oligonucleotide; TTA chr11 5263713 5263734 5263730 5263735 +
accaagaaaagaggagagaagt

SEQ ID NO: 90723 - DNA, 22 bp, Artificial Sequence
  Synthetic oligonucleotide; CTC chr11 5263747 5263768 5263764 5263769 +
aattagaaacaaaacaggagat

SEQ ID NO: 90724 - DNA, 22 bp, Artificial Sequence
  Synthetic oligonucleotide; TTA chr11 5263752 5263773 5263769 5263774 +
gaaacaaaacaggagatactat

SEQ ID NO: 90725 - DNA, 22 bp, Artificial Sequence
  Synthetic oligonucleotide; CTA chr11 5263773 5263794 5263790 5263795 +
ttactgataccacagaaataca

SEQ ID NO: 90726 - DNA, 22 bp, Artificial Sequence
  Synthetic oligonucleotide; TTA chr11 5263776 5263797 5263793 5263798 +
ctgataccacagaaatacaaaa

SEQ ID NO: 90727 - DNA, 22 bp, Artificial Sequence
  Synthetic oligonucleotide; CTG chr11 5263779 5263800 5263796 5263801 +
ataccacagaaatacaaaagat

SEQ ID NO: 90728 - DNA, 22 bp, Artificial Sequence
  Synthetic oligonucleotide; TTA chr11 5263803 5263824 5263820 5263825 +
ttcaaggctactatgaacacct

SEQ ID NO: 90729 - DNA, 22 bp, Artificial Sequence
  Synthetic oligonucleotide; TTC chr11 5263806 5263827 5263823 5263828 +
aaggctactatgaacaccttta

SEQ ID NO: 90730 - DNA, 22 bp, Artificial Sequence
  Synthetic oligonucleotide; CTA chr11 5263813 5263834 5263830 5263835 +
ctatgaacacctttacatgcat

SEQ ID NO: 90731 - DNA, 22 bp, Artificial Sequence
  Synthetic oligonucleotide; CTA chr11 5263816 5263837 5263833 5263838 +
tgaacacctttacatgcataaa

SEQ ID NO: 90732 - DNA, 22 bp, Artificial Sequence
  Synthetic oligonucleotide; CTT chr11 5263826 5263847 5263843 5263848 +
tacatgcataaactagaaaacc

SEQ ID NO: 90733 - DNA, 22 bp, Artificial Sequence
  Synthetic oligonucleotide; TTT chr11 5263827 5263848 5263844 5263849 +
acatgcataaactagaaaacct

SEQ ID NO: 90734 - DNA, 22 bp, Artificial Sequence
  Synthetic oligonucleotide; TTA chr11 5263828 5263849 5263845 5263850 +
catgcataaactagaaaaccta

SEQ ID NO: 90735 - DNA, 22 bp, Artificial Sequence
  Synthetic oligonucleotide; CTA chr11 5263841 5263862 5263858 5263863 +
gaaaacctaaaggagacgttcg

SEQ ID NO: 90736 - DNA, 22 bp, Artificial Sequence
  Synthetic oligonucleotide; CTA chr11 5263850 5263871 5263867 5263872 +
aaggagacgttcgaattcctgg

SEQ ID NO: 90737 - DNA, 22 bp, Artificial Sequence
  Synthetic oligonucleotide; TTC chr11 5263862 5263883 5263879 5263884 +
gaattcctggaaagatacaggg

SEQ ID NO: 90738 - DNA, 22 bp, Artificial Sequence
  Synthetic oligonucleotide; TTC chr11 5263868 5263889 5263885 5263890 +
ctggaaagatacagggctctag

SEQ ID NO: 90739 - DNA, 22 bp, Artificial Sequence
  Synthetic oligonucleotide; CTG chr11 5263871 5263892 5263888 5263893 +
gaaagatacagggctctagctt

SEQ ID NO: 90740 - DNA, 22 bp, Artificial Sequence
  Synthetic oligonucleotide; CTC chr11 5263887 5263908 5263904 5263909 +
tagcttaagtcaggaagaatta

SEQ ID NO: 90741 - DNA, 22 bp, Artificial Sequence
  Synthetic oligonucleotide; CTA chr11 5263889 5263910 5263906 5263911 +
gcttaagtcaggaagaattaga

SEQ ID NO: 90742 - DNA, 22 bp, Artificial Sequence
  Synthetic oligonucleotide; CTT chr11 5263893 5263914 5263910 5263915 +
aagtcaggaagaattagatacc

SEQ ID NO: 90743 - DNA, 22 bp, Artificial Sequence
  Synthetic oligonucleotide; TTA chr11 5263894 5263915 5263911 5263916 +
agtcaggaagaattagataccc

SEQ ID NO: 90744 - DNA, 22 bp, Artificial Sequence
  Synthetic oligonucleotide; TTA chr11 5263909 5263930 5263926 5263931 +
gataccctgaacagaccagtaa

SEQ ID NO: 90745 - DNA, 22 bp, Artificial Sequence
  Synthetic oligonucleotide; CTG chr11 5263918 5263939 5263935 5263940 +
aacagaccagtaataagcagca

SEQ ID NO: 90746 - DNA, 22 bp, Artificial Sequence
  Synthetic oligonucleotide; CTG chr11 5263946 5263967 5263963 5263968 +
aaatgataataaaaatttacca

SEQ ID NO: 90747 - DNA, 22 bp, Artificial Sequence
  Synthetic oligonucleotide; TTT chr11 5263964 5263985 5263981 5263986 +
accaacaacaaaaaagtccagg

SEQ ID NO: 90748 - DNA, 22 bp, Artificial Sequence
  Synthetic oligonucleotide; TTA chr11 5263965 5263986 5263982 5263987 +
ccaacaacaaaaaagtccagga

SEQ ID NO: 90749 - DNA, 22 bp, Artificial Sequence
  Synthetic oligonucleotide; TTC chr11 5263999 5264020 5264016 5264021 +
acagctgaattctaccagacat

SEQ ID NO: 90750 - DNA, 22 bp, Artificial Sequence
  Synthetic oligonucleotide; CTG chr11 5264006 5264027 5264023 5264028 +
aattctaccagacattcaaaga

SEQ ID NO: 90751 - DNA, 22 bp, Artificial Sequence
  Synthetic oligonucleotide; TTC chr11 5264011 5264032 5264028 5264033 +
taccagacattcaaagaagaat

SEQ ID NO: 90752 - DNA, 22 bp, Artificial Sequence
  Synthetic oligonucleotide; CTA chr11 5264013 5264034 5264030 5264035 +
ccagacattcaaagaagaattg

SEQ ID NO: 90753 - DNA, 22 bp, Artificial Sequence
  Synthetic oligonucleotide; TTC chr11 5264023 5264044 5264040 5264045 +
aaagaagaattgataccaatcc

SEQ ID NO: 90754 - DNA, 22 bp, Artificial Sequence
  Synthetic oligonucleotide; TTG chr11 5264035 5264056 5264052 5264057 +
ataccaatcctattgacagtat

SEQ ID NO: 90755 - DNA, 22 bp, Artificial Sequence
  Synthetic oligonucleotide; CTA chr11 5264047 5264068 5264064 5264069 +
ttgacagtattctacaagatag

SEQ ID NO: 90756 - DNA, 22 bp, Artificial Sequence
  Synthetic oligonucleotide; TTG chr11 5264050 5264071 5264067 5264072 +
acagtattctacaagatagaga

SEQ ID NO: 90757 - DNA, 22 bp, Artificial Sequence
  Synthetic oligonucleotide; TTC chr11 5264059 5264080 5264076 5264081 +
tacaagatagagaaagagagaa

SEQ ID NO: 90758 - DNA, 22 bp, Artificial Sequence
  Synthetic oligonucleotide; CTA chr11 5264061 5264082 5264078 5264083 +
caagatagagaaagagagaatc

SEQ ID NO: 90759 - DNA, 22 bp, Artificial Sequence
  Synthetic oligonucleotide; CTC chr11 5264086 5264107 5264103 5264108 +
cctaaatcattctatgaagcca

SEQ ID NO: 90760 - DNA, 22 bp, Artificial Sequence
  Synthetic oligonucleotide; CTA chr11 5264090 5264111 5264107 5264112 +
aatcattctatgaagccagtat

SEQ ID NO: 90761 - DNA, 22 bp, Artificial Sequence
  Synthetic oligonucleotide; TTC chr11 5264098 5264119 5264115 5264120 +
tatgaagccagtatcaccttaa

SEQ ID NO: 90762 - DNA, 22 bp, Artificial Sequence
  Synthetic oligonucleotide; CTA chr11 5264100 5264121 5264117 5264122 +
tgaagccagtatcaccttaata

SEQ ID NO: 90763 - DNA, 22 bp, Artificial Sequence
  Synthetic oligonucleotide; CTT chr11 5264118 5264139 5264135 5264140 +
aataccaaaactgggaaagaac

SEQ ID NO: 90764 - DNA, 22 bp, Artificial Sequence
  Synthetic oligonucleotide; TTA chr11 5264119 5264140 5264136 5264141 +
ataccaaaactgggaaagaaca

SEQ ID NO: 90765 - DNA, 22 bp, Artificial Sequence
  Synthetic oligonucleotide; CTG chr11 5264131 5264152 5264148 5264153 +
ggaaagaacataaccaaaaaaa

SEQ ID NO: 90766 - DNA, 22 bp, Artificial Sequence
  Synthetic oligonucleotide; CTA chr11 5264163 5264184 5264180 5264185 +
cagatcaatatccctgatgaac

SEQ ID NO: 90767 - DNA, 22 bp, Artificial Sequence
  Synthetic oligonucleotide; CTG chr11 5264179 5264200 5264196 5264201 +
atgaacatagatgccaacatcc

SEQ ID NO: 90768 - DNA, 22 bp, Artificial Sequence
  Synthetic oligonucleotide; CTT chr11 5264203 5264224 5264220 5264225 +
gacaaaatactagctaatagca

SEQ ID NO: 90769 - DNA, 22 bp, Artificial Sequence
  Synthetic oligonucleotide; TTG chr11 5264204 5264225 5264221 5264226 +
acaaaatactagctaatagcat

SEQ ID NO: 90770 - DNA, 22 bp, Artificial Sequence
  Synthetic oligonucleotide; CTA chr11 5264215 5264236 5264232 5264237 +
gctaatagcatccgacagcata

SEQ ID NO: 90771 - DNA, 22 bp, Artificial Sequence
  Synthetic oligonucleotide; CTA chr11 5264219 5264240 5264236 5264241 +
atagcatccgacagcatatcaa

SEQ ID NO: 90772 - DNA, 22 bp, Artificial Sequence
  Synthetic oligonucleotide; TTT chr11 5264262 5264283 5264279 5264284 +
catgcgagggatgcacggatgg

SEQ ID NO: 90773 - DNA, 22 bp, Artificial Sequence
  Synthetic oligonucleotide; TTC chr11 5264263 5264284 5264280 5264285 +
atgcgagggatgcacggatggt

SEQ ID NO: 90774 - DNA, 22 bp, Artificial Sequence
  Synthetic oligonucleotide; TTT chr11 5264287 5264308 5264304 5264309 +
aacatacgcaagtcaataagtg

SEQ ID NO: 90775 - DNA, 22 bp, Artificial Sequence
  Synthetic oligonucleotide; TTA chr11 5264288 5264309 5264305 5264310 +
acatacgcaagtcaataagtgt

SEQ ID NO: 90776 - DNA, 22 bp, Artificial Sequence
  Synthetic oligonucleotide; TTG chr11 5264333 5264354 5264350 5264355 +
gaaacaaaaatcatgtgattat

SEQ ID NO: 90777 - DNA, 22 bp, Artificial Sequence
  Synthetic oligonucleotide; TTA chr11 5264354 5264375 5264371 5264376 +
tctcaatagccacagaaactgc

SEQ ID NO: 90778 - DNA, 22 bp, Artificial Sequence
  Synthetic oligonucleotide; CTC chr11 5264358 5264379 5264375 5264380 +
aatagccacagaaactgcattc

SEQ ID NO: 90779 - DNA, 22 bp, Artificial Sequence
  Synthetic oligonucleotide; CTG chr11 5264375 5264396 5264392 5264397 +
cattcaacaaaattcaacatca

SEQ ID NO: 90780 - DNA, 22 bp, Artificial Sequence
  Synthetic oligonucleotide; TTC chr11 5264380 5264401 5264397 5264402 +
aacaaaattcaacatcacttta

SEQ ID NO: 90781 - DNA, 22 bp, Artificial Sequence
  Synthetic oligonucleotide; TTC chr11 5264390 5264411 5264407 5264412 +
aacatcactttatgactaaaac

SEQ ID NO: 90782 - DNA, 22 bp, Artificial Sequence
  Synthetic oligonucleotide; CTT chr11 5264400 5264421 5264417 5264422 +
tatgactaaaactcagcaaaat

SEQ ID NO: 90783 - DNA, 22 bp, Artificial Sequence
  Synthetic oligonucleotide; TTT chr11 5264401 5264422 5264418 5264423 +
atgactaaaactcagcaaaatc

SEQ ID NO: 90784 - DNA, 22 bp, Artificial Sequence
  Synthetic oligonucleotide; TTA chr11 5264402 5264423 5264419 5264424 +
tgactaaaactcagcaaaatcg

SEQ ID NO: 90785 - DNA, 22 bp, Artificial Sequence
  Synthetic oligonucleotide; CTA chr11 5264408 5264429 5264425 5264430 +
aaactcagcaaaatcggtttac

SEQ ID NO: 90786 - DNA, 22 bp, Artificial Sequence
  Synthetic oligonucleotide; CTC chr11 5264414 5264435 5264431 5264436 +
agcaaaatcggtttacaaagga

SEQ ID NO: 90787 - DNA, 22 bp, Artificial Sequence
  Synthetic oligonucleotide; TTT chr11 5264428 5264449 5264445 5264450 +
acaaaggacatacctcaatgta

SEQ ID NO: 90788 - DNA, 22 bp, Artificial Sequence
  Synthetic oligonucleotide; TTA chr11 5264429 5264450 5264446 5264451 +
caaaggacatacctcaatgtaa

SEQ ID NO: 90789 - DNA, 22 bp, Artificial Sequence
  Synthetic oligonucleotide; CTC chr11 5264444 5264465 5264461 5264466 +
aatgtaataaaagccagctatg

SEQ ID NO: 90790 - DNA, 22 bp, Artificial Sequence
  Synthetic oligonucleotide; CTA chr11 5264464 5264485 5264481 5264486 +
tggtaaacacacagccaacatt

SEQ ID NO: 90791 - DNA, 22 bp, Artificial Sequence
  Synthetic oligonucleotide; TTA chr11 5264487 5264508 5264504 5264509 +
tattgaatgggaaaaagttaaa

SEQ ID NO: 90792 - DNA, 22 bp, Artificial Sequence
  Synthetic oligonucleotide; TTG chr11 5264492 5264513 5264509 5264514 +
aatgggaaaaagttaaaagcat

SEQ ID NO: 90793 - DNA, 22 bp, Artificial Sequence
  Synthetic oligonucleotide; TTA chr11 5264507 5264528 5264524 5264529 +
aaagcattctgtctgaaaactg

SEQ ID NO: 90794 - DNA, 22 bp, Artificial Sequence
  Synthetic oligonucleotide; TTC chr11 5264516 5264537 5264533 5264538 +
tgtctgaaaactggaatgagac

SEQ ID NO: 90795 - DNA, 22 bp, Artificial Sequence
  Synthetic oligonucleotide; CTG chr11 5264518 5264539 5264535 5264540 +
tctgaaaactggaatgagacaa

SEQ ID NO: 90796 - DNA, 22 bp, Artificial Sequence
  Synthetic oligonucleotide; CTG chr11 5264522 5264543 5264539 5264544 +
aaaactggaatgagacaaggat

SEQ ID NO: 90797 - DNA, 22 bp, Artificial Sequence
  Synthetic oligonucleotide; CTG chr11 5264529 5264550 5264546 5264551 +
gaatgagacaaggatacccact

SEQ ID NO: 90798 - DNA, 22 bp, Artificial Sequence
  Synthetic oligonucleotide; CTC chr11 5264552 5264573 5264569 5264574 +
tcaccacttctctttaacatat

SEQ ID NO: 90799 - DNA, 22 bp, Artificial Sequence
  Synthetic oligonucleotide; CTC chr11 5264554 5264575 5264571 5264576 +
accacttctctttaacatatta

SEQ ID NO: 90800 - DNA, 22 bp, Artificial Sequence
  Synthetic oligonucleotide; CTT chr11 5264561 5264582 5264578 5264583 +
ctctttaacatattactggaag

SEQ ID NO: 90801 - DNA, 22 bp, Artificial Sequence
  Synthetic oligonucleotide; TTC chr11 5264562 5264583 5264579 5264584 +
tctttaacatattactggaagt

SEQ ID NO: 90802 - DNA, 22 bp, Artificial Sequence
  Synthetic oligonucleotide; CTC chr11 5264564 5264585 5264581 5264586 +
tttaacatattactggaagtcc

SEQ ID NO: 90803 - DNA, 22 bp, Artificial Sequence
  Synthetic oligonucleotide; CTT chr11 5264566 5264587 5264583 5264588 +
taacatattactggaagtccta

SEQ ID NO: 90804 - DNA, 22 bp, Artificial Sequence
  Synthetic oligonucleotide; TTT chr11 5264567 5264588 5264584 5264589 +
aacatattactggaagtcctag

SEQ ID NO: 90805 - DNA, 22 bp, Artificial Sequence
  Synthetic oligonucleotide; TTA chr11 5264568 5264589 5264585 5264590 +
acatattactggaagtcctagc

SEQ ID NO: 90806 - DNA, 22 bp, Artificial Sequence
  Synthetic oligonucleotide; TTA chr11 5264576 5264597 5264593 5264598 +
ctggaagtcctagcaagagcaa

SEQ ID NO: 90807 - DNA, 22 bp, Artificial Sequence
  Synthetic oligonucleotide; CTG chr11 5264579 5264600 5264596 5264601 +
gaagtcctagcaagagcaatca

SEQ ID NO: 90808 - DNA, 22 bp, Artificial Sequence
  Synthetic oligonucleotide; CTA chr11 5264588 5264609 5264605 5264610 +
gcaagagcaatcagacaagaga

SEQ ID NO: 90809 - DNA, 22 bp, Artificial Sequence
  Synthetic oligonucleotide; TTG chr11 5264634 5264655 5264651 5264656 +
ttaaagagaaagtcaaactgtc

SEQ ID NO: 90810 - DNA, 22 bp, Artificial Sequence
  Synthetic oligonucleotide; TTA chr11 5264637 5264658 5264654 5264659 +
aagagaaagtcaaactgtcact

SEQ ID NO: 90811 - DNA, 22 bp, Artificial Sequence
  Synthetic oligonucleotide; CTG chr11 5264654 5264675 5264671 5264676 +
tcactgtttgctgatgatatga

SEQ ID NO: 90812 - DNA, 22 bp, Artificial Sequence
  Synthetic oligonucleotide; CTG chr11 5264660 5264681 5264677 5264682 +
tttgctgatgatatgattgtgt

SEQ ID NO: 90813 - DNA, 22 bp, Artificial Sequence
  Synthetic oligonucleotide; TTT chr11 5264663 5264684 5264680 5264685 +
gctgatgatatgattgtgtatg

SEQ ID NO: 90814 - DNA, 22 bp, Artificial Sequence
  Synthetic oligonucleotide; TTG chr11 5264664 5264685 5264681 5264686 +
ctgatgatatgattgtgtatgt

SEQ ID NO: 90815 - DNA, 22 bp, Artificial Sequence
  Synthetic oligonucleotide; CTG chr11 5264667 5264688 5264684 5264689 +
atgatatgattgtgtatgtaga

SEQ ID NO: 90816 - DNA, 22 bp, Artificial Sequence
  Synthetic oligonucleotide; TTG chr11 5264679 5264700 5264696 5264701 +
tgtatgtagaaaactctaaaga

SEQ ID NO: 90817 - DNA, 22 bp, Artificial Sequence
  Synthetic oligonucleotide; CTC chr11 5264695 5264716 5264712 5264717 +
taaagactcctccaaaaccccc

SEQ ID NO: 90818 - DNA, 22 bp, Artificial Sequence
  Synthetic oligonucleotide; CTA chr11 5264697 5264718 5264714 5264719 +
aagactcctccaaaacccccta

SEQ ID NO: 90819 - DNA, 22 bp, Artificial Sequence
  Synthetic oligonucleotide; CTC chr11 5264704 5264725 5264721 5264726 +
ctccaaaaccccctagaactga

SEQ ID NO: 90820 - DNA, 22 bp, Artificial Sequence
  Synthetic oligonucleotide; CTC chr11 5264707 5264728 5264724 5264729 +
caaaaccccctagaactgataa

SEQ ID NO: 90821 - DNA, 22 bp, Artificial Sequence
  Synthetic oligonucleotide; CTA chr11 5264719 5264740 5264736 5264741 +
gaactgataaaataattcagca

SEQ ID NO: 90822 - DNA, 22 bp, Artificial Sequence
  Synthetic oligonucleotide; CTG chr11 5264725 5264746 5264742 5264747 +
ataaaataattcagcaaagttt

SEQ ID NO: 90823 - DNA, 22 bp, Artificial Sequence
  Synthetic oligonucleotide; TTC chr11 5264737 5264758 5264754 5264759 +
agcaaagtttctggatacaaaa

SEQ ID NO: 90824 - DNA, 22 bp, Artificial Sequence
  Synthetic oligonucleotide; TTT chr11 5264747 5264768 5264764 5264769 +
ctggatacaaaattaacgtaca

SEQ ID NO: 90825 - DNA, 22 bp, Artificial Sequence
  Synthetic oligonucleotide; TTC chr11 5264748 5264769 5264765 5264770 +
tggatacaaaattaacgtacac

SEQ ID NO: 90826 - DNA, 22 bp, Artificial Sequence
  Synthetic oligonucleotide; CTG chr11 5264750 5264771 5264767 5264772 +
gatacaaaattaacgtacacca

SEQ ID NO: 90827 - DNA, 22 bp, Artificial Sequence
  Synthetic oligonucleotide; TTA chr11 5264762 5264783 5264779 5264784 +
acgtacaccaatgagttgcttt

SEQ ID NO: 90828 - DNA, 22 bp, Artificial Sequence
  Synthetic oligonucleotide; TTG chr11 5264780 5264801 5264797 5264802 +
ctttcttacataccagcaatga

SEQ ID NO: 90829 - DNA, 22 bp, Artificial Sequence
  Synthetic oligonucleotide; CTT chr11 5264783 5264804 5264800 5264805 +
tcttacataccagcaatgacca

SEQ ID NO: 90830 - DNA, 22 bp, Artificial Sequence
  Synthetic oligonucleotide; TTT chr11 5264784 5264805 5264801 5264806 +
cttacataccagcaatgaccaa

SEQ ID NO: 90831 - DNA, 22 bp, Artificial Sequence
  Synthetic oligonucleotide; TTC chr11 5264785 5264806 5264802 5264807 +
ttacataccagcaatgaccaag

SEQ ID NO: 90832 - DNA, 22 bp, Artificial Sequence
  Synthetic oligonucleotide; CTT chr11 5264787 5264808 5264804 5264809 +
acataccagcaatgaccaagct

SEQ ID NO: 90833 - DNA, 22 bp, Artificial Sequence
  Synthetic oligonucleotide; TTA chr11 5264788 5264809 5264805 5264810 +
cataccagcaatgaccaagctg

SEQ ID NO: 90834 - DNA, 22 bp, Artificial Sequence
  Synthetic oligonucleotide; CTG chr11 5264810 5264831 5264827 5264832 +
agaataaaatcaagaactcaac

SEQ ID NO: 90835 - DNA, 22 bp, Artificial Sequence
  Synthetic oligonucleotide; CTC chr11 5264829 5264850 5264846 5264851 +
aaccccttttacaatagctgca

SEQ ID NO: 90836 - DNA, 22 bp, Artificial Sequence
  Synthetic oligonucleotide; CTT chr11 5264837 5264858 5264854 5264859 +
ttacaatagctgcaaaaaacaa

SEQ ID NO: 90837 - DNA, 22 bp, Artificial Sequence
  Synthetic oligonucleotide; TTT chr11 5264838 5264859 5264855 5264860 +
tacaatagctgcaaaaaacaaa

SEQ ID NO: 90838 - DNA, 22 bp, Artificial Sequence
  Synthetic oligonucleotide; TTT chr11 5264839 5264860 5264856 5264861 +
acaatagctgcaaaaaacaaaa

SEQ ID NO: 90839 - DNA, 22 bp, Artificial Sequence
  Synthetic oligonucleotide; TTA chr11 5264840 5264861 5264857 5264862 +
caatagctgcaaaaaacaaaac

SEQ ID NO: 90840 - DNA, 22 bp, Artificial Sequence
  Synthetic oligonucleotide; CTG chr11 5264849 5264870 5264866 5264871 +
caaaaaacaaaacaaaacaaaa

SEQ ID NO: 90841 - DNA, 22 bp, Artificial Sequence
  Synthetic oligonucleotide; CTT chr11 5264880 5264901 5264897 5264902 +
aggaatatatacctaaccaagg

SEQ ID NO: 90842 - DNA, 22 bp, Artificial Sequence
  Synthetic oligonucleotide; TTA chr11 5264881 5264902 5264898 5264903 +
ggaatatatacctaaccaagga

SEQ ID NO: 90843 - DNA, 22 bp, Artificial Sequence
  Synthetic oligonucleotide; CTA chr11 5264895 5264916 5264912 5264917 +
accaaggaggtgaaagacatct

SEQ ID NO: 90844 - DNA, 22 bp, Artificial Sequence
  Synthetic oligonucleotide; CTA chr11 5264918 5264939 5264935 5264940 +
caaggaaaactacaaaacacgg

SEQ ID NO: 90845 - DNA, 22 bp, Artificial Sequence
  Synthetic oligonucleotide; CTA chr11 5264930 5264951 5264947 5264952 +
caaaacacggctgaaagtaatc

SEQ ID NO: 90846 - DNA, 22 bp, Artificial Sequence
  Synthetic oligonucleotide; CTG chr11 5264943 5264964 5264960 5264965 +
aaagtaatcatataagacacaa

SEQ ID NO: 90847 - DNA, 22 bp, Artificial Sequence
  Synthetic oligonucleotide; TTC chr11 5264988 5265009 5265005 5265010 +
tcatagatgggtagaatcaata

SEQ ID NO: 90848 - DNA, 22 bp, Artificial Sequence
  Synthetic oligonucleotide; CTC chr11 5264990 5265011 5265007 5265012 +
atagatgggtagaatcaatatt

SEQ ID NO: 90849 - DNA, 22 bp, Artificial Sequence
  Synthetic oligonucleotide; TTG chr11 5265013 5265034 5265030 5265035 +
tgaaaatggccataatgccaga

SEQ ID NO: 90850 - DNA, 22 bp, Artificial Sequence
  Synthetic oligonucleotide; CTA chr11 5265044 5265065 5265061 5265066 +
caaattcattgcaattcccatc

SEQ ID NO: 90851 - DNA, 22 bp, Artificial Sequence
  Synthetic oligonucleotide; TTC chr11 5265051 5265072 5265068 5265073 +
attgcaattcccatcaaaatac

SEQ ID NO: 90852 - DNA, 22 bp, Artificial Sequence
  Synthetic oligonucleotide; TTG chr11 5265055 5265076 5265072 5265077 +
caattcccatcaaaataccacc

SEQ ID NO: 90853 - DNA, 22 bp, Artificial Sequence
  Synthetic oligonucleotide; TTC chr11 5265061 5265082 5265078 5265083 +
ccatcaaaataccaccattagt

SEQ ID NO: 90854 - DNA, 22 bp, Artificial Sequence
  Synthetic oligonucleotide; TTA chr11 5265081 5265102 5265098 5265103 +
gtcttcacagaactagaaaaaa

SEQ ID NO: 90855 - DNA, 22 bp, Artificial Sequence
  Synthetic oligonucleotide; CTT chr11 5265086 5265107 5265103 5265108 +
cacagaactagaaaaaacaatc

SEQ ID NO: 90856 - DNA, 22 bp, Artificial Sequence
  Synthetic oligonucleotide; TTC chr11 5265087 5265108 5265104 5265109 +
acagaactagaaaaaacaatcc

SEQ ID NO: 90857 - DNA, 22 bp, Artificial Sequence
  Synthetic oligonucleotide; CTA chr11 5265096 5265117 5265113 5265118 +
gaaaaaacaatcctaaaattct

SEQ ID NO: 90858 - DNA, 22 bp, Artificial Sequence
  Synthetic oligonucleotide; CTA chr11 5265111 5265132 5265128 5265133 +
aaattcttatggaaccaaaaaa

SEQ ID NO: 90859 - DNA, 22 bp, Artificial Sequence
  Synthetic oligonucleotide; TTC chr11 5265117 5265138 5265134 5265139 +
ttatggaaccaaaaaagagccc

SEQ ID NO: 90860 - DNA, 22 bp, Artificial Sequence
  Synthetic oligonucleotide; CTT chr11 5265119 5265140 5265136 5265141 +
atggaaccaaaaaagagcccaa

SEQ ID NO: 90861 - DNA, 22 bp, Artificial Sequence
  Synthetic oligonucleotide; TTA chr11 5265120 5265141 5265137 5265142 +
tggaaccaaaaaagagcccaat

SEQ ID NO: 90862 - DNA, 22 bp, Artificial Sequence
  Synthetic oligonucleotide; CTA chr11 5265157 5265178 5265174 5265179 +
aaaaaaagaacaaatctgaagg

SEQ ID NO: 90863 - DNA, 22 bp, Artificial Sequence
  Synthetic oligonucleotide; CTG chr11 5265175 5265196 5265192 5265197 +
aaggcattacattacctcattt

SEQ ID NO: 90864 - DNA, 22 bp, Artificial Sequence
  Synthetic oligonucleotide; TTA chr11 5265184 5265205 5265201 5265206 +
cattacctcatttcaaactata

SEQ ID NO: 90865 - DNA, 22 bp, Artificial Sequence
  Synthetic oligonucleotide; TTA chr11 5265189 5265210 5265206 5265211 +
cctcatttcaaactatacaata

SEQ ID NO: 90866 - DNA, 22 bp, Artificial Sequence
  Synthetic oligonucleotide; CTC chr11 5265193 5265214 5265210 5265215 +
atttcaaactatacaataaggc

SEQ ID NO: 90867 - DNA, 22 bp, Artificial Sequence
  Synthetic oligonucleotide; TTT chr11 5265197 5265218 5265214 5265219 +
caaactatacaataaggccata

SEQ ID NO: 90868 - DNA, 22 bp, Artificial Sequence
  Synthetic oligonucleotide; TTC chr11 5265198 5265219 5265215 5265220 +
aaactatacaataaggccatag

SEQ ID NO: 90869 - DNA, 22 bp, Artificial Sequence
  Synthetic oligonucleotide; CTA chr11 5265204 5265225 5265221 5265226 +
tacaataaggccatagtcacca

SEQ ID NO: 90870 - DNA, 22 bp, Artificial Sequence
  Synthetic oligonucleotide; CTG chr11 5265242 5265263 5265259 5265264 +
gtgtacaaataggcacatcgac

SEQ ID NO: 90871 - DNA, 22 bp, Artificial Sequence
  Synthetic oligonucleotide; CTC chr11 5265299 5265320 5265316 5265321 +
aaatacttacatccaactgatc

SEQ ID NO: 90872 - DNA, 22 bp, Artificial Sequence
  Synthetic oligonucleotide; CTT chr11 5265307 5265328 5265324 5265329 +
acatccaactgatctttgacaa

SEQ ID NO: 90873 - DNA, 22 bp, Artificial Sequence
  Synthetic oligonucleotide; TTA chr11 5265308 5265329 5265325 5265330 +
catccaactgatctttgacaaa

SEQ ID NO: 90874 - DNA, 22 bp, Artificial Sequence
  Synthetic oligonucleotide; CTG chr11 5265318 5265339 5265335 5265340 +
atctttgacaaagcaaacaaaa

SEQ ID NO: 90875 - DNA, 22 bp, Artificial Sequence
  Synthetic oligonucleotide; CTT chr11 5265323 5265344 5265340 5265345 +
tgacaaagcaaacaaaaacata

SEQ ID NO: 90876 - DNA, 22 bp, Artificial Sequence
  Synthetic oligonucleotide; TTT chr11 5265324 5265345 5265341 5265346 +
gacaaagcaaacaaaaacataa

SEQ ID NO: 90877 - DNA, 22 bp, Artificial Sequence
  Synthetic oligonucleotide; TTG chr11 5265325 5265346 5265342 5265347 +
acaaagcaaacaaaaacataaa

SEQ ID NO: 90878 - DNA, 22 bp, Artificial Sequence
  Synthetic oligonucleotide; CTA chr11 5265366 5265387 5265383 5265388 +
ttcaacaaatggtgcggggata

SEQ ID NO: 90879 - DNA, 22 bp, Artificial Sequence
  Synthetic oligonucleotide; TTC chr11 5265369 5265390 5265386 5265391 +
aacaaatggtgcggggatagct

SEQ ID NO: 90880 - DNA, 22 bp, Artificial Sequence
  Synthetic oligonucleotide; CTG chr11 5265392 5265413 5265409 5265414 +
gcaagctacatgtaggagaatg

SEQ ID NO: 90881 - DNA, 22 bp, Artificial Sequence
  Synthetic oligonucleotide; CTA chr11 5265400 5265421 5265417 5265422 +
catgtaggagaatgaaactgga

SEQ ID NO: 90882 - DNA, 22 bp, Artificial Sequence
  Synthetic oligonucleotide; CTG chr11 5265420 5265441 5265437 5265442 +
gatcttcatctctcaccttata

SEQ ID NO: 90883 - DNA, 22 bp, Artificial Sequence
  Synthetic oligonucleotide; CTT chr11 5265426 5265447 5265443 5265448 +
catctctcaccttatacaaaaa

SEQ ID NO: 90884 - DNA, 22 bp, Artificial Sequence
  Synthetic oligonucleotide; TTC chr11 5265427 5265448 5265444 5265449 +
atctctcaccttatacaaaaat

SEQ ID NO: 90885 - DNA, 22 bp, Artificial Sequence
  Synthetic oligonucleotide; CTC chr11 5265432 5265453 5265449 5265454 +
tcaccttatacaaaaatcaact

SEQ ID NO: 90886 - DNA, 22 bp, Artificial Sequence
  Synthetic oligonucleotide; CTC chr11 5265434 5265455 5265451 5265456 +
accttatacaaaaatcaactca

SEQ ID NO: 90887 - DNA, 22 bp, Artificial Sequence
  Synthetic oligonucleotide; CTT chr11 5265439 5265460 5265456 5265461 +
atacaaaaatcaactcaagatg

SEQ ID NO: 90888 - DNA, 22 bp, Artificial Sequence
  Synthetic oligonucleotide; TTA chr11 5265440 5265461 5265457 5265462 +
tacaaaaatcaactcaagatgg

SEQ ID NO: 90889 - DNA, 22 bp, Artificial Sequence
  Synthetic oligonucleotide; CTC chr11 5265455 5265476 5265472 5265477 +
aagatggatcaaggacttaaat

SEQ ID NO: 90890 - DNA, 22 bp, Artificial Sequence
  Synthetic oligonucleotide; CTT chr11 5265473 5265494 5265490 5265495 +
aaatctaagccctgaaactgta

SEQ ID NO: 90891 - DNA, 22 bp, Artificial Sequence
  Synthetic oligonucleotide; TTA chr11 5265474 5265495 5265491 5265496 +
aatctaagccctgaaactgtaa

SEQ ID NO: 90892 - DNA, 22 bp, Artificial Sequence
  Synthetic oligonucleotide; CTA chr11 5265480 5265501 5265497 5265502 +
agccctgaaactgtaacaattc

SEQ ID NO: 90893 - DNA, 22 bp, Artificial Sequence
  Synthetic oligonucleotide; CTG chr11 5265487 5265508 5265504 5265509 +
aaactgtaacaattctagaaaa

SEQ ID NO: 90894 - DNA, 22 bp, Artificial Sequence
  Synthetic oligonucleotide; CTG chr11 5265493 5265514 5265510 5265515 +
taacaattctagaaaataacat

SEQ ID NO: 90895 - DNA, 22 bp, Artificial Sequence
  Synthetic oligonucleotide; TTC chr11 5265502 5265523 5265519 5265524 +
tagaaaataacatcggaaaaac

SEQ ID NO: 90896 - DNA, 22 bp, Artificial Sequence
  Synthetic oligonucleotide; CTA chr11 5265504 5265525 5265521 5265526 +
gaaaataacatcggaaaaaccc

SEQ ID NO: 90897 - DNA, 22 bp, Artificial Sequence
  Synthetic oligonucleotide; CTT chr11 5265528 5265549 5265545 5265550 +
ctacacattggcttaggaaagg

SEQ ID NO: 90898 - DNA, 22 bp, Artificial Sequence
  Synthetic oligonucleotide; TTC chr11 5265529 5265550 5265546 5265551 +
tacacattggcttaggaaagga

SEQ ID NO: 90899 - DNA, 22 bp, Artificial Sequence
  Synthetic oligonucleotide; CTA chr11 5265531 5265552 5265548 5265553 +
cacattggcttaggaaaggatt

SEQ ID NO: 90900 - DNA, 22 bp, Artificial Sequence
  Synthetic oligonucleotide; TTG chr11 5265538 5265559 5265555 5265560 +
gcttaggaaaggatttcatgac

SEQ ID NO: 90901 - DNA, 22 bp, Artificial Sequence
  Synthetic oligonucleotide; CTT chr11 5265542 5265563 5265559 5265564 +
aggaaaggatttcatgaccaag

SEQ ID NO: 90902 - DNA, 22 bp, Artificial Sequence
  Synthetic oligonucleotide; TTA chr11 5265543 5265564 5265560 5265565 +
ggaaaggatttcatgaccaaga

SEQ ID NO: 90903 - DNA, 22 bp, Artificial Sequence
  Synthetic oligonucleotide; TTT chr11 5265554 5265575 5265571 5265576 +
catgaccaagaacacaaatgca

SEQ ID NO: 90904 - DNA, 22 bp, Artificial Sequence
  Synthetic oligonucleotide; TTC chr11 5265555 5265576 5265572 5265577 +
atgaccaagaacacaaatgcaa

SEQ ID NO: 90905 - DNA, 22 bp, Artificial Sequence
  Synthetic oligonucleotide; CTG chr11 5265603 5265624 5265620 5265625 +
ggactaaattaaactaaagagc

SEQ ID NO: 90906 - DNA, 22 bp, Artificial Sequence
  Synthetic oligonucleotide; CTA chr11 5265609 5265630 5265626 5265631 +
aattaaactaaagagcttttgc

SEQ ID NO: 90907 - DNA, 22 bp, Artificial Sequence
  Synthetic oligonucleotide; TTA chr11 5265614 5265635 5265631 5265636 +
aactaaagagcttttgcatggc

SEQ ID NO: 90908 - DNA, 22 bp, Artificial Sequence
  Synthetic oligonucleotide; CTA chr11 5265619 5265640 5265636 5265641 +
aagagcttttgcatggcaaaag

SEQ ID NO: 90909 - DNA, 22 bp, Artificial Sequence
  Synthetic oligonucleotide; CTT chr11 5265627 5265648 5265644 5265649 +
ttgcatggcaaaaggaagagtc

SEQ ID NO: 90910 - DNA, 22 bp, Artificial Sequence
  Synthetic oligonucleotide; TTT chr11 5265628 5265649 5265645 5265650 +
tgcatggcaaaaggaagagtct

SEQ ID NO: 90911 - DNA, 22 bp, Artificial Sequence
  Synthetic oligonucleotide; TTT chr11 5265629 5265650 5265646 5265651 +
gcatggcaaaaggaagagtctg

SEQ ID NO: 90912 - DNA, 22 bp, Artificial Sequence
  Synthetic oligonucleotide; TTG chr11 5265630 5265651 5265647 5265652 +
catggcaaaaggaagagtctgc

SEQ ID NO: 90913 - DNA, 22 bp, Artificial Sequence
  Synthetic oligonucleotide; CTG chr11 5265651 5265672 5265668 5265673 +
cagaataaacagacaacccaca

SEQ ID NO: 90914 - DNA, 22 bp, Artificial Sequence
  Synthetic oligonucleotide; CTT chr11 5265690 5265711 5265707 5265712 +
cacaatctatacatctgacaaa

SEQ ID NO: 90915 - DNA, 22 bp, Artificial Sequence
  Synthetic oligonucleotide; TTC chr11 5265691 5265712 5265708 5265713 +
acaatctatacatctgacaaaa

SEQ ID NO: 90916 - DNA, 22 bp, Artificial Sequence
  Synthetic oligonucleotide; CTA chr11 5265699 5265720 5265716 5265721 +
tacatctgacaaaagaataata

SEQ ID NO: 90917 - DNA, 22 bp, Artificial Sequence
  Synthetic oligonucleotide; CTG chr11 5265707 5265728 5265724 5265729 +
acaaaagaataatatccaggct

SEQ ID NO: 90918 - DNA, 22 bp, Artificial Sequence
  Synthetic oligonucleotide; CTC chr11 5265730 5265751 5265747 5265752 +
taaaatgaacacaaatagatta

SEQ ID NO: 90919 - DNA, 22 bp, Artificial Sequence
  Synthetic oligonucleotide; CTA chr11 5265732 5265753 5265749 5265754 +
aaatgaacacaaatagattatc

SEQ ID NO: 90920 - DNA, 22 bp, Artificial Sequence
  Synthetic oligonucleotide; TTA chr11 5265752 5265773 5265769 5265774 +
tcaagaaaataacaaacaatcc

SEQ ID NO: 90921 - DNA, 22 bp, Artificial Sequence
  Synthetic oligonucleotide; CTA chr11 5265791 5265812 5265808 5265813 +
aggacatgaacagacaattctc

SEQ ID NO: 90922 - DNA, 22 bp, Artificial Sequence
  Synthetic oligonucleotide; TTC chr11 5265811 5265832 5265828 5265833 +
tcagaaaaagatatacaaatga

SEQ ID NO: 90923 - DNA, 22 bp, Artificial Sequence
  Synthetic oligonucleotide; CTC chr11 5265813 5265834 5265830 5265835 +
agaaaaagatatacaaatgacc

SEQ ID NO: 90924 - DNA, 22 bp, Artificial Sequence
  Synthetic oligonucleotide; TTC chr11 5265856 5265877 5265873 5265878 +
tcaacatcactaatgatcaggg

SEQ ID NO: 90925 - DNA, 22 bp, Artificial Sequence
  Synthetic oligonucleotide; CTC chr11 5265858 5265879 5265875 5265880 +
aacatcactaatgatcagggaa

SEQ ID NO: 90926 - DNA, 22 bp, Artificial Sequence
  Synthetic oligonucleotide; CTA chr11 5265868 5265889 5265885 5265890 +
atgatcagggaaatgcaaatca

SEQ ID NO: 90927 - DNA, 22 bp, Artificial Sequence
  Synthetic oligonucleotide; CTA chr11 5265896 5265917 5265913 5265918 +
caatgagatatctacttactct

SEQ ID NO: 90928 - DNA, 22 bp, Artificial Sequence
  Synthetic oligonucleotide; CTA chr11 5265910 5265931 5265927 5265932 +
cttactctagttaaaacggcta

SEQ ID NO: 90929 - DNA, 22 bp, Artificial Sequence
  Synthetic oligonucleotide; CTT chr11 5265913 5265934 5265930 5265935 +
actctagttaaaacggctatta

SEQ ID NO: 90930 - DNA, 22 bp, Artificial Sequence
  Synthetic oligonucleotide; TTA chr11 5265914 5265935 5265931 5265936 +
ctctagttaaaacggctattaa

SEQ ID NO: 90931 - DNA, 22 bp, Artificial Sequence
  Synthetic oligonucleotide; CTC chr11 5265917 5265938 5265934 5265939 +
tagttaaaacggctattaacaa

SEQ ID NO: 90932 - DNA, 22 bp, Artificial Sequence
  Synthetic oligonucleotide; CTA chr11 5265919 5265940 5265936 5265941 +
gttaaaacggctattaacaaaa

SEQ ID NO: 90933 - DNA, 22 bp, Artificial Sequence
  Synthetic oligonucleotide; TTA chr11 5265923 5265944 5265940 5265945 +
aaacggctattaacaaaaaaga

SEQ ID NO: 90934 - DNA, 22 bp, Artificial Sequence
  Synthetic oligonucleotide; CTA chr11 5265932 5265953 5265949 5265954 +
ttaacaaaaaagacaaaaaata

SEQ ID NO: 90935 - DNA, 22 bp, Artificial Sequence
  Synthetic oligonucleotide; TTA chr11 5265935 5265956 5265952 5265957 +
acaaaaaagacaaaaaataaca

SEQ ID NO: 90936 - DNA, 22 bp, Artificial Sequence
  Synthetic oligonucleotide; CTT chr11 5265964 5265985 5265981 5265986 +
gtgaggatatggagaaaaggga

SEQ ID NO: 90937 - DNA, 22 bp, Artificial Sequence
  Synthetic oligonucleotide; TTG chr11 5265965 5265986 5265982 5265987 +
tgaggatatggagaaaagggaa

SEQ ID NO: 90938 - DNA, 22 bp, Artificial Sequence
  Synthetic oligonucleotide; CTC chr11 5265990 5266011 5266007 5266012 +
tttcttacacactgttggtggg

SEQ ID NO: 90939 - DNA, 22 bp, Artificial Sequence
  Synthetic oligonucleotide; CTT chr11 5265992 5266013 5266009 5266014 +
tcttacacactgttggtgggaa

SEQ ID NO: 90940 - DNA, 22 bp, Artificial Sequence
  Synthetic oligonucleotide; TTT chr11 5265993 5266014 5266010 5266015 +
cttacacactgttggtgggaat

SEQ ID NO: 90941 - DNA, 22 bp, Artificial Sequence
  Synthetic oligonucleotide; TTC chr11 5265994 5266015 5266011 5266016 +
ttacacactgttggtgggaatg

SEQ ID NO: 90942 - DNA, 22 bp, Artificial Sequence
  Synthetic oligonucleotide; CTT chr11 5265996 5266017 5266013 5266018 +
acacactgttggtgggaatgta

SEQ ID NO: 90943 - DNA, 22 bp, Artificial Sequence
  Synthetic oligonucleotide; TTA chr11 5265997 5266018 5266014 5266019 +
cacactgttggtgggaatgtaa

SEQ ID NO: 90944 - DNA, 22 bp, Artificial Sequence
  Synthetic oligonucleotide; CTG chr11 5266004 5266025 5266021 5266026 +
ttggtgggaatgtaaaatagta

SEQ ID NO: 90945 - DNA, 22 bp, Artificial Sequence
  Synthetic oligonucleotide; TTG chr11 5266007 5266028 5266024 5266029 +
gtgggaatgtaaaatagtacaa

SEQ ID NO: 90946 - DNA, 22 bp, Artificial Sequence
  Synthetic oligonucleotide; TTA chr11 5266035 5266056 5266052 5266057 +
tggaaaacagtatgaagatttc

SEQ ID NO: 90947 - DNA, 22 bp, Artificial Sequence
  Synthetic oligonucleotide; TTT chr11 5266056 5266077 5266073 5266078 +
ctcagtaaactaaaaacagaac

SEQ ID NO: 90948 - DNA, 22 bp, Artificial Sequence
  Synthetic oligonucleotide; TTC chr11 5266057 5266078 5266074 5266079 +
tcagtaaactaaaaacagaact

SEQ ID NO: 90949 - DNA, 22 bp, Artificial Sequence
  Synthetic oligonucleotide; CTC chr11 5266059 5266080 5266076 5266081 +
agtaaactaaaaacagaactat

SEQ ID NO: 90950 - DNA, 22 bp, Artificial Sequence
  Synthetic oligonucleotide; CTA chr11 5266068 5266089 5266085 5266090 +
aaaacagaactatcatacaatc

SEQ ID NO: 90951 - DNA, 22 bp, Artificial Sequence
  Synthetic oligonucleotide; CTA chr11 5266080 5266101 5266097 5266102 +
tcatacaatccagcaatctcac

SEQ ID NO: 90952 - DNA, 22 bp, Artificial Sequence
  Synthetic oligonucleotide; CTC chr11 5266100 5266121 5266117 5266122 +
actagtggttatttatccaaaa

SEQ ID NO: 90953 - DNA, 22 bp, Artificial Sequence
  Synthetic oligonucleotide; CTA chr11 5266104 5266125 5266121 5266126 +
gtggttatttatccaaaagaaa

SEQ ID NO: 90954 - DNA, 22 bp, Artificial Sequence
  Synthetic oligonucleotide; TTA chr11 5266111 5266132 5266128 5266133 +
tttatccaaaagaaaggaaatc

SEQ ID NO: 90955 - DNA, 22 bp, Artificial Sequence
  Synthetic oligonucleotide; TTT chr11 5266114 5266135 5266131 5266136 +
atccaaaagaaaggaaatcagt

SEQ ID NO: 90956 - DNA, 22 bp, Artificial Sequence
  Synthetic oligonucleotide; TTA chr11 5266115 5266136 5266132 5266137 +
tccaaaagaaaggaaatcagta

SEQ ID NO: 90957 - DNA, 22 bp, Artificial Sequence
  Synthetic oligonucleotide; TTA chr11 5266155 5266176 5266172 5266177 +
cactcatgtttattgaagcact

SEQ ID NO: 90958 - DNA, 22 bp, Artificial Sequence
  Synthetic oligonucleotide; CTC chr11 5266160 5266181 5266177 5266182 +
atgtttattgaagcactattca

SEQ ID NO: 90959 - DNA, 22 bp, Artificial Sequence
  Synthetic oligonucleotide; TTT chr11 5266166 5266187 5266183 5266188 +
attgaagcactattcacaatag

SEQ ID NO: 90960 - DNA, 22 bp, Artificial Sequence
  Synthetic oligonucleotide; TTA chr11 5266167 5266188 5266184 5266189 +
ttgaagcactattcacaatagt

SEQ ID NO: 90961 - DNA, 22 bp, Artificial Sequence
  Synthetic oligonucleotide; TTG chr11 5266170 5266191 5266187 5266192 +
aagcactattcacaatagttaa

SEQ ID NO: 90962 - DNA, 22 bp, Artificial Sequence
  Synthetic oligonucleotide; CTA chr11 5266178 5266199 5266195 5266200 +
ttcacaatagttaaggtttggg

SEQ ID NO: 90963 - DNA, 22 bp, Artificial Sequence
  Synthetic oligonucleotide; TTC chr11 5266181 5266202 5266198 5266203 +
acaatagttaaggtttgggatc

SEQ ID NO: 90964 - DNA, 22 bp, Artificial Sequence
  Synthetic oligonucleotide; TTA chr11 5266191 5266212 5266208 5266213 +
aggtttgggatcaacctaagtg

SEQ ID NO: 90965 - DNA, 22 bp, Artificial Sequence
  Synthetic oligonucleotide; TTT chr11 5266197 5266218 5266214 5266219 +
gggatcaacctaagtgtctatc

SEQ ID NO: 90966 - DNA, 22 bp, Artificial Sequence
  Synthetic oligonucleotide; TTG chr11 5266198 5266219 5266215 5266220 +
ggatcaacctaagtgtctatca

SEQ ID NO: 90967 - DNA, 22 bp, Artificial Sequence
  Synthetic oligonucleotide; CTA chr11 5266209 5266230 5266226 5266231 +
agtgtctatcaacagatgaacg

SEQ ID NO: 90968 - DNA, 22 bp, Artificial Sequence
  Synthetic oligonucleotide; CTA chr11 5266217 5266238 5266234 5266239 +
tcaacagatgaacggattaaaa

SEQ ID NO: 90969 - DNA, 22 bp, Artificial Sequence
  Synthetic oligonucleotide; TTA chr11 5266236 5266257 5266253 5266258 +
aaaaattgtatttttgcacagt

SEQ ID NO: 90970 - DNA, 22 bp, Artificial Sequence
  Synthetic oligonucleotide; TTG chr11 5266244 5266265 5266261 5266266 +
tatttttgcacagtactatttt

SEQ ID NO: 90971 - DNA, 22 bp, Artificial Sequence
  Synthetic oligonucleotide; TTT chr11 5266249 5266270 5266266 5266271 +
ttgcacagtactattttgccat

SEQ ID NO: 90972 - DNA, 22 bp, Artificial Sequence
  Synthetic oligonucleotide; TTT chr11 5266250 5266271 5266267 5266272 +
tgcacagtactattttgccatg

SEQ ID NO: 90973 - DNA, 22 bp, Artificial Sequence
  Synthetic oligonucleotide; TTT chr11 5266251 5266272 5266268 5266273 +
gcacagtactattttgccatga

SEQ ID NO: 90974 - DNA, 22 bp, Artificial Sequence
  Synthetic oligonucleotide; TTG chr11 5266252 5266273 5266269 5266274 +
cacagtactattttgccatgaa

SEQ ID NO: 90975 - DNA, 22 bp, Artificial Sequence
  Synthetic oligonucleotide; CTA chr11 5266262 5266283 5266279 5266284 +
ttttgccatgaaaaagaatgaa

SEQ ID NO: 90976 - DNA, 22 bp, Artificial Sequence
  Synthetic oligonucleotide; TTT chr11 5266265 5266286 5266282 5266287 +
tgccatgaaaaagaatgaaatc

SEQ ID NO: 90977 - DNA, 22 bp, Artificial Sequence
  Synthetic oligonucleotide; TTT chr11 5266266 5266287 5266283 5266288 +
gccatgaaaaagaatgaaatct

SEQ ID NO: 90978 - DNA, 22 bp, Artificial Sequence
  Synthetic oligonucleotide; TTG chr11 5266267 5266288 5266284 5266289 +
ccatgaaaaagaatgaaatctt

SEQ ID NO: 90979 - DNA, 22 bp, Artificial Sequence
  Synthetic oligonucleotide; CTT chr11 5266289 5266310 5266306 5266311 +
gtcatttgtagcaacatggatg

SEQ ID NO: 90980 - DNA, 22 bp, Artificial Sequence
  Synthetic oligonucleotide; TTG chr11 5266290 5266311 5266307 5266312 +
tcatttgtagcaacatggatgg

SEQ ID NO: 90981 - DNA, 22 bp, Artificial Sequence
  Synthetic oligonucleotide; TTT chr11 5266296 5266317 5266313 5266318 +
gtagcaacatggatggaaccag

SEQ ID NO: 90982 - DNA, 22 bp, Artificial Sequence
  Synthetic oligonucleotide; TTG chr11 5266297 5266318 5266314 5266319 +
tagcaacatggatggaaccaga

SEQ ID NO: 90983 - DNA, 22 bp, Artificial Sequence
  Synthetic oligonucleotide; TTA chr11 5266327 5266348 5266344 5266349 +
tgttaattgaaagccctgaagc

SEQ ID NO: 90984 - DNA, 22 bp, Artificial Sequence
  Synthetic oligonucleotide; TTA chr11 5266332 5266353 5266349 5266354 +
attgaaagccctgaagcagaac

SEQ ID NO: 90985 - DNA, 22 bp, Artificial Sequence
  Synthetic oligonucleotide; TTG chr11 5266336 5266357 5266353 5266358 +
aaagccctgaagcagaacaaaa

SEQ ID NO: 90986 - DNA, 22 bp, Artificial Sequence
  Synthetic oligonucleotide; CTG chr11 5266345 5266366 5266362 5266367 +
aagcagaacaaaaacaaactct

SEQ ID NO: 90987 - DNA, 22 bp, Artificial Sequence
  Synthetic oligonucleotide; CTC chr11 5266366 5266387 5266383 5266388 +
ttggtatgccaaagagatagat

SEQ ID NO: 90988 - DNA, 22 bp, Artificial Sequence
  Synthetic oligonucleotide; CTT chr11 5266368 5266389 5266385 5266390 +
ggtatgccaaagagatagataa

SEQ ID NO: 90989 - DNA, 22 bp, Artificial Sequence
  Synthetic oligonucleotide; TTG chr11 5266369 5266390 5266386 5266391 +
gtatgccaaagagatagataat

SEQ ID NO: 90990 - DNA, 22 bp, Artificial Sequence
  Synthetic oligonucleotide; TTT chr11 5266430 5266451 5266447 5266452 +
ttattcatctgtgggagctaaa

SEQ ID NO: 90991 - DNA, 22 bp, Artificial Sequence
  Synthetic oligonucleotide; TTT chr11 5266431 5266452 5266448 5266453 +
tattcatctgtgggagctaaaa

SEQ ID NO: 90992 - DNA, 22 bp, Artificial Sequence
  Synthetic oligonucleotide; TTT chr11 5266432 5266453 5266449 5266454 +
attcatctgtgggagctaaaaa

SEQ ID NO: 90993 - DNA, 22 bp, Artificial Sequence
  Synthetic oligonucleotide; TTA chr11 5266433 5266454 5266450 5266455 +
ttcatctgtgggagctaaaaaa

SEQ ID NO: 90994 - DNA, 22 bp, Artificial Sequence
  Synthetic oligonucleotide; TTC chr11 5266436 5266457 5266453 5266458 +
atctgtgggagctaaaaaagtg

SEQ ID NO: 90995 - DNA, 22 bp, Artificial Sequence
  Synthetic oligonucleotide; CTG chr11 5266441 5266462 5266458 5266463 +
tgggagctaaaaaagtgggtct

SEQ ID NO: 90996 - DNA, 22 bp, Artificial Sequence
  Synthetic oligonucleotide; CTA chr11 5266450 5266471 5266467 5266472 +
aaaaagtgggtctcatggtggt

SEQ ID NO: 90997 - DNA, 22 bp, Artificial Sequence
  Synthetic oligonucleotide; CTC chr11 5266464 5266485 5266481 5266486 +
atggtggtagagagtagaatga

SEQ ID NO: 90998 - DNA, 22 bp, Artificial Sequence
  Synthetic oligonucleotide; TTA chr11 5266492 5266513 5266509 5266514 +
tcagaggctggaaaaagtgtga

SEQ ID NO: 90999 - DNA, 22 bp, Artificial Sequence
  Synthetic oligonucleotide; CTG chr11 5266502 5266523 5266519 5266524 +
gaaaaagtgtgagtgtgtatgg

SEQ ID NO: 91000 - DNA, 22 bp, Artificial Sequence
  Synthetic oligonucleotide; TTT chr11 5266534 5266555 5266551 5266556 +
aagagatgttggttaataggta

SEQ ID NO: 91001 - DNA, 22 bp, Artificial Sequence
  Synthetic oligonucleotide; TTA chr11 5266535 5266556 5266552 5266557 +
agagatgttggttaataggtac

SEQ ID NO: 91002 - DNA, 22 bp, Artificial Sequence
  Synthetic oligonucleotide; TTG chr11 5266545 5266566 5266562 5266567 +
gttaataggtacaaacacagtt

SEQ ID NO: 91003 - DNA, 22 bp, Artificial Sequence
  Synthetic oligonucleotide; TTA chr11 5266549 5266570 5266566 5266571 +
ataggtacaaacacagttggat

SEQ ID NO: 91004 - DNA, 22 bp, Artificial Sequence
  Synthetic oligonucleotide; TTG chr11 5266568 5266589 5266585 5266590 +
gatagaaggattaagccataat

SEQ ID NO: 91005 - DNA, 22 bp, Artificial Sequence
  Synthetic oligonucleotide; TTA chr11 5266581 5266602 5266598 5266603 +
agccataatgtttgatatttga

SEQ ID NO: 91006 - DNA, 22 bp, Artificial Sequence
  Synthetic oligonucleotide; TTT chr11 5266594 5266615 5266611 5266616 +
gatatttgagtagggtgactat

SEQ ID NO: 91007 - DNA, 22 bp, Artificial Sequence
  Synthetic oligonucleotide; TTG chr11 5266595 5266616 5266612 5266617 +
atatttgagtagggtgactata

SEQ ID NO: 91008 - DNA, 22 bp, Artificial Sequence
  Synthetic oligonucleotide; TTT chr11 5266601 5266622 5266618 5266623 +
gagtagggtgactatagttaat

SEQ ID NO: 91009 - DNA, 22 bp, Artificial Sequence
  Synthetic oligonucleotide; TTG chr11 5266602 5266623 5266619 5266624 +
agtagggtgactatagttaatt

SEQ ID NO: 91010 - DNA, 22 bp, Artificial Sequence
  Synthetic oligonucleotide; CTA chr11 5266615 5266636 5266632 5266637 +
tagttaattactatttattata

SEQ ID NO: 91011 - DNA, 22 bp, Artificial Sequence
  Synthetic oligonucleotide; TTA chr11 5266621 5266642 5266638 5266643 +
attactatttattatatatttc

SEQ ID NO: 91012 - DNA, 22 bp, Artificial Sequence
  Synthetic oligonucleotide; TTA chr11 5266625 5266646 5266642 5266647 +
ctatttattatatatttcaaaa

SEQ ID NO: 91013 - DNA, 22 bp, Artificial Sequence
  Synthetic oligonucleotide; CTA chr11 5266628 5266649 5266645 5266650 +
tttattatatatttcaaaatgg

SEQ ID NO: 91014 - DNA, 22 bp, Artificial Sequence
  Synthetic oligonucleotide; TTT chr11 5266631 5266652 5266648 5266653 +
attatatatttcaaaatggcta

SEQ ID NO: 91015 - DNA, 22 bp, Artificial Sequence
  Synthetic oligonucleotide; TTA chr11 5266632 5266653 5266649 5266654 +
ttatatatttcaaaatggctag

SEQ ID NO: 91016 - DNA, 22 bp, Artificial Sequence
  Synthetic oligonucleotide; TTA chr11 5266635 5266656 5266652 5266657 +
tatatttcaaaatggctagaaa

SEQ ID NO: 91017 - DNA, 22 bp, Artificial Sequence
  Synthetic oligonucleotide; TTT chr11 5266642 5266663 5266659 5266664 +
caaaatggctagaaatgaggat

SEQ ID NO: 91018 - DNA, 22 bp, Artificial Sequence
  Synthetic oligonucleotide; TTC chr11 5266643 5266664 5266660 5266665 +
aaaatggctagaaatgaggatt

SEQ ID NO: 91019 - DNA, 22 bp, Artificial Sequence
  Synthetic oligonucleotide; CTA chr11 5266653 5266674 5266670 5266675 +
gaaatgaggatttgaaattttc

SEQ ID NO: 91020 - DNA, 22 bp, Artificial Sequence
  Synthetic oligonucleotide; TTT chr11 5266666 5266687 5266683 5266688 +
gaaattttctcaatacatagaa

SEQ ID NO: 91021 - DNA, 22 bp, Artificial Sequence
  Synthetic oligonucleotide; TTG chr11 5266667 5266688 5266684 5266689 +
aaattttctcaatacatagaaa

SEQ ID NO: 91022 - DNA, 22 bp, Artificial Sequence
  Synthetic oligonucleotide; TTT chr11 5266673 5266694 5266690 5266695 +
tctcaatacatagaaatgataa

SEQ ID NO: 91023 - DNA, 22 bp, Artificial Sequence
  Synthetic oligonucleotide; TTT chr11 5266674 5266695 5266691 5266696 +
ctcaatacatagaaatgataaa

SEQ ID NO: 91024 - DNA, 22 bp, Artificial Sequence
  Synthetic oligonucleotide; TTC chr11 5266675 5266696 5266692 5266697 +
tcaatacatagaaatgataaat

SEQ ID NO: 91025 - DNA, 22 bp, Artificial Sequence
  Synthetic oligonucleotide; CTC chr11 5266677 5266698 5266694 5266699 +
aatacatagaaatgataaatgc

SEQ ID NO: 91026 - DNA, 22 bp, Artificial Sequence
  Synthetic oligonucleotide; CTC chr11 5266701 5266722 5266718 5266723 +
aaagcaatggatatcctaaata

SEQ ID NO: 91027 - DNA, 22 bp, Artificial Sequence
  Synthetic oligonucleotide; CTA chr11 5266719 5266740 5266736 5266741 +
aatatctagacttaatcatcac

SEQ ID NO: 91028 - DNA, 22 bp, Artificial Sequence
  Synthetic oligonucleotide; CTA chr11 5266727 5266748 5266744 5266749 +
gacttaatcatcacatgttcta

SEQ ID NO: 91029 - DNA, 22 bp, Artificial Sequence
  Synthetic oligonucleotide; CTT chr11 5266732 5266753 5266749 5266754 +
aatcatcacatgttctaggcat

SEQ ID NO: 91030 - DNA, 22 bp, Artificial Sequence
  Synthetic oligonucleotide; TTA chr11 5266733 5266754 5266750 5266755 +
atcatcacatgttctaggcatg

SEQ ID NO: 91031 - DNA, 22 bp, Artificial Sequence
  Synthetic oligonucleotide; TTC chr11 5266747 5266768 5266764 5266769 +
taggcatgtaagtatcacatgt

SEQ ID NO: 91032 - DNA, 22 bp, Artificial Sequence
  Synthetic oligonucleotide; CTA chr11 5266749 5266770 5266766 5266771 +
ggcatgtaagtatcacatgtac

SEQ ID NO: 91033 - DNA, 22 bp, Artificial Sequence
  Synthetic oligonucleotide; TTG chr11 5266812 5266833 5266829 5266834 +
ctcccatttgttgactgactag

SEQ ID NO: 91034 - DNA, 22 bp, Artificial Sequence
  Synthetic oligonucleotide; CTC chr11 5266815 5266836 5266832 5266837 +
ccatttgttgactgactaggtg

SEQ ID NO: 91035 - DNA, 22 bp, Artificial Sequence
  Synthetic oligonucleotide; TTT chr11 5266821 5266842 5266838 5266843 +
gttgactgactaggtgaaaata

SEQ ID NO: 91036 - DNA, 22 bp, Artificial Sequence
  Synthetic oligonucleotide; TTG chr11 5266822 5266843 5266839 5266844 +
ttgactgactaggtgaaaatat

SEQ ID NO: 91037 - DNA, 22 bp, Artificial Sequence
  Synthetic oligonucleotide; TTG chr11 5266825 5266846 5266842 5266847 +
actgactaggtgaaaatattta

SEQ ID NO: 91038 - DNA, 22 bp, Artificial Sequence
  Synthetic oligonucleotide; CTG chr11 5266829 5266850 5266846 5266851 +
actaggtgaaaatatttagtgc

SEQ ID NO: 91039 - DNA, 22 bp, Artificial Sequence
  Synthetic oligonucleotide; CTA chr11 5266833 5266854 5266850 5266855 +
ggtgaaaatatttagtgccatg

SEQ ID NO: 91040 - DNA, 22 bp, Artificial Sequence
  Synthetic oligonucleotide; TTT chr11 5266846 5266867 5266863 5266868 +
agtgccatgaataatccctgtt

SEQ ID NO: 91041 - DNA, 22 bp, Artificial Sequence
  Synthetic oligonucleotide; TTA chr11 5266847 5266868 5266864 5266869 +
gtgccatgaataatccctgttt

SEQ ID NO: 91042 - DNA, 22 bp, Artificial Sequence
  Synthetic oligonucleotide; CTG chr11 5266866 5266887 5266883 5266888 +
tttactctgtttatgggcatat

SEQ ID NO: 91043 - DNA, 22 bp, Artificial Sequence
  Synthetic oligonucleotide; TTT chr11 5266869 5266890 5266886 5266891 +
actctgtttatgggcatattga

SEQ ID NO: 91044 - DNA, 22 bp, Artificial Sequence
  Synthetic oligonucleotide; TTA chr11 5266870 5266891 5266887 5266892 +
ctctgtttatgggcatattgaa

SEQ ID NO: 91045 - DNA, 22 bp, Artificial Sequence
  Synthetic oligonucleotide; CTC chr11 5266873 5266894 5266890 5266895 +
tgtttatgggcatattgaaagg

SEQ ID NO: 91046 - DNA, 22 bp, Artificial Sequence
  Synthetic oligonucleotide; CTG chr11 5266875 5266896 5266892 5266897 +
tttatgggcatattgaaaggtt

SEQ ID NO: 91047 - DNA, 22 bp, Artificial Sequence
  Synthetic oligonucleotide; TTT chr11 5266878 5266899 5266895 5266900 +
atgggcatattgaaaggttata

SEQ ID NO: 91048 - DNA, 22 bp, Artificial Sequence
  Synthetic oligonucleotide; TTA chr11 5266879 5266900 5266896 5266901 +
tgggcatattgaaaggttataa

SEQ ID NO: 91049 - DNA, 22 bp, Artificial Sequence
  Synthetic oligonucleotide; TTG chr11 5266890 5266911 5266907 5266912 +
aaaggttataaggctcagagag

SEQ ID NO: 91050 - DNA, 22 bp, Artificial Sequence
  Synthetic oligonucleotide; TTA chr11 5266898 5266919 5266915 5266920 +
taaggctcagagagaccagtat

SEQ ID NO: 91051 - DNA, 22 bp, Artificial Sequence
  Synthetic oligonucleotide; CTC chr11 5266906 5266927 5266923 5266928 +
agagagaccagtattgttgata

SEQ ID NO: 91052 - DNA, 22 bp, Artificial Sequence
  Synthetic oligonucleotide; TTG chr11 5266922 5266943 5266939 5266944 +
ttgatagcctgcaactacaata

SEQ ID NO: 91053 - DNA, 22 bp, Artificial Sequence
  Synthetic oligonucleotide; TTG chr11 5266925 5266946 5266942 5266947 +
atagcctgcaactacaataatt

SEQ ID NO: 91054 - DNA, 22 bp, Artificial Sequence
  Synthetic oligonucleotide; CTG chr11 5266933 5266954 5266950 5266955 +
caactacaataattatttgtct

SEQ ID NO: 91055 - DNA, 22 bp, Artificial Sequence
  Synthetic oligonucleotide; CTA chr11 5266939 5266960 5266956 5266961 +
caataattatttgtctctctcc

SEQ ID NO: 91056 - DNA, 22 bp, Artificial Sequence
  Synthetic oligonucleotide; TTA chr11 5266948 5266969 5266965 5266970 +
tttgtctctctcccatattctg

SEQ ID NO: 91057 - DNA, 22 bp, Artificial Sequence
  Synthetic oligonucleotide; TTT chr11 5266951 5266972 5266968 5266973 +
gtctctctcccatattctggat

SEQ ID NO: 91058 - DNA, 22 bp, Artificial Sequence
  Synthetic oligonucleotide; TTG chr11 5266952 5266973 5266969 5266974 +
tctctctcccatattctggata

SEQ ID NO: 91059 - DNA, 22 bp, Artificial Sequence
  Synthetic oligonucleotide; CTC chr11 5266956 5266977 5266973 5266978 +
tctcccatattctggatatata

SEQ ID NO: 91060 - DNA, 22 bp, Artificial Sequence
  Synthetic oligonucleotide; CTC chr11 5266958 5266979 5266975 5266980 +
tcccatattctggatatataca

SEQ ID NO: 91061 - DNA, 22 bp, Artificial Sequence
  Synthetic oligonucleotide; CTC chr11 5266960 5266981 5266977 5266982 +
ccatattctggatatatacagc

SEQ ID NO: 91062 - DNA, 22 bp, Artificial Sequence
  Synthetic oligonucleotide; TTC chr11 5266968 5266989 5266985 5266990 +
tggatatatacagccaaattca

SEQ ID NO: 91063 - DNA, 22 bp, Artificial Sequence
  Synthetic oligonucleotide; CTG chr11 5266970 5266991 5266987 5266992 +
gatatatacagccaaattcaaa

SEQ ID NO: 91064 - DNA, 22 bp, Artificial Sequence
  Synthetic oligonucleotide; TTC chr11 5266989 5267010 5267006 5267011 +
aaaagtaattcacaggaaaaag

SEQ ID NO: 91065 - DNA, 22 bp, Artificial Sequence
  Synthetic oligonucleotide; TTC chr11 5267000 5267021 5267017 5267022 +
acaggaaaaagtctgatcaatg

SEQ ID NO: 91066 - DNA, 22 bp, Artificial Sequence
  Synthetic oligonucleotide; CTG chr11 5267015 5267036 5267032 5267037 +
atcaatgtgagagcactataaa

SEQ ID NO: 91067 - DNA, 22 bp, Artificial Sequence
  Synthetic oligonucleotide; CTA chr11 5267033 5267054 5267050 5267055 +
taaaattactaataaagttata

SEQ ID NO: 91068 - DNA, 22 bp, Artificial Sequence
  Synthetic oligonucleotide; TTA chr11 5267041 5267062 5267058 5267063 +
ctaataaagttatatttgccaa

SEQ ID NO: 91069 - DNA, 22 bp, Artificial Sequence
  Synthetic oligonucleotide; CTA chr11 5267044 5267065 5267061 5267066 +
ataaagttatatttgccaaaat

SEQ ID NO: 91070 - DNA, 22 bp, Artificial Sequence
  Synthetic oligonucleotide; TTA chr11 5267053 5267074 5267070 5267075 +
tatttgccaaaatatggcactc

SEQ ID NO: 91071 - DNA, 22 bp, Artificial Sequence
  Synthetic oligonucleotide; TTT chr11 5267058 5267079 5267075 5267080 +
gccaaaatatggcactctaact

SEQ ID NO: 91072 - DNA, 22 bp, Artificial Sequence
  Synthetic oligonucleotide; TTG chr11 5267059 5267080 5267076 5267081 +
ccaaaatatggcactctaactt

SEQ ID NO: 91073 - DNA, 22 bp, Artificial Sequence
  Synthetic oligonucleotide; CTC chr11 5267075 5267096 5267092 5267097 +
taacttggaaaatgcaaaggtt

SEQ ID NO: 91074 - DNA, 22 bp, Artificial Sequence
  Synthetic oligonucleotide; CTA chr11 5267077 5267098 5267094 5267099 +
acttggaaaatgcaaaggttcc

SEQ ID NO: 91075 - DNA, 22 bp, Artificial Sequence
  Synthetic oligonucleotide; CTT chr11 5267081 5267102 5267098 5267103 +
ggaaaatgcaaaggttccttga

SEQ ID NO: 91076 - DNA, 22 bp, Artificial Sequence
  Synthetic oligonucleotide; TTG chr11 5267082 5267103 5267099 5267104 +
gaaaatgcaaaggttccttgat

SEQ ID NO: 91077 - DNA, 22 bp, Artificial Sequence
  Synthetic oligonucleotide; TTC chr11 5267098 5267119 5267115 5267120 +
cttgatatgaaagacacaagac

SEQ ID NO: 91078 - DNA, 22 bp, Artificial Sequence
  Synthetic oligonucleotide; CTT chr11 5267101 5267122 5267118 5267123 +
gatatgaaagacacaagacctg

SEQ ID NO: 91079 - DNA, 22 bp, Artificial Sequence
  Synthetic oligonucleotide; TTG chr11 5267102 5267123 5267119 5267124 +
atatgaaagacacaagacctga

SEQ ID NO: 91080 - DNA, 22 bp, Artificial Sequence
  Synthetic oligonucleotide; CTG chr11 5267123 5267144 5267140 5267145 +
aaggtcaaaactccctgaccaa

SEQ ID NO: 91081 - DNA, 22 bp, Artificial Sequence
  Synthetic oligonucleotide; CTC chr11 5267136 5267157 5267153 5267158 +
cctgaccaatctagcacttcct

SEQ ID NO: 91082 - DNA, 22 bp, Artificial Sequence
  Synthetic oligonucleotide; CTG chr11 5267140 5267161 5267157 5267162 +
accaatctagcacttcctaaaa

SEQ ID NO: 91083 - DNA, 22 bp, Artificial Sequence
  Synthetic oligonucleotide; CTA chr11 5267149 5267170 5267166 5267171 +
gcacttcctaaaaagtaaatct

SEQ ID NO: 91084 - DNA, 22 bp, Artificial Sequence
  Synthetic oligonucleotide; CTT chr11 5267155 5267176 5267172 5267177 +
cctaaaaagtaaatctgttaat

SEQ ID NO: 91085 - DNA, 22 bp, Artificial Sequence
  Synthetic oligonucleotide; TTC chr11 5267156 5267177 5267173 5267178 +
ctaaaaagtaaatctgttaata

SEQ ID NO: 91086 - DNA, 22 bp, Artificial Sequence
  Synthetic oligonucleotide; CTA chr11 5267159 5267180 5267176 5267181 +
aaaagtaaatctgttaatatcc

SEQ ID NO: 91087 - DNA, 22 bp, Artificial Sequence
  Synthetic oligonucleotide; CTG chr11 5267172 5267193 5267189 5267194 +
ttaatatccctctacccttcac

SEQ ID NO: 91088 - DNA, 22 bp, Artificial Sequence
  Synthetic oligonucleotide; TTA chr11 5267175 5267196 5267192 5267197 +
atatccctctacccttcacaca

SEQ ID NO: 91089 - DNA, 22 bp, Artificial Sequence
  Synthetic oligonucleotide; CTC chr11 5267184 5267205 5267201 5267206 +
tacccttcacacatgagagtca

SEQ ID NO: 91090 - DNA, 22 bp, Artificial Sequence
  Synthetic oligonucleotide; CTA chr11 5267186 5267207 5267203 5267208 +
cccttcacacatgagagtcacc

SEQ ID NO: 91091 - DNA, 22 bp, Artificial Sequence
  Synthetic oligonucleotide; CTT chr11 5267191 5267212 5267208 5267213 +
cacacatgagagtcaccaggtc

SEQ ID NO: 91092 - DNA, 22 bp, Artificial Sequence
  Synthetic oligonucleotide; TTC chr11 5267192 5267213 5267209 5267214 +
acacatgagagtcaccaggtca

SEQ ID NO: 91093 - DNA, 22 bp, Artificial Sequence
  Synthetic oligonucleotide; TTT chr11 5267225 5267246 5267242 5267247 +
cctcctgttatcttcaccagtc

SEQ ID NO: 91094 - DNA, 22 bp, Artificial Sequence
  Synthetic oligonucleotide; TTC chr11 5267226 5267247 5267243 5267248 +
ctcctgttatcttcaccagtct

SEQ ID NO: 91095 - DNA, 22 bp, Artificial Sequence
  Synthetic oligonucleotide; CTC chr11 5267229 5267250 5267246 5267251 +
ctgttatcttcaccagtctggg

SEQ ID NO: 91096 - DNA, 22 bp, Artificial Sequence
  Synthetic oligonucleotide; CTG chr11 5267232 5267253 5267249 5267254 +
ttatcttcaccagtctgggagc

SEQ ID NO: 91097 - DNA, 22 bp, Artificial Sequence
  Synthetic oligonucleotide; TTA chr11 5267235 5267256 5267252 5267257 +
tcttcaccagtctgggagcttt

SEQ ID NO: 91098 - DNA, 22 bp, Artificial Sequence
  Synthetic oligonucleotide; CTT chr11 5267239 5267260 5267256 5267261 +
caccagtctgggagctttcagt

SEQ ID NO: 91099 - DNA, 22 bp, Artificial Sequence
  Synthetic oligonucleotide; TTC chr11 5267240 5267261 5267257 5267262 +
accagtctgggagctttcagtc

SEQ ID NO: 91100 - DNA, 22 bp, Artificial Sequence
  Synthetic oligonucleotide; CTG chr11 5267249 5267270 5267266 5267271 +
ggagctttcagtcatttatcac

SEQ ID NO: 91101 - DNA, 22 bp, Artificial Sequence
  Synthetic oligonucleotide; CTT chr11 5267256 5267277 5267273 5267278 +
tcagtcatttatcacctccttc

SEQ ID NO: 91102 - DNA, 22 bp, Artificial Sequence
  Synthetic oligonucleotide; TTT chr11 5267257 5267278 5267274 5267279 +
cagtcatttatcacctccttct

SEQ ID NO: 91103 - DNA, 22 bp, Artificial Sequence
  Synthetic oligonucleotide; TTC chr11 5267258 5267279 5267275 5267280 +
agtcatttatcacctccttctt

SEQ ID NO: 91104 - DNA, 22 bp, Artificial Sequence
  Synthetic oligonucleotide; TTT chr11 5267266 5267287 5267283 5267288 +
atcacctccttcttccttctca

SEQ ID NO: 91105 - DNA, 22 bp, Artificial Sequence
  Synthetic oligonucleotide; TTA chr11 5267267 5267288 5267284 5267289 +
tcacctccttcttccttctcat

SEQ ID NO: 91106 - DNA, 22 bp, Artificial Sequence
  Synthetic oligonucleotide; CTC chr11 5267274 5267295 5267291 5267296 +
cttcttccttctcatctcccac

SEQ ID NO: 91107 - DNA, 22 bp, Artificial Sequence
  Synthetic oligonucleotide; CTT chr11 5267277 5267298 5267294 5267299 +
cttccttctcatctcccacagt

SEQ ID NO: 91108 - DNA, 22 bp, Artificial Sequence
  Synthetic oligonucleotide; TTC chr11 5267278 5267299 5267295 5267300 +
ttccttctcatctcccacagtc

SEQ ID NO: 91109 - DNA, 22 bp, Artificial Sequence
  Synthetic oligonucleotide; CTT chr11 5267280 5267301 5267297 5267302 +
ccttctcatctcccacagtcag

SEQ ID NO: 91110 - DNA, 22 bp, Artificial Sequence
  Synthetic oligonucleotide; TTC chr11 5267281 5267302 5267298 5267303 +
cttctcatctcccacagtcagt

SEQ ID NO: 91111 - DNA, 22 bp, Artificial Sequence
  Synthetic oligonucleotide; CTT chr11 5267284 5267305 5267301 5267306 +
ctcatctcccacagtcagtcga

SEQ ID NO: 91112 - DNA, 22 bp, Artificial Sequence
  Synthetic oligonucleotide; TTC chr11 5267285 5267306 5267302 5267307 +
tcatctcccacagtcagtcgaa

SEQ ID NO: 91113 - DNA, 22 bp, Artificial Sequence
  Synthetic oligonucleotide; CTC chr11 5267287 5267308 5267304 5267309 +
atctcccacagtcagtcgaata

SEQ ID NO: 91114 - DNA, 22 bp, Artificial Sequence
  Synthetic oligonucleotide; CTC chr11 5267292 5267313 5267309 5267314 +
ccacagtcagtcgaatactatg

SEQ ID NO: 91115 - DNA, 22 bp, Artificial Sequence
  Synthetic oligonucleotide; CTA chr11 5267312 5267333 5267329 5267334 +
tgtctttctcaccccacctttg

SEQ ID NO: 91116 - DNA, 22 bp, Artificial Sequence
  Synthetic oligonucleotide; CTT chr11 5267318 5267339 5267335 5267340 +
tctcaccccacctttgtccatc

SEQ ID NO: 91117 - DNA, 22 bp, Artificial Sequence
  Synthetic oligonucleotide; TTT chr11 5267319 5267340 5267336 5267341 +
ctcaccccacctttgtccatcc

SEQ ID NO: 91118 - DNA, 22 bp, Artificial Sequence
  Synthetic oligonucleotide; TTC chr11 5267320 5267341 5267337 5267342 +
tcaccccacctttgtccatcct

SEQ ID NO: 91119 - DNA, 22 bp, Artificial Sequence
  Synthetic oligonucleotide; CTC chr11 5267322 5267343 5267339 5267344 +
accccacctttgtccatccttc

SEQ ID NO: 91120 - DNA, 22 bp, Artificial Sequence
  Synthetic oligonucleotide; CTT chr11 5267332 5267353 5267349 5267354 +
tgtccatccttcaaattccaca

SEQ ID NO: 91121 - DNA, 22 bp, Artificial Sequence
  Synthetic oligonucleotide; TTT chr11 5267333 5267354 5267350 5267355 +
gtccatccttcaaattccacag

SEQ ID NO: 91122 - DNA, 22 bp, Artificial Sequence
  Synthetic oligonucleotide; TTG chr11 5267334 5267355 5267351 5267356 +
tccatccttcaaattccacaga

SEQ ID NO: 91123 - DNA, 22 bp, Artificial Sequence
  Synthetic oligonucleotide; CTT chr11 5267343 5267364 5267360 5267365 +
caaattccacagactcactgct

SEQ ID NO: 91124 - DNA, 22 bp, Artificial Sequence
  Synthetic oligonucleotide; TTC chr11 5267344 5267365 5267361 5267366 +
aaattccacagactcactgctc

SEQ ID NO: 91125 - DNA, 22 bp, Artificial Sequence
  Synthetic oligonucleotide; TTC chr11 5267350 5267371 5267367 5267372 +
cacagactcactgctcctcttg

SEQ ID NO: 91126 - DNA, 22 bp, Artificial Sequence
  Synthetic oligonucleotide; CTC chr11 5267359 5267380 5267376 5267381 +
actgctcctcttgggtttgaac

SEQ ID NO: 91127 - DNA, 22 bp, Artificial Sequence
  Synthetic oligonucleotide; CTG chr11 5267363 5267384 5267380 5267385 +
ctcctcttgggtttgaaccatt

SEQ ID NO: 91128 - DNA, 22 bp, Artificial Sequence
  Synthetic oligonucleotide; CTC chr11 5267366 5267387 5267383 5267388 +
ctcttgggtttgaaccattgta

SEQ ID NO: 91129 - DNA, 22 bp, Artificial Sequence
  Synthetic oligonucleotide; CTC chr11 5267369 5267390 5267386 5267391 +
ttgggtttgaaccattgtatct

SEQ ID NO: 91130 - DNA, 22 bp, Artificial Sequence
  Synthetic oligonucleotide; CTT chr11 5267371 5267392 5267388 5267393 +
gggtttgaaccattgtatctgt

SEQ ID NO: 91131 - DNA, 22 bp, Artificial Sequence
  Synthetic oligonucleotide; TTG chr11 5267372 5267393 5267389 5267394 +
ggtttgaaccattgtatctgtc

SEQ ID NO: 91132 - DNA, 22 bp, Artificial Sequence
  Synthetic oligonucleotide; TTT chr11 5267377 5267398 5267394 5267399 +
gaaccattgtatctgtcccctt

SEQ ID NO: 91133 - DNA, 22 bp, Artificial Sequence
  Synthetic oligonucleotide; TTG chr11 5267378 5267399 5267395 5267400 +
aaccattgtatctgtccccttg

SEQ ID NO: 91134 - DNA, 22 bp, Artificial Sequence
  Synthetic oligonucleotide; TTG chr11 5267386 5267407 5267403 5267408 +
tatctgtccccttgaatcatca

SEQ ID NO: 91135 - DNA, 22 bp, Artificial Sequence
  Synthetic oligonucleotide; CTG chr11 5267392 5267413 5267409 5267414 +
tccccttgaatcatcatccata

SEQ ID NO: 91136 - DNA, 22 bp, Artificial Sequence
  Synthetic oligonucleotide; CTT chr11 5267399 5267420 5267416 5267421 +
gaatcatcatccatattttatt

SEQ ID NO: 91137 - DNA, 22 bp, Artificial Sequence
  Synthetic oligonucleotide; TTG chr11 5267400 5267421 5267417 5267422 +
aatcatcatccatattttattt

SEQ ID NO: 91138 - DNA, 22 bp, Artificial Sequence
  Synthetic oligonucleotide; TTT chr11 5267417 5267438 5267434 5267439 +
tattttatctgcaaacttgaat

SEQ ID NO: 91139 - DNA, 22 bp, Artificial Sequence
  Synthetic oligonucleotide; TTT chr11 5267418 5267439 5267435 5267440 +
attttatctgcaaacttgaatc

SEQ ID NO: 91140 - DNA, 22 bp, Artificial Sequence
  Synthetic oligonucleotide; TTA chr11 5267419 5267440 5267436 5267441 +
ttttatctgcaaacttgaatcc

SEQ ID NO: 91141 - DNA, 22 bp, Artificial Sequence
  Synthetic oligonucleotide; TTT chr11 5267422 5267443 5267439 5267444 +
tatctgcaaacttgaatccatt

SEQ ID NO: 91142 - DNA, 22 bp, Artificial Sequence
  Synthetic oligonucleotide; TTT chr11 5267423 5267444 5267440 5267445 +
atctgcaaacttgaatccattt

SEQ ID NO: 91143 - DNA, 22 bp, Artificial Sequence
  Synthetic oligonucleotide; TTA chr11 5267424 5267445 5267441 5267446 +
tctgcaaacttgaatccatttt

SEQ ID NO: 91144 - DNA, 22 bp, Artificial Sequence
  Synthetic oligonucleotide; CTG chr11 5267428 5267449 5267445 5267450 +
caaacttgaatccattttgtgc

SEQ ID NO: 91145 - DNA, 22 bp, Artificial Sequence
  Synthetic oligonucleotide; CTT chr11 5267435 5267456 5267452 5267457 +
gaatccattttgtgcacataag

SEQ ID NO: 91146 - DNA, 22 bp, Artificial Sequence
  Synthetic oligonucleotide; TTG chr11 5267436 5267457 5267453 5267458 +
aatccattttgtgcacataagc

SEQ ID NO: 91147 - DNA, 22 bp, Artificial Sequence
  Synthetic oligonucleotide; TTT chr11 5267445 5267466 5267462 5267467 +
tgtgcacataagcagattactt

SEQ ID NO: 91148 - DNA, 22 bp, Artificial Sequence
  Synthetic oligonucleotide; TTT chr11 5267446 5267467 5267463 5267468 +
gtgcacataagcagattacttt

SEQ ID NO: 91149 - DNA, 22 bp, Artificial Sequence
  Synthetic oligonucleotide; TTG chr11 5267447 5267468 5267464 5267469 +
tgcacataagcagattactttt

SEQ ID NO: 91150 - DNA, 22 bp, Artificial Sequence
  Synthetic oligonucleotide; TTA chr11 5267464 5267485 5267481 5267486 +
ctttttcccaaaatcttatttc

SEQ ID NO: 91151 - DNA, 22 bp, Artificial Sequence
  Synthetic oligonucleotide; CTT chr11 5267467 5267488 5267484 5267489 +
tttcccaaaatcttatttcctg

SEQ ID NO: 91152 - DNA, 22 bp, Artificial Sequence
  Synthetic oligonucleotide; TTT chr11 5267468 5267489 5267485 5267490 +
ttcccaaaatcttatttcctga

SEQ ID NO: 91153 - DNA, 22 bp, Artificial Sequence
  Synthetic oligonucleotide; TTT chr11 5267469 5267490 5267486 5267491 +
tcccaaaatcttatttcctgag

SEQ ID NO: 91154 - DNA, 22 bp, Artificial Sequence
  Synthetic oligonucleotide; TTT chr11 5267470 5267491 5267487 5267492 +
cccaaaatcttatttcctgagt

SEQ ID NO: 91155 - DNA, 22 bp, Artificial Sequence
  Synthetic oligonucleotide; TTC chr11 5267471 5267492 5267488 5267493 +
ccaaaatcttatttcctgagtc

SEQ ID NO: 91156 - DNA, 22 bp, Artificial Sequence
  Synthetic oligonucleotide; CTT chr11 5267481 5267502 5267498 5267503 +
atttcctgagtcacttaacatc

SEQ ID NO: 91157 - DNA, 22 bp, Artificial Sequence
  Synthetic oligonucleotide; TTA chr11 5267482 5267503 5267499 5267504 +
tttcctgagtcacttaacatcc

SEQ ID NO: 91158 - DNA, 22 bp, Artificial Sequence
  Synthetic oligonucleotide; TTT chr11 5267485 5267506 5267502 5267507 +
cctgagtcacttaacatcctaa

SEQ ID NO: 91159 - DNA, 22 bp, Artificial Sequence
  Synthetic oligonucleotide; TTC chr11 5267486 5267507 5267503 5267508 +
ctgagtcacttaacatcctaat

SEQ ID NO: 91160 - DNA, 22 bp, Artificial Sequence
  Synthetic oligonucleotide; CTG chr11 5267489 5267510 5267506 5267511 +
agtcacttaacatcctaatgct

SEQ ID NO: 91161 - DNA, 22 bp, Artificial Sequence
  Synthetic oligonucleotide; CTT chr11 5267497 5267518 5267514 5267519 +
aacatcctaatgcttatcgttt

SEQ ID NO: 91162 - DNA, 22 bp, Artificial Sequence
  Synthetic oligonucleotide; TTA chr11 5267498 5267519 5267515 5267520 +
acatcctaatgcttatcgttta

SEQ ID NO: 91163 - DNA, 22 bp, Artificial Sequence
  Synthetic oligonucleotide; CTA chr11 5267506 5267527 5267523 5267528 +
atgcttatcgtttagtattgca

SEQ ID NO: 91164 - DNA, 22 bp, Artificial Sequence
  Synthetic oligonucleotide; CTT chr11 5267512 5267533 5267529 5267534 +
atcgtttagtattgcaatagca

SEQ ID NO: 91165 - DNA, 22 bp, Artificial Sequence
  Synthetic oligonucleotide; TTA chr11 5267513 5267534 5267530 5267535 +
tcgtttagtattgcaatagcat

SEQ ID NO: 91166 - DNA, 22 bp, Artificial Sequence
  Synthetic oligonucleotide; TTT chr11 5267519 5267540 5267536 5267541 +
agtattgcaatagcatagtaaa

SEQ ID NO: 91167 - DNA, 22 bp, Artificial Sequence
  Synthetic oligonucleotide; TTA chr11 5267520 5267541 5267537 5267542 +
gtattgcaatagcatagtaaaa

SEQ ID NO: 91168 - DNA, 22 bp, Artificial Sequence
  Synthetic oligonucleotide; TTG chr11 5267526 5267547 5267543 5267548 +
caatagcatagtaaaagcttgt

SEQ ID NO: 91169 - DNA, 22 bp, Artificial Sequence
  Synthetic oligonucleotide; CTT chr11 5267546 5267567 5267563 5267568 +
gtatttttgtagccaggccctg

SEQ ID NO: 91170 - DNA, 22 bp, Artificial Sequence
  Synthetic oligonucleotide; TTG chr11 5267547 5267568 5267564 5267569 +
tatttttgtagccaggccctgt

SEQ ID NO: 91171 - DNA, 22 bp, Artificial Sequence
  Synthetic oligonucleotide; TTT chr11 5267552 5267573 5267569 5267574 +
ttgtagccaggccctgtactat

SEQ ID NO: 91172 - DNA, 22 bp, Artificial Sequence
  Synthetic oligonucleotide; TTT chr11 5267553 5267574 5267570 5267575 +
tgtagccaggccctgtactatc

SEQ ID NO: 91173 - DNA, 22 bp, Artificial Sequence
  Synthetic oligonucleotide; TTT chr11 5267554 5267575 5267571 5267576 +
gtagccaggccctgtactatct

SEQ ID NO: 91174 - DNA, 22 bp, Artificial Sequence
  Synthetic oligonucleotide; TTG chr11 5267555 5267576 5267572 5267577 +
tagccaggccctgtactatctg

SEQ ID NO: 91175 - DNA, 22 bp, Artificial Sequence
  Synthetic oligonucleotide; CTG chr11 5267568 5267589 5267585 5267590 +
tactatctggtctttcctagtc

SEQ ID NO: 91176 - DNA, 22 bp, Artificial Sequence
  Synthetic oligonucleotide; CTA chr11 5267573 5267594 5267590 5267595 +
tctggtctttcctagtcctcta

SEQ ID NO: 91177 - DNA, 22 bp, Artificial Sequence
  Synthetic oligonucleotide; CTG chr11 5267577 5267598 5267594 5267599 +
gtctttcctagtcctctacgta

SEQ ID NO: 91178 - DNA, 22 bp, Artificial Sequence
  Synthetic oligonucleotide; CTT chr11 5267582 5267603 5267599 5267604 +
tcctagtcctctacgtatgtct

SEQ ID NO: 91179 - DNA, 22 bp, Artificial Sequence
  Synthetic oligonucleotide; TTT chr11 5267583 5267604 5267600 5267605 +
cctagtcctctacgtatgtctt

SEQ ID NO: 91180 - DNA, 22 bp, Artificial Sequence
  Synthetic oligonucleotide; TTC chr11 5267584 5267605 5267601 5267606 +
ctagtcctctacgtatgtctta

SEQ ID NO: 91181 - DNA, 22 bp, Artificial Sequence
  Synthetic oligonucleotide; CTA chr11 5267587 5267608 5267604 5267609 +
gtcctctacgtatgtcttactc

SEQ ID NO: 91182 - DNA, 22 bp, Artificial Sequence
  Synthetic oligonucleotide; CTC chr11 5267593 5267614 5267610 5267615 +
tacgtatgtcttactctccctt

SEQ ID NO: 91183 - DNA, 22 bp, Artificial Sequence
  Synthetic oligonucleotide; CTA chr11 5267595 5267616 5267612 5267617 +
cgtatgtcttactctcccttct

SEQ ID NO: 91184 - DNA, 22 bp, Artificial Sequence
  Synthetic oligonucleotide; CTT chr11 5267605 5267626 5267622 5267627 +
actctcccttctacttccagag

SEQ ID NO: 91185 - DNA, 22 bp, Artificial Sequence
  Synthetic oligonucleotide; TTA chr11 5267606 5267627 5267623 5267628 +
ctctcccttctacttccagaga

SEQ ID NO: 91186 - DNA, 22 bp, Artificial Sequence
  Synthetic oligonucleotide; CTC chr11 5267609 5267630 5267626 5267631 +
tcccttctacttccagagagcc

SEQ ID NO: 91187 - DNA, 22 bp, Artificial Sequence
  Synthetic oligonucleotide; CTC chr11 5267611 5267632 5267628 5267633 +
ccttctacttccagagagccag

SEQ ID NO: 91188 - DNA, 22 bp, Artificial Sequence
  Synthetic oligonucleotide; CTT chr11 5267615 5267636 5267632 5267637 +
ctacttccagagagccagtttc

SEQ ID NO: 91189 - DNA, 22 bp, Artificial Sequence
  Synthetic oligonucleotide; TTC chr11 5267616 5267637 5267633 5267638 +
tacttccagagagccagtttca

SEQ ID NO: 91190 - DNA, 22 bp, Artificial Sequence
  Synthetic oligonucleotide; CTA chr11 5267618 5267639 5267635 5267640 +
cttccagagagccagtttcatg

SEQ ID NO: 91191 - DNA, 22 bp, Artificial Sequence
  Synthetic oligonucleotide; CTT chr11 5267621 5267642 5267638 5267643 +
ccagagagccagtttcatgcaa

SEQ ID NO: 91192 - DNA, 22 bp, Artificial Sequence
  Synthetic oligonucleotide; TTC chr11 5267622 5267643 5267639 5267644 +
cagagagccagtttcatgcaag

SEQ ID NO: 91193 - DNA, 22 bp, Artificial Sequence
  Synthetic oligonucleotide; TTT chr11 5267636 5267657 5267653 5267658 +
catgcaagtcacgaagccctag

SEQ ID NO: 91194 - DNA, 22 bp, Artificial Sequence
  Synthetic oligonucleotide; TTC chr11 5267637 5267658 5267654 5267659 +
atgcaagtcacgaagccctagc

SEQ ID NO: 91195 - DNA, 22 bp, Artificial Sequence
  Synthetic oligonucleotide; CTA chr11 5267657 5267678 5267674 5267679 +
gcttgctggttttagaatttaa

SEQ ID NO: 91196 - DNA, 22 bp, Artificial Sequence
  Synthetic oligonucleotide; CTT chr11 5267661 5267682 5267678 5267683 +
gctggttttagaatttaagcct

SEQ ID NO: 91197 - DNA, 22 bp, Artificial Sequence
  Synthetic oligonucleotide; TTG chr11 5267662 5267683 5267679 5267684 +
ctggttttagaatttaagcctt

SEQ ID NO: 91198 - DNA, 22 bp, Artificial Sequence
  Synthetic oligonucleotide; CTG chr11 5267665 5267686 5267682 5267687 +
gttttagaatttaagcctttat

SEQ ID NO: 91199 - DNA, 22 bp, Artificial Sequence
  Synthetic oligonucleotide; TTT chr11 5267669 5267690 5267686 5267691 +
tagaatttaagcctttattagt

SEQ ID NO: 91200 - DNA, 22 bp, Artificial Sequence
  Synthetic oligonucleotide; TTT chr11 5267670 5267691 5267687 5267692 +
agaatttaagcctttattagta

SEQ ID NO: 91201 - DNA, 22 bp, Artificial Sequence
  Synthetic oligonucleotide; TTA chr11 5267671 5267692 5267688 5267693 +
gaatttaagcctttattagtat

SEQ ID NO: 91202 - DNA, 22 bp, Artificial Sequence
  Synthetic oligonucleotide; TTT chr11 5267677 5267698 5267694 5267699 +
aagcctttattagtattctatc

SEQ ID NO: 91203 - DNA, 22 bp, Artificial Sequence
  Synthetic oligonucleotide; TTA chr11 5267678 5267699 5267695 5267700 +
agcctttattagtattctatct

SEQ ID NO: 91204 - DNA, 22 bp, Artificial Sequence
  Synthetic oligonucleotide; CTT chr11 5267684 5267705 5267701 5267706 +
tattagtattctatctcccacg

SEQ ID NO: 91205 - DNA, 22 bp, Artificial Sequence
  Synthetic oligonucleotide; TTT chr11 5267685 5267706 5267702 5267707 +
attagtattctatctcccacgg

SEQ ID NO: 91206 - DNA, 22 bp, Artificial Sequence
  Synthetic oligonucleotide; TTA chr11 5267686 5267707 5267703 5267708 +
ttagtattctatctcccacgga

SEQ ID NO: 91207 - DNA, 22 bp, Artificial Sequence
  Synthetic oligonucleotide; TTA chr11 5267689 5267710 5267706 5267711 +
gtattctatctcccacggaaag

SEQ ID NO: 91208 - DNA, 22 bp, Artificial Sequence
  Synthetic oligonucleotide; TTC chr11 5267695 5267716 5267712 5267717 +
tatctcccacggaaagtcttca

SEQ ID NO: 91209 - DNA, 22 bp, Artificial Sequence
  Synthetic oligonucleotide; CTA chr11 5267697 5267718 5267714 5267719 +
tctcccacggaaagtcttcatc

SEQ ID NO: 91210 - DNA, 22 bp, Artificial Sequence
  Synthetic oligonucleotide; CTC chr11 5267701 5267722 5267718 5267723 +
ccacggaaagtcttcatcacac

SEQ ID NO: 91211 - DNA, 22 bp, Artificial Sequence
  Synthetic oligonucleotide; CTT chr11 5267715 5267736 5267732 5267737 +
catcacactctccaaaaacttt

SEQ ID NO: 91212 - DNA, 22 bp, Artificial Sequence
  Synthetic oligonucleotide; TTC chr11 5267716 5267737 5267733 5267738 +
atcacactctccaaaaactttc

SEQ ID NO: 91213 - DNA, 22 bp, Artificial Sequence
  Synthetic oligonucleotide; CTC chr11 5267725 5267746 5267742 5267747 +
tccaaaaactttcccactcagg

SEQ ID NO: 91214 - DNA, 22 bp, Artificial Sequence
  Synthetic oligonucleotide; CTC chr11 5267727 5267748 5267744 5267749 +
caaaaactttcccactcaggtc

SEQ ID NO: 91215 - DNA, 22 bp, Artificial Sequence
  Synthetic oligonucleotide; CTT chr11 5267736 5267757 5267753 5267758 +
tcccactcaggtcctaactcta

SEQ ID NO: 91216 - DNA, 22 bp, Artificial Sequence
  Synthetic oligonucleotide; TTT chr11 5267737 5267758 5267754 5267759 +
cccactcaggtcctaactctaa

SEQ ID NO: 91217 - DNA, 22 bp, Artificial Sequence
  Synthetic oligonucleotide; TTC chr11 5267738 5267759 5267755 5267760 +
ccactcaggtcctaactctaac

SEQ ID NO: 91218 - DNA, 22 bp, Artificial Sequence
  Synthetic oligonucleotide; CTC chr11 5267744 5267765 5267761 5267766 +
aggtcctaactctaactttatt

SEQ ID NO: 91219 - DNA, 22 bp, Artificial Sequence
  Synthetic oligonucleotide; CTA chr11 5267752 5267773 5267769 5267774 +
actctaactttattttagtgca

SEQ ID NO: 91220 - DNA, 22 bp, Artificial Sequence
  Synthetic oligonucleotide; CTC chr11 5267756 5267777 5267773 5267778 +
taactttattttagtgcatgtt

SEQ ID NO: 91221 - DNA, 22 bp, Artificial Sequence
  Synthetic oligonucleotide; CTA chr11 5267758 5267779 5267775 5267780 +
actttattttagtgcatgttac

SEQ ID NO: 91222 - DNA, 22 bp, Artificial Sequence
  Synthetic oligonucleotide; CTT chr11 5267762 5267783 5267779 5267784 +
tattttagtgcatgttacattc

SEQ ID NO: 91223 - DNA, 22 bp, Artificial Sequence
  Synthetic oligonucleotide; TTT chr11 5267763 5267784 5267780 5267785 +
attttagtgcatgttacattct

SEQ ID NO: 91224 - DNA, 22 bp, Artificial Sequence
  Synthetic oligonucleotide; TTA chr11 5267764 5267785 5267781 5267786 +
ttttagtgcatgttacattcta

SEQ ID NO: 91225 - DNA, 22 bp, Artificial Sequence
  Synthetic oligonucleotide; TTT chr11 5267767 5267788 5267784 5267789 +
tagtgcatgttacattctatca

SEQ ID NO: 91226 - DNA, 22 bp, Artificial Sequence
  Synthetic oligonucleotide; TTT chr11 5267768 5267789 5267785 5267790 +
agtgcatgttacattctatcag

SEQ ID NO: 91227 - DNA, 22 bp, Artificial Sequence
  Synthetic oligonucleotide; TTA chr11 5267769 5267790 5267786 5267791 +
gtgcatgttacattctatcaga

SEQ ID NO: 91228 - DNA, 22 bp, Artificial Sequence
  Synthetic oligonucleotide; TTA chr11 5267779 5267800 5267796 5267801 +
cattctatcagaagataatgca

SEQ ID NO: 91229 - DNA, 22 bp, Artificial Sequence
  Synthetic oligonucleotide; TTC chr11 5267784 5267805 5267801 5267806 +
tatcagaagataatgcacaatg

SEQ ID NO: 91230 - DNA, 22 bp, Artificial Sequence
  Synthetic oligonucleotide; CTA chr11 5267786 5267807 5267803 5267808 +
tcagaagataatgcacaatgat

SEQ ID NO: 91231 - DNA, 22 bp, Artificial Sequence
  Synthetic oligonucleotide; CTT chr11 5267820 5267841 5267837 5267842 +
agcttcagctaacccatgaaat

SEQ ID NO: 91232 - DNA, 22 bp, Artificial Sequence
  Synthetic oligonucleotide; TTA chr11 5267821 5267842 5267838 5267843 +
gcttcagctaacccatgaaata

SEQ ID NO: 91233 - DNA, 22 bp, Artificial Sequence
  Synthetic oligonucleotide; CTT chr11 5267825 5267846 5267842 5267847 +
cagctaacccatgaaataatgg

SEQ ID NO: 91234 - DNA, 22 bp, Artificial Sequence
  Synthetic oligonucleotide; TTC chr11 5267826 5267847 5267843 5267848 +
agctaacccatgaaataatgga

SEQ ID NO: 91235 - DNA, 22 bp, Artificial Sequence
  Synthetic oligonucleotide; CTA chr11 5267831 5267852 5267848 5267853 +
acccatgaaataatggaatcct

SEQ ID NO: 91236 - DNA, 22 bp, Artificial Sequence
  Synthetic oligonucleotide; CTT chr11 5267854 5267875 5267871 5267876 +
catggaaagagcaggctattgt

SEQ ID NO: 91237 - DNA, 22 bp, Artificial Sequence
  Synthetic oligonucleotide; TTC chr11 5267855 5267876 5267872 5267877 +
atggaaagagcaggctattgtt

SEQ ID NO: 91238 - DNA, 22 bp, Artificial Sequence
  Synthetic oligonucleotide; CTA chr11 5267872 5267893 5267889 5267894 +
ttgttgatacacactcatctta

SEQ ID NO: 91239 - DNA, 22 bp, Artificial Sequence
  Synthetic oligonucleotide; TTG chr11 5267875 5267896 5267892 5267897 +
ttgatacacactcatcttatct

SEQ ID NO: 91240 - DNA, 22 bp, Artificial Sequence
  Synthetic oligonucleotide; TTG chr11 5267878 5267899 5267895 5267900 +
atacacactcatcttatctcca

SEQ ID NO: 91241 - DNA, 22 bp, Artificial Sequence
  Synthetic oligonucleotide; CTC chr11 5267888 5267909 5267905 5267910 +
atcttatctccaaatcaatttc

SEQ ID NO: 91242 - DNA, 22 bp, Artificial Sequence
  Synthetic oligonucleotide; CTT chr11 5267893 5267914 5267910 5267915 +
atctccaaatcaatttcataaa

SEQ ID NO: 91243 - DNA, 22 bp, Artificial Sequence
  Synthetic oligonucleotide; TTA chr11 5267894 5267915 5267911 5267916 +
tctccaaatcaatttcataaaa

SEQ ID NO: 91244 - DNA, 22 bp, Artificial Sequence
  Synthetic oligonucleotide; CTC chr11 5267898 5267919 5267915 5267920 +
caaatcaatttcataaaacatg

SEQ ID NO: 91245 - DNA, 22 bp, Artificial Sequence
  Synthetic oligonucleotide; TTT chr11 5267909 5267930 5267926 5267931 +
cataaaacatgtgacaagctag

SEQ ID NO: 91246 - DNA, 22 bp, Artificial Sequence
  Synthetic oligonucleotide; TTC chr11 5267910 5267931 5267927 5267932 +
ataaaacatgtgacaagctagc

SEQ ID NO: 91247 - DNA, 22 bp, Artificial Sequence
  Synthetic oligonucleotide; CTA chr11 5267930 5267951 5267947 5267952 +
gctacttcaaaatgtaaataag

SEQ ID NO: 91248 - DNA, 22 bp, Artificial Sequence
  Synthetic oligonucleotide; CTA chr11 5267934 5267955 5267951 5267956 +
cttcaaaatgtaaataagagta

SEQ ID NO: 91249 - DNA, 22 bp, Artificial Sequence
  Synthetic oligonucleotide; CTT chr11 5267937 5267958 5267954 5267959 +
caaaatgtaaataagagtaaat

SEQ ID NO: 91250 - DNA, 22 bp, Artificial Sequence
  Synthetic oligonucleotide; TTC chr11 5267938 5267959 5267955 5267960 +
aaaatgtaaataagagtaaatt

SEQ ID NO: 91251 - DNA, 22 bp, Artificial Sequence
  Synthetic oligonucleotide; TTA chr11 5267961 5267982 5267978 5267983 +
aaatagtaattctagcctatat

SEQ ID NO: 91252 - DNA, 22 bp, Artificial Sequence
  Synthetic oligonucleotide; TTC chr11 5267973 5267994 5267990 5267995 +
tagcctatatcttggatatcta

SEQ ID NO: 91253 - DNA, 22 bp, Artificial Sequence
  Synthetic oligonucleotide; CTA chr11 5267975 5267996 5267992 5267997 +
gcctatatcttggatatctatg

SEQ ID NO: 91254 - DNA, 22 bp, Artificial Sequence
  Synthetic oligonucleotide; CTA chr11 5267980 5268001 5267997 5268002 +
tatcttggatatctatgaagtt

SEQ ID NO: 91255 - DNA, 22 bp, Artificial Sequence
  Synthetic oligonucleotide; CTT chr11 5267986 5268007 5268003 5268008 +
ggatatctatgaagttttgttt

SEQ ID NO: 91256 - DNA, 22 bp, Artificial Sequence
  Synthetic oligonucleotide; TTG chr11 5267987 5268008 5268004 5268009 +
gatatctatgaagttttgtttt

SEQ ID NO: 91257 - DNA, 22 bp, Artificial Sequence
  Synthetic oligonucleotide; CTA chr11 5267995 5268016 5268012 5268017 +
tgaagttttgttttgttttgtt

SEQ ID NO: 91258 - DNA, 22 bp, Artificial Sequence
  Synthetic oligonucleotide; TTT chr11 5268003 5268024 5268020 5268025 +
tgttttgttttgtttttgtttt

SEQ ID NO: 91259 - DNA, 22 bp, Artificial Sequence
  Synthetic oligonucleotide; TTT chr11 5268004 5268025 5268021 5268026 +
gttttgttttgtttttgttttt

SEQ ID NO: 91260 - DNA, 22 bp, Artificial Sequence
  Synthetic oligonucleotide; TTG chr11 5268005 5268026 5268022 5268027 +
ttttgttttgtttttgttttta

SEQ ID NO: 91261 - DNA, 22 bp, Artificial Sequence
  Synthetic oligonucleotide; TTT chr11 5268008 5268029 5268025 5268030 +
tgttttgtttttgtttttaatg

SEQ ID NO: 91262 - DNA, 22 bp, Artificial Sequence
  Synthetic oligonucleotide; TTT chr11 5268009 5268030 5268026 5268031 +
gttttgtttttgtttttaatga

SEQ ID NO: 91263 - DNA, 22 bp, Artificial Sequence
  Synthetic oligonucleotide; TTG chr11 5268010 5268031 5268027 5268032 +
ttttgtttttgtttttaatgaa

SEQ ID NO: 91264 - DNA, 22 bp, Artificial Sequence
  Synthetic oligonucleotide; TTT chr11 5268013 5268034 5268030 5268035 +
tgtttttgtttttaatgaaaag

SEQ ID NO: 91265 - DNA, 22 bp, Artificial Sequence
  Synthetic oligonucleotide; TTT chr11 5268014 5268035 5268031 5268036 +
gtttttgtttttaatgaaaagt

SEQ ID NO: 91266 - DNA, 22 bp, Artificial Sequence
  Synthetic oligonucleotide; TTG chr11 5268015 5268036 5268032 5268037 +
tttttgtttttaatgaaaagtg

SEQ ID NO: 91267 - DNA, 22 bp, Artificial Sequence
  Synthetic oligonucleotide; TTT chr11 5268018 5268039 5268035 5268040 +
ttgtttttaatgaaaagtgaca

SEQ ID NO: 91268 - DNA, 22 bp, Artificial Sequence
  Synthetic oligonucleotide; TTT chr11 5268019 5268040 5268036 5268041 +
tgtttttaatgaaaagtgacat

SEQ ID NO: 91269 - DNA, 22 bp, Artificial Sequence
  Synthetic oligonucleotide; TTT chr11 5268020 5268041 5268037 5268042 +
gtttttaatgaaaagtgacatg

SEQ ID NO: 91270 - DNA, 22 bp, Artificial Sequence
  Synthetic oligonucleotide; TTG chr11 5268021 5268042 5268038 5268043 +
tttttaatgaaaagtgacatgt

SEQ ID NO: 91271 - DNA, 22 bp, Artificial Sequence
  Synthetic oligonucleotide; TTT chr11 5268024 5268045 5268041 5268046 +
ttaatgaaaagtgacatgtacc

SEQ ID NO: 91272 - DNA, 22 bp, Artificial Sequence
  Synthetic oligonucleotide; TTT chr11 5268025 5268046 5268042 5268047 +
taatgaaaagtgacatgtacca

SEQ ID NO: 91273 - DNA, 22 bp, Artificial Sequence
  Synthetic oligonucleotide; TTT chr11 5268026 5268047 5268043 5268048 +
aatgaaaagtgacatgtaccac

SEQ ID NO: 91274 - DNA, 22 bp, Artificial Sequence
  Synthetic oligonucleotide; TTA chr11 5268027 5268048 5268044 5268049 +
atgaaaagtgacatgtaccaca

SEQ ID NO: 91275 - DNA, 22 bp, Artificial Sequence
  Synthetic oligonucleotide; CTG chr11 5268055 5268076 5268072 5268077 +
ctttctcaggtaccactaacag

SEQ ID NO: 91276 - DNA, 22 bp, Artificial Sequence
  Synthetic oligonucleotide; CTT chr11 5268058 5268079 5268075 5268080 +
tctcaggtaccactaacagctc

SEQ ID NO: 91277 - DNA, 22 bp, Artificial Sequence
  Synthetic oligonucleotide; TTT chr11 5268059 5268080 5268076 5268081 +
ctcaggtaccactaacagctcc

SEQ ID NO: 91278 - DNA, 22 bp, Artificial Sequence
  Synthetic oligonucleotide; TTC chr11 5268060 5268081 5268077 5268082 +
tcaggtaccactaacagctcct

SEQ ID NO: 91279 - DNA, 22 bp, Artificial Sequence
  Synthetic oligonucleotide; CTC chr11 5268062 5268083 5268079 5268084 +
aggtaccactaacagctccttc

SEQ ID NO: 91280 - DNA, 22 bp, Artificial Sequence
  Synthetic oligonucleotide; CTA chr11 5268073 5268094 5268090 5268095 +
acagctccttctttccccggtg

SEQ ID NO: 91281 - DNA, 22 bp, Artificial Sequence
  Synthetic oligonucleotide; CTC chr11 5268080 5268101 5268097 5268102 +
cttctttccccggtgcagtaaa

SEQ ID NO: 91282 - DNA, 22 bp, Artificial Sequence
  Synthetic oligonucleotide; CTT chr11 5268083 5268104 5268100 5268105 +
ctttccccggtgcagtaaaaac

SEQ ID NO: 91283 - DNA, 22 bp, Artificial Sequence
  Synthetic oligonucleotide; TTC chr11 5268084 5268105 5268101 5268106 +
tttccccggtgcagtaaaaact

SEQ ID NO: 91284 - DNA, 22 bp, Artificial Sequence
  Synthetic oligonucleotide; CTT chr11 5268086 5268107 5268103 5268108 +
tccccggtgcagtaaaaactgc

SEQ ID NO: 91285 - DNA, 22 bp, Artificial Sequence
  Synthetic oligonucleotide; TTT chr11 5268087 5268108 5268104 5268109 +
ccccggtgcagtaaaaactgcc

SEQ ID NO: 91286 - DNA, 22 bp, Artificial Sequence
  Synthetic oligonucleotide; TTC chr11 5268088 5268109 5268105 5268110 +
cccggtgcagtaaaaactgcct

SEQ ID NO: 91287 - DNA, 22 bp, Artificial Sequence
  Synthetic oligonucleotide; CTG chr11 5268107 5268128 5268124 5268129 +
cctaggagtctctgtccactta

SEQ ID NO: 91288 - DNA, 22 bp, Artificial Sequence
  Synthetic oligonucleotide; CTA chr11 5268111 5268132 5268128 5268133 +
ggagtctctgtccacttaatta

SEQ ID NO: 91289 - DNA, 22 bp, Artificial Sequence
  Synthetic oligonucleotide; CTC chr11 5268119 5268140 5268136 5268141 +
tgtccacttaattaaccatttt

SEQ ID NO: 91290 - DNA, 22 bp, Artificial Sequence
  Synthetic oligonucleotide; CTG chr11 5268121 5268142 5268138 5268143 +
tccacttaattaaccattttcc

SEQ ID NO: 91291 - DNA, 22 bp, Artificial Sequence
  Synthetic oligonucleotide; CTT chr11 5268128 5268149 5268145 5268150 +
aattaaccattttcccaccccg

SEQ ID NO: 91292 - DNA, 22 bp, Artificial Sequence
  Synthetic oligonucleotide; TTA chr11 5268129 5268150 5268146 5268151 +
attaaccattttcccaccccga

SEQ ID NO: 91293 - DNA, 22 bp, Artificial Sequence
  Synthetic oligonucleotide; TTA chr11 5268133 5268154 5268150 5268155 +
accattttcccaccccgataaa

SEQ ID NO: 91294 - DNA, 22 bp, Artificial Sequence
  Synthetic oligonucleotide; TTT chr11 5268140 5268161 5268157 5268162 +
tcccaccccgataaagattttt

SEQ ID NO: 91295 - DNA, 22 bp, Artificial Sequence
  Synthetic oligonucleotide; TTT chr11 5268141 5268162 5268158 5268163 +
cccaccccgataaagatttttc

SEQ ID NO: 91296 - DNA, 22 bp, Artificial Sequence
  Synthetic oligonucleotide; TTC chr11 5268142 5268163 5268159 5268164 +
ccaccccgataaagatttttct

SEQ ID NO: 91297 - DNA, 22 bp, Artificial Sequence
  Synthetic oligonucleotide; TTT chr11 5268160 5268181 5268177 5268182 +
ttctccatcatatcatcctcct

SEQ ID NO: 91298 - DNA, 22 bp, Artificial Sequence
  Synthetic oligonucleotide; TTT chr11 5268161 5268182 5268178 5268183 +
tctccatcatatcatcctcctt

SEQ ID NO: 91299 - DNA, 22 bp, Artificial Sequence
  Synthetic oligonucleotide; TTT chr11 5268162 5268183 5268179 5268184 +
ctccatcatatcatcctccttg

SEQ ID NO: 91300 - DNA, 22 bp, Artificial Sequence
  Synthetic oligonucleotide; TTC chr11 5268163 5268184 5268180 5268185 +
tccatcatatcatcctccttgg

SEQ ID NO: 91301 - DNA, 22 bp, Artificial Sequence
  Synthetic oligonucleotide; CTC chr11 5268165 5268186 5268182 5268187 +
catcatatcatcctccttggaa

SEQ ID NO: 91302 - DNA, 22 bp, Artificial Sequence
  Synthetic oligonucleotide; CTC chr11 5268180 5268201 5268197 5268202 +
cttggaatcctggaattctccc

SEQ ID NO: 91303 - DNA, 22 bp, Artificial Sequence
  Synthetic oligonucleotide; CTT chr11 5268183 5268204 5268200 5268205 +
ggaatcctggaattctcccata

SEQ ID NO: 91304 - DNA, 22 bp, Artificial Sequence
  Synthetic oligonucleotide; TTG chr11 5268184 5268205 5268201 5268206 +
gaatcctggaattctcccataa

SEQ ID NO: 91305 - DNA, 22 bp, Artificial Sequence
  Synthetic oligonucleotide; CTG chr11 5268192 5268213 5268209 5268214 +
gaattctcccataacatccaca

SEQ ID NO: 91306 - DNA, 22 bp, Artificial Sequence
  Synthetic oligonucleotide; TTC chr11 5268198 5268219 5268215 5268220 +
tcccataacatccacattaatt

SEQ ID NO: 91307 - DNA, 22 bp, Artificial Sequence
  Synthetic oligonucleotide; CTC chr11 5268200 5268221 5268217 5268222 +
ccataacatccacattaatttt

SEQ ID NO: 91308 - DNA, 22 bp, Artificial Sequence
  Synthetic oligonucleotide; TTA chr11 5268217 5268238 5268234 5268239 +
attttacaagcccccatacatt

SEQ ID NO: 91309 - DNA, 22 bp, Artificial Sequence
  Synthetic oligonucleotide; TTT chr11 5268221 5268242 5268238 5268243 +
tacaagcccccatacatttctt

SEQ ID NO: 91310 - DNA, 22 bp, Artificial Sequence
  Synthetic oligonucleotide; TTT chr11 5268222 5268243 5268239 5268244 +
acaagcccccatacatttctta

SEQ ID NO: 91311 - DNA, 22 bp, Artificial Sequence
  Synthetic oligonucleotide; TTA chr11 5268223 5268244 5268240 5268245 +
caagcccccatacatttcttaa

SEQ ID NO: 91312 - DNA, 22 bp, Artificial Sequence
  Synthetic oligonucleotide; TTT chr11 5268240 5268261 5268257 5268262 +
cttaaggaagctcttggttctt

SEQ ID NO: 91313 - DNA, 22 bp, Artificial Sequence
  Synthetic oligonucleotide; TTC chr11 5268241 5268262 5268258 5268263 +
ttaaggaagctcttggttcttc

SEQ ID NO: 91314 - DNA, 22 bp, Artificial Sequence
  Synthetic oligonucleotide; CTT chr11 5268243 5268264 5268260 5268265 +
aaggaagctcttggttcttcct

SEQ ID NO: 91315 - DNA, 22 bp, Artificial Sequence
  Synthetic oligonucleotide; TTA chr11 5268244 5268265 5268261 5268266 +
aggaagctcttggttcttccta

SEQ ID NO: 91316 - DNA, 22 bp, Artificial Sequence
  Synthetic oligonucleotide; CTC chr11 5268253 5268274 5268270 5268275 +
ttggttcttcctatgtttctct

SEQ ID NO: 91317 - DNA, 22 bp, Artificial Sequence
  Synthetic oligonucleotide; CTT chr11 5268255 5268276 5268272 5268277 +
ggttcttcctatgtttctctcc

SEQ ID NO: 91318 - DNA, 22 bp, Artificial Sequence
  Synthetic oligonucleotide; TTG chr11 5268256 5268277 5268273 5268278 +
gttcttcctatgtttctctcca

SEQ ID NO: 91319 - DNA, 22 bp, Artificial Sequence
  Synthetic oligonucleotide; TTC chr11 5268260 5268281 5268277 5268282 +
ttcctatgtttctctccatccc

SEQ ID NO: 91320 - DNA, 22 bp, Artificial Sequence
  Synthetic oligonucleotide; CTT chr11 5268262 5268283 5268279 5268284 +
cctatgtttctctccatccctc

SEQ ID NO: 91321 - DNA, 22 bp, Artificial Sequence
  Synthetic oligonucleotide; TTC chr11 5268263 5268284 5268280 5268285 +
ctatgtttctctccatccctca

SEQ ID NO: 91322 - DNA, 22 bp, Artificial Sequence
  Synthetic oligonucleotide; CTA chr11 5268266 5268287 5268283 5268288 +
tgtttctctccatccctcagcc

SEQ ID NO: 91323 - DNA, 22 bp, Artificial Sequence
  Synthetic oligonucleotide; TTT chr11 5268271 5268292 5268288 5268293 +
ctctccatccctcagcccatga

SEQ ID NO: 91324 - DNA, 22 bp, Artificial Sequence
  Synthetic oligonucleotide; TTC chr11 5268272 5268293 5268289 5268294 +
tctccatccctcagcccatgaa

SEQ ID NO: 91325 - DNA, 22 bp, Artificial Sequence
  Synthetic oligonucleotide; CTC chr11 5268274 5268295 5268291 5268296 +
tccatccctcagcccatgaaca

SEQ ID NO: 91326 - DNA, 22 bp, Artificial Sequence
  Synthetic oligonucleotide; CTC chr11 5268276 5268297 5268293 5268298 +
catccctcagcccatgaacact

SEQ ID NO: 91327 - DNA, 22 bp, Artificial Sequence
  Synthetic oligonucleotide; CTC chr11 5268284 5268305 5268301 5268306 +
agcccatgaacactttttcctt

SEQ ID NO: 91328 - DNA, 22 bp, Artificial Sequence
  Synthetic oligonucleotide; CTT chr11 5268299 5268320 5268316 5268321 +
tttccttttaacacaagagtaa

SEQ ID NO: 91329 - DNA, 22 bp, Artificial Sequence
  Synthetic oligonucleotide; TTT chr11 5268300 5268321 5268317 5268322 +
ttccttttaacacaagagtaaa

SEQ ID NO: 91330 - DNA, 22 bp, Artificial Sequence
  Synthetic oligonucleotide; TTT chr11 5268301 5268322 5268318 5268323 +
tccttttaacacaagagtaaaa

SEQ ID NO: 91331 - DNA, 22 bp, Artificial Sequence
  Synthetic oligonucleotide; TTT chr11 5268302 5268323 5268319 5268324 +
ccttttaacacaagagtaaaag

SEQ ID NO: 91332 - DNA, 22 bp, Artificial Sequence
  Synthetic oligonucleotide; TTC chr11 5268303 5268324 5268320 5268325 +
cttttaacacaagagtaaaaga

SEQ ID NO: 91333 - DNA, 22 bp, Artificial Sequence
  Synthetic oligonucleotide; CTT chr11 5268306 5268327 5268323 5268328 +
ttaacacaagagtaaaagatgg

SEQ ID NO: 91334 - DNA, 22 bp, Artificial Sequence
  Synthetic oligonucleotide; TTT chr11 5268307 5268328 5268324 5268329 +
taacacaagagtaaaagatgga

SEQ ID NO: 91335 - DNA, 22 bp, Artificial Sequence
  Synthetic oligonucleotide; TTT chr11 5268308 5268329 5268325 5268330 +
aacacaagagtaaaagatggag

SEQ ID NO: 91336 - DNA, 22 bp, Artificial Sequence
  Synthetic oligonucleotide; TTA chr11 5268309 5268330 5268326 5268331 +
acacaagagtaaaagatggaga

SEQ ID NO: 91337 - DNA, 22 bp, Artificial Sequence
  Synthetic oligonucleotide; TTG chr11 5268342 5268363 5268359 5268364 +
caatttttgattactgaagaaa

SEQ ID NO: 91338 - DNA, 22 bp, Artificial Sequence
  Synthetic oligonucleotide; TTT chr11 5268348 5268369 5268365 5268370 +
ttgattactgaagaaaatgtac

SEQ ID NO: 91339 - DNA, 22 bp, Artificial Sequence
  Synthetic oligonucleotide; TTT chr11 5268349 5268370 5268366 5268371 +
tgattactgaagaaaatgtact

SEQ ID NO: 91340 - DNA, 22 bp, Artificial Sequence
  Synthetic oligonucleotide; TTT chr11 5268350 5268371 5268367 5268372 +
gattactgaagaaaatgtactt

SEQ ID NO: 91341 - DNA, 22 bp, Artificial Sequence
  Synthetic oligonucleotide; TTG chr11 5268351 5268372 5268368 5268373 +
attactgaagaaaatgtacttt

SEQ ID NO: 91342 - DNA, 22 bp, Artificial Sequence
  Synthetic oligonucleotide; TTA chr11 5268355 5268376 5268372 5268377 +
ctgaagaaaatgtactttatta

SEQ ID NO: 91343 - DNA, 22 bp, Artificial Sequence
  Synthetic oligonucleotide; CTG chr11 5268358 5268379 5268375 5268380 +
aagaaaatgtactttattaaac

SEQ ID NO: 91344 - DNA, 22 bp, Artificial Sequence
  Synthetic oligonucleotide; CTT chr11 5268372 5268393 5268389 5268394 +
tattaaacagaaggctttctct

SEQ ID NO: 91345 - DNA, 22 bp, Artificial Sequence
  Synthetic oligonucleotide; TTT chr11 5268373 5268394 5268390 5268395 +
attaaacagaaggctttctctc

SEQ ID NO: 91346 - DNA, 22 bp, Artificial Sequence
  Synthetic oligonucleotide; TTA chr11 5268374 5268395 5268391 5268396 +
ttaaacagaaggctttctctca

SEQ ID NO: 91347 - DNA, 22 bp, Artificial Sequence
  Synthetic oligonucleotide; TTA chr11 5268377 5268398 5268394 5268399 +
aacagaaggctttctctcaagg

SEQ ID NO: 91348 - DNA, 22 bp, Artificial Sequence
  Synthetic oligonucleotide; CTT chr11 5268389 5268410 5268406 5268411 +
tctctcaaggccaagcccagtc

SEQ ID NO: 91349 - DNA, 22 bp, Artificial Sequence
  Synthetic oligonucleotide; TTT chr11 5268390 5268411 5268407 5268412 +
ctctcaaggccaagcccagtcc

SEQ ID NO: 91350 - DNA, 22 bp, Artificial Sequence
  Synthetic oligonucleotide; TTC chr11 5268391 5268412 5268408 5268413 +
tctcaaggccaagcccagtccc

SEQ ID NO: 91351 - DNA, 22 bp, Artificial Sequence
  Synthetic oligonucleotide; CTC chr11 5268393 5268414 5268410 5268415 +
tcaaggccaagcccagtcccca

SEQ ID NO: 91352 - DNA, 22 bp, Artificial Sequence
  Synthetic oligonucleotide; CTC chr11 5268395 5268416 5268412 5268417 +
aaggccaagcccagtccccatg

SEQ ID NO: 91353 - DNA, 22 bp, Artificial Sequence
  Synthetic oligonucleotide; CTG chr11 5268453 5268474 5268470 5268475 +
caaactggaagagaactcagtg

SEQ ID NO: 91354 - DNA, 22 bp, Artificial Sequence
  Synthetic oligonucleotide; CTG chr11 5268460 5268481 5268477 5268482 +
gaagagaactcagtggtactta

SEQ ID NO: 91355 - DNA, 22 bp, Artificial Sequence
  Synthetic oligonucleotide; CTC chr11 5268471 5268492 5268488 5268493 +
agtggtacttatgggccagggc

SEQ ID NO: 91356 - DNA, 22 bp, Artificial Sequence
  Synthetic oligonucleotide; CTT chr11 5268481 5268502 5268498 5268503 +
atgggccagggcaatggcgaca

SEQ ID NO: 91357 - DNA, 22 bp, Artificial Sequence
  Synthetic oligonucleotide; TTA chr11 5268482 5268503 5268499 5268504 +
tgggccagggcaatggcgacag

SEQ ID NO: 91358 - DNA, 22 bp, Artificial Sequence
  Synthetic oligonucleotide; CTT chr11 5268517 5268538 5268534 5268539 +
ctgccaggcagcctgcacttca

SEQ ID NO: 91359 - DNA, 22 bp, Artificial Sequence
  Synthetic oligonucleotide; TTC chr11 5268518 5268539 5268535 5268540 +
tgccaggcagcctgcacttcag

SEQ ID NO: 91360 - DNA, 22 bp, Artificial Sequence
  Synthetic oligonucleotide; CTG chr11 5268520 5268541 5268537 5268542 +
ccaggcagcctgcacttcaggg

SEQ ID NO: 91361 - DNA, 22 bp, Artificial Sequence
  Synthetic oligonucleotide; CTG chr11 5268532 5268553 5268549 5268554 +
cacttcaggggtgaactccttg

SEQ ID NO: 91362 - DNA, 22 bp, Artificial Sequence
  Synthetic oligonucleotide; CTT chr11 5268537 5268558 5268554 5268559 +
caggggtgaactccttgccaaa

SEQ ID NO: 91363 - DNA, 22 bp, Artificial Sequence
  Synthetic oligonucleotide; TTC chr11 5268538 5268559 5268555 5268560 +
aggggtgaactccttgccaaag

SEQ ID NO: 91364 - DNA, 22 bp, Artificial Sequence
  Synthetic oligonucleotide; CTC chr11 5268550 5268571 5268567 5268572 +
cttgccaaagtgagtagccaga

SEQ ID NO: 91365 - DNA, 22 bp, Artificial Sequence
  Synthetic oligonucleotide; CTT chr11 5268553 5268574 5268570 5268575 +
gccaaagtgagtagccagaata

SEQ ID NO: 91366 - DNA, 22 bp, Artificial Sequence
  Synthetic oligonucleotide; TTG chr11 5268554 5268575 5268571 5268576 +
ccaaagtgagtagccagaataa

SEQ ID NO: 91367 - DNA, 22 bp, Artificial Sequence
  Synthetic oligonucleotide; TTA chr11 5268590 5268611 5268607 5268612 +
cccaggagctgttaggcaaaag

SEQ ID NO: 91368 - DNA, 22 bp, Artificial Sequence
  Synthetic oligonucleotide; CTG chr11 5268601 5268622 5268618 5268623 +
ttaggcaaaagacaaaataaca

SEQ ID NO: 91369 - DNA, 22 bp, Artificial Sequence
  Synthetic oligonucleotide; TTA chr11 5268604 5268625 5268621 5268626 +
ggcaaaagacaaaataacacac

SEQ ID NO: 91370 - DNA, 22 bp, Artificial Sequence
  Synthetic oligonucleotide; TTG chr11 5268636 5268657 5268653 5268658 +
agtagaagtttccgaaaacaac

SEQ ID NO: 91371 - DNA, 22 bp, Artificial Sequence
  Synthetic oligonucleotide; TTT chr11 5268647 5268668 5268664 5268669 +
ccgaaaacaacttgatgaaaaa

SEQ ID NO: 91372 - DNA, 22 bp, Artificial Sequence
  Synthetic oligonucleotide; TTC chr11 5268648 5268669 5268665 5268670 +
cgaaaacaacttgatgaaaaaa

SEQ ID NO: 91373 - DNA, 22 bp, Artificial Sequence
  Synthetic oligonucleotide; CTT chr11 5268660 5268681 5268677 5268682 +
gatgaaaaaacaaacaaacaaa

SEQ ID NO: 91374 - DNA, 22 bp, Artificial Sequence
  Synthetic oligonucleotide; TTG chr11 5268661 5268682 5268678 5268683 +
atgaaaaaacaaacaaacaaac

SEQ ID NO: 91375 - DNA, 22 bp, Artificial Sequence
  Synthetic oligonucleotide; CTT chr11 5268694 5268715 5268711 5268716 +
tatacctacattcctagacaac

SEQ ID NO: 91376 - DNA, 22 bp, Artificial Sequence
  Synthetic oligonucleotide; TTT chr11 5268695 5268716 5268712 5268717 +
atacctacattcctagacaacc

SEQ ID NO: 91377 - DNA, 22 bp, Artificial Sequence
  Synthetic oligonucleotide; TTA chr11 5268696 5268717 5268713 5268718 +
tacctacattcctagacaaccc

SEQ ID NO: 91378 - DNA, 22 bp, Artificial Sequence
  Synthetic oligonucleotide; CTA chr11 5268702 5268723 5268719 5268724 +
cattcctagacaaccctgacct

SEQ ID NO: 91379 - DNA, 22 bp, Artificial Sequence
  Synthetic oligonucleotide; TTC chr11 5268707 5268728 5268724 5268729 +
ctagacaaccctgacctcaaac

SEQ ID NO: 91380 - DNA, 22 bp, Artificial Sequence
  Synthetic oligonucleotide; CTA chr11 5268710 5268731 5268727 5268732 +
gacaaccctgacctcaaactgt

SEQ ID NO: 91381 - DNA, 22 bp, Artificial Sequence
  Synthetic oligonucleotide; CTG chr11 5268720 5268741 5268737 5268742 +
acctcaaactgttccaaggttt

SEQ ID NO: 91382 - DNA, 22 bp, Artificial Sequence
  Synthetic oligonucleotide; CTC chr11 5268725 5268746 5268742 5268747 +
aaactgttccaaggtttgtgcc

SEQ ID NO: 91383 - DNA, 22 bp, Artificial Sequence
  Synthetic oligonucleotide; CTG chr11 5268731 5268752 5268748 5268753 +
ttccaaggtttgtgcccaccca

SEQ ID NO: 91384 - DNA, 22 bp, Artificial Sequence
  Synthetic oligonucleotide; TTC chr11 5268734 5268755 5268751 5268756 +
caaggtttgtgcccacccaaaa

SEQ ID NO: 91385 - DNA, 22 bp, Artificial Sequence
  Synthetic oligonucleotide; TTT chr11 5268742 5268763 5268759 5268764 +
gtgcccacccaaaaaattcaga

SEQ ID NO: 91386 - DNA, 22 bp, Artificial Sequence
  Synthetic oligonucleotide; TTG chr11 5268743 5268764 5268760 5268765 +
tgcccacccaaaaaattcagat

SEQ ID NO: 91387 - DNA, 22 bp, Artificial Sequence
  Synthetic oligonucleotide; TTC chr11 5268761 5268782 5268778 5268783 +
agatgagcttaggttcaatttt

SEQ ID NO: 91388 - DNA, 22 bp, Artificial Sequence
  Synthetic oligonucleotide; CTT chr11 5268771 5268792 5268788 5268793 +
aggttcaattttattctatgag

SEQ ID NO: 91389 - DNA, 22 bp, Artificial Sequence
  Synthetic oligonucleotide; TTA chr11 5268772 5268793 5268789 5268794 +
ggttcaattttattctatgagc

SEQ ID NO: 91390 - DNA, 22 bp, Artificial Sequence
  Synthetic oligonucleotide; TTC chr11 5268777 5268798 5268794 5268799 +
aattttattctatgagccctac

SEQ ID NO: 91391 - DNA, 22 bp, Artificial Sequence
  Synthetic oligonucleotide; TTT chr11 5268782 5268803 5268799 5268804 +
tattctatgagccctacattca

SEQ ID NO: 91392 - DNA, 22 bp, Artificial Sequence
  Synthetic oligonucleotide; TTT chr11 5268783 5268804 5268800 5268805 +
attctatgagccctacattcaa

SEQ ID NO: 91393 - DNA, 22 bp, Artificial Sequence
  Synthetic oligonucleotide; TTA chr11 5268784 5268805 5268801 5268806 +
ttctatgagccctacattcaac

SEQ ID NO: 91394 - DNA, 22 bp, Artificial Sequence
  Synthetic oligonucleotide; TTC chr11 5268787 5268808 5268804 5268809 +
tatgagccctacattcaacatt

SEQ ID NO: 91395 - DNA, 22 bp, Artificial Sequence
  Synthetic oligonucleotide; CTA chr11 5268789 5268810 5268806 5268811 +
tgagccctacattcaacattct

SEQ ID NO: 91396 - DNA, 22 bp, Artificial Sequence
  Synthetic oligonucleotide; CTA chr11 5268798 5268819 5268815 5268820 +
cattcaacattctacctaccta

SEQ ID NO: 91397 - DNA, 22 bp, Artificial Sequence
  Synthetic oligonucleotide; TTC chr11 5268803 5268824 5268820 5268825 +
aacattctacctacctacaccc

SEQ ID NO: 91398 - DNA, 22 bp, Artificial Sequence
  Synthetic oligonucleotide; TTC chr11 5268810 5268831 5268827 5268832 +
tacctacctacaccctcacccc

SEQ ID NO: 91399 - DNA, 22 bp, Artificial Sequence
  Synthetic oligonucleotide; CTA chr11 5268812 5268833 5268829 5268834 +
cctacctacaccctcaccccct

SEQ ID NO: 91400 - DNA, 22 bp, Artificial Sequence
  Synthetic oligonucleotide; CTA chr11 5268816 5268837 5268833 5268838 +
cctacaccctcacccccttccc

SEQ ID NO: 91401 - DNA, 22 bp, Artificial Sequence
  Synthetic oligonucleotide; CTA chr11 5268820 5268841 5268837 5268842 +
caccctcacccccttccccatt

SEQ ID NO: 91402 - DNA, 22 bp, Artificial Sequence
  Synthetic oligonucleotide; CTC chr11 5268827 5268848 5268844 5268849 +
acccccttccccattttaccag

SEQ ID NO: 91403 - DNA, 22 bp, Artificial Sequence
  Synthetic oligonucleotide; CTT chr11 5268835 5268856 5268852 5268857 +
ccccattttaccagtattattg

SEQ ID NO: 91404 - DNA, 22 bp, Artificial Sequence
  Synthetic oligonucleotide; TTC chr11 5268836 5268857 5268853 5268858 +
cccattttaccagtattattgg

SEQ ID NO: 91405 - DNA, 22 bp, Artificial Sequence
  Synthetic oligonucleotide; TTT chr11 5268843 5268864 5268860 5268865 +
taccagtattattgggttccct

SEQ ID NO: 91406 - DNA, 22 bp, Artificial Sequence
  Synthetic oligonucleotide; TTT chr11 5268844 5268865 5268861 5268866 +
accagtattattgggttccctc

SEQ ID NO: 91407 - DNA, 22 bp, Artificial Sequence
  Synthetic oligonucleotide; TTA chr11 5268845 5268866 5268862 5268867 +
ccagtattattgggttccctct

SEQ ID NO: 91408 - DNA, 22 bp, Artificial Sequence
  Synthetic oligonucleotide; TTA chr11 5268854 5268875 5268871 5268876 +
ttgggttccctctctccctgtt

SEQ ID NO: 91409 - DNA, 22 bp, Artificial Sequence
  Synthetic oligonucleotide; TTG chr11 5268857 5268878 5268874 5268879 +
ggttccctctctccctgttttt

SEQ ID NO: 91410 - DNA, 22 bp, Artificial Sequence
  Synthetic oligonucleotide; TTC chr11 5268862 5268883 5268879 5268884 +
cctctctccctgtttttcttta

SEQ ID NO: 91411 - DNA, 22 bp, Artificial Sequence
  Synthetic oligonucleotide; CTC chr11 5268866 5268887 5268883 5268888 +
tctccctgtttttctttaagca

SEQ ID NO: 91412 - DNA, 22 bp, Artificial Sequence
  Synthetic oligonucleotide; CTC chr11 5268868 5268889 5268885 5268890 +
tccctgtttttctttaagcaat

SEQ ID NO: 91413 - DNA, 22 bp, Artificial Sequence
  Synthetic oligonucleotide; CTC chr11 5268870 5268891 5268887 5268892 +
cctgtttttctttaagcaattg

SEQ ID NO: 91414 - DNA, 22 bp, Artificial Sequence
  Synthetic oligonucleotide; CTG chr11 5268874 5268895 5268891 5268896 +
tttttctttaagcaattgtcta

SEQ ID NO: 91415 - DNA, 22 bp, Artificial Sequence
  Synthetic oligonucleotide; TTT chr11 5268877 5268898 5268894 5268899 +
ttctttaagcaattgtctaatt

SEQ ID NO: 91416 - DNA, 22 bp, Artificial Sequence
  Synthetic oligonucleotide; TTT chr11 5268878 5268899 5268895 5268900 +
tctttaagcaattgtctaattt

SEQ ID NO: 91417 - DNA, 22 bp, Artificial Sequence
  Synthetic oligonucleotide; TTT chr11 5268879 5268900 5268896 5268901 +
ctttaagcaattgtctaatttt

SEQ ID NO: 91418 - DNA, 22 bp, Artificial Sequence
  Synthetic oligonucleotide; TTC chr11 5268880 5268901 5268897 5268902 +
tttaagcaattgtctaattttt

SEQ ID NO: 91419 - DNA, 22 bp, Artificial Sequence
  Synthetic oligonucleotide; CTT chr11 5268882 5268903 5268899 5268904 +
taagcaattgtctaatttttgt

SEQ ID NO: 91420 - DNA, 22 bp, Artificial Sequence
  Synthetic oligonucleotide; TTT chr11 5268883 5268904 5268900 5268905 +
aagcaattgtctaatttttgta

SEQ ID NO: 91421 - DNA, 22 bp, Artificial Sequence
  Synthetic oligonucleotide; TTA chr11 5268884 5268905 5268901 5268906 +
agcaattgtctaatttttgtaa

SEQ ID NO: 91422 - DNA, 22 bp, Artificial Sequence
  Synthetic oligonucleotide; TTG chr11 5268892 5268913 5268909 5268914 +
tctaatttttgtaaatgtagaa

SEQ ID NO: 91423 - DNA, 22 bp, Artificial Sequence
  Synthetic oligonucleotide; CTA chr11 5268896 5268917 5268913 5268918 +
atttttgtaaatgtagaatgtg

SEQ ID NO: 91424 - DNA, 22 bp, Artificial Sequence
  Synthetic oligonucleotide; TTT chr11 5268900 5268921 5268917 5268922 +
ttgtaaatgtagaatgtgagtg

SEQ ID NO: 91425 - DNA, 22 bp, Artificial Sequence
  Synthetic oligonucleotide; TTT chr11 5268901 5268922 5268918 5268923 +
tgtaaatgtagaatgtgagtgc

SEQ ID NO: 91426 - DNA, 22 bp, Artificial Sequence
  Synthetic oligonucleotide; TTT chr11 5268902 5268923 5268919 5268924 +
gtaaatgtagaatgtgagtgct

SEQ ID NO: 91427 - DNA, 22 bp, Artificial Sequence
  Synthetic oligonucleotide; TTG chr11 5268903 5268924 5268920 5268925 +
taaatgtagaatgtgagtgctg

SEQ ID NO: 91428 - DNA, 22 bp, Artificial Sequence
  Synthetic oligonucleotide; CTG chr11 5268925 5268946 5268942 5268947 +
caagagttctcagcgggagttt

SEQ ID NO: 91429 - DNA, 22 bp, Artificial Sequence
  Synthetic oligonucleotide; TTC chr11 5268934 5268955 5268951 5268956 +
tcagcgggagtttaaaatcccc

SEQ ID NO: 91430 - DNA, 22 bp, Artificial Sequence
  Synthetic oligonucleotide; CTC chr11 5268936 5268957 5268953 5268958 +
agcgggagtttaaaatccccaa

SEQ ID NO: 91431 - DNA, 22 bp, Artificial Sequence
  Synthetic oligonucleotide; TTT chr11 5268947 5268968 5268964 5268969 +
aaaatccccaacaaattcggaa

SEQ ID NO: 91432 - DNA, 22 bp, Artificial Sequence
  Synthetic oligonucleotide; TTA chr11 5268948 5268969 5268965 5268970 +
aaatccccaacaaattcggaaa

SEQ ID NO: 91433 - DNA, 22 bp, Artificial Sequence
  Synthetic oligonucleotide; TTC chr11 5268965 5268986 5268982 5268987 +
ggaaacaagccttcacttggtc

SEQ ID NO: 91434 - DNA, 22 bp, Artificial Sequence
  Synthetic oligonucleotide; CTT chr11 5268978 5268999 5268995 5269000 +
cacttggtcacaatactgatgg

SEQ ID NO: 91435 - DNA, 22 bp, Artificial Sequence
  Synthetic oligonucleotide; TTC chr11 5268979 5269000 5268996 5269001 +
acttggtcacaatactgatggg

SEQ ID NO: 91436 - DNA, 22 bp, Artificial Sequence
  Synthetic oligonucleotide; CTT chr11 5268983 5269004 5269000 5269005 +
ggtcacaatactgatgggaaat

SEQ ID NO: 91437 - DNA, 22 bp, Artificial Sequence
  Synthetic oligonucleotide; TTG chr11 5268984 5269005 5269001 5269006 +
gtcacaatactgatgggaaatt

SEQ ID NO: 91438 - DNA, 22 bp, Artificial Sequence
  Synthetic oligonucleotide; CTG chr11 5268996 5269017 5269013 5269018 +
atgggaaatttaacatatttta

SEQ ID NO: 91439 - DNA, 22 bp, Artificial Sequence
  Synthetic oligonucleotide; TTT chr11 5269007 5269028 5269024 5269029 +
aacatattttagaaaatgtgtc

SEQ ID NO: 91440 - DNA, 22 bp, Artificial Sequence
  Synthetic oligonucleotide; TTA chr11 5269008 5269029 5269025 5269030 +
acatattttagaaaatgtgtct

SEQ ID NO: 91441 - DNA, 22 bp, Artificial Sequence
  Synthetic oligonucleotide; TTT chr11 5269016 5269037 5269033 5269038 +
tagaaaatgtgtcttatttttc

SEQ ID NO: 91442 - DNA, 22 bp, Artificial Sequence
  Synthetic oligonucleotide; TTT chr11 5269017 5269038 5269034 5269039 +
agaaaatgtgtcttatttttct

SEQ ID NO: 91443 - DNA, 22 bp, Artificial Sequence
  Synthetic oligonucleotide; TTA chr11 5269018 5269039 5269035 5269040 +
gaaaatgtgtcttatttttctt

SEQ ID NO: 91444 - DNA, 22 bp, Artificial Sequence
  Synthetic oligonucleotide; CTT chr11 5269031 5269052 5269048 5269053 +
atttttctttgagcaaatcttt

SEQ ID NO: 91445 - DNA, 22 bp, Artificial Sequence
  Synthetic oligonucleotide; TTA chr11 5269032 5269053 5269049 5269054 +
tttttctttgagcaaatctttt

SEQ ID NO: 91446 - DNA, 22 bp, Artificial Sequence
  Synthetic oligonucleotide; TTT chr11 5269035 5269056 5269052 5269057 +
ttctttgagcaaatcttttatt

SEQ ID NO: 91447 - DNA, 22 bp, Artificial Sequence
  Synthetic oligonucleotide; TTT chr11 5269036 5269057 5269053 5269058 +
tctttgagcaaatcttttattt

SEQ ID NO: 91448 - DNA, 22 bp, Artificial Sequence
  Synthetic oligonucleotide; TTT chr11 5269037 5269058 5269054 5269059 +
ctttgagcaaatcttttatttt

SEQ ID NO: 91449 - DNA, 22 bp, Artificial Sequence
  Synthetic oligonucleotide; TTC chr11 5269038 5269059 5269055 5269060 +
tttgagcaaatcttttattttt

SEQ ID NO: 91450 - DNA, 22 bp, Artificial Sequence
  Synthetic oligonucleotide; CTT chr11 5269040 5269061 5269057 5269062 +
tgagcaaatcttttattttttt

SEQ ID NO: 91451 - DNA, 22 bp, Artificial Sequence
  Synthetic oligonucleotide; TTT chr11 5269041 5269062 5269058 5269063 +
gagcaaatcttttatttttttt

SEQ ID NO: 91452 - DNA, 22 bp, Artificial Sequence
  Synthetic oligonucleotide; TTG chr11 5269042 5269063 5269059 5269064 +
agcaaatcttttattttttttg

SEQ ID NO: 91453 - DNA, 22 bp, Artificial Sequence
  Synthetic oligonucleotide; CTT chr11 5269052 5269073 5269069 5269074 +
ttattttttttgcaaaaatctc

SEQ ID NO: 91454 - DNA, 22 bp, Artificial Sequence
  Synthetic oligonucleotide; TTT chr11 5269053 5269074 5269070 5269075 +
tattttttttgcaaaaatctct

SEQ ID NO: 91455 - DNA, 22 bp, Artificial Sequence
  Synthetic oligonucleotide; TTT chr11 5269054 5269075 5269071 5269076 +
attttttttgcaaaaatctctt

SEQ ID NO: 91456 - DNA, 22 bp, Artificial Sequence
  Synthetic oligonucleotide; TTA chr11 5269055 5269076 5269072 5269077 +
ttttttttgcaaaaatctcttt

SEQ ID NO: 91457 - DNA, 22 bp, Artificial Sequence
  Synthetic oligonucleotide; TTT chr11 5269058 5269079 5269075 5269080 +
tttttgcaaaaatctctttcta

SEQ ID NO: 91458 - DNA, 22 bp, Artificial Sequence
  Synthetic oligonucleotide; TTT chr11 5269059 5269080 5269076 5269081 +
ttttgcaaaaatctctttctaa

SEQ ID NO: 91459 - DNA, 22 bp, Artificial Sequence
  Synthetic oligonucleotide; TTT chr11 5269060 5269081 5269077 5269082 +
tttgcaaaaatctctttctaaa

SEQ ID NO: 91460 - DNA, 22 bp, Artificial Sequence
  Synthetic oligonucleotide; TTT chr11 5269061 5269082 5269078 5269083 +
ttgcaaaaatctctttctaaac

SEQ ID NO: 91461 - DNA, 22 bp, Artificial Sequence
  Synthetic oligonucleotide; TTT chr11 5269062 5269083 5269079 5269084 +
tgcaaaaatctctttctaaacc

SEQ ID NO: 91462 - DNA, 22 bp, Artificial Sequence
  Synthetic oligonucleotide; TTT chr11 5269063 5269084 5269080 5269085 +
gcaaaaatctctttctaaacct

SEQ ID NO: 91463 - DNA, 22 bp, Artificial Sequence
  Synthetic oligonucleotide; TTG chr11 5269064 5269085 5269081 5269086 +
caaaaatctctttctaaacctc

SEQ ID NO: 91464 - DNA, 22 bp, Artificial Sequence
  Synthetic oligonucleotide; CTC chr11 5269074 5269095 5269091 5269096 +
tttctaaacctcaattatcatg

SEQ ID NO: 91465 - DNA, 22 bp, Artificial Sequence
  Synthetic oligonucleotide; CTT chr11 5269076 5269097 5269093 5269098 +
tctaaacctcaattatcatgac

SEQ ID NO: 91466 - DNA, 22 bp, Artificial Sequence
  Synthetic oligonucleotide; TTT chr11 5269077 5269098 5269094 5269099 +
ctaaacctcaattatcatgacc

SEQ ID NO: 91467 - DNA, 22 bp, Artificial Sequence
  Synthetic oligonucleotide; TTC chr11 5269078 5269099 5269095 5269100 +
taaacctcaattatcatgaccc

SEQ ID NO: 91468 - DNA, 22 bp, Artificial Sequence
  Synthetic oligonucleotide; CTA chr11 5269080 5269101 5269097 5269102 +
aacctcaattatcatgacccac

SEQ ID NO: 91469 - DNA, 22 bp, Artificial Sequence
  Synthetic oligonucleotide; CTC chr11 5269086 5269107 5269103 5269108 +
aattatcatgacccacataaaa

SEQ ID NO: 91470 - DNA, 22 bp, Artificial Sequence
  Synthetic oligonucleotide; TTA chr11 5269091 5269112 5269108 5269113 +
tcatgacccacataaaataagg

SEQ ID NO: 91471 - DNA, 22 bp, Artificial Sequence
  Synthetic oligonucleotide; TTT chr11 5269118 5269139 5269135 5269140 +
ctatttccttgaaatggacttt

SEQ ID NO: 91472 - DNA, 22 bp, Artificial Sequence
  Synthetic oligonucleotide; TTC chr11 5269119 5269140 5269136 5269141 +
tatttccttgaaatggactttc

SEQ ID NO: 91473 - DNA, 22 bp, Artificial Sequence
  Synthetic oligonucleotide; CTA chr11 5269121 5269142 5269138 5269143 +
tttccttgaaatggactttcat

SEQ ID NO: 91474 - DNA, 22 bp, Artificial Sequence
  Synthetic oligonucleotide; TTT chr11 5269124 5269145 5269141 5269146 +
ccttgaaatggactttcatcta

SEQ ID NO: 91475 - DNA, 22 bp, Artificial Sequence
  Synthetic oligonucleotide; TTC chr11 5269125 5269146 5269142 5269147 +
cttgaaatggactttcatctac

SEQ ID NO: 91476 - DNA, 22 bp, Artificial Sequence
  Synthetic oligonucleotide; CTT chr11 5269128 5269149 5269145 5269150 +
gaaatggactttcatctaccaa

SEQ ID NO: 91477 - DNA, 22 bp, Artificial Sequence
  Synthetic oligonucleotide; TTG chr11 5269129 5269150 5269146 5269151 +
aaatggactttcatctaccaaa

SEQ ID NO: 91478 - DNA, 22 bp, Artificial Sequence
  Synthetic oligonucleotide; CTT chr11 5269139 5269160 5269156 5269161 +
tcatctaccaaaagccaaattt

SEQ ID NO: 91479 - DNA, 22 bp, Artificial Sequence
  Synthetic oligonucleotide; TTT chr11 5269140 5269161 5269157 5269162 +
catctaccaaaagccaaatttc

SEQ ID NO: 91480 - DNA, 22 bp, Artificial Sequence
  Synthetic oligonucleotide; TTC chr11 5269141 5269162 5269158 5269163 +
atctaccaaaagccaaatttca

SEQ ID NO: 91481 - DNA, 22 bp, Artificial Sequence
  Synthetic oligonucleotide; CTA chr11 5269146 5269167 5269163 5269168 +
ccaaaagccaaatttcattctt

SEQ ID NO: 91482 - DNA, 22 bp, Artificial Sequence
  Synthetic oligonucleotide; TTT chr11 5269161 5269182 5269178 5269183 +
cattcttctttcacaagtctac

SEQ ID NO: 91483 - DNA, 22 bp, Artificial Sequence
  Synthetic oligonucleotide; TTC chr11 5269162 5269183 5269179 5269184 +
attcttctttcacaagtctaca

SEQ ID NO: 91484 - DNA, 22 bp, Artificial Sequence
  Synthetic oligonucleotide; TTC chr11 5269166 5269187 5269183 5269188 +
ttctttcacaagtctacaattc

SEQ ID NO: 91485 - DNA, 22 bp, Artificial Sequence
  Synthetic oligonucleotide; CTT chr11 5269168 5269189 5269185 5269190 +
ctttcacaagtctacaattcta

SEQ ID NO: 91486 - DNA, 22 bp, Artificial Sequence
  Synthetic oligonucleotide; TTC chr11 5269169 5269190 5269186 5269191 +
tttcacaagtctacaattctat

SEQ ID NO: 91487 - DNA, 22 bp, Artificial Sequence
  Synthetic oligonucleotide; CTT chr11 5269171 5269192 5269188 5269193 +
tcacaagtctacaattctataa

SEQ ID NO: 91488 - DNA, 22 bp, Artificial Sequence
  Synthetic oligonucleotide; TTT chr11 5269172 5269193 5269189 5269194 +
cacaagtctacaattctataat

SEQ ID NO: 91489 - DNA, 22 bp, Artificial Sequence
  Synthetic oligonucleotide; TTC chr11 5269173 5269194 5269190 5269195 +
acaagtctacaattctataata

SEQ ID NO: 91490 - DNA, 22 bp, Artificial Sequence
  Synthetic oligonucleotide; CTA chr11 5269182 5269203 5269199 5269204 +
caattctataatacaattctct

SEQ ID NO: 91491 - DNA, 22 bp, Artificial Sequence
  Synthetic oligonucleotide; TTC chr11 5269188 5269209 5269205 5269210 +
tataatacaattctctgggata

SEQ ID NO: 91492 - DNA, 22 bp, Artificial Sequence
  Synthetic oligonucleotide; CTA chr11 5269190 5269211 5269207 5269212 +
taatacaattctctgggataaa

SEQ ID NO: 91493 - DNA, 22 bp, Artificial Sequence
  Synthetic oligonucleotide; TTC chr11 5269201 5269222 5269218 5269223 +
tctgggataaacacatcaagtt

SEQ ID NO: 91494 - DNA, 22 bp, Artificial Sequence
  Synthetic oligonucleotide; CTC chr11 5269203 5269224 5269220 5269225 +
tgggataaacacatcaagttct

SEQ ID NO: 91495 - DNA, 22 bp, Artificial Sequence
  Synthetic oligonucleotide; CTG chr11 5269205 5269226 5269222 5269227 +
ggataaacacatcaagttctgg

SEQ ID NO: 91496 - DNA, 22 bp, Artificial Sequence
  Synthetic oligonucleotide; TTC chr11 5269224 5269245 5269241 5269246 +
tggcaagatttcctgaaaagtt

SEQ ID NO: 91497 - DNA, 22 bp, Artificial Sequence
  Synthetic oligonucleotide; CTG chr11 5269226 5269247 5269243 5269248 +
gcaagatttcctgaaaagttaa

SEQ ID NO: 91498 - DNA, 22 bp, Artificial Sequence
  Synthetic oligonucleotide; TTT chr11 5269235 5269256 5269252 5269257 +
cctgaaaagttaagccaattca

SEQ ID NO: 91499 - DNA, 22 bp, Artificial Sequence
  Synthetic oligonucleotide; TTC chr11 5269236 5269257 5269253 5269258 +
ctgaaaagttaagccaattcag

SEQ ID NO: 91500 - DNA, 22 bp, Artificial Sequence
  Synthetic oligonucleotide; CTG chr11 5269239 5269260 5269256 5269261 +
aaaagttaagccaattcaggct

SEQ ID NO: 91501 - DNA, 22 bp, Artificial Sequence
  Synthetic oligonucleotide; TTA chr11 5269247 5269268 5269264 5269269 +
agccaattcaggctgttagtag

SEQ ID NO: 91502 - DNA, 22 bp, Artificial Sequence
  Synthetic oligonucleotide; TTC chr11 5269256 5269277 5269273 5269278 +
aggctgttagtagtcctttact

SEQ ID NO: 91503 - DNA, 22 bp, Artificial Sequence
  Synthetic oligonucleotide; CTG chr11 5269262 5269283 5269279 5269284 +
ttagtagtcctttactgtcact

SEQ ID NO: 91504 - DNA, 22 bp, Artificial Sequence
  Synthetic oligonucleotide; TTA chr11 5269265 5269286 5269282 5269287 +
gtagtcctttactgtcactagt

SEQ ID NO: 91505 - DNA, 22 bp, Artificial Sequence
  Synthetic oligonucleotide; CTT chr11 5269274 5269295 5269291 5269296 +
tactgtcactagttctgaatca

SEQ ID NO: 91506 - DNA, 22 bp, Artificial Sequence
  Synthetic oligonucleotide; TTT chr11 5269275 5269296 5269292 5269297 +
actgtcactagttctgaatcat

SEQ ID NO: 91507 - DNA, 22 bp, Artificial Sequence
  Synthetic oligonucleotide; TTA chr11 5269276 5269297 5269293 5269298 +
ctgtcactagttctgaatcatg

SEQ ID NO: 91508 - DNA, 22 bp, Artificial Sequence
  Synthetic oligonucleotide; CTG chr11 5269279 5269300 5269296 5269301 +
tcactagttctgaatcatgtaa

SEQ ID NO: 91509 - DNA, 22 bp, Artificial Sequence
  Synthetic oligonucleotide; CTA chr11 5269285 5269306 5269302 5269307 +
gttctgaatcatgtaagttttg

SEQ ID NO: 91510 - DNA, 22 bp, Artificial Sequence
  Synthetic oligonucleotide; TTC chr11 5269289 5269310 5269306 5269311 +
tgaatcatgtaagttttggtta

SEQ ID NO: 91511 - DNA, 22 bp, Artificial Sequence
  Synthetic oligonucleotide; CTG chr11 5269291 5269312 5269308 5269313 +
aatcatgtaagttttggttatg

SEQ ID NO: 91512 - DNA, 22 bp, Artificial Sequence
  Synthetic oligonucleotide; TTT chr11 5269305 5269326 5269322 5269327 +
tggttatgctcactagaagtct

SEQ ID NO: 91513 - DNA, 22 bp, Artificial Sequence
  Synthetic oligonucleotide; TTT chr11 5269306 5269327 5269323 5269328 +
ggttatgctcactagaagtctg

SEQ ID NO: 91514 - DNA, 22 bp, Artificial Sequence
  Synthetic oligonucleotide; TTG chr11 5269307 5269328 5269324 5269329 +
gttatgctcactagaagtctgc

SEQ ID NO: 91515 - DNA, 22 bp, Artificial Sequence
  Synthetic oligonucleotide; TTA chr11 5269311 5269332 5269328 5269333 +
tgctcactagaagtctgctgtt

SEQ ID NO: 91516 - DNA, 22 bp, Artificial Sequence
  Synthetic oligonucleotide; CTC chr11 5269316 5269337 5269333 5269338 +
actagaagtctgctgttctaac

SEQ ID NO: 91517 - DNA, 22 bp, Artificial Sequence
  Synthetic oligonucleotide; CTA chr11 5269320 5269341 5269337 5269342 +
gaagtctgctgttctaacatca

SEQ ID NO: 91518 - DNA, 22 bp, Artificial Sequence
  Synthetic oligonucleotide; CTG chr11 5269328 5269349 5269345 5269350 +
ctgttctaacatcaagctcgac

SEQ ID NO: 91519 - DNA, 22 bp, Artificial Sequence
  Synthetic oligonucleotide; CTG chr11 5269331 5269352 5269348 5269353 +
ttctaacatcaagctcgaccca

SEQ ID NO: 91520 - DNA, 22 bp, Artificial Sequence
  Synthetic oligonucleotide; TTC chr11 5269334 5269355 5269351 5269356 +
taacatcaagctcgacccatga

SEQ ID NO: 91521 - DNA, 22 bp, Artificial Sequence
  Synthetic oligonucleotide; CTA chr11 5269336 5269357 5269353 5269358 +
acatcaagctcgacccatgatt

SEQ ID NO: 91522 - DNA, 22 bp, Artificial Sequence
  Synthetic oligonucleotide; CTC chr11 5269347 5269368 5269364 5269369 +
gacccatgatttctgagatctt

SEQ ID NO: 91523 - DNA, 22 bp, Artificial Sequence
  Synthetic oligonucleotide; TTT chr11 5269359 5269380 5269376 5269381 +
ctgagatctttgttggtctttc

SEQ ID NO: 91524 - DNA, 22 bp, Artificial Sequence
  Synthetic oligonucleotide; TTC chr11 5269360 5269381 5269377 5269382 +
tgagatctttgttggtctttcc

SEQ ID NO: 91525 - DNA, 22 bp, Artificial Sequence
  Synthetic oligonucleotide; CTG chr11 5269362 5269383 5269379 5269384 +
agatctttgttggtctttccaa

SEQ ID NO: 91526 - DNA, 22 bp, Artificial Sequence
  Synthetic oligonucleotide; CTT chr11 5269369 5269390 5269386 5269391 +
tgttggtctttccaataagatt

SEQ ID NO: 91527 - DNA, 22 bp, Artificial Sequence
  Synthetic oligonucleotide; TTT chr11 5269370 5269391 5269387 5269392 +
gttggtctttccaataagatta

SEQ ID NO: 91528 - DNA, 22 bp, Artificial Sequence
  Synthetic oligonucleotide; TTG chr11 5269371 5269392 5269388 5269393 +
ttggtctttccaataagattat

SEQ ID NO: 91529 - DNA, 22 bp, Artificial Sequence
  Synthetic oligonucleotide; TTG chr11 5269374 5269395 5269391 5269396 +
gtctttccaataagattatgag

SEQ ID NO: 91530 - DNA, 22 bp, Artificial Sequence
  Synthetic oligonucleotide; CTT chr11 5269379 5269400 5269396 5269401 +
tccaataagattatgagcttca

SEQ ID NO: 91531 - DNA, 22 bp, Artificial Sequence
  Synthetic oligonucleotide; TTT chr11 5269380 5269401 5269397 5269402 +
ccaataagattatgagcttcaa

SEQ ID NO: 91532 - DNA, 22 bp, Artificial Sequence
  Synthetic oligonucleotide; TTC chr11 5269381 5269402 5269398 5269403 +
caataagattatgagcttcaat

SEQ ID NO: 91533 - DNA, 22 bp, Artificial Sequence
  Synthetic oligonucleotide; TTA chr11 5269392 5269413 5269409 5269414 +
tgagcttcaattaatgtcaaaa

SEQ ID NO: 91534 - DNA, 22 bp, Artificial Sequence
  Synthetic oligonucleotide; CTT chr11 5269399 5269420 5269416 5269421 +
caattaatgtcaaaatataaag

SEQ ID NO: 91535 - DNA, 22 bp, Artificial Sequence
  Synthetic oligonucleotide; TTC chr11 5269400 5269421 5269417 5269422 +
aattaatgtcaaaatataaagc

SEQ ID NO: 91536 - DNA, 22 bp, Artificial Sequence
  Synthetic oligonucleotide; TTA chr11 5269405 5269426 5269422 5269427 +
atgtcaaaatataaagccaaaa

SEQ ID NO: 91537 - DNA, 22 bp, Artificial Sequence
  Synthetic oligonucleotide; CTG chr11 5269447 5269468 5269464 5269469 +
aactcaccttgaagttctcagg

SEQ ID NO: 91538 - DNA, 22 bp, Artificial Sequence
  Synthetic oligonucleotide; CTC chr11 5269452 5269473 5269469 5269474 +
accttgaagttctcaggatcca

SEQ ID NO: 91539 - DNA, 22 bp, Artificial Sequence
  Synthetic oligonucleotide; CTT chr11 5269457 5269478 5269474 5269479 +
gaagttctcaggatccacatgc

SEQ ID NO: 91540 - DNA, 22 bp, Artificial Sequence
  Synthetic oligonucleotide; TTG chr11 5269458 5269479 5269475 5269480 +
aagttctcaggatccacatgca

SEQ ID NO: 91541 - DNA, 22 bp, Artificial Sequence
  Synthetic oligonucleotide; TTC chr11 5269464 5269485 5269481 5269486 +
tcaggatccacatgcagcttgt

SEQ ID NO: 91542 - DNA, 22 bp, Artificial Sequence
  Synthetic oligonucleotide; CTC chr11 5269466 5269487 5269483 5269488 +
aggatccacatgcagcttgtca

SEQ ID NO: 91543 - DNA, 22 bp, Artificial Sequence
  Synthetic oligonucleotide; CTT chr11 5269484 5269505 5269501 5269506 +
gtcacagtgcagctcactcagc

SEQ ID NO: 91544 - DNA, 22 bp, Artificial Sequence
  Synthetic oligonucleotide; TTG chr11 5269485 5269506 5269502 5269507 +
tcacagtgcagctcactcagct

SEQ ID NO: 91545 - DNA, 22 bp, Artificial Sequence
  Synthetic oligonucleotide; CTC chr11 5269499 5269520 5269516 5269521 +
actcagcttagcaaaggcgggc

SEQ ID NO: 91546 - DNA, 22 bp, Artificial Sequence
  Synthetic oligonucleotide; CTC chr11 5269503 5269524 5269520 5269525 +
agcttagcaaaggcgggcttga

SEQ ID NO: 91547 - DNA, 22 bp, Artificial Sequence
  Synthetic oligonucleotide; CTT chr11 5269508 5269529 5269525 5269530 +
agcaaaggcgggcttgaggttg

SEQ ID NO: 91548 - DNA, 22 bp, Artificial Sequence
  Synthetic oligonucleotide; TTA chr11 5269509 5269530 5269526 5269531 +
gcaaaggcgggcttgaggttgt

SEQ ID NO: 91549 - DNA, 22 bp, Artificial Sequence
  Synthetic oligonucleotide; CTT chr11 5269523 5269544 5269540 5269545 +
gaggttgtccatgtttttaata

SEQ ID NO: 91550 - DNA, 22 bp, Artificial Sequence
  Synthetic oligonucleotide; TTG chr11 5269524 5269545 5269541 5269546 +
aggttgtccatgtttttaatag

SEQ ID NO: 91551 - DNA, 22 bp, Artificial Sequence
  Synthetic oligonucleotide; TTG chr11 5269530 5269551 5269547 5269552 +
tccatgtttttaatagcatctc

SEQ ID NO: 91552 - DNA, 22 bp, Artificial Sequence
  Synthetic oligonucleotide; TTT chr11 5269539 5269560 5269556 5269561 +
ttaatagcatctccaaaggaag

SEQ ID NO: 91553 - DNA, 22 bp, Artificial Sequence
  Synthetic oligonucleotide; TTT chr11 5269540 5269561 5269557 5269562 +
taatagcatctccaaaggaagt

SEQ ID NO: 91554 - DNA, 22 bp, Artificial Sequence
  Synthetic oligonucleotide; TTT chr11 5269541 5269562 5269558 5269563 +
aatagcatctccaaaggaagtc

SEQ ID NO: 91555 - DNA, 22 bp, Artificial Sequence
  Synthetic oligonucleotide; TTA chr11 5269542 5269563 5269559 5269564 +
atagcatctccaaaggaagtca

SEQ ID NO: 91556 - DNA, 22 bp, Artificial Sequence
  Synthetic oligonucleotide; CTC chr11 5269552 5269573 5269569 5269574 +
caaaggaagtcagcaccttctt

SEQ ID NO: 91557 - DNA, 22 bp, Artificial Sequence
  Synthetic oligonucleotide; CTT chr11 5269571 5269592 5269588 5269593 +
cttgccatgggccttgaccttg

SEQ ID NO: 91558 - DNA, 22 bp, Artificial Sequence
  Synthetic oligonucleotide; TTC chr11 5269572 5269593 5269589 5269594 +
ttgccatgggccttgaccttgg

SEQ ID NO: 91559 - DNA, 22 bp, Artificial Sequence
  Synthetic oligonucleotide; CTT chr11 5269574 5269595 5269591 5269596 +
gccatgggccttgaccttgggg

SEQ ID NO: 91560 - DNA, 22 bp, Artificial Sequence
  Synthetic oligonucleotide; TTG chr11 5269575 5269596 5269592 5269597 +
ccatgggccttgaccttggggt

SEQ ID NO: 91561 - DNA, 22 bp, Artificial Sequence
  Synthetic oligonucleotide; CTT chr11 5269586 5269607 5269603 5269608 +
gaccttggggttgcccaggatg

SEQ ID NO: 91562 - DNA, 22 bp, Artificial Sequence
  Synthetic oligonucleotide; TTG chr11 5269587 5269608 5269604 5269609 +
accttggggttgcccaggatgg

SEQ ID NO: 91563 - DNA, 22 bp, Artificial Sequence
  Synthetic oligonucleotide; CTT chr11 5269592 5269613 5269609 5269614 +
ggggttgcccaggatggcagag

SEQ ID NO: 91564 - DNA, 22 bp, Artificial Sequence
  Synthetic oligonucleotide; TTG chr11 5269593 5269614 5269610 5269615 +
gggttgcccaggatggcagagg

SEQ ID NO: 91565 - DNA, 22 bp, Artificial Sequence
  Synthetic oligonucleotide; TTG chr11 5269599 5269620 5269616 5269621 +
cccaggatggcagagggagacg

SEQ ID NO: 91566 - DNA, 22 bp, Artificial Sequence
  Synthetic oligonucleotide; TTT chr11 5269629 5269650 5269646 5269651 +
ccaaagctgtcaaaaaatctct

SEQ ID NO: 91567 - DNA, 22 bp, Artificial Sequence
  Synthetic oligonucleotide; TTC chr11 5269630 5269651 5269647 5269652 +
caaagctgtcaaaaaatctctg

SEQ ID NO: 91568 - DNA, 22 bp, Artificial Sequence
  Synthetic oligonucleotide; CTG chr11 5269638 5269659 5269655 5269660 +
tcaaaaaatctctgggtccagg

SEQ ID NO: 91569 - DNA, 22 bp, Artificial Sequence
  Synthetic oligonucleotide; CTC chr11 5269650 5269671 5269667 5269672 +
tgggtccaggggtaaacaacga

SEQ ID NO: 91570 - DNA, 22 bp, Artificial Sequence
  Synthetic oligonucleotide; CTG chr11 5269652 5269673 5269669 5269674 +
ggtccaggggtaaacaacgagg

SEQ ID NO: 91571 - DNA, 22 bp, Artificial Sequence
  Synthetic oligonucleotide; CTA chr11 5269680 5269701 5269697 5269702 +
tgaaatgacaccatatcagata

SEQ ID NO: 91572 - DNA, 22 bp, Artificial Sequence
  Synthetic oligonucleotide; TTA chr11 5269710 5269731 5269727 5269732 +
gagatgcaaaaaatcttgagga

SEQ ID NO: 91573 - DNA, 22 bp, Artificial Sequence
  Synthetic oligonucleotide; CTT chr11 5269727 5269748 5269744 5269749 +
gaggactttcccaatcaacttg

SEQ ID NO: 91574 - DNA, 22 bp, Artificial Sequence
  Synthetic oligonucleotide; TTG chr11 5269728 5269749 5269745 5269750 +
aggactttcccaatcaacttgc

SEQ ID NO: 91575 - DNA, 22 bp, Artificial Sequence
  Synthetic oligonucleotide; CTT chr11 5269735 5269756 5269752 5269757 +
tcccaatcaacttgctagggta

SEQ ID NO: 91576 - DNA, 22 bp, Artificial Sequence
  Synthetic oligonucleotide; TTT chr11 5269736 5269757 5269753 5269758 +
cccaatcaacttgctagggtaa

SEQ ID NO: 91577 - DNA, 22 bp, Artificial Sequence
  Synthetic oligonucleotide; TTC chr11 5269737 5269758 5269754 5269759 +
ccaatcaacttgctagggtaat

SEQ ID NO: 91578 - DNA, 22 bp, Artificial Sequence
  Synthetic oligonucleotide; CTT chr11 5269748 5269769 5269765 5269770 +
gctagggtaatattcacccttc

SEQ ID NO: 91579 - DNA, 22 bp, Artificial Sequence
  Synthetic oligonucleotide; TTG chr11 5269749 5269770 5269766 5269771 +
ctagggtaatattcacccttca

SEQ ID NO: 91580 - DNA, 22 bp, Artificial Sequence
  Synthetic oligonucleotide; CTA chr11 5269752 5269773 5269769 5269774 +
gggtaatattcacccttcattc

SEQ ID NO: 91581 - DNA, 22 bp, Artificial Sequence
  Synthetic oligonucleotide; TTC chr11 5269763 5269784 5269780 5269785 +
acccttcattcccatgcattga

SEQ ID NO: 91582 - DNA, 22 bp, Artificial Sequence
  Synthetic oligonucleotide; CTT chr11 5269769 5269790 5269786 5269791 +
cattcccatgcattgagaacca

SEQ ID NO: 91583 - DNA, 22 bp, Artificial Sequence
  Synthetic oligonucleotide; TTC chr11 5269770 5269791 5269787 5269792 +
attcccatgcattgagaaccaa

SEQ ID NO: 91584 - DNA, 22 bp, Artificial Sequence
  Synthetic oligonucleotide; TTC chr11 5269774 5269795 5269791 5269796 +
ccatgcattgagaaccaatgct

SEQ ID NO: 91585 - DNA, 22 bp, Artificial Sequence
  Synthetic oligonucleotide; TTG chr11 5269784 5269805 5269801 5269806 +
agaaccaatgcttacctgccca

SEQ ID NO: 91586 - DNA, 22 bp, Artificial Sequence
  Synthetic oligonucleotide; CTT chr11 5269797 5269818 5269814 5269819 +
acctgcccaaggcttcacctcc

SEQ ID NO: 91587 - DNA, 22 bp, Artificial Sequence
  Synthetic oligonucleotide; TTA chr11 5269798 5269819 5269815 5269820 +
cctgcccaaggcttcacctcca

SEQ ID NO: 91588 - DNA, 22 bp, Artificial Sequence
  Synthetic oligonucleotide; CTG chr11 5269802 5269823 5269819 5269824 +
cccaaggcttcacctccagcct

SEQ ID NO: 91589 - DNA, 22 bp, Artificial Sequence
  Synthetic oligonucleotide; CTT chr11 5269812 5269833 5269829 5269834 +
cacctccagcctcttccacatt

SEQ ID NO: 91590 - DNA, 22 bp, Artificial Sequence
  Synthetic oligonucleotide; TTC chr11 5269813 5269834 5269830 5269835 +
acctccagcctcttccacattc

SEQ ID NO: 91591 - DNA, 22 bp, Artificial Sequence
  Synthetic oligonucleotide; CTC chr11 5269818 5269839 5269835 5269840 +
cagcctcttccacattcatctt

SEQ ID NO: 91592 - DNA, 22 bp, Artificial Sequence
  Synthetic oligonucleotide; CTC chr11 5269825 5269846 5269842 5269847 +
ttccacattcatcttgctccac

SEQ ID NO: 91593 - DNA, 22 bp, Artificial Sequence
  Synthetic oligonucleotide; CTT chr11 5269827 5269848 5269844 5269849 +
ccacattcatcttgctccacag

SEQ ID NO: 91594 - DNA, 22 bp, Artificial Sequence
  Synthetic oligonucleotide; TTC chr11 5269828 5269849 5269845 5269850 +
cacattcatcttgctccacagg

SEQ ID NO: 91595 - DNA, 22 bp, Artificial Sequence
  Synthetic oligonucleotide; TTC chr11 5269835 5269856 5269852 5269857 +
atcttgctccacaggctagtga

SEQ ID NO: 91596 - DNA, 22 bp, Artificial Sequence
  Synthetic oligonucleotide; CTT chr11 5269840 5269861 5269857 5269862 +
gctccacaggctagtgacggca

SEQ ID NO: 91597 - DNA, 22 bp, Artificial Sequence
  Synthetic oligonucleotide; TTG chr11 5269841 5269862 5269858 5269863 +
ctccacaggctagtgacggcag

SEQ ID NO: 91598 - DNA, 22 bp, Artificial Sequence
  Synthetic oligonucleotide; CTC chr11 5269844 5269865 5269861 5269866 +
cacaggctagtgacggcagcct

SEQ ID NO: 91599 - DNA, 22 bp, Artificial Sequence
  Synthetic oligonucleotide; CTA chr11 5269853 5269874 5269870 5269875 +
gtgacggcagccttctcctcag

SEQ ID NO: 91600 - DNA, 22 bp, Artificial Sequence
  Synthetic oligonucleotide; CTT chr11 5269867 5269888 5269884 5269889 +
ctcctcagcagtaaaatgcacc

SEQ ID NO: 91601 - DNA, 22 bp, Artificial Sequence
  Synthetic oligonucleotide; TTC chr11 5269868 5269889 5269885 5269890 +
tcctcagcagtaaaatgcacca

SEQ ID NO: 91602 - DNA, 22 bp, Artificial Sequence
  Synthetic oligonucleotide; CTC chr11 5269870 5269891 5269887 5269892 +
ctcagcagtaaaatgcaccatg

SEQ ID NO: 91603 - DNA, 22 bp, Artificial Sequence
  Synthetic oligonucleotide; CTC chr11 5269873 5269894 5269890 5269895 +
agcagtaaaatgcaccatgatg

SEQ ID NO: 91604 - DNA, 22 bp, Artificial Sequence
  Synthetic oligonucleotide; CTG chr11 5269904 5269925 5269921 5269926 +
agagcttgctagtgattgcagc

SEQ ID NO: 91605 - DNA, 22 bp, Artificial Sequence
  Synthetic oligonucleotide; CTT chr11 5269911 5269932 5269928 5269933 +
gctagtgattgcagctgtgtcg

SEQ ID NO: 91606 - DNA, 22 bp, Artificial Sequence
  Synthetic oligonucleotide; TTG chr11 5269912 5269933 5269929 5269934 +
ctagtgattgcagctgtgtcgg

SEQ ID NO: 91607 - DNA, 22 bp, Artificial Sequence
  Synthetic oligonucleotide; CTA chr11 5269915 5269936 5269932 5269937 +
gtgattgcagctgtgtcggaag

SEQ ID NO: 91608 - DNA, 22 bp, Artificial Sequence
  Synthetic oligonucleotide; TTG chr11 5269922 5269943 5269939 5269944 +
cagctgtgtcggaagcagatat

SEQ ID NO: 91609 - DNA, 22 bp, Artificial Sequence
  Synthetic oligonucleotide; CTG chr11 5269928 5269949 5269945 5269950 +
tgtcggaagcagatatgtgctg

SEQ ID NO: 91610 - DNA, 22 bp, Artificial Sequence
  Synthetic oligonucleotide; CTG chr11 5269950 5269971 5269967 5269972 +
ctgcctctctgtctggcctttt

SEQ ID NO: 91611 - DNA, 22 bp, Artificial Sequence
  Synthetic oligonucleotide; CTG chr11 5269953 5269974 5269970 5269975 +
cctctctgtctggccttttatt

SEQ ID NO: 91612 - DNA, 22 bp, Artificial Sequence
  Synthetic oligonucleotide; CTC chr11 5269957 5269978 5269974 5269979 +
tctgtctggccttttattcttt

SEQ ID NO: 91613 - DNA, 22 bp, Artificial Sequence
  Synthetic oligonucleotide; CTC chr11 5269959 5269980 5269976 5269981 +
tgtctggccttttattctttac

SEQ ID NO: 91614 - DNA, 22 bp, Artificial Sequence
  Synthetic oligonucleotide; CTG chr11 5269961 5269982 5269978 5269983 +
tctggccttttattctttactg

SEQ ID NO: 91615 - DNA, 22 bp, Artificial Sequence
  Synthetic oligonucleotide; CTG chr11 5269965 5269986 5269982 5269987 +
gccttttattctttactgccga

SEQ ID NO: 91616 - DNA, 22 bp, Artificial Sequence
  Synthetic oligonucleotide; CTT chr11 5269970 5269991 5269987 5269992 +
ttattctttactgccgaagttc

SEQ ID NO: 91617 - DNA, 22 bp, Artificial Sequence
  Synthetic oligonucleotide; TTT chr11 5269971 5269992 5269988 5269993 +
tattctttactgccgaagttct

SEQ ID NO: 91618 - DNA, 22 bp, Artificial Sequence
  Synthetic oligonucleotide; TTT chr11 5269972 5269993 5269989 5269994 +
attctttactgccgaagttctg

SEQ ID NO: 91619 - DNA, 22 bp, Artificial Sequence
  Synthetic oligonucleotide; TTA chr11 5269973 5269994 5269990 5269995 +
ttctttactgccgaagttctgg

SEQ ID NO: 91620 - DNA, 22 bp, Artificial Sequence
  Synthetic oligonucleotide; TTC chr11 5269976 5269997 5269993 5269998 +
tttactgccgaagttctggccc

SEQ ID NO: 91621 - DNA, 22 bp, Artificial Sequence
  Synthetic oligonucleotide; CTT chr11 5269978 5269999 5269995 5270000 +
tactgccgaagttctggccccc

SEQ ID NO: 91622 - DNA, 22 bp, Artificial Sequence
  Synthetic oligonucleotide; TTT chr11 5269979 5270000 5269996 5270001 +
actgccgaagttctggccccct

SEQ ID NO: 91623 - DNA, 22 bp, Artificial Sequence
  Synthetic oligonucleotide; TTA chr11 5269980 5270001 5269997 5270002 +
ctgccgaagttctggccccctg

SEQ ID NO: 91624 - DNA, 22 bp, Artificial Sequence
  Synthetic oligonucleotide; CTG chr11 5269983 5270004 5270000 5270005 +
ccgaagttctggccccctgttc

SEQ ID NO: 91625 - DNA, 22 bp, Artificial Sequence
  Synthetic oligonucleotide; TTC chr11 5269992 5270013 5270009 5270014 +
tggccccctgttctccatggta

SEQ ID NO: 91626 - DNA, 22 bp, Artificial Sequence
  Synthetic oligonucleotide; CTG chr11 5269994 5270015 5270011 5270016 +
gccccctgttctccatggtact

SEQ ID NO: 91627 - DNA, 22 bp, Artificial Sequence
  Synthetic oligonucleotide; CTG chr11 5270002 5270023 5270019 5270024 +
ttctccatggtacttaaaagtc

SEQ ID NO: 91628 - DNA, 22 bp, Artificial Sequence
  Synthetic oligonucleotide; TTC chr11 5270005 5270026 5270022 5270027 +
tccatggtacttaaaagtcatt

SEQ ID NO: 91629 - DNA, 22 bp, Artificial Sequence
  Synthetic oligonucleotide; CTC chr11 5270007 5270028 5270024 5270029 +
catggtacttaaaagtcattgg

SEQ ID NO: 91630 - DNA, 22 bp, Artificial Sequence
  Synthetic oligonucleotide; CTT chr11 5270017 5270038 5270034 5270039 +
aaaagtcattggtcaaggctga

SEQ ID NO: 91631 - DNA, 22 bp, Artificial Sequence
  Synthetic oligonucleotide; TTA chr11 5270018 5270039 5270035 5270040 +
aaagtcattggtcaaggctgac

SEQ ID NO: 91632 - DNA, 22 bp, Artificial Sequence
  Synthetic oligonucleotide; TTG chr11 5270028 5270049 5270045 5270050 +
gtcaaggctgacctgtgtccct

SEQ ID NO: 91633 - DNA, 22 bp, Artificial Sequence
  Synthetic oligonucleotide; CTG chr11 5270038 5270059 5270055 5270060 +
acctgtgtccctcaggggtgga

SEQ ID NO: 91634 - DNA, 22 bp, Artificial Sequence
  Synthetic oligonucleotide; CTG chr11 5270043 5270064 5270060 5270065 +
tgtccctcaggggtggagtcag

SEQ ID NO: 91635 - DNA, 22 bp, Artificial Sequence
  Synthetic oligonucleotide; CTC chr11 5270051 5270072 5270068 5270073 +
aggggtggagtcaggtccggag

SEQ ID NO: 91636 - DNA, 22 bp, Artificial Sequence
  Synthetic oligonucleotide; CTA chr11 5270100 5270121 5270117 5270122 +
agtttgtgataatgtgtgctgg

SEQ ID NO: 91637 - DNA, 22 bp, Artificial Sequence
  Synthetic oligonucleotide; TTT chr11 5270105 5270126 5270122 5270127 +
gtgataatgtgtgctggatcct

SEQ ID NO: 91638 - DNA, 22 bp, Artificial Sequence
  Synthetic oligonucleotide; TTG chr11 5270106 5270127 5270123 5270128 +
tgataatgtgtgctggatcctg

SEQ ID NO: 91639 - DNA, 22 bp, Artificial Sequence
  Synthetic oligonucleotide; CTG chr11 5270121 5270142 5270138 5270143 +
gatcctgaggctcttttttgtt

SEQ ID NO: 91640 - DNA, 22 bp, Artificial Sequence
  Synthetic oligonucleotide; CTG chr11 5270128 5270149 5270145 5270150 +
aggctcttttttgttggctcct

SEQ ID NO: 91641 - DNA, 22 bp, Artificial Sequence
  Synthetic oligonucleotide; CTC chr11 5270134 5270155 5270151 5270156 +
ttttttgttggctcctcatcta

SEQ ID NO: 91642 - DNA, 22 bp, Artificial Sequence
  Synthetic oligonucleotide; CTT chr11 5270136 5270157 5270153 5270158 +
ttttgttggctcctcatctatc

SEQ ID NO: 91643 - DNA, 22 bp, Artificial Sequence
  Synthetic oligonucleotide; TTT chr11 5270137 5270158 5270154 5270159 +
tttgttggctcctcatctatct

SEQ ID NO: 91644 - DNA, 22 bp, Artificial Sequence
  Synthetic oligonucleotide; TTT chr11 5270138 5270159 5270155 5270160 +
ttgttggctcctcatctatctg

SEQ ID NO: 91645 - DNA, 22 bp, Artificial Sequence
  Synthetic oligonucleotide; TTT chr11 5270139 5270160 5270156 5270161 +
tgttggctcctcatctatctgc

SEQ ID NO: 91646 - DNA, 22 bp, Artificial Sequence
  Synthetic oligonucleotide; TTT chr11 5270140 5270161 5270157 5270162 +
gttggctcctcatctatctgca

SEQ ID NO: 91647 - DNA, 22 bp, Artificial Sequence
  Synthetic oligonucleotide; TTG chr11 5270141 5270162 5270158 5270163 +
ttggctcctcatctatctgcaa

SEQ ID NO: 91648 - DNA, 22 bp, Artificial Sequence
  Synthetic oligonucleotide; TTG chr11 5270144 5270165 5270161 5270166 +
gctcctcatctatctgcaacac

SEQ ID NO: 91649 - DNA, 22 bp, Artificial Sequence
  Synthetic oligonucleotide; CTC chr11 5270148 5270169 5270165 5270170 +
ctcatctatctgcaacacaaat

SEQ ID NO: 91650 - DNA, 22 bp, Artificial Sequence
  Synthetic oligonucleotide; CTC chr11 5270151 5270172 5270168 5270173 +
atctatctgcaacacaaatttc

SEQ ID NO: 91651 - DNA, 22 bp, Artificial Sequence
  Synthetic oligonucleotide; CTA chr11 5270156 5270177 5270173 5270178 +
tctgcaacacaaatttccattt

SEQ ID NO: 91652 - DNA, 22 bp, Artificial Sequence
  Synthetic oligonucleotide; CTG chr11 5270160 5270181 5270177 5270182 +
caacacaaatttccatttgtcc

SEQ ID NO: 91653 - DNA, 22 bp, Artificial Sequence
  Synthetic oligonucleotide; TTT chr11 5270172 5270193 5270189 5270194 +
ccatttgtccccttttttaccc

SEQ ID NO: 91654 - DNA, 22 bp, Artificial Sequence
  Synthetic oligonucleotide; TTC chr11 5270173 5270194 5270190 5270195 +
catttgtccccttttttaccct

SEQ ID NO: 91655 - DNA, 22 bp, Artificial Sequence
  Synthetic oligonucleotide; TTT chr11 5270178 5270199 5270195 5270200 +
gtccccttttttaccctcttca

SEQ ID NO: 91656 - DNA, 22 bp, Artificial Sequence
  Synthetic oligonucleotide; TTG chr11 5270179 5270200 5270196 5270201 +
tccccttttttaccctcttcat

SEQ ID NO: 91657 - DNA, 22 bp, Artificial Sequence
  Synthetic oligonucleotide; CTT chr11 5270186 5270207 5270203 5270208 +
ttttaccctcttcatcatcttc

SEQ ID NO: 91658 - DNA, 22 bp, Artificial Sequence
  Synthetic oligonucleotide; TTT chr11 5270187 5270208 5270204 5270209 +
tttaccctcttcatcatcttcc

SEQ ID NO: 91659 - DNA, 22 bp, Artificial Sequence
  Synthetic oligonucleotide; TTT chr11 5270188 5270209 5270205 5270210 +
ttaccctcttcatcatcttcca

SEQ ID NO: 91660 - DNA, 22 bp, Artificial Sequence
  Synthetic oligonucleotide; TTT chr11 5270189 5270210 5270206 5270211 +
taccctcttcatcatcttccaa

SEQ ID NO: 91661 - DNA, 22 bp, Artificial Sequence
  Synthetic oligonucleotide; TTT chr11 5270190 5270211 5270207 5270212 +
accctcttcatcatcttccaaa

SEQ ID NO: 91662 - DNA, 22 bp, Artificial Sequence
  Synthetic oligonucleotide; TTA chr11 5270191 5270212 5270208 5270213 +
ccctcttcatcatcttccaaaa

SEQ ID NO: 91663 - DNA, 22 bp, Artificial Sequence
  Synthetic oligonucleotide; CTC chr11 5270196 5270217 5270213 5270218 +
ttcatcatcttccaaaatgata

SEQ ID NO: 91664 - DNA, 22 bp, Artificial Sequence
  Synthetic oligonucleotide; CTT chr11 5270198 5270219 5270215 5270220 +
catcatcttccaaaatgatatc

SEQ ID NO: 91665 - DNA, 22 bp, Artificial Sequence
  Synthetic oligonucleotide; TTC chr11 5270199 5270220 5270216 5270221 +
atcatcttccaaaatgatatcc

SEQ ID NO: 91666 - DNA, 22 bp, Artificial Sequence
  Synthetic oligonucleotide; CTT chr11 5270207 5270228 5270224 5270229 +
ccaaaatgatatccatctctcc

SEQ ID NO: 91667 - DNA, 22 bp, Artificial Sequence
  Synthetic oligonucleotide; TTC chr11 5270208 5270229 5270225 5270230 +
caaaatgatatccatctctccc

SEQ ID NO: 91668 - DNA, 22 bp, Artificial Sequence
  Synthetic oligonucleotide; CTC chr11 5270226 5270247 5270243 5270248 +
tcccattctccttttccaagaa

SEQ ID NO: 91669 - DNA, 22 bp, Artificial Sequence
  Synthetic oligonucleotide; CTC chr11 5270228 5270249 5270245 5270250 +
ccattctccttttccaagaaag

SEQ ID NO: 91670 - DNA, 22 bp, Artificial Sequence
  Synthetic oligonucleotide; TTC chr11 5270234 5270255 5270251 5270256 +
tccttttccaagaaagcctcat

SEQ ID NO: 91671 - DNA, 22 bp, Artificial Sequence
  Synthetic oligonucleotide; CTC chr11 5270236 5270257 5270253 5270258 +
cttttccaagaaagcctcatat

SEQ ID NO: 91672 - DNA, 22 bp, Artificial Sequence
  Synthetic oligonucleotide; CTT chr11 5270239 5270260 5270256 5270261 +
ttccaagaaagcctcatataaa

SEQ ID NO: 91673 - DNA, 22 bp, Artificial Sequence
  Synthetic oligonucleotide; TTT chr11 5270240 5270261 5270257 5270262 +
tccaagaaagcctcatataaag

SEQ ID NO: 91674 - DNA, 22 bp, Artificial Sequence
  Synthetic oligonucleotide; TTT chr11 5270241 5270262 5270258 5270263 +
ccaagaaagcctcatataaagg

SEQ ID NO: 91675 - DNA, 22 bp, Artificial Sequence
  Synthetic oligonucleotide; TTC chr11 5270242 5270263 5270259 5270264 +
caagaaagcctcatataaagga

SEQ ID NO: 91676 - DNA, 22 bp, Artificial Sequence
  Synthetic oligonucleotide; CTC chr11 5270254 5270275 5270271 5270276 +
atataaaggagcaaatctcaaa

SEQ ID NO: 91677 - DNA, 22 bp, Artificial Sequence
  Synthetic oligonucleotide; CTC chr11 5270273 5270294 5270290 5270295 +
aaaataggaaaaaaagtttcag

SEQ ID NO: 91678 - DNA, 22 bp, Artificial Sequence
  Synthetic oligonucleotide; TTT chr11 5270292 5270313 5270309 5270314 +
cagccaaagcgcatttaacatt

SEQ ID NO: 91679 - DNA, 22 bp, Artificial Sequence
  Synthetic oligonucleotide; TTC chr11 5270293 5270314 5270310 5270315 +
agccaaagcgcatttaacattt

SEQ ID NO: 91680 - DNA, 22 bp, Artificial Sequence
  Synthetic oligonucleotide; TTT chr11 5270308 5270329 5270325 5270330 +
aacatttgccttaaaggtggtg

SEQ ID NO: 91681 - DNA, 22 bp, Artificial Sequence
  Synthetic oligonucleotide; TTA chr11 5270309 5270330 5270326 5270331 +
acatttgccttaaaggtggtga

SEQ ID NO: 91682 - DNA, 22 bp, Artificial Sequence
  Synthetic oligonucleotide; TTT chr11 5270315 5270336 5270332 5270337 +
gccttaaaggtggtgacagtga

SEQ ID NO: 91683 - DNA, 22 bp, Artificial Sequence
  Synthetic oligonucleotide; TTG chr11 5270316 5270337 5270333 5270338 +
ccttaaaggtggtgacagtgac

SEQ ID NO: 91684 - DNA, 22 bp, Artificial Sequence
  Synthetic oligonucleotide; CTT chr11 5270320 5270341 5270337 5270342 +
aaaggtggtgacagtgacaaaa

SEQ ID NO: 91685 - DNA, 22 bp, Artificial Sequence
  Synthetic oligonucleotide; TTA chr11 5270321 5270342 5270338 5270343 +
aaggtggtgacagtgacaaaaa

SEQ ID NO: 91686 - DNA, 22 bp, Artificial Sequence
  Synthetic oligonucleotide; CTG chr11 5270371 5270392 5270388 5270393 +
ttaaaacagaatctcacccagt

SEQ ID NO: 91687 - DNA, 22 bp, Artificial Sequence
  Synthetic oligonucleotide; TTA chr11 5270374 5270395 5270391 5270396 +
aaacagaatctcacccagttct

SEQ ID NO: 91688 - DNA, 22 bp, Artificial Sequence
  Synthetic oligonucleotide; CTC chr11 5270386 5270407 5270403 5270408 +
acccagttctagctctcttaag

SEQ ID NO: 91689 - DNA, 22 bp, Artificial Sequence
  Synthetic oligonucleotide; TTC chr11 5270395 5270416 5270412 5270417 +
tagctctcttaaggagtgcatt

SEQ ID NO: 91690 - DNA, 22 bp, Artificial Sequence
  Synthetic oligonucleotide; CTA chr11 5270397 5270418 5270414 5270419 +
gctctcttaaggagtgcattgt

SEQ ID NO: 91691 - DNA, 22 bp, Artificial Sequence
  Synthetic oligonucleotide; CTC chr11 5270401 5270422 5270418 5270423 +
tcttaaggagtgcattgtaaac

SEQ ID NO: 91692 - DNA, 22 bp, Artificial Sequence
  Synthetic oligonucleotide; CTC chr11 5270403 5270424 5270420 5270425 +
ttaaggagtgcattgtaaacaa

SEQ ID NO: 91693 - DNA, 22 bp, Artificial Sequence
  Synthetic oligonucleotide; CTT chr11 5270405 5270426 5270422 5270427 +
aaggagtgcattgtaaacaaaa

SEQ ID NO: 91694 - DNA, 22 bp, Artificial Sequence
  Synthetic oligonucleotide; TTA chr11 5270406 5270427 5270423 5270428 +
aggagtgcattgtaaacaaaac

SEQ ID NO: 91695 - DNA, 22 bp, Artificial Sequence
  Synthetic oligonucleotide; TTG chr11 5270418 5270439 5270435 5270440 +
taaacaaaacttctgtacctta

SEQ ID NO: 91696 - DNA, 22 bp, Artificial Sequence
  Synthetic oligonucleotide; CTT chr11 5270430 5270451 5270447 5270452 +
ctgtaccttagtttctctaggg

SEQ ID NO: 91697 - DNA, 22 bp, Artificial Sequence
  Synthetic oligonucleotide; TTC chr11 5270431 5270452 5270448 5270453 +
tgtaccttagtttctctaggga

SEQ ID NO: 91698 - DNA, 22 bp, Artificial Sequence
  Synthetic oligonucleotide; CTG chr11 5270433 5270454 5270450 5270455 +
taccttagtttctctagggaga

SEQ ID NO: 91699 - DNA, 22 bp, Artificial Sequence
  Synthetic oligonucleotide; CTT chr11 5270439 5270460 5270456 5270461 +
agtttctctagggagacaaaaa

SEQ ID NO: 91700 - DNA, 22 bp, Artificial Sequence
  Synthetic oligonucleotide; TTA chr11 5270440 5270461 5270457 5270462 +
gtttctctagggagacaaaaac

SEQ ID NO: 91701 - DNA, 22 bp, Artificial Sequence
  Synthetic oligonucleotide; TTT chr11 5270444 5270465 5270461 5270466 +
ctctagggagacaaaaaccgta

SEQ ID NO: 91702 - DNA, 22 bp, Artificial Sequence
  Synthetic oligonucleotide; TTC chr11 5270445 5270466 5270462 5270467 +
tctagggagacaaaaaccgtac

SEQ ID NO: 91703 - DNA, 22 bp, Artificial Sequence
  Synthetic oligonucleotide; CTC chr11 5270447 5270468 5270464 5270469 +
tagggagacaaaaaccgtacat

SEQ ID NO: 91704 - DNA, 22 bp, Artificial Sequence
  Synthetic oligonucleotide; CTA chr11 5270449 5270470 5270466 5270471 +
gggagacaaaaaccgtacatag

SEQ ID NO: 91705 - DNA, 22 bp, Artificial Sequence
  Synthetic oligonucleotide; TTC chr11 5270474 5270495 5270491 5270496 +
cttctagaaactgaacagaata

SEQ ID NO: 91706 - DNA, 22 bp, Artificial Sequence
  Synthetic oligonucleotide; CTT chr11 5270477 5270498 5270494 5270499 +
ctagaaactgaacagaatagca

SEQ ID NO: 91707 - DNA, 22 bp, Artificial Sequence
  Synthetic oligonucleotide; TTC chr11 5270478 5270499 5270495 5270500 +
tagaaactgaacagaatagcaa

SEQ ID NO: 91708 - DNA, 22 bp, Artificial Sequence
  Synthetic oligonucleotide; CTA chr11 5270480 5270501 5270497 5270502 +
gaaactgaacagaatagcaagt

SEQ ID NO: 91709 - DNA, 22 bp, Artificial Sequence
  Synthetic oligonucleotide; CTG chr11 5270487 5270508 5270504 5270509 +
aacagaatagcaagtagtccac

SEQ ID NO: 91710 - DNA, 22 bp, Artificial Sequence
  Synthetic oligonucleotide; CTA chr11 5270519 5270540 5270536 5270541 +
aagccttaatcccaaagtacag

SEQ ID NO: 91711 - DNA, 22 bp, Artificial Sequence
  Synthetic oligonucleotide; CTT chr11 5270526 5270547 5270543 5270548 +
aatcccaaagtacagtaccttg

SEQ ID NO: 91712 - DNA, 22 bp, Artificial Sequence
  Synthetic oligonucleotide; TTA chr11 5270527 5270548 5270544 5270549 +
atcccaaagtacagtaccttgg

SEQ ID NO: 91713 - DNA, 22 bp, Artificial Sequence
  Synthetic oligonucleotide; CTT chr11 5270547 5270568 5270564 5270569 +
ggggtgattccctagagaggac

SEQ ID NO: 91714 - DNA, 22 bp, Artificial Sequence
  Synthetic oligonucleotide; TTG chr11 5270548 5270569 5270565 5270570 +
gggtgattccctagagaggaca

SEQ ID NO: 91715 - DNA, 22 bp, Artificial Sequence
  Synthetic oligonucleotide; TTC chr11 5270557 5270578 5270574 5270579 +
cctagagaggacagacagaaaa

SEQ ID NO: 91716 - DNA, 22 bp, Artificial Sequence
  Synthetic oligonucleotide; CTA chr11 5270561 5270582 5270578 5270583 +
gagaggacagacagaaaagatt

SEQ ID NO: 91717 - DNA, 22 bp, Artificial Sequence
  Synthetic oligonucleotide; TTA chr11 5270584 5270605 5270601 5270606 +
catccagtgcttccagagaatc

SEQ ID NO: 91718 - DNA, 22 bp, Artificial Sequence
  Synthetic oligonucleotide; CTT chr11 5270596 5270617 5270613 5270618 +
ccagagaatcctctctcttttc

SEQ ID NO: 91719 - DNA, 22 bp, Artificial Sequence
  Synthetic oligonucleotide; TTC chr11 5270597 5270618 5270614 5270619 +
cagagaatcctctctcttttca

SEQ ID NO: 91720 - DNA, 22 bp, Artificial Sequence
  Synthetic oligonucleotide; CTC chr11 5270609 5270630 5270626 5270631 +
tctcttttcatttctctatgac

SEQ ID NO: 91721 - DNA, 22 bp, Artificial Sequence
  Synthetic oligonucleotide; CTC chr11 5270611 5270632 5270628 5270633 +
tcttttcatttctctatgacca

SEQ ID NO: 91722 - DNA, 22 bp, Artificial Sequence
  Synthetic oligonucleotide; CTC chr11 5270613 5270634 5270630 5270635 +
ttttcatttctctatgaccaca

SEQ ID NO: 91723 - DNA, 22 bp, Artificial Sequence
  Synthetic oligonucleotide; CTT chr11 5270615 5270636 5270632 5270637 +
ttcatttctctatgaccacagg

SEQ ID NO: 91724 - DNA, 22 bp, Artificial Sequence
  Synthetic oligonucleotide; TTT chr11 5270616 5270637 5270633 5270638 +
tcatttctctatgaccacaggg

SEQ ID NO: 91725 - DNA, 22 bp, Artificial Sequence
  Synthetic oligonucleotide; TTT chr11 5270617 5270638 5270634 5270639 +
catttctctatgaccacagggg

SEQ ID NO: 91726 - DNA, 22 bp, Artificial Sequence
  Synthetic oligonucleotide; TTC chr11 5270618 5270639 5270635 5270640 +
atttctctatgaccacagggga

SEQ ID NO: 91727 - DNA, 22 bp, Artificial Sequence
  Synthetic oligonucleotide; TTT chr11 5270622 5270643 5270639 5270644 +
ctctatgaccacaggggacatt

SEQ ID NO: 91728 - DNA, 22 bp, Artificial Sequence
  Synthetic oligonucleotide; TTC chr11 5270623 5270644 5270640 5270645 +
tctatgaccacaggggacattg

SEQ ID NO: 91729 - DNA, 22 bp, Artificial Sequence
  Synthetic oligonucleotide; CTC chr11 5270625 5270646 5270642 5270647 +
tatgaccacaggggacattggc

SEQ ID NO: 91730 - DNA, 22 bp, Artificial Sequence
  Synthetic oligonucleotide; CTA chr11 5270627 5270648 5270644 5270649 +
tgaccacaggggacattggcta

SEQ ID NO: 91731 - DNA, 22 bp, Artificial Sequence
  Synthetic oligonucleotide; TTG chr11 5270645 5270666 5270662 5270667 +
gctactttgtgagtattgcctg

SEQ ID NO: 91732 - DNA, 22 bp, Artificial Sequence
  Synthetic oligonucleotide; CTA chr11 5270649 5270670 5270666 5270671 +
ctttgtgagtattgcctggggc

SEQ ID NO: 91733 - DNA, 22 bp, Artificial Sequence
  Synthetic oligonucleotide; CTT chr11 5270652 5270673 5270669 5270674 +
tgtgagtattgcctggggctct

SEQ ID NO: 91734 - DNA, 22 bp, Artificial Sequence
  Synthetic oligonucleotide; TTT chr11 5270653 5270674 5270670 5270675 +
gtgagtattgcctggggctctc

SEQ ID NO: 91735 - DNA, 22 bp, Artificial Sequence
  Synthetic oligonucleotide; TTG chr11 5270654 5270675 5270671 5270676 +
tgagtattgcctggggctctct

SEQ ID NO: 91736 - DNA, 22 bp, Artificial Sequence
  Synthetic oligonucleotide; TTG chr11 5270663 5270684 5270680 5270685 +
cctggggctctcttcttgcttg

SEQ ID NO: 91737 - DNA, 22 bp, Artificial Sequence
  Synthetic oligonucleotide; CTG chr11 5270667 5270688 5270684 5270689 +
gggctctcttcttgcttgcctg

SEQ ID NO: 91738 - DNA, 22 bp, Artificial Sequence
  Synthetic oligonucleotide; CTC chr11 5270673 5270694 5270690 5270695 +
tcttcttgcttgcctgtctgtc

SEQ ID NO: 91739 - DNA, 22 bp, Artificial Sequence
  Synthetic oligonucleotide; CTC chr11 5270675 5270696 5270692 5270697 +
ttcttgcttgcctgtctgtcct

SEQ ID NO: 91740 - DNA, 22 bp, Artificial Sequence
  Synthetic oligonucleotide; CTT chr11 5270677 5270698 5270694 5270699 +
cttgcttgcctgtctgtcctgc

SEQ ID NO: 91741 - DNA, 22 bp, Artificial Sequence
  Synthetic oligonucleotide; TTC chr11 5270678 5270699 5270695 5270700 +
ttgcttgcctgtctgtcctgct

SEQ ID NO: 91742 - DNA, 22 bp, Artificial Sequence
  Synthetic oligonucleotide; CTT chr11 5270680 5270701 5270697 5270702 +
gcttgcctgtctgtcctgctta

SEQ ID NO: 91743 - DNA, 22 bp, Artificial Sequence
  Synthetic oligonucleotide; TTG chr11 5270681 5270702 5270698 5270703 +
cttgcctgtctgtcctgcttat

SEQ ID NO: 91744 - DNA, 22 bp, Artificial Sequence
  Synthetic oligonucleotide; CTT chr11 5270684 5270705 5270701 5270706 +
gcctgtctgtcctgcttatact

SEQ ID NO: 91745 - DNA, 22 bp, Artificial Sequence
  Synthetic oligonucleotide; TTG chr11 5270685 5270706 5270702 5270707 +
cctgtctgtcctgcttatactt

SEQ ID NO: 91746 - DNA, 22 bp, Artificial Sequence
  Synthetic oligonucleotide; CTG chr11 5270689 5270710 5270706 5270711 +
tctgtcctgcttatacttctca

SEQ ID NO: 91747 - DNA, 22 bp, Artificial Sequence
  Synthetic oligonucleotide; CTG chr11 5270693 5270714 5270710 5270715 +
tcctgcttatacttctcactgg

SEQ ID NO: 91748 - DNA, 22 bp, Artificial Sequence
  Synthetic oligonucleotide; CTG chr11 5270698 5270719 5270715 5270720 +
cttatacttctcactgggaagg

SEQ ID NO: 91749 - DNA, 22 bp, Artificial Sequence
  Synthetic oligonucleotide; CTT chr11 5270701 5270722 5270718 5270723 +
atacttctcactgggaagggag

SEQ ID NO: 91750 - DNA, 22 bp, Artificial Sequence
  Synthetic oligonucleotide; TTA chr11 5270702 5270723 5270719 5270724 +
tacttctcactgggaagggagc

SEQ ID NO: 91751 - DNA, 22 bp, Artificial Sequence
  Synthetic oligonucleotide; CTT chr11 5270707 5270728 5270724 5270729 +
ctcactgggaagggagctgaga

SEQ ID NO: 91752 - DNA, 22 bp, Artificial Sequence
  Synthetic oligonucleotide; TTC chr11 5270708 5270729 5270725 5270730 +
tcactgggaagggagctgagaa

SEQ ID NO: 91753 - DNA, 22 bp, Artificial Sequence
  Synthetic oligonucleotide; CTC chr11 5270710 5270731 5270727 5270732 +
actgggaagggagctgagaagc

SEQ ID NO: 91754 - DNA, 22 bp, Artificial Sequence
  Synthetic oligonucleotide; CTG chr11 5270714 5270735 5270731 5270736 +
ggaagggagctgagaagcctaa

SEQ ID NO: 91755 - DNA, 22 bp, Artificial Sequence
  Synthetic oligonucleotide; CTG chr11 5270726 5270747 5270743 5270748 +
agaagcctaaaatcctaaaatt

SEQ ID NO: 91756 - DNA, 22 bp, Artificial Sequence
  Synthetic oligonucleotide; CTA chr11 5270735 5270756 5270752 5270757 +
aaatcctaaaattatttaaagc

SEQ ID NO: 91757 - DNA, 22 bp, Artificial Sequence
  Synthetic oligonucleotide; CTA chr11 5270743 5270764 5270760 5270765 +
aaattatttaaagccagaattt

SEQ ID NO: 91758 - DNA, 22 bp, Artificial Sequence
  Synthetic oligonucleotide; TTA chr11 5270749 5270770 5270766 5270771 +
tttaaagccagaatttgtcatc

SEQ ID NO: 91759 - DNA, 22 bp, Artificial Sequence
  Synthetic oligonucleotide; TTT chr11 5270752 5270773 5270769 5270774 +
aaagccagaatttgtcatcaaa

SEQ ID NO: 91760 - DNA, 22 bp, Artificial Sequence
  Synthetic oligonucleotide; TTA chr11 5270753 5270774 5270770 5270775 +
aagccagaatttgtcatcaaac

SEQ ID NO: 91761 - DNA, 22 bp, Artificial Sequence
  Synthetic oligonucleotide; TTT chr11 5270765 5270786 5270782 5270787 +
gtcatcaaacagagaaaaaagt

SEQ ID NO: 91762 - DNA, 22 bp, Artificial Sequence
  Synthetic oligonucleotide; TTG chr11 5270766 5270787 5270783 5270788 +
tcatcaaacagagaaaaaagtg

SEQ ID NO: 91763 - DNA, 22 bp, Artificial Sequence
  Synthetic oligonucleotide; TTA chr11 5270801 5270822 5270818 5270823 +
atcaggctaggagtcagggtat

SEQ ID NO: 91764 - DNA, 22 bp, Artificial Sequence
  Synthetic oligonucleotide; CTA chr11 5270810 5270831 5270827 5270832 +
ggagtcagggtatattattcct

SEQ ID NO: 91765 - DNA, 22 bp, Artificial Sequence
  Synthetic oligonucleotide; TTA chr11 5270827 5270848 5270844 5270849 +
ttcctctagtgtcctttttttt

SEQ ID NO: 91766 - DNA, 22 bp, Artificial Sequence
  Synthetic oligonucleotide; TTC chr11 5270830 5270851 5270847 5270852 +
ctctagtgtccttttttttttc

SEQ ID NO: 91767 - DNA, 22 bp, Artificial Sequence
  Synthetic oligonucleotide; CTC chr11 5270833 5270854 5270850 5270855 +
tagtgtccttttttttttctgt

SEQ ID NO: 91768 - DNA, 22 bp, Artificial Sequence
  Synthetic oligonucleotide; CTA chr11 5270835 5270856 5270852 5270857 +
gtgtccttttttttttctgtat

SEQ ID NO: 91769 - DNA, 22 bp, Artificial Sequence
  Synthetic oligonucleotide; CTT chr11 5270843 5270864 5270860 5270865 +
ttttttttctgtatgtccccat

SEQ ID NO: 91770 - DNA, 22 bp, Artificial Sequence
  Synthetic oligonucleotide; TTT chr11 5270844 5270865 5270861 5270866 +
tttttttctgtatgtccccatt

SEQ ID NO: 91771 - DNA, 22 bp, Artificial Sequence
  Synthetic oligonucleotide; TTT chr11 5270845 5270866 5270862 5270867 +
ttttttctgtatgtccccattt

SEQ ID NO: 91772 - DNA, 22 bp, Artificial Sequence
  Synthetic oligonucleotide; TTT chr11 5270846 5270867 5270863 5270868 +
tttttctgtatgtccccatttt

SEQ ID NO: 91773 - DNA, 22 bp, Artificial Sequence
  Synthetic oligonucleotide; TTT chr11 5270847 5270868 5270864 5270869 +
ttttctgtatgtccccattttg

SEQ ID NO: 91774 - DNA, 22 bp, Artificial Sequence
  Synthetic oligonucleotide; TTT chr11 5270848 5270869 5270865 5270870 +
tttctgtatgtccccattttga

SEQ ID NO: 91775 - DNA, 22 bp, Artificial Sequence
  Synthetic oligonucleotide; TTT chr11 5270849 5270870 5270866 5270871 +
ttctgtatgtccccattttgat

SEQ ID NO: 91776 - DNA, 22 bp, Artificial Sequence
  Synthetic oligonucleotide; TTT chr11 5270850 5270871 5270867 5270872 +
tctgtatgtccccattttgatg

SEQ ID NO: 91777 - DNA, 22 bp, Artificial Sequence
  Synthetic oligonucleotide; TTT chr11 5270851 5270872 5270868 5270873 +
ctgtatgtccccattttgatga

SEQ ID NO: 91778 - DNA, 22 bp, Artificial Sequence
  Synthetic oligonucleotide; TTC chr11 5270852 5270873 5270869 5270874 +
tgtatgtccccattttgatgac

SEQ ID NO: 91779 - DNA, 22 bp, Artificial Sequence
  Synthetic oligonucleotide; CTG chr11 5270854 5270875 5270871 5270876 +
tatgtccccattttgatgactt

SEQ ID NO: 91780 - DNA, 22 bp, Artificial Sequence
  Synthetic oligonucleotide; TTT chr11 5270867 5270888 5270884 5270889 +
tgatgacttgctagctctttac

SEQ ID NO: 91781 - DNA, 22 bp, Artificial Sequence
  Synthetic oligonucleotide; TTT chr11 5270868 5270889 5270885 5270890 +
gatgacttgctagctctttact

SEQ ID NO: 91782 - DNA, 22 bp, Artificial Sequence
  Synthetic oligonucleotide; TTG chr11 5270869 5270890 5270886 5270891 +
atgacttgctagctctttactt

SEQ ID NO: 91783 - DNA, 22 bp, Artificial Sequence
  Synthetic oligonucleotide; CTT chr11 5270876 5270897 5270893 5270898 +
gctagctctttacttggtagag

SEQ ID NO: 91784 - DNA, 22 bp, Artificial Sequence
  Synthetic oligonucleotide; TTG chr11 5270877 5270898 5270894 5270899 +
ctagctctttacttggtagagc

SEQ ID NO: 91785 - DNA, 22 bp, Artificial Sequence
  Synthetic oligonucleotide; CTA chr11 5270880 5270901 5270897 5270902 +
gctctttacttggtagagctga

SEQ ID NO: 91786 - DNA, 22 bp, Artificial Sequence
  Synthetic oligonucleotide; CTC chr11 5270884 5270905 5270901 5270906 +
tttacttggtagagctgaaact

SEQ ID NO: 91787 - DNA, 22 bp, Artificial Sequence
  Synthetic oligonucleotide; CTT chr11 5270886 5270907 5270903 5270908 +
tacttggtagagctgaaactgg

SEQ ID NO: 91788 - DNA, 22 bp, Artificial Sequence
  Synthetic oligonucleotide; TTT chr11 5270887 5270908 5270904 5270909 +
acttggtagagctgaaactgga

SEQ ID NO: 91789 - DNA, 22 bp, Artificial Sequence
  Synthetic oligonucleotide; TTA chr11 5270888 5270909 5270905 5270910 +
cttggtagagctgaaactggaa

SEQ ID NO: 91790 - DNA, 22 bp, Artificial Sequence
  Synthetic oligonucleotide; CTT chr11 5270891 5270912 5270908 5270913 +
ggtagagctgaaactggaagtt

SEQ ID NO: 91791 - DNA, 22 bp, Artificial Sequence
  Synthetic oligonucleotide; TTG chr11 5270892 5270913 5270909 5270914 +
gtagagctgaaactggaagttg

SEQ ID NO: 91792 - DNA, 22 bp, Artificial Sequence
  Synthetic oligonucleotide; CTG chr11 5270901 5270922 5270918 5270923 +
aaactggaagttgggatttaca

SEQ ID NO: 91793 - DNA, 22 bp, Artificial Sequence
  Synthetic oligonucleotide; CTG chr11 5270907 5270928 5270924 5270929 +
gaagttgggatttacagtgtat

SEQ ID NO: 91794 - DNA, 22 bp, Artificial Sequence
  Synthetic oligonucleotide; TTG chr11 5270914 5270935 5270931 5270936 +
ggatttacagtgtattcaattc

SEQ ID NO: 91795 - DNA, 22 bp, Artificial Sequence
  Synthetic oligonucleotide; TTT chr11 5270920 5270941 5270937 5270942 +
acagtgtattcaattcgatcca

SEQ ID NO: 91796 - DNA, 22 bp, Artificial Sequence
  Synthetic oligonucleotide; TTA chr11 5270921 5270942 5270938 5270943 +
cagtgtattcaattcgatccat

SEQ ID NO: 91797 - DNA, 22 bp, Artificial Sequence
  Synthetic oligonucleotide; TTC chr11 5270931 5270952 5270948 5270953 +
aattcgatccatgtgcctgaag

SEQ ID NO: 91798 - DNA, 22 bp, Artificial Sequence
  Synthetic oligonucleotide; TTC chr11 5270936 5270957 5270953 5270958 +
gatccatgtgcctgaagaatat

SEQ ID NO: 91799 - DNA, 22 bp, Artificial Sequence
  Synthetic oligonucleotide; CTG chr11 5270950 5270971 5270967 5270972 +
aagaatattgctcatgctatat

SEQ ID NO: 91800 - DNA, 22 bp, Artificial Sequence
  Synthetic oligonucleotide; TTG chr11 5270960 5270981 5270977 5270982 +
ctcatgctatatcacttaatct

SEQ ID NO: 91801 - DNA, 22 bp, Artificial Sequence
  Synthetic oligonucleotide; CTC chr11 5270963 5270984 5270980 5270985 +
atgctatatcacttaatctgcc

SEQ ID NO: 91802 - DNA, 22 bp, Artificial Sequence
  Synthetic oligonucleotide; CTA chr11 5270969 5270990 5270986 5270991 +
tatcacttaatctgcccttata

SEQ ID NO: 91803 - DNA, 22 bp, Artificial Sequence
  Synthetic oligonucleotide; CTT chr11 5270977 5270998 5270994 5270999 +
aatctgcccttataataccatt

SEQ ID NO: 91804 - DNA, 22 bp, Artificial Sequence
  Synthetic oligonucleotide; TTA chr11 5270978 5270999 5270995 5271000 +
atctgcccttataataccattg

SEQ ID NO: 91805 - DNA, 22 bp, Artificial Sequence
  Synthetic oligonucleotide; CTG chr11 5270983 5271004 5271000 5271005 +
cccttataataccattgtcatt

SEQ ID NO: 91806 - DNA, 22 bp, Artificial Sequence
  Synthetic oligonucleotide; CTT chr11 5270988 5271009 5271005 5271010 +
ataataccattgtcattatcct

SEQ ID NO: 91807 - DNA, 22 bp, Artificial Sequence
  Synthetic oligonucleotide; TTA chr11 5270989 5271010 5271006 5271011 +
taataccattgtcattatcctc

SEQ ID NO: 91808 - DNA, 22 bp, Artificial Sequence
  Synthetic oligonucleotide; TTG chr11 5271000 5271021 5271017 5271022 +
tcattatcctcatattttagaa

SEQ ID NO: 91809 - DNA, 22 bp, Artificial Sequence
  Synthetic oligonucleotide; TTA chr11 5271006 5271027 5271023 5271028 +
tcctcatattttagaatcaagg

SEQ ID NO: 91810 - DNA, 22 bp, Artificial Sequence
  Synthetic oligonucleotide; CTC chr11 5271011 5271032 5271028 5271033 +
atattttagaatcaaggaataa

SEQ ID NO: 91811 - DNA, 22 bp, Artificial Sequence
  Synthetic oligonucleotide; TTT chr11 5271017 5271038 5271034 5271039 +
tagaatcaaggaataaattcac

SEQ ID NO: 91812 - DNA, 22 bp, Artificial Sequence
  Synthetic oligonucleotide; TTT chr11 5271018 5271039 5271035 5271040 +
agaatcaaggaataaattcaca

SEQ ID NO: 91813 - DNA, 22 bp, Artificial Sequence
  Synthetic oligonucleotide; TTA chr11 5271019 5271040 5271036 5271041 +
gaatcaaggaataaattcacag

SEQ ID NO: 91814 - DNA, 22 bp, Artificial Sequence
  Synthetic oligonucleotide; TTC chr11 5271037 5271058 5271054 5271059 +
acagaaattatttaactatcaa

SEQ ID NO: 91815 - DNA, 22 bp, Artificial Sequence
  Synthetic oligonucleotide; TTA chr11 5271047 5271068 5271064 5271069 +
tttaactatcaatgtgacagaa

SEQ ID NO: 91816 - DNA, 22 bp, Artificial Sequence
  Synthetic oligonucleotide; TTT chr11 5271050 5271071 5271067 5271072 +
aactatcaatgtgacagaagta

SEQ ID NO: 91817 - DNA, 22 bp, Artificial Sequence
  Synthetic oligonucleotide; TTA chr11 5271051 5271072 5271068 5271073 +
actatcaatgtgacagaagtaa

SEQ ID NO: 91818 - DNA, 22 bp, Artificial Sequence
  Synthetic oligonucleotide; CTA chr11 5271055 5271076 5271072 5271077 +
tcaatgtgacagaagtaatgat

SEQ ID NO: 91819 - DNA, 22 bp, Artificial Sequence
  Synthetic oligonucleotide; TTG chr11 5271079 5271100 5271096 5271101 +
ggggaataatagaagcagagtt

SEQ ID NO: 91820 - DNA, 22 bp, Artificial Sequence
  Synthetic oligonucleotide; TTC chr11 5271102 5271123 5271119 5271124 +
cacaaattccagcattgttaat

SEQ ID NO: 91821 - DNA, 22 bp, Artificial Sequence
  Synthetic oligonucleotide; TTC chr11 5271111 5271132 5271128 5271133 +
cagcattgttaattctataaaa

SEQ ID NO: 91822 - DNA, 22 bp, Artificial Sequence
  Synthetic oligonucleotide; TTG chr11 5271119 5271140 5271136 5271141 +
ttaattctataaaagtccctta

SEQ ID NO: 91823 - DNA, 22 bp, Artificial Sequence
  Synthetic oligonucleotide; TTA chr11 5271122 5271143 5271139 5271144 +
attctataaaagtcccttacat

SEQ ID NO: 91824 - DNA, 22 bp, Artificial Sequence
  Synthetic oligonucleotide; TTC chr11 5271126 5271147 5271143 5271148 +
tataaaagtcccttacatcacc

SEQ ID NO: 91825 - DNA, 22 bp, Artificial Sequence
  Synthetic oligonucleotide; CTA chr11 5271128 5271149 5271145 5271150 +
taaaagtcccttacatcaccat

SEQ ID NO: 91826 - DNA, 22 bp, Artificial Sequence
  Synthetic oligonucleotide; CTT chr11 5271140 5271161 5271157 5271162 +
acatcaccataatctcattgcc

SEQ ID NO: 91827 - DNA, 22 bp, Artificial Sequence
  Synthetic oligonucleotide; TTA chr11 5271141 5271162 5271158 5271163 +
catcaccataatctcattgccc

SEQ ID NO: 91828 - DNA, 22 bp, Artificial Sequence
  Synthetic oligonucleotide; CTC chr11 5271156 5271177 5271173 5271178 +
attgccccagcccagttcctcc

SEQ ID NO: 91829 - DNA, 22 bp, Artificial Sequence
  Synthetic oligonucleotide; TTG chr11 5271160 5271181 5271177 5271182 +
ccccagcccagttcctccttct

SEQ ID NO: 91830 - DNA, 22 bp, Artificial Sequence
  Synthetic oligonucleotide; TTC chr11 5271174 5271195 5271191 5271196 +
ctccttctggcttgttctacat

SEQ ID NO: 91831 - DNA, 22 bp, Artificial Sequence
  Synthetic oligonucleotide; CTC chr11 5271177 5271198 5271194 5271199 +
cttctggcttgttctacatcca

SEQ ID NO: 91832 - DNA, 22 bp, Artificial Sequence
  Synthetic oligonucleotide; CTT chr11 5271180 5271201 5271197 5271202 +
ctggcttgttctacatccattt

SEQ ID NO: 91833 - DNA, 22 bp, Artificial Sequence
  Synthetic oligonucleotide; TTC chr11 5271181 5271202 5271198 5271203 +
tggcttgttctacatccattta

SEQ ID NO: 91834 - DNA, 22 bp, Artificial Sequence
  Synthetic oligonucleotide; CTG chr11 5271183 5271204 5271200 5271205 +
gcttgttctacatccatttatt

SEQ ID NO: 91835 - DNA, 22 bp, Artificial Sequence
  Synthetic oligonucleotide; CTT chr11 5271187 5271208 5271204 5271209 +
gttctacatccatttatttttt

SEQ ID NO: 91836 - DNA, 22 bp, Artificial Sequence
  Synthetic oligonucleotide; TTG chr11 5271188 5271209 5271205 5271210 +
ttctacatccatttattttttc

SEQ ID NO: 91837 - DNA, 22 bp, Artificial Sequence
  Synthetic oligonucleotide; TTC chr11 5271191 5271212 5271208 5271213 +
tacatccatttattttttcttt

SEQ ID NO: 91838 - DNA, 22 bp, Artificial Sequence
  Synthetic oligonucleotide; CTA chr11 5271193 5271214 5271210 5271215 +
catccatttattttttcttttt

SEQ ID NO: 91839 - DNA, 22 bp, Artificial Sequence
  Synthetic oligonucleotide; TTT chr11 5271202 5271223 5271219 5271224 +
attttttcttttttctttttct

SEQ ID NO: 91840 - DNA, 22 bp, Artificial Sequence
  Synthetic oligonucleotide; TTA chr11 5271203 5271224 5271220 5271225 +
ttttttcttttttctttttctt

SEQ ID NO: 91841 - DNA, 22 bp, Artificial Sequence
  Synthetic oligonucleotide; TTT chr11 5271206 5271227 5271223 5271228 +
tttcttttttctttttcttttc

SEQ ID NO: 91842 - DNA, 22 bp, Artificial Sequence
  Synthetic oligonucleotide; TTT chr11 5271207 5271228 5271224 5271229 +
ttcttttttctttttcttttct

SEQ ID NO: 91843 - DNA, 22 bp, Artificial Sequence
  Synthetic oligonucleotide; TTT chr11 5271208 5271229 5271225 5271230 +
tcttttttctttttcttttctt

SEQ ID NO: 91844 - DNA, 22 bp, Artificial Sequence
  Synthetic oligonucleotide; TTT chr11 5271209 5271230 5271226 5271231 +
cttttttctttttcttttcttt

SEQ ID NO: 91845 - DNA, 22 bp, Artificial Sequence
  Synthetic oligonucleotide; TTC chr11 5271210 5271231 5271227 5271232 +
ttttttctttttcttttctttc

SEQ ID NO: 91846 - DNA, 22 bp, Artificial Sequence
  Synthetic oligonucleotide; CTT chr11 5271212 5271233 5271229 5271234 +
ttttctttttcttttctttctt

SEQ ID NO: 91847 - DNA, 22 bp, Artificial Sequence
  Synthetic oligonucleotide; TTT chr11 5271213 5271234 5271230 5271235 +
tttctttttcttttctttcttt

SEQ ID NO: 91848 - DNA, 22 bp, Artificial Sequence
  Synthetic oligonucleotide; TTT chr11 5271214 5271235 5271231 5271236 +
ttctttttcttttctttctttc

SEQ ID NO: 91849 - DNA, 22 bp, Artificial Sequence
  Synthetic oligonucleotide; TTT chr11 5271215 5271236 5271232 5271237 +
tctttttcttttctttctttct

SEQ ID NO: 91850 - DNA, 22 bp, Artificial Sequence
  Synthetic oligonucleotide; TTT chr11 5271216 5271237 5271233 5271238 +
ctttttcttttctttctttctt

SEQ ID NO: 91851 - DNA, 22 bp, Artificial Sequence
  Synthetic oligonucleotide; TTC chr11 5271217 5271238 5271234 5271239 +
tttttcttttctttctttcttt

SEQ ID NO: 91852 - DNA, 22 bp, Artificial Sequence
  Synthetic oligonucleotide; CTT chr11 5271219 5271240 5271236 5271241 +
tttcttttctttctttcttttt

SEQ ID NO: 91853 - DNA, 22 bp, Artificial Sequence
  Synthetic oligonucleotide; TTT chr11 5271220 5271241 5271237 5271242 +
ttcttttctttctttctttttt

SEQ ID NO: 91854 - DNA, 22 bp, Artificial Sequence
  Synthetic oligonucleotide; TTT chr11 5271221 5271242 5271238 5271243 +
tcttttctttctttcttttttt

SEQ ID NO: 91855 - DNA, 22 bp, Artificial Sequence
  Synthetic oligonucleotide; TTT chr11 5271222 5271243 5271239 5271244 +
cttttctttctttctttttttt

SEQ ID NO: 91856 - DNA, 22 bp, Artificial Sequence
  Synthetic oligonucleotide; TTC chr11 5271223 5271244 5271240 5271245 +
ttttctttctttcttttttttt

SEQ ID NO: 91857 - DNA, 22 bp, Artificial Sequence
  Synthetic oligonucleotide; CTT chr11 5271225 5271246 5271242 5271247 +
ttctttctttcttttttttttt

SEQ ID NO: 91858 - DNA, 22 bp, Artificial Sequence
  Synthetic oligonucleotide; TTT chr11 5271226 5271247 5271243 5271248 +
tctttctttctttttttttttt

SEQ ID NO: 91859 - DNA, 22 bp, Artificial Sequence
  Synthetic oligonucleotide; TTT chr11 5271227 5271248 5271244 5271249 +
ctttctttcttttttttttttt

SEQ ID NO: 91860 - DNA, 22 bp, Artificial Sequence
  Synthetic oligonucleotide; TTC chr11 5271228 5271249 5271245 5271250 +
tttctttctttttttttttttt

SEQ ID NO: 91861 - DNA, 22 bp, Artificial Sequence
  Synthetic oligonucleotide; CTT chr11 5271230 5271251 5271247 5271252 +
tctttctttttttttttttttt

SEQ ID NO: 91862 - DNA, 22 bp, Artificial Sequence
  Synthetic oligonucleotide; TTT chr11 5271231 5271252 5271248 5271253 +
ctttcttttttttttttttttg

SEQ ID NO: 91863 - DNA, 22 bp, Artificial Sequence
  Synthetic oligonucleotide; TTC chr11 5271232 5271253 5271249 5271254 +
tttcttttttttttttttttga

SEQ ID NO: 91864 - DNA, 22 bp, Artificial Sequence
  Synthetic oligonucleotide; CTT chr11 5271234 5271255 5271251 5271256 +
tcttttttttttttttttgaga

SEQ ID NO: 91865 - DNA, 22 bp, Artificial Sequence
  Synthetic oligonucleotide; TTT chr11 5271235 5271256 5271252 5271257 +
cttttttttttttttttgagac

SEQ ID NO: 91866 - DNA, 22 bp, Artificial Sequence
  Synthetic oligonucleotide; TTC chr11 5271236 5271257 5271253 5271258 +
ttttttttttttttttgagacg

SEQ ID NO: 91867 - DNA, 22 bp, Artificial Sequence
  Synthetic oligonucleotide; CTT chr11 5271238 5271259 5271255 5271260 +
ttttttttttttttgagacgga

SEQ ID NO: 91868 - DNA, 22 bp, Artificial Sequence
  Synthetic oligonucleotide; TTT chr11 5271239 5271260 5271256 5271261 +
tttttttttttttgagacggag

SEQ ID NO: 91869 - DNA, 22 bp, Artificial Sequence
  Synthetic oligonucleotide; TTT chr11 5271240 5271261 5271257 5271262 +
ttttttttttttgagacggagt

SEQ ID NO: 91870 - DNA, 22 bp, Artificial Sequence
  Synthetic oligonucleotide; TTT chr11 5271241 5271262 5271258 5271263 +
tttttttttttgagacggagtc

SEQ ID NO: 91871 - DNA, 22 bp, Artificial Sequence
  Synthetic oligonucleotide; TTT chr11 5271242 5271263 5271259 5271264 +
ttttttttttgagacggagtct

SEQ ID NO: 91872 - DNA, 22 bp, Artificial Sequence
  Synthetic oligonucleotide; TTT chr11 5271243 5271264 5271260 5271265 +
tttttttttgagacggagtctc

SEQ ID NO: 91873 - DNA, 22 bp, Artificial Sequence
  Synthetic oligonucleotide; TTT chr11 5271244 5271265 5271261 5271266 +
ttttttttgagacggagtctca

SEQ ID NO: 91874 - DNA, 22 bp, Artificial Sequence
  Synthetic oligonucleotide; TTT chr11 5271245 5271266 5271262 5271267 +
tttttttgagacggagtctcac

SEQ ID NO: 91875 - DNA, 22 bp, Artificial Sequence
  Synthetic oligonucleotide; TTT chr11 5271246 5271267 5271263 5271268 +
ttttttgagacggagtctcact

SEQ ID NO: 91876 - DNA, 22 bp, Artificial Sequence
  Synthetic oligonucleotide; TTT chr11 5271247 5271268 5271264 5271269 +
tttttgagacggagtctcactc

SEQ ID NO: 91877 - DNA, 22 bp, Artificial Sequence
  Synthetic oligonucleotide; TTT chr11 5271248 5271269 5271265 5271270 +
ttttgagacggagtctcactct

SEQ ID NO: 91878 - DNA, 22 bp, Artificial Sequence
  Synthetic oligonucleotide; TTT chr11 5271249 5271270 5271266 5271271 +
tttgagacggagtctcactctg

SEQ ID NO: 91879 - DNA, 22 bp, Artificial Sequence
  Synthetic oligonucleotide; TTT chr11 5271250 5271271 5271267 5271272 +
ttgagacggagtctcactctgt

SEQ ID NO: 91880 - DNA, 22 bp, Artificial Sequence
  Synthetic oligonucleotide; TTT chr11 5271251 5271272 5271268 5271273 +
tgagacggagtctcactctgtt

SEQ ID NO: 91881 - DNA, 22 bp, Artificial Sequence
  Synthetic oligonucleotide; TTT chr11 5271252 5271273 5271269 5271274 +
gagacggagtctcactctgttg

SEQ ID NO: 91882 - DNA, 22 bp, Artificial Sequence
  Synthetic oligonucleotide; TTG chr11 5271253 5271274 5271270 5271275 +
agacggagtctcactctgttgc

SEQ ID NO: 91883 - DNA, 22 bp, Artificial Sequence
  Synthetic oligonucleotide; CTC chr11 5271265 5271286 5271282 5271287 +
actctgttgccagactggagtg

SEQ ID NO: 91884 - DNA, 22 bp, Artificial Sequence
  Synthetic oligonucleotide; CTC chr11 5271269 5271290 5271286 5271291 +
tgttgccagactggagtgcaat

SEQ ID NO: 91885 - DNA, 22 bp, Artificial Sequence
  Synthetic oligonucleotide; CTG chr11 5271271 5271292 5271288 5271293 +
ttgccagactggagtgcaatgg

SEQ ID NO: 91886 - DNA, 22 bp, Artificial Sequence
  Synthetic oligonucleotide; TTG chr11 5271274 5271295 5271291 5271296 +
ccagactggagtgcaatggcac

SEQ ID NO: 91887 - DNA, 22 bp, Artificial Sequence
  Synthetic oligonucleotide; CTG chr11 5271282 5271303 5271299 5271304 +
gagtgcaatggcactatctcag

SEQ ID NO: 91888 - DNA, 22 bp, Artificial Sequence
  Synthetic oligonucleotide; CTA chr11 5271298 5271319 5271315 5271320 +
tctcagctcactgcaaccttcg

SEQ ID NO: 91889 - DNA, 22 bp, Artificial Sequence
  Synthetic oligonucleotide; CTC chr11 5271302 5271323 5271319 5271324 +
agctcactgcaaccttcgcctc

SEQ ID NO: 91890 - DNA, 22 bp, Artificial Sequence
  Synthetic oligonucleotide; CTC chr11 5271307 5271328 5271324 5271329 +
actgcaaccttcgcctcctggg

SEQ ID NO: 91891 - DNA, 22 bp, Artificial Sequence
  Synthetic oligonucleotide; CTG chr11 5271311 5271332 5271328 5271333 +
caaccttcgcctcctgggttca

SEQ ID NO: 91892 - DNA, 22 bp, Artificial Sequence
  Synthetic oligonucleotide; CTT chr11 5271318 5271339 5271335 5271340 +
cgcctcctgggttcaaacgatt

SEQ ID NO: 91893 - DNA, 22 bp, Artificial Sequence
  Synthetic oligonucleotide; TTC chr11 5271319 5271340 5271336 5271341 +
gcctcctgggttcaaacgattc

SEQ ID NO: 91894 - DNA, 22 bp, Artificial Sequence
  Synthetic oligonucleotide; CTC chr11 5271324 5271345 5271341 5271346 +
ctgggttcaaacgattctcctg

SEQ ID NO: 91895 - DNA, 22 bp, Artificial Sequence
  Synthetic oligonucleotide; CTG chr11 5271327 5271348 5271344 5271349 +
ggttcaaacgattctcctgcct

SEQ ID NO: 91896 - DNA, 22 bp, Artificial Sequence
  Synthetic oligonucleotide; TTC chr11 5271332 5271353 5271349 5271354 +
aaacgattctcctgcctcagcc

SEQ ID NO: 91897 - DNA, 22 bp, Artificial Sequence
  Synthetic oligonucleotide; TTC chr11 5271341 5271362 5271358 5271363 +
tcctgcctcagcctcccgagca

SEQ ID NO: 91898 - DNA, 22 bp, Artificial Sequence
  Synthetic oligonucleotide; CTC chr11 5271343 5271364 5271360 5271365 +
ctgcctcagcctcccgagcagc

SEQ ID NO: 91899 - DNA, 22 bp, Artificial Sequence
  Synthetic oligonucleotide; CTG chr11 5271346 5271367 5271363 5271368 +
cctcagcctcccgagcagctgg

SEQ ID NO: 91900 - DNA, 22 bp, Artificial Sequence
  Synthetic oligonucleotide; CTC chr11 5271350 5271371 5271367 5271372 +
agcctcccgagcagctgggact

SEQ ID NO: 91901 - DNA, 22 bp, Artificial Sequence
  Synthetic oligonucleotide; CTC chr11 5271356 5271377 5271373 5271378 +
ccgagcagctgggactacaggc

SEQ ID NO: 91902 - DNA, 22 bp, Artificial Sequence
  Synthetic oligonucleotide; CTG chr11 5271367 5271388 5271384 5271389 +
ggactacaggcgcatgccacca

SEQ ID NO: 91903 - DNA, 22 bp, Artificial Sequence
  Synthetic oligonucleotide; CTA chr11 5271373 5271394 5271390 5271395 +
caggcgcatgccaccatgccca

SEQ ID NO: 91904 - DNA, 22 bp, Artificial Sequence
  Synthetic oligonucleotide; CTA chr11 5271399 5271420 5271416 5271421 +
atttttttatttttagtagaga

SEQ ID NO: 91905 - DNA, 22 bp, Artificial Sequence
  Synthetic oligonucleotide; TTT chr11 5271403 5271424 5271420 5271425 +
ttttatttttagtagagacggg

SEQ ID NO: 91906 - DNA, 22 bp, Artificial Sequence
  Synthetic oligonucleotide; TTT chr11 5271404 5271425 5271421 5271426 +
tttatttttagtagagacggga

SEQ ID NO: 91907 - DNA, 22 bp, Artificial Sequence
  Synthetic oligonucleotide; TTT chr11 5271405 5271426 5271422 5271427 +
ttatttttagtagagacgggat

SEQ ID NO: 91908 - DNA, 22 bp, Artificial Sequence
  Synthetic oligonucleotide; TTT chr11 5271406 5271427 5271423 5271428 +
tatttttagtagagacgggatt

SEQ ID NO: 91909 - DNA, 22 bp, Artificial Sequence
  Synthetic oligonucleotide; TTT chr11 5271407 5271428 5271424 5271429 +
atttttagtagagacgggattt

SEQ ID NO: 91910 - DNA, 22 bp, Artificial Sequence
  Synthetic oligonucleotide; TTA chr11 5271408 5271429 5271425 5271430 +
tttttagtagagacgggatttc

SEQ ID NO: 91911 - DNA, 22 bp, Artificial Sequence
  Synthetic oligonucleotide; TTT chr11 5271411 5271432 5271428 5271433 +
ttagtagagacgggatttcacc

SEQ ID NO: 91912 - DNA, 22 bp, Artificial Sequence
  Synthetic oligonucleotide; TTT chr11 5271412 5271433 5271429 5271434 +
tagtagagacgggatttcacca

SEQ ID NO: 91913 - DNA, 22 bp, Artificial Sequence
  Synthetic oligonucleotide; TTT chr11 5271413 5271434 5271430 5271435 +
agtagagacgggatttcaccat

SEQ ID NO: 91914 - DNA, 22 bp, Artificial Sequence
  Synthetic oligonucleotide; TTA chr11 5271414 5271435 5271431 5271436 +
gtagagacgggatttcaccatg

SEQ ID NO: 91915 - DNA, 22 bp, Artificial Sequence
  Synthetic oligonucleotide; TTT chr11 5271429 5271450 5271446 5271451 +
caccatgtttgccaggatggtc

SEQ ID NO: 91916 - DNA, 22 bp, Artificial Sequence
  Synthetic oligonucleotide; TTC chr11 5271430 5271451 5271447 5271452 +
accatgtttgccaggatggtct

SEQ ID NO: 91917 - DNA, 22 bp, Artificial Sequence
  Synthetic oligonucleotide; TTT chr11 5271439 5271460 5271456 5271461 +
gccaggatggtctcgatctctt

SEQ ID NO: 91918 - DNA, 22 bp, Artificial Sequence
  Synthetic oligonucleotide; TTG chr11 5271440 5271461 5271457 5271462 +
ccaggatggtctcgatctcttg

SEQ ID NO: 91919 - DNA, 22 bp, Artificial Sequence
  Synthetic oligonucleotide; CTC chr11 5271453 5271474 5271470 5271475 +
gatctcttgacctcatgatctg

SEQ ID NO: 91920 - DNA, 22 bp, Artificial Sequence
  Synthetic oligonucleotide; CTC chr11 5271459 5271480 5271476 5271481 +
ttgacctcatgatctgcccacc

SEQ ID NO: 91921 - DNA, 22 bp, Artificial Sequence
  Synthetic oligonucleotide; CTT chr11 5271461 5271482 5271478 5271483 +
gacctcatgatctgcccacctc

SEQ ID NO: 91922 - DNA, 22 bp, Artificial Sequence
  Synthetic oligonucleotide; TTG chr11 5271462 5271483 5271479 5271484 +
acctcatgatctgcccacctct

SEQ ID NO: 91923 - DNA, 22 bp, Artificial Sequence
  Synthetic oligonucleotide; CTC chr11 5271467 5271488 5271484 5271489 +
atgatctgcccacctctgcctc

SEQ ID NO: 91924 - DNA, 22 bp, Artificial Sequence
  Synthetic oligonucleotide; CTG chr11 5271475 5271496 5271492 5271497 +
cccacctctgcctccgtctcca

SEQ ID NO: 91925 - DNA, 22 bp, Artificial Sequence
  Synthetic oligonucleotide; CTC chr11 5271483 5271504 5271500 5271505 +
tgcctccgtctccatccatttc

SEQ ID NO: 91926 - DNA, 22 bp, Artificial Sequence
  Synthetic oligonucleotide; CTG chr11 5271485 5271506 5271502 5271507 +
cctccgtctccatccatttcta

SEQ ID NO: 91927 - DNA, 22 bp, Artificial Sequence
  Synthetic oligonucleotide; CTC chr11 5271489 5271510 5271506 5271511 +
cgtctccatccatttctaccat

SEQ ID NO: 91928 - DNA, 22 bp, Artificial Sequence
  Synthetic oligonucleotide; CTC chr11 5271495 5271516 5271512 5271517 +
catccatttctaccatttcttt

SEQ ID NO: 91929 - DNA, 22 bp, Artificial Sequence
  Synthetic oligonucleotide; TTT chr11 5271504 5271525 5271521 5271526 +
ctaccatttctttctcctatgg

SEQ ID NO: 91930 - DNA, 22 bp, Artificial Sequence
  Synthetic oligonucleotide; TTC chr11 5271505 5271526 5271522 5271527 +
taccatttctttctcctatggc

SEQ ID NO: 91931 - DNA, 22 bp, Artificial Sequence
  Synthetic oligonucleotide; CTA chr11 5271507 5271528 5271524 5271529 +
ccatttctttctcctatggctc

SEQ ID NO: 91932 - DNA, 22 bp, Artificial Sequence
  Synthetic oligonucleotide; TTT chr11 5271513 5271534 5271530 5271535 +
ctttctcctatggctccccttg

SEQ ID NO: 91933 - DNA, 22 bp, Artificial Sequence
  Synthetic oligonucleotide; TTC chr11 5271514 5271535 5271531 5271536 +
tttctcctatggctccccttgc

SEQ ID NO: 91934 - DNA, 22 bp, Artificial Sequence
  Synthetic oligonucleotide; CTT chr11 5271516 5271537 5271533 5271538 +
tctcctatggctccccttgccc

SEQ ID NO: 91935 - DNA, 22 bp, Artificial Sequence
  Synthetic oligonucleotide; TTT chr11 5271517 5271538 5271534 5271539 +
ctcctatggctccccttgcccc

SEQ ID NO: 91936 - DNA, 22 bp, Artificial Sequence
  Synthetic oligonucleotide; TTC chr11 5271518 5271539 5271535 5271540 +
tcctatggctccccttgcccca

SEQ ID NO: 91937 - DNA, 22 bp, Artificial Sequence
  Synthetic oligonucleotide; CTC chr11 5271520 5271541 5271537 5271542 +
ctatggctccccttgccccacc

SEQ ID NO: 91938 - DNA, 22 bp, Artificial Sequence
  Synthetic oligonucleotide; CTA chr11 5271523 5271544 5271540 5271545 +
tggctccccttgccccaccaga

SEQ ID NO: 91939 - DNA, 22 bp, Artificial Sequence
  Synthetic oligonucleotide; CTC chr11 5271529 5271550 5271546 5271551 +
cccttgccccaccagatctagg

SEQ ID NO: 91940 - DNA, 22 bp, Artificial Sequence
  Synthetic oligonucleotide; CTT chr11 5271534 5271555 5271551 5271556 +
gccccaccagatctaggaattt

SEQ ID NO: 91941 - DNA, 22 bp, Artificial Sequence
  Synthetic oligonucleotide; TTG chr11 5271535 5271556 5271552 5271557 +
ccccaccagatctaggaatttc

SEQ ID NO: 91942 - DNA, 22 bp, Artificial Sequence
  Synthetic oligonucleotide; CTA chr11 5271549 5271570 5271566 5271571 +
ggaatttctgttcctacaattt

SEQ ID NO: 91943 - DNA, 22 bp, Artificial Sequence
  Synthetic oligonucleotide; TTT chr11 5271556 5271577 5271573 5271578 +
ctgttcctacaatttcctgtat

SEQ ID NO: 91944 - DNA, 22 bp, Artificial Sequence
  Synthetic oligonucleotide; TTC chr11 5271557 5271578 5271574 5271579 +
tgttcctacaatttcctgtatg

SEQ ID NO: 91945 - DNA, 22 bp, Artificial Sequence
  Synthetic oligonucleotide; CTG chr11 5271559 5271580 5271576 5271581 +
ttcctacaatttcctgtatgtt

SEQ ID NO: 91946 - DNA, 22 bp, Artificial Sequence
  Synthetic oligonucleotide; TTC chr11 5271562 5271583 5271579 5271584 +
ctacaatttcctgtatgttcag

SEQ ID NO: 91947 - DNA, 22 bp, Artificial Sequence
  Synthetic oligonucleotide; CTA chr11 5271565 5271586 5271582 5271587 +
caatttcctgtatgttcaggcc

SEQ ID NO: 91948 - DNA, 22 bp, Artificial Sequence
  Synthetic oligonucleotide; TTT chr11 5271571 5271592 5271588 5271593 +
cctgtatgttcaggccctagag

SEQ ID NO: 91949 - DNA, 22 bp, Artificial Sequence
  Synthetic oligonucleotide; TTC chr11 5271572 5271593 5271589 5271594 +
ctgtatgttcaggccctagagg

SEQ ID NO: 91950 - DNA, 22 bp, Artificial Sequence
  Synthetic oligonucleotide; CTG chr11 5271575 5271596 5271592 5271597 +
tatgttcaggccctagaggttc

SEQ ID NO: 91951 - DNA, 22 bp, Artificial Sequence
  Synthetic oligonucleotide; TTC chr11 5271582 5271603 5271599 5271604 +
aggccctagaggttcttcgtct

SEQ ID NO: 91952 - DNA, 22 bp, Artificial Sequence
  Synthetic oligonucleotide; CTA chr11 5271590 5271611 5271607 5271612 +
gaggttcttcgtctttttcact

SEQ ID NO: 91953 - DNA, 22 bp, Artificial Sequence
  Synthetic oligonucleotide; TTC chr11 5271597 5271618 5271614 5271619 +
ttcgtctttttcacttagcagt

SEQ ID NO: 91954 - DNA, 22 bp, Artificial Sequence
  Synthetic oligonucleotide; CTT chr11 5271599 5271620 5271616 5271621 +
cgtctttttcacttagcagtat

SEQ ID NO: 91955 - DNA, 22 bp, Artificial Sequence
  Synthetic oligonucleotide; TTC chr11 5271600 5271621 5271617 5271622 +
gtctttttcacttagcagtatg

SEQ ID NO: 91956 - DNA, 22 bp, Artificial Sequence
  Synthetic oligonucleotide; CTT chr11 5271605 5271626 5271622 5271627 +
tttcacttagcagtatggctcc

SEQ ID NO: 91957 - DNA, 22 bp, Artificial Sequence
  Synthetic oligonucleotide; TTT chr11 5271606 5271627 5271623 5271628 +
ttcacttagcagtatggctcct

SEQ ID NO: 91958 - DNA, 22 bp, Artificial Sequence
  Synthetic oligonucleotide; TTT chr11 5271607 5271628 5271624 5271629 +
tcacttagcagtatggctcctg

SEQ ID NO: 91959 - DNA, 22 bp, Artificial Sequence
  Synthetic oligonucleotide; TTT chr11 5271608 5271629 5271625 5271630 +
cacttagcagtatggctcctgt

SEQ ID NO: 91960 - DNA, 22 bp, Artificial Sequence
  Synthetic oligonucleotide; TTC chr11 5271609 5271630 5271626 5271631 +
acttagcagtatggctcctgtc

SEQ ID NO: 91961 - DNA, 22 bp, Artificial Sequence
  Synthetic oligonucleotide; CTT chr11 5271613 5271634 5271630 5271635 +
agcagtatggctcctgtctccc

SEQ ID NO: 91962 - DNA, 22 bp, Artificial Sequence
  Synthetic oligonucleotide; TTA chr11 5271614 5271635 5271631 5271636 +
gcagtatggctcctgtctccca

SEQ ID NO: 91963 - DNA, 22 bp, Artificial Sequence
  Synthetic oligonucleotide; CTC chr11 5271626 5271647 5271643 5271648 +
ctgtctcccaagtcaagtgcct

SEQ ID NO: 91964 - DNA, 22 bp, Artificial Sequence
  Synthetic oligonucleotide; CTG chr11 5271629 5271650 5271646 5271651 +
tctcccaagtcaagtgcctttg

SEQ ID NO: 91965 - DNA, 22 bp, Artificial Sequence
  Synthetic oligonucleotide; CTC chr11 5271633 5271654 5271650 5271655 +
ccaagtcaagtgcctttgggga

SEQ ID NO: 91966 - DNA, 22 bp, Artificial Sequence
  Synthetic oligonucleotide; CTT chr11 5271649 5271670 5271666 5271671 +
tggggattccatattccaagtt

SEQ ID NO: 91967 - DNA, 22 bp, Artificial Sequence
  Synthetic oligonucleotide; TTT chr11 5271650 5271671 5271667 5271672 +
ggggattccatattccaagttt

SEQ ID NO: 91968 - DNA, 22 bp, Artificial Sequence
  Synthetic oligonucleotide; TTG chr11 5271651 5271672 5271668 5271673 +
gggattccatattccaagttta

SEQ ID NO: 91969 - DNA, 22 bp, Artificial Sequence
  Synthetic oligonucleotide; TTC chr11 5271658 5271679 5271675 5271680 +
catattccaagtttactaagag

SEQ ID NO: 91970 - DNA, 22 bp, Artificial Sequence
  Synthetic oligonucleotide; TTC chr11 5271665 5271686 5271682 5271687 +
caagtttactaagagcgtttct

SEQ ID NO: 91971 - DNA, 22 bp, Artificial Sequence
  Synthetic oligonucleotide; TTT chr11 5271672 5271693 5271689 5271694 +
actaagagcgtttctctcttct

SEQ ID NO: 91972 - DNA, 22 bp, Artificial Sequence
  Synthetic oligonucleotide; TTA chr11 5271673 5271694 5271690 5271695 +
ctaagagcgtttctctcttcta

SEQ ID NO: 91973 - DNA, 22 bp, Artificial Sequence
  Synthetic oligonucleotide; CTA chr11 5271676 5271697 5271693 5271698 +
agagcgtttctctcttctataa

SEQ ID NO: 91974 - DNA, 22 bp, Artificial Sequence
  Synthetic oligonucleotide; TTT chr11 5271685 5271706 5271702 5271707 +
ctctcttctataacctgacttt

SEQ ID NO: 91975 - DNA, 22 bp, Artificial Sequence
  Synthetic oligonucleotide; TTC chr11 5271686 5271707 5271703 5271708 +
tctcttctataacctgactttg

SEQ ID NO: 91976 - DNA, 22 bp, Artificial Sequence
  Synthetic oligonucleotide; CTC chr11 5271688 5271709 5271705 5271710 +
tcttctataacctgactttgtt

SEQ ID NO: 91977 - DNA, 22 bp, Artificial Sequence
  Synthetic oligonucleotide; CTC chr11 5271690 5271711 5271707 5271712 +
ttctataacctgactttgttat

SEQ ID NO: 91978 - DNA, 22 bp, Artificial Sequence
  Synthetic oligonucleotide; CTT chr11 5271692 5271713 5271709 5271714 +
ctataacctgactttgttattt

SEQ ID NO: 91979 - DNA, 22 bp, Artificial Sequence
  Synthetic oligonucleotide; TTC chr11 5271693 5271714 5271710 5271715 +
tataacctgactttgttattta

SEQ ID NO: 91980 - DNA, 22 bp, Artificial Sequence
  Synthetic oligonucleotide; CTA chr11 5271695 5271716 5271712 5271717 +
taacctgactttgttatttatt

SEQ ID NO: 91981 - DNA, 22 bp, Artificial Sequence
  Synthetic oligonucleotide; CTG chr11 5271702 5271723 5271719 5271724 +
actttgttatttattatatttt

SEQ ID NO: 91982 - DNA, 22 bp, Artificial Sequence
  Synthetic oligonucleotide; CTT chr11 5271706 5271727 5271723 5271728 +
tgttatttattatattttctta

SEQ ID NO: 91983 - DNA, 22 bp, Artificial Sequence
  Synthetic oligonucleotide; TTT chr11 5271707 5271728 5271724 5271729 +
gttatttattatattttcttat

SEQ ID NO: 91984 - DNA, 22 bp, Artificial Sequence
  Synthetic oligonucleotide; TTG chr11 5271708 5271729 5271725 5271730 +
ttatttattatattttcttatg

SEQ ID NO: 91985 - DNA, 22 bp, Artificial Sequence
  Synthetic oligonucleotide; TTA chr11 5271711 5271732 5271728 5271733 +
tttattatattttcttatgttt

SEQ ID NO: 91986 - DNA, 22 bp, Artificial Sequence
  Synthetic oligonucleotide; TTT chr11 5271714 5271735 5271731 5271736 +
attatattttcttatgtttgtg

SEQ ID NO: 91987 - DNA, 22 bp, Artificial Sequence
  Synthetic oligonucleotide; TTA chr11 5271715 5271736 5271732 5271737 +
ttatattttcttatgtttgtga

SEQ ID NO: 91988 - DNA, 22 bp, Artificial Sequence
  Synthetic oligonucleotide; TTA chr11 5271718 5271739 5271735 5271740 +
tattttcttatgtttgtgataa

SEQ ID NO: 91989 - DNA, 22 bp, Artificial Sequence
  Synthetic oligonucleotide; TTT chr11 5271723 5271744 5271740 5271745 +
tcttatgtttgtgataaaaaaa

SEQ ID NO: 91990 - DNA, 22 bp, Artificial Sequence
  Synthetic oligonucleotide; TTT chr11 5271724 5271745 5271741 5271746 +
cttatgtttgtgataaaaaaaa

SEQ ID NO: 91991 - DNA, 22 bp, Artificial Sequence
  Synthetic oligonucleotide; TTC chr11 5271725 5271746 5271742 5271747 +
ttatgtttgtgataaaaaaaaa

SEQ ID NO: 91992 - DNA, 22 bp, Artificial Sequence
  Synthetic oligonucleotide; CTT chr11 5271727 5271748 5271744 5271749 +
atgtttgtgataaaaaaaaaaa

SEQ ID NO: 91993 - DNA, 22 bp, Artificial Sequence
  Synthetic oligonucleotide; TTA chr11 5271728 5271749 5271745 5271750 +
tgtttgtgataaaaaaaaaaaa

SEQ ID NO: 91994 - DNA, 22 bp, Artificial Sequence
  Synthetic oligonucleotide; TTT chr11 5271733 5271754 5271750 5271755 +
gtgataaaaaaaaaaaaaaaaa

SEQ ID NO: 91995 - DNA, 22 bp, Artificial Sequence
  Synthetic oligonucleotide; TTG chr11 5271734 5271755 5271751 5271756 +
tgataaaaaaaaaaaaaaaaaa

SEQ ID NO: 91996 - DNA, 22 bp, Artificial Sequence
  Synthetic oligonucleotide; CTT chr11 5271764 5271785 5271781 5271786 +
gtggcaagtaagaatgtctccc

SEQ ID NO: 91997 - DNA, 22 bp, Artificial Sequence
  Synthetic oligonucleotide; TTG chr11 5271765 5271786 5271782 5271787 +
tggcaagtaagaatgtctccct

SEQ ID NO: 91998 - DNA, 22 bp, Artificial Sequence
  Synthetic oligonucleotide; CTC chr11 5271784 5271805 5271801 5271806 +
ccttgcttttctcccatgattc

SEQ ID NO: 91999 - DNA, 22 bp, Artificial Sequence
  Synthetic oligonucleotide; CTT chr11 5271788 5271809 5271805 5271810 +
gcttttctcccatgattccaga

SEQ ID NO: 92000 - DNA, 22 bp, Artificial Sequence
  Synthetic oligonucleotide; TTG chr11 5271789 5271810 5271806 5271811 +
cttttctcccatgattccagaa

SEQ ID NO: 92001 - DNA, 22 bp, Artificial Sequence
  Synthetic oligonucleotide; CTT chr11 5271792 5271813 5271809 5271814 +
ttctcccatgattccagaagtc

SEQ ID NO: 92002 - DNA, 22 bp, Artificial Sequence
  Synthetic oligonucleotide; TTT chr11 5271793 5271814 5271810 5271815 +
tctcccatgattccagaagtct

SEQ ID NO: 92003 - DNA, 22 bp, Artificial Sequence
  Synthetic oligonucleotide; TTT chr11 5271794 5271815 5271811 5271816 +
ctcccatgattccagaagtctt

SEQ ID NO: 92004 - DNA, 22 bp, Artificial Sequence
  Synthetic oligonucleotide; TTC chr11 5271795 5271816 5271812 5271817 +
tcccatgattccagaagtcttc

SEQ ID NO: 92005 - DNA, 22 bp, Artificial Sequence
  Synthetic oligonucleotide; CTC chr11 5271797 5271818 5271814 5271819 +
ccatgattccagaagtcttcac

SEQ ID NO: 92006 - DNA, 22 bp, Artificial Sequence
  Synthetic oligonucleotide; TTC chr11 5271806 5271827 5271823 5271828 +
cagaagtcttcacctgacttaa

SEQ ID NO: 92007 - DNA, 22 bp, Artificial Sequence
  Synthetic oligonucleotide; CTT chr11 5271816 5271837 5271833 5271838 +
cacctgacttaatgactgccca

SEQ ID NO: 92008 - DNA, 22 bp, Artificial Sequence
  Synthetic oligonucleotide; TTC chr11 5271817 5271838 5271834 5271839 +
acctgacttaatgactgcccaa

SEQ ID NO: 92009 - DNA, 22 bp, Artificial Sequence
  Synthetic oligonucleotide; CTG chr11 5271822 5271843 5271839 5271844 +
acttaatgactgcccaaattgt

SEQ ID NO: 92010 - DNA, 22 bp, Artificial Sequence
  Synthetic oligonucleotide; CTT chr11 5271826 5271847 5271843 5271848 +
aatgactgcccaaattgttatt

SEQ ID NO: 92011 - DNA, 22 bp, Artificial Sequence
  Synthetic oligonucleotide; TTA chr11 5271827 5271848 5271844 5271849 +
atgactgcccaaattgttatta

SEQ ID NO: 92012 - DNA, 22 bp, Artificial Sequence
  Synthetic oligonucleotide; CTG chr11 5271834 5271855 5271851 5271856 +
cccaaattgttattattccagg

SEQ ID NO: 92013 - DNA, 22 bp, Artificial Sequence
  Synthetic oligonucleotide; TTG chr11 5271843 5271864 5271860 5271865 +
ttattattccaggccactgaat

SEQ ID NO: 92014 - DNA, 22 bp, Artificial Sequence
  Synthetic oligonucleotide; TTA chr11 5271846 5271867 5271863 5271868 +
ttattccaggccactgaatttc

SEQ ID NO: 92015 - DNA, 22 bp, Artificial Sequence
  Synthetic oligonucleotide; TTA chr11 5271849 5271870 5271866 5271871 +
ttccaggccactgaatttctac

SEQ ID NO: 92016 - DNA, 22 bp, Artificial Sequence
  Synthetic oligonucleotide; TTC chr11 5271852 5271873 5271869 5271874 +
caggccactgaatttctactcc

SEQ ID NO: 92017 - DNA, 22 bp, Artificial Sequence
  Synthetic oligonucleotide; CTG chr11 5271862 5271883 5271879 5271884 +
aatttctactccattttctttt

SEQ ID NO: 92018 - DNA, 22 bp, Artificial Sequence
  Synthetic oligonucleotide; TTT chr11 5271867 5271888 5271884 5271889 +
ctactccattttcttttagcta

SEQ ID NO: 92019 - DNA, 22 bp, Artificial Sequence
  Synthetic oligonucleotide; TTC chr11 5271868 5271889 5271885 5271890 +
tactccattttcttttagctat

SEQ ID NO: 92020 - DNA, 22 bp, Artificial Sequence
  Synthetic oligonucleotide; CTA chr11 5271870 5271891 5271887 5271892 +
ctccattttcttttagctatta

SEQ ID NO: 92021 - DNA, 22 bp, Artificial Sequence
  Synthetic oligonucleotide; CTC chr11 5271873 5271894 5271890 5271895 +
cattttcttttagctattaacc

SEQ ID NO: 92022 - DNA, 22 bp, Artificial Sequence
  Synthetic oligonucleotide; TTT chr11 5271878 5271899 5271895 5271900 +
tcttttagctattaaccaatgg

SEQ ID NO: 92023 - DNA, 22 bp, Artificial Sequence
  Synthetic oligonucleotide; TTT chr11 5271879 5271900 5271896 5271901 +
cttttagctattaaccaatggt

SEQ ID NO: 92024 - DNA, 22 bp, Artificial Sequence
  Synthetic oligonucleotide; TTC chr11 5271880 5271901 5271897 5271902 +
ttttagctattaaccaatggta

SEQ ID NO: 92025 - DNA, 22 bp, Artificial Sequence
  Synthetic oligonucleotide; CTT chr11 5271882 5271903 5271899 5271904 +
ttagctattaaccaatggtatc

SEQ ID NO: 92026 - DNA, 22 bp, Artificial Sequence
  Synthetic oligonucleotide; TTT chr11 5271883 5271904 5271900 5271905 +
tagctattaaccaatggtatct

SEQ ID NO: 92027 - DNA, 22 bp, Artificial Sequence
  Synthetic oligonucleotide; TTT chr11 5271884 5271905 5271901 5271906 +
agctattaaccaatggtatctt

SEQ ID NO: 92028 - DNA, 22 bp, Artificial Sequence
  Synthetic oligonucleotide; TTA chr11 5271885 5271906 5271902 5271907 +
gctattaaccaatggtatcttt

SEQ ID NO: 92029 - DNA, 22 bp, Artificial Sequence
  Synthetic oligonucleotide; CTA chr11 5271889 5271910 5271906 5271911 +
ttaaccaatggtatctttctga

SEQ ID NO: 92030 - DNA, 22 bp, Artificial Sequence
  Synthetic oligonucleotide; TTA chr11 5271892 5271913 5271909 5271914 +
accaatggtatctttctgagca

SEQ ID NO: 92031 - DNA, 22 bp, Artificial Sequence
  Synthetic oligonucleotide; CTT chr11 5271906 5271927 5271923 5271928 +
tctgagcatatattctaaccat

SEQ ID NO: 92032 - DNA, 22 bp, Artificial Sequence
  Synthetic oligonucleotide; TTT chr11 5271907 5271928 5271924 5271929 +
ctgagcatatattctaaccatt

SEQ ID NO: 92033 - DNA, 22 bp, Artificial Sequence
  Synthetic oligonucleotide; TTC chr11 5271908 5271929 5271925 5271930 +
tgagcatatattctaaccattg

SEQ ID NO: 92034 - DNA, 22 bp, Artificial Sequence
  Synthetic oligonucleotide; CTG chr11 5271910 5271931 5271927 5271932 +
agcatatattctaaccattggc

SEQ ID NO: 92035 - DNA, 22 bp, Artificial Sequence
  Synthetic oligonucleotide; TTC chr11 5271921 5271942 5271938 5271943 +
taaccattggctaacacagaca

SEQ ID NO: 92036 - DNA, 22 bp, Artificial Sequence
  Synthetic oligonucleotide; CTA chr11 5271923 5271944 5271940 5271945 +
accattggctaacacagacaaa

SEQ ID NO: 92037 - DNA, 22 bp, Artificial Sequence
  Synthetic oligonucleotide; TTG chr11 5271930 5271951 5271947 5271952 +
gctaacacagacaaaaccagga

SEQ ID NO: 92038 - DNA, 22 bp, Artificial Sequence
  Synthetic oligonucleotide; CTA chr11 5271934 5271955 5271951 5271956 +
acacagacaaaaccaggaattc

SEQ ID NO: 92039 - DNA, 22 bp, Artificial Sequence
  Synthetic oligonucleotide; TTC chr11 5271956 5271977 5271973 5271978 +
ctaaactttttttgtgtcacag

SEQ ID NO: 92040 - DNA, 22 bp, Artificial Sequence
  Synthetic oligonucleotide; CTA chr11 5271959 5271980 5271976 5271981 +
aactttttttgtgtcacaggcc

SEQ ID NO: 92041 - DNA, 22 bp, Artificial Sequence
  Synthetic oligonucleotide; CTT chr11 5271964 5271985 5271981 5271986 +
tttttgtgtcacaggccagttt

SEQ ID NO: 92042 - DNA, 22 bp, Artificial Sequence
  Synthetic oligonucleotide; TTT chr11 5271965 5271986 5271982 5271987 +
ttttgtgtcacaggccagtttg

SEQ ID NO: 92043 - DNA, 22 bp, Artificial Sequence
  Synthetic oligonucleotide; TTT chr11 5271966 5271987 5271983 5271988 +
tttgtgtcacaggccagtttgg

SEQ ID NO: 92044 - DNA, 22 bp, Artificial Sequence
  Synthetic oligonucleotide; TTT chr11 5271967 5271988 5271984 5271989 +
ttgtgtcacaggccagtttggc

SEQ ID NO: 92045 - DNA, 22 bp, Artificial Sequence
  Synthetic oligonucleotide; TTT chr11 5271968 5271989 5271985 5271990 +
tgtgtcacaggccagtttggca

SEQ ID NO: 92046 - DNA, 22 bp, Artificial Sequence
  Synthetic oligonucleotide; TTT chr11 5271969 5271990 5271986 5271991 +
gtgtcacaggccagtttggcag

SEQ ID NO: 92047 - DNA, 22 bp, Artificial Sequence
  Synthetic oligonucleotide; TTG chr11 5271970 5271991 5271987 5271992 +
tgtcacaggccagtttggcaga

SEQ ID NO: 92048 - DNA, 22 bp, Artificial Sequence
  Synthetic oligonucleotide; TTT chr11 5271986 5272007 5272003 5272008 +
ggcagactgtaagtgctaaaaa

SEQ ID NO: 92049 - DNA, 22 bp, Artificial Sequence
  Synthetic oligonucleotide; TTG chr11 5271987 5272008 5272004 5272009 +
gcagactgtaagtgctaaaaaa

SEQ ID NO: 92050 - DNA, 22 bp, Artificial Sequence
  Synthetic oligonucleotide; CTG chr11 5271995 5272016 5272012 5272017 +
taagtgctaaaaaaatatgttt

SEQ ID NO: 92051 - DNA, 22 bp, Artificial Sequence
  Synthetic oligonucleotide; CTA chr11 5272004 5272025 5272021 5272026 +
aaaaaatatgtttttattgcat

SEQ ID NO: 92052 - DNA, 22 bp, Artificial Sequence
  Synthetic oligonucleotide; TTT chr11 5272017 5272038 5272034 5272039 +
ttattgcatcaaataatataca

SEQ ID NO: 92053 - DNA, 22 bp, Artificial Sequence
  Synthetic oligonucleotide; TTT chr11 5272018 5272039 5272035 5272040 +
tattgcatcaaataatatacat

SEQ ID NO: 92054 - DNA, 22 bp, Artificial Sequence
  Synthetic oligonucleotide; TTT chr11 5272019 5272040 5272036 5272041 +
attgcatcaaataatatacata

SEQ ID NO: 92055 - DNA, 22 bp, Artificial Sequence
  Synthetic oligonucleotide; TTA chr11 5272020 5272041 5272037 5272042 +
ttgcatcaaataatatacatag

SEQ ID NO: 92056 - DNA, 22 bp, Artificial Sequence
  Synthetic oligonucleotide; TTG chr11 5272023 5272044 5272040 5272045 +
catcaaataatatacataggag

SEQ ID NO: 92057 - DNA, 22 bp, Artificial Sequence
  Synthetic oligonucleotide; CTA chr11 5272050 5272071 5272067 5272072 +
agtttaattacactgaaatatc

SEQ ID NO: 92058 - DNA, 22 bp, Artificial Sequence
  Synthetic oligonucleotide; TTT chr11 5272055 5272076 5272072 5272077 +
aattacactgaaatatcattat

SEQ ID NO: 92059 - DNA, 22 bp, Artificial Sequence
  Synthetic oligonucleotide; TTA chr11 5272056 5272077 5272073 5272078 +
attacactgaaatatcattatc

SEQ ID NO: 92060 - DNA, 22 bp, Artificial Sequence
  Synthetic oligonucleotide; TTA chr11 5272060 5272081 5272077 5272082 +
cactgaaatatcattatcagac

SEQ ID NO: 92061 - DNA, 22 bp, Artificial Sequence
  Synthetic oligonucleotide; CTG chr11 5272065 5272086 5272082 5272087 +
aaatatcattatcagacatcaa

SEQ ID NO: 92062 - DNA, 22 bp, Artificial Sequence
  Synthetic oligonucleotide; TTA chr11 5272076 5272097 5272093 5272098 +
tcagacatcaaacattacattt

SEQ ID NO: 92063 - DNA, 22 bp, Artificial Sequence
  Synthetic oligonucleotide; TTA chr11 5272093 5272114 5272110 5272115 +
catttgtggtatagtatttatt

SEQ ID NO: 92064 - DNA, 22 bp, Artificial Sequence
  Synthetic oligonucleotide; TTT chr11 5272098 5272119 5272115 5272120 +
gtggtatagtatttattatatt

SEQ ID NO: 92065 - DNA, 22 bp, Artificial Sequence
  Synthetic oligonucleotide; TTG chr11 5272099 5272120 5272116 5272121 +
tggtatagtatttattatattt

SEQ ID NO: 92066 - DNA, 22 bp, Artificial Sequence
  Synthetic oligonucleotide; TTT chr11 5272112 5272133 5272129 5272134 +
attatatttgcttctttatgaa

SEQ ID NO: 92067 - DNA, 22 bp, Artificial Sequence
  Synthetic oligonucleotide; TTA chr11 5272113 5272134 5272130 5272135 +
ttatatttgcttctttatgaaa

SEQ ID NO: 92068 - DNA, 22 bp, Artificial Sequence
  Synthetic oligonucleotide; TTA chr11 5272116 5272137 5272133 5272138 +
tatttgcttctttatgaaagca

SEQ ID NO: 92069 - DNA, 22 bp, Artificial Sequence
  Synthetic oligonucleotide; TTT chr11 5272121 5272142 5272138 5272143 +
gcttctttatgaaagcattaga

SEQ ID NO: 92070 - DNA, 22 bp, Artificial Sequence
  Synthetic oligonucleotide; TTG chr11 5272122 5272143 5272139 5272144 +
cttctttatgaaagcattagat

SEQ ID NO: 92071 - DNA, 22 bp, Artificial Sequence
  Synthetic oligonucleotide; CTT chr11 5272125 5272146 5272142 5272147 +
ctttatgaaagcattagatcta

SEQ ID NO: 92072 - DNA, 22 bp, Artificial Sequence
  Synthetic oligonucleotide; TTC chr11 5272126 5272147 5272143 5272148 +
tttatgaaagcattagatctag

SEQ ID NO: 92073 - DNA, 22 bp, Artificial Sequence
  Synthetic oligonucleotide; CTT chr11 5272128 5272149 5272145 5272150 +
tatgaaagcattagatctagga

SEQ ID NO: 92074 - DNA, 22 bp, Artificial Sequence
  Synthetic oligonucleotide; TTT chr11 5272129 5272150 5272146 5272151 +
atgaaagcattagatctaggat

SEQ ID NO: 92075 - DNA, 22 bp, Artificial Sequence
  Synthetic oligonucleotide; TTA chr11 5272130 5272151 5272147 5272152 +
tgaaagcattagatctaggatt

SEQ ID NO: 92076 - DNA, 22 bp, Artificial Sequence
  Synthetic oligonucleotide; TTA chr11 5272141 5272162 5272158 5272163 +
gatctaggattgggtctacagc

SEQ ID NO: 92077 - DNA, 22 bp, Artificial Sequence
  Synthetic oligonucleotide; CTA chr11 5272147 5272168 5272164 5272169 +
ggattgggtctacagctacctt

SEQ ID NO: 92078 - DNA, 22 bp, Artificial Sequence
  Synthetic oligonucleotide; TTG chr11 5272153 5272174 5272170 5272175 +
ggtctacagctaccttaagatc

SEQ ID NO: 92079 - DNA, 22 bp, Artificial Sequence
  Synthetic oligonucleotide; CTA chr11 5272159 5272180 5272176 5272181 +
cagctaccttaagatccaagta

SEQ ID NO: 92080 - DNA, 22 bp, Artificial Sequence
  Synthetic oligonucleotide; CTA chr11 5272165 5272186 5272182 5272187 +
ccttaagatccaagtagtgatg

SEQ ID NO: 92081 - DNA, 22 bp, Artificial Sequence
  Synthetic oligonucleotide; CTT chr11 5272169 5272190 5272186 5272191 +
aagatccaagtagtgatgcaga

SEQ ID NO: 92082 - DNA, 22 bp, Artificial Sequence
  Synthetic oligonucleotide; TTA chr11 5272170 5272191 5272187 5272192 +
agatccaagtagtgatgcagat

SEQ ID NO: 92083 - DNA, 22 bp, Artificial Sequence
  Synthetic oligonucleotide; TTA chr11 5272204 5272225 5272221 5272226 +
aaaatatctgcaatgggccagg

SEQ ID NO: 92084 - DNA, 22 bp, Artificial Sequence
  Synthetic oligonucleotide; CTG chr11 5272214 5272235 5272231 5272236 +
caatgggccaggcgtggtggct

SEQ ID NO: 92085 - DNA, 22 bp, Artificial Sequence
  Synthetic oligonucleotide; CTC chr11 5272237 5272258 5272254 5272259 +
acacctataatcccagcacttc

SEQ ID NO: 92086 - DNA, 22 bp, Artificial Sequence
  Synthetic oligonucleotide; CTA chr11 5272244 5272265 5272261 5272266 +
taatcccagcacttcaggaggc

SEQ ID NO: 92087 - DNA, 22 bp, Artificial Sequence
  Synthetic oligonucleotide; CTT chr11 5272258 5272279 5272275 5272280 +
caggaggccaaggcgggcagat

SEQ ID NO: 92088 - DNA, 22 bp, Artificial Sequence
  Synthetic oligonucleotide; TTC chr11 5272259 5272280 5272276 5272281 +
aggaggccaaggcgggcagatc

SEQ ID NO: 92089 - DNA, 22 bp, Artificial Sequence
  Synthetic oligonucleotide; CTG chr11 5272286 5272307 5272303 5272308 +
aggtcaggagttcaagaccagc

SEQ ID NO: 92090 - DNA, 22 bp, Artificial Sequence
  Synthetic oligonucleotide; TTC chr11 5272299 5272320 5272316 5272321 +
aagaccagcctggccaacatgg

SEQ ID NO: 92091 - DNA, 22 bp, Artificial Sequence
  Synthetic oligonucleotide; CTG chr11 5272311 5272332 5272328 5272333 +
gccaacatggcgaaaccccatc

SEQ ID NO: 92092 - DNA, 22 bp, Artificial Sequence
  Synthetic oligonucleotide; CTC chr11 5272335 5272356 5272352 5272357 +
tactaaaaatacaaaaattaga

SEQ ID NO: 92093 - DNA, 22 bp, Artificial Sequence
  Synthetic oligonucleotide; CTA chr11 5272337 5272358 5272354 5272359 +
ctaaaaatacaaaaattagact

SEQ ID NO: 92094 - DNA, 22 bp, Artificial Sequence
  Synthetic oligonucleotide; CTA chr11 5272340 5272361 5272357 5272362 +
aaaatacaaaaattagactggc

SEQ ID NO: 92095 - DNA, 22 bp, Artificial Sequence
  Synthetic oligonucleotide; TTA chr11 5272355 5272376 5272372 5272377 +
gactggcatggtggcaggtgcc

SEQ ID NO: 92096 - DNA, 22 bp, Artificial Sequence
  Synthetic oligonucleotide; CTG chr11 5272360 5272381 5272377 5272382 +
gcatggtggcaggtgcctgtaa

SEQ ID NO: 92097 - DNA, 22 bp, Artificial Sequence
  Synthetic oligonucleotide; CTG chr11 5272379 5272400 5272396 5272401 +
taatccccagctactcaggagg

SEQ ID NO: 92098 - DNA, 22 bp, Artificial Sequence
  Synthetic oligonucleotide; CTA chr11 5272392 5272413 5272409 5272414 +
ctcaggaggccaaggcaggaga

SEQ ID NO: 92099 - DNA, 22 bp, Artificial Sequence
  Synthetic oligonucleotide; CTC chr11 5272395 5272416 5272412 5272417 +
aggaggccaaggcaggagaatt

SEQ ID NO: 92100 - DNA, 22 bp, Artificial Sequence
  Synthetic oligonucleotide; TTG chr11 5272418 5272439 5272435 5272440 +
cttgaatgcaggaaggggaggt

SEQ ID NO: 92101 - DNA, 22 bp, Artificial Sequence
  Synthetic oligonucleotide; CTT chr11 5272421 5272442 5272438 5272443 +
gaatgcaggaaggggaggttgc

SEQ ID NO: 92102 - DNA, 22 bp, Artificial Sequence
  Synthetic oligonucleotide; TTG chr11 5272422 5272443 5272439 5272444 +
aatgcaggaaggggaggttgca

SEQ ID NO: 92103 - DNA, 22 bp, Artificial Sequence
  Synthetic oligonucleotide; TTG chr11 5272442 5272463 5272459 5272464 +
cagtgagccgaaatcatgccac

SEQ ID NO: 92104 - DNA, 22 bp, Artificial Sequence
  Synthetic oligonucleotide; CTG chr11 5272466 5272487 5272483 5272488 +
cactccagcctgggcaataaga

SEQ ID NO: 92105 - DNA, 22 bp, Artificial Sequence
  Synthetic oligonucleotide; CTC chr11 5272471 5272492 5272488 5272493 +
cagcctgggcaataagagcgaa

SEQ ID NO: 92106 - DNA, 22 bp, Artificial Sequence
  Synthetic oligonucleotide; CTG chr11 5272478 5272499 5272495 5272500 +
ggcaataagagcgaaactccat

SEQ ID NO: 92107 - DNA, 22 bp, Artificial Sequence
  Synthetic oligonucleotide; CTC chr11 5272497 5272518 5272514 5272519 +
catctcaaacaaaaacaaaaac

SEQ ID NO: 92108 - DNA, 22 bp, Artificial Sequence
  Synthetic oligonucleotide; CTC chr11 5272503 5272524 5272520 5272525 +
aaacaaaaacaaaaacaaaaag

SEQ ID NO: 92109 - DNA, 22 bp, Artificial Sequence
  Synthetic oligonucleotide; CTG chr11 5272530 5272551 5272547 5272552 +
caatacctatggtgtagtatga

SEQ ID NO: 92110 - DNA, 22 bp, Artificial Sequence
  Synthetic oligonucleotide; CTA chr11 5272539 5272560 5272556 5272561 +
tggtgtagtatgaaaatatctg

SEQ ID NO: 92111 - DNA, 22 bp, Artificial Sequence
  Synthetic oligonucleotide; CTG chr11 5272561 5272582 5272578 5272583 +
tggtttctctttataactatgc

SEQ ID NO: 92112 - DNA, 22 bp, Artificial Sequence
  Synthetic oligonucleotide; TTT chr11 5272567 5272588 5272584 5272589 +
ctctttataactatgcaatagg

SEQ ID NO: 92113 - DNA, 22 bp, Artificial Sequence
  Synthetic oligonucleotide; TTC chr11 5272568 5272589 5272585 5272590 +
tctttataactatgcaataggt

SEQ ID NO: 92114 - DNA, 22 bp, Artificial Sequence
  Synthetic oligonucleotide; CTC chr11 5272570 5272591 5272587 5272592 +
tttataactatgcaataggtac

SEQ ID NO: 92115 - DNA, 22 bp, Artificial Sequence
  Synthetic oligonucleotide; CTT chr11 5272572 5272593 5272589 5272594 +
tataactatgcaataggtactg

SEQ ID NO: 92116 - DNA, 22 bp, Artificial Sequence
  Synthetic oligonucleotide; TTT chr11 5272573 5272594 5272590 5272595 +
ataactatgcaataggtactga

SEQ ID NO: 92117 - DNA, 22 bp, Artificial Sequence
  Synthetic oligonucleotide; TTA chr11 5272574 5272595 5272591 5272596 +
taactatgcaataggtactgat

SEQ ID NO: 92118 - DNA, 22 bp, Artificial Sequence
  Synthetic oligonucleotide; CTA chr11 5272580 5272601 5272597 5272602 +
tgcaataggtactgatgatgtc

SEQ ID NO: 92119 - DNA, 22 bp, Artificial Sequence
  Synthetic oligonucleotide; CTG chr11 5272594 5272615 5272611 5272616 +
atgatgtcattctagtttgtcc

SEQ ID NO: 92120 - DNA, 22 bp, Artificial Sequence
  Synthetic oligonucleotide; TTC chr11 5272606 5272627 5272623 5272628 +
tagtttgtcctttgcattcaaa

SEQ ID NO: 92121 - DNA, 22 bp, Artificial Sequence
  Synthetic oligonucleotide; CTA chr11 5272608 5272629 5272625 5272630 +
gtttgtcctttgcattcaaagt

SEQ ID NO: 92122 - DNA, 22 bp, Artificial Sequence
  Synthetic oligonucleotide; TTT chr11 5272612 5272633 5272629 5272634 +
gtcctttgcattcaaagtagaa

SEQ ID NO: 92123 - DNA, 22 bp, Artificial Sequence
  Synthetic oligonucleotide; TTG chr11 5272613 5272634 5272630 5272635 +
tcctttgcattcaaagtagaag

SEQ ID NO: 92124 - DNA, 22 bp, Artificial Sequence
  Synthetic oligonucleotide; CTT chr11 5272618 5272639 5272635 5272640 +
tgcattcaaagtagaagaaaat

SEQ ID NO: 92125 - DNA, 22 bp, Artificial Sequence
  Synthetic oligonucleotide; TTT chr11 5272619 5272640 5272636 5272641 +
gcattcaaagtagaagaaaatg

SEQ ID NO: 92126 - DNA, 22 bp, Artificial Sequence
  Synthetic oligonucleotide; TTG chr11 5272620 5272641 5272637 5272642 +
cattcaaagtagaagaaaatgc

SEQ ID NO: 92127 - DNA, 22 bp, Artificial Sequence
  Synthetic oligonucleotide; TTC chr11 5272625 5272646 5272642 5272647 +
aaagtagaagaaaatgctaaat

SEQ ID NO: 92128 - DNA, 22 bp, Artificial Sequence
  Synthetic oligonucleotide; CTA chr11 5272644 5272665 5272661 5272666 +
aatttcagttacatgtaagtaa

SEQ ID NO: 92129 - DNA, 22 bp, Artificial Sequence
  Synthetic oligonucleotide; TTT chr11 5272649 5272670 5272666 5272671 +
cagttacatgtaagtaaaaata

SEQ ID NO: 92130 - DNA, 22 bp, Artificial Sequence
  Synthetic oligonucleotide; TTC chr11 5272650 5272671 5272667 5272672 +
agttacatgtaagtaaaaatac

SEQ ID NO: 92131 - DNA, 22 bp, Artificial Sequence
  Synthetic oligonucleotide; TTA chr11 5272655 5272676 5272672 5272677 +
catgtaagtaaaaatacagatt

SEQ ID NO: 92132 - DNA, 22 bp, Artificial Sequence
  Synthetic oligonucleotide; TTT chr11 5272678 5272699 5272695 5272700 +
tttttctataaacttcaccagc

SEQ ID NO: 92133 - DNA, 22 bp, Artificial Sequence
  Synthetic oligonucleotide; TTT chr11 5272679 5272700 5272696 5272701 +
ttttctataaacttcaccagcc

SEQ ID NO: 92134 - DNA, 22 bp, Artificial Sequence
  Synthetic oligonucleotide; TTT chr11 5272680 5272701 5272697 5272702 +
tttctataaacttcaccagccc

SEQ ID NO: 92135 - DNA, 22 bp, Artificial Sequence
  Synthetic oligonucleotide; TTT chr11 5272681 5272702 5272698 5272703 +
ttctataaacttcaccagcccc

SEQ ID NO: 92136 - DNA, 22 bp, Artificial Sequence
  Synthetic oligonucleotide; TTT chr11 5272682 5272703 5272699 5272704 +
tctataaacttcaccagccccc

SEQ ID NO: 92137 - DNA, 22 bp, Artificial Sequence
  Synthetic oligonucleotide; TTT chr11 5272683 5272704 5272700 5272705 +
ctataaacttcaccagccccct

SEQ ID NO: 92138 - DNA, 22 bp, Artificial Sequence
  Synthetic oligonucleotide; TTC chr11 5272684 5272705 5272701 5272706 +
tataaacttcaccagcccccta

SEQ ID NO: 92139 - DNA, 22 bp, Artificial Sequence
  Synthetic oligonucleotide; CTA chr11 5272686 5272707 5272703 5272708 +
taaacttcaccagccccctagt

SEQ ID NO: 92140 - DNA, 22 bp, Artificial Sequence
  Synthetic oligonucleotide; CTT chr11 5272693 5272714 5272710 5272715 +
caccagccccctagtgttctgt

SEQ ID NO: 92141 - DNA, 22 bp, Artificial Sequence
  Synthetic oligonucleotide; TTC chr11 5272694 5272715 5272711 5272716 +
accagccccctagtgttctgtg

SEQ ID NO: 92142 - DNA, 22 bp, Artificial Sequence
  Synthetic oligonucleotide; CTA chr11 5272706 5272727 5272723 5272728 +
gtgttctgtggaccccagatta

SEQ ID NO: 92143 - DNA, 22 bp, Artificial Sequence
  Synthetic oligonucleotide; TTC chr11 5272712 5272733 5272729 5272734 +
tgtggaccccagattaagactt

SEQ ID NO: 92144 - DNA, 22 bp, Artificial Sequence
  Synthetic oligonucleotide; CTG chr11 5272714 5272735 5272731 5272736 +
tggaccccagattaagacttcc

SEQ ID NO: 92145 - DNA, 22 bp, Artificial Sequence
  Synthetic oligonucleotide; TTA chr11 5272728 5272749 5272745 5272750 +
agacttcctgggacaaaatata

SEQ ID NO: 92146 - DNA, 22 bp, Artificial Sequence
  Synthetic oligonucleotide; CTT chr11 5272734 5272755 5272751 5272756 +
cctgggacaaaatatatagcct

SEQ ID NO: 92147 - DNA, 22 bp, Artificial Sequence
  Synthetic oligonucleotide; TTC chr11 5272735 5272756 5272752 5272757 +
ctgggacaaaatatatagccta

SEQ ID NO: 92148 - DNA, 22 bp, Artificial Sequence
  Synthetic oligonucleotide; CTG chr11 5272738 5272759 5272755 5272760 +
ggacaaaatatatagcctagga

SEQ ID NO: 92149 - DNA, 22 bp, Artificial Sequence
  Synthetic oligonucleotide; CTA chr11 5272757 5272778 5272774 5272779 +
ggaagacaagatcctaggtttg

SEQ ID NO: 92150 - DNA, 22 bp, Artificial Sequence
  Synthetic oligonucleotide; CTA chr11 5272773 5272794 5272790 5272795 +
ggtttggaaagaacgtatttga

SEQ ID NO: 92151 - DNA, 22 bp, Artificial Sequence
  Synthetic oligonucleotide; TTT chr11 5272778 5272799 5272795 5272800 +
ggaaagaacgtatttgatccac

SEQ ID NO: 92152 - DNA, 22 bp, Artificial Sequence
  Synthetic oligonucleotide; TTG chr11 5272779 5272800 5272796 5272801 +
gaaagaacgtatttgatccact

SEQ ID NO: 92153 - DNA, 22 bp, Artificial Sequence
  Synthetic oligonucleotide; TTT chr11 5272793 5272814 5272810 5272815 +
gatccactgaaataaaagaaca

SEQ ID NO: 92154 - DNA, 22 bp, Artificial Sequence
  Synthetic oligonucleotide; TTG chr11 5272794 5272815 5272811 5272816 +
atccactgaaataaaagaacaa

SEQ ID NO: 92155 - DNA, 22 bp, Artificial Sequence
  Synthetic oligonucleotide; CTG chr11 5272802 5272823 5272819 5272824 +
aaataaaagaacaatgactaga

SEQ ID NO: 92156 - DNA, 22 bp, Artificial Sequence
  Synthetic oligonucleotide; CTA chr11 5272822 5272843 5272839 5272844 +
gacaaaaagcagctcagctgct

SEQ ID NO: 92157 - DNA, 22 bp, Artificial Sequence
  Synthetic oligonucleotide; CTC chr11 5272837 5272858 5272854 5272859 +
agctgcttgtagcttgaaccaa

SEQ ID NO: 92158 - DNA, 22 bp, Artificial Sequence
  Synthetic oligonucleotide; CTG chr11 5272842 5272863 5272859 5272864 +
cttgtagcttgaaccaagctga

SEQ ID NO: 92159 - DNA, 22 bp, Artificial Sequence
  Synthetic oligonucleotide; CTT chr11 5272845 5272866 5272862 5272867 +
gtagcttgaaccaagctgagct

SEQ ID NO: 92160 - DNA, 22 bp, Artificial Sequence
  Synthetic oligonucleotide; TTG chr11 5272846 5272867 5272863 5272868 +
tagcttgaaccaagctgagctt

SEQ ID NO: 92161 - DNA, 22 bp, Artificial Sequence
  Synthetic oligonucleotide; CTT chr11 5272852 5272873 5272869 5272874 +
gaaccaagctgagcttggctac

SEQ ID NO: 92162 - DNA, 22 bp, Artificial Sequence
  Synthetic oligonucleotide; TTG chr11 5272853 5272874 5272870 5272875 +
aaccaagctgagcttggctact

SEQ ID NO: 92163 - DNA, 22 bp, Artificial Sequence
  Synthetic oligonucleotide; CTG chr11 5272863 5272884 5272880 5272885 +
agcttggctactcagagaagaa

SEQ ID NO: 92164 - DNA, 22 bp, Artificial Sequence
  Synthetic oligonucleotide; CTT chr11 5272868 5272889 5272885 5272890 +
ggctactcagagaagaacagtc

SEQ ID NO: 92165 - DNA, 22 bp, Artificial Sequence
  Synthetic oligonucleotide; TTG chr11 5272869 5272890 5272886 5272891 +
gctactcagagaagaacagtcg

SEQ ID NO: 92166 - DNA, 22 bp, Artificial Sequence
  Synthetic oligonucleotide; CTA chr11 5272873 5272894 5272890 5272895 +
ctcagagaagaacagtcgttga

SEQ ID NO: 92167 - DNA, 22 bp, Artificial Sequence
  Synthetic oligonucleotide; CTC chr11 5272876 5272897 5272893 5272898 +
agagaagaacagtcgttgagat

SEQ ID NO: 92168 - DNA, 22 bp, Artificial Sequence
  Synthetic oligonucleotide; TTG chr11 5272894 5272915 5272911 5272916 +
agataatataattttttttaac

SEQ ID NO: 92169 - DNA, 22 bp, Artificial Sequence
  Synthetic oligonucleotide; TTT chr11 5272908 5272929 5272925 5272930 +
tttttaaccaattaagatacag

SEQ ID NO: 92170 - DNA, 22 bp, Artificial Sequence
  Synthetic oligonucleotide; TTT chr11 5272909 5272930 5272926 5272931 +
ttttaaccaattaagatacagc

SEQ ID NO: 92171 - DNA, 22 bp, Artificial Sequence
  Synthetic oligonucleotide; TTT chr11 5272910 5272931 5272927 5272932 +
tttaaccaattaagatacagct

SEQ ID NO: 92172 - DNA, 22 bp, Artificial Sequence
  Synthetic oligonucleotide; TTT chr11 5272911 5272932 5272928 5272933 +
ttaaccaattaagatacagctc

SEQ ID NO: 92173 - DNA, 22 bp, Artificial Sequence
  Synthetic oligonucleotide; TTT chr11 5272912 5272933 5272929 5272934 +
taaccaattaagatacagctct

SEQ ID NO: 92174 - DNA, 22 bp, Artificial Sequence
  Synthetic oligonucleotide; TTT chr11 5272913 5272934 5272930 5272935 +
aaccaattaagatacagctctg

SEQ ID NO: 92175 - DNA, 22 bp, Artificial Sequence
  Synthetic oligonucleotide; TTA chr11 5272914 5272935 5272931 5272936 +
accaattaagatacagctctgg

SEQ ID NO: 92176 - DNA, 22 bp, Artificial Sequence
  Synthetic oligonucleotide; TTA chr11 5272922 5272943 5272939 5272944 +
agatacagctctgggttttcag

SEQ ID NO: 92177 - DNA, 22 bp, Artificial Sequence
  Synthetic oligonucleotide; CTC chr11 5272933 5272954 5272950 5272955 +
tgggttttcagggggaatttgc

SEQ ID NO: 92178 - DNA, 22 bp, Artificial Sequence
  Synthetic oligonucleotide; CTG chr11 5272935 5272956 5272952 5272957 +
ggttttcagggggaatttgcta

SEQ ID NO: 92179 - DNA, 22 bp, Artificial Sequence
  Synthetic oligonucleotide; TTT chr11 5272940 5272961 5272957 5272962 +
tcagggggaatttgctacagat

SEQ ID NO: 92180 - DNA, 22 bp, Artificial Sequence
  Synthetic oligonucleotide; TTT chr11 5272941 5272962 5272958 5272963 +
cagggggaatttgctacagatc

SEQ ID NO: 92181 - DNA, 22 bp, Artificial Sequence
  Synthetic oligonucleotide; TTC chr11 5272942 5272963 5272959 5272964 +
agggggaatttgctacagatcc

SEQ ID NO: 92182 - DNA, 22 bp, Artificial Sequence
  Synthetic oligonucleotide; TTT chr11 5272953 5272974 5272970 5272975 +
gctacagatccacagtatgaag

SEQ ID NO: 92183 - DNA, 22 bp, Artificial Sequence
  Synthetic oligonucleotide; TTG chr11 5272954 5272975 5272971 5272976 +
ctacagatccacagtatgaagg

SEQ ID NO: 92184 - DNA, 22 bp, Artificial Sequence
  Synthetic oligonucleotide; CTA chr11 5272957 5272978 5272974 5272979 +
cagatccacagtatgaaggcag

SEQ ID NO: 92185 - DNA, 22 bp, Artificial Sequence
  Synthetic oligonucleotide; CTT chr11 5272987 5273008 5273004 5273009 +
cctcagaacttgaatgtgaggg

SEQ ID NO: 92186 - DNA, 22 bp, Artificial Sequence
  Synthetic oligonucleotide; TTC chr11 5272988 5273009 5273005 5273010 +
ctcagaacttgaatgtgagggt

SEQ ID NO: 92187 - DNA, 22 bp, Artificial Sequence
  Synthetic oligonucleotide; CTC chr11 5272991 5273012 5273008 5273013 +
agaacttgaatgtgagggtcag

SEQ ID NO: 92188 - DNA, 22 bp, Artificial Sequence
  Synthetic oligonucleotide; CTT chr11 5272998 5273019 5273015 5273020 +
gaatgtgagggtcagacattgc

SEQ ID NO: 92189 - DNA, 22 bp, Artificial Sequence
  Synthetic oligonucleotide; TTG chr11 5272999 5273020 5273016 5273021 +
aatgtgagggtcagacattgcc

SEQ ID NO: 92190 - DNA, 22 bp, Artificial Sequence
  Synthetic oligonucleotide; TTG chr11 5273019 5273040 5273036 5273041 +
ccaaagtccaaggaataaggac

SEQ ID NO: 92191 - DNA, 22 bp, Artificial Sequence
  Synthetic oligonucleotide; CTC chr11 5273051 5273072 5273068 5273073 +
aaggccaagagtttggagaaca

SEQ ID NO: 92192 - DNA, 22 bp, Artificial Sequence
  Synthetic oligonucleotide; TTT chr11 5273065 5273086 5273082 5273087 +
ggagaacaggtttctccctaaa

SEQ ID NO: 92193 - DNA, 22 bp, Artificial Sequence
  Synthetic oligonucleotide; TTG chr11 5273066 5273087 5273083 5273088 +
gagaacaggtttctccctaaaa

SEQ ID NO: 92194 - DNA, 22 bp, Artificial Sequence
  Synthetic oligonucleotide; TTT chr11 5273078 5273099 5273095 5273100 +
ctccctaaaacaagccctatgg

SEQ ID NO: 92195 - DNA, 22 bp, Artificial Sequence
  Synthetic oligonucleotide; TTC chr11 5273079 5273100 5273096 5273101 +
tccctaaaacaagccctatggg

SEQ ID NO: 92196 - DNA, 22 bp, Artificial Sequence
  Synthetic oligonucleotide; CTC chr11 5273081 5273102 5273098 5273103 +
cctaaaacaagccctatgggta

SEQ ID NO: 92197 - DNA, 22 bp, Artificial Sequence
  Synthetic oligonucleotide; CTA chr11 5273085 5273106 5273102 5273107 +
aaacaagccctatgggtaatcc

SEQ ID NO: 92198 - DNA, 22 bp, Artificial Sequence
  Synthetic oligonucleotide; CTA chr11 5273097 5273118 5273114 5273119 +
tgggtaatcccatcattcttcc

SEQ ID NO: 92199 - DNA, 22 bp, Artificial Sequence
  Synthetic oligonucleotide; TTC chr11 5273115 5273136 5273132 5273137 +
ttcccattcagagtatggacac

SEQ ID NO: 92200 - DNA, 22 bp, Artificial Sequence
  Synthetic oligonucleotide; CTT chr11 5273117 5273138 5273134 5273139 +
cccattcagagtatggacacca

SEQ ID NO: 92201 - DNA, 22 bp, Artificial Sequence
  Synthetic oligonucleotide; TTC chr11 5273118 5273139 5273135 5273140 +
ccattcagagtatggacaccag

SEQ ID NO: 92202 - DNA, 22 bp, Artificial Sequence
  Synthetic oligonucleotide; TTC chr11 5273124 5273145 5273141 5273146 +
agagtatggacaccagtcttct

SEQ ID NO: 92203 - DNA, 22 bp, Artificial Sequence
  Synthetic oligonucleotide; CTT chr11 5273144 5273165 5273161 5273166 +
ctcttagattcagagtatgggg

SEQ ID NO: 92204 - DNA, 22 bp, Artificial Sequence
  Synthetic oligonucleotide; TTC chr11 5273145 5273166 5273162 5273167 +
tcttagattcagagtatggggt

SEQ ID NO: 92205 - DNA, 22 bp, Artificial Sequence
  Synthetic oligonucleotide; CTC chr11 5273147 5273168 5273164 5273169 +
ttagattcagagtatggggttg

SEQ ID NO: 92206 - DNA, 22 bp, Artificial Sequence
  Synthetic oligonucleotide; CTT chr11 5273149 5273170 5273166 5273171 +
agattcagagtatggggttgat

SEQ ID NO: 92207 - DNA, 22 bp, Artificial Sequence
  Synthetic oligonucleotide; TTA chr11 5273150 5273171 5273167 5273172 +
gattcagagtatggggttgatc

SEQ ID NO: 92208 - DNA, 22 bp, Artificial Sequence
  Synthetic oligonucleotide; TTC chr11 5273155 5273176 5273172 5273177 +
agagtatggggttgatcctctc

SEQ ID NO: 92209 - DNA, 22 bp, Artificial Sequence
  Synthetic oligonucleotide; TTG chr11 5273169 5273190 5273186 5273191 +
atcctctcctgctccctcggag

SEQ ID NO: 92210 - DNA, 22 bp, Artificial Sequence
  Synthetic oligonucleotide; CTC chr11 5273175 5273196 5273192 5273197 +
tcctgctccctcggagccagtt

SEQ ID NO: 92211 - DNA, 22 bp, Artificial Sequence
  Synthetic oligonucleotide; CTC chr11 5273177 5273198 5273194 5273199 +
ctgctccctcggagccagttgc

SEQ ID NO: 92212 - DNA, 22 bp, Artificial Sequence
  Synthetic oligonucleotide; CTG chr11 5273180 5273201 5273197 5273202 +
ctccctcggagccagttgcaga

SEQ ID NO: 92213 - DNA, 22 bp, Artificial Sequence
  Synthetic oligonucleotide; CTC chr11 5273183 5273204 5273200 5273205 +
cctcggagccagttgcagagcc

SEQ ID NO: 92214 - DNA, 22 bp, Artificial Sequence
  Synthetic oligonucleotide; CTC chr11 5273187 5273208 5273204 5273209 +
ggagccagttgcagagcccaca

SEQ ID NO: 92215 - DNA, 22 bp, Artificial Sequence
  Synthetic oligonucleotide; TTG chr11 5273198 5273219 5273215 5273220 +
cagagcccacattttcttctct

SEQ ID NO: 92216 - DNA, 22 bp, Artificial Sequence
  Synthetic oligonucleotide; TTT chr11 5273212 5273233 5273229 5273234 +
tcttctctccttactgcctatg

SEQ ID NO: 92217 - DNA, 22 bp, Artificial Sequence
  Synthetic oligonucleotide; TTT chr11 5273213 5273234 5273230 5273235 +
cttctctccttactgcctatgg

SEQ ID NO: 92218 - DNA, 22 bp, Artificial Sequence
  Synthetic oligonucleotide; TTC chr11 5273214 5273235 5273231 5273236 +
ttctctccttactgcctatggt

SEQ ID NO: 92219 - DNA, 22 bp, Artificial Sequence
  Synthetic oligonucleotide; CTT chr11 5273216 5273237 5273233 5273238 +
ctctccttactgcctatggttc

SEQ ID NO: 92220 - DNA, 22 bp, Artificial Sequence
  Synthetic oligonucleotide; TTC chr11 5273217 5273238 5273234 5273239 +
tctccttactgcctatggttcc

SEQ ID NO: 92221 - DNA, 22 bp, Artificial Sequence
  Synthetic oligonucleotide; CTC chr11 5273219 5273240 5273236 5273241 +
tccttactgcctatggttccag

SEQ ID NO: 92222 - DNA, 22 bp, Artificial Sequence
  Synthetic oligonucleotide; CTC chr11 5273221 5273242 5273238 5273243 +
cttactgcctatggttccagac

SEQ ID NO: 92223 - DNA, 22 bp, Artificial Sequence
  Synthetic oligonucleotide; CTT chr11 5273224 5273245 5273241 5273246 +
actgcctatggttccagacctg

SEQ ID NO: 92224 - DNA, 22 bp, Artificial Sequence
  Synthetic oligonucleotide; TTA chr11 5273225 5273246 5273242 5273247 +
ctgcctatggttccagacctgg

SEQ ID NO: 92225 - DNA, 22 bp, Artificial Sequence
  Synthetic oligonucleotide; CTG chr11 5273228 5273249 5273245 5273250 +
cctatggttccagacctggctt

SEQ ID NO: 92226 - DNA, 22 bp, Artificial Sequence
  Synthetic oligonucleotide; CTA chr11 5273232 5273253 5273249 5273254 +
tggttccagacctggcttgcat

SEQ ID NO: 92227 - DNA, 22 bp, Artificial Sequence
  Synthetic oligonucleotide; TTC chr11 5273238 5273259 5273255 5273260 +
cagacctggcttgcatccaggg

SEQ ID NO: 92228 - DNA, 22 bp, Artificial Sequence
  Synthetic oligonucleotide; CTG chr11 5273246 5273267 5273263 5273268 +
gcttgcatccagggatctgacc

SEQ ID NO: 92229 - DNA, 22 bp, Artificial Sequence
  Synthetic oligonucleotide; CTT chr11 5273250 5273271 5273267 5273272 +
gcatccagggatctgacccatt

SEQ ID NO: 92230 - DNA, 22 bp, Artificial Sequence
  Synthetic oligonucleotide; TTG chr11 5273251 5273272 5273268 5273273 +
catccagggatctgacccattc

SEQ ID NO: 92231 - DNA, 22 bp, Artificial Sequence
  Synthetic oligonucleotide; CTG chr11 5273265 5273286 5273282 5273287 +
acccattccatgtttccttatg

SEQ ID NO: 92232 - DNA, 22 bp, Artificial Sequence
  Synthetic oligonucleotide; TTC chr11 5273273 5273294 5273290 5273295 +
catgtttccttatggctaaagg

SEQ ID NO: 92233 - DNA, 22 bp, Artificial Sequence
  Synthetic oligonucleotide; TTT chr11 5273280 5273301 5273297 5273302 +
ccttatggctaaaggtggtagg

SEQ ID NO: 92234 - DNA, 22 bp, Artificial Sequence
  Synthetic oligonucleotide; TTC chr11 5273281 5273302 5273298 5273303 +
cttatggctaaaggtggtaggg

SEQ ID NO: 92235 - DNA, 22 bp, Artificial Sequence
  Synthetic oligonucleotide; CTT chr11 5273284 5273305 5273301 5273306 +
atggctaaaggtggtagggagg

SEQ ID NO: 92236 - DNA, 22 bp, Artificial Sequence
  Synthetic oligonucleotide; TTA chr11 5273285 5273306 5273302 5273307 +
tggctaaaggtggtagggagga

SEQ ID NO: 92237 - DNA, 22 bp, Artificial Sequence
  Synthetic oligonucleotide; CTA chr11 5273291 5273312 5273308 5273313 +
aaggtggtagggaggagcttca

SEQ ID NO: 92238 - DNA, 22 bp, Artificial Sequence
  Synthetic oligonucleotide; CTT chr11 5273311 5273332 5273328 5273333 +
caagaaaggttatagcattgaa

SEQ ID NO: 92239 - DNA, 22 bp, Artificial Sequence
  Synthetic oligonucleotide; TTC chr11 5273312 5273333 5273329 5273334 +
aagaaaggttatagcattgaaa

SEQ ID NO: 92240 - DNA, 22 bp, Artificial Sequence
  Synthetic oligonucleotide; TTA chr11 5273323 5273344 5273340 5273345 +
tagcattgaaaggcccaggttt

SEQ ID NO: 92241 - DNA, 22 bp, Artificial Sequence
  Synthetic oligonucleotide; TTG chr11 5273331 5273352 5273348 5273353 +
aaaggcccaggtttgtgtctca

SEQ ID NO: 92242 - DNA, 22 bp, Artificial Sequence
  Synthetic oligonucleotide; TTT chr11 5273345 5273366 5273362 5273367 +
gtgtctcagtaacaaggcttat

SEQ ID NO: 92243 - DNA, 22 bp, Artificial Sequence
  Synthetic oligonucleotide; TTG chr11 5273346 5273367 5273363 5273368 +
tgtctcagtaacaaggcttata

SEQ ID NO: 92244 - DNA, 22 bp, Artificial Sequence
  Synthetic oligonucleotide; CTC chr11 5273352 5273373 5273369 5273374 +
agtaacaaggcttataaatcct

SEQ ID NO: 92245 - DNA, 22 bp, Artificial Sequence
  Synthetic oligonucleotide; CTT chr11 5273365 5273386 5273382 5273387 +
ataaatcctgactcagaagtca

SEQ ID NO: 92246 - DNA, 22 bp, Artificial Sequence
  Synthetic oligonucleotide; TTA chr11 5273366 5273387 5273383 5273388 +
taaatcctgactcagaagtcag

SEQ ID NO: 92247 - DNA, 22 bp, Artificial Sequence
  Synthetic oligonucleotide; CTG chr11 5273375 5273396 5273392 5273397 +
actcagaagtcaggtaggctgc

SEQ ID NO: 92248 - DNA, 22 bp, Artificial Sequence
  Synthetic oligonucleotide; CTC chr11 5273379 5273400 5273396 5273401 +
agaagtcaggtaggctgcgggc

SEQ ID NO: 92249 - DNA, 22 bp, Artificial Sequence
  Synthetic oligonucleotide; CTG chr11 5273396 5273417 5273413 5273418 +
cgggcagtctcattattgcttc

SEQ ID NO: 92250 - DNA, 22 bp, Artificial Sequence
  Synthetic oligonucleotide; CTC chr11 5273407 5273428 5273424 5273429 +
attattgcttcgatgcttgttg

SEQ ID NO: 92251 - DNA, 22 bp, Artificial Sequence
  Synthetic oligonucleotide; TTA chr11 5273411 5273432 5273428 5273433 +
ttgcttcgatgcttgttggttc

SEQ ID NO: 92252 - DNA, 22 bp, Artificial Sequence
  Synthetic oligonucleotide; TTG chr11 5273414 5273435 5273431 5273436 +
cttcgatgcttgttggttcaag

SEQ ID NO: 92253 - DNA, 22 bp, Artificial Sequence
  Synthetic oligonucleotide; CTT chr11 5273417 5273438 5273434 5273439 +
cgatgcttgttggttcaagata

SEQ ID NO: 92254 - DNA, 22 bp, Artificial Sequence
  Synthetic oligonucleotide; TTC chr11 5273418 5273439 5273435 5273440 +
gatgcttgttggttcaagataa

SEQ ID NO: 92255 - DNA, 22 bp, Artificial Sequence
  Synthetic oligonucleotide; CTT chr11 5273425 5273446 5273442 5273447 +
gttggttcaagataaattgctt

SEQ ID NO: 92256 - DNA, 22 bp, Artificial Sequence
  Synthetic oligonucleotide; TTG chr11 5273426 5273447 5273443 5273448 +
ttggttcaagataaattgcttc

SEQ ID NO: 92257 - DNA, 22 bp, Artificial Sequence
  Synthetic oligonucleotide; TTG chr11 5273429 5273450 5273446 5273451 +
gttcaagataaattgcttcacc

SEQ ID NO: 92258 - DNA, 22 bp, Artificial Sequence
  Synthetic oligonucleotide; TTC chr11 5273433 5273454 5273450 5273455 +
aagataaattgcttcacctgct

SEQ ID NO: 92259 - DNA, 22 bp, Artificial Sequence
  Synthetic oligonucleotide; TTG chr11 5273444 5273465 5273461 5273466 +
cttcacctgctcatttttaagc

SEQ ID NO: 92260 - DNA, 22 bp, Artificial Sequence
  Synthetic oligonucleotide; CTT chr11 5273447 5273468 5273464 5273469 +
cacctgctcatttttaagcatt

SEQ ID NO: 92261 - DNA, 22 bp, Artificial Sequence
  Synthetic oligonucleotide; TTC chr11 5273448 5273469 5273465 5273470 +
acctgctcatttttaagcattt

SEQ ID NO: 92262 - DNA, 22 bp, Artificial Sequence
  Synthetic oligonucleotide; CTG chr11 5273453 5273474 5273470 5273475 +
ctcatttttaagcattttattt

SEQ ID NO: 92263 - DNA, 22 bp, Artificial Sequence
  Synthetic oligonucleotide; CTC chr11 5273456 5273477 5273473 5273478 +
atttttaagcattttatttgtt

SEQ ID NO: 92264 - DNA, 22 bp, Artificial Sequence
  Synthetic oligonucleotide; TTT chr11 5273460 5273481 5273477 5273482 +
ttaagcattttatttgtttatc

SEQ ID NO: 92265 - DNA, 22 bp, Artificial Sequence
  Synthetic oligonucleotide; TTT chr11 5273461 5273482 5273478 5273483 +
taagcattttatttgtttatca

SEQ ID NO: 92266 - DNA, 22 bp, Artificial Sequence
  Synthetic oligonucleotide; TTT chr11 5273462 5273483 5273479 5273484 +
aagcattttatttgtttatcat

SEQ ID NO: 92267 - DNA, 22 bp, Artificial Sequence
  Synthetic oligonucleotide; TTA chr11 5273463 5273484 5273480 5273485 +
agcattttatttgtttatcata

SEQ ID NO: 92268 - DNA, 22 bp, Artificial Sequence
  Synthetic oligonucleotide; TTT chr11 5273470 5273491 5273487 5273492 +
tatttgtttatcatatgagata

SEQ ID NO: 92269 - DNA, 22 bp, Artificial Sequence
  Synthetic oligonucleotide; TTT chr11 5273471 5273492 5273488 5273493 +
atttgtttatcatatgagatac

SEQ ID NO: 92270 - DNA, 22 bp, Artificial Sequence
  Synthetic oligonucleotide; TTA chr11 5273472 5273493 5273489 5273494 +
tttgtttatcatatgagatacc

SEQ ID NO: 92271 - DNA, 22 bp, Artificial Sequence
  Synthetic oligonucleotide; TTT chr11 5273475 5273496 5273492 5273497 +
gtttatcatatgagataccatg

SEQ ID NO: 92272 - DNA, 22 bp, Artificial Sequence
  Synthetic oligonucleotide; TTG chr11 5273476 5273497 5273493 5273498 +
tttatcatatgagataccatga

SEQ ID NO: 92273 - DNA, 22 bp, Artificial Sequence
  Synthetic oligonucleotide; TTT chr11 5273479 5273500 5273496 5273501 +
atcatatgagataccatgaaaa

SEQ ID NO: 92274 - DNA, 22 bp, Artificial Sequence
  Synthetic oligonucleotide; TTA chr11 5273480 5273501 5273497 5273502 +
tcatatgagataccatgaaaaa

SEQ ID NO: 92275 - DNA, 22 bp, Artificial Sequence
  Synthetic oligonucleotide; TTA chr11 5273509 5273530 5273526 5273531 +
ttgcttttctttcctatattaa

SEQ ID NO: 92276 - DNA, 22 bp, Artificial Sequence
  Synthetic oligonucleotide; TTG chr11 5273512 5273533 5273529 5273534 +
cttttctttcctatattaaaag

SEQ ID NO: 92277 - DNA, 22 bp, Artificial Sequence
  Synthetic oligonucleotide; CTT chr11 5273515 5273536 5273532 5273537 +
ttctttcctatattaaaagccc

SEQ ID NO: 92278 - DNA, 22 bp, Artificial Sequence
  Synthetic oligonucleotide; TTT chr11 5273516 5273537 5273533 5273538 +
tctttcctatattaaaagccca

SEQ ID NO: 92279 - DNA, 22 bp, Artificial Sequence
  Synthetic oligonucleotide; TTT chr11 5273517 5273538 5273534 5273539 +
ctttcctatattaaaagcccaa

SEQ ID NO: 92280 - DNA, 22 bp, Artificial Sequence
  Synthetic oligonucleotide; TTC chr11 5273518 5273539 5273535 5273540 +
tttcctatattaaaagcccaaa

SEQ ID NO: 92281 - DNA, 22 bp, Artificial Sequence
  Synthetic oligonucleotide; CTT chr11 5273520 5273541 5273537 5273542 +
tcctatattaaaagcccaaagt

SEQ ID NO: 92282 - DNA, 22 bp, Artificial Sequence
  Synthetic oligonucleotide; TTT chr11 5273521 5273542 5273538 5273543 +
cctatattaaaagcccaaagtt

SEQ ID NO: 92283 - DNA, 22 bp, Artificial Sequence
  Synthetic oligonucleotide; TTC chr11 5273522 5273543 5273539 5273544 +
ctatattaaaagcccaaagttc

SEQ ID NO: 92284 - DNA, 22 bp, Artificial Sequence
  Synthetic oligonucleotide; CTA chr11 5273525 5273546 5273542 5273547 +
tattaaaagcccaaagttcaga

SEQ ID NO: 92285 - DNA, 22 bp, Artificial Sequence
  Synthetic oligonucleotide; TTA chr11 5273530 5273551 5273547 5273552 +
aaagcccaaagttcagagagat

SEQ ID NO: 92286 - DNA, 22 bp, Artificial Sequence
  Synthetic oligonucleotide; TTC chr11 5273544 5273565 5273561 5273566 +
agagagataagtgttatggcca

SEQ ID NO: 92287 - DNA, 22 bp, Artificial Sequence
  Synthetic oligonucleotide; TTA chr11 5273560 5273581 5273577 5273582 +
tggccatccaggatagatcaga

SEQ ID NO: 92288 - DNA, 22 bp, Artificial Sequence
  Synthetic oligonucleotide; TTA chr11 5273589 5273610 5273606 5273611 +
gacagtcagaaaaagtaatcag

SEQ ID NO: 92289 - DNA, 22 bp, Artificial Sequence
  Synthetic oligonucleotide; TTC chr11 5273622 5273643 5273639 5273644 +
atttattgtctatataattaaa

SEQ ID NO: 92290 - DNA, 22 bp, Artificial Sequence
  Synthetic oligonucleotide; TTT chr11 5273626 5273647 5273643 5273648 +
attgtctatataattaaaatta

SEQ ID NO: 92291 - DNA, 22 bp, Artificial Sequence
  Synthetic oligonucleotide; TTA chr11 5273627 5273648 5273644 5273649 +
ttgtctatataattaaaattag

SEQ ID NO: 92292 - DNA, 22 bp, Artificial Sequence
  Synthetic oligonucleotide; TTG chr11 5273630 5273651 5273647 5273652 +
tctatataattaaaattagtaa

SEQ ID NO: 92293 - DNA, 22 bp, Artificial Sequence
  Synthetic oligonucleotide; CTA chr11 5273634 5273655 5273651 5273656 +
tataattaaaattagtaaaata

SEQ ID NO: 92294 - DNA, 22 bp, Artificial Sequence
  Synthetic oligonucleotide; TTA chr11 5273642 5273663 5273659 5273664 +
aaattagtaaaataaaatctat

SEQ ID NO: 92295 - DNA, 22 bp, Artificial Sequence
  Synthetic oligonucleotide; TTA chr11 5273648 5273669 5273665 5273670 +
gtaaaataaaatctatgtatgt

SEQ ID NO: 92296 - DNA, 22 bp, Artificial Sequence
  Synthetic oligonucleotide; CTA chr11 5273663 5273684 5273680 5273685 +
tgtatgtcttaagacatttaag

SEQ ID NO: 92297 - DNA, 22 bp, Artificial Sequence
  Synthetic oligonucleotide; CTT chr11 5273673 5273694 5273690 5273695 +
aagacatttaagtataaaggac

SEQ ID NO: 92298 - DNA, 22 bp, Artificial Sequence
  Synthetic oligonucleotide; TTA chr11 5273674 5273695 5273691 5273696 +
agacatttaagtataaaggact

SEQ ID NO: 92299 - DNA, 22 bp, Artificial Sequence
  Synthetic oligonucleotide; TTT chr11 5273682 5273703 5273699 5273704 +
aagtataaaggacttttagaaa

SEQ ID NO: 92300 - DNA, 22 bp, Artificial Sequence
  Synthetic oligonucleotide; TTA chr11 5273683 5273704 5273700 5273705 +
agtataaaggacttttagaaag

SEQ ID NO: 92301 - DNA, 22 bp, Artificial Sequence
  Synthetic oligonucleotide; CTT chr11 5273697 5273718 5273714 5273719 +
ttagaaagaaacacccaaattc

SEQ ID NO: 92302 - DNA, 22 bp, Artificial Sequence
  Synthetic oligonucleotide; TTT chr11 5273698 5273719 5273715 5273720 +
tagaaagaaacacccaaattcg

SEQ ID NO: 92303 - DNA, 22 bp, Artificial Sequence
  Synthetic oligonucleotide; TTT chr11 5273699 5273720 5273716 5273721 +
agaaagaaacacccaaattcga

SEQ ID NO: 92304 - DNA, 22 bp, Artificial Sequence
  Synthetic oligonucleotide; TTA chr11 5273700 5273721 5273717 5273722 +
gaaagaaacacccaaattcgat

SEQ ID NO: 92305 - DNA, 22 bp, Artificial Sequence
  Synthetic oligonucleotide; TTC chr11 5273719 5273740 5273736 5273741 +
gatgaagattaattcctgcctg

SEQ ID NO: 92306 - DNA, 22 bp, Artificial Sequence
  Synthetic oligonucleotide; TTA chr11 5273730 5273751 5273747 5273752 +
attcctgcctgtttgggtttgc

SEQ ID NO: 92307 - DNA, 22 bp, Artificial Sequence
  Synthetic oligonucleotide; TTC chr11 5273734 5273755 5273751 5273756 +
ctgcctgtttgggtttgcttta

SEQ ID NO: 92308 - DNA, 22 bp, Artificial Sequence
  Synthetic oligonucleotide; CTG chr11 5273737 5273758 5273754 5273759 +
cctgtttgggtttgctttagca

SEQ ID NO: 92309 - DNA, 22 bp, Artificial Sequence
  Synthetic oligonucleotide; CTG chr11 5273741 5273762 5273758 5273763 +
tttgggtttgctttagcatttg

SEQ ID NO: 92310 - DNA, 22 bp, Artificial Sequence
  Synthetic oligonucleotide; TTT chr11 5273744 5273765 5273761 5273766 +
gggtttgctttagcatttgtaa

SEQ ID NO: 92311 - DNA, 22 bp, Artificial Sequence
  Synthetic oligonucleotide; TTG chr11 5273745 5273766 5273762 5273767 +
ggtttgctttagcatttgtaat

SEQ ID NO: 92312 - DNA, 22 bp, Artificial Sequence
  Synthetic oligonucleotide; TTT chr11 5273750 5273771 5273767 5273772 +
gctttagcatttgtaatttctt

SEQ ID NO: 92313 - DNA, 22 bp, Artificial Sequence
  Synthetic oligonucleotide; TTG chr11 5273751 5273772 5273768 5273773 +
ctttagcatttgtaatttctta

SEQ ID NO: 92314 - DNA, 22 bp, Artificial Sequence
  Synthetic oligonucleotide; CTT chr11 5273754 5273775 5273771 5273776 +
tagcatttgtaatttcttaagt

SEQ ID NO: 92315 - DNA, 22 bp, Artificial Sequence
  Synthetic oligonucleotide; TTT chr11 5273755 5273776 5273772 5273777 +
agcatttgtaatttcttaagtt

SEQ ID NO: 92316 - DNA, 22 bp, Artificial Sequence
  Synthetic oligonucleotide; TTA chr11 5273756 5273777 5273773 5273778 +
gcatttgtaatttcttaagttc

SEQ ID NO: 92317 - DNA, 22 bp, Artificial Sequence
  Synthetic oligonucleotide; TTT chr11 5273762 5273783 5273779 5273784 +
gtaatttcttaagttctatgca

SEQ ID NO: 92318 - DNA, 22 bp, Artificial Sequence
  Synthetic oligonucleotide; TTG chr11 5273763 5273784 5273780 5273785 +
taatttcttaagttctatgcag

SEQ ID NO: 92319 - DNA, 22 bp, Artificial Sequence
  Synthetic oligonucleotide; TTT chr11 5273769 5273790 5273786 5273791 +
cttaagttctatgcaggattct

SEQ ID NO: 92320 - DNA, 22 bp, Artificial Sequence
  Synthetic oligonucleotide; TTC chr11 5273770 5273791 5273787 5273792 +
ttaagttctatgcaggattcta

SEQ ID NO: 92321 - DNA, 22 bp, Artificial Sequence
  Synthetic oligonucleotide; CTT chr11 5273772 5273793 5273789 5273794 +
aagttctatgcaggattctaaa

SEQ ID NO: 92322 - DNA, 22 bp, Artificial Sequence
  Synthetic oligonucleotide; TTA chr11 5273773 5273794 5273790 5273795 +
agttctatgcaggattctaaaa

SEQ ID NO: 92323 - DNA, 22 bp, Artificial Sequence
  Synthetic oligonucleotide; TTC chr11 5273778 5273799 5273795 5273800 +
tatgcaggattctaaaaactgt

SEQ ID NO: 92324 - DNA, 22 bp, Artificial Sequence
  Synthetic oligonucleotide; CTA chr11 5273780 5273801 5273797 5273802 +
tgcaggattctaaaaactgtaa

SEQ ID NO: 92325 - DNA, 22 bp, Artificial Sequence
  Synthetic oligonucleotide; TTC chr11 5273790 5273811 5273807 5273812 +
taaaaactgtaagatgcctaat

SEQ ID NO: 92326 - DNA, 22 bp, Artificial Sequence
  Synthetic oligonucleotide; CTA chr11 5273792 5273813 5273809 5273814 +
aaaactgtaagatgcctaattt

SEQ ID NO: 92327 - DNA, 22 bp, Artificial Sequence
  Synthetic oligonucleotide; CTG chr11 5273799 5273820 5273816 5273821 +
taagatgcctaatttaaacaag

SEQ ID NO: 92328 - DNA, 22 bp, Artificial Sequence
  Synthetic oligonucleotide; CTA chr11 5273810 5273831 5273827 5273832 +
atttaaacaaggaaacatccaa

SEQ ID NO: 92329 - DNA, 22 bp, Artificial Sequence
  Synthetic oligonucleotide; TTT chr11 5273814 5273835 5273831 5273836 +
aaacaaggaaacatccaatatt

SEQ ID NO: 92330 - DNA, 22 bp, Artificial Sequence
  Synthetic oligonucleotide; TTA chr11 5273815 5273836 5273832 5273837 +
aacaaggaaacatccaatattt

SEQ ID NO: 92331 - DNA, 22 bp, Artificial Sequence
  Synthetic oligonucleotide; TTT chr11 5273837 5273858 5273854 5273859 +
tcttaaatctttctggctaatt

SEQ ID NO: 92332 - DNA, 22 bp, Artificial Sequence
  Synthetic oligonucleotide; TTT chr11 5273838 5273859 5273855 5273860 +
cttaaatctttctggctaattt

SEQ ID NO: 92333 - DNA, 22 bp, Artificial Sequence
  Synthetic oligonucleotide; TTC chr11 5273839 5273860 5273856 5273861 +
ttaaatctttctggctaattta

SEQ ID NO: 92334 - DNA, 22 bp, Artificial Sequence
  Synthetic oligonucleotide; CTT chr11 5273841 5273862 5273858 5273863 +
aaatctttctggctaatttatg

SEQ ID NO: 92335 - DNA, 22 bp, Artificial Sequence
  Synthetic oligonucleotide; TTA chr11 5273842 5273863 5273859 5273864 +
aatctttctggctaatttatga

SEQ ID NO: 92336 - DNA, 22 bp, Artificial Sequence
  Synthetic oligonucleotide; CTT chr11 5273848 5273869 5273865 5273870 +
tctggctaatttatgacatatg

SEQ ID NO: 92337 - DNA, 22 bp, Artificial Sequence
  Synthetic oligonucleotide; TTT chr11 5273849 5273870 5273866 5273871 +
ctggctaatttatgacatatgt

SEQ ID NO: 92338 - DNA, 22 bp, Artificial Sequence
  Synthetic oligonucleotide; TTC chr11 5273850 5273871 5273867 5273872 +
tggctaatttatgacatatgtt

SEQ ID NO: 92339 - DNA, 22 bp, Artificial Sequence
  Synthetic oligonucleotide; CTG chr11 5273852 5273873 5273869 5273874 +
gctaatttatgacatatgttta

SEQ ID NO: 92340 - DNA, 22 bp, Artificial Sequence
  Synthetic oligonucleotide; CTA chr11 5273856 5273877 5273873 5273878 +
atttatgacatatgtttaacct

SEQ ID NO: 92341 - DNA, 22 bp, Artificial Sequence
  Synthetic oligonucleotide; TTT chr11 5273860 5273881 5273877 5273882 +
atgacatatgtttaacctgaag

SEQ ID NO: 92342 - DNA, 22 bp, Artificial Sequence
  Synthetic oligonucleotide; TTA chr11 5273861 5273882 5273878 5273883 +
tgacatatgtttaacctgaaga

SEQ ID NO: 92343 - DNA, 22 bp, Artificial Sequence
  Synthetic oligonucleotide; TTT chr11 5273873 5273894 5273890 5273895 +
aacctgaagagtcaaatattgt

SEQ ID NO: 92344 - DNA, 22 bp, Artificial Sequence
  Synthetic oligonucleotide; TTA chr11 5273874 5273895 5273891 5273896 +
acctgaagagtcaaatattgta

SEQ ID NO: 92345 - DNA, 22 bp, Artificial Sequence
  Synthetic oligonucleotide; CTG chr11 5273879 5273900 5273896 5273901 +
aagagtcaaatattgtactgtt

SEQ ID NO: 92346 - DNA, 22 bp, Artificial Sequence
  Synthetic oligonucleotide; TTG chr11 5273894 5273915 5273911 5273916 +
tactgttcttagatgctattag

SEQ ID NO: 92347 - DNA, 22 bp, Artificial Sequence
  Synthetic oligonucleotide; CTG chr11 5273899 5273920 5273916 5273921 +
ttcttagatgctattagtatga

SEQ ID NO: 92348 - DNA, 22 bp, Artificial Sequence
  Synthetic oligonucleotide; TTC chr11 5273902 5273923 5273919 5273924 +
ttagatgctattagtatgaaaa

SEQ ID NO: 92349 - DNA, 22 bp, Artificial Sequence
  Synthetic oligonucleotide; CTT chr11 5273904 5273925 5273921 5273926 +
agatgctattagtatgaaaaat

SEQ ID NO: 92350 - DNA, 22 bp, Artificial Sequence
  Synthetic oligonucleotide; TTA chr11 5273905 5273926 5273922 5273927 +
gatgctattagtatgaaaaatt

SEQ ID NO: 92351 - DNA, 22 bp, Artificial Sequence
  Synthetic oligonucleotide; CTA chr11 5273912 5273933 5273929 5273934 +
ttagtatgaaaaattatataaa

SEQ ID NO: 92352 - DNA, 22 bp, Artificial Sequence
  Synthetic oligonucleotide; TTA chr11 5273915 5273936 5273932 5273937 +
gtatgaaaaattatataaatta

SEQ ID NO: 92353 - DNA, 22 bp, Artificial Sequence
  Synthetic oligonucleotide; TTA chr11 5273928 5273949 5273945 5273950 +
tataaattagattcttgttaag

SEQ ID NO: 92354 - DNA, 22 bp, Artificial Sequence
  Synthetic oligonucleotide; TTA chr11 5273937 5273958 5273954 5273959 +
gattcttgttaagtaaagtagg

SEQ ID NO: 92355 - DNA, 22 bp, Artificial Sequence
  Synthetic oligonucleotide; TTC chr11 5273942 5273963 5273959 5273964 +
ttgttaagtaaagtaggccctt

SEQ ID NO: 92356 - DNA, 22 bp, Artificial Sequence
  Synthetic oligonucleotide; CTT chr11 5273944 5273965 5273961 5273966 +
gttaagtaaagtaggcccttca

SEQ ID NO: 92357 - DNA, 22 bp, Artificial Sequence
  Synthetic oligonucleotide; TTG chr11 5273945 5273966 5273962 5273967 +
ttaagtaaagtaggcccttcac

SEQ ID NO: 92358 - DNA, 22 bp, Artificial Sequence
  Synthetic oligonucleotide; TTA chr11 5273948 5273969 5273965 5273970 +
agtaaagtaggcccttcacttc

SEQ ID NO: 92359 - DNA, 22 bp, Artificial Sequence
  Synthetic oligonucleotide; CTT chr11 5273964 5273985 5273981 5273986 +
cacttcactgaatgtttttcat

SEQ ID NO: 92360 - DNA, 22 bp, Artificial Sequence
  Synthetic oligonucleotide; TTC chr11 5273965 5273986 5273982 5273987 +
acttcactgaatgtttttcatg

SEQ ID NO: 92361 - DNA, 22 bp, Artificial Sequence
  Synthetic oligonucleotide; CTT chr11 5273969 5273990 5273986 5273991 +
cactgaatgtttttcatggtat

SEQ ID NO: 92362 - DNA, 22 bp, Artificial Sequence
  Synthetic oligonucleotide; TTC chr11 5273970 5273991 5273987 5273992 +
actgaatgtttttcatggtatt

SEQ ID NO: 92363 - DNA, 22 bp, Artificial Sequence
  Synthetic oligonucleotide; CTG chr11 5273974 5273995 5273991 5273996 +
aatgtttttcatggtattatct

SEQ ID NO: 92364 - DNA, 22 bp, Artificial Sequence
  Synthetic oligonucleotide; TTT chr11 5273981 5274002 5273998 5274003 +
ttcatggtattatctaagaaat

SEQ ID NO: 92365 - DNA, 22 bp, Artificial Sequence
  Synthetic oligonucleotide; TTT chr11 5273982 5274003 5273999 5274004 +
tcatggtattatctaagaaata

SEQ ID NO: 92366 - DNA, 22 bp, Artificial Sequence
  Synthetic oligonucleotide; TTT chr11 5273983 5274004 5274000 5274005 +
catggtattatctaagaaataa

SEQ ID NO: 92367 - DNA, 22 bp, Artificial Sequence
  Synthetic oligonucleotide; TTC chr11 5273984 5274005 5274001 5274006 +
atggtattatctaagaaataaa

SEQ ID NO: 92368 - DNA, 22 bp, Artificial Sequence
  Synthetic oligonucleotide; TTA chr11 5273993 5274014 5274010 5274015 +
tctaagaaataaatactttaat

SEQ ID NO: 92369 - DNA, 22 bp, Artificial Sequence
  Synthetic oligonucleotide; CTA chr11 5273997 5274018 5274014 5274019 +
agaaataaatactttaatgaat

SEQ ID NO: 92370 - DNA, 22 bp, Artificial Sequence
  Synthetic oligonucleotide; CTT chr11 5274011 5274032 5274028 5274033 +
taatgaatattctttaccacaa

SEQ ID NO: 92371 - DNA, 22 bp, Artificial Sequence
  Synthetic oligonucleotide; TTT chr11 5274012 5274033 5274029 5274034 +
aatgaatattctttaccacaaa

SEQ ID NO: 92372 - DNA, 22 bp, Artificial Sequence
  Synthetic oligonucleotide; TTA chr11 5274013 5274034 5274030 5274035 +
atgaatattctttaccacaaat

SEQ ID NO: 92373 - DNA, 22 bp, Artificial Sequence
  Synthetic oligonucleotide; TTC chr11 5274023 5274044 5274040 5274045 +
tttaccacaaataacttacttt

SEQ ID NO: 92374 - DNA, 22 bp, Artificial Sequence
  Synthetic oligonucleotide; CTT chr11 5274025 5274046 5274042 5274047 +
taccacaaataacttactttat

SEQ ID NO: 92375 - DNA, 22 bp, Artificial Sequence
  Synthetic oligonucleotide; TTT chr11 5274026 5274047 5274043 5274048 +
accacaaataacttactttatt

SEQ ID NO: 92376 - DNA, 22 bp, Artificial Sequence
  Synthetic oligonucleotide; TTA chr11 5274027 5274048 5274044 5274049 +
ccacaaataacttactttattt

SEQ ID NO: 92377 - DNA, 22 bp, Artificial Sequence
  Synthetic oligonucleotide; CTT chr11 5274040 5274061 5274057 5274062 +
actttatttttatttttaaaat

SEQ ID NO: 92378 - DNA, 22 bp, Artificial Sequence
  Synthetic oligonucleotide; TTA chr11 5274041 5274062 5274058 5274063 +
ctttatttttatttttaaaata

SEQ ID NO: 92379 - DNA, 22 bp, Artificial Sequence
  Synthetic oligonucleotide; CTT chr11 5274044 5274065 5274061 5274066 +
tatttttatttttaaaatagga

SEQ ID NO: 92380 - DNA, 22 bp, Artificial Sequence
  Synthetic oligonucleotide; TTT chr11 5274045 5274066 5274062 5274067 +
atttttatttttaaaataggaa

SEQ ID NO: 92381 - DNA, 22 bp, Artificial Sequence
  Synthetic oligonucleotide; TTA chr11 5274046 5274067 5274063 5274068 +
tttttatttttaaaataggaaa

SEQ ID NO: 92382 - DNA, 22 bp, Artificial Sequence
  Synthetic oligonucleotide; TTT chr11 5274049 5274070 5274066 5274071 +
ttatttttaaaataggaaaaat

SEQ ID NO: 92383 - DNA, 22 bp, Artificial Sequence
  Synthetic oligonucleotide; TTT chr11 5274050 5274071 5274067 5274072 +
tatttttaaaataggaaaaata

SEQ ID NO: 92384 - DNA, 22 bp, Artificial Sequence
  Synthetic oligonucleotide; TTT chr11 5274051 5274072 5274068 5274073 +
atttttaaaataggaaaaatat

SEQ ID NO: 92385 - DNA, 22 bp, Artificial Sequence
  Synthetic oligonucleotide; TTA chr11 5274052 5274073 5274069 5274074 +
tttttaaaataggaaaaatata

SEQ ID NO: 92386 - DNA, 22 bp, Artificial Sequence
  Synthetic oligonucleotide; TTT chr11 5274055 5274076 5274072 5274077 +
ttaaaataggaaaaatataaac

SEQ ID NO: 92387 - DNA, 22 bp, Artificial Sequence
  Synthetic oligonucleotide; TTT chr11 5274056 5274077 5274073 5274078 +
taaaataggaaaaatataaaca

SEQ ID NO: 92388 - DNA, 22 bp, Artificial Sequence
  Synthetic oligonucleotide; TTT chr11 5274057 5274078 5274074 5274079 +
aaaataggaaaaatataaacaa

SEQ ID NO: 92389 - DNA, 22 bp, Artificial Sequence
  Synthetic oligonucleotide; TTA chr11 5274058 5274079 5274075 5274080 +
aaataggaaaaatataaacaag

SEQ ID NO: 92390 - DNA, 22 bp, Artificial Sequence
  Synthetic oligonucleotide; CTT chr11 5274084 5274105 5274101 5274106 +
gtaaaccactgataggaaaaga

SEQ ID NO: 92391 - DNA, 22 bp, Artificial Sequence
  Synthetic oligonucleotide; TTG chr11 5274085 5274106 5274102 5274107 +
taaaccactgataggaaaagag

SEQ ID NO: 92392 - DNA, 22 bp, Artificial Sequence
  Synthetic oligonucleotide; CTG chr11 5274095 5274116 5274112 5274117 +
ataggaaaagagctgcttagga

SEQ ID NO: 92393 - DNA, 22 bp, Artificial Sequence
  Synthetic oligonucleotide; CTG chr11 5274110 5274131 5274127 5274132 +
cttaggattctaaattagccag

SEQ ID NO: 92394 - DNA, 22 bp, Artificial Sequence
  Synthetic oligonucleotide; CTT chr11 5274113 5274134 5274130 5274135 +
aggattctaaattagccagatt

SEQ ID NO: 92395 - DNA, 22 bp, Artificial Sequence
  Synthetic oligonucleotide; TTA chr11 5274114 5274135 5274131 5274136 +
ggattctaaattagccagattt

SEQ ID NO: 92396 - DNA, 22 bp, Artificial Sequence
  Synthetic oligonucleotide; TTC chr11 5274120 5274141 5274137 5274142 +
taaattagccagattttaaatt

SEQ ID NO: 92397 - DNA, 22 bp, Artificial Sequence
  Synthetic oligonucleotide; CTA chr11 5274122 5274143 5274139 5274144 +
aattagccagattttaaattat

SEQ ID NO: 92398 - DNA, 22 bp, Artificial Sequence
  Synthetic oligonucleotide; TTA chr11 5274127 5274148 5274144 5274149 +
gccagattttaaattattctgc

SEQ ID NO: 92399 - DNA, 22 bp, Artificial Sequence
  Synthetic oligonucleotide; TTT chr11 5274136 5274157 5274153 5274158 +
taaattattctgcttccattat

SEQ ID NO: 92400 - DNA, 22 bp, Artificial Sequence
  Synthetic oligonucleotide; TTT chr11 5274137 5274158 5274154 5274159 +
aaattattctgcttccattatg

SEQ ID NO: 92401 - DNA, 22 bp, Artificial Sequence
  Synthetic oligonucleotide; TTA chr11 5274138 5274159 5274155 5274160 +
aattattctgcttccattatgt

SEQ ID NO: 92402 - DNA, 22 bp, Artificial Sequence
  Synthetic oligonucleotide; TTA chr11 5274143 5274164 5274160 5274165 +
ttctgcttccattatgtatcta

SEQ ID NO: 92403 - DNA, 22 bp, Artificial Sequence
  Synthetic oligonucleotide; TTC chr11 5274146 5274167 5274163 5274168 +
tgcttccattatgtatctaaat

SEQ ID NO: 92404 - DNA, 22 bp, Artificial Sequence
  Synthetic oligonucleotide; CTG chr11 5274148 5274169 5274165 5274170 +
cttccattatgtatctaaatct

SEQ ID NO: 92405 - DNA, 22 bp, Artificial Sequence
  Synthetic oligonucleotide; CTT chr11 5274151 5274172 5274168 5274173 +
ccattatgtatctaaatctata

SEQ ID NO: 92406 - DNA, 22 bp, Artificial Sequence
  Synthetic oligonucleotide; TTC chr11 5274152 5274173 5274169 5274174 +
cattatgtatctaaatctatat

SEQ ID NO: 92407 - DNA, 22 bp, Artificial Sequence
  Synthetic oligonucleotide; TTA chr11 5274157 5274178 5274174 5274179 +
tgtatctaaatctatattctca

SEQ ID NO: 92408 - DNA, 22 bp, Artificial Sequence
  Synthetic oligonucleotide; CTA chr11 5274165 5274186 5274182 5274187 +
aatctatattctcagaacaaaa

SEQ ID NO: 92409 - DNA, 22 bp, Artificial Sequence
  Synthetic oligonucleotide; CTA chr11 5274171 5274192 5274188 5274193 +
tattctcagaacaaaaatagat

SEQ ID NO: 92410 - DNA, 22 bp, Artificial Sequence
  Synthetic oligonucleotide; TTC chr11 5274176 5274197 5274193 5274198 +
tcagaacaaaaatagatgtaag

SEQ ID NO: 92411 - DNA, 22 bp, Artificial Sequence
  Synthetic oligonucleotide; CTC chr11 5274178 5274199 5274195 5274200 +
agaacaaaaatagatgtaagca

SEQ ID NO: 92412 - DNA, 22 bp, Artificial Sequence
  Synthetic oligonucleotide; TTC chr11 5274208 5274229 5274225 5274230 +
tactagattttgtgttagattt

SEQ ID NO: 92413 - DNA, 22 bp, Artificial Sequence
  Synthetic oligonucleotide; CTA chr11 5274210 5274231 5274227 5274232 +
ctagattttgtgttagattttg

SEQ ID NO: 92414 - DNA, 22 bp, Artificial Sequence
  Synthetic oligonucleotide; CTA chr11 5274213 5274234 5274230 5274235 +
gattttgtgttagattttgcat

SEQ ID NO: 92415 - DNA, 22 bp, Artificial Sequence
  Synthetic oligonucleotide; TTT chr11 5274218 5274239 5274235 5274240 +
tgtgttagattttgcattatcc

SEQ ID NO: 92416 - DNA, 22 bp, Artificial Sequence
  Synthetic oligonucleotide; TTT chr11 5274219 5274240 5274236 5274241 +
gtgttagattttgcattatcca

SEQ ID NO: 92417 - DNA, 22 bp, Artificial Sequence
  Synthetic oligonucleotide; TTG chr11 5274220 5274241 5274237 5274242 +
tgttagattttgcattatccag

SEQ ID NO: 92418 - DNA, 22 bp, Artificial Sequence
  Synthetic oligonucleotide; TTA chr11 5274225 5274246 5274242 5274247 +
gattttgcattatccaggaatg

SEQ ID NO: 92419 - DNA, 22 bp, Artificial Sequence
  Synthetic oligonucleotide; TTT chr11 5274230 5274251 5274247 5274252 +
tgcattatccaggaatgacttg

SEQ ID NO: 92420 - DNA, 22 bp, Artificial Sequence
  Synthetic oligonucleotide; TTT chr11 5274231 5274252 5274248 5274253 +
gcattatccaggaatgacttgg

SEQ ID NO: 92421 - DNA, 22 bp, Artificial Sequence
  Synthetic oligonucleotide; TTG chr11 5274232 5274253 5274249 5274254 +
cattatccaggaatgacttgga

SEQ ID NO: 92422 - DNA, 22 bp, Artificial Sequence
  Synthetic oligonucleotide; TTA chr11 5274237 5274258 5274254 5274259 +
tccaggaatgacttggatatca

SEQ ID NO: 92423 - DNA, 22 bp, Artificial Sequence
  Synthetic oligonucleotide; CTT chr11 5274251 5274272 5274268 5274273 +
ggatatcacaagtcataaattc

SEQ ID NO: 92424 - DNA, 22 bp, Artificial Sequence
  Synthetic oligonucleotide; TTG chr11 5274252 5274273 5274269 5274274 +
gatatcacaagtcataaattct

SEQ ID NO: 92425 - DNA, 22 bp, Artificial Sequence
  Synthetic oligonucleotide; TTC chr11 5274273 5274294 5274290 5274295 +
tgtggctgccttgcaggaagcc

SEQ ID NO: 92426 - DNA, 22 bp, Artificial Sequence
  Synthetic oligonucleotide; CTG chr11 5274275 5274296 5274292 5274297 +
tggctgccttgcaggaagcctg

SEQ ID NO: 92427 - DNA, 22 bp, Artificial Sequence
  Synthetic oligonucleotide; CTG chr11 5274281 5274302 5274298 5274303 +
ccttgcaggaagcctgtggcta

SEQ ID NO: 92428 - DNA, 22 bp, Artificial Sequence
  Synthetic oligonucleotide; CTT chr11 5274285 5274306 5274302 5274307 +
gcaggaagcctgtggctatttt

SEQ ID NO: 92429 - DNA, 22 bp, Artificial Sequence
  Synthetic oligonucleotide; TTG chr11 5274286 5274307 5274303 5274308 +
caggaagcctgtggctattttc

SEQ ID NO: 92430 - DNA, 22 bp, Artificial Sequence
  Synthetic oligonucleotide; CTG chr11 5274297 5274318 5274314 5274319 +
tggctattttctagtgtaattg

SEQ ID NO: 92431 - DNA, 22 bp, Artificial Sequence
  Synthetic oligonucleotide; CTA chr11 5274303 5274324 5274320 5274325 +
ttttctagtgtaattgtaaaga

SEQ ID NO: 92432 - DNA, 22 bp, Artificial Sequence
  Synthetic oligonucleotide; TTT chr11 5274306 5274327 5274323 5274328 +
tctagtgtaattgtaaagaatg

SEQ ID NO: 92433 - DNA, 22 bp, Artificial Sequence
  Synthetic oligonucleotide; TTT chr11 5274307 5274328 5274324 5274329 +
ctagtgtaattgtaaagaatga

SEQ ID NO: 92434 - DNA, 22 bp, Artificial Sequence
  Synthetic oligonucleotide; TTC chr11 5274308 5274329 5274325 5274330 +
tagtgtaattgtaaagaatgag

SEQ ID NO: 92435 - DNA, 22 bp, Artificial Sequence
  Synthetic oligonucleotide; CTA chr11 5274310 5274331 5274327 5274332 +
gtgtaattgtaaagaatgagag

SEQ ID NO: 92436 - DNA, 22 bp, Artificial Sequence
  Synthetic oligonucleotide; TTG chr11 5274319 5274340 5274336 5274341 +
taaagaatgagagaatagacca

SEQ ID NO: 92437 - DNA, 22 bp, Artificial Sequence
  Synthetic oligonucleotide; TTC chr11 5274353 5274374 5274370 5274375 +
aaactgttgctttcttgttttc

SEQ ID NO: 92438 - DNA, 22 bp, Artificial Sequence
  Synthetic oligonucleotide; CTG chr11 5274359 5274380 5274376 5274381 +
ttgctttcttgttttcaacttt

SEQ ID NO: 92439 - DNA, 22 bp, Artificial Sequence
  Synthetic oligonucleotide; TTG chr11 5274362 5274383 5274379 5274384 +
ctttcttgttttcaacttttat

SEQ ID NO: 92440 - DNA, 22 bp, Artificial Sequence
  Synthetic oligonucleotide; CTT chr11 5274365 5274386 5274382 5274387 +
tcttgttttcaacttttatttt

SEQ ID NO: 92441 - DNA, 22 bp, Artificial Sequence
  Synthetic oligonucleotide; TTT chr11 5274366 5274387 5274383 5274388 +
cttgttttcaacttttatttta

SEQ ID NO: 92442 - DNA, 22 bp, Artificial Sequence
  Synthetic oligonucleotide; TTC chr11 5274367 5274388 5274384 5274389 +
ttgttttcaacttttattttaa

SEQ ID NO: 92443 - DNA, 22 bp, Artificial Sequence
  Synthetic oligonucleotide; CTT chr11 5274369 5274390 5274386 5274391 +
gttttcaacttttattttaagt

SEQ ID NO: 92444 - DNA, 22 bp, Artificial Sequence
  Synthetic oligonucleotide; TTG chr11 5274370 5274391 5274387 5274392 +
ttttcaacttttattttaagtt

SEQ ID NO: 92445 - DNA, 22 bp, Artificial Sequence
  Synthetic oligonucleotide; TTT chr11 5274373 5274394 5274390 5274395 +
tcaacttttattttaagttcag

SEQ ID NO: 92446 - DNA, 22 bp, Artificial Sequence
  Synthetic oligonucleotide; TTT chr11 5274374 5274395 5274391 5274396 +
caacttttattttaagttcagg

SEQ ID NO: 92447 - DNA, 22 bp, Artificial Sequence
  Synthetic oligonucleotide; TTC chr11 5274375 5274396 5274392 5274397 +
aacttttattttaagttcaggg

SEQ ID NO: 92448 - DNA, 22 bp, Artificial Sequence
  Synthetic oligonucleotide; CTT chr11 5274380 5274401 5274397 5274402 +
ttattttaagttcaggggtaca

SEQ ID NO: 92449 - DNA, 22 bp, Artificial Sequence
  Synthetic oligonucleotide; TTT chr11 5274381 5274402 5274398 5274403 +
tattttaagttcaggggtacat

SEQ ID NO: 92450 - DNA, 22 bp, Artificial Sequence
  Synthetic oligonucleotide; TTT chr11 5274382 5274403 5274399 5274404 +
attttaagttcaggggtacatg

SEQ ID NO: 92451 - DNA, 22 bp, Artificial Sequence
  Synthetic oligonucleotide; TTA chr11 5274383 5274404 5274400 5274405 +
ttttaagttcaggggtacatgt

SEQ ID NO: 92452 - DNA, 22 bp, Artificial Sequence
  Synthetic oligonucleotide; TTT chr11 5274386 5274407 5274403 5274408 +
taagttcaggggtacatgtaca

SEQ ID NO: 92453 - DNA, 22 bp, Artificial Sequence
  Synthetic oligonucleotide; TTT chr11 5274387 5274408 5274404 5274409 +
aagttcaggggtacatgtacag

SEQ ID NO: 92454 - DNA, 22 bp, Artificial Sequence
  Synthetic oligonucleotide; TTA chr11 5274388 5274409 5274405 5274410 +
agttcaggggtacatgtacagg

SEQ ID NO: 92455 - DNA, 22 bp, Artificial Sequence
  Synthetic oligonucleotide; TTC chr11 5274393 5274414 5274410 5274415 +
aggggtacatgtacaggatgtg

SEQ ID NO: 92456 - DNA, 22 bp, Artificial Sequence
  Synthetic oligonucleotide; TTT chr11 5274422 5274443 5274439 5274444 +
gttacatagataaatgaatgtc

SEQ ID NO: 92457 - DNA, 22 bp, Artificial Sequence
  Synthetic oligonucleotide; TTG chr11 5274423 5274444 5274440 5274445 +
ttacatagataaatgaatgtca

SEQ ID NO: 92458 - DNA, 22 bp, Artificial Sequence
  Synthetic oligonucleotide; TTA chr11 5274426 5274447 5274443 5274448 +
catagataaatgaatgtcaagg

SEQ ID NO: 92459 - DNA, 22 bp, Artificial Sequence
  Synthetic oligonucleotide; TTT chr11 5274454 5274475 5274471 5274476 +
gttgtatagatgatctcatcac

SEQ ID NO: 92460 - DNA, 22 bp, Artificial Sequence
  Synthetic oligonucleotide; TTG chr11 5274455 5274476 5274472 5274477 +
ttgtatagatgatctcatcact

SEQ ID NO: 92461 - DNA, 22 bp, Artificial Sequence
  Synthetic oligonucleotide; TTG chr11 5274458 5274479 5274475 5274480 +
tatagatgatctcatcactcag

SEQ ID NO: 92462 - DNA, 22 bp, Artificial Sequence
  Synthetic oligonucleotide; CTC chr11 5274471 5274492 5274488 5274493 +
atcactcaggtattacgcttag

SEQ ID NO: 92463 - DNA, 22 bp, Artificial Sequence
  Synthetic oligonucleotide; CTC chr11 5274478 5274499 5274495 5274500 +
aggtattacgcttagcatccat

SEQ ID NO: 92464 - DNA, 22 bp, Artificial Sequence
  Synthetic oligonucleotide; TTA chr11 5274486 5274507 5274503 5274508 +
cgcttagcatccattagtgatt

SEQ ID NO: 92465 - DNA, 22 bp, Artificial Sequence
  Synthetic oligonucleotide; CTT chr11 5274491 5274512 5274508 5274513 +
agcatccattagtgatttttcc

SEQ ID NO: 92466 - DNA, 22 bp, Artificial Sequence
  Synthetic oligonucleotide; TTA chr11 5274492 5274513 5274509 5274514 +
gcatccattagtgatttttcct

SEQ ID NO: 92467 - DNA, 22 bp, Artificial Sequence
  Synthetic oligonucleotide; TTA chr11 5274502 5274523 5274519 5274524 +
gtgatttttcctgatcctctcc

SEQ ID NO: 92468 - DNA, 22 bp, Artificial Sequence
  Synthetic oligonucleotide; TTT chr11 5274509 5274530 5274526 5274531 +
ttcctgatcctctccttctctc

SEQ ID NO: 92469 - DNA, 22 bp, Artificial Sequence
  Synthetic oligonucleotide; TTT chr11 5274510 5274531 5274527 5274532 +
tcctgatcctctccttctctca

SEQ ID NO: 92470 - DNA, 22 bp, Artificial Sequence
  Synthetic oligonucleotide; TTT chr11 5274511 5274532 5274528 5274533 +
cctgatcctctccttctctcac

SEQ ID NO: 92471 - DNA, 22 bp, Artificial Sequence
  Synthetic oligonucleotide; TTC chr11 5274512 5274533 5274529 5274534 +
ctgatcctctccttctctcacc

SEQ ID NO: 92472 - DNA, 22 bp, Artificial Sequence
  Synthetic oligonucleotide; CTG chr11 5274515 5274536 5274532 5274537 +
atcctctccttctctcaccctc

SEQ ID NO: 92473 - DNA, 22 bp, Artificial Sequence
  Synthetic oligonucleotide; CTC chr11 5274521 5274542 5274538 5274543 +
tccttctctcaccctccaccct

SEQ ID NO: 92474 - DNA, 22 bp, Artificial Sequence
  Synthetic oligonucleotide; CTC chr11 5274523 5274544 5274540 5274545 +
cttctctcaccctccaccctct

SEQ ID NO: 92475 - DNA, 22 bp, Artificial Sequence
  Synthetic oligonucleotide; CTT chr11 5274526 5274547 5274543 5274548 +
ctctcaccctccaccctctgat

SEQ ID NO: 92476 - DNA, 22 bp, Artificial Sequence
  Synthetic oligonucleotide; TTC chr11 5274527 5274548 5274544 5274549 +
tctcaccctccaccctctgata

SEQ ID NO: 92477 - DNA, 22 bp, Artificial Sequence
  Synthetic oligonucleotide; CTC chr11 5274529 5274550 5274546 5274551 +
tcaccctccaccctctgatagg

SEQ ID NO: 92478 - DNA, 22 bp, Artificial Sequence
  Synthetic oligonucleotide; CTC chr11 5274531 5274552 5274548 5274553 +
accctccaccctctgataggcc

SEQ ID NO: 92479 - DNA, 22 bp, Artificial Sequence
  Synthetic oligonucleotide; CTC chr11 5274537 5274558 5274554 5274559 +
caccctctgataggccccagta

SEQ ID NO: 92480 - DNA, 22 bp, Artificial Sequence
  Synthetic oligonucleotide; CTC chr11 5274544 5274565 5274561 5274566 +
tgataggccccagtatgcgttg

SEQ ID NO: 92481 - DNA, 22 bp, Artificial Sequence
  Synthetic oligonucleotide; CTG chr11 5274546 5274567 5274563 5274568 +
ataggccccagtatgcgttgtt

SEQ ID NO: 92482 - DNA, 22 bp, Artificial Sequence
  Synthetic oligonucleotide; TTG chr11 5274566 5274587 5274583 5274588 +
tttccctctatgagtccatgtg

SEQ ID NO: 92483 - DNA, 22 bp, Artificial Sequence
  Synthetic oligonucleotide; TTT chr11 5274569 5274590 5274586 5274591 +
ccctctatgagtccatgtgttc

SEQ ID NO: 92484 - DNA, 22 bp, Artificial Sequence
  Synthetic oligonucleotide; TTC chr11 5274570 5274591 5274587 5274592 +
cctctatgagtccatgtgttct

SEQ ID NO: 92485 - DNA, 22 bp, Artificial Sequence
  Synthetic oligonucleotide; CTC chr11 5274574 5274595 5274591 5274596 +
tatgagtccatgtgttctcatc

SEQ ID NO: 92486 - DNA, 22 bp, Artificial Sequence
  Synthetic oligonucleotide; CTA chr11 5274576 5274597 5274593 5274598 +
tgagtccatgtgttctcatcat

SEQ ID NO: 92487 - DNA, 22 bp, Artificial Sequence
  Synthetic oligonucleotide; TTC chr11 5274591 5274612 5274608 5274613 +
tcatcatttagcttctaactgt

SEQ ID NO: 92488 - DNA, 22 bp, Artificial Sequence
  Synthetic oligonucleotide; CTC chr11 5274593 5274614 5274610 5274615 +
atcatttagcttctaactgttg

SEQ ID NO: 92489 - DNA, 22 bp, Artificial Sequence
  Synthetic oligonucleotide; TTT chr11 5274600 5274621 5274617 5274622 +
agcttctaactgttgctttcgt

SEQ ID NO: 92490 - DNA, 22 bp, Artificial Sequence
  Synthetic oligonucleotide; TTA chr11 5274601 5274622 5274618 5274623 +
gcttctaactgttgctttcgta

SEQ ID NO: 92491 - DNA, 22 bp, Artificial Sequence
  Synthetic oligonucleotide; CTT chr11 5274605 5274626 5274622 5274627 +
ctaactgttgctttcgtagtgt

SEQ ID NO: 92492 - DNA, 22 bp, Artificial Sequence
  Synthetic oligonucleotide; TTC chr11 5274606 5274627 5274623 5274628 +
taactgttgctttcgtagtgta

SEQ ID NO: 92493 - DNA, 22 bp, Artificial Sequence
  Synthetic oligonucleotide; CTA chr11 5274608 5274629 5274625 5274630 +
actgttgctttcgtagtgtacc

SEQ ID NO: 92494 - DNA, 22 bp, Artificial Sequence
  Synthetic oligonucleotide; CTG chr11 5274612 5274633 5274629 5274634 +
ttgctttcgtagtgtacctctg

SEQ ID NO: 92495 - DNA, 22 bp, Artificial Sequence
  Synthetic oligonucleotide; TTG chr11 5274615 5274636 5274632 5274637 +
ctttcgtagtgtacctctgcct

SEQ ID NO: 92496 - DNA, 22 bp, Artificial Sequence
  Synthetic oligonucleotide; CTT chr11 5274618 5274639 5274635 5274640 +
tcgtagtgtacctctgcctcat

SEQ ID NO: 92497 - DNA, 22 bp, Artificial Sequence
  Synthetic oligonucleotide; TTT chr11 5274619 5274640 5274636 5274641 +
cgtagtgtacctctgcctcatc

SEQ ID NO: 92498 - DNA, 22 bp, Artificial Sequence
  Synthetic oligonucleotide; TTC chr11 5274620 5274641 5274637 5274642 +
gtagtgtacctctgcctcatct

SEQ ID NO: 92499 - DNA, 22 bp, Artificial Sequence
  Synthetic oligonucleotide; CTC chr11 5274632 5274653 5274649 5274654 +
tgcctcatctctcacgaagttt

SEQ ID NO: 92500 - DNA, 22 bp, Artificial Sequence
  Synthetic oligonucleotide; CTG chr11 5274634 5274655 5274651 5274656 +
cctcatctctcacgaagtttgc

SEQ ID NO: 92501 - DNA, 22 bp, Artificial Sequence
  Synthetic oligonucleotide; CTC chr11 5274638 5274659 5274655 5274660 +
atctctcacgaagtttgcaggt

SEQ ID NO: 92502 - DNA, 22 bp, Artificial Sequence
  Synthetic oligonucleotide; CTC chr11 5274643 5274664 5274660 5274665 +
tcacgaagtttgcaggtgagtt

SEQ ID NO: 92503 - DNA, 22 bp, Artificial Sequence
  Synthetic oligonucleotide; CTC chr11 5274645 5274666 5274662 5274667 +
acgaagtttgcaggtgagtttg

SEQ ID NO: 92504 - DNA, 22 bp, Artificial Sequence
  Synthetic oligonucleotide; TTT chr11 5274654 5274675 5274671 5274676 +
gcaggtgagtttgagccagggc

SEQ ID NO: 92505 - DNA, 22 bp, Artificial Sequence
  Synthetic oligonucleotide; TTG chr11 5274655 5274676 5274672 5274677 +
caggtgagtttgagccagggct

SEQ ID NO: 92506 - DNA, 22 bp, Artificial Sequence
  Synthetic oligonucleotide; TTT chr11 5274666 5274687 5274683 5274688 +
gagccagggctgaggctcattc

SEQ ID NO: 92507 - DNA, 22 bp, Artificial Sequence
  Synthetic oligonucleotide; TTG chr11 5274667 5274688 5274684 5274689 +
agccagggctgaggctcattct

SEQ ID NO: 92508 - DNA, 22 bp, Artificial Sequence
  Synthetic oligonucleotide; CTG chr11 5274678 5274699 5274695 5274700 +
aggctcattctcaagagtaatc

SEQ ID NO: 92509 - DNA, 22 bp, Artificial Sequence
  Synthetic oligonucleotide; CTC chr11 5274684 5274705 5274701 5274706 +
attctcaagagtaatctctctc

SEQ ID NO: 92510 - DNA, 22 bp, Artificial Sequence
  Synthetic oligonucleotide; TTC chr11 5274688 5274709 5274705 5274710 +
tcaagagtaatctctctctctg

SEQ ID NO: 92511 - DNA, 22 bp, Artificial Sequence
  Synthetic oligonucleotide; CTC chr11 5274690 5274711 5274707 5274712 +
aagagtaatctctctctctggc

SEQ ID NO: 92512 - DNA, 22 bp, Artificial Sequence
  Synthetic oligonucleotide; CTC chr11 5274702 5274723 5274719 5274724 +
tctctctggcaacttggagcac

SEQ ID NO: 92513 - DNA, 22 bp, Artificial Sequence
  Synthetic oligonucleotide; CTC chr11 5274704 5274725 5274721 5274726 +
tctctggcaacttggagcacag

SEQ ID NO: 92514 - DNA, 22 bp, Artificial Sequence
  Synthetic oligonucleotide; CTC chr11 5274706 5274727 5274723 5274728 +
tctggcaacttggagcacagac

SEQ ID NO: 92515 - DNA, 22 bp, Artificial Sequence
  Synthetic oligonucleotide; CTC chr11 5274708 5274729 5274725 5274730 +
tggcaacttggagcacagacat

SEQ ID NO: 92516 - DNA, 22 bp, Artificial Sequence
  Synthetic oligonucleotide; CTG chr11 5274710 5274731 5274727 5274732 +
gcaacttggagcacagacatcc

SEQ ID NO: 92517 - DNA, 22 bp, Artificial Sequence
  Synthetic oligonucleotide; CTT chr11 5274717 5274738 5274734 5274739 +
ggagcacagacatcctattgtg

SEQ ID NO: 92518 - DNA, 22 bp, Artificial Sequence
  Synthetic oligonucleotide; TTG chr11 5274718 5274739 5274735 5274740 +
gagcacagacatcctattgtgt

SEQ ID NO: 92519 - DNA, 22 bp, Artificial Sequence
  Synthetic oligonucleotide; CTA chr11 5274734 5274755 5274751 5274756 +
ttgtgtgactgacctcgggagc

SEQ ID NO: 92520 - DNA, 22 bp, Artificial Sequence
  Synthetic oligonucleotide; TTG chr11 5274737 5274758 5274754 5274759 +
tgtgactgacctcgggagccac

SEQ ID NO: 92521 - DNA, 22 bp, Artificial Sequence
  Synthetic oligonucleotide; CTG chr11 5274745 5274766 5274762 5274767 +
acctcgggagccactgtgccta

SEQ ID NO: 92522 - DNA, 22 bp, Artificial Sequence
  Synthetic oligonucleotide; CTC chr11 5274750 5274771 5274767 5274772 +
gggagccactgtgcctaaagta

SEQ ID NO: 92523 - DNA, 22 bp, Artificial Sequence
  Synthetic oligonucleotide; CTG chr11 5274761 5274782 5274778 5274783 +
tgcctaaagtacaaccagagtt

SEQ ID NO: 92524 - DNA, 22 bp, Artificial Sequence
  Synthetic oligonucleotide; CTA chr11 5274767 5274788 5274784 5274789 +
aagtacaaccagagttacttgt

SEQ ID NO: 92525 - DNA, 22 bp, Artificial Sequence
  Synthetic oligonucleotide; TTA chr11 5274784 5274805 5274801 5274806 +
cttgtgaatgttaattaagcag

SEQ ID NO: 92526 - DNA, 22 bp, Artificial Sequence
  Synthetic oligonucleotide; CTT chr11 5274787 5274808 5274804 5274809 +
gtgaatgttaattaagcaggag

SEQ ID NO: 92527 - DNA, 22 bp, Artificial Sequence
  Synthetic oligonucleotide; TTG chr11 5274788 5274809 5274805 5274810 +
tgaatgttaattaagcaggagg

SEQ ID NO: 92528 - DNA, 22 bp, Artificial Sequence
  Synthetic oligonucleotide; TTA chr11 5274797 5274818 5274814 5274819 +
attaagcaggagggatctttaa

SEQ ID NO: 92529 - DNA, 22 bp, Artificial Sequence
  Synthetic oligonucleotide; TTA chr11 5274801 5274822 5274818 5274823 +
agcaggagggatctttaatggg

SEQ ID NO: 92530 - DNA, 22 bp, Artificial Sequence
  Synthetic oligonucleotide; CTT chr11 5274816 5274837 5274833 5274838 +
taatgggaaaaaggagtagaaa

SEQ ID NO: 92531 - DNA, 22 bp, Artificial Sequence
  Synthetic oligonucleotide; TTT chr11 5274817 5274838 5274834 5274839 +
aatgggaaaaaggagtagaaag

SEQ ID NO: 92532 - DNA, 22 bp, Artificial Sequence
  Synthetic oligonucleotide; TTA chr11 5274818 5274839 5274835 5274840 +
atgggaaaaaggagtagaaagc

SEQ ID NO: 92533 - DNA, 22 bp, Artificial Sequence
  Synthetic oligonucleotide; TTA chr11 5274856 5274877 5274873 5274878 +
tgccacactttcctacatgatg

SEQ ID NO: 92534 - DNA, 22 bp, Artificial Sequence
  Synthetic oligonucleotide; CTT chr11 5274866 5274887 5274883 5274888 +
tcctacatgatgggcactgaag

SEQ ID NO: 92535 - DNA, 22 bp, Artificial Sequence
  Synthetic oligonucleotide; TTT chr11 5274867 5274888 5274884 5274889 +
cctacatgatgggcactgaagg

SEQ ID NO: 92536 - DNA, 22 bp, Artificial Sequence
  Synthetic oligonucleotide; TTC chr11 5274868 5274889 5274885 5274890 +
ctacatgatgggcactgaaggt

SEQ ID NO: 92537 - DNA, 22 bp, Artificial Sequence
  Synthetic oligonucleotide; CTA chr11 5274871 5274892 5274888 5274893 +
catgatgggcactgaaggttaa

SEQ ID NO: 92538 - DNA, 22 bp, Artificial Sequence
  Synthetic oligonucleotide; CTG chr11 5274885 5274906 5274902 5274907 +
aaggttaaaacttgagtctgtc

SEQ ID NO: 92539 - DNA, 22 bp, Artificial Sequence
  Synthetic oligonucleotide; TTA chr11 5274892 5274913 5274909 5274914 +
aaacttgagtctgtcaacttag

SEQ ID NO: 92540 - DNA, 22 bp, Artificial Sequence
  Synthetic oligonucleotide; CTT chr11 5274898 5274919 5274915 5274920 +
gagtctgtcaacttagaaaact

SEQ ID NO: 92541 - DNA, 22 bp, Artificial Sequence
  Synthetic oligonucleotide; TTG chr11 5274899 5274920 5274916 5274921 +
agtctgtcaacttagaaaactc

SEQ ID NO: 92542 - DNA, 22 bp, Artificial Sequence
  Synthetic oligonucleotide; CTG chr11 5274905 5274926 5274922 5274927 +
tcaacttagaaaactcataaat

SEQ ID NO: 92543 - DNA, 22 bp, Artificial Sequence
  Synthetic oligonucleotide; CTT chr11 5274912 5274933 5274929 5274934 +
agaaaactcataaatatcccat

SEQ ID NO: 92544 - DNA, 22 bp, Artificial Sequence
  Synthetic oligonucleotide; TTA chr11 5274913 5274934 5274930 5274935 +
gaaaactcataaatatcccatt

SEQ ID NO: 92545 - DNA, 22 bp, Artificial Sequence
  Synthetic oligonucleotide; CTC chr11 5274921 5274942 5274938 5274943 +
ataaatatcccattttccgctg

SEQ ID NO: 92546 - DNA, 22 bp, Artificial Sequence
  Synthetic oligonucleotide; TTT chr11 5274936 5274957 5274953 5274958 +
tccgctgaaatatagctttact

SEQ ID NO: 92547 - DNA, 22 bp, Artificial Sequence
  Synthetic oligonucleotide; TTT chr11 5274937 5274958 5274954 5274959 +
ccgctgaaatatagctttactt

SEQ ID NO: 92548 - DNA, 22 bp, Artificial Sequence
  Synthetic oligonucleotide; TTC chr11 5274938 5274959 5274955 5274960 +
cgctgaaatatagctttacttt

SEQ ID NO: 92549 - DNA, 22 bp, Artificial Sequence
  Synthetic oligonucleotide; CTG chr11 5274943 5274964 5274960 5274965 +
aaatatagctttactttcctgg

SEQ ID NO: 92550 - DNA, 22 bp, Artificial Sequence
  Synthetic oligonucleotide; CTT chr11 5274954 5274975 5274971 5274976 +
tactttcctggtttctttgacc

SEQ ID NO: 92551 - DNA, 22 bp, Artificial Sequence
  Synthetic oligonucleotide; TTT chr11 5274955 5274976 5274972 5274977 +
actttcctggtttctttgacct

SEQ ID NO: 92552 - DNA, 22 bp, Artificial Sequence
  Synthetic oligonucleotide; TTA chr11 5274956 5274977 5274973 5274978 +
ctttcctggtttctttgacctt

SEQ ID NO: 92553 - DNA, 22 bp, Artificial Sequence
  Synthetic oligonucleotide; CTT chr11 5274959 5274980 5274976 5274981 +
tcctggtttctttgaccttttg

SEQ ID NO: 92554 - DNA, 22 bp, Artificial Sequence
  Synthetic oligonucleotide; TTT chr11 5274960 5274981 5274977 5274982 +
cctggtttctttgaccttttgg

SEQ ID NO: 92555 - DNA, 22 bp, Artificial Sequence
  Synthetic oligonucleotide; TTC chr11 5274961 5274982 5274978 5274983 +
ctggtttctttgaccttttggg

SEQ ID NO: 92556 - DNA, 22 bp, Artificial Sequence
  Synthetic oligonucleotide; CTG chr11 5274964 5274985 5274981 5274986 +
gtttctttgaccttttgggacc

SEQ ID NO: 92557 - DNA, 22 bp, Artificial Sequence
  Synthetic oligonucleotide; TTT chr11 5274968 5274989 5274985 5274990 +
ctttgaccttttgggaccttga

SEQ ID NO: 92558 - DNA, 22 bp, Artificial Sequence
  Synthetic oligonucleotide; TTC chr11 5274969 5274990 5274986 5274991 +
tttgaccttttgggaccttgag

SEQ ID NO: 92559 - DNA, 22 bp, Artificial Sequence
  Synthetic oligonucleotide; CTT chr11 5274971 5274992 5274988 5274993 +
tgaccttttgggaccttgagta

SEQ ID NO: 92560 - DNA, 22 bp, Artificial Sequence
  Synthetic oligonucleotide; TTT chr11 5274972 5274993 5274989 5274994 +
gaccttttgggaccttgagtaa

SEQ ID NO: 92561 - DNA, 22 bp, Artificial Sequence
  Synthetic oligonucleotide; TTG chr11 5274973 5274994 5274990 5274995 +
accttttgggaccttgagtaag

SEQ ID NO: 92562 - DNA, 22 bp, Artificial Sequence
  Synthetic oligonucleotide; CTT chr11 5274978 5274999 5274995 5275000 +
ttgggaccttgagtaagtaaag

SEQ ID NO: 92563 - DNA, 22 bp, Artificial Sequence
  Synthetic oligonucleotide; TTT chr11 5274979 5275000 5274996 5275001 +
tgggaccttgagtaagtaaaga

SEQ ID NO: 92564 - DNA, 22 bp, Artificial Sequence
  Synthetic oligonucleotide; TTT chr11 5274980 5275001 5274997 5275002 +
gggaccttgagtaagtaaagat

SEQ ID NO: 92565 - DNA, 22 bp, Artificial Sequence
  Synthetic oligonucleotide; TTG chr11 5274981 5275002 5274998 5275003 +
ggaccttgagtaagtaaagatg

SEQ ID NO: 92566 - DNA, 22 bp, Artificial Sequence
  Synthetic oligonucleotide; CTT chr11 5274988 5275009 5275005 5275010 +
gagtaagtaaagatgccttcat

SEQ ID NO: 92567 - DNA, 22 bp, Artificial Sequence
  Synthetic oligonucleotide; TTG chr11 5274989 5275010 5275006 5275011 +
agtaagtaaagatgccttcatt

SEQ ID NO: 92568 - DNA, 22 bp, Artificial Sequence
  Synthetic oligonucleotide; CTT chr11 5275007 5275028 5275024 5275029 +
catttattttcatgattaaaat

SEQ ID NO: 92569 - DNA, 22 bp, Artificial Sequence
  Synthetic oligonucleotide; TTC chr11 5275008 5275029 5275025 5275030 +
atttattttcatgattaaaatt

SEQ ID NO: 92570 - DNA, 22 bp, Artificial Sequence
  Synthetic oligonucleotide; TTT chr11 5275012 5275033 5275029 5275034 +
attttcatgattaaaattctaa

SEQ ID NO: 92571 - DNA, 22 bp, Artificial Sequence
  Synthetic oligonucleotide; TTA chr11 5275013 5275034 5275030 5275035 +
ttttcatgattaaaattctaag

SEQ ID NO: 92572 - DNA, 22 bp, Artificial Sequence
  Synthetic oligonucleotide; TTT chr11 5275016 5275037 5275033 5275038 +
tcatgattaaaattctaagaaa

SEQ ID NO: 92573 - DNA, 22 bp, Artificial Sequence
  Synthetic oligonucleotide; TTT chr11 5275017 5275038 5275034 5275039 +
catgattaaaattctaagaaat

SEQ ID NO: 92574 - DNA, 22 bp, Artificial Sequence
  Synthetic oligonucleotide; TTC chr11 5275018 5275039 5275035 5275040 +
atgattaaaattctaagaaatt

SEQ ID NO: 92575 - DNA, 22 bp, Artificial Sequence
  Synthetic oligonucleotide; TTA chr11 5275025 5275046 5275042 5275047 +
aaattctaagaaattcttgggt

SEQ ID NO: 92576 - DNA, 22 bp, Artificial Sequence
  Synthetic oligonucleotide; TTC chr11 5275031 5275052 5275048 5275053 +
taagaaattcttgggttttttt

SEQ ID NO: 92577 - DNA, 22 bp, Artificial Sequence
  Synthetic oligonucleotide; CTA chr11 5275033 5275054 5275050 5275055 +
agaaattcttgggtttttttaa

SEQ ID NO: 92578 - DNA, 22 bp, Artificial Sequence
  Synthetic oligonucleotide; TTC chr11 5275041 5275062 5275058 5275063 +
ttgggtttttttaattaaattg

SEQ ID NO: 92579 - DNA, 22 bp, Artificial Sequence
  Synthetic oligonucleotide; CTT chr11 5275043 5275064 5275060 5275065 +
gggtttttttaattaaattgca

SEQ ID NO: 92580 - DNA, 22 bp, Artificial Sequence
  Synthetic oligonucleotide; TTG chr11 5275044 5275065 5275061 5275066 +
ggtttttttaattaaattgcat

SEQ ID NO: 92581 - DNA, 22 bp, Artificial Sequence
  Synthetic oligonucleotide; TTT chr11 5275049 5275070 5275066 5275071 +
ttttaattaaattgcattgcct

SEQ ID NO: 92582 - DNA, 22 bp, Artificial Sequence
  Synthetic oligonucleotide; TTT chr11 5275050 5275071 5275067 5275072 +
tttaattaaattgcattgccta

SEQ ID NO: 92583 - DNA, 22 bp, Artificial Sequence
  Synthetic oligonucleotide; TTT chr11 5275051 5275072 5275068 5275073 +
ttaattaaattgcattgcctaa

SEQ ID NO: 92584 - DNA, 22 bp, Artificial Sequence
  Synthetic oligonucleotide; TTT chr11 5275052 5275073 5275069 5275074 +
taattaaattgcattgcctaat

SEQ ID NO: 92585 - DNA, 22 bp, Artificial Sequence
  Synthetic oligonucleotide; TTT chr11 5275053 5275074 5275070 5275075 +
aattaaattgcattgcctaatg

SEQ ID NO: 92586 - DNA, 22 bp, Artificial Sequence
  Synthetic oligonucleotide; TTA chr11 5275054 5275075 5275071 5275076 +
attaaattgcattgcctaatgt

SEQ ID NO: 92587 - DNA, 22 bp, Artificial Sequence
  Synthetic oligonucleotide; TTA chr11 5275058 5275079 5275075 5275080 +
aattgcattgcctaatgtattt

SEQ ID NO: 92588 - DNA, 22 bp, Artificial Sequence
  Synthetic oligonucleotide; TTG chr11 5275063 5275084 5275080 5275085 +
cattgcctaatgtatttatgaa

SEQ ID NO: 92589 - DNA, 22 bp, Artificial Sequence
  Synthetic oligonucleotide; TTG chr11 5275068 5275089 5275085 5275090 +
cctaatgtatttatgaactaag

SEQ ID NO: 92590 - DNA, 22 bp, Artificial Sequence
  Synthetic oligonucleotide; CTA chr11 5275072 5275093 5275089 5275094 +
atgtatttatgaactaagaaca

SEQ ID NO: 92591 - DNA, 22 bp, Artificial Sequence
  Synthetic oligonucleotide; TTT chr11 5275080 5275101 5275097 5275102 +
atgaactaagaacatagaaata

SEQ ID NO: 92592 - DNA, 22 bp, Artificial Sequence
  Synthetic oligonucleotide; TTA chr11 5275081 5275102 5275098 5275103 +
tgaactaagaacatagaaataa

SEQ ID NO: 92593 - DNA, 22 bp, Artificial Sequence
  Synthetic oligonucleotide; CTA chr11 5275088 5275109 5275105 5275110 +
agaacatagaaataaaacaata

SEQ ID NO: 92594 - DNA, 22 bp, Artificial Sequence
  Synthetic oligonucleotide; CTC chr11 5275113 5275134 5275130 5275135 +
tgaagtagttcagaatgtgctt

SEQ ID NO: 92595 - DNA, 22 bp, Artificial Sequence
  Synthetic oligonucleotide; CTG chr11 5275115 5275136 5275132 5275137 +
aagtagttcagaatgtgctttc

SEQ ID NO: 92596 - DNA, 22 bp, Artificial Sequence
  Synthetic oligonucleotide; TTC chr11 5275124 5275145 5275141 5275146 +
agaatgtgctttcaatttatat

SEQ ID NO: 92597 - DNA, 22 bp, Artificial Sequence
  Synthetic oligonucleotide; CTT chr11 5275135 5275156 5275152 5275157 +
tcaatttatataaagagttaat

SEQ ID NO: 92598 - DNA, 22 bp, Artificial Sequence
  Synthetic oligonucleotide; TTT chr11 5275136 5275157 5275153 5275158 +
caatttatataaagagttaatt

SEQ ID NO: 92599 - DNA, 22 bp, Artificial Sequence
  Synthetic oligonucleotide; TTC chr11 5275137 5275158 5275154 5275159 +
aatttatataaagagttaattc

SEQ ID NO: 92600 - DNA, 22 bp, Artificial Sequence
  Synthetic oligonucleotide; TTT chr11 5275142 5275163 5275159 5275164 +
atataaagagttaattcaaatg

SEQ ID NO: 92601 - DNA, 22 bp, Artificial Sequence
  Synthetic oligonucleotide; TTA chr11 5275143 5275164 5275160 5275165 +
tataaagagttaattcaaatga

SEQ ID NO: 92602 - DNA, 22 bp, Artificial Sequence
  Synthetic oligonucleotide; TTA chr11 5275155 5275176 5275172 5275177 +
attcaaatgagactattttaag

SEQ ID NO: 92603 - DNA, 22 bp, Artificial Sequence
  Synthetic oligonucleotide; TTC chr11 5275159 5275180 5275176 5275181 +
aaatgagactattttaagtgca

SEQ ID NO: 92604 - DNA, 22 bp, Artificial Sequence
  Synthetic oligonucleotide; CTA chr11 5275170 5275191 5275187 5275192 +
ttttaagtgcagggctttgaat

SEQ ID NO: 92605 - DNA, 22 bp, Artificial Sequence
  Synthetic oligonucleotide; TTT chr11 5275173 5275194 5275190 5275195 +
taagtgcagggctttgaatctt

SEQ ID NO: 92606 - DNA, 22 bp, Artificial Sequence
  Synthetic oligonucleotide; TTT chr11 5275174 5275195 5275191 5275196 +
aagtgcagggctttgaatctta

SEQ ID NO: 92607 - DNA, 22 bp, Artificial Sequence
  Synthetic oligonucleotide; TTA chr11 5275175 5275196 5275192 5275197 +
agtgcagggctttgaatcttat

SEQ ID NO: 92608 - DNA, 22 bp, Artificial Sequence
  Synthetic oligonucleotide; CTT chr11 5275187 5275208 5275204 5275209 +
tgaatcttatgtctagaaattt

SEQ ID NO: 92609 - DNA, 22 bp, Artificial Sequence
  Synthetic oligonucleotide; TTT chr11 5275188 5275209 5275205 5275210 +
gaatcttatgtctagaaatttt

SEQ ID NO: 92610 - DNA, 22 bp, Artificial Sequence
  Synthetic oligonucleotide; TTG chr11 5275189 5275210 5275206 5275211 +
aatcttatgtctagaaattttg

SEQ ID NO: 92611 - DNA, 22 bp, Artificial Sequence
  Synthetic oligonucleotide; CTT chr11 5275195 5275216 5275212 5275217 +
atgtctagaaattttgaaaaac

SEQ ID NO: 92612 - DNA, 22 bp, Artificial Sequence
  Synthetic oligonucleotide; TTA chr11 5275196 5275217 5275213 5275218 +
tgtctagaaattttgaaaaacc

SEQ ID NO: 92613 - DNA, 22 bp, Artificial Sequence
  Synthetic oligonucleotide; CTA chr11 5275202 5275223 5275219 5275224 +
gaaattttgaaaaacctctgat

SEQ ID NO: 92614 - DNA, 22 bp, Artificial Sequence
  Synthetic oligonucleotide; TTT chr11 5275209 5275230 5275226 5275231 +
tgaaaaacctctgattatatgc

SEQ ID NO: 92615 - DNA, 22 bp, Artificial Sequence
  Synthetic oligonucleotide; TTT chr11 5275210 5275231 5275227 5275232 +
gaaaaacctctgattatatgct

SEQ ID NO: 92616 - DNA, 22 bp, Artificial Sequence
  Synthetic oligonucleotide; TTG chr11 5275211 5275232 5275228 5275233 +
aaaaacctctgattatatgcta

SEQ ID NO: 92617 - DNA, 22 bp, Artificial Sequence
  Synthetic oligonucleotide; CTC chr11 5275220 5275241 5275237 5275242 +
tgattatatgctaagattccac

SEQ ID NO: 92618 - DNA, 22 bp, Artificial Sequence
  Synthetic oligonucleotide; CTG chr11 5275222 5275243 5275239 5275244 +
attatatgctaagattccacct

SEQ ID NO: 92619 - DNA, 22 bp, Artificial Sequence
  Synthetic oligonucleotide; TTA chr11 5275226 5275247 5275243 5275248 +
tatgctaagattccacctctag

SEQ ID NO: 92620 - DNA, 22 bp, Artificial Sequence
  Synthetic oligonucleotide; CTA chr11 5275233 5275254 5275250 5275255 +
agattccacctctagtgctaga

SEQ ID NO: 92621 - DNA, 22 bp, Artificial Sequence
  Synthetic oligonucleotide; TTC chr11 5275239 5275260 5275256 5275261 +
cacctctagtgctagaactgag

SEQ ID NO: 92622 - DNA, 22 bp, Artificial Sequence
  Synthetic oligonucleotide; CTC chr11 5275245 5275266 5275262 5275267 +
tagtgctagaactgagaagtcc

SEQ ID NO: 92623 - DNA, 22 bp, Artificial Sequence
  Synthetic oligonucleotide; CTA chr11 5275247 5275268 5275264 5275269 +
gtgctagaactgagaagtcctt

SEQ ID NO: 92624 - DNA, 22 bp, Artificial Sequence
  Synthetic oligonucleotide; CTA chr11 5275253 5275274 5275270 5275275 +
gaactgagaagtccttgacttg

SEQ ID NO: 92625 - DNA, 22 bp, Artificial Sequence
  Synthetic oligonucleotide; CTG chr11 5275259 5275280 5275276 5275281 +
agaagtccttgacttggtgatc

SEQ ID NO: 92626 - DNA, 22 bp, Artificial Sequence
  Synthetic oligonucleotide; CTT chr11 5275269 5275290 5275286 5275291 +
gacttggtgatcttttttaaat

SEQ ID NO: 92627 - DNA, 22 bp, Artificial Sequence
  Synthetic oligonucleotide; TTG chr11 5275270 5275291 5275287 5275292 +
acttggtgatcttttttaaatt

SEQ ID NO: 92628 - DNA, 22 bp, Artificial Sequence
  Synthetic oligonucleotide; CTT chr11 5275274 5275295 5275291 5275296 +
ggtgatcttttttaaattctga

SEQ ID NO: 92629 - DNA, 22 bp, Artificial Sequence
  Synthetic oligonucleotide; TTG chr11 5275275 5275296 5275292 5275297 +
gtgatcttttttaaattctgaa

SEQ ID NO: 92630 - DNA, 22 bp, Artificial Sequence
  Synthetic oligonucleotide; CTT chr11 5275283 5275304 5275300 5275305 +
ttttaaattctgaaacaacagc

SEQ ID NO: 92631 - DNA, 22 bp, Artificial Sequence
  Synthetic oligonucleotide; TTT chr11 5275284 5275305 5275301 5275306 +
tttaaattctgaaacaacagca

SEQ ID NO: 92632 - DNA, 22 bp, Artificial Sequence
  Synthetic oligonucleotide; TTT chr11 5275285 5275306 5275302 5275307 +
ttaaattctgaaacaacagcaa

SEQ ID NO: 92633 - DNA, 22 bp, Artificial Sequence
  Synthetic oligonucleotide; TTT chr11 5275286 5275307 5275303 5275308 +
taaattctgaaacaacagcaac

SEQ ID NO: 92634 - DNA, 22 bp, Artificial Sequence
  Synthetic oligonucleotide; TTT chr11 5275287 5275308 5275304 5275309 +
aaattctgaaacaacagcaaca

SEQ ID NO: 92635 - DNA, 22 bp, Artificial Sequence
  Synthetic oligonucleotide; TTA chr11 5275288 5275309 5275305 5275310 +
aattctgaaacaacagcaacat

SEQ ID NO: 92636 - DNA, 22 bp, Artificial Sequence
  Synthetic oligonucleotide; TTC chr11 5275293 5275314 5275310 5275315 +
tgaaacaacagcaacataaagc

SEQ ID NO: 92637 - DNA, 22 bp, Artificial Sequence
  Synthetic oligonucleotide; CTG chr11 5275295 5275316 5275312 5275317 +
aaacaacagcaacataaagcta

SEQ ID NO: 92638 - DNA, 22 bp, Artificial Sequence
  Synthetic oligonucleotide; CTA chr11 5275317 5275338 5275334 5275339 +
aggactttttcttgcctatgca

SEQ ID NO: 92639 - DNA, 22 bp, Artificial Sequence
  Synthetic oligonucleotide; CTT chr11 5275324 5275345 5275341 5275346 +
tttcttgcctatgcatgctatc

SEQ ID NO: 92640 - DNA, 22 bp, Artificial Sequence
  Synthetic oligonucleotide; TTT chr11 5275325 5275346 5275342 5275347 +
ttcttgcctatgcatgctatct

SEQ ID NO: 92641 - DNA, 22 bp, Artificial Sequence
  Synthetic oligonucleotide; TTT chr11 5275326 5275347 5275343 5275348 +
tcttgcctatgcatgctatctt

SEQ ID NO: 92642 - DNA, 22 bp, Artificial Sequence
  Synthetic oligonucleotide; TTT chr11 5275327 5275348 5275344 5275349 +
cttgcctatgcatgctatcttc

SEQ ID NO: 92643 - DNA, 22 bp, Artificial Sequence
  Synthetic oligonucleotide; TTC chr11 5275328 5275349 5275345 5275350 +
ttgcctatgcatgctatcttca

SEQ ID NO: 92644 - DNA, 22 bp, Artificial Sequence
  Synthetic oligonucleotide; CTT chr11 5275330 5275351 5275347 5275352 +
gcctatgcatgctatcttcagt

SEQ ID NO: 92645 - DNA, 22 bp, Artificial Sequence
  Synthetic oligonucleotide; TTG chr11 5275331 5275352 5275348 5275353 +
cctatgcatgctatcttcagta

SEQ ID NO: 92646 - DNA, 22 bp, Artificial Sequence
  Synthetic oligonucleotide; CTA chr11 5275335 5275356 5275352 5275357 +
tgcatgctatcttcagtacttt

SEQ ID NO: 92647 - DNA, 22 bp, Artificial Sequence
  Synthetic oligonucleotide; CTA chr11 5275344 5275365 5275361 5275366 +
tcttcagtactttgattattta

SEQ ID NO: 92648 - DNA, 22 bp, Artificial Sequence
  Synthetic oligonucleotide; CTT chr11 5275348 5275369 5275365 5275370 +
cagtactttgattatttagtat

SEQ ID NO: 92649 - DNA, 22 bp, Artificial Sequence
  Synthetic oligonucleotide; TTC chr11 5275349 5275370 5275366 5275371 +
agtactttgattatttagtatt

SEQ ID NO: 92650 - DNA, 22 bp, Artificial Sequence
  Synthetic oligonucleotide; CTT chr11 5275356 5275377 5275373 5275378 +
tgattatttagtattgaaacta

SEQ ID NO: 92651 - DNA, 22 bp, Artificial Sequence
  Synthetic oligonucleotide; TTT chr11 5275357 5275378 5275374 5275379 +
gattatttagtattgaaactat

SEQ ID NO: 92652 - DNA, 22 bp, Artificial Sequence
  Synthetic oligonucleotide; TTG chr11 5275358 5275379 5275375 5275380 +
attatttagtattgaaactata

SEQ ID NO: 92653 - DNA, 22 bp, Artificial Sequence
  Synthetic oligonucleotide; TTA chr11 5275362 5275383 5275379 5275384 +
tttagtattgaaactataacat

SEQ ID NO: 92654 - DNA, 22 bp, Artificial Sequence
  Synthetic oligonucleotide; TTT chr11 5275365 5275386 5275382 5275387 +
agtattgaaactataacatagt

SEQ ID NO: 92655 - DNA, 22 bp, Artificial Sequence
  Synthetic oligonucleotide; TTA chr11 5275366 5275387 5275383 5275388 +
gtattgaaactataacatagta

SEQ ID NO: 92656 - DNA, 22 bp, Artificial Sequence
  Synthetic oligonucleotide; TTG chr11 5275372 5275393 5275389 5275394 +
aaactataacatagtatgtttc

SEQ ID NO: 92657 - DNA, 22 bp, Artificial Sequence
  Synthetic oligonucleotide; CTA chr11 5275378 5275399 5275395 5275400 +
taacatagtatgtttcctgaat

SEQ ID NO: 92658 - DNA, 22 bp, Artificial Sequence
  Synthetic oligonucleotide; TTT chr11 5275393 5275414 5275410 5275415 +
cctgaataaaaaatgtgtattt

SEQ ID NO: 92659 - DNA, 22 bp, Artificial Sequence
  Synthetic oligonucleotide; TTC chr11 5275394 5275415 5275411 5275416 +
ctgaataaaaaatgtgtatttc

SEQ ID NO: 92660 - DNA, 22 bp, Artificial Sequence
  Synthetic oligonucleotide; CTG chr11 5275397 5275418 5275414 5275419 +
aataaaaaatgtgtatttctct

SEQ ID NO: 92661 - DNA, 22 bp, Artificial Sequence
  Synthetic oligonucleotide; TTT chr11 5275415 5275436 5275432 5275437 +
ctctggagaaggttaaaactga

SEQ ID NO: 92662 - DNA, 22 bp, Artificial Sequence
  Synthetic oligonucleotide; TTC chr11 5275416 5275437 5275433 5275438 +
tctggagaaggttaaaactgag

SEQ ID NO: 92663 - DNA, 22 bp, Artificial Sequence
  Synthetic oligonucleotide; CTC chr11 5275418 5275439 5275435 5275440 +
tggagaaggttaaaactgagga

SEQ ID NO: 92664 - DNA, 22 bp, Artificial Sequence
  Synthetic oligonucleotide; CTG chr11 5275420 5275441 5275437 5275442 +
gagaaggttaaaactgaggatt

SEQ ID NO: 92665 - DNA, 22 bp, Artificial Sequence
  Synthetic oligonucleotide; TTA chr11 5275430 5275451 5275447 5275452 +
aaactgaggattggcaagtgag

SEQ ID NO: 92666 - DNA, 22 bp, Artificial Sequence
  Synthetic oligonucleotide; CTG chr11 5275436 5275457 5275453 5275458 +
aggattggcaagtgagcaaggc

SEQ ID NO: 92667 - DNA, 22 bp, Artificial Sequence
  Synthetic oligonucleotide; TTG chr11 5275443 5275464 5275460 5275465 +
gcaagtgagcaaggcttaaatg

SEQ ID NO: 92668 - DNA, 22 bp, Artificial Sequence
  Synthetic oligonucleotide; CTT chr11 5275460 5275481 5275477 5275482 +
aaatggaagaagcaatgatctc

SEQ ID NO: 92669 - DNA, 22 bp, Artificial Sequence
  Synthetic oligonucleotide; TTA chr11 5275461 5275482 5275478 5275483 +
aatggaagaagcaatgatctcg

SEQ ID NO: 92670 - DNA, 22 bp, Artificial Sequence
  Synthetic oligonucleotide; CTC chr11 5275482 5275503 5275499 5275504 +
gtcagaccaccttcattaacga

SEQ ID NO: 92671 - DNA, 22 bp, Artificial Sequence
  Synthetic oligonucleotide; CTT chr11 5275495 5275516 5275512 5275517 +
cattaacgagatcatccatcat

SEQ ID NO: 92672 - DNA, 22 bp, Artificial Sequence
  Synthetic oligonucleotide; TTC chr11 5275496 5275517 5275513 5275518 +
attaacgagatcatccatcatg

SEQ ID NO: 92673 - DNA, 22 bp, Artificial Sequence
  Synthetic oligonucleotide; TTA chr11 5275500 5275521 5275517 5275522 +
acgagatcatccatcatgagga

SEQ ID NO: 92674 - DNA, 22 bp, Artificial Sequence
  Synthetic oligonucleotide; CTC chr11 5275545 5275566 5275562 5275567 +
tgttttgtgtcactaagggtga

SEQ ID NO: 92675 - DNA, 22 bp, Artificial Sequence
  Synthetic oligonucleotide; CTG chr11 5275547 5275568 5275564 5275569 +
ttttgtgtcactaagggtgagg

SEQ ID NO: 92676 - DNA, 22 bp, Artificial Sequence
  Synthetic oligonucleotide; TTT chr11 5275550 5275571 5275567 5275572 +
tgtgtcactaagggtgaggatg

SEQ ID NO: 92677 - DNA, 22 bp, Artificial Sequence
  Synthetic oligonucleotide; TTT chr11 5275551 5275572 5275568 5275573 +
gtgtcactaagggtgaggatgc

SEQ ID NO: 92678 - DNA, 22 bp, Artificial Sequence
  Synthetic oligonucleotide; TTG chr11 5275552 5275573 5275569 5275574 +
tgtcactaagggtgaggatgct

SEQ ID NO: 92679 - DNA, 22 bp, Artificial Sequence
  Synthetic oligonucleotide; CTA chr11 5275560 5275581 5275577 5275582 +
agggtgaggatgctgaatgatt

SEQ ID NO: 92680 - DNA, 22 bp, Artificial Sequence
  Synthetic oligonucleotide; CTG chr11 5275575 5275596 5275592 5275597 +
aatgatttttccctcccccggg

SEQ ID NO: 92681 - DNA, 22 bp, Artificial Sequence
  Synthetic oligonucleotide; TTT chr11 5275583 5275604 5275600 5275605 +
ttccctcccccgggcttctttt

SEQ ID NO: 92682 - DNA, 22 bp, Artificial Sequence
  Synthetic oligonucleotide; TTT chr11 5275584 5275605 5275601 5275606 +
tccctcccccgggcttctttta

SEQ ID NO: 92683 - DNA, 22 bp, Artificial Sequence
  Synthetic oligonucleotide; TTT chr11 5275585 5275606 5275602 5275607 +
ccctcccccgggcttcttttag

SEQ ID NO: 92684 - DNA, 22 bp, Artificial Sequence
  Synthetic oligonucleotide; TTC chr11 5275586 5275607 5275603 5275608 +
cctcccccgggcttcttttagc

SEQ ID NO: 92685 - DNA, 22 bp, Artificial Sequence
  Synthetic oligonucleotide; CTC chr11 5275590 5275611 5275607 5275612 +
ccccgggcttcttttagccatc

SEQ ID NO: 92686 - DNA, 22 bp, Artificial Sequence
  Synthetic oligonucleotide; CTT chr11 5275600 5275621 5275617 5275622 +
cttttagccatcaataattcta

SEQ ID NO: 92687 - DNA, 22 bp, Artificial Sequence
  Synthetic oligonucleotide; TTC chr11 5275601 5275622 5275618 5275623 +
ttttagccatcaataattctag

SEQ ID NO: 92688 - DNA, 22 bp, Artificial Sequence
  Synthetic oligonucleotide; CTT chr11 5275603 5275624 5275620 5275625 +
ttagccatcaataattctagcc

SEQ ID NO: 92689 - DNA, 22 bp, Artificial Sequence
  Synthetic oligonucleotide; TTT chr11 5275604 5275625 5275621 5275626 +
tagccatcaataattctagccc

SEQ ID NO: 92690 - DNA, 22 bp, Artificial Sequence
  Synthetic oligonucleotide; TTT chr11 5275605 5275626 5275622 5275627 +
agccatcaataattctagcccc

SEQ ID NO: 92691 - DNA, 22 bp, Artificial Sequence
  Synthetic oligonucleotide; TTA chr11 5275606 5275627 5275623 5275628 +
gccatcaataattctagcccca

SEQ ID NO: 92692 - DNA, 22 bp, Artificial Sequence
  Synthetic oligonucleotide; TTC chr11 5275620 5275641 5275637 5275642 +
tagccccacaggagtttgttct

SEQ ID NO: 92693 - DNA, 22 bp, Artificial Sequence
  Synthetic oligonucleotide; CTA chr11 5275622 5275643 5275639 5275644 +
gccccacaggagtttgttctga

SEQ ID NO: 92694 - DNA, 22 bp, Artificial Sequence
  Synthetic oligonucleotide; TTT chr11 5275637 5275658 5275654 5275659 +
gttctgaaagtaaacttccaca

SEQ ID NO: 92695 - DNA, 22 bp, Artificial Sequence
  Synthetic oligonucleotide; TTG chr11 5275638 5275659 5275655 5275660 +
ttctgaaagtaaacttccacaa

SEQ ID NO: 92696 - DNA, 22 bp, Artificial Sequence
  Synthetic oligonucleotide; TTC chr11 5275641 5275662 5275658 5275663 +
tgaaagtaaacttccacaaccg

SEQ ID NO: 92697 - DNA, 22 bp, Artificial Sequence
  Synthetic oligonucleotide; CTG chr11 5275643 5275664 5275660 5275665 +
aaagtaaacttccacaaccgca

SEQ ID NO: 92698 - DNA, 22 bp, Artificial Sequence
  Synthetic oligonucleotide; CTT chr11 5275654 5275675 5275671 5275676 +
ccacaaccgcaagcttattgag

SEQ ID NO: 92699 - DNA, 22 bp, Artificial Sequence
  Synthetic oligonucleotide; TTC chr11 5275655 5275676 5275672 5275677 +
cacaaccgcaagcttattgagg

SEQ ID NO: 92700 - DNA, 22 bp, Artificial Sequence
  Synthetic oligonucleotide; CTT chr11 5275670 5275691 5275687 5275692 +
attgaggctaaggcatctgtga

SEQ ID NO: 92701 - DNA, 22 bp, Artificial Sequence
  Synthetic oligonucleotide; TTA chr11 5275671 5275692 5275688 5275693 +
ttgaggctaaggcatctgtgaa

SEQ ID NO: 92702 - DNA, 22 bp, Artificial Sequence
  Synthetic oligonucleotide; TTG chr11 5275674 5275695 5275691 5275696 +
aggctaaggcatctgtgaagga

SEQ ID NO: 92703 - DNA, 22 bp, Artificial Sequence
  Synthetic oligonucleotide; CTA chr11 5275680 5275701 5275697 5275702 +
aggcatctgtgaaggaaagaaa

SEQ ID NO: 92704 - DNA, 22 bp, Artificial Sequence
  Synthetic oligonucleotide; CTG chr11 5275689 5275710 5275706 5275711 +
tgaaggaaagaaacatctcctc

SEQ ID NO: 92705 - DNA, 22 bp, Artificial Sequence
  Synthetic oligonucleotide; CTC chr11 5275708 5275729 5275725 5275730 +
ctctaaaccactatgctgctag

SEQ ID NO: 92706 - DNA, 22 bp, Artificial Sequence
  Synthetic oligonucleotide; CTC chr11 5275711 5275732 5275728 5275733 +
taaaccactatgctgctagagc

SEQ ID NO: 92707 - DNA, 22 bp, Artificial Sequence
  Synthetic oligonucleotide; CTA chr11 5275713 5275734 5275730 5275735 +
aaccactatgctgctagagcct

SEQ ID NO: 92708 - DNA, 22 bp, Artificial Sequence
  Synthetic oligonucleotide; CTA chr11 5275721 5275742 5275738 5275743 +
tgctgctagagcctcttttctg

SEQ ID NO: 92709 - DNA, 22 bp, Artificial Sequence
  Synthetic oligonucleotide; CTG chr11 5275726 5275747 5275743 5275748 +
ctagagcctcttttctgtactc

SEQ ID NO: 92710 - DNA, 22 bp, Artificial Sequence
  Synthetic oligonucleotide; CTA chr11 5275729 5275750 5275746 5275751 +
gagcctcttttctgtactcaag

SEQ ID NO: 92711 - DNA, 22 bp, Artificial Sequence
  Synthetic oligonucleotide; CTC chr11 5275736 5275757 5275753 5275758 +
ttttctgtactcaagcctcatt

SEQ ID NO: 92712 - DNA, 22 bp, Artificial Sequence
  Synthetic oligonucleotide; CTT chr11 5275738 5275759 5275755 5275760 +
ttctgtactcaagcctcattca

SEQ ID NO: 92713 - DNA, 22 bp, Artificial Sequence
  Synthetic oligonucleotide; TTT chr11 5275739 5275760 5275756 5275761 +
tctgtactcaagcctcattcag

SEQ ID NO: 92714 - DNA, 22 bp, Artificial Sequence
  Synthetic oligonucleotide; TTT chr11 5275740 5275761 5275757 5275762 +
ctgtactcaagcctcattcaga

SEQ ID NO: 92715 - DNA, 22 bp, Artificial Sequence
  Synthetic oligonucleotide; TTC chr11 5275741 5275762 5275758 5275763 +
tgtactcaagcctcattcagac

SEQ ID NO: 92716 - DNA, 22 bp, Artificial Sequence
  Synthetic oligonucleotide; CTG chr11 5275743 5275764 5275760 5275765 +
tactcaagcctcattcagacac

SEQ ID NO: 92717 - DNA, 22 bp, Artificial Sequence
  Synthetic oligonucleotide; CTC chr11 5275748 5275769 5275765 5275770 +
aagcctcattcagacactagtg

SEQ ID NO: 92718 - DNA, 22 bp, Artificial Sequence
  Synthetic oligonucleotide; CTC chr11 5275755 5275776 5275772 5275777 +
attcagacactagtgtcaccag

SEQ ID NO: 92719 - DNA, 22 bp, Artificial Sequence
  Synthetic oligonucleotide; TTC chr11 5275759 5275780 5275776 5275781 +
agacactagtgtcaccagtctc

SEQ ID NO: 92720 - DNA, 22 bp, Artificial Sequence
  Synthetic oligonucleotide; CTA chr11 5275767 5275788 5275784 5275789 +
gtgtcaccagtctcctcatata

SEQ ID NO: 92721 - DNA, 22 bp, Artificial Sequence
  Synthetic oligonucleotide; CTC chr11 5275781 5275802 5275798 5275803 +
ctcatatacctattgtattttc

SEQ ID NO: 92722 - DNA, 22 bp, Artificial Sequence
  Synthetic oligonucleotide; CTC chr11 5275784 5275805 5275801 5275806 +
atatacctattgtattttcttc

SEQ ID NO: 92723 - DNA, 22 bp, Artificial Sequence
  Synthetic oligonucleotide; CTA chr11 5275793 5275814 5275810 5275815 +
ttgtattttcttcttcttgctg

SEQ ID NO: 92724 - DNA, 22 bp, Artificial Sequence
  Synthetic oligonucleotide; TTG chr11 5275796 5275817 5275813 5275818 +
tattttcttcttcttgctggtt

SEQ ID NO: 92725 - DNA, 22 bp, Artificial Sequence
  Synthetic oligonucleotide; TTT chr11 5275801 5275822 5275818 5275823 +
tcttcttcttgctggtttagtc

SEQ ID NO: 92726 - DNA, 22 bp, Artificial Sequence
  Synthetic oligonucleotide; TTT chr11 5275802 5275823 5275819 5275824 +
cttcttcttgctggtttagtca

SEQ ID NO: 92727 - DNA, 22 bp, Artificial Sequence
  Synthetic oligonucleotide; TTC chr11 5275803 5275824 5275820 5275825 +
ttcttcttgctggtttagtcat

SEQ ID NO: 92728 - DNA, 22 bp, Artificial Sequence
  Synthetic oligonucleotide; CTT chr11 5275805 5275826 5275822 5275827 +
cttcttgctggtttagtcatgt

SEQ ID NO: 92729 - DNA, 22 bp, Artificial Sequence
  Synthetic oligonucleotide; TTC chr11 5275806 5275827 5275823 5275828 +
ttcttgctggtttagtcatgtt

SEQ ID NO: 92730 - DNA, 22 bp, Artificial Sequence
  Synthetic oligonucleotide; CTT chr11 5275808 5275829 5275825 5275830 +
cttgctggtttagtcatgtttt

SEQ ID NO: 92731 - DNA, 22 bp, Artificial Sequence
  Synthetic oligonucleotide; TTC chr11 5275809 5275830 5275826 5275831 +
ttgctggtttagtcatgttttc

SEQ ID NO: 92732 - DNA, 22 bp, Artificial Sequence
  Synthetic oligonucleotide; CTT chr11 5275811 5275832 5275828 5275833 +
gctggtttagtcatgttttctg

SEQ ID NO: 92733 - DNA, 22 bp, Artificial Sequence
  Synthetic oligonucleotide; TTG chr11 5275812 5275833 5275829 5275834 +
ctggtttagtcatgttttctgg

SEQ ID NO: 92734 - DNA, 22 bp, Artificial Sequence
  Synthetic oligonucleotide; CTG chr11 5275815 5275836 5275832 5275837 +
gtttagtcatgttttctgggag

SEQ ID NO: 92735 - DNA, 22 bp, Artificial Sequence
  Synthetic oligonucleotide; TTT chr11 5275819 5275840 5275836 5275841 +
agtcatgttttctgggagctta

SEQ ID NO: 92736 - DNA, 22 bp, Artificial Sequence
  Synthetic oligonucleotide; TTA chr11 5275820 5275841 5275837 5275842 +
gtcatgttttctgggagcttag

SEQ ID NO: 92737 - DNA, 22 bp, Artificial Sequence
  Synthetic oligonucleotide; TTT chr11 5275829 5275850 5275846 5275851 +
tctgggagcttaggggcttatt

SEQ ID NO: 92738 - DNA, 22 bp, Artificial Sequence
  Synthetic oligonucleotide; TTT chr11 5275830 5275851 5275847 5275852 +
ctgggagcttaggggcttattt

SEQ ID NO: 92739 - DNA, 22 bp, Artificial Sequence
  Synthetic oligonucleotide; TTC chr11 5275831 5275852 5275848 5275853 +
tgggagcttaggggcttatttt

SEQ ID NO: 92740 - DNA, 22 bp, Artificial Sequence
  Synthetic oligonucleotide; CTG chr11 5275833 5275854 5275850 5275855 +
ggagcttaggggcttattttat

SEQ ID NO: 92741 - DNA, 22 bp, Artificial Sequence
  Synthetic oligonucleotide; CTT chr11 5275840 5275861 5275857 5275862 +
aggggcttattttattttgttt

SEQ ID NO: 92742 - DNA, 22 bp, Artificial Sequence
  Synthetic oligonucleotide; TTA chr11 5275841 5275862 5275858 5275863 +
ggggcttattttattttgtttt

SEQ ID NO: 92743 - DNA, 22 bp, Artificial Sequence
  Synthetic oligonucleotide; CTT chr11 5275848 5275869 5275865 5275870 +
attttattttgttttgttttct

SEQ ID NO: 92744 - DNA, 22 bp, Artificial Sequence
  Synthetic oligonucleotide; TTA chr11 5275849 5275870 5275866 5275871 +
ttttattttgttttgttttcta

SEQ ID NO: 92745 - DNA, 22 bp, Artificial Sequence
  Synthetic oligonucleotide; TTT chr11 5275852 5275873 5275869 5275874 +
tattttgttttgttttctaatc

SEQ ID NO: 92746 - DNA, 22 bp, Artificial Sequence
  Synthetic oligonucleotide; TTT chr11 5275853 5275874 5275870 5275875 +
attttgttttgttttctaatca

SEQ ID NO: 92747 - DNA, 22 bp, Artificial Sequence
  Synthetic oligonucleotide; TTA chr11 5275854 5275875 5275871 5275876 +
ttttgttttgttttctaatcaa

SEQ ID NO: 92748 - DNA, 22 bp, Artificial Sequence
  Synthetic oligonucleotide; TTT chr11 5275857 5275878 5275874 5275879 +
tgttttgttttctaatcaacag

SEQ ID NO: 92749 - DNA, 22 bp, Artificial Sequence
  Synthetic oligonucleotide; TTT chr11 5275858 5275879 5275875 5275880 +
gttttgttttctaatcaacaga

SEQ ID NO: 92750 - DNA, 22 bp, Artificial Sequence
  Synthetic oligonucleotide; TTG chr11 5275859 5275880 5275876 5275881 +
ttttgttttctaatcaacagag

SEQ ID NO: 92751 - DNA, 22 bp, Artificial Sequence
  Synthetic oligonucleotide; TTT chr11 5275862 5275883 5275879 5275884 +
tgttttctaatcaacagagatg

SEQ ID NO: 92752 - DNA, 22 bp, Artificial Sequence
  Synthetic oligonucleotide; TTT chr11 5275863 5275884 5275880 5275885 +
gttttctaatcaacagagatgg

SEQ ID NO: 92753 - DNA, 22 bp, Artificial Sequence
  Synthetic oligonucleotide; TTG chr11 5275864 5275885 5275881 5275886 +
ttttctaatcaacagagatggg

SEQ ID NO: 92754 - DNA, 22 bp, Artificial Sequence
  Synthetic oligonucleotide; TTT chr11 5275867 5275888 5275884 5275889 +
tctaatcaacagagatgggcaa

SEQ ID NO: 92755 - DNA, 22 bp, Artificial Sequence
  Synthetic oligonucleotide; TTT chr11 5275868 5275889 5275885 5275890 +
ctaatcaacagagatgggcaaa

SEQ ID NO: 92756 - DNA, 22 bp, Artificial Sequence
  Synthetic oligonucleotide; TTC chr11 5275869 5275890 5275886 5275891 +
taatcaacagagatgggcaaac

SEQ ID NO: 92757 - DNA, 22 bp, Artificial Sequence
  Synthetic oligonucleotide; CTA chr11 5275871 5275892 5275888 5275893 +
atcaacagagatgggcaaaccc

SEQ ID NO: 92758 - DNA, 22 bp, Artificial Sequence
  Synthetic oligonucleotide; TTA chr11 5275897 5275918 5275914 5275919 +
tttttttctttagacttgggat

SEQ ID NO: 92759 - DNA, 22 bp, Artificial Sequence
  Synthetic oligonucleotide; TTT chr11 5275900 5275921 5275917 5275922 +
ttttctttagacttgggatggt

SEQ ID NO: 92760 - DNA, 22 bp, Artificial Sequence
  Synthetic oligonucleotide; TTT chr11 5275901 5275922 5275918 5275923 +
tttctttagacttgggatggtg

SEQ ID NO: 92761 - DNA, 22 bp, Artificial Sequence
  Synthetic oligonucleotide; TTT chr11 5275902 5275923 5275919 5275924 +
ttctttagacttgggatggtga

SEQ ID NO: 92762 - DNA, 22 bp, Artificial Sequence
  Synthetic oligonucleotide; TTT chr11 5275903 5275924 5275920 5275925 +
tctttagacttgggatggtgat

SEQ ID NO: 92763 - DNA, 22 bp, Artificial Sequence
  Synthetic oligonucleotide; TTT chr11 5275904 5275925 5275921 5275926 +
ctttagacttgggatggtgata

SEQ ID NO: 92764 - DNA, 22 bp, Artificial Sequence
  Synthetic oligonucleotide; TTC chr11 5275905 5275926 5275922 5275927 +
tttagacttgggatggtgatag

SEQ ID NO: 92765 - DNA, 22 bp, Artificial Sequence
  Synthetic oligonucleotide; CTT chr11 5275907 5275928 5275924 5275929 +
tagacttgggatggtgatagct

SEQ ID NO: 92766 - DNA, 22 bp, Artificial Sequence
  Synthetic oligonucleotide; TTT chr11 5275908 5275929 5275925 5275930 +
agacttgggatggtgatagctg

SEQ ID NO: 92767 - DNA, 22 bp, Artificial Sequence
  Synthetic oligonucleotide; TTA chr11 5275909 5275930 5275926 5275931 +
gacttgggatggtgatagctgg

SEQ ID NO: 92768 - DNA, 22 bp, Artificial Sequence
  Synthetic oligonucleotide; CTT chr11 5275914 5275935 5275931 5275936 +
gggatggtgatagctgggcagc

SEQ ID NO: 92769 - DNA, 22 bp, Artificial Sequence
  Synthetic oligonucleotide; TTG chr11 5275915 5275936 5275932 5275937 +
ggatggtgatagctgggcagcg

SEQ ID NO: 92770 - DNA, 22 bp, Artificial Sequence
  Synthetic oligonucleotide; CTG chr11 5275930 5275951 5275947 5275952 +
ggcagcgtcagaaactgtgtgt

SEQ ID NO: 92771 - DNA, 22 bp, Artificial Sequence
  Synthetic oligonucleotide; CTG chr11 5275947 5275968 5275964 5275969 +
tgtgtggatatagataagagct

SEQ ID NO: 92772 - DNA, 22 bp, Artificial Sequence
  Synthetic oligonucleotide; CTC chr11 5275970 5275991 5275987 5275992 +
aggactatgctgagctgtgatg

SEQ ID NO: 92773 - DNA, 22 bp, Artificial Sequence
  Synthetic oligonucleotide; CTA chr11 5275977 5275998 5275994 5275999 +
tgctgagctgtgatgagggagg

SEQ ID NO: 92774 - DNA, 22 bp, Artificial Sequence
  Synthetic oligonucleotide; CTG chr11 5275982 5276003 5275999 5276004 +
agctgtgatgagggaggggcct

SEQ ID NO: 92775 - DNA, 22 bp, Artificial Sequence
  Synthetic oligonucleotide; CTG chr11 5275987 5276008 5276004 5276009 +
tgatgagggaggggcctagcta

SEQ ID NO: 92776 - DNA, 22 bp, Artificial Sequence
  Synthetic oligonucleotide; CTA chr11 5276005 5276026 5276022 5276027 +
gctaaaggcagtgagagtcaga

SEQ ID NO: 92777 - DNA, 22 bp, Artificial Sequence
  Synthetic oligonucleotide; CTA chr11 5276009 5276030 5276026 5276031 +
aaggcagtgagagtcagaatgc

SEQ ID NO: 92778 - DNA, 22 bp, Artificial Sequence
  Synthetic oligonucleotide; CTC chr11 5276033 5276054 5276050 5276055 +
ctgctattgccttctcagtccc

SEQ ID NO: 92779 - DNA, 22 bp, Artificial Sequence
  Synthetic oligonucleotide; CTG chr11 5276036 5276057 5276053 5276058 +
ctattgccttctcagtccccac

SEQ ID NO: 92780 - DNA, 22 bp, Artificial Sequence
  Synthetic oligonucleotide; CTA chr11 5276039 5276060 5276056 5276061 +
ttgccttctcagtccccacgct

SEQ ID NO: 92781 - DNA, 22 bp, Artificial Sequence
  Synthetic oligonucleotide; TTG chr11 5276042 5276063 5276059 5276064 +
ccttctcagtccccacgcttgg

SEQ ID NO: 92782 - DNA, 22 bp, Artificial Sequence
  Synthetic oligonucleotide; CTT chr11 5276046 5276067 5276063 5276068 +
ctcagtccccacgcttggtttc

SEQ ID NO: 92783 - DNA, 22 bp, Artificial Sequence
  Synthetic oligonucleotide; TTC chr11 5276047 5276068 5276064 5276069 +
tcagtccccacgcttggtttct

SEQ ID NO: 92784 - DNA, 22 bp, Artificial Sequence
  Synthetic oligonucleotide; CTC chr11 5276049 5276070 5276066 5276071 +
agtccccacgcttggtttctac

SEQ ID NO: 92785 - DNA, 22 bp, Artificial Sequence
  Synthetic oligonucleotide; CTT chr11 5276062 5276083 5276079 5276084 +
ggtttctacacaagtagataca

SEQ ID NO: 92786 - DNA, 22 bp, Artificial Sequence
  Synthetic oligonucleotide; TTG chr11 5276063 5276084 5276080 5276085 +
gtttctacacaagtagatacat

SEQ ID NO: 92787 - DNA, 22 bp, Artificial Sequence
  Synthetic oligonucleotide; TTT chr11 5276067 5276088 5276084 5276089 +
ctacacaagtagatacatagaa

SEQ ID NO: 92788 - DNA, 22 bp, Artificial Sequence
  Synthetic oligonucleotide; TTC chr11 5276068 5276089 5276085 5276090 +
tacacaagtagatacatagaaa

SEQ ID NO: 92789 - DNA, 22 bp, Artificial Sequence
  Synthetic oligonucleotide; CTA chr11 5276070 5276091 5276087 5276092 +
cacaagtagatacatagaaaag

SEQ ID NO: 92790 - DNA, 22 bp, Artificial Sequence
  Synthetic oligonucleotide; CTA chr11 5276096 5276117 5276113 5276118 +
taggttagtgtttgagagtcct

SEQ ID NO: 92791 - DNA, 22 bp, Artificial Sequence
  Synthetic oligonucleotide; TTA chr11 5276103 5276124 5276120 5276125 +
gtgtttgagagtcctgcatgat

SEQ ID NO: 92792 - DNA, 22 bp, Artificial Sequence
  Synthetic oligonucleotide; TTT chr11 5276109 5276130 5276126 5276131 +
gagagtcctgcatgattagttg

SEQ ID NO: 92793 - DNA, 22 bp, Artificial Sequence
  Synthetic oligonucleotide; TTG chr11 5276110 5276131 5276127 5276132 +
agagtcctgcatgattagttgc

SEQ ID NO: 92794 - DNA, 22 bp, Artificial Sequence
  Synthetic oligonucleotide; CTG chr11 5276119 5276140 5276136 5276141 +
catgattagttgctcagaaatg

SEQ ID NO: 92795 - DNA, 22 bp, Artificial Sequence
  Synthetic oligonucleotide; TTA chr11 5276127 5276148 5276144 5276149 +
gttgctcagaaatgcccgataa

SEQ ID NO: 92796 - DNA, 22 bp, Artificial Sequence
  Synthetic oligonucleotide; TTG chr11 5276131 5276152 5276148 5276153 +
ctcagaaatgcccgataaatat

SEQ ID NO: 92797 - DNA, 22 bp, Artificial Sequence
  Synthetic oligonucleotide; CTC chr11 5276134 5276155 5276151 5276156 +
agaaatgcccgataaatatgtt

SEQ ID NO: 92798 - DNA, 22 bp, Artificial Sequence
  Synthetic oligonucleotide; TTA chr11 5276157 5276178 5276174 5276179 +
tgtgtgtttatgtatatatatg

SEQ ID NO: 92799 - DNA, 22 bp, Artificial Sequence
  Synthetic oligonucleotide; TTT chr11 5276166 5276187 5276183 5276188 +
atgtatatatatgttttatata

SEQ ID NO: 92800 - DNA, 22 bp, Artificial Sequence
  Synthetic oligonucleotide; TTA chr11 5276167 5276188 5276184 5276189 +
tgtatatatatgttttatatat

SEQ ID NO: 92801 - DNA, 22 bp, Artificial Sequence
  Synthetic oligonucleotide; TTT chr11 5276182 5276203 5276199 5276204 +
tatatatatatatatgtgtgtg

SEQ ID NO: 92802 - DNA, 22 bp, Artificial Sequence
  Synthetic oligonucleotide; TTT chr11 5276183 5276204 5276200 5276205 +
atatatatatatatgtgtgtgt

SEQ ID NO: 92803 - DNA, 22 bp, Artificial Sequence
  Synthetic oligonucleotide; TTA chr11 5276184 5276205 5276201 5276206 +
tatatatatatatgtgtgtgtg

SEQ ID NO: 92804 - DNA, 22 bp, Artificial Sequence
  Synthetic oligonucleotide; TTG chr11 5276223 5276244 5276240 5276245 +
tgtttacaaatatgtgattatc

SEQ ID NO: 92805 - DNA, 22 bp, Artificial Sequence
  Synthetic oligonucleotide; TTT chr11 5276228 5276249 5276245 5276250 +
acaaatatgtgattatcatcaa

SEQ ID NO: 92806 - DNA, 22 bp, Artificial Sequence
  Synthetic oligonucleotide; TTA chr11 5276229 5276250 5276246 5276251 +
caaatatgtgattatcatcaaa

SEQ ID NO: 92807 - DNA, 22 bp, Artificial Sequence
  Synthetic oligonucleotide; TTA chr11 5276243 5276264 5276260 5276265 +
tcatcaaaacgtgagggctaaa

SEQ ID NO: 92808 - DNA, 22 bp, Artificial Sequence
  Synthetic oligonucleotide; CTA chr11 5276263 5276284 5276280 5276285 +
aagtgaccagataacttgcaag

SEQ ID NO: 92809 - DNA, 22 bp, Artificial Sequence
  Synthetic oligonucleotide; CTT chr11 5276280 5276301 5276297 5276302 +
gcaagtcctaggataccaggaa

SEQ ID NO: 92810 - DNA, 22 bp, Artificial Sequence
  Synthetic oligonucleotide; TTG chr11 5276281 5276302 5276298 5276303 +
caagtcctaggataccaggaaa

SEQ ID NO: 92811 - DNA, 22 bp, Artificial Sequence
  Synthetic oligonucleotide; CTA chr11 5276290 5276311 5276307 5276312 +
ggataccaggaaaataaattac

SEQ ID NO: 92812 - DNA, 22 bp, Artificial Sequence
  Synthetic oligonucleotide; TTA chr11 5276311 5276332 5276328 5276333 +
cattccaaaaatttaactgaga

SEQ ID NO: 92813 - DNA, 22 bp, Artificial Sequence
  Synthetic oligonucleotide; TTC chr11 5276316 5276337 5276333 5276338 +
caaaaatttaactgagacttta

SEQ ID NO: 92814 - DNA, 22 bp, Artificial Sequence
  Synthetic oligonucleotide; TTT chr11 5276325 5276346 5276342 5276347 +
aactgagactttaaaaaaaaaa

SEQ ID NO: 92815 - DNA, 22 bp, Artificial Sequence
  Synthetic oligonucleotide; TTA chr11 5276326 5276347 5276343 5276348 +
actgagactttaaaaaaaaaaa

SEQ ID NO: 92816 - DNA, 22 bp, Artificial Sequence
  Synthetic oligonucleotide; CTG chr11 5276330 5276351 5276347 5276352 +
agactttaaaaaaaaaaaaaaa

SEQ ID NO: 92817 - DNA, 22 bp, Artificial Sequence
  Synthetic oligonucleotide; CTT chr11 5276336 5276357 5276353 5276358 +
taaaaaaaaaaaaaaaacaaaa

SEQ ID NO: 92818 - DNA, 22 bp, Artificial Sequence
  Synthetic oligonucleotide; TTT chr11 5276337 5276358 5276354 5276359 +
aaaaaaaaaaaaaaaacaaaaa

SEQ ID NO: 92819 - DNA, 22 bp, Artificial Sequence
  Synthetic oligonucleotide; TTA chr11 5276338 5276359 5276355 5276360 +
aaaaaaaaaaaaaaacaaaaaa

SEQ ID NO: 92820 - DNA, 22 bp, Artificial Sequence
  Synthetic oligonucleotide; CTG chr11 5276404 5276425 5276421 5276426 +
gggcctgttgggggtggggggc

SEQ ID NO: 92821 - DNA, 22 bp, Artificial Sequence
  Synthetic oligonucleotide; CTG chr11 5276411 5276432 5276428 5276433 +
ttgggggtggggggctagggga

SEQ ID NO: 92822 - DNA, 22 bp, Artificial Sequence
  Synthetic oligonucleotide; TTG chr11 5276414 5276435 5276431 5276436 +
ggggtggggggctaggggaagg

SEQ ID NO: 92823 - DNA, 22 bp, Artificial Sequence
  Synthetic oligonucleotide; CTA chr11 5276428 5276449 5276445 5276450 +
ggggaaggatagcattaggaga

SEQ ID NO: 92824 - DNA, 22 bp, Artificial Sequence
  Synthetic oligonucleotide; TTA chr11 5276445 5276466 5276462 5276467 +
ggagaaatacctaatgtagatg

SEQ ID NO: 92825 - DNA, 22 bp, Artificial Sequence
  Synthetic oligonucleotide; CTA chr11 5276458 5276479 5276475 5276480 +
atgtagatgacgggttgatggg

SEQ ID NO: 92826 - DNA, 22 bp, Artificial Sequence
  Synthetic oligonucleotide; TTG chr11 5276475 5276496 5276492 5276497 +
atgggtgcagcaaaccaccatg

SEQ ID NO: 92827 - DNA, 22 bp, Artificial Sequence
  Synthetic oligonucleotide; CTT chr11 5276517 5276538 5276534 5276539 +
aaagcatattaaaaaaacagtg

SEQ ID NO: 92828 - DNA, 22 bp, Artificial Sequence
  Synthetic oligonucleotide; TTA chr11 5276518 5276539 5276535 5276540 +
aagcatattaaaaaaacagtga

SEQ ID NO: 92829 - DNA, 22 bp, Artificial Sequence
  Synthetic oligonucleotide; TTA chr11 5276528 5276549 5276545 5276550 +
aaaaaacagtgatcataaaaga

SEQ ID NO: 92830 - DNA, 22 bp, Artificial Sequence
  Synthetic oligonucleotide; CTC chr11 5276555 5276576 5276572 5276577 +
aaatttaactataagagacgga

SEQ ID NO: 92831 - DNA, 22 bp, Artificial Sequence
  Synthetic oligonucleotide; TTT chr11 5276561 5276582 5276578 5276583 +
aactataagagacggaatggct

SEQ ID NO: 92832 - DNA, 22 bp, Artificial Sequence
  Synthetic oligonucleotide; TTA chr11 5276562 5276583 5276579 5276584 +
actataagagacggaatggctc

SEQ ID NO: 92833 - DNA, 22 bp, Artificial Sequence
  Synthetic oligonucleotide; CTA chr11 5276566 5276587 5276583 5276588 +
taagagacggaatggctcccac

SEQ ID NO: 92834 - DNA, 22 bp, Artificial Sequence
  Synthetic oligonucleotide; CTC chr11 5276584 5276605 5276601 5276606 +
ccacaattcttaactataatct

SEQ ID NO: 92835 - DNA, 22 bp, Artificial Sequence
  Synthetic oligonucleotide; TTC chr11 5276593 5276614 5276610 5276615 +
ttaactataatcttacagaata

SEQ ID NO: 92836 - DNA, 22 bp, Artificial Sequence
  Synthetic oligonucleotide; CTT chr11 5276595 5276616 5276612 5276617 +
aactataatcttacagaatatt

SEQ ID NO: 92837 - DNA, 22 bp, Artificial Sequence
  Synthetic oligonucleotide; TTA chr11 5276596 5276617 5276613 5276618 +
actataatcttacagaatattc

SEQ ID NO: 92838 - DNA, 22 bp, Artificial Sequence
  Synthetic oligonucleotide; CTA chr11 5276600 5276621 5276617 5276622 +
taatcttacagaatattctcat

SEQ ID NO: 92839 - DNA, 22 bp, Artificial Sequence
  Synthetic oligonucleotide; CTT chr11 5276607 5276628 5276624 5276629 +
acagaatattctcattgaatag

SEQ ID NO: 92840 - DNA, 22 bp, Artificial Sequence
  Synthetic oligonucleotide; TTA chr11 5276608 5276629 5276625 5276630 +
cagaatattctcattgaataga

SEQ ID NO: 92841 - DNA, 22 bp, Artificial Sequence
  Synthetic oligonucleotide; TTC chr11 5276618 5276639 5276635 5276640 +
tcattgaatagaagtatgctta

SEQ ID NO: 92842 - DNA, 22 bp, Artificial Sequence
  Synthetic oligonucleotide; CTC chr11 5276620 5276641 5276637 5276642 +
attgaatagaagtatgcttatc

SEQ ID NO: 92843 - DNA, 22 bp, Artificial Sequence
  Synthetic oligonucleotide; TTG chr11 5276624 5276645 5276641 5276646 +
aatagaagtatgcttatcatta

SEQ ID NO: 92844 - DNA, 22 bp, Artificial Sequence
  Synthetic oligonucleotide; CTT chr11 5276639 5276660 5276656 5276661 +
atcattagagatttggacagcc

SEQ ID NO: 92845 - DNA, 22 bp, Artificial Sequence
  Synthetic oligonucleotide; TTA chr11 5276640 5276661 5276657 5276662 +
tcattagagatttggacagcca

SEQ ID NO: 92846 - DNA, 22 bp, Artificial Sequence
  Synthetic oligonucleotide; TTA chr11 5276646 5276667 5276663 5276668 +
gagatttggacagccaggaaag

SEQ ID NO: 92847 - DNA, 22 bp, Artificial Sequence
  Synthetic oligonucleotide; TTT chr11 5276653 5276674 5276670 5276675 +
ggacagccaggaaagcacagaa

SEQ ID NO: 92848 - DNA, 22 bp, Artificial Sequence
  Synthetic oligonucleotide; TTG chr11 5276654 5276675 5276671 5276676 +
gacagccaggaaagcacagaaa

SEQ ID NO: 92849 - DNA, 22 bp, Artificial Sequence
  Synthetic oligonucleotide; CTC chr11 5276692 5276713 5276709 5276714 +
tgttgccttatagcctagaggt

SEQ ID NO: 92850 - DNA, 22 bp, Artificial Sequence
  Synthetic oligonucleotide; CTG chr11 5276694 5276715 5276711 5276716 +
ttgccttatagcctagaggtgt

SEQ ID NO: 92851 - DNA, 22 bp, Artificial Sequence
  Synthetic oligonucleotide; TTG chr11 5276697 5276718 5276714 5276719 +
ccttatagcctagaggtgtttt

SEQ ID NO: 92852 - DNA, 22 bp, Artificial Sequence
  Synthetic oligonucleotide; CTT chr11 5276701 5276722 5276718 5276723 +
atagcctagaggtgttttgaac

SEQ ID NO: 92853 - DNA, 22 bp, Artificial Sequence
  Synthetic oligonucleotide; TTA chr11 5276702 5276723 5276719 5276724 +
tagcctagaggtgttttgaacc

SEQ ID NO: 92854 - DNA, 22 bp, Artificial Sequence
  Synthetic oligonucleotide; CTA chr11 5276709 5276730 5276726 5276731 +
gaggtgttttgaacctcacata

SEQ ID NO: 92855 - DNA, 22 bp, Artificial Sequence
  Synthetic oligonucleotide; TTT chr11 5276718 5276739 5276735 5276740 +
tgaacctcacataacactgatg

SEQ ID NO: 92856 - DNA, 22 bp, Artificial Sequence
  Synthetic oligonucleotide; TTT chr11 5276719 5276740 5276736 5276741 +
gaacctcacataacactgatgt

SEQ ID NO: 92857 - DNA, 22 bp, Artificial Sequence
  Synthetic oligonucleotide; TTG chr11 5276720 5276741 5276737 5276742 +
aacctcacataacactgatgtc

SEQ ID NO: 92858 - DNA, 22 bp, Artificial Sequence
  Synthetic oligonucleotide; CTC chr11 5276726 5276747 5276743 5276748 +
acataacactgatgtccaggcc

SEQ ID NO: 92859 - DNA, 22 bp, Artificial Sequence
  Synthetic oligonucleotide; CTG chr11 5276737 5276758 5276754 5276759 +
atgtccaggccaaggccatcct

SEQ ID NO: 92860 - DNA, 22 bp, Artificial Sequence
  Synthetic oligonucleotide; CTT chr11 5276760 5276781 5276777 5276782 +
cccatgaagatggatgaataag

SEQ ID NO: 92861 - DNA, 22 bp, Artificial Sequence
  Synthetic oligonucleotide; TTC chr11 5276761 5276782 5276778 5276783 +
ccatgaagatggatgaataagc

SEQ ID NO: 92862 - DNA, 22 bp, Artificial Sequence
  Synthetic oligonucleotide; CTG chr11 5276791 5276812 5276808 5276813 +
acacctatgaaataatgtttac

SEQ ID NO: 92863 - DNA, 22 bp, Artificial Sequence
  Synthetic oligonucleotide; CTA chr11 5276798 5276819 5276815 5276820 +
tgaaataatgtttactttagtg

SEQ ID NO: 92864 - DNA, 22 bp, Artificial Sequence
  Synthetic oligonucleotide; TTT chr11 5276811 5276832 5276828 5276833 +
actttagtggcatattgcatta

SEQ ID NO: 92865 - DNA, 22 bp, Artificial Sequence
  Synthetic oligonucleotide; TTA chr11 5276812 5276833 5276829 5276834 +
ctttagtggcatattgcattag

SEQ ID NO: 92866 - DNA, 22 bp, Artificial Sequence
  Synthetic oligonucleotide; CTT chr11 5276815 5276836 5276832 5276837 +
tagtggcatattgcattaggct

SEQ ID NO: 92867 - DNA, 22 bp, Artificial Sequence
  Synthetic oligonucleotide; TTT chr11 5276816 5276837 5276833 5276838 +
agtggcatattgcattaggcta

SEQ ID NO: 92868 - DNA, 22 bp, Artificial Sequence
  Synthetic oligonucleotide; TTA chr11 5276817 5276838 5276834 5276839 +
gtggcatattgcattaggctac

SEQ ID NO: 92869 - DNA, 22 bp, Artificial Sequence
  Synthetic oligonucleotide; TTG chr11 5276828 5276849 5276845 5276850 +
cattaggctacctgccttggca

SEQ ID NO: 92870 - DNA, 22 bp, Artificial Sequence
  Synthetic oligonucleotide; TTA chr11 5276833 5276854 5276850 5276855 +
ggctacctgccttggcacagtt

SEQ ID NO: 92871 - DNA, 22 bp, Artificial Sequence
  Synthetic oligonucleotide; CTA chr11 5276838 5276859 5276855 5276860 +
cctgccttggcacagtttttct

SEQ ID NO: 92872 - DNA, 22 bp, Artificial Sequence
  Synthetic oligonucleotide; CTG chr11 5276842 5276863 5276859 5276864 +
ccttggcacagtttttctttac

SEQ ID NO: 92873 - DNA, 22 bp, Artificial Sequence
  Synthetic oligonucleotide; CTT chr11 5276846 5276867 5276863 5276868 +
ggcacagtttttctttactttt

SEQ ID NO: 92874 - DNA, 22 bp, Artificial Sequence
  Synthetic oligonucleotide; TTG chr11 5276847 5276868 5276864 5276869 +
gcacagtttttctttactttta

SEQ ID NO: 92875 - DNA, 22 bp, Artificial Sequence
  Synthetic oligonucleotide; TTT chr11 5276856 5276877 5276873 5276878 +
ttctttacttttacctgactga

SEQ ID NO: 92876 - DNA, 22 bp, Artificial Sequence
  Synthetic oligonucleotide; TTT chr11 5276857 5276878 5276874 5276879 +
tctttacttttacctgactgat

SEQ ID NO: 92877 - DNA, 22 bp, Artificial Sequence
  Synthetic oligonucleotide; TTT chr11 5276858 5276879 5276875 5276880 +
ctttacttttacctgactgatg

SEQ ID NO: 92878 - DNA, 22 bp, Artificial Sequence
  Synthetic oligonucleotide; TTC chr11 5276859 5276880 5276876 5276881 +
tttacttttacctgactgatga

SEQ ID NO: 92879 - DNA, 22 bp, Artificial Sequence
  Synthetic oligonucleotide; CTT chr11 5276861 5276882 5276878 5276883 +
tacttttacctgactgatgaaa

SEQ ID NO: 92880 - DNA, 22 bp, Artificial Sequence
  Synthetic oligonucleotide; TTT chr11 5276862 5276883 5276879 5276884 +
acttttacctgactgatgaaac

SEQ ID NO: 92881 - DNA, 22 bp, Artificial Sequence
  Synthetic oligonucleotide; TTA chr11 5276863 5276884 5276880 5276885 +
cttttacctgactgatgaaaca

SEQ ID NO: 92882 - DNA, 22 bp, Artificial Sequence
  Synthetic oligonucleotide; CTT chr11 5276866 5276887 5276883 5276888 +
ttacctgactgatgaaacaatt

SEQ ID NO: 92883 - DNA, 22 bp, Artificial Sequence
  Synthetic oligonucleotide; TTT chr11 5276867 5276888 5276884 5276889 +
tacctgactgatgaaacaatta

SEQ ID NO: 92884 - DNA, 22 bp, Artificial Sequence
  Synthetic oligonucleotide; TTT chr11 5276868 5276889 5276885 5276890 +
acctgactgatgaaacaattaa

SEQ ID NO: 92885 - DNA, 22 bp, Artificial Sequence
  Synthetic oligonucleotide; TTA chr11 5276869 5276890 5276886 5276891 +
cctgactgatgaaacaattaat

SEQ ID NO: 92886 - DNA, 22 bp, Artificial Sequence
  Synthetic oligonucleotide; CTG chr11 5276873 5276894 5276890 5276895 +
actgatgaaacaattaattgct

SEQ ID NO: 92887 - DNA, 22 bp, Artificial Sequence
  Synthetic oligonucleotide; CTG chr11 5276877 5276898 5276894 5276899 +
atgaaacaattaattgcttaca

SEQ ID NO: 92888 - DNA, 22 bp, Artificial Sequence
  Synthetic oligonucleotide; TTA chr11 5276889 5276910 5276906 5276911 +
attgcttacataaacatgagtg

SEQ ID NO: 92889 - DNA, 22 bp, Artificial Sequence
  Synthetic oligonucleotide; TTG chr11 5276893 5276914 5276910 5276915 +
cttacataaacatgagtgctct

SEQ ID NO: 92890 - DNA, 22 bp, Artificial Sequence
  Synthetic oligonucleotide; CTT chr11 5276896 5276917 5276913 5276918 +
acataaacatgagtgctctagt

SEQ ID NO: 92891 - DNA, 22 bp, Artificial Sequence
  Synthetic oligonucleotide; TTA chr11 5276897 5276918 5276914 5276919 +
cataaacatgagtgctctagtt

SEQ ID NO: 92892 - DNA, 22 bp, Artificial Sequence
  Synthetic oligonucleotide; CTC chr11 5276914 5276935 5276931 5276936 +
tagttataaattccagtgtaaa

SEQ ID NO: 92893 - DNA, 22 bp, Artificial Sequence
  Synthetic oligonucleotide; CTA chr11 5276916 5276937 5276933 5276938 +
gttataaattccagtgtaaaaa

SEQ ID NO: 92894 - DNA, 22 bp, Artificial Sequence
  Synthetic oligonucleotide; TTA chr11 5276920 5276941 5276937 5276942 +
taaattccagtgtaaaaaacac

SEQ ID NO: 92895 - DNA, 22 bp, Artificial Sequence
  Synthetic oligonucleotide; TTC chr11 5276927 5276948 5276944 5276949 +
cagtgtaaaaaacaccctggtt

SEQ ID NO: 92896 - DNA, 22 bp, Artificial Sequence
  Synthetic oligonucleotide; CTG chr11 5276946 5276967 5276963 5276968 +
gtttcgatattcatcttttgag

SEQ ID NO: 92897 - DNA, 22 bp, Artificial Sequence
  Synthetic oligonucleotide; TTT chr11 5276950 5276971 5276967 5276972 +
cgatattcatcttttgagcctt

SEQ ID NO: 92898 - DNA, 22 bp, Artificial Sequence
  Synthetic oligonucleotide; TTC chr11 5276951 5276972 5276968 5276973 +
gatattcatcttttgagccttt

SEQ ID NO: 92899 - DNA, 22 bp, Artificial Sequence
  Synthetic oligonucleotide; TTC chr11 5276958 5276979 5276975 5276980 +
atcttttgagccttttattttg

SEQ ID NO: 92900 - DNA, 22 bp, Artificial Sequence
  Synthetic oligonucleotide; CTT chr11 5276963 5276984 5276980 5276985 +
ttgagccttttattttggtcag

SEQ ID NO: 92901 - DNA, 22 bp, Artificial Sequence
  Synthetic oligonucleotide; TTT chr11 5276964 5276985 5276981 5276986 +
tgagccttttattttggtcaga

SEQ ID NO: 92902 - DNA, 22 bp, Artificial Sequence
  Synthetic oligonucleotide; TTT chr11 5276965 5276986 5276982 5276987 +
gagccttttattttggtcagaa

SEQ ID NO: 92903 - DNA, 22 bp, Artificial Sequence
  Synthetic oligonucleotide; TTG chr11 5276966 5276987 5276983 5276988 +
agccttttattttggtcagaac

SEQ ID NO: 92904 - DNA, 22 bp, Artificial Sequence
  Synthetic oligonucleotide; CTT chr11 5276972 5276993 5276989 5276994 +
ttattttggtcagaacaagttt

SEQ ID NO: 92905 - DNA, 22 bp, Artificial Sequence
  Synthetic oligonucleotide; TTT chr11 5276973 5276994 5276990 5276995 +
tattttggtcagaacaagtttt

SEQ ID NO: 92906 - DNA, 22 bp, Artificial Sequence
  Synthetic oligonucleotide; TTT chr11 5276974 5276995 5276991 5276996 +
attttggtcagaacaagttttc

SEQ ID NO: 92907 - DNA, 22 bp, Artificial Sequence
  Synthetic oligonucleotide; TTA chr11 5276975 5276996 5276992 5276997 +
ttttggtcagaacaagttttca

SEQ ID NO: 92908 - DNA, 22 bp, Artificial Sequence
  Synthetic oligonucleotide; TTT chr11 5276978 5276999 5276995 5277000 +
tggtcagaacaagttttcaaga

SEQ ID NO: 92909 - DNA, 22 bp, Artificial Sequence
  Synthetic oligonucleotide; TTT chr11 5276979 5277000 5276996 5277001 +
ggtcagaacaagttttcaagag

SEQ ID NO: 92910 - DNA, 22 bp, Artificial Sequence
  Synthetic oligonucleotide; TTG chr11 5276980 5277001 5276997 5277002 +
gtcagaacaagttttcaagagc

SEQ ID NO: 92911 - DNA, 22 bp, Artificial Sequence
  Synthetic oligonucleotide; TTT chr11 5276994 5277015 5277011 5277016 +
tcaagagcaaatctcagcctac

SEQ ID NO: 92912 - DNA, 22 bp, Artificial Sequence
  Synthetic oligonucleotide; TTT chr11 5276995 5277016 5277012 5277017 +
caagagcaaatctcagcctaca

SEQ ID NO: 92913 - DNA, 22 bp, Artificial Sequence
  Synthetic oligonucleotide; TTC chr11 5276996 5277017 5277013 5277018 +
aagagcaaatctcagcctacaa

SEQ ID NO: 92914 - DNA, 22 bp, Artificial Sequence
  Synthetic oligonucleotide; CTC chr11 5277009 5277030 5277026 5277031 +
agcctacaaaacaaatgagtcc

SEQ ID NO: 92915 - DNA, 22 bp, Artificial Sequence
  Synthetic oligonucleotide; CTA chr11 5277015 5277036 5277032 5277037 +
caaaacaaatgagtccaattct

SEQ ID NO: 92916 - DNA, 22 bp, Artificial Sequence
  Synthetic oligonucleotide; TTC chr11 5277036 5277057 5277053 5277058 +
tagaactcagtaatcccatcaa

SEQ ID NO: 92917 - DNA, 22 bp, Artificial Sequence
  Synthetic oligonucleotide; CTA chr11 5277038 5277059 5277055 5277060 +
gaactcagtaatcccatcaagg

SEQ ID NO: 92918 - DNA, 22 bp, Artificial Sequence
  Synthetic oligonucleotide; CTC chr11 5277044 5277065 5277061 5277066 +
agtaatcccatcaaggctctgc

SEQ ID NO: 92919 - DNA, 22 bp, Artificial Sequence
  Synthetic oligonucleotide; CTC chr11 5277063 5277084 5277080 5277085 +
tgcctgcggagggctaactagc

SEQ ID NO: 92920 - DNA, 22 bp, Artificial Sequence
  Synthetic oligonucleotide; CTG chr11 5277065 5277086 5277082 5277087 +
cctgcggagggctaactagctc

SEQ ID NO: 92921 - DNA, 22 bp, Artificial Sequence
  Synthetic oligonucleotide; CTG chr11 5277069 5277090 5277086 5277091 +
cggagggctaactagctctatg

SEQ ID NO: 92922 - DNA, 22 bp, Artificial Sequence
  Synthetic oligonucleotide; CTA chr11 5277079 5277100 5277096 5277101 +
actagctctatgcaggcttagc

SEQ ID NO: 92923 - DNA, 22 bp, Artificial Sequence
  Synthetic oligonucleotide; CTA chr11 5277083 5277104 5277100 5277105 +
gctctatgcaggcttagcactt

SEQ ID NO: 92924 - DNA, 22 bp, Artificial Sequence
  Synthetic oligonucleotide; CTC chr11 5277087 5277108 5277104 5277109 +
tatgcaggcttagcacttccag

SEQ ID NO: 92925 - DNA, 22 bp, Artificial Sequence
  Synthetic oligonucleotide; CTA chr11 5277089 5277110 5277106 5277111 +
tgcaggcttagcacttccagct

SEQ ID NO: 92926 - DNA, 22 bp, Artificial Sequence
  Synthetic oligonucleotide; CTT chr11 5277098 5277119 5277115 5277120 +
agcacttccagctctactccac

SEQ ID NO: 92927 - DNA, 22 bp, Artificial Sequence
  Synthetic oligonucleotide; TTA chr11 5277099 5277120 5277116 5277121 +
gcacttccagctctactccact

SEQ ID NO: 92928 - DNA, 22 bp, Artificial Sequence
  Synthetic oligonucleotide; CTT chr11 5277105 5277126 5277122 5277127 +
ccagctctactccactgatttc

SEQ ID NO: 92929 - DNA, 22 bp, Artificial Sequence
  Synthetic oligonucleotide; TTC chr11 5277106 5277127 5277123 5277128 +
cagctctactccactgatttct

SEQ ID NO: 92930 - DNA, 22 bp, Artificial Sequence
  Synthetic oligonucleotide; CTC chr11 5277112 5277133 5277129 5277134 +
tactccactgatttctttgtgt

SEQ ID NO: 92931 - DNA, 22 bp, Artificial Sequence
  Synthetic oligonucleotide; CTA chr11 5277114 5277135 5277131 5277136 +
ctccactgatttctttgtgtgt

SEQ ID NO: 92932 - DNA, 22 bp, Artificial Sequence
  Synthetic oligonucleotide; CTC chr11 5277117 5277138 5277134 5277139 +
cactgatttctttgtgtgtgca

SEQ ID NO: 92933 - DNA, 22 bp, Artificial Sequence
  Synthetic oligonucleotide; CTG chr11 5277122 5277143 5277139 5277144 +
atttctttgtgtgtgcatagca

SEQ ID NO: 92934 - DNA, 22 bp, Artificial Sequence
  Synthetic oligonucleotide; TTT chr11 5277126 5277147 5277143 5277148 +
ctttgtgtgtgcatagcagtgg

SEQ ID NO: 92935 - DNA, 22 bp, Artificial Sequence
  Synthetic oligonucleotide; TTC chr11 5277127 5277148 5277144 5277149 +
tttgtgtgtgcatagcagtgga

SEQ ID NO: 92936 - DNA, 22 bp, Artificial Sequence
  Synthetic oligonucleotide; CTT chr11 5277129 5277150 5277146 5277151 +
tgtgtgtgcatagcagtggatg

SEQ ID NO: 92937 - DNA, 22 bp, Artificial Sequence
  Synthetic oligonucleotide; TTT chr11 5277130 5277151 5277147 5277152 +
gtgtgtgcatagcagtggatgt

SEQ ID NO: 92938 - DNA, 22 bp, Artificial Sequence
  Synthetic oligonucleotide; TTG chr11 5277131 5277152 5277148 5277153 +
tgtgtgcatagcagtggatgtg

SEQ ID NO: 92939 - DNA, 22 bp, Artificial Sequence
  Synthetic oligonucleotide; CTT chr11 5277168 5277189 5277185 5277190 +
ttaattatagttgtatatgtgt

SEQ ID NO: 92940 - DNA, 22 bp, Artificial Sequence
  Synthetic oligonucleotide; TTT chr11 5277169 5277190 5277186 5277191 +
taattatagttgtatatgtgtt

SEQ ID NO: 92941 - DNA, 22 bp, Artificial Sequence
  Synthetic oligonucleotide; TTT chr11 5277170 5277191 5277187 5277192 +
aattatagttgtatatgtgttt

SEQ ID NO: 92942 - DNA, 22 bp, Artificial Sequence
  Synthetic oligonucleotide; TTA chr11 5277171 5277192 5277188 5277193 +
attatagttgtatatgtgtttg

SEQ ID NO: 92943 - DNA, 22 bp, Artificial Sequence
  Synthetic oligonucleotide; TTA chr11 5277175 5277196 5277192 5277197 +
tagttgtatatgtgtttgactg

SEQ ID NO: 92944 - DNA, 22 bp, Artificial Sequence
  Synthetic oligonucleotide; TTG chr11 5277181 5277202 5277198 5277203 +
tatatgtgtttgactgctcatt

SEQ ID NO: 92945 - DNA, 22 bp, Artificial Sequence
  Synthetic oligonucleotide; TTT chr11 5277192 5277213 5277209 5277214 +
gactgctcattcattcattcaa

SEQ ID NO: 92946 - DNA, 22 bp, Artificial Sequence
  Synthetic oligonucleotide; TTG chr11 5277193 5277214 5277210 5277215 +
actgctcattcattcattcaaa

SEQ ID NO: 92947 - DNA, 22 bp, Artificial Sequence
  Synthetic oligonucleotide; CTG chr11 5277197 5277218 5277214 5277219 +
ctcattcattcattcaaaattg

SEQ ID NO: 92948 - DNA, 22 bp, Artificial Sequence
  Synthetic oligonucleotide; CTC chr11 5277200 5277221 5277217 5277222 +
attcattcattcaaaattgtaa

SEQ ID NO: 92949 - DNA, 22 bp, Artificial Sequence
  Synthetic oligonucleotide; TTC chr11 5277204 5277225 5277221 5277226 +
attcattcaaaattgtaaaatt

SEQ ID NO: 92950 - DNA, 22 bp, Artificial Sequence
  Synthetic oligonucleotide; TTC chr11 5277208 5277229 5277225 5277230 +
attcaaaattgtaaaattgcta

SEQ ID NO: 92951 - DNA, 22 bp, Artificial Sequence
  Synthetic oligonucleotide; TTC chr11 5277212 5277233 5277229 5277234 +
aaaattgtaaaattgctaagaa

SEQ ID NO: 92952 - DNA, 22 bp, Artificial Sequence
  Synthetic oligonucleotide; TTG chr11 5277219 5277240 5277236 5277241 +
taaaattgctaagaatacagca

SEQ ID NO: 92953 - DNA, 22 bp, Artificial Sequence
  Synthetic oligonucleotide; TTG chr11 5277227 5277248 5277244 5277249 +
ctaagaatacagcacaaaaaca

SEQ ID NO: 92954 - DNA, 22 bp, Artificial Sequence
  Synthetic oligonucleotide; CTA chr11 5277230 5277251 5277247 5277252 +
agaatacagcacaaaaacagaa

SEQ ID NO: 92955 - DNA, 22 bp, Artificial Sequence
  Synthetic oligonucleotide; TTC chr11 5277268 5277289 5277285 5277290 +
ctgttttcatggacttgatagt

SEQ ID NO: 92956 - DNA, 22 bp, Artificial Sequence
  Synthetic oligonucleotide; CTG chr11 5277271 5277292 5277288 5277293 +
ttttcatggacttgatagtgga

SEQ ID NO: 92957 - DNA, 22 bp, Artificial Sequence
  Synthetic oligonucleotide; TTT chr11 5277274 5277295 5277291 5277296 +
tcatggacttgatagtggaaag

SEQ ID NO: 92958 - DNA, 22 bp, Artificial Sequence
  Synthetic oligonucleotide; TTT chr11 5277275 5277296 5277292 5277297 +
catggacttgatagtggaaaga

SEQ ID NO: 92959 - DNA, 22 bp, Artificial Sequence
  Synthetic oligonucleotide; TTC chr11 5277276 5277297 5277293 5277298 +
atggacttgatagtggaaagag

SEQ ID NO: 92960 - DNA, 22 bp, Artificial Sequence
  Synthetic oligonucleotide; CTT chr11 5277284 5277305 5277301 5277306 +
gatagtggaaagagcttgacat

SEQ ID NO: 92961 - DNA, 22 bp, Artificial Sequence
  Synthetic oligonucleotide; TTG chr11 5277285 5277306 5277302 5277307 +
atagtggaaagagcttgacatt

SEQ ID NO: 92962 - DNA, 22 bp, Artificial Sequence
  Synthetic oligonucleotide; CTT chr11 5277301 5277322 5277318 5277323 +
gacattaaataagcaaatgaaa

SEQ ID NO: 92963 - DNA, 22 bp, Artificial Sequence
  Synthetic oligonucleotide; TTG chr11 5277302 5277323 5277319 5277324 +
acattaaataagcaaatgaaac

SEQ ID NO: 92964 - DNA, 22 bp, Artificial Sequence
  Synthetic oligonucleotide; TTA chr11 5277308 5277329 5277325 5277330 +
aataagcaaatgaaacatgtta

SEQ ID NO: 92965 - DNA, 22 bp, Artificial Sequence
  Synthetic oligonucleotide; TTA chr11 5277330 5277351 5277347 5277352 +
tataccaatgagattaggtgct

SEQ ID NO: 92966 - DNA, 22 bp, Artificial Sequence
  Synthetic oligonucleotide; TTA chr11 5277346 5277367 5277363 5277368 +
ggtgctatggagaaaaaaaaaa

SEQ ID NO: 92967 - DNA, 22 bp, Artificial Sequence
  Synthetic oligonucleotide; CTA chr11 5277353 5277374 5277370 5277375 +
tggagaaaaaaaaaaaactgaa

SEQ ID NO: 92968 - DNA, 22 bp, Artificial Sequence
  Synthetic oligonucleotide; CTG chr11 5277373 5277394 5277390 5277395 +
aaatgaaggccagagtgtgatt

SEQ ID NO: 92969 - DNA, 22 bp, Artificial Sequence
  Synthetic oligonucleotide; TTA chr11 5277396 5277417 5277413 5277418 +
ggacagggtgaaagggtatcgc

SEQ ID NO: 92970 - DNA, 22 bp, Artificial Sequence
  Synthetic oligonucleotide; CTA chr11 5277420 5277441 5277437 5277442 +
ctttaagtagtatggcaggaaa

SEQ ID NO: 92971 - DNA, 22 bp, Artificial Sequence
  Synthetic oligonucleotide; CTT chr11 5277423 5277444 5277440 5277445 +
taagtagtatggcaggaaagtc

SEQ ID NO: 92972 - DNA, 22 bp, Artificial Sequence
  Synthetic oligonucleotide; TTT chr11 5277424 5277445 5277441 5277446 +
aagtagtatggcaggaaagtcc

SEQ ID NO: 92973 - DNA, 22 bp, Artificial Sequence
  Synthetic oligonucleotide; TTA chr11 5277425 5277446 5277442 5277447 +
agtagtatggcaggaaagtcct

SEQ ID NO: 92974 - DNA, 22 bp, Artificial Sequence
  Synthetic oligonucleotide; CTC chr11 5277448 5277469 5277465 5277470 +
actataaagttaacacctgaga

SEQ ID NO: 92975 - DNA, 22 bp, Artificial Sequence
  Synthetic oligonucleotide; CTA chr11 5277452 5277473 5277469 5277474 +
taaagttaacacctgagagagt

SEQ ID NO: 92976 - DNA, 22 bp, Artificial Sequence
  Synthetic oligonucleotide; TTA chr11 5277460 5277481 5277477 5277482 +
acacctgagagagtacccatag

SEQ ID NO: 92977 - DNA, 22 bp, Artificial Sequence
  Synthetic oligonucleotide; CTG chr11 5277467 5277488 5277484 5277489 +
agagagtacccatagatgatga

SEQ ID NO: 92978 - DNA, 22 bp, Artificial Sequence
  Synthetic oligonucleotide; TTT chr11 5277500 5277521 5277517 5277522 +
atatgaaactatgattaaatat

SEQ ID NO: 92979 - DNA, 22 bp, Artificial Sequence
  Synthetic oligonucleotide; TTA chr11 5277501 5277522 5277518 5277523 +
tatgaaactatgattaaatatt

SEQ ID NO: 92980 - DNA, 22 bp, Artificial Sequence
  Synthetic oligonucleotide; CTA chr11 5277511 5277532 5277528 5277533 +
tgattaaatatttagggcatag

SEQ ID NO: 92981 - DNA, 22 bp, Artificial Sequence
  Synthetic oligonucleotide; TTA chr11 5277517 5277538 5277534 5277539 +
aatatttagggcatagggaatg

SEQ ID NO: 92982 - DNA, 22 bp, Artificial Sequence
  Synthetic oligonucleotide; TTT chr11 5277524 5277545 5277541 5277546 +
agggcatagggaatggcaaatg

SEQ ID NO: 92983 - DNA, 22 bp, Artificial Sequence
  Synthetic oligonucleotide; TTA chr11 5277525 5277546 5277542 5277547 +
gggcatagggaatggcaaatgt

SEQ ID NO: 92984 - DNA, 22 bp, Artificial Sequence
  Synthetic oligonucleotide; CTA chr11 5277557 5277578 5277574 5277579 +
aagatgtaagatgcttagaatt

SEQ ID NO: 92985 - DNA, 22 bp, Artificial Sequence
  Synthetic oligonucleotide; CTT chr11 5277573 5277594 5277590 5277595 +
agaattttcaaggaatatcaat

SEQ ID NO: 92986 - DNA, 22 bp, Artificial Sequence
  Synthetic oligonucleotide; TTA chr11 5277574 5277595 5277591 5277596 +
gaattttcaaggaatatcaata

SEQ ID NO: 92987 - DNA, 22 bp, Artificial Sequence
  Synthetic oligonucleotide; TTT chr11 5277580 5277601 5277597 5277602 +
tcaaggaatatcaataaggcca

SEQ ID NO: 92988 - DNA, 22 bp, Artificial Sequence
  Synthetic oligonucleotide; TTT chr11 5277581 5277602 5277598 5277603 +
caaggaatatcaataaggccaa

SEQ ID NO: 92989 - DNA, 22 bp, Artificial Sequence
  Synthetic oligonucleotide; TTC chr11 5277582 5277603 5277599 5277604 +
aaggaatatcaataaggccaat

SEQ ID NO: 92990 - DNA, 22 bp, Artificial Sequence
  Synthetic oligonucleotide; TTC chr11 5277618 5277639 5277635 5277640 +
ggtgaaggggagaataaaagat

SEQ ID NO: 92991 - DNA, 22 bp, Artificial Sequence
  Synthetic oligonucleotide; CTA chr11 5277658 5277679 5277675 5277680 +
aattataaaatttgggacacta

SEQ ID NO: 92992 - DNA, 22 bp, Artificial Sequence
  Synthetic oligonucleotide; TTA chr11 5277663 5277684 5277680 5277685 +
taaaatttgggacactaataat

SEQ ID NO: 92993 - DNA, 22 bp, Artificial Sequence
  Synthetic oligonucleotide; TTT chr11 5277671 5277692 5277688 5277693 +
gggacactaataatacctacat

SEQ ID NO: 92994 - DNA, 22 bp, Artificial Sequence
  Synthetic oligonucleotide; TTG chr11 5277672 5277693 5277689 5277694 +
ggacactaataatacctacatc

SEQ ID NO: 92995 - DNA, 22 bp, Artificial Sequence
  Synthetic oligonucleotide; CTA chr11 5277680 5277701 5277697 5277702 +
ataatacctacatcatagagtt

SEQ ID NO: 92996 - DNA, 22 bp, Artificial Sequence
  Synthetic oligonucleotide; CTA chr11 5277690 5277711 5277707 5277712 +
catcatagagttgtaagaaaaa

SEQ ID NO: 92997 - DNA, 22 bp, Artificial Sequence
  Synthetic oligonucleotide; TTG chr11 5277703 5277724 5277720 5277725 +
taagaaaaaacactctacacac

SEQ ID NO: 92998 - DNA, 22 bp, Artificial Sequence
  Synthetic oligonucleotide; CTC chr11 5277718 5277739 5277735 5277740 +
tacacacatacacataaatata

SEQ ID NO: 92999 - DNA, 22 bp, Artificial Sequence
  Synthetic oligonucleotide; CTA chr11 5277720 5277741 5277737 5277742 +
cacacatacacataaatatata

SEQ ID NO: 93000 - DNA, 22 bp, Artificial Sequence
  Synthetic oligonucleotide; TTT chr11 5277747 5277768 5277764 5277769 +
atttatatgagagctatatata

SEQ ID NO: 93001 - DNA, 22 bp, Artificial Sequence
  Synthetic oligonucleotide; TTA chr11 5277748 5277769 5277765 5277770 +
tttatatgagagctatatatat

SEQ ID NO: 93002 - DNA, 22 bp, Artificial Sequence
  Synthetic oligonucleotide; TTT chr11 5277751 5277772 5277768 5277773 +
atatgagagctatatatatgta

SEQ ID NO: 93003 - DNA, 22 bp, Artificial Sequence
  Synthetic oligonucleotide; TTA chr11 5277752 5277773 5277769 5277774 +
tatgagagctatatatatgtat

SEQ ID NO: 93004 - DNA, 22 bp, Artificial Sequence
  Synthetic oligonucleotide; CTA chr11 5277763 5277784 5277780 5277785 +
tatatatgtatctgtaataaac

SEQ ID NO: 93005 - DNA, 22 bp, Artificial Sequence
  Synthetic oligonucleotide; CTG chr11 5277777 5277798 5277794 5277799 +
taataaacataatatatgcatg

SEQ ID NO: 93006 - DNA, 22 bp, Artificial Sequence
  Synthetic oligonucleotide; CTA chr11 5277807 5277828 5277824 5277829 +
ttgtagagaattgtaaggattt

SEQ ID NO: 93007 - DNA, 22 bp, Artificial Sequence
  Synthetic oligonucleotide; TTG chr11 5277810 5277831 5277827 5277832 +
tagagaattgtaaggatttggt

SEQ ID NO: 93008 - DNA, 22 bp, Artificial Sequence
  Synthetic oligonucleotide; TTG chr11 5277820 5277841 5277837 5277842 +
taaggatttggttttattataa

SEQ ID NO: 93009 - DNA, 22 bp, Artificial Sequence
  Synthetic oligonucleotide; TTT chr11 5277829 5277850 5277846 5277851 +
ggttttattataaatgatatag

SEQ ID NO: 93010 - DNA, 22 bp, Artificial Sequence
  Synthetic oligonucleotide; TTG chr11 5277830 5277851 5277847 5277852 +
gttttattataaatgatatagg

SEQ ID NO: 93011 - DNA, 22 bp, Artificial Sequence
  Synthetic oligonucleotide; TTT chr11 5277834 5277855 5277851 5277856 +
tattataaatgatataggaaac

SEQ ID NO: 93012 - DNA, 22 bp, Artificial Sequence
  Synthetic oligonucleotide; TTT chr11 5277835 5277856 5277852 5277857 +
attataaatgatataggaaact

SEQ ID NO: 93013 - DNA, 22 bp, Artificial Sequence
  Synthetic oligonucleotide; TTA chr11 5277836 5277857 5277853 5277858 +
ttataaatgatataggaaacta

SEQ ID NO: 93014 - DNA, 22 bp, Artificial Sequence
  Synthetic oligonucleotide; TTA chr11 5277839 5277860 5277856 5277861 +
taaatgatataggaaactatca

SEQ ID NO: 93015 - DNA, 22 bp, Artificial Sequence
  Synthetic oligonucleotide; CTA chr11 5277858 5277879 5277875 5277880 +
tcagaagactttgaacaaagag

SEQ ID NO: 93016 - DNA, 22 bp, Artificial Sequence
  Synthetic oligonucleotide; CTT chr11 5277869 5277890 5277886 5277891 +
tgaacaaagaggtgaccatata

SEQ ID NO: 93017 - DNA, 22 bp, Artificial Sequence
  Synthetic oligonucleotide; TTT chr11 5277870 5277891 5277887 5277892 +
gaacaaagaggtgaccatatat

SEQ ID NO: 93018 - DNA, 22 bp, Artificial Sequence
  Synthetic oligonucleotide; TTG chr11 5277871 5277892 5277888 5277893 +
aacaaagaggtgaccatatatg

SEQ ID NO: 93019 - DNA, 22 bp, Artificial Sequence
  Synthetic oligonucleotide; CTT chr11 5277897 5277918 5277914 5277919 +
acattttgaaaagactaatttg

SEQ ID NO: 93020 - DNA, 22 bp, Artificial Sequence
  Synthetic oligonucleotide; TTA chr11 5277898 5277919 5277915 5277920 +
cattttgaaaagactaatttgg

SEQ ID NO: 93021 - DNA, 22 bp, Artificial Sequence
  Synthetic oligonucleotide; TTT chr11 5277903 5277924 5277920 5277925 +
tgaaaagactaatttggatagt

SEQ ID NO: 93022 - DNA, 22 bp, Artificial Sequence
  Synthetic oligonucleotide; TTT chr11 5277904 5277925 5277921 5277926 +
gaaaagactaatttggatagta

SEQ ID NO: 93023 - DNA, 22 bp, Artificial Sequence
  Synthetic oligonucleotide; TTG chr11 5277905 5277926 5277922 5277927 +
aaaagactaatttggatagtat

SEQ ID NO: 93024 - DNA, 22 bp, Artificial Sequence
  Synthetic oligonucleotide; CTA chr11 5277914 5277935 5277931 5277936 +
atttggatagtatattgggaag

SEQ ID NO: 93025 - DNA, 22 bp, Artificial Sequence
  Synthetic oligonucleotide; TTT chr11 5277918 5277939 5277935 5277940 +
ggatagtatattgggaagaaat

SEQ ID NO: 93026 - DNA, 22 bp, Artificial Sequence
  Synthetic oligonucleotide; TTG chr11 5277919 5277940 5277936 5277941 +
gatagtatattgggaagaaatt

SEQ ID NO: 93027 - DNA, 22 bp, Artificial Sequence
  Synthetic oligonucleotide; TTG chr11 5277931 5277952 5277948 5277953 +
ggaagaaattgtagtggggcag

SEQ ID NO: 93028 - DNA, 22 bp, Artificial Sequence
  Synthetic oligonucleotide; TTG chr11 5277942 5277963 5277959 5277964 +
tagtggggcagtggtagaagca

SEQ ID NO: 93029 - DNA, 22 bp, Artificial Sequence
  Synthetic oligonucleotide; TTG chr11 5277973 5277994 5277990 5277995 +
ttatgagtcaacagctataatt

SEQ ID NO: 93030 - DNA, 22 bp, Artificial Sequence
  Synthetic oligonucleotide; TTA chr11 5277976 5277997 5277993 5277998 +
tgagtcaacagctataatttag

SEQ ID NO: 93031 - DNA, 22 bp, Artificial Sequence
  Synthetic oligonucleotide; CTA chr11 5277990 5278011 5278007 5278012 +
taatttaggtggtggtgacagt

SEQ ID NO: 93032 - DNA, 22 bp, Artificial Sequence
  Synthetic oligonucleotide; TTT chr11 5277996 5278017 5278013 5278018 +
aggtggtggtgacagtgactta

SEQ ID NO: 93033 - DNA, 22 bp, Artificial Sequence
  Synthetic oligonucleotide; TTA chr11 5277997 5278018 5278014 5278019 +
ggtggtggtgacagtgacttag

SEQ ID NO: 93034 - DNA, 22 bp, Artificial Sequence
  Synthetic oligonucleotide; CTT chr11 5278017 5278038 5278034 5278039 +
agaccagagtggtagcattgga

SEQ ID NO: 93035 - DNA, 22 bp, Artificial Sequence
  Synthetic oligonucleotide; TTA chr11 5278018 5278039 5278035 5278040 +
gaccagagtggtagcattggag

SEQ ID NO: 93036 - DNA, 22 bp, Artificial Sequence
  Synthetic oligonucleotide; TTG chr11 5278037 5278058 5278054 5278059 +
gaggtgaaggcaaggggtcagc

SEQ ID NO: 93037 - DNA, 22 bp, Artificial Sequence
  Synthetic oligonucleotide; CTC chr11 5278062 5278083 5278079 5278084 +
tgaaaacatcctttcacgaaaa

SEQ ID NO: 93038 - DNA, 22 bp, Artificial Sequence
  Synthetic oligonucleotide; CTG chr11 5278064 5278085 5278081 5278086 +
aaaacatcctttcacgaaaaac

SEQ ID NO: 93039 - DNA, 22 bp, Artificial Sequence
  Synthetic oligonucleotide; CTT chr11 5278075 5278096 5278092 5278097 +
tcacgaaaaaccaacaggattt

SEQ ID NO: 93040 - DNA, 22 bp, Artificial Sequence
  Synthetic oligonucleotide; TTT chr11 5278076 5278097 5278093 5278098 +
cacgaaaaaccaacaggatttt

SEQ ID NO: 93041 - DNA, 22 bp, Artificial Sequence
  Synthetic oligonucleotide; TTC chr11 5278077 5278098 5278094 5278099 +
acgaaaaaccaacaggattttc

SEQ ID NO: 93042 - DNA, 22 bp, Artificial Sequence
  Synthetic oligonucleotide; TTT chr11 5278097 5278118 5278114 5278119 +
tctgacagagaatatggaattg

SEQ ID NO: 93043 - DNA, 22 bp, Artificial Sequence
  Synthetic oligonucleotide; TTT chr11 5278098 5278119 5278115 5278120 +
ctgacagagaatatggaattgg

SEQ ID NO: 93044 - DNA, 22 bp, Artificial Sequence
  Synthetic oligonucleotide; TTC chr11 5278099 5278120 5278116 5278121 +
tgacagagaatatggaattggt

SEQ ID NO: 93045 - DNA, 22 bp, Artificial Sequence
  Synthetic oligonucleotide; CTG chr11 5278101 5278122 5278118 5278123 +
acagagaatatggaattggtgt

SEQ ID NO: 93046 - DNA, 22 bp, Artificial Sequence
  Synthetic oligonucleotide; TTG chr11 5278119 5278140 5278136 5278141 +
gtgtgtgtgtgtgttgcactca

SEQ ID NO: 93047 - DNA, 22 bp, Artificial Sequence
  Synthetic oligonucleotide; TTG chr11 5278135 5278156 5278152 5278157 +
cactcatgcacactctagtgca

SEQ ID NO: 93048 - DNA, 22 bp, Artificial Sequence
  Synthetic oligonucleotide; CTC chr11 5278140 5278161 5278157 5278162 +
atgcacactctagtgcatgcta

SEQ ID NO: 93049 - DNA, 22 bp, Artificial Sequence
  Synthetic oligonucleotide; CTC chr11 5278150 5278171 5278167 5278172 +
tagtgcatgctaatttctggct

SEQ ID NO: 93050 - DNA, 22 bp, Artificial Sequence
  Synthetic oligonucleotide; CTA chr11 5278152 5278173 5278169 5278174 +
gtgcatgctaatttctggctgt

SEQ ID NO: 93051 - DNA, 22 bp, Artificial Sequence
  Synthetic oligonucleotide; CTA chr11 5278162 5278183 5278179 5278184 +
atttctggctgtgagtatatgt

SEQ ID NO: 93052 - DNA, 22 bp, Artificial Sequence
  Synthetic oligonucleotide; TTT chr11 5278166 5278187 5278183 5278188 +
ctggctgtgagtatatgtcaga

SEQ ID NO: 93053 - DNA, 22 bp, Artificial Sequence
  Synthetic oligonucleotide; TTC chr11 5278167 5278188 5278184 5278189 +
tggctgtgagtatatgtcagag

SEQ ID NO: 93054 - DNA, 22 bp, Artificial Sequence
  Synthetic oligonucleotide; CTG chr11 5278169 5278190 5278186 5278191 +
gctgtgagtatatgtcagagta

SEQ ID NO: 93055 - DNA, 22 bp, Artificial Sequence
  Synthetic oligonucleotide; CTG chr11 5278173 5278194 5278190 5278195 +
tgagtatatgtcagagtaagga

SEQ ID NO: 93056 - DNA, 22 bp, Artificial Sequence
  Synthetic oligonucleotide; TTT chr11 5278198 5278219 5278215 5278220 +
tgaagctaggcaaagtgagtct

SEQ ID NO: 93057 - DNA, 22 bp, Artificial Sequence
  Synthetic oligonucleotide; TTT chr11 5278199 5278220 5278216 5278221 +
gaagctaggcaaagtgagtctt

SEQ ID NO: 93058 - DNA, 22 bp, Artificial Sequence
  Synthetic oligonucleotide; TTG chr11 5278200 5278221 5278217 5278222 +
aagctaggcaaagtgagtcttt

SEQ ID NO: 93059 - DNA, 22 bp, Artificial Sequence
  Synthetic oligonucleotide; CTA chr11 5278206 5278227 5278223 5278228 +
ggcaaagtgagtctttgggttg

SEQ ID NO: 93060 - DNA, 22 bp, Artificial Sequence
  Synthetic oligonucleotide; CTT chr11 5278221 5278242 5278238 5278243 +
tgggttgaattttgtcaaggtg

SEQ ID NO: 93061 - DNA, 22 bp, Artificial Sequence
  Synthetic oligonucleotide; TTT chr11 5278222 5278243 5278239 5278244 +
gggttgaattttgtcaaggtgt

SEQ ID NO: 93062 - DNA, 22 bp, Artificial Sequence
  Synthetic oligonucleotide; TTG chr11 5278223 5278244 5278240 5278245 +
ggttgaattttgtcaaggtgtt

SEQ ID NO: 93063 - DNA, 22 bp, Artificial Sequence
  Synthetic oligonucleotide; TTG chr11 5278228 5278249 5278245 5278250 +
aattttgtcaaggtgtttgttc

SEQ ID NO: 93064 - DNA, 22 bp, Artificial Sequence
  Synthetic oligonucleotide; TTT chr11 5278233 5278254 5278250 5278255 +
tgtcaaggtgtttgttcatcac

SEQ ID NO: 93065 - DNA, 22 bp, Artificial Sequence
  Synthetic oligonucleotide; TTT chr11 5278234 5278255 5278251 5278256 +
gtcaaggtgtttgttcatcaca

SEQ ID NO: 93066 - DNA, 22 bp, Artificial Sequence
  Synthetic oligonucleotide; TTG chr11 5278235 5278256 5278252 5278257 +
tcaaggtgtttgttcatcacag

SEQ ID NO: 93067 - DNA, 22 bp, Artificial Sequence
  Synthetic oligonucleotide; TTT chr11 5278246 5278267 5278263 5278268 +
gttcatcacagtctctacctca

SEQ ID NO: 93068 - DNA, 22 bp, Artificial Sequence
  Synthetic oligonucleotide; TTG chr11 5278247 5278268 5278264 5278269 +
ttcatcacagtctctacctcag

SEQ ID NO: 93069 - DNA, 22 bp, Artificial Sequence
  Synthetic oligonucleotide; TTC chr11 5278250 5278271 5278267 5278272 +
atcacagtctctacctcagaat

SEQ ID NO: 93070 - DNA, 22 bp, Artificial Sequence
  Synthetic oligonucleotide; CTC chr11 5278261 5278282 5278278 5278283 +
tacctcagaattggctttaaaa

SEQ ID NO: 93071 - DNA, 22 bp, Artificial Sequence
  Synthetic oligonucleotide; CTA chr11 5278263 5278284 5278280 5278285 +
cctcagaattggctttaaaatt

SEQ ID NO: 93072 - DNA, 22 bp, Artificial Sequence
  Synthetic oligonucleotide; CTC chr11 5278267 5278288 5278284 5278289 +
agaattggctttaaaattggaa

SEQ ID NO: 93073 - DNA, 22 bp, Artificial Sequence
  Synthetic oligonucleotide; TTG chr11 5278274 5278295 5278291 5278296 +
gctttaaaattggaaagctggg

SEQ ID NO: 93074 - DNA, 22 bp, Artificial Sequence
  Synthetic oligonucleotide; CTT chr11 5278278 5278299 5278295 5278300 +
taaaattggaaagctgggtggg

SEQ ID NO: 93075 - DNA, 22 bp, Artificial Sequence
  Synthetic oligonucleotide; TTT chr11 5278279 5278300 5278296 5278301 +
aaaattggaaagctgggtgggt

SEQ ID NO: 93076 - DNA, 22 bp, Artificial Sequence
  Synthetic oligonucleotide; TTA chr11 5278280 5278301 5278297 5278302 +
aaattggaaagctgggtgggtg

SEQ ID NO: 93077 - DNA, 22 bp, Artificial Sequence
  Synthetic oligonucleotide; TTG chr11 5278286 5278307 5278303 5278308 +
gaaagctgggtgggtggatatg

SEQ ID NO: 93078 - DNA, 22 bp, Artificial Sequence
  Synthetic oligonucleotide; CTG chr11 5278294 5278315 5278311 5278316 +
ggtgggtggatatggaaatgag

SEQ ID NO: 93079 - DNA, 22 bp, Artificial Sequence
  Synthetic oligonucleotide; CTC chr11 5278326 5278347 5278343 5278348 +
tggagcttgtctacacatcata

SEQ ID NO: 93080 - DNA, 22 bp, Artificial Sequence
  Synthetic oligonucleotide; CTG chr11 5278328 5278349 5278345 5278350 +
gagcttgtctacacatcatacc

SEQ ID NO: 93081 - DNA, 22 bp, Artificial Sequence
  Synthetic oligonucleotide; CTT chr11 5278334 5278355 5278351 5278356 +
gtctacacatcatacctttagc

SEQ ID NO: 93082 - DNA, 22 bp, Artificial Sequence
  Synthetic oligonucleotide; TTG chr11 5278335 5278356 5278352 5278357 +
tctacacatcatacctttagcc

SEQ ID NO: 93083 - DNA, 22 bp, Artificial Sequence
  Synthetic oligonucleotide; CTA chr11 5278339 5278360 5278356 5278361 +
cacatcatacctttagccaaag

SEQ ID NO: 93084 - DNA, 22 bp, Artificial Sequence
  Synthetic oligonucleotide; CTT chr11 5278352 5278373 5278369 5278374 +
tagccaaagtgacatcaagtat

SEQ ID NO: 93085 - DNA, 22 bp, Artificial Sequence
  Synthetic oligonucleotide; TTT chr11 5278353 5278374 5278370 5278375 +
agccaaagtgacatcaagtatt

SEQ ID NO: 93086 - DNA, 22 bp, Artificial Sequence
  Synthetic oligonucleotide; TTA chr11 5278354 5278375 5278371 5278376 +
gccaaagtgacatcaagtattt

SEQ ID NO: 93087 - DNA, 22 bp, Artificial Sequence
  Synthetic oligonucleotide; TTT chr11 5278376 5278397 5278393 5278398 +
cttggatgctgaccagaggctt

SEQ ID NO: 93088 - DNA, 22 bp, Artificial Sequence
  Synthetic oligonucleotide; TTC chr11 5278377 5278398 5278394 5278399 +
ttggatgctgaccagaggcttc

SEQ ID NO: 93089 - DNA, 22 bp, Artificial Sequence
  Synthetic oligonucleotide; CTT chr11 5278379 5278400 5278396 5278401 +
ggatgctgaccagaggcttctg

SEQ ID NO: 93090 - DNA, 22 bp, Artificial Sequence
  Synthetic oligonucleotide; TTG chr11 5278380 5278401 5278397 5278402 +
gatgctgaccagaggcttctga

SEQ ID NO: 93091 - DNA, 22 bp, Artificial Sequence
  Synthetic oligonucleotide; CTG chr11 5278387 5278408 5278404 5278409 +
accagaggcttctgagccaggc

SEQ ID NO: 93092 - DNA, 22 bp, Artificial Sequence
  Synthetic oligonucleotide; CTT chr11 5278398 5278419 5278415 5278420 +
ctgagccaggcccctctagctg

SEQ ID NO: 93093 - DNA, 22 bp, Artificial Sequence
  Synthetic oligonucleotide; TTC chr11 5278399 5278420 5278416 5278421 +
tgagccaggcccctctagctga

SEQ ID NO: 93094 - DNA, 22 bp, Artificial Sequence
  Synthetic oligonucleotide; CTG chr11 5278401 5278422 5278418 5278423 +
agccaggcccctctagctgaag

SEQ ID NO: 93095 - DNA, 22 bp, Artificial Sequence
  Synthetic oligonucleotide; CTC chr11 5278414 5278435 5278431 5278436 +
tagctgaaggaagttcacagtt

SEQ ID NO: 93096 - DNA, 22 bp, Artificial Sequence
  Synthetic oligonucleotide; CTA chr11 5278416 5278437 5278433 5278438 +
gctgaaggaagttcacagtttc

SEQ ID NO: 93097 - DNA, 22 bp, Artificial Sequence
  Synthetic oligonucleotide; CTG chr11 5278420 5278441 5278437 5278442 +
aaggaagttcacagtttcttta

SEQ ID NO: 93098 - DNA, 22 bp, Artificial Sequence
  Synthetic oligonucleotide; TTC chr11 5278430 5278451 5278447 5278452 +
acagtttctttaaggagggaaa

SEQ ID NO: 93099 - DNA, 22 bp, Artificial Sequence
  Synthetic oligonucleotide; TTT chr11 5278437 5278458 5278454 5278459 +
ctttaaggagggaaaatggtag

SEQ ID NO: 93100 - DNA, 22 bp, Artificial Sequence
  Synthetic oligonucleotide; TTC chr11 5278438 5278459 5278455 5278460 +
tttaaggagggaaaatggtaga

SEQ ID NO: 93101 - DNA, 22 bp, Artificial Sequence
  Synthetic oligonucleotide; CTT chr11 5278440 5278461 5278457 5278462 +
taaggagggaaaatggtagata

SEQ ID NO: 93102 - DNA, 22 bp, Artificial Sequence
  Synthetic oligonucleotide; TTT chr11 5278441 5278462 5278458 5278463 +
aaggagggaaaatggtagataa

SEQ ID NO: 93103 - DNA, 22 bp, Artificial Sequence
  Synthetic oligonucleotide; TTA chr11 5278442 5278463 5278459 5278464 +
aggagggaaaatggtagataag

SEQ ID NO: 93104 - DNA, 22 bp, Artificial Sequence
  Synthetic oligonucleotide; TTC chr11 5278488 5278509 5278505 5278510 +
tgttcggtcagggaatttgatg

SEQ ID NO: 93105 - DNA, 22 bp, Artificial Sequence
  Synthetic oligonucleotide; CTG chr11 5278490 5278511 5278507 5278512 +
ttcggtcagggaatttgatggg

SEQ ID NO: 93106 - DNA, 22 bp, Artificial Sequence
  Synthetic oligonucleotide; TTC chr11 5278493 5278514 5278510 5278515 +
ggtcagggaatttgatgggttt

SEQ ID NO: 93107 - DNA, 22 bp, Artificial Sequence
  Synthetic oligonucleotide; TTT chr11 5278506 5278527 5278523 5278528 +
gatgggttttgtttgtttgttt

SEQ ID NO: 93108 - DNA, 22 bp, Artificial Sequence
  Synthetic oligonucleotide; TTG chr11 5278507 5278528 5278524 5278529 +
atgggttttgtttgtttgtttg

SEQ ID NO: 93109 - DNA, 22 bp, Artificial Sequence
  Synthetic oligonucleotide; TTT chr11 5278515 5278536 5278532 5278537 +
tgtttgtttgtttgtttgtttg

SEQ ID NO: 93110 - DNA, 22 bp, Artificial Sequence
  Synthetic oligonucleotide; TTT chr11 5278516 5278537 5278533 5278538 +
gtttgtttgtttgtttgtttgt

SEQ ID NO: 93111 - DNA, 22 bp, Artificial Sequence
  Synthetic oligonucleotide; TTG chr11 5278517 5278538 5278534 5278539 +
tttgtttgtttgtttgtttgtt

SEQ ID NO: 93112 - DNA, 22 bp, Artificial Sequence
  Synthetic oligonucleotide; TTT chr11 5278520 5278541 5278537 5278542 +
gtttgtttgtttgtttgttttc

SEQ ID NO: 93113 - DNA, 22 bp, Artificial Sequence
  Synthetic oligonucleotide; TTG chr11 5278521 5278542 5278538 5278543 +
tttgtttgtttgtttgttttcg

SEQ ID NO: 93114 - DNA, 22 bp, Artificial Sequence
  Synthetic oligonucleotide; TTT chr11 5278524 5278545 5278541 5278546 +
gtttgtttgtttgttttcgttt

SEQ ID NO: 93115 - DNA, 22 bp, Artificial Sequence
  Synthetic oligonucleotide; TTG chr11 5278525 5278546 5278542 5278547 +
tttgtttgtttgttttcgtttt

SEQ ID NO: 93116 - DNA, 22 bp, Artificial Sequence
  Synthetic oligonucleotide; TTT chr11 5278528 5278549 5278545 5278550 +
gtttgtttgttttcgtttttct

SEQ ID NO: 93117 - DNA, 22 bp, Artificial Sequence
  Synthetic oligonucleotide; TTG chr11 5278529 5278550 5278546 5278551 +
tttgtttgttttcgtttttctt

SEQ ID NO: 93118 - DNA, 22 bp, Artificial Sequence
  Synthetic oligonucleotide; TTT chr11 5278532 5278553 5278549 5278554 +
gtttgttttcgtttttctttag

SEQ ID NO: 93119 - DNA, 22 bp, Artificial Sequence
  Synthetic oligonucleotide; TTG chr11 5278533 5278554 5278550 5278555 +
tttgttttcgtttttctttaga

SEQ ID NO: 93120 - DNA, 22 bp, Artificial Sequence
  Synthetic oligonucleotide; TTT chr11 5278536 5278557 5278553 5278558 +
gttttcgtttttctttagacag

SEQ ID NO: 93121 - DNA, 22 bp, Artificial Sequence
  Synthetic oligonucleotide; TTG chr11 5278537 5278558 5278554 5278559 +
ttttcgtttttctttagacaga

SEQ ID NO: 93122 - DNA, 22 bp, Artificial Sequence
  Synthetic oligonucleotide; TTT chr11 5278540 5278561 5278557 5278562 +
tcgtttttctttagacagagtc

SEQ ID NO: 93123 - DNA, 22 bp, Artificial Sequence
  Synthetic oligonucleotide; TTT chr11 5278541 5278562 5278558 5278563 +
cgtttttctttagacagagtct

SEQ ID NO: 93124 - DNA, 22 bp, Artificial Sequence
  Synthetic oligonucleotide; TTC chr11 5278542 5278563 5278559 5278564 +
gtttttctttagacagagtctc

SEQ ID NO: 93125 - DNA, 22 bp, Artificial Sequence
  Synthetic oligonucleotide; TTT chr11 5278546 5278567 5278563 5278568 +
ttctttagacagagtctcgctc

SEQ ID NO: 93126 - DNA, 22 bp, Artificial Sequence
  Synthetic oligonucleotide; TTT chr11 5278547 5278568 5278564 5278569 +
tctttagacagagtctcgctct

SEQ ID NO: 93127 - DNA, 22 bp, Artificial Sequence
  Synthetic oligonucleotide; TTT chr11 5278548 5278569 5278565 5278570 +
ctttagacagagtctcgctctg

SEQ ID NO: 93128 - DNA, 22 bp, Artificial Sequence
  Synthetic oligonucleotide; TTC chr11 5278549 5278570 5278566 5278571 +
tttagacagagtctcgctctgg

SEQ ID NO: 93129 - DNA, 22 bp, Artificial Sequence
  Synthetic oligonucleotide; CTT chr11 5278551 5278572 5278568 5278573 +
tagacagagtctcgctctggag

SEQ ID NO: 93130 - DNA, 22 bp, Artificial Sequence
  Synthetic oligonucleotide; TTT chr11 5278552 5278573 5278569 5278574 +
agacagagtctcgctctggagg

SEQ ID NO: 93131 - DNA, 22 bp, Artificial Sequence
  Synthetic oligonucleotide; TTA chr11 5278553 5278574 5278570 5278575 +
gacagagtctcgctctggaggc

SEQ ID NO: 93132 - DNA, 22 bp, Artificial Sequence
  Synthetic oligonucleotide; CTC chr11 5278564 5278585 5278581 5278586 +
gctctggaggctggagtgcaat

SEQ ID NO: 93133 - DNA, 22 bp, Artificial Sequence
  Synthetic oligonucleotide; CTC chr11 5278568 5278589 5278585 5278590 +
tggaggctggagtgcaatggca

SEQ ID NO: 93134 - DNA, 22 bp, Artificial Sequence
  Synthetic oligonucleotide; CTG chr11 5278570 5278591 5278587 5278592 +
gaggctggagtgcaatggcatg

SEQ ID NO: 93135 - DNA, 22 bp, Artificial Sequence
  Synthetic oligonucleotide; CTG chr11 5278577 5278598 5278594 5278599 +
gagtgcaatggcatgatctctg

SEQ ID NO: 93136 - DNA, 22 bp, Artificial Sequence
  Synthetic oligonucleotide; CTC chr11 5278597 5278618 5278614 5278619 +
tgctcagtgcaaactccacctc

SEQ ID NO: 93137 - DNA, 22 bp, Artificial Sequence
  Synthetic oligonucleotide; CTG chr11 5278599 5278620 5278616 5278621 +
ctcagtgcaaactccacctccc

SEQ ID NO: 93138 - DNA, 22 bp, Artificial Sequence
  Synthetic oligonucleotide; CTC chr11 5278602 5278623 5278619 5278624 +
agtgcaaactccacctccccgg

SEQ ID NO: 93139 - DNA, 22 bp, Artificial Sequence
  Synthetic oligonucleotide; CTC chr11 5278613 5278634 5278630 5278635 +
cacctccccggttcaagcgatt

SEQ ID NO: 93140 - DNA, 22 bp, Artificial Sequence
  Synthetic oligonucleotide; CTC chr11 5278619 5278640 5278636 5278641 +
cccggttcaagcgattctcctg

SEQ ID NO: 93141 - DNA, 22 bp, Artificial Sequence
  Synthetic oligonucleotide; TTC chr11 5278627 5278648 5278644 5278649 +
aagcgattctcctgcctcagcc

SEQ ID NO: 93142 - DNA, 22 bp, Artificial Sequence
  Synthetic oligonucleotide; TTC chr11 5278636 5278657 5278653 5278658 +
tcctgcctcagcctcccaagta

SEQ ID NO: 93143 - DNA, 22 bp, Artificial Sequence
  Synthetic oligonucleotide; CTC chr11 5278638 5278659 5278655 5278660 +
ctgcctcagcctcccaagtagt

SEQ ID NO: 93144 - DNA, 22 bp, Artificial Sequence
  Synthetic oligonucleotide; CTG chr11 5278641 5278662 5278658 5278663 +
cctcagcctcccaagtagttgg

SEQ ID NO: 93145 - DNA, 22 bp, Artificial Sequence
  Synthetic oligonucleotide; CTC chr11 5278645 5278666 5278662 5278667 +
agcctcccaagtagttggatta

SEQ ID NO: 93146 - DNA, 22 bp, Artificial Sequence
  Synthetic oligonucleotide; CTC chr11 5278651 5278672 5278668 5278673 +
ccaagtagttggattacaggct

SEQ ID NO: 93147 - DNA, 22 bp, Artificial Sequence
  Synthetic oligonucleotide; TTG chr11 5278662 5278683 5278679 5278684 +
gattacaggctcccgtcaccac

SEQ ID NO: 93148 - DNA, 22 bp, Artificial Sequence
  Synthetic oligonucleotide; TTA chr11 5278667 5278688 5278684 5278689 +
caggctcccgtcaccacgtcca

SEQ ID NO: 93149 - DNA, 22 bp, Artificial Sequence
  Synthetic oligonucleotide; CTC chr11 5278674 5278695 5278691 5278696 +
ccgtcaccacgtccagctaatt

SEQ ID NO: 93150 - DNA, 22 bp, Artificial Sequence
  Synthetic oligonucleotide; CTA chr11 5278693 5278714 5278710 5278715 +
atttttatatttttaagcagag

SEQ ID NO: 93151 - DNA, 22 bp, Artificial Sequence
  Synthetic oligonucleotide; TTT chr11 5278697 5278718 5278714 5278719 +
ttatatttttaagcagagacca

SEQ ID NO: 93152 - DNA, 22 bp, Artificial Sequence
  Synthetic oligonucleotide; TTT chr11 5278698 5278719 5278715 5278720 +
tatatttttaagcagagaccag

SEQ ID NO: 93153 - DNA, 22 bp, Artificial Sequence
  Synthetic oligonucleotide; TTT chr11 5278699 5278720 5278716 5278721 +
atatttttaagcagagaccagg

SEQ ID NO: 93154 - DNA, 22 bp, Artificial Sequence
  Synthetic oligonucleotide; TTA chr11 5278700 5278721 5278717 5278722 +
tatttttaagcagagaccaggt

SEQ ID NO: 93155 - DNA, 22 bp, Artificial Sequence
  Synthetic oligonucleotide; TTT chr11 5278705 5278726 5278722 5278727 +
ttaagcagagaccaggtttcac

SEQ ID NO: 93156 - DNA, 22 bp, Artificial Sequence
  Synthetic oligonucleotide; TTT chr11 5278706 5278727 5278723 5278728 +
taagcagagaccaggtttcact

SEQ ID NO: 93157 - DNA, 22 bp, Artificial Sequence
  Synthetic oligonucleotide; TTT chr11 5278707 5278728 5278724 5278729 +
aagcagagaccaggtttcacta

SEQ ID NO: 93158 - DNA, 22 bp, Artificial Sequence
  Synthetic oligonucleotide; TTA chr11 5278708 5278729 5278725 5278730 +
agcagagaccaggtttcactat

SEQ ID NO: 93159 - DNA, 22 bp, Artificial Sequence
  Synthetic oligonucleotide; TTT chr11 5278724 5278745 5278741 5278746 +
cactatgttggctgggctggtg

SEQ ID NO: 93160 - DNA, 22 bp, Artificial Sequence
  Synthetic oligonucleotide; TTC chr11 5278725 5278746 5278742 5278747 +
actatgttggctgggctggtgt

SEQ ID NO: 93161 - DNA, 22 bp, Artificial Sequence
  Synthetic oligonucleotide; CTA chr11 5278729 5278750 5278746 5278751 +
tgttggctgggctggtgtccaa

SEQ ID NO: 93162 - DNA, 22 bp, Artificial Sequence
  Synthetic oligonucleotide; TTG chr11 5278734 5278755 5278751 5278756 +
gctgggctggtgtccaactcct

SEQ ID NO: 93163 - DNA, 22 bp, Artificial Sequence
  Synthetic oligonucleotide; CTG chr11 5278738 5278759 5278755 5278760 +
ggctggtgtccaactcctgacc

SEQ ID NO: 93164 - DNA, 22 bp, Artificial Sequence
  Synthetic oligonucleotide; CTG chr11 5278743 5278764 5278760 5278765 +
gtgtccaactcctgacctcaag

SEQ ID NO: 93165 - DNA, 22 bp, Artificial Sequence
  Synthetic oligonucleotide; CTC chr11 5278754 5278775 5278771 5278776 +
ctgacctcaagtgatctgccca

SEQ ID NO: 93166 - DNA, 22 bp, Artificial Sequence
  Synthetic oligonucleotide; CTG chr11 5278757 5278778 5278774 5278779 +
acctcaagtgatctgcccacct

SEQ ID NO: 93167 - DNA, 22 bp, Artificial Sequence
  Synthetic oligonucleotide; CTC chr11 5278762 5278783 5278779 5278784 +
aagtgatctgcccaccttggcg

SEQ ID NO: 93168 - DNA, 22 bp, Artificial Sequence
  Synthetic oligonucleotide; CTG chr11 5278772 5278793 5278789 5278794 +
cccaccttggcgtcccaaactg

SEQ ID NO: 93169 - DNA, 22 bp, Artificial Sequence
  Synthetic oligonucleotide; CTT chr11 5278780 5278801 5278797 5278802 +
ggcgtcccaaactgctgtgatt

SEQ ID NO: 93170 - DNA, 22 bp, Artificial Sequence
  Synthetic oligonucleotide; TTG chr11 5278781 5278802 5278798 5278803 +
gcgtcccaaactgctgtgatta

SEQ ID NO: 93171 - DNA, 22 bp, Artificial Sequence
  Synthetic oligonucleotide; CTG chr11 5278794 5278815 5278811 5278816 +
ctgtgattacaggagtgagcca

SEQ ID NO: 93172 - DNA, 22 bp, Artificial Sequence
  Synthetic oligonucleotide; CTG chr11 5278797 5278818 5278814 5278819 +
tgattacaggagtgagccaccg

SEQ ID NO: 93173 - DNA, 22 bp, Artificial Sequence
  Synthetic oligonucleotide; TTA chr11 5278803 5278824 5278820 5278825 +
caggagtgagccaccgcacctc

SEQ ID NO: 93174 - DNA, 22 bp, Artificial Sequence
  Synthetic oligonucleotide; CTC chr11 5278825 5278846 5278842 5278847 +
aaggaatttgatgtttaggctg

SEQ ID NO: 93175 - DNA, 22 bp, Artificial Sequence
  Synthetic oligonucleotide; TTT chr11 5278834 5278855 5278851 5278856 +
gatgtttaggctgtgacctctg

SEQ ID NO: 93176 - DNA, 22 bp, Artificial Sequence
  Synthetic oligonucleotide; TTG chr11 5278835 5278856 5278852 5278857 +
atgtttaggctgtgacctctgc

SEQ ID NO: 93177 - DNA, 22 bp, Artificial Sequence
  Synthetic oligonucleotide; TTT chr11 5278841 5278862 5278858 5278863 +
aggctgtgacctctgcactagg

SEQ ID NO: 93178 - DNA, 22 bp, Artificial Sequence
  Synthetic oligonucleotide; TTA chr11 5278842 5278863 5278859 5278864 +
ggctgtgacctctgcactagga

SEQ ID NO: 93179 - DNA, 22 bp, Artificial Sequence
  Synthetic oligonucleotide; CTG chr11 5278847 5278868 5278864 5278869 +
tgacctctgcactaggaatgga

SEQ ID NO: 93180 - DNA, 22 bp, Artificial Sequence
  Synthetic oligonucleotide; CTC chr11 5278854 5278875 5278871 5278876 +
tgcactaggaatggaaggttag

SEQ ID NO: 93181 - DNA, 22 bp, Artificial Sequence
  Synthetic oligonucleotide; CTG chr11 5278856 5278877 5278873 5278878 +
cactaggaatggaaggttagcc

SEQ ID NO: 93182 - DNA, 22 bp, Artificial Sequence
  Synthetic oligonucleotide; CTA chr11 5278861 5278882 5278878 5278883 +
ggaatggaaggttagccactcc

SEQ ID NO: 93183 - DNA, 22 bp, Artificial Sequence
  Synthetic oligonucleotide; TTA chr11 5278875 5278896 5278892 5278897 +
gccactcccaccccacccttcg

SEQ ID NO: 93184 - DNA, 22 bp, Artificial Sequence
  Synthetic oligonucleotide; CTC chr11 5278882 5278903 5278899 5278904 +
ccaccccacccttcgtcctgca

SEQ ID NO: 93185 - DNA, 22 bp, Artificial Sequence
  Synthetic oligonucleotide; CTT chr11 5278895 5278916 5278912 5278917 +
cgtcctgcaagtacccaatcac

SEQ ID NO: 93186 - DNA, 22 bp, Artificial Sequence
  Synthetic oligonucleotide; TTC chr11 5278896 5278917 5278913 5278918 +
gtcctgcaagtacccaatcaca

SEQ ID NO: 93187 - DNA, 22 bp, Artificial Sequence
  Synthetic oligonucleotide; CTG chr11 5278902 5278923 5278919 5278924 +
caagtacccaatcacactgcag

SEQ ID NO: 93188 - DNA, 22 bp, Artificial Sequence
  Synthetic oligonucleotide; CTG chr11 5278921 5278942 5278938 5278943 +
cagagccacacctgccttcctt

SEQ ID NO: 93189 - DNA, 22 bp, Artificial Sequence
  Synthetic oligonucleotide; CTG chr11 5278935 5278956 5278952 5278957 +
ccttccttagaggcgtgcctcc

SEQ ID NO: 93190 - DNA, 22 bp, Artificial Sequence
  Synthetic oligonucleotide; CTT chr11 5278939 5278960 5278956 5278961 +
ccttagaggcgtgcctccatcc

SEQ ID NO: 93191 - DNA, 22 bp, Artificial Sequence
  Synthetic oligonucleotide; TTC chr11 5278940 5278961 5278957 5278962 +
cttagaggcgtgcctccatccc

SEQ ID NO: 93192 - DNA, 22 bp, Artificial Sequence
  Synthetic oligonucleotide; CTT chr11 5278943 5278964 5278960 5278965 +
agaggcgtgcctccatccctga

SEQ ID NO: 93193 - DNA, 22 bp, Artificial Sequence
  Synthetic oligonucleotide; TTA chr11 5278944 5278965 5278961 5278966 +
gaggcgtgcctccatccctgat

SEQ ID NO: 93194 - DNA, 22 bp, Artificial Sequence
  Synthetic oligonucleotide; CTC chr11 5278956 5278977 5278973 5278978 +
catccctgatgagtttttcctc

SEQ ID NO: 93195 - DNA, 22 bp, Artificial Sequence
  Synthetic oligonucleotide; CTG chr11 5278964 5278985 5278981 5278986 +
atgagtttttcctccatgtgta

SEQ ID NO: 93196 - DNA, 22 bp, Artificial Sequence
  Synthetic oligonucleotide; TTT chr11 5278972 5278993 5278989 5278994 +
ttcctccatgtgtagaattgaa

SEQ ID NO: 93197 - DNA, 22 bp, Artificial Sequence
  Synthetic oligonucleotide; TTT chr11 5278973 5278994 5278990 5278995 +
tcctccatgtgtagaattgaat

SEQ ID NO: 93198 - DNA, 22 bp, Artificial Sequence
  Synthetic oligonucleotide; TTT chr11 5278974 5278995 5278991 5278996 +
cctccatgtgtagaattgaata

SEQ ID NO: 93199 - DNA, 22 bp, Artificial Sequence
  Synthetic oligonucleotide; TTC chr11 5278975 5278996 5278992 5278997 +
ctccatgtgtagaattgaataa

SEQ ID NO: 93200 - DNA, 22 bp, Artificial Sequence
  Synthetic oligonucleotide; CTC chr11 5278978 5278999 5278995 5279000 +
catgtgtagaattgaataagaa

SEQ ID NO: 93201 - DNA, 22 bp, Artificial Sequence
  Synthetic oligonucleotide; TTG chr11 5278992 5279013 5279009 5279014 +
aataagaaggatagaattcaat

SEQ ID NO: 93202 - DNA, 22 bp, Artificial Sequence
  Synthetic oligonucleotide; TTC chr11 5279011 5279032 5279028 5279033 +
aatttaacaagctttgagtact

SEQ ID NO: 93203 - DNA, 22 bp, Artificial Sequence
  Synthetic oligonucleotide; TTT chr11 5279016 5279037 5279033 5279038 +
aacaagctttgagtacttccta

SEQ ID NO: 93204 - DNA, 22 bp, Artificial Sequence
  Synthetic oligonucleotide; TTA chr11 5279017 5279038 5279034 5279039 +
acaagctttgagtacttcctat

SEQ ID NO: 93205 - DNA, 22 bp, Artificial Sequence
  Synthetic oligonucleotide; CTT chr11 5279025 5279046 5279042 5279047 +
tgagtacttcctatagcctagg

SEQ ID NO: 93206 - DNA, 22 bp, Artificial Sequence
  Synthetic oligonucleotide; TTT chr11 5279026 5279047 5279043 5279048 +
gagtacttcctatagcctaggc

SEQ ID NO: 93207 - DNA, 22 bp, Artificial Sequence
  Synthetic oligonucleotide; TTG chr11 5279027 5279048 5279044 5279049 +
agtacttcctatagcctaggca

SEQ ID NO: 93208 - DNA, 22 bp, Artificial Sequence
  Synthetic oligonucleotide; CTT chr11 5279034 5279055 5279051 5279056 +
cctatagcctaggcattgtgct

SEQ ID NO: 93209 - DNA, 22 bp, Artificial Sequence
  Synthetic oligonucleotide; TTC chr11 5279035 5279056 5279052 5279057 +
ctatagcctaggcattgtgctg

SEQ ID NO: 93210 - DNA, 22 bp, Artificial Sequence
  Synthetic oligonucleotide; CTA chr11 5279038 5279059 5279055 5279060 +
tagcctaggcattgtgctgaca

SEQ ID NO: 93211 - DNA, 22 bp, Artificial Sequence
  Synthetic oligonucleotide; CTA chr11 5279045 5279066 5279062 5279067 +
ggcattgtgctgacaactatgt

SEQ ID NO: 93212 - DNA, 22 bp, Artificial Sequence
  Synthetic oligonucleotide; TTG chr11 5279052 5279073 5279069 5279074 +
tgctgacaactatgttagagag

SEQ ID NO: 93213 - DNA, 22 bp, Artificial Sequence
  Synthetic oligonucleotide; CTG chr11 5279057 5279078 5279074 5279079 +
acaactatgttagagagagaaa

SEQ ID NO: 93214 - DNA, 22 bp, Artificial Sequence
  Synthetic oligonucleotide; CTA chr11 5279064 5279085 5279081 5279086 +
tgttagagagagaaatagacaa

SEQ ID NO: 93215 - DNA, 22 bp, Artificial Sequence
  Synthetic oligonucleotide; TTA chr11 5279069 5279090 5279086 5279091 +
gagagagaaatagacaagctat

SEQ ID NO: 93216 - DNA, 22 bp, Artificial Sequence
  Synthetic oligonucleotide; CTA chr11 5279090 5279111 5279107 5279112 +
taaacttttcctcaggaccatc

SEQ ID NO: 93217 - DNA, 22 bp, Artificial Sequence
  Synthetic oligonucleotide; CTT chr11 5279097 5279118 5279114 5279119 +
ttcctcaggaccatctacataa

SEQ ID NO: 93218 - DNA, 22 bp, Artificial Sequence
  Synthetic oligonucleotide; TTT chr11 5279098 5279119 5279115 5279120 +
tcctcaggaccatctacataat

SEQ ID NO: 93219 - DNA, 22 bp, Artificial Sequence
  Synthetic oligonucleotide; TTT chr11 5279099 5279120 5279116 5279121 +
cctcaggaccatctacataatt

SEQ ID NO: 93220 - DNA, 22 bp, Artificial Sequence
  Synthetic oligonucleotide; TTC chr11 5279100 5279121 5279117 5279122 +
ctcaggaccatctacataattt

SEQ ID NO: 93221 - DNA, 22 bp, Artificial Sequence
  Synthetic oligonucleotide; CTC chr11 5279103 5279124 5279120 5279125 +
aggaccatctacataatttcta

SEQ ID NO: 93222 - DNA, 22 bp, Artificial Sequence
  Synthetic oligonucleotide; CTA chr11 5279114 5279135 5279131 5279136 +
cataatttctaggcccaatata

SEQ ID NO: 93223 - DNA, 22 bp, Artificial Sequence
  Synthetic oligonucleotide; TTT chr11 5279122 5279143 5279139 5279144 +
ctaggcccaatataaaatgaaa

SEQ ID NO: 93224 - DNA, 22 bp, Artificial Sequence
  Synthetic oligonucleotide; TTC chr11 5279123 5279144 5279140 5279145 +
taggcccaatataaaatgaaaa

SEQ ID NO: 93225 - DNA, 22 bp, Artificial Sequence
  Synthetic oligonucleotide; CTA chr11 5279125 5279146 5279142 5279147 +
ggcccaatataaaatgaaaatg

SEQ ID NO: 93226 - DNA, 22 bp, Artificial Sequence
  Synthetic oligonucleotide; CTT chr11 5279158 5279179 5279175 5279180 +
tgtcaaaaattaaggatttcat

SEQ ID NO: 93227 - DNA, 22 bp, Artificial Sequence
  Synthetic oligonucleotide; TTT chr11 5279159 5279180 5279176 5279181 +
gtcaaaaattaaggatttcatg

SEQ ID NO: 93228 - DNA, 22 bp, Artificial Sequence
  Synthetic oligonucleotide; TTG chr11 5279160 5279181 5279177 5279182 +
tcaaaaattaaggatttcatgt

SEQ ID NO: 93229 - DNA, 22 bp, Artificial Sequence
  Synthetic oligonucleotide; TTA chr11 5279170 5279191 5279187 5279192 +
aggatttcatgtcaggaacagc

SEQ ID NO: 93230 - DNA, 22 bp, Artificial Sequence
  Synthetic oligonucleotide; TTT chr11 5279177 5279198 5279194 5279199 +
catgtcaggaacagcaaggatg

SEQ ID NO: 93231 - DNA, 22 bp, Artificial Sequence
  Synthetic oligonucleotide; TTC chr11 5279178 5279199 5279195 5279200 +
atgtcaggaacagcaaggatgt

SEQ ID NO: 93232 - DNA, 22 bp, Artificial Sequence
  Synthetic oligonucleotide; TTA chr11 5279202 5279223 5279219 5279224 +
aaccaagcatggggccatcaag

SEQ ID NO: 93233 - DNA, 22 bp, Artificial Sequence
  Synthetic oligonucleotide; CTA chr11 5279227 5279248 5279244 5279249 +
tatctgctattcatgatacgaa

SEQ ID NO: 93234 - DNA, 22 bp, Artificial Sequence
  Synthetic oligonucleotide; CTG chr11 5279233 5279254 5279250 5279255 +
ctattcatgatacgaaaaaata

SEQ ID NO: 93235 - DNA, 22 bp, Artificial Sequence
  Synthetic oligonucleotide; CTA chr11 5279236 5279257 5279253 5279258 +
ttcatgatacgaaaaaataaag

SEQ ID NO: 93236 - DNA, 22 bp, Artificial Sequence
  Synthetic oligonucleotide; TTC chr11 5279239 5279260 5279256 5279261 +
atgatacgaaaaaataaagagt

SEQ ID NO: 93237 - DNA, 22 bp, Artificial Sequence
  Synthetic oligonucleotide; TTC chr11 5279265 5279286 5279282 5279287 +
tagttatttagccacatatttc

SEQ ID NO: 93238 - DNA, 22 bp, Artificial Sequence
  Synthetic oligonucleotide; CTA chr11 5279267 5279288 5279284 5279289 +
gttatttagccacatatttcaa

SEQ ID NO: 93239 - DNA, 22 bp, Artificial Sequence
  Synthetic oligonucleotide; TTA chr11 5279271 5279292 5279288 5279293 +
tttagccacatatttcaagttt

SEQ ID NO: 93240 - DNA, 22 bp, Artificial Sequence
  Synthetic oligonucleotide; TTT chr11 5279274 5279295 5279291 5279296 +
agccacatatttcaagtttagt

SEQ ID NO: 93241 - DNA, 22 bp, Artificial Sequence
  Synthetic oligonucleotide; TTA chr11 5279275 5279296 5279292 5279297 +
gccacatatttcaagtttagtc

SEQ ID NO: 93242 - DNA, 22 bp, Artificial Sequence
  Synthetic oligonucleotide; TTT chr11 5279286 5279307 5279303 5279308 +
caagtttagtctgatatcaccc

SEQ ID NO: 93243 - DNA, 22 bp, Artificial Sequence
  Synthetic oligonucleotide; TTC chr11 5279287 5279308 5279304 5279309 +
aagtttagtctgatatcaccct

SEQ ID NO: 93244 - DNA, 22 bp, Artificial Sequence
  Synthetic oligonucleotide; TTT chr11 5279293 5279314 5279310 5279315 +
agtctgatatcaccctttaaac

SEQ ID NO: 93245 - DNA, 22 bp, Artificial Sequence
  Synthetic oligonucleotide; TTA chr11 5279294 5279315 5279311 5279316 +
gtctgatatcaccctttaaaca

SEQ ID NO: 93246 - DNA, 22 bp, Artificial Sequence
  Synthetic oligonucleotide; CTG chr11 5279299 5279320 5279316 5279321 +
atatcaccctttaaacactgcc

SEQ ID NO: 93247 - DNA, 22 bp, Artificial Sequence
  Synthetic oligonucleotide; CTT chr11 5279310 5279331 5279327 5279332 +
taaacactgccactcaacctaa

SEQ ID NO: 93248 - DNA, 22 bp, Artificial Sequence
  Synthetic oligonucleotide; TTT chr11 5279311 5279332 5279328 5279333 +
aaacactgccactcaacctaaa

SEQ ID NO: 93249 - DNA, 22 bp, Artificial Sequence
  Synthetic oligonucleotide; TTA chr11 5279312 5279333 5279329 5279334 +
aacactgccactcaacctaaaa

SEQ ID NO: 93250 - DNA, 22 bp, Artificial Sequence
  Synthetic oligonucleotide; CTG chr11 5279319 5279340 5279336 5279341 +
ccactcaacctaaaacaatgct

SEQ ID NO: 93251 - DNA, 22 bp, Artificial Sequence
  Synthetic oligonucleotide; CTC chr11 5279325 5279346 5279342 5279347 +
aacctaaaacaatgctagtctt

SEQ ID NO: 93252 - DNA, 22 bp, Artificial Sequence
  Synthetic oligonucleotide; CTA chr11 5279331 5279352 5279348 5279353 +
aaacaatgctagtctttctaga

SEQ ID NO: 93253 - DNA, 22 bp, Artificial Sequence
  Synthetic oligonucleotide; CTA chr11 5279342 5279363 5279359 5279364 +
gtctttctagacccatccatgg

SEQ ID NO: 93254 - DNA, 22 bp, Artificial Sequence
  Synthetic oligonucleotide; CTT chr11 5279347 5279368 5279364 5279369 +
tctagacccatccatggaattt

SEQ ID NO: 93255 - DNA, 22 bp, Artificial Sequence
  Synthetic oligonucleotide; TTT chr11 5279348 5279369 5279365 5279370 +
ctagacccatccatggaatttt

SEQ ID NO: 93256 - DNA, 22 bp, Artificial Sequence
  Synthetic oligonucleotide; TTC chr11 5279349 5279370 5279366 5279371 +
tagacccatccatggaattttt

SEQ ID NO: 93257 - DNA, 22 bp, Artificial Sequence
  Synthetic oligonucleotide; CTA chr11 5279351 5279372 5279368 5279373 +
gacccatccatggaattttttc

SEQ ID NO: 93258 - DNA, 22 bp, Artificial Sequence
  Synthetic oligonucleotide; TTT chr11 5279369 5279390 5279386 5279391 +
tttccccactgttttttttcta

SEQ ID NO: 93259 - DNA, 22 bp, Artificial Sequence
  Synthetic oligonucleotide; TTT chr11 5279370 5279391 5279387 5279392 +
ttccccactgttttttttctaa

SEQ ID NO: 93260 - DNA, 22 bp, Artificial Sequence
  Synthetic oligonucleotide; TTT chr11 5279371 5279392 5279388 5279393 +
tccccactgttttttttctaat

SEQ ID NO: 93261 - DNA, 22 bp, Artificial Sequence
  Synthetic oligonucleotide; TTT chr11 5279372 5279393 5279389 5279394 +
ccccactgttttttttctaatt

SEQ ID NO: 93262 - DNA, 22 bp, Artificial Sequence
  Synthetic oligonucleotide; TTC chr11 5279373 5279394 5279390 5279395 +
cccactgttttttttctaatta

SEQ ID NO: 93263 - DNA, 22 bp, Artificial Sequence
  Synthetic oligonucleotide; CTG chr11 5279380 5279401 5279397 5279402 +
ttttttttctaattaatttgtg

SEQ ID NO: 93264 - DNA, 22 bp, Artificial Sequence
  Synthetic oligonucleotide; TTT chr11 5279383 5279404 5279400 5279405 +
tttttctaattaatttgtgatt

SEQ ID NO: 93265 - DNA, 22 bp, Artificial Sequence
  Synthetic oligonucleotide; TTT chr11 5279384 5279405 5279401 5279406 +
ttttctaattaatttgtgattt

SEQ ID NO: 93266 - DNA, 22 bp, Artificial Sequence
  Synthetic oligonucleotide; TTT chr11 5279385 5279406 5279402 5279407 +
tttctaattaatttgtgattta

SEQ ID NO: 93267 - DNA, 22 bp, Artificial Sequence
  Synthetic oligonucleotide; TTT chr11 5279386 5279407 5279403 5279408 +
ttctaattaatttgtgatttaa

SEQ ID NO: 93268 - DNA, 22 bp, Artificial Sequence
  Synthetic oligonucleotide; TTT chr11 5279387 5279408 5279404 5279409 +
tctaattaatttgtgatttaaa

SEQ ID NO: 93269 - DNA, 22 bp, Artificial Sequence
  Synthetic oligonucleotide; TTT chr11 5279388 5279409 5279405 5279410 +
ctaattaatttgtgatttaaat

SEQ ID NO: 93270 - DNA, 22 bp, Artificial Sequence
  Synthetic oligonucleotide; TTC chr11 5279389 5279410 5279406 5279411 +
taattaatttgtgatttaaatg

SEQ ID NO: 93271 - DNA, 22 bp, Artificial Sequence
  Synthetic oligonucleotide; CTA chr11 5279391 5279412 5279408 5279413 +
attaatttgtgatttaaatggc

SEQ ID NO: 93272 - DNA, 22 bp, Artificial Sequence
  Synthetic oligonucleotide; TTA chr11 5279395 5279416 5279412 5279417 +
atttgtgatttaaatggctcat

SEQ ID NO: 93273 - DNA, 22 bp, Artificial Sequence
  Synthetic oligonucleotide; TTT chr11 5279399 5279420 5279416 5279421 +
gtgatttaaatggctcatattc

SEQ ID NO: 93274 - DNA, 22 bp, Artificial Sequence
  Synthetic oligonucleotide; TTG chr11 5279400 5279421 5279417 5279422 +
tgatttaaatggctcatattcc

SEQ ID NO: 93275 - DNA, 22 bp, Artificial Sequence
  Synthetic oligonucleotide; TTT chr11 5279406 5279427 5279423 5279428 +
aaatggctcatattccagcctg

SEQ ID NO: 93276 - DNA, 22 bp, Artificial Sequence
  Synthetic oligonucleotide; TTA chr11 5279407 5279428 5279424 5279429 +
aatggctcatattccagcctgt

SEQ ID NO: 93277 - DNA, 22 bp, Artificial Sequence
  Synthetic oligonucleotide; CTC chr11 5279415 5279436 5279432 5279437 +
atattccagcctgtgccacagt

SEQ ID NO: 93278 - DNA, 22 bp, Artificial Sequence
  Synthetic oligonucleotide; TTC chr11 5279421 5279442 5279438 5279443 +
cagcctgtgccacagttattac

SEQ ID NO: 93279 - DNA, 22 bp, Artificial Sequence
  Synthetic oligonucleotide; CTG chr11 5279428 5279449 5279445 5279450 +
tgccacagttattacacattta

SEQ ID NO: 93280 - DNA, 22 bp, Artificial Sequence
  Synthetic oligonucleotide; TTA chr11 5279439 5279460 5279456 5279461 +
ttacacatttaactcactctct

SEQ ID NO: 93281 - DNA, 22 bp, Artificial Sequence
  Synthetic oligonucleotide; TTA chr11 5279442 5279463 5279459 5279464 +
cacatttaactcactctctgta

SEQ ID NO: 93282 - DNA, 22 bp, Artificial Sequence
  Synthetic oligonucleotide; TTT chr11 5279449 5279470 5279466 5279471 +
aactcactctctgtattttgtt

SEQ ID NO: 93283 - DNA, 22 bp, Artificial Sequence
  Synthetic oligonucleotide; TTA chr11 5279450 5279471 5279467 5279472 +
actcactctctgtattttgtta

SEQ ID NO: 93284 - DNA, 22 bp, Artificial Sequence
  Synthetic oligonucleotide; CTC chr11 5279454 5279475 5279471 5279476 +
actctctgtattttgttatctg

SEQ ID NO: 93285 - DNA, 22 bp, Artificial Sequence
  Synthetic oligonucleotide; CTC chr11 5279458 5279479 5279475 5279480 +
tctgtattttgttatctgtata

SEQ ID NO: 93286 - DNA, 22 bp, Artificial Sequence
  Synthetic oligonucleotide; CTC chr11 5279460 5279481 5279477 5279482 +
tgtattttgttatctgtataaa

SEQ ID NO: 93287 - DNA, 22 bp, Artificial Sequence
  Synthetic oligonucleotide; CTG chr11 5279462 5279483 5279479 5279484 +
tattttgttatctgtataaata

SEQ ID NO: 93288 - DNA, 22 bp, Artificial Sequence
  Synthetic oligonucleotide; TTT chr11 5279467 5279488 5279484 5279489 +
tgttatctgtataaatactctt

SEQ ID NO: 93289 - DNA, 22 bp, Artificial Sequence
  Synthetic oligonucleotide; TTT chr11 5279468 5279489 5279485 5279490 +
gttatctgtataaatactcttc

SEQ ID NO: 93290 - DNA, 22 bp, Artificial Sequence
  Synthetic oligonucleotide; TTG chr11 5279469 5279490 5279486 5279491 +
ttatctgtataaatactcttca

SEQ ID NO: 93291 - DNA, 22 bp, Artificial Sequence
  Synthetic oligonucleotide; TTA chr11 5279472 5279493 5279489 5279494 +
tctgtataaatactcttcaggt

SEQ ID NO: 93292 - DNA, 22 bp, Artificial Sequence
  Synthetic oligonucleotide; CTG chr11 5279476 5279497 5279493 5279498 +
tataaatactcttcaggttgat

SEQ ID NO: 93293 - DNA, 22 bp, Artificial Sequence
  Synthetic oligonucleotide; CTC chr11 5279487 5279508 5279504 5279509 +
ttcaggttgatttcctttctta

SEQ ID NO: 93294 - DNA, 22 bp, Artificial Sequence
  Synthetic oligonucleotide; CTT chr11 5279489 5279510 5279506 5279511 +
caggttgatttcctttcttaat

SEQ ID NO: 93295 - DNA, 22 bp, Artificial Sequence
  Synthetic oligonucleotide; TTC chr11 5279490 5279511 5279507 5279512 +
aggttgatttcctttcttaatg

SEQ ID NO: 93296 - DNA, 22 bp, Artificial Sequence
  Synthetic oligonucleotide; TTG chr11 5279496 5279517 5279513 5279518 +
atttcctttcttaatgtttgtg

SEQ ID NO: 93297 - DNA, 22 bp, Artificial Sequence
  Synthetic oligonucleotide; TTT chr11 5279500 5279521 5279517 5279522 +
cctttcttaatgtttgtgttta

SEQ ID NO: 93298 - DNA, 22 bp, Artificial Sequence
  Synthetic oligonucleotide; TTC chr11 5279501 5279522 5279518 5279523 +
ctttcttaatgtttgtgtttat

SEQ ID NO: 93299 - DNA, 22 bp, Artificial Sequence
  Synthetic oligonucleotide; CTT chr11 5279504 5279525 5279521 5279526 +
tcttaatgtttgtgtttatgtt

SEQ ID NO: 93300 - DNA, 22 bp, Artificial Sequence
  Synthetic oligonucleotide; TTT chr11 5279505 5279526 5279522 5279527 +
cttaatgtttgtgtttatgtta

SEQ ID NO: 93301 - DNA, 22 bp, Artificial Sequence
  Synthetic oligonucleotide; TTC chr11 5279506 5279527 5279523 5279528 +
ttaatgtttgtgtttatgttag

SEQ ID NO: 93302 - DNA, 22 bp, Artificial Sequence
  Synthetic oligonucleotide; CTT chr11 5279508 5279529 5279525 5279530 +
aatgtttgtgtttatgttagat

SEQ ID NO: 93303 - DNA, 22 bp, Artificial Sequence
  Synthetic oligonucleotide; TTA chr11 5279509 5279530 5279526 5279531 +
atgtttgtgtttatgttagata

SEQ ID NO: 93304 - DNA, 22 bp, Artificial Sequence
  Synthetic oligonucleotide; TTT chr11 5279515 5279536 5279532 5279537 +
gtgtttatgttagatatgcatc

SEQ ID NO: 93305 - DNA, 22 bp, Artificial Sequence
  Synthetic oligonucleotide; TTG chr11 5279516 5279537 5279533 5279538 +
tgtttatgttagatatgcatca

SEQ ID NO: 93306 - DNA, 22 bp, Artificial Sequence
  Synthetic oligonucleotide; TTT chr11 5279521 5279542 5279538 5279543 +
atgttagatatgcatcatgtag

SEQ ID NO: 93307 - DNA, 22 bp, Artificial Sequence
  Synthetic oligonucleotide; TTA chr11 5279522 5279543 5279539 5279544 +
tgttagatatgcatcatgtagc

SEQ ID NO: 93308 - DNA, 22 bp, Artificial Sequence
  Synthetic oligonucleotide; TTA chr11 5279527 5279548 5279544 5279549 +
gatatgcatcatgtagcctgtc

SEQ ID NO: 93309 - DNA, 22 bp, Artificial Sequence
  Synthetic oligonucleotide; CTG chr11 5279547 5279568 5279564 5279569 +
tcttcatttctatcacaaacat

SEQ ID NO: 93310 - DNA, 22 bp, Artificial Sequence
  Synthetic oligonucleotide; CTT chr11 5279551 5279572 5279568 5279573 +
catttctatcacaaacatacac

SEQ ID NO: 93311 - DNA, 22 bp, Artificial Sequence
  Synthetic oligonucleotide; TTC chr11 5279552 5279573 5279569 5279574 +
atttctatcacaaacatacact

SEQ ID NO: 93312 - DNA, 22 bp, Artificial Sequence
  Synthetic oligonucleotide; TTT chr11 5279556 5279577 5279573 5279578 +
ctatcacaaacatacacttgaa

SEQ ID NO: 93313 - DNA, 22 bp, Artificial Sequence
  Synthetic oligonucleotide; TTC chr11 5279557 5279578 5279574 5279579 +
tatcacaaacatacacttgaac

SEQ ID NO: 93314 - DNA, 22 bp, Artificial Sequence
  Synthetic oligonucleotide; CTA chr11 5279559 5279580 5279576 5279581 +
tcacaaacatacacttgaacca

SEQ ID NO: 93315 - DNA, 22 bp, Artificial Sequence
  Synthetic oligonucleotide; CTT chr11 5279575 5279596 5279592 5279597 +
gaaccaaaaaggaagtttttac

SEQ ID NO: 93316 - DNA, 22 bp, Artificial Sequence
  Synthetic oligonucleotide; TTG chr11 5279576 5279597 5279593 5279598 +
aaccaaaaaggaagtttttaca

SEQ ID NO: 93317 - DNA, 22 bp, Artificial Sequence
  Synthetic oligonucleotide; TTT chr11 5279593 5279614 5279610 5279615 +
ttacatagcatcactaaatctt

SEQ ID NO: 93318 - DNA, 22 bp, Artificial Sequence
  Synthetic oligonucleotide; TTT chr11 5279594 5279615 5279611 5279616 +
tacatagcatcactaaatcttc

SEQ ID NO: 93319 - DNA, 22 bp, Artificial Sequence
  Synthetic oligonucleotide; TTT chr11 5279595 5279616 5279612 5279617 +
acatagcatcactaaatcttct

SEQ ID NO: 93320 - DNA, 22 bp, Artificial Sequence
  Synthetic oligonucleotide; TTA chr11 5279596 5279617 5279613 5279618 +
catagcatcactaaatcttctc

SEQ ID NO: 93321 - DNA, 22 bp, Artificial Sequence
  Synthetic oligonucleotide; CTA chr11 5279609 5279630 5279626 5279631 +
aatcttctctctgtgctcttag

SEQ ID NO: 93322 - DNA, 22 bp, Artificial Sequence
  Synthetic oligonucleotide; CTT chr11 5279615 5279636 5279632 5279637 +
ctctctgtgctcttagcgaaac

SEQ ID NO: 93323 - DNA, 22 bp, Artificial Sequence
  Synthetic oligonucleotide; TTC chr11 5279616 5279637 5279633 5279638 +
tctctgtgctcttagcgaaacc

SEQ ID NO: 93324 - DNA, 22 bp, Artificial Sequence
  Synthetic oligonucleotide; CTC chr11 5279618 5279639 5279635 5279640 +
tctgtgctcttagcgaaaccaa

SEQ ID NO: 93325 - DNA, 22 bp, Artificial Sequence
  Synthetic oligonucleotide; CTC chr11 5279620 5279641 5279637 5279642 +
tgtgctcttagcgaaaccaagt

SEQ ID NO: 93326 - DNA, 22 bp, Artificial Sequence
  Synthetic oligonucleotide; CTG chr11 5279622 5279643 5279639 5279644 +
tgctcttagcgaaaccaagtag

SEQ ID NO: 93327 - DNA, 22 bp, Artificial Sequence
  Synthetic oligonucleotide; CTC chr11 5279627 5279648 5279644 5279649 +
ttagcgaaaccaagtaggctga

SEQ ID NO: 93328 - DNA, 22 bp, Artificial Sequence
  Synthetic oligonucleotide; CTT chr11 5279629 5279650 5279646 5279651 +
agcgaaaccaagtaggctgaca

SEQ ID NO: 93329 - DNA, 22 bp, Artificial Sequence
  Synthetic oligonucleotide; TTA chr11 5279630 5279651 5279647 5279652 +
gcgaaaccaagtaggctgacaa

SEQ ID NO: 93330 - DNA, 22 bp, Artificial Sequence
  Synthetic oligonucleotide; CTG chr11 5279648 5279669 5279665 5279670 +
acaagacatcattcattcacag

SEQ ID NO: 93331 - DNA, 22 bp, Artificial Sequence
  Synthetic oligonucleotide; TTC chr11 5279662 5279683 5279679 5279684 +
attcacagcgaaaccgagtaga

SEQ ID NO: 93332 - DNA, 22 bp, Artificial Sequence
  Synthetic oligonucleotide; TTC chr11 5279666 5279687 5279683 5279688 +
acagcgaaaccgagtagactga

SEQ ID NO: 93333 - DNA, 22 bp, Artificial Sequence
  Synthetic oligonucleotide; CTG chr11 5279687 5279708 5279704 5279709 +
acaagaggtcattcattcacaa

SEQ ID NO: 93334 - DNA, 22 bp, Artificial Sequence
  Synthetic oligonucleotide; TTC chr11 5279701 5279722 5279718 5279723 +
attcacaaatgaatacaaaaaa

SEQ ID NO: 93335 - DNA, 22 bp, Artificial Sequence
  Synthetic oligonucleotide; TTC chr11 5279705 5279726 5279722 5279727 +
acaaatgaatacaaaaaacagt

SEQ ID NO: 93336 - DNA, 22 bp, Artificial Sequence
  Synthetic oligonucleotide; CTG chr11 5279749 5279770 5279766 5279771 +
taatgggtcctgggcctgcaaa

SEQ ID NO: 93337 - DNA, 22 bp, Artificial Sequence
  Synthetic oligonucleotide; CTG chr11 5279761 5279782 5279778 5279783 +
ggcctgcaaaaccctcacagct

SEQ ID NO: 93338 - DNA, 22 bp, Artificial Sequence
  Synthetic oligonucleotide; CTG chr11 5279767 5279788 5279784 5279789 +
caaaaccctcacagctgctaac

SEQ ID NO: 93339 - DNA, 22 bp, Artificial Sequence
  Synthetic oligonucleotide; CTC chr11 5279777 5279798 5279794 5279799 +
acagctgctaacctcaagaagc

SEQ ID NO: 93340 - DNA, 22 bp, Artificial Sequence
  Synthetic oligonucleotide; CTG chr11 5279784 5279805 5279801 5279806 +
ctaacctcaagaagctcagtgg

SEQ ID NO: 93341 - DNA, 22 bp, Artificial Sequence
  Synthetic oligonucleotide; CTA chr11 5279787 5279808 5279804 5279809 +
acctcaagaagctcagtggaga

SEQ ID NO: 93342 - DNA, 22 bp, Artificial Sequence
  Synthetic oligonucleotide; CTC chr11 5279792 5279813 5279809 5279814 +
aagaagctcagtggagacataa

SEQ ID NO: 93343 - DNA, 22 bp, Artificial Sequence
  Synthetic oligonucleotide; CTC chr11 5279801 5279822 5279818 5279823 +
agtggagacataacattcatct

SEQ ID NO: 93344 - DNA, 22 bp, Artificial Sequence
  Synthetic oligonucleotide; TTC chr11 5279819 5279840 5279836 5279841 +
atctgaaaattccttgcatgtc

SEQ ID NO: 93345 - DNA, 22 bp, Artificial Sequence
  Synthetic oligonucleotide; CTG chr11 5279824 5279845 5279841 5279846 +
aaaattccttgcatgtctgttg

SEQ ID NO: 93346 - DNA, 22 bp, Artificial Sequence
  Synthetic oligonucleotide; TTC chr11 5279831 5279852 5279848 5279853 +
cttgcatgtctgttgaactaat

SEQ ID NO: 93347 - DNA, 22 bp, Artificial Sequence
  Synthetic oligonucleotide; CTT chr11 5279834 5279855 5279851 5279856 +
gcatgtctgttgaactaattta

SEQ ID NO: 93348 - DNA, 22 bp, Artificial Sequence
  Synthetic oligonucleotide; TTG chr11 5279835 5279856 5279852 5279857 +
catgtctgttgaactaatttat

SEQ ID NO: 93349 - DNA, 22 bp, Artificial Sequence
  Synthetic oligonucleotide; CTG chr11 5279843 5279864 5279860 5279865 +
ttgaactaatttatctgcctct

SEQ ID NO: 93350 - DNA, 22 bp, Artificial Sequence
  Synthetic oligonucleotide; TTG chr11 5279846 5279867 5279863 5279868 +
aactaatttatctgcctctcct

SEQ ID NO: 93351 - DNA, 22 bp, Artificial Sequence
  Synthetic oligonucleotide; CTA chr11 5279851 5279872 5279868 5279873 +
atttatctgcctctccttaaat

SEQ ID NO: 93352 - DNA, 22 bp, Artificial Sequence
  Synthetic oligonucleotide; TTT chr11 5279855 5279876 5279872 5279877 +
atctgcctctccttaaatttgt

SEQ ID NO: 93353 - DNA, 22 bp, Artificial Sequence
  Synthetic oligonucleotide; TTA chr11 5279856 5279877 5279873 5279878 +
tctgcctctccttaaatttgtt

SEQ ID NO: 93354 - DNA, 22 bp, Artificial Sequence
  Synthetic oligonucleotide; CTG chr11 5279860 5279881 5279877 5279882 +
cctctccttaaatttgttcctt

SEQ ID NO: 93355 - DNA, 22 bp, Artificial Sequence
  Synthetic oligonucleotide; CTC chr11 5279864 5279885 5279881 5279886 +
tccttaaatttgttcctttttg

SEQ ID NO: 93356 - DNA, 22 bp, Artificial Sequence
  Synthetic oligonucleotide; CTC chr11 5279866 5279887 5279883 5279888 +
cttaaatttgttcctttttgta

SEQ ID NO: 93357 - DNA, 22 bp, Artificial Sequence
  Synthetic oligonucleotide; CTT chr11 5279869 5279890 5279886 5279891 +
aaatttgttcctttttgtatag

SEQ ID NO: 93358 - DNA, 22 bp, Artificial Sequence
  Synthetic oligonucleotide; TTA chr11 5279870 5279891 5279887 5279892 +
aatttgttcctttttgtatagt

SEQ ID NO: 93359 - DNA, 22 bp, Artificial Sequence
  Synthetic oligonucleotide; TTT chr11 5279875 5279896 5279892 5279897 +
gttcctttttgtatagttcctt

SEQ ID NO: 93360 - DNA, 22 bp, Artificial Sequence
  Synthetic oligonucleotide; TTG chr11 5279876 5279897 5279893 5279898 +
ttcctttttgtatagttcctta

SEQ ID NO: 93361 - DNA, 22 bp, Artificial Sequence
  Synthetic oligonucleotide; TTC chr11 5279879 5279900 5279896 5279901 +
ctttttgtatagttccttaagt

SEQ ID NO: 93362 - DNA, 22 bp, Artificial Sequence
  Synthetic oligonucleotide; CTT chr11 5279882 5279903 5279899 5279904 +
tttgtatagttccttaagtcat

SEQ ID NO: 93363 - DNA, 22 bp, Artificial Sequence
  Synthetic oligonucleotide; TTT chr11 5279883 5279904 5279900 5279905 +
ttgtatagttccttaagtcatg

SEQ ID NO: 93364 - DNA, 22 bp, Artificial Sequence
  Synthetic oligonucleotide; TTT chr11 5279884 5279905 5279901 5279906 +
tgtatagttccttaagtcatgt

SEQ ID NO: 93365 - DNA, 22 bp, Artificial Sequence
  Synthetic oligonucleotide; TTT chr11 5279885 5279906 5279902 5279907 +
gtatagttccttaagtcatgtc

SEQ ID NO: 93366 - DNA, 22 bp, Artificial Sequence
  Synthetic oligonucleotide; TTG chr11 5279886 5279907 5279903 5279908 +
tatagttccttaagtcatgtca

SEQ ID NO: 93367 - DNA, 22 bp, Artificial Sequence
  Synthetic oligonucleotide; TTC chr11 5279894 5279915 5279911 5279916 +
cttaagtcatgtcacatttctg

SEQ ID NO: 93368 - DNA, 22 bp, Artificial Sequence
  Synthetic oligonucleotide; CTT chr11 5279897 5279918 5279914 5279919 +
aagtcatgtcacatttctgaaa

SEQ ID NO: 93369 - DNA, 22 bp, Artificial Sequence
  Synthetic oligonucleotide; TTA chr11 5279898 5279919 5279915 5279920 +
agtcatgtcacatttctgaaac

SEQ ID NO: 93370 - DNA, 22 bp, Artificial Sequence
  Synthetic oligonucleotide; TTT chr11 5279913 5279934 5279930 5279935 +
ctgaaacatctttgccactgtg

SEQ ID NO: 93371 - DNA, 22 bp, Artificial Sequence
  Synthetic oligonucleotide; TTC chr11 5279914 5279935 5279931 5279936 +
tgaaacatctttgccactgtga

SEQ ID NO: 93372 - DNA, 22 bp, Artificial Sequence
  Synthetic oligonucleotide; CTG chr11 5279916 5279937 5279933 5279938 +
aaacatctttgccactgtgaac

SEQ ID NO: 93373 - DNA, 22 bp, Artificial Sequence
  Synthetic oligonucleotide; CTT chr11 5279925 5279946 5279942 5279947 +
tgccactgtgaactcctacaga

SEQ ID NO: 93374 - DNA, 22 bp, Artificial Sequence
  Synthetic oligonucleotide; TTT chr11 5279926 5279947 5279943 5279948 +
gccactgtgaactcctacagaa

SEQ ID NO: 93375 - DNA, 22 bp, Artificial Sequence
  Synthetic oligonucleotide; TTG chr11 5279927 5279948 5279944 5279949 +
ccactgtgaactcctacagaag

SEQ ID NO: 93376 - DNA, 22 bp, Artificial Sequence
  Synthetic oligonucleotide; CTG chr11 5279933 5279954 5279950 5279955 +
tgaactcctacagaagccagct

SEQ ID NO: 93377 - DNA, 22 bp, Artificial Sequence
  Synthetic oligonucleotide; CTC chr11 5279940 5279961 5279957 5279962 +
ctacagaagccagcttcaaagc

SEQ ID NO: 93378 - DNA, 22 bp, Artificial Sequence
  Synthetic oligonucleotide; CTA chr11 5279943 5279964 5279960 5279965 +
cagaagccagcttcaaagccat

SEQ ID NO: 93379 - DNA, 22 bp, Artificial Sequence
  Synthetic oligonucleotide; CTT chr11 5279956 5279977 5279973 5279978 +
caaagccattcttctggaagcc

SEQ ID NO: 93380 - DNA, 22 bp, Artificial Sequence
  Synthetic oligonucleotide; TTC chr11 5279957 5279978 5279974 5279979 +
aaagccattcttctggaagcct

SEQ ID NO: 93381 - DNA, 22 bp, Artificial Sequence
  Synthetic oligonucleotide; TTC chr11 5279967 5279988 5279984 5279989 +
ttctggaagccttctctatccc

SEQ ID NO: 93382 - DNA, 22 bp, Artificial Sequence
  Synthetic oligonucleotide; CTT chr11 5279969 5279990 5279986 5279991 +
ctggaagccttctctatcccct

SEQ ID NO: 93383 - DNA, 22 bp, Artificial Sequence
  Synthetic oligonucleotide; TTC chr11 5279970 5279991 5279987 5279992 +
tggaagccttctctatcccctt

SEQ ID NO: 93384 - DNA, 22 bp, Artificial Sequence
  Synthetic oligonucleotide; CTG chr11 5279972 5279993 5279989 5279994 +
gaagccttctctatccccttga

SEQ ID NO: 93385 - DNA, 22 bp, Artificial Sequence
  Synthetic oligonucleotide; CTT chr11 5279980 5280001 5279997 5280002 +
ctctatccccttgacctcctgt

SEQ ID NO: 93386 - DNA, 22 bp, Artificial Sequence
  Synthetic oligonucleotide; TTC chr11 5279981 5280002 5279998 5280003 +
tctatccccttgacctcctgtt

SEQ ID NO: 93387 - DNA, 22 bp, Artificial Sequence
  Synthetic oligonucleotide; CTC chr11 5279983 5280004 5280000 5280005 +
tatccccttgacctcctgtttt

SEQ ID NO: 93388 - DNA, 22 bp, Artificial Sequence
  Synthetic oligonucleotide; CTA chr11 5279985 5280006 5280002 5280007 +
tccccttgacctcctgtttttt

SEQ ID NO: 93389 - DNA, 22 bp, Artificial Sequence
  Synthetic oligonucleotide; CTT chr11 5279992 5280013 5280009 5280014 +
gacctcctgttttttctcccac

SEQ ID NO: 93390 - DNA, 22 bp, Artificial Sequence
  Synthetic oligonucleotide; TTG chr11 5279993 5280014 5280010 5280015 +
acctcctgttttttctcccaca

SEQ ID NO: 93391 - DNA, 22 bp, Artificial Sequence
  Synthetic oligonucleotide; CTC chr11 5279998 5280019 5280015 5280020 +
ctgttttttctcccacaagcat

SEQ ID NO: 93392 - DNA, 22 bp, Artificial Sequence
  Synthetic oligonucleotide; CTG chr11 5280001 5280022 5280018 5280023 +
ttttttctcccacaagcattat

SEQ ID NO: 93393 - DNA, 22 bp, Artificial Sequence
  Synthetic oligonucleotide; TTT chr11 5280004 5280025 5280021 5280026 +
tttctcccacaagcattatgtc

SEQ ID NO: 93394 - DNA, 22 bp, Artificial Sequence
  Synthetic oligonucleotide; TTT chr11 5280005 5280026 5280022 5280027 +
ttctcccacaagcattatgtct

SEQ ID NO: 93395 - DNA, 22 bp, Artificial Sequence
  Synthetic oligonucleotide; TTT chr11 5280006 5280027 5280023 5280028 +
tctcccacaagcattatgtctg

SEQ ID NO: 93396 - DNA, 22 bp, Artificial Sequence
  Synthetic oligonucleotide; TTT chr11 5280007 5280028 5280024 5280029 +
ctcccacaagcattatgtctgt

SEQ ID NO: 93397 - DNA, 22 bp, Artificial Sequence
  Synthetic oligonucleotide; TTC chr11 5280008 5280029 5280025 5280030 +
tcccacaagcattatgtctgtc

SEQ ID NO: 93398 - DNA, 22 bp, Artificial Sequence
  Synthetic oligonucleotide; CTC chr11 5280010 5280031 5280027 5280032 +
ccacaagcattatgtctgtctg

SEQ ID NO: 93399 - DNA, 22 bp, Artificial Sequence
  Synthetic oligonucleotide; TTA chr11 5280022 5280043 5280039 5280044 +
tgtctgtctgtcattgtttttc

SEQ ID NO: 93400 - DNA, 22 bp, Artificial Sequence
  Synthetic oligonucleotide; CTG chr11 5280028 5280049 5280045 5280050 +
tctgtcattgtttttcatcctc

SEQ ID NO: 93401 - DNA, 22 bp, Artificial Sequence
  Synthetic oligonucleotide; CTG chr11 5280032 5280053 5280049 5280054 +
tcattgtttttcatcctcttgt

SEQ ID NO: 93402 - DNA, 22 bp, Artificial Sequence
  Synthetic oligonucleotide; TTG chr11 5280038 5280059 5280055 5280060 +
tttttcatcctcttgtagtcct

SEQ ID NO: 93403 - DNA, 22 bp, Artificial Sequence
  Synthetic oligonucleotide; TTT chr11 5280041 5280062 5280058 5280063 +
ttcatcctcttgtagtccttca

SEQ ID NO: 93404 - DNA, 22 bp, Artificial Sequence
  Synthetic oligonucleotide; TTT chr11 5280042 5280063 5280059 5280064 +
tcatcctcttgtagtccttcac

SEQ ID NO: 93405 - DNA, 22 bp, Artificial Sequence
  Synthetic oligonucleotide; TTT chr11 5280043 5280064 5280060 5280065 +
catcctcttgtagtccttcaca

SEQ ID NO: 93406 - DNA, 22 bp, Artificial Sequence
  Synthetic oligonucleotide; TTC chr11 5280044 5280065 5280061 5280066 +
atcctcttgtagtccttcacag

SEQ ID NO: 93407 - DNA, 22 bp, Artificial Sequence
  Synthetic oligonucleotide; CTC chr11 5280050 5280071 5280067 5280072 +
ttgtagtccttcacagttaccc

SEQ ID NO: 93408 - DNA, 22 bp, Artificial Sequence
  Synthetic oligonucleotide; CTT chr11 5280052 5280073 5280069 5280074 +
gtagtccttcacagttacccac

SEQ ID NO: 93409 - DNA, 22 bp, Artificial Sequence
  Synthetic oligonucleotide; TTG chr11 5280053 5280074 5280070 5280075 +
tagtccttcacagttacccaca

SEQ ID NO: 93410 - DNA, 22 bp, Artificial Sequence
  Synthetic oligonucleotide; CTT chr11 5280061 5280082 5280078 5280083 +
cacagttacccacacaggtgaa

SEQ ID NO: 93411 - DNA, 22 bp, Artificial Sequence
  Synthetic oligonucleotide; TTC chr11 5280062 5280083 5280079 5280084 +
acagttacccacacaggtgaac

SEQ ID NO: 93412 - DNA, 22 bp, Artificial Sequence
  Synthetic oligonucleotide; TTA chr11 5280069 5280090 5280086 5280091 +
cccacacaggtgaaccctttta

SEQ ID NO: 93413 - DNA, 22 bp, Artificial Sequence
  Synthetic oligonucleotide; CTT chr11 5280088 5280109 5280105 5280110 +
ttagctctcctggaggaatgtt

SEQ ID NO: 93414 - DNA, 22 bp, Artificial Sequence
  Synthetic oligonucleotide; TTT chr11 5280089 5280110 5280106 5280111 +
tagctctcctggaggaatgttt

SEQ ID NO: 93415 - DNA, 22 bp, Artificial Sequence
  Synthetic oligonucleotide; TTT chr11 5280090 5280111 5280107 5280112 +
agctctcctggaggaatgtttc

SEQ ID NO: 93416 - DNA, 22 bp, Artificial Sequence
  Synthetic oligonucleotide; TTA chr11 5280091 5280112 5280108 5280113 +
gctctcctggaggaatgtttct

SEQ ID NO: 93417 - DNA, 22 bp, Artificial Sequence
  Synthetic oligonucleotide; CTC chr11 5280095 5280116 5280112 5280117 +
tcctggaggaatgtttctttcc

SEQ ID NO: 93418 - DNA, 22 bp, Artificial Sequence
  Synthetic oligonucleotide; CTC chr11 5280097 5280118 5280114 5280119 +
ctggaggaatgtttctttcctc

SEQ ID NO: 93419 - DNA, 22 bp, Artificial Sequence
  Synthetic oligonucleotide; CTG chr11 5280100 5280121 5280117 5280122 +
gaggaatgtttctttcctctca

SEQ ID NO: 93420 - DNA, 22 bp, Artificial Sequence
  Synthetic oligonucleotide; TTT chr11 5280111 5280132 5280128 5280133 +
ctttcctctcaggatcagagtt

SEQ ID NO: 93421 - DNA, 22 bp, Artificial Sequence
  Synthetic oligonucleotide; TTC chr11 5280112 5280133 5280129 5280134 +
tttcctctcaggatcagagttg

SEQ ID NO: 93422 - DNA, 22 bp, Artificial Sequence
  Synthetic oligonucleotide; CTT chr11 5280114 5280135 5280131 5280136 +
tcctctcaggatcagagttgcc

SEQ ID NO: 93423 - DNA, 22 bp, Artificial Sequence
  Synthetic oligonucleotide; TTT chr11 5280115 5280136 5280132 5280137 +
cctctcaggatcagagttgcct

SEQ ID NO: 93424 - DNA, 22 bp, Artificial Sequence
  Synthetic oligonucleotide; TTC chr11 5280116 5280137 5280133 5280138 +
ctctcaggatcagagttgccta

SEQ ID NO: 93425 - DNA, 22 bp, Artificial Sequence
  Synthetic oligonucleotide; CTC chr11 5280119 5280140 5280136 5280141 +
tcaggatcagagttgcctacat

SEQ ID NO: 93426 - DNA, 22 bp, Artificial Sequence
  Synthetic oligonucleotide; CTC chr11 5280121 5280142 5280138 5280143 +
aggatcagagttgcctacatct

SEQ ID NO: 93427 - DNA, 22 bp, Artificial Sequence
  Synthetic oligonucleotide; TTG chr11 5280134 5280155 5280151 5280156 +
cctacatcttcctaatgcacca

SEQ ID NO: 93428 - DNA, 22 bp, Artificial Sequence
  Synthetic oligonucleotide; CTA chr11 5280138 5280159 5280155 5280160 +
catcttcctaatgcaccaagac

SEQ ID NO: 93429 - DNA, 22 bp, Artificial Sequence
  Synthetic oligonucleotide; CTT chr11 5280144 5280165 5280161 5280166 +
cctaatgcaccaagactggcct

SEQ ID NO: 93430 - DNA, 22 bp, Artificial Sequence
  Synthetic oligonucleotide; TTC chr11 5280145 5280166 5280162 5280167 +
ctaatgcaccaagactggcctg

SEQ ID NO: 93431 - DNA, 22 bp, Artificial Sequence
  Synthetic oligonucleotide; CTA chr11 5280148 5280169 5280165 5280170 +
atgcaccaagactggcctgaga

SEQ ID NO: 93432 - DNA, 22 bp, Artificial Sequence
  Synthetic oligonucleotide; CTG chr11 5280162 5280183 5280179 5280184 +
gcctgagatgtatccttaagat

SEQ ID NO: 93433 - DNA, 22 bp, Artificial Sequence
  Synthetic oligonucleotide; CTG chr11 5280167 5280188 5280184 5280189 +
agatgtatccttaagatgagag

SEQ ID NO: 93434 - DNA, 22 bp, Artificial Sequence
  Synthetic oligonucleotide; CTT chr11 5280179 5280200 5280196 5280201 +
aagatgagagcttcccagtagc

SEQ ID NO: 93435 - DNA, 22 bp, Artificial Sequence
  Synthetic oligonucleotide; TTA chr11 5280180 5280201 5280197 5280202 +
agatgagagcttcccagtagca

SEQ ID NO: 93436 - DNA, 22 bp, Artificial Sequence
  Synthetic oligonucleotide; CTT chr11 5280192 5280213 5280209 5280214 +
cccagtagcaccccaagtcaga

SEQ ID NO: 93437 - DNA, 22 bp, Artificial Sequence
  Synthetic oligonucleotide; TTC chr11 5280193 5280214 5280210 5280215 +
ccagtagcaccccaagtcagat

SEQ ID NO: 93438 - DNA, 22 bp, Artificial Sequence
  Synthetic oligonucleotide; CTG chr11 5280218 5280239 5280235 5280240 +
accccgtatgtgagcatgtgtc

SEQ ID NO: 93439 - DNA, 22 bp, Artificial Sequence
  Synthetic oligonucleotide; CTC chr11 5280243 5280264 5280260 5280265 +
taacagcacaggccttttgcca

SEQ ID NO: 93440 - DNA, 22 bp, Artificial Sequence
  Synthetic oligonucleotide; CTA chr11 5280245 5280266 5280262 5280267 +
acagcacaggccttttgccacc

SEQ ID NO: 93441 - DNA, 22 bp, Artificial Sequence
  Synthetic oligonucleotide; CTT chr11 5280259 5280280 5280276 5280281 +
ttgccacctagctgtccagggg

SEQ ID NO: 93442 - DNA, 22 bp, Artificial Sequence
  Synthetic oligonucleotide; TTT chr11 5280260 5280281 5280277 5280282 +
tgccacctagctgtccaggggt

SEQ ID NO: 93443 - DNA, 22 bp, Artificial Sequence
  Synthetic oligonucleotide; TTT chr11 5280261 5280282 5280278 5280283 +
gccacctagctgtccaggggtg

SEQ ID NO: 93444 - DNA, 22 bp, Artificial Sequence
  Synthetic oligonucleotide; TTG chr11 5280262 5280283 5280279 5280284 +
ccacctagctgtccaggggtgc

SEQ ID NO: 93445 - DNA, 22 bp, Artificial Sequence
  Synthetic oligonucleotide; CTA chr11 5280269 5280290 5280286 5280291 +
gctgtccaggggtgccttaaaa

SEQ ID NO: 93446 - DNA, 22 bp, Artificial Sequence
  Synthetic oligonucleotide; CTG chr11 5280273 5280294 5280290 5280295 +
tccaggggtgccttaaaatggc

SEQ ID NO: 93447 - DNA, 22 bp, Artificial Sequence
  Synthetic oligonucleotide; CTT chr11 5280287 5280308 5280304 5280309 +
aaaatggcaaacaaggtttgtt

SEQ ID NO: 93448 - DNA, 22 bp, Artificial Sequence
  Synthetic oligonucleotide; TTA chr11 5280288 5280309 5280305 5280310 +
aaatggcaaacaaggtttgttt

SEQ ID NO: 93449 - DNA, 22 bp, Artificial Sequence
  Synthetic oligonucleotide; TTT chr11 5280306 5280327 5280323 5280328 +
gttttcttttcctgttttcatg

SEQ ID NO: 93450 - DNA, 22 bp, Artificial Sequence
  Synthetic oligonucleotide; TTG chr11 5280307 5280328 5280324 5280329 +
ttttcttttcctgttttcatgc

SEQ ID NO: 93451 - DNA, 22 bp, Artificial Sequence
  Synthetic oligonucleotide; TTT chr11 5280310 5280331 5280327 5280332 +
tcttttcctgttttcatgcctt

SEQ ID NO: 93452 - DNA, 22 bp, Artificial Sequence
  Synthetic oligonucleotide; TTT chr11 5280311 5280332 5280328 5280333 +
cttttcctgttttcatgccttc

SEQ ID NO: 93453 - DNA, 22 bp, Artificial Sequence
  Synthetic oligonucleotide; TTC chr11 5280312 5280333 5280329 5280334 +
ttttcctgttttcatgccttcc

SEQ ID NO: 93454 - DNA, 22 bp, Artificial Sequence
  Synthetic oligonucleotide; CTT chr11 5280314 5280335 5280331 5280336 +
ttcctgttttcatgccttcctc

SEQ ID NO: 93455 - DNA, 22 bp, Artificial Sequence
  Synthetic oligonucleotide; TTT chr11 5280315 5280336 5280332 5280337 +
tcctgttttcatgccttcctct

SEQ ID NO: 93456 - DNA, 22 bp, Artificial Sequence
  Synthetic oligonucleotide; TTT chr11 5280316 5280337 5280333 5280338 +
cctgttttcatgccttcctctt

SEQ ID NO: 93457 - DNA, 22 bp, Artificial Sequence
  Synthetic oligonucleotide; TTC chr11 5280317 5280338 5280334 5280339 +
ctgttttcatgccttcctcttc

SEQ ID NO: 93458 - DNA, 22 bp, Artificial Sequence
  Synthetic oligonucleotide; CTG chr11 5280320 5280341 5280337 5280342 +
ttttcatgccttcctcttccat

SEQ ID NO: 93459 - DNA, 22 bp, Artificial Sequence
  Synthetic oligonucleotide; TTT chr11 5280323 5280344 5280340 5280345 +
tcatgccttcctcttccatatc

SEQ ID NO: 93460 - DNA, 22 bp, Artificial Sequence
  Synthetic oligonucleotide; TTT chr11 5280324 5280345 5280341 5280346 +
catgccttcctcttccatatcc

SEQ ID NO: 93461 - DNA, 22 bp, Artificial Sequence
  Synthetic oligonucleotide; TTC chr11 5280325 5280346 5280342 5280347 +
atgccttcctcttccatatcct

SEQ ID NO: 93462 - DNA, 22 bp, Artificial Sequence
  Synthetic oligonucleotide; CTT chr11 5280332 5280353 5280349 5280354 +
cctcttccatatccttgtttca

SEQ ID NO: 93463 - DNA, 22 bp, Artificial Sequence
  Synthetic oligonucleotide; TTC chr11 5280333 5280354 5280350 5280355 +
ctcttccatatccttgtttcat

SEQ ID NO: 93464 - DNA, 22 bp, Artificial Sequence
  Synthetic oligonucleotide; CTC chr11 5280336 5280357 5280353 5280358 +
ttccatatccttgtttcatatt

SEQ ID NO: 93465 - DNA, 22 bp, Artificial Sequence
  Synthetic oligonucleotide; CTT chr11 5280338 5280359 5280355 5280360 +
ccatatccttgtttcatattaa

SEQ ID NO: 93466 - DNA, 22 bp, Artificial Sequence
  Synthetic oligonucleotide; TTC chr11 5280339 5280360 5280356 5280361 +
catatccttgtttcatattaat

SEQ ID NO: 93467 - DNA, 22 bp, Artificial Sequence
  Synthetic oligonucleotide; CTT chr11 5280348 5280369 5280365 5280370 +
gtttcatattaatacatgtgta

SEQ ID NO: 93468 - DNA, 22 bp, Artificial Sequence
  Synthetic oligonucleotide; TTG chr11 5280349 5280370 5280366 5280371 +
tttcatattaatacatgtgtat

SEQ ID NO: 93469 - DNA, 22 bp, Artificial Sequence
  Synthetic oligonucleotide; TTT chr11 5280352 5280373 5280369 5280374 +
catattaatacatgtgtataga

SEQ ID NO: 93470 - DNA, 22 bp, Artificial Sequence
  Synthetic oligonucleotide; TTC chr11 5280353 5280374 5280370 5280375 +
atattaatacatgtgtatagat

SEQ ID NO: 93471 - DNA, 22 bp, Artificial Sequence
  Synthetic oligonucleotide; TTA chr11 5280359 5280380 5280376 5280381 +
atacatgtgtatagatcctaaa

SEQ ID NO: 93472 - DNA, 22 bp, Artificial Sequence
  Synthetic oligonucleotide; CTA chr11 5280379 5280400 5280396 5280401 +
aaaatctatacacatgtattaa

SEQ ID NO: 93473 - DNA, 22 bp, Artificial Sequence
  Synthetic oligonucleotide; CTA chr11 5280387 5280408 5280404 5280409 +
tacacatgtattaataaagcct

SEQ ID NO: 93474 - DNA, 22 bp, Artificial Sequence
  Synthetic oligonucleotide; TTA chr11 5280400 5280421 5280417 5280422 +
ataaagcctgattctgccgctt

SEQ ID NO: 93475 - DNA, 22 bp, Artificial Sequence
  Synthetic oligonucleotide; CTG chr11 5280410 5280431 5280427 5280432 +
attctgccgcttctaggtatag

SEQ ID NO: 93476 - DNA, 22 bp, Artificial Sequence
  Synthetic oligonucleotide; TTC chr11 5280414 5280435 5280431 5280436 +
tgccgcttctaggtatagaggc

SEQ ID NO: 93477 - DNA, 22 bp, Artificial Sequence
  Synthetic oligonucleotide; CTG chr11 5280416 5280437 5280433 5280438 +
ccgcttctaggtatagaggcca

SEQ ID NO: 93478 - DNA, 22 bp, Artificial Sequence
  Synthetic oligonucleotide; CTT chr11 5280422 5280443 5280439 5280444 +
ctaggtatagaggccacctgca

SEQ ID NO: 93479 - DNA, 22 bp, Artificial Sequence
  Synthetic oligonucleotide; TTC chr11 5280423 5280444 5280440 5280445 +
taggtatagaggccacctgcaa

SEQ ID NO: 93480 - DNA, 22 bp, Artificial Sequence
  Synthetic oligonucleotide; CTA chr11 5280425 5280446 5280442 5280447 +
ggtatagaggccacctgcaaga

SEQ ID NO: 93481 - DNA, 22 bp, Artificial Sequence
  Synthetic oligonucleotide; CTG chr11 5280442 5280463 5280459 5280464 +
caagataaatatttgattcaca

SEQ ID NO: 93482 - DNA, 22 bp, Artificial Sequence
  Synthetic oligonucleotide; TTT chr11 5280456 5280477 5280473 5280478 +
gattcacaataactaatcattc

SEQ ID NO: 93483 - DNA, 22 bp, Artificial Sequence
  Synthetic oligonucleotide; TTG chr11 5280457 5280478 5280474 5280479 +
attcacaataactaatcattct

SEQ ID NO: 93484 - DNA, 22 bp, Artificial Sequence
  Synthetic oligonucleotide; TTC chr11 5280461 5280482 5280478 5280483 +
acaataactaatcattctatgg

SEQ ID NO: 93485 - DNA, 22 bp, Artificial Sequence
  Synthetic oligonucleotide; CTA chr11 5280471 5280492 5280488 5280493 +
atcattctatggcaattgataa

SEQ ID NO: 93486 - DNA, 22 bp, Artificial Sequence
  Synthetic oligonucleotide; TTC chr11 5280478 5280499 5280495 5280500 +
tatggcaattgataacaacaaa

SEQ ID NO: 93487 - DNA, 22 bp, Artificial Sequence
  Synthetic oligonucleotide; CTA chr11 5280480 5280501 5280497 5280502 +
tggcaattgataacaacaaata

SEQ ID NO: 93488 - DNA, 22 bp, Artificial Sequence
  Synthetic oligonucleotide; TTG chr11 5280489 5280510 5280506 5280511 +
ataacaacaaatatatatatat

SEQ ID NO: 93489 - DNA, 22 bp, Artificial Sequence
  Synthetic oligonucleotide; TTC chr11 5280551 5280572 5280568 5280573 +
aggaaataatatattctagaat

SEQ ID NO: 93490 - DNA, 22 bp, Artificial Sequence
  Synthetic oligonucleotide; TTC chr11 5280567 5280588 5280584 5280589 +
tagaatatgtcacattctgtct

SEQ ID NO: 93491 - DNA, 22 bp, Artificial Sequence
  Synthetic oligonucleotide; CTA chr11 5280569 5280590 5280586 5280591 +
gaatatgtcacattctgtctca

SEQ ID NO: 93492 - DNA, 22 bp, Artificial Sequence
  Synthetic oligonucleotide; TTC chr11 5280584 5280605 5280601 5280606 +
tgtctcaggcatccattttctt

SEQ ID NO: 93493 - DNA, 22 bp, Artificial Sequence
  Synthetic oligonucleotide; CTG chr11 5280586 5280607 5280603 5280608 +
tctcaggcatccattttcttta

SEQ ID NO: 93494 - DNA, 22 bp, Artificial Sequence
  Synthetic oligonucleotide; CTC chr11 5280590 5280611 5280607 5280612 +
aggcatccattttctttatgat

SEQ ID NO: 93495 - DNA, 22 bp, Artificial Sequence
  Synthetic oligonucleotide; TTT chr11 5280602 5280623 5280619 5280624 +
tctttatgatgccgtttgaggt

SEQ ID NO: 93496 - DNA, 22 bp, Artificial Sequence
  Synthetic oligonucleotide; TTT chr11 5280603 5280624 5280620 5280625 +
ctttatgatgccgtttgaggtg

SEQ ID NO: 93497 - DNA, 22 bp, Artificial Sequence
  Synthetic oligonucleotide; TTC chr11 5280604 5280625 5280621 5280626 +
tttatgatgccgtttgaggtgg

SEQ ID NO: 93498 - DNA, 22 bp, Artificial Sequence
  Synthetic oligonucleotide; CTT chr11 5280606 5280627 5280623 5280628 +
tatgatgccgtttgaggtggag

SEQ ID NO: 93499 - DNA, 22 bp, Artificial Sequence
  Synthetic oligonucleotide; TTT chr11 5280607 5280628 5280624 5280629 +
atgatgccgtttgaggtggagt

SEQ ID NO: 93500 - DNA, 22 bp, Artificial Sequence
  Synthetic oligonucleotide; TTA chr11 5280608 5280629 5280625 5280630 +
tgatgccgtttgaggtggagtt

SEQ ID NO: 93501 - DNA, 22 bp, Artificial Sequence
  Synthetic oligonucleotide; TTT chr11 5280619 5280640 5280636 5280641 +
gaggtggagttttagtcaggtg

SEQ ID NO: 93502 - DNA, 22 bp, Artificial Sequence
  Synthetic oligonucleotide; TTG chr11 5280620 5280641 5280637 5280642 +
aggtggagttttagtcaggtgg

SEQ ID NO: 93503 - DNA, 22 bp, Artificial Sequence
  Synthetic oligonucleotide; TTT chr11 5280631 5280652 5280648 5280653 +
tagtcaggtggtcagcttctcc

SEQ ID NO: 93504 - DNA, 22 bp, Artificial Sequence
  Synthetic oligonucleotide; TTT chr11 5280632 5280653 5280649 5280654 +
agtcaggtggtcagcttctcct

SEQ ID NO: 93505 - DNA, 22 bp, Artificial Sequence
  Synthetic oligonucleotide; TTA chr11 5280633 5280654 5280650 5280655 +
gtcaggtggtcagcttctcctt

SEQ ID NO: 93506 - DNA, 22 bp, Artificial Sequence
  Synthetic oligonucleotide; CTT chr11 5280649 5280670 5280666 5280671 +
ctccttttttttgccatctgcc

SEQ ID NO: 93507 - DNA, 22 bp, Artificial Sequence
  Synthetic oligonucleotide; TTC chr11 5280650 5280671 5280667 5280672 +
tccttttttttgccatctgccc

SEQ ID NO: 93508 - DNA, 22 bp, Artificial Sequence
  Synthetic oligonucleotide; CTC chr11 5280652 5280673 5280669 5280674 +
cttttttttgccatctgccctg

SEQ ID NO: 93509 - DNA, 22 bp, Artificial Sequence
  Synthetic oligonucleotide; CTT chr11 5280655 5280676 5280672 5280677 +
ttttttgccatctgccctgtaa

SEQ ID NO: 93510 - DNA, 22 bp, Artificial Sequence
  Synthetic oligonucleotide; TTT chr11 5280656 5280677 5280673 5280678 +
tttttgccatctgccctgtaag

SEQ ID NO: 93511 - DNA, 22 bp, Artificial Sequence
  Synthetic oligonucleotide; TTT chr11 5280657 5280678 5280674 5280679 +
ttttgccatctgccctgtaagc

SEQ ID NO: 93512 - DNA, 22 bp, Artificial Sequence
  Synthetic oligonucleotide; TTT chr11 5280658 5280679 5280675 5280680 +
tttgccatctgccctgtaagca

SEQ ID NO: 93513 - DNA, 22 bp, Artificial Sequence
  Synthetic oligonucleotide; TTT chr11 5280659 5280680 5280676 5280681 +
ttgccatctgccctgtaagcat

SEQ ID NO: 93514 - DNA, 22 bp, Artificial Sequence
  Synthetic oligonucleotide; TTT chr11 5280660 5280681 5280677 5280682 +
tgccatctgccctgtaagcatc

SEQ ID NO: 93515 - DNA, 22 bp, Artificial Sequence
  Synthetic oligonucleotide; TTT chr11 5280661 5280682 5280678 5280683 +
gccatctgccctgtaagcatcc

SEQ ID NO: 93516 - DNA, 22 bp, Artificial Sequence
  Synthetic oligonucleotide; TTG chr11 5280662 5280683 5280679 5280684 +
ccatctgccctgtaagcatcct

SEQ ID NO: 93517 - DNA, 22 bp, Artificial Sequence
  Synthetic oligonucleotide; CTG chr11 5280669 5280690 5280686 5280691 +
ccctgtaagcatcctgctgggg

SEQ ID NO: 93518 - DNA, 22 bp, Artificial Sequence
  Synthetic oligonucleotide; CTG chr11 5280674 5280695 5280691 5280696 +
taagcatcctgctggggaccca

SEQ ID NO: 93519 - DNA, 22 bp, Artificial Sequence
  Synthetic oligonucleotide; CTG chr11 5280685 5280706 5280702 5280707 +
ctggggacccagataggagtca

SEQ ID NO: 93520 - DNA, 22 bp, Artificial Sequence
  Synthetic oligonucleotide; CTG chr11 5280688 5280709 5280705 5280710 +
gggacccagataggagtcatca

SEQ ID NO: 93521 - DNA, 22 bp, Artificial Sequence
  Synthetic oligonucleotide; CTC chr11 5280713 5280734 5280730 5280735 +
taggctgagaacatctgggcac

SEQ ID NO: 93522 - DNA, 22 bp, Artificial Sequence
  Synthetic oligonucleotide; CTA chr11 5280715 5280736 5280732 5280737 +
ggctgagaacatctgggcacac

SEQ ID NO: 93523 - DNA, 22 bp, Artificial Sequence
  Synthetic oligonucleotide; CTG chr11 5280720 5280741 5280737 5280742 +
agaacatctgggcacacaccct

SEQ ID NO: 93524 - DNA, 22 bp, Artificial Sequence
  Synthetic oligonucleotide; CTG chr11 5280730 5280751 5280747 5280752 +
ggcacacaccctaagcctcagc

SEQ ID NO: 93525 - DNA, 22 bp, Artificial Sequence
  Synthetic oligonucleotide; CTA chr11 5280743 5280764 5280760 5280765 +
agcctcagcatgactcatcatg

SEQ ID NO: 93526 - DNA, 22 bp, Artificial Sequence
  Synthetic oligonucleotide; CTC chr11 5280749 5280770 5280766 5280771 +
agcatgactcatcatgactcag

SEQ ID NO: 93527 - DNA, 22 bp, Artificial Sequence
  Synthetic oligonucleotide; CTC chr11 5280759 5280780 5280776 5280781 +
atcatgactcagcattgctgtg

SEQ ID NO: 93528 - DNA, 22 bp, Artificial Sequence
  Synthetic oligonucleotide; CTC chr11 5280769 5280790 5280786 5280791 +
agcattgctgtgcttgagccag

SEQ ID NO: 93529 - DNA, 22 bp, Artificial Sequence
  Synthetic oligonucleotide; TTG chr11 5280776 5280797 5280793 5280798 +
ctgtgcttgagccagaaggttt

SEQ ID NO: 93530 - DNA, 22 bp, Artificial Sequence
  Synthetic oligonucleotide; CTG chr11 5280779 5280800 5280796 5280801 +
tgcttgagccagaaggtttgct

SEQ ID NO: 93531 - DNA, 22 bp, Artificial Sequence
  Synthetic oligonucleotide; CTT chr11 5280784 5280805 5280801 5280806 +
gagccagaaggtttgcttagaa

SEQ ID NO: 93532 - DNA, 22 bp, Artificial Sequence
  Synthetic oligonucleotide; TTG chr11 5280785 5280806 5280802 5280807 +
agccagaaggtttgcttagaag

SEQ ID NO: 93533 - DNA, 22 bp, Artificial Sequence
  Synthetic oligonucleotide; TTT chr11 5280798 5280819 5280815 5280820 +
gcttagaaggttacacagaacc

SEQ ID NO: 93534 - DNA, 22 bp, Artificial Sequence
  Synthetic oligonucleotide; TTG chr11 5280799 5280820 5280816 5280821 +
cttagaaggttacacagaacca

SEQ ID NO: 93535 - DNA, 22 bp, Artificial Sequence
  Synthetic oligonucleotide; CTT chr11 5280802 5280823 5280819 5280824 +
agaaggttacacagaaccagaa

SEQ ID NO: 93536 - DNA, 22 bp, Artificial Sequence
  Synthetic oligonucleotide; TTA chr11 5280803 5280824 5280820 5280825 +
gaaggttacacagaaccagaag

SEQ ID NO: 93537 - DNA, 22 bp, Artificial Sequence
  Synthetic oligonucleotide; TTA chr11 5280811 5280832 5280828 5280833 +
cacagaaccagaaggcgggggt

SEQ ID NO: 93538 - DNA, 22 bp, Artificial Sequence
  Synthetic oligonucleotide; CTG chr11 5280842 5280863 5280859 5280864 +
accccgacaggggcctggccag

SEQ ID NO: 93539 - DNA, 22 bp, Artificial Sequence
  Synthetic oligonucleotide; CTG chr11 5280859 5280880 5280876 5280881 +
gccagaactgctcatgcttgga

SEQ ID NO: 93540 - DNA, 22 bp, Artificial Sequence
  Synthetic oligonucleotide; CTG chr11 5280869 5280890 5280886 5280891 +
ctcatgcttggactatgggagg

SEQ ID NO: 93541 - DNA, 22 bp, Artificial Sequence
  Synthetic oligonucleotide; CTC chr11 5280872 5280893 5280889 5280894 +
atgcttggactatgggaggtca

SEQ ID NO: 93542 - DNA, 22 bp, Artificial Sequence
  Synthetic oligonucleotide; CTT chr11 5280878 5280899 5280895 5280900 +
ggactatgggaggtcactaatg

SEQ ID NO: 93543 - DNA, 22 bp, Artificial Sequence
  Synthetic oligonucleotide; TTG chr11 5280879 5280900 5280896 5280901 +
gactatgggaggtcactaatgg

SEQ ID NO: 93544 - DNA, 22 bp, Artificial Sequence
  Synthetic oligonucleotide; CTA chr11 5280884 5280905 5280901 5280906 +
tgggaggtcactaatggagaca

SEQ ID NO: 93545 - DNA, 22 bp, Artificial Sequence
  Synthetic oligonucleotide; CTA chr11 5280897 5280918 5280914 5280919 +
atggagacacacagaaatgtaa

SEQ ID NO: 93546 - DNA, 22 bp, Artificial Sequence
  Synthetic oligonucleotide; CTA chr11 5280928 5280949 5280945 5280950 +
aggaaaaactgaagcttattta

SEQ ID NO: 93547 - DNA, 22 bp, Artificial Sequence
  Synthetic oligonucleotide; CTG chr11 5280939 5280960 5280956 5280961 +
aagcttatttaatcagagatga

SEQ ID NO: 93548 - DNA, 22 bp, Artificial Sequence
  Synthetic oligonucleotide; CTT chr11 5280945 5280966 5280962 5280967 +
atttaatcagagatgaggatgc

SEQ ID NO: 93549 - DNA, 22 bp, Artificial Sequence
  Synthetic oligonucleotide; TTA chr11 5280946 5280967 5280963 5280968 +
tttaatcagagatgaggatgct

SEQ ID NO: 93550 - DNA, 22 bp, Artificial Sequence
  Synthetic oligonucleotide; TTT chr11 5280949 5280970 5280966 5280971 +
aatcagagatgaggatgctgga

SEQ ID NO: 93551 - DNA, 22 bp, Artificial Sequence
  Synthetic oligonucleotide; TTA chr11 5280950 5280971 5280967 5280972 +
atcagagatgaggatgctggaa

SEQ ID NO: 93552 - DNA, 22 bp, Artificial Sequence
  Synthetic oligonucleotide; CTG chr11 5280969 5280990 5280986 5280991 +
gaagggatagagggagctgagc

SEQ ID NO: 93553 - DNA, 22 bp, Artificial Sequence
  Synthetic oligonucleotide; CTG chr11 5280988 5281009 5281005 5281010 +
agcttgtaaaaagtatagtaat

SEQ ID NO: 93554 - DNA, 22 bp, Artificial Sequence
  Synthetic oligonucleotide; CTT chr11 5280993 5281014 5281010 5281015 +
gtaaaaagtatagtaatcattc

SEQ ID NO: 93555 - DNA, 22 bp, Artificial Sequence
  Synthetic oligonucleotide; TTG chr11 5280994 5281015 5281011 5281016 +
taaaaagtatagtaatcattca

SEQ ID NO: 93556 - DNA, 22 bp, Artificial Sequence
  Synthetic oligonucleotide; TTC chr11 5281015 5281036 5281032 5281037 +
agcaaatggttttgaagcacct

SEQ ID NO: 93557 - DNA, 22 bp, Artificial Sequence
  Synthetic oligonucleotide; TTT chr11 5281027 5281048 5281044 5281049 +
tgaagcacctgctggatgctaa

SEQ ID NO: 93558 - DNA, 22 bp, Artificial Sequence
  Synthetic oligonucleotide; TTT chr11 5281028 5281049 5281045 5281050 +
gaagcacctgctggatgctaaa

SEQ ID NO: 93559 - DNA, 22 bp, Artificial Sequence
  Synthetic oligonucleotide; TTG chr11 5281029 5281050 5281046 5281051 +
aagcacctgctggatgctaaac

SEQ ID NO: 93560 - DNA, 22 bp, Artificial Sequence
  Synthetic oligonucleotide; CTG chr11 5281038 5281059 5281055 5281060 +
ctggatgctaaacactattttc

SEQ ID NO: 93561 - DNA, 22 bp, Artificial Sequence
  Synthetic oligonucleotide; CTG chr11 5281041 5281062 5281058 5281063 +
gatgctaaacactattttcagt

SEQ ID NO: 93562 - DNA, 22 bp, Artificial Sequence
  Synthetic oligonucleotide; CTA chr11 5281048 5281069 5281065 5281070 +
aacactattttcagtgcttgaa

SEQ ID NO: 93563 - DNA, 22 bp, Artificial Sequence
  Synthetic oligonucleotide; CTA chr11 5281055 5281076 5281072 5281077 +
ttttcagtgcttgaatcataaa

SEQ ID NO: 93564 - DNA, 22 bp, Artificial Sequence
  Synthetic oligonucleotide; TTT chr11 5281058 5281079 5281075 5281080 +
tcagtgcttgaatcataaataa

SEQ ID NO: 93565 - DNA, 22 bp, Artificial Sequence
  Synthetic oligonucleotide; TTT chr11 5281059 5281080 5281076 5281081 +
cagtgcttgaatcataaataag

SEQ ID NO: 93566 - DNA, 22 bp, Artificial Sequence
  Synthetic oligonucleotide; TTC chr11 5281060 5281081 5281077 5281082 +
agtgcttgaatcataaataaga

SEQ ID NO: 93567 - DNA, 22 bp, Artificial Sequence
  Synthetic oligonucleotide; CTT chr11 5281067 5281088 5281084 5281089 +
gaatcataaataagaataaaac

SEQ ID NO: 93568 - DNA, 22 bp, Artificial Sequence
  Synthetic oligonucleotide; TTG chr11 5281068 5281089 5281085 5281090 +
aatcataaataagaataaaaca

SEQ ID NO: 93569 - DNA, 22 bp, Artificial Sequence
  Synthetic oligonucleotide; CTT chr11 5281098 5281119 5281115 5281120 +
attccccacaagagtccaagta

SEQ ID NO: 93570 - DNA, 22 bp, Artificial Sequence
  Synthetic oligonucleotide; TTA chr11 5281099 5281120 5281116 5281121 +
ttccccacaagagtccaagtaa

SEQ ID NO: 93571 - DNA, 22 bp, Artificial Sequence
  Synthetic oligonucleotide; TTC chr11 5281102 5281123 5281119 5281124 +
cccacaagagtccaagtaaaaa

SEQ ID NO: 93572 - DNA, 22 bp, Artificial Sequence
  Synthetic oligonucleotide; TTA chr11 5281134 5281155 5281151 5281156 +
attataatgtgctctgtccccc

SEQ ID NO: 93573 - DNA, 22 bp, Artificial Sequence
  Synthetic oligonucleotide; TTA chr11 5281138 5281159 5281155 5281160 +
taatgtgctctgtcccccaggc

SEQ ID NO: 93574 - DNA, 22 bp, Artificial Sequence
  Synthetic oligonucleotide; CTC chr11 5281148 5281169 5281165 5281170 +
tgtcccccaggctggagtgcag

SEQ ID NO: 93575 - DNA, 22 bp, Artificial Sequence
  Synthetic oligonucleotide; CTG chr11 5281150 5281171 5281167 5281172 +
tcccccaggctggagtgcagtg

SEQ ID NO: 93576 - DNA, 22 bp, Artificial Sequence
  Synthetic oligonucleotide; CTG chr11 5281162 5281183 5281179 5281184 +
gagtgcagtggcacgatctcag

SEQ ID NO: 93577 - DNA, 22 bp, Artificial Sequence
  Synthetic oligonucleotide; CTC chr11 5281182 5281203 5281199 5281204 +
agctcactgcaacctccgcctc

SEQ ID NO: 93578 - DNA, 22 bp, Artificial Sequence
  Synthetic oligonucleotide; CTC chr11 5281187 5281208 5281204 5281209 +
actgcaacctccgcctcccggg

SEQ ID NO: 93579 - DNA, 22 bp, Artificial Sequence
  Synthetic oligonucleotide; CTG chr11 5281191 5281212 5281208 5281213 +
caacctccgcctcccgggttca

SEQ ID NO: 93580 - DNA, 22 bp, Artificial Sequence
  Synthetic oligonucleotide; CTC chr11 5281198 5281219 5281215 5281220 +
cgcctcccgggttcaagcaatt

SEQ ID NO: 93581 - DNA, 22 bp, Artificial Sequence
  Synthetic oligonucleotide; CTC chr11 5281204 5281225 5281221 5281226 +
ccgggttcaagcaattctcctg

SEQ ID NO: 93582 - DNA, 22 bp, Artificial Sequence
  Synthetic oligonucleotide; TTC chr11 5281212 5281233 5281229 5281234 +
aagcaattctcctgcctcagcc

SEQ ID NO: 93583 - DNA, 22 bp, Artificial Sequence
  Synthetic oligonucleotide; TTC chr11 5281221 5281242 5281238 5281243 +
tcctgcctcagccaccctaata

SEQ ID NO: 93584 - DNA, 22 bp, Artificial Sequence
  Synthetic oligonucleotide; CTC chr11 5281223 5281244 5281240 5281245 +
ctgcctcagccaccctaatagc

SEQ ID NO: 93585 - DNA, 22 bp, Artificial Sequence
  Synthetic oligonucleotide; CTG chr11 5281226 5281247 5281243 5281248 +
cctcagccaccctaatagctgg

SEQ ID NO: 93586 - DNA, 22 bp, Artificial Sequence
  Synthetic oligonucleotide; CTC chr11 5281230 5281251 5281247 5281252 +
agccaccctaatagctgggatt

SEQ ID NO: 93587 - DNA, 22 bp, Artificial Sequence
  Synthetic oligonucleotide; CTA chr11 5281240 5281261 5281257 5281262 +
atagctgggattacaggtgcac

SEQ ID NO: 93588 - DNA, 22 bp, Artificial Sequence
  Synthetic oligonucleotide; CTG chr11 5281247 5281268 5281264 5281269 +
ggattacaggtgcacaccacca

SEQ ID NO: 93589 - DNA, 22 bp, Artificial Sequence
  Synthetic oligonucleotide; TTA chr11 5281253 5281274 5281270 5281275 +
caggtgcacaccaccatgccag

SEQ ID NO: 93590 - DNA, 22 bp, Artificial Sequence
  Synthetic oligonucleotide; CTA chr11 5281279 5281300 5281296 5281301 +
atttttgtactttttgtagagg

SEQ ID NO: 93591 - DNA, 22 bp, Artificial Sequence
  Synthetic oligonucleotide; TTT chr11 5281283 5281304 5281300 5281305 +
ttgtactttttgtagaggcagg

SEQ ID NO: 93592 - DNA, 22 bp, Artificial Sequence
  Synthetic oligonucleotide; TTT chr11 5281284 5281305 5281301 5281306 +
tgtactttttgtagaggcaggg

SEQ ID NO: 93593 - DNA, 22 bp, Artificial Sequence
  Synthetic oligonucleotide; TTT chr11 5281285 5281306 5281302 5281307 +
gtactttttgtagaggcagggt

SEQ ID NO: 93594 - DNA, 22 bp, Artificial Sequence
  Synthetic oligonucleotide; TTG chr11 5281286 5281307 5281303 5281308 +
tactttttgtagaggcagggta

SEQ ID NO: 93595 - DNA, 22 bp, Artificial Sequence
  Synthetic oligonucleotide; CTT chr11 5281291 5281312 5281308 5281313 +
tttgtagaggcagggtatcacc

SEQ ID NO: 93596 - DNA, 22 bp, Artificial Sequence
  Synthetic oligonucleotide; TTT chr11 5281292 5281313 5281309 5281314 +
ttgtagaggcagggtatcacca

SEQ ID NO: 93597 - DNA, 22 bp, Artificial Sequence
  Synthetic oligonucleotide; TTT chr11 5281293 5281314 5281310 5281315 +
tgtagaggcagggtatcaccat

SEQ ID NO: 93598 - DNA, 22 bp, Artificial Sequence
  Synthetic oligonucleotide; TTT chr11 5281294 5281315 5281311 5281316 +
gtagaggcagggtatcaccatg

SEQ ID NO: 93599 - DNA, 22 bp, Artificial Sequence
  Synthetic oligonucleotide; TTG chr11 5281295 5281316 5281312 5281317 +
tagaggcagggtatcaccatgt

SEQ ID NO: 93600 - DNA, 22 bp, Artificial Sequence
  Synthetic oligonucleotide; TTG chr11 5281319 5281340 5281336 5281341 +
tccaagatggtcttgaactcct

SEQ ID NO: 93601 - DNA, 22 bp, Artificial Sequence
  Synthetic oligonucleotide; CTT chr11 5281333 5281354 5281350 5281355 +
gaactcctgagctccaagcagt

SEQ ID NO: 93602 - DNA, 22 bp, Artificial Sequence
  Synthetic oligonucleotide; TTG chr11 5281334 5281355 5281351 5281356 +
aactcctgagctccaagcagtc

SEQ ID NO: 93603 - DNA, 22 bp, Artificial Sequence
  Synthetic oligonucleotide; CTC chr11 5281339 5281360 5281356 5281361 +
ctgagctccaagcagtccaccc

SEQ ID NO: 93604 - DNA, 22 bp, Artificial Sequence
  Synthetic oligonucleotide; CTG chr11 5281342 5281363 5281359 5281364 +
agctccaagcagtccacccacc

SEQ ID NO: 93605 - DNA, 22 bp, Artificial Sequence
  Synthetic oligonucleotide; CTC chr11 5281347 5281368 5281364 5281369 +
caagcagtccacccacctcagc

SEQ ID NO: 93606 - DNA, 22 bp, Artificial Sequence
  Synthetic oligonucleotide; CTC chr11 5281366 5281387 5281383 5281388 +
agcctcccaaagtgctgggatt

SEQ ID NO: 93607 - DNA, 22 bp, Artificial Sequence
  Synthetic oligonucleotide; CTC chr11 5281372 5281393 5281389 5281394 +
ccaaagtgctgggattacaggt

SEQ ID NO: 93608 - DNA, 22 bp, Artificial Sequence
  Synthetic oligonucleotide; CTG chr11 5281383 5281404 5281400 5281405 +
ggattacaggtgtgagacacca

SEQ ID NO: 93609 - DNA, 22 bp, Artificial Sequence
  Synthetic oligonucleotide; TTA chr11 5281389 5281410 5281406 5281411 +
caggtgtgagacaccatgccca

SEQ ID NO: 93610 - DNA, 22 bp, Artificial Sequence
  Synthetic oligonucleotide; TTT chr11 5281416 5281437 5281433 5281438 +
tccatatttaatagaggtattt

SEQ ID NO: 93611 - DNA, 22 bp, Artificial Sequence
  Synthetic oligonucleotide; TTT chr11 5281417 5281438 5281434 5281439 +
ccatatttaatagaggtattta

SEQ ID NO: 93612 - DNA, 22 bp, Artificial Sequence
  Synthetic oligonucleotide; TTC chr11 5281418 5281439 5281435 5281440 +
catatttaatagaggtatttat

SEQ ID NO: 93613 - DNA, 22 bp, Artificial Sequence
  Synthetic oligonucleotide; TTT chr11 5281425 5281446 5281442 5281447 +
aatagaggtatttatgggatgg

SEQ ID NO: 93614 - DNA, 22 bp, Artificial Sequence
  Synthetic oligonucleotide; TTA chr11 5281426 5281447 5281443 5281448 +
atagaggtatttatgggatggg

SEQ ID NO: 93615 - DNA, 22 bp, Artificial Sequence
  Synthetic oligonucleotide; TTT chr11 5281438 5281459 5281455 5281460 +
atgggatgggggaaaagaatgt

SEQ ID NO: 93616 - DNA, 22 bp, Artificial Sequence
  Synthetic oligonucleotide; TTA chr11 5281439 5281460 5281456 5281461 +
tgggatgggggaaaagaatgtt

SEQ ID NO: 93617 - DNA, 22 bp, Artificial Sequence
  Synthetic oligonucleotide; TTT chr11 5281462 5281483 5281479 5281484 +
ctctcactgtggattattttag

SEQ ID NO: 93618 - DNA, 22 bp, Artificial Sequence
  Synthetic oligonucleotide; TTC chr11 5281463 5281484 5281480 5281485 +
tctcactgtggattattttaga

SEQ ID NO: 93619 - DNA, 22 bp, Artificial Sequence
  Synthetic oligonucleotide; CTC chr11 5281465 5281486 5281482 5281487 +
tcactgtggattattttagaga

SEQ ID NO: 93620 - DNA, 22 bp, Artificial Sequence
  Synthetic oligonucleotide; CTC chr11 5281467 5281488 5281484 5281489 +
actgtggattattttagagagt

SEQ ID NO: 93621 - DNA, 22 bp, Artificial Sequence
  Synthetic oligonucleotide; CTG chr11 5281471 5281492 5281488 5281493 +
tggattattttagagagtggag

SEQ ID NO: 93622 - DNA, 22 bp, Artificial Sequence
  Synthetic oligonucleotide; TTA chr11 5281478 5281499 5281495 5281500 +
ttttagagagtggagaatggtc

SEQ ID NO: 93623 - DNA, 22 bp, Artificial Sequence
  Synthetic oligonucleotide; TTT chr11 5281481 5281502 5281498 5281503 +
tagagagtggagaatggtcaag

SEQ ID NO: 93624 - DNA, 22 bp, Artificial Sequence
  Synthetic oligonucleotide; TTT chr11 5281482 5281503 5281499 5281504 +
agagagtggagaatggtcaaga

SEQ ID NO: 93625 - DNA, 22 bp, Artificial Sequence
  Synthetic oligonucleotide; TTA chr11 5281483 5281504 5281500 5281505 +
gagagtggagaatggtcaagat

SEQ ID NO: 93626 - DNA, 22 bp, Artificial Sequence
  Synthetic oligonucleotide; TTT chr11 5281507 5281528 5281524 5281529 +
ttttaaaaattaagaaaacata

SEQ ID NO: 93627 - DNA, 22 bp, Artificial Sequence
  Synthetic oligonucleotide; TTT chr11 5281508 5281529 5281525 5281530 +
tttaaaaattaagaaaacataa

SEQ ID NO: 93628 - DNA, 22 bp, Artificial Sequence
  Synthetic oligonucleotide; TTT chr11 5281509 5281530 5281526 5281531 +
ttaaaaattaagaaaacataag

SEQ ID NO: 93629 - DNA, 22 bp, Artificial Sequence
  Synthetic oligonucleotide; TTT chr11 5281510 5281531 5281527 5281532 +
taaaaattaagaaaacataagt

SEQ ID NO: 93630 - DNA, 22 bp, Artificial Sequence
  Synthetic oligonucleotide; TTT chr11 5281511 5281532 5281528 5281533 +
aaaaattaagaaaacataagtt

SEQ ID NO: 93631 - DNA, 22 bp, Artificial Sequence
  Synthetic oligonucleotide; TTA chr11 5281512 5281533 5281529 5281534 +
aaaattaagaaaacataagttg

SEQ ID NO: 93632 - DNA, 22 bp, Artificial Sequence
  Synthetic oligonucleotide; TTA chr11 5281519 5281540 5281536 5281541 +
agaaaacataagttggaccttg

SEQ ID NO: 93633 - DNA, 22 bp, Artificial Sequence
  Synthetic oligonucleotide; TTG chr11 5281534 5281555 5281551 5281556 +
gaccttgagaaatgaaaattta

SEQ ID NO: 93634 - DNA, 22 bp, Artificial Sequence
  Synthetic oligonucleotide; CTT chr11 5281540 5281561 5281557 5281562 +
gagaaatgaaaatttatttttt

SEQ ID NO: 93635 - DNA, 22 bp, Artificial Sequence
  Synthetic oligonucleotide; TTG chr11 5281541 5281562 5281558 5281563 +
agaaatgaaaatttattttttt

SEQ ID NO: 93636 - DNA, 22 bp, Artificial Sequence
  Synthetic oligonucleotide; TTT chr11 5281555 5281576 5281572 5281577 +
atttttttgttggaggataccc

SEQ ID NO: 93637 - DNA, 22 bp, Artificial Sequence
  Synthetic oligonucleotide; TTA chr11 5281556 5281577 5281573 5281578 +
tttttttgttggaggataccca

SEQ ID NO: 93638 - DNA, 22 bp, Artificial Sequence
  Synthetic oligonucleotide; TTT chr11 5281559 5281580 5281576 5281581 +
ttttgttggaggatacccattc

SEQ ID NO: 93639 - DNA, 22 bp, Artificial Sequence
  Synthetic oligonucleotide; TTT chr11 5281560 5281581 5281577 5281582 +
tttgttggaggatacccattct

SEQ ID NO: 93640 - DNA, 22 bp, Artificial Sequence
  Synthetic oligonucleotide; TTT chr11 5281561 5281582 5281578 5281583 +
ttgttggaggatacccattctc

SEQ ID NO: 93641 - DNA, 22 bp, Artificial Sequence
  Synthetic oligonucleotide; TTT chr11 5281562 5281583 5281579 5281584 +
tgttggaggatacccattctct

SEQ ID NO: 93642 - DNA, 22 bp, Artificial Sequence
  Synthetic oligonucleotide; TTT chr11 5281563 5281584 5281580 5281585 +
gttggaggatacccattctcta

SEQ ID NO: 93643 - DNA, 22 bp, Artificial Sequence
  Synthetic oligonucleotide; TTG chr11 5281564 5281585 5281581 5281586 +
ttggaggatacccattctctat

SEQ ID NO: 93644 - DNA, 22 bp, Artificial Sequence
  Synthetic oligonucleotide; TTG chr11 5281567 5281588 5281584 5281589 +
gaggatacccattctctatctc

SEQ ID NO: 93645 - DNA, 22 bp, Artificial Sequence
  Synthetic oligonucleotide; TTC chr11 5281581 5281602 5281598 5281603 +
tctatctcccatcagggcaagc

SEQ ID NO: 93646 - DNA, 22 bp, Artificial Sequence
  Synthetic oligonucleotide; CTC chr11 5281583 5281604 5281600 5281605 +
tatctcccatcagggcaagctg

SEQ ID NO: 93647 - DNA, 22 bp, Artificial Sequence
  Synthetic oligonucleotide; CTA chr11 5281585 5281606 5281602 5281607 +
tctcccatcagggcaagctgta

SEQ ID NO: 93648 - DNA, 22 bp, Artificial Sequence
  Synthetic oligonucleotide; CTC chr11 5281589 5281610 5281606 5281611 +
ccatcagggcaagctgtaagga

SEQ ID NO: 93649 - DNA, 22 bp, Artificial Sequence
  Synthetic oligonucleotide; CTG chr11 5281605 5281626 5281622 5281627 +
taaggaactggctaagacacag

SEQ ID NO: 93650 - DNA, 22 bp, Artificial Sequence
  Synthetic oligonucleotide; CTG chr11 5281615 5281636 5281632 5281637 +
gctaagacacagtgagacagag

SEQ ID NO: 93651 - DNA, 22 bp, Artificial Sequence
  Synthetic oligonucleotide; CTA chr11 5281619 5281640 5281636 5281641 +
agacacagtgagacagagtgac

SEQ ID NO: 93652 - DNA, 22 bp, Artificial Sequence
  Synthetic oligonucleotide; CTT chr11 5281643 5281664 5281660 5281665 +
agtcttagaggccccactggta

SEQ ID NO: 93653 - DNA, 22 bp, Artificial Sequence
  Synthetic oligonucleotide; TTA chr11 5281644 5281665 5281661 5281666 +
gtcttagaggccccactggtac

SEQ ID NO: 93654 - DNA, 22 bp, Artificial Sequence
  Synthetic oligonucleotide; CTT chr11 5281649 5281670 5281666 5281671 +
agaggccccactggtacccaga

SEQ ID NO: 93655 - DNA, 22 bp, Artificial Sequence
  Synthetic oligonucleotide; TTA chr11 5281650 5281671 5281667 5281672 +
gaggccccactggtacccagat

SEQ ID NO: 93656 - DNA, 22 bp, Artificial Sequence
  Synthetic oligonucleotide; CTG chr11 5281662 5281683 5281679 5281684 +
gtacccagatgagaaggcacct

SEQ ID NO: 93657 - DNA, 22 bp, Artificial Sequence
  Synthetic oligonucleotide; CTT chr11 5281685 5281706 5281702 5281707 +
catcactcatcacagtcagctc

SEQ ID NO: 93658 - DNA, 22 bp, Artificial Sequence
  Synthetic oligonucleotide; TTC chr11 5281686 5281707 5281703 5281708 +
atcactcatcacagtcagctct

SEQ ID NO: 93659 - DNA, 22 bp, Artificial Sequence
  Synthetic oligonucleotide; CTC chr11 5281693 5281714 5281710 5281715 +
atcacagtcagctctgcctttc

SEQ ID NO: 93660 - DNA, 22 bp, Artificial Sequence
  Synthetic oligonucleotide; CTC chr11 5281707 5281728 5281724 5281729 +
tgcctttctcctctctcctttc

SEQ ID NO: 93661 - DNA, 22 bp, Artificial Sequence
  Synthetic oligonucleotide; CTG chr11 5281709 5281730 5281726 5281731 +
cctttctcctctctcctttctc

SEQ ID NO: 93662 - DNA, 22 bp, Artificial Sequence
  Synthetic oligonucleotide; CTT chr11 5281713 5281734 5281730 5281735 +
tctcctctctcctttctcatca

SEQ ID NO: 93663 - DNA, 22 bp, Artificial Sequence
  Synthetic oligonucleotide; TTT chr11 5281714 5281735 5281731 5281736 +
ctcctctctcctttctcatcag

SEQ ID NO: 93664 - DNA, 22 bp, Artificial Sequence
  Synthetic oligonucleotide; TTC chr11 5281715 5281736 5281732 5281737 +
tcctctctcctttctcatcaga

SEQ ID NO: 93665 - DNA, 22 bp, Artificial Sequence
  Synthetic oligonucleotide; CTC chr11 5281717 5281738 5281734 5281739 +
ctctctcctttctcatcagaaa

SEQ ID NO: 93666 - DNA, 22 bp, Artificial Sequence
  Synthetic oligonucleotide; CTC chr11 5281720 5281741 5281737 5281742 +
tctcctttctcatcagaaattt

SEQ ID NO: 93667 - DNA, 22 bp, Artificial Sequence
  Synthetic oligonucleotide; CTC chr11 5281722 5281743 5281739 5281744 +
tcctttctcatcagaaatttca

SEQ ID NO: 93668 - DNA, 22 bp, Artificial Sequence
  Synthetic oligonucleotide; CTC chr11 5281724 5281745 5281741 5281746 +
ctttctcatcagaaatttcata

SEQ ID NO: 93669 - DNA, 22 bp, Artificial Sequence
  Synthetic oligonucleotide; CTT chr11 5281727 5281748 5281744 5281749 +
tctcatcagaaatttcataagt

SEQ ID NO: 93670 - DNA, 22 bp, Artificial Sequence
  Synthetic oligonucleotide; TTT chr11 5281728 5281749 5281745 5281750 +
ctcatcagaaatttcataagtc

SEQ ID NO: 93671 - DNA, 22 bp, Artificial Sequence
  Synthetic oligonucleotide; TTC chr11 5281729 5281750 5281746 5281751 +
tcatcagaaatttcataagtct

SEQ ID NO: 93672 - DNA, 22 bp, Artificial Sequence
  Synthetic oligonucleotide; CTC chr11 5281731 5281752 5281748 5281753 +
atcagaaatttcataagtctac

SEQ ID NO: 93673 - DNA, 22 bp, Artificial Sequence
  Synthetic oligonucleotide; TTT chr11 5281742 5281763 5281759 5281764 +
cataagtctactagggtcaggc

SEQ ID NO: 93674 - DNA, 22 bp, Artificial Sequence
  Synthetic oligonucleotide; TTC chr11 5281743 5281764 5281760 5281765 +
ataagtctactagggtcaggca

SEQ ID NO: 93675 - DNA, 22 bp, Artificial Sequence
  Synthetic oligonucleotide; CTA chr11 5281752 5281773 5281769 5281774 +
ctagggtcaggcagatcacata

SEQ ID NO: 93676 - DNA, 22 bp, Artificial Sequence
  Synthetic oligonucleotide; CTA chr11 5281755 5281776 5281772 5281777 +
gggtcaggcagatcacataaga

SEQ ID NO: 93677 - DNA, 22 bp, Artificial Sequence
  Synthetic oligonucleotide; TTA chr11 5281794 5281815 5281811 5281816 +
aggtctgcagtgagtatgagcc

SEQ ID NO: 93678 - DNA, 22 bp, Artificial Sequence
  Synthetic oligonucleotide; CTG chr11 5281801 5281822 5281818 5281823 +
cagtgagtatgagcccatccct

SEQ ID NO: 93679 - DNA, 22 bp, Artificial Sequence
  Synthetic oligonucleotide; CTG chr11 5281824 5281845 5281841 5281846 +
atgaattaaggcaatcaacact

SEQ ID NO: 93680 - DNA, 22 bp, Artificial Sequence
  Synthetic oligonucleotide; TTA chr11 5281832 5281853 5281849 5281854 +
aggcaatcaacactttaggcag

SEQ ID NO: 93681 - DNA, 22 bp, Artificial Sequence
  Synthetic oligonucleotide; CTT chr11 5281847 5281868 5281864 5281869 +
taggcagccatgttgccatgag

SEQ ID NO: 93682 - DNA, 22 bp, Artificial Sequence
  Synthetic oligonucleotide; TTT chr11 5281848 5281869 5281865 5281870 +
aggcagccatgttgccatgaga

SEQ ID NO: 93683 - DNA, 22 bp, Artificial Sequence
  Synthetic oligonucleotide; TTA chr11 5281849 5281870 5281866 5281871 +
ggcagccatgttgccatgagag

SEQ ID NO: 93684 - DNA, 22 bp, Artificial Sequence
  Synthetic oligonucleotide; TTG chr11 5281862 5281883 5281879 5281884 +
ccatgagagattaggaggggcc

SEQ ID NO: 93685 - DNA, 22 bp, Artificial Sequence
  Synthetic oligonucleotide; TTA chr11 5281875 5281896 5281892 5281897 +
ggaggggccaaatgagcccaga

SEQ ID NO: 93686 - DNA, 22 bp, Artificial Sequence
  Synthetic oligonucleotide; CTA chr11 5281908 5281929 5281925 5281930 +
cttcttagatgatcttgagcaa

SEQ ID NO: 93687 - DNA, 22 bp, Artificial Sequence
  Synthetic oligonucleotide; CTT chr11 5281911 5281932 5281928 5281933 +
cttagatgatcttgagcaagtt

SEQ ID NO: 93688 - DNA, 22 bp, Artificial Sequence
  Synthetic oligonucleotide; TTC chr11 5281912 5281933 5281929 5281934 +
ttagatgatcttgagcaagttg

SEQ ID NO: 93689 - DNA, 22 bp, Artificial Sequence
  Synthetic oligonucleotide; CTT chr11 5281914 5281935 5281931 5281936 +
agatgatcttgagcaagttgct

SEQ ID NO: 93690 - DNA, 22 bp, Artificial Sequence
  Synthetic oligonucleotide; TTA chr11 5281915 5281936 5281932 5281937 +
gatgatcttgagcaagttgctt

SEQ ID NO: 93691 - DNA, 22 bp, Artificial Sequence
  Synthetic oligonucleotide; CTT chr11 5281924 5281945 5281941 5281946 +
gagcaagttgcttaacttcttg

SEQ ID NO: 93692 - DNA, 22 bp, Artificial Sequence
  Synthetic oligonucleotide; TTG chr11 5281925 5281946 5281942 5281947 +
agcaagttgcttaacttcttga

SEQ ID NO: 93693 - DNA, 22 bp, Artificial Sequence
  Synthetic oligonucleotide; TTG chr11 5281934 5281955 5281951 5281956 +
cttaacttcttgaagtctctga

SEQ ID NO: 93694 - DNA, 22 bp, Artificial Sequence
  Synthetic oligonucleotide; CTT chr11 5281937 5281958 5281954 5281959 +
aacttcttgaagtctctgaaat

SEQ ID NO: 93695 - DNA, 22 bp, Artificial Sequence
  Synthetic oligonucleotide; TTA chr11 5281938 5281959 5281955 5281960 +
acttcttgaagtctctgaaata

SEQ ID NO: 93696 - DNA, 22 bp, Artificial Sequence
  Synthetic oligonucleotide; CTT chr11 5281942 5281963 5281959 5281964 +
cttgaagtctctgaaatatagg

SEQ ID NO: 93697 - DNA, 22 bp, Artificial Sequence
  Synthetic oligonucleotide; TTC chr11 5281943 5281964 5281960 5281965 +
ttgaagtctctgaaatatagga

SEQ ID NO: 93698 - DNA, 22 bp, Artificial Sequence
  Synthetic oligonucleotide; CTT chr11 5281945 5281966 5281962 5281967 +
gaagtctctgaaatataggatg

SEQ ID NO: 93699 - DNA, 22 bp, Artificial Sequence
  Synthetic oligonucleotide; TTG chr11 5281946 5281967 5281963 5281968 +
aagtctctgaaatataggatga

SEQ ID NO: 93700 - DNA, 22 bp, Artificial Sequence
  Synthetic oligonucleotide; CTC chr11 5281953 5281974 5281970 5281975 +
tgaaatataggatgataatatg

SEQ ID NO: 93701 - DNA, 22 bp, Artificial Sequence
  Synthetic oligonucleotide; CTG chr11 5281955 5281976 5281972 5281977 +
aaatataggatgataatatgta

SEQ ID NO: 93702 - DNA, 22 bp, Artificial Sequence
  Synthetic oligonucleotide; TTA chr11 5281980 5282001 5281997 5282002 +
gctaatagaattatgaggatga

SEQ ID NO: 93703 - DNA, 22 bp, Artificial Sequence
  Synthetic oligonucleotide; CTA chr11 5281984 5282005 5282001 5282006 +
atagaattatgaggatgagatt

SEQ ID NO: 93704 - DNA, 22 bp, Artificial Sequence
  Synthetic oligonucleotide; TTA chr11 5281993 5282014 5282010 5282015 +
tgaggatgagattagtttattg

SEQ ID NO: 93705 - DNA, 22 bp, Artificial Sequence
  Synthetic oligonucleotide; TTA chr11 5282007 5282028 5282024 5282029 +
gtttattgtgtaaagaactagg

SEQ ID NO: 93706 - DNA, 22 bp, Artificial Sequence
  Synthetic oligonucleotide; TTT chr11 5282011 5282032 5282028 5282033 +
attgtgtaaagaactagggaca

SEQ ID NO: 93707 - DNA, 22 bp, Artificial Sequence
  Synthetic oligonucleotide; TTA chr11 5282012 5282033 5282029 5282034 +
ttgtgtaaagaactagggacac

SEQ ID NO: 93708 - DNA, 22 bp, Artificial Sequence
  Synthetic oligonucleotide; TTG chr11 5282015 5282036 5282032 5282037 +
tgtaaagaactagggacacagt

SEQ ID NO: 93709 - DNA, 22 bp, Artificial Sequence
  Synthetic oligonucleotide; CTA chr11 5282027 5282048 5282044 5282049 +
gggacacagtatatattcagta

SEQ ID NO: 93710 - DNA, 22 bp, Artificial Sequence
  Synthetic oligonucleotide; TTC chr11 5282045 5282066 5282062 5282067 +
agtaagtgttttctgttacagt

SEQ ID NO: 93711 - DNA, 22 bp, Artificial Sequence
  Synthetic oligonucleotide; TTT chr11 5282056 5282077 5282073 5282078 +
tctgttacagtattatgataaa

SEQ ID NO: 93712 - DNA, 22 bp, Artificial Sequence
  Synthetic oligonucleotide; TTT chr11 5282057 5282078 5282074 5282079 +
ctgttacagtattatgataaat

SEQ ID NO: 93713 - DNA, 22 bp, Artificial Sequence
  Synthetic oligonucleotide; TTC chr11 5282058 5282079 5282075 5282080 +
tgttacagtattatgataaata

SEQ ID NO: 93714 - DNA, 22 bp, Artificial Sequence
  Synthetic oligonucleotide; CTG chr11 5282060 5282081 5282077 5282082 +
ttacagtattatgataaatata

SEQ ID NO: 93715 - DNA, 22 bp, Artificial Sequence
  Synthetic oligonucleotide; TTA chr11 5282063 5282084 5282080 5282085 +
cagtattatgataaatatatac

SEQ ID NO: 93716 - DNA, 22 bp, Artificial Sequence
  Synthetic oligonucleotide; TTA chr11 5282071 5282092 5282088 5282093 +
tgataaatatatacatgcaact

SEQ ID NO: 93717 - DNA, 22 bp, Artificial Sequence
  Synthetic oligonucleotide; CTA chr11 5282094 5282115 5282111 5282116 +
ttacagttgcatgctaccttaa

SEQ ID NO: 93718 - DNA, 22 bp, Artificial Sequence
  Synthetic oligonucleotide; TTA chr11 5282097 5282118 5282114 5282119 +
cagttgcatgctaccttaaaga

SEQ ID NO: 93719 - DNA, 22 bp, Artificial Sequence
  Synthetic oligonucleotide; TTG chr11 5282103 5282124 5282120 5282125 +
catgctaccttaaagaataatt

SEQ ID NO: 93720 - DNA, 22 bp, Artificial Sequence
  Synthetic oligonucleotide; CTA chr11 5282110 5282131 5282127 5282132 +
ccttaaagaataattggaggta

SEQ ID NO: 93721 - DNA, 22 bp, Artificial Sequence
  Synthetic oligonucleotide; CTT chr11 5282114 5282135 5282131 5282136 +
aaagaataattggaggtacagt

SEQ ID NO: 93722 - DNA, 22 bp, Artificial Sequence
  Synthetic oligonucleotide; TTA chr11 5282115 5282136 5282132 5282137 +
aagaataattggaggtacagtt

SEQ ID NO: 93723 - DNA, 22 bp, Artificial Sequence
  Synthetic oligonucleotide; TTG chr11 5282126 5282147 5282143 5282148 +
gaggtacagttattcggaggta

SEQ ID NO: 93724 - DNA, 22 bp, Artificial Sequence
  Synthetic oligonucleotide; TTA chr11 5282138 5282159 5282155 5282160 +
ttcggaggtatttcttgactgt

SEQ ID NO: 93725 - DNA, 22 bp, Artificial Sequence
  Synthetic oligonucleotide; TTC chr11 5282141 5282162 5282158 5282163 +
ggaggtatttcttgactgttaa

SEQ ID NO: 93726 - DNA, 22 bp, Artificial Sequence
  Synthetic oligonucleotide; TTT chr11 5282151 5282172 5282168 5282173 +
cttgactgttaatgttggcagc

SEQ ID NO: 93727 - DNA, 22 bp, Artificial Sequence
  Synthetic oligonucleotide; TTC chr11 5282152 5282173 5282169 5282174 +
ttgactgttaatgttggcagca

SEQ ID NO: 93728 - DNA, 22 bp, Artificial Sequence
  Synthetic oligonucleotide; CTT chr11 5282154 5282175 5282171 5282176 +
gactgttaatgttggcagcaga

SEQ ID NO: 93729 - DNA, 22 bp, Artificial Sequence
  Synthetic oligonucleotide; TTG chr11 5282155 5282176 5282172 5282177 +
actgttaatgttggcagcagat

SEQ ID NO: 93730 - DNA, 22 bp, Artificial Sequence
  Synthetic oligonucleotide; CTG chr11 5282159 5282180 5282176 5282181 +
ttaatgttggcagcagattcag

SEQ ID NO: 93731 - DNA, 22 bp, Artificial Sequence
  Synthetic oligonucleotide; TTA chr11 5282162 5282183 5282179 5282184 +
atgttggcagcagattcagctt

SEQ ID NO: 93732 - DNA, 22 bp, Artificial Sequence
  Synthetic oligonucleotide; TTG chr11 5282168 5282189 5282185 5282190 +
gcagcagattcagcttatttta

SEQ ID NO: 93733 - DNA, 22 bp, Artificial Sequence
  Synthetic oligonucleotide; TTC chr11 5282179 5282200 5282196 5282201 +
agcttattttacaacactattc

SEQ ID NO: 93734 - DNA, 22 bp, Artificial Sequence
  Synthetic oligonucleotide; CTT chr11 5282184 5282205 5282201 5282206 +
attttacaacactattcagacc

SEQ ID NO: 93735 - DNA, 22 bp, Artificial Sequence
  Synthetic oligonucleotide; TTA chr11 5282185 5282206 5282202 5282207 +
ttttacaacactattcagacct

SEQ ID NO: 93736 - DNA, 22 bp, Artificial Sequence
  Synthetic oligonucleotide; TTT chr11 5282188 5282209 5282205 5282210 +
tacaacactattcagacctctc

SEQ ID NO: 93737 - DNA, 22 bp, Artificial Sequence
  Synthetic oligonucleotide; TTT chr11 5282189 5282210 5282206 5282211 +
acaacactattcagacctctca

SEQ ID NO: 93738 - DNA, 22 bp, Artificial Sequence
  Synthetic oligonucleotide; TTA chr11 5282190 5282211 5282207 5282212 +
caacactattcagacctctcac

SEQ ID NO: 93739 - DNA, 22 bp, Artificial Sequence
  Synthetic oligonucleotide; CTA chr11 5282198 5282219 5282215 5282220 +
ttcagacctctcacaataattc

SEQ ID NO: 93740 - DNA, 22 bp, Artificial Sequence
  Synthetic oligonucleotide; TTC chr11 5282201 5282222 5282218 5282223 +
agacctctcacaataattccct

SEQ ID NO: 93741 - DNA, 22 bp, Artificial Sequence
  Synthetic oligonucleotide; CTC chr11 5282208 5282229 5282225 5282230 +
tcacaataattccctaggagat

SEQ ID NO: 93742 - DNA, 22 bp, Artificial Sequence
  Synthetic oligonucleotide; CTC chr11 5282210 5282231 5282227 5282232 +
acaataattccctaggagatat

SEQ ID NO: 93743 - DNA, 22 bp, Artificial Sequence
  Synthetic oligonucleotide; TTC chr11 5282220 5282241 5282237 5282242 +
cctaggagatatttagacaaca

SEQ ID NO: 93744 - DNA, 22 bp, Artificial Sequence
  Synthetic oligonucleotide; CTA chr11 5282224 5282245 5282241 5282246 +
ggagatatttagacaacaagcc

SEQ ID NO: 93745 - DNA, 22 bp, Artificial Sequence
  Synthetic oligonucleotide; TTT chr11 5282234 5282255 5282251 5282256 +
agacaacaagccatcatgttgt

SEQ ID NO: 93746 - DNA, 22 bp, Artificial Sequence
  Synthetic oligonucleotide; TTA chr11 5282235 5282256 5282252 5282257 +
gacaacaagccatcatgttgta

SEQ ID NO: 93747 - DNA, 22 bp, Artificial Sequence
  Synthetic oligonucleotide; TTG chr11 5282255 5282276 5282272 5282277 +
taacttctcatttgtcttttct

SEQ ID NO: 93748 - DNA, 22 bp, Artificial Sequence
  Synthetic oligonucleotide; CTT chr11 5282261 5282282 5282278 5282283 +
ctcatttgtcttttctcactta

SEQ ID NO: 93749 - DNA, 22 bp, Artificial Sequence
  Synthetic oligonucleotide; TTC chr11 5282262 5282283 5282279 5282284 +
tcatttgtcttttctcacttac

SEQ ID NO: 93750 - DNA, 22 bp, Artificial Sequence
  Synthetic oligonucleotide; CTC chr11 5282264 5282285 5282281 5282286 +
atttgtcttttctcacttaccc

SEQ ID NO: 93751 - DNA, 22 bp, Artificial Sequence
  Synthetic oligonucleotide; TTT chr11 5282268 5282289 5282285 5282290 +
gtcttttctcacttaccctctc

SEQ ID NO: 93752 - DNA, 22 bp, Artificial Sequence
  Synthetic oligonucleotide; TTG chr11 5282269 5282290 5282286 5282291 +
tcttttctcacttaccctctca

SEQ ID NO: 93753 - DNA, 22 bp, Artificial Sequence
  Synthetic oligonucleotide; CTT chr11 5282273 5282294 5282290 5282295 +
ttctcacttaccctctcattca

SEQ ID NO: 93754 - DNA, 22 bp, Artificial Sequence
  Synthetic oligonucleotide; TTT chr11 5282274 5282295 5282291 5282296 +
tctcacttaccctctcattcac

SEQ ID NO: 93755 - DNA, 22 bp, Artificial Sequence
  Synthetic oligonucleotide; TTT chr11 5282275 5282296 5282292 5282297 +
ctcacttaccctctcattcacc

SEQ ID NO: 93756 - DNA, 22 bp, Artificial Sequence
  Synthetic oligonucleotide; TTC chr11 5282276 5282297 5282293 5282298 +
tcacttaccctctcattcaccc

SEQ ID NO: 93757 - DNA, 22 bp, Artificial Sequence
  Synthetic oligonucleotide; CTC chr11 5282278 5282299 5282295 5282300 +
acttaccctctcattcacccac

SEQ ID NO: 93758 - DNA, 22 bp, Artificial Sequence
  Synthetic oligonucleotide; CTT chr11 5282282 5282303 5282299 5282304 +
accctctcattcacccacctct

SEQ ID NO: 93759 - DNA, 22 bp, Artificial Sequence
  Synthetic oligonucleotide; TTA chr11 5282283 5282304 5282300 5282305 +
ccctctcattcacccacctctt

SEQ ID NO: 93760 - DNA, 22 bp, Artificial Sequence
  Synthetic oligonucleotide; CTC chr11 5282288 5282309 5282305 5282310 +
tcattcacccacctcttttgct

SEQ ID NO: 93761 - DNA, 22 bp, Artificial Sequence
  Synthetic oligonucleotide; CTC chr11 5282290 5282311 5282307 5282312 +
attcacccacctcttttgctct

SEQ ID NO: 93762 - DNA, 22 bp, Artificial Sequence
  Synthetic oligonucleotide; TTC chr11 5282294 5282315 5282311 5282316 +
acccacctcttttgctctctgt

SEQ ID NO: 93763 - DNA, 22 bp, Artificial Sequence
  Synthetic oligonucleotide; CTC chr11 5282303 5282324 5282320 5282325 +
ttttgctctctgttcctgtgaa

SEQ ID NO: 93764 - DNA, 22 bp, Artificial Sequence
  Synthetic oligonucleotide; CTT chr11 5282305 5282326 5282322 5282327 +
ttgctctctgttcctgtgaaag

SEQ ID NO: 93765 - DNA, 22 bp, Artificial Sequence
  Synthetic oligonucleotide; TTT chr11 5282306 5282327 5282323 5282328 +
tgctctctgttcctgtgaaagt

SEQ ID NO: 93766 - DNA, 22 bp, Artificial Sequence
  Synthetic oligonucleotide; TTT chr11 5282307 5282328 5282324 5282329 +
gctctctgttcctgtgaaagta

SEQ ID NO: 93767 - DNA, 22 bp, Artificial Sequence
  Synthetic oligonucleotide; TTG chr11 5282308 5282329 5282325 5282330 +
ctctctgttcctgtgaaagtac

SEQ ID NO: 93768 - DNA, 22 bp, Artificial Sequence
  Synthetic oligonucleotide; CTC chr11 5282311 5282332 5282328 5282333 +
tctgttcctgtgaaagtaccct

SEQ ID NO: 93769 - DNA, 22 bp, Artificial Sequence
  Synthetic oligonucleotide; CTC chr11 5282313 5282334 5282330 5282335 +
tgttcctgtgaaagtacccttc

SEQ ID NO: 93770 - DNA, 22 bp, Artificial Sequence
  Synthetic oligonucleotide; CTG chr11 5282315 5282336 5282332 5282337 +
ttcctgtgaaagtacccttcta

SEQ ID NO: 93771 - DNA, 22 bp, Artificial Sequence
  Synthetic oligonucleotide; TTC chr11 5282318 5282339 5282335 5282340 +
ctgtgaaagtacccttctactt

SEQ ID NO: 93772 - DNA, 22 bp, Artificial Sequence
  Synthetic oligonucleotide; CTG chr11 5282321 5282342 5282338 5282343 +
tgaaagtacccttctacttagc

SEQ ID NO: 93773 - DNA, 22 bp, Artificial Sequence
  Synthetic oligonucleotide; CTT chr11 5282334 5282355 5282351 5282356 +
ctacttagcctacttttgacca

SEQ ID NO: 93774 - DNA, 22 bp, Artificial Sequence
  Synthetic oligonucleotide; TTC chr11 5282335 5282356 5282352 5282357 +
tacttagcctacttttgaccag

SEQ ID NO: 93775 - DNA, 22 bp, Artificial Sequence
  Synthetic oligonucleotide; CTA chr11 5282337 5282358 5282354 5282359 +
cttagcctacttttgaccagtg

SEQ ID NO: 93776 - DNA, 22 bp, Artificial Sequence
  Synthetic oligonucleotide; CTT chr11 5282340 5282361 5282357 5282362 +
agcctacttttgaccagtgtgc

SEQ ID NO: 93777 - DNA, 22 bp, Artificial Sequence
  Synthetic oligonucleotide; TTA chr11 5282341 5282362 5282358 5282363 +
gcctacttttgaccagtgtgca

SEQ ID NO: 93778 - DNA, 22 bp, Artificial Sequence
  Synthetic oligonucleotide; CTA chr11 5282346 5282367 5282363 5282368 +
cttttgaccagtgtgcatgtca

SEQ ID NO: 93779 - DNA, 22 bp, Artificial Sequence
  Synthetic oligonucleotide; CTT chr11 5282349 5282370 5282366 5282371 +
ttgaccagtgtgcatgtcactg

SEQ ID NO: 93780 - DNA, 22 bp, Artificial Sequence
  Synthetic oligonucleotide; TTT chr11 5282350 5282371 5282367 5282372 +
tgaccagtgtgcatgtcactgg

SEQ ID NO: 93781 - DNA, 22 bp, Artificial Sequence
  Synthetic oligonucleotide; TTT chr11 5282351 5282372 5282368 5282373 +
gaccagtgtgcatgtcactggg

SEQ ID NO: 93782 - DNA, 22 bp, Artificial Sequence
  Synthetic oligonucleotide; TTG chr11 5282352 5282373 5282369 5282374 +
accagtgtgcatgtcactgggc

SEQ ID NO: 93783 - DNA, 22 bp, Artificial Sequence
  Synthetic oligonucleotide; CTG chr11 5282371 5282392 5282388 5282393 +
ggcaatacaagacctctgagct

SEQ ID NO: 93784 - DNA, 22 bp, Artificial Sequence
  Synthetic oligonucleotide; CTC chr11 5282387 5282408 5282404 5282409 +
tgagctttggcttagaaggaaa

SEQ ID NO: 93785 - DNA, 22 bp, Artificial Sequence
  Synthetic oligonucleotide; CTG chr11 5282389 5282410 5282406 5282411 +
agctttggcttagaaggaaata

SEQ ID NO: 93786 - DNA, 22 bp, Artificial Sequence
  Synthetic oligonucleotide; CTT chr11 5282394 5282415 5282411 5282416 +
tggcttagaaggaaatacaata

SEQ ID NO: 93787 - DNA, 22 bp, Artificial Sequence
  Synthetic oligonucleotide; TTT chr11 5282395 5282416 5282412 5282417 +
ggcttagaaggaaatacaataa

SEQ ID NO: 93788 - DNA, 22 bp, Artificial Sequence
  Synthetic oligonucleotide; TTG chr11 5282396 5282417 5282413 5282418 +
gcttagaaggaaatacaataat

SEQ ID NO: 93789 - DNA, 22 bp, Artificial Sequence
  Synthetic oligonucleotide; CTT chr11 5282400 5282421 5282417 5282422 +
agaaggaaatacaataatggct

SEQ ID NO: 93790 - DNA, 22 bp, Artificial Sequence
  Synthetic oligonucleotide; TTA chr11 5282401 5282422 5282418 5282423 +
gaaggaaatacaataatggcta

SEQ ID NO: 93791 - DNA, 22 bp, Artificial Sequence
  Synthetic oligonucleotide; CTA chr11 5282423 5282444 5282440 5282445 +
atttttgagaaagaggaactct

SEQ ID NO: 93792 - DNA, 22 bp, Artificial Sequence
  Synthetic oligonucleotide; TTT chr11 5282427 5282448 5282444 5282449 +
ttgagaaagaggaactctagcc

SEQ ID NO: 93793 - DNA, 22 bp, Artificial Sequence
  Synthetic oligonucleotide; TTT chr11 5282428 5282449 5282445 5282450 +
tgagaaagaggaactctagccc

SEQ ID NO: 93794 - DNA, 22 bp, Artificial Sequence
  Synthetic oligonucleotide; TTT chr11 5282429 5282450 5282446 5282451 +
gagaaagaggaactctagccca

SEQ ID NO: 93795 - DNA, 22 bp, Artificial Sequence
  Synthetic oligonucleotide; TTG chr11 5282430 5282451 5282447 5282452 +
agaaagaggaactctagcccat

SEQ ID NO: 93796 - DNA, 22 bp, Artificial Sequence
  Synthetic oligonucleotide; CTC chr11 5282444 5282465 5282461 5282466 +
tagcccatcagggaagacatag

SEQ ID NO: 93797 - DNA, 22 bp, Artificial Sequence
  Synthetic oligonucleotide; CTA chr11 5282446 5282467 5282463 5282468 +
gcccatcagggaagacataggg

SEQ ID NO: 93798 - DNA, 22 bp, Artificial Sequence
  Synthetic oligonucleotide; TTC chr11 5282473 5282494 5282490 5282495 +
tgtaggaatgagttcttccatt

SEQ ID NO: 93799 - DNA, 22 bp, Artificial Sequence
  Synthetic oligonucleotide; CTG chr11 5282475 5282496 5282492 5282497 +
taggaatgagttcttccattct

SEQ ID NO: 93800 - DNA, 22 bp, Artificial Sequence
  Synthetic oligonucleotide; TTC chr11 5282488 5282509 5282505 5282510 +
ttccattctttttacagatgag

SEQ ID NO: 93801 - DNA, 22 bp, Artificial Sequence
  Synthetic oligonucleotide; CTT chr11 5282490 5282511 5282507 5282512 +
ccattctttttacagatgagaa

SEQ ID NO: 93802 - DNA, 22 bp, Artificial Sequence
  Synthetic oligonucleotide; TTC chr11 5282491 5282512 5282508 5282513 +
cattctttttacagatgagaaa

SEQ ID NO: 93803 - DNA, 22 bp, Artificial Sequence
  Synthetic oligonucleotide; TTC chr11 5282496 5282517 5282513 5282518 +
tttttacagatgagaaagacaa

SEQ ID NO: 93804 - DNA, 22 bp, Artificial Sequence
  Synthetic oligonucleotide; CTT chr11 5282498 5282519 5282515 5282520 +
tttacagatgagaaagacaatg

SEQ ID NO: 93805 - DNA, 22 bp, Artificial Sequence
  Synthetic oligonucleotide; TTT chr11 5282499 5282520 5282516 5282521 +
ttacagatgagaaagacaatgt

SEQ ID NO: 93806 - DNA, 22 bp, Artificial Sequence
  Synthetic oligonucleotide; TTT chr11 5282500 5282521 5282517 5282522 +
tacagatgagaaagacaatgtg

SEQ ID NO: 93807 - DNA, 22 bp, Artificial Sequence
  Synthetic oligonucleotide; TTT chr11 5282501 5282522 5282518 5282523 +
acagatgagaaagacaatgtga

SEQ ID NO: 93808 - DNA, 22 bp, Artificial Sequence
  Synthetic oligonucleotide; TTA chr11 5282502 5282523 5282519 5282524 +
cagatgagaaagacaatgtgaa

SEQ ID NO: 93809 - DNA, 22 bp, Artificial Sequence
  Synthetic oligonucleotide; TTT chr11 5282538 5282559 5282555 5282560 +
taaagtagttagcatatggaga

SEQ ID NO: 93810 - DNA, 22 bp, Artificial Sequence
  Synthetic oligonucleotide; TTT chr11 5282539 5282560 5282556 5282561 +
aaagtagttagcatatggagaa

SEQ ID NO: 93811 - DNA, 22 bp, Artificial Sequence
  Synthetic oligonucleotide; TTA chr11 5282540 5282561 5282557 5282562 +
aagtagttagcatatggagaaa

SEQ ID NO: 93812 - DNA, 22 bp, Artificial Sequence
  Synthetic oligonucleotide; TTA chr11 5282549 5282570 5282566 5282571 +
gcatatggagaaatggcttgca

SEQ ID NO: 93813 - DNA, 22 bp, Artificial Sequence
  Synthetic oligonucleotide; CTT chr11 5282568 5282589 5282585 5282590 +
gcattggtaaaatttggggaaa

SEQ ID NO: 93814 - DNA, 22 bp, Artificial Sequence
  Synthetic oligonucleotide; TTG chr11 5282569 5282590 5282586 5282591 +
cattggtaaaatttggggaaac

SEQ ID NO: 93815 - DNA, 22 bp, Artificial Sequence
  Synthetic oligonucleotide; TTG chr11 5282574 5282595 5282591 5282596 +
gtaaaatttggggaaactttgt

SEQ ID NO: 93816 - DNA, 22 bp, Artificial Sequence
  Synthetic oligonucleotide; TTT chr11 5282583 5282604 5282600 5282605 +
ggggaaactttgttgtcagacc

SEQ ID NO: 93817 - DNA, 22 bp, Artificial Sequence
  Synthetic oligonucleotide; TTG chr11 5282584 5282605 5282601 5282606 +
gggaaactttgttgtcagaccc

SEQ ID NO: 93818 - DNA, 22 bp, Artificial Sequence
  Synthetic oligonucleotide; CTT chr11 5282593 5282614 5282610 5282615 +
tgttgtcagacccggcaaaggg

SEQ ID NO: 93819 - DNA, 22 bp, Artificial Sequence
  Synthetic oligonucleotide; TTT chr11 5282594 5282615 5282611 5282616 +
gttgtcagacccggcaaaggga

SEQ ID NO: 93820 - DNA, 22 bp, Artificial Sequence
  Synthetic oligonucleotide; TTG chr11 5282595 5282616 5282612 5282617 +
ttgtcagacccggcaaagggag

SEQ ID NO: 93821 - DNA, 22 bp, Artificial Sequence
  Synthetic oligonucleotide; TTG chr11 5282598 5282619 5282615 5282620 +
tcagacccggcaaagggagatg

SEQ ID NO: 93822 - DNA, 22 bp, Artificial Sequence
  Synthetic oligonucleotide; CTG chr11 5282631 5282652 5282648 5282653 +
cagtttcttctcatttcttgtg

SEQ ID NO: 93823 - DNA, 22 bp, Artificial Sequence
  Synthetic oligonucleotide; TTT chr11 5282637 5282658 5282654 5282659 +
cttctcatttcttgtgtaccta

SEQ ID NO: 93824 - DNA, 22 bp, Artificial Sequence
  Synthetic oligonucleotide; TTC chr11 5282638 5282659 5282655 5282660 +
ttctcatttcttgtgtacctat

SEQ ID NO: 93825 - DNA, 22 bp, Artificial Sequence
  Synthetic oligonucleotide; CTT chr11 5282640 5282661 5282657 5282662 +
ctcatttcttgtgtacctatca

SEQ ID NO: 93826 - DNA, 22 bp, Artificial Sequence
  Synthetic oligonucleotide; TTC chr11 5282641 5282662 5282658 5282663 +
tcatttcttgtgtacctatcac

SEQ ID NO: 93827 - DNA, 22 bp, Artificial Sequence
  Synthetic oligonucleotide; CTC chr11 5282643 5282664 5282660 5282665 +
atttcttgtgtacctatcacag

SEQ ID NO: 93828 - DNA, 22 bp, Artificial Sequence
  Synthetic oligonucleotide; TTT chr11 5282647 5282668 5282664 5282669 +
cttgtgtacctatcacagcacc

SEQ ID NO: 93829 - DNA, 22 bp, Artificial Sequence
  Synthetic oligonucleotide; TTC chr11 5282648 5282669 5282665 5282670 +
ttgtgtacctatcacagcacca

SEQ ID NO: 93830 - DNA, 22 bp, Artificial Sequence
  Synthetic oligonucleotide; CTT chr11 5282650 5282671 5282667 5282672 +
gtgtacctatcacagcaccaca

SEQ ID NO: 93831 - DNA, 22 bp, Artificial Sequence
  Synthetic oligonucleotide; TTG chr11 5282651 5282672 5282668 5282673 +
tgtacctatcacagcaccacag

SEQ ID NO: 93832 - DNA, 22 bp, Artificial Sequence
  Synthetic oligonucleotide; CTA chr11 5282659 5282680 5282676 5282681 +
tcacagcaccacagcactattc

SEQ ID NO: 93833 - DNA, 22 bp, Artificial Sequence
  Synthetic oligonucleotide; CTA chr11 5282678 5282699 5282695 5282700 +
ttcctagcatagtttagggccc

SEQ ID NO: 93834 - DNA, 22 bp, Artificial Sequence
  Synthetic oligonucleotide; TTC chr11 5282681 5282702 5282698 5282703 +
ctagcatagtttagggccctca

SEQ ID NO: 93835 - DNA, 22 bp, Artificial Sequence
  Synthetic oligonucleotide; CTA chr11 5282684 5282705 5282701 5282706 +
gcatagtttagggccctcagtt

SEQ ID NO: 93836 - DNA, 22 bp, Artificial Sequence
  Synthetic oligonucleotide; TTT chr11 5282693 5282714 5282710 5282715 +
agggccctcagttcttgacgct

SEQ ID NO: 93837 - DNA, 22 bp, Artificial Sequence
  Synthetic oligonucleotide; TTA chr11 5282694 5282715 5282711 5282716 +
gggccctcagttcttgacgcta

SEQ ID NO: 93838 - DNA, 22 bp, Artificial Sequence
  Synthetic oligonucleotide; CTC chr11 5282702 5282723 5282719 5282724 +
agttcttgacgctagttagaat

SEQ ID NO: 93839 - DNA, 22 bp, Artificial Sequence
  Synthetic oligonucleotide; TTC chr11 5282707 5282728 5282724 5282729 +
ttgacgctagttagaatttcac

SEQ ID NO: 93840 - DNA, 22 bp, Artificial Sequence
  Synthetic oligonucleotide; CTT chr11 5282709 5282730 5282726 5282731 +
gacgctagttagaatttcacac

SEQ ID NO: 93841 - DNA, 22 bp, Artificial Sequence
  Synthetic oligonucleotide; TTG chr11 5282710 5282731 5282727 5282732 +
acgctagttagaatttcacaca

SEQ ID NO: 93842 - DNA, 22 bp, Artificial Sequence
  Synthetic oligonucleotide; CTA chr11 5282716 5282737 5282733 5282738 +
gttagaatttcacacaaactta

SEQ ID NO: 93843 - DNA, 22 bp, Artificial Sequence
  Synthetic oligonucleotide; TTA chr11 5282720 5282741 5282737 5282742 +
gaatttcacacaaacttaaact

SEQ ID NO: 93844 - DNA, 22 bp, Artificial Sequence
  Synthetic oligonucleotide; TTT chr11 5282726 5282747 5282743 5282748 +
cacacaaacttaaactagacaa

SEQ ID NO: 93845 - DNA, 22 bp, Artificial Sequence
  Synthetic oligonucleotide; TTC chr11 5282727 5282748 5282744 5282749 +
acacaaacttaaactagacaaa

SEQ ID NO: 93846 - DNA, 22 bp, Artificial Sequence
  Synthetic oligonucleotide; CTT chr11 5282737 5282758 5282754 5282759 +
aaactagacaaacatatgtatg

SEQ ID NO: 93847 - DNA, 22 bp, Artificial Sequence
  Synthetic oligonucleotide; TTA chr11 5282738 5282759 5282755 5282760 +
aactagacaaacatatgtatgt

SEQ ID NO: 93848 - DNA, 22 bp, Artificial Sequence
  Synthetic oligonucleotide; CTA chr11 5282743 5282764 5282760 5282765 +
gacaaacatatgtatgtttctg

SEQ ID NO: 93849 - DNA, 22 bp, Artificial Sequence
  Synthetic oligonucleotide; TTT chr11 5282762 5282783 5282779 5282784 +
ctgaggcactgaggtcactgca

SEQ ID NO: 93850 - DNA, 22 bp, Artificial Sequence
  Synthetic oligonucleotide; TTC chr11 5282763 5282784 5282780 5282785 +
tgaggcactgaggtcactgcag

SEQ ID NO: 93851 - DNA, 22 bp, Artificial Sequence
  Synthetic oligonucleotide; CTG chr11 5282765 5282786 5282782 5282787 +
aggcactgaggtcactgcagga

SEQ ID NO: 93852 - DNA, 22 bp, Artificial Sequence
  Synthetic oligonucleotide; CTG chr11 5282773 5282794 5282790 5282795 +
aggtcactgcaggatgaagacg

SEQ ID NO: 93853 - DNA, 22 bp, Artificial Sequence
  Synthetic oligonucleotide; CTG chr11 5282782 5282803 5282799 5282804 +
caggatgaagacggagccaatg

SEQ ID NO: 93854 - DNA, 22 bp, Artificial Sequence
  Synthetic oligonucleotide; TTA chr11 5282809 5282830 5282826 5282831 +
gaccagaagagtaaatgaacac

SEQ ID NO: 93855 - DNA, 22 bp, Artificial Sequence
  Synthetic oligonucleotide; CTA chr11 5282833 5282854 5282850 5282855 +
taacacataaacactcccttta

SEQ ID NO: 93856 - DNA, 22 bp, Artificial Sequence
  Synthetic oligonucleotide; CTC chr11 5282849 5282870 5282866 5282871 +
cctttaaccaaagttgcagctt

SEQ ID NO: 93857 - DNA, 22 bp, Artificial Sequence
  Synthetic oligonucleotide; CTT chr11 5282853 5282874 5282870 5282875 +
taaccaaagttgcagcttgacc

SEQ ID NO: 93858 - DNA, 22 bp, Artificial Sequence
  Synthetic oligonucleotide; TTT chr11 5282854 5282875 5282871 5282876 +
aaccaaagttgcagcttgacca

SEQ ID NO: 93859 - DNA, 22 bp, Artificial Sequence
  Synthetic oligonucleotide; TTA chr11 5282855 5282876 5282872 5282877 +
accaaagttgcagcttgaccaa

SEQ ID NO: 93860 - DNA, 22 bp, Artificial Sequence
  Synthetic oligonucleotide; TTG chr11 5282865 5282886 5282882 5282887 +
cagcttgaccaaggggtcaaag

SEQ ID NO: 93861 - DNA, 22 bp, Artificial Sequence
  Synthetic oligonucleotide; CTT chr11 5282871 5282892 5282888 5282893 +
gaccaaggggtcaaagggtaat

SEQ ID NO: 93862 - DNA, 22 bp, Artificial Sequence
  Synthetic oligonucleotide; TTG chr11 5282872 5282893 5282889 5282894 +
accaaggggtcaaagggtaatt

SEQ ID NO: 93863 - DNA, 22 bp, Artificial Sequence
  Synthetic oligonucleotide; TTT chr11 5282895 5282916 5282912 5282917 +
gggcaggcatgggccttcagtt

SEQ ID NO: 93864 - DNA, 22 bp, Artificial Sequence
  Synthetic oligonucleotide; TTG chr11 5282896 5282917 5282913 5282918 +
ggcaggcatgggccttcagttt

SEQ ID NO: 93865 - DNA, 22 bp, Artificial Sequence
  Synthetic oligonucleotide; CTT chr11 5282912 5282933 5282929 5282934 +
cagttttctcaagtgtctgctt

SEQ ID NO: 93866 - DNA, 22 bp, Artificial Sequence
  Synthetic oligonucleotide; TTC chr11 5282913 5282934 5282930 5282935 +
agttttctcaagtgtctgctta

SEQ ID NO: 93867 - DNA, 22 bp, Artificial Sequence
  Synthetic oligonucleotide; TTT chr11 5282918 5282939 5282935 5282940 +
tctcaagtgtctgcttataatt

SEQ ID NO: 93868 - DNA, 22 bp, Artificial Sequence
  Synthetic oligonucleotide; TTT chr11 5282919 5282940 5282936 5282941 +
ctcaagtgtctgcttataattt

SEQ ID NO: 93869 - DNA, 22 bp, Artificial Sequence
  Synthetic oligonucleotide; TTC chr11 5282920 5282941 5282937 5282942 +
tcaagtgtctgcttataatttg

SEQ ID NO: 93870 - DNA, 22 bp, Artificial Sequence
  Synthetic oligonucleotide; CTC chr11 5282922 5282943 5282939 5282944 +
aagtgtctgcttataatttgtc

SEQ ID NO: 93871 - DNA, 22 bp, Artificial Sequence
  Synthetic oligonucleotide; CTG chr11 5282931 5282952 5282948 5282953 +
cttataatttgtcatatgacaa

SEQ ID NO: 93872 - DNA, 22 bp, Artificial Sequence
  Synthetic oligonucleotide; CTT chr11 5282934 5282955 5282951 5282956 +
ataatttgtcatatgacaatct

SEQ ID NO: 93873 - DNA, 22 bp, Artificial Sequence
  Synthetic oligonucleotide; TTA chr11 5282935 5282956 5282952 5282957 +
taatttgtcatatgacaatctc

SEQ ID NO: 93874 - DNA, 22 bp, Artificial Sequence
  Synthetic oligonucleotide; TTT chr11 5282941 5282962 5282958 5282963 +
gtcatatgacaatctctgtaac

SEQ ID NO: 93875 - DNA, 22 bp, Artificial Sequence
  Synthetic oligonucleotide; TTG chr11 5282942 5282963 5282959 5282964 +
tcatatgacaatctctgtaacc

SEQ ID NO: 93876 - DNA, 22 bp, Artificial Sequence
  Synthetic oligonucleotide; CTC chr11 5282957 5282978 5282974 5282979 +
tgtaacccaagagaaaatctct

SEQ ID NO: 93877 - DNA, 22 bp, Artificial Sequence
  Synthetic oligonucleotide; CTG chr11 5282959 5282980 5282976 5282981 +
taacccaagagaaaatctcttt

SEQ ID NO: 93878 - DNA, 22 bp, Artificial Sequence
  Synthetic oligonucleotide; CTC chr11 5282978 5282999 5282995 5283000 +
tttattctgaagttgtttctaa

SEQ ID NO: 93879 - DNA, 22 bp, Artificial Sequence
  Synthetic oligonucleotide; CTT chr11 5282980 5283001 5282997 5283002 +
tattctgaagttgtttctaaat

SEQ ID NO: 93880 - DNA, 22 bp, Artificial Sequence
  Synthetic oligonucleotide; TTT chr11 5282981 5283002 5282998 5283003 +
attctgaagttgtttctaaatt

SEQ ID NO: 93881 - DNA, 22 bp, Artificial Sequence
  Synthetic oligonucleotide; TTA chr11 5282982 5283003 5282999 5283004 +
ttctgaagttgtttctaaattt

SEQ ID NO: 93882 - DNA, 22 bp, Artificial Sequence
  Synthetic oligonucleotide; TTC chr11 5282985 5283006 5283002 5283007 +
tgaagttgtttctaaatttttc

SEQ ID NO: 93883 - DNA, 22 bp, Artificial Sequence
  Synthetic oligonucleotide; CTG chr11 5282987 5283008 5283004 5283009 +
aagttgtttctaaatttttctt

SEQ ID NO: 93884 - DNA, 22 bp, Artificial Sequence
  Synthetic oligonucleotide; TTG chr11 5282993 5283014 5283010 5283015 +
tttctaaatttttctttacctt

SEQ ID NO: 93885 - DNA, 22 bp, Artificial Sequence
  Synthetic oligonucleotide; TTT chr11 5282996 5283017 5283013 5283018 +
ctaaatttttctttaccttttt

SEQ ID NO: 93886 - DNA, 22 bp, Artificial Sequence
  Synthetic oligonucleotide; TTC chr11 5282997 5283018 5283014 5283019 +
taaatttttctttacctttttc

SEQ ID NO: 93887 - DNA, 22 bp, Artificial Sequence
  Synthetic oligonucleotide; CTA chr11 5282999 5283020 5283016 5283021 +
aatttttctttacctttttctc

SEQ ID NO: 93888 - DNA, 22 bp, Artificial Sequence
  Synthetic oligonucleotide; TTT chr11 5283004 5283025 5283021 5283026 +
ttctttacctttttctccctca

SEQ ID NO: 93889 - DNA, 22 bp, Artificial Sequence
  Synthetic oligonucleotide; TTT chr11 5283005 5283026 5283022 5283027 +
tctttacctttttctccctcaa

SEQ ID NO: 93890 - DNA, 22 bp, Artificial Sequence
  Synthetic oligonucleotide; TTT chr11 5283006 5283027 5283023 5283028 +
ctttacctttttctccctcaaa

SEQ ID NO: 93891 - DNA, 22 bp, Artificial Sequence
  Synthetic oligonucleotide; TTC chr11 5283007 5283028 5283024 5283029 +
tttacctttttctccctcaaac

SEQ ID NO: 93892 - DNA, 22 bp, Artificial Sequence
  Synthetic oligonucleotide; CTT chr11 5283009 5283030 5283026 5283031 +
tacctttttctccctcaaactt

SEQ ID NO: 93893 - DNA, 22 bp, Artificial Sequence
  Synthetic oligonucleotide; TTT chr11 5283010 5283031 5283027 5283032 +
acctttttctccctcaaacttt

SEQ ID NO: 93894 - DNA, 22 bp, Artificial Sequence
  Synthetic oligonucleotide; TTA chr11 5283011 5283032 5283028 5283033 +
cctttttctccctcaaactttc

SEQ ID NO: 93895 - DNA, 22 bp, Artificial Sequence
  Synthetic oligonucleotide; CTT chr11 5283015 5283036 5283032 5283037 +
tttctccctcaaactttcctga

SEQ ID NO: 93896 - DNA, 22 bp, Artificial Sequence
  Synthetic oligonucleotide; TTT chr11 5283016 5283037 5283033 5283038 +
ttctccctcaaactttcctgaa

SEQ ID NO: 93897 - DNA, 22 bp, Artificial Sequence
  Synthetic oligonucleotide; TTT chr11 5283017 5283038 5283034 5283039 +
tctccctcaaactttcctgaag

SEQ ID NO: 93898 - DNA, 22 bp, Artificial Sequence
  Synthetic oligonucleotide; TTT chr11 5283018 5283039 5283035 5283040 +
ctccctcaaactttcctgaaga

SEQ ID NO: 93899 - DNA, 22 bp, Artificial Sequence
  Synthetic oligonucleotide; TTC chr11 5283019 5283040 5283036 5283041 +
tccctcaaactttcctgaagaa

SEQ ID NO: 93900 - DNA, 22 bp, Artificial Sequence
  Synthetic oligonucleotide; CTC chr11 5283021 5283042 5283038 5283043 +
cctcaaactttcctgaagaaat

SEQ ID NO: 93901 - DNA, 22 bp, Artificial Sequence
  Synthetic oligonucleotide; CTC chr11 5283025 5283046 5283042 5283047 +
aaactttcctgaagaaatgcaa

SEQ ID NO: 93902 - DNA, 22 bp, Artificial Sequence
  Synthetic oligonucleotide; CTT chr11 5283031 5283052 5283048 5283053 +
tcctgaagaaatgcaattatgg

SEQ ID NO: 93903 - DNA, 22 bp, Artificial Sequence
  Synthetic oligonucleotide; TTT chr11 5283032 5283053 5283049 5283054 +
cctgaagaaatgcaattatggt

SEQ ID NO: 93904 - DNA, 22 bp, Artificial Sequence
  Synthetic oligonucleotide; TTC chr11 5283033 5283054 5283050 5283055 +
ctgaagaaatgcaattatggtt

SEQ ID NO: 93905 - DNA, 22 bp, Artificial Sequence
  Synthetic oligonucleotide; CTG chr11 5283036 5283057 5283053 5283058 +
aagaaatgcaattatggttgag

SEQ ID NO: 93906 - DNA, 22 bp, Artificial Sequence
  Synthetic oligonucleotide; TTA chr11 5283050 5283071 5283067 5283072 +
tggttgaggaagtatggtctgc

SEQ ID NO: 93907 - DNA, 22 bp, Artificial Sequence
  Synthetic oligonucleotide; TTG chr11 5283056 5283077 5283073 5283078 +
aggaagtatggtctgcaactgt

SEQ ID NO: 93908 - DNA, 22 bp, Artificial Sequence
  Synthetic oligonucleotide; CTG chr11 5283071 5283092 5283088 5283093 +
caactgtggcttggaccacaac

SEQ ID NO: 93909 - DNA, 22 bp, Artificial Sequence
  Synthetic oligonucleotide; CTG chr11 5283077 5283098 5283094 5283099 +
tggcttggaccacaacttccaa

SEQ ID NO: 93910 - DNA, 22 bp, Artificial Sequence
  Synthetic oligonucleotide; CTT chr11 5283083 5283104 5283100 5283105 +
ggaccacaacttccaatcgaca

SEQ ID NO: 93911 - DNA, 22 bp, Artificial Sequence
  Synthetic oligonucleotide; TTG chr11 5283084 5283105 5283101 5283106 +
gaccacaacttccaatcgacaa

SEQ ID NO: 93912 - DNA, 22 bp, Artificial Sequence
  Synthetic oligonucleotide; CTT chr11 5283095 5283116 5283112 5283117 +
ccaatcgacaagaagtaaaagt

SEQ ID NO: 93913 - DNA, 22 bp, Artificial Sequence
  Synthetic oligonucleotide; TTC chr11 5283096 5283117 5283113 5283118 +
caatcgacaagaagtaaaagta

SEQ ID NO: 93914 - DNA, 22 bp, Artificial Sequence
  Synthetic oligonucleotide; CTA chr11 5283149 5283170 5283166 5283171 +
cttctaatttctcgcatccaca

SEQ ID NO: 93915 - DNA, 22 bp, Artificial Sequence
  Synthetic oligonucleotide; CTT chr11 5283152 5283173 5283169 5283174 +
ctaatttctcgcatccacaata

SEQ ID NO: 93916 - DNA, 22 bp, Artificial Sequence
  Synthetic oligonucleotide; TTC chr11 5283153 5283174 5283170 5283175 +
taatttctcgcatccacaatat

SEQ ID NO: 93917 - DNA, 22 bp, Artificial Sequence
  Synthetic oligonucleotide; CTA chr11 5283155 5283176 5283172 5283177 +
atttctcgcatccacaatatct

SEQ ID NO: 93918 - DNA, 22 bp, Artificial Sequence
  Synthetic oligonucleotide; TTT chr11 5283159 5283180 5283176 5283181 +
ctcgcatccacaatatctgagt

SEQ ID NO: 93919 - DNA, 22 bp, Artificial Sequence
  Synthetic oligonucleotide; TTC chr11 5283160 5283181 5283177 5283182 +
tcgcatccacaatatctgagtt

SEQ ID NO: 93920 - DNA, 22 bp, Artificial Sequence
  Synthetic oligonucleotide; CTC chr11 5283162 5283183 5283179 5283184 +
gcatccacaatatctgagtttg

SEQ ID NO: 93921 - DNA, 22 bp, Artificial Sequence
  Synthetic oligonucleotide; CTG chr11 5283178 5283199 5283195 5283200 +
agtttgtgttttgctgtggaaa

SEQ ID NO: 93922 - DNA, 22 bp, Artificial Sequence
  Synthetic oligonucleotide; TTT chr11 5283183 5283204 5283200 5283205 +
gtgttttgctgtggaaaaaaca

SEQ ID NO: 93923 - DNA, 22 bp, Artificial Sequence
  Synthetic oligonucleotide; TTG chr11 5283184 5283205 5283201 5283206 +
tgttttgctgtggaaaaaacac

SEQ ID NO: 93924 - DNA, 22 bp, Artificial Sequence
  Synthetic oligonucleotide; TTT chr11 5283189 5283210 5283206 5283211 +
tgctgtggaaaaaacactgtct

SEQ ID NO: 93925 - DNA, 22 bp, Artificial Sequence
  Synthetic oligonucleotide; TTT chr11 5283190 5283211 5283207 5283212 +
gctgtggaaaaaacactgtctt

SEQ ID NO: 93926 - DNA, 22 bp, Artificial Sequence
  Synthetic oligonucleotide; TTG chr11 5283191 5283212 5283208 5283213 +
ctgtggaaaaaacactgtcttc

SEQ ID NO: 93927 - DNA, 22 bp, Artificial Sequence
  Synthetic oligonucleotide; CTG chr11 5283194 5283215 5283211 5283216 +
tggaaaaaacactgtcttcaga

SEQ ID NO: 93928 - DNA, 22 bp, Artificial Sequence
  Synthetic oligonucleotide; CTG chr11 5283208 5283229 5283225 5283230 +
tcttcagaggtagcagaactgg

SEQ ID NO: 93929 - DNA, 22 bp, Artificial Sequence
  Synthetic oligonucleotide; CTT chr11 5283212 5283233 5283229 5283234 +
cagaggtagcagaactgggtct

SEQ ID NO: 93930 - DNA, 22 bp, Artificial Sequence
  Synthetic oligonucleotide; TTC chr11 5283213 5283234 5283230 5283235 +
agaggtagcagaactgggtcta

SEQ ID NO: 93931 - DNA, 22 bp, Artificial Sequence
  Synthetic oligonucleotide; CTG chr11 5283229 5283250 5283246 5283251 +
ggtctacatcctagccttacta

SEQ ID NO: 93932 - DNA, 22 bp, Artificial Sequence
  Synthetic oligonucleotide; CTA chr11 5283235 5283256 5283252 5283257 +
catcctagccttactacttggt

SEQ ID NO: 93933 - DNA, 22 bp, Artificial Sequence
  Synthetic oligonucleotide; CTA chr11 5283242 5283263 5283259 5283264 +
gccttactacttggtggttctg

SEQ ID NO: 93934 - DNA, 22 bp, Artificial Sequence
  Synthetic oligonucleotide; CTT chr11 5283247 5283268 5283264 5283269 +
actacttggtggttctgtaagc

SEQ ID NO: 93935 - DNA, 22 bp, Artificial Sequence
  Synthetic oligonucleotide; TTA chr11 5283248 5283269 5283265 5283270 +
ctacttggtggttctgtaagct

SEQ ID NO: 93936 - DNA, 22 bp, Artificial Sequence
  Synthetic oligonucleotide; CTA chr11 5283251 5283272 5283268 5283273 +
cttggtggttctgtaagcttgg

SEQ ID NO: 93937 - DNA, 22 bp, Artificial Sequence
  Synthetic oligonucleotide; CTT chr11 5283254 5283275 5283271 5283276 +
ggtggttctgtaagcttggaca

SEQ ID NO: 93938 - DNA, 22 bp, Artificial Sequence
  Synthetic oligonucleotide; TTG chr11 5283255 5283276 5283272 5283277 +
gtggttctgtaagcttggacaa

SEQ ID NO: 93939 - DNA, 22 bp, Artificial Sequence
  Synthetic oligonucleotide; TTC chr11 5283262 5283283 5283279 5283284 +
tgtaagcttggacaaattattt

SEQ ID NO: 93940 - DNA, 22 bp, Artificial Sequence
  Synthetic oligonucleotide; CTG chr11 5283264 5283285 5283281 5283286 +
taagcttggacaaattatttca

SEQ ID NO: 93941 - DNA, 22 bp, Artificial Sequence
  Synthetic oligonucleotide; CTT chr11 5283271 5283292 5283288 5283293 +
ggacaaattatttcatgtcttt

SEQ ID NO: 93942 - DNA, 22 bp, Artificial Sequence
  Synthetic oligonucleotide; TTG chr11 5283272 5283293 5283289 5283294 +
gacaaattatttcatgtctttg

SEQ ID NO: 93943 - DNA, 22 bp, Artificial Sequence
  Synthetic oligonucleotide; TTA chr11 5283281 5283302 5283298 5283303 +
tttcatgtctttgattttcgag

SEQ ID NO: 93944 - DNA, 22 bp, Artificial Sequence
  Synthetic oligonucleotide; TTT chr11 5283284 5283305 5283301 5283306 +
catgtctttgattttcgagtcc

SEQ ID NO: 93945 - DNA, 22 bp, Artificial Sequence
  Synthetic oligonucleotide; TTC chr11 5283285 5283306 5283302 5283307 +
atgtctttgattttcgagtccc

SEQ ID NO: 93946 - DNA, 22 bp, Artificial Sequence
  Synthetic oligonucleotide; CTT chr11 5283292 5283313 5283309 5283314 +
tgattttcgagtccccagttaa

SEQ ID NO: 93947 - DNA, 22 bp, Artificial Sequence
  Synthetic oligonucleotide; TTT chr11 5283293 5283314 5283310 5283315 +
gattttcgagtccccagttaat

SEQ ID NO: 93948 - DNA, 22 bp, Artificial Sequence
  Synthetic oligonucleotide; TTG chr11 5283294 5283315 5283311 5283316 +
attttcgagtccccagttaata

SEQ ID NO: 93949 - DNA, 22 bp, Artificial Sequence
  Synthetic oligonucleotide; TTT chr11 5283298 5283319 5283315 5283320 +
tcgagtccccagttaataagag

SEQ ID NO: 93950 - DNA, 22 bp, Artificial Sequence
  Synthetic oligonucleotide; TTT chr11 5283299 5283320 5283316 5283321 +
cgagtccccagttaataagagc

SEQ ID NO: 93951 - DNA, 22 bp, Artificial Sequence
  Synthetic oligonucleotide; TTC chr11 5283300 5283321 5283317 5283322 +
gagtccccagttaataagagct

SEQ ID NO: 93952 - DNA, 22 bp, Artificial Sequence
  Synthetic oligonucleotide; TTA chr11 5283313 5283334 5283330 5283335 +
ataagagctcatgtaatgtaga

SEQ ID NO: 93953 - DNA, 22 bp, Artificial Sequence
  Synthetic oligonucleotide; CTC chr11 5283323 5283344 5283340 5283345 +
atgtaatgtagacagtaggaga

SEQ ID NO: 93954 - DNA, 22 bp, Artificial Sequence
  Synthetic oligonucleotide; CTC chr11 5283349 5283370 5283366 5283371 +
agaccatctgacttctaattac

SEQ ID NO: 93955 - DNA, 22 bp, Artificial Sequence
  Synthetic oligonucleotide; CTG chr11 5283359 5283380 5283376 5283381 +
acttctaattactaattgtcta

SEQ ID NO: 93956 - DNA, 22 bp, Artificial Sequence
  Synthetic oligonucleotide; CTT chr11 5283363 5283384 5283380 5283385 +
ctaattactaattgtctactta

SEQ ID NO: 93957 - DNA, 22 bp, Artificial Sequence
  Synthetic oligonucleotide; TTC chr11 5283364 5283385 5283381 5283386 +
taattactaattgtctacttat

SEQ ID NO: 93958 - DNA, 22 bp, Artificial Sequence
  Synthetic oligonucleotide; CTA chr11 5283366 5283387 5283383 5283388 +
attactaattgtctacttatta

SEQ ID NO: 93959 - DNA, 22 bp, Artificial Sequence
  Synthetic oligonucleotide; TTA chr11 5283370 5283391 5283387 5283392 +
ctaattgtctacttattagctt

SEQ ID NO: 93960 - DNA, 22 bp, Artificial Sequence
  Synthetic oligonucleotide; CTA chr11 5283373 5283394 5283390 5283395 +
attgtctacttattagcttgtg

SEQ ID NO: 93961 - DNA, 22 bp, Artificial Sequence
  Synthetic oligonucleotide; TTG chr11 5283377 5283398 5283394 5283399 +
tctacttattagcttgtgcttt

SEQ ID NO: 93962 - DNA, 22 bp, Artificial Sequence
  Synthetic oligonucleotide; CTA chr11 5283381 5283402 5283398 5283403 +
cttattagcttgtgctttcaat

SEQ ID NO: 93963 - DNA, 22 bp, Artificial Sequence
  Synthetic oligonucleotide; CTT chr11 5283384 5283405 5283401 5283406 +
attagcttgtgctttcaataag

SEQ ID NO: 93964 - DNA, 22 bp, Artificial Sequence
  Synthetic oligonucleotide; TTA chr11 5283385 5283406 5283402 5283407 +
ttagcttgtgctttcaataagt

SEQ ID NO: 93965 - DNA, 22 bp, Artificial Sequence
  Synthetic oligonucleotide; TTA chr11 5283388 5283409 5283405 5283410 +
gcttgtgctttcaataagttga

SEQ ID NO: 93966 - DNA, 22 bp, Artificial Sequence
  Synthetic oligonucleotide; CTT chr11 5283392 5283413 5283409 5283414 +
gtgctttcaataagttgatcta

SEQ ID NO: 93967 - DNA, 22 bp, Artificial Sequence
  Synthetic oligonucleotide; TTG chr11 5283393 5283414 5283410 5283415 +
tgctttcaataagttgatctac

SEQ ID NO: 93968 - DNA, 22 bp, Artificial Sequence
  Synthetic oligonucleotide; CTT chr11 5283398 5283419 5283415 5283420 +
tcaataagttgatctacactac

SEQ ID NO: 93969 - DNA, 22 bp, Artificial Sequence
  Synthetic oligonucleotide; TTT chr11 5283399 5283420 5283416 5283421 +
caataagttgatctacactaca

SEQ ID NO: 93970 - DNA, 22 bp, Artificial Sequence
  Synthetic oligonucleotide; TTC chr11 5283400 5283421 5283417 5283422 +
aataagttgatctacactacaa

SEQ ID NO: 93971 - DNA, 22 bp, Artificial Sequence
  Synthetic oligonucleotide; TTG chr11 5283409 5283430 5283426 5283431 +
atctacactacaagtacattgg

SEQ ID NO: 93972 - DNA, 22 bp, Artificial Sequence
  Synthetic oligonucleotide; CTA chr11 5283414 5283435 5283431 5283436 +
cactacaagtacattgggctcc

SEQ ID NO: 93973 - DNA, 22 bp, Artificial Sequence
  Synthetic oligonucleotide; CTA chr11 5283419 5283440 5283436 5283441 +
caagtacattgggctcctcatc

SEQ ID NO: 93974 - DNA, 22 bp, Artificial Sequence
  Synthetic oligonucleotide; TTG chr11 5283430 5283451 5283447 5283452 +
ggctcctcatcaataaatgagg

SEQ ID NO: 93975 - DNA, 22 bp, Artificial Sequence
  Synthetic oligonucleotide; CTC chr11 5283435 5283456 5283452 5283457 +
ctcatcaataaatgaggtaata

SEQ ID NO: 93976 - DNA, 22 bp, Artificial Sequence
  Synthetic oligonucleotide; CTC chr11 5283438 5283459 5283455 5283460 +
atcaataaatgaggtaataatc

SEQ ID NO: 93977 - DNA, 22 bp, Artificial Sequence
  Synthetic oligonucleotide; CTA chr11 5283462 5283483 5283479 5283484 +
cttctgagtattggtgtgagta

SEQ ID NO: 93978 - DNA, 22 bp, Artificial Sequence
  Synthetic oligonucleotide; CTT chr11 5283465 5283486 5283482 5283487 +
ctgagtattggtgtgagtaaaa

SEQ ID NO: 93979 - DNA, 22 bp, Artificial Sequence
  Synthetic oligonucleotide; TTC chr11 5283466 5283487 5283483 5283488 +
tgagtattggtgtgagtaaaac

SEQ ID NO: 93980 - DNA, 22 bp, Artificial Sequence
  Synthetic oligonucleotide; CTG chr11 5283468 5283489 5283485 5283490 +
agtattggtgtgagtaaaacta

SEQ ID NO: 93981 - DNA, 22 bp, Artificial Sequence
  Synthetic oligonucleotide; TTG chr11 5283475 5283496 5283492 5283497 +
gtgtgagtaaaactaagttaat

SEQ ID NO: 93982 - DNA, 22 bp, Artificial Sequence
  Synthetic oligonucleotide; CTA chr11 5283490 5283511 5283507 5283512 +
agttaattcatataataaactt

SEQ ID NO: 93983 - DNA, 22 bp, Artificial Sequence
  Synthetic oligonucleotide; TTA chr11 5283495 5283516 5283512 5283517 +
attcatataataaacttctttt

SEQ ID NO: 93984 - DNA, 22 bp, Artificial Sequence
  Synthetic oligonucleotide; TTC chr11 5283499 5283520 5283516 5283521 +
atataataaacttctttttttt

SEQ ID NO: 93985 - DNA, 22 bp, Artificial Sequence
  Synthetic oligonucleotide; CTT chr11 5283512 5283533 5283529 5283534 +
ctttttttttttttgagatgga

SEQ ID NO: 93986 - DNA, 22 bp, Artificial Sequence
  Synthetic oligonucleotide; TTC chr11 5283513 5283534 5283530 5283535 +
tttttttttttttgagatggag

SEQ ID NO: 93987 - DNA, 22 bp, Artificial Sequence
  Synthetic oligonucleotide; CTT chr11 5283515 5283536 5283532 5283537 +
tttttttttttgagatggagtc

SEQ ID NO: 93988 - DNA, 22 bp, Artificial Sequence
  Synthetic oligonucleotide; TTT chr11 5283516 5283537 5283533 5283538 +
ttttttttttgagatggagtct

SEQ ID NO: 93989 - DNA, 22 bp, Artificial Sequence
  Synthetic oligonucleotide; TTT chr11 5283517 5283538 5283534 5283539 +
tttttttttgagatggagtctc

SEQ ID NO: 93990 - DNA, 22 bp, Artificial Sequence
  Synthetic oligonucleotide; TTT chr11 5283518 5283539 5283535 5283540 +
ttttttttgagatggagtctca

SEQ ID NO: 93991 - DNA, 22 bp, Artificial Sequence
  Synthetic oligonucleotide; TTT chr11 5283519 5283540 5283536 5283541 +
tttttttgagatggagtctcac

SEQ ID NO: 93992 - DNA, 22 bp, Artificial Sequence
  Synthetic oligonucleotide; TTT chr11 5283520 5283541 5283537 5283542 +
ttttttgagatggagtctcact

SEQ ID NO: 93993 - DNA, 22 bp, Artificial Sequence
  Synthetic oligonucleotide; TTT chr11 5283521 5283542 5283538 5283543 +
tttttgagatggagtctcactc

SEQ ID NO: 93994 - DNA, 22 bp, Artificial Sequence
  Synthetic oligonucleotide; TTT chr11 5283522 5283543 5283539 5283544 +
ttttgagatggagtctcactct

SEQ ID NO: 93995 - DNA, 22 bp, Artificial Sequence
  Synthetic oligonucleotide; TTT chr11 5283523 5283544 5283540 5283545 +
tttgagatggagtctcactctg

SEQ ID NO: 93996 - DNA, 22 bp, Artificial Sequence
  Synthetic oligonucleotide; TTT chr11 5283524 5283545 5283541 5283546 +
ttgagatggagtctcactctgt

SEQ ID NO: 93997 - DNA, 22 bp, Artificial Sequence
  Synthetic oligonucleotide; TTT chr11 5283525 5283546 5283542 5283547 +
tgagatggagtctcactctgtc

SEQ ID NO: 93998 - DNA, 22 bp, Artificial Sequence
  Synthetic oligonucleotide; TTT chr11 5283526 5283547 5283543 5283548 +
gagatggagtctcactctgtcg

SEQ ID NO: 93999 - DNA, 22 bp, Artificial Sequence
  Synthetic oligonucleotide; TTG chr11 5283527 5283548 5283544 5283549 +
agatggagtctcactctgtcgc

SEQ ID NO: 94000 - DNA, 22 bp, Artificial Sequence
  Synthetic oligonucleotide; CTC chr11 5283539 5283560 5283556 5283561 +
actctgtcgcctaggctggagt

SEQ ID NO: 94001 - DNA, 22 bp, Artificial Sequence
  Synthetic oligonucleotide; CTC chr11 5283543 5283564 5283560 5283565 +
tgtcgcctaggctggagtgcag

SEQ ID NO: 94002 - DNA, 22 bp, Artificial Sequence
  Synthetic oligonucleotide; CTG chr11 5283545 5283566 5283562 5283567 +
tcgcctaggctggagtgcagtg

SEQ ID NO: 94003 - DNA, 22 bp, Artificial Sequence
  Synthetic oligonucleotide; CTA chr11 5283552 5283573 5283569 5283574 +
ggctggagtgcagtggtgcaat

SEQ ID NO: 94004 - DNA, 22 bp, Artificial Sequence
  Synthetic oligonucleotide; CTG chr11 5283557 5283578 5283574 5283579 +
gagtgcagtggtgcaatcttag

SEQ ID NO: 94005 - DNA, 22 bp, Artificial Sequence
  Synthetic oligonucleotide; CTT chr11 5283577 5283598 5283594 5283599 +
agctcactgcaacctccacctc

SEQ ID NO: 94006 - DNA, 22 bp, Artificial Sequence
  Synthetic oligonucleotide; TTA chr11 5283578 5283599 5283595 5283600 +
gctcactgcaacctccacctcc

SEQ ID NO: 94007 - DNA, 22 bp, Artificial Sequence
  Synthetic oligonucleotide; CTC chr11 5283582 5283603 5283599 5283604 +
actgcaacctccacctcctggg

SEQ ID NO: 94008 - DNA, 22 bp, Artificial Sequence
  Synthetic oligonucleotide; CTG chr11 5283586 5283607 5283603 5283608 +
caacctccacctcctgggttca

SEQ ID NO: 94009 - DNA, 22 bp, Artificial Sequence
  Synthetic oligonucleotide; CTC chr11 5283593 5283614 5283610 5283615 +
cacctcctgggttcaagtgatt

SEQ ID NO: 94010 - DNA, 22 bp, Artificial Sequence
  Synthetic oligonucleotide; CTC chr11 5283599 5283620 5283616 5283621 +
ctgggttcaagtgattctcctg

SEQ ID NO: 94011 - DNA, 22 bp, Artificial Sequence
  Synthetic oligonucleotide; CTG chr11 5283602 5283623 5283619 5283624 +
ggttcaagtgattctcctgcct

SEQ ID NO: 94012 - DNA, 22 bp, Artificial Sequence
  Synthetic oligonucleotide; TTC chr11 5283607 5283628 5283624 5283629 +
aagtgattctcctgcctcagcc

SEQ ID NO: 94013 - DNA, 22 bp, Artificial Sequence
  Synthetic oligonucleotide; TTC chr11 5283616 5283637 5283633 5283638 +
tcctgcctcagcctcctgagta

SEQ ID NO: 94014 - DNA, 22 bp, Artificial Sequence
  Synthetic oligonucleotide; CTC chr11 5283618 5283639 5283635 5283640 +
ctgcctcagcctcctgagtagc

SEQ ID NO: 94015 - DNA, 22 bp, Artificial Sequence
  Synthetic oligonucleotide; CTG chr11 5283621 5283642 5283638 5283643 +
cctcagcctcctgagtagctgg

SEQ ID NO: 94016 - DNA, 22 bp, Artificial Sequence
  Synthetic oligonucleotide; CTC chr11 5283625 5283646 5283642 5283647 +
agcctcctgagtagctgggatt

SEQ ID NO: 94017 - DNA, 22 bp, Artificial Sequence
  Synthetic oligonucleotide; CTC chr11 5283631 5283652 5283648 5283653 +
ctgagtagctgggattatagac

SEQ ID NO: 94018 - DNA, 22 bp, Artificial Sequence
  Synthetic oligonucleotide; CTG chr11 5283634 5283655 5283651 5283656 +
agtagctgggattatagacgcg

SEQ ID NO: 94019 - DNA, 22 bp, Artificial Sequence
  Synthetic oligonucleotide; CTG chr11 5283642 5283663 5283659 5283664 +
ggattatagacgcgtgccacca

SEQ ID NO: 94020 - DNA, 22 bp, Artificial Sequence
  Synthetic oligonucleotide; TTA chr11 5283648 5283669 5283665 5283670 +
tagacgcgtgccaccacacctg

SEQ ID NO: 94021 - DNA, 22 bp, Artificial Sequence
  Synthetic oligonucleotide; CTG chr11 5283670 5283691 5283687 5283692 +
gctgattttttgtattttttag

SEQ ID NO: 94022 - DNA, 22 bp, Artificial Sequence
  Synthetic oligonucleotide; CTG chr11 5283674 5283695 5283691 5283696 +
attttttgtattttttagtaga

SEQ ID NO: 94023 - DNA, 22 bp, Artificial Sequence
  Synthetic oligonucleotide; TTT chr11 5283678 5283699 5283695 5283700 +
tttgtattttttagtagagaag

SEQ ID NO: 94024 - DNA, 22 bp, Artificial Sequence
  Synthetic oligonucleotide; TTT chr11 5283679 5283700 5283696 5283701 +
ttgtattttttagtagagaagg

SEQ ID NO: 94025 - DNA, 22 bp, Artificial Sequence
  Synthetic oligonucleotide; TTT chr11 5283680 5283701 5283697 5283702 +
tgtattttttagtagagaaggg

SEQ ID NO: 94026 - DNA, 22 bp, Artificial Sequence
  Synthetic oligonucleotide; TTT chr11 5283681 5283702 5283698 5283703 +
gtattttttagtagagaagggg

SEQ ID NO: 94027 - DNA, 22 bp, Artificial Sequence
  Synthetic oligonucleotide; TTG chr11 5283682 5283703 5283699 5283704 +
tattttttagtagagaaggggt

SEQ ID NO: 94028 - DNA, 22 bp, Artificial Sequence
  Synthetic oligonucleotide; TTT chr11 5283687 5283708 5283704 5283709 +
tttagtagagaaggggtttcac

SEQ ID NO: 94029 - DNA, 22 bp, Artificial Sequence
  Synthetic oligonucleotide; TTT chr11 5283688 5283709 5283705 5283710 +
ttagtagagaaggggtttcacc

SEQ ID NO: 94030 - DNA, 22 bp, Artificial Sequence
  Synthetic oligonucleotide; TTT chr11 5283689 5283710 5283706 5283711 +
tagtagagaaggggtttcacca

SEQ ID NO: 94031 - DNA, 22 bp, Artificial Sequence
  Synthetic oligonucleotide; TTT chr11 5283690 5283711 5283707 5283712 +
agtagagaaggggtttcaccat

SEQ ID NO: 94032 - DNA, 22 bp, Artificial Sequence
  Synthetic oligonucleotide; TTA chr11 5283691 5283712 5283708 5283713 +
gtagagaaggggtttcaccatg

SEQ ID NO: 94033 - DNA, 22 bp, Artificial Sequence
  Synthetic oligonucleotide; TTT chr11 5283706 5283727 5283723 5283728 +
caccatgttggccaggctggtc

SEQ ID NO: 94034 - DNA, 22 bp, Artificial Sequence
  Synthetic oligonucleotide; TTC chr11 5283707 5283728 5283724 5283729 +
accatgttggccaggctggtct

SEQ ID NO: 94035 - DNA, 22 bp, Artificial Sequence
  Synthetic oligonucleotide; TTG chr11 5283716 5283737 5283733 5283738 +
gccaggctggtctggaactcct

SEQ ID NO: 94036 - DNA, 22 bp, Artificial Sequence
  Synthetic oligonucleotide; CTG chr11 5283725 5283746 5283742 5283747 +
gtctggaactcctgacctcagg

SEQ ID NO: 94037 - DNA, 22 bp, Artificial Sequence
  Synthetic oligonucleotide; CTG chr11 5283730 5283751 5283747 5283752 +
gaactcctgacctcaggtgatc

SEQ ID NO: 94038 - DNA, 22 bp, Artificial Sequence
  Synthetic oligonucleotide; CTC chr11 5283736 5283757 5283753 5283758 +
ctgacctcaggtgatccaattg

SEQ ID NO: 94039 - DNA, 22 bp, Artificial Sequence
  Synthetic oligonucleotide; CTG chr11 5283739 5283760 5283756 5283761 +
acctcaggtgatccaattgcct

SEQ ID NO: 94040 - DNA, 22 bp, Artificial Sequence
  Synthetic oligonucleotide; CTC chr11 5283744 5283765 5283761 5283766 +
aggtgatccaattgccttggcc

SEQ ID NO: 94041 - DNA, 22 bp, Artificial Sequence
  Synthetic oligonucleotide; TTG chr11 5283758 5283779 5283775 5283780 +
ccttggcctcccaaagtgctgg

SEQ ID NO: 94042 - DNA, 22 bp, Artificial Sequence
  Synthetic oligonucleotide; CTT chr11 5283762 5283783 5283779 5283784 +
ggcctcccaaagtgctgggatt

SEQ ID NO: 94043 - DNA, 22 bp, Artificial Sequence
  Synthetic oligonucleotide; TTG chr11 5283763 5283784 5283780 5283785 +
gcctcccaaagtgctgggatta

SEQ ID NO: 94044 - DNA, 22 bp, Artificial Sequence
  Synthetic oligonucleotide; CTC chr11 5283768 5283789 5283785 5283790 +
ccaaagtgctgggattacaggc

SEQ ID NO: 94045 - DNA, 22 bp, Artificial Sequence
  Synthetic oligonucleotide; CTG chr11 5283779 5283800 5283796 5283801 +
ggattacaggcatgtaatccca

SEQ ID NO: 94046 - DNA, 22 bp, Artificial Sequence
  Synthetic oligonucleotide; TTA chr11 5283785 5283806 5283802 5283807 +
caggcatgtaatcccatatatg

SEQ ID NO: 94047 - DNA, 22 bp, Artificial Sequence
  Synthetic oligonucleotide; CTC chr11 5283826 5283847 5283843 5283848 +
atatgataaacttaaatttgat

SEQ ID NO: 94048 - DNA, 22 bp, Artificial Sequence
  Synthetic oligonucleotide; CTT chr11 5283839 5283860 5283856 5283861 +
aaatttgattctagcatatact

SEQ ID NO: 94049 - DNA, 22 bp, Artificial Sequence
  Synthetic oligonucleotide; TTA chr11 5283840 5283861 5283857 5283862 +
aatttgattctagcatatacta

SEQ ID NO: 94050 - DNA, 22 bp, Artificial Sequence
  Synthetic oligonucleotide; TTT chr11 5283845 5283866 5283862 5283867 +
gattctagcatatactaagtac

SEQ ID NO: 94051 - DNA, 22 bp, Artificial Sequence
  Synthetic oligonucleotide; TTG chr11 5283846 5283867 5283863 5283868 +
attctagcatatactaagtact

SEQ ID NO: 94052 - DNA, 22 bp, Artificial Sequence
  Synthetic oligonucleotide; TTC chr11 5283850 5283871 5283867 5283872 +
tagcatatactaagtactcaag

SEQ ID NO: 94053 - DNA, 22 bp, Artificial Sequence
  Synthetic oligonucleotide; CTA chr11 5283852 5283873 5283869 5283874 +
gcatatactaagtactcaagag

SEQ ID NO: 94054 - DNA, 22 bp, Artificial Sequence
  Synthetic oligonucleotide; CTA chr11 5283862 5283883 5283879 5283884 +
agtactcaagaggtgttactta

SEQ ID NO: 94055 - DNA, 22 bp, Artificial Sequence
  Synthetic oligonucleotide; CTC chr11 5283869 5283890 5283886 5283891 +
aagaggtgttacttatcattag

SEQ ID NO: 94056 - DNA, 22 bp, Artificial Sequence
  Synthetic oligonucleotide; TTA chr11 5283880 5283901 5283897 5283902 +
cttatcattagtattaattata

SEQ ID NO: 94057 - DNA, 22 bp, Artificial Sequence
  Synthetic oligonucleotide; CTT chr11 5283883 5283904 5283900 5283905 +
atcattagtattaattatagta

SEQ ID NO: 94058 - DNA, 22 bp, Artificial Sequence
  Synthetic oligonucleotide; TTA chr11 5283884 5283905 5283901 5283906 +
tcattagtattaattatagtat

SEQ ID NO: 94059 - DNA, 22 bp, Artificial Sequence
  Synthetic oligonucleotide; TTA chr11 5283890 5283911 5283907 5283912 +
gtattaattatagtatgttcaa

SEQ ID NO: 94060 - DNA, 22 bp, Artificial Sequence
  Synthetic oligonucleotide; TTA chr11 5283896 5283917 5283913 5283918 +
attatagtatgttcaataatac

SEQ ID NO: 94061 - DNA, 22 bp, Artificial Sequence
  Synthetic oligonucleotide; TTA chr11 5283900 5283921 5283917 5283922 +
tagtatgttcaataatacatat

SEQ ID NO: 94062 - DNA, 22 bp, Artificial Sequence
  Synthetic oligonucleotide; TTC chr11 5283910 5283931 5283927 5283932 +
aataatacatatctcacagaat

SEQ ID NO: 94063 - DNA, 22 bp, Artificial Sequence
  Synthetic oligonucleotide; CTC chr11 5283925 5283946 5283942 5283947 +
acagaattaccatatgtaatga

SEQ ID NO: 94064 - DNA, 22 bp, Artificial Sequence
  Synthetic oligonucleotide; TTA chr11 5283934 5283955 5283951 5283956 +
ccatatgtaatgagattattaa

SEQ ID NO: 94065 - DNA, 22 bp, Artificial Sequence
  Synthetic oligonucleotide; TTA chr11 5283952 5283973 5283969 5283974 +
ttaaatatcataaaatggcacc

SEQ ID NO: 94066 - DNA, 22 bp, Artificial Sequence
  Synthetic oligonucleotide; TTA chr11 5283955 5283976 5283972 5283977 +
aatatcataaaatggcacctga

SEQ ID NO: 94067 - DNA, 22 bp, Artificial Sequence
  Synthetic oligonucleotide; CTG chr11 5283976 5283997 5283993 5283998 +
acatatagaaagatttcagtaa

SEQ ID NO: 94068 - DNA, 22 bp, Artificial Sequence
  Synthetic oligonucleotide; TTT chr11 5283992 5284013 5284009 5284014 +
cagtaagtattaattcccactt

SEQ ID NO: 94069 - DNA, 22 bp, Artificial Sequence
  Synthetic oligonucleotide; TTC chr11 5283993 5284014 5284010 5284015 +
agtaagtattaattcccacttc

SEQ ID NO: 94070 - DNA, 22 bp, Artificial Sequence
  Synthetic oligonucleotide; TTA chr11 5284004 5284025 5284021 5284026 +
attcccacttctctttcattta

SEQ ID NO: 94071 - DNA, 22 bp, Artificial Sequence
  Synthetic oligonucleotide; TTC chr11 5284008 5284029 5284025 5284030 +
ccacttctctttcatttacctc

SEQ ID NO: 94072 - DNA, 22 bp, Artificial Sequence
  Synthetic oligonucleotide; CTT chr11 5284014 5284035 5284031 5284036 +
ctctttcatttacctccagcct

SEQ ID NO: 94073 - DNA, 22 bp, Artificial Sequence
  Synthetic oligonucleotide; TTC chr11 5284015 5284036 5284032 5284037 +
tctttcatttacctccagccta

SEQ ID NO: 94074 - DNA, 22 bp, Artificial Sequence
  Synthetic oligonucleotide; CTC chr11 5284017 5284038 5284034 5284039 +
tttcatttacctccagcctaaa

SEQ ID NO: 94075 - DNA, 22 bp, Artificial Sequence
  Synthetic oligonucleotide; CTT chr11 5284019 5284040 5284036 5284041 +
tcatttacctccagcctaaatc

SEQ ID NO: 94076 - DNA, 22 bp, Artificial Sequence
  Synthetic oligonucleotide; TTT chr11 5284020 5284041 5284037 5284042 +
catttacctccagcctaaatct

SEQ ID NO: 94077 - DNA, 22 bp, Artificial Sequence
  Synthetic oligonucleotide; TTC chr11 5284021 5284042 5284038 5284043 +
atttacctccagcctaaatcta

SEQ ID NO: 94078 - DNA, 22 bp, Artificial Sequence
  Synthetic oligonucleotide; TTT chr11 5284025 5284046 5284042 5284047 +
acctccagcctaaatctacact

SEQ ID NO: 94079 - DNA, 22 bp, Artificial Sequence
  Synthetic oligonucleotide; TTA chr11 5284026 5284047 5284043 5284048 +
cctccagcctaaatctacacta

SEQ ID NO: 94080 - DNA, 22 bp, Artificial Sequence
  Synthetic oligonucleotide; CTC chr11 5284030 5284051 5284047 5284052 +
cagcctaaatctacactatttc

SEQ ID NO: 94081 - DNA, 22 bp, Artificial Sequence
  Synthetic oligonucleotide; CTA chr11 5284037 5284058 5284054 5284059 +
aatctacactatttcctcgtgt

SEQ ID NO: 94082 - DNA, 22 bp, Artificial Sequence
  Synthetic oligonucleotide; CTA chr11 5284043 5284064 5284060 5284065 +
cactatttcctcgtgtctctca

SEQ ID NO: 94083 - DNA, 22 bp, Artificial Sequence
  Synthetic oligonucleotide; CTA chr11 5284048 5284069 5284065 5284070 +
tttcctcgtgtctctcatgtgg

SEQ ID NO: 94084 - DNA, 22 bp, Artificial Sequence
  Synthetic oligonucleotide; TTT chr11 5284051 5284072 5284068 5284073 +
cctcgtgtctctcatgtggttt

SEQ ID NO: 94085 - DNA, 22 bp, Artificial Sequence
  Synthetic oligonucleotide; TTC chr11 5284052 5284073 5284069 5284074 +
ctcgtgtctctcatgtggtttc

SEQ ID NO: 94086 - DNA, 22 bp, Artificial Sequence
  Synthetic oligonucleotide; CTC chr11 5284055 5284076 5284072 5284077 +
gtgtctctcatgtggtttctag

SEQ ID NO: 94087 - DNA, 22 bp, Artificial Sequence
  Synthetic oligonucleotide; CTC chr11 5284062 5284083 5284079 5284084 +
tcatgtggtttctagtcccttc

SEQ ID NO: 94088 - DNA, 22 bp, Artificial Sequence
  Synthetic oligonucleotide; CTC chr11 5284064 5284085 5284081 5284086 +
atgtggtttctagtcccttcac

SEQ ID NO: 94089 - DNA, 22 bp, Artificial Sequence
  Synthetic oligonucleotide; TTT chr11 5284073 5284094 5284090 5284095 +
ctagtcccttcaccatcttgtt

SEQ ID NO: 94090 - DNA, 22 bp, Artificial Sequence
  Synthetic oligonucleotide; TTC chr11 5284074 5284095 5284091 5284096 +
tagtcccttcaccatcttgttt

SEQ ID NO: 94091 - DNA, 22 bp, Artificial Sequence
  Synthetic oligonucleotide; CTA chr11 5284076 5284097 5284093 5284098 +
gtcccttcaccatcttgtttcc

SEQ ID NO: 94092 - DNA, 22 bp, Artificial Sequence
  Synthetic oligonucleotide; CTT chr11 5284083 5284104 5284100 5284105 +
caccatcttgtttccctctcaa

SEQ ID NO: 94093 - DNA, 22 bp, Artificial Sequence
  Synthetic oligonucleotide; TTC chr11 5284084 5284105 5284101 5284106 +
accatcttgtttccctctcaac

SEQ ID NO: 94094 - DNA, 22 bp, Artificial Sequence
  Synthetic oligonucleotide; CTT chr11 5284092 5284113 5284109 5284114 +
gtttccctctcaactcctgtgc

SEQ ID NO: 94095 - DNA, 22 bp, Artificial Sequence
  Synthetic oligonucleotide; TTG chr11 5284093 5284114 5284110 5284115 +
tttccctctcaactcctgtgca

SEQ ID NO: 94096 - DNA, 22 bp, Artificial Sequence
  Synthetic oligonucleotide; TTT chr11 5284096 5284117 5284113 5284118 +
ccctctcaactcctgtgcagat

SEQ ID NO: 94097 - DNA, 22 bp, Artificial Sequence
  Synthetic oligonucleotide; TTC chr11 5284097 5284118 5284114 5284119 +
cctctcaactcctgtgcagatt

SEQ ID NO: 94098 - DNA, 22 bp, Artificial Sequence
  Synthetic oligonucleotide; CTC chr11 5284101 5284122 5284118 5284123 +
tcaactcctgtgcagattccta

SEQ ID NO: 94099 - DNA, 22 bp, Artificial Sequence
  Synthetic oligonucleotide; CTC chr11 5284103 5284124 5284120 5284125 +
aactcctgtgcagattcctaaa

SEQ ID NO: 94100 - DNA, 22 bp, Artificial Sequence
  Synthetic oligonucleotide; CTC chr11 5284108 5284129 5284125 5284130 +
ctgtgcagattcctaaaaattt

SEQ ID NO: 94101 - DNA, 22 bp, Artificial Sequence
  Synthetic oligonucleotide; CTG chr11 5284111 5284132 5284128 5284133 +
tgcagattcctaaaaatttctc

SEQ ID NO: 94102 - DNA, 22 bp, Artificial Sequence
  Synthetic oligonucleotide; TTC chr11 5284120 5284141 5284137 5284142 +
ctaaaaatttctcatgttcaga

SEQ ID NO: 94103 - DNA, 22 bp, Artificial Sequence
  Synthetic oligonucleotide; CTA chr11 5284123 5284144 5284140 5284145 +
aaaatttctcatgttcagaacc

SEQ ID NO: 94104 - DNA, 22 bp, Artificial Sequence
  Synthetic oligonucleotide; TTT chr11 5284130 5284151 5284147 5284152 +
ctcatgttcagaaccttgggct

SEQ ID NO: 94105 - DNA, 22 bp, Artificial Sequence
  Synthetic oligonucleotide; TTC chr11 5284131 5284152 5284148 5284153 +
tcatgttcagaaccttgggctt

SEQ ID NO: 94106 - DNA, 22 bp, Artificial Sequence
  Synthetic oligonucleotide; CTC chr11 5284133 5284154 5284150 5284155 +
atgttcagaaccttgggcttcc

SEQ ID NO: 94107 - DNA, 22 bp, Artificial Sequence
  Synthetic oligonucleotide; TTC chr11 5284139 5284160 5284156 5284161 +
agaaccttgggcttccatgttt

SEQ ID NO: 94108 - DNA, 22 bp, Artificial Sequence
  Synthetic oligonucleotide; CTT chr11 5284147 5284168 5284164 5284169 +
gggcttccatgtttccagtgaa

SEQ ID NO: 94109 - DNA, 22 bp, Artificial Sequence
  Synthetic oligonucleotide; TTG chr11 5284148 5284169 5284165 5284170 +
ggcttccatgtttccagtgaag

SEQ ID NO: 94110 - DNA, 22 bp, Artificial Sequence
  Synthetic oligonucleotide; CTT chr11 5284153 5284174 5284170 5284175 +
ccatgtttccagtgaagtcaga

SEQ ID NO: 94111 - DNA, 22 bp, Artificial Sequence
  Synthetic oligonucleotide; TTC chr11 5284154 5284175 5284171 5284176 +
catgtttccagtgaagtcagat

SEQ ID NO: 94112 - DNA, 22 bp, Artificial Sequence
  Synthetic oligonucleotide; TTT chr11 5284161 5284182 5284178 5284183 +
ccagtgaagtcagattttttta

SEQ ID NO: 94113 - DNA, 22 bp, Artificial Sequence
  Synthetic oligonucleotide; TTC chr11 5284162 5284183 5284179 5284184 +
cagtgaagtcagatttttttag

SEQ ID NO: 94114 - DNA, 22 bp, Artificial Sequence
  Synthetic oligonucleotide; TTT chr11 5284178 5284199 5284195 5284200 +
ttttagatggcaaagttgctgt

SEQ ID NO: 94115 - DNA, 22 bp, Artificial Sequence
  Synthetic oligonucleotide; TTT chr11 5284179 5284200 5284196 5284201 +
tttagatggcaaagttgctgtt

SEQ ID NO: 94116 - DNA, 22 bp, Artificial Sequence
  Synthetic oligonucleotide; TTT chr11 5284180 5284201 5284197 5284202 +
ttagatggcaaagttgctgtta

SEQ ID NO: 94117 - DNA, 22 bp, Artificial Sequence
  Synthetic oligonucleotide; TTT chr11 5284181 5284202 5284198 5284203 +
tagatggcaaagttgctgttag

SEQ ID NO: 94118 - DNA, 22 bp, Artificial Sequence
  Synthetic oligonucleotide; TTT chr11 5284182 5284203 5284199 5284204 +
agatggcaaagttgctgttaga

SEQ ID NO: 94119 - DNA, 22 bp, Artificial Sequence
  Synthetic oligonucleotide; TTA chr11 5284183 5284204 5284200 5284205 +
gatggcaaagttgctgttagac

SEQ ID NO: 94120 - DNA, 22 bp, Artificial Sequence
  Synthetic oligonucleotide; TTG chr11 5284196 5284217 5284213 5284218 +
ctgttagacaatttcatctgtg

SEQ ID NO: 94121 - DNA, 22 bp, Artificial Sequence
  Synthetic oligonucleotide; CTG chr11 5284199 5284220 5284216 5284221 +
ttagacaatttcatctgtgccc

SEQ ID NO: 94122 - DNA, 22 bp, Artificial Sequence
  Synthetic oligonucleotide; TTA chr11 5284202 5284223 5284219 5284224 +
gacaatttcatctgtgccctgc

SEQ ID NO: 94123 - DNA, 22 bp, Artificial Sequence
  Synthetic oligonucleotide; TTT chr11 5284210 5284231 5284227 5284232 +
catctgtgccctgcttaggagc

SEQ ID NO: 94124 - DNA, 22 bp, Artificial Sequence
  Synthetic oligonucleotide; TTC chr11 5284211 5284232 5284228 5284233 +
atctgtgccctgcttaggagct

SEQ ID NO: 94125 - DNA, 22 bp, Artificial Sequence
  Synthetic oligonucleotide; CTG chr11 5284216 5284237 5284233 5284238 +
tgccctgcttaggagcttaatc

SEQ ID NO: 94126 - DNA, 22 bp, Artificial Sequence
  Synthetic oligonucleotide; CTG chr11 5284223 5284244 5284240 5284245 +
cttaggagcttaatctttaatg

SEQ ID NO: 94127 - DNA, 22 bp, Artificial Sequence
  Synthetic oligonucleotide; CTT chr11 5284226 5284247 5284243 5284248 +
aggagcttaatctttaatgaaa

SEQ ID NO: 94128 - DNA, 22 bp, Artificial Sequence
  Synthetic oligonucleotide; TTA chr11 5284227 5284248 5284244 5284249 +
ggagcttaatctttaatgaaag

SEQ ID NO: 94129 - DNA, 22 bp, Artificial Sequence
  Synthetic oligonucleotide; CTT chr11 5284234 5284255 5284251 5284256 +
aatctttaatgaaagctaagct

SEQ ID NO: 94130 - DNA, 22 bp, Artificial Sequence
  Synthetic oligonucleotide; TTA chr11 5284235 5284256 5284252 5284257 +
atctttaatgaaagctaagctt

SEQ ID NO: 94131 - DNA, 22 bp, Artificial Sequence
  Synthetic oligonucleotide; CTT chr11 5284240 5284261 5284257 5284262 +
taatgaaagctaagctttcatt

SEQ ID NO: 94132 - DNA, 22 bp, Artificial Sequence
  Synthetic oligonucleotide; TTT chr11 5284241 5284262 5284258 5284263 +
aatgaaagctaagctttcatta

SEQ ID NO: 94133 - DNA, 22 bp, Artificial Sequence
  Synthetic oligonucleotide; TTA chr11 5284242 5284263 5284259 5284264 +
atgaaagctaagctttcattaa

SEQ ID NO: 94134 - DNA, 22 bp, Artificial Sequence
  Synthetic oligonucleotide; CTA chr11 5284252 5284273 5284269 5284274 +
agctttcattaaaaaaagtcta

SEQ ID NO: 94135 - DNA, 22 bp, Artificial Sequence
  Synthetic oligonucleotide; CTT chr11 5284257 5284278 5284274 5284279 +
tcattaaaaaaagtctaaccag

SEQ ID NO: 94136 - DNA, 22 bp, Artificial Sequence
  Synthetic oligonucleotide; TTT chr11 5284258 5284279 5284275 5284280 +
cattaaaaaaagtctaaccagc

SEQ ID NO: 94137 - DNA, 22 bp, Artificial Sequence
  Synthetic oligonucleotide; TTC chr11 5284259 5284280 5284276 5284281 +
attaaaaaaagtctaaccagct

SEQ ID NO: 94138 - DNA, 22 bp, Artificial Sequence
  Synthetic oligonucleotide; TTA chr11 5284263 5284284 5284280 5284285 +
aaaaaagtctaaccagctgcat

SEQ ID NO: 94139 - DNA, 22 bp, Artificial Sequence
  Synthetic oligonucleotide; CTA chr11 5284274 5284295 5284291 5284296 +
accagctgcattcgactttgac

SEQ ID NO: 94140 - DNA, 22 bp, Artificial Sequence
  Synthetic oligonucleotide; CTG chr11 5284282 5284303 5284299 5284304 +
cattcgactttgactgcagcag

SEQ ID NO: 94141 - DNA, 22 bp, Artificial Sequence
  Synthetic oligonucleotide; TTC chr11 5284287 5284308 5284304 5284309 +
gactttgactgcagcagctggt

SEQ ID NO: 94142 - DNA, 22 bp, Artificial Sequence
  Synthetic oligonucleotide; CTT chr11 5284292 5284313 5284309 5284314 +
tgactgcagcagctggttagaa

SEQ ID NO: 94143 - DNA, 22 bp, Artificial Sequence
  Synthetic oligonucleotide; TTT chr11 5284293 5284314 5284310 5284315 +
gactgcagcagctggttagaag

SEQ ID NO: 94144 - DNA, 22 bp, Artificial Sequence
  Synthetic oligonucleotide; TTG chr11 5284294 5284315 5284311 5284316 +
actgcagcagctggttagaagg

SEQ ID NO: 94145 - DNA, 22 bp, Artificial Sequence
  Synthetic oligonucleotide; CTG chr11 5284298 5284319 5284315 5284320 +
cagcagctggttagaaggttct

SEQ ID NO: 94146 - DNA, 22 bp, Artificial Sequence
  Synthetic oligonucleotide; CTG chr11 5284307 5284328 5284324 5284329 +
gttagaaggttctactggagga

SEQ ID NO: 94147 - DNA, 22 bp, Artificial Sequence
  Synthetic oligonucleotide; TTA chr11 5284311 5284332 5284328 5284333 +
gaaggttctactggaggagggt

SEQ ID NO: 94148 - DNA, 22 bp, Artificial Sequence
  Synthetic oligonucleotide; TTC chr11 5284319 5284340 5284336 5284341 +
tactggaggagggtcccagccc

SEQ ID NO: 94149 - DNA, 22 bp, Artificial Sequence
  Synthetic oligonucleotide; CTA chr11 5284321 5284342 5284338 5284343 +
ctggaggagggtcccagcccat

SEQ ID NO: 94150 - DNA, 22 bp, Artificial Sequence
  Synthetic oligonucleotide; CTG chr11 5284324 5284345 5284341 5284346 +
gaggagggtcccagcccattgc

SEQ ID NO: 94151 - DNA, 22 bp, Artificial Sequence
  Synthetic oligonucleotide; TTG chr11 5284345 5284366 5284362 5284367 +
ctaaattaacatcaggctctga

SEQ ID NO: 94152 - DNA, 22 bp, Artificial Sequence
  Synthetic oligonucleotide; CTA chr11 5284348 5284369 5284365 5284370 +
aattaacatcaggctctgagac

SEQ ID NO: 94153 - DNA, 22 bp, Artificial Sequence
  Synthetic oligonucleotide; TTA chr11 5284353 5284374 5284370 5284375 +
acatcaggctctgagactggca

SEQ ID NO: 94154 - DNA, 22 bp, Artificial Sequence
  Synthetic oligonucleotide; CTC chr11 5284364 5284385 5284381 5284386 +
tgagactggcagtatatctcta

SEQ ID NO: 94155 - DNA, 22 bp, Artificial Sequence
  Synthetic oligonucleotide; CTG chr11 5284366 5284387 5284383 5284388 +
agactggcagtatatctctaac

SEQ ID NO: 94156 - DNA, 22 bp, Artificial Sequence
  Synthetic oligonucleotide; CTG chr11 5284372 5284393 5284389 5284394 +
gcagtatatctctaacagtggt

SEQ ID NO: 94157 - DNA, 22 bp, Artificial Sequence
  Synthetic oligonucleotide; CTC chr11 5284384 5284405 5284401 5284406 +
taacagtggttgatgctatctt

SEQ ID NO: 94158 - DNA, 22 bp, Artificial Sequence
  Synthetic oligonucleotide; CTA chr11 5284386 5284407 5284403 5284408 +
acagtggttgatgctatcttct

SEQ ID NO: 94159 - DNA, 22 bp, Artificial Sequence
  Synthetic oligonucleotide; TTG chr11 5284396 5284417 5284413 5284418 +
atgctatcttctggaacttgcc

SEQ ID NO: 94160 - DNA, 22 bp, Artificial Sequence
  Synthetic oligonucleotide; CTA chr11 5284402 5284423 5284419 5284424 +
tcttctggaacttgcctgctac

SEQ ID NO: 94161 - DNA, 22 bp, Artificial Sequence
  Synthetic oligonucleotide; CTT chr11 5284406 5284427 5284423 5284428 +
ctggaacttgcctgctacattg

SEQ ID NO: 94162 - DNA, 22 bp, Artificial Sequence
  Synthetic oligonucleotide; TTC chr11 5284407 5284428 5284424 5284429 +
tggaacttgcctgctacattga

SEQ ID NO: 94163 - DNA, 22 bp, Artificial Sequence
  Synthetic oligonucleotide; CTG chr11 5284409 5284430 5284426 5284431 +
gaacttgcctgctacattgaga

SEQ ID NO: 94164 - DNA, 22 bp, Artificial Sequence
  Synthetic oligonucleotide; CTT chr11 5284415 5284436 5284432 5284437 +
gcctgctacattgagaccactg

SEQ ID NO: 94165 - DNA, 22 bp, Artificial Sequence
  Synthetic oligonucleotide; TTG chr11 5284416 5284437 5284433 5284438 +
cctgctacattgagaccactga

SEQ ID NO: 94166 - DNA, 22 bp, Artificial Sequence
  Synthetic oligonucleotide; CTG chr11 5284420 5284441 5284437 5284442 +
ctacattgagaccactgaccca

SEQ ID NO: 94167 - DNA, 22 bp, Artificial Sequence
  Synthetic oligonucleotide; CTA chr11 5284423 5284444 5284440 5284445 +
cattgagaccactgacccatac

SEQ ID NO: 94168 - DNA, 22 bp, Artificial Sequence
  Synthetic oligonucleotide; TTG chr11 5284428 5284449 5284445 5284450 +
agaccactgacccatacatagg

SEQ ID NO: 94169 - DNA, 22 bp, Artificial Sequence
  Synthetic oligonucleotide; CTG chr11 5284437 5284458 5284454 5284459 +
acccatacataggaagcccata

SEQ ID NO: 94170 - DNA, 22 bp, Artificial Sequence
  Synthetic oligonucleotide; CTC chr11 5284463 5284484 5284480 5284485 +
tgtcctgaactgttaggccact

SEQ ID NO: 94171 - DNA, 22 bp, Artificial Sequence
  Synthetic oligonucleotide; CTG chr11 5284465 5284486 5284482 5284487 +
tcctgaactgttaggccactgg

SEQ ID NO: 94172 - DNA, 22 bp, Artificial Sequence
  Synthetic oligonucleotide; CTG chr11 5284470 5284491 5284487 5284492 +
aactgttaggccactggtccag

SEQ ID NO: 94173 - DNA, 22 bp, Artificial Sequence
  Synthetic oligonucleotide; CTG chr11 5284475 5284496 5284492 5284497 +
ttaggccactggtccagagagt

SEQ ID NO: 94174 - DNA, 22 bp, Artificial Sequence
  Synthetic oligonucleotide; TTA chr11 5284478 5284499 5284495 5284500 +
ggccactggtccagagagtgtg

SEQ ID NO: 94175 - DNA, 22 bp, Artificial Sequence
  Synthetic oligonucleotide; CTG chr11 5284486 5284507 5284503 5284508 +
gtccagagagtgtgcatctcct

SEQ ID NO: 94176 - DNA, 22 bp, Artificial Sequence
  Synthetic oligonucleotide; CTC chr11 5284506 5284527 5284523 5284528 +
ctttgatcctcataataaccct

SEQ ID NO: 94177 - DNA, 22 bp, Artificial Sequence
  Synthetic oligonucleotide; CTT chr11 5284509 5284530 5284526 5284531 +
tgatcctcataataaccctatg

SEQ ID NO: 94178 - DNA, 22 bp, Artificial Sequence
  Synthetic oligonucleotide; TTT chr11 5284510 5284531 5284527 5284532 +
gatcctcataataaccctatga

SEQ ID NO: 94179 - DNA, 22 bp, Artificial Sequence
  Synthetic oligonucleotide; TTG chr11 5284511 5284532 5284528 5284533 +
atcctcataataaccctatgag

SEQ ID NO: 94180 - DNA, 22 bp, Artificial Sequence
  Synthetic oligonucleotide; CTC chr11 5284517 5284538 5284534 5284539 +
ataataaccctatgagatagac

SEQ ID NO: 94181 - DNA, 22 bp, Artificial Sequence
  Synthetic oligonucleotide; CTA chr11 5284529 5284550 5284546 5284551 +
tgagatagacacaattattact

SEQ ID NO: 94182 - DNA, 22 bp, Artificial Sequence
  Synthetic oligonucleotide; TTA chr11 5284546 5284567 5284563 5284568 +
ttactcttactttatagatgat

SEQ ID NO: 94183 - DNA, 22 bp, Artificial Sequence
  Synthetic oligonucleotide; TTA chr11 5284549 5284570 5284566 5284571 +
ctcttactttatagatgatgat

SEQ ID NO: 94184 - DNA, 22 bp, Artificial Sequence
  Synthetic oligonucleotide; CTC chr11 5284552 5284573 5284569 5284574 +
ttactttatagatgatgatcct

SEQ ID NO: 94185 - DNA, 22 bp, Artificial Sequence
  Synthetic oligonucleotide; CTT chr11 5284554 5284575 5284571 5284576 +
actttatagatgatgatcctga

SEQ ID NO: 94186 - DNA, 22 bp, Artificial Sequence
  Synthetic oligonucleotide; TTA chr11 5284555 5284576 5284572 5284577 +
ctttatagatgatgatcctgaa

SEQ ID NO: 94187 - DNA, 22 bp, Artificial Sequence
  Synthetic oligonucleotide; CTT chr11 5284558 5284579 5284575 5284580 +
tatagatgatgatcctgaaaac

SEQ ID NO: 94188 - DNA, 22 bp, Artificial Sequence
  Synthetic oligonucleotide; TTT chr11 5284559 5284580 5284576 5284581 +
atagatgatgatcctgaaaaca

SEQ ID NO: 94189 - DNA, 22 bp, Artificial Sequence
  Synthetic oligonucleotide; TTA chr11 5284560 5284581 5284577 5284582 +
tagatgatgatcctgaaaacat

SEQ ID NO: 94190 - DNA, 22 bp, Artificial Sequence
  Synthetic oligonucleotide; CTG chr11 5284575 5284596 5284592 5284597 +
aaaacataggagtcaaggcact

SEQ ID NO: 94191 - DNA, 22 bp, Artificial Sequence
  Synthetic oligonucleotide; CTT chr11 5284598 5284619 5284615 5284620 +
gcccctagctgggggtataggg

SEQ ID NO: 94192 - DNA, 22 bp, Artificial Sequence
  Synthetic oligonucleotide; TTG chr11 5284599 5284620 5284616 5284621 +
cccctagctgggggtatagggg

SEQ ID NO: 94193 - DNA, 22 bp, Artificial Sequence
  Synthetic oligonucleotide; CTA chr11 5284605 5284626 5284622 5284627 +
gctgggggtataggggagcagt

SEQ ID NO: 94194 - DNA, 22 bp, Artificial Sequence
  Synthetic oligonucleotide; CTG chr11 5284609 5284630 5284626 5284631 +
ggggtataggggagcagtccca

SEQ ID NO: 94195 - DNA, 22 bp, Artificial Sequence
  Synthetic oligonucleotide; CTG chr11 5284656 5284677 5284673 5284678 +
ctatgctgtgcctcccccacct

SEQ ID NO: 94196 - DNA, 22 bp, Artificial Sequence
  Synthetic oligonucleotide; CTA chr11 5284659 5284680 5284676 5284681 +
tgctgtgcctcccccacctttc

SEQ ID NO: 94197 - DNA, 22 bp, Artificial Sequence
  Synthetic oligonucleotide; CTG chr11 5284664 5284685 5284681 5284686 +
tgcctcccccacctttcccatg

SEQ ID NO: 94198 - DNA, 22 bp, Artificial Sequence
  Synthetic oligonucleotide; CTC chr11 5284670 5284691 5284687 5284692 +
ccccacctttcccatgtctgcc

SEQ ID NO: 94199 - DNA, 22 bp, Artificial Sequence
  Synthetic oligonucleotide; CTT chr11 5284679 5284700 5284696 5284701 +
tcccatgtctgccctctactca

SEQ ID NO: 94200 - DNA, 22 bp, Artificial Sequence
  Synthetic oligonucleotide; TTT chr11 5284680 5284701 5284697 5284702 +
cccatgtctgccctctactcat

SEQ ID NO: 94201 - DNA, 22 bp, Artificial Sequence
  Synthetic oligonucleotide; TTC chr11 5284681 5284702 5284698 5284703 +
ccatgtctgccctctactcatg

SEQ ID NO: 94202 - DNA, 22 bp, Artificial Sequence
  Synthetic oligonucleotide; CTG chr11 5284690 5284711 5284707 5284712 +
ccctctactcatggtctatctc

SEQ ID NO: 94203 - DNA, 22 bp, Artificial Sequence
  Synthetic oligonucleotide; CTC chr11 5284695 5284716 5284712 5284717 +
tactcatggtctatctctcctg

SEQ ID NO: 94204 - DNA, 22 bp, Artificial Sequence
  Synthetic oligonucleotide; CTA chr11 5284697 5284718 5284714 5284719 +
ctcatggtctatctctcctggc

SEQ ID NO: 94205 - DNA, 22 bp, Artificial Sequence
  Synthetic oligonucleotide; CTC chr11 5284700 5284721 5284717 5284722 +
atggtctatctctcctggctcc

SEQ ID NO: 94206 - DNA, 22 bp, Artificial Sequence
  Synthetic oligonucleotide; CTA chr11 5284708 5284729 5284725 5284730 +
tctctcctggctcctgggagtc

SEQ ID NO: 94207 - DNA, 22 bp, Artificial Sequence
  Synthetic oligonucleotide; CTC chr11 5284712 5284733 5284729 5284734 +
tcctggctcctgggagtcatgg

SEQ ID NO: 94208 - DNA, 22 bp, Artificial Sequence
  Synthetic oligonucleotide; CTC chr11 5284714 5284735 5284731 5284736 +
ctggctcctgggagtcatggac

SEQ ID NO: 94209 - DNA, 22 bp, Artificial Sequence
  Synthetic oligonucleotide; CTG chr11 5284717 5284738 5284734 5284739 +
gctcctgggagtcatggactcc

SEQ ID NO: 94210 - DNA, 22 bp, Artificial Sequence
  Synthetic oligonucleotide; CTC chr11 5284721 5284742 5284738 5284743 +
ctgggagtcatggactccaccc

SEQ ID NO: 94211 - DNA, 22 bp, Artificial Sequence
  Synthetic oligonucleotide; CTG chr11 5284724 5284745 5284741 5284746 +
ggagtcatggactccacccagc

SEQ ID NO: 94212 - DNA, 22 bp, Artificial Sequence
  Synthetic oligonucleotide; CTC chr11 5284738 5284759 5284755 5284760 +
cacccagcaccaccaacctgac

SEQ ID NO: 94213 - DNA, 22 bp, Artificial Sequence
  Synthetic oligonucleotide; CTG chr11 5284758 5284779 5284775 5284780 +
acctaaccacctatctgagcct

SEQ ID NO: 94214 - DNA, 22 bp, Artificial Sequence
  Synthetic oligonucleotide; CTA chr11 5284763 5284784 5284780 5284785 +
accacctatctgagcctgccag

SEQ ID NO: 94215 - DNA, 22 bp, Artificial Sequence
  Synthetic oligonucleotide; CTA chr11 5284771 5284792 5284788 5284793 +
tctgagcctgccagcctataac

SEQ ID NO: 94216 - DNA, 22 bp, Artificial Sequence
  Synthetic oligonucleotide; CTG chr11 5284775 5284796 5284792 5284797 +
agcctgccagcctataacccat

SEQ ID NO: 94217 - DNA, 22 bp, Artificial Sequence
  Synthetic oligonucleotide; CTG chr11 5284781 5284802 5284798 5284803 +
ccagcctataacccatctgggc

SEQ ID NO: 94218 - DNA, 22 bp, Artificial Sequence
  Synthetic oligonucleotide; CTA chr11 5284789 5284810 5284806 5284811 +
taacccatctgggccctgatag

SEQ ID NO: 94219 - DNA, 22 bp, Artificial Sequence
  Synthetic oligonucleotide; CTG chr11 5284800 5284821 5284817 5284822 +
ggccctgatagctggtggccag

SEQ ID NO: 94220 - DNA, 22 bp, Artificial Sequence
  Synthetic oligonucleotide; CTG chr11 5284807 5284828 5284824 5284829 +
atagctggtggccagccctgac

SEQ ID NO: 94221 - DNA, 22 bp, Artificial Sequence
  Synthetic oligonucleotide; CTG chr11 5284814 5284835 5284831 5284836 +
gtggccagccctgaccccaccc

SEQ ID NO: 94222 - DNA, 22 bp, Artificial Sequence
  Synthetic oligonucleotide; CTG chr11 5284827 5284848 5284844 5284849 +
accccaccccaccctccctgga

SEQ ID NO: 94223 - DNA, 22 bp, Artificial Sequence
  Synthetic oligonucleotide; CTC chr11 5284843 5284864 5284860 5284865 +
cctggaacctctgatagacaca

SEQ ID NO: 94224 - DNA, 22 bp, Artificial Sequence
  Synthetic oligonucleotide; CTG chr11 5284847 5284868 5284864 5284869 +
gaacctctgatagacacatctg

SEQ ID NO: 94225 - DNA, 22 bp, Artificial Sequence
  Synthetic oligonucleotide; CTC chr11 5284854 5284875 5284871 5284876 +
tgatagacacatctggcacacc

SEQ ID NO: 94226 - DNA, 22 bp, Artificial Sequence
  Synthetic oligonucleotide; CTG chr11 5284856 5284877 5284873 5284878 +
atagacacatctggcacaccag

SEQ ID NO: 94227 - DNA, 22 bp, Artificial Sequence
  Synthetic oligonucleotide; CTG chr11 5284869 5284890 5284886 5284891 +
gcacaccagctcgcaaagtcac

SEQ ID NO: 94228 - DNA, 22 bp, Artificial Sequence
  Synthetic oligonucleotide; CTC chr11 5284881 5284902 5284898 5284903 +
gcaaagtcaccgtgagggtctt

SEQ ID NO: 94229 - DNA, 22 bp, Artificial Sequence
  Synthetic oligonucleotide; CTT chr11 5284903 5284924 5284920 5284925 +
gtgtttgctgagtcaaaattcc

SEQ ID NO: 94230 - DNA, 22 bp, Artificial Sequence
  Synthetic oligonucleotide; TTG chr11 5284904 5284925 5284921 5284926 +
tgtttgctgagtcaaaattcct

SEQ ID NO: 94231 - DNA, 22 bp, Artificial Sequence
  Synthetic oligonucleotide; TTT chr11 5284909 5284930 5284926 5284931 +
gctgagtcaaaattccttgaaa

SEQ ID NO: 94232 - DNA, 22 bp, Artificial Sequence
  Synthetic oligonucleotide; TTG chr11 5284910 5284931 5284927 5284932 +
ctgagtcaaaattccttgaaat

SEQ ID NO: 94233 - DNA, 22 bp, Artificial Sequence
  Synthetic oligonucleotide; CTG chr11 5284913 5284934 5284930 5284935 +
agtcaaaattccttgaaatcca

SEQ ID NO: 94234 - DNA, 22 bp, Artificial Sequence
  Synthetic oligonucleotide; TTC chr11 5284924 5284945 5284941 5284946 +
cttgaaatccaagtccttagag

SEQ ID NO: 94235 - DNA, 22 bp, Artificial Sequence
  Synthetic oligonucleotide; CTT chr11 5284927 5284948 5284944 5284949 +
gaaatccaagtccttagagact

SEQ ID NO: 94236 - DNA, 22 bp, Artificial Sequence
  Synthetic oligonucleotide; TTG chr11 5284928 5284949 5284945 5284950 +
aaatccaagtccttagagactc

SEQ ID NO: 94237 - DNA, 22 bp, Artificial Sequence
  Synthetic oligonucleotide; CTT chr11 5284942 5284963 5284959 5284964 +
agagactcctgctcccaaattt

SEQ ID NO: 94238 - DNA, 22 bp, Artificial Sequence
  Synthetic oligonucleotide; TTA chr11 5284943 5284964 5284960 5284965 +
gagactcctgctcccaaattta

SEQ ID NO: 94239 - DNA, 22 bp, Artificial Sequence
  Synthetic oligonucleotide; CTC chr11 5284950 5284971 5284967 5284972 +
ctgctcccaaatttacagtcat

SEQ ID NO: 94240 - DNA, 22 bp, Artificial Sequence
  Synthetic oligonucleotide; CTG chr11 5284953 5284974 5284970 5284975 +
ctcccaaatttacagtcataga

SEQ ID NO: 94241 - DNA, 22 bp, Artificial Sequence
  Synthetic oligonucleotide; CTC chr11 5284956 5284977 5284973 5284978 +
ccaaatttacagtcatagactt

SEQ ID NO: 94242 - DNA, 22 bp, Artificial Sequence
  Synthetic oligonucleotide; TTT chr11 5284964 5284985 5284981 5284986 +
acagtcatagacttcttcatgg

SEQ ID NO: 94243 - DNA, 22 bp, Artificial Sequence
  Synthetic oligonucleotide; TTA chr11 5284965 5284986 5284982 5284987 +
cagtcatagacttcttcatggc

SEQ ID NO: 94244 - DNA, 22 bp, Artificial Sequence
  Synthetic oligonucleotide; CTT chr11 5284978 5284999 5284995 5285000 +
cttcatggctgtctcctttatc

SEQ ID NO: 94245 - DNA, 22 bp, Artificial Sequence
  Synthetic oligonucleotide; TTC chr11 5284979 5285000 5284996 5285001 +
ttcatggctgtctcctttatcc

SEQ ID NO: 94246 - DNA, 22 bp, Artificial Sequence
  Synthetic oligonucleotide; CTT chr11 5284981 5285002 5284998 5285003 +
catggctgtctcctttatccac

SEQ ID NO: 94247 - DNA, 22 bp, Artificial Sequence
  Synthetic oligonucleotide; TTC chr11 5284982 5285003 5284999 5285004 +
atggctgtctcctttatccaca

SEQ ID NO: 94248 - DNA, 22 bp, Artificial Sequence
  Synthetic oligonucleotide; CTG chr11 5284989 5285010 5285006 5285011 +
tctcctttatccacagaatgat

SEQ ID NO: 94249 - DNA, 22 bp, Artificial Sequence
  Synthetic oligonucleotide; CTC chr11 5284993 5285014 5285010 5285015 +
ctttatccacagaatgattcct

SEQ ID NO: 94250 - DNA, 22 bp, Artificial Sequence
  Synthetic oligonucleotide; CTT chr11 5284996 5285017 5285013 5285018 +
tatccacagaatgattcctttg

SEQ ID NO: 94251 - DNA, 22 bp, Artificial Sequence
  Synthetic oligonucleotide; TTT chr11 5284997 5285018 5285014 5285019 +
atccacagaatgattcctttgc

SEQ ID NO: 94252 - DNA, 22 bp, Artificial Sequence
  Synthetic oligonucleotide; TTA chr11 5284998 5285019 5285015 5285020 +
tccacagaatgattcctttgct

SEQ ID NO: 94253 - DNA, 22 bp, Artificial Sequence
  Synthetic oligonucleotide; TTC chr11 5285013 5285034 5285030 5285035 +
ctttgcttcattgccccatcca

SEQ ID NO: 94254 - DNA, 22 bp, Artificial Sequence
  Synthetic oligonucleotide; CTT chr11 5285016 5285037 5285033 5285038 +
tgcttcattgccccatccatct

SEQ ID NO: 94255 - DNA, 22 bp, Artificial Sequence
  Synthetic oligonucleotide; TTT chr11 5285017 5285038 5285034 5285039 +
gcttcattgccccatccatctg

SEQ ID NO: 94256 - DNA, 22 bp, Artificial Sequence
  Synthetic oligonucleotide; TTG chr11 5285018 5285039 5285035 5285040 +
cttcattgccccatccatctga

SEQ ID NO: 94257 - DNA, 22 bp, Artificial Sequence
  Synthetic oligonucleotide; CTT chr11 5285021 5285042 5285038 5285043 +
cattgccccatccatctgatcc

SEQ ID NO: 94258 - DNA, 22 bp, Artificial Sequence
  Synthetic oligonucleotide; TTC chr11 5285022 5285043 5285039 5285044 +
attgccccatccatctgatcct

SEQ ID NO: 94259 - DNA, 22 bp, Artificial Sequence
  Synthetic oligonucleotide; TTG chr11 5285026 5285047 5285043 5285048 +
ccccatccatctgatcctcctc

SEQ ID NO: 94260 - DNA, 22 bp, Artificial Sequence
  Synthetic oligonucleotide; CTG chr11 5285039 5285060 5285056 5285061 +
atcctcctcatcagtgcagcac

SEQ ID NO: 94261 - DNA, 22 bp, Artificial Sequence
  Synthetic oligonucleotide; CTC chr11 5285045 5285066 5285062 5285067 +
ctcatcagtgcagcacagggcc

SEQ ID NO: 94262 - DNA, 22 bp, Artificial Sequence
  Synthetic oligonucleotide; CTC chr11 5285048 5285069 5285065 5285070 +
atcagtgcagcacagggcccat

SEQ ID NO: 94263 - DNA, 22 bp, Artificial Sequence
  Synthetic oligonucleotide; CTG chr11 5285082 5285103 5285099 5285104 +
cagagtctcacataggtctggc

SEQ ID NO: 94264 - DNA, 22 bp, Artificial Sequence
  Synthetic oligonucleotide; CTC chr11 5285091 5285112 5285108 5285113 +
acataggtctggcactgcctct

SEQ ID NO: 94265 - DNA, 22 bp, Artificial Sequence
  Synthetic oligonucleotide; CTG chr11 5285102 5285123 5285119 5285124 +
gcactgcctctgacatgtccga

SEQ ID NO: 94266 - DNA, 22 bp, Artificial Sequence
  Synthetic oligonucleotide; CTG chr11 5285108 5285129 5285125 5285130 +
cctctgacatgtccgaccttag

SEQ ID NO: 94267 - DNA, 22 bp, Artificial Sequence
  Synthetic oligonucleotide; CTC chr11 5285112 5285133 5285129 5285134 +
tgacatgtccgaccttaggcaa

SEQ ID NO: 94268 - DNA, 22 bp, Artificial Sequence
  Synthetic oligonucleotide; CTG chr11 5285114 5285135 5285131 5285136 +
acatgtccgaccttaggcaaat

SEQ ID NO: 94269 - DNA, 22 bp, Artificial Sequence
  Synthetic oligonucleotide; CTT chr11 5285128 5285149 5285145 5285150 +
aggcaaatgcttgactcttctg

SEQ ID NO: 94270 - DNA, 22 bp, Artificial Sequence
  Synthetic oligonucleotide; TTA chr11 5285129 5285150 5285146 5285151 +
ggcaaatgcttgactcttctga

SEQ ID NO: 94271 - DNA, 22 bp, Artificial Sequence
  Synthetic oligonucleotide; CTT chr11 5285140 5285161 5285157 5285162 +
gactcttctgagctcagtcttg

SEQ ID NO: 94272 - DNA, 22 bp, Artificial Sequence
  Synthetic oligonucleotide; TTG chr11 5285141 5285162 5285158 5285163 +
actcttctgagctcagtcttgt

SEQ ID NO: 94273 - DNA, 22 bp, Artificial Sequence
  Synthetic oligonucleotide; CTC chr11 5285145 5285166 5285162 5285167 +
ttctgagctcagtcttgtcatg

SEQ ID NO: 94274 - DNA, 22 bp, Artificial Sequence
  Synthetic oligonucleotide; CTT chr11 5285147 5285168 5285164 5285169 +
ctgagctcagtcttgtcatggc

SEQ ID NO: 94275 - DNA, 22 bp, Artificial Sequence
  Synthetic oligonucleotide; TTC chr11 5285148 5285169 5285165 5285170 +
tgagctcagtcttgtcatggca

SEQ ID NO: 94276 - DNA, 22 bp, Artificial Sequence
  Synthetic oligonucleotide; CTG chr11 5285150 5285171 5285167 5285172 +
agctcagtcttgtcatggcaaa

SEQ ID NO: 94277 - DNA, 22 bp, Artificial Sequence
  Synthetic oligonucleotide; CTC chr11 5285155 5285176 5285172 5285177 +
agtcttgtcatggcaaaataaa

SEQ ID NO: 94278 - DNA, 22 bp, Artificial Sequence
  Synthetic oligonucleotide; CTT chr11 5285161 5285182 5285178 5285183 +
gtcatggcaaaataaagataat

SEQ ID NO: 94279 - DNA, 22 bp, Artificial Sequence
  Synthetic oligonucleotide; TTG chr11 5285162 5285183 5285179 5285184 +
tcatggcaaaataaagataata

SEQ ID NO: 94280 - DNA, 22 bp, Artificial Sequence
  Synthetic oligonucleotide; TTT chr11 5285193 5285214 5285210 5285215 +
ttttatggagttagcgtgagga

SEQ ID NO: 94281 - DNA, 22 bp, Artificial Sequence
  Synthetic oligonucleotide; TTT chr11 5285194 5285215 5285211 5285216 +
tttatggagttagcgtgaggat

SEQ ID NO: 94282 - DNA, 22 bp, Artificial Sequence
  Synthetic oligonucleotide; TTT chr11 5285195 5285216 5285212 5285217 +
ttatggagttagcgtgaggatg

SEQ ID NO: 94283 - DNA, 22 bp, Artificial Sequence
  Synthetic oligonucleotide; TTT chr11 5285196 5285217 5285213 5285218 +
tatggagttagcgtgaggatgg

SEQ ID NO: 94284 - DNA, 22 bp, Artificial Sequence
  Synthetic oligonucleotide; TTT chr11 5285197 5285218 5285214 5285219 +
atggagttagcgtgaggatgga

SEQ ID NO: 94285 - DNA, 22 bp, Artificial Sequence
  Synthetic oligonucleotide; TTA chr11 5285198 5285219 5285215 5285220 +
tggagttagcgtgaggatggaa

SEQ ID NO: 94286 - DNA, 22 bp, Artificial Sequence
  Synthetic oligonucleotide; TTA chr11 5285206 5285227 5285223 5285228 +
gcgtgaggatggaaaacaatag

SEQ ID NO: 94287 - DNA, 22 bp, Artificial Sequence
  Synthetic oligonucleotide; TTG chr11 5285236 5285257 5285253 5285258 +
attagactataaaaggtctcaa

SEQ ID NO: 94288 - DNA, 22 bp, Artificial Sequence
  Synthetic oligonucleotide; TTA chr11 5285240 5285261 5285257 5285262 +
gactataaaaggtctcaacaaa

SEQ ID NO: 94289 - DNA, 22 bp, Artificial Sequence
  Synthetic oligonucleotide; CTA chr11 5285245 5285266 5285262 5285267 +
taaaaggtctcaacaaatagta

SEQ ID NO: 94290 - DNA, 22 bp, Artificial Sequence
  Synthetic oligonucleotide; CTC chr11 5285256 5285277 5285273 5285278 +
aacaaatagtagtagattttat

SEQ ID NO: 94291 - DNA, 22 bp, Artificial Sequence
  Synthetic oligonucleotide; TTT chr11 5285275 5285296 5285292 5285297 +
tatcgtccattaatccttccct

SEQ ID NO: 94292 - DNA, 22 bp, Artificial Sequence
  Synthetic oligonucleotide; TTT chr11 5285276 5285297 5285293 5285298 +
atcgtccattaatccttccctc

SEQ ID NO: 94293 - DNA, 22 bp, Artificial Sequence
  Synthetic oligonucleotide; TTA chr11 5285277 5285298 5285294 5285299 +
tcgtccattaatccttccctct

SEQ ID NO: 94294 - DNA, 22 bp, Artificial Sequence
  Synthetic oligonucleotide; TTA chr11 5285287 5285308 5285304 5285309 +
atccttccctctcctctcttac

SEQ ID NO: 94295 - DNA, 22 bp, Artificial Sequence
  Synthetic oligonucleotide; CTT chr11 5285293 5285314 5285310 5285315 +
ccctctcctctcttactcatcc

SEQ ID NO: 94296 - DNA, 22 bp, Artificial Sequence
  Synthetic oligonucleotide; TTC chr11 5285294 5285315 5285311 5285316 +
cctctcctctcttactcatccc

SEQ ID NO: 94297 - DNA, 22 bp, Artificial Sequence
  Synthetic oligonucleotide; CTC chr11 5285298 5285319 5285315 5285320 +
tcctctcttactcatcccatca

SEQ ID NO: 94298 - DNA, 22 bp, Artificial Sequence
  Synthetic oligonucleotide; CTC chr11 5285300 5285321 5285317 5285322 +
ctctcttactcatcccatcacg

SEQ ID NO: 94299 - DNA, 22 bp, Artificial Sequence
  Synthetic oligonucleotide; CTC chr11 5285303 5285324 5285320 5285325 +
tcttactcatcccatcacgtat

SEQ ID NO: 94300 - DNA, 22 bp, Artificial Sequence
  Synthetic oligonucleotide; CTC chr11 5285305 5285326 5285322 5285327 +
ttactcatcccatcacgtatgc

SEQ ID NO: 94301 - DNA, 22 bp, Artificial Sequence
  Synthetic oligonucleotide; CTT chr11 5285307 5285328 5285324 5285329 +
actcatcccatcacgtatgcct

SEQ ID NO: 94302 - DNA, 22 bp, Artificial Sequence
  Synthetic oligonucleotide; TTA chr11 5285308 5285329 5285325 5285330 +
ctcatcccatcacgtatgcctc

SEQ ID NO: 94303 - DNA, 22 bp, Artificial Sequence
  Synthetic oligonucleotide; CTC chr11 5285311 5285332 5285328 5285333 +
atcccatcacgtatgcctctta

SEQ ID NO: 94304 - DNA, 22 bp, Artificial Sequence
  Synthetic oligonucleotide; CTC chr11 5285330 5285351 5285347 5285352 +
ttaattttcccttacctataat

SEQ ID NO: 94305 - DNA, 22 bp, Artificial Sequence
  Synthetic oligonucleotide; CTT chr11 5285332 5285353 5285349 5285354 +
aattttcccttacctataataa

SEQ ID NO: 94306 - DNA, 22 bp, Artificial Sequence
  Synthetic oligonucleotide; TTA chr11 5285333 5285354 5285350 5285355 +
attttcccttacctataataag

SEQ ID NO: 94307 - DNA, 22 bp, Artificial Sequence
  Synthetic oligonucleotide; TTT chr11 5285337 5285358 5285354 5285359 +
tcccttacctataataagagtt

SEQ ID NO: 94308 - DNA, 22 bp, Artificial Sequence
  Synthetic oligonucleotide; TTT chr11 5285338 5285359 5285355 5285360 +
cccttacctataataagagtta

SEQ ID NO: 94309 - DNA, 22 bp, Artificial Sequence
  Synthetic oligonucleotide; TTC chr11 5285339 5285360 5285356 5285361 +
ccttacctataataagagttat

SEQ ID NO: 94310 - DNA, 22 bp, Artificial Sequence
  Synthetic oligonucleotide; CTT chr11 5285343 5285364 5285360 5285365 +
acctataataagagttattcct

SEQ ID NO: 94311 - DNA, 22 bp, Artificial Sequence
  Synthetic oligonucleotide; TTA chr11 5285344 5285365 5285361 5285366 +
cctataataagagttattcctc

SEQ ID NO: 94312 - DNA, 22 bp, Artificial Sequence
  Synthetic oligonucleotide; CTA chr11 5285348 5285369 5285365 5285370 +
taataagagttattcctcttat

SEQ ID NO: 94313 - DNA, 22 bp, Artificial Sequence
  Synthetic oligonucleotide; TTA chr11 5285360 5285381 5285377 5285382 +
ttcctcttattatattcttctt

SEQ ID NO: 94314 - DNA, 22 bp, Artificial Sequence
  Synthetic oligonucleotide; TTC chr11 5285363 5285384 5285380 5285385 +
ctcttattatattcttcttata

SEQ ID NO: 94315 - DNA, 22 bp, Artificial Sequence
  Synthetic oligonucleotide; CTC chr11 5285366 5285387 5285383 5285388 +
ttattatattcttcttatagtg

SEQ ID NO: 94316 - DNA, 22 bp, Artificial Sequence
  Synthetic oligonucleotide; CTT chr11 5285368 5285389 5285385 5285390 +
attatattcttcttatagtgat

SEQ ID NO: 94317 - DNA, 22 bp, Artificial Sequence
  Synthetic oligonucleotide; TTA chr11 5285369 5285390 5285386 5285391 +
ttatattcttcttatagtgatt

SEQ ID NO: 94318 - DNA, 22 bp, Artificial Sequence
  Synthetic oligonucleotide; TTA chr11 5285372 5285393 5285389 5285394 +
tattcttcttatagtgattctg

SEQ ID NO: 94319 - DNA, 22 bp, Artificial Sequence
  Synthetic oligonucleotide; TTC chr11 5285377 5285398 5285394 5285399 +
ttcttatagtgattctggatat

SEQ ID NO: 94320 - DNA, 22 bp, Artificial Sequence
  Synthetic oligonucleotide; CTT chr11 5285379 5285400 5285396 5285401 +
cttatagtgattctggatatta

SEQ ID NO: 94321 - DNA, 22 bp, Artificial Sequence
  Synthetic oligonucleotide; TTC chr11 5285380 5285401 5285397 5285402 +
ttatagtgattctggatattaa

SEQ ID NO: 94322 - DNA, 22 bp, Artificial Sequence
  Synthetic oligonucleotide; CTT chr11 5285382 5285403 5285399 5285404 +
atagtgattctggatattaaag

SEQ ID NO: 94323 - DNA, 22 bp, Artificial Sequence
  Synthetic oligonucleotide; TTA chr11 5285383 5285404 5285400 5285405 +
tagtgattctggatattaaagt

SEQ ID NO: 94324 - DNA, 22 bp, Artificial Sequence
  Synthetic oligonucleotide; TTC chr11 5285392 5285413 5285409 5285414 +
tggatattaaagtgggaatgag

SEQ ID NO: 94325 - DNA, 22 bp, Artificial Sequence
  Synthetic oligonucleotide; CTG chr11 5285394 5285415 5285411 5285416 +
gatattaaagtgggaatgaggg

SEQ ID NO: 94326 - DNA, 22 bp, Artificial Sequence
  Synthetic oligonucleotide; TTA chr11 5285401 5285422 5285418 5285423 +
aagtgggaatgaggggcaggcc

SEQ ID NO: 94327 - DNA, 22 bp, Artificial Sequence
  Synthetic oligonucleotide; CTA chr11 5285427 5285448 5285444 5285449 +
acgaagaagatgtttctcaaag

SEQ ID NO: 94328 - DNA, 22 bp, Artificial Sequence
  Synthetic oligonucleotide; TTT chr11 5285442 5285463 5285459 5285464 +
ctcaaagaagccattctcccca

SEQ ID NO: 94329 - DNA, 22 bp, Artificial Sequence
  Synthetic oligonucleotide; TTC chr11 5285443 5285464 5285460 5285465 +
tcaaagaagccattctccccac

SEQ ID NO: 94330 - DNA, 22 bp, Artificial Sequence
  Synthetic oligonucleotide; CTC chr11 5285445 5285466 5285462 5285467 +
aaagaagccattctccccacat

SEQ ID NO: 94331 - DNA, 22 bp, Artificial Sequence
  Synthetic oligonucleotide; TTC chr11 5285458 5285479 5285475 5285480 +
tccccacatagatcatctcagc

SEQ ID NO: 94332 - DNA, 22 bp, Artificial Sequence
  Synthetic oligonucleotide; CTC chr11 5285460 5285481 5285477 5285482 +
cccacatagatcatctcagcag

SEQ ID NO: 94333 - DNA, 22 bp, Artificial Sequence
  Synthetic oligonucleotide; CTC chr11 5285477 5285498 5285494 5285499 +
agcagggttcaggaagataaag

SEQ ID NO: 94334 - DNA, 22 bp, Artificial Sequence
  Synthetic oligonucleotide; TTC chr11 5285487 5285508 5285504 5285509 +
aggaagataaaggaggatcaag

SEQ ID NO: 94335 - DNA, 22 bp, Artificial Sequence
  Synthetic oligonucleotide; CTA chr11 5285526 5285547 5285543 5285548 +
aggaagaacactgggcaagtgg

SEQ ID NO: 94336 - DNA, 22 bp, Artificial Sequence
  Synthetic oligonucleotide; CTG chr11 5285539 5285560 5285556 5285561 +
ggcaagtggatccaggttgtcc

SEQ ID NO: 94337 - DNA, 22 bp, Artificial Sequence
  Synthetic oligonucleotide; TTG chr11 5285558 5285579 5285575 5285580 +
tccaacgctgaaagtaggaatc

SEQ ID NO: 94338 - DNA, 22 bp, Artificial Sequence
  Synthetic oligonucleotide; CTG chr11 5285568 5285589 5285585 5285590 +
aaagtaggaatctaagcactag

SEQ ID NO: 94339 - DNA, 22 bp, Artificial Sequence
  Synthetic oligonucleotide; CTA chr11 5285582 5285603 5285599 5285604 +
agcactagtctctggatgctag

SEQ ID NO: 94340 - DNA, 22 bp, Artificial Sequence
  Synthetic oligonucleotide; CTA chr11 5285589 5285610 5285606 5285611 +
gtctctggatgctaggagggcc

SEQ ID NO: 94341 - DNA, 22 bp, Artificial Sequence
  Synthetic oligonucleotide; CTC chr11 5285594 5285615 5285611 5285616 +
tggatgctaggagggcctctgc

SEQ ID NO: 94342 - DNA, 22 bp, Artificial Sequence
  Synthetic oligonucleotide; CTG chr11 5285596 5285617 5285613 5285618 +
gatgctaggagggcctctgcat

SEQ ID NO: 94343 - DNA, 22 bp, Artificial Sequence
  Synthetic oligonucleotide; CTA chr11 5285603 5285624 5285620 5285625 +
ggagggcctctgcatgggtaac

SEQ ID NO: 94344 - DNA, 22 bp, Artificial Sequence
  Synthetic oligonucleotide; CTC chr11 5285613 5285634 5285630 5285635 +
tgcatgggtaactctttcaact

SEQ ID NO: 94345 - DNA, 22 bp, Artificial Sequence
  Synthetic oligonucleotide; CTG chr11 5285615 5285636 5285632 5285637 +
catgggtaactctttcaactag

SEQ ID NO: 94346 - DNA, 22 bp, Artificial Sequence
  Synthetic oligonucleotide; CTC chr11 5285627 5285648 5285644 5285649 +
tttcaactagccaggggctgga

SEQ ID NO: 94347 - DNA, 22 bp, Artificial Sequence
  Synthetic oligonucleotide; CTT chr11 5285629 5285650 5285646 5285651 +
tcaactagccaggggctggact

SEQ ID NO: 94348 - DNA, 22 bp, Artificial Sequence
  Synthetic oligonucleotide; TTT chr11 5285630 5285651 5285647 5285652 +
caactagccaggggctggactg

SEQ ID NO: 94349 - DNA, 22 bp, Artificial Sequence
  Synthetic oligonucleotide; TTC chr11 5285631 5285652 5285648 5285653 +
aactagccaggggctggactgt

SEQ ID NO: 94350 - DNA, 22 bp, Artificial Sequence
  Synthetic oligonucleotide; CTA chr11 5285636 5285657 5285653 5285658 +
gccaggggctggactgtggaga

SEQ ID NO: 94351 - DNA, 22 bp, Artificial Sequence
  Synthetic oligonucleotide; CTG chr11 5285647 5285668 5285664 5285669 +
gactgtggagaaaccatttcca

SEQ ID NO: 94352 - DNA, 22 bp, Artificial Sequence
  Synthetic oligonucleotide; CTG chr11 5285652 5285673 5285669 5285674 +
tggagaaaccatttccagatag

SEQ ID NO: 94353 - DNA, 22 bp, Artificial Sequence
  Synthetic oligonucleotide; TTT chr11 5285666 5285687 5285683 5285688 +
ccagatagaagtgaggagattc

SEQ ID NO: 94354 - DNA, 22 bp, Artificial Sequence
  Synthetic oligonucleotide; TTC chr11 5285667 5285688 5285684 5285689 +
cagatagaagtgaggagattcc

SEQ ID NO: 94355 - DNA, 22 bp, Artificial Sequence
  Synthetic oligonucleotide; TTC chr11 5285688 5285709 5285705 5285710 +
cagcaggaaacacttaagagag

SEQ ID NO: 94356 - DNA, 22 bp, Artificial Sequence
  Synthetic oligonucleotide; CTT chr11 5285703 5285724 5285720 5285725 +
aagagaggatccctggaagttc

SEQ ID NO: 94357 - DNA, 22 bp, Artificial Sequence
  Synthetic oligonucleotide; TTA chr11 5285704 5285725 5285721 5285726 +
agagaggatccctggaagttcg

SEQ ID NO: 94358 - DNA, 22 bp, Artificial Sequence
  Synthetic oligonucleotide; CTG chr11 5285718 5285739 5285735 5285740 +
gaagttcggggcaggaggctcc

SEQ ID NO: 94359 - DNA, 22 bp, Artificial Sequence
  Synthetic oligonucleotide; TTC chr11 5285725 5285746 5285742 5285747 +
ggggcaggaggctccctgtcac

SEQ ID NO: 94360 - DNA, 22 bp, Artificial Sequence
  Synthetic oligonucleotide; CTC chr11 5285739 5285760 5285756 5285761 +
cctgtcacatgaaggaaacctg

SEQ ID NO: 94361 - DNA, 22 bp, Artificial Sequence
  Synthetic oligonucleotide; CTG chr11 5285743 5285764 5285760 5285765 +
tcacatgaaggaaacctgctca

SEQ ID NO: 94362 - DNA, 22 bp, Artificial Sequence
  Synthetic oligonucleotide; CTG chr11 5285761 5285782 5285778 5285783 +
ctcagcgtaggctctaggttct

SEQ ID NO: 94363 - DNA, 22 bp, Artificial Sequence
  Synthetic oligonucleotide; CTC chr11 5285764 5285785 5285781 5285786 +
agcgtaggctctaggttcttcc

SEQ ID NO: 94364 - DNA, 22 bp, Artificial Sequence
  Synthetic oligonucleotide; CTC chr11 5285775 5285796 5285792 5285797 +
taggttcttccctactcttatc

SEQ ID NO: 94365 - DNA, 22 bp, Artificial Sequence
  Synthetic oligonucleotide; CTA chr11 5285777 5285798 5285794 5285799 +
ggttcttccctactcttatcca

SEQ ID NO: 94366 - DNA, 22 bp, Artificial Sequence
  Synthetic oligonucleotide; TTC chr11 5285782 5285803 5285799 5285804 +
ttccctactcttatccaatggg

SEQ ID NO: 94367 - DNA, 22 bp, Artificial Sequence
  Synthetic oligonucleotide; CTT chr11 5285784 5285805 5285801 5285806 +
ccctactcttatccaatggggc

SEQ ID NO: 94368 - DNA, 22 bp, Artificial Sequence
  Synthetic oligonucleotide; TTC chr11 5285785 5285806 5285802 5285807 +
cctactcttatccaatggggct

SEQ ID NO: 94369 - DNA, 22 bp, Artificial Sequence
  Synthetic oligonucleotide; CTA chr11 5285789 5285810 5285806 5285811 +
ctcttatccaatggggcttctg

SEQ ID NO: 94370 - DNA, 22 bp, Artificial Sequence
  Synthetic oligonucleotide; CTC chr11 5285792 5285813 5285809 5285814 +
ttatccaatggggcttctgatt

SEQ ID NO: 94371 - DNA, 22 bp, Artificial Sequence
  Synthetic oligonucleotide; CTT chr11 5285794 5285815 5285811 5285816 +
atccaatggggcttctgatttt

SEQ ID NO: 94372 - DNA, 22 bp, Artificial Sequence
  Synthetic oligonucleotide; TTA chr11 5285795 5285816 5285812 5285817 +
tccaatggggcttctgatttta

SEQ ID NO: 94373 - DNA, 22 bp, Artificial Sequence
  Synthetic oligonucleotide; CTT chr11 5285808 5285829 5285825 5285830 +
ctgattttaagccagtcttcac

SEQ ID NO: 94374 - DNA, 22 bp, Artificial Sequence
  Synthetic oligonucleotide; TTC chr11 5285809 5285830 5285826 5285831 +
tgattttaagccagtcttcaca

SEQ ID NO: 94375 - DNA, 22 bp, Artificial Sequence
  Synthetic oligonucleotide; CTG chr11 5285811 5285832 5285828 5285833 +
attttaagccagtcttcacaaa

SEQ ID NO: 94376 - DNA, 22 bp, Artificial Sequence
  Synthetic oligonucleotide; TTT chr11 5285815 5285836 5285832 5285837 +
taagccagtcttcacaaagccc

SEQ ID NO: 94377 - DNA, 22 bp, Artificial Sequence
  Synthetic oligonucleotide; TTT chr11 5285816 5285837 5285833 5285838 +
aagccagtcttcacaaagcccc

SEQ ID NO: 94378 - DNA, 22 bp, Artificial Sequence
  Synthetic oligonucleotide; TTA chr11 5285817 5285838 5285834 5285839 +
agccagtcttcacaaagcccca

SEQ ID NO: 94379 - DNA, 22 bp, Artificial Sequence
  Synthetic oligonucleotide; CTT chr11 5285827 5285848 5285844 5285849 +
cacaaagccccagatttctaca

SEQ ID NO: 94380 - DNA, 22 bp, Artificial Sequence
  Synthetic oligonucleotide; TTC chr11 5285828 5285849 5285845 5285850 +
acaaagccccagatttctacat

SEQ ID NO: 94381 - DNA, 22 bp, Artificial Sequence
  Synthetic oligonucleotide; TTT chr11 5285844 5285865 5285861 5285866 +
ctacatgctggagccctgaatg

SEQ ID NO: 94382 - DNA, 22 bp, Artificial Sequence
  Synthetic oligonucleotide; TTC chr11 5285845 5285866 5285862 5285867 +
tacatgctggagccctgaatgg

SEQ ID NO: 94383 - DNA, 22 bp, Artificial Sequence
  Synthetic oligonucleotide; CTA chr11 5285847 5285868 5285864 5285869 +
catgctggagccctgaatgggc

SEQ ID NO: 94384 - DNA, 22 bp, Artificial Sequence
  Synthetic oligonucleotide; CTG chr11 5285854 5285875 5285871 5285876 +
gagccctgaatgggcaggaagc

SEQ ID NO: 94385 - DNA, 22 bp, Artificial Sequence
  Synthetic oligonucleotide; CTG chr11 5285862 5285883 5285879 5285884 +
aatgggcaggaagcattgcggt

SEQ ID NO: 94386 - DNA, 22 bp, Artificial Sequence
  Synthetic oligonucleotide; TTG chr11 5285880 5285901 5285897 5285902 +
cggtttccatttcattcagagc

SEQ ID NO: 94387 - DNA, 22 bp, Artificial Sequence
  Synthetic oligonucleotide; TTT chr11 5285886 5285907 5285903 5285908 +
ccatttcattcagagctctttc

SEQ ID NO: 94388 - DNA, 22 bp, Artificial Sequence
  Synthetic oligonucleotide; TTC chr11 5285887 5285908 5285904 5285909 +
catttcattcagagctctttca

SEQ ID NO: 94389 - DNA, 22 bp, Artificial Sequence
  Synthetic oligonucleotide; TTT chr11 5285892 5285913 5285909 5285914 +
cattcagagctctttcataccc

SEQ ID NO: 94390 - DNA, 22 bp, Artificial Sequence
  Synthetic oligonucleotide; TTC chr11 5285893 5285914 5285910 5285915 +
attcagagctctttcataccct

SEQ ID NO: 94391 - DNA, 22 bp, Artificial Sequence
  Synthetic oligonucleotide; TTC chr11 5285897 5285918 5285914 5285919 +
agagctctttcataccctgctt

SEQ ID NO: 94392 - DNA, 22 bp, Artificial Sequence
  Synthetic oligonucleotide; CTC chr11 5285904 5285925 5285921 5285926 +
tttcataccctgcttccccata

SEQ ID NO: 94393 - DNA, 22 bp, Artificial Sequence
  Synthetic oligonucleotide; CTT chr11 5285906 5285927 5285923 5285928 +
tcataccctgcttccccatagt

SEQ ID NO: 94394 - DNA, 22 bp, Artificial Sequence
  Synthetic oligonucleotide; TTT chr11 5285907 5285928 5285924 5285929 +
cataccctgcttccccatagtt

SEQ ID NO: 94395 - DNA, 22 bp, Artificial Sequence
  Synthetic oligonucleotide; TTC chr11 5285908 5285929 5285925 5285930 +
ataccctgcttccccatagttt

SEQ ID NO: 94396 - DNA, 22 bp, Artificial Sequence
  Synthetic oligonucleotide; CTG chr11 5285916 5285937 5285933 5285938 +
cttccccatagtttgtctcaac

SEQ ID NO: 94397 - DNA, 22 bp, Artificial Sequence
  Synthetic oligonucleotide; CTT chr11 5285919 5285940 5285936 5285941 +
ccccatagtttgtctcaacatt

SEQ ID NO: 94398 - DNA, 22 bp, Artificial Sequence
  Synthetic oligonucleotide; TTC chr11 5285920 5285941 5285937 5285942 +
cccatagtttgtctcaacattt

SEQ ID NO: 94399 - DNA, 22 bp, Artificial Sequence
  Synthetic oligonucleotide; TTT chr11 5285930 5285951 5285947 5285952 +
gtctcaacatttctgttgataa

SEQ ID NO: 94400 - DNA, 22 bp, Artificial Sequence
  Synthetic oligonucleotide; TTG chr11 5285931 5285952 5285948 5285953 +
tctcaacatttctgttgataat

SEQ ID NO: 94401 - DNA, 22 bp, Artificial Sequence
  Synthetic oligonucleotide; CTC chr11 5285935 5285956 5285952 5285957 +
aacatttctgttgataatctga

SEQ ID NO: 94402 - DNA, 22 bp, Artificial Sequence
  Synthetic oligonucleotide; TTT chr11 5285942 5285963 5285959 5285964 +
ctgttgataatctgattcatgc

SEQ ID NO: 94403 - DNA, 22 bp, Artificial Sequence
  Synthetic oligonucleotide; TTC chr11 5285943 5285964 5285960 5285965 +
tgttgataatctgattcatgca

SEQ ID NO: 94404 - DNA, 22 bp, Artificial Sequence
  Synthetic oligonucleotide; CTG chr11 5285945 5285966 5285962 5285967 +
ttgataatctgattcatgcaac

SEQ ID NO: 94405 - DNA, 22 bp, Artificial Sequence
  Synthetic oligonucleotide; TTG chr11 5285948 5285969 5285965 5285970 +
ataatctgattcatgcaaccaa

SEQ ID NO: 94406 - DNA, 22 bp, Artificial Sequence
  Synthetic oligonucleotide; CTG chr11 5285956 5285977 5285973 5285978 +
attcatgcaaccaagaattatg

SEQ ID NO: 94407 - DNA, 22 bp, Artificial Sequence
  Synthetic oligonucleotide; TTC chr11 5285960 5285981 5285977 5285982 +
atgcaaccaagaattatgagag

SEQ ID NO: 94408 - DNA, 22 bp, Artificial Sequence
  Synthetic oligonucleotide; TTA chr11 5285976 5285997 5285993 5285998 +
tgagagagccttcagtcatgcc

SEQ ID NO: 94409 - DNA, 22 bp, Artificial Sequence
  Synthetic oligonucleotide; CTT chr11 5285988 5286009 5286005 5286010 +
cagtcatgcctaggcctgcatt

SEQ ID NO: 94410 - DNA, 22 bp, Artificial Sequence
  Synthetic oligonucleotide; TTC chr11 5285989 5286010 5286006 5286011 +
agtcatgcctaggcctgcattt

SEQ ID NO: 94411 - DNA, 22 bp, Artificial Sequence
  Synthetic oligonucleotide; CTA chr11 5286000 5286021 5286017 5286022 +
ggcctgcatttattgttgtgca

SEQ ID NO: 94412 - DNA, 22 bp, Artificial Sequence
  Synthetic oligonucleotide; CTG chr11 5286006 5286027 5286023 5286028 +
catttattgttgtgcatatgat

SEQ ID NO: 94413 - DNA, 22 bp, Artificial Sequence
  Synthetic oligonucleotide; TTT chr11 5286011 5286032 5286028 5286033 +
attgttgtgcatatgatggggt

SEQ ID NO: 94414 - DNA, 22 bp, Artificial Sequence
  Synthetic oligonucleotide; TTA chr11 5286012 5286033 5286029 5286034 +
ttgttgtgcatatgatggggta

SEQ ID NO: 94415 - DNA, 22 bp, Artificial Sequence
  Synthetic oligonucleotide; TTG chr11 5286015 5286036 5286032 5286037 +
ttgtgcatatgatggggtagca

SEQ ID NO: 94416 - DNA, 22 bp, Artificial Sequence
  Synthetic oligonucleotide; TTG chr11 5286018 5286039 5286035 5286040 +
tgcatatgatggggtagcagac

SEQ ID NO: 94417 - DNA, 22 bp, Artificial Sequence
  Synthetic oligonucleotide; TTA chr11 5286052 5286073 5286069 5286074 +
acagcatagactttctcagagc

SEQ ID NO: 94418 - DNA, 22 bp, Artificial Sequence
  Synthetic oligonucleotide; CTT chr11 5286065 5286086 5286082 5286087 +
tctcagagctatatgagtttgg

SEQ ID NO: 94419 - DNA, 22 bp, Artificial Sequence
  Synthetic oligonucleotide; TTT chr11 5286066 5286087 5286083 5286088 +
ctcagagctatatgagtttggg

SEQ ID NO: 94420 - DNA, 22 bp, Artificial Sequence
  Synthetic oligonucleotide; TTC chr11 5286067 5286088 5286084 5286089 +
tcagagctatatgagtttggga

SEQ ID NO: 94421 - DNA, 22 bp, Artificial Sequence
  Synthetic oligonucleotide; CTC chr11 5286069 5286090 5286086 5286091 +
agagctatatgagtttgggaat

SEQ ID NO: 94422 - DNA, 22 bp, Artificial Sequence
  Synthetic oligonucleotide; CTA chr11 5286076 5286097 5286093 5286098 +
tatgagtttgggaattaatcaa

SEQ ID NO: 94423 - DNA, 22 bp, Artificial Sequence
  Synthetic oligonucleotide; TTT chr11 5286085 5286106 5286102 5286107 +
gggaattaatcaagaccagcct

SEQ ID NO: 94424 - DNA, 22 bp, Artificial Sequence
  Synthetic oligonucleotide; TTG chr11 5286086 5286107 5286103 5286108 +
ggaattaatcaagaccagcctt

SEQ ID NO: 94425 - DNA, 22 bp, Artificial Sequence
  Synthetic oligonucleotide; TTA chr11 5286093 5286114 5286110 5286115 +
atcaagaccagccttttgctca

SEQ ID NO: 94426 - DNA, 22 bp, Artificial Sequence
  Synthetic oligonucleotide; CTT chr11 5286108 5286129 5286125 5286130 +
ttgctcagggtagaaatcccct

SEQ ID NO: 94427 - DNA, 22 bp, Artificial Sequence
  Synthetic oligonucleotide; TTT chr11 5286109 5286130 5286126 5286131 +
tgctcagggtagaaatccccta

SEQ ID NO: 94428 - DNA, 22 bp, Artificial Sequence
  Synthetic oligonucleotide; TTT chr11 5286110 5286131 5286127 5286132 +
gctcagggtagaaatcccctat

SEQ ID NO: 94429 - DNA, 22 bp, Artificial Sequence
  Synthetic oligonucleotide; TTG chr11 5286111 5286132 5286128 5286133 +
ctcagggtagaaatcccctata

SEQ ID NO: 94430 - DNA, 22 bp, Artificial Sequence
  Synthetic oligonucleotide; CTC chr11 5286114 5286135 5286131 5286136 +
agggtagaaatcccctataggg

SEQ ID NO: 94431 - DNA, 22 bp, Artificial Sequence
  Synthetic oligonucleotide; CTA chr11 5286131 5286152 5286148 5286153 +
tagggatttattcaatgatggg

SEQ ID NO: 94432 - DNA, 22 bp, Artificial Sequence
  Synthetic oligonucleotide; TTT chr11 5286140 5286161 5286157 5286162 +
attcaatgatgggttaaaagct

SEQ ID NO: 94433 - DNA, 22 bp, Artificial Sequence
  Synthetic oligonucleotide; TTA chr11 5286141 5286162 5286158 5286163 +
ttcaatgatgggttaaaagctt

SEQ ID NO: 94434 - DNA, 22 bp, Artificial Sequence
  Synthetic oligonucleotide; TTC chr11 5286144 5286165 5286161 5286166 +
aatgatgggttaaaagctttct

SEQ ID NO: 94435 - DNA, 22 bp, Artificial Sequence
  Synthetic oligonucleotide; TTA chr11 5286156 5286177 5286173 5286178 +
aaagctttctatatggtgagga

SEQ ID NO: 94436 - DNA, 22 bp, Artificial Sequence
  Synthetic oligonucleotide; CTT chr11 5286163 5286184 5286180 5286185 +
tctatatggtgaggagctcaca

SEQ ID NO: 94437 - DNA, 22 bp, Artificial Sequence
  Synthetic oligonucleotide; TTT chr11 5286164 5286185 5286181 5286186 +
ctatatggtgaggagctcacag

SEQ ID NO: 94438 - DNA, 22 bp, Artificial Sequence
  Synthetic oligonucleotide; TTC chr11 5286165 5286186 5286182 5286187 +
tatatggtgaggagctcacaga

SEQ ID NO: 94439 - DNA, 22 bp, Artificial Sequence
  Synthetic oligonucleotide; CTA chr11 5286167 5286188 5286184 5286189 +
tatggtgaggagctcacagatt

SEQ ID NO: 94440 - DNA, 22 bp, Artificial Sequence
  Synthetic oligonucleotide; CTC chr11 5286182 5286203 5286199 5286204 +
acagattttccaagcccttgct

SEQ ID NO: 94441 - DNA, 22 bp, Artificial Sequence
  Synthetic oligonucleotide; TTT chr11 5286190 5286211 5286207 5286212 +
tccaagcccttgcttttgctag

SEQ ID NO: 94442 - DNA, 22 bp, Artificial Sequence
  Synthetic oligonucleotide; TTT chr11 5286191 5286212 5286208 5286213 +
ccaagcccttgcttttgctaga

SEQ ID NO: 94443 - DNA, 22 bp, Artificial Sequence
  Synthetic oligonucleotide; TTC chr11 5286192 5286213 5286209 5286214 +
caagcccttgcttttgctagac

SEQ ID NO: 94444 - DNA, 22 bp, Artificial Sequence
  Synthetic oligonucleotide; CTT chr11 5286201 5286222 5286218 5286223 +
gcttttgctagacagcttaatg

SEQ ID NO: 94445 - DNA, 22 bp, Artificial Sequence
  Synthetic oligonucleotide; TTG chr11 5286202 5286223 5286219 5286224 +
cttttgctagacagcttaatgt

SEQ ID NO: 94446 - DNA, 22 bp, Artificial Sequence
  Synthetic oligonucleotide; CTT chr11 5286205 5286226 5286222 5286227 +
ttgctagacagcttaatgttta

SEQ ID NO: 94447 - DNA, 22 bp, Artificial Sequence
  Synthetic oligonucleotide; TTT chr11 5286206 5286227 5286223 5286228 +
tgctagacagcttaatgtttat

SEQ ID NO: 94448 - DNA, 22 bp, Artificial Sequence
  Synthetic oligonucleotide; TTT chr11 5286207 5286228 5286224 5286229 +
gctagacagcttaatgtttatg

SEQ ID NO: 94449 - DNA, 22 bp, Artificial Sequence
  Synthetic oligonucleotide; TTG chr11 5286208 5286229 5286225 5286230 +
ctagacagcttaatgtttatga

SEQ ID NO: 94450 - DNA, 22 bp, Artificial Sequence
  Synthetic oligonucleotide; CTA chr11 5286211 5286232 5286228 5286233 +
gacagcttaatgtttatgaaat

SEQ ID NO: 94451 - DNA, 22 bp, Artificial Sequence
  Synthetic oligonucleotide; CTT chr11 5286219 5286240 5286236 5286241 +
aatgtttatgaaattcttacac

SEQ ID NO: 94452 - DNA, 22 bp, Artificial Sequence
  Synthetic oligonucleotide; TTA chr11 5286220 5286241 5286237 5286242 +
atgtttatgaaattcttacaca

SEQ ID NO: 94453 - DNA, 22 bp, Artificial Sequence
  Synthetic oligonucleotide; TTT chr11 5286226 5286247 5286243 5286248 +
atgaaattcttacacacagaag

SEQ ID NO: 94454 - DNA, 22 bp, Artificial Sequence
  Synthetic oligonucleotide; TTA chr11 5286227 5286248 5286244 5286249 +
tgaaattcttacacacagaaga

SEQ ID NO: 94455 - DNA, 22 bp, Artificial Sequence
  Synthetic oligonucleotide; TTC chr11 5286235 5286256 5286252 5286257 +
ttacacacagaagaatcttcta

SEQ ID NO: 94456 - DNA, 22 bp, Artificial Sequence
  Synthetic oligonucleotide; CTT chr11 5286237 5286258 5286254 5286259 +
acacacagaagaatcttctaat

SEQ ID NO: 94457 - DNA, 22 bp, Artificial Sequence
  Synthetic oligonucleotide; TTA chr11 5286238 5286259 5286255 5286260 +
cacacagaagaatcttctaatc

SEQ ID NO: 94458 - DNA, 22 bp, Artificial Sequence
  Synthetic oligonucleotide; CTT chr11 5286254 5286275 5286271 5286276 +
ctaatcctgggttacataatat

SEQ ID NO: 94459 - DNA, 22 bp, Artificial Sequence
  Synthetic oligonucleotide; TTC chr11 5286255 5286276 5286272 5286277 +
taatcctgggttacataatata

SEQ ID NO: 94460 - DNA, 22 bp, Artificial Sequence
  Synthetic oligonucleotide; CTA chr11 5286257 5286278 5286274 5286279 +
atcctgggttacataatataac

SEQ ID NO: 94461 - DNA, 22 bp, Artificial Sequence
  Synthetic oligonucleotide; CTG chr11 5286263 5286284 5286280 5286285 +
ggttacataatataacttgatt

SEQ ID NO: 94462 - DNA, 22 bp, Artificial Sequence
  Synthetic oligonucleotide; TTA chr11 5286268 5286289 5286285 5286290 +
cataatataacttgattcccta

SEQ ID NO: 94463 - DNA, 22 bp, Artificial Sequence
  Synthetic oligonucleotide; CTT chr11 5286281 5286302 5286298 5286303 +
gattccctattccagaagataa

SEQ ID NO: 94464 - DNA, 22 bp, Artificial Sequence
  Synthetic oligonucleotide; TTG chr11 5286282 5286303 5286299 5286304 +
attccctattccagaagataat

SEQ ID NO: 94465 - DNA, 22 bp, Artificial Sequence
  Synthetic oligonucleotide; TTC chr11 5286286 5286307 5286303 5286308 +
cctattccagaagataatattc

SEQ ID NO: 94466 - DNA, 22 bp, Artificial Sequence
  Synthetic oligonucleotide; CTA chr11 5286290 5286311 5286307 5286312 +
ttccagaagataatattcccat

SEQ ID NO: 94467 - DNA, 22 bp, Artificial Sequence
  Synthetic oligonucleotide; TTC chr11 5286293 5286314 5286310 5286315 +
cagaagataatattcccatatt

SEQ ID NO: 94468 - DNA, 22 bp, Artificial Sequence
  Synthetic oligonucleotide; TTC chr11 5286308 5286329 5286325 5286330 +
ccatattctgaagcattcatgc

SEQ ID NO: 94469 - DNA, 22 bp, Artificial Sequence
  Synthetic oligonucleotide; TTC chr11 5286316 5286337 5286333 5286338 +
tgaagcattcatgcatttgtta

SEQ ID NO: 94470 - DNA, 22 bp, Artificial Sequence
  Synthetic oligonucleotide; CTG chr11 5286318 5286339 5286335 5286340 +
aagcattcatgcatttgttaaa

SEQ ID NO: 94471 - DNA, 22 bp, Artificial Sequence
  Synthetic oligonucleotide; TTC chr11 5286326 5286347 5286343 5286348 +
atgcatttgttaaataataggc

SEQ ID NO: 94472 - DNA, 22 bp, Artificial Sequence
  Synthetic oligonucleotide; TTT chr11 5286334 5286355 5286351 5286356 +
gttaaataataggcatagtgac

SEQ ID NO: 94473 - DNA, 22 bp, Artificial Sequence
  Synthetic oligonucleotide; TTG chr11 5286335 5286356 5286352 5286357 +
ttaaataataggcatagtgaca

SEQ ID NO: 94474 - DNA, 22 bp, Artificial Sequence
  Synthetic oligonucleotide; TTA chr11 5286338 5286359 5286355 5286360 +
aataataggcatagtgacaagt

SEQ ID NO: 94475 - DNA, 22 bp, Artificial Sequence
  Synthetic oligonucleotide; CTC chr11 5286370 5286391 5286387 5286392 +
taacagtcaaccagagagccac

SEQ ID NO: 94476 - DNA, 22 bp, Artificial Sequence
  Synthetic oligonucleotide; CTA chr11 5286372 5286393 5286389 5286394 +
acagtcaaccagagagccacag

SEQ ID NO: 94477 - DNA, 22 bp, Artificial Sequence
  Synthetic oligonucleotide; TTT chr11 5286397 5286418 5286414 5286419 +
tcaacttcacaaagttaaccat

SEQ ID NO: 94478 - DNA, 22 bp, Artificial Sequence
  Synthetic oligonucleotide; TTT chr11 5286398 5286419 5286415 5286420 +
caacttcacaaagttaaccatc

SEQ ID NO: 94479 - DNA, 22 bp, Artificial Sequence
  Synthetic oligonucleotide; TTC chr11 5286399 5286420 5286416 5286421 +
aacttcacaaagttaaccatct

SEQ ID NO: 94480 - DNA, 22 bp, Artificial Sequence
  Synthetic oligonucleotide; CTT chr11 5286404 5286425 5286421 5286426 +
cacaaagttaaccatctaactg

SEQ ID NO: 94481 - DNA, 22 bp, Artificial Sequence
  Synthetic oligonucleotide; TTC chr11 5286405 5286426 5286422 5286427 +
acaaagttaaccatctaactga

SEQ ID NO: 94482 - DNA, 22 bp, Artificial Sequence
  Synthetic oligonucleotide; TTA chr11 5286414 5286435 5286431 5286436 +
accatctaactgaagacagcag

SEQ ID NO: 94483 - DNA, 22 bp, Artificial Sequence
  Synthetic oligonucleotide; CTA chr11 5286422 5286443 5286439 5286444 +
actgaagacagcagcaatcaaa

SEQ ID NO: 94484 - DNA, 22 bp, Artificial Sequence
  Synthetic oligonucleotide; CTG chr11 5286426 5286447 5286443 5286448 +
aagacagcagcaatcaaaacca

SEQ ID NO: 94485 - DNA, 22 bp, Artificial Sequence
  Synthetic oligonucleotide; CTT chr11 5286457 5286478 5286474 5286479 +
ctccacatggtgtagtctttcc

SEQ ID NO: 94486 - DNA, 22 bp, Artificial Sequence
  Synthetic oligonucleotide; TTC chr11 5286458 5286479 5286475 5286480 +
tccacatggtgtagtctttcct

SEQ ID NO: 94487 - DNA, 22 bp, Artificial Sequence
  Synthetic oligonucleotide; CTC chr11 5286460 5286481 5286477 5286482 +
cacatggtgtagtctttcctga

SEQ ID NO: 94488 - DNA, 22 bp, Artificial Sequence
  Synthetic oligonucleotide; CTT chr11 5286476 5286497 5286493 5286498 +
tcctgatgtcagggatgttagg

SEQ ID NO: 94489 - DNA, 22 bp, Artificial Sequence
  Synthetic oligonucleotide; TTT chr11 5286477 5286498 5286494 5286499 +
cctgatgtcagggatgttaggc

SEQ ID NO: 94490 - DNA, 22 bp, Artificial Sequence
  Synthetic oligonucleotide; TTC chr11 5286478 5286499 5286495 5286500 +
ctgatgtcagggatgttaggct

SEQ ID NO: 94491 - DNA, 22 bp, Artificial Sequence
  Synthetic oligonucleotide; CTG chr11 5286481 5286502 5286498 5286503 +
atgtcagggatgttaggctcag

SEQ ID NO: 94492 - DNA, 22 bp, Artificial Sequence
  Synthetic oligonucleotide; TTA chr11 5286496 5286517 5286513 5286518 +
ggctcaggttaggaaagtcaga

SEQ ID NO: 94493 - DNA, 22 bp, Artificial Sequence
  Synthetic oligonucleotide; CTC chr11 5286501 5286522 5286518 5286523 +
aggttaggaaagtcagactatc

SEQ ID NO: 94494 - DNA, 22 bp, Artificial Sequence
  Synthetic oligonucleotide; TTA chr11 5286507 5286528 5286524 5286529 +
ggaaagtcagactatcatccca

SEQ ID NO: 94495 - DNA, 22 bp, Artificial Sequence
  Synthetic oligonucleotide; CTA chr11 5286521 5286542 5286538 5286543 +
tcatcccagagcaggacacaga

SEQ ID NO: 94496 - DNA, 22 bp, Artificial Sequence
  Synthetic oligonucleotide; TTT chr11 5286560 5286581 5286577 5286582 +
tttagtcacttaggaaaaacag

SEQ ID NO: 94497 - DNA, 22 bp, Artificial Sequence
  Synthetic oligonucleotide; TTT chr11 5286561 5286582 5286578 5286583 +
ttagtcacttaggaaaaacagt

SEQ ID NO: 94498 - DNA, 22 bp, Artificial Sequence
  Synthetic oligonucleotide; TTT chr11 5286562 5286583 5286579 5286584 +
tagtcacttaggaaaaacagtg

SEQ ID NO: 94499 - DNA, 22 bp, Artificial Sequence
  Synthetic oligonucleotide; TTT chr11 5286563 5286584 5286580 5286585 +
agtcacttaggaaaaacagtgg

SEQ ID NO: 94500 - DNA, 22 bp, Artificial Sequence
  Synthetic oligonucleotide; TTA chr11 5286564 5286585 5286581 5286586 +
gtcacttaggaaaaacagtgga

SEQ ID NO: 94501 - DNA, 22 bp, Artificial Sequence
  Synthetic oligonucleotide; CTT chr11 5286571 5286592 5286588 5286593 +
aggaaaaacagtggaatgcaaa

SEQ ID NO: 94502 - DNA, 22 bp, Artificial Sequence
  Synthetic oligonucleotide; TTA chr11 5286572 5286593 5286589 5286594 +
ggaaaaacagtggaatgcaaag

SEQ ID NO: 94503 - DNA, 22 bp, Artificial Sequence
  Synthetic oligonucleotide; CTT chr11 5286608 5286629 5286625 5286630 +
tctgaatggataacttggcctg

SEQ ID NO: 94504 - DNA, 22 bp, Artificial Sequence
  Synthetic oligonucleotide; TTT chr11 5286609 5286630 5286626 5286631 +
ctgaatggataacttggcctgg

SEQ ID NO: 94505 - DNA, 22 bp, Artificial Sequence
  Synthetic oligonucleotide; TTC chr11 5286610 5286631 5286627 5286632 +
tgaatggataacttggcctggg

SEQ ID NO: 94506 - DNA, 22 bp, Artificial Sequence
  Synthetic oligonucleotide; CTG chr11 5286612 5286633 5286629 5286634 +
aatggataacttggcctgggag

SEQ ID NO: 94507 - DNA, 22 bp, Artificial Sequence
  Synthetic oligonucleotide; CTT chr11 5286624 5286645 5286641 5286646 +
ggcctgggaggcctttggaagc

SEQ ID NO: 94508 - DNA, 22 bp, Artificial Sequence
  Synthetic oligonucleotide; TTG chr11 5286625 5286646 5286642 5286647 +
gcctgggaggcctttggaagca

SEQ ID NO: 94509 - DNA, 22 bp, Artificial Sequence
  Synthetic oligonucleotide; CTG chr11 5286630 5286651 5286647 5286652 +
ggaggcctttggaagcagagac

SEQ ID NO: 94510 - DNA, 22 bp, Artificial Sequence
  Synthetic oligonucleotide; CTT chr11 5286639 5286660 5286656 5286661 +
tggaagcagagactggagctta

SEQ ID NO: 94511 - DNA, 22 bp, Artificial Sequence
  Synthetic oligonucleotide; TTT chr11 5286640 5286661 5286657 5286662 +
ggaagcagagactggagcttaa

SEQ ID NO: 94512 - DNA, 22 bp, Artificial Sequence
  Synthetic oligonucleotide; TTG chr11 5286641 5286662 5286658 5286663 +
gaagcagagactggagcttaaa

SEQ ID NO: 94513 - DNA, 22 bp, Artificial Sequence
  Synthetic oligonucleotide; CTG chr11 5286654 5286675 5286671 5286676 +
gagcttaaatttaaacatcttt

SEQ ID NO: 94514 - DNA, 22 bp, Artificial Sequence
  Synthetic oligonucleotide; CTT chr11 5286660 5286681 5286677 5286682 +
aaatttaaacatctttgtatcc

SEQ ID NO: 94515 - DNA, 22 bp, Artificial Sequence
  Synthetic oligonucleotide; TTA chr11 5286661 5286682 5286678 5286683 +
aatttaaacatctttgtatccc

SEQ ID NO: 94516 - DNA, 22 bp, Artificial Sequence
  Synthetic oligonucleotide; TTT chr11 5286666 5286687 5286683 5286688 +
aaacatctttgtatccccagca

SEQ ID NO: 94517 - DNA, 22 bp, Artificial Sequence
  Synthetic oligonucleotide; TTA chr11 5286667 5286688 5286684 5286689 +
aacatctttgtatccccagcat

SEQ ID NO: 94518 - DNA, 22 bp, Artificial Sequence
  Synthetic oligonucleotide; CTT chr11 5286675 5286696 5286692 5286697 +
tgtatccccagcatccagcata

SEQ ID NO: 94519 - DNA, 22 bp, Artificial Sequence
  Synthetic oligonucleotide; TTT chr11 5286676 5286697 5286693 5286698 +
gtatccccagcatccagcatac

SEQ ID NO: 94520 - DNA, 22 bp, Artificial Sequence
  Synthetic oligonucleotide; TTG chr11 5286677 5286698 5286694 5286699 +
tatccccagcatccagcataca

SEQ ID NO: 94521 - DNA, 22 bp, Artificial Sequence
  Synthetic oligonucleotide; CTG chr11 5286704 5286725 5286721 5286726 +
ccaagaagtacatgtcaataaa

SEQ ID NO: 94522 - DNA, 22 bp, Artificial Sequence
  Synthetic oligonucleotide; TTT chr11 5286731 5286752 5286748 5286753 +
attggatagtgagcaaagacat

SEQ ID NO: 94523 - DNA, 22 bp, Artificial Sequence
  Synthetic oligonucleotide; TTA chr11 5286732 5286753 5286749 5286754 +
ttggatagtgagcaaagacata

SEQ ID NO: 94524 - DNA, 22 bp, Artificial Sequence
  Synthetic oligonucleotide; TTG chr11 5286735 5286756 5286752 5286757 +
gatagtgagcaaagacataatt

SEQ ID NO: 94525 - DNA, 22 bp, Artificial Sequence
  Synthetic oligonucleotide; TTA chr11 5286758 5286779 5286775 5286780 +
ggaccaaatctcaattctacta

SEQ ID NO: 94526 - DNA, 22 bp, Artificial Sequence
  Synthetic oligonucleotide; CTC chr11 5286770 5286791 5286787 5286792 +
aattctactatttgctagtagt

SEQ ID NO: 94527 - DNA, 22 bp, Artificial Sequence
  Synthetic oligonucleotide; TTC chr11 5286775 5286796 5286792 5286797 +
tactatttgctagtagtttatg

SEQ ID NO: 94528 - DNA, 22 bp, Artificial Sequence
  Synthetic oligonucleotide; CTA chr11 5286777 5286798 5286794 5286799 +
ctatttgctagtagtttatgtt

SEQ ID NO: 94529 - DNA, 22 bp, Artificial Sequence
  Synthetic oligonucleotide; CTA chr11 5286780 5286801 5286797 5286802 +
tttgctagtagtttatgtttgt

SEQ ID NO: 94530 - DNA, 22 bp, Artificial Sequence
  Synthetic oligonucleotide; TTT chr11 5286783 5286804 5286800 5286805 +
gctagtagtttatgtttgtgtg

SEQ ID NO: 94531 - DNA, 22 bp, Artificial Sequence
  Synthetic oligonucleotide; TTG chr11 5286784 5286805 5286801 5286806 +
ctagtagtttatgtttgtgtgt

SEQ ID NO: 94532 - DNA, 22 bp, Artificial Sequence
  Synthetic oligonucleotide; CTA chr11 5286787 5286808 5286804 5286809 +
gtagtttatgtttgtgtgtgtg

SEQ ID NO: 94533 - DNA, 22 bp, Artificial Sequence
  Synthetic oligonucleotide; TTT chr11 5286794 5286815 5286811 5286816 +
atgtttgtgtgtgtgagagtgt

SEQ ID NO: 94534 - DNA, 22 bp, Artificial Sequence
  Synthetic oligonucleotide; TTA chr11 5286795 5286816 5286812 5286817 +
tgtttgtgtgtgtgagagtgta

SEQ ID NO: 94535 - DNA, 22 bp, Artificial Sequence
  Synthetic oligonucleotide; TTT chr11 5286800 5286821 5286817 5286822 +
gtgtgtgtgagagtgtatgctt

SEQ ID NO: 94536 - DNA, 22 bp, Artificial Sequence
  Synthetic oligonucleotide; TTG chr11 5286801 5286822 5286818 5286823 +
tgtgtgtgagagtgtatgcttg

SEQ ID NO: 94537 - DNA, 22 bp, Artificial Sequence
  Synthetic oligonucleotide; CTT chr11 5286822 5286843 5286839 5286844 +
gagcaagttgagaggtagtttt

SEQ ID NO: 94538 - DNA, 22 bp, Artificial Sequence
  Synthetic oligonucleotide; TTG chr11 5286823 5286844 5286840 5286845 +
agcaagttgagaggtagttttt

SEQ ID NO: 94539 - DNA, 22 bp, Artificial Sequence
  Synthetic oligonucleotide; TTG chr11 5286832 5286853 5286849 5286854 +
agaggtagtttttttaactgta

SEQ ID NO: 94540 - DNA, 22 bp, Artificial Sequence
  Synthetic oligonucleotide; TTT chr11 5286843 5286864 5286860 5286865 +
ttttaactgtagtaaaatgggg

SEQ ID NO: 94541 - DNA, 22 bp, Artificial Sequence
  Synthetic oligonucleotide; TTT chr11 5286844 5286865 5286861 5286866 +
tttaactgtagtaaaatgggga

SEQ ID NO: 94542 - DNA, 22 bp, Artificial Sequence
  Synthetic oligonucleotide; TTT chr11 5286845 5286866 5286862 5286867 +
ttaactgtagtaaaatggggat

SEQ ID NO: 94543 - DNA, 22 bp, Artificial Sequence
  Synthetic oligonucleotide; TTT chr11 5286846 5286867 5286863 5286868 +
taactgtagtaaaatggggata

SEQ ID NO: 94544 - DNA, 22 bp, Artificial Sequence
  Synthetic oligonucleotide; TTT chr11 5286847 5286868 5286864 5286869 +
aactgtagtaaaatggggataa

SEQ ID NO: 94545 - DNA, 22 bp, Artificial Sequence
  Synthetic oligonucleotide; TTA chr11 5286848 5286869 5286865 5286870 +
actgtagtaaaatggggataat

SEQ ID NO: 94546 - DNA, 22 bp, Artificial Sequence
  Synthetic oligonucleotide; CTG chr11 5286852 5286873 5286869 5286874 +
tagtaaaatggggataataata

SEQ ID NO: 94547 - DNA, 22 bp, Artificial Sequence
  Synthetic oligonucleotide; CTA chr11 5286881 5286902 5286898 5286903 +
cctgaaagaatccaagagtatt

SEQ ID NO: 94548 - DNA, 22 bp, Artificial Sequence
  Synthetic oligonucleotide; CTG chr11 5286885 5286906 5286902 5286907 +
aaagaatccaagagtattaaat

SEQ ID NO: 94549 - DNA, 22 bp, Artificial Sequence
  Synthetic oligonucleotide; TTA chr11 5286904 5286925 5286921 5286926 +
aatatgattaattatgcaaagc

SEQ ID NO: 94550 - DNA, 22 bp, Artificial Sequence
  Synthetic oligonucleotide; TTA chr11 5286914 5286935 5286931 5286936 +
attatgcaaagcactaattaca

SEQ ID NO: 94551 - DNA, 22 bp, Artificial Sequence
  Synthetic oligonucleotide; TTA chr11 5286918 5286939 5286935 5286940 +
tgcaaagcactaattacagtct

SEQ ID NO: 94552 - DNA, 22 bp, Artificial Sequence
  Synthetic oligonucleotide; CTA chr11 5286930 5286951 5286947 5286952 +
attacagtctctgatagccttc

SEQ ID NO: 94553 - DNA, 22 bp, Artificial Sequence
  Synthetic oligonucleotide; TTA chr11 5286934 5286955 5286951 5286956 +
cagtctctgatagccttcaata

SEQ ID NO: 94554 - DNA, 22 bp, Artificial Sequence
  Synthetic oligonucleotide; CTC chr11 5286941 5286962 5286958 5286963 +
tgatagccttcaataaatgtca

SEQ ID NO: 94555 - DNA, 22 bp, Artificial Sequence
  Synthetic oligonucleotide; CTG chr11 5286943 5286964 5286960 5286965 +
atagccttcaataaatgtcagt

SEQ ID NO: 94556 - DNA, 22 bp, Artificial Sequence
  Synthetic oligonucleotide; CTT chr11 5286951 5286972 5286968 5286973 +
caataaatgtcagttattttta

SEQ ID NO: 94557 - DNA, 22 bp, Artificial Sequence
  Synthetic oligonucleotide; TTC chr11 5286952 5286973 5286969 5286974 +
aataaatgtcagttatttttat

SEQ ID NO: 94558 - DNA, 22 bp, Artificial Sequence
  Synthetic oligonucleotide; TTA chr11 5286967 5286988 5286984 5286989 +
tttttattattacagttaaaga

SEQ ID NO: 94559 - DNA, 22 bp, Artificial Sequence
  Synthetic oligonucleotide; TTT chr11 5286970 5286991 5286987 5286992 +
ttattattacagttaaagatga

SEQ ID NO: 94560 - DNA, 22 bp, Artificial Sequence
  Synthetic oligonucleotide; TTT chr11 5286971 5286992 5286988 5286993 +
tattattacagttaaagatgaa

SEQ ID NO: 94561 - DNA, 22 bp, Artificial Sequence
  Synthetic oligonucleotide; TTT chr11 5286972 5286993 5286989 5286994 +
attattacagttaaagatgaat

SEQ ID NO: 94562 - DNA, 22 bp, Artificial Sequence
  Synthetic oligonucleotide; TTA chr11 5286973 5286994 5286990 5286995 +
ttattacagttaaagatgaatg

SEQ ID NO: 94563 - DNA, 22 bp, Artificial Sequence
  Synthetic oligonucleotide; TTA chr11 5286976 5286997 5286993 5286998 +
ttacagttaaagatgaatgggc

SEQ ID NO: 94564 - DNA, 22 bp, Artificial Sequence
  Synthetic oligonucleotide; TTA chr11 5286979 5287000 5286996 5287001 +
cagttaaagatgaatgggcata

SEQ ID NO: 94565 - DNA, 22 bp, Artificial Sequence
  Synthetic oligonucleotide; TTA chr11 5286985 5287006 5287002 5287007 +
aagatgaatgggcataaagtac

SEQ ID NO: 94566 - DNA, 22 bp, Artificial Sequence
  Synthetic oligonucleotide; CTA chr11 5287016 5287037 5287033 5287038 +
gttttcacctgcagcaagaatg

SEQ ID NO: 94567 - DNA, 22 bp, Artificial Sequence
  Synthetic oligonucleotide; TTT chr11 5287020 5287041 5287037 5287042 +
tcacctgcagcaagaatgattg

SEQ ID NO: 94568 - DNA, 22 bp, Artificial Sequence
  Synthetic oligonucleotide; TTT chr11 5287021 5287042 5287038 5287043 +
cacctgcagcaagaatgattgc

SEQ ID NO: 94569 - DNA, 22 bp, Artificial Sequence
  Synthetic oligonucleotide; TTC chr11 5287022 5287043 5287039 5287044 +
acctgcagcaagaatgattgca

SEQ ID NO: 94570 - DNA, 22 bp, Artificial Sequence
  Synthetic oligonucleotide; CTG chr11 5287027 5287048 5287044 5287049 +
cagcaagaatgattgcagttaa

SEQ ID NO: 94571 - DNA, 22 bp, Artificial Sequence
  Synthetic oligonucleotide; TTG chr11 5287042 5287063 5287059 5287064 +
cagttaaacaaaaaatactagc

SEQ ID NO: 94572 - DNA, 22 bp, Artificial Sequence
  Synthetic oligonucleotide; TTA chr11 5287048 5287069 5287065 5287070 +
aacaaaaaatactagcaaacat

SEQ ID NO: 94573 - DNA, 22 bp, Artificial Sequence
  Synthetic oligonucleotide; CTA chr11 5287062 5287083 5287079 5287084 +
gcaaacatttctagagtagtta

SEQ ID NO: 94574 - DNA, 22 bp, Artificial Sequence
  Synthetic oligonucleotide; TTT chr11 5287072 5287093 5287089 5287094 +
ctagagtagttagcatttataa

SEQ ID NO: 94575 - DNA, 22 bp, Artificial Sequence
  Synthetic oligonucleotide; TTC chr11 5287073 5287094 5287090 5287095 +
tagagtagttagcatttataag

SEQ ID NO: 94576 - DNA, 22 bp, Artificial Sequence
  Synthetic oligonucleotide; CTA chr11 5287075 5287096 5287092 5287097 +
gagtagttagcatttataagtc

SEQ ID NO: 94577 - DNA, 22 bp, Artificial Sequence
  Synthetic oligonucleotide; TTA chr11 5287084 5287105 5287101 5287106 +
gcatttataagtcactgcttta

SEQ ID NO: 94578 - DNA, 22 bp, Artificial Sequence
  Synthetic oligonucleotide; TTT chr11 5287090 5287111 5287107 5287112 +
ataagtcactgctttaaactct

SEQ ID NO: 94579 - DNA, 22 bp, Artificial Sequence
  Synthetic oligonucleotide; TTA chr11 5287091 5287112 5287108 5287113 +
taagtcactgctttaaactctt

SEQ ID NO: 94580 - DNA, 22 bp, Artificial Sequence
  Synthetic oligonucleotide; CTG chr11 5287101 5287122 5287118 5287123 +
ctttaaactctttgcatgtatt

SEQ ID NO: 94581 - DNA, 22 bp, Artificial Sequence
  Synthetic oligonucleotide; CTT chr11 5287104 5287125 5287121 5287126 +
taaactctttgcatgtattaac

SEQ ID NO: 94582 - DNA, 22 bp, Artificial Sequence
  Synthetic oligonucleotide; TTT chr11 5287105 5287126 5287122 5287127 +
aaactctttgcatgtattaact

SEQ ID NO: 94583 - DNA, 22 bp, Artificial Sequence
  Synthetic oligonucleotide; TTA chr11 5287106 5287127 5287123 5287128 +
aactctttgcatgtattaactc

SEQ ID NO: 94584 - DNA, 22 bp, Artificial Sequence
  Synthetic oligonucleotide; CTC chr11 5287111 5287132 5287128 5287133 +
tttgcatgtattaactcactcg

SEQ ID NO: 94585 - DNA, 22 bp, Artificial Sequence
  Synthetic oligonucleotide; CTT chr11 5287113 5287134 5287130 5287135 +
tgcatgtattaactcactcggg

SEQ ID NO: 94586 - DNA, 22 bp, Artificial Sequence
  Synthetic oligonucleotide; TTT chr11 5287114 5287135 5287131 5287136 +
gcatgtattaactcactcgggc

SEQ ID NO: 94587 - DNA, 22 bp, Artificial Sequence
  Synthetic oligonucleotide; TTG chr11 5287115 5287136 5287132 5287137 +
catgtattaactcactcgggct

SEQ ID NO: 94588 - DNA, 22 bp, Artificial Sequence
  Synthetic oligonucleotide; TTA chr11 5287124 5287145 5287141 5287146 +
actcactcgggctgcagaacaa

SEQ ID NO: 94589 - DNA, 22 bp, Artificial Sequence
  Synthetic oligonucleotide; CTC chr11 5287128 5287149 5287145 5287150 +
actcgggctgcagaacaatctt

SEQ ID NO: 94590 - DNA, 22 bp, Artificial Sequence
  Synthetic oligonucleotide; CTC chr11 5287132 5287153 5287149 5287154 +
gggctgcagaacaatcttatga

SEQ ID NO: 94591 - DNA, 22 bp, Artificial Sequence
  Synthetic oligonucleotide; CTG chr11 5287138 5287159 5287155 5287160 +
cagaacaatcttatgagcctgt

SEQ ID NO: 94592 - DNA, 22 bp, Artificial Sequence
  Synthetic oligonucleotide; CTT chr11 5287150 5287171 5287167 5287172 +
atgagcctgttaaaactcctgt

SEQ ID NO: 94593 - DNA, 22 bp, Artificial Sequence
  Synthetic oligonucleotide; TTA chr11 5287151 5287172 5287168 5287173 +
tgagcctgttaaaactcctgta

SEQ ID NO: 94594 - DNA, 22 bp, Artificial Sequence
  Synthetic oligonucleotide; CTG chr11 5287159 5287180 5287176 5287181 +
ttaaaactcctgtaatcatgct

SEQ ID NO: 94595 - DNA, 22 bp, Artificial Sequence
  Synthetic oligonucleotide; TTA chr11 5287162 5287183 5287179 5287184 +
aaactcctgtaatcatgcttat

SEQ ID NO: 94596 - DNA, 22 bp, Artificial Sequence
  Synthetic oligonucleotide; CTC chr11 5287168 5287189 5287185 5287190 +
ctgtaatcatgcttataatccc

SEQ ID NO: 94597 - DNA, 22 bp, Artificial Sequence
  Synthetic oligonucleotide; CTG chr11 5287171 5287192 5287188 5287193 +
taatcatgcttataatcccagc

SEQ ID NO: 94598 - DNA, 22 bp, Artificial Sequence
  Synthetic oligonucleotide; CTT chr11 5287182 5287203 5287199 5287204 +
ataatcccagcactttggaagg

SEQ ID NO: 94599 - DNA, 22 bp, Artificial Sequence
  Synthetic oligonucleotide; TTA chr11 5287183 5287204 5287200 5287205 +
taatcccagcactttggaaggc

SEQ ID NO: 94600 - DNA, 22 bp, Artificial Sequence
  Synthetic oligonucleotide; CTT chr11 5287197 5287218 5287214 5287219 +
tggaaggctgaggtgggcagat

SEQ ID NO: 94601 - DNA, 22 bp, Artificial Sequence
  Synthetic oligonucleotide; TTT chr11 5287198 5287219 5287215 5287220 +
ggaaggctgaggtgggcagatt

SEQ ID NO: 94602 - DNA, 22 bp, Artificial Sequence
  Synthetic oligonucleotide; TTG chr11 5287199 5287220 5287216 5287221 +
gaaggctgaggtgggcagattg

SEQ ID NO: 94603 - DNA, 22 bp, Artificial Sequence
  Synthetic oligonucleotide; CTG chr11 5287207 5287228 5287224 5287229 +
aggtgggcagattgcttgagct

SEQ ID NO: 94604 - DNA, 22 bp, Artificial Sequence
  Synthetic oligonucleotide; TTG chr11 5287221 5287242 5287238 5287243 +
cttgagctccggagtctgagac

SEQ ID NO: 94605 - DNA, 22 bp, Artificial Sequence
  Synthetic oligonucleotide; CTT chr11 5287224 5287245 5287241 5287246 +
gagctccggagtctgagaccat

SEQ ID NO: 94606 - DNA, 22 bp, Artificial Sequence
  Synthetic oligonucleotide; TTG chr11 5287225 5287246 5287242 5287247 +
agctccggagtctgagaccatc

SEQ ID NO: 94607 - DNA, 22 bp, Artificial Sequence
  Synthetic oligonucleotide; CTC chr11 5287230 5287251 5287247 5287252 +
cggagtctgagaccatcctgtg

SEQ ID NO: 94608 - DNA, 22 bp, Artificial Sequence
  Synthetic oligonucleotide; CTG chr11 5287239 5287260 5287256 5287261 +
agaccatcctgtgtaacatgtg

SEQ ID NO: 94609 - DNA, 22 bp, Artificial Sequence
  Synthetic oligonucleotide; CTG chr11 5287250 5287271 5287267 5287272 +
tgtaacatgtgaaaccccatct

SEQ ID NO: 94610 - DNA, 22 bp, Artificial Sequence
  Synthetic oligonucleotide; CTC chr11 5287273 5287294 5287290 5287295 +
taccaaaaatacaaaaaattag

SEQ ID NO: 94611 - DNA, 22 bp, Artificial Sequence
  Synthetic oligonucleotide; CTA chr11 5287275 5287296 5287292 5287297 +
ccaaaaatacaaaaaattagcg

SEQ ID NO: 94612 - DNA, 22 bp, Artificial Sequence
  Synthetic oligonucleotide; TTA chr11 5287294 5287315 5287311 5287316 +
gcgaggtatggtggtgtgtacc

SEQ ID NO: 94613 - DNA, 22 bp, Artificial Sequence
  Synthetic oligonucleotide; CTG chr11 5287318 5287339 5287335 5287340 +
tggttccagctactcaggatgt

SEQ ID NO: 94614 - DNA, 22 bp, Artificial Sequence
  Synthetic oligonucleotide; TTC chr11 5287324 5287345 5287341 5287346 +
cagctactcaggatgttgaggt

SEQ ID NO: 94615 - DNA, 22 bp, Artificial Sequence
  Synthetic oligonucleotide; CTA chr11 5287330 5287351 5287347 5287352 +
ctcaggatgttgaggtgggagg

SEQ ID NO: 94616 - DNA, 22 bp, Artificial Sequence
  Synthetic oligonucleotide; CTC chr11 5287333 5287354 5287350 5287355 +
aggatgttgaggtgggaggacc

SEQ ID NO: 94617 - DNA, 22 bp, Artificial Sequence
  Synthetic oligonucleotide; TTG chr11 5287342 5287363 5287359 5287364 +
aggtgggaggaccgcttgagcc

SEQ ID NO: 94618 - DNA, 22 bp, Artificial Sequence
  Synthetic oligonucleotide; CTT chr11 5287359 5287380 5287376 5287381 +
gagcctgggaagtgcaagttgc

SEQ ID NO: 94619 - DNA, 22 bp, Artificial Sequence
  Synthetic oligonucleotide; TTG chr11 5287360 5287381 5287377 5287382 +
agcctgggaagtgcaagttgca

SEQ ID NO: 94620 - DNA, 22 bp, Artificial Sequence
  Synthetic oligonucleotide; CTG chr11 5287366 5287387 5287383 5287388 +
ggaagtgcaagttgcagtgagc

SEQ ID NO: 94621 - DNA, 22 bp, Artificial Sequence
  Synthetic oligonucleotide; TTG chr11 5287380 5287401 5287397 5287402 +
cagtgagccgagattttgccac

SEQ ID NO: 94622 - DNA, 22 bp, Artificial Sequence
  Synthetic oligonucleotide; TTT chr11 5287396 5287417 5287413 5287418 +
tgccactacactcccatttggg

SEQ ID NO: 94623 - DNA, 22 bp, Artificial Sequence
  Synthetic oligonucleotide; TTT chr11 5287397 5287418 5287414 5287419 +
gccactacactcccatttgggt

SEQ ID NO: 94624 - DNA, 22 bp, Artificial Sequence
  Synthetic oligonucleotide; TTG chr11 5287398 5287419 5287415 5287420 +
ccactacactcccatttgggtg

SEQ ID NO: 94625 - DNA, 22 bp, Artificial Sequence
  Synthetic oligonucleotide; CTA chr11 5287404 5287425 5287421 5287426 +
cactcccatttgggtgacagag

SEQ ID NO: 94626 - DNA, 22 bp, Artificial Sequence
  Synthetic oligonucleotide; CTC chr11 5287409 5287430 5287426 5287431 +
ccatttgggtgacagagtgaga

SEQ ID NO: 94627 - DNA, 22 bp, Artificial Sequence
  Synthetic oligonucleotide; TTT chr11 5287415 5287436 5287432 5287437 +
gggtgacagagtgagacccttt

SEQ ID NO: 94628 - DNA, 22 bp, Artificial Sequence
  Synthetic oligonucleotide; TTG chr11 5287416 5287437 5287433 5287438 +
ggtgacagagtgagaccctttc

SEQ ID NO: 94629 - DNA, 22 bp, Artificial Sequence
  Synthetic oligonucleotide; CTT chr11 5287436 5287457 5287453 5287458 +
tctcaaaaacaaactaattaaa

SEQ ID NO: 94630 - DNA, 22 bp, Artificial Sequence
  Synthetic oligonucleotide; TTT chr11 5287437 5287458 5287454 5287459 +
ctcaaaaacaaactaattaaaa

SEQ ID NO: 94631 - DNA, 22 bp, Artificial Sequence
  Synthetic oligonucleotide; TTC chr11 5287438 5287459 5287455 5287460 +
tcaaaaacaaactaattaaaaa

SEQ ID NO: 94632 - DNA, 22 bp, Artificial Sequence
  Synthetic oligonucleotide; CTC chr11 5287440 5287461 5287457 5287462 +
aaaaacaaactaattaaaaaac

SEQ ID NO: 94633 - DNA, 22 bp, Artificial Sequence
  Synthetic oligonucleotide; CTA chr11 5287452 5287473 5287469 5287474 +
attaaaaaaccctccattttac

SEQ ID NO: 94634 - DNA, 22 bp, Artificial Sequence
  Synthetic oligonucleotide; TTA chr11 5287456 5287477 5287473 5287478 +
aaaaaccctccattttacagat

SEQ ID NO: 94635 - DNA, 22 bp, Artificial Sequence
  Synthetic oligonucleotide; CTC chr11 5287466 5287487 5287483 5287488 +
cattttacagatgaagaaactg

SEQ ID NO: 94636 - DNA, 22 bp, Artificial Sequence
  Synthetic oligonucleotide; TTT chr11 5287471 5287492 5287488 5287493 +
tacagatgaagaaactgagtca

SEQ ID NO: 94637 - DNA, 22 bp, Artificial Sequence
  Synthetic oligonucleotide; TTT chr11 5287472 5287493 5287489 5287494 +
acagatgaagaaactgagtcat

SEQ ID NO: 94638 - DNA, 22 bp, Artificial Sequence
  Synthetic oligonucleotide; TTA chr11 5287473 5287494 5287490 5287495 +
cagatgaagaaactgagtcata

SEQ ID NO: 94639 - DNA, 22 bp, Artificial Sequence
  Synthetic oligonucleotide; CTG chr11 5287488 5287509 5287505 5287510 +
agtcatacaactactaagagaa

SEQ ID NO: 94640 - DNA, 22 bp, Artificial Sequence
  Synthetic oligonucleotide; CTA chr11 5287501 5287522 5287518 5287523 +
ctaagagaaactgagtcactaa

SEQ ID NO: 94641 - DNA, 22 bp, Artificial Sequence
  Synthetic oligonucleotide; CTA chr11 5287504 5287525 5287521 5287526 +
agagaaactgagtcactaatca

SEQ ID NO: 94642 - DNA, 22 bp, Artificial Sequence
  Synthetic oligonucleotide; CTG chr11 5287514 5287535 5287531 5287536 +
agtcactaatcactcaggtggt

SEQ ID NO: 94643 - DNA, 22 bp, Artificial Sequence
  Synthetic oligonucleotide; CTA chr11 5287522 5287543 5287539 5287544 +
atcactcaggtggtctggctcc

SEQ ID NO: 94644 - DNA, 22 bp, Artificial Sequence
  Synthetic oligonucleotide; CTC chr11 5287529 5287550 5287546 5287551 +
aggtggtctggctccagcatct

SEQ ID NO: 94645 - DNA, 22 bp, Artificial Sequence
  Synthetic oligonucleotide; CTG chr11 5287539 5287560 5287556 5287561 +
gctccagcatctgtactcttaa

SEQ ID NO: 94646 - DNA, 22 bp, Artificial Sequence
  Synthetic oligonucleotide; CTC chr11 5287543 5287564 5287560 5287565 +
cagcatctgtactcttaatctc

SEQ ID NO: 94647 - DNA, 22 bp, Artificial Sequence
  Synthetic oligonucleotide; CTG chr11 5287552 5287573 5287569 5287574 +
tactcttaatctctgctctata

SEQ ID NO: 94648 - DNA, 22 bp, Artificial Sequence
  Synthetic oligonucleotide; CTC chr11 5287557 5287578 5287574 5287579 +
ttaatctctgctctatactgcc

SEQ ID NO: 94649 - DNA, 22 bp, Artificial Sequence
  Synthetic oligonucleotide; CTT chr11 5287559 5287580 5287576 5287581 +
aatctctgctctatactgccca

SEQ ID NO: 94650 - DNA, 22 bp, Artificial Sequence
  Synthetic oligonucleotide; TTA chr11 5287560 5287581 5287577 5287582 +
atctctgctctatactgcccaa

SEQ ID NO: 94651 - DNA, 22 bp, Artificial Sequence
  Synthetic oligonucleotide; CTC chr11 5287565 5287586 5287582 5287587 +
tgctctatactgcccaagactt

SEQ ID NO: 94652 - DNA, 22 bp, Artificial Sequence
  Synthetic oligonucleotide; CTG chr11 5287567 5287588 5287584 5287589 +
ctctatactgcccaagactttt

SEQ ID NO: 94653 - DNA, 22 bp, Artificial Sequence
  Synthetic oligonucleotide; CTC chr11 5287570 5287591 5287587 5287592 +
tatactgcccaagacttttata

SEQ ID NO: 94654 - DNA, 22 bp, Artificial Sequence
  Synthetic oligonucleotide; CTA chr11 5287572 5287593 5287589 5287594 +
tactgcccaagacttttataaa

SEQ ID NO: 94655 - DNA, 22 bp, Artificial Sequence
  Synthetic oligonucleotide; CTG chr11 5287577 5287598 5287594 5287599 +
cccaagacttttataaagtcaa

SEQ ID NO: 94656 - DNA, 22 bp, Artificial Sequence
  Synthetic oligonucleotide; CTT chr11 5287587 5287608 5287604 5287609 +
ttataaagtcaagggttgagtc

SEQ ID NO: 94657 - DNA, 22 bp, Artificial Sequence
  Synthetic oligonucleotide; TTT chr11 5287588 5287609 5287605 5287610 +
tataaagtcaagggttgagtca

SEQ ID NO: 94658 - DNA, 22 bp, Artificial Sequence
  Synthetic oligonucleotide; TTT chr11 5287589 5287610 5287606 5287611 +
ataaagtcaagggttgagtcac

SEQ ID NO: 94659 - DNA, 22 bp, Artificial Sequence
  Synthetic oligonucleotide; TTA chr11 5287590 5287611 5287607 5287612 +
taaagtcaagggttgagtcact

SEQ ID NO: 94660 - DNA, 22 bp, Artificial Sequence
  Synthetic oligonucleotide; TTG chr11 5287605 5287626 5287622 5287627 +
agtcactgaaatgagttattgg

SEQ ID NO: 94661 - DNA, 22 bp, Artificial Sequence
  Synthetic oligonucleotide; CTG chr11 5287613 5287634 5287630 5287635 +
aaatgagttattgggatggctg

SEQ ID NO: 94662 - DNA, 22 bp, Artificial Sequence
  Synthetic oligonucleotide; TTA chr11 5287623 5287644 5287640 5287645 +
ttgggatggctgtgtgggaagg

SEQ ID NO: 94663 - DNA, 22 bp, Artificial Sequence
  Synthetic oligonucleotide; TTG chr11 5287626 5287647 5287643 5287648 +
ggatggctgtgtgggaagggtg

SEQ ID NO: 94664 - DNA, 22 bp, Artificial Sequence
  Synthetic oligonucleotide; CTG chr11 5287635 5287656 5287652 5287657 +
tgtgggaagggtgctaagttct

SEQ ID NO: 94665 - DNA, 22 bp, Artificial Sequence
  Synthetic oligonucleotide; CTA chr11 5287651 5287672 5287668 5287673 +
agttctttcctaaaggtatgtg

SEQ ID NO: 94666 - DNA, 22 bp, Artificial Sequence
  Synthetic oligonucleotide; TTC chr11 5287656 5287677 5287673 5287678 +
tttcctaaaggtatgtgagaat

SEQ ID NO: 94667 - DNA, 22 bp, Artificial Sequence
  Synthetic oligonucleotide; CTT chr11 5287658 5287679 5287675 5287680 +
tcctaaaggtatgtgagaatac

SEQ ID NO: 94668 - DNA, 22 bp, Artificial Sequence
  Synthetic oligonucleotide; TTT chr11 5287659 5287680 5287676 5287681 +
cctaaaggtatgtgagaataca

SEQ ID NO: 94669 - DNA, 22 bp, Artificial Sequence
  Synthetic oligonucleotide; TTC chr11 5287660 5287681 5287677 5287682 +
ctaaaggtatgtgagaatacaa

SEQ ID NO: 94670 - DNA, 22 bp, Artificial Sequence
  Synthetic oligonucleotide; CTA chr11 5287663 5287684 5287680 5287685 +
aaggtatgtgagaatacaaagg

SEQ ID NO: 94671 - DNA, 22 bp, Artificial Sequence
  Synthetic oligonucleotide; CTC chr11 5287699 5287720 5287716 5287721 +
ctttttacacacgtgaactagt

SEQ ID NO: 94672 - DNA, 22 bp, Artificial Sequence
  Synthetic oligonucleotide; CTT chr11 5287702 5287723 5287719 5287724 +
tttacacacgtgaactagtgca

SEQ ID NO: 94673 - DNA, 22 bp, Artificial Sequence
  Synthetic oligonucleotide; TTT chr11 5287703 5287724 5287720 5287725 +
ttacacacgtgaactagtgcat

SEQ ID NO: 94674 - DNA, 22 bp, Artificial Sequence
  Synthetic oligonucleotide; TTT chr11 5287704 5287725 5287721 5287726 +
tacacacgtgaactagtgcatg

SEQ ID NO: 94675 - DNA, 22 bp, Artificial Sequence
  Synthetic oligonucleotide; TTT chr11 5287705 5287726 5287722 5287727 +
acacacgtgaactagtgcatgc

SEQ ID NO: 94676 - DNA, 22 bp, Artificial Sequence
  Synthetic oligonucleotide; TTA chr11 5287706 5287727 5287723 5287728 +
cacacgtgaactagtgcatgca

SEQ ID NO: 94677 - DNA, 22 bp, Artificial Sequence
  Synthetic oligonucleotide; CTA chr11 5287719 5287740 5287736 5287741 +
gtgcatgcaaatctgacactca

SEQ ID NO: 94678 - DNA, 22 bp, Artificial Sequence
  Synthetic oligonucleotide; CTG chr11 5287734 5287755 5287751 5287756 +
acactcagtgggcctgggtgaa

SEQ ID NO: 94679 - DNA, 22 bp, Artificial Sequence
  Synthetic oligonucleotide; CTC chr11 5287740 5287761 5287757 5287762 +
agtgggcctgggtgaaggtgag

SEQ ID NO: 94680 - DNA, 22 bp, Artificial Sequence
  Synthetic oligonucleotide; CTG chr11 5287750 5287771 5287767 5287772 +
ggtgaaggtgagaattttattg

SEQ ID NO: 94681 - DNA, 22 bp, Artificial Sequence
  Synthetic oligonucleotide; TTT chr11 5287767 5287788 5287784 5287789 +
tattgctgaatgagagcctctg

SEQ ID NO: 94682 - DNA, 22 bp, Artificial Sequence
  Synthetic oligonucleotide; TTT chr11 5287768 5287789 5287785 5287790 +
attgctgaatgagagcctctgg

SEQ ID NO: 94683 - DNA, 22 bp, Artificial Sequence
  Synthetic oligonucleotide; TTA chr11 5287769 5287790 5287786 5287791 +
ttgctgaatgagagcctctggg

SEQ ID NO: 94684 - DNA, 22 bp, Artificial Sequence
  Synthetic oligonucleotide; TTG chr11 5287772 5287793 5287789 5287794 +
ctgaatgagagcctctggggac

SEQ ID NO: 94685 - DNA, 22 bp, Artificial Sequence
  Synthetic oligonucleotide; CTG chr11 5287775 5287796 5287792 5287797 +
aatgagagcctctggggacatc

SEQ ID NO: 94686 - DNA, 22 bp, Artificial Sequence
  Synthetic oligonucleotide; CTC chr11 5287787 5287808 5287804 5287809 +
tggggacatcttgccagtcaat

SEQ ID NO: 94687 - DNA, 22 bp, Artificial Sequence
  Synthetic oligonucleotide; CTG chr11 5287789 5287810 5287806 5287811 +
gggacatcttgccagtcaatga

SEQ ID NO: 94688 - DNA, 22 bp, Artificial Sequence
  Synthetic oligonucleotide; CTT chr11 5287799 5287820 5287816 5287821 +
gccagtcaatgagtctcaggtt

SEQ ID NO: 94689 - DNA, 22 bp, Artificial Sequence
  Synthetic oligonucleotide; TTG chr11 5287800 5287821 5287817 5287822 +
ccagtcaatgagtctcaggttc

SEQ ID NO: 94690 - DNA, 22 bp, Artificial Sequence
  Synthetic oligonucleotide; CTC chr11 5287816 5287837 5287833 5287838 +
aggttcaatttccttctcagtc

SEQ ID NO: 94691 - DNA, 22 bp, Artificial Sequence
  Synthetic oligonucleotide; TTC chr11 5287822 5287843 5287839 5287844 +
aatttccttctcagtcttggag

SEQ ID NO: 94692 - DNA, 22 bp, Artificial Sequence
  Synthetic oligonucleotide; TTT chr11 5287827 5287848 5287844 5287849 +
ccttctcagtcttggagtaaca

SEQ ID NO: 94693 - DNA, 22 bp, Artificial Sequence
  Synthetic oligonucleotide; TTC chr11 5287828 5287849 5287845 5287850 +
cttctcagtcttggagtaacag

SEQ ID NO: 94694 - DNA, 22 bp, Artificial Sequence
  Synthetic oligonucleotide; CTT chr11 5287831 5287852 5287848 5287853 +
ctcagtcttggagtaacagaag

SEQ ID NO: 94695 - DNA, 22 bp, Artificial Sequence
  Synthetic oligonucleotide; TTC chr11 5287832 5287853 5287849 5287854 +
tcagtcttggagtaacagaagc

SEQ ID NO: 94696 - DNA, 22 bp, Artificial Sequence
  Synthetic oligonucleotide; CTC chr11 5287834 5287855 5287851 5287856 +
agtcttggagtaacagaagctc

SEQ ID NO: 94697 - DNA, 22 bp, Artificial Sequence
  Synthetic oligonucleotide; CTT chr11 5287840 5287861 5287857 5287862 +
ggagtaacagaagctcatgcat

SEQ ID NO: 94698 - DNA, 22 bp, Artificial Sequence
  Synthetic oligonucleotide; TTG chr11 5287841 5287862 5287858 5287863 +
gagtaacagaagctcatgcatt

SEQ ID NO: 94699 - DNA, 22 bp, Artificial Sequence
  Synthetic oligonucleotide; CTC chr11 5287856 5287877 5287873 5287878 +
atgcatttaataaacggaaatt

SEQ ID NO: 94700 - DNA, 22 bp, Artificial Sequence
  Synthetic oligonucleotide; TTT chr11 5287864 5287885 5287881 5287886 +
aataaacggaaattttgtattg

SEQ ID NO: 94701 - DNA, 22 bp, Artificial Sequence
  Synthetic oligonucleotide; TTA chr11 5287865 5287886 5287882 5287887 +
ataaacggaaattttgtattga

SEQ ID NO: 94702 - DNA, 22 bp, Artificial Sequence
  Synthetic oligonucleotide; TTT chr11 5287879 5287900 5287896 5287901 +
tgtattgaaatgagagccattg

SEQ ID NO: 94703 - DNA, 22 bp, Artificial Sequence
  Synthetic oligonucleotide; TTT chr11 5287880 5287901 5287897 5287902 +
gtattgaaatgagagccattgg

SEQ ID NO: 94704 - DNA, 22 bp, Artificial Sequence
  Synthetic oligonucleotide; TTG chr11 5287881 5287902 5287898 5287903 +
tattgaaatgagagccattgga

SEQ ID NO: 94705 - DNA, 22 bp, Artificial Sequence
  Synthetic oligonucleotide; TTG chr11 5287886 5287907 5287903 5287908 +
aaatgagagccattggaaatca

SEQ ID NO: 94706 - DNA, 22 bp, Artificial Sequence
  Synthetic oligonucleotide; TTG chr11 5287901 5287922 5287918 5287923 +
gaaatcatttactccagactcc

SEQ ID NO: 94707 - DNA, 22 bp, Artificial Sequence
  Synthetic oligonucleotide; TTT chr11 5287911 5287932 5287928 5287933 +
actccagactcctacttataaa

SEQ ID NO: 94708 - DNA, 22 bp, Artificial Sequence
  Synthetic oligonucleotide; TTA chr11 5287912 5287933 5287929 5287934 +
ctccagactcctacttataaaa

SEQ ID NO: 94709 - DNA, 22 bp, Artificial Sequence
  Synthetic oligonucleotide; CTC chr11 5287915 5287936 5287932 5287937 +
cagactcctacttataaaaaga

SEQ ID NO: 94710 - DNA, 22 bp, Artificial Sequence
  Synthetic oligonucleotide; CTC chr11 5287922 5287943 5287939 5287944 +
ctacttataaaaagagaaactg

SEQ ID NO: 94711 - DNA, 22 bp, Artificial Sequence
  Synthetic oligonucleotide; CTA chr11 5287925 5287946 5287942 5287947 +
cttataaaaagagaaactgagg

SEQ ID NO: 94712 - DNA, 22 bp, Artificial Sequence
  Synthetic oligonucleotide; CTT chr11 5287928 5287949 5287945 5287950 +
ataaaaagagaaactgaggctc

SEQ ID NO: 94713 - DNA, 22 bp, Artificial Sequence
  Synthetic oligonucleotide; TTA chr11 5287929 5287950 5287946 5287951 +
taaaaagagaaactgaggctca

SEQ ID NO: 94714 - DNA, 22 bp, Artificial Sequence
  Synthetic oligonucleotide; CTG chr11 5287944 5287965 5287961 5287966 +
aggctcagagaagggtggggac

SEQ ID NO: 94715 - DNA, 22 bp, Artificial Sequence
  Synthetic oligonucleotide; CTC chr11 5287950 5287971 5287967 5287972 +
agagaagggtggggactttctc

SEQ ID NO: 94716 - DNA, 22 bp, Artificial Sequence
  Synthetic oligonucleotide; CTT chr11 5287968 5287989 5287985 5287990 +
tctcagtatgacatggaaatga

SEQ ID NO: 94717 - DNA, 22 bp, Artificial Sequence
  Synthetic oligonucleotide; TTT chr11 5287969 5287990 5287986 5287991 +
ctcagtatgacatggaaatgat

SEQ ID NO: 94718 - DNA, 22 bp, Artificial Sequence
  Synthetic oligonucleotide; TTC chr11 5287970 5287991 5287987 5287992 +
tcagtatgacatggaaatgatc

SEQ ID NO: 94719 - DNA, 22 bp, Artificial Sequence
  Synthetic oligonucleotide; CTC chr11 5287972 5287993 5287989 5287994 +
agtatgacatggaaatgatcag

SEQ ID NO: 94720 - DNA, 22 bp, Artificial Sequence
  Synthetic oligonucleotide; CTT chr11 5287998 5288019 5288015 5288020 +
ggattcaaagctcctgactttc

SEQ ID NO: 94721 - DNA, 22 bp, Artificial Sequence
  Synthetic oligonucleotide; TTG chr11 5287999 5288020 5288016 5288021 +
gattcaaagctcctgactttct

SEQ ID NO: 94722 - DNA, 22 bp, Artificial Sequence
  Synthetic oligonucleotide; TTC chr11 5288004 5288025 5288021 5288026 +
aaagctcctgactttctgtcta

SEQ ID NO: 94723 - DNA, 22 bp, Artificial Sequence
  Synthetic oligonucleotide; CTC chr11 5288011 5288032 5288028 5288033 +
ctgactttctgtctagtgtatg

SEQ ID NO: 94724 - DNA, 22 bp, Artificial Sequence
  Synthetic oligonucleotide; CTG chr11 5288014 5288035 5288031 5288036 +
actttctgtctagtgtatgtgc

SEQ ID NO: 94725 - DNA, 22 bp, Artificial Sequence
  Synthetic oligonucleotide; CTT chr11 5288018 5288039 5288035 5288040 +
tctgtctagtgtatgtgcagtg

SEQ ID NO: 94726 - DNA, 22 bp, Artificial Sequence
  Synthetic oligonucleotide; TTT chr11 5288019 5288040 5288036 5288041 +
ctgtctagtgtatgtgcagtga

SEQ ID NO: 94727 - DNA, 22 bp, Artificial Sequence
  Synthetic oligonucleotide; TTC chr11 5288020 5288041 5288037 5288042 +
tgtctagtgtatgtgcagtgag

SEQ ID NO: 94728 - DNA, 22 bp, Artificial Sequence
  Synthetic oligonucleotide; CTG chr11 5288022 5288043 5288039 5288044 +
tctagtgtatgtgcagtgagcc

SEQ ID NO: 94729 - DNA, 22 bp, Artificial Sequence
  Synthetic oligonucleotide; CTA chr11 5288026 5288047 5288043 5288048 +
gtgtatgtgcagtgagcccctt

SEQ ID NO: 94730 - DNA, 22 bp, Artificial Sequence
  Synthetic oligonucleotide; CTT chr11 5288048 5288069 5288065 5288070 +
ttcctctaactgaaagaaggaa

SEQ ID NO: 94731 - DNA, 22 bp, Artificial Sequence
  Synthetic oligonucleotide; TTT chr11 5288049 5288070 5288066 5288071 +
tcctctaactgaaagaaggaaa

SEQ ID NO: 94732 - DNA, 22 bp, Artificial Sequence
  Synthetic oligonucleotide; TTT chr11 5288050 5288071 5288067 5288072 +
cctctaactgaaagaaggaaaa

SEQ ID NO: 94733 - DNA, 22 bp, Artificial Sequence
  Synthetic oligonucleotide; TTC chr11 5288051 5288072 5288068 5288073 +
ctctaactgaaagaaggaaaaa

SEQ ID NO: 94734 - DNA, 22 bp, Artificial Sequence
  Synthetic oligonucleotide; CTC chr11 5288054 5288075 5288071 5288076 +
taactgaaagaaggaaaaaaaa

SEQ ID NO: 94735 - DNA, 22 bp, Artificial Sequence
  Synthetic oligonucleotide; CTA chr11 5288056 5288077 5288073 5288078 +
actgaaagaaggaaaaaaaaat

SEQ ID NO: 94736 - DNA, 22 bp, Artificial Sequence
  Synthetic oligonucleotide; CTG chr11 5288060 5288081 5288077 5288082 +
aaagaaggaaaaaaaaatggaa

SEQ ID NO: 94737 - DNA, 22 bp, Artificial Sequence
  Synthetic oligonucleotide; TTC chr11 5288094 5288115 5288111 5288116 +
tacatagtttccatgtcacagc

SEQ ID NO: 94738 - DNA, 22 bp, Artificial Sequence
  Synthetic oligonucleotide; CTA chr11 5288096 5288117 5288113 5288118 +
catagtttccatgtcacagcca

SEQ ID NO: 94739 - DNA, 22 bp, Artificial Sequence
  Synthetic oligonucleotide; TTT chr11 5288104 5288125 5288121 5288126 +
ccatgtcacagccagggctggg

SEQ ID NO: 94740 - DNA, 22 bp, Artificial Sequence
  Synthetic oligonucleotide; TTC chr11 5288105 5288126 5288122 5288127 +
catgtcacagccagggctgggc

SEQ ID NO: 94741 - DNA, 22 bp, Artificial Sequence
  Synthetic oligonucleotide; CTG chr11 5288124 5288145 5288141 5288146 +
ggcagtctcctgttatttcttt

SEQ ID NO: 94742 - DNA, 22 bp, Artificial Sequence
  Synthetic oligonucleotide; CTC chr11 5288133 5288154 5288150 5288155 +
ctgttatttcttttaaaataaa

SEQ ID NO: 94743 - DNA, 22 bp, Artificial Sequence
  Synthetic oligonucleotide; CTG chr11 5288136 5288157 5288153 5288158 +
ttatttcttttaaaataaatat

SEQ ID NO: 94744 - DNA, 22 bp, Artificial Sequence
  Synthetic oligonucleotide; TTA chr11 5288139 5288160 5288156 5288161 +
tttcttttaaaataaatatatc

SEQ ID NO: 94745 - DNA, 22 bp, Artificial Sequence
  Synthetic oligonucleotide; TTT chr11 5288142 5288163 5288159 5288164 +
cttttaaaataaatatatcatt

SEQ ID NO: 94746 - DNA, 22 bp, Artificial Sequence
  Synthetic oligonucleotide; TTC chr11 5288143 5288164 5288160 5288165 +
ttttaaaataaatatatcattt

SEQ ID NO: 94747 - DNA, 22 bp, Artificial Sequence
  Synthetic oligonucleotide; CTT chr11 5288145 5288166 5288162 5288167 +
ttaaaataaatatatcatttaa

SEQ ID NO: 94748 - DNA, 22 bp, Artificial Sequence
  Synthetic oligonucleotide; TTT chr11 5288146 5288167 5288163 5288168 +
taaaataaatatatcatttaaa

SEQ ID NO: 94749 - DNA, 22 bp, Artificial Sequence
  Synthetic oligonucleotide; TTT chr11 5288147 5288168 5288164 5288169 +
aaaataaatatatcatttaaat

SEQ ID NO: 94750 - DNA, 22 bp, Artificial Sequence
  Synthetic oligonucleotide; TTA chr11 5288148 5288169 5288165 5288170 +
aaataaatatatcatttaaatg

SEQ ID NO: 94751 - DNA, 22 bp, Artificial Sequence
  Synthetic oligonucleotide; TTT chr11 5288165 5288186 5288182 5288187 +
aaatgcataaataagcaaaccc

SEQ ID NO: 94752 - DNA, 22 bp, Artificial Sequence
  Synthetic oligonucleotide; TTA chr11 5288166 5288187 5288183 5288188 +
aatgcataaataagcaaaccct

SEQ ID NO: 94753 - DNA, 22 bp, Artificial Sequence
  Synthetic oligonucleotide; CTG chr11 5288189 5288210 5288206 5288211 +
ctcgggaatgggagggagagtc

SEQ ID NO: 94754 - DNA, 22 bp, Artificial Sequence
  Synthetic oligonucleotide; CTC chr11 5288192 5288213 5288209 5288214 +
gggaatgggagggagagtctct

SEQ ID NO: 94755 - DNA, 22 bp, Artificial Sequence
  Synthetic oligonucleotide; CTC chr11 5288213 5288234 5288230 5288235 +
tggagtccaccccttctcggcc

SEQ ID NO: 94756 - DNA, 22 bp, Artificial Sequence
  Synthetic oligonucleotide; CTG chr11 5288215 5288236 5288232 5288237 +
gagtccaccccttctcggccct

SEQ ID NO: 94757 - DNA, 22 bp, Artificial Sequence
  Synthetic oligonucleotide; CTT chr11 5288228 5288249 5288245 5288250 +
ctcggccctggctctgcagata

SEQ ID NO: 94758 - DNA, 22 bp, Artificial Sequence
  Synthetic oligonucleotide; TTC chr11 5288229 5288250 5288246 5288251 +
tcggccctggctctgcagatag

SEQ ID NO: 94759 - DNA, 22 bp, Artificial Sequence
  Synthetic oligonucleotide; CTC chr11 5288231 5288252 5288248 5288253 +
ggccctggctctgcagatagtg

SEQ ID NO: 94760 - DNA, 22 bp, Artificial Sequence
  Synthetic oligonucleotide; CTG chr11 5288238 5288259 5288255 5288260 +
gctctgcagatagtgctatcaa

SEQ ID NO: 94761 - DNA, 22 bp, Artificial Sequence
  Synthetic oligonucleotide; CTC chr11 5288242 5288263 5288259 5288264 +
tgcagatagtgctatcaaagcc

SEQ ID NO: 94762 - DNA, 22 bp, Artificial Sequence
  Synthetic oligonucleotide; CTG chr11 5288244 5288265 5288261 5288266 +
cagatagtgctatcaaagccct

SEQ ID NO: 94763 - DNA, 22 bp, Artificial Sequence
  Synthetic oligonucleotide; CTA chr11 5288256 5288277 5288273 5288278 +
tcaaagccctgacagagccctg

SEQ ID NO: 94764 - DNA, 22 bp, Artificial Sequence
  Synthetic oligonucleotide; CTG chr11 5288267 5288288 5288284 5288289 +
acagagccctgcccattgctgg

SEQ ID NO: 94765 - DNA, 22 bp, Artificial Sequence
  Synthetic oligonucleotide; CTG chr11 5288278 5288299 5288295 5288300 +
cccattgctgggccttggagtg

SEQ ID NO: 94766 - DNA, 22 bp, Artificial Sequence
  Synthetic oligonucleotide; TTG chr11 5288285 5288306 5288302 5288307 +
ctgggccttggagtgagtcagc

SEQ ID NO: 94767 - DNA, 22 bp, Artificial Sequence
  Synthetic oligonucleotide; CTG chr11 5288288 5288309 5288305 5288310 +
ggccttggagtgagtcagccta

SEQ ID NO: 94768 - DNA, 22 bp, Artificial Sequence
  Synthetic oligonucleotide; CTT chr11 5288294 5288315 5288311 5288316 +
ggagtgagtcagcctagtagag

SEQ ID NO: 94769 - DNA, 22 bp, Artificial Sequence
  Synthetic oligonucleotide; TTG chr11 5288295 5288316 5288312 5288317 +
gagtgagtcagcctagtagaga

SEQ ID NO: 94770 - DNA, 22 bp, Artificial Sequence
  Synthetic oligonucleotide; CTA chr11 5288310 5288331 5288327 5288332 +
gtagagaggcagggcaagccat

SEQ ID NO: 94771 - DNA, 22 bp, Artificial Sequence
  Synthetic oligonucleotide; CTC chr11 5288335 5288356 5288352 5288357 +
atagctgctgagtgggagagag

SEQ ID NO: 94772 - DNA, 22 bp, Artificial Sequence
  Synthetic oligonucleotide; CTG chr11 5288342 5288363 5288359 5288364 +
ctgagtgggagagagaaaaggg

SEQ ID NO: 94773 - DNA, 22 bp, Artificial Sequence
  Synthetic oligonucleotide; CTG chr11 5288345 5288366 5288362 5288367 +
agtgggagagagaaaagggctc

SEQ ID NO: 94774 - DNA, 22 bp, Artificial Sequence
  Synthetic oligonucleotide; CTC chr11 5288367 5288388 5288384 5288389 +
attgtctataaactcaggtcat

SEQ ID NO: 94775 - DNA, 22 bp, Artificial Sequence
  Synthetic oligonucleotide; TTG chr11 5288371 5288392 5288388 5288393 +
tctataaactcaggtcatggct

SEQ ID NO: 94776 - DNA, 22 bp, Artificial Sequence
  Synthetic oligonucleotide; CTA chr11 5288375 5288396 5288392 5288397 +
taaactcaggtcatggctattc

SEQ ID NO: 94777 - DNA, 22 bp, Artificial Sequence
  Synthetic oligonucleotide; CTC chr11 5288382 5288403 5288399 5288404 +
aggtcatggctattcttattct

SEQ ID NO: 94778 - DNA, 22 bp, Artificial Sequence
  Synthetic oligonucleotide; CTA chr11 5288394 5288415 5288411 5288416 +
ttcttattctcacactaagaaa

SEQ ID NO: 94779 - DNA, 22 bp, Artificial Sequence
  Synthetic oligonucleotide; TTC chr11 5288397 5288418 5288414 5288419 +
ttattctcacactaagaaaaag

SEQ ID NO: 94780 - DNA, 22 bp, Artificial Sequence
  Synthetic oligonucleotide; CTT chr11 5288399 5288420 5288416 5288421 +
attctcacactaagaaaaagaa

SEQ ID NO: 94781 - DNA, 22 bp, Artificial Sequence
  Synthetic oligonucleotide; TTA chr11 5288400 5288421 5288417 5288422 +
ttctcacactaagaaaaagaat

SEQ ID NO: 94782 - DNA, 22 bp, Artificial Sequence
  Synthetic oligonucleotide; TTC chr11 5288403 5288424 5288420 5288425 +
tcacactaagaaaaagaatgag

SEQ ID NO: 94783 - DNA, 22 bp, Artificial Sequence
  Synthetic oligonucleotide; CTC chr11 5288405 5288426 5288422 5288427 +
acactaagaaaaagaatgagat

SEQ ID NO: 94784 - DNA, 22 bp, Artificial Sequence
  Synthetic oligonucleotide; CTA chr11 5288411 5288432 5288428 5288433 +
agaaaaagaatgagatgtctac

SEQ ID NO: 94785 - DNA, 22 bp, Artificial Sequence
  Synthetic oligonucleotide; CTA chr11 5288432 5288453 5288449 5288454 +
catataccctgcgtcccctctt

SEQ ID NO: 94786 - DNA, 22 bp, Artificial Sequence
  Synthetic oligonucleotide; CTG chr11 5288443 5288464 5288460 5288465 +
cgtcccctcttgtgtactgggg

SEQ ID NO: 94787 - DNA, 22 bp, Artificial Sequence
  Synthetic oligonucleotide; CTC chr11 5288452 5288473 5288469 5288474 +
ttgtgtactggggtccccaaga

SEQ ID NO: 94788 - DNA, 22 bp, Artificial Sequence
  Synthetic oligonucleotide; CTT chr11 5288454 5288475 5288471 5288476 +
gtgtactggggtccccaagagc

SEQ ID NO: 94789 - DNA, 22 bp, Artificial Sequence
  Synthetic oligonucleotide; TTG chr11 5288455 5288476 5288472 5288477 +
tgtactggggtccccaagagct

SEQ ID NO: 94790 - DNA, 22 bp, Artificial Sequence
  Synthetic oligonucleotide; CTG chr11 5288462 5288483 5288479 5288484 +
gggtccccaagagctctctaaa

SEQ ID NO: 94791 - DNA, 22 bp, Artificial Sequence
  Synthetic oligonucleotide; CTC chr11 5288478 5288499 5288495 5288500 +
tctaaaagtgatggcaaagtca

SEQ ID NO: 94792 - DNA, 22 bp, Artificial Sequence
  Synthetic oligonucleotide; CTC chr11 5288480 5288501 5288497 5288502 +
taaaagtgatggcaaagtcatt

SEQ ID NO: 94793 - DNA, 22 bp, Artificial Sequence
  Synthetic oligonucleotide; CTA chr11 5288482 5288503 5288499 5288504 +
aaagtgatggcaaagtcattgc

SEQ ID NO: 94794 - DNA, 22 bp, Artificial Sequence
  Synthetic oligonucleotide; TTG chr11 5288503 5288524 5288520 5288525 +
cgctagatgccatcccatctat

SEQ ID NO: 94795 - DNA, 22 bp, Artificial Sequence
  Synthetic oligonucleotide; CTA chr11 5288508 5288529 5288525 5288530 +
gatgccatcccatctattataa

SEQ ID NO: 94796 - DNA, 22 bp, Artificial Sequence
  Synthetic oligonucleotide; CTA chr11 5288524 5288545 5288541 5288546 +
ttataaacctgcatttgtctcc

SEQ ID NO: 94797 - DNA, 22 bp, Artificial Sequence
  Synthetic oligonucleotide; TTA chr11 5288527 5288548 5288544 5288549 +
taaacctgcatttgtctccaca

SEQ ID NO: 94798 - DNA, 22 bp, Artificial Sequence
  Synthetic oligonucleotide; CTG chr11 5288535 5288556 5288552 5288557 +
catttgtctccacacaccagtc

SEQ ID NO: 94799 - DNA, 22 bp, Artificial Sequence
  Synthetic oligonucleotide; TTT chr11 5288540 5288561 5288557 5288562 +
gtctccacacaccagtcatgga

SEQ ID NO: 94800 - DNA, 22 bp, Artificial Sequence
  Synthetic oligonucleotide; TTG chr11 5288541 5288562 5288558 5288563 +
tctccacacaccagtcatggac

SEQ ID NO: 94801 - DNA, 22 bp, Artificial Sequence
  Synthetic oligonucleotide; CTC chr11 5288545 5288566 5288562 5288567 +
cacacaccagtcatggacaata

SEQ ID NO: 94802 - DNA, 22 bp, Artificial Sequence
  Synthetic oligonucleotide; CTC chr11 5288573 5288594 5288590 5288595 +
ctcccaggtccacgtgcttgtc

SEQ ID NO: 94803 - DNA, 22 bp, Artificial Sequence
  Synthetic oligonucleotide; CTC chr11 5288576 5288597 5288593 5288598 +
ccaggtccacgtgcttgtcttt

SEQ ID NO: 94804 - DNA, 22 bp, Artificial Sequence
  Synthetic oligonucleotide; CTT chr11 5288592 5288613 5288609 5288614 +
gtctttgtataatactcaagta

SEQ ID NO: 94805 - DNA, 22 bp, Artificial Sequence
  Synthetic oligonucleotide; TTG chr11 5288593 5288614 5288610 5288615 +
tctttgtataatactcaagtaa

SEQ ID NO: 94806 - DNA, 22 bp, Artificial Sequence
  Synthetic oligonucleotide; CTT chr11 5288597 5288618 5288614 5288619 +
tgtataatactcaagtaatttc

SEQ ID NO: 94807 - DNA, 22 bp, Artificial Sequence
  Synthetic oligonucleotide; TTT chr11 5288598 5288619 5288615 5288620 +
gtataatactcaagtaatttcg

SEQ ID NO: 94808 - DNA, 22 bp, Artificial Sequence
  Synthetic oligonucleotide; TTG chr11 5288599 5288620 5288616 5288621 +
tataatactcaagtaatttcgg

SEQ ID NO: 94809 - DNA, 22 bp, Artificial Sequence
  Synthetic oligonucleotide; CTC chr11 5288609 5288630 5288626 5288631 +
aagtaatttcggaaaatgtatt

SEQ ID NO: 94810 - DNA, 22 bp, Artificial Sequence
  Synthetic oligonucleotide; TTT chr11 5288618 5288639 5288635 5288640 +
cggaaaatgtattctttcaatc

SEQ ID NO: 94811 - DNA, 22 bp, Artificial Sequence
  Synthetic oligonucleotide; TTC chr11 5288619 5288640 5288636 5288641 +
ggaaaatgtattctttcaatct

SEQ ID NO: 94812 - DNA, 22 bp, Artificial Sequence
  Synthetic oligonucleotide; TTC chr11 5288632 5288653 5288649 5288654 +
tttcaatcttgttctgttattc

SEQ ID NO: 94813 - DNA, 22 bp, Artificial Sequence
  Synthetic oligonucleotide; CTT chr11 5288634 5288655 5288651 5288656 +
tcaatcttgttctgttattcct

SEQ ID NO: 94814 - DNA, 22 bp, Artificial Sequence
  Synthetic oligonucleotide; TTT chr11 5288635 5288656 5288652 5288657 +
caatcttgttctgttattcctg

SEQ ID NO: 94815 - DNA, 22 bp, Artificial Sequence
  Synthetic oligonucleotide; TTC chr11 5288636 5288657 5288653 5288658 +
aatcttgttctgttattcctgt

SEQ ID NO: 94816 - DNA, 22 bp, Artificial Sequence
  Synthetic oligonucleotide; CTT chr11 5288642 5288663 5288659 5288664 +
gttctgttattcctgtttcaat

SEQ ID NO: 94817 - DNA, 22 bp, Artificial Sequence
  Synthetic oligonucleotide; TTG chr11 5288643 5288664 5288660 5288665 +
ttctgttattcctgtttcaatg

SEQ ID NO: 94818 - DNA, 22 bp, Artificial Sequence
  Synthetic oligonucleotide; TTC chr11 5288646 5288667 5288663 5288668 +
tgttattcctgtttcaatggct

SEQ ID NO: 94819 - DNA, 22 bp, Artificial Sequence
  Synthetic oligonucleotide; CTG chr11 5288648 5288669 5288665 5288670 +
ttattcctgtttcaatggctta

SEQ ID NO: 94820 - DNA, 22 bp, Artificial Sequence
  Synthetic oligonucleotide; TTA chr11 5288651 5288672 5288668 5288673 +
ttcctgtttcaatggcttagta

SEQ ID NO: 94821 - DNA, 22 bp, Artificial Sequence
  Synthetic oligonucleotide; TTC chr11 5288654 5288675 5288671 5288676 +
ctgtttcaatggcttagtagaa

SEQ ID NO: 94822 - DNA, 22 bp, Artificial Sequence
  Synthetic oligonucleotide; CTG chr11 5288657 5288678 5288674 5288679 +
tttcaatggcttagtagaaaaa

SEQ ID NO: 94823 - DNA, 22 bp, Artificial Sequence
  Synthetic oligonucleotide; TTT chr11 5288660 5288681 5288677 5288682 +
caatggcttagtagaaaaagta

SEQ ID NO: 94824 - DNA, 22 bp, Artificial Sequence
  Synthetic oligonucleotide; TTC chr11 5288661 5288682 5288678 5288683 +
aatggcttagtagaaaaagtac

SEQ ID NO: 94825 - DNA, 22 bp, Artificial Sequence
  Synthetic oligonucleotide; CTT chr11 5288669 5288690 5288686 5288691 +
agtagaaaaagtacatacttgt

SEQ ID NO: 94826 - DNA, 22 bp, Artificial Sequence
  Synthetic oligonucleotide; TTA chr11 5288670 5288691 5288687 5288692 +
gtagaaaaagtacatacttgtt

SEQ ID NO: 94827 - DNA, 22 bp, Artificial Sequence
  Synthetic oligonucleotide; CTT chr11 5288689 5288710 5288706 5288711 +
gttttcccataaattgacaata

SEQ ID NO: 94828 - DNA, 22 bp, Artificial Sequence
  Synthetic oligonucleotide; TTG chr11 5288690 5288711 5288707 5288712 +
ttttcccataaattgacaatag

SEQ ID NO: 94829 - DNA, 22 bp, Artificial Sequence
  Synthetic oligonucleotide; TTT chr11 5288693 5288714 5288710 5288715 +
tcccataaattgacaatagaca

SEQ ID NO: 94830 - DNA, 22 bp, Artificial Sequence
  Synthetic oligonucleotide; TTT chr11 5288694 5288715 5288711 5288716 +
cccataaattgacaatagacaa

SEQ ID NO: 94831 - DNA, 22 bp, Artificial Sequence
  Synthetic oligonucleotide; TTC chr11 5288695 5288716 5288712 5288717 +
ccataaattgacaatagacaat

SEQ ID NO: 94832 - DNA, 22 bp, Artificial Sequence
  Synthetic oligonucleotide; TTG chr11 5288705 5288726 5288722 5288727 +
acaatagacaatttcacatcaa

SEQ ID NO: 94833 - DNA, 22 bp, Artificial Sequence
  Synthetic oligonucleotide; TTT chr11 5288719 5288740 5288736 5288741 +
cacatcaatgtctatatgggtc

SEQ ID NO: 94834 - DNA, 22 bp, Artificial Sequence
  Synthetic oligonucleotide; TTC chr11 5288720 5288741 5288737 5288742 +
acatcaatgtctatatgggtcg

SEQ ID NO: 94835 - DNA, 22 bp, Artificial Sequence
  Synthetic oligonucleotide; CTA chr11 5288733 5288754 5288750 5288755 +
tatgggtcgttgtgtttgctgt

SEQ ID NO: 94836 - DNA, 22 bp, Artificial Sequence
  Synthetic oligonucleotide; TTG chr11 5288745 5288766 5288762 5288767 +
tgtttgctgtgtttgcaaaaac

SEQ ID NO: 94837 - DNA, 22 bp, Artificial Sequence
  Synthetic oligonucleotide; TTT chr11 5288750 5288771 5288767 5288772 +
gctgtgtttgcaaaaactcaca

SEQ ID NO: 94838 - DNA, 22 bp, Artificial Sequence
  Synthetic oligonucleotide; TTG chr11 5288751 5288772 5288768 5288773 +
ctgtgtttgcaaaaactcacaa

SEQ ID NO: 94839 - DNA, 22 bp, Artificial Sequence
  Synthetic oligonucleotide; CTG chr11 5288754 5288775 5288771 5288776 +
tgtttgcaaaaactcacaataa

SEQ ID NO: 94840 - DNA, 22 bp, Artificial Sequence
  Synthetic oligonucleotide; TTT chr11 5288759 5288780 5288776 5288781 +
gcaaaaactcacaataacttta

SEQ ID NO: 94841 - DNA, 22 bp, Artificial Sequence
  Synthetic oligonucleotide; TTG chr11 5288760 5288781 5288777 5288782 +
caaaaactcacaataactttat

SEQ ID NO: 94842 - DNA, 22 bp, Artificial Sequence
  Synthetic oligonucleotide; CTC chr11 5288769 5288790 5288786 5288791 +
acaataactttatattgttact

SEQ ID NO: 94843 - DNA, 22 bp, Artificial Sequence
  Synthetic oligonucleotide; CTT chr11 5288779 5288800 5288796 5288801 +
tatattgttactactctaagaa

SEQ ID NO: 94844 - DNA, 22 bp, Artificial Sequence
  Synthetic oligonucleotide; TTT chr11 5288780 5288801 5288797 5288802 +
atattgttactactctaagaaa

SEQ ID NO: 94845 - DNA, 22 bp, Artificial Sequence
  Synthetic oligonucleotide; TTA chr11 5288781 5288802 5288798 5288803 +
tattgttactactctaagaaag

SEQ ID NO: 94846 - DNA, 22 bp, Artificial Sequence
  Synthetic oligonucleotide; TTG chr11 5288786 5288807 5288803 5288808 +
ttactactctaagaaagttaca

SEQ ID NO: 94847 - DNA, 22 bp, Artificial Sequence
  Synthetic oligonucleotide; TTA chr11 5288789 5288810 5288806 5288811 +
ctactctaagaaagttacaaca

SEQ ID NO: 94848 - DNA, 22 bp, Artificial Sequence
  Synthetic oligonucleotide; CTA chr11 5288792 5288813 5288809 5288814 +
ctctaagaaagttacaacatgg

SEQ ID NO: 94849 - DNA, 22 bp, Artificial Sequence
  Synthetic oligonucleotide; CTC chr11 5288795 5288816 5288812 5288817 +
taagaaagttacaacatggtga

SEQ ID NO: 94850 - DNA, 22 bp, Artificial Sequence
  Synthetic oligonucleotide; CTA chr11 5288797 5288818 5288814 5288819 +
agaaagttacaacatggtgaat

SEQ ID NO: 94851 - DNA, 22 bp, Artificial Sequence
  Synthetic oligonucleotide; TTA chr11 5288806 5288827 5288823 5288828 +
caacatggtgaatacaagagaa

SEQ ID NO: 94852 - DNA, 22 bp, Artificial Sequence
  Synthetic oligonucleotide; CTA chr11 5288833 5288854 5288850 5288855 +
ttacaagtccagaaaataaaag

SEQ ID NO: 94853 - DNA, 22 bp, Artificial Sequence
  Synthetic oligonucleotide; TTA chr11 5288836 5288857 5288853 5288858 +
caagtccagaaaataaaagtta

SEQ ID NO: 94854 - DNA, 22 bp, Artificial Sequence
  Synthetic oligonucleotide; TTA chr11 5288858 5288879 5288875 5288880 +
tcatcttgaggcctcagctttc

SEQ ID NO: 94855 - DNA, 22 bp, Artificial Sequence
  Synthetic oligonucleotide; CTT chr11 5288865 5288886 5288882 5288887 +
gaggcctcagctttctaggaat

SEQ ID NO: 94856 - DNA, 22 bp, Artificial Sequence
  Synthetic oligonucleotide; TTG chr11 5288866 5288887 5288883 5288888 +
aggcctcagctttctaggaata

SEQ ID NO: 94857 - DNA, 22 bp, Artificial Sequence
  Synthetic oligonucleotide; CTC chr11 5288873 5288894 5288890 5288895 +
agctttctaggaataatatcaa

SEQ ID NO: 94858 - DNA, 22 bp, Artificial Sequence
  Synthetic oligonucleotide; CTT chr11 5288878 5288899 5288895 5288900 +
tctaggaataatatcaatatta

SEQ ID NO: 94859 - DNA, 22 bp, Artificial Sequence
  Synthetic oligonucleotide; TTT chr11 5288879 5288900 5288896 5288901 +
ctaggaataatatcaatattac

SEQ ID NO: 94860 - DNA, 22 bp, Artificial Sequence
  Synthetic oligonucleotide; TTC chr11 5288880 5288901 5288897 5288902 +
taggaataatatcaatattaca

SEQ ID NO: 94861 - DNA, 22 bp, Artificial Sequence
  Synthetic oligonucleotide; CTA chr11 5288882 5288903 5288899 5288904 +
ggaataatatcaatattacaaa

SEQ ID NO: 94862 - DNA, 22 bp, Artificial Sequence
  Synthetic oligonucleotide; TTA chr11 5288900 5288921 5288917 5288922 +
caaaattaatctaacaattatg

SEQ ID NO: 94863 - DNA, 22 bp, Artificial Sequence
  Synthetic oligonucleotide; TTA chr11 5288908 5288929 5288925 5288930 +
atctaacaattatgaacagcaa

SEQ ID NO: 94864 - DNA, 22 bp, Artificial Sequence
  Synthetic oligonucleotide; CTA chr11 5288913 5288934 5288930 5288935 +
acaattatgaacagcaatgaga

SEQ ID NO: 94865 - DNA, 22 bp, Artificial Sequence
  Synthetic oligonucleotide; TTA chr11 5288920 5288941 5288937 5288942 +
tgaacagcaatgagataatgtg

SEQ ID NO: 94866 - DNA, 22 bp, Artificial Sequence
  Synthetic oligonucleotide; CTA chr11 5288961 5288982 5288978 5288983 +
tgtggtagagcatcaaggaagc

SEQ ID NO: 94867 - DNA, 22 bp, Artificial Sequence
  Synthetic oligonucleotide; TTG chr11 5288989 5289010 5289006 5289011 +
cggagcagttttttgtttgttt

SEQ ID NO: 94868 - DNA, 22 bp, Artificial Sequence
  Synthetic oligonucleotide; TTT chr11 5289000 5289021 5289017 5289022 +
tttgtttgtttgtttttgtatt

SEQ ID NO: 94869 - DNA, 22 bp, Artificial Sequence
  Synthetic oligonucleotide; TTT chr11 5289001 5289022 5289018 5289023 +
ttgtttgtttgtttttgtattc

SEQ ID NO: 94870 - DNA, 22 bp, Artificial Sequence
  Synthetic oligonucleotide; TTT chr11 5289002 5289023 5289019 5289024 +
tgtttgtttgtttttgtattct

SEQ ID NO: 94871 - DNA, 22 bp, Artificial Sequence
  Synthetic oligonucleotide; TTT chr11 5289003 5289024 5289020 5289025 +
gtttgtttgtttttgtattctg

SEQ ID NO: 94872 - DNA, 22 bp, Artificial Sequence
  Synthetic oligonucleotide; TTG chr11 5289004 5289025 5289021 5289026 +
tttgtttgtttttgtattctgt

SEQ ID NO: 94873 - DNA, 22 bp, Artificial Sequence
  Synthetic oligonucleotide; TTT chr11 5289007 5289028 5289024 5289029 +
gtttgtttttgtattctgtttc

SEQ ID NO: 94874 - DNA, 22 bp, Artificial Sequence
  Synthetic oligonucleotide; TTG chr11 5289008 5289029 5289025 5289030 +
tttgtttttgtattctgtttcg

SEQ ID NO: 94875 - DNA, 22 bp, Artificial Sequence
  Synthetic oligonucleotide; TTT chr11 5289011 5289032 5289028 5289033 +
gtttttgtattctgtttcgtga

SEQ ID NO: 94876 - DNA, 22 bp, Artificial Sequence
  Synthetic oligonucleotide; TTG chr11 5289012 5289033 5289029 5289034 +
tttttgtattctgtttcgtgag

SEQ ID NO: 94877 - DNA, 22 bp, Artificial Sequence
  Synthetic oligonucleotide; TTT chr11 5289015 5289036 5289032 5289037 +
ttgtattctgtttcgtgaggca

SEQ ID NO: 94878 - DNA, 22 bp, Artificial Sequence
  Synthetic oligonucleotide; TTT chr11 5289016 5289037 5289033 5289038 +
tgtattctgtttcgtgaggcaa

SEQ ID NO: 94879 - DNA, 22 bp, Artificial Sequence
  Synthetic oligonucleotide; TTT chr11 5289017 5289038 5289034 5289039 +
gtattctgtttcgtgaggcaag

SEQ ID NO: 94880 - DNA, 22 bp, Artificial Sequence
  Synthetic oligonucleotide; TTG chr11 5289018 5289039 5289035 5289040 +
tattctgtttcgtgaggcaagg

SEQ ID NO: 94881 - DNA, 22 bp, Artificial Sequence
  Synthetic oligonucleotide; TTC chr11 5289023 5289044 5289040 5289045 +
tgtttcgtgaggcaaggtttca

SEQ ID NO: 94882 - DNA, 22 bp, Artificial Sequence
  Synthetic oligonucleotide; CTG chr11 5289025 5289046 5289042 5289047 +
tttcgtgaggcaaggtttcact

SEQ ID NO: 94883 - DNA, 22 bp, Artificial Sequence
  Synthetic oligonucleotide; TTT chr11 5289028 5289049 5289045 5289050 +
cgtgaggcaaggtttcactctg

SEQ ID NO: 94884 - DNA, 22 bp, Artificial Sequence
  Synthetic oligonucleotide; TTC chr11 5289029 5289050 5289046 5289051 +
gtgaggcaaggtttcactctgc

SEQ ID NO: 94885 - DNA, 22 bp, Artificial Sequence
  Synthetic oligonucleotide; TTT chr11 5289043 5289064 5289060 5289065 +
cactctgctgtccaggctggag

SEQ ID NO: 94886 - DNA, 22 bp, Artificial Sequence
  Synthetic oligonucleotide; TTC chr11 5289044 5289065 5289061 5289066 +
actctgctgtccaggctggagt

SEQ ID NO: 94887 - DNA, 22 bp, Artificial Sequence
  Synthetic oligonucleotide; CTC chr11 5289048 5289069 5289065 5289070 +
tgctgtccaggctggagtgcag

SEQ ID NO: 94888 - DNA, 22 bp, Artificial Sequence
  Synthetic oligonucleotide; CTG chr11 5289050 5289071 5289067 5289072 +
ctgtccaggctggagtgcagtg

SEQ ID NO: 94889 - DNA, 22 bp, Artificial Sequence
  Synthetic oligonucleotide; CTG chr11 5289053 5289074 5289070 5289075 +
tccaggctggagtgcagtggca

SEQ ID NO: 94890 - DNA, 22 bp, Artificial Sequence
  Synthetic oligonucleotide; CTG chr11 5289062 5289083 5289079 5289084 +
gagtgcagtggcaagatcatgt

SEQ ID NO: 94891 - DNA, 22 bp, Artificial Sequence
  Synthetic oligonucleotide; CTC chr11 5289087 5289108 5289104 5289109 +
actgcagccttgacctcctgag

SEQ ID NO: 94892 - DNA, 22 bp, Artificial Sequence
  Synthetic oligonucleotide; CTG chr11 5289091 5289112 5289108 5289113 +
cagccttgacctcctgagctca

SEQ ID NO: 94893 - DNA, 22 bp, Artificial Sequence
  Synthetic oligonucleotide; CTT chr11 5289098 5289119 5289115 5289120 +
gacctcctgagctcaagggatc

SEQ ID NO: 94894 - DNA, 22 bp, Artificial Sequence
  Synthetic oligonucleotide; TTG chr11 5289099 5289120 5289116 5289121 +
acctcctgagctcaagggatcc

SEQ ID NO: 94895 - DNA, 22 bp, Artificial Sequence
  Synthetic oligonucleotide; CTC chr11 5289104 5289125 5289121 5289126 +
ctgagctcaagggatcctccca

SEQ ID NO: 94896 - DNA, 22 bp, Artificial Sequence
  Synthetic oligonucleotide; CTG chr11 5289107 5289128 5289124 5289129 +
agctcaagggatcctcccattt

SEQ ID NO: 94897 - DNA, 22 bp, Artificial Sequence
  Synthetic oligonucleotide; CTC chr11 5289112 5289133 5289129 5289134 +
aagggatcctcccatttcggcc

SEQ ID NO: 94898 - DNA, 22 bp, Artificial Sequence
  Synthetic oligonucleotide; CTC chr11 5289123 5289144 5289140 5289145 +
ccatttcggcctcctgagtagc

SEQ ID NO: 94899 - DNA, 22 bp, Artificial Sequence
  Synthetic oligonucleotide; TTT chr11 5289129 5289150 5289146 5289151 +
cggcctcctgagtagctgggac

SEQ ID NO: 94900 - DNA, 22 bp, Artificial Sequence
  Synthetic oligonucleotide; TTC chr11 5289130 5289151 5289147 5289152 +
ggcctcctgagtagctgggact

SEQ ID NO: 94901 - DNA, 22 bp, Artificial Sequence
  Synthetic oligonucleotide; CTC chr11 5289136 5289157 5289153 5289158 +
ctgagtagctgggactacaggt

SEQ ID NO: 94902 - DNA, 22 bp, Artificial Sequence
  Synthetic oligonucleotide; CTG chr11 5289139 5289160 5289156 5289161 +
agtagctgggactacaggtgta

SEQ ID NO: 94903 - DNA, 22 bp, Artificial Sequence
  Synthetic oligonucleotide; CTG chr11 5289147 5289168 5289164 5289169 +
ggactacaggtgtacatcacat

SEQ ID NO: 94904 - DNA, 22 bp, Artificial Sequence
  Synthetic oligonucleotide; CTA chr11 5289153 5289174 5289170 5289175 +
caggtgtacatcacatgcctgg

SEQ ID NO: 94905 - DNA, 22 bp, Artificial Sequence
  Synthetic oligonucleotide; CTG chr11 5289174 5289195 5289191 5289196 +
gctaatttttttttttttttta

SEQ ID NO: 94906 - DNA, 22 bp, Artificial Sequence
  Synthetic oligonucleotide; CTA chr11 5289178 5289199 5289195 5289200 +
attttttttttttttttaagta

SEQ ID NO: 94907 - DNA, 22 bp, Artificial Sequence
  Synthetic oligonucleotide; TTT chr11 5289182 5289203 5289199 5289204 +
tttttttttttttaagtagaga

SEQ ID NO: 94908 - DNA, 22 bp, Artificial Sequence
  Synthetic oligonucleotide; TTT chr11 5289183 5289204 5289200 5289205 +
ttttttttttttaagtagagac

SEQ ID NO: 94909 - DNA, 22 bp, Artificial Sequence
  Synthetic oligonucleotide; TTT chr11 5289184 5289205 5289201 5289206 +
tttttttttttaagtagagacg

SEQ ID NO: 94910 - DNA, 22 bp, Artificial Sequence
  Synthetic oligonucleotide; TTT chr11 5289185 5289206 5289202 5289207 +
ttttttttttaagtagagacga

SEQ ID NO: 94911 - DNA, 22 bp, Artificial Sequence
  Synthetic oligonucleotide; TTT chr11 5289186 5289207 5289203 5289208 +
tttttttttaagtagagacgag

SEQ ID NO: 94912 - DNA, 22 bp, Artificial Sequence
  Synthetic oligonucleotide; TTT chr11 5289187 5289208 5289204 5289209 +
ttttttttaagtagagacgagg

SEQ ID NO: 94913 - DNA, 22 bp, Artificial Sequence
  Synthetic oligonucleotide; TTT chr11 5289188 5289209 5289205 5289210 +
tttttttaagtagagacgaggt

SEQ ID NO: 94914 - DNA, 22 bp, Artificial Sequence
  Synthetic oligonucleotide; TTT chr11 5289189 5289210 5289206 5289211 +
ttttttaagtagagacgaggtc

SEQ ID NO: 94915 - DNA, 22 bp, Artificial Sequence
  Synthetic oligonucleotide; TTT chr11 5289190 5289211 5289207 5289212 +
tttttaagtagagacgaggtct

SEQ ID NO: 94916 - DNA, 22 bp, Artificial Sequence
  Synthetic oligonucleotide; TTT chr11 5289191 5289212 5289208 5289213 +
ttttaagtagagacgaggtctt

SEQ ID NO: 94917 - DNA, 22 bp, Artificial Sequence
  Synthetic oligonucleotide; TTT chr11 5289192 5289213 5289209 5289214 +
tttaagtagagacgaggtcttg

SEQ ID NO: 94918 - DNA, 22 bp, Artificial Sequence
  Synthetic oligonucleotide; TTT chr11 5289193 5289214 5289210 5289215 +
ttaagtagagacgaggtcttgc

SEQ ID NO: 94919 - DNA, 22 bp, Artificial Sequence
  Synthetic oligonucleotide; TTT chr11 5289194 5289215 5289211 5289216 +
taagtagagacgaggtcttgct

SEQ ID NO: 94920 - DNA, 22 bp, Artificial Sequence
  Synthetic oligonucleotide; TTT chr11 5289195 5289216 5289212 5289217 +
aagtagagacgaggtcttgcta

SEQ ID NO: 94921 - DNA, 22 bp, Artificial Sequence
  Synthetic oligonucleotide; TTA chr11 5289196 5289217 5289213 5289218 +
agtagagacgaggtcttgctat

SEQ ID NO: 94922 - DNA, 22 bp, Artificial Sequence
  Synthetic oligonucleotide; CTT chr11 5289213 5289234 5289230 5289235 +
gctatgttgtccaggataatat

SEQ ID NO: 94923 - DNA, 22 bp, Artificial Sequence
  Synthetic oligonucleotide; TTG chr11 5289214 5289235 5289231 5289236 +
ctatgttgtccaggataatatc

SEQ ID NO: 94924 - DNA, 22 bp, Artificial Sequence
  Synthetic oligonucleotide; CTA chr11 5289217 5289238 5289234 5289239 +
tgttgtccaggataatatcaaa

SEQ ID NO: 94925 - DNA, 22 bp, Artificial Sequence
  Synthetic oligonucleotide; TTG chr11 5289222 5289243 5289239 5289244 +
tccaggataatatcaaactctt

SEQ ID NO: 94926 - DNA, 22 bp, Artificial Sequence
  Synthetic oligonucleotide; CTC chr11 5289242 5289263 5289259 5289264 +
ttgagctcaagcagtcctccca

SEQ ID NO: 94927 - DNA, 22 bp, Artificial Sequence
  Synthetic oligonucleotide; CTT chr11 5289244 5289265 5289261 5289266 +
gagctcaagcagtcctcccact

SEQ ID NO: 94928 - DNA, 22 bp, Artificial Sequence
  Synthetic oligonucleotide; TTG chr11 5289245 5289266 5289262 5289267 +
agctcaagcagtcctcccactt

SEQ ID NO: 94929 - DNA, 22 bp, Artificial Sequence
  Synthetic oligonucleotide; CTC chr11 5289250 5289271 5289267 5289272 +
aagcagtcctcccacttctacc

SEQ ID NO: 94930 - DNA, 22 bp, Artificial Sequence
  Synthetic oligonucleotide; CTC chr11 5289261 5289282 5289278 5289283 +
ccacttctacctctcaagtgct

SEQ ID NO: 94931 - DNA, 22 bp, Artificial Sequence
  Synthetic oligonucleotide; CTT chr11 5289267 5289288 5289284 5289289 +
ctacctctcaagtgctggaatt

SEQ ID NO: 94932 - DNA, 22 bp, Artificial Sequence
  Synthetic oligonucleotide; TTC chr11 5289268 5289289 5289285 5289290 +
tacctctcaagtgctggaatta

SEQ ID NO: 94933 - DNA, 22 bp, Artificial Sequence
  Synthetic oligonucleotide; CTA chr11 5289270 5289291 5289287 5289292 +
cctctcaagtgctggaattaca

SEQ ID NO: 94934 - DNA, 22 bp, Artificial Sequence
  Synthetic oligonucleotide; CTC chr11 5289274 5289295 5289291 5289296 +
tcaagtgctggaattacagaca

SEQ ID NO: 94935 - DNA, 22 bp, Artificial Sequence
  Synthetic oligonucleotide; CTC chr11 5289276 5289297 5289293 5289298 +
aagtgctggaattacagacatg

SEQ ID NO: 94936 - DNA, 22 bp, Artificial Sequence
  Synthetic oligonucleotide; CTG chr11 5289284 5289305 5289301 5289306 +
gaattacagacatgagccacca

SEQ ID NO: 94937 - DNA, 22 bp, Artificial Sequence
  Synthetic oligonucleotide; TTA chr11 5289290 5289311 5289307 5289312 +
cagacatgagccaccactcctg

SEQ ID NO: 94938 - DNA, 22 bp, Artificial Sequence
  Synthetic oligonucleotide; CTC chr11 5289309 5289330 5289326 5289331 +
ctggcttgcagactatttaaat

SEQ ID NO: 94939 - DNA, 22 bp, Artificial Sequence
  Synthetic oligonucleotide; CTG chr11 5289312 5289333 5289329 5289334 +
gcttgcagactatttaaatgac

SEQ ID NO: 94940 - DNA, 22 bp, Artificial Sequence
  Synthetic oligonucleotide; CTT chr11 5289316 5289337 5289333 5289338 +
gcagactatttaaatgactaat

SEQ ID NO: 94941 - DNA, 22 bp, Artificial Sequence
  Synthetic oligonucleotide; TTG chr11 5289317 5289338 5289334 5289339 +
cagactatttaaatgactaatt

SEQ ID NO: 94942 - DNA, 22 bp, Artificial Sequence
  Synthetic oligonucleotide; CTA chr11 5289324 5289345 5289341 5289346 +
tttaaatgactaattcctgaca

SEQ ID NO: 94943 - DNA, 22 bp, Artificial Sequence
  Synthetic oligonucleotide; TTT chr11 5289327 5289348 5289344 5289349 +
aaatgactaattcctgacacta

SEQ ID NO: 94944 - DNA, 22 bp, Artificial Sequence
  Synthetic oligonucleotide; TTA chr11 5289328 5289349 5289345 5289350 +
aatgactaattcctgacactac

SEQ ID NO: 94945 - DNA, 22 bp, Artificial Sequence
  Synthetic oligonucleotide; CTA chr11 5289336 5289357 5289353 5289358 +
attcctgacactacttgaggga

SEQ ID NO: 94946 - DNA, 22 bp, Artificial Sequence
  Synthetic oligonucleotide; TTC chr11 5289340 5289361 5289357 5289362 +
ctgacactacttgagggatact

SEQ ID NO: 94947 - DNA, 22 bp, Artificial Sequence
  Synthetic oligonucleotide; CTG chr11 5289343 5289364 5289360 5289365 +
acactacttgagggatactaga

SEQ ID NO: 94948 - DNA, 22 bp, Artificial Sequence
  Synthetic oligonucleotide; CTA chr11 5289349 5289370 5289366 5289371 +
cttgagggatactagacagtag

SEQ ID NO: 94949 - DNA, 22 bp, Artificial Sequence
  Synthetic oligonucleotide; CTT chr11 5289352 5289373 5289369 5289374 +
gagggatactagacagtagaca

SEQ ID NO: 94950 - DNA, 22 bp, Artificial Sequence
  Synthetic oligonucleotide; TTG chr11 5289353 5289374 5289370 5289375 +
agggatactagacagtagacaa

SEQ ID NO: 94951 - DNA, 22 bp, Artificial Sequence
  Synthetic oligonucleotide; CTA chr11 5289363 5289384 5289380 5289385 +
gacagtagacaacacatcttta

SEQ ID NO: 94952 - DNA, 22 bp, Artificial Sequence
  Synthetic oligonucleotide; CTT chr11 5289383 5289404 5289400 5289405 +
taatataccaaatgggtgactg

SEQ ID NO: 94953 - DNA, 22 bp, Artificial Sequence
  Synthetic oligonucleotide; TTT chr11 5289384 5289405 5289401 5289406 +
aatataccaaatgggtgactgt

SEQ ID NO: 94954 - DNA, 22 bp, Artificial Sequence
  Synthetic oligonucleotide; TTA chr11 5289385 5289406 5289402 5289407 +
atataccaaatgggtgactgta

SEQ ID NO: 94955 - DNA, 22 bp, Artificial Sequence
  Synthetic oligonucleotide; CTG chr11 5289405 5289426 5289422 5289427 +
tagggttgagagggagattaga

SEQ ID NO: 94956 - DNA, 22 bp, Artificial Sequence
  Synthetic oligonucleotide; TTG chr11 5289413 5289434 5289430 5289435 +
agagggagattagaattcaatg

SEQ ID NO: 94957 - DNA, 22 bp, Artificial Sequence
  Synthetic oligonucleotide; TTA chr11 5289425 5289446 5289442 5289447 +
gaattcaatgttttatgaccaa

SEQ ID NO: 94958 - DNA, 22 bp, Artificial Sequence
  Synthetic oligonucleotide; TTC chr11 5289431 5289452 5289448 5289453 +
aatgttttatgaccaaaaaggc

SEQ ID NO: 94959 - DNA, 22 bp, Artificial Sequence
  Synthetic oligonucleotide; TTT chr11 5289438 5289459 5289455 5289460 +
tatgaccaaaaaggcttaaatc

SEQ ID NO: 94960 - DNA, 22 bp, Artificial Sequence
  Synthetic oligonucleotide; TTT chr11 5289439 5289460 5289456 5289461 +
atgaccaaaaaggcttaaatca

SEQ ID NO: 94961 - DNA, 22 bp, Artificial Sequence
  Synthetic oligonucleotide; TTA chr11 5289440 5289461 5289457 5289462 +
tgaccaaaaaggcttaaatcag

SEQ ID NO: 94962 - DNA, 22 bp, Artificial Sequence
  Synthetic oligonucleotide; CTT chr11 5289455 5289476 5289472 5289477 +
aaatcaggcacaagcttaggtc

SEQ ID NO: 94963 - DNA, 22 bp, Artificial Sequence
  Synthetic oligonucleotide; TTA chr11 5289456 5289477 5289473 5289478 +
aatcaggcacaagcttaggtct

SEQ ID NO: 94964 - DNA, 22 bp, Artificial Sequence
  Synthetic oligonucleotide; CTT chr11 5289472 5289493 5289489 5289494 +
aggtcttttcaactgtgaggac

SEQ ID NO: 94965 - DNA, 22 bp, Artificial Sequence
  Synthetic oligonucleotide; TTA chr11 5289473 5289494 5289490 5289495 +
ggtcttttcaactgtgaggacc

SEQ ID NO: 94966 - DNA, 22 bp, Artificial Sequence
  Synthetic oligonucleotide; CTT chr11 5289479 5289500 5289496 5289501 +
ttcaactgtgaggaccggactg

SEQ ID NO: 94967 - DNA, 22 bp, Artificial Sequence
  Synthetic oligonucleotide; TTT chr11 5289480 5289501 5289497 5289502 +
tcaactgtgaggaccggactga

SEQ ID NO: 94968 - DNA, 22 bp, Artificial Sequence
  Synthetic oligonucleotide; TTT chr11 5289481 5289502 5289498 5289503 +
caactgtgaggaccggactgaa

SEQ ID NO: 94969 - DNA, 22 bp, Artificial Sequence
  Synthetic oligonucleotide; TTC chr11 5289482 5289503 5289499 5289504 +
aactgtgaggaccggactgaaa

SEQ ID NO: 94970 - DNA, 22 bp, Artificial Sequence
  Synthetic oligonucleotide; CTG chr11 5289487 5289508 5289504 5289509 +
tgaggaccggactgaaagtgtg

SEQ ID NO: 94971 - DNA, 22 bp, Artificial Sequence
  Synthetic oligonucleotide; CTG chr11 5289501 5289522 5289518 5289523 +
aaagtgtgcagttcaaggccct

SEQ ID NO: 94972 - DNA, 22 bp, Artificial Sequence
  Synthetic oligonucleotide; TTC chr11 5289515 5289536 5289532 5289537 +
aaggccctgtagttgctgttta

SEQ ID NO: 94973 - DNA, 22 bp, Artificial Sequence
  Synthetic oligonucleotide; CTG chr11 5289524 5289545 5289541 5289546 +
tagttgctgtttaactgttccc

SEQ ID NO: 94974 - DNA, 22 bp, Artificial Sequence
  Synthetic oligonucleotide; TTG chr11 5289530 5289551 5289547 5289552 +
ctgtttaactgttcccaggtgg

SEQ ID NO: 94975 - DNA, 22 bp, Artificial Sequence
  Synthetic oligonucleotide; CTG chr11 5289533 5289554 5289550 5289555 +
tttaactgttcccaggtggaag

SEQ ID NO: 94976 - DNA, 22 bp, Artificial Sequence
  Synthetic oligonucleotide; TTT chr11 5289536 5289557 5289553 5289558 +
aactgttcccaggtggaagtct

SEQ ID NO: 94977 - DNA, 22 bp, Artificial Sequence
  Synthetic oligonucleotide; TTA chr11 5289537 5289558 5289554 5289559 +
actgttcccaggtggaagtctc

SEQ ID NO: 94978 - DNA, 22 bp, Artificial Sequence
  Synthetic oligonucleotide; CTG chr11 5289541 5289562 5289558 5289563 +
ttcccaggtggaagtctcttca

SEQ ID NO: 94979 - DNA, 22 bp, Artificial Sequence
  Synthetic oligonucleotide; TTC chr11 5289544 5289565 5289561 5289566 +
ccaggtggaagtctcttcaaag

SEQ ID NO: 94980 - DNA, 22 bp, Artificial Sequence
  Synthetic oligonucleotide; CTC chr11 5289559 5289580 5289576 5289581 +
ttcaaagaaccactggtgcaaa

SEQ ID NO: 94981 - DNA, 22 bp, Artificial Sequence
  Synthetic oligonucleotide; CTT chr11 5289561 5289582 5289578 5289583 +
caaagaaccactggtgcaaaaa

SEQ ID NO: 94982 - DNA, 22 bp, Artificial Sequence
  Synthetic oligonucleotide; TTC chr11 5289562 5289583 5289579 5289584 +
aaagaaccactggtgcaaaaag

SEQ ID NO: 94983 - DNA, 22 bp, Artificial Sequence
  Synthetic oligonucleotide; CTG chr11 5289574 5289595 5289591 5289596 +
gtgcaaaaagggaactacctgg

SEQ ID NO: 94984 - DNA, 22 bp, Artificial Sequence
  Synthetic oligonucleotide; CTA chr11 5289591 5289612 5289608 5289613 +
cctggggataaatatttcctcc

SEQ ID NO: 94985 - DNA, 22 bp, Artificial Sequence
  Synthetic oligonucleotide; CTG chr11 5289595 5289616 5289612 5289617 +
gggataaatatttcctccagaa

SEQ ID NO: 94986 - DNA, 22 bp, Artificial Sequence
  Synthetic oligonucleotide; TTT chr11 5289608 5289629 5289625 5289630 +
cctccagaaagggggaaagtgc

SEQ ID NO: 94987 - DNA, 22 bp, Artificial Sequence
  Synthetic oligonucleotide; TTC chr11 5289609 5289630 5289626 5289631 +
ctccagaaagggggaaagtgca

SEQ ID NO: 94988 - DNA, 22 bp, Artificial Sequence
  Synthetic oligonucleotide; CTC chr11 5289612 5289633 5289629 5289634 +
cagaaagggggaaagtgcaagc

SEQ ID NO: 94989 - DNA, 22 bp, Artificial Sequence
  Synthetic oligonucleotide; CTC chr11 5289636 5289657 5289653 5289658 +
ccctaccaaaagcaccaggcaa

SEQ ID NO: 94990 - DNA, 22 bp, Artificial Sequence
  Synthetic oligonucleotide; CTA chr11 5289641 5289662 5289658 5289663 +
ccaaaagcaccaggcaagtcct

SEQ ID NO: 94991 - DNA, 22 bp, Artificial Sequence
  Synthetic oligonucleotide; CTT chr11 5289664 5289685 5289681 5289686 +
gtctattttccctgaagttctc

SEQ ID NO: 94992 - DNA, 22 bp, Artificial Sequence
  Synthetic oligonucleotide; TTG chr11 5289665 5289686 5289682 5289687 +
tctattttccctgaagttctca

SEQ ID NO: 94993 - DNA, 22 bp, Artificial Sequence
  Synthetic oligonucleotide; CTA chr11 5289669 5289690 5289686 5289691 +
ttttccctgaagttctcaaaga

SEQ ID NO: 94994 - DNA, 22 bp, Artificial Sequence
  Synthetic oligonucleotide; TTT chr11 5289672 5289693 5289689 5289694 +
tccctgaagttctcaaagaaat

SEQ ID NO: 94995 - DNA, 22 bp, Artificial Sequence
  Synthetic oligonucleotide; TTT chr11 5289673 5289694 5289690 5289695 +
ccctgaagttctcaaagaaatg

SEQ ID NO: 94996 - DNA, 22 bp, Artificial Sequence
  Synthetic oligonucleotide; TTC chr11 5289674 5289695 5289691 5289696 +
cctgaagttctcaaagaaatga

SEQ ID NO: 94997 - DNA, 22 bp, Artificial Sequence
  Synthetic oligonucleotide; CTG chr11 5289678 5289699 5289695 5289700 +
aagttctcaaagaaatgagacc

SEQ ID NO: 94998 - DNA, 22 bp, Artificial Sequence
  Synthetic oligonucleotide; TTC chr11 5289684 5289705 5289701 5289706 +
tcaaagaaatgagacccttgtt

SEQ ID NO: 94999 - DNA, 22 bp, Artificial Sequence
  Synthetic oligonucleotide; CTC chr11 5289686 5289707 5289703 5289708 +
aaagaaatgagacccttgttta

SEQ ID NO: 95000 - DNA, 22 bp, Artificial Sequence
  Synthetic oligonucleotide; CTT chr11 5289703 5289724 5289720 5289725 +
gtttacctttaagattagagaa

SEQ ID NO: 95001 - DNA, 22 bp, Artificial Sequence
  Synthetic oligonucleotide; TTG chr11 5289704 5289725 5289721 5289726 +
tttacctttaagattagagaag

SEQ ID NO: 95002 - DNA, 22 bp, Artificial Sequence
  Synthetic oligonucleotide; TTT chr11 5289707 5289728 5289724 5289729 +
acctttaagattagagaaggct

SEQ ID NO: 95003 - DNA, 22 bp, Artificial Sequence
  Synthetic oligonucleotide; TTA chr11 5289708 5289729 5289725 5289730 +
cctttaagattagagaaggctt

SEQ ID NO: 95004 - DNA, 22 bp, Artificial Sequence
  Synthetic oligonucleotide; CTT chr11 5289712 5289733 5289729 5289734 +
taagattagagaaggcttgaaa

SEQ ID NO: 95005 - DNA, 22 bp, Artificial Sequence
  Synthetic oligonucleotide; TTT chr11 5289713 5289734 5289730 5289735 +
aagattagagaaggcttgaaaa

SEQ ID NO: 95006 - DNA, 22 bp, Artificial Sequence
  Synthetic oligonucleotide; TTA chr11 5289714 5289735 5289731 5289736 +
agattagagaaggcttgaaaag

SEQ ID NO: 95007 - DNA, 22 bp, Artificial Sequence
  Synthetic oligonucleotide; TTA chr11 5289720 5289741 5289737 5289742 +
gagaaggcttgaaaagtttgag

SEQ ID NO: 95008 - DNA, 22 bp, Artificial Sequence
  Synthetic oligonucleotide; CTT chr11 5289730 5289751 5289747 5289752 +
gaaaagtttgagctgtgccttt

SEQ ID NO: 95009 - DNA, 22 bp, Artificial Sequence
  Synthetic oligonucleotide; TTG chr11 5289731 5289752 5289748 5289753 +
aaaagtttgagctgtgcctttg

SEQ ID NO: 95010 - DNA, 22 bp, Artificial Sequence
  Synthetic oligonucleotide; TTT chr11 5289739 5289760 5289756 5289761 +
gagctgtgcctttggaggccaa

SEQ ID NO: 95011 - DNA, 22 bp, Artificial Sequence
  Synthetic oligonucleotide; TTG chr11 5289740 5289761 5289757 5289762 +
agctgtgcctttggaggccaac

SEQ ID NO: 95012 - DNA, 22 bp, Artificial Sequence
  Synthetic oligonucleotide; CTG chr11 5289745 5289766 5289762 5289767 +
tgcctttggaggccaacaaact

SEQ ID NO: 95013 - DNA, 22 bp, Artificial Sequence
  Synthetic oligonucleotide; CTT chr11 5289751 5289772 5289768 5289773 +
tggaggccaacaaacttttctc

SEQ ID NO: 95014 - DNA, 22 bp, Artificial Sequence
  Synthetic oligonucleotide; TTT chr11 5289752 5289773 5289769 5289774 +
ggaggccaacaaacttttctcc

SEQ ID NO: 95015 - DNA, 22 bp, Artificial Sequence
  Synthetic oligonucleotide; TTG chr11 5289753 5289774 5289770 5289775 +
gaggccaacaaacttttctcct

SEQ ID NO: 95016 - DNA, 22 bp, Artificial Sequence
  Synthetic oligonucleotide; CTT chr11 5289768 5289789 5289785 5289790 +
ttctcctttgttgaccaagttc

SEQ ID NO: 95017 - DNA, 22 bp, Artificial Sequence
  Synthetic oligonucleotide; TTT chr11 5289769 5289790 5289786 5289791 +
tctcctttgttgaccaagttca

SEQ ID NO: 95018 - DNA, 22 bp, Artificial Sequence
  Synthetic oligonucleotide; TTT chr11 5289770 5289791 5289787 5289792 +
ctcctttgttgaccaagttcag

SEQ ID NO: 95019 - DNA, 22 bp, Artificial Sequence
  Synthetic oligonucleotide; TTC chr11 5289771 5289792 5289788 5289793 +
tcctttgttgaccaagttcagc

SEQ ID NO: 95020 - DNA, 22 bp, Artificial Sequence
  Synthetic oligonucleotide; CTC chr11 5289773 5289794 5289790 5289795 +
ctttgttgaccaagttcagctc

SEQ ID NO: 95021 - DNA, 22 bp, Artificial Sequence
  Synthetic oligonucleotide; CTT chr11 5289776 5289797 5289793 5289798 +
tgttgaccaagttcagctctcc

SEQ ID NO: 95022 - DNA, 22 bp, Artificial Sequence
  Synthetic oligonucleotide; TTT chr11 5289777 5289798 5289794 5289799 +
gttgaccaagttcagctctcct

SEQ ID NO: 95023 - DNA, 22 bp, Artificial Sequence
  Synthetic oligonucleotide; TTG chr11 5289778 5289799 5289795 5289800 +
ttgaccaagttcagctctcctg

SEQ ID NO: 95024 - DNA, 22 bp, Artificial Sequence
  Synthetic oligonucleotide; TTG chr11 5289781 5289802 5289798 5289803 +
accaagttcagctctcctgtat

SEQ ID NO: 95025 - DNA, 22 bp, Artificial Sequence
  Synthetic oligonucleotide; TTC chr11 5289790 5289811 5289807 5289812 +
agctctcctgtatgcttccaag

SEQ ID NO: 95026 - DNA, 22 bp, Artificial Sequence
  Synthetic oligonucleotide; CTC chr11 5289795 5289816 5289812 5289817 +
tcctgtatgcttccaaggtctg

SEQ ID NO: 95027 - DNA, 22 bp, Artificial Sequence
  Synthetic oligonucleotide; CTC chr11 5289797 5289818 5289814 5289819 +
ctgtatgcttccaaggtctgtt

SEQ ID NO: 95028 - DNA, 22 bp, Artificial Sequence
  Synthetic oligonucleotide; CTG chr11 5289800 5289821 5289817 5289822 +
tatgcttccaaggtctgttgca

SEQ ID NO: 95029 - DNA, 22 bp, Artificial Sequence
  Synthetic oligonucleotide; CTT chr11 5289807 5289828 5289824 5289829 +
ccaaggtctgttgcatcaagag

SEQ ID NO: 95030 - DNA, 22 bp, Artificial Sequence
  Synthetic oligonucleotide; TTC chr11 5289808 5289829 5289825 5289830 +
caaggtctgttgcatcaagagt

SEQ ID NO: 95031 - DNA, 22 bp, Artificial Sequence
  Synthetic oligonucleotide; CTG chr11 5289817 5289838 5289834 5289839 +
ttgcatcaagagtgagaattga

SEQ ID NO: 95032 - DNA, 22 bp, Artificial Sequence
  Synthetic oligonucleotide; TTG chr11 5289820 5289841 5289837 5289842 +
catcaagagtgagaattgaagg

SEQ ID NO: 95033 - DNA, 22 bp, Artificial Sequence
  Synthetic oligonucleotide; TTG chr11 5289838 5289859 5289855 5289860 +
aaggtcttagaagctgggatct

SEQ ID NO: 95034 - DNA, 22 bp, Artificial Sequence
  Synthetic oligonucleotide; CTT chr11 5289846 5289867 5289863 5289868 +
agaagctgggatctcagatgta

SEQ ID NO: 95035 - DNA, 22 bp, Artificial Sequence
  Synthetic oligonucleotide; TTA chr11 5289847 5289868 5289864 5289869 +
gaagctgggatctcagatgtag

SEQ ID NO: 95036 - DNA, 22 bp, Artificial Sequence
  Synthetic oligonucleotide; CTG chr11 5289854 5289875 5289871 5289876 +
ggatctcagatgtagggaaaag

SEQ ID NO: 95037 - DNA, 22 bp, Artificial Sequence
  Synthetic oligonucleotide; CTC chr11 5289861 5289882 5289878 5289883 +
agatgtagggaaaagaggagat

SEQ ID NO: 95038 - DNA, 22 bp, Artificial Sequence
  Synthetic oligonucleotide; TTT chr11 5289885 5289906 5289902 5289907 +
cctgttcactcactgttaagat

SEQ ID NO: 95039 - DNA, 22 bp, Artificial Sequence
  Synthetic oligonucleotide; TTC chr11 5289886 5289907 5289903 5289908 +
ctgttcactcactgttaagata

SEQ ID NO: 95040 - DNA, 22 bp, Artificial Sequence
  Synthetic oligonucleotide; CTG chr11 5289889 5289910 5289906 5289911 +
ttcactcactgttaagatatgg

SEQ ID NO: 95041 - DNA, 22 bp, Artificial Sequence
  Synthetic oligonucleotide; TTC chr11 5289892 5289913 5289909 5289914 +
actcactgttaagatatggctg

SEQ ID NO: 95042 - DNA, 22 bp, Artificial Sequence
  Synthetic oligonucleotide; CTC chr11 5289896 5289917 5289913 5289918 +
actgttaagatatggctgaaat

SEQ ID NO: 95043 - DNA, 22 bp, Artificial Sequence
  Synthetic oligonucleotide; CTG chr11 5289900 5289921 5289917 5289922 +
ttaagatatggctgaaattttt

SEQ ID NO: 95044 - DNA, 22 bp, Artificial Sequence
  Synthetic oligonucleotide; TTA chr11 5289903 5289924 5289920 5289925 +
agatatggctgaaattttttga

SEQ ID NO: 95045 - DNA, 22 bp, Artificial Sequence
  Synthetic oligonucleotide; CTG chr11 5289914 5289935 5289931 5289936 +
aaattttttgatctagtcatct

SEQ ID NO: 95046 - DNA, 22 bp, Artificial Sequence
  Synthetic oligonucleotide; TTT chr11 5289920 5289941 5289937 5289942 +
tttgatctagtcatctacaaag

SEQ ID NO: 95047 - DNA, 22 bp, Artificial Sequence
  Synthetic oligonucleotide; TTT chr11 5289921 5289942 5289938 5289943 +
ttgatctagtcatctacaaagc

SEQ ID NO: 95048 - DNA, 22 bp, Artificial Sequence
  Synthetic oligonucleotide; TTT chr11 5289922 5289943 5289939 5289944 +
tgatctagtcatctacaaagca

SEQ ID NO: 95049 - DNA, 22 bp, Artificial Sequence
  Synthetic oligonucleotide; TTT chr11 5289923 5289944 5289940 5289945 +
gatctagtcatctacaaagcat

SEQ ID NO: 95050 - DNA, 22 bp, Artificial Sequence
  Synthetic oligonucleotide; TTG chr11 5289924 5289945 5289941 5289946 +
atctagtcatctacaaagcatg

SEQ ID NO: 95051 - DNA, 22 bp, Artificial Sequence
  Synthetic oligonucleotide; CTA chr11 5289929 5289950 5289946 5289951 +
gtcatctacaaagcatgagttg

SEQ ID NO: 95052 - DNA, 22 bp, Artificial Sequence
  Synthetic oligonucleotide; CTA chr11 5289937 5289958 5289954 5289959 +
caaagcatgagttgtgggtcag

SEQ ID NO: 95053 - DNA, 22 bp, Artificial Sequence
  Synthetic oligonucleotide; TTG chr11 5289951 5289972 5289968 5289973 +
tgggtcagaaattgtttttcac

SEQ ID NO: 95054 - DNA, 22 bp, Artificial Sequence
  Synthetic oligonucleotide; TTG chr11 5289965 5289986 5289982 5289987 +
tttttcacatcttttgacttcc

SEQ ID NO: 95055 - DNA, 22 bp, Artificial Sequence
  Synthetic oligonucleotide; TTT chr11 5289968 5289989 5289985 5289990 +
ttcacatcttttgacttccttt

SEQ ID NO: 95056 - DNA, 22 bp, Artificial Sequence
  Synthetic oligonucleotide; TTT chr11 5289969 5289990 5289986 5289991 +
tcacatcttttgacttcctttg

SEQ ID NO: 95057 - DNA, 22 bp, Artificial Sequence
  Synthetic oligonucleotide; TTT chr11 5289970 5289991 5289987 5289992 +
cacatcttttgacttcctttga

SEQ ID NO: 95058 - DNA, 22 bp, Artificial Sequence
  Synthetic oligonucleotide; TTC chr11 5289971 5289992 5289988 5289993 +
acatcttttgacttcctttgac

SEQ ID NO: 95059 - DNA, 22 bp, Artificial Sequence
  Synthetic oligonucleotide; CTT chr11 5289978 5289999 5289995 5290000 +
ttgacttcctttgacatcagaa

SEQ ID NO: 95060 - DNA, 22 bp, Artificial Sequence
  Synthetic oligonucleotide; TTT chr11 5289979 5290000 5289996 5290001 +
tgacttcctttgacatcagaat

SEQ ID NO: 95061 - DNA, 22 bp, Artificial Sequence
  Synthetic oligonucleotide; TTT chr11 5289980 5290001 5289997 5290002 +
gacttcctttgacatcagaata

SEQ ID NO: 95062 - DNA, 22 bp, Artificial Sequence
  Synthetic oligonucleotide; TTG chr11 5289981 5290002 5289998 5290003 +
acttcctttgacatcagaatat

SEQ ID NO: 95063 - DNA, 22 bp, Artificial Sequence
  Synthetic oligonucleotide; CTT chr11 5289985 5290006 5290002 5290007 +
cctttgacatcagaatataacc

SEQ ID NO: 95064 - DNA, 22 bp, Artificial Sequence
  Synthetic oligonucleotide; TTC chr11 5289986 5290007 5290003 5290008 +
ctttgacatcagaatataacct

SEQ ID NO: 95065 - DNA, 22 bp, Artificial Sequence
  Synthetic oligonucleotide; CTT chr11 5289989 5290010 5290006 5290011 +
tgacatcagaatataacctagg

SEQ ID NO: 95066 - DNA, 22 bp, Artificial Sequence
  Synthetic oligonucleotide; TTT chr11 5289990 5290011 5290007 5290012 +
gacatcagaatataacctagga

SEQ ID NO: 95067 - DNA, 22 bp, Artificial Sequence
  Synthetic oligonucleotide; TTG chr11 5289991 5290012 5290008 5290013 +
acatcagaatataacctaggaa

SEQ ID NO: 95068 - DNA, 22 bp, Artificial Sequence
  Synthetic oligonucleotide; CTA chr11 5290009 5290030 5290026 5290031 +
ggaattgattacttaagtgaag

SEQ ID NO: 95069 - DNA, 22 bp, Artificial Sequence
  Synthetic oligonucleotide; TTG chr11 5290016 5290037 5290033 5290038 +
attacttaagtgaaggcaaggt

SEQ ID NO: 95070 - DNA, 22 bp, Artificial Sequence
  Synthetic oligonucleotide; TTA chr11 5290020 5290041 5290037 5290042 +
cttaagtgaaggcaaggtactt

SEQ ID NO: 95071 - DNA, 22 bp, Artificial Sequence
  Synthetic oligonucleotide; CTT chr11 5290023 5290044 5290040 5290045 +
aagtgaaggcaaggtactttgg

SEQ ID NO: 95072 - DNA, 22 bp, Artificial Sequence
  Synthetic oligonucleotide; TTA chr11 5290024 5290045 5290041 5290046 +
agtgaaggcaaggtactttggt

SEQ ID NO: 95073 - DNA, 22 bp, Artificial Sequence
  Synthetic oligonucleotide; CTT chr11 5290042 5290063 5290059 5290064 +
tggtctggacaggaacattttg

SEQ ID NO: 95074 - DNA, 22 bp, Artificial Sequence
  Synthetic oligonucleotide; TTT chr11 5290043 5290064 5290060 5290065 +
ggtctggacaggaacattttga

SEQ ID NO: 95075 - DNA, 22 bp, Artificial Sequence
  Synthetic oligonucleotide; TTG chr11 5290044 5290065 5290061 5290066 +
gtctggacaggaacattttgaa

SEQ ID NO: 95076 - DNA, 22 bp, Artificial Sequence
  Synthetic oligonucleotide; CTG chr11 5290049 5290070 5290066 5290071 +
gacaggaacattttgaacaagg

SEQ ID NO: 95077 - DNA, 22 bp, Artificial Sequence
  Synthetic oligonucleotide; TTT chr11 5290062 5290083 5290079 5290084 +
tgaacaaggtagggagacagct

SEQ ID NO: 95078 - DNA, 22 bp, Artificial Sequence
  Synthetic oligonucleotide; TTT chr11 5290063 5290084 5290080 5290085 +
gaacaaggtagggagacagcta

SEQ ID NO: 95079 - DNA, 22 bp, Artificial Sequence
  Synthetic oligonucleotide; TTG chr11 5290064 5290085 5290081 5290086 +
aacaaggtagggagacagctat

SEQ ID NO: 95080 - DNA, 22 bp, Artificial Sequence
  Synthetic oligonucleotide; CTA chr11 5290085 5290106 5290102 5290107 +
tgaaggcaagcatttattctat

SEQ ID NO: 95081 - DNA, 22 bp, Artificial Sequence
  Synthetic oligonucleotide; TTT chr11 5290100 5290121 5290117 5290122 +
attctatctatcatctatctgt

SEQ ID NO: 95082 - DNA, 22 bp, Artificial Sequence
  Synthetic oligonucleotide; TTA chr11 5290101 5290122 5290118 5290123 +
ttctatctatcatctatctgtc

SEQ ID NO: 95083 - DNA, 22 bp, Artificial Sequence
  Synthetic oligonucleotide; TTC chr11 5290104 5290125 5290121 5290126 +
tatctatcatctatctgtctat

SEQ ID NO: 95084 - DNA, 22 bp, Artificial Sequence
  Synthetic oligonucleotide; CTA chr11 5290106 5290127 5290123 5290128 +
tctatcatctatctgtctatct

SEQ ID NO: 95085 - DNA, 22 bp, Artificial Sequence
  Synthetic oligonucleotide; CTA chr11 5290110 5290131 5290127 5290132 +
tcatctatctgtctatctatct

SEQ ID NO: 95086 - DNA, 22 bp, Artificial Sequence
  Synthetic oligonucleotide; CTA chr11 5290117 5290138 5290134 5290139 +
tctgtctatctatctatctatt

SEQ ID NO: 95087 - DNA, 22 bp, Artificial Sequence
  Synthetic oligonucleotide; CTG chr11 5290121 5290142 5290138 5290143 +
tctatctatctatctattcttt

SEQ ID NO: 95088 - DNA, 22 bp, Artificial Sequence
  Synthetic oligonucleotide; CTA chr11 5290125 5290146 5290142 5290147 +
tctatctatctattctttcatc

SEQ ID NO: 95089 - DNA, 22 bp, Artificial Sequence
  Synthetic oligonucleotide; CTA chr11 5290129 5290150 5290146 5290151 +
tctatctattctttcatccact

SEQ ID NO: 95090 - DNA, 22 bp, Artificial Sequence
  Synthetic oligonucleotide; CTA chr11 5290133 5290154 5290150 5290155 +
tctattctttcatccacttatt

SEQ ID NO: 95091 - DNA, 22 bp, Artificial Sequence
  Synthetic oligonucleotide; CTA chr11 5290137 5290158 5290154 5290159 +
ttctttcatccacttatttata

SEQ ID NO: 95092 - DNA, 22 bp, Artificial Sequence
  Synthetic oligonucleotide; TTC chr11 5290140 5290161 5290157 5290162 +
tttcatccacttatttatacat

SEQ ID NO: 95093 - DNA, 22 bp, Artificial Sequence
  Synthetic oligonucleotide; CTT chr11 5290142 5290163 5290159 5290164 +
tcatccacttatttatacattt

SEQ ID NO: 95094 - DNA, 22 bp, Artificial Sequence
  Synthetic oligonucleotide; TTT chr11 5290143 5290164 5290160 5290165 +
catccacttatttatacattta

SEQ ID NO: 95095 - DNA, 22 bp, Artificial Sequence
  Synthetic oligonucleotide; TTC chr11 5290144 5290165 5290161 5290166 +
atccacttatttatacatttaa

SEQ ID NO: 95096 - DNA, 22 bp, Artificial Sequence
  Synthetic oligonucleotide; CTT chr11 5290152 5290173 5290169 5290174 +
atttatacatttaaacaaaaag

SEQ ID NO: 95097 - DNA, 22 bp, Artificial Sequence
  Synthetic oligonucleotide; TTA chr11 5290153 5290174 5290170 5290175 +
tttatacatttaaacaaaaagt

SEQ ID NO: 95098 - DNA, 22 bp, Artificial Sequence
  Synthetic oligonucleotide; TTT chr11 5290156 5290177 5290173 5290178 +
atacatttaaacaaaaagtata

SEQ ID NO: 95099 - DNA, 22 bp, Artificial Sequence
  Synthetic oligonucleotide; TTA chr11 5290157 5290178 5290174 5290179 +
tacatttaaacaaaaagtatag

SEQ ID NO: 95100 - DNA, 22 bp, Artificial Sequence
  Synthetic oligonucleotide; TTT chr11 5290164 5290185 5290181 5290186 +
aaacaaaaagtatagagcgtag

SEQ ID NO: 95101 - DNA, 22 bp, Artificial Sequence
  Synthetic oligonucleotide; TTA chr11 5290165 5290186 5290182 5290187 +
aacaaaaagtatagagcgtagt

SEQ ID NO: 95102 - DNA, 22 bp, Artificial Sequence
  Synthetic oligonucleotide; TTT chr11 5290194 5290215 5290211 5290216 +
gtaagtgctcagggctgtgtgt

SEQ ID NO: 95103 - DNA, 22 bp, Artificial Sequence
  Synthetic oligonucleotide; TTG chr11 5290195 5290216 5290212 5290217 +
taagtgctcagggctgtgtgtg

SEQ ID NO: 95104 - DNA, 22 bp, Artificial Sequence
  Synthetic oligonucleotide; CTC chr11 5290204 5290225 5290221 5290226 +
agggctgtgtgtgtatggattg

SEQ ID NO: 95105 - DNA, 22 bp, Artificial Sequence
  Synthetic oligonucleotide; CTG chr11 5290211 5290232 5290228 5290233 +
tgtgtgtatggattgtttgaaa

SEQ ID NO: 95106 - DNA, 22 bp, Artificial Sequence
  Synthetic oligonucleotide; TTG chr11 5290226 5290247 5290243 5290248 +
tttgaaatgaaactaaagtggg

SEQ ID NO: 95107 - DNA, 22 bp, Artificial Sequence
  Synthetic oligonucleotide; TTT chr11 5290229 5290250 5290246 5290251 +
gaaatgaaactaaagtgggagt

SEQ ID NO: 95108 - DNA, 22 bp, Artificial Sequence
  Synthetic oligonucleotide; TTG chr11 5290230 5290251 5290247 5290252 +
aaatgaaactaaagtgggagta

SEQ ID NO: 95109 - DNA, 22 bp, Artificial Sequence
  Synthetic oligonucleotide; CTA chr11 5290241 5290262 5290258 5290263 +
aagtgggagtataattctactg

SEQ ID NO: 95110 - DNA, 22 bp, Artificial Sequence
  Synthetic oligonucleotide; TTC chr11 5290258 5290279 5290275 5290280 +
tactgcccccttaaccctgtgg

SEQ ID NO: 95111 - DNA, 22 bp, Artificial Sequence
  Synthetic oligonucleotide; CTA chr11 5290260 5290281 5290277 5290282 +
ctgcccccttaaccctgtggtc

SEQ ID NO: 95112 - DNA, 22 bp, Artificial Sequence
  Synthetic oligonucleotide; CTG chr11 5290263 5290284 5290280 5290285 +
cccccttaaccctgtggtccct

SEQ ID NO: 95113 - DNA, 22 bp, Artificial Sequence
  Synthetic oligonucleotide; CTT chr11 5290270 5290291 5290287 5290292 +
aaccctgtggtccctacactac

SEQ ID NO: 95114 - DNA, 22 bp, Artificial Sequence
  Synthetic oligonucleotide; TTA chr11 5290271 5290292 5290288 5290293 +
accctgtggtccctacactacc

SEQ ID NO: 95115 - DNA, 22 bp, Artificial Sequence
  Synthetic oligonucleotide; CTG chr11 5290277 5290298 5290294 5290299 +
tggtccctacactaccctgcaa

SEQ ID NO: 95116 - DNA, 22 bp, Artificial Sequence
  Synthetic oligonucleotide; CTA chr11 5290286 5290307 5290303 5290308 +
cactaccctgcaagactcttag

SEQ ID NO: 95117 - DNA, 22 bp, Artificial Sequence
  Synthetic oligonucleotide; CTA chr11 5290291 5290312 5290308 5290313 +
ccctgcaagactcttagctgct

SEQ ID NO: 95118 - DNA, 22 bp, Artificial Sequence
  Synthetic oligonucleotide; CTG chr11 5290296 5290317 5290313 5290318 +
caagactcttagctgcttagct

SEQ ID NO: 95119 - DNA, 22 bp, Artificial Sequence
  Synthetic oligonucleotide; CTC chr11 5290304 5290325 5290321 5290326 +
ttagctgcttagcttaattgtg

SEQ ID NO: 95120 - DNA, 22 bp, Artificial Sequence
  Synthetic oligonucleotide; CTT chr11 5290306 5290327 5290323 5290328 +
agctgcttagcttaattgtgag

SEQ ID NO: 95121 - DNA, 22 bp, Artificial Sequence
  Synthetic oligonucleotide; TTA chr11 5290307 5290328 5290324 5290329 +
gctgcttagcttaattgtgagg

SEQ ID NO: 95122 - DNA, 22 bp, Artificial Sequence
  Synthetic oligonucleotide; CTG chr11 5290311 5290332 5290328 5290333 +
cttagcttaattgtgaggctga

SEQ ID NO: 95123 - DNA, 22 bp, Artificial Sequence
  Synthetic oligonucleotide; CTT chr11 5290314 5290335 5290331 5290336 +
agcttaattgtgaggctgattt

SEQ ID NO: 95124 - DNA, 22 bp, Artificial Sequence
  Synthetic oligonucleotide; TTA chr11 5290315 5290336 5290332 5290337 +
gcttaattgtgaggctgatttg

SEQ ID NO: 95125 - DNA, 22 bp, Artificial Sequence
  Synthetic oligonucleotide; CTT chr11 5290319 5290340 5290336 5290341 +
aattgtgaggctgatttggggc

SEQ ID NO: 95126 - DNA, 22 bp, Artificial Sequence
  Synthetic oligonucleotide; TTA chr11 5290320 5290341 5290337 5290342 +
attgtgaggctgatttggggca

SEQ ID NO: 95127 - DNA, 22 bp, Artificial Sequence
  Synthetic oligonucleotide; TTG chr11 5290324 5290345 5290341 5290346 +
tgaggctgatttggggcatagc

SEQ ID NO: 95128 - DNA, 22 bp, Artificial Sequence
  Synthetic oligonucleotide; CTG chr11 5290332 5290353 5290349 5290354 +
atttggggcatagcaccccatc

SEQ ID NO: 95129 - DNA, 22 bp, Artificial Sequence
  Synthetic oligonucleotide; TTT chr11 5290336 5290357 5290353 5290358 +
ggggcatagcaccccatcctct

SEQ ID NO: 95130 - DNA, 22 bp, Artificial Sequence
  Synthetic oligonucleotide; TTG chr11 5290337 5290358 5290354 5290359 +
gggcatagcaccccatcctctc

SEQ ID NO: 95131 - DNA, 22 bp, Artificial Sequence
  Synthetic oligonucleotide; CTC chr11 5290357 5290378 5290374 5290379 +
tctgtctttcaacatcctcata

SEQ ID NO: 95132 - DNA, 22 bp, Artificial Sequence
  Synthetic oligonucleotide; CTC chr11 5290359 5290380 5290376 5290381 +
tgtctttcaacatcctcataat

SEQ ID NO: 95133 - DNA, 22 bp, Artificial Sequence
  Synthetic oligonucleotide; CTG chr11 5290361 5290382 5290378 5290383 +
tctttcaacatcctcataataa

SEQ ID NO: 95134 - DNA, 22 bp, Artificial Sequence
  Synthetic oligonucleotide; CTT chr11 5290365 5290386 5290382 5290387 +
tcaacatcctcataataacttg

SEQ ID NO: 95135 - DNA, 22 bp, Artificial Sequence
  Synthetic oligonucleotide; TTT chr11 5290366 5290387 5290383 5290388 +
caacatcctcataataacttga

SEQ ID NO: 95136 - DNA, 22 bp, Artificial Sequence
  Synthetic oligonucleotide; TTC chr11 5290367 5290388 5290384 5290389 +
aacatcctcataataacttgag

SEQ ID NO: 95137 - DNA, 22 bp, Artificial Sequence
  Synthetic oligonucleotide; CTC chr11 5290376 5290397 5290393 5290398 +
ataataacttgagaataatttt

SEQ ID NO: 95138 - DNA, 22 bp, Artificial Sequence
  Synthetic oligonucleotide; CTT chr11 5290386 5290407 5290403 5290408 +
gagaataattttataaaatatc

SEQ ID NO: 95139 - DNA, 22 bp, Artificial Sequence
  Synthetic oligonucleotide; TTG chr11 5290387 5290408 5290404 5290409 +
agaataattttataaaatatca

SEQ ID NO: 95140 - DNA, 22 bp, Artificial Sequence
  Synthetic oligonucleotide; TTT chr11 5290397 5290418 5290414 5290419 +
tataaaatatcacaatagggtc

SEQ ID NO: 95141 - DNA, 22 bp, Artificial Sequence
  Synthetic oligonucleotide; TTT chr11 5290398 5290419 5290415 5290420 +
ataaaatatcacaatagggtca

SEQ ID NO: 95142 - DNA, 22 bp, Artificial Sequence
  Synthetic oligonucleotide; TTA chr11 5290399 5290420 5290416 5290421 +
taaaatatcacaatagggtcat

SEQ ID NO: 95143 - DNA, 22 bp, Artificial Sequence
  Synthetic oligonucleotide; TTC chr11 5290425 5290446 5290442 5290447 +
agtagggtgatatataaaatta

SEQ ID NO: 95144 - DNA, 22 bp, Artificial Sequence
  Synthetic oligonucleotide; TTA chr11 5290447 5290468 5290464 5290469 +
gacaagccatagtttgagttta

SEQ ID NO: 95145 - DNA, 22 bp, Artificial Sequence
  Synthetic oligonucleotide; TTT chr11 5290462 5290483 5290479 5290484 +
gagtttacccttttgaataaat

SEQ ID NO: 95146 - DNA, 22 bp, Artificial Sequence
  Synthetic oligonucleotide; TTG chr11 5290463 5290484 5290480 5290485 +
agtttacccttttgaataaata

SEQ ID NO: 95147 - DNA, 22 bp, Artificial Sequence
  Synthetic oligonucleotide; TTT chr11 5290468 5290489 5290485 5290490 +
acccttttgaataaatatatga

SEQ ID NO: 95148 - DNA, 22 bp, Artificial Sequence
  Synthetic oligonucleotide; TTA chr11 5290469 5290490 5290486 5290491 +
cccttttgaataaatatatgac

SEQ ID NO: 95149 - DNA, 22 bp, Artificial Sequence
  Synthetic oligonucleotide; CTT chr11 5290474 5290495 5290491 5290496 +
ttgaataaatatatgacaaaag

SEQ ID NO: 95150 - DNA, 22 bp, Artificial Sequence
  Synthetic oligonucleotide; TTT chr11 5290475 5290496 5290492 5290497 +
tgaataaatatatgacaaaagg

SEQ ID NO: 95151 - DNA, 22 bp, Artificial Sequence
  Synthetic oligonucleotide; TTT chr11 5290476 5290497 5290493 5290498 +
gaataaatatatgacaaaaggc

SEQ ID NO: 95152 - DNA, 22 bp, Artificial Sequence
  Synthetic oligonucleotide; TTG chr11 5290477 5290498 5290494 5290499 +
aataaatatatgacaaaaggca

SEQ ID NO: 95153 - DNA, 22 bp, Artificial Sequence
  Synthetic oligonucleotide; TTT chr11 5290503 5290524 5290520 5290525 +
aattatctttatgagtttggag

SEQ ID NO: 95154 - DNA, 22 bp, Artificial Sequence
  Synthetic oligonucleotide; TTA chr11 5290504 5290525 5290521 5290526 +
attatctttatgagtttggagg

SEQ ID NO: 95155 - DNA, 22 bp, Artificial Sequence
  Synthetic oligonucleotide; TTA chr11 5290508 5290529 5290525 5290530 +
tctttatgagtttggaggtatc

SEQ ID NO: 95156 - DNA, 22 bp, Artificial Sequence
  Synthetic oligonucleotide; CTT chr11 5290512 5290533 5290529 5290534 +
tatgagtttggaggtatccagt

SEQ ID NO: 95157 - DNA, 22 bp, Artificial Sequence
  Synthetic oligonucleotide; TTT chr11 5290513 5290534 5290530 5290535 +
atgagtttggaggtatccagta

SEQ ID NO: 95158 - DNA, 22 bp, Artificial Sequence
  Synthetic oligonucleotide; TTA chr11 5290514 5290535 5290531 5290536 +
tgagtttggaggtatccagtat

SEQ ID NO: 95159 - DNA, 22 bp, Artificial Sequence
  Synthetic oligonucleotide; TTT chr11 5290521 5290542 5290538 5290543 +
ggaggtatccagtatgaaattt

SEQ ID NO: 95160 - DNA, 22 bp, Artificial Sequence
  Synthetic oligonucleotide; TTG chr11 5290522 5290543 5290539 5290544 +
gaggtatccagtatgaaattta

SEQ ID NO: 95161 - DNA, 22 bp, Artificial Sequence
  Synthetic oligonucleotide; TTT chr11 5290543 5290564 5290560 5290565 +
agataatacctgccttctagtg

SEQ ID NO: 95162 - DNA, 22 bp, Artificial Sequence
  Synthetic oligonucleotide; TTA chr11 5290544 5290565 5290561 5290566 +
gataatacctgccttctagtgt

SEQ ID NO: 95163 - DNA, 22 bp, Artificial Sequence
  Synthetic oligonucleotide; CTG chr11 5290555 5290576 5290572 5290577 +
ccttctagtgttgaaattagaa

SEQ ID NO: 95164 - DNA, 22 bp, Artificial Sequence
  Synthetic oligonucleotide; CTT chr11 5290559 5290580 5290576 5290581 +
ctagtgttgaaattagaactta

SEQ ID NO: 95165 - DNA, 22 bp, Artificial Sequence
  Synthetic oligonucleotide; TTC chr11 5290560 5290581 5290577 5290582 +
tagtgttgaaattagaacttaa

SEQ ID NO: 95166 - DNA, 22 bp, Artificial Sequence
  Synthetic oligonucleotide; CTA chr11 5290562 5290583 5290579 5290584 +
gtgttgaaattagaacttaatg

SEQ ID NO: 95167 - DNA, 22 bp, Artificial Sequence
  Synthetic oligonucleotide; TTG chr11 5290568 5290589 5290585 5290590 +
aaattagaacttaatgatataa

SEQ ID NO: 95168 - DNA, 22 bp, Artificial Sequence
  Synthetic oligonucleotide; TTA chr11 5290574 5290595 5290591 5290596 +
gaacttaatgatataatgcatc

SEQ ID NO: 95169 - DNA, 22 bp, Artificial Sequence
  Synthetic oligonucleotide; CTT chr11 5290580 5290601 5290597 5290602 +
aatgatataatgcatcaatgaa

SEQ ID NO: 95170 - DNA, 22 bp, Artificial Sequence
  Synthetic oligonucleotide; TTA chr11 5290581 5290602 5290598 5290603 +
atgatataatgcatcaatgaac

SEQ ID NO: 95171 - DNA, 22 bp, Artificial Sequence
  Synthetic oligonucleotide; CTT chr11 5290605 5290626 5290622 5290627 +
attatagttcctagcacaaagt

SEQ ID NO: 95172 - DNA, 22 bp, Artificial Sequence
  Synthetic oligonucleotide; TTA chr11 5290606 5290627 5290623 5290628 +
ttatagttcctagcacaaagta

SEQ ID NO: 95173 - DNA, 22 bp, Artificial Sequence
  Synthetic oligonucleotide; TTA chr11 5290609 5290630 5290626 5290631 +
tagttcctagcacaaagtaaga

SEQ ID NO: 95174 - DNA, 22 bp, Artificial Sequence
  Synthetic oligonucleotide; TTC chr11 5290615 5290636 5290632 5290637 +
ctagcacaaagtaagaatcctt

SEQ ID NO: 95175 - DNA, 22 bp, Artificial Sequence
  Synthetic oligonucleotide; CTA chr11 5290618 5290639 5290635 5290640 +
gcacaaagtaagaatcctttca

SEQ ID NO: 95176 - DNA, 22 bp, Artificial Sequence
  Synthetic oligonucleotide; CTT chr11 5290637 5290658 5290654 5290659 +
tcaatgtgtgtgtgtgtgtatg

SEQ ID NO: 95177 - DNA, 22 bp, Artificial Sequence
  Synthetic oligonucleotide; TTT chr11 5290638 5290659 5290655 5290660 +
caatgtgtgtgtgtgtgtatgt

SEQ ID NO: 95178 - DNA, 22 bp, Artificial Sequence
  Synthetic oligonucleotide; TTC chr11 5290639 5290660 5290656 5290661 +
aatgtgtgtgtgtgtgtatgta

SEQ ID NO: 95179 - DNA, 22 bp, Artificial Sequence
  Synthetic oligonucleotide; TTT chr11 5290664 5290685 5290681 5290686 +
atctgttattaataggaatctt

SEQ ID NO: 95180 - DNA, 22 bp, Artificial Sequence
  Synthetic oligonucleotide; TTA chr11 5290665 5290686 5290682 5290687 +
tctgttattaataggaatctta

SEQ ID NO: 95181 - DNA, 22 bp, Artificial Sequence
  Synthetic oligonucleotide; CTG chr11 5290669 5290690 5290686 5290691 +
ttattaataggaatcttatggg

SEQ ID NO: 95182 - DNA, 22 bp, Artificial Sequence
  Synthetic oligonucleotide; TTA chr11 5290672 5290693 5290689 5290694 +
ttaataggaatcttatgggcat

SEQ ID NO: 95183 - DNA, 22 bp, Artificial Sequence
  Synthetic oligonucleotide; TTA chr11 5290675 5290696 5290692 5290697 +
ataggaatcttatgggcattat

SEQ ID NO: 95184 - DNA, 22 bp, Artificial Sequence
  Synthetic oligonucleotide; CTT chr11 5290686 5290707 5290703 5290708 +
atgggcattatctcacttaatc

SEQ ID NO: 95185 - DNA, 22 bp, Artificial Sequence
  Synthetic oligonucleotide; TTA chr11 5290687 5290708 5290704 5290709 +
tgggcattatctcacttaatcc

SEQ ID NO: 95186 - DNA, 22 bp, Artificial Sequence
  Synthetic oligonucleotide; TTA chr11 5290696 5290717 5290713 5290718 +
tctcacttaatccttattaata

SEQ ID NO: 95187 - DNA, 22 bp, Artificial Sequence
  Synthetic oligonucleotide; CTC chr11 5290700 5290721 5290717 5290722 +
acttaatccttattaataacta

SEQ ID NO: 95188 - DNA, 22 bp, Artificial Sequence
  Synthetic oligonucleotide; CTT chr11 5290704 5290725 5290721 5290726 +
aatccttattaataactatgaa

SEQ ID NO: 95189 - DNA, 22 bp, Artificial Sequence
  Synthetic oligonucleotide; TTA chr11 5290705 5290726 5290722 5290727 +
atccttattaataactatgaag

SEQ ID NO: 95190 - DNA, 22 bp, Artificial Sequence
  Synthetic oligonucleotide; CTT chr11 5290711 5290732 5290728 5290733 +
attaataactatgaagcaggta

SEQ ID NO: 95191 - DNA, 22 bp, Artificial Sequence
  Synthetic oligonucleotide; TTA chr11 5290712 5290733 5290729 5290734 +
ttaataactatgaagcaggtat

SEQ ID NO: 95192 - DNA, 22 bp, Artificial Sequence
  Synthetic oligonucleotide; TTA chr11 5290715 5290736 5290732 5290737 +
ataactatgaagcaggtattta

SEQ ID NO: 95193 - DNA, 22 bp, Artificial Sequence
  Synthetic oligonucleotide; CTA chr11 5290722 5290743 5290739 5290744 +
tgaagcaggtatttatttgagt

SEQ ID NO: 95194 - DNA, 22 bp, Artificial Sequence
  Synthetic oligonucleotide; TTT chr11 5290736 5290757 5290753 5290758 +
atttgagttttccaagtgagtt

SEQ ID NO: 95195 - DNA, 22 bp, Artificial Sequence
  Synthetic oligonucleotide; TTA chr11 5290737 5290758 5290754 5290759 +
tttgagttttccaagtgagtta

SEQ ID NO: 95196 - DNA, 22 bp, Artificial Sequence
  Synthetic oligonucleotide; TTT chr11 5290740 5290761 5290757 5290762 +
gagttttccaagtgagttaagt

SEQ ID NO: 95197 - DNA, 22 bp, Artificial Sequence
  Synthetic oligonucleotide; TTG chr11 5290741 5290762 5290758 5290763 +
agttttccaagtgagttaagta

SEQ ID NO: 95198 - DNA, 22 bp, Artificial Sequence
  Synthetic oligonucleotide; TTT chr11 5290746 5290767 5290763 5290768 +
tccaagtgagttaagtatagct

SEQ ID NO: 95199 - DNA, 22 bp, Artificial Sequence
  Synthetic oligonucleotide; TTT chr11 5290747 5290768 5290764 5290769 +
ccaagtgagttaagtatagctt

SEQ ID NO: 95200 - DNA, 22 bp, Artificial Sequence
  Synthetic oligonucleotide; TTC chr11 5290748 5290769 5290765 5290770 +
caagtgagttaagtatagcttg

SEQ ID NO: 95201 - DNA, 22 bp, Artificial Sequence
  Synthetic oligonucleotide; TTA chr11 5290759 5290780 5290776 5290781 +
agtatagcttgtaatacttaag

SEQ ID NO: 95202 - DNA, 22 bp, Artificial Sequence
  Synthetic oligonucleotide; CTT chr11 5290769 5290790 5290786 5290791 +
gtaatacttaaggaaatatcca

SEQ ID NO: 95203 - DNA, 22 bp, Artificial Sequence
  Synthetic oligonucleotide; TTG chr11 5290770 5290791 5290787 5290792 +
taatacttaaggaaatatccac

SEQ ID NO: 95204 - DNA, 22 bp, Artificial Sequence
  Synthetic oligonucleotide; CTT chr11 5290778 5290799 5290795 5290800 +
aaggaaatatccacaggttaca

SEQ ID NO: 95205 - DNA, 22 bp, Artificial Sequence
  Synthetic oligonucleotide; TTA chr11 5290779 5290800 5290796 5290801 +
aggaaatatccacaggttacat

SEQ ID NO: 95206 - DNA, 22 bp, Artificial Sequence
  Synthetic oligonucleotide; TTA chr11 5290798 5290819 5290815 5290820 +
catagctagtatataactgaga

SEQ ID NO: 95207 - DNA, 22 bp, Artificial Sequence
  Synthetic oligonucleotide; CTA chr11 5290806 5290827 5290823 5290828 +
gtatataactgagaaataattt

SEQ ID NO: 95208 - DNA, 22 bp, Artificial Sequence
  Synthetic oligonucleotide; CTG chr11 5290817 5290838 5290834 5290839 +
agaaataattttatttatatta

SEQ ID NO: 95209 - DNA, 22 bp, Artificial Sequence
  Synthetic oligonucleotide; TTT chr11 5290828 5290849 5290845 5290850 +
tatttatattataaaacattct

SEQ ID NO: 95210 - DNA, 22 bp, Artificial Sequence
  Synthetic oligonucleotide; TTT chr11 5290829 5290850 5290846 5290851 +
atttatattataaaacattcta

SEQ ID NO: 95211 - DNA, 22 bp, Artificial Sequence
  Synthetic oligonucleotide; TTA chr11 5290830 5290851 5290847 5290852 +
tttatattataaaacattctaa

SEQ ID NO: 95212 - DNA, 22 bp, Artificial Sequence
  Synthetic oligonucleotide; TTT chr11 5290833 5290854 5290850 5290855 +
atattataaaacattctaacaa

SEQ ID NO: 95213 - DNA, 22 bp, Artificial Sequence
  Synthetic oligonucleotide; TTA chr11 5290834 5290855 5290851 5290856 +
tattataaaacattctaacaat

SEQ ID NO: 95214 - DNA, 22 bp, Artificial Sequence
  Synthetic oligonucleotide; TTA chr11 5290839 5290860 5290856 5290861 +
taaaacattctaacaatacaga

SEQ ID NO: 95215 - DNA, 22 bp, Artificial Sequence
  Synthetic oligonucleotide; TTC chr11 5290849 5290870 5290866 5290871 +
taacaatacagatgtatataaa

SEQ ID NO: 95216 - DNA, 22 bp, Artificial Sequence
  Synthetic oligonucleotide; CTA chr11 5290851 5290872 5290868 5290873 +
acaatacagatgtatataaact

SEQ ID NO: 95217 - DNA, 22 bp, Artificial Sequence
  Synthetic oligonucleotide; CTA chr11 5290874 5290895 5290891 5290896 +
aaaaactgaaagggctcatgca

SEQ ID NO: 95218 - DNA, 22 bp, Artificial Sequence
  Synthetic oligonucleotide; CTG chr11 5290882 5290903 5290899 5290904 +
aaagggctcatgcaaccctacc

SEQ ID NO: 95219 - DNA, 22 bp, Artificial Sequence
  Synthetic oligonucleotide; CTC chr11 5290891 5290912 5290908 5290913 +
atgcaaccctaccttctcaata

SEQ ID NO: 95220 - DNA, 22 bp, Artificial Sequence
  Synthetic oligonucleotide; CTA chr11 5290902 5290923 5290919 5290924 +
ccttctcaatatcacttcttca

SEQ ID NO: 95221 - DNA, 22 bp, Artificial Sequence
  Synthetic oligonucleotide; CTT chr11 5290906 5290927 5290923 5290928 +
ctcaatatcacttcttcactta

SEQ ID NO: 95222 - DNA, 22 bp, Artificial Sequence
  Synthetic oligonucleotide; TTC chr11 5290907 5290928 5290924 5290929 +
tcaatatcacttcttcacttag

SEQ ID NO: 95223 - DNA, 22 bp, Artificial Sequence
  Synthetic oligonucleotide; CTC chr11 5290909 5290930 5290926 5290931 +
aatatcacttcttcacttagaa

SEQ ID NO: 95224 - DNA, 22 bp, Artificial Sequence
  Synthetic oligonucleotide; CTT chr11 5290919 5290940 5290936 5290941 +
cttcacttagaaaaaaccagcc

SEQ ID NO: 95225 - DNA, 22 bp, Artificial Sequence
  Synthetic oligonucleotide; TTC chr11 5290920 5290941 5290937 5290942 +
ttcacttagaaaaaaccagcct

SEQ ID NO: 95226 - DNA, 22 bp, Artificial Sequence
  Synthetic oligonucleotide; CTT chr11 5290922 5290943 5290939 5290944 +
cacttagaaaaaaccagcctta

SEQ ID NO: 95227 - DNA, 22 bp, Artificial Sequence
  Synthetic oligonucleotide; TTC chr11 5290923 5290944 5290940 5290945 +
acttagaaaaaaccagccttag

SEQ ID NO: 95228 - DNA, 22 bp, Artificial Sequence
  Synthetic oligonucleotide; CTT chr11 5290927 5290948 5290944 5290949 +
agaaaaaaccagccttagctgt

SEQ ID NO: 95229 - DNA, 22 bp, Artificial Sequence
  Synthetic oligonucleotide; TTA chr11 5290928 5290949 5290945 5290950 +
gaaaaaaccagccttagctgtc

SEQ ID NO: 95230 - DNA, 22 bp, Artificial Sequence
  Synthetic oligonucleotide; CTT chr11 5290943 5290964 5290960 5290965 +
agctgtctgctatgaatccttt

SEQ ID NO: 95231 - DNA, 22 bp, Artificial Sequence
  Synthetic oligonucleotide; TTA chr11 5290944 5290965 5290961 5290966 +
gctgtctgctatgaatcctttc

SEQ ID NO: 95232 - DNA, 22 bp, Artificial Sequence
  Synthetic oligonucleotide; CTG chr11 5290948 5290969 5290965 5290970 +
tctgctatgaatcctttcaaaa

SEQ ID NO: 95233 - DNA, 22 bp, Artificial Sequence
  Synthetic oligonucleotide; CTG chr11 5290952 5290973 5290969 5290974 +
ctatgaatcctttcaaaatata

SEQ ID NO: 95234 - DNA, 22 bp, Artificial Sequence
  Synthetic oligonucleotide; CTA chr11 5290955 5290976 5290972 5290977 +
tgaatcctttcaaaatatactt

SEQ ID NO: 95235 - DNA, 22 bp, Artificial Sequence
  Synthetic oligonucleotide; CTT chr11 5290964 5290985 5290981 5290986 +
tcaaaatatacttctgagaaat

SEQ ID NO: 95236 - DNA, 22 bp, Artificial Sequence
  Synthetic oligonucleotide; TTT chr11 5290965 5290986 5290982 5290987 +
caaaatatacttctgagaaatg

SEQ ID NO: 95237 - DNA, 22 bp, Artificial Sequence
  Synthetic oligonucleotide; TTC chr11 5290966 5290987 5290983 5290988 +
aaaatatacttctgagaaatga

SEQ ID NO: 95238 - DNA, 22 bp, Artificial Sequence
  Synthetic oligonucleotide; CTT chr11 5290977 5290998 5290994 5290999 +
ctgagaaatgagagagagaaat

SEQ ID NO: 95239 - DNA, 22 bp, Artificial Sequence
  Synthetic oligonucleotide; TTC chr11 5290978 5290999 5290995 5291000 +
tgagaaatgagagagagaaatg

SEQ ID NO: 95240 - DNA, 22 bp, Artificial Sequence
  Synthetic oligonucleotide; CTG chr11 5290980 5291001 5290997 5291002 +
agaaatgagagagagaaatggg

SEQ ID NO: 95241 - DNA, 22 bp, Artificial Sequence
  Synthetic oligonucleotide; TTA chr11 5291063 5291084 5291080 5291085 +
aattattcttttctctgtctct

SEQ ID NO: 95242 - DNA, 22 bp, Artificial Sequence
  Synthetic oligonucleotide; TTA chr11 5291068 5291089 5291085 5291090 +
ttcttttctctgtctcttgaaa

SEQ ID NO: 95243 - DNA, 22 bp, Artificial Sequence
  Synthetic oligonucleotide; TTC chr11 5291071 5291092 5291088 5291093 +
ttttctctgtctcttgaaagag

SEQ ID NO: 95244 - DNA, 22 bp, Artificial Sequence
  Synthetic oligonucleotide; CTT chr11 5291073 5291094 5291090 5291095 +
ttctctgtctcttgaaagagct

SEQ ID NO: 95245 - DNA, 22 bp, Artificial Sequence
  Synthetic oligonucleotide; TTT chr11 5291074 5291095 5291091 5291096 +
tctctgtctcttgaaagagctc

SEQ ID NO: 95246 - DNA, 22 bp, Artificial Sequence
  Synthetic oligonucleotide; TTT chr11 5291075 5291096 5291092 5291097 +
ctctgtctcttgaaagagctct

SEQ ID NO: 95247 - DNA, 22 bp, Artificial Sequence
  Synthetic oligonucleotide; TTC chr11 5291076 5291097 5291093 5291098 +
tctgtctcttgaaagagctctt

SEQ ID NO: 95248 - DNA, 22 bp, Artificial Sequence
  Synthetic oligonucleotide; CTC chr11 5291078 5291099 5291095 5291100 +
tgtctcttgaaagagctctttc

SEQ ID NO: 95249 - DNA, 22 bp, Artificial Sequence
  Synthetic oligonucleotide; CTG chr11 5291080 5291101 5291097 5291102 +
tctcttgaaagagctctttcca

SEQ ID NO: 95250 - DNA, 22 bp, Artificial Sequence
  Synthetic oligonucleotide; CTC chr11 5291084 5291105 5291101 5291106 +
ttgaaagagctctttccattac

SEQ ID NO: 95251 - DNA, 22 bp, Artificial Sequence
  Synthetic oligonucleotide; CTT chr11 5291086 5291107 5291103 5291108 +
gaaagagctctttccattacat

SEQ ID NO: 95252 - DNA, 22 bp, Artificial Sequence
  Synthetic oligonucleotide; TTG chr11 5291087 5291108 5291104 5291109 +
aaagagctctttccattacatt

SEQ ID NO: 95253 - DNA, 22 bp, Artificial Sequence
  Synthetic oligonucleotide; CTC chr11 5291096 5291117 5291113 5291118 +
tttccattacattgaatcaaag

SEQ ID NO: 95254 - DNA, 22 bp, Artificial Sequence
  Synthetic oligonucleotide; CTT chr11 5291098 5291119 5291115 5291120 +
tccattacattgaatcaaaggt

SEQ ID NO: 95255 - DNA, 22 bp, Artificial Sequence
  Synthetic oligonucleotide; TTT chr11 5291099 5291120 5291116 5291121 +
ccattacattgaatcaaaggta

SEQ ID NO: 95256 - DNA, 22 bp, Artificial Sequence
  Synthetic oligonucleotide; TTC chr11 5291100 5291121 5291117 5291122 +
cattacattgaatcaaaggtaa

SEQ ID NO: 95257 - DNA, 22 bp, Artificial Sequence
  Synthetic oligonucleotide; TTA chr11 5291105 5291126 5291122 5291127 +
cattgaatcaaaggtaatgttg

SEQ ID NO: 95258 - DNA, 22 bp, Artificial Sequence
  Synthetic oligonucleotide; TTG chr11 5291110 5291131 5291127 5291132 +
aatcaaaggtaatgttgccatt

SEQ ID NO: 95259 - DNA, 22 bp, Artificial Sequence
  Synthetic oligonucleotide; TTG chr11 5291127 5291148 5291144 5291149 +
ccatttctggactcttgaaata

SEQ ID NO: 95260 - DNA, 22 bp, Artificial Sequence
  Synthetic oligonucleotide; TTT chr11 5291133 5291154 5291150 5291155 +
ctggactcttgaaataaagaaa

SEQ ID NO: 95261 - DNA, 22 bp, Artificial Sequence
  Synthetic oligonucleotide; TTC chr11 5291134 5291155 5291151 5291156 +
tggactcttgaaataaagaaag

SEQ ID NO: 95262 - DNA, 22 bp, Artificial Sequence
  Synthetic oligonucleotide; CTG chr11 5291136 5291157 5291153 5291158 +
gactcttgaaataaagaaagac

SEQ ID NO: 95263 - DNA, 22 bp, Artificial Sequence
  Synthetic oligonucleotide; CTC chr11 5291141 5291162 5291158 5291163 +
ttgaaataaagaaagaccgatg

SEQ ID NO: 95264 - DNA, 22 bp, Artificial Sequence
  Synthetic oligonucleotide; CTT chr11 5291143 5291164 5291160 5291165 +
gaaataaagaaagaccgatgta

SEQ ID NO: 95265 - DNA, 22 bp, Artificial Sequence
  Synthetic oligonucleotide; TTG chr11 5291144 5291165 5291161 5291166 +
aaataaagaaagaccgatgtat

SEQ ID NO: 95266 - DNA, 22 bp, Artificial Sequence
  Synthetic oligonucleotide; TTT chr11 5291176 5291197 5291193 5291198 +
tgaaagtctatggcattttcaa

SEQ ID NO: 95267 - DNA, 22 bp, Artificial Sequence
  Synthetic oligonucleotide; TTT chr11 5291177 5291198 5291194 5291199 +
gaaagtctatggcattttcaaa

SEQ ID NO: 95268 - DNA, 22 bp, Artificial Sequence
  Synthetic oligonucleotide; TTG chr11 5291178 5291199 5291195 5291200 +
aaagtctatggcattttcaaaa

SEQ ID NO: 95269 - DNA, 22 bp, Artificial Sequence
  Synthetic oligonucleotide; CTA chr11 5291186 5291207 5291203 5291208 +
tggcattttcaaaatgcaaggt

SEQ ID NO: 95270 - DNA, 22 bp, Artificial Sequence
  Synthetic oligonucleotide; TTT chr11 5291194 5291215 5291211 5291216 +
tcaaaatgcaaggtgatgtctt

SEQ ID NO: 95271 - DNA, 22 bp, Artificial Sequence
  Synthetic oligonucleotide; TTT chr11 5291195 5291216 5291212 5291217 +
caaaatgcaaggtgatgtctta

SEQ ID NO: 95272 - DNA, 22 bp, Artificial Sequence
  Synthetic oligonucleotide; TTC chr11 5291196 5291217 5291213 5291218 +
aaaatgcaaggtgatgtcttac

SEQ ID NO: 95273 - DNA, 22 bp, Artificial Sequence
  Synthetic oligonucleotide; CTT chr11 5291216 5291237 5291233 5291238 +
actaactagcctttgctttatt

SEQ ID NO: 95274 - DNA, 22 bp, Artificial Sequence
  Synthetic oligonucleotide; TTA chr11 5291217 5291238 5291234 5291239 +
ctaactagcctttgctttatta

SEQ ID NO: 95275 - DNA, 22 bp, Artificial Sequence
  Synthetic oligonucleotide; CTA chr11 5291220 5291241 5291237 5291242 +
actagcctttgctttattatta

SEQ ID NO: 95276 - DNA, 22 bp, Artificial Sequence
  Synthetic oligonucleotide; CTA chr11 5291224 5291245 5291241 5291246 +
gcctttgctttattattagaaa

SEQ ID NO: 95277 - DNA, 22 bp, Artificial Sequence
  Synthetic oligonucleotide; CTT chr11 5291229 5291250 5291246 5291251 +
tgctttattattagaaatgggg

SEQ ID NO: 95278 - DNA, 22 bp, Artificial Sequence
  Synthetic oligonucleotide; TTT chr11 5291230 5291251 5291247 5291252 +
gctttattattagaaatgggga

SEQ ID NO: 95279 - DNA, 22 bp, Artificial Sequence
  Synthetic oligonucleotide; TTG chr11 5291231 5291252 5291248 5291253 +
ctttattattagaaatggggaa

SEQ ID NO: 95280 - DNA, 22 bp, Artificial Sequence
  Synthetic oligonucleotide; CTT chr11 5291234 5291255 5291251 5291256 +
tattattagaaatggggaagtg

SEQ ID NO: 95281 - DNA, 22 bp, Artificial Sequence
  Synthetic oligonucleotide; TTT chr11 5291235 5291256 5291252 5291257 +
attattagaaatggggaagtga

SEQ ID NO: 95282 - DNA, 22 bp, Artificial Sequence
  Synthetic oligonucleotide; TTA chr11 5291236 5291257 5291253 5291258 +
ttattagaaatggggaagtgag

SEQ ID NO: 95283 - DNA, 22 bp, Artificial Sequence
  Synthetic oligonucleotide; TTA chr11 5291239 5291260 5291256 5291261 +
ttagaaatggggaagtgagtat

SEQ ID NO: 95284 - DNA, 22 bp, Artificial Sequence
  Synthetic oligonucleotide; TTA chr11 5291242 5291263 5291259 5291264 +
gaaatggggaagtgagtataga

SEQ ID NO: 95285 - DNA, 22 bp, Artificial Sequence
  Synthetic oligonucleotide; TTT chr11 5291269 5291290 5291286 5291291 +
tatcaggagatatattaggaaa

SEQ ID NO: 95286 - DNA, 22 bp, Artificial Sequence
  Synthetic oligonucleotide; TTT chr11 5291270 5291291 5291287 5291292 +
atcaggagatatattaggaaaa

SEQ ID NO: 95287 - DNA, 22 bp, Artificial Sequence
  Synthetic oligonucleotide; TTA chr11 5291271 5291292 5291288 5291293 +
tcaggagatatattaggaaaaa

SEQ ID NO: 95288 - DNA, 22 bp, Artificial Sequence
  Synthetic oligonucleotide; TTA chr11 5291286 5291307 5291303 5291308 +
ggaaaaagggaaactggagaaa

SEQ ID NO: 95289 - DNA, 22 bp, Artificial Sequence
  Synthetic oligonucleotide; CTG chr11 5291302 5291323 5291319 5291324 +
gagaaactgggaggagtatcca

SEQ ID NO: 95290 - DNA, 22 bp, Artificial Sequence
  Synthetic oligonucleotide; CTG chr11 5291311 5291332 5291328 5291333 +
ggaggagtatccagatgtcctg

SEQ ID NO: 95291 - DNA, 22 bp, Artificial Sequence
  Synthetic oligonucleotide; CTG chr11 5291333 5291354 5291350 5291355 +
tccctgtaaggtgggggcaccc

SEQ ID NO: 95292 - DNA, 22 bp, Artificial Sequence
  Synthetic oligonucleotide; CTG chr11 5291339 5291360 5291356 5291361 +
taaggtgggggcacccaccttc

SEQ ID NO: 95293 - DNA, 22 bp, Artificial Sequence
  Synthetic oligonucleotide; CTT chr11 5291360 5291381 5291377 5291382 +
caatcaaaagggctccttaaca

SEQ ID NO: 95294 - DNA, 22 bp, Artificial Sequence
  Synthetic oligonucleotide; TTC chr11 5291361 5291382 5291378 5291383 +
aatcaaaagggctccttaacaa

SEQ ID NO: 95295 - DNA, 22 bp, Artificial Sequence
  Synthetic oligonucleotide; CTC chr11 5291375 5291396 5291392 5291397 +
cttaacaacttccttgcttggg

SEQ ID NO: 95296 - DNA, 22 bp, Artificial Sequence
  Synthetic oligonucleotide; CTT chr11 5291378 5291399 5291395 5291400 +
aacaacttccttgcttggggct

SEQ ID NO: 95297 - DNA, 22 bp, Artificial Sequence
  Synthetic oligonucleotide; TTA chr11 5291379 5291400 5291396 5291401 +
acaacttccttgcttggggctc

SEQ ID NO: 95298 - DNA, 22 bp, Artificial Sequence
  Synthetic oligonucleotide; CTT chr11 5291386 5291407 5291403 5291408 +
ccttgcttggggctccaccatc

SEQ ID NO: 95299 - DNA, 22 bp, Artificial Sequence
  Synthetic oligonucleotide; TTC chr11 5291387 5291408 5291404 5291409 +
cttgcttggggctccaccatct

SEQ ID NO: 95300 - DNA, 22 bp, Artificial Sequence
  Synthetic oligonucleotide; CTT chr11 5291390 5291411 5291407 5291412 +
gcttggggctccaccatcttgg

SEQ ID NO: 95301 - DNA, 22 bp, Artificial Sequence
  Synthetic oligonucleotide; TTG chr11 5291391 5291412 5291408 5291413 +
cttggggctccaccatcttgga

SEQ ID NO: 95302 - DNA, 22 bp, Artificial Sequence
  Synthetic oligonucleotide; CTT chr11 5291394 5291415 5291411 5291416 +
ggggctccaccatcttggacca

SEQ ID NO: 95303 - DNA, 22 bp, Artificial Sequence
  Synthetic oligonucleotide; TTG chr11 5291395 5291416 5291412 5291417 +
gggctccaccatcttggaccat

SEQ ID NO: 95304 - DNA, 22 bp, Artificial Sequence
  Synthetic oligonucleotide; CTC chr11 5291401 5291422 5291418 5291423 +
caccatcttggaccattagctc

SEQ ID NO: 95305 - DNA, 22 bp, Artificial Sequence
  Synthetic oligonucleotide; CTT chr11 5291410 5291431 5291427 5291432 +
ggaccattagctccacaggtat

SEQ ID NO: 95306 - DNA, 22 bp, Artificial Sequence
  Synthetic oligonucleotide; TTG chr11 5291411 5291432 5291428 5291433 +
gaccattagctccacaggtatc

SEQ ID NO: 95307 - DNA, 22 bp, Artificial Sequence
  Synthetic oligonucleotide; TTA chr11 5291419 5291440 5291436 5291441 +
gctccacaggtatcttcttccc

SEQ ID NO: 95308 - DNA, 22 bp, Artificial Sequence
  Synthetic oligonucleotide; CTC chr11 5291423 5291444 5291440 5291445 +
cacaggtatcttcttccctcta

SEQ ID NO: 95309 - DNA, 22 bp, Artificial Sequence
  Synthetic oligonucleotide; CTT chr11 5291435 5291456 5291452 5291457 +
cttccctctagtggtcataaca

SEQ ID NO: 95310 - DNA, 22 bp, Artificial Sequence
  Synthetic oligonucleotide; TTC chr11 5291436 5291457 5291453 5291458 +
ttccctctagtggtcataacag

SEQ ID NO: 95311 - DNA, 22 bp, Artificial Sequence
  Synthetic oligonucleotide; CTT chr11 5291438 5291459 5291455 5291460 +
ccctctagtggtcataacagca

SEQ ID NO: 95312 - DNA, 22 bp, Artificial Sequence
  Synthetic oligonucleotide; TTC chr11 5291439 5291460 5291456 5291461 +
cctctagtggtcataacagcag

SEQ ID NO: 95313 - DNA, 22 bp, Artificial Sequence
  Synthetic oligonucleotide; CTC chr11 5291443 5291464 5291460 5291465 +
tagtggtcataacagcagcttc

SEQ ID NO: 95314 - DNA, 22 bp, Artificial Sequence
  Synthetic oligonucleotide; CTA chr11 5291445 5291466 5291462 5291467 +
gtggtcataacagcagcttcag

SEQ ID NO: 95315 - DNA, 22 bp, Artificial Sequence
  Synthetic oligonucleotide; CTT chr11 5291464 5291485 5291481 5291486 +
cagctacctctctaaagagtcc

SEQ ID NO: 95316 - DNA, 22 bp, Artificial Sequence
  Synthetic oligonucleotide; TTC chr11 5291465 5291486 5291482 5291487 +
agctacctctctaaagagtcct

SEQ ID NO: 95317 - DNA, 22 bp, Artificial Sequence
  Synthetic oligonucleotide; CTA chr11 5291470 5291491 5291487 5291492 +
cctctctaaagagtcctgccag

SEQ ID NO: 95318 - DNA, 22 bp, Artificial Sequence
  Synthetic oligonucleotide; CTC chr11 5291474 5291495 5291491 5291496 +
tctaaagagtcctgccagatat

SEQ ID NO: 95319 - DNA, 22 bp, Artificial Sequence
  Synthetic oligonucleotide; CTC chr11 5291476 5291497 5291493 5291498 +
taaagagtcctgccagatatag

SEQ ID NO: 95320 - DNA, 22 bp, Artificial Sequence
  Synthetic oligonucleotide; CTA chr11 5291478 5291499 5291495 5291500 +
aagagtcctgccagatataggt

SEQ ID NO: 95321 - DNA, 22 bp, Artificial Sequence
  Synthetic oligonucleotide; CTG chr11 5291488 5291509 5291505 5291510 +
ccagatataggtcaggaaatat

SEQ ID NO: 95322 - DNA, 22 bp, Artificial Sequence
  Synthetic oligonucleotide; CTA chr11 5291519 5291540 5291536 5291541 +
ataaaaagagaaacattttgac

SEQ ID NO: 95323 - DNA, 22 bp, Artificial Sequence
  Synthetic oligonucleotide; TTT chr11 5291537 5291558 5291554 5291559 +
tgactgtagttgtttgtttttt

SEQ ID NO: 95324 - DNA, 22 bp, Artificial Sequence
  Synthetic oligonucleotide; TTT chr11 5291538 5291559 5291555 5291560 +
gactgtagttgtttgttttttg

SEQ ID NO: 95325 - DNA, 22 bp, Artificial Sequence
  Synthetic oligonucleotide; TTG chr11 5291539 5291560 5291556 5291561 +
actgtagttgtttgttttttgt

SEQ ID NO: 95326 - DNA, 22 bp, Artificial Sequence
  Synthetic oligonucleotide; CTG chr11 5291543 5291564 5291560 5291565 +
tagttgtttgttttttgtcatt

SEQ ID NO: 95327 - DNA, 22 bp, Artificial Sequence
  Synthetic oligonucleotide; TTG chr11 5291549 5291570 5291566 5291571 +
tttgttttttgtcattgtgact

SEQ ID NO: 95328 - DNA, 22 bp, Artificial Sequence
  Synthetic oligonucleotide; TTT chr11 5291552 5291573 5291569 5291574 +
gttttttgtcattgtgactatc

SEQ ID NO: 95329 - DNA, 22 bp, Artificial Sequence
  Synthetic oligonucleotide; TTG chr11 5291553 5291574 5291570 5291575 +
ttttttgtcattgtgactatca

SEQ ID NO: 95330 - DNA, 22 bp, Artificial Sequence
  Synthetic oligonucleotide; TTT chr11 5291556 5291577 5291573 5291578 +
tttgtcattgtgactatcaata

SEQ ID NO: 95331 - DNA, 22 bp, Artificial Sequence
  Synthetic oligonucleotide; TTT chr11 5291557 5291578 5291574 5291579 +
ttgtcattgtgactatcaataa

SEQ ID NO: 95332 - DNA, 22 bp, Artificial Sequence
  Synthetic oligonucleotide; TTT chr11 5291558 5291579 5291575 5291580 +
tgtcattgtgactatcaataac

SEQ ID NO: 95333 - DNA, 22 bp, Artificial Sequence
  Synthetic oligonucleotide; TTT chr11 5291559 5291580 5291576 5291581 +
gtcattgtgactatcaataaca

SEQ ID NO: 95334 - DNA, 22 bp, Artificial Sequence
  Synthetic oligonucleotide; TTG chr11 5291560 5291581 5291577 5291582 +
tcattgtgactatcaataacat

SEQ ID NO: 95335 - DNA, 22 bp, Artificial Sequence
  Synthetic oligonucleotide; TTG chr11 5291566 5291587 5291583 5291588 +
tgactatcaataacattctcac

SEQ ID NO: 95336 - DNA, 22 bp, Artificial Sequence
  Synthetic oligonucleotide; CTA chr11 5291572 5291593 5291589 5291594 +
tcaataacattctcactctttc

SEQ ID NO: 95337 - DNA, 22 bp, Artificial Sequence
  Synthetic oligonucleotide; TTC chr11 5291584 5291605 5291601 5291606 +
tcactctttcatcagtaatcac

SEQ ID NO: 95338 - DNA, 22 bp, Artificial Sequence
  Synthetic oligonucleotide; CTC chr11 5291586 5291607 5291603 5291608 +
actctttcatcagtaatcactc

SEQ ID NO: 95339 - DNA, 22 bp, Artificial Sequence
  Synthetic oligonucleotide; CTC chr11 5291590 5291611 5291607 5291612 +
tttcatcagtaatcactcaggt

SEQ ID NO: 95340 - DNA, 22 bp, Artificial Sequence
  Synthetic oligonucleotide; CTT chr11 5291592 5291613 5291609 5291614 +
tcatcagtaatcactcaggtta

SEQ ID NO: 95341 - DNA, 22 bp, Artificial Sequence
  Synthetic oligonucleotide; TTT chr11 5291593 5291614 5291610 5291615 +
catcagtaatcactcaggttat

SEQ ID NO: 95342 - DNA, 22 bp, Artificial Sequence
  Synthetic oligonucleotide; TTC chr11 5291594 5291615 5291611 5291616 +
atcagtaatcactcaggttatt

SEQ ID NO: 95343 - DNA, 22 bp, Artificial Sequence
  Synthetic oligonucleotide; CTC chr11 5291608 5291629 5291625 5291630 +
aggttattctgtgaccaacaga

SEQ ID NO: 95344 - DNA, 22 bp, Artificial Sequence
  Synthetic oligonucleotide; TTA chr11 5291614 5291635 5291631 5291636 +
ttctgtgaccaacagactgtgg

SEQ ID NO: 95345 - DNA, 22 bp, Artificial Sequence
  Synthetic oligonucleotide; TTC chr11 5291617 5291638 5291634 5291639 +
tgtgaccaacagactgtgggaa

SEQ ID NO: 95346 - DNA, 22 bp, Artificial Sequence
  Synthetic oligonucleotide; CTG chr11 5291619 5291640 5291636 5291641 +
tgaccaacagactgtgggaaaa

SEQ ID NO: 95347 - DNA, 22 bp, Artificial Sequence
  Synthetic oligonucleotide; CTG chr11 5291633 5291654 5291650 5291655 +
tgggaaaaatcagagaaggagg

SEQ ID NO: 95348 - DNA, 22 bp, Artificial Sequence
  Synthetic oligonucleotide; CTC chr11 5291662 5291683 5291679 5291684 +
atgcttactagcctaaactgaa

SEQ ID NO: 95349 - DNA, 22 bp, Artificial Sequence
  Synthetic oligonucleotide; CTT chr11 5291668 5291689 5291685 5291690 +
actagcctaaactgaaattgct

SEQ ID NO: 95350 - DNA, 22 bp, Artificial Sequence
  Synthetic oligonucleotide; TTA chr11 5291669 5291690 5291686 5291691 +
ctagcctaaactgaaattgcta

SEQ ID NO: 95351 - DNA, 22 bp, Artificial Sequence
  Synthetic oligonucleotide; CTA chr11 5291672 5291693 5291689 5291694 +
gcctaaactgaaattgctatag

SEQ ID NO: 95352 - DNA, 22 bp, Artificial Sequence
  Synthetic oligonucleotide; CTA chr11 5291677 5291698 5291694 5291699 +
aactgaaattgctatagcagag

SEQ ID NO: 95353 - DNA, 22 bp, Artificial Sequence
  Synthetic oligonucleotide; CTG chr11 5291682 5291703 5291699 5291704 +
aaattgctatagcagagtgaac

SEQ ID NO: 95354 - DNA, 22 bp, Artificial Sequence
  Synthetic oligonucleotide; TTG chr11 5291688 5291709 5291705 5291710 +
ctatagcagagtgaaccagaag

SEQ ID NO: 95355 - DNA, 22 bp, Artificial Sequence
  Synthetic oligonucleotide; CTA chr11 5291691 5291712 5291708 5291713 +
tagcagagtgaaccagaaggtt

SEQ ID NO: 95356 - DNA, 22 bp, Artificial Sequence
  Synthetic oligonucleotide; TTT chr11 5291714 5291735 5291731 5291736 +
acagatattttccacaaagagt

SEQ ID NO: 95357 - DNA, 22 bp, Artificial Sequence
  Synthetic oligonucleotide; TTA chr11 5291715 5291736 5291732 5291737 +
cagatattttccacaaagagta

SEQ ID NO: 95358 - DNA, 22 bp, Artificial Sequence
  Synthetic oligonucleotide; TTT chr11 5291724 5291745 5291741 5291746 +
tccacaaagagtaaaaggattg

SEQ ID NO: 95359 - DNA, 22 bp, Artificial Sequence
  Synthetic oligonucleotide; TTT chr11 5291725 5291746 5291742 5291747 +
ccacaaagagtaaaaggattga

SEQ ID NO: 95360 - DNA, 22 bp, Artificial Sequence
  Synthetic oligonucleotide; TTC chr11 5291726 5291747 5291743 5291748 +
cacaaagagtaaaaggattgaa

SEQ ID NO: 95361 - DNA, 22 bp, Artificial Sequence
  Synthetic oligonucleotide; TTG chr11 5291746 5291767 5291763 5291768 +
aagccttctccagatcaatgca

SEQ ID NO: 95362 - DNA, 22 bp, Artificial Sequence
  Synthetic oligonucleotide; CTT chr11 5291753 5291774 5291770 5291775 +
ctccagatcaatgcataggaaa

SEQ ID NO: 95363 - DNA, 22 bp, Artificial Sequence
  Synthetic oligonucleotide; TTC chr11 5291754 5291775 5291771 5291776 +
tccagatcaatgcataggaaat

SEQ ID NO: 95364 - DNA, 22 bp, Artificial Sequence
  Synthetic oligonucleotide; CTC chr11 5291756 5291777 5291773 5291778 +
cagatcaatgcataggaaataa

SEQ ID NO: 95365 - DNA, 22 bp, Artificial Sequence
  Synthetic oligonucleotide; TTA chr11 5291802 5291823 5291819 5291824 +
tgacgaacaacattaggataag

SEQ ID NO: 95366 - DNA, 22 bp, Artificial Sequence
  Synthetic oligonucleotide; TTA chr11 5291817 5291838 5291834 5291839 +
ggataagtccatatcaattttt

SEQ ID NO: 95367 - DNA, 22 bp, Artificial Sequence
  Synthetic oligonucleotide; TTT chr11 5291837 5291858 5291854 5291859 +
ttaatccagtcataagcacaga

SEQ ID NO: 95368 - DNA, 22 bp, Artificial Sequence
  Synthetic oligonucleotide; TTT chr11 5291838 5291859 5291855 5291860 +
taatccagtcataagcacagac

SEQ ID NO: 95369 - DNA, 22 bp, Artificial Sequence
  Synthetic oligonucleotide; TTT chr11 5291839 5291860 5291856 5291861 +
aatccagtcataagcacagact

SEQ ID NO: 95370 - DNA, 22 bp, Artificial Sequence
  Synthetic oligonucleotide; TTA chr11 5291840 5291861 5291857 5291862 +
atccagtcataagcacagacta

SEQ ID NO: 95371 - DNA, 22 bp, Artificial Sequence
  Synthetic oligonucleotide; CTA chr11 5291862 5291883 5291879 5291884 +
cgtgaagcacgtccaagtgaag

SEQ ID NO: 95372 - DNA, 22 bp, Artificial Sequence
  Synthetic oligonucleotide; TTT chr11 5291922 5291943 5291939 5291944 +
gatcaagaatagcagaaaaagg

SEQ ID NO: 95373 - DNA, 22 bp, Artificial Sequence
  Synthetic oligonucleotide; TTG chr11 5291923 5291944 5291940 5291945 +
atcaagaatagcagaaaaagga

SEQ ID NO: 95374 - DNA, 22 bp, Artificial Sequence
  Synthetic oligonucleotide; TTA chr11 5291961 5291982 5291978 5291983 +
acaaatgattgtcatgccaaca

SEQ ID NO: 95375 - DNA, 22 bp, Artificial Sequence
  Synthetic oligonucleotide; TTG chr11 5291972 5291993 5291989 5291994 +
tcatgccaacagtacagataac

SEQ ID NO: 95376 - DNA, 22 bp, Artificial Sequence
  Synthetic oligonucleotide; CTC chr11 5291996 5292017 5292013 5292018 +
tgctaataaaggtagaggcata

SEQ ID NO: 95377 - DNA, 22 bp, Artificial Sequence
  Synthetic oligonucleotide; CTG chr11 5291998 5292019 5292015 5292020 +
ctaataaaggtagaggcataat

SEQ ID NO: 95378 - DNA, 22 bp, Artificial Sequence
  Synthetic oligonucleotide; CTA chr11 5292001 5292022 5292018 5292023 +
ataaaggtagaggcataataca

SEQ ID NO: 95379 - DNA, 22 bp, Artificial Sequence
  Synthetic oligonucleotide; CTA chr11 5292041 5292062 5292058 5292063 +
catagtagttaaaggacatggc

SEQ ID NO: 95380 - DNA, 22 bp, Artificial Sequence
  Synthetic oligonucleotide; TTA chr11 5292052 5292073 5292069 5292074 +
aaggacatggccatcagtacag

SEQ ID NO: 95381 - DNA, 22 bp, Artificial Sequence
  Synthetic oligonucleotide; TTC chr11 5292081 5292102 5292098 5292103 +
cataaaggagaacctaaagagg

SEQ ID NO: 95382 - DNA, 22 bp, Artificial Sequence
  Synthetic oligonucleotide; CTA chr11 5292097 5292118 5292114 5292119 +
aagaggaagaataatttgtcag

SEQ ID NO: 95383 - DNA, 22 bp, Artificial Sequence
  Synthetic oligonucleotide; TTT chr11 5292114 5292135 5292131 5292136 +
gtcagaagcttaaaagctgaac

SEQ ID NO: 95384 - DNA, 22 bp, Artificial Sequence
  Synthetic oligonucleotide; TTG chr11 5292115 5292136 5292132 5292137 +
tcagaagcttaaaagctgaact

SEQ ID NO: 95385 - DNA, 22 bp, Artificial Sequence
  Synthetic oligonucleotide; CTT chr11 5292125 5292146 5292142 5292147 +
aaaagctgaactctgaggcatt

SEQ ID NO: 95386 - DNA, 22 bp, Artificial Sequence
  Synthetic oligonucleotide; TTA chr11 5292126 5292147 5292143 5292148 +
aaagctgaactctgaggcatta

SEQ ID NO: 95387 - DNA, 22 bp, Artificial Sequence
  Synthetic oligonucleotide; CTG chr11 5292133 5292154 5292150 5292155 +
aactctgaggcattaaactaca

SEQ ID NO: 95388 - DNA, 22 bp, Artificial Sequence
  Synthetic oligonucleotide; CTC chr11 5292138 5292159 5292155 5292160 +
tgaggcattaaactacaatatc

SEQ ID NO: 95389 - DNA, 22 bp, Artificial Sequence
  Synthetic oligonucleotide; CTG chr11 5292140 5292161 5292157 5292162 +
aggcattaaactacaatatcct

SEQ ID NO: 95390 - DNA, 22 bp, Artificial Sequence
  Synthetic oligonucleotide; TTA chr11 5292148 5292169 5292165 5292170 +
aactacaatatccttttgactg

SEQ ID NO: 95391 - DNA, 22 bp, Artificial Sequence
  Synthetic oligonucleotide; CTA chr11 5292153 5292174 5292170 5292175 +
caatatccttttgactgtggaa

SEQ ID NO: 95392 - DNA, 22 bp, Artificial Sequence
  Synthetic oligonucleotide; CTT chr11 5292163 5292184 5292180 5292185 +
ttgactgtggaaagggtggtga

SEQ ID NO: 95393 - DNA, 22 bp, Artificial Sequence
  Synthetic oligonucleotide; TTT chr11 5292164 5292185 5292181 5292186 +
tgactgtggaaagggtggtgaa

SEQ ID NO: 95394 - DNA, 22 bp, Artificial Sequence
  Synthetic oligonucleotide; TTT chr11 5292165 5292186 5292182 5292187 +
gactgtggaaagggtggtgaaa

SEQ ID NO: 95395 - DNA, 22 bp, Artificial Sequence
  Synthetic oligonucleotide; TTG chr11 5292166 5292187 5292183 5292188 +
actgtggaaagggtggtgaaag

SEQ ID NO: 95396 - DNA, 22 bp, Artificial Sequence
  Synthetic oligonucleotide; CTG chr11 5292170 5292191 5292187 5292192 +
tggaaagggtggtgaaaggaaa

SEQ ID NO: 95397 - DNA, 22 bp, Artificial Sequence
  Synthetic oligonucleotide; TTC chr11 5292196 5292217 5292213 5292218 +
aaggacatttgagccaacatag

SEQ ID NO: 95398 - DNA, 22 bp, Artificial Sequence
  Synthetic oligonucleotide; TTT chr11 5292206 5292227 5292223 5292228 +
gagccaacatagagaggaacat

SEQ ID NO: 95399 - DNA, 22 bp, Artificial Sequence
  Synthetic oligonucleotide; TTG chr11 5292207 5292228 5292224 5292229 +
agccaacatagagaggaacatt

SEQ ID NO: 95400 - DNA, 22 bp, Artificial Sequence
  Synthetic oligonucleotide; TTG chr11 5292230 5292251 5292247 5292252 +
gcttggtgagggatatctgtcc

SEQ ID NO: 95401 - DNA, 22 bp, Artificial Sequence
  Synthetic oligonucleotide; CTT chr11 5292234 5292255 5292251 5292256 +
ggtgagggatatctgtcctgat

SEQ ID NO: 95402 - DNA, 22 bp, Artificial Sequence
  Synthetic oligonucleotide; TTG chr11 5292235 5292256 5292252 5292257 +
gtgagggatatctgtcctgatg

SEQ ID NO: 95403 - DNA, 22 bp, Artificial Sequence
  Synthetic oligonucleotide; CTG chr11 5292249 5292270 5292266 5292271 +
tcctgatgttgtccaggatggt

SEQ ID NO: 95404 - DNA, 22 bp, Artificial Sequence
  Synthetic oligonucleotide; CTG chr11 5292254 5292275 5292271 5292276 +
atgttgtccaggatggtgatga

SEQ ID NO: 95405 - DNA, 22 bp, Artificial Sequence
  Synthetic oligonucleotide; TTG chr11 5292260 5292281 5292277 5292282 +
tccaggatggtgatgataccca

SEQ ID NO: 95406 - DNA, 22 bp, Artificial Sequence
  Synthetic oligonucleotide; CTA chr11 5292322 5292343 5292339 5292344 +
gacaaagaggcatcaaagatag

SEQ ID NO: 95407 - DNA, 22 bp, Artificial Sequence
  Synthetic oligonucleotide; TTT chr11 5292352 5292373 5292369 5292374 +
gtaaggatgaaatagaacgttt

SEQ ID NO: 95408 - DNA, 22 bp, Artificial Sequence
  Synthetic oligonucleotide; TTG chr11 5292353 5292374 5292370 5292375 +
taaggatgaaatagaacgtttt

SEQ ID NO: 95409 - DNA, 22 bp, Artificial Sequence
  Synthetic oligonucleotide; TTT chr11 5292374 5292395 5292391 5292396 +
tttgcgttagtcaccgtgagga

SEQ ID NO: 95410 - DNA, 22 bp, Artificial Sequence
  Synthetic oligonucleotide; TTT chr11 5292375 5292396 5292392 5292397 +
ttgcgttagtcaccgtgaggat

SEQ ID NO: 95411 - DNA, 22 bp, Artificial Sequence
  Synthetic oligonucleotide; TTT chr11 5292376 5292397 5292393 5292398 +
tgcgttagtcaccgtgaggatg

SEQ ID NO: 95412 - DNA, 22 bp, Artificial Sequence
  Synthetic oligonucleotide; TTT chr11 5292377 5292398 5292394 5292399 +
gcgttagtcaccgtgaggatga

SEQ ID NO: 95413 - DNA, 22 bp, Artificial Sequence
  Synthetic oligonucleotide; TTG chr11 5292378 5292399 5292395 5292400 +
cgttagtcaccgtgaggatgac

SEQ ID NO: 95414 - DNA, 22 bp, Artificial Sequence
  Synthetic oligonucleotide; TTA chr11 5292383 5292404 5292400 5292405 +
gtcaccgtgaggatgaccggta

SEQ ID NO: 95415 - DNA, 22 bp, Artificial Sequence
  Synthetic oligonucleotide; CTA chr11 5292423 5292444 5292440 5292445 +
atgcctttgttattttttatta

SEQ ID NO: 95416 - DNA, 22 bp, Artificial Sequence
  Synthetic oligonucleotide; CTT chr11 5292430 5292451 5292447 5292452 +
tgttattttttattatttcatt

SEQ ID NO: 95417 - DNA, 22 bp, Artificial Sequence
  Synthetic oligonucleotide; TTT chr11 5292431 5292452 5292448 5292453 +
gttattttttattatttcattt

SEQ ID NO: 95418 - DNA, 22 bp, Artificial Sequence
  Synthetic oligonucleotide; TTG chr11 5292432 5292453 5292449 5292454 +
ttattttttattatttcatttt

SEQ ID NO: 95419 - DNA, 22 bp, Artificial Sequence
  Synthetic oligonucleotide; TTA chr11 5292435 5292456 5292452 5292457 +
ttttttattatttcattttaaa

SEQ ID NO: 95420 - DNA, 22 bp, Artificial Sequence
  Synthetic oligonucleotide; TTT chr11 5292438 5292459 5292455 5292460 +
tttattatttcattttaaattg

SEQ ID NO: 95421 - DNA, 22 bp, Artificial Sequence
  Synthetic oligonucleotide; TTT chr11 5292439 5292460 5292456 5292461 +
ttattatttcattttaaattga

SEQ ID NO: 95422 - DNA, 22 bp, Artificial Sequence
  Synthetic oligonucleotide; TTT chr11 5292440 5292461 5292457 5292462 +
tattatttcattttaaattgac

SEQ ID NO: 95423 - DNA, 22 bp, Artificial Sequence
  Synthetic oligonucleotide; TTT chr11 5292441 5292462 5292458 5292463 +
attatttcattttaaattgaca

SEQ ID NO: 95424 - DNA, 22 bp, Artificial Sequence
  Synthetic oligonucleotide; TTA chr11 5292442 5292463 5292459 5292464 +
ttatttcattttaaattgacaa

SEQ ID NO: 95425 - DNA, 22 bp, Artificial Sequence
  Synthetic oligonucleotide; TTA chr11 5292445 5292466 5292462 5292467 +
tttcattttaaattgacaaata

SEQ ID NO: 95426 - DNA, 22 bp, Artificial Sequence
  Synthetic oligonucleotide; TTT chr11 5292448 5292469 5292465 5292470 +
cattttaaattgacaaataata

SEQ ID NO: 95427 - DNA, 22 bp, Artificial Sequence
  Synthetic oligonucleotide; TTC chr11 5292449 5292470 5292466 5292471 +
attttaaattgacaaataataa

SEQ ID NO: 95428 - DNA, 22 bp, Artificial Sequence
  Synthetic oligonucleotide; TTT chr11 5292453 5292474 5292470 5292475 +
taaattgacaaataataattgt

SEQ ID NO: 95429 - DNA, 22 bp, Artificial Sequence
  Synthetic oligonucleotide; TTT chr11 5292454 5292475 5292471 5292476 +
aaattgacaaataataattgtg

SEQ ID NO: 95430 - DNA, 22 bp, Artificial Sequence
  Synthetic oligonucleotide; TTA chr11 5292455 5292476 5292472 5292477 +
aattgacaaataataattgtgt

SEQ ID NO: 95431 - DNA, 22 bp, Artificial Sequence
  Synthetic oligonucleotide; TTG chr11 5292460 5292481 5292477 5292482 +
acaaataataattgtgtgtatt

SEQ ID NO: 95432 - DNA, 22 bp, Artificial Sequence
  Synthetic oligonucleotide; TTG chr11 5292474 5292495 5292491 5292496 +
tgtgtattcatggggtacaaca

SEQ ID NO: 95433 - DNA, 22 bp, Artificial Sequence
  Synthetic oligonucleotide; TTC chr11 5292483 5292504 5292500 5292505 +
atggggtacaacatgatgcttt

SEQ ID NO: 95434 - DNA, 22 bp, Artificial Sequence
  Synthetic oligonucleotide; CTT chr11 5292504 5292525 5292521 5292526 +
tggtgtacgtgtacaatattaa

SEQ ID NO: 95435 - DNA, 22 bp, Artificial Sequence
  Synthetic oligonucleotide; TTT chr11 5292505 5292526 5292522 5292527 +
ggtgtacgtgtacaatattaaa

SEQ ID NO: 95436 - DNA, 22 bp, Artificial Sequence
  Synthetic oligonucleotide; TTG chr11 5292506 5292527 5292523 5292528 +
gtgtacgtgtacaatattaaat

SEQ ID NO: 95437 - DNA, 22 bp, Artificial Sequence
  Synthetic oligonucleotide; TTA chr11 5292525 5292546 5292542 5292547 +
aatggttaaataaggctaatta

SEQ ID NO: 95438 - DNA, 22 bp, Artificial Sequence
  Synthetic oligonucleotide; TTA chr11 5292533 5292554 5292550 5292555 +
aataaggctaattaacaaatcc

SEQ ID NO: 95439 - DNA, 22 bp, Artificial Sequence
  Synthetic oligonucleotide; CTA chr11 5292543 5292564 5292560 5292565 +
attaacaaatccaccacttcac

SEQ ID NO: 95440 - DNA, 22 bp, Artificial Sequence
  Synthetic oligonucleotide; TTA chr11 5292547 5292568 5292564 5292569 +
acaaatccaccacttcacatac

SEQ ID NO: 95441 - DNA, 22 bp, Artificial Sequence
  Synthetic oligonucleotide; CTT chr11 5292562 5292583 5292579 5292584 +
cacatacttattttttgtggtg

SEQ ID NO: 95442 - DNA, 22 bp, Artificial Sequence
  Synthetic oligonucleotide; TTC chr11 5292563 5292584 5292580 5292585 +
acatacttattttttgtggtga

SEQ ID NO: 95443 - DNA, 22 bp, Artificial Sequence
  Synthetic oligonucleotide; CTT chr11 5292571 5292592 5292588 5292593 +
attttttgtggtgaaaacattt

SEQ ID NO: 95444 - DNA, 22 bp, Artificial Sequence
  Synthetic oligonucleotide; TTA chr11 5292572 5292593 5292589 5292594 +
ttttttgtggtgaaaacattta

SEQ ID NO: 95445 - DNA, 22 bp, Artificial Sequence
  Synthetic oligonucleotide; TTT chr11 5292575 5292596 5292592 5292597 +
tttgtggtgaaaacatttaaaa

SEQ ID NO: 95446 - DNA, 22 bp, Artificial Sequence
  Synthetic oligonucleotide; TTT chr11 5292576 5292597 5292593 5292598 +
ttgtggtgaaaacatttaaaat

SEQ ID NO: 95447 - DNA, 22 bp, Artificial Sequence
  Synthetic oligonucleotide; TTT chr11 5292577 5292598 5292594 5292599 +
tgtggtgaaaacatttaaaatt

SEQ ID NO: 95448 - DNA, 22 bp, Artificial Sequence
  Synthetic oligonucleotide; TTT chr11 5292578 5292599 5292595 5292600 +
gtggtgaaaacatttaaaattt

SEQ ID NO: 95449 - DNA, 22 bp, Artificial Sequence
  Synthetic oligonucleotide; TTG chr11 5292579 5292600 5292596 5292601 +
tggtgaaaacatttaaaattta

SEQ ID NO: 95450 - DNA, 22 bp, Artificial Sequence
  Synthetic oligonucleotide; TTT chr11 5292593 5292614 5292610 5292615 +
aaaatttacactcttcattcaa

SEQ ID NO: 95451 - DNA, 22 bp, Artificial Sequence
  Synthetic oligonucleotide; TTA chr11 5292594 5292615 5292611 5292616 +
aaatttacactcttcattcaaa

SEQ ID NO: 95452 - DNA, 22 bp, Artificial Sequence
  Synthetic oligonucleotide; TTT chr11 5292600 5292621 5292617 5292622 +
acactcttcattcaaaaatctg

SEQ ID NO: 95453 - DNA, 22 bp, Artificial Sequence
  Synthetic oligonucleotide; TTA chr11 5292601 5292622 5292618 5292623 +
cactcttcattcaaaaatctgg

SEQ ID NO: 95454 - DNA, 22 bp, Artificial Sequence
  Synthetic oligonucleotide; CTC chr11 5292606 5292627 5292623 5292628 +
ttcattcaaaaatctggaacat

SEQ ID NO: 95455 - DNA, 22 bp, Artificial Sequence
  Synthetic oligonucleotide; CTT chr11 5292608 5292629 5292625 5292630 +
cattcaaaaatctggaacatag

SEQ ID NO: 95456 - DNA, 22 bp, Artificial Sequence
  Synthetic oligonucleotide; TTC chr11 5292609 5292630 5292626 5292631 +
attcaaaaatctggaacatagt

SEQ ID NO: 95457 - DNA, 22 bp, Artificial Sequence
  Synthetic oligonucleotide; TTC chr11 5292613 5292634 5292630 5292635 +
aaaaatctggaacatagttaaa

SEQ ID NO: 95458 - DNA, 22 bp, Artificial Sequence
  Synthetic oligonucleotide; CTG chr11 5292622 5292643 5292639 5292644 +
gaacatagttaaaatgtcatat

SEQ ID NO: 95459 - DNA, 22 bp, Artificial Sequence
  Synthetic oligonucleotide; TTA chr11 5292633 5292654 5292650 5292655 +
aaatgtcatatgtgtcaggatg

SEQ ID NO: 95460 - DNA, 22 bp, Artificial Sequence
  Synthetic oligonucleotide; TTT chr11 5292668 5292689 5292685 5292690 +
agaaaacattgaatgattcctt

SEQ ID NO: 95461 - DNA, 22 bp, Artificial Sequence
  Synthetic oligonucleotide; TTA chr11 5292669 5292690 5292686 5292691 +
gaaaacattgaatgattccttg

SEQ ID NO: 95462 - DNA, 22 bp, Artificial Sequence
  Synthetic oligonucleotide; TTG chr11 5292679 5292700 5292696 5292701 +
aatgattccttgcaaatcatga

SEQ ID NO: 95463 - DNA, 22 bp, Artificial Sequence
  Synthetic oligonucleotide; TTC chr11 5292687 5292708 5292704 5292709 +
cttgcaaatcatgaataatgat

SEQ ID NO: 95464 - DNA, 22 bp, Artificial Sequence
  Synthetic oligonucleotide; CTT chr11 5292690 5292711 5292707 5292712 +
gcaaatcatgaataatgatcaa

SEQ ID NO: 95465 - DNA, 22 bp, Artificial Sequence
  Synthetic oligonucleotide; TTG chr11 5292691 5292712 5292708 5292713 +
caaatcatgaataatgatcaat

SEQ ID NO: 95466 - DNA, 22 bp, Artificial Sequence
  Synthetic oligonucleotide; CTA chr11 5292726 5292747 5292743 5292748 +
tgaaaatgagaaaattttggag

SEQ ID NO: 95467 - DNA, 22 bp, Artificial Sequence
  Synthetic oligonucleotide; TTT chr11 5292743 5292764 5292760 5292765 +
tggagcctgaactaaaaatatc

SEQ ID NO: 95468 - DNA, 22 bp, Artificial Sequence
  Synthetic oligonucleotide; TTT chr11 5292744 5292765 5292761 5292766 +
ggagcctgaactaaaaatatct

SEQ ID NO: 95469 - DNA, 22 bp, Artificial Sequence
  Synthetic oligonucleotide; TTG chr11 5292745 5292766 5292762 5292767 +
gagcctgaactaaaaatatctt

SEQ ID NO: 95470 - DNA, 22 bp, Artificial Sequence
  Synthetic oligonucleotide; CTG chr11 5292752 5292773 5292769 5292774 +
aactaaaaatatcttgatcact

SEQ ID NO: 95471 - DNA, 22 bp, Artificial Sequence
  Synthetic oligonucleotide; CTA chr11 5292757 5292778 5292774 5292779 +
aaaatatcttgatcacttttgg

SEQ ID NO: 95472 - DNA, 22 bp, Artificial Sequence
  Synthetic oligonucleotide; CTT chr11 5292767 5292788 5292784 5292789 +
gatcacttttggaggtcaggaa

SEQ ID NO: 95473 - DNA, 22 bp, Artificial Sequence
  Synthetic oligonucleotide; TTG chr11 5292768 5292789 5292785 5292790 +
atcacttttggaggtcaggaat

SEQ ID NO: 95474 - DNA, 22 bp, Artificial Sequence
  Synthetic oligonucleotide; CTT chr11 5292775 5292796 5292792 5292797 +
ttggaggtcaggaattcagatt

SEQ ID NO: 95475 - DNA, 22 bp, Artificial Sequence
  Synthetic oligonucleotide; TTT chr11 5292776 5292797 5292793 5292798 +
tggaggtcaggaattcagattc

SEQ ID NO: 95476 - DNA, 22 bp, Artificial Sequence
  Synthetic oligonucleotide; TTT chr11 5292777 5292798 5292794 5292799 +
ggaggtcaggaattcagattca

SEQ ID NO: 95477 - DNA, 22 bp, Artificial Sequence
  Synthetic oligonucleotide; TTG chr11 5292778 5292799 5292795 5292800 +
gaggtcaggaattcagattcat

SEQ ID NO: 95478 - DNA, 22 bp, Artificial Sequence
  Synthetic oligonucleotide; TTC chr11 5292792 5292813 5292809 5292814 +
agattcatttttctcggcctgt

SEQ ID NO: 95479 - DNA, 22 bp, Artificial Sequence
  Synthetic oligonucleotide; TTC chr11 5292798 5292819 5292815 5292820 +
atttttctcggcctgtaaagaa

SEQ ID NO: 95480 - DNA, 22 bp, Artificial Sequence
  Synthetic oligonucleotide; TTT chr11 5292802 5292823 5292819 5292824 +
ttctcggcctgtaaagaacttg

SEQ ID NO: 95481 - DNA, 22 bp, Artificial Sequence
  Synthetic oligonucleotide; TTT chr11 5292803 5292824 5292820 5292825 +
tctcggcctgtaaagaacttga

SEQ ID NO: 95482 - DNA, 22 bp, Artificial Sequence
  Synthetic oligonucleotide; TTT chr11 5292804 5292825 5292821 5292826 +
ctcggcctgtaaagaacttgaa

SEQ ID NO: 95483 - DNA, 22 bp, Artificial Sequence
  Synthetic oligonucleotide; TTC chr11 5292805 5292826 5292822 5292827 +
tcggcctgtaaagaacttgaaa

SEQ ID NO: 95484 - DNA, 22 bp, Artificial Sequence
  Synthetic oligonucleotide; CTC chr11 5292807 5292828 5292824 5292829 +
ggcctgtaaagaacttgaaatt

SEQ ID NO: 95485 - DNA, 22 bp, Artificial Sequence
  Synthetic oligonucleotide; CTG chr11 5292813 5292834 5292830 5292835 +
taaagaacttgaaattgcatta

SEQ ID NO: 95486 - DNA, 22 bp, Artificial Sequence
  Synthetic oligonucleotide; CTT chr11 5292823 5292844 5292840 5292845 +
gaaattgcattatagcagaatg

SEQ ID NO: 95487 - DNA, 22 bp, Artificial Sequence
  Synthetic oligonucleotide; TTG chr11 5292824 5292845 5292841 5292846 +
aaattgcattatagcagaatgt

SEQ ID NO: 95488 - DNA, 22 bp, Artificial Sequence
  Synthetic oligonucleotide; TTG chr11 5292830 5292851 5292847 5292852 +
cattatagcagaatgtaggcct

SEQ ID NO: 95489 - DNA, 22 bp, Artificial Sequence
  Synthetic oligonucleotide; TTA chr11 5292835 5292856 5292852 5292857 +
tagcagaatgtaggccttgagt

SEQ ID NO: 95490 - DNA, 22 bp, Artificial Sequence
  Synthetic oligonucleotide; CTT chr11 5292853 5292874 5292870 5292875 +
gagtggattgatgtggaagcaa

SEQ ID NO: 95491 - DNA, 22 bp, Artificial Sequence
  Synthetic oligonucleotide; TTG chr11 5292854 5292875 5292871 5292876 +
agtggattgatgtggaagcaaa

SEQ ID NO: 95492 - DNA, 22 bp, Artificial Sequence
  Synthetic oligonucleotide; TTG chr11 5292863 5292884 5292880 5292885 +
atgtggaagcaaaacaagccac

SEQ ID NO: 95493 - DNA, 22 bp, Artificial Sequence
  Synthetic oligonucleotide; CTT chr11 5292922 5292943 5292939 5292944 +
gtgccattaattttaagcagtt

SEQ ID NO: 95494 - DNA, 22 bp, Artificial Sequence
  Synthetic oligonucleotide; TTG chr11 5292923 5292944 5292940 5292945 +
tgccattaattttaagcagttt

SEQ ID NO: 95495 - DNA, 22 bp, Artificial Sequence
  Synthetic oligonucleotide; TTA chr11 5292931 5292952 5292948 5292953 +
attttaagcagtttcatatgaa

SEQ ID NO: 95496 - DNA, 22 bp, Artificial Sequence
  Synthetic oligonucleotide; TTT chr11 5292935 5292956 5292952 5292957 +
taagcagtttcatatgaaacgt

SEQ ID NO: 95497 - DNA, 22 bp, Artificial Sequence
  Synthetic oligonucleotide; TTT chr11 5292936 5292957 5292953 5292958 +
aagcagtttcatatgaaacgtg

SEQ ID NO: 95498 - DNA, 22 bp, Artificial Sequence
  Synthetic oligonucleotide; TTA chr11 5292937 5292958 5292954 5292959 +
agcagtttcatatgaaacgtgg

SEQ ID NO: 95499 - DNA, 22 bp, Artificial Sequence
  Synthetic oligonucleotide; TTT chr11 5292945 5292966 5292962 5292967 +
catatgaaacgtgggtttcttt

SEQ ID NO: 95500 - DNA, 22 bp, Artificial Sequence
  Synthetic oligonucleotide; TTC chr11 5292946 5292967 5292963 5292968 +
atatgaaacgtgggtttcttta

SEQ ID NO: 95501 - DNA, 22 bp, Artificial Sequence
  Synthetic oligonucleotide; TTT chr11 5292963 5292984 5292980 5292985 +
ctttattgctacgtcacagtca

SEQ ID NO: 95502 - DNA, 22 bp, Artificial Sequence
  Synthetic oligonucleotide; TTC chr11 5292964 5292985 5292981 5292986 +
tttattgctacgtcacagtcag

SEQ ID NO: 95503 - DNA, 22 bp, Artificial Sequence
  Synthetic oligonucleotide; CTT chr11 5292966 5292987 5292983 5292988 +
tattgctacgtcacagtcagat

SEQ ID NO: 95504 - DNA, 22 bp, Artificial Sequence
  Synthetic oligonucleotide; TTT chr11 5292967 5292988 5292984 5292989 +
attgctacgtcacagtcagatg

SEQ ID NO: 95505 - DNA, 22 bp, Artificial Sequence
  Synthetic oligonucleotide; TTA chr11 5292968 5292989 5292985 5292990 +
ttgctacgtcacagtcagatgt

SEQ ID NO: 95506 - DNA, 22 bp, Artificial Sequence
  Synthetic oligonucleotide; TTG chr11 5292971 5292992 5292988 5292993 +
ctacgtcacagtcagatgttca

SEQ ID NO: 95507 - DNA, 22 bp, Artificial Sequence
  Synthetic oligonucleotide; CTA chr11 5292974 5292995 5292991 5292996 +
cgtcacagtcagatgttcatgg

SEQ ID NO: 95508 - DNA, 22 bp, Artificial Sequence
  Synthetic oligonucleotide; TTC chr11 5292992 5293013 5293009 5293014 +
atggtcctgagtgctctcctcc

SEQ ID NO: 95509 - DNA, 22 bp, Artificial Sequence
  Synthetic oligonucleotide; CTG chr11 5293001 5293022 5293018 5293023 +
agtgctctcctccaagcagtgg

SEQ ID NO: 95510 - DNA, 22 bp, Artificial Sequence
  Synthetic oligonucleotide; CTC chr11 5293008 5293029 5293025 5293030 +
tcctccaagcagtgggccagga

SEQ ID NO: 95511 - DNA, 22 bp, Artificial Sequence
  Synthetic oligonucleotide; CTC chr11 5293010 5293031 5293027 5293032 +
ctccaagcagtgggccaggagt

SEQ ID NO: 95512 - DNA, 22 bp, Artificial Sequence
  Synthetic oligonucleotide; CTC chr11 5293013 5293034 5293030 5293035 +
caagcagtgggccaggagtcca

SEQ ID NO: 95513 - DNA, 22 bp, Artificial Sequence
  Synthetic oligonucleotide; CTT chr11 5293043 5293064 5293060 5293065 +
cctgtgattgactttatcattt

SEQ ID NO: 95514 - DNA, 22 bp, Artificial Sequence
  Synthetic oligonucleotide; TTC chr11 5293044 5293065 5293061 5293066 +
ctgtgattgactttatcatttc

SEQ ID NO: 95515 - DNA, 22 bp, Artificial Sequence
  Synthetic oligonucleotide; CTG chr11 5293047 5293068 5293064 5293069 +
tgattgactttatcatttcaga

SEQ ID NO: 95516 - DNA, 22 bp, Artificial Sequence
  Synthetic oligonucleotide; TTG chr11 5293053 5293074 5293070 5293075 +
actttatcatttcagaatcttt

SEQ ID NO: 95517 - DNA, 22 bp, Artificial Sequence
  Synthetic oligonucleotide; CTT chr11 5293057 5293078 5293074 5293079 +
tatcatttcagaatcttttact

SEQ ID NO: 95518 - DNA, 22 bp, Artificial Sequence
  Synthetic oligonucleotide; TTT chr11 5293058 5293079 5293075 5293080 +
atcatttcagaatcttttactt

SEQ ID NO: 95519 - DNA, 22 bp, Artificial Sequence
  Synthetic oligonucleotide; TTA chr11 5293059 5293080 5293076 5293081 +
tcatttcagaatcttttacttt

SEQ ID NO: 95520 - DNA, 22 bp, Artificial Sequence
  Synthetic oligonucleotide; TTT chr11 5293065 5293086 5293082 5293087 +
cagaatcttttactttctgcca

SEQ ID NO: 95521 - DNA, 22 bp, Artificial Sequence
  Synthetic oligonucleotide; TTC chr11 5293066 5293087 5293083 5293088 +
agaatcttttactttctgccac

SEQ ID NO: 95522 - DNA, 22 bp, Artificial Sequence
  Synthetic oligonucleotide; CTT chr11 5293074 5293095 5293091 5293096 +
ttactttctgccacatagagga

SEQ ID NO: 95523 - DNA, 22 bp, Artificial Sequence
  Synthetic oligonucleotide; TTT chr11 5293075 5293096 5293092 5293097 +
tactttctgccacatagaggaa

SEQ ID NO: 95524 - DNA, 22 bp, Artificial Sequence
  Synthetic oligonucleotide; TTT chr11 5293076 5293097 5293093 5293098 +
actttctgccacatagaggaag

SEQ ID NO: 95525 - DNA, 22 bp, Artificial Sequence
  Synthetic oligonucleotide; TTA chr11 5293077 5293098 5293094 5293099 +
ctttctgccacatagaggaagg

SEQ ID NO: 95526 - DNA, 22 bp, Artificial Sequence
  Synthetic oligonucleotide; CTT chr11 5293080 5293101 5293097 5293102 +
tctgccacatagaggaagggaa

SEQ ID NO: 95527 - DNA, 22 bp, Artificial Sequence
  Synthetic oligonucleotide; TTT chr11 5293081 5293102 5293098 5293103 +
ctgccacatagaggaagggaaa

SEQ ID NO: 95528 - DNA, 22 bp, Artificial Sequence
  Synthetic oligonucleotide; TTC chr11 5293082 5293103 5293099 5293104 +
tgccacatagaggaagggaaag

SEQ ID NO: 95529 - DNA, 22 bp, Artificial Sequence
  Synthetic oligonucleotide; CTG chr11 5293084 5293105 5293101 5293106 +
ccacatagaggaagggaaagag

SEQ ID NO: 95530 - DNA, 22 bp, Artificial Sequence
  Synthetic oligonucleotide; CTC chr11 5293124 5293145 5293141 5293146 +
tgccttagggagtaacacatta

SEQ ID NO: 95531 - DNA, 22 bp, Artificial Sequence
  Synthetic oligonucleotide; CTG chr11 5293126 5293147 5293143 5293148 +
ccttagggagtaacacattatt

SEQ ID NO: 95532 - DNA, 22 bp, Artificial Sequence
  Synthetic oligonucleotide; CTT chr11 5293130 5293151 5293147 5293152 +
agggagtaacacattattatct

SEQ ID NO: 95533 - DNA, 22 bp, Artificial Sequence
  Synthetic oligonucleotide; TTA chr11 5293131 5293152 5293148 5293153 +
gggagtaacacattattatctc

SEQ ID NO: 95534 - DNA, 22 bp, Artificial Sequence
  Synthetic oligonucleotide; TTA chr11 5293146 5293167 5293163 5293168 +
ttatctccacattattttagtc

SEQ ID NO: 95535 - DNA, 22 bp, Artificial Sequence
  Synthetic oligonucleotide; TTA chr11 5293149 5293170 5293166 5293171 +
tctccacattattttagtcaca

SEQ ID NO: 95536 - DNA, 22 bp, Artificial Sequence
  Synthetic oligonucleotide; CTC chr11 5293153 5293174 5293170 5293175 +
cacattattttagtcacaacca

SEQ ID NO: 95537 - DNA, 22 bp, Artificial Sequence
  Synthetic oligonucleotide; TTA chr11 5293160 5293181 5293177 5293182 +
ttttagtcacaaccagtcacat

SEQ ID NO: 95538 - DNA, 22 bp, Artificial Sequence
  Synthetic oligonucleotide; TTT chr11 5293163 5293184 5293180 5293185 +
tagtcacaaccagtcacatggc

SEQ ID NO: 95539 - DNA, 22 bp, Artificial Sequence
  Synthetic oligonucleotide; TTT chr11 5293164 5293185 5293181 5293186 +
agtcacaaccagtcacatggcc

SEQ ID NO: 95540 - DNA, 22 bp, Artificial Sequence
  Synthetic oligonucleotide; TTA chr11 5293165 5293186 5293182 5293187 +
gtcacaaccagtcacatggcca

SEQ ID NO: 95541 - DNA, 22 bp, Artificial Sequence
  Synthetic oligonucleotide; TTA chr11 5293192 5293213 5293209 5293214 +
attgcaagggctgttggaaatt

SEQ ID NO: 95542 - DNA, 22 bp, Artificial Sequence
  Synthetic oligonucleotide; TTG chr11 5293196 5293217 5293213 5293218 +
caagggctgttggaaattgttg

SEQ ID NO: 95543 - DNA, 22 bp, Artificial Sequence
  Synthetic oligonucleotide; CTG chr11 5293205 5293226 5293222 5293227 +
ttggaaattgttgagaagtata

SEQ ID NO: 95544 - DNA, 22 bp, Artificial Sequence
  Synthetic oligonucleotide; TTG chr11 5293208 5293229 5293225 5293230 +
gaaattgttgagaagtatattg

SEQ ID NO: 95545 - DNA, 22 bp, Artificial Sequence
  Synthetic oligonucleotide; TTG chr11 5293215 5293236 5293232 5293237 +
ttgagaagtatattgatttagt

SEQ ID NO: 95546 - DNA, 22 bp, Artificial Sequence
  Synthetic oligonucleotide; TTG chr11 5293218 5293239 5293235 5293240 +
agaagtatattgatttagtgac

SEQ ID NO: 95547 - DNA, 22 bp, Artificial Sequence
  Synthetic oligonucleotide; TTG chr11 5293230 5293251 5293247 5293252 +
atttagtgactcatattgtttc

SEQ ID NO: 95548 - DNA, 22 bp, Artificial Sequence
  Synthetic oligonucleotide; TTT chr11 5293234 5293255 5293251 5293256 +
agtgactcatattgtttctgac

SEQ ID NO: 95549 - DNA, 22 bp, Artificial Sequence
  Synthetic oligonucleotide; TTA chr11 5293235 5293256 5293252 5293257 +
gtgactcatattgtttctgaca

SEQ ID NO: 95550 - DNA, 22 bp, Artificial Sequence
  Synthetic oligonucleotide; CTC chr11 5293242 5293263 5293259 5293264 +
atattgtttctgacatactgtg

SEQ ID NO: 95551 - DNA, 22 bp, Artificial Sequence
  Synthetic oligonucleotide; TTG chr11 5293248 5293269 5293265 5293270 +
tttctgacatactgtgtccgga

SEQ ID NO: 95552 - DNA, 22 bp, Artificial Sequence
  Synthetic oligonucleotide; TTT chr11 5293251 5293272 5293268 5293273 +
ctgacatactgtgtccggaatt

SEQ ID NO: 95553 - DNA, 22 bp, Artificial Sequence
  Synthetic oligonucleotide; TTC chr11 5293252 5293273 5293269 5293274 +
tgacatactgtgtccggaattg

SEQ ID NO: 95554 - DNA, 22 bp, Artificial Sequence
  Synthetic oligonucleotide; CTG chr11 5293254 5293275 5293271 5293276 +
acatactgtgtccggaattggt

SEQ ID NO: 95555 - DNA, 22 bp, Artificial Sequence
  Synthetic oligonucleotide; CTG chr11 5293262 5293283 5293279 5293284 +
tgtccggaattggtgggttctt

SEQ ID NO: 95556 - DNA, 22 bp, Artificial Sequence
  Synthetic oligonucleotide; TTG chr11 5293274 5293295 5293291 5293296 +
gtgggttcttggtttcactgac

SEQ ID NO: 95557 - DNA, 22 bp, Artificial Sequence
  Synthetic oligonucleotide; TTC chr11 5293282 5293303 5293299 5293304 +
ttggtttcactgacttcaagaa

SEQ ID NO: 95558 - DNA, 22 bp, Artificial Sequence
  Synthetic oligonucleotide; CTT chr11 5293284 5293305 5293301 5293306 +
ggtttcactgacttcaagaatg

SEQ ID NO: 95559 - DNA, 22 bp, Artificial Sequence
  Synthetic oligonucleotide; TTG chr11 5293285 5293306 5293302 5293307 +
gtttcactgacttcaagaatga

SEQ ID NO: 95560 - DNA, 22 bp, Artificial Sequence
  Synthetic oligonucleotide; TTT chr11 5293289 5293310 5293306 5293311 +
cactgacttcaagaatgaagcc

SEQ ID NO: 95561 - DNA, 22 bp, Artificial Sequence
  Synthetic oligonucleotide; TTC chr11 5293290 5293311 5293307 5293312 +
actgacttcaagaatgaagccg

SEQ ID NO: 95562 - DNA, 22 bp, Artificial Sequence
  Synthetic oligonucleotide; CTG chr11 5293294 5293315 5293311 5293316 +
acttcaagaatgaagccgggga

SEQ ID NO: 95563 - DNA, 22 bp, Artificial Sequence
  Synthetic oligonucleotide; CTT chr11 5293298 5293319 5293315 5293320 +
caagaatgaagccggggaccct

SEQ ID NO: 95564 - DNA, 22 bp, Artificial Sequence
  Synthetic oligonucleotide; TTC chr11 5293299 5293320 5293316 5293321 +
aagaatgaagccggggaccctc

SEQ ID NO: 95565 - DNA, 22 bp, Artificial Sequence
  Synthetic oligonucleotide; CTC chr11 5293321 5293342 5293338 5293343 +
gtggtgagtgttacagttctta

SEQ ID NO: 95566 - DNA, 22 bp, Artificial Sequence
  Synthetic oligonucleotide; TTA chr11 5293334 5293355 5293351 5293356 +
cagttcttaaaggctgcgtgtg

SEQ ID NO: 95567 - DNA, 22 bp, Artificial Sequence
  Synthetic oligonucleotide; TTC chr11 5293340 5293361 5293357 5293362 +
ttaaaggctgcgtgtgtggagt

SEQ ID NO: 95568 - DNA, 22 bp, Artificial Sequence
  Synthetic oligonucleotide; CTT chr11 5293342 5293363 5293359 5293364 +
aaaggctgcgtgtgtggagttt

SEQ ID NO: 95569 - DNA, 22 bp, Artificial Sequence
  Synthetic oligonucleotide; TTA chr11 5293343 5293364 5293360 5293365 +
aaggctgcgtgtgtggagtttg

SEQ ID NO: 95570 - DNA, 22 bp, Artificial Sequence
  Synthetic oligonucleotide; CTG chr11 5293350 5293371 5293367 5293372 +
cgtgtgtggagtttgttcgttc

SEQ ID NO: 95571 - DNA, 22 bp, Artificial Sequence
  Synthetic oligonucleotide; TTT chr11 5293364 5293385 5293381 5293386 +
gttcgttctgatgtttggatgt

SEQ ID NO: 95572 - DNA, 22 bp, Artificial Sequence
  Synthetic oligonucleotide; TTG chr11 5293365 5293386 5293382 5293387 +
ttcgttctgatgtttggatgtg

SEQ ID NO: 95573 - DNA, 22 bp, Artificial Sequence
  Synthetic oligonucleotide; TTC chr11 5293368 5293389 5293385 5293390 +
gttctgatgtttggatgtgttc

SEQ ID NO: 95574 - DNA, 22 bp, Artificial Sequence
  Synthetic oligonucleotide; TTC chr11 5293372 5293393 5293389 5293394 +
tgatgtttggatgtgttcggag

SEQ ID NO: 95575 - DNA, 22 bp, Artificial Sequence
  Synthetic oligonucleotide; CTG chr11 5293374 5293395 5293391 5293396 +
atgtttggatgtgttcggagtt

SEQ ID NO: 95576 - DNA, 22 bp, Artificial Sequence
  Synthetic oligonucleotide; TTT chr11 5293380 5293401 5293397 5293402 +
ggatgtgttcggagtttcttcc

SEQ ID NO: 95577 - DNA, 22 bp, Artificial Sequence
  Synthetic oligonucleotide; TTG chr11 5293381 5293402 5293398 5293403 +
gatgtgttcggagtttcttcct

SEQ ID NO: 95578 - DNA, 22 bp, Artificial Sequence
  Synthetic oligonucleotide; TTC chr11 5293390 5293411 5293407 5293412 +
ggagtttcttccttctgatggg

SEQ ID NO: 95579 - DNA, 22 bp, Artificial Sequence
  Synthetic oligonucleotide; TTT chr11 5293397 5293418 5293414 5293419 +
cttccttctgatgggttcgtgg

SEQ ID NO: 95580 - DNA, 22 bp, Artificial Sequence
  Synthetic oligonucleotide; TTC chr11 5293398 5293419 5293415 5293420 +
ttccttctgatgggttcgtggt

SEQ ID NO: 95581 - DNA, 22 bp, Artificial Sequence
  Synthetic oligonucleotide; CTT chr11 5293400 5293421 5293417 5293422 +
ccttctgatgggttcgtggtct

SEQ ID NO: 95582 - DNA, 22 bp, Artificial Sequence
  Synthetic oligonucleotide; TTC chr11 5293401 5293422 5293418 5293423 +
cttctgatgggttcgtggtctc

SEQ ID NO: 95583 - DNA, 22 bp, Artificial Sequence
  Synthetic oligonucleotide; CTT chr11 5293404 5293425 5293421 5293426 +
ctgatgggttcgtggtctcgct

SEQ ID NO: 95584 - DNA, 22 bp, Artificial Sequence
  Synthetic oligonucleotide; TTC chr11 5293405 5293426 5293422 5293427 +
tgatgggttcgtggtctcgctg

SEQ ID NO: 95585 - DNA, 22 bp, Artificial Sequence
  Synthetic oligonucleotide; CTG chr11 5293407 5293428 5293424 5293429 +
atgggttcgtggtctcgctggc

SEQ ID NO: 95586 - DNA, 22 bp, Artificial Sequence
  Synthetic oligonucleotide; TTC chr11 5293415 5293436 5293432 5293437 +
gtggtctcgctggctcaggagt

SEQ ID NO: 95587 - DNA, 22 bp, Artificial Sequence
  Synthetic oligonucleotide; CTC chr11 5293423 5293444 5293440 5293445 +
gctggctcaggagtgaagctgc

SEQ ID NO: 95588 - DNA, 22 bp, Artificial Sequence
  Synthetic oligonucleotide; CTG chr11 5293427 5293448 5293444 5293449 +
gctcaggagtgaagctgcagac

SEQ ID NO: 95589 - DNA, 22 bp, Artificial Sequence
  Synthetic oligonucleotide; CTC chr11 5293431 5293452 5293448 5293453 +
aggagtgaagctgcagaccttc

SEQ ID NO: 95590 - DNA, 22 bp, Artificial Sequence
  Synthetic oligonucleotide; CTG chr11 5293444 5293465 5293461 5293466 +
cagaccttcacagtgaacgttc

SEQ ID NO: 95591 - DNA, 22 bp, Artificial Sequence
  Synthetic oligonucleotide; CTT chr11 5293452 5293473 5293469 5293474 +
cacagtgaacgttccagctctt

SEQ ID NO: 95592 - DNA, 22 bp, Artificial Sequence
  Synthetic oligonucleotide; TTC chr11 5293453 5293474 5293470 5293475 +
acagtgaacgttccagctctta

SEQ ID NO: 95593 - DNA, 22 bp, Artificial Sequence
  Synthetic oligonucleotide; TTC chr11 5293466 5293487 5293483 5293488 +
cagctcttaaggcggcgcctct

SEQ ID NO: 95594 - DNA, 22 bp, Artificial Sequence
  Synthetic oligonucleotide; CTC chr11 5293472 5293493 5293489 5293494 +
ttaaggcggcgcctctggagtt

SEQ ID NO: 95595 - DNA, 22 bp, Artificial Sequence
  Synthetic oligonucleotide; CTT chr11 5293474 5293495 5293491 5293496 +
aaggcggcgcctctggagttgt

SEQ ID NO: 95596 - DNA, 22 bp, Artificial Sequence
  Synthetic oligonucleotide; TTA chr11 5293475 5293496 5293492 5293497 +
aggcggcgcctctggagttgtt

SEQ ID NO: 95597 - DNA, 22 bp, Artificial Sequence
  Synthetic oligonucleotide; CTC chr11 5293487 5293508 5293504 5293509 +
tggagttgttcgttcctcccgg

SEQ ID NO: 95598 - DNA, 22 bp, Artificial Sequence
  Synthetic oligonucleotide; CTG chr11 5293489 5293510 5293506 5293511 +
gagttgttcgttcctcccggtg

SEQ ID NO: 95599 - DNA, 22 bp, Artificial Sequence
  Synthetic oligonucleotide; TTG chr11 5293495 5293516 5293512 5293517 +
ttcgttcctcccggtgggttcg

SEQ ID NO: 95600 - DNA, 22 bp, Artificial Sequence
  Synthetic oligonucleotide; TTC chr11 5293498 5293519 5293515 5293520 +
gttcctcccggtgggttcgtgg

SEQ ID NO: 95601 - DNA, 22 bp, Artificial Sequence
  Synthetic oligonucleotide; TTC chr11 5293502 5293523 5293519 5293524 +
ctcccggtgggttcgtggtctc

SEQ ID NO: 95602 - DNA, 22 bp, Artificial Sequence
  Synthetic oligonucleotide; CTC chr11 5293505 5293526 5293522 5293527 +
ccggtgggttcgtggtctcgct

SEQ ID NO: 95603 - DNA, 22 bp, Artificial Sequence
  Synthetic oligonucleotide; TTC chr11 5293516 5293537 5293533 5293538 +
gtggtctcgctggcttcaagag

SEQ ID NO: 95604 - DNA, 22 bp, Artificial Sequence
  Synthetic oligonucleotide; CTC chr11 5293524 5293545 5293541 5293546 +
gctggcttcaagagtgaagctg

SEQ ID NO: 95605 - DNA, 22 bp, Artificial Sequence
  Synthetic oligonucleotide; CTG chr11 5293528 5293549 5293545 5293550 +
gcttcaagagtgaagctgcaga

SEQ ID NO: 95606 - DNA, 22 bp, Artificial Sequence
  Synthetic oligonucleotide; CTT chr11 5293532 5293553 5293549 5293554 +
caagagtgaagctgcagacctt

SEQ ID NO: 95607 - DNA, 22 bp, Artificial Sequence
  Synthetic oligonucleotide; TTC chr11 5293533 5293554 5293550 5293555 +
aagagtgaagctgcagaccttc

SEQ ID NO: 95608 - DNA, 22 bp, Artificial Sequence
  Synthetic oligonucleotide; CTG chr11 5293546 5293567 5293563 5293568 +
cagaccttcgcggtgagcgtta

SEQ ID NO: 95609 - DNA, 22 bp, Artificial Sequence
  Synthetic oligonucleotide; CTT chr11 5293554 5293575 5293571 5293576 +
cgcggtgagcgttacagctcat

SEQ ID NO: 95610 - DNA, 22 bp, Artificial Sequence
  Synthetic oligonucleotide; TTC chr11 5293555 5293576 5293572 5293577 +
gcggtgagcgttacagctcata

SEQ ID NO: 95611 - DNA, 22 bp, Artificial Sequence
  Synthetic oligonucleotide; TTA chr11 5293568 5293589 5293585 5293590 +
cagctcataaaggcagtgtaga

SEQ ID NO: 95612 - DNA, 22 bp, Artificial Sequence
  Synthetic oligonucleotide; CTC chr11 5293574 5293595 5293591 5293596 +
ataaaggcagtgtagacccaaa

SEQ ID NO: 95613 - DNA, 22 bp, Artificial Sequence
  Synthetic oligonucleotide; TTT chr11 5293617 5293638 5293634 5293639 +
attgcaaagagcgaaagaacaa

SEQ ID NO: 95614 - DNA, 22 bp, Artificial Sequence
  Synthetic oligonucleotide; TTA chr11 5293618 5293639 5293635 5293640 +
ttgcaaagagcgaaagaacaaa

SEQ ID NO: 95615 - DNA, 22 bp, Artificial Sequence
  Synthetic oligonucleotide; TTG chr11 5293621 5293642 5293638 5293643 +
caaagagcgaaagaacaaagct

SEQ ID NO: 95616 - DNA, 22 bp, Artificial Sequence
  Synthetic oligonucleotide; CTT chr11 5293644 5293665 5293661 5293666 +
ccacagtgtggaaggggacccg

SEQ ID NO: 95617 - DNA, 22 bp, Artificial Sequence
  Synthetic oligonucleotide; TTC chr11 5293645 5293666 5293662 5293667 +
cacagtgtggaaggggacccga

SEQ ID NO: 95618 - DNA, 22 bp, Artificial Sequence
  Synthetic oligonucleotide; TTG chr11 5293675 5293696 5293692 5293697 +
ccactgctggctcgggcagcct

SEQ ID NO: 95619 - DNA, 22 bp, Artificial Sequence
  Synthetic oligonucleotide; CTG chr11 5293681 5293702 5293698 5293703 +
ctggctcgggcagcctgctttt

SEQ ID NO: 95620 - DNA, 22 bp, Artificial Sequence
  Synthetic oligonucleotide; CTG chr11 5293684 5293705 5293701 5293706 +
gctcgggcagcctgcttttatt

SEQ ID NO: 95621 - DNA, 22 bp, Artificial Sequence
  Synthetic oligonucleotide; CTC chr11 5293688 5293709 5293705 5293710 +
gggcagcctgcttttattctct

SEQ ID NO: 95622 - DNA, 22 bp, Artificial Sequence
  Synthetic oligonucleotide; CTG chr11 5293698 5293719 5293715 5293720 +
cttttattctcttatctggccc

SEQ ID NO: 95623 - DNA, 22 bp, Artificial Sequence
  Synthetic oligonucleotide; CTT chr11 5293701 5293722 5293718 5293723 +
ttattctcttatctggccccac

SEQ ID NO: 95624 - DNA, 22 bp, Artificial Sequence
  Synthetic oligonucleotide; TTT chr11 5293702 5293723 5293719 5293724 +
tattctcttatctggccccacc

SEQ ID NO: 95625 - DNA, 22 bp, Artificial Sequence
  Synthetic oligonucleotide; TTT chr11 5293703 5293724 5293720 5293725 +
attctcttatctggccccaccc

SEQ ID NO: 95626 - DNA, 22 bp, Artificial Sequence
  Synthetic oligonucleotide; TTA chr11 5293704 5293725 5293721 5293726 +
ttctcttatctggccccaccca

SEQ ID NO: 95627 - DNA, 22 bp, Artificial Sequence
  Synthetic oligonucleotide; TTC chr11 5293707 5293728 5293724 5293729 +
tcttatctggccccacccacat

SEQ ID NO: 95628 - DNA, 22 bp, Artificial Sequence
  Synthetic oligonucleotide; CTC chr11 5293709 5293730 5293726 5293731 +
ttatctggccccacccacatcc

SEQ ID NO: 95629 - DNA, 22 bp, Artificial Sequence
  Synthetic oligonucleotide; CTT chr11 5293711 5293732 5293728 5293733 +
atctggccccacccacatcctg

SEQ ID NO: 95630 - DNA, 22 bp, Artificial Sequence
  Synthetic oligonucleotide; TTA chr11 5293712 5293733 5293729 5293734 +
tctggccccacccacatcctgc

SEQ ID NO: 95631 - DNA, 22 bp, Artificial Sequence
  Synthetic oligonucleotide; CTG chr11 5293716 5293737 5293733 5293738 +
gccccacccacatcctgctgat

SEQ ID NO: 95632 - DNA, 22 bp, Artificial Sequence
  Synthetic oligonucleotide; CTG chr11 5293733 5293754 5293750 5293755 +
ctgattggtagagcccagtggt

SEQ ID NO: 95633 - DNA, 22 bp, Artificial Sequence
  Synthetic oligonucleotide; CTG chr11 5293736 5293757 5293753 5293758 +
attggtagagcccagtggtctg

SEQ ID NO: 95634 - DNA, 22 bp, Artificial Sequence
  Synthetic oligonucleotide; TTG chr11 5293740 5293761 5293757 5293762 +
gtagagcccagtggtctgtttt

SEQ ID NO: 95635 - DNA, 22 bp, Artificial Sequence
  Synthetic oligonucleotide; CTG chr11 5293758 5293779 5293775 5293780 +
ttttgacagggcactgattggt

SEQ ID NO: 95636 - DNA, 22 bp, Artificial Sequence
  Synthetic oligonucleotide; TTT chr11 5293761 5293782 5293778 5293783 +
tgacagggcactgattggtgca

SEQ ID NO: 95637 - DNA, 22 bp, Artificial Sequence
  Synthetic oligonucleotide; TTT chr11 5293762 5293783 5293779 5293784 +
gacagggcactgattggtgcat

SEQ ID NO: 95638 - DNA, 22 bp, Artificial Sequence
  Synthetic oligonucleotide; TTG chr11 5293763 5293784 5293780 5293785 +
acagggcactgattggtgcatt

SEQ ID NO: 95639 - DNA, 22 bp, Artificial Sequence
  Synthetic oligonucleotide; CTG chr11 5293774 5293795 5293791 5293796 +
attggtgcatttacaatccatg

SEQ ID NO: 95640 - DNA, 22 bp, Artificial Sequence
  Synthetic oligonucleotide; TTG chr11 5293778 5293799 5293795 5293800 +
gtgcatttacaatccatgagct

SEQ ID NO: 95641 - DNA, 22 bp, Artificial Sequence
  Synthetic oligonucleotide; TTT chr11 5293786 5293807 5293803 5293808 +
acaatccatgagctagacacaa

SEQ ID NO: 95642 - DNA, 22 bp, Artificial Sequence
  Synthetic oligonucleotide; TTA chr11 5293787 5293808 5293804 5293809 +
caatccatgagctagacacaaa

SEQ ID NO: 95643 - DNA, 22 bp, Artificial Sequence
  Synthetic oligonucleotide; CTA chr11 5293801 5293822 5293818 5293823 +
gacacaaaggttctccacgtcc

SEQ ID NO: 95644 - DNA, 22 bp, Artificial Sequence
  Synthetic oligonucleotide; TTC chr11 5293814 5293835 5293831 5293836 +
tccacgtccccaccagattagc

SEQ ID NO: 95645 - DNA, 22 bp, Artificial Sequence
  Synthetic oligonucleotide; CTC chr11 5293816 5293837 5293833 5293838 +
cacgtccccaccagattagcta

SEQ ID NO: 95646 - DNA, 22 bp, Artificial Sequence
  Synthetic oligonucleotide; TTA chr11 5293834 5293855 5293851 5293856 +
gctagatacagagtgtccacac

SEQ ID NO: 95647 - DNA, 22 bp, Artificial Sequence
  Synthetic oligonucleotide; CTA chr11 5293838 5293859 5293855 5293860 +
gatacagagtgtccacacaaag

SEQ ID NO: 95648 - DNA, 22 bp, Artificial Sequence
  Synthetic oligonucleotide; TTC chr11 5293864 5293885 5293881 5293886 +
tccaagtccccaccagagtagc

SEQ ID NO: 95649 - DNA, 22 bp, Artificial Sequence
  Synthetic oligonucleotide; CTC chr11 5293866 5293887 5293883 5293888 +
caagtccccaccagagtagcta

SEQ ID NO: 95650 - DNA, 22 bp, Artificial Sequence
  Synthetic oligonucleotide; CTA chr11 5293888 5293909 5293905 5293910 +
gatacagagtgttgattggtgc

SEQ ID NO: 95651 - DNA, 22 bp, Artificial Sequence
  Synthetic oligonucleotide; TTG chr11 5293902 5293923 5293919 5293924 +
attggtgcattcacaaaccctg

SEQ ID NO: 95652 - DNA, 22 bp, Artificial Sequence
  Synthetic oligonucleotide; TTG chr11 5293906 5293927 5293923 5293928 +
gtgcattcacaaaccctgagct

SEQ ID NO: 95653 - DNA, 22 bp, Artificial Sequence
  Synthetic oligonucleotide; TTC chr11 5293914 5293935 5293931 5293936 +
acaaaccctgagctagacacag

SEQ ID NO: 95654 - DNA, 22 bp, Artificial Sequence
  Synthetic oligonucleotide; CTG chr11 5293924 5293945 5293941 5293946 +
agctagacacagggtgctgatt

SEQ ID NO: 95655 - DNA, 22 bp, Artificial Sequence
  Synthetic oligonucleotide; CTA chr11 5293929 5293950 5293946 5293951 +
gacacagggtgctgattggtgt

SEQ ID NO: 95656 - DNA, 22 bp, Artificial Sequence
  Synthetic oligonucleotide; CTG chr11 5293943 5293964 5293960 5293965 +
attggtgtgtttacaaaccttg

SEQ ID NO: 95657 - DNA, 22 bp, Artificial Sequence
  Synthetic oligonucleotide; TTG chr11 5293947 5293968 5293964 5293969 +
gtgtgtttacaaaccttgagct

SEQ ID NO: 95658 - DNA, 22 bp, Artificial Sequence
  Synthetic oligonucleotide; TTT chr11 5293955 5293976 5293972 5293977 +
acaaaccttgagctagatacag

SEQ ID NO: 95659 - DNA, 22 bp, Artificial Sequence
  Synthetic oligonucleotide; TTA chr11 5293956 5293977 5293973 5293978 +
caaaccttgagctagatacaga

SEQ ID NO: 95660 - DNA, 22 bp, Artificial Sequence
  Synthetic oligonucleotide; CTT chr11 5293964 5293985 5293981 5293986 +
gagctagatacagactgccgag

SEQ ID NO: 95661 - DNA, 22 bp, Artificial Sequence
  Synthetic oligonucleotide; TTG chr11 5293965 5293986 5293982 5293987 +
agctagatacagactgccgagt

SEQ ID NO: 95662 - DNA, 22 bp, Artificial Sequence
  Synthetic oligonucleotide; CTA chr11 5293970 5293991 5293987 5293992 +
gatacagactgccgagtggtgt

SEQ ID NO: 95663 - DNA, 22 bp, Artificial Sequence
  Synthetic oligonucleotide; CTG chr11 5293981 5294002 5293998 5294003 +
ccgagtggtgtatttacaatcc

SEQ ID NO: 95664 - DNA, 22 bp, Artificial Sequence
  Synthetic oligonucleotide; TTT chr11 5293996 5294017 5294013 5294018 +
acaatccctgagctagacataa

SEQ ID NO: 95665 - DNA, 22 bp, Artificial Sequence
  Synthetic oligonucleotide; TTA chr11 5293997 5294018 5294014 5294019 +
caatccctgagctagacataaa

SEQ ID NO: 95666 - DNA, 22 bp, Artificial Sequence
  Synthetic oligonucleotide; CTG chr11 5294006 5294027 5294023 5294028 +
agctagacataaaggttctcca

SEQ ID NO: 95667 - DNA, 22 bp, Artificial Sequence
  Synthetic oligonucleotide; CTA chr11 5294011 5294032 5294028 5294033 +
gacataaaggttctccacgtcc

SEQ ID NO: 95668 - DNA, 22 bp, Artificial Sequence
  Synthetic oligonucleotide; TTC chr11 5294024 5294045 5294041 5294046 +
tccacgtccccaccagagtagc

SEQ ID NO: 95669 - DNA, 22 bp, Artificial Sequence
  Synthetic oligonucleotide; CTC chr11 5294026 5294047 5294043 5294048 +
cacgtccccaccagagtagcta

SEQ ID NO: 95670 - DNA, 22 bp, Artificial Sequence
  Synthetic oligonucleotide; CTA chr11 5294048 5294069 5294065 5294070 +
gatacagagtgttgattggtgc

SEQ ID NO: 95671 - DNA, 22 bp, Artificial Sequence
  Synthetic oligonucleotide; TTG chr11 5294062 5294083 5294079 5294084 +
attggtgcattcacaaaccctg

SEQ ID NO: 95672 - DNA, 22 bp, Artificial Sequence
  Synthetic oligonucleotide; TTG chr11 5294066 5294087 5294083 5294088 +
gtgcattcacaaaccctgagct

SEQ ID NO: 95673 - DNA, 22 bp, Artificial Sequence
  Synthetic oligonucleotide; TTC chr11 5294074 5294095 5294091 5294096 +
acaaaccctgagctagacacag

SEQ ID NO: 95674 - DNA, 22 bp, Artificial Sequence
  Synthetic oligonucleotide; CTG chr11 5294084 5294105 5294101 5294106 +
agctagacacagggtgctgatt

SEQ ID NO: 95675 - DNA, 22 bp, Artificial Sequence
  Synthetic oligonucleotide; CTA chr11 5294089 5294110 5294106 5294111 +
gacacagggtgctgattggtgt

SEQ ID NO: 95676 - DNA, 22 bp, Artificial Sequence
  Synthetic oligonucleotide; CTG chr11 5294103 5294124 5294120 5294125 +
attggtgtgtttacaaaccttg

SEQ ID NO: 95677 - DNA, 22 bp, Artificial Sequence
  Synthetic oligonucleotide; TTG chr11 5294107 5294128 5294124 5294129 +
gtgtgtttacaaaccttgagct

SEQ ID NO: 95678 - DNA, 22 bp, Artificial Sequence
  Synthetic oligonucleotide; TTT chr11 5294115 5294136 5294132 5294137 +
acaaaccttgagctagatacag

SEQ ID NO: 95679 - DNA, 22 bp, Artificial Sequence
  Synthetic oligonucleotide; TTA chr11 5294116 5294137 5294133 5294138 +
caaaccttgagctagatacaga

SEQ ID NO: 95680 - DNA, 22 bp, Artificial Sequence
  Synthetic oligonucleotide; CTT chr11 5294124 5294145 5294141 5294146 +
gagctagatacagactgccgat

SEQ ID NO: 95681 - DNA, 22 bp, Artificial Sequence
  Synthetic oligonucleotide; TTG chr11 5294125 5294146 5294142 5294147 +
agctagatacagactgccgatt

SEQ ID NO: 95682 - DNA, 22 bp, Artificial Sequence
  Synthetic oligonucleotide; CTA chr11 5294130 5294151 5294147 5294152 +
gatacagactgccgattggtgt

SEQ ID NO: 95683 - DNA, 22 bp, Artificial Sequence
  Synthetic oligonucleotide; CTG chr11 5294141 5294162 5294158 5294163 +
ccgattggtgtatttacaatcc

SEQ ID NO: 95684 - DNA, 22 bp, Artificial Sequence
  Synthetic oligonucleotide; TTG chr11 5294148 5294169 5294165 5294170 +
gtgtatttacaatccctgagct

SEQ ID NO: 95685 - DNA, 22 bp, Artificial Sequence
  Synthetic oligonucleotide; TTT chr11 5294156 5294177 5294173 5294178 +
acaatccctgagctagacataa

SEQ ID NO: 95686 - DNA, 22 bp, Artificial Sequence
  Synthetic oligonucleotide; TTA chr11 5294157 5294178 5294174 5294179 +
caatccctgagctagacataaa

SEQ ID NO: 95687 - DNA, 22 bp, Artificial Sequence
  Synthetic oligonucleotide; CTG chr11 5294166 5294187 5294183 5294188 +
agctagacataaaggttctcca

SEQ ID NO: 95688 - DNA, 22 bp, Artificial Sequence
  Synthetic oligonucleotide; CTA chr11 5294171 5294192 5294188 5294193 +
gacataaaggttctccaaggcc

SEQ ID NO: 95689 - DNA, 22 bp, Artificial Sequence
  Synthetic oligonucleotide; TTC chr11 5294184 5294205 5294201 5294206 +
tccaaggccccaccagagtagc

SEQ ID NO: 95690 - DNA, 22 bp, Artificial Sequence
  Synthetic oligonucleotide; CTC chr11 5294186 5294207 5294203 5294208 +
caaggccccaccagagtagcta

SEQ ID NO: 95691 - DNA, 22 bp, Artificial Sequence
  Synthetic oligonucleotide; CTA chr11 5294208 5294229 5294225 5294230 +
gatagagtgttgattggtgcat

SEQ ID NO: 95692 - DNA, 22 bp, Artificial Sequence
  Synthetic oligonucleotide; TTG chr11 5294220 5294241 5294237 5294242 +
attggtgcattcacaaaccctg

SEQ ID NO: 95693 - DNA, 22 bp, Artificial Sequence
  Synthetic oligonucleotide; TTG chr11 5294224 5294245 5294241 5294246 +
gtgcattcacaaaccctgagct

SEQ ID NO: 95694 - DNA, 22 bp, Artificial Sequence
  Synthetic oligonucleotide; TTC chr11 5294232 5294253 5294249 5294254 +
acaaaccctgagctagacacag

SEQ ID NO: 95695 - DNA, 22 bp, Artificial Sequence
  Synthetic oligonucleotide; CTG chr11 5294242 5294263 5294259 5294264 +
agctagacacagggtgctgatt

SEQ ID NO: 95696 - DNA, 22 bp, Artificial Sequence
  Synthetic oligonucleotide; CTA chr11 5294247 5294268 5294264 5294269 +
gacacagggtgctgattggtgt

SEQ ID NO: 95697 - DNA, 22 bp, Artificial Sequence
  Synthetic oligonucleotide; CTG chr11 5294261 5294282 5294278 5294283 +
attggtgtgtttacaaaccttg

SEQ ID NO: 95698 - DNA, 22 bp, Artificial Sequence
  Synthetic oligonucleotide; TTG chr11 5294265 5294286 5294282 5294287 +
gtgtgtttacaaaccttgagct

SEQ ID NO: 95699 - DNA, 22 bp, Artificial Sequence
  Synthetic oligonucleotide; TTT chr11 5294273 5294294 5294290 5294295 +
acaaaccttgagctagatacag

SEQ ID NO: 95700 - DNA, 22 bp, Artificial Sequence
  Synthetic oligonucleotide; TTA chr11 5294274 5294295 5294291 5294296 +
caaaccttgagctagatacaga

SEQ ID NO: 95701 - DNA, 22 bp, Artificial Sequence
  Synthetic oligonucleotide; CTT chr11 5294282 5294303 5294299 5294304 +
gagctagatacagagtgccaat

SEQ ID NO: 95702 - DNA, 22 bp, Artificial Sequence
  Synthetic oligonucleotide; TTG chr11 5294283 5294304 5294300 5294305 +
agctagatacagagtgccaatt

SEQ ID NO: 95703 - DNA, 22 bp, Artificial Sequence
  Synthetic oligonucleotide; CTA chr11 5294288 5294309 5294305 5294310 +
gatacagagtgccaattggtgt

SEQ ID NO: 95704 - DNA, 22 bp, Artificial Sequence
  Synthetic oligonucleotide; TTG chr11 5294306 5294327 5294323 5294328 +
gtgtatttacaatcccttatct

SEQ ID NO: 95705 - DNA, 22 bp, Artificial Sequence
  Synthetic oligonucleotide; TTT chr11 5294314 5294335 5294331 5294336 +
acaatcccttatctagacataa

SEQ ID NO: 95706 - DNA, 22 bp, Artificial Sequence
  Synthetic oligonucleotide; TTA chr11 5294315 5294336 5294332 5294337 +
caatcccttatctagacataag

SEQ ID NO: 95707 - DNA, 22 bp, Artificial Sequence
  Synthetic oligonucleotide; CTT chr11 5294324 5294345 5294341 5294346 +
atctagacataagggttcttcg

SEQ ID NO: 95708 - DNA, 22 bp, Artificial Sequence
  Synthetic oligonucleotide; TTA chr11 5294325 5294346 5294342 5294347 +
tctagacataagggttcttcgc

SEQ ID NO: 95709 - DNA, 22 bp, Artificial Sequence
  Synthetic oligonucleotide; CTA chr11 5294329 5294350 5294346 5294351 +
gacataagggttcttcgcatcc

SEQ ID NO: 95710 - DNA, 22 bp, Artificial Sequence
  Synthetic oligonucleotide; TTC chr11 5294342 5294363 5294359 5294364 +
ttcgcatccccagcaaactcag

SEQ ID NO: 95711 - DNA, 22 bp, Artificial Sequence
  Synthetic oligonucleotide; CTT chr11 5294344 5294365 5294361 5294366 +
cgcatccccagcaaactcagga

SEQ ID NO: 95712 - DNA, 22 bp, Artificial Sequence
  Synthetic oligonucleotide; TTC chr11 5294345 5294366 5294362 5294367 +
gcatccccagcaaactcaggag

SEQ ID NO: 95713 - DNA, 22 bp, Artificial Sequence
  Synthetic oligonucleotide; CTC chr11 5294362 5294383 5294379 5294384 +
aggagcctagccggcttcaccc

SEQ ID NO: 95714 - DNA, 22 bp, Artificial Sequence
  Synthetic oligonucleotide; CTA chr11 5294371 5294392 5294388 5294393 +
gccggcttcacccagtggatcc

SEQ ID NO: 95715 - DNA, 22 bp, Artificial Sequence
  Synthetic oligonucleotide; CTT chr11 5294379 5294400 5294396 5294401 +
cacccagtggatcccgcacctg

SEQ ID NO: 95716 - DNA, 22 bp, Artificial Sequence
  Synthetic oligonucleotide; TTC chr11 5294380 5294401 5294397 5294402 +
acccagtggatcccgcacctgg

SEQ ID NO: 95717 - DNA, 22 bp, Artificial Sequence
  Synthetic oligonucleotide; CTG chr11 5294401 5294422 5294418 5294423 +
ggctgcagggggagctgcctgc

SEQ ID NO: 95718 - DNA, 22 bp, Artificial Sequence
  Synthetic oligonucleotide; CTG chr11 5294406 5294427 5294423 5294428 +
cagggggagctgcctgccagtc

SEQ ID NO: 95719 - DNA, 22 bp, Artificial Sequence
  Synthetic oligonucleotide; CTG chr11 5294418 5294439 5294435 5294440 +
cctgccagtcccctgccgtgcg

SEQ ID NO: 95720 - DNA, 22 bp, Artificial Sequence
  Synthetic oligonucleotide; CTG chr11 5294422 5294443 5294439 5294444 +
ccagtcccctgccgtgcgcccg

SEQ ID NO: 95721 - DNA, 22 bp, Artificial Sequence
  Synthetic oligonucleotide; CTG chr11 5294433 5294454 5294450 5294455 +
ccgtgcgcccgcactcttcagc

SEQ ID NO: 95722 - DNA, 22 bp, Artificial Sequence
  Synthetic oligonucleotide; CTC chr11 5294449 5294470 5294466 5294471 +
ttcagcccttgggtggtcgatg

SEQ ID NO: 95723 - DNA, 22 bp, Artificial Sequence
  Synthetic oligonucleotide; CTT chr11 5294451 5294472 5294468 5294473 +
cagcccttgggtggtcgatggg

SEQ ID NO: 95724 - DNA, 22 bp, Artificial Sequence
  Synthetic oligonucleotide; TTC chr11 5294452 5294473 5294469 5294474 +
agcccttgggtggtcgatggga

SEQ ID NO: 95725 - DNA, 22 bp, Artificial Sequence
  Synthetic oligonucleotide; CTT chr11 5294459 5294480 5294476 5294481 +
gggtggtcgatgggactgggtg

SEQ ID NO: 95726 - DNA, 22 bp, Artificial Sequence
  Synthetic oligonucleotide; TTG chr11 5294460 5294481 5294477 5294482 +
ggtggtcgatgggactgggtgc

SEQ ID NO: 95727 - DNA, 22 bp, Artificial Sequence
  Synthetic oligonucleotide; CTG chr11 5294477 5294498 5294494 5294499 +
ggtgccctggagcagggggcgg

SEQ ID NO: 95728 - DNA, 22 bp, Artificial Sequence
  Synthetic oligonucleotide; CTG chr11 5294486 5294507 5294503 5294508 +
gagcagggggcggcgctcgtcg

SEQ ID NO: 95729 - DNA, 22 bp, Artificial Sequence
  Synthetic oligonucleotide; CTC chr11 5294504 5294525 5294521 5294526 +
gtcggcgaggctcgggccgcac

SEQ ID NO: 95730 - DNA, 22 bp, Artificial Sequence
  Synthetic oligonucleotide; CTC chr11 5294517 5294538 5294534 5294539 +
gggccgcacaggagcccatgaa

SEQ ID NO: 95731 - DNA, 22 bp, Artificial Sequence
  Synthetic oligonucleotide; CTC chr11 5294552 5294573 5294569 5294574 +
aggcatggcgcgctgcaggtcc

SEQ ID NO: 95732 - DNA, 22 bp, Artificial Sequence
  Synthetic oligonucleotide; CTG chr11 5294567 5294588 5294584 5294589 +
caggtcccgagccctgccccgc

SEQ ID NO: 95733 - DNA, 22 bp, Artificial Sequence
  Synthetic oligonucleotide; CTG chr11 5294583 5294604 5294600 5294605 +
ccccgcaggaaggcagctaagg

SEQ ID NO: 95734 - DNA, 22 bp, Artificial Sequence
  Synthetic oligonucleotide; CTA chr11 5294602 5294623 5294619 5294624 +
aggcccggcgaggaattgagca

SEQ ID NO: 95735 - DNA, 22 bp, Artificial Sequence
  Synthetic oligonucleotide; TTG chr11 5294620 5294641 5294637 5294642 +
agcacagcagctgctggcccag

SEQ ID NO: 95736 - DNA, 22 bp, Artificial Sequence
  Synthetic oligonucleotide; CTG chr11 5294633 5294654 5294650 5294655 +
ctggcccaggtgctaagcccct

SEQ ID NO: 95737 - DNA, 22 bp, Artificial Sequence
  Synthetic oligonucleotide; CTG chr11 5294636 5294657 5294653 5294658 +
gcccaggtgctaagcccctcac

SEQ ID NO: 95738 - DNA, 22 bp, Artificial Sequence
  Synthetic oligonucleotide; CTA chr11 5294648 5294669 5294665 5294670 +
agcccctcactgcccgcggccg

SEQ ID NO: 95739 - DNA, 22 bp, Artificial Sequence
  Synthetic oligonucleotide; CTC chr11 5294656 5294677 5294673 5294678 +
actgcccgcggccggtggggcc

SEQ ID NO: 95740 - DNA, 22 bp, Artificial Sequence
  Synthetic oligonucleotide; CTG chr11 5294660 5294681 5294677 5294682 +
cccgcggccggtggggccggct

SEQ ID NO: 95741 - DNA, 22 bp, Artificial Sequence
  Synthetic oligonucleotide; CTG chr11 5294683 5294704 5294700 5294705 +
gcggctccgagtgcggggtcct

SEQ ID NO: 95742 - DNA, 22 bp, Artificial Sequence
  Synthetic oligonucleotide; CTC chr11 5294690 5294711 5294707 5294712 +
cgagtgcggggtcctcggagcc

SEQ ID NO: 95743 - DNA, 22 bp, Artificial Sequence
  Synthetic oligonucleotide; CTC chr11 5294706 5294727 5294723 5294728 +
ggagcccatgcccacccggaac

SEQ ID NO: 95744 - DNA, 22 bp, Artificial Sequence
  Synthetic oligonucleotide; CTC chr11 5294730 5294751 5294747 5294752 +
cctcaagcacggcgcacagccc

SEQ ID NO: 95745 - DNA, 22 bp, Artificial Sequence
  Synthetic oligonucleotide; CTC chr11 5294734 5294755 5294751 5294756 +
aagcacggcgcacagcccggtt

SEQ ID NO: 95746 - DNA, 22 bp, Artificial Sequence
  Synthetic oligonucleotide; TTC chr11 5294757 5294778 5294774 5294779 +
ctgcccgcgtctgtccctccac

SEQ ID NO: 95747 - DNA, 22 bp, Artificial Sequence
  Synthetic oligonucleotide; CTG chr11 5294760 5294781 5294777 5294782 +
cccgcgtctgtccctccacacc

SEQ ID NO: 95748 - DNA, 22 bp, Artificial Sequence
  Synthetic oligonucleotide; CTG chr11 5294770 5294791 5294787 5294792 +
tccctccacacctcctggcaag

SEQ ID NO: 95749 - DNA, 22 bp, Artificial Sequence
  Synthetic oligonucleotide; CTC chr11 5294776 5294797 5294793 5294798 +
cacacctcctggcaagctgagg

SEQ ID NO: 95750 - DNA, 22 bp, Artificial Sequence
  Synthetic oligonucleotide; CTC chr11 5294784 5294805 5294801 5294806 +
ctggcaagctgagggagccggc

SEQ ID NO: 95751 - DNA, 22 bp, Artificial Sequence
  Synthetic oligonucleotide; CTG chr11 5294787 5294808 5294804 5294809 +
gcaagctgagggagccggctct

SEQ ID NO: 95752 - DNA, 22 bp, Artificial Sequence
  Synthetic oligonucleotide; CTG chr11 5294795 5294816 5294812 5294817 +
agggagccggctctggccttgg

SEQ ID NO: 95753 - DNA, 22 bp, Artificial Sequence
  Synthetic oligonucleotide; CTC chr11 5294808 5294829 5294825 5294830 +
tggccttggccagcccagaaaa

SEQ ID NO: 95754 - DNA, 22 bp, Artificial Sequence
  Synthetic oligonucleotide; CTG chr11 5294810 5294831 5294827 5294832 +
gccttggccagcccagaaaagg

SEQ ID NO: 95755 - DNA, 22 bp, Artificial Sequence
  Synthetic oligonucleotide; CTT chr11 5294815 5294836 5294832 5294837 +
ggccagcccagaaaagggctcc

SEQ ID NO: 95756 - DNA, 22 bp, Artificial Sequence
  Synthetic oligonucleotide; TTG chr11 5294816 5294837 5294833 5294838 +
gccagcccagaaaagggctccc

SEQ ID NO: 95757 - DNA, 22 bp, Artificial Sequence
  Synthetic oligonucleotide; CTC chr11 5294836 5294857 5294853 5294858 +
ccacagtgcagcggccggctga

SEQ ID NO: 95758 - DNA, 22 bp, Artificial Sequence
  Synthetic oligonucleotide; CTG chr11 5294857 5294878 5294874 5294879 +
aagggctcctcaagtgccacca

SEQ ID NO: 95759 - DNA, 22 bp, Artificial Sequence
  Synthetic oligonucleotide; CTC chr11 5294865 5294886 5294882 5294887 +
ctcaagtgccaccaatgtggga

SEQ ID NO: 95760 - DNA, 22 bp, Artificial Sequence
  Synthetic oligonucleotide; CTC chr11 5294868 5294889 5294885 5294890 +
aagtgccaccaatgtgggagcc

SEQ ID NO: 95761 - DNA, 22 bp, Artificial Sequence
  Synthetic oligonucleotide; CTG chr11 5294925 5294946 5294942 5294947 +
tgaggactgccagcacgctgtc

SEQ ID NO: 95762 - DNA, 22 bp, Artificial Sequence
  Synthetic oligonucleotide; CTG chr11 5294934 5294955 5294951 5294956 +
ccagcacgctgtcacctctcaa

SEQ ID NO: 95763 - DNA, 22 bp, Artificial Sequence
  Synthetic oligonucleotide; CTG chr11 5294945 5294966 5294962 5294967 +
tcacctctcaatactaatcact

SEQ ID NO: 95764 - DNA, 22 bp, Artificial Sequence
  Synthetic oligonucleotide; CTC chr11 5294952 5294973 5294969 5294974 +
tcaatactaatcactagtaatt

SEQ ID NO: 95765 - DNA, 22 bp, Artificial Sequence
  Synthetic oligonucleotide; CTC chr11 5294954 5294975 5294971 5294976 +
aatactaatcactagtaattag

SEQ ID NO: 95766 - DNA, 22 bp, Artificial Sequence
  Synthetic oligonucleotide; CTA chr11 5294961 5294982 5294978 5294983 +
atcactagtaattagcattatc

SEQ ID NO: 95767 - DNA, 22 bp, Artificial Sequence
  Synthetic oligonucleotide; CTA chr11 5294968 5294989 5294985 5294990 +
gtaattagcattatcccacacc

SEQ ID NO: 95768 - DNA, 22 bp, Artificial Sequence
  Synthetic oligonucleotide; TTA chr11 5294975 5294996 5294992 5294997 +
gcattatcccacaccctgtgct

SEQ ID NO: 95769 - DNA, 22 bp, Artificial Sequence
  Synthetic oligonucleotide; TTA chr11 5294981 5295002 5294998 5295003 +
tcccacaccctgtgcttccaaa

SEQ ID NO: 95770 - DNA, 22 bp, Artificial Sequence
  Synthetic oligonucleotide; CTG chr11 5294993 5295014 5295010 5295015 +
tgcttccaaaaataacaggaat

SEQ ID NO: 95771 - DNA, 22 bp, Artificial Sequence
  Synthetic oligonucleotide; CTT chr11 5294998 5295019 5295015 5295020 +
ccaaaaataacaggaatattat

SEQ ID NO: 95772 - DNA, 22 bp, Artificial Sequence
  Synthetic oligonucleotide; TTC chr11 5294999 5295020 5295016 5295021 +
caaaaataacaggaatattatt

SEQ ID NO: 95773 - DNA, 22 bp, Artificial Sequence
  Synthetic oligonucleotide; TTA chr11 5295019 5295040 5295036 5295041 +
ttgtaaaatcaaaggcatactg

SEQ ID NO: 95774 - DNA, 22 bp, Artificial Sequence
  Synthetic oligonucleotide; TTG chr11 5295022 5295043 5295039 5295044 +
taaaatcaaaggcatactgaac

SEQ ID NO: 95775 - DNA, 22 bp, Artificial Sequence
  Synthetic oligonucleotide; CTG chr11 5295041 5295062 5295058 5295063 +
aaccatatgttttattatgttt

SEQ ID NO: 95776 - DNA, 22 bp, Artificial Sequence
  Synthetic oligonucleotide; TTT chr11 5295053 5295074 5295070 5295075 +
tattatgtttaagcagtaaaaa

SEQ ID NO: 95777 - DNA, 22 bp, Artificial Sequence
  Synthetic oligonucleotide; TTT chr11 5295054 5295075 5295071 5295076 +
attatgtttaagcagtaaaaat

SEQ ID NO: 95778 - DNA, 22 bp, Artificial Sequence
  Synthetic oligonucleotide; TTA chr11 5295055 5295076 5295072 5295077 +
ttatgtttaagcagtaaaaata

SEQ ID NO: 95779 - DNA, 22 bp, Artificial Sequence
  Synthetic oligonucleotide; TTA chr11 5295058 5295079 5295075 5295080 +
tgtttaagcagtaaaaataaga

SEQ ID NO: 95780 - DNA, 22 bp, Artificial Sequence
  Synthetic oligonucleotide; TTT chr11 5295063 5295084 5295080 5295085 +
aagcagtaaaaataagacctgg

SEQ ID NO: 95781 - DNA, 22 bp, Artificial Sequence
  Synthetic oligonucleotide; TTA chr11 5295064 5295085 5295081 5295086 +
agcagtaaaaataagacctgga

SEQ ID NO: 95782 - DNA, 22 bp, Artificial Sequence
  Synthetic oligonucleotide; CTG chr11 5295084 5295105 5295101 5295106 +
gagtgcaaaaagactaccaaat

SEQ ID NO: 95783 - DNA, 22 bp, Artificial Sequence
  Synthetic oligonucleotide; CTA chr11 5295100 5295121 5295117 5295122 +
ccaaatgctgtaatacttcatg

SEQ ID NO: 95784 - DNA, 22 bp, Artificial Sequence
  Synthetic oligonucleotide; CTG chr11 5295110 5295131 5295127 5295132 +
taatacttcatggaatctaagc

SEQ ID NO: 95785 - DNA, 22 bp, Artificial Sequence
  Synthetic oligonucleotide; CTT chr11 5295118 5295139 5295135 5295140 +
catggaatctaagctttctcac

SEQ ID NO: 95786 - DNA, 22 bp, Artificial Sequence
  Synthetic oligonucleotide; TTC chr11 5295119 5295140 5295136 5295141 +
atggaatctaagctttctcacc

SEQ ID NO: 95787 - DNA, 22 bp, Artificial Sequence
  Synthetic oligonucleotide; CTA chr11 5295129 5295150 5295146 5295151 +
agctttctcaccccaaattatg

SEQ ID NO: 95788 - DNA, 22 bp, Artificial Sequence
  Synthetic oligonucleotide; CTT chr11 5295134 5295155 5295151 5295156 +
tctcaccccaaattatgtctta

SEQ ID NO: 95789 - DNA, 22 bp, Artificial Sequence
  Synthetic oligonucleotide; TTT chr11 5295135 5295156 5295152 5295157 +
ctcaccccaaattatgtcttat

SEQ ID NO: 95790 - DNA, 22 bp, Artificial Sequence
  Synthetic oligonucleotide; TTC chr11 5295136 5295157 5295153 5295158 +
tcaccccaaattatgtcttatt

SEQ ID NO: 95791 - DNA, 22 bp, Artificial Sequence
  Synthetic oligonucleotide; CTC chr11 5295138 5295159 5295155 5295160 +
accccaaattatgtcttatttc

SEQ ID NO: 95792 - DNA, 22 bp, Artificial Sequence
  Synthetic oligonucleotide; TTA chr11 5295149 5295170 5295166 5295171 +
tgtcttatttcagagcaaataa

SEQ ID NO: 95793 - DNA, 22 bp, Artificial Sequence
  Synthetic oligonucleotide; CTT chr11 5295155 5295176 5295172 5295177 +
atttcagagcaaataacttagg

SEQ ID NO: 95794 - DNA, 22 bp, Artificial Sequence
  Synthetic oligonucleotide; TTA chr11 5295156 5295177 5295173 5295178 +
tttcagagcaaataacttaggc

SEQ ID NO: 95795 - DNA, 22 bp, Artificial Sequence
  Synthetic oligonucleotide; TTT chr11 5295159 5295180 5295176 5295181 +
cagagcaaataacttaggcttt

SEQ ID NO: 95796 - DNA, 22 bp, Artificial Sequence
  Synthetic oligonucleotide; TTC chr11 5295160 5295181 5295177 5295182 +
agagcaaataacttaggcttta

SEQ ID NO: 95797 - DNA, 22 bp, Artificial Sequence
  Synthetic oligonucleotide; CTT chr11 5295174 5295195 5295191 5295196 +
aggctttaaaaaatgtttcctc

SEQ ID NO: 95798 - DNA, 22 bp, Artificial Sequence
  Synthetic oligonucleotide; TTA chr11 5295175 5295196 5295192 5295197 +
ggctttaaaaaatgtttcctca

SEQ ID NO: 95799 - DNA, 22 bp, Artificial Sequence
  Synthetic oligonucleotide; CTT chr11 5295180 5295201 5295197 5295202 +
taaaaaatgtttcctcatgaat

SEQ ID NO: 95800 - DNA, 22 bp, Artificial Sequence
  Synthetic oligonucleotide; TTT chr11 5295181 5295202 5295198 5295203 +
aaaaaatgtttcctcatgaatt

SEQ ID NO: 95801 - DNA, 22 bp, Artificial Sequence
  Synthetic oligonucleotide; TTA chr11 5295182 5295203 5295199 5295204 +
aaaaatgtttcctcatgaatta

SEQ ID NO: 95802 - DNA, 22 bp, Artificial Sequence
  Synthetic oligonucleotide; TTT chr11 5295192 5295213 5295209 5295214 +
cctcatgaattattattgtata

SEQ ID NO: 95803 - DNA, 22 bp, Artificial Sequence
  Synthetic oligonucleotide; TTC chr11 5295193 5295214 5295210 5295215 +
ctcatgaattattattgtataa

SEQ ID NO: 95804 - DNA, 22 bp, Artificial Sequence
  Synthetic oligonucleotide; CTC chr11 5295196 5295217 5295213 5295218 +
atgaattattattgtataatga

SEQ ID NO: 95805 - DNA, 22 bp, Artificial Sequence
  Synthetic oligonucleotide; TTA chr11 5295204 5295225 5295221 5295226 +
ttattgtataatgattcagagc

SEQ ID NO: 95806 - DNA, 22 bp, Artificial Sequence
  Synthetic oligonucleotide; TTA chr11 5295207 5295228 5295224 5295229 +
ttgtataatgattcagagcatg

SEQ ID NO: 95807 - DNA, 22 bp, Artificial Sequence
  Synthetic oligonucleotide; TTG chr11 5295210 5295231 5295227 5295232 +
tataatgattcagagcatgtat

SEQ ID NO: 95808 - DNA, 22 bp, Artificial Sequence
  Synthetic oligonucleotide; TTC chr11 5295221 5295242 5295238 5295243 +
agagcatgtattctagagccaa

SEQ ID NO: 95809 - DNA, 22 bp, Artificial Sequence
  Synthetic oligonucleotide; TTC chr11 5295234 5295255 5295251 5295256 +
tagagccaaatatcatgagttg

SEQ ID NO: 95810 - DNA, 22 bp, Artificial Sequence
  Synthetic oligonucleotide; CTA chr11 5295236 5295257 5295253 5295258 +
gagccaaatatcatgagttgaa

SEQ ID NO: 95811 - DNA, 22 bp, Artificial Sequence
  Synthetic oligonucleotide; TTG chr11 5295256 5295277 5295273 5295278 +
aattatgccctctgtcagttag

SEQ ID NO: 95812 - DNA, 22 bp, Artificial Sequence
  Synthetic oligonucleotide; TTA chr11 5295261 5295282 5295278 5295283 +
tgccctctgtcagttagtagcc

SEQ ID NO: 95813 - DNA, 22 bp, Artificial Sequence
  Synthetic oligonucleotide; CTC chr11 5295268 5295289 5295285 5295290 +
tgtcagttagtagccacttcat

SEQ ID NO: 95814 - DNA, 22 bp, Artificial Sequence
  Synthetic oligonucleotide; CTG chr11 5295270 5295291 5295287 5295292 +
tcagttagtagccacttcatct

SEQ ID NO: 95815 - DNA, 22 bp, Artificial Sequence
  Synthetic oligonucleotide; TTA chr11 5295277 5295298 5295294 5295299 +
gtagccacttcatcttggaata

SEQ ID NO: 95816 - DNA, 22 bp, Artificial Sequence
  Synthetic oligonucleotide; CTT chr11 5295287 5295308 5295304 5295309 +
catcttggaatattactttagg

SEQ ID NO: 95817 - DNA, 22 bp, Artificial Sequence
  Synthetic oligonucleotide; TTC chr11 5295288 5295309 5295305 5295310 +
atcttggaatattactttaggg

SEQ ID NO: 95818 - DNA, 22 bp, Artificial Sequence
  Synthetic oligonucleotide; CTT chr11 5295293 5295314 5295310 5295315 +
ggaatattactttagggccctg

SEQ ID NO: 95819 - DNA, 22 bp, Artificial Sequence
  Synthetic oligonucleotide; TTG chr11 5295294 5295315 5295311 5295316 +
gaatattactttagggccctgt

SEQ ID NO: 95820 - DNA, 22 bp, Artificial Sequence
  Synthetic oligonucleotide; TTA chr11 5295302 5295323 5295319 5295324 +
ctttagggccctgtgcctcagt

SEQ ID NO: 95821 - DNA, 22 bp, Artificial Sequence
  Synthetic oligonucleotide; CTT chr11 5295305 5295326 5295322 5295327 +
tagggccctgtgcctcagtttc

SEQ ID NO: 95822 - DNA, 22 bp, Artificial Sequence
  Synthetic oligonucleotide; TTT chr11 5295306 5295327 5295323 5295328 +
agggccctgtgcctcagtttcc

SEQ ID NO: 95823 - DNA, 22 bp, Artificial Sequence
  Synthetic oligonucleotide; TTA chr11 5295307 5295328 5295324 5295329 +
gggccctgtgcctcagtttcct

SEQ ID NO: 95824 - DNA, 22 bp, Artificial Sequence
  Synthetic oligonucleotide; CTG chr11 5295315 5295336 5295332 5295337 +
tgcctcagtttcctcctcttaa

SEQ ID NO: 95825 - DNA, 22 bp, Artificial Sequence
  Synthetic oligonucleotide; CTC chr11 5295321 5295342 5295338 5295343 +
agtttcctcctcttaaagggta

SEQ ID NO: 95826 - DNA, 22 bp, Artificial Sequence
  Synthetic oligonucleotide; TTT chr11 5295326 5295347 5295343 5295348 +
cctcctcttaaagggtattaca

SEQ ID NO: 95827 - DNA, 22 bp, Artificial Sequence
  Synthetic oligonucleotide; TTC chr11 5295327 5295348 5295344 5295349 +
ctcctcttaaagggtattacaa

SEQ ID NO: 95828 - DNA, 22 bp, Artificial Sequence
  Synthetic oligonucleotide; CTC chr11 5295330 5295351 5295347 5295352 +
ctcttaaagggtattacaatag

SEQ ID NO: 95829 - DNA, 22 bp, Artificial Sequence
  Synthetic oligonucleotide; CTC chr11 5295333 5295354 5295350 5295355 +
ttaaagggtattacaatagtac

SEQ ID NO: 95830 - DNA, 22 bp, Artificial Sequence
  Synthetic oligonucleotide; CTT chr11 5295335 5295356 5295352 5295357 +
aaagggtattacaatagtactt

SEQ ID NO: 95831 - DNA, 22 bp, Artificial Sequence
  Synthetic oligonucleotide; TTA chr11 5295336 5295357 5295353 5295358 +
aagggtattacaatagtacttg

SEQ ID NO: 95832 - DNA, 22 bp, Artificial Sequence
  Synthetic oligonucleotide; TTA chr11 5295346 5295367 5295363 5295368 +
caatagtacttgaggcacagag

SEQ ID NO: 95833 - DNA, 22 bp, Artificial Sequence
  Synthetic oligonucleotide; CTT chr11 5295357 5295378 5295374 5295379 +
gaggcacagagttactgtgaat

SEQ ID NO: 95834 - DNA, 22 bp, Artificial Sequence
  Synthetic oligonucleotide; TTG chr11 5295358 5295379 5295375 5295380 +
aggcacagagttactgtgaata

SEQ ID NO: 95835 - DNA, 22 bp, Artificial Sequence
  Synthetic oligonucleotide; TTA chr11 5295371 5295392 5295388 5295393 +
ctgtgaatactaaatgaaataa

SEQ ID NO: 95836 - DNA, 22 bp, Artificial Sequence
  Synthetic oligonucleotide; CTG chr11 5295374 5295395 5295391 5295396 +
tgaatactaaatgaaataatat

SEQ ID NO: 95837 - DNA, 22 bp, Artificial Sequence
  Synthetic oligonucleotide; CTA chr11 5295383 5295404 5295400 5295405 +
aatgaaataatatatcaacagt

SEQ ID NO: 95838 - DNA, 22 bp, Artificial Sequence
  Synthetic oligonucleotide; CTT chr11 5295410 5295431 5295427 5295432 +
gtgtatagtataagccataatc

SEQ ID NO: 95839 - DNA, 22 bp, Artificial Sequence
  Synthetic oligonucleotide; TTG chr11 5295411 5295432 5295428 5295433 +
tgtatagtataagccataatca

SEQ ID NO: 95840 - DNA, 22 bp, Artificial Sequence
  Synthetic oligonucleotide; TTG chr11 5295436 5295457 5295453 5295458 +
tattgttattactattactact

SEQ ID NO: 95841 - DNA, 22 bp, Artificial Sequence
  Synthetic oligonucleotide; TTG chr11 5295441 5295462 5295458 5295463 +
ttattactattactactattat

SEQ ID NO: 95842 - DNA, 22 bp, Artificial Sequence
  Synthetic oligonucleotide; TTA chr11 5295444 5295465 5295461 5295466 +
ttactattactactattattac

SEQ ID NO: 95843 - DNA, 22 bp, Artificial Sequence
  Synthetic oligonucleotide; TTA chr11 5295447 5295468 5295464 5295469 +
ctattactactattattactat

SEQ ID NO: 95844 - DNA, 22 bp, Artificial Sequence
  Synthetic oligonucleotide; CTA chr11 5295450 5295471 5295467 5295472 +
ttactactattattactattac

SEQ ID NO: 95845 - DNA, 22 bp, Artificial Sequence
  Synthetic oligonucleotide; TTA chr11 5295453 5295474 5295470 5295475 +
ctactattattactattacttt

SEQ ID NO: 95846 - DNA, 22 bp, Artificial Sequence
  Synthetic oligonucleotide; CTA chr11 5295456 5295477 5295473 5295478 +
ctattattactattacttttat

SEQ ID NO: 95847 - DNA, 22 bp, Artificial Sequence
  Synthetic oligonucleotide; CTA chr11 5295459 5295480 5295476 5295481 +
ttattactattacttttatact

SEQ ID NO: 95848 - DNA, 22 bp, Artificial Sequence
  Synthetic oligonucleotide; TTA chr11 5295462 5295483 5295479 5295484 +
ttactattacttttatactatc

SEQ ID NO: 95849 - DNA, 22 bp, Artificial Sequence
  Synthetic oligonucleotide; TTA chr11 5295465 5295486 5295482 5295487 +
ctattacttttatactatccta

SEQ ID NO: 95850 - DNA, 22 bp, Artificial Sequence
  Synthetic oligonucleotide; CTA chr11 5295468 5295489 5295485 5295490 +
ttacttttatactatcctagtg

SEQ ID NO: 95851 - DNA, 22 bp, Artificial Sequence
  Synthetic oligonucleotide; TTA chr11 5295471 5295492 5295488 5295493 +
cttttatactatcctagtgtgt

SEQ ID NO: 95852 - DNA, 22 bp, Artificial Sequence
  Synthetic oligonucleotide; CTT chr11 5295474 5295495 5295491 5295496 +
ttatactatcctagtgtgtaga

SEQ ID NO: 95853 - DNA, 22 bp, Artificial Sequence
  Synthetic oligonucleotide; TTT chr11 5295475 5295496 5295492 5295497 +
tatactatcctagtgtgtagat

SEQ ID NO: 95854 - DNA, 22 bp, Artificial Sequence
  Synthetic oligonucleotide; TTT chr11 5295476 5295497 5295493 5295498 +
atactatcctagtgtgtagatt

SEQ ID NO: 95855 - DNA, 22 bp, Artificial Sequence
  Synthetic oligonucleotide; TTA chr11 5295477 5295498 5295494 5295499 +
tactatcctagtgtgtagattg

SEQ ID NO: 95856 - DNA, 22 bp, Artificial Sequence
  Synthetic oligonucleotide; CTA chr11 5295482 5295503 5295499 5295504 +
tcctagtgtgtagattgaggat

SEQ ID NO: 95857 - DNA, 22 bp, Artificial Sequence
  Synthetic oligonucleotide; CTA chr11 5295487 5295508 5295504 5295509 +
gtgtgtagattgaggatgtagg

SEQ ID NO: 95858 - DNA, 22 bp, Artificial Sequence
  Synthetic oligonucleotide; TTG chr11 5295499 5295520 5295516 5295521 +
aggatgtaggggcttagagcaa

SEQ ID NO: 95859 - DNA, 22 bp, Artificial Sequence
  Synthetic oligonucleotide; CTT chr11 5295514 5295535 5295531 5295536 +
agagcaaagacatgaaggtcac

SEQ ID NO: 95860 - DNA, 22 bp, Artificial Sequence
  Synthetic oligonucleotide; TTA chr11 5295515 5295536 5295532 5295537 +
gagcaaagacatgaaggtcaca

SEQ ID NO: 95861 - DNA, 22 bp, Artificial Sequence
  Synthetic oligonucleotide; TTG chr11 5295576 5295597 5295593 5295598 +
tcaaggattacacgagtctttc

SEQ ID NO: 95862 - DNA, 22 bp, Artificial Sequence
  Synthetic oligonucleotide; TTA chr11 5295586 5295607 5295603 5295608 +
cacgagtctttctctgcaaagc

SEQ ID NO: 95863 - DNA, 22 bp, Artificial Sequence
  Synthetic oligonucleotide; CTT chr11 5295596 5295617 5295613 5295618 +
tctctgcaaagcgagggaaggt

SEQ ID NO: 95864 - DNA, 22 bp, Artificial Sequence
  Synthetic oligonucleotide; TTT chr11 5295597 5295618 5295614 5295619 +
ctctgcaaagcgagggaaggtt

SEQ ID NO: 95865 - DNA, 22 bp, Artificial Sequence
  Synthetic oligonucleotide; TTC chr11 5295598 5295619 5295615 5295620 +
tctgcaaagcgagggaaggtta

SEQ ID NO: 95866 - DNA, 22 bp, Artificial Sequence
  Synthetic oligonucleotide; CTC chr11 5295600 5295621 5295617 5295622 +
tgcaaagcgagggaaggttagt

SEQ ID NO: 95867 - DNA, 22 bp, Artificial Sequence
  Synthetic oligonucleotide; CTG chr11 5295602 5295623 5295619 5295624 +
caaagcgagggaaggttagtct

SEQ ID NO: 95868 - DNA, 22 bp, Artificial Sequence
  Synthetic oligonucleotide; TTA chr11 5295620 5295641 5295637 5295642 +
gtctctttcagagaacatcatg

SEQ ID NO: 95869 - DNA, 22 bp, Artificial Sequence
  Synthetic oligonucleotide; CTC chr11 5295625 5295646 5295642 5295647 +
tttcagagaacatcatggcaga

SEQ ID NO: 95870 - DNA, 22 bp, Artificial Sequence
  Synthetic oligonucleotide; CTT chr11 5295627 5295648 5295644 5295649 +
tcagagaacatcatggcagaaa

SEQ ID NO: 95871 - DNA, 22 bp, Artificial Sequence
  Synthetic oligonucleotide; TTT chr11 5295628 5295649 5295645 5295650 +
cagagaacatcatggcagaaac

SEQ ID NO: 95872 - DNA, 22 bp, Artificial Sequence
  Synthetic oligonucleotide; TTC chr11 5295629 5295650 5295646 5295651 +
agagaacatcatggcagaaaca

SEQ ID NO: 95873 - DNA, 22 bp, Artificial Sequence
  Synthetic oligonucleotide; TTT chr11 5295654 5295675 5295671 5295676 +
tttcaagagaatccatgcattt

SEQ ID NO: 95874 - DNA, 22 bp, Artificial Sequence
  Synthetic oligonucleotide; TTT chr11 5295655 5295676 5295672 5295677 +
ttcaagagaatccatgcatttt

SEQ ID NO: 95875 - DNA, 22 bp, Artificial Sequence
  Synthetic oligonucleotide; TTT chr11 5295656 5295677 5295673 5295678 +
tcaagagaatccatgcatttta

SEQ ID NO: 95876 - DNA, 22 bp, Artificial Sequence
  Synthetic oligonucleotide; TTT chr11 5295657 5295678 5295674 5295679 +
caagagaatccatgcattttac

SEQ ID NO: 95877 - DNA, 22 bp, Artificial Sequence
  Synthetic oligonucleotide; TTC chr11 5295658 5295679 5295675 5295680 +
aagagaatccatgcattttacg

SEQ ID NO: 95878 - DNA, 22 bp, Artificial Sequence
  Synthetic oligonucleotide; TTT chr11 5295676 5295697 5295693 5295698 +
tacgtccatgtagttgcaaaca

SEQ ID NO: 95879 - DNA, 22 bp, Artificial Sequence
  Synthetic oligonucleotide; TTT chr11 5295677 5295698 5295694 5295699 +
acgtccatgtagttgcaaacaa

SEQ ID NO: 95880 - DNA, 22 bp, Artificial Sequence
  Synthetic oligonucleotide; TTA chr11 5295678 5295699 5295695 5295700 +
cgtccatgtagttgcaaacaat

SEQ ID NO: 95881 - DNA, 22 bp, Artificial Sequence
  Synthetic oligonucleotide; TTG chr11 5295692 5295713 5295709 5295714 +
caaacaatgccaagtagaactc

SEQ ID NO: 95882 - DNA, 22 bp, Artificial Sequence
  Synthetic oligonucleotide; CTC chr11 5295714 5295735 5295731 5295736 +
caatccagagctaagtggggct

SEQ ID NO: 95883 - DNA, 22 bp, Artificial Sequence
  Synthetic oligonucleotide; CTA chr11 5295727 5295748 5295744 5295749 +
agtggggctgtgggaactatgt

SEQ ID NO: 95884 - DNA, 22 bp, Artificial Sequence
  Synthetic oligonucleotide; CTG chr11 5295737 5295758 5295754 5295759 +
tgggaactatgtaccaattgat

SEQ ID NO: 95885 - DNA, 22 bp, Artificial Sequence
  Synthetic oligonucleotide; CTA chr11 5295746 5295767 5295763 5295768 +
tgtaccaattgatggacatgct

SEQ ID NO: 95886 - DNA, 22 bp, Artificial Sequence
  Synthetic oligonucleotide; TTG chr11 5295757 5295778 5295774 5295779 +
atggacatgctgctttttgact

SEQ ID NO: 95887 - DNA, 22 bp, Artificial Sequence
  Synthetic oligonucleotide; CTG chr11 5295769 5295790 5295786 5295791 +
ctttttgactcagaggtggata

SEQ ID NO: 95888 - DNA, 22 bp, Artificial Sequence
  Synthetic oligonucleotide; CTT chr11 5295772 5295793 5295789 5295794 +
tttgactcagaggtggataaga

SEQ ID NO: 95889 - DNA, 22 bp, Artificial Sequence
  Synthetic oligonucleotide; TTT chr11 5295773 5295794 5295790 5295795 +
ttgactcagaggtggataagag

SEQ ID NO: 95890 - DNA, 22 bp, Artificial Sequence
  Synthetic oligonucleotide; TTT chr11 5295774 5295795 5295791 5295796 +
tgactcagaggtggataagaga

SEQ ID NO: 95891 - DNA, 22 bp, Artificial Sequence
  Synthetic oligonucleotide; TTT chr11 5295775 5295796 5295792 5295797 +
gactcagaggtggataagagac

SEQ ID NO: 95892 - DNA, 22 bp, Artificial Sequence
  Synthetic oligonucleotide; TTG chr11 5295776 5295797 5295793 5295798 +
actcagaggtggataagagaca

SEQ ID NO: 95893 - DNA, 22 bp, Artificial Sequence
  Synthetic oligonucleotide; CTC chr11 5295780 5295801 5295797 5295802 +
agaggtggataagagacaaaac

SEQ ID NO: 95894 - DNA, 22 bp, Artificial Sequence
  Synthetic oligonucleotide; CTC chr11 5295804 5295825 5295821 5295826 +
ttttcttcttagatgtactaaa

SEQ ID NO: 95895 - DNA, 22 bp, Artificial Sequence
  Synthetic oligonucleotide; CTT chr11 5295806 5295827 5295823 5295828 +
ttcttcttagatgtactaaaaa

SEQ ID NO: 95896 - DNA, 22 bp, Artificial Sequence
  Synthetic oligonucleotide; TTT chr11 5295807 5295828 5295824 5295829 +
tcttcttagatgtactaaaaag

SEQ ID NO: 95897 - DNA, 22 bp, Artificial Sequence
  Synthetic oligonucleotide; TTT chr11 5295808 5295829 5295825 5295830 +
cttcttagatgtactaaaaagt

SEQ ID NO: 95898 - DNA, 22 bp, Artificial Sequence
  Synthetic oligonucleotide; TTC chr11 5295809 5295830 5295826 5295831 +
ttcttagatgtactaaaaagta

SEQ ID NO: 95899 - DNA, 22 bp, Artificial Sequence
  Synthetic oligonucleotide; CTT chr11 5295811 5295832 5295828 5295833 +
cttagatgtactaaaaagtagt

SEQ ID NO: 95900 - DNA, 22 bp, Artificial Sequence
  Synthetic oligonucleotide; TTC chr11 5295812 5295833 5295829 5295834 +
ttagatgtactaaaaagtagtt

SEQ ID NO: 95901 - DNA, 22 bp, Artificial Sequence
  Synthetic oligonucleotide; CTT chr11 5295814 5295835 5295831 5295836 +
agatgtactaaaaagtagttag

SEQ ID NO: 95902 - DNA, 22 bp, Artificial Sequence
  Synthetic oligonucleotide; TTA chr11 5295815 5295836 5295832 5295837 +
gatgtactaaaaagtagttagt

SEQ ID NO: 95903 - DNA, 22 bp, Artificial Sequence
  Synthetic oligonucleotide; CTA chr11 5295824 5295845 5295841 5295846 +
aaaagtagttagtctggaagta

SEQ ID NO: 95904 - DNA, 22 bp, Artificial Sequence
  Synthetic oligonucleotide; TTA chr11 5295835 5295856 5295852 5295857 +
gtctggaagtatttagaaggct

SEQ ID NO: 95905 - DNA, 22 bp, Artificial Sequence
  Synthetic oligonucleotide; CTG chr11 5295840 5295861 5295857 5295862 +
gaagtatttagaaggctttgga

SEQ ID NO: 95906 - DNA, 22 bp, Artificial Sequence
  Synthetic oligonucleotide; TTT chr11 5295849 5295870 5295866 5295871 +
agaaggctttggagaggaatgt

SEQ ID NO: 95907 - DNA, 22 bp, Artificial Sequence
  Synthetic oligonucleotide; TTA chr11 5295850 5295871 5295867 5295872 +
gaaggctttggagaggaatgtg

SEQ ID NO: 95908 - DNA, 22 bp, Artificial Sequence
  Synthetic oligonucleotide; CTT chr11 5295858 5295879 5295875 5295880 +
tggagaggaatgtgattttatc

SEQ ID NO: 95909 - DNA, 22 bp, Artificial Sequence
  Synthetic oligonucleotide; TTT chr11 5295859 5295880 5295876 5295881 +
ggagaggaatgtgattttatca

SEQ ID NO: 95910 - DNA, 22 bp, Artificial Sequence
  Synthetic oligonucleotide; TTG chr11 5295860 5295881 5295877 5295882 +
gagaggaatgtgattttatcag

SEQ ID NO: 95911 - DNA, 22 bp, Artificial Sequence
  Synthetic oligonucleotide; TTT chr11 5295876 5295897 5295893 5295898 +
tatcaggtaaatcaaaaataga

SEQ ID NO: 95912 - DNA, 22 bp, Artificial Sequence
  Synthetic oligonucleotide; TTT chr11 5295877 5295898 5295894 5295899 +
atcaggtaaatcaaaaatagag

SEQ ID NO: 95913 - DNA, 22 bp, Artificial Sequence
  Synthetic oligonucleotide; TTA chr11 5295878 5295899 5295895 5295900 +
tcaggtaaatcaaaaatagagg

SEQ ID NO: 95914 - DNA, 22 bp, Artificial Sequence
  Synthetic oligonucleotide; CTA chr11 5295903 5295924 5295920 5295925 +
tttctgaaagaagcaactagaa

SEQ ID NO: 95915 - DNA, 22 bp, Artificial Sequence
  Synthetic oligonucleotide; TTT chr11 5295906 5295927 5295923 5295928 +
ctgaaagaagcaactagaacca

SEQ ID NO: 95916 - DNA, 22 bp, Artificial Sequence
  Synthetic oligonucleotide; TTC chr11 5295907 5295928 5295924 5295929 +
tgaaagaagcaactagaaccaa

SEQ ID NO: 95917 - DNA, 22 bp, Artificial Sequence
  Synthetic oligonucleotide; CTG chr11 5295909 5295930 5295926 5295931 +
aaagaagcaactagaaccaagt

SEQ ID NO: 95918 - DNA, 22 bp, Artificial Sequence
  Synthetic oligonucleotide; CTA chr11 5295922 5295943 5295939 5295944 +
gaaccaagttacacacagaaaa

SEQ ID NO: 95919 - DNA, 22 bp, Artificial Sequence
  Synthetic oligonucleotide; TTA chr11 5295933 5295954 5295950 5295955 +
cacacagaaaatacccataatg

SEQ ID NO: 95920 - DNA, 22 bp, Artificial Sequence
  Synthetic oligonucleotide; TTT chr11 5295966 5295987 5295983 5295988 +
ttgactagagtagcatgtgcaa

SEQ ID NO: 95921 - DNA, 22 bp, Artificial Sequence
  Synthetic oligonucleotide; TTT chr11 5295967 5295988 5295984 5295989 +
tgactagagtagcatgtgcaaa

SEQ ID NO: 95922 - DNA, 22 bp, Artificial Sequence
  Synthetic oligonucleotide; TTT chr11 5295968 5295989 5295985 5295990 +
gactagagtagcatgtgcaaat

SEQ ID NO: 95923 - DNA, 22 bp, Artificial Sequence
  Synthetic oligonucleotide; TTG chr11 5295969 5295990 5295986 5295991 +
actagagtagcatgtgcaaatt

SEQ ID NO: 95924 - DNA, 22 bp, Artificial Sequence
  Synthetic oligonucleotide; CTA chr11 5295973 5295994 5295990 5295995 +
gagtagcatgtgcaaatttgta

SEQ ID NO: 95925 - DNA, 22 bp, Artificial Sequence
  Synthetic oligonucleotide; TTT chr11 5295992 5296013 5296009 5296014 +
gtataaaatatttgcaggtaag

SEQ ID NO: 95926 - DNA, 22 bp, Artificial Sequence
  Synthetic oligonucleotide; TTG chr11 5295993 5296014 5296010 5296015 +
tataaaatatttgcaggtaagt

SEQ ID NO: 95927 - DNA, 22 bp, Artificial Sequence
  Synthetic oligonucleotide; TTT chr11 5296005 5296026 5296022 5296027 +
gcaggtaagttaggtaatgcaa

SEQ ID NO: 95928 - DNA, 22 bp, Artificial Sequence
  Synthetic oligonucleotide; TTG chr11 5296006 5296027 5296023 5296028 +
caggtaagttaggtaatgcaac

SEQ ID NO: 95929 - DNA, 22 bp, Artificial Sequence
  Synthetic oligonucleotide; TTA chr11 5296017 5296038 5296034 5296039 +
ggtaatgcaacatttgagactc

SEQ ID NO: 95930 - DNA, 22 bp, Artificial Sequence
  Synthetic oligonucleotide; TTT chr11 5296032 5296053 5296049 5296054 +
gagactctaagtttgtgggaaa

SEQ ID NO: 95931 - DNA, 22 bp, Artificial Sequence
  Synthetic oligonucleotide; TTG chr11 5296033 5296054 5296050 5296055 +
agactctaagtttgtgggaaac

SEQ ID NO: 95932 - DNA, 22 bp, Artificial Sequence
  Synthetic oligonucleotide; CTC chr11 5296039 5296060 5296056 5296061 +
taagtttgtgggaaacttagaa

SEQ ID NO: 95933 - DNA, 22 bp, Artificial Sequence
  Synthetic oligonucleotide; CTA chr11 5296041 5296062 5296058 5296063 +
agtttgtgggaaacttagaact

SEQ ID NO: 95934 - DNA, 22 bp, Artificial Sequence
  Synthetic oligonucleotide; TTT chr11 5296046 5296067 5296063 5296068 +
gtgggaaacttagaactgtttc

SEQ ID NO: 95935 - DNA, 22 bp, Artificial Sequence
  Synthetic oligonucleotide; TTG chr11 5296047 5296068 5296064 5296069 +
tgggaaacttagaactgtttca

SEQ ID NO: 95936 - DNA, 22 bp, Artificial Sequence
  Synthetic oligonucleotide; CTT chr11 5296057 5296078 5296074 5296079 +
agaactgtttcagttttctaca

SEQ ID NO: 95937 - DNA, 22 bp, Artificial Sequence
  Synthetic oligonucleotide; TTA chr11 5296058 5296079 5296075 5296080 +
gaactgtttcagttttctacat

SEQ ID NO: 95938 - DNA, 22 bp, Artificial Sequence
  Synthetic oligonucleotide; CTG chr11 5296064 5296085 5296081 5296086 +
tttcagttttctacattattcc

SEQ ID NO: 95939 - DNA, 22 bp, Artificial Sequence
  Synthetic oligonucleotide; TTT chr11 5296067 5296088 5296084 5296089 +
cagttttctacattattcctaa

SEQ ID NO: 95940 - DNA, 22 bp, Artificial Sequence
  Synthetic oligonucleotide; TTC chr11 5296068 5296089 5296085 5296090 +
agttttctacattattcctaac

SEQ ID NO: 95941 - DNA, 22 bp, Artificial Sequence
  Synthetic oligonucleotide; TTT chr11 5296073 5296094 5296090 5296095 +
tctacattattcctaactattt

SEQ ID NO: 95942 - DNA, 22 bp, Artificial Sequence
  Synthetic oligonucleotide; TTT chr11 5296074 5296095 5296091 5296096 +
ctacattattcctaactattta

SEQ ID NO: 95943 - DNA, 22 bp, Artificial Sequence
  Synthetic oligonucleotide; TTC chr11 5296075 5296096 5296092 5296097 +
tacattattcctaactatttaa

SEQ ID NO: 95944 - DNA, 22 bp, Artificial Sequence
  Synthetic oligonucleotide; CTA chr11 5296077 5296098 5296094 5296099 +
cattattcctaactatttaaaa

SEQ ID NO: 95945 - DNA, 22 bp, Artificial Sequence
  Synthetic oligonucleotide; TTA chr11 5296082 5296103 5296099 5296104 +
ttcctaactatttaaaatgcta

SEQ ID NO: 95946 - DNA, 22 bp, Artificial Sequence
  Synthetic oligonucleotide; TTC chr11 5296085 5296106 5296102 5296107 +
ctaactatttaaaatgctatga

SEQ ID NO: 95947 - DNA, 22 bp, Artificial Sequence
  Synthetic oligonucleotide; CTA chr11 5296088 5296109 5296105 5296110 +
actatttaaaatgctatgaaat

SEQ ID NO: 95948 - DNA, 22 bp, Artificial Sequence
  Synthetic oligonucleotide; CTA chr11 5296092 5296113 5296109 5296114 +
tttaaaatgctatgaaatgatt

SEQ ID NO: 95949 - DNA, 22 bp, Artificial Sequence
  Synthetic oligonucleotide; TTT chr11 5296095 5296116 5296112 5296117 +
aaaatgctatgaaatgattttg

SEQ ID NO: 95950 - DNA, 22 bp, Artificial Sequence
  Synthetic oligonucleotide; TTA chr11 5296096 5296117 5296113 5296118 +
aaatgctatgaaatgattttgc

SEQ ID NO: 95951 - DNA, 22 bp, Artificial Sequence
  Synthetic oligonucleotide; CTA chr11 5296104 5296125 5296121 5296126 +
tgaaatgattttgcagattttt

SEQ ID NO: 95952 - DNA, 22 bp, Artificial Sequence
  Synthetic oligonucleotide; TTT chr11 5296115 5296136 5296132 5296137 +
tgcagatttttctgagatgttt

SEQ ID NO: 95953 - DNA, 22 bp, Artificial Sequence
  Synthetic oligonucleotide; TTT chr11 5296116 5296137 5296133 5296138 +
gcagatttttctgagatgttta

SEQ ID NO: 95954 - DNA, 22 bp, Artificial Sequence
  Synthetic oligonucleotide; TTG chr11 5296117 5296138 5296134 5296139 +
cagatttttctgagatgtttat

SEQ ID NO: 95955 - DNA, 22 bp, Artificial Sequence
  Synthetic oligonucleotide; TTT chr11 5296124 5296145 5296141 5296146 +
ttctgagatgtttatagtgata

SEQ ID NO: 95956 - DNA, 22 bp, Artificial Sequence
  Synthetic oligonucleotide; TTT chr11 5296125 5296146 5296142 5296147 +
tctgagatgtttatagtgataa

SEQ ID NO: 95957 - DNA, 22 bp, Artificial Sequence
  Synthetic oligonucleotide; TTT chr11 5296126 5296147 5296143 5296148 +
ctgagatgtttatagtgataag

SEQ ID NO: 95958 - DNA, 22 bp, Artificial Sequence
  Synthetic oligonucleotide; TTC chr11 5296127 5296148 5296144 5296149 +
tgagatgtttatagtgataagt

SEQ ID NO: 95959 - DNA, 22 bp, Artificial Sequence
  Synthetic oligonucleotide; CTG chr11 5296129 5296150 5296146 5296151 +
agatgtttatagtgataagtga

SEQ ID NO: 95960 - DNA, 22 bp, Artificial Sequence
  Synthetic oligonucleotide; TTT chr11 5296137 5296158 5296154 5296159 +
atagtgataagtgagaatatat

SEQ ID NO: 95961 - DNA, 22 bp, Artificial Sequence
  Synthetic oligonucleotide; TTA chr11 5296138 5296159 5296155 5296160 +
tagtgataagtgagaatatatg

SEQ ID NO: 95962 - DNA, 22 bp, Artificial Sequence
  Synthetic oligonucleotide; CTG chr11 5296170 5296191 5296187 5296192 +
ttcctttgttgtataactctgt

SEQ ID NO: 95963 - DNA, 22 bp, Artificial Sequence
  Synthetic oligonucleotide; TTC chr11 5296173 5296194 5296190 5296195 +
ctttgttgtataactctgttta

SEQ ID NO: 95964 - DNA, 22 bp, Artificial Sequence
  Synthetic oligonucleotide; CTT chr11 5296176 5296197 5296193 5296198 +
tgttgtataactctgtttaaaa

SEQ ID NO: 95965 - DNA, 22 bp, Artificial Sequence
  Synthetic oligonucleotide; TTT chr11 5296177 5296198 5296194 5296199 +
gttgtataactctgtttaaaat

SEQ ID NO: 95966 - DNA, 22 bp, Artificial Sequence
  Synthetic oligonucleotide; TTG chr11 5296178 5296199 5296195 5296200 +
ttgtataactctgtttaaaata

SEQ ID NO: 95967 - DNA, 22 bp, Artificial Sequence
  Synthetic oligonucleotide; TTG chr11 5296181 5296202 5296198 5296203 +
tataactctgtttaaaatatct

SEQ ID NO: 95968 - DNA, 22 bp, Artificial Sequence
  Synthetic oligonucleotide; CTC chr11 5296189 5296210 5296206 5296211 +
tgtttaaaatatcttttatata

SEQ ID NO: 95969 - DNA, 22 bp, Artificial Sequence
  Synthetic oligonucleotide; CTG chr11 5296191 5296212 5296208 5296213 +
tttaaaatatcttttatataat

SEQ ID NO: 95970 - DNA, 22 bp, Artificial Sequence
  Synthetic oligonucleotide; TTT chr11 5296194 5296215 5296211 5296216 +
aaaatatcttttatataatgat

SEQ ID NO: 95971 - DNA, 22 bp, Artificial Sequence
  Synthetic oligonucleotide; TTA chr11 5296195 5296216 5296212 5296217 +
aaatatcttttatataatgata

SEQ ID NO: 95972 - DNA, 22 bp, Artificial Sequence
  Synthetic oligonucleotide; CTT chr11 5296204 5296225 5296221 5296226 +
ttatataatgataaaaaatcta

SEQ ID NO: 95973 - DNA, 22 bp, Artificial Sequence
  Synthetic oligonucleotide; TTT chr11 5296205 5296226 5296222 5296227 +
tatataatgataaaaaatctat

SEQ ID NO: 95974 - DNA, 22 bp, Artificial Sequence
  Synthetic oligonucleotide; TTT chr11 5296206 5296227 5296223 5296228 +
atataatgataaaaaatctatc

SEQ ID NO: 95975 - DNA, 22 bp, Artificial Sequence
  Synthetic oligonucleotide; TTA chr11 5296207 5296228 5296224 5296229 +
tataatgataaaaaatctatct

SEQ ID NO: 95976 - DNA, 22 bp, Artificial Sequence
  Synthetic oligonucleotide; CTA chr11 5296226 5296247 5296243 5296248 +
tctctttgtaacttaccacagc

SEQ ID NO: 95977 - DNA, 22 bp, Artificial Sequence
  Synthetic oligonucleotide; CTC chr11 5296230 5296251 5296247 5296252 +
tttgtaacttaccacagcagat

SEQ ID NO: 95978 - DNA, 22 bp, Artificial Sequence
  Synthetic oligonucleotide; CTT chr11 5296232 5296253 5296249 5296254 +
tgtaacttaccacagcagattt

SEQ ID NO: 95979 - DNA, 22 bp, Artificial Sequence
  Synthetic oligonucleotide; TTT chr11 5296233 5296254 5296250 5296255 +
gtaacttaccacagcagatttg

SEQ ID NO: 95980 - DNA, 22 bp, Artificial Sequence
  Synthetic oligonucleotide; TTG chr11 5296234 5296255 5296251 5296256 +
taacttaccacagcagatttgt

SEQ ID NO: 95981 - DNA, 22 bp, Artificial Sequence
  Synthetic oligonucleotide; CTT chr11 5296240 5296261 5296257 5296262 +
accacagcagatttgtattatt

SEQ ID NO: 95982 - DNA, 22 bp, Artificial Sequence
  Synthetic oligonucleotide; TTA chr11 5296241 5296262 5296258 5296263 +
ccacagcagatttgtattattt

SEQ ID NO: 95983 - DNA, 22 bp, Artificial Sequence
  Synthetic oligonucleotide; TTT chr11 5296254 5296275 5296271 5296276 +
gtattattttatgtgaagaaac

SEQ ID NO: 95984 - DNA, 22 bp, Artificial Sequence
  Synthetic oligonucleotide; TTG chr11 5296255 5296276 5296272 5296277 +
tattattttatgtgaagaaact

SEQ ID NO: 95985 - DNA, 22 bp, Artificial Sequence
  Synthetic oligonucleotide; TTA chr11 5296260 5296281 5296277 5296282 +
ttttatgtgaagaaactcagaa

SEQ ID NO: 95986 - DNA, 22 bp, Artificial Sequence
  Synthetic oligonucleotide; TTT chr11 5296263 5296284 5296280 5296285 +
tatgtgaagaaactcagaatat

SEQ ID NO: 95987 - DNA, 22 bp, Artificial Sequence
  Synthetic oligonucleotide; TTT chr11 5296264 5296285 5296281 5296286 +
atgtgaagaaactcagaatatg

SEQ ID NO: 95988 - DNA, 22 bp, Artificial Sequence
  Synthetic oligonucleotide; TTA chr11 5296265 5296286 5296282 5296287 +
tgtgaagaaactcagaatatgg

SEQ ID NO: 95989 - DNA, 22 bp, Artificial Sequence
  Synthetic oligonucleotide; CTC chr11 5296278 5296299 5296295 5296300 +
agaatatggagtattttttttc

SEQ ID NO: 95990 - DNA, 22 bp, Artificial Sequence
  Synthetic oligonucleotide; TTT chr11 5296294 5296315 5296311 5296316 +
tttttctcaaattatcactttt

SEQ ID NO: 95991 - DNA, 22 bp, Artificial Sequence
  Synthetic oligonucleotide; TTT chr11 5296295 5296316 5296312 5296317 +
ttttctcaaattatcactttta

SEQ ID NO: 95992 - DNA, 22 bp, Artificial Sequence
  Synthetic oligonucleotide; TTT chr11 5296296 5296317 5296313 5296318 +
tttctcaaattatcacttttat

SEQ ID NO: 95993 - DNA, 22 bp, Artificial Sequence
  Synthetic oligonucleotide; TTT chr11 5296297 5296318 5296314 5296319 +
ttctcaaattatcacttttata

SEQ ID NO: 95994 - DNA, 22 bp, Artificial Sequence
  Synthetic oligonucleotide; TTT chr11 5296298 5296319 5296315 5296320 +
tctcaaattatcacttttataa

SEQ ID NO: 95995 - DNA, 22 bp, Artificial Sequence
  Synthetic oligonucleotide; TTT chr11 5296299 5296320 5296316 5296321 +
ctcaaattatcacttttataag

SEQ ID NO: 95996 - DNA, 22 bp, Artificial Sequence
  Synthetic oligonucleotide; TTC chr11 5296300 5296321 5296317 5296322 +
tcaaattatcacttttataagg

SEQ ID NO: 95997 - DNA, 22 bp, Artificial Sequence
  Synthetic oligonucleotide; CTC chr11 5296302 5296323 5296319 5296324 +
aaattatcacttttataaggat

SEQ ID NO: 95998 - DNA, 22 bp, Artificial Sequence
  Synthetic oligonucleotide; TTA chr11 5296308 5296329 5296325 5296330 +
tcacttttataaggatctgcta

SEQ ID NO: 95999 - DNA, 22 bp, Artificial Sequence
  Synthetic oligonucleotide; CTT chr11 5296314 5296335 5296331 5296336 +
ttataaggatctgctatctatc

SEQ ID NO: 96000 - DNA, 22 bp, Artificial Sequence
  Synthetic oligonucleotide; TTT chr11 5296315 5296336 5296332 5296337 +
tataaggatctgctatctatcc

SEQ ID NO: 96001 - DNA, 22 bp, Artificial Sequence
  Synthetic oligonucleotide; TTT chr11 5296316 5296337 5296333 5296338 +
ataaggatctgctatctatcca

SEQ ID NO: 96002 - DNA, 22 bp, Artificial Sequence
  Synthetic oligonucleotide; TTA chr11 5296317 5296338 5296334 5296339 +
taaggatctgctatctatccat

SEQ ID NO: 96003 - DNA, 22 bp, Artificial Sequence
  Synthetic oligonucleotide; CTG chr11 5296327 5296348 5296344 5296349 +
ctatctatccatcttattttct

SEQ ID NO: 96004 - DNA, 22 bp, Artificial Sequence
  Synthetic oligonucleotide; CTA chr11 5296330 5296351 5296347 5296352 +
tctatccatcttattttcttta

SEQ ID NO: 96005 - DNA, 22 bp, Artificial Sequence
  Synthetic oligonucleotide; CTA chr11 5296334 5296355 5296351 5296356 +
tccatcttattttctttatgta

SEQ ID NO: 96006 - DNA, 22 bp, Artificial Sequence
  Synthetic oligonucleotide; CTT chr11 5296342 5296363 5296359 5296364 +
attttctttatgtaaaccagtg

SEQ ID NO: 96007 - DNA, 22 bp, Artificial Sequence
  Synthetic oligonucleotide; TTA chr11 5296343 5296364 5296360 5296365 +
ttttctttatgtaaaccagtgt

SEQ ID NO: 96008 - DNA, 22 bp, Artificial Sequence
  Synthetic oligonucleotide; TTT chr11 5296346 5296367 5296363 5296368 +
tctttatgtaaaccagtgtttt

SEQ ID NO: 96009 - DNA, 22 bp, Artificial Sequence
  Synthetic oligonucleotide; TTT chr11 5296347 5296368 5296364 5296369 +
ctttatgtaaaccagtgtttta

SEQ ID NO: 96010 - DNA, 22 bp, Artificial Sequence
  Synthetic oligonucleotide; TTC chr11 5296348 5296369 5296365 5296370 +
tttatgtaaaccagtgttttat

SEQ ID NO: 96011 - DNA, 22 bp, Artificial Sequence
  Synthetic oligonucleotide; CTT chr11 5296350 5296371 5296367 5296372 +
tatgtaaaccagtgttttatct

SEQ ID NO: 96012 - DNA, 22 bp, Artificial Sequence
  Synthetic oligonucleotide; TTT chr11 5296351 5296372 5296368 5296373 +
atgtaaaccagtgttttatctc

SEQ ID NO: 96013 - DNA, 22 bp, Artificial Sequence
  Synthetic oligonucleotide; TTA chr11 5296352 5296373 5296369 5296374 +
tgtaaaccagtgttttatctct

SEQ ID NO: 96014 - DNA, 22 bp, Artificial Sequence
  Synthetic oligonucleotide; TTT chr11 5296367 5296388 5296384 5296389 +
tatctcttctcattttctatca

SEQ ID NO: 96015 - DNA, 22 bp, Artificial Sequence
  Synthetic oligonucleotide; TTT chr11 5296368 5296389 5296385 5296390 +
atctcttctcattttctatcaa

SEQ ID NO: 96016 - DNA, 22 bp, Artificial Sequence
  Synthetic oligonucleotide; TTA chr11 5296369 5296390 5296386 5296391 +
tctcttctcattttctatcaag

SEQ ID NO: 96017 - DNA, 22 bp, Artificial Sequence
  Synthetic oligonucleotide; CTC chr11 5296373 5296394 5296390 5296395 +
ttctcattttctatcaaggatt

SEQ ID NO: 96018 - DNA, 22 bp, Artificial Sequence
  Synthetic oligonucleotide; CTT chr11 5296375 5296396 5296392 5296397 +
ctcattttctatcaaggattaa

SEQ ID NO: 96019 - DNA, 22 bp, Artificial Sequence
  Synthetic oligonucleotide; TTC chr11 5296376 5296397 5296393 5296398 +
tcattttctatcaaggattaat

SEQ ID NO: 96020 - DNA, 22 bp, Artificial Sequence
  Synthetic oligonucleotide; CTC chr11 5296378 5296399 5296395 5296400 +
attttctatcaaggattaatag

SEQ ID NO: 96021 - DNA, 22 bp, Artificial Sequence
  Synthetic oligonucleotide; TTT chr11 5296382 5296403 5296399 5296404 +
tctatcaaggattaatagattt

SEQ ID NO: 96022 - DNA, 22 bp, Artificial Sequence
  Synthetic oligonucleotide; TTT chr11 5296383 5296404 5296400 5296405 +
ctatcaaggattaatagatttt

SEQ ID NO: 96023 - DNA, 22 bp, Artificial Sequence
  Synthetic oligonucleotide; TTC chr11 5296384 5296405 5296401 5296406 +
tatcaaggattaatagattttt

SEQ ID NO: 96024 - DNA, 22 bp, Artificial Sequence
  Synthetic oligonucleotide; CTA chr11 5296386 5296407 5296403 5296408 +
tcaaggattaatagatttttgt

SEQ ID NO: 96025 - DNA, 22 bp, Artificial Sequence
  Synthetic oligonucleotide; TTA chr11 5296396 5296417 5296413 5296418 +
atagatttttgtcatctttatt

SEQ ID NO: 96026 - DNA, 22 bp, Artificial Sequence
  Synthetic oligonucleotide; TTT chr11 5296404 5296425 5296421 5296426 +
ttgtcatctttattgtcttttt

SEQ ID NO: 96027 - DNA, 22 bp, Artificial Sequence
  Synthetic oligonucleotide; TTT chr11 5296405 5296426 5296422 5296427 +
tgtcatctttattgtctttttt

SEQ ID NO: 96028 - DNA, 22 bp, Artificial Sequence
  Synthetic oligonucleotide; TTT chr11 5296406 5296427 5296423 5296428 +
gtcatctttattgtcttttttt

SEQ ID NO: 96029 - DNA, 22 bp, Artificial Sequence
  Synthetic oligonucleotide; TTG chr11 5296407 5296428 5296424 5296429 +
tcatctttattgtctttttttc

SEQ ID NO: 96030 - DNA, 22 bp, Artificial Sequence
  Synthetic oligonucleotide; CTT chr11 5296414 5296435 5296431 5296436 +
tattgtctttttttctccaact

SEQ ID NO: 96031 - DNA, 22 bp, Artificial Sequence
  Synthetic oligonucleotide; TTT chr11 5296415 5296436 5296432 5296437 +
attgtctttttttctccaactt

SEQ ID NO: 96032 - DNA, 22 bp, Artificial Sequence
  Synthetic oligonucleotide; TTA chr11 5296416 5296437 5296433 5296438 +
ttgtctttttttctccaacttt

SEQ ID NO: 96033 - DNA, 22 bp, Artificial Sequence
  Synthetic oligonucleotide; TTG chr11 5296419 5296440 5296436 5296441 +
tctttttttctccaactttttg

SEQ ID NO: 96034 - DNA, 22 bp, Artificial Sequence
  Synthetic oligonucleotide; CTT chr11 5296423 5296444 5296440 5296445 +
tttttctccaactttttgtatc

SEQ ID NO: 96035 - DNA, 22 bp, Artificial Sequence
  Synthetic oligonucleotide; TTT chr11 5296424 5296445 5296441 5296446 +
ttttctccaactttttgtatct

SEQ ID NO: 96036 - DNA, 22 bp, Artificial Sequence
  Synthetic oligonucleotide; TTT chr11 5296425 5296446 5296442 5296447 +
tttctccaactttttgtatcta

SEQ ID NO: 96037 - DNA, 22 bp, Artificial Sequence
  Synthetic oligonucleotide; TTT chr11 5296426 5296447 5296443 5296448 +
ttctccaactttttgtatctac

SEQ ID NO: 96038 - DNA, 22 bp, Artificial Sequence
  Synthetic oligonucleotide; TTT chr11 5296427 5296448 5296444 5296449 +
tctccaactttttgtatctaca

SEQ ID NO: 96039 - DNA, 22 bp, Artificial Sequence
  Synthetic oligonucleotide; TTT chr11 5296428 5296449 5296445 5296450 +
ctccaactttttgtatctacag

SEQ ID NO: 96040 - DNA, 22 bp, Artificial Sequence
  Synthetic oligonucleotide; TTC chr11 5296429 5296450 5296446 5296451 +
tccaactttttgtatctacagg

SEQ ID NO: 96041 - DNA, 22 bp, Artificial Sequence
  Synthetic oligonucleotide; CTC chr11 5296431 5296452 5296448 5296453 +
caactttttgtatctacaggtt

SEQ ID NO: 96042 - DNA, 22 bp, Artificial Sequence
  Synthetic oligonucleotide; CTT chr11 5296437 5296458 5296454 5296459 +
tttgtatctacaggttcctacc

SEQ ID NO: 96043 - DNA, 22 bp, Artificial Sequence
  Synthetic oligonucleotide; TTT chr11 5296438 5296459 5296455 5296460 +
ttgtatctacaggttcctacct

SEQ ID NO: 96044 - DNA, 22 bp, Artificial Sequence
  Synthetic oligonucleotide; TTT chr11 5296439 5296460 5296456 5296461 +
tgtatctacaggttcctacctt

SEQ ID NO: 96045 - DNA, 22 bp, Artificial Sequence
  Synthetic oligonucleotide; TTT chr11 5296440 5296461 5296457 5296462 +
gtatctacaggttcctaccttc

SEQ ID NO: 96046 - DNA, 22 bp, Artificial Sequence
  Synthetic oligonucleotide; TTG chr11 5296441 5296462 5296458 5296463 +
tatctacaggttcctaccttca

SEQ ID NO: 96047 - DNA, 22 bp, Artificial Sequence
  Synthetic oligonucleotide; CTA chr11 5296447 5296468 5296464 5296469 +
caggttcctaccttcatttata

SEQ ID NO: 96048 - DNA, 22 bp, Artificial Sequence
  Synthetic oligonucleotide; TTC chr11 5296454 5296475 5296471 5296476 +
ctaccttcatttatattttaaa

SEQ ID NO: 96049 - DNA, 22 bp, Artificial Sequence
  Synthetic oligonucleotide; CTA chr11 5296457 5296478 5296474 5296479 +
ccttcatttatattttaaagta

SEQ ID NO: 96050 - DNA, 22 bp, Artificial Sequence
  Synthetic oligonucleotide; CTT chr11 5296461 5296482 5296478 5296483 +
catttatattttaaagtaggtg

SEQ ID NO: 96051 - DNA, 22 bp, Artificial Sequence
  Synthetic oligonucleotide; TTC chr11 5296462 5296483 5296479 5296484 +
atttatattttaaagtaggtga

SEQ ID NO: 96052 - DNA, 22 bp, Artificial Sequence
  Synthetic oligonucleotide; TTT chr11 5296466 5296487 5296483 5296488 +
atattttaaagtaggtgagcaa

SEQ ID NO: 96053 - DNA, 22 bp, Artificial Sequence
  Synthetic oligonucleotide; TTA chr11 5296467 5296488 5296484 5296489 +
tattttaaagtaggtgagcaaa

SEQ ID NO: 96054 - DNA, 22 bp, Artificial Sequence
  Synthetic oligonucleotide; TTT chr11 5296472 5296493 5296489 5296494 +
taaagtaggtgagcaaatgcat

SEQ ID NO: 96055 - DNA, 22 bp, Artificial Sequence
  Synthetic oligonucleotide; TTT chr11 5296473 5296494 5296490 5296495 +
aaagtaggtgagcaaatgcatt

SEQ ID NO: 96056 - DNA, 22 bp, Artificial Sequence
  Synthetic oligonucleotide; TTA chr11 5296474 5296495 5296491 5296496 +
aagtaggtgagcaaatgcattt

SEQ ID NO: 96057 - DNA, 22 bp, Artificial Sequence
  Synthetic oligonucleotide; TTT chr11 5296496 5296517 5296513 5296518 +
taacactccaagatagatttag

SEQ ID NO: 96058 - DNA, 22 bp, Artificial Sequence
  Synthetic oligonucleotide; TTT chr11 5296497 5296518 5296514 5296519 +
aacactccaagatagatttaga

SEQ ID NO: 96059 - DNA, 22 bp, Artificial Sequence
  Synthetic oligonucleotide; TTA chr11 5296498 5296519 5296515 5296520 +
acactccaagatagatttagat

SEQ ID NO: 96060 - DNA, 22 bp, Artificial Sequence
  Synthetic oligonucleotide; CTC chr11 5296504 5296525 5296521 5296526 +
caagatagatttagattaaaac

SEQ ID NO: 96061 - DNA, 22 bp, Artificial Sequence
  Synthetic oligonucleotide; TTT chr11 5296516 5296537 5296533 5296538 +
agattaaaacatctaaccagga

SEQ ID NO: 96062 - DNA, 22 bp, Artificial Sequence
  Synthetic oligonucleotide; TTA chr11 5296517 5296538 5296534 5296539 +
gattaaaacatctaaccaggat

SEQ ID NO: 96063 - DNA, 22 bp, Artificial Sequence
  Synthetic oligonucleotide; TTA chr11 5296522 5296543 5296539 5296544 +
aaacatctaaccaggataaaca

SEQ ID NO: 96064 - DNA, 22 bp, Artificial Sequence
  Synthetic oligonucleotide; CTA chr11 5296531 5296552 5296548 5296553 +
accaggataaacattgctgtct

SEQ ID NO: 96065 - DNA, 22 bp, Artificial Sequence
  Synthetic oligonucleotide; TTG chr11 5296547 5296568 5296564 5296569 +
ctgtctaaatgtatttgttgtt

SEQ ID NO: 96066 - DNA, 22 bp, Artificial Sequence
  Synthetic oligonucleotide; CTG chr11 5296550 5296571 5296567 5296572 +
tctaaatgtatttgttgtttta

SEQ ID NO: 96067 - DNA, 22 bp, Artificial Sequence
  Synthetic oligonucleotide; CTA chr11 5296554 5296575 5296571 5296576 +
aatgtatttgttgttttaatct

SEQ ID NO: 96068 - DNA, 22 bp, Artificial Sequence
  Synthetic oligonucleotide; TTT chr11 5296563 5296584 5296580 5296585 +
gttgttttaatctcttccgtta

SEQ ID NO: 96069 - DNA, 22 bp, Artificial Sequence
  Synthetic oligonucleotide; TTG chr11 5296564 5296585 5296581 5296586 +
ttgttttaatctcttccgttat

SEQ ID NO: 96070 - DNA, 22 bp, Artificial Sequence
  Synthetic oligonucleotide; TTG chr11 5296567 5296588 5296584 5296589 +
ttttaatctcttccgttattgt

SEQ ID NO: 96071 - DNA, 22 bp, Artificial Sequence
  Synthetic oligonucleotide; TTT chr11 5296570 5296591 5296587 5296592 +
taatctcttccgttattgtaac

SEQ ID NO: 96072 - DNA, 22 bp, Artificial Sequence
  Synthetic oligonucleotide; TTT chr11 5296571 5296592 5296588 5296593 +
aatctcttccgttattgtaaca

SEQ ID NO: 96073 - DNA, 22 bp, Artificial Sequence
  Synthetic oligonucleotide; TTA chr11 5296572 5296593 5296589 5296594 +
atctcttccgttattgtaacat

SEQ ID NO: 96074 - DNA, 22 bp, Artificial Sequence
  Synthetic oligonucleotide; CTC chr11 5296577 5296598 5296594 5296599 +
ttccgttattgtaacatgatga

SEQ ID NO: 96075 - DNA, 22 bp, Artificial Sequence
  Synthetic oligonucleotide; CTT chr11 5296579 5296600 5296596 5296601 +
ccgttattgtaacatgatgagg

SEQ ID NO: 96076 - DNA, 22 bp, Artificial Sequence
  Synthetic oligonucleotide; TTC chr11 5296580 5296601 5296597 5296602 +
cgttattgtaacatgatgagga

SEQ ID NO: 96077 - DNA, 22 bp, Artificial Sequence
  Synthetic oligonucleotide; TTA chr11 5296585 5296606 5296602 5296607 +
ttgtaacatgatgaggagacat

SEQ ID NO: 96078 - DNA, 22 bp, Artificial Sequence
  Synthetic oligonucleotide; TTG chr11 5296588 5296609 5296605 5296610 +
taacatgatgaggagacatgga

SEQ ID NO: 96079 - DNA, 22 bp, Artificial Sequence
  Synthetic oligonucleotide; CTT chr11 5296620 5296641 5296637 5296642 +
ctgctaatttctcctttaaagt

SEQ ID NO: 96080 - DNA, 22 bp, Artificial Sequence
  Synthetic oligonucleotide; TTC chr11 5296621 5296642 5296638 5296643 +
tgctaatttctcctttaaagtc

SEQ ID NO: 96081 - DNA, 22 bp, Artificial Sequence
  Synthetic oligonucleotide; CTG chr11 5296623 5296644 5296640 5296645 +
ctaatttctcctttaaagtcac

SEQ ID NO: 96082 - DNA, 22 bp, Artificial Sequence
  Synthetic oligonucleotide; CTA chr11 5296626 5296647 5296643 5296648 +
atttctcctttaaagtcacttc

SEQ ID NO: 96083 - DNA, 22 bp, Artificial Sequence
  Synthetic oligonucleotide; TTT chr11 5296630 5296651 5296647 5296652 +
ctcctttaaagtcacttcacat

SEQ ID NO: 96084 - DNA, 22 bp, Artificial Sequence
  Synthetic oligonucleotide; TTC chr11 5296631 5296652 5296648 5296653 +
tcctttaaagtcacttcacatt

SEQ ID NO: 96085 - DNA, 22 bp, Artificial Sequence
  Synthetic oligonucleotide; CTC chr11 5296633 5296654 5296650 5296655 +
ctttaaagtcacttcacattag

SEQ ID NO: 96086 - DNA, 22 bp, Artificial Sequence
  Synthetic oligonucleotide; CTT chr11 5296636 5296657 5296653 5296658 +
taaagtcacttcacattagtta

SEQ ID NO: 96087 - DNA, 22 bp, Artificial Sequence
  Synthetic oligonucleotide; TTT chr11 5296637 5296658 5296654 5296659 +
aaagtcacttcacattagttat

SEQ ID NO: 96088 - DNA, 22 bp, Artificial Sequence
  Synthetic oligonucleotide; TTA chr11 5296638 5296659 5296655 5296660 +
aagtcacttcacattagttatc

SEQ ID NO: 96089 - DNA, 22 bp, Artificial Sequence
  Synthetic oligonucleotide; CTT chr11 5296647 5296668 5296664 5296669 +
cacattagttatctcttacata

SEQ ID NO: 96090 - DNA, 22 bp, Artificial Sequence
  Synthetic oligonucleotide; TTC chr11 5296648 5296669 5296665 5296670 +
acattagttatctcttacatat

SEQ ID NO: 96091 - DNA, 22 bp, Artificial Sequence
  Synthetic oligonucleotide; TTA chr11 5296654 5296675 5296671 5296676 +
gttatctcttacatatgagtcc

SEQ ID NO: 96092 - DNA, 22 bp, Artificial Sequence
  Synthetic oligonucleotide; TTA chr11 5296658 5296679 5296675 5296680 +
tctcttacatatgagtccctgg

SEQ ID NO: 96093 - DNA, 22 bp, Artificial Sequence
  Synthetic oligonucleotide; CTC chr11 5296662 5296683 5296679 5296684 +
ttacatatgagtccctggcagt

SEQ ID NO: 96094 - DNA, 22 bp, Artificial Sequence
  Synthetic oligonucleotide; CTT chr11 5296664 5296685 5296681 5296686 +
acatatgagtccctggcagtgt

SEQ ID NO: 96095 - DNA, 22 bp, Artificial Sequence
  Synthetic oligonucleotide; TTA chr11 5296665 5296686 5296682 5296687 +
catatgagtccctggcagtgtc

SEQ ID NO: 96096 - DNA, 22 bp, Artificial Sequence
  Synthetic oligonucleotide; CTG chr11 5296679 5296700 5296696 5296701 +
gcagtgtcagttgaccattcct

SEQ ID NO: 96097 - DNA, 22 bp, Artificial Sequence
  Synthetic oligonucleotide; TTG chr11 5296692 5296713 5296709 5296714 +
accattccttttcatgacccta

SEQ ID NO: 96098 - DNA, 22 bp, Artificial Sequence
  Synthetic oligonucleotide; TTC chr11 5296699 5296720 5296716 5296721 +
cttttcatgaccctaaagactt

SEQ ID NO: 96099 - DNA, 22 bp, Artificial Sequence
  Synthetic oligonucleotide; CTT chr11 5296702 5296723 5296719 5296724 +
ttcatgaccctaaagacttctg

SEQ ID NO: 96100 - DNA, 22 bp, Artificial Sequence
  Synthetic oligonucleotide; TTT chr11 5296703 5296724 5296720 5296725 +
tcatgaccctaaagacttctga

SEQ ID NO: 96101 - DNA, 22 bp, Artificial Sequence
  Synthetic oligonucleotide; TTT chr11 5296704 5296725 5296721 5296726 +
catgaccctaaagacttctgat

SEQ ID NO: 96102 - DNA, 22 bp, Artificial Sequence
  Synthetic oligonucleotide; TTC chr11 5296705 5296726 5296722 5296727 +
atgaccctaaagacttctgata

SEQ ID NO: 96103 - DNA, 22 bp, Artificial Sequence
  Synthetic oligonucleotide; CTA chr11 5296714 5296735 5296731 5296736 +
aagacttctgataaatatactg

SEQ ID NO: 96104 - DNA, 22 bp, Artificial Sequence
  Synthetic oligonucleotide; CTT chr11 5296721 5296742 5296738 5296743 +
ctgataaatatactgcattttt

SEQ ID NO: 96105 - DNA, 22 bp, Artificial Sequence
  Synthetic oligonucleotide; TTC chr11 5296722 5296743 5296739 5296744 +
tgataaatatactgcatttttc

SEQ ID NO: 96106 - DNA, 22 bp, Artificial Sequence
  Synthetic oligonucleotide; CTG chr11 5296724 5296745 5296741 5296746 +
ataaatatactgcatttttcta

SEQ ID NO: 96107 - DNA, 22 bp, Artificial Sequence
  Synthetic oligonucleotide; CTG chr11 5296736 5296757 5296753 5296758 +
catttttctatagctcatttca

SEQ ID NO: 96108 - DNA, 22 bp, Artificial Sequence
  Synthetic oligonucleotide; TTT chr11 5296741 5296762 5296758 5296763 +
ttctatagctcatttcaaccta

SEQ ID NO: 96109 - DNA, 22 bp, Artificial Sequence
  Synthetic oligonucleotide; TTT chr11 5296742 5296763 5296759 5296764 +
tctatagctcatttcaacctac

SEQ ID NO: 96110 - DNA, 22 bp, Artificial Sequence
  Synthetic oligonucleotide; TTT chr11 5296743 5296764 5296760 5296765 +
ctatagctcatttcaacctaca

SEQ ID NO: 96111 - DNA, 22 bp, Artificial Sequence
  Synthetic oligonucleotide; TTC chr11 5296744 5296765 5296761 5296766 +
tatagctcatttcaacctacac

SEQ ID NO: 96112 - DNA, 22 bp, Artificial Sequence
  Synthetic oligonucleotide; CTA chr11 5296746 5296767 5296763 5296768 +
tagctcatttcaacctacacaa

SEQ ID NO: 96113 - DNA, 22 bp, Artificial Sequence
  Synthetic oligonucleotide; CTC chr11 5296752 5296773 5296769 5296774 +
atttcaacctacacaaattatg

SEQ ID NO: 96114 - DNA, 22 bp, Artificial Sequence
  Synthetic oligonucleotide; TTT chr11 5296756 5296777 5296773 5296778 +
caacctacacaaattatgggtt

SEQ ID NO: 96115 - DNA, 22 bp, Artificial Sequence
  Synthetic oligonucleotide; TTC chr11 5296757 5296778 5296774 5296779 +
aacctacacaaattatgggttt

SEQ ID NO: 96116 - DNA, 22 bp, Artificial Sequence
  Synthetic oligonucleotide; CTA chr11 5296763 5296784 5296780 5296785 +
cacaaattatgggtttgcatgc

SEQ ID NO: 96117 - DNA, 22 bp, Artificial Sequence
  Synthetic oligonucleotide; TTA chr11 5296772 5296793 5296789 5296794 +
tgggtttgcatgcctttatccc

SEQ ID NO: 96118 - DNA, 22 bp, Artificial Sequence
  Synthetic oligonucleotide; TTT chr11 5296779 5296800 5296796 5296801 +
gcatgcctttatccctaattag

SEQ ID NO: 96119 - DNA, 22 bp, Artificial Sequence
  Synthetic oligonucleotide; TTG chr11 5296780 5296801 5296797 5296802 +
catgcctttatccctaattagg

SEQ ID NO: 96120 - DNA, 22 bp, Artificial Sequence
  Synthetic oligonucleotide; CTT chr11 5296788 5296809 5296805 5296810 +
tatccctaattaggctacacag

SEQ ID NO: 96121 - DNA, 22 bp, Artificial Sequence
  Synthetic oligonucleotide; TTT chr11 5296789 5296810 5296806 5296811 +
atccctaattaggctacacagc

SEQ ID NO: 96122 - DNA, 22 bp, Artificial Sequence
  Synthetic oligonucleotide; TTA chr11 5296790 5296811 5296807 5296812 +
tccctaattaggctacacagct

SEQ ID NO: 96123 - DNA, 22 bp, Artificial Sequence
  Synthetic oligonucleotide; CTA chr11 5296796 5296817 5296813 5296818 +
attaggctacacagctgtttaa

SEQ ID NO: 96124 - DNA, 22 bp, Artificial Sequence
  Synthetic oligonucleotide; TTA chr11 5296800 5296821 5296817 5296822 +
ggctacacagctgtttaaatta

SEQ ID NO: 96125 - DNA, 22 bp, Artificial Sequence
  Synthetic oligonucleotide; CTA chr11 5296805 5296826 5296822 5296827 +
cacagctgtttaaattaggaat

SEQ ID NO: 96126 - DNA, 22 bp, Artificial Sequence
  Synthetic oligonucleotide; CTG chr11 5296813 5296834 5296830 5296835 +
tttaaattaggaattacagatt

SEQ ID NO: 96127 - DNA, 22 bp, Artificial Sequence
  Synthetic oligonucleotide; TTT chr11 5296816 5296837 5296833 5296838 +
aaattaggaattacagatttcg

SEQ ID NO: 96128 - DNA, 22 bp, Artificial Sequence
  Synthetic oligonucleotide; TTA chr11 5296817 5296838 5296834 5296839 +
aattaggaattacagatttcgc

SEQ ID NO: 96129 - DNA, 22 bp, Artificial Sequence
  Synthetic oligonucleotide; TTA chr11 5296822 5296843 5296839 5296844 +
ggaattacagatttcgccagat

SEQ ID NO: 96130 - DNA, 22 bp, Artificial Sequence
  Synthetic oligonucleotide; TTA chr11 5296829 5296850 5296846 5296851 +
cagatttcgccagataattgta

SEQ ID NO: 96131 - DNA, 22 bp, Artificial Sequence
  Synthetic oligonucleotide; TTT chr11 5296836 5296857 5296853 5296858 +
cgccagataattgtatatctga

SEQ ID NO: 96132 - DNA, 22 bp, Artificial Sequence
  Synthetic oligonucleotide; TTC chr11 5296837 5296858 5296854 5296859 +
gccagataattgtatatctgat

SEQ ID NO: 96133 - DNA, 22 bp, Artificial Sequence
  Synthetic oligonucleotide; TTG chr11 5296849 5296870 5296866 5296871 +
tatatctgatacagattaggca

SEQ ID NO: 96134 - DNA, 22 bp, Artificial Sequence
  Synthetic oligonucleotide; CTG chr11 5296857 5296878 5296874 5296879 +
atacagattaggcatttaataa

SEQ ID NO: 96135 - DNA, 22 bp, Artificial Sequence
  Synthetic oligonucleotide; TTA chr11 5296867 5296888 5296884 5296889 +
ggcatttaataaattttggtga

SEQ ID NO: 96136 - DNA, 22 bp, Artificial Sequence
  Synthetic oligonucleotide; TTT chr11 5296874 5296895 5296891 5296896 +
aataaattttggtgaataggta

SEQ ID NO: 96137 - DNA, 22 bp, Artificial Sequence
  Synthetic oligonucleotide; TTA chr11 5296875 5296896 5296892 5296897 +
ataaattttggtgaataggtaa

SEQ ID NO: 96138 - DNA, 22 bp, Artificial Sequence
  Synthetic oligonucleotide; TTT chr11 5296883 5296904 5296900 5296905 +
tggtgaataggtaaacactaaa

SEQ ID NO: 96139 - DNA, 22 bp, Artificial Sequence
  Synthetic oligonucleotide; TTT chr11 5296884 5296905 5296901 5296906 +
ggtgaataggtaaacactaaat

SEQ ID NO: 96140 - DNA, 22 bp, Artificial Sequence
  Synthetic oligonucleotide; TTG chr11 5296885 5296906 5296902 5296907 +
gtgaataggtaaacactaaatt

SEQ ID NO: 96141 - DNA, 22 bp, Artificial Sequence
  Synthetic oligonucleotide; CTA chr11 5296903 5296924 5296920 5296925 +
aattgttcctcaaacatttgtc

SEQ ID NO: 96142 - DNA, 22 bp, Artificial Sequence
  Synthetic oligonucleotide; TTG chr11 5296908 5296929 5296925 5296930 +
ttcctcaaacatttgtcagatg

SEQ ID NO: 96143 - DNA, 22 bp, Artificial Sequence
  Synthetic oligonucleotide; TTC chr11 5296911 5296932 5296928 5296933 +
ctcaaacatttgtcagatgttc

SEQ ID NO: 96144 - DNA, 22 bp, Artificial Sequence
  Synthetic oligonucleotide; CTC chr11 5296914 5296935 5296931 5296936 +
aaacatttgtcagatgttcact

SEQ ID NO: 96145 - DNA, 22 bp, Artificial Sequence
  Synthetic oligonucleotide; TTT chr11 5296922 5296943 5296939 5296944 +
gtcagatgttcactatgatacc

SEQ ID NO: 96146 - DNA, 22 bp, Artificial Sequence
  Synthetic oligonucleotide; TTG chr11 5296923 5296944 5296940 5296945 +
tcagatgttcactatgatacct

SEQ ID NO: 96147 - DNA, 22 bp, Artificial Sequence
  Synthetic oligonucleotide; TTC chr11 5296933 5296954 5296950 5296955 +
actatgatacctacttattgag

SEQ ID NO: 96148 - DNA, 22 bp, Artificial Sequence
  Synthetic oligonucleotide; CTA chr11 5296937 5296958 5296954 5296959 +
tgatacctacttattgagaatc

SEQ ID NO: 96149 - DNA, 22 bp, Artificial Sequence
  Synthetic oligonucleotide; CTA chr11 5296946 5296967 5296963 5296968 +
cttattgagaatcaagtaaata

SEQ ID NO: 96150 - DNA, 22 bp, Artificial Sequence
  Synthetic oligonucleotide; CTT chr11 5296949 5296970 5296966 5296971 +
attgagaatcaagtaaatagag

SEQ ID NO: 96151 - DNA, 22 bp, Artificial Sequence
  Synthetic oligonucleotide; TTA chr11 5296950 5296971 5296967 5296972 +
ttgagaatcaagtaaatagaga

SEQ ID NO: 96152 - DNA, 22 bp, Artificial Sequence
  Synthetic oligonucleotide; TTG chr11 5296953 5296974 5296970 5296975 +
agaatcaagtaaatagagatat

SEQ ID NO: 96153 - DNA, 22 bp, Artificial Sequence
  Synthetic oligonucleotide; TTC chr11 5296977 5296998 5296994 5296999 +
agacacattacagagaagtata

SEQ ID NO: 96154 - DNA, 22 bp, Artificial Sequence
  Synthetic oligonucleotide; TTA chr11 5296987 5297008 5297004 5297009 +
cagagaagtatatacttacaaa

SEQ ID NO: 96155 - DNA, 22 bp, Artificial Sequence
  Synthetic oligonucleotide; CTT chr11 5297004 5297025 5297021 5297026 +
acaaactcaaagtatttgacac

SEQ ID NO: 96156 - DNA, 22 bp, Artificial Sequence
  Synthetic oligonucleotide; TTA chr11 5297005 5297026 5297022 5297027 +
caaactcaaagtatttgacacc

SEQ ID NO: 96157 - DNA, 22 bp, Artificial Sequence
  Synthetic oligonucleotide; CTC chr11 5297012 5297033 5297029 5297034 +
aaagtatttgacacccctaggc

SEQ ID NO: 96158 - DNA, 22 bp, Artificial Sequence
  Synthetic oligonucleotide; TTT chr11 5297021 5297042 5297038 5297043 +
gacacccctaggcacatgaaac

SEQ ID NO: 96159 - DNA, 22 bp, Artificial Sequence
  Synthetic oligonucleotide; TTG chr11 5297022 5297043 5297039 5297044 +
acacccctaggcacatgaaaca

SEQ ID NO: 96160 - DNA, 22 bp, Artificial Sequence
  Synthetic oligonucleotide; CTA chr11 5297031 5297052 5297048 5297053 +
ggcacatgaaacacttttgaat

SEQ ID NO: 96161 - DNA, 22 bp, Artificial Sequence
  Synthetic oligonucleotide; CTT chr11 5297047 5297068 5297064 5297069 +
ttgaatatacagcacactttta

SEQ ID NO: 96162 - DNA, 22 bp, Artificial Sequence
  Synthetic oligonucleotide; TTT chr11 5297048 5297069 5297065 5297070 +
tgaatatacagcacacttttac

SEQ ID NO: 96163 - DNA, 22 bp, Artificial Sequence
  Synthetic oligonucleotide; TTT chr11 5297049 5297070 5297066 5297071 +
gaatatacagcacacttttaca

SEQ ID NO: 96164 - DNA, 22 bp, Artificial Sequence
  Synthetic oligonucleotide; TTG chr11 5297050 5297071 5297067 5297072 +
aatatacagcacacttttacat

SEQ ID NO: 96165 - DNA, 22 bp, Artificial Sequence
  Synthetic oligonucleotide; CTT chr11 5297066 5297087 5297083 5297088 +
ttacatacacattattcataaa

SEQ ID NO: 96166 - DNA, 22 bp, Artificial Sequence
  Synthetic oligonucleotide; TTT chr11 5297067 5297088 5297084 5297089 +
tacatacacattattcataaac

SEQ ID NO: 96167 - DNA, 22 bp, Artificial Sequence
  Synthetic oligonucleotide; TTT chr11 5297068 5297089 5297085 5297090 +
acatacacattattcataaaca

SEQ ID NO: 96168 - DNA, 22 bp, Artificial Sequence
  Synthetic oligonucleotide; TTA chr11 5297069 5297090 5297086 5297091 +
catacacattattcataaacat

SEQ ID NO: 96169 - DNA, 22 bp, Artificial Sequence
  Synthetic oligonucleotide; TTA chr11 5297080 5297101 5297097 5297102 +
ttcataaacattgccaatgcat

SEQ ID NO: 96170 - DNA, 22 bp, Artificial Sequence
  Synthetic oligonucleotide; TTC chr11 5297083 5297104 5297100 5297105 +
ataaacattgccaatgcatgca

SEQ ID NO: 96171 - DNA, 22 bp, Artificial Sequence
  Synthetic oligonucleotide; TTG chr11 5297093 5297114 5297110 5297115 +
ccaatgcatgcagaaagaagct

SEQ ID NO: 96172 - DNA, 22 bp, Artificial Sequence
  Synthetic oligonucleotide; CTT chr11 5297116 5297137 5297133 5297138 +
aatgtggattttacatatactt

SEQ ID NO: 96173 - DNA, 22 bp, Artificial Sequence
  Synthetic oligonucleotide; TTA chr11 5297117 5297138 5297134 5297139 +
atgtggattttacatatacttt

SEQ ID NO: 96174 - DNA, 22 bp, Artificial Sequence
  Synthetic oligonucleotide; TTT chr11 5297127 5297148 5297144 5297149 +
tacatatactttcatgaacata

SEQ ID NO: 96175 - DNA, 22 bp, Artificial Sequence
  Synthetic oligonucleotide; TTT chr11 5297128 5297149 5297145 5297150 +
acatatactttcatgaacatag

SEQ ID NO: 96176 - DNA, 22 bp, Artificial Sequence
  Synthetic oligonucleotide; TTA chr11 5297129 5297150 5297146 5297151 +
catatactttcatgaacatagc

SEQ ID NO: 96177 - DNA, 22 bp, Artificial Sequence
  Synthetic oligonucleotide; CTT chr11 5297138 5297159 5297155 5297160 +
tcatgaacatagccttgccaac

SEQ ID NO: 96178 - DNA, 22 bp, Artificial Sequence
  Synthetic oligonucleotide; TTT chr11 5297139 5297160 5297156 5297161 +
catgaacatagccttgccaaca

SEQ ID NO: 96179 - DNA, 22 bp, Artificial Sequence
  Synthetic oligonucleotide; TTC chr11 5297140 5297161 5297157 5297162 +
atgaacatagccttgccaacat

SEQ ID NO: 96180 - DNA, 22 bp, Artificial Sequence
  Synthetic oligonucleotide; CTT chr11 5297154 5297175 5297171 5297176 +
gccaacatcctttccctttctg

SEQ ID NO: 96181 - DNA, 22 bp, Artificial Sequence
  Synthetic oligonucleotide; TTG chr11 5297155 5297176 5297172 5297177 +
ccaacatcctttccctttctgt

SEQ ID NO: 96182 - DNA, 22 bp, Artificial Sequence
  Synthetic oligonucleotide; CTT chr11 5297166 5297187 5297183 5297188 +
tccctttctgttagagtcacct

SEQ ID NO: 96183 - DNA, 22 bp, Artificial Sequence
  Synthetic oligonucleotide; TTT chr11 5297167 5297188 5297184 5297189 +
ccctttctgttagagtcacctg

SEQ ID NO: 96184 - DNA, 22 bp, Artificial Sequence
  Synthetic oligonucleotide; TTC chr11 5297168 5297189 5297185 5297190 +
cctttctgttagagtcacctgc

SEQ ID NO: 96185 - DNA, 22 bp, Artificial Sequence
  Synthetic oligonucleotide; CTT chr11 5297172 5297193 5297189 5297194 +
tctgttagagtcacctgccttc

SEQ ID NO: 96186 - DNA, 22 bp, Artificial Sequence
  Synthetic oligonucleotide; TTT chr11 5297173 5297194 5297190 5297195 +
ctgttagagtcacctgccttca

SEQ ID NO: 96187 - DNA, 22 bp, Artificial Sequence
  Synthetic oligonucleotide; TTC chr11 5297174 5297195 5297191 5297196 +
tgttagagtcacctgccttcat

SEQ ID NO: 96188 - DNA, 22 bp, Artificial Sequence
  Synthetic oligonucleotide; CTG chr11 5297176 5297197 5297193 5297198 +
ttagagtcacctgccttcatcc

SEQ ID NO: 96189 - DNA, 22 bp, Artificial Sequence
  Synthetic oligonucleotide; TTA chr11 5297179 5297200 5297196 5297201 +
gagtcacctgccttcatccatc

SEQ ID NO: 96190 - DNA, 22 bp, Artificial Sequence
  Synthetic oligonucleotide; CTG chr11 5297189 5297210 5297206 5297211 +
ccttcatccatcccttggatat

SEQ ID NO: 96191 - DNA, 22 bp, Artificial Sequence
  Synthetic oligonucleotide; CTT chr11 5297193 5297214 5297210 5297215 +
catccatcccttggatatgata

SEQ ID NO: 96192 - DNA, 22 bp, Artificial Sequence
  Synthetic oligonucleotide; TTC chr11 5297194 5297215 5297211 5297216 +
atccatcccttggatatgatac

SEQ ID NO: 96193 - DNA, 22 bp, Artificial Sequence
  Synthetic oligonucleotide; CTT chr11 5297205 5297226 5297222 5297227 +
ggatatgataccttgagttatc

SEQ ID NO: 96194 - DNA, 22 bp, Artificial Sequence
  Synthetic oligonucleotide; TTG chr11 5297206 5297227 5297223 5297228 +
gatatgataccttgagttatcc

SEQ ID NO: 96195 - DNA, 22 bp, Artificial Sequence
  Synthetic oligonucleotide; CTT chr11 5297219 5297240 5297236 5297241 +
gagttatccccacacccaaatc

SEQ ID NO: 96196 - DNA, 22 bp, Artificial Sequence
  Synthetic oligonucleotide; TTG chr11 5297220 5297241 5297237 5297242 +
agttatccccacacccaaatct

SEQ ID NO: 96197 - DNA, 22 bp, Artificial Sequence
  Synthetic oligonucleotide; TTA chr11 5297225 5297246 5297242 5297247 +
tccccacacccaaatcttcaac

SEQ ID NO: 96198 - DNA, 22 bp, Artificial Sequence
  Synthetic oligonucleotide; CTT chr11 5297243 5297264 5297260 5297265 +
caacagacagaaatgtaaagtc

SEQ ID NO: 96199 - DNA, 22 bp, Artificial Sequence
  Synthetic oligonucleotide; TTC chr11 5297244 5297265 5297261 5297266 +
aacagacagaaatgtaaagtcc

SEQ ID NO: 96200 - DNA, 22 bp, Artificial Sequence
  Synthetic oligonucleotide; TTT chr11 5297271 5297292 5297288 5297293 +
aatgtgtgatagatgaactaaa

SEQ ID NO: 96201 - DNA, 22 bp, Artificial Sequence
  Synthetic oligonucleotide; TTA chr11 5297272 5297293 5297289 5297294 +
atgtgtgatagatgaactaaat

SEQ ID NO: 96202 - DNA, 22 bp, Artificial Sequence
  Synthetic oligonucleotide; CTA chr11 5297291 5297312 5297308 5297313 +
aatattctatctcagtattcat

SEQ ID NO: 96203 - DNA, 22 bp, Artificial Sequence
  Synthetic oligonucleotide; TTC chr11 5297298 5297319 5297315 5297320 +
tatctcagtattcatctgacag

SEQ ID NO: 96204 - DNA, 22 bp, Artificial Sequence
  Synthetic oligonucleotide; CTA chr11 5297300 5297321 5297317 5297322 +
tctcagtattcatctgacagca

SEQ ID NO: 96205 - DNA, 22 bp, Artificial Sequence
  Synthetic oligonucleotide; CTC chr11 5297304 5297325 5297321 5297326 +
agtattcatctgacagcatagg

SEQ ID NO: 96206 - DNA, 22 bp, Artificial Sequence
  Synthetic oligonucleotide; TTC chr11 5297311 5297332 5297328 5297333 +
atctgacagcataggaaggaga

SEQ ID NO: 96207 - DNA, 22 bp, Artificial Sequence
  Synthetic oligonucleotide; CTG chr11 5297316 5297337 5297333 5297338 +
acagcataggaaggagagaaat

SEQ ID NO: 96208 - DNA, 22 bp, Artificial Sequence
  Synthetic oligonucleotide; CTC chr11 5297343 5297364 5297360 5297365 +
tgtctcatttataccacatatt

SEQ ID NO: 96209 - DNA, 22 bp, Artificial Sequence
  Synthetic oligonucleotide; CTG chr11 5297345 5297366 5297362 5297367 +
tctcatttataccacatattgt

SEQ ID NO: 96210 - DNA, 22 bp, Artificial Sequence
  Synthetic oligonucleotide; CTC chr11 5297349 5297370 5297366 5297371 +
atttataccacatattgtgttt

SEQ ID NO: 96211 - DNA, 22 bp, Artificial Sequence
  Synthetic oligonucleotide; TTT chr11 5297353 5297374 5297370 5297375 +
ataccacatattgtgtttctat

SEQ ID NO: 96212 - DNA, 22 bp, Artificial Sequence
  Synthetic oligonucleotide; TTA chr11 5297354 5297375 5297371 5297376 +
taccacatattgtgtttctatg

SEQ ID NO: 96213 - DNA, 22 bp, Artificial Sequence
  Synthetic oligonucleotide; TTG chr11 5297366 5297387 5297383 5297388 +
tgtttctatggccgaatcagct

SEQ ID NO: 96214 - DNA, 22 bp, Artificial Sequence
  Synthetic oligonucleotide; TTT chr11 5297371 5297392 5297388 5297393 +
ctatggccgaatcagcttaggt

SEQ ID NO: 96215 - DNA, 22 bp, Artificial Sequence
  Synthetic oligonucleotide; TTC chr11 5297372 5297393 5297389 5297394 +
tatggccgaatcagcttaggtt

SEQ ID NO: 96216 - DNA, 22 bp, Artificial Sequence
  Synthetic oligonucleotide; CTA chr11 5297374 5297395 5297391 5297396 +
tggccgaatcagcttaggttct

SEQ ID NO: 96217 - DNA, 22 bp, Artificial Sequence
  Synthetic oligonucleotide; CTT chr11 5297389 5297410 5297406 5297411 +
aggttctacattgtgtggtttt

SEQ ID NO: 96218 - DNA, 22 bp, Artificial Sequence
  Synthetic oligonucleotide; TTA chr11 5297390 5297411 5297407 5297412 +
ggttctacattgtgtggttttg

SEQ ID NO: 96219 - DNA, 22 bp, Artificial Sequence
  Synthetic oligonucleotide; TTC chr11 5297395 5297416 5297412 5297417 +
tacattgtgtggttttggataa

SEQ ID NO: 96220 - DNA, 22 bp, Artificial Sequence
  Synthetic oligonucleotide; CTA chr11 5297397 5297418 5297414 5297419 +
cattgtgtggttttggataaat

SEQ ID NO: 96221 - DNA, 22 bp, Artificial Sequence
  Synthetic oligonucleotide; TTG chr11 5297402 5297423 5297419 5297424 +
tgtggttttggataaattactt

SEQ ID NO: 96222 - DNA, 22 bp, Artificial Sequence
  Synthetic oligonucleotide; TTT chr11 5297410 5297431 5297427 5297432 +
tggataaattacttaacctacc

SEQ ID NO: 96223 - DNA, 22 bp, Artificial Sequence
  Synthetic oligonucleotide; TTT chr11 5297411 5297432 5297428 5297433 +
ggataaattacttaacctacct

SEQ ID NO: 96224 - DNA, 22 bp, Artificial Sequence
  Synthetic oligonucleotide; TTG chr11 5297412 5297433 5297429 5297434 +
gataaattacttaacctaccta

SEQ ID NO: 96225 - DNA, 22 bp, Artificial Sequence
  Synthetic oligonucleotide; TTA chr11 5297421 5297442 5297438 5297443 +
cttaacctacctaagtaaggca

SEQ ID NO: 96226 - DNA, 22 bp, Artificial Sequence
  Synthetic oligonucleotide; CTT chr11 5297424 5297445 5297441 5297446 +
aacctacctaagtaaggcacct

SEQ ID NO: 96227 - DNA, 22 bp, Artificial Sequence
  Synthetic oligonucleotide; TTA chr11 5297425 5297446 5297442 5297447 +
acctacctaagtaaggcaccta

SEQ ID NO: 96228 - DNA, 22 bp, Artificial Sequence
  Synthetic oligonucleotide; CTA chr11 5297430 5297451 5297447 5297452 +
cctaagtaaggcacctacgtgt

SEQ ID NO: 96229 - DNA, 22 bp, Artificial Sequence
  Synthetic oligonucleotide; CTA chr11 5297434 5297455 5297451 5297456 +
agtaaggcacctacgtgtcagt

SEQ ID NO: 96230 - DNA, 22 bp, Artificial Sequence
  Synthetic oligonucleotide; CTA chr11 5297447 5297468 5297464 5297469 +
cgtgtcagtctcttcatgtgta

SEQ ID NO: 96231 - DNA, 22 bp, Artificial Sequence
  Synthetic oligonucleotide; CTC chr11 5297459 5297480 5297476 5297481 +
ttcatgtgtagtcaggaattat

SEQ ID NO: 96232 - DNA, 22 bp, Artificial Sequence
  Synthetic oligonucleotide; CTT chr11 5297461 5297482 5297478 5297483 +
catgtgtagtcaggaattataa

SEQ ID NO: 96233 - DNA, 22 bp, Artificial Sequence
  Synthetic oligonucleotide; TTC chr11 5297462 5297483 5297479 5297484 +
atgtgtagtcaggaattataat

SEQ ID NO: 96234 - DNA, 22 bp, Artificial Sequence
  Synthetic oligonucleotide; TTA chr11 5297480 5297501 5297497 5297502 +
taatgaaaagtaactcgaagta

SEQ ID NO: 96235 - DNA, 22 bp, Artificial Sequence
  Synthetic oligonucleotide; CTC chr11 5297496 5297517 5297513 5297518 +
gaagtatttttgtgataatcag

SEQ ID NO: 96236 - DNA, 22 bp, Artificial Sequence
  Synthetic oligonucleotide; TTT chr11 5297505 5297526 5297522 5297527 +
ttgtgataatcagttagataaa

SEQ ID NO: 96237 - DNA, 22 bp, Artificial Sequence
  Synthetic oligonucleotide; TTT chr11 5297506 5297527 5297523 5297528 +
tgtgataatcagttagataaaa

SEQ ID NO: 96238 - DNA, 22 bp, Artificial Sequence
  Synthetic oligonucleotide; TTT chr11 5297507 5297528 5297524 5297529 +
gtgataatcagttagataaaaa

SEQ ID NO: 96239 - DNA, 22 bp, Artificial Sequence
  Synthetic oligonucleotide; TTG chr11 5297508 5297529 5297525 5297530 +
tgataatcagttagataaaaat

SEQ ID NO: 96240 - DNA, 22 bp, Artificial Sequence
  Synthetic oligonucleotide; TTA chr11 5297521 5297542 5297538 5297543 +
gataaaaatgtgaacctcttaa

SEQ ID NO: 96241 - DNA, 22 bp, Artificial Sequence
  Synthetic oligonucleotide; CTC chr11 5297539 5297560 5297556 5297561 +
ttaagacactagcaacttgaat

SEQ ID NO: 96242 - DNA, 22 bp, Artificial Sequence
  Synthetic oligonucleotide; CTT chr11 5297541 5297562 5297558 5297563 +
aagacactagcaacttgaatac

SEQ ID NO: 96243 - DNA, 22 bp, Artificial Sequence
  Synthetic oligonucleotide; TTA chr11 5297542 5297563 5297559 5297564 +
agacactagcaacttgaataca

SEQ ID NO: 96244 - DNA, 22 bp, Artificial Sequence
  Synthetic oligonucleotide; CTA chr11 5297550 5297571 5297567 5297572 +
gcaacttgaatacataattgat

SEQ ID NO: 96245 - DNA, 22 bp, Artificial Sequence
  Synthetic oligonucleotide; CTT chr11 5297557 5297578 5297574 5297579 +
gaatacataattgattttttat

SEQ ID NO: 96246 - DNA, 22 bp, Artificial Sequence
  Synthetic oligonucleotide; TTG chr11 5297558 5297579 5297575 5297580 +
aatacataattgattttttatt

SEQ ID NO: 96247 - DNA, 22 bp, Artificial Sequence
  Synthetic oligonucleotide; TTG chr11 5297570 5297591 5297587 5297592 +
attttttattctgttacaatta

SEQ ID NO: 96248 - DNA, 22 bp, Artificial Sequence
  Synthetic oligonucleotide; TTT chr11 5297574 5297595 5297591 5297596 +
tttattctgttacaattatata

SEQ ID NO: 96249 - DNA, 22 bp, Artificial Sequence
  Synthetic oligonucleotide; TTT chr11 5297575 5297596 5297592 5297597 +
ttattctgttacaattatatac

SEQ ID NO: 96250 - DNA, 22 bp, Artificial Sequence
  Synthetic oligonucleotide; TTT chr11 5297576 5297597 5297593 5297598 +
tattctgttacaattatatact

SEQ ID NO: 96251 - DNA, 22 bp, Artificial Sequence
  Synthetic oligonucleotide; TTT chr11 5297577 5297598 5297594 5297599 +
attctgttacaattatatactg

SEQ ID NO: 96252 - DNA, 22 bp, Artificial Sequence
  Synthetic oligonucleotide; TTA chr11 5297578 5297599 5297595 5297600 +
ttctgttacaattatatactga

SEQ ID NO: 96253 - DNA, 22 bp, Artificial Sequence
  Synthetic oligonucleotide; TTC chr11 5297581 5297602 5297598 5297603 +
tgttacaattatatactgaact

SEQ ID NO: 96254 - DNA, 22 bp, Artificial Sequence
  Synthetic oligonucleotide; CTG chr11 5297583 5297604 5297600 5297605 +
ttacaattatatactgaactca

SEQ ID NO: 96255 - DNA, 22 bp, Artificial Sequence
  Synthetic oligonucleotide; TTA chr11 5297586 5297607 5297603 5297608 +
caattatatactgaactcatgt

SEQ ID NO: 96256 - DNA, 22 bp, Artificial Sequence
  Synthetic oligonucleotide; TTA chr11 5297592 5297613 5297609 5297614 +
tatactgaactcatgtgaggat

SEQ ID NO: 96257 - DNA, 22 bp, Artificial Sequence
  Synthetic oligonucleotide; CTG chr11 5297599 5297620 5297616 5297621 +
aactcatgtgaggatccagttt

SEQ ID NO: 96258 - DNA, 22 bp, Artificial Sequence
  Synthetic oligonucleotide; CTC chr11 5297604 5297625 5297621 5297626 +
atgtgaggatccagtttctata

SEQ ID NO: 96259 - DNA, 22 bp, Artificial Sequence
  Synthetic oligonucleotide; TTT chr11 5297621 5297642 5297638 5297643 +
ctatatctaggcttttcaaact

SEQ ID NO: 96260 - DNA, 22 bp, Artificial Sequence
  Synthetic oligonucleotide; TTC chr11 5297622 5297643 5297639 5297644 +
tatatctaggcttttcaaacta

SEQ ID NO: 96261 - DNA, 22 bp, Artificial Sequence
  Synthetic oligonucleotide; CTA chr11 5297624 5297645 5297641 5297646 +
tatctaggcttttcaaactacc

SEQ ID NO: 96262 - DNA, 22 bp, Artificial Sequence
  Synthetic oligonucleotide; CTA chr11 5297630 5297651 5297647 5297652 +
ggcttttcaaactaccttagag

SEQ ID NO: 96263 - DNA, 22 bp, Artificial Sequence
  Synthetic oligonucleotide; CTT chr11 5297635 5297656 5297652 5297657 +
ttcaaactaccttagagaaata

SEQ ID NO: 96264 - DNA, 22 bp, Artificial Sequence
  Synthetic oligonucleotide; TTT chr11 5297636 5297657 5297653 5297658 +
tcaaactaccttagagaaatac

SEQ ID NO: 96265 - DNA, 22 bp, Artificial Sequence
  Synthetic oligonucleotide; TTT chr11 5297637 5297658 5297654 5297659 +
caaactaccttagagaaatact

SEQ ID NO: 96266 - DNA, 22 bp, Artificial Sequence
  Synthetic oligonucleotide; TTC chr11 5297638 5297659 5297655 5297660 +
aaactaccttagagaaatactt

SEQ ID NO: 96267 - DNA, 22 bp, Artificial Sequence
  Synthetic oligonucleotide; CTA chr11 5297644 5297665 5297661 5297666 +
ccttagagaaatacttgtatat

SEQ ID NO: 96268 - DNA, 22 bp, Artificial Sequence
  Synthetic oligonucleotide; CTT chr11 5297648 5297669 5297665 5297670 +
agagaaatacttgtatatcttc

SEQ ID NO: 96269 - DNA, 22 bp, Artificial Sequence
  Synthetic oligonucleotide; TTA chr11 5297649 5297670 5297666 5297671 +
gagaaatacttgtatatcttcc

SEQ ID NO: 96270 - DNA, 22 bp, Artificial Sequence
  Synthetic oligonucleotide; CTT chr11 5297660 5297681 5297677 5297682 +
gtatatcttccttgtaggtata

SEQ ID NO: 96271 - DNA, 22 bp, Artificial Sequence
  Synthetic oligonucleotide; TTG chr11 5297661 5297682 5297678 5297683 +
tatatcttccttgtaggtatag

SEQ ID NO: 96272 - DNA, 22 bp, Artificial Sequence
  Synthetic oligonucleotide; CTT chr11 5297669 5297690 5297686 5297691 +
ccttgtaggtatagagtaaaat

SEQ ID NO: 96273 - DNA, 22 bp, Artificial Sequence
  Synthetic oligonucleotide; TTC chr11 5297670 5297691 5297687 5297692 +
cttgtaggtatagagtaaaata

SEQ ID NO: 96274 - DNA, 22 bp, Artificial Sequence
  Synthetic oligonucleotide; CTT chr11 5297673 5297694 5297690 5297695 +
gtaggtatagagtaaaatacta

SEQ ID NO: 96275 - DNA, 22 bp, Artificial Sequence
  Synthetic oligonucleotide; TTG chr11 5297674 5297695 5297691 5297696 +
taggtatagagtaaaatactaa

SEQ ID NO: 96276 - DNA, 22 bp, Artificial Sequence
  Synthetic oligonucleotide; CTA chr11 5297695 5297716 5297712 5297717 +
acttcaggtttagtaccaatgc

SEQ ID NO: 96277 - DNA, 22 bp, Artificial Sequence
  Synthetic oligonucleotide; CTT chr11 5297699 5297720 5297716 5297721 +
caggtttagtaccaatgcttat

SEQ ID NO: 96278 - DNA, 22 bp, Artificial Sequence
  Synthetic oligonucleotide; TTC chr11 5297700 5297721 5297717 5297722 +
aggtttagtaccaatgcttatc

SEQ ID NO: 96279 - DNA, 22 bp, Artificial Sequence
  Synthetic oligonucleotide; TTT chr11 5297706 5297727 5297723 5297728 +
agtaccaatgcttatccatatt

SEQ ID NO: 96280 - DNA, 22 bp, Artificial Sequence
  Synthetic oligonucleotide; TTA chr11 5297707 5297728 5297724 5297729 +
gtaccaatgcttatccatatta

SEQ ID NO: 96281 - DNA, 22 bp, Artificial Sequence
  Synthetic oligonucleotide; CTT chr11 5297719 5297740 5297736 5297741 +
atccatattataatttacattg

SEQ ID NO: 96282 - DNA, 22 bp, Artificial Sequence
  Synthetic oligonucleotide; TTA chr11 5297720 5297741 5297737 5297742 +
tccatattataatttacattgc

SEQ ID NO: 96283 - DNA, 22 bp, Artificial Sequence
  Synthetic oligonucleotide; TTA chr11 5297729 5297750 5297746 5297751 +
taatttacattgcaagttttat

SEQ ID NO: 96284 - DNA, 22 bp, Artificial Sequence
  Synthetic oligonucleotide; TTT chr11 5297735 5297756 5297752 5297757 +
acattgcaagttttattttctg

SEQ ID NO: 96285 - DNA, 22 bp, Artificial Sequence
  Synthetic oligonucleotide; TTA chr11 5297736 5297757 5297753 5297758 +
cattgcaagttttattttctgt

SEQ ID NO: 96286 - DNA, 22 bp, Artificial Sequence
  Synthetic oligonucleotide; TTG chr11 5297741 5297762 5297758 5297763 +
caagttttattttctgttcctt

SEQ ID NO: 96287 - DNA, 22 bp, Artificial Sequence
  Synthetic oligonucleotide; TTT chr11 5297748 5297769 5297765 5297770 +
tattttctgttccttattggtc

SEQ ID NO: 96288 - DNA, 22 bp, Artificial Sequence
  Synthetic oligonucleotide; TTT chr11 5297749 5297770 5297766 5297771 +
attttctgttccttattggtca

SEQ ID NO: 96289 - DNA, 22 bp, Artificial Sequence
  Synthetic oligonucleotide; TTA chr11 5297750 5297771 5297767 5297772 +
ttttctgttccttattggtcaa

SEQ ID NO: 96290 - DNA, 22 bp, Artificial Sequence
  Synthetic oligonucleotide; TTT chr11 5297753 5297774 5297770 5297775 +
tctgttccttattggtcaatac

SEQ ID NO: 96291 - DNA, 22 bp, Artificial Sequence
  Synthetic oligonucleotide; TTT chr11 5297754 5297775 5297771 5297776 +
ctgttccttattggtcaatact

SEQ ID NO: 96292 - DNA, 22 bp, Artificial Sequence
  Synthetic oligonucleotide; TTC chr11 5297755 5297776 5297772 5297777 +
tgttccttattggtcaatactt

SEQ ID NO: 96293 - DNA, 22 bp, Artificial Sequence
  Synthetic oligonucleotide; CTG chr11 5297757 5297778 5297774 5297779 +
ttccttattggtcaatactttt

SEQ ID NO: 96294 - DNA, 22 bp, Artificial Sequence
  Synthetic oligonucleotide; TTC chr11 5297760 5297781 5297777 5297782 +
cttattggtcaatacttttgga

SEQ ID NO: 96295 - DNA, 22 bp, Artificial Sequence
  Synthetic oligonucleotide; CTT chr11 5297763 5297784 5297780 5297785 +
attggtcaatacttttggatcc

SEQ ID NO: 96296 - DNA, 22 bp, Artificial Sequence
  Synthetic oligonucleotide; TTA chr11 5297764 5297785 5297781 5297786 +
ttggtcaatacttttggatcca

SEQ ID NO: 96297 - DNA, 22 bp, Artificial Sequence
  Synthetic oligonucleotide; TTG chr11 5297767 5297788 5297784 5297789 +
gtcaatacttttggatccagct

SEQ ID NO: 96298 - DNA, 22 bp, Artificial Sequence
  Synthetic oligonucleotide; CTT chr11 5297777 5297798 5297794 5297799 +
ttggatccagctgttcaactgt

SEQ ID NO: 96299 - DNA, 22 bp, Artificial Sequence
  Synthetic oligonucleotide; TTT chr11 5297778 5297799 5297795 5297800 +
tggatccagctgttcaactgtg

SEQ ID NO: 96300 - DNA, 22 bp, Artificial Sequence
  Synthetic oligonucleotide; TTT chr11 5297779 5297800 5297796 5297801 +
ggatccagctgttcaactgtgg

SEQ ID NO: 96301 - DNA, 22 bp, Artificial Sequence
  Synthetic oligonucleotide; TTG chr11 5297780 5297801 5297797 5297802 +
gatccagctgttcaactgtggt

SEQ ID NO: 96302 - DNA, 22 bp, Artificial Sequence
  Synthetic oligonucleotide; CTG chr11 5297790 5297811 5297807 5297812 +
ttcaactgtggtaacacttgat

SEQ ID NO: 96303 - DNA, 22 bp, Artificial Sequence
  Synthetic oligonucleotide; TTC chr11 5297793 5297814 5297810 5297815 +
aactgtggtaacacttgataat

SEQ ID NO: 96304 - DNA, 22 bp, Artificial Sequence
  Synthetic oligonucleotide; CTG chr11 5297798 5297819 5297815 5297820 +
tggtaacacttgataataatgc

SEQ ID NO: 96305 - DNA, 22 bp, Artificial Sequence
  Synthetic oligonucleotide; CTT chr11 5297809 5297830 5297826 5297831 +
gataataatgccaagaggctgg

SEQ ID NO: 96306 - DNA, 22 bp, Artificial Sequence
  Synthetic oligonucleotide; TTG chr11 5297810 5297831 5297827 5297832 +
ataataatgccaagaggctggg

SEQ ID NO: 96307 - DNA, 22 bp, Artificial Sequence
  Synthetic oligonucleotide; CTG chr11 5297830 5297851 5297847 5297852 +
gggtgagctataagaggagtca

SEQ ID NO: 96308 - DNA, 22 bp, Artificial Sequence
  Synthetic oligonucleotide; CTA chr11 5297840 5297861 5297857 5297862 +
taagaggagtcaaggctaatca

SEQ ID NO: 96309 - DNA, 22 bp, Artificial Sequence
  Synthetic oligonucleotide; CTA chr11 5297858 5297879 5297875 5297880 +
atcagtacagcaagaggaatga

SEQ ID NO: 96310 - DNA, 22 bp, Artificial Sequence
  Synthetic oligonucleotide; CTA chr11 5297891 5297912 5297908 5297913 +
gataaagggaacggcgtgggag

SEQ ID NO: 96311 - DNA, 22 bp, Artificial Sequence
  Synthetic oligonucleotide; TTT chr11 5297920 5297941 5297937 5297942 +
cctgagggaatattcatgagac

SEQ ID NO: 96312 - DNA, 22 bp, Artificial Sequence
  Synthetic oligonucleotide; TTC chr11 5297921 5297942 5297938 5297943 +
ctgagggaatattcatgagaca

SEQ ID NO: 96313 - DNA, 22 bp, Artificial Sequence
  Synthetic oligonucleotide; CTG chr11 5297924 5297945 5297941 5297946 +
agggaatattcatgagacaaac

SEQ ID NO: 96314 - DNA, 22 bp, Artificial Sequence
  Synthetic oligonucleotide; TTC chr11 5297935 5297956 5297952 5297957 +
atgagacaaacagagaataaag

SEQ ID NO: 96315 - DNA, 22 bp, Artificial Sequence
  Synthetic oligonucleotide; TTA chr11 5297993 5298014 5298010 5298015 +
atatacaagtgatttctagaaa

SEQ ID NO: 96316 - DNA, 22 bp, Artificial Sequence
  Synthetic oligonucleotide; TTT chr11 5298008 5298029 5298025 5298030 +
ctagaaagtgcatgaataagac

SEQ ID NO: 96317 - DNA, 22 bp, Artificial Sequence
  Synthetic oligonucleotide; TTC chr11 5298009 5298030 5298026 5298031 +
tagaaagtgcatgaataagaca

SEQ ID NO: 96318 - DNA, 22 bp, Artificial Sequence
  Synthetic oligonucleotide; CTA chr11 5298011 5298032 5298028 5298033 +
gaaagtgcatgaataagacagc

SEQ ID NO: 96319 - DNA, 22 bp, Artificial Sequence
  Synthetic oligonucleotide; CTA chr11 5298035 5298056 5298052 5298057 +
gaaagatagaaagacctggcac

SEQ ID NO: 96320 - DNA, 22 bp, Artificial Sequence
  Synthetic oligonucleotide; CTG chr11 5298053 5298074 5298070 5298075 +
gcacttaaaatgtgaatgtgaa

SEQ ID NO: 96321 - DNA, 22 bp, Artificial Sequence
  Synthetic oligonucleotide; CTT chr11 5298059 5298080 5298076 5298081 +
aaaatgtgaatgtgaaacagtt

SEQ ID NO: 96322 - DNA, 22 bp, Artificial Sequence
  Synthetic oligonucleotide; TTA chr11 5298060 5298081 5298077 5298082 +
aaatgtgaatgtgaaacagttc

SEQ ID NO: 96323 - DNA, 22 bp, Artificial Sequence
  Synthetic oligonucleotide; TTC chr11 5298082 5298103 5298099 5298104 +
tggctgagagaaatatctcagg

SEQ ID NO: 96324 - DNA, 22 bp, Artificial Sequence
  Synthetic oligonucleotide; CTG chr11 5298084 5298105 5298101 5298106 +
gctgagagaaatatctcaggaa

SEQ ID NO: 96325 - DNA, 22 bp, Artificial Sequence
  Synthetic oligonucleotide; CTG chr11 5298088 5298109 5298105 5298110 +
agagaaatatctcaggaatggc

SEQ ID NO: 96326 - DNA, 22 bp, Artificial Sequence
  Synthetic oligonucleotide; CTC chr11 5298101 5298122 5298118 5298123 +
aggaatggccatgttccaggct

SEQ ID NO: 96327 - DNA, 22 bp, Artificial Sequence
  Synthetic oligonucleotide; TTC chr11 5298117 5298138 5298134 5298139 +
caggcttcagggtaggacccat

SEQ ID NO: 96328 - DNA, 22 bp, Artificial Sequence
  Synthetic oligonucleotide; CTT chr11 5298124 5298145 5298141 5298146 +
cagggtaggacccatgccaggg

SEQ ID NO: 96329 - DNA, 22 bp, Artificial Sequence
  Synthetic oligonucleotide; TTC chr11 5298125 5298146 5298142 5298147 +
agggtaggacccatgccaggga

SEQ ID NO: 96330 - DNA, 22 bp, Artificial Sequence
  Synthetic oligonucleotide; CTT chr11 5298157 5298178 5298174 5298179 +
ttctgcctaaaatttctctgcc

SEQ ID NO: 96331 - DNA, 22 bp, Artificial Sequence
  Synthetic oligonucleotide; TTT chr11 5298158 5298179 5298175 5298180 +
tctgcctaaaatttctctgcct

SEQ ID NO: 96332 - DNA, 22 bp, Artificial Sequence
  Synthetic oligonucleotide; TTT chr11 5298159 5298180 5298176 5298181 +
ctgcctaaaatttctctgcctc

SEQ ID NO: 96333 - DNA, 22 bp, Artificial Sequence
  Synthetic oligonucleotide; TTC chr11 5298160 5298181 5298177 5298182 +
tgcctaaaatttctctgcctcc

SEQ ID NO: 96334 - DNA, 22 bp, Artificial Sequence
  Synthetic oligonucleotide; CTG chr11 5298162 5298183 5298179 5298184 +
cctaaaatttctctgcctcctg

SEQ ID NO: 96335 - DNA, 22 bp, Artificial Sequence
  Synthetic oligonucleotide; CTA chr11 5298166 5298187 5298183 5298188 +
aaatttctctgcctcctgtccc

SEQ ID NO: 96336 - DNA, 22 bp, Artificial Sequence
  Synthetic oligonucleotide; TTT chr11 5298172 5298193 5298189 5298194 +
ctctgcctcctgtccctatcat

SEQ ID NO: 96337 - DNA, 22 bp, Artificial Sequence
  Synthetic oligonucleotide; TTC chr11 5298173 5298194 5298190 5298195 +
tctgcctcctgtccctatcatt

SEQ ID NO: 96338 - DNA, 22 bp, Artificial Sequence
  Synthetic oligonucleotide; CTC chr11 5298175 5298196 5298192 5298197 +
tgcctcctgtccctatcattag

SEQ ID NO: 96339 - DNA, 22 bp, Artificial Sequence
  Synthetic oligonucleotide; CTG chr11 5298177 5298198 5298194 5298199 +
cctcctgtccctatcattagga

SEQ ID NO: 96340 - DNA, 22 bp, Artificial Sequence
  Synthetic oligonucleotide; CTC chr11 5298181 5298202 5298198 5298203 +
ctgtccctatcattaggaggcc

SEQ ID NO: 96341 - DNA, 22 bp, Artificial Sequence
  Synthetic oligonucleotide; CTG chr11 5298184 5298205 5298201 5298206 +
tccctatcattaggaggccagg

SEQ ID NO: 96342 - DNA, 22 bp, Artificial Sequence
  Synthetic oligonucleotide; CTA chr11 5298190 5298211 5298207 5298212 +
tcattaggaggccagggtggga

SEQ ID NO: 96343 - DNA, 22 bp, Artificial Sequence
  Synthetic oligonucleotide; TTA chr11 5298196 5298217 5298213 5298218 +
ggaggccagggtgggaggattg

SEQ ID NO: 96344 - DNA, 22 bp, Artificial Sequence
  Synthetic oligonucleotide; TTG chr11 5298218 5298239 5298235 5298240 +
cttgaggttaggaattggagag

SEQ ID NO: 96345 - DNA, 22 bp, Artificial Sequence
  Synthetic oligonucleotide; CTT chr11 5298221 5298242 5298238 5298243 +
gaggttaggaattggagagcag

SEQ ID NO: 96346 - DNA, 22 bp, Artificial Sequence
  Synthetic oligonucleotide; TTG chr11 5298222 5298243 5298239 5298244 +
aggttaggaattggagagcagc

SEQ ID NO: 96347 - DNA, 22 bp, Artificial Sequence
  Synthetic oligonucleotide; TTA chr11 5298228 5298249 5298245 5298250 +
ggaattggagagcagcctcggc

SEQ ID NO: 96348 - DNA, 22 bp, Artificial Sequence
  Synthetic oligonucleotide; TTG chr11 5298235 5298256 5298252 5298257 +
gagagcagcctcggcaacataa

SEQ ID NO: 96349 - DNA, 22 bp, Artificial Sequence
  Synthetic oligonucleotide; CTC chr11 5298247 5298268 5298264 5298269 +
ggcaacataacatgatcccata

SEQ ID NO: 96350 - DNA, 22 bp, Artificial Sequence
  Synthetic oligonucleotide; TTT chr11 5298272 5298293 5298289 5298294 +
acaaaaaataaaaacattagct

SEQ ID NO: 96351 - DNA, 22 bp, Artificial Sequence
  Synthetic oligonucleotide; TTA chr11 5298273 5298294 5298290 5298295 +
caaaaaataaaaacattagcta

SEQ ID NO: 96352 - DNA, 22 bp, Artificial Sequence
  Synthetic oligonucleotide; TTA chr11 5298291 5298312 5298308 5298313 +
gctaggtgcagtggcataaacc

SEQ ID NO: 96353 - DNA, 22 bp, Artificial Sequence
  Synthetic oligonucleotide; CTA chr11 5298295 5298316 5298312 5298317 +
ggtgcagtggcataaacctgta

SEQ ID NO: 96354 - DNA, 22 bp, Artificial Sequence
  Synthetic oligonucleotide; CTG chr11 5298315 5298336 5298332 5298337 +
tagtcctaggtactcaaaaagc

SEQ ID NO: 96355 - DNA, 22 bp, Artificial Sequence
  Synthetic oligonucleotide; CTA chr11 5298323 5298344 5298340 5298345 +
ggtactcaaaaagctgaggaag

SEQ ID NO: 96356 - DNA, 22 bp, Artificial Sequence
  Synthetic oligonucleotide; CTC chr11 5298330 5298351 5298347 5298352 +
aaaaagctgaggaagaaggatt

SEQ ID NO: 96357 - DNA, 22 bp, Artificial Sequence
  Synthetic oligonucleotide; CTG chr11 5298339 5298360 5298356 5298361 +
aggaagaaggattgcttgagcc

SEQ ID NO: 96358 - DNA, 22 bp, Artificial Sequence
  Synthetic oligonucleotide; TTG chr11 5298353 5298374 5298370 5298375 +
cttgagcccaggatttcaaggc

SEQ ID NO: 96359 - DNA, 22 bp, Artificial Sequence
  Synthetic oligonucleotide; CTT chr11 5298356 5298377 5298373 5298378 +
gagcccaggatttcaaggctgc

SEQ ID NO: 96360 - DNA, 22 bp, Artificial Sequence
  Synthetic oligonucleotide; TTG chr11 5298357 5298378 5298374 5298379 +
agcccaggatttcaaggctgca

SEQ ID NO: 96361 - DNA, 22 bp, Artificial Sequence
  Synthetic oligonucleotide; TTT chr11 5298369 5298390 5298386 5298391 +
caaggctgcagtgagctgtgat

SEQ ID NO: 96362 - DNA, 22 bp, Artificial Sequence
  Synthetic oligonucleotide; TTC chr11 5298370 5298391 5298387 5298392 +
aaggctgcagtgagctgtgatg

SEQ ID NO: 96363 - DNA, 22 bp, Artificial Sequence
  Synthetic oligonucleotide; CTG chr11 5298377 5298398 5298394 5298399 +
cagtgagctgtgatggcaccac

SEQ ID NO: 96364 - DNA, 22 bp, Artificial Sequence
  Synthetic oligonucleotide; CTG chr11 5298387 5298408 5298404 5298409 +
tgatggcaccactgcactccag

SEQ ID NO: 96365 - DNA, 22 bp, Artificial Sequence
  Synthetic oligonucleotide; CTG chr11 5298401 5298422 5298418 5298423 +
cactccagcctgggcaacagag

SEQ ID NO: 96366 - DNA, 22 bp, Artificial Sequence
  Synthetic oligonucleotide; CTC chr11 5298406 5298427 5298423 5298428 +
cagcctgggcaacagagcaaga

SEQ ID NO: 96367 - DNA, 22 bp, Artificial Sequence
  Synthetic oligonucleotide; CTG chr11 5298413 5298434 5298430 5298435 +
ggcaacagagcaagatcatgtc

SEQ ID NO: 96368 - DNA, 22 bp, Artificial Sequence
  Synthetic oligonucleotide; CTA chr11 5298437 5298458 5298454 5298459 +
taaaaataaataaataaataaa

SEQ ID NO: 96369 - DNA, 22 bp, Artificial Sequence
  Synthetic oligonucleotide; CTT chr11 5298470 5298491 5298487 5298492 +
tagccacaccagacaagtaaca

SEQ ID NO: 96370 - DNA, 22 bp, Artificial Sequence
  Synthetic oligonucleotide; TTT chr11 5298471 5298492 5298488 5298493 +
agccacaccagacaagtaacat

SEQ ID NO: 96371 - DNA, 22 bp, Artificial Sequence
  Synthetic oligonucleotide; TTA chr11 5298472 5298493 5298489 5298494 +
gccacaccagacaagtaacatt

SEQ ID NO: 96372 - DNA, 22 bp, Artificial Sequence
  Synthetic oligonucleotide; TTG chr11 5298495 5298516 5298512 5298517 +
tgtatttttaaaggactgcatt

SEQ ID NO: 96373 - DNA, 22 bp, Artificial Sequence
  Synthetic oligonucleotide; TTT chr11 5298502 5298523 5298519 5298524 +
ttaaaggactgcattaataaat

SEQ ID NO: 96374 - DNA, 22 bp, Artificial Sequence
  Synthetic oligonucleotide; TTT chr11 5298503 5298524 5298520 5298525 +
taaaggactgcattaataaatt

SEQ ID NO: 96375 - DNA, 22 bp, Artificial Sequence
  Synthetic oligonucleotide; TTT chr11 5298504 5298525 5298521 5298526 +
aaaggactgcattaataaattt

SEQ ID NO: 96376 - DNA, 22 bp, Artificial Sequence
  Synthetic oligonucleotide; TTA chr11 5298505 5298526 5298522 5298527 +
aaggactgcattaataaatttg

SEQ ID NO: 96377 - DNA, 22 bp, Artificial Sequence
  Synthetic oligonucleotide; CTG chr11 5298513 5298534 5298530 5298535 +
cattaataaatttgggggttta

SEQ ID NO: 96378 - DNA, 22 bp, Artificial Sequence
  Synthetic oligonucleotide; TTA chr11 5298518 5298539 5298535 5298540 +
ataaatttgggggtttacagaa

SEQ ID NO: 96379 - DNA, 22 bp, Artificial Sequence
  Synthetic oligonucleotide; TTT chr11 5298526 5298547 5298543 5298548 +
gggggtttacagaatggcaggt

SEQ ID NO: 96380 - DNA, 22 bp, Artificial Sequence
  Synthetic oligonucleotide; TTG chr11 5298527 5298548 5298544 5298549 +
ggggtttacagaatggcaggta

SEQ ID NO: 96381 - DNA, 22 bp, Artificial Sequence
  Synthetic oligonucleotide; TTT chr11 5298534 5298555 5298551 5298556 +
acagaatggcaggtagttatcc

SEQ ID NO: 96382 - DNA, 22 bp, Artificial Sequence
  Synthetic oligonucleotide; TTA chr11 5298535 5298556 5298552 5298557 +
cagaatggcaggtagttatcct

SEQ ID NO: 96383 - DNA, 22 bp, Artificial Sequence
  Synthetic oligonucleotide; TTA chr11 5298553 5298574 5298570 5298575 +
tccttgggaagacaatatgctg

SEQ ID NO: 96384 - DNA, 22 bp, Artificial Sequence
  Synthetic oligonucleotide; CTT chr11 5298558 5298579 5298575 5298580 +
gggaagacaatatgctgatggg

SEQ ID NO: 96385 - DNA, 22 bp, Artificial Sequence
  Synthetic oligonucleotide; TTG chr11 5298559 5298580 5298576 5298581 +
ggaagacaatatgctgatgggg

SEQ ID NO: 96386 - DNA, 22 bp, Artificial Sequence
  Synthetic oligonucleotide; CTG chr11 5298575 5298596 5298592 5298597 +
atggggaaatataattactgcc

SEQ ID NO: 96387 - DNA, 22 bp, Artificial Sequence
  Synthetic oligonucleotide; TTA chr11 5298592 5298613 5298609 5298614 +
ctgccctgactaaactcacagt

SEQ ID NO: 96388 - DNA, 22 bp, Artificial Sequence
  Synthetic oligonucleotide; CTG chr11 5298595 5298616 5298612 5298617 +
ccctgactaaactcacagtatg

SEQ ID NO: 96389 - DNA, 22 bp, Artificial Sequence
  Synthetic oligonucleotide; CTG chr11 5298600 5298621 5298617 5298622 +
actaaactcacagtatgacaga

SEQ ID NO: 96390 - DNA, 22 bp, Artificial Sequence
  Synthetic oligonucleotide; CTA chr11 5298604 5298625 5298621 5298626 +
aactcacagtatgacagagaat

SEQ ID NO: 96391 - DNA, 22 bp, Artificial Sequence
  Synthetic oligonucleotide; CTC chr11 5298609 5298630 5298626 5298631 +
acagtatgacagagaattaact

SEQ ID NO: 96392 - DNA, 22 bp, Artificial Sequence
  Synthetic oligonucleotide; TTA chr11 5298628 5298649 5298645 5298650 +
actgtgctgacttgataattcc

SEQ ID NO: 96393 - DNA, 22 bp, Artificial Sequence
  Synthetic oligonucleotide; CTG chr11 5298632 5298653 5298649 5298654 +
tgctgacttgataattcctcag

SEQ ID NO: 96394 - DNA, 22 bp, Artificial Sequence
  Synthetic oligonucleotide; CTG chr11 5298637 5298658 5298654 5298659 +
acttgataattcctcagagcag

SEQ ID NO: 96395 - DNA, 22 bp, Artificial Sequence
  Synthetic oligonucleotide; CTT chr11 5298641 5298662 5298658 5298663 +
gataattcctcagagcagatct

SEQ ID NO: 96396 - DNA, 22 bp, Artificial Sequence
  Synthetic oligonucleotide; TTG chr11 5298642 5298663 5298659 5298664 +
ataattcctcagagcagatctc

SEQ ID NO: 96397 - DNA, 22 bp, Artificial Sequence
  Synthetic oligonucleotide; TTC chr11 5298649 5298670 5298666 5298671 +
ctcagagcagatctctaagaga

SEQ ID NO: 96398 - DNA, 22 bp, Artificial Sequence
  Synthetic oligonucleotide; CTC chr11 5298652 5298673 5298669 5298674 +
agagcagatctctaagagagct

SEQ ID NO: 96399 - DNA, 22 bp, Artificial Sequence
  Synthetic oligonucleotide; CTC chr11 5298664 5298685 5298681 5298686 +
taagagagcttatagacacaac

SEQ ID NO: 96400 - DNA, 22 bp, Artificial Sequence
  Synthetic oligonucleotide; CTA chr11 5298666 5298687 5298683 5298688 +
agagagcttatagacacaacgc

SEQ ID NO: 96401 - DNA, 22 bp, Artificial Sequence
  Synthetic oligonucleotide; CTT chr11 5298675 5298696 5298692 5298697 +
atagacacaacgcctgcttcac

SEQ ID NO: 96402 - DNA, 22 bp, Artificial Sequence
  Synthetic oligonucleotide; TTA chr11 5298676 5298697 5298693 5298698 +
tagacacaacgcctgcttcaca

SEQ ID NO: 96403 - DNA, 22 bp, Artificial Sequence
  Synthetic oligonucleotide; CTG chr11 5298691 5298712 5298708 5298713 +
cttcacaaggttctcaagtatg

SEQ ID NO: 96404 - DNA, 22 bp, Artificial Sequence
  Synthetic oligonucleotide; CTT chr11 5298694 5298715 5298711 5298716 +
cacaaggttctcaagtatggca

SEQ ID NO: 96405 - DNA, 22 bp, Artificial Sequence
  Synthetic oligonucleotide; TTC chr11 5298695 5298716 5298712 5298717 +
acaaggttctcaagtatggcaa

SEQ ID NO: 96406 - DNA, 22 bp, Artificial Sequence
  Synthetic oligonucleotide; TTC chr11 5298704 5298725 5298721 5298726 +
tcaagtatggcaaacttgtcag

SEQ ID NO: 96407 - DNA, 22 bp, Artificial Sequence
  Synthetic oligonucleotide; CTC chr11 5298706 5298727 5298723 5298728 +
aagtatggcaaacttgtcagtc

SEQ ID NO: 96408 - DNA, 22 bp, Artificial Sequence
  Synthetic oligonucleotide; CTT chr11 5298721 5298742 5298738 5298743 +
gtcagtcagggtgagactgagg

SEQ ID NO: 96409 - DNA, 22 bp, Artificial Sequence
  Synthetic oligonucleotide; TTG chr11 5298722 5298743 5298739 5298744 +
tcagtcagggtgagactgagga

SEQ ID NO: 96410 - DNA, 22 bp, Artificial Sequence
  Synthetic oligonucleotide; CTG chr11 5298740 5298761 5298757 5298762 +
aggatgaggtctaagagacttg

SEQ ID NO: 96411 - DNA, 22 bp, Artificial Sequence
  Synthetic oligonucleotide; CTA chr11 5298753 5298774 5298770 5298775 +
agagacttgtctggaagctgca

SEQ ID NO: 96412 - DNA, 22 bp, Artificial Sequence
  Synthetic oligonucleotide; CTT chr11 5298761 5298782 5298778 5298783 +
gtctggaagctgcacttgtttg

SEQ ID NO: 96413 - DNA, 22 bp, Artificial Sequence
  Synthetic oligonucleotide; TTG chr11 5298762 5298783 5298779 5298784 +
tctggaagctgcacttgtttga

SEQ ID NO: 96414 - DNA, 22 bp, Artificial Sequence
  Synthetic oligonucleotide; CTG chr11 5298766 5298787 5298783 5298788 +
gaagctgcacttgtttgaaagg

SEQ ID NO: 96415 - DNA, 22 bp, Artificial Sequence
  Synthetic oligonucleotide; CTG chr11 5298773 5298794 5298790 5298795 +
cacttgtttgaaaggacactga

SEQ ID NO: 96416 - DNA, 22 bp, Artificial Sequence
  Synthetic oligonucleotide; CTT chr11 5298778 5298799 5298795 5298800 +
gtttgaaaggacactgatttta

SEQ ID NO: 96417 - DNA, 22 bp, Artificial Sequence
  Synthetic oligonucleotide; TTG chr11 5298779 5298800 5298796 5298801 +
tttgaaaggacactgattttac

SEQ ID NO: 96418 - DNA, 22 bp, Artificial Sequence
  Synthetic oligonucleotide; TTT chr11 5298782 5298803 5298799 5298804 +
gaaaggacactgattttacttc

SEQ ID NO: 96419 - DNA, 22 bp, Artificial Sequence
  Synthetic oligonucleotide; TTG chr11 5298783 5298804 5298800 5298805 +
aaaggacactgattttacttca

SEQ ID NO: 96420 - DNA, 22 bp, Artificial Sequence
  Synthetic oligonucleotide; CTG chr11 5298794 5298815 5298811 5298816 +
attttacttcagtggtgcaata

SEQ ID NO: 96421 - DNA, 22 bp, Artificial Sequence
  Synthetic oligonucleotide; TTT chr11 5298798 5298819 5298815 5298820 +
tacttcagtggtgcaataaatg

SEQ ID NO: 96422 - DNA, 22 bp, Artificial Sequence
  Synthetic oligonucleotide; TTT chr11 5298799 5298820 5298816 5298821 +
acttcagtggtgcaataaatgt

SEQ ID NO: 96423 - DNA, 22 bp, Artificial Sequence
  Synthetic oligonucleotide; TTA chr11 5298800 5298821 5298817 5298822 +
cttcagtggtgcaataaatgtc

SEQ ID NO: 96424 - DNA, 22 bp, Artificial Sequence
  Synthetic oligonucleotide; CTT chr11 5298803 5298824 5298820 5298825 +
cagtggtgcaataaatgtcctt

SEQ ID NO: 96425 - DNA, 22 bp, Artificial Sequence
  Synthetic oligonucleotide; TTC chr11 5298804 5298825 5298821 5298826 +
agtggtgcaataaatgtcctta

SEQ ID NO: 96426 - DNA, 22 bp, Artificial Sequence
  Synthetic oligonucleotide; CTT chr11 5298825 5298846 5298842 5298847 +
atatatcactggatcagcaggt

SEQ ID NO: 96427 - DNA, 22 bp, Artificial Sequence
  Synthetic oligonucleotide; TTA chr11 5298826 5298847 5298843 5298848 +
tatatcactggatcagcaggtg

SEQ ID NO: 96428 - DNA, 22 bp, Artificial Sequence
  Synthetic oligonucleotide; CTG chr11 5298836 5298857 5298853 5298858 +
gatcagcaggtggatgctgact

SEQ ID NO: 96429 - DNA, 22 bp, Artificial Sequence
  Synthetic oligonucleotide; CTG chr11 5298855 5298876 5298872 5298877 +
acttaataattgaaaggatttt

SEQ ID NO: 96430 - DNA, 22 bp, Artificial Sequence
  Synthetic oligonucleotide; CTT chr11 5298859 5298880 5298876 5298881 +
aataattgaaaggattttcaaa

SEQ ID NO: 96431 - DNA, 22 bp, Artificial Sequence
  Synthetic oligonucleotide; TTA chr11 5298860 5298881 5298877 5298882 +
ataattgaaaggattttcaaac

SEQ ID NO: 96432 - DNA, 22 bp, Artificial Sequence
  Synthetic oligonucleotide; TTG chr11 5298867 5298888 5298884 5298889 +
aaaggattttcaaactaagaag

SEQ ID NO: 96433 - DNA, 22 bp, Artificial Sequence
  Synthetic oligonucleotide; TTT chr11 5298876 5298897 5298893 5298898 +
tcaaactaagaagttgtaaaat

SEQ ID NO: 96434 - DNA, 22 bp, Artificial Sequence
  Synthetic oligonucleotide; TTT chr11 5298877 5298898 5298894 5298899 +
caaactaagaagttgtaaaata

SEQ ID NO: 96435 - DNA, 22 bp, Artificial Sequence
  Synthetic oligonucleotide; TTC chr11 5298878 5298899 5298895 5298900 +
aaactaagaagttgtaaaatat

SEQ ID NO: 96436 - DNA, 22 bp, Artificial Sequence
  Synthetic oligonucleotide; CTA chr11 5298884 5298905 5298901 5298906 +
agaagttgtaaaatataatata

SEQ ID NO: 96437 - DNA, 22 bp, Artificial Sequence
  Synthetic oligonucleotide; TTG chr11 5298892 5298913 5298909 5298914 +
taaaatataatatataggttat

SEQ ID NO: 96438 - DNA, 22 bp, Artificial Sequence
  Synthetic oligonucleotide; TTA chr11 5298913 5298934 5298930 5298935 +
tgaatataattaaaattaaaac

SEQ ID NO: 96439 - DNA, 22 bp, Artificial Sequence
  Synthetic oligonucleotide; TTA chr11 5298925 5298946 5298942 5298947 +
aaattaaaacgcataaatatac

SEQ ID NO: 96440 - DNA, 22 bp, Artificial Sequence
  Synthetic oligonucleotide; TTA chr11 5298931 5298952 5298948 5298953 +
aaacgcataaatatacatttac

SEQ ID NO: 96441 - DNA, 22 bp, Artificial Sequence
  Synthetic oligonucleotide; TTT chr11 5298951 5298972 5298968 5298973 +
acttaagaaaatgagtgatttt

SEQ ID NO: 96442 - DNA, 22 bp, Artificial Sequence
  Synthetic oligonucleotide; TTA chr11 5298952 5298973 5298969 5298974 +
cttaagaaaatgagtgattttt

SEQ ID NO: 96443 - DNA, 22 bp, Artificial Sequence
  Synthetic oligonucleotide; CTT chr11 5298955 5298976 5298972 5298977 +
aagaaaatgagtgatttttaaa

SEQ ID NO: 96444 - DNA, 22 bp, Artificial Sequence
  Synthetic oligonucleotide; TTA chr11 5298956 5298977 5298973 5298978 +
agaaaatgagtgatttttaaaa

SEQ ID NO: 96445 - DNA, 22 bp, Artificial Sequence
  Synthetic oligonucleotide; TTT chr11 5298972 5298993 5298989 5298994 +
ttaaaatttatcctttttaatt

SEQ ID NO: 96446 - DNA, 22 bp, Artificial Sequence
  Synthetic oligonucleotide; TTT chr11 5298973 5298994 5298990 5298995 +
taaaatttatcctttttaattg

SEQ ID NO: 96447 - DNA, 22 bp, Artificial Sequence
  Synthetic oligonucleotide; TTT chr11 5298974 5298995 5298991 5298996 +
aaaatttatcctttttaattga

SEQ ID NO: 96448 - DNA, 22 bp, Artificial Sequence
  Synthetic oligonucleotide; TTA chr11 5298975 5298996 5298992 5298997 +
aaatttatcctttttaattgat

SEQ ID NO: 96449 - DNA, 22 bp, Artificial Sequence
  Synthetic oligonucleotide; TTT chr11 5298981 5299002 5298998 5299003 +
atcctttttaattgatttttga

SEQ ID NO: 96450 - DNA, 22 bp, Artificial Sequence
  Synthetic oligonucleotide; TTA chr11 5298982 5299003 5298999 5299004 +
tcctttttaattgatttttgac

SEQ ID NO: 96451 - DNA, 22 bp, Artificial Sequence
  Synthetic oligonucleotide; CTT chr11 5298987 5299008 5299004 5299009 +
tttaattgatttttgactattg

SEQ ID NO: 96452 - DNA, 22 bp, Artificial Sequence
  Synthetic oligonucleotide; TTT chr11 5298988 5299009 5299005 5299010 +
ttaattgatttttgactattga

SEQ ID NO: 96453 - DNA, 22 bp, Artificial Sequence
  Synthetic oligonucleotide; TTT chr11 5298989 5299010 5299006 5299011 +
taattgatttttgactattgat

SEQ ID NO: 96454 - DNA, 22 bp, Artificial Sequence
  Synthetic oligonucleotide; TTT chr11 5298990 5299011 5299007 5299012 +
aattgatttttgactattgata

SEQ ID NO: 96455 - DNA, 22 bp, Artificial Sequence
  Synthetic oligonucleotide; TTA chr11 5298991 5299012 5299008 5299013 +
attgatttttgactattgatac

SEQ ID NO: 96456 - DNA, 22 bp, Artificial Sequence
  Synthetic oligonucleotide; TTG chr11 5298995 5299016 5299012 5299017 +
atttttgactattgatacaggc

SEQ ID NO: 96457 - DNA, 22 bp, Artificial Sequence
  Synthetic oligonucleotide; TTT chr11 5298999 5299020 5299016 5299021 +
ttgactattgatacaggctgtt

SEQ ID NO: 96458 - DNA, 22 bp, Artificial Sequence
  Synthetic oligonucleotide; TTT chr11 5299000 5299021 5299017 5299022 +
tgactattgatacaggctgttt

SEQ ID NO: 96459 - DNA, 22 bp, Artificial Sequence
  Synthetic oligonucleotide; TTT chr11 5299001 5299022 5299018 5299023 +
gactattgatacaggctgttta

SEQ ID NO: 96460 - DNA, 22 bp, Artificial Sequence
  Synthetic oligonucleotide; TTG chr11 5299002 5299023 5299019 5299024 +
actattgatacaggctgtttaa

SEQ ID NO: 96461 - DNA, 22 bp, Artificial Sequence
  Synthetic oligonucleotide; CTA chr11 5299006 5299027 5299023 5299028 +
ttgatacaggctgtttaaagat

SEQ ID NO: 96462 - DNA, 22 bp, Artificial Sequence
  Synthetic oligonucleotide; TTG chr11 5299009 5299030 5299026 5299031 +
atacaggctgtttaaagatcaa

SEQ ID NO: 96463 - DNA, 22 bp, Artificial Sequence
  Synthetic oligonucleotide; CTG chr11 5299019 5299040 5299036 5299041 +
tttaaagatcaataggctataa

SEQ ID NO: 96464 - DNA, 22 bp, Artificial Sequence
  Synthetic oligonucleotide; TTT chr11 5299022 5299043 5299039 5299044 +
aaagatcaataggctataatat

SEQ ID NO: 96465 - DNA, 22 bp, Artificial Sequence
  Synthetic oligonucleotide; TTA chr11 5299023 5299044 5299040 5299045 +
aagatcaataggctataatatc

SEQ ID NO: 96466 - DNA, 22 bp, Artificial Sequence
  Synthetic oligonucleotide; CTA chr11 5299038 5299059 5299055 5299060 +
taatatcatattatgtcatccc

SEQ ID NO: 96467 - DNA, 22 bp, Artificial Sequence
  Synthetic oligonucleotide; TTA chr11 5299051 5299072 5299068 5299073 +
tgtcatcccttgctaacatatg

SEQ ID NO: 96468 - DNA, 22 bp, Artificial Sequence
  Synthetic oligonucleotide; CTT chr11 5299062 5299083 5299079 5299084 +
gctaacatatgagtaaacttga

SEQ ID NO: 96469 - DNA, 22 bp, Artificial Sequence
  Synthetic oligonucleotide; TTG chr11 5299063 5299084 5299080 5299085 +
ctaacatatgagtaaacttgag

SEQ ID NO: 96470 - DNA, 22 bp, Artificial Sequence
  Synthetic oligonucleotide; CTA chr11 5299066 5299087 5299083 5299088 +
acatatgagtaaacttgagctc

SEQ ID NO: 96471 - DNA, 22 bp, Artificial Sequence
  Synthetic oligonucleotide; CTT chr11 5299082 5299103 5299099 5299104 +
gagctctcaacttgatcttccc

SEQ ID NO: 96472 - DNA, 22 bp, Artificial Sequence
  Synthetic oligonucleotide; TTG chr11 5299083 5299104 5299100 5299105 +
agctctcaacttgatcttccca

SEQ ID NO: 96473 - DNA, 22 bp, Artificial Sequence
  Synthetic oligonucleotide; CTC chr11 5299088 5299109 5299105 5299110 +
tcaacttgatcttcccacttct

SEQ ID NO: 96474 - DNA, 22 bp, Artificial Sequence
  Synthetic oligonucleotide; CTC chr11 5299090 5299111 5299107 5299112 +
aacttgatcttcccacttcttc

SEQ ID NO: 96475 - DNA, 22 bp, Artificial Sequence
  Synthetic oligonucleotide; CTT chr11 5299095 5299116 5299112 5299117 +
gatcttcccacttcttcttatt

SEQ ID NO: 96476 - DNA, 22 bp, Artificial Sequence
  Synthetic oligonucleotide; TTG chr11 5299096 5299117 5299113 5299118 +
atcttcccacttcttcttattt

SEQ ID NO: 96477 - DNA, 22 bp, Artificial Sequence
  Synthetic oligonucleotide; CTT chr11 5299101 5299122 5299118 5299123 +
cccacttcttcttatttataat

SEQ ID NO: 96478 - DNA, 22 bp, Artificial Sequence
  Synthetic oligonucleotide; TTC chr11 5299102 5299123 5299119 5299124 +
ccacttcttcttatttataatt

SEQ ID NO: 96479 - DNA, 22 bp, Artificial Sequence
  Synthetic oligonucleotide; CTT chr11 5299108 5299129 5299125 5299130 +
cttcttatttataattagatac

SEQ ID NO: 96480 - DNA, 22 bp, Artificial Sequence
  Synthetic oligonucleotide; TTC chr11 5299109 5299130 5299126 5299131 +
ttcttatttataattagatacc

SEQ ID NO: 96481 - DNA, 22 bp, Artificial Sequence
  Synthetic oligonucleotide; CTT chr11 5299111 5299132 5299128 5299133 +
cttatttataattagatacctc

SEQ ID NO: 96482 - DNA, 22 bp, Artificial Sequence
  Synthetic oligonucleotide; TTC chr11 5299112 5299133 5299129 5299134 +
ttatttataattagatacctct

SEQ ID NO: 96483 - DNA, 22 bp, Artificial Sequence
  Synthetic oligonucleotide; CTT chr11 5299114 5299135 5299131 5299136 +
atttataattagatacctctgt

SEQ ID NO: 96484 - DNA, 22 bp, Artificial Sequence
  Synthetic oligonucleotide; TTA chr11 5299115 5299136 5299132 5299137 +
tttataattagatacctctgtt

SEQ ID NO: 96485 - DNA, 22 bp, Artificial Sequence
  Synthetic oligonucleotide; TTT chr11 5299118 5299139 5299135 5299140 +
ataattagatacctctgtttct

SEQ ID NO: 96486 - DNA, 22 bp, Artificial Sequence
  Synthetic oligonucleotide; TTA chr11 5299119 5299140 5299136 5299141 +
taattagatacctctgtttctt

SEQ ID NO: 96487 - DNA, 22 bp, Artificial Sequence
  Synthetic oligonucleotide; TTA chr11 5299125 5299146 5299142 5299147 +
gatacctctgtttcttagactt

SEQ ID NO: 96488 - DNA, 22 bp, Artificial Sequence
  Synthetic oligonucleotide; CTC chr11 5299133 5299154 5299150 5299155 +
tgtttcttagacttcgctatca

SEQ ID NO: 96489 - DNA, 22 bp, Artificial Sequence
  Synthetic oligonucleotide; CTG chr11 5299135 5299156 5299152 5299157 +
tttcttagacttcgctatcata

SEQ ID NO: 96490 - DNA, 22 bp, Artificial Sequence
  Synthetic oligonucleotide; TTT chr11 5299138 5299159 5299155 5299160 +
cttagacttcgctatcatacct

SEQ ID NO: 96491 - DNA, 22 bp, Artificial Sequence
  Synthetic oligonucleotide; TTC chr11 5299139 5299160 5299156 5299161 +
ttagacttcgctatcatacctt

SEQ ID NO: 96492 - DNA, 22 bp, Artificial Sequence
  Synthetic oligonucleotide; CTT chr11 5299141 5299162 5299158 5299163 +
agacttcgctatcataccttat

SEQ ID NO: 96493 - DNA, 22 bp, Artificial Sequence
  Synthetic oligonucleotide; TTA chr11 5299142 5299163 5299159 5299164 +
gacttcgctatcataccttatt

SEQ ID NO: 96494 - DNA, 22 bp, Artificial Sequence
  Synthetic oligonucleotide; CTT chr11 5299147 5299168 5299164 5299169 +
cgctatcataccttattttcag

SEQ ID NO: 96495 - DNA, 22 bp, Artificial Sequence
  Synthetic oligonucleotide; TTC chr11 5299148 5299169 5299165 5299170 +
gctatcataccttattttcagc

SEQ ID NO: 96496 - DNA, 22 bp, Artificial Sequence
  Synthetic oligonucleotide; CTA chr11 5299152 5299173 5299169 5299174 +
tcataccttattttcagcacat

SEQ ID NO: 96497 - DNA, 22 bp, Artificial Sequence
  Synthetic oligonucleotide; CTT chr11 5299161 5299182 5299178 5299183 +
attttcagcacatcgcccctaa

SEQ ID NO: 96498 - DNA, 22 bp, Artificial Sequence
  Synthetic oligonucleotide; TTA chr11 5299162 5299183 5299179 5299184 +
ttttcagcacatcgcccctaag

SEQ ID NO: 96499 - DNA, 22 bp, Artificial Sequence
  Synthetic oligonucleotide; TTT chr11 5299165 5299186 5299182 5299187 +
tcagcacatcgcccctaagttt

SEQ ID NO: 96500 - DNA, 22 bp, Artificial Sequence
  Synthetic oligonucleotide; TTT chr11 5299166 5299187 5299183 5299188 +
cagcacatcgcccctaagtttg

SEQ ID NO: 96501 - DNA, 22 bp, Artificial Sequence
  Synthetic oligonucleotide; TTC chr11 5299167 5299188 5299184 5299189 +
agcacatcgcccctaagtttgc

SEQ ID NO: 96502 - DNA, 22 bp, Artificial Sequence
  Synthetic oligonucleotide; CTA chr11 5299182 5299203 5299199 5299204 +
agtttgcattacacatttacac

SEQ ID NO: 96503 - DNA, 22 bp, Artificial Sequence
  Synthetic oligonucleotide; TTT chr11 5299187 5299208 5299204 5299209 +
gcattacacatttacacattgt

SEQ ID NO: 96504 - DNA, 22 bp, Artificial Sequence
  Synthetic oligonucleotide; TTG chr11 5299188 5299209 5299205 5299210 +
cattacacatttacacattgtt

SEQ ID NO: 96505 - DNA, 22 bp, Artificial Sequence
  Synthetic oligonucleotide; TTA chr11 5299193 5299214 5299210 5299215 +
cacatttacacattgttgtagg

SEQ ID NO: 96506 - DNA, 22 bp, Artificial Sequence
  Synthetic oligonucleotide; TTT chr11 5299200 5299221 5299217 5299222 +
acacattgttgtaggctgtctt

SEQ ID NO: 96507 - DNA, 22 bp, Artificial Sequence
  Synthetic oligonucleotide; TTA chr11 5299201 5299222 5299218 5299223 +
cacattgttgtaggctgtcttc

SEQ ID NO: 96508 - DNA, 22 bp, Artificial Sequence
  Synthetic oligonucleotide; TTG chr11 5299208 5299229 5299225 5299230 +
ttgtaggctgtcttcttataac

SEQ ID NO: 96509 - DNA, 22 bp, Artificial Sequence
  Synthetic oligonucleotide; TTG chr11 5299211 5299232 5299228 5299233 +
taggctgtcttcttataacaat

SEQ ID NO: 96510 - DNA, 22 bp, Artificial Sequence
  Synthetic oligonucleotide; CTG chr11 5299218 5299239 5299235 5299240 +
tcttcttataacaatcaagaaa

SEQ ID NO: 96511 - DNA, 22 bp, Artificial Sequence
  Synthetic oligonucleotide; CTT chr11 5299222 5299243 5299239 5299244 +
cttataacaatcaagaaaacag

SEQ ID NO: 96512 - DNA, 22 bp, Artificial Sequence
  Synthetic oligonucleotide; TTC chr11 5299223 5299244 5299240 5299245 +
ttataacaatcaagaaaacagc

SEQ ID NO: 96513 - DNA, 22 bp, Artificial Sequence
  Synthetic oligonucleotide; CTT chr11 5299225 5299246 5299242 5299247 +
ataacaatcaagaaaacagcat

SEQ ID NO: 96514 - DNA, 22 bp, Artificial Sequence
  Synthetic oligonucleotide; TTA chr11 5299226 5299247 5299243 5299248 +
taacaatcaagaaaacagcatc

SEQ ID NO: 96515 - DNA, 22 bp, Artificial Sequence
  Synthetic oligonucleotide; CTA chr11 5299259 5299280 5299276 5299281 +
ctgacaaatacatttgccattt

SEQ ID NO: 96516 - DNA, 22 bp, Artificial Sequence
  Synthetic oligonucleotide; CTG chr11 5299262 5299283 5299279 5299284 +
acaaatacatttgccattttta

SEQ ID NO: 96517 - DNA, 22 bp, Artificial Sequence
  Synthetic oligonucleotide; TTT chr11 5299274 5299295 5299291 5299296 +
gccatttttacaaaaaaccctt

SEQ ID NO: 96518 - DNA, 22 bp, Artificial Sequence
  Synthetic oligonucleotide; TTG chr11 5299275 5299296 5299292 5299297 +
ccatttttacaaaaaaccctta

SEQ ID NO: 96519 - DNA, 22 bp, Artificial Sequence
  Synthetic oligonucleotide; TTT chr11 5299281 5299302 5299298 5299303 +
ttacaaaaaacccttattcgcc

SEQ ID NO: 96520 - DNA, 22 bp, Artificial Sequence
  Synthetic oligonucleotide; TTT chr11 5299282 5299303 5299299 5299304 +
tacaaaaaacccttattcgcct

SEQ ID NO: 96521 - DNA, 22 bp, Artificial Sequence
  Synthetic oligonucleotide; TTT chr11 5299283 5299304 5299300 5299305 +
acaaaaaacccttattcgcctg

SEQ ID NO: 96522 - DNA, 22 bp, Artificial Sequence
  Synthetic oligonucleotide; TTA chr11 5299284 5299305 5299301 5299306 +
caaaaaacccttattcgcctga

SEQ ID NO: 96523 - DNA, 22 bp, Artificial Sequence
  Synthetic oligonucleotide; CTT chr11 5299296 5299317 5299313 5299318 +
attcgcctgaaaattttaatac

SEQ ID NO: 96524 - DNA, 22 bp, Artificial Sequence
  Synthetic oligonucleotide; TTA chr11 5299297 5299318 5299314 5299319 +
ttcgcctgaaaattttaatacc

SEQ ID NO: 96525 - DNA, 22 bp, Artificial Sequence
  Synthetic oligonucleotide; TTC chr11 5299300 5299321 5299317 5299322 +
gcctgaaaattttaataccgct

SEQ ID NO: 96526 - DNA, 22 bp, Artificial Sequence
  Synthetic oligonucleotide; CTG chr11 5299305 5299326 5299322 5299327 +
aaaattttaataccgctatgtt

SEQ ID NO: 96527 - DNA, 22 bp, Artificial Sequence
  Synthetic oligonucleotide; TTT chr11 5299312 5299333 5299329 5299334 +
taataccgctatgttttttact

SEQ ID NO: 96528 - DNA, 22 bp, Artificial Sequence
  Synthetic oligonucleotide; TTT chr11 5299313 5299334 5299330 5299335 +
aataccgctatgttttttactc

SEQ ID NO: 96529 - DNA, 22 bp, Artificial Sequence
  Synthetic oligonucleotide; TTA chr11 5299314 5299335 5299331 5299336 +
ataccgctatgttttttactct

SEQ ID NO: 96530 - DNA, 22 bp, Artificial Sequence
  Synthetic oligonucleotide; CTA chr11 5299323 5299344 5299340 5299345 +
tgttttttactcttacagacat

SEQ ID NO: 96531 - DNA, 22 bp, Artificial Sequence
  Synthetic oligonucleotide; TTT chr11 5299328 5299349 5299345 5299350 +
tttactcttacagacatccttt

SEQ ID NO: 96532 - DNA, 22 bp, Artificial Sequence
  Synthetic oligonucleotide; TTT chr11 5299329 5299350 5299346 5299351 +
ttactcttacagacatcctttc

SEQ ID NO: 96533 - DNA, 22 bp, Artificial Sequence
  Synthetic oligonucleotide; TTT chr11 5299330 5299351 5299347 5299352 +
tactcttacagacatcctttca

SEQ ID NO: 96534 - DNA, 22 bp, Artificial Sequence
  Synthetic oligonucleotide; TTT chr11 5299331 5299352 5299348 5299353 +
actcttacagacatcctttcag

SEQ ID NO: 96535 - DNA, 22 bp, Artificial Sequence
  Synthetic oligonucleotide; TTA chr11 5299332 5299353 5299349 5299354 +
ctcttacagacatcctttcagt

SEQ ID NO: 96536 - DNA, 22 bp, Artificial Sequence
  Synthetic oligonucleotide; CTC chr11 5299335 5299356 5299352 5299357 +
ttacagacatcctttcagtggt

SEQ ID NO: 96537 - DNA, 22 bp, Artificial Sequence
  Synthetic oligonucleotide; CTT chr11 5299337 5299358 5299354 5299359 +
acagacatcctttcagtggtca

SEQ ID NO: 96538 - DNA, 22 bp, Artificial Sequence
  Synthetic oligonucleotide; TTA chr11 5299338 5299359 5299355 5299360 +
cagacatcctttcagtggtcaa

SEQ ID NO: 96539 - DNA, 22 bp, Artificial Sequence
  Synthetic oligonucleotide; CTT chr11 5299349 5299370 5299366 5299371 +
tcagtggtcaatagagatgcag

SEQ ID NO: 96540 - DNA, 22 bp, Artificial Sequence
  Synthetic oligonucleotide; TTT chr11 5299350 5299371 5299367 5299372 +
cagtggtcaatagagatgcagc

SEQ ID NO: 96541 - DNA, 22 bp, Artificial Sequence
  Synthetic oligonucleotide; TTC chr11 5299351 5299372 5299368 5299373 +
agtggtcaatagagatgcagct

SEQ ID NO: 96542 - DNA, 22 bp, Artificial Sequence
  Synthetic oligonucleotide; CTT chr11 5299374 5299395 5299391 5299396 +
tcctaaatgtagtttgtatgtt

SEQ ID NO: 96543 - DNA, 22 bp, Artificial Sequence
  Synthetic oligonucleotide; TTT chr11 5299375 5299396 5299392 5299397 +
cctaaatgtagtttgtatgtta

SEQ ID NO: 96544 - DNA, 22 bp, Artificial Sequence
  Synthetic oligonucleotide; TTC chr11 5299376 5299397 5299393 5299398 +
ctaaatgtagtttgtatgttag

SEQ ID NO: 96545 - DNA, 22 bp, Artificial Sequence
  Synthetic oligonucleotide; CTA chr11 5299379 5299400 5299396 5299401 +
aatgtagtttgtatgttagcac

SEQ ID NO: 96546 - DNA, 22 bp, Artificial Sequence
  Synthetic oligonucleotide; TTT chr11 5299389 5299410 5299406 5299411 +
gtatgttagcacaatgtgcatt

SEQ ID NO: 96547 - DNA, 22 bp, Artificial Sequence
  Synthetic oligonucleotide; TTG chr11 5299390 5299411 5299407 5299412 +
tatgttagcacaatgtgcattt

SEQ ID NO: 96548 - DNA, 22 bp, Artificial Sequence
  Synthetic oligonucleotide; TTA chr11 5299397 5299418 5299414 5299419 +
gcacaatgtgcattttagacca

SEQ ID NO: 96549 - DNA, 22 bp, Artificial Sequence
  Synthetic oligonucleotide; TTT chr11 5299412 5299433 5299429 5299434 +
tagaccaaacaacaaaggcaac

SEQ ID NO: 96550 - DNA, 22 bp, Artificial Sequence
  Synthetic oligonucleotide; TTT chr11 5299413 5299434 5299430 5299435 +
agaccaaacaacaaaggcaacc

SEQ ID NO: 96551 - DNA, 22 bp, Artificial Sequence
  Synthetic oligonucleotide; TTA chr11 5299414 5299435 5299431 5299436 +
gaccaaacaacaaaggcaacca

SEQ ID NO: 96552 - DNA, 22 bp, Artificial Sequence
  Synthetic oligonucleotide; TTT chr11 5299449 5299470 5299466 5299471 +
ctaaatagaataaactctgtat

SEQ ID NO: 96553 - DNA, 22 bp, Artificial Sequence
  Synthetic oligonucleotide; TTC chr11 5299450 5299471 5299467 5299472 +
taaatagaataaactctgtatg

SEQ ID NO: 96554 - DNA, 22 bp, Artificial Sequence
  Synthetic oligonucleotide; CTA chr11 5299452 5299473 5299469 5299474 +
aatagaataaactctgtatgcc

SEQ ID NO: 96555 - DNA, 22 bp, Artificial Sequence
  Synthetic oligonucleotide; CTC chr11 5299466 5299487 5299483 5299488 +
tgtatgccaactttggaaaaac

SEQ ID NO: 96556 - DNA, 22 bp, Artificial Sequence
  Synthetic oligonucleotide; CTG chr11 5299468 5299489 5299485 5299490 +
tatgccaactttggaaaaacaa

SEQ ID NO: 96557 - DNA, 22 bp, Artificial Sequence
  Synthetic oligonucleotide; CTT chr11 5299479 5299500 5299496 5299501 +
tggaaaaacaaataaataaatt

SEQ ID NO: 96558 - DNA, 22 bp, Artificial Sequence
  Synthetic oligonucleotide; TTT chr11 5299480 5299501 5299497 5299502 +
ggaaaaacaaataaataaattt

SEQ ID NO: 96559 - DNA, 22 bp, Artificial Sequence
  Synthetic oligonucleotide; TTG chr11 5299481 5299502 5299498 5299503 +
gaaaaacaaataaataaatttt

SEQ ID NO: 96560 - DNA, 22 bp, Artificial Sequence
  Synthetic oligonucleotide; TTT chr11 5299502 5299523 5299519 5299524 +
tacacagagaataacaactaaa

SEQ ID NO: 96561 - DNA, 22 bp, Artificial Sequence
  Synthetic oligonucleotide; TTT chr11 5299503 5299524 5299520 5299525 +
acacagagaataacaactaaaa

SEQ ID NO: 96562 - DNA, 22 bp, Artificial Sequence
  Synthetic oligonucleotide; TTA chr11 5299504 5299525 5299521 5299526 +
cacagagaataacaactaaaat

SEQ ID NO: 96563 - DNA, 22 bp, Artificial Sequence
  Synthetic oligonucleotide; CTA chr11 5299522 5299543 5299539 5299544 +
aaatgacaatgaataaaccccc

SEQ ID NO: 96564 - DNA, 22 bp, Artificial Sequence
  Synthetic oligonucleotide; CTA chr11 5299553 5299574 5299570 5299575 +
ctttcaaagaactctcacaaac

SEQ ID NO: 96565 - DNA, 22 bp, Artificial Sequence
  Synthetic oligonucleotide; CTT chr11 5299556 5299577 5299573 5299578 +
tcaaagaactctcacaaacaat

SEQ ID NO: 96566 - DNA, 22 bp, Artificial Sequence
  Synthetic oligonucleotide; TTT chr11 5299557 5299578 5299574 5299579 +
caaagaactctcacaaacaatt

SEQ ID NO: 96567 - DNA, 22 bp, Artificial Sequence
  Synthetic oligonucleotide; TTC chr11 5299558 5299579 5299575 5299580 +
aaagaactctcacaaacaattc

SEQ ID NO: 96568 - DNA, 22 bp, Artificial Sequence
  Synthetic oligonucleotide; CTC chr11 5299567 5299588 5299584 5299589 +
tcacaaacaattcgcacaataa

SEQ ID NO: 96569 - DNA, 22 bp, Artificial Sequence
  Synthetic oligonucleotide; CTC chr11 5299569 5299590 5299586 5299591 +
acaaacaattcgcacaataact

SEQ ID NO: 96570 - DNA, 22 bp, Artificial Sequence
  Synthetic oligonucleotide; TTC chr11 5299580 5299601 5299597 5299602 +
gcacaataactgaatccttcag

SEQ ID NO: 96571 - DNA, 22 bp, Artificial Sequence
  Synthetic oligonucleotide; CTG chr11 5299592 5299613 5299609 5299614 +
aatccttcaggagtagtcattt

SEQ ID NO: 96572 - DNA, 22 bp, Artificial Sequence
  Synthetic oligonucleotide; CTT chr11 5299599 5299620 5299616 5299621 +
caggagtagtcatttattagtt

SEQ ID NO: 96573 - DNA, 22 bp, Artificial Sequence
  Synthetic oligonucleotide; TTC chr11 5299600 5299621 5299617 5299622 +
aggagtagtcatttattagttt

SEQ ID NO: 96574 - DNA, 22 bp, Artificial Sequence
  Synthetic oligonucleotide; TTT chr11 5299614 5299635 5299631 5299636 +
attagtttttatttttcctgca

SEQ ID NO: 96575 - DNA, 22 bp, Artificial Sequence
  Synthetic oligonucleotide; TTA chr11 5299615 5299636 5299632 5299637 +
ttagtttttatttttcctgcat

SEQ ID NO: 96576 - DNA, 22 bp, Artificial Sequence
  Synthetic oligonucleotide; TTA chr11 5299618 5299639 5299635 5299640 +
gtttttatttttcctgcatcca

SEQ ID NO: 96577 - DNA, 22 bp, Artificial Sequence
  Synthetic oligonucleotide; TTT chr11 5299622 5299643 5299639 5299644 +
ttatttttcctgcatccaaatg

SEQ ID NO: 96578 - DNA, 22 bp, Artificial Sequence
  Synthetic oligonucleotide; TTT chr11 5299623 5299644 5299640 5299645 +
tatttttcctgcatccaaatgg

SEQ ID NO: 96579 - DNA, 22 bp, Artificial Sequence
  Synthetic oligonucleotide; TTT chr11 5299624 5299645 5299641 5299646 +
atttttcctgcatccaaatggg

SEQ ID NO: 96580 - DNA, 22 bp, Artificial Sequence
  Synthetic oligonucleotide; TTA chr11 5299625 5299646 5299642 5299647 +
tttttcctgcatccaaatgggc

SEQ ID NO: 96581 - DNA, 22 bp, Artificial Sequence
  Synthetic oligonucleotide; TTT chr11 5299628 5299649 5299645 5299650 +
ttcctgcatccaaatgggcctt

SEQ ID NO: 96582 - DNA, 22 bp, Artificial Sequence
  Synthetic oligonucleotide; TTT chr11 5299629 5299650 5299646 5299651 +
tcctgcatccaaatgggccttc

SEQ ID NO: 96583 - DNA, 22 bp, Artificial Sequence
  Synthetic oligonucleotide; TTT chr11 5299630 5299651 5299647 5299652 +
cctgcatccaaatgggccttct

SEQ ID NO: 96584 - DNA, 22 bp, Artificial Sequence
  Synthetic oligonucleotide; TTC chr11 5299631 5299652 5299648 5299653 +
ctgcatccaaatgggccttcta

SEQ ID NO: 96585 - DNA, 22 bp, Artificial Sequence
  Synthetic oligonucleotide; CTG chr11 5299634 5299655 5299651 5299656 +
catccaaatgggccttctaatt

SEQ ID NO: 96586 - DNA, 22 bp, Artificial Sequence
  Synthetic oligonucleotide; CTT chr11 5299650 5299671 5299667 5299672 +
ctaatttggagaaatactgcat

SEQ ID NO: 96587 - DNA, 22 bp, Artificial Sequence
  Synthetic oligonucleotide; TTC chr11 5299651 5299672 5299668 5299673 +
taatttggagaaatactgcatt

SEQ ID NO: 96588 - DNA, 22 bp, Artificial Sequence
  Synthetic oligonucleotide; CTA chr11 5299653 5299674 5299670 5299675 +
atttggagaaatactgcattat

SEQ ID NO: 96589 - DNA, 22 bp, Artificial Sequence
  Synthetic oligonucleotide; TTT chr11 5299657 5299678 5299674 5299679 +
ggagaaatactgcattatttag

SEQ ID NO: 96590 - DNA, 22 bp, Artificial Sequence
  Synthetic oligonucleotide; TTG chr11 5299658 5299679 5299675 5299680 +
gagaaatactgcattatttagc

SEQ ID NO: 96591 - DNA, 22 bp, Artificial Sequence
  Synthetic oligonucleotide; CTG chr11 5299669 5299690 5299686 5299691 +
cattatttagctttagttttca

SEQ ID NO: 96592 - DNA, 22 bp, Artificial Sequence
  Synthetic oligonucleotide; TTA chr11 5299674 5299695 5299691 5299696 +
tttagctttagttttcagtaag

SEQ ID NO: 96593 - DNA, 22 bp, Artificial Sequence
  Synthetic oligonucleotide; TTT chr11 5299677 5299698 5299694 5299699 +
agctttagttttcagtaagtat

SEQ ID NO: 96594 - DNA, 22 bp, Artificial Sequence
  Synthetic oligonucleotide; TTA chr11 5299678 5299699 5299695 5299700 +
gctttagttttcagtaagtatt

SEQ ID NO: 96595 - DNA, 22 bp, Artificial Sequence
  Synthetic oligonucleotide; CTT chr11 5299682 5299703 5299699 5299704 +
tagttttcagtaagtattttct

SEQ ID NO: 96596 - DNA, 22 bp, Artificial Sequence
  Synthetic oligonucleotide; TTT chr11 5299683 5299704 5299700 5299705 +
agttttcagtaagtattttctt

SEQ ID NO: 96597 - DNA, 22 bp, Artificial Sequence
  Synthetic oligonucleotide; TTA chr11 5299684 5299705 5299701 5299706 +
gttttcagtaagtattttctta

SEQ ID NO: 96598 - DNA, 22 bp, Artificial Sequence
  Synthetic oligonucleotide; TTT chr11 5299688 5299709 5299705 5299710 +
tcagtaagtattttcttatcaa

SEQ ID NO: 96599 - DNA, 22 bp, Artificial Sequence
  Synthetic oligonucleotide; TTT chr11 5299689 5299710 5299706 5299711 +
cagtaagtattttcttatcaaa

SEQ ID NO: 96600 - DNA, 22 bp, Artificial Sequence
  Synthetic oligonucleotide; TTC chr11 5299690 5299711 5299707 5299712 +
agtaagtattttcttatcaaat

SEQ ID NO: 96601 - DNA, 22 bp, Artificial Sequence
  Synthetic oligonucleotide; TTT chr11 5299701 5299722 5299718 5299723 +
tcttatcaaatctctggaatat

SEQ ID NO: 96602 - DNA, 22 bp, Artificial Sequence
  Synthetic oligonucleotide; TTT chr11 5299702 5299723 5299719 5299724 +
cttatcaaatctctggaatatt

SEQ ID NO: 96603 - DNA, 22 bp, Artificial Sequence
  Synthetic oligonucleotide; TTC chr11 5299703 5299724 5299720 5299725 +
ttatcaaatctctggaatattt

SEQ ID NO: 96604 - DNA, 22 bp, Artificial Sequence
  Synthetic oligonucleotide; CTT chr11 5299705 5299726 5299722 5299727 +
atcaaatctctggaatattttc

SEQ ID NO: 96605 - DNA, 22 bp, Artificial Sequence
  Synthetic oligonucleotide; TTA chr11 5299706 5299727 5299723 5299728 +
tcaaatctctggaatattttca

SEQ ID NO: 96606 - DNA, 22 bp, Artificial Sequence
  Synthetic oligonucleotide; CTC chr11 5299715 5299736 5299732 5299737 +
tggaatattttcagagtgctca

SEQ ID NO: 96607 - DNA, 22 bp, Artificial Sequence
  Synthetic oligonucleotide; CTG chr11 5299717 5299738 5299734 5299739 +
gaatattttcagagtgctcact

SEQ ID NO: 96608 - DNA, 22 bp, Artificial Sequence
  Synthetic oligonucleotide; TTT chr11 5299725 5299746 5299742 5299747 +
tcagagtgctcactgtccagat

SEQ ID NO: 96609 - DNA, 22 bp, Artificial Sequence
  Synthetic oligonucleotide; TTT chr11 5299726 5299747 5299743 5299748 +
cagagtgctcactgtccagatg

SEQ ID NO: 96610 - DNA, 22 bp, Artificial Sequence
  Synthetic oligonucleotide; TTC chr11 5299727 5299748 5299744 5299749 +
agagtgctcactgtccagatgt

SEQ ID NO: 96611 - DNA, 22 bp, Artificial Sequence
  Synthetic oligonucleotide; CTC chr11 5299736 5299757 5299753 5299758 +
actgtccagatgtaaaataaat

SEQ ID NO: 96612 - DNA, 22 bp, Artificial Sequence
  Synthetic oligonucleotide; CTG chr11 5299740 5299761 5299757 5299762 +
tccagatgtaaaataaatatga

SEQ ID NO: 96613 - DNA, 22 bp, Artificial Sequence
  Synthetic oligonucleotide; TTT chr11 5299769 5299790 5299786 5299791 +
cttaagtgaagcagagagaatt

SEQ ID NO: 96614 - DNA, 22 bp, Artificial Sequence
  Synthetic oligonucleotide; TTC chr11 5299770 5299791 5299787 5299792 +
ttaagtgaagcagagagaattt

SEQ ID NO: 96615 - DNA, 22 bp, Artificial Sequence
  Synthetic oligonucleotide; CTT chr11 5299772 5299793 5299789 5299794 +
aagtgaagcagagagaatttag

SEQ ID NO: 96616 - DNA, 22 bp, Artificial Sequence
  Synthetic oligonucleotide; TTA chr11 5299773 5299794 5299790 5299795 +
agtgaagcagagagaatttaga

SEQ ID NO: 96617 - DNA, 22 bp, Artificial Sequence
  Synthetic oligonucleotide; TTT chr11 5299792 5299813 5299809 5299814 +
agaatggaataattatatactg

SEQ ID NO: 96618 - DNA, 22 bp, Artificial Sequence
  Synthetic oligonucleotide; TTA chr11 5299793 5299814 5299810 5299815 +
gaatggaataattatatactgg

SEQ ID NO: 96619 - DNA, 22 bp, Artificial Sequence
  Synthetic oligonucleotide; TTA chr11 5299807 5299828 5299824 5299829 +
tatactgggttctgaacatgga

SEQ ID NO: 96620 - DNA, 22 bp, Artificial Sequence
  Synthetic oligonucleotide; CTG chr11 5299814 5299835 5299831 5299836 +
ggttctgaacatggactttcaa

SEQ ID NO: 96621 - DNA, 22 bp, Artificial Sequence
  Synthetic oligonucleotide; TTC chr11 5299819 5299840 5299836 5299841 +
tgaacatggactttcaatcaga

SEQ ID NO: 96622 - DNA, 22 bp, Artificial Sequence
  Synthetic oligonucleotide; CTG chr11 5299821 5299842 5299838 5299843 +
aacatggactttcaatcagaaa

SEQ ID NO: 96623 - DNA, 22 bp, Artificial Sequence
  Synthetic oligonucleotide; CTT chr11 5299832 5299853 5299849 5299854 +
tcaatcagaaaagaaaatatta

SEQ ID NO: 96624 - DNA, 22 bp, Artificial Sequence
  Synthetic oligonucleotide; TTT chr11 5299833 5299854 5299850 5299855 +
caatcagaaaagaaaatattag

SEQ ID NO: 96625 - DNA, 22 bp, Artificial Sequence
  Synthetic oligonucleotide; TTC chr11 5299834 5299855 5299851 5299856 +
aatcagaaaagaaaatattaga

SEQ ID NO: 96626 - DNA, 22 bp, Artificial Sequence
  Synthetic oligonucleotide; TTA chr11 5299854 5299875 5299871 5299876 +
gaagcaagctcaacgagaactt

SEQ ID NO: 96627 - DNA, 22 bp, Artificial Sequence
  Synthetic oligonucleotide; CTC chr11 5299865 5299886 5299882 5299887 +
aacgagaacttaaaaattggaa

SEQ ID NO: 96628 - DNA, 22 bp, Artificial Sequence
  Synthetic oligonucleotide; CTT chr11 5299876 5299897 5299893 5299898 +
aaaaattggaagaaacagcagt

SEQ ID NO: 96629 - DNA, 22 bp, Artificial Sequence
  Synthetic oligonucleotide; TTA chr11 5299877 5299898 5299894 5299899 +
aaaattggaagaaacagcagtc

SEQ ID NO: 96630 - DNA, 22 bp, Artificial Sequence
  Synthetic oligonucleotide; TTG chr11 5299884 5299905 5299901 5299906 +
gaagaaacagcagtcttcagag

SEQ ID NO: 96631 - DNA, 22 bp, Artificial Sequence
  Synthetic oligonucleotide; CTT chr11 5299901 5299922 5299918 5299923 +
cagagaggaatgaatgcaactt

SEQ ID NO: 96632 - DNA, 22 bp, Artificial Sequence
  Synthetic oligonucleotide; TTC chr11 5299902 5299923 5299919 5299924 +
agagaggaatgaatgcaacttt

SEQ ID NO: 96633 - DNA, 22 bp, Artificial Sequence
  Synthetic oligonucleotide; CTT chr11 5299923 5299944 5299940 5299945 +
ttgagattagtttcctataagg

SEQ ID NO: 96634 - DNA, 22 bp, Artificial Sequence
  Synthetic oligonucleotide; TTT chr11 5299924 5299945 5299941 5299946 +
tgagattagtttcctataagga

SEQ ID NO: 96635 - DNA, 22 bp, Artificial Sequence
  Synthetic oligonucleotide; TTT chr11 5299925 5299946 5299942 5299947 +
gagattagtttcctataaggag

SEQ ID NO: 96636 - DNA, 22 bp, Artificial Sequence
  Synthetic oligonucleotide; TTG chr11 5299926 5299947 5299943 5299948 +
agattagtttcctataaggaga

SEQ ID NO: 96637 - DNA, 22 bp, Artificial Sequence
  Synthetic oligonucleotide; TTA chr11 5299932 5299953 5299949 5299954 +
gtttcctataaggagatcagct

SEQ ID NO: 96638 - DNA, 22 bp, Artificial Sequence
  Synthetic oligonucleotide; TTT chr11 5299936 5299957 5299953 5299958 +
cctataaggagatcagctgcaa

SEQ ID NO: 96639 - DNA, 22 bp, Artificial Sequence
  Synthetic oligonucleotide; TTC chr11 5299937 5299958 5299954 5299959 +
ctataaggagatcagctgcaaa

SEQ ID NO: 96640 - DNA, 22 bp, Artificial Sequence
  Synthetic oligonucleotide; CTA chr11 5299940 5299961 5299957 5299962 +
taaggagatcagctgcaaatac

SEQ ID NO: 96641 - DNA, 22 bp, Artificial Sequence
  Synthetic oligonucleotide; CTG chr11 5299955 5299976 5299972 5299977 +
caaatactagcgcagaactagc

SEQ ID NO: 96642 - DNA, 22 bp, Artificial Sequence
  Synthetic oligonucleotide; CTA chr11 5299964 5299985 5299981 5299986 +
gcgcagaactagcagtagatga

SEQ ID NO: 96643 - DNA, 22 bp, Artificial Sequence
  Synthetic oligonucleotide; CTA chr11 5299975 5299996 5299992 5299997 +
gcagtagatgaagaaattgtca

SEQ ID NO: 96644 - DNA, 22 bp, Artificial Sequence
  Synthetic oligonucleotide; TTG chr11 5299994 5300015 5300011 5300016 +
tcatcccctgttacactaatag

SEQ ID NO: 96645 - DNA, 22 bp, Artificial Sequence
  Synthetic oligonucleotide; CTG chr11 5300004 5300025 5300021 5300026 +
ttacactaatagcaagtggtag

SEQ ID NO: 96646 - DNA, 22 bp, Artificial Sequence
  Synthetic oligonucleotide; TTA chr11 5300007 5300028 5300024 5300029 +
cactaatagcaagtggtagact

SEQ ID NO: 96647 - DNA, 22 bp, Artificial Sequence
  Synthetic oligonucleotide; CTA chr11 5300012 5300033 5300029 5300034 +
atagcaagtggtagactgcggt

SEQ ID NO: 96648 - DNA, 22 bp, Artificial Sequence
  Synthetic oligonucleotide; CTG chr11 5300030 5300051 5300047 5300052 +
cggttcagacccaatgaacagc

SEQ ID NO: 96649 - DNA, 22 bp, Artificial Sequence
  Synthetic oligonucleotide; TTC chr11 5300036 5300057 5300053 5300058 +
agacccaatgaacagcataaag

SEQ ID NO: 96650 - DNA, 22 bp, Artificial Sequence
  Synthetic oligonucleotide; CTT chr11 5300062 5300083 5300079 5300084 +
acaaacactttgaagaagattg

SEQ ID NO: 96651 - DNA, 22 bp, Artificial Sequence
  Synthetic oligonucleotide; TTA chr11 5300063 5300084 5300080 5300085 +
caaacactttgaagaagattga

SEQ ID NO: 96652 - DNA, 22 bp, Artificial Sequence
  Synthetic oligonucleotide; CTT chr11 5300072 5300093 5300089 5300094 +
tgaagaagattgaaggaagaaa

SEQ ID NO: 96653 - DNA, 22 bp, Artificial Sequence
  Synthetic oligonucleotide; TTT chr11 5300073 5300094 5300090 5300095 +
gaagaagattgaaggaagaaac

SEQ ID NO: 96654 - DNA, 22 bp, Artificial Sequence
  Synthetic oligonucleotide; TTG chr11 5300074 5300095 5300091 5300096 +
aagaagattgaaggaagaaact

SEQ ID NO: 96655 - DNA, 22 bp, Artificial Sequence
  Synthetic oligonucleotide; TTG chr11 5300084 5300105 5300101 5300106 +
aaggaagaaactattccatcag

SEQ ID NO: 96656 - DNA, 22 bp, Artificial Sequence
  Synthetic oligonucleotide; CTA chr11 5300097 5300118 5300114 5300119 +
ttccatcagtgaaaaatttcta

SEQ ID NO: 96657 - DNA, 22 bp, Artificial Sequence
  Synthetic oligonucleotide; TTC chr11 5300100 5300121 5300117 5300122 +
catcagtgaaaaatttctaaaa

SEQ ID NO: 96658 - DNA, 22 bp, Artificial Sequence
  Synthetic oligonucleotide; TTT chr11 5300116 5300137 5300133 5300138 +
ctaaaatataacattacctttg

SEQ ID NO: 96659 - DNA, 22 bp, Artificial Sequence
  Synthetic oligonucleotide; TTC chr11 5300117 5300138 5300134 5300139 +
taaaatataacattacctttgc

SEQ ID NO: 96660 - DNA, 22 bp, Artificial Sequence
  Synthetic oligonucleotide; CTA chr11 5300119 5300140 5300136 5300141 +
aaatataacattacctttgcca

SEQ ID NO: 96661 - DNA, 22 bp, Artificial Sequence
  Synthetic oligonucleotide; TTA chr11 5300132 5300153 5300149 5300154 +
cctttgccaagtttttgcatta

SEQ ID NO: 96662 - DNA, 22 bp, Artificial Sequence
  Synthetic oligonucleotide; CTT chr11 5300136 5300157 5300153 5300158 +
tgccaagtttttgcattaatta

SEQ ID NO: 96663 - DNA, 22 bp, Artificial Sequence
  Synthetic oligonucleotide; TTT chr11 5300137 5300158 5300154 5300159 +
gccaagtttttgcattaattat

SEQ ID NO: 96664 - DNA, 22 bp, Artificial Sequence
  Synthetic oligonucleotide; TTG chr11 5300138 5300159 5300155 5300160 +
ccaagtttttgcattaattatc

SEQ ID NO: 96665 - DNA, 22 bp, Artificial Sequence
  Synthetic oligonucleotide; TTT chr11 5300146 5300167 5300163 5300168 +
ttgcattaattatcaaaactat

SEQ ID NO: 96666 - DNA, 22 bp, Artificial Sequence
  Synthetic oligonucleotide; TTT chr11 5300147 5300168 5300164 5300169 +
tgcattaattatcaaaactatt

SEQ ID NO: 96667 - DNA, 22 bp, Artificial Sequence
  Synthetic oligonucleotide; TTT chr11 5300148 5300169 5300165 5300170 +
gcattaattatcaaaactattt

SEQ ID NO: 96668 - DNA, 22 bp, Artificial Sequence
  Synthetic oligonucleotide; TTG chr11 5300149 5300170 5300166 5300171 +
cattaattatcaaaactatttc

SEQ ID NO: 96669 - DNA, 22 bp, Artificial Sequence
  Synthetic oligonucleotide; TTA chr11 5300154 5300175 5300171 5300176 +
attatcaaaactatttcatgaa

SEQ ID NO: 96670 - DNA, 22 bp, Artificial Sequence
  Synthetic oligonucleotide; TTA chr11 5300158 5300179 5300175 5300180 +
tcaaaactatttcatgaagtga

SEQ ID NO: 96671 - DNA, 22 bp, Artificial Sequence
  Synthetic oligonucleotide; CTA chr11 5300167 5300188 5300184 5300189 +
tttcatgaagtgaaaaagtctc

SEQ ID NO: 96672 - DNA, 22 bp, Artificial Sequence
  Synthetic oligonucleotide; TTT chr11 5300170 5300191 5300187 5300192 +
catgaagtgaaaaagtctcgag

SEQ ID NO: 96673 - DNA, 22 bp, Artificial Sequence
  Synthetic oligonucleotide; TTC chr11 5300171 5300192 5300188 5300193 +
atgaagtgaaaaagtctcgaga

SEQ ID NO: 96674 - DNA, 22 bp, Artificial Sequence
  Synthetic oligonucleotide; CTC chr11 5300189 5300210 5300206 5300211 +
gagattttttatgtgagaagca

SEQ ID NO: 96675 - DNA, 22 bp, Artificial Sequence
  Synthetic oligonucleotide; TTT chr11 5300196 5300217 5300213 5300218 +
tttatgtgagaagcaagagggg

SEQ ID NO: 96676 - DNA, 22 bp, Artificial Sequence
  Synthetic oligonucleotide; TTT chr11 5300197 5300218 5300214 5300219 +
ttatgtgagaagcaagagggga

SEQ ID NO: 96677 - DNA, 22 bp, Artificial Sequence
  Synthetic oligonucleotide; TTT chr11 5300198 5300219 5300215 5300220 +
tatgtgagaagcaagaggggaa

SEQ ID NO: 96678 - DNA, 22 bp, Artificial Sequence
  Synthetic oligonucleotide; TTT chr11 5300199 5300220 5300216 5300221 +
atgtgagaagcaagaggggaaa

SEQ ID NO: 96679 - DNA, 22 bp, Artificial Sequence
  Synthetic oligonucleotide; TTA chr11 5300200 5300221 5300217 5300222 +
tgtgagaagcaagaggggaaat

SEQ ID NO: 96680 - DNA, 22 bp, Artificial Sequence
  Synthetic oligonucleotide; CTA chr11 5300243 5300264 5300260 5300265 +
aatttatagttggttatttttt

SEQ ID NO: 96681 - DNA, 22 bp, Artificial Sequence
  Synthetic oligonucleotide; TTT chr11 5300248 5300269 5300265 5300270 +
atagttggttatttttttcaga

SEQ ID NO: 96682 - DNA, 22 bp, Artificial Sequence
  Synthetic oligonucleotide; TTA chr11 5300249 5300270 5300266 5300271 +
tagttggttatttttttcagaa

SEQ ID NO: 96683 - DNA, 22 bp, Artificial Sequence
  Synthetic oligonucleotide; TTG chr11 5300255 5300276 5300272 5300277 +
gttatttttttcagaagaaaaa

SEQ ID NO: 96684 - DNA, 22 bp, Artificial Sequence
  Synthetic oligonucleotide; TTA chr11 5300259 5300280 5300276 5300281 +
tttttttcagaagaaaaatgtc

SEQ ID NO: 96685 - DNA, 22 bp, Artificial Sequence
  Synthetic oligonucleotide; TTT chr11 5300262 5300283 5300279 5300284 +
ttttcagaagaaaaatgtcagg

SEQ ID NO: 96686 - DNA, 22 bp, Artificial Sequence
  Synthetic oligonucleotide; TTT chr11 5300263 5300284 5300280 5300285 +
tttcagaagaaaaatgtcagga

SEQ ID NO: 96687 - DNA, 22 bp, Artificial Sequence
  Synthetic oligonucleotide; TTT chr11 5300264 5300285 5300281 5300286 +
ttcagaagaaaaatgtcaggag

SEQ ID NO: 96688 - DNA, 22 bp, Artificial Sequence
  Synthetic oligonucleotide; TTT chr11 5300265 5300286 5300282 5300287 +
tcagaagaaaaatgtcaggaga

SEQ ID NO: 96689 - DNA, 22 bp, Artificial Sequence
  Synthetic oligonucleotide; TTT chr11 5300266 5300287 5300283 5300288 +
cagaagaaaaatgtcaggagac

SEQ ID NO: 96690 - DNA, 22 bp, Artificial Sequence
  Synthetic oligonucleotide; TTC chr11 5300267 5300288 5300284 5300289 +
agaagaaaaatgtcaggagaca

SEQ ID NO: 96691 - DNA, 22 bp, Artificial Sequence
  Synthetic oligonucleotide; CTG chr11 5300302 5300323 5300319 5300324 +
gaaagaagaaaaagtattaagt

SEQ ID NO: 96692 - DNA, 22 bp, Artificial Sequence
  Synthetic oligonucleotide; TTA chr11 5300321 5300342 5300338 5300343 +
agttagtttcagcagacaatgg

SEQ ID NO: 96693 - DNA, 22 bp, Artificial Sequence
  Synthetic oligonucleotide; TTA chr11 5300326 5300347 5300343 5300348 +
gtttcagcagacaatgggaaga

SEQ ID NO: 96694 - DNA, 22 bp, Artificial Sequence
  Synthetic oligonucleotide; TTT chr11 5300330 5300351 5300347 5300352 +
cagcagacaatgggaagaagga

SEQ ID NO: 96695 - DNA, 22 bp, Artificial Sequence
  Synthetic oligonucleotide; TTC chr11 5300331 5300352 5300348 5300353 +
agcagacaatgggaagaaggaa

SEQ ID NO: 96696 - DNA, 22 bp, Artificial Sequence
  Synthetic oligonucleotide; CTG chr11 5300363 5300384 5300380 5300385 +
ggatatctggcttccacgagat

SEQ ID NO: 96697 - DNA, 22 bp, Artificial Sequence
  Synthetic oligonucleotide; CTG chr11 5300372 5300393 5300389 5300394 +
gcttccacgagatgataagaaa

SEQ ID NO: 96698 - DNA, 22 bp, Artificial Sequence
  Synthetic oligonucleotide; CTT chr11 5300376 5300397 5300393 5300398 +
ccacgagatgataagaaatgtg

SEQ ID NO: 96699 - DNA, 22 bp, Artificial Sequence
  Synthetic oligonucleotide; TTC chr11 5300377 5300398 5300394 5300399 +
cacgagatgataagaaatgtgt

SEQ ID NO: 96700 - DNA, 22 bp, Artificial Sequence
  Synthetic oligonucleotide; TTT chr11 5300401 5300422 5300418 5300423 +
gctgctatttagctgttagtct

SEQ ID NO: 96701 - DNA, 22 bp, Artificial Sequence
  Synthetic oligonucleotide; TTG chr11 5300402 5300423 5300419 5300424 +
ctgctatttagctgttagtctg

SEQ ID NO: 96702 - DNA, 22 bp, Artificial Sequence
  Synthetic oligonucleotide; CTG chr11 5300405 5300426 5300422 5300427 +
ctatttagctgttagtctgtat

SEQ ID NO: 96703 - DNA, 22 bp, Artificial Sequence
  Synthetic oligonucleotide; CTA chr11 5300408 5300429 5300425 5300430 +
tttagctgttagtctgtatcac

SEQ ID NO: 96704 - DNA, 22 bp, Artificial Sequence
  Synthetic oligonucleotide; TTT chr11 5300411 5300432 5300428 5300433 +
agctgttagtctgtatcacacg

SEQ ID NO: 96705 - DNA, 22 bp, Artificial Sequence
  Synthetic oligonucleotide; TTA chr11 5300412 5300433 5300429 5300434 +
gctgttagtctgtatcacacgc

SEQ ID NO: 96706 - DNA, 22 bp, Artificial Sequence
  Synthetic oligonucleotide; CTG chr11 5300416 5300437 5300433 5300438 +
ttagtctgtatcacacgccttt

SEQ ID NO: 96707 - DNA, 22 bp, Artificial Sequence
  Synthetic oligonucleotide; TTA chr11 5300419 5300440 5300436 5300441 +
gtctgtatcacacgccttttag

SEQ ID NO: 96708 - DNA, 22 bp, Artificial Sequence
  Synthetic oligonucleotide; CTG chr11 5300424 5300445 5300441 5300446 +
tatcacacgccttttagtagta

SEQ ID NO: 96709 - DNA, 22 bp, Artificial Sequence
  Synthetic oligonucleotide; CTT chr11 5300437 5300458 5300454 5300459 +
ttagtagtaaaatatgccagtc

SEQ ID NO: 96710 - DNA, 22 bp, Artificial Sequence
  Synthetic oligonucleotide; TTT chr11 5300438 5300459 5300455 5300460 +
tagtagtaaaatatgccagtct

SEQ ID NO: 96711 - DNA, 22 bp, Artificial Sequence
  Synthetic oligonucleotide; TTT chr11 5300439 5300460 5300456 5300461 +
agtagtaaaatatgccagtcta

SEQ ID NO: 96712 - DNA, 22 bp, Artificial Sequence
  Synthetic oligonucleotide; TTA chr11 5300440 5300461 5300457 5300462 +
gtagtaaaatatgccagtctac

SEQ ID NO: 96713 - DNA, 22 bp, Artificial Sequence
  Synthetic oligonucleotide; CTA chr11 5300461 5300482 5300478 5300483 +
ctaagggaaattacatttcatg

SEQ ID NO: 96714 - DNA, 22 bp, Artificial Sequence
  Synthetic oligonucleotide; CTA chr11 5300464 5300485 5300481 5300486 +
agggaaattacatttcatgagt

SEQ ID NO: 96715 - DNA, 22 bp, Artificial Sequence
  Synthetic oligonucleotide; TTA chr11 5300474 5300495 5300491 5300496 +
catttcatgagtaagcttccta

SEQ ID NO: 96716 - DNA, 22 bp, Artificial Sequence
  Synthetic oligonucleotide; TTT chr11 5300479 5300500 5300496 5300501 +
catgagtaagcttcctaaagtt

SEQ ID NO: 96717 - DNA, 22 bp, Artificial Sequence
  Synthetic oligonucleotide; TTC chr11 5300480 5300501 5300497 5300502 +
atgagtaagcttcctaaagttc

SEQ ID NO: 96718 - DNA, 22 bp, Artificial Sequence
  Synthetic oligonucleotide; CTT chr11 5300492 5300513 5300509 5300514 +
cctaaagttctagatatttgct

SEQ ID NO: 96719 - DNA, 22 bp, Artificial Sequence
  Synthetic oligonucleotide; TTC chr11 5300493 5300514 5300510 5300515 +
ctaaagttctagatatttgctg

SEQ ID NO: 96720 - DNA, 22 bp, Artificial Sequence
  Synthetic oligonucleotide; CTA chr11 5300496 5300517 5300513 5300518 +
aagttctagatatttgctgttt

SEQ ID NO: 96721 - DNA, 22 bp, Artificial Sequence
  Synthetic oligonucleotide; TTC chr11 5300502 5300523 5300519 5300524 +
tagatatttgctgtttagcctc

SEQ ID NO: 96722 - DNA, 22 bp, Artificial Sequence
  Synthetic oligonucleotide; CTA chr11 5300504 5300525 5300521 5300526 +
gatatttgctgtttagcctcac

SEQ ID NO: 96723 - DNA, 22 bp, Artificial Sequence
  Synthetic oligonucleotide; TTT chr11 5300511 5300532 5300528 5300533 +
gctgtttagcctcacacaagtt

SEQ ID NO: 96724 - DNA, 22 bp, Artificial Sequence
  Synthetic oligonucleotide; TTG chr11 5300512 5300533 5300529 5300534 +
ctgtttagcctcacacaagttt

SEQ ID NO: 96725 - DNA, 22 bp, Artificial Sequence
  Synthetic oligonucleotide; CTG chr11 5300515 5300536 5300532 5300537 +
tttagcctcacacaagtttgct

SEQ ID NO: 96726 - DNA, 22 bp, Artificial Sequence
  Synthetic oligonucleotide; TTT chr11 5300518 5300539 5300535 5300540 +
agcctcacacaagtttgcttac

SEQ ID NO: 96727 - DNA, 22 bp, Artificial Sequence
  Synthetic oligonucleotide; TTA chr11 5300519 5300540 5300536 5300541 +
gcctcacacaagtttgcttact

SEQ ID NO: 96728 - DNA, 22 bp, Artificial Sequence
  Synthetic oligonucleotide; CTC chr11 5300524 5300545 5300541 5300546 +
acacaagtttgcttactaatca

SEQ ID NO: 96729 - DNA, 22 bp, Artificial Sequence
  Synthetic oligonucleotide; TTT chr11 5300534 5300555 5300551 5300556 +
gcttactaatcaagcaagatcc

SEQ ID NO: 96730 - DNA, 22 bp, Artificial Sequence
  Synthetic oligonucleotide; TTG chr11 5300535 5300556 5300552 5300557 +
cttactaatcaagcaagatcct

SEQ ID NO: 96731 - DNA, 22 bp, Artificial Sequence
  Synthetic oligonucleotide; CTT chr11 5300538 5300559 5300555 5300560 +
actaatcaagcaagatcctttt

SEQ ID NO: 96732 - DNA, 22 bp, Artificial Sequence
  Synthetic oligonucleotide; TTA chr11 5300539 5300560 5300556 5300561 +
ctaatcaagcaagatccttttc

SEQ ID NO: 96733 - DNA, 22 bp, Artificial Sequence
  Synthetic oligonucleotide; CTA chr11 5300542 5300563 5300559 5300564 +
atcaagcaagatccttttcaga

SEQ ID NO: 96734 - DNA, 22 bp, Artificial Sequence
  Synthetic oligonucleotide; CTT chr11 5300558 5300579 5300575 5300580 +
ttcagagtaactagtttcaaag

SEQ ID NO: 96735 - DNA, 22 bp, Artificial Sequence
  Synthetic oligonucleotide; TTT chr11 5300559 5300580 5300576 5300581 +
tcagagtaactagtttcaaagt

SEQ ID NO: 96736 - DNA, 22 bp, Artificial Sequence
  Synthetic oligonucleotide; TTT chr11 5300560 5300581 5300577 5300582 +
cagagtaactagtttcaaagta

SEQ ID NO: 96737 - DNA, 22 bp, Artificial Sequence
  Synthetic oligonucleotide; TTC chr11 5300561 5300582 5300578 5300583 +
agagtaactagtttcaaagtat

SEQ ID NO: 96738 - DNA, 22 bp, Artificial Sequence
  Synthetic oligonucleotide; CTA chr11 5300571 5300592 5300588 5300593 +
gtttcaaagtatggagatgaaa

SEQ ID NO: 96739 - DNA, 22 bp, Artificial Sequence
  Synthetic oligonucleotide; TTT chr11 5300575 5300596 5300592 5300597 +
caaagtatggagatgaaaatat

SEQ ID NO: 96740 - DNA, 22 bp, Artificial Sequence
  Synthetic oligonucleotide; TTC chr11 5300576 5300597 5300593 5300598 +
aaagtatggagatgaaaatatg

SEQ ID NO: 96741 - DNA, 22 bp, Artificial Sequence
  Synthetic oligonucleotide; TTA chr11 5300609 5300630 5300626 5300631 +
ttcaaattcacctttataagac

SEQ ID NO: 96742 - DNA, 22 bp, Artificial Sequence
  Synthetic oligonucleotide; TTC chr11 5300612 5300633 5300629 5300634 +
aaattcacctttataagacaca

SEQ ID NO: 96743 - DNA, 22 bp, Artificial Sequence
  Synthetic oligonucleotide; TTC chr11 5300618 5300639 5300635 5300640 +
acctttataagacacataaaat

SEQ ID NO: 96744 - DNA, 22 bp, Artificial Sequence
  Synthetic oligonucleotide; CTT chr11 5300623 5300644 5300640 5300645 +
tataagacacataaaatgtacc

SEQ ID NO: 96745 - DNA, 22 bp, Artificial Sequence
  Synthetic oligonucleotide; TTT chr11 5300624 5300645 5300641 5300646 +
ataagacacataaaatgtacct

SEQ ID NO: 96746 - DNA, 22 bp, Artificial Sequence
  Synthetic oligonucleotide; TTA chr11 5300625 5300646 5300642 5300647 +
taagacacataaaatgtacctc

SEQ ID NO: 96747 - DNA, 22 bp, Artificial Sequence
  Synthetic oligonucleotide; CTC chr11 5300647 5300668 5300664 5300669 +
caactgcacatttttctttaga

SEQ ID NO: 96748 - DNA, 22 bp, Artificial Sequence
  Synthetic oligonucleotide; CTG chr11 5300653 5300674 5300670 5300675 +
cacatttttctttagatgaact

SEQ ID NO: 96749 - DNA, 22 bp, Artificial Sequence
  Synthetic oligonucleotide; TTT chr11 5300660 5300681 5300677 5300682 +
ttctttagatgaactgtatttg

SEQ ID NO: 96750 - DNA, 22 bp, Artificial Sequence
  Synthetic oligonucleotide; TTT chr11 5300661 5300682 5300678 5300683 +
tctttagatgaactgtatttga

SEQ ID NO: 96751 - DNA, 22 bp, Artificial Sequence
  Synthetic oligonucleotide; TTT chr11 5300662 5300683 5300679 5300684 +
ctttagatgaactgtatttgac

SEQ ID NO: 96752 - DNA, 22 bp, Artificial Sequence
  Synthetic oligonucleotide; TTC chr11 5300663 5300684 5300680 5300685 +
tttagatgaactgtatttgacc

SEQ ID NO: 96753 - DNA, 22 bp, Artificial Sequence
  Synthetic oligonucleotide; CTT chr11 5300665 5300686 5300682 5300687 +
tagatgaactgtatttgaccca

SEQ ID NO: 96754 - DNA, 22 bp, Artificial Sequence
  Synthetic oligonucleotide; TTT chr11 5300666 5300687 5300683 5300688 +
agatgaactgtatttgacccaa

SEQ ID NO: 96755 - DNA, 22 bp, Artificial Sequence
  Synthetic oligonucleotide; TTA chr11 5300667 5300688 5300684 5300689 +
gatgaactgtatttgacccaag

SEQ ID NO: 96756 - DNA, 22 bp, Artificial Sequence
  Synthetic oligonucleotide; CTG chr11 5300676 5300697 5300693 5300698 +
tatttgacccaagctgctttag

SEQ ID NO: 96757 - DNA, 22 bp, Artificial Sequence
  Synthetic oligonucleotide; TTT chr11 5300681 5300702 5300698 5300703 +
gacccaagctgctttagtccac

SEQ ID NO: 96758 - DNA, 22 bp, Artificial Sequence
  Synthetic oligonucleotide; TTG chr11 5300682 5300703 5300699 5300704 +
acccaagctgctttagtccact

SEQ ID NO: 96759 - DNA, 22 bp, Artificial Sequence
  Synthetic oligonucleotide; CTG chr11 5300692 5300713 5300709 5300714 +
ctttagtccacttatcttgact

SEQ ID NO: 96760 - DNA, 22 bp, Artificial Sequence
  Synthetic oligonucleotide; CTT chr11 5300695 5300716 5300712 5300717 +
tagtccacttatcttgactatt

SEQ ID NO: 96761 - DNA, 22 bp, Artificial Sequence
  Synthetic oligonucleotide; TTT chr11 5300696 5300717 5300713 5300718 +
agtccacttatcttgactattt

SEQ ID NO: 96762 - DNA, 22 bp, Artificial Sequence
  Synthetic oligonucleotide; TTA chr11 5300697 5300718 5300714 5300719 +
gtccacttatcttgactatttc

SEQ ID NO: 96763 - DNA, 22 bp, Artificial Sequence
  Synthetic oligonucleotide; CTT chr11 5300705 5300726 5300722 5300727 +
atcttgactatttctgaaatca

SEQ ID NO: 96764 - DNA, 22 bp, Artificial Sequence
  Synthetic oligonucleotide; TTA chr11 5300706 5300727 5300723 5300728 +
tcttgactatttctgaaatcat

SEQ ID NO: 96765 - DNA, 22 bp, Artificial Sequence
  Synthetic oligonucleotide; CTT chr11 5300710 5300731 5300727 5300732 +
gactatttctgaaatcatagtt

SEQ ID NO: 96766 - DNA, 22 bp, Artificial Sequence
  Synthetic oligonucleotide; TTG chr11 5300711 5300732 5300728 5300733 +
actatttctgaaatcatagtta

SEQ ID NO: 96767 - DNA, 22 bp, Artificial Sequence
  Synthetic oligonucleotide; CTA chr11 5300715 5300736 5300732 5300737 +
tttctgaaatcatagttactct

SEQ ID NO: 96768 - DNA, 22 bp, Artificial Sequence
  Synthetic oligonucleotide; TTT chr11 5300718 5300739 5300735 5300740 +
ctgaaatcatagttactcttct

SEQ ID NO: 96769 - DNA, 22 bp, Artificial Sequence
  Synthetic oligonucleotide; TTC chr11 5300719 5300740 5300736 5300741 +
tgaaatcatagttactcttctt

SEQ ID NO: 96770 - DNA, 22 bp, Artificial Sequence
  Synthetic oligonucleotide; CTG chr11 5300721 5300742 5300738 5300743 +
aaatcatagttactcttctttt

SEQ ID NO: 96771 - DNA, 22 bp, Artificial Sequence
  Synthetic oligonucleotide; TTA chr11 5300733 5300754 5300750 5300755 +
ctcttcttttggattgttatat

SEQ ID NO: 96772 - DNA, 22 bp, Artificial Sequence
  Synthetic oligonucleotide; CTC chr11 5300736 5300757 5300753 5300758 +
ttcttttggattgttatatctc

SEQ ID NO: 96773 - DNA, 22 bp, Artificial Sequence
  Synthetic oligonucleotide; CTT chr11 5300738 5300759 5300755 5300760 +
cttttggattgttatatctcct

SEQ ID NO: 96774 - DNA, 22 bp, Artificial Sequence
  Synthetic oligonucleotide; TTC chr11 5300739 5300760 5300756 5300761 +
ttttggattgttatatctcctc

SEQ ID NO: 96775 - DNA, 22 bp, Artificial Sequence
  Synthetic oligonucleotide; CTT chr11 5300741 5300762 5300758 5300763 +
ttggattgttatatctcctctg

SEQ ID NO: 96776 - DNA, 22 bp, Artificial Sequence
  Synthetic oligonucleotide; TTT chr11 5300742 5300763 5300759 5300764 +
tggattgttatatctcctctgc

SEQ ID NO: 96777 - DNA, 22 bp, Artificial Sequence
  Synthetic oligonucleotide; TTT chr11 5300743 5300764 5300760 5300765 +
ggattgttatatctcctctgct

SEQ ID NO: 96778 - DNA, 22 bp, Artificial Sequence
  Synthetic oligonucleotide; TTG chr11 5300744 5300765 5300761 5300766 +
gattgttatatctcctctgctt

SEQ ID NO: 96779 - DNA, 22 bp, Artificial Sequence
  Synthetic oligonucleotide; TTG chr11 5300749 5300770 5300766 5300771 +
ttatatctcctctgcttcctgt

SEQ ID NO: 96780 - DNA, 22 bp, Artificial Sequence
  Synthetic oligonucleotide; TTA chr11 5300752 5300773 5300769 5300774 +
tatctcctctgcttcctgtatt

SEQ ID NO: 96781 - DNA, 22 bp, Artificial Sequence
  Synthetic oligonucleotide; CTC chr11 5300758 5300779 5300775 5300780 +
ctctgcttcctgtattcttttt

SEQ ID NO: 96782 - DNA, 22 bp, Artificial Sequence
  Synthetic oligonucleotide; CTC chr11 5300761 5300782 5300778 5300783 +
tgcttcctgtattctttttctt

SEQ ID NO: 96783 - DNA, 22 bp, Artificial Sequence
  Synthetic oligonucleotide; CTG chr11 5300763 5300784 5300780 5300785 +
cttcctgtattctttttcttca

SEQ ID NO: 96784 - DNA, 22 bp, Artificial Sequence
  Synthetic oligonucleotide; CTT chr11 5300766 5300787 5300783 5300788 +
cctgtattctttttcttcagca

SEQ ID NO: 96785 - DNA, 22 bp, Artificial Sequence
  Synthetic oligonucleotide; TTC chr11 5300767 5300788 5300784 5300789 +
ctgtattctttttcttcagcat

SEQ ID NO: 96786 - DNA, 22 bp, Artificial Sequence
  Synthetic oligonucleotide; CTG chr11 5300770 5300791 5300787 5300792 +
tattctttttcttcagcatcac

SEQ ID NO: 96787 - DNA, 22 bp, Artificial Sequence
  Synthetic oligonucleotide; TTC chr11 5300775 5300796 5300792 5300797 +
tttttcttcagcatcactggca

SEQ ID NO: 96788 - DNA, 22 bp, Artificial Sequence
  Synthetic oligonucleotide; CTT chr11 5300777 5300798 5300794 5300799 +
tttcttcagcatcactggcatt

SEQ ID NO: 96789 - DNA, 22 bp, Artificial Sequence
  Synthetic oligonucleotide; TTT chr11 5300778 5300799 5300795 5300800 +
ttcttcagcatcactggcattc

SEQ ID NO: 96790 - DNA, 22 bp, Artificial Sequence
  Synthetic oligonucleotide; TTT chr11 5300779 5300800 5300796 5300801 +
tcttcagcatcactggcattcc

SEQ ID NO: 96791 - DNA, 22 bp, Artificial Sequence
  Synthetic oligonucleotide; TTT chr11 5300780 5300801 5300797 5300802 +
cttcagcatcactggcattccc

SEQ ID NO: 96792 - DNA, 22 bp, Artificial Sequence
  Synthetic oligonucleotide; TTC chr11 5300781 5300802 5300798 5300803 +
ttcagcatcactggcattccct

SEQ ID NO: 96793 - DNA, 22 bp, Artificial Sequence
  Synthetic oligonucleotide; CTT chr11 5300783 5300804 5300800 5300805 +
cagcatcactggcattccctct

SEQ ID NO: 96794 - DNA, 22 bp, Artificial Sequence
  Synthetic oligonucleotide; TTC chr11 5300784 5300805 5300801 5300806 +
agcatcactggcattccctctt

SEQ ID NO: 96795 - DNA, 22 bp, Artificial Sequence
  Synthetic oligonucleotide; CTG chr11 5300794 5300815 5300811 5300816 +
gcattccctctttattaggtga

SEQ ID NO: 96796 - DNA, 22 bp, Artificial Sequence
  Synthetic oligonucleotide; TTC chr11 5300800 5300821 5300817 5300822 +
cctctttattaggtgatatata

SEQ ID NO: 96797 - DNA, 22 bp, Artificial Sequence
  Synthetic oligonucleotide; CTC chr11 5300804 5300825 5300821 5300826 +
tttattaggtgatatatatata

SEQ ID NO: 96798 - DNA, 22 bp, Artificial Sequence
  Synthetic oligonucleotide; CTT chr11 5300806 5300827 5300823 5300828 +
tattaggtgatatatatatata

SEQ ID NO: 96799 - DNA, 22 bp, Artificial Sequence
  Synthetic oligonucleotide; TTT chr11 5300807 5300828 5300824 5300829 +
attaggtgatatatatatatat

SEQ ID NO: 96800 - DNA, 22 bp, Artificial Sequence
  Synthetic oligonucleotide; TTA chr11 5300808 5300829 5300825 5300830 +
ttaggtgatatatatatatata

SEQ ID NO: 96801 - DNA, 22 bp, Artificial Sequence
  Synthetic oligonucleotide; TTA chr11 5300811 5300832 5300828 5300833 +
ggtgatatatatatatatatat

SEQ ID NO: 96802 - DNA, 22 bp, Artificial Sequence
  Synthetic oligonucleotide; TTT chr11 5300869 5300890 5300886 5300891 +
ctcgctcacatcagctttttca

SEQ ID NO: 96803 - DNA, 22 bp, Artificial Sequence
  Synthetic oligonucleotide; TTC chr11 5300870 5300891 5300887 5300892 +
tcgctcacatcagctttttcat

SEQ ID NO: 96804 - DNA, 22 bp, Artificial Sequence
  Synthetic oligonucleotide; CTC chr11 5300872 5300893 5300889 5300894 +
gctcacatcagctttttcatgt

SEQ ID NO: 96805 - DNA, 22 bp, Artificial Sequence
  Synthetic oligonucleotide; CTC chr11 5300876 5300897 5300893 5300898 +
acatcagctttttcatgtgata

SEQ ID NO: 96806 - DNA, 22 bp, Artificial Sequence
  Synthetic oligonucleotide; CTT chr11 5300886 5300907 5300903 5300908 +
tttcatgtgataattaaaattg

SEQ ID NO: 96807 - DNA, 22 bp, Artificial Sequence
  Synthetic oligonucleotide; TTT chr11 5300887 5300908 5300904 5300909 +
ttcatgtgataattaaaattga

SEQ ID NO: 96808 - DNA, 22 bp, Artificial Sequence
  Synthetic oligonucleotide; TTT chr11 5300888 5300909 5300905 5300910 +
tcatgtgataattaaaattgaa

SEQ ID NO: 96809 - DNA, 22 bp, Artificial Sequence
  Synthetic oligonucleotide; TTT chr11 5300889 5300910 5300906 5300911 +
catgtgataattaaaattgaat

SEQ ID NO: 96810 - DNA, 22 bp, Artificial Sequence
  Synthetic oligonucleotide; TTC chr11 5300890 5300911 5300907 5300912 +
atgtgataattaaaattgaatc

SEQ ID NO: 96811 - DNA, 22 bp, Artificial Sequence
  Synthetic oligonucleotide; TTA chr11 5300902 5300923 5300919 5300924 +
aaattgaatctaactctgagga

SEQ ID NO: 96812 - DNA, 22 bp, Artificial Sequence
  Synthetic oligonucleotide; TTG chr11 5300908 5300929 5300925 5300930 +
aatctaactctgaggaaaaaaa

SEQ ID NO: 96813 - DNA, 22 bp, Artificial Sequence
  Synthetic oligonucleotide; CTA chr11 5300914 5300935 5300931 5300936 +
actctgaggaaaaaaaagtgtg

SEQ ID NO: 96814 - DNA, 22 bp, Artificial Sequence
  Synthetic oligonucleotide; CTC chr11 5300918 5300939 5300935 5300940 +
tgaggaaaaaaaagtgtggata

SEQ ID NO: 96815 - DNA, 22 bp, Artificial Sequence
  Synthetic oligonucleotide; CTG chr11 5300920 5300941 5300937 5300942 +
aggaaaaaaaagtgtggatata

SEQ ID NO: 96816 - DNA, 22 bp, Artificial Sequence
  Synthetic oligonucleotide; TTC chr11 5300954 5300975 5300971 5300976 +
cttttcagtaatgggagaggcc

SEQ ID NO: 96817 - DNA, 22 bp, Artificial Sequence
  Synthetic oligonucleotide; CTT chr11 5300957 5300978 5300974 5300979 +
ttcagtaatgggagaggcccag

SEQ ID NO: 96818 - DNA, 22 bp, Artificial Sequence
  Synthetic oligonucleotide; TTT chr11 5300958 5300979 5300975 5300980 +
tcagtaatgggagaggcccaga

SEQ ID NO: 96819 - DNA, 22 bp, Artificial Sequence
  Synthetic oligonucleotide; TTT chr11 5300959 5300980 5300976 5300981 +
cagtaatgggagaggcccagaa

SEQ ID NO: 96820 - DNA, 22 bp, Artificial Sequence
  Synthetic oligonucleotide; TTC chr11 5300960 5300981 5300977 5300982 +
agtaatgggagaggcccagaaa

SEQ ID NO: 96821 - DNA, 22 bp, Artificial Sequence
  Synthetic oligonucleotide; CTA chr11 5300987 5301008 5301004 5301009 +
gagatcttgagattctgaaata

SEQ ID NO: 96822 - DNA, 22 bp, Artificial Sequence
  Synthetic oligonucleotide; CTT chr11 5300995 5301016 5301012 5301017 +
gagattctgaaataagggctca

SEQ ID NO: 96823 - DNA, 22 bp, Artificial Sequence
  Synthetic oligonucleotide; TTG chr11 5300996 5301017 5301013 5301018 +
agattctgaaataagggctcaa

SEQ ID NO: 96824 - DNA, 22 bp, Artificial Sequence
  Synthetic oligonucleotide; TTC chr11 5301002 5301023 5301019 5301024 +
tgaaataagggctcaagcccta

SEQ ID NO: 96825 - DNA, 22 bp, Artificial Sequence
  Synthetic oligonucleotide; CTG chr11 5301004 5301025 5301021 5301026 +
aaataagggctcaagccctact

SEQ ID NO: 96826 - DNA, 22 bp, Artificial Sequence
  Synthetic oligonucleotide; CTC chr11 5301016 5301037 5301033 5301038 +
aagccctactctgcccagaaaa

SEQ ID NO: 96827 - DNA, 22 bp, Artificial Sequence
  Synthetic oligonucleotide; CTA chr11 5301024 5301045 5301041 5301046 +
ctctgcccagaaaataggcgaa

SEQ ID NO: 96828 - DNA, 22 bp, Artificial Sequence
  Synthetic oligonucleotide; CTC chr11 5301027 5301048 5301044 5301049 +
tgcccagaaaataggcgaataa

SEQ ID NO: 96829 - DNA, 22 bp, Artificial Sequence
  Synthetic oligonucleotide; CTG chr11 5301029 5301050 5301046 5301051 +
cccagaaaataggcgaataatg

SEQ ID NO: 96830 - DNA, 22 bp, Artificial Sequence
  Synthetic oligonucleotide; CTT chr11 5301054 5301075 5301071 5301076 +
ctttgaatctgcttggtcttga

SEQ ID NO: 96831 - DNA, 22 bp, Artificial Sequence
  Synthetic oligonucleotide; TTC chr11 5301055 5301076 5301072 5301077 +
tttgaatctgcttggtcttgat

SEQ ID NO: 96832 - DNA, 22 bp, Artificial Sequence
  Synthetic oligonucleotide; CTT chr11 5301057 5301078 5301074 5301079 +
tgaatctgcttggtcttgatgc

SEQ ID NO: 96833 - DNA, 22 bp, Artificial Sequence
  Synthetic oligonucleotide; TTT chr11 5301058 5301079 5301075 5301080 +
gaatctgcttggtcttgatgct

SEQ ID NO: 96834 - DNA, 22 bp, Artificial Sequence
  Synthetic oligonucleotide; TTG chr11 5301059 5301080 5301076 5301081 +
aatctgcttggtcttgatgcta

SEQ ID NO: 96835 - DNA, 22 bp, Artificial Sequence
  Synthetic oligonucleotide; CTG chr11 5301065 5301086 5301082 5301087 +
cttggtcttgatgctataaatg

SEQ ID NO: 96836 - DNA, 22 bp, Artificial Sequence
  Synthetic oligonucleotide; CTT chr11 5301068 5301089 5301085 5301090 +
ggtcttgatgctataaatgata

SEQ ID NO: 96837 - DNA, 22 bp, Artificial Sequence
  Synthetic oligonucleotide; TTG chr11 5301069 5301090 5301086 5301091 +
gtcttgatgctataaatgatag

SEQ ID NO: 96838 - DNA, 22 bp, Artificial Sequence
  Synthetic oligonucleotide; CTT chr11 5301074 5301095 5301091 5301096 +
gatgctataaatgataggattc

SEQ ID NO: 96839 - DNA, 22 bp, Artificial Sequence
  Synthetic oligonucleotide; TTG chr11 5301075 5301096 5301092 5301097 +
atgctataaatgataggattca

SEQ ID NO: 96840 - DNA, 22 bp, Artificial Sequence
  Synthetic oligonucleotide; CTA chr11 5301081 5301102 5301098 5301103 +
taaatgataggattcacgaatg

SEQ ID NO: 96841 - DNA, 22 bp, Artificial Sequence
  Synthetic oligonucleotide; TTC chr11 5301096 5301117 5301113 5301118 +
acgaatggaggaaagagaaaat

SEQ ID NO: 96842 - DNA, 22 bp, Artificial Sequence
  Synthetic oligonucleotide; CTC chr11 5301129 5301150 5301146 5301151 +
atggtaatggggaccacatgag

SEQ ID NO: 96843 - DNA, 22 bp, Artificial Sequence
  Synthetic oligonucleotide; TTT chr11 5301161 5301182 5301178 5301183 +
cccaaacctgtgaatgaatgac

SEQ ID NO: 96844 - DNA, 22 bp, Artificial Sequence
  Synthetic oligonucleotide; TTC chr11 5301162 5301183 5301179 5301184 +
ccaaacctgtgaatgaatgaca

SEQ ID NO: 96845 - DNA, 22 bp, Artificial Sequence
  Synthetic oligonucleotide; CTG chr11 5301171 5301192 5301188 5301193 +
tgaatgaatgacagtcccatca

SEQ ID NO: 96846 - DNA, 22 bp, Artificial Sequence
  Synthetic oligonucleotide; CTA chr11 5301211 5301232 5301228 5301233 +
ggacacagctaatatgggagac

SEQ ID NO: 96847 - DNA, 22 bp, Artificial Sequence
  Synthetic oligonucleotide; CTA chr11 5301222 5301243 5301239 5301244 +
atatgggagacacaagtgttga

SEQ ID NO: 96848 - DNA, 22 bp, Artificial Sequence
  Synthetic oligonucleotide; TTG chr11 5301243 5301264 5301260 5301265 +
agagatttagcttcctcttgtc

SEQ ID NO: 96849 - DNA, 22 bp, Artificial Sequence
  Synthetic oligonucleotide; TTT chr11 5301251 5301272 5301268 5301273 +
agcttcctcttgtccagacgca

SEQ ID NO: 96850 - DNA, 22 bp, Artificial Sequence
  Synthetic oligonucleotide; TTA chr11 5301252 5301273 5301269 5301274 +
gcttcctcttgtccagacgcaa

SEQ ID NO: 96851 - DNA, 22 bp, Artificial Sequence
  Synthetic oligonucleotide; CTT chr11 5301256 5301277 5301273 5301278 +
cctcttgtccagacgcaatgcc

SEQ ID NO: 96852 - DNA, 22 bp, Artificial Sequence
  Synthetic oligonucleotide; TTC chr11 5301257 5301278 5301274 5301279 +
ctcttgtccagacgcaatgccc

SEQ ID NO: 96853 - DNA, 22 bp, Artificial Sequence
  Synthetic oligonucleotide; CTC chr11 5301260 5301281 5301277 5301282 +
ttgtccagacgcaatgcccatc

SEQ ID NO: 96854 - DNA, 22 bp, Artificial Sequence
  Synthetic oligonucleotide; CTT chr11 5301262 5301283 5301279 5301284 +
gtccagacgcaatgcccatcac

SEQ ID NO: 96855 - DNA, 22 bp, Artificial Sequence
  Synthetic oligonucleotide; TTG chr11 5301263 5301284 5301280 5301285 +
tccagacgcaatgcccatcact

SEQ ID NO: 96856 - DNA, 22 bp, Artificial Sequence
  Synthetic oligonucleotide; CTG chr11 5301286 5301307 5301303 5301308 +
tcttgaggattagtatataaga

SEQ ID NO: 96857 - DNA, 22 bp, Artificial Sequence
  Synthetic oligonucleotide; CTT chr11 5301290 5301311 5301307 5301312 +
gaggattagtatataagaaaag

SEQ ID NO: 96858 - DNA, 22 bp, Artificial Sequence
  Synthetic oligonucleotide; TTG chr11 5301291 5301312 5301308 5301313 +
aggattagtatataagaaaaga

SEQ ID NO: 96859 - DNA, 22 bp, Artificial Sequence
  Synthetic oligonucleotide; TTA chr11 5301298 5301319 5301315 5301320 +
gtatataagaaaagatgatgat

SEQ ID NO: 96860 - DNA, 22 bp, Artificial Sequence
  Synthetic oligonucleotide; TTA chr11 5301322 5301343 5301339 5301344 +
gagcatctaaaaagacagtcaa

SEQ ID NO: 96861 - DNA, 22 bp, Artificial Sequence
  Synthetic oligonucleotide; CTA chr11 5301331 5301352 5301348 5301353 +
aaaagacagtcaaagaagtctg

SEQ ID NO: 96862 - DNA, 22 bp, Artificial Sequence
  Synthetic oligonucleotide; CTG chr11 5301353 5301374 5301370 5301375 +
aataattggatatatgtgatta

SEQ ID NO: 96863 - DNA, 22 bp, Artificial Sequence
  Synthetic oligonucleotide; TTG chr11 5301361 5301382 5301378 5301383 +
gatatatgtgattaaacgtgat

SEQ ID NO: 96864 - DNA, 22 bp, Artificial Sequence
  Synthetic oligonucleotide; TTA chr11 5301375 5301396 5301392 5301397 +
aacgtgatatcagcacaggcga

SEQ ID NO: 96865 - DNA, 22 bp, Artificial Sequence
  Synthetic oligonucleotide; TTT chr11 5301401 5301422 5301418 5301423 +
tatgacatcttgatggaggcaa

SEQ ID NO: 96866 - DNA, 22 bp, Artificial Sequence
  Synthetic oligonucleotide; TTT chr11 5301402 5301423 5301419 5301424 +
atgacatcttgatggaggcaaa

SEQ ID NO: 96867 - DNA, 22 bp, Artificial Sequence
  Synthetic oligonucleotide; TTA chr11 5301403 5301424 5301420 5301425 +
tgacatcttgatggaggcaaaa

SEQ ID NO: 96868 - DNA, 22 bp, Artificial Sequence
  Synthetic oligonucleotide; CTT chr11 5301412 5301433 5301429 5301434 +
gatggaggcaaaatgtgtgcaa

SEQ ID NO: 96869 - DNA, 22 bp, Artificial Sequence
  Synthetic oligonucleotide; TTG chr11 5301413 5301434 5301430 5301435 +
atggaggcaaaatgtgtgcaag

SEQ ID NO: 96870 - DNA, 22 bp, Artificial Sequence
  Synthetic oligonucleotide; TTA chr11 5301481 5301502 5301498 5301503 +
tgggcaaaatggacataaaacc

SEQ ID NO: 96871 - DNA, 22 bp, Artificial Sequence
  Synthetic oligonucleotide; CTC chr11 5301505 5301526 5301522 5301527 +
tcatcagtacccccagtcctat

SEQ ID NO: 96872 - DNA, 22 bp, Artificial Sequence
  Synthetic oligonucleotide; CTC chr11 5301507 5301528 5301524 5301529 +
atcagtacccccagtcctatgt

SEQ ID NO: 96873 - DNA, 22 bp, Artificial Sequence
  Synthetic oligonucleotide; CTA chr11 5301526 5301547 5301543 5301548 +
tgttcatcactcgggaattggt

SEQ ID NO: 96874 - DNA, 22 bp, Artificial Sequence
  Synthetic oligonucleotide; TTC chr11 5301531 5301552 5301548 5301553 +
atcactcgggaattggtaagaa

SEQ ID NO: 96875 - DNA, 22 bp, Artificial Sequence
  Synthetic oligonucleotide; CTC chr11 5301538 5301559 5301555 5301560 +
gggaattggtaagaatgcagtt

SEQ ID NO: 96876 - DNA, 22 bp, Artificial Sequence
  Synthetic oligonucleotide; TTG chr11 5301546 5301567 5301563 5301568 +
gtaagaatgcagttgtacctca

SEQ ID NO: 96877 - DNA, 22 bp, Artificial Sequence
  Synthetic oligonucleotide; TTG chr11 5301561 5301582 5301578 5301583 +
tacctcagtggtgtgcggatgg

SEQ ID NO: 96878 - DNA, 22 bp, Artificial Sequence
  Synthetic oligonucleotide; CTC chr11 5301567 5301588 5301584 5301589 +
agtggtgtgcggatggcaatga

SEQ ID NO: 96879 - DNA, 22 bp, Artificial Sequence
  Synthetic oligonucleotide; CTG chr11 5301622 5301643 5301639 5301644 +
attctacaatggccagtgaatg

SEQ ID NO: 96880 - DNA, 22 bp, Artificial Sequence
  Synthetic oligonucleotide; TTC chr11 5301626 5301647 5301643 5301648 +
tacaatggccagtgaatgaatg

SEQ ID NO: 96881 - DNA, 22 bp, Artificial Sequence
  Synthetic oligonucleotide; CTA chr11 5301628 5301649 5301645 5301650 +
caatggccagtgaatgaatgaa

SEQ ID NO: 96882 - DNA, 22 bp, Artificial Sequence
  Synthetic oligonucleotide; TTG chr11 5301656 5301677 5301673 5301678 +
ggtgaaacaggcagcatgggca

SEQ ID NO: 96883 - DNA, 22 bp, Artificial Sequence
  Synthetic oligonucleotide; CTC chr11 5301683 5301704 5301700 5301705 +
cctctggtctagcagcaggaca

SEQ ID NO: 96884 - DNA, 22 bp, Artificial Sequence
  Synthetic oligonucleotide; CTC chr11 5301687 5301708 5301704 5301709 +
tggtctagcagcaggacaccca

SEQ ID NO: 96885 - DNA, 22 bp, Artificial Sequence
  Synthetic oligonucleotide; CTG chr11 5301689 5301710 5301706 5301711 +
gtctagcagcaggacacccagg

SEQ ID NO: 96886 - DNA, 22 bp, Artificial Sequence
  Synthetic oligonucleotide; CTA chr11 5301694 5301715 5301711 5301716 +
gcagcaggacacccaggactgt

SEQ ID NO: 96887 - DNA, 22 bp, Artificial Sequence
  Synthetic oligonucleotide; CTG chr11 5301715 5301736 5301732 5301737 +
tgggcattgtagtgaatgtcat

SEQ ID NO: 96888 - DNA, 22 bp, Artificial Sequence
  Synthetic oligonucleotide; TTG chr11 5301724 5301745 5301741 5301746 +
tagtgaatgtcatcccaaggtc

SEQ ID NO: 96889 - DNA, 22 bp, Artificial Sequence
  Synthetic oligonucleotide; CTG chr11 5301754 5301775 5301771 5301776 +
ccagcatagccaggaagtagta

SEQ ID NO: 96890 - DNA, 22 bp, Artificial Sequence
  Synthetic oligonucleotide; CTC chr11 5301785 5301806 5301802 5301807 +
atggaggctgtgatcattccaa

SEQ ID NO: 96891 - DNA, 22 bp, Artificial Sequence
  Synthetic oligonucleotide; CTG chr11 5301795 5301816 5301812 5301817 +
tgatcattccaaatgaggacaa

SEQ ID NO: 96892 - DNA, 22 bp, Artificial Sequence
  Synthetic oligonucleotide; TTC chr11 5301804 5301825 5301821 5301826 +
caaatgaggacaagaagagtgc

SEQ ID NO: 96893 - DNA, 22 bp, Artificial Sequence
  Synthetic oligonucleotide; TTT chr11 5301831 5301852 5301848 5301853 +
ccaaaaaggacggagaagtaga

SEQ ID NO: 96894 - DNA, 22 bp, Artificial Sequence
  Synthetic oligonucleotide; TTC chr11 5301832 5301853 5301849 5301854 +
caaaaaggacggagaagtagat

SEQ ID NO: 96895 - DNA, 22 bp, Artificial Sequence
  Synthetic oligonucleotide; CTG chr11 5301889 5301910 5301906 5301911 +
cctctgagcccaagaagccagt

SEQ ID NO: 96896 - DNA, 22 bp, Artificial Sequence
  Synthetic oligonucleotide; CTC chr11 5301893 5301914 5301910 5301915 +
tgagcccaagaagccagtcagc

SEQ ID NO: 96897 - DNA, 22 bp, Artificial Sequence
  Synthetic oligonucleotide; CTG chr11 5301895 5301916 5301912 5301917 +
agcccaagaagccagtcagcaa

SEQ ID NO: 96898 - DNA, 22 bp, Artificial Sequence
  Synthetic oligonucleotide; CTG chr11 5301933 5301954 5301950 5301955 +
ttgttataccacatggtaggtt

SEQ ID NO: 96899 - DNA, 22 bp, Artificial Sequence
  Synthetic oligonucleotide; TTG chr11 5301936 5301957 5301953 5301958 +
ttataccacatggtaggttttg

SEQ ID NO: 96900 - DNA, 22 bp, Artificial Sequence
  Synthetic oligonucleotide; TTA chr11 5301939 5301960 5301956 5301961 +
taccacatggtaggttttgcag

SEQ ID NO: 96901 - DNA, 22 bp, Artificial Sequence
  Synthetic oligonucleotide; TTT chr11 5301956 5301977 5301973 5301978 +
tgcaggtggagaagatattttt

SEQ ID NO: 96902 - DNA, 22 bp, Artificial Sequence
  Synthetic oligonucleotide; TTT chr11 5301957 5301978 5301974 5301979 +
gcaggtggagaagatatttttt

SEQ ID NO: 96903 - DNA, 22 bp, Artificial Sequence
  Synthetic oligonucleotide; TTG chr11 5301958 5301979 5301975 5301980 +
caggtggagaagatatttttta

SEQ ID NO: 96904 - DNA, 22 bp, Artificial Sequence
  Synthetic oligonucleotide; TTT chr11 5301976 5301997 5301993 5301998 +
tttaggggtgatgacctccaaa

SEQ ID NO: 96905 - DNA, 22 bp, Artificial Sequence
  Synthetic oligonucleotide; TTT chr11 5301977 5301998 5301994 5301999 +
ttaggggtgatgacctccaaag

SEQ ID NO: 96906 - DNA, 22 bp, Artificial Sequence
  Synthetic oligonucleotide; TTT chr11 5301978 5301999 5301995 5302000 +
taggggtgatgacctccaaaga

SEQ ID NO: 96907 - DNA, 22 bp, Artificial Sequence
  Synthetic oligonucleotide; TTT chr11 5301979 5302000 5301996 5302001 +
aggggtgatgacctccaaagat

SEQ ID NO: 96908 - DNA, 22 bp, Artificial Sequence
  Synthetic oligonucleotide; TTA chr11 5301980 5302001 5301997 5302002 +
ggggtgatgacctccaaagatg

SEQ ID NO: 96909 - DNA, 22 bp, Artificial Sequence
  Synthetic oligonucleotide; CTC chr11 5301994 5302015 5302011 5302016 +
caaagatgcagttttctttttt

SEQ ID NO: 96910 - DNA, 22 bp, Artificial Sequence
  Synthetic oligonucleotide; TTT chr11 5302008 5302029 5302025 5302030 +
tcttttttctctcacaatcttc

SEQ ID NO: 96911 - DNA, 22 bp, Artificial Sequence
  Synthetic oligonucleotide; TTT chr11 5302009 5302030 5302026 5302031 +
cttttttctctcacaatcttct

SEQ ID NO: 96912 - DNA, 22 bp, Artificial Sequence
  Synthetic oligonucleotide; TTC chr11 5302010 5302031 5302027 5302032 +
ttttttctctcacaatcttctt

SEQ ID NO: 96913 - DNA, 22 bp, Artificial Sequence
  Synthetic oligonucleotide; CTT chr11 5302012 5302033 5302029 5302034 +
ttttctctcacaatcttcttgt

SEQ ID NO: 96914 - DNA, 22 bp, Artificial Sequence
  Synthetic oligonucleotide; TTT chr11 5302013 5302034 5302030 5302035 +
tttctctcacaatcttcttgta

SEQ ID NO: 96915 - DNA, 22 bp, Artificial Sequence
  Synthetic oligonucleotide; TTT chr11 5302014 5302035 5302031 5302036 +
ttctctcacaatcttcttgtag

SEQ ID NO: 96916 - DNA, 22 bp, Artificial Sequence
  Synthetic oligonucleotide; TTT chr11 5302015 5302036 5302032 5302037 +
tctctcacaatcttcttgtagc

SEQ ID NO: 96917 - DNA, 22 bp, Artificial Sequence
  Synthetic oligonucleotide; TTT chr11 5302016 5302037 5302033 5302038 +
ctctcacaatcttcttgtagca

SEQ ID NO: 96918 - DNA, 22 bp, Artificial Sequence
  Synthetic oligonucleotide; TTC chr11 5302017 5302038 5302034 5302039 +
tctcacaatcttcttgtagcac

SEQ ID NO: 96919 - DNA, 22 bp, Artificial Sequence
  Synthetic oligonucleotide; CTC chr11 5302019 5302040 5302036 5302041 +
tcacaatcttcttgtagcacat

SEQ ID NO: 96920 - DNA, 22 bp, Artificial Sequence
  Synthetic oligonucleotide; CTC chr11 5302021 5302042 5302038 5302043 +
acaatcttcttgtagcacatca

SEQ ID NO: 96921 - DNA, 22 bp, Artificial Sequence
  Synthetic oligonucleotide; CTT chr11 5302029 5302050 5302046 5302051 +
cttgtagcacatcatcaggcca

SEQ ID NO: 96922 - DNA, 22 bp, Artificial Sequence
  Synthetic oligonucleotide; TTC chr11 5302030 5302051 5302047 5302052 +
ttgtagcacatcatcaggccat

SEQ ID NO: 96923 - DNA, 22 bp, Artificial Sequence
  Synthetic oligonucleotide; CTT chr11 5302032 5302053 5302049 5302054 +
gtagcacatcatcaggccattt

SEQ ID NO: 96924 - DNA, 22 bp, Artificial Sequence
  Synthetic oligonucleotide; TTG chr11 5302033 5302054 5302050 5302055 +
tagcacatcatcaggccatttt

SEQ ID NO: 96925 - DNA, 22 bp, Artificial Sequence
  Synthetic oligonucleotide; TTT chr11 5302054 5302075 5302071 5302076 +
tttacctcaaaacttaaatatt

SEQ ID NO: 96926 - DNA, 22 bp, Artificial Sequence
  Synthetic oligonucleotide; TTT chr11 5302055 5302076 5302072 5302077 +
ttacctcaaaacttaaatattt

SEQ ID NO: 96927 - DNA, 22 bp, Artificial Sequence
  Synthetic oligonucleotide; TTT chr11 5302056 5302077 5302073 5302078 +
tacctcaaaacttaaatatttt

SEQ ID NO: 96928 - DNA, 22 bp, Artificial Sequence
  Synthetic oligonucleotide; TTT chr11 5302057 5302078 5302074 5302079 +
acctcaaaacttaaatattttt

SEQ ID NO: 96929 - DNA, 22 bp, Artificial Sequence
  Synthetic oligonucleotide; TTA chr11 5302058 5302079 5302075 5302080 +
cctcaaaacttaaatatttttc

SEQ ID NO: 96930 - DNA, 22 bp, Artificial Sequence
  Synthetic oligonucleotide; CTC chr11 5302062 5302083 5302079 5302084 +
aaaacttaaatatttttctgga

SEQ ID NO: 96931 - DNA, 22 bp, Artificial Sequence
  Synthetic oligonucleotide; CTT chr11 5302069 5302090 5302086 5302091 +
aaatatttttctggattgtctc

SEQ ID NO: 96932 - DNA, 22 bp, Artificial Sequence
  Synthetic oligonucleotide; TTA chr11 5302070 5302091 5302087 5302092 +
aatatttttctggattgtctca

SEQ ID NO: 96933 - DNA, 22 bp, Artificial Sequence
  Synthetic oligonucleotide; TTT chr11 5302077 5302098 5302094 5302099 +
ttctggattgtctcatacttaa

SEQ ID NO: 96934 - DNA, 22 bp, Artificial Sequence
  Synthetic oligonucleotide; TTT chr11 5302078 5302099 5302095 5302100 +
tctggattgtctcatacttaat

SEQ ID NO: 96935 - DNA, 22 bp, Artificial Sequence
  Synthetic oligonucleotide; TTT chr11 5302079 5302100 5302096 5302101 +
ctggattgtctcatacttaatt

SEQ ID NO: 96936 - DNA, 22 bp, Artificial Sequence
  Synthetic oligonucleotide; TTC chr11 5302080 5302101 5302097 5302102 +
tggattgtctcatacttaatta

SEQ ID NO: 96937 - DNA, 22 bp, Artificial Sequence
  Synthetic oligonucleotide; CTG chr11 5302082 5302103 5302099 5302104 +
gattgtctcatacttaattaat

SEQ ID NO: 96938 - DNA, 22 bp, Artificial Sequence
  Synthetic oligonucleotide; TTG chr11 5302087 5302108 5302104 5302109 +
tctcatacttaattaattgtaa

SEQ ID NO: 96939 - DNA, 22 bp, Artificial Sequence
  Synthetic oligonucleotide; CTC chr11 5302091 5302112 5302108 5302113 +
atacttaattaattgtaagcct

SEQ ID NO: 96940 - DNA, 22 bp, Artificial Sequence
  Synthetic oligonucleotide; CTT chr11 5302097 5302118 5302114 5302119 +
aattaattgtaagcctgtactc

SEQ ID NO: 96941 - DNA, 22 bp, Artificial Sequence
  Synthetic oligonucleotide; TTA chr11 5302098 5302119 5302115 5302120 +
attaattgtaagcctgtactca

SEQ ID NO: 96942 - DNA, 22 bp, Artificial Sequence
  Synthetic oligonucleotide; TTA chr11 5302102 5302123 5302119 5302124 +
attgtaagcctgtactcacaag

SEQ ID NO: 96943 - DNA, 22 bp, Artificial Sequence
  Synthetic oligonucleotide; TTG chr11 5302106 5302127 5302123 5302128 +
taagcctgtactcacaaggcct

SEQ ID NO: 96944 - DNA, 22 bp, Artificial Sequence
  Synthetic oligonucleotide; CTG chr11 5302114 5302135 5302131 5302136 +
tactcacaaggcctttccctag

SEQ ID NO: 96945 - DNA, 22 bp, Artificial Sequence
  Synthetic oligonucleotide; CTC chr11 5302119 5302140 5302136 5302141 +
acaaggcctttccctagaataa

SEQ ID NO: 96946 - DNA, 22 bp, Artificial Sequence
  Synthetic oligonucleotide; CTT chr11 5302129 5302150 5302146 5302151 +
tccctagaataacaaataacaa

SEQ ID NO: 96947 - DNA, 22 bp, Artificial Sequence
  Synthetic oligonucleotide; TTT chr11 5302130 5302151 5302147 5302152 +
ccctagaataacaaataacaaa

SEQ ID NO: 96948 - DNA, 22 bp, Artificial Sequence
  Synthetic oligonucleotide; TTC chr11 5302131 5302152 5302148 5302153 +
cctagaataacaaataacaaaa

SEQ ID NO: 96949 - DNA, 22 bp, Artificial Sequence
  Synthetic oligonucleotide; CTA chr11 5302135 5302156 5302152 5302157 +
gaataacaaataacaaaaatca

SEQ ID NO: 96950 - DNA, 22 bp, Artificial Sequence
  Synthetic oligonucleotide; TTC chr11 5302175 5302196 5302192 5302197 +
caattcactatgaagcatacaa

SEQ ID NO: 96951 - DNA, 22 bp, Artificial Sequence
  Synthetic oligonucleotide; TTC chr11 5302181 5302202 5302198 5302203 +
actatgaagcatacaaccttta

SEQ ID NO: 96952 - DNA, 22 bp, Artificial Sequence
  Synthetic oligonucleotide; CTA chr11 5302185 5302206 5302202 5302207 +
tgaagcatacaacctttatttt

SEQ ID NO: 96953 - DNA, 22 bp, Artificial Sequence
  Synthetic oligonucleotide; CTT chr11 5302201 5302222 5302218 5302223 +
tattttttcaacactcatctta

SEQ ID NO: 96954 - DNA, 22 bp, Artificial Sequence
  Synthetic oligonucleotide; TTT chr11 5302202 5302223 5302219 5302224 +
attttttcaacactcatcttac

SEQ ID NO: 96955 - DNA, 22 bp, Artificial Sequence
  Synthetic oligonucleotide; TTA chr11 5302203 5302224 5302220 5302225 +
ttttttcaacactcatcttacg

SEQ ID NO: 96956 - DNA, 22 bp, Artificial Sequence
  Synthetic oligonucleotide; TTT chr11 5302206 5302227 5302223 5302228 +
tttcaacactcatcttacgtct

SEQ ID NO: 96957 - DNA, 22 bp, Artificial Sequence
  Synthetic oligonucleotide; TTT chr11 5302207 5302228 5302224 5302229 +
ttcaacactcatcttacgtctg

SEQ ID NO: 96958 - DNA, 22 bp, Artificial Sequence
  Synthetic oligonucleotide; TTT chr11 5302208 5302229 5302225 5302230 +
tcaacactcatcttacgtctgt

SEQ ID NO: 96959 - DNA, 22 bp, Artificial Sequence
  Synthetic oligonucleotide; TTT chr11 5302209 5302230 5302226 5302231 +
caacactcatcttacgtctgtg

SEQ ID NO: 96960 - DNA, 22 bp, Artificial Sequence
  Synthetic oligonucleotide; TTC chr11 5302210 5302231 5302227 5302232 +
aacactcatcttacgtctgtgc

SEQ ID NO: 96961 - DNA, 22 bp, Artificial Sequence
  Synthetic oligonucleotide; CTC chr11 5302217 5302238 5302234 5302239 +
atcttacgtctgtgctcatagc

SEQ ID NO: 96962 - DNA, 22 bp, Artificial Sequence
  Synthetic oligonucleotide; CTT chr11 5302222 5302243 5302239 5302244 +
acgtctgtgctcatagccttga

SEQ ID NO: 96963 - DNA, 22 bp, Artificial Sequence
  Synthetic oligonucleotide; TTA chr11 5302223 5302244 5302240 5302245 +
cgtctgtgctcatagccttgac

SEQ ID NO: 96964 - DNA, 22 bp, Artificial Sequence
  Synthetic oligonucleotide; CTG chr11 5302229 5302250 5302246 5302251 +
tgctcatagccttgactcttgg

SEQ ID NO: 96965 - DNA, 22 bp, Artificial Sequence
  Synthetic oligonucleotide; CTC chr11 5302234 5302255 5302251 5302256 +
atagccttgactcttggtccca

SEQ ID NO: 96966 - DNA, 22 bp, Artificial Sequence
  Synthetic oligonucleotide; CTT chr11 5302242 5302263 5302259 5302264 +
gactcttggtcccaaataggac

SEQ ID NO: 96967 - DNA, 22 bp, Artificial Sequence
  Synthetic oligonucleotide; TTG chr11 5302243 5302264 5302260 5302265 +
actcttggtcccaaataggact

SEQ ID NO: 96968 - DNA, 22 bp, Artificial Sequence
  Synthetic oligonucleotide; CTC chr11 5302247 5302268 5302264 5302269 +
ttggtcccaaataggactcctt

SEQ ID NO: 96969 - DNA, 22 bp, Artificial Sequence
  Synthetic oligonucleotide; CTT chr11 5302249 5302270 5302266 5302271 +
ggtcccaaataggactcctttg

SEQ ID NO: 96970 - DNA, 22 bp, Artificial Sequence
  Synthetic oligonucleotide; TTG chr11 5302250 5302271 5302267 5302272 +
gtcccaaataggactcctttgt

SEQ ID NO: 96971 - DNA, 22 bp, Artificial Sequence
  Synthetic oligonucleotide; CTC chr11 5302266 5302287 5302283 5302288 +
ctttgttcccttttattctctt

SEQ ID NO: 96972 - DNA, 22 bp, Artificial Sequence
  Synthetic oligonucleotide; CTT chr11 5302269 5302290 5302286 5302291 +
tgttcccttttattctctttac

SEQ ID NO: 96973 - DNA, 22 bp, Artificial Sequence
  Synthetic oligonucleotide; TTT chr11 5302270 5302291 5302287 5302292 +
gttcccttttattctctttact

SEQ ID NO: 96974 - DNA, 22 bp, Artificial Sequence
  Synthetic oligonucleotide; TTG chr11 5302271 5302292 5302288 5302293 +
ttcccttttattctctttactc

SEQ ID NO: 96975 - DNA, 22 bp, Artificial Sequence
  Synthetic oligonucleotide; TTC chr11 5302274 5302295 5302291 5302296 +
ccttttattctctttactcttt

SEQ ID NO: 96976 - DNA, 22 bp, Artificial Sequence
  Synthetic oligonucleotide; CTT chr11 5302278 5302299 5302295 5302300 +
ttattctctttactcttttatt

SEQ ID NO: 96977 - DNA, 22 bp, Artificial Sequence
  Synthetic oligonucleotide; TTT chr11 5302279 5302300 5302296 5302301 +
tattctctttactcttttattc

SEQ ID NO: 96978 - DNA, 22 bp, Artificial Sequence
  Synthetic oligonucleotide; TTT chr11 5302280 5302301 5302297 5302302 +
attctctttactcttttattcc

SEQ ID NO: 96979 - DNA, 22 bp, Artificial Sequence
  Synthetic oligonucleotide; TTA chr11 5302281 5302302 5302298 5302303 +
ttctctttactcttttattcct

SEQ ID NO: 96980 - DNA, 22 bp, Artificial Sequence
  Synthetic oligonucleotide; TTC chr11 5302284 5302305 5302301 5302306 +
tctttactcttttattcctcct

SEQ ID NO: 96981 - DNA, 22 bp, Artificial Sequence
  Synthetic oligonucleotide; CTC chr11 5302286 5302307 5302303 5302308 +
tttactcttttattcctcctcc

SEQ ID NO: 96982 - DNA, 22 bp, Artificial Sequence
  Synthetic oligonucleotide; CTT chr11 5302288 5302309 5302305 5302310 +
tactcttttattcctcctccta

SEQ ID NO: 96983 - DNA, 22 bp, Artificial Sequence
  Synthetic oligonucleotide; TTT chr11 5302289 5302310 5302306 5302311 +
actcttttattcctcctcctat

SEQ ID NO: 96984 - DNA, 22 bp, Artificial Sequence
  Synthetic oligonucleotide; TTA chr11 5302290 5302311 5302307 5302312 +
ctcttttattcctcctcctatt

SEQ ID NO: 96985 - DNA, 22 bp, Artificial Sequence
  Synthetic oligonucleotide; CTC chr11 5302293 5302314 5302310 5302315 +
ttttattcctcctcctattatt

SEQ ID NO: 96986 - DNA, 22 bp, Artificial Sequence
  Synthetic oligonucleotide; CTT chr11 5302295 5302316 5302312 5302317 +
ttattcctcctcctattattta

SEQ ID NO: 96987 - DNA, 22 bp, Artificial Sequence
  Synthetic oligonucleotide; TTT chr11 5302296 5302317 5302313 5302318 +
tattcctcctcctattatttat

SEQ ID NO: 96988 - DNA, 22 bp, Artificial Sequence
  Synthetic oligonucleotide; TTT chr11 5302297 5302318 5302314 5302319 +
attcctcctcctattatttatc

SEQ ID NO: 96989 - DNA, 22 bp, Artificial Sequence
  Synthetic oligonucleotide; TTA chr11 5302298 5302319 5302315 5302320 +
ttcctcctcctattatttatca

SEQ ID NO: 96990 - DNA, 22 bp, Artificial Sequence
  Synthetic oligonucleotide; TTC chr11 5302301 5302322 5302318 5302323 +
ctcctcctattatttatcatat

SEQ ID NO: 96991 - DNA, 22 bp, Artificial Sequence
  Synthetic oligonucleotide; CTC chr11 5302304 5302325 5302321 5302326 +
ctcctattatttatcatatggg

SEQ ID NO: 96992 - DNA, 22 bp, Artificial Sequence
  Synthetic oligonucleotide; CTC chr11 5302307 5302328 5302324 5302329 +
ctattatttatcatatgggccc

SEQ ID NO: 96993 - DNA, 22 bp, Artificial Sequence
  Synthetic oligonucleotide; CTA chr11 5302310 5302331 5302327 5302332 +
ttatttatcatatgggccctta

SEQ ID NO: 96994 - DNA, 22 bp, Artificial Sequence
  Synthetic oligonucleotide; TTA chr11 5302313 5302334 5302330 5302335 +
tttatcatatgggcccttactg

SEQ ID NO: 96995 - DNA, 22 bp, Artificial Sequence
  Synthetic oligonucleotide; TTT chr11 5302316 5302337 5302333 5302338 +
atcatatgggcccttactgtgt

SEQ ID NO: 96996 - DNA, 22 bp, Artificial Sequence
  Synthetic oligonucleotide; TTA chr11 5302317 5302338 5302334 5302339 +
tcatatgggcccttactgtgtt

SEQ ID NO: 96997 - DNA, 22 bp, Artificial Sequence
  Synthetic oligonucleotide; CTT chr11 5302331 5302352 5302348 5302353 +
actgtgttactatccaagttga

SEQ ID NO: 96998 - DNA, 22 bp, Artificial Sequence
  Synthetic oligonucleotide; TTA chr11 5302332 5302353 5302349 5302354 +
ctgtgttactatccaagttgag

SEQ ID NO: 96999 - DNA, 22 bp, Artificial Sequence
  Synthetic oligonucleotide; CTG chr11 5302335 5302356 5302352 5302357 +
tgttactatccaagttgagtca

SEQ ID NO: 97000 - DNA, 22 bp, Artificial Sequence
  Synthetic oligonucleotide; TTA chr11 5302340 5302361 5302357 5302362 +
ctatccaagttgagtcagttca

SEQ ID NO: 97001 - DNA, 22 bp, Artificial Sequence
  Synthetic oligonucleotide; CTA chr11 5302343 5302364 5302360 5302365 +
tccaagttgagtcagttcaaat

SEQ ID NO: 97002 - DNA, 22 bp, Artificial Sequence
  Synthetic oligonucleotide; TTG chr11 5302352 5302373 5302369 5302374 +
agtcagttcaaattttttctct

SEQ ID NO: 97003 - DNA, 22 bp, Artificial Sequence
  Synthetic oligonucleotide; TTC chr11 5302361 5302382 5302378 5302383 +
aaattttttctcttgaaactaa

SEQ ID NO: 97004 - DNA, 22 bp, Artificial Sequence
  Synthetic oligonucleotide; TTT chr11 5302367 5302388 5302384 5302389 +
tttctcttgaaactaatgggac

SEQ ID NO: 97005 - DNA, 22 bp, Artificial Sequence
  Synthetic oligonucleotide; TTT chr11 5302368 5302389 5302385 5302390 +
ttctcttgaaactaatgggaca

SEQ ID NO: 97006 - DNA, 22 bp, Artificial Sequence
  Synthetic oligonucleotide; TTT chr11 5302369 5302390 5302386 5302391 +
tctcttgaaactaatgggacag

SEQ ID NO: 97007 - DNA, 22 bp, Artificial Sequence
  Synthetic oligonucleotide; TTT chr11 5302370 5302391 5302387 5302392 +
ctcttgaaactaatgggacagc

SEQ ID NO: 97008 - DNA, 22 bp, Artificial Sequence
  Synthetic oligonucleotide; TTC chr11 5302371 5302392 5302388 5302393 +
tcttgaaactaatgggacagct

SEQ ID NO: 97009 - DNA, 22 bp, Artificial Sequence
  Synthetic oligonucleotide; CTC chr11 5302373 5302394 5302390 5302395 +
ttgaaactaatgggacagctgt

SEQ ID NO: 97010 - DNA, 22 bp, Artificial Sequence
  Synthetic oligonucleotide; CTT chr11 5302375 5302396 5302392 5302397 +
gaaactaatgggacagctgtat

SEQ ID NO: 97011 - DNA, 22 bp, Artificial Sequence
  Synthetic oligonucleotide; TTG chr11 5302376 5302397 5302393 5302398 +
aaactaatgggacagctgtatt

SEQ ID NO: 97012 - DNA, 22 bp, Artificial Sequence
  Synthetic oligonucleotide; CTA chr11 5302382 5302403 5302399 5302404 +
atgggacagctgtatttaggat

SEQ ID NO: 97013 - DNA, 22 bp, Artificial Sequence
  Synthetic oligonucleotide; CTG chr11 5302394 5302415 5302411 5302416 +
tatttaggattaaccactgagg

SEQ ID NO: 97014 - DNA, 22 bp, Artificial Sequence
  Synthetic oligonucleotide; TTT chr11 5302399 5302420 5302416 5302421 +
aggattaaccactgaggaaaat

SEQ ID NO: 97015 - DNA, 22 bp, Artificial Sequence
  Synthetic oligonucleotide; TTA chr11 5302400 5302421 5302417 5302422 +
ggattaaccactgaggaaaatg

SEQ ID NO: 97016 - DNA, 22 bp, Artificial Sequence
  Synthetic oligonucleotide; TTA chr11 5302406 5302427 5302423 5302428 +
accactgaggaaaatgcttatt

SEQ ID NO: 97017 - DNA, 22 bp, Artificial Sequence
  Synthetic oligonucleotide; CTG chr11 5302413 5302434 5302430 5302435 +
aggaaaatgcttattcaataga

SEQ ID NO: 97018 - DNA, 22 bp, Artificial Sequence
  Synthetic oligonucleotide; CTT chr11 5302425 5302446 5302442 5302447 +
attcaatagaaatgactgagaa

SEQ ID NO: 97019 - DNA, 22 bp, Artificial Sequence
  Synthetic oligonucleotide; TTA chr11 5302426 5302447 5302443 5302448 +
ttcaatagaaatgactgagaaa

SEQ ID NO: 97020 - DNA, 22 bp, Artificial Sequence
  Synthetic oligonucleotide; TTC chr11 5302429 5302450 5302446 5302451 +
aatagaaatgactgagaaatat

SEQ ID NO: 97021 - DNA, 22 bp, Artificial Sequence
  Synthetic oligonucleotide; CTG chr11 5302443 5302464 5302460 5302465 +
agaaatattgtgatcaatgttg

SEQ ID NO: 97022 - DNA, 22 bp, Artificial Sequence
  Synthetic oligonucleotide; TTG chr11 5302453 5302474 5302470 5302475 +
tgatcaatgttgctatctcaag

SEQ ID NO: 97023 - DNA, 22 bp, Artificial Sequence
  Synthetic oligonucleotide; TTG chr11 5302465 5302486 5302482 5302487 +
ctatctcaagtggactgtgaat

SEQ ID NO: 97024 - DNA, 22 bp, Artificial Sequence
  Synthetic oligonucleotide; CTA chr11 5302468 5302489 5302485 5302490 +
tctcaagtggactgtgaataag

SEQ ID NO: 97025 - DNA, 22 bp, Artificial Sequence
  Synthetic oligonucleotide; CTC chr11 5302472 5302493 5302489 5302494 +
aagtggactgtgaataagaaga

SEQ ID NO: 97026 - DNA, 22 bp, Artificial Sequence
  Synthetic oligonucleotide; CTG chr11 5302482 5302503 5302499 5302504 +
tgaataagaagagaacccagcc

SEQ ID NO: 97027 - DNA, 22 bp, Artificial Sequence
  Synthetic oligonucleotide; CTG chr11 5302506 5302527 5302523 5302528 +
ggcaacatagctagaccctgcc

SEQ ID NO: 97028 - DNA, 22 bp, Artificial Sequence
  Synthetic oligonucleotide; CTA chr11 5302519 5302540 5302536 5302541 +
gaccctgcctccaccaaaaaaa

SEQ ID NO: 97029 - DNA, 22 bp, Artificial Sequence
  Synthetic oligonucleotide; CTG chr11 5302526 5302547 5302543 5302548 +
cctccaccaaaaaaaaaagaaa

SEQ ID NO: 97030 - DNA, 22 bp, Artificial Sequence
  Synthetic oligonucleotide; CTC chr11 5302530 5302551 5302547 5302552 +
caccaaaaaaaaaagaaaagat

SEQ ID NO: 97031 - DNA, 22 bp, Artificial Sequence
  Synthetic oligonucleotide; TTA chr11 5302560 5302581 5302577 5302582 +
gctgggcacaggggcacacatc

SEQ ID NO: 97032 - DNA, 22 bp, Artificial Sequence
  Synthetic oligonucleotide; CTG chr11 5302564 5302585 5302581 5302586 +
ggcacaggggcacacatcacct

SEQ ID NO: 97033 - DNA, 22 bp, Artificial Sequence
  Synthetic oligonucleotide; CTG chr11 5302587 5302608 5302604 5302609 +
agcccaggactgtgaggctgca

SEQ ID NO: 97034 - DNA, 22 bp, Artificial Sequence
  Synthetic oligonucleotide; CTG chr11 5302599 5302620 5302616 5302621 +
tgaggctgcagggagctatgat

SEQ ID NO: 97035 - DNA, 22 bp, Artificial Sequence
  Synthetic oligonucleotide; CTG chr11 5302607 5302628 5302624 5302629 +
cagggagctatgattgcagcac

SEQ ID NO: 97036 - DNA, 22 bp, Artificial Sequence
  Synthetic oligonucleotide; CTA chr11 5302617 5302638 5302634 5302639 +
tgattgcagcactgctctccag

SEQ ID NO: 97037 - DNA, 22 bp, Artificial Sequence
  Synthetic oligonucleotide; TTG chr11 5302623 5302644 5302640 5302645 +
cagcactgctctccagcctggg

SEQ ID NO: 97038 - DNA, 22 bp, Artificial Sequence
  Synthetic oligonucleotide; CTG chr11 5302631 5302652 5302648 5302653 +
ctctccagcctgggcaacggag

SEQ ID NO: 97039 - DNA, 22 bp, Artificial Sequence
  Synthetic oligonucleotide; CTC chr11 5302634 5302655 5302651 5302656 +
tccagcctgggcaacggagtca

SEQ ID NO: 97040 - DNA, 22 bp, Artificial Sequence
  Synthetic oligonucleotide; CTC chr11 5302636 5302657 5302653 5302658 +
cagcctgggcaacggagtcaga

SEQ ID NO: 97041 - DNA, 22 bp, Artificial Sequence
  Synthetic oligonucleotide; CTG chr11 5302643 5302664 5302660 5302665 +
ggcaacggagtcagactctgtc

SEQ ID NO: 97042 - DNA, 22 bp, Artificial Sequence
  Synthetic oligonucleotide; CTC chr11 5302661 5302682 5302678 5302683 +
tgtctctataaaaaataaaata

SEQ ID NO: 97043 - DNA, 22 bp, Artificial Sequence
  Synthetic oligonucleotide; CTG chr11 5302663 5302684 5302680 5302685 +
tctctataaaaaataaaataaa

SEQ ID NO: 97044 - DNA, 22 bp, Artificial Sequence
  Synthetic oligonucleotide; CTC chr11 5302667 5302688 5302684 5302689 +
tataaaaaataaaataaaataa

SEQ ID NO: 97045 - DNA, 22 bp, Artificial Sequence
  Synthetic oligonucleotide; CTA chr11 5302669 5302690 5302686 5302691 +
taaaaaataaaataaaataaaa

SEQ ID NO: 97046 - DNA, 22 bp, Artificial Sequence
  Synthetic oligonucleotide; CTC chr11 5302707 5302728 5302724 5302729 +
atctattgtgagtttccacaga

SEQ ID NO: 97047 - DNA, 22 bp, Artificial Sequence
  Synthetic oligonucleotide; CTA chr11 5302712 5302733 5302729 5302734 +
ttgtgagtttccacagaaatct

SEQ ID NO: 97048 - DNA, 22 bp, Artificial Sequence
  Synthetic oligonucleotide; TTG chr11 5302715 5302736 5302732 5302737 +
tgagtttccacagaaatctgaa

SEQ ID NO: 97049 - DNA, 22 bp, Artificial Sequence
  Synthetic oligonucleotide; TTT chr11 5302722 5302743 5302739 5302744 +
ccacagaaatctgaacacctga

SEQ ID NO: 97050 - DNA, 22 bp, Artificial Sequence
  Synthetic oligonucleotide; TTC chr11 5302723 5302744 5302740 5302745 +
cacagaaatctgaacacctgaa

SEQ ID NO: 97051 - DNA, 22 bp, Artificial Sequence
  Synthetic oligonucleotide; CTG chr11 5302735 5302756 5302752 5302757 +
aacacctgaacaagtgggtaaa

SEQ ID NO: 97052 - DNA, 22 bp, Artificial Sequence
  Synthetic oligonucleotide; CTG chr11 5302743 5302764 5302760 5302765 +
aacaagtgggtaaagttagtaa

SEQ ID NO: 97053 - DNA, 22 bp, Artificial Sequence
  Synthetic oligonucleotide; TTA chr11 5302761 5302782 5302778 5302783 +
gtaaactcattttagaaaggtg

SEQ ID NO: 97054 - DNA, 22 bp, Artificial Sequence
  Synthetic oligonucleotide; CTC chr11 5302769 5302790 5302786 5302791 +
attttagaaaggtgtaattact

SEQ ID NO: 97055 - DNA, 22 bp, Artificial Sequence
  Synthetic oligonucleotide; TTT chr11 5302773 5302794 5302790 5302795 +
tagaaaggtgtaattactcagt

SEQ ID NO: 97056 - DNA, 22 bp, Artificial Sequence
  Synthetic oligonucleotide; TTT chr11 5302774 5302795 5302791 5302796 +
agaaaggtgtaattactcagtg

SEQ ID NO: 97057 - DNA, 22 bp, Artificial Sequence
  Synthetic oligonucleotide; TTA chr11 5302775 5302796 5302792 5302797 +
gaaaggtgtaattactcagtgg

SEQ ID NO: 97058 - DNA, 22 bp, Artificial Sequence
  Synthetic oligonucleotide; TTA chr11 5302789 5302810 5302806 5302811 +
ctcagtggacttgggactcagc

SEQ ID NO: 97059 - DNA, 22 bp, Artificial Sequence
  Synthetic oligonucleotide; CTC chr11 5302792 5302813 5302809 5302814 +
agtggacttgggactcagcaag

SEQ ID NO: 97060 - DNA, 22 bp, Artificial Sequence
  Synthetic oligonucleotide; CTT chr11 5302801 5302822 5302818 5302823 +
gggactcagcaagttccctatg

SEQ ID NO: 97061 - DNA, 22 bp, Artificial Sequence
  Synthetic oligonucleotide; TTG chr11 5302802 5302823 5302819 5302824 +
ggactcagcaagttccctatgc

SEQ ID NO: 97062 - DNA, 22 bp, Artificial Sequence
  Synthetic oligonucleotide; CTC chr11 5302808 5302829 5302825 5302830 +
agcaagttccctatgctgcaaa

SEQ ID NO: 97063 - DNA, 22 bp, Artificial Sequence
  Synthetic oligonucleotide; TTC chr11 5302817 5302838 5302834 5302839 +
cctatgctgcaaaaagtctgag

SEQ ID NO: 97064 - DNA, 22 bp, Artificial Sequence
  Synthetic oligonucleotide; CTA chr11 5302821 5302842 5302838 5302843 +
tgctgcaaaaagtctgagtttt

SEQ ID NO: 97065 - DNA, 22 bp, Artificial Sequence
  Synthetic oligonucleotide; CTG chr11 5302826 5302847 5302843 5302848 +
caaaaagtctgagttttggcac

SEQ ID NO: 97066 - DNA, 22 bp, Artificial Sequence
  Synthetic oligonucleotide; CTG chr11 5302837 5302858 5302854 5302859 +
agttttggcacattagggacaa

SEQ ID NO: 97067 - DNA, 22 bp, Artificial Sequence
  Synthetic oligonucleotide; TTT chr11 5302842 5302863 5302859 5302864 +
tggcacattagggacaaacatg

SEQ ID NO: 97068 - DNA, 22 bp, Artificial Sequence
  Synthetic oligonucleotide; TTT chr11 5302843 5302864 5302860 5302865 +
ggcacattagggacaaacatga

SEQ ID NO: 97069 - DNA, 22 bp, Artificial Sequence
  Synthetic oligonucleotide; TTG chr11 5302844 5302865 5302861 5302866 +
gcacattagggacaaacatgaa

SEQ ID NO: 97070 - DNA, 22 bp, Artificial Sequence
  Synthetic oligonucleotide; TTA chr11 5302852 5302873 5302869 5302874 +
gggacaaacatgaaaataggag

SEQ ID NO: 97071 - DNA, 22 bp, Artificial Sequence
  Synthetic oligonucleotide; CTC chr11 5302878 5302899 5302895 5302900 +
atgttggaagctcataacggaa

SEQ ID NO: 97072 - DNA, 22 bp, Artificial Sequence
  Synthetic oligonucleotide; TTG chr11 5302884 5302905 5302901 5302906 +
gaagctcataacggaaatattt

SEQ ID NO: 97073 - DNA, 22 bp, Artificial Sequence
  Synthetic oligonucleotide; CTC chr11 5302891 5302912 5302908 5302913 +
ataacggaaatattttaaggac

SEQ ID NO: 97074 - DNA, 22 bp, Artificial Sequence
  Synthetic oligonucleotide; TTT chr11 5302906 5302927 5302923 5302928 +
taaggacatacttctacaatga

SEQ ID NO: 97075 - DNA, 22 bp, Artificial Sequence
  Synthetic oligonucleotide; TTT chr11 5302907 5302928 5302924 5302929 +
aaggacatacttctacaatgag

SEQ ID NO: 97076 - DNA, 22 bp, Artificial Sequence
  Synthetic oligonucleotide; TTA chr11 5302908 5302929 5302925 5302930 +
aggacatacttctacaatgagg

SEQ ID NO: 97077 - DNA, 22 bp, Artificial Sequence
  Synthetic oligonucleotide; CTT chr11 5302919 5302940 5302936 5302941 +
ctacaatgagggcctccacaaa

SEQ ID NO: 97078 - DNA, 22 bp, Artificial Sequence
  Synthetic oligonucleotide; TTC chr11 5302920 5302941 5302937 5302942 +
tacaatgagggcctccacaaaa

SEQ ID NO: 97079 - DNA, 22 bp, Artificial Sequence
  Synthetic oligonucleotide; CTA chr11 5302922 5302943 5302939 5302944 +
caatgagggcctccacaaaagc

SEQ ID NO: 97080 - DNA, 22 bp, Artificial Sequence
  Synthetic oligonucleotide; CTC chr11 5302935 5302956 5302952 5302957 +
cacaaaagcctaatacttgtta

SEQ ID NO: 97081 - DNA, 22 bp, Artificial Sequence
  Synthetic oligonucleotide; CTA chr11 5302947 5302968 5302964 5302969 +
atacttgttagagtcatagatt

SEQ ID NO: 97082 - DNA, 22 bp, Artificial Sequence
  Synthetic oligonucleotide; CTT chr11 5302953 5302974 5302970 5302975 +
gttagagtcatagattcgtaag

SEQ ID NO: 97083 - DNA, 22 bp, Artificial Sequence
  Synthetic oligonucleotide; TTG chr11 5302954 5302975 5302971 5302976 +
ttagagtcatagattcgtaagt

SEQ ID NO: 97084 - DNA, 22 bp, Artificial Sequence
  Synthetic oligonucleotide; TTA chr11 5302957 5302978 5302974 5302979 +
gagtcatagattcgtaagtatg

SEQ ID NO: 97085 - DNA, 22 bp, Artificial Sequence
  Synthetic oligonucleotide; TTC chr11 5302970 5302991 5302987 5302992 +
gtaagtatgttgatctgaaggg

SEQ ID NO: 97086 - DNA, 22 bp, Artificial Sequence
  Synthetic oligonucleotide; TTG chr11 5302982 5303003 5302999 5303004 +
atctgaagggcaatagtaatat

SEQ ID NO: 97087 - DNA, 22 bp, Artificial Sequence
  Synthetic oligonucleotide; CTG chr11 5302987 5303008 5303004 5303009 +
aagggcaatagtaatatcggaa

SEQ ID NO: 97088 - DNA, 22 bp, Artificial Sequence
  Synthetic oligonucleotide; TTG chr11 5303013 5303034 5303030 5303035 +
gtaattgagttaataaacttca

SEQ ID NO: 97089 - DNA, 22 bp, Artificial Sequence
  Synthetic oligonucleotide; TTG chr11 5303020 5303041 5303037 5303042 +
agttaataaacttcacacaacc

SEQ ID NO: 97090 - DNA, 22 bp, Artificial Sequence
  Synthetic oligonucleotide; TTA chr11 5303025 5303046 5303042 5303047 +
ataaacttcacacaaccagttc

SEQ ID NO: 97091 - DNA, 22 bp, Artificial Sequence
  Synthetic oligonucleotide; CTT chr11 5303033 5303054 5303050 5303055 +
cacacaaccagttctagggaaa

SEQ ID NO: 97092 - DNA, 22 bp, Artificial Sequence
  Synthetic oligonucleotide; TTC chr11 5303034 5303055 5303051 5303056 +
acacaaccagttctagggaaaa

SEQ ID NO: 97093 - DNA, 22 bp, Artificial Sequence
  Synthetic oligonucleotide; TTC chr11 5303047 5303068 5303064 5303069 +
tagggaaaagataagcactccc

SEQ ID NO: 97094 - DNA, 22 bp, Artificial Sequence
  Synthetic oligonucleotide; CTA chr11 5303049 5303070 5303066 5303071 +
gggaaaagataagcactcccag

SEQ ID NO: 97095 - DNA, 22 bp, Artificial Sequence
  Synthetic oligonucleotide; CTC chr11 5303067 5303088 5303084 5303089 +
ccagagagaaaatacggcaact

SEQ ID NO: 97096 - DNA, 22 bp, Artificial Sequence
  Synthetic oligonucleotide; CTA chr11 5303090 5303111 5303107 5303112 +
tgttgctgatggagacaatctt

SEQ ID NO: 97097 - DNA, 22 bp, Artificial Sequence
  Synthetic oligonucleotide; TTG chr11 5303095 5303116 5303112 5303117 +
ctgatggagacaatcttacaga

SEQ ID NO: 97098 - DNA, 22 bp, Artificial Sequence
  Synthetic oligonucleotide; CTG chr11 5303098 5303119 5303115 5303120 +
atggagacaatcttacagaccc

SEQ ID NO: 97099 - DNA, 22 bp, Artificial Sequence
  Synthetic oligonucleotide; CTT chr11 5303112 5303133 5303129 5303134 +
acagaccctctaatcattatga

SEQ ID NO: 97100 - DNA, 22 bp, Artificial Sequence
  Synthetic oligonucleotide; TTA chr11 5303113 5303134 5303130 5303135 +
cagaccctctaatcattatgaa

SEQ ID NO: 97101 - DNA, 22 bp, Artificial Sequence
  Synthetic oligonucleotide; CTC chr11 5303122 5303143 5303139 5303144 +
taatcattatgaatctgtaaga

SEQ ID NO: 97102 - DNA, 22 bp, Artificial Sequence
  Synthetic oligonucleotide; CTA chr11 5303124 5303145 5303141 5303146 +
atcattatgaatctgtaagact

SEQ ID NO: 97103 - DNA, 22 bp, Artificial Sequence
  Synthetic oligonucleotide; TTA chr11 5303131 5303152 5303148 5303153 +
tgaatctgtaagactcgtattg

SEQ ID NO: 97104 - DNA, 22 bp, Artificial Sequence
  Synthetic oligonucleotide; CTG chr11 5303139 5303160 5303156 5303161 +
taagactcgtattgagaaaaat

SEQ ID NO: 97105 - DNA, 22 bp, Artificial Sequence
  Synthetic oligonucleotide; CTC chr11 5303147 5303168 5303164 5303169 +
gtattgagaaaaattcacaagg

SEQ ID NO: 97106 - DNA, 22 bp, Artificial Sequence
  Synthetic oligonucleotide; TTG chr11 5303153 5303174 5303170 5303175 +
agaaaaattcacaaggatcctc

SEQ ID NO: 97107 - DNA, 22 bp, Artificial Sequence
  Synthetic oligonucleotide; TTC chr11 5303163 5303184 5303180 5303185 +
acaaggatcctcatagggaact

SEQ ID NO: 97108 - DNA, 22 bp, Artificial Sequence
  Synthetic oligonucleotide; CTC chr11 5303175 5303196 5303192 5303197 +
atagggaactatgaagtctatt

SEQ ID NO: 97109 - DNA, 22 bp, Artificial Sequence
  Synthetic oligonucleotide; CTA chr11 5303186 5303207 5303203 5303208 +
tgaagtctatttataattaata

SEQ ID NO: 97110 - DNA, 22 bp, Artificial Sequence
  Synthetic oligonucleotide; CTA chr11 5303195 5303216 5303212 5303217 +
tttataattaatatttatttat

SEQ ID NO: 97111 - DNA, 22 bp, Artificial Sequence
  Synthetic oligonucleotide; TTT chr11 5303198 5303219 5303215 5303220 +
ataattaatatttatttatatt

SEQ ID NO: 97112 - DNA, 22 bp, Artificial Sequence
  Synthetic oligonucleotide; TTA chr11 5303199 5303220 5303216 5303221 +
taattaatatttatttatattt

SEQ ID NO: 97113 - DNA, 22 bp, Artificial Sequence
  Synthetic oligonucleotide; TTA chr11 5303205 5303226 5303222 5303227 +
atatttatttatatttataatt

SEQ ID NO: 97114 - DNA, 22 bp, Artificial Sequence
  Synthetic oligonucleotide; TTT chr11 5303211 5303232 5303228 5303233 +
atttatatttataattacactt

SEQ ID NO: 97115 - DNA, 22 bp, Artificial Sequence
  Synthetic oligonucleotide; TTA chr11 5303212 5303233 5303229 5303234 +
tttatatttataattacacttt

SEQ ID NO: 97116 - DNA, 22 bp, Artificial Sequence
  Synthetic oligonucleotide; TTT chr11 5303215 5303236 5303232 5303237 +
atatttataattacacttttac

SEQ ID NO: 97117 - DNA, 22 bp, Artificial Sequence
  Synthetic oligonucleotide; TTA chr11 5303216 5303237 5303233 5303238 +
tatttataattacacttttaca

SEQ ID NO: 97118 - DNA, 22 bp, Artificial Sequence
  Synthetic oligonucleotide; TTT chr11 5303221 5303242 5303238 5303243 +
ataattacacttttacaaagtc

SEQ ID NO: 97119 - DNA, 22 bp, Artificial Sequence
  Synthetic oligonucleotide; TTA chr11 5303222 5303243 5303239 5303244 +
taattacacttttacaaagtca

SEQ ID NO: 97120 - DNA, 22 bp, Artificial Sequence
  Synthetic oligonucleotide; TTA chr11 5303228 5303249 5303245 5303250 +
cacttttacaaagtcaagattt

SEQ ID NO: 97121 - DNA, 22 bp, Artificial Sequence
  Synthetic oligonucleotide; CTT chr11 5303233 5303254 5303250 5303255 +
ttacaaagtcaagatttttgtt

SEQ ID NO: 97122 - DNA, 22 bp, Artificial Sequence
  Synthetic oligonucleotide; TTT chr11 5303234 5303255 5303251 5303256 +
tacaaagtcaagatttttgttg

SEQ ID NO: 97123 - DNA, 22 bp, Artificial Sequence
  Synthetic oligonucleotide; TTT chr11 5303235 5303256 5303252 5303257 +
acaaagtcaagatttttgttgt

SEQ ID NO: 97124 - DNA, 22 bp, Artificial Sequence
  Synthetic oligonucleotide; TTA chr11 5303236 5303257 5303253 5303258 +
caaagtcaagatttttgttgtt

SEQ ID NO: 97125 - DNA, 22 bp, Artificial Sequence
  Synthetic oligonucleotide; TTT chr11 5303250 5303271 5303267 5303272 +
ttgttgttgtgataccaagaaa

SEQ ID NO: 97126 - DNA, 22 bp, Artificial Sequence
  Synthetic oligonucleotide; TTT chr11 5303251 5303272 5303268 5303273 +
tgttgttgtgataccaagaaat

SEQ ID NO: 97127 - DNA, 22 bp, Artificial Sequence
  Synthetic oligonucleotide; TTT chr11 5303252 5303273 5303269 5303274 +
gttgttgtgataccaagaaatt

SEQ ID NO: 97128 - DNA, 22 bp, Artificial Sequence
  Synthetic oligonucleotide; TTG chr11 5303253 5303274 5303270 5303275 +
ttgttgtgataccaagaaattt

SEQ ID NO: 97129 - DNA, 22 bp, Artificial Sequence
  Synthetic oligonucleotide; TTG chr11 5303256 5303277 5303273 5303278 +
ttgtgataccaagaaattttgt

SEQ ID NO: 97130 - DNA, 22 bp, Artificial Sequence
  Synthetic oligonucleotide; TTG chr11 5303259 5303280 5303276 5303281 +
tgataccaagaaattttgtagc

SEQ ID NO: 97131 - DNA, 22 bp, Artificial Sequence
  Synthetic oligonucleotide; TTT chr11 5303275 5303296 5303292 5303297 +
tgtagcaggtttattgggaaaa

SEQ ID NO: 97132 - DNA, 22 bp, Artificial Sequence
  Synthetic oligonucleotide; TTT chr11 5303276 5303297 5303293 5303298 +
gtagcaggtttattgggaaaac

SEQ ID NO: 97133 - DNA, 22 bp, Artificial Sequence
  Synthetic oligonucleotide; TTG chr11 5303277 5303298 5303294 5303299 +
tagcaggtttattgggaaaaca

SEQ ID NO: 97134 - DNA, 22 bp, Artificial Sequence
  Synthetic oligonucleotide; TTT chr11 5303287 5303308 5303304 5303309 +
attgggaaaacaaagagaacta

SEQ ID NO: 97135 - DNA, 22 bp, Artificial Sequence
  Synthetic oligonucleotide; TTA chr11 5303288 5303309 5303305 5303310 +
ttgggaaaacaaagagaactac

SEQ ID NO: 97136 - DNA, 22 bp, Artificial Sequence
  Synthetic oligonucleotide; TTG chr11 5303291 5303312 5303308 5303313 +
ggaaaacaaagagaactacaag

SEQ ID NO: 97137 - DNA, 22 bp, Artificial Sequence
  Synthetic oligonucleotide; CTA chr11 5303309 5303330 5303326 5303331 +
caagggaaactcagtttctccc

SEQ ID NO: 97138 - DNA, 22 bp, Artificial Sequence
  Synthetic oligonucleotide; CTC chr11 5303321 5303342 5303338 5303343 +
agtttctcccaaattcaattga

SEQ ID NO: 97139 - DNA, 22 bp, Artificial Sequence
  Synthetic oligonucleotide; TTT chr11 5303326 5303347 5303343 5303348 +
ctcccaaattcaattgattctg

SEQ ID NO: 97140 - DNA, 22 bp, Artificial Sequence
  Synthetic oligonucleotide; TTC chr11 5303327 5303348 5303344 5303349 +
tcccaaattcaattgattctgt

SEQ ID NO: 97141 - DNA, 22 bp, Artificial Sequence
  Synthetic oligonucleotide; CTC chr11 5303329 5303350 5303346 5303351 +
ccaaattcaattgattctgtat

SEQ ID NO: 97142 - DNA, 22 bp, Artificial Sequence
  Synthetic oligonucleotide; TTC chr11 5303337 5303358 5303354 5303359 +
aattgattctgtatgtgtccag

SEQ ID NO: 97143 - DNA, 22 bp, Artificial Sequence
  Synthetic oligonucleotide; TTG chr11 5303342 5303363 5303359 5303364 +
attctgtatgtgtccagagtct

SEQ ID NO: 97144 - DNA, 22 bp, Artificial Sequence
  Synthetic oligonucleotide; TTC chr11 5303346 5303367 5303363 5303368 +
tgtatgtgtccagagtctttta

SEQ ID NO: 97145 - DNA, 22 bp, Artificial Sequence
  Synthetic oligonucleotide; CTG chr11 5303348 5303369 5303365 5303370 +
tatgtgtccagagtcttttaaa

SEQ ID NO: 97146 - DNA, 22 bp, Artificial Sequence
  Synthetic oligonucleotide; CTT chr11 5303365 5303386 5303382 5303387 +
ttaaaatatcattcaatattat

SEQ ID NO: 97147 - DNA, 22 bp, Artificial Sequence
  Synthetic oligonucleotide; TTT chr11 5303366 5303387 5303383 5303388 +
taaaatatcattcaatattata

SEQ ID NO: 97148 - DNA, 22 bp, Artificial Sequence
  Synthetic oligonucleotide; TTT chr11 5303367 5303388 5303384 5303389 +
aaaatatcattcaatattataa

SEQ ID NO: 97149 - DNA, 22 bp, Artificial Sequence
  Synthetic oligonucleotide; TTA chr11 5303368 5303389 5303385 5303390 +
aaatatcattcaatattataaa

SEQ ID NO: 97150 - DNA, 22 bp, Artificial Sequence
  Synthetic oligonucleotide; TTC chr11 5303379 5303400 5303396 5303401 +
aatattataaatattactaccg

SEQ ID NO: 97151 - DNA, 22 bp, Artificial Sequence
  Synthetic oligonucleotide; TTA chr11 5303386 5303407 5303403 5303408 +
taaatattactaccgacacctt

SEQ ID NO: 97152 - DNA, 22 bp, Artificial Sequence
  Synthetic oligonucleotide; TTA chr11 5303395 5303416 5303412 5303417 +
ctaccgacacctttgaagtgta

SEQ ID NO: 97153 - DNA, 22 bp, Artificial Sequence
  Synthetic oligonucleotide; CTA chr11 5303398 5303419 5303415 5303420 +
ccgacacctttgaagtgtaatt

SEQ ID NO: 97154 - DNA, 22 bp, Artificial Sequence
  Synthetic oligonucleotide; CTT chr11 5303408 5303429 5303425 5303430 +
tgaagtgtaattcagtaaaaat

SEQ ID NO: 97155 - DNA, 22 bp, Artificial Sequence
  Synthetic oligonucleotide; TTT chr11 5303409 5303430 5303426 5303431 +
gaagtgtaattcagtaaaaatg

SEQ ID NO: 97156 - DNA, 22 bp, Artificial Sequence
  Synthetic oligonucleotide; TTG chr11 5303410 5303431 5303427 5303432 +
aagtgtaattcagtaaaaatga

SEQ ID NO: 97157 - DNA, 22 bp, Artificial Sequence
  Synthetic oligonucleotide; TTC chr11 5303421 5303442 5303438 5303443 +
agtaaaaatgaagtgataacaa

SEQ ID NO: 97158 - DNA, 22 bp, Artificial Sequence
  Synthetic oligonucleotide; CTT chr11 5303447 5303468 5303464 5303469 +
tgcaccttttttattttataaa

SEQ ID NO: 97159 - DNA, 22 bp, Artificial Sequence
  Synthetic oligonucleotide; TTT chr11 5303448 5303469 5303465 5303470 +
gcaccttttttattttataaaa

SEQ ID NO: 97160 - DNA, 22 bp, Artificial Sequence
  Synthetic oligonucleotide; TTG chr11 5303449 5303470 5303466 5303471 +
caccttttttattttataaaaa

SEQ ID NO: 97161 - DNA, 22 bp, Artificial Sequence
  Synthetic oligonucleotide; CTT chr11 5303455 5303476 5303472 5303477 +
ttttattttataaaaacctata

SEQ ID NO: 97162 - DNA, 22 bp, Artificial Sequence
  Synthetic oligonucleotide; TTT chr11 5303456 5303477 5303473 5303478 +
tttattttataaaaacctatag

SEQ ID NO: 97163 - DNA, 22 bp, Artificial Sequence
  Synthetic oligonucleotide; TTT chr11 5303457 5303478 5303474 5303479 +
ttattttataaaaacctataga

SEQ ID NO: 97164 - DNA, 22 bp, Artificial Sequence
  Synthetic oligonucleotide; TTT chr11 5303458 5303479 5303475 5303480 +
tattttataaaaacctatagaa

SEQ ID NO: 97165 - DNA, 22 bp, Artificial Sequence
  Synthetic oligonucleotide; TTT chr11 5303459 5303480 5303476 5303481 +
attttataaaaacctatagaaa

SEQ ID NO: 97166 - DNA, 22 bp, Artificial Sequence
  Synthetic oligonucleotide; TTA chr11 5303460 5303481 5303477 5303482 +
ttttataaaaacctatagaaac

SEQ ID NO: 97167 - DNA, 22 bp, Artificial Sequence
  Synthetic oligonucleotide; TTT chr11 5303463 5303484 5303480 5303485 +
tataaaaacctatagaaacaat

SEQ ID NO: 97168 - DNA, 22 bp, Artificial Sequence
  Synthetic oligonucleotide; TTT chr11 5303464 5303485 5303481 5303486 +
ataaaaacctatagaaacaata

SEQ ID NO: 97169 - DNA, 22 bp, Artificial Sequence
  Synthetic oligonucleotide; TTA chr11 5303465 5303486 5303482 5303487 +
taaaaacctatagaaacaataa

SEQ ID NO: 97170 - DNA, 22 bp, Artificial Sequence
  Synthetic oligonucleotide; CTA chr11 5303475 5303496 5303492 5303497 +
tagaaacaataataattatatg

SEQ ID NO: 97171 - DNA, 22 bp, Artificial Sequence
  Synthetic oligonucleotide; TTA chr11 5303493 5303514 5303510 5303515 +
tatgtttcagaattttggcaca

SEQ ID NO: 97172 - DNA, 22 bp, Artificial Sequence
  Synthetic oligonucleotide; TTT chr11 5303500 5303521 5303517 5303522 +
cagaattttggcacatagtaac

SEQ ID NO: 97173 - DNA, 22 bp, Artificial Sequence
  Synthetic oligonucleotide; TTC chr11 5303501 5303522 5303518 5303523 +
agaattttggcacatagtaaca

SEQ ID NO: 97174 - DNA, 22 bp, Artificial Sequence
  Synthetic oligonucleotide; TTT chr11 5303508 5303529 5303525 5303530 +
tggcacatagtaacatctctaa

SEQ ID NO: 97175 - DNA, 22 bp, Artificial Sequence
  Synthetic oligonucleotide; TTT chr11 5303509 5303530 5303526 5303531 +
ggcacatagtaacatctctaat

SEQ ID NO: 97176 - DNA, 22 bp, Artificial Sequence
  Synthetic oligonucleotide; TTG chr11 5303510 5303531 5303527 5303532 +
gcacatagtaacatctctaata

SEQ ID NO: 97177 - DNA, 22 bp, Artificial Sequence
  Synthetic oligonucleotide; CTC chr11 5303527 5303548 5303544 5303549 +
taatataagcaattattggtgg

SEQ ID NO: 97178 - DNA, 22 bp, Artificial Sequence
  Synthetic oligonucleotide; CTA chr11 5303529 5303550 5303546 5303551 +
atataagcaattattggtggag

SEQ ID NO: 97179 - DNA, 22 bp, Artificial Sequence
  Synthetic oligonucleotide; TTA chr11 5303542 5303563 5303559 5303564 +
ttggtggagagagatggacaga

SEQ ID NO: 97180 - DNA, 22 bp, Artificial Sequence
  Synthetic oligonucleotide; TTG chr11 5303545 5303566 5303562 5303567 +
gtggagagagatggacagagga

SEQ ID NO: 97181 - DNA, 22 bp, Artificial Sequence
  Synthetic oligonucleotide; CTT chr11 5303582 5303603 5303599 5303604 +
ttgaaagggctgctacttcagg

SEQ ID NO: 97182 - DNA, 22 bp, Artificial Sequence
  Synthetic oligonucleotide; TTT chr11 5303583 5303604 5303600 5303605 +
tgaaagggctgctacttcaggg

SEQ ID NO: 97183 - DNA, 22 bp, Artificial Sequence
  Synthetic oligonucleotide; TTT chr11 5303584 5303605 5303601 5303606 +
gaaagggctgctacttcagggg

SEQ ID NO: 97184 - DNA, 22 bp, Artificial Sequence
  Synthetic oligonucleotide; TTG chr11 5303585 5303606 5303602 5303607 +
aaagggctgctacttcagggga

SEQ ID NO: 97185 - DNA, 22 bp, Artificial Sequence
  Synthetic oligonucleotide; CTG chr11 5303594 5303615 5303611 5303616 +
ctacttcaggggacactgttga

SEQ ID NO: 97186 - DNA, 22 bp, Artificial Sequence
  Synthetic oligonucleotide; CTA chr11 5303597 5303618 5303614 5303619 +
cttcaggggacactgttgataa

SEQ ID NO: 97187 - DNA, 22 bp, Artificial Sequence
  Synthetic oligonucleotide; CTT chr11 5303600 5303621 5303617 5303622 +
caggggacactgttgataacaa

SEQ ID NO: 97188 - DNA, 22 bp, Artificial Sequence
  Synthetic oligonucleotide; TTC chr11 5303601 5303622 5303618 5303623 +
aggggacactgttgataacaaa

SEQ ID NO: 97189 - DNA, 22 bp, Artificial Sequence
  Synthetic oligonucleotide; CTG chr11 5303612 5303633 5303629 5303634 +
ttgataacaaaaatgtcagtct

SEQ ID NO: 97190 - DNA, 22 bp, Artificial Sequence
  Synthetic oligonucleotide; TTG chr11 5303615 5303636 5303632 5303637 +
ataacaaaaatgtcagtctagg

SEQ ID NO: 97191 - DNA, 22 bp, Artificial Sequence
  Synthetic oligonucleotide; CTA chr11 5303635 5303656 5303652 5303657 +
ggcactgcagtagcagagacta

SEQ ID NO: 97192 - DNA, 22 bp, Artificial Sequence
  Synthetic oligonucleotide; CTG chr11 5303642 5303663 5303659 5303664 +
cagtagcagagactatgttcat

SEQ ID NO: 97193 - DNA, 22 bp, Artificial Sequence
  Synthetic oligonucleotide; CTA chr11 5303657 5303678 5303674 5303679 +
tgttcatatggatactaaaaac

SEQ ID NO: 97194 - DNA, 22 bp, Artificial Sequence
  Synthetic oligonucleotide; TTC chr11 5303662 5303683 5303679 5303684 +
atatggatactaaaaacactgc

SEQ ID NO: 97195 - DNA, 22 bp, Artificial Sequence
  Synthetic oligonucleotide; CTA chr11 5303674 5303695 5303691 5303696 +
aaaacactgctaactaacttga

SEQ ID NO: 97196 - DNA, 22 bp, Artificial Sequence
  Synthetic oligonucleotide; CTG chr11 5303683 5303704 5303700 5303705 +
ctaactaacttgatccactgaa

SEQ ID NO: 97197 - DNA, 22 bp, Artificial Sequence
  Synthetic oligonucleotide; CTA chr11 5303686 5303707 5303703 5303708 +
actaacttgatccactgaatta

SEQ ID NO: 97198 - DNA, 22 bp, Artificial Sequence
  Synthetic oligonucleotide; CTA chr11 5303690 5303711 5303707 5303712 +
acttgatccactgaattatgac

SEQ ID NO: 97199 - DNA, 22 bp, Artificial Sequence
  Synthetic oligonucleotide; CTT chr11 5303694 5303715 5303711 5303716 +
gatccactgaattatgacctgc

SEQ ID NO: 97200 - DNA, 22 bp, Artificial Sequence
  Synthetic oligonucleotide; TTG chr11 5303695 5303716 5303712 5303717 +
atccactgaattatgacctgca

SEQ ID NO: 97201 - DNA, 22 bp, Artificial Sequence
  Synthetic oligonucleotide; CTG chr11 5303703 5303724 5303720 5303725 +
aattatgacctgcatagtgctt

SEQ ID NO: 97202 - DNA, 22 bp, Artificial Sequence
  Synthetic oligonucleotide; TTA chr11 5303708 5303729 5303725 5303730 +
tgacctgcatagtgcttaatgt

SEQ ID NO: 97203 - DNA, 22 bp, Artificial Sequence
  Synthetic oligonucleotide; CTG chr11 5303715 5303736 5303732 5303737 +
catagtgcttaatgtggcagaa

SEQ ID NO: 97204 - DNA, 22 bp, Artificial Sequence
  Synthetic oligonucleotide; CTT chr11 5303725 5303746 5303742 5303747 +
aatgtggcagaacttatctacc

SEQ ID NO: 97205 - DNA, 22 bp, Artificial Sequence
  Synthetic oligonucleotide; TTA chr11 5303726 5303747 5303743 5303748 +
atgtggcagaacttatctaccg

SEQ ID NO: 97206 - DNA, 22 bp, Artificial Sequence
  Synthetic oligonucleotide; CTT chr11 5303740 5303761 5303757 5303762 +
atctaccgccacaggagtgatg

SEQ ID NO: 97207 - DNA, 22 bp, Artificial Sequence
  Synthetic oligonucleotide; TTA chr11 5303741 5303762 5303758 5303763 +
tctaccgccacaggagtgatgt

SEQ ID NO: 97208 - DNA, 22 bp, Artificial Sequence
  Synthetic oligonucleotide; CTA chr11 5303745 5303766 5303762 5303767 +
ccgccacaggagtgatgtgtat

SEQ ID NO: 97209 - DNA, 22 bp, Artificial Sequence
  Synthetic oligonucleotide; TTA chr11 5303774 5303795 5303791 5303796 +
taagttctcttaaccttccaat

SEQ ID NO: 97210 - DNA, 22 bp, Artificial Sequence
  Synthetic oligonucleotide; TTC chr11 5303781 5303802 5303798 5303803 +
tcttaaccttccaatgttgcct

SEQ ID NO: 97211 - DNA, 22 bp, Artificial Sequence
  Synthetic oligonucleotide; CTC chr11 5303783 5303804 5303800 5303805 +
ttaaccttccaatgttgcctta

SEQ ID NO: 97212 - DNA, 22 bp, Artificial Sequence
  Synthetic oligonucleotide; CTT chr11 5303785 5303806 5303802 5303807 +
aaccttccaatgttgccttata

SEQ ID NO: 97213 - DNA, 22 bp, Artificial Sequence
  Synthetic oligonucleotide; TTA chr11 5303786 5303807 5303803 5303808 +
accttccaatgttgccttataa

SEQ ID NO: 97214 - DNA, 22 bp, Artificial Sequence
  Synthetic oligonucleotide; CTT chr11 5303791 5303812 5303808 5303813 +
ccaatgttgccttataagagaa

SEQ ID NO: 97215 - DNA, 22 bp, Artificial Sequence
  Synthetic oligonucleotide; TTC chr11 5303792 5303813 5303809 5303814 +
caatgttgccttataagagaat

SEQ ID NO: 97216 - DNA, 22 bp, Artificial Sequence
  Synthetic oligonucleotide; TTG chr11 5303800 5303821 5303817 5303822 +
ccttataagagaatggattaat

SEQ ID NO: 97217 - DNA, 22 bp, Artificial Sequence
  Synthetic oligonucleotide; CTT chr11 5303804 5303825 5303821 5303826 +
ataagagaatggattaatgcca

SEQ ID NO: 97218 - DNA, 22 bp, Artificial Sequence
  Synthetic oligonucleotide; TTA chr11 5303805 5303826 5303822 5303827 +
taagagaatggattaatgccaa

SEQ ID NO: 97219 - DNA, 22 bp, Artificial Sequence
  Synthetic oligonucleotide; TTA chr11 5303820 5303841 5303837 5303842 +
atgccaaaatttgttgtacagg

SEQ ID NO: 97220 - DNA, 22 bp, Artificial Sequence
  Synthetic oligonucleotide; TTT chr11 5303832 5303853 5303849 5303854 +
gttgtacaggataagagctaac

SEQ ID NO: 97221 - DNA, 22 bp, Artificial Sequence
  Synthetic oligonucleotide; TTG chr11 5303833 5303854 5303850 5303855 +
ttgtacaggataagagctaacc

SEQ ID NO: 97222 - DNA, 22 bp, Artificial Sequence
  Synthetic oligonucleotide; TTG chr11 5303836 5303857 5303853 5303858 +
tacaggataagagctaaccact

SEQ ID NO: 97223 - DNA, 22 bp, Artificial Sequence
  Synthetic oligonucleotide; CTA chr11 5303852 5303873 5303869 5303874 +
accacttatttggatctactgt

SEQ ID NO: 97224 - DNA, 22 bp, Artificial Sequence
  Synthetic oligonucleotide; CTT chr11 5303859 5303880 5303876 5303881 +
atttggatctactgtcacccag

SEQ ID NO: 97225 - DNA, 22 bp, Artificial Sequence
  Synthetic oligonucleotide; TTA chr11 5303860 5303881 5303877 5303882 +
tttggatctactgtcacccaga

SEQ ID NO: 97226 - DNA, 22 bp, Artificial Sequence
  Synthetic oligonucleotide; TTT chr11 5303863 5303884 5303880 5303885 +
ggatctactgtcacccagataa

SEQ ID NO: 97227 - DNA, 22 bp, Artificial Sequence
  Synthetic oligonucleotide; TTG chr11 5303864 5303885 5303881 5303886 +
gatctactgtcacccagataat

SEQ ID NO: 97228 - DNA, 22 bp, Artificial Sequence
  Synthetic oligonucleotide; CTA chr11 5303870 5303891 5303887 5303892 +
ctgtcacccagataatggacca

SEQ ID NO: 97229 - DNA, 22 bp, Artificial Sequence
  Synthetic oligonucleotide; CTG chr11 5303873 5303894 5303890 5303895 +
tcacccagataatggaccagat

SEQ ID NO: 97230 - DNA, 22 bp, Artificial Sequence
  Synthetic oligonucleotide; CTG chr11 5303917 5303938 5303934 5303939 +
attattcttaaactatagtcgt

SEQ ID NO: 97231 - DNA, 22 bp, Artificial Sequence
  Synthetic oligonucleotide; TTA chr11 5303921 5303942 5303938 5303943 +
ttcttaaactatagtcgtgttt

SEQ ID NO: 97232 - DNA, 22 bp, Artificial Sequence
  Synthetic oligonucleotide; TTC chr11 5303924 5303945 5303941 5303946 +
ttaaactatagtcgtgttttca

SEQ ID NO: 97233 - DNA, 22 bp, Artificial Sequence
  Synthetic oligonucleotide; CTT chr11 5303926 5303947 5303943 5303948 +
aaactatagtcgtgttttcaaa

SEQ ID NO: 97234 - DNA, 22 bp, Artificial Sequence
  Synthetic oligonucleotide; TTA chr11 5303927 5303948 5303944 5303949 +
aactatagtcgtgttttcaaaa

SEQ ID NO: 97235 - DNA, 22 bp, Artificial Sequence
  Synthetic oligonucleotide; CTA chr11 5303932 5303953 5303949 5303954 +
tagtcgtgttttcaaaacctga

SEQ ID NO: 97236 - DNA, 22 bp, Artificial Sequence
  Synthetic oligonucleotide; TTT chr11 5303943 5303964 5303960 5303965 +
tcaaaacctgagctgcgtttgg

SEQ ID NO: 97237 - DNA, 22 bp, Artificial Sequence
  Synthetic oligonucleotide; TTT chr11 5303944 5303965 5303961 5303966 +
caaaacctgagctgcgtttggg

SEQ ID NO: 97238 - DNA, 22 bp, Artificial Sequence
  Synthetic oligonucleotide; TTC chr11 5303945 5303966 5303962 5303967 +
aaaacctgagctgcgtttggga

SEQ ID NO: 97239 - DNA, 22 bp, Artificial Sequence
  Synthetic oligonucleotide; CTG chr11 5303953 5303974 5303970 5303975 +
agctgcgtttgggacatgcgga

SEQ ID NO: 97240 - DNA, 22 bp, Artificial Sequence
  Synthetic oligonucleotide; CTG chr11 5303958 5303979 5303975 5303980 +
cgtttgggacatgcggatgcac

SEQ ID NO: 97241 - DNA, 22 bp, Artificial Sequence
  Synthetic oligonucleotide; TTT chr11 5303963 5303984 5303980 5303985 +
gggacatgcggatgcacagggt

SEQ ID NO: 97242 - DNA, 22 bp, Artificial Sequence
  Synthetic oligonucleotide; TTG chr11 5303964 5303985 5303981 5303986 +
ggacatgcggatgcacagggtt

SEQ ID NO: 97243 - DNA, 22 bp, Artificial Sequence
  Synthetic oligonucleotide; TTT chr11 5303987 5304008 5304004 5304009 +
tattaaaactgtgtggtaatta

SEQ ID NO: 97244 - DNA, 22 bp, Artificial Sequence
  Synthetic oligonucleotide; TTT chr11 5303988 5304009 5304005 5304010 +
attaaaactgtgtggtaattac

SEQ ID NO: 97245 - DNA, 22 bp, Artificial Sequence
  Synthetic oligonucleotide; TTA chr11 5303989 5304010 5304006 5304011 +
ttaaaactgtgtggtaattact

SEQ ID NO: 97246 - DNA, 22 bp, Artificial Sequence
  Synthetic oligonucleotide; TTA chr11 5303992 5304013 5304009 5304014 +
aaactgtgtggtaattactggg

SEQ ID NO: 97247 - DNA, 22 bp, Artificial Sequence
  Synthetic oligonucleotide; CTG chr11 5303998 5304019 5304015 5304020 +
tgtggtaattactggggaaata

SEQ ID NO: 97248 - DNA, 22 bp, Artificial Sequence
  Synthetic oligonucleotide; TTA chr11 5304009 5304030 5304026 5304031 +
ctggggaaatagttaatacaat

SEQ ID NO: 97249 - DNA, 22 bp, Artificial Sequence
  Synthetic oligonucleotide; CTG chr11 5304012 5304033 5304029 5304034 +
gggaaatagttaatacaattta

SEQ ID NO: 97250 - DNA, 22 bp, Artificial Sequence
  Synthetic oligonucleotide; TTA chr11 5304024 5304045 5304041 5304046 +
atacaatttataagtatatttt

SEQ ID NO: 97251 - DNA, 22 bp, Artificial Sequence
  Synthetic oligonucleotide; TTT chr11 5304033 5304054 5304050 5304055 +
ataagtatattttattgaccta

SEQ ID NO: 97252 - DNA, 22 bp, Artificial Sequence
  Synthetic oligonucleotide; TTA chr11 5304034 5304055 5304051 5304056 +
taagtatattttattgacctaa

SEQ ID NO: 97253 - DNA, 22 bp, Artificial Sequence
  Synthetic oligonucleotide; TTT chr11 5304045 5304066 5304062 5304067 +
tattgacctaaagatagccctc

SEQ ID NO: 97254 - DNA, 22 bp, Artificial Sequence
  Synthetic oligonucleotide; TTT chr11 5304046 5304067 5304063 5304068 +
attgacctaaagatagccctct

SEQ ID NO: 97255 - DNA, 22 bp, Artificial Sequence
  Synthetic oligonucleotide; TTA chr11 5304047 5304068 5304064 5304069 +
ttgacctaaagatagccctcta

SEQ ID NO: 97256 - DNA, 22 bp, Artificial Sequence
  Synthetic oligonucleotide; TTG chr11 5304050 5304071 5304067 5304072 +
acctaaagatagccctctattt

SEQ ID NO: 97257 - DNA, 22 bp, Artificial Sequence
  Synthetic oligonucleotide; CTA chr11 5304055 5304076 5304072 5304077 +
aagatagccctctatttaacat

SEQ ID NO: 97258 - DNA, 22 bp, Artificial Sequence
  Synthetic oligonucleotide; CTC chr11 5304067 5304088 5304084 5304089 +
tatttaacatctgcagtctcta

SEQ ID NO: 97259 - DNA, 22 bp, Artificial Sequence
  Synthetic oligonucleotide; CTA chr11 5304069 5304090 5304086 5304091 +
tttaacatctgcagtctctagc

SEQ ID NO: 97260 - DNA, 22 bp, Artificial Sequence
  Synthetic oligonucleotide; TTT chr11 5304072 5304093 5304089 5304094 +
aacatctgcagtctctagcaaa

SEQ ID NO: 97261 - DNA, 22 bp, Artificial Sequence
  Synthetic oligonucleotide; TTA chr11 5304073 5304094 5304090 5304095 +
acatctgcagtctctagcaaaa

SEQ ID NO: 97262 - DNA, 22 bp, Artificial Sequence
  Synthetic oligonucleotide; CTG chr11 5304080 5304101 5304097 5304102 +
cagtctctagcaaaacagctac

SEQ ID NO: 97263 - DNA, 22 bp, Artificial Sequence
  Synthetic oligonucleotide; CTC chr11 5304087 5304108 5304104 5304109 +
tagcaaaacagctacgctggca

SEQ ID NO: 97264 - DNA, 22 bp, Artificial Sequence
  Synthetic oligonucleotide; CTA chr11 5304089 5304110 5304106 5304111 +
gcaaaacagctacgctggcatt

SEQ ID NO: 97265 - DNA, 22 bp, Artificial Sequence
  Synthetic oligonucleotide; CTA chr11 5304101 5304122 5304118 5304123 +
cgctggcatttaattgtggcaa

SEQ ID NO: 97266 - DNA, 22 bp, Artificial Sequence
  Synthetic oligonucleotide; CTG chr11 5304106 5304127 5304123 5304128 +
gcatttaattgtggcaaatttg

SEQ ID NO: 97267 - DNA, 22 bp, Artificial Sequence
  Synthetic oligonucleotide; TTT chr11 5304112 5304133 5304129 5304134 +
aattgtggcaaatttggtagta

SEQ ID NO: 97268 - DNA, 22 bp, Artificial Sequence
  Synthetic oligonucleotide; TTA chr11 5304113 5304134 5304130 5304135 +
attgtggcaaatttggtagtac

SEQ ID NO: 97269 - DNA, 22 bp, Artificial Sequence
  Synthetic oligonucleotide; TTG chr11 5304117 5304138 5304134 5304139 +
tggcaaatttggtagtaccaga

SEQ ID NO: 97270 - DNA, 22 bp, Artificial Sequence
  Synthetic oligonucleotide; TTT chr11 5304127 5304148 5304144 5304149 +
ggtagtaccagaaactgtccac

SEQ ID NO: 97271 - DNA, 22 bp, Artificial Sequence
  Synthetic oligonucleotide; TTG chr11 5304128 5304149 5304145 5304150 +
gtagtaccagaaactgtccaca

SEQ ID NO: 97272 - DNA, 22 bp, Artificial Sequence
  Synthetic oligonucleotide; CTG chr11 5304144 5304165 5304161 5304166 +
tccacatacccaaatattccag

SEQ ID NO: 97273 - DNA, 22 bp, Artificial Sequence
  Synthetic oligonucleotide; TTC chr11 5304163 5304184 5304180 5304185 +
cagggagaatagttgccctaat

SEQ ID NO: 97274 - DNA, 22 bp, Artificial Sequence
  Synthetic oligonucleotide; TTG chr11 5304178 5304199 5304195 5304200 +
ccctaatagtttagggagtctc

SEQ ID NO: 97275 - DNA, 22 bp, Artificial Sequence
  Synthetic oligonucleotide; CTA chr11 5304183 5304204 5304200 5304205 +
atagtttagggagtctcctaga

SEQ ID NO: 97276 - DNA, 22 bp, Artificial Sequence
  Synthetic oligonucleotide; TTT chr11 5304190 5304211 5304207 5304212 +
agggagtctcctagaatgtgat

SEQ ID NO: 97277 - DNA, 22 bp, Artificial Sequence
  Synthetic oligonucleotide; TTA chr11 5304191 5304212 5304208 5304213 +
gggagtctcctagaatgtgata

SEQ ID NO: 97278 - DNA, 22 bp, Artificial Sequence
  Synthetic oligonucleotide; CTC chr11 5304200 5304221 5304217 5304222 +
ctagaatgtgatacatgacaaa

SEQ ID NO: 97279 - DNA, 22 bp, Artificial Sequence
  Synthetic oligonucleotide; CTA chr11 5304203 5304224 5304220 5304225 +
gaatgtgatacatgacaaaagt

SEQ ID NO: 97280 - DNA, 22 bp, Artificial Sequence
  Synthetic oligonucleotide; CTT chr11 5304239 5304260 5304256 5304261 +
tagtggaatttatcactctcag

SEQ ID NO: 97281 - DNA, 22 bp, Artificial Sequence
  Synthetic oligonucleotide; TTT chr11 5304240 5304261 5304257 5304262 +
agtggaatttatcactctcagg

SEQ ID NO: 97282 - DNA, 22 bp, Artificial Sequence
  Synthetic oligonucleotide; TTA chr11 5304241 5304262 5304258 5304263 +
gtggaatttatcactctcaggc

SEQ ID NO: 97283 - DNA, 22 bp, Artificial Sequence
  Synthetic oligonucleotide; TTT chr11 5304250 5304271 5304267 5304272 +
atcactctcaggcaagcataga

SEQ ID NO: 97284 - DNA, 22 bp, Artificial Sequence
  Synthetic oligonucleotide; TTA chr11 5304251 5304272 5304268 5304273 +
tcactctcaggcaagcatagag

SEQ ID NO: 97285 - DNA, 22 bp, Artificial Sequence
  Synthetic oligonucleotide; CTC chr11 5304257 5304278 5304274 5304279 +
tcaggcaagcatagaggccccc

SEQ ID NO: 97286 - DNA, 22 bp, Artificial Sequence
  Synthetic oligonucleotide; CTC chr11 5304259 5304280 5304276 5304281 +
aggcaagcatagaggccccctg

SEQ ID NO: 97287 - DNA, 22 bp, Artificial Sequence
  Synthetic oligonucleotide; CTG chr11 5304281 5304302 5304298 5304303 +
agggatgcaaaaatgactggct

SEQ ID NO: 97288 - DNA, 22 bp, Artificial Sequence
  Synthetic oligonucleotide; CTG chr11 5304300 5304321 5304317 5304322 +
gctcactgttctcttgcccctt

SEQ ID NO: 97289 - DNA, 22 bp, Artificial Sequence
  Synthetic oligonucleotide; CTC chr11 5304304 5304325 5304321 5304326 +
actgttctcttgcccctttctg

SEQ ID NO: 97290 - DNA, 22 bp, Artificial Sequence
  Synthetic oligonucleotide; CTG chr11 5304308 5304329 5304325 5304330 +
ttctcttgcccctttctgagtg

SEQ ID NO: 97291 - DNA, 22 bp, Artificial Sequence
  Synthetic oligonucleotide; TTC chr11 5304311 5304332 5304328 5304333 +
tcttgcccctttctgagtgcct

SEQ ID NO: 97292 - DNA, 22 bp, Artificial Sequence
  Synthetic oligonucleotide; CTC chr11 5304313 5304334 5304330 5304335 +
ttgcccctttctgagtgccttt

SEQ ID NO: 97293 - DNA, 22 bp, Artificial Sequence
  Synthetic oligonucleotide; CTT chr11 5304315 5304336 5304332 5304337 +
gcccctttctgagtgcctttgg

SEQ ID NO: 97294 - DNA, 22 bp, Artificial Sequence
  Synthetic oligonucleotide; TTG chr11 5304316 5304337 5304333 5304338 +
cccctttctgagtgcctttgga

SEQ ID NO: 97295 - DNA, 22 bp, Artificial Sequence
  Synthetic oligonucleotide; CTT chr11 5304322 5304343 5304339 5304344 +
tctgagtgcctttggactgatt

SEQ ID NO: 97296 - DNA, 22 bp, Artificial Sequence
  Synthetic oligonucleotide; TTT chr11 5304323 5304344 5304340 5304345 +
ctgagtgcctttggactgattc

SEQ ID NO: 97297 - DNA, 22 bp, Artificial Sequence
  Synthetic oligonucleotide; TTC chr11 5304324 5304345 5304341 5304346 +
tgagtgcctttggactgattct

SEQ ID NO: 97298 - DNA, 22 bp, Artificial Sequence
  Synthetic oligonucleotide; CTG chr11 5304326 5304347 5304343 5304348 +
agtgcctttggactgattcttt

SEQ ID NO: 97299 - DNA, 22 bp, Artificial Sequence
  Synthetic oligonucleotide; CTT chr11 5304334 5304355 5304351 5304356 +
tggactgattctttgacagcaa

SEQ ID NO: 97300 - DNA, 22 bp, Artificial Sequence
  Synthetic oligonucleotide; TTT chr11 5304335 5304356 5304352 5304357 +
ggactgattctttgacagcaac

SEQ ID NO: 97301 - DNA, 22 bp, Artificial Sequence
  Synthetic oligonucleotide; TTG chr11 5304336 5304357 5304353 5304358 +
gactgattctttgacagcaact

SEQ ID NO: 97302 - DNA, 22 bp, Artificial Sequence
  Synthetic oligonucleotide; CTG chr11 5304341 5304362 5304358 5304363 +
attctttgacagcaactatccc

SEQ ID NO: 97303 - DNA, 22 bp, Artificial Sequence
  Synthetic oligonucleotide; TTC chr11 5304345 5304366 5304362 5304367 +
tttgacagcaactatcccagag

SEQ ID NO: 97304 - DNA, 22 bp, Artificial Sequence
  Synthetic oligonucleotide; CTT chr11 5304347 5304368 5304364 5304369 +
tgacagcaactatcccagagtc

SEQ ID NO: 97305 - DNA, 22 bp, Artificial Sequence
  Synthetic oligonucleotide; TTT chr11 5304348 5304369 5304365 5304370 +
gacagcaactatcccagagtcc

SEQ ID NO: 97306 - DNA, 22 bp, Artificial Sequence
  Synthetic oligonucleotide; TTG chr11 5304349 5304370 5304366 5304371 +
acagcaactatcccagagtcct

SEQ ID NO: 97307 - DNA, 22 bp, Artificial Sequence
  Synthetic oligonucleotide; CTA chr11 5304359 5304380 5304376 5304381 +
tcccagagtcctcaagagtttc

SEQ ID NO: 97308 - DNA, 22 bp, Artificial Sequence
  Synthetic oligonucleotide; CTC chr11 5304372 5304393 5304389 5304394 +
aagagtttctgaaggtaacata

SEQ ID NO: 97309 - DNA, 22 bp, Artificial Sequence
  Synthetic oligonucleotide; TTT chr11 5304380 5304401 5304397 5304402 +
ctgaaggtaacatagatccatc

SEQ ID NO: 97310 - DNA, 22 bp, Artificial Sequence
  Synthetic oligonucleotide; TTC chr11 5304381 5304402 5304398 5304403 +
tgaaggtaacatagatccatca

SEQ ID NO: 97311 - DNA, 22 bp, Artificial Sequence
  Synthetic oligonucleotide; CTG chr11 5304383 5304404 5304400 5304405 +
aaggtaacatagatccatcatc

SEQ ID NO: 97312 - DNA, 22 bp, Artificial Sequence
  Synthetic oligonucleotide; CTT chr11 5304413 5304434 5304430 5304435 +
cttcaacttgccatgctgacaa

SEQ ID NO: 97313 - DNA, 22 bp, Artificial Sequence
  Synthetic oligonucleotide; TTC chr11 5304414 5304435 5304431 5304436 +
ttcaacttgccatgctgacaaa

SEQ ID NO: 97314 - DNA, 22 bp, Artificial Sequence
  Synthetic oligonucleotide; CTT chr11 5304416 5304437 5304433 5304438 +
caacttgccatgctgacaaaaa

SEQ ID NO: 97315 - DNA, 22 bp, Artificial Sequence
  Synthetic oligonucleotide; TTC chr11 5304417 5304438 5304434 5304439 +
aacttgccatgctgacaaaaag

SEQ ID NO: 97316 - DNA, 22 bp, Artificial Sequence
  Synthetic oligonucleotide; CTT chr11 5304422 5304443 5304439 5304444 +
gccatgctgacaaaaagcttag

SEQ ID NO: 97317 - DNA, 22 bp, Artificial Sequence
  Synthetic oligonucleotide; TTG chr11 5304423 5304444 5304440 5304445 +
ccatgctgacaaaaagcttagg

SEQ ID NO: 97318 - DNA, 22 bp, Artificial Sequence
  Synthetic oligonucleotide; CTG chr11 5304431 5304452 5304448 5304453 +
acaaaaagcttaggaactgttc

SEQ ID NO: 97319 - DNA, 22 bp, Artificial Sequence
  Synthetic oligonucleotide; CTT chr11 5304442 5304463 5304459 5304464 +
aggaactgttcaggaaaccatt

SEQ ID NO: 97320 - DNA, 22 bp, Artificial Sequence
  Synthetic oligonucleotide; TTA chr11 5304443 5304464 5304460 5304465 +
ggaactgttcaggaaaccattt

SEQ ID NO: 97321 - DNA, 22 bp, Artificial Sequence
  Synthetic oligonucleotide; CTG chr11 5304450 5304471 5304467 5304472 +
ttcaggaaaccatttataaaga

SEQ ID NO: 97322 - DNA, 22 bp, Artificial Sequence
  Synthetic oligonucleotide; TTC chr11 5304453 5304474 5304470 5304475 +
aggaaaccatttataaagacat

SEQ ID NO: 97323 - DNA, 22 bp, Artificial Sequence
  Synthetic oligonucleotide; TTT chr11 5304465 5304486 5304482 5304487 +
ataaagacataaactaaaatga

SEQ ID NO: 97324 - DNA, 22 bp, Artificial Sequence
  Synthetic oligonucleotide; TTA chr11 5304466 5304487 5304483 5304488 +
taaagacataaactaaaatgag

SEQ ID NO: 97325 - DNA, 22 bp, Artificial Sequence
  Synthetic oligonucleotide; CTA chr11 5304481 5304502 5304498 5304503 +
aaatgagaagacaaaaagagaa

SEQ ID NO: 97326 - DNA, 22 bp, Artificial Sequence
  Synthetic oligonucleotide; TTA chr11 5304508 5304529 5304525 5304530 +
agatcgtgttaaaaaagaacag

SEQ ID NO: 97327 - DNA, 22 bp, Artificial Sequence
  Synthetic oligonucleotide; TTA chr11 5304519 5304540 5304536 5304541 +
aaaaagaacagtcttccgttta

SEQ ID NO: 97328 - DNA, 22 bp, Artificial Sequence
  Synthetic oligonucleotide; CTT chr11 5304534 5304555 5304551 5304556 +
ccgtttagttccagataatctg

SEQ ID NO: 97329 - DNA, 22 bp, Artificial Sequence
  Synthetic oligonucleotide; TTC chr11 5304535 5304556 5304552 5304557 +
cgtttagttccagataatctgc

SEQ ID NO: 97330 - DNA, 22 bp, Artificial Sequence
  Synthetic oligonucleotide; TTT chr11 5304540 5304561 5304557 5304562 +
agttccagataatctgcaagtg

SEQ ID NO: 97331 - DNA, 22 bp, Artificial Sequence
  Synthetic oligonucleotide; TTA chr11 5304541 5304562 5304558 5304563 +
gttccagataatctgcaagtgc

SEQ ID NO: 97332 - DNA, 22 bp, Artificial Sequence
  Synthetic oligonucleotide; TTC chr11 5304545 5304566 5304562 5304567 +
cagataatctgcaagtgccctg

SEQ ID NO: 97333 - DNA, 22 bp, Artificial Sequence
  Synthetic oligonucleotide; CTG chr11 5304556 5304577 5304573 5304578 +
caagtgccctgtacaatcagtg

SEQ ID NO: 97334 - DNA, 22 bp, Artificial Sequence
  Synthetic oligonucleotide; CTG chr11 5304567 5304588 5304584 5304589 +
tacaatcagtgtcccctgaatc

SEQ ID NO: 97335 - DNA, 22 bp, Artificial Sequence
  Synthetic oligonucleotide; CTG chr11 5304585 5304606 5304602 5304607 +
aatccactttttcatctccaca

SEQ ID NO: 97336 - DNA, 22 bp, Artificial Sequence
  Synthetic oligonucleotide; CTT chr11 5304594 5304615 5304611 5304616 +
tttcatctccacatattgcccc

SEQ ID NO: 97337 - DNA, 22 bp, Artificial Sequence
  Synthetic oligonucleotide; TTT chr11 5304595 5304616 5304612 5304617 +
ttcatctccacatattgcccca

SEQ ID NO: 97338 - DNA, 22 bp, Artificial Sequence
  Synthetic oligonucleotide; TTT chr11 5304596 5304617 5304613 5304618 +
tcatctccacatattgccccaa

SEQ ID NO: 97339 - DNA, 22 bp, Artificial Sequence
  Synthetic oligonucleotide; TTT chr11 5304597 5304618 5304614 5304619 +
catctccacatattgccccaaa

SEQ ID NO: 97340 - DNA, 22 bp, Artificial Sequence
  Synthetic oligonucleotide; TTC chr11 5304598 5304619 5304615 5304620 +
atctccacatattgccccaaaa

SEQ ID NO: 97341 - DNA, 22 bp, Artificial Sequence
  Synthetic oligonucleotide; CTC chr11 5304603 5304624 5304620 5304625 +
cacatattgccccaaaattgtg

SEQ ID NO: 97342 - DNA, 22 bp, Artificial Sequence
  Synthetic oligonucleotide; TTG chr11 5304612 5304633 5304629 5304634 +
ccccaaaattgtgttcctatag

SEQ ID NO: 97343 - DNA, 22 bp, Artificial Sequence
  Synthetic oligonucleotide; TTG chr11 5304623 5304644 5304640 5304645 +
tgttcctatagaagaaattaat

SEQ ID NO: 97344 - DNA, 22 bp, Artificial Sequence
  Synthetic oligonucleotide; TTC chr11 5304628 5304649 5304645 5304650 +
ctatagaagaaattaataaata

SEQ ID NO: 97345 - DNA, 22 bp, Artificial Sequence
  Synthetic oligonucleotide; CTA chr11 5304631 5304652 5304648 5304653 +
tagaagaaattaataaatatac

SEQ ID NO: 97346 - DNA, 22 bp, Artificial Sequence
  Synthetic oligonucleotide; TTA chr11 5304643 5304664 5304660 5304665 +
ataaatataccaaaataaatat

SEQ ID NO: 97347 - DNA, 22 bp, Artificial Sequence
  Synthetic oligonucleotide; TTT chr11 5304667 5304688 5304684 5304689 +
aaagtcaactgacaatgggaag

SEQ ID NO: 97348 - DNA, 22 bp, Artificial Sequence
  Synthetic oligonucleotide; TTA chr11 5304668 5304689 5304685 5304690 +
aagtcaactgacaatgggaagc

SEQ ID NO: 97349 - DNA, 22 bp, Artificial Sequence
  Synthetic oligonucleotide; CTG chr11 5304678 5304699 5304695 5304700 +
acaatgggaagccatgagatga

SEQ ID NO: 97350 - DNA, 22 bp, Artificial Sequence
  Synthetic oligonucleotide; CTG chr11 5304714 5304735 5304731 5304736 +
aaaaatctcagcttttaagtga

SEQ ID NO: 97351 - DNA, 22 bp, Artificial Sequence
  Synthetic oligonucleotide; CTC chr11 5304723 5304744 5304740 5304745 +
agcttttaagtgacttttttat

SEQ ID NO: 97352 - DNA, 22 bp, Artificial Sequence
  Synthetic oligonucleotide; CTT chr11 5304728 5304749 5304745 5304750 +
ttaagtgacttttttatatctt

SEQ ID NO: 97353 - DNA, 22 bp, Artificial Sequence
  Synthetic oligonucleotide; TTT chr11 5304729 5304750 5304746 5304751 +
taagtgacttttttatatctta

SEQ ID NO: 97354 - DNA, 22 bp, Artificial Sequence
  Synthetic oligonucleotide; TTT chr11 5304730 5304751 5304747 5304752 +
aagtgacttttttatatcttac

SEQ ID NO: 97355 - DNA, 22 bp, Artificial Sequence
  Synthetic oligonucleotide; TTA chr11 5304731 5304752 5304748 5304753 +
agtgacttttttatatcttacc

SEQ ID NO: 97356 - DNA, 22 bp, Artificial Sequence
  Synthetic oligonucleotide; CTT chr11 5304739 5304760 5304756 5304761 +
ttttatatcttaccttaagtac

SEQ ID NO: 97357 - DNA, 22 bp, Artificial Sequence
  Synthetic oligonucleotide; TTT chr11 5304740 5304761 5304757 5304762 +
tttatatcttaccttaagtaca

SEQ ID NO: 97358 - DNA, 22 bp, Artificial Sequence
  Synthetic oligonucleotide; TTT chr11 5304741 5304762 5304758 5304763 +
ttatatcttaccttaagtacaa

SEQ ID NO: 97359 - DNA, 22 bp, Artificial Sequence
  Synthetic oligonucleotide; TTT chr11 5304742 5304763 5304759 5304764 +
tatatcttaccttaagtacaaa

SEQ ID NO: 97360 - DNA, 22 bp, Artificial Sequence
  Synthetic oligonucleotide; TTT chr11 5304743 5304764 5304760 5304765 +
atatcttaccttaagtacaaat

SEQ ID NO: 97361 - DNA, 22 bp, Artificial Sequence
  Synthetic oligonucleotide; TTA chr11 5304744 5304765 5304761 5304766 +
tatcttaccttaagtacaaatt

SEQ ID NO: 97362 - DNA, 22 bp, Artificial Sequence
  Synthetic oligonucleotide; CTT chr11 5304750 5304771 5304767 5304772 +
accttaagtacaaattaaaatg

SEQ ID NO: 97363 - DNA, 22 bp, Artificial Sequence
  Synthetic oligonucleotide; TTA chr11 5304751 5304772 5304768 5304773 +
ccttaagtacaaattaaaatgg

SEQ ID NO: 97364 - DNA, 22 bp, Artificial Sequence
  Synthetic oligonucleotide; CTT chr11 5304755 5304776 5304772 5304777 +
aagtacaaattaaaatggaaga

SEQ ID NO: 97365 - DNA, 22 bp, Artificial Sequence
  Synthetic oligonucleotide; TTA chr11 5304756 5304777 5304773 5304778 +
agtacaaattaaaatggaagag

SEQ ID NO: 97366 - DNA, 22 bp, Artificial Sequence
  Synthetic oligonucleotide; TTA chr11 5304767 5304788 5304784 5304789 +
aaatggaagaggtggccaggca

SEQ ID NO: 97367 - DNA, 22 bp, Artificial Sequence
  Synthetic oligonucleotide; CTC chr11 5304798 5304819 5304815 5304820 +
atgcctgtaatcctagcacttt

SEQ ID NO: 97368 - DNA, 22 bp, Artificial Sequence
  Synthetic oligonucleotide; CTG chr11 5304805 5304826 5304822 5304827 +
taatcctagcactttggaaggc

SEQ ID NO: 97369 - DNA, 22 bp, Artificial Sequence
  Synthetic oligonucleotide; CTA chr11 5304813 5304834 5304830 5304835 +
gcactttggaaggctgaggtgg

SEQ ID NO: 97370 - DNA, 22 bp, Artificial Sequence
  Synthetic oligonucleotide; CTT chr11 5304819 5304840 5304836 5304841 +
tggaaggctgaggtggatcacg

SEQ ID NO: 97371 - DNA, 22 bp, Artificial Sequence
  Synthetic oligonucleotide; TTT chr11 5304820 5304841 5304837 5304842 +
ggaaggctgaggtggatcacga

SEQ ID NO: 97372 - DNA, 22 bp, Artificial Sequence
  Synthetic oligonucleotide; TTG chr11 5304821 5304842 5304838 5304843 +
gaaggctgaggtggatcacgag

SEQ ID NO: 97373 - DNA, 22 bp, Artificial Sequence
  Synthetic oligonucleotide; CTG chr11 5304829 5304850 5304846 5304851 +
aggtggatcacgaggtcagcag

SEQ ID NO: 97374 - DNA, 22 bp, Artificial Sequence
  Synthetic oligonucleotide; TTT chr11 5304854 5304875 5304871 5304876 +
gagactagcctggccaacatgg

SEQ ID NO: 97375 - DNA, 22 bp, Artificial Sequence
  Synthetic oligonucleotide; TTG chr11 5304855 5304876 5304872 5304877 +
agactagcctggccaacatggt

SEQ ID NO: 97376 - DNA, 22 bp, Artificial Sequence
  Synthetic oligonucleotide; CTA chr11 5304861 5304882 5304878 5304883 +
gcctggccaacatggtgaaacc

SEQ ID NO: 97377 - DNA, 22 bp, Artificial Sequence
  Synthetic oligonucleotide; CTG chr11 5304866 5304887 5304883 5304888 +
gccaacatggtgaaaccctgtc

SEQ ID NO: 97378 - DNA, 22 bp, Artificial Sequence
  Synthetic oligonucleotide; CTG chr11 5304886 5304907 5304903 5304908 +
tctctactaaaaatacaaaaat

SEQ ID NO: 97379 - DNA, 22 bp, Artificial Sequence
  Synthetic oligonucleotide; CTC chr11 5304890 5304911 5304907 5304912 +
tactaaaaatacaaaaattagc

SEQ ID NO: 97380 - DNA, 22 bp, Artificial Sequence
  Synthetic oligonucleotide; CTA chr11 5304892 5304913 5304909 5304914 +
ctaaaaatacaaaaattagctg

SEQ ID NO: 97381 - DNA, 22 bp, Artificial Sequence
  Synthetic oligonucleotide; CTA chr11 5304895 5304916 5304912 5304917 +
aaaatacaaaaattagctgggt

SEQ ID NO: 97382 - DNA, 22 bp, Artificial Sequence
  Synthetic oligonucleotide; TTA chr11 5304910 5304931 5304927 5304932 +
gctgggtgtggtggtgagcgcc

SEQ ID NO: 97383 - DNA, 22 bp, Artificial Sequence
  Synthetic oligonucleotide; CTG chr11 5304914 5304935 5304931 5304936 +
ggtgtggtggtgagcgcctgta

SEQ ID NO: 97384 - DNA, 22 bp, Artificial Sequence
  Synthetic oligonucleotide; CTG chr11 5304934 5304955 5304951 5304956 +
taatcccagctactcgggaggc

SEQ ID NO: 97385 - DNA, 22 bp, Artificial Sequence
  Synthetic oligonucleotide; CTA chr11 5304946 5304967 5304963 5304968 +
ctcgggaggctgaggcaggaga

SEQ ID NO: 97386 - DNA, 22 bp, Artificial Sequence
  Synthetic oligonucleotide; CTC chr11 5304949 5304970 5304966 5304971 +
gggaggctgaggcaggagaatt

SEQ ID NO: 97387 - DNA, 22 bp, Artificial Sequence
  Synthetic oligonucleotide; CTG chr11 5304958 5304979 5304975 5304980 +
aggcaggagaattgctttaaaa

SEQ ID NO: 97388 - DNA, 22 bp, Artificial Sequence
  Synthetic oligonucleotide; TTG chr11 5304972 5304993 5304989 5304994 +
ctttaaaaaaactggggagcag

SEQ ID NO: 97389 - DNA, 22 bp, Artificial Sequence
  Synthetic oligonucleotide; CTT chr11 5304975 5304996 5304992 5304997 +
taaaaaaactggggagcagagg

SEQ ID NO: 97390 - DNA, 22 bp, Artificial Sequence
  Synthetic oligonucleotide; TTT chr11 5304976 5304997 5304993 5304998 +
aaaaaaactggggagcagaggt

SEQ ID NO: 97391 - DNA, 22 bp, Artificial Sequence
  Synthetic oligonucleotide; TTA chr11 5304977 5304998 5304994 5304999 +
aaaaaactggggagcagaggtc

SEQ ID NO: 97392 - DNA, 22 bp, Artificial Sequence
  Synthetic oligonucleotide; CTG chr11 5304986 5305007 5305003 5305008 +
gggagcagaggtcgtcgcagtg

SEQ ID NO: 97393 - DNA, 22 bp, Artificial Sequence
  Synthetic oligonucleotide; TTG chr11 5305019 5305040 5305036 5305041 +
tgccactgcactacagcctggg

SEQ ID NO: 97394 - DNA, 22 bp, Artificial Sequence
  Synthetic oligonucleotide; CTG chr11 5305027 5305048 5305044 5305049 +
cactacagcctgggcgacaaag

SEQ ID NO: 97395 - DNA, 22 bp, Artificial Sequence
  Synthetic oligonucleotide; CTA chr11 5305032 5305053 5305049 5305054 +
cagcctgggcgacaaagcaagg

SEQ ID NO: 97396 - DNA, 22 bp, Artificial Sequence
  Synthetic oligonucleotide; CTG chr11 5305039 5305060 5305056 5305061 +
ggcgacaaagcaaggctctgtc

SEQ ID NO: 97397 - DNA, 22 bp, Artificial Sequence
  Synthetic oligonucleotide; CTC chr11 5305057 5305078 5305074 5305079 +
tgtctcaaaaaaaaaaaaaaaa

SEQ ID NO: 97398 - DNA, 22 bp, Artificial Sequence
  Synthetic oligonucleotide; CTG chr11 5305059 5305080 5305076 5305081 +
tctcaaaaaaaaaaaaaaaaaa

SEQ ID NO: 97399 - DNA, 22 bp, Artificial Sequence
  Synthetic oligonucleotide; CTC chr11 5305063 5305084 5305080 5305085 +
aaaaaaaaaaaaaaaaaaggtt

SEQ ID NO: 97400 - DNA, 22 bp, Artificial Sequence
  Synthetic oligonucleotide; TTT chr11 5305086 5305107 5305103 5305108 +
ggagagaaacattgggaaacta

SEQ ID NO: 97401 - DNA, 22 bp, Artificial Sequence
  Synthetic oligonucleotide; TTG chr11 5305087 5305108 5305104 5305109 +
gagagaaacattgggaaactag

SEQ ID NO: 97402 - DNA, 22 bp, Artificial Sequence
  Synthetic oligonucleotide; TTG chr11 5305100 5305121 5305117 5305122 +
ggaaactaggacaaattttgct

SEQ ID NO: 97403 - DNA, 22 bp, Artificial Sequence
  Synthetic oligonucleotide; CTA chr11 5305108 5305129 5305125 5305130 +
ggacaaattttgctctcagtaa

SEQ ID NO: 97404 - DNA, 22 bp, Artificial Sequence
  Synthetic oligonucleotide; TTT chr11 5305118 5305139 5305135 5305140 +
tgctctcagtaaaaagaaagat

SEQ ID NO: 97405 - DNA, 22 bp, Artificial Sequence
  Synthetic oligonucleotide; TTT chr11 5305119 5305140 5305136 5305141 +
gctctcagtaaaaagaaagatc

SEQ ID NO: 97406 - DNA, 22 bp, Artificial Sequence
  Synthetic oligonucleotide; TTG chr11 5305120 5305141 5305137 5305142 +
ctctcagtaaaaagaaagatct

SEQ ID NO: 97407 - DNA, 22 bp, Artificial Sequence
  Synthetic oligonucleotide; CTC chr11 5305123 5305144 5305140 5305145 +
tcagtaaaaagaaagatctcaa

SEQ ID NO: 97408 - DNA, 22 bp, Artificial Sequence
  Synthetic oligonucleotide; CTC chr11 5305125 5305146 5305142 5305147 +
agtaaaaagaaagatctcaaag

SEQ ID NO: 97409 - DNA, 22 bp, Artificial Sequence
  Synthetic oligonucleotide; CTC chr11 5305143 5305164 5305160 5305165 +
aaaggagatagacaaagaagca

SEQ ID NO: 97410 - DNA, 22 bp, Artificial Sequence
  Synthetic oligonucleotide; TTG chr11 5305194 5305215 5305211 5305216 +
atctgtatttacaaaaaaacaa

SEQ ID NO: 97411 - DNA, 22 bp, Artificial Sequence
  Synthetic oligonucleotide; CTG chr11 5305199 5305220 5305216 5305221 +
tatttacaaaaaaacaatgaaa

SEQ ID NO: 97412 - DNA, 22 bp, Artificial Sequence
  Synthetic oligonucleotide; TTT chr11 5305204 5305225 5305221 5305226 +
acaaaaaaacaatgaaaaggga

SEQ ID NO: 97413 - DNA, 22 bp, Artificial Sequence
  Synthetic oligonucleotide; TTA chr11 5305205 5305226 5305222 5305227 +
caaaaaaacaatgaaaagggaa

SEQ ID NO: 97414 - DNA, 22 bp, Artificial Sequence
  Synthetic oligonucleotide; TTT chr11 5305231 5305252 5305248 5305253 +
ataggagtggatactatggtag

SEQ ID NO: 97415 - DNA, 22 bp, Artificial Sequence
  Synthetic oligonucleotide; TTA chr11 5305232 5305253 5305249 5305254 +
taggagtggatactatggtagg

SEQ ID NO: 97416 - DNA, 22 bp, Artificial Sequence
  Synthetic oligonucleotide; CTA chr11 5305247 5305268 5305264 5305269 +
tggtaggttaatagtgaaaaat

SEQ ID NO: 97417 - DNA, 22 bp, Artificial Sequence
  Synthetic oligonucleotide; TTA chr11 5305257 5305278 5305274 5305279 +
atagtgaaaaatatagaattat

SEQ ID NO: 97418 - DNA, 22 bp, Artificial Sequence
  Synthetic oligonucleotide; TTA chr11 5305278 5305299 5305295 5305300 +
tcaattaatataaacatagagg

SEQ ID NO: 97419 - DNA, 22 bp, Artificial Sequence
  Synthetic oligonucleotide; TTA chr11 5305285 5305306 5305302 5305307 +
atataaacatagaggtgttgat

SEQ ID NO: 97420 - DNA, 22 bp, Artificial Sequence
  Synthetic oligonucleotide; TTG chr11 5305305 5305326 5305322 5305327 +
attgtttggggcaactaggtct

SEQ ID NO: 97421 - DNA, 22 bp, Artificial Sequence
  Synthetic oligonucleotide; TTG chr11 5305309 5305330 5305326 5305331 +
tttggggcaactaggtctttgg

SEQ ID NO: 97422 - DNA, 22 bp, Artificial Sequence
  Synthetic oligonucleotide; TTT chr11 5305312 5305333 5305329 5305334 +
ggggcaactaggtctttggtaa

SEQ ID NO: 97423 - DNA, 22 bp, Artificial Sequence
  Synthetic oligonucleotide; TTG chr11 5305313 5305334 5305330 5305335 +
gggcaactaggtctttggtaat

SEQ ID NO: 97424 - DNA, 22 bp, Artificial Sequence
  Synthetic oligonucleotide; CTA chr11 5305322 5305343 5305339 5305344 +
ggtctttggtaatattgacaat

SEQ ID NO: 97425 - DNA, 22 bp, Artificial Sequence
  Synthetic oligonucleotide; CTT chr11 5305328 5305349 5305345 5305350 +
tggtaatattgacaatttcaac

SEQ ID NO: 97426 - DNA, 22 bp, Artificial Sequence
  Synthetic oligonucleotide; TTT chr11 5305329 5305350 5305346 5305351 +
ggtaatattgacaatttcaaca

SEQ ID NO: 97427 - DNA, 22 bp, Artificial Sequence
  Synthetic oligonucleotide; TTG chr11 5305330 5305351 5305347 5305352 +
gtaatattgacaatttcaacat

SEQ ID NO: 97428 - DNA, 22 bp, Artificial Sequence
  Synthetic oligonucleotide; TTG chr11 5305339 5305360 5305356 5305361 +
acaatttcaacataatggcaga

SEQ ID NO: 97429 - DNA, 22 bp, Artificial Sequence
  Synthetic oligonucleotide; TTT chr11 5305346 5305367 5305363 5305368 +
caacataatggcagaaatgaat

SEQ ID NO: 97430 - DNA, 22 bp, Artificial Sequence
  Synthetic oligonucleotide; TTC chr11 5305347 5305368 5305364 5305369 +
aacataatggcagaaatgaatg

SEQ ID NO: 97431 - DNA, 22 bp, Artificial Sequence
  Synthetic oligonucleotide; CTA chr11 5305373 5305394 5305390 5305395 +
atgactgtgagacaaaaagtga

SEQ ID NO: 97432 - DNA, 22 bp, Artificial Sequence
  Synthetic oligonucleotide; CTG chr11 5305380 5305401 5305397 5305402 +
tgagacaaaaagtgagtaaaaa

SEQ ID NO: 97433 - DNA, 22 bp, Artificial Sequence
  Synthetic oligonucleotide; CTG chr11 5305409 5305430 5305426 5305431 +
ggcacggtggctcatgcctata

SEQ ID NO: 97434 - DNA, 22 bp, Artificial Sequence
  Synthetic oligonucleotide; CTC chr11 5305422 5305443 5305439 5305444 +
atgcctataatcccagcacttt

SEQ ID NO: 97435 - DNA, 22 bp, Artificial Sequence
  Synthetic oligonucleotide; CTA chr11 5305429 5305450 5305446 5305451 +
taatcccagcactttgggaggc

SEQ ID NO: 97436 - DNA, 22 bp, Artificial Sequence
  Synthetic oligonucleotide; CTT chr11 5305443 5305464 5305460 5305465 +
tgggaggccgaggagggtggat

SEQ ID NO: 97437 - DNA, 22 bp, Artificial Sequence
  Synthetic oligonucleotide; TTT chr11 5305444 5305465 5305461 5305466 +
gggaggccgaggagggtggatc

SEQ ID NO: 97438 - DNA, 22 bp, Artificial Sequence
  Synthetic oligonucleotide; TTG chr11 5305445 5305466 5305462 5305467 +
ggaggccgaggagggtggatca

SEQ ID NO: 97439 - DNA, 22 bp, Artificial Sequence
  Synthetic oligonucleotide; CTT chr11 5305470 5305491 5305487 5305492 +
gagttcaggagttcgagaccag

SEQ ID NO: 97440 - DNA, 22 bp, Artificial Sequence
  Synthetic oligonucleotide; TTG chr11 5305471 5305492 5305488 5305493 +
agttcaggagttcgagaccagc

SEQ ID NO: 97441 - DNA, 22 bp, Artificial Sequence
  Synthetic oligonucleotide; TTC chr11 5305476 5305497 5305493 5305498 +
aggagttcgagaccagctgggc

SEQ ID NO: 97442 - DNA, 22 bp, Artificial Sequence
  Synthetic oligonucleotide; TTC chr11 5305484 5305505 5305501 5305506 +
gagaccagctgggccaacatgg

SEQ ID NO: 97443 - DNA, 22 bp, Artificial Sequence
  Synthetic oligonucleotide; CTG chr11 5305495 5305516 5305512 5305517 +
ggccaacatggcaaaacaccat

SEQ ID NO: 97444 - DNA, 22 bp, Artificial Sequence
  Synthetic oligonucleotide; CTA chr11 5305522 5305543 5305539 5305544 +
ctataattacaaaaataagcca

SEQ ID NO: 97445 - DNA, 22 bp, Artificial Sequence
  Synthetic oligonucleotide; CTA chr11 5305525 5305546 5305542 5305547 +
taattacaaaaataagccaggt

SEQ ID NO: 97446 - DNA, 22 bp, Artificial Sequence
  Synthetic oligonucleotide; TTA chr11 5305531 5305552 5305548 5305553 +
caaaaataagccaggtgtggtg

SEQ ID NO: 97447 - DNA, 22 bp, Artificial Sequence
  Synthetic oligonucleotide; CTA chr11 5305576 5305597 5305593 5305598 +
ctctggaggctgaggcatgaga

SEQ ID NO: 97448 - DNA, 22 bp, Artificial Sequence
  Synthetic oligonucleotide; CTC chr11 5305579 5305600 5305596 5305601 +
tggaggctgaggcatgagaatc

SEQ ID NO: 97449 - DNA, 22 bp, Artificial Sequence
  Synthetic oligonucleotide; CTG chr11 5305581 5305602 5305598 5305603 +
gaggctgaggcatgagaatccc

SEQ ID NO: 97450 - DNA, 22 bp, Artificial Sequence
  Synthetic oligonucleotide; CTG chr11 5305588 5305609 5305605 5305610 +
aggcatgagaatcccctgaacc

SEQ ID NO: 97451 - DNA, 22 bp, Artificial Sequence
  Synthetic oligonucleotide; CTG chr11 5305606 5305627 5305623 5305628 +
aaccctggtggaggaggtcgca

SEQ ID NO: 97452 - DNA, 22 bp, Artificial Sequence
  Synthetic oligonucleotide; CTG chr11 5305613 5305634 5305630 5305635 +
gtggaggaggtcgcagtgagct

SEQ ID NO: 97453 - DNA, 22 bp, Artificial Sequence
  Synthetic oligonucleotide; CTG chr11 5305636 5305657 5305653 5305658 +
agatcgcaccactgcactctag

SEQ ID NO: 97454 - DNA, 22 bp, Artificial Sequence
  Synthetic oligonucleotide; CTG chr11 5305650 5305671 5305667 5305672 +
cactctagcctgggcaacagag

SEQ ID NO: 97455 - DNA, 22 bp, Artificial Sequence
  Synthetic oligonucleotide; CTC chr11 5305655 5305676 5305672 5305677 +
tagcctgggcaacagagaaaaa

SEQ ID NO: 97456 - DNA, 22 bp, Artificial Sequence
  Synthetic oligonucleotide; CTA chr11 5305657 5305678 5305674 5305679 +
gcctgggcaacagagaaaaatc

SEQ ID NO: 97457 - DNA, 22 bp, Artificial Sequence
  Synthetic oligonucleotide; CTG chr11 5305662 5305683 5305679 5305684 +
ggcaacagagaaaaatctgtta

SEQ ID NO: 97458 - DNA, 22 bp, Artificial Sequence
  Synthetic oligonucleotide; CTG chr11 5305681 5305702 5305698 5305703 +
ttaaagagagagagagaaaaga

SEQ ID NO: 97459 - DNA, 22 bp, Artificial Sequence
  Synthetic oligonucleotide; TTA chr11 5305684 5305705 5305701 5305706 +
aagagagagagagaaaagaaaa

SEQ ID NO: 97460 - DNA, 22 bp, Artificial Sequence
  Synthetic oligonucleotide; TTA chr11 5305742 5305763 5305759 5305764 +
ttttatttatattgttatggtg

SEQ ID NO: 97461 - DNA, 22 bp, Artificial Sequence
  Synthetic oligonucleotide; TTT chr11 5305745 5305766 5305762 5305767 +
tatttatattgttatggtgagg

SEQ ID NO: 97462 - DNA, 22 bp, Artificial Sequence
  Synthetic oligonucleotide; TTT chr11 5305746 5305767 5305763 5305768 +
atttatattgttatggtgagga

SEQ ID NO: 97463 - DNA, 22 bp, Artificial Sequence
  Synthetic oligonucleotide; TTA chr11 5305747 5305768 5305764 5305769 +
tttatattgttatggtgaggaa

SEQ ID NO: 97464 - DNA, 22 bp, Artificial Sequence
  Synthetic oligonucleotide; TTT chr11 5305750 5305771 5305767 5305772 +
atattgttatggtgaggaaatt

SEQ ID NO: 97465 - DNA, 22 bp, Artificial Sequence
  Synthetic oligonucleotide; TTA chr11 5305751 5305772 5305768 5305773 +
tattgttatggtgaggaaattg

SEQ ID NO: 97466 - DNA, 22 bp, Artificial Sequence
  Synthetic oligonucleotide; TTG chr11 5305756 5305777 5305773 5305778 +
ttatggtgaggaaattgagcct

SEQ ID NO: 97467 - DNA, 22 bp, Artificial Sequence
  Synthetic oligonucleotide; TTA chr11 5305759 5305780 5305776 5305781 +
tggtgaggaaattgagccttag

SEQ ID NO: 97468 - DNA, 22 bp, Artificial Sequence
  Synthetic oligonucleotide; TTG chr11 5305773 5305794 5305790 5305795 +
agccttagacaagttaagcaat

SEQ ID NO: 97469 - DNA, 22 bp, Artificial Sequence
  Synthetic oligonucleotide; CTT chr11 5305779 5305800 5305796 5305801 +
agacaagttaagcaattagcct

SEQ ID NO: 97470 - DNA, 22 bp, Artificial Sequence
  Synthetic oligonucleotide; TTA chr11 5305780 5305801 5305797 5305802 +
gacaagttaagcaattagccta

SEQ ID NO: 97471 - DNA, 22 bp, Artificial Sequence
  Synthetic oligonucleotide; TTA chr11 5305789 5305810 5305806 5305811 +
agcaattagcctaagatcacgc

SEQ ID NO: 97472 - DNA, 22 bp, Artificial Sequence
  Synthetic oligonucleotide; TTA chr11 5305797 5305818 5305814 5305819 +
gcctaagatcacgcaactaata

SEQ ID NO: 97473 - DNA, 22 bp, Artificial Sequence
  Synthetic oligonucleotide; CTA chr11 5305802 5305823 5305819 5305824 +
agatcacgcaactaatatgtgt

SEQ ID NO: 97474 - DNA, 22 bp, Artificial Sequence
  Synthetic oligonucleotide; CTA chr11 5305816 5305837 5305833 5305838 +
atatgtgtcataaaggaattca

SEQ ID NO: 97475 - DNA, 22 bp, Artificial Sequence
  Synthetic oligonucleotide; TTC chr11 5305837 5305858 5305854 5305859 +
aaacacaggtttatctaaccca

SEQ ID NO: 97476 - DNA, 22 bp, Artificial Sequence
  Synthetic oligonucleotide; TTT chr11 5305849 5305870 5305866 5305871 +
atctaacccaaaacccaagctc

SEQ ID NO: 97477 - DNA, 22 bp, Artificial Sequence
  Synthetic oligonucleotide; TTA chr11 5305850 5305871 5305867 5305872 +
tctaacccaaaacccaagctca

SEQ ID NO: 97478 - DNA, 22 bp, Artificial Sequence
  Synthetic oligonucleotide; CTA chr11 5305854 5305875 5305871 5305876 +
acccaaaacccaagctcatatt

SEQ ID NO: 97479 - DNA, 22 bp, Artificial Sequence
  Synthetic oligonucleotide; CTC chr11 5305871 5305892 5305888 5305893 +
atattctcaaccaatgtccatc

SEQ ID NO: 97480 - DNA, 22 bp, Artificial Sequence
  Synthetic oligonucleotide; TTC chr11 5305877 5305898 5305894 5305899 +
tcaaccaatgtccatcaaatgg

SEQ ID NO: 97481 - DNA, 22 bp, Artificial Sequence
  Synthetic oligonucleotide; CTC chr11 5305879 5305900 5305896 5305901 +
aaccaatgtccatcaaatggaa

SEQ ID NO: 97482 - DNA, 22 bp, Artificial Sequence
  Synthetic oligonucleotide; TTA chr11 5305908 5305929 5305925 5305930 +
aacttgcttcccgtatttgaat

SEQ ID NO: 97483 - DNA, 22 bp, Artificial Sequence
  Synthetic oligonucleotide; CTT chr11 5305913 5305934 5305930 5305935 +
gcttcccgtatttgaatccttg

SEQ ID NO: 97484 - DNA, 22 bp, Artificial Sequence
  Synthetic oligonucleotide; TTG chr11 5305914 5305935 5305931 5305936 +
cttcccgtatttgaatccttgg

SEQ ID NO: 97485 - DNA, 22 bp, Artificial Sequence
  Synthetic oligonucleotide; CTT chr11 5305917 5305938 5305934 5305939 +
cccgtatttgaatccttggctt

SEQ ID NO: 97486 - DNA, 22 bp, Artificial Sequence
  Synthetic oligonucleotide; TTC chr11 5305918 5305939 5305935 5305940 +
ccgtatttgaatccttggcttt

SEQ ID NO: 97487 - DNA, 22 bp, Artificial Sequence
  Synthetic oligonucleotide; TTT chr11 5305926 5305947 5305943 5305948 +
gaatccttggcttttcttacct

SEQ ID NO: 97488 - DNA, 22 bp, Artificial Sequence
  Synthetic oligonucleotide; TTG chr11 5305927 5305948 5305944 5305949 +
aatccttggcttttcttacctg

SEQ ID NO: 97489 - DNA, 22 bp, Artificial Sequence
  Synthetic oligonucleotide; CTT chr11 5305934 5305955 5305951 5305956 +
ggcttttcttacctgagccaca

SEQ ID NO: 97490 - DNA, 22 bp, Artificial Sequence
  Synthetic oligonucleotide; TTG chr11 5305935 5305956 5305952 5305957 +
gcttttcttacctgagccacag

SEQ ID NO: 97491 - DNA, 22 bp, Artificial Sequence
  Synthetic oligonucleotide; CTT chr11 5305939 5305960 5305956 5305961 +
ttcttacctgagccacagtttt

SEQ ID NO: 97492 - DNA, 22 bp, Artificial Sequence
  Synthetic oligonucleotide; TTT chr11 5305940 5305961 5305957 5305962 +
tcttacctgagccacagttttc

SEQ ID NO: 97493 - DNA, 22 bp, Artificial Sequence
  Synthetic oligonucleotide; TTT chr11 5305941 5305962 5305958 5305963 +
cttacctgagccacagttttct

SEQ ID NO: 97494 - DNA, 22 bp, Artificial Sequence
  Synthetic oligonucleotide; TTC chr11 5305942 5305963 5305959 5305964 +
ttacctgagccacagttttctc

SEQ ID NO: 97495 - DNA, 22 bp, Artificial Sequence
  Synthetic oligonucleotide; CTT chr11 5305944 5305965 5305961 5305966 +
acctgagccacagttttctctt

SEQ ID NO: 97496 - DNA, 22 bp, Artificial Sequence
  Synthetic oligonucleotide; TTA chr11 5305945 5305966 5305962 5305967 +
cctgagccacagttttctcttt

SEQ ID NO: 97497 - DNA, 22 bp, Artificial Sequence
  Synthetic oligonucleotide; CTG chr11 5305949 5305970 5305966 5305971 +
agccacagttttctctttgcgg

SEQ ID NO: 97498 - DNA, 22 bp, Artificial Sequence
  Synthetic oligonucleotide; TTT chr11 5305960 5305981 5305977 5305982 +
tctctttgcggtttctgagcat

SEQ ID NO: 97499 - DNA, 22 bp, Artificial Sequence
  Synthetic oligonucleotide; TTT chr11 5305961 5305982 5305978 5305983 +
ctctttgcggtttctgagcatg

SEQ ID NO: 97500 - DNA, 22 bp, Artificial Sequence
  Synthetic oligonucleotide; TTC chr11 5305962 5305983 5305979 5305984 +
tctttgcggtttctgagcatga

SEQ ID NO: 97501 - DNA, 22 bp, Artificial Sequence
  Synthetic oligonucleotide; CTC chr11 5305964 5305985 5305981 5305986 +
tttgcggtttctgagcatgacc

SEQ ID NO: 97502 - DNA, 22 bp, Artificial Sequence
  Synthetic oligonucleotide; CTT chr11 5305966 5305987 5305983 5305988 +
tgcggtttctgagcatgacctg

SEQ ID NO: 97503 - DNA, 22 bp, Artificial Sequence
  Synthetic oligonucleotide; TTT chr11 5305967 5305988 5305984 5305989 +
gcggtttctgagcatgacctga

SEQ ID NO: 97504 - DNA, 22 bp, Artificial Sequence
  Synthetic oligonucleotide; TTG chr11 5305968 5305989 5305985 5305990 +
cggtttctgagcatgacctgaa

SEQ ID NO: 97505 - DNA, 22 bp, Artificial Sequence
  Synthetic oligonucleotide; TTT chr11 5305974 5305995 5305991 5305996 +
ctgagcatgacctgaatattgg

SEQ ID NO: 97506 - DNA, 22 bp, Artificial Sequence
  Synthetic oligonucleotide; TTC chr11 5305975 5305996 5305992 5305997 +
tgagcatgacctgaatattggt

SEQ ID NO: 97507 - DNA, 22 bp, Artificial Sequence
  Synthetic oligonucleotide; CTG chr11 5305977 5305998 5305994 5305999 +
agcatgacctgaatattggttg

SEQ ID NO: 97508 - DNA, 22 bp, Artificial Sequence
  Synthetic oligonucleotide; CTG chr11 5305988 5306009 5306005 5306010 +
aatattggttgtttgctatatc

SEQ ID NO: 97509 - DNA, 22 bp, Artificial Sequence
  Synthetic oligonucleotide; TTG chr11 5305995 5306016 5306012 5306017 +
gttgtttgctatatcctcagta

SEQ ID NO: 97510 - DNA, 22 bp, Artificial Sequence
  Synthetic oligonucleotide; TTG chr11 5305999 5306020 5306016 5306021 +
tttgctatatcctcagtattta

SEQ ID NO: 97511 - DNA, 22 bp, Artificial Sequence
  Synthetic oligonucleotide; TTT chr11 5306002 5306023 5306019 5306024 +
gctatatcctcagtatttactc

SEQ ID NO: 97512 - DNA, 22 bp, Artificial Sequence
  Synthetic oligonucleotide; TTG chr11 5306003 5306024 5306020 5306025 +
ctatatcctcagtatttactct

SEQ ID NO: 97513 - DNA, 22 bp, Artificial Sequence
  Synthetic oligonucleotide; CTA chr11 5306006 5306027 5306023 5306028 +
tatcctcagtatttactcttaa

SEQ ID NO: 97514 - DNA, 22 bp, Artificial Sequence
  Synthetic oligonucleotide; CTC chr11 5306013 5306034 5306030 5306035 +
agtatttactcttaattctgat

SEQ ID NO: 97515 - DNA, 22 bp, Artificial Sequence
  Synthetic oligonucleotide; TTT chr11 5306020 5306041 5306037 5306042 +
actcttaattctgatgagagat

SEQ ID NO: 97516 - DNA, 22 bp, Artificial Sequence
  Synthetic oligonucleotide; TTA chr11 5306021 5306042 5306038 5306043 +
ctcttaattctgatgagagata

SEQ ID NO: 97517 - DNA, 22 bp, Artificial Sequence
  Synthetic oligonucleotide; CTC chr11 5306024 5306045 5306041 5306046 +
ttaattctgatgagagatatat

SEQ ID NO: 97518 - DNA, 22 bp, Artificial Sequence
  Synthetic oligonucleotide; CTT chr11 5306026 5306047 5306043 5306048 +
aattctgatgagagatatattt

SEQ ID NO: 97519 - DNA, 22 bp, Artificial Sequence
  Synthetic oligonucleotide; TTA chr11 5306027 5306048 5306044 5306049 +
attctgatgagagatatatttg

SEQ ID NO: 97520 - DNA, 22 bp, Artificial Sequence
  Synthetic oligonucleotide; TTC chr11 5306031 5306052 5306048 5306053 +
tgatgagagatatatttgttac

SEQ ID NO: 97521 - DNA, 22 bp, Artificial Sequence
  Synthetic oligonucleotide; CTG chr11 5306033 5306054 5306050 5306055 +
atgagagatatatttgttacac

SEQ ID NO: 97522 - DNA, 22 bp, Artificial Sequence
  Synthetic oligonucleotide; TTT chr11 5306048 5306069 5306065 5306070 +
gttacacaaacaactctcaagg

SEQ ID NO: 97523 - DNA, 22 bp, Artificial Sequence
  Synthetic oligonucleotide; TTG chr11 5306049 5306070 5306066 5306071 +
ttacacaaacaactctcaaggg

SEQ ID NO: 97524 - DNA, 22 bp, Artificial Sequence
  Synthetic oligonucleotide; TTA chr11 5306052 5306073 5306069 5306074 +
cacaaacaactctcaaggggtt

SEQ ID NO: 97525 - DNA, 22 bp, Artificial Sequence
  Synthetic oligonucleotide; CTC chr11 5306064 5306085 5306081 5306086 +
tcaaggggttattctagctcat

SEQ ID NO: 97526 - DNA, 22 bp, Artificial Sequence
  Synthetic oligonucleotide; CTC chr11 5306066 5306087 5306083 5306088 +
aaggggttattctagctcattt

SEQ ID NO: 97527 - DNA, 22 bp, Artificial Sequence
  Synthetic oligonucleotide; TTA chr11 5306075 5306096 5306092 5306097 +
ttctagctcatttccacatagg

SEQ ID NO: 97528 - DNA, 22 bp, Artificial Sequence
  Synthetic oligonucleotide; TTC chr11 5306078 5306099 5306095 5306100 +
tagctcatttccacataggata

SEQ ID NO: 97529 - DNA, 22 bp, Artificial Sequence
  Synthetic oligonucleotide; CTA chr11 5306080 5306101 5306097 5306102 +
gctcatttccacataggatatt

SEQ ID NO: 97530 - DNA, 22 bp, Artificial Sequence
  Synthetic oligonucleotide; CTC chr11 5306084 5306105 5306101 5306106 +
atttccacataggatatttggg

SEQ ID NO: 97531 - DNA, 22 bp, Artificial Sequence
  Synthetic oligonucleotide; TTT chr11 5306088 5306109 5306105 5306110 +
ccacataggatatttgggaata

SEQ ID NO: 97532 - DNA, 22 bp, Artificial Sequence
  Synthetic oligonucleotide; TTC chr11 5306089 5306110 5306106 5306111 +
cacataggatatttgggaatag

SEQ ID NO: 97533 - DNA, 22 bp, Artificial Sequence
  Synthetic oligonucleotide; TTT chr11 5306103 5306124 5306120 5306125 +
gggaatagtgtaccaaataatt

SEQ ID NO: 97534 - DNA, 22 bp, Artificial Sequence
  Synthetic oligonucleotide; TTG chr11 5306104 5306125 5306121 5306126 +
ggaatagtgtaccaaataattc

SEQ ID NO: 97535 - DNA, 22 bp, Artificial Sequence
  Synthetic oligonucleotide; TTC chr11 5306126 5306147 5306143 5306148 +
tcttttcctccccaacctggga

SEQ ID NO: 97536 - DNA, 22 bp, Artificial Sequence
  Synthetic oligonucleotide; CTC chr11 5306128 5306149 5306145 5306150 +
ttttcctccccaacctgggaaa

SEQ ID NO: 97537 - DNA, 22 bp, Artificial Sequence
  Synthetic oligonucleotide; CTT chr11 5306130 5306151 5306147 5306152 +
ttcctccccaacctgggaaaga

SEQ ID NO: 97538 - DNA, 22 bp, Artificial Sequence
  Synthetic oligonucleotide; TTT chr11 5306131 5306152 5306148 5306153 +
tcctccccaacctgggaaagat

SEQ ID NO: 97539 - DNA, 22 bp, Artificial Sequence
  Synthetic oligonucleotide; TTT chr11 5306132 5306153 5306149 5306154 +
cctccccaacctgggaaagatc

SEQ ID NO: 97540 - DNA, 22 bp, Artificial Sequence
  Synthetic oligonucleotide; TTC chr11 5306133 5306154 5306150 5306155 +
ctccccaacctgggaaagatct

SEQ ID NO: 97541 - DNA, 22 bp, Artificial Sequence
  Synthetic oligonucleotide; CTC chr11 5306136 5306157 5306153 5306158 +
cccaacctgggaaagatctggg

SEQ ID NO: 97542 - DNA, 22 bp, Artificial Sequence
  Synthetic oligonucleotide; CTG chr11 5306145 5306166 5306162 5306167 +
ggaaagatctgggccattgaaa

SEQ ID NO: 97543 - DNA, 22 bp, Artificial Sequence
  Synthetic oligonucleotide; CTG chr11 5306156 5306177 5306173 5306178 +
ggccattgaaactggtccccat

SEQ ID NO: 97544 - DNA, 22 bp, Artificial Sequence
  Synthetic oligonucleotide; TTG chr11 5306164 5306185 5306181 5306186 +
aaactggtccccatggccttta

SEQ ID NO: 97545 - DNA, 22 bp, Artificial Sequence
  Synthetic oligonucleotide; CTG chr11 5306170 5306191 5306187 5306192 +
gtccccatggcctttatttttt

SEQ ID NO: 97546 - DNA, 22 bp, Artificial Sequence
  Synthetic oligonucleotide; CTT chr11 5306184 5306205 5306201 5306206 +
tattttttctttggaaggagag

SEQ ID NO: 97547 - DNA, 22 bp, Artificial Sequence
  Synthetic oligonucleotide; TTT chr11 5306185 5306206 5306202 5306207 +
attttttctttggaaggagagt

SEQ ID NO: 97548 - DNA, 22 bp, Artificial Sequence
  Synthetic oligonucleotide; TTA chr11 5306186 5306207 5306203 5306208 +
ttttttctttggaaggagagtc

SEQ ID NO: 97549 - DNA, 22 bp, Artificial Sequence
  Synthetic oligonucleotide; TTT chr11 5306189 5306210 5306206 5306211 +
tttctttggaaggagagtctct

SEQ ID NO: 97550 - DNA, 22 bp, Artificial Sequence
  Synthetic oligonucleotide; TTT chr11 5306190 5306211 5306207 5306212 +
ttctttggaaggagagtctcta

SEQ ID NO: 97551 - DNA, 22 bp, Artificial Sequence
  Synthetic oligonucleotide; TTT chr11 5306191 5306212 5306208 5306213 +
tctttggaaggagagtctctaa

SEQ ID NO: 97552 - DNA, 22 bp, Artificial Sequence
  Synthetic oligonucleotide; TTT chr11 5306192 5306213 5306209 5306214 +
ctttggaaggagagtctctaag

SEQ ID NO: 97553 - DNA, 22 bp, Artificial Sequence
  Synthetic oligonucleotide; TTC chr11 5306193 5306214 5306210 5306215 +
tttggaaggagagtctctaaga

SEQ ID NO: 97554 - DNA, 22 bp, Artificial Sequence
  Synthetic oligonucleotide; CTT chr11 5306195 5306216 5306212 5306217 +
tggaaggagagtctctaagaga

SEQ ID NO: 97555 - DNA, 22 bp, Artificial Sequence
  Synthetic oligonucleotide; TTT chr11 5306196 5306217 5306213 5306218 +
ggaaggagagtctctaagagaa

SEQ ID NO: 97556 - DNA, 22 bp, Artificial Sequence
  Synthetic oligonucleotide; TTG chr11 5306197 5306218 5306214 5306219 +
gaaggagagtctctaagagaag

SEQ ID NO: 97557 - DNA, 22 bp, Artificial Sequence
  Synthetic oligonucleotide; CTC chr11 5306210 5306231 5306227 5306232 +
taagagaagttgtgtctctaac

SEQ ID NO: 97558 - DNA, 22 bp, Artificial Sequence
  Synthetic oligonucleotide; CTA chr11 5306212 5306233 5306229 5306234 +
agagaagttgtgtctctaacat

SEQ ID NO: 97559 - DNA, 22 bp, Artificial Sequence
  Synthetic oligonucleotide; TTG chr11 5306222 5306243 5306239 5306244 +
tgtctctaacatcagatgaggc

SEQ ID NO: 97560 - DNA, 22 bp, Artificial Sequence
  Synthetic oligonucleotide; CTC chr11 5306228 5306249 5306245 5306250 +
taacatcagatgaggcatgacc

SEQ ID NO: 97561 - DNA, 22 bp, Artificial Sequence
  Synthetic oligonucleotide; CTA chr11 5306230 5306251 5306247 5306252 +
acatcagatgaggcatgaccga

SEQ ID NO: 97562 - DNA, 22 bp, Artificial Sequence
  Synthetic oligonucleotide; CTC chr11 5306264 5306285 5306281 5306286 +
tcaagtgttccattggtcttag

SEQ ID NO: 97563 - DNA, 22 bp, Artificial Sequence
  Synthetic oligonucleotide; CTC chr11 5306266 5306287 5306283 5306288 +
aagtgttccattggtcttagag

SEQ ID NO: 97564 - DNA, 22 bp, Artificial Sequence
  Synthetic oligonucleotide; TTC chr11 5306274 5306295 5306291 5306296 +
cattggtcttagagtgggaaga

SEQ ID NO: 97565 - DNA, 22 bp, Artificial Sequence
  Synthetic oligonucleotide; TTG chr11 5306279 5306300 5306296 5306301 +
gtcttagagtgggaagaccagt

SEQ ID NO: 97566 - DNA, 22 bp, Artificial Sequence
  Synthetic oligonucleotide; CTT chr11 5306284 5306305 5306301 5306306 +
agagtgggaagaccagtcactt

SEQ ID NO: 97567 - DNA, 22 bp, Artificial Sequence
  Synthetic oligonucleotide; TTA chr11 5306285 5306306 5306302 5306307 +
gagtgggaagaccagtcacttt

SEQ ID NO: 97568 - DNA, 22 bp, Artificial Sequence
  Synthetic oligonucleotide; CTT chr11 5306306 5306327 5306323 5306328 +
tgtctttgtaaatgttaacatt

SEQ ID NO: 97569 - DNA, 22 bp, Artificial Sequence
  Synthetic oligonucleotide; TTT chr11 5306307 5306328 5306324 5306329 +
gtctttgtaaatgttaacattt

SEQ ID NO: 97570 - DNA, 22 bp, Artificial Sequence
  Synthetic oligonucleotide; TTG chr11 5306308 5306329 5306325 5306330 +
tctttgtaaatgttaacatttg

SEQ ID NO: 97571 - DNA, 22 bp, Artificial Sequence
  Synthetic oligonucleotide; CTT chr11 5306312 5306333 5306329 5306334 +
tgtaaatgttaacatttgaaga

SEQ ID NO: 97572 - DNA, 22 bp, Artificial Sequence
  Synthetic oligonucleotide; TTT chr11 5306313 5306334 5306330 5306335 +
gtaaatgttaacatttgaagaa

SEQ ID NO: 97573 - DNA, 22 bp, Artificial Sequence
  Synthetic oligonucleotide; TTG chr11 5306314 5306335 5306331 5306336 +
taaatgttaacatttgaagaac

SEQ ID NO: 97574 - DNA, 22 bp, Artificial Sequence
  Synthetic oligonucleotide; TTA chr11 5306323 5306344 5306340 5306345 +
acatttgaagaacattgcccct

SEQ ID NO: 97575 - DNA, 22 bp, Artificial Sequence
  Synthetic oligonucleotide; TTT chr11 5306329 5306350 5306346 5306351 +
gaagaacattgccccttttcaa

SEQ ID NO: 97576 - DNA, 22 bp, Artificial Sequence
  Synthetic oligonucleotide; TTG chr11 5306330 5306351 5306347 5306352 +
aagaacattgccccttttcaaa

SEQ ID NO: 97577 - DNA, 22 bp, Artificial Sequence
  Synthetic oligonucleotide; TTG chr11 5306340 5306361 5306357 5306362 +
ccccttttcaaactgtattata

SEQ ID NO: 97578 - DNA, 22 bp, Artificial Sequence
  Synthetic oligonucleotide; CTT chr11 5306346 5306367 5306363 5306368 +
ttcaaactgtattatattctct

SEQ ID NO: 97579 - DNA, 22 bp, Artificial Sequence
  Synthetic oligonucleotide; TTT chr11 5306347 5306368 5306364 5306369 +
tcaaactgtattatattctcta

SEQ ID NO: 97580 - DNA, 22 bp, Artificial Sequence
  Synthetic oligonucleotide; TTT chr11 5306348 5306369 5306365 5306370 +
caaactgtattatattctctaa

SEQ ID NO: 97581 - DNA, 22 bp, Artificial Sequence
  Synthetic oligonucleotide; TTC chr11 5306349 5306370 5306366 5306371 +
aaactgtattatattctctaat

SEQ ID NO: 97582 - DNA, 22 bp, Artificial Sequence
  Synthetic oligonucleotide; CTG chr11 5306355 5306376 5306372 5306377 +
tattatattctctaattcaacc

SEQ ID NO: 97583 - DNA, 22 bp, Artificial Sequence
  Synthetic oligonucleotide; TTA chr11 5306360 5306381 5306377 5306382 +
tattctctaattcaacccttta

SEQ ID NO: 97584 - DNA, 22 bp, Artificial Sequence
  Synthetic oligonucleotide; TTC chr11 5306365 5306386 5306382 5306387 +
tctaattcaaccctttacaaaa

SEQ ID NO: 97585 - DNA, 22 bp, Artificial Sequence
  Synthetic oligonucleotide; CTC chr11 5306367 5306388 5306384 5306389 +
taattcaaccctttacaaaatc

SEQ ID NO: 97586 - DNA, 22 bp, Artificial Sequence
  Synthetic oligonucleotide; CTA chr11 5306369 5306390 5306386 5306391 +
attcaaccctttacaaaatcct

SEQ ID NO: 97587 - DNA, 22 bp, Artificial Sequence
  Synthetic oligonucleotide; TTC chr11 5306373 5306394 5306390 5306395 +
aaccctttacaaaatccttgag

SEQ ID NO: 97588 - DNA, 22 bp, Artificial Sequence
  Synthetic oligonucleotide; CTT chr11 5306380 5306401 5306397 5306402 +
tacaaaatccttgagccaccac

SEQ ID NO: 97589 - DNA, 22 bp, Artificial Sequence
  Synthetic oligonucleotide; TTT chr11 5306381 5306402 5306398 5306403 +
acaaaatccttgagccaccacc

SEQ ID NO: 97590 - DNA, 22 bp, Artificial Sequence
  Synthetic oligonucleotide; TTA chr11 5306382 5306403 5306399 5306404 +
caaaatccttgagccaccacca

SEQ ID NO: 97591 - DNA, 22 bp, Artificial Sequence
  Synthetic oligonucleotide; CTT chr11 5306392 5306413 5306409 5306414 +
gagccaccaccaaaccttttcg

SEQ ID NO: 97592 - DNA, 22 bp, Artificial Sequence
  Synthetic oligonucleotide; TTG chr11 5306393 5306414 5306410 5306415 +
agccaccaccaaaccttttcgt

SEQ ID NO: 97593 - DNA, 22 bp, Artificial Sequence
  Synthetic oligonucleotide; CTT chr11 5306410 5306431 5306427 5306432 +
ttcgtcttgatgattattcatc

SEQ ID NO: 97594 - DNA, 22 bp, Artificial Sequence
  Synthetic oligonucleotide; TTT chr11 5306411 5306432 5306428 5306433 +
tcgtcttgatgattattcatca

SEQ ID NO: 97595 - DNA, 22 bp, Artificial Sequence
  Synthetic oligonucleotide; TTT chr11 5306412 5306433 5306429 5306434 +
cgtcttgatgattattcatcag

SEQ ID NO: 97596 - DNA, 22 bp, Artificial Sequence
  Synthetic oligonucleotide; TTC chr11 5306413 5306434 5306430 5306435 +
gtcttgatgattattcatcaga

SEQ ID NO: 97597 - DNA, 22 bp, Artificial Sequence
  Synthetic oligonucleotide; CTT chr11 5306418 5306439 5306435 5306440 +
gatgattattcatcagacattt

SEQ ID NO: 97598 - DNA, 22 bp, Artificial Sequence
  Synthetic oligonucleotide; TTG chr11 5306419 5306440 5306436 5306441 +
atgattattcatcagacattta

SEQ ID NO: 97599 - DNA, 22 bp, Artificial Sequence
  Synthetic oligonucleotide; TTA chr11 5306426 5306447 5306443 5306448 +
ttcatcagacatttatttattc

SEQ ID NO: 97600 - DNA, 22 bp, Artificial Sequence
  Synthetic oligonucleotide; TTC chr11 5306429 5306450 5306446 5306451 +
atcagacatttatttattcttt

SEQ ID NO: 97601 - DNA, 22 bp, Artificial Sequence
  Synthetic oligonucleotide; TTT chr11 5306440 5306461 5306457 5306462 +
atttattctttctattgattca

SEQ ID NO: 97602 - DNA, 22 bp, Artificial Sequence
  Synthetic oligonucleotide; TTA chr11 5306441 5306462 5306458 5306463 +
tttattctttctattgattcaa

SEQ ID NO: 97603 - DNA, 22 bp, Artificial Sequence
  Synthetic oligonucleotide; TTT chr11 5306444 5306465 5306461 5306466 +
attctttctattgattcaaaac

SEQ ID NO: 97604 - DNA, 22 bp, Artificial Sequence
  Synthetic oligonucleotide; TTA chr11 5306445 5306466 5306462 5306467 +
ttctttctattgattcaaaact

SEQ ID NO: 97605 - DNA, 22 bp, Artificial Sequence
  Synthetic oligonucleotide; TTC chr11 5306448 5306469 5306465 5306470 +
tttctattgattcaaaactcac

SEQ ID NO: 97606 - DNA, 22 bp, Artificial Sequence
  Synthetic oligonucleotide; CTT chr11 5306450 5306471 5306467 5306472 +
tctattgattcaaaactcacta

SEQ ID NO: 97607 - DNA, 22 bp, Artificial Sequence
  Synthetic oligonucleotide; TTT chr11 5306451 5306472 5306468 5306473 +
ctattgattcaaaactcactac

SEQ ID NO: 97608 - DNA, 22 bp, Artificial Sequence
  Synthetic oligonucleotide; TTC chr11 5306452 5306473 5306469 5306474 +
tattgattcaaaactcactacc

SEQ ID NO: 97609 - DNA, 22 bp, Artificial Sequence
  Synthetic oligonucleotide; CTA chr11 5306454 5306475 5306471 5306476 +
ttgattcaaaactcactaccct

SEQ ID NO: 97610 - DNA, 22 bp, Artificial Sequence
  Synthetic oligonucleotide; TTG chr11 5306457 5306478 5306474 5306479 +
attcaaaactcactaccctacc

SEQ ID NO: 97611 - DNA, 22 bp, Artificial Sequence
  Synthetic oligonucleotide; TTC chr11 5306461 5306482 5306478 5306483 +
aaaactcactaccctaccctga

SEQ ID NO: 97612 - DNA, 22 bp, Artificial Sequence
  Synthetic oligonucleotide; CTC chr11 5306468 5306489 5306485 5306490 +
actaccctaccctgagctatct

SEQ ID NO: 97613 - DNA, 22 bp, Artificial Sequence
  Synthetic oligonucleotide; CTA chr11 5306472 5306493 5306489 5306494 +
ccctaccctgagctatctcatt

SEQ ID NO: 97614 - DNA, 22 bp, Artificial Sequence
  Synthetic oligonucleotide; CTA chr11 5306477 5306498 5306494 5306499 +
ccctgagctatctcattcatat

SEQ ID NO: 97615 - DNA, 22 bp, Artificial Sequence
  Synthetic oligonucleotide; CTG chr11 5306482 5306503 5306499 5306504 +
agctatctcattcatatatatg

SEQ ID NO: 97616 - DNA, 22 bp, Artificial Sequence
  Synthetic oligonucleotide; CTA chr11 5306487 5306508 5306504 5306509 +
tctcattcatatatatgtgggt

SEQ ID NO: 97617 - DNA, 22 bp, Artificial Sequence
  Synthetic oligonucleotide; CTC chr11 5306491 5306512 5306508 5306513 +
attcatatatatgtgggtttca

SEQ ID NO: 97618 - DNA, 22 bp, Artificial Sequence
  Synthetic oligonucleotide; TTC chr11 5306495 5306516 5306512 5306517 +
atatatatgtgggtttcattta

SEQ ID NO: 97619 - DNA, 22 bp, Artificial Sequence
  Synthetic oligonucleotide; TTT chr11 5306511 5306532 5306528 5306533 +
catttaattatttagtatatgt

SEQ ID NO: 97620 - DNA, 22 bp, Artificial Sequence
  Synthetic oligonucleotide; TTC chr11 5306512 5306533 5306529 5306534 +
atttaattatttagtatatgta

SEQ ID NO: 97621 - DNA, 22 bp, Artificial Sequence
  Synthetic oligonucleotide; TTT chr11 5306516 5306537 5306533 5306538 +
aattatttagtatatgtatata

SEQ ID NO: 97622 - DNA, 22 bp, Artificial Sequence
  Synthetic oligonucleotide; TTA chr11 5306517 5306538 5306534 5306539 +
attatttagtatatgtatatat

SEQ ID NO: 97623 - DNA, 22 bp, Artificial Sequence
  Synthetic oligonucleotide; TTA chr11 5306521 5306542 5306538 5306543 +
tttagtatatgtatatatggta

SEQ ID NO: 97624 - DNA, 22 bp, Artificial Sequence
  Synthetic oligonucleotide; TTT chr11 5306524 5306545 5306541 5306546 +
agtatatgtatatatggtattt

SEQ ID NO: 97625 - DNA, 22 bp, Artificial Sequence
  Synthetic oligonucleotide; TTA chr11 5306525 5306546 5306542 5306547 +
gtatatgtatatatggtattta

SEQ ID NO: 97626 - DNA, 22 bp, Artificial Sequence
  Synthetic oligonucleotide; TTT chr11 5306546 5306567 5306563 5306568 +
actatcaatatatgtatgcata

SEQ ID NO: 97627 - DNA, 22 bp, Artificial Sequence
  Synthetic oligonucleotide; TTA chr11 5306547 5306568 5306564 5306569 +
ctatcaatatatgtatgcatag

SEQ ID NO: 97628 - DNA, 22 bp, Artificial Sequence
  Synthetic oligonucleotide; CTA chr11 5306550 5306571 5306567 5306572 +
tcaatatatgtatgcataggtg

SEQ ID NO: 97629 - DNA, 22 bp, Artificial Sequence
  Synthetic oligonucleotide; TTC chr11 5306599 5306620 5306616 5306621 +
acagacagagacagtgagagag

SEQ ID NO: 97630 - DNA, 22 bp, Artificial Sequence
  Synthetic oligonucleotide; CTT chr11 5306639 5306660 5306656 5306661 +
ctctgaaacatataatatctac

SEQ ID NO: 97631 - DNA, 22 bp, Artificial Sequence
  Synthetic oligonucleotide; TTC chr11 5306640 5306661 5306657 5306662 +
tctgaaacatataatatctact

SEQ ID NO: 97632 - DNA, 22 bp, Artificial Sequence
  Synthetic oligonucleotide; CTC chr11 5306642 5306663 5306659 5306664 +
tgaaacatataatatctactcc

SEQ ID NO: 97633 - DNA, 22 bp, Artificial Sequence
  Synthetic oligonucleotide; CTG chr11 5306644 5306665 5306661 5306666 +
aaacatataatatctactcctt

SEQ ID NO: 97634 - DNA, 22 bp, Artificial Sequence
  Synthetic oligonucleotide; CTA chr11 5306660 5306681 5306677 5306682 +
ctccttatatttaggtctgatc

SEQ ID NO: 97635 - DNA, 22 bp, Artificial Sequence
  Synthetic oligonucleotide; CTC chr11 5306663 5306684 5306680 5306685 +
cttatatttaggtctgatctcc

SEQ ID NO: 97636 - DNA, 22 bp, Artificial Sequence
  Synthetic oligonucleotide; CTT chr11 5306666 5306687 5306683 5306688 +
atatttaggtctgatctccaga

SEQ ID NO: 97637 - DNA, 22 bp, Artificial Sequence
  Synthetic oligonucleotide; TTA chr11 5306667 5306688 5306684 5306689 +
tatttaggtctgatctccagaa

SEQ ID NO: 97638 - DNA, 22 bp, Artificial Sequence
  Synthetic oligonucleotide; TTT chr11 5306672 5306693 5306689 5306694 +
aggtctgatctccagaataaaa

SEQ ID NO: 97639 - DNA, 22 bp, Artificial Sequence
  Synthetic oligonucleotide; TTA chr11 5306673 5306694 5306690 5306695 +
ggtctgatctccagaataaaat

SEQ ID NO: 97640 - DNA, 22 bp, Artificial Sequence
  Synthetic oligonucleotide; CTG chr11 5306679 5306700 5306696 5306701 +
atctccagaataaaataaccat

SEQ ID NO: 97641 - DNA, 22 bp, Artificial Sequence
  Synthetic oligonucleotide; CTC chr11 5306684 5306705 5306701 5306706 +
cagaataaaataaccatatatt

SEQ ID NO: 97642 - DNA, 22 bp, Artificial Sequence
  Synthetic oligonucleotide; TTA chr11 5306707 5306728 5306724 5306729 +
gccattatattcatacataatt

SEQ ID NO: 97643 - DNA, 22 bp, Artificial Sequence
  Synthetic oligonucleotide; TTA chr11 5306714 5306735 5306731 5306736 +
tattcatacataatttttttct

SEQ ID NO: 97644 - DNA, 22 bp, Artificial Sequence
  Synthetic oligonucleotide; TTC chr11 5306719 5306740 5306736 5306741 +
atacataatttttttctagatg

SEQ ID NO: 97645 - DNA, 22 bp, Artificial Sequence
  Synthetic oligonucleotide; TTT chr11 5306730 5306751 5306747 5306752 +
ttttctagatgtataaagatat

SEQ ID NO: 97646 - DNA, 22 bp, Artificial Sequence
  Synthetic oligonucleotide; TTT chr11 5306731 5306752 5306748 5306753 +
tttctagatgtataaagatatc

SEQ ID NO: 97647 - DNA, 22 bp, Artificial Sequence
  Synthetic oligonucleotide; TTT chr11 5306732 5306753 5306749 5306754 +
ttctagatgtataaagatatct

SEQ ID NO: 97648 - DNA, 22 bp, Artificial Sequence
  Synthetic oligonucleotide; TTT chr11 5306733 5306754 5306750 5306755 +
tctagatgtataaagatatctg

SEQ ID NO: 97649 - DNA, 22 bp, Artificial Sequence
  Synthetic oligonucleotide; TTT chr11 5306734 5306755 5306751 5306756 +
ctagatgtataaagatatctgc

SEQ ID NO: 97650 - DNA, 22 bp, Artificial Sequence
  Synthetic oligonucleotide; TTC chr11 5306735 5306756 5306752 5306757 +
tagatgtataaagatatctgca

SEQ ID NO: 97651 - DNA, 22 bp, Artificial Sequence
  Synthetic oligonucleotide; CTA chr11 5306737 5306758 5306754 5306759 +
gatgtataaagatatctgcatt

SEQ ID NO: 97652 - DNA, 22 bp, Artificial Sequence
  Synthetic oligonucleotide; CTG chr11 5306755 5306776 5306772 5306777 +
cattaaaaaccctaagacttct

SEQ ID NO: 97653 - DNA, 22 bp, Artificial Sequence
  Synthetic oligonucleotide; TTA chr11 5306760 5306781 5306777 5306782 +
aaaaccctaagacttctttcct

SEQ ID NO: 97654 - DNA, 22 bp, Artificial Sequence
  Synthetic oligonucleotide; CTA chr11 5306769 5306790 5306786 5306791 +
agacttctttcctgatgggtga

SEQ ID NO: 97655 - DNA, 22 bp, Artificial Sequence
  Synthetic oligonucleotide; CTT chr11 5306775 5306796 5306792 5306797 +
ctttcctgatgggtgaaccaat

SEQ ID NO: 97656 - DNA, 22 bp, Artificial Sequence
  Synthetic oligonucleotide; TTC chr11 5306776 5306797 5306793 5306798 +
tttcctgatgggtgaaccaata

SEQ ID NO: 97657 - DNA, 22 bp, Artificial Sequence
  Synthetic oligonucleotide; CTT chr11 5306778 5306799 5306795 5306800 +
tcctgatgggtgaaccaatatc

SEQ ID NO: 97658 - DNA, 22 bp, Artificial Sequence
  Synthetic oligonucleotide; TTT chr11 5306779 5306800 5306796 5306801 +
cctgatgggtgaaccaatatca

SEQ ID NO: 97659 - DNA, 22 bp, Artificial Sequence
  Synthetic oligonucleotide; TTC chr11 5306780 5306801 5306797 5306802 +
ctgatgggtgaaccaatatcaa

SEQ ID NO: 97660 - DNA, 22 bp, Artificial Sequence
  Synthetic oligonucleotide; CTG chr11 5306783 5306804 5306800 5306805 +
atgggtgaaccaatatcaacag

SEQ ID NO: 97661 - DNA, 22 bp, Artificial Sequence
  Synthetic oligonucleotide; CTT chr11 5306810 5306831 5306827 5306832 +
taaatgtttatcatgtaattat

SEQ ID NO: 97662 - DNA, 22 bp, Artificial Sequence
  Synthetic oligonucleotide; TTT chr11 5306811 5306832 5306828 5306833 +
aaatgtttatcatgtaattatt

SEQ ID NO: 97663 - DNA, 22 bp, Artificial Sequence
  Synthetic oligonucleotide; TTA chr11 5306812 5306833 5306829 5306834 +
aatgtttatcatgtaattattc

SEQ ID NO: 97664 - DNA, 22 bp, Artificial Sequence
  Synthetic oligonucleotide; TTT chr11 5306819 5306840 5306836 5306841 +
atcatgtaattattcctaatcc

SEQ ID NO: 97665 - DNA, 22 bp, Artificial Sequence
  Synthetic oligonucleotide; TTA chr11 5306820 5306841 5306837 5306842 +
tcatgtaattattcctaatcct

SEQ ID NO: 97666 - DNA, 22 bp, Artificial Sequence
  Synthetic oligonucleotide; TTA chr11 5306831 5306852 5306848 5306853 +
ttcctaatcctgatttatttcc

SEQ ID NO: 97667 - DNA, 22 bp, Artificial Sequence
  Synthetic oligonucleotide; TTC chr11 5306834 5306855 5306851 5306856 +
ctaatcctgatttatttcctat

SEQ ID NO: 97668 - DNA, 22 bp, Artificial Sequence
  Synthetic oligonucleotide; CTA chr11 5306837 5306858 5306854 5306859 +
atcctgatttatttcctatgat

SEQ ID NO: 97669 - DNA, 22 bp, Artificial Sequence
  Synthetic oligonucleotide; CTG chr11 5306843 5306864 5306860 5306865 +
atttatttcctatgatgctcca

SEQ ID NO: 97670 - DNA, 22 bp, Artificial Sequence
  Synthetic oligonucleotide; TTT chr11 5306847 5306868 5306864 5306869 +
atttcctatgatgctccacctt

SEQ ID NO: 97671 - DNA, 22 bp, Artificial Sequence
  Synthetic oligonucleotide; TTA chr11 5306848 5306869 5306865 5306870 +
tttcctatgatgctccacctta

SEQ ID NO: 97672 - DNA, 22 bp, Artificial Sequence
  Synthetic oligonucleotide; TTT chr11 5306851 5306872 5306868 5306873 +
cctatgatgctccaccttattg

SEQ ID NO: 97673 - DNA, 22 bp, Artificial Sequence
  Synthetic oligonucleotide; TTC chr11 5306852 5306873 5306869 5306874 +
ctatgatgctccaccttattga

SEQ ID NO: 97674 - DNA, 22 bp, Artificial Sequence
  Synthetic oligonucleotide; CTA chr11 5306855 5306876 5306872 5306877 +
tgatgctccaccttattgaaca

SEQ ID NO: 97675 - DNA, 22 bp, Artificial Sequence
  Synthetic oligonucleotide; CTC chr11 5306863 5306884 5306880 5306885 +
caccttattgaacataataatc

SEQ ID NO: 97676 - DNA, 22 bp, Artificial Sequence
  Synthetic oligonucleotide; CTT chr11 5306869 5306890 5306886 5306891 +
attgaacataataatccagatg

SEQ ID NO: 97677 - DNA, 22 bp, Artificial Sequence
  Synthetic oligonucleotide; TTA chr11 5306870 5306891 5306887 5306892 +
ttgaacataataatccagatgt

SEQ ID NO: 97678 - DNA, 22 bp, Artificial Sequence
  Synthetic oligonucleotide; TTG chr11 5306873 5306894 5306890 5306895 +
aacataataatccagatgttgt

SEQ ID NO: 97679 - DNA, 22 bp, Artificial Sequence
  Synthetic oligonucleotide; TTG chr11 5306894 5306915 5306911 5306916 +
tcatattagtcccattctgaaa

SEQ ID NO: 97680 - DNA, 22 bp, Artificial Sequence
  Synthetic oligonucleotide; TTA chr11 5306902 5306923 5306919 5306924 +
gtcccattctgaaatctctttt

SEQ ID NO: 97681 - DNA, 22 bp, Artificial Sequence
  Synthetic oligonucleotide; TTC chr11 5306911 5306932 5306928 5306933 +
tgaaatctcttttttcattgga

SEQ ID NO: 97682 - DNA, 22 bp, Artificial Sequence
  Synthetic oligonucleotide; CTG chr11 5306913 5306934 5306930 5306935 +
aaatctcttttttcattggatt

SEQ ID NO: 97683 - DNA, 22 bp, Artificial Sequence
  Synthetic oligonucleotide; CTC chr11 5306920 5306941 5306937 5306942 +
ttttttcattggattatgtgct

SEQ ID NO: 97684 - DNA, 22 bp, Artificial Sequence
  Synthetic oligonucleotide; CTT chr11 5306922 5306943 5306939 5306944 +
ttttcattggattatgtgctga

SEQ ID NO: 97685 - DNA, 22 bp, Artificial Sequence
  Synthetic oligonucleotide; TTT chr11 5306923 5306944 5306940 5306945 +
tttcattggattatgtgctgag

SEQ ID NO: 97686 - DNA, 22 bp, Artificial Sequence
  Synthetic oligonucleotide; TTT chr11 5306924 5306945 5306941 5306946 +
ttcattggattatgtgctgagt

SEQ ID NO: 97687 - DNA, 22 bp, Artificial Sequence
  Synthetic oligonucleotide; TTT chr11 5306925 5306946 5306942 5306947 +
tcattggattatgtgctgagtt

SEQ ID NO: 97688 - DNA, 22 bp, Artificial Sequence
  Synthetic oligonucleotide; TTT chr11 5306926 5306947 5306943 5306948 +
cattggattatgtgctgagttt

SEQ ID NO: 97689 - DNA, 22 bp, Artificial Sequence
  Synthetic oligonucleotide; TTC chr11 5306927 5306948 5306944 5306949 +
attggattatgtgctgagtttc

SEQ ID NO: 97690 - DNA, 22 bp, Artificial Sequence
  Synthetic oligonucleotide; TTG chr11 5306931 5306952 5306948 5306953 +
gattatgtgctgagtttctatt

SEQ ID NO: 97691 - DNA, 22 bp, Artificial Sequence
  Synthetic oligonucleotide; TTA chr11 5306936 5306957 5306953 5306958 +
tgtgctgagtttctatttaagt

SEQ ID NO: 97692 - DNA, 22 bp, Artificial Sequence
  Synthetic oligonucleotide; CTG chr11 5306943 5306964 5306960 5306965 +
agtttctatttaagtagtctaa

SEQ ID NO: 97693 - DNA, 22 bp, Artificial Sequence
  Synthetic oligonucleotide; TTT chr11 5306948 5306969 5306965 5306970 +
ctatttaagtagtctaagatcg

SEQ ID NO: 97694 - DNA, 22 bp, Artificial Sequence
  Synthetic oligonucleotide; TTC chr11 5306949 5306970 5306966 5306971 +
tatttaagtagtctaagatcgt

SEQ ID NO: 97695 - DNA, 22 bp, Artificial Sequence
  Synthetic oligonucleotide; CTA chr11 5306951 5306972 5306968 5306973 +
tttaagtagtctaagatcgtgc

SEQ ID NO: 97696 - DNA, 22 bp, Artificial Sequence
  Synthetic oligonucleotide; TTT chr11 5306954 5306975 5306971 5306976 +
aagtagtctaagatcgtgcaga

SEQ ID NO: 97697 - DNA, 22 bp, Artificial Sequence
  Synthetic oligonucleotide; TTA chr11 5306955 5306976 5306972 5306977 +
agtagtctaagatcgtgcagat

SEQ ID NO: 97698 - DNA, 22 bp, Artificial Sequence
  Synthetic oligonucleotide; CTA chr11 5306964 5306985 5306981 5306986 +
agatcgtgcagatacacaactc

SEQ ID NO: 97699 - DNA, 22 bp, Artificial Sequence
  Synthetic oligonucleotide; CTC chr11 5306986 5307007 5307003 5307008 +
taccctaaactcttatctcaaa

SEQ ID NO: 97700 - DNA, 22 bp, Artificial Sequence
  Synthetic oligonucleotide; CTA chr11 5306988 5307009 5307005 5307010 +
ccctaaactcttatctcaaaac

SEQ ID NO: 97701 - DNA, 22 bp, Artificial Sequence
  Synthetic oligonucleotide; CTA chr11 5306993 5307014 5307010 5307015 +
aactcttatctcaaaacatgtc

SEQ ID NO: 97702 - DNA, 22 bp, Artificial Sequence
  Synthetic oligonucleotide; CTC chr11 5306998 5307019 5307015 5307020 +
ttatctcaaaacatgtcaaatt

SEQ ID NO: 97703 - DNA, 22 bp, Artificial Sequence
  Synthetic oligonucleotide; CTT chr11 5307000 5307021 5307017 5307022 +
atctcaaaacatgtcaaattca

SEQ ID NO: 97704 - DNA, 22 bp, Artificial Sequence
  Synthetic oligonucleotide; TTA chr11 5307001 5307022 5307018 5307023 +
tctcaaaacatgtcaaattcag

SEQ ID NO: 97705 - DNA, 22 bp, Artificial Sequence
  Synthetic oligonucleotide; CTC chr11 5307005 5307026 5307022 5307027 +
aaaacatgtcaaattcagtctt

SEQ ID NO: 97706 - DNA, 22 bp, Artificial Sequence
  Synthetic oligonucleotide; TTC chr11 5307021 5307042 5307038 5307043 +
agtctttcagatttaaaatagt

SEQ ID NO: 97707 - DNA, 22 bp, Artificial Sequence
  Synthetic oligonucleotide; CTT chr11 5307027 5307048 5307044 5307049 +
tcagatttaaaatagtgataaa

SEQ ID NO: 97708 - DNA, 22 bp, Artificial Sequence
  Synthetic oligonucleotide; TTT chr11 5307028 5307049 5307045 5307050 +
cagatttaaaatagtgataaaa

SEQ ID NO: 97709 - DNA, 22 bp, Artificial Sequence
  Synthetic oligonucleotide; TTC chr11 5307029 5307050 5307046 5307051 +
agatttaaaatagtgataaaat

SEQ ID NO: 97710 - DNA, 22 bp, Artificial Sequence
  Synthetic oligonucleotide; TTT chr11 5307035 5307056 5307052 5307057 +
aaaatagtgataaaatgcatat

SEQ ID NO: 97711 - DNA, 22 bp, Artificial Sequence
  Synthetic oligonucleotide; TTA chr11 5307036 5307057 5307053 5307058 +
aaatagtgataaaatgcatatt

SEQ ID NO: 97712 - DNA, 22 bp, Artificial Sequence
  Synthetic oligonucleotide; TTC chr11 5307059 5307080 5307076 5307081 +
tacataatatatgtgacactcg

SEQ ID NO: 97713 - DNA, 22 bp, Artificial Sequence
  Synthetic oligonucleotide; CTA chr11 5307061 5307082 5307078 5307083 +
cataatatatgtgacactcgca

SEQ ID NO: 97714 - DNA, 22 bp, Artificial Sequence
  Synthetic oligonucleotide; CTC chr11 5307080 5307101 5307097 5307102 +
gcagcaagttactctatttact

SEQ ID NO: 97715 - DNA, 22 bp, Artificial Sequence
  Synthetic oligonucleotide; TTA chr11 5307091 5307112 5307108 5307113 +
ctctatttactatcacctgttt

SEQ ID NO: 97716 - DNA, 22 bp, Artificial Sequence
  Synthetic oligonucleotide; CTC chr11 5307094 5307115 5307111 5307116 +
tatttactatcacctgtttata

SEQ ID NO: 97717 - DNA, 22 bp, Artificial Sequence
  Synthetic oligonucleotide; CTA chr11 5307096 5307117 5307113 5307118 +
tttactatcacctgtttatact

SEQ ID NO: 97718 - DNA, 22 bp, Artificial Sequence
  Synthetic oligonucleotide; TTT chr11 5307099 5307120 5307116 5307121 +
actatcacctgtttatacttag

SEQ ID NO: 97719 - DNA, 22 bp, Artificial Sequence
  Synthetic oligonucleotide; TTA chr11 5307100 5307121 5307117 5307122 +
ctatcacctgtttatacttagg

SEQ ID NO: 97720 - DNA, 22 bp, Artificial Sequence
  Synthetic oligonucleotide; CTA chr11 5307103 5307124 5307120 5307125 +
tcacctgtttatacttagggga

SEQ ID NO: 97721 - DNA, 22 bp, Artificial Sequence
  Synthetic oligonucleotide; CTG chr11 5307110 5307131 5307127 5307132 +
tttatacttaggggaaaaaaac

SEQ ID NO: 97722 - DNA, 22 bp, Artificial Sequence
  Synthetic oligonucleotide; TTT chr11 5307113 5307134 5307130 5307135 +
atacttaggggaaaaaaaccta

SEQ ID NO: 97723 - DNA, 22 bp, Artificial Sequence
  Synthetic oligonucleotide; TTA chr11 5307114 5307135 5307131 5307136 +
tacttaggggaaaaaaacctaa

SEQ ID NO: 97724 - DNA, 22 bp, Artificial Sequence
  Synthetic oligonucleotide; CTT chr11 5307119 5307140 5307136 5307141 +
aggggaaaaaaacctaaatatc

SEQ ID NO: 97725 - DNA, 22 bp, Artificial Sequence
  Synthetic oligonucleotide; TTA chr11 5307120 5307141 5307137 5307142 +
ggggaaaaaaacctaaatatcc

SEQ ID NO: 97726 - DNA, 22 bp, Artificial Sequence
  Synthetic oligonucleotide; CTA chr11 5307135 5307156 5307152 5307157 +
aatatcctctcatatattcagg

SEQ ID NO: 97727 - DNA, 22 bp, Artificial Sequence
  Synthetic oligonucleotide; CTC chr11 5307144 5307165 5307161 5307166 +
tcatatattcaggtaagatttt

SEQ ID NO: 97728 - DNA, 22 bp, Artificial Sequence
  Synthetic oligonucleotide; CTC chr11 5307146 5307167 5307163 5307168 +
atatattcaggtaagattttgc

SEQ ID NO: 97729 - DNA, 22 bp, Artificial Sequence
  Synthetic oligonucleotide; TTC chr11 5307154 5307175 5307171 5307176 +
aggtaagattttgccaaaacgt

SEQ ID NO: 97730 - DNA, 22 bp, Artificial Sequence
  Synthetic oligonucleotide; TTT chr11 5307165 5307186 5307182 5307187 +
tgccaaaacgtgattttaggtc

SEQ ID NO: 97731 - DNA, 22 bp, Artificial Sequence
  Synthetic oligonucleotide; TTT chr11 5307166 5307187 5307183 5307188 +
gccaaaacgtgattttaggtca

SEQ ID NO: 97732 - DNA, 22 bp, Artificial Sequence
  Synthetic oligonucleotide; TTG chr11 5307167 5307188 5307184 5307189 +
ccaaaacgtgattttaggtcat

SEQ ID NO: 97733 - DNA, 22 bp, Artificial Sequence
  Synthetic oligonucleotide; TTT chr11 5307181 5307202 5307198 5307203 +
taggtcatacagcaataaatgc

SEQ ID NO: 97734 - DNA, 22 bp, Artificial Sequence
  Synthetic oligonucleotide; TTT chr11 5307182 5307203 5307199 5307204 +
aggtcatacagcaataaatgca

SEQ ID NO: 97735 - DNA, 22 bp, Artificial Sequence
  Synthetic oligonucleotide; TTA chr11 5307183 5307204 5307200 5307205 +
ggtcatacagcaataaatgcat

SEQ ID NO: 97736 - DNA, 22 bp, Artificial Sequence
  Synthetic oligonucleotide; TTC chr11 5307207 5307228 5307224 5307229 +
cagaattcattttgcagaacct

SEQ ID NO: 97737 - DNA, 22 bp, Artificial Sequence
  Synthetic oligonucleotide; TTC chr11 5307215 5307236 5307232 5307237 +
attttgcagaacctgttgattc

SEQ ID NO: 97738 - DNA, 22 bp, Artificial Sequence
  Synthetic oligonucleotide; TTT chr11 5307219 5307240 5307236 5307241 +
tgcagaacctgttgattctaga

SEQ ID NO: 97739 - DNA, 22 bp, Artificial Sequence
  Synthetic oligonucleotide; TTT chr11 5307220 5307241 5307237 5307242 +
gcagaacctgttgattctagac

SEQ ID NO: 97740 - DNA, 22 bp, Artificial Sequence
  Synthetic oligonucleotide; TTG chr11 5307221 5307242 5307238 5307243 +
cagaacctgttgattctagact

SEQ ID NO: 97741 - DNA, 22 bp, Artificial Sequence
  Synthetic oligonucleotide; CTG chr11 5307230 5307251 5307247 5307252 +
ttgattctagacttgtagctaa

SEQ ID NO: 97742 - DNA, 22 bp, Artificial Sequence
  Synthetic oligonucleotide; TTG chr11 5307233 5307254 5307250 5307255 +
attctagacttgtagctaagaa

SEQ ID NO: 97743 - DNA, 22 bp, Artificial Sequence
  Synthetic oligonucleotide; TTC chr11 5307237 5307258 5307254 5307259 +
tagacttgtagctaagaagtga

SEQ ID NO: 97744 - DNA, 22 bp, Artificial Sequence
  Synthetic oligonucleotide; CTA chr11 5307239 5307260 5307256 5307261 +
gacttgtagctaagaagtgacg

SEQ ID NO: 97745 - DNA, 22 bp, Artificial Sequence
  Synthetic oligonucleotide; CTT chr11 5307244 5307265 5307261 5307266 +
gtagctaagaagtgacggcttg

SEQ ID NO: 97746 - DNA, 22 bp, Artificial Sequence
  Synthetic oligonucleotide; TTG chr11 5307245 5307266 5307262 5307267 +
tagctaagaagtgacggcttgg

SEQ ID NO: 97747 - DNA, 22 bp, Artificial Sequence
  Synthetic oligonucleotide; CTA chr11 5307251 5307272 5307268 5307273 +
agaagtgacggcttggtaaata

SEQ ID NO: 97748 - DNA, 22 bp, Artificial Sequence
  Synthetic oligonucleotide; CTT chr11 5307265 5307286 5307282 5307287 +
ggtaaataaccatatcataaag

SEQ ID NO: 97749 - DNA, 22 bp, Artificial Sequence
  Synthetic oligonucleotide; TTG chr11 5307266 5307287 5307283 5307288 +
gtaaataaccatatcataaagt

SEQ ID NO: 97750 - DNA, 22 bp, Artificial Sequence
  Synthetic oligonucleotide; TTC chr11 5307294 5307315 5307311 5307316 +
tctttgtactcacagtaaaaca

SEQ ID NO: 97751 - DNA, 22 bp, Artificial Sequence
  Synthetic oligonucleotide; CTC chr11 5307296 5307317 5307313 5307318 +
tttgtactcacagtaaaacaaa

SEQ ID NO: 97752 - DNA, 22 bp, Artificial Sequence
  Synthetic oligonucleotide; CTT chr11 5307298 5307319 5307315 5307320 +
tgtactcacagtaaaacaaaac

SEQ ID NO: 97753 - DNA, 22 bp, Artificial Sequence
  Synthetic oligonucleotide; TTT chr11 5307299 5307320 5307316 5307321 +
gtactcacagtaaaacaaaact

SEQ ID NO: 97754 - DNA, 22 bp, Artificial Sequence
  Synthetic oligonucleotide; TTG chr11 5307300 5307321 5307317 5307322 +
tactcacagtaaaacaaaactt

SEQ ID NO: 97755 - DNA, 22 bp, Artificial Sequence
  Synthetic oligonucleotide; CTC chr11 5307305 5307326 5307322 5307327 +
acagtaaaacaaaacttctgaa

SEQ ID NO: 97756 - DNA, 22 bp, Artificial Sequence
  Synthetic oligonucleotide; CTT chr11 5307322 5307343 5307339 5307344 +
ctgaaagattttaagtgagtga

SEQ ID NO: 97757 - DNA, 22 bp, Artificial Sequence
  Synthetic oligonucleotide; TTC chr11 5307323 5307344 5307340 5307345 +
tgaaagattttaagtgagtgac

SEQ ID NO: 97758 - DNA, 22 bp, Artificial Sequence
  Synthetic oligonucleotide; CTG chr11 5307325 5307346 5307342 5307347 +
aaagattttaagtgagtgacat

SEQ ID NO: 97759 - DNA, 22 bp, Artificial Sequence
  Synthetic oligonucleotide; TTT chr11 5307333 5307354 5307350 5307355 +
taagtgagtgacattttcagtg

SEQ ID NO: 97760 - DNA, 22 bp, Artificial Sequence
  Synthetic oligonucleotide; TTT chr11 5307334 5307355 5307351 5307356 +
aagtgagtgacattttcagtgc

SEQ ID NO: 97761 - DNA, 22 bp, Artificial Sequence
  Synthetic oligonucleotide; TTA chr11 5307335 5307356 5307352 5307357 +
agtgagtgacattttcagtgct

SEQ ID NO: 97762 - DNA, 22 bp, Artificial Sequence
  Synthetic oligonucleotide; TTT chr11 5307349 5307370 5307366 5307371 +
tcagtgcttaaaatggagctta

SEQ ID NO: 97763 - DNA, 22 bp, Artificial Sequence
  Synthetic oligonucleotide; TTT chr11 5307350 5307371 5307367 5307372 +
cagtgcttaaaatggagcttaa

SEQ ID NO: 97764 - DNA, 22 bp, Artificial Sequence
  Synthetic oligonucleotide; TTC chr11 5307351 5307372 5307368 5307373 +
agtgcttaaaatggagcttaac

SEQ ID NO: 97765 - DNA, 22 bp, Artificial Sequence
  Synthetic oligonucleotide; CTT chr11 5307358 5307379 5307375 5307380 +
aaaatggagcttaacatatagt

SEQ ID NO: 97766 - DNA, 22 bp, Artificial Sequence
  Synthetic oligonucleotide; TTA chr11 5307359 5307380 5307376 5307381 +
aaatggagcttaacatatagtg

SEQ ID NO: 97767 - DNA, 22 bp, Artificial Sequence
  Synthetic oligonucleotide; CTT chr11 5307370 5307391 5307387 5307392 +
aacatatagtgggtgctcagta

SEQ ID NO: 97768 - DNA, 22 bp, Artificial Sequence
  Synthetic oligonucleotide; TTA chr11 5307371 5307392 5307388 5307393 +
acatatagtgggtgctcagtaa

SEQ ID NO: 97769 - DNA, 22 bp, Artificial Sequence
  Synthetic oligonucleotide; CTC chr11 5307388 5307409 5307405 5307410 +
agtaagtactagttaagcaaat

SEQ ID NO: 97770 - DNA, 22 bp, Artificial Sequence
  Synthetic oligonucleotide; CTA chr11 5307399 5307420 5307416 5307421 +
gttaagcaaatgaatgctattc

SEQ ID NO: 97771 - DNA, 22 bp, Artificial Sequence
  Synthetic oligonucleotide; TTA chr11 5307403 5307424 5307420 5307425 +
agcaaatgaatgctattcttgt

SEQ ID NO: 97772 - DNA, 22 bp, Artificial Sequence
  Synthetic oligonucleotide; CTA chr11 5307418 5307439 5307435 5307440 +
ttcttgtgatcaagccattggt

SEQ ID NO: 97773 - DNA, 22 bp, Artificial Sequence
  Synthetic oligonucleotide; TTC chr11 5307421 5307442 5307438 5307443 +
ttgtgatcaagccattggtttt

SEQ ID NO: 97774 - DNA, 22 bp, Artificial Sequence
  Synthetic oligonucleotide; CTT chr11 5307423 5307444 5307440 5307445 +
gtgatcaagccattggttttgt

SEQ ID NO: 97775 - DNA, 22 bp, Artificial Sequence
  Synthetic oligonucleotide; TTG chr11 5307424 5307445 5307441 5307446 +
tgatcaagccattggttttgta

SEQ ID NO: 97776 - DNA, 22 bp, Artificial Sequence
  Synthetic oligonucleotide; TTG chr11 5307438 5307459 5307455 5307460 +
gttttgtagccaaattgtagac

SEQ ID NO: 97777 - DNA, 22 bp, Artificial Sequence
  Synthetic oligonucleotide; TTT chr11 5307442 5307463 5307459 5307464 +
tgtagccaaattgtagaccttt

SEQ ID NO: 97778 - DNA, 22 bp, Artificial Sequence
  Synthetic oligonucleotide; TTT chr11 5307443 5307464 5307460 5307465 +
gtagccaaattgtagaccttta

SEQ ID NO: 97779 - DNA, 22 bp, Artificial Sequence
  Synthetic oligonucleotide; TTG chr11 5307444 5307465 5307461 5307466 +
tagccaaattgtagacctttac

SEQ ID NO: 97780 - DNA, 22 bp, Artificial Sequence
  Synthetic oligonucleotide; TTG chr11 5307455 5307476 5307472 5307477 +
tagacctttacaacctctacat

SEQ ID NO: 97781 - DNA, 22 bp, Artificial Sequence
  Synthetic oligonucleotide; CTT chr11 5307463 5307484 5307480 5307485 +
tacaacctctacatctgtttgt

SEQ ID NO: 97782 - DNA, 22 bp, Artificial Sequence
  Synthetic oligonucleotide; TTT chr11 5307464 5307485 5307481 5307486 +
acaacctctacatctgtttgta

SEQ ID NO: 97783 - DNA, 22 bp, Artificial Sequence
  Synthetic oligonucleotide; TTA chr11 5307465 5307486 5307482 5307487 +
caacctctacatctgtttgtaa

SEQ ID NO: 97784 - DNA, 22 bp, Artificial Sequence
  Synthetic oligonucleotide; CTC chr11 5307472 5307493 5307489 5307494 +
tacatctgtttgtaataagatt

SEQ ID NO: 97785 - DNA, 22 bp, Artificial Sequence
  Synthetic oligonucleotide; CTA chr11 5307474 5307495 5307491 5307496 +
catctgtttgtaataagattac

SEQ ID NO: 97786 - DNA, 22 bp, Artificial Sequence
  Synthetic oligonucleotide; CTG chr11 5307480 5307501 5307497 5307502 +
tttgtaataagattactagttc

SEQ ID NO: 97787 - DNA, 22 bp, Artificial Sequence
  Synthetic oligonucleotide; TTT chr11 5307483 5307504 5307500 5307505 +
gtaataagattactagttcaag

SEQ ID NO: 97788 - DNA, 22 bp, Artificial Sequence
  Synthetic oligonucleotide; TTG chr11 5307484 5307505 5307501 5307506 +
taataagattactagttcaagc

SEQ ID NO: 97789 - DNA, 22 bp, Artificial Sequence
  Synthetic oligonucleotide; TTA chr11 5307495 5307516 5307512 5307517 +
ctagttcaagcatgccaaacaa

SEQ ID NO: 97790 - DNA, 22 bp, Artificial Sequence
  Synthetic oligonucleotide; CTA chr11 5307498 5307519 5307515 5307520 +
gttcaagcatgccaaacaatgc

SEQ ID NO: 97791 - DNA, 22 bp, Artificial Sequence
  Synthetic oligonucleotide; TTC chr11 5307502 5307523 5307519 5307524 +
aagcatgccaaacaatgctatc

SEQ ID NO: 97792 - DNA, 22 bp, Artificial Sequence
  Synthetic oligonucleotide; CTA chr11 5307522 5307543 5307539 5307544 +
tctccttttctttattgtttag

SEQ ID NO: 97793 - DNA, 22 bp, Artificial Sequence
  Synthetic oligonucleotide; CTC chr11 5307526 5307547 5307543 5307548 +
cttttctttattgtttagtact

SEQ ID NO: 97794 - DNA, 22 bp, Artificial Sequence
  Synthetic oligonucleotide; CTT chr11 5307529 5307550 5307546 5307551 +
ttctttattgtttagtacttcg

SEQ ID NO: 97795 - DNA, 22 bp, Artificial Sequence
  Synthetic oligonucleotide; TTT chr11 5307530 5307551 5307547 5307552 +
tctttattgtttagtacttcga

SEQ ID NO: 97796 - DNA, 22 bp, Artificial Sequence
  Synthetic oligonucleotide; TTT chr11 5307531 5307552 5307548 5307553 +
ctttattgtttagtacttcgat

SEQ ID NO: 97797 - DNA, 22 bp, Artificial Sequence
  Synthetic oligonucleotide; TTC chr11 5307532 5307553 5307549 5307554 +
tttattgtttagtacttcgatg

SEQ ID NO: 97798 - DNA, 22 bp, Artificial Sequence
  Synthetic oligonucleotide; CTT chr11 5307534 5307555 5307551 5307556 +
tattgtttagtacttcgatgtc

SEQ ID NO: 97799 - DNA, 22 bp, Artificial Sequence
  Synthetic oligonucleotide; TTT chr11 5307535 5307556 5307552 5307557 +
attgtttagtacttcgatgtct

SEQ ID NO: 97800 - DNA, 22 bp, Artificial Sequence
  Synthetic oligonucleotide; TTA chr11 5307536 5307557 5307553 5307558 +
ttgtttagtacttcgatgtctc

SEQ ID NO: 97801 - DNA, 22 bp, Artificial Sequence
  Synthetic oligonucleotide; TTG chr11 5307539 5307560 5307556 5307561 +
tttagtacttcgatgtctctaa

SEQ ID NO: 97802 - DNA, 22 bp, Artificial Sequence
  Synthetic oligonucleotide; TTT chr11 5307542 5307563 5307559 5307564 +
agtacttcgatgtctctaattt

SEQ ID NO: 97803 - DNA, 22 bp, Artificial Sequence
  Synthetic oligonucleotide; TTA chr11 5307543 5307564 5307560 5307565 +
gtacttcgatgtctctaatttt

SEQ ID NO: 97804 - DNA, 22 bp, Artificial Sequence
  Synthetic oligonucleotide; CTT chr11 5307549 5307570 5307566 5307571 +
cgatgtctctaatttttacatc

SEQ ID NO: 97805 - DNA, 22 bp, Artificial Sequence
  Synthetic oligonucleotide; TTC chr11 5307550 5307571 5307567 5307572 +
gatgtctctaatttttacatca

SEQ ID NO: 97806 - DNA, 22 bp, Artificial Sequence
  Synthetic oligonucleotide; CTC chr11 5307558 5307579 5307575 5307580 +
taatttttacatcaatcatggt

SEQ ID NO: 97807 - DNA, 22 bp, Artificial Sequence
  Synthetic oligonucleotide; CTA chr11 5307560 5307581 5307577 5307582 +
atttttacatcaatcatggttc

SEQ ID NO: 97808 - DNA, 22 bp, Artificial Sequence
  Synthetic oligonucleotide; TTT chr11 5307564 5307585 5307581 5307586 +
ttacatcaatcatggttcagag

SEQ ID NO: 97809 - DNA, 22 bp, Artificial Sequence
  Synthetic oligonucleotide; TTT chr11 5307565 5307586 5307582 5307587 +
tacatcaatcatggttcagaga

SEQ ID NO: 97810 - DNA, 22 bp, Artificial Sequence
  Synthetic oligonucleotide; TTT chr11 5307566 5307587 5307583 5307588 +
acatcaatcatggttcagagaa

SEQ ID NO: 97811 - DNA, 22 bp, Artificial Sequence
  Synthetic oligonucleotide; TTA chr11 5307567 5307588 5307584 5307589 +
catcaatcatggttcagagaaa

SEQ ID NO: 97812 - DNA, 22 bp, Artificial Sequence
  Synthetic oligonucleotide; TTC chr11 5307582 5307603 5307599 5307604 +
agagaaaaatccataacaacat

SEQ ID NO: 97813 - DNA, 22 bp, Artificial Sequence
  Synthetic oligonucleotide; TTT chr11 5307619 5307640 5307636 5307641 +
tttgaagtttccttccttcctc

SEQ ID NO: 97814 - DNA, 22 bp, Artificial Sequence
  Synthetic oligonucleotide; TTT chr11 5307620 5307641 5307637 5307642 +
ttgaagtttccttccttcctcc

SEQ ID NO: 97815 - DNA, 22 bp, Artificial Sequence
  Synthetic oligonucleotide; TTT chr11 5307621 5307642 5307638 5307643 +
tgaagtttccttccttcctccc

SEQ ID NO: 97816 - DNA, 22 bp, Artificial Sequence
  Synthetic oligonucleotide; TTT chr11 5307622 5307643 5307639 5307644 +
gaagtttccttccttcctccct

SEQ ID NO: 97817 - DNA, 22 bp, Artificial Sequence
  Synthetic oligonucleotide; TTG chr11 5307623 5307644 5307640 5307645 +
aagtttccttccttcctccctc

SEQ ID NO: 97818 - DNA, 22 bp, Artificial Sequence
  Synthetic oligonucleotide; TTT chr11 5307629 5307650 5307646 5307651 +
ccttccttcctccctccctccc

SEQ ID NO: 97819 - DNA, 22 bp, Artificial Sequence
  Synthetic oligonucleotide; TTC chr11 5307630 5307651 5307647 5307652 +
cttccttcctccctccctccct

SEQ ID NO: 97820 - DNA, 22 bp, Artificial Sequence
  Synthetic oligonucleotide; CTT chr11 5307633 5307654 5307650 5307655 +
ccttcctccctccctccctccc

SEQ ID NO: 97821 - DNA, 22 bp, Artificial Sequence
  Synthetic oligonucleotide; TTC chr11 5307634 5307655 5307651 5307656 +
cttcctccctccctccctcccc

SEQ ID NO: 97822 - DNA, 22 bp, Artificial Sequence
  Synthetic oligonucleotide; CTT chr11 5307637 5307658 5307654 5307659 +
cctccctccctccctccccctt

SEQ ID NO: 97823 - DNA, 22 bp, Artificial Sequence
  Synthetic oligonucleotide; TTC chr11 5307638 5307659 5307655 5307660 +
ctccctccctccctcccccttc

SEQ ID NO: 97824 - DNA, 22 bp, Artificial Sequence
  Synthetic oligonucleotide; CTC chr11 5307641 5307662 5307658 5307663 +
cctccctccctcccccttcccc

SEQ ID NO: 97825 - DNA, 22 bp, Artificial Sequence
  Synthetic oligonucleotide; CTC chr11 5307645 5307666 5307662 5307667 +
cctccctcccccttcccccttc

SEQ ID NO: 97826 - DNA, 22 bp, Artificial Sequence
  Synthetic oligonucleotide; CTC chr11 5307649 5307670 5307666 5307671 +
cctcccccttcccccttccccc

SEQ ID NO: 97827 - DNA, 22 bp, Artificial Sequence
  Synthetic oligonucleotide; CTC chr11 5307653 5307674 5307670 5307675 +
ccccttcccccttcccccttcc

SEQ ID NO: 97828 - DNA, 22 bp, Artificial Sequence
  Synthetic oligonucleotide; CTT chr11 5307659 5307680 5307676 5307681 +
cccccttcccccttccctcctt

SEQ ID NO: 97829 - DNA, 22 bp, Artificial Sequence
  Synthetic oligonucleotide; TTC chr11 5307660 5307681 5307677 5307682 +
ccccttcccccttccctccttc

SEQ ID NO: 97830 - DNA, 22 bp, Artificial Sequence
  Synthetic oligonucleotide; CTT chr11 5307666 5307687 5307683 5307688 +
cccccttccctccttccctcct

SEQ ID NO: 97831 - DNA, 22 bp, Artificial Sequence
  Synthetic oligonucleotide; TTC chr11 5307667 5307688 5307684 5307689 +
ccccttccctccttccctcctt

SEQ ID NO: 97832 - DNA, 22 bp, Artificial Sequence
  Synthetic oligonucleotide; CTT chr11 5307673 5307694 5307690 5307695 +
ccctccttccctccttccctca

SEQ ID NO: 97833 - DNA, 22 bp, Artificial Sequence
  Synthetic oligonucleotide; TTC chr11 5307674 5307695 5307691 5307696 +
cctccttccctccttccctcat

SEQ ID NO: 97834 - DNA, 22 bp, Artificial Sequence
  Synthetic oligonucleotide; CTC chr11 5307678 5307699 5307695 5307700 +
cttccctccttccctcattcct

SEQ ID NO: 97835 - DNA, 22 bp, Artificial Sequence
  Synthetic oligonucleotide; CTT chr11 5307681 5307702 5307698 5307703 +
ccctccttccctcattccttcc

SEQ ID NO: 97836 - DNA, 22 bp, Artificial Sequence
  Synthetic oligonucleotide; TTC chr11 5307682 5307703 5307699 5307704 +
cctccttccctcattccttcct

SEQ ID NO: 97837 - DNA, 22 bp, Artificial Sequence
  Synthetic oligonucleotide; CTC chr11 5307686 5307707 5307703 5307708 +
cttccctcattccttcctttct

SEQ ID NO: 97838 - DNA, 22 bp, Artificial Sequence
  Synthetic oligonucleotide; CTT chr11 5307689 5307710 5307706 5307711 +
ccctcattccttcctttctttt

SEQ ID NO: 97839 - DNA, 22 bp, Artificial Sequence
  Synthetic oligonucleotide; TTC chr11 5307690 5307711 5307707 5307712 +
cctcattccttcctttcttttt

SEQ ID NO: 97840 - DNA, 22 bp, Artificial Sequence
  Synthetic oligonucleotide; CTC chr11 5307694 5307715 5307711 5307716 +
attccttcctttcttttttctt

SEQ ID NO: 97841 - DNA, 22 bp, Artificial Sequence
  Synthetic oligonucleotide; TTC chr11 5307698 5307719 5307715 5307720 +
cttcctttcttttttctttctt

SEQ ID NO: 97842 - DNA, 22 bp, Artificial Sequence
  Synthetic oligonucleotide; CTT chr11 5307701 5307722 5307718 5307723 +
cctttcttttttctttctttcc

SEQ ID NO: 97843 - DNA, 22 bp, Artificial Sequence
  Synthetic oligonucleotide; TTC chr11 5307702 5307723 5307719 5307724 +
ctttcttttttctttctttcct

SEQ ID NO: 97844 - DNA, 22 bp, Artificial Sequence
  Synthetic oligonucleotide; CTT chr11 5307705 5307726 5307722 5307727 +
tcttttttctttctttccttat

SEQ ID NO: 97845 - DNA, 22 bp, Artificial Sequence
  Synthetic oligonucleotide; TTT chr11 5307706 5307727 5307723 5307728 +
cttttttctttctttccttatt

SEQ ID NO: 97846 - DNA, 22 bp, Artificial Sequence
  Synthetic oligonucleotide; TTC chr11 5307707 5307728 5307724 5307729 +
ttttttctttctttccttattt

SEQ ID NO: 97847 - DNA, 22 bp, Artificial Sequence
  Synthetic oligonucleotide; CTT chr11 5307709 5307730 5307726 5307731 +
ttttctttctttccttatttct

SEQ ID NO: 97848 - DNA, 22 bp, Artificial Sequence
  Synthetic oligonucleotide; TTT chr11 5307710 5307731 5307727 5307732 +
tttctttctttccttatttctc

SEQ ID NO: 97849 - DNA, 22 bp, Artificial Sequence
  Synthetic oligonucleotide; TTT chr11 5307711 5307732 5307728 5307733 +
ttctttctttccttatttctct

SEQ ID NO: 97850 - DNA, 22 bp, Artificial Sequence
  Synthetic oligonucleotide; TTT chr11 5307712 5307733 5307729 5307734 +
tctttctttccttatttctctc

SEQ ID NO: 97851 - DNA, 22 bp, Artificial Sequence
  Synthetic oligonucleotide; TTT chr11 5307713 5307734 5307730 5307735 +
ctttctttccttatttctctct

SEQ ID NO: 97852 - DNA, 22 bp, Artificial Sequence
  Synthetic oligonucleotide; TTC chr11 5307714 5307735 5307731 5307736 +
tttctttccttatttctctctc

SEQ ID NO: 97853 - DNA, 22 bp, Artificial Sequence
  Synthetic oligonucleotide; CTT chr11 5307716 5307737 5307733 5307738 +
tctttccttatttctctctctc

SEQ ID NO: 97854 - DNA, 22 bp, Artificial Sequence
  Synthetic oligonucleotide; TTT chr11 5307717 5307738 5307734 5307739 +
ctttccttatttctctctctct

SEQ ID NO: 97855 - DNA, 22 bp, Artificial Sequence
  Synthetic oligonucleotide; TTC chr11 5307718 5307739 5307735 5307740 +
tttccttatttctctctctctt

SEQ ID NO: 97856 - DNA, 22 bp, Artificial Sequence
  Synthetic oligonucleotide; CTT chr11 5307720 5307741 5307737 5307742 +
tccttatttctctctctctttt

SEQ ID NO: 97857 - DNA, 22 bp, Artificial Sequence
  Synthetic oligonucleotide; TTT chr11 5307721 5307742 5307738 5307743 +
ccttatttctctctctcttttt

SEQ ID NO: 97858 - DNA, 22 bp, Artificial Sequence
  Synthetic oligonucleotide; TTC chr11 5307722 5307743 5307739 5307744 +
cttatttctctctctctttttc

SEQ ID NO: 97859 - DNA, 22 bp, Artificial Sequence
  Synthetic oligonucleotide; CTT chr11 5307725 5307746 5307742 5307747 +
atttctctctctctttttcttc

SEQ ID NO: 97860 - DNA, 22 bp, Artificial Sequence
  Synthetic oligonucleotide; TTA chr11 5307726 5307747 5307743 5307748 +
tttctctctctctttttcttcc

SEQ ID NO: 97861 - DNA, 22 bp, Artificial Sequence
  Synthetic oligonucleotide; TTT chr11 5307729 5307750 5307746 5307751 +
ctctctctctttttcttccttc

SEQ ID NO: 97862 - DNA, 22 bp, Artificial Sequence
  Synthetic oligonucleotide; TTC chr11 5307730 5307751 5307747 5307752 +
tctctctctttttcttccttcc

SEQ ID NO: 97863 - DNA, 22 bp, Artificial Sequence
  Synthetic oligonucleotide; CTC chr11 5307732 5307753 5307749 5307754 +
tctctctttttcttccttcctt

SEQ ID NO: 97864 - DNA, 22 bp, Artificial Sequence
  Synthetic oligonucleotide; CTC chr11 5307734 5307755 5307751 5307756 +
tctctttttcttccttccttcc

SEQ ID NO: 97865 - DNA, 22 bp, Artificial Sequence
  Synthetic oligonucleotide; CTC chr11 5307736 5307757 5307753 5307758 +
tctttttcttccttccttcctt

SEQ ID NO: 97866 - DNA, 22 bp, Artificial Sequence
  Synthetic oligonucleotide; CTC chr11 5307738 5307759 5307755 5307760 +
tttttcttccttccttcctttc

SEQ ID NO: 97867 - DNA, 22 bp, Artificial Sequence
  Synthetic oligonucleotide; CTT chr11 5307740 5307761 5307757 5307762 +
tttcttccttccttcctttctt

SEQ ID NO: 97868 - DNA, 22 bp, Artificial Sequence
  Synthetic oligonucleotide; TTT chr11 5307741 5307762 5307758 5307763 +
ttcttccttccttcctttcttt

SEQ ID NO: 97869 - DNA, 22 bp, Artificial Sequence
  Synthetic oligonucleotide; TTT chr11 5307742 5307763 5307759 5307764 +
tcttccttccttcctttctttc

SEQ ID NO: 97870 - DNA, 22 bp, Artificial Sequence
  Synthetic oligonucleotide; TTT chr11 5307743 5307764 5307760 5307765 +
cttccttccttcctttctttct

SEQ ID NO: 97871 - DNA, 22 bp, Artificial Sequence
  Synthetic oligonucleotide; TTC chr11 5307744 5307765 5307761 5307766 +
ttccttccttcctttctttctc

SEQ ID NO: 97872 - DNA, 22 bp, Artificial Sequence
  Synthetic oligonucleotide; CTT chr11 5307746 5307767 5307763 5307768 +
ccttccttcctttctttctccc

SEQ ID NO: 97873 - DNA, 22 bp, Artificial Sequence
  Synthetic oligonucleotide; TTC chr11 5307747 5307768 5307764 5307769 +
cttccttcctttctttctccct

SEQ ID NO: 97874 - DNA, 22 bp, Artificial Sequence
  Synthetic oligonucleotide; CTT chr11 5307750 5307771 5307767 5307772 +
ccttcctttctttctccctttc

SEQ ID NO: 97875 - DNA, 22 bp, Artificial Sequence
  Synthetic oligonucleotide; TTC chr11 5307751 5307772 5307768 5307773 +
cttcctttctttctccctttcc

SEQ ID NO: 97876 - DNA, 22 bp, Artificial Sequence
  Synthetic oligonucleotide; CTT chr11 5307754 5307775 5307771 5307776 +
cctttctttctccctttccttt

SEQ ID NO: 97877 - DNA, 22 bp, Artificial Sequence
  Synthetic oligonucleotide; TTC chr11 5307755 5307776 5307772 5307777 +
ctttctttctccctttcctttc

SEQ ID NO: 97878 - DNA, 22 bp, Artificial Sequence
  Synthetic oligonucleotide; CTT chr11 5307758 5307779 5307775 5307780 +
tctttctccctttcctttcctt

SEQ ID NO: 97879 - DNA, 22 bp, Artificial Sequence
  Synthetic oligonucleotide; TTT chr11 5307759 5307780 5307776 5307781 +
ctttctccctttcctttccttt

SEQ ID NO: 97880 - DNA, 22 bp, Artificial Sequence
  Synthetic oligonucleotide; TTC chr11 5307760 5307781 5307777 5307782 +
tttctccctttcctttcctttc

SEQ ID NO: 97881 - DNA, 22 bp, Artificial Sequence
  Synthetic oligonucleotide; CTT chr11 5307762 5307783 5307779 5307784 +
tctccctttcctttcctttcct

SEQ ID NO: 97882 - DNA, 22 bp, Artificial Sequence
  Synthetic oligonucleotide; TTT chr11 5307763 5307784 5307780 5307785 +
ctccctttcctttcctttcctt

SEQ ID NO: 97883 - DNA, 22 bp, Artificial Sequence
  Synthetic oligonucleotide; TTC chr11 5307764 5307785 5307781 5307786 +
tccctttcctttcctttccttt

SEQ ID NO: 97884 - DNA, 22 bp, Artificial Sequence
  Synthetic oligonucleotide; CTC chr11 5307766 5307787 5307783 5307788 +
cctttcctttcctttcctttta

SEQ ID NO: 97885 - DNA, 22 bp, Artificial Sequence
  Synthetic oligonucleotide; CTT chr11 5307770 5307791 5307787 5307792 +
tcctttcctttccttttattct

SEQ ID NO: 97886 - DNA, 22 bp, Artificial Sequence
  Synthetic oligonucleotide; TTT chr11 5307771 5307792 5307788 5307793 +
cctttcctttccttttattctc

SEQ ID NO: 97887 - DNA, 22 bp, Artificial Sequence
  Synthetic oligonucleotide; TTC chr11 5307772 5307793 5307789 5307794 +
ctttcctttccttttattctct

SEQ ID NO: 97888 - DNA, 22 bp, Artificial Sequence
  Synthetic oligonucleotide; CTT chr11 5307775 5307796 5307792 5307797 +
tcctttccttttattctctttt

SEQ ID NO: 97889 - DNA, 22 bp, Artificial Sequence
  Synthetic oligonucleotide; TTT chr11 5307776 5307797 5307793 5307798 +
cctttccttttattctcttttc

SEQ ID NO: 97890 - DNA, 22 bp, Artificial Sequence
  Synthetic oligonucleotide; TTC chr11 5307777 5307798 5307794 5307799 +
ctttccttttattctcttttct

SEQ ID NO: 97891 - DNA, 22 bp, Artificial Sequence
  Synthetic oligonucleotide; CTT chr11 5307780 5307801 5307797 5307802 +
tccttttattctcttttctttt

SEQ ID NO: 97892 - DNA, 22 bp, Artificial Sequence
  Synthetic oligonucleotide; TTT chr11 5307781 5307802 5307798 5307803 +
ccttttattctcttttcttttc

SEQ ID NO: 97893 - DNA, 22 bp, Artificial Sequence
  Synthetic oligonucleotide; TTC chr11 5307782 5307803 5307799 5307804 +
cttttattctcttttcttttct

SEQ ID NO: 97894 - DNA, 22 bp, Artificial Sequence
  Synthetic oligonucleotide; CTT chr11 5307785 5307806 5307802 5307807 +
ttattctcttttcttttctttc

SEQ ID NO: 97895 - DNA, 22 bp, Artificial Sequence
  Synthetic oligonucleotide; TTT chr11 5307786 5307807 5307803 5307808 +
tattctcttttcttttctttcc

SEQ ID NO: 97896 - DNA, 22 bp, Artificial Sequence
  Synthetic oligonucleotide; TTT chr11 5307787 5307808 5307804 5307809 +
attctcttttcttttctttcct

SEQ ID NO: 97897 - DNA, 22 bp, Artificial Sequence
  Synthetic oligonucleotide; TTA chr11 5307788 5307809 5307805 5307810 +
ttctcttttcttttctttcctc

SEQ ID NO: 97898 - DNA, 22 bp, Artificial Sequence
  Synthetic oligonucleotide; TTC chr11 5307791 5307812 5307808 5307813 +
tcttttcttttctttcctctct

SEQ ID NO: 97899 - DNA, 22 bp, Artificial Sequence
  Synthetic oligonucleotide; CTC chr11 5307793 5307814 5307810 5307815 +
ttttcttttctttcctctcttt

SEQ ID NO: 97900 - DNA, 22 bp, Artificial Sequence
  Synthetic oligonucleotide; CTT chr11 5307795 5307816 5307812 5307817 +
ttcttttctttcctctcttttg

SEQ ID NO: 97901 - DNA, 22 bp, Artificial Sequence
  Synthetic oligonucleotide; TTT chr11 5307796 5307817 5307813 5307818 +
tcttttctttcctctcttttga

SEQ ID NO: 97902 - DNA, 22 bp, Artificial Sequence
  Synthetic oligonucleotide; TTT chr11 5307797 5307818 5307814 5307819 +
cttttctttcctctcttttgag

SEQ ID NO: 97903 - DNA, 22 bp, Artificial Sequence
  Synthetic oligonucleotide; TTC chr11 5307798 5307819 5307815 5307820 +
ttttctttcctctcttttgaga

SEQ ID NO: 97904 - DNA, 22 bp, Artificial Sequence
  Synthetic oligonucleotide; CTT chr11 5307800 5307821 5307817 5307822 +
ttctttcctctcttttgagaca

SEQ ID NO: 97905 - DNA, 22 bp, Artificial Sequence
  Synthetic oligonucleotide; TTT chr11 5307801 5307822 5307818 5307823 +
tctttcctctcttttgagacag

SEQ ID NO: 97906 - DNA, 22 bp, Artificial Sequence
  Synthetic oligonucleotide; TTT chr11 5307802 5307823 5307819 5307824 +
ctttcctctcttttgagacagt

SEQ ID NO: 97907 - DNA, 22 bp, Artificial Sequence
  Synthetic oligonucleotide; TTC chr11 5307803 5307824 5307820 5307825 +
tttcctctcttttgagacagtg

SEQ ID NO: 97908 - DNA, 22 bp, Artificial Sequence
  Synthetic oligonucleotide; CTT chr11 5307805 5307826 5307822 5307827 +
tcctctcttttgagacagtgtc

SEQ ID NO: 97909 - DNA, 22 bp, Artificial Sequence
  Synthetic oligonucleotide; TTT chr11 5307806 5307827 5307823 5307828 +
cctctcttttgagacagtgtct

SEQ ID NO: 97910 - DNA, 22 bp, Artificial Sequence
  Synthetic oligonucleotide; TTC chr11 5307807 5307828 5307824 5307829 +
ctctcttttgagacagtgtctt

SEQ ID NO: 97911 - DNA, 22 bp, Artificial Sequence
  Synthetic oligonucleotide; CTC chr11 5307810 5307831 5307827 5307832 +
tcttttgagacagtgtcttgct

SEQ ID NO: 97912 - DNA, 22 bp, Artificial Sequence
  Synthetic oligonucleotide; CTC chr11 5307812 5307833 5307829 5307834 +
ttttgagacagtgtcttgctct

SEQ ID NO: 97913 - DNA, 22 bp, Artificial Sequence
  Synthetic oligonucleotide; CTT chr11 5307814 5307835 5307831 5307836 +
ttgagacagtgtcttgctctgt

SEQ ID NO: 97914 - DNA, 22 bp, Artificial Sequence
  Synthetic oligonucleotide; TTT chr11 5307815 5307836 5307832 5307837 +
tgagacagtgtcttgctctgtc

SEQ ID NO: 97915 - DNA, 22 bp, Artificial Sequence
  Synthetic oligonucleotide; TTT chr11 5307816 5307837 5307833 5307838 +
gagacagtgtcttgctctgtca

SEQ ID NO: 97916 - DNA, 22 bp, Artificial Sequence
  Synthetic oligonucleotide; TTG chr11 5307817 5307838 5307834 5307839 +
agacagtgtcttgctctgtcac

SEQ ID NO: 97917 - DNA, 22 bp, Artificial Sequence
  Synthetic oligonucleotide; CTT chr11 5307829 5307850 5307846 5307851 +
gctctgtcacccaggagggagt

SEQ ID NO: 97918 - DNA, 22 bp, Artificial Sequence
  Synthetic oligonucleotide; TTG chr11 5307830 5307851 5307847 5307852 +
ctctgtcacccaggagggagtg

SEQ ID NO: 97919 - DNA, 22 bp, Artificial Sequence
  Synthetic oligonucleotide; CTC chr11 5307833 5307854 5307850 5307855 +
tgtcacccaggagggagtgcag

SEQ ID NO: 97920 - DNA, 22 bp, Artificial Sequence
  Synthetic oligonucleotide; CTG chr11 5307835 5307856 5307852 5307857 +
tcacccaggagggagtgcagtg

SEQ ID NO: 97921 - DNA, 22 bp, Artificial Sequence
  Synthetic oligonucleotide; TTT chr11 5307872 5307893 5307889 5307894 +
actgcagcctcaagcttttagg

SEQ ID NO: 97922 - DNA, 22 bp, Artificial Sequence
  Synthetic oligonucleotide; TTA chr11 5307873 5307894 5307890 5307895 +
ctgcagcctcaagcttttaggc

SEQ ID NO: 97923 - DNA, 22 bp, Artificial Sequence
  Synthetic oligonucleotide; CTG chr11 5307876 5307897 5307893 5307898 +
cagcctcaagcttttaggctta

SEQ ID NO: 97924 - DNA, 22 bp, Artificial Sequence
  Synthetic oligonucleotide; CTC chr11 5307883 5307904 5307900 5307905 +
aagcttttaggcttaagtgatt

SEQ ID NO: 97925 - DNA, 22 bp, Artificial Sequence
  Synthetic oligonucleotide; CTT chr11 5307889 5307910 5307906 5307911 +
ttaggcttaagtgatttttaca

SEQ ID NO: 97926 - DNA, 22 bp, Artificial Sequence
  Synthetic oligonucleotide; TTT chr11 5307890 5307911 5307907 5307912 +
taggcttaagtgatttttacac

SEQ ID NO: 97927 - DNA, 22 bp, Artificial Sequence
  Synthetic oligonucleotide; TTT chr11 5307891 5307912 5307908 5307913 +
aggcttaagtgatttttacacc

SEQ ID NO: 97928 - DNA, 22 bp, Artificial Sequence
  Synthetic oligonucleotide; TTA chr11 5307892 5307913 5307909 5307914 +
ggcttaagtgatttttacacct

SEQ ID NO: 97929 - DNA, 22 bp, Artificial Sequence
  Synthetic oligonucleotide; CTT chr11 5307897 5307918 5307914 5307919 +
aagtgatttttacacctcagcc

SEQ ID NO: 97930 - DNA, 22 bp, Artificial Sequence
  Synthetic oligonucleotide; TTA chr11 5307898 5307919 5307915 5307920 +
agtgatttttacacctcagcct

SEQ ID NO: 97931 - DNA, 22 bp, Artificial Sequence
  Synthetic oligonucleotide; TTT chr11 5307906 5307927 5307923 5307928 +
ttacacctcagcctcccaaata

SEQ ID NO: 97932 - DNA, 22 bp, Artificial Sequence
  Synthetic oligonucleotide; TTT chr11 5307907 5307928 5307924 5307929 +
tacacctcagcctcccaaatag

SEQ ID NO: 97933 - DNA, 22 bp, Artificial Sequence
  Synthetic oligonucleotide; TTT chr11 5307908 5307929 5307925 5307930 +
acacctcagcctcccaaatagc

SEQ ID NO: 97934 - DNA, 22 bp, Artificial Sequence
  Synthetic oligonucleotide; TTA chr11 5307909 5307930 5307926 5307931 +
cacctcagcctcccaaatagct

SEQ ID NO: 97935 - DNA, 22 bp, Artificial Sequence
  Synthetic oligonucleotide; CTC chr11 5307915 5307936 5307932 5307937 +
agcctcccaaatagctgtgacc

SEQ ID NO: 97936 - DNA, 22 bp, Artificial Sequence
  Synthetic oligonucleotide; CTC chr11 5307921 5307942 5307938 5307943 +
ccaaatagctgtgaccacatga

SEQ ID NO: 97937 - DNA, 22 bp, Artificial Sequence
  Synthetic oligonucleotide; CTG chr11 5307932 5307953 5307949 5307954 +
tgaccacatgagaagagacatt

SEQ ID NO: 97938 - DNA, 22 bp, Artificial Sequence
  Synthetic oligonucleotide; TTT chr11 5307955 5307976 5307972 5307977 +
atgtgtttttttccttcttagt

SEQ ID NO: 97939 - DNA, 22 bp, Artificial Sequence
  Synthetic oligonucleotide; TTA chr11 5307956 5307977 5307973 5307978 +
tgtgtttttttccttcttagta

SEQ ID NO: 97940 - DNA, 22 bp, Artificial Sequence
  Synthetic oligonucleotide; TTT chr11 5307963 5307984 5307980 5307985 +
ttttccttcttagtactttggc

SEQ ID NO: 97941 - DNA, 22 bp, Artificial Sequence
  Synthetic oligonucleotide; TTT chr11 5307964 5307985 5307981 5307986 +
tttccttcttagtactttggct

SEQ ID NO: 97942 - DNA, 22 bp, Artificial Sequence
  Synthetic oligonucleotide; TTT chr11 5307965 5307986 5307982 5307987 +
ttccttcttagtactttggctg

SEQ ID NO: 97943 - DNA, 22 bp, Artificial Sequence
  Synthetic oligonucleotide; TTT chr11 5307966 5307987 5307983 5307988 +
tccttcttagtactttggctgc

SEQ ID NO: 97944 - DNA, 22 bp, Artificial Sequence
  Synthetic oligonucleotide; TTT chr11 5307967 5307988 5307984 5307989 +
ccttcttagtactttggctgca

SEQ ID NO: 97945 - DNA, 22 bp, Artificial Sequence
  Synthetic oligonucleotide; TTC chr11 5307968 5307989 5307985 5307990 +
cttcttagtactttggctgcaa

SEQ ID NO: 97946 - DNA, 22 bp, Artificial Sequence
  Synthetic oligonucleotide; CTT chr11 5307971 5307992 5307988 5307993 +
cttagtactttggctgcaagtg

SEQ ID NO: 97947 - DNA, 22 bp, Artificial Sequence
  Synthetic oligonucleotide; TTC chr11 5307972 5307993 5307989 5307994 +
ttagtactttggctgcaagtga

SEQ ID NO: 97948 - DNA, 22 bp, Artificial Sequence
  Synthetic oligonucleotide; CTT chr11 5307974 5307995 5307991 5307996 +
agtactttggctgcaagtgagt

SEQ ID NO: 97949 - DNA, 22 bp, Artificial Sequence
  Synthetic oligonucleotide; TTA chr11 5307975 5307996 5307992 5307997 +
gtactttggctgcaagtgagtc

SEQ ID NO: 97950 - DNA, 22 bp, Artificial Sequence
  Synthetic oligonucleotide; CTT chr11 5307981 5308002 5307998 5308003 +
tggctgcaagtgagtctcaagg

SEQ ID NO: 97951 - DNA, 22 bp, Artificial Sequence
  Synthetic oligonucleotide; TTT chr11 5307982 5308003 5307999 5308004 +
ggctgcaagtgagtctcaaggt

SEQ ID NO: 97952 - DNA, 22 bp, Artificial Sequence
  Synthetic oligonucleotide; TTG chr11 5307983 5308004 5308000 5308005 +
gctgcaagtgagtctcaaggta

SEQ ID NO: 97953 - DNA, 22 bp, Artificial Sequence
  Synthetic oligonucleotide; CTG chr11 5307987 5308008 5308004 5308009 +
caagtgagtctcaaggtaagat

SEQ ID NO: 97954 - DNA, 22 bp, Artificial Sequence
  Synthetic oligonucleotide; CTC chr11 5307999 5308020 5308016 5308021 +
aaggtaagatgttttaaccact

SEQ ID NO: 97955 - DNA, 22 bp, Artificial Sequence
  Synthetic oligonucleotide; TTT chr11 5308013 5308034 5308030 5308035 +
taaccacttatggaacttatat

SEQ ID NO: 97956 - DNA, 22 bp, Artificial Sequence
  Synthetic oligonucleotide; TTT chr11 5308014 5308035 5308031 5308036 +
aaccacttatggaacttatatt

SEQ ID NO: 97957 - DNA, 22 bp, Artificial Sequence
  Synthetic oligonucleotide; TTA chr11 5308015 5308036 5308032 5308037 +
accacttatggaacttatattc

SEQ ID NO: 97958 - DNA, 22 bp, Artificial Sequence
  Synthetic oligonucleotide; CTT chr11 5308022 5308043 5308039 5308044 +
atggaacttatattctcccatt

SEQ ID NO: 97959 - DNA, 22 bp, Artificial Sequence
  Synthetic oligonucleotide; TTA chr11 5308023 5308044 5308040 5308045 +
tggaacttatattctcccattc

SEQ ID NO: 97960 - DNA, 22 bp, Artificial Sequence
  Synthetic oligonucleotide; CTT chr11 5308031 5308052 5308048 5308053 +
atattctcccattccaatgaaa

SEQ ID NO: 97961 - DNA, 22 bp, Artificial Sequence
  Synthetic oligonucleotide; TTA chr11 5308032 5308053 5308049 5308054 +
tattctcccattccaatgaaaa

SEQ ID NO: 97962 - DNA, 22 bp, Artificial Sequence
  Synthetic oligonucleotide; TTC chr11 5308037 5308058 5308054 5308059 +
tcccattccaatgaaaagacta

SEQ ID NO: 97963 - DNA, 22 bp, Artificial Sequence
  Synthetic oligonucleotide; CTC chr11 5308039 5308060 5308056 5308061 +
ccattccaatgaaaagactact

SEQ ID NO: 97964 - DNA, 22 bp, Artificial Sequence
  Synthetic oligonucleotide; TTC chr11 5308045 5308066 5308062 5308067 +
caatgaaaagactactttgaaa

SEQ ID NO: 97965 - DNA, 22 bp, Artificial Sequence
  Synthetic oligonucleotide; CTA chr11 5308059 5308080 5308076 5308081 +
ctttgaaaatgtttttgttgat

SEQ ID NO: 97966 - DNA, 22 bp, Artificial Sequence
  Synthetic oligonucleotide; CTT chr11 5308062 5308083 5308079 5308084 +
tgaaaatgtttttgttgatgtc

SEQ ID NO: 97967 - DNA, 22 bp, Artificial Sequence
  Synthetic oligonucleotide; TTT chr11 5308063 5308084 5308080 5308085 +
gaaaatgtttttgttgatgtct

SEQ ID NO: 97968 - DNA, 22 bp, Artificial Sequence
  Synthetic oligonucleotide; TTG chr11 5308064 5308085 5308081 5308086 +
aaaatgtttttgttgatgtcta

SEQ ID NO: 97969 - DNA, 22 bp, Artificial Sequence
  Synthetic oligonucleotide; TTT chr11 5308073 5308094 5308090 5308095 +
ttgttgatgtctaaatacacca

SEQ ID NO: 97970 - DNA, 22 bp, Artificial Sequence
  Synthetic oligonucleotide; TTT chr11 5308074 5308095 5308091 5308096 +
tgttgatgtctaaatacaccaa

SEQ ID NO: 97971 - DNA, 22 bp, Artificial Sequence
  Synthetic oligonucleotide; TTT chr11 5308075 5308096 5308092 5308097 +
gttgatgtctaaatacaccaag

SEQ ID NO: 97972 - DNA, 22 bp, Artificial Sequence
  Synthetic oligonucleotide; TTG chr11 5308076 5308097 5308093 5308098 +
ttgatgtctaaatacaccaagt

SEQ ID NO: 97973 - DNA, 22 bp, Artificial Sequence
  Synthetic oligonucleotide; TTG chr11 5308079 5308100 5308096 5308101 +
atgtctaaatacaccaagtcta

SEQ ID NO: 97974 - DNA, 22 bp, Artificial Sequence
  Synthetic oligonucleotide; CTA chr11 5308086 5308107 5308103 5308108 +
aatacaccaagtctacaatttc

SEQ ID NO: 97975 - DNA, 22 bp, Artificial Sequence
  Synthetic oligonucleotide; CTA chr11 5308101 5308122 5308118 5308123 +
caatttcctgtgatctatctat

SEQ ID NO: 97976 - DNA, 22 bp, Artificial Sequence
  Synthetic oligonucleotide; TTT chr11 5308107 5308128 5308124 5308129 +
cctgtgatctatctatactact

SEQ ID NO: 97977 - DNA, 22 bp, Artificial Sequence
  Synthetic oligonucleotide; TTC chr11 5308108 5308129 5308125 5308130 +
ctgtgatctatctatactacta

SEQ ID NO: 97978 - DNA, 22 bp, Artificial Sequence
  Synthetic oligonucleotide; CTG chr11 5308111 5308132 5308128 5308133 +
tgatctatctatactactaaat

SEQ ID NO: 97979 - DNA, 22 bp, Artificial Sequence
  Synthetic oligonucleotide; CTA chr11 5308118 5308139 5308135 5308140 +
tctatactactaaatagctaga

SEQ ID NO: 97980 - DNA, 22 bp, Artificial Sequence
  Synthetic oligonucleotide; CTA chr11 5308122 5308143 5308139 5308144 +
tactactaaatagctagaccaa

SEQ ID NO: 97981 - DNA, 22 bp, Artificial Sequence
  Synthetic oligonucleotide; CTA chr11 5308127 5308148 5308144 5308149 +
ctaaatagctagaccaatacat

SEQ ID NO: 97982 - DNA, 22 bp, Artificial Sequence
  Synthetic oligonucleotide; CTA chr11 5308130 5308151 5308147 5308152 +
aatagctagaccaatacatgaa

SEQ ID NO: 97983 - DNA, 22 bp, Artificial Sequence
  Synthetic oligonucleotide; CTA chr11 5308138 5308159 5308155 5308160 +
gaccaatacatgaaaagaaact

SEQ ID NO: 97984 - DNA, 22 bp, Artificial Sequence
  Synthetic oligonucleotide; CTC chr11 5308161 5308182 5308178 5308183 +
ttattctcaataaagaactgta

SEQ ID NO: 97985 - DNA, 22 bp, Artificial Sequence
  Synthetic oligonucleotide; CTT chr11 5308163 5308184 5308180 5308185 +
attctcaataaagaactgtacc

SEQ ID NO: 97986 - DNA, 22 bp, Artificial Sequence
  Synthetic oligonucleotide; TTA chr11 5308164 5308185 5308181 5308186 +
ttctcaataaagaactgtaccc

SEQ ID NO: 97987 - DNA, 22 bp, Artificial Sequence
  Synthetic oligonucleotide; TTC chr11 5308167 5308188 5308184 5308189 +
tcaataaagaactgtaccccaa

SEQ ID NO: 97988 - DNA, 22 bp, Artificial Sequence
  Synthetic oligonucleotide; CTC chr11 5308169 5308190 5308186 5308191 +
aataaagaactgtaccccaaca

SEQ ID NO: 97989 - DNA, 22 bp, Artificial Sequence
  Synthetic oligonucleotide; CTG chr11 5308181 5308202 5308198 5308203 +
taccccaacaataatatatcag

SEQ ID NO: 97990 - DNA, 22 bp, Artificial Sequence
  Synthetic oligonucleotide; TTA chr11 5308209 5308230 5308226 5308231 +
tatgtcttttttatcttctttg

SEQ ID NO: 97991 - DNA, 22 bp, Artificial Sequence
  Synthetic oligonucleotide; CTT chr11 5308217 5308238 5308234 5308239 +
ttttatcttctttgtgtcttat

SEQ ID NO: 97992 - DNA, 22 bp, Artificial Sequence
  Synthetic oligonucleotide; TTT chr11 5308218 5308239 5308235 5308240 +
tttatcttctttgtgtcttatc

SEQ ID NO: 97993 - DNA, 22 bp, Artificial Sequence
  Synthetic oligonucleotide; TTT chr11 5308219 5308240 5308236 5308241 +
ttatcttctttgtgtcttatca

SEQ ID NO: 97994 - DNA, 22 bp, Artificial Sequence
  Synthetic oligonucleotide; TTT chr11 5308220 5308241 5308237 5308242 +
tatcttctttgtgtcttatcag

SEQ ID NO: 97995 - DNA, 22 bp, Artificial Sequence
  Synthetic oligonucleotide; TTT chr11 5308221 5308242 5308238 5308243 +
atcttctttgtgtcttatcagt

SEQ ID NO: 97996 - DNA, 22 bp, Artificial Sequence
  Synthetic oligonucleotide; TTA chr11 5308222 5308243 5308239 5308244 +
tcttctttgtgtcttatcagtt

SEQ ID NO: 97997 - DNA, 22 bp, Artificial Sequence
  Synthetic oligonucleotide; CTT chr11 5308226 5308247 5308243 5308248 +
ctttgtgtcttatcagttatgt

SEQ ID NO: 97998 - DNA, 22 bp, Artificial Sequence
  Synthetic oligonucleotide; TTC chr11 5308227 5308248 5308244 5308249 +
tttgtgtcttatcagttatgtt

SEQ ID NO: 97999 - DNA, 22 bp, Artificial Sequence
  Synthetic oligonucleotide; CTT chr11 5308229 5308250 5308246 5308251 +
tgtgtcttatcagttatgttac

SEQ ID NO: 98000 - DNA, 22 bp, Artificial Sequence
  Synthetic oligonucleotide; TTT chr11 5308230 5308251 5308247 5308252 +
gtgtcttatcagttatgttacc

SEQ ID NO: 98001 - DNA, 22 bp, Artificial Sequence
  Synthetic oligonucleotide; TTG chr11 5308231 5308252 5308248 5308253 +
tgtcttatcagttatgttacca

SEQ ID NO: 98002 - DNA, 22 bp, Artificial Sequence
  Synthetic oligonucleotide; CTT chr11 5308237 5308258 5308254 5308259 +
atcagttatgttaccatatagg

SEQ ID NO: 98003 - DNA, 22 bp, Artificial Sequence
  Synthetic oligonucleotide; TTA chr11 5308238 5308259 5308255 5308260 +
tcagttatgttaccatatagga

SEQ ID NO: 98004 - DNA, 22 bp, Artificial Sequence
  Synthetic oligonucleotide; TTA chr11 5308245 5308266 5308262 5308267 +
tgttaccatataggaagagaaa

SEQ ID NO: 98005 - DNA, 22 bp, Artificial Sequence
  Synthetic oligonucleotide; TTA chr11 5308250 5308271 5308267 5308272 +
ccatataggaagagaaagaaaa

SEQ ID NO: 98006 - DNA, 22 bp, Artificial Sequence
  Synthetic oligonucleotide; TTA chr11 5308275 5308296 5308292 5308297 +
taagtgaaatcactgtgtacca

SEQ ID NO: 98007 - DNA, 22 bp, Artificial Sequence
  Synthetic oligonucleotide; CTG chr11 5308290 5308311 5308307 5308312 +
tgtaccatctcacatctatgca

SEQ ID NO: 98008 - DNA, 22 bp, Artificial Sequence
  Synthetic oligonucleotide; CTC chr11 5308301 5308322 5308318 5308323 +
acatctatgcaaggcaaatagg

SEQ ID NO: 98009 - DNA, 22 bp, Artificial Sequence
  Synthetic oligonucleotide; CTA chr11 5308308 5308329 5308325 5308330 +
tgcaaggcaaataggactaata

SEQ ID NO: 98010 - DNA, 22 bp, Artificial Sequence
  Synthetic oligonucleotide; CTA chr11 5308327 5308348 5308344 5308349 +
atagtacagggacaaggctgaa

SEQ ID NO: 98011 - DNA, 22 bp, Artificial Sequence
  Synthetic oligonucleotide; CTG chr11 5308347 5308368 5308364 5308369 +
aaaggagacattttaaggttga

SEQ ID NO: 98012 - DNA, 22 bp, Artificial Sequence
  Synthetic oligonucleotide; TTT chr11 5308360 5308381 5308377 5308382 +
taaggttgaaggtatgcagtaa

SEQ ID NO: 98013 - DNA, 22 bp, Artificial Sequence
  Synthetic oligonucleotide; TTT chr11 5308361 5308382 5308378 5308383 +
aaggttgaaggtatgcagtaaa

SEQ ID NO: 98014 - DNA, 22 bp, Artificial Sequence
  Synthetic oligonucleotide; TTA chr11 5308362 5308383 5308379 5308384 +
aggttgaaggtatgcagtaaaa

SEQ ID NO: 98015 - DNA, 22 bp, Artificial Sequence
  Synthetic oligonucleotide; TTG chr11 5308368 5308389 5308385 5308390 +
aaggtatgcagtaaaacttgtt

SEQ ID NO: 98016 - DNA, 22 bp, Artificial Sequence
  Synthetic oligonucleotide; CTT chr11 5308387 5308408 5308404 5308409 +
gttttctggagattacgttgaa

SEQ ID NO: 98017 - DNA, 22 bp, Artificial Sequence
  Synthetic oligonucleotide; TTG chr11 5308388 5308409 5308405 5308410 +
ttttctggagattacgttgaaa

SEQ ID NO: 98018 - DNA, 22 bp, Artificial Sequence
  Synthetic oligonucleotide; TTT chr11 5308391 5308412 5308408 5308413 +
tctggagattacgttgaaagaa

SEQ ID NO: 98019 - DNA, 22 bp, Artificial Sequence
  Synthetic oligonucleotide; TTT chr11 5308392 5308413 5308409 5308414 +
ctggagattacgttgaaagaag

SEQ ID NO: 98020 - DNA, 22 bp, Artificial Sequence
  Synthetic oligonucleotide; TTC chr11 5308393 5308414 5308410 5308415 +
tggagattacgttgaaagaagt

SEQ ID NO: 98021 - DNA, 22 bp, Artificial Sequence
  Synthetic oligonucleotide; CTG chr11 5308395 5308416 5308412 5308417 +
gagattacgttgaaagaagtta

SEQ ID NO: 98022 - DNA, 22 bp, Artificial Sequence
  Synthetic oligonucleotide; TTA chr11 5308402 5308423 5308419 5308424 +
cgttgaaagaagttacagtcag

SEQ ID NO: 98023 - DNA, 22 bp, Artificial Sequence
  Synthetic oligonucleotide; TTG chr11 5308407 5308428 5308424 5308429 +
aaagaagttacagtcagtcaat

SEQ ID NO: 98024 - DNA, 22 bp, Artificial Sequence
  Synthetic oligonucleotide; TTA chr11 5308417 5308438 5308434 5308439 +
cagtcagtcaatctaatgaggt

SEQ ID NO: 98025 - DNA, 22 bp, Artificial Sequence
  Synthetic oligonucleotide; CTA chr11 5308432 5308453 5308449 5308454 +
atgaggttgtagaagatgaaac

SEQ ID NO: 98026 - DNA, 22 bp, Artificial Sequence
  Synthetic oligonucleotide; TTG chr11 5308441 5308462 5308458 5308463 +
tagaagatgaaacaactaagct

SEQ ID NO: 98027 - DNA, 22 bp, Artificial Sequence
  Synthetic oligonucleotide; CTA chr11 5308459 5308480 5308476 5308481 +
agctggtgctcctggtaatgac

SEQ ID NO: 98028 - DNA, 22 bp, Artificial Sequence
  Synthetic oligonucleotide; CTG chr11 5308464 5308485 5308481 5308486 +
gtgctcctggtaatgacttgat

SEQ ID NO: 98029 - DNA, 22 bp, Artificial Sequence
  Synthetic oligonucleotide; CTC chr11 5308470 5308491 5308487 5308492 +
ctggtaatgacttgatacctgc

SEQ ID NO: 98030 - DNA, 22 bp, Artificial Sequence
  Synthetic oligonucleotide; CTG chr11 5308473 5308494 5308490 5308495 +
gtaatgacttgatacctgcgaa

SEQ ID NO: 98031 - DNA, 22 bp, Artificial Sequence
  Synthetic oligonucleotide; CTT chr11 5308483 5308504 5308500 5308505 +
gatacctgcgaagtgtctaaat

SEQ ID NO: 98032 - DNA, 22 bp, Artificial Sequence
  Synthetic oligonucleotide; TTG chr11 5308484 5308505 5308501 5308506 +
atacctgcgaagtgtctaaata

SEQ ID NO: 98033 - DNA, 22 bp, Artificial Sequence
  Synthetic oligonucleotide; CTG chr11 5308491 5308512 5308508 5308513 +
cgaagtgtctaaatatgtatag

SEQ ID NO: 98034 - DNA, 22 bp, Artificial Sequence
  Synthetic oligonucleotide; CTA chr11 5308502 5308523 5308519 5308524 +
aatatgtatagaggagttgata

SEQ ID NO: 98035 - DNA, 22 bp, Artificial Sequence
  Synthetic oligonucleotide; TTG chr11 5308521 5308542 5308538 5308543 +
ataatatagaccaattgcactt

SEQ ID NO: 98036 - DNA, 22 bp, Artificial Sequence
  Synthetic oligonucleotide; TTG chr11 5308538 5308559 5308555 5308560 +
cactttgggcccctgctgagta

SEQ ID NO: 98037 - DNA, 22 bp, Artificial Sequence
  Synthetic oligonucleotide; CTT chr11 5308543 5308564 5308560 5308565 +
tgggcccctgctgagtaagatt

SEQ ID NO: 98038 - DNA, 22 bp, Artificial Sequence
  Synthetic oligonucleotide; TTT chr11 5308544 5308565 5308561 5308566 +
gggcccctgctgagtaagattt

SEQ ID NO: 98039 - DNA, 22 bp, Artificial Sequence
  Synthetic oligonucleotide; TTG chr11 5308545 5308566 5308562 5308567 +
ggcccctgctgagtaagatttt

SEQ ID NO: 98040 - DNA, 22 bp, Artificial Sequence
  Synthetic oligonucleotide; CTG chr11 5308553 5308574 5308570 5308575 +
ctgagtaagattttgtgtcaac

SEQ ID NO: 98041 - DNA, 22 bp, Artificial Sequence
  Synthetic oligonucleotide; CTG chr11 5308556 5308577 5308573 5308578 +
agtaagattttgtgtcaactaa

SEQ ID NO: 98042 - DNA, 22 bp, Artificial Sequence
  Synthetic oligonucleotide; TTT chr11 5308566 5308587 5308583 5308588 +
tgtgtcaactaaacaaaacgat

SEQ ID NO: 98043 - DNA, 22 bp, Artificial Sequence
  Synthetic oligonucleotide; TTT chr11 5308567 5308588 5308584 5308589 +
gtgtcaactaaacaaaacgata

SEQ ID NO: 98044 - DNA, 22 bp, Artificial Sequence
  Synthetic oligonucleotide; TTG chr11 5308568 5308589 5308585 5308590 +
tgtcaactaaacaaaacgatag

SEQ ID NO: 98045 - DNA, 22 bp, Artificial Sequence
  Synthetic oligonucleotide; CTA chr11 5308577 5308598 5308594 5308599 +
aacaaaacgataggaaattgta

SEQ ID NO: 98046 - DNA, 22 bp, Artificial Sequence
  Synthetic oligonucleotide; TTG chr11 5308597 5308618 5308614 5308619 +
tatttccccaaagacattttgg

SEQ ID NO: 98047 - DNA, 22 bp, Artificial Sequence
  Synthetic oligonucleotide; TTT chr11 5308602 5308623 5308619 5308624 +
ccccaaagacattttggaaacg

SEQ ID NO: 98048 - DNA, 22 bp, Artificial Sequence
  Synthetic oligonucleotide; TTC chr11 5308603 5308624 5308620 5308625 +
cccaaagacattttggaaacgt

SEQ ID NO: 98049 - DNA, 22 bp, Artificial Sequence
  Synthetic oligonucleotide; TTT chr11 5308616 5308637 5308633 5308638 +
tggaaacgttctccttcagcac

SEQ ID NO: 98050 - DNA, 22 bp, Artificial Sequence
  Synthetic oligonucleotide; TTT chr11 5308617 5308638 5308634 5308639 +
ggaaacgttctccttcagcacc

SEQ ID NO: 98051 - DNA, 22 bp, Artificial Sequence
  Synthetic oligonucleotide; TTG chr11 5308618 5308639 5308635 5308640 +
gaaacgttctccttcagcacca

SEQ ID NO: 98052 - DNA, 22 bp, Artificial Sequence
  Synthetic oligonucleotide; TTC chr11 5308627 5308648 5308644 5308649 +
tccttcagcaccaatggtagca

SEQ ID NO: 98053 - DNA, 22 bp, Artificial Sequence
  Synthetic oligonucleotide; CTC chr11 5308629 5308650 5308646 5308651 +
cttcagcaccaatggtagcacc

SEQ ID NO: 98054 - DNA, 22 bp, Artificial Sequence
  Synthetic oligonucleotide; CTT chr11 5308632 5308653 5308649 5308654 +
cagcaccaatggtagcacctgg

SEQ ID NO: 98055 - DNA, 22 bp, Artificial Sequence
  Synthetic oligonucleotide; TTC chr11 5308633 5308654 5308650 5308655 +
agcaccaatggtagcacctgga

SEQ ID NO: 98056 - DNA, 22 bp, Artificial Sequence
  Synthetic oligonucleotide; CTG chr11 5308653 5308674 5308670 5308675 +
gaactgaccatccaacttccaa

SEQ ID NO: 98057 - DNA, 22 bp, Artificial Sequence
  Synthetic oligonucleotide; CTG chr11 5308659 5308680 5308676 5308681 +
accatccaacttccaagccaaa

SEQ ID NO: 98058 - DNA, 22 bp, Artificial Sequence
  Synthetic oligonucleotide; CTT chr11 5308671 5308692 5308688 5308693 +
ccaagccaaacaacttcaccca

SEQ ID NO: 98059 - DNA, 22 bp, Artificial Sequence
  Synthetic oligonucleotide; TTC chr11 5308672 5308693 5308689 5308694 +
caagccaaacaacttcacccat

SEQ ID NO: 98060 - DNA, 22 bp, Artificial Sequence
  Synthetic oligonucleotide; CTT chr11 5308687 5308708 5308704 5308709 +
cacccataaatctacattcctc

SEQ ID NO: 98061 - DNA, 22 bp, Artificial Sequence
  Synthetic oligonucleotide; TTC chr11 5308688 5308709 5308705 5308710 +
acccataaatctacattcctcc

SEQ ID NO: 98062 - DNA, 22 bp, Artificial Sequence
  Synthetic oligonucleotide; CTA chr11 5308701 5308722 5308718 5308723 +
cattcctccaatctctttcctc

SEQ ID NO: 98063 - DNA, 22 bp, Artificial Sequence
  Synthetic oligonucleotide; TTC chr11 5308706 5308727 5308723 5308728 +
ctccaatctctttcctccatca

SEQ ID NO: 98064 - DNA, 22 bp, Artificial Sequence
  Synthetic oligonucleotide; CTC chr11 5308709 5308730 5308726 5308731 +
caatctctttcctccatcatgg

SEQ ID NO: 98065 - DNA, 22 bp, Artificial Sequence
  Synthetic oligonucleotide; CTC chr11 5308716 5308737 5308733 5308738 +
tttcctccatcatggaaacagc

SEQ ID NO: 98066 - DNA, 22 bp, Artificial Sequence
  Synthetic oligonucleotide; CTT chr11 5308718 5308739 5308735 5308740 +
tcctccatcatggaaacagccc

SEQ ID NO: 98067 - DNA, 22 bp, Artificial Sequence
  Synthetic oligonucleotide; TTT chr11 5308719 5308740 5308736 5308741 +
cctccatcatggaaacagccct

SEQ ID NO: 98068 - DNA, 22 bp, Artificial Sequence
  Synthetic oligonucleotide; TTC chr11 5308720 5308741 5308737 5308742 +
ctccatcatggaaacagccctg

SEQ ID NO: 98069 - DNA, 22 bp, Artificial Sequence
  Synthetic oligonucleotide; CTC chr11 5308723 5308744 5308740 5308745 +
catcatggaaacagccctgcat

SEQ ID NO: 98070 - DNA, 22 bp, Artificial Sequence
  Synthetic oligonucleotide; CTG chr11 5308742 5308763 5308759 5308764 +
catattcaaaagtgagtgtccc

SEQ ID NO: 98071 - DNA, 22 bp, Artificial Sequence
  Synthetic oligonucleotide; TTC chr11 5308749 5308770 5308766 5308771 +
aaaagtgagtgtccctctctta

SEQ ID NO: 98072 - DNA, 22 bp, Artificial Sequence
  Synthetic oligonucleotide; CTC chr11 5308766 5308787 5308783 5308788 +
tcttatacctcgtcagagagat

SEQ ID NO: 98073 - DNA, 22 bp, Artificial Sequence
  Synthetic oligonucleotide; CTC chr11 5308768 5308789 5308785 5308790 +
ttatacctcgtcagagagattc

SEQ ID NO: 98074 - DNA, 22 bp, Artificial Sequence
  Synthetic oligonucleotide; CTT chr11 5308770 5308791 5308787 5308792 +
atacctcgtcagagagattcaa

SEQ ID NO: 98075 - DNA, 22 bp, Artificial Sequence
  Synthetic oligonucleotide; TTA chr11 5308771 5308792 5308788 5308793 +
tacctcgtcagagagattcaaa

SEQ ID NO: 98076 - DNA, 22 bp, Artificial Sequence
  Synthetic oligonucleotide; CTC chr11 5308777 5308798 5308794 5308799 +
gtcagagagattcaaatattgt

SEQ ID NO: 98077 - DNA, 22 bp, Artificial Sequence
  Synthetic oligonucleotide; TTC chr11 5308790 5308811 5308807 5308812 +
aaatattgtcatattcacaatc

SEQ ID NO: 98078 - DNA, 22 bp, Artificial Sequence
  Synthetic oligonucleotide; TTG chr11 5308798 5308819 5308815 5308820 +
tcatattcacaatccacaacag

SEQ ID NO: 98079 - DNA, 22 bp, Artificial Sequence
  Synthetic oligonucleotide; TTC chr11 5308806 5308827 5308823 5308828 +
acaatccacaacaggcccagat

SEQ ID NO: 98080 - DNA, 22 bp, Artificial Sequence
  Synthetic oligonucleotide; TTC chr11 5308836 5308857 5308853 5308858 +
agtgatgctggtcatcactgaa

SEQ ID NO: 98081 - DNA, 22 bp, Artificial Sequence
  Synthetic oligonucleotide; CTG chr11 5308846 5308867 5308863 5308868 +
gtcatcactgaagatagattga

SEQ ID NO: 98082 - DNA, 22 bp, Artificial Sequence
  Synthetic oligonucleotide; CTG chr11 5308856 5308877 5308873 5308878 +
aagatagattgaatcttccttt

SEQ ID NO: 98083 - DNA, 22 bp, Artificial Sequence
  Synthetic oligonucleotide; TTG chr11 5308867 5308888 5308884 5308889 +
aatcttcctttcttcttggacg

SEQ ID NO: 98084 - DNA, 22 bp, Artificial Sequence
  Synthetic oligonucleotide; CTT chr11 5308873 5308894 5308890 5308895 +
cctttcttcttggacgtaaatt

SEQ ID NO: 98085 - DNA, 22 bp, Artificial Sequence
  Synthetic oligonucleotide; TTC chr11 5308874 5308895 5308891 5308896 +
ctttcttcttggacgtaaattg

SEQ ID NO: 98086 - DNA, 22 bp, Artificial Sequence
  Synthetic oligonucleotide; CTT chr11 5308877 5308898 5308894 5308899 +
tcttcttggacgtaaattgcag

SEQ ID NO: 98087 - DNA, 22 bp, Artificial Sequence
  Synthetic oligonucleotide; TTT chr11 5308878 5308899 5308895 5308900 +
cttcttggacgtaaattgcagg

SEQ ID NO: 98088 - DNA, 22 bp, Artificial Sequence
  Synthetic oligonucleotide; TTC chr11 5308879 5308900 5308896 5308901 +
ttcttggacgtaaattgcaggt

SEQ ID NO: 98089 - DNA, 22 bp, Artificial Sequence
  Synthetic oligonucleotide; CTT chr11 5308881 5308902 5308898 5308903 +
cttggacgtaaattgcaggtta

SEQ ID NO: 98090 - DNA, 22 bp, Artificial Sequence
  Synthetic oligonucleotide; TTC chr11 5308882 5308903 5308899 5308904 +
ttggacgtaaattgcaggttat

SEQ ID NO: 98091 - DNA, 22 bp, Artificial Sequence
  Synthetic oligonucleotide; CTT chr11 5308884 5308905 5308901 5308906 +
ggacgtaaattgcaggttattg

SEQ ID NO: 98092 - DNA, 22 bp, Artificial Sequence
  Synthetic oligonucleotide; TTG chr11 5308885 5308906 5308902 5308907 +
gacgtaaattgcaggttattga

SEQ ID NO: 98093 - DNA, 22 bp, Artificial Sequence
  Synthetic oligonucleotide; TTG chr11 5308896 5308917 5308913 5308918 +
caggttattgaaaaaactataa

SEQ ID NO: 98094 - DNA, 22 bp, Artificial Sequence
  Synthetic oligonucleotide; TTA chr11 5308903 5308924 5308920 5308925 +
ttgaaaaaactataacttgaag

SEQ ID NO: 98095 - DNA, 22 bp, Artificial Sequence
  Synthetic oligonucleotide; TTG chr11 5308906 5308927 5308923 5308928 +
aaaaaactataacttgaagttt

SEQ ID NO: 98096 - DNA, 22 bp, Artificial Sequence
  Synthetic oligonucleotide; CTA chr11 5308915 5308936 5308932 5308937 +
taacttgaagtttcatagcaga

SEQ ID NO: 98097 - DNA, 22 bp, Artificial Sequence
  Synthetic oligonucleotide; CTT chr11 5308921 5308942 5308938 5308943 +
gaagtttcatagcagaaagttg

SEQ ID NO: 98098 - DNA, 22 bp, Artificial Sequence
  Synthetic oligonucleotide; TTG chr11 5308922 5308943 5308939 5308944 +
aagtttcatagcagaaagttgg

SEQ ID NO: 98099 - DNA, 22 bp, Artificial Sequence
  Synthetic oligonucleotide; TTT chr11 5308928 5308949 5308945 5308950 +
catagcagaaagttggcatctt

SEQ ID NO: 98100 - DNA, 22 bp, Artificial Sequence
  Synthetic oligonucleotide; TTC chr11 5308929 5308950 5308946 5308951 +
atagcagaaagttggcatcttt

SEQ ID NO: 98101 - DNA, 22 bp, Artificial Sequence
  Synthetic oligonucleotide; TTG chr11 5308943 5308964 5308960 5308965 +
gcatctttctcactaagcatga

SEQ ID NO: 98102 - DNA, 22 bp, Artificial Sequence
  Synthetic oligonucleotide; CTT chr11 5308950 5308971 5308967 5308972 +
tctcactaagcatgagaaaaac

SEQ ID NO: 98103 - DNA, 22 bp, Artificial Sequence
  Synthetic oligonucleotide; TTT chr11 5308951 5308972 5308968 5308973 +
ctcactaagcatgagaaaaact

SEQ ID NO: 98104 - DNA, 22 bp, Artificial Sequence
  Synthetic oligonucleotide; TTC chr11 5308952 5308973 5308969 5308974 +
tcactaagcatgagaaaaacta

SEQ ID NO: 98105 - DNA, 22 bp, Artificial Sequence
  Synthetic oligonucleotide; CTC chr11 5308954 5308975 5308971 5308976 +
actaagcatgagaaaaactaac

SEQ ID NO: 98106 - DNA, 22 bp, Artificial Sequence
  Synthetic oligonucleotide; CTA chr11 5308958 5308979 5308975 5308980 +
agcatgagaaaaactaacagag

SEQ ID NO: 98107 - DNA, 22 bp, Artificial Sequence
  Synthetic oligonucleotide; CTA chr11 5308974 5308995 5308991 5308996 +
acagagttttaatttgaagggc

SEQ ID NO: 98108 - DNA, 22 bp, Artificial Sequence
  Synthetic oligonucleotide; TTT chr11 5308983 5309004 5309000 5309005 +
taatttgaagggccttagccaa

SEQ ID NO: 98109 - DNA, 22 bp, Artificial Sequence
  Synthetic oligonucleotide; TTT chr11 5308984 5309005 5309001 5309006 +
aatttgaagggccttagccaac

SEQ ID NO: 98110 - DNA, 22 bp, Artificial Sequence
  Synthetic oligonucleotide; TTA chr11 5308985 5309006 5309002 5309007 +
atttgaagggccttagccaact

SEQ ID NO: 98111 - DNA, 22 bp, Artificial Sequence
  Synthetic oligonucleotide; TTT chr11 5308989 5309010 5309006 5309011 +
gaagggccttagccaacttagc

SEQ ID NO: 98112 - DNA, 22 bp, Artificial Sequence
  Synthetic oligonucleotide; TTG chr11 5308990 5309011 5309007 5309012 +
aagggccttagccaacttagct

SEQ ID NO: 98113 - DNA, 22 bp, Artificial Sequence
  Synthetic oligonucleotide; CTT chr11 5308999 5309020 5309016 5309021 +
agccaacttagctgaagtccct

SEQ ID NO: 98114 - DNA, 22 bp, Artificial Sequence
  Synthetic oligonucleotide; TTA chr11 5309000 5309021 5309017 5309022 +
gccaacttagctgaagtccctt

SEQ ID NO: 98115 - DNA, 22 bp, Artificial Sequence
  Synthetic oligonucleotide; CTT chr11 5309008 5309029 5309025 5309030 +
agctgaagtcccttccacctaa

SEQ ID NO: 98116 - DNA, 22 bp, Artificial Sequence
  Synthetic oligonucleotide; TTA chr11 5309009 5309030 5309026 5309031 +
gctgaagtcccttccacctaag

SEQ ID NO: 98117 - DNA, 22 bp, Artificial Sequence
  Synthetic oligonucleotide; CTG chr11 5309013 5309034 5309030 5309035 +
aagtcccttccacctaagataa

SEQ ID NO: 98118 - DNA, 22 bp, Artificial Sequence
  Synthetic oligonucleotide; CTT chr11 5309022 5309043 5309039 5309044 +
ccacctaagataaagctgtaaa

SEQ ID NO: 98119 - DNA, 22 bp, Artificial Sequence
  Synthetic oligonucleotide; TTC chr11 5309023 5309044 5309040 5309045 +
cacctaagataaagctgtaaaa

SEQ ID NO: 98120 - DNA, 22 bp, Artificial Sequence
  Synthetic oligonucleotide; CTA chr11 5309029 5309050 5309046 5309051 +
agataaagctgtaaaagaggag

SEQ ID NO: 98121 - DNA, 22 bp, Artificial Sequence
  Synthetic oligonucleotide; CTG chr11 5309040 5309061 5309057 5309062 +
taaaagaggagcagatgtataa

SEQ ID NO: 98122 - DNA, 22 bp, Artificial Sequence
  Synthetic oligonucleotide; TTT chr11 5309065 5309086 5309082 5309087 +
agatattggagcagcatgcagt

SEQ ID NO: 98123 - DNA, 22 bp, Artificial Sequence
  Synthetic oligonucleotide; TTA chr11 5309066 5309087 5309083 5309088 +
gatattggagcagcatgcagta

SEQ ID NO: 98124 - DNA, 22 bp, Artificial Sequence
  Synthetic oligonucleotide; TTG chr11 5309073 5309094 5309090 5309095 +
gagcagcatgcagtatcaaaat

SEQ ID NO: 98125 - DNA, 22 bp, Artificial Sequence
  Synthetic oligonucleotide; CTC chr11 5309100 5309121 5309117 5309122 +
atgagcaccaaagaagccatat

SEQ ID NO: 98126 - DNA, 22 bp, Artificial Sequence
  Synthetic oligonucleotide; TTT chr11 5309126 5309147 5309143 5309148 +
ttcacagtttctattcttccaa

SEQ ID NO: 98127 - DNA, 22 bp, Artificial Sequence
  Synthetic oligonucleotide; TTT chr11 5309127 5309148 5309144 5309149 +
tcacagtttctattcttccaaa

SEQ ID NO: 98128 - DNA, 22 bp, Artificial Sequence
  Synthetic oligonucleotide; TTT chr11 5309128 5309149 5309145 5309150 +
cacagtttctattcttccaaaa

SEQ ID NO: 98129 - DNA, 22 bp, Artificial Sequence
  Synthetic oligonucleotide; TTC chr11 5309129 5309150 5309146 5309151 +
acagtttctattcttccaaaat

SEQ ID NO: 98130 - DNA, 22 bp, Artificial Sequence
  Synthetic oligonucleotide; TTT chr11 5309136 5309157 5309153 5309158 +
ctattcttccaaaataacttac

SEQ ID NO: 98131 - DNA, 22 bp, Artificial Sequence
  Synthetic oligonucleotide; TTC chr11 5309137 5309158 5309154 5309159 +
tattcttccaaaataacttaca

SEQ ID NO: 98132 - DNA, 22 bp, Artificial Sequence
  Synthetic oligonucleotide; CTA chr11 5309139 5309160 5309156 5309161 +
ttcttccaaaataacttacaaa

SEQ ID NO: 98133 - DNA, 22 bp, Artificial Sequence
  Synthetic oligonucleotide; TTC chr11 5309142 5309163 5309159 5309164 +
ttccaaaataacttacaaagac

SEQ ID NO: 98134 - DNA, 22 bp, Artificial Sequence
  Synthetic oligonucleotide; CTT chr11 5309144 5309165 5309161 5309166 +
ccaaaataacttacaaagacag

SEQ ID NO: 98135 - DNA, 22 bp, Artificial Sequence
  Synthetic oligonucleotide; TTC chr11 5309145 5309166 5309162 5309167 +
caaaataacttacaaagacagt

SEQ ID NO: 98136 - DNA, 22 bp, Artificial Sequence
  Synthetic oligonucleotide; CTT chr11 5309156 5309177 5309173 5309178 +
acaaagacagtctttcctctgt

SEQ ID NO: 98137 - DNA, 22 bp, Artificial Sequence
  Synthetic oligonucleotide; TTA chr11 5309157 5309178 5309174 5309179 +
caaagacagtctttcctctgtc

SEQ ID NO: 98138 - DNA, 22 bp, Artificial Sequence
  Synthetic oligonucleotide; CTT chr11 5309170 5309191 5309187 5309192 +
tcctctgtcataagaacctgca

SEQ ID NO: 98139 - DNA, 22 bp, Artificial Sequence
  Synthetic oligonucleotide; TTT chr11 5309171 5309192 5309188 5309193 +
cctctgtcataagaacctgcac

SEQ ID NO: 98140 - DNA, 22 bp, Artificial Sequence
  Synthetic oligonucleotide; TTC chr11 5309172 5309193 5309189 5309194 +
ctctgtcataagaacctgcacc

SEQ ID NO: 98141 - DNA, 22 bp, Artificial Sequence
  Synthetic oligonucleotide; CTC chr11 5309175 5309196 5309192 5309197 +
tgtcataagaacctgcacccag

SEQ ID NO: 98142 - DNA, 22 bp, Artificial Sequence
  Synthetic oligonucleotide; CTG chr11 5309177 5309198 5309194 5309199 +
tcataagaacctgcacccaggt

SEQ ID NO: 98143 - DNA, 22 bp, Artificial Sequence
  Synthetic oligonucleotide; CTG chr11 5309190 5309211 5309207 5309212 +
cacccaggtcagcaaatcaaga

SEQ ID NO: 98144 - DNA, 22 bp, Artificial Sequence
  Synthetic oligonucleotide; TTG chr11 5309230 5309251 5309247 5309252 +
aaatttcctaccaacacactaa

SEQ ID NO: 98145 - DNA, 22 bp, Artificial Sequence
  Synthetic oligonucleotide; TTT chr11 5309236 5309257 5309253 5309258 +
cctaccaacacactaataaaca

SEQ ID NO: 98146 - DNA, 22 bp, Artificial Sequence
  Synthetic oligonucleotide; TTC chr11 5309237 5309258 5309254 5309259 +
ctaccaacacactaataaacat

SEQ ID NO: 98147 - DNA, 22 bp, Artificial Sequence
  Synthetic oligonucleotide; CTA chr11 5309240 5309261 5309257 5309262 +
ccaacacactaataaacattag

SEQ ID NO: 98148 - DNA, 22 bp, Artificial Sequence
  Synthetic oligonucleotide; CTA chr11 5309251 5309272 5309268 5309273 +
ataaacattaggaacttactgg

SEQ ID NO: 98149 - DNA, 22 bp, Artificial Sequence
  Synthetic oligonucleotide; TTA chr11 5309261 5309282 5309278 5309283 +
ggaacttactgggcacattatg

SEQ ID NO: 98150 - DNA, 22 bp, Artificial Sequence
  Synthetic oligonucleotide; CTT chr11 5309268 5309289 5309285 5309290 +
actgggcacattatgagaaaca

SEQ ID NO: 98151 - DNA, 22 bp, Artificial Sequence
  Synthetic oligonucleotide; TTA chr11 5309269 5309290 5309286 5309291 +
ctgggcacattatgagaaacag

SEQ ID NO: 98152 - DNA, 22 bp, Artificial Sequence
  Synthetic oligonucleotide; CTG chr11 5309272 5309293 5309289 5309294 +
ggcacattatgagaaacagagg

SEQ ID NO: 98153 - DNA, 22 bp, Artificial Sequence
  Synthetic oligonucleotide; TTA chr11 5309281 5309302 5309298 5309303 +
tgagaaacagaggagtctttgg

SEQ ID NO: 98154 - DNA, 22 bp, Artificial Sequence
  Synthetic oligonucleotide; CTT chr11 5309300 5309321 5309317 5309322 +
tgggggataaccagattttaag

SEQ ID NO: 98155 - DNA, 22 bp, Artificial Sequence
  Synthetic oligonucleotide; TTT chr11 5309301 5309322 5309318 5309323 +
gggggataaccagattttaaga

SEQ ID NO: 98156 - DNA, 22 bp, Artificial Sequence
  Synthetic oligonucleotide; TTG chr11 5309302 5309323 5309319 5309324 +
ggggataaccagattttaagat

SEQ ID NO: 98157 - DNA, 22 bp, Artificial Sequence
  Synthetic oligonucleotide; TTT chr11 5309318 5309339 5309335 5309340 +
taagatttgtgtttatactcag

SEQ ID NO: 98158 - DNA, 22 bp, Artificial Sequence
  Synthetic oligonucleotide; TTT chr11 5309319 5309340 5309336 5309341 +
aagatttgtgtttatactcagt

SEQ ID NO: 98159 - DNA, 22 bp, Artificial Sequence
  Synthetic oligonucleotide; TTA chr11 5309320 5309341 5309337 5309342 +
agatttgtgtttatactcagta

SEQ ID NO: 98160 - DNA, 22 bp, Artificial Sequence
  Synthetic oligonucleotide; TTT chr11 5309326 5309347 5309343 5309348 +
gtgtttatactcagtatcaata

SEQ ID NO: 98161 - DNA, 22 bp, Artificial Sequence
  Synthetic oligonucleotide; TTG chr11 5309327 5309348 5309344 5309349 +
tgtttatactcagtatcaatag

SEQ ID NO: 98162 - DNA, 22 bp, Artificial Sequence
  Synthetic oligonucleotide; TTT chr11 5309332 5309353 5309349 5309354 +
atactcagtatcaatagcttaa

SEQ ID NO: 98163 - DNA, 22 bp, Artificial Sequence
  Synthetic oligonucleotide; TTA chr11 5309333 5309354 5309350 5309355 +
tactcagtatcaatagcttaaa

SEQ ID NO: 98164 - DNA, 22 bp, Artificial Sequence
  Synthetic oligonucleotide; CTC chr11 5309338 5309359 5309355 5309360 +
agtatcaatagcttaaacattg

SEQ ID NO: 98165 - DNA, 22 bp, Artificial Sequence
  Synthetic oligonucleotide; CTT chr11 5309352 5309373 5309369 5309374 +
aaacattgtactcaatagcata

SEQ ID NO: 98166 - DNA, 22 bp, Artificial Sequence
  Synthetic oligonucleotide; TTA chr11 5309353 5309374 5309370 5309375 +
aacattgtactcaatagcatat

SEQ ID NO: 98167 - DNA, 22 bp, Artificial Sequence
  Synthetic oligonucleotide; TTG chr11 5309360 5309381 5309377 5309382 +
tactcaatagcatataattttg

SEQ ID NO: 98168 - DNA, 22 bp, Artificial Sequence
  Synthetic oligonucleotide; CTC chr11 5309365 5309386 5309382 5309387 +
aatagcatataattttgcttac

SEQ ID NO: 98169 - DNA, 22 bp, Artificial Sequence
  Synthetic oligonucleotide; TTT chr11 5309380 5309401 5309397 5309402 +
tgcttacagcatgcattgggta

SEQ ID NO: 98170 - DNA, 22 bp, Artificial Sequence
  Synthetic oligonucleotide; TTT chr11 5309381 5309402 5309398 5309403 +
gcttacagcatgcattgggtaa

SEQ ID NO: 98171 - DNA, 22 bp, Artificial Sequence
  Synthetic oligonucleotide; TTG chr11 5309382 5309403 5309399 5309404 +
cttacagcatgcattgggtaaa

SEQ ID NO: 98172 - DNA, 22 bp, Artificial Sequence
  Synthetic oligonucleotide; CTT chr11 5309385 5309406 5309402 5309407 +
acagcatgcattgggtaaataa

SEQ ID NO: 98173 - DNA, 22 bp, Artificial Sequence
  Synthetic oligonucleotide; TTA chr11 5309386 5309407 5309403 5309408 +
cagcatgcattgggtaaataat

SEQ ID NO: 98174 - DNA, 22 bp, Artificial Sequence
  Synthetic oligonucleotide; TTG chr11 5309398 5309419 5309415 5309420 +
ggtaaataatcggttttacaat

SEQ ID NO: 98175 - DNA, 22 bp, Artificial Sequence
  Synthetic oligonucleotide; TTT chr11 5309414 5309435 5309431 5309436 +
tacaattgattcagtatgaaaa

SEQ ID NO: 98176 - DNA, 22 bp, Artificial Sequence
  Synthetic oligonucleotide; TTT chr11 5309415 5309436 5309432 5309437 +
acaattgattcagtatgaaaaa

SEQ ID NO: 98177 - DNA, 22 bp, Artificial Sequence
  Synthetic oligonucleotide; TTA chr11 5309416 5309437 5309433 5309438 +
caattgattcagtatgaaaaag

SEQ ID NO: 98178 - DNA, 22 bp, Artificial Sequence
  Synthetic oligonucleotide; TTG chr11 5309422 5309443 5309439 5309444 +
attcagtatgaaaaagttttaa

SEQ ID NO: 98179 - DNA, 22 bp, Artificial Sequence
  Synthetic oligonucleotide; TTC chr11 5309426 5309447 5309443 5309448 +
agtatgaaaaagttttaataca

SEQ ID NO: 98180 - DNA, 22 bp, Artificial Sequence
  Synthetic oligonucleotide; TTT chr11 5309441 5309462 5309458 5309463 +
taatacaaggacatacagaaaa

SEQ ID NO: 98181 - DNA, 22 bp, Artificial Sequence
  Synthetic oligonucleotide; TTT chr11 5309442 5309463 5309459 5309464 +
aatacaaggacatacagaaaac

SEQ ID NO: 98182 - DNA, 22 bp, Artificial Sequence
  Synthetic oligonucleotide; TTA chr11 5309443 5309464 5309460 5309465 +
atacaaggacatacagaaaact

SEQ ID NO: 98183 - DNA, 22 bp, Artificial Sequence
  Synthetic oligonucleotide; CTT chr11 5309466 5309487 5309483 5309488 +
gcgcctacacctatttttttaa

SEQ ID NO: 98184 - DNA, 22 bp, Artificial Sequence
  Synthetic oligonucleotide; TTG chr11 5309467 5309488 5309484 5309489 +
cgcctacacctatttttttaag

SEQ ID NO: 98185 - DNA, 22 bp, Artificial Sequence
  Synthetic oligonucleotide; CTA chr11 5309473 5309494 5309490 5309495 +
cacctatttttttaagcattcc

SEQ ID NO: 98186 - DNA, 22 bp, Artificial Sequence
  Synthetic oligonucleotide; CTA chr11 5309479 5309500 5309496 5309501 +
tttttttaagcattccatagat

SEQ ID NO: 98187 - DNA, 22 bp, Artificial Sequence
  Synthetic oligonucleotide; TTT chr11 5309482 5309503 5309499 5309504 +
ttttaagcattccatagattgg

SEQ ID NO: 98188 - DNA, 22 bp, Artificial Sequence
  Synthetic oligonucleotide; TTT chr11 5309483 5309504 5309500 5309505 +
tttaagcattccatagattgga

SEQ ID NO: 98189 - DNA, 22 bp, Artificial Sequence
  Synthetic oligonucleotide; TTT chr11 5309484 5309505 5309501 5309506 +
ttaagcattccatagattggat

SEQ ID NO: 98190 - DNA, 22 bp, Artificial Sequence
  Synthetic oligonucleotide; TTT chr11 5309485 5309506 5309502 5309507 +
taagcattccatagattggatc

SEQ ID NO: 98191 - DNA, 22 bp, Artificial Sequence
  Synthetic oligonucleotide; TTT chr11 5309486 5309507 5309503 5309508 +
aagcattccatagattggatct

SEQ ID NO: 98192 - DNA, 22 bp, Artificial Sequence
  Synthetic oligonucleotide; TTA chr11 5309487 5309508 5309504 5309509 +
agcattccatagattggatctc

SEQ ID NO: 98193 - DNA, 22 bp, Artificial Sequence
  Synthetic oligonucleotide; TTC chr11 5309494 5309515 5309511 5309516 +
catagattggatctcatttctc

SEQ ID NO: 98194 - DNA, 22 bp, Artificial Sequence
  Synthetic oligonucleotide; TTG chr11 5309503 5309524 5309520 5309525 +
gatctcatttctctccacattt

SEQ ID NO: 98195 - DNA, 22 bp, Artificial Sequence
  Synthetic oligonucleotide; CTC chr11 5309509 5309530 5309526 5309531 +
atttctctccacatttttatgt

SEQ ID NO: 98196 - DNA, 22 bp, Artificial Sequence
  Synthetic oligonucleotide; TTT chr11 5309513 5309534 5309530 5309535 +
ctctccacatttttatgtcttc

SEQ ID NO: 98197 - DNA, 22 bp, Artificial Sequence
  Synthetic oligonucleotide; TTC chr11 5309514 5309535 5309531 5309536 +
tctccacatttttatgtcttcc

SEQ ID NO: 98198 - DNA, 22 bp, Artificial Sequence
  Synthetic oligonucleotide; CTC chr11 5309516 5309537 5309533 5309538 +
tccacatttttatgtcttccca

SEQ ID NO: 98199 - DNA, 22 bp, Artificial Sequence
  Synthetic oligonucleotide; CTC chr11 5309518 5309539 5309535 5309540 +
cacatttttatgtcttcccaat

SEQ ID NO: 98200 - DNA, 22 bp, Artificial Sequence
  Synthetic oligonucleotide; TTT chr11 5309525 5309546 5309542 5309547 +
ttatgtcttcccaatataaaac

SEQ ID NO: 98201 - DNA, 22 bp, Artificial Sequence
  Synthetic oligonucleotide; TTT chr11 5309526 5309547 5309543 5309548 +
tatgtcttcccaatataaaact

SEQ ID NO: 98202 - DNA, 22 bp, Artificial Sequence
  Synthetic oligonucleotide; TTT chr11 5309527 5309548 5309544 5309549 +
atgtcttcccaatataaaactt

SEQ ID NO: 98203 - DNA, 22 bp, Artificial Sequence
  Synthetic oligonucleotide; TTA chr11 5309528 5309549 5309545 5309550 +
tgtcttcccaatataaaacttt

SEQ ID NO: 98204 - DNA, 22 bp, Artificial Sequence
  Synthetic oligonucleotide; CTT chr11 5309534 5309555 5309551 5309556 +
cccaatataaaactttactcag

SEQ ID NO: 98205 - DNA, 22 bp, Artificial Sequence
  Synthetic oligonucleotide; TTC chr11 5309535 5309556 5309552 5309557 +
ccaatataaaactttactcagg

SEQ ID NO: 98206 - DNA, 22 bp, Artificial Sequence
  Synthetic oligonucleotide; CTT chr11 5309549 5309570 5309566 5309571 +
tactcaggccgggcgcggtggc

SEQ ID NO: 98207 - DNA, 22 bp, Artificial Sequence
  Synthetic oligonucleotide; TTT chr11 5309550 5309571 5309567 5309572 +
actcaggccgggcgcggtggct

SEQ ID NO: 98208 - DNA, 22 bp, Artificial Sequence
  Synthetic oligonucleotide; TTA chr11 5309551 5309572 5309568 5309573 +
ctcaggccgggcgcggtggctc

SEQ ID NO: 98209 - DNA, 22 bp, Artificial Sequence
  Synthetic oligonucleotide; CTC chr11 5309554 5309575 5309571 5309576 +
aggccgggcgcggtggctcacg

SEQ ID NO: 98210 - DNA, 22 bp, Artificial Sequence
  Synthetic oligonucleotide; CTC chr11 5309573 5309594 5309590 5309595 +
acgcctgtaatcccagcacttt

SEQ ID NO: 98211 - DNA, 22 bp, Artificial Sequence
  Synthetic oligonucleotide; CTG chr11 5309580 5309601 5309597 5309602 +
taatcccagcactttgggaggc

SEQ ID NO: 98212 - DNA, 22 bp, Artificial Sequence
  Synthetic oligonucleotide; CTT chr11 5309594 5309615 5309611 5309616 +
tgggaggccgaggcgggtggat

SEQ ID NO: 98213 - DNA, 22 bp, Artificial Sequence
  Synthetic oligonucleotide; TTT chr11 5309595 5309616 5309612 5309617 +
gggaggccgaggcgggtggatc

SEQ ID NO: 98214 - DNA, 22 bp, Artificial Sequence
  Synthetic oligonucleotide; TTG chr11 5309596 5309617 5309613 5309618 +
ggaggccgaggcgggtggatca

SEQ ID NO: 98215 - DNA, 22 bp, Artificial Sequence
  Synthetic oligonucleotide; CTG chr11 5309645 5309666 5309662 5309667 +
gctaacacagtgaaaccccgtc

SEQ ID NO: 98216 - DNA, 22 bp, Artificial Sequence
  Synthetic oligonucleotide; CTA chr11 5309649 5309670 5309666 5309671 +
acacagtgaaaccccgtctcta

SEQ ID NO: 98217 - DNA, 22 bp, Artificial Sequence
  Synthetic oligonucleotide; CTC chr11 5309669 5309690 5309686 5309691 +
tactaaaaagacaaaaaaattt

SEQ ID NO: 98218 - DNA, 22 bp, Artificial Sequence
  Synthetic oligonucleotide; CTA chr11 5309671 5309692 5309688 5309693 +
ctaaaaagacaaaaaaatttgc

SEQ ID NO: 98219 - DNA, 22 bp, Artificial Sequence
  Synthetic oligonucleotide; CTA chr11 5309674 5309695 5309691 5309696 +
aaaagacaaaaaaatttgcctg

SEQ ID NO: 98220 - DNA, 22 bp, Artificial Sequence
  Synthetic oligonucleotide; TTT chr11 5309691 5309712 5309708 5309713 +
gcctggcgtggtggcgggcgcc

SEQ ID NO: 98221 - DNA, 22 bp, Artificial Sequence
  Synthetic oligonucleotide; TTG chr11 5309692 5309713 5309709 5309714 +
cctggcgtggtggcgggcgcct

SEQ ID NO: 98222 - DNA, 22 bp, Artificial Sequence
  Synthetic oligonucleotide; CTG chr11 5309696 5309717 5309713 5309718 +
gcgtggtggcgggcgcctgtag

SEQ ID NO: 98223 - DNA, 22 bp, Artificial Sequence
  Synthetic oligonucleotide; CTG chr11 5309715 5309736 5309732 5309737 +
tagtcccagctactcgggaggc

SEQ ID NO: 98224 - DNA, 22 bp, Artificial Sequence
  Synthetic oligonucleotide; CTA chr11 5309727 5309748 5309744 5309749 +
ctcgggaggctgaggcaggaga

SEQ ID NO: 98225 - DNA, 22 bp, Artificial Sequence
  Synthetic oligonucleotide; CTC chr11 5309730 5309751 5309747 5309752 +
gggaggctgaggcaggagaatg

SEQ ID NO: 98226 - DNA, 22 bp, Artificial Sequence
  Synthetic oligonucleotide; CTG chr11 5309739 5309760 5309756 5309761 +
aggcaggagaatggcgtgaacc

SEQ ID NO: 98227 - DNA, 22 bp, Artificial Sequence
  Synthetic oligonucleotide; CTT chr11 5309776 5309797 5309793 5309798 +
gcagtgagctgagatcacgcca

SEQ ID NO: 98228 - DNA, 22 bp, Artificial Sequence
  Synthetic oligonucleotide; TTG chr11 5309777 5309798 5309794 5309799 +
cagtgagctgagatcacgccac

SEQ ID NO: 98229 - DNA, 22 bp, Artificial Sequence
  Synthetic oligonucleotide; CTG chr11 5309787 5309808 5309804 5309809 +
agatcacgccactgcactccag

SEQ ID NO: 98230 - DNA, 22 bp, Artificial Sequence
  Synthetic oligonucleotide; CTG chr11 5309801 5309822 5309818 5309823 +
cactccagcctgggcgacagag

SEQ ID NO: 98231 - DNA, 22 bp, Artificial Sequence
  Synthetic oligonucleotide; CTC chr11 5309806 5309827 5309823 5309828 +
cagcctgggcgacagagcgaga

SEQ ID NO: 98232 - DNA, 22 bp, Artificial Sequence
  Synthetic oligonucleotide; CTG chr11 5309813 5309834 5309830 5309835 +
ggcgacagagcgagactccatc

SEQ ID NO: 98233 - DNA, 22 bp, Artificial Sequence
  Synthetic oligonucleotide; CTC chr11 5309831 5309852 5309848 5309853 +
catctcaaaaacaaaacaaaac

SEQ ID NO: 98234 - DNA, 22 bp, Artificial Sequence
  Synthetic oligonucleotide; CTC chr11 5309837 5309858 5309854 5309859 +
aaaaacaaaacaaaacaaagca

SEQ ID NO: 98235 - DNA, 22 bp, Artificial Sequence
  Synthetic oligonucleotide; CTT chr11 5309869 5309890 5309886 5309891 +
tactcagtgaagtccagagcaa

SEQ ID NO: 98236 - DNA, 22 bp, Artificial Sequence
  Synthetic oligonucleotide; TTT chr11 5309870 5309891 5309887 5309892 +
actcagtgaagtccagagcaaa

SEQ ID NO: 98237 - DNA, 22 bp, Artificial Sequence
  Synthetic oligonucleotide; TTA chr11 5309871 5309892 5309888 5309893 +
ctcagtgaagtccagagcaaag

SEQ ID NO: 98238 - DNA, 22 bp, Artificial Sequence
  Synthetic oligonucleotide; CTC chr11 5309874 5309895 5309891 5309896 +
agtgaagtccagagcaaagatt

SEQ ID NO: 98239 - DNA, 22 bp, Artificial Sequence
  Synthetic oligonucleotide; TTT chr11 5309897 5309918 5309914 5309919 +
gttgcaaacaaatcaccagttc

SEQ ID NO: 98240 - DNA, 22 bp, Artificial Sequence
  Synthetic oligonucleotide; TTG chr11 5309898 5309919 5309915 5309920 +
ttgcaaacaaatcaccagttct

SEQ ID NO: 98241 - DNA, 22 bp, Artificial Sequence
  Synthetic oligonucleotide; TTG chr11 5309901 5309922 5309918 5309923 +
caaacaaatcaccagttcttat

SEQ ID NO: 98242 - DNA, 22 bp, Artificial Sequence
  Synthetic oligonucleotide; TTC chr11 5309919 5309940 5309936 5309941 +
ttatctttctccgtgaaaatgt

SEQ ID NO: 98243 - DNA, 22 bp, Artificial Sequence
  Synthetic oligonucleotide; CTT chr11 5309921 5309942 5309938 5309943 +
atctttctccgtgaaaatgtac

SEQ ID NO: 98244 - DNA, 22 bp, Artificial Sequence
  Synthetic oligonucleotide; TTA chr11 5309922 5309943 5309939 5309944 +
tctttctccgtgaaaatgtacc

SEQ ID NO: 98245 - DNA, 22 bp, Artificial Sequence
  Synthetic oligonucleotide; CTT chr11 5309926 5309947 5309943 5309948 +
tctccgtgaaaatgtacctgta

SEQ ID NO: 98246 - DNA, 22 bp, Artificial Sequence
  Synthetic oligonucleotide; TTT chr11 5309927 5309948 5309944 5309949 +
ctccgtgaaaatgtacctgtaa

SEQ ID NO: 98247 - DNA, 22 bp, Artificial Sequence
  Synthetic oligonucleotide; TTC chr11 5309928 5309949 5309945 5309950 +
tccgtgaaaatgtacctgtaaa

SEQ ID NO: 98248 - DNA, 22 bp, Artificial Sequence
  Synthetic oligonucleotide; CTC chr11 5309930 5309951 5309947 5309952 +
cgtgaaaatgtacctgtaaaat

SEQ ID NO: 98249 - DNA, 22 bp, Artificial Sequence
  Synthetic oligonucleotide; CTG chr11 5309946 5309967 5309963 5309968 +
taaaatgtggatgccacatatt

SEQ ID NO: 98250 - DNA, 22 bp, Artificial Sequence
  Synthetic oligonucleotide; TTT chr11 5309969 5309990 5309986 5309991 +
ttaggtctggaaggattgcatt

SEQ ID NO: 98251 - DNA, 22 bp, Artificial Sequence
  Synthetic oligonucleotide; TTT chr11 5309970 5309991 5309987 5309992 +
taggtctggaaggattgcatta

SEQ ID NO: 98252 - DNA, 22 bp, Artificial Sequence
  Synthetic oligonucleotide; TTT chr11 5309971 5309992 5309988 5309993 +
aggtctggaaggattgcattat

SEQ ID NO: 98253 - DNA, 22 bp, Artificial Sequence
  Synthetic oligonucleotide; TTA chr11 5309972 5309993 5309989 5309994 +
ggtctggaaggattgcattatc

SEQ ID NO: 98254 - DNA, 22 bp, Artificial Sequence
  Synthetic oligonucleotide; CTG chr11 5309978 5309999 5309995 5310000 +
gaaggattgcattatcttttat

SEQ ID NO: 98255 - DNA, 22 bp, Artificial Sequence
  Synthetic oligonucleotide; TTG chr11 5309987 5310008 5310004 5310009 +
cattatcttttatctgtattgc

SEQ ID NO: 98256 - DNA, 22 bp, Artificial Sequence
  Synthetic oligonucleotide; TTA chr11 5309992 5310013 5310009 5310014 +
tcttttatctgtattgcattat

SEQ ID NO: 98257 - DNA, 22 bp, Artificial Sequence
  Synthetic oligonucleotide; CTT chr11 5309996 5310017 5310013 5310018 +
ttatctgtattgcattatcata

SEQ ID NO: 98258 - DNA, 22 bp, Artificial Sequence
  Synthetic oligonucleotide; TTT chr11 5309997 5310018 5310014 5310019 +
tatctgtattgcattatcataa

SEQ ID NO: 98259 - DNA, 22 bp, Artificial Sequence
  Synthetic oligonucleotide; TTT chr11 5309998 5310019 5310015 5310020 +
atctgtattgcattatcataaa

SEQ ID NO: 98260 - DNA, 22 bp, Artificial Sequence
  Synthetic oligonucleotide; TTA chr11 5309999 5310020 5310016 5310021 +
tctgtattgcattatcataaaa

SEQ ID NO: 98261 - DNA, 22 bp, Artificial Sequence
  Synthetic oligonucleotide; CTG chr11 5310003 5310024 5310020 5310025 +
tattgcattatcataaaatctc

SEQ ID NO: 98262 - DNA, 22 bp, Artificial Sequence
  Synthetic oligonucleotide; TTG chr11 5310008 5310029 5310025 5310030 +
cattatcataaaatctctagtt

SEQ ID NO: 98263 - DNA, 22 bp, Artificial Sequence
  Synthetic oligonucleotide; TTA chr11 5310013 5310034 5310030 5310035 +
tcataaaatctctagttgagtg

SEQ ID NO: 98264 - DNA, 22 bp, Artificial Sequence
  Synthetic oligonucleotide; CTC chr11 5310025 5310046 5310042 5310047 +
tagttgagtgaaaaaatttgtt

SEQ ID NO: 98265 - DNA, 22 bp, Artificial Sequence
  Synthetic oligonucleotide; CTA chr11 5310027 5310048 5310044 5310049 +
gttgagtgaaaaaatttgttaa

SEQ ID NO: 98266 - DNA, 22 bp, Artificial Sequence
  Synthetic oligonucleotide; TTG chr11 5310031 5310052 5310048 5310053 +
agtgaaaaaatttgttaaatca

SEQ ID NO: 98267 - DNA, 22 bp, Artificial Sequence
  Synthetic oligonucleotide; TTT chr11 5310044 5310065 5310061 5310066 +
gttaaatcatttctttaactga

SEQ ID NO: 98268 - DNA, 22 bp, Artificial Sequence
  Synthetic oligonucleotide; TTG chr11 5310045 5310066 5310062 5310067 +
ttaaatcatttctttaactgaa

SEQ ID NO: 98269 - DNA, 22 bp, Artificial Sequence
  Synthetic oligonucleotide; TTA chr11 5310048 5310069 5310065 5310070 +
aatcatttctttaactgaaaac

SEQ ID NO: 98270 - DNA, 22 bp, Artificial Sequence
  Synthetic oligonucleotide; TTT chr11 5310056 5310077 5310073 5310078 +
ctttaactgaaaactgaaccca

SEQ ID NO: 98271 - DNA, 22 bp, Artificial Sequence
  Synthetic oligonucleotide; TTC chr11 5310057 5310078 5310074 5310079 +
tttaactgaaaactgaacccag

SEQ ID NO: 98272 - DNA, 22 bp, Artificial Sequence
  Synthetic oligonucleotide; CTT chr11 5310059 5310080 5310076 5310081 +
taactgaaaactgaacccagga

SEQ ID NO: 98273 - DNA, 22 bp, Artificial Sequence
  Synthetic oligonucleotide; TTT chr11 5310060 5310081 5310077 5310082 +
aactgaaaactgaacccaggag

SEQ ID NO: 98274 - DNA, 22 bp, Artificial Sequence
  Synthetic oligonucleotide; TTA chr11 5310061 5310082 5310078 5310083 +
actgaaaactgaacccaggagg

SEQ ID NO: 98275 - DNA, 22 bp, Artificial Sequence
  Synthetic oligonucleotide; CTG chr11 5310065 5310086 5310082 5310087 +
aaaactgaacccaggaggcaga

SEQ ID NO: 98276 - DNA, 22 bp, Artificial Sequence
  Synthetic oligonucleotide; CTG chr11 5310072 5310093 5310089 5310094 +
aacccaggaggcagaggttgca

SEQ ID NO: 98277 - DNA, 22 bp, Artificial Sequence
  Synthetic oligonucleotide; TTG chr11 5310092 5310113 5310109 5310114 +
cagtcagccgagatcaaggcac

SEQ ID NO: 98278 - DNA, 22 bp, Artificial Sequence
  Synthetic oligonucleotide; CTG chr11 5310116 5310137 5310133 5310138 +
aaaacttcctttctccagaaag

SEQ ID NO: 98279 - DNA, 22 bp, Artificial Sequence
  Synthetic oligonucleotide; CTT chr11 5310123 5310144 5310140 5310145 +
cctttctccagaaagcttgtct

SEQ ID NO: 98280 - DNA, 22 bp, Artificial Sequence
  Synthetic oligonucleotide; TTC chr11 5310124 5310145 5310141 5310146 +
ctttctccagaaagcttgtctc

SEQ ID NO: 98281 - DNA, 22 bp, Artificial Sequence
  Synthetic oligonucleotide; CTT chr11 5310127 5310148 5310144 5310149 +
tctccagaaagcttgtctcatt

SEQ ID NO: 98282 - DNA, 22 bp, Artificial Sequence
  Synthetic oligonucleotide; TTT chr11 5310128 5310149 5310145 5310150 +
ctccagaaagcttgtctcattt

SEQ ID NO: 98283 - DNA, 22 bp, Artificial Sequence
  Synthetic oligonucleotide; TTC chr11 5310129 5310150 5310146 5310151 +
tccagaaagcttgtctcatttt

SEQ ID NO: 98284 - DNA, 22 bp, Artificial Sequence
  Synthetic oligonucleotide; CTC chr11 5310131 5310152 5310148 5310153 +
cagaaagcttgtctcattttct

SEQ ID NO: 98285 - DNA, 22 bp, Artificial Sequence
  Synthetic oligonucleotide; CTT chr11 5310141 5310162 5310158 5310163 +
gtctcattttcttcttccatgg

SEQ ID NO: 98286 - DNA, 22 bp, Artificial Sequence
  Synthetic oligonucleotide; TTG chr11 5310142 5310163 5310159 5310164 +
tctcattttcttcttccatgga

SEQ ID NO: 98287 - DNA, 22 bp, Artificial Sequence
  Synthetic oligonucleotide; CTC chr11 5310146 5310167 5310163 5310168 +
attttcttcttccatggaatat

SEQ ID NO: 98288 - DNA, 22 bp, Artificial Sequence
  Synthetic oligonucleotide; TTT chr11 5310150 5310171 5310167 5310172 +
tcttcttccatggaatattcca

SEQ ID NO: 98289 - DNA, 22 bp, Artificial Sequence
  Synthetic oligonucleotide; TTT chr11 5310151 5310172 5310168 5310173 +
cttcttccatggaatattccaa

SEQ ID NO: 98290 - DNA, 22 bp, Artificial Sequence
  Synthetic oligonucleotide; TTC chr11 5310152 5310173 5310169 5310174 +
ttcttccatggaatattccaag

SEQ ID NO: 98291 - DNA, 22 bp, Artificial Sequence
  Synthetic oligonucleotide; CTT chr11 5310154 5310175 5310171 5310176 +
cttccatggaatattccaagga

SEQ ID NO: 98292 - DNA, 22 bp, Artificial Sequence
  Synthetic oligonucleotide; TTC chr11 5310155 5310176 5310172 5310177 +
ttccatggaatattccaaggaa

SEQ ID NO: 98293 - DNA, 22 bp, Artificial Sequence
  Synthetic oligonucleotide; CTT chr11 5310157 5310178 5310174 5310179 +
ccatggaatattccaaggaata

SEQ ID NO: 98294 - DNA, 22 bp, Artificial Sequence
  Synthetic oligonucleotide; TTC chr11 5310158 5310179 5310175 5310180 +
catggaatattccaaggaatat

SEQ ID NO: 98295 - DNA, 22 bp, Artificial Sequence
  Synthetic oligonucleotide; TTC chr11 5310170 5310191 5310187 5310192 +
caaggaatattctttgaaaagc

SEQ ID NO: 98296 - DNA, 22 bp, Artificial Sequence
  Synthetic oligonucleotide; TTC chr11 5310182 5310203 5310199 5310204 +
tttgaaaagcagaatattcaga

SEQ ID NO: 98297 - DNA, 22 bp, Artificial Sequence
  Synthetic oligonucleotide; CTT chr11 5310184 5310205 5310201 5310206 +
tgaaaagcagaatattcagagt

SEQ ID NO: 98298 - DNA, 22 bp, Artificial Sequence
  Synthetic oligonucleotide; TTT chr11 5310185 5310206 5310202 5310207 +
gaaaagcagaatattcagagtg

SEQ ID NO: 98299 - DNA, 22 bp, Artificial Sequence
  Synthetic oligonucleotide; TTG chr11 5310186 5310207 5310203 5310208 +
aaaagcagaatattcagagtga

SEQ ID NO: 98300 - DNA, 22 bp, Artificial Sequence
  Synthetic oligonucleotide; TTC chr11 5310201 5310222 5310218 5310223 +
agagtgagaggaagtagagaga

SEQ ID NO: 98301 - DNA, 22 bp, Artificial Sequence
  Synthetic oligonucleotide; TTT chr11 5310230 5310251 5310247 5310252 +
aggtagaatctgggcatattga

SEQ ID NO: 98302 - DNA, 22 bp, Artificial Sequence
  Synthetic oligonucleotide; TTA chr11 5310231 5310252 5310248 5310253 +
ggtagaatctgggcatattgaa

SEQ ID NO: 98303 - DNA, 22 bp, Artificial Sequence
  Synthetic oligonucleotide; CTG chr11 5310242 5310263 5310259 5310264 +
ggcatattgaagggaagacatc

SEQ ID NO: 98304 - DNA, 22 bp, Artificial Sequence
  Synthetic oligonucleotide; TTG chr11 5310251 5310272 5310268 5310273 +
aagggaagacatcaataattca

SEQ ID NO: 98305 - DNA, 22 bp, Artificial Sequence
  Synthetic oligonucleotide; TTC chr11 5310272 5310293 5310289 5310294 +
acagtagccaaggaatagaaac

SEQ ID NO: 98306 - DNA, 22 bp, Artificial Sequence
  Synthetic oligonucleotide; CTA chr11 5310308 5310329 5310325 5310330 +
tcaacagatgcgtatatcaaca

SEQ ID NO: 98307 - DNA, 22 bp, Artificial Sequence
  Synthetic oligonucleotide; CTT chr11 5310339 5310360 5310356 5310361 +
atatatgtgatagaatattatt

SEQ ID NO: 98308 - DNA, 22 bp, Artificial Sequence
  Synthetic oligonucleotide; TTA chr11 5310340 5310361 5310357 5310362 +
tatatgtgatagaatattattt

SEQ ID NO: 98309 - DNA, 22 bp, Artificial Sequence
  Synthetic oligonucleotide; TTA chr11 5310359 5310380 5310376 5310381 +
tttatctataaaaagtaggtct

SEQ ID NO: 98310 - DNA, 22 bp, Artificial Sequence
  Synthetic oligonucleotide; TTT chr11 5310362 5310383 5310379 5310384 +
atctataaaaagtaggtctgac

SEQ ID NO: 98311 - DNA, 22 bp, Artificial Sequence
  Synthetic oligonucleotide; TTA chr11 5310363 5310384 5310380 5310385 +
tctataaaaagtaggtctgaca

SEQ ID NO: 98312 - DNA, 22 bp, Artificial Sequence
  Synthetic oligonucleotide; CTA chr11 5310367 5310388 5310384 5310389 +
taaaaagtaggtctgacacatg

SEQ ID NO: 98313 - DNA, 22 bp, Artificial Sequence
  Synthetic oligonucleotide; CTG chr11 5310382 5310403 5310399 5310404 +
acacatgctacaacatgaataa

SEQ ID NO: 98314 - DNA, 22 bp, Artificial Sequence
  Synthetic oligonucleotide; CTA chr11 5310392 5310413 5310409 5310414 +
caacatgaataaaccttaaaaa

SEQ ID NO: 98315 - DNA, 22 bp, Artificial Sequence
  Synthetic oligonucleotide; CTT chr11 5310409 5310430 5310426 5310431 +
aaaaaactatcctaagtgcaat

SEQ ID NO: 98316 - DNA, 22 bp, Artificial Sequence
  Synthetic oligonucleotide; TTA chr11 5310410 5310431 5310427 5310432 +
aaaaactatcctaagtgcaata

SEQ ID NO: 98317 - DNA, 22 bp, Artificial Sequence
  Synthetic oligonucleotide; CTA chr11 5310418 5310439 5310435 5310440 +
tcctaagtgcaataagtcatac

SEQ ID NO: 98318 - DNA, 22 bp, Artificial Sequence
  Synthetic oligonucleotide; CTA chr11 5310423 5310444 5310440 5310445 +
agtgcaataagtcatacgcaaa

SEQ ID NO: 98319 - DNA, 22 bp, Artificial Sequence
  Synthetic oligonucleotide; TTG chr11 5310454 5310475 5310471 5310476 +
tctgatttcacttacatgagct

SEQ ID NO: 98320 - DNA, 22 bp, Artificial Sequence
  Synthetic oligonucleotide; CTG chr11 5310458 5310479 5310475 5310480 +
atttcacttacatgagctatct

SEQ ID NO: 98321 - DNA, 22 bp, Artificial Sequence
  Synthetic oligonucleotide; TTT chr11 5310462 5310483 5310479 5310484 +
cacttacatgagctatctagaa

SEQ ID NO: 98322 - DNA, 22 bp, Artificial Sequence
  Synthetic oligonucleotide; TTC chr11 5310463 5310484 5310480 5310485 +
acttacatgagctatctagaat

SEQ ID NO: 98323 - DNA, 22 bp, Artificial Sequence
  Synthetic oligonucleotide; CTT chr11 5310467 5310488 5310484 5310489 +
acatgagctatctagaataggc

SEQ ID NO: 98324 - DNA, 22 bp, Artificial Sequence
  Synthetic oligonucleotide; TTA chr11 5310468 5310489 5310485 5310490 +
catgagctatctagaataggca

SEQ ID NO: 98325 - DNA, 22 bp, Artificial Sequence
  Synthetic oligonucleotide; CTA chr11 5310477 5310498 5310494 5310499 +
tctagaataggcaaattcatag

SEQ ID NO: 98326 - DNA, 22 bp, Artificial Sequence
  Synthetic oligonucleotide; CTA chr11 5310481 5310502 5310498 5310503 +
gaataggcaaattcatagagac

SEQ ID NO: 98327 - DNA, 22 bp, Artificial Sequence
  Synthetic oligonucleotide; TTC chr11 5310495 5310516 5310512 5310517 +
atagagacaaaaagtagattag

SEQ ID NO: 98328 - DNA, 22 bp, Artificial Sequence
  Synthetic oligonucleotide; TTA chr11 5310516 5310537 5310533 5310538 +
gaagttaccagagtgtaggaag

SEQ ID NO: 98329 - DNA, 22 bp, Artificial Sequence
  Synthetic oligonucleotide; TTA chr11 5310523 5310544 5310540 5310545 +
ccagagtgtaggaagaacatgg

SEQ ID NO: 98330 - DNA, 22 bp, Artificial Sequence
  Synthetic oligonucleotide; TTG chr11 5310549 5310570 5310566 5310571 +
gggagtaactgattaatcaata

SEQ ID NO: 98331 - DNA, 22 bp, Artificial Sequence
  Synthetic oligonucleotide; CTG chr11 5310560 5310581 5310577 5310582 +
attaatcaatatagagttttta

SEQ ID NO: 98332 - DNA, 22 bp, Artificial Sequence
  Synthetic oligonucleotide; TTA chr11 5310564 5310585 5310581 5310586 +
atcaatatagagtttttatttg

SEQ ID NO: 98333 - DNA, 22 bp, Artificial Sequence
  Synthetic oligonucleotide; TTT chr11 5310579 5310600 5310596 5310601 +
ttatttggtgtaatacaaaatt

SEQ ID NO: 98334 - DNA, 22 bp, Artificial Sequence
  Synthetic oligonucleotide; TTT chr11 5310580 5310601 5310597 5310602 +
tatttggtgtaatacaaaattt

SEQ ID NO: 98335 - DNA, 22 bp, Artificial Sequence
  Synthetic oligonucleotide; TTT chr11 5310581 5310602 5310598 5310603 +
atttggtgtaatacaaaatttt

SEQ ID NO: 98336 - DNA, 22 bp, Artificial Sequence
  Synthetic oligonucleotide; TTA chr11 5310582 5310603 5310599 5310604 +
tttggtgtaatacaaaatttta

SEQ ID NO: 98337 - DNA, 22 bp, Artificial Sequence
  Synthetic oligonucleotide; TTT chr11 5310585 5310606 5310602 5310607 +
ggtgtaatacaaaattttagaa

SEQ ID NO: 98338 - DNA, 22 bp, Artificial Sequence
  Synthetic oligonucleotide; TTG chr11 5310586 5310607 5310603 5310608 +
gtgtaatacaaaattttagaaa

SEQ ID NO: 98339 - DNA, 22 bp, Artificial Sequence
  Synthetic oligonucleotide; TTT chr11 5310602 5310623 5310619 5310624 +
tagaaatagtggtggtgattgc

SEQ ID NO: 98340 - DNA, 22 bp, Artificial Sequence
  Synthetic oligonucleotide; TTT chr11 5310603 5310624 5310620 5310625 +
agaaatagtggtggtgattgca

SEQ ID NO: 98341 - DNA, 22 bp, Artificial Sequence
  Synthetic oligonucleotide; TTA chr11 5310604 5310625 5310621 5310626 +
gaaatagtggtggtgattgcac

SEQ ID NO: 98342 - DNA, 22 bp, Artificial Sequence
  Synthetic oligonucleotide; TTG chr11 5310623 5310644 5310640 5310645 +
cacaacatggcaaatgtaataa

SEQ ID NO: 98343 - DNA, 22 bp, Artificial Sequence
  Synthetic oligonucleotide; CTG chr11 5310654 5310675 5310671 5310676 +
cattatacattataaaaaggct

SEQ ID NO: 98344 - DNA, 22 bp, Artificial Sequence
  Synthetic oligonucleotide; TTA chr11 5310659 5310680 5310676 5310681 +
tacattataaaaaggctaaagt

SEQ ID NO: 98345 - DNA, 22 bp, Artificial Sequence
  Synthetic oligonucleotide; TTA chr11 5310666 5310687 5310683 5310688 +
taaaaaggctaaagtggcaaat

SEQ ID NO: 98346 - DNA, 22 bp, Artificial Sequence
  Synthetic oligonucleotide; CTA chr11 5310677 5310698 5310694 5310699 +
aagtggcaaattgtatatatta

SEQ ID NO: 98347 - DNA, 22 bp, Artificial Sequence
  Synthetic oligonucleotide; TTG chr11 5310690 5310711 5310707 5310712 +
tatatattaccactataaaaat

SEQ ID NO: 98348 - DNA, 22 bp, Artificial Sequence
  Synthetic oligonucleotide; TTA chr11 5310699 5310720 5310716 5310721 +
ccactataaaaataaaacaata

SEQ ID NO: 98349 - DNA, 22 bp, Artificial Sequence
  Synthetic oligonucleotide; CTA chr11 5310705 5310726 5310722 5310727 +
taaaaataaaacaataaatgta

SEQ ID NO: 98350 - DNA, 22 bp, Artificial Sequence
  Synthetic oligonucleotide; TTT chr11 5310730 5310751 5310747 5310752 +
caattcattaaatttattgtga

SEQ ID NO: 98351 - DNA, 22 bp, Artificial Sequence
  Synthetic oligonucleotide; TTC chr11 5310731 5310752 5310748 5310753 +
aattcattaaatttattgtgaa

SEQ ID NO: 98352 - DNA, 22 bp, Artificial Sequence
  Synthetic oligonucleotide; TTC chr11 5310736 5310757 5310753 5310758 +
attaaatttattgtgaaaggtt

SEQ ID NO: 98353 - DNA, 22 bp, Artificial Sequence
  Synthetic oligonucleotide; TTA chr11 5310740 5310761 5310757 5310762 +
aatttattgtgaaaggtttaaa

SEQ ID NO: 98354 - DNA, 22 bp, Artificial Sequence
  Synthetic oligonucleotide; TTT chr11 5310745 5310766 5310762 5310767 +
attgtgaaaggtttaaaaacaa

SEQ ID NO: 98355 - DNA, 22 bp, Artificial Sequence
  Synthetic oligonucleotide; TTA chr11 5310746 5310767 5310763 5310768 +
ttgtgaaaggtttaaaaacaag

SEQ ID NO: 98356 - DNA, 22 bp, Artificial Sequence
  Synthetic oligonucleotide; TTG chr11 5310749 5310770 5310766 5310771 +
tgaaaggtttaaaaacaagagt

SEQ ID NO: 98357 - DNA, 22 bp, Artificial Sequence
  Synthetic oligonucleotide; TTT chr11 5310759 5310780 5310776 5310781 +
aaaaacaagagtttgaggttaa

SEQ ID NO: 98358 - DNA, 22 bp, Artificial Sequence
  Synthetic oligonucleotide; TTA chr11 5310760 5310781 5310777 5310782 +
aaaacaagagtttgaggttaaa

SEQ ID NO: 98359 - DNA, 22 bp, Artificial Sequence
  Synthetic oligonucleotide; TTT chr11 5310773 5310794 5310790 5310795 +
gaggttaaaaattatgtctaag

SEQ ID NO: 98360 - DNA, 22 bp, Artificial Sequence
  Synthetic oligonucleotide; TTG chr11 5310774 5310795 5310791 5310796 +
aggttaaaaattatgtctaaga

SEQ ID NO: 98361 - DNA, 22 bp, Artificial Sequence
  Synthetic oligonucleotide; TTA chr11 5310780 5310801 5310797 5310802 +
aaaattatgtctaagataaaat

SEQ ID NO: 98362 - DNA, 22 bp, Artificial Sequence
  Synthetic oligonucleotide; TTA chr11 5310787 5310808 5310804 5310809 +
tgtctaagataaaatattaaaa

SEQ ID NO: 98363 - DNA, 22 bp, Artificial Sequence
  Synthetic oligonucleotide; CTA chr11 5310793 5310814 5310810 5310815 +
agataaaatattaaaagattta

SEQ ID NO: 98364 - DNA, 22 bp, Artificial Sequence
  Synthetic oligonucleotide; TTA chr11 5310806 5310827 5310823 5310828 +
aaagatttattccacatgtgca

SEQ ID NO: 98365 - DNA, 22 bp, Artificial Sequence
  Synthetic oligonucleotide; TTT chr11 5310814 5310835 5310831 5310836 +
attccacatgtgcaggtgtcca

SEQ ID NO: 98366 - DNA, 22 bp, Artificial Sequence
  Synthetic oligonucleotide; TTA chr11 5310815 5310836 5310832 5310837 +
ttccacatgtgcaggtgtccac

SEQ ID NO: 98367 - DNA, 22 bp, Artificial Sequence
  Synthetic oligonucleotide; TTC chr11 5310818 5310839 5310835 5310840 +
cacatgtgcaggtgtccacaca

SEQ ID NO: 98368 - DNA, 22 bp, Artificial Sequence
  Synthetic oligonucleotide; CTA chr11 5310858 5310879 5310875 5310880 +
tatatatacatactaggataaa

SEQ ID NO: 98369 - DNA, 22 bp, Artificial Sequence
  Synthetic oligonucleotide; CTA chr11 5310873 5310894 5310890 5310895 +
ggataaagtctcttatatctta

SEQ ID NO: 98370 - DNA, 22 bp, Artificial Sequence
  Synthetic oligonucleotide; CTC chr11 5310885 5310906 5310902 5310907 +
ttatatcttaaagaccatttat

SEQ ID NO: 98371 - DNA, 22 bp, Artificial Sequence
  Synthetic oligonucleotide; CTT chr11 5310887 5310908 5310904 5310909 +
atatcttaaagaccatttattt

SEQ ID NO: 98372 - DNA, 22 bp, Artificial Sequence
  Synthetic oligonucleotide; TTA chr11 5310888 5310909 5310905 5310910 +
tatcttaaagaccatttatttg

SEQ ID NO: 98373 - DNA, 22 bp, Artificial Sequence
  Synthetic oligonucleotide; CTT chr11 5310894 5310915 5310911 5310916 +
aaagaccatttatttgatttta

SEQ ID NO: 98374 - DNA, 22 bp, Artificial Sequence
  Synthetic oligonucleotide; TTA chr11 5310895 5310916 5310912 5310917 +
aagaccatttatttgattttaa

SEQ ID NO: 98375 - DNA, 22 bp, Artificial Sequence
  Synthetic oligonucleotide; TTT chr11 5310905 5310926 5310922 5310927 +
atttgattttaataaatagaat

SEQ ID NO: 98376 - DNA, 22 bp, Artificial Sequence
  Synthetic oligonucleotide; TTA chr11 5310906 5310927 5310923 5310928 +
tttgattttaataaatagaata

SEQ ID NO: 98377 - DNA, 22 bp, Artificial Sequence
  Synthetic oligonucleotide; TTT chr11 5310909 5310930 5310926 5310931 +
gattttaataaatagaatagga

SEQ ID NO: 98378 - DNA, 22 bp, Artificial Sequence
  Synthetic oligonucleotide; TTG chr11 5310910 5310931 5310927 5310932 +
attttaataaatagaataggat

SEQ ID NO: 98379 - DNA, 22 bp, Artificial Sequence
  Synthetic oligonucleotide; TTT chr11 5310914 5310935 5310931 5310936 +
taataaatagaataggatggtt

SEQ ID NO: 98380 - DNA, 22 bp, Artificial Sequence
  Synthetic oligonucleotide; TTT chr11 5310915 5310936 5310932 5310937 +
aataaatagaataggatggttg

SEQ ID NO: 98381 - DNA, 22 bp, Artificial Sequence
  Synthetic oligonucleotide; TTA chr11 5310916 5310937 5310933 5310938 +
ataaatagaataggatggttga

SEQ ID NO: 98382 - DNA, 22 bp, Artificial Sequence
  Synthetic oligonucleotide; TTG chr11 5310937 5310958 5310954 5310959 +
actcaacaatttcacttgagag

SEQ ID NO: 98383 - DNA, 22 bp, Artificial Sequence
  Synthetic oligonucleotide; CTC chr11 5310941 5310962 5310958 5310963 +
aacaatttcacttgagagaaag

SEQ ID NO: 98384 - DNA, 22 bp, Artificial Sequence
  Synthetic oligonucleotide; TTT chr11 5310949 5310970 5310966 5310971 +
cacttgagagaaagaatcaagc

SEQ ID NO: 98385 - DNA, 22 bp, Artificial Sequence
  Synthetic oligonucleotide; TTC chr11 5310950 5310971 5310967 5310972 +
acttgagagaaagaatcaagca

SEQ ID NO: 98386 - DNA, 22 bp, Artificial Sequence
  Synthetic oligonucleotide; CTT chr11 5310954 5310975 5310971 5310976 +
gagagaaagaatcaagcataga

SEQ ID NO: 98387 - DNA, 22 bp, Artificial Sequence
  Synthetic oligonucleotide; TTG chr11 5310955 5310976 5310972 5310977 +
agagaaagaatcaagcatagat

SEQ ID NO: 98388 - DNA, 22 bp, Artificial Sequence
  Synthetic oligonucleotide; TTA chr11 5310979 5311000 5310996 5311001 +
ttttcagttccatatggtcctc

SEQ ID NO: 98389 - DNA, 22 bp, Artificial Sequence
  Synthetic oligonucleotide; TTT chr11 5310982 5311003 5310999 5311004 +
tcagttccatatggtcctcctc

SEQ ID NO: 98390 - DNA, 22 bp, Artificial Sequence
  Synthetic oligonucleotide; TTT chr11 5310983 5311004 5311000 5311005 +
cagttccatatggtcctcctca

SEQ ID NO: 98391 - DNA, 22 bp, Artificial Sequence
  Synthetic oligonucleotide; TTC chr11 5310984 5311005 5311001 5311006 +
agttccatatggtcctcctcaa

SEQ ID NO: 98392 - DNA, 22 bp, Artificial Sequence
  Synthetic oligonucleotide; TTC chr11 5310989 5311010 5311006 5311011 +
catatggtcctcctcaaatatc

SEQ ID NO: 98393 - DNA, 22 bp, Artificial Sequence
  Synthetic oligonucleotide; CTC chr11 5311001 5311022 5311018 5311023 +
ctcaaatatctatgattggaca

SEQ ID NO: 98394 - DNA, 22 bp, Artificial Sequence
  Synthetic oligonucleotide; CTC chr11 5311004 5311025 5311021 5311026 +
aaatatctatgattggacatct

SEQ ID NO: 98395 - DNA, 22 bp, Artificial Sequence
  Synthetic oligonucleotide; CTA chr11 5311013 5311034 5311030 5311035 +
tgattggacatctgtgaaggca

SEQ ID NO: 98396 - DNA, 22 bp, Artificial Sequence
  Synthetic oligonucleotide; TTG chr11 5311019 5311040 5311036 5311041 +
gacatctgtgaaggcatgccgc

SEQ ID NO: 98397 - DNA, 22 bp, Artificial Sequence
  Synthetic oligonucleotide; CTG chr11 5311027 5311048 5311044 5311049 +
tgaaggcatgccgcaaatctag

SEQ ID NO: 98398 - DNA, 22 bp, Artificial Sequence
  Synthetic oligonucleotide; CTA chr11 5311048 5311069 5311065 5311070 +
gggtaactaacataagcactca

SEQ ID NO: 98399 - DNA, 22 bp, Artificial Sequence
  Synthetic oligonucleotide; CTA chr11 5311057 5311078 5311074 5311079 +
acataagcactcatgaaaaaac

SEQ ID NO: 98400 - DNA, 22 bp, Artificial Sequence
  Synthetic oligonucleotide; CTC chr11 5311069 5311090 5311086 5311091 +
atgaaaaaacttcatttttcaa

SEQ ID NO: 98401 - DNA, 22 bp, Artificial Sequence
  Synthetic oligonucleotide; CTT chr11 5311081 5311102 5311098 5311103 +
catttttcaataaattcttgtt

SEQ ID NO: 98402 - DNA, 22 bp, Artificial Sequence
  Synthetic oligonucleotide; TTC chr11 5311082 5311103 5311099 5311104 +
atttttcaataaattcttgtta

SEQ ID NO: 98403 - DNA, 22 bp, Artificial Sequence
  Synthetic oligonucleotide; TTT chr11 5311086 5311107 5311103 5311108 +
ttcaataaattcttgttattta

SEQ ID NO: 98404 - DNA, 22 bp, Artificial Sequence
  Synthetic oligonucleotide; TTT chr11 5311087 5311108 5311104 5311109 +
tcaataaattcttgttatttac

SEQ ID NO: 98405 - DNA, 22 bp, Artificial Sequence
  Synthetic oligonucleotide; TTT chr11 5311088 5311109 5311105 5311110 +
caataaattcttgttatttact

SEQ ID NO: 98406 - DNA, 22 bp, Artificial Sequence
  Synthetic oligonucleotide; TTC chr11 5311089 5311110 5311106 5311111 +
aataaattcttgttatttactc

SEQ ID NO: 98407 - DNA, 22 bp, Artificial Sequence
  Synthetic oligonucleotide; TTC chr11 5311098 5311119 5311115 5311120 +
ttgttatttactcatctggtaa

SEQ ID NO: 98408 - DNA, 22 bp, Artificial Sequence
  Synthetic oligonucleotide; CTT chr11 5311100 5311121 5311117 5311122 +
gttatttactcatctggtaatt

SEQ ID NO: 98409 - DNA, 22 bp, Artificial Sequence
  Synthetic oligonucleotide; TTG chr11 5311101 5311122 5311118 5311123 +
ttatttactcatctggtaattc

SEQ ID NO: 98410 - DNA, 22 bp, Artificial Sequence
  Synthetic oligonucleotide; TTA chr11 5311104 5311125 5311121 5311126 +
tttactcatctggtaattcaga

SEQ ID NO: 98411 - DNA, 22 bp, Artificial Sequence
  Synthetic oligonucleotide; TTT chr11 5311107 5311128 5311124 5311129 +
actcatctggtaattcagaatt

SEQ ID NO: 98412 - DNA, 22 bp, Artificial Sequence
  Synthetic oligonucleotide; TTA chr11 5311108 5311129 5311125 5311130 +
ctcatctggtaattcagaattt

SEQ ID NO: 98413 - DNA, 22 bp, Artificial Sequence
  Synthetic oligonucleotide; CTC chr11 5311111 5311132 5311128 5311133 +
atctggtaattcagaatttagt

SEQ ID NO: 98414 - DNA, 22 bp, Artificial Sequence
  Synthetic oligonucleotide; CTG chr11 5311116 5311137 5311133 5311138 +
gtaattcagaatttagttaatc

SEQ ID NO: 98415 - DNA, 22 bp, Artificial Sequence
  Synthetic oligonucleotide; TTC chr11 5311123 5311144 5311140 5311145 +
agaatttagttaatccatcttc

SEQ ID NO: 98416 - DNA, 22 bp, Artificial Sequence
  Synthetic oligonucleotide; TTT chr11 5311130 5311151 5311147 5311152 +
agttaatccatcttcctattta

SEQ ID NO: 98417 - DNA, 22 bp, Artificial Sequence
  Synthetic oligonucleotide; TTA chr11 5311131 5311152 5311148 5311153 +
gttaatccatcttcctatttat

SEQ ID NO: 98418 - DNA, 22 bp, Artificial Sequence
  Synthetic oligonucleotide; TTA chr11 5311135 5311156 5311152 5311157 +
atccatcttcctatttatgttt

SEQ ID NO: 98419 - DNA, 22 bp, Artificial Sequence
  Synthetic oligonucleotide; CTT chr11 5311144 5311165 5311161 5311166 +
cctatttatgtttgtatcagat

SEQ ID NO: 98420 - DNA, 22 bp, Artificial Sequence
  Synthetic oligonucleotide; TTC chr11 5311145 5311166 5311162 5311167 +
ctatttatgtttgtatcagatt

SEQ ID NO: 98421 - DNA, 22 bp, Artificial Sequence
  Synthetic oligonucleotide; CTA chr11 5311148 5311169 5311165 5311170 +
tttatgtttgtatcagattatc

SEQ ID NO: 98422 - DNA, 22 bp, Artificial Sequence
  Synthetic oligonucleotide; TTT chr11 5311151 5311172 5311168 5311173 +
atgtttgtatcagattatctgg

SEQ ID NO: 98423 - DNA, 22 bp, Artificial Sequence
  Synthetic oligonucleotide; TTA chr11 5311152 5311173 5311169 5311174 +
tgtttgtatcagattatctggc

SEQ ID NO: 98424 - DNA, 22 bp, Artificial Sequence
  Synthetic oligonucleotide; TTT chr11 5311157 5311178 5311174 5311179 +
gtatcagattatctggctctaa

SEQ ID NO: 98425 - DNA, 22 bp, Artificial Sequence
  Synthetic oligonucleotide; TTG chr11 5311158 5311179 5311175 5311180 +
tatcagattatctggctctaac

SEQ ID NO: 98426 - DNA, 22 bp, Artificial Sequence
  Synthetic oligonucleotide; TTA chr11 5311168 5311189 5311185 5311190 +
tctggctctaaccagttgtatc

SEQ ID NO: 98427 - DNA, 22 bp, Artificial Sequence
  Synthetic oligonucleotide; CTG chr11 5311172 5311193 5311189 5311194 +
gctctaaccagttgtatcatat

SEQ ID NO: 98428 - DNA, 22 bp, Artificial Sequence
  Synthetic oligonucleotide; CTC chr11 5311176 5311197 5311193 5311198 +
taaccagttgtatcatataatt

SEQ ID NO: 98429 - DNA, 22 bp, Artificial Sequence
  Synthetic oligonucleotide; CTA chr11 5311178 5311199 5311195 5311200 +
accagttgtatcatataattga

SEQ ID NO: 98430 - DNA, 22 bp, Artificial Sequence
  Synthetic oligonucleotide; TTG chr11 5311186 5311207 5311203 5311208 +
tatcatataattgatatattat

SEQ ID NO: 98431 - DNA, 22 bp, Artificial Sequence
  Synthetic oligonucleotide; TTG chr11 5311199 5311220 5311216 5311221 +
atatattatctcacgtttggca

SEQ ID NO: 98432 - DNA, 22 bp, Artificial Sequence
  Synthetic oligonucleotide; TTA chr11 5311207 5311228 5311224 5311229 +
tctcacgtttggcagtattttt

SEQ ID NO: 98433 - DNA, 22 bp, Artificial Sequence
  Synthetic oligonucleotide; CTC chr11 5311211 5311232 5311228 5311233 +
acgtttggcagtattttttgga

SEQ ID NO: 98434 - DNA, 22 bp, Artificial Sequence
  Synthetic oligonucleotide; TTT chr11 5311217 5311238 5311234 5311239 +
ggcagtattttttggactgcta

SEQ ID NO: 98435 - DNA, 22 bp, Artificial Sequence
  Synthetic oligonucleotide; TTG chr11 5311218 5311239 5311235 5311240 +
gcagtattttttggactgctat

SEQ ID NO: 98436 - DNA, 22 bp, Artificial Sequence
  Synthetic oligonucleotide; TTT chr11 5311227 5311248 5311244 5311249 +
tttggactgctattttaaaact

SEQ ID NO: 98437 - DNA, 22 bp, Artificial Sequence
  Synthetic oligonucleotide; TTT chr11 5311228 5311249 5311245 5311250 +
ttggactgctattttaaaactg

SEQ ID NO: 98438 - DNA, 22 bp, Artificial Sequence
  Synthetic oligonucleotide; TTT chr11 5311229 5311250 5311246 5311251 +
tggactgctattttaaaactgg

SEQ ID NO: 98439 - DNA, 22 bp, Artificial Sequence
  Synthetic oligonucleotide; TTT chr11 5311230 5311251 5311247 5311252 +
ggactgctattttaaaactggg

SEQ ID NO: 98440 - DNA, 22 bp, Artificial Sequence
  Synthetic oligonucleotide; TTG chr11 5311231 5311252 5311248 5311253 +
gactgctattttaaaactgggt

SEQ ID NO: 98441 - DNA, 22 bp, Artificial Sequence
  Synthetic oligonucleotide; CTG chr11 5311236 5311257 5311253 5311258 +
ctattttaaaactgggtctact

SEQ ID NO: 98442 - DNA, 22 bp, Artificial Sequence
  Synthetic oligonucleotide; CTA chr11 5311239 5311260 5311256 5311261 +
ttttaaaactgggtctacttca

SEQ ID NO: 98443 - DNA, 22 bp, Artificial Sequence
  Synthetic oligonucleotide; TTT chr11 5311242 5311263 5311259 5311264 +
taaaactgggtctacttcagtg

SEQ ID NO: 98444 - DNA, 22 bp, Artificial Sequence
  Synthetic oligonucleotide; TTT chr11 5311243 5311264 5311260 5311265 +
aaaactgggtctacttcagtga

SEQ ID NO: 98445 - DNA, 22 bp, Artificial Sequence
  Synthetic oligonucleotide; TTA chr11 5311244 5311265 5311261 5311266 +
aaactgggtctacttcagtgaa

SEQ ID NO: 98446 - DNA, 22 bp, Artificial Sequence
  Synthetic oligonucleotide; CTG chr11 5311250 5311271 5311267 5311272 +
ggtctacttcagtgaatgacac

SEQ ID NO: 98447 - DNA, 22 bp, Artificial Sequence
  Synthetic oligonucleotide; CTA chr11 5311256 5311277 5311273 5311278 +
cttcagtgaatgacacccaaga

SEQ ID NO: 98448 - DNA, 22 bp, Artificial Sequence
  Synthetic oligonucleotide; CTT chr11 5311259 5311280 5311276 5311281 +
cagtgaatgacacccaagaaaa

SEQ ID NO: 98449 - DNA, 22 bp, Artificial Sequence
  Synthetic oligonucleotide; TTC chr11 5311260 5311281 5311277 5311282 +
agtgaatgacacccaagaaaaa

SEQ ID NO: 98450 - DNA, 22 bp, Artificial Sequence
  Synthetic oligonucleotide; CTA chr11 5311292 5311313 5311309 5311314 +
tcctgctttctcctaggatagt

SEQ ID NO: 98451 - DNA, 22 bp, Artificial Sequence
  Synthetic oligonucleotide; CTG chr11 5311297 5311318 5311314 5311319 +
ctttctcctaggatagtgagcc

SEQ ID NO: 98452 - DNA, 22 bp, Artificial Sequence
  Synthetic oligonucleotide; CTT chr11 5311300 5311321 5311317 5311322 +
tctcctaggatagtgagccact

SEQ ID NO: 98453 - DNA, 22 bp, Artificial Sequence
  Synthetic oligonucleotide; TTT chr11 5311301 5311322 5311318 5311323 +
ctcctaggatagtgagccactg

SEQ ID NO: 98454 - DNA, 22 bp, Artificial Sequence
  Synthetic oligonucleotide; TTC chr11 5311302 5311323 5311319 5311324 +
tcctaggatagtgagccactgt

SEQ ID NO: 98455 - DNA, 22 bp, Artificial Sequence
  Synthetic oligonucleotide; CTC chr11 5311304 5311325 5311321 5311326 +
ctaggatagtgagccactgttt

SEQ ID NO: 98456 - DNA, 22 bp, Artificial Sequence
  Synthetic oligonucleotide; CTA chr11 5311307 5311328 5311324 5311329 +
ggatagtgagccactgtttcac

SEQ ID NO: 98457 - DNA, 22 bp, Artificial Sequence
  Synthetic oligonucleotide; CTG chr11 5311323 5311344 5311340 5311345 +
tttcacttattctctgaccttc

SEQ ID NO: 98458 - DNA, 22 bp, Artificial Sequence
  Synthetic oligonucleotide; TTT chr11 5311326 5311347 5311343 5311348 +
cacttattctctgaccttcttt

SEQ ID NO: 98459 - DNA, 22 bp, Artificial Sequence
  Synthetic oligonucleotide; TTC chr11 5311327 5311348 5311344 5311349 +
acttattctctgaccttctttg

SEQ ID NO: 98460 - DNA, 22 bp, Artificial Sequence
  Synthetic oligonucleotide; CTT chr11 5311331 5311352 5311348 5311353 +
attctctgaccttctttgggtg

SEQ ID NO: 98461 - DNA, 22 bp, Artificial Sequence
  Synthetic oligonucleotide; TTA chr11 5311332 5311353 5311349 5311354 +
ttctctgaccttctttgggtgt

SEQ ID NO: 98462 - DNA, 22 bp, Artificial Sequence
  Synthetic oligonucleotide; TTC chr11 5311335 5311356 5311352 5311357 +
tctgaccttctttgggtgtcat

SEQ ID NO: 98463 - DNA, 22 bp, Artificial Sequence
  Synthetic oligonucleotide; CTC chr11 5311337 5311358 5311354 5311359 +
tgaccttctttgggtgtcatct

SEQ ID NO: 98464 - DNA, 22 bp, Artificial Sequence
  Synthetic oligonucleotide; CTG chr11 5311339 5311360 5311356 5311361 +
accttctttgggtgtcatctgc

SEQ ID NO: 98465 - DNA, 22 bp, Artificial Sequence
  Synthetic oligonucleotide; CTT chr11 5311344 5311365 5311361 5311366 +
ctttgggtgtcatctgcttcag

SEQ ID NO: 98466 - DNA, 22 bp, Artificial Sequence
  Synthetic oligonucleotide; TTC chr11 5311345 5311366 5311362 5311367 +
tttgggtgtcatctgcttcagt

SEQ ID NO: 98467 - DNA, 22 bp, Artificial Sequence
  Synthetic oligonucleotide; CTT chr11 5311347 5311368 5311364 5311369 +
tgggtgtcatctgcttcagttt

SEQ ID NO: 98468 - DNA, 22 bp, Artificial Sequence
  Synthetic oligonucleotide; TTT chr11 5311348 5311369 5311365 5311370 +
gggtgtcatctgcttcagtttg

SEQ ID NO: 98469 - DNA, 22 bp, Artificial Sequence
  Synthetic oligonucleotide; TTG chr11 5311349 5311370 5311366 5311371 +
ggtgtcatctgcttcagtttgt

SEQ ID NO: 98470 - DNA, 22 bp, Artificial Sequence
  Synthetic oligonucleotide; CTG chr11 5311360 5311381 5311377 5311382 +
cttcagtttgtttctgttgtct

SEQ ID NO: 98471 - DNA, 22 bp, Artificial Sequence
  Synthetic oligonucleotide; CTT chr11 5311363 5311384 5311380 5311385 +
cagtttgtttctgttgtcttgc

SEQ ID NO: 98472 - DNA, 22 bp, Artificial Sequence
  Synthetic oligonucleotide; TTC chr11 5311364 5311385 5311381 5311386 +
agtttgtttctgttgtcttgca

SEQ ID NO: 98473 - DNA, 22 bp, Artificial Sequence
  Synthetic oligonucleotide; TTT chr11 5311369 5311390 5311386 5311391 +
gtttctgttgtcttgcatctgt

SEQ ID NO: 98474 - DNA, 22 bp, Artificial Sequence
  Synthetic oligonucleotide; TTG chr11 5311370 5311391 5311387 5311392 +
tttctgttgtcttgcatctgta

SEQ ID NO: 98475 - DNA, 22 bp, Artificial Sequence
  Synthetic oligonucleotide; TTT chr11 5311373 5311394 5311390 5311395 +
ctgttgtcttgcatctgtaaat

SEQ ID NO: 98476 - DNA, 22 bp, Artificial Sequence
  Synthetic oligonucleotide; TTC chr11 5311374 5311395 5311391 5311396 +
tgttgtcttgcatctgtaaatt

SEQ ID NO: 98477 - DNA, 22 bp, Artificial Sequence
  Synthetic oligonucleotide; CTG chr11 5311376 5311397 5311393 5311398 +
ttgtcttgcatctgtaaattct

SEQ ID NO: 98478 - DNA, 22 bp, Artificial Sequence
  Synthetic oligonucleotide; TTG chr11 5311379 5311400 5311396 5311401 +
tcttgcatctgtaaattctcat

SEQ ID NO: 98479 - DNA, 22 bp, Artificial Sequence
  Synthetic oligonucleotide; CTT chr11 5311383 5311404 5311400 5311405 +
gcatctgtaaattctcatcatt

SEQ ID NO: 98480 - DNA, 22 bp, Artificial Sequence
  Synthetic oligonucleotide; TTG chr11 5311384 5311405 5311401 5311406 +
catctgtaaattctcatcattt

SEQ ID NO: 98481 - DNA, 22 bp, Artificial Sequence
  Synthetic oligonucleotide; CTG chr11 5311390 5311411 5311407 5311412 +
taaattctcatcattttctgac

SEQ ID NO: 98482 - DNA, 22 bp, Artificial Sequence
  Synthetic oligonucleotide; TTC chr11 5311397 5311418 5311414 5311419 +
tcatcattttctgacatatgtc

SEQ ID NO: 98483 - DNA, 22 bp, Artificial Sequence
  Synthetic oligonucleotide; CTC chr11 5311399 5311420 5311416 5311421 +
atcattttctgacatatgtctt

SEQ ID NO: 98484 - DNA, 22 bp, Artificial Sequence
  Synthetic oligonucleotide; TTT chr11 5311406 5311427 5311423 5311428 +
tctgacatatgtcttgccttta

SEQ ID NO: 98485 - DNA, 22 bp, Artificial Sequence
  Synthetic oligonucleotide; TTT chr11 5311407 5311428 5311424 5311429 +
ctgacatatgtcttgcctttac

SEQ ID NO: 98486 - DNA, 22 bp, Artificial Sequence
  Synthetic oligonucleotide; TTC chr11 5311408 5311429 5311425 5311430 +
tgacatatgtcttgcctttact

SEQ ID NO: 98487 - DNA, 22 bp, Artificial Sequence
  Synthetic oligonucleotide; CTG chr11 5311410 5311431 5311427 5311432 +
acatatgtcttgcctttactat

SEQ ID NO: 98488 - DNA, 22 bp, Artificial Sequence
  Synthetic oligonucleotide; CTT chr11 5311421 5311442 5311438 5311443 +
gcctttactatgactcttcatg

SEQ ID NO: 98489 - DNA, 22 bp, Artificial Sequence
  Synthetic oligonucleotide; TTG chr11 5311422 5311443 5311439 5311444 +
cctttactatgactcttcatga

SEQ ID NO: 98490 - DNA, 22 bp, Artificial Sequence
  Synthetic oligonucleotide; CTT chr11 5311426 5311447 5311443 5311448 +
tactatgactcttcatgatcag

SEQ ID NO: 98491 - DNA, 22 bp, Artificial Sequence
  Synthetic oligonucleotide; TTT chr11 5311427 5311448 5311444 5311449 +
actatgactcttcatgatcagg

SEQ ID NO: 98492 - DNA, 22 bp, Artificial Sequence
  Synthetic oligonucleotide; TTA chr11 5311428 5311449 5311445 5311450 +
ctatgactcttcatgatcaggc

SEQ ID NO: 98493 - DNA, 22 bp, Artificial Sequence
  Synthetic oligonucleotide; CTA chr11 5311431 5311452 5311448 5311453 +
tgactcttcatgatcaggcaaa

SEQ ID NO: 98494 - DNA, 22 bp, Artificial Sequence
  Synthetic oligonucleotide; CTC chr11 5311437 5311458 5311454 5311459 +
ttcatgatcaggcaaaaagaaa

SEQ ID NO: 98495 - DNA, 22 bp, Artificial Sequence
  Synthetic oligonucleotide; CTT chr11 5311439 5311460 5311456 5311461 +
catgatcaggcaaaaagaaata

SEQ ID NO: 98496 - DNA, 22 bp, Artificial Sequence
  Synthetic oligonucleotide; TTC chr11 5311440 5311461 5311457 5311462 +
atgatcaggcaaaaagaaatac

SEQ ID NO: 98497 - DNA, 22 bp, Artificial Sequence
  Synthetic oligonucleotide; CTG chr11 5311468 5311489 5311485 5311490 +
aaatgatttgaatgaatgattt

SEQ ID NO: 98498 - DNA, 22 bp, Artificial Sequence
  Synthetic oligonucleotide; TTT chr11 5311477 5311498 5311494 5311499 +
gaatgaatgatttttttaatta

SEQ ID NO: 98499 - DNA, 22 bp, Artificial Sequence
  Synthetic oligonucleotide; TTG chr11 5311478 5311499 5311495 5311500 +
aatgaatgatttttttaattat

SEQ ID NO: 98500 - DNA, 22 bp, Artificial Sequence
  Synthetic oligonucleotide; TTT chr11 5311490 5311511 5311507 5311512 +
ttttaattattaagctaatatt

SEQ ID NO: 98501 - DNA, 22 bp, Artificial Sequence
  Synthetic oligonucleotide; TTT chr11 5311491 5311512 5311508 5311513 +
tttaattattaagctaatattt

SEQ ID NO: 98502 - DNA, 22 bp, Artificial Sequence
  Synthetic oligonucleotide; TTT chr11 5311492 5311513 5311509 5311514 +
ttaattattaagctaatatttt

SEQ ID NO: 98503 - DNA, 22 bp, Artificial Sequence
  Synthetic oligonucleotide; TTT chr11 5311493 5311514 5311510 5311515 +
taattattaagctaatattttg

SEQ ID NO: 98504 - DNA, 22 bp, Artificial Sequence
  Synthetic oligonucleotide; TTT chr11 5311494 5311515 5311511 5311516 +
aattattaagctaatattttgt

SEQ ID NO: 98505 - DNA, 22 bp, Artificial Sequence
  Synthetic oligonucleotide; TTA chr11 5311495 5311516 5311512 5311517 +
attattaagctaatattttgtt

SEQ ID NO: 98506 - DNA, 22 bp, Artificial Sequence
  Synthetic oligonucleotide; TTA chr11 5311499 5311520 5311516 5311521 +
ttaagctaatattttgttttta

SEQ ID NO: 98507 - DNA, 22 bp, Artificial Sequence
  Synthetic oligonucleotide; TTA chr11 5311502 5311523 5311519 5311524 +
agctaatattttgtttttaaaa

SEQ ID NO: 98508 - DNA, 22 bp, Artificial Sequence
  Synthetic oligonucleotide; CTA chr11 5311507 5311528 5311524 5311529 +
atattttgtttttaaaagtcta

SEQ ID NO: 98509 - DNA, 22 bp, Artificial Sequence
  Synthetic oligonucleotide; TTT chr11 5311513 5311534 5311530 5311535 +
tgtttttaaaagtctagttcta

SEQ ID NO: 98510 - DNA, 22 bp, Artificial Sequence
  Synthetic oligonucleotide; TTT chr11 5311514 5311535 5311531 5311536 +
gtttttaaaagtctagttctac

SEQ ID NO: 98511 - DNA, 22 bp, Artificial Sequence
  Synthetic oligonucleotide; TTG chr11 5311515 5311536 5311532 5311537 +
tttttaaaagtctagttctaca

SEQ ID NO: 98512 - DNA, 22 bp, Artificial Sequence
  Synthetic oligonucleotide; TTT chr11 5311518 5311539 5311535 5311540 +
ttaaaagtctagttctacagtt

SEQ ID NO: 98513 - DNA, 22 bp, Artificial Sequence
  Synthetic oligonucleotide; TTT chr11 5311519 5311540 5311536 5311541 +
taaaagtctagttctacagttt

SEQ ID NO: 98514 - DNA, 22 bp, Artificial Sequence
  Synthetic oligonucleotide; TTT chr11 5311520 5311541 5311537 5311542 +
aaaagtctagttctacagtttg

SEQ ID NO: 98515 - DNA, 22 bp, Artificial Sequence
  Synthetic oligonucleotide; TTA chr11 5311521 5311542 5311538 5311543 +
aaagtctagttctacagtttga

SEQ ID NO: 98516 - DNA, 22 bp, Artificial Sequence
  Synthetic oligonucleotide; CTA chr11 5311529 5311550 5311546 5311551 +
gttctacagtttgaaatacttc

SEQ ID NO: 98517 - DNA, 22 bp, Artificial Sequence
  Synthetic oligonucleotide; TTC chr11 5311533 5311554 5311550 5311555 +
tacagtttgaaatacttccttc

SEQ ID NO: 98518 - DNA, 22 bp, Artificial Sequence
  Synthetic oligonucleotide; CTA chr11 5311535 5311556 5311552 5311557 +
cagtttgaaatacttccttcaa

SEQ ID NO: 98519 - DNA, 22 bp, Artificial Sequence
  Synthetic oligonucleotide; TTT chr11 5311541 5311562 5311558 5311563 +
gaaatacttccttcaattgctt

SEQ ID NO: 98520 - DNA, 22 bp, Artificial Sequence
  Synthetic oligonucleotide; TTG chr11 5311542 5311563 5311559 5311564 +
aaatacttccttcaattgcttt

SEQ ID NO: 98521 - DNA, 22 bp, Artificial Sequence
  Synthetic oligonucleotide; CTT chr11 5311550 5311571 5311567 5311572 +
ccttcaattgctttcttaaatc

SEQ ID NO: 98522 - DNA, 22 bp, Artificial Sequence
  Synthetic oligonucleotide; TTC chr11 5311551 5311572 5311568 5311573 +
cttcaattgctttcttaaatca

SEQ ID NO: 98523 - DNA, 22 bp, Artificial Sequence
  Synthetic oligonucleotide; CTT chr11 5311554 5311575 5311571 5311576 +
caattgctttcttaaatcacat

SEQ ID NO: 98524 - DNA, 22 bp, Artificial Sequence
  Synthetic oligonucleotide; TTC chr11 5311555 5311576 5311572 5311577 +
aattgctttcttaaatcacatg

SEQ ID NO: 98525 - DNA, 22 bp, Artificial Sequence
  Synthetic oligonucleotide; TTG chr11 5311560 5311581 5311577 5311582 +
ctttcttaaatcacatgtttat

SEQ ID NO: 98526 - DNA, 22 bp, Artificial Sequence
  Synthetic oligonucleotide; CTT chr11 5311563 5311584 5311580 5311585 +
tcttaaatcacatgtttattat

SEQ ID NO: 98527 - DNA, 22 bp, Artificial Sequence
  Synthetic oligonucleotide; TTT chr11 5311564 5311585 5311581 5311586 +
cttaaatcacatgtttattatt

SEQ ID NO: 98528 - DNA, 22 bp, Artificial Sequence
  Synthetic oligonucleotide; TTC chr11 5311565 5311586 5311582 5311587 +
ttaaatcacatgtttattattt

SEQ ID NO: 98529 - DNA, 22 bp, Artificial Sequence
  Synthetic oligonucleotide; CTT chr11 5311567 5311588 5311584 5311589 +
aaatcacatgtttattattttg

SEQ ID NO: 98530 - DNA, 22 bp, Artificial Sequence
  Synthetic oligonucleotide; TTA chr11 5311568 5311589 5311585 5311590 +
aatcacatgtttattattttga

SEQ ID NO: 98531 - DNA, 22 bp, Artificial Sequence
  Synthetic oligonucleotide; TTT chr11 5311580 5311601 5311597 5311602 +
attattttgactcattctcagt

SEQ ID NO: 98532 - DNA, 22 bp, Artificial Sequence
  Synthetic oligonucleotide; TTA chr11 5311581 5311602 5311598 5311603 +
ttattttgactcattctcagtg

SEQ ID NO: 98533 - DNA, 22 bp, Artificial Sequence
  Synthetic oligonucleotide; TTA chr11 5311584 5311605 5311601 5311606 +
ttttgactcattctcagtgtcc

SEQ ID NO: 98534 - DNA, 22 bp, Artificial Sequence
  Synthetic oligonucleotide; TTT chr11 5311587 5311608 5311604 5311609 +
tgactcattctcagtgtcccac

SEQ ID NO: 98535 - DNA, 22 bp, Artificial Sequence
  Synthetic oligonucleotide; TTT chr11 5311588 5311609 5311605 5311610 +
gactcattctcagtgtcccaca

SEQ ID NO: 98536 - DNA, 22 bp, Artificial Sequence
  Synthetic oligonucleotide; TTG chr11 5311589 5311610 5311606 5311611 +
actcattctcagtgtcccacaa

SEQ ID NO: 98537 - DNA, 22 bp, Artificial Sequence
  Synthetic oligonucleotide; CTC chr11 5311593 5311614 5311610 5311615 +
attctcagtgtcccacaacttt

SEQ ID NO: 98538 - DNA, 22 bp, Artificial Sequence
  Synthetic oligonucleotide; TTC chr11 5311597 5311618 5311614 5311619 +
tcagtgtcccacaactttaaaa

SEQ ID NO: 98539 - DNA, 22 bp, Artificial Sequence
  Synthetic oligonucleotide; CTC chr11 5311599 5311620 5311616 5311621 +
agtgtcccacaactttaaaaat

SEQ ID NO: 98540 - DNA, 22 bp, Artificial Sequence
  Synthetic oligonucleotide; CTT chr11 5311614 5311635 5311631 5311636 +
taaaaattataatgattcttct

SEQ ID NO: 98541 - DNA, 22 bp, Artificial Sequence
  Synthetic oligonucleotide; TTT chr11 5311615 5311636 5311632 5311637 +
aaaaattataatgattcttctt

SEQ ID NO: 98542 - DNA, 22 bp, Artificial Sequence
  Synthetic oligonucleotide; TTA chr11 5311616 5311637 5311633 5311638 +
aaaattataatgattcttctta

SEQ ID NO: 98543 - DNA, 22 bp, Artificial Sequence
  Synthetic oligonucleotide; TTA chr11 5311623 5311644 5311640 5311645 +
taatgattcttcttatttatag

SEQ ID NO: 98544 - DNA, 22 bp, Artificial Sequence
  Synthetic oligonucleotide; TTC chr11 5311632 5311653 5311649 5311654 +
ttcttatttatagacaatacat

SEQ ID NO: 98545 - DNA, 22 bp, Artificial Sequence
  Synthetic oligonucleotide; CTT chr11 5311634 5311655 5311651 5311656 +
cttatttatagacaatacataa

SEQ ID NO: 98546 - DNA, 22 bp, Artificial Sequence
  Synthetic oligonucleotide; TTC chr11 5311635 5311656 5311652 5311657 +
ttatttatagacaatacataat

SEQ ID NO: 98547 - DNA, 22 bp, Artificial Sequence
  Synthetic oligonucleotide; CTT chr11 5311637 5311658 5311654 5311659 +
atttatagacaatacataatca

SEQ ID NO: 98548 - DNA, 22 bp, Artificial Sequence
  Synthetic oligonucleotide; TTA chr11 5311638 5311659 5311655 5311660 +
tttatagacaatacataatcag

SEQ ID NO: 98549 - DNA, 22 bp, Artificial Sequence
  Synthetic oligonucleotide; TTT chr11 5311641 5311662 5311658 5311663 +
atagacaatacataatcagtga

SEQ ID NO: 98550 - DNA, 22 bp, Artificial Sequence
  Synthetic oligonucleotide; TTA chr11 5311642 5311663 5311659 5311664 +
tagacaatacataatcagtgac

SEQ ID NO: 98551 - DNA, 22 bp, Artificial Sequence
  Synthetic oligonucleotide; CTG chr11 5311666 5311687 5311683 5311688 +
cctttcttttggcactgccttt

SEQ ID NO: 98552 - DNA, 22 bp, Artificial Sequence
  Synthetic oligonucleotide; CTT chr11 5311670 5311691 5311687 5311692 +
tcttttggcactgcctttcttc

SEQ ID NO: 98553 - DNA, 22 bp, Artificial Sequence
  Synthetic oligonucleotide; TTT chr11 5311671 5311692 5311688 5311693 +
cttttggcactgcctttcttcc

SEQ ID NO: 98554 - DNA, 22 bp, Artificial Sequence
  Synthetic oligonucleotide; TTC chr11 5311672 5311693 5311689 5311694 +
ttttggcactgcctttcttcca

SEQ ID NO: 98555 - DNA, 22 bp, Artificial Sequence
  Synthetic oligonucleotide; CTT chr11 5311674 5311695 5311691 5311696 +
ttggcactgcctttcttccaag

SEQ ID NO: 98556 - DNA, 22 bp, Artificial Sequence
  Synthetic oligonucleotide; TTT chr11 5311675 5311696 5311692 5311697 +
tggcactgcctttcttccaaga

SEQ ID NO: 98557 - DNA, 22 bp, Artificial Sequence
  Synthetic oligonucleotide; TTT chr11 5311676 5311697 5311693 5311698 +
ggcactgcctttcttccaagaa

SEQ ID NO: 98558 - DNA, 22 bp, Artificial Sequence
  Synthetic oligonucleotide; TTG chr11 5311677 5311698 5311694 5311699 +
gcactgcctttcttccaagaac

SEQ ID NO: 98559 - DNA, 22 bp, Artificial Sequence
  Synthetic oligonucleotide; CTG chr11 5311683 5311704 5311700 5311705 +
cctttcttccaagaacatgtca

SEQ ID NO: 98560 - DNA, 22 bp, Artificial Sequence
  Synthetic oligonucleotide; CTT chr11 5311687 5311708 5311704 5311709 +
tcttccaagaacatgtcagaaa

SEQ ID NO: 98561 - DNA, 22 bp, Artificial Sequence
  Synthetic oligonucleotide; TTT chr11 5311688 5311709 5311705 5311710 +
cttccaagaacatgtcagaaat

SEQ ID NO: 98562 - DNA, 22 bp, Artificial Sequence
  Synthetic oligonucleotide; TTC chr11 5311689 5311710 5311706 5311711 +
ttccaagaacatgtcagaaatt

SEQ ID NO: 98563 - DNA, 22 bp, Artificial Sequence
  Synthetic oligonucleotide; CTT chr11 5311691 5311712 5311708 5311713 +
ccaagaacatgtcagaaattga

SEQ ID NO: 98564 - DNA, 22 bp, Artificial Sequence
  Synthetic oligonucleotide; TTC chr11 5311692 5311713 5311709 5311714 +
caagaacatgtcagaaattgat

SEQ ID NO: 98565 - DNA, 22 bp, Artificial Sequence
  Synthetic oligonucleotide; TTG chr11 5311712 5311733 5311729 5311734 +
atggtgatttttgctcctttcc

SEQ ID NO: 98566 - DNA, 22 bp, Artificial Sequence
  Synthetic oligonucleotide; TTT chr11 5311722 5311743 5311739 5311744 +
ttgctcctttccaactctttct

SEQ ID NO: 98567 - DNA, 22 bp, Artificial Sequence
  Synthetic oligonucleotide; TTT chr11 5311723 5311744 5311740 5311745 +
tgctcctttccaactctttctt

SEQ ID NO: 98568 - DNA, 22 bp, Artificial Sequence
  Synthetic oligonucleotide; TTT chr11 5311724 5311745 5311741 5311746 +
gctcctttccaactctttcttt

SEQ ID NO: 98569 - DNA, 22 bp, Artificial Sequence
  Synthetic oligonucleotide; TTG chr11 5311725 5311746 5311742 5311747 +
ctcctttccaactctttctttc

SEQ ID NO: 98570 - DNA, 22 bp, Artificial Sequence
  Synthetic oligonucleotide; CTC chr11 5311728 5311749 5311745 5311750 +
ctttccaactctttctttcctc

SEQ ID NO: 98571 - DNA, 22 bp, Artificial Sequence
  Synthetic oligonucleotide; CTT chr11 5311731 5311752 5311748 5311753 +
tccaactctttctttcctctgc

SEQ ID NO: 98572 - DNA, 22 bp, Artificial Sequence
  Synthetic oligonucleotide; TTT chr11 5311732 5311753 5311749 5311754 +
ccaactctttctttcctctgct

SEQ ID NO: 98573 - DNA, 22 bp, Artificial Sequence
  Synthetic oligonucleotide; TTC chr11 5311733 5311754 5311750 5311755 +
caactctttctttcctctgctt

SEQ ID NO: 98574 - DNA, 22 bp, Artificial Sequence
  Synthetic oligonucleotide; CTC chr11 5311739 5311760 5311756 5311761 +
tttctttcctctgcttttctaa

SEQ ID NO: 98575 - DNA, 22 bp, Artificial Sequence
  Synthetic oligonucleotide; CTT chr11 5311741 5311762 5311758 5311763 +
tctttcctctgcttttctaaat

SEQ ID NO: 98576 - DNA, 22 bp, Artificial Sequence
  Synthetic oligonucleotide; TTT chr11 5311742 5311763 5311759 5311764 +
ctttcctctgcttttctaaata

SEQ ID NO: 98577 - DNA, 22 bp, Artificial Sequence
  Synthetic oligonucleotide; TTC chr11 5311743 5311764 5311760 5311765 +
tttcctctgcttttctaaataa

SEQ ID NO: 98578 - DNA, 22 bp, Artificial Sequence
  Synthetic oligonucleotide; CTT chr11 5311745 5311766 5311762 5311767 +
tcctctgcttttctaaataacc

SEQ ID NO: 98579 - DNA, 22 bp, Artificial Sequence
  Synthetic oligonucleotide; TTT chr11 5311746 5311767 5311763 5311768 +
cctctgcttttctaaataacct

SEQ ID NO: 98580 - DNA, 22 bp, Artificial Sequence
  Synthetic oligonucleotide; TTC chr11 5311747 5311768 5311764 5311769 +
ctctgcttttctaaataacctg

SEQ ID NO: 98581 - DNA, 22 bp, Artificial Sequence
  Synthetic oligonucleotide; CTC chr11 5311750 5311771 5311767 5311772 +
tgcttttctaaataacctgtaa

SEQ ID NO: 98582 - DNA, 22 bp, Artificial Sequence
  Synthetic oligonucleotide; CTG chr11 5311752 5311773 5311769 5311774 +
cttttctaaataacctgtaaac

SEQ ID NO: 98583 - DNA, 22 bp, Artificial Sequence
  Synthetic oligonucleotide; CTT chr11 5311755 5311776 5311772 5311777 +
ttctaaataacctgtaaacctt

SEQ ID NO: 98584 - DNA, 22 bp, Artificial Sequence
  Synthetic oligonucleotide; TTT chr11 5311756 5311777 5311773 5311778 +
tctaaataacctgtaaacctta

SEQ ID NO: 98585 - DNA, 22 bp, Artificial Sequence
  Synthetic oligonucleotide; TTT chr11 5311757 5311778 5311774 5311779 +
ctaaataacctgtaaaccttat

SEQ ID NO: 98586 - DNA, 22 bp, Artificial Sequence
  Synthetic oligonucleotide; TTC chr11 5311758 5311779 5311775 5311780 +
taaataacctgtaaaccttatt

SEQ ID NO: 98587 - DNA, 22 bp, Artificial Sequence
  Synthetic oligonucleotide; CTA chr11 5311760 5311781 5311777 5311782 +
aataacctgtaaaccttattat

SEQ ID NO: 98588 - DNA, 22 bp, Artificial Sequence
  Synthetic oligonucleotide; CTG chr11 5311769 5311790 5311786 5311791 +
taaaccttattatatttagacc

SEQ ID NO: 98589 - DNA, 22 bp, Artificial Sequence
  Synthetic oligonucleotide; CTT chr11 5311777 5311798 5311794 5311799 +
attatatttagaccttaaatat

SEQ ID NO: 98590 - DNA, 22 bp, Artificial Sequence
  Synthetic oligonucleotide; TTA chr11 5311778 5311799 5311795 5311800 +
ttatatttagaccttaaatatt

SEQ ID NO: 98591 - DNA, 22 bp, Artificial Sequence
  Synthetic oligonucleotide; TTA chr11 5311781 5311802 5311798 5311803 +
tatttagaccttaaatatttgt

SEQ ID NO: 98592 - DNA, 22 bp, Artificial Sequence
  Synthetic oligonucleotide; TTT chr11 5311786 5311807 5311803 5311808 +
agaccttaaatatttgtcatat

SEQ ID NO: 98593 - DNA, 22 bp, Artificial Sequence
  Synthetic oligonucleotide; TTA chr11 5311787 5311808 5311804 5311809 +
gaccttaaatatttgtcatatc

SEQ ID NO: 98594 - DNA, 22 bp, Artificial Sequence
  Synthetic oligonucleotide; CTT chr11 5311793 5311814 5311810 5311815 +
aaatatttgtcatatctctcca

SEQ ID NO: 98595 - DNA, 22 bp, Artificial Sequence
  Synthetic oligonucleotide; TTA chr11 5311794 5311815 5311811 5311816 +
aatatttgtcatatctctccat

SEQ ID NO: 98596 - DNA, 22 bp, Artificial Sequence
  Synthetic oligonucleotide; TTT chr11 5311801 5311822 5311818 5311823 +
gtcatatctctccattaccatt

SEQ ID NO: 98597 - DNA, 22 bp, Artificial Sequence
  Synthetic oligonucleotide; TTG chr11 5311802 5311823 5311819 5311824 +
tcatatctctccattaccattt

SEQ ID NO: 98598 - DNA, 22 bp, Artificial Sequence
  Synthetic oligonucleotide; CTC chr11 5311811 5311832 5311828 5311833 +
tccattaccatttccactttcc

SEQ ID NO: 98599 - DNA, 22 bp, Artificial Sequence
  Synthetic oligonucleotide; CTC chr11 5311813 5311834 5311830 5311835 +
cattaccatttccactttccta

SEQ ID NO: 98600 - DNA, 22 bp, Artificial Sequence
  Synthetic oligonucleotide; TTA chr11 5311818 5311839 5311835 5311840 +
ccatttccactttcctaaattg

SEQ ID NO: 98601 - DNA, 22 bp, Artificial Sequence
  Synthetic oligonucleotide; TTT chr11 5311824 5311845 5311841 5311846 +
ccactttcctaaattgagttac

SEQ ID NO: 98602 - DNA, 22 bp, Artificial Sequence
  Synthetic oligonucleotide; TTC chr11 5311825 5311846 5311842 5311847 +
cactttcctaaattgagttact

SEQ ID NO: 98603 - DNA, 22 bp, Artificial Sequence
  Synthetic oligonucleotide; CTT chr11 5311830 5311851 5311847 5311852 +
tcctaaattgagttactattat

SEQ ID NO: 98604 - DNA, 22 bp, Artificial Sequence
  Synthetic oligonucleotide; TTT chr11 5311831 5311852 5311848 5311853 +
cctaaattgagttactattatc

SEQ ID NO: 98605 - DNA, 22 bp, Artificial Sequence
  Synthetic oligonucleotide; TTC chr11 5311832 5311853 5311849 5311854 +
ctaaattgagttactattatct

SEQ ID NO: 98606 - DNA, 22 bp, Artificial Sequence
  Synthetic oligonucleotide; CTA chr11 5311835 5311856 5311852 5311857 +
aattgagttactattatctttc

SEQ ID NO: 98607 - DNA, 22 bp, Artificial Sequence
  Synthetic oligonucleotide; TTG chr11 5311840 5311861 5311857 5311862 +
agttactattatctttcttcaa

SEQ ID NO: 98608 - DNA, 22 bp, Artificial Sequence
  Synthetic oligonucleotide; TTA chr11 5311845 5311866 5311862 5311867 +
ctattatctttcttcaaattac

SEQ ID NO: 98609 - DNA, 22 bp, Artificial Sequence
  Synthetic oligonucleotide; CTA chr11 5311848 5311869 5311865 5311870 +
ttatctttcttcaaattactct

SEQ ID NO: 98610 - DNA, 22 bp, Artificial Sequence
  Synthetic oligonucleotide; TTA chr11 5311851 5311872 5311868 5311873 +
tctttcttcaaattactctaat

SEQ ID NO: 98611 - DNA, 22 bp, Artificial Sequence
  Synthetic oligonucleotide; CTT chr11 5311855 5311876 5311872 5311877 +
tcttcaaattactctaatattc

SEQ ID NO: 98612 - DNA, 22 bp, Artificial Sequence
  Synthetic oligonucleotide; TTT chr11 5311856 5311877 5311873 5311878 +
cttcaaattactctaatattct

SEQ ID NO: 98613 - DNA, 22 bp, Artificial Sequence
  Synthetic oligonucleotide; TTC chr11 5311857 5311878 5311874 5311879 +
ttcaaattactctaatattctg

SEQ ID NO: 98614 - DNA, 22 bp, Artificial Sequence
  Synthetic oligonucleotide; CTT chr11 5311859 5311880 5311876 5311881 +
caaattactctaatattctgcc

SEQ ID NO: 98615 - DNA, 22 bp, Artificial Sequence
  Synthetic oligonucleotide; TTC chr11 5311860 5311881 5311877 5311882 +
aaattactctaatattctgccc

SEQ ID NO: 98616 - DNA, 22 bp, Artificial Sequence
  Synthetic oligonucleotide; TTA chr11 5311866 5311887 5311883 5311888 +
ctctaatattctgccctttccc

SEQ ID NO: 98617 - DNA, 22 bp, Artificial Sequence
  Synthetic oligonucleotide; CTC chr11 5311869 5311890 5311886 5311891 +
taatattctgccctttccctgc

SEQ ID NO: 98618 - DNA, 22 bp, Artificial Sequence
  Synthetic oligonucleotide; CTA chr11 5311871 5311892 5311888 5311893 +
atattctgccctttccctgcct

SEQ ID NO: 98619 - DNA, 22 bp, Artificial Sequence
  Synthetic oligonucleotide; TTC chr11 5311877 5311898 5311894 5311899 +
tgccctttccctgcctccctca

SEQ ID NO: 98620 - DNA, 22 bp, Artificial Sequence
  Synthetic oligonucleotide; CTG chr11 5311879 5311900 5311896 5311901 +
ccctttccctgcctccctcaat

SEQ ID NO: 98621 - DNA, 22 bp, Artificial Sequence
  Synthetic oligonucleotide; CTT chr11 5311884 5311905 5311901 5311906 +
tccctgcctccctcaattccat

SEQ ID NO: 98622 - DNA, 22 bp, Artificial Sequence
  Synthetic oligonucleotide; TTT chr11 5311885 5311906 5311902 5311907 +
ccctgcctccctcaattccatt

SEQ ID NO: 98623 - DNA, 22 bp, Artificial Sequence
  Synthetic oligonucleotide; TTC chr11 5311886 5311907 5311903 5311908 +
cctgcctccctcaattccattt

SEQ ID NO: 98624 - DNA, 22 bp, Artificial Sequence
  Synthetic oligonucleotide; CTG chr11 5311890 5311911 5311907 5311912 +
cctccctcaattccattttata

SEQ ID NO: 98625 - DNA, 22 bp, Artificial Sequence
  Synthetic oligonucleotide; CTC chr11 5311894 5311915 5311911 5311916 +
cctcaattccattttataaata

SEQ ID NO: 98626 - DNA, 22 bp, Artificial Sequence
  Synthetic oligonucleotide; CTC chr11 5311898 5311919 5311915 5311920 +
aattccattttataaataatat

SEQ ID NO: 98627 - DNA, 22 bp, Artificial Sequence
  Synthetic oligonucleotide; TTC chr11 5311903 5311924 5311920 5311925 +
cattttataaataatattgaag

SEQ ID NO: 98628 - DNA, 22 bp, Artificial Sequence
  Synthetic oligonucleotide; TTT chr11 5311908 5311929 5311925 5311930 +
tataaataatattgaagtaatt

SEQ ID NO: 98629 - DNA, 22 bp, Artificial Sequence
  Synthetic oligonucleotide; TTT chr11 5311909 5311930 5311926 5311931 +
ataaataatattgaagtaattt

SEQ ID NO: 98630 - DNA, 22 bp, Artificial Sequence
  Synthetic oligonucleotide; TTA chr11 5311910 5311931 5311927 5311932 +
taaataatattgaagtaatttt

SEQ ID NO: 98631 - DNA, 22 bp, Artificial Sequence
  Synthetic oligonucleotide; TTG chr11 5311922 5311943 5311939 5311944 +
aagtaattttaaaacatcaatg

SEQ ID NO: 98632 - DNA, 22 bp, Artificial Sequence
  Synthetic oligonucleotide; TTT chr11 5311931 5311952 5311948 5311953 +
taaaacatcaatgaattatgca

SEQ ID NO: 98633 - DNA, 22 bp, Artificial Sequence
  Synthetic oligonucleotide; TTT chr11 5311932 5311953 5311949 5311954 +
aaaacatcaatgaattatgcag

SEQ ID NO: 98634 - DNA, 22 bp, Artificial Sequence
  Synthetic oligonucleotide; TTA chr11 5311933 5311954 5311950 5311955 +
aaacatcaatgaattatgcagc

SEQ ID NO: 98635 - DNA, 22 bp, Artificial Sequence
  Synthetic oligonucleotide; TTA chr11 5311949 5311970 5311966 5311971 +
tgcagcttctttcagtagcttt

SEQ ID NO: 98636 - DNA, 22 bp, Artificial Sequence
  Synthetic oligonucleotide; CTT chr11 5311957 5311978 5311974 5311979 +
ctttcagtagctttccatgact

SEQ ID NO: 98637 - DNA, 22 bp, Artificial Sequence
  Synthetic oligonucleotide; TTC chr11 5311958 5311979 5311975 5311980 +
tttcagtagctttccatgactc

SEQ ID NO: 98638 - DNA, 22 bp, Artificial Sequence
  Synthetic oligonucleotide; CTT chr11 5311960 5311981 5311977 5311982 +
tcagtagctttccatgactccg

SEQ ID NO: 98639 - DNA, 22 bp, Artificial Sequence
  Synthetic oligonucleotide; TTT chr11 5311961 5311982 5311978 5311983 +
cagtagctttccatgactccga

SEQ ID NO: 98640 - DNA, 22 bp, Artificial Sequence
  Synthetic oligonucleotide; TTC chr11 5311962 5311983 5311979 5311984 +
agtagctttccatgactccgag

SEQ ID NO: 98641 - DNA, 22 bp, Artificial Sequence
  Synthetic oligonucleotide; CTT chr11 5311970 5311991 5311987 5311992 +
tccatgactccgagtagagact

SEQ ID NO: 98642 - DNA, 22 bp, Artificial Sequence
  Synthetic oligonucleotide; TTT chr11 5311971 5311992 5311988 5311993 +
ccatgactccgagtagagactc

SEQ ID NO: 98643 - DNA, 22 bp, Artificial Sequence
  Synthetic oligonucleotide; TTC chr11 5311972 5311993 5311989 5311994 +
catgactccgagtagagactca

SEQ ID NO: 98644 - DNA, 22 bp, Artificial Sequence
  Synthetic oligonucleotide; CTC chr11 5311980 5312001 5311997 5312002 +
cgagtagagactcaaactctta

SEQ ID NO: 98645 - DNA, 22 bp, Artificial Sequence
  Synthetic oligonucleotide; CTC chr11 5311993 5312014 5312010 5312015 +
aaactcttatgatgaccaataa

SEQ ID NO: 98646 - DNA, 22 bp, Artificial Sequence
  Synthetic oligonucleotide; CTC chr11 5311999 5312020 5312016 5312021 +
ttatgatgaccaataaggccat

SEQ ID NO: 98647 - DNA, 22 bp, Artificial Sequence
  Synthetic oligonucleotide; CTT chr11 5312001 5312022 5312018 5312023 +
atgatgaccaataaggccattc

SEQ ID NO: 98648 - DNA, 22 bp, Artificial Sequence
  Synthetic oligonucleotide; TTA chr11 5312002 5312023 5312019 5312024 +
tgatgaccaataaggccattcc

SEQ ID NO: 98649 - DNA, 22 bp, Artificial Sequence
  Synthetic oligonucleotide; TTC chr11 5312023 5312044 5312040 5312045 +
cttccctcttcagcctcttctc

SEQ ID NO: 98650 - DNA, 22 bp, Artificial Sequence
  Synthetic oligonucleotide; CTT chr11 5312026 5312047 5312043 5312048 +
ccctcttcagcctcttctcaaa

SEQ ID NO: 98651 - DNA, 22 bp, Artificial Sequence
  Synthetic oligonucleotide; TTC chr11 5312027 5312048 5312044 5312049 +
cctcttcagcctcttctcaaag

SEQ ID NO: 98652 - DNA, 22 bp, Artificial Sequence
  Synthetic oligonucleotide; CTC chr11 5312031 5312052 5312048 5312053 +
ttcagcctcttctcaaagcaaa

SEQ ID NO: 98653 - DNA, 22 bp, Artificial Sequence
  Synthetic oligonucleotide; CTT chr11 5312033 5312054 5312050 5312055 +
cagcctcttctcaaagcaaaca

SEQ ID NO: 98654 - DNA, 22 bp, Artificial Sequence
  Synthetic oligonucleotide; TTC chr11 5312034 5312055 5312051 5312056 +
agcctcttctcaaagcaaacac

SEQ ID NO: 98655 - DNA, 22 bp, Artificial Sequence
  Synthetic oligonucleotide; CTC chr11 5312040 5312061 5312057 5312062 +
ttctcaaagcaaacaccctctt

SEQ ID NO: 98656 - DNA, 22 bp, Artificial Sequence
  Synthetic oligonucleotide; CTT chr11 5312042 5312063 5312059 5312064 +
ctcaaagcaaacaccctcttcc

SEQ ID NO: 98657 - DNA, 22 bp, Artificial Sequence
  Synthetic oligonucleotide; TTC chr11 5312043 5312064 5312060 5312065 +
tcaaagcaaacaccctcttcca

SEQ ID NO: 98658 - DNA, 22 bp, Artificial Sequence
  Synthetic oligonucleotide; CTC chr11 5312045 5312066 5312062 5312067 +
aaagcaaacaccctcttccagt

SEQ ID NO: 98659 - DNA, 22 bp, Artificial Sequence
  Synthetic oligonucleotide; CTC chr11 5312060 5312081 5312077 5312082 +
ttccagtagccaccttccctaa

SEQ ID NO: 98660 - DNA, 22 bp, Artificial Sequence
  Synthetic oligonucleotide; CTT chr11 5312062 5312083 5312079 5312084 +
ccagtagccaccttccctaata

SEQ ID NO: 98661 - DNA, 22 bp, Artificial Sequence
  Synthetic oligonucleotide; TTC chr11 5312063 5312084 5312080 5312085 +
cagtagccaccttccctaatat

SEQ ID NO: 98662 - DNA, 22 bp, Artificial Sequence
  Synthetic oligonucleotide; CTT chr11 5312076 5312097 5312093 5312098 +
ccctaatataaaccaacctagc

SEQ ID NO: 98663 - DNA, 22 bp, Artificial Sequence
  Synthetic oligonucleotide; TTC chr11 5312077 5312098 5312094 5312099 +
cctaatataaaccaacctagct

SEQ ID NO: 98664 - DNA, 22 bp, Artificial Sequence
  Synthetic oligonucleotide; CTA chr11 5312081 5312102 5312098 5312103 +
atataaaccaacctagctgagg

SEQ ID NO: 98665 - DNA, 22 bp, Artificial Sequence
  Synthetic oligonucleotide; CTA chr11 5312096 5312117 5312113 5312118 +
gctgaggtctccacacacactc

SEQ ID NO: 98666 - DNA, 22 bp, Artificial Sequence
  Synthetic oligonucleotide; CTG chr11 5312100 5312121 5312117 5312122 +
aggtctccacacacactccttc

SEQ ID NO: 98667 - DNA, 22 bp, Artificial Sequence
  Synthetic oligonucleotide; CTC chr11 5312107 5312128 5312124 5312129 +
cacacacactccttcagtctta

SEQ ID NO: 98668 - DNA, 22 bp, Artificial Sequence
  Synthetic oligonucleotide; CTC chr11 5312118 5312139 5312135 5312140 +
cttcagtcttagaatattcttg

SEQ ID NO: 98669 - DNA, 22 bp, Artificial Sequence
  Synthetic oligonucleotide; CTT chr11 5312121 5312142 5312138 5312143 +
cagtcttagaatattcttgtct

SEQ ID NO: 98670 - DNA, 22 bp, Artificial Sequence
  Synthetic oligonucleotide; TTC chr11 5312122 5312143 5312139 5312144 +
agtcttagaatattcttgtctg

SEQ ID NO: 98671 - DNA, 22 bp, Artificial Sequence
  Synthetic oligonucleotide; CTT chr11 5312128 5312149 5312145 5312150 +
agaatattcttgtctgtatttt

SEQ ID NO: 98672 - DNA, 22 bp, Artificial Sequence
  Synthetic oligonucleotide; TTA chr11 5312129 5312150 5312146 5312151 +
gaatattcttgtctgtattttc

SEQ ID NO: 98673 - DNA, 22 bp, Artificial Sequence
  Synthetic oligonucleotide; TTC chr11 5312137 5312158 5312154 5312159 +
ttgtctgtattttcaccagtta

SEQ ID NO: 98674 - DNA, 22 bp, Artificial Sequence
  Synthetic oligonucleotide; CTT chr11 5312139 5312160 5312156 5312161 +
gtctgtattttcaccagttagt

SEQ ID NO: 98675 - DNA, 22 bp, Artificial Sequence
  Synthetic oligonucleotide; TTG chr11 5312140 5312161 5312157 5312162 +
tctgtattttcaccagttagtt

SEQ ID NO: 98676 - DNA, 22 bp, Artificial Sequence
  Synthetic oligonucleotide; CTG chr11 5312144 5312165 5312161 5312166 +
tattttcaccagttagtttcta

SEQ ID NO: 98677 - DNA, 22 bp, Artificial Sequence
  Synthetic oligonucleotide; TTT chr11 5312149 5312170 5312166 5312171 +
tcaccagttagtttctaatcca

SEQ ID NO: 98678 - DNA, 22 bp, Artificial Sequence
  Synthetic oligonucleotide; TTT chr11 5312150 5312171 5312167 5312172 +
caccagttagtttctaatccat

SEQ ID NO: 98679 - DNA, 22 bp, Artificial Sequence
  Synthetic oligonucleotide; TTC chr11 5312151 5312172 5312168 5312173 +
accagttagtttctaatccatt

SEQ ID NO: 98680 - DNA, 22 bp, Artificial Sequence
  Synthetic oligonucleotide; TTA chr11 5312159 5312180 5312176 5312181 +
gtttctaatccattttcaggtc

SEQ ID NO: 98681 - DNA, 22 bp, Artificial Sequence
  Synthetic oligonucleotide; TTT chr11 5312163 5312184 5312180 5312185 +
ctaatccattttcaggtctcag

SEQ ID NO: 98682 - DNA, 22 bp, Artificial Sequence
  Synthetic oligonucleotide; TTC chr11 5312164 5312185 5312181 5312186 +
taatccattttcaggtctcagc

SEQ ID NO: 98683 - DNA, 22 bp, Artificial Sequence
  Synthetic oligonucleotide; CTA chr11 5312166 5312187 5312183 5312188 +
atccattttcaggtctcagctg

SEQ ID NO: 98684 - DNA, 22 bp, Artificial Sequence
  Synthetic oligonucleotide; TTT chr11 5312174 5312195 5312191 5312196 +
tcaggtctcagctgaagggaca

SEQ ID NO: 98685 - DNA, 22 bp, Artificial Sequence
  Synthetic oligonucleotide; TTT chr11 5312175 5312196 5312192 5312197 +
caggtctcagctgaagggacac

SEQ ID NO: 98686 - DNA, 22 bp, Artificial Sequence
  Synthetic oligonucleotide; TTC chr11 5312176 5312197 5312193 5312198 +
aggtctcagctgaagggacact

SEQ ID NO: 98687 - DNA, 22 bp, Artificial Sequence
  Synthetic oligonucleotide; CTC chr11 5312183 5312204 5312200 5312205 +
agctgaagggacactttctcag

SEQ ID NO: 98688 - DNA, 22 bp, Artificial Sequence
  Synthetic oligonucleotide; CTG chr11 5312188 5312209 5312205 5312210 +
aagggacactttctcagggaat

SEQ ID NO: 98689 - DNA, 22 bp, Artificial Sequence
  Synthetic oligonucleotide; CTT chr11 5312199 5312220 5312216 5312221 +
tctcagggaatcttacccttat

SEQ ID NO: 98690 - DNA, 22 bp, Artificial Sequence
  Synthetic oligonucleotide; TTT chr11 5312200 5312221 5312217 5312222 +
ctcagggaatcttacccttatt

SEQ ID NO: 98691 - DNA, 22 bp, Artificial Sequence
  Synthetic oligonucleotide; TTC chr11 5312201 5312222 5312218 5312223 +
tcagggaatcttacccttattt

SEQ ID NO: 98692 - DNA, 22 bp, Artificial Sequence
  Synthetic oligonucleotide; CTC chr11 5312203 5312224 5312220 5312225 +
agggaatcttacccttatttca

SEQ ID NO: 98693 - DNA, 22 bp, Artificial Sequence
  Synthetic oligonucleotide; CTT chr11 5312213 5312234 5312230 5312235 +
acccttatttcaagccataacc

SEQ ID NO: 98694 - DNA, 22 bp, Artificial Sequence
  Synthetic oligonucleotide; TTA chr11 5312214 5312235 5312231 5312236 +
cccttatttcaagccataacct

SEQ ID NO: 98695 - DNA, 22 bp, Artificial Sequence
  Synthetic oligonucleotide; CTT chr11 5312219 5312240 5312236 5312241 +
atttcaagccataacctcaagc

SEQ ID NO: 98696 - DNA, 22 bp, Artificial Sequence
  Synthetic oligonucleotide; TTA chr11 5312220 5312241 5312237 5312242 +
tttcaagccataacctcaagcc

SEQ ID NO: 98697 - DNA, 22 bp, Artificial Sequence
  Synthetic oligonucleotide; TTT chr11 5312223 5312244 5312240 5312245 +
caagccataacctcaagccttt

SEQ ID NO: 98698 - DNA, 22 bp, Artificial Sequence
  Synthetic oligonucleotide; TTC chr11 5312224 5312245 5312241 5312246 +
aagccataacctcaagcctttt

SEQ ID NO: 98699 - DNA, 22 bp, Artificial Sequence
  Synthetic oligonucleotide; CTC chr11 5312237 5312258 5312254 5312259 +
aagccttttttgagacccacac

SEQ ID NO: 98700 - DNA, 22 bp, Artificial Sequence
  Synthetic oligonucleotide; CTT chr11 5312244 5312265 5312261 5312266 +
ttttgagacccacactctccat

SEQ ID NO: 98701 - DNA, 22 bp, Artificial Sequence
  Synthetic oligonucleotide; TTT chr11 5312245 5312266 5312262 5312267 +
tttgagacccacactctccatt

SEQ ID NO: 98702 - DNA, 22 bp, Artificial Sequence
  Synthetic oligonucleotide; TTT chr11 5312246 5312267 5312263 5312268 +
ttgagacccacactctccattc

SEQ ID NO: 98703 - DNA, 22 bp, Artificial Sequence
  Synthetic oligonucleotide; TTT chr11 5312247 5312268 5312264 5312269 +
tgagacccacactctccattca

SEQ ID NO: 98704 - DNA, 22 bp, Artificial Sequence
  Synthetic oligonucleotide; TTT chr11 5312248 5312269 5312265 5312270 +
gagacccacactctccattcag

SEQ ID NO: 98705 - DNA, 22 bp, Artificial Sequence
  Synthetic oligonucleotide; TTG chr11 5312249 5312270 5312266 5312271 +
agacccacactctccattcagt

SEQ ID NO: 98706 - DNA, 22 bp, Artificial Sequence
  Synthetic oligonucleotide; CTC chr11 5312261 5312282 5312278 5312283 +
tccattcagtgtcttctttctg

SEQ ID NO: 98707 - DNA, 22 bp, Artificial Sequence
  Synthetic oligonucleotide; CTC chr11 5312263 5312284 5312280 5312285 +
cattcagtgtcttctttctgct

SEQ ID NO: 98708 - DNA, 22 bp, Artificial Sequence
  Synthetic oligonucleotide; TTC chr11 5312268 5312289 5312285 5312290 +
agtgtcttctttctgctttatg

SEQ ID NO: 98709 - DNA, 22 bp, Artificial Sequence
  Synthetic oligonucleotide; CTT chr11 5312276 5312297 5312293 5312298 +
ctttctgctttatgattaatca

SEQ ID NO: 98710 - DNA, 22 bp, Artificial Sequence
  Synthetic oligonucleotide; TTC chr11 5312277 5312298 5312294 5312299 +
tttctgctttatgattaatcac

SEQ ID NO: 98711 - DNA, 22 bp, Artificial Sequence
  Synthetic oligonucleotide; CTT chr11 5312279 5312300 5312296 5312301 +
tctgctttatgattaatcacag

SEQ ID NO: 98712 - DNA, 22 bp, Artificial Sequence
  Synthetic oligonucleotide; TTT chr11 5312280 5312301 5312297 5312302 +
ctgctttatgattaatcacagc

SEQ ID NO: 98713 - DNA, 22 bp, Artificial Sequence
  Synthetic oligonucleotide; TTC chr11 5312281 5312302 5312298 5312303 +
tgctttatgattaatcacagca

SEQ ID NO: 98714 - DNA, 22 bp, Artificial Sequence
  Synthetic oligonucleotide; CTG chr11 5312283 5312304 5312300 5312305 +
ctttatgattaatcacagcact

SEQ ID NO: 98715 - DNA, 22 bp, Artificial Sequence
  Synthetic oligonucleotide; CTT chr11 5312286 5312307 5312303 5312308 +
tatgattaatcacagcacttgt

SEQ ID NO: 98716 - DNA, 22 bp, Artificial Sequence
  Synthetic oligonucleotide; TTT chr11 5312287 5312308 5312304 5312309 +
atgattaatcacagcacttgtt

SEQ ID NO: 98717 - DNA, 22 bp, Artificial Sequence
  Synthetic oligonucleotide; TTA chr11 5312288 5312309 5312305 5312310 +
tgattaatcacagcacttgttt

SEQ ID NO: 98718 - DNA, 22 bp, Artificial Sequence
  Synthetic oligonucleotide; TTA chr11 5312294 5312315 5312311 5312316 +
atcacagcacttgttttaaatt

SEQ ID NO: 98719 - DNA, 22 bp, Artificial Sequence
  Synthetic oligonucleotide; CTT chr11 5312306 5312327 5312323 5312328 +
gttttaaatttggatttctttt

SEQ ID NO: 98720 - DNA, 22 bp, Artificial Sequence
  Synthetic oligonucleotide; TTG chr11 5312307 5312328 5312324 5312329 +
ttttaaatttggatttctttta

SEQ ID NO: 98721 - DNA, 22 bp, Artificial Sequence
  Synthetic oligonucleotide; TTT chr11 5312310 5312331 5312327 5312332 +
taaatttggatttcttttattc

SEQ ID NO: 98722 - DNA, 22 bp, Artificial Sequence
  Synthetic oligonucleotide; TTT chr11 5312311 5312332 5312328 5312333 +
aaatttggatttcttttattct

SEQ ID NO: 98723 - DNA, 22 bp, Artificial Sequence
  Synthetic oligonucleotide; TTA chr11 5312312 5312333 5312329 5312334 +
aatttggatttcttttattctt

SEQ ID NO: 98724 - DNA, 22 bp, Artificial Sequence
  Synthetic oligonucleotide; TTT chr11 5312317 5312338 5312334 5312339 +
ggatttcttttattctttgagt

SEQ ID NO: 98725 - DNA, 22 bp, Artificial Sequence
  Synthetic oligonucleotide; TTG chr11 5312318 5312339 5312335 5312340 +
gatttcttttattctttgagtc

SEQ ID NO: 98726 - DNA, 22 bp, Artificial Sequence
  Synthetic oligonucleotide; TTT chr11 5312323 5312344 5312340 5312345 +
cttttattctttgagtccccac

SEQ ID NO: 98727 - DNA, 22 bp, Artificial Sequence
  Synthetic oligonucleotide; TTC chr11 5312324 5312345 5312341 5312346 +
ttttattctttgagtccccact

SEQ ID NO: 98728 - DNA, 22 bp, Artificial Sequence
  Synthetic oligonucleotide; CTT chr11 5312326 5312347 5312343 5312348 +
ttattctttgagtccccactta

SEQ ID NO: 98729 - DNA, 22 bp, Artificial Sequence
  Synthetic oligonucleotide; TTT chr11 5312327 5312348 5312344 5312349 +
tattctttgagtccccacttat

SEQ ID NO: 98730 - DNA, 22 bp, Artificial Sequence
  Synthetic oligonucleotide; TTT chr11 5312328 5312349 5312345 5312350 +
attctttgagtccccacttatt

SEQ ID NO: 98731 - DNA, 22 bp, Artificial Sequence
  Synthetic oligonucleotide; TTA chr11 5312329 5312350 5312346 5312351 +
ttctttgagtccccacttattt

SEQ ID NO: 98732 - DNA, 22 bp, Artificial Sequence
  Synthetic oligonucleotide; TTC chr11 5312332 5312353 5312349 5312354 +
tttgagtccccacttatttgaa

SEQ ID NO: 98733 - DNA, 22 bp, Artificial Sequence
  Synthetic oligonucleotide; CTT chr11 5312334 5312355 5312351 5312356 +
tgagtccccacttatttgaaga

SEQ ID NO: 98734 - DNA, 22 bp, Artificial Sequence
  Synthetic oligonucleotide; TTT chr11 5312335 5312356 5312352 5312357 +
gagtccccacttatttgaagac

SEQ ID NO: 98735 - DNA, 22 bp, Artificial Sequence
  Synthetic oligonucleotide; TTG chr11 5312336 5312357 5312353 5312358 +
agtccccacttatttgaagact

SEQ ID NO: 98736 - DNA, 22 bp, Artificial Sequence
  Synthetic oligonucleotide; CTT chr11 5312347 5312368 5312364 5312369 +
atttgaagactttaagaagaaa

SEQ ID NO: 98737 - DNA, 22 bp, Artificial Sequence
  Synthetic oligonucleotide; TTA chr11 5312348 5312369 5312365 5312370 +
tttgaagactttaagaagaaaa

SEQ ID NO: 98738 - DNA, 22 bp, Artificial Sequence
  Synthetic oligonucleotide; TTT chr11 5312351 5312372 5312368 5312373 +
gaagactttaagaagaaaagtt

SEQ ID NO: 98739 - DNA, 22 bp, Artificial Sequence
  Synthetic oligonucleotide; TTG chr11 5312352 5312373 5312369 5312374 +
aagactttaagaagaaaagttt

SEQ ID NO: 98740 - DNA, 22 bp, Artificial Sequence
  Synthetic oligonucleotide; CTT chr11 5312359 5312380 5312376 5312381 +
taagaagaaaagtttgtctatt

SEQ ID NO: 98741 - DNA, 22 bp, Artificial Sequence
  Synthetic oligonucleotide; TTT chr11 5312360 5312381 5312377 5312382 +
aagaagaaaagtttgtctattt

SEQ ID NO: 98742 - DNA, 22 bp, Artificial Sequence
  Synthetic oligonucleotide; TTA chr11 5312361 5312382 5312378 5312383 +
agaagaaaagtttgtctatttg

SEQ ID NO: 98743 - DNA, 22 bp, Artificial Sequence
  Synthetic oligonucleotide; TTT chr11 5312374 5312395 5312391 5312396 +
gtctatttgctctcttatatca

SEQ ID NO: 98744 - DNA, 22 bp, Artificial Sequence
  Synthetic oligonucleotide; TTG chr11 5312375 5312396 5312392 5312397 +
tctatttgctctcttatatcat

SEQ ID NO: 98745 - DNA, 22 bp, Artificial Sequence
  Synthetic oligonucleotide; CTA chr11 5312379 5312400 5312396 5312401 +
tttgctctcttatatcattttt

SEQ ID NO: 98746 - DNA, 22 bp, Artificial Sequence
  Synthetic oligonucleotide; TTT chr11 5312382 5312403 5312399 5312404 +
gctctcttatatcatttttgct

SEQ ID NO: 98747 - DNA, 22 bp, Artificial Sequence
  Synthetic oligonucleotide; TTG chr11 5312383 5312404 5312400 5312405 +
ctctcttatatcatttttgctt

SEQ ID NO: 98748 - DNA, 22 bp, Artificial Sequence
  Synthetic oligonucleotide; CTC chr11 5312386 5312407 5312403 5312408 +
tcttatatcatttttgcttagc

SEQ ID NO: 98749 - DNA, 22 bp, Artificial Sequence
  Synthetic oligonucleotide; CTC chr11 5312388 5312409 5312405 5312410 +
ttatatcatttttgcttagcaa

SEQ ID NO: 98750 - DNA, 22 bp, Artificial Sequence
  Synthetic oligonucleotide; CTT chr11 5312390 5312411 5312407 5312412 +
atatcatttttgcttagcaagg

SEQ ID NO: 98751 - DNA, 22 bp, Artificial Sequence
  Synthetic oligonucleotide; TTA chr11 5312391 5312412 5312408 5312413 +
tatcatttttgcttagcaaggt

SEQ ID NO: 98752 - DNA, 22 bp, Artificial Sequence
  Synthetic oligonucleotide; TTT chr11 5312399 5312420 5312416 5312421 +
ttgcttagcaaggtgacccata

SEQ ID NO: 98753 - DNA, 22 bp, Artificial Sequence
  Synthetic oligonucleotide; TTT chr11 5312400 5312421 5312417 5312422 +
tgcttagcaaggtgacccataa

SEQ ID NO: 98754 - DNA, 22 bp, Artificial Sequence
  Synthetic oligonucleotide; TTT chr11 5312401 5312422 5312418 5312423 +
gcttagcaaggtgacccataat

SEQ ID NO: 98755 - DNA, 22 bp, Artificial Sequence
  Synthetic oligonucleotide; TTG chr11 5312402 5312423 5312419 5312424 +
cttagcaaggtgacccataata

SEQ ID NO: 98756 - DNA, 22 bp, Artificial Sequence
  Synthetic oligonucleotide; CTT chr11 5312405 5312426 5312422 5312427 +
agcaaggtgacccataatagtg

SEQ ID NO: 98757 - DNA, 22 bp, Artificial Sequence
  Synthetic oligonucleotide; TTA chr11 5312406 5312427 5312423 5312428 +
gcaaggtgacccataatagtgc

SEQ ID NO: 98758 - DNA, 22 bp, Artificial Sequence
  Synthetic oligonucleotide; CTT chr11 5312432 5312453 5312449 5312454 +
aaaaaattaaccaaaggaatga

SEQ ID NO: 98759 - DNA, 22 bp, Artificial Sequence
  Synthetic oligonucleotide; TTA chr11 5312433 5312454 5312450 5312455 +
aaaaattaaccaaaggaatgat

SEQ ID NO: 98760 - DNA, 22 bp, Artificial Sequence
  Synthetic oligonucleotide; TTA chr11 5312441 5312462 5312458 5312463 +
accaaaggaatgattaaatatt

SEQ ID NO: 98761 - DNA, 22 bp, Artificial Sequence
  Synthetic oligonucleotide; TTA chr11 5312457 5312478 5312474 5312479 +
aatattagtggtgtttccacga

SEQ ID NO: 98762 - DNA, 22 bp, Artificial Sequence
  Synthetic oligonucleotide; TTA chr11 5312464 5312485 5312481 5312486 +
gtggtgtttccacgaaaatagg

SEQ ID NO: 98763 - DNA, 22 bp, Artificial Sequence
  Synthetic oligonucleotide; TTT chr11 5312473 5312494 5312490 5312495 +
ccacgaaaataggcacatgagg

SEQ ID NO: 98764 - DNA, 22 bp, Artificial Sequence
  Synthetic oligonucleotide; TTC chr11 5312474 5312495 5312491 5312496 +
cacgaaaataggcacatgagga

SEQ ID NO: 98765 - DNA, 22 bp, Artificial Sequence
  Synthetic oligonucleotide; TTT chr11 5312503 5312524 5312520 5312525 +
aaagtcctactctcctccaaac

SEQ ID NO: 98766 - DNA, 22 bp, Artificial Sequence
  Synthetic oligonucleotide; TTA chr11 5312504 5312525 5312521 5312526 +
aagtcctactctcctccaaaca

SEQ ID NO: 98767 - DNA, 22 bp, Artificial Sequence
  Synthetic oligonucleotide; CTA chr11 5312512 5312533 5312529 5312534 +
ctctcctccaaacacaaaccct

SEQ ID NO: 98768 - DNA, 22 bp, Artificial Sequence
  Synthetic oligonucleotide; CTC chr11 5312515 5312536 5312532 5312537 +
tcctccaaacacaaaccctttt

SEQ ID NO: 98769 - DNA, 22 bp, Artificial Sequence
  Synthetic oligonucleotide; CTC chr11 5312517 5312538 5312534 5312539 +
ctccaaacacaaacccttttaa

SEQ ID NO: 98770 - DNA, 22 bp, Artificial Sequence
  Synthetic oligonucleotide; CTC chr11 5312520 5312541 5312537 5312542 +
caaacacaaacccttttaaaca

SEQ ID NO: 98771 - DNA, 22 bp, Artificial Sequence
  Synthetic oligonucleotide; CTT chr11 5312535 5312556 5312552 5312557 +
ttaaacataggatatgtacaaa

SEQ ID NO: 98772 - DNA, 22 bp, Artificial Sequence
  Synthetic oligonucleotide; TTT chr11 5312536 5312557 5312553 5312558 +
taaacataggatatgtacaaat

SEQ ID NO: 98773 - DNA, 22 bp, Artificial Sequence
  Synthetic oligonucleotide; TTT chr11 5312537 5312558 5312554 5312559 +
aaacataggatatgtacaaata

SEQ ID NO: 98774 - DNA, 22 bp, Artificial Sequence
  Synthetic oligonucleotide; TTA chr11 5312538 5312559 5312555 5312560 +
aacataggatatgtacaaataa

SEQ ID NO: 98775 - DNA, 22 bp, Artificial Sequence
  Synthetic oligonucleotide; TTA chr11 5312564 5312585 5312581 5312586 +
ggcaaaagtataagaaaaagat

SEQ ID NO: 98776 - DNA, 22 bp, Artificial Sequence
  Synthetic oligonucleotide; CTG chr11 5312599 5312620 5312616 5312621 +
aagtcagcaagggctttgatag

SEQ ID NO: 98777 - DNA, 22 bp, Artificial Sequence
  Synthetic oligonucleotide; CTT chr11 5312615 5312636 5312632 5312637 +
tgatagtatggctccaatactt

SEQ ID NO: 98778 - DNA, 22 bp, Artificial Sequence
  Synthetic oligonucleotide; TTT chr11 5312616 5312637 5312633 5312638 +
gatagtatggctccaatacttc

SEQ ID NO: 98779 - DNA, 22 bp, Artificial Sequence
  Synthetic oligonucleotide; TTG chr11 5312617 5312638 5312634 5312639 +
atagtatggctccaatacttca

SEQ ID NO: 98780 - DNA, 22 bp, Artificial Sequence
  Synthetic oligonucleotide; CTC chr11 5312629 5312650 5312646 5312651 +
caatacttcagtagataaagta

SEQ ID NO: 98781 - DNA, 22 bp, Artificial Sequence
  Synthetic oligonucleotide; CTT chr11 5312637 5312658 5312654 5312659 +
cagtagataaagtaaataataa

SEQ ID NO: 98782 - DNA, 22 bp, Artificial Sequence
  Synthetic oligonucleotide; TTC chr11 5312638 5312659 5312655 5312660 +
agtagataaagtaaataataaa

SEQ ID NO: 98783 - DNA, 22 bp, Artificial Sequence
  Synthetic oligonucleotide; CTT chr11 5312679 5312700 5312696 5312701 +
ttaaattgtgtatatagcaaga

SEQ ID NO: 98784 - DNA, 22 bp, Artificial Sequence
  Synthetic oligonucleotide; TTT chr11 5312680 5312701 5312697 5312702 +
taaattgtgtatatagcaagac

SEQ ID NO: 98785 - DNA, 22 bp, Artificial Sequence
  Synthetic oligonucleotide; TTT chr11 5312681 5312702 5312698 5312703 +
aaattgtgtatatagcaagaca

SEQ ID NO: 98786 - DNA, 22 bp, Artificial Sequence
  Synthetic oligonucleotide; TTA chr11 5312682 5312703 5312699 5312704 +
aattgtgtatatagcaagacaa

SEQ ID NO: 98787 - DNA, 22 bp, Artificial Sequence
  Synthetic oligonucleotide; TTG chr11 5312687 5312708 5312704 5312709 +
tgtatatagcaagacaaacaga

SEQ ID NO: 98788 - DNA, 22 bp, Artificial Sequence
  Synthetic oligonucleotide; CTG chr11 5312715 5312736 5312732 5312737 +
ggaaaatacgtacactaaaaat

SEQ ID NO: 98789 - DNA, 22 bp, Artificial Sequence
  Synthetic oligonucleotide; CTA chr11 5312732 5312753 5312749 5312754 +
aaaataaaacactagagataat

SEQ ID NO: 98790 - DNA, 22 bp, Artificial Sequence
  Synthetic oligonucleotide; CTA chr11 5312746 5312767 5312763 5312768 +
gagataatacataataaacttc

SEQ ID NO: 98791 - DNA, 22 bp, Artificial Sequence
  Synthetic oligonucleotide; CTT chr11 5312767 5312788 5312784 5312789 +
cttaaaatcaattataaaagga

SEQ ID NO: 98792 - DNA, 22 bp, Artificial Sequence
  Synthetic oligonucleotide; TTC chr11 5312768 5312789 5312785 5312790 +
ttaaaatcaattataaaaggat

SEQ ID NO: 98793 - DNA, 22 bp, Artificial Sequence
  Synthetic oligonucleotide; CTT chr11 5312770 5312791 5312787 5312792 +
aaaatcaattataaaaggatga

SEQ ID NO: 98794 - DNA, 22 bp, Artificial Sequence
  Synthetic oligonucleotide; TTA chr11 5312771 5312792 5312788 5312793 +
aaatcaattataaaaggatgaa

SEQ ID NO: 98795 - DNA, 22 bp, Artificial Sequence
  Synthetic oligonucleotide; TTA chr11 5312781 5312802 5312798 5312803 +
taaaaggatgaaaattagcaaa

SEQ ID NO: 98796 - DNA, 22 bp, Artificial Sequence
  Synthetic oligonucleotide; TTA chr11 5312798 5312819 5312815 5312820 +
gcaaaatatatgatcaaataaa

SEQ ID NO: 98797 - DNA, 22 bp, Artificial Sequence
  Synthetic oligonucleotide; CTA chr11 5312825 5312846 5312842 5312847 +
gtgagatttccaagttgctgca

SEQ ID NO: 98798 - DNA, 22 bp, Artificial Sequence
  Synthetic oligonucleotide; TTT chr11 5312834 5312855 5312851 5312856 +
ccaagttgctgcaacaaattga

SEQ ID NO: 98799 - DNA, 22 bp, Artificial Sequence
  Synthetic oligonucleotide; TTC chr11 5312835 5312856 5312852 5312857 +
caagttgctgcaacaaattgag

SEQ ID NO: 98800 - DNA, 22 bp, Artificial Sequence
  Synthetic oligonucleotide; TTG chr11 5312842 5312863 5312859 5312864 +
ctgcaacaaattgagatcactt

SEQ ID NO: 98801 - DNA, 22 bp, Artificial Sequence
  Synthetic oligonucleotide; CTG chr11 5312845 5312866 5312862 5312867 +
caacaaattgagatcacttgtg

SEQ ID NO: 98802 - DNA, 22 bp, Artificial Sequence
  Synthetic oligonucleotide; TTG chr11 5312855 5312876 5312872 5312877 +
agatcacttgtgatttattaga

SEQ ID NO: 98803 - DNA, 22 bp, Artificial Sequence
  Synthetic oligonucleotide; CTT chr11 5312864 5312885 5312881 5312886 +
gtgatttattagaataaaaaat

SEQ ID NO: 98804 - DNA, 22 bp, Artificial Sequence
  Synthetic oligonucleotide; TTG chr11 5312865 5312886 5312882 5312887 +
tgatttattagaataaaaaata

SEQ ID NO: 98805 - DNA, 22 bp, Artificial Sequence
  Synthetic oligonucleotide; TTT chr11 5312871 5312892 5312888 5312893 +
attagaataaaaaataaattga

SEQ ID NO: 98806 - DNA, 22 bp, Artificial Sequence
  Synthetic oligonucleotide; TTA chr11 5312872 5312893 5312889 5312894 +
ttagaataaaaaataaattgaa

SEQ ID NO: 98807 - DNA, 22 bp, Artificial Sequence
  Synthetic oligonucleotide; TTA chr11 5312875 5312896 5312892 5312897 +
gaataaaaaataaattgaatat

SEQ ID NO: 98808 - DNA, 22 bp, Artificial Sequence
  Synthetic oligonucleotide; TTG chr11 5312892 5312913 5312909 5312914 +
aatatacaaaaaggaaaatatc

SEQ ID NO: 98809 - DNA, 22 bp, Artificial Sequence
  Synthetic oligonucleotide; TTA chr11 5312920 5312941 5312937 5312942 +
tatttcatctattggacatatc

SEQ ID NO: 98810 - DNA, 22 bp, Artificial Sequence
  Synthetic oligonucleotide; TTT chr11 5312925 5312946 5312942 5312947 +
catctattggacatatcagaaa

SEQ ID NO: 98811 - DNA, 22 bp, Artificial Sequence
  Synthetic oligonucleotide; TTC chr11 5312926 5312947 5312943 5312948 +
atctattggacatatcagaaat

SEQ ID NO: 98812 - DNA, 22 bp, Artificial Sequence
  Synthetic oligonucleotide; CTA chr11 5312931 5312952 5312948 5312953 +
ttggacatatcagaaatgtttc

SEQ ID NO: 98813 - DNA, 22 bp, Artificial Sequence
  Synthetic oligonucleotide; TTG chr11 5312934 5312955 5312951 5312956 +
gacatatcagaaatgtttctat

SEQ ID NO: 98814 - DNA, 22 bp, Artificial Sequence
  Synthetic oligonucleotide; TTT chr11 5312952 5312973 5312969 5312974 +
ctatccagcatttagagagaac

SEQ ID NO: 98815 - DNA, 22 bp, Artificial Sequence
  Synthetic oligonucleotide; TTC chr11 5312953 5312974 5312970 5312975 +
tatccagcatttagagagaaca

SEQ ID NO: 98816 - DNA, 22 bp, Artificial Sequence
  Synthetic oligonucleotide; CTA chr11 5312955 5312976 5312972 5312977 +
tccagcatttagagagaacaca

SEQ ID NO: 98817 - DNA, 22 bp, Artificial Sequence
  Synthetic oligonucleotide; TTT chr11 5312965 5312986 5312982 5312987 +
agagagaacacaagatcaaaag

SEQ ID NO: 98818 - DNA, 22 bp, Artificial Sequence
  Synthetic oligonucleotide; TTA chr11 5312966 5312987 5312983 5312988 +
gagagaacacaagatcaaaaga

SEQ ID NO: 98819 - DNA, 22 bp, Artificial Sequence
  Synthetic oligonucleotide; TTA chr11 5312997 5313018 5313014 5313019 +
actcatgaaatgagcaactagg

SEQ ID NO: 98820 - DNA, 22 bp, Artificial Sequence
  Synthetic oligonucleotide; CTC chr11 5313001 5313022 5313018 5313023 +
atgaaatgagcaactaggaaat

SEQ ID NO: 98821 - DNA, 22 bp, Artificial Sequence
  Synthetic oligonucleotide; CTA chr11 5313017 5313038 5313034 5313039 +
ggaaatttatgaatttagagag

SEQ ID NO: 98822 - DNA, 22 bp, Artificial Sequence
  Synthetic oligonucleotide; TTT chr11 5313025 5313046 5313042 5313047 +
atgaatttagagagtctctact

SEQ ID NO: 98823 - DNA, 22 bp, Artificial Sequence
  Synthetic oligonucleotide; TTA chr11 5313026 5313047 5313043 5313048 +
tgaatttagagagtctctactg

SEQ ID NO: 98824 - DNA, 22 bp, Artificial Sequence
  Synthetic oligonucleotide; TTT chr11 5313033 5313054 5313050 5313055 +
agagagtctctactgtaaaact

SEQ ID NO: 98825 - DNA, 22 bp, Artificial Sequence
  Synthetic oligonucleotide; TTA chr11 5313034 5313055 5313051 5313056 +
gagagtctctactgtaaaactt

SEQ ID NO: 98826 - DNA, 22 bp, Artificial Sequence
  Synthetic oligonucleotide; CTC chr11 5313043 5313064 5313060 5313065 +
tactgtaaaactttatagatga

SEQ ID NO: 98827 - DNA, 22 bp, Artificial Sequence
  Synthetic oligonucleotide; CTA chr11 5313045 5313066 5313062 5313067 +
ctgtaaaactttatagatgaca

SEQ ID NO: 98828 - DNA, 22 bp, Artificial Sequence
  Synthetic oligonucleotide; CTG chr11 5313048 5313069 5313065 5313070 +
taaaactttatagatgacattg

SEQ ID NO: 98829 - DNA, 22 bp, Artificial Sequence
  Synthetic oligonucleotide; CTT chr11 5313056 5313077 5313073 5313078 +
tatagatgacattgtatcattt

SEQ ID NO: 98830 - DNA, 22 bp, Artificial Sequence
  Synthetic oligonucleotide; TTT chr11 5313057 5313078 5313074 5313079 +
atagatgacattgtatcatttt

SEQ ID NO: 98831 - DNA, 22 bp, Artificial Sequence
  Synthetic oligonucleotide; TTA chr11 5313058 5313079 5313075 5313080 +
tagatgacattgtatcattttg

SEQ ID NO: 98832 - DNA, 22 bp, Artificial Sequence
  Synthetic oligonucleotide; TTG chr11 5313070 5313091 5313087 5313092 +
tatcattttgaaagaaaactca

SEQ ID NO: 98833 - DNA, 22 bp, Artificial Sequence
  Synthetic oligonucleotide; TTT chr11 5313078 5313099 5313095 5313100 +
tgaaagaaaactcaagacacca

SEQ ID NO: 98834 - DNA, 22 bp, Artificial Sequence
  Synthetic oligonucleotide; TTT chr11 5313079 5313100 5313096 5313101 +
gaaagaaaactcaagacaccaa

SEQ ID NO: 98835 - DNA, 22 bp, Artificial Sequence
  Synthetic oligonucleotide; TTG chr11 5313080 5313101 5313097 5313102 +
aaagaaaactcaagacaccaaa

SEQ ID NO: 98836 - DNA, 22 bp, Artificial Sequence
  Synthetic oligonucleotide; CTC chr11 5313091 5313112 5313108 5313113 +
aagacaccaaaagcaactgcaa

SEQ ID NO: 98837 - DNA, 22 bp, Artificial Sequence
  Synthetic oligonucleotide; CTG chr11 5313110 5313131 5313127 5313132 +
caaaaaaaaattgacaaatggg

SEQ ID NO: 98838 - DNA, 22 bp, Artificial Sequence
  Synthetic oligonucleotide; TTG chr11 5313123 5313144 5313140 5313145 +
acaaatgggatctaattaaatt

SEQ ID NO: 98839 - DNA, 22 bp, Artificial Sequence
  Synthetic oligonucleotide; CTA chr11 5313137 5313158 5313154 5313159 +
attaaattaaagagcttctgca

SEQ ID NO: 98840 - DNA, 22 bp, Artificial Sequence
  Synthetic oligonucleotide; TTA chr11 5313141 5313162 5313158 5313163 +
aattaaagagcttctgcacagc

SEQ ID NO: 98841 - DNA, 22 bp, Artificial Sequence
  Synthetic oligonucleotide; TTA chr11 5313146 5313167 5313163 5313168 +
aagagcttctgcacagcaaaag

SEQ ID NO: 98842 - DNA, 22 bp, Artificial Sequence
  Synthetic oligonucleotide; CTT chr11 5313154 5313175 5313171 5313176 +
ctgcacagcaaaagaaactatc

SEQ ID NO: 98843 - DNA, 22 bp, Artificial Sequence
  Synthetic oligonucleotide; TTC chr11 5313155 5313176 5313172 5313177 +
tgcacagcaaaagaaactatca

SEQ ID NO: 98844 - DNA, 22 bp, Artificial Sequence
  Synthetic oligonucleotide; CTG chr11 5313157 5313178 5313174 5313179 +
cacagcaaaagaaactatcatc

SEQ ID NO: 98845 - DNA, 22 bp, Artificial Sequence
  Synthetic oligonucleotide; CTA chr11 5313174 5313195 5313191 5313196 +
tcatcagagataacagacaacc

SEQ ID NO: 98846 - DNA, 22 bp, Artificial Sequence
  Synthetic oligonucleotide; CTA chr11 5313198 5313219 5313215 5313220 +
cagaatagaagaaaatttttgc

SEQ ID NO: 98847 - DNA, 22 bp, Artificial Sequence
  Synthetic oligonucleotide; TTT chr11 5313216 5313237 5313233 5313238 +
ttgcaatttctccatctgacaa

SEQ ID NO: 98848 - DNA, 22 bp, Artificial Sequence
  Synthetic oligonucleotide; TTT chr11 5313217 5313238 5313234 5313239 +
tgcaatttctccatctgacaaa

SEQ ID NO: 98849 - DNA, 22 bp, Artificial Sequence
  Synthetic oligonucleotide; TTT chr11 5313218 5313239 5313235 5313240 +
gcaatttctccatctgacaaaa

SEQ ID NO: 98850 - DNA, 22 bp, Artificial Sequence
  Synthetic oligonucleotide; TTG chr11 5313219 5313240 5313236 5313241 +
caatttctccatctgacaaaag

SEQ ID NO: 98851 - DNA, 22 bp, Artificial Sequence
  Synthetic oligonucleotide; TTT chr11 5313225 5313246 5313242 5313247 +
ctccatctgacaaaagtctaat

SEQ ID NO: 98852 - DNA, 22 bp, Artificial Sequence
  Synthetic oligonucleotide; TTC chr11 5313226 5313247 5313243 5313248 +
tccatctgacaaaagtctaata

SEQ ID NO: 98853 - DNA, 22 bp, Artificial Sequence
  Synthetic oligonucleotide; CTC chr11 5313228 5313249 5313245 5313250 +
catctgacaaaagtctaatatc

SEQ ID NO: 98854 - DNA, 22 bp, Artificial Sequence
  Synthetic oligonucleotide; CTG chr11 5313234 5313255 5313251 5313256 +
acaaaagtctaatatctggagt

SEQ ID NO: 98855 - DNA, 22 bp, Artificial Sequence
  Synthetic oligonucleotide; CTA chr11 5313245 5313266 5313262 5313267 +
atatctggagtctatgaggaac

SEQ ID NO: 98856 - DNA, 22 bp, Artificial Sequence
  Synthetic oligonucleotide; CTG chr11 5313252 5313273 5313269 5313274 +
gagtctatgaggaactaaaaca

SEQ ID NO: 98857 - DNA, 22 bp, Artificial Sequence
  Synthetic oligonucleotide; CTA chr11 5313259 5313280 5313276 5313281 +
tgaggaactaaaacaaatttac

SEQ ID NO: 98858 - DNA, 22 bp, Artificial Sequence
  Synthetic oligonucleotide; CTA chr11 5313269 5313290 5313286 5313291 +
aaacaaatttacaagaaaaaaa

SEQ ID NO: 98859 - DNA, 22 bp, Artificial Sequence
  Synthetic oligonucleotide; TTT chr11 5313279 5313300 5313296 5313301 +
acaagaaaaaaacaaccccatt

SEQ ID NO: 98860 - DNA, 22 bp, Artificial Sequence
  Synthetic oligonucleotide; TTA chr11 5313280 5313301 5313297 5313302 +
caagaaaaaaacaaccccatta

SEQ ID NO: 98861 - DNA, 22 bp, Artificial Sequence
  Synthetic oligonucleotide; TTA chr11 5313302 5313323 5313319 5313324 +
aaaagtggggaatgacatgaat

SEQ ID NO: 98862 - DNA, 22 bp, Artificial Sequence
  Synthetic oligonucleotide; CTT chr11 5313332 5313353 5313349 5313354 +
ctctaaagaagacattcatgct

SEQ ID NO: 98863 - DNA, 22 bp, Artificial Sequence
  Synthetic oligonucleotide; TTC chr11 5313333 5313354 5313350 5313355 +
tctaaagaagacattcatgctt

SEQ ID NO: 98864 - DNA, 22 bp, Artificial Sequence
  Synthetic oligonucleotide; CTC chr11 5313335 5313356 5313352 5313357 +
taaagaagacattcatgcttct

SEQ ID NO: 98865 - DNA, 22 bp, Artificial Sequence
  Synthetic oligonucleotide; CTA chr11 5313337 5313358 5313354 5313359 +
aagaagacattcatgcttctaa

SEQ ID NO: 98866 - DNA, 22 bp, Artificial Sequence
  Synthetic oligonucleotide; TTC chr11 5313349 5313370 5313366 5313371 +
atgcttctaataaacatatgaa

SEQ ID NO: 98867 - DNA, 22 bp, Artificial Sequence
  Synthetic oligonucleotide; CTT chr11 5313355 5313376 5313372 5313377 +
ctaataaacatatgaaaaaaaa

SEQ ID NO: 98868 - DNA, 22 bp, Artificial Sequence
  Synthetic oligonucleotide; TTC chr11 5313356 5313377 5313373 5313378 +
taataaacatatgaaaaaaaaa

SEQ ID NO: 98869 - DNA, 22 bp, Artificial Sequence
  Synthetic oligonucleotide; CTA chr11 5313358 5313379 5313375 5313380 +
ataaacatatgaaaaaaaaaaa

SEQ ID NO: 98870 - DNA, 22 bp, Artificial Sequence
  Synthetic oligonucleotide; CTC chr11 5313384 5313405 5313401 5313406 +
aaccttactggtcattagaaaa

SEQ ID NO: 98871 - DNA, 22 bp, Artificial Sequence
  Synthetic oligonucleotide; CTT chr11 5313390 5313411 5313407 5313412 +
actggtcattagaaaaatgcaa

SEQ ID NO: 98872 - DNA, 22 bp, Artificial Sequence
  Synthetic oligonucleotide; TTA chr11 5313391 5313412 5313408 5313413 +
ctggtcattagaaaaatgcaaa

SEQ ID NO: 98873 - DNA, 22 bp, Artificial Sequence
  Synthetic oligonucleotide; CTG chr11 5313394 5313415 5313411 5313416 +
gtcattagaaaaatgcaaatca

SEQ ID NO: 98874 - DNA, 22 bp, Artificial Sequence
  Synthetic oligonucleotide; TTA chr11 5313401 5313422 5313418 5313423 +
gaaaaatgcaaatcaaaaccac

SEQ ID NO: 98875 - DNA, 22 bp, Artificial Sequence
  Synthetic oligonucleotide; CTC chr11 5313439 5313460 5313456 5313461 +
acaccagtcagaatggcaatta

SEQ ID NO: 98876 - DNA, 22 bp, Artificial Sequence
  Synthetic oligonucleotide; TTA chr11 5313461 5313482 5313478 5313483 +
ttaaaaagtcaagaaacaacag

SEQ ID NO: 98877 - DNA, 22 bp, Artificial Sequence
  Synthetic oligonucleotide; TTA chr11 5313464 5313485 5313481 5313486 +
aaaagtcaagaaacaacagttg

SEQ ID NO: 98878 - DNA, 22 bp, Artificial Sequence
  Synthetic oligonucleotide; TTG chr11 5313486 5313507 5313503 5313508 +
ctggcaaggttgcagagagaaa

SEQ ID NO: 98879 - DNA, 22 bp, Artificial Sequence
  Synthetic oligonucleotide; CTG chr11 5313489 5313510 5313506 5313511 +
gcaaggttgcagagagaaagga

SEQ ID NO: 98880 - DNA, 22 bp, Artificial Sequence
  Synthetic oligonucleotide; TTG chr11 5313498 5313519 5313515 5313520 +
cagagagaaaggaatggaatgc

SEQ ID NO: 98881 - DNA, 22 bp, Artificial Sequence
  Synthetic oligonucleotide; CTT chr11 5313522 5313543 5313539 5313544 +
ttacactgttaacgggagagta

SEQ ID NO: 98882 - DNA, 22 bp, Artificial Sequence
  Synthetic oligonucleotide; TTT chr11 5313523 5313544 5313540 5313545 +
tacactgttaacgggagagtaa

SEQ ID NO: 98883 - DNA, 22 bp, Artificial Sequence
  Synthetic oligonucleotide; TTT chr11 5313524 5313545 5313541 5313546 +
acactgttaacgggagagtaaa

SEQ ID NO: 98884 - DNA, 22 bp, Artificial Sequence
  Synthetic oligonucleotide; TTA chr11 5313525 5313546 5313542 5313547 +
cactgttaacgggagagtaaat

SEQ ID NO: 98885 - DNA, 22 bp, Artificial Sequence
  Synthetic oligonucleotide; CTG chr11 5313530 5313551 5313547 5313552 +
ttaacgggagagtaaattagtt

SEQ ID NO: 98886 - DNA, 22 bp, Artificial Sequence
  Synthetic oligonucleotide; TTA chr11 5313533 5313554 5313550 5313555 +
acgggagagtaaattagttcaa

SEQ ID NO: 98887 - DNA, 22 bp, Artificial Sequence
  Synthetic oligonucleotide; TTA chr11 5313549 5313570 5313566 5313571 +
gttcaaacattgtggaagagag

SEQ ID NO: 98888 - DNA, 22 bp, Artificial Sequence
  Synthetic oligonucleotide; TTC chr11 5313553 5313574 5313570 5313575 +
aaacattgtggaagagagtgta

SEQ ID NO: 98889 - DNA, 22 bp, Artificial Sequence
  Synthetic oligonucleotide; TTG chr11 5313561 5313582 5313578 5313583 +
tggaagagagtgtagcctttcc

SEQ ID NO: 98890 - DNA, 22 bp, Artificial Sequence
  Synthetic oligonucleotide; CTT chr11 5313580 5313601 5313597 5313602 +
tcctcaaagatgtagaagcaga

SEQ ID NO: 98891 - DNA, 22 bp, Artificial Sequence
  Synthetic oligonucleotide; TTT chr11 5313581 5313602 5313598 5313603 +
cctcaaagatgtagaagcagaa

SEQ ID NO: 98892 - DNA, 22 bp, Artificial Sequence
  Synthetic oligonucleotide; TTC chr11 5313582 5313603 5313599 5313604 +
ctcaaagatgtagaagcagaaa

SEQ ID NO: 98893 - DNA, 22 bp, Artificial Sequence
  Synthetic oligonucleotide; CTC chr11 5313585 5313606 5313602 5313607 +
aaagatgtagaagcagaaatac

SEQ ID NO: 98894 - DNA, 22 bp, Artificial Sequence
  Synthetic oligonucleotide; CTT chr11 5313612 5313633 5313629 5313634 +
gactcagcaatctcattactgg

SEQ ID NO: 98895 - DNA, 22 bp, Artificial Sequence
  Synthetic oligonucleotide; TTG chr11 5313613 5313634 5313630 5313635 +
actcagcaatctcattactggg

SEQ ID NO: 98896 - DNA, 22 bp, Artificial Sequence
  Synthetic oligonucleotide; CTC chr11 5313617 5313638 5313634 5313639 +
agcaatctcattactgggtata

SEQ ID NO: 98897 - DNA, 22 bp, Artificial Sequence
  Synthetic oligonucleotide; CTC chr11 5313626 5313647 5313643 5313648 +
attactgggtatatacccaaag

SEQ ID NO: 98898 - DNA, 22 bp, Artificial Sequence
  Synthetic oligonucleotide; TTA chr11 5313630 5313651 5313647 5313652 +
ctgggtatatacccaaaggaat

SEQ ID NO: 98899 - DNA, 22 bp, Artificial Sequence
  Synthetic oligonucleotide; CTG chr11 5313633 5313654 5313650 5313655 +
ggtatatacccaaaggaatata

SEQ ID NO: 98900 - DNA, 22 bp, Artificial Sequence
  Synthetic oligonucleotide; CTA chr11 5313665 5313686 5313682 5313687 +
ttataaaaatacaggcatgctt

SEQ ID NO: 98901 - DNA, 22 bp, Artificial Sequence
  Synthetic oligonucleotide; TTA chr11 5313668 5313689 5313685 5313690 +
taaaaatacaggcatgcttatg

SEQ ID NO: 98902 - DNA, 22 bp, Artificial Sequence
  Synthetic oligonucleotide; CTT chr11 5313687 5313708 5313704 5313709 +
atgttcattgcagcattattca

SEQ ID NO: 98903 - DNA, 22 bp, Artificial Sequence
  Synthetic oligonucleotide; TTA chr11 5313688 5313709 5313705 5313710 +
tgttcattgcagcattattcat

SEQ ID NO: 98904 - DNA, 22 bp, Artificial Sequence
  Synthetic oligonucleotide; TTC chr11 5313693 5313714 5313710 5313715 +
attgcagcattattcataatag

SEQ ID NO: 98905 - DNA, 22 bp, Artificial Sequence
  Synthetic oligonucleotide; TTG chr11 5313697 5313718 5313714 5313719 +
cagcattattcataatagccaa

SEQ ID NO: 98906 - DNA, 22 bp, Artificial Sequence
  Synthetic oligonucleotide; TTA chr11 5313705 5313726 5313722 5313727 +
ttcataatagccaagatgtgga

SEQ ID NO: 98907 - DNA, 22 bp, Artificial Sequence
  Synthetic oligonucleotide; TTC chr11 5313708 5313729 5313725 5313730 +
ataatagccaagatgtggaatc

SEQ ID NO: 98908 - DNA, 22 bp, Artificial Sequence
  Synthetic oligonucleotide; CTA chr11 5313797 5313818 5313814 5313819 +
tacagccataaaaaggaaaagg

SEQ ID NO: 98909 - DNA, 22 bp, Artificial Sequence
  Synthetic oligonucleotide; TTG chr11 5313823 5313844 5313840 5313845 +
tgttccttgcagggacatgaat

SEQ ID NO: 98910 - DNA, 22 bp, Artificial Sequence
  Synthetic oligonucleotide; TTC chr11 5313828 5313849 5313845 5313850 +
cttgcagggacatgaatggagc

SEQ ID NO: 98911 - DNA, 22 bp, Artificial Sequence
  Synthetic oligonucleotide; CTT chr11 5313831 5313852 5313848 5313853 +
gcagggacatgaatggagctgg

SEQ ID NO: 98912 - DNA, 22 bp, Artificial Sequence
  Synthetic oligonucleotide; TTG chr11 5313832 5313853 5313849 5313854 +
cagggacatgaatggagctgga

SEQ ID NO: 98913 - DNA, 22 bp, Artificial Sequence
  Synthetic oligonucleotide; CTG chr11 5313852 5313873 5313869 5313874 +
gaagccattatcctcatcaaac

SEQ ID NO: 98914 - DNA, 22 bp, Artificial Sequence
  Synthetic oligonucleotide; TTA chr11 5313862 5313883 5313879 5313884 +
tcctcatcaaactaacacagga

SEQ ID NO: 98915 - DNA, 22 bp, Artificial Sequence
  Synthetic oligonucleotide; CTC chr11 5313867 5313888 5313884 5313889 +
atcaaactaacacaggaacaga

SEQ ID NO: 98916 - DNA, 22 bp, Artificial Sequence
  Synthetic oligonucleotide; CTA chr11 5313876 5313897 5313893 5313898 +
acacaggaacagaaaaccaaac

SEQ ID NO: 98917 - DNA, 22 bp, Artificial Sequence
  Synthetic oligonucleotide; TTC chr11 5313908 5313929 5313925 5313930 +
tcacacagaaatgggagctgaa

SEQ ID NO: 98918 - DNA, 22 bp, Artificial Sequence
  Synthetic oligonucleotide; CTC chr11 5313910 5313931 5313927 5313932 +
acacagaaatgggagctgaaca

SEQ ID NO: 98919 - DNA, 22 bp, Artificial Sequence
  Synthetic oligonucleotide; CTG chr11 5313928 5313949 5313945 5313950 +
aacagtgagaacacatggacac

SEQ ID NO: 98920 - DNA, 22 bp, Artificial Sequence
  Synthetic oligonucleotide; CTT chr11 5313952 5313973 5313969 5313974 +
gtggggaacaacacacacaggg

SEQ ID NO: 98921 - DNA, 22 bp, Artificial Sequence
  Synthetic oligonucleotide; TTG chr11 5313953 5313974 5313970 5313975 +
tggggaacaacacacacagggg

SEQ ID NO: 98922 - DNA, 22 bp, Artificial Sequence
  Synthetic oligonucleotide; CTG chr11 5313979 5314000 5313996 5314001 +
tccggtagtgggtggggaggag

SEQ ID NO: 98923 - DNA, 22 bp, Artificial Sequence
  Synthetic oligonucleotide; CTA chr11 5314027 5314048 5314044 5314049 +
acgaatgcagcaaacctgcatg

SEQ ID NO: 98924 - DNA, 22 bp, Artificial Sequence
  Synthetic oligonucleotide; CTG chr11 5314045 5314066 5314062 5314067 +
catggcacacatttacctatgt

SEQ ID NO: 98925 - DNA, 22 bp, Artificial Sequence
  Synthetic oligonucleotide; TTT chr11 5314059 5314080 5314076 5314081 +
acctatgtaataaacctgcaca

SEQ ID NO: 98926 - DNA, 22 bp, Artificial Sequence
  Synthetic oligonucleotide; TTA chr11 5314060 5314081 5314077 5314082 +
cctatgtaataaacctgcacat

SEQ ID NO: 98927 - DNA, 22 bp, Artificial Sequence
  Synthetic oligonucleotide; CTA chr11 5314064 5314085 5314081 5314086 +
tgtaataaacctgcacatcctg

SEQ ID NO: 98928 - DNA, 22 bp, Artificial Sequence
  Synthetic oligonucleotide; CTG chr11 5314077 5314098 5314094 5314099 +
cacatcctgcacatgtgccctg

SEQ ID NO: 98929 - DNA, 22 bp, Artificial Sequence
  Synthetic oligonucleotide; CTG chr11 5314086 5314107 5314103 5314108 +
cacatgtgccctggaacttaaa

SEQ ID NO: 98930 - DNA, 22 bp, Artificial Sequence
  Synthetic oligonucleotide; CTG chr11 5314099 5314120 5314116 5314121 +
gaacttaaaatatattatgttg

SEQ ID NO: 98931 - DNA, 22 bp, Artificial Sequence
  Synthetic oligonucleotide; CTT chr11 5314105 5314126 5314122 5314127 +
aaaatatattatgttggtacaa

SEQ ID NO: 98932 - DNA, 22 bp, Artificial Sequence
  Synthetic oligonucleotide; TTA chr11 5314106 5314127 5314123 5314128 +
aaatatattatgttggtacaaa

SEQ ID NO: 98933 - DNA, 22 bp, Artificial Sequence
  Synthetic oligonucleotide; TTA chr11 5314116 5314137 5314133 5314138 +
tgttggtacaaaagtaatttct

SEQ ID NO: 98934 - DNA, 22 bp, Artificial Sequence
  Synthetic oligonucleotide; TTG chr11 5314121 5314142 5314138 5314143 +
gtacaaaagtaatttctgtgaa

SEQ ID NO: 98935 - DNA, 22 bp, Artificial Sequence
  Synthetic oligonucleotide; TTT chr11 5314136 5314157 5314153 5314158 +
ctgtgaactgcaattacctttg

SEQ ID NO: 98936 - DNA, 22 bp, Artificial Sequence
  Synthetic oligonucleotide; TTC chr11 5314137 5314158 5314154 5314159 +
tgtgaactgcaattacctttgc

SEQ ID NO: 98937 - DNA, 22 bp, Artificial Sequence
  Synthetic oligonucleotide; CTG chr11 5314139 5314160 5314156 5314161 +
tgaactgcaattacctttgcac

SEQ ID NO: 98938 - DNA, 22 bp, Artificial Sequence
  Synthetic oligonucleotide; CTG chr11 5314146 5314167 5314163 5314168 +
caattacctttgcacctaccta

SEQ ID NO: 98939 - DNA, 22 bp, Artificial Sequence
  Synthetic oligonucleotide; TTA chr11 5314152 5314173 5314169 5314174 +
cctttgcacctacctaataagt

SEQ ID NO: 98940 - DNA, 22 bp, Artificial Sequence
  Synthetic oligonucleotide; CTT chr11 5314156 5314177 5314173 5314178 +
tgcacctacctaataagttgaa

SEQ ID NO: 98941 - DNA, 22 bp, Artificial Sequence
  Synthetic oligonucleotide; TTT chr11 5314157 5314178 5314174 5314179 +
gcacctacctaataagttgaag

SEQ ID NO: 98942 - DNA, 22 bp, Artificial Sequence
  Synthetic oligonucleotide; TTG chr11 5314158 5314179 5314175 5314180 +
cacctacctaataagttgaagg

SEQ ID NO: 98943 - DNA, 22 bp, Artificial Sequence
  Synthetic oligonucleotide; CTA chr11 5314164 5314185 5314181 5314186 +
cctaataagttgaaggaaaata

SEQ ID NO: 98944 - DNA, 22 bp, Artificial Sequence
  Synthetic oligonucleotide; CTA chr11 5314168 5314189 5314185 5314190 +
ataagttgaaggaaaataaaat

SEQ ID NO: 98945 - DNA, 22 bp, Artificial Sequence
  Synthetic oligonucleotide; TTG chr11 5314176 5314197 5314193 5314198 +
aaggaaaataaaatctatttta

SEQ ID NO: 98946 - DNA, 22 bp, Artificial Sequence
  Synthetic oligonucleotide; CTA chr11 5314193 5314214 5314210 5314215 +
ttttaaaaaaaaaaaaaaaaaa

SEQ ID NO: 98947 - DNA, 22 bp, Artificial Sequence
  Synthetic oligonucleotide; TTT chr11 5314196 5314217 5314213 5314218 +
taaaaaaaaaaaaaaaaaagga

SEQ ID NO: 98948 - DNA, 22 bp, Artificial Sequence
  Synthetic oligonucleotide; TTT chr11 5314197 5314218 5314214 5314219 +
aaaaaaaaaaaaaaaaaaggaa

SEQ ID NO: 98949 - DNA, 22 bp, Artificial Sequence
  Synthetic oligonucleotide; TTA chr11 5314198 5314219 5314215 5314220 +
aaaaaaaaaaaaaaaaaggaaa

SEQ ID NO: 98950 - DNA, 22 bp, Artificial Sequence
  Synthetic oligonucleotide; CTA chr11 5314225 5314246 5314242 5314247 +
ccctgaaatagagtagttttga

SEQ ID NO: 98951 - DNA, 22 bp, Artificial Sequence
  Synthetic oligonucleotide; CTG chr11 5314230 5314251 5314247 5314252 +
aaatagagtagttttgagatta

SEQ ID NO: 98952 - DNA, 22 bp, Artificial Sequence
  Synthetic oligonucleotide; TTT chr11 5314244 5314265 5314261 5314266 +
tgagattatagtagagttccat

SEQ ID NO: 98953 - DNA, 22 bp, Artificial Sequence
  Synthetic oligonucleotide; TTT chr11 5314245 5314266 5314262 5314267 +
gagattatagtagagttccatg

SEQ ID NO: 98954 - DNA, 22 bp, Artificial Sequence
  Synthetic oligonucleotide; TTG chr11 5314246 5314267 5314263 5314268 +
agattatagtagagttccatga

SEQ ID NO: 98955 - DNA, 22 bp, Artificial Sequence
  Synthetic oligonucleotide; TTA chr11 5314252 5314273 5314269 5314274 +
tagtagagttccatgacctcaa

SEQ ID NO: 98956 - DNA, 22 bp, Artificial Sequence
  Synthetic oligonucleotide; TTC chr11 5314263 5314284 5314280 5314285 +
catgacctcaattcacatgcta

SEQ ID NO: 98957 - DNA, 22 bp, Artificial Sequence
  Synthetic oligonucleotide; CTC chr11 5314272 5314293 5314289 5314294 +
aattcacatgctataattcatc

SEQ ID NO: 98958 - DNA, 22 bp, Artificial Sequence
  Synthetic oligonucleotide; TTC chr11 5314277 5314298 5314294 5314299 +
acatgctataattcatctttat

SEQ ID NO: 98959 - DNA, 22 bp, Artificial Sequence
  Synthetic oligonucleotide; CTA chr11 5314285 5314306 5314302 5314307 +
taattcatctttatatggccaa

SEQ ID NO: 98960 - DNA, 22 bp, Artificial Sequence
  Synthetic oligonucleotide; TTC chr11 5314291 5314312 5314308 5314313 +
atctttatatggccaaaactag

SEQ ID NO: 98961 - DNA, 22 bp, Artificial Sequence
  Synthetic oligonucleotide; CTT chr11 5314296 5314317 5314313 5314318 +
tatatggccaaaactagatctg

SEQ ID NO: 98962 - DNA, 22 bp, Artificial Sequence
  Synthetic oligonucleotide; TTT chr11 5314297 5314318 5314314 5314319 +
atatggccaaaactagatctgc

SEQ ID NO: 98963 - DNA, 22 bp, Artificial Sequence
  Synthetic oligonucleotide; TTA chr11 5314298 5314319 5314315 5314320 +
tatggccaaaactagatctgca

SEQ ID NO: 98964 - DNA, 22 bp, Artificial Sequence
  Synthetic oligonucleotide; CTA chr11 5314312 5314333 5314329 5314334 +
gatctgcaattgcacatttttc

SEQ ID NO: 98965 - DNA, 22 bp, Artificial Sequence
  Synthetic oligonucleotide; CTG chr11 5314318 5314339 5314335 5314340 +
caattgcacatttttccttctg

SEQ ID NO: 98966 - DNA, 22 bp, Artificial Sequence
  Synthetic oligonucleotide; TTG chr11 5314324 5314345 5314341 5314346 +
cacatttttccttctgtaggct

SEQ ID NO: 98967 - DNA, 22 bp, Artificial Sequence
  Synthetic oligonucleotide; TTT chr11 5314331 5314352 5314348 5314353 +
ttccttctgtaggctttggttg

SEQ ID NO: 98968 - DNA, 22 bp, Artificial Sequence
  Synthetic oligonucleotide; TTT chr11 5314332 5314353 5314349 5314354 +
tccttctgtaggctttggttga

SEQ ID NO: 98969 - DNA, 22 bp, Artificial Sequence
  Synthetic oligonucleotide; TTT chr11 5314333 5314354 5314350 5314355 +
ccttctgtaggctttggttgaa

SEQ ID NO: 98970 - DNA, 22 bp, Artificial Sequence
  Synthetic oligonucleotide; TTC chr11 5314334 5314355 5314351 5314356 +
cttctgtaggctttggttgaac

SEQ ID NO: 98971 - DNA, 22 bp, Artificial Sequence
  Synthetic oligonucleotide; CTT chr11 5314337 5314358 5314354 5314359 +
ctgtaggctttggttgaactag

SEQ ID NO: 98972 - DNA, 22 bp, Artificial Sequence
  Synthetic oligonucleotide; TTC chr11 5314338 5314359 5314355 5314360 +
tgtaggctttggttgaactaga

SEQ ID NO: 98973 - DNA, 22 bp, Artificial Sequence
  Synthetic oligonucleotide; CTG chr11 5314340 5314361 5314357 5314362 +
taggctttggttgaactagact

SEQ ID NO: 98974 - DNA, 22 bp, Artificial Sequence
  Synthetic oligonucleotide; CTT chr11 5314347 5314368 5314364 5314369 +
tggttgaactagactggccact

SEQ ID NO: 98975 - DNA, 22 bp, Artificial Sequence
  Synthetic oligonucleotide; TTT chr11 5314348 5314369 5314365 5314370 +
ggttgaactagactggccactt

SEQ ID NO: 98976 - DNA, 22 bp, Artificial Sequence
  Synthetic oligonucleotide; TTG chr11 5314349 5314370 5314366 5314371 +
gttgaactagactggccacttg

SEQ ID NO: 98977 - DNA, 22 bp, Artificial Sequence
  Synthetic oligonucleotide; TTG chr11 5314353 5314374 5314370 5314375 +
aactagactggccacttgactc

SEQ ID NO: 98978 - DNA, 22 bp, Artificial Sequence
  Synthetic oligonucleotide; CTA chr11 5314358 5314379 5314375 5314380 +
gactggccacttgactcttcct

SEQ ID NO: 98979 - DNA, 22 bp, Artificial Sequence
  Synthetic oligonucleotide; CTG chr11 5314363 5314384 5314380 5314385 +
gccacttgactcttcctaaaat

SEQ ID NO: 98980 - DNA, 22 bp, Artificial Sequence
  Synthetic oligonucleotide; CTT chr11 5314370 5314391 5314387 5314392 +
gactcttcctaaaatggtactt

SEQ ID NO: 98981 - DNA, 22 bp, Artificial Sequence
  Synthetic oligonucleotide; TTG chr11 5314371 5314392 5314388 5314393 +
actcttcctaaaatggtacttt

SEQ ID NO: 98982 - DNA, 22 bp, Artificial Sequence
  Synthetic oligonucleotide; CTC chr11 5314375 5314396 5314392 5314397 +
ttcctaaaatggtactttcagt

SEQ ID NO: 98983 - DNA, 22 bp, Artificial Sequence
  Synthetic oligonucleotide; CTT chr11 5314377 5314398 5314394 5314399 +
cctaaaatggtactttcagttc

SEQ ID NO: 98984 - DNA, 22 bp, Artificial Sequence
  Synthetic oligonucleotide; TTC chr11 5314378 5314399 5314395 5314400 +
ctaaaatggtactttcagttct

SEQ ID NO: 98985 - DNA, 22 bp, Artificial Sequence
  Synthetic oligonucleotide; CTA chr11 5314381 5314402 5314398 5314403 +
aaatggtactttcagttcttat

SEQ ID NO: 98986 - DNA, 22 bp, Artificial Sequence
  Synthetic oligonucleotide; CTT chr11 5314392 5314413 5314409 5314414 +
tcagttcttatgaatacaggtt

SEQ ID NO: 98987 - DNA, 22 bp, Artificial Sequence
  Synthetic oligonucleotide; TTT chr11 5314393 5314414 5314410 5314415 +
cagttcttatgaatacaggtta

SEQ ID NO: 98988 - DNA, 22 bp, Artificial Sequence
  Synthetic oligonucleotide; TTC chr11 5314394 5314415 5314411 5314416 +
agttcttatgaatacaggttat

SEQ ID NO: 98989 - DNA, 22 bp, Artificial Sequence
  Synthetic oligonucleotide; TTC chr11 5314399 5314420 5314416 5314421 +
ttatgaatacaggttatgaata

SEQ ID NO: 98990 - DNA, 22 bp, Artificial Sequence
  Synthetic oligonucleotide; CTT chr11 5314401 5314422 5314418 5314423 +
atgaatacaggttatgaataac

SEQ ID NO: 98991 - DNA, 22 bp, Artificial Sequence
  Synthetic oligonucleotide; TTA chr11 5314402 5314423 5314419 5314424 +
tgaatacaggttatgaataacc

SEQ ID NO: 98992 - DNA, 22 bp, Artificial Sequence
  Synthetic oligonucleotide; TTA chr11 5314415 5314436 5314432 5314437 +
tgaataaccatattttccctga

SEQ ID NO: 98993 - DNA, 22 bp, Artificial Sequence
  Synthetic oligonucleotide; TTT chr11 5314430 5314451 5314447 5314452 +
tccctgattattagggtattta

SEQ ID NO: 98994 - DNA, 22 bp, Artificial Sequence
  Synthetic oligonucleotide; TTT chr11 5314431 5314452 5314448 5314453 +
ccctgattattagggtatttat

SEQ ID NO: 98995 - DNA, 22 bp, Artificial Sequence
  Synthetic oligonucleotide; TTC chr11 5314432 5314453 5314449 5314454 +
cctgattattagggtatttatc

SEQ ID NO: 98996 - DNA, 22 bp, Artificial Sequence
  Synthetic oligonucleotide; CTG chr11 5314436 5314457 5314453 5314458 +
attattagggtatttatctaca

SEQ ID NO: 98997 - DNA, 22 bp, Artificial Sequence
  Synthetic oligonucleotide; TTA chr11 5314440 5314461 5314457 5314462 +
ttagggtatttatctacatgtt

SEQ ID NO: 98998 - DNA, 22 bp, Artificial Sequence
  Synthetic oligonucleotide; TTA chr11 5314443 5314464 5314460 5314465 +
gggtatttatctacatgtttta

SEQ ID NO: 98999 - DNA, 22 bp, Artificial Sequence
  Synthetic oligonucleotide; TTT chr11 5314451 5314472 5314468 5314473 +
atctacatgttttatctccata

SEQ ID NO: 99000 - DNA, 22 bp, Artificial Sequence
  Synthetic oligonucleotide; TTA chr11 5314452 5314473 5314469 5314474 +
tctacatgttttatctccatat

SEQ ID NO: 99001 - DNA, 22 bp, Artificial Sequence
  Synthetic oligonucleotide; CTA chr11 5314456 5314477 5314473 5314478 +
catgttttatctccatattcaa

SEQ ID NO: 99002 - DNA, 22 bp, Artificial Sequence
  Synthetic oligonucleotide; TTT chr11 5314463 5314484 5314480 5314485 +
tatctccatattcaatagtatt

SEQ ID NO: 99003 - DNA, 22 bp, Artificial Sequence
  Synthetic oligonucleotide; TTT chr11 5314464 5314485 5314481 5314486 +
atctccatattcaatagtattc

SEQ ID NO: 99004 - DNA, 22 bp, Artificial Sequence
  Synthetic oligonucleotide; TTA chr11 5314465 5314486 5314482 5314487 +
tctccatattcaatagtattcc

SEQ ID NO: 99005 - DNA, 22 bp, Artificial Sequence
  Synthetic oligonucleotide; CTC chr11 5314469 5314490 5314486 5314491 +
catattcaatagtattccactt

SEQ ID NO: 99006 - DNA, 22 bp, Artificial Sequence
  Synthetic oligonucleotide; TTC chr11 5314476 5314497 5314493 5314498 +
aatagtattccactttcctagt

SEQ ID NO: 99007 - DNA, 22 bp, Artificial Sequence
  Synthetic oligonucleotide; TTC chr11 5314486 5314507 5314503 5314508 +
cactttcctagtatctctcaat

SEQ ID NO: 99008 - DNA, 22 bp, Artificial Sequence
  Synthetic oligonucleotide; CTT chr11 5314491 5314512 5314508 5314513 +
tcctagtatctctcaatagata

SEQ ID NO: 99009 - DNA, 22 bp, Artificial Sequence
  Synthetic oligonucleotide; TTT chr11 5314492 5314513 5314509 5314514 +
cctagtatctctcaatagatag

SEQ ID NO: 99010 - DNA, 22 bp, Artificial Sequence
  Synthetic oligonucleotide; TTC chr11 5314493 5314514 5314510 5314515 +
ctagtatctctcaatagatagg

SEQ ID NO: 99011 - DNA, 22 bp, Artificial Sequence
  Synthetic oligonucleotide; CTA chr11 5314496 5314517 5314513 5314518 +
gtatctctcaatagataggtaa

SEQ ID NO: 99012 - DNA, 22 bp, Artificial Sequence
  Synthetic oligonucleotide; CTC chr11 5314503 5314524 5314520 5314525 +
tcaatagataggtaaattatag

SEQ ID NO: 99013 - DNA, 22 bp, Artificial Sequence
  Synthetic oligonucleotide; CTC chr11 5314505 5314526 5314522 5314527 +
aatagataggtaaattatagat

SEQ ID NO: 99014 - DNA, 22 bp, Artificial Sequence
  Synthetic oligonucleotide; TTA chr11 5314522 5314543 5314539 5314544 +
tagatatatctccctcgataaa

SEQ ID NO: 99015 - DNA, 22 bp, Artificial Sequence
  Synthetic oligonucleotide; CTC chr11 5314534 5314555 5314551 5314556 +
cctcgataaagctttacatcta

SEQ ID NO: 99016 - DNA, 22 bp, Artificial Sequence
  Synthetic oligonucleotide; CTC chr11 5314538 5314559 5314555 5314560 +
gataaagctttacatctacata

SEQ ID NO: 99017 - DNA, 22 bp, Artificial Sequence
  Synthetic oligonucleotide; CTT chr11 5314548 5314569 5314565 5314570 +
tacatctacatatgaatacatt

SEQ ID NO: 99018 - DNA, 22 bp, Artificial Sequence
  Synthetic oligonucleotide; TTT chr11 5314549 5314570 5314566 5314571 +
acatctacatatgaatacattt

SEQ ID NO: 99019 - DNA, 22 bp, Artificial Sequence
  Synthetic oligonucleotide; TTA chr11 5314550 5314571 5314567 5314572 +
catctacatatgaatacattta

SEQ ID NO: 99020 - DNA, 22 bp, Artificial Sequence
  Synthetic oligonucleotide; CTA chr11 5314556 5314577 5314573 5314578 +
catatgaatacatttatacata

SEQ ID NO: 99021 - DNA, 22 bp, Artificial Sequence
  Synthetic oligonucleotide; TTT chr11 5314571 5314592 5314588 5314593 +
atacatatatttatgtatttat

SEQ ID NO: 99022 - DNA, 22 bp, Artificial Sequence
  Synthetic oligonucleotide; TTA chr11 5314572 5314593 5314589 5314594 +
tacatatatttatgtatttatc

SEQ ID NO: 99023 - DNA, 22 bp, Artificial Sequence
  Synthetic oligonucleotide; TTT chr11 5314583 5314604 5314600 5314605 +
atgtatttatcaattgatcaat

SEQ ID NO: 99024 - DNA, 22 bp, Artificial Sequence
  Synthetic oligonucleotide; TTA chr11 5314584 5314605 5314601 5314606 +
tgtatttatcaattgatcaatt

SEQ ID NO: 99025 - DNA, 22 bp, Artificial Sequence
  Synthetic oligonucleotide; TTT chr11 5314591 5314612 5314608 5314613 +
atcaattgatcaattgatggat

SEQ ID NO: 99026 - DNA, 22 bp, Artificial Sequence
  Synthetic oligonucleotide; TTA chr11 5314592 5314613 5314609 5314614 +
tcaattgatcaattgatggata

SEQ ID NO: 99027 - DNA, 22 bp, Artificial Sequence
  Synthetic oligonucleotide; TTG chr11 5314599 5314620 5314616 5314621 +
atcaattgatggatacattcat

SEQ ID NO: 99028 - DNA, 22 bp, Artificial Sequence
  Synthetic oligonucleotide; TTG chr11 5314607 5314628 5314624 5314629 +
atggatacattcattgtattat

SEQ ID NO: 99029 - DNA, 22 bp, Artificial Sequence
  Synthetic oligonucleotide; TTC chr11 5314619 5314640 5314636 5314641 +
attgtattattgttccatgtag

SEQ ID NO: 99030 - DNA, 22 bp, Artificial Sequence
  Synthetic oligonucleotide; TTG chr11 5314623 5314644 5314640 5314645 +
tattattgttccatgtagcttt

SEQ ID NO: 99031 - DNA, 22 bp, Artificial Sequence
  Synthetic oligonucleotide; TTA chr11 5314628 5314649 5314645 5314650 +
ttgttccatgtagcttttcact

SEQ ID NO: 99032 - DNA, 22 bp, Artificial Sequence
  Synthetic oligonucleotide; TTG chr11 5314631 5314652 5314648 5314653 +
ttccatgtagcttttcacttta

SEQ ID NO: 99033 - DNA, 22 bp, Artificial Sequence
  Synthetic oligonucleotide; TTC chr11 5314634 5314655 5314651 5314656 +
catgtagcttttcactttagat

SEQ ID NO: 99034 - DNA, 22 bp, Artificial Sequence
  Synthetic oligonucleotide; CTT chr11 5314644 5314665 5314661 5314666 +
ttcactttagataatagttaaa

SEQ ID NO: 99035 - DNA, 22 bp, Artificial Sequence
  Synthetic oligonucleotide; TTT chr11 5314645 5314666 5314662 5314667 +
tcactttagataatagttaaag

SEQ ID NO: 99036 - DNA, 22 bp, Artificial Sequence
  Synthetic oligonucleotide; TTT chr11 5314646 5314667 5314663 5314668 +
cactttagataatagttaaagc

SEQ ID NO: 99037 - DNA, 22 bp, Artificial Sequence
  Synthetic oligonucleotide; TTC chr11 5314647 5314668 5314664 5314669 +
actttagataatagttaaagcc

SEQ ID NO: 99038 - DNA, 22 bp, Artificial Sequence
  Synthetic oligonucleotide; CTT chr11 5314651 5314672 5314668 5314673 +
tagataatagttaaagcctatc

SEQ ID NO: 99039 - DNA, 22 bp, Artificial Sequence
  Synthetic oligonucleotide; TTT chr11 5314652 5314673 5314669 5314674 +
agataatagttaaagcctatct

SEQ ID NO: 99040 - DNA, 22 bp, Artificial Sequence
  Synthetic oligonucleotide; TTA chr11 5314653 5314674 5314670 5314675 +
gataatagttaaagcctatcta

SEQ ID NO: 99041 - DNA, 22 bp, Artificial Sequence
  Synthetic oligonucleotide; TTA chr11 5314664 5314685 5314681 5314686 +
aagcctatctaacactgataca

SEQ ID NO: 99042 - DNA, 22 bp, Artificial Sequence
  Synthetic oligonucleotide; CTA chr11 5314671 5314692 5314688 5314693 +
tctaacactgatacaagagata

SEQ ID NO: 99043 - DNA, 22 bp, Artificial Sequence
  Synthetic oligonucleotide; CTA chr11 5314675 5314696 5314692 5314697 +
acactgatacaagagatattgg

SEQ ID NO: 99044 - DNA, 22 bp, Artificial Sequence
  Synthetic oligonucleotide; CTG chr11 5314681 5314702 5314698 5314703 +
atacaagagatattgggtataa

SEQ ID NO: 99045 - DNA, 22 bp, Artificial Sequence
  Synthetic oligonucleotide; TTG chr11 5314696 5314717 5314713 5314718 +
ggtataaaataagctcctttcc

SEQ ID NO: 99046 - DNA, 22 bp, Artificial Sequence
  Synthetic oligonucleotide; CTC chr11 5314712 5314733 5314729 5314734 +
ctttccaattactcaaaaggcc

SEQ ID NO: 99047 - DNA, 22 bp, Artificial Sequence
  Synthetic oligonucleotide; CTT chr11 5314715 5314736 5314732 5314737 +
tccaattactcaaaaggcccag

SEQ ID NO: 99048 - DNA, 22 bp, Artificial Sequence
  Synthetic oligonucleotide; TTT chr11 5314716 5314737 5314733 5314738 +
ccaattactcaaaaggcccaga

SEQ ID NO: 99049 - DNA, 22 bp, Artificial Sequence
  Synthetic oligonucleotide; TTC chr11 5314717 5314738 5314734 5314739 +
caattactcaaaaggcccagaa

SEQ ID NO: 99050 - DNA, 22 bp, Artificial Sequence
  Synthetic oligonucleotide; TTA chr11 5314723 5314744 5314740 5314745 +
ctcaaaaggcccagaaatcatg

SEQ ID NO: 99051 - DNA, 22 bp, Artificial Sequence
  Synthetic oligonucleotide; CTC chr11 5314726 5314747 5314743 5314748 +
aaaaggcccagaaatcatgaag

SEQ ID NO: 99052 - DNA, 22 bp, Artificial Sequence
  Synthetic oligonucleotide; TTC chr11 5314760 5314781 5314777 5314782 +
tgaaaaaagggctcaagccatt

SEQ ID NO: 99053 - DNA, 22 bp, Artificial Sequence
  Synthetic oligonucleotide; CTG chr11 5314762 5314783 5314779 5314784 +
aaaaaagggctcaagccattct

SEQ ID NO: 99054 - DNA, 22 bp, Artificial Sequence
  Synthetic oligonucleotide; CTC chr11 5314774 5314795 5314791 5314796 +
aagccattctgtgcccagaaaa

SEQ ID NO: 99055 - DNA, 22 bp, Artificial Sequence
  Synthetic oligonucleotide; TTC chr11 5314783 5314804 5314800 5314805 +
tgtgcccagaaaataggcgaac

SEQ ID NO: 99056 - DNA, 22 bp, Artificial Sequence
  Synthetic oligonucleotide; CTG chr11 5314785 5314806 5314802 5314807 +
tgcccagaaaataggcgaacaa

SEQ ID NO: 99057 - DNA, 22 bp, Artificial Sequence
  Synthetic oligonucleotide; CTT chr11 5314812 5314833 5314829 5314834 +
ctttggatctgcttggtttgat

SEQ ID NO: 99058 - DNA, 22 bp, Artificial Sequence
  Synthetic oligonucleotide; TTC chr11 5314813 5314834 5314830 5314835 +
tttggatctgcttggtttgatg

SEQ ID NO: 99059 - DNA, 22 bp, Artificial Sequence
  Synthetic oligonucleotide; CTT chr11 5314815 5314836 5314832 5314837 +
tggatctgcttggtttgatgct

SEQ ID NO: 99060 - DNA, 22 bp, Artificial Sequence
  Synthetic oligonucleotide; TTT chr11 5314816 5314837 5314833 5314838 +
ggatctgcttggtttgatgctg

SEQ ID NO: 99061 - DNA, 22 bp, Artificial Sequence
  Synthetic oligonucleotide; TTG chr11 5314817 5314838 5314834 5314839 +
gatctgcttggtttgatgctgt

SEQ ID NO: 99062 - DNA, 22 bp, Artificial Sequence
  Synthetic oligonucleotide; CTG chr11 5314823 5314844 5314840 5314845 +
cttggtttgatgctgtatataa

SEQ ID NO: 99063 - DNA, 22 bp, Artificial Sequence
  Synthetic oligonucleotide; CTT chr11 5314826 5314847 5314843 5314848 +
ggtttgatgctgtatataatag

SEQ ID NO: 99064 - DNA, 22 bp, Artificial Sequence
  Synthetic oligonucleotide; TTG chr11 5314827 5314848 5314844 5314849 +
gtttgatgctgtatataatagg

SEQ ID NO: 99065 - DNA, 22 bp, Artificial Sequence
  Synthetic oligonucleotide; TTT chr11 5314831 5314852 5314848 5314853 +
gatgctgtatataatagggttc

SEQ ID NO: 99066 - DNA, 22 bp, Artificial Sequence
  Synthetic oligonucleotide; TTG chr11 5314832 5314853 5314849 5314854 +
atgctgtatataatagggttca

SEQ ID NO: 99067 - DNA, 22 bp, Artificial Sequence
  Synthetic oligonucleotide; CTG chr11 5314838 5314859 5314855 5314860 +
tatataatagggttcatgaatg

SEQ ID NO: 99068 - DNA, 22 bp, Artificial Sequence
  Synthetic oligonucleotide; TTC chr11 5314853 5314874 5314870 5314875 +
atgaatggaggaaaaagaaatg

SEQ ID NO: 99069 - DNA, 22 bp, Artificial Sequence
  Synthetic oligonucleotide; TTA chr11 5314883 5314904 5314900 5314905 +
gctcacggtaatgtgcaccaca

SEQ ID NO: 99070 - DNA, 22 bp, Artificial Sequence
  Synthetic oligonucleotide; CTC chr11 5314887 5314908 5314904 5314909 +
acggtaatgtgcaccacatgtg

SEQ ID NO: 99071 - DNA, 22 bp, Artificial Sequence
  Synthetic oligonucleotide; TTT chr11 5314919 5314940 5314936 5314941 +
cccaaacctgtgaatgaaagtc

SEQ ID NO: 99072 - DNA, 22 bp, Artificial Sequence
  Synthetic oligonucleotide; TTC chr11 5314920 5314941 5314937 5314942 +
ccaaacctgtgaatgaaagtct

SEQ ID NO: 99073 - DNA, 22 bp, Artificial Sequence
  Synthetic oligonucleotide; CTG chr11 5314929 5314950 5314946 5314951 +
tgaatgaaagtctcactgatca

SEQ ID NO: 99074 - DNA, 22 bp, Artificial Sequence
  Synthetic oligonucleotide; CTC chr11 5314943 5314964 5314960 5314965 +
actgatcacggtgatgtgaaat

SEQ ID NO: 99075 - DNA, 22 bp, Artificial Sequence
  Synthetic oligonucleotide; CTG chr11 5314947 5314968 5314964 5314969 +
atcacggtgatgtgaaatacca

SEQ ID NO: 99076 - DNA, 22 bp, Artificial Sequence
  Synthetic oligonucleotide; CTG chr11 5314980 5315001 5314997 5315002 +
atatgggagacacacatgttga

SEQ ID NO: 99077 - DNA, 22 bp, Artificial Sequence
  Synthetic oligonucleotide; TTG chr11 5315001 5315022 5315018 5315023 +
agagctttggcttgctcttttc

SEQ ID NO: 99078 - DNA, 22 bp, Artificial Sequence
  Synthetic oligonucleotide; CTT chr11 5315008 5315029 5315025 5315030 +
tggcttgctcttttctggaggc

SEQ ID NO: 99079 - DNA, 22 bp, Artificial Sequence
  Synthetic oligonucleotide; TTT chr11 5315009 5315030 5315026 5315031 +
ggcttgctcttttctggaggca

SEQ ID NO: 99080 - DNA, 22 bp, Artificial Sequence
  Synthetic oligonucleotide; TTG chr11 5315010 5315031 5315027 5315032 +
gcttgctcttttctggaggcaa

SEQ ID NO: 99081 - DNA, 22 bp, Artificial Sequence
  Synthetic oligonucleotide; CTT chr11 5315014 5315035 5315031 5315036 +
gctcttttctggaggcaatacc

SEQ ID NO: 99082 - DNA, 22 bp, Artificial Sequence
  Synthetic oligonucleotide; TTG chr11 5315015 5315036 5315032 5315037 +
ctcttttctggaggcaatacct

SEQ ID NO: 99083 - DNA, 22 bp, Artificial Sequence
  Synthetic oligonucleotide; CTC chr11 5315018 5315039 5315035 5315040 +
ttttctggaggcaataccttta

SEQ ID NO: 99084 - DNA, 22 bp, Artificial Sequence
  Synthetic oligonucleotide; CTT chr11 5315020 5315041 5315037 5315042 +
ttctggaggcaatacctttaac

SEQ ID NO: 99085 - DNA, 22 bp, Artificial Sequence
  Synthetic oligonucleotide; TTT chr11 5315021 5315042 5315038 5315043 +
tctggaggcaatacctttaact

SEQ ID NO: 99086 - DNA, 22 bp, Artificial Sequence
  Synthetic oligonucleotide; TTT chr11 5315022 5315043 5315039 5315044 +
ctggaggcaatacctttaactg

SEQ ID NO: 99087 - DNA, 22 bp, Artificial Sequence
  Synthetic oligonucleotide; TTC chr11 5315023 5315044 5315040 5315045 +
tggaggcaatacctttaactgt

SEQ ID NO: 99088 - DNA, 22 bp, Artificial Sequence
  Synthetic oligonucleotide; CTG chr11 5315025 5315046 5315042 5315047 +
gaggcaatacctttaactgttt

SEQ ID NO: 99089 - DNA, 22 bp, Artificial Sequence
  Synthetic oligonucleotide; CTT chr11 5315038 5315059 5315055 5315060 +
taactgttttaaggatcaggat

SEQ ID NO: 99090 - DNA, 22 bp, Artificial Sequence
  Synthetic oligonucleotide; TTT chr11 5315039 5315060 5315056 5315061 +
aactgttttaaggatcaggata

SEQ ID NO: 99091 - DNA, 22 bp, Artificial Sequence
  Synthetic oligonucleotide; TTA chr11 5315040 5315061 5315057 5315062 +
actgttttaaggatcaggatat

SEQ ID NO: 99092 - DNA, 22 bp, Artificial Sequence
  Synthetic oligonucleotide; CTG chr11 5315044 5315065 5315061 5315066 +
ttttaaggatcaggatataaga

SEQ ID NO: 99093 - DNA, 22 bp, Artificial Sequence
  Synthetic oligonucleotide; TTT chr11 5315047 5315068 5315064 5315069 +
taaggatcaggatataagaaaa

SEQ ID NO: 99094 - DNA, 22 bp, Artificial Sequence
  Synthetic oligonucleotide; TTT chr11 5315048 5315069 5315065 5315070 +
aaggatcaggatataagaaaag

SEQ ID NO: 99095 - DNA, 22 bp, Artificial Sequence
  Synthetic oligonucleotide; TTA chr11 5315049 5315070 5315066 5315071 +
aggatcaggatataagaaaaga

SEQ ID NO: 99096 - DNA, 22 bp, Artificial Sequence
  Synthetic oligonucleotide; CTA chr11 5315089 5315110 5315106 5315111 +
ggaagaaaatcaaagcaaccag

SEQ ID NO: 99097 - DNA, 22 bp, Artificial Sequence
  Synthetic oligonucleotide; CTG chr11 5315119 5315140 5315136 5315141 +
ggtataagtgattgaatgtaat

SEQ ID NO: 99098 - DNA, 22 bp, Artificial Sequence
  Synthetic oligonucleotide; TTG chr11 5315133 5315154 5315150 5315155 +
aatgtaatatcagcacaggcaa

SEQ ID NO: 99099 - DNA, 22 bp, Artificial Sequence
  Synthetic oligonucleotide; TTT chr11 5315159 5315180 5315176 5315181 +
caggacatcttgatggagaaaa

SEQ ID NO: 99100 - DNA, 22 bp, Artificial Sequence
  Synthetic oligonucleotide; TTC chr11 5315160 5315181 5315177 5315182 +
aggacatcttgatggagaaaaa

SEQ ID NO: 99101 - DNA, 22 bp, Artificial Sequence
  Synthetic oligonucleotide; CTT chr11 5315170 5315191 5315187 5315192 +
gatggagaaaaaaggtgtggaa

SEQ ID NO: 99102 - DNA, 22 bp, Artificial Sequence
  Synthetic oligonucleotide; TTG chr11 5315171 5315192 5315188 5315193 +
atggagaaaaaaggtgtggaag

SEQ ID NO: 99103 - DNA, 22 bp, Artificial Sequence
  Synthetic oligonucleotide; TTG chr11 5315239 5315260 5315256 5315261 +
gaggcacgagggataaaaagtc

SEQ ID NO: 99104 - DNA, 22 bp, Artificial Sequence
  Synthetic oligonucleotide; CTC chr11 5315265 5315286 5315282 5315287 +
ataaatagccacagttctatct

SEQ ID NO: 99105 - DNA, 22 bp, Artificial Sequence
  Synthetic oligonucleotide; TTC chr11 5315282 5315303 5315299 5315304 +
tatcttcacccaagatttagta

SEQ ID NO: 99106 - DNA, 22 bp, Artificial Sequence
  Synthetic oligonucleotide; CTA chr11 5315284 5315305 5315301 5315306 +
tcttcacccaagatttagtaga

SEQ ID NO: 99107 - DNA, 22 bp, Artificial Sequence
  Synthetic oligonucleotide; CTT chr11 5315288 5315309 5315305 5315310 +
cacccaagatttagtagaaata

SEQ ID NO: 99108 - DNA, 22 bp, Artificial Sequence
  Synthetic oligonucleotide; TTC chr11 5315289 5315310 5315306 5315311 +
acccaagatttagtagaaatag

SEQ ID NO: 99109 - DNA, 22 bp, Artificial Sequence
  Synthetic oligonucleotide; TTT chr11 5315300 5315321 5315317 5315322 +
agtagaaatagttatacctgag

SEQ ID NO: 99110 - DNA, 22 bp, Artificial Sequence
  Synthetic oligonucleotide; TTA chr11 5315301 5315322 5315318 5315323 +
gtagaaatagttatacctgaga

SEQ ID NO: 99111 - DNA, 22 bp, Artificial Sequence
  Synthetic oligonucleotide; TTA chr11 5315314 5315335 5315331 5315336 +
tacctgagaagcatgtggatga

SEQ ID NO: 99112 - DNA, 22 bp, Artificial Sequence
  Synthetic oligonucleotide; CTG chr11 5315320 5315341 5315337 5315342 +
agaagcatgtggatgataatga

SEQ ID NO: 99113 - DNA, 22 bp, Artificial Sequence
  Synthetic oligonucleotide; TTG chr11 5315360 5315381 5315377 5315382 +
acaggagaatacctgattctgc

SEQ ID NO: 99114 - DNA, 22 bp, Artificial Sequence
  Synthetic oligonucleotide; CTG chr11 5315375 5315396 5315392 5315397 +
attctgcaagtggataatggga

SEQ ID NO: 99115 - DNA, 22 bp, Artificial Sequence
  Synthetic oligonucleotide; TTC chr11 5315379 5315400 5315396 5315401 +
tgcaagtggataatgggagtgg

SEQ ID NO: 99116 - DNA, 22 bp, Artificial Sequence
  Synthetic oligonucleotide; CTG chr11 5315381 5315402 5315398 5315403 +
caagtggataatgggagtggat

SEQ ID NO: 99117 - DNA, 22 bp, Artificial Sequence
  Synthetic oligonucleotide; CTG chr11 5315415 5315436 5315432 5315437 +
caagaagcaggccccatggata

SEQ ID NO: 99118 - DNA, 22 bp, Artificial Sequence
  Synthetic oligonucleotide; CTC chr11 5315442 5315463 5315459 5315464 +
tttgtgattcatccacaagacg

SEQ ID NO: 99119 - DNA, 22 bp, Artificial Sequence
  Synthetic oligonucleotide; CTT chr11 5315444 5315465 5315461 5315466 +
tgtgattcatccacaagacgcc

SEQ ID NO: 99120 - DNA, 22 bp, Artificial Sequence
  Synthetic oligonucleotide; TTT chr11 5315445 5315466 5315462 5315467 +
gtgattcatccacaagacgccc

SEQ ID NO: 99121 - DNA, 22 bp, Artificial Sequence
  Synthetic oligonucleotide; TTG chr11 5315446 5315467 5315463 5315468 +
tgattcatccacaagacgccca

SEQ ID NO: 99122 - DNA, 22 bp, Artificial Sequence
  Synthetic oligonucleotide; TTC chr11 5315452 5315473 5315469 5315474 +
atccacaagacgcccattacag

SEQ ID NO: 99123 - DNA, 22 bp, Artificial Sequence
  Synthetic oligonucleotide; TTA chr11 5315471 5315492 5315488 5315493 +
cagtgggcatcatggtcaattt

SEQ ID NO: 99124 - DNA, 22 bp, Artificial Sequence
  Synthetic oligonucleotide; TTT chr11 5315493 5315514 5315510 5315515 +
caccatgaggtcttgcctcagt

SEQ ID NO: 99125 - DNA, 22 bp, Artificial Sequence
  Synthetic oligonucleotide; TTC chr11 5315494 5315515 5315511 5315516 +
accatgaggtcttgcctcagtg

SEQ ID NO: 99126 - DNA, 22 bp, Artificial Sequence
  Synthetic oligonucleotide; CTT chr11 5315507 5315528 5315524 5315529 +
gcctcagtgtggcaaggaaaca

SEQ ID NO: 99127 - DNA, 22 bp, Artificial Sequence
  Synthetic oligonucleotide; TTG chr11 5315508 5315529 5315525 5315530 +
cctcagtgtggcaaggaaacag

SEQ ID NO: 99128 - DNA, 22 bp, Artificial Sequence
  Synthetic oligonucleotide; CTC chr11 5315512 5315533 5315529 5315534 +
agtgtggcaaggaaacagtaca

SEQ ID NO: 99129 - DNA, 22 bp, Artificial Sequence
  Synthetic oligonucleotide; TTC chr11 5315541 5315562 5315558 5315563 +
gtgaagactgtggtcatgcttg

SEQ ID NO: 99130 - DNA, 22 bp, Artificial Sequence
  Synthetic oligonucleotide; CTG chr11 5315551 5315572 5315568 5315573 +
tggtcatgcttgatgaggtaga

SEQ ID NO: 99131 - DNA, 22 bp, Artificial Sequence
  Synthetic oligonucleotide; CTT chr11 5315562 5315583 5315579 5315584 +
gatgaggtagaggagcttgcca

SEQ ID NO: 99132 - DNA, 22 bp, Artificial Sequence
  Synthetic oligonucleotide; TTG chr11 5315563 5315584 5315580 5315585 +
atgaggtagaggagcttgccat

SEQ ID NO: 99133 - DNA, 22 bp, Artificial Sequence
  Synthetic oligonucleotide; CTT chr11 5315580 5315601 5315597 5315602 +
gccattgccaagaaggacgcac

SEQ ID NO: 99134 - DNA, 22 bp, Artificial Sequence
  Synthetic oligonucleotide; TTG chr11 5315581 5315602 5315598 5315603 +
ccattgccaagaaggacgcaca

SEQ ID NO: 99135 - DNA, 22 bp, Artificial Sequence
  Synthetic oligonucleotide; TTG chr11 5315587 5315608 5315604 5315609 +
ccaagaaggacgcacacataaa

SEQ ID NO: 99136 - DNA, 22 bp, Artificial Sequence
  Synthetic oligonucleotide; TTG chr11 5315645 5315666 5315662 5315667 +
cctccagtactgaaaagccagg

SEQ ID NO: 99137 - DNA, 22 bp, Artificial Sequence
  Synthetic oligonucleotide; CTC chr11 5315649 5315670 5315666 5315671 +
cagtactgaaaagccaggcagc

SEQ ID NO: 99138 - DNA, 22 bp, Artificial Sequence
  Synthetic oligonucleotide; CTG chr11 5315657 5315678 5315674 5315679 +
aaaagccaggcagcaaaaaagg

SEQ ID NO: 99139 - DNA, 22 bp, Artificial Sequence
  Synthetic oligonucleotide; TTG chr11 5315689 5315710 5315706 5315711 +
tgtgttcacaagtggcaagtag

SEQ ID NO: 99140 - DNA, 22 bp, Artificial Sequence
  Synthetic oligonucleotide; TTC chr11 5315696 5315717 5315713 5315718 +
acaagtggcaagtagctttata

SEQ ID NO: 99141 - DNA, 22 bp, Artificial Sequence
  Synthetic oligonucleotide; CTT chr11 5315714 5315735 5315731 5315736 +
tatagaaactattacactgaaa

SEQ ID NO: 99142 - DNA, 22 bp, Artificial Sequence
  Synthetic oligonucleotide; TTT chr11 5315715 5315736 5315732 5315737 +
atagaaactattacactgaaat

SEQ ID NO: 99143 - DNA, 22 bp, Artificial Sequence
  Synthetic oligonucleotide; TTA chr11 5315716 5315737 5315733 5315738 +
tagaaactattacactgaaatc

SEQ ID NO: 99144 - DNA, 22 bp, Artificial Sequence
  Synthetic oligonucleotide; CTA chr11 5315725 5315746 5315742 5315747 +
ttacactgaaatccctgcctta

SEQ ID NO: 99145 - DNA, 22 bp, Artificial Sequence
  Synthetic oligonucleotide; TTA chr11 5315728 5315749 5315745 5315750 +
cactgaaatccctgccttatca

SEQ ID NO: 99146 - DNA, 22 bp, Artificial Sequence
  Synthetic oligonucleotide; CTG chr11 5315733 5315754 5315750 5315755 +
aaatccctgccttatcagtttt

SEQ ID NO: 99147 - DNA, 22 bp, Artificial Sequence
  Synthetic oligonucleotide; CTG chr11 5315742 5315763 5315759 5315764 +
ccttatcagtttttactacctt

SEQ ID NO: 99148 - DNA, 22 bp, Artificial Sequence
  Synthetic oligonucleotide; CTT chr11 5315746 5315767 5315763 5315768 +
atcagtttttactaccttcttg

SEQ ID NO: 99149 - DNA, 22 bp, Artificial Sequence
  Synthetic oligonucleotide; TTA chr11 5315747 5315768 5315764 5315769 +
tcagtttttactaccttcttgt

SEQ ID NO: 99150 - DNA, 22 bp, Artificial Sequence
  Synthetic oligonucleotide; TTT chr11 5315754 5315775 5315771 5315776 +
ttactaccttcttgtgaaactg

SEQ ID NO: 99151 - DNA, 22 bp, Artificial Sequence
  Synthetic oligonucleotide; TTT chr11 5315755 5315776 5315772 5315777 +
tactaccttcttgtgaaactgt

SEQ ID NO: 99152 - DNA, 22 bp, Artificial Sequence
  Synthetic oligonucleotide; TTT chr11 5315756 5315777 5315773 5315778 +
actaccttcttgtgaaactgta

SEQ ID NO: 99153 - DNA, 22 bp, Artificial Sequence
  Synthetic oligonucleotide; TTA chr11 5315757 5315778 5315774 5315779 +
ctaccttcttgtgaaactgtat

SEQ ID NO: 99154 - DNA, 22 bp, Artificial Sequence
  Synthetic oligonucleotide; CTA chr11 5315760 5315781 5315777 5315782 +
ccttcttgtgaaactgtatttc

SEQ ID NO: 99155 - DNA, 22 bp, Artificial Sequence
  Synthetic oligonucleotide; CTT chr11 5315764 5315785 5315781 5315786 +
cttgtgaaactgtatttctgca

SEQ ID NO: 99156 - DNA, 22 bp, Artificial Sequence
  Synthetic oligonucleotide; TTC chr11 5315765 5315786 5315782 5315787 +
ttgtgaaactgtatttctgcag

SEQ ID NO: 99157 - DNA, 22 bp, Artificial Sequence
  Synthetic oligonucleotide; CTT chr11 5315767 5315788 5315784 5315789 +
gtgaaactgtatttctgcagcc

SEQ ID NO: 99158 - DNA, 22 bp, Artificial Sequence
  Synthetic oligonucleotide; TTG chr11 5315768 5315789 5315785 5315790 +
tgaaactgtatttctgcagcct

SEQ ID NO: 99159 - DNA, 22 bp, Artificial Sequence
  Synthetic oligonucleotide; CTG chr11 5315776 5315797 5315793 5315798 +
tatttctgcagcctcaatccta

SEQ ID NO: 99160 - DNA, 22 bp, Artificial Sequence
  Synthetic oligonucleotide; TTT chr11 5315781 5315802 5315798 5315803 +
ctgcagcctcaatcctaatatt

SEQ ID NO: 99161 - DNA, 22 bp, Artificial Sequence
  Synthetic oligonucleotide; TTC chr11 5315782 5315803 5315799 5315804 +
tgcagcctcaatcctaatattc

SEQ ID NO: 99162 - DNA, 22 bp, Artificial Sequence
  Synthetic oligonucleotide; CTG chr11 5315784 5315805 5315801 5315806 +
cagcctcaatcctaatattcat

SEQ ID NO: 99163 - DNA, 22 bp, Artificial Sequence
  Synthetic oligonucleotide; CTC chr11 5315791 5315812 5315808 5315813 +
aatcctaatattcatatttagc

SEQ ID NO: 99164 - DNA, 22 bp, Artificial Sequence
  Synthetic oligonucleotide; CTA chr11 5315798 5315819 5315815 5315820 +
atattcatatttagcaataatt

SEQ ID NO: 99165 - DNA, 22 bp, Artificial Sequence
  Synthetic oligonucleotide; TTC chr11 5315804 5315825 5315821 5315826 +
atatttagcaataatttattgg

SEQ ID NO: 99166 - DNA, 22 bp, Artificial Sequence
  Synthetic oligonucleotide; TTT chr11 5315810 5315831 5315827 5315832 +
agcaataatttattggtatatg

SEQ ID NO: 99167 - DNA, 22 bp, Artificial Sequence
  Synthetic oligonucleotide; TTA chr11 5315811 5315832 5315828 5315833 +
gcaataatttattggtatatgc

SEQ ID NO: 99168 - DNA, 22 bp, Artificial Sequence
  Synthetic oligonucleotide; TTT chr11 5315821 5315842 5315838 5315843 +
attggtatatgcatgaatgtgc

SEQ ID NO: 99169 - DNA, 22 bp, Artificial Sequence
  Synthetic oligonucleotide; TTA chr11 5315822 5315843 5315839 5315844 +
ttggtatatgcatgaatgtgca

SEQ ID NO: 99170 - DNA, 22 bp, Artificial Sequence
  Synthetic oligonucleotide; TTG chr11 5315825 5315846 5315842 5315847 +
gtatatgcatgaatgtgcaaca

SEQ ID NO: 99171 - DNA, 22 bp, Artificial Sequence
  Synthetic oligonucleotide; TTT chr11 5315851 5315872 5315868 5315873 +
tcttatagaagagcaatacatt

SEQ ID NO: 99172 - DNA, 22 bp, Artificial Sequence
  Synthetic oligonucleotide; TTT chr11 5315852 5315873 5315869 5315874 +
cttatagaagagcaatacattt

SEQ ID NO: 99173 - DNA, 22 bp, Artificial Sequence
  Synthetic oligonucleotide; TTC chr11 5315853 5315874 5315870 5315875 +
ttatagaagagcaatacattta

SEQ ID NO: 99174 - DNA, 22 bp, Artificial Sequence
  Synthetic oligonucleotide; CTT chr11 5315855 5315876 5315872 5315877 +
atagaagagcaatacatttata

SEQ ID NO: 99175 - DNA, 22 bp, Artificial Sequence
  Synthetic oligonucleotide; TTA chr11 5315856 5315877 5315873 5315878 +
tagaagagcaatacatttatag

SEQ ID NO: 99176 - DNA, 22 bp, Artificial Sequence
  Synthetic oligonucleotide; TTT chr11 5315874 5315895 5315891 5315896 +
atagactgtgctagagataagg

SEQ ID NO: 99177 - DNA, 22 bp, Artificial Sequence
  Synthetic oligonucleotide; TTA chr11 5315875 5315896 5315892 5315897 +
tagactgtgctagagataagga

SEQ ID NO: 99178 - DNA, 22 bp, Artificial Sequence
  Synthetic oligonucleotide; CTG chr11 5315882 5315903 5315899 5315904 +
tgctagagataaggaatgatga

SEQ ID NO: 99179 - DNA, 22 bp, Artificial Sequence
  Synthetic oligonucleotide; CTA chr11 5315887 5315908 5315904 5315909 +
gagataaggaatgatgatcatt

SEQ ID NO: 99180 - DNA, 22 bp, Artificial Sequence
  Synthetic oligonucleotide; TTT chr11 5315910 5315931 5315927 5315932 +
cttcagttatgaataattaagt

SEQ ID NO: 99181 - DNA, 22 bp, Artificial Sequence
  Synthetic oligonucleotide; TTC chr11 5315911 5315932 5315928 5315933 +
ttcagttatgaataattaagta

SEQ ID NO: 99182 - DNA, 22 bp, Artificial Sequence
  Synthetic oligonucleotide; CTT chr11 5315913 5315934 5315930 5315935 +
cagttatgaataattaagtagt

SEQ ID NO: 99183 - DNA, 22 bp, Artificial Sequence
  Synthetic oligonucleotide; TTC chr11 5315914 5315935 5315931 5315936 +
agttatgaataattaagtagtt

SEQ ID NO: 99184 - DNA, 22 bp, Artificial Sequence
  Synthetic oligonucleotide; TTA chr11 5315919 5315940 5315936 5315941 +
tgaataattaagtagttaagca

SEQ ID NO: 99185 - DNA, 22 bp, Artificial Sequence
  Synthetic oligonucleotide; TTA chr11 5315929 5315950 5315946 5315951 +
agtagttaagcattcttaatct

SEQ ID NO: 99186 - DNA, 22 bp, Artificial Sequence
  Synthetic oligonucleotide; TTA chr11 5315937 5315958 5315954 5315959 +
agcattcttaatctaaaaaaca

SEQ ID NO: 99187 - DNA, 22 bp, Artificial Sequence
  Synthetic oligonucleotide; TTC chr11 5315944 5315965 5315961 5315966 +
ttaatctaaaaaacacatttta

SEQ ID NO: 99188 - DNA, 22 bp, Artificial Sequence
  Synthetic oligonucleotide; CTT chr11 5315946 5315967 5315963 5315968 +
aatctaaaaaacacattttaaa

SEQ ID NO: 99189 - DNA, 22 bp, Artificial Sequence
  Synthetic oligonucleotide; TTA chr11 5315947 5315968 5315964 5315969 +
atctaaaaaacacattttaaaa

SEQ ID NO: 99190 - DNA, 22 bp, Artificial Sequence
  Synthetic oligonucleotide; CTA chr11 5315952 5315973 5315969 5315974 +
aaaaacacattttaaaaaatgc

SEQ ID NO: 99191 - DNA, 22 bp, Artificial Sequence
  Synthetic oligonucleotide; TTT chr11 5315964 5315985 5315981 5315986 +
taaaaaatgcatcatgcccctc

SEQ ID NO: 99192 - DNA, 22 bp, Artificial Sequence
  Synthetic oligonucleotide; TTT chr11 5315965 5315986 5315982 5315987 +
aaaaaatgcatcatgcccctct

SEQ ID NO: 99193 - DNA, 22 bp, Artificial Sequence
  Synthetic oligonucleotide; TTA chr11 5315966 5315987 5315983 5315988 +
aaaaatgcatcatgcccctctg

SEQ ID NO: 99194 - DNA, 22 bp, Artificial Sequence
  Synthetic oligonucleotide; CTC chr11 5315986 5316007 5316003 5316008 +
tgtggtgtgcttgctgcacaat

SEQ ID NO: 99195 - DNA, 22 bp, Artificial Sequence
  Synthetic oligonucleotide; CTG chr11 5315988 5316009 5316005 5316010 +
tggtgtgcttgctgcacaatgt

SEQ ID NO: 99196 - DNA, 22 bp, Artificial Sequence
  Synthetic oligonucleotide; CTT chr11 5315998 5316019 5316015 5316020 +
gctgcacaatgtttgaaccaat

SEQ ID NO: 99197 - DNA, 22 bp, Artificial Sequence
  Synthetic oligonucleotide; TTG chr11 5315999 5316020 5316016 5316021 +
ctgcacaatgtttgaaccaata

SEQ ID NO: 99198 - DNA, 22 bp, Artificial Sequence
  Synthetic oligonucleotide; CTG chr11 5316002 5316023 5316019 5316024 +
cacaatgtttgaaccaatagta

SEQ ID NO: 99199 - DNA, 22 bp, Artificial Sequence
  Synthetic oligonucleotide; TTT chr11 5316012 5316033 5316029 5316034 +
gaaccaatagtaacaaaaaaga

SEQ ID NO: 99200 - DNA, 22 bp, Artificial Sequence
  Synthetic oligonucleotide; TTG chr11 5316013 5316034 5316030 5316035 +
aaccaatagtaacaaaaaagaa

SEQ ID NO: 99201 - DNA, 22 bp, Artificial Sequence
  Synthetic oligonucleotide; TTA chr11 5316053 5316074 5316070 5316075 +
gataataattgtacatagttaa

SEQ ID NO: 99202 - DNA, 22 bp, Artificial Sequence
  Synthetic oligonucleotide; TTG chr11 5316064 5316085 5316081 5316086 +
tacatagttaacctgctgctta

SEQ ID NO: 99203 - DNA, 22 bp, Artificial Sequence
  Synthetic oligonucleotide; TTA chr11 5316074 5316095 5316091 5316096 +
acctgctgcttagcttaattgc

SEQ ID NO: 99204 - DNA, 22 bp, Artificial Sequence
  Synthetic oligonucleotide; CTG chr11 5316079 5316100 5316096 5316101 +
ctgcttagcttaattgcatatt

SEQ ID NO: 99205 - DNA, 22 bp, Artificial Sequence
  Synthetic oligonucleotide; CTG chr11 5316082 5316103 5316099 5316104 +
cttagcttaattgcatatttgg

SEQ ID NO: 99206 - DNA, 22 bp, Artificial Sequence
  Synthetic oligonucleotide; CTT chr11 5316085 5316106 5316102 5316107 +
agcttaattgcatatttggata

SEQ ID NO: 99207 - DNA, 22 bp, Artificial Sequence
  Synthetic oligonucleotide; TTA chr11 5316086 5316107 5316103 5316108 +
gcttaattgcatatttggatac

SEQ ID NO: 99208 - DNA, 22 bp, Artificial Sequence
  Synthetic oligonucleotide; CTT chr11 5316090 5316111 5316107 5316112 +
aattgcatatttggatacattt

SEQ ID NO: 99209 - DNA, 22 bp, Artificial Sequence
  Synthetic oligonucleotide; TTA chr11 5316091 5316112 5316108 5316113 +
attgcatatttggatacattta

SEQ ID NO: 99210 - DNA, 22 bp, Artificial Sequence
  Synthetic oligonucleotide; TTG chr11 5316095 5316116 5316112 5316117 +
catatttggatacatttaaact

SEQ ID NO: 99211 - DNA, 22 bp, Artificial Sequence
  Synthetic oligonucleotide; TTT chr11 5316102 5316123 5316119 5316124 +
ggatacatttaaacttgatttt

SEQ ID NO: 99212 - DNA, 22 bp, Artificial Sequence
  Synthetic oligonucleotide; TTG chr11 5316103 5316124 5316120 5316125 +
gatacatttaaacttgattttt

SEQ ID NO: 99213 - DNA, 22 bp, Artificial Sequence
  Synthetic oligonucleotide; TTT chr11 5316112 5316133 5316129 5316134 +
aaacttgatttttattttatgt

SEQ ID NO: 99214 - DNA, 22 bp, Artificial Sequence
  Synthetic oligonucleotide; TTA chr11 5316113 5316134 5316130 5316135 +
aacttgatttttattttatgtt

SEQ ID NO: 99215 - DNA, 22 bp, Artificial Sequence
  Synthetic oligonucleotide; CTT chr11 5316118 5316139 5316135 5316140 +
gatttttattttatgtttcaca

SEQ ID NO: 99216 - DNA, 22 bp, Artificial Sequence
  Synthetic oligonucleotide; TTG chr11 5316119 5316140 5316136 5316141 +
atttttattttatgtttcacaa

SEQ ID NO: 99217 - DNA, 22 bp, Artificial Sequence
  Synthetic oligonucleotide; TTT chr11 5316123 5316144 5316140 5316145 +
ttattttatgtttcacaatcat

SEQ ID NO: 99218 - DNA, 22 bp, Artificial Sequence
  Synthetic oligonucleotide; TTT chr11 5316124 5316145 5316141 5316146 +
tattttatgtttcacaatcatg

SEQ ID NO: 99219 - DNA, 22 bp, Artificial Sequence
  Synthetic oligonucleotide; TTT chr11 5316125 5316146 5316142 5316147 +
attttatgtttcacaatcatga

SEQ ID NO: 99220 - DNA, 22 bp, Artificial Sequence
  Synthetic oligonucleotide; TTA chr11 5316126 5316147 5316143 5316148 +
ttttatgtttcacaatcatgat

SEQ ID NO: 99221 - DNA, 22 bp, Artificial Sequence
  Synthetic oligonucleotide; TTT chr11 5316129 5316150 5316146 5316151 +
tatgtttcacaatcatgatata

SEQ ID NO: 99222 - DNA, 22 bp, Artificial Sequence
  Synthetic oligonucleotide; TTT chr11 5316130 5316151 5316147 5316152 +
atgtttcacaatcatgatatag

SEQ ID NO: 99223 - DNA, 22 bp, Artificial Sequence
  Synthetic oligonucleotide; TTA chr11 5316131 5316152 5316148 5316153 +
tgtttcacaatcatgatataga

SEQ ID NO: 99224 - DNA, 22 bp, Artificial Sequence
  Synthetic oligonucleotide; TTT chr11 5316136 5316157 5316153 5316158 +
cacaatcatgatatagacatag

SEQ ID NO: 99225 - DNA, 22 bp, Artificial Sequence
  Synthetic oligonucleotide; TTC chr11 5316137 5316158 5316154 5316159 +
acaatcatgatatagacatagt

SEQ ID NO: 99226 - DNA, 22 bp, Artificial Sequence
  Synthetic oligonucleotide; TTT chr11 5316163 5316184 5316180 5316185 +
tgttagaaaacttttctttgtt

SEQ ID NO: 99227 - DNA, 22 bp, Artificial Sequence
  Synthetic oligonucleotide; TTT chr11 5316164 5316185 5316181 5316186 +
gttagaaaacttttctttgttt

SEQ ID NO: 99228 - DNA, 22 bp, Artificial Sequence
  Synthetic oligonucleotide; TTG chr11 5316165 5316186 5316182 5316187 +
ttagaaaacttttctttgttta

SEQ ID NO: 99229 - DNA, 22 bp, Artificial Sequence
  Synthetic oligonucleotide; TTA chr11 5316168 5316189 5316185 5316190 +
gaaaacttttctttgtttagtt

SEQ ID NO: 99230 - DNA, 22 bp, Artificial Sequence
  Synthetic oligonucleotide; CTT chr11 5316176 5316197 5316193 5316198 +
ttctttgtttagttttgaaata

SEQ ID NO: 99231 - DNA, 22 bp, Artificial Sequence
  Synthetic oligonucleotide; TTT chr11 5316177 5316198 5316194 5316199 +
tctttgtttagttttgaaatag

SEQ ID NO: 99232 - DNA, 22 bp, Artificial Sequence
  Synthetic oligonucleotide; TTT chr11 5316178 5316199 5316195 5316200 +
ctttgtttagttttgaaataga

SEQ ID NO: 99233 - DNA, 22 bp, Artificial Sequence
  Synthetic oligonucleotide; TTC chr11 5316179 5316200 5316196 5316201 +
tttgtttagttttgaaatagaa

SEQ ID NO: 99234 - DNA, 22 bp, Artificial Sequence
  Synthetic oligonucleotide; CTT chr11 5316181 5316202 5316198 5316203 +
tgtttagttttgaaatagaatg

SEQ ID NO: 99235 - DNA, 22 bp, Artificial Sequence
  Synthetic oligonucleotide; TTT chr11 5316182 5316203 5316199 5316204 +
gtttagttttgaaatagaatgt

SEQ ID NO: 99236 - DNA, 22 bp, Artificial Sequence
  Synthetic oligonucleotide; TTG chr11 5316183 5316204 5316200 5316205 +
tttagttttgaaatagaatgtt

SEQ ID NO: 99237 - DNA, 22 bp, Artificial Sequence
  Synthetic oligonucleotide; TTT chr11 5316186 5316207 5316203 5316208 +
agttttgaaatagaatgttaat

SEQ ID NO: 99238 - DNA, 22 bp, Artificial Sequence
  Synthetic oligonucleotide; TTA chr11 5316187 5316208 5316204 5316209 +
gttttgaaatagaatgttaatg

SEQ ID NO: 99239 - DNA, 22 bp, Artificial Sequence
  Synthetic oligonucleotide; TTT chr11 5316191 5316212 5316208 5316213 +
tgaaatagaatgttaatgtttt

SEQ ID NO: 99240 - DNA, 22 bp, Artificial Sequence
  Synthetic oligonucleotide; TTT chr11 5316192 5316213 5316209 5316214 +
gaaatagaatgttaatgtttta

SEQ ID NO: 99241 - DNA, 22 bp, Artificial Sequence
  Synthetic oligonucleotide; TTG chr11 5316193 5316214 5316210 5316215 +
aaatagaatgttaatgttttat

SEQ ID NO: 99242 - DNA, 22 bp, Artificial Sequence
  Synthetic oligonucleotide; TTA chr11 5316206 5316227 5316223 5316228 +
atgttttatggaattctaacaa

SEQ ID NO: 99243 - DNA, 22 bp, Artificial Sequence
  Synthetic oligonucleotide; TTT chr11 5316212 5316233 5316229 5316234 +
tatggaattctaacaaaagcca

SEQ ID NO: 99244 - DNA, 22 bp, Artificial Sequence
  Synthetic oligonucleotide; TTT chr11 5316213 5316234 5316230 5316235 +
atggaattctaacaaaagccat

SEQ ID NO: 99245 - DNA, 22 bp, Artificial Sequence
  Synthetic oligonucleotide; TTA chr11 5316214 5316235 5316231 5316236 +
tggaattctaacaaaagccatg

SEQ ID NO: 99246 - DNA, 22 bp, Artificial Sequence
  Synthetic oligonucleotide; TTC chr11 5316222 5316243 5316239 5316244 +
taacaaaagccatgagccctct

SEQ ID NO: 99247 - DNA, 22 bp, Artificial Sequence
  Synthetic oligonucleotide; CTA chr11 5316224 5316245 5316241 5316246 +
acaaaagccatgagccctctgt

SEQ ID NO: 99248 - DNA, 22 bp, Artificial Sequence
  Synthetic oligonucleotide; CTC chr11 5316243 5316264 5316260 5316265 +
tgtggagaaaaatggacaaaag

SEQ ID NO: 99249 - DNA, 22 bp, Artificial Sequence
  Synthetic oligonucleotide; CTG chr11 5316245 5316266 5316262 5316267 +
tggagaaaaatggacaaaagca

SEQ ID NO: 99250 - DNA, 22 bp, Artificial Sequence
  Synthetic oligonucleotide; TTT chr11 5316282 5316303 5316299 5316304 +
agtctaaaaatattcacacgtt

SEQ ID NO: 99251 - DNA, 22 bp, Artificial Sequence
  Synthetic oligonucleotide; TTA chr11 5316283 5316304 5316300 5316305 +
gtctaaaaatattcacacgttt

SEQ ID NO: 99252 - DNA, 22 bp, Artificial Sequence
  Synthetic oligonucleotide; CTA chr11 5316288 5316309 5316305 5316310 +
aaaatattcacacgttttcctg

SEQ ID NO: 99253 - DNA, 22 bp, Artificial Sequence
  Synthetic oligonucleotide; TTC chr11 5316297 5316318 5316314 5316319 +
acacgttttcctgaagctaatc

SEQ ID NO: 99254 - DNA, 22 bp, Artificial Sequence
  Synthetic oligonucleotide; TTT chr11 5316305 5316326 5316322 5316327 +
tcctgaagctaatccatgagca

SEQ ID NO: 99255 - DNA, 22 bp, Artificial Sequence
  Synthetic oligonucleotide; TTT chr11 5316306 5316327 5316323 5316328 +
cctgaagctaatccatgagcac

SEQ ID NO: 99256 - DNA, 22 bp, Artificial Sequence
  Synthetic oligonucleotide; TTC chr11 5316307 5316328 5316324 5316329 +
ctgaagctaatccatgagcacc

SEQ ID NO: 99257 - DNA, 22 bp, Artificial Sequence
  Synthetic oligonucleotide; CTG chr11 5316310 5316331 5316327 5316332 +
aagctaatccatgagcaccaca

SEQ ID NO: 99258 - DNA, 22 bp, Artificial Sequence
  Synthetic oligonucleotide; CTA chr11 5316316 5316337 5316333 5316338 +
atccatgagcaccacatttgaa

SEQ ID NO: 99259 - DNA, 22 bp, Artificial Sequence
  Synthetic oligonucleotide; TTT chr11 5316335 5316356 5316352 5316357 +
gaaacttcaagcctgccttgaa

SEQ ID NO: 99260 - DNA, 22 bp, Artificial Sequence
  Synthetic oligonucleotide; TTG chr11 5316336 5316357 5316353 5316358 +
aaacttcaagcctgccttgaaa

SEQ ID NO: 99261 - DNA, 22 bp, Artificial Sequence
  Synthetic oligonucleotide; CTT chr11 5316342 5316363 5316359 5316364 +
caagcctgccttgaaacatgtg

SEQ ID NO: 99262 - DNA, 22 bp, Artificial Sequence
  Synthetic oligonucleotide; TTC chr11 5316343 5316364 5316360 5316365 +
aagcctgccttgaaacatgtgt

SEQ ID NO: 99263 - DNA, 22 bp, Artificial Sequence
  Synthetic oligonucleotide; CTG chr11 5316350 5316371 5316367 5316372 +
ccttgaaacatgtgttgagatg

SEQ ID NO: 99264 - DNA, 22 bp, Artificial Sequence
  Synthetic oligonucleotide; CTT chr11 5316354 5316375 5316371 5316376 +
gaaacatgtgttgagatgaaaa

SEQ ID NO: 99265 - DNA, 22 bp, Artificial Sequence
  Synthetic oligonucleotide; TTG chr11 5316355 5316376 5316372 5316377 +
aaacatgtgttgagatgaaaaa

SEQ ID NO: 99266 - DNA, 22 bp, Artificial Sequence
  Synthetic oligonucleotide; TTG chr11 5316367 5316388 5316384 5316389 +
agatgaaaaagtctgtgcttta

SEQ ID NO: 99267 - DNA, 22 bp, Artificial Sequence
  Synthetic oligonucleotide; CTG chr11 5316382 5316403 5316399 5316404 +
tgctttaggtgttggtcatccc

SEQ ID NO: 99268 - DNA, 22 bp, Artificial Sequence
  Synthetic oligonucleotide; CTT chr11 5316387 5316408 5316404 5316409 +
taggtgttggtcatcccagatg

SEQ ID NO: 99269 - DNA, 22 bp, Artificial Sequence
  Synthetic oligonucleotide; TTT chr11 5316388 5316409 5316405 5316410 +
aggtgttggtcatcccagatgg

SEQ ID NO: 99270 - DNA, 22 bp, Artificial Sequence
  Synthetic oligonucleotide; TTA chr11 5316389 5316410 5316406 5316411 +
ggtgttggtcatcccagatgga

SEQ ID NO: 99271 - DNA, 22 bp, Artificial Sequence
  Synthetic oligonucleotide; TTG chr11 5316396 5316417 5316413 5316418 +
gtcatcccagatggagtatgtt

SEQ ID NO: 99272 - DNA, 22 bp, Artificial Sequence
  Synthetic oligonucleotide; TTC chr11 5316419 5316440 5316436 5316441 +
tcctatgcagacctctgaaaat

SEQ ID NO: 99273 - DNA, 22 bp, Artificial Sequence
  Synthetic oligonucleotide; CTC chr11 5316421 5316442 5316438 5316443 +
ctatgcagacctctgaaaatct

SEQ ID NO: 99274 - DNA, 22 bp, Artificial Sequence
  Synthetic oligonucleotide; CTA chr11 5316424 5316445 5316441 5316446 +
tgcagacctctgaaaatcttcc

SEQ ID NO: 99275 - DNA, 22 bp, Artificial Sequence
  Synthetic oligonucleotide; CTC chr11 5316434 5316455 5316451 5316456 +
tgaaaatcttcctatcttctct

SEQ ID NO: 99276 - DNA, 22 bp, Artificial Sequence
  Synthetic oligonucleotide; CTG chr11 5316436 5316457 5316453 5316458 +
aaaatcttcctatcttctcttc

SEQ ID NO: 99277 - DNA, 22 bp, Artificial Sequence
  Synthetic oligonucleotide; CTT chr11 5316444 5316465 5316461 5316466 +
cctatcttctcttcgctgcatc

SEQ ID NO: 99278 - DNA, 22 bp, Artificial Sequence
  Synthetic oligonucleotide; TTC chr11 5316445 5316466 5316462 5316467 +
ctatcttctcttcgctgcatct

SEQ ID NO: 99279 - DNA, 22 bp, Artificial Sequence
  Synthetic oligonucleotide; CTA chr11 5316448 5316469 5316465 5316470 +
tcttctcttcgctgcatctaac

SEQ ID NO: 99280 - DNA, 22 bp, Artificial Sequence
  Synthetic oligonucleotide; CTT chr11 5316452 5316473 5316469 5316474 +
ctcttcgctgcatctaacataa

SEQ ID NO: 99281 - DNA, 22 bp, Artificial Sequence
  Synthetic oligonucleotide; TTC chr11 5316453 5316474 5316470 5316475 +
tcttcgctgcatctaacataag

SEQ ID NO: 99282 - DNA, 22 bp, Artificial Sequence
  Synthetic oligonucleotide; CTC chr11 5316455 5316476 5316472 5316477 +
ttcgctgcatctaacataagaa

SEQ ID NO: 99283 - DNA, 22 bp, Artificial Sequence
  Synthetic oligonucleotide; CTT chr11 5316457 5316478 5316474 5316479 +
cgctgcatctaacataagaagg

SEQ ID NO: 99284 - DNA, 22 bp, Artificial Sequence
  Synthetic oligonucleotide; TTC chr11 5316458 5316479 5316475 5316480 +
gctgcatctaacataagaagga

SEQ ID NO: 99285 - DNA, 22 bp, Artificial Sequence
  Synthetic oligonucleotide; CTG chr11 5316462 5316483 5316479 5316484 +
catctaacataagaaggaagag

SEQ ID NO: 99286 - DNA, 22 bp, Artificial Sequence
  Synthetic oligonucleotide; CTA chr11 5316468 5316489 5316485 5316490 +
acataagaaggaagaggaatca

SEQ ID NO: 99287 - DNA, 22 bp, Artificial Sequence
  Synthetic oligonucleotide; TTC chr11 5316493 5316514 5316510 5316515 +
cttattcctgttcctggcactc

SEQ ID NO: 99288 - DNA, 22 bp, Artificial Sequence
  Synthetic oligonucleotide; CTT chr11 5316496 5316517 5316513 5316518 +
attcctgttcctggcactcacc

SEQ ID NO: 99289 - DNA, 22 bp, Artificial Sequence
  Synthetic oligonucleotide; TTA chr11 5316497 5316518 5316514 5316519 +
ttcctgttcctggcactcacct

SEQ ID NO: 99290 - DNA, 22 bp, Artificial Sequence
  Synthetic oligonucleotide; TTC chr11 5316500 5316521 5316517 5316522 +
ctgttcctggcactcacctatg

SEQ ID NO: 99291 - DNA, 22 bp, Artificial Sequence
  Synthetic oligonucleotide; CTG chr11 5316503 5316524 5316520 5316525 +
ttcctggcactcacctatgctg

SEQ ID NO: 99292 - DNA, 22 bp, Artificial Sequence
  Synthetic oligonucleotide; TTC chr11 5316506 5316527 5316523 5316528 +
ctggcactcacctatgctgtca

SEQ ID NO: 99293 - DNA, 22 bp, Artificial Sequence
  Synthetic oligonucleotide; CTG chr11 5316509 5316530 5316526 5316531 +
gcactcacctatgctgtcattt

SEQ ID NO: 99294 - DNA, 22 bp, Artificial Sequence
  Synthetic oligonucleotide; CTC chr11 5316515 5316536 5316532 5316537 +
acctatgctgtcattttcttgc

SEQ ID NO: 99295 - DNA, 22 bp, Artificial Sequence
  Synthetic oligonucleotide; CTA chr11 5316520 5316541 5316537 5316542 +
tgctgtcattttcttgctggaa

SEQ ID NO: 99296 - DNA, 22 bp, Artificial Sequence
  Synthetic oligonucleotide; CTG chr11 5316525 5316546 5316542 5316547 +
tcattttcttgctggaataagg

SEQ ID NO: 99297 - DNA, 22 bp, Artificial Sequence
  Synthetic oligonucleotide; TTT chr11 5316531 5316552 5316548 5316553 +
tcttgctggaataaggacccat

SEQ ID NO: 99298 - DNA, 22 bp, Artificial Sequence
  Synthetic oligonucleotide; TTT chr11 5316532 5316553 5316549 5316554 +
cttgctggaataaggacccatt

SEQ ID NO: 99299 - DNA, 22 bp, Artificial Sequence
  Synthetic oligonucleotide; TTC chr11 5316533 5316554 5316550 5316555 +
ttgctggaataaggacccattc

SEQ ID NO: 99300 - DNA, 22 bp, Artificial Sequence
  Synthetic oligonucleotide; CTT chr11 5316535 5316556 5316552 5316557 +
gctggaataaggacccattcct

SEQ ID NO: 99301 - DNA, 22 bp, Artificial Sequence
  Synthetic oligonucleotide; TTG chr11 5316536 5316557 5316553 5316558 +
ctggaataaggacccattcctg

SEQ ID NO: 99302 - DNA, 22 bp, Artificial Sequence
  Synthetic oligonucleotide; CTG chr11 5316539 5316560 5316556 5316561 +
gaataaggacccattcctgctc

SEQ ID NO: 99303 - DNA, 22 bp, Artificial Sequence
  Synthetic oligonucleotide; TTC chr11 5316555 5316576 5316572 5316577 +
ctgctctatttgaagactcagt

SEQ ID NO: 99304 - DNA, 22 bp, Artificial Sequence
  Synthetic oligonucleotide; CTG chr11 5316558 5316579 5316575 5316580 +
ctctatttgaagactcagttca

SEQ ID NO: 99305 - DNA, 22 bp, Artificial Sequence
  Synthetic oligonucleotide; CTC chr11 5316561 5316582 5316578 5316583 +
tatttgaagactcagttcagac

SEQ ID NO: 99306 - DNA, 22 bp, Artificial Sequence
  Synthetic oligonucleotide; CTA chr11 5316563 5316584 5316580 5316585 +
tttgaagactcagttcagacac

SEQ ID NO: 99307 - DNA, 22 bp, Artificial Sequence
  Synthetic oligonucleotide; TTT chr11 5316566 5316587 5316583 5316588 +
gaagactcagttcagacactca

SEQ ID NO: 99308 - DNA, 22 bp, Artificial Sequence
  Synthetic oligonucleotide; TTG chr11 5316567 5316588 5316584 5316589 +
aagactcagttcagacactcac

SEQ ID NO: 99309 - DNA, 22 bp, Artificial Sequence
  Synthetic oligonucleotide; CTC chr11 5316574 5316595 5316591 5316596 +
agttcagacactcacttctcaa

SEQ ID NO: 99310 - DNA, 22 bp, Artificial Sequence
  Synthetic oligonucleotide; TTC chr11 5316579 5316600 5316596 5316601 +
agacactcacttctcaaagact

SEQ ID NO: 99311 - DNA, 22 bp, Artificial Sequence
  Synthetic oligonucleotide; CTC chr11 5316587 5316608 5316604 5316609 +
acttctcaaagactattcaaga

SEQ ID NO: 99312 - DNA, 22 bp, Artificial Sequence
  Synthetic oligonucleotide; CTT chr11 5316591 5316612 5316608 5316613 +
ctcaaagactattcaagaggcc

SEQ ID NO: 99313 - DNA, 22 bp, Artificial Sequence
  Synthetic oligonucleotide; TTC chr11 5316592 5316613 5316609 5316614 +
tcaaagactattcaagaggcca

SEQ ID NO: 99314 - DNA, 22 bp, Artificial Sequence
  Synthetic oligonucleotide; CTC chr11 5316594 5316615 5316611 5316616 +
aaagactattcaagaggccaaa

SEQ ID NO: 99315 - DNA, 22 bp, Artificial Sequence
  Synthetic oligonucleotide; CTA chr11 5316602 5316623 5316619 5316624 +
ttcaagaggccaaattagagag

SEQ ID NO: 99316 - DNA, 22 bp, Artificial Sequence
  Synthetic oligonucleotide; TTC chr11 5316605 5316626 5316622 5316627 +
aagaggccaaattagagagttt

SEQ ID NO: 99317 - DNA, 22 bp, Artificial Sequence
  Synthetic oligonucleotide; TTA chr11 5316619 5316640 5316636 5316641 +
gagagtttatgtatgtggaaat

SEQ ID NO: 99318 - DNA, 22 bp, Artificial Sequence
  Synthetic oligonucleotide; TTT chr11 5316627 5316648 5316644 5316649 +
atgtatgtggaaatcacttccc

SEQ ID NO: 99319 - DNA, 22 bp, Artificial Sequence
  Synthetic oligonucleotide; TTA chr11 5316628 5316649 5316645 5316650 +
tgtatgtggaaatcacttcccc

SEQ ID NO: 99320 - DNA, 22 bp, Artificial Sequence
  Synthetic oligonucleotide; CTT chr11 5316646 5316667 5316663 5316668 +
ccccagagtttcctctttccaa

SEQ ID NO: 99321 - DNA, 22 bp, Artificial Sequence
  Synthetic oligonucleotide; TTC chr11 5316647 5316668 5316664 5316669 +
cccagagtttcctctttccaaa

SEQ ID NO: 99322 - DNA, 22 bp, Artificial Sequence
  Synthetic oligonucleotide; TTT chr11 5316657 5316678 5316674 5316679 +
cctctttccaaatactcagaag

SEQ ID NO: 99323 - DNA, 22 bp, Artificial Sequence
  Synthetic oligonucleotide; TTC chr11 5316658 5316679 5316675 5316680 +
ctctttccaaatactcagaaga

SEQ ID NO: 99324 - DNA, 22 bp, Artificial Sequence
  Synthetic oligonucleotide; CTC chr11 5316661 5316682 5316678 5316683 +
tttccaaatactcagaagaacc

SEQ ID NO: 99325 - DNA, 22 bp, Artificial Sequence
  Synthetic oligonucleotide; CTT chr11 5316663 5316684 5316680 5316685 +
tccaaatactcagaagaaccct

SEQ ID NO: 99326 - DNA, 22 bp, Artificial Sequence
  Synthetic oligonucleotide; TTT chr11 5316664 5316685 5316681 5316686 +
ccaaatactcagaagaaccctt

SEQ ID NO: 99327 - DNA, 22 bp, Artificial Sequence
  Synthetic oligonucleotide; TTC chr11 5316665 5316686 5316682 5316687 +
caaatactcagaagaacccttg

SEQ ID NO: 99328 - DNA, 22 bp, Artificial Sequence
  Synthetic oligonucleotide; CTC chr11 5316674 5316695 5316691 5316696 +
agaagaacccttgatctcccct

SEQ ID NO: 99329 - DNA, 22 bp, Artificial Sequence
  Synthetic oligonucleotide; CTT chr11 5316686 5316707 5316703 5316708 +
gatctcccctccctcctctgtc

SEQ ID NO: 99330 - DNA, 22 bp, Artificial Sequence
  Synthetic oligonucleotide; TTG chr11 5316687 5316708 5316704 5316709 +
atctcccctccctcctctgtct

SEQ ID NO: 99331 - DNA, 22 bp, Artificial Sequence
  Synthetic oligonucleotide; CTC chr11 5316692 5316713 5316709 5316714 +
ccctccctcctctgtctgggag

SEQ ID NO: 99332 - DNA, 22 bp, Artificial Sequence
  Synthetic oligonucleotide; CTC chr11 5316697 5316718 5316714 5316719 +
cctcctctgtctgggagaagca

SEQ ID NO: 99333 - DNA, 22 bp, Artificial Sequence
  Synthetic oligonucleotide; CTC chr11 5316701 5316722 5316718 5316723 +
ctctgtctgggagaagcaggga

SEQ ID NO: 99334 - DNA, 22 bp, Artificial Sequence
  Synthetic oligonucleotide; CTC chr11 5316704 5316725 5316721 5316726 +
tgtctgggagaagcagggacgc

SEQ ID NO: 99335 - DNA, 22 bp, Artificial Sequence
  Synthetic oligonucleotide; CTG chr11 5316706 5316727 5316723 5316728 +
tctgggagaagcagggacgctc

SEQ ID NO: 99336 - DNA, 22 bp, Artificial Sequence
  Synthetic oligonucleotide; CTG chr11 5316710 5316731 5316727 5316732 +
ggagaagcagggacgctcaacc

SEQ ID NO: 99337 - DNA, 22 bp, Artificial Sequence
  Synthetic oligonucleotide; CTC chr11 5316728 5316749 5316745 5316750 +
aaccaatgtcctcggaactttc

SEQ ID NO: 99338 - DNA, 22 bp, Artificial Sequence
  Synthetic oligonucleotide; CTC chr11 5316741 5316762 5316758 5316763 +
ggaactttcaggtatttctcca

SEQ ID NO: 99339 - DNA, 22 bp, Artificial Sequence
  Synthetic oligonucleotide; CTT chr11 5316748 5316769 5316765 5316770 +
tcaggtatttctccaaggatgg

SEQ ID NO: 99340 - DNA, 22 bp, Artificial Sequence
  Synthetic oligonucleotide; TTT chr11 5316749 5316770 5316766 5316771 +
caggtatttctccaaggatgga

SEQ ID NO: 99341 - DNA, 22 bp, Artificial Sequence
  Synthetic oligonucleotide; TTC chr11 5316750 5316771 5316767 5316772 +
aggtatttctccaaggatggat

SEQ ID NO: 99342 - DNA, 22 bp, Artificial Sequence
  Synthetic oligonucleotide; TTT chr11 5316758 5316779 5316775 5316780 +
ctccaaggatggatgagaaaag

SEQ ID NO: 99343 - DNA, 22 bp, Artificial Sequence
  Synthetic oligonucleotide; TTC chr11 5316759 5316780 5316776 5316781 +
tccaaggatggatgagaaaagc

SEQ ID NO: 99344 - DNA, 22 bp, Artificial Sequence
  Synthetic oligonucleotide; CTC chr11 5316761 5316782 5316778 5316783 +
caaggatggatgagaaaagctg

SEQ ID NO: 99345 - DNA, 22 bp, Artificial Sequence
  Synthetic oligonucleotide; CTG chr11 5316783 5316804 5316800 5316805 +
catactccaatgccacctctac

SEQ ID NO: 99346 - DNA, 22 bp, Artificial Sequence
  Synthetic oligonucleotide; CTC chr11 5316790 5316811 5316807 5316812 +
caatgccacctctacattggga

SEQ ID NO: 99347 - DNA, 22 bp, Artificial Sequence
  Synthetic oligonucleotide; CTC chr11 5316802 5316823 5316819 5316824 +
tacattgggatgccaggactta

SEQ ID NO: 99348 - DNA, 22 bp, Artificial Sequence
  Synthetic oligonucleotide; CTA chr11 5316804 5316825 5316821 5316826 +
cattgggatgccaggacttaat

SEQ ID NO: 99349 - DNA, 22 bp, Artificial Sequence
  Synthetic oligonucleotide; TTG chr11 5316809 5316830 5316826 5316831 +
ggatgccaggacttaattatgt

SEQ ID NO: 99350 - DNA, 22 bp, Artificial Sequence
  Synthetic oligonucleotide; CTT chr11 5316823 5316844 5316840 5316845 +
aattatgtgacccttcaggacc

SEQ ID NO: 99351 - DNA, 22 bp, Artificial Sequence
  Synthetic oligonucleotide; TTA chr11 5316824 5316845 5316841 5316846 +
attatgtgacccttcaggaccc

SEQ ID NO: 99352 - DNA, 22 bp, Artificial Sequence
  Synthetic oligonucleotide; TTA chr11 5316828 5316849 5316845 5316850 +
tgtgacccttcaggaccctaag

SEQ ID NO: 99353 - DNA, 22 bp, Artificial Sequence
  Synthetic oligonucleotide; CTT chr11 5316838 5316859 5316855 5316860 +
caggaccctaagcatcagtaca

SEQ ID NO: 99354 - DNA, 22 bp, Artificial Sequence
  Synthetic oligonucleotide; TTC chr11 5316839 5316860 5316856 5316861 +
aggaccctaagcatcagtacac

SEQ ID NO: 99355 - DNA, 22 bp, Artificial Sequence
  Synthetic oligonucleotide; CTA chr11 5316848 5316869 5316865 5316870 +
agcatcagtacacagtatatcc

SEQ ID NO: 99356 - DNA, 22 bp, Artificial Sequence
  Synthetic oligonucleotide; CTT chr11 5316882 5316903 5316899 5316904 +
tgcattgtctgtctcaatacaa

SEQ ID NO: 99357 - DNA, 22 bp, Artificial Sequence
  Synthetic oligonucleotide; TTT chr11 5316883 5316904 5316900 5316905 +
gcattgtctgtctcaatacaat

SEQ ID NO: 99358 - DNA, 22 bp, Artificial Sequence
  Synthetic oligonucleotide; TTG chr11 5316884 5316905 5316901 5316906 +
cattgtctgtctcaatacaatg

SEQ ID NO: 99359 - DNA, 22 bp, Artificial Sequence
  Synthetic oligonucleotide; TTG chr11 5316889 5316910 5316906 5316911 +
tctgtctcaatacaatgcaaag

SEQ ID NO: 99360 - DNA, 22 bp, Artificial Sequence
  Synthetic oligonucleotide; CTG chr11 5316893 5316914 5316910 5316915 +
tctcaatacaatgcaaagtatt

SEQ ID NO: 99361 - DNA, 22 bp, Artificial Sequence
  Synthetic oligonucleotide; CTC chr11 5316897 5316918 5316914 5316919 +
aatacaatgcaaagtattgaga

SEQ ID NO: 99362 - DNA, 22 bp, Artificial Sequence
  Synthetic oligonucleotide; TTG chr11 5316916 5316937 5316933 5316938 +
agagatactagttgaatgcagg

SEQ ID NO: 99363 - DNA, 22 bp, Artificial Sequence
  Synthetic oligonucleotide; CTA chr11 5316926 5316947 5316943 5316948 +
gttgaatgcagggtcacatgtg

SEQ ID NO: 99364 - DNA, 22 bp, Artificial Sequence
  Synthetic oligonucleotide; TTG chr11 5316930 5316951 5316947 5316952 +
aatgcagggtcacatgtgtctt

SEQ ID NO: 99365 - DNA, 22 bp, Artificial Sequence
  Synthetic oligonucleotide; CTT chr11 5316952 5316973 5316969 5316974 +
tgtcctggagtttatgcatttc

SEQ ID NO: 99366 - DNA, 22 bp, Artificial Sequence
  Synthetic oligonucleotide; TTT chr11 5316953 5316974 5316970 5316975 +
gtcctggagtttatgcatttca

SEQ ID NO: 99367 - DNA, 22 bp, Artificial Sequence
  Synthetic oligonucleotide; TTG chr11 5316954 5316975 5316971 5316976 +
tcctggagtttatgcatttcaa

SEQ ID NO: 99368 - DNA, 22 bp, Artificial Sequence
  Synthetic oligonucleotide; CTG chr11 5316959 5316980 5316976 5316981 +
gagtttatgcatttcaattgca

SEQ ID NO: 99369 - DNA, 22 bp, Artificial Sequence
  Synthetic oligonucleotide; TTT chr11 5316965 5316986 5316982 5316987 +
atgcatttcaattgcattgttg

SEQ ID NO: 99370 - DNA, 22 bp, Artificial Sequence
  Synthetic oligonucleotide; TTA chr11 5316966 5316987 5316983 5316988 +
tgcatttcaattgcattgttgt

SEQ ID NO: 99371 - DNA, 22 bp, Artificial Sequence
  Synthetic oligonucleotide; TTT chr11 5316973 5316994 5316990 5316995 +
caattgcattgttgtcttttct

SEQ ID NO: 99372 - DNA, 22 bp, Artificial Sequence
  Synthetic oligonucleotide; TTC chr11 5316974 5316995 5316991 5316996 +
aattgcattgttgtcttttctg

SEQ ID NO: 99373 - DNA, 22 bp, Artificial Sequence
  Synthetic oligonucleotide; TTG chr11 5316979 5317000 5316996 5317001 +
cattgttgtcttttctgatact

SEQ ID NO: 99374 - DNA, 22 bp, Artificial Sequence
  Synthetic oligonucleotide; TTG chr11 5316984 5317005 5317001 5317006 +
ttgtcttttctgatactttggg

SEQ ID NO: 99375 - DNA, 22 bp, Artificial Sequence
  Synthetic oligonucleotide; TTG chr11 5316987 5317008 5317004 5317009 +
tcttttctgatactttgggaaa

SEQ ID NO: 99376 - DNA, 22 bp, Artificial Sequence
  Synthetic oligonucleotide; CTT chr11 5316991 5317012 5317008 5317013 +
ttctgatactttgggaaaatca

SEQ ID NO: 99377 - DNA, 22 bp, Artificial Sequence
  Synthetic oligonucleotide; TTT chr11 5316992 5317013 5317009 5317014 +
tctgatactttgggaaaatcag

SEQ ID NO: 99378 - DNA, 22 bp, Artificial Sequence
  Synthetic oligonucleotide; TTT chr11 5316993 5317014 5317010 5317015 +
ctgatactttgggaaaatcagt

SEQ ID NO: 99379 - DNA, 22 bp, Artificial Sequence
  Synthetic oligonucleotide; TTC chr11 5316994 5317015 5317011 5317016 +
tgatactttgggaaaatcagtt

SEQ ID NO: 99380 - DNA, 22 bp, Artificial Sequence
  Synthetic oligonucleotide; CTG chr11 5316996 5317017 5317013 5317018 +
atactttgggaaaatcagttct

SEQ ID NO: 99381 - DNA, 22 bp, Artificial Sequence
  Synthetic oligonucleotide; CTT chr11 5317002 5317023 5317019 5317024 +
tgggaaaatcagttctgatcca

SEQ ID NO: 99382 - DNA, 22 bp, Artificial Sequence
  Synthetic oligonucleotide; TTT chr11 5317003 5317024 5317020 5317025 +
gggaaaatcagttctgatccac

SEQ ID NO: 99383 - DNA, 22 bp, Artificial Sequence
  Synthetic oligonucleotide; TTG chr11 5317004 5317025 5317021 5317026 +
ggaaaatcagttctgatccaca

SEQ ID NO: 99384 - DNA, 22 bp, Artificial Sequence
  Synthetic oligonucleotide; TTC chr11 5317017 5317038 5317034 5317039 +
tgatccacaggaacctcaatgg

SEQ ID NO: 99385 - DNA, 22 bp, Artificial Sequence
  Synthetic oligonucleotide; CTG chr11 5317019 5317040 5317036 5317041 +
atccacaggaacctcaatggat

SEQ ID NO: 99386 - DNA, 22 bp, Artificial Sequence
  Synthetic oligonucleotide; CTC chr11 5317034 5317055 5317051 5317056 +
aatggatctattaatagccaag

SEQ ID NO: 99387 - DNA, 22 bp, Artificial Sequence
  Synthetic oligonucleotide; CTA chr11 5317044 5317065 5317061 5317066 +
ttaatagccaagtaaatgaagg

SEQ ID NO: 99388 - DNA, 22 bp, Artificial Sequence
  Synthetic oligonucleotide; TTA chr11 5317047 5317068 5317064 5317069 +
atagccaagtaaatgaagggcc

SEQ ID NO: 99389 - DNA, 22 bp, Artificial Sequence
  Synthetic oligonucleotide; CTA chr11 5317071 5317092 5317088 5317093 +
ttatattttgtcttaaaataac

SEQ ID NO: 99390 - DNA, 22 bp, Artificial Sequence
  Synthetic oligonucleotide; TTA chr11 5317074 5317095 5317091 5317096 +
tattttgtcttaaaataacttt

SEQ ID NO: 99391 - DNA, 22 bp, Artificial Sequence
  Synthetic oligonucleotide; TTT chr11 5317079 5317100 5317096 5317101 +
tgtcttaaaataactttgttta

SEQ ID NO: 99392 - DNA, 22 bp, Artificial Sequence
  Synthetic oligonucleotide; TTT chr11 5317080 5317101 5317097 5317102 +
gtcttaaaataactttgtttat

SEQ ID NO: 99393 - DNA, 22 bp, Artificial Sequence
  Synthetic oligonucleotide; TTG chr11 5317081 5317102 5317098 5317103 +
tcttaaaataactttgtttata

SEQ ID NO: 99394 - DNA, 22 bp, Artificial Sequence
  Synthetic oligonucleotide; CTT chr11 5317085 5317106 5317102 5317107 +
aaaataactttgtttatataaa

SEQ ID NO: 99395 - DNA, 22 bp, Artificial Sequence
  Synthetic oligonucleotide; TTA chr11 5317086 5317107 5317103 5317108 +
aaataactttgtttatataaaa

SEQ ID NO: 99396 - DNA, 22 bp, Artificial Sequence
  Synthetic oligonucleotide; CTT chr11 5317095 5317116 5317112 5317117 +
tgtttatataaaaatcactgcc

SEQ ID NO: 99397 - DNA, 22 bp, Artificial Sequence
  Synthetic oligonucleotide; TTT chr11 5317096 5317117 5317113 5317118 +
gtttatataaaaatcactgccc

SEQ ID NO: 99398 - DNA, 22 bp, Artificial Sequence
  Synthetic oligonucleotide; TTG chr11 5317097 5317118 5317114 5317119 +
tttatataaaaatcactgccca

SEQ ID NO: 99399 - DNA, 22 bp, Artificial Sequence
  Synthetic oligonucleotide; TTT chr11 5317100 5317121 5317117 5317122 +
atataaaaatcactgcccattt

SEQ ID NO: 99400 - DNA, 22 bp, Artificial Sequence
  Synthetic oligonucleotide; TTA chr11 5317101 5317122 5317118 5317123 +
tataaaaatcactgcccatttc

SEQ ID NO: 99401 - DNA, 22 bp, Artificial Sequence
  Synthetic oligonucleotide; CTG chr11 5317115 5317136 5317132 5317137 +
cccatttcataccaggttcagg

SEQ ID NO: 99402 - DNA, 22 bp, Artificial Sequence
  Synthetic oligonucleotide; TTT chr11 5317122 5317143 5317139 5317144 +
cataccaggttcaggatagact

SEQ ID NO: 99403 - DNA, 22 bp, Artificial Sequence
  Synthetic oligonucleotide; TTC chr11 5317123 5317144 5317140 5317145 +
ataccaggttcaggatagactt

SEQ ID NO: 99404 - DNA, 22 bp, Artificial Sequence
  Synthetic oligonucleotide; TTC chr11 5317134 5317155 5317151 5317156 +
aggatagacttgtttttattta

SEQ ID NO: 99405 - DNA, 22 bp, Artificial Sequence
  Synthetic oligonucleotide; CTT chr11 5317145 5317166 5317162 5317167 +
gtttttatttatttgttttttc

SEQ ID NO: 99406 - DNA, 22 bp, Artificial Sequence
  Synthetic oligonucleotide; TTG chr11 5317146 5317167 5317163 5317168 +
tttttatttatttgttttttct

SEQ ID NO: 99407 - DNA, 22 bp, Artificial Sequence
  Synthetic oligonucleotide; TTT chr11 5317149 5317170 5317166 5317171 +
ttatttatttgttttttctttt

SEQ ID NO: 99408 - DNA, 22 bp, Artificial Sequence
  Synthetic oligonucleotide; TTT chr11 5317150 5317171 5317167 5317172 +
tatttatttgttttttctttta

SEQ ID NO: 99409 - DNA, 22 bp, Artificial Sequence
  Synthetic oligonucleotide; TTT chr11 5317151 5317172 5317168 5317173 +
atttatttgttttttcttttaa

SEQ ID NO: 99410 - DNA, 22 bp, Artificial Sequence
  Synthetic oligonucleotide; TTA chr11 5317152 5317173 5317169 5317174 +
tttatttgttttttcttttaaa

SEQ ID NO: 99411 - DNA, 22 bp, Artificial Sequence
  Synthetic oligonucleotide; TTT chr11 5317155 5317176 5317172 5317177 +
atttgttttttcttttaaattt

SEQ ID NO: 99412 - DNA, 22 bp, Artificial Sequence
  Synthetic oligonucleotide; TTA chr11 5317156 5317177 5317173 5317178 +
tttgttttttcttttaaatttt

SEQ ID NO: 99413 - DNA, 22 bp, Artificial Sequence
  Synthetic oligonucleotide; TTT chr11 5317159 5317180 5317176 5317181 +
gttttttcttttaaattttcaa

SEQ ID NO: 99414 - DNA, 22 bp, Artificial Sequence
  Synthetic oligonucleotide; TTG chr11 5317160 5317181 5317177 5317182 +
ttttttcttttaaattttcaac

SEQ ID NO: 99415 - DNA, 22 bp, Artificial Sequence
  Synthetic oligonucleotide; TTT chr11 5317163 5317184 5317180 5317185 +
tttcttttaaattttcaacatt

SEQ ID NO: 99416 - DNA, 22 bp, Artificial Sequence
  Synthetic oligonucleotide; TTT chr11 5317164 5317185 5317181 5317186 +
ttcttttaaattttcaacattt

SEQ ID NO: 99417 - DNA, 22 bp, Artificial Sequence
  Synthetic oligonucleotide; TTT chr11 5317165 5317186 5317182 5317187 +
tcttttaaattttcaacattta

SEQ ID NO: 99418 - DNA, 22 bp, Artificial Sequence
  Synthetic oligonucleotide; TTT chr11 5317166 5317187 5317183 5317188 +
cttttaaattttcaacatttac

SEQ ID NO: 99419 - DNA, 22 bp, Artificial Sequence
  Synthetic oligonucleotide; TTC chr11 5317167 5317188 5317184 5317189 +
ttttaaattttcaacatttact

SEQ ID NO: 99420 - DNA, 22 bp, Artificial Sequence
  Synthetic oligonucleotide; CTT chr11 5317169 5317190 5317186 5317191 +
ttaaattttcaacatttacttt

SEQ ID NO: 99421 - DNA, 22 bp, Artificial Sequence
  Synthetic oligonucleotide; TTT chr11 5317170 5317191 5317187 5317192 +
taaattttcaacatttacttta

SEQ ID NO: 99422 - DNA, 22 bp, Artificial Sequence
  Synthetic oligonucleotide; TTT chr11 5317171 5317192 5317188 5317193 +
aaattttcaacatttactttag

SEQ ID NO: 99423 - DNA, 22 bp, Artificial Sequence
  Synthetic oligonucleotide; TTA chr11 5317172 5317193 5317189 5317194 +
aattttcaacatttactttaga

SEQ ID NO: 99424 - DNA, 22 bp, Artificial Sequence
  Synthetic oligonucleotide; TTT chr11 5317177 5317198 5317194 5317199 +
tcaacatttactttagatacag

SEQ ID NO: 99425 - DNA, 22 bp, Artificial Sequence
  Synthetic oligonucleotide; TTT chr11 5317178 5317199 5317195 5317200 +
caacatttactttagatacagt

SEQ ID NO: 99426 - DNA, 22 bp, Artificial Sequence
  Synthetic oligonucleotide; TTC chr11 5317179 5317200 5317196 5317201 +
aacatttactttagatacagtg

SEQ ID NO: 99427 - DNA, 22 bp, Artificial Sequence
  Synthetic oligonucleotide; TTT chr11 5317186 5317207 5317203 5317208 +
actttagatacagtgggtactt

SEQ ID NO: 99428 - DNA, 22 bp, Artificial Sequence
  Synthetic oligonucleotide; TTA chr11 5317187 5317208 5317204 5317209 +
ctttagatacagtgggtacttg

SEQ ID NO: 99429 - DNA, 22 bp, Artificial Sequence
  Synthetic oligonucleotide; CTT chr11 5317190 5317211 5317207 5317212 +
tagatacagtgggtacttgtgc

SEQ ID NO: 99430 - DNA, 22 bp, Artificial Sequence
  Synthetic oligonucleotide; TTT chr11 5317191 5317212 5317208 5317213 +
agatacagtgggtacttgtgca

SEQ ID NO: 99431 - DNA, 22 bp, Artificial Sequence
  Synthetic oligonucleotide; TTA chr11 5317192 5317213 5317209 5317214 +
gatacagtgggtacttgtgcag

SEQ ID NO: 99432 - DNA, 22 bp, Artificial Sequence
  Synthetic oligonucleotide; CTT chr11 5317208 5317229 5317225 5317230 +
gtgcaggttttttacatggata

SEQ ID NO: 99433 - DNA, 22 bp, Artificial Sequence
  Synthetic oligonucleotide; TTG chr11 5317209 5317230 5317226 5317231 +
tgcaggttttttacatggatat

SEQ ID NO: 99434 - DNA, 22 bp, Artificial Sequence
  Synthetic oligonucleotide; TTT chr11 5317218 5317239 5317235 5317240 +
tttacatggatatattgcatgc

SEQ ID NO: 99435 - DNA, 22 bp, Artificial Sequence
  Synthetic oligonucleotide; TTT chr11 5317219 5317240 5317236 5317241 +
ttacatggatatattgcatgca

SEQ ID NO: 99436 - DNA, 22 bp, Artificial Sequence
  Synthetic oligonucleotide; TTT chr11 5317220 5317241 5317237 5317242 +
tacatggatatattgcatgcag

SEQ ID NO: 99437 - DNA, 22 bp, Artificial Sequence
  Synthetic oligonucleotide; TTT chr11 5317221 5317242 5317238 5317243 +
acatggatatattgcatgcagt

SEQ ID NO: 99438 - DNA, 22 bp, Artificial Sequence
  Synthetic oligonucleotide; TTA chr11 5317222 5317243 5317239 5317244 +
catggatatattgcatgcagtg

SEQ ID NO: 99439 - DNA, 22 bp, Artificial Sequence
  Synthetic oligonucleotide; TTG chr11 5317235 5317256 5317252 5317257 +
catgcagtggtgagcatactat

SEQ ID NO: 99440 - DNA, 22 bp, Artificial Sequence
  Synthetic oligonucleotide; CTA chr11 5317256 5317277 5317273 5317278 +
tccaatagattttttaaccctc

SEQ ID NO: 99441 - DNA, 22 bp, Artificial Sequence
  Synthetic oligonucleotide; TTT chr11 5317268 5317289 5317285 5317290 +
tttaaccctctcccgcatctct

SEQ ID NO: 99442 - DNA, 22 bp, Artificial Sequence
  Synthetic oligonucleotide; TTT chr11 5317269 5317290 5317286 5317291 +
ttaaccctctcccgcatctctc

SEQ ID NO: 99443 - DNA, 22 bp, Artificial Sequence
  Synthetic oligonucleotide; TTT chr11 5317270 5317291 5317287 5317292 +
taaccctctcccgcatctctcc

SEQ ID NO: 99444 - DNA, 22 bp, Artificial Sequence
  Synthetic oligonucleotide; TTT chr11 5317271 5317292 5317288 5317293 +
aaccctctcccgcatctctccc

SEQ ID NO: 99445 - DNA, 22 bp, Artificial Sequence
  Synthetic oligonucleotide; TTA chr11 5317272 5317293 5317289 5317294 +
accctctcccgcatctctccct

SEQ ID NO: 99446 - DNA, 22 bp, Artificial Sequence
  Synthetic oligonucleotide; CTC chr11 5317278 5317299 5317295 5317300 +
tcccgcatctctccctgcccct

SEQ ID NO: 99447 - DNA, 22 bp, Artificial Sequence
  Synthetic oligonucleotide; CTC chr11 5317280 5317301 5317297 5317302 +
ccgcatctctccctgccccttg

SEQ ID NO: 99448 - DNA, 22 bp, Artificial Sequence
  Synthetic oligonucleotide; CTC chr11 5317289 5317310 5317306 5317311 +
tccctgccccttgtagtagttt

SEQ ID NO: 99449 - DNA, 22 bp, Artificial Sequence
  Synthetic oligonucleotide; CTC chr11 5317291 5317312 5317308 5317313 +
cctgccccttgtagtagtttca

SEQ ID NO: 99450 - DNA, 22 bp, Artificial Sequence
  Synthetic oligonucleotide; CTG chr11 5317295 5317316 5317312 5317317 +
ccccttgtagtagtttcaagtg

SEQ ID NO: 99451 - DNA, 22 bp, Artificial Sequence
  Synthetic oligonucleotide; CTT chr11 5317301 5317322 5317318 5317323 +
gtagtagtttcaagtggctatt

SEQ ID NO: 99452 - DNA, 22 bp, Artificial Sequence
  Synthetic oligonucleotide; TTG chr11 5317302 5317323 5317319 5317324 +
tagtagtttcaagtggctattg

SEQ ID NO: 99453 - DNA, 22 bp, Artificial Sequence
  Synthetic oligonucleotide; TTT chr11 5317311 5317332 5317328 5317333 +
caagtggctattgttcccatgt

SEQ ID NO: 99454 - DNA, 22 bp, Artificial Sequence
  Synthetic oligonucleotide; TTC chr11 5317312 5317333 5317329 5317334 +
aagtggctattgttcccatgtt

SEQ ID NO: 99455 - DNA, 22 bp, Artificial Sequence
  Synthetic oligonucleotide; CTA chr11 5317321 5317342 5317338 5317343 +
ttgttcccatgtttatatccac

SEQ ID NO: 99456 - DNA, 22 bp, Artificial Sequence
  Synthetic oligonucleotide; TTG chr11 5317324 5317345 5317341 5317346 +
ttcccatgtttatatccacgtg

SEQ ID NO: 99457 - DNA, 22 bp, Artificial Sequence
  Synthetic oligonucleotide; TTC chr11 5317327 5317348 5317344 5317349 +
ccatgtttatatccacgtgtac

SEQ ID NO: 99458 - DNA, 22 bp, Artificial Sequence
  Synthetic oligonucleotide; TTT chr11 5317335 5317356 5317352 5317357 +
atatccacgtgtactcaatgtt

SEQ ID NO: 99459 - DNA, 22 bp, Artificial Sequence
  Synthetic oligonucleotide; TTA chr11 5317336 5317357 5317353 5317358 +
tatccacgtgtactcaatgttt

SEQ ID NO: 99460 - DNA, 22 bp, Artificial Sequence
  Synthetic oligonucleotide; CTC chr11 5317351 5317372 5317368 5317373 +
aatgtttagcttccacttataa

SEQ ID NO: 99461 - DNA, 22 bp, Artificial Sequence
  Synthetic oligonucleotide; TTT chr11 5317358 5317379 5317375 5317380 +
agcttccacttataaatgagaa

SEQ ID NO: 99462 - DNA, 22 bp, Artificial Sequence
  Synthetic oligonucleotide; TTA chr11 5317359 5317380 5317376 5317381 +
gcttccacttataaatgagaat

SEQ ID NO: 99463 - DNA, 22 bp, Artificial Sequence
  Synthetic oligonucleotide; CTT chr11 5317363 5317384 5317380 5317385 +
ccacttataaatgagaatatat

SEQ ID NO: 99464 - DNA, 22 bp, Artificial Sequence
  Synthetic oligonucleotide; TTC chr11 5317364 5317385 5317381 5317386 +
cacttataaatgagaatatatg

SEQ ID NO: 99465 - DNA, 22 bp, Artificial Sequence
  Synthetic oligonucleotide; CTT chr11 5317369 5317390 5317386 5317391 +
ataaatgagaatatatggtatt

SEQ ID NO: 99466 - DNA, 22 bp, Artificial Sequence
  Synthetic oligonucleotide; TTA chr11 5317370 5317391 5317387 5317392 +
taaatgagaatatatggtattt

SEQ ID NO: 99467 - DNA, 22 bp, Artificial Sequence
  Synthetic oligonucleotide; TTT chr11 5317392 5317413 5317409 5317414 +
gcttttgtgttcttgcgttaat

SEQ ID NO: 99468 - DNA, 22 bp, Artificial Sequence
  Synthetic oligonucleotide; TTG chr11 5317393 5317414 5317410 5317415 +
cttttgtgttcttgcgttaatt

SEQ ID NO: 99469 - DNA, 22 bp, Artificial Sequence
  Synthetic oligonucleotide; CTT chr11 5317396 5317417 5317413 5317418 +
ttgtgttcttgcgttaatttgc

SEQ ID NO: 99470 - DNA, 22 bp, Artificial Sequence
  Synthetic oligonucleotide; TTT chr11 5317397 5317418 5317414 5317419 +
tgtgttcttgcgttaatttgct

SEQ ID NO: 99471 - DNA, 22 bp, Artificial Sequence
  Synthetic oligonucleotide; TTT chr11 5317398 5317419 5317415 5317420 +
gtgttcttgcgttaatttgctt

SEQ ID NO: 99472 - DNA, 22 bp, Artificial Sequence
  Synthetic oligonucleotide; TTG chr11 5317399 5317420 5317416 5317421 +
tgttcttgcgttaatttgctta

SEQ ID NO: 99473 - DNA, 22 bp, Artificial Sequence
  Synthetic oligonucleotide; TTC chr11 5317404 5317425 5317421 5317426 +
ttgcgttaatttgcttaggatt

SEQ ID NO: 99474 - DNA, 22 bp, Artificial Sequence
  Synthetic oligonucleotide; CTT chr11 5317406 5317427 5317423 5317428 +
gcgttaatttgcttaggattat

SEQ ID NO: 99475 - DNA, 22 bp, Artificial Sequence
  Synthetic oligonucleotide; TTG chr11 5317407 5317428 5317424 5317429 +
cgttaatttgcttaggattata

SEQ ID NO: 99476 - DNA, 22 bp, Artificial Sequence
  Synthetic oligonucleotide; TTA chr11 5317412 5317433 5317429 5317434 +
atttgcttaggattatagcctc

SEQ ID NO: 99477 - DNA, 22 bp, Artificial Sequence
  Synthetic oligonucleotide; TTT chr11 5317416 5317437 5317433 5317438 +
gcttaggattatagcctccagc

SEQ ID NO: 99478 - DNA, 22 bp, Artificial Sequence
  Synthetic oligonucleotide; TTG chr11 5317417 5317438 5317434 5317439 +
cttaggattatagcctccagct

SEQ ID NO: 99479 - DNA, 22 bp, Artificial Sequence
  Synthetic oligonucleotide; CTT chr11 5317420 5317441 5317437 5317442 +
aggattatagcctccagctcca

SEQ ID NO: 99480 - DNA, 22 bp, Artificial Sequence
  Synthetic oligonucleotide; TTA chr11 5317421 5317442 5317438 5317443 +
ggattatagcctccagctccac

SEQ ID NO: 99481 - DNA, 22 bp, Artificial Sequence
  Synthetic oligonucleotide; TTA chr11 5317427 5317448 5317444 5317449 +
tagcctccagctccacccatgt

SEQ ID NO: 99482 - DNA, 22 bp, Artificial Sequence
  Synthetic oligonucleotide; CTC chr11 5317434 5317455 5317451 5317456 +
cagctccacccatgttgctgaa

SEQ ID NO: 99483 - DNA, 22 bp, Artificial Sequence
  Synthetic oligonucleotide; CTC chr11 5317440 5317461 5317457 5317462 +
cacccatgttgctgaaaaggac

SEQ ID NO: 99484 - DNA, 22 bp, Artificial Sequence
  Synthetic oligonucleotide; TTG chr11 5317451 5317472 5317468 5317473 +
ctgaaaaggacatgatttcatt

SEQ ID NO: 99485 - DNA, 22 bp, Artificial Sequence
  Synthetic oligonucleotide; CTG chr11 5317454 5317475 5317471 5317476 +
aaaaggacatgatttcatttgt

SEQ ID NO: 99486 - DNA, 22 bp, Artificial Sequence
  Synthetic oligonucleotide; TTT chr11 5317469 5317490 5317486 5317491 +
catttgttcttattgccacata

SEQ ID NO: 99487 - DNA, 22 bp, Artificial Sequence
  Synthetic oligonucleotide; TTC chr11 5317470 5317491 5317487 5317492 +
atttgttcttattgccacatag

SEQ ID NO: 99488 - DNA, 22 bp, Artificial Sequence
  Synthetic oligonucleotide; TTT chr11 5317474 5317495 5317491 5317496 +
gttcttattgccacatagtggt

SEQ ID NO: 99489 - DNA, 22 bp, Artificial Sequence
  Synthetic oligonucleotide; TTG chr11 5317475 5317496 5317492 5317497 +
ttcttattgccacatagtggtg

SEQ ID NO: 99490 - DNA, 22 bp, Artificial Sequence
  Synthetic oligonucleotide; TTC chr11 5317478 5317499 5317495 5317500 +
ttattgccacatagtggtggtg

SEQ ID NO: 99491 - DNA, 22 bp, Artificial Sequence
  Synthetic oligonucleotide; CTT chr11 5317480 5317501 5317497 5317502 +
attgccacatagtggtggtgta

SEQ ID NO: 99492 - DNA, 22 bp, Artificial Sequence
  Synthetic oligonucleotide; TTA chr11 5317481 5317502 5317498 5317503 +
ttgccacatagtggtggtgtat

SEQ ID NO: 99493 - DNA, 22 bp, Artificial Sequence
  Synthetic oligonucleotide; TTG chr11 5317484 5317505 5317501 5317506 +
ccacatagtggtggtgtatatg

SEQ ID NO: 99494 - DNA, 22 bp, Artificial Sequence
  Synthetic oligonucleotide; TTT chr11 5317517 5317538 5317534 5317539 +
ctttatcccgtccgcctttgat

SEQ ID NO: 99495 - DNA, 22 bp, Artificial Sequence
  Synthetic oligonucleotide; TTC chr11 5317518 5317539 5317535 5317540 +
tttatcccgtccgcctttgata

SEQ ID NO: 99496 - DNA, 22 bp, Artificial Sequence
  Synthetic oligonucleotide; CTT chr11 5317520 5317541 5317537 5317542 +
tatcccgtccgcctttgataga

SEQ ID NO: 99497 - DNA, 22 bp, Artificial Sequence
  Synthetic oligonucleotide; TTT chr11 5317521 5317542 5317538 5317543 +
atcccgtccgcctttgatagac

SEQ ID NO: 99498 - DNA, 22 bp, Artificial Sequence
  Synthetic oligonucleotide; TTA chr11 5317522 5317543 5317539 5317544 +
tcccgtccgcctttgatagaca

SEQ ID NO: 99499 - DNA, 22 bp, Artificial Sequence
  Synthetic oligonucleotide; CTT chr11 5317535 5317556 5317552 5317557 +
tgatagacacctaggccagtta

SEQ ID NO: 99500 - DNA, 22 bp, Artificial Sequence
  Synthetic oligonucleotide; TTT chr11 5317536 5317557 5317553 5317558 +
gatagacacctaggccagttat

SEQ ID NO: 99501 - DNA, 22 bp, Artificial Sequence
  Synthetic oligonucleotide; TTG chr11 5317537 5317558 5317554 5317559 +
atagacacctaggccagttatt

SEQ ID NO: 99502 - DNA, 22 bp, Artificial Sequence
  Synthetic oligonucleotide; CTA chr11 5317548 5317569 5317565 5317570 +
ggccagttatttgtatttgcta

SEQ ID NO: 99503 - DNA, 22 bp, Artificial Sequence
  Synthetic oligonucleotide; TTA chr11 5317557 5317578 5317574 5317579 +
tttgtatttgctattctaaaca

SEQ ID NO: 99504 - DNA, 22 bp, Artificial Sequence
  Synthetic oligonucleotide; TTT chr11 5317560 5317581 5317577 5317582 +
gtatttgctattctaaacagca

SEQ ID NO: 99505 - DNA, 22 bp, Artificial Sequence
  Synthetic oligonucleotide; TTG chr11 5317561 5317582 5317578 5317583 +
tatttgctattctaaacagcat

SEQ ID NO: 99506 - DNA, 22 bp, Artificial Sequence
  Synthetic oligonucleotide; TTT chr11 5317566 5317587 5317583 5317588 +
gctattctaaacagcattacag

SEQ ID NO: 99507 - DNA, 22 bp, Artificial Sequence
  Synthetic oligonucleotide; TTG chr11 5317567 5317588 5317584 5317589 +
ctattctaaacagcattacagt

SEQ ID NO: 99508 - DNA, 22 bp, Artificial Sequence
  Synthetic oligonucleotide; CTA chr11 5317570 5317591 5317587 5317592 +
ttctaaacagcattacagtgaa

SEQ ID NO: 99509 - DNA, 22 bp, Artificial Sequence
  Synthetic oligonucleotide; TTC chr11 5317573 5317594 5317590 5317595 +
taaacagcattacagtgaacat

SEQ ID NO: 99510 - DNA, 22 bp, Artificial Sequence
  Synthetic oligonucleotide; CTA chr11 5317575 5317596 5317592 5317597 +
aacagcattacagtgaacatgc

SEQ ID NO: 99511 - DNA, 22 bp, Artificial Sequence
  Synthetic oligonucleotide; TTA chr11 5317585 5317606 5317602 5317607 +
cagtgaacatgcaagtgcatgt

SEQ ID NO: 99512 - DNA, 22 bp, Artificial Sequence
  Synthetic oligonucleotide; CTA chr11 5317612 5317633 5317629 5317634 +
gttggtctaatgctctgttttc

SEQ ID NO: 99513 - DNA, 22 bp, Artificial Sequence
  Synthetic oligonucleotide; TTG chr11 5317616 5317637 5317633 5317638 +
gtctaatgctctgttttcctat

SEQ ID NO: 99514 - DNA, 22 bp, Artificial Sequence
  Synthetic oligonucleotide; CTA chr11 5317621 5317642 5317638 5317643 +
atgctctgttttcctatggata

SEQ ID NO: 99515 - DNA, 22 bp, Artificial Sequence
  Synthetic oligonucleotide; CTC chr11 5317627 5317648 5317644 5317649 +
tgttttcctatggatatatacc

SEQ ID NO: 99516 - DNA, 22 bp, Artificial Sequence
  Synthetic oligonucleotide; CTG chr11 5317629 5317650 5317646 5317651 +
ttttcctatggatatataccca

SEQ ID NO: 99517 - DNA, 22 bp, Artificial Sequence
  Synthetic oligonucleotide; TTT chr11 5317632 5317653 5317649 5317654 +
tcctatggatatatacccagta

SEQ ID NO: 99518 - DNA, 22 bp, Artificial Sequence
  Synthetic oligonucleotide; TTT chr11 5317633 5317654 5317650 5317655 +
cctatggatatatacccagtag

SEQ ID NO: 99519 - DNA, 22 bp, Artificial Sequence
  Synthetic oligonucleotide; TTC chr11 5317634 5317655 5317651 5317656 +
ctatggatatatacccagtagc

SEQ ID NO: 99520 - DNA, 22 bp, Artificial Sequence
  Synthetic oligonucleotide; CTA chr11 5317637 5317658 5317654 5317659 +
tggatatatacccagtagcggg

SEQ ID NO: 99521 - DNA, 22 bp, Artificial Sequence
  Synthetic oligonucleotide; TTG chr11 5317663 5317684 5317680 5317685 +
ctgtgtcaaattgtagctctgc

SEQ ID NO: 99522 - DNA, 22 bp, Artificial Sequence
  Synthetic oligonucleotide; CTG chr11 5317666 5317687 5317683 5317688 +
tgtcaaattgtagctctgctta

SEQ ID NO: 99523 - DNA, 22 bp, Artificial Sequence
  Synthetic oligonucleotide; TTG chr11 5317676 5317697 5317693 5317698 +
tagctctgcttaaagttctttg

SEQ ID NO: 99524 - DNA, 22 bp, Artificial Sequence
  Synthetic oligonucleotide; CTC chr11 5317682 5317703 5317699 5317704 +
tgcttaaagttctttgaagact

SEQ ID NO: 99525 - DNA, 22 bp, Artificial Sequence
  Synthetic oligonucleotide; CTG chr11 5317684 5317705 5317701 5317706 +
cttaaagttctttgaagactct

SEQ ID NO: 99526 - DNA, 22 bp, Artificial Sequence
  Synthetic oligonucleotide; CTT chr11 5317687 5317708 5317704 5317709 +
aaagttctttgaagactctcca

SEQ ID NO: 99527 - DNA, 22 bp, Artificial Sequence
  Synthetic oligonucleotide; TTA chr11 5317688 5317709 5317705 5317710 +
aagttctttgaagactctccaa

SEQ ID NO: 99528 - DNA, 22 bp, Artificial Sequence
  Synthetic oligonucleotide; TTC chr11 5317694 5317715 5317711 5317716 +
tttgaagactctccaaactgtt

SEQ ID NO: 99529 - DNA, 22 bp, Artificial Sequence
  Synthetic oligonucleotide; CTT chr11 5317696 5317717 5317713 5317718 +
tgaagactctccaaactgtttt

SEQ ID NO: 99530 - DNA, 22 bp, Artificial Sequence
  Synthetic oligonucleotide; TTT chr11 5317697 5317718 5317714 5317719 +
gaagactctccaaactgttttc

SEQ ID NO: 99531 - DNA, 22 bp, Artificial Sequence
  Synthetic oligonucleotide; TTG chr11 5317698 5317719 5317715 5317720 +
aagactctccaaactgttttct

SEQ ID NO: 99532 - DNA, 22 bp, Artificial Sequence
  Synthetic oligonucleotide; CTC chr11 5317705 5317726 5317722 5317727 +
tccaaactgttttctgcagtgg

SEQ ID NO: 99533 - DNA, 22 bp, Artificial Sequence
  Synthetic oligonucleotide; CTC chr11 5317707 5317728 5317724 5317729 +
caaactgttttctgcagtggtt

SEQ ID NO: 99534 - DNA, 22 bp, Artificial Sequence
  Synthetic oligonucleotide; CTG chr11 5317714 5317735 5317731 5317736 +
ttttctgcagtggttgaactaa

SEQ ID NO: 99535 - DNA, 22 bp, Artificial Sequence
  Synthetic oligonucleotide; TTT chr11 5317717 5317738 5317734 5317739 +
tctgcagtggttgaactaattt

SEQ ID NO: 99536 - DNA, 22 bp, Artificial Sequence
  Synthetic oligonucleotide; TTT chr11 5317718 5317739 5317735 5317740 +
ctgcagtggttgaactaattta

SEQ ID NO: 99537 - DNA, 22 bp, Artificial Sequence
  Synthetic oligonucleotide; TTC chr11 5317719 5317740 5317736 5317741 +
tgcagtggttgaactaatttac

SEQ ID NO: 99538 - DNA, 22 bp, Artificial Sequence
  Synthetic oligonucleotide; CTG chr11 5317721 5317742 5317738 5317743 +
cagtggttgaactaatttacat

SEQ ID NO: 99539 - DNA, 22 bp, Artificial Sequence
  Synthetic oligonucleotide; TTG chr11 5317730 5317751 5317747 5317752 +
aactaatttacatccccatcat

SEQ ID NO: 99540 - DNA, 22 bp, Artificial Sequence
  Synthetic oligonucleotide; CTA chr11 5317735 5317756 5317752 5317757 +
atttacatccccatcatcattg

SEQ ID NO: 99541 - DNA, 22 bp, Artificial Sequence
  Synthetic oligonucleotide; TTT chr11 5317739 5317760 5317756 5317761 +
acatccccatcatcattgtata

SEQ ID NO: 99542 - DNA, 22 bp, Artificial Sequence
  Synthetic oligonucleotide; TTA chr11 5317740 5317761 5317757 5317762 +
catccccatcatcattgtataa

SEQ ID NO: 99543 - DNA, 22 bp, Artificial Sequence
  Synthetic oligonucleotide; TTG chr11 5317757 5317778 5317774 5317779 +
tataagtgttcccttttctcca

SEQ ID NO: 99544 - DNA, 22 bp, Artificial Sequence
  Synthetic oligonucleotide; TTC chr11 5317768 5317789 5317785 5317790 +
ccttttctccatagcctcatga

SEQ ID NO: 99545 - DNA, 22 bp, Artificial Sequence
  Synthetic oligonucleotide; CTT chr11 5317772 5317793 5317789 5317794 +
ttctccatagcctcatgagaat

SEQ ID NO: 99546 - DNA, 22 bp, Artificial Sequence
  Synthetic oligonucleotide; TTT chr11 5317773 5317794 5317790 5317795 +
tctccatagcctcatgagaatc

SEQ ID NO: 99547 - DNA, 22 bp, Artificial Sequence
  Synthetic oligonucleotide; TTT chr11 5317774 5317795 5317791 5317796 +
ctccatagcctcatgagaatct

SEQ ID NO: 99548 - DNA, 22 bp, Artificial Sequence
  Synthetic oligonucleotide; TTC chr11 5317775 5317796 5317792 5317797 +
tccatagcctcatgagaatctg

SEQ ID NO: 99549 - DNA, 22 bp, Artificial Sequence
  Synthetic oligonucleotide; CTC chr11 5317777 5317798 5317794 5317799 +
catagcctcatgagaatctgtt

SEQ ID NO: 99550 - DNA, 22 bp, Artificial Sequence
  Synthetic oligonucleotide; CTC chr11 5317786 5317807 5317803 5317808 +
atgagaatctgttttttggctt

SEQ ID NO: 99551 - DNA, 22 bp, Artificial Sequence
  Synthetic oligonucleotide; CTG chr11 5317797 5317818 5317814 5317819 +
ttttttggctttttaaaaatag

SEQ ID NO: 99552 - DNA, 22 bp, Artificial Sequence
  Synthetic oligonucleotide; TTT chr11 5317800 5317821 5317817 5317822 +
tttggctttttaaaaatagcta

SEQ ID NO: 99553 - DNA, 22 bp, Artificial Sequence
  Synthetic oligonucleotide; TTT chr11 5317801 5317822 5317818 5317823 +
ttggctttttaaaaatagctat

SEQ ID NO: 99554 - DNA, 22 bp, Artificial Sequence
  Synthetic oligonucleotide; TTT chr11 5317802 5317823 5317819 5317824 +
tggctttttaaaaatagctatt

SEQ ID NO: 99555 - DNA, 22 bp, Artificial Sequence
  Synthetic oligonucleotide; TTT chr11 5317803 5317824 5317820 5317825 +
ggctttttaaaaatagctattc

SEQ ID NO: 99556 - DNA, 22 bp, Artificial Sequence
  Synthetic oligonucleotide; TTG chr11 5317804 5317825 5317821 5317826 +
gctttttaaaaatagctattct

SEQ ID NO: 99557 - DNA, 22 bp, Artificial Sequence
  Synthetic oligonucleotide; CTT chr11 5317808 5317829 5317825 5317830 +
tttaaaaatagctattctgact

SEQ ID NO: 99558 - DNA, 22 bp, Artificial Sequence
  Synthetic oligonucleotide; TTT chr11 5317809 5317830 5317826 5317831 +
ttaaaaatagctattctgactg

SEQ ID NO: 99559 - DNA, 22 bp, Artificial Sequence
  Synthetic oligonucleotide; TTT chr11 5317810 5317831 5317827 5317832 +
taaaaatagctattctgactgg

SEQ ID NO: 99560 - DNA, 22 bp, Artificial Sequence
  Synthetic oligonucleotide; TTT chr11 5317811 5317832 5317828 5317833 +
aaaaatagctattctgactggt

SEQ ID NO: 99561 - DNA, 22 bp, Artificial Sequence
  Synthetic oligonucleotide; TTA chr11 5317812 5317833 5317829 5317834 +
aaaatagctattctgactggta

SEQ ID NO: 99562 - DNA, 22 bp, Artificial Sequence
  Synthetic oligonucleotide; CTA chr11 5317822 5317843 5317839 5317844 +
ttctgactggtatgagatagta

SEQ ID NO: 99563 - DNA, 22 bp, Artificial Sequence
  Synthetic oligonucleotide; TTC chr11 5317825 5317846 5317842 5317847 +
tgactggtatgagatagtatct

SEQ ID NO: 99564 - DNA, 22 bp, Artificial Sequence
  Synthetic oligonucleotide; CTG chr11 5317827 5317848 5317844 5317849 +
actggtatgagatagtatctct

SEQ ID NO: 99565 - DNA, 22 bp, Artificial Sequence
  Synthetic oligonucleotide; CTG chr11 5317831 5317852 5317848 5317853 +
gtatgagatagtatctcttgtg

SEQ ID NO: 99566 - DNA, 22 bp, Artificial Sequence
  Synthetic oligonucleotide; CTC chr11 5317848 5317869 5317865 5317870 +
ttgtggttttgatttgcatttc

SEQ ID NO: 99567 - DNA, 22 bp, Artificial Sequence
  Synthetic oligonucleotide; CTT chr11 5317850 5317871 5317867 5317872 +
gtggttttgatttgcatttctc

SEQ ID NO: 99568 - DNA, 22 bp, Artificial Sequence
  Synthetic oligonucleotide; TTG chr11 5317851 5317872 5317868 5317873 +
tggttttgatttgcatttctct

SEQ ID NO: 99569 - DNA, 22 bp, Artificial Sequence
  Synthetic oligonucleotide; TTT chr11 5317857 5317878 5317874 5317879 +
tgatttgcatttctctcattag

SEQ ID NO: 99570 - DNA, 22 bp, Artificial Sequence
  Synthetic oligonucleotide; TTT chr11 5317858 5317879 5317875 5317880 +
gatttgcatttctctcattagt

SEQ ID NO: 99571 - DNA, 22 bp, Artificial Sequence
  Synthetic oligonucleotide; TTG chr11 5317859 5317880 5317876 5317881 +
atttgcatttctctcattagtg

SEQ ID NO: 99572 - DNA, 22 bp, Artificial Sequence
  Synthetic oligonucleotide; TTT chr11 5317863 5317884 5317880 5317885 +
gcatttctctcattagtgatga

SEQ ID NO: 99573 - DNA, 22 bp, Artificial Sequence
  Synthetic oligonucleotide; TTG chr11 5317864 5317885 5317881 5317886 +
catttctctcattagtgatgat

SEQ ID NO: 99574 - DNA, 22 bp, Artificial Sequence
  Synthetic oligonucleotide; TTT chr11 5317869 5317890 5317886 5317891 +
ctctcattagtgatgatgatca

SEQ ID NO: 99575 - DNA, 22 bp, Artificial Sequence
  Synthetic oligonucleotide; TTC chr11 5317870 5317891 5317887 5317892 +
tctcattagtgatgatgatcat

SEQ ID NO: 99576 - DNA, 22 bp, Artificial Sequence
  Synthetic oligonucleotide; CTC chr11 5317872 5317893 5317889 5317894 +
tcattagtgatgatgatcattt

SEQ ID NO: 99577 - DNA, 22 bp, Artificial Sequence
  Synthetic oligonucleotide; CTC chr11 5317874 5317895 5317891 5317896 +
attagtgatgatgatcattttt

SEQ ID NO: 99578 - DNA, 22 bp, Artificial Sequence
  Synthetic oligonucleotide; TTA chr11 5317878 5317899 5317895 5317900 +
gtgatgatgatcatttttgtat

SEQ ID NO: 99579 - DNA, 22 bp, Artificial Sequence
  Synthetic oligonucleotide; TTT chr11 5317894 5317915 5317911 5317916 +
ttgtatatatttgttggctgcc

SEQ ID NO: 99580 - DNA, 22 bp, Artificial Sequence
  Synthetic oligonucleotide; TTT chr11 5317895 5317916 5317912 5317917 +
tgtatatatttgttggctgcct

SEQ ID NO: 99581 - DNA, 22 bp, Artificial Sequence
  Synthetic oligonucleotide; TTT chr11 5317896 5317917 5317913 5317918 +
gtatatatttgttggctgcctg

SEQ ID NO: 99582 - DNA, 22 bp, Artificial Sequence
  Synthetic oligonucleotide; TTG chr11 5317897 5317918 5317914 5317919 +
tatatatttgttggctgcctgt

SEQ ID NO: 99583 - DNA, 22 bp, Artificial Sequence
  Synthetic oligonucleotide; TTT chr11 5317906 5317927 5317923 5317928 +
gttggctgcctgtatgtcttct

SEQ ID NO: 99584 - DNA, 22 bp, Artificial Sequence
  Synthetic oligonucleotide; TTG chr11 5317907 5317928 5317924 5317929 +
ttggctgcctgtatgtcttctc

SEQ ID NO: 99585 - DNA, 22 bp, Artificial Sequence
  Synthetic oligonucleotide; TTG chr11 5317910 5317931 5317927 5317932 +
gctgcctgtatgtcttctcttg

SEQ ID NO: 99586 - DNA, 22 bp, Artificial Sequence
  Synthetic oligonucleotide; CTG chr11 5317914 5317935 5317931 5317936 +
cctgtatgtcttctcttgagaa

SEQ ID NO: 99587 - DNA, 22 bp, Artificial Sequence
  Synthetic oligonucleotide; CTG chr11 5317918 5317939 5317935 5317940 +
tatgtcttctcttgagaagagt

SEQ ID NO: 99588 - DNA, 22 bp, Artificial Sequence
  Synthetic oligonucleotide; CTT chr11 5317926 5317947 5317943 5317948 +
ctcttgagaagagtctgttcgt

SEQ ID NO: 99589 - DNA, 22 bp, Artificial Sequence
  Synthetic oligonucleotide; TTC chr11 5317927 5317948 5317944 5317949 +
tcttgagaagagtctgttcgtg

SEQ ID NO: 99590 - DNA, 22 bp, Artificial Sequence
  Synthetic oligonucleotide; CTC chr11 5317929 5317950 5317946 5317951 +
ttgagaagagtctgttcgtgga

SEQ ID NO: 99591 - DNA, 22 bp, Artificial Sequence
  Synthetic oligonucleotide; CTT chr11 5317931 5317952 5317948 5317953 +
gagaagagtctgttcgtggatt

SEQ ID NO: 99592 - DNA, 22 bp, Artificial Sequence
  Synthetic oligonucleotide; TTG chr11 5317932 5317953 5317949 5317954 +
agaagagtctgttcgtggattt

SEQ ID NO: 99593 - DNA, 22 bp, Artificial Sequence
  Synthetic oligonucleotide; CTG chr11 5317943 5317964 5317960 5317965 +
ttcgtggattttgcccattttt

SEQ ID NO: 99594 - DNA, 22 bp, Artificial Sequence
  Synthetic oligonucleotide; TTC chr11 5317946 5317967 5317963 5317968 +
gtggattttgcccatttttaaa

SEQ ID NO: 99595 - DNA, 22 bp, Artificial Sequence
  Synthetic oligonucleotide; TTT chr11 5317954 5317975 5317971 5317976 +
tgcccatttttaaatggaattg

SEQ ID NO: 99596 - DNA, 22 bp, Artificial Sequence
  Synthetic oligonucleotide; TTT chr11 5317955 5317976 5317972 5317977 +
gcccatttttaaatggaattgt

SEQ ID NO: 99597 - DNA, 22 bp, Artificial Sequence
  Synthetic oligonucleotide; TTG chr11 5317956 5317977 5317973 5317978 +
cccatttttaaatggaattgtt

SEQ ID NO: 99598 - DNA, 22 bp, Artificial Sequence
  Synthetic oligonucleotide; TTT chr11 5317963 5317984 5317980 5317985 +
ttaaatggaattgtttgctttt

SEQ ID NO: 99599 - DNA, 22 bp, Artificial Sequence
  Synthetic oligonucleotide; TTT chr11 5317964 5317985 5317981 5317986 +
taaatggaattgtttgcttttt

SEQ ID NO: 99600 - DNA, 22 bp, Artificial Sequence
  Synthetic oligonucleotide; TTT chr11 5317965 5317986 5317982 5317987 +
aaatggaattgtttgctttttg

SEQ ID NO: 99601 - DNA, 22 bp, Artificial Sequence
  Synthetic oligonucleotide; TTA chr11 5317966 5317987 5317983 5317988 +
aatggaattgtttgctttttgc

SEQ ID NO: 99602 - DNA, 22 bp, Artificial Sequence
  Synthetic oligonucleotide; TTG chr11 5317976 5317997 5317993 5317998 +
tttgctttttgcttgctgatat

SEQ ID NO: 99603 - DNA, 22 bp, Artificial Sequence
  Synthetic oligonucleotide; TTT chr11 5317979 5318000 5317996 5318001 +
gctttttgcttgctgatatgtt

SEQ ID NO: 99604 - DNA, 22 bp, Artificial Sequence
  Synthetic oligonucleotide; TTG chr11 5317980 5318001 5317997 5318002 +
ctttttgcttgctgatatgttc

SEQ ID NO: 99605 - DNA, 22 bp, Artificial Sequence
  Synthetic oligonucleotide; CTT chr11 5317983 5318004 5318000 5318005 +
tttgcttgctgatatgttcgaa

SEQ ID NO: 99606 - DNA, 22 bp, Artificial Sequence
  Synthetic oligonucleotide; TTT chr11 5317984 5318005 5318001 5318006 +
ttgcttgctgatatgttcgaat

SEQ ID NO: 99607 - DNA, 22 bp, Artificial Sequence
  Synthetic oligonucleotide; TTT chr11 5317985 5318006 5318002 5318007 +
tgcttgctgatatgttcgaatt

SEQ ID NO: 99608 - DNA, 22 bp, Artificial Sequence
  Synthetic oligonucleotide; TTT chr11 5317986 5318007 5318003 5318008 +
gcttgctgatatgttcgaattc

SEQ ID NO: 99609 - DNA, 22 bp, Artificial Sequence
  Synthetic oligonucleotide; TTG chr11 5317987 5318008 5318004 5318009 +
cttgctgatatgttcgaattcc

SEQ ID NO: 99610 - DNA, 22 bp, Artificial Sequence
  Synthetic oligonucleotide; CTT chr11 5317990 5318011 5318007 5318012 +
gctgatatgttcgaattcctta

SEQ ID NO: 99611 - DNA, 22 bp, Artificial Sequence
  Synthetic oligonucleotide; TTG chr11 5317991 5318012 5318008 5318013 +
ctgatatgttcgaattccttat

SEQ ID NO: 99612 - DNA, 22 bp, Artificial Sequence
  Synthetic oligonucleotide; CTG chr11 5317994 5318015 5318011 5318016 +
atatgttcgaattccttataga

SEQ ID NO: 99613 - DNA, 22 bp, Artificial Sequence
  Synthetic oligonucleotide; TTC chr11 5318002 5318023 5318019 5318024 +
gaattccttatagattctgaat

SEQ ID NO: 99614 - DNA, 22 bp, Artificial Sequence
  Synthetic oligonucleotide; TTC chr11 5318008 5318029 5318025 5318030 +
cttatagattctgaatattaga

SEQ ID NO: 99615 - DNA, 22 bp, Artificial Sequence
  Synthetic oligonucleotide; CTT chr11 5318011 5318032 5318028 5318033 +
atagattctgaatattagacct

SEQ ID NO: 99616 - DNA, 22 bp, Artificial Sequence
  Synthetic oligonucleotide; TTA chr11 5318012 5318033 5318029 5318034 +
tagattctgaatattagacctt

SEQ ID NO: 99617 - DNA, 22 bp, Artificial Sequence
  Synthetic oligonucleotide; TTC chr11 5318019 5318040 5318036 5318041 +
tgaatattagaccttttccaga

SEQ ID NO: 99618 - DNA, 22 bp, Artificial Sequence
  Synthetic oligonucleotide; CTG chr11 5318021 5318042 5318038 5318043 +
aatattagaccttttccagatg

SEQ ID NO: 99619 - DNA, 22 bp, Artificial Sequence
  Synthetic oligonucleotide; TTA chr11 5318028 5318049 5318045 5318050 +
gaccttttccagatgcacagtt

SEQ ID NO: 99620 - DNA, 22 bp, Artificial Sequence
  Synthetic oligonucleotide; CTT chr11 5318034 5318055 5318051 5318056 +
ttccagatgcacagtttgtgaa

SEQ ID NO: 99621 - DNA, 22 bp, Artificial Sequence
  Synthetic oligonucleotide; TTT chr11 5318035 5318056 5318052 5318057 +
tccagatgcacagtttgtgaat

SEQ ID NO: 99622 - DNA, 22 bp, Artificial Sequence
  Synthetic oligonucleotide; TTT chr11 5318036 5318057 5318053 5318058 +
ccagatgcacagtttgtgaata

SEQ ID NO: 99623 - DNA, 22 bp, Artificial Sequence
  Synthetic oligonucleotide; TTC chr11 5318037 5318058 5318054 5318059 +
cagatgcacagtttgtgaatag

SEQ ID NO: 99624 - DNA, 22 bp, Artificial Sequence
  Synthetic oligonucleotide; TTT chr11 5318051 5318072 5318068 5318073 +
gtgaatagtttctcctatcctg

SEQ ID NO: 99625 - DNA, 22 bp, Artificial Sequence
  Synthetic oligonucleotide; TTG chr11 5318052 5318073 5318069 5318074 +
tgaatagtttctcctatcctgt

SEQ ID NO: 99626 - DNA, 22 bp, Artificial Sequence
  Synthetic oligonucleotide; TTT chr11 5318062 5318083 5318079 5318084 +
ctcctatcctgtagattgtcag

SEQ ID NO: 99627 - DNA, 22 bp, Artificial Sequence
  Synthetic oligonucleotide; TTC chr11 5318063 5318084 5318080 5318085 +
tcctatcctgtagattgtcagt

SEQ ID NO: 99628 - DNA, 22 bp, Artificial Sequence
  Synthetic oligonucleotide; CTC chr11 5318065 5318086 5318082 5318087 +
ctatcctgtagattgtcagttt

SEQ ID NO: 99629 - DNA, 22 bp, Artificial Sequence
  Synthetic oligonucleotide; CTA chr11 5318068 5318089 5318085 5318090 +
tcctgtagattgtcagtttact

SEQ ID NO: 99630 - DNA, 22 bp, Artificial Sequence
  Synthetic oligonucleotide; CTG chr11 5318073 5318094 5318090 5318095 +
tagattgtcagtttactctgtt

SEQ ID NO: 99631 - DNA, 22 bp, Artificial Sequence
  Synthetic oligonucleotide; TTG chr11 5318080 5318101 5318097 5318102 +
tcagtttactctgttgatagtt

SEQ ID NO: 99632 - DNA, 22 bp, Artificial Sequence
  Synthetic oligonucleotide; TTT chr11 5318087 5318108 5318104 5318109 +
actctgttgatagtttcttctg

SEQ ID NO: 99633 - DNA, 22 bp, Artificial Sequence
  Synthetic oligonucleotide; TTA chr11 5318088 5318109 5318105 5318110 +
ctctgttgatagtttcttctgc

SEQ ID NO: 99634 - DNA, 22 bp, Artificial Sequence
  Synthetic oligonucleotide; CTC chr11 5318091 5318112 5318108 5318113 +
tgttgatagtttcttctgctgc

SEQ ID NO: 99635 - DNA, 22 bp, Artificial Sequence
  Synthetic oligonucleotide; CTG chr11 5318093 5318114 5318110 5318115 +
ttgatagtttcttctgctgcac

SEQ ID NO: 99636 - DNA, 22 bp, Artificial Sequence
  Synthetic oligonucleotide; TTG chr11 5318096 5318117 5318113 5318118 +
atagtttcttctgctgcacaga

SEQ ID NO: 99637 - DNA, 22 bp, Artificial Sequence
  Synthetic oligonucleotide; TTT chr11 5318103 5318124 5318120 5318125 +
cttctgctgcacagaagctctt

SEQ ID NO: 99638 - DNA, 22 bp, Artificial Sequence
  Synthetic oligonucleotide; TTC chr11 5318104 5318125 5318121 5318126 +
ttctgctgcacagaagctcttt

SEQ ID NO: 99639 - DNA, 22 bp, Artificial Sequence
  Synthetic oligonucleotide; CTT chr11 5318106 5318127 5318123 5318128 +
ctgctgcacagaagctcttttt

SEQ ID NO: 99640 - DNA, 22 bp, Artificial Sequence
  Synthetic oligonucleotide; TTC chr11 5318107 5318128 5318124 5318129 +
tgctgcacagaagctcttttta

SEQ ID NO: 99641 - DNA, 22 bp, Artificial Sequence
  Synthetic oligonucleotide; CTG chr11 5318109 5318130 5318126 5318131 +
ctgcacagaagctctttttatt

SEQ ID NO: 99642 - DNA, 22 bp, Artificial Sequence
  Synthetic oligonucleotide; CTG chr11 5318112 5318133 5318129 5318134 +
cacagaagctctttttattatt

SEQ ID NO: 99643 - DNA, 22 bp, Artificial Sequence
  Synthetic oligonucleotide; CTC chr11 5318123 5318144 5318140 5318145 +
tttttattattattattatact

SEQ ID NO: 99644 - DNA, 22 bp, Artificial Sequence
  Synthetic oligonucleotide; CTT chr11 5318125 5318146 5318142 5318147 +
tttattattattattatacttt

SEQ ID NO: 99645 - DNA, 22 bp, Artificial Sequence
  Synthetic oligonucleotide; TTT chr11 5318126 5318147 5318143 5318148 +
ttattattattattatacttta

SEQ ID NO: 99646 - DNA, 22 bp, Artificial Sequence
  Synthetic oligonucleotide; TTT chr11 5318127 5318148 5318144 5318149 +
tattattattattatactttaa

SEQ ID NO: 99647 - DNA, 22 bp, Artificial Sequence
  Synthetic oligonucleotide; TTT chr11 5318128 5318149 5318145 5318150 +
attattattattatactttaag

SEQ ID NO: 99648 - DNA, 22 bp, Artificial Sequence
  Synthetic oligonucleotide; TTA chr11 5318129 5318150 5318146 5318151 +
ttattattattatactttaagt

SEQ ID NO: 99649 - DNA, 22 bp, Artificial Sequence
  Synthetic oligonucleotide; TTA chr11 5318132 5318153 5318149 5318154 +
ttattattatactttaagttct

SEQ ID NO: 99650 - DNA, 22 bp, Artificial Sequence
  Synthetic oligonucleotide; TTA chr11 5318135 5318156 5318152 5318157 +
ttattatactttaagttctagg

SEQ ID NO: 99651 - DNA, 22 bp, Artificial Sequence
  Synthetic oligonucleotide; TTA chr11 5318138 5318159 5318155 5318160 +
ttatactttaagttctagggta

SEQ ID NO: 99652 - DNA, 22 bp, Artificial Sequence
  Synthetic oligonucleotide; TTA chr11 5318141 5318162 5318158 5318163 +
tactttaagttctagggtacat

SEQ ID NO: 99653 - DNA, 22 bp, Artificial Sequence
  Synthetic oligonucleotide; CTT chr11 5318146 5318167 5318163 5318168 +
taagttctagggtacatgtgcg

SEQ ID NO: 99654 - DNA, 22 bp, Artificial Sequence
  Synthetic oligonucleotide; TTT chr11 5318147 5318168 5318164 5318169 +
aagttctagggtacatgtgcgc

SEQ ID NO: 99655 - DNA, 22 bp, Artificial Sequence
  Synthetic oligonucleotide; TTA chr11 5318148 5318169 5318165 5318170 +
agttctagggtacatgtgcgca

SEQ ID NO: 99656 - DNA, 22 bp, Artificial Sequence
  Synthetic oligonucleotide; TTC chr11 5318153 5318174 5318170 5318175 +
tagggtacatgtgcgcaacgtg

SEQ ID NO: 99657 - DNA, 22 bp, Artificial Sequence
  Synthetic oligonucleotide; CTA chr11 5318155 5318176 5318172 5318177 +
gggtacatgtgcgcaacgtgca

SEQ ID NO: 99658 - DNA, 22 bp, Artificial Sequence
  Synthetic oligonucleotide; TTT chr11 5318182 5318203 5318199 5318204 +
gttacatatgtatacatgtgcc

SEQ ID NO: 99659 - DNA, 22 bp, Artificial Sequence
  Synthetic oligonucleotide; TTG chr11 5318183 5318204 5318200 5318205 +
ttacatatgtatacatgtgcca

SEQ ID NO: 99660 - DNA, 22 bp, Artificial Sequence
  Synthetic oligonucleotide; TTA chr11 5318186 5318207 5318203 5318208 +
catatgtatacatgtgccatgt

SEQ ID NO: 99661 - DNA, 22 bp, Artificial Sequence
  Synthetic oligonucleotide; TTG chr11 5318210 5318231 5318227 5318232 +
gtgtgctgcacccattaactca

SEQ ID NO: 99662 - DNA, 22 bp, Artificial Sequence
  Synthetic oligonucleotide; CTG chr11 5318218 5318239 5318235 5318240 +
cacccattaactcatcatttac

SEQ ID NO: 99663 - DNA, 22 bp, Artificial Sequence
  Synthetic oligonucleotide; TTA chr11 5318227 5318248 5318244 5318249 +
actcatcatttacattaggtat

SEQ ID NO: 99664 - DNA, 22 bp, Artificial Sequence
  Synthetic oligonucleotide; CTC chr11 5318231 5318252 5318248 5318253 +
atcatttacattaggtatatct

SEQ ID NO: 99665 - DNA, 22 bp, Artificial Sequence
  Synthetic oligonucleotide; TTT chr11 5318238 5318259 5318255 5318260 +
acattaggtatatctcctaatg

SEQ ID NO: 99666 - DNA, 22 bp, Artificial Sequence
  Synthetic oligonucleotide; TTA chr11 5318239 5318260 5318256 5318261 +
cattaggtatatctcctaatgc

SEQ ID NO: 99667 - DNA, 22 bp, Artificial Sequence
  Synthetic oligonucleotide; TTA chr11 5318244 5318265 5318261 5318266 +
ggtatatctcctaatgctatcc

SEQ ID NO: 99668 - DNA, 22 bp, Artificial Sequence
  Synthetic oligonucleotide; CTC chr11 5318254 5318275 5318271 5318276 +
ctaatgctatccctctccaccc

SEQ ID NO: 99669 - DNA, 22 bp, Artificial Sequence
  Synthetic oligonucleotide; CTA chr11 5318257 5318278 5318274 5318279 +
atgctatccctctccacccccc

SEQ ID NO: 99670 - DNA, 22 bp, Artificial Sequence
  Synthetic oligonucleotide; CTA chr11 5318263 5318284 5318280 5318285 +
tccctctccaccccccaccccc

SEQ ID NO: 99671 - DNA, 22 bp, Artificial Sequence
  Synthetic oligonucleotide; CTC chr11 5318269 5318290 5318286 5318291 +
tccaccccccacccccacccca

SEQ ID NO: 99672 - DNA, 22 bp, Artificial Sequence
  Synthetic oligonucleotide; CTC chr11 5318271 5318292 5318288 5318293 +
caccccccacccccaccccaca

SEQ ID NO: 99673 - DNA, 22 bp, Artificial Sequence
  Synthetic oligonucleotide; CTG chr11 5318303 5318324 5318320 5318325 +
gtgtgtgatgttccccttcctc

SEQ ID NO: 99674 - DNA, 22 bp, Artificial Sequence
  Synthetic oligonucleotide; TTC chr11 5318316 5318337 5318333 5318338 +
cccttcctctgtccaagtgttc

SEQ ID NO: 99675 - DNA, 22 bp, Artificial Sequence
  Synthetic oligonucleotide; CTT chr11 5318321 5318342 5318338 5318343 +
cctctgtccaagtgttctcatt

SEQ ID NO: 99676 - DNA, 22 bp, Artificial Sequence
  Synthetic oligonucleotide; TTC chr11 5318322 5318343 5318339 5318344 +
ctctgtccaagtgttctcattg

SEQ ID NO: 99677 - DNA, 22 bp, Artificial Sequence
  Synthetic oligonucleotide; CTC chr11 5318325 5318346 5318342 5318347 +
tgtccaagtgttctcattgttc

SEQ ID NO: 99678 - DNA, 22 bp, Artificial Sequence
  Synthetic oligonucleotide; CTG chr11 5318327 5318348 5318344 5318349 +
tccaagtgttctcattgttcaa

SEQ ID NO: 99679 - DNA, 22 bp, Artificial Sequence
  Synthetic oligonucleotide; TTC chr11 5318338 5318359 5318355 5318360 +
tcattgttcaattcccacctat

SEQ ID NO: 99680 - DNA, 22 bp, Artificial Sequence
  Synthetic oligonucleotide; CTC chr11 5318340 5318361 5318357 5318362 +
attgttcaattcccacctataa

SEQ ID NO: 99681 - DNA, 22 bp, Artificial Sequence
  Synthetic oligonucleotide; TTG chr11 5318344 5318365 5318361 5318366 +
ttcaattcccacctataagtga

SEQ ID NO: 99682 - DNA, 22 bp, Artificial Sequence
  Synthetic oligonucleotide; TTC chr11 5318347 5318368 5318364 5318369 +
aattcccacctataagtgagaa

SEQ ID NO: 99683 - DNA, 22 bp, Artificial Sequence
  Synthetic oligonucleotide; TTC chr11 5318352 5318373 5318369 5318374 +
ccacctataagtgagaacatgt

SEQ ID NO: 99684 - DNA, 22 bp, Artificial Sequence
  Synthetic oligonucleotide; CTA chr11 5318359 5318380 5318376 5318381 +
taagtgagaacatgtggtattt

SEQ ID NO: 99685 - DNA, 22 bp, Artificial Sequence
  Synthetic oligonucleotide; TTT chr11 5318381 5318402 5318398 5318403 +
ggttttttgtccttgtgatagt

SEQ ID NO: 99686 - DNA, 22 bp, Artificial Sequence
  Synthetic oligonucleotide; TTG chr11 5318382 5318403 5318399 5318404 +
gttttttgtccttgtgatagtt

SEQ ID NO: 99687 - DNA, 22 bp, Artificial Sequence
  Synthetic oligonucleotide; TTT chr11 5318386 5318407 5318403 5318408 +
tttgtccttgtgatagtttgct

SEQ ID NO: 99688 - DNA, 22 bp, Artificial Sequence
  Synthetic oligonucleotide; TTT chr11 5318387 5318408 5318404 5318409 +
ttgtccttgtgatagtttgctg

SEQ ID NO: 99689 - DNA, 22 bp, Artificial Sequence
  Synthetic oligonucleotide; TTT chr11 5318388 5318409 5318405 5318410 +
tgtccttgtgatagtttgctga

SEQ ID NO: 99690 - DNA, 22 bp, Artificial Sequence
  Synthetic oligonucleotide; TTT chr11 5318389 5318410 5318406 5318411 +
gtccttgtgatagtttgctgag

SEQ ID NO: 99691 - DNA, 22 bp, Artificial Sequence
  Synthetic oligonucleotide; TTG chr11 5318390 5318411 5318407 5318412 +
tccttgtgatagtttgctgaga

SEQ ID NO: 99692 - DNA, 22 bp, Artificial Sequence
  Synthetic oligonucleotide; CTT chr11 5318395 5318416 5318412 5318417 +
gtgatagtttgctgagaatgat

SEQ ID NO: 99693 - DNA, 22 bp, Artificial Sequence
  Synthetic oligonucleotide; TTG chr11 5318396 5318417 5318413 5318418 +
tgatagtttgctgagaatgatg

SEQ ID NO: 99694 - DNA, 22 bp, Artificial Sequence
  Synthetic oligonucleotide; TTT chr11 5318405 5318426 5318422 5318427 +
gctgagaatgatggtttccagc

SEQ ID NO: 99695 - DNA, 22 bp, Artificial Sequence
  Synthetic oligonucleotide; TTG chr11 5318406 5318427 5318423 5318428 +
ctgagaatgatggtttccagct

SEQ ID NO: 99696 - DNA, 22 bp, Artificial Sequence
  Synthetic oligonucleotide; CTG chr11 5318409 5318430 5318426 5318431 +
agaatgatggtttccagcttca

SEQ ID NO: 99697 - DNA, 22 bp, Artificial Sequence
  Synthetic oligonucleotide; TTT chr11 5318422 5318443 5318439 5318444 +
ccagcttcatccatgtccctac

SEQ ID NO: 99698 - DNA, 22 bp, Artificial Sequence
  Synthetic oligonucleotide; TTC chr11 5318423 5318444 5318440 5318445 +
cagcttcatccatgtccctaca

SEQ ID NO: 99699 - DNA, 22 bp, Artificial Sequence
  Synthetic oligonucleotide; CTT chr11 5318429 5318450 5318446 5318451 +
catccatgtccctacaaaggac

SEQ ID NO: 99700 - DNA, 22 bp, Artificial Sequence
  Synthetic oligonucleotide; TTC chr11 5318430 5318451 5318447 5318452 +
atccatgtccctacaaaggaca

SEQ ID NO: 99701 - DNA, 22 bp, Artificial Sequence
  Synthetic oligonucleotide; CTA chr11 5318443 5318464 5318460 5318465 +
caaaggacatgaactcatcatt

SEQ ID NO: 99702 - DNA, 22 bp, Artificial Sequence
  Synthetic oligonucleotide; CTC chr11 5318459 5318480 5318476 5318481 +
atcattttttatggctgcatag

SEQ ID NO: 99703 - DNA, 22 bp, Artificial Sequence
  Synthetic oligonucleotide; TTT chr11 5318466 5318487 5318483 5318488 +
tttatggctgcatagtattcca

SEQ ID NO: 99704 - DNA, 22 bp, Artificial Sequence
  Synthetic oligonucleotide; TTT chr11 5318467 5318488 5318484 5318489 +
ttatggctgcatagtattccat

SEQ ID NO: 99705 - DNA, 22 bp, Artificial Sequence
  Synthetic oligonucleotide; TTT chr11 5318468 5318489 5318485 5318490 +
tatggctgcatagtattccatg

SEQ ID NO: 99706 - DNA, 22 bp, Artificial Sequence
  Synthetic oligonucleotide; TTT chr11 5318469 5318490 5318486 5318491 +
atggctgcatagtattccatgg

SEQ ID NO: 99707 - DNA, 22 bp, Artificial Sequence
  Synthetic oligonucleotide; TTA chr11 5318470 5318491 5318487 5318492 +
tggctgcatagtattccatggt

SEQ ID NO: 99708 - DNA, 22 bp, Artificial Sequence
  Synthetic oligonucleotide; CTG chr11 5318476 5318497 5318493 5318498 +
catagtattccatggtgtatat

SEQ ID NO: 99709 - DNA, 22 bp, Artificial Sequence
  Synthetic oligonucleotide; TTC chr11 5318486 5318507 5318503 5318508 +
catggtgtatatgtgccacatt

SEQ ID NO: 99710 - DNA, 22 bp, Artificial Sequence
  Synthetic oligonucleotide; TTT chr11 5318509 5318530 5318526 5318531 +
tcttaatccattctatcattgt

SEQ ID NO: 99711 - DNA, 22 bp, Artificial Sequence
  Synthetic oligonucleotide; TTT chr11 5318510 5318531 5318527 5318532 +
cttaatccattctatcattgtt

SEQ ID NO: 99712 - DNA, 22 bp, Artificial Sequence
  Synthetic oligonucleotide; TTC chr11 5318511 5318532 5318528 5318533 +
ttaatccattctatcattgttg

SEQ ID NO: 99713 - DNA, 22 bp, Artificial Sequence
  Synthetic oligonucleotide; CTT chr11 5318513 5318534 5318530 5318535 +
aatccattctatcattgttgga

SEQ ID NO: 99714 - DNA, 22 bp, Artificial Sequence
  Synthetic oligonucleotide; TTA chr11 5318514 5318535 5318531 5318536 +
atccattctatcattgttggac

SEQ ID NO: 99715 - DNA, 22 bp, Artificial Sequence
  Synthetic oligonucleotide; TTC chr11 5318522 5318543 5318539 5318544 +
tatcattgttggacatttgggt

SEQ ID NO: 99716 - DNA, 22 bp, Artificial Sequence
  Synthetic oligonucleotide; CTA chr11 5318524 5318545 5318541 5318546 +
tcattgttggacatttgggttg

SEQ ID NO: 99717 - DNA, 22 bp, Artificial Sequence
  Synthetic oligonucleotide; TTG chr11 5318530 5318551 5318547 5318552 +
ttggacatttgggttggttcca

SEQ ID NO: 99718 - DNA, 22 bp, Artificial Sequence
  Synthetic oligonucleotide; TTG chr11 5318533 5318554 5318550 5318555 +
gacatttgggttggttccaagt

SEQ ID NO: 99719 - DNA, 22 bp, Artificial Sequence
  Synthetic oligonucleotide; TTT chr11 5318540 5318561 5318557 5318562 +
gggttggttccaagtctttgtt

SEQ ID NO: 99720 - DNA, 22 bp, Artificial Sequence
  Synthetic oligonucleotide; TTG chr11 5318541 5318562 5318558 5318563 +
ggttggttccaagtctttgtta

SEQ ID NO: 99721 - DNA, 22 bp, Artificial Sequence
  Synthetic oligonucleotide; TTG chr11 5318546 5318567 5318563 5318568 +
gttccaagtctttgttattgtg

SEQ ID NO: 99722 - DNA, 22 bp, Artificial Sequence
  Synthetic oligonucleotide; TTC chr11 5318550 5318571 5318567 5318572 +
caagtctttgttattgtgaata

SEQ ID NO: 99723 - DNA, 22 bp, Artificial Sequence
  Synthetic oligonucleotide; CTT chr11 5318558 5318579 5318575 5318580 +
tgttattgtgaatagtgaagct

SEQ ID NO: 99724 - DNA, 22 bp, Artificial Sequence
  Synthetic oligonucleotide; TTT chr11 5318559 5318580 5318576 5318581 +
gttattgtgaatagtgaagctc

SEQ ID NO: 99725 - DNA, 22 bp, Artificial Sequence
  Synthetic oligonucleotide; TTG chr11 5318560 5318581 5318577 5318582 +
ttattgtgaatagtgaagctct

SEQ ID NO: 99726 - DNA, 22 bp, Artificial Sequence
  Synthetic oligonucleotide; TTA chr11 5318563 5318584 5318580 5318585 +
ttgtgaatagtgaagctcttta

SEQ ID NO: 99727 - DNA, 22 bp, Artificial Sequence
  Synthetic oligonucleotide; TTG chr11 5318566 5318587 5318583 5318588 +
tgaatagtgaagctctttagtt

SEQ ID NO: 99728 - DNA, 22 bp, Artificial Sequence
  Synthetic oligonucleotide; CTC chr11 5318581 5318602 5318598 5318603 +
tttagtttaattaggttccact

SEQ ID NO: 99729 - DNA, 22 bp, Artificial Sequence
  Synthetic oligonucleotide; CTT chr11 5318583 5318604 5318600 5318605 +
tagtttaattaggttccacttg

SEQ ID NO: 99730 - DNA, 22 bp, Artificial Sequence
  Synthetic oligonucleotide; TTT chr11 5318584 5318605 5318601 5318606 +
agtttaattaggttccacttgt

SEQ ID NO: 99731 - DNA, 22 bp, Artificial Sequence
  Synthetic oligonucleotide; TTA chr11 5318585 5318606 5318602 5318607 +
gtttaattaggttccacttgtg

SEQ ID NO: 99732 - DNA, 22 bp, Artificial Sequence
  Synthetic oligonucleotide; TTT chr11 5318589 5318610 5318606 5318611 +
aattaggttccacttgtgaatt

SEQ ID NO: 99733 - DNA, 22 bp, Artificial Sequence
  Synthetic oligonucleotide; TTA chr11 5318590 5318611 5318607 5318612 +
attaggttccacttgtgaattt

SEQ ID NO: 99734 - DNA, 22 bp, Artificial Sequence
  Synthetic oligonucleotide; TTA chr11 5318594 5318615 5318611 5318616 +
ggttccacttgtgaatttttct

SEQ ID NO: 99735 - DNA, 22 bp, Artificial Sequence
  Synthetic oligonucleotide; TTC chr11 5318599 5318620 5318616 5318621 +
cacttgtgaatttttctttgca

SEQ ID NO: 99736 - DNA, 22 bp, Artificial Sequence
  Synthetic oligonucleotide; CTT chr11 5318604 5318625 5318621 5318626 +
gtgaatttttctttgcattgca

SEQ ID NO: 99737 - DNA, 22 bp, Artificial Sequence
  Synthetic oligonucleotide; TTG chr11 5318605 5318626 5318622 5318627 +
tgaatttttctttgcattgcaa

SEQ ID NO: 99738 - DNA, 22 bp, Artificial Sequence
  Synthetic oligonucleotide; TTT chr11 5318612 5318633 5318629 5318634 +
ttctttgcattgcaattgcttt

SEQ ID NO: 99739 - DNA, 22 bp, Artificial Sequence
  Synthetic oligonucleotide; TTT chr11 5318613 5318634 5318630 5318635 +
tctttgcattgcaattgctttt

SEQ ID NO: 99740 - DNA, 22 bp, Artificial Sequence
  Synthetic oligonucleotide; TTT chr11 5318614 5318635 5318631 5318636 +
ctttgcattgcaattgcttttg

SEQ ID NO: 99741 - DNA, 22 bp, Artificial Sequence
  Synthetic oligonucleotide; TTC chr11 5318615 5318636 5318632 5318637 +
tttgcattgcaattgcttttgg

SEQ ID NO: 99742 - DNA, 22 bp, Artificial Sequence
  Synthetic oligonucleotide; CTT chr11 5318617 5318638 5318634 5318639 +
tgcattgcaattgcttttgggg

SEQ ID NO: 99743 - DNA, 22 bp, Artificial Sequence
  Synthetic oligonucleotide; TTT chr11 5318618 5318639 5318635 5318640 +
gcattgcaattgcttttggggg

SEQ ID NO: 99744 - DNA, 22 bp, Artificial Sequence
  Synthetic oligonucleotide; TTG chr11 5318619 5318640 5318636 5318641 +
cattgcaattgcttttgggggc

SEQ ID NO: 99745 - DNA, 22 bp, Artificial Sequence
  Synthetic oligonucleotide; TTG chr11 5318624 5318645 5318641 5318646 +
caattgcttttgggggcttagc

SEQ ID NO: 99746 - DNA, 22 bp, Artificial Sequence
  Synthetic oligonucleotide; TTG chr11 5318630 5318651 5318647 5318652 +
cttttgggggcttagccaaaaa

SEQ ID NO: 99747 - DNA, 22 bp, Artificial Sequence
  Synthetic oligonucleotide; CTT chr11 5318633 5318654 5318650 5318655 +
ttgggggcttagccaaaaatgc

SEQ ID NO: 99748 - DNA, 22 bp, Artificial Sequence
  Synthetic oligonucleotide; TTT chr11 5318634 5318655 5318651 5318656 +
tgggggcttagccaaaaatgca

SEQ ID NO: 99749 - DNA, 22 bp, Artificial Sequence
  Synthetic oligonucleotide; TTT chr11 5318635 5318656 5318652 5318657 +
gggggcttagccaaaaatgcac

SEQ ID NO: 99750 - DNA, 22 bp, Artificial Sequence
  Synthetic oligonucleotide; TTG chr11 5318636 5318657 5318653 5318658 +
ggggcttagccaaaaatgcact

SEQ ID NO: 99751 - DNA, 22 bp, Artificial Sequence
  Synthetic oligonucleotide; CTT chr11 5318643 5318664 5318660 5318665 +
agccaaaaatgcactgccagtg

SEQ ID NO: 99752 - DNA, 22 bp, Artificial Sequence
  Synthetic oligonucleotide; TTA chr11 5318644 5318665 5318661 5318666 +
gccaaaaatgcactgccagtgc

SEQ ID NO: 99753 - DNA, 22 bp, Artificial Sequence
  Synthetic oligonucleotide; CTG chr11 5318659 5318680 5318676 5318681 +
ccagtgcaggtaagatttgaga

SEQ ID NO: 99754 - DNA, 22 bp, Artificial Sequence
  Synthetic oligonucleotide; TTT chr11 5318677 5318698 5318694 5318699 +
gagatcttacatttaagttttg

SEQ ID NO: 99755 - DNA, 22 bp, Artificial Sequence
  Synthetic oligonucleotide; TTG chr11 5318678 5318699 5318695 5318700 +
agatcttacatttaagttttga

SEQ ID NO: 99756 - DNA, 22 bp, Artificial Sequence
  Synthetic oligonucleotide; CTT chr11 5318685 5318706 5318702 5318707 +
acatttaagttttgaattcatt

SEQ ID NO: 99757 - DNA, 22 bp, Artificial Sequence
  Synthetic oligonucleotide; TTA chr11 5318686 5318707 5318703 5318708 +
catttaagttttgaattcattt

SEQ ID NO: 99758 - DNA, 22 bp, Artificial Sequence
  Synthetic oligonucleotide; TTT chr11 5318691 5318712 5318708 5318713 +
aagttttgaattcattttcagt

SEQ ID NO: 99759 - DNA, 22 bp, Artificial Sequence
  Synthetic oligonucleotide; TTA chr11 5318692 5318713 5318709 5318714 +
agttttgaattcattttcagtt

SEQ ID NO: 99760 - DNA, 22 bp, Artificial Sequence
  Synthetic oligonucleotide; TTT chr11 5318697 5318718 5318714 5318719 +
tgaattcattttcagttgattt

SEQ ID NO: 99761 - DNA, 22 bp, Artificial Sequence
  Synthetic oligonucleotide; TTT chr11 5318698 5318719 5318715 5318720 +
gaattcattttcagttgatttc

SEQ ID NO: 99762 - DNA, 22 bp, Artificial Sequence
  Synthetic oligonucleotide; TTG chr11 5318699 5318720 5318716 5318721 +
aattcattttcagttgatttct

SEQ ID NO: 99763 - DNA, 22 bp, Artificial Sequence
  Synthetic oligonucleotide; TTC chr11 5318704 5318725 5318721 5318726 +
attttcagttgatttctctaaa

SEQ ID NO: 99764 - DNA, 22 bp, Artificial Sequence
  Synthetic oligonucleotide; TTT chr11 5318708 5318729 5318725 5318730 +
tcagttgatttctctaaatggt

SEQ ID NO: 99765 - DNA, 22 bp, Artificial Sequence
  Synthetic oligonucleotide; TTT chr11 5318709 5318730 5318726 5318731 +
cagttgatttctctaaatggtg

SEQ ID NO: 99766 - DNA, 22 bp, Artificial Sequence
  Synthetic oligonucleotide; TTC chr11 5318710 5318731 5318727 5318732 +
agttgatttctctaaatggtgt

SEQ ID NO: 99767 - DNA, 22 bp, Artificial Sequence
  Synthetic oligonucleotide; TTG chr11 5318715 5318736 5318732 5318737 +
atttctctaaatggtgtaaggt

SEQ ID NO: 99768 - DNA, 22 bp, Artificial Sequence
  Synthetic oligonucleotide; TTT chr11 5318719 5318740 5318736 5318741 +
ctctaaatggtgtaaggtaagg

SEQ ID NO: 99769 - DNA, 22 bp, Artificial Sequence
  Synthetic oligonucleotide; TTC chr11 5318720 5318741 5318737 5318742 +
tctaaatggtgtaaggtaaggg

SEQ ID NO: 99770 - DNA, 22 bp, Artificial Sequence
  Synthetic oligonucleotide; CTC chr11 5318722 5318743 5318739 5318744 +
taaatggtgtaaggtaagggtc

SEQ ID NO: 99771 - DNA, 22 bp, Artificial Sequence
  Synthetic oligonucleotide; CTA chr11 5318724 5318745 5318741 5318746 +
aatggtgtaaggtaagggtcta

SEQ ID NO: 99772 - DNA, 22 bp, Artificial Sequence
  Synthetic oligonucleotide; CTA chr11 5318746 5318767 5318763 5318768 +
gtttcattcttctgcatatggc

SEQ ID NO: 99773 - DNA, 22 bp, Artificial Sequence
  Synthetic oligonucleotide; TTT chr11 5318750 5318771 5318767 5318772 +
cattcttctgcatatggctagc

SEQ ID NO: 99774 - DNA, 22 bp, Artificial Sequence
  Synthetic oligonucleotide; TTC chr11 5318751 5318772 5318768 5318773 +
attcttctgcatatggctagcc

SEQ ID NO: 99775 - DNA, 22 bp, Artificial Sequence
  Synthetic oligonucleotide; TTC chr11 5318755 5318776 5318772 5318777 +
ttctgcatatggctagccacgt

SEQ ID NO: 99776 - DNA, 22 bp, Artificial Sequence
  Synthetic oligonucleotide; CTT chr11 5318757 5318778 5318774 5318779 +
ctgcatatggctagccacgtat

SEQ ID NO: 99777 - DNA, 22 bp, Artificial Sequence
  Synthetic oligonucleotide; TTC chr11 5318758 5318779 5318775 5318780 +
tgcatatggctagccacgtatt

SEQ ID NO: 99778 - DNA, 22 bp, Artificial Sequence
  Synthetic oligonucleotide; CTG chr11 5318760 5318781 5318777 5318782 +
catatggctagccacgtattcc

SEQ ID NO: 99779 - DNA, 22 bp, Artificial Sequence
  Synthetic oligonucleotide; CTA chr11 5318770 5318791 5318787 5318792 +
gccacgtattccagcacagttt

SEQ ID NO: 99780 - DNA, 22 bp, Artificial Sequence
  Synthetic oligonucleotide; TTC chr11 5318781 5318802 5318798 5318803 +
cagcacagtttattggataggt

SEQ ID NO: 99781 - DNA, 22 bp, Artificial Sequence
  Synthetic oligonucleotide; TTT chr11 5318792 5318813 5318809 5318814 +
attggataggtagtccttttcc

SEQ ID NO: 99782 - DNA, 22 bp, Artificial Sequence
  Synthetic oligonucleotide; TTA chr11 5318793 5318814 5318810 5318815 +
ttggataggtagtccttttccc

SEQ ID NO: 99783 - DNA, 22 bp, Artificial Sequence
  Synthetic oligonucleotide; TTG chr11 5318796 5318817 5318813 5318818 +
gataggtagtccttttcccgct

SEQ ID NO: 99784 - DNA, 22 bp, Artificial Sequence
  Synthetic oligonucleotide; CTT chr11 5318810 5318831 5318827 5318832 +
ttcccgctgcttgtttttgtca

SEQ ID NO: 99785 - DNA, 22 bp, Artificial Sequence
  Synthetic oligonucleotide; TTT chr11 5318811 5318832 5318828 5318833 +
tcccgctgcttgtttttgtcag

SEQ ID NO: 99786 - DNA, 22 bp, Artificial Sequence
  Synthetic oligonucleotide; TTT chr11 5318812 5318833 5318829 5318834 +
cccgctgcttgtttttgtcagt

SEQ ID NO: 99787 - DNA, 22 bp, Artificial Sequence
  Synthetic oligonucleotide; TTC chr11 5318813 5318834 5318830 5318835 +
ccgctgcttgtttttgtcagtg

SEQ ID NO: 99788 - DNA, 22 bp, Artificial Sequence
  Synthetic oligonucleotide; CTG chr11 5318819 5318840 5318836 5318841 +
cttgtttttgtcagtgttgttg

SEQ ID NO: 99789 - DNA, 22 bp, Artificial Sequence
  Synthetic oligonucleotide; CTT chr11 5318822 5318843 5318839 5318844 +
gtttttgtcagtgttgttgaag

SEQ ID NO: 99790 - DNA, 22 bp, Artificial Sequence
  Synthetic oligonucleotide; TTG chr11 5318823 5318844 5318840 5318845 +
tttttgtcagtgttgttgaaga

SEQ ID NO: 99791 - DNA, 22 bp, Artificial Sequence
  Synthetic oligonucleotide; TTT chr11 5318826 5318847 5318843 5318848 +
ttgtcagtgttgttgaagatca

SEQ ID NO: 99792 - DNA, 22 bp, Artificial Sequence
  Synthetic oligonucleotide; TTT chr11 5318827 5318848 5318844 5318849 +
tgtcagtgttgttgaagatcag

SEQ ID NO: 99793 - DNA, 22 bp, Artificial Sequence
  Synthetic oligonucleotide; TTT chr11 5318828 5318849 5318845 5318850 +
gtcagtgttgttgaagatcaga

SEQ ID NO: 99794 - DNA, 22 bp, Artificial Sequence
  Synthetic oligonucleotide; TTG chr11 5318829 5318850 5318846 5318851 +
tcagtgttgttgaagatcagat

SEQ ID NO: 99795 - DNA, 22 bp, Artificial Sequence
  Synthetic oligonucleotide; TTG chr11 5318838 5318859 5318855 5318860 +
ttgaagatcagatggttgtaac

SEQ ID NO: 99796 - DNA, 22 bp, Artificial Sequence
  Synthetic oligonucleotide; TTG chr11 5318841 5318862 5318858 5318863 +
aagatcagatggttgtaactat

SEQ ID NO: 99797 - DNA, 22 bp, Artificial Sequence
  Synthetic oligonucleotide; TTG chr11 5318856 5318877 5318873 5318878 +
taactatgtagctttatttttg

SEQ ID NO: 99798 - DNA, 22 bp, Artificial Sequence
  Synthetic oligonucleotide; CTA chr11 5318862 5318883 5318879 5318884 +
tgtagctttatttttgagtttt

SEQ ID NO: 99799 - DNA, 22 bp, Artificial Sequence
  Synthetic oligonucleotide; CTT chr11 5318870 5318891 5318887 5318892 +
tatttttgagttttctattgtg

SEQ ID NO: 99800 - DNA, 22 bp, Artificial Sequence
  Synthetic oligonucleotide; TTT chr11 5318871 5318892 5318888 5318893 +
atttttgagttttctattgtgt

SEQ ID NO: 99801 - DNA, 22 bp, Artificial Sequence
  Synthetic oligonucleotide; TTA chr11 5318872 5318893 5318889 5318894 +
tttttgagttttctattgtgtt

SEQ ID NO: 99802 - DNA, 22 bp, Artificial Sequence
  Synthetic oligonucleotide; TTT chr11 5318875 5318896 5318892 5318897 +
ttgagttttctattgtgtttcc

SEQ ID NO: 99803 - DNA, 22 bp, Artificial Sequence
  Synthetic oligonucleotide; TTT chr11 5318876 5318897 5318893 5318898 +
tgagttttctattgtgtttcct

SEQ ID NO: 99804 - DNA, 22 bp, Artificial Sequence
  Synthetic oligonucleotide; TTT chr11 5318877 5318898 5318894 5318899 +
gagttttctattgtgtttcctt

SEQ ID NO: 99805 - DNA, 22 bp, Artificial Sequence
  Synthetic oligonucleotide; TTG chr11 5318878 5318899 5318895 5318900 +
agttttctattgtgtttcctta

SEQ ID NO: 99806 - DNA, 22 bp, Artificial Sequence
  Synthetic oligonucleotide; TTT chr11 5318883 5318904 5318900 5318905 +
tctattgtgtttccttagtcaa

SEQ ID NO: 99807 - DNA, 22 bp, Artificial Sequence
  Synthetic oligonucleotide; TTT chr11 5318884 5318905 5318901 5318906 +
ctattgtgtttccttagtcaat

SEQ ID NO: 99808 - DNA, 22 bp, Artificial Sequence
  Synthetic oligonucleotide; TTC chr11 5318885 5318906 5318902 5318907 +
tattgtgtttccttagtcaatg

SEQ ID NO: 99809 - DNA, 22 bp, Artificial Sequence
  Synthetic oligonucleotide; CTA chr11 5318887 5318908 5318904 5318909 +
ttgtgtttccttagtcaatgtg

SEQ ID NO: 99810 - DNA, 22 bp, Artificial Sequence
  Synthetic oligonucleotide; TTG chr11 5318890 5318911 5318907 5318912 +
tgtttccttagtcaatgtgtct

SEQ ID NO: 99811 - DNA, 22 bp, Artificial Sequence
  Synthetic oligonucleotide; TTT chr11 5318895 5318916 5318912 5318917 +
ccttagtcaatgtgtctatttt

SEQ ID NO: 99812 - DNA, 22 bp, Artificial Sequence
  Synthetic oligonucleotide; TTC chr11 5318896 5318917 5318913 5318918 +
cttagtcaatgtgtctattttt

SEQ ID NO: 99813 - DNA, 22 bp, Artificial Sequence
  Synthetic oligonucleotide; CTT chr11 5318899 5318920 5318916 5318921 +
agtcaatgtgtctatttttgta

SEQ ID NO: 99814 - DNA, 22 bp, Artificial Sequence
  Synthetic oligonucleotide; TTA chr11 5318900 5318921 5318917 5318922 +
gtcaatgtgtctatttttgtaa

SEQ ID NO: 99815 - DNA, 22 bp, Artificial Sequence
  Synthetic oligonucleotide; CTA chr11 5318913 5318934 5318930 5318935 +
tttttgtaacaatatcatgctg

SEQ ID NO: 99816 - DNA, 22 bp, Artificial Sequence
  Synthetic oligonucleotide; TTT chr11 5318916 5318937 5318933 5318938 +
ttgtaacaatatcatgctgttt

SEQ ID NO: 99817 - DNA, 22 bp, Artificial Sequence
  Synthetic oligonucleotide; TTT chr11 5318917 5318938 5318934 5318939 +
tgtaacaatatcatgctgtttg

SEQ ID NO: 99818 - DNA, 22 bp, Artificial Sequence
  Synthetic oligonucleotide; TTT chr11 5318918 5318939 5318935 5318940 +
gtaacaatatcatgctgtttgg

SEQ ID NO: 99819 - DNA, 22 bp, Artificial Sequence
  Synthetic oligonucleotide; TTG chr11 5318919 5318940 5318936 5318941 +
taacaatatcatgctgtttggg

SEQ ID NO: 99820 - DNA, 22 bp, Artificial Sequence
  Synthetic oligonucleotide; CTG chr11 5318935 5318956 5318952 5318957 +
tttggggtactgtggccttata

SEQ ID NO: 99821 - DNA, 22 bp, Artificial Sequence
  Synthetic oligonucleotide; TTT chr11 5318938 5318959 5318955 5318960 +
ggggtactgtggccttataatg

SEQ ID NO: 99822 - DNA, 22 bp, Artificial Sequence
  Synthetic oligonucleotide; TTG chr11 5318939 5318960 5318956 5318961 +
gggtactgtggccttataatgt

SEQ ID NO: 99823 - DNA, 22 bp, Artificial Sequence
  Synthetic oligonucleotide; CTG chr11 5318947 5318968 5318964 5318969 +
tggccttataatgtagtttctt

SEQ ID NO: 99824 - DNA, 22 bp, Artificial Sequence
  Synthetic oligonucleotide; CTT chr11 5318954 5318975 5318971 5318976 +
ataatgtagtttctttcctttc

SEQ ID NO: 99825 - DNA, 22 bp, Artificial Sequence
  Synthetic oligonucleotide; TTA chr11 5318955 5318976 5318972 5318977 +
taatgtagtttctttcctttct

SEQ ID NO: 99826 - DNA, 22 bp, Artificial Sequence
  Synthetic oligonucleotide; TTT chr11 5318966 5318987 5318983 5318988 +
ctttcctttcttccctctcttt

SEQ ID NO: 99827 - DNA, 22 bp, Artificial Sequence
  Synthetic oligonucleotide; TTC chr11 5318967 5318988 5318984 5318989 +
tttcctttcttccctctctttc

SEQ ID NO: 99828 - DNA, 22 bp, Artificial Sequence
  Synthetic oligonucleotide; CTT chr11 5318969 5318990 5318986 5318991 +
tcctttcttccctctctttctt

SEQ ID NO: 99829 - DNA, 22 bp, Artificial Sequence
  Synthetic oligonucleotide; TTT chr11 5318970 5318991 5318987 5318992 +
cctttcttccctctctttcttt

SEQ ID NO: 99830 - DNA, 22 bp, Artificial Sequence
  Synthetic oligonucleotide; TTC chr11 5318971 5318992 5318988 5318993 +
ctttcttccctctctttctttc

SEQ ID NO: 99831 - DNA, 22 bp, Artificial Sequence
  Synthetic oligonucleotide; CTT chr11 5318974 5318995 5318991 5318996 +
tcttccctctctttctttcttt

SEQ ID NO: 99832 - DNA, 22 bp, Artificial Sequence
  Synthetic oligonucleotide; TTT chr11 5318975 5318996 5318992 5318997 +
cttccctctctttctttctttt

SEQ ID NO: 99833 - DNA, 22 bp, Artificial Sequence
  Synthetic oligonucleotide; TTC chr11 5318976 5318997 5318993 5318998 +
ttccctctctttctttcttttc

SEQ ID NO: 99834 - DNA, 22 bp, Artificial Sequence
  Synthetic oligonucleotide; CTT chr11 5318978 5318999 5318995 5319000 +
ccctctctttctttcttttctt

SEQ ID NO: 99835 - DNA, 22 bp, Artificial Sequence
  Synthetic oligonucleotide; TTC chr11 5318979 5319000 5318996 5319001 +
cctctctttctttcttttcttt

SEQ ID NO: 99836 - DNA, 22 bp, Artificial Sequence
  Synthetic oligonucleotide; CTC chr11 5318983 5319004 5319000 5319005 +
tctttctttcttttctttcttt

SEQ ID NO: 99837 - DNA, 22 bp, Artificial Sequence
  Synthetic oligonucleotide; CTC chr11 5318985 5319006 5319002 5319007 +
tttctttcttttctttcttttt

SEQ ID NO: 99838 - DNA, 22 bp, Artificial Sequence
  Synthetic oligonucleotide; CTT chr11 5318987 5319008 5319004 5319009 +
tctttcttttctttcttttttt

SEQ ID NO: 99839 - DNA, 22 bp, Artificial Sequence
  Synthetic oligonucleotide; TTT chr11 5318988 5319009 5319005 5319010 +
ctttcttttctttcttttttta

SEQ ID NO: 99840 - DNA, 22 bp, Artificial Sequence
  Synthetic oligonucleotide; TTC chr11 5318989 5319010 5319006 5319011 +
tttcttttctttctttttttat

SEQ ID NO: 99841 - DNA, 22 bp, Artificial Sequence
  Synthetic oligonucleotide; CTT chr11 5318991 5319012 5319008 5319013 +
tcttttctttctttttttattt

SEQ ID NO: 99842 - DNA, 22 bp, Artificial Sequence
  Synthetic oligonucleotide; TTT chr11 5318992 5319013 5319009 5319014 +
cttttctttctttttttatttt

SEQ ID NO: 99843 - DNA, 22 bp, Artificial Sequence
  Synthetic oligonucleotide; TTC chr11 5318993 5319014 5319010 5319015 +
ttttctttctttttttattttt

SEQ ID NO: 99844 - DNA, 22 bp, Artificial Sequence
  Synthetic oligonucleotide; CTT chr11 5318995 5319016 5319012 5319017 +
ttctttctttttttattttttc

SEQ ID NO: 99845 - DNA, 22 bp, Artificial Sequence
  Synthetic oligonucleotide; TTT chr11 5318996 5319017 5319013 5319018 +
tctttctttttttattttttca

SEQ ID NO: 99846 - DNA, 22 bp, Artificial Sequence
  Synthetic oligonucleotide; TTT chr11 5318997 5319018 5319014 5319019 +
ctttctttttttattttttcag

SEQ ID NO: 99847 - DNA, 22 bp, Artificial Sequence
  Synthetic oligonucleotide; TTC chr11 5318998 5319019 5319015 5319020 +
tttctttttttattttttcaga

SEQ ID NO: 99848 - DNA, 22 bp, Artificial Sequence
  Synthetic oligonucleotide; CTT chr11 5319000 5319021 5319017 5319022 +
tctttttttattttttcagagt

SEQ ID NO: 99849 - DNA, 22 bp, Artificial Sequence
  Synthetic oligonucleotide; TTT chr11 5319001 5319022 5319018 5319023 +
ctttttttattttttcagagtt

SEQ ID NO: 99850 - DNA, 22 bp, Artificial Sequence
  Synthetic oligonucleotide; TTC chr11 5319002 5319023 5319019 5319024 +
tttttttattttttcagagttt

SEQ ID NO: 99851 - DNA, 22 bp, Artificial Sequence
  Synthetic oligonucleotide; CTT chr11 5319004 5319025 5319021 5319026 +
tttttattttttcagagtttca

SEQ ID NO: 99852 - DNA, 22 bp, Artificial Sequence
  Synthetic oligonucleotide; TTT chr11 5319005 5319026 5319022 5319027 +
ttttattttttcagagtttcac

SEQ ID NO: 99853 - DNA, 22 bp, Artificial Sequence
  Synthetic oligonucleotide; TTT chr11 5319006 5319027 5319023 5319028 +
tttattttttcagagtttcact

SEQ ID NO: 99854 - DNA, 22 bp, Artificial Sequence
  Synthetic oligonucleotide; TTT chr11 5319007 5319028 5319024 5319029 +
ttattttttcagagtttcactc

SEQ ID NO: 99855 - DNA, 22 bp, Artificial Sequence
  Synthetic oligonucleotide; TTT chr11 5319008 5319029 5319025 5319030 +
tattttttcagagtttcactct

SEQ ID NO: 99856 - DNA, 22 bp, Artificial Sequence
  Synthetic oligonucleotide; TTT chr11 5319009 5319030 5319026 5319031 +
attttttcagagtttcactctg

SEQ ID NO: 99857 - DNA, 22 bp, Artificial Sequence
  Synthetic oligonucleotide; TTA chr11 5319010 5319031 5319027 5319032 +
ttttttcagagtttcactctgt

SEQ ID NO: 99858 - DNA, 22 bp, Artificial Sequence
  Synthetic oligonucleotide; TTT chr11 5319013 5319034 5319030 5319035 +
tttcagagtttcactctgtcac

SEQ ID NO: 99859 - DNA, 22 bp, Artificial Sequence
  Synthetic oligonucleotide; TTT chr11 5319014 5319035 5319031 5319036 +
ttcagagtttcactctgtcacc

SEQ ID NO: 99860 - DNA, 22 bp, Artificial Sequence
  Synthetic oligonucleotide; TTT chr11 5319015 5319036 5319032 5319037 +
tcagagtttcactctgtcaccc

SEQ ID NO: 99861 - DNA, 22 bp, Artificial Sequence
  Synthetic oligonucleotide; TTT chr11 5319016 5319037 5319033 5319038 +
cagagtttcactctgtcaccca

SEQ ID NO: 99862 - DNA, 22 bp, Artificial Sequence
  Synthetic oligonucleotide; TTC chr11 5319017 5319038 5319034 5319039 +
agagtttcactctgtcacccag

SEQ ID NO: 99863 - DNA, 22 bp, Artificial Sequence
  Synthetic oligonucleotide; TTT chr11 5319024 5319045 5319041 5319046 +
cactctgtcacccaggctggag

SEQ ID NO: 99864 - DNA, 22 bp, Artificial Sequence
  Synthetic oligonucleotide; TTC chr11 5319025 5319046 5319042 5319047 +
actctgtcacccaggctggagt

SEQ ID NO: 99865 - DNA, 22 bp, Artificial Sequence
  Synthetic oligonucleotide; CTC chr11 5319029 5319050 5319046 5319051 +
tgtcacccaggctggagtgcag

SEQ ID NO: 99866 - DNA, 22 bp, Artificial Sequence
  Synthetic oligonucleotide; CTG chr11 5319031 5319052 5319048 5319053 +
tcacccaggctggagtgcagtg

SEQ ID NO: 99867 - DNA, 22 bp, Artificial Sequence
  Synthetic oligonucleotide; CTG chr11 5319043 5319064 5319060 5319065 +
gagtgcagtggtgcgatcttgg

SEQ ID NO: 99868 - DNA, 22 bp, Artificial Sequence
  Synthetic oligonucleotide; CTT chr11 5319063 5319084 5319080 5319085 +
ggctcactgcaccgtctgcctc

SEQ ID NO: 99869 - DNA, 22 bp, Artificial Sequence
  Synthetic oligonucleotide; TTG chr11 5319064 5319085 5319081 5319086 +
gctcactgcaccgtctgcctcc

SEQ ID NO: 99870 - DNA, 22 bp, Artificial Sequence
  Synthetic oligonucleotide; CTC chr11 5319068 5319089 5319085 5319090 +
actgcaccgtctgcctccagag

SEQ ID NO: 99871 - DNA, 22 bp, Artificial Sequence
  Synthetic oligonucleotide; CTG chr11 5319072 5319093 5319089 5319094 +
caccgtctgcctccagagttca

SEQ ID NO: 99872 - DNA, 22 bp, Artificial Sequence
  Synthetic oligonucleotide; CTG chr11 5319081 5319102 5319098 5319103 +
cctccagagttcaagcaattct

SEQ ID NO: 99873 - DNA, 22 bp, Artificial Sequence
  Synthetic oligonucleotide; CTC chr11 5319085 5319106 5319102 5319107 +
cagagttcaagcaattctcctg

SEQ ID NO: 99874 - DNA, 22 bp, Artificial Sequence
  Synthetic oligonucleotide; TTC chr11 5319093 5319114 5319110 5319115 +
aagcaattctcctgcctcagcc

SEQ ID NO: 99875 - DNA, 22 bp, Artificial Sequence
  Synthetic oligonucleotide; TTC chr11 5319102 5319123 5319119 5319124 +
tcctgcctcagccttccgagta

SEQ ID NO: 99876 - DNA, 22 bp, Artificial Sequence
  Synthetic oligonucleotide; CTC chr11 5319104 5319125 5319121 5319126 +
ctgcctcagccttccgagtagc

SEQ ID NO: 99877 - DNA, 22 bp, Artificial Sequence
  Synthetic oligonucleotide; CTG chr11 5319107 5319128 5319124 5319129 +
cctcagccttccgagtagctgg

SEQ ID NO: 99878 - DNA, 22 bp, Artificial Sequence
  Synthetic oligonucleotide; CTC chr11 5319111 5319132 5319128 5319133 +
agccttccgagtagctgggatt

SEQ ID NO: 99879 - DNA, 22 bp, Artificial Sequence
  Synthetic oligonucleotide; CTT chr11 5319117 5319138 5319134 5319139 +
ccgagtagctgggattacagcc

SEQ ID NO: 99880 - DNA, 22 bp, Artificial Sequence
  Synthetic oligonucleotide; TTC chr11 5319118 5319139 5319135 5319140 +
cgagtagctgggattacagccc

SEQ ID NO: 99881 - DNA, 22 bp, Artificial Sequence
  Synthetic oligonucleotide; CTG chr11 5319128 5319149 5319145 5319150 +
ggattacagcccccaccaccac

SEQ ID NO: 99882 - DNA, 22 bp, Artificial Sequence
  Synthetic oligonucleotide; TTA chr11 5319134 5319155 5319151 5319156 +
cagcccccaccaccacagccgg

SEQ ID NO: 99883 - DNA, 22 bp, Artificial Sequence
  Synthetic oligonucleotide; CTA chr11 5319159 5319180 5319176 5319181 +
attttgtatttttagtagagac

SEQ ID NO: 99884 - DNA, 22 bp, Artificial Sequence
  Synthetic oligonucleotide; TTT chr11 5319163 5319184 5319180 5319185 +
tgtatttttagtagagacagtg

SEQ ID NO: 99885 - DNA, 22 bp, Artificial Sequence
  Synthetic oligonucleotide; TTT chr11 5319164 5319185 5319181 5319186 +
gtatttttagtagagacagtgt

SEQ ID NO: 99886 - DNA, 22 bp, Artificial Sequence
  Synthetic oligonucleotide; TTG chr11 5319165 5319186 5319182 5319187 +
tatttttagtagagacagtgtt

SEQ ID NO: 99887 - DNA, 22 bp, Artificial Sequence
  Synthetic oligonucleotide; TTT chr11 5319170 5319191 5319187 5319192 +
ttagtagagacagtgtttcacc

SEQ ID NO: 99888 - DNA, 22 bp, Artificial Sequence
  Synthetic oligonucleotide; TTT chr11 5319171 5319192 5319188 5319193 +
tagtagagacagtgtttcacca

SEQ ID NO: 99889 - DNA, 22 bp, Artificial Sequence
  Synthetic oligonucleotide; TTT chr11 5319172 5319193 5319189 5319194 +
agtagagacagtgtttcaccat

SEQ ID NO: 99890 - DNA, 22 bp, Artificial Sequence
  Synthetic oligonucleotide; TTA chr11 5319173 5319194 5319190 5319195 +
gtagagacagtgtttcaccatg

SEQ ID NO: 99891 - DNA, 22 bp, Artificial Sequence
  Synthetic oligonucleotide; TTT chr11 5319188 5319209 5319205 5319210 +
caccatgttgaccaggctggtc

SEQ ID NO: 99892 - DNA, 22 bp, Artificial Sequence
  Synthetic oligonucleotide; TTC chr11 5319189 5319210 5319206 5319211 +
accatgttgaccaggctggtct

SEQ ID NO: 99893 - DNA, 22 bp, Artificial Sequence
  Synthetic oligonucleotide; TTG chr11 5319198 5319219 5319215 5319220 +
accaggctggtcttgaactcct

SEQ ID NO: 99894 - DNA, 22 bp, Artificial Sequence
  Synthetic oligonucleotide; CTG chr11 5319207 5319228 5319224 5319229 +
gtcttgaactcctgacctcagg

SEQ ID NO: 99895 - DNA, 22 bp, Artificial Sequence
  Synthetic oligonucleotide; CTT chr11 5319212 5319233 5319229 5319234 +
gaactcctgacctcaggtgata

SEQ ID NO: 99896 - DNA, 22 bp, Artificial Sequence
  Synthetic oligonucleotide; TTG chr11 5319213 5319234 5319230 5319235 +
aactcctgacctcaggtgatac

SEQ ID NO: 99897 - DNA, 22 bp, Artificial Sequence
  Synthetic oligonucleotide; CTC chr11 5319218 5319239 5319235 5319240 +
ctgacctcaggtgatacaccca

SEQ ID NO: 99898 - DNA, 22 bp, Artificial Sequence
  Synthetic oligonucleotide; CTG chr11 5319221 5319242 5319238 5319243 +
acctcaggtgatacacccacct

SEQ ID NO: 99899 - DNA, 22 bp, Artificial Sequence
  Synthetic oligonucleotide; CTC chr11 5319226 5319247 5319243 5319248 +
aggtgatacacccacctcagcc

SEQ ID NO: 99900 - DNA, 22 bp, Artificial Sequence
  Synthetic oligonucleotide; CTC chr11 5319244 5319265 5319261 5319266 +
agccccctaaagtgctagagtt

SEQ ID NO: 99901 - DNA, 22 bp, Artificial Sequence
  Synthetic oligonucleotide; CTA chr11 5319253 5319274 5319270 5319275 +
aagtgctagagttacaggcgtg

SEQ ID NO: 99902 - DNA, 22 bp, Artificial Sequence
  Synthetic oligonucleotide; CTA chr11 5319261 5319282 5319278 5319283 +
gagttacaggcgtgagccaccg

SEQ ID NO: 99903 - DNA, 22 bp, Artificial Sequence
  Synthetic oligonucleotide; TTA chr11 5319267 5319288 5319284 5319289 +
caggcgtgagccaccgtgcctg

SEQ ID NO: 99904 - DNA, 22 bp, Artificial Sequence
  Synthetic oligonucleotide; CTG chr11 5319289 5319310 5319306 5319311 +
gcctgtagtttcaagtcaggtg

SEQ ID NO: 99905 - DNA, 22 bp, Artificial Sequence
  Synthetic oligonucleotide; CTG chr11 5319294 5319315 5319311 5319316 +
tagtttcaagtcaggtggtgtg

SEQ ID NO: 99906 - DNA, 22 bp, Artificial Sequence
  Synthetic oligonucleotide; TTT chr11 5319300 5319321 5319317 5319322 +
caagtcaggtggtgtggtgctt

SEQ ID NO: 99907 - DNA, 22 bp, Artificial Sequence
  Synthetic oligonucleotide; TTC chr11 5319301 5319322 5319318 5319323 +
aagtcaggtggtgtggtgcttc

SEQ ID NO: 99908 - DNA, 22 bp, Artificial Sequence
  Synthetic oligonucleotide; CTT chr11 5319322 5319343 5319339 5319344 +
ccaattttgttctttctgctta

SEQ ID NO: 99909 - DNA, 22 bp, Artificial Sequence
  Synthetic oligonucleotide; TTC chr11 5319323 5319344 5319340 5319345 +
caattttgttctttctgcttaa

SEQ ID NO: 99910 - DNA, 22 bp, Artificial Sequence
  Synthetic oligonucleotide; TTT chr11 5319329 5319350 5319346 5319351 +
tgttctttctgcttaagattgc

SEQ ID NO: 99911 - DNA, 22 bp, Artificial Sequence
  Synthetic oligonucleotide; TTT chr11 5319330 5319351 5319347 5319352 +
gttctttctgcttaagattgct

SEQ ID NO: 99912 - DNA, 22 bp, Artificial Sequence
  Synthetic oligonucleotide; TTG chr11 5319331 5319352 5319348 5319353 +
ttctttctgcttaagattgctt

SEQ ID NO: 99913 - DNA, 22 bp, Artificial Sequence
  Synthetic oligonucleotide; TTC chr11 5319334 5319355 5319351 5319356 +
tttctgcttaagattgctttgc

SEQ ID NO: 99914 - DNA, 22 bp, Artificial Sequence
  Synthetic oligonucleotide; CTT chr11 5319336 5319357 5319353 5319358 +
tctgcttaagattgctttgcct

SEQ ID NO: 99915 - DNA, 22 bp, Artificial Sequence
  Synthetic oligonucleotide; TTT chr11 5319337 5319358 5319354 5319359 +
ctgcttaagattgctttgcctg

SEQ ID NO: 99916 - DNA, 22 bp, Artificial Sequence
  Synthetic oligonucleotide; TTC chr11 5319338 5319359 5319355 5319360 +
tgcttaagattgctttgcctgt

SEQ ID NO: 99917 - DNA, 22 bp, Artificial Sequence
  Synthetic oligonucleotide; CTG chr11 5319340 5319361 5319357 5319362 +
cttaagattgctttgcctgttc

SEQ ID NO: 99918 - DNA, 22 bp, Artificial Sequence
  Synthetic oligonucleotide; CTT chr11 5319343 5319364 5319360 5319365 +
aagattgctttgcctgttcagg

SEQ ID NO: 99919 - DNA, 22 bp, Artificial Sequence
  Synthetic oligonucleotide; TTA chr11 5319344 5319365 5319361 5319366 +
agattgctttgcctgttcaggc

SEQ ID NO: 99920 - DNA, 22 bp, Artificial Sequence
  Synthetic oligonucleotide; TTG chr11 5319350 5319371 5319367 5319372 +
ctttgcctgttcaggctctttt

SEQ ID NO: 99921 - DNA, 22 bp, Artificial Sequence
  Synthetic oligonucleotide; CTT chr11 5319353 5319374 5319370 5319375 +
tgcctgttcaggctctttttgg

SEQ ID NO: 99922 - DNA, 22 bp, Artificial Sequence
  Synthetic oligonucleotide; TTT chr11 5319354 5319375 5319371 5319376 +
gcctgttcaggctctttttggt

SEQ ID NO: 99923 - DNA, 22 bp, Artificial Sequence
  Synthetic oligonucleotide; TTG chr11 5319355 5319376 5319372 5319377 +
cctgttcaggctctttttggtt

SEQ ID NO: 99924 - DNA, 22 bp, Artificial Sequence
  Synthetic oligonucleotide; CTG chr11 5319359 5319380 5319376 5319381 +
ttcaggctctttttggttccat

SEQ ID NO: 99925 - DNA, 22 bp, Artificial Sequence
  Synthetic oligonucleotide; TTC chr11 5319362 5319383 5319379 5319384 +
aggctctttttggttccatatg

SEQ ID NO: 99926 - DNA, 22 bp, Artificial Sequence
  Synthetic oligonucleotide; CTC chr11 5319368 5319389 5319385 5319390 +
tttttggttccatatgaatttt

SEQ ID NO: 99927 - DNA, 22 bp, Artificial Sequence
  Synthetic oligonucleotide; CTT chr11 5319370 5319391 5319387 5319392 +
tttggttccatatgaattttaa

SEQ ID NO: 99928 - DNA, 22 bp, Artificial Sequence
  Synthetic oligonucleotide; TTT chr11 5319371 5319392 5319388 5319393 +
ttggttccatatgaattttaaa

SEQ ID NO: 99929 - DNA, 22 bp, Artificial Sequence
  Synthetic oligonucleotide; TTT chr11 5319372 5319393 5319389 5319394 +
tggttccatatgaattttaaac

SEQ ID NO: 99930 - DNA, 22 bp, Artificial Sequence
  Synthetic oligonucleotide; TTT chr11 5319373 5319394 5319390 5319395 +
ggttccatatgaattttaaact

SEQ ID NO: 99931 - DNA, 22 bp, Artificial Sequence
  Synthetic oligonucleotide; TTG chr11 5319374 5319395 5319391 5319396 +
gttccatatgaattttaaacta

SEQ ID NO: 99932 - DNA, 22 bp, Artificial Sequence
  Synthetic oligonucleotide; TTC chr11 5319378 5319399 5319395 5319400 +
catatgaattttaaactagttt

SEQ ID NO: 99933 - DNA, 22 bp, Artificial Sequence
  Synthetic oligonucleotide; TTT chr11 5319389 5319410 5319406 5319411 +
taaactagtttttctaatactg

SEQ ID NO: 99934 - DNA, 22 bp, Artificial Sequence
  Synthetic oligonucleotide; TTT chr11 5319390 5319411 5319407 5319412 +
aaactagtttttctaatactgt

SEQ ID NO: 99935 - DNA, 22 bp, Artificial Sequence
  Synthetic oligonucleotide; TTA chr11 5319391 5319412 5319408 5319413 +
aactagtttttctaatactgtg

SEQ ID NO: 99936 - DNA, 22 bp, Artificial Sequence
  Synthetic oligonucleotide; CTA chr11 5319396 5319417 5319413 5319418 +
gtttttctaatactgtgaagaa

SEQ ID NO: 99937 - DNA, 22 bp, Artificial Sequence
  Synthetic oligonucleotide; TTT chr11 5319400 5319421 5319417 5319422 +
ttctaatactgtgaagaatgac

SEQ ID NO: 99938 - DNA, 22 bp, Artificial Sequence
  Synthetic oligonucleotide; TTT chr11 5319401 5319422 5319418 5319423 +
tctaatactgtgaagaatgaca

SEQ ID NO: 99939 - DNA, 22 bp, Artificial Sequence
  Synthetic oligonucleotide; TTT chr11 5319402 5319423 5319419 5319424 +
ctaatactgtgaagaatgacat

SEQ ID NO: 99940 - DNA, 22 bp, Artificial Sequence
  Synthetic oligonucleotide; TTC chr11 5319403 5319424 5319420 5319425 +
taatactgtgaagaatgacatt

SEQ ID NO: 99941 - DNA, 22 bp, Artificial Sequence
  Synthetic oligonucleotide; CTA chr11 5319405 5319426 5319422 5319427 +
atactgtgaagaatgacattgg

SEQ ID NO: 99942 - DNA, 22 bp, Artificial Sequence
  Synthetic oligonucleotide; CTG chr11 5319411 5319432 5319428 5319433 +
tgaagaatgacattggtaattg

SEQ ID NO: 99943 - DNA, 22 bp, Artificial Sequence
  Synthetic oligonucleotide; TTG chr11 5319426 5319447 5319443 5319448 +
gtaattggatagaaattgcaat

SEQ ID NO: 99944 - DNA, 22 bp, Artificial Sequence
  Synthetic oligonucleotide; TTG chr11 5319433 5319454 5319450 5319455 +
gatagaaattgcaatgaatgtc

SEQ ID NO: 99945 - DNA, 22 bp, Artificial Sequence
  Synthetic oligonucleotide; TTG chr11 5319444 5319465 5319461 5319466 +
caatgaatgtctaaattgcttt

SEQ ID NO: 99946 - DNA, 22 bp, Artificial Sequence
  Synthetic oligonucleotide; CTA chr11 5319457 5319478 5319474 5319479 +
aattgctttgagcagtatggcc

SEQ ID NO: 99947 - DNA, 22 bp, Artificial Sequence
  Synthetic oligonucleotide; TTG chr11 5319462 5319483 5319479 5319484 +
ctttgagcagtatggccattta

SEQ ID NO: 99948 - DNA, 22 bp, Artificial Sequence
  Synthetic oligonucleotide; CTT chr11 5319465 5319486 5319482 5319487 +
tgagcagtatggccatttaaat

SEQ ID NO: 99949 - DNA, 22 bp, Artificial Sequence
  Synthetic oligonucleotide; TTT chr11 5319466 5319487 5319483 5319488 +
gagcagtatggccatttaaatt

SEQ ID NO: 99950 - DNA, 22 bp, Artificial Sequence
  Synthetic oligonucleotide; TTG chr11 5319467 5319488 5319484 5319489 +
agcagtatggccatttaaattc

SEQ ID NO: 99951 - DNA, 22 bp, Artificial Sequence
  Synthetic oligonucleotide; TTT chr11 5319483 5319504 5319500 5319505 +
aaattcatattgattcttccaa

SEQ ID NO: 99952 - DNA, 22 bp, Artificial Sequence
  Synthetic oligonucleotide; TTA chr11 5319484 5319505 5319501 5319506 +
aattcatattgattcttccaat

SEQ ID NO: 99953 - DNA, 22 bp, Artificial Sequence
  Synthetic oligonucleotide; TTC chr11 5319489 5319510 5319506 5319511 +
atattgattcttccaatccatg

SEQ ID NO: 99954 - DNA, 22 bp, Artificial Sequence
  Synthetic oligonucleotide; TTG chr11 5319495 5319516 5319512 5319517 +
attcttccaatccatgagcctg

SEQ ID NO: 99955 - DNA, 22 bp, Artificial Sequence
  Synthetic oligonucleotide; TTC chr11 5319499 5319520 5319516 5319521 +
ttccaatccatgagcctggaaa

SEQ ID NO: 99956 - DNA, 22 bp, Artificial Sequence
  Synthetic oligonucleotide; CTT chr11 5319501 5319522 5319518 5319523 +
ccaatccatgagcctggaaagc

SEQ ID NO: 99957 - DNA, 22 bp, Artificial Sequence
  Synthetic oligonucleotide; TTC chr11 5319502 5319523 5319519 5319524 +
caatccatgagcctggaaagct

SEQ ID NO: 99958 - DNA, 22 bp, Artificial Sequence
  Synthetic oligonucleotide; CTG chr11 5319517 5319538 5319534 5319539 +
gaaagcttttatttatttattt

SEQ ID NO: 99959 - DNA, 22 bp, Artificial Sequence
  Synthetic oligonucleotide; CTT chr11 5319525 5319546 5319542 5319547 +
ttatttatttatttgtgttgtt

SEQ ID NO: 99960 - DNA, 22 bp, Artificial Sequence
  Synthetic oligonucleotide; TTT chr11 5319526 5319547 5319543 5319548 +
tatttatttatttgtgttgttt

SEQ ID NO: 99961 - DNA, 22 bp, Artificial Sequence
  Synthetic oligonucleotide; TTT chr11 5319527 5319548 5319544 5319549 +
atttatttatttgtgttgtttc

SEQ ID NO: 99962 - DNA, 22 bp, Artificial Sequence
  Synthetic oligonucleotide; TTA chr11 5319528 5319549 5319545 5319550 +
tttatttatttgtgttgtttct

SEQ ID NO: 99963 - DNA, 22 bp, Artificial Sequence
  Synthetic oligonucleotide; TTT chr11 5319531 5319552 5319548 5319553 +
atttatttgtgttgtttctgat

SEQ ID NO: 99964 - DNA, 22 bp, Artificial Sequence
  Synthetic oligonucleotide; TTA chr11 5319532 5319553 5319549 5319554 +
tttatttgtgttgtttctgatt

SEQ ID NO: 99965 - DNA, 22 bp, Artificial Sequence
  Synthetic oligonucleotide; TTT chr11 5319535 5319556 5319552 5319557 +
atttgtgttgtttctgatttct

SEQ ID NO: 99966 - DNA, 22 bp, Artificial Sequence
  Synthetic oligonucleotide; TTA chr11 5319536 5319557 5319553 5319558 +
tttgtgttgtttctgatttctt

SEQ ID NO: 99967 - DNA, 22 bp, Artificial Sequence
  Synthetic oligonucleotide; TTT chr11 5319539 5319560 5319556 5319561 +
gtgttgtttctgatttctttca

SEQ ID NO: 99968 - DNA, 22 bp, Artificial Sequence
  Synthetic oligonucleotide; TTG chr11 5319540 5319561 5319557 5319562 +
tgttgtttctgatttctttcag

SEQ ID NO: 99969 - DNA, 22 bp, Artificial Sequence
  Synthetic oligonucleotide; TTG chr11 5319545 5319566 5319562 5319567 +
tttctgatttctttcagcagtg

SEQ ID NO: 99970 - DNA, 22 bp, Artificial Sequence
  Synthetic oligonucleotide; TTT chr11 5319548 5319569 5319565 5319570 +
ctgatttctttcagcagtgttt

SEQ ID NO: 99971 - DNA, 22 bp, Artificial Sequence
  Synthetic oligonucleotide; TTC chr11 5319549 5319570 5319566 5319571 +
tgatttctttcagcagtgtttt

SEQ ID NO: 99972 - DNA, 22 bp, Artificial Sequence
  Synthetic oligonucleotide; CTG chr11 5319551 5319572 5319568 5319573 +
atttctttcagcagtgttttgt

SEQ ID NO: 99973 - DNA, 22 bp, Artificial Sequence
  Synthetic oligonucleotide; TTT chr11 5319555 5319576 5319572 5319577 +
ctttcagcagtgttttgtagtt

SEQ ID NO: 99974 - DNA, 22 bp, Artificial Sequence
  Synthetic oligonucleotide; TTC chr11 5319556 5319577 5319573 5319578 +
tttcagcagtgttttgtagttc

SEQ ID NO: 99975 - DNA, 22 bp, Artificial Sequence
  Synthetic oligonucleotide; CTT chr11 5319558 5319579 5319575 5319580 +
tcagcagtgttttgtagttctc

SEQ ID NO: 99976 - DNA, 22 bp, Artificial Sequence
  Synthetic oligonucleotide; TTT chr11 5319559 5319580 5319576 5319581 +
cagcagtgttttgtagttctcc

SEQ ID NO: 99977 - DNA, 22 bp, Artificial Sequence
  Synthetic oligonucleotide; TTC chr11 5319560 5319581 5319577 5319582 +
agcagtgttttgtagttctcct

SEQ ID NO: 99978 - DNA, 22 bp, Artificial Sequence
  Synthetic oligonucleotide; TTT chr11 5319570 5319591 5319587 5319592 +
tgtagttctccttgtagagatc

SEQ ID NO: 99979 - DNA, 22 bp, Artificial Sequence
  Synthetic oligonucleotide; TTT chr11 5319571 5319592 5319588 5319593 +
gtagttctccttgtagagatct

SEQ ID NO: 99980 - DNA, 22 bp, Artificial Sequence
  Synthetic oligonucleotide; TTG chr11 5319572 5319593 5319589 5319594 +
tagttctccttgtagagatctt

SEQ ID NO: 99981 - DNA, 22 bp, Artificial Sequence
  Synthetic oligonucleotide; TTC chr11 5319578 5319599 5319595 5319600 +
tccttgtagagatctttcacct

SEQ ID NO: 99982 - DNA, 22 bp, Artificial Sequence
  Synthetic oligonucleotide; CTC chr11 5319580 5319601 5319597 5319602 +
cttgtagagatctttcacctcc

SEQ ID NO: 99983 - DNA, 22 bp, Artificial Sequence
  Synthetic oligonucleotide; CTT chr11 5319583 5319604 5319600 5319605 +
gtagagatctttcacctcccac

SEQ ID NO: 99984 - DNA, 22 bp, Artificial Sequence
  Synthetic oligonucleotide; TTG chr11 5319584 5319605 5319601 5319606 +
tagagatctttcacctcccaca

SEQ ID NO: 99985 - DNA, 22 bp, Artificial Sequence
  Synthetic oligonucleotide; CTT chr11 5319594 5319615 5319611 5319616 +
tcacctcccacaaaccatatga

SEQ ID NO: 99986 - DNA, 22 bp, Artificial Sequence
  Synthetic oligonucleotide; TTT chr11 5319595 5319616 5319612 5319617 +
cacctcccacaaaccatatgat

SEQ ID NO: 99987 - DNA, 22 bp, Artificial Sequence
  Synthetic oligonucleotide; TTC chr11 5319596 5319617 5319613 5319618 +
acctcccacaaaccatatgatc

SEQ ID NO: 99988 - DNA, 22 bp, Artificial Sequence
  Synthetic oligonucleotide; CTC chr11 5319601 5319622 5319618 5319623 +
ccacaaaccatatgatcatctc

SEQ ID NO: 99989 - DNA, 22 bp, Artificial Sequence
  Synthetic oligonucleotide; CTC chr11 5319623 5319644 5319640 5319645 +
aatagactgagaaaaacctttc

SEQ ID NO: 99990 - DNA, 22 bp, Artificial Sequence
  Synthetic oligonucleotide; CTG chr11 5319632 5319653 5319649 5319654 +
agaaaaacctttcaataaaatt

SEQ ID NO: 99991 - DNA, 22 bp, Artificial Sequence
  Synthetic oligonucleotide; CTT chr11 5319643 5319664 5319660 5319665 +
tcaataaaattcaacatccctt

SEQ ID NO: 99992 - DNA, 22 bp, Artificial Sequence
  Synthetic oligonucleotide; TTT chr11 5319644 5319665 5319661 5319666 +
caataaaattcaacatcccttc

SEQ ID NO: 99993 - DNA, 22 bp, Artificial Sequence
  Synthetic oligonucleotide; TTC chr11 5319645 5319666 5319662 5319667 +
aataaaattcaacatcccttca

SEQ ID NO: 99994 - DNA, 22 bp, Artificial Sequence
  Synthetic oligonucleotide; TTC chr11 5319655 5319676 5319672 5319677 +
aacatcccttcatgataaaaac

SEQ ID NO: 99995 - DNA, 22 bp, Artificial Sequence
  Synthetic oligonucleotide; CTT chr11 5319665 5319686 5319682 5319687 +
catgataaaaacctccaacaga

SEQ ID NO: 99996 - DNA, 22 bp, Artificial Sequence
  Synthetic oligonucleotide; TTC chr11 5319666 5319687 5319683 5319688 +
atgataaaaacctccaacagac

SEQ ID NO: 99997 - DNA, 22 bp, Artificial Sequence
  Synthetic oligonucleotide; CTC chr11 5319680 5319701 5319697 5319702 +
caacagactaggcatcaaagga

SEQ ID NO: 99998 - DNA, 22 bp, Artificial Sequence
  Synthetic oligonucleotide; CTA chr11 5319690 5319711 5319707 5319712 +
ggcatcaaaggaacatacctca

SEQ ID NO: 99999 - DNA, 22 bp, Artificial Sequence
  Synthetic oligonucleotide; CTC chr11 5319711 5319732 5319728 5319733 +
aaaagaataaaagccacgtatg

SEQ ID NO: 100000 - DNA, 22 bp, Artificial Sequence
  Synthetic oligonucleotide; CTG chr11 5319759 5319780 5319776 5319781 +
aatgggcaaaagctggaactat

SEQ ID NO: 100001 - DNA, 22 bp, Artificial Sequence
  Synthetic oligonucleotide; CTG chr11 5319774 5319795 5319791 5319796 +
gaactattctcctcgaaaactg

SEQ ID NO: 100002 - DNA, 22 bp, Artificial Sequence
  Synthetic oligonucleotide; CTA chr11 5319780 5319801 5319797 5319802 +
ttctcctcgaaaactgcaacaa

SEQ ID NO: 100003 - DNA, 22 bp, Artificial Sequence
  Synthetic oligonucleotide; TTC chr11 5319783 5319804 5319800 5319805 +
tcctcgaaaactgcaacaagac

SEQ ID NO: 100004 - DNA, 22 bp, Artificial Sequence
  Synthetic oligonucleotide; CTC chr11 5319785 5319806 5319802 5319807 +
ctcgaaaactgcaacaagacaa

SEQ ID NO: 100005 - DNA, 22 bp, Artificial Sequence
  Synthetic oligonucleotide; CTC chr11 5319788 5319809 5319805 5319810 +
gaaaactgcaacaagacaagga

SEQ ID NO: 100006 - DNA, 22 bp, Artificial Sequence
  Synthetic oligonucleotide; CTG chr11 5319796 5319817 5319813 5319818 +
caacaagacaaggattcccatt

SEQ ID NO: 100007 - DNA, 22 bp, Artificial Sequence
  Synthetic oligonucleotide; TTC chr11 5319813 5319834 5319830 5319835 +
ccattctcaccactcctagtga

SEQ ID NO: 100008 - DNA, 22 bp, Artificial Sequence
  Synthetic oligonucleotide; TTC chr11 5319819 5319840 5319836 5319841 +
tcaccactcctagtgaacataa

SEQ ID NO: 100009 - DNA, 22 bp, Artificial Sequence
  Synthetic oligonucleotide; CTC chr11 5319821 5319842 5319838 5319843 +
accactcctagtgaacataaaa

SEQ ID NO: 100010 - DNA, 22 bp, Artificial Sequence
  Synthetic oligonucleotide; CTC chr11 5319828 5319849 5319845 5319850 +
ctagtgaacataaaattggaag

SEQ ID NO: 100011 - DNA, 22 bp, Artificial Sequence
  Synthetic oligonucleotide; CTA chr11 5319831 5319852 5319848 5319853 +
gtgaacataaaattggaagtcc

SEQ ID NO: 100012 - DNA, 22 bp, Artificial Sequence
  Synthetic oligonucleotide; TTG chr11 5319846 5319867 5319863 5319868 +
gaagtcctaaccagggcaatca

SEQ ID NO: 100013 - DNA, 22 bp, Artificial Sequence
  Synthetic oligonucleotide; CTA chr11 5319855 5319876 5319872 5319877 +
accagggcaatcaggcgagaga

SEQ ID NO: 100014 - DNA, 22 bp, Artificial Sequence
  Synthetic oligonucleotide; CTA chr11 5319918 5319939 5319935 5319940 +
tctctctttgctgatgatatga

SEQ ID NO: 100015 - DNA, 22 bp, Artificial Sequence
  Synthetic oligonucleotide; CTC chr11 5319922 5319943 5319939 5319944 +
tctttgctgatgatatgactct

SEQ ID NO: 100016 - DNA, 22 bp, Artificial Sequence
  Synthetic oligonucleotide; CTC chr11 5319924 5319945 5319941 5319946 +
tttgctgatgatatgactctat

SEQ ID NO: 100017 - DNA, 22 bp, Artificial Sequence
  Synthetic oligonucleotide; CTT chr11 5319926 5319947 5319943 5319948 +
tgctgatgatatgactctatac

SEQ ID NO: 100018 - DNA, 22 bp, Artificial Sequence
  Synthetic oligonucleotide; TTT chr11 5319927 5319948 5319944 5319949 +
gctgatgatatgactctatact

SEQ ID NO: 100019 - DNA, 22 bp, Artificial Sequence
  Synthetic oligonucleotide; TTG chr11 5319928 5319949 5319945 5319950 +
ctgatgatatgactctatactt

SEQ ID NO: 100020 - DNA, 22 bp, Artificial Sequence
  Synthetic oligonucleotide; CTG chr11 5319931 5319952 5319948 5319953 +
atgatatgactctatacttaga

SEQ ID NO: 100021 - DNA, 22 bp, Artificial Sequence
  Synthetic oligonucleotide; CTC chr11 5319943 5319964 5319960 5319965 +
tatacttagaaaatcctacaga

SEQ ID NO: 100022 - DNA, 22 bp, Artificial Sequence
  Synthetic oligonucleotide; CTA chr11 5319945 5319966 5319962 5319967 +
tacttagaaaatcctacagatt

SEQ ID NO: 100023 - DNA, 22 bp, Artificial Sequence
  Synthetic oligonucleotide; CTT chr11 5319950 5319971 5319967 5319972 +
agaaaatcctacagattcttcc

SEQ ID NO: 100024 - DNA, 22 bp, Artificial Sequence
  Synthetic oligonucleotide; TTA chr11 5319951 5319972 5319968 5319973 +
gaaaatcctacagattcttcca

SEQ ID NO: 100025 - DNA, 22 bp, Artificial Sequence
  Synthetic oligonucleotide; CTA chr11 5319961 5319982 5319978 5319983 +
cagattcttccaaaaggctgct

SEQ ID NO: 100026 - DNA, 22 bp, Artificial Sequence
  Synthetic oligonucleotide; TTC chr11 5319968 5319989 5319985 5319990 +
ttccaaaaggctgctagaactg

SEQ ID NO: 100027 - DNA, 22 bp, Artificial Sequence
  Synthetic oligonucleotide; CTT chr11 5319970 5319991 5319987 5319992 +
ccaaaaggctgctagaactgat

SEQ ID NO: 100028 - DNA, 22 bp, Artificial Sequence
  Synthetic oligonucleotide; TTC chr11 5319971 5319992 5319988 5319993 +
caaaaggctgctagaactgata

SEQ ID NO: 100029 - DNA, 22 bp, Artificial Sequence
  Synthetic oligonucleotide; CTG chr11 5319981 5320002 5319998 5320003 +
ctagaactgataaacaatttta

SEQ ID NO: 100030 - DNA, 22 bp, Artificial Sequence
  Synthetic oligonucleotide; CTA chr11 5319984 5320005 5320001 5320006 +
gaactgataaacaattttagca

SEQ ID NO: 100031 - DNA, 22 bp, Artificial Sequence
  Synthetic oligonucleotide; CTG chr11 5319990 5320011 5320007 5320012 +
ataaacaattttagcaaggttt

SEQ ID NO: 100032 - DNA, 22 bp, Artificial Sequence
  Synthetic oligonucleotide; TTT chr11 5320001 5320022 5320018 5320023 +
tagcaaggtttcaggatacaaa

SEQ ID NO: 100033 - DNA, 22 bp, Artificial Sequence
  Synthetic oligonucleotide; TTT chr11 5320002 5320023 5320019 5320024 +
agcaaggtttcaggatacaaaa

SEQ ID NO: 100034 - DNA, 22 bp, Artificial Sequence
  Synthetic oligonucleotide; TTA chr11 5320003 5320024 5320020 5320025 +
gcaaggtttcaggatacaaaat

SEQ ID NO: 100035 - DNA, 22 bp, Artificial Sequence
  Synthetic oligonucleotide; TTT chr11 5320012 5320033 5320029 5320034 +
caggatacaaaatcacatacaa

SEQ ID NO: 100036 - DNA, 22 bp, Artificial Sequence
  Synthetic oligonucleotide; TTC chr11 5320013 5320034 5320030 5320035 +
aggatacaaaatcacatacaaa

SEQ ID NO: 100037 - DNA, 22 bp, Artificial Sequence
  Synthetic oligonucleotide; TTT chr11 5320049 5320070 5320066 5320071 +
ccatacaccaataaggcccagg

SEQ ID NO: 100038 - DNA, 22 bp, Artificial Sequence
  Synthetic oligonucleotide; TTC chr11 5320050 5320071 5320067 5320072 +
catacaccaataaggcccaggc

SEQ ID NO: 100039 - DNA, 22 bp, Artificial Sequence
  Synthetic oligonucleotide; CTG chr11 5320074 5320095 5320091 5320096 +
agagtcaaatcgagaacacaat

SEQ ID NO: 100040 - DNA, 22 bp, Artificial Sequence
  Synthetic oligonucleotide; TTA chr11 5320103 5320124 5320120 5320125 +
agaacagccacaaagaaaatga

SEQ ID NO: 100041 - DNA, 22 bp, Artificial Sequence
  Synthetic oligonucleotide; CTA chr11 5320133 5320154 5320150 5320155 +
ggacttgttctttttattgaaa

SEQ ID NO: 100042 - DNA, 22 bp, Artificial Sequence
  Synthetic oligonucleotide; CTT chr11 5320139 5320160 5320156 5320161 +
gttctttttattgaaatttaaa

SEQ ID NO: 100043 - DNA, 22 bp, Artificial Sequence
  Synthetic oligonucleotide; TTG chr11 5320140 5320161 5320157 5320162 +
ttctttttattgaaatttaaaa

SEQ ID NO: 100044 - DNA, 22 bp, Artificial Sequence
  Synthetic oligonucleotide; TTC chr11 5320143 5320164 5320160 5320165 +
tttttattgaaatttaaaaccc

SEQ ID NO: 100045 - DNA, 22 bp, Artificial Sequence
  Synthetic oligonucleotide; CTT chr11 5320145 5320166 5320162 5320167 +
tttattgaaatttaaaacccaa

SEQ ID NO: 100046 - DNA, 22 bp, Artificial Sequence
  Synthetic oligonucleotide; TTT chr11 5320146 5320167 5320163 5320168 +
ttattgaaatttaaaacccaag

SEQ ID NO: 100047 - DNA, 22 bp, Artificial Sequence
  Synthetic oligonucleotide; TTT chr11 5320147 5320168 5320164 5320169 +
tattgaaatttaaaacccaagc

SEQ ID NO: 100048 - DNA, 22 bp, Artificial Sequence
  Synthetic oligonucleotide; TTT chr11 5320148 5320169 5320165 5320170 +
attgaaatttaaaacccaagca

SEQ ID NO: 100049 - DNA, 22 bp, Artificial Sequence
  Synthetic oligonucleotide; TTA chr11 5320149 5320170 5320166 5320171 +
ttgaaatttaaaacccaagcag

SEQ ID NO: 100050 - DNA, 22 bp, Artificial Sequence
  Synthetic oligonucleotide; TTG chr11 5320152 5320173 5320169 5320174 +
aaatttaaaacccaagcaggca

SEQ ID NO: 100051 - DNA, 22 bp, Artificial Sequence
  Synthetic oligonucleotide; TTT chr11 5320158 5320179 5320175 5320180 +
aaaacccaagcaggcactagaa

SEQ ID NO: 100052 - DNA, 22 bp, Artificial Sequence
  Synthetic oligonucleotide; TTA chr11 5320159 5320180 5320176 5320181 +
aaacccaagcaggcactagaaa

SEQ ID NO: 100053 - DNA, 22 bp, Artificial Sequence
  Synthetic oligonucleotide; CTA chr11 5320177 5320198 5320194 5320199 +
gaaagaaaatatttaccatgaa

SEQ ID NO: 100054 - DNA, 22 bp, Artificial Sequence
  Synthetic oligonucleotide; TTT chr11 5320191 5320212 5320208 5320213 +
accatgaattcatacaacacta

SEQ ID NO: 100055 - DNA, 22 bp, Artificial Sequence
  Synthetic oligonucleotide; TTA chr11 5320192 5320213 5320209 5320214 +
ccatgaattcatacaacactat

SEQ ID NO: 100056 - DNA, 22 bp, Artificial Sequence
  Synthetic oligonucleotide; TTC chr11 5320202 5320223 5320219 5320224 +
atacaacactatcattactacg

SEQ ID NO: 100057 - DNA, 22 bp, Artificial Sequence
  Synthetic oligonucleotide; CTA chr11 5320213 5320234 5320230 5320235 +
tcattactacgtgaatattagt

SEQ ID NO: 100058 - DNA, 22 bp, Artificial Sequence
  Synthetic oligonucleotide; TTA chr11 5320219 5320240 5320236 5320241 +
ctacgtgaatattagtgtgcta

SEQ ID NO: 100059 - DNA, 22 bp, Artificial Sequence
  Synthetic oligonucleotide; CTA chr11 5320222 5320243 5320239 5320244 +
cgtgaatattagtgtgctatga

SEQ ID NO: 100060 - DNA, 22 bp, Artificial Sequence
  Synthetic oligonucleotide; TTA chr11 5320233 5320254 5320250 5320255 +
gtgtgctatgagagacacatca

SEQ ID NO: 100061 - DNA, 22 bp, Artificial Sequence
  Synthetic oligonucleotide; CTA chr11 5320241 5320262 5320258 5320263 +
tgagagacacatcaaataaatt

SEQ ID NO: 100062 - DNA, 22 bp, Artificial Sequence
  Synthetic oligonucleotide; TTT chr11 5320264 5320285 5320281 5320286 +
ctgggatcagggaacattttcc

SEQ ID NO: 100063 - DNA, 22 bp, Artificial Sequence
  Synthetic oligonucleotide; TTC chr11 5320265 5320286 5320282 5320287 +
tgggatcagggaacattttcca

SEQ ID NO: 100064 - DNA, 22 bp, Artificial Sequence
  Synthetic oligonucleotide; CTG chr11 5320267 5320288 5320284 5320289 +
ggatcagggaacattttccaga

SEQ ID NO: 100065 - DNA, 22 bp, Artificial Sequence
  Synthetic oligonucleotide; TTT chr11 5320283 5320304 5320300 5320305 +
tccagaagaaatgctacttaag

SEQ ID NO: 100066 - DNA, 22 bp, Artificial Sequence
  Synthetic oligonucleotide; TTT chr11 5320284 5320305 5320301 5320306 +
ccagaagaaatgctacttaagc

SEQ ID NO: 100067 - DNA, 22 bp, Artificial Sequence
  Synthetic oligonucleotide; TTC chr11 5320285 5320306 5320302 5320307 +
cagaagaaatgctacttaagct

SEQ ID NO: 100068 - DNA, 22 bp, Artificial Sequence
  Synthetic oligonucleotide; CTA chr11 5320299 5320320 5320316 5320321 +
cttaagctgagaattaaatgct

SEQ ID NO: 100069 - DNA, 22 bp, Artificial Sequence
  Synthetic oligonucleotide; CTT chr11 5320302 5320323 5320319 5320324 +
aagctgagaattaaatgctact

SEQ ID NO: 100070 - DNA, 22 bp, Artificial Sequence
  Synthetic oligonucleotide; TTA chr11 5320303 5320324 5320320 5320325 +
agctgagaattaaatgctacta

SEQ ID NO: 100071 - DNA, 22 bp, Artificial Sequence
  Synthetic oligonucleotide; CTG chr11 5320308 5320329 5320325 5320330 +
agaattaaatgctactatatta

SEQ ID NO: 100072 - DNA, 22 bp, Artificial Sequence
  Synthetic oligonucleotide; TTA chr11 5320315 5320336 5320332 5320337 +
aatgctactatattagtagtgt

SEQ ID NO: 100073 - DNA, 22 bp, Artificial Sequence
  Synthetic oligonucleotide; CTA chr11 5320322 5320343 5320339 5320344 +
ctatattagtagtgtagtagta

SEQ ID NO: 100074 - DNA, 22 bp, Artificial Sequence
  Synthetic oligonucleotide; CTA chr11 5320325 5320346 5320342 5320347 +
tattagtagtgtagtagtattt

SEQ ID NO: 100075 - DNA, 22 bp, Artificial Sequence
  Synthetic oligonucleotide; TTA chr11 5320330 5320351 5320347 5320352 +
gtagtgtagtagtatttggtgg

SEQ ID NO: 100076 - DNA, 22 bp, Artificial Sequence
  Synthetic oligonucleotide; TTT chr11 5320347 5320368 5320364 5320369 +
ggtggggtagtgcaatcattgc

SEQ ID NO: 100077 - DNA, 22 bp, Artificial Sequence
  Synthetic oligonucleotide; TTG chr11 5320348 5320369 5320365 5320370 +
gtggggtagtgcaatcattgcg

SEQ ID NO: 100078 - DNA, 22 bp, Artificial Sequence
  Synthetic oligonucleotide; TTG chr11 5320368 5320389 5320385 5320390 +
cgtacaggtgaaaagaacaaac

SEQ ID NO: 100079 - DNA, 22 bp, Artificial Sequence
  Synthetic oligonucleotide; TTA chr11 5320416 5320437 5320433 5320438 +
aagtttgtaaaatgtacattgg

SEQ ID NO: 100080 - DNA, 22 bp, Artificial Sequence
  Synthetic oligonucleotide; TTT chr11 5320422 5320443 5320439 5320444 +
gtaaaatgtacattggtaatgg

SEQ ID NO: 100081 - DNA, 22 bp, Artificial Sequence
  Synthetic oligonucleotide; TTG chr11 5320423 5320444 5320440 5320445 +
taaaatgtacattggtaatggg

SEQ ID NO: 100082 - DNA, 22 bp, Artificial Sequence
  Synthetic oligonucleotide; TTG chr11 5320437 5320458 5320454 5320459 +
gtaatggggcaagattaaatac

SEQ ID NO: 100083 - DNA, 22 bp, Artificial Sequence
  Synthetic oligonucleotide; TTA chr11 5320454 5320475 5320471 5320476 +
aatactataaattcaaataaaa

SEQ ID NO: 100084 - DNA, 22 bp, Artificial Sequence
  Synthetic oligonucleotide; CTA chr11 5320461 5320482 5320478 5320483 +
taaattcaaataaaaataattt

SEQ ID NO: 100085 - DNA, 22 bp, Artificial Sequence
  Synthetic oligonucleotide; TTC chr11 5320468 5320489 5320485 5320490 +
aaataaaaataattttattcaa

SEQ ID NO: 100086 - DNA, 22 bp, Artificial Sequence
  Synthetic oligonucleotide; TTT chr11 5320483 5320504 5320500 5320505 +
tattcaaaatatacattaagga

SEQ ID NO: 100087 - DNA, 22 bp, Artificial Sequence
  Synthetic oligonucleotide; TTT chr11 5320484 5320505 5320501 5320506 +
attcaaaatatacattaaggaa

SEQ ID NO: 100088 - DNA, 22 bp, Artificial Sequence
  Synthetic oligonucleotide; TTA chr11 5320485 5320506 5320502 5320507 +
ttcaaaatatacattaaggaag

SEQ ID NO: 100089 - DNA, 22 bp, Artificial Sequence
  Synthetic oligonucleotide; TTC chr11 5320488 5320509 5320505 5320510 +
aaaatatacattaaggaagtat

SEQ ID NO: 100090 - DNA, 22 bp, Artificial Sequence
  Synthetic oligonucleotide; TTA chr11 5320501 5320522 5320518 5320523 +
aggaagtataatatctcttgaa

SEQ ID NO: 100091 - DNA, 22 bp, Artificial Sequence
  Synthetic oligonucleotide; CTC chr11 5320518 5320539 5320535 5320540 +
ttgaacaacaatacatgaaaaa

SEQ ID NO: 100092 - DNA, 22 bp, Artificial Sequence
  Synthetic oligonucleotide; CTT chr11 5320520 5320541 5320537 5320542 +
gaacaacaatacatgaaaaaaa

SEQ ID NO: 100093 - DNA, 22 bp, Artificial Sequence
  Synthetic oligonucleotide; TTG chr11 5320521 5320542 5320538 5320543 +
aacaacaatacatgaaaaaaag

SEQ ID NO: 100094 - DNA, 22 bp, Artificial Sequence
  Synthetic oligonucleotide; CTT chr11 5320546 5320567 5320563 5320568 +
gagagaaaatgaatctgtagta

SEQ ID NO: 100095 - DNA, 22 bp, Artificial Sequence
  Synthetic oligonucleotide; TTG chr11 5320547 5320568 5320564 5320569 +
agagaaaatgaatctgtagtag

SEQ ID NO: 100096 - DNA, 22 bp, Artificial Sequence
  Synthetic oligonucleotide; CTG chr11 5320563 5320584 5320580 5320585 +
tagtagtagcaggttctgatca

SEQ ID NO: 100097 - DNA, 22 bp, Artificial Sequence
  Synthetic oligonucleotide; TTC chr11 5320579 5320600 5320596 5320601 +
tgatcacaatatatcttgcaaa

SEQ ID NO: 100098 - DNA, 22 bp, Artificial Sequence
  Synthetic oligonucleotide; CTG chr11 5320581 5320602 5320598 5320603 +
atcacaatatatcttgcaaatc

SEQ ID NO: 100099 - DNA, 22 bp, Artificial Sequence
  Synthetic oligonucleotide; CTT chr11 5320596 5320617 5320613 5320618 +
gcaaatcatgtaaaacattttg

SEQ ID NO: 100100 - DNA, 22 bp, Artificial Sequence
  Synthetic oligonucleotide; TTG chr11 5320597 5320618 5320614 5320619 +
caaatcatgtaaaacattttga

SEQ ID NO: 100101 - DNA, 22 bp, Artificial Sequence
  Synthetic oligonucleotide; TTT chr11 5320616 5320637 5320633 5320638 +
tgacattaccataagggaatga

SEQ ID NO: 100102 - DNA, 22 bp, Artificial Sequence
  Synthetic oligonucleotide; TTT chr11 5320617 5320638 5320634 5320639 +
gacattaccataagggaatgaa

SEQ ID NO: 100103 - DNA, 22 bp, Artificial Sequence
  Synthetic oligonucleotide; TTG chr11 5320618 5320639 5320635 5320640 +
acattaccataagggaatgaat

SEQ ID NO: 100104 - DNA, 22 bp, Artificial Sequence
  Synthetic oligonucleotide; TTA chr11 5320624 5320645 5320641 5320646 +
ccataagggaatgaatataaaa

SEQ ID NO: 100105 - DNA, 22 bp, Artificial Sequence
  Synthetic oligonucleotide; CTT chr11 5320667 5320688 5320684 5320689 +
ataatcaagtagttattgttta

SEQ ID NO: 100106 - DNA, 22 bp, Artificial Sequence
  Synthetic oligonucleotide; TTA chr11 5320668 5320689 5320685 5320690 +
taatcaagtagttattgtttaa

SEQ ID NO: 100107 - DNA, 22 bp, Artificial Sequence
  Synthetic oligonucleotide; TTA chr11 5320682 5320703 5320699 5320704 +
ttgtttaaagttactatggcta

SEQ ID NO: 100108 - DNA, 22 bp, Artificial Sequence
  Synthetic oligonucleotide; TTG chr11 5320685 5320706 5320702 5320707 +
tttaaagttactatggctacag

SEQ ID NO: 100109 - DNA, 22 bp, Artificial Sequence
  Synthetic oligonucleotide; TTT chr11 5320688 5320709 5320705 5320710 +
aaagttactatggctacagtat

SEQ ID NO: 100110 - DNA, 22 bp, Artificial Sequence
  Synthetic oligonucleotide; TTA chr11 5320689 5320710 5320706 5320711 +
aagttactatggctacagtatg

SEQ ID NO: 100111 - DNA, 22 bp, Artificial Sequence
  Synthetic oligonucleotide; TTA chr11 5320695 5320716 5320712 5320717 +
ctatggctacagtatgagaaac

SEQ ID NO: 100112 - DNA, 22 bp, Artificial Sequence
  Synthetic oligonucleotide; CTA chr11 5320698 5320719 5320715 5320720 +
tggctacagtatgagaaacatg

SEQ ID NO: 100113 - DNA, 22 bp, Artificial Sequence
  Synthetic oligonucleotide; CTA chr11 5320704 5320725 5320721 5320726 +
cagtatgagaaacatgttggaa

SEQ ID NO: 100114 - DNA, 22 bp, Artificial Sequence
  Synthetic oligonucleotide; TTG chr11 5320723 5320744 5320740 5320745 +
gaaaagggggagaacaggtaaa

SEQ ID NO: 100115 - DNA, 22 bp, Artificial Sequence
  Synthetic oligonucleotide; TTG chr11 5320782 5320803 5320799 5320804 +
tgttggtgtggttttgactagt

SEQ ID NO: 100116 - DNA, 22 bp, Artificial Sequence
  Synthetic oligonucleotide; TTG chr11 5320787 5320808 5320804 5320809 +
gtgtggttttgactagttgtta

SEQ ID NO: 100117 - DNA, 22 bp, Artificial Sequence
  Synthetic oligonucleotide; TTT chr11 5320796 5320817 5320813 5320818 +
tgactagttgttatcagtagca

SEQ ID NO: 100118 - DNA, 22 bp, Artificial Sequence
  Synthetic oligonucleotide; TTT chr11 5320797 5320818 5320814 5320819 +
gactagttgttatcagtagcat

SEQ ID NO: 100119 - DNA, 22 bp, Artificial Sequence
  Synthetic oligonucleotide; TTG chr11 5320798 5320819 5320815 5320820 +
actagttgttatcagtagcatt

SEQ ID NO: 100120 - DNA, 22 bp, Artificial Sequence
  Synthetic oligonucleotide; CTA chr11 5320802 5320823 5320819 5320824 +
gttgttatcagtagcattagaa

SEQ ID NO: 100121 - DNA, 22 bp, Artificial Sequence
  Synthetic oligonucleotide; TTG chr11 5320806 5320827 5320823 5320828 +
ttatcagtagcattagaaaggc

SEQ ID NO: 100122 - DNA, 22 bp, Artificial Sequence
  Synthetic oligonucleotide; TTA chr11 5320809 5320830 5320826 5320831 +
tcagtagcattagaaaggcttg

SEQ ID NO: 100123 - DNA, 22 bp, Artificial Sequence
  Synthetic oligonucleotide; TTA chr11 5320821 5320842 5320838 5320843 +
gaaaggcttgaatagaagagag

SEQ ID NO: 100124 - DNA, 22 bp, Artificial Sequence
  Synthetic oligonucleotide; CTT chr11 5320830 5320851 5320847 5320852 +
gaatagaagagagattctatga

SEQ ID NO: 100125 - DNA, 22 bp, Artificial Sequence
  Synthetic oligonucleotide; TTG chr11 5320831 5320852 5320848 5320853 +
aatagaagagagattctatgac

SEQ ID NO: 100126 - DNA, 22 bp, Artificial Sequence
  Synthetic oligonucleotide; TTC chr11 5320847 5320868 5320864 5320869 +
tatgacttagaatagaactgag

SEQ ID NO: 100127 - DNA, 22 bp, Artificial Sequence
  Synthetic oligonucleotide; CTA chr11 5320849 5320870 5320866 5320871 +
tgacttagaatagaactgagtg

SEQ ID NO: 100128 - DNA, 22 bp, Artificial Sequence
  Synthetic oligonucleotide; CTT chr11 5320855 5320876 5320872 5320877 +
agaatagaactgagtgattgaa

SEQ ID NO: 100129 - DNA, 22 bp, Artificial Sequence
  Synthetic oligonucleotide; TTA chr11 5320856 5320877 5320873 5320878 +
gaatagaactgagtgattgaag

SEQ ID NO: 100130 - DNA, 22 bp, Artificial Sequence
  Synthetic oligonucleotide; CTG chr11 5320867 5320888 5320884 5320889 +
agtgattgaaggtagtagatta

SEQ ID NO: 100131 - DNA, 22 bp, Artificial Sequence
  Synthetic oligonucleotide; TTG chr11 5320875 5320896 5320892 5320897 +
aaggtagtagattaaagagaaa

SEQ ID NO: 100132 - DNA, 22 bp, Artificial Sequence
  Synthetic oligonucleotide; TTA chr11 5320889 5320910 5320906 5320911 +
aagagaaagaagcgtaagtaat

SEQ ID NO: 100133 - DNA, 22 bp, Artificial Sequence
  Synthetic oligonucleotide; CTG chr11 5320919 5320940 5320936 5320941 +
aatttctgagttttgctgaatg

SEQ ID NO: 100134 - DNA, 22 bp, Artificial Sequence
  Synthetic oligonucleotide; TTT chr11 5320924 5320945 5320941 5320946 +
ctgagttttgctgaatggagag

SEQ ID NO: 100135 - DNA, 22 bp, Artificial Sequence
  Synthetic oligonucleotide; TTC chr11 5320925 5320946 5320942 5320947 +
tgagttttgctgaatggagagt

SEQ ID NO: 100136 - DNA, 22 bp, Artificial Sequence
  Synthetic oligonucleotide; CTG chr11 5320927 5320948 5320944 5320949 +
agttttgctgaatggagagtag

SEQ ID NO: 100137 - DNA, 22 bp, Artificial Sequence
  Synthetic oligonucleotide; TTT chr11 5320932 5320953 5320949 5320954 +
tgctgaatggagagtagttcca

SEQ ID NO: 100138 - DNA, 22 bp, Artificial Sequence
  Synthetic oligonucleotide; TTT chr11 5320933 5320954 5320950 5320955 +
gctgaatggagagtagttccat

SEQ ID NO: 100139 - DNA, 22 bp, Artificial Sequence
  Synthetic oligonucleotide; TTG chr11 5320934 5320955 5320951 5320956 +
ctgaatggagagtagttccatt

SEQ ID NO: 100140 - DNA, 22 bp, Artificial Sequence
  Synthetic oligonucleotide; CTG chr11 5320937 5320958 5320954 5320959 +
aatggagagtagttccattgac

SEQ ID NO: 100141 - DNA, 22 bp, Artificial Sequence
  Synthetic oligonucleotide; TTC chr11 5320952 5320973 5320969 5320974 +
cattgacttccatagttatcac

SEQ ID NO: 100142 - DNA, 22 bp, Artificial Sequence
  Synthetic oligonucleotide; TTG chr11 5320957 5320978 5320974 5320979 +
acttccatagttatcacaagaa

SEQ ID NO: 100143 - DNA, 22 bp, Artificial Sequence
  Synthetic oligonucleotide; CTT chr11 5320961 5320982 5320978 5320983 +
ccatagttatcacaagaagata

SEQ ID NO: 100144 - DNA, 22 bp, Artificial Sequence
  Synthetic oligonucleotide; TTC chr11 5320962 5320983 5320979 5320984 +
catagttatcacaagaagataa

SEQ ID NO: 100145 - DNA, 22 bp, Artificial Sequence
  Synthetic oligonucleotide; TTA chr11 5320970 5320991 5320987 5320992 +
tcacaagaagataatgacttta

SEQ ID NO: 100146 - DNA, 22 bp, Artificial Sequence
  Synthetic oligonucleotide; CTT chr11 5320990 5321011 5321007 5321012 +
tattcactaatcaacagttatt

SEQ ID NO: 100147 - DNA, 22 bp, Artificial Sequence
  Synthetic oligonucleotide; TTT chr11 5320991 5321012 5321008 5321013 +
attcactaatcaacagttattt

SEQ ID NO: 100148 - DNA, 22 bp, Artificial Sequence
  Synthetic oligonucleotide; TTA chr11 5320992 5321013 5321009 5321014 +
ttcactaatcaacagttattta

SEQ ID NO: 100149 - DNA, 22 bp, Artificial Sequence
  Synthetic oligonucleotide; TTC chr11 5320995 5321016 5321012 5321017 +
actaatcaacagttatttattg

SEQ ID NO: 100150 - DNA, 22 bp, Artificial Sequence
  Synthetic oligonucleotide; CTA chr11 5320999 5321020 5321016 5321021 +
atcaacagttatttattgattg

SEQ ID NO: 100151 - DNA, 22 bp, Artificial Sequence
  Synthetic oligonucleotide; TTA chr11 5321010 5321031 5321027 5321032 +
tttattgattggtcattgtaca

SEQ ID NO: 100152 - DNA, 22 bp, Artificial Sequence
  Synthetic oligonucleotide; TTT chr11 5321013 5321034 5321030 5321035 +
attgattggtcattgtacatta

SEQ ID NO: 100153 - DNA, 22 bp, Artificial Sequence
  Synthetic oligonucleotide; TTA chr11 5321014 5321035 5321031 5321036 +
ttgattggtcattgtacattaa

SEQ ID NO: 100154 - DNA, 22 bp, Artificial Sequence
  Synthetic oligonucleotide; TTG chr11 5321017 5321038 5321034 5321039 +
attggtcattgtacattaatga

SEQ ID NO: 100155 - DNA, 22 bp, Artificial Sequence
  Synthetic oligonucleotide; TTG chr11 5321021 5321042 5321038 5321043 +
gtcattgtacattaatgagtgt

SEQ ID NO: 100156 - DNA, 22 bp, Artificial Sequence
  Synthetic oligonucleotide; TTG chr11 5321028 5321049 5321045 5321050 +
tacattaatgagtgttttacat

SEQ ID NO: 100157 - DNA, 22 bp, Artificial Sequence
  Synthetic oligonucleotide; TTA chr11 5321035 5321056 5321052 5321057 +
atgagtgttttacatgctgact

SEQ ID NO: 100158 - DNA, 22 bp, Artificial Sequence
  Synthetic oligonucleotide; TTT chr11 5321045 5321066 5321062 5321067 +
tacatgctgactttgtagaaaa

SEQ ID NO: 100159 - DNA, 22 bp, Artificial Sequence
  Synthetic oligonucleotide; TTT chr11 5321046 5321067 5321063 5321068 +
acatgctgactttgtagaaaag

SEQ ID NO: 100160 - DNA, 22 bp, Artificial Sequence
  Synthetic oligonucleotide; TTA chr11 5321047 5321068 5321064 5321069 +
catgctgactttgtagaaaaga

SEQ ID NO: 100161 - DNA, 22 bp, Artificial Sequence
  Synthetic oligonucleotide; CTG chr11 5321054 5321075 5321071 5321076 +
actttgtagaaaagatgaagag

SEQ ID NO: 100162 - DNA, 22 bp, Artificial Sequence
  Synthetic oligonucleotide; CTT chr11 5321058 5321079 5321075 5321080 +
tgtagaaaagatgaagagaatc

SEQ ID NO: 100163 - DNA, 22 bp, Artificial Sequence
  Synthetic oligonucleotide; TTT chr11 5321059 5321080 5321076 5321081 +
gtagaaaagatgaagagaatca

SEQ ID NO: 100164 - DNA, 22 bp, Artificial Sequence
  Synthetic oligonucleotide; TTG chr11 5321060 5321081 5321077 5321082 +
tagaaaagatgaagagaatcag

SEQ ID NO: 100165 - DNA, 22 bp, Artificial Sequence
  Synthetic oligonucleotide; TTT chr11 5321085 5321106 5321102 5321107 +
caatgaagtgctttgcacaaag

SEQ ID NO: 100166 - DNA, 22 bp, Artificial Sequence
  Synthetic oligonucleotide; TTC chr11 5321086 5321107 5321103 5321108 +
aatgaagtgctttgcacaaagg

SEQ ID NO: 100167 - DNA, 22 bp, Artificial Sequence
  Synthetic oligonucleotide; CTT chr11 5321098 5321119 5321115 5321120 +
tgcacaaaggataccctggaga

SEQ ID NO: 100168 - DNA, 22 bp, Artificial Sequence
  Synthetic oligonucleotide; TTT chr11 5321099 5321120 5321116 5321121 +
gcacaaaggataccctggagaa

SEQ ID NO: 100169 - DNA, 22 bp, Artificial Sequence
  Synthetic oligonucleotide; TTG chr11 5321100 5321121 5321117 5321122 +
cacaaaggataccctggagaaa

SEQ ID NO: 100170 - DNA, 22 bp, Artificial Sequence
  Synthetic oligonucleotide; CTG chr11 5321116 5321137 5321133 5321138 +
gagaaaattactcatatcattt

SEQ ID NO: 100171 - DNA, 22 bp, Artificial Sequence
  Synthetic oligonucleotide; TTA chr11 5321126 5321147 5321143 5321148 +
ctcatatcattttcttttctaa

SEQ ID NO: 100172 - DNA, 22 bp, Artificial Sequence
  Synthetic oligonucleotide; CTC chr11 5321129 5321150 5321146 5321151 +
atatcattttcttttctaacag

SEQ ID NO: 100173 - DNA, 22 bp, Artificial Sequence
  Synthetic oligonucleotide; TTT chr11 5321138 5321159 5321155 5321160 +
tcttttctaacagtttcattaa

SEQ ID NO: 100174 - DNA, 22 bp, Artificial Sequence
  Synthetic oligonucleotide; TTT chr11 5321139 5321160 5321156 5321161 +
cttttctaacagtttcattaac

SEQ ID NO: 100175 - DNA, 22 bp, Artificial Sequence
  Synthetic oligonucleotide; TTC chr11 5321140 5321161 5321157 5321162 +
ttttctaacagtttcattaaca

SEQ ID NO: 100176 - DNA, 22 bp, Artificial Sequence
  Synthetic oligonucleotide; CTT chr11 5321142 5321163 5321159 5321164 +
ttctaacagtttcattaacata

SEQ ID NO: 100177 - DNA, 22 bp, Artificial Sequence
  Synthetic oligonucleotide; TTT chr11 5321143 5321164 5321160 5321165 +
tctaacagtttcattaacatat

SEQ ID NO: 100178 - DNA, 22 bp, Artificial Sequence
  Synthetic oligonucleotide; TTT chr11 5321144 5321165 5321161 5321166 +
ctaacagtttcattaacatata

SEQ ID NO: 100179 - DNA, 22 bp, Artificial Sequence
  Synthetic oligonucleotide; TTC chr11 5321145 5321166 5321162 5321167 +
taacagtttcattaacatatag

SEQ ID NO: 100180 - DNA, 22 bp, Artificial Sequence
  Synthetic oligonucleotide; CTA chr11 5321147 5321168 5321164 5321169 +
acagtttcattaacatataggt

SEQ ID NO: 100181 - DNA, 22 bp, Artificial Sequence
  Synthetic oligonucleotide; TTT chr11 5321154 5321175 5321171 5321176 +
cattaacatataggtaaagaca

SEQ ID NO: 100182 - DNA, 22 bp, Artificial Sequence
  Synthetic oligonucleotide; TTC chr11 5321155 5321176 5321172 5321177 +
attaacatataggtaaagacag

SEQ ID NO: 100183 - DNA, 22 bp, Artificial Sequence
  Synthetic oligonucleotide; TTA chr11 5321159 5321180 5321176 5321181 +
acatataggtaaagacaggata

SEQ ID NO: 100184 - DNA, 22 bp, Artificial Sequence
  Synthetic oligonucleotide; TTG chr11 5321190 5321211 5321207 5321212 +
acatagtacagtgtcattaata

SEQ ID NO: 100185 - DNA, 22 bp, Artificial Sequence
  Synthetic oligonucleotide; TTA chr11 5321209 5321230 5321226 5321231 +
ataggttaatcaggtcatgtgg

SEQ ID NO: 100186 - DNA, 22 bp, Artificial Sequence
  Synthetic oligonucleotide; TTA chr11 5321217 5321238 5321234 5321239 +
atcaggtcatgtggtaaagtgg

SEQ ID NO: 100187 - DNA, 22 bp, Artificial Sequence
  Synthetic oligonucleotide; CTG chr11 5321247 5321268 5321264 5321269 +
aataaggatattattttgtttt

SEQ ID NO: 100188 - DNA, 22 bp, Artificial Sequence
  Synthetic oligonucleotide; TTA chr11 5321260 5321281 5321277 5321282 +
ttttgtttttagagaatttaaa

SEQ ID NO: 100189 - DNA, 22 bp, Artificial Sequence
  Synthetic oligonucleotide; TTT chr11 5321263 5321284 5321280 5321285 +
tgtttttagagaatttaaagga

SEQ ID NO: 100190 - DNA, 22 bp, Artificial Sequence
  Synthetic oligonucleotide; TTT chr11 5321264 5321285 5321281 5321286 +
gtttttagagaatttaaaggaa

SEQ ID NO: 100191 - DNA, 22 bp, Artificial Sequence
  Synthetic oligonucleotide; TTG chr11 5321265 5321286 5321282 5321287 +
tttttagagaatttaaaggaag

SEQ ID NO: 100192 - DNA, 22 bp, Artificial Sequence
  Synthetic oligonucleotide; TTT chr11 5321268 5321289 5321285 5321290 +
ttagagaatttaaaggaagctg

SEQ ID NO: 100193 - DNA, 22 bp, Artificial Sequence
  Synthetic oligonucleotide; TTT chr11 5321269 5321290 5321286 5321291 +
tagagaatttaaaggaagctgt

SEQ ID NO: 100194 - DNA, 22 bp, Artificial Sequence
  Synthetic oligonucleotide; TTT chr11 5321270 5321291 5321287 5321292 +
agagaatttaaaggaagctgtc

SEQ ID NO: 100195 - DNA, 22 bp, Artificial Sequence
  Synthetic oligonucleotide; TTA chr11 5321271 5321292 5321288 5321293 +
gagaatttaaaggaagctgtcc

SEQ ID NO: 100196 - DNA, 22 bp, Artificial Sequence
  Synthetic oligonucleotide; TTT chr11 5321279 5321300 5321296 5321301 +
aaaggaagctgtcctccttatt

SEQ ID NO: 100197 - DNA, 22 bp, Artificial Sequence
  Synthetic oligonucleotide; TTA chr11 5321280 5321301 5321297 5321302 +
aaggaagctgtcctccttatta

SEQ ID NO: 100198 - DNA, 22 bp, Artificial Sequence
  Synthetic oligonucleotide; CTG chr11 5321290 5321311 5321307 5321312 +
tcctccttattaaaaatatgac

SEQ ID NO: 100199 - DNA, 22 bp, Artificial Sequence
  Synthetic oligonucleotide; CTC chr11 5321295 5321316 5321312 5321317 +
cttattaaaaatatgacagaag

SEQ ID NO: 100200 - DNA, 22 bp, Artificial Sequence
  Synthetic oligonucleotide; CTT chr11 5321298 5321319 5321315 5321320 +
attaaaaatatgacagaagagt

SEQ ID NO: 100201 - DNA, 22 bp, Artificial Sequence
  Synthetic oligonucleotide; TTA chr11 5321299 5321320 5321316 5321321 +
ttaaaaatatgacagaagagtg

SEQ ID NO: 100202 - DNA, 22 bp, Artificial Sequence
  Synthetic oligonucleotide; TTA chr11 5321302 5321323 5321319 5321324 +
aaaatatgacagaagagtgata

SEQ ID NO: 100203 - DNA, 22 bp, Artificial Sequence
  Synthetic oligonucleotide; CTG chr11 5321328 5321349 5321345 5321350 +
gtttggtttaatgaagtattgg

SEQ ID NO: 100204 - DNA, 22 bp, Artificial Sequence
  Synthetic oligonucleotide; TTT chr11 5321332 5321353 5321349 5321354 +
ggtttaatgaagtattggcttg

SEQ ID NO: 100205 - DNA, 22 bp, Artificial Sequence
  Synthetic oligonucleotide; TTG chr11 5321333 5321354 5321350 5321355 +
gtttaatgaagtattggcttgt

SEQ ID NO: 100206 - DNA, 22 bp, Artificial Sequence
  Synthetic oligonucleotide; TTT chr11 5321337 5321358 5321354 5321359 +
aatgaagtattggcttgtgccc

SEQ ID NO: 100207 - DNA, 22 bp, Artificial Sequence
  Synthetic oligonucleotide; TTA chr11 5321338 5321359 5321355 5321360 +
atgaagtattggcttgtgccct

SEQ ID NO: 100208 - DNA, 22 bp, Artificial Sequence
  Synthetic oligonucleotide; TTG chr11 5321349 5321370 5321366 5321371 +
gcttgtgccctcagaagggact

SEQ ID NO: 100209 - DNA, 22 bp, Artificial Sequence
  Synthetic oligonucleotide; CTT chr11 5321353 5321374 5321370 5321375 +
gtgccctcagaagggactgtgt

SEQ ID NO: 100210 - DNA, 22 bp, Artificial Sequence
  Synthetic oligonucleotide; TTG chr11 5321354 5321375 5321371 5321376 +
tgccctcagaagggactgtgta

SEQ ID NO: 100211 - DNA, 22 bp, Artificial Sequence
  Synthetic oligonucleotide; CTC chr11 5321361 5321382 5321378 5321383 +
agaagggactgtgtatctttta

SEQ ID NO: 100212 - DNA, 22 bp, Artificial Sequence
  Synthetic oligonucleotide; CTG chr11 5321372 5321393 5321389 5321394 +
tgtatcttttatcatgaaagtt

SEQ ID NO: 100213 - DNA, 22 bp, Artificial Sequence
  Synthetic oligonucleotide; CTT chr11 5321380 5321401 5321397 5321402 +
ttatcatgaaagttgatatttc

SEQ ID NO: 100214 - DNA, 22 bp, Artificial Sequence
  Synthetic oligonucleotide; TTT chr11 5321381 5321402 5321398 5321403 +
tatcatgaaagttgatatttca

SEQ ID NO: 100215 - DNA, 22 bp, Artificial Sequence
  Synthetic oligonucleotide; TTT chr11 5321382 5321403 5321399 5321404 +
atcatgaaagttgatatttcag

SEQ ID NO: 100216 - DNA, 22 bp, Artificial Sequence
  Synthetic oligonucleotide; TTA chr11 5321383 5321404 5321400 5321405 +
tcatgaaagttgatatttcaga

SEQ ID NO: 100217 - DNA, 22 bp, Artificial Sequence
  Synthetic oligonucleotide; TTG chr11 5321395 5321416 5321412 5321417 +
atatttcagagcactaataact

SEQ ID NO: 100218 - DNA, 22 bp, Artificial Sequence
  Synthetic oligonucleotide; TTT chr11 5321401 5321422 5321418 5321423 +
cagagcactaataacttagttt

SEQ ID NO: 100219 - DNA, 22 bp, Artificial Sequence
  Synthetic oligonucleotide; TTC chr11 5321402 5321423 5321419 5321424 +
agagcactaataacttagtttc

SEQ ID NO: 100220 - DNA, 22 bp, Artificial Sequence
  Synthetic oligonucleotide; CTA chr11 5321411 5321432 5321428 5321433 +
ataacttagtttccttctatgt

SEQ ID NO: 100221 - DNA, 22 bp, Artificial Sequence
  Synthetic oligonucleotide; CTT chr11 5321418 5321439 5321435 5321440 +
agtttccttctatgtaaaagat

SEQ ID NO: 100222 - DNA, 22 bp, Artificial Sequence
  Synthetic oligonucleotide; TTA chr11 5321419 5321440 5321436 5321441 +
gtttccttctatgtaaaagatg

SEQ ID NO: 100223 - DNA, 22 bp, Artificial Sequence
  Synthetic oligonucleotide; TTT chr11 5321423 5321444 5321440 5321445 +
ccttctatgtaaaagatgaaaa

SEQ ID NO: 100224 - DNA, 22 bp, Artificial Sequence
  Synthetic oligonucleotide; TTC chr11 5321424 5321445 5321441 5321446 +
cttctatgtaaaagatgaaaag

SEQ ID NO: 100225 - DNA, 22 bp, Artificial Sequence
  Synthetic oligonucleotide; CTT chr11 5321427 5321448 5321444 5321449 +
ctatgtaaaagatgaaaagtct

SEQ ID NO: 100226 - DNA, 22 bp, Artificial Sequence
  Synthetic oligonucleotide; TTC chr11 5321428 5321449 5321445 5321450 +
tatgtaaaagatgaaaagtctc

SEQ ID NO: 100227 - DNA, 22 bp, Artificial Sequence
  Synthetic oligonucleotide; CTA chr11 5321430 5321451 5321447 5321452 +
tgtaaaagatgaaaagtctcaa

SEQ ID NO: 100228 - DNA, 22 bp, Artificial Sequence
  Synthetic oligonucleotide; CTC chr11 5321450 5321471 5321467 5321472 +
aatgaaataaaatgctagtgga

SEQ ID NO: 100229 - DNA, 22 bp, Artificial Sequence
  Synthetic oligonucleotide; CTA chr11 5321467 5321488 5321484 5321489 +
gtggattcagatcaccctctta

SEQ ID NO: 100230 - DNA, 22 bp, Artificial Sequence
  Synthetic oligonucleotide; TTC chr11 5321475 5321496 5321492 5321497 +
agatcaccctcttagaatcaat

SEQ ID NO: 100231 - DNA, 22 bp, Artificial Sequence
  Synthetic oligonucleotide; CTC chr11 5321486 5321507 5321503 5321508 +
ttagaatcaatttgaaaaatat

SEQ ID NO: 100232 - DNA, 22 bp, Artificial Sequence
  Synthetic oligonucleotide; CTT chr11 5321488 5321509 5321505 5321510 +
agaatcaatttgaaaaatattt

SEQ ID NO: 100233 - DNA, 22 bp, Artificial Sequence
  Synthetic oligonucleotide; TTA chr11 5321489 5321510 5321506 5321511 +
gaatcaatttgaaaaatatttt

SEQ ID NO: 100234 - DNA, 22 bp, Artificial Sequence
  Synthetic oligonucleotide; TTT chr11 5321499 5321520 5321516 5321521 +
gaaaaatattttctttaaacaa

SEQ ID NO: 100235 - DNA, 22 bp, Artificial Sequence
  Synthetic oligonucleotide; TTG chr11 5321500 5321521 5321517 5321522 +
aaaaatattttctttaaacaac

SEQ ID NO: 100236 - DNA, 22 bp, Artificial Sequence
  Synthetic oligonucleotide; TTT chr11 5321510 5321531 5321527 5321532 +
tctttaaacaaccatgaaggca

SEQ ID NO: 100237 - DNA, 22 bp, Artificial Sequence
  Synthetic oligonucleotide; TTT chr11 5321511 5321532 5321528 5321533 +
ctttaaacaaccatgaaggcac

SEQ ID NO: 100238 - DNA, 22 bp, Artificial Sequence
  Synthetic oligonucleotide; TTC chr11 5321512 5321533 5321529 5321534 +
tttaaacaaccatgaaggcacc

SEQ ID NO: 100239 - DNA, 22 bp, Artificial Sequence
  Synthetic oligonucleotide; CTT chr11 5321514 5321535 5321531 5321536 +
taaacaaccatgaaggcaccaa

SEQ ID NO: 100240 - DNA, 22 bp, Artificial Sequence
  Synthetic oligonucleotide; TTT chr11 5321515 5321536 5321532 5321537 +
aaacaaccatgaaggcaccaag

SEQ ID NO: 100241 - DNA, 22 bp, Artificial Sequence
  Synthetic oligonucleotide; TTA chr11 5321516 5321537 5321533 5321538 +
aacaaccatgaaggcaccaaga

SEQ ID NO: 100242 - DNA, 22 bp, Artificial Sequence
  Synthetic oligonucleotide; TTC chr11 5321549 5321570 5321566 5321571 +
aacgtctaaaccagtttaagga

SEQ ID NO: 100243 - DNA, 22 bp, Artificial Sequence
  Synthetic oligonucleotide; CTA chr11 5321557 5321578 5321574 5321579 +
aaccagtttaaggacaacgtca

SEQ ID NO: 100244 - DNA, 22 bp, Artificial Sequence
  Synthetic oligonucleotide; TTT chr11 5321566 5321587 5321583 5321588 +
aaggacaacgtcattaataata

SEQ ID NO: 100245 - DNA, 22 bp, Artificial Sequence
  Synthetic oligonucleotide; TTA chr11 5321567 5321588 5321584 5321589 +
aggacaacgtcattaataataa

SEQ ID NO: 100246 - DNA, 22 bp, Artificial Sequence
  Synthetic oligonucleotide; TTA chr11 5321582 5321603 5321599 5321604 +
ataataaacatatttcccaata

SEQ ID NO: 100247 - DNA, 22 bp, Artificial Sequence
  Synthetic oligonucleotide; TTT chr11 5321597 5321618 5321614 5321619 +
cccaataatttgggcttctttc

SEQ ID NO: 100248 - DNA, 22 bp, Artificial Sequence
  Synthetic oligonucleotide; TTC chr11 5321598 5321619 5321615 5321620 +
ccaataatttgggcttctttca

SEQ ID NO: 100249 - DNA, 22 bp, Artificial Sequence
  Synthetic oligonucleotide; TTT chr11 5321608 5321629 5321625 5321630 +
gggcttctttcatcttggaaac

SEQ ID NO: 100250 - DNA, 22 bp, Artificial Sequence
  Synthetic oligonucleotide; TTG chr11 5321609 5321630 5321626 5321631 +
ggcttctttcatcttggaaaca

SEQ ID NO: 100251 - DNA, 22 bp, Artificial Sequence
  Synthetic oligonucleotide; CTT chr11 5321614 5321635 5321631 5321636 +
ctttcatcttggaaacaacact

SEQ ID NO: 100252 - DNA, 22 bp, Artificial Sequence
  Synthetic oligonucleotide; TTC chr11 5321615 5321636 5321632 5321637 +
tttcatcttggaaacaacactg

SEQ ID NO: 100253 - DNA, 22 bp, Artificial Sequence
  Synthetic oligonucleotide; CTT chr11 5321617 5321638 5321634 5321639 +
tcatcttggaaacaacactgct

SEQ ID NO: 100254 - DNA, 22 bp, Artificial Sequence
  Synthetic oligonucleotide; TTT chr11 5321618 5321639 5321635 5321640 +
catcttggaaacaacactgctt

SEQ ID NO: 100255 - DNA, 22 bp, Artificial Sequence
  Synthetic oligonucleotide; TTC chr11 5321619 5321640 5321636 5321641 +
atcttggaaacaacactgctta

SEQ ID NO: 100256 - DNA, 22 bp, Artificial Sequence
  Synthetic oligonucleotide; CTT chr11 5321624 5321645 5321641 5321646 +
ggaaacaacactgcttatccaa

SEQ ID NO: 100257 - DNA, 22 bp, Artificial Sequence
  Synthetic oligonucleotide; TTG chr11 5321625 5321646 5321642 5321647 +
gaaacaacactgcttatccaaa

SEQ ID NO: 100258 - DNA, 22 bp, Artificial Sequence
  Synthetic oligonucleotide; CTG chr11 5321637 5321658 5321654 5321659 +
cttatccaaagtaagcacctcc

SEQ ID NO: 100259 - DNA, 22 bp, Artificial Sequence
  Synthetic oligonucleotide; CTT chr11 5321640 5321661 5321657 5321662 +
atccaaagtaagcacctcctta

SEQ ID NO: 100260 - DNA, 22 bp, Artificial Sequence
  Synthetic oligonucleotide; TTA chr11 5321641 5321662 5321658 5321663 +
tccaaagtaagcacctccttat

SEQ ID NO: 100261 - DNA, 22 bp, Artificial Sequence
  Synthetic oligonucleotide; CTC chr11 5321658 5321679 5321675 5321680 +
cttatacctattcagtgaggct

SEQ ID NO: 100262 - DNA, 22 bp, Artificial Sequence
  Synthetic oligonucleotide; CTT chr11 5321661 5321682 5321678 5321683 +
atacctattcagtgaggctgca

SEQ ID NO: 100263 - DNA, 22 bp, Artificial Sequence
  Synthetic oligonucleotide; TTA chr11 5321662 5321683 5321679 5321684 +
tacctattcagtgaggctgcaa

SEQ ID NO: 100264 - DNA, 22 bp, Artificial Sequence
  Synthetic oligonucleotide; CTA chr11 5321668 5321689 5321685 5321690 +
ttcagtgaggctgcaatattgc

SEQ ID NO: 100265 - DNA, 22 bp, Artificial Sequence
  Synthetic oligonucleotide; TTC chr11 5321671 5321692 5321688 5321693 +
agtgaggctgcaatattgccat

SEQ ID NO: 100266 - DNA, 22 bp, Artificial Sequence
  Synthetic oligonucleotide; CTG chr11 5321681 5321702 5321698 5321703 +
caatattgccatatcctcaacc

SEQ ID NO: 100267 - DNA, 22 bp, Artificial Sequence
  Synthetic oligonucleotide; TTG chr11 5321689 5321710 5321706 5321711 +
ccatatcctcaacccaccatat

SEQ ID NO: 100268 - DNA, 22 bp, Artificial Sequence
  Synthetic oligonucleotide; CTC chr11 5321699 5321720 5321716 5321721 +
aacccaccatatacacaaaagg

SEQ ID NO: 100269 - DNA, 22 bp, Artificial Sequence
  Synthetic oligonucleotide; CTG chr11 5321737 5321758 5321754 5321759 +
ctccatcatggtttgaaacttc

SEQ ID NO: 100270 - DNA, 22 bp, Artificial Sequence
  Synthetic oligonucleotide; CTC chr11 5321740 5321761 5321757 5321762 +
catcatggtttgaaacttcctt

SEQ ID NO: 100271 - DNA, 22 bp, Artificial Sequence
  Synthetic oligonucleotide; TTT chr11 5321751 5321772 5321768 5321773 +
gaaacttccttatttctcacac

SEQ ID NO: 100272 - DNA, 22 bp, Artificial Sequence
  Synthetic oligonucleotide; TTG chr11 5321752 5321773 5321769 5321774 +
aaacttccttatttctcacaca

SEQ ID NO: 100273 - DNA, 22 bp, Artificial Sequence
  Synthetic oligonucleotide; CTT chr11 5321758 5321779 5321775 5321780 +
ccttatttctcacacatgtggc

SEQ ID NO: 100274 - DNA, 22 bp, Artificial Sequence
  Synthetic oligonucleotide; TTC chr11 5321759 5321780 5321776 5321781 +
cttatttctcacacatgtggca

SEQ ID NO: 100275 - DNA, 22 bp, Artificial Sequence
  Synthetic oligonucleotide; CTT chr11 5321762 5321783 5321779 5321784 +
atttctcacacatgtggcaggt

SEQ ID NO: 100276 - DNA, 22 bp, Artificial Sequence
  Synthetic oligonucleotide; TTA chr11 5321763 5321784 5321780 5321785 +
tttctcacacatgtggcaggta

SEQ ID NO: 100277 - DNA, 22 bp, Artificial Sequence
  Synthetic oligonucleotide; TTT chr11 5321766 5321787 5321783 5321788 +
ctcacacatgtggcaggtaatt

SEQ ID NO: 100278 - DNA, 22 bp, Artificial Sequence
  Synthetic oligonucleotide; TTC chr11 5321767 5321788 5321784 5321789 +
tcacacatgtggcaggtaatta

SEQ ID NO: 100279 - DNA, 22 bp, Artificial Sequence
  Synthetic oligonucleotide; CTC chr11 5321769 5321790 5321786 5321791 +
acacatgtggcaggtaattaaa

SEQ ID NO: 100280 - DNA, 22 bp, Artificial Sequence
  Synthetic oligonucleotide; TTA chr11 5321789 5321810 5321806 5321811 +
aactatggcttgaagtcctggc

SEQ ID NO: 100281 - DNA, 22 bp, Artificial Sequence
  Synthetic oligonucleotide; CTA chr11 5321794 5321815 5321811 5321816 +
tggcttgaagtcctggccttgg

SEQ ID NO: 100282 - DNA, 22 bp, Artificial Sequence
  Synthetic oligonucleotide; CTT chr11 5321800 5321821 5321817 5321822 +
gaagtcctggccttggccagtt

SEQ ID NO: 100283 - DNA, 22 bp, Artificial Sequence
  Synthetic oligonucleotide; TTG chr11 5321801 5321822 5321818 5321823 +
aagtcctggccttggccagtta

SEQ ID NO: 100284 - DNA, 22 bp, Artificial Sequence
  Synthetic oligonucleotide; CTG chr11 5321809 5321830 5321826 5321831 +
gccttggccagttaaactaaga

SEQ ID NO: 100285 - DNA, 22 bp, Artificial Sequence
  Synthetic oligonucleotide; CTT chr11 5321814 5321835 5321831 5321836 +
ggccagttaaactaagagtcct

SEQ ID NO: 100286 - DNA, 22 bp, Artificial Sequence
  Synthetic oligonucleotide; TTG chr11 5321815 5321836 5321832 5321837 +
gccagttaaactaagagtcctt

SEQ ID NO: 100287 - DNA, 22 bp, Artificial Sequence
  Synthetic oligonucleotide; TTA chr11 5321823 5321844 5321840 5321845 +
aactaagagtccttccatcaaa

SEQ ID NO: 100288 - DNA, 22 bp, Artificial Sequence
  Synthetic oligonucleotide; CTA chr11 5321828 5321849 5321845 5321850 +
agagtccttccatcaaatgtat

SEQ ID NO: 100289 - DNA, 22 bp, Artificial Sequence
  Synthetic oligonucleotide; CTT chr11 5321837 5321858 5321854 5321859 +
ccatcaaatgtatcactgtaaa

SEQ ID NO: 100290 - DNA, 22 bp, Artificial Sequence
  Synthetic oligonucleotide; TTC chr11 5321838 5321859 5321855 5321860 +
catcaaatgtatcactgtaaaa

SEQ ID NO: 100291 - DNA, 22 bp, Artificial Sequence
  Synthetic oligonucleotide; CTG chr11 5321855 5321876 5321872 5321877 +
taaaacagatagcctatcctca

SEQ ID NO: 100292 - DNA, 22 bp, Artificial Sequence
  Synthetic oligonucleotide; CTA chr11 5321871 5321892 5321888 5321893 +
tcctcaaaatttagatatcaga

SEQ ID NO: 100293 - DNA, 22 bp, Artificial Sequence
  Synthetic oligonucleotide; CTC chr11 5321876 5321897 5321893 5321898 +
aaaatttagatatcagatgggg

SEQ ID NO: 100294 - DNA, 22 bp, Artificial Sequence
  Synthetic oligonucleotide; TTT chr11 5321883 5321904 5321900 5321905 +
agatatcagatggggatataat

SEQ ID NO: 100295 - DNA, 22 bp, Artificial Sequence
  Synthetic oligonucleotide; TTA chr11 5321884 5321905 5321901 5321906 +
gatatcagatggggatataata

SEQ ID NO: 100296 - DNA, 22 bp, Artificial Sequence
  Synthetic oligonucleotide; CTT chr11 5321918 5321939 5321935 5321940 +
gtgattaccacagcaacttgtg

SEQ ID NO: 100297 - DNA, 22 bp, Artificial Sequence
  Synthetic oligonucleotide; TTG chr11 5321919 5321940 5321936 5321941 +
tgattaccacagcaacttgtga

SEQ ID NO: 100298 - DNA, 22 bp, Artificial Sequence
  Synthetic oligonucleotide; TTA chr11 5321925 5321946 5321942 5321947 +
ccacagcaacttgtgatgtccc

SEQ ID NO: 100299 - DNA, 22 bp, Artificial Sequence
  Synthetic oligonucleotide; CTT chr11 5321937 5321958 5321954 5321959 +
gtgatgtcccacagcttctgtt

SEQ ID NO: 100300 - DNA, 22 bp, Artificial Sequence
  Synthetic oligonucleotide; TTG chr11 5321938 5321959 5321955 5321960 +
tgatgtcccacagcttctgttc

SEQ ID NO: 100301 - DNA, 22 bp, Artificial Sequence
  Synthetic oligonucleotide; CTT chr11 5321954 5321975 5321971 5321976 +
ctgttctacaaagatgggaaac

SEQ ID NO: 100302 - DNA, 22 bp, Artificial Sequence
  Synthetic oligonucleotide; TTC chr11 5321955 5321976 5321972 5321977 +
tgttctacaaagatgggaaaca

SEQ ID NO: 100303 - DNA, 22 bp, Artificial Sequence
  Synthetic oligonucleotide; CTG chr11 5321957 5321978 5321974 5321979 +
ttctacaaagatgggaaacaaa

SEQ ID NO: 100304 - DNA, 22 bp, Artificial Sequence
  Synthetic oligonucleotide; TTC chr11 5321960 5321981 5321977 5321982 +
tacaaagatgggaaacaaaggc

SEQ ID NO: 100305 - DNA, 22 bp, Artificial Sequence
  Synthetic oligonucleotide; CTA chr11 5321962 5321983 5321979 5321984 +
caaagatgggaaacaaaggcag

SEQ ID NO: 100306 - DNA, 22 bp, Artificial Sequence
  Synthetic oligonucleotide; CTT chr11 5321988 5322009 5322005 5322010 +
tcctcagctacaagaggttctg

SEQ ID NO: 100307 - DNA, 22 bp, Artificial Sequence
  Synthetic oligonucleotide; TTT chr11 5321989 5322010 5322006 5322011 +
cctcagctacaagaggttctgc

SEQ ID NO: 100308 - DNA, 22 bp, Artificial Sequence
  Synthetic oligonucleotide; TTC chr11 5321990 5322011 5322007 5322012 +
ctcagctacaagaggttctgca

SEQ ID NO: 100309 - DNA, 22 bp, Artificial Sequence
  Synthetic oligonucleotide; CTC chr11 5321993 5322014 5322010 5322015 +
agctacaagaggttctgcatca

SEQ ID NO: 100310 - DNA, 22 bp, Artificial Sequence
  Synthetic oligonucleotide; CTA chr11 5321998 5322019 5322015 5322020 +
caagaggttctgcatcaagata

SEQ ID NO: 100311 - DNA, 22 bp, Artificial Sequence
  Synthetic oligonucleotide; TTC chr11 5322008 5322029 5322025 5322030 +
tgcatcaagatagcaaatcaag

SEQ ID NO: 100312 - DNA, 22 bp, Artificial Sequence
  Synthetic oligonucleotide; CTG chr11 5322010 5322031 5322027 5322032 +
catcaagatagcaaatcaagat

SEQ ID NO: 100313 - DNA, 22 bp, Artificial Sequence
  Synthetic oligonucleotide; TTA chr11 5322040 5322061 5322057 5322062 +
tccgaaatgagatttttccatt

SEQ ID NO: 100314 - DNA, 22 bp, Artificial Sequence
  Synthetic oligonucleotide; TTT chr11 5322055 5322076 5322072 5322077 +
ttccattaagatgcctagatgt

SEQ ID NO: 100315 - DNA, 22 bp, Artificial Sequence
  Synthetic oligonucleotide; TTT chr11 5322056 5322077 5322073 5322078 +
tccattaagatgcctagatgta

SEQ ID NO: 100316 - DNA, 22 bp, Artificial Sequence
  Synthetic oligonucleotide; TTT chr11 5322057 5322078 5322074 5322079 +
ccattaagatgcctagatgtat

SEQ ID NO: 100317 - DNA, 22 bp, Artificial Sequence
  Synthetic oligonucleotide; TTC chr11 5322058 5322079 5322075 5322080 +
cattaagatgcctagatgtatt

SEQ ID NO: 100318 - DNA, 22 bp, Artificial Sequence
  Synthetic oligonucleotide; TTA chr11 5322063 5322084 5322080 5322085 +
agatgcctagatgtattataga

SEQ ID NO: 100319 - DNA, 22 bp, Artificial Sequence
  Synthetic oligonucleotide; CTA chr11 5322072 5322093 5322089 5322094 +
gatgtattatagacctcatggt

SEQ ID NO: 100320 - DNA, 22 bp, Artificial Sequence
  Synthetic oligonucleotide; TTA chr11 5322081 5322102 5322098 5322103 +
tagacctcatggtcacatataa

SEQ ID NO: 100321 - DNA, 22 bp, Artificial Sequence
  Synthetic oligonucleotide; CTC chr11 5322089 5322110 5322106 5322111 +
atggtcacatataaggaacaga

SEQ ID NO: 100322 - DNA, 22 bp, Artificial Sequence
  Synthetic oligonucleotide; CTT chr11 5322120 5322141 5322137 5322142 +
tggtagataactgacttttagg

SEQ ID NO: 100323 - DNA, 22 bp, Artificial Sequence
  Synthetic oligonucleotide; TTT chr11 5322121 5322142 5322138 5322143 +
ggtagataactgacttttagga

SEQ ID NO: 100324 - DNA, 22 bp, Artificial Sequence
  Synthetic oligonucleotide; TTG chr11 5322122 5322143 5322139 5322144 +
gtagataactgacttttaggat

SEQ ID NO: 100325 - DNA, 22 bp, Artificial Sequence
  Synthetic oligonucleotide; CTG chr11 5322133 5322154 5322150 5322155 +
acttttaggatttgagtttata

SEQ ID NO: 100326 - DNA, 22 bp, Artificial Sequence
  Synthetic oligonucleotide; CTT chr11 5322137 5322158 5322154 5322159 +
ttaggatttgagtttatattca

SEQ ID NO: 100327 - DNA, 22 bp, Artificial Sequence
  Synthetic oligonucleotide; TTT chr11 5322138 5322159 5322155 5322160 +
taggatttgagtttatattcag

SEQ ID NO: 100328 - DNA, 22 bp, Artificial Sequence
  Synthetic oligonucleotide; TTT chr11 5322139 5322160 5322156 5322161 +
aggatttgagtttatattcagc

SEQ ID NO: 100329 - DNA, 22 bp, Artificial Sequence
  Synthetic oligonucleotide; TTA chr11 5322140 5322161 5322157 5322162 +
ggatttgagtttatattcagca

SEQ ID NO: 100330 - DNA, 22 bp, Artificial Sequence
  Synthetic oligonucleotide; TTT chr11 5322146 5322167 5322163 5322168 +
gagtttatattcagcatcaata

SEQ ID NO: 100331 - DNA, 22 bp, Artificial Sequence
  Synthetic oligonucleotide; TTG chr11 5322147 5322168 5322164 5322169 +
agtttatattcagcatcaataa

SEQ ID NO: 100332 - DNA, 22 bp, Artificial Sequence
  Synthetic oligonucleotide; TTT chr11 5322152 5322173 5322169 5322174 +
atattcagcatcaataacttga

SEQ ID NO: 100333 - DNA, 22 bp, Artificial Sequence
  Synthetic oligonucleotide; TTA chr11 5322153 5322174 5322170 5322175 +
tattcagcatcaataacttgaa

SEQ ID NO: 100334 - DNA, 22 bp, Artificial Sequence
  Synthetic oligonucleotide; TTC chr11 5322158 5322179 5322175 5322180 +
agcatcaataacttgaacatta

SEQ ID NO: 100335 - DNA, 22 bp, Artificial Sequence
  Synthetic oligonucleotide; CTT chr11 5322172 5322193 5322189 5322194 +
gaacattatactctgagatagg

SEQ ID NO: 100336 - DNA, 22 bp, Artificial Sequence
  Synthetic oligonucleotide; TTG chr11 5322173 5322194 5322190 5322195 +
aacattatactctgagataggt

SEQ ID NO: 100337 - DNA, 22 bp, Artificial Sequence
  Synthetic oligonucleotide; TTA chr11 5322180 5322201 5322197 5322202 +
tactctgagataggttttcccc

SEQ ID NO: 100338 - DNA, 22 bp, Artificial Sequence
  Synthetic oligonucleotide; CTC chr11 5322185 5322206 5322202 5322207 +
tgagataggttttccccttttg

SEQ ID NO: 100339 - DNA, 22 bp, Artificial Sequence
  Synthetic oligonucleotide; CTG chr11 5322187 5322208 5322204 5322209 +
agataggttttccccttttgaa

SEQ ID NO: 100340 - DNA, 22 bp, Artificial Sequence
  Synthetic oligonucleotide; TTT chr11 5322197 5322218 5322214 5322219 +
tccccttttgaaatttgtggat

SEQ ID NO: 100341 - DNA, 22 bp, Artificial Sequence
  Synthetic oligonucleotide; TTT chr11 5322198 5322219 5322215 5322220 +
ccccttttgaaatttgtggatg

SEQ ID NO: 100342 - DNA, 22 bp, Artificial Sequence
  Synthetic oligonucleotide; TTC chr11 5322199 5322220 5322216 5322221 +
cccttttgaaatttgtggatga

SEQ ID NO: 100343 - DNA, 22 bp, Artificial Sequence
  Synthetic oligonucleotide; CTT chr11 5322204 5322225 5322221 5322226 +
ttgaaatttgtggatgaaaatc

SEQ ID NO: 100344 - DNA, 22 bp, Artificial Sequence
  Synthetic oligonucleotide; TTT chr11 5322205 5322226 5322222 5322227 +
tgaaatttgtggatgaaaatcc

SEQ ID NO: 100345 - DNA, 22 bp, Artificial Sequence
  Synthetic oligonucleotide; TTT chr11 5322206 5322227 5322223 5322228 +
gaaatttgtggatgaaaatcct

SEQ ID NO: 100346 - DNA, 22 bp, Artificial Sequence
  Synthetic oligonucleotide; TTG chr11 5322207 5322228 5322224 5322229 +
aaatttgtggatgaaaatcctg

SEQ ID NO: 100347 - DNA, 22 bp, Artificial Sequence
  Synthetic oligonucleotide; TTT chr11 5322213 5322234 5322230 5322235 +
gtggatgaaaatcctgtttcac

SEQ ID NO: 100348 - DNA, 22 bp, Artificial Sequence
  Synthetic oligonucleotide; TTG chr11 5322214 5322235 5322231 5322236 +
tggatgaaaatcctgtttcaca

SEQ ID NO: 100349 - DNA, 22 bp, Artificial Sequence
  Synthetic oligonucleotide; CTG chr11 5322229 5322250 5322246 5322251 +
tttcacaattaaatcagtctaa

SEQ ID NO: 100350 - DNA, 22 bp, Artificial Sequence
  Synthetic oligonucleotide; TTT chr11 5322232 5322253 5322249 5322254 +
cacaattaaatcagtctaaaag

SEQ ID NO: 100351 - DNA, 22 bp, Artificial Sequence
  Synthetic oligonucleotide; TTC chr11 5322233 5322254 5322250 5322255 +
acaattaaatcagtctaaaaga

SEQ ID NO: 100352 - DNA, 22 bp, Artificial Sequence
  Synthetic oligonucleotide; TTA chr11 5322240 5322261 5322257 5322262 +
aatcagtctaaaagaagctttt

SEQ ID NO: 100353 - DNA, 22 bp, Artificial Sequence
  Synthetic oligonucleotide; CTA chr11 5322250 5322271 5322267 5322272 +
aaagaagcttttagtacacagt

SEQ ID NO: 100354 - DNA, 22 bp, Artificial Sequence
  Synthetic oligonucleotide; CTT chr11 5322260 5322281 5322277 5322282 +
ttagtacacagtcacacaaaaa

SEQ ID NO: 100355 - DNA, 22 bp, Artificial Sequence
  Synthetic oligonucleotide; TTT chr11 5322261 5322282 5322278 5322283 +
tagtacacagtcacacaaaaac

SEQ ID NO: 100356 - DNA, 22 bp, Artificial Sequence
  Synthetic oligonucleotide; TTT chr11 5322262 5322283 5322279 5322284 +
agtacacagtcacacaaaaact

SEQ ID NO: 100357 - DNA, 22 bp, Artificial Sequence
  Synthetic oligonucleotide; TTA chr11 5322263 5322284 5322280 5322285 +
gtacacagtcacacaaaaactc

SEQ ID NO: 100358 - DNA, 22 bp, Artificial Sequence
  Synthetic oligonucleotide; CTC chr11 5322285 5322306 5322302 5322307 +
ctcccaccacaattttttagtc

SEQ ID NO: 100359 - DNA, 22 bp, Artificial Sequence
  Synthetic oligonucleotide; CTC chr11 5322288 5322309 5322305 5322310 +
ccaccacaattttttagtcatt

SEQ ID NO: 100360 - DNA, 22 bp, Artificial Sequence
  Synthetic oligonucleotide; TTT chr11 5322300 5322321 5322317 5322322 +
tttagtcattggatgaattgaa

SEQ ID NO: 100361 - DNA, 22 bp, Artificial Sequence
  Synthetic oligonucleotide; TTT chr11 5322301 5322322 5322318 5322323 +
ttagtcattggatgaattgaaa

SEQ ID NO: 100362 - DNA, 22 bp, Artificial Sequence
  Synthetic oligonucleotide; TTT chr11 5322302 5322323 5322319 5322324 +
tagtcattggatgaattgaaat

SEQ ID NO: 100363 - DNA, 22 bp, Artificial Sequence
  Synthetic oligonucleotide; TTT chr11 5322303 5322324 5322320 5322325 +
agtcattggatgaattgaaatc

SEQ ID NO: 100364 - DNA, 22 bp, Artificial Sequence
  Synthetic oligonucleotide; TTA chr11 5322304 5322325 5322321 5322326 +
gtcattggatgaattgaaatcc

SEQ ID NO: 100365 - DNA, 22 bp, Artificial Sequence
  Synthetic oligonucleotide; TTG chr11 5322311 5322332 5322328 5322333 +
gatgaattgaaatccatttctc

SEQ ID NO: 100366 - DNA, 22 bp, Artificial Sequence
  Synthetic oligonucleotide; TTG chr11 5322320 5322341 5322337 5322342 +
aaatccatttctctcaacattg

SEQ ID NO: 100367 - DNA, 22 bp, Artificial Sequence
  Synthetic oligonucleotide; TTT chr11 5322330 5322351 5322347 5322352 +
ctctcaacattgttggtcttcc

SEQ ID NO: 100368 - DNA, 22 bp, Artificial Sequence
  Synthetic oligonucleotide; TTC chr11 5322331 5322352 5322348 5322353 +
tctcaacattgttggtcttcct

SEQ ID NO: 100369 - DNA, 22 bp, Artificial Sequence
  Synthetic oligonucleotide; CTC chr11 5322333 5322354 5322350 5322355 +
tcaacattgttggtcttcctaa

SEQ ID NO: 100370 - DNA, 22 bp, Artificial Sequence
  Synthetic oligonucleotide; CTC chr11 5322335 5322356 5322352 5322357 +
aacattgttggtcttcctaata

SEQ ID NO: 100371 - DNA, 22 bp, Artificial Sequence
  Synthetic oligonucleotide; TTG chr11 5322342 5322363 5322359 5322364 +
ttggtcttcctaatatagagag

SEQ ID NO: 100372 - DNA, 22 bp, Artificial Sequence
  Synthetic oligonucleotide; TTG chr11 5322345 5322366 5322362 5322367 +
gtcttcctaatatagagagttt

SEQ ID NO: 100373 - DNA, 22 bp, Artificial Sequence
  Synthetic oligonucleotide; CTT chr11 5322350 5322371 5322367 5322372 +
cctaatatagagagtttacagt

SEQ ID NO: 100374 - DNA, 22 bp, Artificial Sequence
  Synthetic oligonucleotide; TTC chr11 5322351 5322372 5322368 5322373 +
ctaatatagagagtttacagta

SEQ ID NO: 100375 - DNA, 22 bp, Artificial Sequence
  Synthetic oligonucleotide; CTA chr11 5322354 5322375 5322371 5322376 +
atatagagagtttacagtagat

SEQ ID NO: 100376 - DNA, 22 bp, Artificial Sequence
  Synthetic oligonucleotide; TTT chr11 5322367 5322388 5322384 5322389 +
acagtagatgtcagagaaagta

SEQ ID NO: 100377 - DNA, 22 bp, Artificial Sequence
  Synthetic oligonucleotide; TTA chr11 5322368 5322389 5322385 5322390 +
cagtagatgtcagagaaagtat

SEQ ID NO: 100378 - DNA, 22 bp, Artificial Sequence
  Synthetic oligonucleotide; TTT chr11 5322392 5322413 5322409 5322414 +
atggcaaaagaatcaccatttc

SEQ ID NO: 100379 - DNA, 22 bp, Artificial Sequence
  Synthetic oligonucleotide; TTA chr11 5322393 5322414 5322410 5322415 +
tggcaaaagaatcaccatttct

SEQ ID NO: 100380 - DNA, 22 bp, Artificial Sequence
  Synthetic oligonucleotide; TTT chr11 5322413 5322434 5322430 5322435 +
ctaatttttccctctgaacata

SEQ ID NO: 100381 - DNA, 22 bp, Artificial Sequence
  Synthetic oligonucleotide; TTC chr11 5322414 5322435 5322431 5322436 +
taatttttccctctgaacatat

SEQ ID NO: 100382 - DNA, 22 bp, Artificial Sequence
  Synthetic oligonucleotide; CTA chr11 5322416 5322437 5322433 5322438 +
atttttccctctgaacatatat

SEQ ID NO: 100383 - DNA, 22 bp, Artificial Sequence
  Synthetic oligonucleotide; TTT chr11 5322420 5322441 5322437 5322442 +
ttccctctgaacatatataaag

SEQ ID NO: 100384 - DNA, 22 bp, Artificial Sequence
  Synthetic oligonucleotide; TTT chr11 5322421 5322442 5322438 5322443 +
tccctctgaacatatataaagt

SEQ ID NO: 100385 - DNA, 22 bp, Artificial Sequence
  Synthetic oligonucleotide; TTT chr11 5322422 5322443 5322439 5322444 +
ccctctgaacatatataaagta

SEQ ID NO: 100386 - DNA, 22 bp, Artificial Sequence
  Synthetic oligonucleotide; TTC chr11 5322423 5322444 5322440 5322445 +
cctctgaacatatataaagtat

SEQ ID NO: 100387 - DNA, 22 bp, Artificial Sequence
  Synthetic oligonucleotide; CTC chr11 5322427 5322448 5322444 5322449 +
tgaacatatataaagtatatat

SEQ ID NO: 100388 - DNA, 22 bp, Artificial Sequence
  Synthetic oligonucleotide; CTG chr11 5322429 5322450 5322446 5322451 +
aacatatataaagtatatataa

SEQ ID NO: 100389 - DNA, 22 bp, Artificial Sequence
  Synthetic oligonucleotide; CTT chr11 5322454 5322475 5322471 5322476 +
gtgaagtaatgatgtctcatat

SEQ ID NO: 100390 - DNA, 22 bp, Artificial Sequence
  Synthetic oligonucleotide; TTG chr11 5322455 5322476 5322472 5322477 +
tgaagtaatgatgtctcatatt

SEQ ID NO: 100391 - DNA, 22 bp, Artificial Sequence
  Synthetic oligonucleotide; CTC chr11 5322472 5322493 5322489 5322494 +
atatttttcattctagaatggc

SEQ ID NO: 100392 - DNA, 22 bp, Artificial Sequence
  Synthetic oligonucleotide; TTT chr11 5322478 5322499 5322495 5322500 +
ttcattctagaatggctatatt

SEQ ID NO: 100393 - DNA, 22 bp, Artificial Sequence
  Synthetic oligonucleotide; TTT chr11 5322479 5322500 5322496 5322501 +
tcattctagaatggctatattt

SEQ ID NO: 100394 - DNA, 22 bp, Artificial Sequence
  Synthetic oligonucleotide; TTT chr11 5322480 5322501 5322497 5322502 +
cattctagaatggctatatttt

SEQ ID NO: 100395 - DNA, 22 bp, Artificial Sequence
  Synthetic oligonucleotide; TTC chr11 5322481 5322502 5322498 5322503 +
attctagaatggctatattttc

SEQ ID NO: 100396 - DNA, 22 bp, Artificial Sequence
  Synthetic oligonucleotide; TTC chr11 5322485 5322506 5322502 5322507 +
tagaatggctatattttctatt

SEQ ID NO: 100397 - DNA, 22 bp, Artificial Sequence
  Synthetic oligonucleotide; CTA chr11 5322487 5322508 5322504 5322509 +
gaatggctatattttctatttt

SEQ ID NO: 100398 - DNA, 22 bp, Artificial Sequence
  Synthetic oligonucleotide; CTA chr11 5322496 5322517 5322513 5322518 +
tattttctatttttgaatagag

SEQ ID NO: 100399 - DNA, 22 bp, Artificial Sequence
  Synthetic oligonucleotide; TTT chr11 5322501 5322522 5322518 5322523 +
tctatttttgaatagagccttg

SEQ ID NO: 100400 - DNA, 22 bp, Artificial Sequence
  Synthetic oligonucleotide; TTT chr11 5322502 5322523 5322519 5322524 +
ctatttttgaatagagccttga

SEQ ID NO: 100401 - DNA, 22 bp, Artificial Sequence
  Synthetic oligonucleotide; TTC chr11 5322503 5322524 5322520 5322525 +
tatttttgaatagagccttgac

SEQ ID NO: 100402 - DNA, 22 bp, Artificial Sequence
  Synthetic oligonucleotide; CTA chr11 5322505 5322526 5322522 5322527 +
tttttgaatagagccttgaccc

SEQ ID NO: 100403 - DNA, 22 bp, Artificial Sequence
  Synthetic oligonucleotide; TTT chr11 5322508 5322529 5322525 5322530 +
ttgaatagagccttgacccttc

SEQ ID NO: 100404 - DNA, 22 bp, Artificial Sequence
  Synthetic oligonucleotide; TTT chr11 5322509 5322530 5322526 5322531 +
tgaatagagccttgacccttcc

SEQ ID NO: 100405 - DNA, 22 bp, Artificial Sequence
  Synthetic oligonucleotide; TTT chr11 5322510 5322531 5322527 5322532 +
gaatagagccttgacccttcct

SEQ ID NO: 100406 - DNA, 22 bp, Artificial Sequence
  Synthetic oligonucleotide; TTG chr11 5322511 5322532 5322528 5322533 +
aatagagccttgacccttccta

SEQ ID NO: 100407 - DNA, 22 bp, Artificial Sequence
  Synthetic oligonucleotide; CTT chr11 5322522 5322543 5322539 5322544 +
gacccttcctattattaggcca

SEQ ID NO: 100408 - DNA, 22 bp, Artificial Sequence
  Synthetic oligonucleotide; TTG chr11 5322523 5322544 5322540 5322545 +
acccttcctattattaggccaa

SEQ ID NO: 100409 - DNA, 22 bp, Artificial Sequence
  Synthetic oligonucleotide; CTT chr11 5322529 5322550 5322546 5322551 +
cctattattaggccaagggaaa

SEQ ID NO: 100410 - DNA, 22 bp, Artificial Sequence
  Synthetic oligonucleotide; TTC chr11 5322530 5322551 5322547 5322552 +
ctattattaggccaagggaaaa

SEQ ID NO: 100411 - DNA, 22 bp, Artificial Sequence
  Synthetic oligonucleotide; CTA chr11 5322533 5322554 5322550 5322555 +
ttattaggccaagggaaaagta

SEQ ID NO: 100412 - DNA, 22 bp, Artificial Sequence
  Synthetic oligonucleotide; TTA chr11 5322536 5322557 5322553 5322558 +
ttaggccaagggaaaagtatgt

SEQ ID NO: 100413 - DNA, 22 bp, Artificial Sequence
  Synthetic oligonucleotide; TTA chr11 5322539 5322560 5322556 5322561 +
ggccaagggaaaagtatgttaa

SEQ ID NO: 100414 - DNA, 22 bp, Artificial Sequence
  Synthetic oligonucleotide; TTA chr11 5322560 5322581 5322577 5322582 +
aaatcatctgaagagcaaacat

SEQ ID NO: 100415 - DNA, 22 bp, Artificial Sequence
  Synthetic oligonucleotide; CTG chr11 5322570 5322591 5322587 5322592 +
aagagcaaacatactcttaaaa

SEQ ID NO: 100416 - DNA, 22 bp, Artificial Sequence
  Synthetic oligonucleotide; CTC chr11 5322586 5322607 5322603 5322608 +
ttaaaaactcactttttacttt

SEQ ID NO: 100417 - DNA, 22 bp, Artificial Sequence
  Synthetic oligonucleotide; CTT chr11 5322588 5322609 5322605 5322610 +
aaaaactcactttttacttttt

SEQ ID NO: 100418 - DNA, 22 bp, Artificial Sequence
  Synthetic oligonucleotide; TTA chr11 5322589 5322610 5322606 5322611 +
aaaactcactttttactttttt

SEQ ID NO: 100419 - DNA, 22 bp, Artificial Sequence
  Synthetic oligonucleotide; CTC chr11 5322596 5322617 5322613 5322618 +
actttttacttttttacgagct

SEQ ID NO: 100420 - DNA, 22 bp, Artificial Sequence
  Synthetic oligonucleotide; CTT chr11 5322600 5322621 5322617 5322622 +
tttacttttttacgagctgaca

SEQ ID NO: 100421 - DNA, 22 bp, Artificial Sequence
  Synthetic oligonucleotide; TTT chr11 5322601 5322622 5322618 5322623 +
ttacttttttacgagctgacaa

SEQ ID NO: 100422 - DNA, 22 bp, Artificial Sequence
  Synthetic oligonucleotide; TTT chr11 5322602 5322623 5322619 5322624 +
tacttttttacgagctgacaag

SEQ ID NO: 100423 - DNA, 22 bp, Artificial Sequence
  Synthetic oligonucleotide; TTT chr11 5322603 5322624 5322620 5322625 +
acttttttacgagctgacaaga

SEQ ID NO: 100424 - DNA, 22 bp, Artificial Sequence
  Synthetic oligonucleotide; TTA chr11 5322604 5322625 5322621 5322626 +
cttttttacgagctgacaagaa

SEQ ID NO: 100425 - DNA, 22 bp, Artificial Sequence
  Synthetic oligonucleotide; CTT chr11 5322607 5322628 5322624 5322629 +
ttttacgagctgacaagaagct

SEQ ID NO: 100426 - DNA, 22 bp, Artificial Sequence
  Synthetic oligonucleotide; TTT chr11 5322608 5322629 5322625 5322630 +
tttacgagctgacaagaagctt

SEQ ID NO: 100427 - DNA, 22 bp, Artificial Sequence
  Synthetic oligonucleotide; TTT chr11 5322609 5322630 5322626 5322631 +
ttacgagctgacaagaagcttg

SEQ ID NO: 100428 - DNA, 22 bp, Artificial Sequence
  Synthetic oligonucleotide; TTT chr11 5322610 5322631 5322627 5322632 +
tacgagctgacaagaagcttgt

SEQ ID NO: 100429 - DNA, 22 bp, Artificial Sequence
  Synthetic oligonucleotide; TTT chr11 5322611 5322632 5322628 5322633 +
acgagctgacaagaagcttgtc

SEQ ID NO: 100430 - DNA, 22 bp, Artificial Sequence
  Synthetic oligonucleotide; TTA chr11 5322612 5322633 5322629 5322634 +
cgagctgacaagaagcttgtct

SEQ ID NO: 100431 - DNA, 22 bp, Artificial Sequence
  Synthetic oligonucleotide; CTG chr11 5322619 5322640 5322636 5322641 +
acaagaagcttgtctaggtttt

SEQ ID NO: 100432 - DNA, 22 bp, Artificial Sequence
  Synthetic oligonucleotide; CTT chr11 5322630 5322651 5322647 5322652 +
gtctaggtttttccttctaaga

SEQ ID NO: 100433 - DNA, 22 bp, Artificial Sequence
  Synthetic oligonucleotide; TTG chr11 5322631 5322652 5322648 5322653 +
tctaggtttttccttctaagat

SEQ ID NO: 100434 - DNA, 22 bp, Artificial Sequence
  Synthetic oligonucleotide; CTA chr11 5322635 5322656 5322652 5322657 +
ggtttttccttctaagattttt

SEQ ID NO: 100435 - DNA, 22 bp, Artificial Sequence
  Synthetic oligonucleotide; TTT chr11 5322640 5322661 5322657 5322662 +
ttccttctaagatttttttggg

SEQ ID NO: 100436 - DNA, 22 bp, Artificial Sequence
  Synthetic oligonucleotide; TTT chr11 5322641 5322662 5322658 5322663 +
tccttctaagatttttttgggc

SEQ ID NO: 100437 - DNA, 22 bp, Artificial Sequence
  Synthetic oligonucleotide; TTT chr11 5322642 5322663 5322659 5322664 +
ccttctaagatttttttgggca

SEQ ID NO: 100438 - DNA, 22 bp, Artificial Sequence
  Synthetic oligonucleotide; TTC chr11 5322643 5322664 5322660 5322665 +
cttctaagatttttttgggcaa

SEQ ID NO: 100439 - DNA, 22 bp, Artificial Sequence
  Synthetic oligonucleotide; CTT chr11 5322646 5322667 5322663 5322668 +
ctaagatttttttgggcaaaag

SEQ ID NO: 100440 - DNA, 22 bp, Artificial Sequence
  Synthetic oligonucleotide; TTC chr11 5322647 5322668 5322664 5322669 +
taagatttttttgggcaaaaga

SEQ ID NO: 100441 - DNA, 22 bp, Artificial Sequence
  Synthetic oligonucleotide; CTA chr11 5322649 5322670 5322666 5322671 +
agatttttttgggcaaaagaat

SEQ ID NO: 100442 - DNA, 22 bp, Artificial Sequence
  Synthetic oligonucleotide; TTT chr11 5322655 5322676 5322672 5322677 +
ttttgggcaaaagaatatttat

SEQ ID NO: 100443 - DNA, 22 bp, Artificial Sequence
  Synthetic oligonucleotide; TTT chr11 5322656 5322677 5322673 5322678 +
tttgggcaaaagaatatttata

SEQ ID NO: 100444 - DNA, 22 bp, Artificial Sequence
  Synthetic oligonucleotide; TTT chr11 5322657 5322678 5322674 5322679 +
ttgggcaaaagaatatttatag

SEQ ID NO: 100445 - DNA, 22 bp, Artificial Sequence
  Synthetic oligonucleotide; TTT chr11 5322658 5322679 5322675 5322680 +
tgggcaaaagaatatttataga

SEQ ID NO: 100446 - DNA, 22 bp, Artificial Sequence
  Synthetic oligonucleotide; TTT chr11 5322659 5322680 5322676 5322681 +
gggcaaaagaatatttatagaa

SEQ ID NO: 100447 - DNA, 22 bp, Artificial Sequence
  Synthetic oligonucleotide; TTG chr11 5322660 5322681 5322677 5322682 +
ggcaaaagaatatttatagaag

SEQ ID NO: 100448 - DNA, 22 bp, Artificial Sequence
  Synthetic oligonucleotide; TTT chr11 5322675 5322696 5322692 5322697 +
atagaagaatgaggtaaagaaa

SEQ ID NO: 100449 - DNA, 22 bp, Artificial Sequence
  Synthetic oligonucleotide; TTA chr11 5322676 5322697 5322693 5322698 +
tagaagaatgaggtaaagaaat

SEQ ID NO: 100450 - DNA, 22 bp, Artificial Sequence
  Synthetic oligonucleotide; CTT chr11 5322704 5322725 5322721 5322726 +
ttataaaatccagacatcctgc

SEQ ID NO: 100451 - DNA, 22 bp, Artificial Sequence
  Synthetic oligonucleotide; TTT chr11 5322705 5322726 5322722 5322727 +
tataaaatccagacatcctgca

SEQ ID NO: 100452 - DNA, 22 bp, Artificial Sequence
  Synthetic oligonucleotide; TTT chr11 5322706 5322727 5322723 5322728 +
ataaaatccagacatcctgcaa

SEQ ID NO: 100453 - DNA, 22 bp, Artificial Sequence
  Synthetic oligonucleotide; TTA chr11 5322707 5322728 5322724 5322729 +
taaaatccagacatcctgcaag

SEQ ID NO: 100454 - DNA, 22 bp, Artificial Sequence
  Synthetic oligonucleotide; CTG chr11 5322725 5322746 5322742 5322747 +
caaggaatgtattgaaaattaa

SEQ ID NO: 100455 - DNA, 22 bp, Artificial Sequence
  Synthetic oligonucleotide; TTG chr11 5322739 5322760 5322756 5322761 +
aaaattaaaaagctcttattga

SEQ ID NO: 100456 - DNA, 22 bp, Artificial Sequence
  Synthetic oligonucleotide; TTA chr11 5322746 5322767 5322763 5322768 +
aaaagctcttattgaaatactc

SEQ ID NO: 100457 - DNA, 22 bp, Artificial Sequence
  Synthetic oligonucleotide; CTC chr11 5322754 5322775 5322771 5322776 +
ttattgaaatactctgtaagtg

SEQ ID NO: 100458 - DNA, 22 bp, Artificial Sequence
  Synthetic oligonucleotide; CTT chr11 5322756 5322777 5322773 5322778 +
attgaaatactctgtaagtgac

SEQ ID NO: 100459 - DNA, 22 bp, Artificial Sequence
  Synthetic oligonucleotide; TTA chr11 5322757 5322778 5322774 5322779 +
ttgaaatactctgtaagtgact

SEQ ID NO: 100460 - DNA, 22 bp, Artificial Sequence
  Synthetic oligonucleotide; TTG chr11 5322760 5322781 5322777 5322782 +
aaatactctgtaagtgacttac

SEQ ID NO: 100461 - DNA, 22 bp, Artificial Sequence
  Synthetic oligonucleotide; CTC chr11 5322768 5322789 5322785 5322790 +
tgtaagtgacttacgactgtat

SEQ ID NO: 100462 - DNA, 22 bp, Artificial Sequence
  Synthetic oligonucleotide; CTG chr11 5322770 5322791 5322787 5322792 +
taagtgacttacgactgtattt

SEQ ID NO: 100463 - DNA, 22 bp, Artificial Sequence
  Synthetic oligonucleotide; CTT chr11 5322780 5322801 5322797 5322802 +
acgactgtatttagaaaatatt

SEQ ID NO: 100464 - DNA, 22 bp, Artificial Sequence
  Synthetic oligonucleotide; TTA chr11 5322781 5322802 5322798 5322803 +
cgactgtatttagaaaatatta

SEQ ID NO: 100465 - DNA, 22 bp, Artificial Sequence
  Synthetic oligonucleotide; CTG chr11 5322787 5322808 5322804 5322809 +
tatttagaaaatattaaatgca

SEQ ID NO: 100466 - DNA, 22 bp, Artificial Sequence
  Synthetic oligonucleotide; TTT chr11 5322792 5322813 5322809 5322814 +
agaaaatattaaatgcaaatca

SEQ ID NO: 100467 - DNA, 22 bp, Artificial Sequence
  Synthetic oligonucleotide; TTA chr11 5322793 5322814 5322810 5322815 +
gaaaatattaaatgcaaatcat

SEQ ID NO: 100468 - DNA, 22 bp, Artificial Sequence
  Synthetic oligonucleotide; TTA chr11 5322803 5322824 5322820 5322825 +
aatgcaaatcatggccctagag

SEQ ID NO: 100469 - DNA, 22 bp, Artificial Sequence
  Synthetic oligonucleotide; CTA chr11 5322822 5322843 5322839 5322844 +
gagagtaccctaactcagggta

SEQ ID NO: 100470 - DNA, 22 bp, Artificial Sequence
  Synthetic oligonucleotide; CTA chr11 5322834 5322855 5322851 5322856 +
actcagggtagaggacagttaa

SEQ ID NO: 100471 - DNA, 22 bp, Artificial Sequence
  Synthetic oligonucleotide; CTC chr11 5322838 5322859 5322855 5322860 +
agggtagaggacagttaaaaga

SEQ ID NO: 100472 - DNA, 22 bp, Artificial Sequence
  Synthetic oligonucleotide; TTA chr11 5322855 5322876 5322872 5322877 +
aaagataaccaacacttactta

SEQ ID NO: 100473 - DNA, 22 bp, Artificial Sequence
  Synthetic oligonucleotide; CTT chr11 5322872 5322893 5322889 5322894 +
acttatttaaaagtaaatttaa

SEQ ID NO: 100474 - DNA, 22 bp, Artificial Sequence
  Synthetic oligonucleotide; TTA chr11 5322873 5322894 5322890 5322895 +
cttatttaaaagtaaatttaaa

SEQ ID NO: 100475 - DNA, 22 bp, Artificial Sequence
  Synthetic oligonucleotide; CTT chr11 5322876 5322897 5322893 5322898 +
atttaaaagtaaatttaaaatg

SEQ ID NO: 100476 - DNA, 22 bp, Artificial Sequence
  Synthetic oligonucleotide; TTA chr11 5322877 5322898 5322894 5322899 +
tttaaaagtaaatttaaaatgt

SEQ ID NO: 100477 - DNA, 22 bp, Artificial Sequence
  Synthetic oligonucleotide; TTT chr11 5322880 5322901 5322897 5322902 +
aaaagtaaatttaaaatgttag

SEQ ID NO: 100478 - DNA, 22 bp, Artificial Sequence
  Synthetic oligonucleotide; TTA chr11 5322881 5322902 5322898 5322903 +
aaagtaaatttaaaatgttagt

SEQ ID NO: 100479 - DNA, 22 bp, Artificial Sequence
  Synthetic oligonucleotide; TTT chr11 5322892 5322913 5322909 5322914 +
aaaatgttagtttcttatcact

SEQ ID NO: 100480 - DNA, 22 bp, Artificial Sequence
  Synthetic oligonucleotide; TTA chr11 5322893 5322914 5322910 5322915 +
aaatgttagtttcttatcacta

SEQ ID NO: 100481 - DNA, 22 bp, Artificial Sequence
  Synthetic oligonucleotide; TTA chr11 5322901 5322922 5322918 5322923 +
gtttcttatcactatatttgcc

SEQ ID NO: 100482 - DNA, 22 bp, Artificial Sequence
  Synthetic oligonucleotide; TTT chr11 5322905 5322926 5322922 5322927 +
cttatcactatatttgccatga

SEQ ID NO: 100483 - DNA, 22 bp, Artificial Sequence
  Synthetic oligonucleotide; TTC chr11 5322906 5322927 5322923 5322928 +
ttatcactatatttgccatgag

SEQ ID NO: 100484 - DNA, 22 bp, Artificial Sequence
  Synthetic oligonucleotide; CTT chr11 5322908 5322929 5322925 5322930 +
atcactatatttgccatgagaa

SEQ ID NO: 100485 - DNA, 22 bp, Artificial Sequence
  Synthetic oligonucleotide; TTA chr11 5322909 5322930 5322926 5322931 +
tcactatatttgccatgagaat

SEQ ID NO: 100486 - DNA, 22 bp, Artificial Sequence
  Synthetic oligonucleotide; CTA chr11 5322915 5322936 5322932 5322937 +
tatttgccatgagaataatgaa

SEQ ID NO: 100487 - DNA, 22 bp, Artificial Sequence
  Synthetic oligonucleotide; TTT chr11 5322920 5322941 5322937 5322942 +
gccatgagaataatgaaaattt

SEQ ID NO: 100488 - DNA, 22 bp, Artificial Sequence
  Synthetic oligonucleotide; TTG chr11 5322921 5322942 5322938 5322943 +
ccatgagaataatgaaaatttt

SEQ ID NO: 100489 - DNA, 22 bp, Artificial Sequence
  Synthetic oligonucleotide; TTT chr11 5322942 5322963 5322959 5322964 +
taaataagaatttatttctaga

SEQ ID NO: 100490 - DNA, 22 bp, Artificial Sequence
  Synthetic oligonucleotide; TTT chr11 5322943 5322964 5322960 5322965 +
aaataagaatttatttctagag

SEQ ID NO: 100491 - DNA, 22 bp, Artificial Sequence
  Synthetic oligonucleotide; TTA chr11 5322944 5322965 5322961 5322966 +
aataagaatttatttctagaga

SEQ ID NO: 100492 - DNA, 22 bp, Artificial Sequence
  Synthetic oligonucleotide; TTT chr11 5322955 5322976 5322972 5322977 +
atttctagagaatgatgatcaa

SEQ ID NO: 100493 - DNA, 22 bp, Artificial Sequence
  Synthetic oligonucleotide; TTA chr11 5322956 5322977 5322973 5322978 +
tttctagagaatgatgatcaac

SEQ ID NO: 100494 - DNA, 22 bp, Artificial Sequence
  Synthetic oligonucleotide; TTT chr11 5322959 5322980 5322976 5322981 +
ctagagaatgatgatcaacttt

SEQ ID NO: 100495 - DNA, 22 bp, Artificial Sequence
  Synthetic oligonucleotide; TTC chr11 5322960 5322981 5322977 5322982 +
tagagaatgatgatcaactttt

SEQ ID NO: 100496 - DNA, 22 bp, Artificial Sequence
  Synthetic oligonucleotide; CTA chr11 5322962 5322983 5322979 5322984 +
gagaatgatgatcaactttttt

SEQ ID NO: 100497 - DNA, 22 bp, Artificial Sequence
  Synthetic oligonucleotide; CTT chr11 5322980 5323001 5322997 5323002 +
ttttttttacacttgtgtgcat

SEQ ID NO: 100498 - DNA, 22 bp, Artificial Sequence
  Synthetic oligonucleotide; TTT chr11 5322981 5323002 5322998 5323003 +
tttttttacacttgtgtgcatt

SEQ ID NO: 100499 - DNA, 22 bp, Artificial Sequence
  Synthetic oligonucleotide; TTT chr11 5322982 5323003 5322999 5323004 +
ttttttacacttgtgtgcatta

SEQ ID NO: 100500 - DNA, 22 bp, Artificial Sequence
  Synthetic oligonucleotide; TTT chr11 5322983 5323004 5323000 5323005 +
tttttacacttgtgtgcattag

SEQ ID NO: 100501 - DNA, 22 bp, Artificial Sequence
  Synthetic oligonucleotide; TTT chr11 5322984 5323005 5323001 5323006 +
ttttacacttgtgtgcattagc

SEQ ID NO: 100502 - DNA, 22 bp, Artificial Sequence
  Synthetic oligonucleotide; TTT chr11 5322985 5323006 5323002 5323007 +
tttacacttgtgtgcattagcc

SEQ ID NO: 100503 - DNA, 22 bp, Artificial Sequence
  Synthetic oligonucleotide; TTT chr11 5322986 5323007 5323003 5323008 +
ttacacttgtgtgcattagcct

SEQ ID NO: 100504 - DNA, 22 bp, Artificial Sequence
  Synthetic oligonucleotide; TTT chr11 5322987 5323008 5323004 5323009 +
tacacttgtgtgcattagccta

SEQ ID NO: 100505 - DNA, 22 bp, Artificial Sequence
  Synthetic oligonucleotide; TTT chr11 5322988 5323009 5323005 5323010 +
acacttgtgtgcattagcctat

SEQ ID NO: 100506 - DNA, 22 bp, Artificial Sequence
  Synthetic oligonucleotide; TTA chr11 5322989 5323010 5323006 5323011 +
cacttgtgtgcattagcctatg

SEQ ID NO: 100507 - DNA, 22 bp, Artificial Sequence
  Synthetic oligonucleotide; CTT chr11 5322994 5323015 5323011 5323016 +
gtgtgcattagcctatgcaaac

SEQ ID NO: 100508 - DNA, 22 bp, Artificial Sequence
  Synthetic oligonucleotide; TTG chr11 5322995 5323016 5323012 5323017 +
tgtgcattagcctatgcaaaca

SEQ ID NO: 100509 - DNA, 22 bp, Artificial Sequence
  Synthetic oligonucleotide; TTA chr11 5323004 5323025 5323021 5323026 +
gcctatgcaaacacataaacat

SEQ ID NO: 100510 - DNA, 22 bp, Artificial Sequence
  Synthetic oligonucleotide; CTA chr11 5323009 5323030 5323026 5323031 +
tgcaaacacataaacatgtatg

SEQ ID NO: 100511 - DNA, 22 bp, Artificial Sequence
  Synthetic oligonucleotide; CTG chr11 5323048 5323069 5323065 5323070 +
aggcaaaagtttttcatagaga

SEQ ID NO: 100512 - DNA, 22 bp, Artificial Sequence
  Synthetic oligonucleotide; TTT chr11 5323060 5323081 5323077 5323082 +
ttcatagagattatatgttctg

SEQ ID NO: 100513 - DNA, 22 bp, Artificial Sequence
  Synthetic oligonucleotide; TTT chr11 5323061 5323082 5323078 5323083 +
tcatagagattatatgttctgc

SEQ ID NO: 100514 - DNA, 22 bp, Artificial Sequence
  Synthetic oligonucleotide; TTT chr11 5323062 5323083 5323079 5323084 +
catagagattatatgttctgcc

SEQ ID NO: 100515 - DNA, 22 bp, Artificial Sequence
  Synthetic oligonucleotide; TTC chr11 5323063 5323084 5323080 5323085 +
atagagattatatgttctgcct

SEQ ID NO: 100516 - DNA, 22 bp, Artificial Sequence
  Synthetic oligonucleotide; TTA chr11 5323073 5323094 5323090 5323095 +
tatgttctgccttttcctcaaa

SEQ ID NO: 100517 - DNA, 22 bp, Artificial Sequence
  Synthetic oligonucleotide; TTC chr11 5323080 5323101 5323097 5323102 +
tgccttttcctcaaatttcact

SEQ ID NO: 100518 - DNA, 22 bp, Artificial Sequence
  Synthetic oligonucleotide; CTG chr11 5323082 5323103 5323099 5323104 +
ccttttcctcaaatttcactga

SEQ ID NO: 100519 - DNA, 22 bp, Artificial Sequence
  Synthetic oligonucleotide; CTT chr11 5323086 5323107 5323103 5323108 +
ttcctcaaatttcactgaggtg

SEQ ID NO: 100520 - DNA, 22 bp, Artificial Sequence
  Synthetic oligonucleotide; TTT chr11 5323087 5323108 5323104 5323109 +
tcctcaaatttcactgaggtgg

SEQ ID NO: 100521 - DNA, 22 bp, Artificial Sequence
  Synthetic oligonucleotide; TTT chr11 5323088 5323109 5323105 5323110 +
cctcaaatttcactgaggtggc

SEQ ID NO: 100522 - DNA, 22 bp, Artificial Sequence
  Synthetic oligonucleotide; TTC chr11 5323089 5323110 5323106 5323111 +
ctcaaatttcactgaggtggct

SEQ ID NO: 100523 - DNA, 22 bp, Artificial Sequence
  Synthetic oligonucleotide; CTC chr11 5323092 5323113 5323109 5323114 +
aaatttcactgaggtggctaat

SEQ ID NO: 100524 - DNA, 22 bp, Artificial Sequence
  Synthetic oligonucleotide; TTT chr11 5323098 5323119 5323115 5323120 +
cactgaggtggctaatttcagg

SEQ ID NO: 100525 - DNA, 22 bp, Artificial Sequence
  Synthetic oligonucleotide; TTC chr11 5323099 5323120 5323116 5323121 +
actgaggtggctaatttcaggt

SEQ ID NO: 100526 - DNA, 22 bp, Artificial Sequence
  Synthetic oligonucleotide; CTG chr11 5323103 5323124 5323120 5323125 +
aggtggctaatttcaggtgcat

SEQ ID NO: 100527 - DNA, 22 bp, Artificial Sequence
  Synthetic oligonucleotide; CTA chr11 5323112 5323133 5323129 5323134 +
atttcaggtgcatttgaaagaa

SEQ ID NO: 100528 - DNA, 22 bp, Artificial Sequence
  Synthetic oligonucleotide; TTT chr11 5323116 5323137 5323133 5323138 +
caggtgcatttgaaagaagaat

SEQ ID NO: 100529 - DNA, 22 bp, Artificial Sequence
  Synthetic oligonucleotide; TTC chr11 5323117 5323138 5323134 5323139 +
aggtgcatttgaaagaagaatt

SEQ ID NO: 100530 - DNA, 22 bp, Artificial Sequence
  Synthetic oligonucleotide; TTT chr11 5323127 5323148 5323144 5323149 +
gaaagaagaatttaaatataga

SEQ ID NO: 100531 - DNA, 22 bp, Artificial Sequence
  Synthetic oligonucleotide; TTG chr11 5323128 5323149 5323145 5323150 +
aaagaagaatttaaatatagac

SEQ ID NO: 100532 - DNA, 22 bp, Artificial Sequence
  Synthetic oligonucleotide; TTT chr11 5323140 5323161 5323157 5323162 +
aaatatagactttttcagttcc

SEQ ID NO: 100533 - DNA, 22 bp, Artificial Sequence
  Synthetic oligonucleotide; TTA chr11 5323141 5323162 5323158 5323163 +
aatatagactttttcagttcca

SEQ ID NO: 100534 - DNA, 22 bp, Artificial Sequence
  Synthetic oligonucleotide; CTT chr11 5323152 5323173 5323169 5323174 +
tttcagttccatatggtctatt

SEQ ID NO: 100535 - DNA, 22 bp, Artificial Sequence
  Synthetic oligonucleotide; TTT chr11 5323153 5323174 5323170 5323175 +
ttcagttccatatggtctattc

SEQ ID NO: 100536 - DNA, 22 bp, Artificial Sequence
  Synthetic oligonucleotide; TTT chr11 5323154 5323175 5323171 5323176 +
tcagttccatatggtctattca

SEQ ID NO: 100537 - DNA, 22 bp, Artificial Sequence
  Synthetic oligonucleotide; TTT chr11 5323155 5323176 5323172 5323177 +
cagttccatatggtctattcag

SEQ ID NO: 100538 - DNA, 22 bp, Artificial Sequence
  Synthetic oligonucleotide; TTC chr11 5323156 5323177 5323173 5323178 +
agttccatatggtctattcagt

SEQ ID NO: 100539 - DNA, 22 bp, Artificial Sequence
  Synthetic oligonucleotide; TTC chr11 5323161 5323182 5323178 5323183 +
catatggtctattcagtgttct

SEQ ID NO: 100540 - DNA, 22 bp, Artificial Sequence
  Synthetic oligonucleotide; CTA chr11 5323172 5323193 5323189 5323194 +
ttcagtgttctgtcaccagact

SEQ ID NO: 100541 - DNA, 22 bp, Artificial Sequence
  Synthetic oligonucleotide; TTC chr11 5323175 5323196 5323192 5323197 +
agtgttctgtcaccagacttct

SEQ ID NO: 100542 - DNA, 22 bp, Artificial Sequence
  Synthetic oligonucleotide; TTC chr11 5323182 5323203 5323199 5323204 +
tgtcaccagacttctcctaaga

SEQ ID NO: 100543 - DNA, 22 bp, Artificial Sequence
  Synthetic oligonucleotide; CTG chr11 5323184 5323205 5323201 5323206 +
tcaccagacttctcctaagata

SEQ ID NO: 100544 - DNA, 22 bp, Artificial Sequence
  Synthetic oligonucleotide; CTT chr11 5323195 5323216 5323212 5323217 +
ctcctaagatatgcccccaacc

SEQ ID NO: 100545 - DNA, 22 bp, Artificial Sequence
  Synthetic oligonucleotide; TTC chr11 5323196 5323217 5323213 5323218 +
tcctaagatatgcccccaaccc

SEQ ID NO: 100546 - DNA, 22 bp, Artificial Sequence
  Synthetic oligonucleotide; CTC chr11 5323198 5323219 5323215 5323220 +
ctaagatatgcccccaacccta

SEQ ID NO: 100547 - DNA, 22 bp, Artificial Sequence
  Synthetic oligonucleotide; CTA chr11 5323201 5323222 5323218 5323223 +
agatatgcccccaaccctatgg

SEQ ID NO: 100548 - DNA, 22 bp, Artificial Sequence
  Synthetic oligonucleotide; CTA chr11 5323220 5323241 5323237 5323242 +
tggtaaagtacttaagtccttg

SEQ ID NO: 100549 - DNA, 22 bp, Artificial Sequence
  Synthetic oligonucleotide; CTT chr11 5323233 5323254 5323250 5323255 +
aagtccttgtgagtgacaacat

SEQ ID NO: 100550 - DNA, 22 bp, Artificial Sequence
  Synthetic oligonucleotide; TTA chr11 5323234 5323255 5323251 5323256 +
agtccttgtgagtgacaacatt

SEQ ID NO: 100551 - DNA, 22 bp, Artificial Sequence
  Synthetic oligonucleotide; CTT chr11 5323241 5323262 5323258 5323263 +
gtgagtgacaacattgtcttcc

SEQ ID NO: 100552 - DNA, 22 bp, Artificial Sequence
  Synthetic oligonucleotide; TTG chr11 5323242 5323263 5323259 5323264 +
tgagtgacaacattgtcttcca

SEQ ID NO: 100553 - DNA, 22 bp, Artificial Sequence
  Synthetic oligonucleotide; TTG chr11 5323257 5323278 5323274 5323279 +
tcttccagtatacccttgctct

SEQ ID NO: 100554 - DNA, 22 bp, Artificial Sequence
  Synthetic oligonucleotide; CTT chr11 5323261 5323282 5323278 5323283 +
ccagtatacccttgctctttgc

SEQ ID NO: 100555 - DNA, 22 bp, Artificial Sequence
  Synthetic oligonucleotide; TTC chr11 5323262 5323283 5323279 5323284 +
cagtatacccttgctctttgct

SEQ ID NO: 100556 - DNA, 22 bp, Artificial Sequence
  Synthetic oligonucleotide; CTT chr11 5323274 5323295 5323291 5323296 +
gctctttgctaagaaagaactc

SEQ ID NO: 100557 - DNA, 22 bp, Artificial Sequence
  Synthetic oligonucleotide; TTG chr11 5323275 5323296 5323292 5323297 +
ctctttgctaagaaagaactcc

SEQ ID NO: 100558 - DNA, 22 bp, Artificial Sequence
  Synthetic oligonucleotide; CTC chr11 5323278 5323299 5323295 5323300 +
tttgctaagaaagaactccagg

SEQ ID NO: 100559 - DNA, 22 bp, Artificial Sequence
  Synthetic oligonucleotide; CTT chr11 5323280 5323301 5323297 5323302 +
tgctaagaaagaactccaggct

SEQ ID NO: 100560 - DNA, 22 bp, Artificial Sequence
  Synthetic oligonucleotide; TTT chr11 5323281 5323302 5323298 5323303 +
gctaagaaagaactccaggctt

SEQ ID NO: 100561 - DNA, 22 bp, Artificial Sequence
  Synthetic oligonucleotide; TTG chr11 5323282 5323303 5323299 5323304 +
ctaagaaagaactccaggcttt

SEQ ID NO: 100562 - DNA, 22 bp, Artificial Sequence
  Synthetic oligonucleotide; CTA chr11 5323285 5323306 5323302 5323307 +
agaaagaactccaggctttcat

SEQ ID NO: 100563 - DNA, 22 bp, Artificial Sequence
  Synthetic oligonucleotide; CTC chr11 5323296 5323317 5323313 5323318 +
caggctttcatttttcattctg

SEQ ID NO: 100564 - DNA, 22 bp, Artificial Sequence
  Synthetic oligonucleotide; CTT chr11 5323303 5323324 5323320 5323325 +
tcatttttcattctggcttcat

SEQ ID NO: 100565 - DNA, 22 bp, Artificial Sequence
  Synthetic oligonucleotide; TTT chr11 5323304 5323325 5323321 5323326 +
catttttcattctggcttcatt

SEQ ID NO: 100566 - DNA, 22 bp, Artificial Sequence
  Synthetic oligonucleotide; TTC chr11 5323305 5323326 5323322 5323327 +
atttttcattctggcttcattt

SEQ ID NO: 100567 - DNA, 22 bp, Artificial Sequence
  Synthetic oligonucleotide; TTT chr11 5323309 5323330 5323326 5323331 +
ttcattctggcttcatttttat

SEQ ID NO: 100568 - DNA, 22 bp, Artificial Sequence
  Synthetic oligonucleotide; TTT chr11 5323310 5323331 5323327 5323332 +
tcattctggcttcatttttatg

SEQ ID NO: 100569 - DNA, 22 bp, Artificial Sequence
  Synthetic oligonucleotide; TTT chr11 5323311 5323332 5323328 5323333 +
cattctggcttcatttttatgt

SEQ ID NO: 100570 - DNA, 22 bp, Artificial Sequence
  Synthetic oligonucleotide; TTC chr11 5323312 5323333 5323329 5323334 +
attctggcttcatttttatgtc

SEQ ID NO: 100571 - DNA, 22 bp, Artificial Sequence
  Synthetic oligonucleotide; TTC chr11 5323316 5323337 5323333 5323338 +
tggcttcatttttatgtctgtg

SEQ ID NO: 100572 - DNA, 22 bp, Artificial Sequence
  Synthetic oligonucleotide; CTG chr11 5323318 5323339 5323335 5323340 +
gcttcatttttatgtctgtgtc

SEQ ID NO: 100573 - DNA, 22 bp, Artificial Sequence
  Synthetic oligonucleotide; CTT chr11 5323322 5323343 5323339 5323344 +
catttttatgtctgtgtctgat

SEQ ID NO: 100574 - DNA, 22 bp, Artificial Sequence
  Synthetic oligonucleotide; TTC chr11 5323323 5323344 5323340 5323345 +
atttttatgtctgtgtctgatt

SEQ ID NO: 100575 - DNA, 22 bp, Artificial Sequence
  Synthetic oligonucleotide; TTT chr11 5323327 5323348 5323344 5323349 +
ttatgtctgtgtctgattctcc

SEQ ID NO: 100576 - DNA, 22 bp, Artificial Sequence
  Synthetic oligonucleotide; TTT chr11 5323328 5323349 5323345 5323350 +
tatgtctgtgtctgattctcca

SEQ ID NO: 100577 - DNA, 22 bp, Artificial Sequence
  Synthetic oligonucleotide; TTT chr11 5323329 5323350 5323346 5323351 +
atgtctgtgtctgattctccag

SEQ ID NO: 100578 - DNA, 22 bp, Artificial Sequence
  Synthetic oligonucleotide; TTA chr11 5323330 5323351 5323347 5323352 +
tgtctgtgtctgattctccaga

SEQ ID NO: 100579 - DNA, 22 bp, Artificial Sequence
  Synthetic oligonucleotide; CTG chr11 5323336 5323357 5323353 5323358 +
tgtctgattctccagatccgag

SEQ ID NO: 100580 - DNA, 22 bp, Artificial Sequence
  Synthetic oligonucleotide; CTG chr11 5323342 5323363 5323359 5323364 +
attctccagatccgagtttaac

SEQ ID NO: 100581 - DNA, 22 bp, Artificial Sequence
  Synthetic oligonucleotide; TTC chr11 5323346 5323367 5323363 5323368 +
tccagatccgagtttaactact

SEQ ID NO: 100582 - DNA, 22 bp, Artificial Sequence
  Synthetic oligonucleotide; CTC chr11 5323348 5323369 5323365 5323370 +
cagatccgagtttaactactaa

SEQ ID NO: 100583 - DNA, 22 bp, Artificial Sequence
  Synthetic oligonucleotide; TTT chr11 5323361 5323382 5323378 5323383 +
aactactaaacctatgtttaga

SEQ ID NO: 100584 - DNA, 22 bp, Artificial Sequence
  Synthetic oligonucleotide; TTA chr11 5323362 5323383 5323379 5323384 +
actactaaacctatgtttagat

SEQ ID NO: 100585 - DNA, 22 bp, Artificial Sequence
  Synthetic oligonucleotide; CTA chr11 5323366 5323387 5323383 5323388 +
ctaaacctatgtttagataaaa

SEQ ID NO: 100586 - DNA, 22 bp, Artificial Sequence
  Synthetic oligonucleotide; CTA chr11 5323369 5323390 5323386 5323391 +
aacctatgtttagataaaaggc

SEQ ID NO: 100587 - DNA, 22 bp, Artificial Sequence
  Synthetic oligonucleotide; CTA chr11 5323375 5323396 5323392 5323397 +
tgtttagataaaaggcggataa

SEQ ID NO: 100588 - DNA, 22 bp, Artificial Sequence
  Synthetic oligonucleotide; TTT chr11 5323380 5323401 5323397 5323402 +
agataaaaggcggataatgcca

SEQ ID NO: 100589 - DNA, 22 bp, Artificial Sequence
  Synthetic oligonucleotide; TTA chr11 5323381 5323402 5323398 5323403 +
gataaaaggcggataatgccat

SEQ ID NO: 100590 - DNA, 22 bp, Artificial Sequence
  Synthetic oligonucleotide; TTG chr11 5323407 5323428 5323424 5323429 +
tatttgcttggttttgatgctg

SEQ ID NO: 100591 - DNA, 22 bp, Artificial Sequence
  Synthetic oligonucleotide; TTT chr11 5323412 5323433 5323429 5323434 +
gcttggttttgatgctgtagat

SEQ ID NO: 100592 - DNA, 22 bp, Artificial Sequence
  Synthetic oligonucleotide; TTG chr11 5323413 5323434 5323430 5323435 +
cttggttttgatgctgtagatg

SEQ ID NO: 100593 - DNA, 22 bp, Artificial Sequence
  Synthetic oligonucleotide; CTT chr11 5323416 5323437 5323433 5323438 +
ggttttgatgctgtagatgaca

SEQ ID NO: 100594 - DNA, 22 bp, Artificial Sequence
  Synthetic oligonucleotide; TTG chr11 5323417 5323438 5323434 5323439 +
gttttgatgctgtagatgacag

SEQ ID NO: 100595 - DNA, 22 bp, Artificial Sequence
  Synthetic oligonucleotide; TTT chr11 5323421 5323442 5323438 5323443 +
tgatgctgtagatgacagggtt

SEQ ID NO: 100596 - DNA, 22 bp, Artificial Sequence
  Synthetic oligonucleotide; TTT chr11 5323422 5323443 5323439 5323444 +
gatgctgtagatgacagggttc

SEQ ID NO: 100597 - DNA, 22 bp, Artificial Sequence
  Synthetic oligonucleotide; TTG chr11 5323423 5323444 5323440 5323445 +
atgctgtagatgacagggttca

SEQ ID NO: 100598 - DNA, 22 bp, Artificial Sequence
  Synthetic oligonucleotide; CTG chr11 5323429 5323450 5323446 5323451 +
tagatgacagggttcattaaag

SEQ ID NO: 100599 - DNA, 22 bp, Artificial Sequence
  Synthetic oligonucleotide; TTC chr11 5323444 5323465 5323461 5323466 +
attaaaggaggaaagaggaagt

SEQ ID NO: 100600 - DNA, 22 bp, Artificial Sequence
  Synthetic oligonucleotide; TTA chr11 5323448 5323469 5323465 5323470 +
aaggaggaaagaggaagtagat

SEQ ID NO: 100601 - DNA, 22 bp, Artificial Sequence
  Synthetic oligonucleotide; CTC chr11 5323477 5323498 5323494 5323499 +
atgataatgtggacaacctctg

SEQ ID NO: 100602 - DNA, 22 bp, Artificial Sequence
  Synthetic oligonucleotide; CTC chr11 5323497 5323518 5323514 5323519 +
tggcacattcttcccaaatctg

SEQ ID NO: 100603 - DNA, 22 bp, Artificial Sequence
  Synthetic oligonucleotide; CTG chr11 5323499 5323520 5323516 5323521 +
gcacattcttcccaaatctgta

SEQ ID NO: 100604 - DNA, 22 bp, Artificial Sequence
  Synthetic oligonucleotide; TTC chr11 5323507 5323528 5323524 5323529 +
ttcccaaatctgtaaatgaatg

SEQ ID NO: 100605 - DNA, 22 bp, Artificial Sequence
  Synthetic oligonucleotide; CTT chr11 5323509 5323530 5323526 5323531 +
cccaaatctgtaaatgaatgtc

SEQ ID NO: 100606 - DNA, 22 bp, Artificial Sequence
  Synthetic oligonucleotide; TTC chr11 5323510 5323531 5323527 5323532 +
ccaaatctgtaaatgaatgtca

SEQ ID NO: 100607 - DNA, 22 bp, Artificial Sequence
  Synthetic oligonucleotide; CTG chr11 5323519 5323540 5323536 5323541 +
taaatgaatgtcaaacccatca

SEQ ID NO: 100608 - DNA, 22 bp, Artificial Sequence
  Synthetic oligonucleotide; CTG chr11 5323544 5323565 5323561 5323566 +
taacatagaagataagaacaca

SEQ ID NO: 100609 - DNA, 22 bp, Artificial Sequence
  Synthetic oligonucleotide; CTA chr11 5323570 5323591 5323587 5323592 +
atgtgggagatacaggtattga

SEQ ID NO: 100610 - DNA, 22 bp, Artificial Sequence
  Synthetic oligonucleotide; TTG chr11 5323591 5323612 5323608 5323613 +
agggctttggctctctcttcac

SEQ ID NO: 100611 - DNA, 22 bp, Artificial Sequence
  Synthetic oligonucleotide; CTT chr11 5323598 5323619 5323615 5323620 +
tggctctctcttcaccagaagc

SEQ ID NO: 100612 - DNA, 22 bp, Artificial Sequence
  Synthetic oligonucleotide; TTT chr11 5323599 5323620 5323616 5323621 +
ggctctctcttcaccagaagca

SEQ ID NO: 100613 - DNA, 22 bp, Artificial Sequence
  Synthetic oligonucleotide; TTG chr11 5323600 5323621 5323617 5323622 +
gctctctcttcaccagaagcaa

SEQ ID NO: 100614 - DNA, 22 bp, Artificial Sequence
  Synthetic oligonucleotide; CTC chr11 5323604 5323625 5323621 5323626 +
tctcttcaccagaagcaatgcc

SEQ ID NO: 100615 - DNA, 22 bp, Artificial Sequence
  Synthetic oligonucleotide; CTC chr11 5323606 5323627 5323623 5323628 +
tcttcaccagaagcaatgccta

SEQ ID NO: 100616 - DNA, 22 bp, Artificial Sequence
  Synthetic oligonucleotide; CTC chr11 5323608 5323629 5323625 5323630 +
ttcaccagaagcaatgcctatg

SEQ ID NO: 100617 - DNA, 22 bp, Artificial Sequence
  Synthetic oligonucleotide; CTT chr11 5323610 5323631 5323627 5323632 +
caccagaagcaatgcctatgac

SEQ ID NO: 100618 - DNA, 22 bp, Artificial Sequence
  Synthetic oligonucleotide; TTC chr11 5323611 5323632 5323628 5323633 +
accagaagcaatgcctatgaca

SEQ ID NO: 100619 - DNA, 22 bp, Artificial Sequence
  Synthetic oligonucleotide; CTA chr11 5323628 5323649 5323645 5323650 +
tgacagtattaagaattagaat

SEQ ID NO: 100620 - DNA, 22 bp, Artificial Sequence
  Synthetic oligonucleotide; TTA chr11 5323639 5323660 5323656 5323661 +
agaattagaatataggagaaga

SEQ ID NO: 100621 - DNA, 22 bp, Artificial Sequence
  Synthetic oligonucleotide; TTA chr11 5323646 5323667 5323663 5323668 +
gaatataggagaagaggatgat

SEQ ID NO: 100622 - DNA, 22 bp, Artificial Sequence
  Synthetic oligonucleotide; CTA chr11 5323679 5323700 5323696 5323701 +
ggaagattgttaaagagatcaa

SEQ ID NO: 100623 - DNA, 22 bp, Artificial Sequence
  Synthetic oligonucleotide; TTG chr11 5323688 5323709 5323705 5323710 +
ttaaagagatcaaaattacagg

SEQ ID NO: 100624 - DNA, 22 bp, Artificial Sequence
  Synthetic oligonucleotide; TTA chr11 5323691 5323712 5323708 5323713 +
aagagatcaaaattacagggta

SEQ ID NO: 100625 - DNA, 22 bp, Artificial Sequence
  Synthetic oligonucleotide; TTA chr11 5323706 5323727 5323723 5323728 +
cagggtaaagtctattgaaagt

SEQ ID NO: 100626 - DNA, 22 bp, Artificial Sequence
  Synthetic oligonucleotide; CTA chr11 5323720 5323741 5323737 5323742 +
ttgaaagttatgtcagcacaag

SEQ ID NO: 100627 - DNA, 22 bp, Artificial Sequence
  Synthetic oligonucleotide; TTG chr11 5323723 5323744 5323740 5323745 +
aaagttatgtcagcacaagcca

SEQ ID NO: 100628 - DNA, 22 bp, Artificial Sequence
  Synthetic oligonucleotide; TTA chr11 5323730 5323751 5323747 5323752 +
tgtcagcacaagccagtctcat

SEQ ID NO: 100629 - DNA, 22 bp, Artificial Sequence
  Synthetic oligonucleotide; CTC chr11 5323750 5323771 5323767 5323772 +
atgatttcttggtggaggcaga

SEQ ID NO: 100630 - DNA, 22 bp, Artificial Sequence
  Synthetic oligonucleotide; TTT chr11 5323757 5323778 5323774 5323779 +
cttggtggaggcagaaagcacg

SEQ ID NO: 100631 - DNA, 22 bp, Artificial Sequence
  Synthetic oligonucleotide; TTC chr11 5323758 5323779 5323775 5323780 +
ttggtggaggcagaaagcacgt

SEQ ID NO: 100632 - DNA, 22 bp, Artificial Sequence
  Synthetic oligonucleotide; CTT chr11 5323760 5323781 5323777 5323782 +
ggtggaggcagaaagcacgtgt

SEQ ID NO: 100633 - DNA, 22 bp, Artificial Sequence
  Synthetic oligonucleotide; TTG chr11 5323761 5323782 5323778 5323783 +
gtggaggcagaaagcacgtgtg

SEQ ID NO: 100634 - DNA, 22 bp, Artificial Sequence
  Synthetic oligonucleotide; TTT chr11 5323797 5323818 5323814 5323819 +
gcaatatgaaaatgaaaaaaga

SEQ ID NO: 100635 - DNA, 22 bp, Artificial Sequence
  Synthetic oligonucleotide; TTG chr11 5323798 5323819 5323815 5323820 +
caatatgaaaatgaaaaaagac

SEQ ID NO: 100636 - DNA, 22 bp, Artificial Sequence
  Synthetic oligonucleotide; TTA chr11 5323829 5323850 5323846 5323851 +
caggcaggatggatacaaaacc

SEQ ID NO: 100637 - DNA, 22 bp, Artificial Sequence
  Synthetic oligonucleotide; CTT chr11 5323855 5323876 5323872 5323877 +
agaaacactcccactcctaacg

SEQ ID NO: 100638 - DNA, 22 bp, Artificial Sequence
  Synthetic oligonucleotide; TTA chr11 5323856 5323877 5323873 5323878 +
gaaacactcccactcctaacgc

SEQ ID NO: 100639 - DNA, 22 bp, Artificial Sequence
  Synthetic oligonucleotide; CTC chr11 5323865 5323886 5323882 5323887 +
ccactcctaacgctatgactct

SEQ ID NO: 100640 - DNA, 22 bp, Artificial Sequence
  Synthetic oligonucleotide; CTC chr11 5323871 5323892 5323888 5323893 +
ctaacgctatgactctagtatt

SEQ ID NO: 100641 - DNA, 22 bp, Artificial Sequence
  Synthetic oligonucleotide; CTA chr11 5323874 5323895 5323891 5323896 +
acgctatgactctagtattggt

SEQ ID NO: 100642 - DNA, 22 bp, Artificial Sequence
  Synthetic oligonucleotide; CTA chr11 5323880 5323901 5323897 5323902 +
tgactctagtattggtgagaat

SEQ ID NO: 100643 - DNA, 22 bp, Artificial Sequence
  Synthetic oligonucleotide; CTC chr11 5323886 5323907 5323903 5323908 +
tagtattggtgagaatggaagc

SEQ ID NO: 100644 - DNA, 22 bp, Artificial Sequence
  Synthetic oligonucleotide; CTA chr11 5323888 5323909 5323905 5323910 +
gtattggtgagaatggaagcat

SEQ ID NO: 100645 - DNA, 22 bp, Artificial Sequence
  Synthetic oligonucleotide; TTG chr11 5323894 5323915 5323911 5323916 +
gtgagaatggaagcatatctca

SEQ ID NO: 100646 - DNA, 22 bp, Artificial Sequence
  Synthetic oligonucleotide; CTC chr11 5323915 5323936 5323932 5323937 +
aaaggattgcggatggcaatga

SEQ ID NO: 100647 - DNA, 22 bp, Artificial Sequence
  Synthetic oligonucleotide; TTG chr11 5323924 5323945 5323941 5323946 +
cggatggcaatgaaacaatcat

SEQ ID NO: 100648 - DNA, 22 bp, Artificial Sequence
  Synthetic oligonucleotide; TTG chr11 5323955 5323976 5323972 5323977 +
ccaggagggaacctgattccac

SEQ ID NO: 100649 - DNA, 22 bp, Artificial Sequence
  Synthetic oligonucleotide; CTG chr11 5323970 5323991 5323987 5323992 +
attccacaacagaaagggagtg

SEQ ID NO: 100650 - DNA, 22 bp, Artificial Sequence
  Synthetic oligonucleotide; TTC chr11 5323974 5323995 5323991 5323996 +
cacaacagaaagggagtgaata

SEQ ID NO: 100651 - DNA, 22 bp, Artificial Sequence
  Synthetic oligonucleotide; CTG chr11 5324007 5324028 5324024 5324029 +
taggaagcagcccacactgcta

SEQ ID NO: 100652 - DNA, 22 bp, Artificial Sequence
  Synthetic oligonucleotide; CTG chr11 5324026 5324047 5324043 5324048 +
ctaatctccctgtgattcaccc

SEQ ID NO: 100653 - DNA, 22 bp, Artificial Sequence
  Synthetic oligonucleotide; CTA chr11 5324029 5324050 5324046 5324051 +
atctccctgtgattcacccata

SEQ ID NO: 100654 - DNA, 22 bp, Artificial Sequence
  Synthetic oligonucleotide; CTC chr11 5324034 5324055 5324051 5324056 +
cctgtgattcacccataggatg

SEQ ID NO: 100655 - DNA, 22 bp, Artificial Sequence
  Synthetic oligonucleotide; CTG chr11 5324038 5324059 5324055 5324060 +
tgattcacccataggatgccca

SEQ ID NO: 100656 - DNA, 22 bp, Artificial Sequence
  Synthetic oligonucleotide; TTC chr11 5324044 5324065 5324061 5324066 +
acccataggatgcccattacag

SEQ ID NO: 100657 - DNA, 22 bp, Artificial Sequence
  Synthetic oligonucleotide; TTA chr11 5324063 5324084 5324080 5324085 +
cagtaggcatcgtggtcaatgt

SEQ ID NO: 100658 - DNA, 22 bp, Artificial Sequence
  Synthetic oligonucleotide; CTG chr11 5324099 5324120 5324116 5324121 +
tgcctgccagcatggtgaggaa

SEQ ID NO: 100659 - DNA, 22 bp, Artificial Sequence
  Synthetic oligonucleotide; CTG chr11 5324105 5324126 5324122 5324127 +
ccagcatggtgaggaagtagta

SEQ ID NO: 100660 - DNA, 22 bp, Artificial Sequence
  Synthetic oligonucleotide; CTC chr11 5324136 5324157 5324153 5324158 +
atgaagactgtggtcatgcttg

SEQ ID NO: 100661 - DNA, 22 bp, Artificial Sequence
  Synthetic oligonucleotide; CTG chr11 5324146 5324167 5324163 5324168 +
tggtcatgcttgatgaggtaga

SEQ ID NO: 100662 - DNA, 22 bp, Artificial Sequence
  Synthetic oligonucleotide; CTT chr11 5324157 5324178 5324174 5324179 +
gatgaggtagaggagcatgcca

SEQ ID NO: 100663 - DNA, 22 bp, Artificial Sequence
  Synthetic oligonucleotide; TTG chr11 5324158 5324179 5324175 5324180 +
atgaggtagaggagcatgccat

SEQ ID NO: 100664 - DNA, 22 bp, Artificial Sequence
  Synthetic oligonucleotide; TTG chr11 5324182 5324203 5324199 5324204 +
cccagaaggatgcacacataaa

SEQ ID NO: 100665 - DNA, 22 bp, Artificial Sequence
  Synthetic oligonucleotide; CTG chr11 5324240 5324261 5324257 5324262 +
cctccagccctggaaagccagt

SEQ ID NO: 100666 - DNA, 22 bp, Artificial Sequence
  Synthetic oligonucleotide; CTC chr11 5324244 5324265 5324261 5324266 +
cagccctggaaagccagtcagc

SEQ ID NO: 100667 - DNA, 22 bp, Artificial Sequence
  Synthetic oligonucleotide; CTG chr11 5324252 5324273 5324269 5324274 +
gaaagccagtcagcaaaaaagg

SEQ ID NO: 100668 - DNA, 22 bp, Artificial Sequence
  Synthetic oligonucleotide; CTG chr11 5324279 5324300 5324296 5324301 +
cagtaatattgggccacatagt

SEQ ID NO: 100669 - DNA, 22 bp, Artificial Sequence
  Synthetic oligonucleotide; TTG chr11 5324290 5324311 5324307 5324312 +
ggccacatagtgtatccaccgg

SEQ ID NO: 100670 - DNA, 22 bp, Artificial Sequence
  Synthetic oligonucleotide; TTT chr11 5324326 5324347 5324343 5324348 +
cttgaaaccttgaaaccaggag

SEQ ID NO: 100671 - DNA, 22 bp, Artificial Sequence
  Synthetic oligonucleotide; TTC chr11 5324327 5324348 5324344 5324349 +
ttgaaaccttgaaaccaggagc

SEQ ID NO: 100672 - DNA, 22 bp, Artificial Sequence
  Synthetic oligonucleotide; CTT chr11 5324329 5324350 5324346 5324351 +
gaaaccttgaaaccaggagcct

SEQ ID NO: 100673 - DNA, 22 bp, Artificial Sequence
  Synthetic oligonucleotide; TTG chr11 5324330 5324351 5324347 5324352 +
aaaccttgaaaccaggagcctc

SEQ ID NO: 100674 - DNA, 22 bp, Artificial Sequence
  Synthetic oligonucleotide; CTT chr11 5324337 5324358 5324354 5324359 +
gaaaccaggagcctccaatctt

SEQ ID NO: 100675 - DNA, 22 bp, Artificial Sequence
  Synthetic oligonucleotide; TTG chr11 5324338 5324359 5324355 5324360 +
aaaccaggagcctccaatcttc

SEQ ID NO: 100676 - DNA, 22 bp, Artificial Sequence
  Synthetic oligonucleotide; CTC chr11 5324352 5324373 5324369 5324374 +
caatcttcctgcttggagatga

SEQ ID NO: 100677 - DNA, 22 bp, Artificial Sequence
  Synthetic oligonucleotide; CTT chr11 5324359 5324380 5324376 5324381 +
cctgcttggagatgattaactg

SEQ ID NO: 100678 - DNA, 22 bp, Artificial Sequence
  Synthetic oligonucleotide; TTC chr11 5324360 5324381 5324377 5324382 +
ctgcttggagatgattaactgg

SEQ ID NO: 100679 - DNA, 22 bp, Artificial Sequence
  Synthetic oligonucleotide; CTG chr11 5324363 5324384 5324380 5324385 +
cttggagatgattaactggtgt

SEQ ID NO: 100680 - DNA, 22 bp, Artificial Sequence
  Synthetic oligonucleotide; CTT chr11 5324366 5324387 5324383 5324388 +
ggagatgattaactggtgtgat

SEQ ID NO: 100681 - DNA, 22 bp, Artificial Sequence
  Synthetic oligonucleotide; TTG chr11 5324367 5324388 5324384 5324389 +
gagatgattaactggtgtgata

SEQ ID NO: 100682 - DNA, 22 bp, Artificial Sequence
  Synthetic oligonucleotide; TTA chr11 5324377 5324398 5324394 5324399 +
actggtgtgataaatttgactc

SEQ ID NO: 100683 - DNA, 22 bp, Artificial Sequence
  Synthetic oligonucleotide; CTG chr11 5324381 5324402 5324398 5324403 +
gtgtgataaatttgactctgca

SEQ ID NO: 100684 - DNA, 22 bp, Artificial Sequence
  Synthetic oligonucleotide; TTT chr11 5324394 5324415 5324411 5324416 +
gactctgcaactattttcctga

SEQ ID NO: 100685 - DNA, 22 bp, Artificial Sequence
  Synthetic oligonucleotide; TTG chr11 5324395 5324416 5324412 5324417 +
actctgcaactattttcctgaa

SEQ ID NO: 100686 - DNA, 22 bp, Artificial Sequence
  Synthetic oligonucleotide; CTC chr11 5324399 5324420 5324416 5324421 +
tgcaactattttcctgaagaag

SEQ ID NO: 100687 - DNA, 22 bp, Artificial Sequence
  Synthetic oligonucleotide; CTG chr11 5324401 5324422 5324418 5324423 +
caactattttcctgaagaagaa

SEQ ID NO: 100688 - DNA, 22 bp, Artificial Sequence
  Synthetic oligonucleotide; CTA chr11 5324407 5324428 5324424 5324429 +
ttttcctgaagaagaatagcat

SEQ ID NO: 100689 - DNA, 22 bp, Artificial Sequence
  Synthetic oligonucleotide; TTT chr11 5324410 5324431 5324427 5324432 +
tcctgaagaagaatagcatgta

SEQ ID NO: 100690 - DNA, 22 bp, Artificial Sequence
  Synthetic oligonucleotide; TTT chr11 5324411 5324432 5324428 5324433 +
cctgaagaagaatagcatgtac

SEQ ID NO: 100691 - DNA, 22 bp, Artificial Sequence
  Synthetic oligonucleotide; TTC chr11 5324412 5324433 5324429 5324434 +
ctgaagaagaatagcatgtaca

SEQ ID NO: 100692 - DNA, 22 bp, Artificial Sequence
  Synthetic oligonucleotide; CTG chr11 5324415 5324436 5324432 5324437 +
aagaagaatagcatgtacagac

SEQ ID NO: 100693 - DNA, 22 bp, Artificial Sequence
  Synthetic oligonucleotide; CTA chr11 5324439 5324460 5324456 5324461 +
tggttttttccctaattagaaa

SEQ ID NO: 100694 - DNA, 22 bp, Artificial Sequence
  Synthetic oligonucleotide; TTT chr11 5324445 5324466 5324462 5324467 +
tttccctaattagaaaaaatac

SEQ ID NO: 100695 - DNA, 22 bp, Artificial Sequence
  Synthetic oligonucleotide; TTT chr11 5324446 5324467 5324463 5324468 +
ttccctaattagaaaaaatact

SEQ ID NO: 100696 - DNA, 22 bp, Artificial Sequence
  Synthetic oligonucleotide; TTT chr11 5324447 5324468 5324464 5324469 +
tccctaattagaaaaaatactg

SEQ ID NO: 100697 - DNA, 22 bp, Artificial Sequence
  Synthetic oligonucleotide; TTT chr11 5324448 5324469 5324465 5324470 +
ccctaattagaaaaaatactga

SEQ ID NO: 100698 - DNA, 22 bp, Artificial Sequence
  Synthetic oligonucleotide; TTC chr11 5324449 5324470 5324466 5324471 +
cctaattagaaaaaatactgag

SEQ ID NO: 100699 - DNA, 22 bp, Artificial Sequence
  Synthetic oligonucleotide; CTA chr11 5324453 5324474 5324470 5324475 +
attagaaaaaatactgagttaa

SEQ ID NO: 100700 - DNA, 22 bp, Artificial Sequence
  Synthetic oligonucleotide; TTA chr11 5324457 5324478 5324474 5324479 +
gaaaaaatactgagttaatggt

SEQ ID NO: 100701 - DNA, 22 bp, Artificial Sequence
  Synthetic oligonucleotide; CTG chr11 5324469 5324490 5324486 5324491 +
agttaatggttcgatttttctc

SEQ ID NO: 100702 - DNA, 22 bp, Artificial Sequence
  Synthetic oligonucleotide; TTA chr11 5324474 5324495 5324491 5324496 +
atggttcgatttttctcaaatt

SEQ ID NO: 100703 - DNA, 22 bp, Artificial Sequence
  Synthetic oligonucleotide; TTC chr11 5324481 5324502 5324498 5324503 +
gatttttctcaaattcaaaaat

SEQ ID NO: 100704 - DNA, 22 bp, Artificial Sequence
  Synthetic oligonucleotide; TTT chr11 5324486 5324507 5324503 5324508 +
ttctcaaattcaaaaatttttc

SEQ ID NO: 100705 - DNA, 22 bp, Artificial Sequence
  Synthetic oligonucleotide; TTT chr11 5324487 5324508 5324504 5324509 +
tctcaaattcaaaaatttttca

SEQ ID NO: 100706 - DNA, 22 bp, Artificial Sequence
  Synthetic oligonucleotide; TTT chr11 5324488 5324509 5324505 5324510 +
ctcaaattcaaaaatttttcat

SEQ ID NO: 100707 - DNA, 22 bp, Artificial Sequence
  Synthetic oligonucleotide; TTC chr11 5324489 5324510 5324506 5324511 +
tcaaattcaaaaatttttcatt

SEQ ID NO: 100708 - DNA, 22 bp, Artificial Sequence
  Synthetic oligonucleotide; CTC chr11 5324491 5324512 5324508 5324513 +
aaattcaaaaatttttcattaa

SEQ ID NO: 100709 - DNA, 22 bp, Artificial Sequence
  Synthetic oligonucleotide; TTC chr11 5324497 5324518 5324514 5324519 +
aaaaatttttcattaattttaa

SEQ ID NO: 100710 - DNA, 22 bp, Artificial Sequence
  Synthetic oligonucleotide; TTT chr11 5324505 5324526 5324522 5324527 +
ttcattaattttaaatatatta

SEQ ID NO: 100711 - DNA, 22 bp, Artificial Sequence
  Synthetic oligonucleotide; TTT chr11 5324506 5324527 5324523 5324528 +
tcattaattttaaatatattat

SEQ ID NO: 100712 - DNA, 22 bp, Artificial Sequence
  Synthetic oligonucleotide; TTT chr11 5324507 5324528 5324524 5324529 +
cattaattttaaatatattatc

SEQ ID NO: 100713 - DNA, 22 bp, Artificial Sequence
  Synthetic oligonucleotide; TTC chr11 5324508 5324529 5324525 5324530 +
attaattttaaatatattatcc

SEQ ID NO: 100714 - DNA, 22 bp, Artificial Sequence
  Synthetic oligonucleotide; TTA chr11 5324512 5324533 5324529 5324534 +
attttaaatatattatccgcaa

SEQ ID NO: 100715 - DNA, 22 bp, Artificial Sequence
  Synthetic oligonucleotide; TTT chr11 5324516 5324537 5324533 5324538 +
taaatatattatccgcaactat

SEQ ID NO: 100716 - DNA, 22 bp, Artificial Sequence
  Synthetic oligonucleotide; TTT chr11 5324517 5324538 5324534 5324539 +
aaatatattatccgcaactatt

SEQ ID NO: 100717 - DNA, 22 bp, Artificial Sequence
  Synthetic oligonucleotide; TTA chr11 5324518 5324539 5324535 5324540 +
aatatattatccgcaactattt

SEQ ID NO: 100718 - DNA, 22 bp, Artificial Sequence
  Synthetic oligonucleotide; TTA chr11 5324527 5324548 5324544 5324549 +
tccgcaactattttgagggtac

SEQ ID NO: 100719 - DNA, 22 bp, Artificial Sequence
  Synthetic oligonucleotide; CTA chr11 5324537 5324558 5324554 5324559 +
ttttgagggtacttataaatat

SEQ ID NO: 100720 - DNA, 22 bp, Artificial Sequence
  Synthetic oligonucleotide; TTT chr11 5324540 5324561 5324557 5324562 +
tgagggtacttataaatatttg

SEQ ID NO: 100721 - DNA, 22 bp, Artificial Sequence
  Synthetic oligonucleotide; TTT chr11 5324541 5324562 5324558 5324563 +
gagggtacttataaatatttgc

SEQ ID NO: 100722 - DNA, 22 bp, Artificial Sequence
  Synthetic oligonucleotide; TTG chr11 5324542 5324563 5324559 5324564 +
agggtacttataaatatttgca

SEQ ID NO: 100723 - DNA, 22 bp, Artificial Sequence
  Synthetic oligonucleotide; CTT chr11 5324551 5324572 5324568 5324573 +
ataaatatttgcaacaacagtg

SEQ ID NO: 100724 - DNA, 22 bp, Artificial Sequence
  Synthetic oligonucleotide; TTA chr11 5324552 5324573 5324569 5324574 +
taaatatttgcaacaacagtga

SEQ ID NO: 100725 - DNA, 22 bp, Artificial Sequence
  Synthetic oligonucleotide; TTT chr11 5324561 5324582 5324578 5324583 +
gcaacaacagtgataacaaaaa

SEQ ID NO: 100726 - DNA, 22 bp, Artificial Sequence
  Synthetic oligonucleotide; TTG chr11 5324562 5324583 5324579 5324584 +
caacaacagtgataacaaaaac

SEQ ID NO: 100727 - DNA, 22 bp, Artificial Sequence
  Synthetic oligonucleotide; CTG chr11 5324620 5324641 5324637 5324642 +
gcttagttgtcttcttgctgtg

SEQ ID NO: 100728 - DNA, 22 bp, Artificial Sequence
  Synthetic oligonucleotide; CTT chr11 5324624 5324645 5324641 5324646 +
agttgtcttcttgctgtgatta

SEQ ID NO: 100729 - DNA, 22 bp, Artificial Sequence
  Synthetic oligonucleotide; TTA chr11 5324625 5324646 5324642 5324647 +
gttgtcttcttgctgtgattac

SEQ ID NO: 100730 - DNA, 22 bp, Artificial Sequence
  Synthetic oligonucleotide; TTG chr11 5324629 5324650 5324646 5324651 +
tcttcttgctgtgattactgac

SEQ ID NO: 100731 - DNA, 22 bp, Artificial Sequence
  Synthetic oligonucleotide; CTT chr11 5324633 5324654 5324650 5324655 +
cttgctgtgattactgaccatt

SEQ ID NO: 100732 - DNA, 22 bp, Artificial Sequence
  Synthetic oligonucleotide; TTC chr11 5324634 5324655 5324651 5324656 +
ttgctgtgattactgaccattt

SEQ ID NO: 100733 - DNA, 22 bp, Artificial Sequence
  Synthetic oligonucleotide; CTT chr11 5324636 5324657 5324653 5324658 +
gctgtgattactgaccatttgg

SEQ ID NO: 100734 - DNA, 22 bp, Artificial Sequence
  Synthetic oligonucleotide; TTG chr11 5324637 5324658 5324654 5324659 +
ctgtgattactgaccatttgga

SEQ ID NO: 100735 - DNA, 22 bp, Artificial Sequence
  Synthetic oligonucleotide; CTG chr11 5324640 5324661 5324657 5324662 +
tgattactgaccatttggaaat

SEQ ID NO: 100736 - DNA, 22 bp, Artificial Sequence
  Synthetic oligonucleotide; TTA chr11 5324646 5324667 5324663 5324668 +
ctgaccatttggaaatgattgt

SEQ ID NO: 100737 - DNA, 22 bp, Artificial Sequence
  Synthetic oligonucleotide; CTG chr11 5324649 5324670 5324666 5324671 +
accatttggaaatgattgttgt

SEQ ID NO: 100738 - DNA, 22 bp, Artificial Sequence
  Synthetic oligonucleotide; TTT chr11 5324656 5324677 5324673 5324678 +
ggaaatgattgttgtaatttta

SEQ ID NO: 100739 - DNA, 22 bp, Artificial Sequence
  Synthetic oligonucleotide; TTG chr11 5324657 5324678 5324674 5324679 +
gaaatgattgttgtaattttac

SEQ ID NO: 100740 - DNA, 22 bp, Artificial Sequence
  Synthetic oligonucleotide; TTG chr11 5324667 5324688 5324684 5324689 +
ttgtaattttacatttcacgat

SEQ ID NO: 100741 - DNA, 22 bp, Artificial Sequence
  Synthetic oligonucleotide; TTG chr11 5324670 5324691 5324687 5324692 +
taattttacatttcacgattat

SEQ ID NO: 100742 - DNA, 22 bp, Artificial Sequence
  Synthetic oligonucleotide; TTT chr11 5324676 5324697 5324693 5324698 +
tacatttcacgattatgatgaa

SEQ ID NO: 100743 - DNA, 22 bp, Artificial Sequence
  Synthetic oligonucleotide; TTT chr11 5324677 5324698 5324694 5324699 +
acatttcacgattatgatgaag

SEQ ID NO: 100744 - DNA, 22 bp, Artificial Sequence
  Synthetic oligonucleotide; TTA chr11 5324678 5324699 5324695 5324700 +
catttcacgattatgatgaaga

SEQ ID NO: 100745 - DNA, 22 bp, Artificial Sequence
  Synthetic oligonucleotide; TTT chr11 5324683 5324704 5324700 5324705 +
cacgattatgatgaagacagtt

SEQ ID NO: 100746 - DNA, 22 bp, Artificial Sequence
  Synthetic oligonucleotide; TTC chr11 5324684 5324705 5324701 5324706 +
acgattatgatgaagacagttt

SEQ ID NO: 100747 - DNA, 22 bp, Artificial Sequence
  Synthetic oligonucleotide; TTA chr11 5324691 5324712 5324708 5324713 +
tgatgaagacagttttttcagt

SEQ ID NO: 100748 - DNA, 22 bp, Artificial Sequence
  Synthetic oligonucleotide; TTT chr11 5324706 5324727 5324723 5324728 +
tttcagttaatgcagtttttct

SEQ ID NO: 100749 - DNA, 22 bp, Artificial Sequence
  Synthetic oligonucleotide; TTT chr11 5324707 5324728 5324724 5324729 +
ttcagttaatgcagtttttctc

SEQ ID NO: 100750 - DNA, 22 bp, Artificial Sequence
  Synthetic oligonucleotide; TTT chr11 5324708 5324729 5324725 5324730 +
tcagttaatgcagtttttctca

SEQ ID NO: 100751 - DNA, 22 bp, Artificial Sequence
  Synthetic oligonucleotide; TTT chr11 5324709 5324730 5324726 5324731 +
cagttaatgcagtttttctcat

SEQ ID NO: 100752 - DNA, 22 bp, Artificial Sequence
  Synthetic oligonucleotide; TTC chr11 5324710 5324731 5324727 5324732 +
agttaatgcagtttttctcatt

SEQ ID NO: 100753 - DNA, 22 bp, Artificial Sequence
  Synthetic oligonucleotide; TTA chr11 5324715 5324736 5324732 5324737 +
atgcagtttttctcattttttt

SEQ ID NO: 100754 - DNA, 22 bp, Artificial Sequence
  Synthetic oligonucleotide; TTT chr11 5324724 5324745 5324741 5324746 +
ttctcattttttttggaaattg

SEQ ID NO: 100755 - DNA, 22 bp, Artificial Sequence
  Synthetic oligonucleotide; TTT chr11 5324725 5324746 5324742 5324747 +
tctcattttttttggaaattga

SEQ ID NO: 100756 - DNA, 22 bp, Artificial Sequence
  Synthetic oligonucleotide; TTT chr11 5324726 5324747 5324743 5324748 +
ctcattttttttggaaattgaa

SEQ ID NO: 100757 - DNA, 22 bp, Artificial Sequence
  Synthetic oligonucleotide; TTC chr11 5324727 5324748 5324744 5324749 +
tcattttttttggaaattgaat

SEQ ID NO: 100758 - DNA, 22 bp, Artificial Sequence
  Synthetic oligonucleotide; CTC chr11 5324729 5324750 5324746 5324751 +
attttttttggaaattgaatgt

SEQ ID NO: 100759 - DNA, 22 bp, Artificial Sequence
  Synthetic oligonucleotide; TTT chr11 5324733 5324754 5324750 5324755 +
tttttggaaattgaatgtcagt

SEQ ID NO: 100760 - DNA, 22 bp, Artificial Sequence
  Synthetic oligonucleotide; TTT chr11 5324734 5324755 5324751 5324756 +
ttttggaaattgaatgtcagtg

SEQ ID NO: 100761 - DNA, 22 bp, Artificial Sequence
  Synthetic oligonucleotide; TTT chr11 5324735 5324756 5324752 5324757 +
tttggaaattgaatgtcagtgt

SEQ ID NO: 100762 - DNA, 22 bp, Artificial Sequence
  Synthetic oligonucleotide; TTT chr11 5324736 5324757 5324753 5324758 +
ttggaaattgaatgtcagtgtt

SEQ ID NO: 100763 - DNA, 22 bp, Artificial Sequence
  Synthetic oligonucleotide; TTT chr11 5324737 5324758 5324754 5324759 +
tggaaattgaatgtcagtgttt

SEQ ID NO: 100764 - DNA, 22 bp, Artificial Sequence
  Synthetic oligonucleotide; TTT chr11 5324738 5324759 5324755 5324760 +
ggaaattgaatgtcagtgtttt

SEQ ID NO: 100765 - DNA, 22 bp, Artificial Sequence
  Synthetic oligonucleotide; TTG chr11 5324739 5324760 5324756 5324761 +
gaaattgaatgtcagtgtttta

SEQ ID NO: 100766 - DNA, 22 bp, Artificial Sequence
  Synthetic oligonucleotide; TTG chr11 5324746 5324767 5324763 5324768 +
aatgtcagtgttttatgcacta

SEQ ID NO: 100767 - DNA, 22 bp, Artificial Sequence
  Synthetic oligonucleotide; TTT chr11 5324759 5324780 5324776 5324781 +
tatgcactatagcgtgcatcac

SEQ ID NO: 100768 - DNA, 22 bp, Artificial Sequence
  Synthetic oligonucleotide; TTT chr11 5324760 5324781 5324777 5324782 +
atgcactatagcgtgcatcacc

SEQ ID NO: 100769 - DNA, 22 bp, Artificial Sequence
  Synthetic oligonucleotide; TTA chr11 5324761 5324782 5324778 5324783 +
tgcactatagcgtgcatcacca

SEQ ID NO: 100770 - DNA, 22 bp, Artificial Sequence
  Synthetic oligonucleotide; CTA chr11 5324768 5324789 5324785 5324790 +
tagcgtgcatcaccatcactac

SEQ ID NO: 100771 - DNA, 22 bp, Artificial Sequence
  Synthetic oligonucleotide; CTA chr11 5324789 5324810 5324806 5324811 +
ccaatgaacggctttgtcactc

SEQ ID NO: 100772 - DNA, 22 bp, Artificial Sequence
  Synthetic oligonucleotide; CTT chr11 5324803 5324824 5324820 5324825 +
tgtcactctaacagttacttga

SEQ ID NO: 100773 - DNA, 22 bp, Artificial Sequence
  Synthetic oligonucleotide; TTT chr11 5324804 5324825 5324821 5324826 +
gtcactctaacagttacttgag

SEQ ID NO: 100774 - DNA, 22 bp, Artificial Sequence
  Synthetic oligonucleotide; TTG chr11 5324805 5324826 5324822 5324827 +
tcactctaacagttacttgagc

SEQ ID NO: 100775 - DNA, 22 bp, Artificial Sequence
  Synthetic oligonucleotide; CTC chr11 5324811 5324832 5324828 5324833 +
taacagttacttgagcttggcc

SEQ ID NO: 100776 - DNA, 22 bp, Artificial Sequence
  Synthetic oligonucleotide; CTA chr11 5324813 5324834 5324830 5324835 +
acagttacttgagcttggccac

SEQ ID NO: 100777 - DNA, 22 bp, Artificial Sequence
  Synthetic oligonucleotide; TTA chr11 5324820 5324841 5324837 5324842 +
cttgagcttggccaccagagtt

SEQ ID NO: 100778 - DNA, 22 bp, Artificial Sequence
  Synthetic oligonucleotide; CTT chr11 5324823 5324844 5324840 5324845 +
gagcttggccaccagagttgtg

SEQ ID NO: 100779 - DNA, 22 bp, Artificial Sequence
  Synthetic oligonucleotide; TTG chr11 5324824 5324845 5324841 5324846 +
agcttggccaccagagttgtgg

SEQ ID NO: 100780 - DNA, 22 bp, Artificial Sequence
  Synthetic oligonucleotide; CTT chr11 5324829 5324850 5324846 5324851 +
ggccaccagagttgtggatcac

SEQ ID NO: 100781 - DNA, 22 bp, Artificial Sequence
  Synthetic oligonucleotide; TTG chr11 5324830 5324851 5324847 5324852 +
gccaccagagttgtggatcaca

SEQ ID NO: 100782 - DNA, 22 bp, Artificial Sequence
  Synthetic oligonucleotide; TTG chr11 5324843 5324864 5324860 5324865 +
tggatcacagactagacgcagc

SEQ ID NO: 100783 - DNA, 22 bp, Artificial Sequence
  Synthetic oligonucleotide; CTA chr11 5324857 5324878 5324874 5324879 +
gacgcagctaacaagcagcggg

SEQ ID NO: 100784 - DNA, 22 bp, Artificial Sequence
  Synthetic oligonucleotide; CTA chr11 5324867 5324888 5324884 5324889 +
acaagcagcgggcttgttaggc

SEQ ID NO: 100785 - DNA, 22 bp, Artificial Sequence
  Synthetic oligonucleotide; CTT chr11 5324882 5324903 5324899 5324904 +
gttaggcatgcagcctcagatt

SEQ ID NO: 100786 - DNA, 22 bp, Artificial Sequence
  Synthetic oligonucleotide; TTG chr11 5324883 5324904 5324900 5324905 +
ttaggcatgcagcctcagattc

SEQ ID NO: 100787 - DNA, 22 bp, Artificial Sequence
  Synthetic oligonucleotide; TTA chr11 5324886 5324907 5324903 5324908 +
ggcatgcagcctcagattctgc

SEQ ID NO: 100788 - DNA, 22 bp, Artificial Sequence
  Synthetic oligonucleotide; CTC chr11 5324899 5324920 5324916 5324921 +
agattctgccccttccaacatt

SEQ ID NO: 100789 - DNA, 22 bp, Artificial Sequence
  Synthetic oligonucleotide; TTC chr11 5324905 5324926 5324922 5324927 +
tgccccttccaacattctgaat

SEQ ID NO: 100790 - DNA, 22 bp, Artificial Sequence
  Synthetic oligonucleotide; CTG chr11 5324907 5324928 5324924 5324929 +
ccccttccaacattctgaatca

SEQ ID NO: 100791 - DNA, 22 bp, Artificial Sequence
  Synthetic oligonucleotide; CTT chr11 5324913 5324934 5324930 5324935 +
ccaacattctgaatcaaattcg

SEQ ID NO: 100792 - DNA, 22 bp, Artificial Sequence
  Synthetic oligonucleotide; TTC chr11 5324914 5324935 5324931 5324936 +
caacattctgaatcaaattcgc

SEQ ID NO: 100793 - DNA, 22 bp, Artificial Sequence
  Synthetic oligonucleotide; TTC chr11 5324922 5324943 5324939 5324944 +
tgaatcaaattcgcttttttca

SEQ ID NO: 100794 - DNA, 22 bp, Artificial Sequence
  Synthetic oligonucleotide; CTG chr11 5324924 5324945 5324941 5324946 +
aatcaaattcgcttttttcagg

SEQ ID NO: 100795 - DNA, 22 bp, Artificial Sequence
  Synthetic oligonucleotide; TTC chr11 5324934 5324955 5324951 5324956 +
gcttttttcaggtcctcaggtg

SEQ ID NO: 100796 - DNA, 22 bp, Artificial Sequence
  Synthetic oligonucleotide; CTT chr11 5324938 5324959 5324955 5324960 +
ttttcaggtcctcaggtgattc

SEQ ID NO: 100797 - DNA, 22 bp, Artificial Sequence
  Synthetic oligonucleotide; TTT chr11 5324939 5324960 5324956 5324961 +
tttcaggtcctcaggtgattcc

SEQ ID NO: 100798 - DNA, 22 bp, Artificial Sequence
  Synthetic oligonucleotide; TTT chr11 5324940 5324961 5324957 5324962 +
ttcaggtcctcaggtgattcca

SEQ ID NO: 100799 - DNA, 22 bp, Artificial Sequence
  Synthetic oligonucleotide; TTT chr11 5324941 5324962 5324958 5324963 +
tcaggtcctcaggtgattccag

SEQ ID NO: 100800 - DNA, 22 bp, Artificial Sequence
  Synthetic oligonucleotide; TTT chr11 5324942 5324963 5324959 5324964 +
caggtcctcaggtgattccagt

SEQ ID NO: 100801 - DNA, 22 bp, Artificial Sequence
  Synthetic oligonucleotide; TTC chr11 5324943 5324964 5324960 5324965 +
aggtcctcaggtgattccagtg

SEQ ID NO: 100802 - DNA, 22 bp, Artificial Sequence
  Synthetic oligonucleotide; CTC chr11 5324951 5324972 5324968 5324973 +
aggtgattccagtgcaaaacaa

SEQ ID NO: 100803 - DNA, 22 bp, Artificial Sequence
  Synthetic oligonucleotide; TTC chr11 5324960 5324981 5324977 5324982 +
cagtgcaaaacaatgtctgggc

SEQ ID NO: 100804 - DNA, 22 bp, Artificial Sequence
  Synthetic oligonucleotide; CTG chr11 5324979 5325000 5324996 5325001 +
ggcatcactgctataagcattt

SEQ ID NO: 100805 - DNA, 22 bp, Artificial Sequence
  Synthetic oligonucleotide; CTG chr11 5324989 5325010 5325006 5325011 +
ctataagcatttcatacctaat

SEQ ID NO: 100806 - DNA, 22 bp, Artificial Sequence
  Synthetic oligonucleotide; CTA chr11 5324992 5325013 5325009 5325014 +
taagcatttcatacctaatcca

SEQ ID NO: 100807 - DNA, 22 bp, Artificial Sequence
  Synthetic oligonucleotide; TTT chr11 5325001 5325022 5325018 5325023 +
catacctaatccatctttcgag

SEQ ID NO: 100808 - DNA, 22 bp, Artificial Sequence
  Synthetic oligonucleotide; TTC chr11 5325002 5325023 5325019 5325024 +
atacctaatccatctttcgaga

SEQ ID NO: 100809 - DNA, 22 bp, Artificial Sequence
  Synthetic oligonucleotide; CTA chr11 5325009 5325030 5325026 5325031 +
atccatctttcgagatagaaac

SEQ ID NO: 100810 - DNA, 22 bp, Artificial Sequence
  Synthetic oligonucleotide; CTT chr11 5325018 5325039 5325035 5325040 +
tcgagatagaaaccttttaatg

SEQ ID NO: 100811 - DNA, 22 bp, Artificial Sequence
  Synthetic oligonucleotide; TTT chr11 5325019 5325040 5325036 5325041 +
cgagatagaaaccttttaatgc

SEQ ID NO: 100812 - DNA, 22 bp, Artificial Sequence
  Synthetic oligonucleotide; TTC chr11 5325020 5325041 5325037 5325042 +
gagatagaaaccttttaatgct

SEQ ID NO: 100813 - DNA, 22 bp, Artificial Sequence
  Synthetic oligonucleotide; CTT chr11 5325034 5325055 5325051 5325056 +
ttaatgcttccatccagttgat

SEQ ID NO: 100814 - DNA, 22 bp, Artificial Sequence
  Synthetic oligonucleotide; TTT chr11 5325035 5325056 5325052 5325057 +
taatgcttccatccagttgatt

SEQ ID NO: 100815 - DNA, 22 bp, Artificial Sequence
  Synthetic oligonucleotide; TTT chr11 5325036 5325057 5325053 5325058 +
aatgcttccatccagttgattt

SEQ ID NO: 100816 - DNA, 22 bp, Artificial Sequence
  Synthetic oligonucleotide; TTA chr11 5325037 5325058 5325054 5325059 +
atgcttccatccagttgatttt

SEQ ID NO: 100817 - DNA, 22 bp, Artificial Sequence
  Synthetic oligonucleotide; CTT chr11 5325043 5325064 5325060 5325065 +
ccatccagttgattttctcatt

SEQ ID NO: 100818 - DNA, 22 bp, Artificial Sequence
  Synthetic oligonucleotide; TTC chr11 5325044 5325065 5325061 5325066 +
catccagttgattttctcattt

SEQ ID NO: 100819 - DNA, 22 bp, Artificial Sequence
  Synthetic oligonucleotide; TTG chr11 5325054 5325075 5325071 5325076 +
attttctcattttctccaaata

SEQ ID NO: 100820 - DNA, 22 bp, Artificial Sequence
  Synthetic oligonucleotide; TTT chr11 5325058 5325079 5325075 5325080 +
tctcattttctccaaatatctt

SEQ ID NO: 100821 - DNA, 22 bp, Artificial Sequence
  Synthetic oligonucleotide; TTT chr11 5325059 5325080 5325076 5325081 +
ctcattttctccaaatatcttc

SEQ ID NO: 100822 - DNA, 22 bp, Artificial Sequence
  Synthetic oligonucleotide; TTC chr11 5325060 5325081 5325077 5325082 +
tcattttctccaaatatcttca

SEQ ID NO: 100823 - DNA, 22 bp, Artificial Sequence
  Synthetic oligonucleotide; CTC chr11 5325062 5325083 5325079 5325084 +
attttctccaaatatcttcata

SEQ ID NO: 100824 - DNA, 22 bp, Artificial Sequence
  Synthetic oligonucleotide; TTT chr11 5325066 5325087 5325083 5325088 +
tctccaaatatcttcatacaat

SEQ ID NO: 100825 - DNA, 22 bp, Artificial Sequence
  Synthetic oligonucleotide; TTT chr11 5325067 5325088 5325084 5325089 +
ctccaaatatcttcatacaatt

SEQ ID NO: 100826 - DNA, 22 bp, Artificial Sequence
  Synthetic oligonucleotide; TTC chr11 5325068 5325089 5325085 5325090 +
tccaaatatcttcatacaatta

SEQ ID NO: 100827 - DNA, 22 bp, Artificial Sequence
  Synthetic oligonucleotide; CTC chr11 5325070 5325091 5325087 5325092 +
caaatatcttcatacaattatc

SEQ ID NO: 100828 - DNA, 22 bp, Artificial Sequence
  Synthetic oligonucleotide; CTT chr11 5325080 5325101 5325097 5325102 +
catacaattatcttttttatgt

SEQ ID NO: 100829 - DNA, 22 bp, Artificial Sequence
  Synthetic oligonucleotide; TTC chr11 5325081 5325102 5325098 5325103 +
atacaattatcttttttatgtt

SEQ ID NO: 100830 - DNA, 22 bp, Artificial Sequence
  Synthetic oligonucleotide; TTA chr11 5325090 5325111 5325107 5325112 +
tcttttttatgtttctttcacc

SEQ ID NO: 100831 - DNA, 22 bp, Artificial Sequence
  Synthetic oligonucleotide; CTT chr11 5325094 5325115 5325111 5325116 +
ttttatgtttctttcaccattt

SEQ ID NO: 100832 - DNA, 22 bp, Artificial Sequence
  Synthetic oligonucleotide; TTT chr11 5325095 5325116 5325112 5325117 +
tttatgtttctttcaccattta

SEQ ID NO: 100833 - DNA, 22 bp, Artificial Sequence
  Synthetic oligonucleotide; TTT chr11 5325096 5325117 5325113 5325118 +
ttatgtttctttcaccatttac

SEQ ID NO: 100834 - DNA, 22 bp, Artificial Sequence
  Synthetic oligonucleotide; TTT chr11 5325097 5325118 5325114 5325119 +
tatgtttctttcaccatttact

SEQ ID NO: 100835 - DNA, 22 bp, Artificial Sequence
  Synthetic oligonucleotide; TTT chr11 5325098 5325119 5325115 5325120 +
atgtttctttcaccatttactg

SEQ ID NO: 100836 - DNA, 22 bp, Artificial Sequence
  Synthetic oligonucleotide; TTA chr11 5325099 5325120 5325116 5325121 +
tgtttctttcaccatttactgg

SEQ ID NO: 100837 - DNA, 22 bp, Artificial Sequence
  Synthetic oligonucleotide; TTT chr11 5325104 5325125 5325121 5325126 +
ctttcaccatttactggctttc

SEQ ID NO: 100838 - DNA, 22 bp, Artificial Sequence
  Synthetic oligonucleotide; TTC chr11 5325105 5325126 5325122 5325127 +
tttcaccatttactggctttct

SEQ ID NO: 100839 - DNA, 22 bp, Artificial Sequence
  Synthetic oligonucleotide; CTT chr11 5325107 5325128 5325124 5325129 +
tcaccatttactggctttcttt

SEQ ID NO: 100840 - DNA, 22 bp, Artificial Sequence
  Synthetic oligonucleotide; TTT chr11 5325108 5325129 5325125 5325130 +
caccatttactggctttctttc

SEQ ID NO: 100841 - DNA, 22 bp, Artificial Sequence
  Synthetic oligonucleotide; TTC chr11 5325109 5325130 5325126 5325131 +
accatttactggctttctttct

SEQ ID NO: 100842 - DNA, 22 bp, Artificial Sequence
  Synthetic oligonucleotide; TTT chr11 5325116 5325137 5325133 5325138 +
actggctttctttctgccactt

SEQ ID NO: 100843 - DNA, 22 bp, Artificial Sequence
  Synthetic oligonucleotide; TTA chr11 5325117 5325138 5325134 5325139 +
ctggctttctttctgccacttg

SEQ ID NO: 100844 - DNA, 22 bp, Artificial Sequence
  Synthetic oligonucleotide; CTG chr11 5325120 5325141 5325137 5325142 +
gctttctttctgccacttgccc

SEQ ID NO: 100845 - DNA, 22 bp, Artificial Sequence
  Synthetic oligonucleotide; CTT chr11 5325124 5325145 5325141 5325146 +
tctttctgccacttgccctttc

SEQ ID NO: 100846 - DNA, 22 bp, Artificial Sequence
  Synthetic oligonucleotide; TTT chr11 5325125 5325146 5325142 5325147 +
ctttctgccacttgccctttcc

SEQ ID NO: 100847 - DNA, 22 bp, Artificial Sequence
  Synthetic oligonucleotide; TTC chr11 5325126 5325147 5325143 5325148 +
tttctgccacttgccctttcca

SEQ ID NO: 100848 - DNA, 22 bp, Artificial Sequence
  Synthetic oligonucleotide; CTT chr11 5325128 5325149 5325145 5325150 +
tctgccacttgccctttccaac

SEQ ID NO: 100849 - DNA, 22 bp, Artificial Sequence
  Synthetic oligonucleotide; TTT chr11 5325129 5325150 5325146 5325151 +
ctgccacttgccctttccaaca

SEQ ID NO: 100850 - DNA, 22 bp, Artificial Sequence
  Synthetic oligonucleotide; TTC chr11 5325130 5325151 5325147 5325152 +
tgccacttgccctttccaacat

SEQ ID NO: 100851 - DNA, 22 bp, Artificial Sequence
  Synthetic oligonucleotide; CTG chr11 5325132 5325153 5325149 5325154 +
ccacttgccctttccaacatta

SEQ ID NO: 100852 - DNA, 22 bp, Artificial Sequence
  Synthetic oligonucleotide; CTT chr11 5325138 5325159 5325155 5325160 +
gccctttccaacattatttccc

SEQ ID NO: 100853 - DNA, 22 bp, Artificial Sequence
  Synthetic oligonucleotide; TTG chr11 5325139 5325160 5325156 5325161 +
ccctttccaacattatttccca

SEQ ID NO: 100854 - DNA, 22 bp, Artificial Sequence
  Synthetic oligonucleotide; CTT chr11 5325144 5325165 5325161 5325166 +
tccaacattatttcccataatt

SEQ ID NO: 100855 - DNA, 22 bp, Artificial Sequence
  Synthetic oligonucleotide; TTT chr11 5325145 5325166 5325162 5325167 +
ccaacattatttcccataatta

SEQ ID NO: 100856 - DNA, 22 bp, Artificial Sequence
  Synthetic oligonucleotide; TTC chr11 5325146 5325167 5325163 5325168 +
caacattatttcccataattaa

SEQ ID NO: 100857 - DNA, 22 bp, Artificial Sequence
  Synthetic oligonucleotide; TTA chr11 5325154 5325175 5325171 5325176 +
tttcccataattaaatacttag

SEQ ID NO: 100858 - DNA, 22 bp, Artificial Sequence
  Synthetic oligonucleotide; TTT chr11 5325157 5325178 5325174 5325179 +
cccataattaaatacttagctg

SEQ ID NO: 100859 - DNA, 22 bp, Artificial Sequence
  Synthetic oligonucleotide; TTC chr11 5325158 5325179 5325175 5325180 +
ccataattaaatacttagctgg

SEQ ID NO: 100860 - DNA, 22 bp, Artificial Sequence
  Synthetic oligonucleotide; TTA chr11 5325167 5325188 5325184 5325189 +
aatacttagctggttttctgtc

SEQ ID NO: 100861 - DNA, 22 bp, Artificial Sequence
  Synthetic oligonucleotide; CTT chr11 5325174 5325195 5325191 5325196 +
agctggttttctgtccttctta

SEQ ID NO: 100862 - DNA, 22 bp, Artificial Sequence
  Synthetic oligonucleotide; TTA chr11 5325175 5325196 5325192 5325197 +
gctggttttctgtccttcttac

SEQ ID NO: 100863 - DNA, 22 bp, Artificial Sequence
  Synthetic oligonucleotide; CTG chr11 5325179 5325200 5325196 5325201 +
gttttctgtccttcttacctct

SEQ ID NO: 100864 - DNA, 22 bp, Artificial Sequence
  Synthetic oligonucleotide; TTT chr11 5325183 5325204 5325200 5325205 +
tctgtccttcttacctctctct

SEQ ID NO: 100865 - DNA, 22 bp, Artificial Sequence
  Synthetic oligonucleotide; TTT chr11 5325184 5325205 5325201 5325206 +
ctgtccttcttacctctctctg

SEQ ID NO: 100866 - DNA, 22 bp, Artificial Sequence
  Synthetic oligonucleotide; TTC chr11 5325185 5325206 5325202 5325207 +
tgtccttcttacctctctctgc

SEQ ID NO: 100867 - DNA, 22 bp, Artificial Sequence
  Synthetic oligonucleotide; CTG chr11 5325187 5325208 5325204 5325209 +
tccttcttacctctctctgctt

SEQ ID NO: 100868 - DNA, 22 bp, Artificial Sequence
  Synthetic oligonucleotide; CTT chr11 5325192 5325213 5325209 5325214 +
cttacctctctctgcttttcca

SEQ ID NO: 100869 - DNA, 22 bp, Artificial Sequence
  Synthetic oligonucleotide; TTC chr11 5325193 5325214 5325210 5325215 +
ttacctctctctgcttttccat

SEQ ID NO: 100870 - DNA, 22 bp, Artificial Sequence
  Synthetic oligonucleotide; CTT chr11 5325195 5325216 5325212 5325217 +
acctctctctgcttttccatca

SEQ ID NO: 100871 - DNA, 22 bp, Artificial Sequence
  Synthetic oligonucleotide; TTA chr11 5325196 5325217 5325213 5325218 +
cctctctctgcttttccatcaa

SEQ ID NO: 100872 - DNA, 22 bp, Artificial Sequence
  Synthetic oligonucleotide; CTC chr11 5325200 5325221 5325217 5325222 +
tctctgcttttccatcaactcc

SEQ ID NO: 100873 - DNA, 22 bp, Artificial Sequence
  Synthetic oligonucleotide; CTC chr11 5325202 5325223 5325219 5325224 +
tctgcttttccatcaactccaa

SEQ ID NO: 100874 - DNA, 22 bp, Artificial Sequence
  Synthetic oligonucleotide; CTC chr11 5325204 5325225 5325221 5325226 +
tgcttttccatcaactccaaac

SEQ ID NO: 100875 - DNA, 22 bp, Artificial Sequence
  Synthetic oligonucleotide; CTG chr11 5325206 5325227 5325223 5325228 +
cttttccatcaactccaaactc

SEQ ID NO: 100876 - DNA, 22 bp, Artificial Sequence
  Synthetic oligonucleotide; CTT chr11 5325209 5325230 5325226 5325231 +
ttccatcaactccaaactcctg

SEQ ID NO: 100877 - DNA, 22 bp, Artificial Sequence
  Synthetic oligonucleotide; TTT chr11 5325210 5325231 5325227 5325232 +
tccatcaactccaaactcctga

SEQ ID NO: 100878 - DNA, 22 bp, Artificial Sequence
  Synthetic oligonucleotide; TTT chr11 5325211 5325232 5325228 5325233 +
ccatcaactccaaactcctgag

SEQ ID NO: 100879 - DNA, 22 bp, Artificial Sequence
  Synthetic oligonucleotide; TTC chr11 5325212 5325233 5325229 5325234 +
catcaactccaaactcctgagg

SEQ ID NO: 100880 - DNA, 22 bp, Artificial Sequence
  Synthetic oligonucleotide; CTC chr11 5325221 5325242 5325238 5325243 +
caaactcctgaggaactgttgc

SEQ ID NO: 100881 - DNA, 22 bp, Artificial Sequence
  Synthetic oligonucleotide; CTC chr11 5325228 5325249 5325245 5325250 +
ctgaggaactgttgcagttctg

SEQ ID NO: 100882 - DNA, 22 bp, Artificial Sequence
  Synthetic oligonucleotide; CTG chr11 5325231 5325252 5325248 5325253 +
aggaactgttgcagttctgtaa

SEQ ID NO: 100883 - DNA, 22 bp, Artificial Sequence
  Synthetic oligonucleotide; CTG chr11 5325239 5325260 5325256 5325261 +
ttgcagttctgtaacaggtaaa

SEQ ID NO: 100884 - DNA, 22 bp, Artificial Sequence
  Synthetic oligonucleotide; TTG chr11 5325242 5325263 5325259 5325264 +
cagttctgtaacaggtaaaatt

SEQ ID NO: 100885 - DNA, 22 bp, Artificial Sequence
  Synthetic oligonucleotide; TTC chr11 5325248 5325269 5325265 5325270 +
tgtaacaggtaaaattataatg

SEQ ID NO: 100886 - DNA, 22 bp, Artificial Sequence
  Synthetic oligonucleotide; CTG chr11 5325250 5325271 5325267 5325272 +
taacaggtaaaattataatgtt

SEQ ID NO: 100887 - DNA, 22 bp, Artificial Sequence
  Synthetic oligonucleotide; TTA chr11 5325265 5325286 5325282 5325287 +
taatgtttccacagcctaagga

SEQ ID NO: 100888 - DNA, 22 bp, Artificial Sequence
  Synthetic oligonucleotide; TTT chr11 5325273 5325294 5325290 5325295 +
ccacagcctaaggatgccagcc

SEQ ID NO: 100889 - DNA, 22 bp, Artificial Sequence
  Synthetic oligonucleotide; TTC chr11 5325274 5325295 5325291 5325296 +
cacagcctaaggatgccagcca

SEQ ID NO: 100890 - DNA, 22 bp, Artificial Sequence
  Synthetic oligonucleotide; CTA chr11 5325283 5325304 5325300 5325305 +
aggatgccagccatcactactg

SEQ ID NO: 100891 - DNA, 22 bp, Artificial Sequence
  Synthetic oligonucleotide; CTA chr11 5325302 5325323 5325319 5325324 +
ctgtttctgttttcttggttgc

SEQ ID NO: 100892 - DNA, 22 bp, Artificial Sequence
  Synthetic oligonucleotide; CTG chr11 5325305 5325326 5325322 5325327 +
tttctgttttcttggttgccac

SEQ ID NO: 100893 - DNA, 22 bp, Artificial Sequence
  Synthetic oligonucleotide; TTT chr11 5325308 5325329 5325325 5325330 +
ctgttttcttggttgccacgat

SEQ ID NO: 100894 - DNA, 22 bp, Artificial Sequence
  Synthetic oligonucleotide; TTC chr11 5325309 5325330 5325326 5325331 +
tgttttcttggttgccacgatc

SEQ ID NO: 100895 - DNA, 22 bp, Artificial Sequence
  Synthetic oligonucleotide; CTG chr11 5325311 5325332 5325328 5325333 +
ttttcttggttgccacgatcca

SEQ ID NO: 100896 - DNA, 22 bp, Artificial Sequence
  Synthetic oligonucleotide; TTT chr11 5325314 5325335 5325331 5325336 +
tcttggttgccacgatccaaga

SEQ ID NO: 100897 - DNA, 22 bp, Artificial Sequence
  Synthetic oligonucleotide; TTT chr11 5325315 5325336 5325332 5325337 +
cttggttgccacgatccaagag

SEQ ID NO: 100898 - DNA, 22 bp, Artificial Sequence
  Synthetic oligonucleotide; TTC chr11 5325316 5325337 5325333 5325338 +
ttggttgccacgatccaagagg

SEQ ID NO: 100899 - DNA, 22 bp, Artificial Sequence
  Synthetic oligonucleotide; CTT chr11 5325318 5325339 5325335 5325340 +
ggttgccacgatccaagagggg

SEQ ID NO: 100900 - DNA, 22 bp, Artificial Sequence
  Synthetic oligonucleotide; TTG chr11 5325319 5325340 5325336 5325341 +
gttgccacgatccaagaggggt

SEQ ID NO: 100901 - DNA, 22 bp, Artificial Sequence
  Synthetic oligonucleotide; TTG chr11 5325323 5325344 5325340 5325345 +
ccacgatccaagaggggtatgg

SEQ ID NO: 100902 - DNA, 22 bp, Artificial Sequence
  Synthetic oligonucleotide; CTT chr11 5325361 5325382 5325378 5325383 +
attaccagctctgctgcagtct

SEQ ID NO: 100903 - DNA, 22 bp, Artificial Sequence
  Synthetic oligonucleotide; TTA chr11 5325362 5325383 5325379 5325384 +
ttaccagctctgctgcagtctt

SEQ ID NO: 100904 - DNA, 22 bp, Artificial Sequence
  Synthetic oligonucleotide; TTA chr11 5325365 5325386 5325382 5325387 +
ccagctctgctgcagtcttatt

SEQ ID NO: 100905 - DNA, 22 bp, Artificial Sequence
  Synthetic oligonucleotide; CTC chr11 5325372 5325393 5325389 5325394 +
tgctgcagtcttatttaacgag

SEQ ID NO: 100906 - DNA, 22 bp, Artificial Sequence
  Synthetic oligonucleotide; CTG chr11 5325374 5325395 5325391 5325396 +
ctgcagtcttatttaacgagaa

SEQ ID NO: 100907 - DNA, 22 bp, Artificial Sequence
  Synthetic oligonucleotide; CTG chr11 5325377 5325398 5325394 5325399 +
cagtcttatttaacgagaaatt

SEQ ID NO: 100908 - DNA, 22 bp, Artificial Sequence
  Synthetic oligonucleotide; CTT chr11 5325384 5325405 5325401 5325406 +
atttaacgagaaattcagaatc

SEQ ID NO: 100909 - DNA, 22 bp, Artificial Sequence
  Synthetic oligonucleotide; TTA chr11 5325385 5325406 5325402 5325407 +
tttaacgagaaattcagaatcc

SEQ ID NO: 100910 - DNA, 22 bp, Artificial Sequence
  Synthetic oligonucleotide; TTT chr11 5325388 5325409 5325405 5325410 +
aacgagaaattcagaatcctgg

SEQ ID NO: 100911 - DNA, 22 bp, Artificial Sequence
  Synthetic oligonucleotide; TTA chr11 5325389 5325410 5325406 5325411 +
acgagaaattcagaatcctgga

SEQ ID NO: 100912 - DNA, 22 bp, Artificial Sequence
  Synthetic oligonucleotide; TTC chr11 5325400 5325421 5325417 5325422 +
agaatcctggaggcaagtcttt

SEQ ID NO: 100913 - DNA, 22 bp, Artificial Sequence
  Synthetic oligonucleotide; CTG chr11 5325409 5325430 5325426 5325431 +
gaggcaagtctttagcacctag

SEQ ID NO: 100914 - DNA, 22 bp, Artificial Sequence
  Synthetic oligonucleotide; CTT chr11 5325421 5325442 5325438 5325443 +
tagcacctagcagttttcttca

SEQ ID NO: 100915 - DNA, 22 bp, Artificial Sequence
  Synthetic oligonucleotide; TTT chr11 5325422 5325443 5325439 5325444 +
agcacctagcagttttcttcat

SEQ ID NO: 100916 - DNA, 22 bp, Artificial Sequence
  Synthetic oligonucleotide; TTA chr11 5325423 5325444 5325440 5325445 +
gcacctagcagttttcttcata

SEQ ID NO: 100917 - DNA, 22 bp, Artificial Sequence
  Synthetic oligonucleotide; CTA chr11 5325430 5325451 5325447 5325452 +
gcagttttcttcataaaatggc

SEQ ID NO: 100918 - DNA, 22 bp, Artificial Sequence
  Synthetic oligonucleotide; TTT chr11 5325437 5325458 5325454 5325459 +
tcttcataaaatggcctcagta

SEQ ID NO: 100919 - DNA, 22 bp, Artificial Sequence
  Synthetic oligonucleotide; TTT chr11 5325438 5325459 5325455 5325460 +
cttcataaaatggcctcagtat

SEQ ID NO: 100920 - DNA, 22 bp, Artificial Sequence
  Synthetic oligonucleotide; TTC chr11 5325439 5325460 5325456 5325461 +
ttcataaaatggcctcagtatc

SEQ ID NO: 100921 - DNA, 22 bp, Artificial Sequence
  Synthetic oligonucleotide; CTT chr11 5325441 5325462 5325458 5325463 +
cataaaatggcctcagtatcaa

SEQ ID NO: 100922 - DNA, 22 bp, Artificial Sequence
  Synthetic oligonucleotide; TTC chr11 5325442 5325463 5325459 5325464 +
ataaaatggcctcagtatcaaa

SEQ ID NO: 100923 - DNA, 22 bp, Artificial Sequence
  Synthetic oligonucleotide; CTC chr11 5325455 5325476 5325472 5325477 +
agtatcaaaaataaatcagaat

SEQ ID NO: 100924 - DNA, 22 bp, Artificial Sequence
  Synthetic oligonucleotide; TTT chr11 5325499 5325520 5325516 5325521 +
catattgtataaggaaatgttc

SEQ ID NO: 100925 - DNA, 22 bp, Artificial Sequence
  Synthetic oligonucleotide; TTC chr11 5325500 5325521 5325517 5325522 +
atattgtataaggaaatgttct

SEQ ID NO: 100926 - DNA, 22 bp, Artificial Sequence
  Synthetic oligonucleotide; TTG chr11 5325506 5325527 5325523 5325528 +
tataaggaaatgttctgatgct

SEQ ID NO: 100927 - DNA, 22 bp, Artificial Sequence
  Synthetic oligonucleotide; TTC chr11 5325521 5325542 5325538 5325543 +
tgatgctacctctgtatcagct

SEQ ID NO: 100928 - DNA, 22 bp, Artificial Sequence
  Synthetic oligonucleotide; CTG chr11 5325523 5325544 5325540 5325545 +
atgctacctctgtatcagctcc

SEQ ID NO: 100929 - DNA, 22 bp, Artificial Sequence
  Synthetic oligonucleotide; CTA chr11 5325529 5325550 5325546 5325551 +
cctctgtatcagctcctgtgag

SEQ ID NO: 100930 - DNA, 22 bp, Artificial Sequence
  Synthetic oligonucleotide; CTC chr11 5325533 5325554 5325550 5325555 +
tgtatcagctcctgtgagtcag

SEQ ID NO: 100931 - DNA, 22 bp, Artificial Sequence
  Synthetic oligonucleotide; CTG chr11 5325535 5325556 5325552 5325557 +
tatcagctcctgtgagtcagga

SEQ ID NO: 100932 - DNA, 22 bp, Artificial Sequence
  Synthetic oligonucleotide; CTC chr11 5325544 5325565 5325561 5325566 +
ctgtgagtcaggattactaact

SEQ ID NO: 100933 - DNA, 22 bp, Artificial Sequence
  Synthetic oligonucleotide; CTG chr11 5325547 5325568 5325564 5325569 +
tgagtcaggattactaacttac

SEQ ID NO: 100934 - DNA, 22 bp, Artificial Sequence
  Synthetic oligonucleotide; TTA chr11 5325560 5325581 5325577 5325582 +
ctaacttactgagattgaaatc

SEQ ID NO: 100935 - DNA, 22 bp, Artificial Sequence
  Synthetic oligonucleotide; CTA chr11 5325563 5325584 5325580 5325585 +
acttactgagattgaaatcacc

SEQ ID NO: 100936 - DNA, 22 bp, Artificial Sequence
  Synthetic oligonucleotide; CTT chr11 5325567 5325588 5325584 5325589 +
actgagattgaaatcaccaaca

SEQ ID NO: 100937 - DNA, 22 bp, Artificial Sequence
  Synthetic oligonucleotide; TTA chr11 5325568 5325589 5325585 5325590 +
ctgagattgaaatcaccaacac

SEQ ID NO: 100938 - DNA, 22 bp, Artificial Sequence
  Synthetic oligonucleotide; CTG chr11 5325571 5325592 5325588 5325593 +
agattgaaatcaccaacactag

SEQ ID NO: 100939 - DNA, 22 bp, Artificial Sequence
  Synthetic oligonucleotide; TTG chr11 5325577 5325598 5325594 5325599 +
aaatcaccaacactagggaatc

SEQ ID NO: 100940 - DNA, 22 bp, Artificial Sequence
  Synthetic oligonucleotide; CTA chr11 5325592 5325613 5325609 5325614 +
gggaatccctaaaattaaatca

SEQ ID NO: 100941 - DNA, 22 bp, Artificial Sequence
  Synthetic oligonucleotide; CTA chr11 5325603 5325624 5325620 5325625 +
aaattaaatcacattgaattca

SEQ ID NO: 100942 - DNA, 22 bp, Artificial Sequence
  Synthetic oligonucleotide; TTA chr11 5325609 5325630 5325626 5325631 +
aatcacattgaattcatataga

SEQ ID NO: 100943 - DNA, 22 bp, Artificial Sequence
  Synthetic oligonucleotide; TTG chr11 5325619 5325640 5325636 5325641 +
aattcatatagaagactgaatt

SEQ ID NO: 100944 - DNA, 22 bp, Artificial Sequence
  Synthetic oligonucleotide; TTC chr11 5325624 5325645 5325641 5325646 +
atatagaagactgaattataat

SEQ ID NO: 100945 - DNA, 22 bp, Artificial Sequence
  Synthetic oligonucleotide; CTG chr11 5325637 5325658 5325654 5325659 +
aattataattattacacaaatg

SEQ ID NO: 100946 - DNA, 22 bp, Artificial Sequence
  Synthetic oligonucleotide; TTA chr11 5325642 5325663 5325659 5325664 +
taattattacacaaatgttgtt

SEQ ID NO: 100947 - DNA, 22 bp, Artificial Sequence
  Synthetic oligonucleotide; TTA chr11 5325648 5325669 5325665 5325670 +
ttacacaaatgttgttctacct

SEQ ID NO: 100948 - DNA, 22 bp, Artificial Sequence
  Synthetic oligonucleotide; TTA chr11 5325651 5325672 5325668 5325673 +
cacaaatgttgttctaccttcg

SEQ ID NO: 100949 - DNA, 22 bp, Artificial Sequence
  Synthetic oligonucleotide; TTG chr11 5325662 5325683 5325679 5325684 +
ttctaccttcgaaagatccttc

SEQ ID NO: 100950 - DNA, 22 bp, Artificial Sequence
  Synthetic oligonucleotide; TTC chr11 5325665 5325686 5325682 5325687 +
taccttcgaaagatccttcatg

SEQ ID NO: 100951 - DNA, 22 bp, Artificial Sequence
  Synthetic oligonucleotide; CTA chr11 5325667 5325688 5325684 5325689 +
ccttcgaaagatccttcatgct

SEQ ID NO: 100952 - DNA, 22 bp, Artificial Sequence
  Synthetic oligonucleotide; CTT chr11 5325671 5325692 5325688 5325693 +
cgaaagatccttcatgcttaaa

SEQ ID NO: 100953 - DNA, 22 bp, Artificial Sequence
  Synthetic oligonucleotide; TTC chr11 5325672 5325693 5325689 5325694 +
gaaagatccttcatgcttaaaa

SEQ ID NO: 100954 - DNA, 22 bp, Artificial Sequence
  Synthetic oligonucleotide; CTT chr11 5325683 5325704 5325700 5325705 +
catgcttaaaaacacagattga

SEQ ID NO: 100955 - DNA, 22 bp, Artificial Sequence
  Synthetic oligonucleotide; TTC chr11 5325684 5325705 5325701 5325706 +
atgcttaaaaacacagattgag

SEQ ID NO: 100956 - DNA, 22 bp, Artificial Sequence
  Synthetic oligonucleotide; CTT chr11 5325690 5325711 5325707 5325712 +
aaaaacacagattgaggaataa

SEQ ID NO: 100957 - DNA, 22 bp, Artificial Sequence
  Synthetic oligonucleotide; TTA chr11 5325691 5325712 5325708 5325713 +
aaaacacagattgaggaataag

SEQ ID NO: 100958 - DNA, 22 bp, Artificial Sequence
  Synthetic oligonucleotide; TTG chr11 5325704 5325725 5325721 5325726 +
aggaataagaggatgtacggaa

SEQ ID NO: 100959 - DNA, 22 bp, Artificial Sequence
  Synthetic oligonucleotide; TTA chr11 5325757 5325778 5325774 5325779 +
gagaaaggacaaattggtgaca

SEQ ID NO: 100960 - DNA, 22 bp, Artificial Sequence
  Synthetic oligonucleotide; TTG chr11 5325773 5325794 5325790 5325795 +
gtgacacatattctgaagggta

SEQ ID NO: 100961 - DNA, 22 bp, Artificial Sequence
  Synthetic oligonucleotide; TTC chr11 5325786 5325807 5325803 5325808 +
tgaagggtaaacatagaagaaa

SEQ ID NO: 100962 - DNA, 22 bp, Artificial Sequence
  Synthetic oligonucleotide; CTG chr11 5325788 5325809 5325805 5325810 +
aagggtaaacatagaagaaagt

SEQ ID NO: 100963 - DNA, 22 bp, Artificial Sequence
  Synthetic oligonucleotide; TTA chr11 5325817 5325838 5325834 5325839 +
aaattttttttaattaaagttt

SEQ ID NO: 100964 - DNA, 22 bp, Artificial Sequence
  Synthetic oligonucleotide; TTT chr11 5325823 5325844 5325840 5325845 +
tttttaattaaagttttaaaaa

SEQ ID NO: 100965 - DNA, 22 bp, Artificial Sequence
  Synthetic oligonucleotide; TTT chr11 5325824 5325845 5325841 5325846 +
ttttaattaaagttttaaaaaa

SEQ ID NO: 100966 - DNA, 22 bp, Artificial Sequence
  Synthetic oligonucleotide; TTT chr11 5325825 5325846 5325842 5325847 +
tttaattaaagttttaaaaaat

SEQ ID NO: 100967 - DNA, 22 bp, Artificial Sequence
  Synthetic oligonucleotide; TTT chr11 5325826 5325847 5325843 5325848 +
ttaattaaagttttaaaaaatt

SEQ ID NO: 100968 - DNA, 22 bp, Artificial Sequence
  Synthetic oligonucleotide; TTT chr11 5325827 5325848 5325844 5325849 +
taattaaagttttaaaaaattt

SEQ ID NO: 100969 - DNA, 22 bp, Artificial Sequence
  Synthetic oligonucleotide; TTT chr11 5325828 5325849 5325845 5325850 +
aattaaagttttaaaaaatttt

SEQ ID NO: 100970 - DNA, 22 bp, Artificial Sequence
  Synthetic oligonucleotide; TTA chr11 5325829 5325850 5325846 5325851 +
attaaagttttaaaaaatttta

SEQ ID NO: 100971 - DNA, 22 bp, Artificial Sequence
  Synthetic oligonucleotide; TTA chr11 5325833 5325854 5325850 5325855 +
aagttttaaaaaattttaaaaa

SEQ ID NO: 100972 - DNA, 22 bp, Artificial Sequence
  Synthetic oligonucleotide; TTT chr11 5325839 5325860 5325856 5325861 +
taaaaaattttaaaaataaaaa

SEQ ID NO: 100973 - DNA, 22 bp, Artificial Sequence
  Synthetic oligonucleotide; TTT chr11 5325840 5325861 5325857 5325862 +
aaaaaattttaaaaataaaaaa

SEQ ID NO: 100974 - DNA, 22 bp, Artificial Sequence
  Synthetic oligonucleotide; TTA chr11 5325841 5325862 5325858 5325863 +
aaaaattttaaaaataaaaaat

SEQ ID NO: 100975 - DNA, 22 bp, Artificial Sequence
  Synthetic oligonucleotide; TTT chr11 5325849 5325870 5325866 5325871 +
taaaaataaaaaatttttaaaa

SEQ ID NO: 100976 - DNA, 22 bp, Artificial Sequence
  Synthetic oligonucleotide; TTT chr11 5325850 5325871 5325867 5325872 +
aaaaataaaaaatttttaaaaa

SEQ ID NO: 100977 - DNA, 22 bp, Artificial Sequence
  Synthetic oligonucleotide; TTA chr11 5325851 5325872 5325868 5325873 +
aaaataaaaaatttttaaaaag

SEQ ID NO: 100978 - DNA, 22 bp, Artificial Sequence
  Synthetic oligonucleotide; TTT chr11 5325865 5325886 5325882 5325887 +
ttaaaaagaaagccataaaatc

SEQ ID NO: 100979 - DNA, 22 bp, Artificial Sequence
  Synthetic oligonucleotide; TTT chr11 5325866 5325887 5325883 5325888 +
taaaaagaaagccataaaatct

SEQ ID NO: 100980 - DNA, 22 bp, Artificial Sequence
  Synthetic oligonucleotide; TTT chr11 5325867 5325888 5325884 5325889 +
aaaaagaaagccataaaatctg

SEQ ID NO: 100981 - DNA, 22 bp, Artificial Sequence
  Synthetic oligonucleotide; TTA chr11 5325868 5325889 5325885 5325890 +
aaaagaaagccataaaatctgg

SEQ ID NO: 100982 - DNA, 22 bp, Artificial Sequence
  Synthetic oligonucleotide; CTG chr11 5325889 5325910 5325906 5325911 +
ggattcctttaaaaaaaattgt

SEQ ID NO: 100983 - DNA, 22 bp, Artificial Sequence
  Synthetic oligonucleotide; TTC chr11 5325895 5325916 5325912 5325917 +
ctttaaaaaaaattgtgtaagg

SEQ ID NO: 100984 - DNA, 22 bp, Artificial Sequence
  Synthetic oligonucleotide; CTT chr11 5325898 5325919 5325915 5325920 +
taaaaaaaattgtgtaaggatc

SEQ ID NO: 100985 - DNA, 22 bp, Artificial Sequence
  Synthetic oligonucleotide; TTT chr11 5325899 5325920 5325916 5325921 +
aaaaaaaattgtgtaaggatca

SEQ ID NO: 100986 - DNA, 22 bp, Artificial Sequence
  Synthetic oligonucleotide; TTA chr11 5325900 5325921 5325917 5325922 +
aaaaaaattgtgtaaggatcaa

SEQ ID NO: 100987 - DNA, 22 bp, Artificial Sequence
  Synthetic oligonucleotide; TTG chr11 5325910 5325931 5325927 5325932 +
tgtaaggatcaaactagatttc

SEQ ID NO: 100988 - DNA, 22 bp, Artificial Sequence
  Synthetic oligonucleotide; CTA chr11 5325926 5325947 5325943 5325948 +
gatttccagagcacaagtactt

SEQ ID NO: 100989 - DNA, 22 bp, Artificial Sequence
  Synthetic oligonucleotide; TTT chr11 5325931 5325952 5325948 5325953 +
ccagagcacaagtactttttaa

SEQ ID NO: 100990 - DNA, 22 bp, Artificial Sequence
  Synthetic oligonucleotide; TTC chr11 5325932 5325953 5325949 5325954 +
cagagcacaagtactttttaaa

SEQ ID NO: 100991 - DNA, 22 bp, Artificial Sequence
  Synthetic oligonucleotide; CTT chr11 5325948 5325969 5325965 5325970 +
tttaaaatgtttgtgagctttt

SEQ ID NO: 100992 - DNA, 22 bp, Artificial Sequence
  Synthetic oligonucleotide; TTT chr11 5325949 5325970 5325966 5325971 +
ttaaaatgtttgtgagcttttc

SEQ ID NO: 100993 - DNA, 22 bp, Artificial Sequence
  Synthetic oligonucleotide; TTT chr11 5325950 5325971 5325967 5325972 +
taaaatgtttgtgagcttttcc

SEQ ID NO: 100994 - DNA, 22 bp, Artificial Sequence
  Synthetic oligonucleotide; TTT chr11 5325951 5325972 5325968 5325973 +
aaaatgtttgtgagcttttcct

SEQ ID NO: 100995 - DNA, 22 bp, Artificial Sequence
  Synthetic oligonucleotide; TTA chr11 5325952 5325973 5325969 5325974 +
aaatgtttgtgagcttttcctt

SEQ ID NO: 100996 - DNA, 22 bp, Artificial Sequence
  Synthetic oligonucleotide; TTT chr11 5325960 5325981 5325977 5325982 +
gtgagcttttccttaaaaaaca

SEQ ID NO: 100997 - DNA, 22 bp, Artificial Sequence
  Synthetic oligonucleotide; TTG chr11 5325961 5325982 5325978 5325983 +
tgagcttttccttaaaaaacaa

SEQ ID NO: 100998 - DNA, 22 bp, Artificial Sequence
  Synthetic oligonucleotide; CTT chr11 5325968 5325989 5325985 5325990 +
ttccttaaaaaacaataacgtc

SEQ ID NO: 100999 - DNA, 22 bp, Artificial Sequence
  Synthetic oligonucleotide; TTT chr11 5325969 5325990 5325986 5325991 +
tccttaaaaaacaataacgtct

SEQ ID NO: 101000 - DNA, 22 bp, Artificial Sequence
  Synthetic oligonucleotide; TTT chr11 5325970 5325991 5325987 5325992 +
ccttaaaaaacaataacgtctt

SEQ ID NO: 101001 - DNA, 22 bp, Artificial Sequence
  Synthetic oligonucleotide; TTC chr11 5325971 5325992 5325988 5325993 +
cttaaaaaacaataacgtcttt

SEQ ID NO: 101002 - DNA, 22 bp, Artificial Sequence
  Synthetic oligonucleotide; CTT chr11 5325974 5325995 5325991 5325996 +
aaaaaacaataacgtctttaga

SEQ ID NO: 101003 - DNA, 22 bp, Artificial Sequence
  Synthetic oligonucleotide; TTA chr11 5325975 5325996 5325992 5325997 +
aaaaacaataacgtctttagag

SEQ ID NO: 101004 - DNA, 22 bp, Artificial Sequence
  Synthetic oligonucleotide; CTT chr11 5325992 5326013 5326009 5326014 +
tagagaaattggccataaaaca

SEQ ID NO: 101005 - DNA, 22 bp, Artificial Sequence
  Synthetic oligonucleotide; TTT chr11 5325993 5326014 5326010 5326015 +
agagaaattggccataaaacac

SEQ ID NO: 101006 - DNA, 22 bp, Artificial Sequence
  Synthetic oligonucleotide; TTA chr11 5325994 5326015 5326011 5326016 +
gagaaattggccataaaacact

SEQ ID NO: 101007 - DNA, 22 bp, Artificial Sequence
  Synthetic oligonucleotide; TTG chr11 5326003 5326024 5326020 5326025 +
gccataaaacacttgaaaccaa

SEQ ID NO: 101008 - DNA, 22 bp, Artificial Sequence
  Synthetic oligonucleotide; CTT chr11 5326017 5326038 5326034 5326039 +
gaaaccaaaaaagaaagttttt

SEQ ID NO: 101009 - DNA, 22 bp, Artificial Sequence
  Synthetic oligonucleotide; TTG chr11 5326018 5326039 5326035 5326040 +
aaaccaaaaaagaaagtttttt

SEQ ID NO: 101010 - DNA, 22 bp, Artificial Sequence
  Synthetic oligonucleotide; TTT chr11 5326037 5326058 5326054 5326059 +
tttattatatttatgagcagaa

SEQ ID NO: 101011 - DNA, 22 bp, Artificial Sequence
  Synthetic oligonucleotide; TTT chr11 5326038 5326059 5326055 5326060 +
ttattatatttatgagcagaaa

SEQ ID NO: 101012 - DNA, 22 bp, Artificial Sequence
  Synthetic oligonucleotide; TTT chr11 5326039 5326060 5326056 5326061 +
tattatatttatgagcagaaaa

SEQ ID NO: 101013 - DNA, 22 bp, Artificial Sequence
  Synthetic oligonucleotide; TTT chr11 5326040 5326061 5326057 5326062 +
attatatttatgagcagaaaaa

SEQ ID NO: 101014 - DNA, 22 bp, Artificial Sequence
  Synthetic oligonucleotide; TTA chr11 5326041 5326062 5326058 5326063 +
ttatatttatgagcagaaaaaa

SEQ ID NO: 101015 - DNA, 22 bp, Artificial Sequence
  Synthetic oligonucleotide; TTA chr11 5326044 5326065 5326061 5326066 +
tatttatgagcagaaaaaaatg

SEQ ID NO: 101016 - DNA, 22 bp, Artificial Sequence
  Synthetic oligonucleotide; TTT chr11 5326049 5326070 5326066 5326071 +
atgagcagaaaaaaatgtttac

SEQ ID NO: 101017 - DNA, 22 bp, Artificial Sequence
  Synthetic oligonucleotide; TTA chr11 5326050 5326071 5326067 5326072 +
tgagcagaaaaaaatgtttaca

SEQ ID NO: 101018 - DNA, 22 bp, Artificial Sequence
  Synthetic oligonucleotide; TTT chr11 5326069 5326090 5326086 5326091 +
acagtcatatctccctccatct

SEQ ID NO: 101019 - DNA, 22 bp, Artificial Sequence
  Synthetic oligonucleotide; TTA chr11 5326070 5326091 5326087 5326092 +
cagtcatatctccctccatctc

SEQ ID NO: 101020 - DNA, 22 bp, Artificial Sequence
  Synthetic oligonucleotide; CTC chr11 5326082 5326103 5326099 5326104 +
cctccatctctaagcttgggtc

SEQ ID NO: 101021 - DNA, 22 bp, Artificial Sequence
  Synthetic oligonucleotide; CTC chr11 5326086 5326107 5326103 5326108 +
catctctaagcttgggtcatta

SEQ ID NO: 101022 - DNA, 22 bp, Artificial Sequence
  Synthetic oligonucleotide; CTC chr11 5326092 5326113 5326109 5326114 +
taagcttgggtcattaaaagta

SEQ ID NO: 101023 - DNA, 22 bp, Artificial Sequence
  Synthetic oligonucleotide; CTA chr11 5326094 5326115 5326111 5326116 +
agcttgggtcattaaaagtaag

SEQ ID NO: 101024 - DNA, 22 bp, Artificial Sequence
  Synthetic oligonucleotide; CTT chr11 5326099 5326120 5326116 5326121 +
gggtcattaaaagtaagacagg

SEQ ID NO: 101025 - DNA, 22 bp, Artificial Sequence
  Synthetic oligonucleotide; TTG chr11 5326100 5326121 5326117 5326122 +
ggtcattaaaagtaagacaggg

SEQ ID NO: 101026 - DNA, 22 bp, Artificial Sequence
  Synthetic oligonucleotide; TTA chr11 5326108 5326129 5326125 5326130 +
aaagtaagacagggaaggttat

SEQ ID NO: 101027 - DNA, 22 bp, Artificial Sequence
  Synthetic oligonucleotide; TTA chr11 5326129 5326150 5326146 5326151 +
tggtacctcaaagaaaatgaaa

SEQ ID NO: 101028 - DNA, 22 bp, Artificial Sequence
  Synthetic oligonucleotide; CTC chr11 5326138 5326159 5326155 5326160 +
aaagaaaatgaaaggtaaatca

SEQ ID NO: 101029 - DNA, 22 bp, Artificial Sequence
  Synthetic oligonucleotide; CTG chr11 5326166 5326187 5326183 5326188 +
agattttgggaataaaaagaaa

SEQ ID NO: 101030 - DNA, 22 bp, Artificial Sequence
  Synthetic oligonucleotide; TTT chr11 5326172 5326193 5326189 5326194 +
tgggaataaaaagaaacacaaa

SEQ ID NO: 101031 - DNA, 22 bp, Artificial Sequence
  Synthetic oligonucleotide; TTT chr11 5326173 5326194 5326190 5326195 +
gggaataaaaagaaacacaaaa

SEQ ID NO: 101032 - DNA, 22 bp, Artificial Sequence
  Synthetic oligonucleotide; TTG chr11 5326174 5326195 5326191 5326196 +
ggaataaaaagaaacacaaaag

SEQ ID NO: 101033 - DNA, 22 bp, Artificial Sequence
  Synthetic oligonucleotide; CTG chr11 5326203 5326224 5326220 5326225 +
cccaacactgggaagccgttga

SEQ ID NO: 101034 - DNA, 22 bp, Artificial Sequence
  Synthetic oligonucleotide; CTG chr11 5326213 5326234 5326230 5326235 +
ggaagccgttgatatttaccca

SEQ ID NO: 101035 - DNA, 22 bp, Artificial Sequence
  Synthetic oligonucleotide; TTG chr11 5326224 5326245 5326241 5326246 +
atatttacccagaggcaggcgt

SEQ ID NO: 101036 - DNA, 22 bp, Artificial Sequence
  Synthetic oligonucleotide; TTT chr11 5326230 5326251 5326247 5326252 +
acccagaggcaggcgtgtgggg

SEQ ID NO: 101037 - DNA, 22 bp, Artificial Sequence
  Synthetic oligonucleotide; TTA chr11 5326231 5326252 5326248 5326253 +
cccagaggcaggcgtgtgggga

SEQ ID NO: 101038 - DNA, 22 bp, Artificial Sequence
  Synthetic oligonucleotide; TTC chr11 5326256 5326277 5326273 5326278 +
taggagagctagatactgtcat

SEQ ID NO: 101039 - DNA, 22 bp, Artificial Sequence
  Synthetic oligonucleotide; CTA chr11 5326258 5326279 5326275 5326280 +
ggagagctagatactgtcatca

SEQ ID NO: 101040 - DNA, 22 bp, Artificial Sequence
  Synthetic oligonucleotide; CTA chr11 5326267 5326288 5326284 5326289 +
gatactgtcatcaaactgaggc

SEQ ID NO: 101041 - DNA, 22 bp, Artificial Sequence
  Synthetic oligonucleotide; CTG chr11 5326274 5326295 5326291 5326296 +
tcatcaaactgaggcccactat

SEQ ID NO: 101042 - DNA, 22 bp, Artificial Sequence
  Synthetic oligonucleotide; CTG chr11 5326285 5326306 5326302 5326307 +
aggcccactataagcagtgtca

SEQ ID NO: 101043 - DNA, 22 bp, Artificial Sequence
  Synthetic oligonucleotide; CTA chr11 5326295 5326316 5326312 5326317 +
taagcagtgtcaccagagatga

SEQ ID NO: 101044 - DNA, 22 bp, Artificial Sequence
  Synthetic oligonucleotide; CTG chr11 5326327 5326348 5326344 5326349 +
tatgcatgctcccaaggctgca

SEQ ID NO: 101045 - DNA, 22 bp, Artificial Sequence
  Synthetic oligonucleotide; CTC chr11 5326338 5326359 5326355 5326360 +
ccaaggctgcactatgtggcaa

SEQ ID NO: 101046 - DNA, 22 bp, Artificial Sequence
  Synthetic oligonucleotide; CTG chr11 5326347 5326368 5326364 5326369 +
cactatgtggcaaaattccatt

SEQ ID NO: 101047 - DNA, 22 bp, Artificial Sequence
  Synthetic oligonucleotide; CTA chr11 5326352 5326373 5326369 5326374 +
tgtggcaaaattccattcagat

SEQ ID NO: 101048 - DNA, 22 bp, Artificial Sequence
  Synthetic oligonucleotide; TTC chr11 5326365 5326386 5326382 5326387 +
cattcagatggcttagctatta

SEQ ID NO: 101049 - DNA, 22 bp, Artificial Sequence
  Synthetic oligonucleotide; TTC chr11 5326370 5326391 5326387 5326392 +
agatggcttagctattaacaag

SEQ ID NO: 101050 - DNA, 22 bp, Artificial Sequence
  Synthetic oligonucleotide; CTT chr11 5326379 5326400 5326396 5326401 +
agctattaacaagtgttaagaa

SEQ ID NO: 101051 - DNA, 22 bp, Artificial Sequence
  Synthetic oligonucleotide; TTA chr11 5326380 5326401 5326397 5326402 +
gctattaacaagtgttaagaaa

SEQ ID NO: 101052 - DNA, 22 bp, Artificial Sequence
  Synthetic oligonucleotide; CTA chr11 5326384 5326405 5326401 5326406 +
ttaacaagtgttaagaaaatta

SEQ ID NO: 101053 - DNA, 22 bp, Artificial Sequence
  Synthetic oligonucleotide; TTA chr11 5326387 5326408 5326404 5326409 +
acaagtgttaagaaaattatac

SEQ ID NO: 101054 - DNA, 22 bp, Artificial Sequence
  Synthetic oligonucleotide; TTA chr11 5326397 5326418 5326414 5326419 +
agaaaattatactagaagcaca

SEQ ID NO: 101055 - DNA, 22 bp, Artificial Sequence
  Synthetic oligonucleotide; TTA chr11 5326406 5326427 5326423 5326428 +
tactagaagcacaagaactagt

SEQ ID NO: 101056 - DNA, 22 bp, Artificial Sequence
  Synthetic oligonucleotide; CTA chr11 5326411 5326432 5326428 5326433 +
gaagcacaagaactagtttttc

SEQ ID NO: 101057 - DNA, 22 bp, Artificial Sequence
  Synthetic oligonucleotide; CTA chr11 5326426 5326447 5326443 5326448 +
gtttttctggataaaggtggag

SEQ ID NO: 101058 - DNA, 22 bp, Artificial Sequence
  Synthetic oligonucleotide; TTT chr11 5326430 5326451 5326447 5326452 +
ttctggataaaggtggagcagc

SEQ ID NO: 101059 - DNA, 22 bp, Artificial Sequence
  Synthetic oligonucleotide; TTT chr11 5326431 5326452 5326448 5326453 +
tctggataaaggtggagcagct

SEQ ID NO: 101060 - DNA, 22 bp, Artificial Sequence
  Synthetic oligonucleotide; TTT chr11 5326432 5326453 5326449 5326454 +
ctggataaaggtggagcagcta

SEQ ID NO: 101061 - DNA, 22 bp, Artificial Sequence
  Synthetic oligonucleotide; TTC chr11 5326433 5326454 5326450 5326455 +
tggataaaggtggagcagctat

SEQ ID NO: 101062 - DNA, 22 bp, Artificial Sequence
  Synthetic oligonucleotide; CTG chr11 5326435 5326456 5326452 5326457 +
gataaaggtggagcagctatgg

SEQ ID NO: 101063 - DNA, 22 bp, Artificial Sequence
  Synthetic oligonucleotide; CTA chr11 5326454 5326475 5326471 5326476 +
tggctgtgaaattgataggcag

SEQ ID NO: 101064 - DNA, 22 bp, Artificial Sequence
  Synthetic oligonucleotide; CTG chr11 5326460 5326481 5326477 5326482 +
tgaaattgataggcagctctca

SEQ ID NO: 101065 - DNA, 22 bp, Artificial Sequence
  Synthetic oligonucleotide; TTG chr11 5326468 5326489 5326485 5326490 +
ataggcagctctcaactcagaa

SEQ ID NO: 101066 - DNA, 22 bp, Artificial Sequence
  Synthetic oligonucleotide; CTC chr11 5326479 5326500 5326496 5326501 +
tcaactcagaacataaatgttt

SEQ ID NO: 101067 - DNA, 22 bp, Artificial Sequence
  Synthetic oligonucleotide; CTC chr11 5326481 5326502 5326498 5326503 +
aactcagaacataaatgtttag

SEQ ID NO: 101068 - DNA, 22 bp, Artificial Sequence
  Synthetic oligonucleotide; CTC chr11 5326486 5326507 5326503 5326508 +
agaacataaatgtttagtgatt

SEQ ID NO: 101069 - DNA, 22 bp, Artificial Sequence
  Synthetic oligonucleotide; TTT chr11 5326501 5326522 5326518 5326523 +
agtgatttcctaaggatctggg

SEQ ID NO: 101070 - DNA, 22 bp, Artificial Sequence
  Synthetic oligonucleotide; TTA chr11 5326502 5326523 5326519 5326524 +
gtgatttcctaaggatctgggg

SEQ ID NO: 101071 - DNA, 22 bp, Artificial Sequence
  Synthetic oligonucleotide; TTT chr11 5326509 5326530 5326526 5326531 +
cctaaggatctggggtcctgac

SEQ ID NO: 101072 - DNA, 22 bp, Artificial Sequence
  Synthetic oligonucleotide; TTC chr11 5326510 5326531 5326527 5326532 +
ctaaggatctggggtcctgact

SEQ ID NO: 101073 - DNA, 22 bp, Artificial Sequence
  Synthetic oligonucleotide; CTA chr11 5326513 5326534 5326530 5326535 +
aggatctggggtcctgacttga

SEQ ID NO: 101074 - DNA, 22 bp, Artificial Sequence
  Synthetic oligonucleotide; CTG chr11 5326521 5326542 5326538 5326543 +
gggtcctgacttgatgtgtgat

SEQ ID NO: 101075 - DNA, 22 bp, Artificial Sequence
  Synthetic oligonucleotide; CTG chr11 5326529 5326550 5326546 5326551 +
acttgatgtgtgatgatttttc

SEQ ID NO: 101076 - DNA, 22 bp, Artificial Sequence
  Synthetic oligonucleotide; CTT chr11 5326533 5326554 5326550 5326555 +
gatgtgtgatgatttttccttg

SEQ ID NO: 101077 - DNA, 22 bp, Artificial Sequence
  Synthetic oligonucleotide; TTG chr11 5326534 5326555 5326551 5326556 +
atgtgtgatgatttttccttga

SEQ ID NO: 101078 - DNA, 22 bp, Artificial Sequence
  Synthetic oligonucleotide; TTT chr11 5326548 5326569 5326565 5326570 +
ttccttgaactgatatatcata

SEQ ID NO: 101079 - DNA, 22 bp, Artificial Sequence
  Synthetic oligonucleotide; TTT chr11 5326549 5326570 5326566 5326571 +
tccttgaactgatatatcatat

SEQ ID NO: 101080 - DNA, 22 bp, Artificial Sequence
  Synthetic oligonucleotide; TTT chr11 5326550 5326571 5326567 5326572 +
ccttgaactgatatatcatata

SEQ ID NO: 101081 - DNA, 22 bp, Artificial Sequence
  Synthetic oligonucleotide; TTC chr11 5326551 5326572 5326568 5326573 +
cttgaactgatatatcatatat

SEQ ID NO: 101082 - DNA, 22 bp, Artificial Sequence
  Synthetic oligonucleotide; CTT chr11 5326554 5326575 5326571 5326576 +
gaactgatatatcatatatgaa

SEQ ID NO: 101083 - DNA, 22 bp, Artificial Sequence
  Synthetic oligonucleotide; TTG chr11 5326555 5326576 5326572 5326577 +
aactgatatatcatatatgaag

SEQ ID NO: 101084 - DNA, 22 bp, Artificial Sequence
  Synthetic oligonucleotide; CTG chr11 5326560 5326581 5326577 5326582 +
atatatcatatatgaagatata

SEQ ID NO: 101085 - DNA, 22 bp, Artificial Sequence
  Synthetic oligonucleotide; CTG chr11 5326591 5326612 5326608 5326613 +
taggagctccattcaccaatac

SEQ ID NO: 101086 - DNA, 22 bp, Artificial Sequence
  Synthetic oligonucleotide; CTC chr11 5326600 5326621 5326617 5326622 +
cattcaccaataccatctggga

SEQ ID NO: 101087 - DNA, 22 bp, Artificial Sequence
  Synthetic oligonucleotide; TTC chr11 5326605 5326626 5326622 5326627 +
accaataccatctgggacaagt

SEQ ID NO: 101088 - DNA, 22 bp, Artificial Sequence
  Synthetic oligonucleotide; CTG chr11 5326619 5326640 5326636 5326641 +
ggacaagttggaaaatgactat

SEQ ID NO: 101089 - DNA, 22 bp, Artificial Sequence
  Synthetic oligonucleotide; TTG chr11 5326629 5326650 5326646 5326651 +
gaaaatgactattttgagtcag

SEQ ID NO: 101090 - DNA, 22 bp, Artificial Sequence
  Synthetic oligonucleotide; CTA chr11 5326640 5326661 5326657 5326662 +
ttttgagtcagcacagaattgg

SEQ ID NO: 101091 - DNA, 22 bp, Artificial Sequence
  Synthetic oligonucleotide; TTT chr11 5326643 5326664 5326660 5326665 +
tgagtcagcacagaattggtga

SEQ ID NO: 101092 - DNA, 22 bp, Artificial Sequence
  Synthetic oligonucleotide; TTT chr11 5326644 5326665 5326661 5326666 +
gagtcagcacagaattggtgag

SEQ ID NO: 101093 - DNA, 22 bp, Artificial Sequence
  Synthetic oligonucleotide; TTG chr11 5326645 5326666 5326662 5326667 +
agtcagcacagaattggtgagc

SEQ ID NO: 101094 - DNA, 22 bp, Artificial Sequence
  Synthetic oligonucleotide; TTG chr11 5326661 5326682 5326678 5326683 +
gtgagcacatgccacacaactg

SEQ ID NO: 101095 - DNA, 22 bp, Artificial Sequence
  Synthetic oligonucleotide; CTG chr11 5326683 5326704 5326700 5326705 +
cactgtgtttagttctaaataa

SEQ ID NO: 101096 - DNA, 22 bp, Artificial Sequence
  Synthetic oligonucleotide; CTG chr11 5326688 5326709 5326705 5326710 +
tgtttagttctaaataaccatg

SEQ ID NO: 101097 - DNA, 22 bp, Artificial Sequence
  Synthetic oligonucleotide; TTT chr11 5326693 5326714 5326710 5326715 +
agttctaaataaccatgtaata

SEQ ID NO: 101098 - DNA, 22 bp, Artificial Sequence
  Synthetic oligonucleotide; TTA chr11 5326694 5326715 5326711 5326716 +
gttctaaataaccatgtaataa

SEQ ID NO: 101099 - DNA, 22 bp, Artificial Sequence
  Synthetic oligonucleotide; TTC chr11 5326698 5326719 5326715 5326720 +
taaataaccatgtaataagcac

SEQ ID NO: 101100 - DNA, 22 bp, Artificial Sequence
  Synthetic oligonucleotide; CTA chr11 5326700 5326721 5326717 5326722 +
aataaccatgtaataagcacag

SEQ ID NO: 101101 - DNA, 22 bp, Artificial Sequence
  Synthetic oligonucleotide; CTG chr11 5326726 5326747 5326743 5326748 +
ctcttaagaagctctcaatatg

SEQ ID NO: 101102 - DNA, 22 bp, Artificial Sequence
  Synthetic oligonucleotide; CTC chr11 5326729 5326750 5326746 5326751 +
ttaagaagctctcaatatggcc

SEQ ID NO: 101103 - DNA, 22 bp, Artificial Sequence
  Synthetic oligonucleotide; CTT chr11 5326731 5326752 5326748 5326753 +
aagaagctctcaatatggccta

SEQ ID NO: 101104 - DNA, 22 bp, Artificial Sequence
  Synthetic oligonucleotide; TTA chr11 5326732 5326753 5326749 5326754 +
agaagctctcaatatggcctat

SEQ ID NO: 101105 - DNA, 22 bp, Artificial Sequence
  Synthetic oligonucleotide; CTC chr11 5326740 5326761 5326757 5326762 +
tcaatatggcctatgagtttat

SEQ ID NO: 101106 - DNA, 22 bp, Artificial Sequence
  Synthetic oligonucleotide; CTC chr11 5326742 5326763 5326759 5326764 +
aatatggcctatgagtttataa

SEQ ID NO: 101107 - DNA, 22 bp, Artificial Sequence
  Synthetic oligonucleotide; CTA chr11 5326753 5326774 5326770 5326775 +
tgagtttataatagtgcttaat

SEQ ID NO: 101108 - DNA, 22 bp, Artificial Sequence
  Synthetic oligonucleotide; TTT chr11 5326760 5326781 5326777 5326782 +
ataatagtgcttaatattctcc

SEQ ID NO: 101109 - DNA, 22 bp, Artificial Sequence
  Synthetic oligonucleotide; TTA chr11 5326761 5326782 5326778 5326783 +
taatagtgcttaatattctccc

SEQ ID NO: 101110 - DNA, 22 bp, Artificial Sequence
  Synthetic oligonucleotide; CTT chr11 5326772 5326793 5326789 5326794 +
aatattctcccttcaattttat

SEQ ID NO: 101111 - DNA, 22 bp, Artificial Sequence
  Synthetic oligonucleotide; TTA chr11 5326773 5326794 5326790 5326795 +
atattctcccttcaattttatg

SEQ ID NO: 101112 - DNA, 22 bp, Artificial Sequence
  Synthetic oligonucleotide; TTC chr11 5326779 5326800 5326796 5326801 +
tcccttcaattttatgcagaat

SEQ ID NO: 101113 - DNA, 22 bp, Artificial Sequence
  Synthetic oligonucleotide; CTC chr11 5326781 5326802 5326798 5326803 +
ccttcaattttatgcagaatat

SEQ ID NO: 101114 - DNA, 22 bp, Artificial Sequence
  Synthetic oligonucleotide; CTT chr11 5326785 5326806 5326802 5326807 +
caattttatgcagaatattgcc

SEQ ID NO: 101115 - DNA, 22 bp, Artificial Sequence
  Synthetic oligonucleotide; TTC chr11 5326786 5326807 5326803 5326808 +
aattttatgcagaatattgccc

SEQ ID NO: 101116 - DNA, 22 bp, Artificial Sequence
  Synthetic oligonucleotide; TTT chr11 5326791 5326812 5326808 5326813 +
tatgcagaatattgcccttgaa

SEQ ID NO: 101117 - DNA, 22 bp, Artificial Sequence
  Synthetic oligonucleotide; TTT chr11 5326792 5326813 5326809 5326814 +
atgcagaatattgcccttgaat

SEQ ID NO: 101118 - DNA, 22 bp, Artificial Sequence
  Synthetic oligonucleotide; TTA chr11 5326793 5326814 5326810 5326815 +
tgcagaatattgcccttgaatg

SEQ ID NO: 101119 - DNA, 22 bp, Artificial Sequence
  Synthetic oligonucleotide; TTG chr11 5326805 5326826 5326822 5326827 +
cccttgaatgtctcaacaggat

SEQ ID NO: 101120 - DNA, 22 bp, Artificial Sequence
  Synthetic oligonucleotide; CTT chr11 5326810 5326831 5326827 5326832 +
gaatgtctcaacaggatccata

SEQ ID NO: 101121 - DNA, 22 bp, Artificial Sequence
  Synthetic oligonucleotide; TTG chr11 5326811 5326832 5326828 5326833 +
aatgtctcaacaggatccataa

SEQ ID NO: 101122 - DNA, 22 bp, Artificial Sequence
  Synthetic oligonucleotide; CTC chr11 5326819 5326840 5326836 5326841 +
aacaggatccataatgctgaaa

SEQ ID NO: 101123 - DNA, 22 bp, Artificial Sequence
  Synthetic oligonucleotide; CTG chr11 5326838 5326859 5326855 5326860 +
aaaacttgagaaaaatcataga

SEQ ID NO: 101124 - DNA, 22 bp, Artificial Sequence
  Synthetic oligonucleotide; CTT chr11 5326845 5326866 5326862 5326867 +
gagaaaaatcatagatctaagc

SEQ ID NO: 101125 - DNA, 22 bp, Artificial Sequence
  Synthetic oligonucleotide; TTG chr11 5326846 5326867 5326863 5326868 +
agaaaaatcatagatctaagcc

SEQ ID NO: 101126 - DNA, 22 bp, Artificial Sequence
  Synthetic oligonucleotide; CTA chr11 5326864 5326885 5326881 5326886 +
agccctgcttcattctagcttc

SEQ ID NO: 101127 - DNA, 22 bp, Artificial Sequence
  Synthetic oligonucleotide; CTG chr11 5326871 5326892 5326888 5326893 +
cttcattctagcttcattctag

SEQ ID NO: 101128 - DNA, 22 bp, Artificial Sequence
  Synthetic oligonucleotide; CTT chr11 5326874 5326895 5326891 5326896 +
cattctagcttcattctagatg

SEQ ID NO: 101129 - DNA, 22 bp, Artificial Sequence
  Synthetic oligonucleotide; TTC chr11 5326875 5326896 5326892 5326897 +
attctagcttcattctagatgt

SEQ ID NO: 101130 - DNA, 22 bp, Artificial Sequence
  Synthetic oligonucleotide; TTC chr11 5326879 5326900 5326896 5326901 +
tagcttcattctagatgttcta

SEQ ID NO: 101131 - DNA, 22 bp, Artificial Sequence
  Synthetic oligonucleotide; CTA chr11 5326881 5326902 5326898 5326903 +
gcttcattctagatgttctatt

SEQ ID NO: 101132 - DNA, 22 bp, Artificial Sequence
  Synthetic oligonucleotide; CTT chr11 5326885 5326906 5326902 5326907 +
cattctagatgttctattgacc

SEQ ID NO: 101133 - DNA, 22 bp, Artificial Sequence
  Synthetic oligonucleotide; TTC chr11 5326886 5326907 5326903 5326908 +
attctagatgttctattgacct

SEQ ID NO: 101134 - DNA, 22 bp, Artificial Sequence
  Synthetic oligonucleotide; TTC chr11 5326890 5326911 5326907 5326912 +
tagatgttctattgacctgaat

SEQ ID NO: 101135 - DNA, 22 bp, Artificial Sequence
  Synthetic oligonucleotide; CTA chr11 5326892 5326913 5326909 5326914 +
gatgttctattgacctgaattt

SEQ ID NO: 101136 - DNA, 22 bp, Artificial Sequence
  Synthetic oligonucleotide; TTC chr11 5326899 5326920 5326916 5326921 +
tattgacctgaatttcacatga

SEQ ID NO: 101137 - DNA, 22 bp, Artificial Sequence
  Synthetic oligonucleotide; CTA chr11 5326901 5326922 5326918 5326923 +
ttgacctgaatttcacatgatg

SEQ ID NO: 101138 - DNA, 22 bp, Artificial Sequence
  Synthetic oligonucleotide; TTG chr11 5326904 5326925 5326921 5326926 +
acctgaatttcacatgatgata

SEQ ID NO: 101139 - DNA, 22 bp, Artificial Sequence
  Synthetic oligonucleotide; CTG chr11 5326909 5326930 5326926 5326931 +
aatttcacatgatgatatattt

SEQ ID NO: 101140 - DNA, 22 bp, Artificial Sequence
  Synthetic oligonucleotide; TTT chr11 5326914 5326935 5326931 5326936 +
cacatgatgatatatttctaga

SEQ ID NO: 101141 - DNA, 22 bp, Artificial Sequence
  Synthetic oligonucleotide; TTC chr11 5326915 5326936 5326932 5326937 +
acatgatgatatatttctagat

SEQ ID NO: 101142 - DNA, 22 bp, Artificial Sequence
  Synthetic oligonucleotide; TTT chr11 5326931 5326952 5326948 5326953 +
ctagatgaataagattcctata

SEQ ID NO: 101143 - DNA, 22 bp, Artificial Sequence
  Synthetic oligonucleotide; TTC chr11 5326932 5326953 5326949 5326954 +
tagatgaataagattcctatac

SEQ ID NO: 101144 - DNA, 22 bp, Artificial Sequence
  Synthetic oligonucleotide; CTA chr11 5326934 5326955 5326951 5326956 +
gatgaataagattcctatactt

SEQ ID NO: 101145 - DNA, 22 bp, Artificial Sequence
  Synthetic oligonucleotide; TTC chr11 5326948 5326969 5326965 5326970 +
ctatacttgtagcaacactctc

SEQ ID NO: 101146 - DNA, 22 bp, Artificial Sequence
  Synthetic oligonucleotide; CTA chr11 5326951 5326972 5326968 5326973 +
tacttgtagcaacactctcacc

SEQ ID NO: 101147 - DNA, 22 bp, Artificial Sequence
  Synthetic oligonucleotide; CTT chr11 5326956 5326977 5326973 5326978 +
gtagcaacactctcaccaagat

SEQ ID NO: 101148 - DNA, 22 bp, Artificial Sequence
  Synthetic oligonucleotide; TTG chr11 5326957 5326978 5326974 5326979 +
tagcaacactctcaccaagatg

SEQ ID NO: 101149 - DNA, 22 bp, Artificial Sequence
  Synthetic oligonucleotide; CTC chr11 5326968 5326989 5326985 5326990 +
tcaccaagatgcataaatacat

SEQ ID NO: 101150 - DNA, 22 bp, Artificial Sequence
  Synthetic oligonucleotide; CTC chr11 5326970 5326991 5326987 5326992 +
accaagatgcataaatacatac

SEQ ID NO: 101151 - DNA, 22 bp, Artificial Sequence
  Synthetic oligonucleotide; TTG chr11 5327012 5327033 5327029 5327034 +
tcatgctcactttgagaacata

SEQ ID NO: 101152 - DNA, 22 bp, Artificial Sequence
  Synthetic oligonucleotide; CTC chr11 5327020 5327041 5327037 5327042 +
actttgagaacataatttgaat

SEQ ID NO: 101153 - DNA, 22 bp, Artificial Sequence
  Synthetic oligonucleotide; CTT chr11 5327024 5327045 5327041 5327046 +
tgagaacataatttgaatgtta

SEQ ID NO: 101154 - DNA, 22 bp, Artificial Sequence
  Synthetic oligonucleotide; TTT chr11 5327025 5327046 5327042 5327047 +
gagaacataatttgaatgttac

SEQ ID NO: 101155 - DNA, 22 bp, Artificial Sequence
  Synthetic oligonucleotide; TTG chr11 5327026 5327047 5327043 5327048 +
agaacataatttgaatgttacc

SEQ ID NO: 101156 - DNA, 22 bp, Artificial Sequence
  Synthetic oligonucleotide; TTT chr11 5327038 5327059 5327055 5327060 +
gaatgttaccagatacaaggga

SEQ ID NO: 101157 - DNA, 22 bp, Artificial Sequence
  Synthetic oligonucleotide; TTG chr11 5327039 5327060 5327056 5327061 +
aatgttaccagatacaagggag

SEQ ID NO: 101158 - DNA, 22 bp, Artificial Sequence
  Synthetic oligonucleotide; TTA chr11 5327046 5327067 5327063 5327068 +
ccagatacaagggagtaaagga

SEQ ID NO: 101159 - DNA, 22 bp, Artificial Sequence
  Synthetic oligonucleotide; CTT chr11 5327082 5327103 5327099 5327104 +
tgtagtatgaagaaggaacaga

SEQ ID NO: 101160 - DNA, 22 bp, Artificial Sequence
  Synthetic oligonucleotide; TTT chr11 5327083 5327104 5327100 5327105 +
gtagtatgaagaaggaacagac

SEQ ID NO: 101161 - DNA, 22 bp, Artificial Sequence
  Synthetic oligonucleotide; TTG chr11 5327084 5327105 5327101 5327106 +
tagtatgaagaaggaacagaca

SEQ ID NO: 101162 - DNA, 22 bp, Artificial Sequence
  Synthetic oligonucleotide; CTG chr11 5327117 5327138 5327134 5327139 +
ttagcctcaagaaaatgtagta

SEQ ID NO: 101163 - DNA, 22 bp, Artificial Sequence
  Synthetic oligonucleotide; TTA chr11 5327120 5327141 5327137 5327142 +
gcctcaagaaaatgtagtaaat

SEQ ID NO: 101164 - DNA, 22 bp, Artificial Sequence
  Synthetic oligonucleotide; CTC chr11 5327125 5327146 5327142 5327147 +
aagaaaatgtagtaaatagtga

SEQ ID NO: 101165 - DNA, 22 bp, Artificial Sequence
  Synthetic oligonucleotide; CTA chr11 5327152 5327173 5327169 5327174 +
ttatacagtctacataaacaag

SEQ ID NO: 101166 - DNA, 22 bp, Artificial Sequence
  Synthetic oligonucleotide; TTA chr11 5327155 5327176 5327172 5327177 +
tacagtctacataaacaagtga

SEQ ID NO: 101167 - DNA, 22 bp, Artificial Sequence
  Synthetic oligonucleotide; CTA chr11 5327164 5327185 5327181 5327186 +
cataaacaagtgaaagaggaaa

SEQ ID NO: 101168 - DNA, 22 bp, Artificial Sequence
  Synthetic oligonucleotide; TTC chr11 5327197 5327218 5327214 5327219 +
ctcctttccctcatcttctcat

SEQ ID NO: 101169 - DNA, 22 bp, Artificial Sequence
  Synthetic oligonucleotide; CTC chr11 5327200 5327221 5327217 5327222 +
ctttccctcatcttctcatttc

SEQ ID NO: 101170 - DNA, 22 bp, Artificial Sequence
  Synthetic oligonucleotide; CTT chr11 5327203 5327224 5327220 5327225 +
tccctcatcttctcatttccta

SEQ ID NO: 101171 - DNA, 22 bp, Artificial Sequence
  Synthetic oligonucleotide; TTT chr11 5327204 5327225 5327221 5327226 +
ccctcatcttctcatttcctac

SEQ ID NO: 101172 - DNA, 22 bp, Artificial Sequence
  Synthetic oligonucleotide; TTC chr11 5327205 5327226 5327222 5327227 +
cctcatcttctcatttcctact

SEQ ID NO: 101173 - DNA, 22 bp, Artificial Sequence
  Synthetic oligonucleotide; CTC chr11 5327209 5327230 5327226 5327231 +
atcttctcatttcctactctgc

SEQ ID NO: 101174 - DNA, 22 bp, Artificial Sequence
  Synthetic oligonucleotide; CTT chr11 5327214 5327235 5327231 5327236 +
ctcatttcctactctgccctcc

SEQ ID NO: 101175 - DNA, 22 bp, Artificial Sequence
  Synthetic oligonucleotide; TTC chr11 5327215 5327236 5327232 5327237 +
tcatttcctactctgccctcct

SEQ ID NO: 101176 - DNA, 22 bp, Artificial Sequence
  Synthetic oligonucleotide; CTC chr11 5327217 5327238 5327234 5327239 +
atttcctactctgccctccttc

SEQ ID NO: 101177 - DNA, 22 bp, Artificial Sequence
  Synthetic oligonucleotide; TTT chr11 5327221 5327242 5327238 5327243 +
cctactctgccctccttctgag

SEQ ID NO: 101178 - DNA, 22 bp, Artificial Sequence
  Synthetic oligonucleotide; TTC chr11 5327222 5327243 5327239 5327244 +
ctactctgccctccttctgagt

SEQ ID NO: 101179 - DNA, 22 bp, Artificial Sequence
  Synthetic oligonucleotide; CTA chr11 5327225 5327246 5327242 5327247 +
ctctgccctccttctgagttgg

SEQ ID NO: 101180 - DNA, 22 bp, Artificial Sequence
  Synthetic oligonucleotide; CTC chr11 5327228 5327249 5327245 5327250 +
tgccctccttctgagttggatg

SEQ ID NO: 101181 - DNA, 22 bp, Artificial Sequence
  Synthetic oligonucleotide; CTG chr11 5327230 5327251 5327247 5327252 +
ccctccttctgagttggatgga

SEQ ID NO: 101182 - DNA, 22 bp, Artificial Sequence
  Synthetic oligonucleotide; CTC chr11 5327235 5327256 5327252 5327257 +
cttctgagttggatggaagatg

SEQ ID NO: 101183 - DNA, 22 bp, Artificial Sequence
  Synthetic oligonucleotide; CTT chr11 5327238 5327259 5327255 5327260 +
ctgagttggatggaagatgtgt

SEQ ID NO: 101184 - DNA, 22 bp, Artificial Sequence
  Synthetic oligonucleotide; TTC chr11 5327239 5327260 5327256 5327261 +
tgagttggatggaagatgtgtc

SEQ ID NO: 101185 - DNA, 22 bp, Artificial Sequence
  Synthetic oligonucleotide; CTG chr11 5327241 5327262 5327258 5327263 +
agttggatggaagatgtgtccc

SEQ ID NO: 101186 - DNA, 22 bp, Artificial Sequence
  Synthetic oligonucleotide; TTG chr11 5327246 5327267 5327263 5327268 +
gatggaagatgtgtccccgcac

SEQ ID NO: 101187 - DNA, 22 bp, Artificial Sequence
  Synthetic oligonucleotide; CTT chr11 5327271 5327292 5327288 5327293 +
cctaaggagatgggccctgtct

SEQ ID NO: 101188 - DNA, 22 bp, Artificial Sequence
  Synthetic oligonucleotide; TTC chr11 5327272 5327293 5327289 5327294 +
ctaaggagatgggccctgtctc

SEQ ID NO: 101189 - DNA, 22 bp, Artificial Sequence
  Synthetic oligonucleotide; CTA chr11 5327275 5327296 5327292 5327297 +
aggagatgggccctgtctctag

SEQ ID NO: 101190 - DNA, 22 bp, Artificial Sequence
  Synthetic oligonucleotide; CTG chr11 5327290 5327311 5327307 5327312 +
tctctagaatttttctagtgag

SEQ ID NO: 101191 - DNA, 22 bp, Artificial Sequence
  Synthetic oligonucleotide; CTC chr11 5327294 5327315 5327311 5327316 +
tagaatttttctagtgagtccc

SEQ ID NO: 101192 - DNA, 22 bp, Artificial Sequence
  Synthetic oligonucleotide; CTA chr11 5327296 5327317 5327313 5327318 +
gaatttttctagtgagtcccac

SEQ ID NO: 101193 - DNA, 22 bp, Artificial Sequence
  Synthetic oligonucleotide; TTT chr11 5327302 5327323 5327319 5327324 +
ttctagtgagtcccactgacta

SEQ ID NO: 101194 - DNA, 22 bp, Artificial Sequence
  Synthetic oligonucleotide; TTT chr11 5327303 5327324 5327320 5327325 +
tctagtgagtcccactgactac

SEQ ID NO: 101195 - DNA, 22 bp, Artificial Sequence
  Synthetic oligonucleotide; TTT chr11 5327304 5327325 5327321 5327326 +
ctagtgagtcccactgactact

SEQ ID NO: 101196 - DNA, 22 bp, Artificial Sequence
  Synthetic oligonucleotide; TTC chr11 5327305 5327326 5327322 5327327 +
tagtgagtcccactgactactc

SEQ ID NO: 101197 - DNA, 22 bp, Artificial Sequence
  Synthetic oligonucleotide; CTA chr11 5327307 5327328 5327324 5327329 +
gtgagtcccactgactactcat

SEQ ID NO: 101198 - DNA, 22 bp, Artificial Sequence
  Synthetic oligonucleotide; CTG chr11 5327320 5327341 5327337 5327342 +
actactcatgccatctcttaga

SEQ ID NO: 101199 - DNA, 22 bp, Artificial Sequence
  Synthetic oligonucleotide; CTA chr11 5327324 5327345 5327341 5327346 +
ctcatgccatctcttagagcag

SEQ ID NO: 101200 - DNA, 22 bp, Artificial Sequence
  Synthetic oligonucleotide; CTC chr11 5327327 5327348 5327344 5327349 +
atgccatctcttagagcagttc

SEQ ID NO: 101201 - DNA, 22 bp, Artificial Sequence
  Synthetic oligonucleotide; CTC chr11 5327337 5327358 5327354 5327359 +
ttagagcagttcttcaaacaaa

SEQ ID NO: 101202 - DNA, 22 bp, Artificial Sequence
  Synthetic oligonucleotide; CTT chr11 5327339 5327360 5327356 5327361 +
agagcagttcttcaaacaaaca

SEQ ID NO: 101203 - DNA, 22 bp, Artificial Sequence
  Synthetic oligonucleotide; TTA chr11 5327340 5327361 5327357 5327362 +
gagcagttcttcaaacaaacac

SEQ ID NO: 101204 - DNA, 22 bp, Artificial Sequence
  Synthetic oligonucleotide; TTC chr11 5327349 5327370 5327366 5327371 +
ttcaaacaaacacacagacaca

SEQ ID NO: 101205 - DNA, 22 bp, Artificial Sequence
  Synthetic oligonucleotide; CTT chr11 5327351 5327372 5327368 5327373 +
caaacaaacacacagacacaca

SEQ ID NO: 101206 - DNA, 22 bp, Artificial Sequence
  Synthetic oligonucleotide; TTC chr11 5327352 5327373 5327369 5327374 +
aaacaaacacacagacacacat

SEQ ID NO: 101207 - DNA, 22 bp, Artificial Sequence
  Synthetic oligonucleotide; TTT chr11 5327388 5327409 5327405 5327410 +
caaggggtgttgtttggatctt

SEQ ID NO: 101208 - DNA, 22 bp, Artificial Sequence
  Synthetic oligonucleotide; TTC chr11 5327389 5327410 5327406 5327411 +
aaggggtgttgtttggatctta

SEQ ID NO: 101209 - DNA, 22 bp, Artificial Sequence
  Synthetic oligonucleotide; TTG chr11 5327400 5327421 5327417 5327422 +
tttggatcttataaattaaatt

SEQ ID NO: 101210 - DNA, 22 bp, Artificial Sequence
  Synthetic oligonucleotide; TTT chr11 5327403 5327424 5327420 5327425 +
ggatcttataaattaaattgtt

SEQ ID NO: 101211 - DNA, 22 bp, Artificial Sequence
  Synthetic oligonucleotide; TTG chr11 5327404 5327425 5327421 5327426 +
gatcttataaattaaattgtta

SEQ ID NO: 101212 - DNA, 22 bp, Artificial Sequence
  Synthetic oligonucleotide; CTT chr11 5327410 5327431 5327427 5327432 +
ataaattaaattgttatatgtt

SEQ ID NO: 101213 - DNA, 22 bp, Artificial Sequence
  Synthetic oligonucleotide; TTA chr11 5327411 5327432 5327428 5327433 +
taaattaaattgttatatgtta

SEQ ID NO: 101214 - DNA, 22 bp, Artificial Sequence
  Synthetic oligonucleotide; TTA chr11 5327418 5327439 5327435 5327440 +
aattgttatatgttaaaatggt

SEQ ID NO: 101215 - DNA, 22 bp, Artificial Sequence
  Synthetic oligonucleotide; TTG chr11 5327423 5327444 5327440 5327445 +
ttatatgttaaaatggtgactt

SEQ ID NO: 101216 - DNA, 22 bp, Artificial Sequence
  Synthetic oligonucleotide; TTA chr11 5327426 5327447 5327443 5327448 +
tatgttaaaatggtgacttttc

SEQ ID NO: 101217 - DNA, 22 bp, Artificial Sequence
  Synthetic oligonucleotide; TTA chr11 5327433 5327454 5327450 5327455 +
aaatggtgacttttctttctat

SEQ ID NO: 101218 - DNA, 22 bp, Artificial Sequence
  Synthetic oligonucleotide; CTT chr11 5327445 5327466 5327462 5327467 +
ttctttctataaatttcaggat

SEQ ID NO: 101219 - DNA, 22 bp, Artificial Sequence
  Synthetic oligonucleotide; TTT chr11 5327446 5327467 5327463 5327468 +
tctttctataaatttcaggatc

SEQ ID NO: 101220 - DNA, 22 bp, Artificial Sequence
  Synthetic oligonucleotide; TTT chr11 5327447 5327468 5327464 5327469 +
ctttctataaatttcaggatct

SEQ ID NO: 101221 - DNA, 22 bp, Artificial Sequence
  Synthetic oligonucleotide; TTC chr11 5327448 5327469 5327465 5327470 +
tttctataaatttcaggatctt

SEQ ID NO: 101222 - DNA, 22 bp, Artificial Sequence
  Synthetic oligonucleotide; CTT chr11 5327450 5327471 5327467 5327472 +
tctataaatttcaggatcttag

SEQ ID NO: 101223 - DNA, 22 bp, Artificial Sequence
  Synthetic oligonucleotide; TTT chr11 5327451 5327472 5327468 5327473 +
ctataaatttcaggatcttagc

SEQ ID NO: 101224 - DNA, 22 bp, Artificial Sequence
  Synthetic oligonucleotide; TTC chr11 5327452 5327473 5327469 5327474 +
tataaatttcaggatcttagca

SEQ ID NO: 101225 - DNA, 22 bp, Artificial Sequence
  Synthetic oligonucleotide; CTA chr11 5327454 5327475 5327471 5327476 +
taaatttcaggatcttagcaga

SEQ ID NO: 101226 - DNA, 22 bp, Artificial Sequence
  Synthetic oligonucleotide; TTT chr11 5327461 5327482 5327478 5327483 +
caggatcttagcagagtgcaga

SEQ ID NO: 101227 - DNA, 22 bp, Artificial Sequence
  Synthetic oligonucleotide; TTC chr11 5327462 5327483 5327479 5327484 +
aggatcttagcagagtgcagaa

SEQ ID NO: 101228 - DNA, 22 bp, Artificial Sequence
  Synthetic oligonucleotide; CTT chr11 5327470 5327491 5327487 5327492 +
agcagagtgcagaagctcagcc

SEQ ID NO: 101229 - DNA, 22 bp, Artificial Sequence
  Synthetic oligonucleotide; TTA chr11 5327471 5327492 5327488 5327493 +
gcagagtgcagaagctcagcct

SEQ ID NO: 101230 - DNA, 22 bp, Artificial Sequence
  Synthetic oligonucleotide; CTC chr11 5327488 5327509 5327505 5327510 +
agcctgtttaggttcagaactc

SEQ ID NO: 101231 - DNA, 22 bp, Artificial Sequence
  Synthetic oligonucleotide; CTG chr11 5327494 5327515 5327511 5327516 +
tttaggttcagaactccgtgct

SEQ ID NO: 101232 - DNA, 22 bp, Artificial Sequence
  Synthetic oligonucleotide; TTT chr11 5327497 5327518 5327514 5327519 +
aggttcagaactccgtgctctc

SEQ ID NO: 101233 - DNA, 22 bp, Artificial Sequence
  Synthetic oligonucleotide; TTA chr11 5327498 5327519 5327515 5327520 +
ggttcagaactccgtgctctca

SEQ ID NO: 101234 - DNA, 22 bp, Artificial Sequence
  Synthetic oligonucleotide; TTC chr11 5327503 5327524 5327520 5327525 +
agaactccgtgctctcacgcat

SEQ ID NO: 101235 - DNA, 22 bp, Artificial Sequence
  Synthetic oligonucleotide; CTC chr11 5327510 5327531 5327527 5327532 +
cgtgctctcacgcattgtcttt

SEQ ID NO: 101236 - DNA, 22 bp, Artificial Sequence
  Synthetic oligonucleotide; CTC chr11 5327517 5327538 5327534 5327539 +
tcacgcattgtctttaatcttc

SEQ ID NO: 101237 - DNA, 22 bp, Artificial Sequence
  Synthetic oligonucleotide; CTC chr11 5327519 5327540 5327536 5327541 +
acgcattgtctttaatcttcaa

SEQ ID NO: 101238 - DNA, 22 bp, Artificial Sequence
  Synthetic oligonucleotide; TTG chr11 5327527 5327548 5327544 5327549 +
tctttaatcttcaaaaaagtga

SEQ ID NO: 101239 - DNA, 22 bp, Artificial Sequence
  Synthetic oligonucleotide; CTT chr11 5327531 5327552 5327548 5327553 +
taatcttcaaaaaagtgagtcc

SEQ ID NO: 101240 - DNA, 22 bp, Artificial Sequence
  Synthetic oligonucleotide; TTT chr11 5327532 5327553 5327549 5327554 +
aatcttcaaaaaagtgagtcct

SEQ ID NO: 101241 - DNA, 22 bp, Artificial Sequence
  Synthetic oligonucleotide; TTA chr11 5327533 5327554 5327550 5327555 +
atcttcaaaaaagtgagtcctc

SEQ ID NO: 101242 - DNA, 22 bp, Artificial Sequence
  Synthetic oligonucleotide; CTT chr11 5327538 5327559 5327555 5327560 +
caaaaaagtgagtcctccattt

SEQ ID NO: 101243 - DNA, 22 bp, Artificial Sequence
  Synthetic oligonucleotide; TTC chr11 5327539 5327560 5327556 5327561 +
aaaaaagtgagtcctccatttg

SEQ ID NO: 101244 - DNA, 22 bp, Artificial Sequence
  Synthetic oligonucleotide; CTC chr11 5327555 5327576 5327572 5327577 +
catttggccccagtcctgaggg

SEQ ID NO: 101245 - DNA, 22 bp, Artificial Sequence
  Synthetic oligonucleotide; TTT chr11 5327560 5327581 5327577 5327582 +
ggccccagtcctgagggcctga

SEQ ID NO: 101246 - DNA, 22 bp, Artificial Sequence
  Synthetic oligonucleotide; TTG chr11 5327561 5327582 5327578 5327583 +
gccccagtcctgagggcctgac

SEQ ID NO: 101247 - DNA, 22 bp, Artificial Sequence
  Synthetic oligonucleotide; CTG chr11 5327573 5327594 5327590 5327595 +
agggcctgacagttgggactac

SEQ ID NO: 101248 - DNA, 22 bp, Artificial Sequence
  Synthetic oligonucleotide; CTG chr11 5327581 5327602 5327598 5327603 +
acagttgggactacccaactct

SEQ ID NO: 101249 - DNA, 22 bp, Artificial Sequence
  Synthetic oligonucleotide; TTG chr11 5327588 5327609 5327605 5327610 +
ggactacccaactctcagattt

SEQ ID NO: 101250 - DNA, 22 bp, Artificial Sequence
  Synthetic oligonucleotide; CTA chr11 5327594 5327615 5327611 5327616 +
cccaactctcagatttctattg

SEQ ID NO: 101251 - DNA, 22 bp, Artificial Sequence
  Synthetic oligonucleotide; CTC chr11 5327602 5327623 5327619 5327624 +
tcagatttctattgtccacaag

SEQ ID NO: 101252 - DNA, 22 bp, Artificial Sequence
  Synthetic oligonucleotide; CTC chr11 5327604 5327625 5327621 5327626 +
agatttctattgtccacaagtt

SEQ ID NO: 101253 - DNA, 22 bp, Artificial Sequence
  Synthetic oligonucleotide; TTT chr11 5327610 5327631 5327627 5327632 +
ctattgtccacaagttaaattc

SEQ ID NO: 101254 - DNA, 22 bp, Artificial Sequence
  Synthetic oligonucleotide; TTC chr11 5327611 5327632 5327628 5327633 +
tattgtccacaagttaaattcc

SEQ ID NO: 101255 - DNA, 22 bp, Artificial Sequence
  Synthetic oligonucleotide; CTA chr11 5327613 5327634 5327630 5327635 +
ttgtccacaagttaaattcctc

SEQ ID NO: 101256 - DNA, 22 bp, Artificial Sequence
  Synthetic oligonucleotide; TTG chr11 5327616 5327637 5327633 5327638 +
tccacaagttaaattcctcctg

SEQ ID NO: 101257 - DNA, 22 bp, Artificial Sequence
  Synthetic oligonucleotide; TTA chr11 5327627 5327648 5327644 5327649 +
aattcctcctgccttctccaac

SEQ ID NO: 101258 - DNA, 22 bp, Artificial Sequence
  Synthetic oligonucleotide; TTC chr11 5327632 5327653 5327649 5327654 +
ctcctgccttctccaacccagt

SEQ ID NO: 101259 - DNA, 22 bp, Artificial Sequence
  Synthetic oligonucleotide; CTC chr11 5327635 5327656 5327652 5327657 +
ctgccttctccaacccagtcca

SEQ ID NO: 101260 - DNA, 22 bp, Artificial Sequence
  Synthetic oligonucleotide; CTG chr11 5327638 5327659 5327655 5327660 +
ccttctccaacccagtccaata

SEQ ID NO: 101261 - DNA, 22 bp, Artificial Sequence
  Synthetic oligonucleotide; CTT chr11 5327642 5327663 5327659 5327664 +
ctccaacccagtccaatatatt

SEQ ID NO: 101262 - DNA, 22 bp, Artificial Sequence
  Synthetic oligonucleotide; TTC chr11 5327643 5327664 5327660 5327665 +
tccaacccagtccaatatatta

SEQ ID NO: 101263 - DNA, 22 bp, Artificial Sequence
  Synthetic oligonucleotide; CTC chr11 5327645 5327666 5327662 5327667 +
caacccagtccaatatattatc

SEQ ID NO: 101264 - DNA, 22 bp, Artificial Sequence
  Synthetic oligonucleotide; TTA chr11 5327665 5327686 5327682 5327687 +
tcatctgccatcaatatgattt

SEQ ID NO: 101265 - DNA, 22 bp, Artificial Sequence
  Synthetic oligonucleotide; CTG chr11 5327672 5327693 5327689 5327694 +
ccatcaatatgatttcattttc

SEQ ID NO: 101266 - DNA, 22 bp, Artificial Sequence
  Synthetic oligonucleotide; TTT chr11 5327687 5327708 5327704 5327709 +
cattttcaatccaatttgcttt

SEQ ID NO: 101267 - DNA, 22 bp, Artificial Sequence
  Synthetic oligonucleotide; TTC chr11 5327688 5327709 5327705 5327710 +
attttcaatccaatttgctttc

SEQ ID NO: 101268 - DNA, 22 bp, Artificial Sequence
  Synthetic oligonucleotide; TTT chr11 5327692 5327713 5327709 5327714 +
tcaatccaatttgctttcttag

SEQ ID NO: 101269 - DNA, 22 bp, Artificial Sequence
  Synthetic oligonucleotide; TTT chr11 5327693 5327714 5327710 5327715 +
caatccaatttgctttcttaga

SEQ ID NO: 101270 - DNA, 22 bp, Artificial Sequence
  Synthetic oligonucleotide; TTC chr11 5327694 5327715 5327711 5327716 +
aatccaatttgctttcttagat

SEQ ID NO: 101271 - DNA, 22 bp, Artificial Sequence
  Synthetic oligonucleotide; TTT chr11 5327704 5327725 5327721 5327726 +
gctttcttagatcttaatttgg

SEQ ID NO: 101272 - DNA, 22 bp, Artificial Sequence
  Synthetic oligonucleotide; TTG chr11 5327705 5327726 5327722 5327727 +
ctttcttagatcttaatttggc

SEQ ID NO: 101273 - DNA, 22 bp, Artificial Sequence
  Synthetic oligonucleotide; CTT chr11 5327708 5327729 5327725 5327730 +
tcttagatcttaatttggctgc

SEQ ID NO: 101274 - DNA, 22 bp, Artificial Sequence
  Synthetic oligonucleotide; TTT chr11 5327709 5327730 5327726 5327731 +
cttagatcttaatttggctgcc

SEQ ID NO: 101275 - DNA, 22 bp, Artificial Sequence
  Synthetic oligonucleotide; TTC chr11 5327710 5327731 5327727 5327732 +
ttagatcttaatttggctgccc

SEQ ID NO: 101276 - DNA, 22 bp, Artificial Sequence
  Synthetic oligonucleotide; CTT chr11 5327712 5327733 5327729 5327734 +
agatcttaatttggctgccctt

SEQ ID NO: 101277 - DNA, 22 bp, Artificial Sequence
  Synthetic oligonucleotide; TTA chr11 5327713 5327734 5327730 5327735 +
gatcttaatttggctgcccttt

SEQ ID NO: 101278 - DNA, 22 bp, Artificial Sequence
  Synthetic oligonucleotide; CTT chr11 5327719 5327740 5327736 5327741 +
aatttggctgcccttttctaag

SEQ ID NO: 101279 - DNA, 22 bp, Artificial Sequence
  Synthetic oligonucleotide; TTA chr11 5327720 5327741 5327737 5327742 +
atttggctgcccttttctaagc

SEQ ID NO: 101280 - DNA, 22 bp, Artificial Sequence
  Synthetic oligonucleotide; TTT chr11 5327724 5327745 5327741 5327746 +
ggctgcccttttctaagccttt

SEQ ID NO: 101281 - DNA, 22 bp, Artificial Sequence
  Synthetic oligonucleotide; TTG chr11 5327725 5327746 5327742 5327747 +
gctgcccttttctaagcctttc

SEQ ID NO: 101282 - DNA, 22 bp, Artificial Sequence
  Synthetic oligonucleotide; CTG chr11 5327729 5327750 5327746 5327751 +
cccttttctaagcctttcaact

SEQ ID NO: 101283 - DNA, 22 bp, Artificial Sequence
  Synthetic oligonucleotide; CTT chr11 5327734 5327755 5327751 5327756 +
ttctaagcctttcaactcgatt

SEQ ID NO: 101284 - DNA, 22 bp, Artificial Sequence
  Synthetic oligonucleotide; TTT chr11 5327735 5327756 5327752 5327757 +
tctaagcctttcaactcgattc

SEQ ID NO: 101285 - DNA, 22 bp, Artificial Sequence
  Synthetic oligonucleotide; TTT chr11 5327736 5327757 5327753 5327758 +
ctaagcctttcaactcgattca

SEQ ID NO: 101286 - DNA, 22 bp, Artificial Sequence
  Synthetic oligonucleotide; TTC chr11 5327737 5327758 5327754 5327759 +
taagcctttcaactcgattcag

SEQ ID NO: 101287 - DNA, 22 bp, Artificial Sequence
  Synthetic oligonucleotide; CTA chr11 5327739 5327760 5327756 5327761 +
agcctttcaactcgattcagaa

SEQ ID NO: 101288 - DNA, 22 bp, Artificial Sequence
  Synthetic oligonucleotide; CTT chr11 5327745 5327766 5327762 5327767 +
tcaactcgattcagaatttttt

SEQ ID NO: 101289 - DNA, 22 bp, Artificial Sequence
  Synthetic oligonucleotide; TTT chr11 5327746 5327767 5327763 5327768 +
caactcgattcagaattttttg

SEQ ID NO: 101290 - DNA, 22 bp, Artificial Sequence
  Synthetic oligonucleotide; TTC chr11 5327747 5327768 5327764 5327769 +
aactcgattcagaattttttgt

SEQ ID NO: 101291 - DNA, 22 bp, Artificial Sequence
  Synthetic oligonucleotide; CTC chr11 5327752 5327773 5327769 5327774 +
gattcagaattttttgtctact

SEQ ID NO: 101292 - DNA, 22 bp, Artificial Sequence
  Synthetic oligonucleotide; TTC chr11 5327757 5327778 5327774 5327779 +
agaattttttgtctactcttca

SEQ ID NO: 101293 - DNA, 22 bp, Artificial Sequence
  Synthetic oligonucleotide; TTT chr11 5327764 5327785 5327781 5327786 +
tttgtctactcttcagagaaaa

SEQ ID NO: 101294 - DNA, 22 bp, Artificial Sequence
  Synthetic oligonucleotide; TTT chr11 5327765 5327786 5327782 5327787 +
ttgtctactcttcagagaaaaa

SEQ ID NO: 101295 - DNA, 22 bp, Artificial Sequence
  Synthetic oligonucleotide; TTT chr11 5327766 5327787 5327783 5327788 +
tgtctactcttcagagaaaaac

SEQ ID NO: 101296 - DNA, 22 bp, Artificial Sequence
  Synthetic oligonucleotide; TTT chr11 5327767 5327788 5327784 5327789 +
gtctactcttcagagaaaaact

SEQ ID NO: 101297 - DNA, 22 bp, Artificial Sequence
  Synthetic oligonucleotide; TTG chr11 5327768 5327789 5327785 5327790 +
tctactcttcagagaaaaacta

SEQ ID NO: 101298 - DNA, 22 bp, Artificial Sequence
  Synthetic oligonucleotide; CTA chr11 5327772 5327793 5327789 5327794 +
ctcttcagagaaaaactatcaa

SEQ ID NO: 101299 - DNA, 22 bp, Artificial Sequence
  Synthetic oligonucleotide; CTC chr11 5327775 5327796 5327792 5327797 +
ttcagagaaaaactatcaacaa

SEQ ID NO: 101300 - DNA, 22 bp, Artificial Sequence
  Synthetic oligonucleotide; CTT chr11 5327777 5327798 5327794 5327799 +
cagagaaaaactatcaacaaaa

SEQ ID NO: 101301 - DNA, 22 bp, Artificial Sequence
  Synthetic oligonucleotide; TTC chr11 5327778 5327799 5327795 5327800 +
agagaaaaactatcaacaaaaa

SEQ ID NO: 101302 - DNA, 22 bp, Artificial Sequence
  Synthetic oligonucleotide; CTA chr11 5327790 5327811 5327807 5327812 +
tcaacaaaaaatcctctgaaca

SEQ ID NO: 101303 - DNA, 22 bp, Artificial Sequence
  Synthetic oligonucleotide; CTC chr11 5327806 5327827 5327823 5327828 +
tgaacaggaaagttatcaataa

SEQ ID NO: 101304 - DNA, 22 bp, Artificial Sequence
  Synthetic oligonucleotide; CTG chr11 5327808 5327829 5327825 5327830 +
aacaggaaagttatcaataaaa

SEQ ID NO: 101305 - DNA, 22 bp, Artificial Sequence
  Synthetic oligonucleotide; TTA chr11 5327821 5327842 5327838 5327843 +
tcaataaaaaataaacgtaaaa

SEQ ID NO: 101306 - DNA, 22 bp, Artificial Sequence
  Synthetic oligonucleotide; CTT chr11 5327852 5327873 5327869 5327874 +
tctggataaacaaaaactgagt

SEQ ID NO: 101307 - DNA, 22 bp, Artificial Sequence
  Synthetic oligonucleotide; TTT chr11 5327853 5327874 5327870 5327875 +
ctggataaacaaaaactgagtt

SEQ ID NO: 101308 - DNA, 22 bp, Artificial Sequence
  Synthetic oligonucleotide; TTC chr11 5327854 5327875 5327871 5327876 +
tggataaacaaaaactgagttg

SEQ ID NO: 101309 - DNA, 22 bp, Artificial Sequence
  Synthetic oligonucleotide; CTG chr11 5327856 5327877 5327873 5327878 +
gataaacaaaaactgagttgat

SEQ ID NO: 101310 - DNA, 22 bp, Artificial Sequence
  Synthetic oligonucleotide; CTG chr11 5327871 5327892 5327888 5327893 +
agttgatttcaactaagttgaa

SEQ ID NO: 101311 - DNA, 22 bp, Artificial Sequence
  Synthetic oligonucleotide; TTG chr11 5327876 5327897 5327893 5327898 +
atttcaactaagttgaaaccaa

SEQ ID NO: 101312 - DNA, 22 bp, Artificial Sequence
  Synthetic oligonucleotide; TTT chr11 5327880 5327901 5327897 5327902 +
caactaagttgaaaccaaatga

SEQ ID NO: 101313 - DNA, 22 bp, Artificial Sequence
  Synthetic oligonucleotide; TTC chr11 5327881 5327902 5327898 5327903 +
aactaagttgaaaccaaatgac

SEQ ID NO: 101314 - DNA, 22 bp, Artificial Sequence
  Synthetic oligonucleotide; CTA chr11 5327886 5327907 5327903 5327908 +
agttgaaaccaaatgaccaaag

SEQ ID NO: 101315 - DNA, 22 bp, Artificial Sequence
  Synthetic oligonucleotide; TTG chr11 5327891 5327912 5327908 5327913 +
aaaccaaatgaccaaagatgat

SEQ ID NO: 101316 - DNA, 22 bp, Artificial Sequence
  Synthetic oligonucleotide; TTT chr11 5327918 5327939 5327935 5327940 +
gaatctacataaaatgacaaaa

SEQ ID NO: 101317 - DNA, 22 bp, Artificial Sequence
  Synthetic oligonucleotide; TTG chr11 5327919 5327940 5327936 5327941 +
aatctacataaaatgacaaaag

SEQ ID NO: 101318 - DNA, 22 bp, Artificial Sequence
  Synthetic oligonucleotide; CTA chr11 5327925 5327946 5327942 5327947 +
cataaaatgacaaaagcaccag

SEQ ID NO: 101319 - DNA, 22 bp, Artificial Sequence
  Synthetic oligonucleotide; TTA chr11 5327967 5327988 5327984 5327989 +
tagaagacattatgcatacata

SEQ ID NO: 101320 - DNA, 22 bp, Artificial Sequence
  Synthetic oligonucleotide; TTA chr11 5327979 5328000 5327996 5328001 +
tgcatacatattcctttctgct

SEQ ID NO: 101321 - DNA, 22 bp, Artificial Sequence
  Synthetic oligonucleotide; TTC chr11 5327992 5328013 5328009 5328014 +
ctttctgcttcttattttcaaa

SEQ ID NO: 101322 - DNA, 22 bp, Artificial Sequence
  Synthetic oligonucleotide; CTT chr11 5327995 5328016 5328012 5328017 +
tctgcttcttattttcaaaaat

SEQ ID NO: 101323 - DNA, 22 bp, Artificial Sequence
  Synthetic oligonucleotide; TTT chr11 5327996 5328017 5328013 5328018 +
ctgcttcttattttcaaaaatg

SEQ ID NO: 101324 - DNA, 22 bp, Artificial Sequence
  Synthetic oligonucleotide; TTC chr11 5327997 5328018 5328014 5328019 +
tgcttcttattttcaaaaatga

SEQ ID NO: 101325 - DNA, 22 bp, Artificial Sequence
  Synthetic oligonucleotide; CTG chr11 5327999 5328020 5328016 5328021 +
cttcttattttcaaaaatgaat

SEQ ID NO: 101326 - DNA, 22 bp, Artificial Sequence
  Synthetic oligonucleotide; CTT chr11 5328002 5328023 5328019 5328024 +
cttattttcaaaaatgaatgta

SEQ ID NO: 101327 - DNA, 22 bp, Artificial Sequence
  Synthetic oligonucleotide; TTC chr11 5328003 5328024 5328020 5328025 +
ttattttcaaaaatgaatgtat

SEQ ID NO: 101328 - DNA, 22 bp, Artificial Sequence
  Synthetic oligonucleotide; CTT chr11 5328005 5328026 5328022 5328027 +
attttcaaaaatgaatgtatta

SEQ ID NO: 101329 - DNA, 22 bp, Artificial Sequence
  Synthetic oligonucleotide; TTA chr11 5328006 5328027 5328023 5328028 +
ttttcaaaaatgaatgtattac

SEQ ID NO: 101330 - DNA, 22 bp, Artificial Sequence
  Synthetic oligonucleotide; TTT chr11 5328009 5328030 5328026 5328031 +
tcaaaaatgaatgtattacaat

SEQ ID NO: 101331 - DNA, 22 bp, Artificial Sequence
  Synthetic oligonucleotide; TTT chr11 5328010 5328031 5328027 5328032 +
caaaaatgaatgtattacaata

SEQ ID NO: 101332 - DNA, 22 bp, Artificial Sequence
  Synthetic oligonucleotide; TTC chr11 5328011 5328032 5328028 5328033 +
aaaaatgaatgtattacaataa

SEQ ID NO: 101333 - DNA, 22 bp, Artificial Sequence
  Synthetic oligonucleotide; TTA chr11 5328027 5328048 5328044 5328049 +
caataaaaaatagaattgcatt

SEQ ID NO: 101334 - DNA, 22 bp, Artificial Sequence
  Synthetic oligonucleotide; TTG chr11 5328045 5328066 5328062 5328067 +
cattgctggaactattacaaat

SEQ ID NO: 101335 - DNA, 22 bp, Artificial Sequence
  Synthetic oligonucleotide; TTG chr11 5328050 5328071 5328067 5328072 +
ctggaactattacaaatataaa

SEQ ID NO: 101336 - DNA, 22 bp, Artificial Sequence
  Synthetic oligonucleotide; CTG chr11 5328053 5328074 5328070 5328075 +
gaactattacaaatataaatgt

SEQ ID NO: 101337 - DNA, 22 bp, Artificial Sequence
  Synthetic oligonucleotide; CTA chr11 5328059 5328080 5328076 5328081 +
ttacaaatataaatgtaatata

SEQ ID NO: 101338 - DNA, 22 bp, Artificial Sequence
  Synthetic oligonucleotide; TTA chr11 5328062 5328083 5328079 5328084 +
caaatataaatgtaatatattt

SEQ ID NO: 101339 - DNA, 22 bp, Artificial Sequence
  Synthetic oligonucleotide; TTT chr11 5328084 5328105 5328101 5328106 +
accaataactgaacaaaggagg

SEQ ID NO: 101340 - DNA, 22 bp, Artificial Sequence
  Synthetic oligonucleotide; TTA chr11 5328085 5328106 5328102 5328107 +
ccaataactgaacaaaggaggt

SEQ ID NO: 101341 - DNA, 22 bp, Artificial Sequence
  Synthetic oligonucleotide; CTG chr11 5328095 5328116 5328112 5328117 +
aacaaaggaggtgagtgataac

SEQ ID NO: 101342 - DNA, 22 bp, Artificial Sequence
  Synthetic oligonucleotide; CTG chr11 5328124 5328145 5328141 5328146 +
ttttggaatgaagaaatattct

SEQ ID NO: 101343 - DNA, 22 bp, Artificial Sequence
  Synthetic oligonucleotide; TTT chr11 5328127 5328148 5328144 5328149 +
tggaatgaagaaatattctctg

SEQ ID NO: 101344 - DNA, 22 bp, Artificial Sequence
  Synthetic oligonucleotide; TTT chr11 5328128 5328149 5328145 5328150 +
ggaatgaagaaatattctctga

SEQ ID NO: 101345 - DNA, 22 bp, Artificial Sequence
  Synthetic oligonucleotide; TTG chr11 5328129 5328150 5328146 5328151 +
gaatgaagaaatattctctgaa

SEQ ID NO: 101346 - DNA, 22 bp, Artificial Sequence
  Synthetic oligonucleotide; TTC chr11 5328145 5328166 5328162 5328167 +
tctgaaaaaaaagctataaaca

SEQ ID NO: 101347 - DNA, 22 bp, Artificial Sequence
  Synthetic oligonucleotide; CTC chr11 5328147 5328168 5328164 5328169 +
tgaaaaaaaagctataaacatc

SEQ ID NO: 101348 - DNA, 22 bp, Artificial Sequence
  Synthetic oligonucleotide; CTG chr11 5328149 5328170 5328166 5328171 +
aaaaaaaagctataaacatcta

SEQ ID NO: 101349 - DNA, 22 bp, Artificial Sequence
  Synthetic oligonucleotide; CTA chr11 5328161 5328182 5328178 5328183 +
taaacatctacatagaaaaatg

SEQ ID NO: 101350 - DNA, 22 bp, Artificial Sequence
  Synthetic oligonucleotide; CTA chr11 5328171 5328192 5328188 5328193 +
catagaaaaatgagtaagaatg

SEQ ID NO: 101351 - DNA, 22 bp, Artificial Sequence
  Synthetic oligonucleotide; TTC chr11 5328213 5328234 5328230 5328235 +
tgagcattaacaattatactta

SEQ ID NO: 101352 - DNA, 22 bp, Artificial Sequence
  Synthetic oligonucleotide; CTG chr11 5328215 5328236 5328232 5328237 +
agcattaacaattatacttatg

SEQ ID NO: 101353 - DNA, 22 bp, Artificial Sequence
  Synthetic oligonucleotide; TTA chr11 5328222 5328243 5328239 5328244 +
acaattatacttatgccaatcc

SEQ ID NO: 101354 - DNA, 22 bp, Artificial Sequence
  Synthetic oligonucleotide; TTA chr11 5328229 5328250 5328246 5328251 +
tacttatgccaatccaagggtc

SEQ ID NO: 101355 - DNA, 22 bp, Artificial Sequence
  Synthetic oligonucleotide; CTT chr11 5328234 5328255 5328251 5328256 +
atgccaatccaagggtcccaga

SEQ ID NO: 101356 - DNA, 22 bp, Artificial Sequence
  Synthetic oligonucleotide; TTA chr11 5328235 5328256 5328252 5328257 +
tgccaatccaagggtcccagat

SEQ ID NO: 101357 - DNA, 22 bp, Artificial Sequence
  Synthetic oligonucleotide; TTA chr11 5328259 5328280 5328276 5328281 +
gaaaacctaaatctatcacagt

SEQ ID NO: 101358 - DNA, 22 bp, Artificial Sequence
  Synthetic oligonucleotide; CTA chr11 5328268 5328289 5328285 5328290 +
aatctatcacagttccttaaat

SEQ ID NO: 101359 - DNA, 22 bp, Artificial Sequence
  Synthetic oligonucleotide; CTA chr11 5328274 5328295 5328291 5328296 +
tcacagttccttaaatactctt

SEQ ID NO: 101360 - DNA, 22 bp, Artificial Sequence
  Synthetic oligonucleotide; TTC chr11 5328283 5328304 5328300 5328305 +
cttaaatactctttcaaaaaag

SEQ ID NO: 101361 - DNA, 22 bp, Artificial Sequence
  Synthetic oligonucleotide; CTT chr11 5328286 5328307 5328303 5328308 +
aaatactctttcaaaaaagaaa

SEQ ID NO: 101362 - DNA, 22 bp, Artificial Sequence
  Synthetic oligonucleotide; TTA chr11 5328287 5328308 5328304 5328309 +
aatactctttcaaaaaagaaaa

SEQ ID NO: 101363 - DNA, 22 bp, Artificial Sequence
  Synthetic oligonucleotide; CTC chr11 5328294 5328315 5328311 5328316 +
tttcaaaaaagaaaaaaaaaaa

SEQ ID NO: 101364 - DNA, 22 bp, Artificial Sequence
  Synthetic oligonucleotide; CTT chr11 5328296 5328317 5328313 5328318 +
tcaaaaaagaaaaaaaaaaatc

SEQ ID NO: 101365 - DNA, 22 bp, Artificial Sequence
  Synthetic oligonucleotide; TTT chr11 5328297 5328318 5328314 5328319 +
caaaaaagaaaaaaaaaaatct

SEQ ID NO: 101366 - DNA, 22 bp, Artificial Sequence
  Synthetic oligonucleotide; TTC chr11 5328298 5328319 5328315 5328320 +
aaaaaagaaaaaaaaaaatctg

SEQ ID NO: 101367 - DNA, 22 bp, Artificial Sequence
  Synthetic oligonucleotide; CTG chr11 5328320 5328341 5328337 5328342 +
tgctgtaggatatcccacctca

SEQ ID NO: 101368 - DNA, 22 bp, Artificial Sequence
  Synthetic oligonucleotide; CTG chr11 5328325 5328346 5328342 5328347 +
taggatatcccacctcagctgt

SEQ ID NO: 101369 - DNA, 22 bp, Artificial Sequence
  Synthetic oligonucleotide; CTC chr11 5328341 5328362 5328358 5328363 +
agctgtgatctttacctctagg

SEQ ID NO: 101370 - DNA, 22 bp, Artificial Sequence
  Synthetic oligonucleotide; CTG chr11 5328346 5328367 5328363 5328368 +
tgatctttacctctaggcagac

SEQ ID NO: 101371 - DNA, 22 bp, Artificial Sequence
  Synthetic oligonucleotide; CTT chr11 5328353 5328374 5328370 5328375 +
tacctctaggcagacctctgga

SEQ ID NO: 101372 - DNA, 22 bp, Artificial Sequence
  Synthetic oligonucleotide; TTT chr11 5328354 5328375 5328371 5328376 +
acctctaggcagacctctggaa

SEQ ID NO: 101373 - DNA, 22 bp, Artificial Sequence
  Synthetic oligonucleotide; TTA chr11 5328355 5328376 5328372 5328377 +
cctctaggcagacctctggaaa

SEQ ID NO: 101374 - DNA, 22 bp, Artificial Sequence
  Synthetic oligonucleotide; CTC chr11 5328359 5328380 5328376 5328381 +
taggcagacctctggaaaacct

SEQ ID NO: 101375 - DNA, 22 bp, Artificial Sequence
  Synthetic oligonucleotide; CTA chr11 5328361 5328382 5328378 5328383 +
ggcagacctctggaaaaccttc

SEQ ID NO: 101376 - DNA, 22 bp, Artificial Sequence
  Synthetic oligonucleotide; CTC chr11 5328371 5328392 5328388 5328393 +
tggaaaaccttcttatatgctt

SEQ ID NO: 101377 - DNA, 22 bp, Artificial Sequence
  Synthetic oligonucleotide; CTG chr11 5328373 5328394 5328390 5328395 +
gaaaaccttcttatatgctttc

SEQ ID NO: 101378 - DNA, 22 bp, Artificial Sequence
  Synthetic oligonucleotide; CTT chr11 5328382 5328403 5328399 5328404 +
cttatatgctttccttgagtgc

SEQ ID NO: 101379 - DNA, 22 bp, Artificial Sequence
  Synthetic oligonucleotide; TTC chr11 5328383 5328404 5328400 5328405 +
ttatatgctttccttgagtgca

SEQ ID NO: 101380 - DNA, 22 bp, Artificial Sequence
  Synthetic oligonucleotide; CTT chr11 5328385 5328406 5328402 5328407 +
atatgctttccttgagtgcatc

SEQ ID NO: 101381 - DNA, 22 bp, Artificial Sequence
  Synthetic oligonucleotide; TTA chr11 5328386 5328407 5328403 5328408 +
tatgctttccttgagtgcatct

SEQ ID NO: 101382 - DNA, 22 bp, Artificial Sequence
  Synthetic oligonucleotide; CTT chr11 5328393 5328414 5328410 5328415 +
tccttgagtgcatctcacatca

SEQ ID NO: 101383 - DNA, 22 bp, Artificial Sequence
  Synthetic oligonucleotide; TTT chr11 5328394 5328415 5328411 5328416 +
ccttgagtgcatctcacatcag

SEQ ID NO: 101384 - DNA, 22 bp, Artificial Sequence
  Synthetic oligonucleotide; TTC chr11 5328395 5328416 5328412 5328417 +
cttgagtgcatctcacatcaga

SEQ ID NO: 101385 - DNA, 22 bp, Artificial Sequence
  Synthetic oligonucleotide; CTT chr11 5328398 5328419 5328415 5328420 +
gagtgcatctcacatcagaaga

SEQ ID NO: 101386 - DNA, 22 bp, Artificial Sequence
  Synthetic oligonucleotide; TTG chr11 5328399 5328420 5328416 5328421 +
agtgcatctcacatcagaagag

SEQ ID NO: 101387 - DNA, 22 bp, Artificial Sequence
  Synthetic oligonucleotide; CTC chr11 5328409 5328430 5328426 5328431 +
acatcagaagagagaggaatca

SEQ ID NO: 101388 - DNA, 22 bp, Artificial Sequence
  Synthetic oligonucleotide; TTC chr11 5328434 5328455 5328451 5328456 +
catattcaagttcctggcactc

SEQ ID NO: 101389 - DNA, 22 bp, Artificial Sequence
  Synthetic oligonucleotide; TTC chr11 5328441 5328462 5328458 5328463 +
aagttcctggcactcacccact

SEQ ID NO: 101390 - DNA, 22 bp, Artificial Sequence
  Synthetic oligonucleotide; TTC chr11 5328447 5328468 5328464 5328469 +
ctggcactcacccactcacagt

SEQ ID NO: 101391 - DNA, 22 bp, Artificial Sequence
  Synthetic oligonucleotide; CTG chr11 5328450 5328471 5328467 5328472 +
gcactcacccactcacagtatt

SEQ ID NO: 101392 - DNA, 22 bp, Artificial Sequence
  Synthetic oligonucleotide; CTC chr11 5328456 5328477 5328473 5328478 +
acccactcacagtattgtggct

SEQ ID NO: 101393 - DNA, 22 bp, Artificial Sequence
  Synthetic oligonucleotide; CTC chr11 5328464 5328485 5328481 5328486 +
acagtattgtggctaaaatagg

SEQ ID NO: 101394 - DNA, 22 bp, Artificial Sequence
  Synthetic oligonucleotide; TTG chr11 5328473 5328494 5328490 5328495 +
tggctaaaataggaacctattc

SEQ ID NO: 101395 - DNA, 22 bp, Artificial Sequence
  Synthetic oligonucleotide; CTA chr11 5328479 5328500 5328496 5328501 +
aaataggaacctattcctgtcc

SEQ ID NO: 101396 - DNA, 22 bp, Artificial Sequence
  Synthetic oligonucleotide; CTA chr11 5328492 5328513 5328509 5328514 +
ttcctgtcctctttgaggactc

SEQ ID NO: 101397 - DNA, 22 bp, Artificial Sequence
  Synthetic oligonucleotide; TTC chr11 5328495 5328516 5328512 5328517 +
ctgtcctctttgaggactcagt

SEQ ID NO: 101398 - DNA, 22 bp, Artificial Sequence
  Synthetic oligonucleotide; CTG chr11 5328498 5328519 5328515 5328520 +
tcctctttgaggactcagttca

SEQ ID NO: 101399 - DNA, 22 bp, Artificial Sequence
  Synthetic oligonucleotide; CTC chr11 5328503 5328524 5328520 5328525 +
tttgaggactcagttcagatca

SEQ ID NO: 101400 - DNA, 22 bp, Artificial Sequence
  Synthetic oligonucleotide; CTT chr11 5328505 5328526 5328522 5328527 +
tgaggactcagttcagatcatt

SEQ ID NO: 101401 - DNA, 22 bp, Artificial Sequence
  Synthetic oligonucleotide; TTT chr11 5328506 5328527 5328523 5328528 +
gaggactcagttcagatcattc

SEQ ID NO: 101402 - DNA, 22 bp, Artificial Sequence
  Synthetic oligonucleotide; TTG chr11 5328507 5328528 5328524 5328529 +
aggactcagttcagatcattca

SEQ ID NO: 101403 - DNA, 22 bp, Artificial Sequence
  Synthetic oligonucleotide; CTC chr11 5328514 5328535 5328531 5328536 +
agttcagatcattcactcacag

SEQ ID NO: 101404 - DNA, 22 bp, Artificial Sequence
  Synthetic oligonucleotide; TTC chr11 5328519 5328540 5328536 5328541 +
agatcattcactcacagacctc

SEQ ID NO: 101405 - DNA, 22 bp, Artificial Sequence
  Synthetic oligonucleotide; TTC chr11 5328528 5328549 5328545 5328550 +
actcacagacctctcatgaggc

SEQ ID NO: 101406 - DNA, 22 bp, Artificial Sequence
  Synthetic oligonucleotide; CTC chr11 5328532 5328553 5328549 5328554 +
acagacctctcatgaggcctca

SEQ ID NO: 101407 - DNA, 22 bp, Artificial Sequence
  Synthetic oligonucleotide; CTC chr11 5328541 5328562 5328558 5328563 +
tcatgaggcctcattttaaagc

SEQ ID NO: 101408 - DNA, 22 bp, Artificial Sequence
  Synthetic oligonucleotide; CTC chr11 5328543 5328564 5328560 5328565 +
atgaggcctcattttaaagctt

SEQ ID NO: 101409 - DNA, 22 bp, Artificial Sequence
  Synthetic oligonucleotide; CTC chr11 5328553 5328574 5328570 5328575 +
attttaaagcttatgcatgtgg

SEQ ID NO: 101410 - DNA, 22 bp, Artificial Sequence
  Synthetic oligonucleotide; TTT chr11 5328557 5328578 5328574 5328579 +
taaagcttatgcatgtggaaat

SEQ ID NO: 101411 - DNA, 22 bp, Artificial Sequence
  Synthetic oligonucleotide; TTT chr11 5328558 5328579 5328575 5328580 +
aaagcttatgcatgtggaaatc

SEQ ID NO: 101412 - DNA, 22 bp, Artificial Sequence
  Synthetic oligonucleotide; TTA chr11 5328559 5328580 5328576 5328581 +
aagcttatgcatgtggaaatca

SEQ ID NO: 101413 - DNA, 22 bp, Artificial Sequence
  Synthetic oligonucleotide; CTT chr11 5328565 5328586 5328582 5328587 +
atgcatgtggaaatcacctccc

SEQ ID NO: 101414 - DNA, 22 bp, Artificial Sequence
  Synthetic oligonucleotide; TTA chr11 5328566 5328587 5328583 5328588 +
tgcatgtggaaatcacctcccc

SEQ ID NO: 101415 - DNA, 22 bp, Artificial Sequence
  Synthetic oligonucleotide; CTC chr11 5328585 5328606 5328602 5328607 +
ccctgagtttcatctttctagc

SEQ ID NO: 101416 - DNA, 22 bp, Artificial Sequence
  Synthetic oligonucleotide; CTG chr11 5328590 5328611 5328607 5328612 +
agtttcatctttctagcatctc

SEQ ID NO: 101417 - DNA, 22 bp, Artificial Sequence
  Synthetic oligonucleotide; TTT chr11 5328595 5328616 5328612 5328617 +
catctttctagcatctcaggag

SEQ ID NO: 101418 - DNA, 22 bp, Artificial Sequence
  Synthetic oligonucleotide; TTC chr11 5328596 5328617 5328613 5328618 +
atctttctagcatctcaggaga

SEQ ID NO: 101419 - DNA, 22 bp, Artificial Sequence
  Synthetic oligonucleotide; CTT chr11 5328601 5328622 5328618 5328623 +
tctagcatctcaggagacccct

SEQ ID NO: 101420 - DNA, 22 bp, Artificial Sequence
  Synthetic oligonucleotide; TTT chr11 5328602 5328623 5328619 5328624 +
ctagcatctcaggagacccctt

SEQ ID NO: 101421 - DNA, 22 bp, Artificial Sequence
  Synthetic oligonucleotide; TTC chr11 5328603 5328624 5328620 5328625 +
tagcatctcaggagaccccttg

SEQ ID NO: 101422 - DNA, 22 bp, Artificial Sequence
  Synthetic oligonucleotide; CTA chr11 5328605 5328626 5328622 5328627 +
gcatctcaggagaccccttgat

SEQ ID NO: 101423 - DNA, 22 bp, Artificial Sequence
  Synthetic oligonucleotide; CTC chr11 5328612 5328633 5328629 5328634 +
aggagaccccttgatctccctt

SEQ ID NO: 101424 - DNA, 22 bp, Artificial Sequence
  Synthetic oligonucleotide; CTT chr11 5328624 5328645 5328641 5328646 +
gatctcccttccctctcttctc

SEQ ID NO: 101425 - DNA, 22 bp, Artificial Sequence
  Synthetic oligonucleotide; TTG chr11 5328625 5328646 5328642 5328647 +
atctcccttccctctcttctct

SEQ ID NO: 101426 - DNA, 22 bp, Artificial Sequence
  Synthetic oligonucleotide; CTC chr11 5328630 5328651 5328647 5328652 +
ccttccctctcttctctgttcg

SEQ ID NO: 101427 - DNA, 22 bp, Artificial Sequence
  Synthetic oligonucleotide; CTT chr11 5328634 5328655 5328651 5328656 +
ccctctcttctctgttcgggag

SEQ ID NO: 101428 - DNA, 22 bp, Artificial Sequence
  Synthetic oligonucleotide; TTC chr11 5328635 5328656 5328652 5328657 +
cctctcttctctgttcgggagg

SEQ ID NO: 101429 - DNA, 22 bp, Artificial Sequence
  Synthetic oligonucleotide; CTC chr11 5328639 5328660 5328656 5328661 +
tcttctctgttcgggaggaaca

SEQ ID NO: 101430 - DNA, 22 bp, Artificial Sequence
  Synthetic oligonucleotide; CTC chr11 5328641 5328662 5328658 5328663 +
ttctctgttcgggaggaacagg

SEQ ID NO: 101431 - DNA, 22 bp, Artificial Sequence
  Synthetic oligonucleotide; CTT chr11 5328643 5328664 5328660 5328665 +
ctctgttcgggaggaacagggc

SEQ ID NO: 101432 - DNA, 22 bp, Artificial Sequence
  Synthetic oligonucleotide; TTC chr11 5328644 5328665 5328661 5328666 +
tctgttcgggaggaacagggcc

SEQ ID NO: 101433 - DNA, 22 bp, Artificial Sequence
  Synthetic oligonucleotide; CTC chr11 5328646 5328667 5328663 5328668 +
tgttcgggaggaacagggcccc

SEQ ID NO: 101434 - DNA, 22 bp, Artificial Sequence
  Synthetic oligonucleotide; CTG chr11 5328648 5328669 5328665 5328670 +
ttcgggaggaacagggccccac

SEQ ID NO: 101435 - DNA, 22 bp, Artificial Sequence
  Synthetic oligonucleotide; TTC chr11 5328651 5328672 5328668 5328673 +
gggaggaacagggccccacaac

SEQ ID NO: 101436 - DNA, 22 bp, Artificial Sequence
  Synthetic oligonucleotide; CTG chr11 5328675 5328696 5328692 5328697 +
atgtcctcgggattttcaggtg

SEQ ID NO: 101437 - DNA, 22 bp, Artificial Sequence
  Synthetic oligonucleotide; CTC chr11 5328683 5328704 5328700 5328705 +
gggattttcaggtgtttcctga

SEQ ID NO: 101438 - DNA, 22 bp, Artificial Sequence
  Synthetic oligonucleotide; TTT chr11 5328690 5328711 5328707 5328712 +
tcaggtgtttcctgaagaatgg

SEQ ID NO: 101439 - DNA, 22 bp, Artificial Sequence
  Synthetic oligonucleotide; TTT chr11 5328691 5328712 5328708 5328713 +
caggtgtttcctgaagaatggg

SEQ ID NO: 101440 - DNA, 22 bp, Artificial Sequence
  Synthetic oligonucleotide; TTC chr11 5328692 5328713 5328709 5328714 +
aggtgtttcctgaagaatgggg

SEQ ID NO: 101441 - DNA, 22 bp, Artificial Sequence
  Synthetic oligonucleotide; TTT chr11 5328700 5328721 5328717 5328722 +
cctgaagaatggggtgaggaaa

SEQ ID NO: 101442 - DNA, 22 bp, Artificial Sequence
  Synthetic oligonucleotide; TTC chr11 5328701 5328722 5328718 5328723 +
ctgaagaatggggtgaggaaaa

SEQ ID NO: 101443 - DNA, 22 bp, Artificial Sequence
  Synthetic oligonucleotide; CTG chr11 5328704 5328725 5328721 5328726 +
aagaatggggtgaggaaaattt

SEQ ID NO: 101444 - DNA, 22 bp, Artificial Sequence
  Synthetic oligonucleotide; TTT chr11 5328726 5328747 5328743 5328748 +
gaaattcaaaaaccagctgatg

SEQ ID NO: 101445 - DNA, 22 bp, Artificial Sequence
  Synthetic oligonucleotide; TTG chr11 5328727 5328748 5328744 5328749 +
aaattcaaaaaccagctgatgt

SEQ ID NO: 101446 - DNA, 22 bp, Artificial Sequence
  Synthetic oligonucleotide; TTC chr11 5328733 5328754 5328750 5328755 +
aaaaaccagctgatgtaagata

SEQ ID NO: 101447 - DNA, 22 bp, Artificial Sequence
  Synthetic oligonucleotide; CTG chr11 5328745 5328766 5328762 5328767 +
atgtaagatagggataccaggg

SEQ ID NO: 101448 - DNA, 22 bp, Artificial Sequence
  Synthetic oligonucleotide; CTT chr11 5328770 5328791 5328787 5328792 +
ggttatgtgacccaaggaggct

SEQ ID NO: 101449 - DNA, 22 bp, Artificial Sequence
  Synthetic oligonucleotide; TTG chr11 5328771 5328792 5328788 5328793 +
gttatgtgacccaaggaggctc

SEQ ID NO: 101450 - DNA, 22 bp, Artificial Sequence
  Synthetic oligonucleotide; TTA chr11 5328775 5328796 5328792 5328797 +
tgtgacccaaggaggctcagca

SEQ ID NO: 101451 - DNA, 22 bp, Artificial Sequence
  Synthetic oligonucleotide; CTC chr11 5328793 5328814 5328810 5328815 +
agcatcataacttagtttattt

SEQ ID NO: 101452 - DNA, 22 bp, Artificial Sequence
  Synthetic oligonucleotide; CTT chr11 5328806 5328827 5328823 5328828 +
agtttatttgaaagggttaggg

SEQ ID NO: 101453 - DNA, 22 bp, Artificial Sequence
  Synthetic oligonucleotide; TTA chr11 5328807 5328828 5328824 5328829 +
gtttatttgaaagggttagggg

SEQ ID NO: 101454 - DNA, 22 bp, Artificial Sequence
  Synthetic oligonucleotide; TTT chr11 5328811 5328832 5328828 5328833 +
atttgaaagggttaggggatat

SEQ ID NO: 101455 - DNA, 22 bp, Artificial Sequence
  Synthetic oligonucleotide; TTA chr11 5328812 5328833 5328829 5328834 +
tttgaaagggttaggggatatc

SEQ ID NO: 101456 - DNA, 22 bp, Artificial Sequence
  Synthetic oligonucleotide; TTT chr11 5328815 5328836 5328832 5328837 +
gaaagggttaggggatatcggt

SEQ ID NO: 101457 - DNA, 22 bp, Artificial Sequence
  Synthetic oligonucleotide; TTG chr11 5328816 5328837 5328833 5328838 +
aaagggttaggggatatcggtt

SEQ ID NO: 101458 - DNA, 22 bp, Artificial Sequence
  Synthetic oligonucleotide; TTA chr11 5328825 5328846 5328842 5328847 +
ggggatatcggttgtcttcagg

SEQ ID NO: 101459 - DNA, 22 bp, Artificial Sequence
  Synthetic oligonucleotide; TTG chr11 5328839 5328860 5328856 5328861 +
tcttcagggatcatatgtacct

SEQ ID NO: 101460 - DNA, 22 bp, Artificial Sequence
  Synthetic oligonucleotide; CTT chr11 5328843 5328864 5328860 5328865 +
cagggatcatatgtacctctac

SEQ ID NO: 101461 - DNA, 22 bp, Artificial Sequence
  Synthetic oligonucleotide; TTC chr11 5328844 5328865 5328861 5328866 +
agggatcatatgtacctctacg

SEQ ID NO: 101462 - DNA, 22 bp, Artificial Sequence
  Synthetic oligonucleotide; CTC chr11 5328862 5328883 5328879 5328884 +
tacgggtcctagagcttatgaa

SEQ ID NO: 101463 - DNA, 22 bp, Artificial Sequence
  Synthetic oligonucleotide; CTA chr11 5328864 5328885 5328881 5328886 +
cgggtcctagagcttatgaatt

SEQ ID NO: 101464 - DNA, 22 bp, Artificial Sequence
  Synthetic oligonucleotide; CTA chr11 5328873 5328894 5328890 5328895 +
gagcttatgaattccaattgcg

SEQ ID NO: 101465 - DNA, 22 bp, Artificial Sequence
  Synthetic oligonucleotide; CTT chr11 5328879 5328900 5328896 5328901 +
atgaattccaattgcgtttttg

SEQ ID NO: 101466 - DNA, 22 bp, Artificial Sequence
  Synthetic oligonucleotide; TTA chr11 5328880 5328901 5328897 5328902 +
tgaattccaattgcgtttttgt

SEQ ID NO: 101467 - DNA, 22 bp, Artificial Sequence
  Synthetic oligonucleotide; TTC chr11 5328887 5328908 5328904 5328909 +
caattgcgtttttgtctttcct

SEQ ID NO: 101468 - DNA, 22 bp, Artificial Sequence
  Synthetic oligonucleotide; TTG chr11 5328893 5328914 5328910 5328915 +
cgtttttgtctttcctgttact

SEQ ID NO: 101469 - DNA, 22 bp, Artificial Sequence
  Synthetic oligonucleotide; TTT chr11 5328898 5328919 5328915 5328920 +
ttgtctttcctgttactttggt

SEQ ID NO: 101470 - DNA, 22 bp, Artificial Sequence
  Synthetic oligonucleotide; TTT chr11 5328899 5328920 5328916 5328921 +
tgtctttcctgttactttggta

SEQ ID NO: 101471 - DNA, 22 bp, Artificial Sequence
  Synthetic oligonucleotide; TTT chr11 5328900 5328921 5328917 5328922 +
gtctttcctgttactttggtaa

SEQ ID NO: 101472 - DNA, 22 bp, Artificial Sequence
  Synthetic oligonucleotide; TTG chr11 5328901 5328922 5328918 5328923 +
tctttcctgttactttggtaaa

SEQ ID NO: 101473 - DNA, 22 bp, Artificial Sequence
  Synthetic oligonucleotide; CTT chr11 5328905 5328926 5328922 5328927 +
tcctgttactttggtaaaattt

SEQ ID NO: 101474 - DNA, 22 bp, Artificial Sequence
  Synthetic oligonucleotide; TTT chr11 5328906 5328927 5328923 5328928 +
cctgttactttggtaaaatttg

SEQ ID NO: 101475 - DNA, 22 bp, Artificial Sequence
  Synthetic oligonucleotide; TTC chr11 5328907 5328928 5328924 5328929 +
ctgttactttggtaaaatttgt

SEQ ID NO: 101476 - DNA, 22 bp, Artificial Sequence
  Synthetic oligonucleotide; CTG chr11 5328910 5328931 5328927 5328932 +
ttactttggtaaaatttgttct

SEQ ID NO: 101477 - DNA, 22 bp, Artificial Sequence
  Synthetic oligonucleotide; TTA chr11 5328913 5328934 5328930 5328935 +
ctttggtaaaatttgttcttat

SEQ ID NO: 101478 - DNA, 22 bp, Artificial Sequence
  Synthetic oligonucleotide; CTT chr11 5328916 5328937 5328933 5328938 +
tggtaaaatttgttcttatcta

SEQ ID NO: 101479 - DNA, 22 bp, Artificial Sequence
  Synthetic oligonucleotide; TTT chr11 5328917 5328938 5328934 5328939 +
ggtaaaatttgttcttatctac

SEQ ID NO: 101480 - DNA, 22 bp, Artificial Sequence
  Synthetic oligonucleotide; TTG chr11 5328918 5328939 5328935 5328940 +
gtaaaatttgttcttatctact

SEQ ID NO: 101481 - DNA, 22 bp, Artificial Sequence
  Synthetic oligonucleotide; TTT chr11 5328927 5328948 5328944 5328949 +
gttcttatctactggaacttca

SEQ ID NO: 101482 - DNA, 22 bp, Artificial Sequence
  Synthetic oligonucleotide; TTG chr11 5328928 5328949 5328945 5328950 +
ttcttatctactggaacttcaa

SEQ ID NO: 101483 - DNA, 22 bp, Artificial Sequence
  Synthetic oligonucleotide; TTC chr11 5328931 5328952 5328948 5328953 +
ttatctactggaacttcaatgg

SEQ ID NO: 101484 - DNA, 22 bp, Artificial Sequence
  Synthetic oligonucleotide; CTT chr11 5328933 5328954 5328950 5328955 +
atctactggaacttcaatggat

SEQ ID NO: 101485 - DNA, 22 bp, Artificial Sequence
  Synthetic oligonucleotide; TTA chr11 5328934 5328955 5328951 5328956 +
tctactggaacttcaatggatc

SEQ ID NO: 101486 - DNA, 22 bp, Artificial Sequence
  Synthetic oligonucleotide; CTA chr11 5328938 5328959 5328955 5328960 +
ctggaacttcaatggatctgtt

SEQ ID NO: 101487 - DNA, 22 bp, Artificial Sequence
  Synthetic oligonucleotide; CTG chr11 5328941 5328962 5328958 5328963 +
gaacttcaatggatctgttaat

SEQ ID NO: 101488 - DNA, 22 bp, Artificial Sequence
  Synthetic oligonucleotide; CTT chr11 5328947 5328968 5328964 5328969 +
caatggatctgttaatagtcat

SEQ ID NO: 101489 - DNA, 22 bp, Artificial Sequence
  Synthetic oligonucleotide; TTC chr11 5328948 5328969 5328965 5328970 +
aatggatctgttaatagtcatg

SEQ ID NO: 101490 - DNA, 22 bp, Artificial Sequence
  Synthetic oligonucleotide; CTG chr11 5328958 5328979 5328975 5328980 +
ttaatagtcatgcagattcatg

SEQ ID NO: 101491 - DNA, 22 bp, Artificial Sequence
  Synthetic oligonucleotide; TTA chr11 5328961 5328982 5328978 5328983 +
atagtcatgcagattcatgaca

SEQ ID NO: 101492 - DNA, 22 bp, Artificial Sequence
  Synthetic oligonucleotide; TTC chr11 5328977 5328998 5328994 5328999 +
atgacattcagctttttttttt

SEQ ID NO: 101493 - DNA, 22 bp, Artificial Sequence
  Synthetic oligonucleotide; TTC chr11 5328986 5329007 5329003 5329008 +
agcttttttttttttttttttt

SEQ ID NO: 101494 - DNA, 22 bp, Artificial Sequence
  Synthetic oligonucleotide; CTT chr11 5328991 5329012 5329008 5329013 +
tttttttttttttttttttttt

SEQ ID NO: 101495 - DNA, 22 bp, Artificial Sequence
  Synthetic oligonucleotide; TTT chr11 5328992 5329013 5329009 5329014 +
tttttttttttttttttttttt

SEQ ID NO: 101496 - DNA, 22 bp, Artificial Sequence
  Synthetic oligonucleotide; TTT chr11 5328993 5329014 5329010 5329015 +
tttttttttttttttttttttt

SEQ ID NO: 101497 - DNA, 22 bp, Artificial Sequence
  Synthetic oligonucleotide; TTT chr11 5328994 5329015 5329011 5329016 +
tttttttttttttttttttttt

SEQ ID NO: 101498 - DNA, 22 bp, Artificial Sequence
  Synthetic oligonucleotide; TTT chr11 5328995 5329016 5329012 5329017 +
tttttttttttttttttttttt

SEQ ID NO: 101499 - DNA, 22 bp, Artificial Sequence
  Synthetic oligonucleotide; TTT chr11 5328996 5329017 5329013 5329018 +
ttttttttttttttttttttta

SEQ ID NO: 101500 - DNA, 22 bp, Artificial Sequence
  Synthetic oligonucleotide; TTT chr11 5328997 5329018 5329014 5329019 +
ttttttttttttttttttttag

SEQ ID NO: 101501 - DNA, 22 bp, Artificial Sequence
  Synthetic oligonucleotide; TTT chr11 5328998 5329019 5329015 5329020 +
tttttttttttttttttttaga

SEQ ID NO: 101502 - DNA, 22 bp, Artificial Sequence
  Synthetic oligonucleotide; TTT chr11 5328999 5329020 5329016 5329021 +
ttttttttttttttttttagat

SEQ ID NO: 101503 - DNA, 22 bp, Artificial Sequence
  Synthetic oligonucleotide; TTT chr11 5329000 5329021 5329017 5329022 +
tttttttttttttttttagata

SEQ ID NO: 101504 - DNA, 22 bp, Artificial Sequence
  Synthetic oligonucleotide; TTT chr11 5329001 5329022 5329018 5329023 +
ttttttttttttttttagatag

SEQ ID NO: 101505 - DNA, 22 bp, Artificial Sequence
  Synthetic oligonucleotide; TTT chr11 5329002 5329023 5329019 5329024 +
tttttttttttttttagataga

SEQ ID NO: 101506 - DNA, 22 bp, Artificial Sequence
  Synthetic oligonucleotide; TTT chr11 5329003 5329024 5329020 5329025 +
ttttttttttttttagatagag

SEQ ID NO: 101507 - DNA, 22 bp, Artificial Sequence
  Synthetic oligonucleotide; TTT chr11 5329004 5329025 5329021 5329026 +
tttttttttttttagatagagt

SEQ ID NO: 101508 - DNA, 22 bp, Artificial Sequence
  Synthetic oligonucleotide; TTT chr11 5329005 5329026 5329022 5329027 +
ttttttttttttagatagagtc

SEQ ID NO: 101509 - DNA, 22 bp, Artificial Sequence
  Synthetic oligonucleotide; TTT chr11 5329006 5329027 5329023 5329028 +
tttttttttttagatagagtct

SEQ ID NO: 101510 - DNA, 22 bp, Artificial Sequence
  Synthetic oligonucleotide; TTT chr11 5329007 5329028 5329024 5329029 +
ttttttttttagatagagtctc

SEQ ID NO: 101511 - DNA, 22 bp, Artificial Sequence
  Synthetic oligonucleotide; TTT chr11 5329008 5329029 5329025 5329030 +
tttttttttagatagagtctca

SEQ ID NO: 101512 - DNA, 22 bp, Artificial Sequence
  Synthetic oligonucleotide; TTT chr11 5329009 5329030 5329026 5329031 +
ttttttttagatagagtctcac

SEQ ID NO: 101513 - DNA, 22 bp, Artificial Sequence
  Synthetic oligonucleotide; TTT chr11 5329010 5329031 5329027 5329032 +
tttttttagatagagtctcact

SEQ ID NO: 101514 - DNA, 22 bp, Artificial Sequence
  Synthetic oligonucleotide; TTT chr11 5329011 5329032 5329028 5329033 +
ttttttagatagagtctcactc

SEQ ID NO: 101515 - DNA, 22 bp, Artificial Sequence
  Synthetic oligonucleotide; TTT chr11 5329012 5329033 5329029 5329034 +
tttttagatagagtctcactct

SEQ ID NO: 101516 - DNA, 22 bp, Artificial Sequence
  Synthetic oligonucleotide; TTT chr11 5329013 5329034 5329030 5329035 +
ttttagatagagtctcactctg

SEQ ID NO: 101517 - DNA, 22 bp, Artificial Sequence
  Synthetic oligonucleotide; TTT chr11 5329014 5329035 5329031 5329036 +
tttagatagagtctcactctgt

SEQ ID NO: 101518 - DNA, 22 bp, Artificial Sequence
  Synthetic oligonucleotide; TTT chr11 5329015 5329036 5329032 5329037 +
ttagatagagtctcactctgtc

SEQ ID NO: 101519 - DNA, 22 bp, Artificial Sequence
  Synthetic oligonucleotide; TTT chr11 5329016 5329037 5329033 5329038 +
tagatagagtctcactctgtcg

SEQ ID NO: 101520 - DNA, 22 bp, Artificial Sequence
  Synthetic oligonucleotide; TTT chr11 5329017 5329038 5329034 5329039 +
agatagagtctcactctgtcgc

SEQ ID NO: 101521 - DNA, 22 bp, Artificial Sequence
  Synthetic oligonucleotide; TTA chr11 5329018 5329039 5329035 5329040 +
gatagagtctcactctgtcgcc

SEQ ID NO: 101522 - DNA, 22 bp, Artificial Sequence
  Synthetic oligonucleotide; CTC chr11 5329029 5329050 5329046 5329051 +
actctgtcgccaggctggagtg

SEQ ID NO: 101523 - DNA, 22 bp, Artificial Sequence
  Synthetic oligonucleotide; CTC chr11 5329033 5329054 5329050 5329055 +
tgtcgccaggctggagtgcagt

SEQ ID NO: 101524 - DNA, 22 bp, Artificial Sequence
  Synthetic oligonucleotide; CTG chr11 5329035 5329056 5329052 5329057 +
tcgccaggctggagtgcagtag

SEQ ID NO: 101525 - DNA, 22 bp, Artificial Sequence
  Synthetic oligonucleotide; CTG chr11 5329046 5329067 5329063 5329068 +
gagtgcagtagcacaatctcag

SEQ ID NO: 101526 - DNA, 22 bp, Artificial Sequence
  Synthetic oligonucleotide; CTC chr11 5329066 5329087 5329083 5329088 +
agctcactgcaaactccacctc

SEQ ID NO: 101527 - DNA, 22 bp, Artificial Sequence
  Synthetic oligonucleotide; CTC chr11 5329071 5329092 5329088 5329093 +
actgcaaactccacctcccagg

SEQ ID NO: 101528 - DNA, 22 bp, Artificial Sequence
  Synthetic oligonucleotide; CTG chr11 5329075 5329096 5329092 5329097 +
caaactccacctcccaggttca

SEQ ID NO: 101529 - DNA, 22 bp, Artificial Sequence
  Synthetic oligonucleotide; CTC chr11 5329082 5329103 5329099 5329104 +
cacctcccaggttcaagtgatt

SEQ ID NO: 101530 - DNA, 22 bp, Artificial Sequence
  Synthetic oligonucleotide; CTC chr11 5329088 5329109 5329105 5329110 +
ccaggttcaagtgattctcctg

SEQ ID NO: 101531 - DNA, 22 bp, Artificial Sequence
  Synthetic oligonucleotide; TTC chr11 5329096 5329117 5329113 5329118 +
aagtgattctcctgccacagcc

SEQ ID NO: 101532 - DNA, 22 bp, Artificial Sequence
  Synthetic oligonucleotide; TTC chr11 5329105 5329126 5329122 5329127 +
tcctgccacagcctcctgagaa

SEQ ID NO: 101533 - DNA, 22 bp, Artificial Sequence
  Synthetic oligonucleotide; CTC chr11 5329107 5329128 5329124 5329129 +
ctgccacagcctcctgagaagc

SEQ ID NO: 101534 - DNA, 22 bp, Artificial Sequence
  Synthetic oligonucleotide; CTG chr11 5329110 5329131 5329127 5329132 +
ccacagcctcctgagaagctgg

SEQ ID NO: 101535 - DNA, 22 bp, Artificial Sequence
  Synthetic oligonucleotide; CTC chr11 5329120 5329141 5329137 5329142 +
ctgagaagctgggactacagta

SEQ ID NO: 101536 - DNA, 22 bp, Artificial Sequence
  Synthetic oligonucleotide; CTG chr11 5329123 5329144 5329140 5329145 +
agaagctgggactacagtagcg

SEQ ID NO: 101537 - DNA, 22 bp, Artificial Sequence
  Synthetic oligonucleotide; CTG chr11 5329131 5329152 5329148 5329153 +
ggactacagtagcgcgtcacca

SEQ ID NO: 101538 - DNA, 22 bp, Artificial Sequence
  Synthetic oligonucleotide; CTA chr11 5329137 5329158 5329154 5329159 +
cagtagcgcgtcaccacaccca

SEQ ID NO: 101539 - DNA, 22 bp, Artificial Sequence
  Synthetic oligonucleotide; CTA chr11 5329163 5329184 5329180 5329185 +
atttttgtatttttagtagaca

SEQ ID NO: 101540 - DNA, 22 bp, Artificial Sequence
  Synthetic oligonucleotide; TTT chr11 5329167 5329188 5329184 5329189 +
ttgtatttttagtagacacggg

SEQ ID NO: 101541 - DNA, 22 bp, Artificial Sequence
  Synthetic oligonucleotide; TTT chr11 5329168 5329189 5329185 5329190 +
tgtatttttagtagacacgggg

SEQ ID NO: 101542 - DNA, 22 bp, Artificial Sequence
  Synthetic oligonucleotide; TTT chr11 5329169 5329190 5329186 5329191 +
gtatttttagtagacacggggt

SEQ ID NO: 101543 - DNA, 22 bp, Artificial Sequence
  Synthetic oligonucleotide; TTG chr11 5329170 5329191 5329187 5329192 +
tatttttagtagacacggggtt

SEQ ID NO: 101544 - DNA, 22 bp, Artificial Sequence
  Synthetic oligonucleotide; TTT chr11 5329175 5329196 5329192 5329197 +
ttagtagacacggggtttcacc

SEQ ID NO: 101545 - DNA, 22 bp, Artificial Sequence
  Synthetic oligonucleotide; TTT chr11 5329176 5329197 5329193 5329198 +
tagtagacacggggtttcacca

SEQ ID NO: 101546 - DNA, 22 bp, Artificial Sequence
  Synthetic oligonucleotide; TTT chr11 5329177 5329198 5329194 5329199 +
agtagacacggggtttcaccat

SEQ ID NO: 101547 - DNA, 22 bp, Artificial Sequence
  Synthetic oligonucleotide; TTA chr11 5329178 5329199 5329195 5329200 +
gtagacacggggtttcaccata

SEQ ID NO: 101548 - DNA, 22 bp, Artificial Sequence
  Synthetic oligonucleotide; TTT chr11 5329193 5329214 5329210 5329215 +
caccatattggccaggatggtc

SEQ ID NO: 101549 - DNA, 22 bp, Artificial Sequence
  Synthetic oligonucleotide; TTC chr11 5329194 5329215 5329211 5329216 +
accatattggccaggatggtct

SEQ ID NO: 101550 - DNA, 22 bp, Artificial Sequence
  Synthetic oligonucleotide; TTG chr11 5329203 5329224 5329220 5329225 +
gccaggatggtctcgatctctt

SEQ ID NO: 101551 - DNA, 22 bp, Artificial Sequence
  Synthetic oligonucleotide; CTC chr11 5329217 5329238 5329234 5329239 +
gatctcttgacctcgtgatcca

SEQ ID NO: 101552 - DNA, 22 bp, Artificial Sequence
  Synthetic oligonucleotide; CTC chr11 5329223 5329244 5329240 5329245 +
ttgacctcgtgatccaccctcc

SEQ ID NO: 101553 - DNA, 22 bp, Artificial Sequence
  Synthetic oligonucleotide; CTT chr11 5329225 5329246 5329242 5329247 +
gacctcgtgatccaccctcctt

SEQ ID NO: 101554 - DNA, 22 bp, Artificial Sequence
  Synthetic oligonucleotide; TTG chr11 5329226 5329247 5329243 5329248 +
acctcgtgatccaccctccttg

SEQ ID NO: 101555 - DNA, 22 bp, Artificial Sequence
  Synthetic oligonucleotide; CTC chr11 5329231 5329252 5329248 5329253 +
gtgatccaccctccttggcctc

SEQ ID NO: 101556 - DNA, 22 bp, Artificial Sequence
  Synthetic oligonucleotide; CTC chr11 5329244 5329265 5329261 5329266 +
cttggcctcccaaagtgctggg

SEQ ID NO: 101557 - DNA, 22 bp, Artificial Sequence
  Synthetic oligonucleotide; CTT chr11 5329247 5329268 5329264 5329269 +
ggcctcccaaagtgctgggatt

SEQ ID NO: 101558 - DNA, 22 bp, Artificial Sequence
  Synthetic oligonucleotide; TTG chr11 5329248 5329269 5329265 5329270 +
gcctcccaaagtgctgggattg

SEQ ID NO: 101559 - DNA, 22 bp, Artificial Sequence
  Synthetic oligonucleotide; CTC chr11 5329253 5329274 5329270 5329275 +
ccaaagtgctgggattgcaggt

SEQ ID NO: 101560 - DNA, 22 bp, Artificial Sequence
  Synthetic oligonucleotide; CTG chr11 5329264 5329285 5329281 5329286 +
ggattgcaggtgtgagtcactg

SEQ ID NO: 101561 - DNA, 22 bp, Artificial Sequence
  Synthetic oligonucleotide; TTG chr11 5329270 5329291 5329287 5329292 +
caggtgtgagtcactgcgcccg

SEQ ID NO: 101562 - DNA, 22 bp, Artificial Sequence
  Synthetic oligonucleotide; CTG chr11 5329286 5329307 5329303 5329308 +
cgcccggctgacattcagcttt

SEQ ID NO: 101563 - DNA, 22 bp, Artificial Sequence
  Synthetic oligonucleotide; CTG chr11 5329296 5329317 5329313 5329318 +
acattcagctttttatcttaaa

SEQ ID NO: 101564 - DNA, 22 bp, Artificial Sequence
  Synthetic oligonucleotide; TTC chr11 5329302 5329323 5329319 5329324 +
agctttttatcttaaaattata

SEQ ID NO: 101565 - DNA, 22 bp, Artificial Sequence
  Synthetic oligonucleotide; CTT chr11 5329307 5329328 5329324 5329329 +
tttatcttaaaattatattact

SEQ ID NO: 101566 - DNA, 22 bp, Artificial Sequence
  Synthetic oligonucleotide; TTT chr11 5329308 5329329 5329325 5329330 +
ttatcttaaaattatattactt

SEQ ID NO: 101567 - DNA, 22 bp, Artificial Sequence
  Synthetic oligonucleotide; TTT chr11 5329309 5329330 5329326 5329331 +
tatcttaaaattatattacttg

SEQ ID NO: 101568 - DNA, 22 bp, Artificial Sequence
  Synthetic oligonucleotide; TTT chr11 5329310 5329331 5329327 5329332 +
atcttaaaattatattacttgt

SEQ ID NO: 101569 - DNA, 22 bp, Artificial Sequence
  Synthetic oligonucleotide; TTA chr11 5329311 5329332 5329328 5329333 +
tcttaaaattatattacttgta

SEQ ID NO: 101570 - DNA, 22 bp, Artificial Sequence
  Synthetic oligonucleotide; CTT chr11 5329315 5329336 5329332 5329337 +
aaaattatattacttgtagctc

SEQ ID NO: 101571 - DNA, 22 bp, Artificial Sequence
  Synthetic oligonucleotide; TTA chr11 5329316 5329337 5329333 5329338 +
aaattatattacttgtagctca

SEQ ID NO: 101572 - DNA, 22 bp, Artificial Sequence
  Synthetic oligonucleotide; TTA chr11 5329322 5329343 5329339 5329344 +
tattacttgtagctcattgccc

SEQ ID NO: 101573 - DNA, 22 bp, Artificial Sequence
  Synthetic oligonucleotide; TTA chr11 5329327 5329348 5329344 5329349 +
cttgtagctcattgcccttttt

SEQ ID NO: 101574 - DNA, 22 bp, Artificial Sequence
  Synthetic oligonucleotide; CTT chr11 5329330 5329351 5329347 5329352 +
gtagctcattgccctttttttt

SEQ ID NO: 101575 - DNA, 22 bp, Artificial Sequence
  Synthetic oligonucleotide; TTG chr11 5329331 5329352 5329348 5329353 +
tagctcattgcccttttttttt

SEQ ID NO: 101576 - DNA, 22 bp, Artificial Sequence
  Synthetic oligonucleotide; CTC chr11 5329337 5329358 5329354 5329359 +
attgcccttttttttttttttt

SEQ ID NO: 101577 - DNA, 22 bp, Artificial Sequence
  Synthetic oligonucleotide; TTG chr11 5329341 5329362 5329358 5329363 +
ccctttttttttttttttgcca

SEQ ID NO: 101578 - DNA, 22 bp, Artificial Sequence
  Synthetic oligonucleotide; CTT chr11 5329346 5329367 5329363 5329368 +
tttttttttttttgccagatac

SEQ ID NO: 101579 - DNA, 22 bp, Artificial Sequence
  Synthetic oligonucleotide; TTT chr11 5329347 5329368 5329364 5329369 +
ttttttttttttgccagataca

SEQ ID NO: 101580 - DNA, 22 bp, Artificial Sequence
  Synthetic oligonucleotide; TTT chr11 5329348 5329369 5329365 5329370 +
tttttttttttgccagatacac

SEQ ID NO: 101581 - DNA, 22 bp, Artificial Sequence
  Synthetic oligonucleotide; TTT chr11 5329349 5329370 5329366 5329371 +
ttttttttttgccagatacaca

SEQ ID NO: 101582 - DNA, 22 bp, Artificial Sequence
  Synthetic oligonucleotide; TTT chr11 5329350 5329371 5329367 5329372 +
tttttttttgccagatacacaa

SEQ ID NO: 101583 - DNA, 22 bp, Artificial Sequence
  Synthetic oligonucleotide; TTT chr11 5329351 5329372 5329368 5329373 +
ttttttttgccagatacacaat

SEQ ID NO: 101584 - DNA, 22 bp, Artificial Sequence
  Synthetic oligonucleotide; TTT chr11 5329352 5329373 5329369 5329374 +
tttttttgccagatacacaatg

SEQ ID NO: 101585 - DNA, 22 bp, Artificial Sequence
  Synthetic oligonucleotide; TTT chr11 5329353 5329374 5329370 5329375 +
ttttttgccagatacacaatga

SEQ ID NO: 101586 - DNA, 22 bp, Artificial Sequence
  Synthetic oligonucleotide; TTT chr11 5329354 5329375 5329371 5329376 +
tttttgccagatacacaatgag

SEQ ID NO: 101587 - DNA, 22 bp, Artificial Sequence
  Synthetic oligonucleotide; TTT chr11 5329355 5329376 5329372 5329377 +
ttttgccagatacacaatgagg

SEQ ID NO: 101588 - DNA, 22 bp, Artificial Sequence
  Synthetic oligonucleotide; TTT chr11 5329356 5329377 5329373 5329378 +
tttgccagatacacaatgagga

SEQ ID NO: 101589 - DNA, 22 bp, Artificial Sequence
  Synthetic oligonucleotide; TTT chr11 5329357 5329378 5329374 5329379 +
ttgccagatacacaatgaggag

SEQ ID NO: 101590 - DNA, 22 bp, Artificial Sequence
  Synthetic oligonucleotide; TTT chr11 5329358 5329379 5329375 5329380 +
tgccagatacacaatgaggagc

SEQ ID NO: 101591 - DNA, 22 bp, Artificial Sequence
  Synthetic oligonucleotide; TTT chr11 5329359 5329380 5329376 5329381 +
gccagatacacaatgaggagca

SEQ ID NO: 101592 - DNA, 22 bp, Artificial Sequence
  Synthetic oligonucleotide; TTG chr11 5329360 5329381 5329377 5329382 +
ccagatacacaatgaggagcat

SEQ ID NO: 101593 - DNA, 22 bp, Artificial Sequence
  Synthetic oligonucleotide; CTT chr11 5329388 5329409 5329405 5329410 +
tattcacagaatgtaaatagtg

SEQ ID NO: 101594 - DNA, 22 bp, Artificial Sequence
  Synthetic oligonucleotide; TTT chr11 5329389 5329410 5329406 5329411 +
attcacagaatgtaaatagtgt

SEQ ID NO: 101595 - DNA, 22 bp, Artificial Sequence
  Synthetic oligonucleotide; TTA chr11 5329390 5329411 5329407 5329412 +
ttcacagaatgtaaatagtgtg

SEQ ID NO: 101596 - DNA, 22 bp, Artificial Sequence
  Synthetic oligonucleotide; TTC chr11 5329393 5329414 5329410 5329415 +
acagaatgtaaatagtgtgtaa

SEQ ID NO: 101597 - DNA, 22 bp, Artificial Sequence
  Synthetic oligonucleotide; TTA chr11 5329432 5329453 5329449 5329454 +
ccacaaattttcatagcactat

SEQ ID NO: 101598 - DNA, 22 bp, Artificial Sequence
  Synthetic oligonucleotide; TTT chr11 5329442 5329463 5329459 5329464 +
tcatagcactatcattactgca

SEQ ID NO: 101599 - DNA, 22 bp, Artificial Sequence
  Synthetic oligonucleotide; TTT chr11 5329443 5329464 5329460 5329465 +
catagcactatcattactgcat

SEQ ID NO: 101600 - DNA, 22 bp, Artificial Sequence
  Synthetic oligonucleotide; TTC chr11 5329444 5329465 5329461 5329466 +
atagcactatcattactgcata

SEQ ID NO: 101601 - DNA, 22 bp, Artificial Sequence
  Synthetic oligonucleotide; CTA chr11 5329453 5329474 5329470 5329475 +
tcattactgcatagatggtagc

SEQ ID NO: 101602 - DNA, 22 bp, Artificial Sequence
  Synthetic oligonucleotide; TTA chr11 5329459 5329480 5329476 5329481 +
ctgcatagatggtagcatgcta

SEQ ID NO: 101603 - DNA, 22 bp, Artificial Sequence
  Synthetic oligonucleotide; CTG chr11 5329462 5329483 5329479 5329484 +
catagatggtagcatgctaaag

SEQ ID NO: 101604 - DNA, 22 bp, Artificial Sequence
  Synthetic oligonucleotide; CTA chr11 5329481 5329502 5329498 5329503 +
aagggagcccacagaaagcatc

SEQ ID NO: 101605 - DNA, 22 bp, Artificial Sequence
  Synthetic oligonucleotide; CTT chr11 5329505 5329526 5329522 5329527 +
tggggcaggggaaaatttctca

SEQ ID NO: 101606 - DNA, 22 bp, Artificial Sequence
  Synthetic oligonucleotide; TTT chr11 5329506 5329527 5329523 5329528 +
ggggcaggggaaaatttctcaa

SEQ ID NO: 101607 - DNA, 22 bp, Artificial Sequence
  Synthetic oligonucleotide; TTG chr11 5329507 5329528 5329524 5329529 +
gggcaggggaaaatttctcaaa

SEQ ID NO: 101608 - DNA, 22 bp, Artificial Sequence
  Synthetic oligonucleotide; TTT chr11 5329523 5329544 5329540 5329545 +
ctcaaaagaaatattatttaag

SEQ ID NO: 101609 - DNA, 22 bp, Artificial Sequence
  Synthetic oligonucleotide; TTC chr11 5329524 5329545 5329541 5329546 +
tcaaaagaaatattatttaagc

SEQ ID NO: 101610 - DNA, 22 bp, Artificial Sequence
  Synthetic oligonucleotide; CTC chr11 5329526 5329547 5329543 5329548 +
aaaagaaatattatttaagcta

SEQ ID NO: 101611 - DNA, 22 bp, Artificial Sequence
  Synthetic oligonucleotide; TTA chr11 5329539 5329560 5329556 5329561 +
tttaagctaataattgaaaaac

SEQ ID NO: 101612 - DNA, 22 bp, Artificial Sequence
  Synthetic oligonucleotide; TTT chr11 5329542 5329563 5329559 5329564 +
aagctaataattgaaaaacaag

SEQ ID NO: 101613 - DNA, 22 bp, Artificial Sequence
  Synthetic oligonucleotide; TTA chr11 5329543 5329564 5329560 5329565 +
agctaataattgaaaaacaagg

SEQ ID NO: 101614 - DNA, 22 bp, Artificial Sequence
  Synthetic oligonucleotide; CTA chr11 5329548 5329569 5329565 5329570 +
ataattgaaaaacaaggaaggt

SEQ ID NO: 101615 - DNA, 22 bp, Artificial Sequence
  Synthetic oligonucleotide; TTG chr11 5329555 5329576 5329572 5329577 +
aaaaacaaggaaggtaacaaat

SEQ ID NO: 101616 - DNA, 22 bp, Artificial Sequence
  Synthetic oligonucleotide; TTT chr11 5329586 5329607 5329603 5329608 +
gtataagtggggtacagtttat

SEQ ID NO: 101617 - DNA, 22 bp, Artificial Sequence
  Synthetic oligonucleotide; TTG chr11 5329587 5329608 5329604 5329609 +
tataagtggggtacagtttata

SEQ ID NO: 101618 - DNA, 22 bp, Artificial Sequence
  Synthetic oligonucleotide; TTT chr11 5329606 5329627 5329623 5329628 +
ataaaggaagaaaaaatacaca

SEQ ID NO: 101619 - DNA, 22 bp, Artificial Sequence
  Synthetic oligonucleotide; TTA chr11 5329607 5329628 5329624 5329629 +
taaaggaagaaaaaatacacag

SEQ ID NO: 101620 - DNA, 22 bp, Artificial Sequence
  Synthetic oligonucleotide; CTA chr11 5329633 5329654 5329650 5329655 +
tggggaaagagaaaatatgaca

SEQ ID NO: 101621 - DNA, 22 bp, Artificial Sequence
  Synthetic oligonucleotide; CTC chr11 5329660 5329681 5329677 5329682 +
aaatcaagagaattctagcaga

SEQ ID NO: 101622 - DNA, 22 bp, Artificial Sequence
  Synthetic oligonucleotide; TTC chr11 5329675 5329696 5329692 5329697 +
tagcagagccagaataacaaaa

SEQ ID NO: 101623 - DNA, 22 bp, Artificial Sequence
  Synthetic oligonucleotide; CTA chr11 5329677 5329698 5329694 5329699 +
gcagagccagaataacaaaaca

SEQ ID NO: 101624 - DNA, 22 bp, Artificial Sequence
  Synthetic oligonucleotide; TTG chr11 5329712 5329733 5329729 5329734 +
aacacaaagagaatctgtggta

SEQ ID NO: 101625 - DNA, 22 bp, Artificial Sequence
  Synthetic oligonucleotide; CTG chr11 5329729 5329750 5329746 5329751 +
tggtagcctgttggtttttgtt

SEQ ID NO: 101626 - DNA, 22 bp, Artificial Sequence
  Synthetic oligonucleotide; CTG chr11 5329739 5329760 5329756 5329761 +
ttggtttttgttaatccaaaat

SEQ ID NO: 101627 - DNA, 22 bp, Artificial Sequence
  Synthetic oligonucleotide; TTG chr11 5329742 5329763 5329759 5329764 +
gtttttgttaatccaaaataat

SEQ ID NO: 101628 - DNA, 22 bp, Artificial Sequence
  Synthetic oligonucleotide; TTT chr11 5329746 5329767 5329763 5329768 +
ttgttaatccaaaataatgtat

SEQ ID NO: 101629 - DNA, 22 bp, Artificial Sequence
  Synthetic oligonucleotide; TTT chr11 5329747 5329768 5329764 5329769 +
tgttaatccaaaataatgtatt

SEQ ID NO: 101630 - DNA, 22 bp, Artificial Sequence
  Synthetic oligonucleotide; TTT chr11 5329748 5329769 5329765 5329770 +
gttaatccaaaataatgtattt

SEQ ID NO: 101631 - DNA, 22 bp, Artificial Sequence
  Synthetic oligonucleotide; TTG chr11 5329749 5329770 5329766 5329771 +
ttaatccaaaataatgtatttt

SEQ ID NO: 101632 - DNA, 22 bp, Artificial Sequence
  Synthetic oligonucleotide; TTA chr11 5329752 5329773 5329769 5329774 +
atccaaaataatgtatttttat

SEQ ID NO: 101633 - DNA, 22 bp, Artificial Sequence
  Synthetic oligonucleotide; TTT chr11 5329770 5329791 5329787 5329792 +
ttattattattattattatact

SEQ ID NO: 101634 - DNA, 22 bp, Artificial Sequence
  Synthetic oligonucleotide; TTT chr11 5329771 5329792 5329788 5329793 +
tattattattattattatactt

SEQ ID NO: 101635 - DNA, 22 bp, Artificial Sequence
  Synthetic oligonucleotide; TTT chr11 5329772 5329793 5329789 5329794 +
attattattattattatacttt

SEQ ID NO: 101636 - DNA, 22 bp, Artificial Sequence
  Synthetic oligonucleotide; TTA chr11 5329773 5329794 5329790 5329795 +
ttattattattattatacttta

SEQ ID NO: 101637 - DNA, 22 bp, Artificial Sequence
  Synthetic oligonucleotide; TTA chr11 5329776 5329797 5329793 5329798 +
ttattattattatactttaagt

SEQ ID NO: 101638 - DNA, 22 bp, Artificial Sequence
  Synthetic oligonucleotide; TTA chr11 5329779 5329800 5329796 5329801 +
ttattattatactttaagtttt

SEQ ID NO: 101639 - DNA, 22 bp, Artificial Sequence
  Synthetic oligonucleotide; TTA chr11 5329782 5329803 5329799 5329804 +
ttattatactttaagttttagg

SEQ ID NO: 101640 - DNA, 22 bp, Artificial Sequence
  Synthetic oligonucleotide; TTA chr11 5329785 5329806 5329802 5329807 +
ttatactttaagttttagggta

SEQ ID NO: 101641 - DNA, 22 bp, Artificial Sequence
  Synthetic oligonucleotide; TTA chr11 5329788 5329809 5329805 5329810 +
tactttaagttttagggtacat

SEQ ID NO: 101642 - DNA, 22 bp, Artificial Sequence
  Synthetic oligonucleotide; CTT chr11 5329793 5329814 5329810 5329815 +
taagttttagggtacatgtgca

SEQ ID NO: 101643 - DNA, 22 bp, Artificial Sequence
  Synthetic oligonucleotide; TTT chr11 5329794 5329815 5329811 5329816 +
aagttttagggtacatgtgcac

SEQ ID NO: 101644 - DNA, 22 bp, Artificial Sequence
  Synthetic oligonucleotide; TTA chr11 5329795 5329816 5329812 5329817 +
agttttagggtacatgtgcaca

SEQ ID NO: 101645 - DNA, 22 bp, Artificial Sequence
  Synthetic oligonucleotide; TTT chr11 5329800 5329821 5329817 5329822 +
tagggtacatgtgcacaatgtg

SEQ ID NO: 101646 - DNA, 22 bp, Artificial Sequence
  Synthetic oligonucleotide; TTT chr11 5329801 5329822 5329818 5329823 +
agggtacatgtgcacaatgtgc

SEQ ID NO: 101647 - DNA, 22 bp, Artificial Sequence
  Synthetic oligonucleotide; TTA chr11 5329802 5329823 5329819 5329824 +
gggtacatgtgcacaatgtgca

SEQ ID NO: 101648 - DNA, 22 bp, Artificial Sequence
  Synthetic oligonucleotide; TTT chr11 5329829 5329850 5329846 5329851 +
gttacatatgtatacatgtgcc

SEQ ID NO: 101649 - DNA, 22 bp, Artificial Sequence
  Synthetic oligonucleotide; TTG chr11 5329830 5329851 5329847 5329852 +
ttacatatgtatacatgtgcca

SEQ ID NO: 101650 - DNA, 22 bp, Artificial Sequence
  Synthetic oligonucleotide; TTA chr11 5329833 5329854 5329850 5329855 +
catatgtatacatgtgccatgt

SEQ ID NO: 101651 - DNA, 22 bp, Artificial Sequence
  Synthetic oligonucleotide; TTG chr11 5329857 5329878 5329874 5329879 +
gtgtgctgcacccattaacttg

SEQ ID NO: 101652 - DNA, 22 bp, Artificial Sequence
  Synthetic oligonucleotide; CTG chr11 5329865 5329886 5329882 5329887 +
cacccattaacttgtcacttag

SEQ ID NO: 101653 - DNA, 22 bp, Artificial Sequence
  Synthetic oligonucleotide; TTA chr11 5329874 5329895 5329891 5329896 +
acttgtcacttagcattaggta

SEQ ID NO: 101654 - DNA, 22 bp, Artificial Sequence
  Synthetic oligonucleotide; CTT chr11 5329878 5329899 5329895 5329900 +
gtcacttagcattaggtatatc

SEQ ID NO: 101655 - DNA, 22 bp, Artificial Sequence
  Synthetic oligonucleotide; TTG chr11 5329879 5329900 5329896 5329901 +
tcacttagcattaggtatatct

SEQ ID NO: 101656 - DNA, 22 bp, Artificial Sequence
  Synthetic oligonucleotide; CTT chr11 5329885 5329906 5329902 5329907 +
agcattaggtatatctcctaat

SEQ ID NO: 101657 - DNA, 22 bp, Artificial Sequence
  Synthetic oligonucleotide; TTA chr11 5329886 5329907 5329903 5329908 +
gcattaggtatatctcctaatg

SEQ ID NO: 101658 - DNA, 22 bp, Artificial Sequence
  Synthetic oligonucleotide; TTA chr11 5329892 5329913 5329909 5329914 +
ggtatatctcctaatgctctct

SEQ ID NO: 101659 - DNA, 22 bp, Artificial Sequence
  Synthetic oligonucleotide; CTC chr11 5329902 5329923 5329919 5329924 +
ctaatgctctctctcccccttc

SEQ ID NO: 101660 - DNA, 22 bp, Artificial Sequence
  Synthetic oligonucleotide; CTA chr11 5329905 5329926 5329922 5329927 +
atgctctctctcccccttcccc

SEQ ID NO: 101661 - DNA, 22 bp, Artificial Sequence
  Synthetic oligonucleotide; CTC chr11 5329911 5329932 5329928 5329933 +
tctctcccccttccccccacct

SEQ ID NO: 101662 - DNA, 22 bp, Artificial Sequence
  Synthetic oligonucleotide; CTC chr11 5329913 5329934 5329930 5329935 +
tctcccccttccccccacctca

SEQ ID NO: 101663 - DNA, 22 bp, Artificial Sequence
  Synthetic oligonucleotide; CTC chr11 5329915 5329936 5329932 5329937 +
tcccccttccccccacctcaca

SEQ ID NO: 101664 - DNA, 22 bp, Artificial Sequence
  Synthetic oligonucleotide; CTC chr11 5329917 5329938 5329934 5329939 +
ccccttccccccacctcacaac

SEQ ID NO: 101665 - DNA, 22 bp, Artificial Sequence
  Synthetic oligonucleotide; CTT chr11 5329923 5329944 5329940 5329945 +
ccccccacctcacaacagtccc

SEQ ID NO: 101666 - DNA, 22 bp, Artificial Sequence
  Synthetic oligonucleotide; TTC chr11 5329924 5329945 5329941 5329946 +
cccccacctcacaacagtcccc

SEQ ID NO: 101667 - DNA, 22 bp, Artificial Sequence
  Synthetic oligonucleotide; CTC chr11 5329934 5329955 5329951 5329956 +
acaacagtccccggagtgtgtt

SEQ ID NO: 101668 - DNA, 22 bp, Artificial Sequence
  Synthetic oligonucleotide; TTG chr11 5329957 5329978 5329974 5329979 +
ttccccttcctgtgtccatgtg

SEQ ID NO: 101669 - DNA, 22 bp, Artificial Sequence
  Synthetic oligonucleotide; TTC chr11 5329960 5329981 5329977 5329982 +
cccttcctgtgtccatgtgttc

SEQ ID NO: 101670 - DNA, 22 bp, Artificial Sequence
  Synthetic oligonucleotide; CTT chr11 5329965 5329986 5329982 5329987 +
cctgtgtccatgtgttctcatt

SEQ ID NO: 101671 - DNA, 22 bp, Artificial Sequence
  Synthetic oligonucleotide; TTC chr11 5329966 5329987 5329983 5329988 +
ctgtgtccatgtgttctcattg

SEQ ID NO: 101672 - DNA, 22 bp, Artificial Sequence
  Synthetic oligonucleotide; CTG chr11 5329969 5329990 5329986 5329991 +
tgtccatgtgttctcattgttc

SEQ ID NO: 101673 - DNA, 22 bp, Artificial Sequence
  Synthetic oligonucleotide; TTC chr11 5329982 5330003 5329999 5330004 +
tcattgttcaattcccacctat

SEQ ID NO: 101674 - DNA, 22 bp, Artificial Sequence
  Synthetic oligonucleotide; CTC chr11 5329984 5330005 5330001 5330006 +
attgttcaattcccacctatga

SEQ ID NO: 101675 - DNA, 22 bp, Artificial Sequence
  Synthetic oligonucleotide; TTG chr11 5329988 5330009 5330005 5330010 +
ttcaattcccacctatgagtga

SEQ ID NO: 101676 - DNA, 22 bp, Artificial Sequence
  Synthetic oligonucleotide; TTC chr11 5329991 5330012 5330008 5330013 +
aattcccacctatgagtgagaa

SEQ ID NO: 101677 - DNA, 22 bp, Artificial Sequence
  Synthetic oligonucleotide; TTC chr11 5329996 5330017 5330013 5330018 +
ccacctatgagtgagaacatgc

SEQ ID NO: 101678 - DNA, 22 bp, Artificial Sequence
  Synthetic oligonucleotide; CTA chr11 5330003 5330024 5330020 5330025 +
tgagtgagaacatgcagtgctt

SEQ ID NO: 101679 - DNA, 22 bp, Artificial Sequence
  Synthetic oligonucleotide; CTT chr11 5330025 5330046 5330042 5330047 +
ggttttttgtccttgcgatagt

SEQ ID NO: 101680 - DNA, 22 bp, Artificial Sequence
  Synthetic oligonucleotide; TTG chr11 5330026 5330047 5330043 5330048 +
gttttttgtccttgcgatagtt

SEQ ID NO: 101681 - DNA, 22 bp, Artificial Sequence
  Synthetic oligonucleotide; TTT chr11 5330030 5330051 5330047 5330052 +
tttgtccttgcgatagtttgct

SEQ ID NO: 101682 - DNA, 22 bp, Artificial Sequence
  Synthetic oligonucleotide; TTT chr11 5330031 5330052 5330048 5330053 +
ttgtccttgcgatagtttgctg

SEQ ID NO: 101683 - DNA, 22 bp, Artificial Sequence
  Synthetic oligonucleotide; TTT chr11 5330032 5330053 5330049 5330054 +
tgtccttgcgatagtttgctga

SEQ ID NO: 101684 - DNA, 22 bp, Artificial Sequence
  Synthetic oligonucleotide; TTT chr11 5330033 5330054 5330050 5330055 +
gtccttgcgatagtttgctgag

SEQ ID NO: 101685 - DNA, 22 bp, Artificial Sequence
  Synthetic oligonucleotide; TTG chr11 5330034 5330055 5330051 5330056 +
tccttgcgatagtttgctgaga

SEQ ID NO: 101686 - DNA, 22 bp, Artificial Sequence
  Synthetic oligonucleotide; CTT chr11 5330039 5330060 5330056 5330061 +
gcgatagtttgctgagaatgat

SEQ ID NO: 101687 - DNA, 22 bp, Artificial Sequence
  Synthetic oligonucleotide; TTG chr11 5330040 5330061 5330057 5330062 +
cgatagtttgctgagaatgatg

SEQ ID NO: 101688 - DNA, 22 bp, Artificial Sequence
  Synthetic oligonucleotide; TTT chr11 5330049 5330070 5330066 5330071 +
gctgagaatgatggtttccagt

SEQ ID NO: 101689 - DNA, 22 bp, Artificial Sequence
  Synthetic oligonucleotide; TTG chr11 5330050 5330071 5330067 5330072 +
ctgagaatgatggtttccagtt

SEQ ID NO: 101690 - DNA, 22 bp, Artificial Sequence
  Synthetic oligonucleotide; CTG chr11 5330053 5330074 5330070 5330075 +
agaatgatggtttccagtttca

SEQ ID NO: 101691 - DNA, 22 bp, Artificial Sequence
  Synthetic oligonucleotide; TTT chr11 5330066 5330087 5330083 5330088 +
ccagtttcatccatgtccctac

SEQ ID NO: 101692 - DNA, 22 bp, Artificial Sequence
  Synthetic oligonucleotide; TTC chr11 5330067 5330088 5330084 5330089 +
cagtttcatccatgtccctaca

SEQ ID NO: 101693 - DNA, 22 bp, Artificial Sequence
  Synthetic oligonucleotide; TTT chr11 5330073 5330094 5330090 5330095 +
catccatgtccctacaaatgac

SEQ ID NO: 101694 - DNA, 22 bp, Artificial Sequence
  Synthetic oligonucleotide; TTC chr11 5330074 5330095 5330091 5330096 +
atccatgtccctacaaatgaca

SEQ ID NO: 101695 - DNA, 22 bp, Artificial Sequence
  Synthetic oligonucleotide; CTA chr11 5330087 5330108 5330104 5330109 +
caaatgacatgaactcttcatt

SEQ ID NO: 101696 - DNA, 22 bp, Artificial Sequence
  Synthetic oligonucleotide; CTC chr11 5330103 5330124 5330120 5330125 +
ttcattttttatggctgcatag

SEQ ID NO: 101697 - DNA, 22 bp, Artificial Sequence
  Synthetic oligonucleotide; CTT chr11 5330105 5330126 5330122 5330127 +
cattttttatggctgcatagta

SEQ ID NO: 101698 - DNA, 22 bp, Artificial Sequence
  Synthetic oligonucleotide; TTC chr11 5330106 5330127 5330123 5330128 +
attttttatggctgcatagtat

SEQ ID NO: 101699 - DNA, 22 bp, Artificial Sequence
  Synthetic oligonucleotide; TTT chr11 5330110 5330131 5330127 5330132 +
tttatggctgcatagtattcca

SEQ ID NO: 101700 - DNA, 22 bp, Artificial Sequence
  Synthetic oligonucleotide; TTT chr11 5330111 5330132 5330128 5330133 +
ttatggctgcatagtattccat

SEQ ID NO: 101701 - DNA, 22 bp, Artificial Sequence
  Synthetic oligonucleotide; TTT chr11 5330112 5330133 5330129 5330134 +
tatggctgcatagtattccatg

SEQ ID NO: 101702 - DNA, 22 bp, Artificial Sequence
  Synthetic oligonucleotide; TTT chr11 5330113 5330134 5330130 5330135 +
atggctgcatagtattccatgg

SEQ ID NO: 101703 - DNA, 22 bp, Artificial Sequence
  Synthetic oligonucleotide; TTA chr11 5330114 5330135 5330131 5330136 +
tggctgcatagtattccatggt

SEQ ID NO: 101704 - DNA, 22 bp, Artificial Sequence
  Synthetic oligonucleotide; CTG chr11 5330120 5330141 5330137 5330142 +
catagtattccatggtgtatat

SEQ ID NO: 101705 - DNA, 22 bp, Artificial Sequence
  Synthetic oligonucleotide; TTC chr11 5330130 5330151 5330147 5330152 +
catggtgtatatgtgccacatt

SEQ ID NO: 101706 - DNA, 22 bp, Artificial Sequence
  Synthetic oligonucleotide; TTT chr11 5330153 5330174 5330170 5330175 +
tcttaattcagtctatcattgt

SEQ ID NO: 101707 - DNA, 22 bp, Artificial Sequence
  Synthetic oligonucleotide; TTT chr11 5330154 5330175 5330171 5330176 +
cttaattcagtctatcattgtt

SEQ ID NO: 101708 - DNA, 22 bp, Artificial Sequence
  Synthetic oligonucleotide; TTC chr11 5330155 5330176 5330172 5330177 +
ttaattcagtctatcattgttg

SEQ ID NO: 101709 - DNA, 22 bp, Artificial Sequence
  Synthetic oligonucleotide; CTT chr11 5330157 5330178 5330174 5330179 +
aattcagtctatcattgttgga

SEQ ID NO: 101710 - DNA, 22 bp, Artificial Sequence
  Synthetic oligonucleotide; TTA chr11 5330158 5330179 5330175 5330180 +
attcagtctatcattgttggac

SEQ ID NO: 101711 - DNA, 22 bp, Artificial Sequence
  Synthetic oligonucleotide; TTC chr11 5330162 5330183 5330179 5330184 +
agtctatcattgttggacattt

SEQ ID NO: 101712 - DNA, 22 bp, Artificial Sequence
  Synthetic oligonucleotide; CTA chr11 5330168 5330189 5330185 5330190 +
tcattgttggacatttgggttg

SEQ ID NO: 101713 - DNA, 22 bp, Artificial Sequence
  Synthetic oligonucleotide; TTG chr11 5330174 5330195 5330191 5330196 +
ttggacatttgggttggttcca

SEQ ID NO: 101714 - DNA, 22 bp, Artificial Sequence
  Synthetic oligonucleotide; TTG chr11 5330177 5330198 5330194 5330199 +
gacatttgggttggttccaagt

SEQ ID NO: 101715 - DNA, 22 bp, Artificial Sequence
  Synthetic oligonucleotide; TTT chr11 5330184 5330205 5330201 5330206 +
gggttggttccaagtctttgct

SEQ ID NO: 101716 - DNA, 22 bp, Artificial Sequence
  Synthetic oligonucleotide; TTG chr11 5330185 5330206 5330202 5330207 +
ggttggttccaagtctttgcta

SEQ ID NO: 101717 - DNA, 22 bp, Artificial Sequence
  Synthetic oligonucleotide; TTG chr11 5330190 5330211 5330207 5330212 +
gttccaagtctttgctattgtg

SEQ ID NO: 101718 - DNA, 22 bp, Artificial Sequence
  Synthetic oligonucleotide; TTC chr11 5330194 5330215 5330211 5330216 +
caagtctttgctattgtgaata

SEQ ID NO: 101719 - DNA, 22 bp, Artificial Sequence
  Synthetic oligonucleotide; CTT chr11 5330202 5330223 5330219 5330224 +
tgctattgtgaatagtgccaca

SEQ ID NO: 101720 - DNA, 22 bp, Artificial Sequence
  Synthetic oligonucleotide; TTT chr11 5330203 5330224 5330220 5330225 +
gctattgtgaatagtgccacag

SEQ ID NO: 101721 - DNA, 22 bp, Artificial Sequence
  Synthetic oligonucleotide; TTG chr11 5330204 5330225 5330221 5330226 +
ctattgtgaatagtgccacagt

SEQ ID NO: 101722 - DNA, 22 bp, Artificial Sequence
  Synthetic oligonucleotide; CTA chr11 5330207 5330228 5330224 5330229 +
ttgtgaatagtgccacagtaaa

SEQ ID NO: 101723 - DNA, 22 bp, Artificial Sequence
  Synthetic oligonucleotide; TTG chr11 5330210 5330231 5330227 5330232 +
tgaatagtgccacagtaaacat

SEQ ID NO: 101724 - DNA, 22 bp, Artificial Sequence
  Synthetic oligonucleotide; CTT chr11 5330249 5330270 5330266 5330271 +
tatagcagcatgatttataatc

SEQ ID NO: 101725 - DNA, 22 bp, Artificial Sequence
  Synthetic oligonucleotide; TTT chr11 5330250 5330271 5330267 5330272 +
atagcagcatgatttataatcc

SEQ ID NO: 101726 - DNA, 22 bp, Artificial Sequence
  Synthetic oligonucleotide; TTA chr11 5330251 5330272 5330268 5330273 +
tagcagcatgatttataatccg

SEQ ID NO: 101727 - DNA, 22 bp, Artificial Sequence
  Synthetic oligonucleotide; TTT chr11 5330265 5330286 5330282 5330287 +
ataatccgttgggtatataccc

SEQ ID NO: 101728 - DNA, 22 bp, Artificial Sequence
  Synthetic oligonucleotide; TTA chr11 5330266 5330287 5330283 5330288 +
taatccgttgggtatataccca

SEQ ID NO: 101729 - DNA, 22 bp, Artificial Sequence
  Synthetic oligonucleotide; TTG chr11 5330276 5330297 5330293 5330298 +
ggtatatacccagtaatgggat

SEQ ID NO: 101730 - DNA, 22 bp, Artificial Sequence
  Synthetic oligonucleotide; CTG chr11 5330303 5330324 5330320 5330325 +
ggtcaaatggtatttctagttc

SEQ ID NO: 101731 - DNA, 22 bp, Artificial Sequence
  Synthetic oligonucleotide; TTT chr11 5330318 5330339 5330335 5330340 +
ctagttctagatccctgaggaa

SEQ ID NO: 101732 - DNA, 22 bp, Artificial Sequence
  Synthetic oligonucleotide; TTC chr11 5330319 5330340 5330336 5330341 +
tagttctagatccctgaggaat

SEQ ID NO: 101733 - DNA, 22 bp, Artificial Sequence
  Synthetic oligonucleotide; CTA chr11 5330321 5330342 5330338 5330343 +
gttctagatccctgaggaatcg

SEQ ID NO: 101734 - DNA, 22 bp, Artificial Sequence
  Synthetic oligonucleotide; TTC chr11 5330325 5330346 5330342 5330347 +
tagatccctgaggaatcgccac

SEQ ID NO: 101735 - DNA, 22 bp, Artificial Sequence
  Synthetic oligonucleotide; CTA chr11 5330327 5330348 5330344 5330349 +
gatccctgaggaatcgccacac

SEQ ID NO: 101736 - DNA, 22 bp, Artificial Sequence
  Synthetic oligonucleotide; CTG chr11 5330335 5330356 5330352 5330357 +
aggaatcgccacactgacttcc

SEQ ID NO: 101737 - DNA, 22 bp, Artificial Sequence
  Synthetic oligonucleotide; CTG chr11 5330351 5330372 5330368 5330373 +
acttccacaatggttgaactag

SEQ ID NO: 101738 - DNA, 22 bp, Artificial Sequence
  Synthetic oligonucleotide; CTT chr11 5330355 5330376 5330372 5330377 +
ccacaatggttgaactagttta

SEQ ID NO: 101739 - DNA, 22 bp, Artificial Sequence
  Synthetic oligonucleotide; TTC chr11 5330356 5330377 5330373 5330378 +
cacaatggttgaactagtttac

SEQ ID NO: 101740 - DNA, 22 bp, Artificial Sequence
  Synthetic oligonucleotide; TTG chr11 5330367 5330388 5330384 5330389 +
aactagtttacagtcccaccaa

SEQ ID NO: 101741 - DNA, 22 bp, Artificial Sequence
  Synthetic oligonucleotide; CTA chr11 5330372 5330393 5330389 5330394 +
gtttacagtcccaccaagagtg

SEQ ID NO: 101742 - DNA, 22 bp, Artificial Sequence
  Synthetic oligonucleotide; TTT chr11 5330376 5330397 5330393 5330398 +
acagtcccaccaagagtgtaaa

SEQ ID NO: 101743 - DNA, 22 bp, Artificial Sequence
  Synthetic oligonucleotide; TTA chr11 5330377 5330398 5330394 5330399 +
cagtcccaccaagagtgtaaaa

SEQ ID NO: 101744 - DNA, 22 bp, Artificial Sequence
  Synthetic oligonucleotide; TTC chr11 5330405 5330426 5330422 5330427 +
ctatttctccacatcctctcca

SEQ ID NO: 101745 - DNA, 22 bp, Artificial Sequence
  Synthetic oligonucleotide; CTA chr11 5330408 5330429 5330425 5330430 +
tttctccacatcctctccagca

SEQ ID NO: 101746 - DNA, 22 bp, Artificial Sequence
  Synthetic oligonucleotide; TTT chr11 5330411 5330432 5330428 5330433 +
ctccacatcctctccagcacct

SEQ ID NO: 101747 - DNA, 22 bp, Artificial Sequence
  Synthetic oligonucleotide; TTC chr11 5330412 5330433 5330429 5330434 +
tccacatcctctccagcacctg

SEQ ID NO: 101748 - DNA, 22 bp, Artificial Sequence
  Synthetic oligonucleotide; CTC chr11 5330414 5330435 5330431 5330436 +
cacatcctctccagcacctgtt

SEQ ID NO: 101749 - DNA, 22 bp, Artificial Sequence
  Synthetic oligonucleotide; CTC chr11 5330423 5330444 5330440 5330445 +
tccagcacctgttgttccctga

SEQ ID NO: 101750 - DNA, 22 bp, Artificial Sequence
  Synthetic oligonucleotide; CTC chr11 5330425 5330446 5330442 5330447 +
cagcacctgttgttccctgact

SEQ ID NO: 101751 - DNA, 22 bp, Artificial Sequence
  Synthetic oligonucleotide; CTG chr11 5330434 5330455 5330451 5330456 +
ttgttccctgactttttaatga

SEQ ID NO: 101752 - DNA, 22 bp, Artificial Sequence
  Synthetic oligonucleotide; TTG chr11 5330437 5330458 5330454 5330459 +
ttccctgactttttaatgattg

SEQ ID NO: 101753 - DNA, 22 bp, Artificial Sequence
  Synthetic oligonucleotide; TTC chr11 5330440 5330461 5330457 5330462 +
cctgactttttaatgattgcca

SEQ ID NO: 101754 - DNA, 22 bp, Artificial Sequence
  Synthetic oligonucleotide; CTG chr11 5330444 5330465 5330461 5330466 +
actttttaatgattgccattct

SEQ ID NO: 101755 - DNA, 22 bp, Artificial Sequence
  Synthetic oligonucleotide; CTT chr11 5330448 5330469 5330465 5330470 +
tttaatgattgccattctaact

SEQ ID NO: 101756 - DNA, 22 bp, Artificial Sequence
  Synthetic oligonucleotide; TTT chr11 5330449 5330470 5330466 5330471 +
ttaatgattgccattctaactg

SEQ ID NO: 101757 - DNA, 22 bp, Artificial Sequence
  Synthetic oligonucleotide; TTT chr11 5330450 5330471 5330467 5330472 +
taatgattgccattctaactgg

SEQ ID NO: 101758 - DNA, 22 bp, Artificial Sequence
  Synthetic oligonucleotide; TTT chr11 5330451 5330472 5330468 5330473 +
aatgattgccattctaactggt

SEQ ID NO: 101759 - DNA, 22 bp, Artificial Sequence
  Synthetic oligonucleotide; TTA chr11 5330452 5330473 5330469 5330474 +
atgattgccattctaactggtg

SEQ ID NO: 101760 - DNA, 22 bp, Artificial Sequence
  Synthetic oligonucleotide; TTG chr11 5330459 5330480 5330476 5330481 +
ccattctaactggtgtgagatg

SEQ ID NO: 101761 - DNA, 22 bp, Artificial Sequence
  Synthetic oligonucleotide; TTC chr11 5330465 5330486 5330482 5330487 +
taactggtgtgagatggtatct

SEQ ID NO: 101762 - DNA, 22 bp, Artificial Sequence
  Synthetic oligonucleotide; CTA chr11 5330467 5330488 5330484 5330489 +
actggtgtgagatggtatctct

SEQ ID NO: 101763 - DNA, 22 bp, Artificial Sequence
  Synthetic oligonucleotide; CTG chr11 5330471 5330492 5330488 5330493 +
gtgtgagatggtatctctttgt

SEQ ID NO: 101764 - DNA, 22 bp, Artificial Sequence
  Synthetic oligonucleotide; CTC chr11 5330488 5330509 5330505 5330510 +
tttgtggttttgatttgcattg

SEQ ID NO: 101765 - DNA, 22 bp, Artificial Sequence
  Synthetic oligonucleotide; CTT chr11 5330490 5330511 5330507 5330512 +
tgtggttttgatttgcattgtg

SEQ ID NO: 101766 - DNA, 22 bp, Artificial Sequence
  Synthetic oligonucleotide; TTT chr11 5330491 5330512 5330508 5330513 +
gtggttttgatttgcattgtga

SEQ ID NO: 101767 - DNA, 22 bp, Artificial Sequence
  Synthetic oligonucleotide; TTG chr11 5330492 5330513 5330509 5330514 +
tggttttgatttgcattgtgac

SEQ ID NO: 101768 - DNA, 22 bp, Artificial Sequence
  Synthetic oligonucleotide; TTT chr11 5330498 5330519 5330515 5330520 +
tgatttgcattgtgacgtgtta

SEQ ID NO: 101769 - DNA, 22 bp, Artificial Sequence
  Synthetic oligonucleotide; TTT chr11 5330499 5330520 5330516 5330521 +
gatttgcattgtgacgtgttag

SEQ ID NO: 101770 - DNA, 22 bp, Artificial Sequence
  Synthetic oligonucleotide; TTG chr11 5330500 5330521 5330517 5330522 +
atttgcattgtgacgtgttagt

SEQ ID NO: 101771 - DNA, 22 bp, Artificial Sequence
  Synthetic oligonucleotide; TTT chr11 5330504 5330525 5330521 5330526 +
gcattgtgacgtgttagtttta

SEQ ID NO: 101772 - DNA, 22 bp, Artificial Sequence
  Synthetic oligonucleotide; TTG chr11 5330505 5330526 5330522 5330527 +
cattgtgacgtgttagttttaa

SEQ ID NO: 101773 - DNA, 22 bp, Artificial Sequence
  Synthetic oligonucleotide; TTG chr11 5330510 5330531 5330527 5330532 +
tgacgtgttagttttaaagtat

SEQ ID NO: 101774 - DNA, 22 bp, Artificial Sequence
  Synthetic oligonucleotide; TTA chr11 5330520 5330541 5330537 5330542 +
gttttaaagtatgtgtgaaata

SEQ ID NO: 101775 - DNA, 22 bp, Artificial Sequence
  Synthetic oligonucleotide; TTT chr11 5330524 5330545 5330541 5330546 +
taaagtatgtgtgaaataattt

SEQ ID NO: 101776 - DNA, 22 bp, Artificial Sequence
  Synthetic oligonucleotide; TTT chr11 5330525 5330546 5330542 5330547 +
aaagtatgtgtgaaataatttt

SEQ ID NO: 101777 - DNA, 22 bp, Artificial Sequence
  Synthetic oligonucleotide; TTA chr11 5330526 5330547 5330543 5330548 +
aagtatgtgtgaaataattttt

SEQ ID NO: 101778 - DNA, 22 bp, Artificial Sequence
  Synthetic oligonucleotide; TTT chr11 5330546 5330567 5330563 5330568 +
ttattcttaacatttttttgat

SEQ ID NO: 101779 - DNA, 22 bp, Artificial Sequence
  Synthetic oligonucleotide; TTT chr11 5330547 5330568 5330564 5330569 +
tattcttaacatttttttgatg

SEQ ID NO: 101780 - DNA, 22 bp, Artificial Sequence
  Synthetic oligonucleotide; TTT chr11 5330548 5330569 5330565 5330570 +
attcttaacatttttttgatga

SEQ ID NO: 101781 - DNA, 22 bp, Artificial Sequence
  Synthetic oligonucleotide; TTA chr11 5330549 5330570 5330566 5330571 +
ttcttaacatttttttgatgaa

SEQ ID NO: 101782 - DNA, 22 bp, Artificial Sequence
  Synthetic oligonucleotide; TTC chr11 5330552 5330573 5330569 5330574 +
ttaacatttttttgatgaagca

SEQ ID NO: 101783 - DNA, 22 bp, Artificial Sequence
  Synthetic oligonucleotide; CTT chr11 5330554 5330575 5330571 5330576 +
aacatttttttgatgaagcaca

SEQ ID NO: 101784 - DNA, 22 bp, Artificial Sequence
  Synthetic oligonucleotide; TTA chr11 5330555 5330576 5330572 5330577 +
acatttttttgatgaagcacag

SEQ ID NO: 101785 - DNA, 22 bp, Artificial Sequence
  Synthetic oligonucleotide; TTT chr11 5330561 5330582 5330578 5330583 +
ttttgatgaagcacagtgtctg

SEQ ID NO: 101786 - DNA, 22 bp, Artificial Sequence
  Synthetic oligonucleotide; TTT chr11 5330562 5330583 5330579 5330584 +
tttgatgaagcacagtgtctga

SEQ ID NO: 101787 - DNA, 22 bp, Artificial Sequence
  Synthetic oligonucleotide; TTT chr11 5330563 5330584 5330580 5330585 +
ttgatgaagcacagtgtctgaa

SEQ ID NO: 101788 - DNA, 22 bp, Artificial Sequence
  Synthetic oligonucleotide; TTT chr11 5330564 5330585 5330581 5330586 +
tgatgaagcacagtgtctgaaa

SEQ ID NO: 101789 - DNA, 22 bp, Artificial Sequence
  Synthetic oligonucleotide; TTT chr11 5330565 5330586 5330582 5330587 +
gatgaagcacagtgtctgaaag

SEQ ID NO: 101790 - DNA, 22 bp, Artificial Sequence
  Synthetic oligonucleotide; TTG chr11 5330566 5330587 5330583 5330588 +
atgaagcacagtgtctgaaagg

SEQ ID NO: 101791 - DNA, 22 bp, Artificial Sequence
  Synthetic oligonucleotide; CTG chr11 5330583 5330604 5330600 5330605 +
aaagggtggtagcccaatcaag

SEQ ID NO: 101792 - DNA, 22 bp, Artificial Sequence
  Synthetic oligonucleotide; TTA chr11 5330613 5330634 5330630 5330635 +
aaaaccagaacacagctaatgt

SEQ ID NO: 101793 - DNA, 22 bp, Artificial Sequence
  Synthetic oligonucleotide; CTA chr11 5330631 5330652 5330648 5330653 +
atgtgagaaatacaagtattta

SEQ ID NO: 101794 - DNA, 22 bp, Artificial Sequence
  Synthetic oligonucleotide; TTT chr11 5330652 5330673 5330669 5330674 +
agggccttagtctgctccttgt

SEQ ID NO: 101795 - DNA, 22 bp, Artificial Sequence
  Synthetic oligonucleotide; TTA chr11 5330653 5330674 5330670 5330675 +
gggccttagtctgctccttgtc

SEQ ID NO: 101796 - DNA, 22 bp, Artificial Sequence
  Synthetic oligonucleotide; CTT chr11 5330660 5330681 5330677 5330682 +
agtctgctccttgtctgaggca

SEQ ID NO: 101797 - DNA, 22 bp, Artificial Sequence
  Synthetic oligonucleotide; TTA chr11 5330661 5330682 5330678 5330683 +
gtctgctccttgtctgaggcaa

SEQ ID NO: 101798 - DNA, 22 bp, Artificial Sequence
  Synthetic oligonucleotide; CTG chr11 5330666 5330687 5330683 5330688 +
ctccttgtctgaggcaattccc

SEQ ID NO: 101799 - DNA, 22 bp, Artificial Sequence
  Synthetic oligonucleotide; CTC chr11 5330669 5330690 5330686 5330691 +
cttgtctgaggcaattcccatg

SEQ ID NO: 101800 - DNA, 22 bp, Artificial Sequence
  Synthetic oligonucleotide; CTT chr11 5330672 5330693 5330689 5330694 +
gtctgaggcaattcccatgacc

SEQ ID NO: 101801 - DNA, 22 bp, Artificial Sequence
  Synthetic oligonucleotide; TTG chr11 5330673 5330694 5330690 5330695 +
tctgaggcaattcccatgacct

SEQ ID NO: 101802 - DNA, 22 bp, Artificial Sequence
  Synthetic oligonucleotide; CTG chr11 5330677 5330698 5330694 5330699 +
aggcaattcccatgaccttctt

SEQ ID NO: 101803 - DNA, 22 bp, Artificial Sequence
  Synthetic oligonucleotide; TTC chr11 5330686 5330707 5330703 5330708 +
ccatgaccttcttaaggatcag

SEQ ID NO: 101804 - DNA, 22 bp, Artificial Sequence
  Synthetic oligonucleotide; CTT chr11 5330696 5330717 5330713 5330718 +
cttaaggatcagaatgtaagag

SEQ ID NO: 101805 - DNA, 22 bp, Artificial Sequence
  Synthetic oligonucleotide; TTC chr11 5330697 5330718 5330714 5330719 +
ttaaggatcagaatgtaagaga

SEQ ID NO: 101806 - DNA, 22 bp, Artificial Sequence
  Synthetic oligonucleotide; CTT chr11 5330699 5330720 5330716 5330721 +
aaggatcagaatgtaagagata

SEQ ID NO: 101807 - DNA, 22 bp, Artificial Sequence
  Synthetic oligonucleotide; TTA chr11 5330700 5330721 5330717 5330722 +
aggatcagaatgtaagagataa

SEQ ID NO: 101808 - DNA, 22 bp, Artificial Sequence
  Synthetic oligonucleotide; TTG chr11 5330752 5330773 5330769 5330774 +
atgagaccaggactataggata

SEQ ID NO: 101809 - DNA, 22 bp, Artificial Sequence
  Synthetic oligonucleotide; CTA chr11 5330767 5330788 5330784 5330789 +
taggataaagtctattaaaggt

SEQ ID NO: 101810 - DNA, 22 bp, Artificial Sequence
  Synthetic oligonucleotide; CTA chr11 5330781 5330802 5330798 5330803 +
ttaaaggtgatgtctgcacagg

SEQ ID NO: 101811 - DNA, 22 bp, Artificial Sequence
  Synthetic oligonucleotide; TTA chr11 5330784 5330805 5330801 5330806 +
aaggtgatgtctgcacaggcca

SEQ ID NO: 101812 - DNA, 22 bp, Artificial Sequence
  Synthetic oligonucleotide; CTG chr11 5330797 5330818 5330814 5330819 +
cacaggccagtttgatcacatc

SEQ ID NO: 101813 - DNA, 22 bp, Artificial Sequence
  Synthetic oligonucleotide; TTT chr11 5330810 5330831 5330827 5330832 +
gatcacatctggtgcaggcaga

SEQ ID NO: 101814 - DNA, 22 bp, Artificial Sequence
  Synthetic oligonucleotide; TTG chr11 5330811 5330832 5330828 5330833 +
atcacatctggtgcaggcagaa

SEQ ID NO: 101815 - DNA, 22 bp, Artificial Sequence
  Synthetic oligonucleotide; CTG chr11 5330821 5330842 5330838 5330843 +
gtgcaggcagaaagcatgggag

SEQ ID NO: 101816 - DNA, 22 bp, Artificial Sequence
  Synthetic oligonucleotide; TTG chr11 5330857 5330878 5330874 5330879 +
acagtaggggaatccagagagg

SEQ ID NO: 101817 - DNA, 22 bp, Artificial Sequence
  Synthetic oligonucleotide; TTA chr11 5330889 5330910 5330906 5330911 +
tgggcacaattagcataacaaa

SEQ ID NO: 101818 - DNA, 22 bp, Artificial Sequence
  Synthetic oligonucleotide; TTA chr11 5330901 5330922 5330918 5330923 +
gcataacaaatcccctcatttg

SEQ ID NO: 101819 - DNA, 22 bp, Artificial Sequence
  Synthetic oligonucleotide; CTC chr11 5330918 5330939 5330935 5330940 +
atttgaacccccagatctatct

SEQ ID NO: 101820 - DNA, 22 bp, Artificial Sequence
  Synthetic oligonucleotide; TTT chr11 5330922 5330943 5330939 5330944 +
gaacccccagatctatcttcac

SEQ ID NO: 101821 - DNA, 22 bp, Artificial Sequence
  Synthetic oligonucleotide; TTG chr11 5330923 5330944 5330940 5330945 +
aacccccagatctatcttcacc

SEQ ID NO: 101822 - DNA, 22 bp, Artificial Sequence
  Synthetic oligonucleotide; CTA chr11 5330937 5330958 5330954 5330959 +
tcttcaccaccttagcattggt

SEQ ID NO: 101823 - DNA, 22 bp, Artificial Sequence
  Synthetic oligonucleotide; CTT chr11 5330941 5330962 5330958 5330963 +
caccaccttagcattggtgaga

SEQ ID NO: 101824 - DNA, 22 bp, Artificial Sequence
  Synthetic oligonucleotide; TTC chr11 5330942 5330963 5330959 5330964 +
accaccttagcattggtgagaa

SEQ ID NO: 101825 - DNA, 22 bp, Artificial Sequence
  Synthetic oligonucleotide; CTT chr11 5330950 5330971 5330967 5330972 +
agcattggtgagaatggaggtg

SEQ ID NO: 101826 - DNA, 22 bp, Artificial Sequence
  Synthetic oligonucleotide; TTA chr11 5330951 5330972 5330968 5330973 +
gcattggtgagaatggaggtgt

SEQ ID NO: 101827 - DNA, 22 bp, Artificial Sequence
  Synthetic oligonucleotide; TTG chr11 5330957 5330978 5330974 5330979 +
gtgagaatggaggtgtatctca

SEQ ID NO: 101828 - DNA, 22 bp, Artificial Sequence
  Synthetic oligonucleotide; CTC chr11 5330978 5330999 5330995 5331000 +
aggggattatggatgccaataa

SEQ ID NO: 101829 - DNA, 22 bp, Artificial Sequence
  Synthetic oligonucleotide; TTA chr11 5330987 5331008 5331004 5331009 +
tggatgccaataaaacagtcat

SEQ ID NO: 101830 - DNA, 22 bp, Artificial Sequence
  Synthetic oligonucleotide; CTC chr11 5331030 5331051 5331047 5331052 +
tggactccacgatagagaggga

SEQ ID NO: 101831 - DNA, 22 bp, Artificial Sequence
  Synthetic oligonucleotide; CTG chr11 5331032 5331053 5331049 5331054 +
gactccacgatagagagggagt

SEQ ID NO: 101832 - DNA, 22 bp, Artificial Sequence
  Synthetic oligonucleotide; CTC chr11 5331037 5331058 5331054 5331059 +
cacgatagagagggagtggatt

SEQ ID NO: 101833 - DNA, 22 bp, Artificial Sequence
  Synthetic oligonucleotide; TTA chr11 5331060 5331081 5331077 5331082 +
gataggcctggaggaagcaggc

SEQ ID NO: 101834 - DNA, 22 bp, Artificial Sequence
  Synthetic oligonucleotide; CTG chr11 5331070 5331091 5331087 5331092 +
gaggaagcaggctccatggctc

SEQ ID NO: 101835 - DNA, 22 bp, Artificial Sequence
  Synthetic oligonucleotide; CTC chr11 5331084 5331105 5331101 5331106 +
catggctcattttcctgtgatc

SEQ ID NO: 101836 - DNA, 22 bp, Artificial Sequence
  Synthetic oligonucleotide; CTC chr11 5331092 5331113 5331109 5331114 +
attttcctgtgatctagccaga

SEQ ID NO: 101837 - DNA, 22 bp, Artificial Sequence
  Synthetic oligonucleotide; TTT chr11 5331096 5331117 5331113 5331118 +
tcctgtgatctagccagagaac

SEQ ID NO: 101838 - DNA, 22 bp, Artificial Sequence
  Synthetic oligonucleotide; TTT chr11 5331097 5331118 5331114 5331119 +
cctgtgatctagccagagaaca

SEQ ID NO: 101839 - DNA, 22 bp, Artificial Sequence
  Synthetic oligonucleotide; TTC chr11 5331098 5331119 5331115 5331120 +
ctgtgatctagccagagaacac

SEQ ID NO: 101840 - DNA, 22 bp, Artificial Sequence
  Synthetic oligonucleotide; CTG chr11 5331101 5331122 5331118 5331123 +
tgatctagccagagaacaccaa

SEQ ID NO: 101841 - DNA, 22 bp, Artificial Sequence
  Synthetic oligonucleotide; CTA chr11 5331108 5331129 5331125 5331130 +
gccagagaacaccaaggacagt

SEQ ID NO: 101842 - DNA, 22 bp, Artificial Sequence
  Synthetic oligonucleotide; TTG chr11 5331138 5331159 5331155 5331160 +
ttgtcaaagttacaccaaggtc

SEQ ID NO: 101843 - DNA, 22 bp, Artificial Sequence
  Synthetic oligonucleotide; TTG chr11 5331141 5331162 5331158 5331163 +
tcaaagttacaccaaggtctat

SEQ ID NO: 101844 - DNA, 22 bp, Artificial Sequence
  Synthetic oligonucleotide; TTA chr11 5331150 5331171 5331167 5331172 +
caccaaggtctatggctgccag

SEQ ID NO: 101845 - DNA, 22 bp, Artificial Sequence
  Synthetic oligonucleotide; CTA chr11 5331162 5331183 5331179 5331184 +
tggctgccagtatagtcagaga

SEQ ID NO: 101846 - DNA, 22 bp, Artificial Sequence
  Synthetic oligonucleotide; CTG chr11 5331168 5331189 5331185 5331190 +
ccagtatagtcagagagtagta

SEQ ID NO: 101847 - DNA, 22 bp, Artificial Sequence
  Synthetic oligonucleotide; CTC chr11 5331199 5331220 5331216 5331221 +
atgaagagtgcagtcttctctg

SEQ ID NO: 101848 - DNA, 22 bp, Artificial Sequence
  Synthetic oligonucleotide; CTT chr11 5331216 5331237 5331233 5331238 +
ctctgataaagaggaggaggct

SEQ ID NO: 101849 - DNA, 22 bp, Artificial Sequence
  Synthetic oligonucleotide; TTC chr11 5331217 5331238 5331234 5331239 +
tctgataaagaggaggaggctg

SEQ ID NO: 101850 - DNA, 22 bp, Artificial Sequence
  Synthetic oligonucleotide; CTC chr11 5331219 5331240 5331236 5331241 +
tgataaagaggaggaggctgcc

SEQ ID NO: 101851 - DNA, 22 bp, Artificial Sequence
  Synthetic oligonucleotide; CTG chr11 5331221 5331242 5331238 5331243 +
ataaagaggaggaggctgccat

SEQ ID NO: 101852 - DNA, 22 bp, Artificial Sequence
  Synthetic oligonucleotide; CTG chr11 5331239 5331260 5331256 5331261 +
ccattgccaaggactgtagaga

SEQ ID NO: 101853 - DNA, 22 bp, Artificial Sequence
  Synthetic oligonucleotide; TTG chr11 5331245 5331266 5331262 5331267 +
ccaaggactgtagagacataga

SEQ ID NO: 101854 - DNA, 22 bp, Artificial Sequence
  Synthetic oligonucleotide; CTG chr11 5331255 5331276 5331272 5331277 +
tagagacatagatgataaagaa

SEQ ID NO: 101855 - DNA, 22 bp, Artificial Sequence
  Synthetic oligonucleotide; CTC chr11 5331290 5331311 5331307 5331312 +
caaggatgaaatctctccagac

SEQ ID NO: 101856 - DNA, 22 bp, Artificial Sequence
  Synthetic oligonucleotide; CTC chr11 5331305 5331326 5331322 5331327 +
tccagacctggaaagccagtga

SEQ ID NO: 101857 - DNA, 22 bp, Artificial Sequence
  Synthetic oligonucleotide; CTC chr11 5331307 5331328 5331324 5331329 +
cagacctggaaagccagtgagg

SEQ ID NO: 101858 - DNA, 22 bp, Artificial Sequence
  Synthetic oligonucleotide; CTG chr11 5331315 5331336 5331332 5331337 +
gaaagccagtgaggagaaaagg

SEQ ID NO: 101859 - DNA, 22 bp, Artificial Sequence
  Synthetic oligonucleotide; CTG chr11 5331373 5331394 5331390 5331395 +
aggagaaacaaacaaacaaaac

SEQ ID NO: 101860 - DNA, 22 bp, Artificial Sequence
  Synthetic oligonucleotide; CTC chr11 5331400 5331421 5331417 5331422 +
tctagaccagcactatgtggtg

SEQ ID NO: 101861 - DNA, 22 bp, Artificial Sequence
  Synthetic oligonucleotide; CTC chr11 5331402 5331423 5331419 5331424 +
tagaccagcactatgtggtgga

SEQ ID NO: 101862 - DNA, 22 bp, Artificial Sequence
  Synthetic oligonucleotide; CTA chr11 5331404 5331425 5331421 5331426 +
gaccagcactatgtggtggaaa

SEQ ID NO: 101863 - DNA, 22 bp, Artificial Sequence
  Synthetic oligonucleotide; CTA chr11 5331415 5331436 5331432 5331437 +
tgtggtggaaatataattagag

SEQ ID NO: 101864 - DNA, 22 bp, Artificial Sequence
  Synthetic oligonucleotide; TTA chr11 5331434 5331455 5331451 5331456 +
gagctaaatatgtgatgttaaa

SEQ ID NO: 101865 - DNA, 22 bp, Artificial Sequence
  Synthetic oligonucleotide; CTA chr11 5331440 5331461 5331457 5331462 +
aatatgtgatgttaaatgttct

SEQ ID NO: 101866 - DNA, 22 bp, Artificial Sequence
  Synthetic oligonucleotide; TTA chr11 5331454 5331475 5331471 5331476 +
aatgttctggtagtcacattaa

SEQ ID NO: 101867 - DNA, 22 bp, Artificial Sequence
  Synthetic oligonucleotide; TTC chr11 5331461 5331482 5331478 5331483 +
tggtagtcacattaaaaggagt

SEQ ID NO: 101868 - DNA, 22 bp, Artificial Sequence
  Synthetic oligonucleotide; CTG chr11 5331463 5331484 5331480 5331485 +
gtagtcacattaaaaggagtaa

SEQ ID NO: 101869 - DNA, 22 bp, Artificial Sequence
  Synthetic oligonucleotide; TTA chr11 5331475 5331496 5331492 5331497 +
aaaggagtaaaaagaaaagtgg

SEQ ID NO: 101870 - DNA, 22 bp, Artificial Sequence
  Synthetic oligonucleotide; TTA chr11 5331505 5331526 5331522 5331527 +
atattagtatgtcttatttaag

SEQ ID NO: 101871 - DNA, 22 bp, Artificial Sequence
  Synthetic oligonucleotide; TTA chr11 5331511 5331532 5331528 5331533 +
gtatgtcttatttaagctacta

SEQ ID NO: 101872 - DNA, 22 bp, Artificial Sequence
  Synthetic oligonucleotide; CTT chr11 5331520 5331541 5331537 5331542 +
atttaagctactatatcaaaaa

SEQ ID NO: 101873 - DNA, 22 bp, Artificial Sequence
  Synthetic oligonucleotide; TTA chr11 5331521 5331542 5331538 5331543 +
tttaagctactatatcaaaaat

SEQ ID NO: 101874 - DNA, 22 bp, Artificial Sequence
  Synthetic oligonucleotide; TTT chr11 5331524 5331545 5331541 5331546 +
aagctactatatcaaaaatatt

SEQ ID NO: 101875 - DNA, 22 bp, Artificial Sequence
  Synthetic oligonucleotide; TTA chr11 5331525 5331546 5331542 5331547 +
agctactatatcaaaaatatta

SEQ ID NO: 101876 - DNA, 22 bp, Artificial Sequence
  Synthetic oligonucleotide; CTA chr11 5331530 5331551 5331547 5331552 +
ctatatcaaaaatattatcatt

SEQ ID NO: 101877 - DNA, 22 bp, Artificial Sequence
  Synthetic oligonucleotide; CTA chr11 5331533 5331554 5331550 5331555 +
tatcaaaaatattatcatttta

SEQ ID NO: 101878 - DNA, 22 bp, Artificial Sequence
  Synthetic oligonucleotide; TTA chr11 5331547 5331568 5331564 5331569 +
tcattttaatagataatcagca

SEQ ID NO: 101879 - DNA, 22 bp, Artificial Sequence
  Synthetic oligonucleotide; TTT chr11 5331553 5331574 5331570 5331575 +
taatagataatcagcataaaaa

SEQ ID NO: 101880 - DNA, 22 bp, Artificial Sequence
  Synthetic oligonucleotide; TTT chr11 5331554 5331575 5331571 5331576 +
aatagataatcagcataaaaat

SEQ ID NO: 101881 - DNA, 22 bp, Artificial Sequence
  Synthetic oligonucleotide; TTA chr11 5331555 5331576 5331572 5331577 +
atagataatcagcataaaaatc

SEQ ID NO: 101882 - DNA, 22 bp, Artificial Sequence
  Synthetic oligonucleotide; TTC chr11 5331593 5331614 5331610 5331615 +
ccacgatttttttttggtacaa

SEQ ID NO: 101883 - DNA, 22 bp, Artificial Sequence
  Synthetic oligonucleotide; TTT chr11 5331602 5331623 5331619 5331624 +
ttttttggtacaaattcttcaa

SEQ ID NO: 101884 - DNA, 22 bp, Artificial Sequence
  Synthetic oligonucleotide; TTT chr11 5331603 5331624 5331620 5331625 +
tttttggtacaaattcttcaaa

SEQ ID NO: 101885 - DNA, 22 bp, Artificial Sequence
  Synthetic oligonucleotide; TTT chr11 5331604 5331625 5331621 5331626 +
ttttggtacaaattcttcaaaa

SEQ ID NO: 101886 - DNA, 22 bp, Artificial Sequence
  Synthetic oligonucleotide; TTT chr11 5331605 5331626 5331622 5331627 +
tttggtacaaattcttcaaaat

SEQ ID NO: 101887 - DNA, 22 bp, Artificial Sequence
  Synthetic oligonucleotide; TTT chr11 5331606 5331627 5331623 5331628 +
ttggtacaaattcttcaaaatc

SEQ ID NO: 101888 - DNA, 22 bp, Artificial Sequence
  Synthetic oligonucleotide; TTT chr11 5331607 5331628 5331624 5331629 +
tggtacaaattcttcaaaatcg

SEQ ID NO: 101889 - DNA, 22 bp, Artificial Sequence
  Synthetic oligonucleotide; TTT chr11 5331608 5331629 5331625 5331630 +
ggtacaaattcttcaaaatcga

SEQ ID NO: 101890 - DNA, 22 bp, Artificial Sequence
  Synthetic oligonucleotide; TTG chr11 5331609 5331630 5331626 5331631 +
gtacaaattcttcaaaatcgag

SEQ ID NO: 101891 - DNA, 22 bp, Artificial Sequence
  Synthetic oligonucleotide; TTC chr11 5331619 5331640 5331636 5331641 +
ttcaaaatcgagtgtttacact

SEQ ID NO: 101892 - DNA, 22 bp, Artificial Sequence
  Synthetic oligonucleotide; CTT chr11 5331621 5331642 5331638 5331643 +
caaaatcgagtgtttacactta

SEQ ID NO: 101893 - DNA, 22 bp, Artificial Sequence
  Synthetic oligonucleotide; TTC chr11 5331622 5331643 5331639 5331644 +
aaaatcgagtgtttacacttac

SEQ ID NO: 101894 - DNA, 22 bp, Artificial Sequence
  Synthetic oligonucleotide; TTT chr11 5331636 5331657 5331653 5331658 +
acacttacagaaaattctgact

SEQ ID NO: 101895 - DNA, 22 bp, Artificial Sequence
  Synthetic oligonucleotide; TTA chr11 5331637 5331658 5331654 5331659 +
cacttacagaaaattctgactc

SEQ ID NO: 101896 - DNA, 22 bp, Artificial Sequence
  Synthetic oligonucleotide; CTT chr11 5331642 5331663 5331659 5331664 +
acagaaaattctgactcaagct

SEQ ID NO: 101897 - DNA, 22 bp, Artificial Sequence
  Synthetic oligonucleotide; TTA chr11 5331643 5331664 5331660 5331665 +
cagaaaattctgactcaagcta

SEQ ID NO: 101898 - DNA, 22 bp, Artificial Sequence
  Synthetic oligonucleotide; TTC chr11 5331653 5331674 5331670 5331675 +
tgactcaagctaaccagatgct

SEQ ID NO: 101899 - DNA, 22 bp, Artificial Sequence
  Synthetic oligonucleotide; CTG chr11 5331655 5331676 5331672 5331677 +
actcaagctaaccagatgctac

SEQ ID NO: 101900 - DNA, 22 bp, Artificial Sequence
  Synthetic oligonucleotide; CTC chr11 5331659 5331680 5331676 5331681 +
aagctaaccagatgctactgtt

SEQ ID NO: 101901 - DNA, 22 bp, Artificial Sequence
  Synthetic oligonucleotide; CTA chr11 5331665 5331686 5331682 5331687 +
accagatgctactgttttggac

SEQ ID NO: 101902 - DNA, 22 bp, Artificial Sequence
  Synthetic oligonucleotide; CTA chr11 5331676 5331697 5331693 5331698 +
ctgttttggacagcacagctct

SEQ ID NO: 101903 - DNA, 22 bp, Artificial Sequence
  Synthetic oligonucleotide; CTG chr11 5331679 5331700 5331696 5331701 +
ttttggacagcacagctctaga

SEQ ID NO: 101904 - DNA, 22 bp, Artificial Sequence
  Synthetic oligonucleotide; TTT chr11 5331682 5331703 5331699 5331704 +
tggacagcacagctctagacta

SEQ ID NO: 101905 - DNA, 22 bp, Artificial Sequence
  Synthetic oligonucleotide; TTT chr11 5331683 5331704 5331700 5331705 +
ggacagcacagctctagactat

SEQ ID NO: 101906 - DNA, 22 bp, Artificial Sequence
  Synthetic oligonucleotide; TTG chr11 5331684 5331705 5331701 5331706 +
gacagcacagctctagactata

SEQ ID NO: 101907 - DNA, 22 bp, Artificial Sequence
  Synthetic oligonucleotide; CTC chr11 5331697 5331718 5331714 5331719 +
tagactatacgacttcatcctc

SEQ ID NO: 101908 - DNA, 22 bp, Artificial Sequence
  Synthetic oligonucleotide; CTA chr11 5331699 5331720 5331716 5331721 +
gactatacgacttcatcctcag

SEQ ID NO: 101909 - DNA, 22 bp, Artificial Sequence
  Synthetic oligonucleotide; CTA chr11 5331704 5331725 5331721 5331726 +
tacgacttcatcctcagtttcg

SEQ ID NO: 101910 - DNA, 22 bp, Artificial Sequence
  Synthetic oligonucleotide; CTT chr11 5331712 5331733 5331729 5331734 +
catcctcagtttcgactccagc

SEQ ID NO: 101911 - DNA, 22 bp, Artificial Sequence
  Synthetic oligonucleotide; TTC chr11 5331713 5331734 5331730 5331735 +
atcctcagtttcgactccagct

SEQ ID NO: 101912 - DNA, 22 bp, Artificial Sequence
  Synthetic oligonucleotide; CTC chr11 5331719 5331740 5331736 5331741 +
agtttcgactccagctgctttc

SEQ ID NO: 101913 - DNA, 22 bp, Artificial Sequence
  Synthetic oligonucleotide; TTT chr11 5331724 5331745 5331741 5331746 +
cgactccagctgctttctacca

SEQ ID NO: 101914 - DNA, 22 bp, Artificial Sequence
  Synthetic oligonucleotide; TTC chr11 5331725 5331746 5331742 5331747 +
gactccagctgctttctaccac

SEQ ID NO: 101915 - DNA, 22 bp, Artificial Sequence
  Synthetic oligonucleotide; CTC chr11 5331730 5331751 5331747 5331752 +
cagctgctttctaccacccttt

SEQ ID NO: 101916 - DNA, 22 bp, Artificial Sequence
  Synthetic oligonucleotide; CTG chr11 5331736 5331757 5331753 5331758 +
ctttctaccaccctttcagaca

SEQ ID NO: 101917 - DNA, 22 bp, Artificial Sequence
  Synthetic oligonucleotide; CTT chr11 5331739 5331760 5331756 5331761 +
tctaccaccctttcagacattg

SEQ ID NO: 101918 - DNA, 22 bp, Artificial Sequence
  Synthetic oligonucleotide; TTT chr11 5331740 5331761 5331757 5331762 +
ctaccaccctttcagacattgt

SEQ ID NO: 101919 - DNA, 22 bp, Artificial Sequence
  Synthetic oligonucleotide; TTC chr11 5331741 5331762 5331758 5331763 +
taccaccctttcagacattgtg

SEQ ID NO: 101920 - DNA, 22 bp, Artificial Sequence
  Synthetic oligonucleotide; CTA chr11 5331743 5331764 5331760 5331765 +
ccaccctttcagacattgtgct

SEQ ID NO: 101921 - DNA, 22 bp, Artificial Sequence
  Synthetic oligonucleotide; CTT chr11 5331751 5331772 5331768 5331773 +
tcagacattgtgcttcatcaaa

SEQ ID NO: 101922 - DNA, 22 bp, Artificial Sequence
  Synthetic oligonucleotide; TTT chr11 5331752 5331773 5331769 5331774 +
cagacattgtgcttcatcaaaa

SEQ ID NO: 101923 - DNA, 22 bp, Artificial Sequence
  Synthetic oligonucleotide; TTC chr11 5331753 5331774 5331770 5331775 +
agacattgtgcttcatcaaaaa

SEQ ID NO: 101924 - DNA, 22 bp, Artificial Sequence
  Synthetic oligonucleotide; TTG chr11 5331761 5331782 5331778 5331783 +
tgcttcatcaaaaaaatgttaa

SEQ ID NO: 101925 - DNA, 22 bp, Artificial Sequence
  Synthetic oligonucleotide; CTT chr11 5331766 5331787 5331783 5331788 +
catcaaaaaaatgttaagaata

SEQ ID NO: 101926 - DNA, 22 bp, Artificial Sequence
  Synthetic oligonucleotide; TTC chr11 5331767 5331788 5331784 5331789 +
atcaaaaaaatgttaagaataa

SEQ ID NO: 101927 - DNA, 22 bp, Artificial Sequence
  Synthetic oligonucleotide; TTA chr11 5331782 5331803 5331799 5331804 +
agaataaaaattatttcacaca

SEQ ID NO: 101928 - DNA, 22 bp, Artificial Sequence
  Synthetic oligonucleotide; TTA chr11 5331795 5331816 5331812 5331817 +
tttcacacatactttaaaacta

SEQ ID NO: 101929 - DNA, 22 bp, Artificial Sequence
  Synthetic oligonucleotide; TTT chr11 5331798 5331819 5331815 5331820 +
cacacatactttaaaactaaca

SEQ ID NO: 101930 - DNA, 22 bp, Artificial Sequence
  Synthetic oligonucleotide; TTC chr11 5331799 5331820 5331816 5331821 +
acacatactttaaaactaacac

SEQ ID NO: 101931 - DNA, 22 bp, Artificial Sequence
  Synthetic oligonucleotide; CTT chr11 5331809 5331830 5331826 5331831 +
taaaactaacacatatattgga

SEQ ID NO: 101932 - DNA, 22 bp, Artificial Sequence
  Synthetic oligonucleotide; TTT chr11 5331810 5331831 5331827 5331832 +
aaaactaacacatatattggaa

SEQ ID NO: 101933 - DNA, 22 bp, Artificial Sequence
  Synthetic oligonucleotide; TTA chr11 5331811 5331832 5331828 5331833 +
aaactaacacatatattggaaa

SEQ ID NO: 101934 - DNA, 22 bp, Artificial Sequence
  Synthetic oligonucleotide; CTA chr11 5331817 5331838 5331834 5331839 +
acacatatattggaaaagaaag

SEQ ID NO: 101935 - DNA, 22 bp, Artificial Sequence
  Synthetic oligonucleotide; TTG chr11 5331829 5331850 5331846 5331851 +
gaaaagaaagtctcctctctca

SEQ ID NO: 101936 - DNA, 22 bp, Artificial Sequence
  Synthetic oligonucleotide; CTC chr11 5331843 5331864 5331860 5331865 +
ctctctcactagctatttttta

SEQ ID NO: 101937 - DNA, 22 bp, Artificial Sequence
  Synthetic oligonucleotide; CTC chr11 5331846 5331867 5331863 5331868 +
tctcactagctattttttaaat

SEQ ID NO: 101938 - DNA, 22 bp, Artificial Sequence
  Synthetic oligonucleotide; CTC chr11 5331848 5331869 5331865 5331870 +
tcactagctattttttaaatgg

SEQ ID NO: 101939 - DNA, 22 bp, Artificial Sequence
  Synthetic oligonucleotide; CTC chr11 5331850 5331871 5331867 5331872 +
actagctattttttaaatggtg

SEQ ID NO: 101940 - DNA, 22 bp, Artificial Sequence
  Synthetic oligonucleotide; CTA chr11 5331854 5331875 5331871 5331876 +
gctattttttaaatggtgtgat

SEQ ID NO: 101941 - DNA, 22 bp, Artificial Sequence
  Synthetic oligonucleotide; CTA chr11 5331858 5331879 5331875 5331880 +
ttttttaaatggtgtgataggc

SEQ ID NO: 101942 - DNA, 22 bp, Artificial Sequence
  Synthetic oligonucleotide; TTT chr11 5331861 5331882 5331878 5331883 +
tttaaatggtgtgataggcata

SEQ ID NO: 101943 - DNA, 22 bp, Artificial Sequence
  Synthetic oligonucleotide; TTT chr11 5331862 5331883 5331879 5331884 +
ttaaatggtgtgataggcataa

SEQ ID NO: 101944 - DNA, 22 bp, Artificial Sequence
  Synthetic oligonucleotide; TTT chr11 5331863 5331884 5331880 5331885 +
taaatggtgtgataggcataat

SEQ ID NO: 101945 - DNA, 22 bp, Artificial Sequence
  Synthetic oligonucleotide; TTT chr11 5331864 5331885 5331881 5331886 +
aaatggtgtgataggcataatt

SEQ ID NO: 101946 - DNA, 22 bp, Artificial Sequence
  Synthetic oligonucleotide; TTA chr11 5331865 5331886 5331882 5331887 +
aatggtgtgataggcataattt

SEQ ID NO: 101947 - DNA, 22 bp, Artificial Sequence
  Synthetic oligonucleotide; TTT chr11 5331887 5331908 5331904 5331909 +
taaaaacctttctaccacaaga

SEQ ID NO: 101948 - DNA, 22 bp, Artificial Sequence
  Synthetic oligonucleotide; TTT chr11 5331888 5331909 5331905 5331910 +
aaaaacctttctaccacaagat

SEQ ID NO: 101949 - DNA, 22 bp, Artificial Sequence
  Synthetic oligonucleotide; TTA chr11 5331889 5331910 5331906 5331911 +
aaaacctttctaccacaagatt

SEQ ID NO: 101950 - DNA, 22 bp, Artificial Sequence
  Synthetic oligonucleotide; CTT chr11 5331897 5331918 5331914 5331919 +
tctaccacaagatttcctatcc

SEQ ID NO: 101951 - DNA, 22 bp, Artificial Sequence
  Synthetic oligonucleotide; TTT chr11 5331898 5331919 5331915 5331920 +
ctaccacaagatttcctatcct

SEQ ID NO: 101952 - DNA, 22 bp, Artificial Sequence
  Synthetic oligonucleotide; TTC chr11 5331899 5331920 5331916 5331921 +
taccacaagatttcctatccta

SEQ ID NO: 101953 - DNA, 22 bp, Artificial Sequence
  Synthetic oligonucleotide; CTA chr11 5331901 5331922 5331918 5331923 +
ccacaagatttcctatcctaat

SEQ ID NO: 101954 - DNA, 22 bp, Artificial Sequence
  Synthetic oligonucleotide; TTT chr11 5331912 5331933 5331929 5331934 +
cctatcctaatttctaggactg

SEQ ID NO: 101955 - DNA, 22 bp, Artificial Sequence
  Synthetic oligonucleotide; TTC chr11 5331913 5331934 5331930 5331935 +
ctatcctaatttctaggactgt

SEQ ID NO: 101956 - DNA, 22 bp, Artificial Sequence
  Synthetic oligonucleotide; CTA chr11 5331916 5331937 5331933 5331938 +
tcctaatttctaggactgtgaa

SEQ ID NO: 101957 - DNA, 22 bp, Artificial Sequence
  Synthetic oligonucleotide; CTA chr11 5331921 5331942 5331938 5331943 +
atttctaggactgtgaatatga

SEQ ID NO: 101958 - DNA, 22 bp, Artificial Sequence
  Synthetic oligonucleotide; TTT chr11 5331925 5331946 5331942 5331947 +
ctaggactgtgaatatgataca

SEQ ID NO: 101959 - DNA, 22 bp, Artificial Sequence
  Synthetic oligonucleotide; TTC chr11 5331926 5331947 5331943 5331948 +
taggactgtgaatatgatacaa

SEQ ID NO: 101960 - DNA, 22 bp, Artificial Sequence
  Synthetic oligonucleotide; CTA chr11 5331928 5331949 5331945 5331950 +
ggactgtgaatatgatacaata

SEQ ID NO: 101961 - DNA, 22 bp, Artificial Sequence
  Synthetic oligonucleotide; CTG chr11 5331934 5331955 5331951 5331956 +
tgaatatgatacaatatcatgc

SEQ ID NO: 101962 - DNA, 22 bp, Artificial Sequence
  Synthetic oligonucleotide; CTT chr11 5331958 5331979 5331975 5331980 +
ggggttatacagatgtaattaa

SEQ ID NO: 101963 - DNA, 22 bp, Artificial Sequence
  Synthetic oligonucleotide; TTG chr11 5331959 5331980 5331976 5331981 +
gggttatacagatgtaattaaa

SEQ ID NO: 101964 - DNA, 22 bp, Artificial Sequence
  Synthetic oligonucleotide; TTA chr11 5331965 5331986 5331982 5331987 +
tacagatgtaattaaagttgct

SEQ ID NO: 101965 - DNA, 22 bp, Artificial Sequence
  Synthetic oligonucleotide; TTA chr11 5331979 5332000 5331996 5332001 +
aagttgctgatctattgacttt

SEQ ID NO: 101966 - DNA, 22 bp, Artificial Sequence
  Synthetic oligonucleotide; TTG chr11 5331985 5332006 5332002 5332007 +
ctgatctattgactttgagtta

SEQ ID NO: 101967 - DNA, 22 bp, Artificial Sequence
  Synthetic oligonucleotide; CTG chr11 5331988 5332009 5332005 5332010 +
atctattgactttgagttaatt

SEQ ID NO: 101968 - DNA, 22 bp, Artificial Sequence
  Synthetic oligonucleotide; CTA chr11 5331993 5332014 5332010 5332015 +
ttgactttgagttaattgaaaa

SEQ ID NO: 101969 - DNA, 22 bp, Artificial Sequence
  Synthetic oligonucleotide; TTG chr11 5331996 5332017 5332013 5332018 +
actttgagttaattgaaaagga

SEQ ID NO: 101970 - DNA, 22 bp, Artificial Sequence
  Synthetic oligonucleotide; CTT chr11 5332000 5332021 5332017 5332022 +
tgagttaattgaaaaggaaatt

SEQ ID NO: 101971 - DNA, 22 bp, Artificial Sequence
  Synthetic oligonucleotide; TTT chr11 5332001 5332022 5332018 5332023 +
gagttaattgaaaaggaaatta

SEQ ID NO: 101972 - DNA, 22 bp, Artificial Sequence
  Synthetic oligonucleotide; TTG chr11 5332002 5332023 5332019 5332024 +
agttaattgaaaaggaaattac

SEQ ID NO: 101973 - DNA, 22 bp, Artificial Sequence
  Synthetic oligonucleotide; TTA chr11 5332007 5332028 5332024 5332029 +
attgaaaaggaaattactcagg

SEQ ID NO: 101974 - DNA, 22 bp, Artificial Sequence
  Synthetic oligonucleotide; TTG chr11 5332011 5332032 5332028 5332033 +
aaaaggaaattactcaggggaa

SEQ ID NO: 101975 - DNA, 22 bp, Artificial Sequence
  Synthetic oligonucleotide; TTA chr11 5332023 5332044 5332040 5332045 +
ctcaggggaacctagtctaatt

SEQ ID NO: 101976 - DNA, 22 bp, Artificial Sequence
  Synthetic oligonucleotide; CTC chr11 5332026 5332047 5332043 5332048 +
aggggaacctagtctaattcca

SEQ ID NO: 101977 - DNA, 22 bp, Artificial Sequence
  Synthetic oligonucleotide; CTA chr11 5332037 5332058 5332054 5332059 +
gtctaattccatgagcccctaa

SEQ ID NO: 101978 - DNA, 22 bp, Artificial Sequence
  Synthetic oligonucleotide; CTA chr11 5332042 5332063 5332059 5332064 +
attccatgagcccctaaaagca

SEQ ID NO: 101979 - DNA, 22 bp, Artificial Sequence
  Synthetic oligonucleotide; TTC chr11 5332046 5332067 5332063 5332068 +
catgagcccctaaaagcagagt

SEQ ID NO: 101980 - DNA, 22 bp, Artificial Sequence
  Synthetic oligonucleotide; CTA chr11 5332058 5332079 5332075 5332080 +
aaagcagagttttcaccaagta

SEQ ID NO: 101981 - DNA, 22 bp, Artificial Sequence
  Synthetic oligonucleotide; TTT chr11 5332070 5332091 5332087 5332092 +
tcaccaagtagtaggagaatag

SEQ ID NO: 101982 - DNA, 22 bp, Artificial Sequence
  Synthetic oligonucleotide; TTT chr11 5332071 5332092 5332088 5332093 +
caccaagtagtaggagaatagg

SEQ ID NO: 101983 - DNA, 22 bp, Artificial Sequence
  Synthetic oligonucleotide; TTC chr11 5332072 5332093 5332089 5332094 +
accaagtagtaggagaatagga

SEQ ID NO: 101984 - DNA, 22 bp, Artificial Sequence
  Synthetic oligonucleotide; TTC chr11 5332108 5332129 5332125 5332130 +
aaaatttgagaaaggttcatgg

SEQ ID NO: 101985 - DNA, 22 bp, Artificial Sequence
  Synthetic oligonucleotide; TTT chr11 5332115 5332136 5332132 5332137 +
gagaaaggttcatgggtcagtt

SEQ ID NO: 101986 - DNA, 22 bp, Artificial Sequence
  Synthetic oligonucleotide; TTG chr11 5332116 5332137 5332133 5332138 +
agaaaggttcatgggtcagttg

SEQ ID NO: 101987 - DNA, 22 bp, Artificial Sequence
  Synthetic oligonucleotide; TTC chr11 5332126 5332147 5332143 5332148 +
atgggtcagttgctggtttgaa

SEQ ID NO: 101988 - DNA, 22 bp, Artificial Sequence
  Synthetic oligonucleotide; TTG chr11 5332138 5332159 5332155 5332160 +
ctggtttgaaatataaggaggt

SEQ ID NO: 101989 - DNA, 22 bp, Artificial Sequence
  Synthetic oligonucleotide; CTG chr11 5332141 5332162 5332158 5332163 +
gtttgaaatataaggaggtcac

SEQ ID NO: 101990 - DNA, 22 bp, Artificial Sequence
  Synthetic oligonucleotide; TTT chr11 5332145 5332166 5332162 5332167 +
gaaatataaggaggtcacaaaa

SEQ ID NO: 101991 - DNA, 22 bp, Artificial Sequence
  Synthetic oligonucleotide; TTG chr11 5332146 5332167 5332163 5332168 +
aaatataaggaggtcacaaaag

SEQ ID NO: 101992 - DNA, 22 bp, Artificial Sequence
  Synthetic oligonucleotide; CTA chr11 5332189 5332210 5332206 5332211 +
ggtacagaacgggcatcctagc

SEQ ID NO: 101993 - DNA, 22 bp, Artificial Sequence
  Synthetic oligonucleotide; CTA chr11 5332209 5332230 5332226 5332231 +
gctaacagcctgcaaacaaaca

SEQ ID NO: 101994 - DNA, 22 bp, Artificial Sequence
  Synthetic oligonucleotide; CTA chr11 5332213 5332234 5332230 5332235 +
acagcctgcaaacaaacaaaca

SEQ ID NO: 101995 - DNA, 22 bp, Artificial Sequence
  Synthetic oligonucleotide; CTG chr11 5332221 5332242 5332238 5332243 +
caaacaaacaaacaaaaaacaa

SEQ ID NO: 101996 - DNA, 22 bp, Artificial Sequence
  Synthetic oligonucleotide; CTT chr11 5332265 5332286 5332282 5332287 +
cagagttcagcagtaggaaact

SEQ ID NO: 101997 - DNA, 22 bp, Artificial Sequence
  Synthetic oligonucleotide; TTC chr11 5332266 5332287 5332283 5332288 +
agagttcagcagtaggaaactg

SEQ ID NO: 101998 - DNA, 22 bp, Artificial Sequence
  Synthetic oligonucleotide; TTC chr11 5332273 5332294 5332290 5332295 +
agcagtaggaaactgaactctg

SEQ ID NO: 101999 - DNA, 22 bp, Artificial Sequence
  Synthetic oligonucleotide; CTG chr11 5332288 5332309 5332305 5332310 +
aactctgacagccgggtgcaat

SEQ ID NO: 102000 - DNA, 22 bp, Artificial Sequence
  Synthetic oligonucleotide; CTC chr11 5332293 5332314 5332310 5332315 +
tgacagccgggtgcaatggctc

SEQ ID NO: 102001 - DNA, 22 bp, Artificial Sequence
  Synthetic oligonucleotide; CTG chr11 5332295 5332316 5332312 5332317 +
acagccgggtgcaatggctcat

SEQ ID NO: 102002 - DNA, 22 bp, Artificial Sequence
  Synthetic oligonucleotide; CTC chr11 5332315 5332336 5332332 5332337 +
attcaagcctgtaatcccagca

SEQ ID NO: 102003 - DNA, 22 bp, Artificial Sequence
  Synthetic oligonucleotide; TTC chr11 5332319 5332340 5332336 5332341 +
aagcctgtaatcccagcacttt

SEQ ID NO: 102004 - DNA, 22 bp, Artificial Sequence
  Synthetic oligonucleotide; CTG chr11 5332326 5332347 5332343 5332348 +
taatcccagcactttgggaggc

SEQ ID NO: 102005 - DNA, 22 bp, Artificial Sequence
  Synthetic oligonucleotide; CTT chr11 5332340 5332361 5332357 5332362 +
tgggaggccaaggcgggcggat

SEQ ID NO: 102006 - DNA, 22 bp, Artificial Sequence
  Synthetic oligonucleotide; TTT chr11 5332341 5332362 5332358 5332363 +
gggaggccaaggcgggcggatc

SEQ ID NO: 102007 - DNA, 22 bp, Artificial Sequence
  Synthetic oligonucleotide; TTG chr11 5332342 5332363 5332359 5332364 +
ggaggccaaggcgggcggatca

SEQ ID NO: 102008 - DNA, 22 bp, Artificial Sequence
  Synthetic oligonucleotide; CTG chr11 5332368 5332389 5332385 5332390 +
aggtcaggagttccagaccagc

SEQ ID NO: 102009 - DNA, 22 bp, Artificial Sequence
  Synthetic oligonucleotide; TTC chr11 5332381 5332402 5332398 5332403 +
cagaccagcctggccaacatgg

SEQ ID NO: 102010 - DNA, 22 bp, Artificial Sequence
  Synthetic oligonucleotide; CTG chr11 5332393 5332414 5332410 5332415 +
gccaacatggtgaaattccatc

SEQ ID NO: 102011 - DNA, 22 bp, Artificial Sequence
  Synthetic oligonucleotide; TTC chr11 5332411 5332432 5332428 5332433 +
catccctaccaaaaaatataaa

SEQ ID NO: 102012 - DNA, 22 bp, Artificial Sequence
  Synthetic oligonucleotide; CTA chr11 5332419 5332440 5332436 5332441 +
ccaaaaaatataaaaattagcc

SEQ ID NO: 102013 - DNA, 22 bp, Artificial Sequence
  Synthetic oligonucleotide; TTA chr11 5332438 5332459 5332455 5332460 +
gccaggtgtggttgcagttgcc

SEQ ID NO: 102014 - DNA, 22 bp, Artificial Sequence
  Synthetic oligonucleotide; TTG chr11 5332452 5332473 5332469 5332474 +
cagttgcctgtagttccagcta

SEQ ID NO: 102015 - DNA, 22 bp, Artificial Sequence
  Synthetic oligonucleotide; TTG chr11 5332458 5332479 5332475 5332480 +
cctgtagttccagctacttggg

SEQ ID NO: 102016 - DNA, 22 bp, Artificial Sequence
  Synthetic oligonucleotide; CTG chr11 5332462 5332483 5332479 5332484 +
tagttccagctacttgggaaac

SEQ ID NO: 102017 - DNA, 22 bp, Artificial Sequence
  Synthetic oligonucleotide; TTC chr11 5332468 5332489 5332485 5332490 +
cagctacttgggaaactgaggc

SEQ ID NO: 102018 - DNA, 22 bp, Artificial Sequence
  Synthetic oligonucleotide; CTA chr11 5332474 5332495 5332491 5332496 +
cttgggaaactgaggcaggaga

SEQ ID NO: 102019 - DNA, 22 bp, Artificial Sequence
  Synthetic oligonucleotide; CTT chr11 5332477 5332498 5332494 5332499 +
gggaaactgaggcaggagaatt

SEQ ID NO: 102020 - DNA, 22 bp, Artificial Sequence
  Synthetic oligonucleotide; TTG chr11 5332478 5332499 5332495 5332500 +
ggaaactgaggcaggagaattg

SEQ ID NO: 102021 - DNA, 22 bp, Artificial Sequence
  Synthetic oligonucleotide; CTG chr11 5332486 5332507 5332503 5332508 +
aggcaggagaattgcttgaacc

SEQ ID NO: 102022 - DNA, 22 bp, Artificial Sequence
  Synthetic oligonucleotide; TTG chr11 5332500 5332521 5332517 5332522 +
cttgaacccgggaggcacaggt

SEQ ID NO: 102023 - DNA, 22 bp, Artificial Sequence
  Synthetic oligonucleotide; CTT chr11 5332503 5332524 5332520 5332525 +
gaacccgggaggcacaggttgc

SEQ ID NO: 102024 - DNA, 22 bp, Artificial Sequence
  Synthetic oligonucleotide; TTG chr11 5332504 5332525 5332521 5332526 +
aacccgggaggcacaggttgca

SEQ ID NO: 102025 - DNA, 22 bp, Artificial Sequence
  Synthetic oligonucleotide; TTG chr11 5332524 5332545 5332541 5332546 +
cagggagcaagagattgtgcca

SEQ ID NO: 102026 - DNA, 22 bp, Artificial Sequence
  Synthetic oligonucleotide; TTG chr11 5332541 5332562 5332558 5332563 +
tgccactgcactccaggctggg

SEQ ID NO: 102027 - DNA, 22 bp, Artificial Sequence
  Synthetic oligonucleotide; CTG chr11 5332549 5332570 5332566 5332571 +
cactccaggctgggtgacagag

SEQ ID NO: 102028 - DNA, 22 bp, Artificial Sequence
  Synthetic oligonucleotide; CTC chr11 5332554 5332575 5332571 5332576 +
caggctgggtgacagagcgaga

SEQ ID NO: 102029 - DNA, 22 bp, Artificial Sequence
  Synthetic oligonucleotide; CTG chr11 5332561 5332582 5332578 5332583 +
ggtgacagagcgagactccatc

SEQ ID NO: 102030 - DNA, 22 bp, Artificial Sequence
  Synthetic oligonucleotide; CTC chr11 5332579 5332600 5332596 5332601 +
catctcaaaaaaaaaaaaaaaa

SEQ ID NO: 102031 - DNA, 22 bp, Artificial Sequence
  Synthetic oligonucleotide; CTC chr11 5332585 5332606 5332602 5332607 +
aaaaaaaaaaaaaaaaaaaaga

SEQ ID NO: 102032 - DNA, 22 bp, Artificial Sequence
  Synthetic oligonucleotide; CTG chr11 5332622 5332643 5332639 5332644 +
agctctgactacaatctgaatg

SEQ ID NO: 102033 - DNA, 22 bp, Artificial Sequence
  Synthetic oligonucleotide; CTC chr11 5332627 5332648 5332644 5332649 +
tgactacaatctgaatgaacgt

SEQ ID NO: 102034 - DNA, 22 bp, Artificial Sequence
  Synthetic oligonucleotide; CTG chr11 5332629 5332650 5332646 5332651 +
actacaatctgaatgaacgtgg

SEQ ID NO: 102035 - DNA, 22 bp, Artificial Sequence
  Synthetic oligonucleotide; CTA chr11 5332633 5332654 5332650 5332655 +
caatctgaatgaacgtggaagc

SEQ ID NO: 102036 - DNA, 22 bp, Artificial Sequence
  Synthetic oligonucleotide; CTG chr11 5332640 5332661 5332657 5332662 +
aatgaacgtggaagcgaattct

SEQ ID NO: 102037 - DNA, 22 bp, Artificial Sequence
  Synthetic oligonucleotide; TTC chr11 5332661 5332682 5332678 5332683 +
ttccccagagcctttggataag

SEQ ID NO: 102038 - DNA, 22 bp, Artificial Sequence
  Synthetic oligonucleotide; CTT chr11 5332663 5332684 5332680 5332685 +
ccccagagcctttggataagag

SEQ ID NO: 102039 - DNA, 22 bp, Artificial Sequence
  Synthetic oligonucleotide; TTC chr11 5332664 5332685 5332681 5332686 +
cccagagcctttggataagagc

SEQ ID NO: 102040 - DNA, 22 bp, Artificial Sequence
  Synthetic oligonucleotide; CTT chr11 5332675 5332696 5332692 5332697 +
tggataagagcccagccctccc

SEQ ID NO: 102041 - DNA, 22 bp, Artificial Sequence
  Synthetic oligonucleotide; TTT chr11 5332676 5332697 5332693 5332698 +
ggataagagcccagccctcccg

SEQ ID NO: 102042 - DNA, 22 bp, Artificial Sequence
  Synthetic oligonucleotide; TTG chr11 5332677 5332698 5332694 5332699 +
gataagagcccagccctcccga

SEQ ID NO: 102043 - DNA, 22 bp, Artificial Sequence
  Synthetic oligonucleotide; CTC chr11 5332695 5332716 5332712 5332717 +
ccgatattttgaatttgacctt

SEQ ID NO: 102044 - DNA, 22 bp, Artificial Sequence
  Synthetic oligonucleotide; TTT chr11 5332704 5332725 5332721 5332726 +
tgaatttgaccttatgataccc

SEQ ID NO: 102045 - DNA, 22 bp, Artificial Sequence
  Synthetic oligonucleotide; TTT chr11 5332705 5332726 5332722 5332727 +
gaatttgaccttatgataccct

SEQ ID NO: 102046 - DNA, 22 bp, Artificial Sequence
  Synthetic oligonucleotide; TTG chr11 5332706 5332727 5332723 5332728 +
aatttgaccttatgatacccta

SEQ ID NO: 102047 - DNA, 22 bp, Artificial Sequence
  Synthetic oligonucleotide; TTT chr11 5332711 5332732 5332728 5332733 +
gaccttatgataccctaagcag

SEQ ID NO: 102048 - DNA, 22 bp, Artificial Sequence
  Synthetic oligonucleotide; TTG chr11 5332712 5332733 5332729 5332734 +
accttatgataccctaagcaga

SEQ ID NO: 102049 - DNA, 22 bp, Artificial Sequence
  Synthetic oligonucleotide; CTT chr11 5332717 5332738 5332734 5332739 +
atgataccctaagcagagaact

SEQ ID NO: 102050 - DNA, 22 bp, Artificial Sequence
  Synthetic oligonucleotide; TTA chr11 5332718 5332739 5332735 5332740 +
tgataccctaagcagagaactc

SEQ ID NO: 102051 - DNA, 22 bp, Artificial Sequence
  Synthetic oligonucleotide; CTA chr11 5332728 5332749 5332745 5332750 +
agcagagaactcagttaagcct

SEQ ID NO: 102052 - DNA, 22 bp, Artificial Sequence
  Synthetic oligonucleotide; CTC chr11 5332740 5332761 5332757 5332762 +
agttaagcctatgagagtgcag

SEQ ID NO: 102053 - DNA, 22 bp, Artificial Sequence
  Synthetic oligonucleotide; TTA chr11 5332745 5332766 5332762 5332767 +
agcctatgagagtgcagaccta

SEQ ID NO: 102054 - DNA, 22 bp, Artificial Sequence
  Synthetic oligonucleotide; CTA chr11 5332751 5332772 5332768 5332773 +
tgagagtgcagacctatagaaa

SEQ ID NO: 102055 - DNA, 22 bp, Artificial Sequence
  Synthetic oligonucleotide; CTA chr11 5332767 5332788 5332784 5332789 +
tagaaatgtgatataataaact

SEQ ID NO: 102056 - DNA, 22 bp, Artificial Sequence
  Synthetic oligonucleotide; CTA chr11 5332790 5332811 5332807 5332812 +
ataatgtttgaagcagctcaag

SEQ ID NO: 102057 - DNA, 22 bp, Artificial Sequence
  Synthetic oligonucleotide; TTT chr11 5332799 5332820 5332816 5332821 +
gaagcagctcaagttgcagtaa

SEQ ID NO: 102058 - DNA, 22 bp, Artificial Sequence
  Synthetic oligonucleotide; TTG chr11 5332800 5332821 5332817 5332822 +
aagcagctcaagttgcagtaat

SEQ ID NO: 102059 - DNA, 22 bp, Artificial Sequence
  Synthetic oligonucleotide; CTC chr11 5332809 5332830 5332826 5332831 +
aagttgcagtaatttatgtata

SEQ ID NO: 102060 - DNA, 22 bp, Artificial Sequence
  Synthetic oligonucleotide; TTG chr11 5332815 5332836 5332832 5332837 +
cagtaatttatgtataacaata

SEQ ID NO: 102061 - DNA, 22 bp, Artificial Sequence
  Synthetic oligonucleotide; TTT chr11 5332824 5332845 5332841 5332846 +
atgtataacaatagaaaactaa

SEQ ID NO: 102062 - DNA, 22 bp, Artificial Sequence
  Synthetic oligonucleotide; TTA chr11 5332825 5332846 5332842 5332847 +
tgtataacaatagaaaactaat

SEQ ID NO: 102063 - DNA, 22 bp, Artificial Sequence
  Synthetic oligonucleotide; CTA chr11 5332845 5332866 5332862 5332867 +
atgcaaagtattactattatcc

SEQ ID NO: 102064 - DNA, 22 bp, Artificial Sequence
  Synthetic oligonucleotide; TTA chr11 5332858 5332879 5332875 5332880 +
ctattatccatattttattaag

SEQ ID NO: 102065 - DNA, 22 bp, Artificial Sequence
  Synthetic oligonucleotide; CTA chr11 5332861 5332882 5332878 5332883 +
ttatccatattttattaagagt

SEQ ID NO: 102066 - DNA, 22 bp, Artificial Sequence
  Synthetic oligonucleotide; TTA chr11 5332864 5332885 5332881 5332886 +
tccatattttattaagagttta

SEQ ID NO: 102067 - DNA, 22 bp, Artificial Sequence
  Synthetic oligonucleotide; TTT chr11 5332873 5332894 5332890 5332895 +
tattaagagtttatagagttct

SEQ ID NO: 102068 - DNA, 22 bp, Artificial Sequence
  Synthetic oligonucleotide; TTT chr11 5332874 5332895 5332891 5332896 +
attaagagtttatagagttcta

SEQ ID NO: 102069 - DNA, 22 bp, Artificial Sequence
  Synthetic oligonucleotide; TTA chr11 5332875 5332896 5332892 5332897 +
ttaagagtttatagagttctat

SEQ ID NO: 102070 - DNA, 22 bp, Artificial Sequence
  Synthetic oligonucleotide; TTA chr11 5332878 5332899 5332895 5332900 +
agagtttatagagttctataat

SEQ ID NO: 102071 - DNA, 22 bp, Artificial Sequence
  Synthetic oligonucleotide; TTT chr11 5332885 5332906 5332902 5332907 +
atagagttctataataaactaa

SEQ ID NO: 102072 - DNA, 22 bp, Artificial Sequence
  Synthetic oligonucleotide; TTA chr11 5332886 5332907 5332903 5332908 +
tagagttctataataaactaat

SEQ ID NO: 102073 - DNA, 22 bp, Artificial Sequence
  Synthetic oligonucleotide; TTC chr11 5332894 5332915 5332911 5332916 +
tataataaactaatatttacag

SEQ ID NO: 102074 - DNA, 22 bp, Artificial Sequence
  Synthetic oligonucleotide; CTA chr11 5332896 5332917 5332913 5332918 +
taataaactaatatttacaggg

SEQ ID NO: 102075 - DNA, 22 bp, Artificial Sequence
  Synthetic oligonucleotide; CTA chr11 5332906 5332927 5332923 5332928 +
atatttacagggtttatgtaaa

SEQ ID NO: 102076 - DNA, 22 bp, Artificial Sequence
  Synthetic oligonucleotide; TTT chr11 5332912 5332933 5332929 5332934 +
acagggtttatgtaaattattg

SEQ ID NO: 102077 - DNA, 22 bp, Artificial Sequence
  Synthetic oligonucleotide; TTA chr11 5332913 5332934 5332930 5332935 +
cagggtttatgtaaattattgt

SEQ ID NO: 102078 - DNA, 22 bp, Artificial Sequence
  Synthetic oligonucleotide; TTT chr11 5332921 5332942 5332938 5332943 +
atgtaaattattgtatcattta

SEQ ID NO: 102079 - DNA, 22 bp, Artificial Sequence
  Synthetic oligonucleotide; TTA chr11 5332922 5332943 5332939 5332944 +
tgtaaattattgtatcatttat

SEQ ID NO: 102080 - DNA, 22 bp, Artificial Sequence
  Synthetic oligonucleotide; TTA chr11 5332931 5332952 5332948 5332953 +
ttgtatcatttatctattatca

SEQ ID NO: 102081 - DNA, 22 bp, Artificial Sequence
  Synthetic oligonucleotide; TTG chr11 5332934 5332955 5332951 5332956 +
tatcatttatctattatcacag

SEQ ID NO: 102082 - DNA, 22 bp, Artificial Sequence
  Synthetic oligonucleotide; TTT chr11 5332942 5332963 5332959 5332964 +
atctattatcacagaattgtca

SEQ ID NO: 102083 - DNA, 22 bp, Artificial Sequence
  Synthetic oligonucleotide; TTA chr11 5332943 5332964 5332960 5332965 +
tctattatcacagaattgtcac

SEQ ID NO: 102084 - DNA, 22 bp, Artificial Sequence
  Synthetic oligonucleotide; CTA chr11 5332947 5332968 5332964 5332969 +
ttatcacagaattgtcacatca

SEQ ID NO: 102085 - DNA, 22 bp, Artificial Sequence
  Synthetic oligonucleotide; TTA chr11 5332950 5332971 5332967 5332972 +
tcacagaattgtcacatcacaa

SEQ ID NO: 102086 - DNA, 22 bp, Artificial Sequence
  Synthetic oligonucleotide; TTG chr11 5332961 5332982 5332978 5332983 +
tcacatcacaaagccctgtata

SEQ ID NO: 102087 - DNA, 22 bp, Artificial Sequence
  Synthetic oligonucleotide; CTG chr11 5332979 5333000 5332996 5333001 +
tatagcatcagtggctgacaac

SEQ ID NO: 102088 - DNA, 22 bp, Artificial Sequence
  Synthetic oligonucleotide; CTG chr11 5332996 5333017 5333013 5333018 +
acaacattaaacatttattttt

SEQ ID NO: 102089 - DNA, 22 bp, Artificial Sequence
  Synthetic oligonucleotide; TTA chr11 5333005 5333026 5333022 5333027 +
aacatttatttttcactctaat

SEQ ID NO: 102090 - DNA, 22 bp, Artificial Sequence
  Synthetic oligonucleotide; TTT chr11 5333012 5333033 5333029 5333034 +
atttttcactctaatgcatggt

SEQ ID NO: 102091 - DNA, 22 bp, Artificial Sequence
  Synthetic oligonucleotide; TTA chr11 5333013 5333034 5333030 5333035 +
tttttcactctaatgcatggtt

SEQ ID NO: 102092 - DNA, 22 bp, Artificial Sequence
  Synthetic oligonucleotide; TTT chr11 5333016 5333037 5333033 5333038 +
ttcactctaatgcatggttcaa

SEQ ID NO: 102093 - DNA, 22 bp, Artificial Sequence
  Synthetic oligonucleotide; TTT chr11 5333017 5333038 5333034 5333039 +
tcactctaatgcatggttcaac

SEQ ID NO: 102094 - DNA, 22 bp, Artificial Sequence
  Synthetic oligonucleotide; TTT chr11 5333018 5333039 5333035 5333040 +
cactctaatgcatggttcaact

SEQ ID NO: 102095 - DNA, 22 bp, Artificial Sequence
  Synthetic oligonucleotide; TTC chr11 5333019 5333040 5333036 5333041 +
actctaatgcatggttcaactt

SEQ ID NO: 102096 - DNA, 22 bp, Artificial Sequence
  Synthetic oligonucleotide; CTC chr11 5333023 5333044 5333040 5333045 +
taatgcatggttcaacttattt

SEQ ID NO: 102097 - DNA, 22 bp, Artificial Sequence
  Synthetic oligonucleotide; CTA chr11 5333025 5333046 5333042 5333047 +
atgcatggttcaacttatttag

SEQ ID NO: 102098 - DNA, 22 bp, Artificial Sequence
  Synthetic oligonucleotide; TTC chr11 5333036 5333057 5333053 5333058 +
aacttatttaggctgggcttgg

SEQ ID NO: 102099 - DNA, 22 bp, Artificial Sequence
  Synthetic oligonucleotide; CTT chr11 5333041 5333062 5333058 5333063 +
atttaggctgggcttggctggg

SEQ ID NO: 102100 - DNA, 22 bp, Artificial Sequence
  Synthetic oligonucleotide; TTA chr11 5333042 5333063 5333059 5333064 +
tttaggctgggcttggctgggc

SEQ ID NO: 102101 - DNA, 22 bp, Artificial Sequence
  Synthetic oligonucleotide; TTT chr11 5333045 5333066 5333062 5333067 +
aggctgggcttggctgggcagc

SEQ ID NO: 102102 - DNA, 22 bp, Artificial Sequence
  Synthetic oligonucleotide; TTA chr11 5333046 5333067 5333063 5333068 +
ggctgggcttggctgggcagca

SEQ ID NO: 102103 - DNA, 22 bp, Artificial Sequence
  Synthetic oligonucleotide; CTG chr11 5333051 5333072 5333068 5333073 +
ggcttggctgggcagcactgat

SEQ ID NO: 102104 - DNA, 22 bp, Artificial Sequence
  Synthetic oligonucleotide; CTT chr11 5333056 5333077 5333073 5333078 +
ggctgggcagcactgatcattt

SEQ ID NO: 102105 - DNA, 22 bp, Artificial Sequence
  Synthetic oligonucleotide; TTG chr11 5333057 5333078 5333074 5333079 +
gctgggcagcactgatcatttc

SEQ ID NO: 102106 - DNA, 22 bp, Artificial Sequence
  Synthetic oligonucleotide; CTG chr11 5333061 5333082 5333078 5333083 +
ggcagcactgatcatttctgca

SEQ ID NO: 102107 - DNA, 22 bp, Artificial Sequence
  Synthetic oligonucleotide; CTG chr11 5333071 5333092 5333088 5333093 +
atcatttctgcaccatctgctc

SEQ ID NO: 102108 - DNA, 22 bp, Artificial Sequence
  Synthetic oligonucleotide; TTT chr11 5333078 5333099 5333095 5333100 +
ctgcaccatctgctcaggtaca

SEQ ID NO: 102109 - DNA, 22 bp, Artificial Sequence
  Synthetic oligonucleotide; TTC chr11 5333079 5333100 5333096 5333101 +
tgcaccatctgctcaggtacat

SEQ ID NO: 102110 - DNA, 22 bp, Artificial Sequence
  Synthetic oligonucleotide; CTG chr11 5333081 5333102 5333098 5333103 +
caccatctgctcaggtacatag

SEQ ID NO: 102111 - DNA, 22 bp, Artificial Sequence
  Synthetic oligonucleotide; CTG chr11 5333090 5333111 5333107 5333112 +
ctcaggtacatagggtgcagct

SEQ ID NO: 102112 - DNA, 22 bp, Artificial Sequence
  Synthetic oligonucleotide; CTC chr11 5333093 5333114 5333110 5333115 +
aggtacatagggtgcagctgta

SEQ ID NO: 102113 - DNA, 22 bp, Artificial Sequence
  Synthetic oligonucleotide; CTG chr11 5333113 5333134 5333130 5333135 +
tacgtcatccctatcctattgt

SEQ ID NO: 102114 - DNA, 22 bp, Artificial Sequence
  Synthetic oligonucleotide; CTA chr11 5333126 5333147 5333143 5333148 +
tcctattgttttcctgtgtcgt

SEQ ID NO: 102115 - DNA, 22 bp, Artificial Sequence
  Synthetic oligonucleotide; CTA chr11 5333131 5333152 5333148 5333153 +
ttgttttcctgtgtcgttcttc

SEQ ID NO: 102116 - DNA, 22 bp, Artificial Sequence
  Synthetic oligonucleotide; TTG chr11 5333134 5333155 5333151 5333156 +
ttttcctgtgtcgttcttccta

SEQ ID NO: 102117 - DNA, 22 bp, Artificial Sequence
  Synthetic oligonucleotide; TTT chr11 5333137 5333158 5333154 5333159 +
tcctgtgtcgttcttcctatat

SEQ ID NO: 102118 - DNA, 22 bp, Artificial Sequence
  Synthetic oligonucleotide; TTT chr11 5333138 5333159 5333155 5333160 +
cctgtgtcgttcttcctatatc

SEQ ID NO: 102119 - DNA, 22 bp, Artificial Sequence
  Synthetic oligonucleotide; TTC chr11 5333139 5333160 5333156 5333161 +
ctgtgtcgttcttcctatatcc

SEQ ID NO: 102120 - DNA, 22 bp, Artificial Sequence
  Synthetic oligonucleotide; CTG chr11 5333142 5333163 5333159 5333164 +
tgtcgttcttcctatatccatc

SEQ ID NO: 102121 - DNA, 22 bp, Artificial Sequence
  Synthetic oligonucleotide; TTC chr11 5333150 5333171 5333167 5333172 +
ttcctatatccatcaccctttt

SEQ ID NO: 102122 - DNA, 22 bp, Artificial Sequence
  Synthetic oligonucleotide; CTT chr11 5333152 5333173 5333169 5333174 +
cctatatccatcacccttttgt

SEQ ID NO: 102123 - DNA, 22 bp, Artificial Sequence
  Synthetic oligonucleotide; TTC chr11 5333153 5333174 5333170 5333175 +
ctatatccatcacccttttgtt

SEQ ID NO: 102124 - DNA, 22 bp, Artificial Sequence
  Synthetic oligonucleotide; CTA chr11 5333156 5333177 5333173 5333178 +
tatccatcacccttttgttgta

SEQ ID NO: 102125 - DNA, 22 bp, Artificial Sequence
  Synthetic oligonucleotide; CTT chr11 5333170 5333191 5333187 5333192 +
ttgttgtatctatttctatatt

SEQ ID NO: 102126 - DNA, 22 bp, Artificial Sequence
  Synthetic oligonucleotide; TTT chr11 5333171 5333192 5333188 5333193 +
tgttgtatctatttctatattg

SEQ ID NO: 102127 - DNA, 22 bp, Artificial Sequence
  Synthetic oligonucleotide; TTT chr11 5333172 5333193 5333189 5333194 +
gttgtatctatttctatattgt

SEQ ID NO: 102128 - DNA, 22 bp, Artificial Sequence
  Synthetic oligonucleotide; TTG chr11 5333173 5333194 5333190 5333195 +
ttgtatctatttctatattgtc

SEQ ID NO: 102129 - DNA, 22 bp, Artificial Sequence
  Synthetic oligonucleotide; TTG chr11 5333176 5333197 5333193 5333198 +
tatctatttctatattgtctct

SEQ ID NO: 102130 - DNA, 22 bp, Artificial Sequence
  Synthetic oligonucleotide; CTA chr11 5333182 5333203 5333199 5333204 +
tttctatattgtctcttatttt

SEQ ID NO: 102131 - DNA, 22 bp, Artificial Sequence
  Synthetic oligonucleotide; TTT chr11 5333185 5333206 5333202 5333207 +
ctatattgtctcttattttgcc

SEQ ID NO: 102132 - DNA, 22 bp, Artificial Sequence
  Synthetic oligonucleotide; TTC chr11 5333186 5333207 5333203 5333208 +
tatattgtctcttattttgccc

SEQ ID NO: 102133 - DNA, 22 bp, Artificial Sequence
  Synthetic oligonucleotide; CTA chr11 5333188 5333209 5333205 5333210 +
tattgtctcttattttgccctc

SEQ ID NO: 102134 - DNA, 22 bp, Artificial Sequence
  Synthetic oligonucleotide; TTG chr11 5333193 5333214 5333210 5333215 +
tctcttattttgccctctctaa

SEQ ID NO: 102135 - DNA, 22 bp, Artificial Sequence
  Synthetic oligonucleotide; CTC chr11 5333197 5333218 5333214 5333219 +
ttattttgccctctctaactaa

SEQ ID NO: 102136 - DNA, 22 bp, Artificial Sequence
  Synthetic oligonucleotide; CTT chr11 5333199 5333220 5333216 5333221 +
attttgccctctctaactaaac

SEQ ID NO: 102137 - DNA, 22 bp, Artificial Sequence
  Synthetic oligonucleotide; TTA chr11 5333200 5333221 5333217 5333222 +
ttttgccctctctaactaaacc

SEQ ID NO: 102138 - DNA, 22 bp, Artificial Sequence
  Synthetic oligonucleotide; TTT chr11 5333203 5333224 5333220 5333225 +
tgccctctctaactaaacccca

SEQ ID NO: 102139 - DNA, 22 bp, Artificial Sequence
  Synthetic oligonucleotide; TTT chr11 5333204 5333225 5333221 5333226 +
gccctctctaactaaaccccag

SEQ ID NO: 102140 - DNA, 22 bp, Artificial Sequence
  Synthetic oligonucleotide; TTG chr11 5333205 5333226 5333222 5333227 +
ccctctctaactaaaccccaga

SEQ ID NO: 102141 - DNA, 22 bp, Artificial Sequence
  Synthetic oligonucleotide; CTC chr11 5333210 5333231 5333227 5333232 +
tctaactaaaccccagatgtct

SEQ ID NO: 102142 - DNA, 22 bp, Artificial Sequence
  Synthetic oligonucleotide; CTC chr11 5333212 5333233 5333229 5333234 +
taactaaaccccagatgtctct

SEQ ID NO: 102143 - DNA, 22 bp, Artificial Sequence
  Synthetic oligonucleotide; CTA chr11 5333214 5333235 5333231 5333236 +
actaaaccccagatgtctcttt

SEQ ID NO: 102144 - DNA, 22 bp, Artificial Sequence
  Synthetic oligonucleotide; CTA chr11 5333218 5333239 5333235 5333240 +
aaccccagatgtctcttttgca

SEQ ID NO: 102145 - DNA, 22 bp, Artificial Sequence
  Synthetic oligonucleotide; CTC chr11 5333233 5333254 5333250 5333255 +
ttttgcatcacccagactttag

SEQ ID NO: 102146 - DNA, 22 bp, Artificial Sequence
  Synthetic oligonucleotide; CTT chr11 5333235 5333256 5333252 5333257 +
ttgcatcacccagactttagca

SEQ ID NO: 102147 - DNA, 22 bp, Artificial Sequence
  Synthetic oligonucleotide; TTT chr11 5333236 5333257 5333253 5333258 +
tgcatcacccagactttagcat

SEQ ID NO: 102148 - DNA, 22 bp, Artificial Sequence
  Synthetic oligonucleotide; TTT chr11 5333237 5333258 5333254 5333259 +
gcatcacccagactttagcata

SEQ ID NO: 102149 - DNA, 22 bp, Artificial Sequence
  Synthetic oligonucleotide; TTG chr11 5333238 5333259 5333255 5333260 +
catcacccagactttagcataa

SEQ ID NO: 102150 - DNA, 22 bp, Artificial Sequence
  Synthetic oligonucleotide; CTT chr11 5333252 5333273 5333269 5333274 +
tagcataaaacttagcacaaaa

SEQ ID NO: 102151 - DNA, 22 bp, Artificial Sequence
  Synthetic oligonucleotide; TTT chr11 5333253 5333274 5333270 5333275 +
agcataaaacttagcacaaaat

SEQ ID NO: 102152 - DNA, 22 bp, Artificial Sequence
  Synthetic oligonucleotide; TTA chr11 5333254 5333275 5333271 5333276 +
gcataaaacttagcacaaaatt

SEQ ID NO: 102153 - DNA, 22 bp, Artificial Sequence
  Synthetic oligonucleotide; CTT chr11 5333265 5333286 5333282 5333287 +
agcacaaaatttttactgttta

SEQ ID NO: 102154 - DNA, 22 bp, Artificial Sequence
  Synthetic oligonucleotide; TTA chr11 5333266 5333287 5333283 5333288 +
gcacaaaatttttactgtttac

SEQ ID NO: 102155 - DNA, 22 bp, Artificial Sequence
  Synthetic oligonucleotide; TTT chr11 5333277 5333298 5333294 5333299 +
ttactgtttacattcttttact

SEQ ID NO: 102156 - DNA, 22 bp, Artificial Sequence
  Synthetic oligonucleotide; TTT chr11 5333278 5333299 5333295 5333300 +
tactgtttacattcttttacta

SEQ ID NO: 102157 - DNA, 22 bp, Artificial Sequence
  Synthetic oligonucleotide; TTT chr11 5333279 5333300 5333296 5333301 +
actgtttacattcttttactag

SEQ ID NO: 102158 - DNA, 22 bp, Artificial Sequence
  Synthetic oligonucleotide; TTA chr11 5333280 5333301 5333297 5333302 +
ctgtttacattcttttactagt

SEQ ID NO: 102159 - DNA, 22 bp, Artificial Sequence
  Synthetic oligonucleotide; CTG chr11 5333283 5333304 5333300 5333305 +
tttacattcttttactagtctc

SEQ ID NO: 102160 - DNA, 22 bp, Artificial Sequence
  Synthetic oligonucleotide; TTT chr11 5333286 5333307 5333303 5333308 +
acattcttttactagtctctca

SEQ ID NO: 102161 - DNA, 22 bp, Artificial Sequence
  Synthetic oligonucleotide; TTA chr11 5333287 5333308 5333304 5333309 +
cattcttttactagtctctcag

SEQ ID NO: 102162 - DNA, 22 bp, Artificial Sequence
  Synthetic oligonucleotide; TTC chr11 5333292 5333313 5333309 5333314 +
ttttactagtctctcagaccta

SEQ ID NO: 102163 - DNA, 22 bp, Artificial Sequence
  Synthetic oligonucleotide; CTT chr11 5333294 5333315 5333311 5333316 +
ttactagtctctcagacctagt

SEQ ID NO: 102164 - DNA, 22 bp, Artificial Sequence
  Synthetic oligonucleotide; TTT chr11 5333295 5333316 5333312 5333317 +
tactagtctctcagacctagtg

SEQ ID NO: 102165 - DNA, 22 bp, Artificial Sequence
  Synthetic oligonucleotide; TTT chr11 5333296 5333317 5333313 5333318 +
actagtctctcagacctagtgg

SEQ ID NO: 102166 - DNA, 22 bp, Artificial Sequence
  Synthetic oligonucleotide; TTA chr11 5333297 5333318 5333314 5333319 +
ctagtctctcagacctagtggc

SEQ ID NO: 102167 - DNA, 22 bp, Artificial Sequence
  Synthetic oligonucleotide; CTA chr11 5333300 5333321 5333317 5333322 +
gtctctcagacctagtggctct

SEQ ID NO: 102168 - DNA, 22 bp, Artificial Sequence
  Synthetic oligonucleotide; CTC chr11 5333305 5333326 5333322 5333327 +
tcagacctagtggctctaactc

SEQ ID NO: 102169 - DNA, 22 bp, Artificial Sequence
  Synthetic oligonucleotide; CTC chr11 5333307 5333328 5333324 5333329 +
agacctagtggctctaactcat

SEQ ID NO: 102170 - DNA, 22 bp, Artificial Sequence
  Synthetic oligonucleotide; CTA chr11 5333314 5333335 5333331 5333336 +
gtggctctaactcattgtagta

SEQ ID NO: 102171 - DNA, 22 bp, Artificial Sequence
  Synthetic oligonucleotide; CTC chr11 5333321 5333342 5333338 5333343 +
taactcattgtagtaaaaaaca

SEQ ID NO: 102172 - DNA, 22 bp, Artificial Sequence
  Synthetic oligonucleotide; CTA chr11 5333323 5333344 5333340 5333345 +
actcattgtagtaaaaaacacg

SEQ ID NO: 102173 - DNA, 22 bp, Artificial Sequence
  Synthetic oligonucleotide; CTC chr11 5333327 5333348 5333344 5333349 +
attgtagtaaaaaacacggttc

SEQ ID NO: 102174 - DNA, 22 bp, Artificial Sequence
  Synthetic oligonucleotide; TTG chr11 5333331 5333352 5333348 5333353 +
tagtaaaaaacacggttctact

SEQ ID NO: 102175 - DNA, 22 bp, Artificial Sequence
  Synthetic oligonucleotide; TTC chr11 5333349 5333370 5333366 5333371 +
tactcccactccaacactaaca

SEQ ID NO: 102176 - DNA, 22 bp, Artificial Sequence
  Synthetic oligonucleotide; CTA chr11 5333351 5333372 5333368 5333373 +
ctcccactccaacactaacatt

SEQ ID NO: 102177 - DNA, 22 bp, Artificial Sequence
  Synthetic oligonucleotide; CTC chr11 5333354 5333375 5333371 5333376 +
ccactccaacactaacattgct

SEQ ID NO: 102178 - DNA, 22 bp, Artificial Sequence
  Synthetic oligonucleotide; CTC chr11 5333360 5333381 5333377 5333382 +
caacactaacattgcttacttt

SEQ ID NO: 102179 - DNA, 22 bp, Artificial Sequence
  Synthetic oligonucleotide; CTA chr11 5333368 5333389 5333385 5333390 +
acattgcttactttactaagtg

SEQ ID NO: 102180 - DNA, 22 bp, Artificial Sequence
  Synthetic oligonucleotide; TTG chr11 5333374 5333395 5333391 5333396 +
cttactttactaagtgttgtat

SEQ ID NO: 102181 - DNA, 22 bp, Artificial Sequence
  Synthetic oligonucleotide; CTT chr11 5333377 5333398 5333394 5333399 +
actttactaagtgttgtattaa

SEQ ID NO: 102182 - DNA, 22 bp, Artificial Sequence
  Synthetic oligonucleotide; TTA chr11 5333378 5333399 5333395 5333400 +
ctttactaagtgttgtattaac

SEQ ID NO: 102183 - DNA, 22 bp, Artificial Sequence
  Synthetic oligonucleotide; CTT chr11 5333381 5333402 5333398 5333403 +
tactaagtgttgtattaacaca

SEQ ID NO: 102184 - DNA, 22 bp, Artificial Sequence
  Synthetic oligonucleotide; TTT chr11 5333382 5333403 5333399 5333404 +
actaagtgttgtattaacacac

SEQ ID NO: 102185 - DNA, 22 bp, Artificial Sequence
  Synthetic oligonucleotide; TTA chr11 5333383 5333404 5333400 5333405 +
ctaagtgttgtattaacacacc

SEQ ID NO: 102186 - DNA, 22 bp, Artificial Sequence
  Synthetic oligonucleotide; CTA chr11 5333386 5333407 5333403 5333408 +
agtgttgtattaacacaccaat

SEQ ID NO: 102187 - DNA, 22 bp, Artificial Sequence
  Synthetic oligonucleotide; TTG chr11 5333393 5333414 5333410 5333415 +
tattaacacaccaatggccctg

SEQ ID NO: 102188 - DNA, 22 bp, Artificial Sequence
  Synthetic oligonucleotide; TTA chr11 5333398 5333419 5333415 5333420 +
acacaccaatggccctggaagc

SEQ ID NO: 102189 - DNA, 22 bp, Artificial Sequence
  Synthetic oligonucleotide; CTG chr11 5333415 5333436 5333432 5333437 +
gaagcaatgacagagtttgaca

SEQ ID NO: 102190 - DNA, 22 bp, Artificial Sequence
  Synthetic oligonucleotide; TTT chr11 5333433 5333454 5333450 5333455 +
gacatattgattgtaaggttat

SEQ ID NO: 102191 - DNA, 22 bp, Artificial Sequence
  Synthetic oligonucleotide; TTG chr11 5333434 5333455 5333451 5333456 +
acatattgattgtaaggttatt

SEQ ID NO: 102192 - DNA, 22 bp, Artificial Sequence
  Synthetic oligonucleotide; TTG chr11 5333442 5333463 5333459 5333464 +
attgtaaggttatttataaaat

SEQ ID NO: 102193 - DNA, 22 bp, Artificial Sequence
  Synthetic oligonucleotide; TTG chr11 5333446 5333467 5333463 5333468 +
taaggttatttataaaatttta

SEQ ID NO: 102194 - DNA, 22 bp, Artificial Sequence
  Synthetic oligonucleotide; TTA chr11 5333454 5333475 5333471 5333476 +
tttataaaattttaattacttt

SEQ ID NO: 102195 - DNA, 22 bp, Artificial Sequence
  Synthetic oligonucleotide; TTT chr11 5333457 5333478 5333474 5333479 +
ataaaattttaattactttatg

SEQ ID NO: 102196 - DNA, 22 bp, Artificial Sequence
  Synthetic oligonucleotide; TTA chr11 5333458 5333479 5333475 5333480 +
taaaattttaattactttatga

SEQ ID NO: 102197 - DNA, 22 bp, Artificial Sequence
  Synthetic oligonucleotide; TTT chr11 5333466 5333487 5333483 5333488 +
taattactttatgattaacaca

SEQ ID NO: 102198 - DNA, 22 bp, Artificial Sequence
  Synthetic oligonucleotide; TTT chr11 5333467 5333488 5333484 5333489 +
aattactttatgattaacacat

SEQ ID NO: 102199 - DNA, 22 bp, Artificial Sequence
  Synthetic oligonucleotide; TTA chr11 5333468 5333489 5333485 5333490 +
attactttatgattaacacatt

SEQ ID NO: 102200 - DNA, 22 bp, Artificial Sequence
  Synthetic oligonucleotide; TTA chr11 5333472 5333493 5333489 5333494 +
ctttatgattaacacattgatc

SEQ ID NO: 102201 - DNA, 22 bp, Artificial Sequence
  Synthetic oligonucleotide; CTT chr11 5333475 5333496 5333492 5333497 +
tatgattaacacattgatcact

SEQ ID NO: 102202 - DNA, 22 bp, Artificial Sequence
  Synthetic oligonucleotide; TTT chr11 5333476 5333497 5333493 5333498 +
atgattaacacattgatcacta

SEQ ID NO: 102203 - DNA, 22 bp, Artificial Sequence
  Synthetic oligonucleotide; TTA chr11 5333477 5333498 5333494 5333499 +
tgattaacacattgatcactaa

SEQ ID NO: 102204 - DNA, 22 bp, Artificial Sequence
  Synthetic oligonucleotide; TTA chr11 5333483 5333504 5333500 5333505 +
acacattgatcactaactgact

SEQ ID NO: 102205 - DNA, 22 bp, Artificial Sequence
  Synthetic oligonucleotide; TTG chr11 5333491 5333512 5333508 5333513 +
atcactaactgactggtatgct

SEQ ID NO: 102206 - DNA, 22 bp, Artificial Sequence
  Synthetic oligonucleotide; CTA chr11 5333498 5333519 5333515 5333520 +
actgactggtatgctgattgtt

SEQ ID NO: 102207 - DNA, 22 bp, Artificial Sequence
  Synthetic oligonucleotide; CTG chr11 5333502 5333523 5333519 5333524 +
actggtatgctgattgttaaac

SEQ ID NO: 102208 - DNA, 22 bp, Artificial Sequence
  Synthetic oligonucleotide; CTG chr11 5333506 5333527 5333523 5333528 +
gtatgctgattgttaaactgac

SEQ ID NO: 102209 - DNA, 22 bp, Artificial Sequence
  Synthetic oligonucleotide; CTG chr11 5333514 5333535 5333531 5333536 +
attgttaaactgacttaggtaa

SEQ ID NO: 102210 - DNA, 22 bp, Artificial Sequence
  Synthetic oligonucleotide; TTG chr11 5333518 5333539 5333535 5333540 +
ttaaactgacttaggtaagaac

SEQ ID NO: 102211 - DNA, 22 bp, Artificial Sequence
  Synthetic oligonucleotide; TTA chr11 5333521 5333542 5333538 5333543 +
aactgacttaggtaagaacagt

SEQ ID NO: 102212 - DNA, 22 bp, Artificial Sequence
  Synthetic oligonucleotide; CTG chr11 5333526 5333547 5333543 5333548 +
acttaggtaagaacagtgactt

SEQ ID NO: 102213 - DNA, 22 bp, Artificial Sequence
  Synthetic oligonucleotide; CTT chr11 5333530 5333551 5333547 5333552 +
aggtaagaacagtgacttcaaa

SEQ ID NO: 102214 - DNA, 22 bp, Artificial Sequence
  Synthetic oligonucleotide; TTA chr11 5333531 5333552 5333548 5333553 +
ggtaagaacagtgacttcaaaa

SEQ ID NO: 102215 - DNA, 22 bp, Artificial Sequence
  Synthetic oligonucleotide; CTT chr11 5333548 5333569 5333565 5333570 +
caaaatattactaatatactaa

SEQ ID NO: 102216 - DNA, 22 bp, Artificial Sequence
  Synthetic oligonucleotide; TTC chr11 5333549 5333570 5333566 5333571 +
aaaatattactaatatactaat

SEQ ID NO: 102217 - DNA, 22 bp, Artificial Sequence
  Synthetic oligonucleotide; TTA chr11 5333558 5333579 5333575 5333580 +
ctaatatactaattggctaata

SEQ ID NO: 102218 - DNA, 22 bp, Artificial Sequence
  Synthetic oligonucleotide; CTA chr11 5333561 5333582 5333578 5333583 +
atatactaattggctaatatat

SEQ ID NO: 102219 - DNA, 22 bp, Artificial Sequence
  Synthetic oligonucleotide; CTA chr11 5333569 5333590 5333586 5333591 +
attggctaatatataagctgaa

SEQ ID NO: 102220 - DNA, 22 bp, Artificial Sequence
  Synthetic oligonucleotide; TTG chr11 5333573 5333594 5333590 5333595 +
gctaatatataagctgaaaatg

SEQ ID NO: 102221 - DNA, 22 bp, Artificial Sequence
  Synthetic oligonucleotide; CTA chr11 5333577 5333598 5333594 5333599 +
atatataagctgaaaatgtggg

SEQ ID NO: 102222 - DNA, 22 bp, Artificial Sequence
  Synthetic oligonucleotide; CTG chr11 5333589 5333610 5333606 5333611 +
aaaatgtgggagctacaaagta

SEQ ID NO: 102223 - DNA, 22 bp, Artificial Sequence
  Synthetic oligonucleotide; CTA chr11 5333604 5333625 5333621 5333626 +
caaagtagaggaggaagaaggc

SEQ ID NO: 102224 - DNA, 22 bp, Artificial Sequence
  Synthetic oligonucleotide; CTG chr11 5333665 5333686 5333682 5333687 +
agcctagagaactgcatcaaga

SEQ ID NO: 102225 - DNA, 22 bp, Artificial Sequence
  Synthetic oligonucleotide; CTA chr11 5333671 5333692 5333688 5333693 +
gagaactgcatcaagaggagga

SEQ ID NO: 102226 - DNA, 22 bp, Artificial Sequence
  Synthetic oligonucleotide; CTG chr11 5333679 5333700 5333696 5333701 +
catcaagaggaggaggagaggt

SEQ ID NO: 102227 - DNA, 22 bp, Artificial Sequence
  Synthetic oligonucleotide; CTA chr11 5333715 5333736 5333732 5333737 +
caggtgtcatggtgaccccacc

SEQ ID NO: 102228 - DNA, 22 bp, Artificial Sequence
  Synthetic oligonucleotide; CTG chr11 5333740 5333761 5333757 5333762 +
cacattcactcccagagtcagt

SEQ ID NO: 102229 - DNA, 22 bp, Artificial Sequence
  Synthetic oligonucleotide; TTC chr11 5333747 5333768 5333764 5333769 +
actcccagagtcagtctctttc

SEQ ID NO: 102230 - DNA, 22 bp, Artificial Sequence
  Synthetic oligonucleotide; CTC chr11 5333751 5333772 5333768 5333773 +
ccagagtcagtctctttcctct

SEQ ID NO: 102231 - DNA, 22 bp, Artificial Sequence
  Synthetic oligonucleotide; CTC chr11 5333765 5333786 5333782 5333787 +
tttcctctcctgcctcttccaa

SEQ ID NO: 102232 - DNA, 22 bp, Artificial Sequence
  Synthetic oligonucleotide; CTT chr11 5333767 5333788 5333784 5333789 +
tcctctcctgcctcttccaaag

SEQ ID NO: 102233 - DNA, 22 bp, Artificial Sequence
  Synthetic oligonucleotide; TTT chr11 5333768 5333789 5333785 5333790 +
cctctcctgcctcttccaaaga

SEQ ID NO: 102234 - DNA, 22 bp, Artificial Sequence
  Synthetic oligonucleotide; TTC chr11 5333769 5333790 5333786 5333791 +
ctctcctgcctcttccaaagaa

SEQ ID NO: 102235 - DNA, 22 bp, Artificial Sequence
  Synthetic oligonucleotide; CTC chr11 5333772 5333793 5333789 5333794 +
tcctgcctcttccaaagaaaat

SEQ ID NO: 102236 - DNA, 22 bp, Artificial Sequence
  Synthetic oligonucleotide; CTC chr11 5333774 5333795 5333791 5333796 +
ctgcctcttccaaagaaaattt

SEQ ID NO: 102237 - DNA, 22 bp, Artificial Sequence
  Synthetic oligonucleotide; CTG chr11 5333777 5333798 5333794 5333799 +
cctcttccaaagaaaatttcta

SEQ ID NO: 102238 - DNA, 22 bp, Artificial Sequence
  Synthetic oligonucleotide; CTC chr11 5333781 5333802 5333798 5333803 +
ttccaaagaaaatttctattgt

SEQ ID NO: 102239 - DNA, 22 bp, Artificial Sequence
  Synthetic oligonucleotide; CTT chr11 5333783 5333804 5333800 5333805 +
ccaaagaaaatttctattgtag

SEQ ID NO: 102240 - DNA, 22 bp, Artificial Sequence
  Synthetic oligonucleotide; TTC chr11 5333784 5333805 5333801 5333806 +
caaagaaaatttctattgtagg

SEQ ID NO: 102241 - DNA, 22 bp, Artificial Sequence
  Synthetic oligonucleotide; TTT chr11 5333796 5333817 5333813 5333818 +
ctattgtaggaaaagtgttctt

SEQ ID NO: 102242 - DNA, 22 bp, Artificial Sequence
  Synthetic oligonucleotide; TTC chr11 5333797 5333818 5333814 5333819 +
tattgtaggaaaagtgttctta

SEQ ID NO: 102243 - DNA, 22 bp, Artificial Sequence
  Synthetic oligonucleotide; CTA chr11 5333799 5333820 5333816 5333821 +
ttgtaggaaaagtgttcttaat

SEQ ID NO: 102244 - DNA, 22 bp, Artificial Sequence
  Synthetic oligonucleotide; TTG chr11 5333802 5333823 5333819 5333824 +
taggaaaagtgttcttaatagc

SEQ ID NO: 102245 - DNA, 22 bp, Artificial Sequence
  Synthetic oligonucleotide; TTC chr11 5333816 5333837 5333833 5333838 +
ttaatagcgctgagctaacaag

SEQ ID NO: 102246 - DNA, 22 bp, Artificial Sequence
  Synthetic oligonucleotide; CTT chr11 5333818 5333839 5333835 5333840 +
aatagcgctgagctaacaagaa

SEQ ID NO: 102247 - DNA, 22 bp, Artificial Sequence
  Synthetic oligonucleotide; TTA chr11 5333819 5333840 5333836 5333841 +
atagcgctgagctaacaagaac

SEQ ID NO: 102248 - DNA, 22 bp, Artificial Sequence
  Synthetic oligonucleotide; CTG chr11 5333828 5333849 5333845 5333850 +
agctaacaagaacttctagata

SEQ ID NO: 102249 - DNA, 22 bp, Artificial Sequence
  Synthetic oligonucleotide; CTA chr11 5333833 5333854 5333850 5333855 +
acaagaacttctagatatcaac

SEQ ID NO: 102250 - DNA, 22 bp, Artificial Sequence
  Synthetic oligonucleotide; CTT chr11 5333843 5333864 5333860 5333865 +
ctagatatcaactcagaactct

SEQ ID NO: 102251 - DNA, 22 bp, Artificial Sequence
  Synthetic oligonucleotide; TTC chr11 5333844 5333865 5333861 5333866 +
tagatatcaactcagaactctt

SEQ ID NO: 102252 - DNA, 22 bp, Artificial Sequence
  Synthetic oligonucleotide; CTA chr11 5333846 5333867 5333863 5333868 +
gatatcaactcagaactcttaa

SEQ ID NO: 102253 - DNA, 22 bp, Artificial Sequence
  Synthetic oligonucleotide; CTC chr11 5333857 5333878 5333874 5333879 +
agaactcttaattattcatgta

SEQ ID NO: 102254 - DNA, 22 bp, Artificial Sequence
  Synthetic oligonucleotide; CTC chr11 5333864 5333885 5333881 5333886 +
ttaattattcatgtaagcaccc

SEQ ID NO: 102255 - DNA, 22 bp, Artificial Sequence
  Synthetic oligonucleotide; CTT chr11 5333866 5333887 5333883 5333888 +
aattattcatgtaagcacccat

SEQ ID NO: 102256 - DNA, 22 bp, Artificial Sequence
  Synthetic oligonucleotide; TTA chr11 5333867 5333888 5333884 5333889 +
attattcatgtaagcacccatc

SEQ ID NO: 102257 - DNA, 22 bp, Artificial Sequence
  Synthetic oligonucleotide; TTA chr11 5333871 5333892 5333888 5333893 +
ttcatgtaagcacccatcacat

SEQ ID NO: 102258 - DNA, 22 bp, Artificial Sequence
  Synthetic oligonucleotide; TTC chr11 5333874 5333895 5333891 5333896 +
atgtaagcacccatcacataaa

SEQ ID NO: 102259 - DNA, 22 bp, Artificial Sequence
  Synthetic oligonucleotide; CTA chr11 5333900 5333921 5333917 5333922 +
ctgtttttatttcagagttaac

SEQ ID NO: 102260 - DNA, 22 bp, Artificial Sequence
  Synthetic oligonucleotide; CTG chr11 5333903 5333924 5333920 5333925 +
tttttatttcagagttaacatt

SEQ ID NO: 102261 - DNA, 22 bp, Artificial Sequence
  Synthetic oligonucleotide; TTT chr11 5333906 5333927 5333923 5333928 +
ttatttcagagttaacatttgc

SEQ ID NO: 102262 - DNA, 22 bp, Artificial Sequence
  Synthetic oligonucleotide; TTT chr11 5333907 5333928 5333924 5333929 +
tatttcagagttaacatttgct

SEQ ID NO: 102263 - DNA, 22 bp, Artificial Sequence
  Synthetic oligonucleotide; TTT chr11 5333908 5333929 5333925 5333930 +
atttcagagttaacatttgcta

SEQ ID NO: 102264 - DNA, 22 bp, Artificial Sequence
  Synthetic oligonucleotide; TTA chr11 5333909 5333930 5333926 5333931 +
tttcagagttaacatttgctag

SEQ ID NO: 102265 - DNA, 22 bp, Artificial Sequence
  Synthetic oligonucleotide; TTT chr11 5333912 5333933 5333929 5333934 +
cagagttaacatttgctaggaa

SEQ ID NO: 102266 - DNA, 22 bp, Artificial Sequence
  Synthetic oligonucleotide; TTC chr11 5333913 5333934 5333930 5333935 +
agagttaacatttgctaggaag

SEQ ID NO: 102267 - DNA, 22 bp, Artificial Sequence
  Synthetic oligonucleotide; TTA chr11 5333920 5333941 5333937 5333942 +
acatttgctaggaagttgaact

SEQ ID NO: 102268 - DNA, 22 bp, Artificial Sequence
  Synthetic oligonucleotide; TTT chr11 5333926 5333947 5333943 5333948 +
gctaggaagttgaacttttatg

SEQ ID NO: 102269 - DNA, 22 bp, Artificial Sequence
  Synthetic oligonucleotide; TTG chr11 5333927 5333948 5333944 5333949 +
ctaggaagttgaacttttatgt

SEQ ID NO: 102270 - DNA, 22 bp, Artificial Sequence
  Synthetic oligonucleotide; CTA chr11 5333930 5333951 5333947 5333952 +
ggaagttgaacttttatgttgg

SEQ ID NO: 102271 - DNA, 22 bp, Artificial Sequence
  Synthetic oligonucleotide; TTG chr11 5333938 5333959 5333955 5333960 +
aacttttatgttggaggttgat

SEQ ID NO: 102272 - DNA, 22 bp, Artificial Sequence
  Synthetic oligonucleotide; CTT chr11 5333943 5333964 5333960 5333965 +
ttatgttggaggttgatacacc

SEQ ID NO: 102273 - DNA, 22 bp, Artificial Sequence
  Synthetic oligonucleotide; TTT chr11 5333944 5333965 5333961 5333966 +
tatgttggaggttgatacaccc

SEQ ID NO: 102274 - DNA, 22 bp, Artificial Sequence
  Synthetic oligonucleotide; TTT chr11 5333945 5333966 5333962 5333967 +
atgttggaggttgatacacccg

SEQ ID NO: 102275 - DNA, 22 bp, Artificial Sequence
  Synthetic oligonucleotide; TTA chr11 5333946 5333967 5333963 5333968 +
tgttggaggttgatacacccgg

SEQ ID NO: 102276 - DNA, 22 bp, Artificial Sequence
  Synthetic oligonucleotide; TTG chr11 5333951 5333972 5333968 5333973 +
gaggttgatacacccggcagaa

SEQ ID NO: 102277 - DNA, 22 bp, Artificial Sequence
  Synthetic oligonucleotide; TTG chr11 5333958 5333979 5333975 5333980 +
atacacccggcagaatctgtag

SEQ ID NO: 102278 - DNA, 22 bp, Artificial Sequence
  Synthetic oligonucleotide; CTG chr11 5333977 5333998 5333994 5333999 +
tagatacagatatcttgcctct

SEQ ID NO: 102279 - DNA, 22 bp, Artificial Sequence
  Synthetic oligonucleotide; CTT chr11 5333993 5334014 5334010 5334015 +
gcctcttttctctatttaccct

SEQ ID NO: 102280 - DNA, 22 bp, Artificial Sequence
  Synthetic oligonucleotide; TTG chr11 5333994 5334015 5334011 5334016 +
cctcttttctctatttaccctc

SEQ ID NO: 102281 - DNA, 22 bp, Artificial Sequence
  Synthetic oligonucleotide; CTC chr11 5333998 5334019 5334015 5334020 +
ttttctctatttaccctcttgc

SEQ ID NO: 102282 - DNA, 22 bp, Artificial Sequence
  Synthetic oligonucleotide; CTT chr11 5334000 5334021 5334017 5334022 +
ttctctatttaccctcttgcaa

SEQ ID NO: 102283 - DNA, 22 bp, Artificial Sequence
  Synthetic oligonucleotide; TTT chr11 5334001 5334022 5334018 5334023 +
tctctatttaccctcttgcaac

SEQ ID NO: 102284 - DNA, 22 bp, Artificial Sequence
  Synthetic oligonucleotide; TTT chr11 5334002 5334023 5334019 5334024 +
ctctatttaccctcttgcaaca

SEQ ID NO: 102285 - DNA, 22 bp, Artificial Sequence
  Synthetic oligonucleotide; TTC chr11 5334003 5334024 5334020 5334025 +
tctatttaccctcttgcaacaa

SEQ ID NO: 102286 - DNA, 22 bp, Artificial Sequence
  Synthetic oligonucleotide; CTC chr11 5334005 5334026 5334022 5334027 +
tatttaccctcttgcaacaact

SEQ ID NO: 102287 - DNA, 22 bp, Artificial Sequence
  Synthetic oligonucleotide; CTA chr11 5334007 5334028 5334024 5334029 +
tttaccctcttgcaacaactat

SEQ ID NO: 102288 - DNA, 22 bp, Artificial Sequence
  Synthetic oligonucleotide; TTT chr11 5334010 5334031 5334027 5334032 +
accctcttgcaacaactatgtg

SEQ ID NO: 102289 - DNA, 22 bp, Artificial Sequence
  Synthetic oligonucleotide; TTA chr11 5334011 5334032 5334028 5334033 +
ccctcttgcaacaactatgtgg

SEQ ID NO: 102290 - DNA, 22 bp, Artificial Sequence
  Synthetic oligonucleotide; CTC chr11 5334016 5334037 5334033 5334038 +
ttgcaacaactatgtggtggaa

SEQ ID NO: 102291 - DNA, 22 bp, Artificial Sequence
  Synthetic oligonucleotide; CTT chr11 5334018 5334039 5334035 5334040 +
gcaacaactatgtggtggaaga

SEQ ID NO: 102292 - DNA, 22 bp, Artificial Sequence
  Synthetic oligonucleotide; TTG chr11 5334019 5334040 5334036 5334041 +
caacaactatgtggtggaagag

SEQ ID NO: 102293 - DNA, 22 bp, Artificial Sequence
  Synthetic oligonucleotide; CTA chr11 5334028 5334049 5334045 5334050 +
tgtggtggaagagaatccaaga

SEQ ID NO: 102294 - DNA, 22 bp, Artificial Sequence
  Synthetic oligonucleotide; TTA chr11 5334056 5334077 5334073 5334078 +
gtctttattttcctctcaatta

SEQ ID NO: 102295 - DNA, 22 bp, Artificial Sequence
  Synthetic oligonucleotide; CTT chr11 5334061 5334082 5334078 5334083 +
tattttcctctcaattaccttc

SEQ ID NO: 102296 - DNA, 22 bp, Artificial Sequence
  Synthetic oligonucleotide; TTT chr11 5334062 5334083 5334079 5334084 +
attttcctctcaattaccttca

SEQ ID NO: 102297 - DNA, 22 bp, Artificial Sequence
  Synthetic oligonucleotide; TTA chr11 5334063 5334084 5334080 5334085 +
ttttcctctcaattaccttcat

SEQ ID NO: 102298 - DNA, 22 bp, Artificial Sequence
  Synthetic oligonucleotide; TTT chr11 5334066 5334087 5334083 5334088 +
tcctctcaattaccttcattcc

SEQ ID NO: 102299 - DNA, 22 bp, Artificial Sequence
  Synthetic oligonucleotide; TTT chr11 5334067 5334088 5334084 5334089 +
cctctcaattaccttcattcca

SEQ ID NO: 102300 - DNA, 22 bp, Artificial Sequence
  Synthetic oligonucleotide; TTC chr11 5334068 5334089 5334085 5334090 +
ctctcaattaccttcattccat

SEQ ID NO: 102301 - DNA, 22 bp, Artificial Sequence
  Synthetic oligonucleotide; CTC chr11 5334071 5334092 5334088 5334093 +
tcaattaccttcattccattct

SEQ ID NO: 102302 - DNA, 22 bp, Artificial Sequence
  Synthetic oligonucleotide; CTC chr11 5334073 5334094 5334090 5334095 +
aattaccttcattccattctcc

SEQ ID NO: 102303 - DNA, 22 bp, Artificial Sequence
  Synthetic oligonucleotide; TTA chr11 5334078 5334099 5334095 5334100 +
ccttcattccattctcccatag

SEQ ID NO: 102304 - DNA, 22 bp, Artificial Sequence
  Synthetic oligonucleotide; CTT chr11 5334082 5334103 5334099 5334104 +
cattccattctcccatagtcac

SEQ ID NO: 102305 - DNA, 22 bp, Artificial Sequence
  Synthetic oligonucleotide; TTC chr11 5334083 5334104 5334100 5334105 +
attccattctcccatagtcact

SEQ ID NO: 102306 - DNA, 22 bp, Artificial Sequence
  Synthetic oligonucleotide; TTC chr11 5334087 5334108 5334104 5334109 +
cattctcccatagtcactagag

SEQ ID NO: 102307 - DNA, 22 bp, Artificial Sequence
  Synthetic oligonucleotide; TTC chr11 5334092 5334113 5334109 5334114 +
tcccatagtcactagagcctga

SEQ ID NO: 102308 - DNA, 22 bp, Artificial Sequence
  Synthetic oligonucleotide; CTC chr11 5334094 5334115 5334111 5334116 +
ccatagtcactagagcctgacc

SEQ ID NO: 102309 - DNA, 22 bp, Artificial Sequence
  Synthetic oligonucleotide; CTA chr11 5334106 5334127 5334123 5334128 +
gagcctgacctggggtatcaga

SEQ ID NO: 102310 - DNA, 22 bp, Artificial Sequence
  Synthetic oligonucleotide; CTG chr11 5334113 5334134 5334130 5334135 +
acctggggtatcagaaattaag

SEQ ID NO: 102311 - DNA, 22 bp, Artificial Sequence
  Synthetic oligonucleotide; CTG chr11 5334118 5334139 5334135 5334140 +
gggtatcagaaattaaggggag

SEQ ID NO: 102312 - DNA, 22 bp, Artificial Sequence
  Synthetic oligonucleotide; TTA chr11 5334133 5334154 5334150 5334155 +
aggggagaggtaattgctgagt

SEQ ID NO: 102313 - DNA, 22 bp, Artificial Sequence
  Synthetic oligonucleotide; TTG chr11 5334149 5334170 5334166 5334171 +
ctgagtcctggtgtagaaattg

SEQ ID NO: 102314 - DNA, 22 bp, Artificial Sequence
  Synthetic oligonucleotide; CTG chr11 5334152 5334173 5334169 5334174 +
agtcctggtgtagaaattggtt

SEQ ID NO: 102315 - DNA, 22 bp, Artificial Sequence
  Synthetic oligonucleotide; CTG chr11 5334159 5334180 5334176 5334181 +
gtgtagaaattggtttaaatgg

SEQ ID NO: 102316 - DNA, 22 bp, Artificial Sequence
  Synthetic oligonucleotide; TTG chr11 5334171 5334192 5334188 5334193 +
gtttaaatggtatctctgaaga

SEQ ID NO: 102317 - DNA, 22 bp, Artificial Sequence
  Synthetic oligonucleotide; TTT chr11 5334175 5334196 5334192 5334197 +
aaatggtatctctgaagactgc

SEQ ID NO: 102318 - DNA, 22 bp, Artificial Sequence
  Synthetic oligonucleotide; TTA chr11 5334176 5334197 5334193 5334198 +
aatggtatctctgaagactgct

SEQ ID NO: 102319 - DNA, 22 bp, Artificial Sequence
  Synthetic oligonucleotide; CTC chr11 5334187 5334208 5334204 5334209 +
tgaagactgctaacagggttaa

SEQ ID NO: 102320 - DNA, 22 bp, Artificial Sequence
  Synthetic oligonucleotide; CTG chr11 5334189 5334210 5334206 5334211 +
aagactgctaacagggttaatt

SEQ ID NO: 102321 - DNA, 22 bp, Artificial Sequence
  Synthetic oligonucleotide; CTG chr11 5334196 5334217 5334213 5334218 +
ctaacagggttaatttgtgagg

SEQ ID NO: 102322 - DNA, 22 bp, Artificial Sequence
  Synthetic oligonucleotide; CTA chr11 5334199 5334220 5334216 5334221 +
acagggttaatttgtgaggtta

SEQ ID NO: 102323 - DNA, 22 bp, Artificial Sequence
  Synthetic oligonucleotide; TTA chr11 5334208 5334229 5334225 5334230 +
atttgtgaggttatttgtattc

SEQ ID NO: 102324 - DNA, 22 bp, Artificial Sequence
  Synthetic oligonucleotide; TTT chr11 5334212 5334233 5334229 5334234 +
gtgaggttatttgtattcaaaa

SEQ ID NO: 102325 - DNA, 22 bp, Artificial Sequence
  Synthetic oligonucleotide; TTG chr11 5334213 5334234 5334230 5334235 +
tgaggttatttgtattcaaaat

SEQ ID NO: 102326 - DNA, 22 bp, Artificial Sequence
  Synthetic oligonucleotide; TTA chr11 5334221 5334242 5334238 5334243 +
tttgtattcaaaattgttcccc

SEQ ID NO: 102327 - DNA, 22 bp, Artificial Sequence
  Synthetic oligonucleotide; TTT chr11 5334224 5334245 5334241 5334246 +
gtattcaaaattgttccccagt

SEQ ID NO: 102328 - DNA, 22 bp, Artificial Sequence
  Synthetic oligonucleotide; TTG chr11 5334225 5334246 5334242 5334247 +
tattcaaaattgttccccagta

SEQ ID NO: 102329 - DNA, 22 bp, Artificial Sequence
  Synthetic oligonucleotide; TTC chr11 5334230 5334251 5334247 5334252 +
aaaattgttccccagtatctgt

SEQ ID NO: 102330 - DNA, 22 bp, Artificial Sequence
  Synthetic oligonucleotide; TTG chr11 5334237 5334258 5334254 5334259 +
ttccccagtatctgtcttgatg

SEQ ID NO: 102331 - DNA, 22 bp, Artificial Sequence
  Synthetic oligonucleotide; TTC chr11 5334240 5334261 5334257 5334262 +
cccagtatctgtcttgatgctg

SEQ ID NO: 102332 - DNA, 22 bp, Artificial Sequence
  Synthetic oligonucleotide; CTG chr11 5334251 5334272 5334268 5334273 +
tcttgatgctggataattaggc

SEQ ID NO: 102333 - DNA, 22 bp, Artificial Sequence
  Synthetic oligonucleotide; CTT chr11 5334255 5334276 5334272 5334277 +
gatgctggataattaggctact

SEQ ID NO: 102334 - DNA, 22 bp, Artificial Sequence
  Synthetic oligonucleotide; TTG chr11 5334256 5334277 5334273 5334278 +
atgctggataattaggctactg

SEQ ID NO: 102335 - DNA, 22 bp, Artificial Sequence
  Synthetic oligonucleotide; CTG chr11 5334262 5334283 5334279 5334284 +
gataattaggctactgggatat

SEQ ID NO: 102336 - DNA, 22 bp, Artificial Sequence
  Synthetic oligonucleotide; TTA chr11 5334270 5334291 5334287 5334292 +
ggctactgggatattttttttc

SEQ ID NO: 102337 - DNA, 22 bp, Artificial Sequence
  Synthetic oligonucleotide; CTA chr11 5334275 5334296 5334292 5334297 +
ctgggatattttttttcaagcc

SEQ ID NO: 102338 - DNA, 22 bp, Artificial Sequence
  Synthetic oligonucleotide; CTG chr11 5334278 5334299 5334295 5334300 +
ggatattttttttcaagcctcc

SEQ ID NO: 102339 - DNA, 22 bp, Artificial Sequence
  Synthetic oligonucleotide; TTT chr11 5334286 5334307 5334303 5334308 +
tttttcaagcctcctttggaga

SEQ ID NO: 102340 - DNA, 22 bp, Artificial Sequence
  Synthetic oligonucleotide; TTT chr11 5334287 5334308 5334304 5334309 +
ttttcaagcctcctttggagaa

SEQ ID NO: 102341 - DNA, 22 bp, Artificial Sequence
  Synthetic oligonucleotide; TTT chr11 5334288 5334309 5334305 5334310 +
tttcaagcctcctttggagaag

SEQ ID NO: 102342 - DNA, 22 bp, Artificial Sequence
  Synthetic oligonucleotide; TTT chr11 5334289 5334310 5334306 5334311 +
ttcaagcctcctttggagaagg

SEQ ID NO: 102343 - DNA, 22 bp, Artificial Sequence
  Synthetic oligonucleotide; TTT chr11 5334290 5334311 5334307 5334312 +
tcaagcctcctttggagaagga

SEQ ID NO: 102344 - DNA, 22 bp, Artificial Sequence
  Synthetic oligonucleotide; TTT chr11 5334291 5334312 5334308 5334313 +
caagcctcctttggagaaggaa

SEQ ID NO: 102345 - DNA, 22 bp, Artificial Sequence
  Synthetic oligonucleotide; TTC chr11 5334292 5334313 5334309 5334314 +
aagcctcctttggagaaggaag

SEQ ID NO: 102346 - DNA, 22 bp, Artificial Sequence
  Synthetic oligonucleotide; CTC chr11 5334299 5334320 5334316 5334321 +
ctttggagaaggaagtgggctc

SEQ ID NO: 102347 - DNA, 22 bp, Artificial Sequence
  Synthetic oligonucleotide; CTT chr11 5334302 5334323 5334319 5334324 +
tggagaaggaagtgggctccag

SEQ ID NO: 102348 - DNA, 22 bp, Artificial Sequence
  Synthetic oligonucleotide; TTT chr11 5334303 5334324 5334320 5334325 +
ggagaaggaagtgggctccaga

SEQ ID NO: 102349 - DNA, 22 bp, Artificial Sequence
  Synthetic oligonucleotide; TTG chr11 5334304 5334325 5334321 5334326 +
gagaaggaagtgggctccagaa

SEQ ID NO: 102350 - DNA, 22 bp, Artificial Sequence
  Synthetic oligonucleotide; CTC chr11 5334321 5334342 5334338 5334343 +
cagaactgtgttcttaaagccc

SEQ ID NO: 102351 - DNA, 22 bp, Artificial Sequence
  Synthetic oligonucleotide; CTG chr11 5334329 5334350 5334346 5334351 +
tgttcttaaagccccatatttt

SEQ ID NO: 102352 - DNA, 22 bp, Artificial Sequence
  Synthetic oligonucleotide; TTC chr11 5334334 5334355 5334351 5334356 +
ttaaagccccatattttctttg

SEQ ID NO: 102353 - DNA, 22 bp, Artificial Sequence
  Synthetic oligonucleotide; CTT chr11 5334336 5334357 5334353 5334358 +
aaagccccatattttctttgca

SEQ ID NO: 102354 - DNA, 22 bp, Artificial Sequence
  Synthetic oligonucleotide; TTA chr11 5334337 5334358 5334354 5334359 +
aagccccatattttctttgcaa

SEQ ID NO: 102355 - DNA, 22 bp, Artificial Sequence
  Synthetic oligonucleotide; TTT chr11 5334350 5334371 5334367 5334372 +
tctttgcaaaaagaaaacagaa

SEQ ID NO: 102356 - DNA, 22 bp, Artificial Sequence
  Synthetic oligonucleotide; TTT chr11 5334351 5334372 5334368 5334373 +
ctttgcaaaaagaaaacagaat

SEQ ID NO: 102357 - DNA, 22 bp, Artificial Sequence
  Synthetic oligonucleotide; TTC chr11 5334352 5334373 5334369 5334374 +
tttgcaaaaagaaaacagaatt

SEQ ID NO: 102358 - DNA, 22 bp, Artificial Sequence
  Synthetic oligonucleotide; CTT chr11 5334354 5334375 5334371 5334376 +
tgcaaaaagaaaacagaattgt

SEQ ID NO: 102359 - DNA, 22 bp, Artificial Sequence
  Synthetic oligonucleotide; TTT chr11 5334355 5334376 5334372 5334377 +
gcaaaaagaaaacagaattgta

SEQ ID NO: 102360 - DNA, 22 bp, Artificial Sequence
  Synthetic oligonucleotide; TTG chr11 5334356 5334377 5334373 5334378 +
caaaaagaaaacagaattgtag

SEQ ID NO: 102361 - DNA, 22 bp, Artificial Sequence
  Synthetic oligonucleotide; TTG chr11 5334375 5334396 5334392 5334397 +
tagcttcatccagcacatggaa

SEQ ID NO: 102362 - DNA, 22 bp, Artificial Sequence
  Synthetic oligonucleotide; CTT chr11 5334381 5334402 5334398 5334403 +
catccagcacatggaagtcatg

SEQ ID NO: 102363 - DNA, 22 bp, Artificial Sequence
  Synthetic oligonucleotide; TTC chr11 5334382 5334403 5334399 5334404 +
atccagcacatggaagtcatgc

SEQ ID NO: 102364 - DNA, 22 bp, Artificial Sequence
  Synthetic oligonucleotide; CTA chr11 5334406 5334427 5334423 5334428 +
tctaactacctttgccttgtat

SEQ ID NO: 102365 - DNA, 22 bp, Artificial Sequence
  Synthetic oligonucleotide; CTA chr11 5334410 5334431 5334427 5334432 +
actacctttgccttgtatgatt

SEQ ID NO: 102366 - DNA, 22 bp, Artificial Sequence
  Synthetic oligonucleotide; CTA chr11 5334414 5334435 5334431 5334436 +
cctttgccttgtatgattcccc

SEQ ID NO: 102367 - DNA, 22 bp, Artificial Sequence
  Synthetic oligonucleotide; CTT chr11 5334418 5334439 5334435 5334440 +
tgccttgtatgattccccacct

SEQ ID NO: 102368 - DNA, 22 bp, Artificial Sequence
  Synthetic oligonucleotide; TTT chr11 5334419 5334440 5334436 5334441 +
gccttgtatgattccccacctc

SEQ ID NO: 102369 - DNA, 22 bp, Artificial Sequence
  Synthetic oligonucleotide; TTG chr11 5334420 5334441 5334437 5334442 +
ccttgtatgattccccacctca

SEQ ID NO: 102370 - DNA, 22 bp, Artificial Sequence
  Synthetic oligonucleotide; CTT chr11 5334424 5334445 5334441 5334446 +
gtatgattccccacctcaaaaa

SEQ ID NO: 102371 - DNA, 22 bp, Artificial Sequence
  Synthetic oligonucleotide; TTG chr11 5334425 5334446 5334442 5334447 +
tatgattccccacctcaaaaag

SEQ ID NO: 102372 - DNA, 22 bp, Artificial Sequence
  Synthetic oligonucleotide; TTC chr11 5334433 5334454 5334450 5334455 +
cccacctcaaaaagaagatacc

SEQ ID NO: 102373 - DNA, 22 bp, Artificial Sequence
  Synthetic oligonucleotide; CTC chr11 5334441 5334462 5334458 5334463 +
aaaaagaagataccgtgaagcc

SEQ ID NO: 102374 - DNA, 22 bp, Artificial Sequence
  Synthetic oligonucleotide; CTA chr11 5334465 5334486 5334482 5334487 +
cttttgttattccttaaccctg

SEQ ID NO: 102375 - DNA, 22 bp, Artificial Sequence
  Synthetic oligonucleotide; CTT chr11 5334468 5334489 5334485 5334490 +
ttgttattccttaaccctgtag

SEQ ID NO: 102376 - DNA, 22 bp, Artificial Sequence
  Synthetic oligonucleotide; TTT chr11 5334469 5334490 5334486 5334491 +
tgttattccttaaccctgtagc

SEQ ID NO: 102377 - DNA, 22 bp, Artificial Sequence
  Synthetic oligonucleotide; TTT chr11 5334470 5334491 5334487 5334492 +
gttattccttaaccctgtagcc

SEQ ID NO: 102378 - DNA, 22 bp, Artificial Sequence
  Synthetic oligonucleotide; TTG chr11 5334471 5334492 5334488 5334493 +
ttattccttaaccctgtagcca

SEQ ID NO: 102379 - DNA, 22 bp, Artificial Sequence
  Synthetic oligonucleotide; TTA chr11 5334474 5334495 5334491 5334496 +
ttccttaaccctgtagccaata

SEQ ID NO: 102380 - DNA, 22 bp, Artificial Sequence
  Synthetic oligonucleotide; TTC chr11 5334477 5334498 5334494 5334499 +
cttaaccctgtagccaataagc

SEQ ID NO: 102381 - DNA, 22 bp, Artificial Sequence
  Synthetic oligonucleotide; CTT chr11 5334480 5334501 5334497 5334502 +
aaccctgtagccaataagctca

SEQ ID NO: 102382 - DNA, 22 bp, Artificial Sequence
  Synthetic oligonucleotide; TTA chr11 5334481 5334502 5334498 5334503 +
accctgtagccaataagctcac

SEQ ID NO: 102383 - DNA, 22 bp, Artificial Sequence
  Synthetic oligonucleotide; CTG chr11 5334487 5334508 5334504 5334509 +
tagccaataagctcactcaact

SEQ ID NO: 102384 - DNA, 22 bp, Artificial Sequence
  Synthetic oligonucleotide; CTC chr11 5334501 5334522 5334518 5334523 +
actcaacttagacaaagcttaa

SEQ ID NO: 102385 - DNA, 22 bp, Artificial Sequence
  Synthetic oligonucleotide; CTC chr11 5334505 5334526 5334522 5334527 +
aacttagacaaagcttaataat

SEQ ID NO: 102386 - DNA, 22 bp, Artificial Sequence
  Synthetic oligonucleotide; CTT chr11 5334510 5334531 5334527 5334532 +
agacaaagcttaataatccctc

SEQ ID NO: 102387 - DNA, 22 bp, Artificial Sequence
  Synthetic oligonucleotide; TTA chr11 5334511 5334532 5334528 5334533 +
gacaaagcttaataatccctca

SEQ ID NO: 102388 - DNA, 22 bp, Artificial Sequence
  Synthetic oligonucleotide; CTT chr11 5334521 5334542 5334538 5334543 +
aataatccctcacacttaatct

SEQ ID NO: 102389 - DNA, 22 bp, Artificial Sequence
  Synthetic oligonucleotide; TTA chr11 5334522 5334543 5334539 5334544 +
ataatccctcacacttaatctt

SEQ ID NO: 102390 - DNA, 22 bp, Artificial Sequence
  Synthetic oligonucleotide; CTC chr11 5334532 5334553 5334549 5334554 +
acacttaatcttttcttggttt

SEQ ID NO: 102391 - DNA, 22 bp, Artificial Sequence
  Synthetic oligonucleotide; CTT chr11 5334538 5334559 5334555 5334560 +
aatcttttcttggtttcaaata

SEQ ID NO: 102392 - DNA, 22 bp, Artificial Sequence
  Synthetic oligonucleotide; TTA chr11 5334539 5334560 5334556 5334561 +
atcttttcttggtttcaaataa

SEQ ID NO: 102393 - DNA, 22 bp, Artificial Sequence
  Synthetic oligonucleotide; CTT chr11 5334544 5334565 5334561 5334566 +
ttcttggtttcaaataagattg

SEQ ID NO: 102394 - DNA, 22 bp, Artificial Sequence
  Synthetic oligonucleotide; TTT chr11 5334545 5334566 5334562 5334567 +
tcttggtttcaaataagattgt

SEQ ID NO: 102395 - DNA, 22 bp, Artificial Sequence
  Synthetic oligonucleotide; TTT chr11 5334546 5334567 5334563 5334568 +
cttggtttcaaataagattgtt

SEQ ID NO: 102396 - DNA, 22 bp, Artificial Sequence
  Synthetic oligonucleotide; TTC chr11 5334547 5334568 5334564 5334569 +
ttggtttcaaataagattgttt

SEQ ID NO: 102397 - DNA, 22 bp, Artificial Sequence
  Synthetic oligonucleotide; CTT chr11 5334549 5334570 5334566 5334571 +
ggtttcaaataagattgtttgt

SEQ ID NO: 102398 - DNA, 22 bp, Artificial Sequence
  Synthetic oligonucleotide; TTG chr11 5334550 5334571 5334567 5334572 +
gtttcaaataagattgtttgtt

SEQ ID NO: 102399 - DNA, 22 bp, Artificial Sequence
  Synthetic oligonucleotide; TTT chr11 5334554 5334575 5334571 5334576 +
caaataagattgtttgttatat

SEQ ID NO: 102400 - DNA, 22 bp, Artificial Sequence
  Synthetic oligonucleotide; TTC chr11 5334555 5334576 5334572 5334577 +
aaataagattgtttgttatata

SEQ ID NO: 102401 - DNA, 22 bp, Artificial Sequence
  Synthetic oligonucleotide; TTG chr11 5334566 5334587 5334583 5334588 +
tttgttatatatactcacaaat

SEQ ID NO: 102402 - DNA, 22 bp, Artificial Sequence
  Synthetic oligonucleotide; TTT chr11 5334569 5334590 5334586 5334591 +
gttatatatactcacaaatgag

SEQ ID NO: 102403 - DNA, 22 bp, Artificial Sequence
  Synthetic oligonucleotide; TTG chr11 5334570 5334591 5334587 5334592 +
ttatatatactcacaaatgagt

SEQ ID NO: 102404 - DNA, 22 bp, Artificial Sequence
  Synthetic oligonucleotide; TTA chr11 5334573 5334594 5334590 5334595 +
tatatactcacaaatgagtgct

SEQ ID NO: 102405 - DNA, 22 bp, Artificial Sequence
  Synthetic oligonucleotide; CTC chr11 5334582 5334603 5334599 5334604 +
acaaatgagtgctgctgataag

SEQ ID NO: 102406 - DNA, 22 bp, Artificial Sequence
  Synthetic oligonucleotide; CTG chr11 5334596 5334617 5334613 5334618 +
ctgataagttctttcaaacagt

SEQ ID NO: 102407 - DNA, 22 bp, Artificial Sequence
  Synthetic oligonucleotide; CTG chr11 5334599 5334620 5334616 5334621 +
ataagttctttcaaacagtaag

SEQ ID NO: 102408 - DNA, 22 bp, Artificial Sequence
  Synthetic oligonucleotide; TTC chr11 5334607 5334628 5334624 5334629 +
tttcaaacagtaagcttgtttt

SEQ ID NO: 102409 - DNA, 22 bp, Artificial Sequence
  Synthetic oligonucleotide; CTT chr11 5334609 5334630 5334626 5334631 +
tcaaacagtaagcttgttttct

SEQ ID NO: 102410 - DNA, 22 bp, Artificial Sequence
  Synthetic oligonucleotide; TTT chr11 5334610 5334631 5334627 5334632 +
caaacagtaagcttgttttctg

SEQ ID NO: 102411 - DNA, 22 bp, Artificial Sequence
  Synthetic oligonucleotide; TTC chr11 5334611 5334632 5334628 5334633 +
aaacagtaagcttgttttctgt

SEQ ID NO: 102412 - DNA, 22 bp, Artificial Sequence
  Synthetic oligonucleotide; CTT chr11 5334624 5334645 5334641 5334646 +
gttttctgtctcttggtaagtc

SEQ ID NO: 102413 - DNA, 22 bp, Artificial Sequence
  Synthetic oligonucleotide; TTG chr11 5334625 5334646 5334642 5334647 +
ttttctgtctcttggtaagtct

SEQ ID NO: 102414 - DNA, 22 bp, Artificial Sequence
  Synthetic oligonucleotide; TTT chr11 5334628 5334649 5334645 5334650 +
tctgtctcttggtaagtcttgc

SEQ ID NO: 102415 - DNA, 22 bp, Artificial Sequence
  Synthetic oligonucleotide; TTT chr11 5334629 5334650 5334646 5334651 +
ctgtctcttggtaagtcttgcc

SEQ ID NO: 102416 - DNA, 22 bp, Artificial Sequence
  Synthetic oligonucleotide; TTC chr11 5334630 5334651 5334647 5334652 +
tgtctcttggtaagtcttgccc

SEQ ID NO: 102417 - DNA, 22 bp, Artificial Sequence
  Synthetic oligonucleotide; CTG chr11 5334632 5334653 5334649 5334654 +
tctcttggtaagtcttgcccaa

SEQ ID NO: 102418 - DNA, 22 bp, Artificial Sequence
  Synthetic oligonucleotide; CTC chr11 5334636 5334657 5334653 5334658 +
ttggtaagtcttgcccaagaat

SEQ ID NO: 102419 - DNA, 22 bp, Artificial Sequence
  Synthetic oligonucleotide; CTT chr11 5334638 5334659 5334655 5334660 +
ggtaagtcttgcccaagaatca

SEQ ID NO: 102420 - DNA, 22 bp, Artificial Sequence
  Synthetic oligonucleotide; TTG chr11 5334639 5334660 5334656 5334661 +
gtaagtcttgcccaagaatcag

SEQ ID NO: 102421 - DNA, 22 bp, Artificial Sequence
  Synthetic oligonucleotide; CTT chr11 5334648 5334669 5334665 5334670 +
gcccaagaatcagagttactgc

SEQ ID NO: 102422 - DNA, 22 bp, Artificial Sequence
  Synthetic oligonucleotide; TTG chr11 5334649 5334670 5334666 5334671 +
cccaagaatcagagttactgct

SEQ ID NO: 102423 - DNA, 22 bp, Artificial Sequence
  Synthetic oligonucleotide; TTA chr11 5334666 5334687 5334683 5334688 +
ctgcttctggagcaatataaat

SEQ ID NO: 102424 - DNA, 22 bp, Artificial Sequence
  Synthetic oligonucleotide; CTG chr11 5334669 5334690 5334686 5334691 +
cttctggagcaatataaatcaa

SEQ ID NO: 102425 - DNA, 22 bp, Artificial Sequence
  Synthetic oligonucleotide; CTT chr11 5334672 5334693 5334689 5334694 +
ctggagcaatataaatcaagtt

SEQ ID NO: 102426 - DNA, 22 bp, Artificial Sequence
  Synthetic oligonucleotide; TTC chr11 5334673 5334694 5334690 5334695 +
tggagcaatataaatcaagttt

SEQ ID NO: 102427 - DNA, 22 bp, Artificial Sequence
  Synthetic oligonucleotide; CTG chr11 5334675 5334696 5334692 5334697 +
gagcaatataaatcaagtttaa

SEQ ID NO: 102428 - DNA, 22 bp, Artificial Sequence
  Synthetic oligonucleotide; TTT chr11 5334695 5334716 5334712 5334717 +
aaaaaattttatttaagtgtcc

SEQ ID NO: 102429 - DNA, 22 bp, Artificial Sequence
  Synthetic oligonucleotide; TTA chr11 5334696 5334717 5334713 5334718 +
aaaaattttatttaagtgtcct

SEQ ID NO: 102430 - DNA, 22 bp, Artificial Sequence
  Synthetic oligonucleotide; TTT chr11 5334704 5334725 5334721 5334726 +
tatttaagtgtcctgtagtaat

SEQ ID NO: 102431 - DNA, 22 bp, Artificial Sequence
  Synthetic oligonucleotide; TTT chr11 5334705 5334726 5334722 5334727 +
atttaagtgtcctgtagtaatg

SEQ ID NO: 102432 - DNA, 22 bp, Artificial Sequence
  Synthetic oligonucleotide; TTA chr11 5334706 5334727 5334723 5334728 +
tttaagtgtcctgtagtaatgt

SEQ ID NO: 102433 - DNA, 22 bp, Artificial Sequence
  Synthetic oligonucleotide; TTT chr11 5334709 5334730 5334726 5334731 +
aagtgtcctgtagtaatgttaa

SEQ ID NO: 102434 - DNA, 22 bp, Artificial Sequence
  Synthetic oligonucleotide; TTA chr11 5334710 5334731 5334727 5334732 +
agtgtcctgtagtaatgttaaa

SEQ ID NO: 102435 - DNA, 22 bp, Artificial Sequence
  Synthetic oligonucleotide; CTG chr11 5334719 5334740 5334736 5334741 +
tagtaatgttaaaaaggggaca

SEQ ID NO: 102436 - DNA, 22 bp, Artificial Sequence
  Synthetic oligonucleotide; TTA chr11 5334730 5334751 5334747 5334752 +
aaaaggggacatggtggaggta

SEQ ID NO: 102437 - DNA, 22 bp, Artificial Sequence
  Synthetic oligonucleotide; TTC chr11 5334755 5334776 5334772 5334777 +
tttaatccctggctttgtctga

SEQ ID NO: 102438 - DNA, 22 bp, Artificial Sequence
  Synthetic oligonucleotide; CTT chr11 5334757 5334778 5334774 5334779 +
taatccctggctttgtctgaca

SEQ ID NO: 102439 - DNA, 22 bp, Artificial Sequence
  Synthetic oligonucleotide; TTT chr11 5334758 5334779 5334775 5334780 +
aatccctggctttgtctgacaa

SEQ ID NO: 102440 - DNA, 22 bp, Artificial Sequence
  Synthetic oligonucleotide; TTA chr11 5334759 5334780 5334776 5334781 +
atccctggctttgtctgacaat

SEQ ID NO: 102441 - DNA, 22 bp, Artificial Sequence
  Synthetic oligonucleotide; CTG chr11 5334766 5334787 5334783 5334788 +
gctttgtctgacaatttgtact

SEQ ID NO: 102442 - DNA, 22 bp, Artificial Sequence
  Synthetic oligonucleotide; CTT chr11 5334770 5334791 5334787 5334792 +
tgtctgacaatttgtacttgaa

SEQ ID NO: 102443 - DNA, 22 bp, Artificial Sequence
  Synthetic oligonucleotide; TTT chr11 5334771 5334792 5334788 5334793 +
gtctgacaatttgtacttgaat

SEQ ID NO: 102444 - DNA, 22 bp, Artificial Sequence
  Synthetic oligonucleotide; TTG chr11 5334772 5334793 5334789 5334794 +
tctgacaatttgtacttgaata

SEQ ID NO: 102445 - DNA, 22 bp, Artificial Sequence
  Synthetic oligonucleotide; CTG chr11 5334776 5334797 5334793 5334798 +
acaatttgtacttgaatacaat

SEQ ID NO: 102446 - DNA, 22 bp, Artificial Sequence
  Synthetic oligonucleotide; TTT chr11 5334783 5334804 5334800 5334805 +
gtacttgaatacaatcatctca

SEQ ID NO: 102447 - DNA, 22 bp, Artificial Sequence
  Synthetic oligonucleotide; TTG chr11 5334784 5334805 5334801 5334806 +
tacttgaatacaatcatctcat

SEQ ID NO: 102448 - DNA, 22 bp, Artificial Sequence
  Synthetic oligonucleotide; CTT chr11 5334789 5334810 5334806 5334811 +
gaatacaatcatctcatagtct

SEQ ID NO: 102449 - DNA, 22 bp, Artificial Sequence
  Synthetic oligonucleotide; TTG chr11 5334790 5334811 5334807 5334812 +
aatacaatcatctcatagtctg

SEQ ID NO: 102450 - DNA, 22 bp, Artificial Sequence
  Synthetic oligonucleotide; CTC chr11 5334804 5334825 5334821 5334826 +
atagtctgtcagagaaataagg

SEQ ID NO: 102451 - DNA, 22 bp, Artificial Sequence
  Synthetic oligonucleotide; CTG chr11 5334812 5334833 5334829 5334834 +
tcagagaaataaggatctgaga

SEQ ID NO: 102452 - DNA, 22 bp, Artificial Sequence
  Synthetic oligonucleotide; CTG chr11 5334831 5334852 5334848 5334853 +
agaatttctattgtctcatcag

SEQ ID NO: 102453 - DNA, 22 bp, Artificial Sequence
  Synthetic oligonucleotide; TTT chr11 5334838 5334859 5334855 5334860 +
ctattgtctcatcagtcttaaa

SEQ ID NO: 102454 - DNA, 22 bp, Artificial Sequence
  Synthetic oligonucleotide; TTC chr11 5334839 5334860 5334856 5334861 +
tattgtctcatcagtcttaaat

SEQ ID NO: 102455 - DNA, 22 bp, Artificial Sequence
  Synthetic oligonucleotide; CTA chr11 5334841 5334862 5334858 5334863 +
ttgtctcatcagtcttaaatcc

SEQ ID NO: 102456 - DNA, 22 bp, Artificial Sequence
  Synthetic oligonucleotide; TTG chr11 5334844 5334865 5334861 5334866 +
tctcatcagtcttaaatcctaa

SEQ ID NO: 102457 - DNA, 22 bp, Artificial Sequence
  Synthetic oligonucleotide; CTC chr11 5334848 5334869 5334865 5334870 +
atcagtcttaaatcctaaattt

SEQ ID NO: 102458 - DNA, 22 bp, Artificial Sequence
  Synthetic oligonucleotide; CTT chr11 5334857 5334878 5334874 5334879 +
aaatcctaaatttatcctggaa

SEQ ID NO: 102459 - DNA, 22 bp, Artificial Sequence
  Synthetic oligonucleotide; TTA chr11 5334858 5334879 5334875 5334880 +
aatcctaaatttatcctggaac

SEQ ID NO: 102460 - DNA, 22 bp, Artificial Sequence
  Synthetic oligonucleotide; CTA chr11 5334865 5334886 5334882 5334887 +
aatttatcctggaacttagccc

SEQ ID NO: 102461 - DNA, 22 bp, Artificial Sequence
  Synthetic oligonucleotide; TTT chr11 5334870 5334891 5334887 5334892 +
atcctggaacttagcccaacta

SEQ ID NO: 102462 - DNA, 22 bp, Artificial Sequence
  Synthetic oligonucleotide; TTA chr11 5334871 5334892 5334888 5334893 +
tcctggaacttagcccaactat

SEQ ID NO: 102463 - DNA, 22 bp, Artificial Sequence
  Synthetic oligonucleotide; CTG chr11 5334876 5334897 5334893 5334898 +
gaacttagcccaactatgagat

SEQ ID NO: 102464 - DNA, 22 bp, Artificial Sequence
  Synthetic oligonucleotide; CTT chr11 5334882 5334903 5334899 5334904 +
agcccaactatgagattttaaa

SEQ ID NO: 102465 - DNA, 22 bp, Artificial Sequence
  Synthetic oligonucleotide; TTA chr11 5334883 5334904 5334900 5334905 +
gcccaactatgagattttaaaa

SEQ ID NO: 102466 - DNA, 22 bp, Artificial Sequence
  Synthetic oligonucleotide; CTA chr11 5334892 5334913 5334909 5334914 +
tgagattttaaaatgagtatgg

SEQ ID NO: 102467 - DNA, 22 bp, Artificial Sequence
  Synthetic oligonucleotide; TTT chr11 5334900 5334921 5334917 5334922 +
taaaatgagtatgggtgcaatg

SEQ ID NO: 102468 - DNA, 22 bp, Artificial Sequence
  Synthetic oligonucleotide; TTT chr11 5334901 5334922 5334918 5334923 +
aaaatgagtatgggtgcaatgt

SEQ ID NO: 102469 - DNA, 22 bp, Artificial Sequence
  Synthetic oligonucleotide; TTA chr11 5334902 5334923 5334919 5334924 +
aaatgagtatgggtgcaatgtg

SEQ ID NO: 102470 - DNA, 22 bp, Artificial Sequence
  Synthetic oligonucleotide; TTT chr11 5334946 5334967 5334963 5334968 +
tggtgcctgacatttcacatca

SEQ ID NO: 102471 - DNA, 22 bp, Artificial Sequence
  Synthetic oligonucleotide; TTT chr11 5334947 5334968 5334964 5334969 +
ggtgcctgacatttcacatcag

SEQ ID NO: 102472 - DNA, 22 bp, Artificial Sequence
  Synthetic oligonucleotide; TTG chr11 5334948 5334969 5334965 5334970 +
gtgcctgacatttcacatcagt

SEQ ID NO: 102473 - DNA, 22 bp, Artificial Sequence
  Synthetic oligonucleotide; CTG chr11 5334955 5334976 5334972 5334977 +
acatttcacatcagttaagttc

SEQ ID NO: 102474 - DNA, 22 bp, Artificial Sequence
  Synthetic oligonucleotide; TTT chr11 5334961 5334982 5334978 5334983 +
cacatcagttaagttcctcctg

SEQ ID NO: 102475 - DNA, 22 bp, Artificial Sequence
  Synthetic oligonucleotide; TTC chr11 5334962 5334983 5334979 5334984 +
acatcagttaagttcctcctga

SEQ ID NO: 102476 - DNA, 22 bp, Artificial Sequence
  Synthetic oligonucleotide; TTA chr11 5334972 5334993 5334989 5334994 +
agttcctcctgaactgcattct

SEQ ID NO: 102477 - DNA, 22 bp, Artificial Sequence
  Synthetic oligonucleotide; TTC chr11 5334977 5334998 5334994 5334999 +
ctcctgaactgcattctgctca

SEQ ID NO: 102478 - DNA, 22 bp, Artificial Sequence
  Synthetic oligonucleotide; CTC chr11 5334980 5335001 5334997 5335002 +
ctgaactgcattctgctcatag

SEQ ID NO: 102479 - DNA, 22 bp, Artificial Sequence
  Synthetic oligonucleotide; CTG chr11 5334983 5335004 5335000 5335005 +
aactgcattctgctcataggtc

SEQ ID NO: 102480 - DNA, 22 bp, Artificial Sequence
  Synthetic oligonucleotide; CTG chr11 5334988 5335009 5335005 5335010 +
cattctgctcataggtcttcct

SEQ ID NO: 102481 - DNA, 22 bp, Artificial Sequence
  Synthetic oligonucleotide; TTC chr11 5334993 5335014 5335010 5335015 +
tgctcataggtcttcctaaatg

SEQ ID NO: 102482 - DNA, 22 bp, Artificial Sequence
  Synthetic oligonucleotide; CTG chr11 5334995 5335016 5335012 5335017 +
ctcataggtcttcctaaatgta

SEQ ID NO: 102483 - DNA, 22 bp, Artificial Sequence
  Synthetic oligonucleotide; CTC chr11 5334998 5335019 5335015 5335020 +
ataggtcttcctaaatgtaagc

SEQ ID NO: 102484 - DNA, 22 bp, Artificial Sequence
  Synthetic oligonucleotide; CTT chr11 5335007 5335028 5335024 5335029 +
cctaaatgtaagcagaatagta

SEQ ID NO: 102485 - DNA, 22 bp, Artificial Sequence
  Synthetic oligonucleotide; TTC chr11 5335008 5335029 5335025 5335030 +
ctaaatgtaagcagaatagtag

SEQ ID NO: 102486 - DNA, 22 bp, Artificial Sequence
  Synthetic oligonucleotide; CTA chr11 5335011 5335032 5335028 5335033 +
aatgtaagcagaatagtagtag

SEQ ID NO: 102487 - DNA, 22 bp, Artificial Sequence
  Synthetic oligonucleotide; TTA chr11 5335046 5335067 5335063 5335068 +
aaagtcagtctctggaaatggc

SEQ ID NO: 102488 - DNA, 22 bp, Artificial Sequence
  Synthetic oligonucleotide; CTC chr11 5335058 5335079 5335075 5335080 +
tggaaatggcttaagtctgaaa

SEQ ID NO: 102489 - DNA, 22 bp, Artificial Sequence
  Synthetic oligonucleotide; CTG chr11 5335060 5335081 5335077 5335082 +
gaaatggcttaagtctgaaaat

SEQ ID NO: 102490 - DNA, 22 bp, Artificial Sequence
  Synthetic oligonucleotide; CTT chr11 5335070 5335091 5335087 5335092 +
aagtctgaaaatttgtgtgtcc

SEQ ID NO: 102491 - DNA, 22 bp, Artificial Sequence
  Synthetic oligonucleotide; TTA chr11 5335071 5335092 5335088 5335093 +
agtctgaaaatttgtgtgtcct

SEQ ID NO: 102492 - DNA, 22 bp, Artificial Sequence
  Synthetic oligonucleotide; CTG chr11 5335077 5335098 5335094 5335099 +
aaaatttgtgtgtcctctttgt

SEQ ID NO: 102493 - DNA, 22 bp, Artificial Sequence
  Synthetic oligonucleotide; TTT chr11 5335084 5335105 5335101 5335106 +
gtgtgtcctctttgtactaagt

SEQ ID NO: 102494 - DNA, 22 bp, Artificial Sequence
  Synthetic oligonucleotide; TTG chr11 5335085 5335106 5335102 5335107 +
tgtgtcctctttgtactaagtt

SEQ ID NO: 102495 - DNA, 22 bp, Artificial Sequence
  Synthetic oligonucleotide; CTC chr11 5335094 5335115 5335111 5335116 +
tttgtactaagttaaaatttag

SEQ ID NO: 102496 - DNA, 22 bp, Artificial Sequence
  Synthetic oligonucleotide; CTT chr11 5335096 5335117 5335113 5335118 +
tgtactaagttaaaatttaggt

SEQ ID NO: 102497 - DNA, 22 bp, Artificial Sequence
  Synthetic oligonucleotide; TTT chr11 5335097 5335118 5335114 5335119 +
gtactaagttaaaatttaggtc

SEQ ID NO: 102498 - DNA, 22 bp, Artificial Sequence
  Synthetic oligonucleotide; TTG chr11 5335098 5335119 5335115 5335120 +
tactaagttaaaatttaggtct

SEQ ID NO: 102499 - DNA, 22 bp, Artificial Sequence
  Synthetic oligonucleotide; CTA chr11 5335103 5335124 5335120 5335125 +
agttaaaatttaggtctggatt

SEQ ID NO: 102500 - DNA, 22 bp, Artificial Sequence
  Synthetic oligonucleotide; TTA chr11 5335108 5335129 5335125 5335130 +
aaatttaggtctggattgattt

SEQ ID NO: 102501 - DNA, 22 bp, Artificial Sequence
  Synthetic oligonucleotide; TTT chr11 5335114 5335135 5335131 5335136 +
aggtctggattgatttagggga

SEQ ID NO: 102502 - DNA, 22 bp, Artificial Sequence
  Synthetic oligonucleotide; TTA chr11 5335115 5335136 5335132 5335137 +
ggtctggattgatttaggggag

SEQ ID NO: 102503 - DNA, 22 bp, Artificial Sequence
  Synthetic oligonucleotide; CTG chr11 5335121 5335142 5335138 5335143 +
gattgatttaggggagccatgc

SEQ ID NO: 102504 - DNA, 22 bp, Artificial Sequence
  Synthetic oligonucleotide; TTG chr11 5335126 5335147 5335143 5335148 +
atttaggggagccatgctttga

SEQ ID NO: 102505 - DNA, 22 bp, Artificial Sequence
  Synthetic oligonucleotide; TTT chr11 5335130 5335151 5335147 5335152 +
aggggagccatgctttgaactt

SEQ ID NO: 102506 - DNA, 22 bp, Artificial Sequence
  Synthetic oligonucleotide; TTA chr11 5335131 5335152 5335148 5335153 +
ggggagccatgctttgaactta

SEQ ID NO: 102507 - DNA, 22 bp, Artificial Sequence
  Synthetic oligonucleotide; CTT chr11 5335145 5335166 5335162 5335167 +
tgaacttaaaatgaggtgaggt

SEQ ID NO: 102508 - DNA, 22 bp, Artificial Sequence
  Synthetic oligonucleotide; TTT chr11 5335146 5335167 5335163 5335168 +
gaacttaaaatgaggtgaggta

SEQ ID NO: 102509 - DNA, 22 bp, Artificial Sequence
  Synthetic oligonucleotide; TTG chr11 5335147 5335168 5335164 5335169 +
aacttaaaatgaggtgaggtag

SEQ ID NO: 102510 - DNA, 22 bp, Artificial Sequence
  Synthetic oligonucleotide; CTT chr11 5335152 5335173 5335169 5335174 +
aaaatgaggtgaggtagtaaga

SEQ ID NO: 102511 - DNA, 22 bp, Artificial Sequence
  Synthetic oligonucleotide; TTA chr11 5335153 5335174 5335170 5335175 +
aaatgaggtgaggtagtaagac

SEQ ID NO: 102512 - DNA, 22 bp, Artificial Sequence
  Synthetic oligonucleotide; CTG chr11 5335179 5335200 5335196 5335201 +
agataactgatttaatttcagg

SEQ ID NO: 102513 - DNA, 22 bp, Artificial Sequence
  Synthetic oligonucleotide; CTG chr11 5335188 5335209 5335205 5335210 +
atttaatttcaggctgccctcc

SEQ ID NO: 102514 - DNA, 22 bp, Artificial Sequence
  Synthetic oligonucleotide; TTT chr11 5335192 5335213 5335209 5335214 +
aatttcaggctgccctcccatt

SEQ ID NO: 102515 - DNA, 22 bp, Artificial Sequence
  Synthetic oligonucleotide; TTA chr11 5335193 5335214 5335210 5335215 +
atttcaggctgccctcccattt

SEQ ID NO: 102516 - DNA, 22 bp, Artificial Sequence
  Synthetic oligonucleotide; TTT chr11 5335197 5335218 5335214 5335219 +
caggctgccctcccatttcatt

SEQ ID NO: 102517 - DNA, 22 bp, Artificial Sequence
  Synthetic oligonucleotide; TTC chr11 5335198 5335219 5335215 5335220 +
aggctgccctcccatttcatta

SEQ ID NO: 102518 - DNA, 22 bp, Artificial Sequence
  Synthetic oligonucleotide; CTG chr11 5335204 5335225 5335221 5335226 +
ccctcccatttcattagtaggt

SEQ ID NO: 102519 - DNA, 22 bp, Artificial Sequence
  Synthetic oligonucleotide; CTC chr11 5335209 5335230 5335226 5335231 +
ccatttcattagtaggtatatt

SEQ ID NO: 102520 - DNA, 22 bp, Artificial Sequence
  Synthetic oligonucleotide; TTT chr11 5335215 5335236 5335232 5335237 +
cattagtaggtatattgaccct

SEQ ID NO: 102521 - DNA, 22 bp, Artificial Sequence
  Synthetic oligonucleotide; TTC chr11 5335216 5335237 5335233 5335238 +
attagtaggtatattgaccctc

SEQ ID NO: 102522 - DNA, 22 bp, Artificial Sequence
  Synthetic oligonucleotide; TTA chr11 5335220 5335241 5335237 5335242 +
gtaggtatattgaccctctcac

SEQ ID NO: 102523 - DNA, 22 bp, Artificial Sequence
  Synthetic oligonucleotide; TTG chr11 5335232 5335253 5335249 5335254 +
accctctcactggcagtacacg

SEQ ID NO: 102524 - DNA, 22 bp, Artificial Sequence
  Synthetic oligonucleotide; CTC chr11 5335238 5335259 5335255 5335260 +
tcactggcagtacacgaatctt

SEQ ID NO: 102525 - DNA, 22 bp, Artificial Sequence
  Synthetic oligonucleotide; CTC chr11 5335240 5335261 5335257 5335262 +
actggcagtacacgaatcttct

SEQ ID NO: 102526 - DNA, 22 bp, Artificial Sequence
  Synthetic oligonucleotide; CTG chr11 5335244 5335265 5335261 5335266 +
gcagtacacgaatcttctgccc

SEQ ID NO: 102527 - DNA, 22 bp, Artificial Sequence
  Synthetic oligonucleotide; CTT chr11 5335260 5335281 5335277 5335282 +
ctgccccataaatatgactcta

SEQ ID NO: 102528 - DNA, 22 bp, Artificial Sequence
  Synthetic oligonucleotide; TTC chr11 5335261 5335282 5335278 5335283 +
tgccccataaatatgactctat

SEQ ID NO: 102529 - DNA, 22 bp, Artificial Sequence
  Synthetic oligonucleotide; CTG chr11 5335263 5335284 5335280 5335285 +
ccccataaatatgactctattc

SEQ ID NO: 102530 - DNA, 22 bp, Artificial Sequence
  Synthetic oligonucleotide; CTC chr11 5335280 5335301 5335297 5335302 +
tattcctggaaacatcacttat

SEQ ID NO: 102531 - DNA, 22 bp, Artificial Sequence
  Synthetic oligonucleotide; CTA chr11 5335282 5335303 5335299 5335304 +
ttcctggaaacatcacttatct

SEQ ID NO: 102532 - DNA, 22 bp, Artificial Sequence
  Synthetic oligonucleotide; TTC chr11 5335285 5335306 5335302 5335307 +
ctggaaacatcacttatcttag

SEQ ID NO: 102533 - DNA, 22 bp, Artificial Sequence
  Synthetic oligonucleotide; CTG chr11 5335288 5335309 5335305 5335310 +
gaaacatcacttatcttagaac

SEQ ID NO: 102534 - DNA, 22 bp, Artificial Sequence
  Synthetic oligonucleotide; CTT chr11 5335300 5335321 5335317 5335322 +
atcttagaacagatataaagta

SEQ ID NO: 102535 - DNA, 22 bp, Artificial Sequence
  Synthetic oligonucleotide; TTA chr11 5335301 5335322 5335318 5335323 +
tcttagaacagatataaagtaa

SEQ ID NO: 102536 - DNA, 22 bp, Artificial Sequence
  Synthetic oligonucleotide; CTT chr11 5335305 5335326 5335322 5335327 +
agaacagatataaagtaatttc

SEQ ID NO: 102537 - DNA, 22 bp, Artificial Sequence
  Synthetic oligonucleotide; TTA chr11 5335306 5335327 5335323 5335328 +
gaacagatataaagtaatttcc

SEQ ID NO: 102538 - DNA, 22 bp, Artificial Sequence
  Synthetic oligonucleotide; TTT chr11 5335326 5335347 5335343 5335348 +
cctgcagactgccccagagttg

SEQ ID NO: 102539 - DNA, 22 bp, Artificial Sequence
  Synthetic oligonucleotide; TTC chr11 5335327 5335348 5335344 5335349 +
ctgcagactgccccagagttgg

SEQ ID NO: 102540 - DNA, 22 bp, Artificial Sequence
  Synthetic oligonucleotide; CTG chr11 5335330 5335351 5335347 5335352 +
cagactgccccagagttgggat

SEQ ID NO: 102541 - DNA, 22 bp, Artificial Sequence
  Synthetic oligonucleotide; CTG chr11 5335337 5335358 5335354 5335359 +
ccccagagttgggataaaatct

SEQ ID NO: 102542 - DNA, 22 bp, Artificial Sequence
  Synthetic oligonucleotide; TTG chr11 5335348 5335369 5335365 5335370 +
ggataaaatctcatgtgaagtg

SEQ ID NO: 102543 - DNA, 22 bp, Artificial Sequence
  Synthetic oligonucleotide; CTC chr11 5335360 5335381 5335377 5335382 +
atgtgaagtgacactgttggtg

SEQ ID NO: 102544 - DNA, 22 bp, Artificial Sequence
  Synthetic oligonucleotide; CTG chr11 5335376 5335397 5335393 5335398 +
ttggtggaggataagcctccag

SEQ ID NO: 102545 - DNA, 22 bp, Artificial Sequence
  Synthetic oligonucleotide; TTG chr11 5335379 5335400 5335396 5335401 +
gtggaggataagcctccagaga

SEQ ID NO: 102546 - DNA, 22 bp, Artificial Sequence
  Synthetic oligonucleotide; CTC chr11 5335395 5335416 5335412 5335417 +
cagagaatgggaacaactatta

SEQ ID NO: 102547 - DNA, 22 bp, Artificial Sequence
  Synthetic oligonucleotide; CTA chr11 5335414 5335435 5335431 5335436 +
ttatcagccaacactcaaagtc

SEQ ID NO: 102548 - DNA, 22 bp, Artificial Sequence
  Synthetic oligonucleotide; TTA chr11 5335417 5335438 5335434 5335439 +
tcagccaacactcaaagtcacc

SEQ ID NO: 102549 - DNA, 22 bp, Artificial Sequence
  Synthetic oligonucleotide; CTC chr11 5335430 5335451 5335447 5335452 +
aaagtcaccaagcttaggggca

SEQ ID NO: 102550 - DNA, 22 bp, Artificial Sequence
  Synthetic oligonucleotide; CTT chr11 5335445 5335466 5335462 5335467 +
aggggcactgggaggaagtagg

SEQ ID NO: 102551 - DNA, 22 bp, Artificial Sequence
  Synthetic oligonucleotide; TTA chr11 5335446 5335467 5335463 5335468 +
ggggcactgggaggaagtaggc

SEQ ID NO: 102552 - DNA, 22 bp, Artificial Sequence
  Synthetic oligonucleotide; CTG chr11 5335455 5335476 5335472 5335477 +
ggaggaagtaggcagggcaccc

SEQ ID NO: 102553 - DNA, 22 bp, Artificial Sequence
  Synthetic oligonucleotide; CTT chr11 5335487 5335508 5335504 5335509 +
ctatttccttaaatagccattg

SEQ ID NO: 102554 - DNA, 22 bp, Artificial Sequence
  Synthetic oligonucleotide; TTC chr11 5335488 5335509 5335505 5335510 +
tatttccttaaatagccattga

SEQ ID NO: 102555 - DNA, 22 bp, Artificial Sequence
  Synthetic oligonucleotide; CTA chr11 5335490 5335511 5335507 5335512 +
tttccttaaatagccattgatg

SEQ ID NO: 102556 - DNA, 22 bp, Artificial Sequence
  Synthetic oligonucleotide; TTT chr11 5335493 5335514 5335510 5335515 +
ccttaaatagccattgatgtgt

SEQ ID NO: 102557 - DNA, 22 bp, Artificial Sequence
  Synthetic oligonucleotide; TTC chr11 5335494 5335515 5335511 5335516 +
cttaaatagccattgatgtgtc

SEQ ID NO: 102558 - DNA, 22 bp, Artificial Sequence
  Synthetic oligonucleotide; CTT chr11 5335497 5335518 5335514 5335519 +
aaatagccattgatgtgtctct

SEQ ID NO: 102559 - DNA, 22 bp, Artificial Sequence
  Synthetic oligonucleotide; TTA chr11 5335498 5335519 5335515 5335520 +
aatagccattgatgtgtctctc

SEQ ID NO: 102560 - DNA, 22 bp, Artificial Sequence
  Synthetic oligonucleotide; TTG chr11 5335509 5335530 5335526 5335531 +
atgtgtctctcattcatgtatt

SEQ ID NO: 102561 - DNA, 22 bp, Artificial Sequence
  Synthetic oligonucleotide; CTC chr11 5335518 5335539 5335535 5335540 +
tcattcatgtattttctaagac

SEQ ID NO: 102562 - DNA, 22 bp, Artificial Sequence
  Synthetic oligonucleotide; CTC chr11 5335520 5335541 5335537 5335542 +
attcatgtattttctaagacct

SEQ ID NO: 102563 - DNA, 22 bp, Artificial Sequence
  Synthetic oligonucleotide; TTC chr11 5335524 5335545 5335541 5335546 +
atgtattttctaagaccttgtt

SEQ ID NO: 102564 - DNA, 22 bp, Artificial Sequence
  Synthetic oligonucleotide; TTT chr11 5335532 5335553 5335549 5335554 +
tctaagaccttgttcattcttt

SEQ ID NO: 102565 - DNA, 22 bp, Artificial Sequence
  Synthetic oligonucleotide; TTT chr11 5335533 5335554 5335550 5335555 +
ctaagaccttgttcattctttt

SEQ ID NO: 102566 - DNA, 22 bp, Artificial Sequence
  Synthetic oligonucleotide; TTC chr11 5335534 5335555 5335551 5335556 +
taagaccttgttcattcttttc

SEQ ID NO: 102567 - DNA, 22 bp, Artificial Sequence
  Synthetic oligonucleotide; CTA chr11 5335536 5335557 5335553 5335558 +
agaccttgttcattcttttcat

SEQ ID NO: 102568 - DNA, 22 bp, Artificial Sequence
  Synthetic oligonucleotide; CTT chr11 5335543 5335564 5335560 5335565 +
gttcattcttttcatatttcct

SEQ ID NO: 102569 - DNA, 22 bp, Artificial Sequence
  Synthetic oligonucleotide; TTG chr11 5335544 5335565 5335561 5335566 +
ttcattcttttcatatttcctg

SEQ ID NO: 102570 - DNA, 22 bp, Artificial Sequence
  Synthetic oligonucleotide; TTC chr11 5335547 5335568 5335564 5335569 +
attcttttcatatttcctgctg

SEQ ID NO: 102571 - DNA, 22 bp, Artificial Sequence
  Synthetic oligonucleotide; TTC chr11 5335551 5335572 5335568 5335573 +
ttttcatatttcctgctgtatt

SEQ ID NO: 102572 - DNA, 22 bp, Artificial Sequence
  Synthetic oligonucleotide; CTT chr11 5335553 5335574 5335570 5335575 +
ttcatatttcctgctgtattgc

SEQ ID NO: 102573 - DNA, 22 bp, Artificial Sequence
  Synthetic oligonucleotide; TTT chr11 5335554 5335575 5335571 5335576 +
tcatatttcctgctgtattgcc

SEQ ID NO: 102574 - DNA, 22 bp, Artificial Sequence
  Synthetic oligonucleotide; TTT chr11 5335555 5335576 5335572 5335577 +
catatttcctgctgtattgcct

SEQ ID NO: 102575 - DNA, 22 bp, Artificial Sequence
  Synthetic oligonucleotide; TTC chr11 5335556 5335577 5335573 5335578 +
atatttcctgctgtattgcctg

SEQ ID NO: 102576 - DNA, 22 bp, Artificial Sequence
  Synthetic oligonucleotide; TTT chr11 5335562 5335583 5335579 5335584 +
cctgctgtattgcctgtgaagt

SEQ ID NO: 102577 - DNA, 22 bp, Artificial Sequence
  Synthetic oligonucleotide; TTC chr11 5335563 5335584 5335580 5335585 +
ctgctgtattgcctgtgaagta

SEQ ID NO: 102578 - DNA, 22 bp, Artificial Sequence
  Synthetic oligonucleotide; CTG chr11 5335566 5335587 5335583 5335588 +
ctgtattgcctgtgaagtaaag

SEQ ID NO: 102579 - DNA, 22 bp, Artificial Sequence
  Synthetic oligonucleotide; CTG chr11 5335569 5335590 5335586 5335591 +
tattgcctgtgaagtaaagtat

SEQ ID NO: 102580 - DNA, 22 bp, Artificial Sequence
  Synthetic oligonucleotide; TTG chr11 5335574 5335595 5335591 5335596 +
cctgtgaagtaaagtatcatgt

SEQ ID NO: 102581 - DNA, 22 bp, Artificial Sequence
  Synthetic oligonucleotide; CTG chr11 5335578 5335599 5335595 5335600 +
tgaagtaaagtatcatgtcaca

SEQ ID NO: 102582 - DNA, 22 bp, Artificial Sequence
  Synthetic oligonucleotide; CTC chr11 5335613 5335634 5335630 5335635 +
agattgggaaggacctccatct

SEQ ID NO: 102583 - DNA, 22 bp, Artificial Sequence
  Synthetic oligonucleotide; TTG chr11 5335619 5335640 5335636 5335641 +
ggaaggacctccatctcctgta

SEQ ID NO: 102584 - DNA, 22 bp, Artificial Sequence
  Synthetic oligonucleotide; CTC chr11 5335630 5335651 5335647 5335652 +
catctcctgtaataaaagcctt

SEQ ID NO: 102585 - DNA, 22 bp, Artificial Sequence
  Synthetic oligonucleotide; CTC chr11 5335636 5335657 5335653 5335658 +
ctgtaataaaagccttctttga

SEQ ID NO: 102586 - DNA, 22 bp, Artificial Sequence
  Synthetic oligonucleotide; CTG chr11 5335639 5335660 5335656 5335661 +
taataaaagccttctttgatgc

SEQ ID NO: 102587 - DNA, 22 bp, Artificial Sequence
  Synthetic oligonucleotide; CTT chr11 5335652 5335673 5335669 5335674 +
ctttgatgcagtgtttcctgac

SEQ ID NO: 102588 - DNA, 22 bp, Artificial Sequence
  Synthetic oligonucleotide; TTC chr11 5335653 5335674 5335670 5335675 +
tttgatgcagtgtttcctgaca

SEQ ID NO: 102589 - DNA, 22 bp, Artificial Sequence
  Synthetic oligonucleotide; CTT chr11 5335655 5335676 5335672 5335677 +
tgatgcagtgtttcctgacaag

SEQ ID NO: 102590 - DNA, 22 bp, Artificial Sequence
  Synthetic oligonucleotide; TTT chr11 5335656 5335677 5335673 5335678 +
gatgcagtgtttcctgacaagg

SEQ ID NO: 102591 - DNA, 22 bp, Artificial Sequence
  Synthetic oligonucleotide; TTG chr11 5335657 5335678 5335674 5335679 +
atgcagtgtttcctgacaaggg

SEQ ID NO: 102592 - DNA, 22 bp, Artificial Sequence
  Synthetic oligonucleotide; TTT chr11 5335668 5335689 5335685 5335690 +
cctgacaagggtcatccgctga

SEQ ID NO: 102593 - DNA, 22 bp, Artificial Sequence
  Synthetic oligonucleotide; TTC chr11 5335669 5335690 5335686 5335691 +
ctgacaagggtcatccgctgag

SEQ ID NO: 102594 - DNA, 22 bp, Artificial Sequence
  Synthetic oligonucleotide; CTG chr11 5335672 5335693 5335689 5335694 +
acaagggtcatccgctgagtgc

SEQ ID NO: 102595 - DNA, 22 bp, Artificial Sequence
  Synthetic oligonucleotide; CTG chr11 5335689 5335710 5335706 5335711 +
agtgcctgtctctttctaaatc

SEQ ID NO: 102596 - DNA, 22 bp, Artificial Sequence
  Synthetic oligonucleotide; CTG chr11 5335697 5335718 5335714 5335719 +
tctctttctaaatcacataaca

SEQ ID NO: 102597 - DNA, 22 bp, Artificial Sequence
  Synthetic oligonucleotide; CTC chr11 5335701 5335722 5335718 5335723 +
tttctaaatcacataacacaat

SEQ ID NO: 102598 - DNA, 22 bp, Artificial Sequence
  Synthetic oligonucleotide; CTT chr11 5335703 5335724 5335720 5335725 +
tctaaatcacataacacaatat

SEQ ID NO: 102599 - DNA, 22 bp, Artificial Sequence
  Synthetic oligonucleotide; TTT chr11 5335704 5335725 5335721 5335726 +
ctaaatcacataacacaatatt

SEQ ID NO: 102600 - DNA, 22 bp, Artificial Sequence
  Synthetic oligonucleotide; TTC chr11 5335705 5335726 5335722 5335727 +
taaatcacataacacaatattt

SEQ ID NO: 102601 - DNA, 22 bp, Artificial Sequence
  Synthetic oligonucleotide; CTA chr11 5335707 5335728 5335724 5335729 +
aatcacataacacaatatttat

SEQ ID NO: 102602 - DNA, 22 bp, Artificial Sequence
  Synthetic oligonucleotide; TTT chr11 5335727 5335748 5335744 5335749 +
attagaatatctgtgctgaaaa

SEQ ID NO: 102603 - DNA, 22 bp, Artificial Sequence
  Synthetic oligonucleotide; TTA chr11 5335728 5335749 5335745 5335750 +
ttagaatatctgtgctgaaaat

SEQ ID NO: 102604 - DNA, 22 bp, Artificial Sequence
  Synthetic oligonucleotide; TTA chr11 5335731 5335752 5335748 5335753 +
gaatatctgtgctgaaaatact

SEQ ID NO: 102605 - DNA, 22 bp, Artificial Sequence
  Synthetic oligonucleotide; CTG chr11 5335740 5335761 5335757 5335762 +
tgctgaaaatactcaggcagcc

SEQ ID NO: 102606 - DNA, 22 bp, Artificial Sequence
  Synthetic oligonucleotide; CTG chr11 5335745 5335766 5335762 5335767 +
aaaatactcaggcagccacatt

SEQ ID NO: 102607 - DNA, 22 bp, Artificial Sequence
  Synthetic oligonucleotide; CTC chr11 5335754 5335775 5335771 5335776 +
aggcagccacattattagaaat

SEQ ID NO: 102608 - DNA, 22 bp, Artificial Sequence
  Synthetic oligonucleotide; TTA chr11 5335768 5335789 5335785 5335790 +
ttagaaattacctaacttttta

SEQ ID NO: 102609 - DNA, 22 bp, Artificial Sequence
  Synthetic oligonucleotide; TTA chr11 5335771 5335792 5335788 5335793 +
gaaattacctaactttttaaaa

SEQ ID NO: 102610 - DNA, 22 bp, Artificial Sequence
  Synthetic oligonucleotide; TTA chr11 5335778 5335799 5335795 5335800 +
cctaactttttaaaatgaaaat

SEQ ID NO: 102611 - DNA, 22 bp, Artificial Sequence
  Synthetic oligonucleotide; CTA chr11 5335782 5335803 5335799 5335804 +
actttttaaaatgaaaatattt

SEQ ID NO: 102612 - DNA, 22 bp, Artificial Sequence
  Synthetic oligonucleotide; CTT chr11 5335786 5335807 5335803 5335808 +
tttaaaatgaaaatatttttct

SEQ ID NO: 102613 - DNA, 22 bp, Artificial Sequence
  Synthetic oligonucleotide; TTT chr11 5335787 5335808 5335804 5335809 +
ttaaaatgaaaatatttttctg

SEQ ID NO: 102614 - DNA, 22 bp, Artificial Sequence
  Synthetic oligonucleotide; TTT chr11 5335788 5335809 5335805 5335810 +
taaaatgaaaatatttttctgg

SEQ ID NO: 102615 - DNA, 22 bp, Artificial Sequence
  Synthetic oligonucleotide; TTT chr11 5335789 5335810 5335806 5335811 +
aaaatgaaaatatttttctggt

SEQ ID NO: 102616 - DNA, 22 bp, Artificial Sequence
  Synthetic oligonucleotide; TTA chr11 5335790 5335811 5335807 5335812 +
aaatgaaaatatttttctggtc

SEQ ID NO: 102617 - DNA, 22 bp, Artificial Sequence
  Synthetic oligonucleotide; TTT chr11 5335804 5335825 5335821 5335826 +
ttctggtcttcctattccttgg

SEQ ID NO: 102618 - DNA, 22 bp, Artificial Sequence
  Synthetic oligonucleotide; TTT chr11 5335805 5335826 5335822 5335827 +
tctggtcttcctattccttggc

SEQ ID NO: 102619 - DNA, 22 bp, Artificial Sequence
  Synthetic oligonucleotide; TTT chr11 5335806 5335827 5335823 5335828 +
ctggtcttcctattccttggct

SEQ ID NO: 102620 - DNA, 22 bp, Artificial Sequence
  Synthetic oligonucleotide; TTC chr11 5335807 5335828 5335824 5335829 +
tggtcttcctattccttggctc

SEQ ID NO: 102621 - DNA, 22 bp, Artificial Sequence
  Synthetic oligonucleotide; CTG chr11 5335809 5335830 5335826 5335831 +
gtcttcctattccttggctctt

SEQ ID NO: 102622 - DNA, 22 bp, Artificial Sequence
  Synthetic oligonucleotide; CTT chr11 5335814 5335835 5335831 5335836 +
cctattccttggctcttggtct

SEQ ID NO: 102623 - DNA, 22 bp, Artificial Sequence
  Synthetic oligonucleotide; TTC chr11 5335815 5335836 5335832 5335837 +
ctattccttggctcttggtctg

SEQ ID NO: 102624 - DNA, 22 bp, Artificial Sequence
  Synthetic oligonucleotide; CTA chr11 5335818 5335839 5335835 5335840 +
ttccttggctcttggtctgagc

SEQ ID NO: 102625 - DNA, 22 bp, Artificial Sequence
  Synthetic oligonucleotide; TTC chr11 5335821 5335842 5335838 5335843 +
cttggctcttggtctgagctct

SEQ ID NO: 102626 - DNA, 22 bp, Artificial Sequence
  Synthetic oligonucleotide; CTT chr11 5335824 5335845 5335841 5335846 +
ggctcttggtctgagctctggc

SEQ ID NO: 102627 - DNA, 22 bp, Artificial Sequence
  Synthetic oligonucleotide; TTG chr11 5335825 5335846 5335842 5335847 +
gctcttggtctgagctctggca

SEQ ID NO: 102628 - DNA, 22 bp, Artificial Sequence
  Synthetic oligonucleotide; CTC chr11 5335829 5335850 5335846 5335851 +
ttggtctgagctctggcatcac

SEQ ID NO: 102629 - DNA, 22 bp, Artificial Sequence
  Synthetic oligonucleotide; CTT chr11 5335831 5335852 5335848 5335853 +
ggtctgagctctggcatcacag

SEQ ID NO: 102630 - DNA, 22 bp, Artificial Sequence
  Synthetic oligonucleotide; TTG chr11 5335832 5335853 5335849 5335854 +
gtctgagctctggcatcacagt

SEQ ID NO: 102631 - DNA, 22 bp, Artificial Sequence
  Synthetic oligonucleotide; CTG chr11 5335837 5335858 5335854 5335859 +
agctctggcatcacagtctata

SEQ ID NO: 102632 - DNA, 22 bp, Artificial Sequence
  Synthetic oligonucleotide; CTC chr11 5335842 5335863 5335859 5335864 +
tggcatcacagtctatatctaa

SEQ ID NO: 102633 - DNA, 22 bp, Artificial Sequence
  Synthetic oligonucleotide; CTG chr11 5335844 5335865 5335861 5335866 +
gcatcacagtctatatctaact

SEQ ID NO: 102634 - DNA, 22 bp, Artificial Sequence
  Synthetic oligonucleotide; CTA chr11 5335857 5335878 5335874 5335879 +
tatctaactgctgccttatatt

SEQ ID NO: 102635 - DNA, 22 bp, Artificial Sequence
  Synthetic oligonucleotide; CTA chr11 5335863 5335884 5335880 5335885 +
actgctgccttatattacatat

SEQ ID NO: 102636 - DNA, 22 bp, Artificial Sequence
  Synthetic oligonucleotide; CTG chr11 5335867 5335888 5335884 5335889 +
ctgccttatattacatatggca

SEQ ID NO: 102637 - DNA, 22 bp, Artificial Sequence
  Synthetic oligonucleotide; CTG chr11 5335870 5335891 5335887 5335892 +
ccttatattacatatggcatat

SEQ ID NO: 102638 - DNA, 22 bp, Artificial Sequence
  Synthetic oligonucleotide; CTT chr11 5335874 5335895 5335891 5335896 +
atattacatatggcatatagga

SEQ ID NO: 102639 - DNA, 22 bp, Artificial Sequence
  Synthetic oligonucleotide; TTA chr11 5335875 5335896 5335892 5335897 +
tattacatatggcatataggaa

SEQ ID NO: 102640 - DNA, 22 bp, Artificial Sequence
  Synthetic oligonucleotide; TTA chr11 5335880 5335901 5335897 5335902 +
catatggcatataggaaggcaa

SEQ ID NO: 102641 - DNA, 22 bp, Artificial Sequence
  Synthetic oligonucleotide; TTC chr11 5335907 5335928 5335924 5335929 +
aagtataataagcttatatcgc

SEQ ID NO: 102642 - DNA, 22 bp, Artificial Sequence
  Synthetic oligonucleotide; CTT chr11 5335922 5335943 5335939 5335944 +
atatcgctaacgattcaggaag

SEQ ID NO: 102643 - DNA, 22 bp, Artificial Sequence
  Synthetic oligonucleotide; TTA chr11 5335923 5335944 5335940 5335945 +
tatcgctaacgattcaggaagg

SEQ ID NO: 102644 - DNA, 22 bp, Artificial Sequence
  Synthetic oligonucleotide; CTA chr11 5335931 5335952 5335948 5335953 +
acgattcaggaaggtctctatc

SEQ ID NO: 102645 - DNA, 22 bp, Artificial Sequence
  Synthetic oligonucleotide; TTC chr11 5335938 5335959 5335955 5335960 +
aggaaggtctctatcctaggat

SEQ ID NO: 102646 - DNA, 22 bp, Artificial Sequence
  Synthetic oligonucleotide; CTC chr11 5335949 5335970 5335966 5335971 +
tatcctaggatttttgctgttt

SEQ ID NO: 102647 - DNA, 22 bp, Artificial Sequence
  Synthetic oligonucleotide; CTA chr11 5335951 5335972 5335968 5335973 +
tcctaggatttttgctgtttgt

SEQ ID NO: 102648 - DNA, 22 bp, Artificial Sequence
  Synthetic oligonucleotide; CTA chr11 5335956 5335977 5335973 5335978 +
ggatttttgctgtttgttgagt

SEQ ID NO: 102649 - DNA, 22 bp, Artificial Sequence
  Synthetic oligonucleotide; TTT chr11 5335962 5335983 5335979 5335984 +
ttgctgtttgttgagtaagtct

SEQ ID NO: 102650 - DNA, 22 bp, Artificial Sequence
  Synthetic oligonucleotide; TTT chr11 5335963 5335984 5335980 5335985 +
tgctgtttgttgagtaagtctg

SEQ ID NO: 102651 - DNA, 22 bp, Artificial Sequence
  Synthetic oligonucleotide; TTT chr11 5335964 5335985 5335981 5335986 +
gctgtttgttgagtaagtctgt

SEQ ID NO: 102652 - DNA, 22 bp, Artificial Sequence
  Synthetic oligonucleotide; TTG chr11 5335965 5335986 5335982 5335987 +
ctgtttgttgagtaagtctgtg

SEQ ID NO: 102653 - DNA, 22 bp, Artificial Sequence
  Synthetic oligonucleotide; CTG chr11 5335968 5335989 5335985 5335990 +
tttgttgagtaagtctgtgctg

SEQ ID NO: 102654 - DNA, 22 bp, Artificial Sequence
  Synthetic oligonucleotide; TTT chr11 5335971 5335992 5335988 5335993 +
gttgagtaagtctgtgctgaca

SEQ ID NO: 102655 - DNA, 22 bp, Artificial Sequence
  Synthetic oligonucleotide; TTG chr11 5335972 5335993 5335989 5335994 +
ttgagtaagtctgtgctgacaa

SEQ ID NO: 102656 - DNA, 22 bp, Artificial Sequence
  Synthetic oligonucleotide; TTG chr11 5335975 5335996 5335992 5335997 +
agtaagtctgtgctgacaatac

SEQ ID NO: 102657 - DNA, 22 bp, Artificial Sequence
  Synthetic oligonucleotide; CTG chr11 5335985 5336006 5336002 5336007 +
tgctgacaataccagcttcttt

SEQ ID NO: 102658 - DNA, 22 bp, Artificial Sequence
  Synthetic oligonucleotide; CTG chr11 5335990 5336011 5336007 5336012 +
acaataccagcttctttttttt

SEQ ID NO: 102659 - DNA, 22 bp, Artificial Sequence
  Synthetic oligonucleotide; CTT chr11 5336003 5336024 5336020 5336025 +
cttttttttttttttctgtgta

SEQ ID NO: 102660 - DNA, 22 bp, Artificial Sequence
  Synthetic oligonucleotide; TTC chr11 5336004 5336025 5336021 5336026 +
ttttttttttttttctgtgtag

SEQ ID NO: 102661 - DNA, 22 bp, Artificial Sequence
  Synthetic oligonucleotide; CTT chr11 5336006 5336027 5336023 5336028 +
ttttttttttttctgtgtagtt

SEQ ID NO: 102662 - DNA, 22 bp, Artificial Sequence
  Synthetic oligonucleotide; TTT chr11 5336007 5336028 5336024 5336029 +
tttttttttttctgtgtagttt

SEQ ID NO: 102663 - DNA, 22 bp, Artificial Sequence
  Synthetic oligonucleotide; TTT chr11 5336008 5336029 5336025 5336030 +
ttttttttttctgtgtagtttg

SEQ ID NO: 102664 - DNA, 22 bp, Artificial Sequence
  Synthetic oligonucleotide; TTT chr11 5336009 5336030 5336026 5336031 +
tttttttttctgtgtagtttga

SEQ ID NO: 102665 - DNA, 22 bp, Artificial Sequence
  Synthetic oligonucleotide; TTT chr11 5336010 5336031 5336027 5336032 +
ttttttttctgtgtagtttgat

SEQ ID NO: 102666 - DNA, 22 bp, Artificial Sequence
  Synthetic oligonucleotide; TTT chr11 5336011 5336032 5336028 5336033 +
tttttttctgtgtagtttgatt

SEQ ID NO: 102667 - DNA, 22 bp, Artificial Sequence
  Synthetic oligonucleotide; TTT chr11 5336012 5336033 5336029 5336034 +
ttttttctgtgtagtttgattc

SEQ ID NO: 102668 - DNA, 22 bp, Artificial Sequence
  Synthetic oligonucleotide; TTT chr11 5336013 5336034 5336030 5336035 +
tttttctgtgtagtttgattct

SEQ ID NO: 102669 - DNA, 22 bp, Artificial Sequence
  Synthetic oligonucleotide; TTT chr11 5336014 5336035 5336031 5336036 +
ttttctgtgtagtttgattcta

SEQ ID NO: 102670 - DNA, 22 bp, Artificial Sequence
  Synthetic oligonucleotide; TTT chr11 5336015 5336036 5336032 5336037 +
tttctgtgtagtttgattctat

SEQ ID NO: 102671 - DNA, 22 bp, Artificial Sequence
  Synthetic oligonucleotide; TTT chr11 5336016 5336037 5336033 5336038 +
ttctgtgtagtttgattctatt

SEQ ID NO: 102672 - DNA, 22 bp, Artificial Sequence
  Synthetic oligonucleotide; TTT chr11 5336017 5336038 5336034 5336039 +
tctgtgtagtttgattctatta

SEQ ID NO: 102673 - DNA, 22 bp, Artificial Sequence
  Synthetic oligonucleotide; TTT chr11 5336018 5336039 5336035 5336040 +
ctgtgtagtttgattctattat

SEQ ID NO: 102674 - DNA, 22 bp, Artificial Sequence
  Synthetic oligonucleotide; TTC chr11 5336019 5336040 5336036 5336041 +
tgtgtagtttgattctattatc

SEQ ID NO: 102675 - DNA, 22 bp, Artificial Sequence
  Synthetic oligonucleotide; CTG chr11 5336021 5336042 5336038 5336043 +
tgtagtttgattctattatctg

SEQ ID NO: 102676 - DNA, 22 bp, Artificial Sequence
  Synthetic oligonucleotide; TTT chr11 5336029 5336050 5336046 5336051 +
gattctattatctgtcagcctt

SEQ ID NO: 102677 - DNA, 22 bp, Artificial Sequence
  Synthetic oligonucleotide; TTG chr11 5336030 5336051 5336047 5336052 +
attctattatctgtcagccttc

SEQ ID NO: 102678 - DNA, 22 bp, Artificial Sequence
  Synthetic oligonucleotide; TTC chr11 5336034 5336055 5336051 5336056 +
tattatctgtcagccttctgga

SEQ ID NO: 102679 - DNA, 22 bp, Artificial Sequence
  Synthetic oligonucleotide; CTA chr11 5336036 5336057 5336053 5336058 +
ttatctgtcagccttctggatt

SEQ ID NO: 102680 - DNA, 22 bp, Artificial Sequence
  Synthetic oligonucleotide; TTA chr11 5336039 5336060 5336056 5336061 +
tctgtcagccttctggattcca

SEQ ID NO: 102681 - DNA, 22 bp, Artificial Sequence
  Synthetic oligonucleotide; CTG chr11 5336043 5336064 5336060 5336065 +
tcagccttctggattccacaat

SEQ ID NO: 102682 - DNA, 22 bp, Artificial Sequence
  Synthetic oligonucleotide; CTT chr11 5336051 5336072 5336068 5336073 +
ctggattccacaattatctccg

SEQ ID NO: 102683 - DNA, 22 bp, Artificial Sequence
  Synthetic oligonucleotide; TTC chr11 5336052 5336073 5336069 5336074 +
tggattccacaattatctccga

SEQ ID NO: 102684 - DNA, 22 bp, Artificial Sequence
  Synthetic oligonucleotide; CTG chr11 5336054 5336075 5336071 5336076 +
gattccacaattatctccgaag

SEQ ID NO: 102685 - DNA, 22 bp, Artificial Sequence
  Synthetic oligonucleotide; TTC chr11 5336059 5336080 5336076 5336081 +
cacaattatctccgaagattcc

SEQ ID NO: 102686 - DNA, 22 bp, Artificial Sequence
  Synthetic oligonucleotide; TTA chr11 5336067 5336088 5336084 5336089 +
tctccgaagattccatccttta

SEQ ID NO: 102687 - DNA, 22 bp, Artificial Sequence
  Synthetic oligonucleotide; CTC chr11 5336071 5336092 5336088 5336093 +
cgaagattccatcctttaactc

SEQ ID NO: 102688 - DNA, 22 bp, Artificial Sequence
  Synthetic oligonucleotide; TTC chr11 5336080 5336101 5336097 5336102 +
catcctttaactcatcctctac

SEQ ID NO: 102689 - DNA, 22 bp, Artificial Sequence
  Synthetic oligonucleotide; CTT chr11 5336087 5336108 5336104 5336109 +
taactcatcctctacaggctct

SEQ ID NO: 102690 - DNA, 22 bp, Artificial Sequence
  Synthetic oligonucleotide; TTT chr11 5336088 5336109 5336105 5336110 +
aactcatcctctacaggctctg

SEQ ID NO: 102691 - DNA, 22 bp, Artificial Sequence
  Synthetic oligonucleotide; TTA chr11 5336089 5336110 5336106 5336111 +
actcatcctctacaggctctga

SEQ ID NO: 102692 - DNA, 22 bp, Artificial Sequence
  Synthetic oligonucleotide; CTC chr11 5336093 5336114 5336110 5336115 +
atcctctacaggctctgatggt

SEQ ID NO: 102693 - DNA, 22 bp, Artificial Sequence
  Synthetic oligonucleotide; CTC chr11 5336099 5336120 5336116 5336121 +
tacaggctctgatggttaattt

SEQ ID NO: 102694 - DNA, 22 bp, Artificial Sequence
  Synthetic oligonucleotide; CTA chr11 5336101 5336122 5336118 5336123 +
caggctctgatggttaatttta

SEQ ID NO: 102695 - DNA, 22 bp, Artificial Sequence
  Synthetic oligonucleotide; CTC chr11 5336108 5336129 5336125 5336130 +
tgatggttaattttatatgcca

SEQ ID NO: 102696 - DNA, 22 bp, Artificial Sequence
  Synthetic oligonucleotide; CTG chr11 5336110 5336131 5336127 5336132 +
atggttaattttatatgccaat

SEQ ID NO: 102697 - DNA, 22 bp, Artificial Sequence
  Synthetic oligonucleotide; TTA chr11 5336117 5336138 5336134 5336139 +
attttatatgccaatttgactg

SEQ ID NO: 102698 - DNA, 22 bp, Artificial Sequence
  Synthetic oligonucleotide; TTT chr11 5336121 5336142 5336138 5336143 +
tatatgccaatttgactgggcc

SEQ ID NO: 102699 - DNA, 22 bp, Artificial Sequence
  Synthetic oligonucleotide; TTT chr11 5336122 5336143 5336139 5336144 +
atatgccaatttgactgggcca

SEQ ID NO: 102700 - DNA, 22 bp, Artificial Sequence
  Synthetic oligonucleotide; TTA chr11 5336123 5336144 5336140 5336145 +
tatgccaatttgactgggccat

SEQ ID NO: 102701 - DNA, 22 bp, Artificial Sequence
  Synthetic oligonucleotide; TTT chr11 5336134 5336155 5336151 5336156 +
gactgggccatggggtgcccaa

SEQ ID NO: 102702 - DNA, 22 bp, Artificial Sequence
  Synthetic oligonucleotide; TTG chr11 5336135 5336156 5336152 5336157 +
actgggccatggggtgcccaaa

SEQ ID NO: 102703 - DNA, 22 bp, Artificial Sequence
  Synthetic oligonucleotide; CTG chr11 5336139 5336160 5336156 5336161 +
ggccatggggtgcccaaatatt

SEQ ID NO: 102704 - DNA, 22 bp, Artificial Sequence
  Synthetic oligonucleotide; TTT chr11 5336162 5336183 5336179 5336184 +
gtcaaacattattctagatgtt

SEQ ID NO: 102705 - DNA, 22 bp, Artificial Sequence
  Synthetic oligonucleotide; TTG chr11 5336163 5336184 5336180 5336185 +
tcaaacattattctagatgttt

SEQ ID NO: 102706 - DNA, 22 bp, Artificial Sequence
  Synthetic oligonucleotide; TTA chr11 5336173 5336194 5336190 5336195 +
ttctagatgtttttgtgagggt

SEQ ID NO: 102707 - DNA, 22 bp, Artificial Sequence
  Synthetic oligonucleotide; TTC chr11 5336176 5336197 5336193 5336198 +
tagatgtttttgtgagggtgtt

SEQ ID NO: 102708 - DNA, 22 bp, Artificial Sequence
  Synthetic oligonucleotide; CTA chr11 5336178 5336199 5336195 5336200 +
gatgtttttgtgagggtgtttt

SEQ ID NO: 102709 - DNA, 22 bp, Artificial Sequence
  Synthetic oligonucleotide; TTT chr11 5336185 5336206 5336202 5336207 +
ttgtgagggtgtttttaggcaa

SEQ ID NO: 102710 - DNA, 22 bp, Artificial Sequence
  Synthetic oligonucleotide; TTT chr11 5336186 5336207 5336203 5336208 +
tgtgagggtgtttttaggcaag

SEQ ID NO: 102711 - DNA, 22 bp, Artificial Sequence
  Synthetic oligonucleotide; TTT chr11 5336187 5336208 5336204 5336209 +
gtgagggtgtttttaggcaaga

SEQ ID NO: 102712 - DNA, 22 bp, Artificial Sequence
  Synthetic oligonucleotide; TTG chr11 5336188 5336209 5336205 5336210 +
tgagggtgtttttaggcaagat

SEQ ID NO: 102713 - DNA, 22 bp, Artificial Sequence
  Synthetic oligonucleotide; TTT chr11 5336199 5336220 5336216 5336221 +
ttaggcaagattaacatttaaa

SEQ ID NO: 102714 - DNA, 22 bp, Artificial Sequence
  Synthetic oligonucleotide; TTT chr11 5336200 5336221 5336217 5336222 +
taggcaagattaacatttaaat

SEQ ID NO: 102715 - DNA, 22 bp, Artificial Sequence
  Synthetic oligonucleotide; TTT chr11 5336201 5336222 5336218 5336223 +
aggcaagattaacatttaaatc

SEQ ID NO: 102716 - DNA, 22 bp, Artificial Sequence
  Synthetic oligonucleotide; TTA chr11 5336202 5336223 5336219 5336224 +
ggcaagattaacatttaaatcg

SEQ ID NO: 102717 - DNA, 22 bp, Artificial Sequence
  Synthetic oligonucleotide; TTA chr11 5336212 5336233 5336229 5336234 +
acatttaaatcggtagaccaag

SEQ ID NO: 102718 - DNA, 22 bp, Artificial Sequence
  Synthetic oligonucleotide; TTT chr11 5336218 5336239 5336235 5336240 +
aaatcggtagaccaagtagagc

SEQ ID NO: 102719 - DNA, 22 bp, Artificial Sequence
  Synthetic oligonucleotide; TTA chr11 5336219 5336240 5336236 5336241 +
aatcggtagaccaagtagagca

SEQ ID NO: 102720 - DNA, 22 bp, Artificial Sequence
  Synthetic oligonucleotide; CTT chr11 5336251 5336272 5336268 5336273 +
cctattgcaggcggcttcctcc

SEQ ID NO: 102721 - DNA, 22 bp, Artificial Sequence
  Synthetic oligonucleotide; TTC chr11 5336252 5336273 5336269 5336274 +
ctattgcaggcggcttcctcca

SEQ ID NO: 102722 - DNA, 22 bp, Artificial Sequence
  Synthetic oligonucleotide; CTA chr11 5336255 5336276 5336272 5336277 +
ttgcaggcggcttcctccaatc

SEQ ID NO: 102723 - DNA, 22 bp, Artificial Sequence
  Synthetic oligonucleotide; TTG chr11 5336258 5336279 5336275 5336280 +
caggcggcttcctccaatcagt

SEQ ID NO: 102724 - DNA, 22 bp, Artificial Sequence
  Synthetic oligonucleotide; CTT chr11 5336268 5336289 5336285 5336290 +
cctccaatcagttgaaaacctg

SEQ ID NO: 102725 - DNA, 22 bp, Artificial Sequence
  Synthetic oligonucleotide; TTC chr11 5336269 5336290 5336286 5336291 +
ctccaatcagttgaaaacctga

SEQ ID NO: 102726 - DNA, 22 bp, Artificial Sequence
  Synthetic oligonucleotide; CTC chr11 5336272 5336293 5336289 5336294 +
caatcagttgaaaacctgaata

SEQ ID NO: 102727 - DNA, 22 bp, Artificial Sequence
  Synthetic oligonucleotide; TTG chr11 5336282 5336303 5336299 5336304 +
aaaacctgaatagaacaaaaag

SEQ ID NO: 102728 - DNA, 22 bp, Artificial Sequence
  Synthetic oligonucleotide; CTG chr11 5336290 5336311 5336307 5336312 +
aatagaacaaaaagtctgaccc

SEQ ID NO: 102729 - DNA, 22 bp, Artificial Sequence
  Synthetic oligonucleotide; CTG chr11 5336308 5336329 5336325 5336330 +
acccttccccaaatcagagaga

SEQ ID NO: 102730 - DNA, 22 bp, Artificial Sequence
  Synthetic oligonucleotide; CTT chr11 5336314 5336335 5336331 5336336 +
ccccaaatcagagagaattatt

SEQ ID NO: 102731 - DNA, 22 bp, Artificial Sequence
  Synthetic oligonucleotide; TTC chr11 5336315 5336336 5336332 5336337 +
cccaaatcagagagaattattc

SEQ ID NO: 102732 - DNA, 22 bp, Artificial Sequence
  Synthetic oligonucleotide; TTA chr11 5336334 5336355 5336351 5336356 +
ttccttattgatggccttcaaa

SEQ ID NO: 102733 - DNA, 22 bp, Artificial Sequence
  Synthetic oligonucleotide; TTC chr11 5336337 5336358 5336354 5336359 +
cttattgatggccttcaaactg

SEQ ID NO: 102734 - DNA, 22 bp, Artificial Sequence
  Synthetic oligonucleotide; CTT chr11 5336340 5336361 5336357 5336362 +
attgatggccttcaaactggaa

SEQ ID NO: 102735 - DNA, 22 bp, Artificial Sequence
  Synthetic oligonucleotide; TTA chr11 5336341 5336362 5336358 5336363 +
ttgatggccttcaaactggaat

SEQ ID NO: 102736 - DNA, 22 bp, Artificial Sequence
  Synthetic oligonucleotide; TTG chr11 5336344 5336365 5336361 5336366 +
atggccttcaaactggaatcta

SEQ ID NO: 102737 - DNA, 22 bp, Artificial Sequence
  Synthetic oligonucleotide; CTT chr11 5336352 5336373 5336369 5336374 +
caaactggaatctagacctttt

SEQ ID NO: 102738 - DNA, 22 bp, Artificial Sequence
  Synthetic oligonucleotide; TTC chr11 5336353 5336374 5336370 5336375 +
aaactggaatctagaccttttt

SEQ ID NO: 102739 - DNA, 22 bp, Artificial Sequence
  Synthetic oligonucleotide; CTG chr11 5336359 5336380 5336376 5336381 +
gaatctagacctttttttctgc

SEQ ID NO: 102740 - DNA, 22 bp, Artificial Sequence
  Synthetic oligonucleotide; CTA chr11 5336366 5336387 5336383 5336388 +
gacctttttttctgcctttaga

SEQ ID NO: 102741 - DNA, 22 bp, Artificial Sequence
  Synthetic oligonucleotide; CTT chr11 5336372 5336393 5336389 5336394 +
tttttctgcctttagattgaac

SEQ ID NO: 102742 - DNA, 22 bp, Artificial Sequence
  Synthetic oligonucleotide; TTT chr11 5336373 5336394 5336390 5336395 +
ttttctgcctttagattgaact

SEQ ID NO: 102743 - DNA, 22 bp, Artificial Sequence
  Synthetic oligonucleotide; TTT chr11 5336374 5336395 5336391 5336396 +
tttctgcctttagattgaactg

SEQ ID NO: 102744 - DNA, 22 bp, Artificial Sequence
  Synthetic oligonucleotide; TTT chr11 5336375 5336396 5336392 5336397 +
ttctgcctttagattgaactga

SEQ ID NO: 102745 - DNA, 22 bp, Artificial Sequence
  Synthetic oligonucleotide; TTT chr11 5336376 5336397 5336393 5336398 +
tctgcctttagattgaactgaa

SEQ ID NO: 102746 - DNA, 22 bp, Artificial Sequence
  Synthetic oligonucleotide; TTT chr11 5336377 5336398 5336394 5336399 +
ctgcctttagattgaactgaaa

SEQ ID NO: 102747 - DNA, 22 bp, Artificial Sequence
  Synthetic oligonucleotide; TTC chr11 5336378 5336399 5336395 5336400 +
tgcctttagattgaactgaaac

SEQ ID NO: 102748 - DNA, 22 bp, Artificial Sequence
  Synthetic oligonucleotide; CTG chr11 5336380 5336401 5336397 5336402 +
cctttagattgaactgaaacat

SEQ ID NO: 102749 - DNA, 22 bp, Artificial Sequence
  Synthetic oligonucleotide; CTT chr11 5336384 5336405 5336401 5336406 +
tagattgaactgaaacatcaaa

SEQ ID NO: 102750 - DNA, 22 bp, Artificial Sequence
  Synthetic oligonucleotide; TTT chr11 5336385 5336406 5336402 5336407 +
agattgaactgaaacatcaaaa

SEQ ID NO: 102751 - DNA, 22 bp, Artificial Sequence
  Synthetic oligonucleotide; TTA chr11 5336386 5336407 5336403 5336408 +
gattgaactgaaacatcaaaac

SEQ ID NO: 102752 - DNA, 22 bp, Artificial Sequence
  Synthetic oligonucleotide; TTG chr11 5336391 5336412 5336408 5336413 +
aactgaaacatcaaaacttcct

SEQ ID NO: 102753 - DNA, 22 bp, Artificial Sequence
  Synthetic oligonucleotide; CTG chr11 5336396 5336417 5336413 5336418 +
aaacatcaaaacttcctgggtc

SEQ ID NO: 102754 - DNA, 22 bp, Artificial Sequence
  Synthetic oligonucleotide; CTT chr11 5336410 5336431 5336427 5336432 +
cctgggtctgaagcctgatggc

SEQ ID NO: 102755 - DNA, 22 bp, Artificial Sequence
  Synthetic oligonucleotide; TTC chr11 5336411 5336432 5336428 5336433 +
ctgggtctgaagcctgatggct

SEQ ID NO: 102756 - DNA, 22 bp, Artificial Sequence
  Synthetic oligonucleotide; CTG chr11 5336414 5336435 5336431 5336436 +
ggtctgaagcctgatggctttt

SEQ ID NO: 102757 - DNA, 22 bp, Artificial Sequence
  Synthetic oligonucleotide; CTG chr11 5336420 5336441 5336437 5336442 +
aagcctgatggcttttgggttg

SEQ ID NO: 102758 - DNA, 22 bp, Artificial Sequence
  Synthetic oligonucleotide; CTG chr11 5336427 5336448 5336444 5336449 +
atggcttttgggttgcaagtac

SEQ ID NO: 102759 - DNA, 22 bp, Artificial Sequence
  Synthetic oligonucleotide; CTT chr11 5336434 5336455 5336451 5336456 +
ttgggttgcaagtacaccatca

SEQ ID NO: 102760 - DNA, 22 bp, Artificial Sequence
  Synthetic oligonucleotide; TTT chr11 5336435 5336456 5336452 5336457 +
tgggttgcaagtacaccatcaa

SEQ ID NO: 102761 - DNA, 22 bp, Artificial Sequence
  Synthetic oligonucleotide; TTT chr11 5336436 5336457 5336453 5336458 +
gggttgcaagtacaccatcaat

SEQ ID NO: 102762 - DNA, 22 bp, Artificial Sequence
  Synthetic oligonucleotide; TTG chr11 5336437 5336458 5336454 5336459 +
ggttgcaagtacaccatcaatc

SEQ ID NO: 102763 - DNA, 22 bp, Artificial Sequence
  Synthetic oligonucleotide; TTG chr11 5336442 5336463 5336459 5336464 +
caagtacaccatcaatcctcct

SEQ ID NO: 102764 - DNA, 22 bp, Artificial Sequence
  Synthetic oligonucleotide; CTC chr11 5336462 5336483 5336479 5336484 +
ctgtttcccaggccttcagact

SEQ ID NO: 102765 - DNA, 22 bp, Artificial Sequence
  Synthetic oligonucleotide; CTG chr11 5336465 5336486 5336482 5336487 +
tttcccaggccttcagacttgg

SEQ ID NO: 102766 - DNA, 22 bp, Artificial Sequence
  Synthetic oligonucleotide; TTT chr11 5336468 5336489 5336485 5336490 +
cccaggccttcagacttggact

SEQ ID NO: 102767 - DNA, 22 bp, Artificial Sequence
  Synthetic oligonucleotide; TTC chr11 5336469 5336490 5336486 5336491 +
ccaggccttcagacttggactg

SEQ ID NO: 102768 - DNA, 22 bp, Artificial Sequence
  Synthetic oligonucleotide; CTT chr11 5336478 5336499 5336495 5336500 +
cagacttggactgggactaaac

SEQ ID NO: 102769 - DNA, 22 bp, Artificial Sequence
  Synthetic oligonucleotide; TTC chr11 5336479 5336500 5336496 5336501 +
agacttggactgggactaaact

SEQ ID NO: 102770 - DNA, 22 bp, Artificial Sequence
  Synthetic oligonucleotide; CTT chr11 5336485 5336506 5336502 5336507 +
ggactgggactaaactaccagg

SEQ ID NO: 102771 - DNA, 22 bp, Artificial Sequence
  Synthetic oligonucleotide; TTG chr11 5336486 5336507 5336503 5336508 +
gactgggactaaactaccaggc

SEQ ID NO: 102772 - DNA, 22 bp, Artificial Sequence
  Synthetic oligonucleotide; CTG chr11 5336491 5336512 5336508 5336513 +
ggactaaactaccaggctctct

SEQ ID NO: 102773 - DNA, 22 bp, Artificial Sequence
  Synthetic oligonucleotide; CTA chr11 5336497 5336518 5336514 5336519 +
aactaccaggctctcttgagtt

SEQ ID NO: 102774 - DNA, 22 bp, Artificial Sequence
  Synthetic oligonucleotide; CTA chr11 5336502 5336523 5336519 5336524 +
ccaggctctcttgagttttcaa

SEQ ID NO: 102775 - DNA, 22 bp, Artificial Sequence
  Synthetic oligonucleotide; CTC chr11 5336510 5336531 5336527 5336532 +
tcttgagttttcaacttgatga

SEQ ID NO: 102776 - DNA, 22 bp, Artificial Sequence
  Synthetic oligonucleotide; CTC chr11 5336512 5336533 5336529 5336534 +
ttgagttttcaacttgatgact

SEQ ID NO: 102777 - DNA, 22 bp, Artificial Sequence
  Synthetic oligonucleotide; CTT chr11 5336514 5336535 5336531 5336536 +
gagttttcaacttgatgactca

SEQ ID NO: 102778 - DNA, 22 bp, Artificial Sequence
  Synthetic oligonucleotide; TTG chr11 5336515 5336536 5336532 5336537 +
agttttcaacttgatgactcac

SEQ ID NO: 102779 - DNA, 22 bp, Artificial Sequence
  Synthetic oligonucleotide; TTT chr11 5336520 5336541 5336537 5336542 +
tcaacttgatgactcactctgc

SEQ ID NO: 102780 - DNA, 22 bp, Artificial Sequence
  Synthetic oligonucleotide; TTT chr11 5336521 5336542 5336538 5336543 +
caacttgatgactcactctgca

SEQ ID NO: 102781 - DNA, 22 bp, Artificial Sequence
  Synthetic oligonucleotide; TTC chr11 5336522 5336543 5336539 5336544 +
aacttgatgactcactctgcat

SEQ ID NO: 102782 - DNA, 22 bp, Artificial Sequence
  Synthetic oligonucleotide; CTT chr11 5336527 5336548 5336544 5336549 +
gatgactcactctgcatatctt

SEQ ID NO: 102783 - DNA, 22 bp, Artificial Sequence
  Synthetic oligonucleotide; TTG chr11 5336528 5336549 5336545 5336550 +
atgactcactctgcatatcttg

SEQ ID NO: 102784 - DNA, 22 bp, Artificial Sequence
  Synthetic oligonucleotide; CTC chr11 5336535 5336556 5336552 5336557 +
actctgcatatcttgggacttg

SEQ ID NO: 102785 - DNA, 22 bp, Artificial Sequence
  Synthetic oligonucleotide; CTC chr11 5336539 5336560 5336556 5336561 +
tgcatatcttgggacttgcctt

SEQ ID NO: 102786 - DNA, 22 bp, Artificial Sequence
  Synthetic oligonucleotide; CTG chr11 5336541 5336562 5336558 5336563 +
catatcttgggacttgccttcc

SEQ ID NO: 102787 - DNA, 22 bp, Artificial Sequence
  Synthetic oligonucleotide; CTT chr11 5336549 5336570 5336566 5336571 +
gggacttgccttcctccataat

SEQ ID NO: 102788 - DNA, 22 bp, Artificial Sequence
  Synthetic oligonucleotide; TTG chr11 5336550 5336571 5336567 5336572 +
ggacttgccttcctccataatc

SEQ ID NO: 102789 - DNA, 22 bp, Artificial Sequence
  Synthetic oligonucleotide; CTT chr11 5336556 5336577 5336573 5336578 +
gccttcctccataatcacatct

SEQ ID NO: 102790 - DNA, 22 bp, Artificial Sequence
  Synthetic oligonucleotide; TTG chr11 5336557 5336578 5336574 5336579 +
ccttcctccataatcacatctg

SEQ ID NO: 102791 - DNA, 22 bp, Artificial Sequence
  Synthetic oligonucleotide; CTT chr11 5336561 5336582 5336578 5336583 +
cctccataatcacatctgctat

SEQ ID NO: 102792 - DNA, 22 bp, Artificial Sequence
  Synthetic oligonucleotide; TTC chr11 5336562 5336583 5336579 5336584 +
ctccataatcacatctgctatt

SEQ ID NO: 102793 - DNA, 22 bp, Artificial Sequence
  Synthetic oligonucleotide; CTC chr11 5336565 5336586 5336582 5336587 +
cataatcacatctgctatttcc

SEQ ID NO: 102794 - DNA, 22 bp, Artificial Sequence
  Synthetic oligonucleotide; CTG chr11 5336579 5336600 5336596 5336601 +
ctatttccttatattaggttgg

SEQ ID NO: 102795 - DNA, 22 bp, Artificial Sequence
  Synthetic oligonucleotide; CTA chr11 5336582 5336603 5336599 5336604 +
tttccttatattaggttggtgc

SEQ ID NO: 102796 - DNA, 22 bp, Artificial Sequence
  Synthetic oligonucleotide; TTT chr11 5336585 5336606 5336602 5336607 +
ccttatattaggttggtgcaac

SEQ ID NO: 102797 - DNA, 22 bp, Artificial Sequence
  Synthetic oligonucleotide; TTC chr11 5336586 5336607 5336603 5336608 +
cttatattaggttggtgcaaca

SEQ ID NO: 102798 - DNA, 22 bp, Artificial Sequence
  Synthetic oligonucleotide; CTT chr11 5336589 5336610 5336606 5336611 +
atattaggttggtgcaacagta

SEQ ID NO: 102799 - DNA, 22 bp, Artificial Sequence
  Synthetic oligonucleotide; TTA chr11 5336590 5336611 5336607 5336612 +
tattaggttggtgcaacagtaa

SEQ ID NO: 102800 - DNA, 22 bp, Artificial Sequence
  Synthetic oligonucleotide; TTA chr11 5336595 5336616 5336612 5336617 +
ggttggtgcaacagtaattgca

SEQ ID NO: 102801 - DNA, 22 bp, Artificial Sequence
  Synthetic oligonucleotide; TTG chr11 5336600 5336621 5336617 5336622 +
gtgcaacagtaattgcagtttt

SEQ ID NO: 102802 - DNA, 22 bp, Artificial Sequence
  Synthetic oligonucleotide; TTG chr11 5336615 5336636 5336632 5336637 +
cagtttttgccattattttttt

SEQ ID NO: 102803 - DNA, 22 bp, Artificial Sequence
  Synthetic oligonucleotide; TTT chr11 5336621 5336642 5336638 5336643 +
ttgccattatttttttttaatg

SEQ ID NO: 102804 - DNA, 22 bp, Artificial Sequence
  Synthetic oligonucleotide; TTT chr11 5336622 5336643 5336639 5336644 +
tgccattatttttttttaatgc

SEQ ID NO: 102805 - DNA, 22 bp, Artificial Sequence
  Synthetic oligonucleotide; TTT chr11 5336623 5336644 5336640 5336645 +
gccattatttttttttaatgca

SEQ ID NO: 102806 - DNA, 22 bp, Artificial Sequence
  Synthetic oligonucleotide; TTG chr11 5336624 5336645 5336641 5336646 +
ccattatttttttttaatgcag

SEQ ID NO: 102807 - DNA, 22 bp, Artificial Sequence
  Synthetic oligonucleotide; TTA chr11 5336630 5336651 5336647 5336652 +
tttttttttaatgcagtgaatt

SEQ ID NO: 102808 - DNA, 22 bp, Artificial Sequence
  Synthetic oligonucleotide; TTT chr11 5336633 5336654 5336650 5336655 +
ttttttaatgcagtgaattaca

SEQ ID NO: 102809 - DNA, 22 bp, Artificial Sequence
  Synthetic oligonucleotide; TTT chr11 5336634 5336655 5336651 5336656 +
tttttaatgcagtgaattacat

SEQ ID NO: 102810 - DNA, 22 bp, Artificial Sequence
  Synthetic oligonucleotide; TTT chr11 5336635 5336656 5336652 5336657 +
ttttaatgcagtgaattacatt

SEQ ID NO: 102811 - DNA, 22 bp, Artificial Sequence
  Synthetic oligonucleotide; TTT chr11 5336636 5336657 5336653 5336658 +
tttaatgcagtgaattacattt

SEQ ID NO: 102812 - DNA, 22 bp, Artificial Sequence
  Synthetic oligonucleotide; TTT chr11 5336637 5336658 5336654 5336659 +
ttaatgcagtgaattacattta

SEQ ID NO: 102813 - DNA, 22 bp, Artificial Sequence
  Synthetic oligonucleotide; TTT chr11 5336638 5336659 5336655 5336660 +
taatgcagtgaattacatttat

SEQ ID NO: 102814 - DNA, 22 bp, Artificial Sequence
  Synthetic oligonucleotide; TTT chr11 5336639 5336660 5336656 5336661 +
aatgcagtgaattacatttatt

SEQ ID NO: 102815 - DNA, 22 bp, Artificial Sequence
  Synthetic oligonucleotide; TTA chr11 5336640 5336661 5336657 5336662 +
atgcagtgaattacatttatta

SEQ ID NO: 102816 - DNA, 22 bp, Artificial Sequence
  Synthetic oligonucleotide; TTA chr11 5336653 5336674 5336670 5336675 +
catttattaatttccatatttt

SEQ ID NO: 102817 - DNA, 22 bp, Artificial Sequence
  Synthetic oligonucleotide; TTT chr11 5336658 5336679 5336675 5336680 +
attaatttccatatttttatgt

SEQ ID NO: 102818 - DNA, 22 bp, Artificial Sequence
  Synthetic oligonucleotide; TTA chr11 5336659 5336680 5336676 5336681 +
ttaatttccatatttttatgta

SEQ ID NO: 102819 - DNA, 22 bp, Artificial Sequence
  Synthetic oligonucleotide; TTA chr11 5336662 5336683 5336679 5336684 +
atttccatatttttatgtacat

SEQ ID NO: 102820 - DNA, 22 bp, Artificial Sequence
  Synthetic oligonucleotide; TTT chr11 5336666 5336687 5336683 5336688 +
ccatatttttatgtacattcaa

SEQ ID NO: 102821 - DNA, 22 bp, Artificial Sequence
  Synthetic oligonucleotide; TTC chr11 5336667 5336688 5336684 5336689 +
catatttttatgtacattcaat

SEQ ID NO: 102822 - DNA, 22 bp, Artificial Sequence
  Synthetic oligonucleotide; TTT chr11 5336674 5336695 5336691 5336696 +
ttatgtacattcaattttttta

SEQ ID NO: 102823 - DNA, 22 bp, Artificial Sequence
  Synthetic oligonucleotide; TTT chr11 5336675 5336696 5336692 5336697 +
tatgtacattcaatttttttaa

SEQ ID NO: 102824 - DNA, 22 bp, Artificial Sequence
  Synthetic oligonucleotide; TTT chr11 5336676 5336697 5336693 5336698 +
atgtacattcaatttttttaat

SEQ ID NO: 102825 - DNA, 22 bp, Artificial Sequence
  Synthetic oligonucleotide; TTA chr11 5336677 5336698 5336694 5336699 +
tgtacattcaatttttttaatt

SEQ ID NO: 102826 - DNA, 22 bp, Artificial Sequence
  Synthetic oligonucleotide; TTC chr11 5336686 5336707 5336703 5336708 +
aatttttttaatttttaagttc

SEQ ID NO: 102827 - DNA, 22 bp, Artificial Sequence
  Synthetic oligonucleotide; TTT chr11 5336691 5336712 5336708 5336713 +
ttttaatttttaagttctgagg

SEQ ID NO: 102828 - DNA, 22 bp, Artificial Sequence
  Synthetic oligonucleotide; TTT chr11 5336692 5336713 5336709 5336714 +
tttaatttttaagttctgaggt

SEQ ID NO: 102829 - DNA, 22 bp, Artificial Sequence
  Synthetic oligonucleotide; TTT chr11 5336693 5336714 5336710 5336715 +
ttaatttttaagttctgaggta

SEQ ID NO: 102830 - DNA, 22 bp, Artificial Sequence
  Synthetic oligonucleotide; TTT chr11 5336694 5336715 5336711 5336716 +
taatttttaagttctgaggtac

SEQ ID NO: 102831 - DNA, 22 bp, Artificial Sequence
  Synthetic oligonucleotide; TTT chr11 5336695 5336716 5336712 5336717 +
aatttttaagttctgaggtaca

SEQ ID NO: 102832 - DNA, 22 bp, Artificial Sequence
  Synthetic oligonucleotide; TTA chr11 5336696 5336717 5336713 5336718 +
atttttaagttctgaggtacat

SEQ ID NO: 102833 - DNA, 22 bp, Artificial Sequence
  Synthetic oligonucleotide; TTT chr11 5336700 5336721 5336717 5336722 +
ttaagttctgaggtacatgtgc

SEQ ID NO: 102834 - DNA, 22 bp, Artificial Sequence
  Synthetic oligonucleotide; TTT chr11 5336701 5336722 5336718 5336723 +
taagttctgaggtacatgtgca

SEQ ID NO: 102835 - DNA, 22 bp, Artificial Sequence
  Synthetic oligonucleotide; TTT chr11 5336702 5336723 5336719 5336724 +
aagttctgaggtacatgtgcag

SEQ ID NO: 102836 - DNA, 22 bp, Artificial Sequence
  Synthetic oligonucleotide; TTA chr11 5336703 5336724 5336720 5336725 +
agttctgaggtacatgtgcagg

SEQ ID NO: 102837 - DNA, 22 bp, Artificial Sequence
  Synthetic oligonucleotide; TTC chr11 5336708 5336729 5336725 5336730 +
tgaggtacatgtgcaggatgtg

SEQ ID NO: 102838 - DNA, 22 bp, Artificial Sequence
  Synthetic oligonucleotide; CTG chr11 5336710 5336731 5336727 5336732 +
aggtacatgtgcaggatgtgca

SEQ ID NO: 102839 - DNA, 22 bp, Artificial Sequence
  Synthetic oligonucleotide; TTT chr11 5336737 5336758 5336754 5336759 +
attacatacgtaaatgtgtgca

SEQ ID NO: 102840 - DNA, 22 bp, Artificial Sequence
  Synthetic oligonucleotide; TTA chr11 5336738 5336759 5336755 5336760 +
ttacatacgtaaatgtgtgcaa

SEQ ID NO: 102841 - DNA, 22 bp, Artificial Sequence
  Synthetic oligonucleotide; TTA chr11 5336741 5336762 5336758 5336763 +
catacgtaaatgtgtgcaatgg

SEQ ID NO: 102842 - DNA, 22 bp, Artificial Sequence
  Synthetic oligonucleotide; TTT chr11 5336769 5336790 5336786 5336791 +
gctgtacctatcaacccatcac

SEQ ID NO: 102843 - DNA, 22 bp, Artificial Sequence
  Synthetic oligonucleotide; TTG chr11 5336770 5336791 5336787 5336792 +
ctgtacctatcaacccatcacc

SEQ ID NO: 102844 - DNA, 22 bp, Artificial Sequence
  Synthetic oligonucleotide; CTG chr11 5336773 5336794 5336790 5336795 +
tacctatcaacccatcacctag

SEQ ID NO: 102845 - DNA, 22 bp, Artificial Sequence
  Synthetic oligonucleotide; CTA chr11 5336779 5336800 5336796 5336801 +
tcaacccatcacctaggtgtta

SEQ ID NO: 102846 - DNA, 22 bp, Artificial Sequence
  Synthetic oligonucleotide; CTA chr11 5336794 5336815 5336811 5336816 +
ggtgttaagcccagcatgcatt

SEQ ID NO: 102847 - DNA, 22 bp, Artificial Sequence
  Synthetic oligonucleotide; TTA chr11 5336801 5336822 5336818 5336823 +
agcccagcatgcattagctatt

SEQ ID NO: 102848 - DNA, 22 bp, Artificial Sequence
  Synthetic oligonucleotide; TTA chr11 5336817 5336838 5336834 5336839 +
gctattttttctaatgctcccc

SEQ ID NO: 102849 - DNA, 22 bp, Artificial Sequence
  Synthetic oligonucleotide; CTA chr11 5336821 5336842 5336838 5336843 +
ttttttctaatgctccccttca

SEQ ID NO: 102850 - DNA, 22 bp, Artificial Sequence
  Synthetic oligonucleotide; TTT chr11 5336824 5336845 5336841 5336846 +
tttctaatgctccccttcacca

SEQ ID NO: 102851 - DNA, 22 bp, Artificial Sequence
  Synthetic oligonucleotide; TTT chr11 5336825 5336846 5336842 5336847 +
ttctaatgctccccttcaccac

SEQ ID NO: 102852 - DNA, 22 bp, Artificial Sequence
  Synthetic oligonucleotide; TTT chr11 5336826 5336847 5336843 5336848 +
tctaatgctccccttcaccaca

SEQ ID NO: 102853 - DNA, 22 bp, Artificial Sequence
  Synthetic oligonucleotide; TTT chr11 5336827 5336848 5336844 5336849 +
ctaatgctccccttcaccacac

SEQ ID NO: 102854 - DNA, 22 bp, Artificial Sequence
  Synthetic oligonucleotide; TTC chr11 5336828 5336849 5336845 5336850 +
taatgctccccttcaccacacc

SEQ ID NO: 102855 - DNA, 22 bp, Artificial Sequence
  Synthetic oligonucleotide; CTA chr11 5336830 5336851 5336847 5336852 +
atgctccccttcaccacacccc

SEQ ID NO: 102856 - DNA, 22 bp, Artificial Sequence
  Synthetic oligonucleotide; CTC chr11 5336836 5336857 5336853 5336858 +
cccttcaccacaccccatgccc

SEQ ID NO: 102857 - DNA, 22 bp, Artificial Sequence
  Synthetic oligonucleotide; CTT chr11 5336841 5336862 5336858 5336863 +
caccacaccccatgccctgaca

SEQ ID NO: 102858 - DNA, 22 bp, Artificial Sequence
  Synthetic oligonucleotide; TTC chr11 5336842 5336863 5336859 5336864 +
accacaccccatgccctgacag

SEQ ID NO: 102859 - DNA, 22 bp, Artificial Sequence
  Synthetic oligonucleotide; CTG chr11 5336860 5336881 5336877 5336882 +
acaggctccagtgtgtgttctt

SEQ ID NO: 102860 - DNA, 22 bp, Artificial Sequence
  Synthetic oligonucleotide; CTC chr11 5336868 5336889 5336885 5336890 +
cagtgtgtgttcttcccctcac

SEQ ID NO: 102861 - DNA, 22 bp, Artificial Sequence
  Synthetic oligonucleotide; TTC chr11 5336880 5336901 5336897 5336902 +
ttcccctcactgtttccatgtg

SEQ ID NO: 102862 - DNA, 22 bp, Artificial Sequence
  Synthetic oligonucleotide; CTT chr11 5336882 5336903 5336899 5336904 +
cccctcactgtttccatgtgtt

SEQ ID NO: 102863 - DNA, 22 bp, Artificial Sequence
  Synthetic oligonucleotide; TTC chr11 5336883 5336904 5336900 5336905 +
ccctcactgtttccatgtgttc

SEQ ID NO: 102864 - DNA, 22 bp, Artificial Sequence
  Synthetic oligonucleotide; CTC chr11 5336888 5336909 5336905 5336910 +
actgtttccatgtgttctcatt

SEQ ID NO: 102865 - DNA, 22 bp, Artificial Sequence
  Synthetic oligonucleotide; CTG chr11 5336892 5336913 5336909 5336914 +
tttccatgtgttctcattctca

SEQ ID NO: 102866 - DNA, 22 bp, Artificial Sequence
  Synthetic oligonucleotide; TTT chr11 5336895 5336916 5336912 5336917 +
ccatgtgttctcattctcattg

SEQ ID NO: 102867 - DNA, 22 bp, Artificial Sequence
  Synthetic oligonucleotide; TTC chr11 5336896 5336917 5336913 5336918 +
catgtgttctcattctcattgt

SEQ ID NO: 102868 - DNA, 22 bp, Artificial Sequence
  Synthetic oligonucleotide; TTC chr11 5336905 5336926 5336922 5336927 +
tcattctcattgttcagctccc

SEQ ID NO: 102869 - DNA, 22 bp, Artificial Sequence
  Synthetic oligonucleotide; CTC chr11 5336907 5336928 5336924 5336929 +
attctcattgttcagctcccac

SEQ ID NO: 102870 - DNA, 22 bp, Artificial Sequence
  Synthetic oligonucleotide; TTC chr11 5336911 5336932 5336928 5336933 +
tcattgttcagctcccacttct

SEQ ID NO: 102871 - DNA, 22 bp, Artificial Sequence
  Synthetic oligonucleotide; CTC chr11 5336913 5336934 5336930 5336935 +
attgttcagctcccacttctaa

SEQ ID NO: 102872 - DNA, 22 bp, Artificial Sequence
  Synthetic oligonucleotide; TTG chr11 5336917 5336938 5336934 5336939 +
ttcagctcccacttctaagtga

SEQ ID NO: 102873 - DNA, 22 bp, Artificial Sequence
  Synthetic oligonucleotide; TTC chr11 5336920 5336941 5336937 5336942 +
agctcccacttctaagtgagaa

SEQ ID NO: 102874 - DNA, 22 bp, Artificial Sequence
  Synthetic oligonucleotide; CTC chr11 5336925 5336946 5336942 5336947 +
ccacttctaagtgagaacatgt

SEQ ID NO: 102875 - DNA, 22 bp, Artificial Sequence
  Synthetic oligonucleotide; CTT chr11 5336931 5336952 5336948 5336953 +
ctaagtgagaacatgtggtgtt

SEQ ID NO: 102876 - DNA, 22 bp, Artificial Sequence
  Synthetic oligonucleotide; TTC chr11 5336932 5336953 5336949 5336954 +
taagtgagaacatgtggtgttt

SEQ ID NO: 102877 - DNA, 22 bp, Artificial Sequence
  Synthetic oligonucleotide; CTA chr11 5336934 5336955 5336951 5336956 +
agtgagaacatgtggtgtttgg

SEQ ID NO: 102878 - DNA, 22 bp, Artificial Sequence
  Synthetic oligonucleotide; TTT chr11 5336954 5336975 5336971 5336976 +
ggttttctgttcctgcattagt

SEQ ID NO: 102879 - DNA, 22 bp, Artificial Sequence
  Synthetic oligonucleotide; TTG chr11 5336955 5336976 5336972 5336977 +
gttttctgttcctgcattagtt

SEQ ID NO: 102880 - DNA, 22 bp, Artificial Sequence
  Synthetic oligonucleotide; TTT chr11 5336959 5336980 5336976 5336981 +
tctgttcctgcattagtttact

SEQ ID NO: 102881 - DNA, 22 bp, Artificial Sequence
  Synthetic oligonucleotide; TTT chr11 5336960 5336981 5336977 5336982 +
ctgttcctgcattagtttactg

SEQ ID NO: 102882 - DNA, 22 bp, Artificial Sequence
  Synthetic oligonucleotide; TTC chr11 5336961 5336982 5336978 5336983 +
tgttcctgcattagtttactga

SEQ ID NO: 102883 - DNA, 22 bp, Artificial Sequence
  Synthetic oligonucleotide; CTG chr11 5336963 5336984 5336980 5336985 +
ttcctgcattagtttactgaag

SEQ ID NO: 102884 - DNA, 22 bp, Artificial Sequence
  Synthetic oligonucleotide; TTC chr11 5336966 5336987 5336983 5336988 +
ctgcattagtttactgaagata

SEQ ID NO: 102885 - DNA, 22 bp, Artificial Sequence
  Synthetic oligonucleotide; CTG chr11 5336969 5336990 5336986 5336991 +
cattagtttactgaagataatg

SEQ ID NO: 102886 - DNA, 22 bp, Artificial Sequence
  Synthetic oligonucleotide; TTA chr11 5336974 5336995 5336991 5336996 +
gtttactgaagataatggcttt

SEQ ID NO: 102887 - DNA, 22 bp, Artificial Sequence
  Synthetic oligonucleotide; TTT chr11 5336978 5336999 5336995 5337000 +
actgaagataatggctttcggc

SEQ ID NO: 102888 - DNA, 22 bp, Artificial Sequence
  Synthetic oligonucleotide; TTA chr11 5336979 5337000 5336996 5337001 +
ctgaagataatggctttcggct

SEQ ID NO: 102889 - DNA, 22 bp, Artificial Sequence
  Synthetic oligonucleotide; CTG chr11 5336982 5337003 5336999 5337004 +
aagataatggctttcggctcca

SEQ ID NO: 102890 - DNA, 22 bp, Artificial Sequence
  Synthetic oligonucleotide; CTT chr11 5336995 5337016 5337012 5337017 +
tcggctccatccatgtcccagc

SEQ ID NO: 102891 - DNA, 22 bp, Artificial Sequence
  Synthetic oligonucleotide; TTT chr11 5336996 5337017 5337013 5337018 +
cggctccatccatgtcccagca

SEQ ID NO: 102892 - DNA, 22 bp, Artificial Sequence
  Synthetic oligonucleotide; TTC chr11 5336997 5337018 5337014 5337019 +
ggctccatccatgtcccagcaa

SEQ ID NO: 102893 - DNA, 22 bp, Artificial Sequence
  Synthetic oligonucleotide; CTC chr11 5337002 5337023 5337019 5337024 +
catccatgtcccagcaaagggc

SEQ ID NO: 102894 - DNA, 22 bp, Artificial Sequence
  Synthetic oligonucleotide; CTC chr11 5337032 5337053 5337049 5337054 +
atccctttttatggttagatag

SEQ ID NO: 102895 - DNA, 22 bp, Artificial Sequence
  Synthetic oligonucleotide; CTT chr11 5337039 5337060 5337056 5337061 +
tttatggttagatagtatttca

SEQ ID NO: 102896 - DNA, 22 bp, Artificial Sequence
  Synthetic oligonucleotide; TTT chr11 5337040 5337061 5337057 5337062 +
ttatggttagatagtatttcat

SEQ ID NO: 102897 - DNA, 22 bp, Artificial Sequence
  Synthetic oligonucleotide; TTT chr11 5337041 5337062 5337058 5337063 +
tatggttagatagtatttcatg

SEQ ID NO: 102898 - DNA, 22 bp, Artificial Sequence
  Synthetic oligonucleotide; TTT chr11 5337042 5337063 5337059 5337064 +
atggttagatagtatttcatgg

SEQ ID NO: 102899 - DNA, 22 bp, Artificial Sequence
  Synthetic oligonucleotide; TTA chr11 5337043 5337064 5337060 5337065 +
tggttagatagtatttcatggt

SEQ ID NO: 102900 - DNA, 22 bp, Artificial Sequence
  Synthetic oligonucleotide; TTA chr11 5337049 5337070 5337066 5337071 +
gatagtatttcatggtttatat

SEQ ID NO: 102901 - DNA, 22 bp, Artificial Sequence
  Synthetic oligonucleotide; TTT chr11 5337059 5337080 5337076 5337081 +
catggtttatatgtaccacatt

SEQ ID NO: 102902 - DNA, 22 bp, Artificial Sequence
  Synthetic oligonucleotide; TTC chr11 5337060 5337081 5337077 5337082 +
atggtttatatgtaccacattt

SEQ ID NO: 102903 - DNA, 22 bp, Artificial Sequence
  Synthetic oligonucleotide; TTT chr11 5337067 5337088 5337084 5337089 +
atatgtaccacattttttaaat

SEQ ID NO: 102904 - DNA, 22 bp, Artificial Sequence
  Synthetic oligonucleotide; TTA chr11 5337068 5337089 5337085 5337090 +
tatgtaccacattttttaaatt

SEQ ID NO: 102905 - DNA, 22 bp, Artificial Sequence
  Synthetic oligonucleotide; TTT chr11 5337082 5337103 5337099 5337104 +
tttaaattgtctatcattgatg

SEQ ID NO: 102906 - DNA, 22 bp, Artificial Sequence
  Synthetic oligonucleotide; TTT chr11 5337083 5337104 5337100 5337105 +
ttaaattgtctatcattgatgg

SEQ ID NO: 102907 - DNA, 22 bp, Artificial Sequence
  Synthetic oligonucleotide; TTT chr11 5337084 5337105 5337101 5337106 +
taaattgtctatcattgatggc

SEQ ID NO: 102908 - DNA, 22 bp, Artificial Sequence
  Synthetic oligonucleotide; TTT chr11 5337085 5337106 5337102 5337107 +
aaattgtctatcattgatggcc

SEQ ID NO: 102909 - DNA, 22 bp, Artificial Sequence
  Synthetic oligonucleotide; TTA chr11 5337086 5337107 5337103 5337108 +
aattgtctatcattgatggcca

SEQ ID NO: 102910 - DNA, 22 bp, Artificial Sequence
  Synthetic oligonucleotide; TTG chr11 5337091 5337112 5337108 5337113 +
tctatcattgatggccatttgg

SEQ ID NO: 102911 - DNA, 22 bp, Artificial Sequence
  Synthetic oligonucleotide; CTA chr11 5337095 5337116 5337112 5337117 +
tcattgatggccatttgggttg

SEQ ID NO: 102912 - DNA, 22 bp, Artificial Sequence
  Synthetic oligonucleotide; TTG chr11 5337101 5337122 5337118 5337123 +
atggccatttgggttgattcta

SEQ ID NO: 102913 - DNA, 22 bp, Artificial Sequence
  Synthetic oligonucleotide; TTT chr11 5337111 5337132 5337128 5337133 +
gggttgattctatgtctttgct

SEQ ID NO: 102914 - DNA, 22 bp, Artificial Sequence
  Synthetic oligonucleotide; TTG chr11 5337112 5337133 5337129 5337134 +
ggttgattctatgtctttgcta

SEQ ID NO: 102915 - DNA, 22 bp, Artificial Sequence
  Synthetic oligonucleotide; TTG chr11 5337117 5337138 5337134 5337139 +
attctatgtctttgctattgtg

SEQ ID NO: 102916 - DNA, 22 bp, Artificial Sequence
  Synthetic oligonucleotide; TTC chr11 5337121 5337142 5337138 5337143 +
tatgtctttgctattgtgaata

SEQ ID NO: 102917 - DNA, 22 bp, Artificial Sequence
  Synthetic oligonucleotide; CTA chr11 5337123 5337144 5337140 5337145 +
tgtctttgctattgtgaatagt

SEQ ID NO: 102918 - DNA, 22 bp, Artificial Sequence
  Synthetic oligonucleotide; CTT chr11 5337129 5337150 5337146 5337151 +
tgctattgtgaatagtgctaca

SEQ ID NO: 102919 - DNA, 22 bp, Artificial Sequence
  Synthetic oligonucleotide; TTT chr11 5337130 5337151 5337147 5337152 +
gctattgtgaatagtgctacaa

SEQ ID NO: 102920 - DNA, 22 bp, Artificial Sequence
  Synthetic oligonucleotide; TTG chr11 5337131 5337152 5337148 5337153 +
ctattgtgaatagtgctacaat

SEQ ID NO: 102921 - DNA, 22 bp, Artificial Sequence
  Synthetic oligonucleotide; CTA chr11 5337134 5337155 5337151 5337156 +
ttgtgaatagtgctacaatgaa

SEQ ID NO: 102922 - DNA, 22 bp, Artificial Sequence
  Synthetic oligonucleotide; TTG chr11 5337137 5337158 5337154 5337159 +
tgaatagtgctacaatgaacat

SEQ ID NO: 102923 - DNA, 22 bp, Artificial Sequence
  Synthetic oligonucleotide; CTA chr11 5337149 5337170 5337166 5337171 +
caatgaacatacatgtgcatgt

SEQ ID NO: 102924 - DNA, 22 bp, Artificial Sequence
  Synthetic oligonucleotide; CTT chr11 5337176 5337197 5337193 5337198 +
agtaatagaatgatttatactc

SEQ ID NO: 102925 - DNA, 22 bp, Artificial Sequence
  Synthetic oligonucleotide; TTA chr11 5337177 5337198 5337194 5337199 +
gtaatagaatgatttatactcc

SEQ ID NO: 102926 - DNA, 22 bp, Artificial Sequence
  Synthetic oligonucleotide; TTT chr11 5337192 5337213 5337209 5337214 +
atactcctttaggtatataccc

SEQ ID NO: 102927 - DNA, 22 bp, Artificial Sequence
  Synthetic oligonucleotide; TTA chr11 5337193 5337214 5337210 5337215 +
tactcctttaggtatataccca

SEQ ID NO: 102928 - DNA, 22 bp, Artificial Sequence
  Synthetic oligonucleotide; CTC chr11 5337198 5337219 5337215 5337220 +
ctttaggtatatacccagtaat

SEQ ID NO: 102929 - DNA, 22 bp, Artificial Sequence
  Synthetic oligonucleotide; CTT chr11 5337201 5337222 5337218 5337223 +
taggtatatacccagtaatggg

SEQ ID NO: 102930 - DNA, 22 bp, Artificial Sequence
  Synthetic oligonucleotide; TTT chr11 5337202 5337223 5337219 5337224 +
aggtatatacccagtaatggga

SEQ ID NO: 102931 - DNA, 22 bp, Artificial Sequence
  Synthetic oligonucleotide; TTA chr11 5337203 5337224 5337220 5337225 +
ggtatatacccagtaatgggat

SEQ ID NO: 102932 - DNA, 22 bp, Artificial Sequence
  Synthetic oligonucleotide; TTG chr11 5337227 5337248 5337244 5337249 +
tgaggtcaaatggtatttctgg

SEQ ID NO: 102933 - DNA, 22 bp, Artificial Sequence
  Synthetic oligonucleotide; TTT chr11 5337245 5337266 5337262 5337267 +
ctggttctaaatctttgaggaa

SEQ ID NO: 102934 - DNA, 22 bp, Artificial Sequence
  Synthetic oligonucleotide; TTC chr11 5337246 5337267 5337263 5337268 +
tggttctaaatctttgaggaat

SEQ ID NO: 102935 - DNA, 22 bp, Artificial Sequence
  Synthetic oligonucleotide; CTG chr11 5337248 5337269 5337265 5337270 +
gttctaaatctttgaggaattg

SEQ ID NO: 102936 - DNA, 22 bp, Artificial Sequence
  Synthetic oligonucleotide; TTC chr11 5337252 5337273 5337269 5337274 +
taaatctttgaggaattgccac

SEQ ID NO: 102937 - DNA, 22 bp, Artificial Sequence
  Synthetic oligonucleotide; CTA chr11 5337254 5337275 5337271 5337276 +
aatctttgaggaattgccacac

SEQ ID NO: 102938 - DNA, 22 bp, Artificial Sequence
  Synthetic oligonucleotide; CTT chr11 5337260 5337281 5337277 5337282 +
tgaggaattgccacactgtctt

SEQ ID NO: 102939 - DNA, 22 bp, Artificial Sequence
  Synthetic oligonucleotide; TTT chr11 5337261 5337282 5337278 5337283 +
gaggaattgccacactgtcttc

SEQ ID NO: 102940 - DNA, 22 bp, Artificial Sequence
  Synthetic oligonucleotide; TTG chr11 5337262 5337283 5337279 5337284 +
aggaattgccacactgtcttcc

SEQ ID NO: 102941 - DNA, 22 bp, Artificial Sequence
  Synthetic oligonucleotide; TTG chr11 5337270 5337291 5337287 5337292 +
ccacactgtcttccacaatggt

SEQ ID NO: 102942 - DNA, 22 bp, Artificial Sequence
  Synthetic oligonucleotide; CTG chr11 5337278 5337299 5337295 5337300 +
tcttccacaatggttgaattag

SEQ ID NO: 102943 - DNA, 22 bp, Artificial Sequence
  Synthetic oligonucleotide; CTT chr11 5337282 5337303 5337299 5337304 +
ccacaatggttgaattagttta

SEQ ID NO: 102944 - DNA, 22 bp, Artificial Sequence
  Synthetic oligonucleotide; TTC chr11 5337283 5337304 5337300 5337305 +
cacaatggttgaattagtttac

SEQ ID NO: 102945 - DNA, 22 bp, Artificial Sequence
  Synthetic oligonucleotide; TTG chr11 5337294 5337315 5337311 5337316 +
aattagtttacagtcccaccaa

SEQ ID NO: 102946 - DNA, 22 bp, Artificial Sequence
  Synthetic oligonucleotide; TTA chr11 5337299 5337320 5337316 5337321 +
gtttacagtcccaccaacagtg

SEQ ID NO: 102947 - DNA, 22 bp, Artificial Sequence
  Synthetic oligonucleotide; TTT chr11 5337303 5337324 5337320 5337325 +
acagtcccaccaacagtgtaaa

SEQ ID NO: 102948 - DNA, 22 bp, Artificial Sequence
  Synthetic oligonucleotide; TTA chr11 5337304 5337325 5337321 5337326 +
cagtcccaccaacagtgtaaaa

SEQ ID NO: 102949 - DNA, 22 bp, Artificial Sequence
  Synthetic oligonucleotide; TTC chr11 5337332 5337353 5337349 5337354 +
ctatttctctgcaaccttgcta

SEQ ID NO: 102950 - DNA, 22 bp, Artificial Sequence
  Synthetic oligonucleotide; CTA chr11 5337335 5337356 5337352 5337357 +
tttctctgcaaccttgctagca

SEQ ID NO: 102951 - DNA, 22 bp, Artificial Sequence
  Synthetic oligonucleotide; TTT chr11 5337338 5337359 5337355 5337360 +
ctctgcaaccttgctagcatct

SEQ ID NO: 102952 - DNA, 22 bp, Artificial Sequence
  Synthetic oligonucleotide; TTC chr11 5337339 5337360 5337356 5337361 +
tctgcaaccttgctagcatctg

SEQ ID NO: 102953 - DNA, 22 bp, Artificial Sequence
  Synthetic oligonucleotide; CTC chr11 5337341 5337362 5337358 5337363 +
tgcaaccttgctagcatctgtt

SEQ ID NO: 102954 - DNA, 22 bp, Artificial Sequence
  Synthetic oligonucleotide; CTG chr11 5337343 5337364 5337360 5337365 +
caaccttgctagcatctgttgt

SEQ ID NO: 102955 - DNA, 22 bp, Artificial Sequence
  Synthetic oligonucleotide; CTT chr11 5337350 5337371 5337367 5337372 +
gctagcatctgttgtttcttga

SEQ ID NO: 102956 - DNA, 22 bp, Artificial Sequence
  Synthetic oligonucleotide; TTG chr11 5337351 5337372 5337368 5337373 +
ctagcatctgttgtttcttgac

SEQ ID NO: 102957 - DNA, 22 bp, Artificial Sequence
  Synthetic oligonucleotide; CTA chr11 5337354 5337375 5337371 5337376 +
gcatctgttgtttcttgacttt

SEQ ID NO: 102958 - DNA, 22 bp, Artificial Sequence
  Synthetic oligonucleotide; CTG chr11 5337361 5337382 5337378 5337383 +
ttgtttcttgactttaaaaacc

SEQ ID NO: 102959 - DNA, 22 bp, Artificial Sequence
  Synthetic oligonucleotide; TTG chr11 5337364 5337385 5337381 5337386 +
tttcttgactttaaaaaccacc

SEQ ID NO: 102960 - DNA, 22 bp, Artificial Sequence
  Synthetic oligonucleotide; TTT chr11 5337367 5337388 5337384 5337389 +
cttgactttaaaaaccaccatt

SEQ ID NO: 102961 - DNA, 22 bp, Artificial Sequence
  Synthetic oligonucleotide; TTC chr11 5337368 5337389 5337385 5337390 +
ttgactttaaaaaccaccattc

SEQ ID NO: 102962 - DNA, 22 bp, Artificial Sequence
  Synthetic oligonucleotide; CTT chr11 5337370 5337391 5337387 5337392 +
gactttaaaaaccaccattctg

SEQ ID NO: 102963 - DNA, 22 bp, Artificial Sequence
  Synthetic oligonucleotide; TTG chr11 5337371 5337392 5337388 5337393 +
actttaaaaaccaccattctga

SEQ ID NO: 102964 - DNA, 22 bp, Artificial Sequence
  Synthetic oligonucleotide; CTT chr11 5337375 5337396 5337392 5337397 +
taaaaaccaccattctgactgg

SEQ ID NO: 102965 - DNA, 22 bp, Artificial Sequence
  Synthetic oligonucleotide; TTT chr11 5337376 5337397 5337393 5337398 +
aaaaaccaccattctgactggt

SEQ ID NO: 102966 - DNA, 22 bp, Artificial Sequence
  Synthetic oligonucleotide; TTA chr11 5337377 5337398 5337394 5337399 +
aaaaccaccattctgactggtg

SEQ ID NO: 102967 - DNA, 22 bp, Artificial Sequence
  Synthetic oligonucleotide; TTC chr11 5337390 5337411 5337407 5337412 +
tgactggtgtcagatggtattt

SEQ ID NO: 102968 - DNA, 22 bp, Artificial Sequence
  Synthetic oligonucleotide; CTG chr11 5337392 5337413 5337409 5337414 +
actggtgtcagatggtatttca

SEQ ID NO: 102969 - DNA, 22 bp, Artificial Sequence
  Synthetic oligonucleotide; CTG chr11 5337396 5337417 5337413 5337418 +
gtgtcagatggtatttcattgt

SEQ ID NO: 102970 - DNA, 22 bp, Artificial Sequence
  Synthetic oligonucleotide; TTT chr11 5337412 5337433 5337429 5337434 +
cattgtggttttgatttgcatt

SEQ ID NO: 102971 - DNA, 22 bp, Artificial Sequence
  Synthetic oligonucleotide; TTC chr11 5337413 5337434 5337430 5337435 +
attgtggttttgatttgcattt

SEQ ID NO: 102972 - DNA, 22 bp, Artificial Sequence
  Synthetic oligonucleotide; TTG chr11 5337417 5337438 5337434 5337439 +
tggttttgatttgcatttctct

SEQ ID NO: 102973 - DNA, 22 bp, Artificial Sequence
  Synthetic oligonucleotide; TTT chr11 5337423 5337444 5337440 5337445 +
tgatttgcatttctctaatgat

SEQ ID NO: 102974 - DNA, 22 bp, Artificial Sequence
  Synthetic oligonucleotide; TTT chr11 5337424 5337445 5337441 5337446 +
gatttgcatttctctaatgatc

SEQ ID NO: 102975 - DNA, 22 bp, Artificial Sequence
  Synthetic oligonucleotide; TTG chr11 5337425 5337446 5337442 5337447 +
atttgcatttctctaatgatca

SEQ ID NO: 102976 - DNA, 22 bp, Artificial Sequence
  Synthetic oligonucleotide; TTT chr11 5337429 5337450 5337446 5337451 +
gcatttctctaatgatcagtga

SEQ ID NO: 102977 - DNA, 22 bp, Artificial Sequence
  Synthetic oligonucleotide; TTG chr11 5337430 5337451 5337447 5337452 +
catttctctaatgatcagtgac

SEQ ID NO: 102978 - DNA, 22 bp, Artificial Sequence
  Synthetic oligonucleotide; TTT chr11 5337435 5337456 5337452 5337457 +
ctctaatgatcagtgacattga

SEQ ID NO: 102979 - DNA, 22 bp, Artificial Sequence
  Synthetic oligonucleotide; TTC chr11 5337436 5337457 5337453 5337458 +
tctaatgatcagtgacattgag

SEQ ID NO: 102980 - DNA, 22 bp, Artificial Sequence
  Synthetic oligonucleotide; CTC chr11 5337438 5337459 5337455 5337460 +
taatgatcagtgacattgagac

SEQ ID NO: 102981 - DNA, 22 bp, Artificial Sequence
  Synthetic oligonucleotide; CTA chr11 5337440 5337461 5337457 5337462 +
atgatcagtgacattgagactt

SEQ ID NO: 102982 - DNA, 22 bp, Artificial Sequence
  Synthetic oligonucleotide; TTG chr11 5337456 5337477 5337473 5337478 +
agacttttttcgtatgtttctt

SEQ ID NO: 102983 - DNA, 22 bp, Artificial Sequence
  Synthetic oligonucleotide; CTT chr11 5337462 5337483 5337479 5337484 +
ttttcgtatgtttcttagccac

SEQ ID NO: 102984 - DNA, 22 bp, Artificial Sequence
  Synthetic oligonucleotide; TTT chr11 5337463 5337484 5337480 5337485 +
tttcgtatgtttcttagccaca

SEQ ID NO: 102985 - DNA, 22 bp, Artificial Sequence
  Synthetic oligonucleotide; TTT chr11 5337464 5337485 5337481 5337486 +
ttcgtatgtttcttagccacat

SEQ ID NO: 102986 - DNA, 22 bp, Artificial Sequence
  Synthetic oligonucleotide; TTT chr11 5337465 5337486 5337482 5337487 +
tcgtatgtttcttagccacata

SEQ ID NO: 102987 - DNA, 22 bp, Artificial Sequence
  Synthetic oligonucleotide; TTT chr11 5337466 5337487 5337483 5337488 +
cgtatgtttcttagccacataa

SEQ ID NO: 102988 - DNA, 22 bp, Artificial Sequence
  Synthetic oligonucleotide; TTC chr11 5337467 5337488 5337484 5337489 +
gtatgtttcttagccacataaa

SEQ ID NO: 102989 - DNA, 22 bp, Artificial Sequence
  Synthetic oligonucleotide; TTT chr11 5337475 5337496 5337492 5337497 +
cttagccacataaatgtcttct

SEQ ID NO: 102990 - DNA, 22 bp, Artificial Sequence
  Synthetic oligonucleotide; TTC chr11 5337476 5337497 5337493 5337498 +
ttagccacataaatgtcttctt

SEQ ID NO: 102991 - DNA, 22 bp, Artificial Sequence
  Synthetic oligonucleotide; CTT chr11 5337478 5337499 5337495 5337500 +
agccacataaatgtcttctttt

SEQ ID NO: 102992 - DNA, 22 bp, Artificial Sequence
  Synthetic oligonucleotide; TTA chr11 5337479 5337500 5337496 5337501 +
gccacataaatgtcttcttttg

SEQ ID NO: 102993 - DNA, 22 bp, Artificial Sequence
  Synthetic oligonucleotide; CTT chr11 5337495 5337516 5337512 5337517 +
cttttgagaagtgtctgttcat

SEQ ID NO: 102994 - DNA, 22 bp, Artificial Sequence
  Synthetic oligonucleotide; TTC chr11 5337496 5337517 5337513 5337518 +
ttttgagaagtgtctgttcatg

SEQ ID NO: 102995 - DNA, 22 bp, Artificial Sequence
  Synthetic oligonucleotide; CTT chr11 5337498 5337519 5337515 5337520 +
ttgagaagtgtctgttcatgtc

SEQ ID NO: 102996 - DNA, 22 bp, Artificial Sequence
  Synthetic oligonucleotide; TTT chr11 5337499 5337520 5337516 5337521 +
tgagaagtgtctgttcatgtcc

SEQ ID NO: 102997 - DNA, 22 bp, Artificial Sequence
  Synthetic oligonucleotide; TTT chr11 5337500 5337521 5337517 5337522 +
gagaagtgtctgttcatgtcct

SEQ ID NO: 102998 - DNA, 22 bp, Artificial Sequence
  Synthetic oligonucleotide; TTG chr11 5337501 5337522 5337518 5337523 +
agaagtgtctgttcatgtcctt

SEQ ID NO: 102999 - DNA, 22 bp, Artificial Sequence
  Synthetic oligonucleotide; CTG chr11 5337512 5337533 5337529 5337534 +
ttcatgtcctttgcccactttt

SEQ ID NO: 103000 - DNA, 22 bp, Artificial Sequence
  Synthetic oligonucleotide; TTC chr11 5337515 5337536 5337532 5337537 +
atgtcctttgcccactttttaa

SEQ ID NO: 103001 - DNA, 22 bp, Artificial Sequence
  Synthetic oligonucleotide; CTT chr11 5337523 5337544 5337540 5337545 +
tgcccactttttaatggggttg

SEQ ID NO: 103002 - DNA, 22 bp, Artificial Sequence
  Synthetic oligonucleotide; TTT chr11 5337524 5337545 5337541 5337546 +
gcccactttttaatggggttgt

SEQ ID NO: 103003 - DNA, 22 bp, Artificial Sequence
  Synthetic oligonucleotide; TTG chr11 5337525 5337546 5337542 5337547 +
cccactttttaatggggttgtt

SEQ ID NO: 103004 - DNA, 22 bp, Artificial Sequence
  Synthetic oligonucleotide; CTT chr11 5337532 5337553 5337549 5337554 +
tttaatggggttgtttgtgtgt

SEQ ID NO: 103005 - DNA, 22 bp, Artificial Sequence
  Synthetic oligonucleotide; TTT chr11 5337533 5337554 5337550 5337555 +
ttaatggggttgtttgtgtgtt

SEQ ID NO: 103006 - DNA, 22 bp, Artificial Sequence
  Synthetic oligonucleotide; TTT chr11 5337534 5337555 5337551 5337556 +
taatggggttgtttgtgtgttt

SEQ ID NO: 103007 - DNA, 22 bp, Artificial Sequence
  Synthetic oligonucleotide; TTT chr11 5337535 5337556 5337552 5337557 +
aatggggttgtttgtgtgtttc

SEQ ID NO: 103008 - DNA, 22 bp, Artificial Sequence
  Synthetic oligonucleotide; TTA chr11 5337536 5337557 5337553 5337558 +
atggggttgtttgtgtgtttct

SEQ ID NO: 103009 - DNA, 22 bp, Artificial Sequence
  Synthetic oligonucleotide; TTG chr11 5337545 5337566 5337562 5337567 +
tttgtgtgtttcttttgtaaat

SEQ ID NO: 103010 - DNA, 22 bp, Artificial Sequence
  Synthetic oligonucleotide; TTT chr11 5337548 5337569 5337565 5337570 +
gtgtgtttcttttgtaaatatg

SEQ ID NO: 103011 - DNA, 22 bp, Artificial Sequence
  Synthetic oligonucleotide; TTG chr11 5337549 5337570 5337566 5337571 +
tgtgtttcttttgtaaatatgt

SEQ ID NO: 103012 - DNA, 22 bp, Artificial Sequence
  Synthetic oligonucleotide; TTT chr11 5337556 5337577 5337573 5337578 +
cttttgtaaatatgtctaagtt

SEQ ID NO: 103013 - DNA, 22 bp, Artificial Sequence
  Synthetic oligonucleotide; TTC chr11 5337557 5337578 5337574 5337579 +
ttttgtaaatatgtctaagttc

SEQ ID NO: 103014 - DNA, 22 bp, Artificial Sequence
  Synthetic oligonucleotide; CTT chr11 5337559 5337580 5337576 5337581 +
ttgtaaatatgtctaagttcct

SEQ ID NO: 103015 - DNA, 22 bp, Artificial Sequence
  Synthetic oligonucleotide; TTT chr11 5337560 5337581 5337577 5337582 +
tgtaaatatgtctaagttcctc

SEQ ID NO: 103016 - DNA, 22 bp, Artificial Sequence
  Synthetic oligonucleotide; TTT chr11 5337561 5337582 5337578 5337583 +
gtaaatatgtctaagttcctca

SEQ ID NO: 103017 - DNA, 22 bp, Artificial Sequence
  Synthetic oligonucleotide; TTG chr11 5337562 5337583 5337579 5337584 +
taaatatgtctaagttcctcat

SEQ ID NO: 103018 - DNA, 22 bp, Artificial Sequence
  Synthetic oligonucleotide; CTA chr11 5337574 5337595 5337591 5337596 +
agttcctcatagattctggata

SEQ ID NO: 103019 - DNA, 22 bp, Artificial Sequence
  Synthetic oligonucleotide; TTC chr11 5337579 5337600 5337596 5337601 +
ctcatagattctggatattaga

SEQ ID NO: 103020 - DNA, 22 bp, Artificial Sequence
  Synthetic oligonucleotide; CTC chr11 5337582 5337603 5337599 5337604 +
atagattctggatattagacct

SEQ ID NO: 103021 - DNA, 22 bp, Artificial Sequence
  Synthetic oligonucleotide; TTC chr11 5337590 5337611 5337607 5337612 +
tggatattagacctttgtcaga

SEQ ID NO: 103022 - DNA, 22 bp, Artificial Sequence
  Synthetic oligonucleotide; CTG chr11 5337592 5337613 5337609 5337614 +
gatattagacctttgtcagatg

SEQ ID NO: 103023 - DNA, 22 bp, Artificial Sequence
  Synthetic oligonucleotide; TTA chr11 5337599 5337620 5337616 5337621 +
gacctttgtcagatgggtagat

SEQ ID NO: 103024 - DNA, 22 bp, Artificial Sequence
  Synthetic oligonucleotide; CTT chr11 5337605 5337626 5337622 5337627 +
tgtcagatgggtagattgcaga

SEQ ID NO: 103025 - DNA, 22 bp, Artificial Sequence
  Synthetic oligonucleotide; TTT chr11 5337606 5337627 5337623 5337628 +
gtcagatgggtagattgcagaa

SEQ ID NO: 103026 - DNA, 22 bp, Artificial Sequence
  Synthetic oligonucleotide; TTG chr11 5337607 5337628 5337624 5337629 +
tcagatgggtagattgcagaaa

SEQ ID NO: 103027 - DNA, 22 bp, Artificial Sequence
  Synthetic oligonucleotide; TTG chr11 5337623 5337644 5337640 5337645 +
cagaaattttctcccattctgt

SEQ ID NO: 103028 - DNA, 22 bp, Artificial Sequence
  Synthetic oligonucleotide; TTT chr11 5337632 5337653 5337649 5337654 +
tctcccattctgtaggttgcct

SEQ ID NO: 103029 - DNA, 22 bp, Artificial Sequence
  Synthetic oligonucleotide; TTT chr11 5337633 5337654 5337650 5337655 +
ctcccattctgtaggttgcctg

SEQ ID NO: 103030 - DNA, 22 bp, Artificial Sequence
  Synthetic oligonucleotide; TTC chr11 5337634 5337655 5337651 5337656 +
tcccattctgtaggttgcctgt

SEQ ID NO: 103031 - DNA, 22 bp, Artificial Sequence
  Synthetic oligonucleotide; CTC chr11 5337636 5337657 5337653 5337658 +
ccattctgtaggttgcctgttc

SEQ ID NO: 103032 - DNA, 22 bp, Artificial Sequence
  Synthetic oligonucleotide; TTC chr11 5337642 5337663 5337659 5337664 +
tgtaggttgcctgttcgctctg

SEQ ID NO: 103033 - DNA, 22 bp, Artificial Sequence
  Synthetic oligonucleotide; CTG chr11 5337644 5337665 5337661 5337666 +
taggttgcctgttcgctctgat

SEQ ID NO: 103034 - DNA, 22 bp, Artificial Sequence
  Synthetic oligonucleotide; TTG chr11 5337651 5337672 5337668 5337673 +
cctgttcgctctgatgatagtt

SEQ ID NO: 103035 - DNA, 22 bp, Artificial Sequence
  Synthetic oligonucleotide; CTG chr11 5337655 5337676 5337672 5337677 +
ttcgctctgatgatagtttatt

SEQ ID NO: 103036 - DNA, 22 bp, Artificial Sequence
  Synthetic oligonucleotide; TTC chr11 5337658 5337679 5337675 5337680 +
gctctgatgatagtttattttg

SEQ ID NO: 103037 - DNA, 22 bp, Artificial Sequence
  Synthetic oligonucleotide; CTC chr11 5337662 5337683 5337679 5337684 +
tgatgatagtttattttgctgt

SEQ ID NO: 103038 - DNA, 22 bp, Artificial Sequence
  Synthetic oligonucleotide; CTG chr11 5337664 5337685 5337681 5337686 +
atgatagtttattttgctgttt

SEQ ID NO: 103039 - DNA, 22 bp, Artificial Sequence
  Synthetic oligonucleotide; TTT chr11 5337674 5337695 5337691 5337696 +
attttgctgtttagaagctctg

SEQ ID NO: 103040 - DNA, 22 bp, Artificial Sequence
  Synthetic oligonucleotide; TTA chr11 5337675 5337696 5337692 5337697 +
ttttgctgtttagaagctctgt

SEQ ID NO: 103041 - DNA, 22 bp, Artificial Sequence
  Synthetic oligonucleotide; TTT chr11 5337678 5337699 5337695 5337700 +
tgctgtttagaagctctgtatt

SEQ ID NO: 103042 - DNA, 22 bp, Artificial Sequence
  Synthetic oligonucleotide; TTT chr11 5337679 5337700 5337696 5337701 +
gctgtttagaagctctgtattt

SEQ ID NO: 103043 - DNA, 22 bp, Artificial Sequence
  Synthetic oligonucleotide; TTG chr11 5337680 5337701 5337697 5337702 +
ctgtttagaagctctgtattta

SEQ ID NO: 103044 - DNA, 22 bp, Artificial Sequence
  Synthetic oligonucleotide; CTG chr11 5337683 5337704 5337700 5337705 +
tttagaagctctgtatttaatt

SEQ ID NO: 103045 - DNA, 22 bp, Artificial Sequence
  Synthetic oligonucleotide; TTT chr11 5337686 5337707 5337703 5337708 +
agaagctctgtatttaattgta

SEQ ID NO: 103046 - DNA, 22 bp, Artificial Sequence
  Synthetic oligonucleotide; TTA chr11 5337687 5337708 5337704 5337709 +
gaagctctgtatttaattgtat

SEQ ID NO: 103047 - DNA, 22 bp, Artificial Sequence
  Synthetic oligonucleotide; CTC chr11 5337694 5337715 5337711 5337716 +
tgtatttaattgtatttttctt

SEQ ID NO: 103048 - DNA, 22 bp, Artificial Sequence
  Synthetic oligonucleotide; CTG chr11 5337696 5337717 5337713 5337718 +
tatttaattgtatttttcttta

SEQ ID NO: 103049 - DNA, 22 bp, Artificial Sequence
  Synthetic oligonucleotide; TTT chr11 5337701 5337722 5337718 5337723 +
aattgtatttttctttattttg

SEQ ID NO: 103050 - DNA, 22 bp, Artificial Sequence
  Synthetic oligonucleotide; TTA chr11 5337702 5337723 5337719 5337724 +
attgtatttttctttattttga

SEQ ID NO: 103051 - DNA, 22 bp, Artificial Sequence
  Synthetic oligonucleotide; TTG chr11 5337706 5337727 5337723 5337728 +
tatttttctttattttgagatg

SEQ ID NO: 103052 - DNA, 22 bp, Artificial Sequence
  Synthetic oligonucleotide; TTT chr11 5337711 5337732 5337728 5337733 +
ttctttattttgagatgaagtc

SEQ ID NO: 103053 - DNA, 22 bp, Artificial Sequence
  Synthetic oligonucleotide; TTT chr11 5337712 5337733 5337729 5337734 +
tctttattttgagatgaagtct

SEQ ID NO: 103054 - DNA, 22 bp, Artificial Sequence
  Synthetic oligonucleotide; TTT chr11 5337713 5337734 5337730 5337735 +
ctttattttgagatgaagtctc

SEQ ID NO: 103055 - DNA, 22 bp, Artificial Sequence
  Synthetic oligonucleotide; TTC chr11 5337714 5337735 5337731 5337736 +
tttattttgagatgaagtctca

SEQ ID NO: 103056 - DNA, 22 bp, Artificial Sequence
  Synthetic oligonucleotide; CTT chr11 5337716 5337737 5337733 5337738 +
tattttgagatgaagtctcact

SEQ ID NO: 103057 - DNA, 22 bp, Artificial Sequence
  Synthetic oligonucleotide; TTT chr11 5337717 5337738 5337734 5337739 +
attttgagatgaagtctcactc

SEQ ID NO: 103058 - DNA, 22 bp, Artificial Sequence
  Synthetic oligonucleotide; TTA chr11 5337718 5337739 5337735 5337740 +
ttttgagatgaagtctcactct

SEQ ID NO: 103059 - DNA, 22 bp, Artificial Sequence
  Synthetic oligonucleotide; TTT chr11 5337721 5337742 5337738 5337743 +
tgagatgaagtctcactctttc

SEQ ID NO: 103060 - DNA, 22 bp, Artificial Sequence
  Synthetic oligonucleotide; TTT chr11 5337722 5337743 5337739 5337744 +
gagatgaagtctcactctttca

SEQ ID NO: 103061 - DNA, 22 bp, Artificial Sequence
  Synthetic oligonucleotide; TTG chr11 5337723 5337744 5337740 5337745 +
agatgaagtctcactctttcac

SEQ ID NO: 103062 - DNA, 22 bp, Artificial Sequence
  Synthetic oligonucleotide; CTC chr11 5337735 5337756 5337752 5337757 +
actctttcacccatgctagagt

SEQ ID NO: 103063 - DNA, 22 bp, Artificial Sequence
  Synthetic oligonucleotide; CTC chr11 5337739 5337760 5337756 5337761 +
tttcacccatgctagagtgcag

SEQ ID NO: 103064 - DNA, 22 bp, Artificial Sequence
  Synthetic oligonucleotide; CTT chr11 5337741 5337762 5337758 5337763 +
tcacccatgctagagtgcagtg

SEQ ID NO: 103065 - DNA, 22 bp, Artificial Sequence
  Synthetic oligonucleotide; TTT chr11 5337742 5337763 5337759 5337764 +
cacccatgctagagtgcagtgg

SEQ ID NO: 103066 - DNA, 22 bp, Artificial Sequence
  Synthetic oligonucleotide; TTC chr11 5337743 5337764 5337760 5337765 +
acccatgctagagtgcagtggt

SEQ ID NO: 103067 - DNA, 22 bp, Artificial Sequence
  Synthetic oligonucleotide; CTA chr11 5337753 5337774 5337770 5337775 +
gagtgcagtggtgcgatctcag

SEQ ID NO: 103068 - DNA, 22 bp, Artificial Sequence
  Synthetic oligonucleotide; CTC chr11 5337773 5337794 5337790 5337795 +
agctcactgcaacctctgcctc

SEQ ID NO: 103069 - DNA, 22 bp, Artificial Sequence
  Synthetic oligonucleotide; CTC chr11 5337778 5337799 5337795 5337800 +
actgcaacctctgcctcctggg

SEQ ID NO: 103070 - DNA, 22 bp, Artificial Sequence
  Synthetic oligonucleotide; CTG chr11 5337782 5337803 5337799 5337804 +
caacctctgcctcctgggttca

SEQ ID NO: 103071 - DNA, 22 bp, Artificial Sequence
  Synthetic oligonucleotide; CTC chr11 5337789 5337810 5337806 5337811 +
tgcctcctgggttcaagcaatt

SEQ ID NO: 103072 - DNA, 22 bp, Artificial Sequence
  Synthetic oligonucleotide; CTG chr11 5337791 5337812 5337808 5337813 +
cctcctgggttcaagcaattct

SEQ ID NO: 103073 - DNA, 22 bp, Artificial Sequence
  Synthetic oligonucleotide; CTC chr11 5337795 5337816 5337812 5337817 +
ctgggttcaagcaattctcctg

SEQ ID NO: 103074 - DNA, 22 bp, Artificial Sequence
  Synthetic oligonucleotide; CTG chr11 5337798 5337819 5337815 5337820 +
ggttcaagcaattctcctgcct

SEQ ID NO: 103075 - DNA, 22 bp, Artificial Sequence
  Synthetic oligonucleotide; TTC chr11 5337803 5337824 5337820 5337825 +
aagcaattctcctgcctcagcc

SEQ ID NO: 103076 - DNA, 22 bp, Artificial Sequence
  Synthetic oligonucleotide; TTC chr11 5337812 5337833 5337829 5337834 +
tcctgcctcagcctcctgagta

SEQ ID NO: 103077 - DNA, 22 bp, Artificial Sequence
  Synthetic oligonucleotide; CTC chr11 5337814 5337835 5337831 5337836 +
ctgcctcagcctcctgagtagc

SEQ ID NO: 103078 - DNA, 22 bp, Artificial Sequence
  Synthetic oligonucleotide; CTG chr11 5337817 5337838 5337834 5337839 +
cctcagcctcctgagtagctga

SEQ ID NO: 103079 - DNA, 22 bp, Artificial Sequence
  Synthetic oligonucleotide; CTC chr11 5337821 5337842 5337838 5337843 +
agcctcctgagtagctgagatt

SEQ ID NO: 103080 - DNA, 22 bp, Artificial Sequence
  Synthetic oligonucleotide; CTC chr11 5337827 5337848 5337844 5337849 +
ctgagtagctgagattacaggt

SEQ ID NO: 103081 - DNA, 22 bp, Artificial Sequence
  Synthetic oligonucleotide; CTG chr11 5337830 5337851 5337847 5337852 +
agtagctgagattacaggtacg

SEQ ID NO: 103082 - DNA, 22 bp, Artificial Sequence
  Synthetic oligonucleotide; CTG chr11 5337838 5337859 5337855 5337860 +
agattacaggtacgcaccacca

SEQ ID NO: 103083 - DNA, 22 bp, Artificial Sequence
  Synthetic oligonucleotide; TTA chr11 5337844 5337865 5337861 5337866 +
caggtacgcaccaccataccca

SEQ ID NO: 103084 - DNA, 22 bp, Artificial Sequence
  Synthetic oligonucleotide; TTT chr11 5337874 5337895 5337891 5337896 +
tttgtatttttagtagagatgg

SEQ ID NO: 103085 - DNA, 22 bp, Artificial Sequence
  Synthetic oligonucleotide; TTT chr11 5337875 5337896 5337892 5337897 +
ttgtatttttagtagagatgga

SEQ ID NO: 103086 - DNA, 22 bp, Artificial Sequence
  Synthetic oligonucleotide; TTT chr11 5337876 5337897 5337893 5337898 +
tgtatttttagtagagatggag

SEQ ID NO: 103087 - DNA, 22 bp, Artificial Sequence
  Synthetic oligonucleotide; TTT chr11 5337877 5337898 5337894 5337899 +
gtatttttagtagagatggagt

SEQ ID NO: 103088 - DNA, 22 bp, Artificial Sequence
  Synthetic oligonucleotide; TTG chr11 5337878 5337899 5337895 5337900 +
tatttttagtagagatggagtt

SEQ ID NO: 103089 - DNA, 22 bp, Artificial Sequence
  Synthetic oligonucleotide; TTT chr11 5337883 5337904 5337900 5337905 +
ttagtagagatggagtttcacc

SEQ ID NO: 103090 - DNA, 22 bp, Artificial Sequence
  Synthetic oligonucleotide; TTT chr11 5337884 5337905 5337901 5337906 +
tagtagagatggagtttcacca

SEQ ID NO: 103091 - DNA, 22 bp, Artificial Sequence
  Synthetic oligonucleotide; TTT chr11 5337885 5337906 5337902 5337907 +
agtagagatggagtttcaccat

SEQ ID NO: 103092 - DNA, 22 bp, Artificial Sequence
  Synthetic oligonucleotide; TTA chr11 5337886 5337907 5337903 5337908 +
gtagagatggagtttcaccatg

SEQ ID NO: 103093 - DNA, 22 bp, Artificial Sequence
  Synthetic oligonucleotide; TTT chr11 5337901 5337922 5337918 5337923 +
caccatgttggccaggctgctc

SEQ ID NO: 103094 - DNA, 22 bp, Artificial Sequence
  Synthetic oligonucleotide; TTC chr11 5337902 5337923 5337919 5337924 +
accatgttggccaggctgctct

SEQ ID NO: 103095 - DNA, 22 bp, Artificial Sequence
  Synthetic oligonucleotide; TTG chr11 5337911 5337932 5337928 5337933 +
gccaggctgctcttatactccc

SEQ ID NO: 103096 - DNA, 22 bp, Artificial Sequence
  Synthetic oligonucleotide; CTG chr11 5337920 5337941 5337937 5337942 +
ctcttatactccccacctcaag

SEQ ID NO: 103097 - DNA, 22 bp, Artificial Sequence
  Synthetic oligonucleotide; CTC chr11 5337923 5337944 5337940 5337945 +
ttatactccccacctcaagtga

SEQ ID NO: 103098 - DNA, 22 bp, Artificial Sequence
  Synthetic oligonucleotide; CTT chr11 5337925 5337946 5337942 5337947 +
atactccccacctcaagtgatc

SEQ ID NO: 103099 - DNA, 22 bp, Artificial Sequence
  Synthetic oligonucleotide; TTA chr11 5337926 5337947 5337943 5337948 +
tactccccacctcaagtgatcc

SEQ ID NO: 103100 - DNA, 22 bp, Artificial Sequence
  Synthetic oligonucleotide; CTC chr11 5337931 5337952 5337948 5337953 +
cccacctcaagtgatccaccca

SEQ ID NO: 103101 - DNA, 22 bp, Artificial Sequence
  Synthetic oligonucleotide; CTC chr11 5337939 5337960 5337956 5337961 +
aagtgatccacccaccttggcc

SEQ ID NO: 103102 - DNA, 22 bp, Artificial Sequence
  Synthetic oligonucleotide; CTT chr11 5337957 5337978 5337974 5337979 +
ggcctcccaaagtgctgggatt

SEQ ID NO: 103103 - DNA, 22 bp, Artificial Sequence
  Synthetic oligonucleotide; TTG chr11 5337958 5337979 5337975 5337980 +
gcctcccaaagtgctgggatta

SEQ ID NO: 103104 - DNA, 22 bp, Artificial Sequence
  Synthetic oligonucleotide; CTC chr11 5337963 5337984 5337980 5337985 +
ccaaagtgctgggattacaggc

SEQ ID NO: 103105 - DNA, 22 bp, Artificial Sequence
  Synthetic oligonucleotide; CTG chr11 5337974 5337995 5337991 5337996 +
ggattacaggcgtgagccacca

SEQ ID NO: 103106 - DNA, 22 bp, Artificial Sequence
  Synthetic oligonucleotide; TTA chr11 5337980 5338001 5337997 5338002 +
caggcgtgagccaccatgcccg

SEQ ID NO: 103107 - DNA, 22 bp, Artificial Sequence
  Synthetic oligonucleotide; CTC chr11 5338007 5338028 5338024 5338029 +
tttagtttaattagatctcatt

SEQ ID NO: 103108 - DNA, 22 bp, Artificial Sequence
  Synthetic oligonucleotide; CTT chr11 5338009 5338030 5338026 5338031 +
tagtttaattagatctcatttg

SEQ ID NO: 103109 - DNA, 22 bp, Artificial Sequence
  Synthetic oligonucleotide; TTT chr11 5338010 5338031 5338027 5338032 +
agtttaattagatctcatttga

SEQ ID NO: 103110 - DNA, 22 bp, Artificial Sequence
  Synthetic oligonucleotide; TTA chr11 5338011 5338032 5338028 5338033 +
gtttaattagatctcatttgac

SEQ ID NO: 103111 - DNA, 22 bp, Artificial Sequence
  Synthetic oligonucleotide; TTT chr11 5338015 5338036 5338032 5338037 +
aattagatctcatttgacagtg

SEQ ID NO: 103112 - DNA, 22 bp, Artificial Sequence
  Synthetic oligonucleotide; TTA chr11 5338016 5338037 5338033 5338038 +
attagatctcatttgacagtgt

SEQ ID NO: 103113 - DNA, 22 bp, Artificial Sequence
  Synthetic oligonucleotide; TTA chr11 5338020 5338041 5338037 5338042 +
gatctcatttgacagtgtttgc

SEQ ID NO: 103114 - DNA, 22 bp, Artificial Sequence
  Synthetic oligonucleotide; CTC chr11 5338026 5338047 5338043 5338048 +
atttgacagtgtttgcttttgt

SEQ ID NO: 103115 - DNA, 22 bp, Artificial Sequence
  Synthetic oligonucleotide; TTT chr11 5338030 5338051 5338047 5338052 +
gacagtgtttgcttttgttgca

SEQ ID NO: 103116 - DNA, 22 bp, Artificial Sequence
  Synthetic oligonucleotide; TTG chr11 5338031 5338052 5338048 5338053 +
acagtgtttgcttttgttgcaa

SEQ ID NO: 103117 - DNA, 22 bp, Artificial Sequence
  Synthetic oligonucleotide; TTT chr11 5338040 5338061 5338057 5338062 +
gcttttgttgcaattgtttttg

SEQ ID NO: 103118 - DNA, 22 bp, Artificial Sequence
  Synthetic oligonucleotide; TTG chr11 5338041 5338062 5338058 5338063 +
cttttgttgcaattgtttttga

SEQ ID NO: 103119 - DNA, 22 bp, Artificial Sequence
  Synthetic oligonucleotide; CTT chr11 5338044 5338065 5338061 5338066 +
ttgttgcaattgtttttgacat

SEQ ID NO: 103120 - DNA, 22 bp, Artificial Sequence
  Synthetic oligonucleotide; TTT chr11 5338045 5338066 5338062 5338067 +
tgttgcaattgtttttgacatt

SEQ ID NO: 103121 - DNA, 22 bp, Artificial Sequence
  Synthetic oligonucleotide; TTT chr11 5338046 5338067 5338063 5338068 +
gttgcaattgtttttgacattt

SEQ ID NO: 103122 - DNA, 22 bp, Artificial Sequence
  Synthetic oligonucleotide; TTG chr11 5338047 5338068 5338064 5338069 +
ttgcaattgtttttgacatttt

SEQ ID NO: 103123 - DNA, 22 bp, Artificial Sequence
  Synthetic oligonucleotide; TTG chr11 5338050 5338071 5338067 5338072 +
caattgtttttgacattttcat

SEQ ID NO: 103124 - DNA, 22 bp, Artificial Sequence
  Synthetic oligonucleotide; TTG chr11 5338056 5338077 5338073 5338078 +
tttttgacattttcatcatgaa

SEQ ID NO: 103125 - DNA, 22 bp, Artificial Sequence
  Synthetic oligonucleotide; TTT chr11 5338059 5338080 5338076 5338081 +
ttgacattttcatcatgaaatc

SEQ ID NO: 103126 - DNA, 22 bp, Artificial Sequence
  Synthetic oligonucleotide; TTT chr11 5338060 5338081 5338077 5338082 +
tgacattttcatcatgaaatct

SEQ ID NO: 103127 - DNA, 22 bp, Artificial Sequence
  Synthetic oligonucleotide; TTT chr11 5338061 5338082 5338078 5338083 +
gacattttcatcatgaaatctt

SEQ ID NO: 103128 - DNA, 22 bp, Artificial Sequence
  Synthetic oligonucleotide; TTG chr11 5338062 5338083 5338079 5338084 +
acattttcatcatgaaatcttt

SEQ ID NO: 103129 - DNA, 22 bp, Artificial Sequence
  Synthetic oligonucleotide; TTT chr11 5338068 5338089 5338085 5338090 +
tcatcatgaaatctttgcctgt

SEQ ID NO: 103130 - DNA, 22 bp, Artificial Sequence
  Synthetic oligonucleotide; TTT chr11 5338069 5338090 5338086 5338091 +
catcatgaaatctttgcctgtg

SEQ ID NO: 103131 - DNA, 22 bp, Artificial Sequence
  Synthetic oligonucleotide; TTC chr11 5338070 5338091 5338087 5338092 +
atcatgaaatctttgcctgtgt

SEQ ID NO: 103132 - DNA, 22 bp, Artificial Sequence
  Synthetic oligonucleotide; CTT chr11 5338083 5338104 5338100 5338105 +
tgcctgtgtctatgtccggaat

SEQ ID NO: 103133 - DNA, 22 bp, Artificial Sequence
  Synthetic oligonucleotide; TTT chr11 5338084 5338105 5338101 5338106 +
gcctgtgtctatgtccggaatg

SEQ ID NO: 103134 - DNA, 22 bp, Artificial Sequence
  Synthetic oligonucleotide; TTG chr11 5338085 5338106 5338102 5338107 +
cctgtgtctatgtccggaatgg

SEQ ID NO: 103135 - DNA, 22 bp, Artificial Sequence
  Synthetic oligonucleotide; CTG chr11 5338089 5338110 5338106 5338111 +
tgtctatgtccggaatggtatt

SEQ ID NO: 103136 - DNA, 22 bp, Artificial Sequence
  Synthetic oligonucleotide; CTA chr11 5338095 5338116 5338112 5338117 +
tgtccggaatggtattgcctag

SEQ ID NO: 103137 - DNA, 22 bp, Artificial Sequence
  Synthetic oligonucleotide; TTG chr11 5338112 5338133 5338129 5338134 +
cctaggttttcttctaaagttt

SEQ ID NO: 103138 - DNA, 22 bp, Artificial Sequence
  Synthetic oligonucleotide; CTA chr11 5338116 5338137 5338133 5338138 +
ggttttcttctaaagtttttat

SEQ ID NO: 103139 - DNA, 22 bp, Artificial Sequence
  Synthetic oligonucleotide; TTT chr11 5338121 5338142 5338138 5338143 +
tcttctaaagtttttatagttt

SEQ ID NO: 103140 - DNA, 22 bp, Artificial Sequence
  Synthetic oligonucleotide; TTT chr11 5338122 5338143 5338139 5338144 +
cttctaaagtttttatagtttt

SEQ ID NO: 103141 - DNA, 22 bp, Artificial Sequence
  Synthetic oligonucleotide; TTC chr11 5338123 5338144 5338140 5338145 +
ttctaaagtttttatagttttg

SEQ ID NO: 103142 - DNA, 22 bp, Artificial Sequence
  Synthetic oligonucleotide; CTT chr11 5338125 5338146 5338142 5338147 +
ctaaagtttttatagttttggg

SEQ ID NO: 103143 - DNA, 22 bp, Artificial Sequence
  Synthetic oligonucleotide; TTC chr11 5338126 5338147 5338143 5338148 +
taaagtttttatagttttgggt

SEQ ID NO: 103144 - DNA, 22 bp, Artificial Sequence
  Synthetic oligonucleotide; CTA chr11 5338128 5338149 5338145 5338150 +
aagtttttatagttttgggttt

SEQ ID NO: 103145 - DNA, 22 bp, Artificial Sequence
  Synthetic oligonucleotide; TTT chr11 5338134 5338155 5338151 5338156 +
ttatagttttgggttttacact

SEQ ID NO: 103146 - DNA, 22 bp, Artificial Sequence
  Synthetic oligonucleotide; TTT chr11 5338135 5338156 5338152 5338157 +
tatagttttgggttttacactt

SEQ ID NO: 103147 - DNA, 22 bp, Artificial Sequence
  Synthetic oligonucleotide; TTT chr11 5338136 5338157 5338153 5338158 +
atagttttgggttttacactta

SEQ ID NO: 103148 - DNA, 22 bp, Artificial Sequence
  Synthetic oligonucleotide; TTA chr11 5338137 5338158 5338154 5338159 +
tagttttgggttttacacttaa

SEQ ID NO: 103149 - DNA, 22 bp, Artificial Sequence
  Synthetic oligonucleotide; TTT chr11 5338143 5338164 5338160 5338165 +
tgggttttacacttaagtcttt

SEQ ID NO: 103150 - DNA, 22 bp, Artificial Sequence
  Synthetic oligonucleotide; TTT chr11 5338144 5338165 5338161 5338166 +
gggttttacacttaagtcttta

SEQ ID NO: 103151 - DNA, 22 bp, Artificial Sequence
  Synthetic oligonucleotide; TTG chr11 5338145 5338166 5338162 5338167 +
ggttttacacttaagtctttaa

SEQ ID NO: 103152 - DNA, 22 bp, Artificial Sequence
  Synthetic oligonucleotide; TTT chr11 5338150 5338171 5338167 5338172 +
tacacttaagtctttaatgcat

SEQ ID NO: 103153 - DNA, 22 bp, Artificial Sequence
  Synthetic oligonucleotide; TTT chr11 5338151 5338172 5338168 5338173 +
acacttaagtctttaatgcatc

SEQ ID NO: 103154 - DNA, 22 bp, Artificial Sequence
  Synthetic oligonucleotide; TTA chr11 5338152 5338173 5338169 5338174 +
cacttaagtctttaatgcatct

SEQ ID NO: 103155 - DNA, 22 bp, Artificial Sequence
  Synthetic oligonucleotide; CTT chr11 5338157 5338178 5338174 5338179 +
aagtctttaatgcatcttgagt

SEQ ID NO: 103156 - DNA, 22 bp, Artificial Sequence
  Synthetic oligonucleotide; TTA chr11 5338158 5338179 5338175 5338180 +
agtctttaatgcatcttgagtt

SEQ ID NO: 103157 - DNA, 22 bp, Artificial Sequence
  Synthetic oligonucleotide; CTT chr11 5338164 5338185 5338181 5338186 +
taatgcatcttgagttaattta

SEQ ID NO: 103158 - DNA, 22 bp, Artificial Sequence
  Synthetic oligonucleotide; TTT chr11 5338165 5338186 5338182 5338187 +
aatgcatcttgagttaatttat

SEQ ID NO: 103159 - DNA, 22 bp, Artificial Sequence
  Synthetic oligonucleotide; TTA chr11 5338166 5338187 5338183 5338188 +
atgcatcttgagttaatttatg

SEQ ID NO: 103160 - DNA, 22 bp, Artificial Sequence
  Synthetic oligonucleotide; CTT chr11 5338175 5338196 5338192 5338197 +
gagttaatttatgtataagatg

SEQ ID NO: 103161 - DNA, 22 bp, Artificial Sequence
  Synthetic oligonucleotide; TTG chr11 5338176 5338197 5338193 5338198 +
agttaatttatgtataagatgt

SEQ ID NO: 103162 - DNA, 22 bp, Artificial Sequence
  Synthetic oligonucleotide; TTA chr11 5338181 5338202 5338198 5338203 +
atttatgtataagatgtaagga

SEQ ID NO: 103163 - DNA, 22 bp, Artificial Sequence
  Synthetic oligonucleotide; TTT chr11 5338185 5338206 5338202 5338207 +
atgtataagatgtaaggaaggg

SEQ ID NO: 103164 - DNA, 22 bp, Artificial Sequence
  Synthetic oligonucleotide; TTA chr11 5338186 5338207 5338203 5338208 +
tgtataagatgtaaggaagggg

SEQ ID NO: 103165 - DNA, 22 bp, Artificial Sequence
  Synthetic oligonucleotide; TTT chr11 5338216 5338237 5338233 5338238 +
caattttctgcatatggctagc

SEQ ID NO: 103166 - DNA, 22 bp, Artificial Sequence
  Synthetic oligonucleotide; TTC chr11 5338217 5338238 5338234 5338239 +
aattttctgcatatggctagcc

SEQ ID NO: 103167 - DNA, 22 bp, Artificial Sequence
  Synthetic oligonucleotide; TTT chr11 5338222 5338243 5338239 5338244 +
tctgcatatggctagccagttc

SEQ ID NO: 103168 - DNA, 22 bp, Artificial Sequence
  Synthetic oligonucleotide; TTT chr11 5338223 5338244 5338240 5338245 +
ctgcatatggctagccagttct

SEQ ID NO: 103169 - DNA, 22 bp, Artificial Sequence
  Synthetic oligonucleotide; TTC chr11 5338224 5338245 5338241 5338246 +
tgcatatggctagccagttctc

SEQ ID NO: 103170 - DNA, 22 bp, Artificial Sequence
  Synthetic oligonucleotide; CTG chr11 5338226 5338247 5338243 5338248 +
catatggctagccagttctccc

SEQ ID NO: 103171 - DNA, 22 bp, Artificial Sequence
  Synthetic oligonucleotide; CTA chr11 5338236 5338257 5338253 5338258 +
gccagttctcccagcacaattt

SEQ ID NO: 103172 - DNA, 22 bp, Artificial Sequence
  Synthetic oligonucleotide; TTC chr11 5338244 5338265 5338261 5338266 +
tcccagcacaatttataaaata

SEQ ID NO: 103173 - DNA, 22 bp, Artificial Sequence
  Synthetic oligonucleotide; CTC chr11 5338246 5338267 5338263 5338268 +
ccagcacaatttataaaatagg

SEQ ID NO: 103174 - DNA, 22 bp, Artificial Sequence
  Synthetic oligonucleotide; TTT chr11 5338258 5338279 5338275 5338280 +
ataaaatagggaatcccttccc

SEQ ID NO: 103175 - DNA, 22 bp, Artificial Sequence
  Synthetic oligonucleotide; TTA chr11 5338259 5338280 5338276 5338281 +
taaaatagggaatcccttcccc

SEQ ID NO: 103176 - DNA, 22 bp, Artificial Sequence
  Synthetic oligonucleotide; CTT chr11 5338277 5338298 5338294 5338299 +
ccccattacttgtttttaccag

SEQ ID NO: 103177 - DNA, 22 bp, Artificial Sequence
  Synthetic oligonucleotide; TTC chr11 5338278 5338299 5338295 5338300 +
cccattacttgtttttaccagg

SEQ ID NO: 103178 - DNA, 22 bp, Artificial Sequence
  Synthetic oligonucleotide; TTA chr11 5338285 5338306 5338302 5338307 +
cttgtttttaccaggtttgttg

SEQ ID NO: 103179 - DNA, 22 bp, Artificial Sequence
  Synthetic oligonucleotide; CTT chr11 5338288 5338309 5338305 5338310 +
gtttttaccaggtttgttgaag

SEQ ID NO: 103180 - DNA, 22 bp, Artificial Sequence
  Synthetic oligonucleotide; TTG chr11 5338289 5338310 5338306 5338311 +
tttttaccaggtttgttgaaga

SEQ ID NO: 103181 - DNA, 22 bp, Artificial Sequence
  Synthetic oligonucleotide; TTT chr11 5338292 5338313 5338309 5338314 +
ttaccaggtttgttgaagatca

SEQ ID NO: 103182 - DNA, 22 bp, Artificial Sequence
  Synthetic oligonucleotide; TTT chr11 5338293 5338314 5338310 5338315 +
taccaggtttgttgaagatcag

SEQ ID NO: 103183 - DNA, 22 bp, Artificial Sequence
  Synthetic oligonucleotide; TTT chr11 5338294 5338315 5338311 5338316 +
accaggtttgttgaagatcaga

SEQ ID NO: 103184 - DNA, 22 bp, Artificial Sequence
  Synthetic oligonucleotide; TTA chr11 5338295 5338316 5338312 5338317 +
ccaggtttgttgaagatcagat

SEQ ID NO: 103185 - DNA, 22 bp, Artificial Sequence
  Synthetic oligonucleotide; TTT chr11 5338303 5338324 5338320 5338325 +
gttgaagatcagattgtttcag

SEQ ID NO: 103186 - DNA, 22 bp, Artificial Sequence
  Synthetic oligonucleotide; TTG chr11 5338304 5338325 5338321 5338326 +
ttgaagatcagattgtttcaga

SEQ ID NO: 103187 - DNA, 22 bp, Artificial Sequence
  Synthetic oligonucleotide; TTG chr11 5338307 5338328 5338324 5338329 +
aagatcagattgtttcagatgc

SEQ ID NO: 103188 - DNA, 22 bp, Artificial Sequence
  Synthetic oligonucleotide; TTG chr11 5338319 5338340 5338336 5338341 +
tttcagatgcgcggtcttactt

SEQ ID NO: 103189 - DNA, 22 bp, Artificial Sequence
  Synthetic oligonucleotide; TTT chr11 5338322 5338343 5338339 5338344 +
cagatgcgcggtcttacttctg

SEQ ID NO: 103190 - DNA, 22 bp, Artificial Sequence
  Synthetic oligonucleotide; TTC chr11 5338323 5338344 5338340 5338345 +
agatgcgcggtcttacttctga

SEQ ID NO: 103191 - DNA, 22 bp, Artificial Sequence
  Synthetic oligonucleotide; CTT chr11 5338337 5338358 5338354 5338359 +
acttctgagttctccattctgt

SEQ ID NO: 103192 - DNA, 22 bp, Artificial Sequence
  Synthetic oligonucleotide; TTA chr11 5338338 5338359 5338355 5338360 +
cttctgagttctccattctgtt

SEQ ID NO: 103193 - DNA, 22 bp, Artificial Sequence
  Synthetic oligonucleotide; CTT chr11 5338341 5338362 5338358 5338363 +
ctgagttctccattctgttcca

SEQ ID NO: 103194 - DNA, 22 bp, Artificial Sequence
  Synthetic oligonucleotide; TTC chr11 5338342 5338363 5338359 5338364 +
tgagttctccattctgttccat

SEQ ID NO: 103195 - DNA, 22 bp, Artificial Sequence
  Synthetic oligonucleotide; CTG chr11 5338344 5338365 5338361 5338366 +
agttctccattctgttccatta

SEQ ID NO: 103196 - DNA, 22 bp, Artificial Sequence
  Synthetic oligonucleotide; TTC chr11 5338349 5338370 5338366 5338371 +
tccattctgttccattagtcag

SEQ ID NO: 103197 - DNA, 22 bp, Artificial Sequence
  Synthetic oligonucleotide; CTC chr11 5338351 5338372 5338368 5338373 +
cattctgttccattagtcagtg

SEQ ID NO: 103198 - DNA, 22 bp, Artificial Sequence
  Synthetic oligonucleotide; TTC chr11 5338356 5338377 5338373 5338378 +
tgttccattagtcagtgtgtct

SEQ ID NO: 103199 - DNA, 22 bp, Artificial Sequence
  Synthetic oligonucleotide; CTG chr11 5338358 5338379 5338375 5338380 +
ttccattagtcagtgtgtctgt

SEQ ID NO: 103200 - DNA, 22 bp, Artificial Sequence
  Synthetic oligonucleotide; TTC chr11 5338361 5338382 5338378 5338383 +
cattagtcagtgtgtctgtttg

SEQ ID NO: 103201 - DNA, 22 bp, Artificial Sequence
  Synthetic oligonucleotide; TTA chr11 5338366 5338387 5338383 5338388 +
gtcagtgtgtctgtttggtatc

SEQ ID NO: 103202 - DNA, 22 bp, Artificial Sequence
  Synthetic oligonucleotide; CTG chr11 5338379 5338400 5338396 5338401 +
tttggtatcagtaccatgctgt

SEQ ID NO: 103203 - DNA, 22 bp, Artificial Sequence
  Synthetic oligonucleotide; TTT chr11 5338382 5338403 5338399 5338404 +
ggtatcagtaccatgctgtttc

SEQ ID NO: 103204 - DNA, 22 bp, Artificial Sequence
  Synthetic oligonucleotide; TTG chr11 5338383 5338404 5338400 5338405 +
gtatcagtaccatgctgtttca

SEQ ID NO: 103205 - DNA, 22 bp, Artificial Sequence
  Synthetic oligonucleotide; CTG chr11 5338400 5338421 5338417 5338422 +
tttcagttagttactgtcacct

SEQ ID NO: 103206 - DNA, 22 bp, Artificial Sequence
  Synthetic oligonucleotide; TTT chr11 5338403 5338424 5338420 5338425 +
cagttagttactgtcaccttgt

SEQ ID NO: 103207 - DNA, 22 bp, Artificial Sequence
  Synthetic oligonucleotide; TTC chr11 5338404 5338425 5338421 5338426 +
agttagttactgtcaccttgta

SEQ ID NO: 103208 - DNA, 22 bp, Artificial Sequence
  Synthetic oligonucleotide; TTA chr11 5338409 5338430 5338426 5338431 +
gttactgtcaccttgtagtata

SEQ ID NO: 103209 - DNA, 22 bp, Artificial Sequence
  Synthetic oligonucleotide; TTA chr11 5338413 5338434 5338430 5338435 +
ctgtcaccttgtagtataattt

SEQ ID NO: 103210 - DNA, 22 bp, Artificial Sequence
  Synthetic oligonucleotide; CTG chr11 5338416 5338437 5338433 5338438 +
tcaccttgtagtataatttgaa

SEQ ID NO: 103211 - DNA, 22 bp, Artificial Sequence
  Synthetic oligonucleotide; CTT chr11 5338423 5338444 5338440 5338445 +
gtagtataatttgaagttgggt

SEQ ID NO: 103212 - DNA, 22 bp, Artificial Sequence
  Synthetic oligonucleotide; TTG chr11 5338424 5338445 5338441 5338446 +
tagtataatttgaagttgggta

SEQ ID NO: 103213 - DNA, 22 bp, Artificial Sequence
  Synthetic oligonucleotide; TTT chr11 5338435 5338456 5338452 5338457 +
gaagttgggtaaatcctgttga

SEQ ID NO: 103214 - DNA, 22 bp, Artificial Sequence
  Synthetic oligonucleotide; TTG chr11 5338436 5338457 5338453 5338458 +
aagttgggtaaatcctgttgat

SEQ ID NO: 103215 - DNA, 22 bp, Artificial Sequence
  Synthetic oligonucleotide; TTG chr11 5338442 5338463 5338459 5338464 +
ggtaaatcctgttgattctatt

SEQ ID NO: 103216 - DNA, 22 bp, Artificial Sequence
  Synthetic oligonucleotide; CTG chr11 5338453 5338474 5338470 5338475 +
ttgattctatttttctggagaa

SEQ ID NO: 103217 - DNA, 22 bp, Artificial Sequence
  Synthetic oligonucleotide; TTG chr11 5338456 5338477 5338473 5338478 +
attctatttttctggagaacca

SEQ ID NO: 103218 - DNA, 22 bp, Artificial Sequence
  Synthetic oligonucleotide; TTC chr11 5338460 5338481 5338477 5338482 +
tatttttctggagaaccatgac

SEQ ID NO: 103219 - DNA, 22 bp, Artificial Sequence
  Synthetic oligonucleotide; CTA chr11 5338462 5338483 5338479 5338484 +
tttttctggagaaccatgacta

SEQ ID NO: 103220 - DNA, 22 bp, Artificial Sequence
  Synthetic oligonucleotide; TTT chr11 5338465 5338486 5338482 5338487 +
ttctggagaaccatgactaaca

SEQ ID NO: 103221 - DNA, 22 bp, Artificial Sequence
  Synthetic oligonucleotide; TTT chr11 5338466 5338487 5338483 5338488 +
tctggagaaccatgactaacat

SEQ ID NO: 103222 - DNA, 22 bp, Artificial Sequence
  Synthetic oligonucleotide; TTT chr11 5338467 5338488 5338484 5338489 +
ctggagaaccatgactaacata

SEQ ID NO: 103223 - DNA, 22 bp, Artificial Sequence
  Synthetic oligonucleotide; TTC chr11 5338468 5338489 5338485 5338490 +
tggagaaccatgactaacatag

SEQ ID NO: 103224 - DNA, 22 bp, Artificial Sequence
  Synthetic oligonucleotide; CTG chr11 5338470 5338491 5338487 5338492 +
gagaaccatgactaacataggg

SEQ ID NO: 103225 - DNA, 22 bp, Artificial Sequence
  Synthetic oligonucleotide; CTA chr11 5338484 5338505 5338501 5338506 +
acatagggccatctatttttga

SEQ ID NO: 103226 - DNA, 22 bp, Artificial Sequence
  Synthetic oligonucleotide; CTA chr11 5338499 5338520 5338516 5338521 +
tttttgaggcactttgtgacta

SEQ ID NO: 103227 - DNA, 22 bp, Artificial Sequence
  Synthetic oligonucleotide; TTT chr11 5338502 5338523 5338519 5338524 +
ttgaggcactttgtgactaatc

SEQ ID NO: 103228 - DNA, 22 bp, Artificial Sequence
  Synthetic oligonucleotide; TTT chr11 5338503 5338524 5338520 5338525 +
tgaggcactttgtgactaatca

SEQ ID NO: 103229 - DNA, 22 bp, Artificial Sequence
  Synthetic oligonucleotide; TTT chr11 5338504 5338525 5338521 5338526 +
gaggcactttgtgactaatcac

SEQ ID NO: 103230 - DNA, 22 bp, Artificial Sequence
  Synthetic oligonucleotide; TTG chr11 5338505 5338526 5338522 5338527 +
aggcactttgtgactaatcact

SEQ ID NO: 103231 - DNA, 22 bp, Artificial Sequence
  Synthetic oligonucleotide; CTT chr11 5338513 5338534 5338530 5338535 +
tgtgactaatcactgtcatctg

SEQ ID NO: 103232 - DNA, 22 bp, Artificial Sequence
  Synthetic oligonucleotide; TTT chr11 5338514 5338535 5338531 5338536 +
gtgactaatcactgtcatctgt

SEQ ID NO: 103233 - DNA, 22 bp, Artificial Sequence
  Synthetic oligonucleotide; TTG chr11 5338515 5338536 5338532 5338537 +
tgactaatcactgtcatctgtc

SEQ ID NO: 103234 - DNA, 22 bp, Artificial Sequence
  Synthetic oligonucleotide; CTA chr11 5338521 5338542 5338538 5338543 +
atcactgtcatctgtcagtttg

SEQ ID NO: 103235 - DNA, 22 bp, Artificial Sequence
  Synthetic oligonucleotide; CTG chr11 5338528 5338549 5338545 5338550 +
tcatctgtcagtttggtggcat

SEQ ID NO: 103236 - DNA, 22 bp, Artificial Sequence
  Synthetic oligonucleotide; CTG chr11 5338535 5338556 5338552 5338557 +
tcagtttggtggcatgtacttg

SEQ ID NO: 103237 - DNA, 22 bp, Artificial Sequence
  Synthetic oligonucleotide; TTT chr11 5338542 5338563 5338559 5338564 +
ggtggcatgtacttgaaatcta

SEQ ID NO: 103238 - DNA, 22 bp, Artificial Sequence
  Synthetic oligonucleotide; TTG chr11 5338543 5338564 5338560 5338565 +
gtggcatgtacttgaaatctag

SEQ ID NO: 103239 - DNA, 22 bp, Artificial Sequence
  Synthetic oligonucleotide; CTT chr11 5338556 5338577 5338573 5338578 +
gaaatctagggacataaactcc

SEQ ID NO: 103240 - DNA, 22 bp, Artificial Sequence
  Synthetic oligonucleotide; TTG chr11 5338557 5338578 5338574 5338579 +
aaatctagggacataaactcct

SEQ ID NO: 103241 - DNA, 22 bp, Artificial Sequence
  Synthetic oligonucleotide; CTA chr11 5338564 5338585 5338581 5338586 +
gggacataaactcctaaatttc

SEQ ID NO: 103242 - DNA, 22 bp, Artificial Sequence
  Synthetic oligonucleotide; CTC chr11 5338577 5338598 5338594 5338599 +
ctaaatttcccataaaataaat

SEQ ID NO: 103243 - DNA, 22 bp, Artificial Sequence
  Synthetic oligonucleotide; CTA chr11 5338580 5338601 5338597 5338602 +
aatttcccataaaataaatttt

SEQ ID NO: 103244 - DNA, 22 bp, Artificial Sequence
  Synthetic oligonucleotide; TTT chr11 5338585 5338606 5338602 5338607 +
cccataaaataaattttgtcta

SEQ ID NO: 103245 - DNA, 22 bp, Artificial Sequence
  Synthetic oligonucleotide; TTC chr11 5338586 5338607 5338603 5338608 +
ccataaaataaattttgtctat

SEQ ID NO: 103246 - DNA, 22 bp, Artificial Sequence
  Synthetic oligonucleotide; TTT chr11 5338601 5338622 5338618 5338623 +
tgtctatgagtttattaataac

SEQ ID NO: 103247 - DNA, 22 bp, Artificial Sequence
  Synthetic oligonucleotide; TTT chr11 5338602 5338623 5338619 5338624 +
gtctatgagtttattaataaca

SEQ ID NO: 103248 - DNA, 22 bp, Artificial Sequence
  Synthetic oligonucleotide; TTG chr11 5338603 5338624 5338620 5338625 +
tctatgagtttattaataacaa

SEQ ID NO: 103249 - DNA, 22 bp, Artificial Sequence
  Synthetic oligonucleotide; CTA chr11 5338607 5338628 5338624 5338629 +
tgagtttattaataacaatgac

SEQ ID NO: 103250 - DNA, 22 bp, Artificial Sequence
  Synthetic oligonucleotide; TTT chr11 5338614 5338635 5338631 5338636 +
attaataacaatgactgtgtct

SEQ ID NO: 103251 - DNA, 22 bp, Artificial Sequence
  Synthetic oligonucleotide; TTA chr11 5338615 5338636 5338632 5338637 +
ttaataacaatgactgtgtcta

SEQ ID NO: 103252 - DNA, 22 bp, Artificial Sequence
  Synthetic oligonucleotide; TTA chr11 5338618 5338639 5338635 5338640 +
ataacaatgactgtgtctaagg

SEQ ID NO: 103253 - DNA, 22 bp, Artificial Sequence
  Synthetic oligonucleotide; CTG chr11 5338631 5338652 5338648 5338653 +
tgtctaaggatttaggctataa

SEQ ID NO: 103254 - DNA, 22 bp, Artificial Sequence
  Synthetic oligonucleotide; CTA chr11 5338637 5338658 5338654 5338659 +
aggatttaggctataaaatcaa

SEQ ID NO: 103255 - DNA, 22 bp, Artificial Sequence
  Synthetic oligonucleotide; TTT chr11 5338644 5338665 5338661 5338666 +
aggctataaaatcaaaaacaga

SEQ ID NO: 103256 - DNA, 22 bp, Artificial Sequence
  Synthetic oligonucleotide; TTA chr11 5338645 5338666 5338662 5338667 +
ggctataaaatcaaaaacagat

SEQ ID NO: 103257 - DNA, 22 bp, Artificial Sequence
  Synthetic oligonucleotide; CTA chr11 5338650 5338671 5338667 5338672 +
taaaatcaaaaacagatttaca

SEQ ID NO: 103258 - DNA, 22 bp, Artificial Sequence
  Synthetic oligonucleotide; TTT chr11 5338669 5338690 5338686 5338691 +
acattctttaattggacatgga

SEQ ID NO: 103259 - DNA, 22 bp, Artificial Sequence
  Synthetic oligonucleotide; TTA chr11 5338670 5338691 5338687 5338692 +
cattctttaattggacatggag

SEQ ID NO: 103260 - DNA, 22 bp, Artificial Sequence
  Synthetic oligonucleotide; TTC chr11 5338675 5338696 5338692 5338697 +
tttaattggacatggagacctc

SEQ ID NO: 103261 - DNA, 22 bp, Artificial Sequence
  Synthetic oligonucleotide; CTT chr11 5338677 5338698 5338694 5338699 +
taattggacatggagacctctg

SEQ ID NO: 103262 - DNA, 22 bp, Artificial Sequence
  Synthetic oligonucleotide; TTT chr11 5338678 5338699 5338695 5338700 +
aattggacatggagacctctgg

SEQ ID NO: 103263 - DNA, 22 bp, Artificial Sequence
  Synthetic oligonucleotide; TTA chr11 5338679 5338700 5338696 5338701 +
attggacatggagacctctggg

SEQ ID NO: 103264 - DNA, 22 bp, Artificial Sequence
  Synthetic oligonucleotide; TTG chr11 5338683 5338704 5338700 5338705 +
gacatggagacctctgggtcct

SEQ ID NO: 103265 - DNA, 22 bp, Artificial Sequence
  Synthetic oligonucleotide; CTC chr11 5338697 5338718 5338714 5338719 +
tgggtccttaatcatttctaat

SEQ ID NO: 103266 - DNA, 22 bp, Artificial Sequence
  Synthetic oligonucleotide; CTG chr11 5338699 5338720 5338716 5338721 +
ggtccttaatcatttctaatca

SEQ ID NO: 103267 - DNA, 22 bp, Artificial Sequence
  Synthetic oligonucleotide; CTT chr11 5338706 5338727 5338723 5338728 +
aatcatttctaatcatccttgc

SEQ ID NO: 103268 - DNA, 22 bp, Artificial Sequence
  Synthetic oligonucleotide; TTA chr11 5338707 5338728 5338724 5338729 +
atcatttctaatcatccttgct

SEQ ID NO: 103269 - DNA, 22 bp, Artificial Sequence
  Synthetic oligonucleotide; TTT chr11 5338714 5338735 5338731 5338736 +
ctaatcatccttgctgcccaat

SEQ ID NO: 103270 - DNA, 22 bp, Artificial Sequence
  Synthetic oligonucleotide; TTC chr11 5338715 5338736 5338732 5338737 +
taatcatccttgctgcccaatt

SEQ ID NO: 103271 - DNA, 22 bp, Artificial Sequence
  Synthetic oligonucleotide; CTA chr11 5338717 5338738 5338734 5338739 +
atcatccttgctgcccaattta

SEQ ID NO: 103272 - DNA, 22 bp, Artificial Sequence
  Synthetic oligonucleotide; CTT chr11 5338726 5338747 5338743 5338748 +
gctgcccaatttaatactcata

SEQ ID NO: 103273 - DNA, 22 bp, Artificial Sequence
  Synthetic oligonucleotide; TTG chr11 5338727 5338748 5338744 5338749 +
ctgcccaatttaatactcatat

SEQ ID NO: 103274 - DNA, 22 bp, Artificial Sequence
  Synthetic oligonucleotide; CTG chr11 5338730 5338751 5338747 5338752 +
cccaatttaatactcatataat

SEQ ID NO: 103275 - DNA, 22 bp, Artificial Sequence
  Synthetic oligonucleotide; TTT chr11 5338738 5338759 5338755 5338760 +
aatactcatataatctagtaag

SEQ ID NO: 103276 - DNA, 22 bp, Artificial Sequence
  Synthetic oligonucleotide; TTA chr11 5338739 5338760 5338756 5338761 +
atactcatataatctagtaagt

SEQ ID NO: 103277 - DNA, 22 bp, Artificial Sequence
  Synthetic oligonucleotide; CTC chr11 5338745 5338766 5338762 5338767 +
atataatctagtaagtatcttt

SEQ ID NO: 103278 - DNA, 22 bp, Artificial Sequence
  Synthetic oligonucleotide; CTA chr11 5338755 5338776 5338772 5338777 +
gtaagtatctttaaatatatca

SEQ ID NO: 103279 - DNA, 22 bp, Artificial Sequence
  Synthetic oligonucleotide; CTT chr11 5338766 5338787 5338783 5338788 +
taaatatatcacctttcattta

SEQ ID NO: 103280 - DNA, 22 bp, Artificial Sequence
  Synthetic oligonucleotide; TTT chr11 5338767 5338788 5338784 5338789 +
aaatatatcacctttcatttac

SEQ ID NO: 103281 - DNA, 22 bp, Artificial Sequence
  Synthetic oligonucleotide; TTA chr11 5338768 5338789 5338785 5338790 +
aatatatcacctttcatttacc

SEQ ID NO: 103282 - DNA, 22 bp, Artificial Sequence
  Synthetic oligonucleotide; CTT chr11 5338781 5338802 5338798 5338803 +
tcatttaccctataaaaatctg

SEQ ID NO: 103283 - DNA, 22 bp, Artificial Sequence
  Synthetic oligonucleotide; TTT chr11 5338782 5338803 5338799 5338804 +
catttaccctataaaaatctgc

SEQ ID NO: 103284 - DNA, 22 bp, Artificial Sequence
  Synthetic oligonucleotide; TTC chr11 5338783 5338804 5338800 5338805 +
atttaccctataaaaatctgca

SEQ ID NO: 103285 - DNA, 22 bp, Artificial Sequence
  Synthetic oligonucleotide; TTT chr11 5338787 5338808 5338804 5338809 +
accctataaaaatctgcatctc

SEQ ID NO: 103286 - DNA, 22 bp, Artificial Sequence
  Synthetic oligonucleotide; TTA chr11 5338788 5338809 5338805 5338810 +
ccctataaaaatctgcatctct

SEQ ID NO: 103287 - DNA, 22 bp, Artificial Sequence
  Synthetic oligonucleotide; CTA chr11 5338793 5338814 5338810 5338815 +
taaaaatctgcatctctggtga

SEQ ID NO: 103288 - DNA, 22 bp, Artificial Sequence
  Synthetic oligonucleotide; CTG chr11 5338803 5338824 5338820 5338825 +
catctctggtgaaggaacccag

SEQ ID NO: 103289 - DNA, 22 bp, Artificial Sequence
  Synthetic oligonucleotide; CTC chr11 5338809 5338830 5338826 5338831 +
tggtgaaggaacccagcaatta

SEQ ID NO: 103290 - DNA, 22 bp, Artificial Sequence
  Synthetic oligonucleotide; CTG chr11 5338811 5338832 5338828 5338833 +
gtgaaggaacccagcaattatt

SEQ ID NO: 103291 - DNA, 22 bp, Artificial Sequence
  Synthetic oligonucleotide; TTA chr11 5338831 5338852 5338848 5338853 +
tttgttaatgagaggaataaag

SEQ ID NO: 103292 - DNA, 22 bp, Artificial Sequence
  Synthetic oligonucleotide; TTT chr11 5338834 5338855 5338851 5338856 +
gttaatgagaggaataaagttc

SEQ ID NO: 103293 - DNA, 22 bp, Artificial Sequence
  Synthetic oligonucleotide; TTG chr11 5338835 5338856 5338852 5338857 +
ttaatgagaggaataaagttca

SEQ ID NO: 103294 - DNA, 22 bp, Artificial Sequence
  Synthetic oligonucleotide; TTA chr11 5338838 5338859 5338855 5338860 +
atgagaggaataaagttcatct

SEQ ID NO: 103295 - DNA, 22 bp, Artificial Sequence
  Synthetic oligonucleotide; TTC chr11 5338856 5338877 5338873 5338878 +
atcttccccttatctagtataa

SEQ ID NO: 103296 - DNA, 22 bp, Artificial Sequence
  Synthetic oligonucleotide; CTT chr11 5338861 5338882 5338878 5338883 +
ccccttatctagtataaattca

SEQ ID NO: 103297 - DNA, 22 bp, Artificial Sequence
  Synthetic oligonucleotide; TTC chr11 5338862 5338883 5338879 5338884 +
cccttatctagtataaattcat

SEQ ID NO: 103298 - DNA, 22 bp, Artificial Sequence
  Synthetic oligonucleotide; CTT chr11 5338867 5338888 5338884 5338889 +
atctagtataaattcattttat

SEQ ID NO: 103299 - DNA, 22 bp, Artificial Sequence
  Synthetic oligonucleotide; TTA chr11 5338868 5338889 5338885 5338890 +
tctagtataaattcattttata

SEQ ID NO: 103300 - DNA, 22 bp, Artificial Sequence
  Synthetic oligonucleotide; CTA chr11 5338872 5338893 5338889 5338894 +
gtataaattcattttatatggg

SEQ ID NO: 103301 - DNA, 22 bp, Artificial Sequence
  Synthetic oligonucleotide; TTC chr11 5338882 5338903 5338899 5338904 +
attttatatgggaggaaaagtg

SEQ ID NO: 103302 - DNA, 22 bp, Artificial Sequence
  Synthetic oligonucleotide; TTT chr11 5338886 5338907 5338903 5338908 +
tatatgggaggaaaagtgatct

SEQ ID NO: 103303 - DNA, 22 bp, Artificial Sequence
  Synthetic oligonucleotide; TTT chr11 5338887 5338908 5338904 5338909 +
atatgggaggaaaagtgatctg

SEQ ID NO: 103304 - DNA, 22 bp, Artificial Sequence
  Synthetic oligonucleotide; TTA chr11 5338888 5338909 5338905 5338910 +
tatgggaggaaaagtgatctgt

SEQ ID NO: 103305 - DNA, 22 bp, Artificial Sequence
  Synthetic oligonucleotide; CTG chr11 5338909 5338930 5338926 5338931 +
taaactcattagaccatacata

SEQ ID NO: 103306 - DNA, 22 bp, Artificial Sequence
  Synthetic oligonucleotide; CTC chr11 5338916 5338937 5338933 5338938 +
attagaccatacatattttttc

SEQ ID NO: 103307 - DNA, 22 bp, Artificial Sequence
  Synthetic oligonucleotide; TTA chr11 5338920 5338941 5338937 5338942 +
gaccatacatattttttcagtg

SEQ ID NO: 103308 - DNA, 22 bp, Artificial Sequence
  Synthetic oligonucleotide; TTT chr11 5338934 5338955 5338951 5338956 +
tttcagtgtgtctctaagattc

SEQ ID NO: 103309 - DNA, 22 bp, Artificial Sequence
  Synthetic oligonucleotide; TTT chr11 5338935 5338956 5338952 5338957 +
ttcagtgtgtctctaagattct

SEQ ID NO: 103310 - DNA, 22 bp, Artificial Sequence
  Synthetic oligonucleotide; TTT chr11 5338936 5338957 5338953 5338958 +
tcagtgtgtctctaagattctt

SEQ ID NO: 103311 - DNA, 22 bp, Artificial Sequence
  Synthetic oligonucleotide; TTT chr11 5338937 5338958 5338954 5338959 +
cagtgtgtctctaagattcttc

SEQ ID NO: 103312 - DNA, 22 bp, Artificial Sequence
  Synthetic oligonucleotide; TTC chr11 5338938 5338959 5338955 5338960 +
agtgtgtctctaagattcttcc

SEQ ID NO: 103313 - DNA, 22 bp, Artificial Sequence
  Synthetic oligonucleotide; CTC chr11 5338948 5338969 5338965 5338970 +
taagattcttccacgtcttctt

SEQ ID NO: 103314 - DNA, 22 bp, Artificial Sequence
  Synthetic oligonucleotide; CTA chr11 5338950 5338971 5338967 5338972 +
agattcttccacgtcttcttaa

SEQ ID NO: 103315 - DNA, 22 bp, Artificial Sequence
  Synthetic oligonucleotide; TTC chr11 5338956 5338977 5338973 5338978 +
ttccacgtcttcttaatcattt

SEQ ID NO: 103316 - DNA, 22 bp, Artificial Sequence
  Synthetic oligonucleotide; CTT chr11 5338958 5338979 5338975 5338980 +
ccacgtcttcttaatcatttct

SEQ ID NO: 103317 - DNA, 22 bp, Artificial Sequence
  Synthetic oligonucleotide; TTC chr11 5338959 5338980 5338976 5338981 +
cacgtcttcttaatcatttcta

SEQ ID NO: 103318 - DNA, 22 bp, Artificial Sequence
  Synthetic oligonucleotide; CTT chr11 5338967 5338988 5338984 5338989 +
cttaatcatttctaagattggc

SEQ ID NO: 103319 - DNA, 22 bp, Artificial Sequence
  Synthetic oligonucleotide; TTC chr11 5338968 5338989 5338985 5338990 +
ttaatcatttctaagattggct

SEQ ID NO: 103320 - DNA, 22 bp, Artificial Sequence
  Synthetic oligonucleotide; CTT chr11 5338970 5338991 5338987 5338992 +
aatcatttctaagattggctta

SEQ ID NO: 103321 - DNA, 22 bp, Artificial Sequence
  Synthetic oligonucleotide; TTA chr11 5338971 5338992 5338988 5338993 +
atcatttctaagattggcttag

SEQ ID NO: 103322 - DNA, 22 bp, Artificial Sequence
  Synthetic oligonucleotide; TTT chr11 5338978 5338999 5338995 5339000 +
ctaagattggcttagtctacag

SEQ ID NO: 103323 - DNA, 22 bp, Artificial Sequence
  Synthetic oligonucleotide; TTC chr11 5338979 5339000 5338996 5339001 +
taagattggcttagtctacaga

SEQ ID NO: 103324 - DNA, 22 bp, Artificial Sequence
  Synthetic oligonucleotide; CTA chr11 5338981 5339002 5338998 5339003 +
agattggcttagtctacagaaa

SEQ ID NO: 103325 - DNA, 22 bp, Artificial Sequence
  Synthetic oligonucleotide; TTG chr11 5338987 5339008 5339004 5339009 +
gcttagtctacagaaatgcaca

SEQ ID NO: 103326 - DNA, 22 bp, Artificial Sequence
  Synthetic oligonucleotide; CTT chr11 5338991 5339012 5339008 5339013 +
agtctacagaaatgcacactta

SEQ ID NO: 103327 - DNA, 22 bp, Artificial Sequence
  Synthetic oligonucleotide; TTA chr11 5338992 5339013 5339009 5339014 +
gtctacagaaatgcacacttag

SEQ ID NO: 103328 - DNA, 22 bp, Artificial Sequence
  Synthetic oligonucleotide; CTA chr11 5338997 5339018 5339014 5339019 +
cagaaatgcacacttagccttt

SEQ ID NO: 103329 - DNA, 22 bp, Artificial Sequence
  Synthetic oligonucleotide; CTT chr11 5339012 5339033 5339029 5339034 +
agcctttcatttcctgactcaa

SEQ ID NO: 103330 - DNA, 22 bp, Artificial Sequence
  Synthetic oligonucleotide; TTA chr11 5339013 5339034 5339030 5339035 +
gcctttcatttcctgactcaaa

SEQ ID NO: 103331 - DNA, 22 bp, Artificial Sequence
  Synthetic oligonucleotide; CTT chr11 5339018 5339039 5339035 5339040 +
tcatttcctgactcaaattaaa

SEQ ID NO: 103332 - DNA, 22 bp, Artificial Sequence
  Synthetic oligonucleotide; TTT chr11 5339019 5339040 5339036 5339041 +
catttcctgactcaaattaaat

SEQ ID NO: 103333 - DNA, 22 bp, Artificial Sequence
  Synthetic oligonucleotide; TTC chr11 5339020 5339041 5339037 5339042 +
atttcctgactcaaattaaata

SEQ ID NO: 103334 - DNA, 22 bp, Artificial Sequence
  Synthetic oligonucleotide; TTT chr11 5339024 5339045 5339041 5339046 +
cctgactcaaattaaatattct

SEQ ID NO: 103335 - DNA, 22 bp, Artificial Sequence
  Synthetic oligonucleotide; TTC chr11 5339025 5339046 5339042 5339047 +
ctgactcaaattaaatattctt

SEQ ID NO: 103336 - DNA, 22 bp, Artificial Sequence
  Synthetic oligonucleotide; CTG chr11 5339028 5339049 5339045 5339050 +
actcaaattaaatattcttatg

SEQ ID NO: 103337 - DNA, 22 bp, Artificial Sequence
  Synthetic oligonucleotide; CTC chr11 5339032 5339053 5339049 5339054 +
aaattaaatattcttatggtat

SEQ ID NO: 103338 - DNA, 22 bp, Artificial Sequence
  Synthetic oligonucleotide; TTA chr11 5339038 5339059 5339055 5339060 +
aatattcttatggtatgttatc

SEQ ID NO: 103339 - DNA, 22 bp, Artificial Sequence
  Synthetic oligonucleotide; TTC chr11 5339045 5339066 5339062 5339067 +
ttatggtatgttatcccttcaa

SEQ ID NO: 103340 - DNA, 22 bp, Artificial Sequence
  Synthetic oligonucleotide; CTT chr11 5339047 5339068 5339064 5339069 +
atggtatgttatcccttcaagc

SEQ ID NO: 103341 - DNA, 22 bp, Artificial Sequence
  Synthetic oligonucleotide; TTA chr11 5339048 5339069 5339065 5339070 +
tggtatgttatcccttcaagcc

SEQ ID NO: 103342 - DNA, 22 bp, Artificial Sequence
  Synthetic oligonucleotide; TTA chr11 5339058 5339079 5339075 5339080 +
tcccttcaagcccatactacac

SEQ ID NO: 103343 - DNA, 22 bp, Artificial Sequence
  Synthetic oligonucleotide; CTT chr11 5339064 5339085 5339081 5339086 +
caagcccatactacacaagtat

SEQ ID NO: 103344 - DNA, 22 bp, Artificial Sequence
  Synthetic oligonucleotide; TTC chr11 5339065 5339086 5339082 5339087 +
aagcccatactacacaagtata

SEQ ID NO: 103345 - DNA, 22 bp, Artificial Sequence
  Synthetic oligonucleotide; CTA chr11 5339077 5339098 5339094 5339099 +
cacaagtatattattatttgaa

SEQ ID NO: 103346 - DNA, 22 bp, Artificial Sequence
  Synthetic oligonucleotide; TTA chr11 5339090 5339111 5339107 5339112 +
ttatttgaaaaagaaaggatgg

SEQ ID NO: 103347 - DNA, 22 bp, Artificial Sequence
  Synthetic oligonucleotide; TTA chr11 5339093 5339114 5339110 5339115 +
tttgaaaaagaaaggatggtat

SEQ ID NO: 103348 - DNA, 22 bp, Artificial Sequence
  Synthetic oligonucleotide; TTT chr11 5339096 5339117 5339113 5339118 +
gaaaaagaaaggatggtatttg

SEQ ID NO: 103349 - DNA, 22 bp, Artificial Sequence
  Synthetic oligonucleotide; TTG chr11 5339097 5339118 5339114 5339119 +
aaaaagaaaggatggtatttgg

SEQ ID NO: 103350 - DNA, 22 bp, Artificial Sequence
  Synthetic oligonucleotide; TTT chr11 5339117 5339138 5339134 5339139 +
ggcaagggctttttttaatgta

SEQ ID NO: 103351 - DNA, 22 bp, Artificial Sequence
  Synthetic oligonucleotide; TTG chr11 5339118 5339139 5339135 5339140 +
gcaagggctttttttaatgtat

SEQ ID NO: 103352 - DNA, 22 bp, Artificial Sequence
  Synthetic oligonucleotide; CTT chr11 5339128 5339149 5339145 5339150 +
tttttaatgtatattcttttac

SEQ ID NO: 103353 - DNA, 22 bp, Artificial Sequence
  Synthetic oligonucleotide; TTT chr11 5339129 5339150 5339146 5339151 +
ttttaatgtatattcttttaca

SEQ ID NO: 103354 - DNA, 22 bp, Artificial Sequence
  Synthetic oligonucleotide; TTT chr11 5339130 5339151 5339147 5339152 +
tttaatgtatattcttttacac

SEQ ID NO: 103355 - DNA, 22 bp, Artificial Sequence
  Synthetic oligonucleotide; TTT chr11 5339131 5339152 5339148 5339153 +
ttaatgtatattcttttacacc

SEQ ID NO: 103356 - DNA, 22 bp, Artificial Sequence
  Synthetic oligonucleotide; TTT chr11 5339132 5339153 5339149 5339154 +
taatgtatattcttttacacct

SEQ ID NO: 103357 - DNA, 22 bp, Artificial Sequence
  Synthetic oligonucleotide; TTT chr11 5339133 5339154 5339150 5339155 +
aatgtatattcttttacacctt

SEQ ID NO: 103358 - DNA, 22 bp, Artificial Sequence
  Synthetic oligonucleotide; TTA chr11 5339134 5339155 5339151 5339156 +
atgtatattcttttacacctta

SEQ ID NO: 103359 - DNA, 22 bp, Artificial Sequence
  Synthetic oligonucleotide; TTC chr11 5339144 5339165 5339161 5339166 +
ttttacaccttagatttcccat

SEQ ID NO: 103360 - DNA, 22 bp, Artificial Sequence
  Synthetic oligonucleotide; CTT chr11 5339146 5339167 5339163 5339168 +
ttacaccttagatttcccataa

SEQ ID NO: 103361 - DNA, 22 bp, Artificial Sequence
  Synthetic oligonucleotide; TTT chr11 5339147 5339168 5339164 5339169 +
tacaccttagatttcccataac

SEQ ID NO: 103362 - DNA, 22 bp, Artificial Sequence
  Synthetic oligonucleotide; TTT chr11 5339148 5339169 5339165 5339170 +
acaccttagatttcccataact

SEQ ID NO: 103363 - DNA, 22 bp, Artificial Sequence
  Synthetic oligonucleotide; TTA chr11 5339149 5339170 5339166 5339171 +
caccttagatttcccataacta

SEQ ID NO: 103364 - DNA, 22 bp, Artificial Sequence
  Synthetic oligonucleotide; CTT chr11 5339155 5339176 5339172 5339177 +
agatttcccataactacatggt

SEQ ID NO: 103365 - DNA, 22 bp, Artificial Sequence
  Synthetic oligonucleotide; TTA chr11 5339156 5339177 5339173 5339178 +
gatttcccataactacatggta

SEQ ID NO: 103366 - DNA, 22 bp, Artificial Sequence
  Synthetic oligonucleotide; TTT chr11 5339161 5339182 5339178 5339183 +
cccataactacatggtacttat

SEQ ID NO: 103367 - DNA, 22 bp, Artificial Sequence
  Synthetic oligonucleotide; TTC chr11 5339162 5339183 5339179 5339184 +
ccataactacatggtacttatt

SEQ ID NO: 103368 - DNA, 22 bp, Artificial Sequence
  Synthetic oligonucleotide; CTA chr11 5339171 5339192 5339188 5339193 +
catggtacttatttatcttaat

SEQ ID NO: 103369 - DNA, 22 bp, Artificial Sequence
  Synthetic oligonucleotide; CTT chr11 5339181 5339202 5339198 5339203 +
atttatcttaataggcaccatg

SEQ ID NO: 103370 - DNA, 22 bp, Artificial Sequence
  Synthetic oligonucleotide; TTA chr11 5339182 5339203 5339199 5339204 +
tttatcttaataggcaccatga

SEQ ID NO: 103371 - DNA, 22 bp, Artificial Sequence
  Synthetic oligonucleotide; TTT chr11 5339185 5339206 5339202 5339207 +
atcttaataggcaccatgaaat

SEQ ID NO: 103372 - DNA, 22 bp, Artificial Sequence
  Synthetic oligonucleotide; TTA chr11 5339186 5339207 5339203 5339208 +
tcttaataggcaccatgaaatt

SEQ ID NO: 103373 - DNA, 22 bp, Artificial Sequence
  Synthetic oligonucleotide; CTT chr11 5339190 5339211 5339207 5339212 +
aataggcaccatgaaatttatt

SEQ ID NO: 103374 - DNA, 22 bp, Artificial Sequence
  Synthetic oligonucleotide; TTA chr11 5339191 5339212 5339208 5339213 +
ataggcaccatgaaatttattc

SEQ ID NO: 103375 - DNA, 22 bp, Artificial Sequence
  Synthetic oligonucleotide; TTT chr11 5339209 5339230 5339226 5339231 +
attcctcatgaggtccttctct

SEQ ID NO: 103376 - DNA, 22 bp, Artificial Sequence
  Synthetic oligonucleotide; TTA chr11 5339210 5339231 5339227 5339232 +
ttcctcatgaggtccttctcta

SEQ ID NO: 103377 - DNA, 22 bp, Artificial Sequence
  Synthetic oligonucleotide; TTC chr11 5339213 5339234 5339230 5339235 +
ctcatgaggtccttctctatat

SEQ ID NO: 103378 - DNA, 22 bp, Artificial Sequence
  Synthetic oligonucleotide; CTC chr11 5339216 5339237 5339233 5339238 +
atgaggtccttctctatataag

SEQ ID NO: 103379 - DNA, 22 bp, Artificial Sequence
  Synthetic oligonucleotide; CTT chr11 5339227 5339248 5339244 5339249 +
ctctatataagttatattcttc

SEQ ID NO: 103380 - DNA, 22 bp, Artificial Sequence
  Synthetic oligonucleotide; TTC chr11 5339228 5339249 5339245 5339250 +
tctatataagttatattcttct

SEQ ID NO: 103381 - DNA, 22 bp, Artificial Sequence
  Synthetic oligonucleotide; CTC chr11 5339230 5339251 5339247 5339252 +
tatataagttatattcttcttt

SEQ ID NO: 103382 - DNA, 22 bp, Artificial Sequence
  Synthetic oligonucleotide; CTA chr11 5339232 5339253 5339249 5339254 +
tataagttatattcttctttca

SEQ ID NO: 103383 - DNA, 22 bp, Artificial Sequence
  Synthetic oligonucleotide; TTA chr11 5339241 5339262 5339258 5339263 +
tattcttctttcagtcttgaat

SEQ ID NO: 103384 - DNA, 22 bp, Artificial Sequence
  Synthetic oligonucleotide; TTC chr11 5339246 5339267 5339263 5339268 +
ttctttcagtcttgaatgatga

SEQ ID NO: 103385 - DNA, 22 bp, Artificial Sequence
  Synthetic oligonucleotide; CTT chr11 5339248 5339269 5339265 5339270 +
ctttcagtcttgaatgatgaaa

SEQ ID NO: 103386 - DNA, 22 bp, Artificial Sequence
  Synthetic oligonucleotide; TTC chr11 5339249 5339270 5339266 5339271 +
tttcagtcttgaatgatgaaaa

SEQ ID NO: 103387 - DNA, 22 bp, Artificial Sequence
  Synthetic oligonucleotide; CTT chr11 5339251 5339272 5339268 5339273 +
tcagtcttgaatgatgaaaagc

SEQ ID NO: 103388 - DNA, 22 bp, Artificial Sequence
  Synthetic oligonucleotide; TTT chr11 5339252 5339273 5339269 5339274 +
cagtcttgaatgatgaaaagct

SEQ ID NO: 103389 - DNA, 22 bp, Artificial Sequence
  Synthetic oligonucleotide; TTC chr11 5339253 5339274 5339270 5339275 +
agtcttgaatgatgaaaagctg

SEQ ID NO: 103390 - DNA, 22 bp, Artificial Sequence
  Synthetic oligonucleotide; CTT chr11 5339259 5339280 5339276 5339281 +
gaatgatgaaaagctgaattac

SEQ ID NO: 103391 - DNA, 22 bp, Artificial Sequence
  Synthetic oligonucleotide; TTG chr11 5339260 5339281 5339277 5339282 +
aatgatgaaaagctgaattaca

SEQ ID NO: 103392 - DNA, 22 bp, Artificial Sequence
  Synthetic oligonucleotide; CTG chr11 5339275 5339296 5339292 5339297 +
aattacaggcttcacctgctgt

SEQ ID NO: 103393 - DNA, 22 bp, Artificial Sequence
  Synthetic oligonucleotide; TTA chr11 5339280 5339301 5339297 5339302 +
caggcttcacctgctgtaagaa

SEQ ID NO: 103394 - DNA, 22 bp, Artificial Sequence
  Synthetic oligonucleotide; CTT chr11 5339287 5339308 5339304 5339309 +
cacctgctgtaagaaggtggtt

SEQ ID NO: 103395 - DNA, 22 bp, Artificial Sequence
  Synthetic oligonucleotide; TTC chr11 5339288 5339309 5339305 5339310 +
acctgctgtaagaaggtggttc

SEQ ID NO: 103396 - DNA, 22 bp, Artificial Sequence
  Synthetic oligonucleotide; CTG chr11 5339293 5339314 5339310 5339315 +
ctgtaagaaggtggttcaccag

SEQ ID NO: 103397 - DNA, 22 bp, Artificial Sequence
  Synthetic oligonucleotide; CTG chr11 5339296 5339317 5339313 5339318 +
taagaaggtggttcaccagttt

SEQ ID NO: 103398 - DNA, 22 bp, Artificial Sequence
  Synthetic oligonucleotide; TTC chr11 5339310 5339331 5339327 5339332 +
accagtttgttagtccactgga

SEQ ID NO: 103399 - DNA, 22 bp, Artificial Sequence
  Synthetic oligonucleotide; TTT chr11 5339318 5339339 5339335 5339340 +
gttagtccactggaccactctg

SEQ ID NO: 103400 - DNA, 22 bp, Artificial Sequence
  Synthetic oligonucleotide; TTG chr11 5339319 5339340 5339336 5339341 +
ttagtccactggaccactctga

SEQ ID NO: 103401 - DNA, 22 bp, Artificial Sequence
  Synthetic oligonucleotide; TTA chr11 5339322 5339343 5339339 5339344 +
gtccactggaccactctgaatt

SEQ ID NO: 103402 - DNA, 22 bp, Artificial Sequence
  Synthetic oligonucleotide; CTG chr11 5339330 5339351 5339347 5339352 +
gaccactctgaattctactctt

SEQ ID NO: 103403 - DNA, 22 bp, Artificial Sequence
  Synthetic oligonucleotide; CTC chr11 5339338 5339359 5339355 5339360 +
tgaattctactcttcttatgaa

SEQ ID NO: 103404 - DNA, 22 bp, Artificial Sequence
  Synthetic oligonucleotide; CTG chr11 5339340 5339361 5339357 5339362 +
aattctactcttcttatgaata

SEQ ID NO: 103405 - DNA, 22 bp, Artificial Sequence
  Synthetic oligonucleotide; TTC chr11 5339345 5339366 5339362 5339367 +
tactcttcttatgaatacaaat

SEQ ID NO: 103406 - DNA, 22 bp, Artificial Sequence
  Synthetic oligonucleotide; CTA chr11 5339347 5339368 5339364 5339369 +
ctcttcttatgaatacaaattc

SEQ ID NO: 103407 - DNA, 22 bp, Artificial Sequence
  Synthetic oligonucleotide; CTC chr11 5339350 5339371 5339367 5339372 +
ttcttatgaatacaaattcatg

SEQ ID NO: 103408 - DNA, 22 bp, Artificial Sequence
  Synthetic oligonucleotide; CTT chr11 5339352 5339373 5339369 5339374 +
cttatgaatacaaattcatgtg

SEQ ID NO: 103409 - DNA, 22 bp, Artificial Sequence
  Synthetic oligonucleotide; TTC chr11 5339353 5339374 5339370 5339375 +
ttatgaatacaaattcatgtgc

SEQ ID NO: 103410 - DNA, 22 bp, Artificial Sequence
  Synthetic oligonucleotide; CTT chr11 5339355 5339376 5339372 5339377 +
atgaatacaaattcatgtgcag

SEQ ID NO: 103411 - DNA, 22 bp, Artificial Sequence
  Synthetic oligonucleotide; TTA chr11 5339356 5339377 5339373 5339378 +
tgaatacaaattcatgtgcagt

SEQ ID NO: 103412 - DNA, 22 bp, Artificial Sequence
  Synthetic oligonucleotide; TTC chr11 5339369 5339390 5339386 5339391 +
atgtgcagtgtttcctaggaga

SEQ ID NO: 103413 - DNA, 22 bp, Artificial Sequence
  Synthetic oligonucleotide; TTT chr11 5339382 5339403 5339399 5339404 +
cctaggagatagtgttataaat

SEQ ID NO: 103414 - DNA, 22 bp, Artificial Sequence
  Synthetic oligonucleotide; TTC chr11 5339383 5339404 5339400 5339405 +
ctaggagatagtgttataaata

SEQ ID NO: 103415 - DNA, 22 bp, Artificial Sequence
  Synthetic oligonucleotide; CTA chr11 5339386 5339407 5339403 5339408 +
ggagatagtgttataaataggc

SEQ ID NO: 103416 - DNA, 22 bp, Artificial Sequence
  Synthetic oligonucleotide; TTA chr11 5339399 5339420 5339416 5339421 +
taaataggcttcttttcctaac

SEQ ID NO: 103417 - DNA, 22 bp, Artificial Sequence
  Synthetic oligonucleotide; CTT chr11 5339410 5339431 5339427 5339432 +
cttttcctaactaacttttatt

SEQ ID NO: 103418 - DNA, 22 bp, Artificial Sequence
  Synthetic oligonucleotide; TTC chr11 5339411 5339432 5339428 5339433 +
ttttcctaactaacttttattt

SEQ ID NO: 103419 - DNA, 22 bp, Artificial Sequence
  Synthetic oligonucleotide; CTT chr11 5339413 5339434 5339430 5339435 +
ttcctaactaacttttatttta

SEQ ID NO: 103420 - DNA, 22 bp, Artificial Sequence
  Synthetic oligonucleotide; TTT chr11 5339414 5339435 5339431 5339436 +
tcctaactaacttttattttag

SEQ ID NO: 103421 - DNA, 22 bp, Artificial Sequence
  Synthetic oligonucleotide; TTT chr11 5339415 5339436 5339432 5339437 +
cctaactaacttttattttagg

SEQ ID NO: 103422 - DNA, 22 bp, Artificial Sequence
  Synthetic oligonucleotide; TTC chr11 5339416 5339437 5339433 5339438 +
ctaactaacttttattttaggt

SEQ ID NO: 103423 - DNA, 22 bp, Artificial Sequence
  Synthetic oligonucleotide; CTA chr11 5339419 5339440 5339436 5339441 +
actaacttttattttaggttca

SEQ ID NO: 103424 - DNA, 22 bp, Artificial Sequence
  Synthetic oligonucleotide; CTA chr11 5339423 5339444 5339440 5339445 +
acttttattttaggttcaggag

SEQ ID NO: 103425 - DNA, 22 bp, Artificial Sequence
  Synthetic oligonucleotide; CTT chr11 5339427 5339448 5339444 5339449 +
ttattttaggttcaggagtaca

SEQ ID NO: 103426 - DNA, 22 bp, Artificial Sequence
  Synthetic oligonucleotide; TTT chr11 5339428 5339449 5339445 5339450 +
tattttaggttcaggagtacaa

SEQ ID NO: 103427 - DNA, 22 bp, Artificial Sequence
  Synthetic oligonucleotide; TTT chr11 5339429 5339450 5339446 5339451 +
attttaggttcaggagtacaag

SEQ ID NO: 103428 - DNA, 22 bp, Artificial Sequence
  Synthetic oligonucleotide; TTA chr11 5339430 5339451 5339447 5339452 +
ttttaggttcaggagtacaaga

SEQ ID NO: 103429 - DNA, 22 bp, Artificial Sequence
  Synthetic oligonucleotide; TTT chr11 5339433 5339454 5339450 5339455 +
taggttcaggagtacaagagca

SEQ ID NO: 103430 - DNA, 22 bp, Artificial Sequence
  Synthetic oligonucleotide; TTT chr11 5339434 5339455 5339451 5339456 +
aggttcaggagtacaagagcag

SEQ ID NO: 103431 - DNA, 22 bp, Artificial Sequence
  Synthetic oligonucleotide; TTA chr11 5339435 5339456 5339452 5339457 +
ggttcaggagtacaagagcagg

SEQ ID NO: 103432 - DNA, 22 bp, Artificial Sequence
  Synthetic oligonucleotide; TTC chr11 5339440 5339461 5339457 5339462 +
aggagtacaagagcaggtctgt

SEQ ID NO: 103433 - DNA, 22 bp, Artificial Sequence
  Synthetic oligonucleotide; CTG chr11 5339461 5339482 5339478 5339483 +
ttacatatttaaacttgtgtca

SEQ ID NO: 103434 - DNA, 22 bp, Artificial Sequence
  Synthetic oligonucleotide; TTA chr11 5339464 5339485 5339481 5339486 +
catatttaaacttgtgtcacga

SEQ ID NO: 103435 - DNA, 22 bp, Artificial Sequence
  Synthetic oligonucleotide; TTT chr11 5339471 5339492 5339488 5339493 +
aaacttgtgtcacgagggtttg

SEQ ID NO: 103436 - DNA, 22 bp, Artificial Sequence
  Synthetic oligonucleotide; TTA chr11 5339472 5339493 5339489 5339494 +
aacttgtgtcacgagggtttgt

SEQ ID NO: 103437 - DNA, 22 bp, Artificial Sequence
  Synthetic oligonucleotide; CTT chr11 5339477 5339498 5339494 5339499 +
gtgtcacgagggtttgttgtac

SEQ ID NO: 103438 - DNA, 22 bp, Artificial Sequence
  Synthetic oligonucleotide; TTG chr11 5339478 5339499 5339495 5339500 +
tgtcacgagggtttgttgtaca

SEQ ID NO: 103439 - DNA, 22 bp, Artificial Sequence
  Synthetic oligonucleotide; TTT chr11 5339492 5339513 5339509 5339514 +
gttgtacagattatgtcatcac

SEQ ID NO: 103440 - DNA, 22 bp, Artificial Sequence
  Synthetic oligonucleotide; TTG chr11 5339493 5339514 5339510 5339515 +
ttgtacagattatgtcatcact

SEQ ID NO: 103441 - DNA, 22 bp, Artificial Sequence
  Synthetic oligonucleotide; TTG chr11 5339496 5339517 5339513 5339518 +
tacagattatgtcatcactcac

SEQ ID NO: 103442 - DNA, 22 bp, Artificial Sequence
  Synthetic oligonucleotide; TTA chr11 5339505 5339526 5339522 5339527 +
tgtcatcactcactcaggtatt

SEQ ID NO: 103443 - DNA, 22 bp, Artificial Sequence
  Synthetic oligonucleotide; CTC chr11 5339516 5339537 5339533 5339538 +
actcaggtattaagcctagtac

SEQ ID NO: 103444 - DNA, 22 bp, Artificial Sequence
  Synthetic oligonucleotide; CTC chr11 5339520 5339541 5339537 5339542 +
aggtattaagcctagtaccctt

SEQ ID NO: 103445 - DNA, 22 bp, Artificial Sequence
  Synthetic oligonucleotide; TTA chr11 5339528 5339549 5339545 5339550 +
agcctagtacccttttgttact

SEQ ID NO: 103446 - DNA, 22 bp, Artificial Sequence
  Synthetic oligonucleotide; CTA chr11 5339534 5339555 5339551 5339556 +
gtacccttttgttacttttcct

SEQ ID NO: 103447 - DNA, 22 bp, Artificial Sequence
  Synthetic oligonucleotide; CTT chr11 5339542 5339563 5339559 5339564 +
ttgttacttttcctgatcctct

SEQ ID NO: 103448 - DNA, 22 bp, Artificial Sequence
  Synthetic oligonucleotide; TTT chr11 5339543 5339564 5339560 5339565 +
tgttacttttcctgatcctctc

SEQ ID NO: 103449 - DNA, 22 bp, Artificial Sequence
  Synthetic oligonucleotide; TTT chr11 5339544 5339565 5339561 5339566 +
gttacttttcctgatcctctcc

SEQ ID NO: 103450 - DNA, 22 bp, Artificial Sequence
  Synthetic oligonucleotide; TTG chr11 5339545 5339566 5339562 5339567 +
ttacttttcctgatcctctccc

SEQ ID NO: 103451 - DNA, 22 bp, Artificial Sequence
  Synthetic oligonucleotide; TTA chr11 5339548 5339569 5339565 5339570 +
cttttcctgatcctctccctcc

SEQ ID NO: 103452 - DNA, 22 bp, Artificial Sequence
  Synthetic oligonucleotide; CTT chr11 5339551 5339572 5339568 5339573 +
ttcctgatcctctccctccttt

SEQ ID NO: 103453 - DNA, 22 bp, Artificial Sequence
  Synthetic oligonucleotide; TTT chr11 5339552 5339573 5339569 5339574 +
tcctgatcctctccctcctttc

SEQ ID NO: 103454 - DNA, 22 bp, Artificial Sequence
  Synthetic oligonucleotide; TTT chr11 5339553 5339574 5339570 5339575 +
cctgatcctctccctcctttca

SEQ ID NO: 103455 - DNA, 22 bp, Artificial Sequence
  Synthetic oligonucleotide; TTC chr11 5339554 5339575 5339571 5339576 +
ctgatcctctccctcctttcac

SEQ ID NO: 103456 - DNA, 22 bp, Artificial Sequence
  Synthetic oligonucleotide; CTG chr11 5339557 5339578 5339574 5339579 +
atcctctccctcctttcaccct

SEQ ID NO: 103457 - DNA, 22 bp, Artificial Sequence
  Synthetic oligonucleotide; CTC chr11 5339563 5339584 5339580 5339585 +
tccctcctttcaccctccatcc

SEQ ID NO: 103458 - DNA, 22 bp, Artificial Sequence
  Synthetic oligonucleotide; CTC chr11 5339565 5339586 5339582 5339587 +
cctcctttcaccctccatcctc

SEQ ID NO: 103459 - DNA, 22 bp, Artificial Sequence
  Synthetic oligonucleotide; CTC chr11 5339569 5339590 5339586 5339591 +
ctttcaccctccatcctccaat

SEQ ID NO: 103460 - DNA, 22 bp, Artificial Sequence
  Synthetic oligonucleotide; CTT chr11 5339572 5339593 5339589 5339594 +
tcaccctccatcctccaatagg

SEQ ID NO: 103461 - DNA, 22 bp, Artificial Sequence
  Synthetic oligonucleotide; TTT chr11 5339573 5339594 5339590 5339595 +
caccctccatcctccaataggc

SEQ ID NO: 103462 - DNA, 22 bp, Artificial Sequence
  Synthetic oligonucleotide; TTC chr11 5339574 5339595 5339591 5339596 +
accctccatcctccaataggcc

SEQ ID NO: 103463 - DNA, 22 bp, Artificial Sequence
  Synthetic oligonucleotide; CTC chr11 5339580 5339601 5339597 5339602 +
catcctccaataggccccagtg

SEQ ID NO: 103464 - DNA, 22 bp, Artificial Sequence
  Synthetic oligonucleotide; CTC chr11 5339587 5339608 5339604 5339609 +
caataggccccagtgtgtgatg

SEQ ID NO: 103465 - DNA, 22 bp, Artificial Sequence
  Synthetic oligonucleotide; TTC chr11 5339612 5339633 5339629 5339634 +
ccctccatgtgtccatgtgttc

SEQ ID NO: 103466 - DNA, 22 bp, Artificial Sequence
  Synthetic oligonucleotide; CTC chr11 5339617 5339638 5339634 5339639 +
catgtgtccatgtgttctcatc

SEQ ID NO: 103467 - DNA, 22 bp, Artificial Sequence
  Synthetic oligonucleotide; TTC chr11 5339634 5339655 5339651 5339656 +
tcatcatttagctcccactcat

SEQ ID NO: 103468 - DNA, 22 bp, Artificial Sequence
  Synthetic oligonucleotide; CTC chr11 5339636 5339657 5339653 5339658 +
atcatttagctcccactcataa

SEQ ID NO: 103469 - DNA, 22 bp, Artificial Sequence
  Synthetic oligonucleotide; TTT chr11 5339643 5339664 5339660 5339665 +
agctcccactcataagtgagaa

SEQ ID NO: 103470 - DNA, 22 bp, Artificial Sequence
  Synthetic oligonucleotide; TTA chr11 5339644 5339665 5339661 5339666 +
gctcccactcataagtgagaac

SEQ ID NO: 103471 - DNA, 22 bp, Artificial Sequence
  Synthetic oligonucleotide; CTC chr11 5339648 5339669 5339665 5339670 +
ccactcataagtgagaacacgt

SEQ ID NO: 103472 - DNA, 22 bp, Artificial Sequence
  Synthetic oligonucleotide; CTC chr11 5339654 5339675 5339671 5339676 +
ataagtgagaacacgtggtatt

SEQ ID NO: 103473 - DNA, 22 bp, Artificial Sequence
  Synthetic oligonucleotide; TTT chr11 5339677 5339698 5339694 5339699 +
ggttttctgttcctgtattaat

SEQ ID NO: 103474 - DNA, 22 bp, Artificial Sequence
  Synthetic oligonucleotide; TTG chr11 5339678 5339699 5339695 5339700 +
gttttctgttcctgtattaatt

SEQ ID NO: 103475 - DNA, 22 bp, Artificial Sequence
  Synthetic oligonucleotide; TTT chr11 5339682 5339703 5339699 5339704 +
tctgttcctgtattaatttgct

SEQ ID NO: 103476 - DNA, 22 bp, Artificial Sequence
  Synthetic oligonucleotide; TTT chr11 5339683 5339704 5339700 5339705 +
ctgttcctgtattaatttgcta

SEQ ID NO: 103477 - DNA, 22 bp, Artificial Sequence
  Synthetic oligonucleotide; TTC chr11 5339684 5339705 5339701 5339706 +
tgttcctgtattaatttgctaa

SEQ ID NO: 103478 - DNA, 22 bp, Artificial Sequence
  Synthetic oligonucleotide; CTG chr11 5339686 5339707 5339703 5339708 +
ttcctgtattaatttgctaagg

SEQ ID NO: 103479 - DNA, 22 bp, Artificial Sequence
  Synthetic oligonucleotide; TTC chr11 5339689 5339710 5339706 5339711 +
ctgtattaatttgctaaggctt

SEQ ID NO: 103480 - DNA, 22 bp, Artificial Sequence
  Synthetic oligonucleotide; CTG chr11 5339692 5339713 5339709 5339714 +
tattaatttgctaaggcttcta

SEQ ID NO: 103481 - DNA, 22 bp, Artificial Sequence
  Synthetic oligonucleotide; TTA chr11 5339697 5339718 5339714 5339719 +
atttgctaaggcttctaatagt

SEQ ID NO: 103482 - DNA, 22 bp, Artificial Sequence
  Synthetic oligonucleotide; TTT chr11 5339701 5339722 5339718 5339723 +
gctaaggcttctaatagtacat

SEQ ID NO: 103483 - DNA, 22 bp, Artificial Sequence
  Synthetic oligonucleotide; TTG chr11 5339702 5339723 5339719 5339724 +
ctaaggcttctaatagtacata

SEQ ID NO: 103484 - DNA, 22 bp, Artificial Sequence
  Synthetic oligonucleotide; CTA chr11 5339705 5339726 5339722 5339727 +
aggcttctaatagtacatagca

SEQ ID NO: 103485 - DNA, 22 bp, Artificial Sequence
  Synthetic oligonucleotide; CTT chr11 5339711 5339732 5339728 5339733 +
ctaatagtacatagcattttac

SEQ ID NO: 103486 - DNA, 22 bp, Artificial Sequence
  Synthetic oligonucleotide; TTC chr11 5339712 5339733 5339729 5339734 +
taatagtacatagcattttacc

SEQ ID NO: 103487 - DNA, 22 bp, Artificial Sequence
  Synthetic oligonucleotide; CTA chr11 5339714 5339735 5339731 5339736 +
atagtacatagcattttaccac

SEQ ID NO: 103488 - DNA, 22 bp, Artificial Sequence
  Synthetic oligonucleotide; TTT chr11 5339730 5339751 5339747 5339752 +
taccacaggaagacttgtagga

SEQ ID NO: 103489 - DNA, 22 bp, Artificial Sequence
  Synthetic oligonucleotide; TTT chr11 5339731 5339752 5339748 5339753 +
accacaggaagacttgtaggag

SEQ ID NO: 103490 - DNA, 22 bp, Artificial Sequence
  Synthetic oligonucleotide; TTA chr11 5339732 5339753 5339749 5339754 +
ccacaggaagacttgtaggaga

SEQ ID NO: 103491 - DNA, 22 bp, Artificial Sequence
  Synthetic oligonucleotide; CTT chr11 5339746 5339767 5339763 5339768 +
gtaggagatcacagaaagttct

SEQ ID NO: 103492 - DNA, 22 bp, Artificial Sequence
  Synthetic oligonucleotide; TTG chr11 5339747 5339768 5339764 5339769 +
taggagatcacagaaagttcta

SEQ ID NO: 103493 - DNA, 22 bp, Artificial Sequence
  Synthetic oligonucleotide; TTC chr11 5339767 5339788 5339784 5339789 +
taaattttatgataatactaac

SEQ ID NO: 103494 - DNA, 22 bp, Artificial Sequence
  Synthetic oligonucleotide; CTA chr11 5339769 5339790 5339786 5339791 +
aattttatgataatactaacat

SEQ ID NO: 103495 - DNA, 22 bp, Artificial Sequence
  Synthetic oligonucleotide; TTT chr11 5339774 5339795 5339791 5339796 +
tatgataatactaacatactgt

SEQ ID NO: 103496 - DNA, 22 bp, Artificial Sequence
  Synthetic oligonucleotide; TTT chr11 5339775 5339796 5339792 5339797 +
atgataatactaacatactgtg

SEQ ID NO: 103497 - DNA, 22 bp, Artificial Sequence
  Synthetic oligonucleotide; TTA chr11 5339776 5339797 5339793 5339798 +
tgataatactaacatactgtgt

SEQ ID NO: 103498 - DNA, 22 bp, Artificial Sequence
  Synthetic oligonucleotide; CTA chr11 5339787 5339808 5339804 5339809 +
acatactgtgtttatgttgatt

SEQ ID NO: 103499 - DNA, 22 bp, Artificial Sequence
  Synthetic oligonucleotide; CTG chr11 5339795 5339816 5339812 5339817 +
tgtttatgttgattgttacaat

SEQ ID NO: 103500 - DNA, 22 bp, Artificial Sequence
  Synthetic oligonucleotide; TTT chr11 5339800 5339821 5339817 5339822 +
atgttgattgttacaatgggtt

SEQ ID NO: 103501 - DNA, 22 bp, Artificial Sequence
  Synthetic oligonucleotide; TTA chr11 5339801 5339822 5339818 5339823 +
tgttgattgttacaatgggttt

SEQ ID NO: 103502 - DNA, 22 bp, Artificial Sequence
  Synthetic oligonucleotide; TTG chr11 5339806 5339827 5339823 5339828 +
attgttacaatgggttttgaat

SEQ ID NO: 103503 - DNA, 22 bp, Artificial Sequence
  Synthetic oligonucleotide; TTG chr11 5339810 5339831 5339827 5339832 +
ttacaatgggttttgaatagaa

SEQ ID NO: 103504 - DNA, 22 bp, Artificial Sequence
  Synthetic oligonucleotide; TTA chr11 5339813 5339834 5339830 5339835 +
caatgggttttgaatagaaaaa

SEQ ID NO: 103505 - DNA, 22 bp, Artificial Sequence
  Synthetic oligonucleotide; TTT chr11 5339823 5339844 5339840 5339845 +
tgaatagaaaaacatgtctgag

SEQ ID NO: 103506 - DNA, 22 bp, Artificial Sequence
  Synthetic oligonucleotide; TTT chr11 5339824 5339845 5339841 5339846 +
gaatagaaaaacatgtctgagt

SEQ ID NO: 103507 - DNA, 22 bp, Artificial Sequence
  Synthetic oligonucleotide; TTG chr11 5339825 5339846 5339842 5339847 +
aatagaaaaacatgtctgagtg

SEQ ID NO: 103508 - DNA, 22 bp, Artificial Sequence
  Synthetic oligonucleotide; CTG chr11 5339843 5339864 5339860 5339865 +
agtggatttccaccatgtagcc

SEQ ID NO: 103509 - DNA, 22 bp, Artificial Sequence
  Synthetic oligonucleotide; TTT chr11 5339852 5339873 5339869 5339874 +
ccaccatgtagccttctgtata

SEQ ID NO: 103510 - DNA, 22 bp, Artificial Sequence
  Synthetic oligonucleotide; TTC chr11 5339853 5339874 5339870 5339875 +
caccatgtagccttctgtataa

SEQ ID NO: 103511 - DNA, 22 bp, Artificial Sequence
  Synthetic oligonucleotide; CTT chr11 5339867 5339888 5339884 5339889 +
ctgtataactaagtttgagata

SEQ ID NO: 103512 - DNA, 22 bp, Artificial Sequence
  Synthetic oligonucleotide; TTC chr11 5339868 5339889 5339885 5339890 +
tgtataactaagtttgagataa

SEQ ID NO: 103513 - DNA, 22 bp, Artificial Sequence
  Synthetic oligonucleotide; CTG chr11 5339870 5339891 5339887 5339892 +
tataactaagtttgagataatt

SEQ ID NO: 103514 - DNA, 22 bp, Artificial Sequence
  Synthetic oligonucleotide; CTA chr11 5339878 5339899 5339895 5339900 +
agtttgagataattatttagtc

SEQ ID NO: 103515 - DNA, 22 bp, Artificial Sequence
  Synthetic oligonucleotide; TTT chr11 5339883 5339904 5339900 5339905 +
gagataattatttagtcttccc

SEQ ID NO: 103516 - DNA, 22 bp, Artificial Sequence
  Synthetic oligonucleotide; TTG chr11 5339884 5339905 5339901 5339906 +
agataattatttagtcttcccc

SEQ ID NO: 103517 - DNA, 22 bp, Artificial Sequence
  Synthetic oligonucleotide; TTA chr11 5339893 5339914 5339910 5339915 +
tttagtcttccccccacctccg

SEQ ID NO: 103518 - DNA, 22 bp, Artificial Sequence
  Synthetic oligonucleotide; TTT chr11 5339896 5339917 5339913 5339918 +
agtcttccccccacctccgatg

SEQ ID NO: 103519 - DNA, 22 bp, Artificial Sequence
  Synthetic oligonucleotide; TTA chr11 5339897 5339918 5339914 5339919 +
gtcttccccccacctccgatgt

SEQ ID NO: 103520 - DNA, 22 bp, Artificial Sequence
  Synthetic oligonucleotide; CTT chr11 5339902 5339923 5339919 5339924 +
ccccccacctccgatgtcctgt

SEQ ID NO: 103521 - DNA, 22 bp, Artificial Sequence
  Synthetic oligonucleotide; TTC chr11 5339903 5339924 5339920 5339925 +
cccccacctccgatgtcctgtg

SEQ ID NO: 103522 - DNA, 22 bp, Artificial Sequence
  Synthetic oligonucleotide; CTC chr11 5339913 5339934 5339930 5339935 +
cgatgtcctgtgtctgtattca

SEQ ID NO: 103523 - DNA, 22 bp, Artificial Sequence
  Synthetic oligonucleotide; CTG chr11 5339923 5339944 5339940 5339945 +
tgtctgtattcatcctacagca

SEQ ID NO: 103524 - DNA, 22 bp, Artificial Sequence
  Synthetic oligonucleotide; CTG chr11 5339929 5339950 5339946 5339951 +
tattcatcctacagcatcttct

SEQ ID NO: 103525 - DNA, 22 bp, Artificial Sequence
  Synthetic oligonucleotide; TTC chr11 5339934 5339955 5339951 5339956 +
atcctacagcatcttctcagtg

SEQ ID NO: 103526 - DNA, 22 bp, Artificial Sequence
  Synthetic oligonucleotide; CTA chr11 5339940 5339961 5339957 5339962 +
cagcatcttctcagtgaattta

SEQ ID NO: 103527 - DNA, 22 bp, Artificial Sequence
  Synthetic oligonucleotide; CTT chr11 5339949 5339970 5339966 5339971 +
ctcagtgaatttagtttcacac

SEQ ID NO: 103528 - DNA, 22 bp, Artificial Sequence
  Synthetic oligonucleotide; TTC chr11 5339950 5339971 5339967 5339972 +
tcagtgaatttagtttcacact

SEQ ID NO: 103529 - DNA, 22 bp, Artificial Sequence
  Synthetic oligonucleotide; CTC chr11 5339952 5339973 5339969 5339974 +
agtgaatttagtttcacactta

SEQ ID NO: 103530 - DNA, 22 bp, Artificial Sequence
  Synthetic oligonucleotide; TTT chr11 5339961 5339982 5339978 5339983 +
agtttcacacttactttcaagt

SEQ ID NO: 103531 - DNA, 22 bp, Artificial Sequence
  Synthetic oligonucleotide; TTA chr11 5339962 5339983 5339979 5339984 +
gtttcacacttactttcaagtc

SEQ ID NO: 103532 - DNA, 22 bp, Artificial Sequence
  Synthetic oligonucleotide; TTT chr11 5339966 5339987 5339983 5339988 +
cacacttactttcaagtcagaa

SEQ ID NO: 103533 - DNA, 22 bp, Artificial Sequence
  Synthetic oligonucleotide; TTC chr11 5339967 5339988 5339984 5339989 +
acacttactttcaagtcagaaa

SEQ ID NO: 103534 - DNA, 22 bp, Artificial Sequence
  Synthetic oligonucleotide; CTT chr11 5339973 5339994 5339990 5339995 +
actttcaagtcagaaatgaact

SEQ ID NO: 103535 - DNA, 22 bp, Artificial Sequence
  Synthetic oligonucleotide; TTA chr11 5339974 5339995 5339991 5339996 +
ctttcaagtcagaaatgaactt

SEQ ID NO: 103536 - DNA, 22 bp, Artificial Sequence
  Synthetic oligonucleotide; CTT chr11 5339977 5339998 5339994 5339999 +
tcaagtcagaaatgaacttctt

SEQ ID NO: 103537 - DNA, 22 bp, Artificial Sequence
  Synthetic oligonucleotide; TTT chr11 5339978 5339999 5339995 5340000 +
caagtcagaaatgaacttctta

SEQ ID NO: 103538 - DNA, 22 bp, Artificial Sequence
  Synthetic oligonucleotide; TTC chr11 5339979 5340000 5339996 5340001 +
aagtcagaaatgaacttcttaa

SEQ ID NO: 103539 - DNA, 22 bp, Artificial Sequence
  Synthetic oligonucleotide; CTT chr11 5339996 5340017 5340013 5340018 +
cttaaacaagggaaataacttc

SEQ ID NO: 103540 - DNA, 22 bp, Artificial Sequence
  Synthetic oligonucleotide; TTC chr11 5339997 5340018 5340014 5340019 +
ttaaacaagggaaataacttca

SEQ ID NO: 103541 - DNA, 22 bp, Artificial Sequence
  Synthetic oligonucleotide; CTT chr11 5339999 5340020 5340016 5340021 +
aaacaagggaaataacttcata

SEQ ID NO: 103542 - DNA, 22 bp, Artificial Sequence
  Synthetic oligonucleotide; TTA chr11 5340000 5340021 5340017 5340022 +
aacaagggaaataacttcataa

SEQ ID NO: 103543 - DNA, 22 bp, Artificial Sequence
  Synthetic oligonucleotide; CTT chr11 5340017 5340038 5340034 5340039 +
cataaatcattcaccaaatggt

SEQ ID NO: 103544 - DNA, 22 bp, Artificial Sequence
  Synthetic oligonucleotide; TTC chr11 5340018 5340039 5340035 5340040 +
ataaatcattcaccaaatggtc

SEQ ID NO: 103545 - DNA, 22 bp, Artificial Sequence
  Synthetic oligonucleotide; TTC chr11 5340029 5340050 5340046 5340051 +
accaaatggtcaactttcctgc

SEQ ID NO: 103546 - DNA, 22 bp, Artificial Sequence
  Synthetic oligonucleotide; CTT chr11 5340045 5340066 5340062 5340067 +
tcctgccatttttaggttccat

SEQ ID NO: 103547 - DNA, 22 bp, Artificial Sequence
  Synthetic oligonucleotide; TTT chr11 5340046 5340067 5340063 5340068 +
cctgccatttttaggttccatt

SEQ ID NO: 103548 - DNA, 22 bp, Artificial Sequence
  Synthetic oligonucleotide; TTC chr11 5340047 5340068 5340064 5340069 +
ctgccatttttaggttccattt

SEQ ID NO: 103549 - DNA, 22 bp, Artificial Sequence
  Synthetic oligonucleotide; CTG chr11 5340050 5340071 5340067 5340072 +
ccatttttaggttccatttcct

SEQ ID NO: 103550 - DNA, 22 bp, Artificial Sequence
  Synthetic oligonucleotide; TTT chr11 5340056 5340077 5340073 5340078 +
ttaggttccatttcctgtattt

SEQ ID NO: 103551 - DNA, 22 bp, Artificial Sequence
  Synthetic oligonucleotide; TTT chr11 5340057 5340078 5340074 5340079 +
taggttccatttcctgtatttt

SEQ ID NO: 103552 - DNA, 22 bp, Artificial Sequence
  Synthetic oligonucleotide; TTT chr11 5340058 5340079 5340075 5340080 +
aggttccatttcctgtatttta

SEQ ID NO: 103553 - DNA, 22 bp, Artificial Sequence
  Synthetic oligonucleotide; TTA chr11 5340059 5340080 5340076 5340081 +
ggttccatttcctgtattttag

SEQ ID NO: 103554 - DNA, 22 bp, Artificial Sequence
  Synthetic oligonucleotide; TTC chr11 5340064 5340085 5340081 5340086 +
catttcctgtattttagaaaaa

SEQ ID NO: 103555 - DNA, 22 bp, Artificial Sequence
  Synthetic oligonucleotide; TTT chr11 5340069 5340090 5340086 5340091 +
cctgtattttagaaaaagaggc

SEQ ID NO: 103556 - DNA, 22 bp, Artificial Sequence
  Synthetic oligonucleotide; TTC chr11 5340070 5340091 5340087 5340092 +
ctgtattttagaaaaagaggca

SEQ ID NO: 103557 - DNA, 22 bp, Artificial Sequence
  Synthetic oligonucleotide; CTG chr11 5340073 5340094 5340090 5340095 +
tattttagaaaaagaggcagct

SEQ ID NO: 103558 - DNA, 22 bp, Artificial Sequence
  Synthetic oligonucleotide; TTT chr11 5340078 5340099 5340095 5340100 +
tagaaaaagaggcagctcttct

SEQ ID NO: 103559 - DNA, 22 bp, Artificial Sequence
  Synthetic oligonucleotide; TTT chr11 5340079 5340100 5340096 5340101 +
agaaaaagaggcagctcttcta

SEQ ID NO: 103560 - DNA, 22 bp, Artificial Sequence
  Synthetic oligonucleotide; TTA chr11 5340080 5340101 5340097 5340102 +
gaaaaagaggcagctcttctac

SEQ ID NO: 103561 - DNA, 22 bp, Artificial Sequence
  Synthetic oligonucleotide; CTC chr11 5340096 5340117 5340113 5340118 +
ttctacctaacagtattttcca

SEQ ID NO: 103562 - DNA, 22 bp, Artificial Sequence
  Synthetic oligonucleotide; CTT chr11 5340098 5340119 5340115 5340120 +
ctacctaacagtattttccagt

SEQ ID NO: 103563 - DNA, 22 bp, Artificial Sequence
  Synthetic oligonucleotide; TTC chr11 5340099 5340120 5340116 5340121 +
tacctaacagtattttccagtt

SEQ ID NO: 103564 - DNA, 22 bp, Artificial Sequence
  Synthetic oligonucleotide; CTA chr11 5340101 5340122 5340118 5340123 +
cctaacagtattttccagtttt

SEQ ID NO: 103565 - DNA, 22 bp, Artificial Sequence
  Synthetic oligonucleotide; CTA chr11 5340105 5340126 5340122 5340127 +
acagtattttccagttttaaat

SEQ ID NO: 103566 - DNA, 22 bp, Artificial Sequence
  Synthetic oligonucleotide; TTT chr11 5340114 5340135 5340131 5340136 +
tccagttttaaatattagttag

SEQ ID NO: 103567 - DNA, 22 bp, Artificial Sequence
  Synthetic oligonucleotide; TTT chr11 5340115 5340136 5340132 5340137 +
ccagttttaaatattagttaga

SEQ ID NO: 103568 - DNA, 22 bp, Artificial Sequence
  Synthetic oligonucleotide; TTC chr11 5340116 5340137 5340133 5340138 +
cagttttaaatattagttagag

SEQ ID NO: 103569 - DNA, 22 bp, Artificial Sequence
  Synthetic oligonucleotide; TTT chr11 5340122 5340143 5340139 5340144 +
taaatattagttagagaagatt

SEQ ID NO: 103570 - DNA, 22 bp, Artificial Sequence
  Synthetic oligonucleotide; TTT chr11 5340123 5340144 5340140 5340145 +
aaatattagttagagaagattc

SEQ ID NO: 103571 - DNA, 22 bp, Artificial Sequence
  Synthetic oligonucleotide; TTA chr11 5340124 5340145 5340141 5340146 +
aatattagttagagaagattca

SEQ ID NO: 103572 - DNA, 22 bp, Artificial Sequence
  Synthetic oligonucleotide; TTA chr11 5340131 5340152 5340148 5340153 +
gttagagaagattcacatatct

SEQ ID NO: 103573 - DNA, 22 bp, Artificial Sequence
  Synthetic oligonucleotide; TTA chr11 5340135 5340156 5340152 5340157 +
gagaagattcacatatctataa

SEQ ID NO: 103574 - DNA, 22 bp, Artificial Sequence
  Synthetic oligonucleotide; TTC chr11 5340145 5340166 5340162 5340167 +
acatatctataactgagatgat

SEQ ID NO: 103575 - DNA, 22 bp, Artificial Sequence
  Synthetic oligonucleotide; CTA chr11 5340154 5340175 5340171 5340176 +
taactgagatgatataattatt

SEQ ID NO: 103576 - DNA, 22 bp, Artificial Sequence
  Synthetic oligonucleotide; CTG chr11 5340160 5340181 5340177 5340182 +
agatgatataattattaatagc

SEQ ID NO: 103577 - DNA, 22 bp, Artificial Sequence
  Synthetic oligonucleotide; TTA chr11 5340174 5340195 5340191 5340196 +
ttaatagcctttggttataagt

SEQ ID NO: 103578 - DNA, 22 bp, Artificial Sequence
  Synthetic oligonucleotide; TTA chr11 5340177 5340198 5340194 5340199 +
atagcctttggttataagtgaa

SEQ ID NO: 103579 - DNA, 22 bp, Artificial Sequence
  Synthetic oligonucleotide; CTT chr11 5340185 5340206 5340202 5340207 +
tggttataagtgaaactcaact

SEQ ID NO: 103580 - DNA, 22 bp, Artificial Sequence
  Synthetic oligonucleotide; TTT chr11 5340186 5340207 5340203 5340208 +
ggttataagtgaaactcaactg

SEQ ID NO: 103581 - DNA, 22 bp, Artificial Sequence
  Synthetic oligonucleotide; TTG chr11 5340187 5340208 5340204 5340209 +
gttataagtgaaactcaactga

SEQ ID NO: 103582 - DNA, 22 bp, Artificial Sequence
  Synthetic oligonucleotide; TTA chr11 5340191 5340212 5340208 5340213 +
taagtgaaactcaactgaaact

SEQ ID NO: 103583 - DNA, 22 bp, Artificial Sequence
  Synthetic oligonucleotide; CTC chr11 5340203 5340224 5340220 5340225 +
aactgaaactaggctgaacaaa

SEQ ID NO: 103584 - DNA, 22 bp, Artificial Sequence
  Synthetic oligonucleotide; CTG chr11 5340208 5340229 5340225 5340230 +
aaactaggctgaacaaaacaaa

SEQ ID NO: 103585 - DNA, 22 bp, Artificial Sequence
  Synthetic oligonucleotide; CTA chr11 5340214 5340235 5340231 5340236 +
ggctgaacaaaacaaattacaa

SEQ ID NO: 103586 - DNA, 22 bp, Artificial Sequence
  Synthetic oligonucleotide; CTG chr11 5340219 5340240 5340236 5340241 +
aacaaaacaaattacaagaaga

SEQ ID NO: 103587 - DNA, 22 bp, Artificial Sequence
  Synthetic oligonucleotide; TTA chr11 5340233 5340254 5340250 5340255 +
caagaagaggagtttattaggc

SEQ ID NO: 103588 - DNA, 22 bp, Artificial Sequence
  Synthetic oligonucleotide; TTT chr11 5340248 5340269 5340265 5340270 +
attaggctgtggaatcaaaaaa

SEQ ID NO: 103589 - DNA, 22 bp, Artificial Sequence
  Synthetic oligonucleotide; TTA chr11 5340249 5340270 5340266 5340271 +
ttaggctgtggaatcaaaaaaa

SEQ ID NO: 103590 - DNA, 22 bp, Artificial Sequence
  Synthetic oligonucleotide; TTA chr11 5340252 5340273 5340269 5340274 +
ggctgtggaatcaaaaaaaaga

SEQ ID NO: 103591 - DNA, 22 bp, Artificial Sequence
  Synthetic oligonucleotide; CTG chr11 5340257 5340278 5340274 5340279 +
tggaatcaaaaaaaagattcaa

SEQ ID NO: 103592 - DNA, 22 bp, Artificial Sequence
  Synthetic oligonucleotide; TTC chr11 5340277 5340298 5340294 5340299 +
aaactgtcctccttgtcactga

SEQ ID NO: 103593 - DNA, 22 bp, Artificial Sequence
  Synthetic oligonucleotide; CTG chr11 5340283 5340304 5340300 5340305 +
tcctccttgtcactgagtctca

SEQ ID NO: 103594 - DNA, 22 bp, Artificial Sequence
  Synthetic oligonucleotide; CTC chr11 5340288 5340309 5340305 5340310 +
cttgtcactgagtctcaggaaa

SEQ ID NO: 103595 - DNA, 22 bp, Artificial Sequence
  Synthetic oligonucleotide; CTT chr11 5340291 5340312 5340308 5340313 +
gtcactgagtctcaggaaaaca

SEQ ID NO: 103596 - DNA, 22 bp, Artificial Sequence
  Synthetic oligonucleotide; TTG chr11 5340292 5340313 5340309 5340314 +
tcactgagtctcaggaaaacat

SEQ ID NO: 103597 - DNA, 22 bp, Artificial Sequence
  Synthetic oligonucleotide; CTG chr11 5340298 5340319 5340315 5340320 +
agtctcaggaaaacatggaatc

SEQ ID NO: 103598 - DNA, 22 bp, Artificial Sequence
  Synthetic oligonucleotide; CTC chr11 5340304 5340325 5340321 5340326 +
aggaaaacatggaatcagagat

SEQ ID NO: 103599 - DNA, 22 bp, Artificial Sequence
  Synthetic oligonucleotide; TTT chr11 5340328 5340349 5340345 5340350 +
gaagattctttttatttattat

SEQ ID NO: 103600 - DNA, 22 bp, Artificial Sequence
  Synthetic oligonucleotide; TTG chr11 5340329 5340350 5340346 5340351 +
aagattctttttatttattatc

SEQ ID NO: 103601 - DNA, 22 bp, Artificial Sequence
  Synthetic oligonucleotide; TTC chr11 5340336 5340357 5340353 5340358 +
tttttatttattatcatttctt

SEQ ID NO: 103602 - DNA, 22 bp, Artificial Sequence
  Synthetic oligonucleotide; CTT chr11 5340338 5340359 5340355 5340360 +
tttatttattatcatttcttta

SEQ ID NO: 103603 - DNA, 22 bp, Artificial Sequence
  Synthetic oligonucleotide; TTT chr11 5340339 5340360 5340356 5340361 +
ttatttattatcatttctttat

SEQ ID NO: 103604 - DNA, 22 bp, Artificial Sequence
  Synthetic oligonucleotide; TTT chr11 5340340 5340361 5340357 5340362 +
tatttattatcatttctttatc

SEQ ID NO: 103605 - DNA, 22 bp, Artificial Sequence
  Synthetic oligonucleotide; TTT chr11 5340341 5340362 5340358 5340363 +
atttattatcatttctttatct

SEQ ID NO: 103606 - DNA, 22 bp, Artificial Sequence
  Synthetic oligonucleotide; TTA chr11 5340342 5340363 5340359 5340364 +
tttattatcatttctttatcta

SEQ ID NO: 103607 - DNA, 22 bp, Artificial Sequence
  Synthetic oligonucleotide; TTT chr11 5340345 5340366 5340362 5340367 +
attatcatttctttatctataa

SEQ ID NO: 103608 - DNA, 22 bp, Artificial Sequence
  Synthetic oligonucleotide; TTA chr11 5340346 5340367 5340363 5340368 +
ttatcatttctttatctataat

SEQ ID NO: 103609 - DNA, 22 bp, Artificial Sequence
  Synthetic oligonucleotide; TTA chr11 5340349 5340370 5340366 5340371 +
tcatttctttatctataattta

SEQ ID NO: 103610 - DNA, 22 bp, Artificial Sequence
  Synthetic oligonucleotide; TTT chr11 5340355 5340376 5340372 5340377 +
ctttatctataatttactctaa

SEQ ID NO: 103611 - DNA, 22 bp, Artificial Sequence
  Synthetic oligonucleotide; TTC chr11 5340356 5340377 5340373 5340378 +
tttatctataatttactctaaa

SEQ ID NO: 103612 - DNA, 22 bp, Artificial Sequence
  Synthetic oligonucleotide; CTT chr11 5340358 5340379 5340375 5340380 +
tatctataatttactctaaata

SEQ ID NO: 103613 - DNA, 22 bp, Artificial Sequence
  Synthetic oligonucleotide; TTT chr11 5340359 5340380 5340376 5340381 +
atctataatttactctaaatat

SEQ ID NO: 103614 - DNA, 22 bp, Artificial Sequence
  Synthetic oligonucleotide; TTA chr11 5340360 5340381 5340377 5340382 +
tctataatttactctaaatatt

SEQ ID NO: 103615 - DNA, 22 bp, Artificial Sequence
  Synthetic oligonucleotide; CTA chr11 5340364 5340385 5340381 5340386 +
taatttactctaaatatttatt

SEQ ID NO: 103616 - DNA, 22 bp, Artificial Sequence
  Synthetic oligonucleotide; TTT chr11 5340370 5340391 5340387 5340392 +
actctaaatatttattatagtt

SEQ ID NO: 103617 - DNA, 22 bp, Artificial Sequence
  Synthetic oligonucleotide; TTA chr11 5340371 5340392 5340388 5340393 +
ctctaaatatttattatagttt

SEQ ID NO: 103618 - DNA, 22 bp, Artificial Sequence
  Synthetic oligonucleotide; CTC chr11 5340374 5340395 5340391 5340396 +
taaatatttattatagtttgaa

SEQ ID NO: 103619 - DNA, 22 bp, Artificial Sequence
  Synthetic oligonucleotide; CTA chr11 5340376 5340397 5340393 5340398 +
aatatttattatagtttgaagt

SEQ ID NO: 103620 - DNA, 22 bp, Artificial Sequence
  Synthetic oligonucleotide; TTT chr11 5340383 5340404 5340400 5340405 +
attatagtttgaagtcacttgc

SEQ ID NO: 103621 - DNA, 22 bp, Artificial Sequence
  Synthetic oligonucleotide; TTA chr11 5340384 5340405 5340401 5340406 +
ttatagtttgaagtcacttgcc

SEQ ID NO: 103622 - DNA, 22 bp, Artificial Sequence
  Synthetic oligonucleotide; TTA chr11 5340387 5340408 5340404 5340409 +
tagtttgaagtcacttgcctga

SEQ ID NO: 103623 - DNA, 22 bp, Artificial Sequence
  Synthetic oligonucleotide; TTT chr11 5340393 5340414 5340410 5340415 +
gaagtcacttgcctgatgaaaa

SEQ ID NO: 103624 - DNA, 22 bp, Artificial Sequence
  Synthetic oligonucleotide; TTG chr11 5340394 5340415 5340411 5340416 +
aagtcacttgcctgatgaaaaa

SEQ ID NO: 103625 - DNA, 22 bp, Artificial Sequence
  Synthetic oligonucleotide; CTT chr11 5340403 5340424 5340420 5340425 +
gcctgatgaaaaacattgtcat

SEQ ID NO: 103626 - DNA, 22 bp, Artificial Sequence
  Synthetic oligonucleotide; TTG chr11 5340404 5340425 5340421 5340426 +
cctgatgaaaaacattgtcatt

SEQ ID NO: 103627 - DNA, 22 bp, Artificial Sequence
  Synthetic oligonucleotide; CTG chr11 5340408 5340429 5340425 5340430 +
atgaaaaacattgtcattaaca

SEQ ID NO: 103628 - DNA, 22 bp, Artificial Sequence
  Synthetic oligonucleotide; TTG chr11 5340421 5340442 5340438 5340443 +
tcattaacaattctaagcattg

SEQ ID NO: 103629 - DNA, 22 bp, Artificial Sequence
  Synthetic oligonucleotide; TTA chr11 5340427 5340448 5340444 5340449 +
acaattctaagcattgcatttt

SEQ ID NO: 103630 - DNA, 22 bp, Artificial Sequence
  Synthetic oligonucleotide; TTC chr11 5340434 5340455 5340451 5340456 +
taagcattgcattttagtaatt

SEQ ID NO: 103631 - DNA, 22 bp, Artificial Sequence
  Synthetic oligonucleotide; CTA chr11 5340436 5340457 5340453 5340458 +
agcattgcattttagtaattct

SEQ ID NO: 103632 - DNA, 22 bp, Artificial Sequence
  Synthetic oligonucleotide; TTG chr11 5340443 5340464 5340460 5340465 +
cattttagtaattctacaacaa

SEQ ID NO: 103633 - DNA, 22 bp, Artificial Sequence
  Synthetic oligonucleotide; TTT chr11 5340448 5340469 5340465 5340470 +
tagtaattctacaacaaaagca

SEQ ID NO: 103634 - DNA, 22 bp, Artificial Sequence
  Synthetic oligonucleotide; TTT chr11 5340449 5340470 5340466 5340471 +
agtaattctacaacaaaagcat

SEQ ID NO: 103635 - DNA, 22 bp, Artificial Sequence
  Synthetic oligonucleotide; TTA chr11 5340450 5340471 5340467 5340472 +
gtaattctacaacaaaagcatt

SEQ ID NO: 103636 - DNA, 22 bp, Artificial Sequence
  Synthetic oligonucleotide; TTC chr11 5340457 5340478 5340474 5340479 +
tacaacaaaagcattactcttt

SEQ ID NO: 103637 - DNA, 22 bp, Artificial Sequence
  Synthetic oligonucleotide; CTA chr11 5340459 5340480 5340476 5340481 +
caacaaaagcattactcttttt

SEQ ID NO: 103638 - DNA, 22 bp, Artificial Sequence
  Synthetic oligonucleotide; TTA chr11 5340473 5340494 5340490 5340495 +
ctctttttttttttgcaatgtc

SEQ ID NO: 103639 - DNA, 22 bp, Artificial Sequence
  Synthetic oligonucleotide; CTC chr11 5340476 5340497 5340493 5340498 +
tttttttttttgcaatgtcata

SEQ ID NO: 103640 - DNA, 22 bp, Artificial Sequence
  Synthetic oligonucleotide; CTT chr11 5340478 5340499 5340495 5340500 +
tttttttttgcaatgtcatatt

SEQ ID NO: 103641 - DNA, 22 bp, Artificial Sequence
  Synthetic oligonucleotide; TTT chr11 5340479 5340500 5340496 5340501 +
ttttttttgcaatgtcatattg

SEQ ID NO: 103642 - DNA, 22 bp, Artificial Sequence
  Synthetic oligonucleotide; TTT chr11 5340480 5340501 5340497 5340502 +
tttttttgcaatgtcatattga

SEQ ID NO: 103643 - DNA, 22 bp, Artificial Sequence
  Synthetic oligonucleotide; TTT chr11 5340481 5340502 5340498 5340503 +
ttttttgcaatgtcatattgaa

SEQ ID NO: 103644 - DNA, 22 bp, Artificial Sequence
  Synthetic oligonucleotide; TTT chr11 5340482 5340503 5340499 5340504 +
tttttgcaatgtcatattgaaa

SEQ ID NO: 103645 - DNA, 22 bp, Artificial Sequence
  Synthetic oligonucleotide; TTT chr11 5340483 5340504 5340500 5340505 +
ttttgcaatgtcatattgaaaa

SEQ ID NO: 103646 - DNA, 22 bp, Artificial Sequence
  Synthetic oligonucleotide; TTT chr11 5340484 5340505 5340501 5340506 +
tttgcaatgtcatattgaaaaa

SEQ ID NO: 103647 - DNA, 22 bp, Artificial Sequence
  Synthetic oligonucleotide; TTT chr11 5340485 5340506 5340502 5340507 +
ttgcaatgtcatattgaaaaat

SEQ ID NO: 103648 - DNA, 22 bp, Artificial Sequence
  Synthetic oligonucleotide; TTT chr11 5340486 5340507 5340503 5340508 +
tgcaatgtcatattgaaaaatt

SEQ ID NO: 103649 - DNA, 22 bp, Artificial Sequence
  Synthetic oligonucleotide; TTT chr11 5340487 5340508 5340504 5340509 +
gcaatgtcatattgaaaaattc

SEQ ID NO: 103650 - DNA, 22 bp, Artificial Sequence
  Synthetic oligonucleotide; TTG chr11 5340488 5340509 5340505 5340510 +
caatgtcatattgaaaaattct

SEQ ID NO: 103651 - DNA, 22 bp, Artificial Sequence
  Synthetic oligonucleotide; TTG chr11 5340501 5340522 5340518 5340523 +
aaaaattctttttaaaaaagtt

SEQ ID NO: 103652 - DNA, 22 bp, Artificial Sequence
  Synthetic oligonucleotide; TTC chr11 5340509 5340530 5340526 5340531 +
tttttaaaaaagttcttctact

SEQ ID NO: 103653 - DNA, 22 bp, Artificial Sequence
  Synthetic oligonucleotide; CTT chr11 5340511 5340532 5340528 5340533 +
tttaaaaaagttcttctactgc

SEQ ID NO: 103654 - DNA, 22 bp, Artificial Sequence
  Synthetic oligonucleotide; TTT chr11 5340512 5340533 5340529 5340534 +
ttaaaaaagttcttctactgcg

SEQ ID NO: 103655 - DNA, 22 bp, Artificial Sequence
  Synthetic oligonucleotide; TTT chr11 5340513 5340534 5340530 5340535 +
taaaaaagttcttctactgcgg

SEQ ID NO: 103656 - DNA, 22 bp, Artificial Sequence
  Synthetic oligonucleotide; TTT chr11 5340514 5340535 5340531 5340536 +
aaaaaagttcttctactgcggt

SEQ ID NO: 103657 - DNA, 22 bp, Artificial Sequence
  Synthetic oligonucleotide; TTA chr11 5340515 5340536 5340532 5340537 +
aaaaagttcttctactgcggtt

SEQ ID NO: 103658 - DNA, 22 bp, Artificial Sequence
  Synthetic oligonucleotide; TTC chr11 5340524 5340545 5340541 5340546 +
ttctactgcggttaggagtttg

SEQ ID NO: 103659 - DNA, 22 bp, Artificial Sequence
  Synthetic oligonucleotide; CTT chr11 5340526 5340547 5340543 5340548 +
ctactgcggttaggagtttgga

SEQ ID NO: 103660 - DNA, 22 bp, Artificial Sequence
  Synthetic oligonucleotide; TTC chr11 5340527 5340548 5340544 5340549 +
tactgcggttaggagtttggag

SEQ ID NO: 103661 - DNA, 22 bp, Artificial Sequence
  Synthetic oligonucleotide; CTA chr11 5340529 5340550 5340546 5340551 +
ctgcggttaggagtttggagat

SEQ ID NO: 103662 - DNA, 22 bp, Artificial Sequence
  Synthetic oligonucleotide; CTG chr11 5340532 5340553 5340549 5340554 +
cggttaggagtttggagataca

SEQ ID NO: 103663 - DNA, 22 bp, Artificial Sequence
  Synthetic oligonucleotide; TTA chr11 5340538 5340559 5340555 5340560 +
ggagtttggagatacaatgcaa

SEQ ID NO: 103664 - DNA, 22 bp, Artificial Sequence
  Synthetic oligonucleotide; TTT chr11 5340545 5340566 5340562 5340567 +
ggagatacaatgcaaaatatca

SEQ ID NO: 103665 - DNA, 22 bp, Artificial Sequence
  Synthetic oligonucleotide; TTG chr11 5340546 5340567 5340563 5340568 +
gagatacaatgcaaaatatcag

SEQ ID NO: 103666 - DNA, 22 bp, Artificial Sequence
  Synthetic oligonucleotide; TTT chr11 5340571 5340592 5340588 5340593 +
tcatagggaacaatatttttgg

SEQ ID NO: 103667 - DNA, 22 bp, Artificial Sequence
  Synthetic oligonucleotide; TTT chr11 5340572 5340593 5340589 5340594 +
catagggaacaatatttttgga

SEQ ID NO: 103668 - DNA, 22 bp, Artificial Sequence
  Synthetic oligonucleotide; TTC chr11 5340573 5340594 5340590 5340595 +
atagggaacaatatttttggag

SEQ ID NO: 103669 - DNA, 22 bp, Artificial Sequence
  Synthetic oligonucleotide; TTT chr11 5340589 5340610 5340606 5340611 +
ttggagtagaaggaggagaaat

SEQ ID NO: 103670 - DNA, 22 bp, Artificial Sequence
  Synthetic oligonucleotide; TTT chr11 5340590 5340611 5340607 5340612 +
tggagtagaaggaggagaaatt

SEQ ID NO: 103671 - DNA, 22 bp, Artificial Sequence
  Synthetic oligonucleotide; TTT chr11 5340591 5340612 5340608 5340613 +
ggagtagaaggaggagaaattt

SEQ ID NO: 103672 - DNA, 22 bp, Artificial Sequence
  Synthetic oligonucleotide; TTG chr11 5340592 5340613 5340609 5340614 +
gagtagaaggaggagaaatttt

SEQ ID NO: 103673 - DNA, 22 bp, Artificial Sequence
  Synthetic oligonucleotide; TTT chr11 5340613 5340634 5340630 5340635 +
tcagaaaaagaaagtaggtact

SEQ ID NO: 103674 - DNA, 22 bp, Artificial Sequence
  Synthetic oligonucleotide; TTT chr11 5340614 5340635 5340631 5340636 +
cagaaaaagaaagtaggtacta

SEQ ID NO: 103675 - DNA, 22 bp, Artificial Sequence
  Synthetic oligonucleotide; TTC chr11 5340615 5340636 5340632 5340637 +
agaaaaagaaagtaggtactac

SEQ ID NO: 103676 - DNA, 22 bp, Artificial Sequence
  Synthetic oligonucleotide; CTA chr11 5340636 5340657 5340653 5340658 +
caagcatgacggaatacaaggc

SEQ ID NO: 103677 - DNA, 22 bp, Artificial Sequence
  Synthetic oligonucleotide; CTA chr11 5340676 5340697 5340693 5340698 +
aggatagtctactgtagtggag

SEQ ID NO: 103678 - DNA, 22 bp, Artificial Sequence
  Synthetic oligonucleotide; CTA chr11 5340687 5340708 5340704 5340709 +
ctgtagtggagtaccattcaca

SEQ ID NO: 103679 - DNA, 22 bp, Artificial Sequence
  Synthetic oligonucleotide; CTG chr11 5340690 5340711 5340707 5340712 +
tagtggagtaccattcacactg

SEQ ID NO: 103680 - DNA, 22 bp, Artificial Sequence
  Synthetic oligonucleotide; TTC chr11 5340706 5340727 5340723 5340728 +
acactggccttatagttagaag

SEQ ID NO: 103681 - DNA, 22 bp, Artificial Sequence
  Synthetic oligonucleotide; CTG chr11 5340712 5340733 5340729 5340734 +
gccttatagttagaagatataa

SEQ ID NO: 103682 - DNA, 22 bp, Artificial Sequence
  Synthetic oligonucleotide; CTT chr11 5340717 5340738 5340734 5340739 +
atagttagaagatataaatttg

SEQ ID NO: 103683 - DNA, 22 bp, Artificial Sequence
  Synthetic oligonucleotide; TTA chr11 5340718 5340739 5340735 5340740 +
tagttagaagatataaatttga

SEQ ID NO: 103684 - DNA, 22 bp, Artificial Sequence
  Synthetic oligonucleotide; TTA chr11 5340724 5340745 5340741 5340746 +
gaagatataaatttgaatcatg

SEQ ID NO: 103685 - DNA, 22 bp, Artificial Sequence
  Synthetic oligonucleotide; TTT chr11 5340738 5340759 5340755 5340760 +
gaatcatgactataccaattaa

SEQ ID NO: 103686 - DNA, 22 bp, Artificial Sequence
  Synthetic oligonucleotide; TTG chr11 5340739 5340760 5340756 5340761 +
aatcatgactataccaattaaa

SEQ ID NO: 103687 - DNA, 22 bp, Artificial Sequence
  Synthetic oligonucleotide; CTA chr11 5340750 5340771 5340767 5340772 +
taccaattaaaaatgttatgcc

SEQ ID NO: 103688 - DNA, 22 bp, Artificial Sequence
  Synthetic oligonucleotide; TTA chr11 5340759 5340780 5340776 5340781 +
aaaatgttatgcccttggaggg

SEQ ID NO: 103689 - DNA, 22 bp, Artificial Sequence
  Synthetic oligonucleotide; TTA chr11 5340768 5340789 5340785 5340790 +
tgcccttggagggaatatttaa

SEQ ID NO: 103690 - DNA, 22 bp, Artificial Sequence
  Synthetic oligonucleotide; CTT chr11 5340775 5340796 5340792 5340797 +
ggagggaatatttaactttttt

SEQ ID NO: 103691 - DNA, 22 bp, Artificial Sequence
  Synthetic oligonucleotide; TTG chr11 5340776 5340797 5340793 5340798 +
gagggaatatttaactttttta

SEQ ID NO: 103692 - DNA, 22 bp, Artificial Sequence
  Synthetic oligonucleotide; TTT chr11 5340788 5340809 5340805 5340810 +
aacttttttatattaaatttcc

SEQ ID NO: 103693 - DNA, 22 bp, Artificial Sequence
  Synthetic oligonucleotide; TTA chr11 5340789 5340810 5340806 5340811 +
acttttttatattaaatttccc

SEQ ID NO: 103694 - DNA, 22 bp, Artificial Sequence
  Synthetic oligonucleotide; CTT chr11 5340793 5340814 5340810 5340815 +
ttttatattaaatttccccatc

SEQ ID NO: 103695 - DNA, 22 bp, Artificial Sequence
  Synthetic oligonucleotide; TTT chr11 5340794 5340815 5340811 5340816 +
tttatattaaatttccccatca

SEQ ID NO: 103696 - DNA, 22 bp, Artificial Sequence
  Synthetic oligonucleotide; TTT chr11 5340795 5340816 5340812 5340817 +
ttatattaaatttccccatcaa

SEQ ID NO: 103697 - DNA, 22 bp, Artificial Sequence
  Synthetic oligonucleotide; TTT chr11 5340796 5340817 5340813 5340818 +
tatattaaatttccccatcaag

SEQ ID NO: 103698 - DNA, 22 bp, Artificial Sequence
  Synthetic oligonucleotide; TTT chr11 5340797 5340818 5340814 5340819 +
atattaaatttccccatcaaga

SEQ ID NO: 103699 - DNA, 22 bp, Artificial Sequence
  Synthetic oligonucleotide; TTA chr11 5340798 5340819 5340815 5340820 +
tattaaatttccccatcaagaa

SEQ ID NO: 103700 - DNA, 22 bp, Artificial Sequence
  Synthetic oligonucleotide; TTA chr11 5340803 5340824 5340820 5340825 +
aatttccccatcaagaaaacag

SEQ ID NO: 103701 - DNA, 22 bp, Artificial Sequence
  Synthetic oligonucleotide; TTT chr11 5340808 5340829 5340825 5340830 +
ccccatcaagaaaacagtgata

SEQ ID NO: 103702 - DNA, 22 bp, Artificial Sequence
  Synthetic oligonucleotide; TTC chr11 5340809 5340830 5340826 5340831 +
cccatcaagaaaacagtgataa

SEQ ID NO: 103703 - DNA, 22 bp, Artificial Sequence
  Synthetic oligonucleotide; CTA chr11 5340837 5340858 5340854 5340859 +
ccccacaatatttttatgaata

SEQ ID NO: 103704 - DNA, 22 bp, Artificial Sequence
  Synthetic oligonucleotide; TTT chr11 5340850 5340871 5340867 5340872 +
ttatgaataaaataagttgtgg

SEQ ID NO: 103705 - DNA, 22 bp, Artificial Sequence
  Synthetic oligonucleotide; TTT chr11 5340851 5340872 5340868 5340873 +
tatgaataaaataagttgtgga

SEQ ID NO: 103706 - DNA, 22 bp, Artificial Sequence
  Synthetic oligonucleotide; TTT chr11 5340852 5340873 5340869 5340874 +
atgaataaaataagttgtggat

SEQ ID NO: 103707 - DNA, 22 bp, Artificial Sequence
  Synthetic oligonucleotide; TTA chr11 5340853 5340874 5340870 5340875 +
tgaataaaataagttgtggatg

SEQ ID NO: 103708 - DNA, 22 bp, Artificial Sequence
  Synthetic oligonucleotide; TTG chr11 5340869 5340890 5340886 5340891 +
tggatgtagtagagcataatta

SEQ ID NO: 103709 - DNA, 22 bp, Artificial Sequence
  Synthetic oligonucleotide; TTA chr11 5340891 5340912 5340908 5340913 +
agggacacatgtttggttttat

SEQ ID NO: 103710 - DNA, 22 bp, Artificial Sequence
  Synthetic oligonucleotide; TTT chr11 5340905 5340926 5340922 5340927 +
ggttttatgaatgattgaaaac

SEQ ID NO: 103711 - DNA, 22 bp, Artificial Sequence
  Synthetic oligonucleotide; TTG chr11 5340906 5340927 5340923 5340928 +
gttttatgaatgattgaaaaca

SEQ ID NO: 103712 - DNA, 22 bp, Artificial Sequence
  Synthetic oligonucleotide; TTT chr11 5340910 5340931 5340927 5340932 +
tatgaatgattgaaaacaggac

SEQ ID NO: 103713 - DNA, 22 bp, Artificial Sequence
  Synthetic oligonucleotide; TTT chr11 5340911 5340932 5340928 5340933 +
atgaatgattgaaaacaggaca

SEQ ID NO: 103714 - DNA, 22 bp, Artificial Sequence
  Synthetic oligonucleotide; TTA chr11 5340912 5340933 5340929 5340934 +
tgaatgattgaaaacaggacaa

SEQ ID NO: 103715 - DNA, 22 bp, Artificial Sequence
  Synthetic oligonucleotide; TTG chr11 5340922 5340943 5340939 5340944 +
aaaacaggacaaaaacctacca

SEQ ID NO: 103716 - DNA, 22 bp, Artificial Sequence
  Synthetic oligonucleotide; CTA chr11 5340941 5340962 5340958 5340963 +
ccatcacatatatgcactcaca

SEQ ID NO: 103717 - DNA, 22 bp, Artificial Sequence
  Synthetic oligonucleotide; CTC chr11 5340960 5340981 5340977 5340982 +
acactcacaatttagtattcag

SEQ ID NO: 103718 - DNA, 22 bp, Artificial Sequence
  Synthetic oligonucleotide; CTC chr11 5340966 5340987 5340983 5340988 +
acaatttagtattcagactgtg

SEQ ID NO: 103719 - DNA, 22 bp, Artificial Sequence
  Synthetic oligonucleotide; TTT chr11 5340973 5340994 5340990 5340995 +
agtattcagactgtgttgctca

SEQ ID NO: 103720 - DNA, 22 bp, Artificial Sequence
  Synthetic oligonucleotide; TTA chr11 5340974 5340995 5340991 5340996 +
gtattcagactgtgttgctcag

SEQ ID NO: 103721 - DNA, 22 bp, Artificial Sequence
  Synthetic oligonucleotide; TTC chr11 5340980 5341001 5340997 5341002 +
agactgtgttgctcaggtgaca

SEQ ID NO: 103722 - DNA, 22 bp, Artificial Sequence
  Synthetic oligonucleotide; CTG chr11 5340986 5341007 5341003 5341008 +
tgttgctcaggtgacatggcgt

SEQ ID NO: 103723 - DNA, 22 bp, Artificial Sequence
  Synthetic oligonucleotide; TTG chr11 5340991 5341012 5341008 5341013 +
ctcaggtgacatggcgtgacaa

SEQ ID NO: 103724 - DNA, 22 bp, Artificial Sequence
  Synthetic oligonucleotide; CTC chr11 5340994 5341015 5341011 5341016 +
aggtgacatggcgtgacaagga

SEQ ID NO: 103725 - DNA, 22 bp, Artificial Sequence
  Synthetic oligonucleotide; CTG chr11 5341036 5341057 5341053 5341058 +
atttttttatatgttcagttct

SEQ ID NO: 103726 - DNA, 22 bp, Artificial Sequence
  Synthetic oligonucleotide; TTT chr11 5341040 5341061 5341057 5341062 +
ttttatatgttcagttctttca

SEQ ID NO: 103727 - DNA, 22 bp, Artificial Sequence
  Synthetic oligonucleotide; TTT chr11 5341041 5341062 5341058 5341063 +
tttatatgttcagttctttcac

SEQ ID NO: 103728 - DNA, 22 bp, Artificial Sequence
  Synthetic oligonucleotide; TTT chr11 5341042 5341063 5341059 5341064 +
ttatatgttcagttctttcaca

SEQ ID NO: 103729 - DNA, 22 bp, Artificial Sequence
  Synthetic oligonucleotide; TTT chr11 5341043 5341064 5341060 5341065 +
tatatgttcagttctttcacaa

SEQ ID NO: 103730 - DNA, 22 bp, Artificial Sequence
  Synthetic oligonucleotide; TTT chr11 5341044 5341065 5341061 5341066 +
atatgttcagttctttcacaat

SEQ ID NO: 103731 - DNA, 22 bp, Artificial Sequence
  Synthetic oligonucleotide; TTA chr11 5341045 5341066 5341062 5341067 +
tatgttcagttctttcacaatt

SEQ ID NO: 103732 - DNA, 22 bp, Artificial Sequence
  Synthetic oligonucleotide; TTC chr11 5341052 5341073 5341069 5341074 +
agttctttcacaattacatctc

SEQ ID NO: 103733 - DNA, 22 bp, Artificial Sequence
  Synthetic oligonucleotide; TTC chr11 5341057 5341078 5341074 5341079 +
tttcacaattacatctcttaat

SEQ ID NO: 103734 - DNA, 22 bp, Artificial Sequence
  Synthetic oligonucleotide; CTT chr11 5341059 5341080 5341076 5341081 +
tcacaattacatctcttaatga

SEQ ID NO: 103735 - DNA, 22 bp, Artificial Sequence
  Synthetic oligonucleotide; TTT chr11 5341060 5341081 5341077 5341082 +
cacaattacatctcttaatgaa

SEQ ID NO: 103736 - DNA, 22 bp, Artificial Sequence
  Synthetic oligonucleotide; TTC chr11 5341061 5341082 5341078 5341083 +
acaattacatctcttaatgaaa

SEQ ID NO: 103737 - DNA, 22 bp, Artificial Sequence
  Synthetic oligonucleotide; TTA chr11 5341068 5341089 5341085 5341090 +
catctcttaatgaaacagaata

SEQ ID NO: 103738 - DNA, 22 bp, Artificial Sequence
  Synthetic oligonucleotide; CTC chr11 5341074 5341095 5341091 5341096 +
ttaatgaaacagaatataaata

SEQ ID NO: 103739 - DNA, 22 bp, Artificial Sequence
  Synthetic oligonucleotide; CTT chr11 5341076 5341097 5341093 5341098 +
aatgaaacagaatataaataag

SEQ ID NO: 103740 - DNA, 22 bp, Artificial Sequence
  Synthetic oligonucleotide; TTA chr11 5341077 5341098 5341094 5341099 +
atgaaacagaatataaataagg

SEQ ID NO: 103741 - DNA, 22 bp, Artificial Sequence
  Synthetic oligonucleotide; TTG chr11 5341103 5341124 5341120 5341125 +
cagtttttcttaagttggactc

SEQ ID NO: 103742 - DNA, 22 bp, Artificial Sequence
  Synthetic oligonucleotide; TTT chr11 5341109 5341130 5341126 5341131 +
ttcttaagttggactctctatg

SEQ ID NO: 103743 - DNA, 22 bp, Artificial Sequence
  Synthetic oligonucleotide; TTT chr11 5341110 5341131 5341127 5341132 +
tcttaagttggactctctatga

SEQ ID NO: 103744 - DNA, 22 bp, Artificial Sequence
  Synthetic oligonucleotide; TTT chr11 5341111 5341132 5341128 5341133 +
cttaagttggactctctatgag

SEQ ID NO: 103745 - DNA, 22 bp, Artificial Sequence
  Synthetic oligonucleotide; TTC chr11 5341112 5341133 5341129 5341134 +
ttaagttggactctctatgagc

SEQ ID NO: 103746 - DNA, 22 bp, Artificial Sequence
  Synthetic oligonucleotide; CTT chr11 5341114 5341135 5341131 5341136 +
aagttggactctctatgagcaa

SEQ ID NO: 103747 - DNA, 22 bp, Artificial Sequence
  Synthetic oligonucleotide; TTA chr11 5341115 5341136 5341132 5341137 +
agttggactctctatgagcaat

SEQ ID NO: 103748 - DNA, 22 bp, Artificial Sequence
  Synthetic oligonucleotide; TTG chr11 5341120 5341141 5341137 5341142 +
gactctctatgagcaatacctg

SEQ ID NO: 103749 - DNA, 22 bp, Artificial Sequence
  Synthetic oligonucleotide; CTC chr11 5341125 5341146 5341142 5341147 +
tctatgagcaatacctgagata

SEQ ID NO: 103750 - DNA, 22 bp, Artificial Sequence
  Synthetic oligonucleotide; CTC chr11 5341127 5341148 5341144 5341149 +
tatgagcaatacctgagatagg

SEQ ID NO: 103751 - DNA, 22 bp, Artificial Sequence
  Synthetic oligonucleotide; CTA chr11 5341129 5341150 5341146 5341151 +
tgagcaatacctgagataggga

SEQ ID NO: 103752 - DNA, 22 bp, Artificial Sequence
  Synthetic oligonucleotide; CTG chr11 5341142 5341163 5341159 5341164 +
agatagggattcaaatgtgtgc

SEQ ID NO: 103753 - DNA, 22 bp, Artificial Sequence
  Synthetic oligonucleotide; TTC chr11 5341154 5341175 5341171 5341176 +
aaatgtgtgcaatttattaatg

SEQ ID NO: 103754 - DNA, 22 bp, Artificial Sequence
  Synthetic oligonucleotide; TTT chr11 5341169 5341190 5341186 5341191 +
attaatgaatgctctcaggaga

SEQ ID NO: 103755 - DNA, 22 bp, Artificial Sequence
  Synthetic oligonucleotide; TTA chr11 5341170 5341191 5341187 5341192 +
ttaatgaatgctctcaggagac

SEQ ID NO: 103756 - DNA, 22 bp, Artificial Sequence
  Synthetic oligonucleotide; TTA chr11 5341173 5341194 5341190 5341195 +
atgaatgctctcaggagacagg

SEQ ID NO: 103757 - DNA, 22 bp, Artificial Sequence
  Synthetic oligonucleotide; CTC chr11 5341183 5341204 5341200 5341205 +
tcaggagacagggagcaagtaa

SEQ ID NO: 103758 - DNA, 22 bp, Artificial Sequence
  Synthetic oligonucleotide; CTC chr11 5341185 5341206 5341202 5341207 +
aggagacagggagcaagtaaaa

SEQ ID NO: 103759 - DNA, 22 bp, Artificial Sequence
  Synthetic oligonucleotide; CTG chr11 5341247 5341268 5341264 5341269 +
aagctggagcttagcttcagaa

SEQ ID NO: 103760 - DNA, 22 bp, Artificial Sequence
  Synthetic oligonucleotide; CTG chr11 5341253 5341274 5341270 5341275 +
gagcttagcttcagaaggcaag

SEQ ID NO: 103761 - DNA, 22 bp, Artificial Sequence
  Synthetic oligonucleotide; CTT chr11 5341259 5341280 5341276 5341281 +
agcttcagaaggcaagagggtc

SEQ ID NO: 103762 - DNA, 22 bp, Artificial Sequence
  Synthetic oligonucleotide; TTA chr11 5341260 5341281 5341277 5341282 +
gcttcagaaggcaagagggtca

SEQ ID NO: 103763 - DNA, 22 bp, Artificial Sequence
  Synthetic oligonucleotide; CTT chr11 5341264 5341285 5341281 5341286 +
cagaaggcaagagggtcagtat

SEQ ID NO: 103764 - DNA, 22 bp, Artificial Sequence
  Synthetic oligonucleotide; TTC chr11 5341265 5341286 5341282 5341287 +
agaaggcaagagggtcagtatt

SEQ ID NO: 103765 - DNA, 22 bp, Artificial Sequence
  Synthetic oligonucleotide; TTT chr11 5341288 5341309 5341305 5341310 +
gcctatggcctgctacctaagg

SEQ ID NO: 103766 - DNA, 22 bp, Artificial Sequence
  Synthetic oligonucleotide; TTG chr11 5341289 5341310 5341306 5341311 +
cctatggcctgctacctaagga

SEQ ID NO: 103767 - DNA, 22 bp, Artificial Sequence
  Synthetic oligonucleotide; CTA chr11 5341293 5341314 5341310 5341315 +
tggcctgctacctaaggagcag

SEQ ID NO: 103768 - DNA, 22 bp, Artificial Sequence
  Synthetic oligonucleotide; CTG chr11 5341300 5341321 5341317 5341322 +
ctacctaaggagcaggggccat

SEQ ID NO: 103769 - DNA, 22 bp, Artificial Sequence
  Synthetic oligonucleotide; CTA chr11 5341303 5341324 5341320 5341325 +
cctaaggagcaggggccatttt

SEQ ID NO: 103770 - DNA, 22 bp, Artificial Sequence
  Synthetic oligonucleotide; CTA chr11 5341307 5341328 5341324 5341329 +
aggagcaggggccattttcttc

SEQ ID NO: 103771 - DNA, 22 bp, Artificial Sequence
  Synthetic oligonucleotide; TTT chr11 5341324 5341345 5341341 5341346 +
tcttcataagacatttcctgct

SEQ ID NO: 103772 - DNA, 22 bp, Artificial Sequence
  Synthetic oligonucleotide; TTT chr11 5341325 5341346 5341342 5341347 +
cttcataagacatttcctgctg

SEQ ID NO: 103773 - DNA, 22 bp, Artificial Sequence
  Synthetic oligonucleotide; TTC chr11 5341326 5341347 5341343 5341348 +
ttcataagacatttcctgctga

SEQ ID NO: 103774 - DNA, 22 bp, Artificial Sequence
  Synthetic oligonucleotide; CTT chr11 5341328 5341349 5341345 5341350 +
cataagacatttcctgctgagt

SEQ ID NO: 103775 - DNA, 22 bp, Artificial Sequence
  Synthetic oligonucleotide; TTC chr11 5341329 5341350 5341346 5341351 +
ataagacatttcctgctgagtt

SEQ ID NO: 103776 - DNA, 22 bp, Artificial Sequence
  Synthetic oligonucleotide; TTT chr11 5341340 5341361 5341357 5341362 +
cctgctgagttgagaacaacaa

SEQ ID NO: 103777 - DNA, 22 bp, Artificial Sequence
  Synthetic oligonucleotide; TTC chr11 5341341 5341362 5341358 5341363 +
ctgctgagttgagaacaacaac

SEQ ID NO: 103778 - DNA, 22 bp, Artificial Sequence
  Synthetic oligonucleotide; CTG chr11 5341344 5341365 5341361 5341366 +
ctgagttgagaacaacaacctg

SEQ ID NO: 103779 - DNA, 22 bp, Artificial Sequence
  Synthetic oligonucleotide; CTG chr11 5341347 5341368 5341364 5341369 +
agttgagaacaacaacctgcag

SEQ ID NO: 103780 - DNA, 22 bp, Artificial Sequence
  Synthetic oligonucleotide; TTG chr11 5341352 5341373 5341369 5341374 +
agaacaacaacctgcagaaagc

SEQ ID NO: 103781 - DNA, 22 bp, Artificial Sequence
  Synthetic oligonucleotide; CTG chr11 5341366 5341387 5341383 5341388 +
cagaaagcagaaacatgaacaa

SEQ ID NO: 103782 - DNA, 22 bp, Artificial Sequence
  Synthetic oligonucleotide; TTC chr11 5341404 5341425 5341421 5341426 +
acaggtgcacaattctgtaaaa

SEQ ID NO: 103783 - DNA, 22 bp, Artificial Sequence
  Synthetic oligonucleotide; TTC chr11 5341419 5341440 5341436 5341441 +
tgtaaaatgatcggggtaaaac

SEQ ID NO: 103784 - DNA, 22 bp, Artificial Sequence
  Synthetic oligonucleotide; CTG chr11 5341421 5341442 5341438 5341443 +
taaaatgatcggggtaaaacac

SEQ ID NO: 103785 - DNA, 22 bp, Artificial Sequence
  Synthetic oligonucleotide; CTT chr11 5341464 5341485 5341481 5341486 +
ctatatagtcccctctcttgtc

SEQ ID NO: 103786 - DNA, 22 bp, Artificial Sequence
  Synthetic oligonucleotide; TTC chr11 5341465 5341486 5341482 5341487 +
tatatagtcccctctcttgtct

SEQ ID NO: 103787 - DNA, 22 bp, Artificial Sequence
  Synthetic oligonucleotide; CTA chr11 5341467 5341488 5341484 5341489 +
tatagtcccctctcttgtctca

SEQ ID NO: 103788 - DNA, 22 bp, Artificial Sequence
  Synthetic oligonucleotide; CTC chr11 5341479 5341500 5341496 5341501 +
tcttgtctcactgaagtattat

SEQ ID NO: 103789 - DNA, 22 bp, Artificial Sequence
  Synthetic oligonucleotide; CTC chr11 5341481 5341502 5341498 5341503 +
ttgtctcactgaagtattattt

SEQ ID NO: 103790 - DNA, 22 bp, Artificial Sequence
  Synthetic oligonucleotide; CTT chr11 5341483 5341504 5341500 5341505 +
gtctcactgaagtattattttt

SEQ ID NO: 103791 - DNA, 22 bp, Artificial Sequence
  Synthetic oligonucleotide; TTG chr11 5341484 5341505 5341501 5341506 +
tctcactgaagtattatttttg

SEQ ID NO: 103792 - DNA, 22 bp, Artificial Sequence
  Synthetic oligonucleotide; CTC chr11 5341488 5341509 5341505 5341510 +
actgaagtattatttttgctct

SEQ ID NO: 103793 - DNA, 22 bp, Artificial Sequence
  Synthetic oligonucleotide; CTG chr11 5341492 5341513 5341509 5341514 +
aagtattatttttgctctgatt

SEQ ID NO: 103794 - DNA, 22 bp, Artificial Sequence
  Synthetic oligonucleotide; TTA chr11 5341500 5341521 5341517 5341522 +
tttttgctctgattaaagtata

SEQ ID NO: 103795 - DNA, 22 bp, Artificial Sequence
  Synthetic oligonucleotide; TTT chr11 5341503 5341524 5341520 5341525 +
ttgctctgattaaagtataatt

SEQ ID NO: 103796 - DNA, 22 bp, Artificial Sequence
  Synthetic oligonucleotide; TTT chr11 5341504 5341525 5341521 5341526 +
tgctctgattaaagtataatta

SEQ ID NO: 103797 - DNA, 22 bp, Artificial Sequence
  Synthetic oligonucleotide; TTT chr11 5341505 5341526 5341522 5341527 +
gctctgattaaagtataattaa

SEQ ID NO: 103798 - DNA, 22 bp, Artificial Sequence
  Synthetic oligonucleotide; TTG chr11 5341506 5341527 5341523 5341528 +
ctctgattaaagtataattaag

SEQ ID NO: 103799 - DNA, 22 bp, Artificial Sequence
  Synthetic oligonucleotide; CTC chr11 5341509 5341530 5341526 5341531 +
tgattaaagtataattaagaca

SEQ ID NO: 103800 - DNA, 22 bp, Artificial Sequence
  Synthetic oligonucleotide; CTG chr11 5341511 5341532 5341528 5341533 +
attaaagtataattaagacata

SEQ ID NO: 103801 - DNA, 22 bp, Artificial Sequence
  Synthetic oligonucleotide; TTA chr11 5341515 5341536 5341532 5341537 +
aagtataattaagacataacct

SEQ ID NO: 103802 - DNA, 22 bp, Artificial Sequence
  Synthetic oligonucleotide; TTA chr11 5341526 5341547 5341543 5341548 +
agacataacctccctcttttta

SEQ ID NO: 103803 - DNA, 22 bp, Artificial Sequence
  Synthetic oligonucleotide; CTC chr11 5341538 5341559 5341555 5341560 +
cctctttttaggatattttaaa

SEQ ID NO: 103804 - DNA, 22 bp, Artificial Sequence
  Synthetic oligonucleotide; CTC chr11 5341542 5341563 5341559 5341564 +
tttttaggatattttaaattga

SEQ ID NO: 103805 - DNA, 22 bp, Artificial Sequence
  Synthetic oligonucleotide; CTT chr11 5341544 5341565 5341561 5341566 +
tttaggatattttaaattgagt

SEQ ID NO: 103806 - DNA, 22 bp, Artificial Sequence
  Synthetic oligonucleotide; TTT chr11 5341545 5341566 5341562 5341567 +
ttaggatattttaaattgagtt

SEQ ID NO: 103807 - DNA, 22 bp, Artificial Sequence
  Synthetic oligonucleotide; TTT chr11 5341546 5341567 5341563 5341568 +
taggatattttaaattgagtta

SEQ ID NO: 103808 - DNA, 22 bp, Artificial Sequence
  Synthetic oligonucleotide; TTT chr11 5341547 5341568 5341564 5341569 +
aggatattttaaattgagttat

SEQ ID NO: 103809 - DNA, 22 bp, Artificial Sequence
  Synthetic oligonucleotide; TTA chr11 5341548 5341569 5341565 5341570 +
ggatattttaaattgagttatg

SEQ ID NO: 103810 - DNA, 22 bp, Artificial Sequence
  Synthetic oligonucleotide; TTT chr11 5341556 5341577 5341573 5341578 +
taaattgagttatgggtccctt

SEQ ID NO: 103811 - DNA, 22 bp, Artificial Sequence
  Synthetic oligonucleotide; TTT chr11 5341557 5341578 5341574 5341579 +
aaattgagttatgggtcccttc

SEQ ID NO: 103812 - DNA, 22 bp, Artificial Sequence
  Synthetic oligonucleotide; TTA chr11 5341558 5341579 5341575 5341580 +
aattgagttatgggtcccttcc

SEQ ID NO: 103813 - DNA, 22 bp, Artificial Sequence
  Synthetic oligonucleotide; TTG chr11 5341563 5341584 5341580 5341585 +
agttatgggtcccttcctaact

SEQ ID NO: 103814 - DNA, 22 bp, Artificial Sequence
  Synthetic oligonucleotide; TTA chr11 5341568 5341589 5341585 5341590 +
tgggtcccttcctaactcatca

SEQ ID NO: 103815 - DNA, 22 bp, Artificial Sequence
  Synthetic oligonucleotide; CTT chr11 5341578 5341599 5341595 5341600 +
cctaactcatcagacaatttta

SEQ ID NO: 103816 - DNA, 22 bp, Artificial Sequence
  Synthetic oligonucleotide; TTC chr11 5341579 5341600 5341596 5341601 +
ctaactcatcagacaattttaa

SEQ ID NO: 103817 - DNA, 22 bp, Artificial Sequence
  Synthetic oligonucleotide; CTA chr11 5341582 5341603 5341599 5341604 +
actcatcagacaattttaatca

SEQ ID NO: 103818 - DNA, 22 bp, Artificial Sequence
  Synthetic oligonucleotide; CTC chr11 5341586 5341607 5341603 5341608 +
atcagacaattttaatcaaatg

SEQ ID NO: 103819 - DNA, 22 bp, Artificial Sequence
  Synthetic oligonucleotide; TTT chr11 5341598 5341619 5341615 5341620 +
taatcaaatgagaatgacattg

SEQ ID NO: 103820 - DNA, 22 bp, Artificial Sequence
  Synthetic oligonucleotide; TTT chr11 5341599 5341620 5341616 5341621 +
aatcaaatgagaatgacattgt

SEQ ID NO: 103821 - DNA, 22 bp, Artificial Sequence
  Synthetic oligonucleotide; TTA chr11 5341600 5341621 5341617 5341622 +
atcaaatgagaatgacattgtt

SEQ ID NO: 103822 - DNA, 22 bp, Artificial Sequence
  Synthetic oligonucleotide; TTG chr11 5341620 5341641 5341637 5341642 +
ttgtattctttgggaaatttac

SEQ ID NO: 103823 - DNA, 22 bp, Artificial Sequence
  Synthetic oligonucleotide; TTG chr11 5341623 5341644 5341640 5341645 +
tattctttgggaaatttacact

SEQ ID NO: 103824 - DNA, 22 bp, Artificial Sequence
  Synthetic oligonucleotide; TTC chr11 5341628 5341649 5341645 5341650 +
tttgggaaatttacacttatta

SEQ ID NO: 103825 - DNA, 22 bp, Artificial Sequence
  Synthetic oligonucleotide; CTT chr11 5341630 5341651 5341647 5341652 +
tgggaaatttacacttattaca

SEQ ID NO: 103826 - DNA, 22 bp, Artificial Sequence
  Synthetic oligonucleotide; TTT chr11 5341631 5341652 5341648 5341653 +
gggaaatttacacttattacat

SEQ ID NO: 103827 - DNA, 22 bp, Artificial Sequence
  Synthetic oligonucleotide; TTG chr11 5341632 5341653 5341649 5341654 +
ggaaatttacacttattacatg

SEQ ID NO: 103828 - DNA, 22 bp, Artificial Sequence
  Synthetic oligonucleotide; TTT chr11 5341640 5341661 5341657 5341662 +
acacttattacatggaatcaga

SEQ ID NO: 103829 - DNA, 22 bp, Artificial Sequence
  Synthetic oligonucleotide; TTA chr11 5341641 5341662 5341658 5341663 +
cacttattacatggaatcagaa

SEQ ID NO: 103830 - DNA, 22 bp, Artificial Sequence
  Synthetic oligonucleotide; CTT chr11 5341646 5341667 5341663 5341668 +
attacatggaatcagaatgtat

SEQ ID NO: 103831 - DNA, 22 bp, Artificial Sequence
  Synthetic oligonucleotide; TTA chr11 5341647 5341668 5341664 5341669 +
ttacatggaatcagaatgtatg

SEQ ID NO: 103832 - DNA, 22 bp, Artificial Sequence
  Synthetic oligonucleotide; TTA chr11 5341650 5341671 5341667 5341672 +
catggaatcagaatgtatgtac

SEQ ID NO: 103833 - DNA, 22 bp, Artificial Sequence
  Synthetic oligonucleotide; TTC chr11 5341687 5341708 5341704 5341709 +
ttcaaaaaaatgcagaaaccta

SEQ ID NO: 103834 - DNA, 22 bp, Artificial Sequence
  Synthetic oligonucleotide; CTT chr11 5341689 5341710 5341706 5341711 +
caaaaaaatgcagaaacctatt

SEQ ID NO: 103835 - DNA, 22 bp, Artificial Sequence
  Synthetic oligonucleotide; TTC chr11 5341690 5341711 5341707 5341712 +
aaaaaaatgcagaaacctattt

SEQ ID NO: 103836 - DNA, 22 bp, Artificial Sequence
  Synthetic oligonucleotide; CTA chr11 5341709 5341730 5341726 5341731 +
tttttttttgttccttcagacc

SEQ ID NO: 103837 - DNA, 22 bp, Artificial Sequence
  Synthetic oligonucleotide; TTT chr11 5341712 5341733 5341729 5341734 +
ttttttgttccttcagaccttt

SEQ ID NO: 103838 - DNA, 22 bp, Artificial Sequence
  Synthetic oligonucleotide; TTT chr11 5341713 5341734 5341730 5341735 +
tttttgttccttcagacctttt

SEQ ID NO: 103839 - DNA, 22 bp, Artificial Sequence
  Synthetic oligonucleotide; TTT chr11 5341714 5341735 5341731 5341736 +
ttttgttccttcagaccttttt

SEQ ID NO: 103840 - DNA, 22 bp, Artificial Sequence
  Synthetic oligonucleotide; TTT chr11 5341715 5341736 5341732 5341737 +
tttgttccttcagacctttttc

SEQ ID NO: 103841 - DNA, 22 bp, Artificial Sequence
  Synthetic oligonucleotide; TTT chr11 5341716 5341737 5341733 5341738 +
ttgttccttcagacctttttca

SEQ ID NO: 103842 - DNA, 22 bp, Artificial Sequence
  Synthetic oligonucleotide; TTT chr11 5341717 5341738 5341734 5341739 +
tgttccttcagacctttttcat

SEQ ID NO: 103843 - DNA, 22 bp, Artificial Sequence
  Synthetic oligonucleotide; TTT chr11 5341718 5341739 5341735 5341740 +
gttccttcagacctttttcata

SEQ ID NO: 103844 - DNA, 22 bp, Artificial Sequence
  Synthetic oligonucleotide; TTG chr11 5341719 5341740 5341736 5341741 +
ttccttcagacctttttcatag

SEQ ID NO: 103845 - DNA, 22 bp, Artificial Sequence
  Synthetic oligonucleotide; TTC chr11 5341722 5341743 5341739 5341744 +
cttcagacctttttcatagcaa

SEQ ID NO: 103846 - DNA, 22 bp, Artificial Sequence
  Synthetic oligonucleotide; CTT chr11 5341725 5341746 5341742 5341747 +
cagacctttttcatagcaaaag

SEQ ID NO: 103847 - DNA, 22 bp, Artificial Sequence
  Synthetic oligonucleotide; TTC chr11 5341726 5341747 5341743 5341748 +
agacctttttcatagcaaaagg

SEQ ID NO: 103848 - DNA, 22 bp, Artificial Sequence
  Synthetic oligonucleotide; CTT chr11 5341733 5341754 5341750 5341755 +
tttcatagcaaaaggagggtga

SEQ ID NO: 103849 - DNA, 22 bp, Artificial Sequence
  Synthetic oligonucleotide; TTT chr11 5341734 5341755 5341751 5341756 +
ttcatagcaaaaggagggtgaa

SEQ ID NO: 103850 - DNA, 22 bp, Artificial Sequence
  Synthetic oligonucleotide; TTT chr11 5341735 5341756 5341752 5341757 +
tcatagcaaaaggagggtgaag

SEQ ID NO: 103851 - DNA, 22 bp, Artificial Sequence
  Synthetic oligonucleotide; TTT chr11 5341736 5341757 5341753 5341758 +
catagcaaaaggagggtgaagg

SEQ ID NO: 103852 - DNA, 22 bp, Artificial Sequence
  Synthetic oligonucleotide; TTC chr11 5341737 5341758 5341754 5341759 +
atagcaaaaggagggtgaagga

SEQ ID NO: 103853 - DNA, 22 bp, Artificial Sequence
  Synthetic oligonucleotide; CTG chr11 5341763 5341784 5341780 5341785 +
tctcttccactaatttggacta

SEQ ID NO: 103854 - DNA, 22 bp, Artificial Sequence
  Synthetic oligonucleotide; CTC chr11 5341767 5341788 5341784 5341789 +
ttccactaatttggactagtca

SEQ ID NO: 103855 - DNA, 22 bp, Artificial Sequence
  Synthetic oligonucleotide; CTT chr11 5341769 5341790 5341786 5341791 +
ccactaatttggactagtcagc

SEQ ID NO: 103856 - DNA, 22 bp, Artificial Sequence
  Synthetic oligonucleotide; TTC chr11 5341770 5341791 5341787 5341792 +
cactaatttggactagtcagcc

SEQ ID NO: 103857 - DNA, 22 bp, Artificial Sequence
  Synthetic oligonucleotide; CTA chr11 5341775 5341796 5341792 5341797 +
atttggactagtcagccagcgt

SEQ ID NO: 103858 - DNA, 22 bp, Artificial Sequence
  Synthetic oligonucleotide; TTT chr11 5341779 5341800 5341796 5341801 +
ggactagtcagccagcgtagat

SEQ ID NO: 103859 - DNA, 22 bp, Artificial Sequence
  Synthetic oligonucleotide; TTG chr11 5341780 5341801 5341797 5341802 +
gactagtcagccagcgtagata

SEQ ID NO: 103860 - DNA, 22 bp, Artificial Sequence
  Synthetic oligonucleotide; CTA chr11 5341785 5341806 5341802 5341807 +
gtcagccagcgtagatatctga

SEQ ID NO: 103861 - DNA, 22 bp, Artificial Sequence
  Synthetic oligonucleotide; CTG chr11 5341806 5341827 5341823 5341828 +
aggatggcctcaacattggagc

SEQ ID NO: 103862 - DNA, 22 bp, Artificial Sequence
  Synthetic oligonucleotide; CTC chr11 5341817 5341838 5341834 5341839 +
aacattggagctagcaactagg

SEQ ID NO: 103863 - DNA, 22 bp, Artificial Sequence
  Synthetic oligonucleotide; TTG chr11 5341824 5341845 5341841 5341846 +
gagctagcaactagggtagtag

SEQ ID NO: 103864 - DNA, 22 bp, Artificial Sequence
  Synthetic oligonucleotide; CTA chr11 5341830 5341851 5341847 5341852 +
gcaactagggtagtagaataag

SEQ ID NO: 103865 - DNA, 22 bp, Artificial Sequence
  Synthetic oligonucleotide; CTA chr11 5341837 5341858 5341854 5341859 +
gggtagtagaataagaatgaga

SEQ ID NO: 103866 - DNA, 22 bp, Artificial Sequence
  Synthetic oligonucleotide; CTG chr11 5341880 5341901 5341897 5341902 +
actgtgtctacgtcctctcatt

SEQ ID NO: 103867 - DNA, 22 bp, Artificial Sequence
  Synthetic oligonucleotide; CTG chr11 5341884 5341905 5341901 5341906 +
tgtctacgtcctctcatttatc

SEQ ID NO: 103868 - DNA, 22 bp, Artificial Sequence
  Synthetic oligonucleotide; CTA chr11 5341890 5341911 5341907 5341912 +
cgtcctctcatttatccgtgat

SEQ ID NO: 103869 - DNA, 22 bp, Artificial Sequence
  Synthetic oligonucleotide; CTC chr11 5341897 5341918 5341914 5341919 +
tcatttatccgtgattcctctt

SEQ ID NO: 103870 - DNA, 22 bp, Artificial Sequence
  Synthetic oligonucleotide; CTC chr11 5341899 5341920 5341916 5341921 +
atttatccgtgattcctcttct

SEQ ID NO: 103871 - DNA, 22 bp, Artificial Sequence
  Synthetic oligonucleotide; TTT chr11 5341903 5341924 5341920 5341925 +
atccgtgattcctcttctcaca

SEQ ID NO: 103872 - DNA, 22 bp, Artificial Sequence
  Synthetic oligonucleotide; TTA chr11 5341904 5341925 5341921 5341926 +
tccgtgattcctcttctcacat

SEQ ID NO: 103873 - DNA, 22 bp, Artificial Sequence
  Synthetic oligonucleotide; TTC chr11 5341914 5341935 5341931 5341936 +
ctcttctcacatttttttgtta

SEQ ID NO: 103874 - DNA, 22 bp, Artificial Sequence
  Synthetic oligonucleotide; CTC chr11 5341917 5341938 5341934 5341939 +
ttctcacatttttttgttacaa

SEQ ID NO: 103875 - DNA, 22 bp, Artificial Sequence
  Synthetic oligonucleotide; CTT chr11 5341919 5341940 5341936 5341941 +
ctcacatttttttgttacaagt

SEQ ID NO: 103876 - DNA, 22 bp, Artificial Sequence
  Synthetic oligonucleotide; TTC chr11 5341920 5341941 5341937 5341942 +
tcacatttttttgttacaagtt

SEQ ID NO: 103877 - DNA, 22 bp, Artificial Sequence
  Synthetic oligonucleotide; CTC chr11 5341922 5341943 5341939 5341944 +
acatttttttgttacaagtttg

SEQ ID NO: 103878 - DNA, 22 bp, Artificial Sequence
  Synthetic oligonucleotide; TTT chr11 5341928 5341949 5341945 5341950 +
ttttgttacaagtttgtcagaa

SEQ ID NO: 103879 - DNA, 22 bp, Artificial Sequence
  Synthetic oligonucleotide; TTT chr11 5341929 5341950 5341946 5341951 +
tttgttacaagtttgtcagaag

SEQ ID NO: 103880 - DNA, 22 bp, Artificial Sequence
  Synthetic oligonucleotide; TTT chr11 5341930 5341951 5341947 5341952 +
ttgttacaagtttgtcagaagg

SEQ ID NO: 103881 - DNA, 22 bp, Artificial Sequence
  Synthetic oligonucleotide; TTT chr11 5341931 5341952 5341948 5341953 +
tgttacaagtttgtcagaaggt

SEQ ID NO: 103882 - DNA, 22 bp, Artificial Sequence
  Synthetic oligonucleotide; TTT chr11 5341932 5341953 5341949 5341954 +
gttacaagtttgtcagaaggta

SEQ ID NO: 103883 - DNA, 22 bp, Artificial Sequence
  Synthetic oligonucleotide; TTG chr11 5341933 5341954 5341950 5341955 +
ttacaagtttgtcagaaggtac

SEQ ID NO: 103884 - DNA, 22 bp, Artificial Sequence
  Synthetic oligonucleotide; TTA chr11 5341936 5341957 5341953 5341958 +
caagtttgtcagaaggtactgc

SEQ ID NO: 103885 - DNA, 22 bp, Artificial Sequence
  Synthetic oligonucleotide; TTT chr11 5341943 5341964 5341960 5341965 +
gtcagaaggtactgccttgggg

SEQ ID NO: 103886 - DNA, 22 bp, Artificial Sequence
  Synthetic oligonucleotide; TTG chr11 5341944 5341965 5341961 5341966 +
tcagaaggtactgccttgggga

SEQ ID NO: 103887 - DNA, 22 bp, Artificial Sequence
  Synthetic oligonucleotide; CTG chr11 5341957 5341978 5341974 5341979 +
ccttggggaataaatatgagtt

SEQ ID NO: 103888 - DNA, 22 bp, Artificial Sequence
  Synthetic oligonucleotide; CTT chr11 5341961 5341982 5341978 5341983 +
ggggaataaatatgagtttatg

SEQ ID NO: 103889 - DNA, 22 bp, Artificial Sequence
  Synthetic oligonucleotide; TTG chr11 5341962 5341983 5341979 5341984 +
gggaataaatatgagtttatgg

SEQ ID NO: 103890 - DNA, 22 bp, Artificial Sequence
  Synthetic oligonucleotide; TTT chr11 5341980 5342001 5341997 5342002 +
atggtttttgagacaaattcat

SEQ ID NO: 103891 - DNA, 22 bp, Artificial Sequence
  Synthetic oligonucleotide; TTA chr11 5341981 5342002 5341998 5342003 +
tggtttttgagacaaattcatt

SEQ ID NO: 103892 - DNA, 22 bp, Artificial Sequence
  Synthetic oligonucleotide; TTT chr11 5341987 5342008 5342004 5342009 +
ttgagacaaattcattataatt

SEQ ID NO: 103893 - DNA, 22 bp, Artificial Sequence
  Synthetic oligonucleotide; TTT chr11 5341988 5342009 5342005 5342010 +
tgagacaaattcattataattt

SEQ ID NO: 103894 - DNA, 22 bp, Artificial Sequence
  Synthetic oligonucleotide; TTT chr11 5341989 5342010 5342006 5342011 +
gagacaaattcattataatttg

SEQ ID NO: 103895 - DNA, 22 bp, Artificial Sequence
  Synthetic oligonucleotide; TTG chr11 5341990 5342011 5342007 5342012 +
agacaaattcattataatttga

SEQ ID NO: 103896 - DNA, 22 bp, Artificial Sequence
  Synthetic oligonucleotide; TTC chr11 5342000 5342021 5342017 5342022 +
attataatttgatggagggagg

SEQ ID NO: 103897 - DNA, 22 bp, Artificial Sequence
  Synthetic oligonucleotide; TTA chr11 5342004 5342025 5342021 5342026 +
taatttgatggagggaggagga

SEQ ID NO: 103898 - DNA, 22 bp, Artificial Sequence
  Synthetic oligonucleotide; TTT chr11 5342010 5342031 5342027 5342032 +
gatggagggaggaggaaccaac

SEQ ID NO: 103899 - DNA, 22 bp, Artificial Sequence
  Synthetic oligonucleotide; TTG chr11 5342011 5342032 5342028 5342033 +
atggagggaggaggaaccaact

SEQ ID NO: 103900 - DNA, 22 bp, Artificial Sequence
  Synthetic oligonucleotide; CTA chr11 5342034 5342055 5342051 5342056 +
gactgttgagatgataagtaat

SEQ ID NO: 103901 - DNA, 22 bp, Artificial Sequence
  Synthetic oligonucleotide; CTG chr11 5342039 5342060 5342056 5342061 +
ttgagatgataagtaattaggt

SEQ ID NO: 103902 - DNA, 22 bp, Artificial Sequence
  Synthetic oligonucleotide; TTG chr11 5342042 5342063 5342059 5342064 +
agatgataagtaattaggtcac

SEQ ID NO: 103903 - DNA, 22 bp, Artificial Sequence
  Synthetic oligonucleotide; TTA chr11 5342058 5342079 5342075 5342080 +
ggtcactgatcaaagaagatta

SEQ ID NO: 103904 - DNA, 22 bp, Artificial Sequence
  Synthetic oligonucleotide; CTG chr11 5342066 5342087 5342083 5342088 +
atcaaagaagattatattcttt

SEQ ID NO: 103905 - DNA, 22 bp, Artificial Sequence
  Synthetic oligonucleotide; TTA chr11 5342080 5342101 5342097 5342102 +
tattcttttttgcaggaaaatt

SEQ ID NO: 103906 - DNA, 22 bp, Artificial Sequence
  Synthetic oligonucleotide; TTC chr11 5342085 5342106 5342102 5342107 +
ttttttgcaggaaaattcctgg

SEQ ID NO: 103907 - DNA, 22 bp, Artificial Sequence
  Synthetic oligonucleotide; CTT chr11 5342087 5342108 5342104 5342109 +
ttttgcaggaaaattcctggac

SEQ ID NO: 103908 - DNA, 22 bp, Artificial Sequence
  Synthetic oligonucleotide; TTT chr11 5342088 5342109 5342105 5342110 +
tttgcaggaaaattcctggact

SEQ ID NO: 103909 - DNA, 22 bp, Artificial Sequence
  Synthetic oligonucleotide; TTT chr11 5342089 5342110 5342106 5342111 +
ttgcaggaaaattcctggactt

SEQ ID NO: 103910 - DNA, 22 bp, Artificial Sequence
  Synthetic oligonucleotide; TTT chr11 5342090 5342111 5342107 5342112 +
tgcaggaaaattcctggacttc

SEQ ID NO: 103911 - DNA, 22 bp, Artificial Sequence
  Synthetic oligonucleotide; TTT chr11 5342091 5342112 5342108 5342113 +
gcaggaaaattcctggacttca

SEQ ID NO: 103912 - DNA, 22 bp, Artificial Sequence
  Synthetic oligonucleotide; TTG chr11 5342092 5342113 5342109 5342114 +
caggaaaattcctggacttcag

SEQ ID NO: 103913 - DNA, 22 bp, Artificial Sequence
  Synthetic oligonucleotide; TTC chr11 5342103 5342124 5342120 5342125 +
ctggacttcagtgaccaaattt

SEQ ID NO: 103914 - DNA, 22 bp, Artificial Sequence
  Synthetic oligonucleotide; CTG chr11 5342106 5342127 5342123 5342128 +
gacttcagtgaccaaatttata

SEQ ID NO: 103915 - DNA, 22 bp, Artificial Sequence
  Synthetic oligonucleotide; CTT chr11 5342111 5342132 5342128 5342133 +
cagtgaccaaatttataggttc

SEQ ID NO: 103916 - DNA, 22 bp, Artificial Sequence
  Synthetic oligonucleotide; TTC chr11 5342112 5342133 5342129 5342134 +
agtgaccaaatttataggttcc

SEQ ID NO: 103917 - DNA, 22 bp, Artificial Sequence
  Synthetic oligonucleotide; TTT chr11 5342125 5342146 5342142 5342147 +
ataggttcccattgtttgtatg

SEQ ID NO: 103918 - DNA, 22 bp, Artificial Sequence
  Synthetic oligonucleotide; TTA chr11 5342126 5342147 5342143 5342148 +
taggttcccattgtttgtatgg

SEQ ID NO: 103919 - DNA, 22 bp, Artificial Sequence
  Synthetic oligonucleotide; TTC chr11 5342133 5342154 5342150 5342155 +
ccattgtttgtatggacacctg

SEQ ID NO: 103920 - DNA, 22 bp, Artificial Sequence
  Synthetic oligonucleotide; TTG chr11 5342139 5342160 5342156 5342161 +
tttgtatggacacctgcagaga

SEQ ID NO: 103921 - DNA, 22 bp, Artificial Sequence
  Synthetic oligonucleotide; TTT chr11 5342142 5342163 5342159 5342164 +
gtatggacacctgcagagaaat

SEQ ID NO: 103922 - DNA, 22 bp, Artificial Sequence
  Synthetic oligonucleotide; TTG chr11 5342143 5342164 5342160 5342165 +
tatggacacctgcagagaaatt

SEQ ID NO: 103923 - DNA, 22 bp, Artificial Sequence
  Synthetic oligonucleotide; CTG chr11 5342155 5342176 5342172 5342177 +
cagagaaattcataagagttgg

SEQ ID NO: 103924 - DNA, 22 bp, Artificial Sequence
  Synthetic oligonucleotide; TTC chr11 5342166 5342187 5342183 5342188 +
ataagagttggaaattagattt

SEQ ID NO: 103925 - DNA, 22 bp, Artificial Sequence
  Synthetic oligonucleotide; TTG chr11 5342176 5342197 5342193 5342198 +
gaaattagatttgacatagtaa

SEQ ID NO: 103926 - DNA, 22 bp, Artificial Sequence
  Synthetic oligonucleotide; TTA chr11 5342183 5342204 5342200 5342205 +
gatttgacatagtaaaccaaac

SEQ ID NO: 103927 - DNA, 22 bp, Artificial Sequence
  Synthetic oligonucleotide; TTT chr11 5342188 5342209 5342205 5342210 +
gacatagtaaaccaaactctat

SEQ ID NO: 103928 - DNA, 22 bp, Artificial Sequence
  Synthetic oligonucleotide; TTG chr11 5342189 5342210 5342206 5342211 +
acatagtaaaccaaactctatt

SEQ ID NO: 103929 - DNA, 22 bp, Artificial Sequence
  Synthetic oligonucleotide; CTC chr11 5342207 5342228 5342224 5342229 +
tattccatttcactcgaaccaa

SEQ ID NO: 103930 - DNA, 22 bp, Artificial Sequence
  Synthetic oligonucleotide; CTA chr11 5342209 5342230 5342226 5342231 +
ttccatttcactcgaaccaact

SEQ ID NO: 103931 - DNA, 22 bp, Artificial Sequence
  Synthetic oligonucleotide; TTC chr11 5342212 5342233 5342229 5342234 +
catttcactcgaaccaactaat

SEQ ID NO: 103932 - DNA, 22 bp, Artificial Sequence
  Synthetic oligonucleotide; TTT chr11 5342217 5342238 5342234 5342239 +
cactcgaaccaactaataattt

SEQ ID NO: 103933 - DNA, 22 bp, Artificial Sequence
  Synthetic oligonucleotide; TTC chr11 5342218 5342239 5342235 5342240 +
actcgaaccaactaataatttt

SEQ ID NO: 103934 - DNA, 22 bp, Artificial Sequence
  Synthetic oligonucleotide; CTC chr11 5342222 5342243 5342239 5342244 +
gaaccaactaataattttatat

SEQ ID NO: 103935 - DNA, 22 bp, Artificial Sequence
  Synthetic oligonucleotide; CTA chr11 5342232 5342253 5342249 5342254 +
ataattttatatttttatgatt

SEQ ID NO: 103936 - DNA, 22 bp, Artificial Sequence
  Synthetic oligonucleotide; TTT chr11 5342239 5342260 5342256 5342261 +
tatatttttatgattctgttcc

SEQ ID NO: 103937 - DNA, 22 bp, Artificial Sequence
  Synthetic oligonucleotide; TTT chr11 5342240 5342261 5342257 5342262 +
atatttttatgattctgttcct

SEQ ID NO: 103938 - DNA, 22 bp, Artificial Sequence
  Synthetic oligonucleotide; TTA chr11 5342241 5342262 5342258 5342263 +
tatttttatgattctgttccta

SEQ ID NO: 103939 - DNA, 22 bp, Artificial Sequence
  Synthetic oligonucleotide; TTT chr11 5342246 5342267 5342263 5342268 +
ttatgattctgttcctatctgc

SEQ ID NO: 103940 - DNA, 22 bp, Artificial Sequence
  Synthetic oligonucleotide; TTT chr11 5342247 5342268 5342264 5342269 +
tatgattctgttcctatctgct

SEQ ID NO: 103941 - DNA, 22 bp, Artificial Sequence
  Synthetic oligonucleotide; TTT chr11 5342248 5342269 5342265 5342270 +
atgattctgttcctatctgcta

SEQ ID NO: 103942 - DNA, 22 bp, Artificial Sequence
  Synthetic oligonucleotide; TTA chr11 5342249 5342270 5342266 5342271 +
tgattctgttcctatctgctaa

SEQ ID NO: 103943 - DNA, 22 bp, Artificial Sequence
  Synthetic oligonucleotide; TTC chr11 5342255 5342276 5342272 5342277 +
tgttcctatctgctaactttat

SEQ ID NO: 103944 - DNA, 22 bp, Artificial Sequence
  Synthetic oligonucleotide; CTG chr11 5342257 5342278 5342274 5342279 +
ttcctatctgctaactttatac

SEQ ID NO: 103945 - DNA, 22 bp, Artificial Sequence
  Synthetic oligonucleotide; TTC chr11 5342260 5342281 5342277 5342282 +
ctatctgctaactttataccat

SEQ ID NO: 103946 - DNA, 22 bp, Artificial Sequence
  Synthetic oligonucleotide; CTA chr11 5342263 5342284 5342280 5342285 +
tctgctaactttataccatgaa

SEQ ID NO: 103947 - DNA, 22 bp, Artificial Sequence
  Synthetic oligonucleotide; CTG chr11 5342267 5342288 5342284 5342289 +
ctaactttataccatgaaataa

SEQ ID NO: 103948 - DNA, 22 bp, Artificial Sequence
  Synthetic oligonucleotide; CTA chr11 5342270 5342291 5342287 5342292 +
actttataccatgaaataaaca

SEQ ID NO: 103949 - DNA, 22 bp, Artificial Sequence
  Synthetic oligonucleotide; CTT chr11 5342274 5342295 5342291 5342296 +
tataccatgaaataaacatatg

SEQ ID NO: 103950 - DNA, 22 bp, Artificial Sequence
  Synthetic oligonucleotide; TTT chr11 5342275 5342296 5342292 5342297 +
ataccatgaaataaacatatgt

SEQ ID NO: 103951 - DNA, 22 bp, Artificial Sequence
  Synthetic oligonucleotide; TTA chr11 5342276 5342297 5342293 5342298 +
taccatgaaataaacatatgtt

SEQ ID NO: 103952 - DNA, 22 bp, Artificial Sequence
  Synthetic oligonucleotide; TTA chr11 5342299 5342320 5342316 5342321 +
gttacattatagacataccaat

SEQ ID NO: 103953 - DNA, 22 bp, Artificial Sequence
  Synthetic oligonucleotide; TTA chr11 5342303 5342324 5342320 5342325 +
cattatagacataccaatagat

SEQ ID NO: 103954 - DNA, 22 bp, Artificial Sequence
  Synthetic oligonucleotide; TTA chr11 5342308 5342329 5342325 5342330 +
tagacataccaatagatgccta

SEQ ID NO: 103955 - DNA, 22 bp, Artificial Sequence
  Synthetic oligonucleotide; CTA chr11 5342330 5342351 5342347 5342352 +
aggtattgttatcacaataatt

SEQ ID NO: 103956 - DNA, 22 bp, Artificial Sequence
  Synthetic oligonucleotide; TTG chr11 5342338 5342359 5342355 5342360 +
ttatcacaataatttagtggaa

SEQ ID NO: 103957 - DNA, 22 bp, Artificial Sequence
  Synthetic oligonucleotide; TTA chr11 5342341 5342362 5342358 5342363 +
tcacaataatttagtggaaagc

SEQ ID NO: 103958 - DNA, 22 bp, Artificial Sequence
  Synthetic oligonucleotide; TTT chr11 5342353 5342374 5342370 5342375 +
agtggaaagcttagagaaatat

SEQ ID NO: 103959 - DNA, 22 bp, Artificial Sequence
  Synthetic oligonucleotide; TTA chr11 5342354 5342375 5342371 5342376 +
gtggaaagcttagagaaatatt

SEQ ID NO: 103960 - DNA, 22 bp, Artificial Sequence
  Synthetic oligonucleotide; CTT chr11 5342365 5342386 5342382 5342387 +
agagaaatattccgtttacagg

SEQ ID NO: 103961 - DNA, 22 bp, Artificial Sequence
  Synthetic oligonucleotide; TTA chr11 5342366 5342387 5342383 5342388 +
gagaaatattccgtttacagga

SEQ ID NO: 103962 - DNA, 22 bp, Artificial Sequence
  Synthetic oligonucleotide; TTC chr11 5342377 5342398 5342394 5342399 +
cgtttacaggaatgcaacaaaa

SEQ ID NO: 103963 - DNA, 22 bp, Artificial Sequence
  Synthetic oligonucleotide; TTT chr11 5342382 5342403 5342399 5342404 +
acaggaatgcaacaaaaatttg

SEQ ID NO: 103964 - DNA, 22 bp, Artificial Sequence
  Synthetic oligonucleotide; TTA chr11 5342383 5342404 5342400 5342405 +
caggaatgcaacaaaaatttgt

SEQ ID NO: 103965 - DNA, 22 bp, Artificial Sequence
  Synthetic oligonucleotide; TTT chr11 5342403 5342424 5342420 5342425 +
gtacaaactacatttagctaaa

SEQ ID NO: 103966 - DNA, 22 bp, Artificial Sequence
  Synthetic oligonucleotide; TTG chr11 5342404 5342425 5342421 5342426 +
tacaaactacatttagctaaag

SEQ ID NO: 103967 - DNA, 22 bp, Artificial Sequence
  Synthetic oligonucleotide; CTA chr11 5342413 5342434 5342430 5342435 +
catttagctaaagagttgggct

SEQ ID NO: 103968 - DNA, 22 bp, Artificial Sequence
  Synthetic oligonucleotide; TTT chr11 5342418 5342439 5342435 5342440 +
agctaaagagttgggcttaaag

SEQ ID NO: 103969 - DNA, 22 bp, Artificial Sequence
  Synthetic oligonucleotide; TTA chr11 5342419 5342440 5342436 5342441 +
gctaaagagttgggcttaaaga

SEQ ID NO: 103970 - DNA, 22 bp, Artificial Sequence
  Synthetic oligonucleotide; CTA chr11 5342423 5342444 5342440 5342445 +
aagagttgggcttaaagagata

SEQ ID NO: 103971 - DNA, 22 bp, Artificial Sequence
  Synthetic oligonucleotide; TTG chr11 5342431 5342452 5342448 5342453 +
ggcttaaagagataccttaggg

SEQ ID NO: 103972 - DNA, 22 bp, Artificial Sequence
  Synthetic oligonucleotide; CTT chr11 5342436 5342457 5342453 5342458 +
aaagagataccttagggaaact

SEQ ID NO: 103973 - DNA, 22 bp, Artificial Sequence
  Synthetic oligonucleotide; TTA chr11 5342437 5342458 5342454 5342459 +
aagagataccttagggaaactt

SEQ ID NO: 103974 - DNA, 22 bp, Artificial Sequence
  Synthetic oligonucleotide; CTT chr11 5342449 5342470 5342466 5342471 +
agggaaacttgaagctgtattt

SEQ ID NO: 103975 - DNA, 22 bp, Artificial Sequence
  Synthetic oligonucleotide; TTA chr11 5342450 5342471 5342467 5342472 +
gggaaacttgaagctgtatttt

SEQ ID NO: 103976 - DNA, 22 bp, Artificial Sequence
  Synthetic oligonucleotide; CTT chr11 5342459 5342480 5342476 5342481 +
gaagctgtattttaacacctat

SEQ ID NO: 103977 - DNA, 22 bp, Artificial Sequence
  Synthetic oligonucleotide; TTG chr11 5342460 5342481 5342477 5342482 +
aagctgtattttaacacctatt

SEQ ID NO: 103978 - DNA, 22 bp, Artificial Sequence
  Synthetic oligonucleotide; CTG chr11 5342466 5342487 5342483 5342488 +
tattttaacacctattttacca

SEQ ID NO: 103979 - DNA, 22 bp, Artificial Sequence
  Synthetic oligonucleotide; TTT chr11 5342471 5342492 5342488 5342493 +
taacacctattttaccaagtca

SEQ ID NO: 103980 - DNA, 22 bp, Artificial Sequence
  Synthetic oligonucleotide; TTT chr11 5342472 5342493 5342489 5342494 +
aacacctattttaccaagtcat

SEQ ID NO: 103981 - DNA, 22 bp, Artificial Sequence
  Synthetic oligonucleotide; TTA chr11 5342473 5342494 5342490 5342495 +
acacctattttaccaagtcata

SEQ ID NO: 103982 - DNA, 22 bp, Artificial Sequence
  Synthetic oligonucleotide; CTA chr11 5342480 5342501 5342497 5342502 +
ttttaccaagtcatatgagcat

SEQ ID NO: 103983 - DNA, 22 bp, Artificial Sequence
  Synthetic oligonucleotide; TTT chr11 5342483 5342504 5342500 5342505 +
taccaagtcatatgagcatgca

SEQ ID NO: 103984 - DNA, 22 bp, Artificial Sequence
  Synthetic oligonucleotide; TTT chr11 5342484 5342505 5342501 5342506 +
accaagtcatatgagcatgcat

SEQ ID NO: 103985 - DNA, 22 bp, Artificial Sequence
  Synthetic oligonucleotide; TTA chr11 5342485 5342506 5342502 5342507 +
ccaagtcatatgagcatgcatg

SEQ ID NO: 103986 - DNA, 22 bp, Artificial Sequence
  Synthetic oligonucleotide; CTA chr11 5342510 5342531 5342527 5342532 +
gatatgagacttctttgctctc

SEQ ID NO: 103987 - DNA, 22 bp, Artificial Sequence
  Synthetic oligonucleotide; CTT chr11 5342522 5342543 5342539 5342544 +
ctttgctctcctgctaaatatt

SEQ ID NO: 103988 - DNA, 22 bp, Artificial Sequence
  Synthetic oligonucleotide; TTC chr11 5342523 5342544 5342540 5342545 +
tttgctctcctgctaaatatta

SEQ ID NO: 103989 - DNA, 22 bp, Artificial Sequence
  Synthetic oligonucleotide; CTT chr11 5342525 5342546 5342542 5342547 +
tgctctcctgctaaatattaga

SEQ ID NO: 103990 - DNA, 22 bp, Artificial Sequence
  Synthetic oligonucleotide; TTT chr11 5342526 5342547 5342543 5342548 +
gctctcctgctaaatattagag

SEQ ID NO: 103991 - DNA, 22 bp, Artificial Sequence
  Synthetic oligonucleotide; TTG chr11 5342527 5342548 5342544 5342549 +
ctctcctgctaaatattagagt

SEQ ID NO: 103992 - DNA, 22 bp, Artificial Sequence
  Synthetic oligonucleotide; CTC chr11 5342530 5342551 5342547 5342552 +
tcctgctaaatattagagtttt

SEQ ID NO: 103993 - DNA, 22 bp, Artificial Sequence
  Synthetic oligonucleotide; CTC chr11 5342532 5342553 5342549 5342554 +
ctgctaaatattagagttttta

SEQ ID NO: 103994 - DNA, 22 bp, Artificial Sequence
  Synthetic oligonucleotide; CTG chr11 5342535 5342556 5342552 5342557 +
ctaaatattagagtttttacat

SEQ ID NO: 103995 - DNA, 22 bp, Artificial Sequence
  Synthetic oligonucleotide; CTA chr11 5342538 5342559 5342555 5342560 +
aatattagagtttttacattct

SEQ ID NO: 103996 - DNA, 22 bp, Artificial Sequence
  Synthetic oligonucleotide; TTA chr11 5342545 5342566 5342562 5342567 +
gagtttttacattctgtgagag

SEQ ID NO: 103997 - DNA, 22 bp, Artificial Sequence
  Synthetic oligonucleotide; TTT chr11 5342551 5342572 5342568 5342573 +
ttacattctgtgagagtgactg

SEQ ID NO: 103998 - DNA, 22 bp, Artificial Sequence
  Synthetic oligonucleotide; TTT chr11 5342552 5342573 5342569 5342574 +
tacattctgtgagagtgactgt

SEQ ID NO: 103999 - DNA, 22 bp, Artificial Sequence
  Synthetic oligonucleotide; TTT chr11 5342553 5342574 5342570 5342575 +
acattctgtgagagtgactgtg

SEQ ID NO: 104000 - DNA, 22 bp, Artificial Sequence
  Synthetic oligonucleotide; TTA chr11 5342554 5342575 5342571 5342576 +
cattctgtgagagtgactgtga

SEQ ID NO: 104001 - DNA, 22 bp, Artificial Sequence
  Synthetic oligonucleotide; TTC chr11 5342559 5342580 5342576 5342581 +
tgtgagagtgactgtgatgatt

SEQ ID NO: 104002 - DNA, 22 bp, Artificial Sequence
  Synthetic oligonucleotide; CTG chr11 5342561 5342582 5342578 5342583 +
tgagagtgactgtgatgattgg

SEQ ID NO: 104003 - DNA, 22 bp, Artificial Sequence
  Synthetic oligonucleotide; CTG chr11 5342573 5342594 5342590 5342595 +
tgatgattggagatcaggttcc

SEQ ID NO: 104004 - DNA, 22 bp, Artificial Sequence
  Synthetic oligonucleotide; TTG chr11 5342582 5342603 5342599 5342604 +
gagatcaggttccaattctatg

SEQ ID NO: 104005 - DNA, 22 bp, Artificial Sequence
  Synthetic oligonucleotide; TTC chr11 5342594 5342615 5342611 5342616 +
caattctatgggtagtaaaaag

SEQ ID NO: 104006 - DNA, 22 bp, Artificial Sequence
  Synthetic oligonucleotide; TTC chr11 5342600 5342621 5342617 5342622 +
tatgggtagtaaaaaggtgaag

SEQ ID NO: 104007 - DNA, 22 bp, Artificial Sequence
  Synthetic oligonucleotide; CTA chr11 5342602 5342623 5342619 5342624 +
tgggtagtaaaaaggtgaagaa

SEQ ID NO: 104008 - DNA, 22 bp, Artificial Sequence
  Synthetic oligonucleotide; TTC chr11 5342632 5342653 5342649 5342654 +
tgaatctgcttggtcttgacac

SEQ ID NO: 104009 - DNA, 22 bp, Artificial Sequence
  Synthetic oligonucleotide; CTG chr11 5342634 5342655 5342651 5342656 +
aatctgcttggtcttgacacta

SEQ ID NO: 104010 - DNA, 22 bp, Artificial Sequence
  Synthetic oligonucleotide; CTG chr11 5342640 5342661 5342657 5342662 +
cttggtcttgacactatatgtt

SEQ ID NO: 104011 - DNA, 22 bp, Artificial Sequence
  Synthetic oligonucleotide; CTT chr11 5342643 5342664 5342660 5342665 +
ggtcttgacactatatgttata

SEQ ID NO: 104012 - DNA, 22 bp, Artificial Sequence
  Synthetic oligonucleotide; TTG chr11 5342644 5342665 5342661 5342666 +
gtcttgacactatatgttatag

SEQ ID NO: 104013 - DNA, 22 bp, Artificial Sequence
  Synthetic oligonucleotide; CTT chr11 5342649 5342670 5342666 5342671 +
gacactatatgttataggattc

SEQ ID NO: 104014 - DNA, 22 bp, Artificial Sequence
  Synthetic oligonucleotide; TTG chr11 5342650 5342671 5342667 5342672 +
acactatatgttataggattca

SEQ ID NO: 104015 - DNA, 22 bp, Artificial Sequence
  Synthetic oligonucleotide; CTA chr11 5342656 5342677 5342673 5342678 +
tatgttataggattcattagtg

SEQ ID NO: 104016 - DNA, 22 bp, Artificial Sequence
  Synthetic oligonucleotide; TTA chr11 5342663 5342684 5342680 5342685 +
taggattcattagtggagggaa

SEQ ID NO: 104017 - DNA, 22 bp, Artificial Sequence
  Synthetic oligonucleotide; TTC chr11 5342671 5342692 5342688 5342693 +
attagtggagggaacagaaaat

SEQ ID NO: 104018 - DNA, 22 bp, Artificial Sequence
  Synthetic oligonucleotide; TTA chr11 5342675 5342696 5342692 5342697 +
gtggagggaacagaaaataggc

SEQ ID NO: 104019 - DNA, 22 bp, Artificial Sequence
  Synthetic oligonucleotide; CTC chr11 5342704 5342725 5342721 5342726 +
ataatgaggtgaacaatatgtg

SEQ ID NO: 104020 - DNA, 22 bp, Artificial Sequence
  Synthetic oligonucleotide; CTG chr11 5342733 5342754 5342750 5342755 +
ctttccaaaacgatgaatcaga

SEQ ID NO: 104021 - DNA, 22 bp, Artificial Sequence
  Synthetic oligonucleotide; CTT chr11 5342736 5342757 5342753 5342758 +
tccaaaacgatgaatcagagac

SEQ ID NO: 104022 - DNA, 22 bp, Artificial Sequence
  Synthetic oligonucleotide; TTT chr11 5342737 5342758 5342754 5342759 +
ccaaaacgatgaatcagagaca

SEQ ID NO: 104023 - DNA, 22 bp, Artificial Sequence
  Synthetic oligonucleotide; TTC chr11 5342738 5342759 5342755 5342760 +
caaaacgatgaatcagagacaa

SEQ ID NO: 104024 - DNA, 22 bp, Artificial Sequence
  Synthetic oligonucleotide; CTG chr11 5342771 5342792 5342788 5342793 +
tgacataaaaaaccaggacaca

SEQ ID NO: 104025 - DNA, 22 bp, Artificial Sequence
  Synthetic oligonucleotide; CTT chr11 5342826 5342847 5342843 5342848 +
ggccctctcctctctggaggca

SEQ ID NO: 104026 - DNA, 22 bp, Artificial Sequence
  Synthetic oligonucleotide; TTG chr11 5342827 5342848 5342844 5342849 +
gccctctcctctctggaggcaa

SEQ ID NO: 104027 - DNA, 22 bp, Artificial Sequence
  Synthetic oligonucleotide; CTC chr11 5342833 5342854 5342850 5342855 +
tcctctctggaggcaatgctca

SEQ ID NO: 104028 - DNA, 22 bp, Artificial Sequence
  Synthetic oligonucleotide; CTC chr11 5342835 5342856 5342852 5342857 +
ctctctggaggcaatgctcagg

SEQ ID NO: 104029 - DNA, 22 bp, Artificial Sequence
  Synthetic oligonucleotide; CTC chr11 5342838 5342859 5342855 5342860 +
tctggaggcaatgctcaggaca

SEQ ID NO: 104030 - DNA, 22 bp, Artificial Sequence
  Synthetic oligonucleotide; CTC chr11 5342840 5342861 5342857 5342862 +
tggaggcaatgctcaggacagt

SEQ ID NO: 104031 - DNA, 22 bp, Artificial Sequence
  Synthetic oligonucleotide; CTG chr11 5342842 5342863 5342859 5342864 +
gaggcaatgctcaggacagtct

SEQ ID NO: 104032 - DNA, 22 bp, Artificial Sequence
  Synthetic oligonucleotide; CTC chr11 5342854 5342875 5342871 5342876 +
aggacagtcttgagtatcaaca

SEQ ID NO: 104033 - DNA, 22 bp, Artificial Sequence
  Synthetic oligonucleotide; CTT chr11 5342865 5342886 5342882 5342887 +
gagtatcaacacataggagatg

SEQ ID NO: 104034 - DNA, 22 bp, Artificial Sequence
  Synthetic oligonucleotide; TTG chr11 5342866 5342887 5342883 5342888 +
agtatcaacacataggagatga

SEQ ID NO: 104035 - DNA, 22 bp, Artificial Sequence
  Synthetic oligonucleotide; CTA chr11 5342924 5342945 5342941 5342946 +
caagcacagctgggtacagtcg

SEQ ID NO: 104036 - DNA, 22 bp, Artificial Sequence
  Synthetic oligonucleotide; CTG chr11 5342936 5342957 5342953 5342958 +
ggtacagtcggttgaaggtggt

SEQ ID NO: 104037 - DNA, 22 bp, Artificial Sequence
  Synthetic oligonucleotide; TTG chr11 5342950 5342971 5342967 5342972 +
aaggtggtatcagcacaggcga

SEQ ID NO: 104038 - DNA, 22 bp, Artificial Sequence
  Synthetic oligonucleotide; TTT chr11 5342976 5342997 5342993 5342998 +
aatgacatcctggtgaaggcag

SEQ ID NO: 104039 - DNA, 22 bp, Artificial Sequence
  Synthetic oligonucleotide; TTA chr11 5342977 5342998 5342994 5342999 +
atgacatcctggtgaaggcaga

SEQ ID NO: 104040 - DNA, 22 bp, Artificial Sequence
  Synthetic oligonucleotide; CTG chr11 5342988 5343009 5343005 5343010 +
gtgaaggcagaatgcatgtgaa

SEQ ID NO: 104041 - DNA, 22 bp, Artificial Sequence
  Synthetic oligonucleotide; CTG chr11 5343052 5343073 5343069 5343074 +
attgggggaacaacggatacaa

SEQ ID NO: 104042 - DNA, 22 bp, Artificial Sequence
  Synthetic oligonucleotide; TTG chr11 5343056 5343077 5343073 5343078 +
ggggaacaacggatacaaatcc

SEQ ID NO: 104043 - DNA, 22 bp, Artificial Sequence
  Synthetic oligonucleotide; CTC chr11 5343082 5343103 5343099 5343104 +
atcagaactcccagcccaatct

SEQ ID NO: 104044 - DNA, 22 bp, Artificial Sequence
  Synthetic oligonucleotide; CTC chr11 5343092 5343113 5343109 5343114 +
ccagcccaatcttcactactcg

SEQ ID NO: 104045 - DNA, 22 bp, Artificial Sequence
  Synthetic oligonucleotide; CTT chr11 5343105 5343126 5343122 5343127 +
cactactcgagtattagtaagt

SEQ ID NO: 104046 - DNA, 22 bp, Artificial Sequence
  Synthetic oligonucleotide; TTC chr11 5343106 5343127 5343123 5343128 +
actactcgagtattagtaagta

SEQ ID NO: 104047 - DNA, 22 bp, Artificial Sequence
  Synthetic oligonucleotide; CTA chr11 5343110 5343131 5343127 5343132 +
ctcgagtattagtaagtacaga

SEQ ID NO: 104048 - DNA, 22 bp, Artificial Sequence
  Synthetic oligonucleotide; CTC chr11 5343113 5343134 5343130 5343135 +
gagtattagtaagtacagaggt

SEQ ID NO: 104049 - DNA, 22 bp, Artificial Sequence
  Synthetic oligonucleotide; TTA chr11 5343121 5343142 5343138 5343143 +
gtaagtacagaggtatatctaa

SEQ ID NO: 104050 - DNA, 22 bp, Artificial Sequence
  Synthetic oligonucleotide; CTA chr11 5343142 5343163 5343159 5343164 +
agagggttgcagatggcaataa

SEQ ID NO: 104051 - DNA, 22 bp, Artificial Sequence
  Synthetic oligonucleotide; TTG chr11 5343151 5343172 5343168 5343173 +
cagatggcaataaaacggtcat

SEQ ID NO: 104052 - DNA, 22 bp, Artificial Sequence
  Synthetic oligonucleotide; CTC chr11 5343201 5343222 5343218 5343223 +
gagaaaggaaagtgagtgtata

SEQ ID NO: 104053 - DNA, 22 bp, Artificial Sequence
  Synthetic oligonucleotide; CTG chr11 5343234 5343255 5343251 5343256 +
ggaaaagcaggccgcacttcca

SEQ ID NO: 104054 - DNA, 22 bp, Artificial Sequence
  Synthetic oligonucleotide; CTT chr11 5343253 5343274 5343270 5343275 +
ccaatctccctgtgatccagcc

SEQ ID NO: 104055 - DNA, 22 bp, Artificial Sequence
  Synthetic oligonucleotide; TTC chr11 5343254 5343275 5343271 5343276 +
caatctccctgtgatccagcca

SEQ ID NO: 104056 - DNA, 22 bp, Artificial Sequence
  Synthetic oligonucleotide; CTC chr11 5343261 5343282 5343278 5343283 +
cctgtgatccagccagaggact

SEQ ID NO: 104057 - DNA, 22 bp, Artificial Sequence
  Synthetic oligonucleotide; CTG chr11 5343265 5343286 5343282 5343287 +
tgatccagccagaggactccca

SEQ ID NO: 104058 - DNA, 22 bp, Artificial Sequence
  Synthetic oligonucleotide; CTC chr11 5343284 5343305 5343301 5343306 +
ccagcaccgtgggcattgtggt

SEQ ID NO: 104059 - DNA, 22 bp, Artificial Sequence
  Synthetic oligonucleotide; TTG chr11 5343302 5343323 5343319 5343324 +
tggtcagggccagccccaggtc

SEQ ID NO: 104060 - DNA, 22 bp, Artificial Sequence
  Synthetic oligonucleotide; CTG chr11 5343326 5343347 5343343 5343348 +
tggcagccagcatggccagaaa

SEQ ID NO: 104061 - DNA, 22 bp, Artificial Sequence
  Synthetic oligonucleotide; CTC chr11 5343363 5343384 5343380 5343385 +
atgaagattgtgatcttcctta

SEQ ID NO: 104062 - DNA, 22 bp, Artificial Sequence
  Synthetic oligonucleotide; TTG chr11 5343373 5343394 5343390 5343395 +
tgatcttccttaatgagaagaa

SEQ ID NO: 104063 - DNA, 22 bp, Artificial Sequence
  Synthetic oligonucleotide; CTT chr11 5343380 5343401 5343397 5343402 +
ccttaatgagaagaaggagggt

SEQ ID NO: 104064 - DNA, 22 bp, Artificial Sequence
  Synthetic oligonucleotide; TTC chr11 5343381 5343402 5343398 5343403 +
cttaatgagaagaaggagggtg

SEQ ID NO: 104065 - DNA, 22 bp, Artificial Sequence
  Synthetic oligonucleotide; CTT chr11 5343384 5343405 5343401 5343406 +
aatgagaagaaggagggtgcca

SEQ ID NO: 104066 - DNA, 22 bp, Artificial Sequence
  Synthetic oligonucleotide; TTA chr11 5343385 5343406 5343402 5343407 +
atgagaagaaggagggtgccat

SEQ ID NO: 104067 - DNA, 22 bp, Artificial Sequence
  Synthetic oligonucleotide; TTG chr11 5343409 5343430 5343426 5343431 +
ccaaaaaggatggatatataca

SEQ ID NO: 104068 - DNA, 22 bp, Artificial Sequence
  Synthetic oligonucleotide; CTT chr11 5343467 5343488 5343484 5343489 +
cctccaagcctggaaaaccagt

SEQ ID NO: 104069 - DNA, 22 bp, Artificial Sequence
  Synthetic oligonucleotide; TTC chr11 5343468 5343489 5343485 5343490 +
ctccaagcctggaaaaccagtc

SEQ ID NO: 104070 - DNA, 22 bp, Artificial Sequence
  Synthetic oligonucleotide; CTC chr11 5343471 5343492 5343488 5343493 +
caagcctggaaaaccagtcaat

SEQ ID NO: 104071 - DNA, 22 bp, Artificial Sequence
  Synthetic oligonucleotide; CTG chr11 5343479 5343500 5343496 5343501 +
gaaaaccagtcaataggaaggg

SEQ ID NO: 104072 - DNA, 22 bp, Artificial Sequence
  Synthetic oligonucleotide; CTG chr11 5343511 5343532 5343528 5343533 +
ccgctggacgacatcctgggtt

SEQ ID NO: 104073 - DNA, 22 bp, Artificial Sequence
  Synthetic oligonucleotide; CTG chr11 5343517 5343538 5343534 5343539 +
gacgacatcctgggtttatata

SEQ ID NO: 104074 - DNA, 22 bp, Artificial Sequence
  Synthetic oligonucleotide; CTG chr11 5343529 5343550 5343546 5343551 +
ggtttatatagaagaaatgtct

SEQ ID NO: 104075 - DNA, 22 bp, Artificial Sequence
  Synthetic oligonucleotide; TTT chr11 5343534 5343555 5343551 5343556 +
atatagaagaaatgtctttctg

SEQ ID NO: 104076 - DNA, 22 bp, Artificial Sequence
  Synthetic oligonucleotide; TTA chr11 5343535 5343556 5343552 5343557 +
tatagaagaaatgtctttctgt

SEQ ID NO: 104077 - DNA, 22 bp, Artificial Sequence
  Synthetic oligonucleotide; CTT chr11 5343552 5343573 5343569 5343574 +
tctgtttctgttattaccacag

SEQ ID NO: 104078 - DNA, 22 bp, Artificial Sequence
  Synthetic oligonucleotide; TTT chr11 5343553 5343574 5343570 5343575 +
ctgtttctgttattaccacagt

SEQ ID NO: 104079 - DNA, 22 bp, Artificial Sequence
  Synthetic oligonucleotide; TTC chr11 5343554 5343575 5343571 5343576 +
tgtttctgttattaccacagtg

SEQ ID NO: 104080 - DNA, 22 bp, Artificial Sequence
  Synthetic oligonucleotide; CTG chr11 5343556 5343577 5343573 5343578 +
tttctgttattaccacagtgca

SEQ ID NO: 104081 - DNA, 22 bp, Artificial Sequence
  Synthetic oligonucleotide; TTT chr11 5343559 5343580 5343576 5343581 +
ctgttattaccacagtgcacag

SEQ ID NO: 104082 - DNA, 22 bp, Artificial Sequence
  Synthetic oligonucleotide; TTC chr11 5343560 5343581 5343577 5343582 +
tgttattaccacagtgcacagt

SEQ ID NO: 104083 - DNA, 22 bp, Artificial Sequence
  Synthetic oligonucleotide; CTG chr11 5343562 5343583 5343579 5343584 +
ttattaccacagtgcacagttc

SEQ ID NO: 104084 - DNA, 22 bp, Artificial Sequence
  Synthetic oligonucleotide; TTA chr11 5343565 5343586 5343582 5343587 +
ttaccacagtgcacagttctac

SEQ ID NO: 104085 - DNA, 22 bp, Artificial Sequence
  Synthetic oligonucleotide; TTA chr11 5343568 5343589 5343585 5343590 +
ccacagtgcacagttctacctt

SEQ ID NO: 104086 - DNA, 22 bp, Artificial Sequence
  Synthetic oligonucleotide; TTC chr11 5343584 5343605 5343601 5343606 +
taccttcaaggtatcacttcga

SEQ ID NO: 104087 - DNA, 22 bp, Artificial Sequence
  Synthetic oligonucleotide; CTA chr11 5343586 5343607 5343603 5343608 +
ccttcaaggtatcacttcgact

SEQ ID NO: 104088 - DNA, 22 bp, Artificial Sequence
  Synthetic oligonucleotide; CTT chr11 5343590 5343611 5343607 5343612 +
caaggtatcacttcgactatat

SEQ ID NO: 104089 - DNA, 22 bp, Artificial Sequence
  Synthetic oligonucleotide; TTC chr11 5343591 5343612 5343608 5343613 +
aaggtatcacttcgactatatc

SEQ ID NO: 104090 - DNA, 22 bp, Artificial Sequence
  Synthetic oligonucleotide; CTT chr11 5343603 5343624 5343620 5343625 +
cgactatatcattctcagaatt

SEQ ID NO: 104091 - DNA, 22 bp, Artificial Sequence
  Synthetic oligonucleotide; TTC chr11 5343604 5343625 5343621 5343626 +
gactatatcattctcagaattt

SEQ ID NO: 104092 - DNA, 22 bp, Artificial Sequence
  Synthetic oligonucleotide; CTA chr11 5343609 5343630 5343626 5343631 +
tatcattctcagaattttttcc

SEQ ID NO: 104093 - DNA, 22 bp, Artificial Sequence
  Synthetic oligonucleotide; TTC chr11 5343617 5343638 5343634 5343639 +
tcagaattttttcctaaagata

SEQ ID NO: 104094 - DNA, 22 bp, Artificial Sequence
  Synthetic oligonucleotide; CTC chr11 5343619 5343640 5343636 5343641 +
agaattttttcctaaagataat

SEQ ID NO: 104095 - DNA, 22 bp, Artificial Sequence
  Synthetic oligonucleotide; TTT chr11 5343626 5343647 5343643 5343648 +
tttcctaaagataataatgaca

SEQ ID NO: 104096 - DNA, 22 bp, Artificial Sequence
  Synthetic oligonucleotide; TTT chr11 5343627 5343648 5343644 5343649 +
ttcctaaagataataatgacat

SEQ ID NO: 104097 - DNA, 22 bp, Artificial Sequence
  Synthetic oligonucleotide; TTT chr11 5343628 5343649 5343645 5343650 +
tcctaaagataataatgacatc

SEQ ID NO: 104098 - DNA, 22 bp, Artificial Sequence
  Synthetic oligonucleotide; TTT chr11 5343629 5343650 5343646 5343651 +
cctaaagataataatgacatca

SEQ ID NO: 104099 - DNA, 22 bp, Artificial Sequence
  Synthetic oligonucleotide; TTC chr11 5343630 5343651 5343647 5343652 +
ctaaagataataatgacatcaa

SEQ ID NO: 104100 - DNA, 22 bp, Artificial Sequence
  Synthetic oligonucleotide; CTA chr11 5343633 5343654 5343650 5343655 +
aagataataatgacatcaatat

SEQ ID NO: 104101 - DNA, 22 bp, Artificial Sequence
  Synthetic oligonucleotide; TTG chr11 5343664 5343685 5343681 5343686 +
tttctcaaaatacattctcagg

SEQ ID NO: 104102 - DNA, 22 bp, Artificial Sequence
  Synthetic oligonucleotide; TTT chr11 5343667 5343688 5343684 5343689 +
ctcaaaatacattctcagggtt

SEQ ID NO: 104103 - DNA, 22 bp, Artificial Sequence
  Synthetic oligonucleotide; TTC chr11 5343668 5343689 5343685 5343690 +
tcaaaatacattctcagggtta

SEQ ID NO: 104104 - DNA, 22 bp, Artificial Sequence
  Synthetic oligonucleotide; CTC chr11 5343670 5343691 5343687 5343692 +
aaaatacattctcagggttact

SEQ ID NO: 104105 - DNA, 22 bp, Artificial Sequence
  Synthetic oligonucleotide; TTC chr11 5343681 5343702 5343698 5343703 +
tcagggttactcatactatttg

SEQ ID NO: 104106 - DNA, 22 bp, Artificial Sequence
  Synthetic oligonucleotide; CTC chr11 5343683 5343704 5343700 5343705 +
agggttactcatactatttgta

SEQ ID NO: 104107 - DNA, 22 bp, Artificial Sequence
  Synthetic oligonucleotide; TTA chr11 5343690 5343711 5343707 5343712 +
ctcatactatttgtattcttaa

SEQ ID NO: 104108 - DNA, 22 bp, Artificial Sequence
  Synthetic oligonucleotide; CTC chr11 5343693 5343714 5343710 5343715 +
atactatttgtattcttaactg

SEQ ID NO: 104109 - DNA, 22 bp, Artificial Sequence
  Synthetic oligonucleotide; CTA chr11 5343699 5343720 5343716 5343721 +
tttgtattcttaactgcacatt

SEQ ID NO: 104110 - DNA, 22 bp, Artificial Sequence
  Synthetic oligonucleotide; TTT chr11 5343702 5343723 5343719 5343724 +
gtattcttaactgcacattcca

SEQ ID NO: 104111 - DNA, 22 bp, Artificial Sequence
  Synthetic oligonucleotide; TTG chr11 5343703 5343724 5343720 5343725 +
tattcttaactgcacattccag

SEQ ID NO: 104112 - DNA, 22 bp, Artificial Sequence
  Synthetic oligonucleotide; TTC chr11 5343708 5343729 5343725 5343730 +
ttaactgcacattccaggatct

SEQ ID NO: 104113 - DNA, 22 bp, Artificial Sequence
  Synthetic oligonucleotide; CTT chr11 5343710 5343731 5343727 5343732 +
aactgcacattccaggatctat

SEQ ID NO: 104114 - DNA, 22 bp, Artificial Sequence
  Synthetic oligonucleotide; TTA chr11 5343711 5343732 5343728 5343733 +
actgcacattccaggatctatc

SEQ ID NO: 104115 - DNA, 22 bp, Artificial Sequence
  Synthetic oligonucleotide; CTG chr11 5343715 5343736 5343732 5343737 +
cacattccaggatctatctcct

SEQ ID NO: 104116 - DNA, 22 bp, Artificial Sequence
  Synthetic oligonucleotide; TTC chr11 5343722 5343743 5343739 5343744 +
caggatctatctcctacctacg

SEQ ID NO: 104117 - DNA, 22 bp, Artificial Sequence
  Synthetic oligonucleotide; CTA chr11 5343731 5343752 5343748 5343753 +
tctcctacctacgtaatcaaat

SEQ ID NO: 104118 - DNA, 22 bp, Artificial Sequence
  Synthetic oligonucleotide; CTC chr11 5343735 5343756 5343752 5343757 +
ctacctacgtaatcaaattctt

SEQ ID NO: 104119 - DNA, 22 bp, Artificial Sequence
  Synthetic oligonucleotide; CTA chr11 5343738 5343759 5343755 5343760 +
cctacgtaatcaaattcttgga

SEQ ID NO: 104120 - DNA, 22 bp, Artificial Sequence
  Synthetic oligonucleotide; CTA chr11 5343742 5343763 5343759 5343764 +
cgtaatcaaattcttggagttt

SEQ ID NO: 104121 - DNA, 22 bp, Artificial Sequence
  Synthetic oligonucleotide; TTC chr11 5343755 5343776 5343772 5343777 +
ttggagtttcaactgtttatat

SEQ ID NO: 104122 - DNA, 22 bp, Artificial Sequence
  Synthetic oligonucleotide; CTT chr11 5343757 5343778 5343774 5343779 +
ggagtttcaactgtttatatgc

SEQ ID NO: 104123 - DNA, 22 bp, Artificial Sequence
  Synthetic oligonucleotide; TTG chr11 5343758 5343779 5343775 5343780 +
gagtttcaactgtttatatgca

SEQ ID NO: 104124 - DNA, 22 bp, Artificial Sequence
  Synthetic oligonucleotide; TTT chr11 5343764 5343785 5343781 5343786 +
caactgtttatatgcatttaag

SEQ ID NO: 104125 - DNA, 22 bp, Artificial Sequence
  Synthetic oligonucleotide; TTC chr11 5343765 5343786 5343782 5343787 +
aactgtttatatgcatttaagc

SEQ ID NO: 104126 - DNA, 22 bp, Artificial Sequence
  Synthetic oligonucleotide; CTG chr11 5343770 5343791 5343787 5343792 +
tttatatgcatttaagcattct

SEQ ID NO: 104127 - DNA, 22 bp, Artificial Sequence
  Synthetic oligonucleotide; TTT chr11 5343773 5343794 5343790 5343795 +
atatgcatttaagcattctctt

SEQ ID NO: 104128 - DNA, 22 bp, Artificial Sequence
  Synthetic oligonucleotide; TTA chr11 5343774 5343795 5343791 5343796 +
tatgcatttaagcattctcttc

SEQ ID NO: 104129 - DNA, 22 bp, Artificial Sequence
  Synthetic oligonucleotide; TTT chr11 5343783 5343804 5343800 5343805 +
aagcattctcttcagaaaaaaa

SEQ ID NO: 104130 - DNA, 22 bp, Artificial Sequence
  Synthetic oligonucleotide; TTA chr11 5343784 5343805 5343801 5343806 +
agcattctcttcagaaaaaaaa

SEQ ID NO: 104131 - DNA, 22 bp, Artificial Sequence
  Synthetic oligonucleotide; TTC chr11 5343791 5343812 5343808 5343813 +
tcttcagaaaaaaaattatgta

SEQ ID NO: 104132 - DNA, 22 bp, Artificial Sequence
  Synthetic oligonucleotide; CTC chr11 5343793 5343814 5343810 5343815 +
ttcagaaaaaaaattatgtaaa

SEQ ID NO: 104133 - DNA, 22 bp, Artificial Sequence
  Synthetic oligonucleotide; CTT chr11 5343795 5343816 5343812 5343817 +
cagaaaaaaaattatgtaaact

SEQ ID NO: 104134 - DNA, 22 bp, Artificial Sequence
  Synthetic oligonucleotide; TTC chr11 5343796 5343817 5343813 5343818 +
agaaaaaaaattatgtaaacta

SEQ ID NO: 104135 - DNA, 22 bp, Artificial Sequence
  Synthetic oligonucleotide; TTA chr11 5343809 5343830 5343826 5343831 +
tgtaaactacaacttctaaact

SEQ ID NO: 104136 - DNA, 22 bp, Artificial Sequence
  Synthetic oligonucleotide; CTA chr11 5343818 5343839 5343835 5343840 +
caacttctaaactgttaccctt

SEQ ID NO: 104137 - DNA, 22 bp, Artificial Sequence
  Synthetic oligonucleotide; CTT chr11 5343824 5343845 5343841 5343846 +
ctaaactgttacccttaactat

SEQ ID NO: 104138 - DNA, 22 bp, Artificial Sequence
  Synthetic oligonucleotide; TTC chr11 5343825 5343846 5343842 5343847 +
taaactgttacccttaactatg

SEQ ID NO: 104139 - DNA, 22 bp, Artificial Sequence
  Synthetic oligonucleotide; CTA chr11 5343827 5343848 5343844 5343849 +
aactgttacccttaactatgca

SEQ ID NO: 104140 - DNA, 22 bp, Artificial Sequence
  Synthetic oligonucleotide; CTG chr11 5343832 5343853 5343849 5343854 +
ttacccttaactatgcagattt

SEQ ID NO: 104141 - DNA, 22 bp, Artificial Sequence
  Synthetic oligonucleotide; TTA chr11 5343835 5343856 5343852 5343857 +
cccttaactatgcagattttaa

SEQ ID NO: 104142 - DNA, 22 bp, Artificial Sequence
  Synthetic oligonucleotide; CTT chr11 5343840 5343861 5343857 5343862 +
aactatgcagattttaaagaat

SEQ ID NO: 104143 - DNA, 22 bp, Artificial Sequence
  Synthetic oligonucleotide; TTA chr11 5343841 5343862 5343858 5343863 +
actatgcagattttaaagaatt

SEQ ID NO: 104144 - DNA, 22 bp, Artificial Sequence
  Synthetic oligonucleotide; CTA chr11 5343845 5343866 5343862 5343867 +
tgcagattttaaagaattcgta

SEQ ID NO: 104145 - DNA, 22 bp, Artificial Sequence
  Synthetic oligonucleotide; TTT chr11 5343854 5343875 5343871 5343876 +
taaagaattcgtattctatggg

SEQ ID NO: 104146 - DNA, 22 bp, Artificial Sequence
  Synthetic oligonucleotide; TTT chr11 5343855 5343876 5343872 5343877 +
aaagaattcgtattctatgggg

SEQ ID NO: 104147 - DNA, 22 bp, Artificial Sequence
  Synthetic oligonucleotide; TTA chr11 5343856 5343877 5343873 5343878 +
aagaattcgtattctatggggc

SEQ ID NO: 104148 - DNA, 22 bp, Artificial Sequence
  Synthetic oligonucleotide; TTC chr11 5343864 5343885 5343881 5343886 +
gtattctatggggcattcaagg

SEQ ID NO: 104149 - DNA, 22 bp, Artificial Sequence
  Synthetic oligonucleotide; TTC chr11 5343870 5343891 5343887 5343892 +
tatggggcattcaaggggattt

SEQ ID NO: 104150 - DNA, 22 bp, Artificial Sequence
  Synthetic oligonucleotide; CTA chr11 5343872 5343893 5343889 5343894 +
tggggcattcaaggggatttcc

SEQ ID NO: 104151 - DNA, 22 bp, Artificial Sequence
  Synthetic oligonucleotide; TTC chr11 5343882 5343903 5343899 5343904 +
aaggggatttccagaaagctaa

SEQ ID NO: 104152 - DNA, 22 bp, Artificial Sequence
  Synthetic oligonucleotide; TTT chr11 5343892 5343913 5343909 5343914 +
ccagaaagctaacactaatttt

SEQ ID NO: 104153 - DNA, 22 bp, Artificial Sequence
  Synthetic oligonucleotide; TTC chr11 5343893 5343914 5343910 5343915 +
cagaaagctaacactaattttt

SEQ ID NO: 104154 - DNA, 22 bp, Artificial Sequence
  Synthetic oligonucleotide; CTA chr11 5343903 5343924 5343920 5343925 +
acactaatttttttctggtcta

SEQ ID NO: 104155 - DNA, 22 bp, Artificial Sequence
  Synthetic oligonucleotide; CTA chr11 5343909 5343930 5343926 5343931 +
atttttttctggtctaccacct

SEQ ID NO: 104156 - DNA, 22 bp, Artificial Sequence
  Synthetic oligonucleotide; TTT chr11 5343913 5343934 5343930 5343935 +
ttttctggtctaccacctaaac

SEQ ID NO: 104157 - DNA, 22 bp, Artificial Sequence
  Synthetic oligonucleotide; TTT chr11 5343914 5343935 5343931 5343936 +
tttctggtctaccacctaaacc

SEQ ID NO: 104158 - DNA, 22 bp, Artificial Sequence
  Synthetic oligonucleotide; TTT chr11 5343915 5343936 5343932 5343937 +
ttctggtctaccacctaaacct

SEQ ID NO: 104159 - DNA, 22 bp, Artificial Sequence
  Synthetic oligonucleotide; TTT chr11 5343916 5343937 5343933 5343938 +
tctggtctaccacctaaacctg

SEQ ID NO: 104160 - DNA, 22 bp, Artificial Sequence
  Synthetic oligonucleotide; TTT chr11 5343917 5343938 5343934 5343939 +
ctggtctaccacctaaacctgt

SEQ ID NO: 104161 - DNA, 22 bp, Artificial Sequence
  Synthetic oligonucleotide; TTC chr11 5343918 5343939 5343935 5343940 +
tggtctaccacctaaacctgta

SEQ ID NO: 104162 - DNA, 22 bp, Artificial Sequence
  Synthetic oligonucleotide; CTG chr11 5343920 5343941 5343937 5343942 +
gtctaccacctaaacctgtaat

SEQ ID NO: 104163 - DNA, 22 bp, Artificial Sequence
  Synthetic oligonucleotide; CTA chr11 5343925 5343946 5343942 5343947 +
ccacctaaacctgtaattgcct

SEQ ID NO: 104164 - DNA, 22 bp, Artificial Sequence
  Synthetic oligonucleotide; CTA chr11 5343932 5343953 5343949 5343954 +
aacctgtaattgccttcacagt

SEQ ID NO: 104165 - DNA, 22 bp, Artificial Sequence
  Synthetic oligonucleotide; CTG chr11 5343938 5343959 5343955 5343960 +
taattgccttcacagtagtgat

SEQ ID NO: 104166 - DNA, 22 bp, Artificial Sequence
  Synthetic oligonucleotide; TTG chr11 5343944 5343965 5343961 5343966 +
ccttcacagtagtgatccctaa

SEQ ID NO: 104167 - DNA, 22 bp, Artificial Sequence
  Synthetic oligonucleotide; CTT chr11 5343948 5343969 5343965 5343970 +
cacagtagtgatccctaatcca

SEQ ID NO: 104168 - DNA, 22 bp, Artificial Sequence
  Synthetic oligonucleotide; TTC chr11 5343949 5343970 5343966 5343971 +
acagtagtgatccctaatccac

SEQ ID NO: 104169 - DNA, 22 bp, Artificial Sequence
  Synthetic oligonucleotide; CTA chr11 5343965 5343986 5343982 5343987 +
atccacattttcctgcatgtaa

SEQ ID NO: 104170 - DNA, 22 bp, Artificial Sequence
  Synthetic oligonucleotide; TTT chr11 5343975 5343996 5343992 5343997 +
tcctgcatgtaaagacttacct

SEQ ID NO: 104171 - DNA, 22 bp, Artificial Sequence
  Synthetic oligonucleotide; TTT chr11 5343976 5343997 5343993 5343998 +
cctgcatgtaaagacttacctg

SEQ ID NO: 104172 - DNA, 22 bp, Artificial Sequence
  Synthetic oligonucleotide; TTC chr11 5343977 5343998 5343994 5343999 +
ctgcatgtaaagacttacctga

SEQ ID NO: 104173 - DNA, 22 bp, Artificial Sequence
  Synthetic oligonucleotide; CTG chr11 5343980 5344001 5343997 5344002 +
catgtaaagacttacctgaatt

SEQ ID NO: 104174 - DNA, 22 bp, Artificial Sequence
  Synthetic oligonucleotide; CTT chr11 5343993 5344014 5344010 5344015 +
acctgaattatcagctaaagtc

SEQ ID NO: 104175 - DNA, 22 bp, Artificial Sequence
  Synthetic oligonucleotide; TTA chr11 5343994 5344015 5344011 5344016 +
cctgaattatcagctaaagtct

SEQ ID NO: 104176 - DNA, 22 bp, Artificial Sequence
  Synthetic oligonucleotide; CTG chr11 5343998 5344019 5344015 5344020 +
aattatcagctaaagtctcaac

SEQ ID NO: 104177 - DNA, 22 bp, Artificial Sequence
  Synthetic oligonucleotide; TTA chr11 5344003 5344024 5344020 5344025 +
tcagctaaagtctcaacagcct

SEQ ID NO: 104178 - DNA, 22 bp, Artificial Sequence
  Synthetic oligonucleotide; CTA chr11 5344010 5344031 5344027 5344032 +
aagtctcaacagcctaagaaag

SEQ ID NO: 104179 - DNA, 22 bp, Artificial Sequence
  Synthetic oligonucleotide; CTC chr11 5344017 5344038 5344034 5344039 +
aacagcctaagaaagaaaagtg

SEQ ID NO: 104180 - DNA, 22 bp, Artificial Sequence
  Synthetic oligonucleotide; CTA chr11 5344026 5344047 5344043 5344048 +
agaaagaaaagtgtgggaagag

SEQ ID NO: 104181 - DNA, 22 bp, Artificial Sequence
  Synthetic oligonucleotide; CTC chr11 5344054 5344075 5344071 5344076 +
tgccactaccactgtagctaag

SEQ ID NO: 104182 - DNA, 22 bp, Artificial Sequence
  Synthetic oligonucleotide; CTG chr11 5344056 5344077 5344073 5344078 +
ccactaccactgtagctaagga

SEQ ID NO: 104183 - DNA, 22 bp, Artificial Sequence
  Synthetic oligonucleotide; CTA chr11 5344062 5344083 5344079 5344084 +
ccactgtagctaaggagcagtc

SEQ ID NO: 104184 - DNA, 22 bp, Artificial Sequence
  Synthetic oligonucleotide; CTG chr11 5344068 5344089 5344085 5344090 +
tagctaaggagcagtcagattg

SEQ ID NO: 104185 - DNA, 22 bp, Artificial Sequence
  Synthetic oligonucleotide; CTA chr11 5344074 5344095 5344091 5344096 +
aggagcagtcagattgagaaag

SEQ ID NO: 104186 - DNA, 22 bp, Artificial Sequence
  Synthetic oligonucleotide; TTG chr11 5344090 5344111 5344107 5344112 +
agaaagagacacttggcctcca

SEQ ID NO: 104187 - DNA, 22 bp, Artificial Sequence
  Synthetic oligonucleotide; CTT chr11 5344104 5344125 5344121 5344126 +
ggcctccagatttcatggacta

SEQ ID NO: 104188 - DNA, 22 bp, Artificial Sequence
  Synthetic oligonucleotide; TTG chr11 5344105 5344126 5344122 5344127 +
gcctccagatttcatggactag

SEQ ID NO: 104189 - DNA, 22 bp, Artificial Sequence
  Synthetic oligonucleotide; CTC chr11 5344110 5344131 5344127 5344132 +
cagatttcatggactagtgatg

SEQ ID NO: 104190 - DNA, 22 bp, Artificial Sequence
  Synthetic oligonucleotide; TTT chr11 5344117 5344138 5344134 5344139 +
catggactagtgatggggaaca

SEQ ID NO: 104191 - DNA, 22 bp, Artificial Sequence
  Synthetic oligonucleotide; TTC chr11 5344118 5344139 5344135 5344140 +
atggactagtgatggggaacag

SEQ ID NO: 104192 - DNA, 22 bp, Artificial Sequence
  Synthetic oligonucleotide; CTA chr11 5344126 5344147 5344143 5344148 +
gtgatggggaacagacattcac

SEQ ID NO: 104193 - DNA, 22 bp, Artificial Sequence
  Synthetic oligonucleotide; TTC chr11 5344146 5344167 5344163 5344168 +
acgattagtgtgaattaccctc

SEQ ID NO: 104194 - DNA, 22 bp, Artificial Sequence
  Synthetic oligonucleotide; TTA chr11 5344153 5344174 5344170 5344175 +
gtgtgaattaccctcttgtaga

SEQ ID NO: 104195 - DNA, 22 bp, Artificial Sequence
  Synthetic oligonucleotide; TTA chr11 5344163 5344184 5344180 5344185 +
ccctcttgtagaatccttcagt

SEQ ID NO: 104196 - DNA, 22 bp, Artificial Sequence
  Synthetic oligonucleotide; CTC chr11 5344168 5344189 5344185 5344190 +
ttgtagaatccttcagtactac

SEQ ID NO: 104197 - DNA, 22 bp, Artificial Sequence
  Synthetic oligonucleotide; CTT chr11 5344170 5344191 5344187 5344192 +
gtagaatccttcagtactactc

SEQ ID NO: 104198 - DNA, 22 bp, Artificial Sequence
  Synthetic oligonucleotide; TTG chr11 5344171 5344192 5344188 5344193 +
tagaatccttcagtactactca

SEQ ID NO: 104199 - DNA, 22 bp, Artificial Sequence
  Synthetic oligonucleotide; CTT chr11 5344181 5344202 5344198 5344203 +
cagtactactcactacttgtga

SEQ ID NO: 104200 - DNA, 22 bp, Artificial Sequence
  Synthetic oligonucleotide; TTC chr11 5344182 5344203 5344199 5344204 +
agtactactcactacttgtgac

SEQ ID NO: 104201 - DNA, 22 bp, Artificial Sequence
  Synthetic oligonucleotide; CTA chr11 5344189 5344210 5344206 5344211 +
ctcactacttgtgacaatagct

SEQ ID NO: 104202 - DNA, 22 bp, Artificial Sequence
  Synthetic oligonucleotide; CTC chr11 5344192 5344213 5344209 5344214 +
actacttgtgacaatagctcag

SEQ ID NO: 104203 - DNA, 22 bp, Artificial Sequence
  Synthetic oligonucleotide; CTA chr11 5344196 5344217 5344213 5344218 +
cttgtgacaatagctcagtcta

SEQ ID NO: 104204 - DNA, 22 bp, Artificial Sequence
  Synthetic oligonucleotide; CTT chr11 5344199 5344220 5344216 5344221 +
gtgacaatagctcagtctaatt

SEQ ID NO: 104205 - DNA, 22 bp, Artificial Sequence
  Synthetic oligonucleotide; TTG chr11 5344200 5344221 5344217 5344222 +
tgacaatagctcagtctaatta

SEQ ID NO: 104206 - DNA, 22 bp, Artificial Sequence
  Synthetic oligonucleotide; CTC chr11 5344212 5344233 5344229 5344234 +
agtctaattataagttagactt

SEQ ID NO: 104207 - DNA, 22 bp, Artificial Sequence
  Synthetic oligonucleotide; CTA chr11 5344218 5344239 5344235 5344240 +
attataagttagactttggggc

SEQ ID NO: 104208 - DNA, 22 bp, Artificial Sequence
  Synthetic oligonucleotide; TTA chr11 5344222 5344243 5344239 5344244 +
taagttagactttggggctgga

SEQ ID NO: 104209 - DNA, 22 bp, Artificial Sequence
  Synthetic oligonucleotide; TTA chr11 5344229 5344250 5344246 5344251 +
gactttggggctggaataaatg

SEQ ID NO: 104210 - DNA, 22 bp, Artificial Sequence
  Synthetic oligonucleotide; CTT chr11 5344234 5344255 5344251 5344256 +
tggggctggaataaatgattag

SEQ ID NO: 104211 - DNA, 22 bp, Artificial Sequence
  Synthetic oligonucleotide; TTT chr11 5344235 5344256 5344252 5344257 +
ggggctggaataaatgattagg

SEQ ID NO: 104212 - DNA, 22 bp, Artificial Sequence
  Synthetic oligonucleotide; TTG chr11 5344236 5344257 5344253 5344258 +
gggctggaataaatgattaggc

SEQ ID NO: 104213 - DNA, 22 bp, Artificial Sequence
  Synthetic oligonucleotide; CTG chr11 5344242 5344263 5344259 5344264 +
gaataaatgattaggccagcca

SEQ ID NO: 104214 - DNA, 22 bp, Artificial Sequence
  Synthetic oligonucleotide; TTA chr11 5344255 5344276 5344272 5344277 +
ggccagccaaagacatcactta

SEQ ID NO: 104215 - DNA, 22 bp, Artificial Sequence
  Synthetic oligonucleotide; CTT chr11 5344276 5344297 5344293 5344298 +
ataatagtgtatctccttcagt

SEQ ID NO: 104216 - DNA, 22 bp, Artificial Sequence
  Synthetic oligonucleotide; TTA chr11 5344277 5344298 5344294 5344299 +
taatagtgtatctccttcagtt

SEQ ID NO: 104217 - DNA, 22 bp, Artificial Sequence
  Synthetic oligonucleotide; CTC chr11 5344291 5344312 5344308 5344313 +
cttcagtttaaacatcttactg

SEQ ID NO: 104218 - DNA, 22 bp, Artificial Sequence
  Synthetic oligonucleotide; CTT chr11 5344294 5344315 5344311 5344316 +
cagtttaaacatcttactgttt

SEQ ID NO: 104219 - DNA, 22 bp, Artificial Sequence
  Synthetic oligonucleotide; TTC chr11 5344295 5344316 5344312 5344317 +
agtttaaacatcttactgtttc

SEQ ID NO: 104220 - DNA, 22 bp, Artificial Sequence
  Synthetic oligonucleotide; TTT chr11 5344300 5344321 5344317 5344322 +
aaacatcttactgtttcttatt

SEQ ID NO: 104221 - DNA, 22 bp, Artificial Sequence
  Synthetic oligonucleotide; TTA chr11 5344301 5344322 5344318 5344323 +
aacatcttactgtttcttattt

SEQ ID NO: 104222 - DNA, 22 bp, Artificial Sequence
  Synthetic oligonucleotide; CTT chr11 5344309 5344330 5344326 5344331 +
actgtttcttatttacaagtag

SEQ ID NO: 104223 - DNA, 22 bp, Artificial Sequence
  Synthetic oligonucleotide; TTA chr11 5344310 5344331 5344327 5344332 +
ctgtttcttatttacaagtagt

SEQ ID NO: 104224 - DNA, 22 bp, Artificial Sequence
  Synthetic oligonucleotide; CTG chr11 5344313 5344334 5344330 5344335 +
tttcttatttacaagtagtgtc

SEQ ID NO: 104225 - DNA, 22 bp, Artificial Sequence
  Synthetic oligonucleotide; TTT chr11 5344316 5344337 5344333 5344338 +
cttatttacaagtagtgtcttt

SEQ ID NO: 104226 - DNA, 22 bp, Artificial Sequence
  Synthetic oligonucleotide; TTC chr11 5344317 5344338 5344334 5344339 +
ttatttacaagtagtgtctttt

SEQ ID NO: 104227 - DNA, 22 bp, Artificial Sequence
  Synthetic oligonucleotide; CTT chr11 5344319 5344340 5344336 5344341 +
atttacaagtagtgtctttttc

SEQ ID NO: 104228 - DNA, 22 bp, Artificial Sequence
  Synthetic oligonucleotide; TTA chr11 5344320 5344341 5344337 5344342 +
tttacaagtagtgtctttttct

SEQ ID NO: 104229 - DNA, 22 bp, Artificial Sequence
  Synthetic oligonucleotide; TTT chr11 5344323 5344344 5344340 5344345 +
acaagtagtgtctttttctttt

SEQ ID NO: 104230 - DNA, 22 bp, Artificial Sequence
  Synthetic oligonucleotide; TTA chr11 5344324 5344345 5344341 5344346 +
caagtagtgtctttttcttttt

SEQ ID NO: 104231 - DNA, 22 bp, Artificial Sequence
  Synthetic oligonucleotide; CTT chr11 5344337 5344358 5344354 5344359 +
tttctttttaaattatttttct

SEQ ID NO: 104232 - DNA, 22 bp, Artificial Sequence
  Synthetic oligonucleotide; TTT chr11 5344338 5344359 5344355 5344360 +
ttctttttaaattatttttcta

SEQ ID NO: 104233 - DNA, 22 bp, Artificial Sequence
  Synthetic oligonucleotide; TTT chr11 5344339 5344360 5344356 5344361 +
tctttttaaattatttttctat

SEQ ID NO: 104234 - DNA, 22 bp, Artificial Sequence
  Synthetic oligonucleotide; TTT chr11 5344340 5344361 5344357 5344362 +
ctttttaaattatttttctata

SEQ ID NO: 104235 - DNA, 22 bp, Artificial Sequence
  Synthetic oligonucleotide; TTC chr11 5344341 5344362 5344358 5344363 +
tttttaaattatttttctatag

SEQ ID NO: 104236 - DNA, 22 bp, Artificial Sequence
  Synthetic oligonucleotide; CTT chr11 5344343 5344364 5344360 5344365 +
tttaaattatttttctataggc

SEQ ID NO: 104237 - DNA, 22 bp, Artificial Sequence
  Synthetic oligonucleotide; TTT chr11 5344344 5344365 5344361 5344366 +
ttaaattatttttctataggcc

SEQ ID NO: 104238 - DNA, 22 bp, Artificial Sequence
  Synthetic oligonucleotide; TTT chr11 5344345 5344366 5344362 5344367 +
taaattatttttctataggcct

SEQ ID NO: 104239 - DNA, 22 bp, Artificial Sequence
  Synthetic oligonucleotide; TTT chr11 5344346 5344367 5344363 5344368 +
aaattatttttctataggccta

SEQ ID NO: 104240 - DNA, 22 bp, Artificial Sequence
  Synthetic oligonucleotide; TTA chr11 5344347 5344368 5344364 5344369 +
aattatttttctataggcctac

SEQ ID NO: 104241 - DNA, 22 bp, Artificial Sequence
  Synthetic oligonucleotide; TTA chr11 5344352 5344373 5344369 5344374 +
tttttctataggcctactgaag

SEQ ID NO: 104242 - DNA, 22 bp, Artificial Sequence
  Synthetic oligonucleotide; TTT chr11 5344355 5344376 5344372 5344377 +
ttctataggcctactgaagtaa

SEQ ID NO: 104243 - DNA, 22 bp, Artificial Sequence
  Synthetic oligonucleotide; TTT chr11 5344356 5344377 5344373 5344378 +
tctataggcctactgaagtaat

SEQ ID NO: 104244 - DNA, 22 bp, Artificial Sequence
  Synthetic oligonucleotide; TTT chr11 5344357 5344378 5344374 5344379 +
ctataggcctactgaagtaatt

SEQ ID NO: 104245 - DNA, 22 bp, Artificial Sequence
  Synthetic oligonucleotide; TTC chr11 5344358 5344379 5344375 5344380 +
tataggcctactgaagtaattc

SEQ ID NO: 104246 - DNA, 22 bp, Artificial Sequence
  Synthetic oligonucleotide; CTA chr11 5344360 5344381 5344377 5344382 +
taggcctactgaagtaattccc

SEQ ID NO: 104247 - DNA, 22 bp, Artificial Sequence
  Synthetic oligonucleotide; CTA chr11 5344368 5344389 5344385 5344390 +
ctgaagtaattccctagaatct

SEQ ID NO: 104248 - DNA, 22 bp, Artificial Sequence
  Synthetic oligonucleotide; CTG chr11 5344371 5344392 5344388 5344393 +
aagtaattccctagaatctgac

SEQ ID NO: 104249 - DNA, 22 bp, Artificial Sequence
  Synthetic oligonucleotide; TTC chr11 5344380 5344401 5344397 5344402 +
cctagaatctgacctctctcat

SEQ ID NO: 104250 - DNA, 22 bp, Artificial Sequence
  Synthetic oligonucleotide; CTA chr11 5344384 5344405 5344401 5344406 +
gaatctgacctctctcatttca

SEQ ID NO: 104251 - DNA, 22 bp, Artificial Sequence
  Synthetic oligonucleotide; CTG chr11 5344391 5344412 5344408 5344413 +
acctctctcatttcaagttctc

SEQ ID NO: 104252 - DNA, 22 bp, Artificial Sequence
  Synthetic oligonucleotide; CTC chr11 5344396 5344417 5344413 5344418 +
tctcatttcaagttctccattt

SEQ ID NO: 104253 - DNA, 22 bp, Artificial Sequence
  Synthetic oligonucleotide; CTC chr11 5344398 5344419 5344415 5344420 +
tcatttcaagttctccatttat

SEQ ID NO: 104254 - DNA, 22 bp, Artificial Sequence
  Synthetic oligonucleotide; CTC chr11 5344400 5344421 5344417 5344422 +
atttcaagttctccatttatat

SEQ ID NO: 104255 - DNA, 22 bp, Artificial Sequence
  Synthetic oligonucleotide; TTT chr11 5344404 5344425 5344421 5344426 +
caagttctccatttatatttaa

SEQ ID NO: 104256 - DNA, 22 bp, Artificial Sequence
  Synthetic oligonucleotide; TTC chr11 5344405 5344426 5344422 5344427 +
aagttctccatttatatttaaa

SEQ ID NO: 104257 - DNA, 22 bp, Artificial Sequence
  Synthetic oligonucleotide; TTC chr11 5344411 5344432 5344428 5344433 +
tccatttatatttaaacatcca

SEQ ID NO: 104258 - DNA, 22 bp, Artificial Sequence
  Synthetic oligonucleotide; CTC chr11 5344413 5344434 5344430 5344435 +
catttatatttaaacatccatc

SEQ ID NO: 104259 - DNA, 22 bp, Artificial Sequence
  Synthetic oligonucleotide; TTT chr11 5344418 5344439 5344435 5344440 +
atatttaaacatccatcttcct

SEQ ID NO: 104260 - DNA, 22 bp, Artificial Sequence
  Synthetic oligonucleotide; TTA chr11 5344419 5344440 5344436 5344441 +
tatttaaacatccatcttcctg

SEQ ID NO: 104261 - DNA, 22 bp, Artificial Sequence
  Synthetic oligonucleotide; TTT chr11 5344424 5344445 5344441 5344446 +
aaacatccatcttcctggtttc

SEQ ID NO: 104262 - DNA, 22 bp, Artificial Sequence
  Synthetic oligonucleotide; TTA chr11 5344425 5344446 5344442 5344447 +
aacatccatcttcctggtttcc

SEQ ID NO: 104263 - DNA, 22 bp, Artificial Sequence
  Synthetic oligonucleotide; CTT chr11 5344437 5344458 5344454 5344459 +
cctggtttccttccctttatcc

SEQ ID NO: 104264 - DNA, 22 bp, Artificial Sequence
  Synthetic oligonucleotide; TTC chr11 5344438 5344459 5344455 5344460 +
ctggtttccttccctttatccc

SEQ ID NO: 104265 - DNA, 22 bp, Artificial Sequence
  Synthetic oligonucleotide; CTG chr11 5344441 5344462 5344458 5344463 +
gtttccttccctttatccccag

SEQ ID NO: 104266 - DNA, 22 bp, Artificial Sequence
  Synthetic oligonucleotide; TTT chr11 5344445 5344466 5344462 5344467 +
ccttccctttatccccagccat

SEQ ID NO: 104267 - DNA, 22 bp, Artificial Sequence
  Synthetic oligonucleotide; TTC chr11 5344446 5344467 5344463 5344468 +
cttccctttatccccagccata

SEQ ID NO: 104268 - DNA, 22 bp, Artificial Sequence
  Synthetic oligonucleotide; CTT chr11 5344449 5344470 5344466 5344471 +
ccctttatccccagccataggc

SEQ ID NO: 104269 - DNA, 22 bp, Artificial Sequence
  Synthetic oligonucleotide; TTC chr11 5344450 5344471 5344467 5344472 +
cctttatccccagccataggct

SEQ ID NO: 104270 - DNA, 22 bp, Artificial Sequence
  Synthetic oligonucleotide; CTT chr11 5344454 5344475 5344471 5344476 +
tatccccagccataggcttctg

SEQ ID NO: 104271 - DNA, 22 bp, Artificial Sequence
  Synthetic oligonucleotide; TTT chr11 5344455 5344476 5344472 5344477 +
atccccagccataggcttctga

SEQ ID NO: 104272 - DNA, 22 bp, Artificial Sequence
  Synthetic oligonucleotide; TTA chr11 5344456 5344477 5344473 5344478 +
tccccagccataggcttctgaa

SEQ ID NO: 104273 - DNA, 22 bp, Artificial Sequence
  Synthetic oligonucleotide; CTT chr11 5344473 5344494 5344490 5344495 +
ctgaatctgttctccccaatac

SEQ ID NO: 104274 - DNA, 22 bp, Artificial Sequence
  Synthetic oligonucleotide; TTC chr11 5344474 5344495 5344491 5344496 +
tgaatctgttctccccaatact

SEQ ID NO: 104275 - DNA, 22 bp, Artificial Sequence
  Synthetic oligonucleotide; CTG chr11 5344476 5344497 5344493 5344498 +
aatctgttctccccaatactga

SEQ ID NO: 104276 - DNA, 22 bp, Artificial Sequence
  Synthetic oligonucleotide; CTG chr11 5344482 5344503 5344499 5344504 +
ttctccccaatactgagtgaga

SEQ ID NO: 104277 - DNA, 22 bp, Artificial Sequence
  Synthetic oligonucleotide; TTC chr11 5344485 5344506 5344502 5344507 +
tccccaatactgagtgagagct

SEQ ID NO: 104278 - DNA, 22 bp, Artificial Sequence
  Synthetic oligonucleotide; CTC chr11 5344487 5344508 5344504 5344509 +
cccaatactgagtgagagctat

SEQ ID NO: 104279 - DNA, 22 bp, Artificial Sequence
  Synthetic oligonucleotide; CTG chr11 5344497 5344518 5344514 5344519 +
agtgagagctatttccctgctt

SEQ ID NO: 104280 - DNA, 22 bp, Artificial Sequence
  Synthetic oligonucleotide; CTA chr11 5344508 5344529 5344525 5344530 +
tttccctgcttaaacgtggtgc

SEQ ID NO: 104281 - DNA, 22 bp, Artificial Sequence
  Synthetic oligonucleotide; TTT chr11 5344511 5344532 5344528 5344533 +
ccctgcttaaacgtggtgctgt

SEQ ID NO: 104282 - DNA, 22 bp, Artificial Sequence
  Synthetic oligonucleotide; TTC chr11 5344512 5344533 5344529 5344534 +
cctgcttaaacgtggtgctgtc

SEQ ID NO: 104283 - DNA, 22 bp, Artificial Sequence
  Synthetic oligonucleotide; CTG chr11 5344516 5344537 5344533 5344538 +
cttaaacgtggtgctgtctttt

SEQ ID NO: 104284 - DNA, 22 bp, Artificial Sequence
  Synthetic oligonucleotide; CTT chr11 5344519 5344540 5344536 5344541 +
aaacgtggtgctgtcttttact

SEQ ID NO: 104285 - DNA, 22 bp, Artificial Sequence
  Synthetic oligonucleotide; TTA chr11 5344520 5344541 5344537 5344542 +
aacgtggtgctgtcttttactg

SEQ ID NO: 104286 - DNA, 22 bp, Artificial Sequence
  Synthetic oligonucleotide; CTG chr11 5344532 5344553 5344549 5344554 +
tcttttactgaagagaagagat

SEQ ID NO: 104287 - DNA, 22 bp, Artificial Sequence
  Synthetic oligonucleotide; CTT chr11 5344536 5344557 5344553 5344558 +
ttactgaagagaagagattagt

SEQ ID NO: 104288 - DNA, 22 bp, Artificial Sequence
  Synthetic oligonucleotide; TTT chr11 5344537 5344558 5344554 5344559 +
tactgaagagaagagattagtc

SEQ ID NO: 104289 - DNA, 22 bp, Artificial Sequence
  Synthetic oligonucleotide; TTT chr11 5344538 5344559 5344555 5344560 +
actgaagagaagagattagtcc

SEQ ID NO: 104290 - DNA, 22 bp, Artificial Sequence
  Synthetic oligonucleotide; TTA chr11 5344539 5344560 5344556 5344561 +
ctgaagagaagagattagtcct

SEQ ID NO: 104291 - DNA, 22 bp, Artificial Sequence
  Synthetic oligonucleotide; CTG chr11 5344542 5344563 5344559 5344564 +
aagagaagagattagtcctttg

SEQ ID NO: 104292 - DNA, 22 bp, Artificial Sequence
  Synthetic oligonucleotide; TTA chr11 5344556 5344577 5344573 5344578 +
gtcctttgagaaggttttaata

SEQ ID NO: 104293 - DNA, 22 bp, Artificial Sequence
  Synthetic oligonucleotide; CTT chr11 5344562 5344583 5344579 5344584 +
tgagaaggttttaatattcctt

SEQ ID NO: 104294 - DNA, 22 bp, Artificial Sequence
  Synthetic oligonucleotide; TTT chr11 5344563 5344584 5344580 5344585 +
gagaaggttttaatattccttc

SEQ ID NO: 104295 - DNA, 22 bp, Artificial Sequence
  Synthetic oligonucleotide; TTG chr11 5344564 5344585 5344581 5344586 +
agaaggttttaatattccttct

SEQ ID NO: 104296 - DNA, 22 bp, Artificial Sequence
  Synthetic oligonucleotide; TTT chr11 5344573 5344594 5344590 5344595 +
taatattccttctgccactaga

SEQ ID NO: 104297 - DNA, 22 bp, Artificial Sequence
  Synthetic oligonucleotide; TTT chr11 5344574 5344595 5344591 5344596 +
aatattccttctgccactagac

SEQ ID NO: 104298 - DNA, 22 bp, Artificial Sequence
  Synthetic oligonucleotide; TTA chr11 5344575 5344596 5344592 5344597 +
atattccttctgccactagact

SEQ ID NO: 104299 - DNA, 22 bp, Artificial Sequence
  Synthetic oligonucleotide; TTC chr11 5344581 5344602 5344598 5344603 +
cttctgccactagactaggggc

SEQ ID NO: 104300 - DNA, 22 bp, Artificial Sequence
  Synthetic oligonucleotide; CTT chr11 5344584 5344605 5344601 5344606 +
ctgccactagactaggggcttc

SEQ ID NO: 104301 - DNA, 22 bp, Artificial Sequence
  Synthetic oligonucleotide; TTC chr11 5344585 5344606 5344602 5344607 +
tgccactagactaggggcttct

SEQ ID NO: 104302 - DNA, 22 bp, Artificial Sequence
  Synthetic oligonucleotide; CTG chr11 5344587 5344608 5344604 5344609 +
ccactagactaggggcttcttg

SEQ ID NO: 104303 - DNA, 22 bp, Artificial Sequence
  Synthetic oligonucleotide; CTA chr11 5344593 5344614 5344610 5344615 +
gactaggggcttcttgcatata

SEQ ID NO: 104304 - DNA, 22 bp, Artificial Sequence
  Synthetic oligonucleotide; CTA chr11 5344598 5344619 5344615 5344620 +
ggggcttcttgcatatagacat

SEQ ID NO: 104305 - DNA, 22 bp, Artificial Sequence
  Synthetic oligonucleotide; CTT chr11 5344605 5344626 5344622 5344627 +
cttgcatatagacatggtgttt

SEQ ID NO: 104306 - DNA, 22 bp, Artificial Sequence
  Synthetic oligonucleotide; TTC chr11 5344606 5344627 5344623 5344628 +
ttgcatatagacatggtgttta

SEQ ID NO: 104307 - DNA, 22 bp, Artificial Sequence
  Synthetic oligonucleotide; CTT chr11 5344608 5344629 5344625 5344630 +
gcatatagacatggtgtttatt

SEQ ID NO: 104308 - DNA, 22 bp, Artificial Sequence
  Synthetic oligonucleotide; TTG chr11 5344609 5344630 5344626 5344631 +
catatagacatggtgtttattt

SEQ ID NO: 104309 - DNA, 22 bp, Artificial Sequence
  Synthetic oligonucleotide; TTT chr11 5344627 5344648 5344644 5344649 +
atttgctttgctcaacaccttg

SEQ ID NO: 104310 - DNA, 22 bp, Artificial Sequence
  Synthetic oligonucleotide; TTA chr11 5344628 5344649 5344645 5344650 +
tttgctttgctcaacaccttgc

SEQ ID NO: 104311 - DNA, 22 bp, Artificial Sequence
  Synthetic oligonucleotide; TTT chr11 5344631 5344652 5344648 5344653 +
gctttgctcaacaccttgcaaa

SEQ ID NO: 104312 - DNA, 22 bp, Artificial Sequence
  Synthetic oligonucleotide; TTG chr11 5344632 5344653 5344649 5344654 +
ctttgctcaacaccttgcaaag

SEQ ID NO: 104313 - DNA, 22 bp, Artificial Sequence
  Synthetic oligonucleotide; CTT chr11 5344635 5344656 5344652 5344657 +
tgctcaacaccttgcaaagtat

SEQ ID NO: 104314 - DNA, 22 bp, Artificial Sequence
  Synthetic oligonucleotide; TTT chr11 5344636 5344657 5344653 5344658 +
gctcaacaccttgcaaagtatc

SEQ ID NO: 104315 - DNA, 22 bp, Artificial Sequence
  Synthetic oligonucleotide; TTG chr11 5344637 5344658 5344654 5344659 +
ctcaacaccttgcaaagtatct

SEQ ID NO: 104316 - DNA, 22 bp, Artificial Sequence
  Synthetic oligonucleotide; CTC chr11 5344640 5344661 5344657 5344662 +
aacaccttgcaaagtatctaac

SEQ ID NO: 104317 - DNA, 22 bp, Artificial Sequence
  Synthetic oligonucleotide; CTT chr11 5344648 5344669 5344665 5344670 +
gcaaagtatctaacatgtgact

SEQ ID NO: 104318 - DNA, 22 bp, Artificial Sequence
  Synthetic oligonucleotide; TTG chr11 5344649 5344670 5344666 5344671 +
caaagtatctaacatgtgactg

SEQ ID NO: 104319 - DNA, 22 bp, Artificial Sequence
  Synthetic oligonucleotide; CTA chr11 5344660 5344681 5344677 5344682 +
acatgtgactgataaacatttc

SEQ ID NO: 104320 - DNA, 22 bp, Artificial Sequence
  Synthetic oligonucleotide; CTG chr11 5344671 5344692 5344688 5344693 +
ataaacatttcttagttcacct

SEQ ID NO: 104321 - DNA, 22 bp, Artificial Sequence
  Synthetic oligonucleotide; TTT chr11 5344681 5344702 5344698 5344703 +
cttagttcacctaatatttgtg

SEQ ID NO: 104322 - DNA, 22 bp, Artificial Sequence
  Synthetic oligonucleotide; TTC chr11 5344682 5344703 5344699 5344704 +
ttagttcacctaatatttgtga

SEQ ID NO: 104323 - DNA, 22 bp, Artificial Sequence
  Synthetic oligonucleotide; CTT chr11 5344684 5344705 5344701 5344706 +
agttcacctaatatttgtgaac

SEQ ID NO: 104324 - DNA, 22 bp, Artificial Sequence
  Synthetic oligonucleotide; TTA chr11 5344685 5344706 5344702 5344707 +
gttcacctaatatttgtgaaca

SEQ ID NO: 104325 - DNA, 22 bp, Artificial Sequence
  Synthetic oligonucleotide; TTC chr11 5344689 5344710 5344706 5344711 +
acctaatatttgtgaacacgca

SEQ ID NO: 104326 - DNA, 22 bp, Artificial Sequence
  Synthetic oligonucleotide; CTA chr11 5344694 5344715 5344711 5344716 +
atatttgtgaacacgcatcatg

SEQ ID NO: 104327 - DNA, 22 bp, Artificial Sequence
  Synthetic oligonucleotide; TTT chr11 5344700 5344721 5344717 5344722 +
gtgaacacgcatcatgtgacag

SEQ ID NO: 104328 - DNA, 22 bp, Artificial Sequence
  Synthetic oligonucleotide; TTG chr11 5344701 5344722 5344718 5344723 +
tgaacacgcatcatgtgacagc

SEQ ID NO: 104329 - DNA, 22 bp, Artificial Sequence
  Synthetic oligonucleotide; TTT chr11 5344733 5344754 5344750 5344755 +
aaagctctctggaattaaatgg

SEQ ID NO: 104330 - DNA, 22 bp, Artificial Sequence
  Synthetic oligonucleotide; TTA chr11 5344734 5344755 5344751 5344756 +
aagctctctggaattaaatggt

SEQ ID NO: 104331 - DNA, 22 bp, Artificial Sequence
  Synthetic oligonucleotide; CTC chr11 5344740 5344761 5344757 5344762 +
tctggaattaaatggtaataag

SEQ ID NO: 104332 - DNA, 22 bp, Artificial Sequence
  Synthetic oligonucleotide; CTC chr11 5344742 5344763 5344759 5344764 +
tggaattaaatggtaataagac

SEQ ID NO: 104333 - DNA, 22 bp, Artificial Sequence
  Synthetic oligonucleotide; CTG chr11 5344744 5344765 5344761 5344766 +
gaattaaatggtaataagacaa

SEQ ID NO: 104334 - DNA, 22 bp, Artificial Sequence
  Synthetic oligonucleotide; TTA chr11 5344750 5344771 5344767 5344772 +
aatggtaataagacaaagtccc

SEQ ID NO: 104335 - DNA, 22 bp, Artificial Sequence
  Synthetic oligonucleotide; CTA chr11 5344774 5344795 5344791 5344796 +
atcttataaaccataaattaag

SEQ ID NO: 104336 - DNA, 22 bp, Artificial Sequence
  Synthetic oligonucleotide; CTT chr11 5344779 5344800 5344796 5344801 +
ataaaccataaattaagttgaa

SEQ ID NO: 104337 - DNA, 22 bp, Artificial Sequence
  Synthetic oligonucleotide; TTA chr11 5344780 5344801 5344797 5344802 +
taaaccataaattaagttgaaa

SEQ ID NO: 104338 - DNA, 22 bp, Artificial Sequence
  Synthetic oligonucleotide; TTA chr11 5344794 5344815 5344811 5344816 +
agttgaaaaataaataagacaa

SEQ ID NO: 104339 - DNA, 22 bp, Artificial Sequence
  Synthetic oligonucleotide; TTG chr11 5344799 5344820 5344816 5344821 +
aaaaataaataagacaatttta

SEQ ID NO: 104340 - DNA, 22 bp, Artificial Sequence
  Synthetic oligonucleotide; TTT chr11 5344819 5344840 5344836 5344841 +
taaacaaatataaatgcaagtt

SEQ ID NO: 104341 - DNA, 22 bp, Artificial Sequence
  Synthetic oligonucleotide; TTT chr11 5344820 5344841 5344837 5344842 +
aaacaaatataaatgcaagttt

SEQ ID NO: 104342 - DNA, 22 bp, Artificial Sequence
  Synthetic oligonucleotide; TTA chr11 5344821 5344842 5344838 5344843 +
aacaaatataaatgcaagttta

SEQ ID NO: 104343 - DNA, 22 bp, Artificial Sequence
  Synthetic oligonucleotide; TTT chr11 5344842 5344863 5344859 5344864 +
aacataaaacagtactacttga

SEQ ID NO: 104344 - DNA, 22 bp, Artificial Sequence
  Synthetic oligonucleotide; TTA chr11 5344843 5344864 5344860 5344865 +
acataaaacagtactacttgat

SEQ ID NO: 104345 - DNA, 22 bp, Artificial Sequence
  Synthetic oligonucleotide; CTA chr11 5344859 5344880 5344876 5344881 +
cttgatgtagattaattggatg

SEQ ID NO: 104346 - DNA, 22 bp, Artificial Sequence
  Synthetic oligonucleotide; CTT chr11 5344862 5344883 5344879 5344884 +
gatgtagattaattggatggta

SEQ ID NO: 104347 - DNA, 22 bp, Artificial Sequence
  Synthetic oligonucleotide; TTG chr11 5344863 5344884 5344880 5344885 +
atgtagattaattggatggtat

SEQ ID NO: 104348 - DNA, 22 bp, Artificial Sequence
  Synthetic oligonucleotide; TTA chr11 5344873 5344894 5344890 5344895 +
attggatggtattgtatacaag

SEQ ID NO: 104349 - DNA, 22 bp, Artificial Sequence
  Synthetic oligonucleotide; TTG chr11 5344877 5344898 5344894 5344899 +
gatggtattgtatacaagatag

SEQ ID NO: 104350 - DNA, 22 bp, Artificial Sequence
  Synthetic oligonucleotide; TTG chr11 5344887 5344908 5344904 5344909 +
tatacaagatagtatagcagtt

SEQ ID NO: 104351 - DNA, 22 bp, Artificial Sequence
  Synthetic oligonucleotide; TTT chr11 5344910 5344931 5344927 5344932 +
gaggggcctagaactgcaccta

SEQ ID NO: 104352 - DNA, 22 bp, Artificial Sequence
  Synthetic oligonucleotide; TTG chr11 5344911 5344932 5344928 5344933 +
aggggcctagaactgcacctat

SEQ ID NO: 104353 - DNA, 22 bp, Artificial Sequence
  Synthetic oligonucleotide; CTA chr11 5344920 5344941 5344937 5344942 +
gaactgcacctatgaggaggtc

SEQ ID NO: 104354 - DNA, 22 bp, Artificial Sequence
  Synthetic oligonucleotide; CTG chr11 5344926 5344947 5344943 5344948 +
cacctatgaggaggtcccattt

SEQ ID NO: 104355 - DNA, 22 bp, Artificial Sequence
  Synthetic oligonucleotide; CTA chr11 5344932 5344953 5344949 5344954 +
tgaggaggtcccatttgaactg

SEQ ID NO: 104356 - DNA, 22 bp, Artificial Sequence
  Synthetic oligonucleotide; TTT chr11 5344948 5344969 5344965 5344970 +
gaactgagacctcaatacaaaa

SEQ ID NO: 104357 - DNA, 22 bp, Artificial Sequence
  Synthetic oligonucleotide; TTG chr11 5344949 5344970 5344966 5344971 +
aactgagacctcaatacaaaag

SEQ ID NO: 104358 - DNA, 22 bp, Artificial Sequence
  Synthetic oligonucleotide; CTG chr11 5344954 5344975 5344971 5344976 +
agacctcaatacaaaagaaaac

SEQ ID NO: 104359 - DNA, 22 bp, Artificial Sequence
  Synthetic oligonucleotide; CTC chr11 5344961 5344982 5344978 5344983 +
aatacaaaagaaaacctgaccg

SEQ ID NO: 104360 - DNA, 22 bp, Artificial Sequence
  Synthetic oligonucleotide; CTG chr11 5344979 5345000 5344996 5345001 +
accgtatacagacctagaggaa

SEQ ID NO: 104361 - DNA, 22 bp, Artificial Sequence
  Synthetic oligonucleotide; CTA chr11 5344995 5345016 5345012 5345017 +
gaggaaaactgttccagaggga

SEQ ID NO: 104362 - DNA, 22 bp, Artificial Sequence
  Synthetic oligonucleotide; CTG chr11 5345006 5345027 5345023 5345028 +
ttccagagggaaaatcagcatg

SEQ ID NO: 104363 - DNA, 22 bp, Artificial Sequence
  Synthetic oligonucleotide; TTC chr11 5345009 5345030 5345026 5345031 +
cagagggaaaatcagcatgact

SEQ ID NO: 104364 - DNA, 22 bp, Artificial Sequence
  Synthetic oligonucleotide; CTG chr11 5345032 5345053 5345049 5345054 +
gcatttgataagaaaacaggag

SEQ ID NO: 104365 - DNA, 22 bp, Artificial Sequence
  Synthetic oligonucleotide; TTT chr11 5345038 5345059 5345055 5345060 +
gataagaaaacaggagagggac

SEQ ID NO: 104366 - DNA, 22 bp, Artificial Sequence
  Synthetic oligonucleotide; TTG chr11 5345039 5345060 5345056 5345061 +
ataagaaaacaggagagggaca

SEQ ID NO: 104367 - DNA, 22 bp, Artificial Sequence
  Synthetic oligonucleotide; CTT chr11 5345109 5345130 5345126 5345131 +
acagaccaccacggaatttttg

SEQ ID NO: 104368 - DNA, 22 bp, Artificial Sequence
  Synthetic oligonucleotide; TTA chr11 5345110 5345131 5345127 5345132 +
cagaccaccacggaatttttgt

SEQ ID NO: 104369 - DNA, 22 bp, Artificial Sequence
  Synthetic oligonucleotide; TTT chr11 5345128 5345149 5345145 5345150 +
ttgttttgttttgttttcttct

SEQ ID NO: 104370 - DNA, 22 bp, Artificial Sequence
  Synthetic oligonucleotide; TTT chr11 5345129 5345150 5345146 5345151 +
tgttttgttttgttttcttctt

SEQ ID NO: 104371 - DNA, 22 bp, Artificial Sequence
  Synthetic oligonucleotide; TTT chr11 5345130 5345151 5345147 5345152 +
gttttgttttgttttcttctta

SEQ ID NO: 104372 - DNA, 22 bp, Artificial Sequence
  Synthetic oligonucleotide; TTG chr11 5345131 5345152 5345148 5345153 +
ttttgttttgttttcttcttac

SEQ ID NO: 104373 - DNA, 22 bp, Artificial Sequence
  Synthetic oligonucleotide; TTT chr11 5345134 5345155 5345151 5345156 +
tgttttgttttcttcttactat

SEQ ID NO: 104374 - DNA, 22 bp, Artificial Sequence
  Synthetic oligonucleotide; TTT chr11 5345135 5345156 5345152 5345157 +
gttttgttttcttcttactata

SEQ ID NO: 104375 - DNA, 22 bp, Artificial Sequence
  Synthetic oligonucleotide; TTG chr11 5345136 5345157 5345153 5345158 +
ttttgttttcttcttactataa

SEQ ID NO: 104376 - DNA, 22 bp, Artificial Sequence
  Synthetic oligonucleotide; TTT chr11 5345139 5345160 5345156 5345161 +
tgttttcttcttactataaatg

SEQ ID NO: 104377 - DNA, 22 bp, Artificial Sequence
  Synthetic oligonucleotide; TTT chr11 5345140 5345161 5345157 5345162 +
gttttcttcttactataaatgt

SEQ ID NO: 104378 - DNA, 22 bp, Artificial Sequence
  Synthetic oligonucleotide; TTG chr11 5345141 5345162 5345158 5345163 +
ttttcttcttactataaatgta

SEQ ID NO: 104379 - DNA, 22 bp, Artificial Sequence
  Synthetic oligonucleotide; TTT chr11 5345144 5345165 5345161 5345166 +
tcttcttactataaatgtagta

SEQ ID NO: 104380 - DNA, 22 bp, Artificial Sequence
  Synthetic oligonucleotide; TTT chr11 5345145 5345166 5345162 5345167 +
cttcttactataaatgtagtaa

SEQ ID NO: 104381 - DNA, 22 bp, Artificial Sequence
  Synthetic oligonucleotide; TTC chr11 5345146 5345167 5345163 5345168 +
ttcttactataaatgtagtaaa

SEQ ID NO: 104382 - DNA, 22 bp, Artificial Sequence
  Synthetic oligonucleotide; CTT chr11 5345148 5345169 5345165 5345170 +
cttactataaatgtagtaaaga

SEQ ID NO: 104383 - DNA, 22 bp, Artificial Sequence
  Synthetic oligonucleotide; TTC chr11 5345149 5345170 5345166 5345171 +
ttactataaatgtagtaaagac

SEQ ID NO: 104384 - DNA, 22 bp, Artificial Sequence
  Synthetic oligonucleotide; CTT chr11 5345151 5345172 5345168 5345173 +
actataaatgtagtaaagacat

SEQ ID NO: 104385 - DNA, 22 bp, Artificial Sequence
  Synthetic oligonucleotide; TTA chr11 5345152 5345173 5345169 5345174 +
ctataaatgtagtaaagacatt

SEQ ID NO: 104386 - DNA, 22 bp, Artificial Sequence
  Synthetic oligonucleotide; CTA chr11 5345155 5345176 5345172 5345177 +
taaatgtagtaaagacattagg

SEQ ID NO: 104387 - DNA, 22 bp, Artificial Sequence
  Synthetic oligonucleotide; TTA chr11 5345175 5345196 5345192 5345197 +
ggacactttgaaaatcacaatg

SEQ ID NO: 104388 - DNA, 22 bp, Artificial Sequence
  Synthetic oligonucleotide; CTT chr11 5345183 5345204 5345200 5345205 +
tgaaaatcacaatggaaaatag

SEQ ID NO: 104389 - DNA, 22 bp, Artificial Sequence
  Synthetic oligonucleotide; TTT chr11 5345184 5345205 5345201 5345206 +
gaaaatcacaatggaaaatagt

SEQ ID NO: 104390 - DNA, 22 bp, Artificial Sequence
  Synthetic oligonucleotide; TTG chr11 5345185 5345206 5345202 5345207 +
aaaatcacaatggaaaatagtg

SEQ ID NO: 104391 - DNA, 22 bp, Artificial Sequence
  Synthetic oligonucleotide; TTC chr11 5345220 5345241 5345237 5345242 +
tgatttgtatttttaaattact

SEQ ID NO: 104392 - DNA, 22 bp, Artificial Sequence
  Synthetic oligonucleotide; CTG chr11 5345222 5345243 5345239 5345244 +
atttgtatttttaaattactca

SEQ ID NO: 104393 - DNA, 22 bp, Artificial Sequence
  Synthetic oligonucleotide; TTT chr11 5345226 5345247 5345243 5345248 +
gtatttttaaattactcactta

SEQ ID NO: 104394 - DNA, 22 bp, Artificial Sequence
  Synthetic oligonucleotide; TTG chr11 5345227 5345248 5345244 5345249 +
tatttttaaattactcacttag

SEQ ID NO: 104395 - DNA, 22 bp, Artificial Sequence
  Synthetic oligonucleotide; TTT chr11 5345232 5345253 5345249 5345254 +
ttaaattactcacttagactgc

SEQ ID NO: 104396 - DNA, 22 bp, Artificial Sequence
  Synthetic oligonucleotide; TTT chr11 5345233 5345254 5345250 5345255 +
taaattactcacttagactgct

SEQ ID NO: 104397 - DNA, 22 bp, Artificial Sequence
  Synthetic oligonucleotide; TTT chr11 5345234 5345255 5345251 5345256 +
aaattactcacttagactgcta

SEQ ID NO: 104398 - DNA, 22 bp, Artificial Sequence
  Synthetic oligonucleotide; TTA chr11 5345235 5345256 5345252 5345257 +
aattactcacttagactgctat

SEQ ID NO: 104399 - DNA, 22 bp, Artificial Sequence
  Synthetic oligonucleotide; TTA chr11 5345240 5345261 5345257 5345262 +
ctcacttagactgctatgtgaa

SEQ ID NO: 104400 - DNA, 22 bp, Artificial Sequence
  Synthetic oligonucleotide; CTC chr11 5345243 5345264 5345260 5345265 +
acttagactgctatgtgaagaa

SEQ ID NO: 104401 - DNA, 22 bp, Artificial Sequence
  Synthetic oligonucleotide; CTT chr11 5345247 5345268 5345264 5345269 +
agactgctatgtgaagaagact

SEQ ID NO: 104402 - DNA, 22 bp, Artificial Sequence
  Synthetic oligonucleotide; TTA chr11 5345248 5345269 5345265 5345270 +
gactgctatgtgaagaagacta

SEQ ID NO: 104403 - DNA, 22 bp, Artificial Sequence
  Synthetic oligonucleotide; CTG chr11 5345253 5345274 5345270 5345275 +
ctatgtgaagaagactaagcaa

SEQ ID NO: 104404 - DNA, 22 bp, Artificial Sequence
  Synthetic oligonucleotide; CTA chr11 5345256 5345277 5345273 5345278 +
tgtgaagaagactaagcaagag

SEQ ID NO: 104405 - DNA, 22 bp, Artificial Sequence
  Synthetic oligonucleotide; CTA chr11 5345270 5345291 5345287 5345292 +
agcaagagacaagaaaagagat

SEQ ID NO: 104406 - DNA, 22 bp, Artificial Sequence
  Synthetic oligonucleotide; TTA chr11 5345298 5345319 5345315 5345320 +
gaaagctattttaaaaatccat

SEQ ID NO: 104407 - DNA, 22 bp, Artificial Sequence
  Synthetic oligonucleotide; CTA chr11 5345306 5345327 5345323 5345328 +
ttttaaaaatccatatgaagag

SEQ ID NO: 104408 - DNA, 22 bp, Artificial Sequence
  Synthetic oligonucleotide; TTT chr11 5345309 5345330 5345326 5345331 +
taaaaatccatatgaagagtca

SEQ ID NO: 104409 - DNA, 22 bp, Artificial Sequence
  Synthetic oligonucleotide; TTT chr11 5345310 5345331 5345327 5345332 +
aaaaatccatatgaagagtcat

SEQ ID NO: 104410 - DNA, 22 bp, Artificial Sequence
  Synthetic oligonucleotide; TTA chr11 5345311 5345332 5345328 5345333 +
aaaatccatatgaagagtcatg

SEQ ID NO: 104411 - DNA, 22 bp, Artificial Sequence
  Synthetic oligonucleotide; CTT chr11 5345341 5345362 5345358 5345363 +
gactaggagagaagcaggggaa

SEQ ID NO: 104412 - DNA, 22 bp, Artificial Sequence
  Synthetic oligonucleotide; TTG chr11 5345342 5345363 5345359 5345364 +
actaggagagaagcaggggaaa

SEQ ID NO: 104413 - DNA, 22 bp, Artificial Sequence
  Synthetic oligonucleotide; CTA chr11 5345346 5345367 5345363 5345368 +
ggagagaagcaggggaaatgaa

SEQ ID NO: 104414 - DNA, 22 bp, Artificial Sequence
  Synthetic oligonucleotide; CTT chr11 5345392 5345413 5345409 5345414 +
aaacagagacagatgcattttt

SEQ ID NO: 104415 - DNA, 22 bp, Artificial Sequence
  Synthetic oligonucleotide; TTA chr11 5345393 5345414 5345410 5345415 +
aacagagacagatgcatttttg

SEQ ID NO: 104416 - DNA, 22 bp, Artificial Sequence
  Synthetic oligonucleotide; TTT chr11 5345412 5345433 5345429 5345434 +
ttgaagtagtgccaagatttgc

SEQ ID NO: 104417 - DNA, 22 bp, Artificial Sequence
  Synthetic oligonucleotide; TTT chr11 5345413 5345434 5345430 5345435 +
tgaagtagtgccaagatttgct

SEQ ID NO: 104418 - DNA, 22 bp, Artificial Sequence
  Synthetic oligonucleotide; TTT chr11 5345414 5345435 5345431 5345436 +
gaagtagtgccaagatttgctg

SEQ ID NO: 104419 - DNA, 22 bp, Artificial Sequence
  Synthetic oligonucleotide; TTG chr11 5345415 5345436 5345432 5345437 +
aagtagtgccaagatttgctga

SEQ ID NO: 104420 - DNA, 22 bp, Artificial Sequence
  Synthetic oligonucleotide; TTT chr11 5345432 5345453 5345449 5345454 +
gctgatatattaaaaatgggag

SEQ ID NO: 104421 - DNA, 22 bp, Artificial Sequence
  Synthetic oligonucleotide; TTG chr11 5345433 5345454 5345450 5345455 +
ctgatatattaaaaatgggagt

SEQ ID NO: 104422 - DNA, 22 bp, Artificial Sequence
  Synthetic oligonucleotide; CTG chr11 5345436 5345457 5345453 5345458 +
atatattaaaaatgggagtgag

SEQ ID NO: 104423 - DNA, 22 bp, Artificial Sequence
  Synthetic oligonucleotide; TTA chr11 5345444 5345465 5345461 5345466 +
aaaatgggagtgagggaaaaat

SEQ ID NO: 104424 - DNA, 22 bp, Artificial Sequence
  Synthetic oligonucleotide; TTT chr11 5345478 5345499 5345495 5345500 +
cccctagatttctgtttgaaca

SEQ ID NO: 104425 - DNA, 22 bp, Artificial Sequence
  Synthetic oligonucleotide; TTC chr11 5345479 5345500 5345496 5345501 +
ccctagatttctgtttgaacaa

SEQ ID NO: 104426 - DNA, 22 bp, Artificial Sequence
  Synthetic oligonucleotide; CTA chr11 5345484 5345505 5345501 5345506 +
gatttctgtttgaacaaatgaa

SEQ ID NO: 104427 - DNA, 22 bp, Artificial Sequence
  Synthetic oligonucleotide; TTT chr11 5345489 5345510 5345506 5345511 +
ctgtttgaacaaatgaaagaat

SEQ ID NO: 104428 - DNA, 22 bp, Artificial Sequence
  Synthetic oligonucleotide; TTC chr11 5345490 5345511 5345507 5345512 +
tgtttgaacaaatgaaagaatg

SEQ ID NO: 104429 - DNA, 22 bp, Artificial Sequence
  Synthetic oligonucleotide; CTG chr11 5345492 5345513 5345509 5345514 +
tttgaacaaatgaaagaatggt

SEQ ID NO: 104430 - DNA, 22 bp, Artificial Sequence
  Synthetic oligonucleotide; TTT chr11 5345495 5345516 5345512 5345517 +
gaacaaatgaaagaatggtgaa

SEQ ID NO: 104431 - DNA, 22 bp, Artificial Sequence
  Synthetic oligonucleotide; TTG chr11 5345496 5345517 5345513 5345518 +
aacaaatgaaagaatggtgaag

SEQ ID NO: 104432 - DNA, 22 bp, Artificial Sequence
  Synthetic oligonucleotide; TTT chr11 5345524 5345545 5345541 5345546 +
actcaaaatggaagtctgaggg

SEQ ID NO: 104433 - DNA, 22 bp, Artificial Sequence
  Synthetic oligonucleotide; TTA chr11 5345525 5345546 5345542 5345547 +
ctcaaaatggaagtctgagggg

SEQ ID NO: 104434 - DNA, 22 bp, Artificial Sequence
  Synthetic oligonucleotide; CTC chr11 5345528 5345549 5345545 5345550 +
aaaatggaagtctgagggggat

SEQ ID NO: 104435 - DNA, 22 bp, Artificial Sequence
  Synthetic oligonucleotide; CTG chr11 5345542 5345563 5345559 5345564 +
agggggatacatattcacttgt

SEQ ID NO: 104436 - DNA, 22 bp, Artificial Sequence
  Synthetic oligonucleotide; TTC chr11 5345558 5345579 5345575 5345580 +
acttgtgaggaaatcaagagtc

SEQ ID NO: 104437 - DNA, 22 bp, Artificial Sequence
  Synthetic oligonucleotide; CTT chr11 5345562 5345583 5345579 5345584 +
gtgaggaaatcaagagtcatta

SEQ ID NO: 104438 - DNA, 22 bp, Artificial Sequence
  Synthetic oligonucleotide; TTG chr11 5345563 5345584 5345580 5345585 +
tgaggaaatcaagagtcattag

SEQ ID NO: 104439 - DNA, 22 bp, Artificial Sequence
  Synthetic oligonucleotide; TTA chr11 5345584 5345605 5345601 5345606 +
gtaaatatagctgaattagagc

SEQ ID NO: 104440 - DNA, 22 bp, Artificial Sequence
  Synthetic oligonucleotide; CTG chr11 5345597 5345618 5345614 5345619 +
aattagagcaaatgcatccctt

SEQ ID NO: 104441 - DNA, 22 bp, Artificial Sequence
  Synthetic oligonucleotide; TTA chr11 5345602 5345623 5345619 5345624 +
gagcaaatgcatcccttgcttt

SEQ ID NO: 104442 - DNA, 22 bp, Artificial Sequence
  Synthetic oligonucleotide; CTT chr11 5345619 5345640 5345636 5345641 +
gcttttttttcttgtcacatgc

SEQ ID NO: 104443 - DNA, 22 bp, Artificial Sequence
  Synthetic oligonucleotide; TTG chr11 5345620 5345641 5345637 5345642 +
cttttttttcttgtcacatgcc

SEQ ID NO: 104444 - DNA, 22 bp, Artificial Sequence
  Synthetic oligonucleotide; CTT chr11 5345623 5345644 5345640 5345645 +
ttttttcttgtcacatgccaga

SEQ ID NO: 104445 - DNA, 22 bp, Artificial Sequence
  Synthetic oligonucleotide; TTT chr11 5345624 5345645 5345641 5345646 +
tttttcttgtcacatgccagaa

SEQ ID NO: 104446 - DNA, 22 bp, Artificial Sequence
  Synthetic oligonucleotide; TTT chr11 5345625 5345646 5345642 5345647 +
ttttcttgtcacatgccagaac

SEQ ID NO: 104447 - DNA, 22 bp, Artificial Sequence
  Synthetic oligonucleotide; TTT chr11 5345626 5345647 5345643 5345648 +
tttcttgtcacatgccagaaca

SEQ ID NO: 104448 - DNA, 22 bp, Artificial Sequence
  Synthetic oligonucleotide; TTT chr11 5345627 5345648 5345644 5345649 +
ttcttgtcacatgccagaacaa

SEQ ID NO: 104449 - DNA, 22 bp, Artificial Sequence
  Synthetic oligonucleotide; TTT chr11 5345628 5345649 5345645 5345650 +
tcttgtcacatgccagaacaac

SEQ ID NO: 104450 - DNA, 22 bp, Artificial Sequence
  Synthetic oligonucleotide; TTT chr11 5345629 5345650 5345646 5345651 +
cttgtcacatgccagaacaact

SEQ ID NO: 104451 - DNA, 22 bp, Artificial Sequence
  Synthetic oligonucleotide; TTC chr11 5345630 5345651 5345647 5345652 +
ttgtcacatgccagaacaactt

SEQ ID NO: 104452 - DNA, 22 bp, Artificial Sequence
  Synthetic oligonucleotide; CTT chr11 5345632 5345653 5345649 5345654 +
gtcacatgccagaacaacttct

SEQ ID NO: 104453 - DNA, 22 bp, Artificial Sequence
  Synthetic oligonucleotide; TTG chr11 5345633 5345654 5345650 5345655 +
tcacatgccagaacaacttctt

SEQ ID NO: 104454 - DNA, 22 bp, Artificial Sequence
  Synthetic oligonucleotide; CTT chr11 5345652 5345673 5345669 5345674 +
cttgaagttgtttttatcctaa

SEQ ID NO: 104455 - DNA, 22 bp, Artificial Sequence
  Synthetic oligonucleotide; TTC chr11 5345653 5345674 5345670 5345675 +
ttgaagttgtttttatcctaag

SEQ ID NO: 104456 - DNA, 22 bp, Artificial Sequence
  Synthetic oligonucleotide; CTT chr11 5345655 5345676 5345672 5345677 +
gaagttgtttttatcctaagtt

SEQ ID NO: 104457 - DNA, 22 bp, Artificial Sequence
  Synthetic oligonucleotide; TTG chr11 5345656 5345677 5345673 5345678 +
aagttgtttttatcctaagtta

SEQ ID NO: 104458 - DNA, 22 bp, Artificial Sequence
  Synthetic oligonucleotide; TTG chr11 5345662 5345683 5345679 5345684 +
tttttatcctaagttaaaaaga

SEQ ID NO: 104459 - DNA, 22 bp, Artificial Sequence
  Synthetic oligonucleotide; TTT chr11 5345665 5345686 5345682 5345687 +
ttatcctaagttaaaaagatgg

SEQ ID NO: 104460 - DNA, 22 bp, Artificial Sequence
  Synthetic oligonucleotide; TTT chr11 5345666 5345687 5345683 5345688 +
tatcctaagttaaaaagatggt

SEQ ID NO: 104461 - DNA, 22 bp, Artificial Sequence
  Synthetic oligonucleotide; TTT chr11 5345667 5345688 5345684 5345689 +
atcctaagttaaaaagatggtc

SEQ ID NO: 104462 - DNA, 22 bp, Artificial Sequence
  Synthetic oligonucleotide; TTA chr11 5345668 5345689 5345685 5345690 +
tcctaagttaaaaagatggtcg

SEQ ID NO: 104463 - DNA, 22 bp, Artificial Sequence
  Synthetic oligonucleotide; CTA chr11 5345673 5345694 5345690 5345695 +
agttaaaaagatggtcgtatcc

SEQ ID NO: 104464 - DNA, 22 bp, Artificial Sequence
  Synthetic oligonucleotide; TTA chr11 5345678 5345699 5345695 5345700 +
aaaagatggtcgtatccaaata

SEQ ID NO: 104465 - DNA, 22 bp, Artificial Sequence
  Synthetic oligonucleotide; CTT chr11 5345708 5345729 5345725 5345730 +
cagagttactttgtcagtgtaa

SEQ ID NO: 104466 - DNA, 22 bp, Artificial Sequence
  Synthetic oligonucleotide; TTC chr11 5345709 5345730 5345726 5345731 +
agagttactttgtcagtgtaag

SEQ ID NO: 104467 - DNA, 22 bp, Artificial Sequence
  Synthetic oligonucleotide; TTA chr11 5345716 5345737 5345733 5345738 +
ctttgtcagtgtaaggcactac

SEQ ID NO: 104468 - DNA, 22 bp, Artificial Sequence
  Synthetic oligonucleotide; CTT chr11 5345719 5345740 5345736 5345741 +
tgtcagtgtaaggcactaccct

SEQ ID NO: 104469 - DNA, 22 bp, Artificial Sequence
  Synthetic oligonucleotide; TTT chr11 5345720 5345741 5345737 5345742 +
gtcagtgtaaggcactacccta

SEQ ID NO: 104470 - DNA, 22 bp, Artificial Sequence
  Synthetic oligonucleotide; TTG chr11 5345721 5345742 5345738 5345743 +
tcagtgtaaggcactaccctaa

SEQ ID NO: 104471 - DNA, 22 bp, Artificial Sequence
  Synthetic oligonucleotide; CTA chr11 5345737 5345758 5345754 5345759 +
ccctaaagatgccaccaaagga

SEQ ID NO: 104472 - DNA, 22 bp, Artificial Sequence
  Synthetic oligonucleotide; CTA chr11 5345742 5345763 5345759 5345764 +
aagatgccaccaaaggaaacga

SEQ ID NO: 104473 - DNA, 22 bp, Artificial Sequence
  Synthetic oligonucleotide; CTC chr11 5345769 5345790 5345786 5345791 +
ttaccttccacccatagagatg

SEQ ID NO: 104474 - DNA, 22 bp, Artificial Sequence
  Synthetic oligonucleotide; CTT chr11 5345771 5345792 5345788 5345793 +
accttccacccatagagatgag

SEQ ID NO: 104475 - DNA, 22 bp, Artificial Sequence
  Synthetic oligonucleotide; TTA chr11 5345772 5345793 5345789 5345794 +
ccttccacccatagagatgaga

SEQ ID NO: 104476 - DNA, 22 bp, Artificial Sequence
  Synthetic oligonucleotide; CTT chr11 5345776 5345797 5345793 5345798 +
ccacccatagagatgagatcta

SEQ ID NO: 104477 - DNA, 22 bp, Artificial Sequence
  Synthetic oligonucleotide; TTC chr11 5345777 5345798 5345794 5345799 +
cacccatagagatgagatctaa

SEQ ID NO: 104478 - DNA, 22 bp, Artificial Sequence
  Synthetic oligonucleotide; CTA chr11 5345798 5345819 5345815 5345820 +
actgtaatagtttcagtgaaga

SEQ ID NO: 104479 - DNA, 22 bp, Artificial Sequence
  Synthetic oligonucleotide; CTG chr11 5345802 5345823 5345819 5345824 +
taatagtttcagtgaagagatg

SEQ ID NO: 104480 - DNA, 22 bp, Artificial Sequence
  Synthetic oligonucleotide; TTT chr11 5345811 5345832 5345828 5345833 +
cagtgaagagatgccagacaac

SEQ ID NO: 104481 - DNA, 22 bp, Artificial Sequence
  Synthetic oligonucleotide; TTC chr11 5345812 5345833 5345829 5345834 +
agtgaagagatgccagacaact

SEQ ID NO: 104482 - DNA, 22 bp, Artificial Sequence
  Synthetic oligonucleotide; CTG chr11 5345835 5345856 5345852 5345857 +
ggcgtgaggcaacaactcagca

SEQ ID NO: 104483 - DNA, 22 bp, Artificial Sequence
  Synthetic oligonucleotide; CTC chr11 5345853 5345874 5345870 5345875 +
agcactttgaaagaatcatttt

SEQ ID NO: 104484 - DNA, 22 bp, Artificial Sequence
  Synthetic oligonucleotide; CTT chr11 5345860 5345881 5345877 5345882 +
tgaaagaatcatttttcagcat

SEQ ID NO: 104485 - DNA, 22 bp, Artificial Sequence
  Synthetic oligonucleotide; TTT chr11 5345861 5345882 5345878 5345883 +
gaaagaatcatttttcagcatc

SEQ ID NO: 104486 - DNA, 22 bp, Artificial Sequence
  Synthetic oligonucleotide; TTG chr11 5345862 5345883 5345879 5345884 +
aaagaatcatttttcagcatcc

SEQ ID NO: 104487 - DNA, 22 bp, Artificial Sequence
  Synthetic oligonucleotide; TTT chr11 5345874 5345895 5345891 5345896 +
ttcagcatccatattctgtcct

SEQ ID NO: 104488 - DNA, 22 bp, Artificial Sequence
  Synthetic oligonucleotide; TTT chr11 5345875 5345896 5345892 5345897 +
tcagcatccatattctgtccta

SEQ ID NO: 104489 - DNA, 22 bp, Artificial Sequence
  Synthetic oligonucleotide; TTT chr11 5345876 5345897 5345893 5345898 +
cagcatccatattctgtcctag

SEQ ID NO: 104490 - DNA, 22 bp, Artificial Sequence
  Synthetic oligonucleotide; TTC chr11 5345877 5345898 5345894 5345899 +
agcatccatattctgtcctagg

SEQ ID NO: 104491 - DNA, 22 bp, Artificial Sequence
  Synthetic oligonucleotide; TTC chr11 5345890 5345911 5345907 5345912 +
tgtcctaggactgagagacata

SEQ ID NO: 104492 - DNA, 22 bp, Artificial Sequence
  Synthetic oligonucleotide; CTG chr11 5345892 5345913 5345909 5345914 +
tcctaggactgagagacataaa

SEQ ID NO: 104493 - DNA, 22 bp, Artificial Sequence
  Synthetic oligonucleotide; CTA chr11 5345897 5345918 5345914 5345919 +
ggactgagagacataaaccaga

SEQ ID NO: 104494 - DNA, 22 bp, Artificial Sequence
  Synthetic oligonucleotide; CTG chr11 5345903 5345924 5345920 5345925 +
agagacataaaccagaattcag

SEQ ID NO: 104495 - DNA, 22 bp, Artificial Sequence
  Synthetic oligonucleotide; TTC chr11 5345923 5345944 5345940 5345945 +
agtgcctactgaacatacaatg

SEQ ID NO: 104496 - DNA, 22 bp, Artificial Sequence
  Synthetic oligonucleotide; CTA chr11 5345931 5345952 5345948 5345953 +
ctgaacatacaatgagtgatgt

SEQ ID NO: 104497 - DNA, 22 bp, Artificial Sequence
  Synthetic oligonucleotide; CTG chr11 5345934 5345955 5345951 5345956 +
aacatacaatgagtgatgtata

SEQ ID NO: 104498 - DNA, 22 bp, Artificial Sequence
  Synthetic oligonucleotide; TTC chr11 5345959 5345980 5345976 5345981 +
ttcagttactagacgcaaagat

SEQ ID NO: 104499 - DNA, 22 bp, Artificial Sequence
  Synthetic oligonucleotide; CTT chr11 5345961 5345982 5345978 5345983 +
cagttactagacgcaaagataa

SEQ ID NO: 104500 - DNA, 22 bp, Artificial Sequence
  Synthetic oligonucleotide; TTC chr11 5345962 5345983 5345979 5345984 +
agttactagacgcaaagataat

SEQ ID NO: 104501 - DNA, 22 bp, Artificial Sequence
  Synthetic oligonucleotide; TTA chr11 5345967 5345988 5345984 5345989 +
ctagacgcaaagataatccagc

SEQ ID NO: 104502 - DNA, 22 bp, Artificial Sequence
  Synthetic oligonucleotide; CTA chr11 5345970 5345991 5345987 5345992 +
gacgcaaagataatccagctta

SEQ ID NO: 104503 - DNA, 22 bp, Artificial Sequence
  Synthetic oligonucleotide; CTT chr11 5345991 5346012 5346008 5346013 +
agctcctccccttctgtgttct

SEQ ID NO: 104504 - DNA, 22 bp, Artificial Sequence
  Synthetic oligonucleotide; TTA chr11 5345992 5346013 5346009 5346014 +
gctcctccccttctgtgttcta

SEQ ID NO: 104505 - DNA, 22 bp, Artificial Sequence
  Synthetic oligonucleotide; CTC chr11 5345996 5346017 5346013 5346018 +
ctccccttctgtgttctatgta

SEQ ID NO: 104506 - DNA, 22 bp, Artificial Sequence
  Synthetic oligonucleotide; CTC chr11 5345999 5346020 5346016 5346021 +
cccttctgtgttctatgtactt

SEQ ID NO: 104507 - DNA, 22 bp, Artificial Sequence
  Synthetic oligonucleotide; CTT chr11 5346004 5346025 5346021 5346026 +
ctgtgttctatgtacttcattt

SEQ ID NO: 104508 - DNA, 22 bp, Artificial Sequence
  Synthetic oligonucleotide; TTC chr11 5346005 5346026 5346022 5346027 +
tgtgttctatgtacttcatttc

SEQ ID NO: 104509 - DNA, 22 bp, Artificial Sequence
  Synthetic oligonucleotide; CTG chr11 5346007 5346028 5346024 5346029 +
tgttctatgtacttcatttctc

SEQ ID NO: 104510 - DNA, 22 bp, Artificial Sequence
  Synthetic oligonucleotide; TTC chr11 5346012 5346033 5346029 5346034 +
tatgtacttcatttctctgtca

SEQ ID NO: 104511 - DNA, 22 bp, Artificial Sequence
  Synthetic oligonucleotide; CTA chr11 5346014 5346035 5346031 5346036 +
tgtacttcatttctctgtcaac

SEQ ID NO: 104512 - DNA, 22 bp, Artificial Sequence
  Synthetic oligonucleotide; CTT chr11 5346021 5346042 5346038 5346043 +
catttctctgtcaacactctta

SEQ ID NO: 104513 - DNA, 22 bp, Artificial Sequence
  Synthetic oligonucleotide; TTC chr11 5346022 5346043 5346039 5346044 +
atttctctgtcaacactcttac

SEQ ID NO: 104514 - DNA, 22 bp, Artificial Sequence
  Synthetic oligonucleotide; TTT chr11 5346026 5346047 5346043 5346048 +
ctctgtcaacactcttacttct

SEQ ID NO: 104515 - DNA, 22 bp, Artificial Sequence
  Synthetic oligonucleotide; TTC chr11 5346027 5346048 5346044 5346049 +
tctgtcaacactcttacttctc

SEQ ID NO: 104516 - DNA, 22 bp, Artificial Sequence
  Synthetic oligonucleotide; CTC chr11 5346029 5346050 5346046 5346051 +
tgtcaacactcttacttctctg

SEQ ID NO: 104517 - DNA, 22 bp, Artificial Sequence
  Synthetic oligonucleotide; CTG chr11 5346031 5346052 5346048 5346053 +
tcaacactcttacttctctgac

SEQ ID NO: 104518 - DNA, 22 bp, Artificial Sequence
  Synthetic oligonucleotide; CTC chr11 5346040 5346061 5346057 5346062 +
ttacttctctgacgtttcagca

SEQ ID NO: 104519 - DNA, 22 bp, Artificial Sequence
  Synthetic oligonucleotide; CTT chr11 5346042 5346063 5346059 5346064 +
acttctctgacgtttcagcaat

SEQ ID NO: 104520 - DNA, 22 bp, Artificial Sequence
  Synthetic oligonucleotide; TTA chr11 5346043 5346064 5346060 5346065 +
cttctctgacgtttcagcaata

SEQ ID NO: 104521 - DNA, 22 bp, Artificial Sequence
  Synthetic oligonucleotide; CTT chr11 5346046 5346067 5346063 5346068 +
ctctgacgtttcagcaataatc

SEQ ID NO: 104522 - DNA, 22 bp, Artificial Sequence
  Synthetic oligonucleotide; TTC chr11 5346047 5346068 5346064 5346069 +
tctgacgtttcagcaataatct

SEQ ID NO: 104523 - DNA, 22 bp, Artificial Sequence
  Synthetic oligonucleotide; CTC chr11 5346049 5346070 5346066 5346071 +
tgacgtttcagcaataatctcc

SEQ ID NO: 104524 - DNA, 22 bp, Artificial Sequence
  Synthetic oligonucleotide; CTG chr11 5346051 5346072 5346068 5346073 +
acgtttcagcaataatctcctt

SEQ ID NO: 104525 - DNA, 22 bp, Artificial Sequence
  Synthetic oligonucleotide; TTT chr11 5346057 5346078 5346074 5346079 +
cagcaataatctcctttaacct

SEQ ID NO: 104526 - DNA, 22 bp, Artificial Sequence
  Synthetic oligonucleotide; TTC chr11 5346058 5346079 5346075 5346080 +
agcaataatctcctttaaccta

SEQ ID NO: 104527 - DNA, 22 bp, Artificial Sequence
  Synthetic oligonucleotide; CTC chr11 5346070 5346091 5346087 5346092 +
ctttaacctaatctttcactgt

SEQ ID NO: 104528 - DNA, 22 bp, Artificial Sequence
  Synthetic oligonucleotide; CTT chr11 5346073 5346094 5346090 5346095 +
taacctaatctttcactgtatc

SEQ ID NO: 104529 - DNA, 22 bp, Artificial Sequence
  Synthetic oligonucleotide; TTT chr11 5346074 5346095 5346091 5346096 +
aacctaatctttcactgtatct

SEQ ID NO: 104530 - DNA, 22 bp, Artificial Sequence
  Synthetic oligonucleotide; TTA chr11 5346075 5346096 5346092 5346097 +
acctaatctttcactgtatctc

SEQ ID NO: 104531 - DNA, 22 bp, Artificial Sequence
  Synthetic oligonucleotide; CTA chr11 5346080 5346101 5346097 5346102 +
atctttcactgtatctcaactt

SEQ ID NO: 104532 - DNA, 22 bp, Artificial Sequence
  Synthetic oligonucleotide; CTT chr11 5346085 5346106 5346102 5346107 +
tcactgtatctcaactttgtga

SEQ ID NO: 104533 - DNA, 22 bp, Artificial Sequence
  Synthetic oligonucleotide; TTT chr11 5346086 5346107 5346103 5346108 +
cactgtatctcaactttgtgaa

SEQ ID NO: 104534 - DNA, 22 bp, Artificial Sequence
  Synthetic oligonucleotide; TTC chr11 5346087 5346108 5346104 5346109 +
actgtatctcaactttgtgaaa

SEQ ID NO: 104535 - DNA, 22 bp, Artificial Sequence
  Synthetic oligonucleotide; CTG chr11 5346091 5346112 5346108 5346113 +
tatctcaactttgtgaaaaatt

SEQ ID NO: 104536 - DNA, 22 bp, Artificial Sequence
  Synthetic oligonucleotide; CTC chr11 5346097 5346118 5346114 5346119 +
aactttgtgaaaaattccttct

SEQ ID NO: 104537 - DNA, 22 bp, Artificial Sequence
  Synthetic oligonucleotide; CTT chr11 5346102 5346123 5346119 5346124 +
tgtgaaaaattccttcttatca

SEQ ID NO: 104538 - DNA, 22 bp, Artificial Sequence
  Synthetic oligonucleotide; TTT chr11 5346103 5346124 5346120 5346125 +
gtgaaaaattccttcttatcag

SEQ ID NO: 104539 - DNA, 22 bp, Artificial Sequence
  Synthetic oligonucleotide; TTG chr11 5346104 5346125 5346121 5346126 +
tgaaaaattccttcttatcaga

SEQ ID NO: 104540 - DNA, 22 bp, Artificial Sequence
  Synthetic oligonucleotide; TTC chr11 5346114 5346135 5346131 5346136 +
cttcttatcagagaatatgcag

SEQ ID NO: 104541 - DNA, 22 bp, Artificial Sequence
  Synthetic oligonucleotide; CTT chr11 5346117 5346138 5346134 5346139 +
cttatcagagaatatgcagcac

SEQ ID NO: 104542 - DNA, 22 bp, Artificial Sequence
  Synthetic oligonucleotide; TTC chr11 5346118 5346139 5346135 5346140 +
ttatcagagaatatgcagcaca

SEQ ID NO: 104543 - DNA, 22 bp, Artificial Sequence
  Synthetic oligonucleotide; CTT chr11 5346120 5346141 5346137 5346142 +
atcagagaatatgcagcacaag

SEQ ID NO: 104544 - DNA, 22 bp, Artificial Sequence
  Synthetic oligonucleotide; TTA chr11 5346121 5346142 5346138 5346143 +
tcagagaatatgcagcacaagt

SEQ ID NO: 104545 - DNA, 22 bp, Artificial Sequence
  Synthetic oligonucleotide; CTA chr11 5346155 5346176 5346172 5346177 +
cagggaaagctaaccaaactgt

SEQ ID NO: 104546 - DNA, 22 bp, Artificial Sequence
  Synthetic oligonucleotide; CTA chr11 5346167 5346188 5346184 5346189 +
accaaactgtaaggcaatgatt

SEQ ID NO: 104547 - DNA, 22 bp, Artificial Sequence
  Synthetic oligonucleotide; CTG chr11 5346176 5346197 5346193 5346198 +
taaggcaatgattgtattttgc

SEQ ID NO: 104548 - DNA, 22 bp, Artificial Sequence
  Synthetic oligonucleotide; TTG chr11 5346190 5346211 5346207 5346212 +
tattttgccaataataacctgc

SEQ ID NO: 104549 - DNA, 22 bp, Artificial Sequence
  Synthetic oligonucleotide; TTT chr11 5346195 5346216 5346212 5346217 +
tgccaataataacctgcaactt

SEQ ID NO: 104550 - DNA, 22 bp, Artificial Sequence
  Synthetic oligonucleotide; TTT chr11 5346196 5346217 5346213 5346218 +
gccaataataacctgcaactta

SEQ ID NO: 104551 - DNA, 22 bp, Artificial Sequence
  Synthetic oligonucleotide; TTG chr11 5346197 5346218 5346214 5346219 +
ccaataataacctgcaacttaa

SEQ ID NO: 104552 - DNA, 22 bp, Artificial Sequence
  Synthetic oligonucleotide; CTG chr11 5346211 5346232 5346228 5346233 +
caacttaaagtttcctccttct

SEQ ID NO: 104553 - DNA, 22 bp, Artificial Sequence
  Synthetic oligonucleotide; CTT chr11 5346217 5346238 5346234 5346239 +
aaagtttcctccttctccattc

SEQ ID NO: 104554 - DNA, 22 bp, Artificial Sequence
  Synthetic oligonucleotide; TTA chr11 5346218 5346239 5346235 5346240 +
aagtttcctccttctccattcc

SEQ ID NO: 104555 - DNA, 22 bp, Artificial Sequence
  Synthetic oligonucleotide; TTT chr11 5346224 5346245 5346241 5346246 +
cctccttctccattcccaagaa

SEQ ID NO: 104556 - DNA, 22 bp, Artificial Sequence
  Synthetic oligonucleotide; TTC chr11 5346225 5346246 5346242 5346247 +
ctccttctccattcccaagaat

SEQ ID NO: 104557 - DNA, 22 bp, Artificial Sequence
  Synthetic oligonucleotide; CTC chr11 5346228 5346249 5346245 5346250 +
cttctccattcccaagaattcc

SEQ ID NO: 104558 - DNA, 22 bp, Artificial Sequence
  Synthetic oligonucleotide; CTT chr11 5346231 5346252 5346248 5346253 +
ctccattcccaagaattccatg

SEQ ID NO: 104559 - DNA, 22 bp, Artificial Sequence
  Synthetic oligonucleotide; TTC chr11 5346232 5346253 5346249 5346254 +
tccattcccaagaattccatgc

SEQ ID NO: 104560 - DNA, 22 bp, Artificial Sequence
  Synthetic oligonucleotide; CTC chr11 5346234 5346255 5346251 5346256 +
cattcccaagaattccatgcag

SEQ ID NO: 104561 - DNA, 22 bp, Artificial Sequence
  Synthetic oligonucleotide; TTC chr11 5346239 5346260 5346256 5346261 +
ccaagaattccatgcagacata

SEQ ID NO: 104562 - DNA, 22 bp, Artificial Sequence
  Synthetic oligonucleotide; TTC chr11 5346249 5346270 5346266 5346271 +
catgcagacatacctggtaatg

SEQ ID NO: 104563 - DNA, 22 bp, Artificial Sequence
  Synthetic oligonucleotide; CTG chr11 5346265 5346286 5346282 5346287 +
gtaatgcagctataatagtgat

SEQ ID NO: 104564 - DNA, 22 bp, Artificial Sequence
  Synthetic oligonucleotide; CTA chr11 5346277 5346298 5346294 5346299 +
taatagtgatctatggaatcac

SEQ ID NO: 104565 - DNA, 22 bp, Artificial Sequence
  Synthetic oligonucleotide; CTA chr11 5346290 5346311 5346307 5346312 +
tggaatcactctactttgtttt

SEQ ID NO: 104566 - DNA, 22 bp, Artificial Sequence
  Synthetic oligonucleotide; CTC chr11 5346301 5346322 5346318 5346323 +
tactttgttttgtgaaaattct

SEQ ID NO: 104567 - DNA, 22 bp, Artificial Sequence
  Synthetic oligonucleotide; CTA chr11 5346303 5346324 5346320 5346325 +
ctttgttttgtgaaaattcttg

SEQ ID NO: 104568 - DNA, 22 bp, Artificial Sequence
  Synthetic oligonucleotide; CTT chr11 5346306 5346327 5346323 5346328 +
tgttttgtgaaaattcttgtgt

SEQ ID NO: 104569 - DNA, 22 bp, Artificial Sequence
  Synthetic oligonucleotide; TTT chr11 5346307 5346328 5346324 5346329 +
gttttgtgaaaattcttgtgtc

SEQ ID NO: 104570 - DNA, 22 bp, Artificial Sequence
  Synthetic oligonucleotide; TTG chr11 5346308 5346329 5346325 5346330 +
ttttgtgaaaattcttgtgtcc

SEQ ID NO: 104571 - DNA, 22 bp, Artificial Sequence
  Synthetic oligonucleotide; TTT chr11 5346311 5346332 5346328 5346333 +
tgtgaaaattcttgtgtcctca

SEQ ID NO: 104572 - DNA, 22 bp, Artificial Sequence
  Synthetic oligonucleotide; TTT chr11 5346312 5346333 5346329 5346334 +
gtgaaaattcttgtgtcctcag

SEQ ID NO: 104573 - DNA, 22 bp, Artificial Sequence
  Synthetic oligonucleotide; TTG chr11 5346313 5346334 5346330 5346335 +
tgaaaattcttgtgtcctcagc

SEQ ID NO: 104574 - DNA, 22 bp, Artificial Sequence
  Synthetic oligonucleotide; TTC chr11 5346322 5346343 5346339 5346344 +
ttgtgtcctcagctagtcgtgg

SEQ ID NO: 104575 - DNA, 22 bp, Artificial Sequence
  Synthetic oligonucleotide; CTT chr11 5346324 5346345 5346341 5346346 +
gtgtcctcagctagtcgtggct

SEQ ID NO: 104576 - DNA, 22 bp, Artificial Sequence
  Synthetic oligonucleotide; TTG chr11 5346325 5346346 5346342 5346347 +
tgtcctcagctagtcgtggctc

SEQ ID NO: 104577 - DNA, 22 bp, Artificial Sequence
  Synthetic oligonucleotide; CTC chr11 5346332 5346353 5346349 5346354 +
agctagtcgtggctcttggttt

SEQ ID NO: 104578 - DNA, 22 bp, Artificial Sequence
  Synthetic oligonucleotide; CTA chr11 5346337 5346358 5346354 5346359 +
gtcgtggctcttggtttctgag

SEQ ID NO: 104579 - DNA, 22 bp, Artificial Sequence
  Synthetic oligonucleotide; CTC chr11 5346347 5346368 5346364 5346369 +
ttggtttctgagaagaaagaca

SEQ ID NO: 104580 - DNA, 22 bp, Artificial Sequence
  Synthetic oligonucleotide; CTT chr11 5346349 5346370 5346366 5346371 +
ggtttctgagaagaaagacaat

SEQ ID NO: 104581 - DNA, 22 bp, Artificial Sequence
  Synthetic oligonucleotide; TTG chr11 5346350 5346371 5346367 5346372 +
gtttctgagaagaaagacaatg

SEQ ID NO: 104582 - DNA, 22 bp, Artificial Sequence
  Synthetic oligonucleotide; TTT chr11 5346354 5346375 5346371 5346376 +
ctgagaagaaagacaatgagag

SEQ ID NO: 104583 - DNA, 22 bp, Artificial Sequence
  Synthetic oligonucleotide; TTC chr11 5346355 5346376 5346372 5346377 +
tgagaagaaagacaatgagaga

SEQ ID NO: 104584 - DNA, 22 bp, Artificial Sequence
  Synthetic oligonucleotide; CTG chr11 5346357 5346378 5346374 5346379 +
agaagaaagacaatgagagaag

SEQ ID NO: 104585 - DNA, 22 bp, Artificial Sequence
  Synthetic oligonucleotide; CTG chr11 5346391 5346412 5346408 5346413 +
aggaaaaaaaatatagggaagg

SEQ ID NO: 104586 - DNA, 22 bp, Artificial Sequence
  Synthetic oligonucleotide; CTG chr11 5346432 5346453 5346449 5346454 +
aggatagaagcaagaagattct

SEQ ID NO: 104587 - DNA, 22 bp, Artificial Sequence
  Synthetic oligonucleotide; TTC chr11 5346453 5346474 5346470 5346475 +
tataatggaacacctagaaaat

SEQ ID NO: 104588 - DNA, 22 bp, Artificial Sequence
  Synthetic oligonucleotide; CTA chr11 5346455 5346476 5346472 5346477 +
taatggaacacctagaaaatca

SEQ ID NO: 104589 - DNA, 22 bp, Artificial Sequence
  Synthetic oligonucleotide; CTA chr11 5346469 5346490 5346486 5346491 +
gaaaatcagataaacttctaac

SEQ ID NO: 104590 - DNA, 22 bp, Artificial Sequence
  Synthetic oligonucleotide; CTT chr11 5346486 5346507 5346503 5346508 +
ctaacatttacagccataattt

SEQ ID NO: 104591 - DNA, 22 bp, Artificial Sequence
  Synthetic oligonucleotide; TTC chr11 5346487 5346508 5346504 5346509 +
taacatttacagccataatttt

SEQ ID NO: 104592 - DNA, 22 bp, Artificial Sequence
  Synthetic oligonucleotide; CTA chr11 5346489 5346510 5346506 5346511 +
acatttacagccataatttttc

SEQ ID NO: 104593 - DNA, 22 bp, Artificial Sequence
  Synthetic oligonucleotide; TTT chr11 5346495 5346516 5346512 5346517 +
acagccataatttttctctgct

SEQ ID NO: 104594 - DNA, 22 bp, Artificial Sequence
  Synthetic oligonucleotide; TTA chr11 5346496 5346517 5346513 5346518 +
cagccataatttttctctgctt

SEQ ID NO: 104595 - DNA, 22 bp, Artificial Sequence
  Synthetic oligonucleotide; TTT chr11 5346508 5346529 5346525 5346530 +
ttctctgctttgtttaaaaagt

SEQ ID NO: 104596 - DNA, 22 bp, Artificial Sequence
  Synthetic oligonucleotide; TTT chr11 5346509 5346530 5346526 5346531 +
tctctgctttgtttaaaaagta

SEQ ID NO: 104597 - DNA, 22 bp, Artificial Sequence
  Synthetic oligonucleotide; TTT chr11 5346510 5346531 5346527 5346532 +
ctctgctttgtttaaaaagtaa

SEQ ID NO: 104598 - DNA, 22 bp, Artificial Sequence
  Synthetic oligonucleotide; TTC chr11 5346511 5346532 5346528 5346533 +
tctgctttgtttaaaaagtaaa

SEQ ID NO: 104599 - DNA, 22 bp, Artificial Sequence
  Synthetic oligonucleotide; CTC chr11 5346513 5346534 5346530 5346535 +
tgctttgtttaaaaagtaaaat

SEQ ID NO: 104600 - DNA, 22 bp, Artificial Sequence
  Synthetic oligonucleotide; CTG chr11 5346515 5346536 5346532 5346537 +
ctttgtttaaaaagtaaaatgt

SEQ ID NO: 104601 - DNA, 22 bp, Artificial Sequence
  Synthetic oligonucleotide; CTT chr11 5346518 5346539 5346535 5346540 +
tgtttaaaaagtaaaatgtagt

SEQ ID NO: 104602 - DNA, 22 bp, Artificial Sequence
  Synthetic oligonucleotide; TTT chr11 5346519 5346540 5346536 5346541 +
gtttaaaaagtaaaatgtagta

SEQ ID NO: 104603 - DNA, 22 bp, Artificial Sequence
  Synthetic oligonucleotide; TTG chr11 5346520 5346541 5346537 5346542 +
tttaaaaagtaaaatgtagtag

SEQ ID NO: 104604 - DNA, 22 bp, Artificial Sequence
  Synthetic oligonucleotide; TTT chr11 5346523 5346544 5346540 5346545 +
aaaaagtaaaatgtagtagaat

SEQ ID NO: 104605 - DNA, 22 bp, Artificial Sequence
  Synthetic oligonucleotide; TTA chr11 5346524 5346545 5346541 5346546 +
aaaagtaaaatgtagtagaata

SEQ ID NO: 104606 - DNA, 22 bp, Artificial Sequence
  Synthetic oligonucleotide; CTT chr11 5346557 5346578 5346574 5346579 +
cctgttcatcttttagaaagga

SEQ ID NO: 104607 - DNA, 22 bp, Artificial Sequence
  Synthetic oligonucleotide; TTC chr11 5346558 5346579 5346575 5346580 +
ctgttcatcttttagaaaggaa

SEQ ID NO: 104608 - DNA, 22 bp, Artificial Sequence
  Synthetic oligonucleotide; CTG chr11 5346561 5346582 5346578 5346583 +
ttcatcttttagaaaggaaaga

SEQ ID NO: 104609 - DNA, 22 bp, Artificial Sequence
  Synthetic oligonucleotide; TTC chr11 5346564 5346585 5346581 5346586 +
atcttttagaaaggaaagaaga

SEQ ID NO: 104610 - DNA, 22 bp, Artificial Sequence
  Synthetic oligonucleotide; CTT chr11 5346569 5346590 5346586 5346591 +
ttagaaaggaaagaagacatat

SEQ ID NO: 104611 - DNA, 22 bp, Artificial Sequence
  Synthetic oligonucleotide; TTT chr11 5346570 5346591 5346587 5346592 +
tagaaaggaaagaagacatatg

SEQ ID NO: 104612 - DNA, 22 bp, Artificial Sequence
  Synthetic oligonucleotide; TTT chr11 5346571 5346592 5346588 5346593 +
agaaaggaaagaagacatatga

SEQ ID NO: 104613 - DNA, 22 bp, Artificial Sequence
  Synthetic oligonucleotide; TTA chr11 5346572 5346593 5346589 5346594 +
gaaaggaaagaagacatatgag

SEQ ID NO: 104614 - DNA, 22 bp, Artificial Sequence
  Synthetic oligonucleotide; TTC chr11 5346610 5346631 5346627 5346632 +
acatcactgagtacagaaggtc

SEQ ID NO: 104615 - DNA, 22 bp, Artificial Sequence
  Synthetic oligonucleotide; CTG chr11 5346619 5346640 5346636 5346641 +
agtacagaaggtcttaggtagt

SEQ ID NO: 104616 - DNA, 22 bp, Artificial Sequence
  Synthetic oligonucleotide; CTT chr11 5346634 5346655 5346651 5346656 +
aggtagttggttggtagcactt

SEQ ID NO: 104617 - DNA, 22 bp, Artificial Sequence
  Synthetic oligonucleotide; TTA chr11 5346635 5346656 5346652 5346657 +
ggtagttggttggtagcacttg

SEQ ID NO: 104618 - DNA, 22 bp, Artificial Sequence
  Synthetic oligonucleotide; TTG chr11 5346643 5346664 5346660 5346665 +
gttggtagcacttggaattgct

SEQ ID NO: 104619 - DNA, 22 bp, Artificial Sequence
  Synthetic oligonucleotide; TTG chr11 5346647 5346668 5346664 5346669 +
gtagcacttggaattgcttttg

SEQ ID NO: 104620 - DNA, 22 bp, Artificial Sequence
  Synthetic oligonucleotide; CTT chr11 5346656 5346677 5346673 5346678 +
ggaattgcttttgaagttctat

SEQ ID NO: 104621 - DNA, 22 bp, Artificial Sequence
  Synthetic oligonucleotide; TTG chr11 5346657 5346678 5346674 5346679 +
gaattgcttttgaagttctatc

SEQ ID NO: 104622 - DNA, 22 bp, Artificial Sequence
  Synthetic oligonucleotide; TTG chr11 5346663 5346684 5346680 5346685 +
cttttgaagttctatcaacttc

SEQ ID NO: 104623 - DNA, 22 bp, Artificial Sequence
  Synthetic oligonucleotide; CTT chr11 5346666 5346687 5346683 5346688 +
ttgaagttctatcaacttcaga

SEQ ID NO: 104624 - DNA, 22 bp, Artificial Sequence
  Synthetic oligonucleotide; TTT chr11 5346667 5346688 5346684 5346689 +
tgaagttctatcaacttcagac

SEQ ID NO: 104625 - DNA, 22 bp, Artificial Sequence
  Synthetic oligonucleotide; TTT chr11 5346668 5346689 5346685 5346690 +
gaagttctatcaacttcagact

SEQ ID NO: 104626 - DNA, 22 bp, Artificial Sequence
  Synthetic oligonucleotide; TTG chr11 5346669 5346690 5346686 5346691 +
aagttctatcaacttcagactg

SEQ ID NO: 104627 - DNA, 22 bp, Artificial Sequence
  Synthetic oligonucleotide; TTC chr11 5346675 5346696 5346692 5346697 +
tatcaacttcagactgaaatct

SEQ ID NO: 104628 - DNA, 22 bp, Artificial Sequence
  Synthetic oligonucleotide; CTA chr11 5346677 5346698 5346694 5346699 +
tcaacttcagactgaaatctgt

SEQ ID NO: 104629 - DNA, 22 bp, Artificial Sequence
  Synthetic oligonucleotide; CTT chr11 5346684 5346705 5346701 5346706 +
cagactgaaatctgtgcacaca

SEQ ID NO: 104630 - DNA, 22 bp, Artificial Sequence
  Synthetic oligonucleotide; TTC chr11 5346685 5346706 5346702 5346707 +
agactgaaatctgtgcacacat

SEQ ID NO: 104631 - DNA, 22 bp, Artificial Sequence
  Synthetic oligonucleotide; CTG chr11 5346691 5346712 5346708 5346713 +
aaatctgtgcacacatccaaag

SEQ ID NO: 104632 - DNA, 22 bp, Artificial Sequence
  Synthetic oligonucleotide; CTG chr11 5346698 5346719 5346715 5346720 +
tgcacacatccaaagctgtgga

SEQ ID NO: 104633 - DNA, 22 bp, Artificial Sequence
  Synthetic oligonucleotide; CTG chr11 5346716 5346737 5346733 5346738 +
tggactattgagatccttcact

SEQ ID NO: 104634 - DNA, 22 bp, Artificial Sequence
  Synthetic oligonucleotide; CTA chr11 5346723 5346744 5346740 5346745 +
ttgagatccttcacttcttctc

SEQ ID NO: 104635 - DNA, 22 bp, Artificial Sequence
  Synthetic oligonucleotide; TTG chr11 5346726 5346747 5346743 5346748 +
agatccttcacttcttctccgt

SEQ ID NO: 104636 - DNA, 22 bp, Artificial Sequence
  Synthetic oligonucleotide; CTT chr11 5346734 5346755 5346751 5346756 +
cacttcttctccgtatctttct

SEQ ID NO: 104637 - DNA, 22 bp, Artificial Sequence
  Synthetic oligonucleotide; TTC chr11 5346735 5346756 5346752 5346757 +
acttcttctccgtatctttctc

SEQ ID NO: 104638 - DNA, 22 bp, Artificial Sequence
  Synthetic oligonucleotide; CTT chr11 5346739 5346760 5346756 5346761 +
cttctccgtatctttctctgga

SEQ ID NO: 104639 - DNA, 22 bp, Artificial Sequence
  Synthetic oligonucleotide; TTC chr11 5346740 5346761 5346757 5346762 +
ttctccgtatctttctctggag

SEQ ID NO: 104640 - DNA, 22 bp, Artificial Sequence
  Synthetic oligonucleotide; CTT chr11 5346742 5346763 5346759 5346764 +
ctccgtatctttctctggagag

SEQ ID NO: 104641 - DNA, 22 bp, Artificial Sequence
  Synthetic oligonucleotide; TTC chr11 5346743 5346764 5346760 5346765 +
tccgtatctttctctggagagc

SEQ ID NO: 104642 - DNA, 22 bp, Artificial Sequence
  Synthetic oligonucleotide; CTC chr11 5346745 5346766 5346762 5346767 +
cgtatctttctctggagagctt

SEQ ID NO: 104643 - DNA, 22 bp, Artificial Sequence
  Synthetic oligonucleotide; CTT chr11 5346753 5346774 5346770 5346775 +
tctctggagagcttatagagga

SEQ ID NO: 104644 - DNA, 22 bp, Artificial Sequence
  Synthetic oligonucleotide; TTT chr11 5346754 5346775 5346771 5346776 +
ctctggagagcttatagaggag

SEQ ID NO: 104645 - DNA, 22 bp, Artificial Sequence
  Synthetic oligonucleotide; TTC chr11 5346755 5346776 5346772 5346777 +
tctggagagcttatagaggagt

SEQ ID NO: 104646 - DNA, 22 bp, Artificial Sequence
  Synthetic oligonucleotide; CTC chr11 5346757 5346778 5346774 5346779 +
tggagagcttatagaggagtct

SEQ ID NO: 104647 - DNA, 22 bp, Artificial Sequence
  Synthetic oligonucleotide; CTG chr11 5346759 5346780 5346776 5346781 +
gagagcttatagaggagtctcc

SEQ ID NO: 104648 - DNA, 22 bp, Artificial Sequence
  Synthetic oligonucleotide; CTT chr11 5346767 5346788 5346784 5346789 +
atagaggagtctcctagtacac

SEQ ID NO: 104649 - DNA, 22 bp, Artificial Sequence
  Synthetic oligonucleotide; TTA chr11 5346768 5346789 5346785 5346790 +
tagaggagtctcctagtacact

SEQ ID NO: 104650 - DNA, 22 bp, Artificial Sequence
  Synthetic oligonucleotide; CTC chr11 5346780 5346801 5346797 5346802 +
ctagtacactctttatatatct

SEQ ID NO: 104651 - DNA, 22 bp, Artificial Sequence
  Synthetic oligonucleotide; CTA chr11 5346783 5346804 5346800 5346805 +
gtacactctttatatatctagg

SEQ ID NO: 104652 - DNA, 22 bp, Artificial Sequence
  Synthetic oligonucleotide; CTC chr11 5346791 5346812 5346808 5346813 +
tttatatatctaggagtatttc

SEQ ID NO: 104653 - DNA, 22 bp, Artificial Sequence
  Synthetic oligonucleotide; CTT chr11 5346793 5346814 5346810 5346815 +
tatatatctaggagtatttcac

SEQ ID NO: 104654 - DNA, 22 bp, Artificial Sequence
  Synthetic oligonucleotide; TTT chr11 5346794 5346815 5346811 5346816 +
atatatctaggagtatttcacc

SEQ ID NO: 104655 - DNA, 22 bp, Artificial Sequence
  Synthetic oligonucleotide; TTA chr11 5346795 5346816 5346812 5346817 +
tatatctaggagtatttcacca

SEQ ID NO: 104656 - DNA, 22 bp, Artificial Sequence
  Synthetic oligonucleotide; CTA chr11 5346803 5346824 5346820 5346825 +
ggagtatttcaccatactccca

SEQ ID NO: 104657 - DNA, 22 bp, Artificial Sequence
  Synthetic oligonucleotide; TTT chr11 5346812 5346833 5346829 5346834 +
caccatactcccaggtaccata

SEQ ID NO: 104658 - DNA, 22 bp, Artificial Sequence
  Synthetic oligonucleotide; TTC chr11 5346813 5346834 5346830 5346835 +
accatactcccaggtaccataa

SEQ ID NO: 104659 - DNA, 22 bp, Artificial Sequence
  Synthetic oligonucleotide; CTC chr11 5346822 5346843 5346839 5346844 +
ccaggtaccataacttgtttga

SEQ ID NO: 104660 - DNA, 22 bp, Artificial Sequence
  Synthetic oligonucleotide; CTT chr11 5346838 5346859 5346855 5346860 +
gtttgatggtgaggaagagcag

SEQ ID NO: 104661 - DNA, 22 bp, Artificial Sequence
  Synthetic oligonucleotide; TTG chr11 5346839 5346860 5346856 5346861 +
tttgatggtgaggaagagcagg

SEQ ID NO: 104662 - DNA, 22 bp, Artificial Sequence
  Synthetic oligonucleotide; TTT chr11 5346842 5346863 5346859 5346864 +
gatggtgaggaagagcagggtt

SEQ ID NO: 104663 - DNA, 22 bp, Artificial Sequence
  Synthetic oligonucleotide; TTG chr11 5346843 5346864 5346860 5346865 +
atggtgaggaagagcagggttc

SEQ ID NO: 104664 - DNA, 22 bp, Artificial Sequence
  Synthetic oligonucleotide; TTC chr11 5346865 5346886 5346882 5346887 +
ttgtgtcttacctaaagactta

SEQ ID NO: 104665 - DNA, 22 bp, Artificial Sequence
  Synthetic oligonucleotide; CTT chr11 5346867 5346888 5346884 5346889 +
gtgtcttacctaaagacttaga

SEQ ID NO: 104666 - DNA, 22 bp, Artificial Sequence
  Synthetic oligonucleotide; TTG chr11 5346868 5346889 5346885 5346890 +
tgtcttacctaaagacttagat

SEQ ID NO: 104667 - DNA, 22 bp, Artificial Sequence
  Synthetic oligonucleotide; CTT chr11 5346874 5346895 5346891 5346896 +
acctaaagacttagatcatgtt

SEQ ID NO: 104668 - DNA, 22 bp, Artificial Sequence
  Synthetic oligonucleotide; TTA chr11 5346875 5346896 5346892 5346897 +
cctaaagacttagatcatgttg

SEQ ID NO: 104669 - DNA, 22 bp, Artificial Sequence
  Synthetic oligonucleotide; CTA chr11 5346879 5346900 5346896 5346901 +
aagacttagatcatgttgttcc

SEQ ID NO: 104670 - DNA, 22 bp, Artificial Sequence
  Synthetic oligonucleotide; CTT chr11 5346886 5346907 5346903 5346908 +
agatcatgttgttccttctcaa

SEQ ID NO: 104671 - DNA, 22 bp, Artificial Sequence
  Synthetic oligonucleotide; TTA chr11 5346887 5346908 5346904 5346909 +
gatcatgttgttccttctcaac

SEQ ID NO: 104672 - DNA, 22 bp, Artificial Sequence
  Synthetic oligonucleotide; TTG chr11 5346897 5346918 5346914 5346919 +
ttccttctcaacatctgtgaag

SEQ ID NO: 104673 - DNA, 22 bp, Artificial Sequence
  Synthetic oligonucleotide; TTC chr11 5346900 5346921 5346917 5346922 +
cttctcaacatctgtgaagaga

SEQ ID NO: 104674 - DNA, 22 bp, Artificial Sequence
  Synthetic oligonucleotide; CTT chr11 5346903 5346924 5346920 5346925 +
ctcaacatctgtgaagagaagc

SEQ ID NO: 104675 - DNA, 22 bp, Artificial Sequence
  Synthetic oligonucleotide; TTC chr11 5346904 5346925 5346921 5346926 +
tcaacatctgtgaagagaagca

SEQ ID NO: 104676 - DNA, 22 bp, Artificial Sequence
  Synthetic oligonucleotide; CTC chr11 5346906 5346927 5346923 5346928 +
aacatctgtgaagagaagcagt

SEQ ID NO: 104677 - DNA, 22 bp, Artificial Sequence
  Synthetic oligonucleotide; CTG chr11 5346914 5346935 5346931 5346936 +
tgaagagaagcagtcactgtgg

SEQ ID NO: 104678 - DNA, 22 bp, Artificial Sequence
  Synthetic oligonucleotide; CTG chr11 5346933 5346954 5346950 5346955 +
tggttattaataaagatagcac

SEQ ID NO: 104679 - DNA, 22 bp, Artificial Sequence
  Synthetic oligonucleotide; TTA chr11 5346939 5346960 5346956 5346961 +
ttaataaagatagcaccttccc

SEQ ID NO: 104680 - DNA, 22 bp, Artificial Sequence
  Synthetic oligonucleotide; TTA chr11 5346942 5346963 5346959 5346964 +
ataaagatagcaccttcccaga

SEQ ID NO: 104681 - DNA, 22 bp, Artificial Sequence
  Synthetic oligonucleotide; CTT chr11 5346958 5346979 5346975 5346980 +
cccagatgtctcccttttatag

SEQ ID NO: 104682 - DNA, 22 bp, Artificial Sequence
  Synthetic oligonucleotide; TTC chr11 5346959 5346980 5346976 5346981 +
ccagatgtctcccttttatagc

SEQ ID NO: 104683 - DNA, 22 bp, Artificial Sequence
  Synthetic oligonucleotide; CTC chr11 5346970 5346991 5346987 5346992 +
ccttttatagccaacttggatc

SEQ ID NO: 104684 - DNA, 22 bp, Artificial Sequence
  Synthetic oligonucleotide; CTT chr11 5346974 5346995 5346991 5346996 +
ttatagccaacttggatcttaa

SEQ ID NO: 104685 - DNA, 22 bp, Artificial Sequence
  Synthetic oligonucleotide; TTT chr11 5346975 5346996 5346992 5346997 +
tatagccaacttggatcttaag

SEQ ID NO: 104686 - DNA, 22 bp, Artificial Sequence
  Synthetic oligonucleotide; TTT chr11 5346976 5346997 5346993 5346998 +
atagccaacttggatcttaaga

SEQ ID NO: 104687 - DNA, 22 bp, Artificial Sequence
  Synthetic oligonucleotide; TTA chr11 5346977 5346998 5346994 5346999 +
tagccaacttggatcttaagaa

SEQ ID NO: 104688 - DNA, 22 bp, Artificial Sequence
  Synthetic oligonucleotide; CTT chr11 5346987 5347008 5347004 5347009 +
ggatcttaagaaatatttactc

SEQ ID NO: 104689 - DNA, 22 bp, Artificial Sequence
  Synthetic oligonucleotide; TTG chr11 5346988 5347009 5347005 5347010 +
gatcttaagaaatatttactct

SEQ ID NO: 104690 - DNA, 22 bp, Artificial Sequence
  Synthetic oligonucleotide; CTT chr11 5346994 5347015 5347011 5347016 +
aagaaatatttactctgtatta

SEQ ID NO: 104691 - DNA, 22 bp, Artificial Sequence
  Synthetic oligonucleotide; TTA chr11 5346995 5347016 5347012 5347017 +
agaaatatttactctgtattaa

SEQ ID NO: 104692 - DNA, 22 bp, Artificial Sequence
  Synthetic oligonucleotide; TTT chr11 5347005 5347026 5347022 5347027 +
actctgtattaactcctcctta

SEQ ID NO: 104693 - DNA, 22 bp, Artificial Sequence
  Synthetic oligonucleotide; TTA chr11 5347006 5347027 5347023 5347028 +
ctctgtattaactcctccttag

SEQ ID NO: 104694 - DNA, 22 bp, Artificial Sequence
  Synthetic oligonucleotide; CTC chr11 5347009 5347030 5347026 5347031 +
tgtattaactcctccttagagg

SEQ ID NO: 104695 - DNA, 22 bp, Artificial Sequence
  Synthetic oligonucleotide; CTG chr11 5347011 5347032 5347028 5347033 +
tattaactcctccttagaggga

SEQ ID NO: 104696 - DNA, 22 bp, Artificial Sequence
  Synthetic oligonucleotide; TTA chr11 5347016 5347037 5347033 5347038 +
actcctccttagagggagctgg

SEQ ID NO: 104697 - DNA, 22 bp, Artificial Sequence
  Synthetic oligonucleotide; CTC chr11 5347020 5347041 5347037 5347042 +
ctccttagagggagctggaaca

SEQ ID NO: 104698 - DNA, 22 bp, Artificial Sequence
  Synthetic oligonucleotide; CTC chr11 5347023 5347044 5347040 5347045 +
cttagagggagctggaacactt

SEQ ID NO: 104699 - DNA, 22 bp, Artificial Sequence
  Synthetic oligonucleotide; CTT chr11 5347026 5347047 5347043 5347048 +
agagggagctggaacacttaat

SEQ ID NO: 104700 - DNA, 22 bp, Artificial Sequence
  Synthetic oligonucleotide; TTA chr11 5347027 5347048 5347044 5347049 +
gagggagctggaacacttaatt

SEQ ID NO: 104701 - DNA, 22 bp, Artificial Sequence
  Synthetic oligonucleotide; CTG chr11 5347037 5347058 5347054 5347059 +
gaacacttaattagtcccccca

SEQ ID NO: 104702 - DNA, 22 bp, Artificial Sequence
  Synthetic oligonucleotide; CTT chr11 5347045 5347066 5347062 5347067 +
aattagtccccccaagctttta

SEQ ID NO: 104703 - DNA, 22 bp, Artificial Sequence
  Synthetic oligonucleotide; TTA chr11 5347046 5347067 5347063 5347068 +
attagtccccccaagcttttaa

SEQ ID NO: 104704 - DNA, 22 bp, Artificial Sequence
  Synthetic oligonucleotide; TTA chr11 5347050 5347071 5347067 5347072 +
gtccccccaagcttttaaataa

SEQ ID NO: 104705 - DNA, 22 bp, Artificial Sequence
  Synthetic oligonucleotide; CTT chr11 5347064 5347085 5347081 5347086 +
ttaaataatctttcttttttca

SEQ ID NO: 104706 - DNA, 22 bp, Artificial Sequence
  Synthetic oligonucleotide; TTT chr11 5347065 5347086 5347082 5347087 +
taaataatctttcttttttcaa

SEQ ID NO: 104707 - DNA, 22 bp, Artificial Sequence
  Synthetic oligonucleotide; TTT chr11 5347066 5347087 5347083 5347088 +
aaataatctttcttttttcaaa

SEQ ID NO: 104708 - DNA, 22 bp, Artificial Sequence
  Synthetic oligonucleotide; TTA chr11 5347067 5347088 5347084 5347089 +
aataatctttcttttttcaaat

SEQ ID NO: 104709 - DNA, 22 bp, Artificial Sequence
  Synthetic oligonucleotide; CTT chr11 5347076 5347097 5347093 5347098 +
tcttttttcaaataagttactg

SEQ ID NO: 104710 - DNA, 22 bp, Artificial Sequence
  Synthetic oligonucleotide; TTT chr11 5347077 5347098 5347094 5347099 +
cttttttcaaataagttactgg

SEQ ID NO: 104711 - DNA, 22 bp, Artificial Sequence
  Synthetic oligonucleotide; TTC chr11 5347078 5347099 5347095 5347100 +
ttttttcaaataagttactggc

SEQ ID NO: 104712 - DNA, 22 bp, Artificial Sequence
  Synthetic oligonucleotide; CTT chr11 5347080 5347101 5347097 5347102 +
ttttcaaataagttactggctg

SEQ ID NO: 104713 - DNA, 22 bp, Artificial Sequence
  Synthetic oligonucleotide; TTT chr11 5347081 5347102 5347098 5347103 +
tttcaaataagttactggctga

SEQ ID NO: 104714 - DNA, 22 bp, Artificial Sequence
  Synthetic oligonucleotide; TTT chr11 5347082 5347103 5347099 5347104 +
ttcaaataagttactggctgaa

SEQ ID NO: 104715 - DNA, 22 bp, Artificial Sequence
  Synthetic oligonucleotide; TTT chr11 5347083 5347104 5347100 5347105 +
tcaaataagttactggctgaat

SEQ ID NO: 104716 - DNA, 22 bp, Artificial Sequence
  Synthetic oligonucleotide; TTT chr11 5347084 5347105 5347101 5347106 +
caaataagttactggctgaatc

SEQ ID NO: 104717 - DNA, 22 bp, Artificial Sequence
  Synthetic oligonucleotide; TTC chr11 5347085 5347106 5347102 5347107 +
aaataagttactggctgaatca

SEQ ID NO: 104718 - DNA, 22 bp, Artificial Sequence
  Synthetic oligonucleotide; TTA chr11 5347095 5347116 5347112 5347117 +
ctggctgaatcaagccactggt

SEQ ID NO: 104719 - DNA, 22 bp, Artificial Sequence
  Synthetic oligonucleotide; CTG chr11 5347098 5347119 5347115 5347120 +
gctgaatcaagccactggtagg

SEQ ID NO: 104720 - DNA, 22 bp, Artificial Sequence
  Synthetic oligonucleotide; CTG chr11 5347102 5347123 5347119 5347124 +
aatcaagccactggtaggacct

SEQ ID NO: 104721 - DNA, 22 bp, Artificial Sequence
  Synthetic oligonucleotide; CTG chr11 5347115 5347136 5347132 5347137 +
gtaggacctttatgtgtgggga

SEQ ID NO: 104722 - DNA, 22 bp, Artificial Sequence
  Synthetic oligonucleotide; CTT chr11 5347125 5347146 5347142 5347147 +
tatgtgtggggaatcagacagc

SEQ ID NO: 104723 - DNA, 22 bp, Artificial Sequence
  Synthetic oligonucleotide; TTT chr11 5347126 5347147 5347143 5347148 +
atgtgtggggaatcagacagcc

SEQ ID NO: 104724 - DNA, 22 bp, Artificial Sequence
  Synthetic oligonucleotide; TTA chr11 5347127 5347148 5347144 5347149 +
tgtgtggggaatcagacagcct

SEQ ID NO: 104725 - DNA, 22 bp, Artificial Sequence
  Synthetic oligonucleotide; CTG chr11 5347150 5347171 5347167 5347172 +
tcttcatagccccagcagactc

SEQ ID NO: 104726 - DNA, 22 bp, Artificial Sequence
  Synthetic oligonucleotide; CTT chr11 5347154 5347175 5347171 5347176 +
catagccccagcagactctggt

SEQ ID NO: 104727 - DNA, 22 bp, Artificial Sequence
  Synthetic oligonucleotide; TTC chr11 5347155 5347176 5347172 5347177 +
atagccccagcagactctggta

SEQ ID NO: 104728 - DNA, 22 bp, Artificial Sequence
  Synthetic oligonucleotide; CTC chr11 5347172 5347193 5347189 5347194 +
tggtatcacctctgggaggtaa

SEQ ID NO: 104729 - DNA, 22 bp, Artificial Sequence
  Synthetic oligonucleotide; CTG chr11 5347174 5347195 5347191 5347196 +
gtatcacctctgggaggtaatt

SEQ ID NO: 104730 - DNA, 22 bp, Artificial Sequence
  Synthetic oligonucleotide; CTC chr11 5347184 5347205 5347201 5347206 +
tgggaggtaatttattccctac

SEQ ID NO: 104731 - DNA, 22 bp, Artificial Sequence
  Synthetic oligonucleotide; CTG chr11 5347186 5347207 5347203 5347208 +
ggaggtaatttattccctacat

SEQ ID NO: 104732 - DNA, 22 bp, Artificial Sequence
  Synthetic oligonucleotide; TTT chr11 5347197 5347218 5347214 5347219 +
attccctacatttacttcaaca

SEQ ID NO: 104733 - DNA, 22 bp, Artificial Sequence
  Synthetic oligonucleotide; TTA chr11 5347198 5347219 5347215 5347220 +
ttccctacatttacttcaacag

SEQ ID NO: 104734 - DNA, 22 bp, Artificial Sequence
  Synthetic oligonucleotide; TTC chr11 5347201 5347222 5347218 5347223 +
cctacatttacttcaacagtca

SEQ ID NO: 104735 - DNA, 22 bp, Artificial Sequence
  Synthetic oligonucleotide; CTA chr11 5347205 5347226 5347222 5347227 +
catttacttcaacagtcaaatc

SEQ ID NO: 104736 - DNA, 22 bp, Artificial Sequence
  Synthetic oligonucleotide; TTT chr11 5347210 5347231 5347227 5347232 +
acttcaacagtcaaatctttcc

SEQ ID NO: 104737 - DNA, 22 bp, Artificial Sequence
  Synthetic oligonucleotide; TTA chr11 5347211 5347232 5347228 5347233 +
cttcaacagtcaaatctttccc

SEQ ID NO: 104738 - DNA, 22 bp, Artificial Sequence
  Synthetic oligonucleotide; CTT chr11 5347214 5347235 5347231 5347236 +
caacagtcaaatctttcccagt

SEQ ID NO: 104739 - DNA, 22 bp, Artificial Sequence
  Synthetic oligonucleotide; TTC chr11 5347215 5347236 5347232 5347237 +
aacagtcaaatctttcccagtt

SEQ ID NO: 104740 - DNA, 22 bp, Artificial Sequence
  Synthetic oligonucleotide; CTT chr11 5347229 5347250 5347246 5347251 +
tcccagtttatctcaagagaaa

SEQ ID NO: 104741 - DNA, 22 bp, Artificial Sequence
  Synthetic oligonucleotide; TTT chr11 5347230 5347251 5347247 5347252 +
cccagtttatctcaagagaaag

SEQ ID NO: 104742 - DNA, 22 bp, Artificial Sequence
  Synthetic oligonucleotide; TTC chr11 5347231 5347252 5347248 5347253 +
ccagtttatctcaagagaaagc

SEQ ID NO: 104743 - DNA, 22 bp, Artificial Sequence
  Synthetic oligonucleotide; TTT chr11 5347238 5347259 5347255 5347260 +
atctcaagagaaagcctatata

SEQ ID NO: 104744 - DNA, 22 bp, Artificial Sequence
  Synthetic oligonucleotide; TTA chr11 5347239 5347260 5347256 5347261 +
tctcaagagaaagcctatatat

SEQ ID NO: 104745 - DNA, 22 bp, Artificial Sequence
  Synthetic oligonucleotide; CTC chr11 5347243 5347264 5347260 5347265 +
aagagaaagcctatatatcttc

SEQ ID NO: 104746 - DNA, 22 bp, Artificial Sequence
  Synthetic oligonucleotide; CTA chr11 5347256 5347277 5347273 5347278 +
tatatcttcttggcctatgtaa

SEQ ID NO: 104747 - DNA, 22 bp, Artificial Sequence
  Synthetic oligonucleotide; CTT chr11 5347264 5347285 5347281 5347286 +
cttggcctatgtaacctgaatt

SEQ ID NO: 104748 - DNA, 22 bp, Artificial Sequence
  Synthetic oligonucleotide; TTC chr11 5347265 5347286 5347282 5347287 +
ttggcctatgtaacctgaattt

SEQ ID NO: 104749 - DNA, 22 bp, Artificial Sequence
  Synthetic oligonucleotide; CTT chr11 5347267 5347288 5347284 5347289 +
ggcctatgtaacctgaatttct

SEQ ID NO: 104750 - DNA, 22 bp, Artificial Sequence
  Synthetic oligonucleotide; TTG chr11 5347268 5347289 5347285 5347290 +
gcctatgtaacctgaatttcta

SEQ ID NO: 104751 - DNA, 22 bp, Artificial Sequence
  Synthetic oligonucleotide; CTA chr11 5347273 5347294 5347290 5347295 +
tgtaacctgaatttctactata

SEQ ID NO: 104752 - DNA, 22 bp, Artificial Sequence
  Synthetic oligonucleotide; CTG chr11 5347282 5347303 5347299 5347304 +
aatttctactatatttcctgct

SEQ ID NO: 104753 - DNA, 22 bp, Artificial Sequence
  Synthetic oligonucleotide; TTT chr11 5347287 5347308 5347304 5347309 +
ctactatatttcctgcttggtt

SEQ ID NO: 104754 - DNA, 22 bp, Artificial Sequence
  Synthetic oligonucleotide; TTC chr11 5347288 5347309 5347305 5347310 +
tactatatttcctgcttggttt

SEQ ID NO: 104755 - DNA, 22 bp, Artificial Sequence
  Synthetic oligonucleotide; CTA chr11 5347290 5347311 5347307 5347312 +
ctatatttcctgcttggtttag

SEQ ID NO: 104756 - DNA, 22 bp, Artificial Sequence
  Synthetic oligonucleotide; CTA chr11 5347293 5347314 5347310 5347315 +
tatttcctgcttggtttagatc

SEQ ID NO: 104757 - DNA, 22 bp, Artificial Sequence
  Synthetic oligonucleotide; TTT chr11 5347298 5347319 5347315 5347320 +
cctgcttggtttagatcagaga

SEQ ID NO: 104758 - DNA, 22 bp, Artificial Sequence
  Synthetic oligonucleotide; TTC chr11 5347299 5347320 5347316 5347321 +
ctgcttggtttagatcagagaa

SEQ ID NO: 104759 - DNA, 22 bp, Artificial Sequence
  Synthetic oligonucleotide; CTG chr11 5347302 5347323 5347319 5347324 +
cttggtttagatcagagaaagc

SEQ ID NO: 104760 - DNA, 22 bp, Artificial Sequence
  Synthetic oligonucleotide; CTT chr11 5347305 5347326 5347322 5347327 +
ggtttagatcagagaaagcttg

SEQ ID NO: 104761 - DNA, 22 bp, Artificial Sequence
  Synthetic oligonucleotide; TTG chr11 5347306 5347327 5347323 5347328 +
gtttagatcagagaaagcttga

SEQ ID NO: 104762 - DNA, 22 bp, Artificial Sequence
  Synthetic oligonucleotide; TTT chr11 5347310 5347331 5347327 5347332 +
agatcagagaaagcttgaaagc

SEQ ID NO: 104763 - DNA, 22 bp, Artificial Sequence
  Synthetic oligonucleotide; TTA chr11 5347311 5347332 5347328 5347333 +
gatcagagaaagcttgaaagca

SEQ ID NO: 104764 - DNA, 22 bp, Artificial Sequence
  Synthetic oligonucleotide; CTT chr11 5347326 5347347 5347343 5347348 +
gaaagcagagagctagatagac

SEQ ID NO: 104765 - DNA, 22 bp, Artificial Sequence
  Synthetic oligonucleotide; TTG chr11 5347327 5347348 5347344 5347349 +
aaagcagagagctagatagact

SEQ ID NO: 104766 - DNA, 22 bp, Artificial Sequence
  Synthetic oligonucleotide; CTA chr11 5347341 5347362 5347358 5347363 +
gatagactagagtcaatataat

SEQ ID NO: 104767 - DNA, 22 bp, Artificial Sequence
  Synthetic oligonucleotide; CTA chr11 5347350 5347371 5347367 5347372 +
gagtcaatataataaaattcag

SEQ ID NO: 104768 - DNA, 22 bp, Artificial Sequence
  Synthetic oligonucleotide; TTC chr11 5347370 5347391 5347387 5347392 +
aggcagccttctctagtaccca

SEQ ID NO: 104769 - DNA, 22 bp, Artificial Sequence
  Synthetic oligonucleotide; CTT chr11 5347380 5347401 5347397 5347402 +
ctctagtacccaacgtgaacgc

SEQ ID NO: 104770 - DNA, 22 bp, Artificial Sequence
  Synthetic oligonucleotide; TTC chr11 5347381 5347402 5347398 5347403 +
tctagtacccaacgtgaacgca

SEQ ID NO: 104771 - DNA, 22 bp, Artificial Sequence
  Synthetic oligonucleotide; CTC chr11 5347383 5347404 5347400 5347405 +
tagtacccaacgtgaacgcaca

SEQ ID NO: 104772 - DNA, 22 bp, Artificial Sequence
  Synthetic oligonucleotide; CTA chr11 5347385 5347406 5347402 5347407 +
gtacccaacgtgaacgcacatt

SEQ ID NO: 104773 - DNA, 22 bp, Artificial Sequence
  Synthetic oligonucleotide; TTC chr11 5347408 5347429 5347425 5347430 +
tgcagttatcactaactattcc

SEQ ID NO: 104774 - DNA, 22 bp, Artificial Sequence
  Synthetic oligonucleotide; CTG chr11 5347410 5347431 5347427 5347432 +
cagttatcactaactattccct

SEQ ID NO: 104775 - DNA, 22 bp, Artificial Sequence
  Synthetic oligonucleotide; TTA chr11 5347416 5347437 5347433 5347438 +
tcactaactattcccttcttga

SEQ ID NO: 104776 - DNA, 22 bp, Artificial Sequence
  Synthetic oligonucleotide; CTA chr11 5347422 5347443 5347439 5347444 +
actattcccttcttgagtttag

SEQ ID NO: 104777 - DNA, 22 bp, Artificial Sequence
  Synthetic oligonucleotide; CTA chr11 5347426 5347447 5347443 5347448 +
ttcccttcttgagtttagccta

SEQ ID NO: 104778 - DNA, 22 bp, Artificial Sequence
  Synthetic oligonucleotide; TTC chr11 5347429 5347450 5347446 5347451 +
ccttcttgagtttagcctacca

SEQ ID NO: 104779 - DNA, 22 bp, Artificial Sequence
  Synthetic oligonucleotide; CTT chr11 5347433 5347454 5347450 5347455 +
cttgagtttagcctaccagaag

SEQ ID NO: 104780 - DNA, 22 bp, Artificial Sequence
  Synthetic oligonucleotide; TTC chr11 5347434 5347455 5347451 5347456 +
ttgagtttagcctaccagaagt

SEQ ID NO: 104781 - DNA, 22 bp, Artificial Sequence
  Synthetic oligonucleotide; CTT chr11 5347436 5347457 5347453 5347458 +
gagtttagcctaccagaagttt

SEQ ID NO: 104782 - DNA, 22 bp, Artificial Sequence
  Synthetic oligonucleotide; TTG chr11 5347437 5347458 5347454 5347459 +
agtttagcctaccagaagtttt

SEQ ID NO: 104783 - DNA, 22 bp, Artificial Sequence
  Synthetic oligonucleotide; TTT chr11 5347442 5347463 5347459 5347464 +
agcctaccagaagttttctctt

SEQ ID NO: 104784 - DNA, 22 bp, Artificial Sequence
  Synthetic oligonucleotide; TTA chr11 5347443 5347464 5347460 5347465 +
gcctaccagaagttttctcttt

SEQ ID NO: 104785 - DNA, 22 bp, Artificial Sequence
  Synthetic oligonucleotide; CTA chr11 5347448 5347469 5347465 5347470 +
ccagaagttttctcttttccag

SEQ ID NO: 104786 - DNA, 22 bp, Artificial Sequence
  Synthetic oligonucleotide; TTT chr11 5347458 5347479 5347475 5347480 +
tctcttttccaggggatgcagc

SEQ ID NO: 104787 - DNA, 22 bp, Artificial Sequence
  Synthetic oligonucleotide; TTT chr11 5347459 5347480 5347476 5347481 +
ctcttttccaggggatgcagca

SEQ ID NO: 104788 - DNA, 22 bp, Artificial Sequence
  Synthetic oligonucleotide; TTC chr11 5347460 5347481 5347477 5347482 +
tcttttccaggggatgcagcag

SEQ ID NO: 104789 - DNA, 22 bp, Artificial Sequence
  Synthetic oligonucleotide; CTC chr11 5347462 5347483 5347479 5347484 +
ttttccaggggatgcagcaggc

SEQ ID NO: 104790 - DNA, 22 bp, Artificial Sequence
  Synthetic oligonucleotide; CTT chr11 5347464 5347485 5347481 5347486 +
ttccaggggatgcagcaggcat

SEQ ID NO: 104791 - DNA, 22 bp, Artificial Sequence
  Synthetic oligonucleotide; TTT chr11 5347465 5347486 5347482 5347487 +
tccaggggatgcagcaggcata

SEQ ID NO: 104792 - DNA, 22 bp, Artificial Sequence
  Synthetic oligonucleotide; TTT chr11 5347466 5347487 5347483 5347488 +
ccaggggatgcagcaggcatac

SEQ ID NO: 104793 - DNA, 22 bp, Artificial Sequence
  Synthetic oligonucleotide; TTC chr11 5347467 5347488 5347484 5347489 +
caggggatgcagcaggcatact

SEQ ID NO: 104794 - DNA, 22 bp, Artificial Sequence
  Synthetic oligonucleotide; CTC chr11 5347490 5347511 5347507 5347512 +
atcacatggtgcttcagccaag

SEQ ID NO: 104795 - DNA, 22 bp, Artificial Sequence
  Synthetic oligonucleotide; CTT chr11 5347504 5347525 5347521 5347526 +
cagccaagcacaccacatcact

SEQ ID NO: 104796 - DNA, 22 bp, Artificial Sequence
  Synthetic oligonucleotide; TTC chr11 5347505 5347526 5347522 5347527 +
agccaagcacaccacatcactt

SEQ ID NO: 104797 - DNA, 22 bp, Artificial Sequence
  Synthetic oligonucleotide; CTT chr11 5347527 5347548 5347544 5347549 +
tgtgatggcaattattatatgc

SEQ ID NO: 104798 - DNA, 22 bp, Artificial Sequence
  Synthetic oligonucleotide; TTT chr11 5347528 5347549 5347545 5347550 +
gtgatggcaattattatatgcg

SEQ ID NO: 104799 - DNA, 22 bp, Artificial Sequence
  Synthetic oligonucleotide; TTG chr11 5347529 5347550 5347546 5347551 +
tgatggcaattattatatgcgt

SEQ ID NO: 104800 - DNA, 22 bp, Artificial Sequence
  Synthetic oligonucleotide; TTA chr11 5347541 5347562 5347558 5347563 +
ttatatgcgttttacagtaagg

SEQ ID NO: 104801 - DNA, 22 bp, Artificial Sequence
  Synthetic oligonucleotide; TTA chr11 5347544 5347565 5347561 5347566 +
tatgcgttttacagtaaggact

SEQ ID NO: 104802 - DNA, 22 bp, Artificial Sequence
  Synthetic oligonucleotide; TTT chr11 5347553 5347574 5347570 5347575 +
tacagtaaggactatgaaatgc

SEQ ID NO: 104803 - DNA, 22 bp, Artificial Sequence
  Synthetic oligonucleotide; TTT chr11 5347554 5347575 5347571 5347576 +
acagtaaggactatgaaatgca

SEQ ID NO: 104804 - DNA, 22 bp, Artificial Sequence
  Synthetic oligonucleotide; TTA chr11 5347555 5347576 5347572 5347577 +
cagtaaggactatgaaatgcaa

SEQ ID NO: 104805 - DNA, 22 bp, Artificial Sequence
  Synthetic oligonucleotide; CTA chr11 5347567 5347588 5347584 5347589 +
tgaaatgcaatgagataaaata

SEQ ID NO: 104806 - DNA, 22 bp, Artificial Sequence
  Synthetic oligonucleotide; TTC chr11 5347593 5347614 5347610 5347615 +
caaagtagcacagcaagagcca

SEQ ID NO: 104807 - DNA, 22 bp, Artificial Sequence
  Synthetic oligonucleotide; TTC chr11 5347640 5347661 5347657 5347662 +
aacctccaacagaggaaaacct

SEQ ID NO: 104808 - DNA, 22 bp, Artificial Sequence
  Synthetic oligonucleotide; CTC chr11 5347646 5347667 5347663 5347668 +
caacagaggaaaacctccagta

SEQ ID NO: 104809 - DNA, 22 bp, Artificial Sequence
  Synthetic oligonucleotide; CTC chr11 5347663 5347684 5347680 5347685 +
cagtaaaagccaggacagagac

SEQ ID NO: 104810 - DNA, 22 bp, Artificial Sequence
  Synthetic oligonucleotide; CTT chr11 5347694 5347715 5347711 5347716 +
gagttgtgctgttcaaagccca

SEQ ID NO: 104811 - DNA, 22 bp, Artificial Sequence
  Synthetic oligonucleotide; TTG chr11 5347695 5347716 5347712 5347717 +
agttgtgctgttcaaagcccaa

SEQ ID NO: 104812 - DNA, 22 bp, Artificial Sequence
  Synthetic oligonucleotide; TTG chr11 5347700 5347721 5347717 5347722 +
tgctgttcaaagcccaataccc

SEQ ID NO: 104813 - DNA, 22 bp, Artificial Sequence
  Synthetic oligonucleotide; CTG chr11 5347705 5347726 5347722 5347727 +
ttcaaagcccaatacccacaag

SEQ ID NO: 104814 - DNA, 22 bp, Artificial Sequence
  Synthetic oligonucleotide; TTC chr11 5347708 5347729 5347725 5347730 +
aaagcccaatacccacaaggct

SEQ ID NO: 104815 - DNA, 22 bp, Artificial Sequence
  Synthetic oligonucleotide; CTG chr11 5347731 5347752 5347748 5347753 +
agggcacaaataatagagaaaa

SEQ ID NO: 104816 - DNA, 22 bp, Artificial Sequence
  Synthetic oligonucleotide; TTA chr11 5347829 5347850 5347846 5347851 +
tctaaatcaggaatggtctctg

SEQ ID NO: 104817 - DNA, 22 bp, Artificial Sequence
  Synthetic oligonucleotide; CTA chr11 5347833 5347854 5347850 5347855 +
aatcaggaatggtctctgggga

SEQ ID NO: 104818 - DNA, 22 bp, Artificial Sequence
  Synthetic oligonucleotide; CTC chr11 5347849 5347870 5347866 5347871 +
tggggaggagcttctaaaataa

SEQ ID NO: 104819 - DNA, 22 bp, Artificial Sequence
  Synthetic oligonucleotide; CTG chr11 5347851 5347872 5347868 5347873 +
gggaggagcttctaaaataaat

SEQ ID NO: 104820 - DNA, 22 bp, Artificial Sequence
  Synthetic oligonucleotide; CTT chr11 5347862 5347883 5347879 5347884 +
ctaaaataaatgttcctaccag

SEQ ID NO: 104821 - DNA, 22 bp, Artificial Sequence
  Synthetic oligonucleotide; TTC chr11 5347863 5347884 5347880 5347885 +
taaaataaatgttcctaccagc

SEQ ID NO: 104822 - DNA, 22 bp, Artificial Sequence
  Synthetic oligonucleotide; CTA chr11 5347865 5347886 5347882 5347887 +
aaataaatgttcctaccagcca

SEQ ID NO: 104823 - DNA, 22 bp, Artificial Sequence
  Synthetic oligonucleotide; TTC chr11 5347877 5347898 5347894 5347899 +
ctaccagccaggctcatgtgca

SEQ ID NO: 104824 - DNA, 22 bp, Artificial Sequence
  Synthetic oligonucleotide; CTA chr11 5347880 5347901 5347897 5347902 +
ccagccaggctcatgtgcagat

SEQ ID NO: 104825 - DNA, 22 bp, Artificial Sequence
  Synthetic oligonucleotide; CTC chr11 5347892 5347913 5347909 5347914 +
atgtgcagattctgaaaagatg

SEQ ID NO: 104826 - DNA, 22 bp, Artificial Sequence
  Synthetic oligonucleotide; TTC chr11 5347904 5347925 5347921 5347926 +
tgaaaagatgatgcccaaatct

SEQ ID NO: 104827 - DNA, 22 bp, Artificial Sequence
  Synthetic oligonucleotide; CTG chr11 5347906 5347927 5347923 5347928 +
aaaagatgatgcccaaatcttt

SEQ ID NO: 104828 - DNA, 22 bp, Artificial Sequence
  Synthetic oligonucleotide; CTT chr11 5347927 5347948 5347944 5347949 +
tcatacggctaaagatgtgaga

SEQ ID NO: 104829 - DNA, 22 bp, Artificial Sequence
  Synthetic oligonucleotide; TTT chr11 5347928 5347949 5347945 5347950 +
catacggctaaagatgtgagat

SEQ ID NO: 104830 - DNA, 22 bp, Artificial Sequence
  Synthetic oligonucleotide; TTC chr11 5347929 5347950 5347946 5347951 +
atacggctaaagatgtgagata

SEQ ID NO: 104831 - DNA, 22 bp, Artificial Sequence
  Synthetic oligonucleotide; CTA chr11 5347938 5347959 5347955 5347960 +
aagatgtgagatacatgactat

SEQ ID NO: 104832 - DNA, 22 bp, Artificial Sequence
  Synthetic oligonucleotide; CTA chr11 5347959 5347980 5347976 5347981 +
tggaactgaagaatggaaggga

SEQ ID NO: 104833 - DNA, 22 bp, Artificial Sequence
  Synthetic oligonucleotide; CTG chr11 5347967 5347988 5347984 5347989 +
aagaatggaagggaacaaagtt

SEQ ID NO: 104834 - DNA, 22 bp, Artificial Sequence
  Synthetic oligonucleotide; TTT chr11 5347990 5348011 5348007 5348012 +
caggtcagtgagggtatttaat

SEQ ID NO: 104835 - DNA, 22 bp, Artificial Sequence
  Synthetic oligonucleotide; TTC chr11 5347991 5348012 5348008 5348013 +
aggtcagtgagggtatttaatg

SEQ ID NO: 104836 - DNA, 22 bp, Artificial Sequence
  Synthetic oligonucleotide; TTT chr11 5348009 5348030 5348026 5348031 +
aatgaatctcctctgtaagatc

SEQ ID NO: 104837 - DNA, 22 bp, Artificial Sequence
  Synthetic oligonucleotide; TTA chr11 5348010 5348031 5348027 5348032 +
atgaatctcctctgtaagatct

SEQ ID NO: 104838 - DNA, 22 bp, Artificial Sequence
  Synthetic oligonucleotide; CTC chr11 5348019 5348040 5348036 5348041 +
ctctgtaagatctcattgcagg

SEQ ID NO: 104839 - DNA, 22 bp, Artificial Sequence
  Synthetic oligonucleotide; CTC chr11 5348022 5348043 5348039 5348044 +
tgtaagatctcattgcaggaac

SEQ ID NO: 104840 - DNA, 22 bp, Artificial Sequence
  Synthetic oligonucleotide; CTG chr11 5348024 5348045 5348041 5348046 +
taagatctcattgcaggaacca

SEQ ID NO: 104841 - DNA, 22 bp, Artificial Sequence
  Synthetic oligonucleotide; CTC chr11 5348033 5348054 5348050 5348055 +
attgcaggaaccaaggcaaaaa

SEQ ID NO: 104842 - DNA, 22 bp, Artificial Sequence
  Synthetic oligonucleotide; TTG chr11 5348037 5348058 5348054 5348059 +
caggaaccaaggcaaaaaaaaa

SEQ ID NO: 104843 - DNA, 22 bp, Artificial Sequence
  Synthetic oligonucleotide; CTG chr11 5348077 5348098 5348094 5348099 +
atttcttagcaagagaaaagta

SEQ ID NO: 104844 - DNA, 22 bp, Artificial Sequence
  Synthetic oligonucleotide; TTT chr11 5348081 5348102 5348098 5348103 +
cttagcaagagaaaagtaatag

SEQ ID NO: 104845 - DNA, 22 bp, Artificial Sequence
  Synthetic oligonucleotide; TTC chr11 5348082 5348103 5348099 5348104 +
ttagcaagagaaaagtaatagt

SEQ ID NO: 104846 - DNA, 22 bp, Artificial Sequence
  Synthetic oligonucleotide; CTT chr11 5348084 5348105 5348101 5348106 +
agcaagagaaaagtaatagtgt

SEQ ID NO: 104847 - DNA, 22 bp, Artificial Sequence
  Synthetic oligonucleotide; TTA chr11 5348085 5348106 5348102 5348107 +
gcaagagaaaagtaatagtgtt

SEQ ID NO: 104848 - DNA, 22 bp, Artificial Sequence
  Synthetic oligonucleotide; TTG chr11 5348108 5348129 5348125 5348130 +
tctgctaagagtagatatatgt

SEQ ID NO: 104849 - DNA, 22 bp, Artificial Sequence
  Synthetic oligonucleotide; CTG chr11 5348112 5348133 5348129 5348134 +
ctaagagtagatatatgtagta

SEQ ID NO: 104850 - DNA, 22 bp, Artificial Sequence
  Synthetic oligonucleotide; CTA chr11 5348115 5348136 5348132 5348137 +
agagtagatatatgtagtaggc

SEQ ID NO: 104851 - DNA, 22 bp, Artificial Sequence
  Synthetic oligonucleotide; CTA chr11 5348147 5348168 5348164 5348169 +
aagactccctgacatctctaaa

SEQ ID NO: 104852 - DNA, 22 bp, Artificial Sequence
  Synthetic oligonucleotide; CTC chr11 5348154 5348175 5348171 5348176 +
cctgacatctctaaaacttggt

SEQ ID NO: 104853 - DNA, 22 bp, Artificial Sequence
  Synthetic oligonucleotide; CTG chr11 5348158 5348179 5348175 5348180 +
acatctctaaaacttggtttct

SEQ ID NO: 104854 - DNA, 22 bp, Artificial Sequence
  Synthetic oligonucleotide; CTC chr11 5348165 5348186 5348182 5348187 +
taaaacttggtttctttgagag

SEQ ID NO: 104855 - DNA, 22 bp, Artificial Sequence
  Synthetic oligonucleotide; CTA chr11 5348167 5348188 5348184 5348189 +
aaacttggtttctttgagagtt

SEQ ID NO: 104856 - DNA, 22 bp, Artificial Sequence
  Synthetic oligonucleotide; CTT chr11 5348173 5348194 5348190 5348195 +
ggtttctttgagagttacctct

SEQ ID NO: 104857 - DNA, 22 bp, Artificial Sequence
  Synthetic oligonucleotide; TTG chr11 5348174 5348195 5348191 5348196 +
gtttctttgagagttacctctt

SEQ ID NO: 104858 - DNA, 22 bp, Artificial Sequence
  Synthetic oligonucleotide; TTT chr11 5348178 5348199 5348195 5348200 +
ctttgagagttacctcttcaaa

SEQ ID NO: 104859 - DNA, 22 bp, Artificial Sequence
  Synthetic oligonucleotide; TTC chr11 5348179 5348200 5348196 5348201 +
tttgagagttacctcttcaaat

SEQ ID NO: 104860 - DNA, 22 bp, Artificial Sequence
  Synthetic oligonucleotide; CTT chr11 5348181 5348202 5348198 5348203 +
tgagagttacctcttcaaatat

SEQ ID NO: 104861 - DNA, 22 bp, Artificial Sequence
  Synthetic oligonucleotide; TTT chr11 5348182 5348203 5348199 5348204 +
gagagttacctcttcaaatata

SEQ ID NO: 104862 - DNA, 22 bp, Artificial Sequence
  Synthetic oligonucleotide; TTG chr11 5348183 5348204 5348200 5348205 +
agagttacctcttcaaatataa

SEQ ID NO: 104863 - DNA, 22 bp, Artificial Sequence
  Synthetic oligonucleotide; TTA chr11 5348190 5348211 5348207 5348212 +
cctcttcaaatataaaaaagtg

SEQ ID NO: 104864 - DNA, 22 bp, Artificial Sequence
  Synthetic oligonucleotide; CTC chr11 5348194 5348215 5348211 5348216 +
ttcaaatataaaaaagtgaagg

SEQ ID NO: 104865 - DNA, 22 bp, Artificial Sequence
  Synthetic oligonucleotide; CTT chr11 5348196 5348217 5348213 5348218 +
caaatataaaaaagtgaaggat

SEQ ID NO: 104866 - DNA, 22 bp, Artificial Sequence
  Synthetic oligonucleotide; TTC chr11 5348197 5348218 5348214 5348219 +
aaatataaaaaagtgaaggata

SEQ ID NO: 104867 - DNA, 22 bp, Artificial Sequence
  Synthetic oligonucleotide; TTC chr11 5348224 5348245 5348241 5348246 +
tggaacacataaggcaaacaat

SEQ ID NO: 104868 - DNA, 22 bp, Artificial Sequence
  Synthetic oligonucleotide; CTG chr11 5348226 5348247 5348243 5348248 +
gaacacataaggcaaacaattc

SEQ ID NO: 104869 - DNA, 22 bp, Artificial Sequence
  Synthetic oligonucleotide; TTC chr11 5348248 5348269 5348265 5348270 +
tacgaacaaaccagagcatggg

SEQ ID NO: 104870 - DNA, 22 bp, Artificial Sequence
  Synthetic oligonucleotide; CTA chr11 5348250 5348271 5348267 5348272 +
cgaacaaaccagagcatgggtg

SEQ ID NO: 104871 - DNA, 22 bp, Artificial Sequence
  Synthetic oligonucleotide; TTG chr11 5348275 5348296 5348292 5348297 +
actcaggcatgaattatggggt

SEQ ID NO: 104872 - DNA, 22 bp, Artificial Sequence
  Synthetic oligonucleotide; CTC chr11 5348279 5348300 5348296 5348301 +
aggcatgaattatggggttgta

SEQ ID NO: 104873 - DNA, 22 bp, Artificial Sequence
  Synthetic oligonucleotide; TTA chr11 5348291 5348312 5348308 5348313 +
tggggttgtagtaatttctctc

SEQ ID NO: 104874 - DNA, 22 bp, Artificial Sequence
  Synthetic oligonucleotide; TTG chr11 5348299 5348320 5348316 5348321 +
tagtaatttctctccacctgac

SEQ ID NO: 104875 - DNA, 22 bp, Artificial Sequence
  Synthetic oligonucleotide; TTT chr11 5348308 5348329 5348325 5348330 +
ctctccacctgactgattcttt

SEQ ID NO: 104876 - DNA, 22 bp, Artificial Sequence
  Synthetic oligonucleotide; TTC chr11 5348309 5348330 5348326 5348331 +
tctccacctgactgattcttta

SEQ ID NO: 104877 - DNA, 22 bp, Artificial Sequence
  Synthetic oligonucleotide; CTC chr11 5348311 5348332 5348328 5348333 +
tccacctgactgattctttaat

SEQ ID NO: 104878 - DNA, 22 bp, Artificial Sequence
  Synthetic oligonucleotide; CTC chr11 5348313 5348334 5348330 5348335 +
cacctgactgattctttaatct

SEQ ID NO: 104879 - DNA, 22 bp, Artificial Sequence
  Synthetic oligonucleotide; CTG chr11 5348319 5348340 5348336 5348341 +
actgattctttaatctctctgg

SEQ ID NO: 104880 - DNA, 22 bp, Artificial Sequence
  Synthetic oligonucleotide; CTG chr11 5348323 5348344 5348340 5348345 +
attctttaatctctctggcttc

SEQ ID NO: 104881 - DNA, 22 bp, Artificial Sequence
  Synthetic oligonucleotide; TTC chr11 5348327 5348348 5348344 5348349 +
tttaatctctctggcttccatt

SEQ ID NO: 104882 - DNA, 22 bp, Artificial Sequence
  Synthetic oligonucleotide; CTT chr11 5348329 5348350 5348346 5348351 +
taatctctctggcttccattct

SEQ ID NO: 104883 - DNA, 22 bp, Artificial Sequence
  Synthetic oligonucleotide; TTT chr11 5348330 5348351 5348347 5348352 +
aatctctctggcttccattcta

SEQ ID NO: 104884 - DNA, 22 bp, Artificial Sequence
  Synthetic oligonucleotide; TTA chr11 5348331 5348352 5348348 5348353 +
atctctctggcttccattctaa

SEQ ID NO: 104885 - DNA, 22 bp, Artificial Sequence
  Synthetic oligonucleotide; CTC chr11 5348336 5348357 5348353 5348358 +
tctggcttccattctaaccctg

SEQ ID NO: 104886 - DNA, 22 bp, Artificial Sequence
  Synthetic oligonucleotide; CTC chr11 5348338 5348359 5348355 5348360 +
tggcttccattctaaccctgag

SEQ ID NO: 104887 - DNA, 22 bp, Artificial Sequence
  Synthetic oligonucleotide; CTG chr11 5348340 5348361 5348357 5348362 +
gcttccattctaaccctgagag

SEQ ID NO: 104888 - DNA, 22 bp, Artificial Sequence
  Synthetic oligonucleotide; CTT chr11 5348344 5348365 5348361 5348366 +
ccattctaaccctgagagtccc

SEQ ID NO: 104889 - DNA, 22 bp, Artificial Sequence
  Synthetic oligonucleotide; TTC chr11 5348345 5348366 5348362 5348367 +
cattctaaccctgagagtcccc

SEQ ID NO: 104890 - DNA, 22 bp, Artificial Sequence
  Synthetic oligonucleotide; TTC chr11 5348350 5348371 5348367 5348372 +
taaccctgagagtccccctgcc

SEQ ID NO: 104891 - DNA, 22 bp, Artificial Sequence
  Synthetic oligonucleotide; CTA chr11 5348352 5348373 5348369 5348374 +
accctgagagtccccctgcccc

SEQ ID NO: 104892 - DNA, 22 bp, Artificial Sequence
  Synthetic oligonucleotide; CTG chr11 5348358 5348379 5348375 5348380 +
agagtccccctgcccccaaccc

SEQ ID NO: 104893 - DNA, 22 bp, Artificial Sequence
  Synthetic oligonucleotide; CTG chr11 5348370 5348391 5348387 5348392 +
cccccaaccccatgtcttttac

SEQ ID NO: 104894 - DNA, 22 bp, Artificial Sequence
  Synthetic oligonucleotide; CTT chr11 5348388 5348409 5348405 5348410 +
ttaccttagaagtccagataag

SEQ ID NO: 104895 - DNA, 22 bp, Artificial Sequence
  Synthetic oligonucleotide; TTT chr11 5348389 5348410 5348406 5348411 +
taccttagaagtccagataagt

SEQ ID NO: 104896 - DNA, 22 bp, Artificial Sequence
  Synthetic oligonucleotide; TTT chr11 5348390 5348411 5348407 5348412 +
accttagaagtccagataagtg

SEQ ID NO: 104897 - DNA, 22 bp, Artificial Sequence
  Synthetic oligonucleotide; TTA chr11 5348391 5348412 5348408 5348413 +
ccttagaagtccagataagtgc

SEQ ID NO: 104898 - DNA, 22 bp, Artificial Sequence
  Synthetic oligonucleotide; CTT chr11 5348395 5348416 5348412 5348417 +
agaagtccagataagtgccaaa

SEQ ID NO: 104899 - DNA, 22 bp, Artificial Sequence
  Synthetic oligonucleotide; TTA chr11 5348396 5348417 5348413 5348418 +
gaagtccagataagtgccaaat

SEQ ID NO: 104900 - DNA, 22 bp, Artificial Sequence
  Synthetic oligonucleotide; CTC chr11 5348431 5348452 5348448 5348453 +
ttccaaattcttgaggaggtat

SEQ ID NO: 104901 - DNA, 22 bp, Artificial Sequence
  Synthetic oligonucleotide; CTT chr11 5348433 5348454 5348450 5348455 +
ccaaattcttgaggaggtatac

SEQ ID NO: 104902 - DNA, 22 bp, Artificial Sequence
  Synthetic oligonucleotide; TTC chr11 5348434 5348455 5348451 5348456 +
caaattcttgaggaggtatacc

SEQ ID NO: 104903 - DNA, 22 bp, Artificial Sequence
  Synthetic oligonucleotide; TTC chr11 5348441 5348462 5348458 5348463 +
ttgaggaggtatacctctgtaa

SEQ ID NO: 104904 - DNA, 22 bp, Artificial Sequence
  Synthetic oligonucleotide; CTT chr11 5348443 5348464 5348460 5348465 +
gaggaggtatacctctgtaatc

SEQ ID NO: 104905 - DNA, 22 bp, Artificial Sequence
  Synthetic oligonucleotide; TTG chr11 5348444 5348465 5348461 5348466 +
aggaggtatacctctgtaatca

SEQ ID NO: 104906 - DNA, 22 bp, Artificial Sequence
  Synthetic oligonucleotide; CTC chr11 5348458 5348479 5348475 5348480 +
tgtaatcatcagaggttcaaat

SEQ ID NO: 104907 - DNA, 22 bp, Artificial Sequence
  Synthetic oligonucleotide; CTG chr11 5348460 5348481 5348477 5348482 +
taatcatcagaggttcaaatac

SEQ ID NO: 104908 - DNA, 22 bp, Artificial Sequence
  Synthetic oligonucleotide; TTC chr11 5348476 5348497 5348493 5348498 +
aaatactttctagaaaaaaagt

SEQ ID NO: 104909 - DNA, 22 bp, Artificial Sequence
  Synthetic oligonucleotide; CTT chr11 5348484 5348505 5348501 5348506 +
tctagaaaaaaagtcactatct

SEQ ID NO: 104910 - DNA, 22 bp, Artificial Sequence
  Synthetic oligonucleotide; TTT chr11 5348485 5348506 5348502 5348507 +
ctagaaaaaaagtcactatctg

SEQ ID NO: 104911 - DNA, 22 bp, Artificial Sequence
  Synthetic oligonucleotide; TTC chr11 5348486 5348507 5348503 5348508 +
tagaaaaaaagtcactatctga

SEQ ID NO: 104912 - DNA, 22 bp, Artificial Sequence
  Synthetic oligonucleotide; CTA chr11 5348488 5348509 5348505 5348510 +
gaaaaaaagtcactatctgacc

SEQ ID NO: 104913 - DNA, 22 bp, Artificial Sequence
  Synthetic oligonucleotide; CTA chr11 5348503 5348524 5348520 5348525 +
tctgaccatatgactaataaac

SEQ ID NO: 104914 - DNA, 22 bp, Artificial Sequence
  Synthetic oligonucleotide; CTG chr11 5348507 5348528 5348524 5348529 +
accatatgactaataaaccaat

SEQ ID NO: 104915 - DNA, 22 bp, Artificial Sequence
  Synthetic oligonucleotide; CTA chr11 5348519 5348540 5348536 5348541 +
ataaaccaattcaaaattaagc

SEQ ID NO: 104916 - DNA, 22 bp, Artificial Sequence
  Synthetic oligonucleotide; TTC chr11 5348531 5348552 5348548 5348553 +
aaaattaagcttggacggagct

SEQ ID NO: 104917 - DNA, 22 bp, Artificial Sequence
  Synthetic oligonucleotide; TTA chr11 5348538 5348559 5348555 5348560 +
agcttggacggagcttgggtta

SEQ ID NO: 104918 - DNA, 22 bp, Artificial Sequence
  Synthetic oligonucleotide; CTT chr11 5348543 5348564 5348560 5348565 +
ggacggagcttgggttatgtgt

SEQ ID NO: 104919 - DNA, 22 bp, Artificial Sequence
  Synthetic oligonucleotide; TTG chr11 5348544 5348565 5348561 5348566 +
gacggagcttgggttatgtgtg

SEQ ID NO: 104920 - DNA, 22 bp, Artificial Sequence
  Synthetic oligonucleotide; CTT chr11 5348554 5348575 5348571 5348576 +
gggttatgtgtgcctctggatc

SEQ ID NO: 104921 - DNA, 22 bp, Artificial Sequence
  Synthetic oligonucleotide; TTG chr11 5348555 5348576 5348572 5348577 +
ggttatgtgtgcctctggatca

SEQ ID NO: 104922 - DNA, 22 bp, Artificial Sequence
  Synthetic oligonucleotide; TTA chr11 5348560 5348581 5348577 5348582 +
tgtgtgcctctggatcaggggt

SEQ ID NO: 104923 - DNA, 22 bp, Artificial Sequence
  Synthetic oligonucleotide; CTC chr11 5348570 5348591 5348587 5348592 +
tggatcaggggtacagattcac

SEQ ID NO: 104924 - DNA, 22 bp, Artificial Sequence
  Synthetic oligonucleotide; CTG chr11 5348572 5348593 5348589 5348594 +
gatcaggggtacagattcacat

SEQ ID NO: 104925 - DNA, 22 bp, Artificial Sequence
  Synthetic oligonucleotide; TTC chr11 5348590 5348611 5348607 5348612 +
acatagcctgtgtgactttagc

SEQ ID NO: 104926 - DNA, 22 bp, Artificial Sequence
  Synthetic oligonucleotide; CTG chr11 5348600 5348621 5348617 5348622 +
tgtgactttagcacctggaaag

SEQ ID NO: 104927 - DNA, 22 bp, Artificial Sequence
  Synthetic oligonucleotide; CTT chr11 5348608 5348629 5348625 5348630 +
tagcacctggaaaggtttatat

SEQ ID NO: 104928 - DNA, 22 bp, Artificial Sequence
  Synthetic oligonucleotide; TTT chr11 5348609 5348630 5348626 5348631 +
agcacctggaaaggtttatatt

SEQ ID NO: 104929 - DNA, 22 bp, Artificial Sequence
  Synthetic oligonucleotide; TTA chr11 5348610 5348631 5348627 5348632 +
gcacctggaaaggtttatattg

SEQ ID NO: 104930 - DNA, 22 bp, Artificial Sequence
  Synthetic oligonucleotide; CTG chr11 5348617 5348638 5348634 5348639 +
gaaaggtttatattgtgtaaca

SEQ ID NO: 104931 - DNA, 22 bp, Artificial Sequence
  Synthetic oligonucleotide; TTT chr11 5348626 5348647 5348643 5348648 +
atattgtgtaacaggcatccac

SEQ ID NO: 104932 - DNA, 22 bp, Artificial Sequence
  Synthetic oligonucleotide; TTA chr11 5348627 5348648 5348644 5348649 +
tattgtgtaacaggcatccact

SEQ ID NO: 104933 - DNA, 22 bp, Artificial Sequence
  Synthetic oligonucleotide; TTG chr11 5348632 5348653 5348649 5348654 +
tgtaacaggcatccactactct

SEQ ID NO: 104934 - DNA, 22 bp, Artificial Sequence
  Synthetic oligonucleotide; CTA chr11 5348650 5348671 5348667 5348672 +
ctcttccatcttcttttgcctg

SEQ ID NO: 104935 - DNA, 22 bp, Artificial Sequence
  Synthetic oligonucleotide; CTC chr11 5348653 5348674 5348670 5348675 +
ttccatcttcttttgcctgctt

SEQ ID NO: 104936 - DNA, 22 bp, Artificial Sequence
  Synthetic oligonucleotide; CTT chr11 5348655 5348676 5348672 5348677 +
ccatcttcttttgcctgctttc

SEQ ID NO: 104937 - DNA, 22 bp, Artificial Sequence
  Synthetic oligonucleotide; TTC chr11 5348656 5348677 5348673 5348678 +
catcttcttttgcctgctttct

SEQ ID NO: 104938 - DNA, 22 bp, Artificial Sequence
  Synthetic oligonucleotide; CTT chr11 5348662 5348683 5348679 5348684 +
cttttgcctgctttcttctagc

SEQ ID NO: 104939 - DNA, 22 bp, Artificial Sequence
  Synthetic oligonucleotide; TTC chr11 5348663 5348684 5348680 5348685 +
ttttgcctgctttcttctagcc

SEQ ID NO: 104940 - DNA, 22 bp, Artificial Sequence
  Synthetic oligonucleotide; CTT chr11 5348665 5348686 5348682 5348687 +
ttgcctgctttcttctagccgc

SEQ ID NO: 104941 - DNA, 22 bp, Artificial Sequence
  Synthetic oligonucleotide; TTT chr11 5348666 5348687 5348683 5348688 +
tgcctgctttcttctagccgcc

SEQ ID NO: 104942 - DNA, 22 bp, Artificial Sequence
  Synthetic oligonucleotide; TTT chr11 5348667 5348688 5348684 5348689 +
gcctgctttcttctagccgccc

SEQ ID NO: 104943 - DNA, 22 bp, Artificial Sequence
  Synthetic oligonucleotide; TTG chr11 5348668 5348689 5348685 5348690 +
cctgctttcttctagccgccct

SEQ ID NO: 104944 - DNA, 22 bp, Artificial Sequence
  Synthetic oligonucleotide; CTG chr11 5348672 5348693 5348689 5348694 +
ctttcttctagccgccctggca

SEQ ID NO: 104945 - DNA, 22 bp, Artificial Sequence
  Synthetic oligonucleotide; CTT chr11 5348675 5348696 5348692 5348697 +
tcttctagccgccctggcagct

SEQ ID NO: 104946 - DNA, 22 bp, Artificial Sequence
  Synthetic oligonucleotide; TTT chr11 5348676 5348697 5348693 5348698 +
cttctagccgccctggcagctg

SEQ ID NO: 104947 - DNA, 22 bp, Artificial Sequence
  Synthetic oligonucleotide; TTC chr11 5348677 5348698 5348694 5348699 +
ttctagccgccctggcagctga

SEQ ID NO: 104948 - DNA, 22 bp, Artificial Sequence
  Synthetic oligonucleotide; CTT chr11 5348679 5348700 5348696 5348701 +
ctagccgccctggcagctgatt

SEQ ID NO: 104949 - DNA, 22 bp, Artificial Sequence
  Synthetic oligonucleotide; TTC chr11 5348680 5348701 5348697 5348702 +
tagccgccctggcagctgatta

SEQ ID NO: 104950 - DNA, 22 bp, Artificial Sequence
  Synthetic oligonucleotide; CTA chr11 5348682 5348703 5348699 5348704 +
gccgccctggcagctgattaga

SEQ ID NO: 104951 - DNA, 22 bp, Artificial Sequence
  Synthetic oligonucleotide; CTG chr11 5348691 5348712 5348708 5348713 +
gcagctgattagatagtaccca

SEQ ID NO: 104952 - DNA, 22 bp, Artificial Sequence
  Synthetic oligonucleotide; CTG chr11 5348698 5348719 5348715 5348720 +
attagatagtacccacccagac

SEQ ID NO: 104953 - DNA, 22 bp, Artificial Sequence
  Synthetic oligonucleotide; TTA chr11 5348702 5348723 5348719 5348724 +
gatagtacccacccagacggag

SEQ ID NO: 104954 - DNA, 22 bp, Artificial Sequence
  Synthetic oligonucleotide; CTG chr11 5348738 5348759 5348755 5348760 +
cctctcccagtctactgactca

SEQ ID NO: 104955 - DNA, 22 bp, Artificial Sequence
  Synthetic oligonucleotide; CTC chr11 5348742 5348763 5348759 5348764 +
tcccagtctactgactcaaatg

SEQ ID NO: 104956 - DNA, 22 bp, Artificial Sequence
  Synthetic oligonucleotide; CTC chr11 5348744 5348765 5348761 5348766 +
ccagtctactgactcaaatgtt

SEQ ID NO: 104957 - DNA, 22 bp, Artificial Sequence
  Synthetic oligonucleotide; CTA chr11 5348752 5348773 5348769 5348774 +
ctgactcaaatgttaatctcct

SEQ ID NO: 104958 - DNA, 22 bp, Artificial Sequence
  Synthetic oligonucleotide; CTG chr11 5348755 5348776 5348772 5348777 +
actcaaatgttaatctcctttg

SEQ ID NO: 104959 - DNA, 22 bp, Artificial Sequence
  Synthetic oligonucleotide; CTC chr11 5348759 5348780 5348776 5348781 +
aaatgttaatctcctttggcaa

SEQ ID NO: 104960 - DNA, 22 bp, Artificial Sequence
  Synthetic oligonucleotide; TTA chr11 5348767 5348788 5348784 5348789 +
atctcctttggcaacaccctta

SEQ ID NO: 104961 - DNA, 22 bp, Artificial Sequence
  Synthetic oligonucleotide; CTC chr11 5348772 5348793 5348789 5348794 +
ctttggcaacacccttacagca

SEQ ID NO: 104962 - DNA, 22 bp, Artificial Sequence
  Synthetic oligonucleotide; CTT chr11 5348775 5348796 5348792 5348797 +
tggcaacacccttacagcacac

SEQ ID NO: 104963 - DNA, 22 bp, Artificial Sequence
  Synthetic oligonucleotide; TTT chr11 5348776 5348797 5348793 5348798 +
ggcaacacccttacagcacacc

SEQ ID NO: 104964 - DNA, 22 bp, Artificial Sequence
  Synthetic oligonucleotide; TTG chr11 5348777 5348798 5348794 5348799 +
gcaacacccttacagcacaccc

SEQ ID NO: 104965 - DNA, 22 bp, Artificial Sequence
  Synthetic oligonucleotide; CTT chr11 5348788 5348809 5348805 5348810 +
acagcacacccaggaacaatac

SEQ ID NO: 104966 - DNA, 22 bp, Artificial Sequence
  Synthetic oligonucleotide; TTA chr11 5348789 5348810 5348806 5348811 +
cagcacacccaggaacaatact

SEQ ID NO: 104967 - DNA, 22 bp, Artificial Sequence
  Synthetic oligonucleotide; CTT chr11 5348812 5348833 5348829 5348834 +
tgcatccttcaatccaatcaag

SEQ ID NO: 104968 - DNA, 22 bp, Artificial Sequence
  Synthetic oligonucleotide; TTT chr11 5348813 5348834 5348830 5348835 +
gcatccttcaatccaatcaagt

SEQ ID NO: 104969 - DNA, 22 bp, Artificial Sequence
  Synthetic oligonucleotide; TTG chr11 5348814 5348835 5348831 5348836 +
catccttcaatccaatcaagtt

SEQ ID NO: 104970 - DNA, 22 bp, Artificial Sequence
  Synthetic oligonucleotide; CTT chr11 5348821 5348842 5348838 5348843 +
caatccaatcaagtttgcactc

SEQ ID NO: 104971 - DNA, 22 bp, Artificial Sequence
  Synthetic oligonucleotide; TTC chr11 5348822 5348843 5348839 5348844 +
aatccaatcaagtttgcactca

SEQ ID NO: 104972 - DNA, 22 bp, Artificial Sequence
  Synthetic oligonucleotide; TTT chr11 5348837 5348858 5348854 5348859 +
gcactcaatattaaccatcaca

SEQ ID NO: 104973 - DNA, 22 bp, Artificial Sequence
  Synthetic oligonucleotide; TTG chr11 5348838 5348859 5348855 5348860 +
cactcaatattaaccatcacag

SEQ ID NO: 104974 - DNA, 22 bp, Artificial Sequence
  Synthetic oligonucleotide; CTC chr11 5348843 5348864 5348860 5348865 +
aatattaaccatcacagaaagg

SEQ ID NO: 104975 - DNA, 22 bp, Artificial Sequence
  Synthetic oligonucleotide; TTA chr11 5348850 5348871 5348867 5348872 +
accatcacagaaaggataatag

SEQ ID NO: 104976 - DNA, 22 bp, Artificial Sequence
  Synthetic oligonucleotide; CTA chr11 5348909 5348930 5348926 5348931 +
agtgcttgagacagaaaagagt

SEQ ID NO: 104977 - DNA, 22 bp, Artificial Sequence
  Synthetic oligonucleotide; CTT chr11 5348916 5348937 5348933 5348938 +
gagacagaaaagagtgtcagga

SEQ ID NO: 104978 - DNA, 22 bp, Artificial Sequence
  Synthetic oligonucleotide; TTG chr11 5348917 5348938 5348934 5348939 +
agacagaaaagagtgtcaggaa

SEQ ID NO: 104979 - DNA, 22 bp, Artificial Sequence
  Synthetic oligonucleotide; TTA chr11 5348988 5349009 5349005 5349010 +
acatctgaatgggctcctgctg

SEQ ID NO: 104980 - DNA, 22 bp, Artificial Sequence
  Synthetic oligonucleotide; CTG chr11 5348995 5349016 5349012 5349017 +
aatgggctcctgctgaggtgtc

SEQ ID NO: 104981 - DNA, 22 bp, Artificial Sequence
  Synthetic oligonucleotide; CTC chr11 5349004 5349025 5349021 5349026 +
ctgctgaggtgtctgcatagag

SEQ ID NO: 104982 - DNA, 22 bp, Artificial Sequence
  Synthetic oligonucleotide; CTG chr11 5349007 5349028 5349024 5349029 +
ctgaggtgtctgcatagagcca

SEQ ID NO: 104983 - DNA, 22 bp, Artificial Sequence
  Synthetic oligonucleotide; CTG chr11 5349010 5349031 5349027 5349032 +
aggtgtctgcatagagccatca

SEQ ID NO: 104984 - DNA, 22 bp, Artificial Sequence
  Synthetic oligonucleotide; CTG chr11 5349019 5349040 5349036 5349041 +
catagagccatcagtttatgcg

SEQ ID NO: 104985 - DNA, 22 bp, Artificial Sequence
  Synthetic oligonucleotide; TTT chr11 5349036 5349057 5349053 5349058 +
atgcggcagagtttgagacttt

SEQ ID NO: 104986 - DNA, 22 bp, Artificial Sequence
  Synthetic oligonucleotide; TTA chr11 5349037 5349058 5349054 5349059 +
tgcggcagagtttgagactttg

SEQ ID NO: 104987 - DNA, 22 bp, Artificial Sequence
  Synthetic oligonucleotide; TTT chr11 5349050 5349071 5349067 5349072 +
gagactttgagaattagtttct

SEQ ID NO: 104988 - DNA, 22 bp, Artificial Sequence
  Synthetic oligonucleotide; TTG chr11 5349051 5349072 5349068 5349073 +
agactttgagaattagtttctc

SEQ ID NO: 104989 - DNA, 22 bp, Artificial Sequence
  Synthetic oligonucleotide; CTT chr11 5349057 5349078 5349074 5349079 +
tgagaattagtttctcattaat

SEQ ID NO: 104990 - DNA, 22 bp, Artificial Sequence
  Synthetic oligonucleotide; TTT chr11 5349058 5349079 5349075 5349080 +
gagaattagtttctcattaata

SEQ ID NO: 104991 - DNA, 22 bp, Artificial Sequence
  Synthetic oligonucleotide; TTG chr11 5349059 5349080 5349076 5349081 +
agaattagtttctcattaataa

SEQ ID NO: 104992 - DNA, 22 bp, Artificial Sequence
  Synthetic oligonucleotide; TTA chr11 5349066 5349087 5349083 5349088 +
gtttctcattaataaaaactca

SEQ ID NO: 104993 - DNA, 22 bp, Artificial Sequence
  Synthetic oligonucleotide; TTT chr11 5349070 5349091 5349087 5349092 +
ctcattaataaaaactcaagtc

SEQ ID NO: 104994 - DNA, 22 bp, Artificial Sequence
  Synthetic oligonucleotide; TTC chr11 5349071 5349092 5349088 5349093 +
tcattaataaaaactcaagtct

SEQ ID NO: 104995 - DNA, 22 bp, Artificial Sequence
  Synthetic oligonucleotide; CTC chr11 5349073 5349094 5349090 5349095 +
attaataaaaactcaagtctat

SEQ ID NO: 104996 - DNA, 22 bp, Artificial Sequence
  Synthetic oligonucleotide; TTA chr11 5349077 5349098 5349094 5349099 +
ataaaaactcaagtctattcta

SEQ ID NO: 104997 - DNA, 22 bp, Artificial Sequence
  Synthetic oligonucleotide; CTC chr11 5349087 5349108 5349104 5349109 +
aagtctattctatgacagagac

SEQ ID NO: 104998 - DNA, 22 bp, Artificial Sequence
  Synthetic oligonucleotide; CTA chr11 5349094 5349115 5349111 5349116 +
ttctatgacagagaccctggaa

SEQ ID NO: 104999 - DNA, 22 bp, Artificial Sequence
  Synthetic oligonucleotide; TTC chr11 5349097 5349118 5349114 5349119 +
tatgacagagaccctggaagag

SEQ ID NO: 105000 - DNA, 22 bp, Artificial Sequence
  Synthetic oligonucleotide; CTA chr11 5349099 5349120 5349116 5349121 +
tgacagagaccctggaagaggg

SEQ ID NO: 105001 - DNA, 22 bp, Artificial Sequence
  Synthetic oligonucleotide; CTG chr11 5349113 5349134 5349130 5349135 +
gaagagggtgaatggctgcagg

SEQ ID NO: 105002 - DNA, 22 bp, Artificial Sequence
  Synthetic oligonucleotide; CTG chr11 5349131 5349152 5349148 5349153 +
cagggatgaggcaaaggtttta

SEQ ID NO: 105003 - DNA, 22 bp, Artificial Sequence
  Synthetic oligonucleotide; TTT chr11 5349151 5349172 5349168 5349173 +
tagatttttatcccctctgaaa

SEQ ID NO: 105004 - DNA, 22 bp, Artificial Sequence
  Synthetic oligonucleotide; TTT chr11 5349152 5349173 5349169 5349174 +
agatttttatcccctctgaaac

SEQ ID NO: 105005 - DNA, 22 bp, Artificial Sequence
  Synthetic oligonucleotide; TTA chr11 5349153 5349174 5349170 5349175 +
gatttttatcccctctgaaact

SEQ ID NO: 105006 - DNA, 22 bp, Artificial Sequence
  Synthetic oligonucleotide; TTT chr11 5349158 5349179 5349175 5349180 +
ttatcccctctgaaactcacag

SEQ ID NO: 105007 - DNA, 22 bp, Artificial Sequence
  Synthetic oligonucleotide; TTT chr11 5349159 5349180 5349176 5349181 +
tatcccctctgaaactcacaga

SEQ ID NO: 105008 - DNA, 22 bp, Artificial Sequence
  Synthetic oligonucleotide; TTT chr11 5349160 5349181 5349177 5349182 +
atcccctctgaaactcacagat

SEQ ID NO: 105009 - DNA, 22 bp, Artificial Sequence
  Synthetic oligonucleotide; TTA chr11 5349161 5349182 5349178 5349183 +
tcccctctgaaactcacagatc

SEQ ID NO: 105010 - DNA, 22 bp, Artificial Sequence
  Synthetic oligonucleotide; CTC chr11 5349168 5349189 5349185 5349190 +
tgaaactcacagatcatctcat

SEQ ID NO: 105011 - DNA, 22 bp, Artificial Sequence
  Synthetic oligonucleotide; CTG chr11 5349170 5349191 5349187 5349192 +
aaactcacagatcatctcatat

SEQ ID NO: 105012 - DNA, 22 bp, Artificial Sequence
  Synthetic oligonucleotide; CTC chr11 5349176 5349197 5349193 5349198 +
acagatcatctcatataccaca

SEQ ID NO: 105013 - DNA, 22 bp, Artificial Sequence
  Synthetic oligonucleotide; CTC chr11 5349188 5349209 5349205 5349210 +
atataccacaaaagcaactgag

SEQ ID NO: 105014 - DNA, 22 bp, Artificial Sequence
  Synthetic oligonucleotide; CTG chr11 5349208 5349229 5349225 5349230 +
agtgaatcaagtgaaagcactc

SEQ ID NO: 105015 - DNA, 22 bp, Artificial Sequence
  Synthetic oligonucleotide; CTC chr11 5349230 5349251 5349247 5349252 +
agttttcaatatgaaaacagac

SEQ ID NO: 105016 - DNA, 22 bp, Artificial Sequence
  Synthetic oligonucleotide; TTT chr11 5349235 5349256 5349252 5349257 +
tcaatatgaaaacagacaagac

SEQ ID NO: 105017 - DNA, 22 bp, Artificial Sequence
  Synthetic oligonucleotide; TTT chr11 5349236 5349257 5349253 5349258 +
caatatgaaaacagacaagaca

SEQ ID NO: 105018 - DNA, 22 bp, Artificial Sequence
  Synthetic oligonucleotide; TTC chr11 5349237 5349258 5349254 5349259 +
aatatgaaaacagacaagacaa

SEQ ID NO: 105019 - DNA, 22 bp, Artificial Sequence
  Synthetic oligonucleotide; CTA chr11 5349266 5349287 5349283 5349288 +
ttttaaggattcttcccaaaaa

SEQ ID NO: 105020 - DNA, 22 bp, Artificial Sequence
  Synthetic oligonucleotide; TTT chr11 5349269 5349290 5349286 5349291 +
taaggattcttcccaaaaaatg

SEQ ID NO: 105021 - DNA, 22 bp, Artificial Sequence
  Synthetic oligonucleotide; TTT chr11 5349270 5349291 5349287 5349292 +
aaggattcttcccaaaaaatga

SEQ ID NO: 105022 - DNA, 22 bp, Artificial Sequence
  Synthetic oligonucleotide; TTA chr11 5349271 5349292 5349288 5349293 +
aggattcttcccaaaaaatgag

SEQ ID NO: 105023 - DNA, 22 bp, Artificial Sequence
  Synthetic oligonucleotide; TTC chr11 5349278 5349299 5349295 5349300 +
ttcccaaaaaatgaggtgtata

SEQ ID NO: 105024 - DNA, 22 bp, Artificial Sequence
  Synthetic oligonucleotide; CTT chr11 5349280 5349301 5349297 5349302 +
cccaaaaaatgaggtgtatata

SEQ ID NO: 105025 - DNA, 22 bp, Artificial Sequence
  Synthetic oligonucleotide; TTC chr11 5349281 5349302 5349298 5349303 +
ccaaaaaatgaggtgtatataa

SEQ ID NO: 105026 - DNA, 22 bp, Artificial Sequence
  Synthetic oligonucleotide; CTT chr11 5349321 5349342 5349338 5349343 +
gacacacggtagaaattcaaca

SEQ ID NO: 105027 - DNA, 22 bp, Artificial Sequence
  Synthetic oligonucleotide; TTG chr11 5349322 5349343 5349339 5349344 +
acacacggtagaaattcaacaa

SEQ ID NO: 105028 - DNA, 22 bp, Artificial Sequence
  Synthetic oligonucleotide; TTC chr11 5349339 5349360 5349356 5349361 +
aacaattatttgttccatacat

SEQ ID NO: 105029 - DNA, 22 bp, Artificial Sequence
  Synthetic oligonucleotide; TTA chr11 5349347 5349368 5349364 5349369 +
tttgttccatacatttgtttct

SEQ ID NO: 105030 - DNA, 22 bp, Artificial Sequence
  Synthetic oligonucleotide; TTT chr11 5349350 5349371 5349367 5349372 +
gttccatacatttgtttctcag

SEQ ID NO: 105031 - DNA, 22 bp, Artificial Sequence
  Synthetic oligonucleotide; TTG chr11 5349351 5349372 5349368 5349373 +
ttccatacatttgtttctcagc

SEQ ID NO: 105032 - DNA, 22 bp, Artificial Sequence
  Synthetic oligonucleotide; TTC chr11 5349354 5349375 5349371 5349376 +
catacatttgtttctcagcttt

SEQ ID NO: 105033 - DNA, 22 bp, Artificial Sequence
  Synthetic oligonucleotide; TTT chr11 5349363 5349384 5349380 5349385 +
gtttctcagctttattttccct

SEQ ID NO: 105034 - DNA, 22 bp, Artificial Sequence
  Synthetic oligonucleotide; TTG chr11 5349364 5349385 5349381 5349386 +
tttctcagctttattttcccta

SEQ ID NO: 105035 - DNA, 22 bp, Artificial Sequence
  Synthetic oligonucleotide; TTT chr11 5349367 5349388 5349384 5349389 +
ctcagctttattttccctatct

SEQ ID NO: 105036 - DNA, 22 bp, Artificial Sequence
  Synthetic oligonucleotide; TTC chr11 5349368 5349389 5349385 5349390 +
tcagctttattttccctatctg

SEQ ID NO: 105037 - DNA, 22 bp, Artificial Sequence
  Synthetic oligonucleotide; CTC chr11 5349370 5349391 5349387 5349392 +
agctttattttccctatctggt

SEQ ID NO: 105038 - DNA, 22 bp, Artificial Sequence
  Synthetic oligonucleotide; CTT chr11 5349375 5349396 5349392 5349397 +
tattttccctatctggtattcc

SEQ ID NO: 105039 - DNA, 22 bp, Artificial Sequence
  Synthetic oligonucleotide; TTT chr11 5349376 5349397 5349393 5349398 +
attttccctatctggtattcct

SEQ ID NO: 105040 - DNA, 22 bp, Artificial Sequence
  Synthetic oligonucleotide; TTA chr11 5349377 5349398 5349394 5349399 +
ttttccctatctggtattccta

SEQ ID NO: 105041 - DNA, 22 bp, Artificial Sequence
  Synthetic oligonucleotide; TTT chr11 5349380 5349401 5349397 5349402 +
tccctatctggtattcctactc

SEQ ID NO: 105042 - DNA, 22 bp, Artificial Sequence
  Synthetic oligonucleotide; TTT chr11 5349381 5349402 5349398 5349403 +
ccctatctggtattcctactcc

SEQ ID NO: 105043 - DNA, 22 bp, Artificial Sequence
  Synthetic oligonucleotide; TTC chr11 5349382 5349403 5349399 5349404 +
cctatctggtattcctactcct

SEQ ID NO: 105044 - DNA, 22 bp, Artificial Sequence
  Synthetic oligonucleotide; CTA chr11 5349386 5349407 5349403 5349408 +
tctggtattcctactcctgttt

SEQ ID NO: 105045 - DNA, 22 bp, Artificial Sequence
  Synthetic oligonucleotide; CTG chr11 5349390 5349411 5349407 5349412 +
gtattcctactcctgttttttt

SEQ ID NO: 105046 - DNA, 22 bp, Artificial Sequence
  Synthetic oligonucleotide; TTC chr11 5349396 5349417 5349413 5349418 +
ctactcctgtttttttttaatt

SEQ ID NO: 105047 - DNA, 22 bp, Artificial Sequence
  Synthetic oligonucleotide; CTA chr11 5349399 5349420 5349416 5349421 +
ctcctgtttttttttaatttat

SEQ ID NO: 105048 - DNA, 22 bp, Artificial Sequence
  Synthetic oligonucleotide; CTC chr11 5349402 5349423 5349419 5349424 +
ctgtttttttttaatttatcaa

SEQ ID NO: 105049 - DNA, 22 bp, Artificial Sequence
  Synthetic oligonucleotide; CTG chr11 5349405 5349426 5349422 5349427 +
tttttttttaatttatcaatta

SEQ ID NO: 105050 - DNA, 22 bp, Artificial Sequence
  Synthetic oligonucleotide; TTT chr11 5349408 5349429 5349425 5349430 +
ttttttaatttatcaattatat

SEQ ID NO: 105051 - DNA, 22 bp, Artificial Sequence
  Synthetic oligonucleotide; TTT chr11 5349409 5349430 5349426 5349431 +
tttttaatttatcaattatatg

SEQ ID NO: 105052 - DNA, 22 bp, Artificial Sequence
  Synthetic oligonucleotide; TTT chr11 5349410 5349431 5349427 5349432 +
ttttaatttatcaattatatgt

SEQ ID NO: 105053 - DNA, 22 bp, Artificial Sequence
  Synthetic oligonucleotide; TTT chr11 5349411 5349432 5349428 5349433 +
tttaatttatcaattatatgtt

SEQ ID NO: 105054 - DNA, 22 bp, Artificial Sequence
  Synthetic oligonucleotide; TTT chr11 5349412 5349433 5349429 5349434 +
ttaatttatcaattatatgttt

SEQ ID NO: 105055 - DNA, 22 bp, Artificial Sequence
  Synthetic oligonucleotide; TTT chr11 5349413 5349434 5349430 5349435 +
taatttatcaattatatgttta

SEQ ID NO: 105056 - DNA, 22 bp, Artificial Sequence
  Synthetic oligonucleotide; TTT chr11 5349414 5349435 5349431 5349436 +
aatttatcaattatatgtttat

SEQ ID NO: 105057 - DNA, 22 bp, Artificial Sequence
  Synthetic oligonucleotide; TTA chr11 5349415 5349436 5349432 5349437 +
atttatcaattatatgtttatt

SEQ ID NO: 105058 - DNA, 22 bp, Artificial Sequence
  Synthetic oligonucleotide; TTT chr11 5349419 5349440 5349436 5349441 +
atcaattatatgtttatttagt

SEQ ID NO: 105059 - DNA, 22 bp, Artificial Sequence
  Synthetic oligonucleotide; TTA chr11 5349420 5349441 5349437 5349442 +
tcaattatatgtttatttagta

SEQ ID NO: 105060 - DNA, 22 bp, Artificial Sequence
  Synthetic oligonucleotide; TTA chr11 5349427 5349448 5349444 5349449 +
tatgtttatttagtagtaatat

SEQ ID NO: 105061 - DNA, 22 bp, Artificial Sequence
  Synthetic oligonucleotide; TTT chr11 5349434 5349455 5349451 5349456 +
atttagtagtaatataacacaa

SEQ ID NO: 105062 - DNA, 22 bp, Artificial Sequence
  Synthetic oligonucleotide; TTA chr11 5349435 5349456 5349452 5349457 +
tttagtagtaatataacacaat

SEQ ID NO: 105063 - DNA, 22 bp, Artificial Sequence
  Synthetic oligonucleotide; TTT chr11 5349438 5349459 5349455 5349460 +
agtagtaatataacacaattaa

SEQ ID NO: 105064 - DNA, 22 bp, Artificial Sequence
  Synthetic oligonucleotide; TTA chr11 5349439 5349460 5349456 5349461 +
gtagtaatataacacaattaac

SEQ ID NO: 105065 - DNA, 22 bp, Artificial Sequence
  Synthetic oligonucleotide; TTA chr11 5349459 5349480 5349476 5349481 +
actagattaatgttctgtatta

SEQ ID NO: 105066 - DNA, 22 bp, Artificial Sequence
  Synthetic oligonucleotide; CTA chr11 5349463 5349484 5349480 5349485 +
gattaatgttctgtattatctt

SEQ ID NO: 105067 - DNA, 22 bp, Artificial Sequence
  Synthetic oligonucleotide; TTA chr11 5349468 5349489 5349485 5349490 +
atgttctgtattatcttttccc

SEQ ID NO: 105068 - DNA, 22 bp, Artificial Sequence
  Synthetic oligonucleotide; TTC chr11 5349474 5349495 5349491 5349496 +
tgtattatcttttccctcccag

SEQ ID NO: 105069 - DNA, 22 bp, Artificial Sequence
  Synthetic oligonucleotide; CTG chr11 5349476 5349497 5349493 5349498 +
tattatcttttccctcccagct

SEQ ID NO: 105070 - DNA, 22 bp, Artificial Sequence
  Synthetic oligonucleotide; TTA chr11 5349481 5349502 5349498 5349503 +
tcttttccctcccagctttatt

SEQ ID NO: 105071 - DNA, 22 bp, Artificial Sequence
  Synthetic oligonucleotide; CTT chr11 5349485 5349506 5349502 5349507 +
ttccctcccagctttatttagg

SEQ ID NO: 105072 - DNA, 22 bp, Artificial Sequence
  Synthetic oligonucleotide; TTT chr11 5349486 5349507 5349503 5349508 +
tccctcccagctttatttaggt

SEQ ID NO: 105073 - DNA, 22 bp, Artificial Sequence
  Synthetic oligonucleotide; TTT chr11 5349487 5349508 5349504 5349509 +
ccctcccagctttatttaggta

SEQ ID NO: 105074 - DNA, 22 bp, Artificial Sequence
  Synthetic oligonucleotide; TTC chr11 5349488 5349509 5349505 5349510 +
cctcccagctttatttaggtat

SEQ ID NO: 105075 - DNA, 22 bp, Artificial Sequence
  Synthetic oligonucleotide; CTC chr11 5349492 5349513 5349509 5349514 +
ccagctttatttaggtatattt

SEQ ID NO: 105076 - DNA, 22 bp, Artificial Sequence
  Synthetic oligonucleotide; CTT chr11 5349499 5349520 5349516 5349521 +
tatttaggtatatttaaaattt

SEQ ID NO: 105077 - DNA, 22 bp, Artificial Sequence
  Synthetic oligonucleotide; TTT chr11 5349500 5349521 5349517 5349522 +
atttaggtatatttaaaatttg

SEQ ID NO: 105078 - DNA, 22 bp, Artificial Sequence
  Synthetic oligonucleotide; TTA chr11 5349501 5349522 5349518 5349523 +
tttaggtatatttaaaatttgc

SEQ ID NO: 105079 - DNA, 22 bp, Artificial Sequence
  Synthetic oligonucleotide; TTT chr11 5349504 5349525 5349521 5349526 +
aggtatatttaaaatttgctaa

SEQ ID NO: 105080 - DNA, 22 bp, Artificial Sequence
  Synthetic oligonucleotide; TTA chr11 5349505 5349526 5349522 5349527 +
ggtatatttaaaatttgctaag

SEQ ID NO: 105081 - DNA, 22 bp, Artificial Sequence
  Synthetic oligonucleotide; TTT chr11 5349514 5349535 5349531 5349536 +
aaaatttgctaagaaagcagac

SEQ ID NO: 105082 - DNA, 22 bp, Artificial Sequence
  Synthetic oligonucleotide; TTA chr11 5349515 5349536 5349532 5349537 +
aaatttgctaagaaagcagacc

SEQ ID NO: 105083 - DNA, 22 bp, Artificial Sequence
  Synthetic oligonucleotide; TTT chr11 5349521 5349542 5349538 5349543 +
gctaagaaagcagacctcacat

SEQ ID NO: 105084 - DNA, 22 bp, Artificial Sequence
  Synthetic oligonucleotide; TTG chr11 5349522 5349543 5349539 5349544 +
ctaagaaagcagacctcacata

SEQ ID NO: 105085 - DNA, 22 bp, Artificial Sequence
  Synthetic oligonucleotide; CTA chr11 5349525 5349546 5349542 5349547 +
agaaagcagacctcacatattt

SEQ ID NO: 105086 - DNA, 22 bp, Artificial Sequence
  Synthetic oligonucleotide; CTC chr11 5349539 5349560 5349556 5349561 +
acatatttttactaccaaaaaa

SEQ ID NO: 105087 - DNA, 22 bp, Artificial Sequence
  Synthetic oligonucleotide; TTT chr11 5349547 5349568 5349564 5349569 +
ttactaccaaaaaaattaaagt

SEQ ID NO: 105088 - DNA, 22 bp, Artificial Sequence
  Synthetic oligonucleotide; TTT chr11 5349548 5349569 5349565 5349570 +
tactaccaaaaaaattaaagtt

SEQ ID NO: 105089 - DNA, 22 bp, Artificial Sequence
  Synthetic oligonucleotide; TTT chr11 5349549 5349570 5349566 5349571 +
actaccaaaaaaattaaagtta

SEQ ID NO: 105090 - DNA, 22 bp, Artificial Sequence
  Synthetic oligonucleotide; TTA chr11 5349550 5349571 5349567 5349572 +
ctaccaaaaaaattaaagttat

SEQ ID NO: 105091 - DNA, 22 bp, Artificial Sequence
  Synthetic oligonucleotide; CTA chr11 5349553 5349574 5349570 5349575 +
ccaaaaaaattaaagttattat

SEQ ID NO: 105092 - DNA, 22 bp, Artificial Sequence
  Synthetic oligonucleotide; TTA chr11 5349565 5349586 5349582 5349587 +
aagttattatgtgaggtgatag

SEQ ID NO: 105093 - DNA, 22 bp, Artificial Sequence
  Synthetic oligonucleotide; TTA chr11 5349571 5349592 5349588 5349593 +
ttatgtgaggtgatagatatat

SEQ ID NO: 105094 - DNA, 22 bp, Artificial Sequence
  Synthetic oligonucleotide; TTA chr11 5349574 5349595 5349591 5349596 +
tgtgaggtgatagatatattaa

SEQ ID NO: 105095 - DNA, 22 bp, Artificial Sequence
  Synthetic oligonucleotide; TTA chr11 5349595 5349616 5349612 5349617 +
attagtttgattatggtaatca

SEQ ID NO: 105096 - DNA, 22 bp, Artificial Sequence
  Synthetic oligonucleotide; TTA chr11 5349599 5349620 5349616 5349621 +
gtttgattatggtaatcattta

SEQ ID NO: 105097 - DNA, 22 bp, Artificial Sequence
  Synthetic oligonucleotide; TTT chr11 5349603 5349624 5349620 5349625 +
gattatggtaatcatttaacaa

SEQ ID NO: 105098 - DNA, 22 bp, Artificial Sequence
  Synthetic oligonucleotide; TTG chr11 5349604 5349625 5349621 5349626 +
attatggtaatcatttaacaat

SEQ ID NO: 105099 - DNA, 22 bp, Artificial Sequence
  Synthetic oligonucleotide; TTA chr11 5349608 5349629 5349625 5349630 +
tggtaatcatttaacaatgaat

SEQ ID NO: 105100 - DNA, 22 bp, Artificial Sequence
  Synthetic oligonucleotide; TTT chr11 5349620 5349641 5349637 5349642 +
aacaatgaatacctataataaa

SEQ ID NO: 105101 - DNA, 22 bp, Artificial Sequence
  Synthetic oligonucleotide; TTA chr11 5349621 5349642 5349638 5349643 +
acaatgaatacctataataaaa

SEQ ID NO: 105102 - DNA, 22 bp, Artificial Sequence
  Synthetic oligonucleotide; CTA chr11 5349635 5349656 5349652 5349657 +
taataaaacaataagttatata

SEQ ID NO: 105103 - DNA, 22 bp, Artificial Sequence
  Synthetic oligonucleotide; TTA chr11 5349653 5349674 5349670 5349675 +
tatacctatgtacaatttttat

SEQ ID NO: 105104 - DNA, 22 bp, Artificial Sequence
  Synthetic oligonucleotide; CTA chr11 5349661 5349682 5349678 5349683 +
tgtacaatttttatttgccata

SEQ ID NO: 105105 - DNA, 22 bp, Artificial Sequence
  Synthetic oligonucleotide; TTT chr11 5349671 5349692 5349688 5349693 +
ttatttgccatactgcttcttt

SEQ ID NO: 105106 - DNA, 22 bp, Artificial Sequence
  Synthetic oligonucleotide; TTT chr11 5349672 5349693 5349689 5349694 +
tatttgccatactgcttcttta

SEQ ID NO: 105107 - DNA, 22 bp, Artificial Sequence
  Synthetic oligonucleotide; TTT chr11 5349673 5349694 5349690 5349695 +
atttgccatactgcttctttaa

SEQ ID NO: 105108 - DNA, 22 bp, Artificial Sequence
  Synthetic oligonucleotide; TTA chr11 5349674 5349695 5349691 5349696 +
tttgccatactgcttctttaat

SEQ ID NO: 105109 - DNA, 22 bp, Artificial Sequence
  Synthetic oligonucleotide; TTT chr11 5349677 5349698 5349694 5349699 +
gccatactgcttctttaatcct

SEQ ID NO: 105110 - DNA, 22 bp, Artificial Sequence
  Synthetic oligonucleotide; TTG chr11 5349678 5349699 5349695 5349700 +
ccatactgcttctttaatcctg

SEQ ID NO: 105111 - DNA, 22 bp, Artificial Sequence
  Synthetic oligonucleotide; CTG chr11 5349686 5349707 5349703 5349708 +
cttctttaatcctgcataagct

SEQ ID NO: 105112 - DNA, 22 bp, Artificial Sequence
  Synthetic oligonucleotide; CTT chr11 5349689 5349710 5349706 5349711 +
ctttaatcctgcataagctgag

SEQ ID NO: 105113 - DNA, 22 bp, Artificial Sequence
  Synthetic oligonucleotide; TTC chr11 5349690 5349711 5349707 5349712 +
tttaatcctgcataagctgagt

SEQ ID NO: 105114 - DNA, 22 bp, Artificial Sequence
  Synthetic oligonucleotide; CTT chr11 5349692 5349713 5349709 5349714 +
taatcctgcataagctgagtat

SEQ ID NO: 105115 - DNA, 22 bp, Artificial Sequence
  Synthetic oligonucleotide; TTT chr11 5349693 5349714 5349710 5349715 +
aatcctgcataagctgagtatt

SEQ ID NO: 105116 - DNA, 22 bp, Artificial Sequence
  Synthetic oligonucleotide; TTA chr11 5349694 5349715 5349711 5349716 +
atcctgcataagctgagtattg

SEQ ID NO: 105117 - DNA, 22 bp, Artificial Sequence
  Synthetic oligonucleotide; CTG chr11 5349700 5349721 5349717 5349722 +
cataagctgagtattgtctgaa

SEQ ID NO: 105118 - DNA, 22 bp, Artificial Sequence
  Synthetic oligonucleotide; CTG chr11 5349709 5349730 5349726 5349731 +
agtattgtctgaacctctcact

SEQ ID NO: 105119 - DNA, 22 bp, Artificial Sequence
  Synthetic oligonucleotide; TTG chr11 5349716 5349737 5349733 5349738 +
tctgaacctctcactggcaggc

SEQ ID NO: 105120 - DNA, 22 bp, Artificial Sequence
  Synthetic oligonucleotide; CTG chr11 5349720 5349741 5349737 5349742 +
aacctctcactggcaggcagat

SEQ ID NO: 105121 - DNA, 22 bp, Artificial Sequence
  Synthetic oligonucleotide; CTC chr11 5349726 5349747 5349743 5349748 +
tcactggcaggcagattgagca

SEQ ID NO: 105122 - DNA, 22 bp, Artificial Sequence
  Synthetic oligonucleotide; CTC chr11 5349728 5349749 5349745 5349750 +
actggcaggcagattgagcaat

SEQ ID NO: 105123 - DNA, 22 bp, Artificial Sequence
  Synthetic oligonucleotide; CTG chr11 5349732 5349753 5349749 5349754 +
gcaggcagattgagcaataata

SEQ ID NO: 105124 - DNA, 22 bp, Artificial Sequence
  Synthetic oligonucleotide; TTG chr11 5349744 5349765 5349761 5349766 +
agcaataatacctccttttctc

SEQ ID NO: 105125 - DNA, 22 bp, Artificial Sequence
  Synthetic oligonucleotide; CTC chr11 5349758 5349779 5349775 5349780 +
cttttctcactttttgaggaca

SEQ ID NO: 105126 - DNA, 22 bp, Artificial Sequence
  Synthetic oligonucleotide; CTT chr11 5349761 5349782 5349778 5349783 +
ttctcactttttgaggacagag

SEQ ID NO: 105127 - DNA, 22 bp, Artificial Sequence
  Synthetic oligonucleotide; TTT chr11 5349762 5349783 5349779 5349784 +
tctcactttttgaggacagagt

SEQ ID NO: 105128 - DNA, 22 bp, Artificial Sequence
  Synthetic oligonucleotide; TTT chr11 5349763 5349784 5349780 5349785 +
ctcactttttgaggacagagtt

SEQ ID NO: 105129 - DNA, 22 bp, Artificial Sequence
  Synthetic oligonucleotide; TTC chr11 5349764 5349785 5349781 5349786 +
tcactttttgaggacagagttg

SEQ ID NO: 105130 - DNA, 22 bp, Artificial Sequence
  Synthetic oligonucleotide; CTC chr11 5349766 5349787 5349783 5349788 +
actttttgaggacagagttgct

SEQ ID NO: 105131 - DNA, 22 bp, Artificial Sequence
  Synthetic oligonucleotide; CTT chr11 5349770 5349791 5349787 5349792 +
tttgaggacagagttgctttcc

SEQ ID NO: 105132 - DNA, 22 bp, Artificial Sequence
  Synthetic oligonucleotide; TTT chr11 5349771 5349792 5349788 5349793 +
ttgaggacagagttgctttccc

SEQ ID NO: 105133 - DNA, 22 bp, Artificial Sequence
  Synthetic oligonucleotide; TTT chr11 5349772 5349793 5349789 5349794 +
tgaggacagagttgctttcccc

SEQ ID NO: 105134 - DNA, 22 bp, Artificial Sequence
  Synthetic oligonucleotide; TTT chr11 5349773 5349794 5349790 5349795 +
gaggacagagttgctttcccct

SEQ ID NO: 105135 - DNA, 22 bp, Artificial Sequence
  Synthetic oligonucleotide; TTG chr11 5349774 5349795 5349791 5349796 +
aggacagagttgctttcccctc

SEQ ID NO: 105136 - DNA, 22 bp, Artificial Sequence
  Synthetic oligonucleotide; TTG chr11 5349786 5349807 5349803 5349808 +
ctttcccctctacttccctcag

SEQ ID NO: 105137 - DNA, 22 bp, Artificial Sequence
  Synthetic oligonucleotide; CTT chr11 5349789 5349810 5349806 5349811 +
tcccctctacttccctcagtcc

SEQ ID NO: 105138 - DNA, 22 bp, Artificial Sequence
  Synthetic oligonucleotide; TTT chr11 5349790 5349811 5349807 5349812 +
cccctctacttccctcagtccc

SEQ ID NO: 105139 - DNA, 22 bp, Artificial Sequence
  Synthetic oligonucleotide; TTC chr11 5349791 5349812 5349808 5349813 +
ccctctacttccctcagtccca

SEQ ID NO: 105140 - DNA, 22 bp, Artificial Sequence
  Synthetic oligonucleotide; CTC chr11 5349796 5349817 5349813 5349818 +
tacttccctcagtcccaatgcc

SEQ ID NO: 105141 - DNA, 22 bp, Artificial Sequence
  Synthetic oligonucleotide; CTA chr11 5349798 5349819 5349815 5349820 +
cttccctcagtcccaatgcccc

SEQ ID NO: 105142 - DNA, 22 bp, Artificial Sequence
  Synthetic oligonucleotide; CTT chr11 5349801 5349822 5349818 5349823 +
ccctcagtcccaatgccccagg

SEQ ID NO: 105143 - DNA, 22 bp, Artificial Sequence
  Synthetic oligonucleotide; TTC chr11 5349802 5349823 5349819 5349824 +
cctcagtcccaatgccccaggc

SEQ ID NO: 105144 - DNA, 22 bp, Artificial Sequence
  Synthetic oligonucleotide; CTC chr11 5349806 5349827 5349823 5349828 +
agtcccaatgccccaggctcaa

SEQ ID NO: 105145 - DNA, 22 bp, Artificial Sequence
  Synthetic oligonucleotide; CTC chr11 5349826 5349847 5349843 5349848 +
aacgttacttttagctatgtca

SEQ ID NO: 105146 - DNA, 22 bp, Artificial Sequence
  Synthetic oligonucleotide; TTA chr11 5349833 5349854 5349850 5349855 +
cttttagctatgtcagaagttc

SEQ ID NO: 105147 - DNA, 22 bp, Artificial Sequence
  Synthetic oligonucleotide; CTT chr11 5349836 5349857 5349853 5349858 +
ttagctatgtcagaagttccca

SEQ ID NO: 105148 - DNA, 22 bp, Artificial Sequence
  Synthetic oligonucleotide; TTT chr11 5349837 5349858 5349854 5349859 +
tagctatgtcagaagttcccac

SEQ ID NO: 105149 - DNA, 22 bp, Artificial Sequence
  Synthetic oligonucleotide; TTT chr11 5349838 5349859 5349855 5349860 +
agctatgtcagaagttcccaca

SEQ ID NO: 105150 - DNA, 22 bp, Artificial Sequence
  Synthetic oligonucleotide; TTA chr11 5349839 5349860 5349856 5349861 +
gctatgtcagaagttcccacat

SEQ ID NO: 105151 - DNA, 22 bp, Artificial Sequence
  Synthetic oligonucleotide; CTA chr11 5349843 5349864 5349860 5349865 +
tgtcagaagttcccacattggc

SEQ ID NO: 105152 - DNA, 22 bp, Artificial Sequence
  Synthetic oligonucleotide; TTC chr11 5349855 5349876 5349872 5349877 +
ccacattggctcatcaatcttt

SEQ ID NO: 105153 - DNA, 22 bp, Artificial Sequence
  Synthetic oligonucleotide; TTG chr11 5349863 5349884 5349880 5349885 +
gctcatcaatcttttctccttt

SEQ ID NO: 105154 - DNA, 22 bp, Artificial Sequence
  Synthetic oligonucleotide; CTC chr11 5349867 5349888 5349884 5349889 +
atcaatcttttctcctttccct

SEQ ID NO: 105155 - DNA, 22 bp, Artificial Sequence
  Synthetic oligonucleotide; CTT chr11 5349876 5349897 5349893 5349898 +
ttctcctttccctttcccaccc

SEQ ID NO: 105156 - DNA, 22 bp, Artificial Sequence
  Synthetic oligonucleotide; TTT chr11 5349877 5349898 5349894 5349899 +
tctcctttccctttcccaccca

SEQ ID NO: 105157 - DNA, 22 bp, Artificial Sequence
  Synthetic oligonucleotide; TTT chr11 5349878 5349899 5349895 5349900 +
ctcctttccctttcccacccag

SEQ ID NO: 105158 - DNA, 22 bp, Artificial Sequence
  Synthetic oligonucleotide; TTC chr11 5349879 5349900 5349896 5349901 +
tcctttccctttcccacccaga

SEQ ID NO: 105159 - DNA, 22 bp, Artificial Sequence
  Synthetic oligonucleotide; CTC chr11 5349881 5349902 5349898 5349903 +
ctttccctttcccacccagaca

SEQ ID NO: 105160 - DNA, 22 bp, Artificial Sequence
  Synthetic oligonucleotide; CTT chr11 5349884 5349905 5349901 5349906 +
tccctttcccacccagacatat

SEQ ID NO: 105161 - DNA, 22 bp, Artificial Sequence
  Synthetic oligonucleotide; TTT chr11 5349885 5349906 5349902 5349907 +
ccctttcccacccagacatatc

SEQ ID NO: 105162 - DNA, 22 bp, Artificial Sequence
  Synthetic oligonucleotide; TTC chr11 5349886 5349907 5349903 5349908 +
cctttcccacccagacatatca

SEQ ID NO: 105163 - DNA, 22 bp, Artificial Sequence
  Synthetic oligonucleotide; CTT chr11 5349890 5349911 5349907 5349912 +
tcccacccagacatatcacatt

SEQ ID NO: 105164 - DNA, 22 bp, Artificial Sequence
  Synthetic oligonucleotide; TTT chr11 5349891 5349912 5349908 5349913 +
cccacccagacatatcacattt

SEQ ID NO: 105165 - DNA, 22 bp, Artificial Sequence
  Synthetic oligonucleotide; TTC chr11 5349892 5349913 5349909 5349914 +
ccacccagacatatcacatttt

SEQ ID NO: 105166 - DNA, 22 bp, Artificial Sequence
  Synthetic oligonucleotide; TTT chr11 5349913 5349934 5349930 5349935 +
tatctgctgattagagaaacta

SEQ ID NO: 105167 - DNA, 22 bp, Artificial Sequence
  Synthetic oligonucleotide; TTT chr11 5349914 5349935 5349931 5349936 +
atctgctgattagagaaactat

SEQ ID NO: 105168 - DNA, 22 bp, Artificial Sequence
  Synthetic oligonucleotide; TTA chr11 5349915 5349936 5349932 5349937 +
tctgctgattagagaaactata

SEQ ID NO: 105169 - DNA, 22 bp, Artificial Sequence
  Synthetic oligonucleotide; CTG chr11 5349919 5349940 5349936 5349941 +
ctgattagagaaactatagttt

SEQ ID NO: 105170 - DNA, 22 bp, Artificial Sequence
  Synthetic oligonucleotide; CTG chr11 5349922 5349943 5349939 5349944 +
attagagaaactatagtttaat

SEQ ID NO: 105171 - DNA, 22 bp, Artificial Sequence
  Synthetic oligonucleotide; TTA chr11 5349926 5349947 5349943 5349948 +
gagaaactatagtttaatatct

SEQ ID NO: 105172 - DNA, 22 bp, Artificial Sequence
  Synthetic oligonucleotide; CTA chr11 5349935 5349956 5349952 5349957 +
tagtttaatatctttatttaaa

SEQ ID NO: 105173 - DNA, 22 bp, Artificial Sequence
  Synthetic oligonucleotide; TTT chr11 5349941 5349962 5349958 5349963 +
aatatctttatttaaagtcaaa

SEQ ID NO: 105174 - DNA, 22 bp, Artificial Sequence
  Synthetic oligonucleotide; TTA chr11 5349942 5349963 5349959 5349964 +
atatctttatttaaagtcaaac

SEQ ID NO: 105175 - DNA, 22 bp, Artificial Sequence
  Synthetic oligonucleotide; CTT chr11 5349949 5349970 5349966 5349971 +
tatttaaagtcaaacacaggct

SEQ ID NO: 105176 - DNA, 22 bp, Artificial Sequence
  Synthetic oligonucleotide; TTT chr11 5349950 5349971 5349967 5349972 +
atttaaagtcaaacacaggctc

SEQ ID NO: 105177 - DNA, 22 bp, Artificial Sequence
  Synthetic oligonucleotide; TTA chr11 5349951 5349972 5349968 5349973 +
tttaaagtcaaacacaggctcc

SEQ ID NO: 105178 - DNA, 22 bp, Artificial Sequence
  Synthetic oligonucleotide; TTT chr11 5349954 5349975 5349971 5349976 +
aaagtcaaacacaggctcctaa

SEQ ID NO: 105179 - DNA, 22 bp, Artificial Sequence
  Synthetic oligonucleotide; TTA chr11 5349955 5349976 5349972 5349977 +
aagtcaaacacaggctcctaaa

SEQ ID NO: 105180 - DNA, 22 bp, Artificial Sequence
  Synthetic oligonucleotide; CTC chr11 5349972 5349993 5349989 5349994 +
ctaaaaaccccatcatcatctt

SEQ ID NO: 105181 - DNA, 22 bp, Artificial Sequence
  Synthetic oligonucleotide; CTA chr11 5349975 5349996 5349992 5349997 +
aaaaccccatcatcatcttata

SEQ ID NO: 105182 - DNA, 22 bp, Artificial Sequence
  Synthetic oligonucleotide; CTT chr11 5349994 5350015 5350011 5350016 +
atatctgttcccaaggcttcca

SEQ ID NO: 105183 - DNA, 22 bp, Artificial Sequence
  Synthetic oligonucleotide; TTA chr11 5349995 5350016 5350012 5350017 +
tatctgttcccaaggcttccac

SEQ ID NO: 105184 - DNA, 22 bp, Artificial Sequence
  Synthetic oligonucleotide; CTG chr11 5350001 5350022 5350018 5350023 +
ttcccaaggcttccacagaaaa

SEQ ID NO: 105185 - DNA, 22 bp, Artificial Sequence
  Synthetic oligonucleotide; TTC chr11 5350004 5350025 5350021 5350026 +
ccaaggcttccacagaaaaaaa

SEQ ID NO: 105186 - DNA, 22 bp, Artificial Sequence
  Synthetic oligonucleotide; CTT chr11 5350013 5350034 5350030 5350035 +
ccacagaaaaaaaggaaatcat

SEQ ID NO: 105187 - DNA, 22 bp, Artificial Sequence
  Synthetic oligonucleotide; TTC chr11 5350014 5350035 5350031 5350036 +
cacagaaaaaaaggaaatcatt

SEQ ID NO: 105188 - DNA, 22 bp, Artificial Sequence
  Synthetic oligonucleotide; TTT chr11 5350037 5350058 5350054 5350059 +
gacacacctctgggtgaataat

SEQ ID NO: 105189 - DNA, 22 bp, Artificial Sequence
  Synthetic oligonucleotide; TTG chr11 5350038 5350059 5350055 5350060 +
acacacctctgggtgaataatc

SEQ ID NO: 105190 - DNA, 22 bp, Artificial Sequence
  Synthetic oligonucleotide; CTC chr11 5350047 5350068 5350064 5350069 +
tgggtgaataatcctgacatgt

SEQ ID NO: 105191 - DNA, 22 bp, Artificial Sequence
  Synthetic oligonucleotide; CTG chr11 5350049 5350070 5350066 5350071 +
ggtgaataatcctgacatgtac

SEQ ID NO: 105192 - DNA, 22 bp, Artificial Sequence
  Synthetic oligonucleotide; CTG chr11 5350063 5350084 5350080 5350085 +
acatgtactcactagagaaaga

SEQ ID NO: 105193 - DNA, 22 bp, Artificial Sequence
  Synthetic oligonucleotide; CTC chr11 5350073 5350094 5350090 5350095 +
actagagaaagagaaaggaggt

SEQ ID NO: 105194 - DNA, 22 bp, Artificial Sequence
  Synthetic oligonucleotide; CTA chr11 5350077 5350098 5350094 5350099 +
gagaaagagaaaggaggtactt

SEQ ID NO: 105195 - DNA, 22 bp, Artificial Sequence
  Synthetic oligonucleotide; CTT chr11 5350099 5350120 5350116 5350121 +
ctctgaaacaataacaaaaaca

SEQ ID NO: 105196 - DNA, 22 bp, Artificial Sequence
  Synthetic oligonucleotide; TTC chr11 5350100 5350121 5350117 5350122 +
tctgaaacaataacaaaaacac

SEQ ID NO: 105197 - DNA, 22 bp, Artificial Sequence
  Synthetic oligonucleotide; CTC chr11 5350102 5350123 5350119 5350124 +
tgaaacaataacaaaaacacaa

SEQ ID NO: 105198 - DNA, 22 bp, Artificial Sequence
  Synthetic oligonucleotide; CTG chr11 5350104 5350125 5350121 5350126 +
aaacaataacaaaaacacaaaa

SEQ ID NO: 105199 - DNA, 22 bp, Artificial Sequence
  Synthetic oligonucleotide; TTA chr11 5350138 5350159 5350155 5350160 +
tccactctttacaaaacatttc

SEQ ID NO: 105200 - DNA, 22 bp, Artificial Sequence
  Synthetic oligonucleotide; CTC chr11 5350145 5350166 5350162 5350167 +
tttacaaaacatttccccttac

SEQ ID NO: 105201 - DNA, 22 bp, Artificial Sequence
  Synthetic oligonucleotide; CTT chr11 5350147 5350168 5350164 5350169 +
tacaaaacatttccccttactt

SEQ ID NO: 105202 - DNA, 22 bp, Artificial Sequence
  Synthetic oligonucleotide; TTT chr11 5350148 5350169 5350165 5350170 +
acaaaacatttccccttacttt

SEQ ID NO: 105203 - DNA, 22 bp, Artificial Sequence
  Synthetic oligonucleotide; TTA chr11 5350149 5350170 5350166 5350171 +
caaaacatttccccttactttg

SEQ ID NO: 105204 - DNA, 22 bp, Artificial Sequence
  Synthetic oligonucleotide; TTT chr11 5350159 5350180 5350176 5350181 +
ccccttactttgtgtcaagaga

SEQ ID NO: 105205 - DNA, 22 bp, Artificial Sequence
  Synthetic oligonucleotide; TTC chr11 5350160 5350181 5350177 5350182 +
cccttactttgtgtcaagagaa

SEQ ID NO: 105206 - DNA, 22 bp, Artificial Sequence
  Synthetic oligonucleotide; CTT chr11 5350165 5350186 5350182 5350187 +
actttgtgtcaagagaatgact

SEQ ID NO: 105207 - DNA, 22 bp, Artificial Sequence
  Synthetic oligonucleotide; TTA chr11 5350166 5350187 5350183 5350188 +
ctttgtgtcaagagaatgactg

SEQ ID NO: 105208 - DNA, 22 bp, Artificial Sequence
  Synthetic oligonucleotide; CTT chr11 5350169 5350190 5350186 5350191 +
tgtgtcaagagaatgactgaga

SEQ ID NO: 105209 - DNA, 22 bp, Artificial Sequence
  Synthetic oligonucleotide; TTT chr11 5350170 5350191 5350187 5350192 +
gtgtcaagagaatgactgagaa

SEQ ID NO: 105210 - DNA, 22 bp, Artificial Sequence
  Synthetic oligonucleotide; TTG chr11 5350171 5350192 5350188 5350193 +
tgtcaagagaatgactgagaag

SEQ ID NO: 105211 - DNA, 22 bp, Artificial Sequence
  Synthetic oligonucleotide; CTG chr11 5350188 5350209 5350205 5350210 +
agaagacagaaatcactagtag

SEQ ID NO: 105212 - DNA, 22 bp, Artificial Sequence
  Synthetic oligonucleotide; CTA chr11 5350206 5350227 5350223 5350228 +
gtagtctttacaggttatgtaa

SEQ ID NO: 105213 - DNA, 22 bp, Artificial Sequence
  Synthetic oligonucleotide; CTT chr11 5350214 5350235 5350231 5350236 +
tacaggttatgtaaccaaatct

SEQ ID NO: 105214 - DNA, 22 bp, Artificial Sequence
  Synthetic oligonucleotide; TTT chr11 5350215 5350236 5350232 5350237 +
acaggttatgtaaccaaatctc

SEQ ID NO: 105215 - DNA, 22 bp, Artificial Sequence
  Synthetic oligonucleotide; TTA chr11 5350216 5350237 5350233 5350238 +
caggttatgtaaccaaatctca

SEQ ID NO: 105216 - DNA, 22 bp, Artificial Sequence
  Synthetic oligonucleotide; TTA chr11 5350223 5350244 5350240 5350245 +
tgtaaccaaatctcaagattaa

SEQ ID NO: 105217 - DNA, 22 bp, Artificial Sequence
  Synthetic oligonucleotide; CTC chr11 5350237 5350258 5350254 5350259 +
aagattaaattactttcccaag

SEQ ID NO: 105218 - DNA, 22 bp, Artificial Sequence
  Synthetic oligonucleotide; TTA chr11 5350244 5350265 5350261 5350266 +
aattactttcccaagatcatta

SEQ ID NO: 105219 - DNA, 22 bp, Artificial Sequence
  Synthetic oligonucleotide; TTA chr11 5350249 5350270 5350266 5350271 +
ctttcccaagatcattattgtt

SEQ ID NO: 105220 - DNA, 22 bp, Artificial Sequence
  Synthetic oligonucleotide; CTT chr11 5350252 5350273 5350269 5350274 +
tcccaagatcattattgttaga

SEQ ID NO: 105221 - DNA, 22 bp, Artificial Sequence
  Synthetic oligonucleotide; TTT chr11 5350253 5350274 5350270 5350275 +
cccaagatcattattgttagaa

SEQ ID NO: 105222 - DNA, 22 bp, Artificial Sequence
  Synthetic oligonucleotide; TTC chr11 5350254 5350275 5350271 5350276 +
ccaagatcattattgttagaaa

SEQ ID NO: 105223 - DNA, 22 bp, Artificial Sequence
  Synthetic oligonucleotide; TTA chr11 5350266 5350287 5350283 5350288 +
ttgttagaaagagcagagctga

SEQ ID NO: 105224 - DNA, 22 bp, Artificial Sequence
  Synthetic oligonucleotide; TTG chr11 5350269 5350290 5350286 5350291 +
ttagaaagagcagagctgaaac

SEQ ID NO: 105225 - DNA, 22 bp, Artificial Sequence
  Synthetic oligonucleotide; TTA chr11 5350272 5350293 5350289 5350294 +
gaaagagcagagctgaaacttc

SEQ ID NO: 105226 - DNA, 22 bp, Artificial Sequence
  Synthetic oligonucleotide; CTG chr11 5350287 5350308 5350304 5350309 +
aaacttcaacaaattcttctga

SEQ ID NO: 105227 - DNA, 22 bp, Artificial Sequence
  Synthetic oligonucleotide; CTT chr11 5350293 5350314 5350310 5350315 +
caacaaattcttctgaaaatga

SEQ ID NO: 105228 - DNA, 22 bp, Artificial Sequence
  Synthetic oligonucleotide; TTC chr11 5350294 5350315 5350311 5350316 +
aacaaattcttctgaaaatgaa

SEQ ID NO: 105229 - DNA, 22 bp, Artificial Sequence
  Synthetic oligonucleotide; TTC chr11 5350303 5350324 5350320 5350325 +
ttctgaaaatgaaagtccagta

SEQ ID NO: 105230 - DNA, 22 bp, Artificial Sequence
  Synthetic oligonucleotide; CTT chr11 5350305 5350326 5350322 5350327 +
ctgaaaatgaaagtccagtaat

SEQ ID NO: 105231 - DNA, 22 bp, Artificial Sequence
  Synthetic oligonucleotide; TTC chr11 5350306 5350327 5350323 5350328 +
tgaaaatgaaagtccagtaatc

SEQ ID NO: 105232 - DNA, 22 bp, Artificial Sequence
  Synthetic oligonucleotide; CTG chr11 5350308 5350329 5350325 5350330 +
aaaatgaaagtccagtaatctt

SEQ ID NO: 105233 - DNA, 22 bp, Artificial Sequence
  Synthetic oligonucleotide; CTT chr11 5350330 5350351 5350347 5350352 +
ggatgcattcttttcatggaca

SEQ ID NO: 105234 - DNA, 22 bp, Artificial Sequence
  Synthetic oligonucleotide; TTG chr11 5350331 5350352 5350348 5350353 +
gatgcattcttttcatggacag

SEQ ID NO: 105235 - DNA, 22 bp, Artificial Sequence
  Synthetic oligonucleotide; TTC chr11 5350340 5350361 5350357 5350362 +
ttttcatggacagaaagaggtc

SEQ ID NO: 105236 - DNA, 22 bp, Artificial Sequence
  Synthetic oligonucleotide; CTT chr11 5350342 5350363 5350359 5350364 +
ttcatggacagaaagaggtctt

SEQ ID NO: 105237 - DNA, 22 bp, Artificial Sequence
  Synthetic oligonucleotide; TTT chr11 5350343 5350364 5350360 5350365 +
tcatggacagaaagaggtcttg

SEQ ID NO: 105238 - DNA, 22 bp, Artificial Sequence
  Synthetic oligonucleotide; TTT chr11 5350344 5350365 5350361 5350366 +
catggacagaaagaggtcttgt

SEQ ID NO: 105239 - DNA, 22 bp, Artificial Sequence
  Synthetic oligonucleotide; TTC chr11 5350345 5350366 5350362 5350367 +
atggacagaaagaggtcttgta

SEQ ID NO: 105240 - DNA, 22 bp, Artificial Sequence
  Synthetic oligonucleotide; CTT chr11 5350364 5350385 5350381 5350386 +
gtaaatcgtgcataaatttaca

SEQ ID NO: 105241 - DNA, 22 bp, Artificial Sequence
  Synthetic oligonucleotide; TTG chr11 5350365 5350386 5350382 5350387 +
taaatcgtgcataaatttacat

SEQ ID NO: 105242 - DNA, 22 bp, Artificial Sequence
  Synthetic oligonucleotide; TTT chr11 5350383 5350404 5350400 5350405 +
acatcaatatgctctttcaata

SEQ ID NO: 105243 - DNA, 22 bp, Artificial Sequence
  Synthetic oligonucleotide; TTA chr11 5350384 5350405 5350401 5350406 +
catcaatatgctctttcaatag

SEQ ID NO: 105244 - DNA, 22 bp, Artificial Sequence
  Synthetic oligonucleotide; CTC chr11 5350397 5350418 5350414 5350419 +
tttcaatagtatatgagatgta

SEQ ID NO: 105245 - DNA, 22 bp, Artificial Sequence
  Synthetic oligonucleotide; CTT chr11 5350399 5350420 5350416 5350421 +
tcaatagtatatgagatgtata

SEQ ID NO: 105246 - DNA, 22 bp, Artificial Sequence
  Synthetic oligonucleotide; TTT chr11 5350400 5350421 5350417 5350422 +
caatagtatatgagatgtatag

SEQ ID NO: 105247 - DNA, 22 bp, Artificial Sequence
  Synthetic oligonucleotide; TTC chr11 5350401 5350422 5350418 5350423 +
aatagtatatgagatgtatagt

SEQ ID NO: 105248 - DNA, 22 bp, Artificial Sequence
  Synthetic oligonucleotide; CTA chr11 5350453 5350474 5350470 5350475 +
ttttctctggctcatgccacca

SEQ ID NO: 105249 - DNA, 22 bp, Artificial Sequence
  Synthetic oligonucleotide; TTT chr11 5350456 5350477 5350473 5350478 +
tctctggctcatgccaccaaca

SEQ ID NO: 105250 - DNA, 22 bp, Artificial Sequence
  Synthetic oligonucleotide; TTT chr11 5350457 5350478 5350474 5350479 +
ctctggctcatgccaccaacac

SEQ ID NO: 105251 - DNA, 22 bp, Artificial Sequence
  Synthetic oligonucleotide; TTC chr11 5350458 5350479 5350475 5350480 +
tctggctcatgccaccaacaca

SEQ ID NO: 105252 - DNA, 22 bp, Artificial Sequence
  Synthetic oligonucleotide; CTC chr11 5350460 5350481 5350477 5350482 +
tggctcatgccaccaacacaca

SEQ ID NO: 105253 - DNA, 22 bp, Artificial Sequence
  Synthetic oligonucleotide; CTG chr11 5350462 5350483 5350479 5350484 +
gctcatgccaccaacacacaat

SEQ ID NO: 105254 - DNA, 22 bp, Artificial Sequence
  Synthetic oligonucleotide; CTC chr11 5350466 5350487 5350483 5350488 +
atgccaccaacacacaatttat

SEQ ID NO: 105255 - DNA, 22 bp, Artificial Sequence
  Synthetic oligonucleotide; TTT chr11 5350486 5350507 5350503 5350508 +
atgtattctcagaggttggctg

SEQ ID NO: 105256 - DNA, 22 bp, Artificial Sequence
  Synthetic oligonucleotide; TTA chr11 5350487 5350508 5350504 5350509 +
tgtattctcagaggttggctgc

SEQ ID NO: 105257 - DNA, 22 bp, Artificial Sequence
  Synthetic oligonucleotide; TTC chr11 5350494 5350515 5350511 5350516 +
tcagaggttggctgcctgcacc

SEQ ID NO: 105258 - DNA, 22 bp, Artificial Sequence
  Synthetic oligonucleotide; CTC chr11 5350496 5350517 5350513 5350518 +
agaggttggctgcctgcaccag

SEQ ID NO: 105259 - DNA, 22 bp, Artificial Sequence
  Synthetic oligonucleotide; TTG chr11 5350504 5350525 5350521 5350526 +
gctgcctgcaccagctgaaatc

SEQ ID NO: 105260 - DNA, 22 bp, Artificial Sequence
  Synthetic oligonucleotide; CTG chr11 5350508 5350529 5350525 5350530 +
cctgcaccagctgaaatcttag

SEQ ID NO: 105261 - DNA, 22 bp, Artificial Sequence
  Synthetic oligonucleotide; CTG chr11 5350512 5350533 5350529 5350534 +
caccagctgaaatcttagaatt

SEQ ID NO: 105262 - DNA, 22 bp, Artificial Sequence
  Synthetic oligonucleotide; CTG chr11 5350521 5350542 5350538 5350543 +
aaatcttagaattctaatgagt

SEQ ID NO: 105263 - DNA, 22 bp, Artificial Sequence
  Synthetic oligonucleotide; CTT chr11 5350528 5350549 5350545 5350550 +
agaattctaatgagtcacagag

SEQ ID NO: 105264 - DNA, 22 bp, Artificial Sequence
  Synthetic oligonucleotide; TTA chr11 5350529 5350550 5350546 5350551 +
gaattctaatgagtcacagagc

SEQ ID NO: 105265 - DNA, 22 bp, Artificial Sequence
  Synthetic oligonucleotide; TTC chr11 5350535 5350556 5350552 5350557 +
taatgagtcacagagccttctc

SEQ ID NO: 105266 - DNA, 22 bp, Artificial Sequence
  Synthetic oligonucleotide; CTA chr11 5350537 5350558 5350554 5350559 +
atgagtcacagagccttctcac

SEQ ID NO: 105267 - DNA, 22 bp, Artificial Sequence
  Synthetic oligonucleotide; CTT chr11 5350554 5350575 5350571 5350576 +
ctcacttttgtcaaatcccatc

SEQ ID NO: 105268 - DNA, 22 bp, Artificial Sequence
  Synthetic oligonucleotide; TTC chr11 5350555 5350576 5350572 5350577 +
tcacttttgtcaaatcccatca

SEQ ID NO: 105269 - DNA, 22 bp, Artificial Sequence
  Synthetic oligonucleotide; CTC chr11 5350557 5350578 5350574 5350579 +
acttttgtcaaatcccatcaga

SEQ ID NO: 105270 - DNA, 22 bp, Artificial Sequence
  Synthetic oligonucleotide; CTT chr11 5350561 5350582 5350578 5350583 +
ttgtcaaatcccatcagattcc

SEQ ID NO: 105271 - DNA, 22 bp, Artificial Sequence
  Synthetic oligonucleotide; TTT chr11 5350562 5350583 5350579 5350584 +
tgtcaaatcccatcagattcca

SEQ ID NO: 105272 - DNA, 22 bp, Artificial Sequence
  Synthetic oligonucleotide; TTT chr11 5350563 5350584 5350580 5350585 +
gtcaaatcccatcagattccat

SEQ ID NO: 105273 - DNA, 22 bp, Artificial Sequence
  Synthetic oligonucleotide; TTG chr11 5350564 5350585 5350581 5350586 +
tcaaatcccatcagattccata

SEQ ID NO: 105274 - DNA, 22 bp, Artificial Sequence
  Synthetic oligonucleotide; TTC chr11 5350582 5350603 5350599 5350604 +
catagttttaaaaaaaaaattc

SEQ ID NO: 105275 - DNA, 22 bp, Artificial Sequence
  Synthetic oligonucleotide; TTT chr11 5350590 5350611 5350607 5350612 +
taaaaaaaaaattctccttgat

SEQ ID NO: 105276 - DNA, 22 bp, Artificial Sequence
  Synthetic oligonucleotide; TTT chr11 5350591 5350612 5350608 5350613 +
aaaaaaaaaattctccttgatc

SEQ ID NO: 105277 - DNA, 22 bp, Artificial Sequence
  Synthetic oligonucleotide; TTA chr11 5350592 5350613 5350609 5350614 +
aaaaaaaaattctccttgatct

SEQ ID NO: 105278 - DNA, 22 bp, Artificial Sequence
  Synthetic oligonucleotide; TTC chr11 5350604 5350625 5350621 5350626 +
tccttgatcttgcctaaattac

SEQ ID NO: 105279 - DNA, 22 bp, Artificial Sequence
  Synthetic oligonucleotide; CTC chr11 5350606 5350627 5350623 5350628 +
cttgatcttgcctaaattacca

SEQ ID NO: 105280 - DNA, 22 bp, Artificial Sequence
  Synthetic oligonucleotide; CTT chr11 5350609 5350630 5350626 5350631 +
gatcttgcctaaattaccaatt

SEQ ID NO: 105281 - DNA, 22 bp, Artificial Sequence
  Synthetic oligonucleotide; TTG chr11 5350610 5350631 5350627 5350632 +
atcttgcctaaattaccaattt

SEQ ID NO: 105282 - DNA, 22 bp, Artificial Sequence
  Synthetic oligonucleotide; CTT chr11 5350615 5350636 5350632 5350637 +
gcctaaattaccaatttttatt

SEQ ID NO: 105283 - DNA, 22 bp, Artificial Sequence
  Synthetic oligonucleotide; TTG chr11 5350616 5350637 5350633 5350638 +
cctaaattaccaatttttattt

SEQ ID NO: 105284 - DNA, 22 bp, Artificial Sequence
  Synthetic oligonucleotide; CTA chr11 5350620 5350641 5350637 5350642 +
aattaccaatttttatttttgc

SEQ ID NO: 105285 - DNA, 22 bp, Artificial Sequence
  Synthetic oligonucleotide; TTA chr11 5350625 5350646 5350642 5350647 +
ccaatttttatttttgcatcac

SEQ ID NO: 105286 - DNA, 22 bp, Artificial Sequence
  Synthetic oligonucleotide; TTT chr11 5350632 5350653 5350649 5350654 +
ttatttttgcatcaccaagtag

SEQ ID NO: 105287 - DNA, 22 bp, Artificial Sequence
  Synthetic oligonucleotide; TTT chr11 5350633 5350654 5350650 5350655 +
tatttttgcatcaccaagtagg

SEQ ID NO: 105288 - DNA, 22 bp, Artificial Sequence
  Synthetic oligonucleotide; TTT chr11 5350634 5350655 5350651 5350656 +
atttttgcatcaccaagtaggt

SEQ ID NO: 105289 - DNA, 22 bp, Artificial Sequence
  Synthetic oligonucleotide; TTA chr11 5350635 5350656 5350652 5350657 +
tttttgcatcaccaagtaggtg

SEQ ID NO: 105290 - DNA, 22 bp, Artificial Sequence
  Synthetic oligonucleotide; TTT chr11 5350638 5350659 5350655 5350660 +
ttgcatcaccaagtaggtgata

SEQ ID NO: 105291 - DNA, 22 bp, Artificial Sequence
  Synthetic oligonucleotide; TTT chr11 5350639 5350660 5350656 5350661 +
tgcatcaccaagtaggtgatat

SEQ ID NO: 105292 - DNA, 22 bp, Artificial Sequence
  Synthetic oligonucleotide; TTT chr11 5350640 5350661 5350657 5350662 +
gcatcaccaagtaggtgatatg

SEQ ID NO: 105293 - DNA, 22 bp, Artificial Sequence
  Synthetic oligonucleotide; TTG chr11 5350641 5350662 5350658 5350663 +
catcaccaagtaggtgatatgc

SEQ ID NO: 105294 - DNA, 22 bp, Artificial Sequence
  Synthetic oligonucleotide; TTT chr11 5350674 5350695 5350691 5350696 +
ggtgctattatcaattagtgcc

SEQ ID NO: 105295 - DNA, 22 bp, Artificial Sequence
  Synthetic oligonucleotide; TTG chr11 5350675 5350696 5350692 5350697 +
gtgctattatcaattagtgcct

SEQ ID NO: 105296 - DNA, 22 bp, Artificial Sequence
  Synthetic oligonucleotide; CTA chr11 5350681 5350702 5350698 5350703 +
ttatcaattagtgccttcaaaa

SEQ ID NO: 105297 - DNA, 22 bp, Artificial Sequence
  Synthetic oligonucleotide; TTA chr11 5350684 5350705 5350701 5350706 +
tcaattagtgccttcaaaagct

SEQ ID NO: 105298 - DNA, 22 bp, Artificial Sequence
  Synthetic oligonucleotide; TTA chr11 5350691 5350712 5350708 5350713 +
gtgccttcaaaagcttatcatc

SEQ ID NO: 105299 - DNA, 22 bp, Artificial Sequence
  Synthetic oligonucleotide; CTT chr11 5350698 5350719 5350715 5350720 +
caaaagcttatcatcaaatcca

SEQ ID NO: 105300 - DNA, 22 bp, Artificial Sequence
  Synthetic oligonucleotide; TTC chr11 5350699 5350720 5350716 5350721 +
aaaagcttatcatcaaatccac

SEQ ID NO: 105301 - DNA, 22 bp, Artificial Sequence
  Synthetic oligonucleotide; CTT chr11 5350707 5350728 5350724 5350729 +
atcatcaaatccacattttact

SEQ ID NO: 105302 - DNA, 22 bp, Artificial Sequence
  Synthetic oligonucleotide; TTA chr11 5350708 5350729 5350725 5350730 +
tcatcaaatccacattttactg

SEQ ID NO: 105303 - DNA, 22 bp, Artificial Sequence
  Synthetic oligonucleotide; TTT chr11 5350725 5350746 5350742 5350747 +
tactgtttattcttcaatttat

SEQ ID NO: 105304 - DNA, 22 bp, Artificial Sequence
  Synthetic oligonucleotide; TTT chr11 5350726 5350747 5350743 5350748 +
actgtttattcttcaatttata

SEQ ID NO: 105305 - DNA, 22 bp, Artificial Sequence
  Synthetic oligonucleotide; TTA chr11 5350727 5350748 5350744 5350749 +
ctgtttattcttcaatttatat

SEQ ID NO: 105306 - DNA, 22 bp, Artificial Sequence
  Synthetic oligonucleotide; CTG chr11 5350730 5350751 5350747 5350752 +
tttattcttcaatttatattat

SEQ ID NO: 105307 - DNA, 22 bp, Artificial Sequence
  Synthetic oligonucleotide; TTT chr11 5350733 5350754 5350750 5350755 +
attcttcaatttatattatgaa

SEQ ID NO: 105308 - DNA, 22 bp, Artificial Sequence
  Synthetic oligonucleotide; TTA chr11 5350734 5350755 5350751 5350756 +
ttcttcaatttatattatgaaa

SEQ ID NO: 105309 - DNA, 22 bp, Artificial Sequence
  Synthetic oligonucleotide; TTC chr11 5350737 5350758 5350754 5350759 +
ttcaatttatattatgaaaatt

SEQ ID NO: 105310 - DNA, 22 bp, Artificial Sequence
  Synthetic oligonucleotide; CTT chr11 5350739 5350760 5350756 5350761 +
caatttatattatgaaaatttg

SEQ ID NO: 105311 - DNA, 22 bp, Artificial Sequence
  Synthetic oligonucleotide; TTC chr11 5350740 5350761 5350757 5350762 +
aatttatattatgaaaatttga

SEQ ID NO: 105312 - DNA, 22 bp, Artificial Sequence
  Synthetic oligonucleotide; TTT chr11 5350745 5350766 5350762 5350767 +
atattatgaaaatttgaattct

SEQ ID NO: 105313 - DNA, 22 bp, Artificial Sequence
  Synthetic oligonucleotide; TTA chr11 5350746 5350767 5350763 5350768 +
tattatgaaaatttgaattctt

SEQ ID NO: 105314 - DNA, 22 bp, Artificial Sequence
  Synthetic oligonucleotide; TTA chr11 5350751 5350772 5350768 5350773 +
tgaaaatttgaattctttgaag

SEQ ID NO: 105315 - DNA, 22 bp, Artificial Sequence
  Synthetic oligonucleotide; TTT chr11 5350760 5350781 5350777 5350782 +
gaattctttgaagcagtgtatc

SEQ ID NO: 105316 - DNA, 22 bp, Artificial Sequence
  Synthetic oligonucleotide; TTG chr11 5350761 5350782 5350778 5350783 +
aattctttgaagcagtgtatca

SEQ ID NO: 105317 - DNA, 22 bp, Artificial Sequence
  Synthetic oligonucleotide; TTC chr11 5350766 5350787 5350783 5350788 +
tttgaagcagtgtatcaataac

SEQ ID NO: 105318 - DNA, 22 bp, Artificial Sequence
  Synthetic oligonucleotide; CTT chr11 5350768 5350789 5350785 5350790 +
tgaagcagtgtatcaataacta

SEQ ID NO: 105319 - DNA, 22 bp, Artificial Sequence
  Synthetic oligonucleotide; TTT chr11 5350769 5350790 5350786 5350791 +
gaagcagtgtatcaataactag

SEQ ID NO: 105320 - DNA, 22 bp, Artificial Sequence
  Synthetic oligonucleotide; TTG chr11 5350770 5350791 5350787 5350792 +
aagcagtgtatcaataactagg

SEQ ID NO: 105321 - DNA, 22 bp, Artificial Sequence
  Synthetic oligonucleotide; CTA chr11 5350790 5350811 5350807 5350812 +
gggttataaagctgggcaactt

SEQ ID NO: 105322 - DNA, 22 bp, Artificial Sequence
  Synthetic oligonucleotide; TTA chr11 5350796 5350817 5350813 5350818 +
taaagctgggcaacttagagtt

SEQ ID NO: 105323 - DNA, 22 bp, Artificial Sequence
  Synthetic oligonucleotide; CTG chr11 5350804 5350825 5350821 5350826 +
ggcaacttagagttctatgtgc

SEQ ID NO: 105324 - DNA, 22 bp, Artificial Sequence
  Synthetic oligonucleotide; CTT chr11 5350812 5350833 5350829 5350834 +
agagttctatgtgctttggaaa

SEQ ID NO: 105325 - DNA, 22 bp, Artificial Sequence
  Synthetic oligonucleotide; TTA chr11 5350813 5350834 5350830 5350835 +
gagttctatgtgctttggaaac

SEQ ID NO: 105326 - DNA, 22 bp, Artificial Sequence
  Synthetic oligonucleotide; TTC chr11 5350819 5350840 5350836 5350841 +
tatgtgctttggaaacacacac

SEQ ID NO: 105327 - DNA, 22 bp, Artificial Sequence
  Synthetic oligonucleotide; CTA chr11 5350821 5350842 5350838 5350843 +
tgtgctttggaaacacacacag

SEQ ID NO: 105328 - DNA, 22 bp, Artificial Sequence
  Synthetic oligonucleotide; CTT chr11 5350828 5350849 5350845 5350850 +
tggaaacacacacaggtaagtc

SEQ ID NO: 105329 - DNA, 22 bp, Artificial Sequence
  Synthetic oligonucleotide; TTT chr11 5350829 5350850 5350846 5350851 +
ggaaacacacacaggtaagtca

SEQ ID NO: 105330 - DNA, 22 bp, Artificial Sequence
  Synthetic oligonucleotide; TTG chr11 5350830 5350851 5350847 5350852 +
gaaacacacacaggtaagtcac

SEQ ID NO: 105331 - DNA, 22 bp, Artificial Sequence
  Synthetic oligonucleotide; CTC chr11 5350854 5350875 5350871 5350876 +
ttacgtcattttctaactaccc

SEQ ID NO: 105332 - DNA, 22 bp, Artificial Sequence
  Synthetic oligonucleotide; CTT chr11 5350856 5350877 5350873 5350878 +
acgtcattttctaactacccaa

SEQ ID NO: 105333 - DNA, 22 bp, Artificial Sequence
  Synthetic oligonucleotide; TTA chr11 5350857 5350878 5350874 5350879 +
cgtcattttctaactacccaaa

SEQ ID NO: 105334 - DNA, 22 bp, Artificial Sequence
  Synthetic oligonucleotide; TTT chr11 5350865 5350886 5350882 5350887 +
tctaactacccaaaagtctctg

SEQ ID NO: 105335 - DNA, 22 bp, Artificial Sequence
  Synthetic oligonucleotide; TTT chr11 5350866 5350887 5350883 5350888 +
ctaactacccaaaagtctctgg

SEQ ID NO: 105336 - DNA, 22 bp, Artificial Sequence
  Synthetic oligonucleotide; TTC chr11 5350867 5350888 5350884 5350889 +
taactacccaaaagtctctgga

SEQ ID NO: 105337 - DNA, 22 bp, Artificial Sequence
  Synthetic oligonucleotide; CTA chr11 5350869 5350890 5350886 5350891 +
actacccaaaagtctctggagc

SEQ ID NO: 105338 - DNA, 22 bp, Artificial Sequence
  Synthetic oligonucleotide; CTA chr11 5350873 5350894 5350890 5350895 +
cccaaaagtctctggagcttca

SEQ ID NO: 105339 - DNA, 22 bp, Artificial Sequence
  Synthetic oligonucleotide; CTC chr11 5350885 5350906 5350902 5350907 +
tggagcttcatcaattgaattt

SEQ ID NO: 105340 - DNA, 22 bp, Artificial Sequence
  Synthetic oligonucleotide; CTG chr11 5350887 5350908 5350904 5350909 +
gagcttcatcaattgaattttc

SEQ ID NO: 105341 - DNA, 22 bp, Artificial Sequence
  Synthetic oligonucleotide; CTT chr11 5350893 5350914 5350910 5350915 +
catcaattgaattttccctcca

SEQ ID NO: 105342 - DNA, 22 bp, Artificial Sequence
  Synthetic oligonucleotide; TTC chr11 5350894 5350915 5350911 5350916 +
atcaattgaattttccctccag

SEQ ID NO: 105343 - DNA, 22 bp, Artificial Sequence
  Synthetic oligonucleotide; TTG chr11 5350902 5350923 5350919 5350924 +
aattttccctccaggaatattg

SEQ ID NO: 105344 - DNA, 22 bp, Artificial Sequence
  Synthetic oligonucleotide; TTT chr11 5350907 5350928 5350924 5350929 +
tccctccaggaatattgaagaa

SEQ ID NO: 105345 - DNA, 22 bp, Artificial Sequence
  Synthetic oligonucleotide; TTT chr11 5350908 5350929 5350925 5350930 +
ccctccaggaatattgaagaaa

SEQ ID NO: 105346 - DNA, 22 bp, Artificial Sequence
  Synthetic oligonucleotide; TTC chr11 5350909 5350930 5350926 5350931 +
cctccaggaatattgaagaaaa

SEQ ID NO: 105347 - DNA, 22 bp, Artificial Sequence
  Synthetic oligonucleotide; CTC chr11 5350913 5350934 5350930 5350935 +
caggaatattgaagaaaagtca

SEQ ID NO: 105348 - DNA, 22 bp, Artificial Sequence
  Synthetic oligonucleotide; TTG chr11 5350924 5350945 5350941 5350946 +
aagaaaagtcaatctctgaaat

SEQ ID NO: 105349 - DNA, 22 bp, Artificial Sequence
  Synthetic oligonucleotide; CTC chr11 5350940 5350961 5350957 5350962 +
tgaaatttactattttattgta

SEQ ID NO: 105350 - DNA, 22 bp, Artificial Sequence
  Synthetic oligonucleotide; CTG chr11 5350942 5350963 5350959 5350964 +
aaatttactattttattgtatt

SEQ ID NO: 105351 - DNA, 22 bp, Artificial Sequence
  Synthetic oligonucleotide; TTT chr11 5350948 5350969 5350965 5350970 +
actattttattgtatttgctca

SEQ ID NO: 105352 - DNA, 22 bp, Artificial Sequence
  Synthetic oligonucleotide; TTA chr11 5350949 5350970 5350966 5350971 +
ctattttattgtatttgctcat

SEQ ID NO: 105353 - DNA, 22 bp, Artificial Sequence
  Synthetic oligonucleotide; CTA chr11 5350952 5350973 5350969 5350974 +
ttttattgtatttgctcatata

SEQ ID NO: 105354 - DNA, 22 bp, Artificial Sequence
  Synthetic oligonucleotide; TTT chr11 5350955 5350976 5350972 5350977 +
tattgtatttgctcatatattt

SEQ ID NO: 105355 - DNA, 22 bp, Artificial Sequence
  Synthetic oligonucleotide; TTT chr11 5350956 5350977 5350973 5350978 +
attgtatttgctcatatatttc

SEQ ID NO: 105356 - DNA, 22 bp, Artificial Sequence
  Synthetic oligonucleotide; TTA chr11 5350957 5350978 5350974 5350979 +
ttgtatttgctcatatatttct

SEQ ID NO: 105357 - DNA, 22 bp, Artificial Sequence
  Synthetic oligonucleotide; TTG chr11 5350960 5350981 5350977 5350982 +
tatttgctcatatatttcttac

SEQ ID NO: 105358 - DNA, 22 bp, Artificial Sequence
  Synthetic oligonucleotide; TTT chr11 5350965 5350986 5350982 5350987 +
gctcatatatttcttacttgtg

SEQ ID NO: 105359 - DNA, 22 bp, Artificial Sequence
  Synthetic oligonucleotide; TTG chr11 5350966 5350987 5350983 5350988 +
ctcatatatttcttacttgtgt

SEQ ID NO: 105360 - DNA, 22 bp, Artificial Sequence
  Synthetic oligonucleotide; CTC chr11 5350969 5350990 5350986 5350991 +
atatatttcttacttgtgtatt

SEQ ID NO: 105361 - DNA, 22 bp, Artificial Sequence
  Synthetic oligonucleotide; TTT chr11 5350977 5350998 5350994 5350999 +
cttacttgtgtatttgtttttc

SEQ ID NO: 105362 - DNA, 22 bp, Artificial Sequence
  Synthetic oligonucleotide; TTC chr11 5350978 5350999 5350995 5351000 +
ttacttgtgtatttgtttttcc

SEQ ID NO: 105363 - DNA, 22 bp, Artificial Sequence
  Synthetic oligonucleotide; CTT chr11 5350980 5351001 5350997 5351002 +
acttgtgtatttgtttttccat

SEQ ID NO: 105364 - DNA, 22 bp, Artificial Sequence
  Synthetic oligonucleotide; TTA chr11 5350981 5351002 5350998 5351003 +
cttgtgtatttgtttttccata

SEQ ID NO: 105365 - DNA, 22 bp, Artificial Sequence
  Synthetic oligonucleotide; CTT chr11 5350984 5351005 5351001 5351006 +
gtgtatttgtttttccatataa

SEQ ID NO: 105366 - DNA, 22 bp, Artificial Sequence
  Synthetic oligonucleotide; TTG chr11 5350985 5351006 5351002 5351007 +
tgtatttgtttttccatataat

SEQ ID NO: 105367 - DNA, 22 bp, Artificial Sequence
  Synthetic oligonucleotide; TTT chr11 5350992 5351013 5351009 5351014 +
gtttttccatataatctttata

SEQ ID NO: 105368 - DNA, 22 bp, Artificial Sequence
  Synthetic oligonucleotide; TTG chr11 5350993 5351014 5351010 5351015 +
tttttccatataatctttatat

SEQ ID NO: 105369 - DNA, 22 bp, Artificial Sequence
  Synthetic oligonucleotide; TTT chr11 5350996 5351017 5351013 5351018 +
ttccatataatctttatatctg

SEQ ID NO: 105370 - DNA, 22 bp, Artificial Sequence
  Synthetic oligonucleotide; TTT chr11 5350997 5351018 5351014 5351019 +
tccatataatctttatatctgc

SEQ ID NO: 105371 - DNA, 22 bp, Artificial Sequence
  Synthetic oligonucleotide; TTT chr11 5350998 5351019 5351015 5351020 +
ccatataatctttatatctgct

SEQ ID NO: 105372 - DNA, 22 bp, Artificial Sequence
  Synthetic oligonucleotide; TTC chr11 5350999 5351020 5351016 5351021 +
catataatctttatatctgctt

SEQ ID NO: 105373 - DNA, 22 bp, Artificial Sequence
  Synthetic oligonucleotide; CTT chr11 5351010 5351031 5351027 5351032 +
tatatctgcttttccaatagtg

SEQ ID NO: 105374 - DNA, 22 bp, Artificial Sequence
  Synthetic oligonucleotide; TTT chr11 5351011 5351032 5351028 5351033 +
atatctgcttttccaatagtgc

SEQ ID NO: 105375 - DNA, 22 bp, Artificial Sequence
  Synthetic oligonucleotide; TTA chr11 5351012 5351033 5351029 5351034 +
tatctgcttttccaatagtgct

SEQ ID NO: 105376 - DNA, 22 bp, Artificial Sequence
  Synthetic oligonucleotide; CTG chr11 5351018 5351039 5351035 5351040 +
cttttccaatagtgcttagaac

SEQ ID NO: 105377 - DNA, 22 bp, Artificial Sequence
  Synthetic oligonucleotide; CTT chr11 5351021 5351042 5351038 5351043 +
ttccaatagtgcttagaaccat

SEQ ID NO: 105378 - DNA, 22 bp, Artificial Sequence
  Synthetic oligonucleotide; TTT chr11 5351022 5351043 5351039 5351044 +
tccaatagtgcttagaaccatt

SEQ ID NO: 105379 - DNA, 22 bp, Artificial Sequence
  Synthetic oligonucleotide; TTT chr11 5351023 5351044 5351040 5351045 +
ccaatagtgcttagaaccattt

SEQ ID NO: 105380 - DNA, 22 bp, Artificial Sequence
  Synthetic oligonucleotide; TTC chr11 5351024 5351045 5351041 5351046 +
caatagtgcttagaaccatttt

SEQ ID NO: 105381 - DNA, 22 bp, Artificial Sequence
  Synthetic oligonucleotide; CTT chr11 5351035 5351056 5351052 5351057 +
agaaccatttttctactgatct

SEQ ID NO: 105382 - DNA, 22 bp, Artificial Sequence
  Synthetic oligonucleotide; TTA chr11 5351036 5351057 5351053 5351058 +
gaaccatttttctactgatctt

SEQ ID NO: 105383 - DNA, 22 bp, Artificial Sequence
  Synthetic oligonucleotide; TTT chr11 5351045 5351066 5351062 5351067 +
ttctactgatcttttaggtctc

SEQ ID NO: 105384 - DNA, 22 bp, Artificial Sequence
  Synthetic oligonucleotide; TTT chr11 5351046 5351067 5351063 5351068 +
tctactgatcttttaggtctca

SEQ ID NO: 105385 - DNA, 22 bp, Artificial Sequence
  Synthetic oligonucleotide; TTT chr11 5351047 5351068 5351064 5351069 +
ctactgatcttttaggtctcac

SEQ ID NO: 105386 - DNA, 22 bp, Artificial Sequence
  Synthetic oligonucleotide; TTC chr11 5351048 5351069 5351065 5351070 +
tactgatcttttaggtctcaca

SEQ ID NO: 105387 - DNA, 22 bp, Artificial Sequence
  Synthetic oligonucleotide; CTA chr11 5351050 5351071 5351067 5351072 +
ctgatcttttaggtctcacata

SEQ ID NO: 105388 - DNA, 22 bp, Artificial Sequence
  Synthetic oligonucleotide; CTG chr11 5351053 5351074 5351070 5351075 +
atcttttaggtctcacatagcc

SEQ ID NO: 105389 - DNA, 22 bp, Artificial Sequence
  Synthetic oligonucleotide; CTT chr11 5351058 5351079 5351075 5351080 +
ttaggtctcacatagcctggga

SEQ ID NO: 105390 - DNA, 22 bp, Artificial Sequence
  Synthetic oligonucleotide; TTT chr11 5351059 5351080 5351076 5351081 +
taggtctcacatagcctgggaa

SEQ ID NO: 105391 - DNA, 22 bp, Artificial Sequence
  Synthetic oligonucleotide; TTT chr11 5351060 5351081 5351077 5351082 +
aggtctcacatagcctgggaaa

SEQ ID NO: 105392 - DNA, 22 bp, Artificial Sequence
  Synthetic oligonucleotide; TTA chr11 5351061 5351082 5351078 5351083 +
ggtctcacatagcctgggaaac

SEQ ID NO: 105393 - DNA, 22 bp, Artificial Sequence
  Synthetic oligonucleotide; CTC chr11 5351067 5351088 5351084 5351089 +
acatagcctgggaaacctttac

SEQ ID NO: 105394 - DNA, 22 bp, Artificial Sequence
  Synthetic oligonucleotide; CTG chr11 5351077 5351098 5351094 5351099 +
ggaaacctttacatccacccta

SEQ ID NO: 105395 - DNA, 22 bp, Artificial Sequence
  Synthetic oligonucleotide; CTT chr11 5351086 5351107 5351103 5351108 +
tacatccaccctataataccac

SEQ ID NO: 105396 - DNA, 22 bp, Artificial Sequence
  Synthetic oligonucleotide; TTT chr11 5351087 5351108 5351104 5351109 +
acatccaccctataataccacc

SEQ ID NO: 105397 - DNA, 22 bp, Artificial Sequence
  Synthetic oligonucleotide; TTA chr11 5351088 5351109 5351105 5351110 +
catccaccctataataccacca

SEQ ID NO: 105398 - DNA, 22 bp, Artificial Sequence
  Synthetic oligonucleotide; CTA chr11 5351099 5351120 5351116 5351121 +
taataccaccagtcaggatgaa

SEQ ID NO: 105399 - DNA, 22 bp, Artificial Sequence
  Synthetic oligonucleotide; CTA chr11 5351143 5351164 5351160 5351165 +
taagtttcaggccattacagca

SEQ ID NO: 105400 - DNA, 22 bp, Artificial Sequence
  Synthetic oligonucleotide; TTT chr11 5351150 5351171 5351167 5351172 +
caggccattacagcactattca

SEQ ID NO: 105401 - DNA, 22 bp, Artificial Sequence
  Synthetic oligonucleotide; TTC chr11 5351151 5351172 5351168 5351173 +
aggccattacagcactattcaa

SEQ ID NO: 105402 - DNA, 22 bp, Artificial Sequence
  Synthetic oligonucleotide; TTA chr11 5351160 5351181 5351177 5351182 +
cagcactattcaaatatagtga

SEQ ID NO: 105403 - DNA, 22 bp, Artificial Sequence
  Synthetic oligonucleotide; CTA chr11 5351168 5351189 5351185 5351190 +
ttcaaatatagtgatttcttct

SEQ ID NO: 105404 - DNA, 22 bp, Artificial Sequence
  Synthetic oligonucleotide; TTC chr11 5351171 5351192 5351188 5351193 +
aaatatagtgatttcttctttc

SEQ ID NO: 105405 - DNA, 22 bp, Artificial Sequence
  Synthetic oligonucleotide; TTT chr11 5351185 5351206 5351202 5351207 +
cttctttcattttgtttttatt

SEQ ID NO: 105406 - DNA, 22 bp, Artificial Sequence
  Synthetic oligonucleotide; TTC chr11 5351186 5351207 5351203 5351208 +
ttctttcattttgtttttattt

SEQ ID NO: 105407 - DNA, 22 bp, Artificial Sequence
  Synthetic oligonucleotide; CTT chr11 5351188 5351209 5351205 5351210 +
ctttcattttgtttttattttc

SEQ ID NO: 105408 - DNA, 22 bp, Artificial Sequence
  Synthetic oligonucleotide; TTC chr11 5351189 5351210 5351206 5351211 +
tttcattttgtttttattttct

SEQ ID NO: 105409 - DNA, 22 bp, Artificial Sequence
  Synthetic oligonucleotide; CTT chr11 5351191 5351212 5351208 5351213 +
tcattttgtttttattttctgg

SEQ ID NO: 105410 - DNA, 22 bp, Artificial Sequence
  Synthetic oligonucleotide; TTT chr11 5351192 5351213 5351209 5351214 +
cattttgtttttattttctggg

SEQ ID NO: 105411 - DNA, 22 bp, Artificial Sequence
  Synthetic oligonucleotide; TTC chr11 5351193 5351214 5351210 5351215 +
attttgtttttattttctgggt

SEQ ID NO: 105412 - DNA, 22 bp, Artificial Sequence
  Synthetic oligonucleotide; TTT chr11 5351197 5351218 5351214 5351219 +
tgtttttattttctgggttata

SEQ ID NO: 105413 - DNA, 22 bp, Artificial Sequence
  Synthetic oligonucleotide; TTT chr11 5351198 5351219 5351215 5351220 +
gtttttattttctgggttatat

SEQ ID NO: 105414 - DNA, 22 bp, Artificial Sequence
  Synthetic oligonucleotide; TTG chr11 5351199 5351220 5351216 5351221 +
tttttattttctgggttatatg

SEQ ID NO: 105415 - DNA, 22 bp, Artificial Sequence
  Synthetic oligonucleotide; TTT chr11 5351202 5351223 5351219 5351224 +
ttattttctgggttatatgatt

SEQ ID NO: 105416 - DNA, 22 bp, Artificial Sequence
  Synthetic oligonucleotide; TTT chr11 5351203 5351224 5351220 5351225 +
tattttctgggttatatgattt

SEQ ID NO: 105417 - DNA, 22 bp, Artificial Sequence
  Synthetic oligonucleotide; TTT chr11 5351204 5351225 5351221 5351226 +
attttctgggttatatgattta

SEQ ID NO: 105418 - DNA, 22 bp, Artificial Sequence
  Synthetic oligonucleotide; TTA chr11 5351205 5351226 5351222 5351227 +
ttttctgggttatatgatttac

SEQ ID NO: 105419 - DNA, 22 bp, Artificial Sequence
  Synthetic oligonucleotide; TTT chr11 5351208 5351229 5351225 5351230 +
tctgggttatatgatttacaat

SEQ ID NO: 105420 - DNA, 22 bp, Artificial Sequence
  Synthetic oligonucleotide; TTT chr11 5351209 5351230 5351226 5351231 +
ctgggttatatgatttacaatg

SEQ ID NO: 105421 - DNA, 22 bp, Artificial Sequence
  Synthetic oligonucleotide; TTC chr11 5351210 5351231 5351227 5351232 +
tgggttatatgatttacaatga

SEQ ID NO: 105422 - DNA, 22 bp, Artificial Sequence
  Synthetic oligonucleotide; CTG chr11 5351212 5351233 5351229 5351234 +
ggttatatgatttacaatgaat

SEQ ID NO: 105423 - DNA, 22 bp, Artificial Sequence
  Synthetic oligonucleotide; TTA chr11 5351217 5351238 5351234 5351239 +
tatgatttacaatgaattcaac

SEQ ID NO: 105424 - DNA, 22 bp, Artificial Sequence
  Synthetic oligonucleotide; TTT chr11 5351225 5351246 5351242 5351247 +
acaatgaattcaacaatgttta

SEQ ID NO: 105425 - DNA, 22 bp, Artificial Sequence
  Synthetic oligonucleotide; TTA chr11 5351226 5351247 5351243 5351248 +
caatgaattcaacaatgtttat

SEQ ID NO: 105426 - DNA, 22 bp, Artificial Sequence
  Synthetic oligonucleotide; TTC chr11 5351236 5351257 5351253 5351258 +
aacaatgtttattctgcatgaa

SEQ ID NO: 105427 - DNA, 22 bp, Artificial Sequence
  Synthetic oligonucleotide; TTT chr11 5351246 5351267 5351263 5351268 +
attctgcatgaatagctgtatc

SEQ ID NO: 105428 - DNA, 22 bp, Artificial Sequence
  Synthetic oligonucleotide; TTA chr11 5351247 5351268 5351264 5351269 +
ttctgcatgaatagctgtatcc

SEQ ID NO: 105429 - DNA, 22 bp, Artificial Sequence
  Synthetic oligonucleotide; TTC chr11 5351250 5351271 5351267 5351272 +
tgcatgaatagctgtatcccca

SEQ ID NO: 105430 - DNA, 22 bp, Artificial Sequence
  Synthetic oligonucleotide; CTG chr11 5351252 5351273 5351269 5351274 +
catgaatagctgtatccccaac

SEQ ID NO: 105431 - DNA, 22 bp, Artificial Sequence
  Synthetic oligonucleotide; CTG chr11 5351264 5351285 5351281 5351286 +
tatccccaacgtagtatccaat

SEQ ID NO: 105432 - DNA, 22 bp, Artificial Sequence
  Synthetic oligonucleotide; CTT chr11 5351292 5351313 5351309 5351314 +
acatagagtaaaccctaaataa

SEQ ID NO: 105433 - DNA, 22 bp, Artificial Sequence
  Synthetic oligonucleotide; TTA chr11 5351293 5351314 5351310 5351315 +
catagagtaaaccctaaataat

SEQ ID NO: 105434 - DNA, 22 bp, Artificial Sequence
  Synthetic oligonucleotide; CTA chr11 5351309 5351330 5351326 5351331 +
aataatatcttctttatacatt

SEQ ID NO: 105435 - DNA, 22 bp, Artificial Sequence
  Synthetic oligonucleotide; CTT chr11 5351320 5351341 5351337 5351342 +
ctttatacattctattttccca

SEQ ID NO: 105436 - DNA, 22 bp, Artificial Sequence
  Synthetic oligonucleotide; TTC chr11 5351321 5351342 5351338 5351343 +
tttatacattctattttcccat

SEQ ID NO: 105437 - DNA, 22 bp, Artificial Sequence
  Synthetic oligonucleotide; CTT chr11 5351323 5351344 5351340 5351345 +
tatacattctattttcccatac

SEQ ID NO: 105438 - DNA, 22 bp, Artificial Sequence
  Synthetic oligonucleotide; TTT chr11 5351324 5351345 5351341 5351346 +
atacattctattttcccatacc

SEQ ID NO: 105439 - DNA, 22 bp, Artificial Sequence
  Synthetic oligonucleotide; TTA chr11 5351325 5351346 5351342 5351347 +
tacattctattttcccatacct

SEQ ID NO: 105440 - DNA, 22 bp, Artificial Sequence
  Synthetic oligonucleotide; TTC chr11 5351332 5351353 5351349 5351354 +
tattttcccatacctaggatct

SEQ ID NO: 105441 - DNA, 22 bp, Artificial Sequence
  Synthetic oligonucleotide; CTA chr11 5351334 5351355 5351351 5351356 +
ttttcccatacctaggatctcc

SEQ ID NO: 105442 - DNA, 22 bp, Artificial Sequence
  Synthetic oligonucleotide; TTT chr11 5351337 5351358 5351354 5351359 +
tcccatacctaggatctcccag

SEQ ID NO: 105443 - DNA, 22 bp, Artificial Sequence
  Synthetic oligonucleotide; TTT chr11 5351338 5351359 5351355 5351360 +
cccatacctaggatctcccagg

SEQ ID NO: 105444 - DNA, 22 bp, Artificial Sequence
  Synthetic oligonucleotide; TTC chr11 5351339 5351360 5351356 5351361 +
ccatacctaggatctcccagga

SEQ ID NO: 105445 - DNA, 22 bp, Artificial Sequence
  Synthetic oligonucleotide; CTA chr11 5351348 5351369 5351365 5351370 +
ggatctcccaggaatgactaaa

SEQ ID NO: 105446 - DNA, 22 bp, Artificial Sequence
  Synthetic oligonucleotide; CTC chr11 5351355 5351376 5351372 5351377 +
ccaggaatgactaaattatcat

SEQ ID NO: 105447 - DNA, 22 bp, Artificial Sequence
  Synthetic oligonucleotide; CTA chr11 5351368 5351389 5351385 5351390 +
aattatcatccttgctgtcact

SEQ ID NO: 105448 - DNA, 22 bp, Artificial Sequence
  Synthetic oligonucleotide; TTA chr11 5351373 5351394 5351390 5351395 +
tcatccttgctgtcactgaaag

SEQ ID NO: 105449 - DNA, 22 bp, Artificial Sequence
  Synthetic oligonucleotide; CTT chr11 5351381 5351402 5351398 5351403 +
gctgtcactgaaagtcaggact

SEQ ID NO: 105450 - DNA, 22 bp, Artificial Sequence
  Synthetic oligonucleotide; TTG chr11 5351382 5351403 5351399 5351404 +
ctgtcactgaaagtcaggactg

SEQ ID NO: 105451 - DNA, 22 bp, Artificial Sequence
  Synthetic oligonucleotide; CTG chr11 5351385 5351406 5351402 5351407 +
tcactgaaagtcaggactggtg

SEQ ID NO: 105452 - DNA, 22 bp, Artificial Sequence
  Synthetic oligonucleotide; CTG chr11 5351391 5351412 5351408 5351413 +
aaagtcaggactggtgaacatc

SEQ ID NO: 105453 - DNA, 22 bp, Artificial Sequence
  Synthetic oligonucleotide; CTG chr11 5351404 5351425 5351421 5351426 +
gtgaacatcttatgaacaggta

SEQ ID NO: 105454 - DNA, 22 bp, Artificial Sequence
  Synthetic oligonucleotide; CTT chr11 5351415 5351436 5351432 5351437 +
atgaacaggtagaattctcaag

SEQ ID NO: 105455 - DNA, 22 bp, Artificial Sequence
  Synthetic oligonucleotide; TTA chr11 5351416 5351437 5351433 5351438 +
tgaacaggtagaattctcaagg

SEQ ID NO: 105456 - DNA, 22 bp, Artificial Sequence
  Synthetic oligonucleotide; TTC chr11 5351432 5351453 5351449 5351454 +
tcaaggagcaacttttatacaa

SEQ ID NO: 105457 - DNA, 22 bp, Artificial Sequence
  Synthetic oligonucleotide; CTC chr11 5351434 5351455 5351451 5351456 +
aaggagcaacttttatacaact

SEQ ID NO: 105458 - DNA, 22 bp, Artificial Sequence
  Synthetic oligonucleotide; CTT chr11 5351446 5351467 5351463 5351468 +
ttatacaactgattactattgc

SEQ ID NO: 105459 - DNA, 22 bp, Artificial Sequence
  Synthetic oligonucleotide; TTT chr11 5351447 5351468 5351464 5351469 +
tatacaactgattactattgct

SEQ ID NO: 105460 - DNA, 22 bp, Artificial Sequence
  Synthetic oligonucleotide; TTT chr11 5351448 5351469 5351465 5351470 +
atacaactgattactattgctt

SEQ ID NO: 105461 - DNA, 22 bp, Artificial Sequence
  Synthetic oligonucleotide; TTA chr11 5351449 5351470 5351466 5351471 +
tacaactgattactattgcttt

SEQ ID NO: 105462 - DNA, 22 bp, Artificial Sequence
  Synthetic oligonucleotide; CTG chr11 5351457 5351478 5351474 5351479 +
attactattgctttacctggag

SEQ ID NO: 105463 - DNA, 22 bp, Artificial Sequence
  Synthetic oligonucleotide; TTA chr11 5351461 5351482 5351478 5351483 +
ctattgctttacctggagtaaa

SEQ ID NO: 105464 - DNA, 22 bp, Artificial Sequence
  Synthetic oligonucleotide; CTA chr11 5351464 5351485 5351481 5351486 +
ttgctttacctggagtaaatat

SEQ ID NO: 105465 - DNA, 22 bp, Artificial Sequence
  Synthetic oligonucleotide; TTG chr11 5351467 5351488 5351484 5351489 +
ctttacctggagtaaatatttg

SEQ ID NO: 105466 - DNA, 22 bp, Artificial Sequence
  Synthetic oligonucleotide; CTT chr11 5351470 5351491 5351487 5351492 +
tacctggagtaaatatttgcct

SEQ ID NO: 105467 - DNA, 22 bp, Artificial Sequence
  Synthetic oligonucleotide; TTT chr11 5351471 5351492 5351488 5351493 +
acctggagtaaatatttgcctc

SEQ ID NO: 105468 - DNA, 22 bp, Artificial Sequence
  Synthetic oligonucleotide; TTA chr11 5351472 5351493 5351489 5351494 +
cctggagtaaatatttgcctct

SEQ ID NO: 105469 - DNA, 22 bp, Artificial Sequence
  Synthetic oligonucleotide; CTG chr11 5351476 5351497 5351493 5351498 +
gagtaaatatttgcctctttgc

SEQ ID NO: 105470 - DNA, 22 bp, Artificial Sequence
  Synthetic oligonucleotide; TTT chr11 5351488 5351509 5351505 5351510 +
gcctctttgcaaagctggcaat

SEQ ID NO: 105471 - DNA, 22 bp, Artificial Sequence
  Synthetic oligonucleotide; TTG chr11 5351489 5351510 5351506 5351511 +
cctctttgcaaagctggcaatg

SEQ ID NO: 105472 - DNA, 22 bp, Artificial Sequence
  Synthetic oligonucleotide; CTC chr11 5351493 5351514 5351510 5351515 +
tttgcaaagctggcaatggggc

SEQ ID NO: 105473 - DNA, 22 bp, Artificial Sequence
  Synthetic oligonucleotide; CTT chr11 5351495 5351516 5351512 5351517 +
tgcaaagctggcaatggggctc

SEQ ID NO: 105474 - DNA, 22 bp, Artificial Sequence
  Synthetic oligonucleotide; TTT chr11 5351496 5351517 5351513 5351518 +
gcaaagctggcaatggggctca

SEQ ID NO: 105475 - DNA, 22 bp, Artificial Sequence
  Synthetic oligonucleotide; TTG chr11 5351497 5351518 5351514 5351519 +
caaagctggcaatggggctcaa

SEQ ID NO: 105476 - DNA, 22 bp, Artificial Sequence
  Synthetic oligonucleotide; CTG chr11 5351505 5351526 5351522 5351527 +
gcaatggggctcaataagtctg

SEQ ID NO: 105477 - DNA, 22 bp, Artificial Sequence
  Synthetic oligonucleotide; CTC chr11 5351517 5351538 5351534 5351539 +
aataagtctgcttccaccttcc

SEQ ID NO: 105478 - DNA, 22 bp, Artificial Sequence
  Synthetic oligonucleotide; CTG chr11 5351527 5351548 5351544 5351549 +
cttccaccttccagcttactgg

SEQ ID NO: 105479 - DNA, 22 bp, Artificial Sequence
  Synthetic oligonucleotide; CTT chr11 5351530 5351551 5351547 5351552 +
ccaccttccagcttactggctt

SEQ ID NO: 105480 - DNA, 22 bp, Artificial Sequence
  Synthetic oligonucleotide; TTC chr11 5351531 5351552 5351548 5351553 +
caccttccagcttactggcttc

SEQ ID NO: 105481 - DNA, 22 bp, Artificial Sequence
  Synthetic oligonucleotide; CTT chr11 5351537 5351558 5351554 5351559 +
ccagcttactggcttcccaggc

SEQ ID NO: 105482 - DNA, 22 bp, Artificial Sequence
  Synthetic oligonucleotide; TTC chr11 5351538 5351559 5351555 5351560 +
cagcttactggcttcccaggca

SEQ ID NO: 105483 - DNA, 22 bp, Artificial Sequence
  Synthetic oligonucleotide; CTT chr11 5351544 5351565 5351561 5351566 +
actggcttcccaggcatggaga

SEQ ID NO: 105484 - DNA, 22 bp, Artificial Sequence
  Synthetic oligonucleotide; TTA chr11 5351545 5351566 5351562 5351567 +
ctggcttcccaggcatggagaa

SEQ ID NO: 105485 - DNA, 22 bp, Artificial Sequence
  Synthetic oligonucleotide; CTG chr11 5351548 5351569 5351565 5351570 +
gcttcccaggcatggagaaggc

SEQ ID NO: 105486 - DNA, 22 bp, Artificial Sequence
  Synthetic oligonucleotide; CTT chr11 5351552 5351573 5351569 5351574 +
cccaggcatggagaaggcacat

SEQ ID NO: 105487 - DNA, 22 bp, Artificial Sequence
  Synthetic oligonucleotide; TTC chr11 5351553 5351574 5351570 5351575 +
ccaggcatggagaaggcacatc

SEQ ID NO: 105488 - DNA, 22 bp, Artificial Sequence
  Synthetic oligonucleotide; CTG chr11 5351579 5351600 5351596 5351601 +
gatattcatcccattattggca

SEQ ID NO: 105489 - DNA, 22 bp, Artificial Sequence
  Synthetic oligonucleotide; TTC chr11 5351586 5351607 5351603 5351608 +
atcccattattggcagcctaca

SEQ ID NO: 105490 - DNA, 22 bp, Artificial Sequence
  Synthetic oligonucleotide; TTA chr11 5351595 5351616 5351612 5351617 +
ttggcagcctacatctccatac

SEQ ID NO: 105491 - DNA, 22 bp, Artificial Sequence
  Synthetic oligonucleotide; TTG chr11 5351598 5351619 5351615 5351620 +
gcagcctacatctccatacttc

SEQ ID NO: 105492 - DNA, 22 bp, Artificial Sequence
  Synthetic oligonucleotide; CTA chr11 5351606 5351627 5351623 5351628 +
catctccatacttcttggcaat

SEQ ID NO: 105493 - DNA, 22 bp, Artificial Sequence
  Synthetic oligonucleotide; CTC chr11 5351612 5351633 5351629 5351634 +
catacttcttggcaatggcact

SEQ ID NO: 105494 - DNA, 22 bp, Artificial Sequence
  Synthetic oligonucleotide; CTT chr11 5351619 5351640 5351636 5351641 +
cttggcaatggcactcttctct

SEQ ID NO: 105495 - DNA, 22 bp, Artificial Sequence
  Synthetic oligonucleotide; TTC chr11 5351620 5351641 5351637 5351642 +
ttggcaatggcactcttctctt

SEQ ID NO: 105496 - DNA, 22 bp, Artificial Sequence
  Synthetic oligonucleotide; CTT chr11 5351622 5351643 5351639 5351644 +
ggcaatggcactcttctctttc

SEQ ID NO: 105497 - DNA, 22 bp, Artificial Sequence
  Synthetic oligonucleotide; TTG chr11 5351623 5351644 5351640 5351645 +
gcaatggcactcttctctttct

SEQ ID NO: 105498 - DNA, 22 bp, Artificial Sequence
  Synthetic oligonucleotide; CTC chr11 5351635 5351656 5351652 5351657 +
ttctctttctcatcaggaatga

SEQ ID NO: 105499 - DNA, 22 bp, Artificial Sequence
  Synthetic oligonucleotide; CTT chr11 5351637 5351658 5351654 5351659 +
ctctttctcatcaggaatgatc

SEQ ID NO: 105500 - DNA, 22 bp, Artificial Sequence
  Synthetic oligonucleotide; TTC chr11 5351638 5351659 5351655 5351660 +
tctttctcatcaggaatgatca

SEQ ID NO: 105501 - DNA, 22 bp, Artificial Sequence
  Synthetic oligonucleotide; CTC chr11 5351640 5351661 5351657 5351662 +
tttctcatcaggaatgatcata

SEQ ID NO: 105502 - DNA, 22 bp, Artificial Sequence
  Synthetic oligonucleotide; CTT chr11 5351642 5351663 5351659 5351664 +
tctcatcaggaatgatcataac

SEQ ID NO: 105503 - DNA, 22 bp, Artificial Sequence
  Synthetic oligonucleotide; TTT chr11 5351643 5351664 5351660 5351665 +
ctcatcaggaatgatcataacc

SEQ ID NO: 105504 - DNA, 22 bp, Artificial Sequence
  Synthetic oligonucleotide; TTC chr11 5351644 5351665 5351661 5351666 +
tcatcaggaatgatcataacct

SEQ ID NO: 105505 - DNA, 22 bp, Artificial Sequence
  Synthetic oligonucleotide; CTC chr11 5351646 5351667 5351663 5351668 +
atcaggaatgatcataacctcc

SEQ ID NO: 105506 - DNA, 22 bp, Artificial Sequence
  Synthetic oligonucleotide; CTC chr11 5351667 5351688 5351684 5351689 +
catgagcccatgtactatttct

SEQ ID NO: 105507 - DNA, 22 bp, Artificial Sequence
  Synthetic oligonucleotide; CTA chr11 5351684 5351705 5351701 5351706 +
tttcttagctatgttggcagct

SEQ ID NO: 105508 - DNA, 22 bp, Artificial Sequence
  Synthetic oligonucleotide; TTT chr11 5351687 5351708 5351704 5351709 +
cttagctatgttggcagctaca

SEQ ID NO: 105509 - DNA, 22 bp, Artificial Sequence
  Synthetic oligonucleotide; TTC chr11 5351688 5351709 5351705 5351710 +
ttagctatgttggcagctacag

SEQ ID NO: 105510 - DNA, 22 bp, Artificial Sequence
  Synthetic oligonucleotide; CTT chr11 5351690 5351711 5351707 5351712 +
agctatgttggcagctacagac

SEQ ID NO: 105511 - DNA, 22 bp, Artificial Sequence
  Synthetic oligonucleotide; TTA chr11 5351691 5351712 5351708 5351713 +
gctatgttggcagctacagacc

SEQ ID NO: 105512 - DNA, 22 bp, Artificial Sequence
  Synthetic oligonucleotide; CTA chr11 5351695 5351716 5351712 5351717 +
tgttggcagctacagacctcgg

SEQ ID NO: 105513 - DNA, 22 bp, Artificial Sequence
  Synthetic oligonucleotide; TTG chr11 5351700 5351721 5351717 5351722 +
gcagctacagacctcggagtga

SEQ ID NO: 105514 - DNA, 22 bp, Artificial Sequence
  Synthetic oligonucleotide; CTA chr11 5351707 5351728 5351724 5351729 +
cagacctcggagtgacattgac

SEQ ID NO: 105515 - DNA, 22 bp, Artificial Sequence
  Synthetic oligonucleotide; CTC chr11 5351715 5351736 5351732 5351737 +
ggagtgacattgaccacaatgc

SEQ ID NO: 105516 - DNA, 22 bp, Artificial Sequence
  Synthetic oligonucleotide; TTG chr11 5351727 5351748 5351744 5351749 +
accacaatgcccacagtgctag

SEQ ID NO: 105517 - DNA, 22 bp, Artificial Sequence
  Synthetic oligonucleotide; CTA chr11 5351748 5351769 5351765 5351770 +
ggtgttctgtggttagatcaca

SEQ ID NO: 105518 - DNA, 22 bp, Artificial Sequence
  Synthetic oligonucleotide; TTC chr11 5351755 5351776 5351772 5351777 +
tgtggttagatcacagggagat

SEQ ID NO: 105519 - DNA, 22 bp, Artificial Sequence
  Synthetic oligonucleotide; CTG chr11 5351757 5351778 5351774 5351779 +
tggttagatcacagggagattg

SEQ ID NO: 105520 - DNA, 22 bp, Artificial Sequence
  Synthetic oligonucleotide; TTA chr11 5351763 5351784 5351780 5351785 +
gatcacagggagattggccatg

SEQ ID NO: 105521 - DNA, 22 bp, Artificial Sequence
  Synthetic oligonucleotide; TTG chr11 5351779 5351800 5351796 5351801 +
gccatggagcctgcttctctca

SEQ ID NO: 105522 - DNA, 22 bp, Artificial Sequence
  Synthetic oligonucleotide; CTG chr11 5351792 5351813 5351809 5351814 +
cttctctcaggcctattttatc

SEQ ID NO: 105523 - DNA, 22 bp, Artificial Sequence
  Synthetic oligonucleotide; CTT chr11 5351795 5351816 5351812 5351817 +
ctctcaggcctattttatccat

SEQ ID NO: 105524 - DNA, 22 bp, Artificial Sequence
  Synthetic oligonucleotide; TTC chr11 5351796 5351817 5351813 5351818 +
tctcaggcctattttatccata

SEQ ID NO: 105525 - DNA, 22 bp, Artificial Sequence
  Synthetic oligonucleotide; CTC chr11 5351798 5351819 5351815 5351820 +
tcaggcctattttatccatact

SEQ ID NO: 105526 - DNA, 22 bp, Artificial Sequence
  Synthetic oligonucleotide; CTC chr11 5351800 5351821 5351817 5351822 +
aggcctattttatccatactct

SEQ ID NO: 105527 - DNA, 22 bp, Artificial Sequence
  Synthetic oligonucleotide; CTA chr11 5351807 5351828 5351824 5351829 +
ttttatccatactctttctgtc

SEQ ID NO: 105528 - DNA, 22 bp, Artificial Sequence
  Synthetic oligonucleotide; TTT chr11 5351810 5351831 5351827 5351832 +
tatccatactctttctgtcatg

SEQ ID NO: 105529 - DNA, 22 bp, Artificial Sequence
  Synthetic oligonucleotide; TTT chr11 5351811 5351832 5351828 5351833 +
atccatactctttctgtcatgg

SEQ ID NO: 105530 - DNA, 22 bp, Artificial Sequence
  Synthetic oligonucleotide; TTA chr11 5351812 5351833 5351829 5351834 +
tccatactctttctgtcatgga

SEQ ID NO: 105531 - DNA, 22 bp, Artificial Sequence
  Synthetic oligonucleotide; CTC chr11 5351821 5351842 5351838 5351843 +
tttctgtcatggagtcaggtgt

SEQ ID NO: 105532 - DNA, 22 bp, Artificial Sequence
  Synthetic oligonucleotide; CTT chr11 5351823 5351844 5351840 5351845 +
tctgtcatggagtcaggtgtct

SEQ ID NO: 105533 - DNA, 22 bp, Artificial Sequence
  Synthetic oligonucleotide; TTT chr11 5351824 5351845 5351841 5351846 +
ctgtcatggagtcaggtgtctt

SEQ ID NO: 105534 - DNA, 22 bp, Artificial Sequence
  Synthetic oligonucleotide; TTC chr11 5351825 5351846 5351842 5351847 +
tgtcatggagtcaggtgtcttg

SEQ ID NO: 105535 - DNA, 22 bp, Artificial Sequence
  Synthetic oligonucleotide; CTG chr11 5351827 5351848 5351844 5351849 +
tcatggagtcaggtgtcttgct

SEQ ID NO: 105536 - DNA, 22 bp, Artificial Sequence
  Synthetic oligonucleotide; CTT chr11 5351846 5351867 5351863 5351868 +
gcttgccatggcttatgactgt

SEQ ID NO: 105537 - DNA, 22 bp, Artificial Sequence
  Synthetic oligonucleotide; TTG chr11 5351847 5351868 5351864 5351869 +
cttgccatggcttatgactgtt

SEQ ID NO: 105538 - DNA, 22 bp, Artificial Sequence
  Synthetic oligonucleotide; CTT chr11 5351850 5351871 5351867 5351872 +
gccatggcttatgactgtttca

SEQ ID NO: 105539 - DNA, 22 bp, Artificial Sequence
  Synthetic oligonucleotide; TTG chr11 5351851 5351872 5351868 5351873 +
ccatggcttatgactgtttcat

SEQ ID NO: 105540 - DNA, 22 bp, Artificial Sequence
  Synthetic oligonucleotide; CTT chr11 5351860 5351881 5351877 5351882 +
atgactgtttcattaccatccg

SEQ ID NO: 105541 - DNA, 22 bp, Artificial Sequence
  Synthetic oligonucleotide; TTA chr11 5351861 5351882 5351878 5351883 +
tgactgtttcattaccatccgc

SEQ ID NO: 105542 - DNA, 22 bp, Artificial Sequence
  Synthetic oligonucleotide; CTG chr11 5351867 5351888 5351884 5351889 +
tttcattaccatccgcagcccc

SEQ ID NO: 105543 - DNA, 22 bp, Artificial Sequence
  Synthetic oligonucleotide; TTT chr11 5351870 5351891 5351887 5351892 +
cattaccatccgcagcccctta

SEQ ID NO: 105544 - DNA, 22 bp, Artificial Sequence
  Synthetic oligonucleotide; TTC chr11 5351871 5351892 5351888 5351893 +
attaccatccgcagccccttaa

SEQ ID NO: 105545 - DNA, 22 bp, Artificial Sequence
  Synthetic oligonucleotide; TTA chr11 5351875 5351896 5351892 5351897 +
ccatccgcagccccttaagata

SEQ ID NO: 105546 - DNA, 22 bp, Artificial Sequence
  Synthetic oligonucleotide; CTT chr11 5351891 5351912 5351908 5351913 +
aagatatacctctatcctgacc

SEQ ID NO: 105547 - DNA, 22 bp, Artificial Sequence
  Synthetic oligonucleotide; TTA chr11 5351892 5351913 5351909 5351914 +
agatatacctctatcctgacca

SEQ ID NO: 105548 - DNA, 22 bp, Artificial Sequence
  Synthetic oligonucleotide; CTC chr11 5351903 5351924 5351920 5351925 +
tatcctgaccaacacccaggta

SEQ ID NO: 105549 - DNA, 22 bp, Artificial Sequence
  Synthetic oligonucleotide; CTA chr11 5351905 5351926 5351922 5351927 +
tcctgaccaacacccaggtaat

SEQ ID NO: 105550 - DNA, 22 bp, Artificial Sequence
  Synthetic oligonucleotide; CTG chr11 5351910 5351931 5351927 5351932 +
accaacacccaggtaatgaaga

SEQ ID NO: 105551 - DNA, 22 bp, Artificial Sequence
  Synthetic oligonucleotide; TTG chr11 5351935 5351956 5351952 5351957 +
gtgtgcgggtattgacaagggc

SEQ ID NO: 105552 - DNA, 22 bp, Artificial Sequence
  Synthetic oligonucleotide; TTG chr11 5351949 5351970 5351966 5351971 +
acaagggctggtctgtccatta

SEQ ID NO: 105553 - DNA, 22 bp, Artificial Sequence
  Synthetic oligonucleotide; CTG chr11 5351959 5351980 5351976 5351981 +
gtctgtccattatgccaatagt

SEQ ID NO: 105554 - DNA, 22 bp, Artificial Sequence
  Synthetic oligonucleotide; CTG chr11 5351964 5351985 5351981 5351986 +
tccattatgccaatagttgttc

SEQ ID NO: 105555 - DNA, 22 bp, Artificial Sequence
  Synthetic oligonucleotide; TTA chr11 5351971 5351992 5351988 5351993 +
tgccaatagttgttcgcctaca

SEQ ID NO: 105556 - DNA, 22 bp, Artificial Sequence
  Synthetic oligonucleotide; TTG chr11 5351983 5352004 5352000 5352005 +
ttcgcctacactggtttcccta

SEQ ID NO: 105557 - DNA, 22 bp, Artificial Sequence
  Synthetic oligonucleotide; TTC chr11 5351986 5352007 5352003 5352008 +
gcctacactggtttccctactg

SEQ ID NO: 105558 - DNA, 22 bp, Artificial Sequence
  Synthetic oligonucleotide; CTA chr11 5351991 5352012 5352008 5352013 +
cactggtttccctactgtcgat

SEQ ID NO: 105559 - DNA, 22 bp, Artificial Sequence
  Synthetic oligonucleotide; CTG chr11 5351996 5352017 5352013 5352018 +
gtttccctactgtcgatcccat

SEQ ID NO: 105560 - DNA, 22 bp, Artificial Sequence
  Synthetic oligonucleotide; TTT chr11 5352000 5352021 5352017 5352022 +
ccctactgtcgatcccatgtac

SEQ ID NO: 105561 - DNA, 22 bp, Artificial Sequence
  Synthetic oligonucleotide; TTC chr11 5352001 5352022 5352018 5352023 +
cctactgtcgatcccatgtact

SEQ ID NO: 105562 - DNA, 22 bp, Artificial Sequence
  Synthetic oligonucleotide; CTA chr11 5352005 5352026 5352022 5352027 +
ctgtcgatcccatgtactctcc

SEQ ID NO: 105563 - DNA, 22 bp, Artificial Sequence
  Synthetic oligonucleotide; CTG chr11 5352008 5352029 5352025 5352030 +
tcgatcccatgtactctcccat

SEQ ID NO: 105564 - DNA, 22 bp, Artificial Sequence
  Synthetic oligonucleotide; CTC chr11 5352024 5352045 5352041 5352046 +
tcccatgctttctgtctacacc

SEQ ID NO: 105565 - DNA, 22 bp, Artificial Sequence
  Synthetic oligonucleotide; CTC chr11 5352026 5352047 5352043 5352048 +
ccatgctttctgtctacaccaa

SEQ ID NO: 105566 - DNA, 22 bp, Artificial Sequence
  Synthetic oligonucleotide; CTT chr11 5352034 5352055 5352051 5352056 +
tctgtctacaccaagatgtcat

SEQ ID NO: 105567 - DNA, 22 bp, Artificial Sequence
  Synthetic oligonucleotide; TTT chr11 5352035 5352056 5352052 5352057 +
ctgtctacaccaagatgtcatc

SEQ ID NO: 105568 - DNA, 22 bp, Artificial Sequence
  Synthetic oligonucleotide; TTC chr11 5352036 5352057 5352053 5352058 +
tgtctacaccaagatgtcatca

SEQ ID NO: 105569 - DNA, 22 bp, Artificial Sequence
  Synthetic oligonucleotide; CTG chr11 5352038 5352059 5352055 5352060 +
tctacaccaagatgtcatcaag

SEQ ID NO: 105570 - DNA, 22 bp, Artificial Sequence
  Synthetic oligonucleotide; CTA chr11 5352042 5352063 5352059 5352064 +
caccaagatgtcatcaagctag

SEQ ID NO: 105571 - DNA, 22 bp, Artificial Sequence
  Synthetic oligonucleotide; CTA chr11 5352063 5352084 5352080 5352085 +
gcctgtgctgacatcaccttca

SEQ ID NO: 105572 - DNA, 22 bp, Artificial Sequence
  Synthetic oligonucleotide; CTG chr11 5352068 5352089 5352085 5352090 +
tgctgacatcaccttcaaccgt

SEQ ID NO: 105573 - DNA, 22 bp, Artificial Sequence
  Synthetic oligonucleotide; CTG chr11 5352073 5352094 5352090 5352095 +
acatcaccttcaaccgtctcta

SEQ ID NO: 105574 - DNA, 22 bp, Artificial Sequence
  Synthetic oligonucleotide; CTT chr11 5352083 5352104 5352100 5352105 +
caaccgtctctatccagttgta

SEQ ID NO: 105575 - DNA, 22 bp, Artificial Sequence
  Synthetic oligonucleotide; TTC chr11 5352084 5352105 5352101 5352106 +
aaccgtctctatccagttgtag

SEQ ID NO: 105576 - DNA, 22 bp, Artificial Sequence
  Synthetic oligonucleotide; CTC chr11 5352093 5352114 5352110 5352115 +
tatccagttgtagttttatttg

SEQ ID NO: 105577 - DNA, 22 bp, Artificial Sequence
  Synthetic oligonucleotide; CTA chr11 5352095 5352116 5352112 5352117 +
tccagttgtagttttatttgca

SEQ ID NO: 105578 - DNA, 22 bp, Artificial Sequence
  Synthetic oligonucleotide; TTG chr11 5352103 5352124 5352120 5352125 +
tagttttatttgcaatggtctt

SEQ ID NO: 105579 - DNA, 22 bp, Artificial Sequence
  Synthetic oligonucleotide; TTT chr11 5352109 5352130 5352126 5352131 +
tatttgcaatggtcttgttgga

SEQ ID NO: 105580 - DNA, 22 bp, Artificial Sequence
  Synthetic oligonucleotide; TTT chr11 5352110 5352131 5352127 5352132 +
atttgcaatggtcttgttggac

SEQ ID NO: 105581 - DNA, 22 bp, Artificial Sequence
  Synthetic oligonucleotide; TTA chr11 5352111 5352132 5352128 5352133 +
tttgcaatggtcttgttggact

SEQ ID NO: 105582 - DNA, 22 bp, Artificial Sequence
  Synthetic oligonucleotide; TTT chr11 5352114 5352135 5352131 5352136 +
gcaatggtcttgttggactttc

SEQ ID NO: 105583 - DNA, 22 bp, Artificial Sequence
  Synthetic oligonucleotide; TTG chr11 5352115 5352136 5352132 5352137 +
caatggtcttgttggactttct

SEQ ID NO: 105584 - DNA, 22 bp, Artificial Sequence
  Synthetic oligonucleotide; CTT chr11 5352125 5352146 5352142 5352147 +
gttggactttctcatcatcttt

SEQ ID NO: 105585 - DNA, 22 bp, Artificial Sequence
  Synthetic oligonucleotide; TTG chr11 5352126 5352147 5352143 5352148 +
ttggactttctcatcatctttt

SEQ ID NO: 105586 - DNA, 22 bp, Artificial Sequence
  Synthetic oligonucleotide; TTG chr11 5352129 5352150 5352146 5352151 +
gactttctcatcatctttttct

SEQ ID NO: 105587 - DNA, 22 bp, Artificial Sequence
  Synthetic oligonucleotide; CTT chr11 5352134 5352155 5352151 5352156 +
tctcatcatctttttctcctac

SEQ ID NO: 105588 - DNA, 22 bp, Artificial Sequence
  Synthetic oligonucleotide; TTT chr11 5352135 5352156 5352152 5352157 +
ctcatcatctttttctcctaca

SEQ ID NO: 105589 - DNA, 22 bp, Artificial Sequence
  Synthetic oligonucleotide; TTC chr11 5352136 5352157 5352153 5352158 +
tcatcatctttttctcctacat

SEQ ID NO: 105590 - DNA, 22 bp, Artificial Sequence
  Synthetic oligonucleotide; CTC chr11 5352138 5352159 5352155 5352160 +
atcatctttttctcctacattt

SEQ ID NO: 105591 - DNA, 22 bp, Artificial Sequence
  Synthetic oligonucleotide; CTT chr11 5352146 5352167 5352163 5352168 +
tttctcctacattttgattctc

SEQ ID NO: 105592 - DNA, 22 bp, Artificial Sequence
  Synthetic oligonucleotide; TTT chr11 5352147 5352168 5352164 5352169 +
ttctcctacattttgattctca

SEQ ID NO: 105593 - DNA, 22 bp, Artificial Sequence
  Synthetic oligonucleotide; TTT chr11 5352148 5352169 5352165 5352170 +
tctcctacattttgattctcaa

SEQ ID NO: 105594 - DNA, 22 bp, Artificial Sequence
  Synthetic oligonucleotide; TTT chr11 5352149 5352170 5352166 5352171 +
ctcctacattttgattctcaag

SEQ ID NO: 105595 - DNA, 22 bp, Artificial Sequence
  Synthetic oligonucleotide; TTC chr11 5352150 5352171 5352167 5352172 +
tcctacattttgattctcaaga

SEQ ID NO: 105596 - DNA, 22 bp, Artificial Sequence
  Synthetic oligonucleotide; CTC chr11 5352152 5352173 5352169 5352174 +
ctacattttgattctcaagact

SEQ ID NO: 105597 - DNA, 22 bp, Artificial Sequence
  Synthetic oligonucleotide; CTA chr11 5352155 5352176 5352172 5352177 +
cattttgattctcaagactgtc

SEQ ID NO: 105598 - DNA, 22 bp, Artificial Sequence
  Synthetic oligonucleotide; TTT chr11 5352160 5352181 5352177 5352182 +
tgattctcaagactgtcatggg

SEQ ID NO: 105599 - DNA, 22 bp, Artificial Sequence
  Synthetic oligonucleotide; TTT chr11 5352161 5352182 5352178 5352183 +
gattctcaagactgtcatgggc

SEQ ID NO: 105600 - DNA, 22 bp, Artificial Sequence
  Synthetic oligonucleotide; TTG chr11 5352162 5352183 5352179 5352184 +
attctcaagactgtcatgggca

SEQ ID NO: 105601 - DNA, 22 bp, Artificial Sequence
  Synthetic oligonucleotide; TTC chr11 5352166 5352187 5352183 5352188 +
tcaagactgtcatgggcattgg

SEQ ID NO: 105602 - DNA, 22 bp, Artificial Sequence
  Synthetic oligonucleotide; CTC chr11 5352168 5352189 5352185 5352190 +
aagactgtcatgggcattggtt

SEQ ID NO: 105603 - DNA, 22 bp, Artificial Sequence
  Synthetic oligonucleotide; CTG chr11 5352175 5352196 5352192 5352197 +
tcatgggcattggttctggagg

SEQ ID NO: 105604 - DNA, 22 bp, Artificial Sequence
  Synthetic oligonucleotide; TTG chr11 5352187 5352208 5352204 5352209 +
gttctggaggagaaagggccaa

SEQ ID NO: 105605 - DNA, 22 bp, Artificial Sequence
  Synthetic oligonucleotide; TTC chr11 5352191 5352212 5352208 5352213 +
tggaggagaaagggccaaggcc

SEQ ID NO: 105606 - DNA, 22 bp, Artificial Sequence
  Synthetic oligonucleotide; CTG chr11 5352193 5352214 5352210 5352215 +
gaggagaaagggccaaggccct

SEQ ID NO: 105607 - DNA, 22 bp, Artificial Sequence
  Synthetic oligonucleotide; CTC chr11 5352216 5352237 5352233 5352238 +
aacacatgtgtctctcatatct

SEQ ID NO: 105608 - DNA, 22 bp, Artificial Sequence
  Synthetic oligonucleotide; CTC chr11 5352230 5352251 5352247 5352252 +
tcatatctgctgcatcctggtc

SEQ ID NO: 105609 - DNA, 22 bp, Artificial Sequence
  Synthetic oligonucleotide; CTC chr11 5352232 5352253 5352249 5352254 +
atatctgctgcatcctggtctt

SEQ ID NO: 105610 - DNA, 22 bp, Artificial Sequence
  Synthetic oligonucleotide; CTG chr11 5352239 5352260 5352256 5352261 +
ctgcatcctggtcttctatgtc

SEQ ID NO: 105611 - DNA, 22 bp, Artificial Sequence
  Synthetic oligonucleotide; CTG chr11 5352242 5352263 5352259 5352264 +
catcctggtcttctatgtcact

SEQ ID NO: 105612 - DNA, 22 bp, Artificial Sequence
  Synthetic oligonucleotide; CTG chr11 5352249 5352270 5352266 5352271 +
gtcttctatgtcactgtagttt

SEQ ID NO: 105613 - DNA, 22 bp, Artificial Sequence
  Synthetic oligonucleotide; CTT chr11 5352254 5352275 5352271 5352276 +
ctatgtcactgtagtttgtctg

SEQ ID NO: 105614 - DNA, 22 bp, Artificial Sequence
  Synthetic oligonucleotide; TTC chr11 5352255 5352276 5352272 5352277 +
tatgtcactgtagtttgtctga

SEQ ID NO: 105615 - DNA, 22 bp, Artificial Sequence
  Synthetic oligonucleotide; CTA chr11 5352257 5352278 5352274 5352279 +
tgtcactgtagtttgtctgaca

SEQ ID NO: 105616 - DNA, 22 bp, Artificial Sequence
  Synthetic oligonucleotide; CTG chr11 5352265 5352286 5352282 5352287 +
tagtttgtctgacatttattca

SEQ ID NO: 105617 - DNA, 22 bp, Artificial Sequence
  Synthetic oligonucleotide; TTT chr11 5352271 5352292 5352288 5352293 +
gtctgacatttattcataggtt

SEQ ID NO: 105618 - DNA, 22 bp, Artificial Sequence
  Synthetic oligonucleotide; TTG chr11 5352272 5352293 5352289 5352294 +
tctgacatttattcataggttt

SEQ ID NO: 105619 - DNA, 22 bp, Artificial Sequence
  Synthetic oligonucleotide; CTG chr11 5352276 5352297 5352293 5352298 +
acatttattcataggtttggaa

SEQ ID NO: 105620 - DNA, 22 bp, Artificial Sequence
  Synthetic oligonucleotide; TTT chr11 5352282 5352303 5352299 5352304 +
attcataggtttggaaagcatg

SEQ ID NO: 105621 - DNA, 22 bp, Artificial Sequence
  Synthetic oligonucleotide; TTA chr11 5352283 5352304 5352300 5352305 +
ttcataggtttggaaagcatgt

SEQ ID NO: 105622 - DNA, 22 bp, Artificial Sequence
  Synthetic oligonucleotide; TTC chr11 5352286 5352307 5352303 5352308 +
ataggtttggaaagcatgttcc

SEQ ID NO: 105623 - DNA, 22 bp, Artificial Sequence
  Synthetic oligonucleotide; TTT chr11 5352294 5352315 5352311 5352316 +
ggaaagcatgttcctcatgtcg

SEQ ID NO: 105624 - DNA, 22 bp, Artificial Sequence
  Synthetic oligonucleotide; TTG chr11 5352295 5352316 5352312 5352317 +
gaaagcatgttcctcatgtcgt

SEQ ID NO: 105625 - DNA, 22 bp, Artificial Sequence
  Synthetic oligonucleotide; TTC chr11 5352307 5352328 5352324 5352329 +
ctcatgtcgttcacatcacaat

SEQ ID NO: 105626 - DNA, 22 bp, Artificial Sequence
  Synthetic oligonucleotide; CTC chr11 5352310 5352331 5352327 5352332 +
atgtcgttcacatcacaatgag

SEQ ID NO: 105627 - DNA, 22 bp, Artificial Sequence
  Synthetic oligonucleotide; TTC chr11 5352319 5352340 5352336 5352341 +
acatcacaatgagctacatcca

SEQ ID NO: 105628 - DNA, 22 bp, Artificial Sequence
  Synthetic oligonucleotide; CTA chr11 5352335 5352356 5352352 5352357 +
catccacttccttttcccacct

SEQ ID NO: 105629 - DNA, 22 bp, Artificial Sequence
  Synthetic oligonucleotide; CTT chr11 5352344 5352365 5352361 5352366 +
ccttttcccaccttttatgaac

SEQ ID NO: 105630 - DNA, 22 bp, Artificial Sequence
  Synthetic oligonucleotide; TTC chr11 5352345 5352366 5352362 5352367 +
cttttcccaccttttatgaacc

SEQ ID NO: 105631 - DNA, 22 bp, Artificial Sequence
  Synthetic oligonucleotide; CTT chr11 5352348 5352369 5352365 5352370 +
ttcccaccttttatgaacccat

SEQ ID NO: 105632 - DNA, 22 bp, Artificial Sequence
  Synthetic oligonucleotide; TTT chr11 5352349 5352370 5352366 5352371 +
tcccaccttttatgaacccatt

SEQ ID NO: 105633 - DNA, 22 bp, Artificial Sequence
  Synthetic oligonucleotide; TTT chr11 5352350 5352371 5352367 5352372 +
cccaccttttatgaacccattt

SEQ ID NO: 105634 - DNA, 22 bp, Artificial Sequence
  Synthetic oligonucleotide; TTC chr11 5352351 5352372 5352368 5352373 +
ccaccttttatgaacccattta

SEQ ID NO: 105635 - DNA, 22 bp, Artificial Sequence
  Synthetic oligonucleotide; CTT chr11 5352358 5352379 5352375 5352380 +
ttatgaacccatttatctatag

SEQ ID NO: 105636 - DNA, 22 bp, Artificial Sequence
  Synthetic oligonucleotide; TTT chr11 5352359 5352380 5352376 5352381 +
tatgaacccatttatctatagc

SEQ ID NO: 105637 - DNA, 22 bp, Artificial Sequence
  Synthetic oligonucleotide; TTT chr11 5352360 5352381 5352377 5352382 +
atgaacccatttatctatagca

SEQ ID NO: 105638 - DNA, 22 bp, Artificial Sequence
  Synthetic oligonucleotide; TTA chr11 5352361 5352382 5352378 5352383 +
tgaacccatttatctatagcat

SEQ ID NO: 105639 - DNA, 22 bp, Artificial Sequence
  Synthetic oligonucleotide; TTT chr11 5352372 5352393 5352389 5352394 +
atctatagcattaaaactaagc

SEQ ID NO: 105640 - DNA, 22 bp, Artificial Sequence
  Synthetic oligonucleotide; TTA chr11 5352373 5352394 5352390 5352395 +
tctatagcattaaaactaagca

SEQ ID NO: 105641 - DNA, 22 bp, Artificial Sequence
  Synthetic oligonucleotide; CTA chr11 5352377 5352398 5352394 5352399 +
tagcattaaaactaagcagatt

SEQ ID NO: 105642 - DNA, 22 bp, Artificial Sequence
  Synthetic oligonucleotide; TTA chr11 5352385 5352406 5352402 5352407 +
aaactaagcagattcagagtgg

SEQ ID NO: 105643 - DNA, 22 bp, Artificial Sequence
  Synthetic oligonucleotide; CTA chr11 5352391 5352412 5352408 5352413 +
agcagattcagagtggcatact

SEQ ID NO: 105644 - DNA, 22 bp, Artificial Sequence
  Synthetic oligonucleotide; TTC chr11 5352400 5352421 5352417 5352422 +
agagtggcatacttcgtttatt

SEQ ID NO: 105645 - DNA, 22 bp, Artificial Sequence
  Synthetic oligonucleotide; CTT chr11 5352414 5352435 5352431 5352436 +
cgtttattctctctgcctcact

SEQ ID NO: 105646 - DNA, 22 bp, Artificial Sequence
  Synthetic oligonucleotide; TTC chr11 5352415 5352436 5352432 5352437 +
gtttattctctctgcctcactc

SEQ ID NO: 105647 - DNA, 22 bp, Artificial Sequence
  Synthetic oligonucleotide; TTT chr11 5352419 5352440 5352436 5352441 +
attctctctgcctcactctaga

SEQ ID NO: 105648 - DNA, 22 bp, Artificial Sequence
  Synthetic oligonucleotide; TTA chr11 5352420 5352441 5352437 5352442 +
ttctctctgcctcactctagag

SEQ ID NO: 105649 - DNA, 22 bp, Artificial Sequence
  Synthetic oligonucleotide; TTC chr11 5352423 5352444 5352440 5352445 +
tctctgcctcactctagagcat

SEQ ID NO: 105650 - DNA, 22 bp, Artificial Sequence
  Synthetic oligonucleotide; CTC chr11 5352425 5352446 5352442 5352447 +
tctgcctcactctagagcatga

SEQ ID NO: 105651 - DNA, 22 bp, Artificial Sequence
  Synthetic oligonucleotide; CTC chr11 5352427 5352448 5352444 5352449 +
tgcctcactctagagcatgaca

SEQ ID NO: 105652 - DNA, 22 bp, Artificial Sequence
  Synthetic oligonucleotide; CTG chr11 5352429 5352450 5352446 5352451 +
cctcactctagagcatgacatt

SEQ ID NO: 105653 - DNA, 22 bp, Artificial Sequence
  Synthetic oligonucleotide; CTC chr11 5352433 5352454 5352450 5352455 +
actctagagcatgacattgttt

SEQ ID NO: 105654 - DNA, 22 bp, Artificial Sequence
  Synthetic oligonucleotide; CTC chr11 5352437 5352458 5352454 5352459 +
tagagcatgacattgtttcact

SEQ ID NO: 105655 - DNA, 22 bp, Artificial Sequence
  Synthetic oligonucleotide; CTA chr11 5352439 5352460 5352456 5352461 +
gagcatgacattgtttcactgg

SEQ ID NO: 105656 - DNA, 22 bp, Artificial Sequence
  Synthetic oligonucleotide; TTG chr11 5352452 5352473 5352469 5352474 +
tttcactggtctctgaggaata

SEQ ID NO: 105657 - DNA, 22 bp, Artificial Sequence
  Synthetic oligonucleotide; TTT chr11 5352455 5352476 5352472 5352477 +
cactggtctctgaggaataatt

SEQ ID NO: 105658 - DNA, 22 bp, Artificial Sequence
  Synthetic oligonucleotide; TTC chr11 5352456 5352477 5352473 5352478 +
actggtctctgaggaataattc

SEQ ID NO: 105659 - DNA, 22 bp, Artificial Sequence
  Synthetic oligonucleotide; CTG chr11 5352460 5352481 5352477 5352482 +
gtctctgaggaataattcaggg

SEQ ID NO: 105660 - DNA, 22 bp, Artificial Sequence
  Synthetic oligonucleotide; CTC chr11 5352465 5352486 5352482 5352487 +
tgaggaataattcaggggacct

SEQ ID NO: 105661 - DNA, 22 bp, Artificial Sequence
  Synthetic oligonucleotide; CTG chr11 5352467 5352488 5352484 5352489 +
aggaataattcaggggacctgg

SEQ ID NO: 105662 - DNA, 22 bp, Artificial Sequence
  Synthetic oligonucleotide; TTC chr11 5352478 5352499 5352495 5352500 +
aggggacctggacaggatgaca

SEQ ID NO: 105663 - DNA, 22 bp, Artificial Sequence
  Synthetic oligonucleotide; CTG chr11 5352488 5352509 5352505 5352510 +
gacaggatgacaatgttgccag

SEQ ID NO: 105664 - DNA, 22 bp, Artificial Sequence
  Synthetic oligonucleotide; TTG chr11 5352506 5352527 5352523 5352528 +
ccagcataagtaactagggaaa

SEQ ID NO: 105665 - DNA, 22 bp, Artificial Sequence
  Synthetic oligonucleotide; CTA chr11 5352522 5352543 5352539 5352544 +
gggaaagtcatttcaatgagaa

SEQ ID NO: 105666 - DNA, 22 bp, Artificial Sequence
  Synthetic oligonucleotide; TTT chr11 5352535 5352556 5352552 5352557 +
caatgagaactaatcaatccct

SEQ ID NO: 105667 - DNA, 22 bp, Artificial Sequence
  Synthetic oligonucleotide; TTC chr11 5352536 5352557 5352553 5352558 +
aatgagaactaatcaatccctg

SEQ ID NO: 105668 - DNA, 22 bp, Artificial Sequence
  Synthetic oligonucleotide; CTA chr11 5352547 5352568 5352564 5352569 +
atcaatccctgagcatttcagt

SEQ ID NO: 105669 - DNA, 22 bp, Artificial Sequence
  Synthetic oligonucleotide; CTG chr11 5352558 5352579 5352575 5352580 +
agcatttcagtggaaatcagtc

SEQ ID NO: 105670 - DNA, 22 bp, Artificial Sequence
  Synthetic oligonucleotide; TTT chr11 5352565 5352586 5352582 5352587 +
cagtggaaatcagtcaatccct

SEQ ID NO: 105671 - DNA, 22 bp, Artificial Sequence
  Synthetic oligonucleotide; TTC chr11 5352566 5352587 5352583 5352588 +
agtggaaatcagtcaatccctc

SEQ ID NO: 105672 - DNA, 22 bp, Artificial Sequence
  Synthetic oligonucleotide; CTC chr11 5352588 5352609 5352605 5352610 +
tgctacttagaacattatttta

SEQ ID NO: 105673 - DNA, 22 bp, Artificial Sequence
  Synthetic oligonucleotide; CTG chr11 5352590 5352611 5352607 5352612 +
ctacttagaacattattttacc

SEQ ID NO: 105674 - DNA, 22 bp, Artificial Sequence
  Synthetic oligonucleotide; CTA chr11 5352593 5352614 5352610 5352615 +
cttagaacattattttaccctg

SEQ ID NO: 105675 - DNA, 22 bp, Artificial Sequence
  Synthetic oligonucleotide; CTT chr11 5352596 5352617 5352613 5352618 +
agaacattattttaccctgcct

SEQ ID NO: 105676 - DNA, 22 bp, Artificial Sequence
  Synthetic oligonucleotide; TTA chr11 5352597 5352618 5352614 5352619 +
gaacattattttaccctgcctg

SEQ ID NO: 105677 - DNA, 22 bp, Artificial Sequence
  Synthetic oligonucleotide; TTA chr11 5352605 5352626 5352622 5352627 +
ttttaccctgcctgtctattgc

SEQ ID NO: 105678 - DNA, 22 bp, Artificial Sequence
  Synthetic oligonucleotide; TTT chr11 5352608 5352629 5352625 5352630 +
taccctgcctgtctattgctga

SEQ ID NO: 105679 - DNA, 22 bp, Artificial Sequence
  Synthetic oligonucleotide; TTT chr11 5352609 5352630 5352626 5352631 +
accctgcctgtctattgctgat

SEQ ID NO: 105680 - DNA, 22 bp, Artificial Sequence
  Synthetic oligonucleotide; TTA chr11 5352610 5352631 5352627 5352632 +
ccctgcctgtctattgctgatt

SEQ ID NO: 105681 - DNA, 22 bp, Artificial Sequence
  Synthetic oligonucleotide; CTG chr11 5352615 5352636 5352632 5352637 +
cctgtctattgctgatttgtat

SEQ ID NO: 105682 - DNA, 22 bp, Artificial Sequence
  Synthetic oligonucleotide; CTG chr11 5352619 5352640 5352636 5352641 +
tctattgctgatttgtataaga

SEQ ID NO: 105683 - DNA, 22 bp, Artificial Sequence
  Synthetic oligonucleotide; CTA chr11 5352623 5352644 5352640 5352645 +
ttgctgatttgtataagatata

SEQ ID NO: 105684 - DNA, 22 bp, Artificial Sequence
  Synthetic oligonucleotide; TTG chr11 5352626 5352647 5352643 5352648 +
ctgatttgtataagatatatgt

SEQ ID NO: 105685 - DNA, 22 bp, Artificial Sequence
  Synthetic oligonucleotide; CTG chr11 5352629 5352650 5352646 5352651 +
atttgtataagatatatgtaca

SEQ ID NO: 105686 - DNA, 22 bp, Artificial Sequence
  Synthetic oligonucleotide; TTT chr11 5352633 5352654 5352650 5352655 +
gtataagatatatgtacaacac

SEQ ID NO: 105687 - DNA, 22 bp, Artificial Sequence
  Synthetic oligonucleotide; TTG chr11 5352634 5352655 5352651 5352656 +
tataagatatatgtacaacact

SEQ ID NO: 105688 - DNA, 22 bp, Artificial Sequence
  Synthetic oligonucleotide; CTA chr11 5352657 5352678 5352674 5352679 +
agtacatatctcagtgctcaac

SEQ ID NO: 105689 - DNA, 22 bp, Artificial Sequence
  Synthetic oligonucleotide; CTC chr11 5352669 5352690 5352686 5352691 +
agtgctcaactgatattgtttt

SEQ ID NO: 105690 - DNA, 22 bp, Artificial Sequence
  Synthetic oligonucleotide; CTC chr11 5352676 5352697 5352693 5352698 +
aactgatattgttttctcaggt

SEQ ID NO: 105691 - DNA, 22 bp, Artificial Sequence
  Synthetic oligonucleotide; CTG chr11 5352681 5352702 5352698 5352703 +
atattgttttctcaggtaattt

SEQ ID NO: 105692 - DNA, 22 bp, Artificial Sequence
  Synthetic oligonucleotide; TTG chr11 5352687 5352708 5352704 5352709 +
ttttctcaggtaatttaactca

SEQ ID NO: 105693 - DNA, 22 bp, Artificial Sequence
  Synthetic oligonucleotide; TTT chr11 5352690 5352711 5352707 5352712 +
tctcaggtaatttaactcacat

SEQ ID NO: 105694 - DNA, 22 bp, Artificial Sequence
  Synthetic oligonucleotide; TTT chr11 5352691 5352712 5352708 5352713 +
ctcaggtaatttaactcacatt

SEQ ID NO: 105695 - DNA, 22 bp, Artificial Sequence
  Synthetic oligonucleotide; TTC chr11 5352692 5352713 5352709 5352714 +
tcaggtaatttaactcacattg

SEQ ID NO: 105696 - DNA, 22 bp, Artificial Sequence
  Synthetic oligonucleotide; CTC chr11 5352694 5352715 5352711 5352716 +
aggtaatttaactcacattgtt

SEQ ID NO: 105697 - DNA, 22 bp, Artificial Sequence
  Synthetic oligonucleotide; TTT chr11 5352703 5352724 5352720 5352725 +
aactcacattgtttgattagct

SEQ ID NO: 105698 - DNA, 22 bp, Artificial Sequence
  Synthetic oligonucleotide; TTA chr11 5352704 5352725 5352721 5352726 +
actcacattgtttgattagctt

SEQ ID NO: 105699 - DNA, 22 bp, Artificial Sequence
  Synthetic oligonucleotide; CTC chr11 5352708 5352729 5352725 5352730 +
acattgtttgattagcttatgg

SEQ ID NO: 105700 - DNA, 22 bp, Artificial Sequence
  Synthetic oligonucleotide; TTG chr11 5352714 5352735 5352731 5352736 +
tttgattagcttatggctggca

SEQ ID NO: 105701 - DNA, 22 bp, Artificial Sequence
  Synthetic oligonucleotide; TTT chr11 5352717 5352738 5352734 5352739 +
gattagcttatggctggcacca

SEQ ID NO: 105702 - DNA, 22 bp, Artificial Sequence
  Synthetic oligonucleotide; TTG chr11 5352718 5352739 5352735 5352740 +
attagcttatggctggcaccat

SEQ ID NO: 105703 - DNA, 22 bp, Artificial Sequence
  Synthetic oligonucleotide; TTA chr11 5352722 5352743 5352739 5352744 +
gcttatggctggcaccatacac

SEQ ID NO: 105704 - DNA, 22 bp, Artificial Sequence
  Synthetic oligonucleotide; CTT chr11 5352726 5352747 5352743 5352748 +
atggctggcaccatacacatac

SEQ ID NO: 105705 - DNA, 22 bp, Artificial Sequence
  Synthetic oligonucleotide; TTA chr11 5352727 5352748 5352744 5352749 +
tggctggcaccatacacataca

SEQ ID NO: 105706 - DNA, 22 bp, Artificial Sequence
  Synthetic oligonucleotide; CTG chr11 5352733 5352754 5352750 5352755 +
gcaccatacacatacatacata

SEQ ID NO: 105707 - DNA, 22 bp, Artificial Sequence
  Synthetic oligonucleotide; CTT chr11 5352758 5352779 5352775 5352780 +
acacacatacatatacacacac

SEQ ID NO: 105708 - DNA, 22 bp, Artificial Sequence
  Synthetic oligonucleotide; TTA chr11 5352759 5352780 5352776 5352781 +
cacacatacatatacacacaca

SEQ ID NO: 105709 - DNA, 22 bp, Artificial Sequence
  Synthetic oligonucleotide; CTA chr11 5352800 5352821 5352817 5352822 +
ttatatatatttaatatatata

SEQ ID NO: 105710 - DNA, 22 bp, Artificial Sequence
  Synthetic oligonucleotide; TTA chr11 5352803 5352824 5352820 5352825 +
tatatatttaatatatataata

SEQ ID NO: 105711 - DNA, 22 bp, Artificial Sequence
  Synthetic oligonucleotide; TTT chr11 5352812 5352833 5352829 5352834 +
aatatatataatacacactatt

SEQ ID NO: 105712 - DNA, 22 bp, Artificial Sequence
  Synthetic oligonucleotide; TTA chr11 5352813 5352834 5352830 5352835 +
atatatataatacacactatta

SEQ ID NO: 105713 - DNA, 22 bp, Artificial Sequence
  Synthetic oligonucleotide; CTA chr11 5352832 5352853 5352849 5352854 +
ttatatatacttaatatataat

SEQ ID NO: 105714 - DNA, 22 bp, Artificial Sequence
  Synthetic oligonucleotide; TTA chr11 5352835 5352856 5352852 5352857 +
tatatacttaatatataatagt

SEQ ID NO: 105715 - DNA, 22 bp, Artificial Sequence
  Synthetic oligonucleotide; CTT chr11 5352844 5352865 5352861 5352866 +
aatatataatagtgtgtgtatg

SEQ ID NO: 105716 - DNA, 22 bp, Artificial Sequence
  Synthetic oligonucleotide; TTA chr11 5352845 5352866 5352862 5352867 +
atatataatagtgtgtgtatgt

SEQ ID NO: 105717 - DNA, 22 bp, Artificial Sequence
  Synthetic oligonucleotide; CTG chr11 5352872 5352893 5352889 5352894 +
tgtgtgtttatatatattatat

SEQ ID NO: 105718 - DNA, 22 bp, Artificial Sequence
  Synthetic oligonucleotide; TTT chr11 5352881 5352902 5352898 5352903 +
atatatattatataaataatat

SEQ ID NO: 105719 - DNA, 22 bp, Artificial Sequence
  Synthetic oligonucleotide; TTA chr11 5352882 5352903 5352899 5352904 +
tatatattatataaataatata

SEQ ID NO: 105720 - DNA, 22 bp, Artificial Sequence
  Synthetic oligonucleotide; TTA chr11 5352891 5352912 5352908 5352913 +
tataaataatatatatatatga

SEQ ID NO: 105721 - DNA, 22 bp, Artificial Sequence
  Synthetic oligonucleotide; TTA chr11 5352921 5352942 5352938 5352943 +
tatatataattcttgggtctat

SEQ ID NO: 105722 - DNA, 22 bp, Artificial Sequence
  Synthetic oligonucleotide; TTC chr11 5352933 5352954 5352950 5352955 +
ttgggtctatgatttgggtcac

SEQ ID NO: 105723 - DNA, 22 bp, Artificial Sequence
  Synthetic oligonucleotide; CTT chr11 5352935 5352956 5352952 5352957 +
gggtctatgatttgggtcaccg

SEQ ID NO: 105724 - DNA, 22 bp, Artificial Sequence
  Synthetic oligonucleotide; TTG chr11 5352936 5352957 5352953 5352958 +
ggtctatgatttgggtcaccgg

SEQ ID NO: 105725 - DNA, 22 bp, Artificial Sequence
  Synthetic oligonucleotide; CTA chr11 5352942 5352963 5352959 5352964 +
tgatttgggtcaccggcatttc

SEQ ID NO: 105726 - DNA, 22 bp, Artificial Sequence
  Synthetic oligonucleotide; TTT chr11 5352948 5352969 5352965 5352970 +
gggtcaccggcatttcagtcaa

SEQ ID NO: 105727 - DNA, 22 bp, Artificial Sequence
  Synthetic oligonucleotide; TTG chr11 5352949 5352970 5352966 5352971 +
ggtcaccggcatttcagtcaat

SEQ ID NO: 105728 - DNA, 22 bp, Artificial Sequence
  Synthetic oligonucleotide; TTT chr11 5352963 5352984 5352980 5352985 +
cagtcaatgcccattgctctcc

SEQ ID NO: 105729 - DNA, 22 bp, Artificial Sequence
  Synthetic oligonucleotide; TTC chr11 5352964 5352985 5352981 5352986 +
agtcaatgcccattgctctcca

SEQ ID NO: 105730 - DNA, 22 bp, Artificial Sequence
  Synthetic oligonucleotide; TTG chr11 5352979 5353000 5352996 5353001 +
ctctccatatggcttgcatata

SEQ ID NO: 105731 - DNA, 22 bp, Artificial Sequence
  Synthetic oligonucleotide; CTC chr11 5352982 5353003 5352999 5353004 +
tccatatggcttgcatatatta

SEQ ID NO: 105732 - DNA, 22 bp, Artificial Sequence
  Synthetic oligonucleotide; CTC chr11 5352984 5353005 5353001 5353006 +
catatggcttgcatatattagt

SEQ ID NO: 105733 - DNA, 22 bp, Artificial Sequence
  Synthetic oligonucleotide; CTT chr11 5352994 5353015 5353011 5353016 +
gcatatattagtcctgttatac

SEQ ID NO: 105734 - DNA, 22 bp, Artificial Sequence
  Synthetic oligonucleotide; TTG chr11 5352995 5353016 5353012 5353017 +
catatattagtcctgttataca

SEQ ID NO: 105735 - DNA, 22 bp, Artificial Sequence
  Synthetic oligonucleotide; TTA chr11 5353004 5353025 5353021 5353026 +
gtcctgttatacataggaataa

SEQ ID NO: 105736 - DNA, 22 bp, Artificial Sequence
  Synthetic oligonucleotide; CTG chr11 5353010 5353031 5353027 5353032 +
ttatacataggaataaggcatt

SEQ ID NO: 105737 - DNA, 22 bp, Artificial Sequence
  Synthetic oligonucleotide; TTA chr11 5353013 5353034 5353030 5353035 +
tacataggaataaggcattttt

SEQ ID NO: 105738 - DNA, 22 bp, Artificial Sequence
  Synthetic oligonucleotide; TTT chr11 5353033 5353054 5353050 5353055 +
ttggcttcagacatacatccag

SEQ ID NO: 105739 - DNA, 22 bp, Artificial Sequence
  Synthetic oligonucleotide; TTT chr11 5353034 5353055 5353051 5353056 +
tggcttcagacatacatccagt

SEQ ID NO: 105740 - DNA, 22 bp, Artificial Sequence
  Synthetic oligonucleotide; TTT chr11 5353035 5353056 5353052 5353057 +
ggcttcagacatacatccagtt

SEQ ID NO: 105741 - DNA, 22 bp, Artificial Sequence
  Synthetic oligonucleotide; TTG chr11 5353036 5353057 5353053 5353058 +
gcttcagacatacatccagttc

SEQ ID NO: 105742 - DNA, 22 bp, Artificial Sequence
  Synthetic oligonucleotide; CTT chr11 5353040 5353061 5353057 5353062 +
cagacatacatccagttctctt

SEQ ID NO: 105743 - DNA, 22 bp, Artificial Sequence
  Synthetic oligonucleotide; TTC chr11 5353041 5353062 5353058 5353063 +
agacatacatccagttctcttg

SEQ ID NO: 105744 - DNA, 22 bp, Artificial Sequence
  Synthetic oligonucleotide; TTC chr11 5353058 5353079 5353075 5353080 +
tcttgcatatatggagctggct

SEQ ID NO: 105745 - DNA, 22 bp, Artificial Sequence
  Synthetic oligonucleotide; CTC chr11 5353060 5353081 5353077 5353082 +
ttgcatatatggagctggctgc

SEQ ID NO: 105746 - DNA, 22 bp, Artificial Sequence
  Synthetic oligonucleotide; CTT chr11 5353062 5353083 5353079 5353084 +
gcatatatggagctggctgctg

SEQ ID NO: 105747 - DNA, 22 bp, Artificial Sequence
  Synthetic oligonucleotide; TTG chr11 5353063 5353084 5353080 5353085 +
catatatggagctggctgctgt

SEQ ID NO: 105748 - DNA, 22 bp, Artificial Sequence
  Synthetic oligonucleotide; CTG chr11 5353077 5353098 5353094 5353099 +
gctgctgtttctagaaaattgc

SEQ ID NO: 105749 - DNA, 22 bp, Artificial Sequence
  Synthetic oligonucleotide; CTG chr11 5353081 5353102 5353098 5353103 +
ctgtttctagaaaattgcacgt

SEQ ID NO: 105750 - DNA, 22 bp, Artificial Sequence
  Synthetic oligonucleotide; CTG chr11 5353084 5353105 5353101 5353106 +
tttctagaaaattgcacgtgaa

SEQ ID NO: 105751 - DNA, 22 bp, Artificial Sequence
  Synthetic oligonucleotide; TTT chr11 5353087 5353108 5353104 5353109 +
ctagaaaattgcacgtgaagaa

SEQ ID NO: 105752 - DNA, 22 bp, Artificial Sequence
  Synthetic oligonucleotide; TTC chr11 5353088 5353109 5353105 5353110 +
tagaaaattgcacgtgaagaaa

SEQ ID NO: 105753 - DNA, 22 bp, Artificial Sequence
  Synthetic oligonucleotide; CTA chr11 5353090 5353111 5353107 5353112 +
gaaaattgcacgtgaagaaatg

SEQ ID NO: 105754 - DNA, 22 bp, Artificial Sequence
  Synthetic oligonucleotide; TTG chr11 5353098 5353119 5353115 5353120 +
cacgtgaagaaatgagactttc

SEQ ID NO: 105755 - DNA, 22 bp, Artificial Sequence
  Synthetic oligonucleotide; CTT chr11 5353118 5353139 5353135 5353140 +
tcttcaatgagagtaagccatt

SEQ ID NO: 105756 - DNA, 22 bp, Artificial Sequence
  Synthetic oligonucleotide; TTT chr11 5353119 5353140 5353136 5353141 +
cttcaatgagagtaagccattt

SEQ ID NO: 105757 - DNA, 22 bp, Artificial Sequence
  Synthetic oligonucleotide; TTC chr11 5353120 5353141 5353137 5353142 +
ttcaatgagagtaagccatttc

SEQ ID NO: 105758 - DNA, 22 bp, Artificial Sequence
  Synthetic oligonucleotide; CTT chr11 5353122 5353143 5353139 5353144 +
caatgagagtaagccatttccc

SEQ ID NO: 105759 - DNA, 22 bp, Artificial Sequence
  Synthetic oligonucleotide; TTC chr11 5353123 5353144 5353140 5353145 +
aatgagagtaagccatttccct

SEQ ID NO: 105760 - DNA, 22 bp, Artificial Sequence
  Synthetic oligonucleotide; TTT chr11 5353141 5353162 5353158 5353163 +
ccctcaattactttcttcaatg

SEQ ID NO: 105761 - DNA, 22 bp, Artificial Sequence
  Synthetic oligonucleotide; TTC chr11 5353142 5353163 5353159 5353164 +
cctcaattactttcttcaatga

SEQ ID NO: 105762 - DNA, 22 bp, Artificial Sequence
  Synthetic oligonucleotide; CTC chr11 5353146 5353167 5353163 5353168 +
aattactttcttcaatgagggt

SEQ ID NO: 105763 - DNA, 22 bp, Artificial Sequence
  Synthetic oligonucleotide; TTA chr11 5353151 5353172 5353168 5353173 +
ctttcttcaatgagggtaaacc

SEQ ID NO: 105764 - DNA, 22 bp, Artificial Sequence
  Synthetic oligonucleotide; CTT chr11 5353154 5353175 5353171 5353176 +
tcttcaatgagggtaaaccatt

SEQ ID NO: 105765 - DNA, 22 bp, Artificial Sequence
  Synthetic oligonucleotide; TTT chr11 5353155 5353176 5353172 5353177 +
cttcaatgagggtaaaccattt

SEQ ID NO: 105766 - DNA, 22 bp, Artificial Sequence
  Synthetic oligonucleotide; TTC chr11 5353156 5353177 5353173 5353178 +
ttcaatgagggtaaaccatttc

SEQ ID NO: 105767 - DNA, 22 bp, Artificial Sequence
  Synthetic oligonucleotide; CTT chr11 5353158 5353179 5353175 5353180 +
caatgagggtaaaccatttccc

SEQ ID NO: 105768 - DNA, 22 bp, Artificial Sequence
  Synthetic oligonucleotide; TTC chr11 5353159 5353180 5353176 5353181 +
aatgagggtaaaccatttccct

SEQ ID NO: 105769 - DNA, 22 bp, Artificial Sequence
  Synthetic oligonucleotide; TTT chr11 5353177 5353198 5353194 5353199 +
ccctcaattcaaaatgatgagt

SEQ ID NO: 105770 - DNA, 22 bp, Artificial Sequence
  Synthetic oligonucleotide; TTC chr11 5353178 5353199 5353195 5353200 +
cctcaattcaaaatgatgagtc

SEQ ID NO: 105771 - DNA, 22 bp, Artificial Sequence
  Synthetic oligonucleotide; CTC chr11 5353182 5353203 5353199 5353204 +
aattcaaaatgatgagtctagg

SEQ ID NO: 105772 - DNA, 22 bp, Artificial Sequence
  Synthetic oligonucleotide; TTC chr11 5353187 5353208 5353204 5353209 +
aaaatgatgagtctagggaaag

SEQ ID NO: 105773 - DNA, 22 bp, Artificial Sequence
  Synthetic oligonucleotide; CTA chr11 5353202 5353223 5353219 5353224 +
gggaaagtatctctatgagaaa

SEQ ID NO: 105774 - DNA, 22 bp, Artificial Sequence
  Synthetic oligonucleotide; CTC chr11 5353215 5353236 5353232 5353237 +
tatgagaaatgtgttcagttaa

SEQ ID NO: 105775 - DNA, 22 bp, Artificial Sequence
  Synthetic oligonucleotide; CTA chr11 5353217 5353238 5353234 5353239 +
tgagaaatgtgttcagttaaaa

SEQ ID NO: 105776 - DNA, 22 bp, Artificial Sequence
  Synthetic oligonucleotide; TTC chr11 5353231 5353252 5353248 5353253 +
agttaaaactttggttaacatt

SEQ ID NO: 105777 - DNA, 22 bp, Artificial Sequence
  Synthetic oligonucleotide; TTA chr11 5353236 5353257 5353253 5353258 +
aaactttggttaacatttatca

SEQ ID NO: 105778 - DNA, 22 bp, Artificial Sequence
  Synthetic oligonucleotide; CTT chr11 5353242 5353263 5353259 5353264 +
tggttaacatttatcaaataat

SEQ ID NO: 105779 - DNA, 22 bp, Artificial Sequence
  Synthetic oligonucleotide; TTT chr11 5353243 5353264 5353260 5353265 +
ggttaacatttatcaaataata

SEQ ID NO: 105780 - DNA, 22 bp, Artificial Sequence
  Synthetic oligonucleotide; TTG chr11 5353244 5353265 5353261 5353266 +
gttaacatttatcaaataatat

SEQ ID NO: 105781 - DNA, 22 bp, Artificial Sequence
  Synthetic oligonucleotide; TTA chr11 5353248 5353269 5353265 5353270 +
acatttatcaaataatattgat

SEQ ID NO: 105782 - DNA, 22 bp, Artificial Sequence
  Synthetic oligonucleotide; TTT chr11 5353254 5353275 5353271 5353276 +
atcaaataatattgataataat

SEQ ID NO: 105783 - DNA, 22 bp, Artificial Sequence
  Synthetic oligonucleotide; TTA chr11 5353255 5353276 5353272 5353277 +
tcaaataatattgataataatt

SEQ ID NO: 105784 - DNA, 22 bp, Artificial Sequence
  Synthetic oligonucleotide; TTG chr11 5353268 5353289 5353285 5353290 +
ataataatttgaaaacagagat

SEQ ID NO: 105785 - DNA, 22 bp, Artificial Sequence
  Synthetic oligonucleotide; TTT chr11 5353278 5353299 5353295 5353300 +
gaaaacagagatataatttcta

SEQ ID NO: 105786 - DNA, 22 bp, Artificial Sequence
  Synthetic oligonucleotide; TTG chr11 5353279 5353300 5353296 5353301 +
aaaacagagatataatttctaa

SEQ ID NO: 105787 - DNA, 22 bp, Artificial Sequence
  Synthetic oligonucleotide; TTT chr11 5353297 5353318 5353314 5353319 +
ctaattcagatgaccattgtct

SEQ ID NO: 105788 - DNA, 22 bp, Artificial Sequence
  Synthetic oligonucleotide; TTC chr11 5353298 5353319 5353315 5353320 +
taattcagatgaccattgtctt

SEQ ID NO: 105789 - DNA, 22 bp, Artificial Sequence
  Synthetic oligonucleotide; CTA chr11 5353300 5353321 5353317 5353322 +
attcagatgaccattgtcttga

SEQ ID NO: 105790 - DNA, 22 bp, Artificial Sequence
  Synthetic oligonucleotide; TTC chr11 5353304 5353325 5353321 5353326 +
agatgaccattgtcttgatagt

SEQ ID NO: 105791 - DNA, 22 bp, Artificial Sequence
  Synthetic oligonucleotide; TTG chr11 5353316 5353337 5353333 5353338 +
tcttgatagttaattccagtta

SEQ ID NO: 105792 - DNA, 22 bp, Artificial Sequence
  Synthetic oligonucleotide; CTT chr11 5353320 5353341 5353337 5353342 +
gatagttaattccagttactac

SEQ ID NO: 105793 - DNA, 22 bp, Artificial Sequence
  Synthetic oligonucleotide; TTG chr11 5353321 5353342 5353338 5353343 +
atagttaattccagttactact

SEQ ID NO: 105794 - DNA, 22 bp, Artificial Sequence
  Synthetic oligonucleotide; TTA chr11 5353328 5353349 5353345 5353350 +
attccagttactactgaacaga

SEQ ID NO: 105795 - DNA, 22 bp, Artificial Sequence
  Synthetic oligonucleotide; TTC chr11 5353332 5353353 5353349 5353354 +
cagttactactgaacagagaga

SEQ ID NO: 105796 - DNA, 22 bp, Artificial Sequence
  Synthetic oligonucleotide; TTA chr11 5353338 5353359 5353355 5353360 +
ctactgaacagagagatgcatt

SEQ ID NO: 105797 - DNA, 22 bp, Artificial Sequence
  Synthetic oligonucleotide; CTA chr11 5353341 5353362 5353358 5353363 +
ctgaacagagagatgcattttc

SEQ ID NO: 105798 - DNA, 22 bp, Artificial Sequence
  Synthetic oligonucleotide; CTG chr11 5353344 5353365 5353361 5353366 +
aacagagagatgcattttcata

SEQ ID NO: 105799 - DNA, 22 bp, Artificial Sequence
  Synthetic oligonucleotide; TTT chr11 5353361 5353382 5353378 5353383 +
tcataaagtggtatgagaggtc

SEQ ID NO: 105800 - DNA, 22 bp, Artificial Sequence
  Synthetic oligonucleotide; TTT chr11 5353362 5353383 5353379 5353384 +
cataaagtggtatgagaggtct

SEQ ID NO: 105801 - DNA, 22 bp, Artificial Sequence
  Synthetic oligonucleotide; TTC chr11 5353363 5353384 5353380 5353385 +
ataaagtggtatgagaggtctg

SEQ ID NO: 105802 - DNA, 22 bp, Artificial Sequence
  Synthetic oligonucleotide; CTG chr11 5353385 5353406 5353402 5353407 +
gtttaggggaacatcagagata

SEQ ID NO: 105803 - DNA, 22 bp, Artificial Sequence
  Synthetic oligonucleotide; TTT chr11 5353389 5353410 5353406 5353411 +
aggggaacatcagagataagac

SEQ ID NO: 105804 - DNA, 22 bp, Artificial Sequence
  Synthetic oligonucleotide; TTA chr11 5353390 5353411 5353407 5353412 +
ggggaacatcagagataagact

SEQ ID NO: 105805 - DNA, 22 bp, Artificial Sequence
  Synthetic oligonucleotide; CTA chr11 5353413 5353434 5353430 5353435 +
gataggggtgtctggcatgtgc

SEQ ID NO: 105806 - DNA, 22 bp, Artificial Sequence
  Synthetic oligonucleotide; CTG chr11 5353427 5353448 5353444 5353449 +
gcatgtgcaaaatagcagagtt

SEQ ID NO: 105807 - DNA, 22 bp, Artificial Sequence
  Synthetic oligonucleotide; TTG chr11 5353450 5353471 5353467 5353472 +
aaaaacaaacagttggtcatat

SEQ ID NO: 105808 - DNA, 22 bp, Artificial Sequence
  Synthetic oligonucleotide; TTG chr11 5353465 5353486 5353482 5353487 +
gtcatatgtggagagtggggag

SEQ ID NO: 105809 - DNA, 22 bp, Artificial Sequence
  Synthetic oligonucleotide; CTC chr11 5353513 5353534 5353530 5353535 +
ataactagaagataaaatggcc

SEQ ID NO: 105810 - DNA, 22 bp, Artificial Sequence
  Synthetic oligonucleotide; CTA chr11 5353520 5353541 5353537 5353542 +
gaagataaaatggccttttctg

SEQ ID NO: 105811 - DNA, 22 bp, Artificial Sequence
  Synthetic oligonucleotide; CTT chr11 5353537 5353558 5353554 5353559 +
ttctggctccaaatacttttga

SEQ ID NO: 105812 - DNA, 22 bp, Artificial Sequence
  Synthetic oligonucleotide; TTT chr11 5353538 5353559 5353555 5353560 +
tctggctccaaatacttttgat

SEQ ID NO: 105813 - DNA, 22 bp, Artificial Sequence
  Synthetic oligonucleotide; TTT chr11 5353539 5353560 5353556 5353561 +
ctggctccaaatacttttgatt

SEQ ID NO: 105814 - DNA, 22 bp, Artificial Sequence
  Synthetic oligonucleotide; TTC chr11 5353540 5353561 5353557 5353562 +
tggctccaaatacttttgattc

SEQ ID NO: 105815 - DNA, 22 bp, Artificial Sequence
  Synthetic oligonucleotide; CTG chr11 5353542 5353563 5353559 5353564 +
gctccaaatacttttgattctt

SEQ ID NO: 105816 - DNA, 22 bp, Artificial Sequence
  Synthetic oligonucleotide; CTC chr11 5353546 5353567 5353563 5353568 +
caaatacttttgattcttttca

SEQ ID NO: 105817 - DNA, 22 bp, Artificial Sequence
  Synthetic oligonucleotide; CTT chr11 5353555 5353576 5353572 5353577 +
ttgattcttttcagagtctagg

SEQ ID NO: 105818 - DNA, 22 bp, Artificial Sequence
  Synthetic oligonucleotide; TTT chr11 5353556 5353577 5353573 5353578 +
tgattcttttcagagtctaggc

SEQ ID NO: 105819 - DNA, 22 bp, Artificial Sequence
  Synthetic oligonucleotide; TTT chr11 5353557 5353578 5353574 5353579 +
gattcttttcagagtctaggca

SEQ ID NO: 105820 - DNA, 22 bp, Artificial Sequence
  Synthetic oligonucleotide; TTG chr11 5353558 5353579 5353575 5353580 +
attcttttcagagtctaggcat

SEQ ID NO: 105821 - DNA, 22 bp, Artificial Sequence
  Synthetic oligonucleotide; TTC chr11 5353562 5353583 5353579 5353584 +
ttttcagagtctaggcatgaga

SEQ ID NO: 105822 - DNA, 22 bp, Artificial Sequence
  Synthetic oligonucleotide; CTT chr11 5353564 5353585 5353581 5353586 +
ttcagagtctaggcatgagaag

SEQ ID NO: 105823 - DNA, 22 bp, Artificial Sequence
  Synthetic oligonucleotide; TTT chr11 5353565 5353586 5353582 5353587 +
tcagagtctaggcatgagaaga

SEQ ID NO: 105824 - DNA, 22 bp, Artificial Sequence
  Synthetic oligonucleotide; TTT chr11 5353566 5353587 5353583 5353588 +
cagagtctaggcatgagaagag

SEQ ID NO: 105825 - DNA, 22 bp, Artificial Sequence
  Synthetic oligonucleotide; TTC chr11 5353567 5353588 5353584 5353589 +
agagtctaggcatgagaagagg

SEQ ID NO: 105826 - DNA, 22 bp, Artificial Sequence
  Synthetic oligonucleotide; CTA chr11 5353575 5353596 5353592 5353597 +
ggcatgagaagagggggtttgt

SEQ ID NO: 105827 - DNA, 22 bp, Artificial Sequence
  Synthetic oligonucleotide; TTT chr11 5353595 5353616 5353612 5353617 +
gtggtcctatggccaggtgaag

SEQ ID NO: 105828 - DNA, 22 bp, Artificial Sequence
  Synthetic oligonucleotide; TTG chr11 5353596 5353617 5353613 5353618 +
tggtcctatggccaggtgaaga

SEQ ID NO: 105829 - DNA, 22 bp, Artificial Sequence
  Synthetic oligonucleotide; CTA chr11 5353604 5353625 5353621 5353626 +
tggccaggtgaagagccagtat

SEQ ID NO: 105830 - DNA, 22 bp, Artificial Sequence
  Synthetic oligonucleotide; CTC chr11 5353635 5353656 5353652 5353657 +
aaatgataagttttaaattaat

SEQ ID NO: 105831 - DNA, 22 bp, Artificial Sequence
  Synthetic oligonucleotide; TTT chr11 5353648 5353669 5353665 5353670 +
taaattaattttaaaagaaaga

SEQ ID NO: 105832 - DNA, 22 bp, Artificial Sequence
  Synthetic oligonucleotide; TTT chr11 5353649 5353670 5353666 5353671 +
aaattaattttaaaagaaagat

SEQ ID NO: 105833 - DNA, 22 bp, Artificial Sequence
  Synthetic oligonucleotide; TTA chr11 5353650 5353671 5353667 5353672 +
aattaattttaaaagaaagata

SEQ ID NO: 105834 - DNA, 22 bp, Artificial Sequence
  Synthetic oligonucleotide; TTA chr11 5353655 5353676 5353672 5353677 +
attttaaaagaaagatattctt

SEQ ID NO: 105835 - DNA, 22 bp, Artificial Sequence
  Synthetic oligonucleotide; TTT chr11 5353659 5353680 5353676 5353681 +
taaaagaaagatattcttttga

SEQ ID NO: 105836 - DNA, 22 bp, Artificial Sequence
  Synthetic oligonucleotide; TTT chr11 5353660 5353681 5353677 5353682 +
aaaagaaagatattcttttgac

SEQ ID NO: 105837 - DNA, 22 bp, Artificial Sequence
  Synthetic oligonucleotide; TTA chr11 5353661 5353682 5353678 5353683 +
aaagaaagatattcttttgacc

SEQ ID NO: 105838 - DNA, 22 bp, Artificial Sequence
  Synthetic oligonucleotide; TTC chr11 5353675 5353696 5353692 5353697 +
ttttgaccaaaatacagggtat

SEQ ID NO: 105839 - DNA, 22 bp, Artificial Sequence
  Synthetic oligonucleotide; CTT chr11 5353677 5353698 5353694 5353699 +
ttgaccaaaatacagggtatga

SEQ ID NO: 105840 - DNA, 22 bp, Artificial Sequence
  Synthetic oligonucleotide; TTT chr11 5353678 5353699 5353695 5353700 +
tgaccaaaatacagggtatgat

SEQ ID NO: 105841 - DNA, 22 bp, Artificial Sequence
  Synthetic oligonucleotide; TTT chr11 5353679 5353700 5353696 5353701 +
gaccaaaatacagggtatgatg

SEQ ID NO: 105842 - DNA, 22 bp, Artificial Sequence
  Synthetic oligonucleotide; TTG chr11 5353680 5353701 5353697 5353702 +
accaaaatacagggtatgatgt

SEQ ID NO: 105843 - DNA, 22 bp, Artificial Sequence
  Synthetic oligonucleotide; CTT chr11 5353706 5353727 5353723 5353728 +
ggactacacaaggggccaccca

SEQ ID NO: 105844 - DNA, 22 bp, Artificial Sequence
  Synthetic oligonucleotide; TTG chr11 5353707 5353728 5353724 5353729 +
gactacacaaggggccacccag

SEQ ID NO: 105845 - DNA, 22 bp, Artificial Sequence
  Synthetic oligonucleotide; CTA chr11 5353712 5353733 5353729 5353734 +
cacaaggggccacccagtgacc

SEQ ID NO: 105846 - DNA, 22 bp, Artificial Sequence
  Synthetic oligonucleotide; CTG chr11 5353743 5353764 5353760 5353765 +
gatgcccctcatctctggcctc

SEQ ID NO: 105847 - DNA, 22 bp, Artificial Sequence
  Synthetic oligonucleotide; CTC chr11 5353753 5353774 5353770 5353775 +
atctctggcctctgtcatactg

SEQ ID NO: 105848 - DNA, 22 bp, Artificial Sequence
  Synthetic oligonucleotide; CTC chr11 5353758 5353779 5353775 5353780 +
tggcctctgtcatactgacact

SEQ ID NO: 105849 - DNA, 22 bp, Artificial Sequence
  Synthetic oligonucleotide; CTG chr11 5353760 5353781 5353777 5353782 +
gcctctgtcatactgacactca

SEQ ID NO: 105850 - DNA, 22 bp, Artificial Sequence
  Synthetic oligonucleotide; CTC chr11 5353765 5353786 5353782 5353787 +
tgtcatactgacactcagtgat

SEQ ID NO: 105851 - DNA, 22 bp, Artificial Sequence
  Synthetic oligonucleotide; CTG chr11 5353767 5353788 5353784 5353789 +
tcatactgacactcagtgatct

SEQ ID NO: 105852 - DNA, 22 bp, Artificial Sequence
  Synthetic oligonucleotide; CTG chr11 5353775 5353796 5353792 5353797 +
acactcagtgatctatggctgc

SEQ ID NO: 105853 - DNA, 22 bp, Artificial Sequence
  Synthetic oligonucleotide; CTC chr11 5353781 5353802 5353798 5353803 +
agtgatctatggctgcccacct

SEQ ID NO: 105854 - DNA, 22 bp, Artificial Sequence
  Synthetic oligonucleotide; CTA chr11 5353790 5353811 5353807 5353812 +
tggctgcccacctactcttcat

SEQ ID NO: 105855 - DNA, 22 bp, Artificial Sequence
  Synthetic oligonucleotide; CTG chr11 5353796 5353817 5353813 5353818 +
cccacctactcttcatcacaga

SEQ ID NO: 105856 - DNA, 22 bp, Artificial Sequence
  Synthetic oligonucleotide; CTA chr11 5353804 5353825 5353821 5353826 +
ctcttcatcacagaaaggtggg

SEQ ID NO: 105857 - DNA, 22 bp, Artificial Sequence
  Synthetic oligonucleotide; CTC chr11 5353807 5353828 5353824 5353829 +
ttcatcacagaaaggtggggat

SEQ ID NO: 105858 - DNA, 22 bp, Artificial Sequence
  Synthetic oligonucleotide; CTT chr11 5353809 5353830 5353826 5353831 +
catcacagaaaggtggggattt

SEQ ID NO: 105859 - DNA, 22 bp, Artificial Sequence
  Synthetic oligonucleotide; TTC chr11 5353810 5353831 5353827 5353832 +
atcacagaaaggtggggatttt

SEQ ID NO: 105860 - DNA, 22 bp, Artificial Sequence
  Synthetic oligonucleotide; TTT chr11 5353831 5353852 5353848 5353853 +
tttaggattcttgggatgtata

SEQ ID NO: 105861 - DNA, 22 bp, Artificial Sequence
  Synthetic oligonucleotide; TTT chr11 5353832 5353853 5353849 5353854 +
ttaggattcttgggatgtataa

SEQ ID NO: 105862 - DNA, 22 bp, Artificial Sequence
  Synthetic oligonucleotide; TTT chr11 5353833 5353854 5353850 5353855 +
taggattcttgggatgtataaa

SEQ ID NO: 105863 - DNA, 22 bp, Artificial Sequence
  Synthetic oligonucleotide; TTT chr11 5353834 5353855 5353851 5353856 +
aggattcttgggatgtataaat

SEQ ID NO: 105864 - DNA, 22 bp, Artificial Sequence
  Synthetic oligonucleotide; TTA chr11 5353835 5353856 5353852 5353857 +
ggattcttgggatgtataaata

SEQ ID NO: 105865 - DNA, 22 bp, Artificial Sequence
  Synthetic oligonucleotide; TTC chr11 5353841 5353862 5353858 5353863 +
ttgggatgtataaataacacag

SEQ ID NO: 105866 - DNA, 22 bp, Artificial Sequence
  Synthetic oligonucleotide; CTT chr11 5353843 5353864 5353860 5353865 +
gggatgtataaataacacagag

SEQ ID NO: 105867 - DNA, 22 bp, Artificial Sequence
  Synthetic oligonucleotide; TTG chr11 5353844 5353865 5353861 5353866 +
ggatgtataaataacacagaga

SEQ ID NO: 105868 - DNA, 22 bp, Artificial Sequence
  Synthetic oligonucleotide; CTT chr11 5353889 5353910 5353906 5353911 +
cacaatagtttccaggctagta

SEQ ID NO: 105869 - DNA, 22 bp, Artificial Sequence
  Synthetic oligonucleotide; TTC chr11 5353890 5353911 5353907 5353912 +
acaatagtttccaggctagtaa

SEQ ID NO: 105870 - DNA, 22 bp, Artificial Sequence
  Synthetic oligonucleotide; TTT chr11 5353900 5353921 5353917 5353922 +
ccaggctagtaaatgatcttta

SEQ ID NO: 105871 - DNA, 22 bp, Artificial Sequence
  Synthetic oligonucleotide; TTC chr11 5353901 5353922 5353918 5353923 +
caggctagtaaatgatctttat

SEQ ID NO: 105872 - DNA, 22 bp, Artificial Sequence
  Synthetic oligonucleotide; CTA chr11 5353908 5353929 5353925 5353930 +
gtaaatgatctttatctgatta

SEQ ID NO: 105873 - DNA, 22 bp, Artificial Sequence
  Synthetic oligonucleotide; CTT chr11 5353920 5353941 5353937 5353942 +
tatctgattagaccaaaagatt

SEQ ID NO: 105874 - DNA, 22 bp, Artificial Sequence
  Synthetic oligonucleotide; TTT chr11 5353921 5353942 5353938 5353943 +
atctgattagaccaaaagattt

SEQ ID NO: 105875 - DNA, 22 bp, Artificial Sequence
  Synthetic oligonucleotide; TTA chr11 5353922 5353943 5353939 5353944 +
tctgattagaccaaaagatttt

SEQ ID NO: 105876 - DNA, 22 bp, Artificial Sequence
  Synthetic oligonucleotide; CTG chr11 5353926 5353947 5353943 5353948 +
attagaccaaaagattttgttt

SEQ ID NO: 105877 - DNA, 22 bp, Artificial Sequence
  Synthetic oligonucleotide; TTA chr11 5353930 5353951 5353947 5353952 +
gaccaaaagattttgtttgttt

SEQ ID NO: 105878 - DNA, 22 bp, Artificial Sequence
  Synthetic oligonucleotide; TTT chr11 5353943 5353964 5353960 5353965 +
tgtttgttttactcaacttggc

SEQ ID NO: 105879 - DNA, 22 bp, Artificial Sequence
  Synthetic oligonucleotide; TTT chr11 5353944 5353965 5353961 5353966 +
gtttgttttactcaacttggct

SEQ ID NO: 105880 - DNA, 22 bp, Artificial Sequence
  Synthetic oligonucleotide; TTG chr11 5353945 5353966 5353962 5353967 +
tttgttttactcaacttggctg

SEQ ID NO: 105881 - DNA, 22 bp, Artificial Sequence
  Synthetic oligonucleotide; TTT chr11 5353948 5353969 5353965 5353970 +
gttttactcaacttggctgtgt

SEQ ID NO: 105882 - DNA, 22 bp, Artificial Sequence
  Synthetic oligonucleotide; TTG chr11 5353949 5353970 5353966 5353971 +
ttttactcaacttggctgtgtg

SEQ ID NO: 105883 - DNA, 22 bp, Artificial Sequence
  Synthetic oligonucleotide; TTT chr11 5353952 5353973 5353969 5353974 +
tactcaacttggctgtgtgtga

SEQ ID NO: 105884 - DNA, 22 bp, Artificial Sequence
  Synthetic oligonucleotide; TTT chr11 5353953 5353974 5353970 5353975 +
actcaacttggctgtgtgtgaa

SEQ ID NO: 105885 - DNA, 22 bp, Artificial Sequence
  Synthetic oligonucleotide; TTA chr11 5353954 5353975 5353971 5353976 +
ctcaacttggctgtgtgtgaaa

SEQ ID NO: 105886 - DNA, 22 bp, Artificial Sequence
  Synthetic oligonucleotide; CTC chr11 5353957 5353978 5353974 5353979 +
aacttggctgtgtgtgaaattt

SEQ ID NO: 105887 - DNA, 22 bp, Artificial Sequence
  Synthetic oligonucleotide; CTT chr11 5353962 5353983 5353979 5353984 +
ggctgtgtgtgaaatttgcctt

SEQ ID NO: 105888 - DNA, 22 bp, Artificial Sequence
  Synthetic oligonucleotide; TTG chr11 5353963 5353984 5353980 5353985 +
gctgtgtgtgaaatttgccttt

SEQ ID NO: 105889 - DNA, 22 bp, Artificial Sequence
  Synthetic oligonucleotide; CTG chr11 5353967 5353988 5353984 5353989 +
tgtgtgaaatttgcctttctct

SEQ ID NO: 105890 - DNA, 22 bp, Artificial Sequence
  Synthetic oligonucleotide; TTT chr11 5353979 5354000 5353996 5354001 +
gcctttctcttttgtagcttct

SEQ ID NO: 105891 - DNA, 22 bp, Artificial Sequence
  Synthetic oligonucleotide; TTG chr11 5353980 5354001 5353997 5354002 +
cctttctcttttgtagcttctt

SEQ ID NO: 105892 - DNA, 22 bp, Artificial Sequence
  Synthetic oligonucleotide; CTT chr11 5353984 5354005 5354001 5354006 +
tctcttttgtagcttcttgact

SEQ ID NO: 105893 - DNA, 22 bp, Artificial Sequence
  Synthetic oligonucleotide; TTT chr11 5353985 5354006 5354002 5354007 +
ctcttttgtagcttcttgactg

SEQ ID NO: 105894 - DNA, 22 bp, Artificial Sequence
  Synthetic oligonucleotide; TTC chr11 5353986 5354007 5354003 5354008 +
tcttttgtagcttcttgactgt

SEQ ID NO: 105895 - DNA, 22 bp, Artificial Sequence
  Synthetic oligonucleotide; CTC chr11 5353988 5354009 5354005 5354010 +
ttttgtagcttcttgactgtgt

SEQ ID NO: 105896 - DNA, 22 bp, Artificial Sequence
  Synthetic oligonucleotide; CTT chr11 5353990 5354011 5354007 5354012 +
ttgtagcttcttgactgtgtgc

SEQ ID NO: 105897 - DNA, 22 bp, Artificial Sequence
  Synthetic oligonucleotide; TTT chr11 5353991 5354012 5354008 5354013 +
tgtagcttcttgactgtgtgct

SEQ ID NO: 105898 - DNA, 22 bp, Artificial Sequence
  Synthetic oligonucleotide; TTT chr11 5353992 5354013 5354009 5354014 +
gtagcttcttgactgtgtgctc

SEQ ID NO: 105899 - DNA, 22 bp, Artificial Sequence
  Synthetic oligonucleotide; TTG chr11 5353993 5354014 5354010 5354015 +
tagcttcttgactgtgtgctcg

SEQ ID NO: 105900 - DNA, 22 bp, Artificial Sequence
  Synthetic oligonucleotide; CTT chr11 5353999 5354020 5354016 5354021 +
cttgactgtgtgctcgaggatg

SEQ ID NO: 105901 - DNA, 22 bp, Artificial Sequence
  Synthetic oligonucleotide; TTC chr11 5354000 5354021 5354017 5354022 +
ttgactgtgtgctcgaggatgg

SEQ ID NO: 105902 - DNA, 22 bp, Artificial Sequence
  Synthetic oligonucleotide; CTT chr11 5354002 5354023 5354019 5354024 +
gactgtgtgctcgaggatggta

SEQ ID NO: 105903 - DNA, 22 bp, Artificial Sequence
  Synthetic oligonucleotide; TTG chr11 5354003 5354024 5354020 5354025 +
actgtgtgctcgaggatggtaa

SEQ ID NO: 105904 - DNA, 22 bp, Artificial Sequence
  Synthetic oligonucleotide; CTG chr11 5354007 5354028 5354024 5354029 +
tgtgctcgaggatggtaaatat

SEQ ID NO: 105905 - DNA, 22 bp, Artificial Sequence
  Synthetic oligonucleotide; CTC chr11 5354014 5354035 5354031 5354036 +
gaggatggtaaatataacatag

SEQ ID NO: 105906 - DNA, 22 bp, Artificial Sequence
  Synthetic oligonucleotide; TTC chr11 5354039 5354060 5354056 5354061 +
ttattccctactgtattacaga

SEQ ID NO: 105907 - DNA, 22 bp, Artificial Sequence
  Synthetic oligonucleotide; CTT chr11 5354041 5354062 5354058 5354063 +
attccctactgtattacagaac

SEQ ID NO: 105908 - DNA, 22 bp, Artificial Sequence
  Synthetic oligonucleotide; TTA chr11 5354042 5354063 5354059 5354064 +
ttccctactgtattacagaact

SEQ ID NO: 105909 - DNA, 22 bp, Artificial Sequence
  Synthetic oligonucleotide; TTC chr11 5354045 5354066 5354062 5354067 +
cctactgtattacagaacttct

SEQ ID NO: 105910 - DNA, 22 bp, Artificial Sequence
  Synthetic oligonucleotide; CTA chr11 5354049 5354070 5354066 5354071 +
ctgtattacagaacttctcaca

SEQ ID NO: 105911 - DNA, 22 bp, Artificial Sequence
  Synthetic oligonucleotide; CTG chr11 5354052 5354073 5354069 5354074 +
tattacagaacttctcacatag

SEQ ID NO: 105912 - DNA, 22 bp, Artificial Sequence
  Synthetic oligonucleotide; TTA chr11 5354057 5354078 5354074 5354079 +
cagaacttctcacatagaccat

SEQ ID NO: 105913 - DNA, 22 bp, Artificial Sequence
  Synthetic oligonucleotide; CTT chr11 5354065 5354086 5354082 5354087 +
ctcacatagaccatttttaaca

SEQ ID NO: 105914 - DNA, 22 bp, Artificial Sequence
  Synthetic oligonucleotide; TTC chr11 5354066 5354087 5354083 5354088 +
tcacatagaccatttttaacaa

SEQ ID NO: 105915 - DNA, 22 bp, Artificial Sequence
  Synthetic oligonucleotide; CTC chr11 5354068 5354089 5354085 5354090 +
acatagaccatttttaacaaaa

SEQ ID NO: 105916 - DNA, 22 bp, Artificial Sequence
  Synthetic oligonucleotide; TTT chr11 5354081 5354102 5354098 5354103 +
ttaacaaaatataatttttcat

SEQ ID NO: 105917 - DNA, 22 bp, Artificial Sequence
  Synthetic oligonucleotide; TTT chr11 5354082 5354103 5354099 5354104 +
taacaaaatataatttttcatt

SEQ ID NO: 105918 - DNA, 22 bp, Artificial Sequence
  Synthetic oligonucleotide; TTT chr11 5354083 5354104 5354100 5354105 +
aacaaaatataatttttcatta

SEQ ID NO: 105919 - DNA, 22 bp, Artificial Sequence
  Synthetic oligonucleotide; TTA chr11 5354084 5354105 5354101 5354106 +
acaaaatataatttttcattaa

SEQ ID NO: 105920 - DNA, 22 bp, Artificial Sequence
  Synthetic oligonucleotide; TTT chr11 5354098 5354119 5354115 5354120 +
ttcattaaaatgaataaataaa

SEQ ID NO: 105921 - DNA, 22 bp, Artificial Sequence
  Synthetic oligonucleotide; TTT chr11 5354099 5354120 5354116 5354121 +
tcattaaaatgaataaataaaa

SEQ ID NO: 105922 - DNA, 22 bp, Artificial Sequence
  Synthetic oligonucleotide; TTT chr11 5354100 5354121 5354117 5354122 +
cattaaaatgaataaataaaat

SEQ ID NO: 105923 - DNA, 22 bp, Artificial Sequence
  Synthetic oligonucleotide; TTC chr11 5354101 5354122 5354118 5354123 +
attaaaatgaataaataaaatt

SEQ ID NO: 105924 - DNA, 22 bp, Artificial Sequence
  Synthetic oligonucleotide; TTA chr11 5354105 5354126 5354122 5354127 +
aaatgaataaataaaatttaaa

SEQ ID NO: 105925 - DNA, 22 bp, Artificial Sequence
  Synthetic oligonucleotide; TTT chr11 5354124 5354145 5354141 5354146 +
aaagtgacccatgtctttctgt

SEQ ID NO: 105926 - DNA, 22 bp, Artificial Sequence
  Synthetic oligonucleotide; TTA chr11 5354125 5354146 5354142 5354147 +
aagtgacccatgtctttctgtg

SEQ ID NO: 105927 - DNA, 22 bp, Artificial Sequence
  Synthetic oligonucleotide; CTT chr11 5354141 5354162 5354158 5354163 +
tctgtgtgtctgctagttcttc

SEQ ID NO: 105928 - DNA, 22 bp, Artificial Sequence
  Synthetic oligonucleotide; TTT chr11 5354142 5354163 5354159 5354164 +
ctgtgtgtctgctagttcttct

SEQ ID NO: 105929 - DNA, 22 bp, Artificial Sequence
  Synthetic oligonucleotide; TTC chr11 5354143 5354164 5354160 5354165 +
tgtgtgtctgctagttcttctg

SEQ ID NO: 105930 - DNA, 22 bp, Artificial Sequence
  Synthetic oligonucleotide; CTG chr11 5354145 5354166 5354162 5354167 +
tgtgtctgctagttcttctgtc

SEQ ID NO: 105931 - DNA, 22 bp, Artificial Sequence
  Synthetic oligonucleotide; CTG chr11 5354153 5354174 5354170 5354175 +
ctagttcttctgtctgttactg

SEQ ID NO: 105932 - DNA, 22 bp, Artificial Sequence
  Synthetic oligonucleotide; CTA chr11 5354156 5354177 5354173 5354178 +
gttcttctgtctgttactgctc

SEQ ID NO: 105933 - DNA, 22 bp, Artificial Sequence
  Synthetic oligonucleotide; TTC chr11 5354160 5354181 5354177 5354182 +
ttctgtctgttactgctctctg

SEQ ID NO: 105934 - DNA, 22 bp, Artificial Sequence
  Synthetic oligonucleotide; CTT chr11 5354162 5354183 5354179 5354184 +
ctgtctgttactgctctctgta

SEQ ID NO: 105935 - DNA, 22 bp, Artificial Sequence
  Synthetic oligonucleotide; TTC chr11 5354163 5354184 5354180 5354185 +
tgtctgttactgctctctgtat

SEQ ID NO: 105936 - DNA, 22 bp, Artificial Sequence
  Synthetic oligonucleotide; CTG chr11 5354165 5354186 5354182 5354187 +
tctgttactgctctctgtattg

SEQ ID NO: 105937 - DNA, 22 bp, Artificial Sequence
  Synthetic oligonucleotide; CTG chr11 5354169 5354190 5354186 5354191 +
ttactgctctctgtattgtctt

SEQ ID NO: 105938 - DNA, 22 bp, Artificial Sequence
  Synthetic oligonucleotide; TTA chr11 5354172 5354193 5354189 5354194 +
ctgctctctgtattgtcttcca

SEQ ID NO: 105939 - DNA, 22 bp, Artificial Sequence
  Synthetic oligonucleotide; CTG chr11 5354175 5354196 5354192 5354197 +
ctctctgtattgtcttccaaga

SEQ ID NO: 105940 - DNA, 22 bp, Artificial Sequence
  Synthetic oligonucleotide; CTC chr11 5354178 5354199 5354195 5354200 +
tctgtattgtcttccaagatat

SEQ ID NO: 105941 - DNA, 22 bp, Artificial Sequence
  Synthetic oligonucleotide; CTC chr11 5354180 5354201 5354197 5354202 +
tgtattgtcttccaagatatgg

SEQ ID NO: 105942 - DNA, 22 bp, Artificial Sequence
  Synthetic oligonucleotide; CTG chr11 5354182 5354203 5354199 5354204 +
tattgtcttccaagatatgggc

SEQ ID NO: 105943 - DNA, 22 bp, Artificial Sequence
  Synthetic oligonucleotide; TTG chr11 5354187 5354208 5354204 5354209 +
tcttccaagatatgggcaatgt

SEQ ID NO: 105944 - DNA, 22 bp, Artificial Sequence
  Synthetic oligonucleotide; CTT chr11 5354191 5354212 5354208 5354213 +
ccaagatatgggcaatgtatac

SEQ ID NO: 105945 - DNA, 22 bp, Artificial Sequence
  Synthetic oligonucleotide; TTC chr11 5354192 5354213 5354209 5354214 +
caagatatgggcaatgtatact

SEQ ID NO: 105946 - DNA, 22 bp, Artificial Sequence
  Synthetic oligonucleotide; CTT chr11 5354215 5354236 5354232 5354237 +
aatcctgttctttcttcccttg

SEQ ID NO: 105947 - DNA, 22 bp, Artificial Sequence
  Synthetic oligonucleotide; TTA chr11 5354216 5354237 5354233 5354238 +
atcctgttctttcttcccttgg

SEQ ID NO: 105948 - DNA, 22 bp, Artificial Sequence
  Synthetic oligonucleotide; CTG chr11 5354222 5354243 5354239 5354244 +
ttctttcttcccttgggctttt

SEQ ID NO: 105949 - DNA, 22 bp, Artificial Sequence
  Synthetic oligonucleotide; TTC chr11 5354225 5354246 5354242 5354247 +
tttcttcccttgggcttttggg

SEQ ID NO: 105950 - DNA, 22 bp, Artificial Sequence
  Synthetic oligonucleotide; CTT chr11 5354227 5354248 5354244 5354249 +
tcttcccttgggcttttgggaa

SEQ ID NO: 105951 - DNA, 22 bp, Artificial Sequence
  Synthetic oligonucleotide; TTT chr11 5354228 5354249 5354245 5354250 +
cttcccttgggcttttgggaat

SEQ ID NO: 105952 - DNA, 22 bp, Artificial Sequence
  Synthetic oligonucleotide; TTC chr11 5354229 5354250 5354246 5354251 +
ttcccttgggcttttgggaatg

SEQ ID NO: 105953 - DNA, 22 bp, Artificial Sequence
  Synthetic oligonucleotide; CTT chr11 5354231 5354252 5354248 5354253 +
cccttgggcttttgggaatgaa

SEQ ID NO: 105954 - DNA, 22 bp, Artificial Sequence
  Synthetic oligonucleotide; TTC chr11 5354232 5354253 5354249 5354254 +
ccttgggcttttgggaatgaat

SEQ ID NO: 105955 - DNA, 22 bp, Artificial Sequence
  Synthetic oligonucleotide; CTT chr11 5354236 5354257 5354253 5354258 +
gggcttttgggaatgaattcag

SEQ ID NO: 105956 - DNA, 22 bp, Artificial Sequence
  Synthetic oligonucleotide; TTG chr11 5354237 5354258 5354254 5354259 +
ggcttttgggaatgaattcagg

SEQ ID NO: 105957 - DNA, 22 bp, Artificial Sequence
  Synthetic oligonucleotide; CTT chr11 5354242 5354263 5354259 5354264 +
ttgggaatgaattcagggggat

SEQ ID NO: 105958 - DNA, 22 bp, Artificial Sequence
  Synthetic oligonucleotide; TTT chr11 5354243 5354264 5354260 5354265 +
tgggaatgaattcagggggatc

SEQ ID NO: 105959 - DNA, 22 bp, Artificial Sequence
  Synthetic oligonucleotide; TTT chr11 5354244 5354265 5354261 5354266 +
gggaatgaattcagggggatct

SEQ ID NO: 105960 - DNA, 22 bp, Artificial Sequence
  Synthetic oligonucleotide; TTG chr11 5354245 5354266 5354262 5354267 +
ggaatgaattcagggggatcta

SEQ ID NO: 105961 - DNA, 22 bp, Artificial Sequence
  Synthetic oligonucleotide; TTC chr11 5354256 5354277 5354273 5354278 +
agggggatctaagccacatcaa

SEQ ID NO: 105962 - DNA, 22 bp, Artificial Sequence
  Synthetic oligonucleotide; CTA chr11 5354267 5354288 5354284 5354289 +
agccacatcaaagaaaatcttt

SEQ ID NO: 105963 - DNA, 22 bp, Artificial Sequence
  Synthetic oligonucleotide; CTT chr11 5354288 5354309 5354305 5354310 +
tcttgactcaccctctaggtcc

SEQ ID NO: 105964 - DNA, 22 bp, Artificial Sequence
  Synthetic oligonucleotide; TTT chr11 5354289 5354310 5354306 5354311 +
cttgactcaccctctaggtcca

SEQ ID NO: 105965 - DNA, 22 bp, Artificial Sequence
  Synthetic oligonucleotide; TTC chr11 5354290 5354311 5354307 5354312 +
ttgactcaccctctaggtccag

SEQ ID NO: 105966 - DNA, 22 bp, Artificial Sequence
  Synthetic oligonucleotide; CTT chr11 5354292 5354313 5354309 5354314 +
gactcaccctctaggtccagtg

SEQ ID NO: 105967 - DNA, 22 bp, Artificial Sequence
  Synthetic oligonucleotide; TTG chr11 5354293 5354314 5354310 5354315 +
actcaccctctaggtccagtga

SEQ ID NO: 105968 - DNA, 22 bp, Artificial Sequence
  Synthetic oligonucleotide; CTC chr11 5354297 5354318 5354314 5354319 +
accctctaggtccagtgatcct

SEQ ID NO: 105969 - DNA, 22 bp, Artificial Sequence
  Synthetic oligonucleotide; CTC chr11 5354303 5354324 5354320 5354325 +
taggtccagtgatcctgaaacc

SEQ ID NO: 105970 - DNA, 22 bp, Artificial Sequence
  Synthetic oligonucleotide; CTA chr11 5354305 5354326 5354322 5354327 +
ggtccagtgatcctgaaacctg

SEQ ID NO: 105971 - DNA, 22 bp, Artificial Sequence
  Synthetic oligonucleotide; CTG chr11 5354320 5354341 5354337 5354342 +
aaacctgccatagcaggctagt

SEQ ID NO: 105972 - DNA, 22 bp, Artificial Sequence
  Synthetic oligonucleotide; CTG chr11 5354327 5354348 5354344 5354349 +
ccatagcaggctagtataaaga

SEQ ID NO: 105973 - DNA, 22 bp, Artificial Sequence
  Synthetic oligonucleotide; CTA chr11 5354340 5354361 5354357 5354362 +
gtataaagataactaggataac

SEQ ID NO: 105974 - DNA, 22 bp, Artificial Sequence
  Synthetic oligonucleotide; CTA chr11 5354355 5354376 5354372 5354377 +
ggataacaatacattttataaa

SEQ ID NO: 105975 - DNA, 22 bp, Artificial Sequence
  Synthetic oligonucleotide; TTT chr11 5354371 5354392 5354388 5354393 +
tataaattctgtaaatggacac

SEQ ID NO: 105976 - DNA, 22 bp, Artificial Sequence
  Synthetic oligonucleotide; TTT chr11 5354372 5354393 5354389 5354394 +
ataaattctgtaaatggacaca

SEQ ID NO: 105977 - DNA, 22 bp, Artificial Sequence
  Synthetic oligonucleotide; TTA chr11 5354373 5354394 5354390 5354395 +
taaattctgtaaatggacacat

SEQ ID NO: 105978 - DNA, 22 bp, Artificial Sequence
  Synthetic oligonucleotide; TTC chr11 5354380 5354401 5354397 5354402 +
tgtaaatggacacatttgactg

SEQ ID NO: 105979 - DNA, 22 bp, Artificial Sequence
  Synthetic oligonucleotide; CTG chr11 5354382 5354403 5354399 5354404 +
taaatggacacatttgactgac

SEQ ID NO: 105980 - DNA, 22 bp, Artificial Sequence
  Synthetic oligonucleotide; TTT chr11 5354397 5354418 5354414 5354419 +
gactgacaaccctgagtttctc

SEQ ID NO: 105981 - DNA, 22 bp, Artificial Sequence
  Synthetic oligonucleotide; TTG chr11 5354398 5354419 5354415 5354420 +
actgacaaccctgagtttctct

SEQ ID NO: 105982 - DNA, 22 bp, Artificial Sequence
  Synthetic oligonucleotide; CTG chr11 5354402 5354423 5354419 5354424 +
acaaccctgagtttctctcctc

SEQ ID NO: 105983 - DNA, 22 bp, Artificial Sequence
  Synthetic oligonucleotide; CTG chr11 5354411 5354432 5354428 5354433 +
agtttctctcctccctttctgt

SEQ ID NO: 105984 - DNA, 22 bp, Artificial Sequence
  Synthetic oligonucleotide; TTT chr11 5354416 5354437 5354433 5354438 +
ctctcctccctttctgttcttc

SEQ ID NO: 105985 - DNA, 22 bp, Artificial Sequence
  Synthetic oligonucleotide; TTC chr11 5354417 5354438 5354434 5354439 +
tctcctccctttctgttcttcc

SEQ ID NO: 105986 - DNA, 22 bp, Artificial Sequence
  Synthetic oligonucleotide; CTC chr11 5354419 5354440 5354436 5354441 +
tcctccctttctgttcttcctt

SEQ ID NO: 105987 - DNA, 22 bp, Artificial Sequence
  Synthetic oligonucleotide; CTC chr11 5354421 5354442 5354438 5354443 +
ctccctttctgttcttccttat

SEQ ID NO: 105988 - DNA, 22 bp, Artificial Sequence
  Synthetic oligonucleotide; CTC chr11 5354424 5354445 5354441 5354446 +
cctttctgttcttccttatact

SEQ ID NO: 105989 - DNA, 22 bp, Artificial Sequence
  Synthetic oligonucleotide; CTT chr11 5354428 5354449 5354445 5354450 +
tctgttcttccttatactgaag

SEQ ID NO: 105990 - DNA, 22 bp, Artificial Sequence
  Synthetic oligonucleotide; TTT chr11 5354429 5354450 5354446 5354451 +
ctgttcttccttatactgaaga

SEQ ID NO: 105991 - DNA, 22 bp, Artificial Sequence
  Synthetic oligonucleotide; TTC chr11 5354430 5354451 5354447 5354452 +
tgttcttccttatactgaagag

SEQ ID NO: 105992 - DNA, 22 bp, Artificial Sequence
  Synthetic oligonucleotide; CTG chr11 5354432 5354453 5354449 5354454 +
ttcttccttatactgaagagat

SEQ ID NO: 105993 - DNA, 22 bp, Artificial Sequence
  Synthetic oligonucleotide; TTC chr11 5354435 5354456 5354452 5354457 +
ttccttatactgaagagatgtg

SEQ ID NO: 105994 - DNA, 22 bp, Artificial Sequence
  Synthetic oligonucleotide; CTT chr11 5354437 5354458 5354454 5354459 +
ccttatactgaagagatgtgat

SEQ ID NO: 105995 - DNA, 22 bp, Artificial Sequence
  Synthetic oligonucleotide; TTC chr11 5354438 5354459 5354455 5354460 +
cttatactgaagagatgtgatg

SEQ ID NO: 105996 - DNA, 22 bp, Artificial Sequence
  Synthetic oligonucleotide; CTT chr11 5354441 5354462 5354458 5354463 +
atactgaagagatgtgatgaag

SEQ ID NO: 105997 - DNA, 22 bp, Artificial Sequence
  Synthetic oligonucleotide; TTA chr11 5354442 5354463 5354459 5354464 +
tactgaagagatgtgatgaaga

SEQ ID NO: 105998 - DNA, 22 bp, Artificial Sequence
  Synthetic oligonucleotide; CTG chr11 5354447 5354468 5354464 5354469 +
aagagatgtgatgaagagacaa

SEQ ID NO: 105999 - DNA, 22 bp, Artificial Sequence
  Synthetic oligonucleotide; CTG chr11 5354499 5354520 5354516 5354521 +
ggacttgcagttctctttgtgg

SEQ ID NO: 106000 - DNA, 22 bp, Artificial Sequence
  Synthetic oligonucleotide; CTT chr11 5354505 5354526 5354522 5354527 +
gcagttctctttgtggagtccc

SEQ ID NO: 106001 - DNA, 22 bp, Artificial Sequence
  Synthetic oligonucleotide; TTG chr11 5354506 5354527 5354523 5354528 +
cagttctctttgtggagtcccg

SEQ ID NO: 106002 - DNA, 22 bp, Artificial Sequence
  Synthetic oligonucleotide; TTC chr11 5354512 5354533 5354529 5354534 +
tctttgtggagtcccgtgaaac

SEQ ID NO: 106003 - DNA, 22 bp, Artificial Sequence
  Synthetic oligonucleotide; CTC chr11 5354514 5354535 5354531 5354536 +
tttgtggagtcccgtgaaacag

SEQ ID NO: 106004 - DNA, 22 bp, Artificial Sequence
  Synthetic oligonucleotide; CTT chr11 5354516 5354537 5354533 5354538 +
tgtggagtcccgtgaaacagag

SEQ ID NO: 106005 - DNA, 22 bp, Artificial Sequence
  Synthetic oligonucleotide; TTT chr11 5354517 5354538 5354534 5354539 +
gtggagtcccgtgaaacagagc

SEQ ID NO: 106006 - DNA, 22 bp, Artificial Sequence
  Synthetic oligonucleotide; TTG chr11 5354518 5354539 5354535 5354540 +
tggagtcccgtgaaacagagca

SEQ ID NO: 106007 - DNA, 22 bp, Artificial Sequence
  Synthetic oligonucleotide; CTC chr11 5354546 5354567 5354563 5354568 +
tgggctcccgatggtccctgaa

SEQ ID NO: 106008 - DNA, 22 bp, Artificial Sequence
  Synthetic oligonucleotide; CTG chr11 5354548 5354569 5354565 5354570 +
ggctcccgatggtccctgaaca

SEQ ID NO: 106009 - DNA, 22 bp, Artificial Sequence
  Synthetic oligonucleotide; CTC chr11 5354553 5354574 5354570 5354575 +
ccgatggtccctgaacaacata

SEQ ID NO: 106010 - DNA, 22 bp, Artificial Sequence
  Synthetic oligonucleotide; CTG chr11 5354566 5354587 5354583 5354588 +
aacaacatatcaacagtagggt

SEQ ID NO: 106011 - DNA, 22 bp, Artificial Sequence
  Synthetic oligonucleotide; CTC chr11 5354598 5354619 5354615 5354620 +
acccctcctcatgatcctcccc

SEQ ID NO: 106012 - DNA, 22 bp, Artificial Sequence
  Synthetic oligonucleotide; CTC chr11 5354605 5354626 5354622 5354627 +
ctcatgatcctccccacttcct

SEQ ID NO: 106013 - DNA, 22 bp, Artificial Sequence
  Synthetic oligonucleotide; CTC chr11 5354608 5354629 5354625 5354630 +
atgatcctccccacttcctccc

SEQ ID NO: 106014 - DNA, 22 bp, Artificial Sequence
  Synthetic oligonucleotide; CTC chr11 5354617 5354638 5354634 5354639 +
cccacttcctcccgcccctcca

SEQ ID NO: 106015 - DNA, 22 bp, Artificial Sequence
  Synthetic oligonucleotide; CTT chr11 5354624 5354645 5354641 5354646 +
cctcccgcccctccacgccacc

SEQ ID NO: 106016 - DNA, 22 bp, Artificial Sequence
  Synthetic oligonucleotide; TTC chr11 5354625 5354646 5354642 5354647 +
ctcccgcccctccacgccacca

SEQ ID NO: 106017 - DNA, 22 bp, Artificial Sequence
  Synthetic oligonucleotide; CTC chr11 5354628 5354649 5354645 5354650 +
ccgcccctccacgccaccagcc

SEQ ID NO: 106018 - DNA, 22 bp, Artificial Sequence
  Synthetic oligonucleotide; CTC chr11 5354637 5354658 5354654 5354659 +
cacgccaccagccacactgagc

SEQ ID NO: 106019 - DNA, 22 bp, Artificial Sequence
  Synthetic oligonucleotide; CTG chr11 5354656 5354677 5354673 5354678 +
agcgctcagctcctcccaggtc

SEQ ID NO: 106020 - DNA, 22 bp, Artificial Sequence
  Synthetic oligonucleotide; CTC chr11 5354663 5354684 5354680 5354685 +
agctcctcccaggtcctggacc

SEQ ID NO: 106021 - DNA, 22 bp, Artificial Sequence
  Synthetic oligonucleotide; CTC chr11 5354668 5354689 5354685 5354690 +
ctcccaggtcctggacctgcag

SEQ ID NO: 106022 - DNA, 22 bp, Artificial Sequence
  Synthetic oligonucleotide; CTC chr11 5354671 5354692 5354688 5354693 +
ccaggtcctggacctgcagccc

SEQ ID NO: 106023 - DNA, 22 bp, Artificial Sequence
  Synthetic oligonucleotide; CTG chr11 5354681 5354702 5354698 5354703 +
gacctgcagccctggccaacat

SEQ ID NO: 106024 - DNA, 22 bp, Artificial Sequence
  Synthetic oligonucleotide; CTG chr11 5354687 5354708 5354704 5354709 +
cagccctggccaacatcaagag

SEQ ID NO: 106025 - DNA, 22 bp, Artificial Sequence
  Synthetic oligonucleotide; CTG chr11 5354695 5354716 5354712 5354717 +
gccaacatcaagagggcatctt

SEQ ID NO: 106026 - DNA, 22 bp, Artificial Sequence
  Synthetic oligonucleotide; CTT chr11 5354717 5354738 5354734 5354739 +
tgccaagaatgcctggaagaga

SEQ ID NO: 106027 - DNA, 22 bp, Artificial Sequence
  Synthetic oligonucleotide; TTT chr11 5354718 5354739 5354735 5354740 +
gccaagaatgcctggaagagac

SEQ ID NO: 106028 - DNA, 22 bp, Artificial Sequence
  Synthetic oligonucleotide; TTG chr11 5354719 5354740 5354736 5354741 +
ccaagaatgcctggaagagact

SEQ ID NO: 106029 - DNA, 22 bp, Artificial Sequence
  Synthetic oligonucleotide; CTG chr11 5354732 5354753 5354749 5354754 +
gaagagactcagccactcacag

SEQ ID NO: 106030 - DNA, 22 bp, Artificial Sequence
  Synthetic oligonucleotide; CTC chr11 5354742 5354763 5354759 5354764 +
agccactcacaggaaaacgtcc

SEQ ID NO: 106031 - DNA, 22 bp, Artificial Sequence
  Synthetic oligonucleotide; CTC chr11 5354750 5354771 5354767 5354772 +
acaggaaaacgtcctccagaag

SEQ ID NO: 106032 - DNA, 22 bp, Artificial Sequence
  Synthetic oligonucleotide; CTC chr11 5354766 5354787 5354783 5354788 +
cagaagccagggaaagctgctg

SEQ ID NO: 106033 - DNA, 22 bp, Artificial Sequence
  Synthetic oligonucleotide; CTG chr11 5354785 5354806 5354802 5354807 +
ctgagacaaaagacaaacagtt

SEQ ID NO: 106034 - DNA, 22 bp, Artificial Sequence
  Synthetic oligonucleotide; CTG chr11 5354788 5354809 5354805 5354810 +
agacaaaagacaaacagtttga

SEQ ID NO: 106035 - DNA, 22 bp, Artificial Sequence
  Synthetic oligonucleotide; TTT chr11 5354808 5354829 5354825 5354830 +
gaagaatatgtccagaacttca

SEQ ID NO: 106036 - DNA, 22 bp, Artificial Sequence
  Synthetic oligonucleotide; TTG chr11 5354809 5354830 5354826 5354831 +
aagaatatgtccagaacttcaa

SEQ ID NO: 106037 - DNA, 22 bp, Artificial Sequence
  Synthetic oligonucleotide; CTT chr11 5354828 5354849 5354845 5354850 +
caagccacaagaagcagagggt

SEQ ID NO: 106038 - DNA, 22 bp, Artificial Sequence
  Synthetic oligonucleotide; TTC chr11 5354829 5354850 5354846 5354851 +
aagccacaagaagcagagggta

SEQ ID NO: 106039 - DNA, 22 bp, Artificial Sequence
  Synthetic oligonucleotide; CTG chr11 5354860 5354881 5354877 5354882 +
agagaactctgaggatgtttag

SEQ ID NO: 106040 - DNA, 22 bp, Artificial Sequence
  Synthetic oligonucleotide; CTC chr11 5354869 5354890 5354886 5354891 +
tgaggatgtttagaagcaatca

SEQ ID NO: 106041 - DNA, 22 bp, Artificial Sequence
  Synthetic oligonucleotide; CTG chr11 5354871 5354892 5354888 5354893 +
aggatgtttagaagcaatcaaa

SEQ ID NO: 106042 - DNA, 22 bp, Artificial Sequence
  Synthetic oligonucleotide; TTT chr11 5354880 5354901 5354897 5354902 +
agaagcaatcaaaggcattcaa

SEQ ID NO: 106043 - DNA, 22 bp, Artificial Sequence
  Synthetic oligonucleotide; TTA chr11 5354881 5354902 5354898 5354903 +
gaagcaatcaaaggcattcaag

SEQ ID NO: 106044 - DNA, 22 bp, Artificial Sequence
  Synthetic oligonucleotide; TTC chr11 5354900 5354921 5354917 5354922 +
aagagaccttgacgaagctgag

SEQ ID NO: 106045 - DNA, 22 bp, Artificial Sequence
  Synthetic oligonucleotide; CTT chr11 5354910 5354931 5354927 5354932 +
gacgaagctgagtcactgtgtg

SEQ ID NO: 106046 - DNA, 22 bp, Artificial Sequence
  Synthetic oligonucleotide; TTG chr11 5354911 5354932 5354928 5354933 +
acgaagctgagtcactgtgtga

SEQ ID NO: 106047 - DNA, 22 bp, Artificial Sequence
  Synthetic oligonucleotide; CTG chr11 5354920 5354941 5354937 5354942 +
agtcactgtgtgaagtctgtgc

SEQ ID NO: 106048 - DNA, 22 bp, Artificial Sequence
  Synthetic oligonucleotide; CTG chr11 5354928 5354949 5354945 5354950 +
tgtgaagtctgtgcgctggatt

SEQ ID NO: 106049 - DNA, 22 bp, Artificial Sequence
  Synthetic oligonucleotide; CTG chr11 5354939 5354960 5354956 5354961 +
tgcgctggattggtctgggcag

SEQ ID NO: 106050 - DNA, 22 bp, Artificial Sequence
  Synthetic oligonucleotide; CTG chr11 5354946 5354967 5354963 5354968 +
gattggtctgggcaggaaggtg

SEQ ID NO: 106051 - DNA, 22 bp, Artificial Sequence
  Synthetic oligonucleotide; TTG chr11 5354951 5354972 5354968 5354973 +
gtctgggcaggaaggtgtgaaa

SEQ ID NO: 106052 - DNA, 22 bp, Artificial Sequence
  Synthetic oligonucleotide; CTG chr11 5354956 5354977 5354973 5354978 +
ggcaggaaggtgtgaaaatggt

SEQ ID NO: 106053 - DNA, 22 bp, Artificial Sequence
  Synthetic oligonucleotide; TTG chr11 5354980 5355001 5354997 5355002 +
gtgagaaaggtgatgtgctctg

SEQ ID NO: 106054 - DNA, 22 bp, Artificial Sequence
  Synthetic oligonucleotide; CTC chr11 5355000 5355021 5355017 5355022 +
tgggaggatatccacaaaaaac

SEQ ID NO: 106055 - DNA, 22 bp, Artificial Sequence
  Synthetic oligonucleotide; CTG chr11 5355002 5355023 5355019 5355024 +
ggaggatatccacaaaaaactc

SEQ ID NO: 106056 - DNA, 22 bp, Artificial Sequence
  Synthetic oligonucleotide; CTC chr11 5355024 5355045 5355041 5355046 +
atggatgcatccttgctaacac

SEQ ID NO: 106057 - DNA, 22 bp, Artificial Sequence
  Synthetic oligonucleotide; CTT chr11 5355038 5355059 5355055 5355060 +
gctaacactggaaaactacctg

SEQ ID NO: 106058 - DNA, 22 bp, Artificial Sequence
  Synthetic oligonucleotide; TTG chr11 5355039 5355060 5355056 5355061 +
ctaacactggaaaactacctgg

SEQ ID NO: 106059 - DNA, 22 bp, Artificial Sequence
  Synthetic oligonucleotide; CTA chr11 5355042 5355063 5355059 5355064 +
acactggaaaactacctggacc

SEQ ID NO: 106060 - DNA, 22 bp, Artificial Sequence
  Synthetic oligonucleotide; CTG chr11 5355048 5355069 5355065 5355070 +
gaaaactacctggaccaatttc

SEQ ID NO: 106061 - DNA, 22 bp, Artificial Sequence
  Synthetic oligonucleotide; CTA chr11 5355056 5355077 5355073 5355078 +
cctggaccaatttcctgacttg

SEQ ID NO: 106062 - DNA, 22 bp, Artificial Sequence
  Synthetic oligonucleotide; CTG chr11 5355060 5355081 5355077 5355082 +
gaccaatttcctgacttgaaga

SEQ ID NO: 106063 - DNA, 22 bp, Artificial Sequence
  Synthetic oligonucleotide; TTT chr11 5355069 5355090 5355086 5355091 +
cctgacttgaagaatcacatca

SEQ ID NO: 106064 - DNA, 22 bp, Artificial Sequence
  Synthetic oligonucleotide; TTC chr11 5355070 5355091 5355087 5355092 +
ctgacttgaagaatcacatcac

SEQ ID NO: 106065 - DNA, 22 bp, Artificial Sequence
  Synthetic oligonucleotide; CTG chr11 5355073 5355094 5355090 5355095 +
acttgaagaatcacatcaccaa

SEQ ID NO: 106066 - DNA, 22 bp, Artificial Sequence
  Synthetic oligonucleotide; CTT chr11 5355077 5355098 5355094 5355099 +
gaagaatcacatcaccaagtgc

SEQ ID NO: 106067 - DNA, 22 bp, Artificial Sequence
  Synthetic oligonucleotide; TTG chr11 5355078 5355099 5355095 5355100 +
aagaatcacatcaccaagtgca

SEQ ID NO: 106068 - DNA, 22 bp, Artificial Sequence
  Synthetic oligonucleotide; CTT chr11 5355111 5355132 5355128 5355133 +
acggactatgacagtgcctgcc

SEQ ID NO: 106069 - DNA, 22 bp, Artificial Sequence
  Synthetic oligonucleotide; TTA chr11 5355112 5355133 5355129 5355134 +
cggactatgacagtgcctgccc

SEQ ID NO: 106070 - DNA, 22 bp, Artificial Sequence
  Synthetic oligonucleotide; CTA chr11 5355119 5355140 5355136 5355141 +
tgacagtgcctgcccacctcca

SEQ ID NO: 106071 - DNA, 22 bp, Artificial Sequence
  Synthetic oligonucleotide; CTG chr11 5355131 5355152 5355148 5355153 +
cccacctccatcgggctcaaca

SEQ ID NO: 106072 - DNA, 22 bp, Artificial Sequence
  Synthetic oligonucleotide; CTC chr11 5355139 5355160 5355156 5355161 +
catcgggctcaacagagcttca

SEQ ID NO: 106073 - DNA, 22 bp, Artificial Sequence
  Synthetic oligonucleotide; CTC chr11 5355149 5355170 5355166 5355171 +
aacagagcttcaggaggaagga

SEQ ID NO: 106074 - DNA, 22 bp, Artificial Sequence
  Synthetic oligonucleotide; CTT chr11 5355159 5355180 5355176 5355181 +
caggaggaaggataggagcctc

SEQ ID NO: 106075 - DNA, 22 bp, Artificial Sequence
  Synthetic oligonucleotide; TTC chr11 5355160 5355181 5355177 5355182 +
aggaggaaggataggagcctct

SEQ ID NO: 106076 - DNA, 22 bp, Artificial Sequence
  Synthetic oligonucleotide; CTC chr11 5355181 5355202 5355198 5355203 +
tgtctaaggcagaagtagaatt

SEQ ID NO: 106077 - DNA, 22 bp, Artificial Sequence
  Synthetic oligonucleotide; CTG chr11 5355183 5355204 5355200 5355205 +
tctaaggcagaagtagaatttc

SEQ ID NO: 106078 - DNA, 22 bp, Artificial Sequence
  Synthetic oligonucleotide; CTA chr11 5355187 5355208 5355204 5355209 +
aggcagaagtagaatttcagaa

SEQ ID NO: 106079 - DNA, 22 bp, Artificial Sequence
  Synthetic oligonucleotide; TTT chr11 5355204 5355225 5355221 5355226 +
cagaaagcatagagaaagtttg

SEQ ID NO: 106080 - DNA, 22 bp, Artificial Sequence
  Synthetic oligonucleotide; TTC chr11 5355205 5355226 5355222 5355227 +
agaaagcatagagaaagtttga

SEQ ID NO: 106081 - DNA, 22 bp, Artificial Sequence
  Synthetic oligonucleotide; TTT chr11 5355225 5355246 5355242 5355247 +
gaagagtttaatggtgacttac

SEQ ID NO: 106082 - DNA, 22 bp, Artificial Sequence
  Synthetic oligonucleotide; TTG chr11 5355226 5355247 5355243 5355248 +
aagagtttaatggtgacttaca

SEQ ID NO: 106083 - DNA, 22 bp, Artificial Sequence
  Synthetic oligonucleotide; TTT chr11 5355234 5355255 5355251 5355256 +
aatggtgacttacaagaaaagt

SEQ ID NO: 106084 - DNA, 22 bp, Artificial Sequence
  Synthetic oligonucleotide; TTA chr11 5355235 5355256 5355252 5355257 +
atggtgacttacaagaaaagtt

SEQ ID NO: 106085 - DNA, 22 bp, Artificial Sequence
  Synthetic oligonucleotide; CTT chr11 5355245 5355266 5355262 5355267 +
acaagaaaagttaccattatta

SEQ ID NO: 106086 - DNA, 22 bp, Artificial Sequence
  Synthetic oligonucleotide; TTA chr11 5355246 5355267 5355263 5355268 +
caagaaaagttaccattattat

SEQ ID NO: 106087 - DNA, 22 bp, Artificial Sequence
  Synthetic oligonucleotide; TTA chr11 5355258 5355279 5355275 5355280 +
ccattattatagtcaagacgaa

SEQ ID NO: 106088 - DNA, 22 bp, Artificial Sequence
  Synthetic oligonucleotide; TTA chr11 5355264 5355285 5355281 5355286 +
ttatagtcaagacgaattggat

SEQ ID NO: 106089 - DNA, 22 bp, Artificial Sequence
  Synthetic oligonucleotide; TTA chr11 5355267 5355288 5355284 5355289 +
tagtcaagacgaattggatttt

SEQ ID NO: 106090 - DNA, 22 bp, Artificial Sequence
  Synthetic oligonucleotide; TTG chr11 5355283 5355304 5355300 5355305 +
gattttatattaatactttcaa

SEQ ID NO: 106091 - DNA, 22 bp, Artificial Sequence
  Synthetic oligonucleotide; TTT chr11 5355288 5355309 5355305 5355310 +
tatattaatactttcaaaaaca

SEQ ID NO: 106092 - DNA, 22 bp, Artificial Sequence
  Synthetic oligonucleotide; TTT chr11 5355289 5355310 5355306 5355311 +
atattaatactttcaaaaacat

SEQ ID NO: 106093 - DNA, 22 bp, Artificial Sequence
  Synthetic oligonucleotide; TTA chr11 5355290 5355311 5355307 5355312 +
tattaatactttcaaaaacatc

SEQ ID NO: 106094 - DNA, 22 bp, Artificial Sequence
  Synthetic oligonucleotide; TTA chr11 5355295 5355316 5355312 5355317 +
atactttcaaaaacatctccag

SEQ ID NO: 106095 - DNA, 22 bp, Artificial Sequence
  Synthetic oligonucleotide; CTT chr11 5355301 5355322 5355318 5355323 +
tcaaaaacatctccagccttga

SEQ ID NO: 106096 - DNA, 22 bp, Artificial Sequence
  Synthetic oligonucleotide; TTT chr11 5355302 5355323 5355319 5355324 +
caaaaacatctccagccttgaa

SEQ ID NO: 106097 - DNA, 22 bp, Artificial Sequence
  Synthetic oligonucleotide; TTC chr11 5355303 5355324 5355320 5355325 +
aaaaacatctccagccttgaag

SEQ ID NO: 106098 - DNA, 22 bp, Artificial Sequence
  Synthetic oligonucleotide; CTC chr11 5355314 5355335 5355331 5355336 +
cagccttgaagctaagtttcat

SEQ ID NO: 106099 - DNA, 22 bp, Artificial Sequence
  Synthetic oligonucleotide; CTT chr11 5355321 5355342 5355338 5355343 +
gaagctaagtttcataaggaaa

SEQ ID NO: 106100 - DNA, 22 bp, Artificial Sequence
  Synthetic oligonucleotide; TTG chr11 5355322 5355343 5355339 5355344 +
aagctaagtttcataaggaaac

SEQ ID NO: 106101 - DNA, 22 bp, Artificial Sequence
  Synthetic oligonucleotide; CTA chr11 5355328 5355349 5355345 5355350 +
agtttcataaggaaactgtggt

SEQ ID NO: 106102 - DNA, 22 bp, Artificial Sequence
  Synthetic oligonucleotide; TTT chr11 5355333 5355354 5355350 5355355 +
cataaggaaactgtggtgcttt

SEQ ID NO: 106103 - DNA, 22 bp, Artificial Sequence
  Synthetic oligonucleotide; TTC chr11 5355334 5355355 5355351 5355356 +
ataaggaaactgtggtgctttg

SEQ ID NO: 106104 - DNA, 22 bp, Artificial Sequence
  Synthetic oligonucleotide; CTG chr11 5355346 5355367 5355363 5355368 +
tggtgctttggtacaaacagta

SEQ ID NO: 106105 - DNA, 22 bp, Artificial Sequence
  Synthetic oligonucleotide; CTT chr11 5355354 5355375 5355371 5355376 +
tggtacaaacagtatgaagtga

SEQ ID NO: 106106 - DNA, 22 bp, Artificial Sequence
  Synthetic oligonucleotide; TTT chr11 5355355 5355376 5355372 5355377 +
ggtacaaacagtatgaagtgat

SEQ ID NO: 106107 - DNA, 22 bp, Artificial Sequence
  Synthetic oligonucleotide; TTG chr11 5355356 5355377 5355373 5355378 +
gtacaaacagtatgaagtgatg

SEQ ID NO: 106108 - DNA, 22 bp, Artificial Sequence
  Synthetic oligonucleotide; CTG chr11 5355387 5355408 5355404 5355409 +
ggtgaccagtatgctgacaagg

SEQ ID NO: 106109 - DNA, 22 bp, Artificial Sequence
  Synthetic oligonucleotide; CTG chr11 5355403 5355424 5355420 5355425 +
acaaggccttcaacattcaaag

SEQ ID NO: 106110 - DNA, 22 bp, Artificial Sequence
  Synthetic oligonucleotide; CTT chr11 5355413 5355434 5355430 5355435 +
caacattcaaagagcaacaccc

SEQ ID NO: 106111 - DNA, 22 bp, Artificial Sequence
  Synthetic oligonucleotide; TTC chr11 5355414 5355435 5355431 5355436 +
aacattcaaagagcaacaccca

SEQ ID NO: 106112 - DNA, 22 bp, Artificial Sequence
  Synthetic oligonucleotide; TTC chr11 5355421 5355442 5355438 5355443 +
aaagagcaacacccactgattt

SEQ ID NO: 106113 - DNA, 22 bp, Artificial Sequence
  Synthetic oligonucleotide; CTG chr11 5355439 5355460 5355456 5355461 +
atttgggtcctctccacattgc

SEQ ID NO: 106114 - DNA, 22 bp, Artificial Sequence
  Synthetic oligonucleotide; TTT chr11 5355443 5355464 5355460 5355465 +
gggtcctctccacattgcaaag

SEQ ID NO: 106115 - DNA, 22 bp, Artificial Sequence
  Synthetic oligonucleotide; TTG chr11 5355444 5355465 5355461 5355466 +
ggtcctctccacattgcaaaga

SEQ ID NO: 106116 - DNA, 22 bp, Artificial Sequence
  Synthetic oligonucleotide; CTC chr11 5355451 5355472 5355468 5355473 +
tccacattgcaaagatgtcctc

SEQ ID NO: 106117 - DNA, 22 bp, Artificial Sequence
  Synthetic oligonucleotide; CTC chr11 5355453 5355474 5355470 5355475 +
cacattgcaaagatgtcctcat

SEQ ID NO: 106118 - DNA, 22 bp, Artificial Sequence
  Synthetic oligonucleotide; TTG chr11 5355460 5355481 5355477 5355482 +
caaagatgtcctcatggcctag

SEQ ID NO: 106119 - DNA, 22 bp, Artificial Sequence
  Synthetic oligonucleotide; CTC chr11 5355473 5355494 5355490 5355495 +
atggcctagggagctttcattc

SEQ ID NO: 106120 - DNA, 22 bp, Artificial Sequence
  Synthetic oligonucleotide; CTA chr11 5355481 5355502 5355498 5355503 +
gggagctttcattccaccccag

SEQ ID NO: 106121 - DNA, 22 bp, Artificial Sequence
  Synthetic oligonucleotide; CTT chr11 5355489 5355510 5355506 5355511 +
tcattccaccccagcccaacaa

SEQ ID NO: 106122 - DNA, 22 bp, Artificial Sequence
  Synthetic oligonucleotide; TTT chr11 5355490 5355511 5355507 5355512 +
cattccaccccagcccaacaac

SEQ ID NO: 106123 - DNA, 22 bp, Artificial Sequence
  Synthetic oligonucleotide; TTC chr11 5355491 5355512 5355508 5355513 +
attccaccccagcccaacaact

SEQ ID NO: 106124 - DNA, 22 bp, Artificial Sequence
  Synthetic oligonucleotide; TTC chr11 5355495 5355516 5355512 5355517 +
caccccagcccaacaactagtt

SEQ ID NO: 106125 - DNA, 22 bp, Artificial Sequence
  Synthetic oligonucleotide; CTA chr11 5355514 5355535 5355531 5355536 +
gttcaagtgaaacactagcacc

SEQ ID NO: 106126 - DNA, 22 bp, Artificial Sequence
  Synthetic oligonucleotide; TTC chr11 5355518 5355539 5355535 5355540 +
aagtgaaacactagcacctgct

SEQ ID NO: 106127 - DNA, 22 bp, Artificial Sequence
  Synthetic oligonucleotide; CTA chr11 5355531 5355552 5355548 5355553 +
gcacctgcttctcctatgccag

SEQ ID NO: 106128 - DNA, 22 bp, Artificial Sequence
  Synthetic oligonucleotide; CTG chr11 5355538 5355559 5355555 5355560 +
cttctcctatgccagcatgacc

SEQ ID NO: 106129 - DNA, 22 bp, Artificial Sequence
  Synthetic oligonucleotide; CTT chr11 5355541 5355562 5355558 5355563 +
ctcctatgccagcatgacctga

SEQ ID NO: 106130 - DNA, 22 bp, Artificial Sequence
  Synthetic oligonucleotide; TTC chr11 5355542 5355563 5355559 5355564 +
tcctatgccagcatgacctgag

SEQ ID NO: 106131 - DNA, 22 bp, Artificial Sequence
  Synthetic oligonucleotide; CTC chr11 5355544 5355565 5355561 5355566 +
ctatgccagcatgacctgagtc

SEQ ID NO: 106132 - DNA, 22 bp, Artificial Sequence
  Synthetic oligonucleotide; CTA chr11 5355547 5355568 5355564 5355569 +
tgccagcatgacctgagtcact

SEQ ID NO: 106133 - DNA, 22 bp, Artificial Sequence
  Synthetic oligonucleotide; CTG chr11 5355562 5355583 5355579 5355584 +
agtcactcttgcagtcctgtat

SEQ ID NO: 106134 - DNA, 22 bp, Artificial Sequence
  Synthetic oligonucleotide; CTC chr11 5355570 5355591 5355587 5355592 +
ttgcagtcctgtatctgtctaa

SEQ ID NO: 106135 - DNA, 22 bp, Artificial Sequence
  Synthetic oligonucleotide; CTT chr11 5355572 5355593 5355589 5355594 +
gcagtcctgtatctgtctaaag

SEQ ID NO: 106136 - DNA, 22 bp, Artificial Sequence
  Synthetic oligonucleotide; TTG chr11 5355573 5355594 5355590 5355595 +
cagtcctgtatctgtctaaagt

SEQ ID NO: 106137 - DNA, 22 bp, Artificial Sequence
  Synthetic oligonucleotide; CTG chr11 5355581 5355602 5355598 5355603 +
tatctgtctaaagtcacttgac

SEQ ID NO: 106138 - DNA, 22 bp, Artificial Sequence
  Synthetic oligonucleotide; CTG chr11 5355587 5355608 5355604 5355609 +
tctaaagtcacttgacaaagga

SEQ ID NO: 106139 - DNA, 22 bp, Artificial Sequence
  Synthetic oligonucleotide; CTA chr11 5355591 5355612 5355608 5355613 +
aagtcacttgacaaaggaactg

SEQ ID NO: 106140 - DNA, 22 bp, Artificial Sequence
  Synthetic oligonucleotide; CTT chr11 5355600 5355621 5355617 5355622 +
gacaaaggaactgcagcaggaa

SEQ ID NO: 106141 - DNA, 22 bp, Artificial Sequence
  Synthetic oligonucleotide; TTG chr11 5355601 5355622 5355618 5355623 +
acaaaggaactgcagcaggaaa

SEQ ID NO: 106142 - DNA, 22 bp, Artificial Sequence
  Synthetic oligonucleotide; CTG chr11 5355613 5355634 5355630 5355635 +
cagcaggaaaaatatcatcttc

SEQ ID NO: 106143 - DNA, 22 bp, Artificial Sequence
  Synthetic oligonucleotide; CTT chr11 5355634 5355655 5355651 5355656 +
cacagactgtcctaaagtaaga

SEQ ID NO: 106144 - DNA, 22 bp, Artificial Sequence
  Synthetic oligonucleotide; TTC chr11 5355635 5355656 5355652 5355657 +
acagactgtcctaaagtaagat

SEQ ID NO: 106145 - DNA, 22 bp, Artificial Sequence
  Synthetic oligonucleotide; CTG chr11 5355643 5355664 5355660 5355665 +
tcctaaagtaagataggtgatg

SEQ ID NO: 106146 - DNA, 22 bp, Artificial Sequence
  Synthetic oligonucleotide; CTA chr11 5355648 5355669 5355665 5355670 +
aagtaagataggtgatgtgtac

SEQ ID NO: 106147 - DNA, 22 bp, Artificial Sequence
  Synthetic oligonucleotide; CTG chr11 5355672 5355693 5355689 5355694 +
tatccacaaatcatctgtaaaa

SEQ ID NO: 106148 - DNA, 22 bp, Artificial Sequence
  Synthetic oligonucleotide; CTG chr11 5355689 5355710 5355706 5355711 +
taaaagttatgttttcagtggt

SEQ ID NO: 106149 - DNA, 22 bp, Artificial Sequence
  Synthetic oligonucleotide; TTA chr11 5355698 5355719 5355715 5355720 +
tgttttcagtggtgtgtcattt

SEQ ID NO: 106150 - DNA, 22 bp, Artificial Sequence
  Synthetic oligonucleotide; TTT chr11 5355703 5355724 5355720 5355725 +
tcagtggtgtgtcatttcaaat

SEQ ID NO: 106151 - DNA, 22 bp, Artificial Sequence
  Synthetic oligonucleotide; TTT chr11 5355704 5355725 5355721 5355726 +
cagtggtgtgtcatttcaaata

SEQ ID NO: 106152 - DNA, 22 bp, Artificial Sequence
  Synthetic oligonucleotide; TTC chr11 5355705 5355726 5355722 5355727 +
agtggtgtgtcatttcaaataa

SEQ ID NO: 106153 - DNA, 22 bp, Artificial Sequence
  Synthetic oligonucleotide; TTT chr11 5355720 5355741 5355737 5355742 +
caaataaaccttgggaaatttc

SEQ ID NO: 106154 - DNA, 22 bp, Artificial Sequence
  Synthetic oligonucleotide; TTC chr11 5355721 5355742 5355738 5355743 +
aaataaaccttgggaaatttct

SEQ ID NO: 106155 - DNA, 22 bp, Artificial Sequence
  Synthetic oligonucleotide; CTT chr11 5355732 5355753 5355749 5355754 +
gggaaatttctaacaattacct

SEQ ID NO: 106156 - DNA, 22 bp, Artificial Sequence
  Synthetic oligonucleotide; TTG chr11 5355733 5355754 5355750 5355755 +
ggaaatttctaacaattacctt

SEQ ID NO: 106157 - DNA, 22 bp, Artificial Sequence
  Synthetic oligonucleotide; TTT chr11 5355741 5355762 5355758 5355763 +
ctaacaattacctttaaaaatt

SEQ ID NO: 106158 - DNA, 22 bp, Artificial Sequence
  Synthetic oligonucleotide; TTC chr11 5355742 5355763 5355759 5355764 +
taacaattacctttaaaaatta

SEQ ID NO: 106159 - DNA, 22 bp, Artificial Sequence
  Synthetic oligonucleotide; CTA chr11 5355744 5355765 5355761 5355766 +
acaattacctttaaaaattaaa

SEQ ID NO: 106160 - DNA, 22 bp, Artificial Sequence
  Synthetic oligonucleotide; TTA chr11 5355751 5355772 5355768 5355773 +
cctttaaaaattaaaaaaaaaa

SEQ ID NO: 106161 - DNA, 22 bp, Artificial Sequence
  Synthetic oligonucleotide; CTT chr11 5355755 5355776 5355772 5355777 +
taaaaattaaaaaaaaaaaaaa

SEQ ID NO: 106162 - DNA, 22 bp, Artificial Sequence
  Synthetic oligonucleotide; TTT chr11 5355756 5355777 5355773 5355778 +
aaaaattaaaaaaaaaaaaaag

SEQ ID NO: 106163 - DNA, 22 bp, Artificial Sequence
  Synthetic oligonucleotide; TTA chr11 5355757 5355778 5355774 5355779 +
aaaattaaaaaaaaaaaaaaga

SEQ ID NO: 106164 - DNA, 22 bp, Artificial Sequence
  Synthetic oligonucleotide; TTA chr11 5355764 5355785 5355781 5355786 +
aaaaaaaaaaaaagagtagggt

SEQ ID NO: 106165 - DNA, 22 bp, Artificial Sequence
  Synthetic oligonucleotide; TTT chr11 5355811 5355832 5355828 5355833 +
tcttaaaggatcaatgtaatgc

SEQ ID NO: 106166 - DNA, 22 bp, Artificial Sequence
  Synthetic oligonucleotide; TTT chr11 5355812 5355833 5355829 5355834 +
cttaaaggatcaatgtaatgcc

SEQ ID NO: 106167 - DNA, 22 bp, Artificial Sequence
  Synthetic oligonucleotide; TTC chr11 5355813 5355834 5355830 5355835 +
ttaaaggatcaatgtaatgccc

SEQ ID NO: 106168 - DNA, 22 bp, Artificial Sequence
  Synthetic oligonucleotide; CTT chr11 5355815 5355836 5355832 5355837 +
aaaggatcaatgtaatgccctg

SEQ ID NO: 106169 - DNA, 22 bp, Artificial Sequence
  Synthetic oligonucleotide; TTA chr11 5355816 5355837 5355833 5355838 +
aaggatcaatgtaatgccctgc

SEQ ID NO: 106170 - DNA, 22 bp, Artificial Sequence
  Synthetic oligonucleotide; CTG chr11 5355837 5355858 5355854 5355859 +
ctctgattcctgtagtgacata

SEQ ID NO: 106171 - DNA, 22 bp, Artificial Sequence
  Synthetic oligonucleotide; CTC chr11 5355840 5355861 5355857 5355862 +
tgattcctgtagtgacataggc

SEQ ID NO: 106172 - DNA, 22 bp, Artificial Sequence
  Synthetic oligonucleotide; CTG chr11 5355842 5355863 5355859 5355864 +
attcctgtagtgacataggcgt

SEQ ID NO: 106173 - DNA, 22 bp, Artificial Sequence
  Synthetic oligonucleotide; TTC chr11 5355846 5355867 5355863 5355868 +
ctgtagtgacataggcgtcaat

SEQ ID NO: 106174 - DNA, 22 bp, Artificial Sequence
  Synthetic oligonucleotide; CTG chr11 5355849 5355870 5355866 5355871 +
tagtgacataggcgtcaatata

SEQ ID NO: 106175 - DNA, 22 bp, Artificial Sequence
  Synthetic oligonucleotide; CTG chr11 5355885 5355906 5355902 5355907 +
gaagttcttttaaaaatctgct

SEQ ID NO: 106176 - DNA, 22 bp, Artificial Sequence
  Synthetic oligonucleotide; TTC chr11 5355892 5355913 5355909 5355914 +
ttttaaaaatctgctgcaagct

SEQ ID NO: 106177 - DNA, 22 bp, Artificial Sequence
  Synthetic oligonucleotide; CTT chr11 5355894 5355915 5355911 5355916 +
ttaaaaatctgctgcaagctga

SEQ ID NO: 106178 - DNA, 22 bp, Artificial Sequence
  Synthetic oligonucleotide; TTT chr11 5355895 5355916 5355912 5355917 +
taaaaatctgctgcaagctgag

SEQ ID NO: 106179 - DNA, 22 bp, Artificial Sequence
  Synthetic oligonucleotide; TTT chr11 5355896 5355917 5355913 5355918 +
aaaaatctgctgcaagctgagg

SEQ ID NO: 106180 - DNA, 22 bp, Artificial Sequence
  Synthetic oligonucleotide; TTA chr11 5355897 5355918 5355914 5355919 +
aaaatctgctgcaagctgaggg

SEQ ID NO: 106181 - DNA, 22 bp, Artificial Sequence
  Synthetic oligonucleotide; CTG chr11 5355905 5355926 5355922 5355927 +
ctgcaagctgagggtcctgtta

SEQ ID NO: 106182 - DNA, 22 bp, Artificial Sequence
  Synthetic oligonucleotide; CTG chr11 5355908 5355929 5355925 5355930 +
caagctgagggtcctgttagaa

SEQ ID NO: 106183 - DNA, 22 bp, Artificial Sequence
  Synthetic oligonucleotide; CTG chr11 5355915 5355936 5355932 5355937 +
agggtcctgttagaaggaaaac

SEQ ID NO: 106184 - DNA, 22 bp, Artificial Sequence
  Synthetic oligonucleotide; CTG chr11 5355924 5355945 5355941 5355946 +
ttagaaggaaaactaacaaaca

SEQ ID NO: 106185 - DNA, 22 bp, Artificial Sequence
  Synthetic oligonucleotide; TTA chr11 5355927 5355948 5355944 5355949 +
gaaggaaaactaacaaacagaa

SEQ ID NO: 106186 - DNA, 22 bp, Artificial Sequence
  Synthetic oligonucleotide; CTA chr11 5355939 5355960 5355956 5355961 +
acaaacagaaaggacatccaca

SEQ ID NO: 106187 - DNA, 22 bp, Artificial Sequence
  Synthetic oligonucleotide; CTG chr11 5355976 5355997 5355993 5355998 +
tacgtcaccatcatcaaagacc

SEQ ID NO: 106188 - DNA, 22 bp, Artificial Sequence
  Synthetic oligonucleotide; CTG chr11 5356047 5356068 5356064 5356069 +
gaaactctaaaaatcagagtgc

SEQ ID NO: 106189 - DNA, 22 bp, Artificial Sequence
  Synthetic oligonucleotide; CTC chr11 5356054 5356075 5356071 5356076 +
taaaaatcagagtgcctctcct

SEQ ID NO: 106190 - DNA, 22 bp, Artificial Sequence
  Synthetic oligonucleotide; CTA chr11 5356056 5356077 5356073 5356078 +
aaaatcagagtgcctctcctcc

SEQ ID NO: 106191 - DNA, 22 bp, Artificial Sequence
  Synthetic oligonucleotide; CTC chr11 5356072 5356093 5356089 5356094 +
tcctcctccaaaggaatgcagc

SEQ ID NO: 106192 - DNA, 22 bp, Artificial Sequence
  Synthetic oligonucleotide; CTC chr11 5356074 5356095 5356091 5356096 +
ctcctccaaaggaatgcagctc

SEQ ID NO: 106193 - DNA, 22 bp, Artificial Sequence
  Synthetic oligonucleotide; CTC chr11 5356077 5356098 5356094 5356099 +
ctccaaaggaatgcagctcctc

SEQ ID NO: 106194 - DNA, 22 bp, Artificial Sequence
  Synthetic oligonucleotide; CTC chr11 5356080 5356101 5356097 5356102 +
caaaggaatgcagctcctcacc

SEQ ID NO: 106195 - DNA, 22 bp, Artificial Sequence
  Synthetic oligonucleotide; CTC chr11 5356096 5356117 5356113 5356118 +
ctcaccagcaacggtacaaagc

SEQ ID NO: 106196 - DNA, 22 bp, Artificial Sequence
  Synthetic oligonucleotide; CTC chr11 5356099 5356120 5356116 5356121 +
accagcaacggtacaaagctgg

SEQ ID NO: 106197 - DNA, 22 bp, Artificial Sequence
  Synthetic oligonucleotide; CTG chr11 5356120 5356141 5356137 5356142 +
gacagagaatgactttgacaag

SEQ ID NO: 106198 - DNA, 22 bp, Artificial Sequence
  Synthetic oligonucleotide; CTT chr11 5356135 5356156 5356152 5356157 +
tgacaagttgagagaagaaggc

SEQ ID NO: 106199 - DNA, 22 bp, Artificial Sequence
  Synthetic oligonucleotide; TTT chr11 5356136 5356157 5356153 5356158 +
gacaagttgagagaagaaggct

SEQ ID NO: 106200 - DNA, 22 bp, Artificial Sequence
  Synthetic oligonucleotide; TTG chr11 5356137 5356158 5356154 5356159 +
acaagttgagagaagaaggctt

SEQ ID NO: 106201 - DNA, 22 bp, Artificial Sequence
  Synthetic oligonucleotide; TTG chr11 5356145 5356166 5356162 5356167 +
agagaagaaggcttcagacgat

SEQ ID NO: 106202 - DNA, 22 bp, Artificial Sequence
  Synthetic oligonucleotide; CTT chr11 5356159 5356180 5356176 5356181 +
cagacgatcaaactactccgag

SEQ ID NO: 106203 - DNA, 22 bp, Artificial Sequence
  Synthetic oligonucleotide; TTC chr11 5356160 5356181 5356177 5356182 +
agacgatcaaactactccgagc

SEQ ID NO: 106204 - DNA, 22 bp, Artificial Sequence
  Synthetic oligonucleotide; CTA chr11 5356174 5356195 5356191 5356196 +
ctccgagctaaaggaggaagct

SEQ ID NO: 106205 - DNA, 22 bp, Artificial Sequence
  Synthetic oligonucleotide; CTC chr11 5356177 5356198 5356194 5356199 +
cgagctaaaggaggaagctcga

SEQ ID NO: 106206 - DNA, 22 bp, Artificial Sequence
  Synthetic oligonucleotide; CTA chr11 5356184 5356205 5356201 5356206 +
aaggaggaagctcgaacccatg

SEQ ID NO: 106207 - DNA, 22 bp, Artificial Sequence
  Synthetic oligonucleotide; CTC chr11 5356197 5356218 5356214 5356219 +
gaacccatggcaaaaaagttaa

SEQ ID NO: 106208 - DNA, 22 bp, Artificial Sequence
  Synthetic oligonucleotide; TTA chr11 5356218 5356239 5356235 5356240 +
aaaaccttgaaaataaattaga

SEQ ID NO: 106209 - DNA, 22 bp, Artificial Sequence
  Synthetic oligonucleotide; CTT chr11 5356226 5356247 5356243 5356248 +
gaaaataaattagactaatggc

SEQ ID NO: 106210 - DNA, 22 bp, Artificial Sequence
  Synthetic oligonucleotide; TTG chr11 5356227 5356248 5356244 5356249 +
aaaataaattagactaatggct

SEQ ID NO: 106211 - DNA, 22 bp, Artificial Sequence
  Synthetic oligonucleotide; TTA chr11 5356238 5356259 5356255 5356260 +
gactaatggctaactagaataa

SEQ ID NO: 106212 - DNA, 22 bp, Artificial Sequence
  Synthetic oligonucleotide; CTA chr11 5356243 5356264 5356260 5356265 +
atggctaactagaataaccaat

SEQ ID NO: 106213 - DNA, 22 bp, Artificial Sequence
  Synthetic oligonucleotide; CTA chr11 5356250 5356271 5356267 5356272 +
actagaataaccaatacagaga

SEQ ID NO: 106214 - DNA, 22 bp, Artificial Sequence
  Synthetic oligonucleotide; CTA chr11 5356254 5356275 5356271 5356276 +
gaataaccaatacagagaagtc

SEQ ID NO: 106215 - DNA, 22 bp, Artificial Sequence
  Synthetic oligonucleotide; CTT chr11 5356279 5356300 5356296 5356301 +
aaaggacctgatggagctgaaa

SEQ ID NO: 106216 - DNA, 22 bp, Artificial Sequence
  Synthetic oligonucleotide; TTA chr11 5356280 5356301 5356297 5356302 +
aaggacctgatggagctgaaaa

SEQ ID NO: 106217 - DNA, 22 bp, Artificial Sequence
  Synthetic oligonucleotide; CTG chr11 5356289 5356310 5356306 5356311 +
atggagctgaaaaccaaggcat

SEQ ID NO: 106218 - DNA, 22 bp, Artificial Sequence
  Synthetic oligonucleotide; CTG chr11 5356298 5356319 5356315 5356320 +
aaaaccaaggcatgagaactac

SEQ ID NO: 106219 - DNA, 22 bp, Artificial Sequence
  Synthetic oligonucleotide; CTA chr11 5356319 5356340 5356336 5356341 +
catgatgaatgcacaagactca

SEQ ID NO: 106220 - DNA, 22 bp, Artificial Sequence
  Synthetic oligonucleotide; CTC chr11 5356340 5356361 5356357 5356362 +
agtagctgattcgatcaactgg

SEQ ID NO: 106221 - DNA, 22 bp, Artificial Sequence
  Synthetic oligonucleotide; CTG chr11 5356348 5356369 5356365 5356370 +
attcgatcaactggaagaaagg

SEQ ID NO: 106222 - DNA, 22 bp, Artificial Sequence
  Synthetic oligonucleotide; TTC chr11 5356352 5356373 5356369 5356374 +
gatcaactggaagaaagggtat

SEQ ID NO: 106223 - DNA, 22 bp, Artificial Sequence
  Synthetic oligonucleotide; CTG chr11 5356361 5356382 5356378 5356383 +
gaagaaagggtatcagtgatgg

SEQ ID NO: 106224 - DNA, 22 bp, Artificial Sequence
  Synthetic oligonucleotide; TTT chr11 5356421 5356442 5356438 5356443 +
agagaaaaaagaataaaaagaa

SEQ ID NO: 106225 - DNA, 22 bp, Artificial Sequence
  Synthetic oligonucleotide; TTA chr11 5356422 5356443 5356439 5356444 +
gagaaaaaagaataaaaagaaa

SEQ ID NO: 106226 - DNA, 22 bp, Artificial Sequence
  Synthetic oligonucleotide; CTC chr11 5356457 5356478 5356474 5356479 +
caagaaatatgggactatgtga

SEQ ID NO: 106227 - DNA, 22 bp, Artificial Sequence
  Synthetic oligonucleotide; CTA chr11 5356474 5356495 5356491 5356496 +
tgtgaaaagaccaaatctatat

SEQ ID NO: 106228 - DNA, 22 bp, Artificial Sequence
  Synthetic oligonucleotide; CTA chr11 5356493 5356514 5356510 5356515 +
tatctgattggtgtacctgaaa

SEQ ID NO: 106229 - DNA, 22 bp, Artificial Sequence
  Synthetic oligonucleotide; CTG chr11 5356499 5356520 5356516 5356521 +
attggtgtacctgaaagtgacg

SEQ ID NO: 106230 - DNA, 22 bp, Artificial Sequence
  Synthetic oligonucleotide; TTG chr11 5356503 5356524 5356520 5356525 +
gtgtacctgaaagtgacgggca

SEQ ID NO: 106231 - DNA, 22 bp, Artificial Sequence
  Synthetic oligonucleotide; CTG chr11 5356512 5356533 5356529 5356534 +
aaagtgacgggcagaatggaac

SEQ ID NO: 106232 - DNA, 22 bp, Artificial Sequence
  Synthetic oligonucleotide; TTG chr11 5356541 5356562 5356558 5356563 +
gaaaacactctgcaggatatta

SEQ ID NO: 106233 - DNA, 22 bp, Artificial Sequence
  Synthetic oligonucleotide; CTC chr11 5356551 5356572 5356568 5356573 +
tgcaggatattatccaggagaa

SEQ ID NO: 106234 - DNA, 22 bp, Artificial Sequence
  Synthetic oligonucleotide; CTG chr11 5356553 5356574 5356570 5356575 +
caggatattatccaggagaact

SEQ ID NO: 106235 - DNA, 22 bp, Artificial Sequence
  Synthetic oligonucleotide; TTA chr11 5356563 5356584 5356580 5356585 +
tccaggagaacttccccaatct

SEQ ID NO: 106236 - DNA, 22 bp, Artificial Sequence
  Synthetic oligonucleotide; CTT chr11 5356576 5356597 5356593 5356598 +
ccccaatctagcaaggcaggtc

SEQ ID NO: 106237 - DNA, 22 bp, Artificial Sequence
  Synthetic oligonucleotide; TTC chr11 5356577 5356598 5356594 5356599 +
cccaatctagcaaggcaggtca

SEQ ID NO: 106238 - DNA, 22 bp, Artificial Sequence
  Synthetic oligonucleotide; CTA chr11 5356586 5356607 5356603 5356608 +
gcaaggcaggtcaacattcaaa

SEQ ID NO: 106239 - DNA, 22 bp, Artificial Sequence
  Synthetic oligonucleotide; TTC chr11 5356605 5356626 5356622 5356627 +
aaattcaggaaatacagagaac

SEQ ID NO: 106240 - DNA, 22 bp, Artificial Sequence
  Synthetic oligonucleotide; TTC chr11 5356611 5356632 5356628 5356633 +
aggaaatacagagaacgccaca

SEQ ID NO: 106241 - DNA, 22 bp, Artificial Sequence
  Synthetic oligonucleotide; CTC chr11 5356642 5356663 5356659 5356664 +
cttgagaagagcaactacaagg

SEQ ID NO: 106242 - DNA, 22 bp, Artificial Sequence
  Synthetic oligonucleotide; CTT chr11 5356645 5356666 5356662 5356667 +
gagaagagcaactacaaggcac

SEQ ID NO: 106243 - DNA, 22 bp, Artificial Sequence
  Synthetic oligonucleotide; TTG chr11 5356646 5356667 5356663 5356668 +
agaagagcaactacaaggcaca

SEQ ID NO: 106244 - DNA, 22 bp, Artificial Sequence
  Synthetic oligonucleotide; CTA chr11 5356659 5356680 5356676 5356681 +
caaggcacataattgtcagatt

SEQ ID NO: 106245 - DNA, 22 bp, Artificial Sequence
  Synthetic oligonucleotide; TTG chr11 5356674 5356695 5356691 5356696 +
tcagattcaccaaagttgaaat

SEQ ID NO: 106246 - DNA, 22 bp, Artificial Sequence
  Synthetic oligonucleotide; TTC chr11 5356682 5356703 5356699 5356704 +
accaaagttgaaatgaagggaa

SEQ ID NO: 106247 - DNA, 22 bp, Artificial Sequence
  Synthetic oligonucleotide; TTG chr11 5356692 5356713 5356709 5356714 +
aaatgaagggaaaaatgttaag

SEQ ID NO: 106248 - DNA, 22 bp, Artificial Sequence
  Synthetic oligonucleotide; TTA chr11 5356712 5356733 5356729 5356734 +
agggtagccagagagaaaggtc

SEQ ID NO: 106249 - DNA, 22 bp, Artificial Sequence
  Synthetic oligonucleotide; TTA chr11 5356740 5356761 5356757 5356762 +
cccacaaagggaagcccatcag

SEQ ID NO: 106250 - DNA, 22 bp, Artificial Sequence
  Synthetic oligonucleotide; CTC chr11 5356778 5356799 5356795 5356800 +
tcagcagaaactctacaagcca

SEQ ID NO: 106251 - DNA, 22 bp, Artificial Sequence
  Synthetic oligonucleotide; CTC chr11 5356780 5356801 5356797 5356802 +
agcagaaactctacaagccaga

SEQ ID NO: 106252 - DNA, 22 bp, Artificial Sequence
  Synthetic oligonucleotide; CTC chr11 5356791 5356812 5356808 5356813 +
tacaagccagaagagagtgggg

SEQ ID NO: 106253 - DNA, 22 bp, Artificial Sequence
  Synthetic oligonucleotide; CTA chr11 5356793 5356814 5356810 5356815 +
caagccagaagagagtgggggc

SEQ ID NO: 106254 - DNA, 22 bp, Artificial Sequence
  Synthetic oligonucleotide; TTC chr11 5356823 5356844 5356840 5356845 +
aacatccttaaaggaaagaatt

SEQ ID NO: 106255 - DNA, 22 bp, Artificial Sequence
  Synthetic oligonucleotide; CTT chr11 5356832 5356853 5356849 5356854 +
aaaggaaagaattttcaacaca

SEQ ID NO: 106256 - DNA, 22 bp, Artificial Sequence
  Synthetic oligonucleotide; TTA chr11 5356833 5356854 5356850 5356855 +
aaggaaagaattttcaacacag

SEQ ID NO: 106257 - DNA, 22 bp, Artificial Sequence
  Synthetic oligonucleotide; TTT chr11 5356846 5356867 5356863 5356868 +
tcaacacagaatttcatatcca

SEQ ID NO: 106258 - DNA, 22 bp, Artificial Sequence
  Synthetic oligonucleotide; TTT chr11 5356847 5356868 5356864 5356869 +
caacacagaatttcatatccag

SEQ ID NO: 106259 - DNA, 22 bp, Artificial Sequence
  Synthetic oligonucleotide; TTC chr11 5356848 5356869 5356865 5356870 +
aacacagaatttcatatccagc

SEQ ID NO: 106260 - DNA, 22 bp, Artificial Sequence
  Synthetic oligonucleotide; TTT chr11 5356860 5356881 5356877 5356882 +
catatccagccaaactaagctt

SEQ ID NO: 106261 - DNA, 22 bp, Artificial Sequence
  Synthetic oligonucleotide; TTC chr11 5356861 5356882 5356878 5356883 +
atatccagccaaactaagcttc

SEQ ID NO: 106262 - DNA, 22 bp, Artificial Sequence
  Synthetic oligonucleotide; CTA chr11 5356877 5356898 5356894 5356899 +
agcttcataagtgaaggagaaa

SEQ ID NO: 106263 - DNA, 22 bp, Artificial Sequence
  Synthetic oligonucleotide; CTT chr11 5356882 5356903 5356899 5356904 +
cataagtgaaggagaaataaaa

SEQ ID NO: 106264 - DNA, 22 bp, Artificial Sequence
  Synthetic oligonucleotide; TTC chr11 5356883 5356904 5356900 5356905 +
ataagtgaaggagaaataaaat

SEQ ID NO: 106265 - DNA, 22 bp, Artificial Sequence
  Synthetic oligonucleotide; CTT chr11 5356909 5356930 5356926 5356931 +
tacagacaagcaaatgctgaga

SEQ ID NO: 106266 - DNA, 22 bp, Artificial Sequence
  Synthetic oligonucleotide; TTT chr11 5356910 5356931 5356927 5356932 +
acagacaagcaaatgctgagag

SEQ ID NO: 106267 - DNA, 22 bp, Artificial Sequence
  Synthetic oligonucleotide; TTA chr11 5356911 5356932 5356928 5356933 +
cagacaagcaaatgctgagaga

SEQ ID NO: 106268 - DNA, 22 bp, Artificial Sequence
  Synthetic oligonucleotide; CTG chr11 5356928 5356949 5356945 5356950 +
agagattttgtcatcaccaggc

SEQ ID NO: 106269 - DNA, 22 bp, Artificial Sequence
  Synthetic oligonucleotide; TTT chr11 5356936 5356957 5356953 5356958 +
tgtcatcaccaggcctgaccta

SEQ ID NO: 106270 - DNA, 22 bp, Artificial Sequence
  Synthetic oligonucleotide; TTT chr11 5356937 5356958 5356954 5356959 +
gtcatcaccaggcctgacctaa

SEQ ID NO: 106271 - DNA, 22 bp, Artificial Sequence
  Synthetic oligonucleotide; TTG chr11 5356938 5356959 5356955 5356960 +
tcatcaccaggcctgacctaaa

SEQ ID NO: 106272 - DNA, 22 bp, Artificial Sequence
  Synthetic oligonucleotide; CTG chr11 5356953 5356974 5356970 5356975 +
acctaaaagagctcctgaagga

SEQ ID NO: 106273 - DNA, 22 bp, Artificial Sequence
  Synthetic oligonucleotide; CTA chr11 5356958 5356979 5356975 5356980 +
aaagagctcctgaaggaagcac

SEQ ID NO: 106274 - DNA, 22 bp, Artificial Sequence
  Synthetic oligonucleotide; CTC chr11 5356967 5356988 5356984 5356989 +
ctgaaggaagcactaaatatgg

SEQ ID NO: 106275 - DNA, 22 bp, Artificial Sequence
  Synthetic oligonucleotide; CTG chr11 5356970 5356991 5356987 5356992 +
aaggaagcactaaatatggaaa

SEQ ID NO: 106276 - DNA, 22 bp, Artificial Sequence
  Synthetic oligonucleotide; CTA chr11 5356982 5357003 5356999 5357004 +
aatatggaaaggcacaaccggt

SEQ ID NO: 106277 - DNA, 22 bp, Artificial Sequence
  Synthetic oligonucleotide; CTG chr11 5357015 5357036 5357032 5357037 +
caaaaacatgccaaattgtaaa

SEQ ID NO: 106278 - DNA, 22 bp, Artificial Sequence
  Synthetic oligonucleotide; TTG chr11 5357033 5357054 5357050 5357055 +
taaagaccattgaggctaggaa

SEQ ID NO: 106279 - DNA, 22 bp, Artificial Sequence
  Synthetic oligonucleotide; TTG chr11 5357045 5357066 5357062 5357067 +
aggctaggaagaaactgcatca

SEQ ID NO: 106280 - DNA, 22 bp, Artificial Sequence
  Synthetic oligonucleotide; CTA chr11 5357051 5357072 5357068 5357073 +
ggaagaaactgcatcaactaat

SEQ ID NO: 106281 - DNA, 22 bp, Artificial Sequence
  Synthetic oligonucleotide; CTG chr11 5357062 5357083 5357079 5357084 +
catcaactaatgagcaaaataa

SEQ ID NO: 106282 - DNA, 22 bp, Artificial Sequence
  Synthetic oligonucleotide; CTA chr11 5357071 5357092 5357088 5357093 +
atgagcaaaataaccagctaac

SEQ ID NO: 106283 - DNA, 22 bp, Artificial Sequence
  Synthetic oligonucleotide; CTA chr11 5357091 5357112 5357108 5357113 +
acatcataatgacaggatcaaa

SEQ ID NO: 106284 - DNA, 22 bp, Artificial Sequence
  Synthetic oligonucleotide; TTC chr11 5357116 5357137 5357133 5357138 +
acacataacaatattaacctta

SEQ ID NO: 106285 - DNA, 22 bp, Artificial Sequence
  Synthetic oligonucleotide; TTA chr11 5357132 5357153 5357149 5357154 +
accttaatgtaaatgggctaaa

SEQ ID NO: 106286 - DNA, 22 bp, Artificial Sequence
  Synthetic oligonucleotide; CTT chr11 5357137 5357158 5357154 5357159 +
aatgtaaatgggctaaatgctc

SEQ ID NO: 106287 - DNA, 22 bp, Artificial Sequence
  Synthetic oligonucleotide; TTA chr11 5357138 5357159 5357155 5357160 +
atgtaaatgggctaaatgctcc

SEQ ID NO: 106288 - DNA, 22 bp, Artificial Sequence
  Synthetic oligonucleotide; CTA chr11 5357152 5357173 5357169 5357174 +
aatgctccagtaaaaagacaca

SEQ ID NO: 106289 - DNA, 22 bp, Artificial Sequence
  Synthetic oligonucleotide; CTC chr11 5357159 5357180 5357176 5357181 +
cagtaaaaagacacagacgggc

SEQ ID NO: 106290 - DNA, 22 bp, Artificial Sequence
  Synthetic oligonucleotide; TTA chr11 5357187 5357208 5357204 5357209 +
gataaagagtcaagacccatca

SEQ ID NO: 106291 - DNA, 22 bp, Artificial Sequence
  Synthetic oligonucleotide; CTG chr11 5357217 5357238 5357234 5357239 +
tattcaggaaacccatctcatg

SEQ ID NO: 106292 - DNA, 22 bp, Artificial Sequence
  Synthetic oligonucleotide; TTC chr11 5357222 5357243 5357239 5357244 +
aggaaacccatctcatgtgcac

SEQ ID NO: 106293 - DNA, 22 bp, Artificial Sequence
  Synthetic oligonucleotide; CTC chr11 5357236 5357257 5357253 5357258 +
atgtgcacacacacacataggc

SEQ ID NO: 106294 - DNA, 22 bp, Artificial Sequence
  Synthetic oligonucleotide; CTC chr11 5357260 5357281 5357277 5357282 +
aaaataaagggatggaggaaga

SEQ ID NO: 106295 - DNA, 22 bp, Artificial Sequence
  Synthetic oligonucleotide; CTA chr11 5357286 5357307 5357303 5357308 +
ccaagaaaatggaaaacaaaaa

SEQ ID NO: 106296 - DNA, 22 bp, Artificial Sequence
  Synthetic oligonucleotide; TTG chr11 5357321 5357342 5357338 5357343 +
caatcctcatctctgataaaac

SEQ ID NO: 106297 - DNA, 22 bp, Artificial Sequence
  Synthetic oligonucleotide; CTC chr11 5357329 5357350 5357346 5357351 +
atctctgataaaacaggcttta

SEQ ID NO: 106298 - DNA, 22 bp, Artificial Sequence
  Synthetic oligonucleotide; CTC chr11 5357334 5357355 5357351 5357356 +
tgataaaacaggctttaaacca

SEQ ID NO: 106299 - DNA, 22 bp, Artificial Sequence
  Synthetic oligonucleotide; CTG chr11 5357336 5357357 5357353 5357358 +
ataaaacaggctttaaaccaac

SEQ ID NO: 106300 - DNA, 22 bp, Artificial Sequence
  Synthetic oligonucleotide; CTT chr11 5357349 5357370 5357366 5357371 +
taaaccaacaaagatcaaaaga

SEQ ID NO: 106301 - DNA, 22 bp, Artificial Sequence
  Synthetic oligonucleotide; TTT chr11 5357350 5357371 5357367 5357372 +
aaaccaacaaagatcaaaagag

SEQ ID NO: 106302 - DNA, 22 bp, Artificial Sequence
  Synthetic oligonucleotide; TTA chr11 5357351 5357372 5357368 5357373 +
aaccaacaaagatcaaaagaga

SEQ ID NO: 106303 - DNA, 22 bp, Artificial Sequence
  Synthetic oligonucleotide; TTA chr11 5357388 5357409 5357405 5357410 +
cataatggtaaagggatcaatt

SEQ ID NO: 106304 - DNA, 22 bp, Artificial Sequence
  Synthetic oligonucleotide; TTC chr11 5357411 5357432 5357428 5357433 +
aacaagaagagctaactatcct

SEQ ID NO: 106305 - DNA, 22 bp, Artificial Sequence
  Synthetic oligonucleotide; CTA chr11 5357425 5357446 5357442 5357447 +
actatcctaaacatatatgcac

SEQ ID NO: 106306 - DNA, 22 bp, Artificial Sequence
  Synthetic oligonucleotide; CTA chr11 5357429 5357450 5357446 5357451 +
tcctaaacatatatgcacccaa

SEQ ID NO: 106307 - DNA, 22 bp, Artificial Sequence
  Synthetic oligonucleotide; CTA chr11 5357434 5357455 5357451 5357456 +
aacatatatgcacccaatacag

SEQ ID NO: 106308 - DNA, 22 bp, Artificial Sequence
  Synthetic oligonucleotide; TTC chr11 5357470 5357491 5357487 5357492 +
ataaagcaagtccttagagacc

SEQ ID NO: 106309 - DNA, 22 bp, Artificial Sequence
  Synthetic oligonucleotide; CTT chr11 5357485 5357506 5357502 5357507 +
agagacctacaaagagacttag

SEQ ID NO: 106310 - DNA, 22 bp, Artificial Sequence
  Synthetic oligonucleotide; TTA chr11 5357486 5357507 5357503 5357508 +
gagacctacaaagagacttaga

SEQ ID NO: 106311 - DNA, 22 bp, Artificial Sequence
  Synthetic oligonucleotide; CTA chr11 5357494 5357515 5357511 5357516 +
caaagagacttagactctcaca

SEQ ID NO: 106312 - DNA, 22 bp, Artificial Sequence
  Synthetic oligonucleotide; CTT chr11 5357505 5357526 5357522 5357527 +
agactctcacacaataacaatg

SEQ ID NO: 106313 - DNA, 22 bp, Artificial Sequence
  Synthetic oligonucleotide; TTA chr11 5357506 5357527 5357523 5357528 +
gactctcacacaataacaatgg

SEQ ID NO: 106314 - DNA, 22 bp, Artificial Sequence
  Synthetic oligonucleotide; CTC chr11 5357511 5357532 5357528 5357533 +
tcacacaataacaatgggagac

SEQ ID NO: 106315 - DNA, 22 bp, Artificial Sequence
  Synthetic oligonucleotide; CTC chr11 5357513 5357534 5357530 5357535 +
acacaataacaatgggagactt

SEQ ID NO: 106316 - DNA, 22 bp, Artificial Sequence
  Synthetic oligonucleotide; CTT chr11 5357535 5357556 5357552 5357557 +
taacaccccactgtcaacatta

SEQ ID NO: 106317 - DNA, 22 bp, Artificial Sequence
  Synthetic oligonucleotide; TTT chr11 5357536 5357557 5357553 5357558 +
aacaccccactgtcaacattag

SEQ ID NO: 106318 - DNA, 22 bp, Artificial Sequence
  Synthetic oligonucleotide; TTA chr11 5357537 5357558 5357554 5357559 +
acaccccactgtcaacattaga

SEQ ID NO: 106319 - DNA, 22 bp, Artificial Sequence
  Synthetic oligonucleotide; CTG chr11 5357548 5357569 5357565 5357570 +
tcaacattagacagatcaacat

SEQ ID NO: 106320 - DNA, 22 bp, Artificial Sequence
  Synthetic oligonucleotide; TTA chr11 5357557 5357578 5357574 5357579 +
gacagatcaacattagacagat

SEQ ID NO: 106321 - DNA, 22 bp, Artificial Sequence
  Synthetic oligonucleotide; TTA chr11 5357572 5357593 5357589 5357594 +
gacagatcaacgagacagaaag

SEQ ID NO: 106322 - DNA, 22 bp, Artificial Sequence
  Synthetic oligonucleotide; TTA chr11 5357597 5357618 5357614 5357619 +
acaaggatatccaggaattgaa

SEQ ID NO: 106323 - DNA, 22 bp, Artificial Sequence
  Synthetic oligonucleotide; TTG chr11 5357617 5357638 5357634 5357639 +
aactcagctctgcaccaagcgg

SEQ ID NO: 106324 - DNA, 22 bp, Artificial Sequence
  Synthetic oligonucleotide; CTC chr11 5357622 5357643 5357639 5357644 +
agctctgcaccaagcggaccta

SEQ ID NO: 106325 - DNA, 22 bp, Artificial Sequence
  Synthetic oligonucleotide; CTC chr11 5357627 5357648 5357644 5357649 +
tgcaccaagcggacctaataga

SEQ ID NO: 106326 - DNA, 22 bp, Artificial Sequence
  Synthetic oligonucleotide; CTG chr11 5357629 5357650 5357646 5357651 +
caccaagcggacctaatagaca

SEQ ID NO: 106327 - DNA, 22 bp, Artificial Sequence
  Synthetic oligonucleotide; CTA chr11 5357644 5357665 5357661 5357666 +
atagacatctacagaactctcc

SEQ ID NO: 106328 - DNA, 22 bp, Artificial Sequence
  Synthetic oligonucleotide; CTA chr11 5357655 5357676 5357672 5357677 +
cagaactctccaccccaaatca

SEQ ID NO: 106329 - DNA, 22 bp, Artificial Sequence
  Synthetic oligonucleotide; CTC chr11 5357663 5357684 5357680 5357685 +
tccaccccaaatcaacagaata

SEQ ID NO: 106330 - DNA, 22 bp, Artificial Sequence
  Synthetic oligonucleotide; CTC chr11 5357665 5357686 5357682 5357687 +
caccccaaatcaacagaatata

SEQ ID NO: 106331 - DNA, 22 bp, Artificial Sequence
  Synthetic oligonucleotide; TTC chr11 5357692 5357713 5357709 5357714 +
ttttcagcaccacaccacacct

SEQ ID NO: 106332 - DNA, 22 bp, Artificial Sequence
  Synthetic oligonucleotide; CTT chr11 5357694 5357715 5357711 5357716 +
ttcagcaccacaccacacctat

SEQ ID NO: 106333 - DNA, 22 bp, Artificial Sequence
  Synthetic oligonucleotide; TTT chr11 5357695 5357716 5357712 5357717 +
tcagcaccacaccacacctatt

SEQ ID NO: 106334 - DNA, 22 bp, Artificial Sequence
  Synthetic oligonucleotide; TTT chr11 5357696 5357717 5357713 5357718 +
cagcaccacaccacacctattc

SEQ ID NO: 106335 - DNA, 22 bp, Artificial Sequence
  Synthetic oligonucleotide; TTC chr11 5357697 5357718 5357714 5357719 +
agcaccacaccacacctattcc

SEQ ID NO: 106336 - DNA, 22 bp, Artificial Sequence
  Synthetic oligonucleotide; CTA chr11 5357715 5357736 5357732 5357737 +
ttccaaaattgaccacatagtt

SEQ ID NO: 106337 - DNA, 22 bp, Artificial Sequence
  Synthetic oligonucleotide; TTC chr11 5357718 5357739 5357735 5357740 +
caaaattgaccacatagttgga

SEQ ID NO: 106338 - DNA, 22 bp, Artificial Sequence
  Synthetic oligonucleotide; TTG chr11 5357726 5357747 5357743 5357748 +
accacatagttggaagtaaagc

SEQ ID NO: 106339 - DNA, 22 bp, Artificial Sequence
  Synthetic oligonucleotide; TTG chr11 5357738 5357759 5357755 5357760 +
gaagtaaagcactcctcagcaa

SEQ ID NO: 106340 - DNA, 22 bp, Artificial Sequence
  Synthetic oligonucleotide; CTC chr11 5357752 5357773 5357769 5357774 +
ctcagcaaatgtaaaagaacag

SEQ ID NO: 106341 - DNA, 22 bp, Artificial Sequence
  Synthetic oligonucleotide; CTC chr11 5357755 5357776 5357772 5357777 +
agcaaatgtaaaagaacagaaa

SEQ ID NO: 106342 - DNA, 22 bp, Artificial Sequence
  Synthetic oligonucleotide; TTA chr11 5357780 5357801 5357797 5357802 +
taacaaactgtctctcagacca

SEQ ID NO: 106343 - DNA, 22 bp, Artificial Sequence
  Synthetic oligonucleotide; CTG chr11 5357790 5357811 5357807 5357812 +
tctctcagaccacagtgcaatc

SEQ ID NO: 106344 - DNA, 22 bp, Artificial Sequence
  Synthetic oligonucleotide; CTC chr11 5357794 5357815 5357811 5357816 +
tcagaccacagtgcaatcaaac

SEQ ID NO: 106345 - DNA, 22 bp, Artificial Sequence
  Synthetic oligonucleotide; CTC chr11 5357796 5357817 5357813 5357818 +
agaccacagtgcaatcaaacta

SEQ ID NO: 106346 - DNA, 22 bp, Artificial Sequence
  Synthetic oligonucleotide; CTA chr11 5357818 5357839 5357835 5357840 +
gaactcaggattaagaaactca

SEQ ID NO: 106347 - DNA, 22 bp, Artificial Sequence
  Synthetic oligonucleotide; CTC chr11 5357824 5357845 5357841 5357846 +
aggattaagaaactcactcaaa

SEQ ID NO: 106348 - DNA, 22 bp, Artificial Sequence
  Synthetic oligonucleotide; TTA chr11 5357831 5357852 5357848 5357853 +
agaaactcactcaaaaccgctc

SEQ ID NO: 106349 - DNA, 22 bp, Artificial Sequence
  Synthetic oligonucleotide; CTC chr11 5357839 5357860 5357856 5357861 +
actcaaaaccgctcaactacat

SEQ ID NO: 106350 - DNA, 22 bp, Artificial Sequence
  Synthetic oligonucleotide; CTC chr11 5357843 5357864 5357860 5357865 +
aaaaccgctcaactacatggaa

SEQ ID NO: 106351 - DNA, 22 bp, Artificial Sequence
  Synthetic oligonucleotide; CTC chr11 5357853 5357874 5357870 5357875 +
aactacatggaaaccgaacaaa

SEQ ID NO: 106352 - DNA, 22 bp, Artificial Sequence
  Synthetic oligonucleotide; CTA chr11 5357858 5357879 5357875 5357880 +
catggaaaccgaacaaattgct

SEQ ID NO: 106353 - DNA, 22 bp, Artificial Sequence
  Synthetic oligonucleotide; TTG chr11 5357878 5357899 5357895 5357900 +
ctcctgaatgactactgggttc

SEQ ID NO: 106354 - DNA, 22 bp, Artificial Sequence
  Synthetic oligonucleotide; CTC chr11 5357881 5357902 5357898 5357903 +
ctgaatgactactgggttcata

SEQ ID NO: 106355 - DNA, 22 bp, Artificial Sequence
  Synthetic oligonucleotide; CTG chr11 5357884 5357905 5357901 5357906 +
aatgactactgggttcataaca

SEQ ID NO: 106356 - DNA, 22 bp, Artificial Sequence
  Synthetic oligonucleotide; CTA chr11 5357892 5357913 5357909 5357914 +
ctgggttcataacaaaatgaag

SEQ ID NO: 106357 - DNA, 22 bp, Artificial Sequence
  Synthetic oligonucleotide; CTG chr11 5357895 5357916 5357912 5357917 +
ggttcataacaaaatgaaggca

SEQ ID NO: 106358 - DNA, 22 bp, Artificial Sequence
  Synthetic oligonucleotide; TTC chr11 5357900 5357921 5357917 5357922 +
ataacaaaatgaaggcagaaat

SEQ ID NO: 106359 - DNA, 22 bp, Artificial Sequence
  Synthetic oligonucleotide; TTC chr11 5357932 5357953 5357949 5357954 +
tttggaaccaaagagaacaaag

SEQ ID NO: 106360 - DNA, 22 bp, Artificial Sequence
  Synthetic oligonucleotide; CTT chr11 5357934 5357955 5357951 5357956 +
tggaaccaaagagaacaaagac

SEQ ID NO: 106361 - DNA, 22 bp, Artificial Sequence
  Synthetic oligonucleotide; TTT chr11 5357935 5357956 5357952 5357957 +
ggaaccaaagagaacaaagaca

SEQ ID NO: 106362 - DNA, 22 bp, Artificial Sequence
  Synthetic oligonucleotide; TTG chr11 5357936 5357957 5357953 5357958 +
gaaccaaagagaacaaagacac

SEQ ID NO: 106363 - DNA, 22 bp, Artificial Sequence
  Synthetic oligonucleotide; CTC chr11 5357974 5357995 5357991 5357996 +
tgggacacattcaaagcagtgt

SEQ ID NO: 106364 - DNA, 22 bp, Artificial Sequence
  Synthetic oligonucleotide; CTG chr11 5357976 5357997 5357993 5357998 +
ggacacattcaaagcagtgtgt

SEQ ID NO: 106365 - DNA, 22 bp, Artificial Sequence
  Synthetic oligonucleotide; TTC chr11 5357986 5358007 5358003 5358008 +
aaagcagtgtgtagagggaaat

SEQ ID NO: 106366 - DNA, 22 bp, Artificial Sequence
  Synthetic oligonucleotide; TTT chr11 5358010 5358031 5358027 5358032 +
atagcactaaacgcccagaaga

SEQ ID NO: 106367 - DNA, 22 bp, Artificial Sequence
  Synthetic oligonucleotide; TTA chr11 5358011 5358032 5358028 5358033 +
tagcactaaacgcccagaagag

SEQ ID NO: 106368 - DNA, 22 bp, Artificial Sequence
  Synthetic oligonucleotide; CTA chr11 5358019 5358040 5358036 5358041 +
aacgcccagaagagaaagcagg

SEQ ID NO: 106369 - DNA, 22 bp, Artificial Sequence
  Synthetic oligonucleotide; CTA chr11 5358050 5358071 5358067 5358072 +
aaattgacaccctaacatcaca

SEQ ID NO: 106370 - DNA, 22 bp, Artificial Sequence
  Synthetic oligonucleotide; TTG chr11 5358056 5358077 5358073 5358078 +
acaccctaacatcacaattaaa

SEQ ID NO: 106371 - DNA, 22 bp, Artificial Sequence
  Synthetic oligonucleotide; CTA chr11 5358064 5358085 5358081 5358086 +
acatcacaattaaaagaactag

SEQ ID NO: 106372 - DNA, 22 bp, Artificial Sequence
  Synthetic oligonucleotide; TTA chr11 5358076 5358097 5358093 5358098 +
aaagaactagagaagcaagagc

SEQ ID NO: 106373 - DNA, 22 bp, Artificial Sequence
  Synthetic oligonucleotide; CTA chr11 5358085 5358106 5358102 5358107 +
gagaagcaagagcaaacacatt

SEQ ID NO: 106374 - DNA, 22 bp, Artificial Sequence
  Synthetic oligonucleotide; TTC chr11 5358108 5358129 5358125 5358130 +
aaatgctagcagaaggcaagaa

SEQ ID NO: 106375 - DNA, 22 bp, Artificial Sequence
  Synthetic oligonucleotide; CTA chr11 5358116 5358137 5358133 5358138 +
gcagaaggcaagaaataactaa

SEQ ID NO: 106376 - DNA, 22 bp, Artificial Sequence
  Synthetic oligonucleotide; CTA chr11 5358137 5358158 5358154 5358159 +
aaatcagagcagaactgaagga

SEQ ID NO: 106377 - DNA, 22 bp, Artificial Sequence
  Synthetic oligonucleotide; CTG chr11 5358154 5358175 5358171 5358176 +
aaggaaatagagacacaaaaaa

SEQ ID NO: 106378 - DNA, 22 bp, Artificial Sequence
  Synthetic oligonucleotide; CTT chr11 5358182 5358203 5358199 5358204 +
caaaaaatcaatgaatccagaa

SEQ ID NO: 106379 - DNA, 22 bp, Artificial Sequence
  Synthetic oligonucleotide; TTC chr11 5358183 5358204 5358200 5358205 +
aaaaaatcaatgaatccagaag

SEQ ID NO: 106380 - DNA, 22 bp, Artificial Sequence
  Synthetic oligonucleotide; CTG chr11 5358208 5358229 5358225 5358230 +
gtttttcaaaaagatcaacaaa

SEQ ID NO: 106381 - DNA, 22 bp, Artificial Sequence
  Synthetic oligonucleotide; TTT chr11 5358212 5358233 5358229 5358234 +
ttcaaaaagatcaacaaaattg

SEQ ID NO: 106382 - DNA, 22 bp, Artificial Sequence
  Synthetic oligonucleotide; TTT chr11 5358213 5358234 5358230 5358235 +
tcaaaaagatcaacaaaattga

SEQ ID NO: 106383 - DNA, 22 bp, Artificial Sequence
  Synthetic oligonucleotide; TTT chr11 5358214 5358235 5358231 5358236 +
caaaaagatcaacaaaattgat

SEQ ID NO: 106384 - DNA, 22 bp, Artificial Sequence
  Synthetic oligonucleotide; TTC chr11 5358215 5358236 5358232 5358237 +
aaaaagatcaacaaaattgata

SEQ ID NO: 106385 - DNA, 22 bp, Artificial Sequence
  Synthetic oligonucleotide; TTG chr11 5358234 5358255 5358251 5358256 +
atagactgctagcaagactaat

SEQ ID NO: 106386 - DNA, 22 bp, Artificial Sequence
  Synthetic oligonucleotide; CTG chr11 5358242 5358263 5358259 5358264 +
ctagcaagactaataaagaaga

SEQ ID NO: 106387 - DNA, 22 bp, Artificial Sequence
  Synthetic oligonucleotide; CTA chr11 5358245 5358266 5358262 5358267 +
gcaagactaataaagaagaaaa

SEQ ID NO: 106388 - DNA, 22 bp, Artificial Sequence
  Synthetic oligonucleotide; CTA chr11 5358254 5358275 5358271 5358276 +
ataaagaagaaaagagagaaga

SEQ ID NO: 106389 - DNA, 22 bp, Artificial Sequence
  Synthetic oligonucleotide; CTA chr11 5358358 5358379 5358375 5358380 +
taaacacctctacacaaataaa

SEQ ID NO: 106390 - DNA, 22 bp, Artificial Sequence
  Synthetic oligonucleotide; CTC chr11 5358368 5358389 5358385 5358390 +
tacacaaataaactagaaaatc

SEQ ID NO: 106391 - DNA, 22 bp, Artificial Sequence
  Synthetic oligonucleotide; CTA chr11 5358370 5358391 5358387 5358392 +
cacaaataaactagaaaatcta

SEQ ID NO: 106392 - DNA, 22 bp, Artificial Sequence
  Synthetic oligonucleotide; CTA chr11 5358383 5358404 5358400 5358405 +
gaaaatctagaagaaatggata

SEQ ID NO: 106393 - DNA, 22 bp, Artificial Sequence
  Synthetic oligonucleotide; CTA chr11 5358392 5358413 5358409 5358414 +
gaagaaatggataaattccttg

SEQ ID NO: 106394 - DNA, 22 bp, Artificial Sequence
  Synthetic oligonucleotide; TTC chr11 5358410 5358431 5358427 5358432 +
cttgacacatacaccctcccaa

SEQ ID NO: 106395 - DNA, 22 bp, Artificial Sequence
  Synthetic oligonucleotide; CTT chr11 5358413 5358434 5358430 5358435 +
gacacatacaccctcccaagac

SEQ ID NO: 106396 - DNA, 22 bp, Artificial Sequence
  Synthetic oligonucleotide; TTG chr11 5358414 5358435 5358431 5358436 +
acacatacaccctcccaagact

SEQ ID NO: 106397 - DNA, 22 bp, Artificial Sequence
  Synthetic oligonucleotide; CTC chr11 5358428 5358449 5358445 5358450 +
ccaagactaaaccaggaagaag

SEQ ID NO: 106398 - DNA, 22 bp, Artificial Sequence
  Synthetic oligonucleotide; CTA chr11 5358437 5358458 5358454 5358459 +
aaccaggaagaagttgaatctc

SEQ ID NO: 106399 - DNA, 22 bp, Artificial Sequence
  Synthetic oligonucleotide; TTG chr11 5358453 5358474 5358470 5358475 +
aatctctgaatagaccaataac

SEQ ID NO: 106400 - DNA, 22 bp, Artificial Sequence
  Synthetic oligonucleotide; CTC chr11 5358459 5358480 5358476 5358481 +
tgaatagaccaataacaggatc

SEQ ID NO: 106401 - DNA, 22 bp, Artificial Sequence
  Synthetic oligonucleotide; CTG chr11 5358461 5358482 5358478 5358483 +
aatagaccaataacaggatctg

SEQ ID NO: 106402 - DNA, 22 bp, Artificial Sequence
  Synthetic oligonucleotide; CTG chr11 5358483 5358504 5358500 5358505 +
aaattgaggcaataattaatag

SEQ ID NO: 106403 - DNA, 22 bp, Artificial Sequence
  Synthetic oligonucleotide; TTG chr11 5358489 5358510 5358506 5358511 +
aggcaataattaatagcttacc

SEQ ID NO: 106404 - DNA, 22 bp, Artificial Sequence
  Synthetic oligonucleotide; TTA chr11 5358501 5358522 5358518 5358523 +
atagcttaccaaccaaaaacag

SEQ ID NO: 106405 - DNA, 22 bp, Artificial Sequence
  Synthetic oligonucleotide; CTT chr11 5358508 5358529 5358525 5358530 +
accaaccaaaaacagtccagga

SEQ ID NO: 106406 - DNA, 22 bp, Artificial Sequence
  Synthetic oligonucleotide; TTA chr11 5358509 5358530 5358526 5358531 +
ccaaccaaaaacagtccaggac

SEQ ID NO: 106407 - DNA, 22 bp, Artificial Sequence
  Synthetic oligonucleotide; TTC chr11 5358554 5358575 5358571 5358576 +
taccagaggtacaaggaggagc

SEQ ID NO: 106408 - DNA, 22 bp, Artificial Sequence
  Synthetic oligonucleotide; CTA chr11 5358556 5358577 5358573 5358578 +
ccagaggtacaaggaggagctg

SEQ ID NO: 106409 - DNA, 22 bp, Artificial Sequence
  Synthetic oligonucleotide; CTG chr11 5358578 5358599 5358595 5358600 +
gtaccattccctctgaaactat

SEQ ID NO: 106410 - DNA, 22 bp, Artificial Sequence
  Synthetic oligonucleotide; TTC chr11 5358587 5358608 5358604 5358609 +
cctctgaaactattcgaatcaa

SEQ ID NO: 106411 - DNA, 22 bp, Artificial Sequence
  Synthetic oligonucleotide; CTC chr11 5358591 5358612 5358608 5358613 +
tgaaactattcgaatcaatagt

SEQ ID NO: 106412 - DNA, 22 bp, Artificial Sequence
  Synthetic oligonucleotide; CTG chr11 5358593 5358614 5358610 5358615 +
aaactattcgaatcaatagtaa

SEQ ID NO: 106413 - DNA, 22 bp, Artificial Sequence
  Synthetic oligonucleotide; CTA chr11 5358599 5358620 5358616 5358621 +
ttcgaatcaatagtaaaagagg

SEQ ID NO: 106414 - DNA, 22 bp, Artificial Sequence
  Synthetic oligonucleotide; TTC chr11 5358602 5358623 5358619 5358624 +
gaatcaatagtaaaagagggaa

SEQ ID NO: 106415 - DNA, 22 bp, Artificial Sequence
  Synthetic oligonucleotide; CTC chr11 5358629 5358650 5358646 5358651 +
cctaactcattttatgaggcca

SEQ ID NO: 106416 - DNA, 22 bp, Artificial Sequence
  Synthetic oligonucleotide; CTA chr11 5358633 5358654 5358650 5358655 +
actcattttatgaggccagcat

SEQ ID NO: 106417 - DNA, 22 bp, Artificial Sequence
  Synthetic oligonucleotide; CTC chr11 5358637 5358658 5358654 5358659 +
attttatgaggccagcatcatc

SEQ ID NO: 106418 - DNA, 22 bp, Artificial Sequence
  Synthetic oligonucleotide; TTT chr11 5358641 5358662 5358658 5358663 +
tatgaggccagcatcatcctga

SEQ ID NO: 106419 - DNA, 22 bp, Artificial Sequence
  Synthetic oligonucleotide; TTT chr11 5358642 5358663 5358659 5358664 +
atgaggccagcatcatcctgat

SEQ ID NO: 106420 - DNA, 22 bp, Artificial Sequence
  Synthetic oligonucleotide; TTA chr11 5358643 5358664 5358660 5358665 +
tgaggccagcatcatcctgata

SEQ ID NO: 106421 - DNA, 22 bp, Artificial Sequence
  Synthetic oligonucleotide; CTG chr11 5358662 5358683 5358679 5358684 +
ataccaaagccgggcagagaca

SEQ ID NO: 106422 - DNA, 22 bp, Artificial Sequence
  Synthetic oligonucleotide; TTT chr11 5358703 5358724 5358720 5358725 +
tagaccaatatccctgatggac

SEQ ID NO: 106423 - DNA, 22 bp, Artificial Sequence
  Synthetic oligonucleotide; TTT chr11 5358704 5358725 5358721 5358726 +
agaccaatatccctgatggaca

SEQ ID NO: 106424 - DNA, 22 bp, Artificial Sequence
  Synthetic oligonucleotide; TTA chr11 5358705 5358726 5358722 5358727 +
gaccaatatccctgatggacat

SEQ ID NO: 106425 - DNA, 22 bp, Artificial Sequence
  Synthetic oligonucleotide; CTG chr11 5358719 5358740 5358736 5358741 +
atggacatcgatgcaaaaaacc

SEQ ID NO: 106426 - DNA, 22 bp, Artificial Sequence
  Synthetic oligonucleotide; CTC chr11 5358743 5358764 5358760 5358765 +
aataaaatactggcaaagcaaa

SEQ ID NO: 106427 - DNA, 22 bp, Artificial Sequence
  Synthetic oligonucleotide; CTG chr11 5358755 5358776 5358772 5358777 +
gcaaagcaaatccagcagcaca

SEQ ID NO: 106428 - DNA, 22 bp, Artificial Sequence
  Synthetic oligonucleotide; CTT chr11 5358788 5358809 5358805 5358810 +
atccaccatgatcaagtgggct

SEQ ID NO: 106429 - DNA, 22 bp, Artificial Sequence
  Synthetic oligonucleotide; TTA chr11 5358789 5358810 5358806 5358811 +
tccaccatgatcaagtgggctt

SEQ ID NO: 106430 - DNA, 22 bp, Artificial Sequence
  Synthetic oligonucleotide; CTT chr11 5358811 5358832 5358828 5358833 +
catccctgggatgcaaggctgg

SEQ ID NO: 106431 - DNA, 22 bp, Artificial Sequence
  Synthetic oligonucleotide; TTC chr11 5358812 5358833 5358829 5358834 +
atccctgggatgcaaggctggt

SEQ ID NO: 106432 - DNA, 22 bp, Artificial Sequence
  Synthetic oligonucleotide; CTG chr11 5358819 5358840 5358836 5358841 +
ggatgcaaggctggttcaacat

SEQ ID NO: 106433 - DNA, 22 bp, Artificial Sequence
  Synthetic oligonucleotide; CTG chr11 5358832 5358853 5358849 5358854 +
gttcaacatatgcaaatcaata

SEQ ID NO: 106434 - DNA, 22 bp, Artificial Sequence
  Synthetic oligonucleotide; TTC chr11 5358836 5358857 5358853 5358858 +
aacatatgcaaatcaataaatg

SEQ ID NO: 106435 - DNA, 22 bp, Artificial Sequence
  Synthetic oligonucleotide; TTA chr11 5358903 5358924 5358920 5358925 +
tctcaatagatgcagaaaaggc

SEQ ID NO: 106436 - DNA, 22 bp, Artificial Sequence
  Synthetic oligonucleotide; CTC chr11 5358907 5358928 5358924 5358929 +
aatagatgcagaaaaggccttt

SEQ ID NO: 106437 - DNA, 22 bp, Artificial Sequence
  Synthetic oligonucleotide; CTT chr11 5358928 5358949 5358945 5358950 +
tgacaaaattcaacaacccttc

SEQ ID NO: 106438 - DNA, 22 bp, Artificial Sequence
  Synthetic oligonucleotide; TTT chr11 5358929 5358950 5358946 5358951 +
gacaaaattcaacaacccttca

SEQ ID NO: 106439 - DNA, 22 bp, Artificial Sequence
  Synthetic oligonucleotide; TTG chr11 5358930 5358951 5358947 5358952 +
acaaaattcaacaacccttcat

SEQ ID NO: 106440 - DNA, 22 bp, Artificial Sequence
  Synthetic oligonucleotide; TTC chr11 5358939 5358960 5358956 5358961 +
aacaacccttcatgctaaaaac

SEQ ID NO: 106441 - DNA, 22 bp, Artificial Sequence
  Synthetic oligonucleotide; CTT chr11 5358949 5358970 5358966 5358971 +
catgctaaaaactctcaataaa

SEQ ID NO: 106442 - DNA, 22 bp, Artificial Sequence
  Synthetic oligonucleotide; TTC chr11 5358950 5358971 5358967 5358972 +
atgctaaaaactctcaataaat

SEQ ID NO: 106443 - DNA, 22 bp, Artificial Sequence
  Synthetic oligonucleotide; CTA chr11 5358956 5358977 5358973 5358978 +
aaaactctcaataaattaggta

SEQ ID NO: 106444 - DNA, 22 bp, Artificial Sequence
  Synthetic oligonucleotide; CTC chr11 5358963 5358984 5358980 5358985 +
tcaataaattaggtattgatgg

SEQ ID NO: 106445 - DNA, 22 bp, Artificial Sequence
  Synthetic oligonucleotide; CTC chr11 5358965 5358986 5358982 5358987 +
aataaattaggtattgatggga

SEQ ID NO: 106446 - DNA, 22 bp, Artificial Sequence
  Synthetic oligonucleotide; TTA chr11 5358974 5358995 5358991 5358996 +
ggtattgatgggacgtatctca

SEQ ID NO: 106447 - DNA, 22 bp, Artificial Sequence
  Synthetic oligonucleotide; TTG chr11 5358981 5359002 5358998 5359003 +
atgggacgtatctcaaaataat

SEQ ID NO: 106448 - DNA, 22 bp, Artificial Sequence
  Synthetic oligonucleotide; CTC chr11 5358995 5359016 5359012 5359017 +
aaaataataagagccatctatg

SEQ ID NO: 106449 - DNA, 22 bp, Artificial Sequence
  Synthetic oligonucleotide; CTA chr11 5359015 5359036 5359032 5359037 +
tgacaaacccacagccaatatc

SEQ ID NO: 106450 - DNA, 22 bp, Artificial Sequence
  Synthetic oligonucleotide; CTG chr11 5359043 5359064 5359060 5359065 +
aatggacaaaaactggaagcat

SEQ ID NO: 106451 - DNA, 22 bp, Artificial Sequence
  Synthetic oligonucleotide; CTG chr11 5359058 5359079 5359075 5359080 +
gaagcattccctttgaaaactg

SEQ ID NO: 106452 - DNA, 22 bp, Artificial Sequence
  Synthetic oligonucleotide; TTC chr11 5359067 5359088 5359084 5359089 +
cctttgaaaactggcacaagac

SEQ ID NO: 106453 - DNA, 22 bp, Artificial Sequence
  Synthetic oligonucleotide; CTT chr11 5359071 5359092 5359088 5359093 +
tgaaaactggcacaagacaggg

SEQ ID NO: 106454 - DNA, 22 bp, Artificial Sequence
  Synthetic oligonucleotide; TTT chr11 5359072 5359093 5359089 5359094 +
gaaaactggcacaagacaggga

SEQ ID NO: 106455 - DNA, 22 bp, Artificial Sequence
  Synthetic oligonucleotide; TTG chr11 5359073 5359094 5359090 5359095 +
aaaactggcacaagacagggat

SEQ ID NO: 106456 - DNA, 22 bp, Artificial Sequence
  Synthetic oligonucleotide; CTG chr11 5359080 5359101 5359097 5359102 +
gcacaagacagggatgccctct

SEQ ID NO: 106457 - DNA, 22 bp, Artificial Sequence
  Synthetic oligonucleotide; CTC chr11 5359101 5359122 5359118 5359123 +
tctcactactcctattcaacat

SEQ ID NO: 106458 - DNA, 22 bp, Artificial Sequence
  Synthetic oligonucleotide; CTC chr11 5359103 5359124 5359120 5359125 +
tcactactcctattcaacatag

SEQ ID NO: 106459 - DNA, 22 bp, Artificial Sequence
  Synthetic oligonucleotide; CTC chr11 5359105 5359126 5359122 5359127 +
actactcctattcaacatagtg

SEQ ID NO: 106460 - DNA, 22 bp, Artificial Sequence
  Synthetic oligonucleotide; CTA chr11 5359109 5359130 5359126 5359131 +
ctcctattcaacatagtgttgg

SEQ ID NO: 106461 - DNA, 22 bp, Artificial Sequence
  Synthetic oligonucleotide; CTC chr11 5359112 5359133 5359129 5359134 +
ctattcaacatagtgttggaat

SEQ ID NO: 106462 - DNA, 22 bp, Artificial Sequence
  Synthetic oligonucleotide; CTA chr11 5359115 5359136 5359132 5359137 +
ttcaacatagtgttggaatttc

SEQ ID NO: 106463 - DNA, 22 bp, Artificial Sequence
  Synthetic oligonucleotide; TTC chr11 5359118 5359139 5359135 5359140 +
aacatagtgttggaatttctgg

SEQ ID NO: 106464 - DNA, 22 bp, Artificial Sequence
  Synthetic oligonucleotide; TTG chr11 5359130 5359151 5359147 5359152 +
gaatttctggccagggcaatta

SEQ ID NO: 106465 - DNA, 22 bp, Artificial Sequence
  Synthetic oligonucleotide; TTT chr11 5359136 5359157 5359153 5359158 +
ctggccagggcaattaggcagg

SEQ ID NO: 106466 - DNA, 22 bp, Artificial Sequence
  Synthetic oligonucleotide; TTC chr11 5359137 5359158 5359154 5359159 +
tggccagggcaattaggcagga

SEQ ID NO: 106467 - DNA, 22 bp, Artificial Sequence
  Synthetic oligonucleotide; CTG chr11 5359139 5359160 5359156 5359161 +
gccagggcaattaggcaggaga

SEQ ID NO: 106468 - DNA, 22 bp, Artificial Sequence
  Synthetic oligonucleotide; TTA chr11 5359152 5359173 5359169 5359174 +
ggcaggagaaggaaaaaaaggt

SEQ ID NO: 106469 - DNA, 22 bp, Artificial Sequence
  Synthetic oligonucleotide; TTC chr11 5359178 5359199 5359195 5359200 +
aattaggaaaagaggaagtcaa

SEQ ID NO: 106470 - DNA, 22 bp, Artificial Sequence
  Synthetic oligonucleotide; TTA chr11 5359183 5359204 5359200 5359205 +
ggaaaagaggaagtcaaattgt

SEQ ID NO: 106471 - DNA, 22 bp, Artificial Sequence
  Synthetic oligonucleotide; TTG chr11 5359204 5359225 5359221 5359226 +
tccctgtttgcagatgacacga

SEQ ID NO: 106472 - DNA, 22 bp, Artificial Sequence
  Synthetic oligonucleotide; CTG chr11 5359210 5359231 5359227 5359232 +
tttgcagatgacacgattgtat

SEQ ID NO: 106473 - DNA, 22 bp, Artificial Sequence
  Synthetic oligonucleotide; TTT chr11 5359213 5359234 5359230 5359235 +
gcagatgacacgattgtatatc

SEQ ID NO: 106474 - DNA, 22 bp, Artificial Sequence
  Synthetic oligonucleotide; TTG chr11 5359214 5359235 5359231 5359236 +
cagatgacacgattgtatatct

SEQ ID NO: 106475 - DNA, 22 bp, Artificial Sequence
  Synthetic oligonucleotide; TTG chr11 5359229 5359250 5359246 5359251 +
tatatctagaaaaccccactgt

SEQ ID NO: 106476 - DNA, 22 bp, Artificial Sequence
  Synthetic oligonucleotide; CTA chr11 5359237 5359258 5359254 5359259 +
gaaaaccccactgtctcagccc

SEQ ID NO: 106477 - DNA, 22 bp, Artificial Sequence
  Synthetic oligonucleotide; CTG chr11 5359250 5359271 5359267 5359272 +
tctcagcccaaaatgtccttaa

SEQ ID NO: 106478 - DNA, 22 bp, Artificial Sequence
  Synthetic oligonucleotide; CTC chr11 5359254 5359275 5359271 5359276 +
agcccaaaatgtccttaaactg

SEQ ID NO: 106479 - DNA, 22 bp, Artificial Sequence
  Synthetic oligonucleotide; CTT chr11 5359270 5359291 5359287 5359292 +
aaactgataggcaacttcagca

SEQ ID NO: 106480 - DNA, 22 bp, Artificial Sequence
  Synthetic oligonucleotide; TTA chr11 5359271 5359292 5359288 5359293 +
aactgataggcaacttcagcaa

SEQ ID NO: 106481 - DNA, 22 bp, Artificial Sequence
  Synthetic oligonucleotide; CTG chr11 5359276 5359297 5359293 5359298 +
ataggcaacttcagcaaagtct

SEQ ID NO: 106482 - DNA, 22 bp, Artificial Sequence
  Synthetic oligonucleotide; CTT chr11 5359287 5359308 5359304 5359309 +
cagcaaagtctcaggatacaaa

SEQ ID NO: 106483 - DNA, 22 bp, Artificial Sequence
  Synthetic oligonucleotide; TTC chr11 5359288 5359309 5359305 5359310 +
agcaaagtctcaggatacaaaa

SEQ ID NO: 106484 - DNA, 22 bp, Artificial Sequence
  Synthetic oligonucleotide; CTC chr11 5359299 5359320 5359316 5359321 +
aggatacaaaatcaatgtgcaa

SEQ ID NO: 106485 - DNA, 22 bp, Artificial Sequence
  Synthetic oligonucleotide; TTC chr11 5359336 5359357 5359353 5359358 +
ttatacaccaataacagacaaa

SEQ ID NO: 106486 - DNA, 22 bp, Artificial Sequence
  Synthetic oligonucleotide; CTT chr11 5359338 5359359 5359355 5359360 +
atacaccaataacagacaaaca

SEQ ID NO: 106487 - DNA, 22 bp, Artificial Sequence
  Synthetic oligonucleotide; TTA chr11 5359339 5359360 5359356 5359361 +
tacaccaataacagacaaacag

SEQ ID NO: 106488 - DNA, 22 bp, Artificial Sequence
  Synthetic oligonucleotide; CTC chr11 5359384 5359405 5359401 5359406 +
ccattcacaattgcttcaaaga

SEQ ID NO: 106489 - DNA, 22 bp, Artificial Sequence
  Synthetic oligonucleotide; TTC chr11 5359390 5359411 5359407 5359412 +
acaattgcttcaaagagaataa

SEQ ID NO: 106490 - DNA, 22 bp, Artificial Sequence
  Synthetic oligonucleotide; TTG chr11 5359397 5359418 5359414 5359419 +
cttcaaagagaataaaatacct

SEQ ID NO: 106491 - DNA, 22 bp, Artificial Sequence
  Synthetic oligonucleotide; CTT chr11 5359400 5359421 5359417 5359422 +
caaagagaataaaatacctagg

SEQ ID NO: 106492 - DNA, 22 bp, Artificial Sequence
  Synthetic oligonucleotide; TTC chr11 5359401 5359422 5359418 5359423 +
aaagagaataaaatacctagga

SEQ ID NO: 106493 - DNA, 22 bp, Artificial Sequence
  Synthetic oligonucleotide; CTA chr11 5359420 5359441 5359437 5359442 +
ggaatccaacttacaagagagg

SEQ ID NO: 106494 - DNA, 22 bp, Artificial Sequence
  Synthetic oligonucleotide; CTT chr11 5359432 5359453 5359449 5359454 +
acaagagaggtgaaggacctct

SEQ ID NO: 106495 - DNA, 22 bp, Artificial Sequence
  Synthetic oligonucleotide; TTA chr11 5359433 5359454 5359450 5359455 +
caagagaggtgaaggacctctt

SEQ ID NO: 106496 - DNA, 22 bp, Artificial Sequence
  Synthetic oligonucleotide; CTC chr11 5359453 5359474 5359470 5359475 +
ttcaaggagaactacaaaccac

SEQ ID NO: 106497 - DNA, 22 bp, Artificial Sequence
  Synthetic oligonucleotide; CTT chr11 5359455 5359476 5359472 5359477 +
caaggagaactacaaaccactg

SEQ ID NO: 106498 - DNA, 22 bp, Artificial Sequence
  Synthetic oligonucleotide; TTC chr11 5359456 5359477 5359473 5359478 +
aaggagaactacaaaccactgc

SEQ ID NO: 106499 - DNA, 22 bp, Artificial Sequence
  Synthetic oligonucleotide; CTA chr11 5359467 5359488 5359484 5359489 +
caaaccactgctgaatgaaata

SEQ ID NO: 106500 - DNA, 22 bp, Artificial Sequence
  Synthetic oligonucleotide; CTG chr11 5359477 5359498 5359494 5359499 +
ctgaatgaaataaaagaagata

SEQ ID NO: 106501 - DNA, 22 bp, Artificial Sequence
  Synthetic oligonucleotide; CTG chr11 5359480 5359501 5359497 5359502 +
aatgaaataaaagaagatacaa

SEQ ID NO: 106502 - DNA, 22 bp, Artificial Sequence
  Synthetic oligonucleotide; TTC chr11 5359520 5359541 5359537 5359542 +
catgctcatgggtaggaagaat

SEQ ID NO: 106503 - DNA, 22 bp, Artificial Sequence
  Synthetic oligonucleotide; CTC chr11 5359527 5359548 5359544 5359549 +
atgggtaggaagaatcaatatc

SEQ ID NO: 106504 - DNA, 22 bp, Artificial Sequence
  Synthetic oligonucleotide; TTT chr11 5359580 5359601 5359597 5359602 +
atagattcaatgccatccccat

SEQ ID NO: 106505 - DNA, 22 bp, Artificial Sequence
  Synthetic oligonucleotide; TTA chr11 5359581 5359602 5359598 5359603 +
tagattcaatgccatccccatc

SEQ ID NO: 106506 - DNA, 22 bp, Artificial Sequence
  Synthetic oligonucleotide; TTC chr11 5359588 5359609 5359605 5359610 +
aatgccatccccatcaagctac

SEQ ID NO: 106507 - DNA, 22 bp, Artificial Sequence
  Synthetic oligonucleotide; CTA chr11 5359609 5359630 5359626 5359631 +
ccaatgactttcttcacagaat

SEQ ID NO: 106508 - DNA, 22 bp, Artificial Sequence
  Synthetic oligonucleotide; CTT chr11 5359619 5359640 5359636 5359641 +
tcttcacagaattggaaaaaac

SEQ ID NO: 106509 - DNA, 22 bp, Artificial Sequence
  Synthetic oligonucleotide; TTT chr11 5359620 5359641 5359637 5359642 +
cttcacagaattggaaaaaact

SEQ ID NO: 106510 - DNA, 22 bp, Artificial Sequence
  Synthetic oligonucleotide; TTC chr11 5359621 5359642 5359638 5359643 +
ttcacagaattggaaaaaacta

SEQ ID NO: 106511 - DNA, 22 bp, Artificial Sequence
  Synthetic oligonucleotide; CTT chr11 5359623 5359644 5359640 5359645 +
cacagaattggaaaaaactact

SEQ ID NO: 106512 - DNA, 22 bp, Artificial Sequence
  Synthetic oligonucleotide; TTC chr11 5359624 5359645 5359641 5359646 +
acagaattggaaaaaactactt

SEQ ID NO: 106513 - DNA, 22 bp, Artificial Sequence
  Synthetic oligonucleotide; TTG chr11 5359633 5359654 5359650 5359655 +
gaaaaaactactttaaagttca

SEQ ID NO: 106514 - DNA, 22 bp, Artificial Sequence
  Synthetic oligonucleotide; CTA chr11 5359643 5359664 5359660 5359665 +
ctttaaagttcatatggaacca

SEQ ID NO: 106515 - DNA, 22 bp, Artificial Sequence
  Synthetic oligonucleotide; CTT chr11 5359646 5359667 5359663 5359668 +
taaagttcatatggaaccaaaa

SEQ ID NO: 106516 - DNA, 22 bp, Artificial Sequence
  Synthetic oligonucleotide; TTT chr11 5359647 5359668 5359664 5359669 +
aaagttcatatggaaccaaaaa

SEQ ID NO: 106517 - DNA, 22 bp, Artificial Sequence
  Synthetic oligonucleotide; TTA chr11 5359648 5359669 5359665 5359670 +
aagttcatatggaaccaaaaaa

SEQ ID NO: 106518 - DNA, 22 bp, Artificial Sequence
  Synthetic oligonucleotide; TTC chr11 5359654 5359675 5359671 5359676 +
atatggaaccaaaaaagagccc

SEQ ID NO: 106519 - DNA, 22 bp, Artificial Sequence
  Synthetic oligonucleotide; TTG chr11 5359682 5359703 5359699 5359704 +
acatgccaatcctaagccaaaa

SEQ ID NO: 106520 - DNA, 22 bp, Artificial Sequence
  Synthetic oligonucleotide; CTA chr11 5359696 5359717 5359713 5359718 +
agccaaaagaacaaagctggag

SEQ ID NO: 106521 - DNA, 22 bp, Artificial Sequence
  Synthetic oligonucleotide; CTG chr11 5359715 5359736 5359732 5359737 +
gaggcatcacgctacctgactt

SEQ ID NO: 106522 - DNA, 22 bp, Artificial Sequence
  Synthetic oligonucleotide; CTA chr11 5359729 5359750 5359746 5359751 +
cctgacttcaaactatactaca

SEQ ID NO: 106523 - DNA, 22 bp, Artificial Sequence
  Synthetic oligonucleotide; CTG chr11 5359733 5359754 5359750 5359755 +
acttcaaactatactacaaggc

SEQ ID NO: 106524 - DNA, 22 bp, Artificial Sequence
  Synthetic oligonucleotide; CTT chr11 5359737 5359758 5359754 5359759 +
caaactatactacaaggctaca

SEQ ID NO: 106525 - DNA, 22 bp, Artificial Sequence
  Synthetic oligonucleotide; TTC chr11 5359738 5359759 5359755 5359760 +
aaactatactacaaggctacag

SEQ ID NO: 106526 - DNA, 22 bp, Artificial Sequence
  Synthetic oligonucleotide; CTA chr11 5359744 5359765 5359761 5359766 +
tactacaaggctacagtaacca

SEQ ID NO: 106527 - DNA, 22 bp, Artificial Sequence
  Synthetic oligonucleotide; CTA chr11 5359749 5359770 5359766 5359771 +
caaggctacagtaaccaaaaca

SEQ ID NO: 106528 - DNA, 22 bp, Artificial Sequence
  Synthetic oligonucleotide; CTA chr11 5359757 5359778 5359774 5359779 +
cagtaaccaaaacagcatggta

SEQ ID NO: 106529 - DNA, 22 bp, Artificial Sequence
  Synthetic oligonucleotide; CTG chr11 5359782 5359803 5359799 5359804 +
gtaccaaaacagagatatagac

SEQ ID NO: 106530 - DNA, 22 bp, Artificial Sequence
  Synthetic oligonucleotide; CTC chr11 5359827 5359848 5359844 5359849 +
agaaataatgccgcatgtctac

SEQ ID NO: 106531 - DNA, 22 bp, Artificial Sequence
  Synthetic oligonucleotide; CTA chr11 5359848 5359869 5359865 5359870 +
caaccatctgatctttgacaaa

SEQ ID NO: 106532 - DNA, 22 bp, Artificial Sequence
  Synthetic oligonucleotide; CTG chr11 5359858 5359879 5359875 5359880 +
atctttgacaaacctgacaaaa

SEQ ID NO: 106533 - DNA, 22 bp, Artificial Sequence
  Synthetic oligonucleotide; CTT chr11 5359863 5359884 5359880 5359885 +
tgacaaacctgacaaaaaaaac

SEQ ID NO: 106534 - DNA, 22 bp, Artificial Sequence
  Synthetic oligonucleotide; TTT chr11 5359864 5359885 5359881 5359886 +
gacaaacctgacaaaaaaaaca

SEQ ID NO: 106535 - DNA, 22 bp, Artificial Sequence
  Synthetic oligonucleotide; TTG chr11 5359865 5359886 5359882 5359887 +
acaaacctgacaaaaaaaacaa

SEQ ID NO: 106536 - DNA, 22 bp, Artificial Sequence
  Synthetic oligonucleotide; CTG chr11 5359874 5359895 5359891 5359896 +
acaaaaaaaacaaatggggaaa

SEQ ID NO: 106537 - DNA, 22 bp, Artificial Sequence
  Synthetic oligonucleotide; TTC chr11 5359902 5359923 5359919 5359924 +
cctatttaataaatggtgctgg

SEQ ID NO: 106538 - DNA, 22 bp, Artificial Sequence
  Synthetic oligonucleotide; CTA chr11 5359906 5359927 5359923 5359928 +
tttaataaatggtgctgggaaa

SEQ ID NO: 106539 - DNA, 22 bp, Artificial Sequence
  Synthetic oligonucleotide; TTT chr11 5359909 5359930 5359926 5359931 +
aataaatggtgctgggaaaact

SEQ ID NO: 106540 - DNA, 22 bp, Artificial Sequence
  Synthetic oligonucleotide; TTA chr11 5359910 5359931 5359927 5359932 +
ataaatggtgctgggaaaactg

SEQ ID NO: 106541 - DNA, 22 bp, Artificial Sequence
  Synthetic oligonucleotide; CTG chr11 5359923 5359944 5359940 5359945 +
ggaaaactggctaaccatacgc

SEQ ID NO: 106542 - DNA, 22 bp, Artificial Sequence
  Synthetic oligonucleotide; CTG chr11 5359932 5359953 5359949 5359954 +
gctaaccatacgcagaaagctg

SEQ ID NO: 106543 - DNA, 22 bp, Artificial Sequence
  Synthetic oligonucleotide; CTA chr11 5359936 5359957 5359953 5359958 +
accatacgcagaaagctgaaac

SEQ ID NO: 106544 - DNA, 22 bp, Artificial Sequence
  Synthetic oligonucleotide; CTG chr11 5359954 5359975 5359971 5359976 +
aaactggatccctttcttacac

SEQ ID NO: 106545 - DNA, 22 bp, Artificial Sequence
  Synthetic oligonucleotide; CTG chr11 5359960 5359981 5359977 5359982 +
gatccctttcttacaccttata

SEQ ID NO: 106546 - DNA, 22 bp, Artificial Sequence
  Synthetic oligonucleotide; CTT chr11 5359968 5359989 5359985 5359990 +
tcttacaccttatacaaaaatt

SEQ ID NO: 106547 - DNA, 22 bp, Artificial Sequence
  Synthetic oligonucleotide; TTT chr11 5359969 5359990 5359986 5359991 +
cttacaccttatacaaaaatta

SEQ ID NO: 106548 - DNA, 22 bp, Artificial Sequence
  Synthetic oligonucleotide; TTC chr11 5359970 5359991 5359987 5359992 +
ttacaccttatacaaaaattaa

SEQ ID NO: 106549 - DNA, 22 bp, Artificial Sequence
  Synthetic oligonucleotide; CTT chr11 5359972 5359993 5359989 5359994 +
acaccttatacaaaaattaatt

SEQ ID NO: 106550 - DNA, 22 bp, Artificial Sequence
  Synthetic oligonucleotide; TTA chr11 5359973 5359994 5359990 5359995 +
caccttatacaaaaattaattc

SEQ ID NO: 106551 - DNA, 22 bp, Artificial Sequence
  Synthetic oligonucleotide; CTT chr11 5359979 5360000 5359996 5360001 +
atacaaaaattaattcaagatg

SEQ ID NO: 106552 - DNA, 22 bp, Artificial Sequence
  Synthetic oligonucleotide; TTA chr11 5359980 5360001 5359997 5360002 +
tacaaaaattaattcaagatgg

SEQ ID NO: 106553 - DNA, 22 bp, Artificial Sequence
  Synthetic oligonucleotide; TTA chr11 5359991 5360012 5360008 5360013 +
attcaagatggattacagactt

SEQ ID NO: 106554 - DNA, 22 bp, Artificial Sequence
  Synthetic oligonucleotide; TTC chr11 5359995 5360016 5360012 5360017 +
aagatggattacagacttaaat

SEQ ID NO: 106555 - DNA, 22 bp, Artificial Sequence
  Synthetic oligonucleotide; TTA chr11 5360006 5360027 5360023 5360028 +
cagacttaaatgttagactgaa

SEQ ID NO: 106556 - DNA, 22 bp, Artificial Sequence
  Synthetic oligonucleotide; CTT chr11 5360013 5360034 5360030 5360035 +
aaatgttagactgaaaaccata

SEQ ID NO: 106557 - DNA, 22 bp, Artificial Sequence
  Synthetic oligonucleotide; TTA chr11 5360014 5360035 5360031 5360036 +
aatgttagactgaaaaccataa

SEQ ID NO: 106558 - DNA, 22 bp, Artificial Sequence
  Synthetic oligonucleotide; TTA chr11 5360021 5360042 5360038 5360043 +
gactgaaaaccataaaaactct

SEQ ID NO: 106559 - DNA, 22 bp, Artificial Sequence
  Synthetic oligonucleotide; CTG chr11 5360026 5360047 5360043 5360048 +
aaaaccataaaaactctggaag

SEQ ID NO: 106560 - DNA, 22 bp, Artificial Sequence
  Synthetic oligonucleotide; CTC chr11 5360042 5360063 5360059 5360064 +
tggaagaaaacctaggcaatac

SEQ ID NO: 106561 - DNA, 22 bp, Artificial Sequence
  Synthetic oligonucleotide; CTG chr11 5360044 5360065 5360061 5360066 +
gaagaaaacctaggcaatacca

SEQ ID NO: 106562 - DNA, 22 bp, Artificial Sequence
  Synthetic oligonucleotide; CTA chr11 5360056 5360077 5360073 5360078 +
ggcaataccattcaggacatag

SEQ ID NO: 106563 - DNA, 22 bp, Artificial Sequence
  Synthetic oligonucleotide; TTC chr11 5360069 5360090 5360086 5360091 +
aggacataggcatgggcaagga

SEQ ID NO: 106564 - DNA, 22 bp, Artificial Sequence
  Synthetic oligonucleotide; CTT chr11 5360094 5360115 5360111 5360116 +
catgtctaaaacaccaaaagca

SEQ ID NO: 106565 - DNA, 22 bp, Artificial Sequence
  Synthetic oligonucleotide; TTC chr11 5360095 5360116 5360112 5360117 +
atgtctaaaacaccaaaagcaa

SEQ ID NO: 106566 - DNA, 22 bp, Artificial Sequence
  Synthetic oligonucleotide; CTA chr11 5360102 5360123 5360119 5360124 +
aaacaccaaaagcaatggcaac

SEQ ID NO: 106567 - DNA, 22 bp, Artificial Sequence
  Synthetic oligonucleotide; CTA chr11 5360152 5360173 5360169 5360174 +
attaaactaaagagcttctgca

SEQ ID NO: 106568 - DNA, 22 bp, Artificial Sequence
  Synthetic oligonucleotide; TTA chr11 5360156 5360177 5360173 5360178 +
aactaaagagcttctgcacagc

SEQ ID NO: 106569 - DNA, 22 bp, Artificial Sequence
  Synthetic oligonucleotide; CTA chr11 5360161 5360182 5360178 5360183 +
aagagcttctgcacagcaaaag

SEQ ID NO: 106570 - DNA, 22 bp, Artificial Sequence
  Synthetic oligonucleotide; CTT chr11 5360169 5360190 5360186 5360191 +
ctgcacagcaaaagaaactacc

SEQ ID NO: 106571 - DNA, 22 bp, Artificial Sequence
  Synthetic oligonucleotide; TTC chr11 5360170 5360191 5360187 5360192 +
tgcacagcaaaagaaactacca

SEQ ID NO: 106572 - DNA, 22 bp, Artificial Sequence
  Synthetic oligonucleotide; CTG chr11 5360172 5360193 5360189 5360194 +
cacagcaaaagaaactaccatc

SEQ ID NO: 106573 - DNA, 22 bp, Artificial Sequence
  Synthetic oligonucleotide; CTA chr11 5360189 5360210 5360206 5360211 +
ccatcagagtgaacaggcaaca

SEQ ID NO: 106574 - DNA, 22 bp, Artificial Sequence
  Synthetic oligonucleotide; TTT chr11 5360231 5360252 5360248 5360253 +
ttgcaatctactcatccgacaa

SEQ ID NO: 106575 - DNA, 22 bp, Artificial Sequence
  Synthetic oligonucleotide; TTT chr11 5360232 5360253 5360249 5360254 +
tgcaatctactcatccgacaaa

SEQ ID NO: 106576 - DNA, 22 bp, Artificial Sequence
  Synthetic oligonucleotide; TTT chr11 5360233 5360254 5360250 5360255 +
gcaatctactcatccgacaaag

SEQ ID NO: 106577 - DNA, 22 bp, Artificial Sequence
  Synthetic oligonucleotide; TTG chr11 5360234 5360255 5360251 5360256 +
caatctactcatccgacaaagg

SEQ ID NO: 106578 - DNA, 22 bp, Artificial Sequence
  Synthetic oligonucleotide; CTA chr11 5360241 5360262 5360258 5360263 +
ctcatccgacaaagggctaata

SEQ ID NO: 106579 - DNA, 22 bp, Artificial Sequence
  Synthetic oligonucleotide; CTC chr11 5360244 5360265 5360261 5360266 +
atccgacaaagggctaatatcc

SEQ ID NO: 106580 - DNA, 22 bp, Artificial Sequence
  Synthetic oligonucleotide; CTA chr11 5360260 5360281 5360277 5360282 +
atatccagaatctatgatgaac

SEQ ID NO: 106581 - DNA, 22 bp, Artificial Sequence
  Synthetic oligonucleotide; CTA chr11 5360274 5360295 5360291 5360296 +
tgatgaactcaaacaaatttac

SEQ ID NO: 106582 - DNA, 22 bp, Artificial Sequence
  Synthetic oligonucleotide; CTC chr11 5360284 5360305 5360301 5360306 +
aaacaaatttacaagaaaaaaa

SEQ ID NO: 106583 - DNA, 22 bp, Artificial Sequence
  Synthetic oligonucleotide; TTT chr11 5360294 5360315 5360311 5360316 +
acaagaaaaaaacaaccccatc

SEQ ID NO: 106584 - DNA, 22 bp, Artificial Sequence
  Synthetic oligonucleotide; TTA chr11 5360295 5360316 5360312 5360317 +
caagaaaaaaacaaccccatca

SEQ ID NO: 106585 - DNA, 22 bp, Artificial Sequence
  Synthetic oligonucleotide; CTT chr11 5360348 5360369 5360365 5360370 +
ctcaaaagaagacatttatgca

SEQ ID NO: 106586 - DNA, 22 bp, Artificial Sequence
  Synthetic oligonucleotide; TTC chr11 5360349 5360370 5360366 5360371 +
tcaaaagaagacatttatgcag

SEQ ID NO: 106587 - DNA, 22 bp, Artificial Sequence
  Synthetic oligonucleotide; CTC chr11 5360351 5360372 5360368 5360373 +
aaaagaagacatttatgcagtc

SEQ ID NO: 106588 - DNA, 22 bp, Artificial Sequence
  Synthetic oligonucleotide; TTT chr11 5360365 5360386 5360382 5360387 +
atgcagtcaacagacacatgaa

SEQ ID NO: 106589 - DNA, 22 bp, Artificial Sequence
  Synthetic oligonucleotide; TTA chr11 5360366 5360387 5360383 5360388 +
tgcagtcaacagacacatgaaa

SEQ ID NO: 106590 - DNA, 22 bp, Artificial Sequence
  Synthetic oligonucleotide; CTC chr11 5360396 5360417 5360413 5360418 +
atcatcactggccatcagagaa

SEQ ID NO: 106591 - DNA, 22 bp, Artificial Sequence
  Synthetic oligonucleotide; CTG chr11 5360406 5360427 5360423 5360428 +
gccatcagagaaatacaaatca

SEQ ID NO: 106592 - DNA, 22 bp, Artificial Sequence
  Synthetic oligonucleotide; CTC chr11 5360451 5360472 5360468 5360473 +
acaccagttagaatggcgatca

SEQ ID NO: 106593 - DNA, 22 bp, Artificial Sequence
  Synthetic oligonucleotide; TTA chr11 5360461 5360482 5360478 5360483 +
gaatggcgatcattaaaaagtc

SEQ ID NO: 106594 - DNA, 22 bp, Artificial Sequence
  Synthetic oligonucleotide; TTA chr11 5360476 5360497 5360493 5360498 +
aaaagtcaggaaacaacaggtg

SEQ ID NO: 106595 - DNA, 22 bp, Artificial Sequence
  Synthetic oligonucleotide; CTG chr11 5360501 5360522 5360518 5360523 +
gagaggatgtgaagaagtagga

SEQ ID NO: 106596 - DNA, 22 bp, Artificial Sequence
  Synthetic oligonucleotide; CTT chr11 5360529 5360550 5360546 5360551 +
ttacactgttggtgagactgta

SEQ ID NO: 106597 - DNA, 22 bp, Artificial Sequence
  Synthetic oligonucleotide; TTT chr11 5360530 5360551 5360547 5360552 +
tacactgttggtgagactgtaa

SEQ ID NO: 106598 - DNA, 22 bp, Artificial Sequence
  Synthetic oligonucleotide; TTT chr11 5360531 5360552 5360548 5360553 +
acactgttggtgagactgtaaa

SEQ ID NO: 106599 - DNA, 22 bp, Artificial Sequence
  Synthetic oligonucleotide; TTA chr11 5360532 5360553 5360549 5360554 +
cactgttggtgagactgtaaac

SEQ ID NO: 106600 - DNA, 22 bp, Artificial Sequence
  Synthetic oligonucleotide; CTG chr11 5360537 5360558 5360554 5360559 +
ttggtgagactgtaaactagtt

SEQ ID NO: 106601 - DNA, 22 bp, Artificial Sequence
  Synthetic oligonucleotide; TTG chr11 5360540 5360561 5360557 5360562 +
gtgagactgtaaactagttcaa

SEQ ID NO: 106602 - DNA, 22 bp, Artificial Sequence
  Synthetic oligonucleotide; CTG chr11 5360549 5360570 5360566 5360571 +
taaactagttcaaccattgtgg

SEQ ID NO: 106603 - DNA, 22 bp, Artificial Sequence
  Synthetic oligonucleotide; CTA chr11 5360556 5360577 5360573 5360578 +
gttcaaccattgtggaagtcag

SEQ ID NO: 106604 - DNA, 22 bp, Artificial Sequence
  Synthetic oligonucleotide; TTC chr11 5360560 5360581 5360577 5360582 +
aaccattgtggaagtcagtgtg

SEQ ID NO: 106605 - DNA, 22 bp, Artificial Sequence
  Synthetic oligonucleotide; TTG chr11 5360568 5360589 5360585 5360590 +
tggaagtcagtgtggcgattcc

SEQ ID NO: 106606 - DNA, 22 bp, Artificial Sequence
  Synthetic oligonucleotide; TTC chr11 5360589 5360610 5360606 5360611 +
ctcagggatctagaactagaaa

SEQ ID NO: 106607 - DNA, 22 bp, Artificial Sequence
  Synthetic oligonucleotide; CTC chr11 5360592 5360613 5360609 5360614 +
agggatctagaactagaaatac

SEQ ID NO: 106608 - DNA, 22 bp, Artificial Sequence
  Synthetic oligonucleotide; CTA chr11 5360601 5360622 5360618 5360623 +
gaactagaaataccatttgacc

SEQ ID NO: 106609 - DNA, 22 bp, Artificial Sequence
  Synthetic oligonucleotide; CTA chr11 5360607 5360628 5360624 5360629 +
gaaataccatttgacccagcca

SEQ ID NO: 106610 - DNA, 22 bp, Artificial Sequence
  Synthetic oligonucleotide; TTT chr11 5360619 5360640 5360636 5360641 +
gacccagccatcccattactgg

SEQ ID NO: 106611 - DNA, 22 bp, Artificial Sequence
  Synthetic oligonucleotide; TTG chr11 5360620 5360641 5360637 5360642 +
acccagccatcccattactggg

SEQ ID NO: 106612 - DNA, 22 bp, Artificial Sequence
  Synthetic oligonucleotide; TTA chr11 5360637 5360658 5360654 5360659 +
ctgggtacatactcaaaggatt

SEQ ID NO: 106613 - DNA, 22 bp, Artificial Sequence
  Synthetic oligonucleotide; CTG chr11 5360640 5360661 5360657 5360662 +
ggtacatactcaaaggattata

SEQ ID NO: 106614 - DNA, 22 bp, Artificial Sequence
  Synthetic oligonucleotide; CTC chr11 5360651 5360672 5360668 5360673 +
aaaggattataaatcatgctgc

SEQ ID NO: 106615 - DNA, 22 bp, Artificial Sequence
  Synthetic oligonucleotide; TTA chr11 5360660 5360681 5360677 5360682 +
taaatcatgctgctataaagac

SEQ ID NO: 106616 - DNA, 22 bp, Artificial Sequence
  Synthetic oligonucleotide; CTG chr11 5360672 5360693 5360689 5360694 +
ctataaagacacatgcacatgt

SEQ ID NO: 106617 - DNA, 22 bp, Artificial Sequence
  Synthetic oligonucleotide; CTA chr11 5360675 5360696 5360692 5360697 +
taaagacacatgcacatgtatg

SEQ ID NO: 106618 - DNA, 22 bp, Artificial Sequence
  Synthetic oligonucleotide; TTT chr11 5360700 5360721 5360717 5360722 +
attgtggcactattcacaatag

SEQ ID NO: 106619 - DNA, 22 bp, Artificial Sequence
  Synthetic oligonucleotide; TTA chr11 5360701 5360722 5360718 5360723 +
ttgtggcactattcacaatagc

SEQ ID NO: 106620 - DNA, 22 bp, Artificial Sequence
  Synthetic oligonucleotide; TTG chr11 5360704 5360725 5360721 5360726 +
tggcactattcacaatagcaaa

SEQ ID NO: 106621 - DNA, 22 bp, Artificial Sequence
  Synthetic oligonucleotide; CTA chr11 5360712 5360733 5360729 5360734 +
ttcacaatagcaaagacttgga

SEQ ID NO: 106622 - DNA, 22 bp, Artificial Sequence
  Synthetic oligonucleotide; TTC chr11 5360715 5360736 5360732 5360737 +
acaatagcaaagacttggaacc

SEQ ID NO: 106623 - DNA, 22 bp, Artificial Sequence
  Synthetic oligonucleotide; CTT chr11 5360731 5360752 5360748 5360753 +
ggaaccaacccaaatgtccaac

SEQ ID NO: 106624 - DNA, 22 bp, Artificial Sequence
  Synthetic oligonucleotide; TTG chr11 5360732 5360753 5360749 5360754 +
gaaccaacccaaatgtccaaca

SEQ ID NO: 106625 - DNA, 22 bp, Artificial Sequence
  Synthetic oligonucleotide; CTG chr11 5360765 5360786 5360782 5360787 +
gattaagaaaacgtggcacata

SEQ ID NO: 106626 - DNA, 22 bp, Artificial Sequence
  Synthetic oligonucleotide; TTA chr11 5360770 5360791 5360787 5360792 +
agaaaacgtggcacatatacac

SEQ ID NO: 106627 - DNA, 22 bp, Artificial Sequence
  Synthetic oligonucleotide; CTA chr11 5360804 5360825 5360821 5360826 +
tgcagccataaaaaatgaagag

SEQ ID NO: 106628 - DNA, 22 bp, Artificial Sequence
  Synthetic oligonucleotide; TTC chr11 5360829 5360850 5360846 5360851 +
atgtcctttgtagggacatgga

SEQ ID NO: 106629 - DNA, 22 bp, Artificial Sequence
  Synthetic oligonucleotide; CTT chr11 5360837 5360858 5360854 5360859 +
tgtagggacatggatgaagctg

SEQ ID NO: 106630 - DNA, 22 bp, Artificial Sequence
  Synthetic oligonucleotide; TTT chr11 5360838 5360859 5360855 5360860 +
gtagggacatggatgaagctgg

SEQ ID NO: 106631 - DNA, 22 bp, Artificial Sequence
  Synthetic oligonucleotide; TTG chr11 5360839 5360860 5360856 5360861 +
tagggacatggatgaagctgga

SEQ ID NO: 106632 - DNA, 22 bp, Artificial Sequence
  Synthetic oligonucleotide; CTG chr11 5360859 5360880 5360876 5360881 +
gaaaccatcattctcagcaaac

SEQ ID NO: 106633 - DNA, 22 bp, Artificial Sequence
  Synthetic oligonucleotide; TTC chr11 5360872 5360893 5360889 5360894 +
tcagcaaactatcgcaaggaca

SEQ ID NO: 106634 - DNA, 22 bp, Artificial Sequence
  Synthetic oligonucleotide; CTC chr11 5360874 5360895 5360891 5360896 +
agcaaactatcgcaaggacaaa

SEQ ID NO: 106635 - DNA, 22 bp, Artificial Sequence
  Synthetic oligonucleotide; CTA chr11 5360883 5360904 5360900 5360905 +
tcgcaaggacaaaaaccaaaca

SEQ ID NO: 106636 - DNA, 22 bp, Artificial Sequence
  Synthetic oligonucleotide; CTG chr11 5360908 5360929 5360925 5360930 +
catgttctcactcataggtggg

SEQ ID NO: 106637 - DNA, 22 bp, Artificial Sequence
  Synthetic oligonucleotide; TTC chr11 5360915 5360936 5360932 5360937 +
tcactcataggtgggaattgaa

SEQ ID NO: 106638 - DNA, 22 bp, Artificial Sequence
  Synthetic oligonucleotide; CTC chr11 5360917 5360938 5360934 5360939 +
actcataggtgggaattgaaca

SEQ ID NO: 106639 - DNA, 22 bp, Artificial Sequence
  Synthetic oligonucleotide; CTC chr11 5360921 5360942 5360938 5360943 +
ataggtgggaattgaacaatga

SEQ ID NO: 106640 - DNA, 22 bp, Artificial Sequence
  Synthetic oligonucleotide; TTG chr11 5360935 5360956 5360952 5360957 +
aacaatgagaacacatggacac

SEQ ID NO: 106641 - DNA, 22 bp, Artificial Sequence
  Synthetic oligonucleotide; CTG chr11 5360987 5361008 5361004 5361009 +
cagtggggtgggggtcgggggg

SEQ ID NO: 106642 - DNA, 22 bp, Artificial Sequence
  Synthetic oligonucleotide; TTA chr11 5361022 5361043 5361039 5361044 +
ggagatatacctaatgctaagt

SEQ ID NO: 106643 - DNA, 22 bp, Artificial Sequence
  Synthetic oligonucleotide; CTA chr11 5361035 5361056 5361052 5361057 +
atgctaagtgacgagttaatgg

SEQ ID NO: 106644 - DNA, 22 bp, Artificial Sequence
  Synthetic oligonucleotide; CTA chr11 5361041 5361062 5361058 5361063 +
agtgacgagttaatgggtgcag

SEQ ID NO: 106645 - DNA, 22 bp, Artificial Sequence
  Synthetic oligonucleotide; TTA chr11 5361053 5361074 5361070 5361075 +
atgggtgcagcacaccaacatg

SEQ ID NO: 106646 - DNA, 22 bp, Artificial Sequence
  Synthetic oligonucleotide; CTG chr11 5361103 5361124 5361120 5361125 +
cacgttgtgcaaatgtacccta

SEQ ID NO: 106647 - DNA, 22 bp, Artificial Sequence
  Synthetic oligonucleotide; TTG chr11 5361110 5361131 5361127 5361132 +
tgcaaatgtaccctaaaactta

SEQ ID NO: 106648 - DNA, 22 bp, Artificial Sequence
  Synthetic oligonucleotide; CTA chr11 5361125 5361146 5361142 5361147 +
aaacttaaagtataataataaa

SEQ ID NO: 106649 - DNA, 22 bp, Artificial Sequence
  Synthetic oligonucleotide; CTT chr11 5361131 5361152 5361148 5361153 +
aaagtataataataaaagaaag

SEQ ID NO: 106650 - DNA, 22 bp, Artificial Sequence
  Synthetic oligonucleotide; TTA chr11 5361132 5361153 5361149 5361154 +
aagtataataataaaagaaaga

SEQ ID NO: 106651 - DNA, 22 bp, Artificial Sequence
  Synthetic oligonucleotide; CTG chr11 5361168 5361189 5361185 5361190 +
ctgcaaaaaggccatcctccct

SEQ ID NO: 106652 - DNA, 22 bp, Artificial Sequence
  Synthetic oligonucleotide; CTG chr11 5361171 5361192 5361188 5361193 +
caaaaaggccatcctccctaca

SEQ ID NO: 106653 - DNA, 22 bp, Artificial Sequence
  Synthetic oligonucleotide; CTC chr11 5361187 5361208 5361204 5361209 +
cctacattttcttttctacccc

SEQ ID NO: 106654 - DNA, 22 bp, Artificial Sequence
  Synthetic oligonucleotide; CTA chr11 5361191 5361212 5361208 5361213 +
cattttcttttctacccctatg

SEQ ID NO: 106655 - DNA, 22 bp, Artificial Sequence
  Synthetic oligonucleotide; TTT chr11 5361196 5361217 5361213 5361218 +
tcttttctacccctatgtgatg

SEQ ID NO: 106656 - DNA, 22 bp, Artificial Sequence
  Synthetic oligonucleotide; TTT chr11 5361197 5361218 5361214 5361219 +
cttttctacccctatgtgatgc

SEQ ID NO: 106657 - DNA, 22 bp, Artificial Sequence
  Synthetic oligonucleotide; TTC chr11 5361198 5361219 5361215 5361220 +
ttttctacccctatgtgatgct

SEQ ID NO: 106658 - DNA, 22 bp, Artificial Sequence
  Synthetic oligonucleotide; CTT chr11 5361200 5361221 5361217 5361222 +
ttctacccctatgtgatgctta

SEQ ID NO: 106659 - DNA, 22 bp, Artificial Sequence
  Synthetic oligonucleotide; TTT chr11 5361201 5361222 5361218 5361223 +
tctacccctatgtgatgcttaa

SEQ ID NO: 106660 - DNA, 22 bp, Artificial Sequence
  Synthetic oligonucleotide; TTT chr11 5361202 5361223 5361219 5361224 +
ctacccctatgtgatgcttaaa

SEQ ID NO: 106661 - DNA, 22 bp, Artificial Sequence
  Synthetic oligonucleotide; TTC chr11 5361203 5361224 5361220 5361225 +
tacccctatgtgatgcttaaaa

SEQ ID NO: 106662 - DNA, 22 bp, Artificial Sequence
  Synthetic oligonucleotide; CTA chr11 5361205 5361226 5361222 5361227 +
cccctatgtgatgcttaaaata

SEQ ID NO: 106663 - DNA, 22 bp, Artificial Sequence
  Synthetic oligonucleotide; CTA chr11 5361211 5361232 5361228 5361233 +
tgtgatgcttaaaataaatctt

SEQ ID NO: 106664 - DNA, 22 bp, Artificial Sequence
  Synthetic oligonucleotide; CTT chr11 5361221 5361242 5361238 5361243 +
aaaataaatcttatttctggag

SEQ ID NO: 106665 - DNA, 22 bp, Artificial Sequence
  Synthetic oligonucleotide; TTA chr11 5361222 5361243 5361239 5361244 +
aaataaatcttatttctggaga

SEQ ID NO: 106666 - DNA, 22 bp, Artificial Sequence
  Synthetic oligonucleotide; CTT chr11 5361233 5361254 5361250 5361255 +
atttctggagatgtggctaatt

SEQ ID NO: 106667 - DNA, 22 bp, Artificial Sequence
  Synthetic oligonucleotide; TTA chr11 5361234 5361255 5361251 5361256 +
tttctggagatgtggctaattc

SEQ ID NO: 106668 - DNA, 22 bp, Artificial Sequence
  Synthetic oligonucleotide; TTT chr11 5361237 5361258 5361254 5361259 +
ctggagatgtggctaattccct

SEQ ID NO: 106669 - DNA, 22 bp, Artificial Sequence
  Synthetic oligonucleotide; TTC chr11 5361238 5361259 5361255 5361260 +
tggagatgtggctaattcccta

SEQ ID NO: 106670 - DNA, 22 bp, Artificial Sequence
  Synthetic oligonucleotide; CTG chr11 5361240 5361261 5361257 5361262 +
gagatgtggctaattccctaac

SEQ ID NO: 106671 - DNA, 22 bp, Artificial Sequence
  Synthetic oligonucleotide; CTA chr11 5361252 5361273 5361269 5361274 +
attccctaacctagatgcagga

SEQ ID NO: 106672 - DNA, 22 bp, Artificial Sequence
  Synthetic oligonucleotide; TTC chr11 5361256 5361277 5361273 5361278 +
cctaacctagatgcaggaagaa

SEQ ID NO: 106673 - DNA, 22 bp, Artificial Sequence
  Synthetic oligonucleotide; CTA chr11 5361260 5361281 5361277 5361282 +
acctagatgcaggaagaaacct

SEQ ID NO: 106674 - DNA, 22 bp, Artificial Sequence
  Synthetic oligonucleotide; CTA chr11 5361265 5361286 5361282 5361287 +
gatgcaggaagaaaccttagcg

SEQ ID NO: 106675 - DNA, 22 bp, Artificial Sequence
  Synthetic oligonucleotide; CTT chr11 5361283 5361304 5361300 5361305 +
agcgactcctgttccaaagttc

SEQ ID NO: 106676 - DNA, 22 bp, Artificial Sequence
  Synthetic oligonucleotide; TTA chr11 5361284 5361305 5361301 5361306 +
gcgactcctgttccaaagttct

SEQ ID NO: 106677 - DNA, 22 bp, Artificial Sequence
  Synthetic oligonucleotide; CTC chr11 5361291 5361312 5361308 5361313 +
ctgttccaaagttctaaatccc

SEQ ID NO: 106678 - DNA, 22 bp, Artificial Sequence
  Synthetic oligonucleotide; CTG chr11 5361294 5361315 5361311 5361316 +
ttccaaagttctaaatccctca

SEQ ID NO: 106679 - DNA, 22 bp, Artificial Sequence
  Synthetic oligonucleotide; TTC chr11 5361297 5361318 5361314 5361319 +
caaagttctaaatccctcaggc

SEQ ID NO: 106680 - DNA, 22 bp, Artificial Sequence
  Synthetic oligonucleotide; TTC chr11 5361305 5361326 5361322 5361327 +
taaatccctcaggctgggagaa

SEQ ID NO: 106681 - DNA, 22 bp, Artificial Sequence
  Synthetic oligonucleotide; CTA chr11 5361307 5361328 5361324 5361329 +
aatccctcaggctgggagaata

SEQ ID NO: 106682 - DNA, 22 bp, Artificial Sequence
  Synthetic oligonucleotide; CTC chr11 5361315 5361336 5361332 5361337 +
aggctgggagaataaagaagga

SEQ ID NO: 106683 - DNA, 22 bp, Artificial Sequence
  Synthetic oligonucleotide; CTG chr11 5361321 5361342 5361338 5361343 +
ggagaataaagaaggagggagg

SEQ ID NO: 106684 - DNA, 22 bp, Artificial Sequence
  Synthetic oligonucleotide; TTT chr11 5361372 5361393 5361389 5361394 +
ctgaaactaattttctttgcag

SEQ ID NO: 106685 - DNA, 22 bp, Artificial Sequence
  Synthetic oligonucleotide; TTC chr11 5361373 5361394 5361390 5361395 +
tgaaactaattttctttgcagc

SEQ ID NO: 106686 - DNA, 22 bp, Artificial Sequence
  Synthetic oligonucleotide; CTG chr11 5361375 5361396 5361392 5361397 +
aaactaattttctttgcagctt

SEQ ID NO: 106687 - DNA, 22 bp, Artificial Sequence
  Synthetic oligonucleotide; CTA chr11 5361381 5361402 5361398 5361403 +
attttctttgcagcttggcttc

SEQ ID NO: 106688 - DNA, 22 bp, Artificial Sequence
  Synthetic oligonucleotide; TTT chr11 5361385 5361406 5361402 5361407 +
tctttgcagcttggcttctgag

SEQ ID NO: 106689 - DNA, 22 bp, Artificial Sequence
  Synthetic oligonucleotide; TTT chr11 5361386 5361407 5361403 5361408 +
ctttgcagcttggcttctgagt

SEQ ID NO: 106690 - DNA, 22 bp, Artificial Sequence
  Synthetic oligonucleotide; TTC chr11 5361387 5361408 5361404 5361409 +
tttgcagcttggcttctgagta

SEQ ID NO: 106691 - DNA, 22 bp, Artificial Sequence
  Synthetic oligonucleotide; CTT chr11 5361389 5361410 5361406 5361411 +
tgcagcttggcttctgagtata

SEQ ID NO: 106692 - DNA, 22 bp, Artificial Sequence
  Synthetic oligonucleotide; TTT chr11 5361390 5361411 5361407 5361412 +
gcagcttggcttctgagtatag

SEQ ID NO: 106693 - DNA, 22 bp, Artificial Sequence
  Synthetic oligonucleotide; TTG chr11 5361391 5361412 5361408 5361413 +
cagcttggcttctgagtatagt

SEQ ID NO: 106694 - DNA, 22 bp, Artificial Sequence
  Synthetic oligonucleotide; CTT chr11 5361397 5361418 5361414 5361419 +
ggcttctgagtatagtctaaaa

SEQ ID NO: 106695 - DNA, 22 bp, Artificial Sequence
  Synthetic oligonucleotide; TTG chr11 5361398 5361419 5361415 5361420 +
gcttctgagtatagtctaaaaa

SEQ ID NO: 106696 - DNA, 22 bp, Artificial Sequence
  Synthetic oligonucleotide; CTT chr11 5361402 5361423 5361419 5361424 +
ctgagtatagtctaaaaagttg

SEQ ID NO: 106697 - DNA, 22 bp, Artificial Sequence
  Synthetic oligonucleotide; TTC chr11 5361403 5361424 5361420 5361425 +
tgagtatagtctaaaaagttgg

SEQ ID NO: 106698 - DNA, 22 bp, Artificial Sequence
  Synthetic oligonucleotide; CTG chr11 5361405 5361426 5361422 5361427 +
agtatagtctaaaaagttggtg

SEQ ID NO: 106699 - DNA, 22 bp, Artificial Sequence
  Synthetic oligonucleotide; CTA chr11 5361416 5361437 5361433 5361438 +
aaaagttggtgttggatccaat

SEQ ID NO: 106700 - DNA, 22 bp, Artificial Sequence
  Synthetic oligonucleotide; TTG chr11 5361424 5361445 5361441 5361446 +
gtgttggatccaatatcttgac

SEQ ID NO: 106701 - DNA, 22 bp, Artificial Sequence
  Synthetic oligonucleotide; TTG chr11 5361430 5361451 5361447 5361452 +
gatccaatatcttgaccaggct

SEQ ID NO: 106702 - DNA, 22 bp, Artificial Sequence
  Synthetic oligonucleotide; CTT chr11 5361443 5361464 5361460 5361465 +
gaccaggcttaggggttcatag

SEQ ID NO: 106703 - DNA, 22 bp, Artificial Sequence
  Synthetic oligonucleotide; TTG chr11 5361444 5361465 5361461 5361466 +
accaggcttaggggttcatagt

SEQ ID NO: 106704 - DNA, 22 bp, Artificial Sequence
  Synthetic oligonucleotide; CTT chr11 5361453 5361474 5361470 5361475 +
aggggttcatagtcacatctgt

SEQ ID NO: 106705 - DNA, 22 bp, Artificial Sequence
  Synthetic oligonucleotide; TTA chr11 5361454 5361475 5361471 5361476 +
ggggttcatagtcacatctgtg

SEQ ID NO: 106706 - DNA, 22 bp, Artificial Sequence
  Synthetic oligonucleotide; TTC chr11 5361461 5361482 5361478 5361483 +
atagtcacatctgtggcaacaa

SEQ ID NO: 106707 - DNA, 22 bp, Artificial Sequence
  Synthetic oligonucleotide; CTG chr11 5361474 5361495 5361491 5361496 +
tggcaacaatgaacagacttat

SEQ ID NO: 106708 - DNA, 22 bp, Artificial Sequence
  Synthetic oligonucleotide; CTT chr11 5361494 5361515 5361511 5361516 +
atgaacaggtcggtaaagaact

SEQ ID NO: 106709 - DNA, 22 bp, Artificial Sequence
  Synthetic oligonucleotide; TTA chr11 5361495 5361516 5361512 5361517 +
tgaacaggtcggtaaagaactc

SEQ ID NO: 106710 - DNA, 22 bp, Artificial Sequence
  Synthetic oligonucleotide; CTC chr11 5361517 5361538 5361534 5361539 +
cagtgtgtcttggcctagaggc

SEQ ID NO: 106711 - DNA, 22 bp, Artificial Sequence
  Synthetic oligonucleotide; CTT chr11 5361528 5361549 5361545 5361550 +
ggcctagaggctccgcatagga

SEQ ID NO: 106712 - DNA, 22 bp, Artificial Sequence
  Synthetic oligonucleotide; TTG chr11 5361529 5361550 5361546 5361551 +
gcctagaggctccgcataggaa

SEQ ID NO: 106713 - DNA, 22 bp, Artificial Sequence
  Synthetic oligonucleotide; CTA chr11 5361534 5361555 5361551 5361556 +
gaggctccgcataggaatgagc

SEQ ID NO: 106714 - DNA, 22 bp, Artificial Sequence
  Synthetic oligonucleotide; CTC chr11 5361541 5361562 5361558 5361563 +
cgcataggaatgagcagtagac

SEQ ID NO: 106715 - DNA, 22 bp, Artificial Sequence
  Synthetic oligonucleotide; TTG chr11 5361568 5361589 5361585 5361590 +
gcttatcagagattgcagagag

SEQ ID NO: 106716 - DNA, 22 bp, Artificial Sequence
  Synthetic oligonucleotide; CTT chr11 5361572 5361593 5361589 5361594 +
atcagagattgcagagagggaa

SEQ ID NO: 106717 - DNA, 22 bp, Artificial Sequence
  Synthetic oligonucleotide; TTA chr11 5361573 5361594 5361590 5361595 +
tcagagattgcagagagggaaa

SEQ ID NO: 106718 - DNA, 22 bp, Artificial Sequence
  Synthetic oligonucleotide; TTG chr11 5361583 5361604 5361600 5361605 +
cagagagggaaatgcagtaatg

SEQ ID NO: 106719 - DNA, 22 bp, Artificial Sequence
  Synthetic oligonucleotide; CTA chr11 5361639 5361660 5361656 5361661 +
tcatcccaaagactccctaaaa

SEQ ID NO: 106720 - DNA, 22 bp, Artificial Sequence
  Synthetic oligonucleotide; CTC chr11 5361654 5361675 5361671 5361676 +
cctaaaatctttagaacttggc

SEQ ID NO: 106721 - DNA, 22 bp, Artificial Sequence
  Synthetic oligonucleotide; CTA chr11 5361658 5361679 5361675 5361680 +
aaatctttagaacttggcttct

SEQ ID NO: 106722 - DNA, 22 bp, Artificial Sequence
  Synthetic oligonucleotide; CTT chr11 5361665 5361686 5361682 5361687 +
tagaacttggcttctgaataat

SEQ ID NO: 106723 - DNA, 22 bp, Artificial Sequence
  Synthetic oligonucleotide; TTT chr11 5361666 5361687 5361683 5361688 +
agaacttggcttctgaataatc

SEQ ID NO: 106724 - DNA, 22 bp, Artificial Sequence
  Synthetic oligonucleotide; TTA chr11 5361667 5361688 5361684 5361689 +
gaacttggcttctgaataatct

SEQ ID NO: 106725 - DNA, 22 bp, Artificial Sequence
  Synthetic oligonucleotide; CTT chr11 5361673 5361694 5361690 5361695 +
ggcttctgaataatctcttttg

SEQ ID NO: 106726 - DNA, 22 bp, Artificial Sequence
  Synthetic oligonucleotide; TTG chr11 5361674 5361695 5361691 5361696 +
gcttctgaataatctcttttgc

SEQ ID NO: 106727 - DNA, 22 bp, Artificial Sequence
  Synthetic oligonucleotide; CTT chr11 5361678 5361699 5361695 5361700 +
ctgaataatctcttttgcaaat

SEQ ID NO: 106728 - DNA, 22 bp, Artificial Sequence
  Synthetic oligonucleotide; TTC chr11 5361679 5361700 5361696 5361701 +
tgaataatctcttttgcaaatt

SEQ ID NO: 106729 - DNA, 22 bp, Artificial Sequence
  Synthetic oligonucleotide; CTG chr11 5361681 5361702 5361698 5361703 +
aataatctcttttgcaaattcc

SEQ ID NO: 106730 - DNA, 22 bp, Artificial Sequence
  Synthetic oligonucleotide; CTC chr11 5361690 5361711 5361707 5361712 +
ttttgcaaattcctagaagagg

SEQ ID NO: 106731 - DNA, 22 bp, Artificial Sequence
  Synthetic oligonucleotide; CTT chr11 5361692 5361713 5361709 5361714 +
ttgcaaattcctagaagaggga

SEQ ID NO: 106732 - DNA, 22 bp, Artificial Sequence
  Synthetic oligonucleotide; TTT chr11 5361693 5361714 5361710 5361715 +
tgcaaattcctagaagagggaa

SEQ ID NO: 106733 - DNA, 22 bp, Artificial Sequence
  Synthetic oligonucleotide; TTT chr11 5361694 5361715 5361711 5361716 +
gcaaattcctagaagagggaaa

SEQ ID NO: 106734 - DNA, 22 bp, Artificial Sequence
  Synthetic oligonucleotide; TTG chr11 5361695 5361716 5361712 5361717 +
caaattcctagaagagggaaaa

SEQ ID NO: 106735 - DNA, 22 bp, Artificial Sequence
  Synthetic oligonucleotide; TTC chr11 5361702 5361723 5361719 5361724 +
ctagaagagggaaaatcctaga

SEQ ID NO: 106736 - DNA, 22 bp, Artificial Sequence
  Synthetic oligonucleotide; CTA chr11 5361705 5361726 5361722 5361727 +
gaagagggaaaatcctagatct

SEQ ID NO: 106737 - DNA, 22 bp, Artificial Sequence
  Synthetic oligonucleotide; CTA chr11 5361722 5361743 5361739 5361744 +
gatctcctttttcattccctag

SEQ ID NO: 106738 - DNA, 22 bp, Artificial Sequence
  Synthetic oligonucleotide; CTC chr11 5361728 5361749 5361745 5361750 +
ctttttcattccctagcagagt

SEQ ID NO: 106739 - DNA, 22 bp, Artificial Sequence
  Synthetic oligonucleotide; CTT chr11 5361731 5361752 5361748 5361753 +
tttcattccctagcagagtgat

SEQ ID NO: 106740 - DNA, 22 bp, Artificial Sequence
  Synthetic oligonucleotide; TTT chr11 5361732 5361753 5361749 5361754 +
ttcattccctagcagagtgatc

SEQ ID NO: 106741 - DNA, 22 bp, Artificial Sequence
  Synthetic oligonucleotide; TTT chr11 5361733 5361754 5361750 5361755 +
tcattccctagcagagtgatct

SEQ ID NO: 106742 - DNA, 22 bp, Artificial Sequence
  Synthetic oligonucleotide; TTT chr11 5361734 5361755 5361751 5361756 +
cattccctagcagagtgatcta

SEQ ID NO: 106743 - DNA, 22 bp, Artificial Sequence
  Synthetic oligonucleotide; TTC chr11 5361735 5361756 5361752 5361757 +
attccctagcagagtgatctag

SEQ ID NO: 106744 - DNA, 22 bp, Artificial Sequence
  Synthetic oligonucleotide; TTC chr11 5361739 5361760 5361756 5361761 +
cctagcagagtgatctagttag

SEQ ID NO: 106745 - DNA, 22 bp, Artificial Sequence
  Synthetic oligonucleotide; CTA chr11 5361743 5361764 5361760 5361765 +
gcagagtgatctagttaggaaa

SEQ ID NO: 106746 - DNA, 22 bp, Artificial Sequence
  Synthetic oligonucleotide; CTA chr11 5361756 5361777 5361773 5361778 +
gttaggaaaaaatcaagttgaa

SEQ ID NO: 106747 - DNA, 22 bp, Artificial Sequence
  Synthetic oligonucleotide; TTA chr11 5361760 5361781 5361777 5361782 +
ggaaaaaatcaagttgaaaatc

SEQ ID NO: 106748 - DNA, 22 bp, Artificial Sequence
  Synthetic oligonucleotide; TTG chr11 5361776 5361797 5361793 5361798 +
aaaatccacgggaatacagaat

SEQ ID NO: 106749 - DNA, 22 bp, Artificial Sequence
  Synthetic oligonucleotide; CTC chr11 5361806 5361827 5361823 5361828 +
tggtgtagttccagactctggt

SEQ ID NO: 106750 - DNA, 22 bp, Artificial Sequence
  Synthetic oligonucleotide; CTG chr11 5361808 5361829 5361825 5361830 +
gtgtagttccagactctggttt

SEQ ID NO: 106751 - DNA, 22 bp, Artificial Sequence
  Synthetic oligonucleotide; TTC chr11 5361817 5361838 5361834 5361839 +
cagactctggtttggattatct

SEQ ID NO: 106752 - DNA, 22 bp, Artificial Sequence
  Synthetic oligonucleotide; CTC chr11 5361824 5361845 5361841 5361846 +
tggtttggattatctatttcct

SEQ ID NO: 106753 - DNA, 22 bp, Artificial Sequence
  Synthetic oligonucleotide; CTG chr11 5361826 5361847 5361843 5361848 +
gtttggattatctatttccttt

SEQ ID NO: 106754 - DNA, 22 bp, Artificial Sequence
  Synthetic oligonucleotide; TTT chr11 5361830 5361851 5361847 5361852 +
ggattatctatttcctttgttg

SEQ ID NO: 106755 - DNA, 22 bp, Artificial Sequence
  Synthetic oligonucleotide; TTG chr11 5361831 5361852 5361848 5361853 +
gattatctatttcctttgttgc

SEQ ID NO: 106756 - DNA, 22 bp, Artificial Sequence
  Synthetic oligonucleotide; TTA chr11 5361836 5361857 5361853 5361858 +
tctatttcctttgttgctctct

SEQ ID NO: 106757 - DNA, 22 bp, Artificial Sequence
  Synthetic oligonucleotide; CTA chr11 5361840 5361861 5361857 5361862 +
tttcctttgttgctctcttcgg

SEQ ID NO: 106758 - DNA, 22 bp, Artificial Sequence
  Synthetic oligonucleotide; TTT chr11 5361843 5361864 5361860 5361865 +
cctttgttgctctcttcgggct

SEQ ID NO: 106759 - DNA, 22 bp, Artificial Sequence
  Synthetic oligonucleotide; TTC chr11 5361844 5361865 5361861 5361866 +
ctttgttgctctcttcgggctg

SEQ ID NO: 106760 - DNA, 22 bp, Artificial Sequence
  Synthetic oligonucleotide; CTT chr11 5361847 5361868 5361864 5361869 +
tgttgctctcttcgggctgcat

SEQ ID NO: 106761 - DNA, 22 bp, Artificial Sequence
  Synthetic oligonucleotide; TTT chr11 5361848 5361869 5361865 5361870 +
gttgctctcttcgggctgcata

SEQ ID NO: 106762 - DNA, 22 bp, Artificial Sequence
  Synthetic oligonucleotide; TTG chr11 5361849 5361870 5361866 5361871 +
ttgctctcttcgggctgcataa

SEQ ID NO: 106763 - DNA, 22 bp, Artificial Sequence
  Synthetic oligonucleotide; TTG chr11 5361852 5361873 5361869 5361874 +
ctctcttcgggctgcataaacc

SEQ ID NO: 106764 - DNA, 22 bp, Artificial Sequence
  Synthetic oligonucleotide; CTC chr11 5361855 5361876 5361872 5361877 +
tcttcgggctgcataaaccagc

SEQ ID NO: 106765 - DNA, 22 bp, Artificial Sequence
  Synthetic oligonucleotide; CTC chr11 5361857 5361878 5361874 5361879 +
ttcgggctgcataaaccagctt

SEQ ID NO: 106766 - DNA, 22 bp, Artificial Sequence
  Synthetic oligonucleotide; CTT chr11 5361859 5361880 5361876 5361881 +
cgggctgcataaaccagcttcc

SEQ ID NO: 106767 - DNA, 22 bp, Artificial Sequence
  Synthetic oligonucleotide; TTC chr11 5361860 5361881 5361877 5361882 +
gggctgcataaaccagcttcct

SEQ ID NO: 106768 - DNA, 22 bp, Artificial Sequence
  Synthetic oligonucleotide; CTG chr11 5361866 5361887 5361883 5361888 +
cataaaccagcttcctctttgc

SEQ ID NO: 106769 - DNA, 22 bp, Artificial Sequence
  Synthetic oligonucleotide; CTT chr11 5361879 5361900 5361896 5361901 +
cctctttgcctctatgtgttct

SEQ ID NO: 106770 - DNA, 22 bp, Artificial Sequence
  Synthetic oligonucleotide; TTC chr11 5361880 5361901 5361897 5361902 +
ctctttgcctctatgtgttcta

SEQ ID NO: 106771 - DNA, 22 bp, Artificial Sequence
  Synthetic oligonucleotide; CTC chr11 5361883 5361904 5361900 5361905 +
tttgcctctatgtgttctacca

SEQ ID NO: 106772 - DNA, 22 bp, Artificial Sequence
  Synthetic oligonucleotide; CTT chr11 5361885 5361906 5361902 5361907 +
tgcctctatgtgttctaccaag

SEQ ID NO: 106773 - DNA, 22 bp, Artificial Sequence
  Synthetic oligonucleotide; TTT chr11 5361886 5361907 5361903 5361908 +
gcctctatgtgttctaccaagt

SEQ ID NO: 106774 - DNA, 22 bp, Artificial Sequence
  Synthetic oligonucleotide; TTG chr11 5361887 5361908 5361904 5361909 +
cctctatgtgttctaccaagta

SEQ ID NO: 106775 - DNA, 22 bp, Artificial Sequence
  Synthetic oligonucleotide; CTC chr11 5361891 5361912 5361908 5361913 +
tatgtgttctaccaagtactta

SEQ ID NO: 106776 - DNA, 22 bp, Artificial Sequence
  Synthetic oligonucleotide; CTA chr11 5361893 5361914 5361910 5361915 +
tgtgttctaccaagtacttact

SEQ ID NO: 106777 - DNA, 22 bp, Artificial Sequence
  Synthetic oligonucleotide; TTC chr11 5361900 5361921 5361917 5361922 +
taccaagtacttactcccaaaa

SEQ ID NO: 106778 - DNA, 22 bp, Artificial Sequence
  Synthetic oligonucleotide; CTA chr11 5361902 5361923 5361919 5361924 +
ccaagtacttactcccaaaaaa

SEQ ID NO: 106779 - DNA, 22 bp, Artificial Sequence
  Synthetic oligonucleotide; CTT chr11 5361912 5361933 5361929 5361934 +
actcccaaaaaagatgaagtta

SEQ ID NO: 106780 - DNA, 22 bp, Artificial Sequence
  Synthetic oligonucleotide; TTA chr11 5361913 5361934 5361930 5361935 +
ctcccaaaaaagatgaagttag

SEQ ID NO: 106781 - DNA, 22 bp, Artificial Sequence
  Synthetic oligonucleotide; CTC chr11 5361916 5361937 5361933 5361938 +
ccaaaaaagatgaagttagagt

SEQ ID NO: 106782 - DNA, 22 bp, Artificial Sequence
  Synthetic oligonucleotide; TTA chr11 5361934 5361955 5361951 5361956 +
gagtgaggataggggacactgt

SEQ ID NO: 106783 - DNA, 22 bp, Artificial Sequence
  Synthetic oligonucleotide; CTG chr11 5361955 5361976 5361972 5361977 +
taatgacaagggtatagactaa

SEQ ID NO: 106784 - DNA, 22 bp, Artificial Sequence
  Synthetic oligonucleotide; CTA chr11 5361976 5361997 5361993 5361998 +
acagaaagaaaaacttaccaaa

SEQ ID NO: 106785 - DNA, 22 bp, Artificial Sequence
  Synthetic oligonucleotide; CTT chr11 5361992 5362013 5362009 5362014 +
accaaatagattagtgtcagat

SEQ ID NO: 106786 - DNA, 22 bp, Artificial Sequence
  Synthetic oligonucleotide; TTA chr11 5361993 5362014 5362010 5362015 +
ccaaatagattagtgtcagatt

SEQ ID NO: 106787 - DNA, 22 bp, Artificial Sequence
  Synthetic oligonucleotide; TTA chr11 5362005 5362026 5362022 5362027 +
gtgtcagattgagtaaagcaaa

SEQ ID NO: 106788 - DNA, 22 bp, Artificial Sequence
  Synthetic oligonucleotide; TTG chr11 5362016 5362037 5362033 5362038 +
agtaaagcaaactttgacatga

SEQ ID NO: 106789 - DNA, 22 bp, Artificial Sequence
  Synthetic oligonucleotide; CTT chr11 5362030 5362051 5362047 5362052 +
tgacatgaggcacaatgcttta

SEQ ID NO: 106790 - DNA, 22 bp, Artificial Sequence
  Synthetic oligonucleotide; TTT chr11 5362031 5362052 5362048 5362053 +
gacatgaggcacaatgctttaa

SEQ ID NO: 106791 - DNA, 22 bp, Artificial Sequence
  Synthetic oligonucleotide; TTG chr11 5362032 5362053 5362049 5362054 +
acatgaggcacaatgctttaaa

SEQ ID NO: 106792 - DNA, 22 bp, Artificial Sequence
  Synthetic oligonucleotide; CTT chr11 5362050 5362071 5362067 5362072 +
taaattgctgcatattcccaga

SEQ ID NO: 106793 - DNA, 22 bp, Artificial Sequence
  Synthetic oligonucleotide; TTT chr11 5362051 5362072 5362068 5362073 +
aaattgctgcatattcccagaa

SEQ ID NO: 106794 - DNA, 22 bp, Artificial Sequence
  Synthetic oligonucleotide; TTA chr11 5362052 5362073 5362069 5362074 +
aattgctgcatattcccagaaa

SEQ ID NO: 106795 - DNA, 22 bp, Artificial Sequence
  Synthetic oligonucleotide; TTG chr11 5362057 5362078 5362074 5362079 +
ctgcatattcccagaaatgagc

SEQ ID NO: 106796 - DNA, 22 bp, Artificial Sequence
  Synthetic oligonucleotide; CTG chr11 5362060 5362081 5362077 5362082 +
catattcccagaaatgagccta

SEQ ID NO: 106797 - DNA, 22 bp, Artificial Sequence
  Synthetic oligonucleotide; TTC chr11 5362067 5362088 5362084 5362089 +
ccagaaatgagcctagtatcca

SEQ ID NO: 106798 - DNA, 22 bp, Artificial Sequence
  Synthetic oligonucleotide; CTA chr11 5362082 5362103 5362099 5362104 +
gtatccatcagaaaatgtatgc

SEQ ID NO: 106799 - DNA, 22 bp, Artificial Sequence
  Synthetic oligonucleotide; CTT chr11 5362112 5362133 5362129 5362134 +
ataaaccaaagtcagagagagc

SEQ ID NO: 106800 - DNA, 22 bp, Artificial Sequence
  Synthetic oligonucleotide; TTA chr11 5362113 5362134 5362130 5362135 +
taaaccaaagtcagagagagct

SEQ ID NO: 106801 - DNA, 22 bp, Artificial Sequence
  Synthetic oligonucleotide; CTT chr11 5362136 5362157 5362153 5362158 +
gttggttcacttcattccatgc

SEQ ID NO: 106802 - DNA, 22 bp, Artificial Sequence
  Synthetic oligonucleotide; TTG chr11 5362137 5362158 5362154 5362159 +
ttggttcacttcattccatgct

SEQ ID NO: 106803 - DNA, 22 bp, Artificial Sequence
  Synthetic oligonucleotide; TTG chr11 5362140 5362161 5362157 5362162 +
gttcacttcattccatgctgag

SEQ ID NO: 106804 - DNA, 22 bp, Artificial Sequence
  Synthetic oligonucleotide; TTC chr11 5362144 5362165 5362161 5362166 +
acttcattccatgctgagctat

SEQ ID NO: 106805 - DNA, 22 bp, Artificial Sequence
  Synthetic oligonucleotide; CTT chr11 5362148 5362169 5362165 5362170 +
cattccatgctgagctatcagc

SEQ ID NO: 106806 - DNA, 22 bp, Artificial Sequence
  Synthetic oligonucleotide; TTC chr11 5362149 5362170 5362166 5362171 +
attccatgctgagctatcagca

SEQ ID NO: 106807 - DNA, 22 bp, Artificial Sequence
  Synthetic oligonucleotide; TTC chr11 5362153 5362174 5362170 5362175 +
catgctgagctatcagcactgc

SEQ ID NO: 106808 - DNA, 22 bp, Artificial Sequence
  Synthetic oligonucleotide; CTG chr11 5362160 5362181 5362177 5362182 +
agctatcagcactgcagatttt

SEQ ID NO: 106809 - DNA, 22 bp, Artificial Sequence
  Synthetic oligonucleotide; CTA chr11 5362165 5362186 5362182 5362187 +
tcagcactgcagattttgaaga

SEQ ID NO: 106810 - DNA, 22 bp, Artificial Sequence
  Synthetic oligonucleotide; CTG chr11 5362174 5362195 5362191 5362196 +
cagattttgaagatctcaacca

SEQ ID NO: 106811 - DNA, 22 bp, Artificial Sequence
  Synthetic oligonucleotide; TTT chr11 5362181 5362202 5362198 5362203 +
tgaagatctcaaccacacccag

SEQ ID NO: 106812 - DNA, 22 bp, Artificial Sequence
  Synthetic oligonucleotide; TTT chr11 5362182 5362203 5362199 5362204 +
gaagatctcaaccacacccaga

SEQ ID NO: 106813 - DNA, 22 bp, Artificial Sequence
  Synthetic oligonucleotide; TTG chr11 5362183 5362204 5362200 5362205 +
aagatctcaaccacacccagat

SEQ ID NO: 106814 - DNA, 22 bp, Artificial Sequence
  Synthetic oligonucleotide; CTC chr11 5362191 5362212 5362208 5362213 +
aaccacacccagatagagagtg

SEQ ID NO: 106815 - DNA, 22 bp, Artificial Sequence
  Synthetic oligonucleotide; TTT chr11 5362231 5362252 5362248 5362253 +
ctgtcgggggatgggagtagat

SEQ ID NO: 106816 - DNA, 22 bp, Artificial Sequence
  Synthetic oligonucleotide; TTC chr11 5362232 5362253 5362249 5362254 +
tgtcgggggatgggagtagata

SEQ ID NO: 106817 - DNA, 22 bp, Artificial Sequence
  Synthetic oligonucleotide; CTG chr11 5362234 5362255 5362251 5362256 +
tcgggggatgggagtagataag

SEQ ID NO: 106818 - DNA, 22 bp, Artificial Sequence
  Synthetic oligonucleotide; TTT chr11 5362267 5362288 5362284 5362289 +
actatttttaccagcaggggaa

SEQ ID NO: 106819 - DNA, 22 bp, Artificial Sequence
  Synthetic oligonucleotide; TTA chr11 5362268 5362289 5362285 5362290 +
ctatttttaccagcaggggaaa

SEQ ID NO: 106820 - DNA, 22 bp, Artificial Sequence
  Synthetic oligonucleotide; CTA chr11 5362271 5362292 5362288 5362293 +
tttttaccagcaggggaaacta

SEQ ID NO: 106821 - DNA, 22 bp, Artificial Sequence
  Synthetic oligonucleotide; TTT chr11 5362274 5362295 5362291 5362296 +
ttaccagcaggggaaactaccc

SEQ ID NO: 106822 - DNA, 22 bp, Artificial Sequence
  Synthetic oligonucleotide; TTT chr11 5362275 5362296 5362292 5362297 +
taccagcaggggaaactaccca

SEQ ID NO: 106823 - DNA, 22 bp, Artificial Sequence
  Synthetic oligonucleotide; TTT chr11 5362276 5362297 5362293 5362298 +
accagcaggggaaactacccag

SEQ ID NO: 106824 - DNA, 22 bp, Artificial Sequence
  Synthetic oligonucleotide; TTA chr11 5362277 5362298 5362294 5362299 +
ccagcaggggaaactacccaga

SEQ ID NO: 106825 - DNA, 22 bp, Artificial Sequence
  Synthetic oligonucleotide; CTA chr11 5362293 5362314 5362310 5362315 +
cccagatgaaaatggtgctgga

SEQ ID NO: 106826 - DNA, 22 bp, Artificial Sequence
  Synthetic oligonucleotide; CTG chr11 5362313 5362334 5362330 5362335 +
gatgctttgggcaaaaagccat

SEQ ID NO: 106827 - DNA, 22 bp, Artificial Sequence
  Synthetic oligonucleotide; CTT chr11 5362320 5362341 5362337 5362342 +
tgggcaaaaagccattcagagc

SEQ ID NO: 106828 - DNA, 22 bp, Artificial Sequence
  Synthetic oligonucleotide; TTT chr11 5362321 5362342 5362338 5362343 +
gggcaaaaagccattcagagcc

SEQ ID NO: 106829 - DNA, 22 bp, Artificial Sequence
  Synthetic oligonucleotide; TTG chr11 5362322 5362343 5362339 5362344 +
ggcaaaaagccattcagagcca

SEQ ID NO: 106830 - DNA, 22 bp, Artificial Sequence
  Synthetic oligonucleotide; TTC chr11 5362337 5362358 5362354 5362359 +
agagccataatcaactacgaag

SEQ ID NO: 106831 - DNA, 22 bp, Artificial Sequence
  Synthetic oligonucleotide; CTA chr11 5362354 5362375 5362371 5362376 +
cgaagatggtcaggaatttagt

SEQ ID NO: 106832 - DNA, 22 bp, Artificial Sequence
  Synthetic oligonucleotide; TTT chr11 5362373 5362394 5362390 5362395 +
agtgtatttgtagatcagatga

SEQ ID NO: 106833 - DNA, 22 bp, Artificial Sequence
  Synthetic oligonucleotide; TTA chr11 5362374 5362395 5362391 5362396 +
gtgtatttgtagatcagatgat

SEQ ID NO: 106834 - DNA, 22 bp, Artificial Sequence
  Synthetic oligonucleotide; TTT chr11 5362382 5362403 5362399 5362404 +
gtagatcagatgatcagtctat

SEQ ID NO: 106835 - DNA, 22 bp, Artificial Sequence
  Synthetic oligonucleotide; TTG chr11 5362383 5362404 5362400 5362405 +
tagatcagatgatcagtctatg

SEQ ID NO: 106836 - DNA, 22 bp, Artificial Sequence
  Synthetic oligonucleotide; CTA chr11 5362403 5362424 5362420 5362425 +
tggctttggaaaattgtgaaca

SEQ ID NO: 106837 - DNA, 22 bp, Artificial Sequence
  Synthetic oligonucleotide; CTT chr11 5362409 5362430 5362426 5362431 +
tggaaaattgtgaacattagtt

SEQ ID NO: 106838 - DNA, 22 bp, Artificial Sequence
  Synthetic oligonucleotide; TTT chr11 5362410 5362431 5362427 5362432 +
ggaaaattgtgaacattagttg

SEQ ID NO: 106839 - DNA, 22 bp, Artificial Sequence
  Synthetic oligonucleotide; TTG chr11 5362411 5362432 5362428 5362433 +
gaaaattgtgaacattagttgt

SEQ ID NO: 106840 - DNA, 22 bp, Artificial Sequence
  Synthetic oligonucleotide; TTG chr11 5362419 5362440 5362436 5362441 +
tgaacattagttgttgagcctt

SEQ ID NO: 106841 - DNA, 22 bp, Artificial Sequence
  Synthetic oligonucleotide; TTA chr11 5362428 5362449 5362445 5362450 +
gttgttgagccttataatgaga

SEQ ID NO: 106842 - DNA, 22 bp, Artificial Sequence
  Synthetic oligonucleotide; TTG chr11 5362432 5362453 5362449 5362454 +
ttgagccttataatgagaatgt

SEQ ID NO: 106843 - DNA, 22 bp, Artificial Sequence
  Synthetic oligonucleotide; TTG chr11 5362435 5362456 5362452 5362457 +
agccttataatgagaatgtgat

SEQ ID NO: 106844 - DNA, 22 bp, Artificial Sequence
  Synthetic oligonucleotide; CTT chr11 5362441 5362462 5362458 5362463 +
ataatgagaatgtgatgattaa

SEQ ID NO: 106845 - DNA, 22 bp, Artificial Sequence
  Synthetic oligonucleotide; TTA chr11 5362442 5362463 5362459 5362464 +
taatgagaatgtgatgattaaa

SEQ ID NO: 106846 - DNA, 22 bp, Artificial Sequence
  Synthetic oligonucleotide; TTA chr11 5362462 5362483 5362479 5362484 +
aatcaggtctactggatactat

SEQ ID NO: 106847 - DNA, 22 bp, Artificial Sequence
  Synthetic oligonucleotide; CTA chr11 5362473 5362494 5362490 5362495 +
ctggatactatgaatcagaata

SEQ ID NO: 106848 - DNA, 22 bp, Artificial Sequence
  Synthetic oligonucleotide; CTG chr11 5362476 5362497 5362493 5362498 +
gatactatgaatcagaatagat

SEQ ID NO: 106849 - DNA, 22 bp, Artificial Sequence
  Synthetic oligonucleotide; CTA chr11 5362483 5362504 5362500 5362505 +
tgaatcagaatagataacattg

SEQ ID NO: 106850 - DNA, 22 bp, Artificial Sequence
  Synthetic oligonucleotide; TTG chr11 5362505 5362526 5362522 5362527 +
ttagatataattacctagtcag

SEQ ID NO: 106851 - DNA, 22 bp, Artificial Sequence
  Synthetic oligonucleotide; TTA chr11 5362508 5362529 5362525 5362530 +
gatataattacctagtcagaga

SEQ ID NO: 106852 - DNA, 22 bp, Artificial Sequence
  Synthetic oligonucleotide; TTA chr11 5362518 5362539 5362535 5362540 +
cctagtcagagagcagagatga

SEQ ID NO: 106853 - DNA, 22 bp, Artificial Sequence
  Synthetic oligonucleotide; CTA chr11 5362522 5362543 5362539 5362544 +
gtcagagagcagagatgaagtc

SEQ ID NO: 106854 - DNA, 22 bp, Artificial Sequence
  Synthetic oligonucleotide; CTT chr11 5362578 5362599 5362595 5362600 +
ctggtggcagagtggtggctta

SEQ ID NO: 106855 - DNA, 22 bp, Artificial Sequence
  Synthetic oligonucleotide; TTC chr11 5362579 5362600 5362596 5362601 +
tggtggcagagtggtggcttag

SEQ ID NO: 106856 - DNA, 22 bp, Artificial Sequence
  Synthetic oligonucleotide; CTG chr11 5362581 5362602 5362598 5362603 +
gtggcagagtggtggcttagcc

SEQ ID NO: 106857 - DNA, 22 bp, Artificial Sequence
  Synthetic oligonucleotide; CTT chr11 5362599 5362620 5362616 5362621 +
agcctgctggggcaaaatggag

SEQ ID NO: 106858 - DNA, 22 bp, Artificial Sequence
  Synthetic oligonucleotide; TTA chr11 5362600 5362621 5362617 5362622 +
gcctgctggggcaaaatggagc

SEQ ID NO: 106859 - DNA, 22 bp, Artificial Sequence
  Synthetic oligonucleotide; CTG chr11 5362605 5362626 5362622 5362627 +
ctggggcaaaatggagctcaag

SEQ ID NO: 106860 - DNA, 22 bp, Artificial Sequence
  Synthetic oligonucleotide; CTG chr11 5362608 5362629 5362625 5362630 +
gggcaaaatggagctcaaggcc

SEQ ID NO: 106861 - DNA, 22 bp, Artificial Sequence
  Synthetic oligonucleotide; CTC chr11 5362624 5362645 5362641 5362646 +
aaggccatgagcagatacaaca

SEQ ID NO: 106862 - DNA, 22 bp, Artificial Sequence
  Synthetic oligonucleotide; CTG chr11 5362664 5362685 5362681 5362686 +
tcttcccccatctgattgtaga

SEQ ID NO: 106863 - DNA, 22 bp, Artificial Sequence
  Synthetic oligonucleotide; CTT chr11 5362668 5362689 5362685 5362690 +
cccccatctgattgtagagctt

SEQ ID NO: 106864 - DNA, 22 bp, Artificial Sequence
  Synthetic oligonucleotide; TTC chr11 5362669 5362690 5362686 5362691 +
ccccatctgattgtagagcttt

SEQ ID NO: 106865 - DNA, 22 bp, Artificial Sequence
  Synthetic oligonucleotide; CTG chr11 5362678 5362699 5362695 5362700 +
attgtagagcttttggccatcg

SEQ ID NO: 106866 - DNA, 22 bp, Artificial Sequence
  Synthetic oligonucleotide; TTG chr11 5362682 5362703 5362699 5362704 +
tagagcttttggccatcgacat

SEQ ID NO: 106867 - DNA, 22 bp, Artificial Sequence
  Synthetic oligonucleotide; CTT chr11 5362690 5362711 5362707 5362712 +
ttggccatcgacatgttcttca

SEQ ID NO: 106868 - DNA, 22 bp, Artificial Sequence
  Synthetic oligonucleotide; TTT chr11 5362691 5362712 5362708 5362713 +
tggccatcgacatgttcttcac

SEQ ID NO: 106869 - DNA, 22 bp, Artificial Sequence
  Synthetic oligonucleotide; TTT chr11 5362692 5362713 5362709 5362714 +
ggccatcgacatgttcttcacc

SEQ ID NO: 106870 - DNA, 22 bp, Artificial Sequence
  Synthetic oligonucleotide; TTG chr11 5362693 5362714 5362710 5362715 +
gccatcgacatgttcttcacca

SEQ ID NO: 106871 - DNA, 22 bp, Artificial Sequence
  Synthetic oligonucleotide; TTC chr11 5362708 5362729 5362725 5362730 +
ttcaccacctggttctttgttt

SEQ ID NO: 106872 - DNA, 22 bp, Artificial Sequence
  Synthetic oligonucleotide; CTT chr11 5362710 5362731 5362727 5362732 +
caccacctggttctttgtttac

SEQ ID NO: 106873 - DNA, 22 bp, Artificial Sequence
  Synthetic oligonucleotide; TTC chr11 5362711 5362732 5362728 5362733 +
accacctggttctttgtttacg

SEQ ID NO: 106874 - DNA, 22 bp, Artificial Sequence
  Synthetic oligonucleotide; CTG chr11 5362719 5362740 5362736 5362741 +
gttctttgtttacgaggtcacc

SEQ ID NO: 106875 - DNA, 22 bp, Artificial Sequence
  Synthetic oligonucleotide; TTC chr11 5362723 5362744 5362740 5362745 +
tttgtttacgaggtcacctcta

SEQ ID NO: 106876 - DNA, 22 bp, Artificial Sequence
  Synthetic oligonucleotide; CTT chr11 5362725 5362746 5362742 5362747 +
tgtttacgaggtcacctctacc

SEQ ID NO: 106877 - DNA, 22 bp, Artificial Sequence
  Synthetic oligonucleotide; TTT chr11 5362726 5362747 5362743 5362748 +
gtttacgaggtcacctctacca

SEQ ID NO: 106878 - DNA, 22 bp, Artificial Sequence
  Synthetic oligonucleotide; TTG chr11 5362727 5362748 5362744 5362749 +
tttacgaggtcacctctaccaa

SEQ ID NO: 106879 - DNA, 22 bp, Artificial Sequence
  Synthetic oligonucleotide; TTT chr11 5362730 5362751 5362747 5362752 +
acgaggtcacctctaccaagta

SEQ ID NO: 106880 - DNA, 22 bp, Artificial Sequence
  Synthetic oligonucleotide; TTA chr11 5362731 5362752 5362748 5362753 +
cgaggtcacctctaccaagtac

SEQ ID NO: 106881 - DNA, 22 bp, Artificial Sequence
  Synthetic oligonucleotide; CTC chr11 5362743 5362764 5362760 5362765 +
taccaagtacacttgtgatatc

SEQ ID NO: 106882 - DNA, 22 bp, Artificial Sequence
  Synthetic oligonucleotide; CTA chr11 5362745 5362766 5362762 5362767 +
ccaagtacacttgtgatatcta

SEQ ID NO: 106883 - DNA, 22 bp, Artificial Sequence
  Synthetic oligonucleotide; CTT chr11 5362757 5362778 5362774 5362779 +
gtgatatctataaagagtatct

SEQ ID NO: 106884 - DNA, 22 bp, Artificial Sequence
  Synthetic oligonucleotide; TTG chr11 5362758 5362779 5362775 5362780 +
tgatatctataaagagtatctc

SEQ ID NO: 106885 - DNA, 22 bp, Artificial Sequence
  Synthetic oligonucleotide; CTA chr11 5362767 5362788 5362784 5362789 +
taaagagtatctccttggtggc

SEQ ID NO: 106886 - DNA, 22 bp, Artificial Sequence
  Synthetic oligonucleotide; CTC chr11 5362780 5362801 5362797 5362802 +
cttggtggcctcactcttcatg

SEQ ID NO: 106887 - DNA, 22 bp, Artificial Sequence
  Synthetic oligonucleotide; CTT chr11 5362783 5362804 5362800 5362805 +
ggtggcctcactcttcatgggc

SEQ ID NO: 106888 - DNA, 22 bp, Artificial Sequence
  Synthetic oligonucleotide; TTG chr11 5362784 5362805 5362801 5362806 +
gtggcctcactcttcatgggct

SEQ ID NO: 106889 - DNA, 22 bp, Artificial Sequence
  Synthetic oligonucleotide; CTC chr11 5362792 5362813 5362809 5362814 +
actcttcatgggctttgaagtc

SEQ ID NO: 106890 - DNA, 22 bp, Artificial Sequence
  Synthetic oligonucleotide; CTC chr11 5362796 5362817 5362813 5362818 +
ttcatgggctttgaagtcctct

SEQ ID NO: 106891 - DNA, 22 bp, Artificial Sequence
  Synthetic oligonucleotide; CTT chr11 5362798 5362819 5362815 5362820 +
catgggctttgaagtcctcttc

SEQ ID NO: 106892 - DNA, 22 bp, Artificial Sequence
  Synthetic oligonucleotide; TTC chr11 5362799 5362820 5362816 5362821 +
atgggctttgaagtcctcttcc

SEQ ID NO: 106893 - DNA, 22 bp, Artificial Sequence
  Synthetic oligonucleotide; CTT chr11 5362807 5362828 5362824 5362829 +
tgaagtcctcttcctgatgctc

SEQ ID NO: 106894 - DNA, 22 bp, Artificial Sequence
  Synthetic oligonucleotide; TTT chr11 5362808 5362829 5362825 5362830 +
gaagtcctcttcctgatgctct

SEQ ID NO: 106895 - DNA, 22 bp, Artificial Sequence
  Synthetic oligonucleotide; TTG chr11 5362809 5362830 5362826 5362831 +
aagtcctcttcctgatgctctg

SEQ ID NO: 106896 - DNA, 22 bp, Artificial Sequence
  Synthetic oligonucleotide; CTC chr11 5362817 5362838 5362834 5362839 +
ttcctgatgctctgggttggca

SEQ ID NO: 106897 - DNA, 22 bp, Artificial Sequence
  Synthetic oligonucleotide; CTT chr11 5362819 5362840 5362836 5362841 +
cctgatgctctgggttggcatc

SEQ ID NO: 106898 - DNA, 22 bp, Artificial Sequence
  Synthetic oligonucleotide; TTC chr11 5362820 5362841 5362837 5362842 +
ctgatgctctgggttggcatct

SEQ ID NO: 106899 - DNA, 22 bp, Artificial Sequence
  Synthetic oligonucleotide; CTG chr11 5362823 5362844 5362840 5362845 +
atgctctgggttggcatctaca

SEQ ID NO: 106900 - DNA, 22 bp, Artificial Sequence
  Synthetic oligonucleotide; CTC chr11 5362829 5362850 5362846 5362851 +
tgggttggcatctacatgtgag

SEQ ID NO: 106901 - DNA, 22 bp, Artificial Sequence
  Synthetic oligonucleotide; CTG chr11 5362831 5362852 5362848 5362853 +
ggttggcatctacatgtgagtg

SEQ ID NO: 106902 - DNA, 22 bp, Artificial Sequence
  Synthetic oligonucleotide; TTG chr11 5362836 5362857 5362853 5362858 +
gcatctacatgtgagtgcccaa

SEQ ID NO: 106903 - DNA, 22 bp, Artificial Sequence
  Synthetic oligonucleotide; CTA chr11 5362843 5362864 5362860 5362865 +
catgtgagtgcccaagagtaac

SEQ ID NO: 106904 - DNA, 22 bp, Artificial Sequence
  Synthetic oligonucleotide; CTT chr11 5362878 5362899 5362895 5362900 +
cactgaatccctgcttttgtaa

SEQ ID NO: 106905 - DNA, 22 bp, Artificial Sequence
  Synthetic oligonucleotide; TTC chr11 5362879 5362900 5362896 5362901 +
actgaatccctgcttttgtaaa

SEQ ID NO: 106906 - DNA, 22 bp, Artificial Sequence
  Synthetic oligonucleotide; CTG chr11 5362883 5362904 5362900 5362905 +
aatccctgcttttgtaaattaa

SEQ ID NO: 106907 - DNA, 22 bp, Artificial Sequence
  Synthetic oligonucleotide; CTG chr11 5362891 5362912 5362908 5362913 +
cttttgtaaattaagttttctt

SEQ ID NO: 106908 - DNA, 22 bp, Artificial Sequence
  Synthetic oligonucleotide; CTT chr11 5362894 5362915 5362911 5362916 +
ttgtaaattaagttttctttct

SEQ ID NO: 106909 - DNA, 22 bp, Artificial Sequence
  Synthetic oligonucleotide; TTT chr11 5362895 5362916 5362912 5362917 +
tgtaaattaagttttctttcta

SEQ ID NO: 106910 - DNA, 22 bp, Artificial Sequence
  Synthetic oligonucleotide; TTT chr11 5362896 5362917 5362913 5362918 +
gtaaattaagttttctttctat

SEQ ID NO: 106911 - DNA, 22 bp, Artificial Sequence
  Synthetic oligonucleotide; TTG chr11 5362897 5362918 5362914 5362919 +
taaattaagttttctttctatt

SEQ ID NO: 106912 - DNA, 22 bp, Artificial Sequence
  Synthetic oligonucleotide; TTA chr11 5362904 5362925 5362921 5362926 +
agttttctttctattgctggaa

SEQ ID NO: 106913 - DNA, 22 bp, Artificial Sequence
  Synthetic oligonucleotide; TTT chr11 5362909 5362930 5362926 5362931 +
tctttctattgctggaagtgtc

SEQ ID NO: 106914 - DNA, 22 bp, Artificial Sequence
  Synthetic oligonucleotide; TTT chr11 5362910 5362931 5362927 5362932 +
ctttctattgctggaagtgtcc

SEQ ID NO: 106915 - DNA, 22 bp, Artificial Sequence
  Synthetic oligonucleotide; TTC chr11 5362911 5362932 5362928 5362933 +
tttctattgctggaagtgtccc

SEQ ID NO: 106916 - DNA, 22 bp, Artificial Sequence
  Synthetic oligonucleotide; CTT chr11 5362913 5362934 5362930 5362935 +
tctattgctggaagtgtcccgc

SEQ ID NO: 106917 - DNA, 22 bp, Artificial Sequence
  Synthetic oligonucleotide; TTT chr11 5362914 5362935 5362931 5362936 +
ctattgctggaagtgtcccgcc

SEQ ID NO: 106918 - DNA, 22 bp, Artificial Sequence
  Synthetic oligonucleotide; TTC chr11 5362915 5362936 5362932 5362937 +
tattgctggaagtgtcccgcct

SEQ ID NO: 106919 - DNA, 22 bp, Artificial Sequence
  Synthetic oligonucleotide; CTA chr11 5362917 5362938 5362934 5362939 +
ttgctggaagtgtcccgcctgt

SEQ ID NO: 106920 - DNA, 22 bp, Artificial Sequence
  Synthetic oligonucleotide; TTG chr11 5362920 5362941 5362937 5362942 +
ctggaagtgtcccgcctgttgc

SEQ ID NO: 106921 - DNA, 22 bp, Artificial Sequence
  Synthetic oligonucleotide; CTG chr11 5362923 5362944 5362940 5362945 +
gaagtgtcccgcctgttgctta

SEQ ID NO: 106922 - DNA, 22 bp, Artificial Sequence
  Synthetic oligonucleotide; CTG chr11 5362938 5362959 5362955 5362960 +
ttgcttataataaatgcagatg

SEQ ID NO: 106923 - DNA, 22 bp, Artificial Sequence
  Synthetic oligonucleotide; TTG chr11 5362941 5362962 5362958 5362963 +
cttataataaatgcagatgtat

SEQ ID NO: 106924 - DNA, 22 bp, Artificial Sequence
  Synthetic oligonucleotide; CTT chr11 5362944 5362965 5362961 5362966 +
ataataaatgcagatgtatggc

SEQ ID NO: 106925 - DNA, 22 bp, Artificial Sequence
  Synthetic oligonucleotide; TTA chr11 5362945 5362966 5362962 5362967 +
taataaatgcagatgtatggca

SEQ ID NO: 106926 - DNA, 22 bp, Artificial Sequence
  Synthetic oligonucleotide; TTA chr11 5362970 5362991 5362987 5362992 +
aaaaaaaaaaagaaataataga

SEQ ID NO: 106927 - DNA, 22 bp, Artificial Sequence
  Synthetic oligonucleotide; TTA chr11 5362997 5363018 5363014 5363019 +
ggcagggattggggcatgaagg

SEQ ID NO: 106928 - DNA, 22 bp, Artificial Sequence
  Synthetic oligonucleotide; TTG chr11 5363008 5363029 5363025 5363030 +
gggcatgaaggttgaaaacaag

SEQ ID NO: 106929 - DNA, 22 bp, Artificial Sequence
  Synthetic oligonucleotide; TTG chr11 5363022 5363043 5363039 5363044 +
aaaacaaggaaaaggagcccaa

SEQ ID NO: 106930 - DNA, 22 bp, Artificial Sequence
  Synthetic oligonucleotide; TTG chr11 5363060 5363081 5363077 5363082 +
taaaatgtgctaagtagatgtc

SEQ ID NO: 106931 - DNA, 22 bp, Artificial Sequence
  Synthetic oligonucleotide; CTA chr11 5363072 5363093 5363089 5363094 +
agtagatgtctgagtggcattc

SEQ ID NO: 106932 - DNA, 22 bp, Artificial Sequence
  Synthetic oligonucleotide; CTG chr11 5363084 5363105 5363101 5363106 +
agtggcattcctccatgagaga

SEQ ID NO: 106933 - DNA, 22 bp, Artificial Sequence
  Synthetic oligonucleotide; TTC chr11 5363094 5363115 5363111 5363116 +
ctccatgagagaaagcttaagg

SEQ ID NO: 106934 - DNA, 22 bp, Artificial Sequence
  Synthetic oligonucleotide; CTC chr11 5363097 5363118 5363114 5363119 +
catgagagaaagcttaagggaa

SEQ ID NO: 106935 - DNA, 22 bp, Artificial Sequence
  Synthetic oligonucleotide; CTT chr11 5363112 5363133 5363129 5363134 +
aagggaagaaagagaccctgag

SEQ ID NO: 106936 - DNA, 22 bp, Artificial Sequence
  Synthetic oligonucleotide; TTA chr11 5363113 5363134 5363130 5363135 +
agggaagaaagagaccctgagt

SEQ ID NO: 106937 - DNA, 22 bp, Artificial Sequence
  Synthetic oligonucleotide; CTG chr11 5363132 5363153 5363149 5363154 +
agtgtcttcaaaactcaaagtt

SEQ ID NO: 106938 - DNA, 22 bp, Artificial Sequence
  Synthetic oligonucleotide; CTT chr11 5363140 5363161 5363157 5363162 +
caaaactcaaagttttacgaac

SEQ ID NO: 106939 - DNA, 22 bp, Artificial Sequence
  Synthetic oligonucleotide; TTC chr11 5363141 5363162 5363158 5363163 +
aaaactcaaagttttacgaaca

SEQ ID NO: 106940 - DNA, 22 bp, Artificial Sequence
  Synthetic oligonucleotide; CTC chr11 5363148 5363169 5363165 5363170 +
aaagttttacgaacagaatgat

SEQ ID NO: 106941 - DNA, 22 bp, Artificial Sequence
  Synthetic oligonucleotide; TTT chr11 5363155 5363176 5363172 5363177 +
tacgaacagaatgattagtctg

SEQ ID NO: 106942 - DNA, 22 bp, Artificial Sequence
  Synthetic oligonucleotide; TTT chr11 5363156 5363177 5363173 5363178 +
acgaacagaatgattagtctgg

SEQ ID NO: 106943 - DNA, 22 bp, Artificial Sequence
  Synthetic oligonucleotide; TTA chr11 5363157 5363178 5363174 5363179 +
cgaacagaatgattagtctgga

SEQ ID NO: 106944 - DNA, 22 bp, Artificial Sequence
  Synthetic oligonucleotide; TTA chr11 5363172 5363193 5363189 5363194 +
gtctggagaaatcatttttcat

SEQ ID NO: 106945 - DNA, 22 bp, Artificial Sequence
  Synthetic oligonucleotide; CTG chr11 5363177 5363198 5363194 5363199 +
gagaaatcatttttcatcaata

SEQ ID NO: 106946 - DNA, 22 bp, Artificial Sequence
  Synthetic oligonucleotide; TTT chr11 5363189 5363210 5363206 5363211 +
ttcatcaatacaggatctcaag

SEQ ID NO: 106947 - DNA, 22 bp, Artificial Sequence
  Synthetic oligonucleotide; TTT chr11 5363190 5363211 5363207 5363212 +
tcatcaatacaggatctcaagt

SEQ ID NO: 106948 - DNA, 22 bp, Artificial Sequence
  Synthetic oligonucleotide; TTT chr11 5363191 5363212 5363208 5363213 +
catcaatacaggatctcaagtg

SEQ ID NO: 106949 - DNA, 22 bp, Artificial Sequence
  Synthetic oligonucleotide; TTC chr11 5363192 5363213 5363209 5363214 +
atcaatacaggatctcaagtgt

SEQ ID NO: 106950 - DNA, 22 bp, Artificial Sequence
  Synthetic oligonucleotide; CTC chr11 5363208 5363229 5363225 5363230 +
aagtgtttccccacaacgaacc

SEQ ID NO: 106951 - DNA, 22 bp, Artificial Sequence
  Synthetic oligonucleotide; TTT chr11 5363216 5363237 5363233 5363238 +
ccccacaacgaacccaacccct

SEQ ID NO: 106952 - DNA, 22 bp, Artificial Sequence
  Synthetic oligonucleotide; TTC chr11 5363217 5363238 5363234 5363239 +
cccacaacgaacccaacccctc

SEQ ID NO: 106953 - DNA, 22 bp, Artificial Sequence
  Synthetic oligonucleotide; CTC chr11 5363239 5363260 5363256 5363261 +
acacacacacacacacacacac

SEQ ID NO: 106954 - DNA, 22 bp, Artificial Sequence
  Synthetic oligonucleotide; TTT chr11 5363310 5363331 5363327 5363332 +
ttcaagtcatgatgcagcagta

SEQ ID NO: 106955 - DNA, 22 bp, Artificial Sequence
  Synthetic oligonucleotide; TTT chr11 5363311 5363332 5363328 5363333 +
tcaagtcatgatgcagcagtat

SEQ ID NO: 106956 - DNA, 22 bp, Artificial Sequence
  Synthetic oligonucleotide; TTT chr11 5363312 5363333 5363329 5363334 +
caagtcatgatgcagcagtatt

SEQ ID NO: 106957 - DNA, 22 bp, Artificial Sequence
  Synthetic oligonucleotide; TTC chr11 5363313 5363334 5363330 5363335 +
aagtcatgatgcagcagtattg

SEQ ID NO: 106958 - DNA, 22 bp, Artificial Sequence
  Synthetic oligonucleotide; TTG chr11 5363335 5363356 5363352 5363357 +
gaattacagttttttttggttt

SEQ ID NO: 106959 - DNA, 22 bp, Artificial Sequence
  Synthetic oligonucleotide; TTA chr11 5363341 5363362 5363358 5363363 +
cagttttttttggtttttgttt

SEQ ID NO: 106960 - DNA, 22 bp, Artificial Sequence
  Synthetic oligonucleotide; TTT chr11 5363347 5363368 5363364 5363369 +
tttttggtttttgttttttttt

SEQ ID NO: 106961 - DNA, 22 bp, Artificial Sequence
  Synthetic oligonucleotide; TTT chr11 5363348 5363369 5363365 5363370 +
ttttggtttttgttttttttta

SEQ ID NO: 106962 - DNA, 22 bp, Artificial Sequence
  Synthetic oligonucleotide; TTT chr11 5363349 5363370 5363366 5363371 +
tttggtttttgtttttttttac

SEQ ID NO: 106963 - DNA, 22 bp, Artificial Sequence
  Synthetic oligonucleotide; TTT chr11 5363350 5363371 5363367 5363372 +
ttggtttttgtttttttttact

SEQ ID NO: 106964 - DNA, 22 bp, Artificial Sequence
  Synthetic oligonucleotide; TTT chr11 5363351 5363372 5363368 5363373 +
tggtttttgtttttttttactt

SEQ ID NO: 106965 - DNA, 22 bp, Artificial Sequence
  Synthetic oligonucleotide; TTT chr11 5363352 5363373 5363369 5363374 +
ggtttttgtttttttttacttc

SEQ ID NO: 106966 - DNA, 22 bp, Artificial Sequence
  Synthetic oligonucleotide; TTG chr11 5363353 5363374 5363370 5363375 +
gtttttgtttttttttacttca

SEQ ID NO: 106967 - DNA, 22 bp, Artificial Sequence
  Synthetic oligonucleotide; TTT chr11 5363357 5363378 5363374 5363379 +
ttgtttttttttacttcaagct

SEQ ID NO: 106968 - DNA, 22 bp, Artificial Sequence
  Synthetic oligonucleotide; TTT chr11 5363358 5363379 5363375 5363380 +
tgtttttttttacttcaagcta

SEQ ID NO: 106969 - DNA, 22 bp, Artificial Sequence
  Synthetic oligonucleotide; TTT chr11 5363359 5363380 5363376 5363381 +
gtttttttttacttcaagctat

SEQ ID NO: 106970 - DNA, 22 bp, Artificial Sequence
  Synthetic oligonucleotide; TTG chr11 5363360 5363381 5363377 5363382 +
tttttttttacttcaagctatg

SEQ ID NO: 106971 - DNA, 22 bp, Artificial Sequence
  Synthetic oligonucleotide; TTT chr11 5363363 5363384 5363380 5363385 +
ttttttacttcaagctatggtg

SEQ ID NO: 106972 - DNA, 22 bp, Artificial Sequence
  Synthetic oligonucleotide; TTT chr11 5363364 5363385 5363381 5363386 +
tttttacttcaagctatggtgt

SEQ ID NO: 106973 - DNA, 22 bp, Artificial Sequence
  Synthetic oligonucleotide; TTT chr11 5363365 5363386 5363382 5363387 +
ttttacttcaagctatggtgtt

SEQ ID NO: 106974 - DNA, 22 bp, Artificial Sequence
  Synthetic oligonucleotide; TTT chr11 5363366 5363387 5363383 5363388 +
tttacttcaagctatggtgttg

SEQ ID NO: 106975 - DNA, 22 bp, Artificial Sequence
  Synthetic oligonucleotide; TTT chr11 5363367 5363388 5363384 5363389 +
ttacttcaagctatggtgttga

SEQ ID NO: 106976 - DNA, 22 bp, Artificial Sequence
  Synthetic oligonucleotide; TTT chr11 5363368 5363389 5363385 5363390 +
tacttcaagctatggtgttgag

SEQ ID NO: 106977 - DNA, 22 bp, Artificial Sequence
  Synthetic oligonucleotide; TTT chr11 5363369 5363390 5363386 5363391 +
acttcaagctatggtgttgagt

SEQ ID NO: 106978 - DNA, 22 bp, Artificial Sequence
  Synthetic oligonucleotide; TTA chr11 5363370 5363391 5363387 5363392 +
cttcaagctatggtgttgagta

SEQ ID NO: 106979 - DNA, 22 bp, Artificial Sequence
  Synthetic oligonucleotide; CTT chr11 5363373 5363394 5363390 5363395 +
caagctatggtgttgagtacat

SEQ ID NO: 106980 - DNA, 22 bp, Artificial Sequence
  Synthetic oligonucleotide; TTC chr11 5363374 5363395 5363391 5363396 +
aagctatggtgttgagtacatg

SEQ ID NO: 106981 - DNA, 22 bp, Artificial Sequence
  Synthetic oligonucleotide; CTA chr11 5363380 5363401 5363397 5363402 +
tggtgttgagtacatgatccta

SEQ ID NO: 106982 - DNA, 22 bp, Artificial Sequence
  Synthetic oligonucleotide; TTG chr11 5363388 5363409 5363405 5363410 +
agtacatgatcctaatcaccaa

SEQ ID NO: 106983 - DNA, 22 bp, Artificial Sequence
  Synthetic oligonucleotide; CTA chr11 5363402 5363423 5363419 5363424 +
atcaccaattaattgttccttt

SEQ ID NO: 106984 - DNA, 22 bp, Artificial Sequence
  Synthetic oligonucleotide; TTA chr11 5363413 5363434 5363430 5363435 +
attgttcctttaagcccttaac

SEQ ID NO: 106985 - DNA, 22 bp, Artificial Sequence
  Synthetic oligonucleotide; TTG chr11 5363417 5363438 5363434 5363439 +
ttcctttaagcccttaacctct

SEQ ID NO: 106986 - DNA, 22 bp, Artificial Sequence
  Synthetic oligonucleotide; TTC chr11 5363420 5363441 5363437 5363442 +
ctttaagcccttaacctcttga

SEQ ID NO: 106987 - DNA, 22 bp, Artificial Sequence
  Synthetic oligonucleotide; CTT chr11 5363423 5363444 5363440 5363445 +
taagcccttaacctcttgacac

SEQ ID NO: 106988 - DNA, 22 bp, Artificial Sequence
  Synthetic oligonucleotide; TTT chr11 5363424 5363445 5363441 5363446 +
aagcccttaacctcttgacaca

SEQ ID NO: 106989 - DNA, 22 bp, Artificial Sequence
  Synthetic oligonucleotide; TTA chr11 5363425 5363446 5363442 5363447 +
agcccttaacctcttgacacac

SEQ ID NO: 106990 - DNA, 22 bp, Artificial Sequence
  Synthetic oligonucleotide; CTT chr11 5363432 5363453 5363449 5363454 +
aacctcttgacacacatacaca

SEQ ID NO: 106991 - DNA, 22 bp, Artificial Sequence
  Synthetic oligonucleotide; TTA chr11 5363433 5363454 5363450 5363455 +
acctcttgacacacatacacac

SEQ ID NO: 106992 - DNA, 22 bp, Artificial Sequence
  Synthetic oligonucleotide; CTC chr11 5363438 5363459 5363455 5363460 +
ttgacacacatacacacacact

SEQ ID NO: 106993 - DNA, 22 bp, Artificial Sequence
  Synthetic oligonucleotide; CTT chr11 5363440 5363461 5363457 5363462 +
gacacacatacacacacactct

SEQ ID NO: 106994 - DNA, 22 bp, Artificial Sequence
  Synthetic oligonucleotide; TTG chr11 5363441 5363462 5363458 5363463 +
acacacatacacacacactctc

SEQ ID NO: 106995 - DNA, 22 bp, Artificial Sequence
  Synthetic oligonucleotide; CTC chr11 5363461 5363482 5363478 5363483 +
tctctctcacacaaaagcgcca

SEQ ID NO: 106996 - DNA, 22 bp, Artificial Sequence
  Synthetic oligonucleotide; CTC chr11 5363463 5363484 5363480 5363485 +
tctctcacacaaaagcgccaca

SEQ ID NO: 106997 - DNA, 22 bp, Artificial Sequence
  Synthetic oligonucleotide; CTC chr11 5363465 5363486 5363482 5363487 +
tctcacacaaaagcgccacaca

SEQ ID NO: 106998 - DNA, 22 bp, Artificial Sequence
  Synthetic oligonucleotide; CTC chr11 5363467 5363488 5363484 5363489 +
tcacacaaaagcgccacacaca

SEQ ID NO: 106999 - DNA, 22 bp, Artificial Sequence
  Synthetic oligonucleotide; CTC chr11 5363469 5363490 5363486 5363491 +
acacaaaagcgccacacacaca

SEQ ID NO: 107000 - DNA, 22 bp, Artificial Sequence
  Synthetic oligonucleotide; CTC chr11 5363517 5363538 5363534 5363539 +
agctccatgaggtacactcact

SEQ ID NO: 107001 - DNA, 22 bp, Artificial Sequence
  Synthetic oligonucleotide; CTC chr11 5363522 5363543 5363539 5363544 +
catgaggtacactcactacttt

SEQ ID NO: 107002 - DNA, 22 bp, Artificial Sequence
  Synthetic oligonucleotide; CTC chr11 5363536 5363557 5363553 5363558 +
actacttttattaaaccaagca

SEQ ID NO: 107003 - DNA, 22 bp, Artificial Sequence
  Synthetic oligonucleotide; CTA chr11 5363540 5363561 5363557 5363562 +
cttttattaaaccaagcacaga

SEQ ID NO: 107004 - DNA, 22 bp, Artificial Sequence
  Synthetic oligonucleotide; CTT chr11 5363543 5363564 5363560 5363565 +
ttattaaaccaagcacagatac

SEQ ID NO: 107005 - DNA, 22 bp, Artificial Sequence
  Synthetic oligonucleotide; TTT chr11 5363544 5363565 5363561 5363566 +
tattaaaccaagcacagatacc

SEQ ID NO: 107006 - DNA, 22 bp, Artificial Sequence
  Synthetic oligonucleotide; TTT chr11 5363545 5363566 5363562 5363567 +
attaaaccaagcacagatacca

SEQ ID NO: 107007 - DNA, 22 bp, Artificial Sequence
  Synthetic oligonucleotide; TTA chr11 5363546 5363567 5363563 5363568 +
ttaaaccaagcacagataccaa

SEQ ID NO: 107008 - DNA, 22 bp, Artificial Sequence
  Synthetic oligonucleotide; TTA chr11 5363549 5363570 5363566 5363571 +
aaccaagcacagataccaagtt

SEQ ID NO: 107009 - DNA, 22 bp, Artificial Sequence
  Synthetic oligonucleotide; TTT chr11 5363572 5363593 5363589 5363594 +
ttgagtgtgaatgcagaaagaa

SEQ ID NO: 107010 - DNA, 22 bp, Artificial Sequence
  Synthetic oligonucleotide; TTT chr11 5363573 5363594 5363590 5363595 +
tgagtgtgaatgcagaaagaag

SEQ ID NO: 107011 - DNA, 22 bp, Artificial Sequence
  Synthetic oligonucleotide; TTT chr11 5363574 5363595 5363591 5363596 +
gagtgtgaatgcagaaagaaga

SEQ ID NO: 107012 - DNA, 22 bp, Artificial Sequence
  Synthetic oligonucleotide; TTG chr11 5363575 5363596 5363592 5363597 +
agtgtgaatgcagaaagaagat

SEQ ID NO: 107013 - DNA, 22 bp, Artificial Sequence
  Synthetic oligonucleotide; TTG chr11 5363603 5363624 5363620 5363625 +
aggtagatttttctcatagata

SEQ ID NO: 107014 - DNA, 22 bp, Artificial Sequence
  Synthetic oligonucleotide; TTT chr11 5363613 5363634 5363630 5363635 +
ttctcatagatactactaagat

SEQ ID NO: 107015 - DNA, 22 bp, Artificial Sequence
  Synthetic oligonucleotide; TTT chr11 5363614 5363635 5363631 5363636 +
tctcatagatactactaagatt

SEQ ID NO: 107016 - DNA, 22 bp, Artificial Sequence
  Synthetic oligonucleotide; TTT chr11 5363615 5363636 5363632 5363637 +
ctcatagatactactaagatta

SEQ ID NO: 107017 - DNA, 22 bp, Artificial Sequence
  Synthetic oligonucleotide; TTC chr11 5363616 5363637 5363633 5363638 +
tcatagatactactaagattat

SEQ ID NO: 107018 - DNA, 22 bp, Artificial Sequence
  Synthetic oligonucleotide; CTC chr11 5363618 5363639 5363635 5363640 +
atagatactactaagattatat

SEQ ID NO: 107019 - DNA, 22 bp, Artificial Sequence
  Synthetic oligonucleotide; CTA chr11 5363628 5363649 5363645 5363650 +
ctaagattatattgtctggaat

SEQ ID NO: 107020 - DNA, 22 bp, Artificial Sequence
  Synthetic oligonucleotide; CTA chr11 5363631 5363652 5363648 5363653 +
agattatattgtctggaatctt

SEQ ID NO: 107021 - DNA, 22 bp, Artificial Sequence
  Synthetic oligonucleotide; TTA chr11 5363637 5363658 5363654 5363659 +
tattgtctggaatcttatgtga

SEQ ID NO: 107022 - DNA, 22 bp, Artificial Sequence
  Synthetic oligonucleotide; TTG chr11 5363642 5363663 5363659 5363664 +
tctggaatcttatgtgacacag

SEQ ID NO: 107023 - DNA, 22 bp, Artificial Sequence
  Synthetic oligonucleotide; CTG chr11 5363646 5363667 5363663 5363668 +
gaatcttatgtgacacagaaaa

SEQ ID NO: 107024 - DNA, 22 bp, Artificial Sequence
  Synthetic oligonucleotide; CTT chr11 5363653 5363674 5363670 5363675 +
atgtgacacagaaaaagaacaa

SEQ ID NO: 107025 - DNA, 22 bp, Artificial Sequence
  Synthetic oligonucleotide; TTA chr11 5363654 5363675 5363671 5363676 +
tgtgacacagaaaaagaacaac

SEQ ID NO: 107026 - DNA, 22 bp, Artificial Sequence
  Synthetic oligonucleotide; CTC chr11 5363678 5363699 5363695 5363700 +
tgccatttggccatttgcttgt

SEQ ID NO: 107027 - DNA, 22 bp, Artificial Sequence
  Synthetic oligonucleotide; CTG chr11 5363680 5363701 5363697 5363702 +
ccatttggccatttgcttgtgt

SEQ ID NO: 107028 - DNA, 22 bp, Artificial Sequence
  Synthetic oligonucleotide; TTT chr11 5363686 5363707 5363703 5363708 +
ggccatttgcttgtgtttggac

SEQ ID NO: 107029 - DNA, 22 bp, Artificial Sequence
  Synthetic oligonucleotide; TTG chr11 5363687 5363708 5363704 5363709 +
gccatttgcttgtgtttggact

SEQ ID NO: 107030 - DNA, 22 bp, Artificial Sequence
  Synthetic oligonucleotide; TTT chr11 5363694 5363715 5363711 5363716 +
gcttgtgtttggacttgtgaag

SEQ ID NO: 107031 - DNA, 22 bp, Artificial Sequence
  Synthetic oligonucleotide; TTG chr11 5363695 5363716 5363712 5363717 +
cttgtgtttggacttgtgaagg

SEQ ID NO: 107032 - DNA, 22 bp, Artificial Sequence
  Synthetic oligonucleotide; CTT chr11 5363698 5363719 5363715 5363720 +
gtgtttggacttgtgaaggtct

SEQ ID NO: 107033 - DNA, 22 bp, Artificial Sequence
  Synthetic oligonucleotide; TTG chr11 5363699 5363720 5363716 5363721 +
tgtttggacttgtgaaggtctt

SEQ ID NO: 107034 - DNA, 22 bp, Artificial Sequence
  Synthetic oligonucleotide; TTT chr11 5363704 5363725 5363721 5363726 +
ggacttgtgaaggtctttccat

SEQ ID NO: 107035 - DNA, 22 bp, Artificial Sequence
  Synthetic oligonucleotide; TTG chr11 5363705 5363726 5363722 5363727 +
gacttgtgaaggtctttccatc

SEQ ID NO: 107036 - DNA, 22 bp, Artificial Sequence
  Synthetic oligonucleotide; CTT chr11 5363710 5363731 5363727 5363732 +
gtgaaggtctttccatcattct

SEQ ID NO: 107037 - DNA, 22 bp, Artificial Sequence
  Synthetic oligonucleotide; TTG chr11 5363711 5363732 5363728 5363733 +
tgaaggtctttccatcattctg

SEQ ID NO: 107038 - DNA, 22 bp, Artificial Sequence
  Synthetic oligonucleotide; CTT chr11 5363721 5363742 5363738 5363743 +
tccatcattctgttattggaaa

SEQ ID NO: 107039 - DNA, 22 bp, Artificial Sequence
  Synthetic oligonucleotide; TTT chr11 5363722 5363743 5363739 5363744 +
ccatcattctgttattggaaag

SEQ ID NO: 107040 - DNA, 22 bp, Artificial Sequence
  Synthetic oligonucleotide; TTC chr11 5363723 5363744 5363740 5363745 +
catcattctgttattggaaagc

SEQ ID NO: 107041 - DNA, 22 bp, Artificial Sequence
  Synthetic oligonucleotide; TTC chr11 5363731 5363752 5363748 5363753 +
tgttattggaaagcgggaaagt

SEQ ID NO: 107042 - DNA, 22 bp, Artificial Sequence
  Synthetic oligonucleotide; CTG chr11 5363733 5363754 5363750 5363755 +
ttattggaaagcgggaaagtag

SEQ ID NO: 107043 - DNA, 22 bp, Artificial Sequence
  Synthetic oligonucleotide; TTA chr11 5363736 5363757 5363753 5363758 +
ttggaaagcgggaaagtagcat

SEQ ID NO: 107044 - DNA, 22 bp, Artificial Sequence
  Synthetic oligonucleotide; TTG chr11 5363739 5363760 5363756 5363761 +
gaaagcgggaaagtagcatttt

SEQ ID NO: 107045 - DNA, 22 bp, Artificial Sequence
  Synthetic oligonucleotide; TTT chr11 5363760 5363781 5363777 5363782 +
tcatgaggattctattaaaaac

SEQ ID NO: 107046 - DNA, 22 bp, Artificial Sequence
  Synthetic oligonucleotide; TTT chr11 5363761 5363782 5363778 5363783 +
catgaggattctattaaaaact

SEQ ID NO: 107047 - DNA, 22 bp, Artificial Sequence
  Synthetic oligonucleotide; TTC chr11 5363762 5363783 5363779 5363784 +
atgaggattctattaaaaacta

SEQ ID NO: 107048 - DNA, 22 bp, Artificial Sequence
  Synthetic oligonucleotide; TTC chr11 5363772 5363793 5363789 5363794 +
tattaaaaactagggaccatat

SEQ ID NO: 107049 - DNA, 22 bp, Artificial Sequence
  Synthetic oligonucleotide; CTA chr11 5363774 5363795 5363791 5363796 +
ttaaaaactagggaccatatgc

SEQ ID NO: 107050 - DNA, 22 bp, Artificial Sequence
  Synthetic oligonucleotide; TTA chr11 5363777 5363798 5363794 5363799 +
aaaactagggaccatatgcaat

SEQ ID NO: 107051 - DNA, 22 bp, Artificial Sequence
  Synthetic oligonucleotide; CTA chr11 5363784 5363805 5363801 5363806 +
gggaccatatgcaatacatcca

SEQ ID NO: 107052 - DNA, 22 bp, Artificial Sequence
  Synthetic oligonucleotide; CTA chr11 5363811 5363832 5363828 5363833 +
tatttagtgtacaatagaaagc

SEQ ID NO: 107053 - DNA, 22 bp, Artificial Sequence
  Synthetic oligonucleotide; TTT chr11 5363816 5363837 5363833 5363838 +
agtgtacaatagaaagcaatta

SEQ ID NO: 107054 - DNA, 22 bp, Artificial Sequence
  Synthetic oligonucleotide; TTA chr11 5363817 5363838 5363834 5363839 +
gtgtacaatagaaagcaattac

SEQ ID NO: 107055 - DNA, 22 bp, Artificial Sequence
  Synthetic oligonucleotide; TTA chr11 5363838 5363859 5363855 5363860 +
ccatagcaattatgttccctag

SEQ ID NO: 107056 - DNA, 22 bp, Artificial Sequence
  Synthetic oligonucleotide; TTA chr11 5363850 5363871 5363867 5363872 +
tgttccctagctgtcttctctc

SEQ ID NO: 107057 - DNA, 22 bp, Artificial Sequence
  Synthetic oligonucleotide; TTC chr11 5363855 5363876 5363872 5363877 +
cctagctgtcttctctctttgc

SEQ ID NO: 107058 - DNA, 22 bp, Artificial Sequence
  Synthetic oligonucleotide; CTA chr11 5363859 5363880 5363876 5363881 +
gctgtcttctctctttgcaaac

SEQ ID NO: 107059 - DNA, 22 bp, Artificial Sequence
  Synthetic oligonucleotide; CTG chr11 5363863 5363884 5363880 5363885 +
tcttctctctttgcaaacccca

SEQ ID NO: 107060 - DNA, 22 bp, Artificial Sequence
  Synthetic oligonucleotide; CTT chr11 5363867 5363888 5363884 5363889 +
ctctctttgcaaaccccagccc

SEQ ID NO: 107061 - DNA, 22 bp, Artificial Sequence
  Synthetic oligonucleotide; TTC chr11 5363868 5363889 5363885 5363890 +
tctctttgcaaaccccagcccc

SEQ ID NO: 107062 - DNA, 22 bp, Artificial Sequence
  Synthetic oligonucleotide; CTC chr11 5363870 5363891 5363887 5363892 +
tctttgcaaaccccagccccca

SEQ ID NO: 107063 - DNA, 22 bp, Artificial Sequence
  Synthetic oligonucleotide; CTC chr11 5363872 5363893 5363889 5363894 +
tttgcaaaccccagcccccact

SEQ ID NO: 107064 - DNA, 22 bp, Artificial Sequence
  Synthetic oligonucleotide; CTT chr11 5363874 5363895 5363891 5363896 +
tgcaaaccccagcccccactca

SEQ ID NO: 107065 - DNA, 22 bp, Artificial Sequence
  Synthetic oligonucleotide; TTT chr11 5363875 5363896 5363892 5363897 +
gcaaaccccagcccccactcag

SEQ ID NO: 107066 - DNA, 22 bp, Artificial Sequence
  Synthetic oligonucleotide; TTG chr11 5363876 5363897 5363893 5363898 +
caaaccccagcccccactcagc

SEQ ID NO: 107067 - DNA, 22 bp, Artificial Sequence
  Synthetic oligonucleotide; CTC chr11 5363895 5363916 5363912 5363917 +
agcatgacatggcaggtataaa

SEQ ID NO: 107068 - DNA, 22 bp, Artificial Sequence
  Synthetic oligonucleotide; CTC chr11 5363929 5363950 5363946 5363951 +
agacccatttctgtaaaggagg

SEQ ID NO: 107069 - DNA, 22 bp, Artificial Sequence
  Synthetic oligonucleotide; TTT chr11 5363939 5363960 5363956 5363961 +
ctgtaaaggaggagaagcttgt

SEQ ID NO: 107070 - DNA, 22 bp, Artificial Sequence
  Synthetic oligonucleotide; TTC chr11 5363940 5363961 5363957 5363962 +
tgtaaaggaggagaagcttgtg

SEQ ID NO: 107071 - DNA, 22 bp, Artificial Sequence
  Synthetic oligonucleotide; CTG chr11 5363942 5363963 5363959 5363964 +
taaaggaggagaagcttgtgtt

SEQ ID NO: 107072 - DNA, 22 bp, Artificial Sequence
  Synthetic oligonucleotide; CTT chr11 5363959 5363980 5363976 5363981 +
gtgttaggaatggaagaatgcc

SEQ ID NO: 107073 - DNA, 22 bp, Artificial Sequence
  Synthetic oligonucleotide; TTG chr11 5363960 5363981 5363977 5363982 +
tgttaggaatggaagaatgcct

SEQ ID NO: 107074 - DNA, 22 bp, Artificial Sequence
  Synthetic oligonucleotide; TTA chr11 5363965 5363986 5363982 5363987 +
ggaatggaagaatgcctgggct

SEQ ID NO: 107075 - DNA, 22 bp, Artificial Sequence
  Synthetic oligonucleotide; CTG chr11 5363983 5364004 5364000 5364005 +
ggctggagaacagggcttcaca

SEQ ID NO: 107076 - DNA, 22 bp, Artificial Sequence
  Synthetic oligonucleotide; CTG chr11 5363988 5364009 5364005 5364010 +
gagaacagggcttcacaacagt

SEQ ID NO: 107077 - DNA, 22 bp, Artificial Sequence
  Synthetic oligonucleotide; CTT chr11 5364001 5364022 5364018 5364023 +
cacaacagtgtagtgatagatt

SEQ ID NO: 107078 - DNA, 22 bp, Artificial Sequence
  Synthetic oligonucleotide; TTC chr11 5364002 5364023 5364019 5364024 +
acaacagtgtagtgatagattc

SEQ ID NO: 107079 - DNA, 22 bp, Artificial Sequence
  Synthetic oligonucleotide; TTC chr11 5364024 5364045 5364041 5364046 +
acccacatattatgtgatgtgg

SEQ ID NO: 107080 - DNA, 22 bp, Artificial Sequence
  Synthetic oligonucleotide; TTA chr11 5364036 5364057 5364053 5364058 +
tgtgatgtggacctctgagcca

SEQ ID NO: 107081 - DNA, 22 bp, Artificial Sequence
  Synthetic oligonucleotide; CTC chr11 5364051 5364072 5364068 5364073 +
tgagccaggtactatctcattc

SEQ ID NO: 107082 - DNA, 22 bp, Artificial Sequence
  Synthetic oligonucleotide; CTG chr11 5364053 5364074 5364070 5364075 +
agccaggtactatctcattctc

SEQ ID NO: 107083 - DNA, 22 bp, Artificial Sequence
  Synthetic oligonucleotide; CTA chr11 5364065 5364086 5364082 5364087 +
tctcattctccatggttgcaat

SEQ ID NO: 107084 - DNA, 22 bp, Artificial Sequence
  Synthetic oligonucleotide; CTC chr11 5364069 5364090 5364086 5364091 +
attctccatggttgcaataagg

SEQ ID NO: 107085 - DNA, 22 bp, Artificial Sequence
  Synthetic oligonucleotide; TTC chr11 5364073 5364094 5364090 5364095 +
tccatggttgcaataaggtcga

SEQ ID NO: 107086 - DNA, 22 bp, Artificial Sequence
  Synthetic oligonucleotide; CTC chr11 5364075 5364096 5364092 5364097 +
catggttgcaataaggtcgatt

SEQ ID NO: 107087 - DNA, 22 bp, Artificial Sequence
  Synthetic oligonucleotide; TTG chr11 5364083 5364104 5364100 5364105 +
caataaggtcgattatagattc

SEQ ID NO: 107088 - DNA, 22 bp, Artificial Sequence
  Synthetic oligonucleotide; TTA chr11 5364098 5364119 5364115 5364120 +
tagattcaataaaggaagaggt

SEQ ID NO: 107089 - DNA, 22 bp, Artificial Sequence
  Synthetic oligonucleotide; TTC chr11 5364105 5364126 5364122 5364127 +
aataaaggaagaggtatctcaa

SEQ ID NO: 107090 - DNA, 22 bp, Artificial Sequence
  Synthetic oligonucleotide; CTC chr11 5364125 5364146 5364142 5364147 +
aacactaaagaaagagtaaaat

SEQ ID NO: 107091 - DNA, 22 bp, Artificial Sequence
  Synthetic oligonucleotide; CTA chr11 5364132 5364153 5364149 5364154 +
aagaaagagtaaaattttcagg

SEQ ID NO: 107092 - DNA, 22 bp, Artificial Sequence
  Synthetic oligonucleotide; TTT chr11 5364149 5364170 5364166 5364171 +
tcagggttcaacaagcgaccac

SEQ ID NO: 107093 - DNA, 22 bp, Artificial Sequence
  Synthetic oligonucleotide; TTT chr11 5364150 5364171 5364167 5364172 +
cagggttcaacaagcgaccacc

SEQ ID NO: 107094 - DNA, 22 bp, Artificial Sequence
  Synthetic oligonucleotide; TTC chr11 5364151 5364172 5364168 5364173 +
agggttcaacaagcgaccacct

SEQ ID NO: 107095 - DNA, 22 bp, Artificial Sequence
  Synthetic oligonucleotide; TTC chr11 5364158 5364179 5364175 5364180 +
aacaagcgaccacctaagggca

SEQ ID NO: 107096 - DNA, 22 bp, Artificial Sequence
  Synthetic oligonucleotide; CTA chr11 5364174 5364195 5364191 5364196 +
agggcaaaatattttcctaaat

SEQ ID NO: 107097 - DNA, 22 bp, Artificial Sequence
  Synthetic oligonucleotide; TTT chr11 5364188 5364209 5364205 5364210 +
tcctaaattttgacaaacttta

SEQ ID NO: 107098 - DNA, 22 bp, Artificial Sequence
  Synthetic oligonucleotide; TTT chr11 5364189 5364210 5364206 5364211 +
cctaaattttgacaaactttaa

SEQ ID NO: 107099 - DNA, 22 bp, Artificial Sequence
  Synthetic oligonucleotide; TTC chr11 5364190 5364211 5364207 5364212 +
ctaaattttgacaaactttaag

SEQ ID NO: 107100 - DNA, 22 bp, Artificial Sequence
  Synthetic oligonucleotide; CTA chr11 5364193 5364214 5364210 5364215 +
aattttgacaaactttaagttc

SEQ ID NO: 107101 - DNA, 22 bp, Artificial Sequence
  Synthetic oligonucleotide; TTT chr11 5364198 5364219 5364215 5364220 +
tgacaaactttaagttcaaaaa

SEQ ID NO: 107102 - DNA, 22 bp, Artificial Sequence
  Synthetic oligonucleotide; TTT chr11 5364199 5364220 5364216 5364221 +
gacaaactttaagttcaaaaag

SEQ ID NO: 107103 - DNA, 22 bp, Artificial Sequence
  Synthetic oligonucleotide; TTG chr11 5364200 5364221 5364217 5364222 +
acaaactttaagttcaaaaagc

SEQ ID NO: 107104 - DNA, 22 bp, Artificial Sequence
  Synthetic oligonucleotide; CTT chr11 5364208 5364229 5364225 5364230 +
taagttcaaaaagctcatctag

SEQ ID NO: 107105 - DNA, 22 bp, Artificial Sequence
  Synthetic oligonucleotide; TTT chr11 5364209 5364230 5364226 5364231 +
aagttcaaaaagctcatctagc

SEQ ID NO: 107106 - DNA, 22 bp, Artificial Sequence
  Synthetic oligonucleotide; TTA chr11 5364210 5364231 5364227 5364232 +
agttcaaaaagctcatctagct

SEQ ID NO: 107107 - DNA, 22 bp, Artificial Sequence
  Synthetic oligonucleotide; TTC chr11 5364215 5364236 5364232 5364237 +
aaaaagctcatctagctatgac

SEQ ID NO: 107108 - DNA, 22 bp, Artificial Sequence
  Synthetic oligonucleotide; CTC chr11 5364224 5364245 5364241 5364246 +
atctagctatgacaaagtttga

SEQ ID NO: 107109 - DNA, 22 bp, Artificial Sequence
  Synthetic oligonucleotide; CTA chr11 5364229 5364250 5364246 5364251 +
gctatgacaaagtttgacatag

SEQ ID NO: 107110 - DNA, 22 bp, Artificial Sequence
  Synthetic oligonucleotide; CTA chr11 5364233 5364254 5364250 5364255 +
tgacaaagtttgacatagttag

SEQ ID NO: 107111 - DNA, 22 bp, Artificial Sequence
  Synthetic oligonucleotide; TTT chr11 5364244 5364265 5364261 5364266 +
gacatagttagatgagcttttg

SEQ ID NO: 107112 - DNA, 22 bp, Artificial Sequence
  Synthetic oligonucleotide; TTG chr11 5364245 5364266 5364262 5364267 +
acatagttagatgagcttttga

SEQ ID NO: 107113 - DNA, 22 bp, Artificial Sequence
  Synthetic oligonucleotide; TTA chr11 5364254 5364275 5364271 5364276 +
gatgagcttttgatctgtgcac

SEQ ID NO: 107114 - DNA, 22 bp, Artificial Sequence
  Synthetic oligonucleotide; CTT chr11 5364263 5364284 5364280 5364285 +
ttgatctgtgcactttccctcg

SEQ ID NO: 107115 - DNA, 22 bp, Artificial Sequence
  Synthetic oligonucleotide; TTT chr11 5364264 5364285 5364281 5364286 +
tgatctgtgcactttccctcga

SEQ ID NO: 107116 - DNA, 22 bp, Artificial Sequence
  Synthetic oligonucleotide; TTT chr11 5364265 5364286 5364282 5364287 +
gatctgtgcactttccctcgac

SEQ ID NO: 107117 - DNA, 22 bp, Artificial Sequence
  Synthetic oligonucleotide; TTG chr11 5364266 5364287 5364283 5364288 +
atctgtgcactttccctcgacc

SEQ ID NO: 107118 - DNA, 22 bp, Artificial Sequence
  Synthetic oligonucleotide; CTG chr11 5364271 5364292 5364288 5364293 +
tgcactttccctcgaccttgac

SEQ ID NO: 107119 - DNA, 22 bp, Artificial Sequence
  Synthetic oligonucleotide; CTT chr11 5364278 5364299 5364295 5364300 +
tccctcgaccttgaccaccaat

SEQ ID NO: 107120 - DNA, 22 bp, Artificial Sequence
  Synthetic oligonucleotide; TTT chr11 5364279 5364300 5364296 5364301 +
ccctcgaccttgaccaccaatc

SEQ ID NO: 107121 - DNA, 22 bp, Artificial Sequence
  Synthetic oligonucleotide; TTC chr11 5364280 5364301 5364297 5364302 +
cctcgaccttgaccaccaatct

SEQ ID NO: 107122 - DNA, 22 bp, Artificial Sequence
  Synthetic oligonucleotide; CTC chr11 5364284 5364305 5364301 5364306 +
gaccttgaccaccaatcttgac

SEQ ID NO: 107123 - DNA, 22 bp, Artificial Sequence
  Synthetic oligonucleotide; CTT chr11 5364290 5364311 5364307 5364312 +
gaccaccaatcttgacttcaca

SEQ ID NO: 107124 - DNA, 22 bp, Artificial Sequence
  Synthetic oligonucleotide; TTG chr11 5364291 5364312 5364308 5364313 +
accaccaatcttgacttcacaa

SEQ ID NO: 107125 - DNA, 22 bp, Artificial Sequence
  Synthetic oligonucleotide; CTT chr11 5364303 5364324 5364320 5364325 +
gacttcacaaaaccattggaat

SEQ ID NO: 107126 - DNA, 22 bp, Artificial Sequence
  Synthetic oligonucleotide; TTG chr11 5364304 5364325 5364321 5364326 +
acttcacaaaaccattggaatt

SEQ ID NO: 107127 - DNA, 22 bp, Artificial Sequence
  Synthetic oligonucleotide; CTT chr11 5364308 5364329 5364325 5364330 +
cacaaaaccattggaatttggg

SEQ ID NO: 107128 - DNA, 22 bp, Artificial Sequence
  Synthetic oligonucleotide; TTC chr11 5364309 5364330 5364326 5364331 +
acaaaaccattggaatttgggg

SEQ ID NO: 107129 - DNA, 22 bp, Artificial Sequence
  Synthetic oligonucleotide; TTG chr11 5364321 5364342 5364338 5364343 +
gaatttggggtgatatggaggc

SEQ ID NO: 107130 - DNA, 22 bp, Artificial Sequence
  Synthetic oligonucleotide; TTT chr11 5364327 5364348 5364344 5364349 +
ggggtgatatggaggcaagcca

SEQ ID NO: 107131 - DNA, 22 bp, Artificial Sequence
  Synthetic oligonucleotide; TTG chr11 5364328 5364349 5364345 5364350 +
gggtgatatggaggcaagccaa

SEQ ID NO: 107132 - DNA, 22 bp, Artificial Sequence
  Synthetic oligonucleotide; CTA chr11 5364380 5364401 5364397 5364402 +
tgatgcagtttaggagctatgt

SEQ ID NO: 107133 - DNA, 22 bp, Artificial Sequence
  Synthetic oligonucleotide; TTT chr11 5364391 5364412 5364408 5364413 +
aggagctatgtgatgtgtcatt

SEQ ID NO: 107134 - DNA, 22 bp, Artificial Sequence
  Synthetic oligonucleotide; TTA chr11 5364392 5364413 5364409 5364414 +
ggagctatgtgatgtgtcattt

SEQ ID NO: 107135 - DNA, 22 bp, Artificial Sequence
  Synthetic oligonucleotide; CTA chr11 5364399 5364420 5364416 5364421 +
tgtgatgtgtcatttctgtgac

SEQ ID NO: 107136 - DNA, 22 bp, Artificial Sequence
  Synthetic oligonucleotide; TTT chr11 5364414 5364435 5364431 5364436 +
ctgtgacaggatatgagagctg

SEQ ID NO: 107137 - DNA, 22 bp, Artificial Sequence
  Synthetic oligonucleotide; TTC chr11 5364415 5364436 5364432 5364437 +
tgtgacaggatatgagagctgc

SEQ ID NO: 107138 - DNA, 22 bp, Artificial Sequence
  Synthetic oligonucleotide; CTG chr11 5364417 5364438 5364434 5364439 +
tgacaggatatgagagctgcac

SEQ ID NO: 107139 - DNA, 22 bp, Artificial Sequence
  Synthetic oligonucleotide; CTG chr11 5364436 5364457 5364453 5364458 +
cacatctttctgtttagaaatt

SEQ ID NO: 107140 - DNA, 22 bp, Artificial Sequence
  Synthetic oligonucleotide; CTT chr11 5364444 5364465 5364461 5364466 +
tctgtttagaaattcctgccat

SEQ ID NO: 107141 - DNA, 22 bp, Artificial Sequence
  Synthetic oligonucleotide; TTT chr11 5364445 5364466 5364462 5364467 +
ctgtttagaaattcctgccata

SEQ ID NO: 107142 - DNA, 22 bp, Artificial Sequence
  Synthetic oligonucleotide; TTC chr11 5364446 5364467 5364463 5364468 +
tgtttagaaattcctgccatat

SEQ ID NO: 107143 - DNA, 22 bp, Artificial Sequence
  Synthetic oligonucleotide; CTG chr11 5364448 5364469 5364465 5364470 +
tttagaaattcctgccatattt

SEQ ID NO: 107144 - DNA, 22 bp, Artificial Sequence
  Synthetic oligonucleotide; TTT chr11 5364451 5364472 5364468 5364473 +
agaaattcctgccatatttgta

SEQ ID NO: 107145 - DNA, 22 bp, Artificial Sequence
  Synthetic oligonucleotide; TTA chr11 5364452 5364473 5364469 5364474 +
gaaattcctgccatatttgtaa

SEQ ID NO: 107146 - DNA, 22 bp, Artificial Sequence
  Synthetic oligonucleotide; TTC chr11 5364459 5364480 5364476 5364481 +
ctgccatatttgtaattctcaa

SEQ ID NO: 107147 - DNA, 22 bp, Artificial Sequence
  Synthetic oligonucleotide; CTG chr11 5364462 5364483 5364479 5364484 +
ccatatttgtaattctcaatgg

SEQ ID NO: 107148 - DNA, 22 bp, Artificial Sequence
  Synthetic oligonucleotide; TTT chr11 5364470 5364491 5364487 5364492 +
gtaattctcaatggtcagtctc

SEQ ID NO: 107149 - DNA, 22 bp, Artificial Sequence
  Synthetic oligonucleotide; TTG chr11 5364471 5364492 5364488 5364493 +
taattctcaatggtcagtctcc

SEQ ID NO: 107150 - DNA, 22 bp, Artificial Sequence
  Synthetic oligonucleotide; TTC chr11 5364477 5364498 5364494 5364499 +
tcaatggtcagtctccttgctg

SEQ ID NO: 107151 - DNA, 22 bp, Artificial Sequence
  Synthetic oligonucleotide; CTC chr11 5364479 5364500 5364496 5364501 +
aatggtcagtctccttgctgga

SEQ ID NO: 107152 - DNA, 22 bp, Artificial Sequence
  Synthetic oligonucleotide; CTC chr11 5364492 5364513 5364509 5364514 +
cttgctggactataaattcaac

SEQ ID NO: 107153 - DNA, 22 bp, Artificial Sequence
  Synthetic oligonucleotide; CTT chr11 5364495 5364516 5364512 5364517 +
gctggactataaattcaactac

SEQ ID NO: 107154 - DNA, 22 bp, Artificial Sequence
  Synthetic oligonucleotide; TTG chr11 5364496 5364517 5364513 5364518 +
ctggactataaattcaactaca

SEQ ID NO: 107155 - DNA, 22 bp, Artificial Sequence
  Synthetic oligonucleotide; CTG chr11 5364499 5364520 5364516 5364521 +
gactataaattcaactacatgc

SEQ ID NO: 107156 - DNA, 22 bp, Artificial Sequence
  Synthetic oligonucleotide; CTA chr11 5364504 5364525 5364521 5364526 +
taaattcaactacatgccagct

SEQ ID NO: 107157 - DNA, 22 bp, Artificial Sequence
  Synthetic oligonucleotide; TTC chr11 5364511 5364532 5364528 5364533 +
aactacatgccagctttaagca

SEQ ID NO: 107158 - DNA, 22 bp, Artificial Sequence
  Synthetic oligonucleotide; CTA chr11 5364516 5364537 5364533 5364538 +
catgccagctttaagcacagtg

SEQ ID NO: 107159 - DNA, 22 bp, Artificial Sequence
  Synthetic oligonucleotide; CTT chr11 5364527 5364548 5364544 5364549 +
taagcacagtgctttgaagaga

SEQ ID NO: 107160 - DNA, 22 bp, Artificial Sequence
  Synthetic oligonucleotide; TTT chr11 5364528 5364549 5364545 5364550 +
aagcacagtgctttgaagagag

SEQ ID NO: 107161 - DNA, 22 bp, Artificial Sequence
  Synthetic oligonucleotide; TTA chr11 5364529 5364550 5364546 5364551 +
agcacagtgctttgaagagagt

SEQ ID NO: 107162 - DNA, 22 bp, Artificial Sequence
  Synthetic oligonucleotide; CTT chr11 5364541 5364562 5364558 5364563 +
tgaagagagtaggagcttaaaa

SEQ ID NO: 107163 - DNA, 22 bp, Artificial Sequence
  Synthetic oligonucleotide; TTT chr11 5364542 5364563 5364559 5364564 +
gaagagagtaggagcttaaaaa

SEQ ID NO: 107164 - DNA, 22 bp, Artificial Sequence
  Synthetic oligonucleotide; TTG chr11 5364543 5364564 5364560 5364565 +
aagagagtaggagcttaaaaaa

SEQ ID NO: 107165 - DNA, 22 bp, Artificial Sequence
  Synthetic oligonucleotide; CTT chr11 5364559 5364580 5364576 5364581 +
aaaaaatattctgtattaaatg

SEQ ID NO: 107166 - DNA, 22 bp, Artificial Sequence
  Synthetic oligonucleotide; TTA chr11 5364560 5364581 5364577 5364582 +
aaaaatattctgtattaaatga

SEQ ID NO: 107167 - DNA, 22 bp, Artificial Sequence
  Synthetic oligonucleotide; TTC chr11 5364570 5364591 5364587 5364592 +
tgtattaaatgaaaaaataaac

SEQ ID NO: 107168 - DNA, 22 bp, Artificial Sequence
  Synthetic oligonucleotide; CTG chr11 5364572 5364593 5364589 5364594 +
tattaaatgaaaaaataaacta

SEQ ID NO: 107169 - DNA, 22 bp, Artificial Sequence
  Synthetic oligonucleotide; TTA chr11 5364577 5364598 5364594 5364599 +
aatgaaaaaataaactaagcgt

SEQ ID NO: 107170 - DNA, 22 bp, Artificial Sequence
  Synthetic oligonucleotide; CTA chr11 5364594 5364615 5364611 5364616 +
agcgtgagaggtatttatgtgt

SEQ ID NO: 107171 - DNA, 22 bp, Artificial Sequence
  Synthetic oligonucleotide; TTT chr11 5364610 5364631 5364627 5364632 +
atgtgtctctctcttcctcttc

SEQ ID NO: 107172 - DNA, 22 bp, Artificial Sequence
  Synthetic oligonucleotide; TTA chr11 5364611 5364632 5364628 5364633 +
tgtgtctctctcttcctcttct

SEQ ID NO: 107173 - DNA, 22 bp, Artificial Sequence
  Synthetic oligonucleotide; CTC chr11 5364619 5364640 5364636 5364641 +
tctcttcctcttctcactccat

SEQ ID NO: 107174 - DNA, 22 bp, Artificial Sequence
  Synthetic oligonucleotide; CTC chr11 5364621 5364642 5364638 5364643 +
tcttcctcttctcactccatcc

SEQ ID NO: 107175 - DNA, 22 bp, Artificial Sequence
  Synthetic oligonucleotide; CTC chr11 5364623 5364644 5364640 5364645 +
ttcctcttctcactccatcctc

SEQ ID NO: 107176 - DNA, 22 bp, Artificial Sequence
  Synthetic oligonucleotide; CTT chr11 5364625 5364646 5364642 5364647 +
cctcttctcactccatcctcat

SEQ ID NO: 107177 - DNA, 22 bp, Artificial Sequence
  Synthetic oligonucleotide; TTC chr11 5364626 5364647 5364643 5364648 +
ctcttctcactccatcctcatg

SEQ ID NO: 107178 - DNA, 22 bp, Artificial Sequence
  Synthetic oligonucleotide; CTC chr11 5364629 5364650 5364646 5364651 +
ttctcactccatcctcatgtgc

SEQ ID NO: 107179 - DNA, 22 bp, Artificial Sequence
  Synthetic oligonucleotide; CTT chr11 5364631 5364652 5364648 5364653 +
ctcactccatcctcatgtgcat

SEQ ID NO: 107180 - DNA, 22 bp, Artificial Sequence
  Synthetic oligonucleotide; TTC chr11 5364632 5364653 5364649 5364654 +
tcactccatcctcatgtgcatc

SEQ ID NO: 107181 - DNA, 22 bp, Artificial Sequence
  Synthetic oligonucleotide; CTC chr11 5364634 5364655 5364651 5364656 +
actccatcctcatgtgcatctc

SEQ ID NO: 107182 - DNA, 22 bp, Artificial Sequence
  Synthetic oligonucleotide; CTC chr11 5364638 5364659 5364655 5364660 +
catcctcatgtgcatctctgaa

SEQ ID NO: 107183 - DNA, 22 bp, Artificial Sequence
  Synthetic oligonucleotide; CTC chr11 5364645 5364666 5364662 5364667 +
atgtgcatctctgaatatctct

SEQ ID NO: 107184 - DNA, 22 bp, Artificial Sequence
  Synthetic oligonucleotide; CTC chr11 5364656 5364677 5364673 5364678 +
tgaatatctctgattttgtgca

SEQ ID NO: 107185 - DNA, 22 bp, Artificial Sequence
  Synthetic oligonucleotide; CTG chr11 5364658 5364679 5364675 5364680 +
aatatctctgattttgtgcact

SEQ ID NO: 107186 - DNA, 22 bp, Artificial Sequence
  Synthetic oligonucleotide; CTC chr11 5364666 5364687 5364683 5364688 +
tgattttgtgcactctaaggca

SEQ ID NO: 107187 - DNA, 22 bp, Artificial Sequence
  Synthetic oligonucleotide; CTG chr11 5364668 5364689 5364685 5364690 +
attttgtgcactctaaggcagc

SEQ ID NO: 107188 - DNA, 22 bp, Artificial Sequence
  Synthetic oligonucleotide; TTT chr11 5364672 5364693 5364689 5364694 +
tgtgcactctaaggcagccctc

SEQ ID NO: 107189 - DNA, 22 bp, Artificial Sequence
  Synthetic oligonucleotide; TTT chr11 5364673 5364694 5364690 5364695 +
gtgcactctaaggcagccctct

SEQ ID NO: 107190 - DNA, 22 bp, Artificial Sequence
  Synthetic oligonucleotide; TTG chr11 5364674 5364695 5364691 5364696 +
tgcactctaaggcagccctcta

SEQ ID NO: 107191 - DNA, 22 bp, Artificial Sequence
  Synthetic oligonucleotide; CTC chr11 5364681 5364702 5364698 5364703 +
taaggcagccctctaagctgtt

SEQ ID NO: 107192 - DNA, 22 bp, Artificial Sequence
  Synthetic oligonucleotide; CTA chr11 5364683 5364704 5364700 5364705 +
aggcagccctctaagctgtttg

SEQ ID NO: 107193 - DNA, 22 bp, Artificial Sequence
  Synthetic oligonucleotide; CTC chr11 5364694 5364715 5364711 5364716 +
taagctgtttgcccatccagca

SEQ ID NO: 107194 - DNA, 22 bp, Artificial Sequence
  Synthetic oligonucleotide; CTA chr11 5364696 5364717 5364713 5364718 +
agctgtttgcccatccagcata

SEQ ID NO: 107195 - DNA, 22 bp, Artificial Sequence
  Synthetic oligonucleotide; CTG chr11 5364701 5364722 5364718 5364723 +
tttgcccatccagcatatgaca

SEQ ID NO: 107196 - DNA, 22 bp, Artificial Sequence
  Synthetic oligonucleotide; TTT chr11 5364704 5364725 5364721 5364726 +
gcccatccagcatatgacagaa

SEQ ID NO: 107197 - DNA, 22 bp, Artificial Sequence
  Synthetic oligonucleotide; TTG chr11 5364705 5364726 5364722 5364727 +
cccatccagcatatgacagaag

SEQ ID NO: 107198 - DNA, 22 bp, Artificial Sequence
  Synthetic oligonucleotide; CTC chr11 5364731 5364752 5364748 5364753 +
ttcaaagtgaatgatcaaagtc

SEQ ID NO: 107199 - DNA, 22 bp, Artificial Sequence
  Synthetic oligonucleotide; CTT chr11 5364733 5364754 5364750 5364755 +
caaagtgaatgatcaaagtccc

SEQ ID NO: 107200 - DNA, 22 bp, Artificial Sequence
  Synthetic oligonucleotide; TTC chr11 5364734 5364755 5364751 5364756 +
aaagtgaatgatcaaagtccct

SEQ ID NO: 107201 - DNA, 22 bp, Artificial Sequence
  Synthetic oligonucleotide; CTT chr11 5364757 5364778 5364774 5364779 +
gtttacagggtccccccaccct

SEQ ID NO: 107202 - DNA, 22 bp, Artificial Sequence
  Synthetic oligonucleotide; TTG chr11 5364758 5364779 5364775 5364780 +
tttacagggtccccccaccctc

SEQ ID NO: 107203 - DNA, 22 bp, Artificial Sequence
  Synthetic oligonucleotide; TTT chr11 5364761 5364782 5364778 5364783 +
acagggtccccccaccctcttc

SEQ ID NO: 107204 - DNA, 22 bp, Artificial Sequence
  Synthetic oligonucleotide; TTA chr11 5364762 5364783 5364779 5364784 +
cagggtccccccaccctcttcc

SEQ ID NO: 107205 - DNA, 22 bp, Artificial Sequence
  Synthetic oligonucleotide; CTC chr11 5364780 5364801 5364797 5364802 +
ttccttcctgagcatgtgttct

SEQ ID NO: 107206 - DNA, 22 bp, Artificial Sequence
  Synthetic oligonucleotide; CTT chr11 5364782 5364803 5364799 5364804 +
ccttcctgagcatgtgttctgg

SEQ ID NO: 107207 - DNA, 22 bp, Artificial Sequence
  Synthetic oligonucleotide; TTC chr11 5364783 5364804 5364800 5364805 +
cttcctgagcatgtgttctgga

SEQ ID NO: 107208 - DNA, 22 bp, Artificial Sequence
  Synthetic oligonucleotide; CTT chr11 5364786 5364807 5364803 5364808 +
cctgagcatgtgttctggatat

SEQ ID NO: 107209 - DNA, 22 bp, Artificial Sequence
  Synthetic oligonucleotide; TTC chr11 5364787 5364808 5364804 5364809 +
ctgagcatgtgttctggatatg

SEQ ID NO: 107210 - DNA, 22 bp, Artificial Sequence
  Synthetic oligonucleotide; CTG chr11 5364790 5364811 5364807 5364812 +
agcatgtgttctggatatgctg

SEQ ID NO: 107211 - DNA, 22 bp, Artificial Sequence
  Synthetic oligonucleotide; TTC chr11 5364801 5364822 5364818 5364823 +
tggatatgctgaagccaacctc

SEQ ID NO: 107212 - DNA, 22 bp, Artificial Sequence
  Synthetic oligonucleotide; CTG chr11 5364803 5364824 5364820 5364825 +
gatatgctgaagccaacctcac

SEQ ID NO: 107213 - DNA, 22 bp, Artificial Sequence
  Synthetic oligonucleotide; CTG chr11 5364812 5364833 5364829 5364834 +
aagccaacctcacaggactttg

SEQ ID NO: 107214 - DNA, 22 bp, Artificial Sequence
  Synthetic oligonucleotide; CTC chr11 5364823 5364844 5364840 5364845 +
acaggactttgttacctttcct

SEQ ID NO: 107215 - DNA, 22 bp, Artificial Sequence
  Synthetic oligonucleotide; CTT chr11 5364832 5364853 5364849 5364854 +
tgttacctttcctaagtttcta

SEQ ID NO: 107216 - DNA, 22 bp, Artificial Sequence
  Synthetic oligonucleotide; TTT chr11 5364833 5364854 5364850 5364855 +
gttacctttcctaagtttctat

SEQ ID NO: 107217 - DNA, 22 bp, Artificial Sequence
  Synthetic oligonucleotide; TTG chr11 5364834 5364855 5364851 5364856 +
ttacctttcctaagtttctatt

SEQ ID NO: 107218 - DNA, 22 bp, Artificial Sequence
  Synthetic oligonucleotide; TTA chr11 5364837 5364858 5364854 5364859 +
cctttcctaagtttctattggt

SEQ ID NO: 107219 - DNA, 22 bp, Artificial Sequence
  Synthetic oligonucleotide; CTT chr11 5364841 5364862 5364858 5364863 +
tcctaagtttctattggtgaat

SEQ ID NO: 107220 - DNA, 22 bp, Artificial Sequence
  Synthetic oligonucleotide; TTT chr11 5364842 5364863 5364859 5364864 +
cctaagtttctattggtgaatt

SEQ ID NO: 107221 - DNA, 22 bp, Artificial Sequence
  Synthetic oligonucleotide; TTC chr11 5364843 5364864 5364860 5364865 +
ctaagtttctattggtgaattt

SEQ ID NO: 107222 - DNA, 22 bp, Artificial Sequence
  Synthetic oligonucleotide; CTA chr11 5364846 5364867 5364863 5364868 +
agtttctattggtgaatttcca

SEQ ID NO: 107223 - DNA, 22 bp, Artificial Sequence
  Synthetic oligonucleotide; TTT chr11 5364851 5364872 5364868 5364873 +
ctattggtgaatttccatttaa

SEQ ID NO: 107224 - DNA, 22 bp, Artificial Sequence
  Synthetic oligonucleotide; TTC chr11 5364852 5364873 5364869 5364874 +
tattggtgaatttccatttaat

SEQ ID NO: 107225 - DNA, 22 bp, Artificial Sequence
  Synthetic oligonucleotide; CTA chr11 5364854 5364875 5364871 5364876 +
ttggtgaatttccatttaatat

SEQ ID NO: 107226 - DNA, 22 bp, Artificial Sequence
  Synthetic oligonucleotide; TTG chr11 5364857 5364878 5364874 5364879 +
gtgaatttccatttaatatagt

SEQ ID NO: 107227 - DNA, 22 bp, Artificial Sequence
  Synthetic oligonucleotide; TTT chr11 5364865 5364886 5364882 5364887 +
ccatttaatatagttttattaa

SEQ ID NO: 107228 - DNA, 22 bp, Artificial Sequence
  Synthetic oligonucleotide; TTC chr11 5364866 5364887 5364883 5364888 +
catttaatatagttttattaaa

SEQ ID NO: 107229 - DNA, 22 bp, Artificial Sequence
  Synthetic oligonucleotide; TTT chr11 5364871 5364892 5364888 5364893 +
aatatagttttattaaatgatt

SEQ ID NO: 107230 - DNA, 22 bp, Artificial Sequence
  Synthetic oligonucleotide; TTA chr11 5364872 5364893 5364889 5364894 +
atatagttttattaaatgattt

SEQ ID NO: 107231 - DNA, 22 bp, Artificial Sequence
  Synthetic oligonucleotide; TTT chr11 5364881 5364902 5364898 5364903 +
tattaaatgattttagtaaata

SEQ ID NO: 107232 - DNA, 22 bp, Artificial Sequence
  Synthetic oligonucleotide; TTT chr11 5364882 5364903 5364899 5364904 +
attaaatgattttagtaaataa

SEQ ID NO: 107233 - DNA, 22 bp, Artificial Sequence
  Synthetic oligonucleotide; TTA chr11 5364883 5364904 5364900 5364905 +
ttaaatgattttagtaaataat

SEQ ID NO: 107234 - DNA, 22 bp, Artificial Sequence
  Synthetic oligonucleotide; TTA chr11 5364886 5364907 5364903 5364908 +
aatgattttagtaaataatttt

SEQ ID NO: 107235 - DNA, 22 bp, Artificial Sequence
  Synthetic oligonucleotide; TTT chr11 5364894 5364915 5364911 5364916 +
tagtaaataatttttaatcatt

SEQ ID NO: 107236 - DNA, 22 bp, Artificial Sequence
  Synthetic oligonucleotide; TTT chr11 5364895 5364916 5364912 5364917 +
agtaaataatttttaatcattg

SEQ ID NO: 107237 - DNA, 22 bp, Artificial Sequence
  Synthetic oligonucleotide; TTA chr11 5364896 5364917 5364913 5364918 +
gtaaataatttttaatcattgt

SEQ ID NO: 107238 - DNA, 22 bp, Artificial Sequence
  Synthetic oligonucleotide; TTT chr11 5364907 5364928 5364924 5364929 +
ttaatcattgtagcttctatgg

SEQ ID NO: 107239 - DNA, 22 bp, Artificial Sequence
  Synthetic oligonucleotide; TTT chr11 5364908 5364929 5364925 5364930 +
taatcattgtagcttctatggt

SEQ ID NO: 107240 - DNA, 22 bp, Artificial Sequence
  Synthetic oligonucleotide; TTT chr11 5364909 5364930 5364926 5364931 +
aatcattgtagcttctatggtg

SEQ ID NO: 107241 - DNA, 22 bp, Artificial Sequence
  Synthetic oligonucleotide; TTA chr11 5364910 5364931 5364927 5364932 +
atcattgtagcttctatggtgg

SEQ ID NO: 107242 - DNA, 22 bp, Artificial Sequence
  Synthetic oligonucleotide; TTG chr11 5364917 5364938 5364934 5364939 +
tagcttctatggtggatacaca

SEQ ID NO: 107243 - DNA, 22 bp, Artificial Sequence
  Synthetic oligonucleotide; CTT chr11 5364923 5364944 5364940 5364945 +
ctatggtggatacacaaggaga

SEQ ID NO: 107244 - DNA, 22 bp, Artificial Sequence
  Synthetic oligonucleotide; TTC chr11 5364924 5364945 5364941 5364946 +
tatggtggatacacaaggagaa

SEQ ID NO: 107245 - DNA, 22 bp, Artificial Sequence
  Synthetic oligonucleotide; CTA chr11 5364926 5364947 5364943 5364948 +
tggtggatacacaaggagaagc

SEQ ID NO: 107246 - DNA, 22 bp, Artificial Sequence
  Synthetic oligonucleotide; CTA chr11 5364985 5365006 5365002 5365007 +
caaggggatttctcaagtaact

SEQ ID NO: 107247 - DNA, 22 bp, Artificial Sequence
  Synthetic oligonucleotide; TTT chr11 5364996 5365017 5365013 5365018 +
ctcaagtaactgcttcttcttg

SEQ ID NO: 107248 - DNA, 22 bp, Artificial Sequence
  Synthetic oligonucleotide; TTC chr11 5364997 5365018 5365014 5365019 +
tcaagtaactgcttcttcttgt

SEQ ID NO: 107249 - DNA, 22 bp, Artificial Sequence
  Synthetic oligonucleotide; CTC chr11 5364999 5365020 5365016 5365021 +
aagtaactgcttcttcttgtca

SEQ ID NO: 107250 - DNA, 22 bp, Artificial Sequence
  Synthetic oligonucleotide; CTG chr11 5365008 5365029 5365025 5365030 +
cttcttcttgtcattcttgtca

SEQ ID NO: 107251 - DNA, 22 bp, Artificial Sequence
  Synthetic oligonucleotide; CTT chr11 5365011 5365032 5365028 5365033 +
cttcttgtcattcttgtcacag

SEQ ID NO: 107252 - DNA, 22 bp, Artificial Sequence
  Synthetic oligonucleotide; TTC chr11 5365012 5365033 5365029 5365034 +
ttcttgtcattcttgtcacagc

SEQ ID NO: 107253 - DNA, 22 bp, Artificial Sequence
  Synthetic oligonucleotide; CTT chr11 5365014 5365035 5365031 5365036 +
cttgtcattcttgtcacagcaa

SEQ ID NO: 107254 - DNA, 22 bp, Artificial Sequence
  Synthetic oligonucleotide; TTC chr11 5365015 5365036 5365032 5365037 +
ttgtcattcttgtcacagcaat

SEQ ID NO: 107255 - DNA, 22 bp, Artificial Sequence
  Synthetic oligonucleotide; CTT chr11 5365017 5365038 5365034 5365039 +
gtcattcttgtcacagcaatga

SEQ ID NO: 107256 - DNA, 22 bp, Artificial Sequence
  Synthetic oligonucleotide; TTG chr11 5365018 5365039 5365035 5365040 +
tcattcttgtcacagcaatgaa

SEQ ID NO: 107257 - DNA, 22 bp, Artificial Sequence
  Synthetic oligonucleotide; TTC chr11 5365024 5365045 5365041 5365046 +
ttgtcacagcaatgaatcttgg

SEQ ID NO: 107258 - DNA, 22 bp, Artificial Sequence
  Synthetic oligonucleotide; CTT chr11 5365026 5365047 5365043 5365048 +
gtcacagcaatgaatcttgggc

SEQ ID NO: 107259 - DNA, 22 bp, Artificial Sequence
  Synthetic oligonucleotide; TTG chr11 5365027 5365048 5365044 5365049 +
tcacagcaatgaatcttgggca

SEQ ID NO: 107260 - DNA, 22 bp, Artificial Sequence
  Synthetic oligonucleotide; CTT chr11 5365044 5365065 5365061 5365066 +
gggcaaataagggacactcaat

SEQ ID NO: 107261 - DNA, 22 bp, Artificial Sequence
  Synthetic oligonucleotide; TTG chr11 5365045 5365066 5365062 5365067 +
ggcaaataagggacactcaata

SEQ ID NO: 107262 - DNA, 22 bp, Artificial Sequence
  Synthetic oligonucleotide; CTC chr11 5365063 5365084 5365080 5365085 +
aataaaaccaaatgtgtcaata

SEQ ID NO: 107263 - DNA, 22 bp, Artificial Sequence
  Synthetic oligonucleotide; CTT chr11 5365094 5365115 5365111 5365116 +
gtaataaccttgaattcaagtg

SEQ ID NO: 107264 - DNA, 22 bp, Artificial Sequence
  Synthetic oligonucleotide; TTG chr11 5365095 5365116 5365112 5365117 +
taataaccttgaattcaagtgg

SEQ ID NO: 107265 - DNA, 22 bp, Artificial Sequence
  Synthetic oligonucleotide; CTT chr11 5365105 5365126 5365122 5365127 +
gaattcaagtggtagcttatca

SEQ ID NO: 107266 - DNA, 22 bp, Artificial Sequence
  Synthetic oligonucleotide; TTG chr11 5365106 5365127 5365123 5365128 +
aattcaagtggtagcttatcac

SEQ ID NO: 107267 - DNA, 22 bp, Artificial Sequence
  Synthetic oligonucleotide; TTC chr11 5365111 5365132 5365128 5365133 +
aagtggtagcttatcacaactg

SEQ ID NO: 107268 - DNA, 22 bp, Artificial Sequence
  Synthetic oligonucleotide; CTT chr11 5365123 5365144 5365140 5365145 +
atcacaactgctaaataacttt

SEQ ID NO: 107269 - DNA, 22 bp, Artificial Sequence
  Synthetic oligonucleotide; TTA chr11 5365124 5365145 5365141 5365146 +
tcacaactgctaaataactttt

SEQ ID NO: 107270 - DNA, 22 bp, Artificial Sequence
  Synthetic oligonucleotide; CTG chr11 5365133 5365154 5365150 5365155 +
ctaaataacttttcttctttgt

SEQ ID NO: 107271 - DNA, 22 bp, Artificial Sequence
  Synthetic oligonucleotide; CTA chr11 5365136 5365157 5365153 5365158 +
aataacttttcttctttgtctg

SEQ ID NO: 107272 - DNA, 22 bp, Artificial Sequence
  Synthetic oligonucleotide; CTT chr11 5365144 5365165 5365161 5365166 +
ttcttctttgtctggtgagttc

SEQ ID NO: 107273 - DNA, 22 bp, Artificial Sequence
  Synthetic oligonucleotide; TTT chr11 5365145 5365166 5365162 5365167 +
tcttctttgtctggtgagttct

SEQ ID NO: 107274 - DNA, 22 bp, Artificial Sequence
  Synthetic oligonucleotide; TTT chr11 5365146 5365167 5365163 5365168 +
cttctttgtctggtgagttctg

SEQ ID NO: 107275 - DNA, 22 bp, Artificial Sequence
  Synthetic oligonucleotide; TTC chr11 5365147 5365168 5365164 5365169 +
ttctttgtctggtgagttctgt

SEQ ID NO: 107276 - DNA, 22 bp, Artificial Sequence
  Synthetic oligonucleotide; CTT chr11 5365149 5365170 5365166 5365171 +
ctttgtctggtgagttctgtag

SEQ ID NO: 107277 - DNA, 22 bp, Artificial Sequence
  Synthetic oligonucleotide; TTC chr11 5365150 5365171 5365167 5365172 +
tttgtctggtgagttctgtaga

SEQ ID NO: 107278 - DNA, 22 bp, Artificial Sequence
  Synthetic oligonucleotide; CTT chr11 5365152 5365173 5365169 5365174 +
tgtctggtgagttctgtagaca

SEQ ID NO: 107279 - DNA, 22 bp, Artificial Sequence
  Synthetic oligonucleotide; TTT chr11 5365153 5365174 5365170 5365175 +
gtctggtgagttctgtagacat

SEQ ID NO: 107280 - DNA, 22 bp, Artificial Sequence
  Synthetic oligonucleotide; TTG chr11 5365154 5365175 5365171 5365176 +
tctggtgagttctgtagacatt

SEQ ID NO: 107281 - DNA, 22 bp, Artificial Sequence
  Synthetic oligonucleotide; CTG chr11 5365158 5365179 5365175 5365180 +
gtgagttctgtagacatttaga

SEQ ID NO: 107282 - DNA, 22 bp, Artificial Sequence
  Synthetic oligonucleotide; TTC chr11 5365166 5365187 5365183 5365188 +
tgtagacatttagagtgtaggg

SEQ ID NO: 107283 - DNA, 22 bp, Artificial Sequence
  Synthetic oligonucleotide; CTG chr11 5365168 5365189 5365185 5365190 +
tagacatttagagtgtagggct

SEQ ID NO: 107284 - DNA, 22 bp, Artificial Sequence
  Synthetic oligonucleotide; TTT chr11 5365177 5365198 5365194 5365199 +
agagtgtagggctggcaactgt

SEQ ID NO: 107285 - DNA, 22 bp, Artificial Sequence
  Synthetic oligonucleotide; TTA chr11 5365178 5365199 5365195 5365200 +
gagtgtagggctggcaactgtg

SEQ ID NO: 107286 - DNA, 22 bp, Artificial Sequence
  Synthetic oligonucleotide; CTG chr11 5365191 5365212 5365208 5365213 +
gcaactgtgtttaaaataagtt

SEQ ID NO: 107287 - DNA, 22 bp, Artificial Sequence
  Synthetic oligonucleotide; CTG chr11 5365198 5365219 5365215 5365220 +
tgtttaaaataagttgtctatt

SEQ ID NO: 107288 - DNA, 22 bp, Artificial Sequence
  Synthetic oligonucleotide; TTT chr11 5365203 5365224 5365220 5365225 +
aaaataagttgtctattatatc

SEQ ID NO: 107289 - DNA, 22 bp, Artificial Sequence
  Synthetic oligonucleotide; TTA chr11 5365204 5365225 5365221 5365226 +
aaataagttgtctattatatca

SEQ ID NO: 107290 - DNA, 22 bp, Artificial Sequence
  Synthetic oligonucleotide; TTG chr11 5365214 5365235 5365231 5365236 +
tctattatatcaggactccatg

SEQ ID NO: 107291 - DNA, 22 bp, Artificial Sequence
  Synthetic oligonucleotide; CTA chr11 5365218 5365239 5365235 5365240 +
ttatatcaggactccatggaaa

SEQ ID NO: 107292 - DNA, 22 bp, Artificial Sequence
  Synthetic oligonucleotide; TTA chr11 5365221 5365242 5365238 5365243 +
tatcaggactccatggaaacat

SEQ ID NO: 107293 - DNA, 22 bp, Artificial Sequence
  Synthetic oligonucleotide; CTC chr11 5365232 5365253 5365249 5365254 +
catggaaacatctagtgaacca

SEQ ID NO: 107294 - DNA, 22 bp, Artificial Sequence
  Synthetic oligonucleotide; CTA chr11 5365246 5365267 5365263 5365268 +
gtgaaccagaagggctggtggt

SEQ ID NO: 107295 - DNA, 22 bp, Artificial Sequence
  Synthetic oligonucleotide; CTG chr11 5365263 5365284 5365280 5365285 +
gtggtgagaacagtgttattag

SEQ ID NO: 107296 - DNA, 22 bp, Artificial Sequence
  Synthetic oligonucleotide; TTA chr11 5365281 5365302 5365298 5365303 +
ttagaataccactggtgtttgc

SEQ ID NO: 107297 - DNA, 22 bp, Artificial Sequence
  Synthetic oligonucleotide; TTA chr11 5365284 5365305 5365301 5365306 +
gaataccactggtgtttgccag

SEQ ID NO: 107298 - DNA, 22 bp, Artificial Sequence
  Synthetic oligonucleotide; CTG chr11 5365295 5365316 5365312 5365317 +
gtgtttgccagctgtggaaaac

SEQ ID NO: 107299 - DNA, 22 bp, Artificial Sequence
  Synthetic oligonucleotide; TTT chr11 5365301 5365322 5365318 5365323 +
gccagctgtggaaaacatgggt

SEQ ID NO: 107300 - DNA, 22 bp, Artificial Sequence
  Synthetic oligonucleotide; TTG chr11 5365302 5365323 5365319 5365324 +
ccagctgtggaaaacatgggta

SEQ ID NO: 107301 - DNA, 22 bp, Artificial Sequence
  Synthetic oligonucleotide; CTG chr11 5365309 5365330 5365326 5365331 +
tggaaaacatgggtatagagca

SEQ ID NO: 107302 - DNA, 22 bp, Artificial Sequence
  Synthetic oligonucleotide; CTG chr11 5365338 5365359 5365355 5365360 +
atgccaaaggcaaaccaatgca

SEQ ID NO: 107303 - DNA, 22 bp, Artificial Sequence
  Synthetic oligonucleotide; CTG chr11 5365366 5365387 5365383 5365388 +
gtcccggcatggcaacaagtaa

SEQ ID NO: 107304 - DNA, 22 bp, Artificial Sequence
  Synthetic oligonucleotide; CTG chr11 5365424 5365445 5365441 5365446 +
tagaaatcgctgtggagagatg

SEQ ID NO: 107305 - DNA, 22 bp, Artificial Sequence
  Synthetic oligonucleotide; CTG chr11 5365436 5365457 5365453 5365458 +
tggagagatgcatttagatgaa

SEQ ID NO: 107306 - DNA, 22 bp, Artificial Sequence
  Synthetic oligonucleotide; TTT chr11 5365451 5365472 5365468 5365473 +
agatgaaaaggtaacccaattc

SEQ ID NO: 107307 - DNA, 22 bp, Artificial Sequence
  Synthetic oligonucleotide; TTA chr11 5365452 5365473 5365469 5365474 +
gatgaaaaggtaacccaattct

SEQ ID NO: 107308 - DNA, 22 bp, Artificial Sequence
  Synthetic oligonucleotide; TTC chr11 5365473 5365494 5365490 5365495 +
tggtctgccagtcagcaaccat

SEQ ID NO: 107309 - DNA, 22 bp, Artificial Sequence
  Synthetic oligonucleotide; CTG chr11 5365475 5365496 5365492 5365497 +
gtctgccagtcagcaaccattt

SEQ ID NO: 107310 - DNA, 22 bp, Artificial Sequence
  Synthetic oligonucleotide; CTG chr11 5365480 5365501 5365497 5365502 +
ccagtcagcaaccattttcctg

SEQ ID NO: 107311 - DNA, 22 bp, Artificial Sequence
  Synthetic oligonucleotide; TTT chr11 5365497 5365518 5365514 5365519 +
tcctgtctatgcacaggatagg

SEQ ID NO: 107312 - DNA, 22 bp, Artificial Sequence
  Synthetic oligonucleotide; TTT chr11 5365498 5365519 5365515 5365520 +
cctgtctatgcacaggatagga

SEQ ID NO: 107313 - DNA, 22 bp, Artificial Sequence
  Synthetic oligonucleotide; TTC chr11 5365499 5365520 5365516 5365521 +
ctgtctatgcacaggataggat

SEQ ID NO: 107314 - DNA, 22 bp, Artificial Sequence
  Synthetic oligonucleotide; CTG chr11 5365502 5365523 5365519 5365524 +
tctatgcacaggataggatatg

SEQ ID NO: 107315 - DNA, 22 bp, Artificial Sequence
  Synthetic oligonucleotide; CTA chr11 5365506 5365527 5365523 5365528 +
tgcacaggataggatatggctg

SEQ ID NO: 107316 - DNA, 22 bp, Artificial Sequence
  Synthetic oligonucleotide; CTG chr11 5365528 5365549 5365545 5365550 +
tactacctcgaagttttttcac

SEQ ID NO: 107317 - DNA, 22 bp, Artificial Sequence
  Synthetic oligonucleotide; CTA chr11 5365533 5365554 5365550 5365555 +
cctcgaagttttttcacaaagc

SEQ ID NO: 107318 - DNA, 22 bp, Artificial Sequence
  Synthetic oligonucleotide; CTC chr11 5365537 5365558 5365554 5365559 +
gaagttttttcacaaagcatat

SEQ ID NO: 107319 - DNA, 22 bp, Artificial Sequence
  Synthetic oligonucleotide; TTT chr11 5365544 5365565 5365561 5365566 +
tttcacaaagcatattgataca

SEQ ID NO: 107320 - DNA, 22 bp, Artificial Sequence
  Synthetic oligonucleotide; TTT chr11 5365545 5365566 5365562 5365567 +
ttcacaaagcatattgatacac

SEQ ID NO: 107321 - DNA, 22 bp, Artificial Sequence
  Synthetic oligonucleotide; TTT chr11 5365546 5365567 5365563 5365568 +
tcacaaagcatattgatacaca

SEQ ID NO: 107322 - DNA, 22 bp, Artificial Sequence
  Synthetic oligonucleotide; TTT chr11 5365547 5365568 5365564 5365569 +
cacaaagcatattgatacacaa

SEQ ID NO: 107323 - DNA, 22 bp, Artificial Sequence
  Synthetic oligonucleotide; TTC chr11 5365548 5365569 5365565 5365570 +
acaaagcatattgatacacaaa

SEQ ID NO: 107324 - DNA, 22 bp, Artificial Sequence
  Synthetic oligonucleotide; TTG chr11 5365561 5365582 5365578 5365583 +
atacacaaaaacattatcgaga

SEQ ID NO: 107325 - DNA, 22 bp, Artificial Sequence
  Synthetic oligonucleotide; TTA chr11 5365577 5365598 5365594 5365599 +
tcgagatgcacatgacatcggt

SEQ ID NO: 107326 - DNA, 22 bp, Artificial Sequence
  Synthetic oligonucleotide; TTT chr11 5365601 5365622 5365618 5365623 +
gccatgacagggctcttggtgt

SEQ ID NO: 107327 - DNA, 22 bp, Artificial Sequence
  Synthetic oligonucleotide; TTG chr11 5365602 5365623 5365619 5365624 +
ccatgacagggctcttggtgtg

SEQ ID NO: 107328 - DNA, 22 bp, Artificial Sequence
  Synthetic oligonucleotide; CTC chr11 5365616 5365637 5365633 5365638 +
ttggtgtgaatctgactactgt

SEQ ID NO: 107329 - DNA, 22 bp, Artificial Sequence
  Synthetic oligonucleotide; CTT chr11 5365618 5365639 5365635 5365640 +
ggtgtgaatctgactactgtct

SEQ ID NO: 107330 - DNA, 22 bp, Artificial Sequence
  Synthetic oligonucleotide; TTG chr11 5365619 5365640 5365636 5365641 +
gtgtgaatctgactactgtctt

SEQ ID NO: 107331 - DNA, 22 bp, Artificial Sequence
  Synthetic oligonucleotide; CTG chr11 5365630 5365651 5365647 5365652 +
actactgtcttaacacacctcc

SEQ ID NO: 107332 - DNA, 22 bp, Artificial Sequence
  Synthetic oligonucleotide; CTA chr11 5365634 5365655 5365651 5365656 +
ctgtcttaacacacctccaaat

SEQ ID NO: 107333 - DNA, 22 bp, Artificial Sequence
  Synthetic oligonucleotide; CTG chr11 5365637 5365658 5365654 5365659 +
tcttaacacacctccaaatgtg

SEQ ID NO: 107334 - DNA, 22 bp, Artificial Sequence
  Synthetic oligonucleotide; CTT chr11 5365641 5365662 5365658 5365663 +
aacacacctccaaatgtgttga

SEQ ID NO: 107335 - DNA, 22 bp, Artificial Sequence
  Synthetic oligonucleotide; TTA chr11 5365642 5365663 5365659 5365664 +
acacacctccaaatgtgttgag

SEQ ID NO: 107336 - DNA, 22 bp, Artificial Sequence
  Synthetic oligonucleotide; CTC chr11 5365651 5365672 5365668 5365673 +
caaatgtgttgaggccctaatg

SEQ ID NO: 107337 - DNA, 22 bp, Artificial Sequence
  Synthetic oligonucleotide; TTG chr11 5365662 5365683 5365679 5365684 +
aggccctaatgagaaacatccc

SEQ ID NO: 107338 - DNA, 22 bp, Artificial Sequence
  Synthetic oligonucleotide; CTA chr11 5365670 5365691 5365687 5365692 +
atgagaaacatccctgatttta

SEQ ID NO: 107339 - DNA, 22 bp, Artificial Sequence
  Synthetic oligonucleotide; CTG chr11 5365686 5365707 5365703 5365708 +
attttattcaacccaaactgat

SEQ ID NO: 107340 - DNA, 22 bp, Artificial Sequence
  Synthetic oligonucleotide; TTT chr11 5365690 5365711 5365707 5365712 +
tattcaacccaaactgatacat

SEQ ID NO: 107341 - DNA, 22 bp, Artificial Sequence
  Synthetic oligonucleotide; TTT chr11 5365691 5365712 5365708 5365713 +
attcaacccaaactgatacatt

SEQ ID NO: 107342 - DNA, 22 bp, Artificial Sequence
  Synthetic oligonucleotide; TTA chr11 5365692 5365713 5365709 5365714 +
ttcaacccaaactgatacattt

SEQ ID NO: 107343 - DNA, 22 bp, Artificial Sequence
  Synthetic oligonucleotide; TTC chr11 5365695 5365716 5365712 5365717 +
aacccaaactgatacatttaaa

SEQ ID NO: 107344 - DNA, 22 bp, Artificial Sequence
  Synthetic oligonucleotide; CTG chr11 5365706 5365727 5365723 5365728 +
atacatttaaattgtcctgtaa

SEQ ID NO: 107345 - DNA, 22 bp, Artificial Sequence
  Synthetic oligonucleotide; TTT chr11 5365714 5365735 5365731 5365736 +
aaattgtcctgtaattatttaa

SEQ ID NO: 107346 - DNA, 22 bp, Artificial Sequence
  Synthetic oligonucleotide; TTA chr11 5365715 5365736 5365732 5365737 +
aattgtcctgtaattatttaaa

SEQ ID NO: 107347 - DNA, 22 bp, Artificial Sequence
  Synthetic oligonucleotide; TTG chr11 5365720 5365741 5365737 5365742 +
tcctgtaattatttaaaaaata

SEQ ID NO: 107348 - DNA, 22 bp, Artificial Sequence
  Synthetic oligonucleotide; CTG chr11 5365725 5365746 5365742 5365747 +
taattatttaaaaaatagatat

SEQ ID NO: 107349 - DNA, 22 bp, Artificial Sequence
  Synthetic oligonucleotide; TTA chr11 5365731 5365752 5365748 5365753 +
tttaaaaaatagatataagctt

SEQ ID NO: 107350 - DNA, 22 bp, Artificial Sequence
  Synthetic oligonucleotide; TTT chr11 5365734 5365755 5365751 5365756 +
aaaaaatagatataagcttttg

SEQ ID NO: 107351 - DNA, 22 bp, Artificial Sequence
  Synthetic oligonucleotide; TTA chr11 5365735 5365756 5365752 5365757 +
aaaaatagatataagcttttga

SEQ ID NO: 107352 - DNA, 22 bp, Artificial Sequence
  Synthetic oligonucleotide; CTT chr11 5365753 5365774 5365770 5365775 +
ttgagggcagatattataatcc

SEQ ID NO: 107353 - DNA, 22 bp, Artificial Sequence
  Synthetic oligonucleotide; TTT chr11 5365754 5365775 5365771 5365776 +
tgagggcagatattataatcca

SEQ ID NO: 107354 - DNA, 22 bp, Artificial Sequence
  Synthetic oligonucleotide; TTT chr11 5365755 5365776 5365772 5365777 +
gagggcagatattataatccag

SEQ ID NO: 107355 - DNA, 22 bp, Artificial Sequence
  Synthetic oligonucleotide; TTG chr11 5365756 5365777 5365773 5365778 +
agggcagatattataatccagg

SEQ ID NO: 107356 - DNA, 22 bp, Artificial Sequence
  Synthetic oligonucleotide; TTA chr11 5365769 5365790 5365786 5365791 +
taatccaggcatcacctccatt

SEQ ID NO: 107357 - DNA, 22 bp, Artificial Sequence
  Synthetic oligonucleotide; CTC chr11 5365787 5365808 5365804 5365809 +
cattacccacattgtctagcac

SEQ ID NO: 107358 - DNA, 22 bp, Artificial Sequence
  Synthetic oligonucleotide; TTA chr11 5365792 5365813 5365809 5365814 +
cccacattgtctagcacattat

SEQ ID NO: 107359 - DNA, 22 bp, Artificial Sequence
  Synthetic oligonucleotide; TTG chr11 5365801 5365822 5365818 5365823 +
tctagcacattatagatgctta

SEQ ID NO: 107360 - DNA, 22 bp, Artificial Sequence
  Synthetic oligonucleotide; CTA chr11 5365805 5365826 5365822 5365827 +
gcacattatagatgcttagtat

SEQ ID NO: 107361 - DNA, 22 bp, Artificial Sequence
  Synthetic oligonucleotide; TTA chr11 5365813 5365834 5365830 5365835 +
tagatgcttagtatgtgctggc

SEQ ID NO: 107362 - DNA, 22 bp, Artificial Sequence
  Synthetic oligonucleotide; CTT chr11 5365822 5365843 5365839 5365844 +
agtatgtgctggcttgatgaca

SEQ ID NO: 107363 - DNA, 22 bp, Artificial Sequence
  Synthetic oligonucleotide; TTA chr11 5365823 5365844 5365840 5365845 +
gtatgtgctggcttgatgacag

SEQ ID NO: 107364 - DNA, 22 bp, Artificial Sequence
  Synthetic oligonucleotide; CTG chr11 5365833 5365854 5365850 5365855 +
gcttgatgacaggatgaagttt

SEQ ID NO: 107365 - DNA, 22 bp, Artificial Sequence
  Synthetic oligonucleotide; CTT chr11 5365837 5365858 5365854 5365859 +
gatgacaggatgaagtttaagt

SEQ ID NO: 107366 - DNA, 22 bp, Artificial Sequence
  Synthetic oligonucleotide; TTG chr11 5365838 5365859 5365855 5365860 +
atgacaggatgaagtttaagtt

SEQ ID NO: 107367 - DNA, 22 bp, Artificial Sequence
  Synthetic oligonucleotide; TTT chr11 5365855 5365876 5365872 5365877 +
aagttgctaaccattcttagag

SEQ ID NO: 107368 - DNA, 22 bp, Artificial Sequence
  Synthetic oligonucleotide; TTA chr11 5365856 5365877 5365873 5365878 +
agttgctaaccattcttagagg

SEQ ID NO: 107369 - DNA, 22 bp, Artificial Sequence
  Synthetic oligonucleotide; TTG chr11 5365861 5365882 5365878 5365883 +
ctaaccattcttagaggaactc

SEQ ID NO: 107370 - DNA, 22 bp, Artificial Sequence
  Synthetic oligonucleotide; CTA chr11 5365864 5365885 5365881 5365886 +
accattcttagaggaactctgc

SEQ ID NO: 107371 - DNA, 22 bp, Artificial Sequence
  Synthetic oligonucleotide; TTC chr11 5365871 5365892 5365888 5365893 +
ttagaggaactctgcttacctc

SEQ ID NO: 107372 - DNA, 22 bp, Artificial Sequence
  Synthetic oligonucleotide; CTT chr11 5365873 5365894 5365890 5365895 +
agaggaactctgcttacctctt

SEQ ID NO: 107373 - DNA, 22 bp, Artificial Sequence
  Synthetic oligonucleotide; TTA chr11 5365874 5365895 5365891 5365896 +
gaggaactctgcttacctcttg

SEQ ID NO: 107374 - DNA, 22 bp, Artificial Sequence
  Synthetic oligonucleotide; CTC chr11 5365883 5365904 5365900 5365905 +
tgcttacctcttgggttctgaa

SEQ ID NO: 107375 - DNA, 22 bp, Artificial Sequence
  Synthetic oligonucleotide; CTG chr11 5365885 5365906 5365902 5365907 +
cttacctcttgggttctgaagg

SEQ ID NO: 107376 - DNA, 22 bp, Artificial Sequence
  Synthetic oligonucleotide; CTT chr11 5365888 5365909 5365905 5365910 +
acctcttgggttctgaagggtc

SEQ ID NO: 107377 - DNA, 22 bp, Artificial Sequence
  Synthetic oligonucleotide; TTA chr11 5365889 5365910 5365906 5365911 +
cctcttgggttctgaagggtct

SEQ ID NO: 107378 - DNA, 22 bp, Artificial Sequence
  Synthetic oligonucleotide; CTC chr11 5365893 5365914 5365910 5365915 +
ttgggttctgaagggtctgact

SEQ ID NO: 107379 - DNA, 22 bp, Artificial Sequence
  Synthetic oligonucleotide; CTT chr11 5365895 5365916 5365912 5365917 +
gggttctgaagggtctgactga

SEQ ID NO: 107380 - DNA, 22 bp, Artificial Sequence
  Synthetic oligonucleotide; TTG chr11 5365896 5365917 5365913 5365918 +
ggttctgaagggtctgactgac

SEQ ID NO: 107381 - DNA, 22 bp, Artificial Sequence
  Synthetic oligonucleotide; TTC chr11 5365901 5365922 5365918 5365923 +
tgaagggtctgactgaccagag

SEQ ID NO: 107382 - DNA, 22 bp, Artificial Sequence
  Synthetic oligonucleotide; CTG chr11 5365903 5365924 5365920 5365925 +
aagggtctgactgaccagagag

SEQ ID NO: 107383 - DNA, 22 bp, Artificial Sequence
  Synthetic oligonucleotide; CTG chr11 5365912 5365933 5365929 5365934 +
actgaccagagaggcatgaagg

SEQ ID NO: 107384 - DNA, 22 bp, Artificial Sequence
  Synthetic oligonucleotide; CTG chr11 5365916 5365937 5365933 5365938 +
accagagaggcatgaagggggc

SEQ ID NO: 107385 - DNA, 22 bp, Artificial Sequence
  Synthetic oligonucleotide; CTC chr11 5365944 5365965 5365961 5365966 +
agcatgatcaccagcactgaga

SEQ ID NO: 107386 - DNA, 22 bp, Artificial Sequence
  Synthetic oligonucleotide; CTG chr11 5365963 5365984 5365980 5365985 +
agaaccacacaaactgaagaac

SEQ ID NO: 107387 - DNA, 22 bp, Artificial Sequence
  Synthetic oligonucleotide; CTG chr11 5365979 5366000 5365996 5366001 +
aagaactgctaggtgctggcta

SEQ ID NO: 107388 - DNA, 22 bp, Artificial Sequence
  Synthetic oligonucleotide; CTG chr11 5365987 5366008 5366004 5366009 +
ctaggtgctggctagtgggaga

SEQ ID NO: 107389 - DNA, 22 bp, Artificial Sequence
  Synthetic oligonucleotide; CTA chr11 5365990 5366011 5366007 5366012 +
ggtgctggctagtgggagactt

SEQ ID NO: 107390 - DNA, 22 bp, Artificial Sequence
  Synthetic oligonucleotide; CTG chr11 5365997 5366018 5366014 5366019 +
gctagtgggagacttaagacca

SEQ ID NO: 107391 - DNA, 22 bp, Artificial Sequence
  Synthetic oligonucleotide; CTA chr11 5366001 5366022 5366018 5366023 +
gtgggagacttaagaccaacca

SEQ ID NO: 107392 - DNA, 22 bp, Artificial Sequence
  Synthetic oligonucleotide; CTT chr11 5366012 5366033 5366029 5366034 +
aagaccaaccaaccaccctatg

SEQ ID NO: 107393 - DNA, 22 bp, Artificial Sequence
  Synthetic oligonucleotide; TTA chr11 5366013 5366034 5366030 5366035 +
agaccaaccaaccaccctatgg

SEQ ID NO: 107394 - DNA, 22 bp, Artificial Sequence
  Synthetic oligonucleotide; CTA chr11 5366032 5366053 5366049 5366054 +
tggagcagccaggtaatcagca

SEQ ID NO: 107395 - DNA, 22 bp, Artificial Sequence
  Synthetic oligonucleotide; TTT chr11 5366059 5366080 5366076 5366081 +
gggggctgttaatggaagagtt

SEQ ID NO: 107396 - DNA, 22 bp, Artificial Sequence
  Synthetic oligonucleotide; TTG chr11 5366060 5366081 5366077 5366082 +
ggggctgttaatggaagagttg

SEQ ID NO: 107397 - DNA, 22 bp, Artificial Sequence
  Synthetic oligonucleotide; CTG chr11 5366067 5366088 5366084 5366089 +
ttaatggaagagttgctgaggg

SEQ ID NO: 107398 - DNA, 22 bp, Artificial Sequence
  Synthetic oligonucleotide; TTA chr11 5366070 5366091 5366087 5366092 +
atggaagagttgctgaggggta

SEQ ID NO: 107399 - DNA, 22 bp, Artificial Sequence
  Synthetic oligonucleotide; TTG chr11 5366082 5366103 5366099 5366104 +
ctgaggggtatgcttacttgtc

SEQ ID NO: 107400 - DNA, 22 bp, Artificial Sequence
  Synthetic oligonucleotide; CTG chr11 5366085 5366106 5366102 5366107 +
aggggtatgcttacttgtccag

SEQ ID NO: 107401 - DNA, 22 bp, Artificial Sequence
  Synthetic oligonucleotide; CTT chr11 5366097 5366118 5366114 5366119 +
acttgtccagttgtgtgtgact

SEQ ID NO: 107402 - DNA, 22 bp, Artificial Sequence
  Synthetic oligonucleotide; TTA chr11 5366098 5366119 5366115 5366120 +
cttgtccagttgtgtgtgactt

SEQ ID NO: 107403 - DNA, 22 bp, Artificial Sequence
  Synthetic oligonucleotide; CTT chr11 5366101 5366122 5366118 5366123 +
gtccagttgtgtgtgacttaga

SEQ ID NO: 107404 - DNA, 22 bp, Artificial Sequence
  Synthetic oligonucleotide; TTG chr11 5366102 5366123 5366119 5366124 +
tccagttgtgtgtgacttagag

SEQ ID NO: 107405 - DNA, 22 bp, Artificial Sequence
  Synthetic oligonucleotide; TTG chr11 5366110 5366131 5366127 5366132 +
tgtgtgacttagaggtgaaccc

SEQ ID NO: 107406 - DNA, 22 bp, Artificial Sequence
  Synthetic oligonucleotide; CTT chr11 5366120 5366141 5366137 5366142 +
agaggtgaacccagtgggcaaa

SEQ ID NO: 107407 - DNA, 22 bp, Artificial Sequence
  Synthetic oligonucleotide; TTA chr11 5366121 5366142 5366138 5366143 +
gaggtgaacccagtgggcaaaa

SEQ ID NO: 107408 - DNA, 22 bp, Artificial Sequence
  Synthetic oligonucleotide; CTT chr11 5366179 5366200 5366196 5366201 +
aagtaggaagttaaggatgagg

SEQ ID NO: 107409 - DNA, 22 bp, Artificial Sequence
  Synthetic oligonucleotide; TTA chr11 5366180 5366201 5366197 5366202 +
agtaggaagttaaggatgaggg

SEQ ID NO: 107410 - DNA, 22 bp, Artificial Sequence
  Synthetic oligonucleotide; TTA chr11 5366192 5366213 5366209 5366214 +
aggatgagggaaacaggaagga

SEQ ID NO: 107411 - DNA, 22 bp, Artificial Sequence
  Synthetic oligonucleotide; CTG chr11 5366277 5366298 5366294 5366299 +
aaaaggagctcaagggaaggtt

SEQ ID NO: 107412 - DNA, 22 bp, Artificial Sequence
  Synthetic oligonucleotide; CTC chr11 5366288 5366309 5366305 5366310 +
aagggaaggttcctctgtgggt

SEQ ID NO: 107413 - DNA, 22 bp, Artificial Sequence
  Synthetic oligonucleotide; TTC chr11 5366300 5366321 5366317 5366322 +
ctctgtgggtagcctgttaaag

SEQ ID NO: 107414 - DNA, 22 bp, Artificial Sequence
  Synthetic oligonucleotide; CTC chr11 5366303 5366324 5366320 5366325 +
tgtgggtagcctgttaaagaaa

SEQ ID NO: 107415 - DNA, 22 bp, Artificial Sequence
  Synthetic oligonucleotide; CTG chr11 5366305 5366326 5366322 5366327 +
tgggtagcctgttaaagaaaag

SEQ ID NO: 107416 - DNA, 22 bp, Artificial Sequence
  Synthetic oligonucleotide; CTG chr11 5366316 5366337 5366333 5366338 +
ttaaagaaaaggctacattaca

SEQ ID NO: 107417 - DNA, 22 bp, Artificial Sequence
  Synthetic oligonucleotide; TTA chr11 5366319 5366340 5366336 5366341 +
aagaaaaggctacattacagac

SEQ ID NO: 107418 - DNA, 22 bp, Artificial Sequence
  Synthetic oligonucleotide; CTA chr11 5366331 5366352 5366348 5366353 +
cattacagactcatgcctgtaa

SEQ ID NO: 107419 - DNA, 22 bp, Artificial Sequence
  Synthetic oligonucleotide; TTA chr11 5366336 5366357 5366353 5366358 +
cagactcatgcctgtaatccca

SEQ ID NO: 107420 - DNA, 22 bp, Artificial Sequence
  Synthetic oligonucleotide; CTC chr11 5366343 5366364 5366360 5366365 +
atgcctgtaatcccagcacttt

SEQ ID NO: 107421 - DNA, 22 bp, Artificial Sequence
  Synthetic oligonucleotide; CTG chr11 5366350 5366371 5366367 5366372 +
taatcccagcactttgggtggc

SEQ ID NO: 107422 - DNA, 22 bp, Artificial Sequence
  Synthetic oligonucleotide; CTT chr11 5366364 5366385 5366381 5366386 +
tgggtggctgaggcaggaggat

SEQ ID NO: 107423 - DNA, 22 bp, Artificial Sequence
  Synthetic oligonucleotide; TTT chr11 5366365 5366386 5366382 5366387 +
gggtggctgaggcaggaggatc

SEQ ID NO: 107424 - DNA, 22 bp, Artificial Sequence
  Synthetic oligonucleotide; TTG chr11 5366366 5366387 5366383 5366388 +
ggtggctgaggcaggaggatca

SEQ ID NO: 107425 - DNA, 22 bp, Artificial Sequence
  Synthetic oligonucleotide; CTG chr11 5366374 5366395 5366391 5366396 +
aggcaggaggatcacctgaggg

SEQ ID NO: 107426 - DNA, 22 bp, Artificial Sequence
  Synthetic oligonucleotide; CTG chr11 5366392 5366413 5366409 5366414 +
agggcaagagttcgagaccagc

SEQ ID NO: 107427 - DNA, 22 bp, Artificial Sequence
  Synthetic oligonucleotide; TTC chr11 5366405 5366426 5366422 5366427 +
gagaccagcctgaccaacatgg

SEQ ID NO: 107428 - DNA, 22 bp, Artificial Sequence
  Synthetic oligonucleotide; CTG chr11 5366417 5366438 5366434 5366439 +
accaacatggtgaaaccctgtc

SEQ ID NO: 107429 - DNA, 22 bp, Artificial Sequence
  Synthetic oligonucleotide; CTG chr11 5366437 5366458 5366454 5366459 +
tctctaataaaaatacaaaaaa

SEQ ID NO: 107430 - DNA, 22 bp, Artificial Sequence
  Synthetic oligonucleotide; CTC chr11 5366441 5366462 5366458 5366463 +
taataaaaatacaaaaaaatta

SEQ ID NO: 107431 - DNA, 22 bp, Artificial Sequence
  Synthetic oligonucleotide; CTA chr11 5366443 5366464 5366460 5366465 +
ataaaaatacaaaaaaattagc

SEQ ID NO: 107432 - DNA, 22 bp, Artificial Sequence
  Synthetic oligonucleotide; TTA chr11 5366463 5366484 5366480 5366485 +
gcagggcctggtggcagatgcc

SEQ ID NO: 107433 - DNA, 22 bp, Artificial Sequence
  Synthetic oligonucleotide; CTG chr11 5366473 5366494 5366490 5366495 +
gtggcagatgcctgtaattgca

SEQ ID NO: 107434 - DNA, 22 bp, Artificial Sequence
  Synthetic oligonucleotide; CTG chr11 5366487 5366508 5366504 5366509 +
taattgcagctacacaggaggc

SEQ ID NO: 107435 - DNA, 22 bp, Artificial Sequence
  Synthetic oligonucleotide; TTG chr11 5366493 5366514 5366510 5366515 +
cagctacacaggaggctgaggt

SEQ ID NO: 107436 - DNA, 22 bp, Artificial Sequence
  Synthetic oligonucleotide; CTA chr11 5366499 5366520 5366516 5366521 +
cacaggaggctgaggtaggaga

SEQ ID NO: 107437 - DNA, 22 bp, Artificial Sequence
  Synthetic oligonucleotide; CTG chr11 5366511 5366532 5366528 5366533 +
aggtaggagaatcgcttgaacc

SEQ ID NO: 107438 - DNA, 22 bp, Artificial Sequence
  Synthetic oligonucleotide; CTT chr11 5366528 5366549 5366545 5366550 +
gaacctgggaggcggaggttgc

SEQ ID NO: 107439 - DNA, 22 bp, Artificial Sequence
  Synthetic oligonucleotide; TTG chr11 5366529 5366550 5366546 5366551 +
aacctgggaggcggaggttgca

SEQ ID NO: 107440 - DNA, 22 bp, Artificial Sequence
  Synthetic oligonucleotide; CTG chr11 5366535 5366556 5366552 5366557 +
ggaggcggaggttgcagtgagc

SEQ ID NO: 107441 - DNA, 22 bp, Artificial Sequence
  Synthetic oligonucleotide; TTG chr11 5366549 5366570 5366566 5366571 +
cagtgagccgagatcgcgccat

SEQ ID NO: 107442 - DNA, 22 bp, Artificial Sequence
  Synthetic oligonucleotide; TTG chr11 5366573 5366594 5366590 5366595 +
cactccagcagcctggaaggca

SEQ ID NO: 107443 - DNA, 22 bp, Artificial Sequence
  Synthetic oligonucleotide; CTC chr11 5366578 5366599 5366595 5366600 +
cagcagcctggaaggcaaaagc

SEQ ID NO: 107444 - DNA, 22 bp, Artificial Sequence
  Synthetic oligonucleotide; CTG chr11 5366588 5366609 5366605 5366610 +
gaaggcaaaagcaagatgagaa

SEQ ID NO: 107445 - DNA, 22 bp, Artificial Sequence
  Synthetic oligonucleotide; TTC chr11 5366757 5366778 5366774 5366779 +
acttgagattcaaagtctttag

SEQ ID NO: 107446 - DNA, 22 bp, Artificial Sequence
  Synthetic oligonucleotide; CTT chr11 5366761 5366782 5366778 5366783 +
gagattcaaagtctttagaata

SEQ ID NO: 107447 - DNA, 22 bp, Artificial Sequence
  Synthetic oligonucleotide; TTG chr11 5366762 5366783 5366779 5366784 +
agattcaaagtctttagaataa

SEQ ID NO: 107448 - DNA, 22 bp, Artificial Sequence
  Synthetic oligonucleotide; TTC chr11 5366768 5366789 5366785 5366790 +
aaagtctttagaataaaaatta

SEQ ID NO: 107449 - DNA, 22 bp, Artificial Sequence
  Synthetic oligonucleotide; CTT chr11 5366776 5366797 5366793 5366798 +
tagaataaaaattaaaatttgg

SEQ ID NO: 107450 - DNA, 22 bp, Artificial Sequence
  Synthetic oligonucleotide; TTT chr11 5366777 5366798 5366794 5366799 +
agaataaaaattaaaatttggg

SEQ ID NO: 107451 - DNA, 22 bp, Artificial Sequence
  Synthetic oligonucleotide; TTA chr11 5366778 5366799 5366795 5366800 +
gaataaaaattaaaatttggga

SEQ ID NO: 107452 - DNA, 22 bp, Artificial Sequence
  Synthetic oligonucleotide; TTA chr11 5366790 5366811 5366807 5366812 +
aaatttgggaaaataagtttgt

SEQ ID NO: 107453 - DNA, 22 bp, Artificial Sequence
  Synthetic oligonucleotide; TTT chr11 5366796 5366817 5366813 5366818 +
gggaaaataagtttgtattgat

SEQ ID NO: 107454 - DNA, 22 bp, Artificial Sequence
  Synthetic oligonucleotide; TTG chr11 5366797 5366818 5366814 5366819 +
ggaaaataagtttgtattgatg

SEQ ID NO: 107455 - DNA, 22 bp, Artificial Sequence
  Synthetic oligonucleotide; TTT chr11 5366810 5366831 5366827 5366832 +
gtattgatgactaattccaatc

SEQ ID NO: 107456 - DNA, 22 bp, Artificial Sequence
  Synthetic oligonucleotide; TTG chr11 5366811 5366832 5366828 5366833 +
tattgatgactaattccaatcc

SEQ ID NO: 107457 - DNA, 22 bp, Artificial Sequence
  Synthetic oligonucleotide; TTG chr11 5366816 5366837 5366833 5366838 +
atgactaattccaatcccaagc

SEQ ID NO: 107458 - DNA, 22 bp, Artificial Sequence
  Synthetic oligonucleotide; CTA chr11 5366823 5366844 5366840 5366845 +
attccaatcccaagcacgggtc

SEQ ID NO: 107459 - DNA, 22 bp, Artificial Sequence
  Synthetic oligonucleotide; TTC chr11 5366827 5366848 5366844 5366849 +
caatcccaagcacgggtctctg

SEQ ID NO: 107460 - DNA, 22 bp, Artificial Sequence
  Synthetic oligonucleotide; CTC chr11 5366847 5366868 5366864 5366869 +
tgtgcaatgcaggactgggaag

SEQ ID NO: 107461 - DNA, 22 bp, Artificial Sequence
  Synthetic oligonucleotide; CTG chr11 5366849 5366870 5366866 5366871 +
tgcaatgcaggactgggaaggt

SEQ ID NO: 107462 - DNA, 22 bp, Artificial Sequence
  Synthetic oligonucleotide; CTG chr11 5366864 5366885 5366881 5366886 +
ggaaggtttaggcaggggtgct

SEQ ID NO: 107463 - DNA, 22 bp, Artificial Sequence
  Synthetic oligonucleotide; TTT chr11 5366873 5366894 5366890 5366895 +
aggcaggggtgctatctgattc

SEQ ID NO: 107464 - DNA, 22 bp, Artificial Sequence
  Synthetic oligonucleotide; TTA chr11 5366874 5366895 5366891 5366896 +
ggcaggggtgctatctgattca

SEQ ID NO: 107465 - DNA, 22 bp, Artificial Sequence
  Synthetic oligonucleotide; CTA chr11 5366887 5366908 5366904 5366909 +
tctgattcatgagacaacaggc

SEQ ID NO: 107466 - DNA, 22 bp, Artificial Sequence
  Synthetic oligonucleotide; CTG chr11 5366891 5366912 5366908 5366913 +
attcatgagacaacaggcacaa

SEQ ID NO: 107467 - DNA, 22 bp, Artificial Sequence
  Synthetic oligonucleotide; TTC chr11 5366895 5366916 5366912 5366917 +
atgagacaacaggcacaaagtt

SEQ ID NO: 107468 - DNA, 22 bp, Artificial Sequence
  Synthetic oligonucleotide; TTT chr11 5366918 5366939 5366935 5366940 +
tagtccctgcctggacttggtg

SEQ ID NO: 107469 - DNA, 22 bp, Artificial Sequence
  Synthetic oligonucleotide; TTT chr11 5366919 5366940 5366936 5366941 +
agtccctgcctggacttggtgt

SEQ ID NO: 107470 - DNA, 22 bp, Artificial Sequence
  Synthetic oligonucleotide; TTA chr11 5366920 5366941 5366937 5366942 +
gtccctgcctggacttggtgtc

SEQ ID NO: 107471 - DNA, 22 bp, Artificial Sequence
  Synthetic oligonucleotide; CTG chr11 5366927 5366948 5366944 5366949 +
cctggacttggtgtcatctctt

SEQ ID NO: 107472 - DNA, 22 bp, Artificial Sequence
  Synthetic oligonucleotide; CTG chr11 5366931 5366952 5366948 5366953 +
gacttggtgtcatctcttgagc

SEQ ID NO: 107473 - DNA, 22 bp, Artificial Sequence
  Synthetic oligonucleotide; CTT chr11 5366936 5366957 5366953 5366958 +
ggtgtcatctcttgagcacatg

SEQ ID NO: 107474 - DNA, 22 bp, Artificial Sequence
  Synthetic oligonucleotide; TTG chr11 5366937 5366958 5366954 5366959 +
gtgtcatctcttgagcacatgc

SEQ ID NO: 107475 - DNA, 22 bp, Artificial Sequence
  Synthetic oligonucleotide; CTC chr11 5366947 5366968 5366964 5366969 +
ttgagcacatgcctaatggtct

SEQ ID NO: 107476 - DNA, 22 bp, Artificial Sequence
  Synthetic oligonucleotide; CTT chr11 5366949 5366970 5366966 5366971 +
gagcacatgcctaatggtctcc

SEQ ID NO: 107477 - DNA, 22 bp, Artificial Sequence
  Synthetic oligonucleotide; TTG chr11 5366950 5366971 5366967 5366972 +
agcacatgcctaatggtctcct

SEQ ID NO: 107478 - DNA, 22 bp, Artificial Sequence
  Synthetic oligonucleotide; CTA chr11 5366962 5366983 5366979 5366984 +
atggtctcctaacattcccctc

SEQ ID NO: 107479 - DNA, 22 bp, Artificial Sequence
  Synthetic oligonucleotide; CTC chr11 5366970 5366991 5366987 5366992 +
ctaacattcccctcccaaagtt

SEQ ID NO: 107480 - DNA, 22 bp, Artificial Sequence
  Synthetic oligonucleotide; CTA chr11 5366973 5366994 5366990 5366995 +
acattcccctcccaaagtttga

SEQ ID NO: 107481 - DNA, 22 bp, Artificial Sequence
  Synthetic oligonucleotide; TTC chr11 5366979 5367000 5366996 5367001 +
ccctcccaaagtttgaaaatgc

SEQ ID NO: 107482 - DNA, 22 bp, Artificial Sequence
  Synthetic oligonucleotide; CTC chr11 5366984 5367005 5367001 5367006 +
ccaaagtttgaaaatgcttcca

SEQ ID NO: 107483 - DNA, 22 bp, Artificial Sequence
  Synthetic oligonucleotide; TTT chr11 5366993 5367014 5367010 5367015 +
gaaaatgcttccacctcccgct

SEQ ID NO: 107484 - DNA, 22 bp, Artificial Sequence
  Synthetic oligonucleotide; TTG chr11 5366994 5367015 5367011 5367016 +
aaaatgcttccacctcccgctg

SEQ ID NO: 107485 - DNA, 22 bp, Artificial Sequence
  Synthetic oligonucleotide; CTT chr11 5367003 5367024 5367020 5367025 +
ccacctcccgctgcagtccatg

SEQ ID NO: 107486 - DNA, 22 bp, Artificial Sequence
  Synthetic oligonucleotide; TTC chr11 5367004 5367025 5367021 5367026 +
cacctcccgctgcagtccatga

SEQ ID NO: 107487 - DNA, 22 bp, Artificial Sequence
  Synthetic oligonucleotide; CTC chr11 5367010 5367031 5367027 5367032 +
ccgctgcagtccatgaaccagg

SEQ ID NO: 107488 - DNA, 22 bp, Artificial Sequence
  Synthetic oligonucleotide; CTG chr11 5367016 5367037 5367033 5367038 +
cagtccatgaaccaggataaaa

SEQ ID NO: 107489 - DNA, 22 bp, Artificial Sequence
  Synthetic oligonucleotide; TTC chr11 5367041 5367062 5367058 5367063 +
tctagcagcagagaccaaagac

SEQ ID NO: 107490 - DNA, 22 bp, Artificial Sequence
  Synthetic oligonucleotide; CTC chr11 5367043 5367064 5367060 5367065 +
tagcagcagagaccaaagacat

SEQ ID NO: 107491 - DNA, 22 bp, Artificial Sequence
  Synthetic oligonucleotide; CTA chr11 5367045 5367066 5367062 5367067 +
gcagcagagaccaaagacattc

SEQ ID NO: 107492 - DNA, 22 bp, Artificial Sequence
  Synthetic oligonucleotide; TTC chr11 5367067 5367088 5367084 5367089 +
tctcaagtctcaggaatgtggt

SEQ ID NO: 107493 - DNA, 22 bp, Artificial Sequence
  Synthetic oligonucleotide; CTC chr11 5367069 5367090 5367086 5367091 +
tcaagtctcaggaatgtggttc

SEQ ID NO: 107494 - DNA, 22 bp, Artificial Sequence
  Synthetic oligonucleotide; CTC chr11 5367071 5367092 5367088 5367093 +
aagtctcaggaatgtggttctg

SEQ ID NO: 107495 - DNA, 22 bp, Artificial Sequence
  Synthetic oligonucleotide; CTC chr11 5367078 5367099 5367095 5367100 +
aggaatgtggttctgaaggaag

SEQ ID NO: 107496 - DNA, 22 bp, Artificial Sequence
  Synthetic oligonucleotide; TTC chr11 5367091 5367112 5367108 5367113 +
tgaaggaagagaagctctgcca

SEQ ID NO: 107497 - DNA, 22 bp, Artificial Sequence
  Synthetic oligonucleotide; CTG chr11 5367093 5367114 5367110 5367115 +
aaggaagagaagctctgccaca

SEQ ID NO: 107498 - DNA, 22 bp, Artificial Sequence
  Synthetic oligonucleotide; CTC chr11 5367108 5367129 5367125 5367130 +
tgccacacatacacatgccacc

SEQ ID NO: 107499 - DNA, 22 bp, Artificial Sequence
  Synthetic oligonucleotide; CTG chr11 5367110 5367131 5367127 5367132 +
ccacacatacacatgccacctt

SEQ ID NO: 107500 - DNA, 22 bp, Artificial Sequence
  Synthetic oligonucleotide; CTT chr11 5367132 5367153 5367149 5367154 +
gcaaagccacttagtgacacag

SEQ ID NO: 107501 - DNA, 22 bp, Artificial Sequence
  Synthetic oligonucleotide; TTG chr11 5367133 5367154 5367150 5367155 +
caaagccacttagtgacacaga

SEQ ID NO: 107502 - DNA, 22 bp, Artificial Sequence
  Synthetic oligonucleotide; CTT chr11 5367144 5367165 5367161 5367166 +
agtgacacagagttttagttat

SEQ ID NO: 107503 - DNA, 22 bp, Artificial Sequence
  Synthetic oligonucleotide; TTA chr11 5367145 5367166 5367162 5367167 +
gtgacacagagttttagttatt

SEQ ID NO: 107504 - DNA, 22 bp, Artificial Sequence
  Synthetic oligonucleotide; TTT chr11 5367159 5367180 5367176 5367181 +
tagttatttcattgtgaactgg

SEQ ID NO: 107505 - DNA, 22 bp, Artificial Sequence
  Synthetic oligonucleotide; TTT chr11 5367160 5367181 5367177 5367182 +
agttatttcattgtgaactgga

SEQ ID NO: 107506 - DNA, 22 bp, Artificial Sequence
  Synthetic oligonucleotide; TTA chr11 5367161 5367182 5367178 5367183 +
gttatttcattgtgaactggaa

SEQ ID NO: 107507 - DNA, 22 bp, Artificial Sequence
  Synthetic oligonucleotide; TTA chr11 5367165 5367186 5367182 5367187 +
tttcattgtgaactggaataaa

SEQ ID NO: 107508 - DNA, 22 bp, Artificial Sequence
  Synthetic oligonucleotide; TTT chr11 5367168 5367189 5367185 5367190 +
cattgtgaactggaataaaatc

SEQ ID NO: 107509 - DNA, 22 bp, Artificial Sequence
  Synthetic oligonucleotide; TTC chr11 5367169 5367190 5367186 5367191 +
attgtgaactggaataaaatca

SEQ ID NO: 107510 - DNA, 22 bp, Artificial Sequence
  Synthetic oligonucleotide; TTG chr11 5367173 5367194 5367190 5367195 +
tgaactggaataaaatcatttt

SEQ ID NO: 107511 - DNA, 22 bp, Artificial Sequence
  Synthetic oligonucleotide; CTG chr11 5367180 5367201 5367197 5367202 +
gaataaaatcattttgaaagga

SEQ ID NO: 107512 - DNA, 22 bp, Artificial Sequence
  Synthetic oligonucleotide; TTT chr11 5367194 5367215 5367211 5367216 +
tgaaaggagatttttgaagtta

SEQ ID NO: 107513 - DNA, 22 bp, Artificial Sequence
  Synthetic oligonucleotide; TTT chr11 5367195 5367216 5367212 5367217 +
gaaaggagatttttgaagttaa

SEQ ID NO: 107514 - DNA, 22 bp, Artificial Sequence
  Synthetic oligonucleotide; TTG chr11 5367196 5367217 5367213 5367218 +
aaaggagatttttgaagttaaa

SEQ ID NO: 107515 - DNA, 22 bp, Artificial Sequence
  Synthetic oligonucleotide; TTT chr11 5367207 5367228 5367224 5367229 +
ttgaagttaaaagcattgccag

SEQ ID NO: 107516 - DNA, 22 bp, Artificial Sequence
  Synthetic oligonucleotide; TTT chr11 5367208 5367229 5367225 5367230 +
tgaagttaaaagcattgccaga

SEQ ID NO: 107517 - DNA, 22 bp, Artificial Sequence
  Synthetic oligonucleotide; TTT chr11 5367209 5367230 5367226 5367231 +
gaagttaaaagcattgccagaa

SEQ ID NO: 107518 - DNA, 22 bp, Artificial Sequence
  Synthetic oligonucleotide; TTG chr11 5367210 5367231 5367227 5367232 +
aagttaaaagcattgccagaaa

SEQ ID NO: 107519 - DNA, 22 bp, Artificial Sequence
  Synthetic oligonucleotide; TTA chr11 5367216 5367237 5367233 5367238 +
aaagcattgccagaaaggagtc

SEQ ID NO: 107520 - DNA, 22 bp, Artificial Sequence
  Synthetic oligonucleotide; TTG chr11 5367225 5367246 5367242 5367247 +
ccagaaaggagtcacaatccag

SEQ ID NO: 107521 - DNA, 22 bp, Artificial Sequence
  Synthetic oligonucleotide; CTA chr11 5367253 5367274 5367270 5367275 +
agagagggttcttggatttcgt

SEQ ID NO: 107522 - DNA, 22 bp, Artificial Sequence
  Synthetic oligonucleotide; TTC chr11 5367264 5367285 5367281 5367286 +
ttggatttcgtgcccaagaaag

SEQ ID NO: 107523 - DNA, 22 bp, Artificial Sequence
  Synthetic oligonucleotide; CTT chr11 5367266 5367287 5367283 5367288 +
ggatttcgtgcccaagaaagaa

SEQ ID NO: 107524 - DNA, 22 bp, Artificial Sequence
  Synthetic oligonucleotide; TTG chr11 5367267 5367288 5367284 5367289 +
gatttcgtgcccaagaaagaat

SEQ ID NO: 107525 - DNA, 22 bp, Artificial Sequence
  Synthetic oligonucleotide; TTT chr11 5367272 5367293 5367289 5367294 +
cgtgcccaagaaagaatttggg

SEQ ID NO: 107526 - DNA, 22 bp, Artificial Sequence
  Synthetic oligonucleotide; TTC chr11 5367273 5367294 5367290 5367295 +
gtgcccaagaaagaatttgggg

SEQ ID NO: 107527 - DNA, 22 bp, Artificial Sequence
  Synthetic oligonucleotide; TTT chr11 5367291 5367312 5367308 5367313 +
ggggcaaatccatacagaaaag

SEQ ID NO: 107528 - DNA, 22 bp, Artificial Sequence
  Synthetic oligonucleotide; TTG chr11 5367292 5367313 5367309 5367314 +
gggcaaatccatacagaaaagt

SEQ ID NO: 107529 - DNA, 22 bp, Artificial Sequence
  Synthetic oligonucleotide; TTA chr11 5367326 5367347 5367343 5367348 +
attaagaaagtaaaggagtaaa

SEQ ID NO: 107530 - DNA, 22 bp, Artificial Sequence
  Synthetic oligonucleotide; TTA chr11 5367330 5367351 5367347 5367352 +
agaaagtaaaggagtaaaataa

SEQ ID NO: 107531 - DNA, 22 bp, Artificial Sequence
  Synthetic oligonucleotide; CTA chr11 5367358 5367379 5367375 5367380 +
ccctataggcagaacagtcctg

SEQ ID NO: 107532 - DNA, 22 bp, Artificial Sequence
  Synthetic oligonucleotide; CTA chr11 5367363 5367384 5367380 5367385 +
taggcagaacagtcctgaggac

SEQ ID NO: 107533 - DNA, 22 bp, Artificial Sequence
  Synthetic oligonucleotide; CTG chr11 5367380 5367401 5367397 5367402 +
aggactgctggttgcccatttt

SEQ ID NO: 107534 - DNA, 22 bp, Artificial Sequence
  Synthetic oligonucleotide; CTG chr11 5367387 5367408 5367404 5367409 +
ctggttgcccatttttatggtt

SEQ ID NO: 107535 - DNA, 22 bp, Artificial Sequence
  Synthetic oligonucleotide; CTG chr11 5367390 5367411 5367407 5367412 +
gttgcccatttttatggttatt

SEQ ID NO: 107536 - DNA, 22 bp, Artificial Sequence
  Synthetic oligonucleotide; TTG chr11 5367394 5367415 5367411 5367416 +
cccatttttatggttatttatt

SEQ ID NO: 107537 - DNA, 22 bp, Artificial Sequence
  Synthetic oligonucleotide; TTT chr11 5367401 5367422 5367418 5367423 +
ttatggttatttattgatgata

SEQ ID NO: 107538 - DNA, 22 bp, Artificial Sequence
  Synthetic oligonucleotide; TTT chr11 5367402 5367423 5367419 5367424 +
tatggttatttattgatgatat

SEQ ID NO: 107539 - DNA, 22 bp, Artificial Sequence
  Synthetic oligonucleotide; TTT chr11 5367403 5367424 5367420 5367425 +
atggttatttattgatgatatg

SEQ ID NO: 107540 - DNA, 22 bp, Artificial Sequence
  Synthetic oligonucleotide; TTA chr11 5367404 5367425 5367421 5367426 +
tggttatttattgatgatatgc

SEQ ID NO: 107541 - DNA, 22 bp, Artificial Sequence
  Synthetic oligonucleotide; TTA chr11 5367410 5367431 5367427 5367432 +
tttattgatgatatgctaaaca

SEQ ID NO: 107542 - DNA, 22 bp, Artificial Sequence
  Synthetic oligonucleotide; TTT chr11 5367413 5367434 5367430 5367435 +
attgatgatatgctaaacaagg

SEQ ID NO: 107543 - DNA, 22 bp, Artificial Sequence
  Synthetic oligonucleotide; TTA chr11 5367414 5367435 5367431 5367436 +
ttgatgatatgctaaacaaggg

SEQ ID NO: 107544 - DNA, 22 bp, Artificial Sequence
  Synthetic oligonucleotide; TTG chr11 5367417 5367438 5367434 5367439 +
atgatatgctaaacaaggggtg

SEQ ID NO: 107545 - DNA, 22 bp, Artificial Sequence
  Synthetic oligonucleotide; CTA chr11 5367428 5367449 5367445 5367450 +
aacaaggggtggattattcatg

SEQ ID NO: 107546 - DNA, 22 bp, Artificial Sequence
  Synthetic oligonucleotide; TTA chr11 5367444 5367465 5367461 5367466 +
ttcatgcctccccttttcagac

SEQ ID NO: 107547 - DNA, 22 bp, Artificial Sequence
  Synthetic oligonucleotide; TTC chr11 5367447 5367468 5367464 5367469 +
atgcctccccttttcagaccgc

SEQ ID NO: 107548 - DNA, 22 bp, Artificial Sequence
  Synthetic oligonucleotide; CTC chr11 5367454 5367475 5367471 5367476 +
cccttttcagaccgcttagcgt

SEQ ID NO: 107549 - DNA, 22 bp, Artificial Sequence
  Synthetic oligonucleotide; CTT chr11 5367459 5367480 5367476 5367481 +
ttcagaccgcttagcgtaactt

SEQ ID NO: 107550 - DNA, 22 bp, Artificial Sequence
  Synthetic oligonucleotide; TTT chr11 5367460 5367481 5367477 5367482 +
tcagaccgcttagcgtaacttc

SEQ ID NO: 107551 - DNA, 22 bp, Artificial Sequence
  Synthetic oligonucleotide; TTT chr11 5367461 5367482 5367478 5367483 +
cagaccgcttagcgtaacttcc

SEQ ID NO: 107552 - DNA, 22 bp, Artificial Sequence
  Synthetic oligonucleotide; TTC chr11 5367462 5367483 5367479 5367484 +
agaccgcttagcgtaacttcct

SEQ ID NO: 107553 - DNA, 22 bp, Artificial Sequence
  Synthetic oligonucleotide; CTT chr11 5367471 5367492 5367488 5367493 +
agcgtaacttcctgatgttgcc

SEQ ID NO: 107554 - DNA, 22 bp, Artificial Sequence
  Synthetic oligonucleotide; TTA chr11 5367472 5367493 5367489 5367494 +
gcgtaacttcctgatgttgcca

SEQ ID NO: 107555 - DNA, 22 bp, Artificial Sequence
  Synthetic oligonucleotide; CTT chr11 5367481 5367502 5367498 5367503 +
cctgatgttgccatggcatttc

SEQ ID NO: 107556 - DNA, 22 bp, Artificial Sequence
  Synthetic oligonucleotide; TTC chr11 5367482 5367503 5367499 5367504 +
ctgatgttgccatggcatttct

SEQ ID NO: 107557 - DNA, 22 bp, Artificial Sequence
  Synthetic oligonucleotide; CTG chr11 5367485 5367506 5367502 5367507 +
atgttgccatggcatttctaaa

SEQ ID NO: 107558 - DNA, 22 bp, Artificial Sequence
  Synthetic oligonucleotide; TTG chr11 5367491 5367512 5367508 5367513 +
ccatggcatttctaaacagtca

SEQ ID NO: 107559 - DNA, 22 bp, Artificial Sequence
  Synthetic oligonucleotide; TTT chr11 5367502 5367523 5367519 5367524 +
ctaaacagtcatagtgctggtg

SEQ ID NO: 107560 - DNA, 22 bp, Artificial Sequence
  Synthetic oligonucleotide; TTC chr11 5367503 5367524 5367520 5367525 +
taaacagtcatagtgctggtgg

SEQ ID NO: 107561 - DNA, 22 bp, Artificial Sequence
  Synthetic oligonucleotide; CTA chr11 5367505 5367526 5367522 5367527 +
aacagtcatagtgctggtggga

SEQ ID NO: 107562 - DNA, 22 bp, Artificial Sequence
  Synthetic oligonucleotide; CTG chr11 5367521 5367542 5367538 5367543 +
gtgggagagtagcagtgaggac

SEQ ID NO: 107563 - DNA, 22 bp, Artificial Sequence
  Synthetic oligonucleotide; CTA chr11 5367545 5367566 5367562 5367567 +
ccagaggtcactctcatcacaa

SEQ ID NO: 107564 - DNA, 22 bp, Artificial Sequence
  Synthetic oligonucleotide; CTC chr11 5367558 5367579 5367575 5367580 +
tcatcacaatcttggtttggtg

SEQ ID NO: 107565 - DNA, 22 bp, Artificial Sequence
  Synthetic oligonucleotide; CTC chr11 5367560 5367581 5367577 5367582 +
atcacaatcttggtttggtggg

SEQ ID NO: 107566 - DNA, 22 bp, Artificial Sequence
  Synthetic oligonucleotide; CTT chr11 5367571 5367592 5367588 5367593 +
ggtttggtgggtttcagccagc

SEQ ID NO: 107567 - DNA, 22 bp, Artificial Sequence
  Synthetic oligonucleotide; TTG chr11 5367572 5367593 5367589 5367594 +
gtttggtgggtttcagccagct

SEQ ID NO: 107568 - DNA, 22 bp, Artificial Sequence
  Synthetic oligonucleotide; TTT chr11 5367576 5367597 5367593 5367598 +
ggtgggtttcagccagcttctt

SEQ ID NO: 107569 - DNA, 22 bp, Artificial Sequence
  Synthetic oligonucleotide; TTG chr11 5367577 5367598 5367594 5367599 +
gtgggtttcagccagcttcttt

SEQ ID NO: 107570 - DNA, 22 bp, Artificial Sequence
  Synthetic oligonucleotide; TTT chr11 5367585 5367606 5367602 5367607 +
cagccagcttctttactgcaaa

SEQ ID NO: 107571 - DNA, 22 bp, Artificial Sequence
  Synthetic oligonucleotide; TTC chr11 5367586 5367607 5367603 5367608 +
agccagcttctttactgcaaac

SEQ ID NO: 107572 - DNA, 22 bp, Artificial Sequence
  Synthetic oligonucleotide; CTT chr11 5367595 5367616 5367612 5367617 +
ctttactgcaaactgttttttc

SEQ ID NO: 107573 - DNA, 22 bp, Artificial Sequence
  Synthetic oligonucleotide; TTC chr11 5367596 5367617 5367613 5367618 +
tttactgcaaactgttttttca

SEQ ID NO: 107574 - DNA, 22 bp, Artificial Sequence
  Synthetic oligonucleotide; CTT chr11 5367598 5367619 5367615 5367620 +
tactgcaaactgttttttcagc

SEQ ID NO: 107575 - DNA, 22 bp, Artificial Sequence
  Synthetic oligonucleotide; TTT chr11 5367599 5367620 5367616 5367621 +
actgcaaactgttttttcagca

SEQ ID NO: 107576 - DNA, 22 bp, Artificial Sequence
  Synthetic oligonucleotide; TTA chr11 5367600 5367621 5367617 5367622 +
ctgcaaactgttttttcagcaa

SEQ ID NO: 107577 - DNA, 22 bp, Artificial Sequence
  Synthetic oligonucleotide; CTG chr11 5367603 5367624 5367620 5367625 +
caaactgttttttcagcaaggt

SEQ ID NO: 107578 - DNA, 22 bp, Artificial Sequence
  Synthetic oligonucleotide; CTG chr11 5367610 5367631 5367627 5367632 +
ttttttcagcaaggtctttatg

SEQ ID NO: 107579 - DNA, 22 bp, Artificial Sequence
  Synthetic oligonucleotide; TTT chr11 5367613 5367634 5367630 5367635 +
tttcagcaaggtctttatgacc

SEQ ID NO: 107580 - DNA, 22 bp, Artificial Sequence
  Synthetic oligonucleotide; TTT chr11 5367614 5367635 5367631 5367636 +
ttcagcaaggtctttatgacct

SEQ ID NO: 107581 - DNA, 22 bp, Artificial Sequence
  Synthetic oligonucleotide; TTT chr11 5367615 5367636 5367632 5367637 +
tcagcaaggtctttatgacctg

SEQ ID NO: 107582 - DNA, 22 bp, Artificial Sequence
  Synthetic oligonucleotide; TTT chr11 5367616 5367637 5367633 5367638 +
cagcaaggtctttatgacctgt

SEQ ID NO: 107583 - DNA, 22 bp, Artificial Sequence
  Synthetic oligonucleotide; TTC chr11 5367617 5367638 5367634 5367639 +
agcaaggtctttatgacctgta

SEQ ID NO: 107584 - DNA, 22 bp, Artificial Sequence
  Synthetic oligonucleotide; CTT chr11 5367628 5367649 5367645 5367650 +
tatgacctgtatcttgtgccaa

SEQ ID NO: 107585 - DNA, 22 bp, Artificial Sequence
  Synthetic oligonucleotide; TTT chr11 5367629 5367650 5367646 5367651 +
atgacctgtatcttgtgccaac

SEQ ID NO: 107586 - DNA, 22 bp, Artificial Sequence
  Synthetic oligonucleotide; TTA chr11 5367630 5367651 5367647 5367652 +
tgacctgtatcttgtgccaacc

SEQ ID NO: 107587 - DNA, 22 bp, Artificial Sequence
  Synthetic oligonucleotide; CTG chr11 5367637 5367658 5367654 5367659 +
tatcttgtgccaacctcttatc

SEQ ID NO: 107588 - DNA, 22 bp, Artificial Sequence
  Synthetic oligonucleotide; CTT chr11 5367643 5367664 5367660 5367665 +
gtgccaacctcttatctcatcc

SEQ ID NO: 107589 - DNA, 22 bp, Artificial Sequence
  Synthetic oligonucleotide; TTG chr11 5367644 5367665 5367661 5367666 +
tgccaacctcttatctcatcct

SEQ ID NO: 107590 - DNA, 22 bp, Artificial Sequence
  Synthetic oligonucleotide; CTC chr11 5367654 5367675 5367671 5367676 +
ttatctcatcctgtgactgaga

SEQ ID NO: 107591 - DNA, 22 bp, Artificial Sequence
  Synthetic oligonucleotide; CTT chr11 5367656 5367677 5367673 5367678 +
atctcatcctgtgactgagaat

SEQ ID NO: 107592 - DNA, 22 bp, Artificial Sequence
  Synthetic oligonucleotide; TTA chr11 5367657 5367678 5367674 5367679 +
tctcatcctgtgactgagaatg

SEQ ID NO: 107593 - DNA, 22 bp, Artificial Sequence
  Synthetic oligonucleotide; CTC chr11 5367661 5367682 5367678 5367683 +
atcctgtgactgagaatgccta

SEQ ID NO: 107594 - DNA, 22 bp, Artificial Sequence
  Synthetic oligonucleotide; CTG chr11 5367667 5367688 5367684 5367689 +
tgactgagaatgcctaactttc

SEQ ID NO: 107595 - DNA, 22 bp, Artificial Sequence
  Synthetic oligonucleotide; CTG chr11 5367673 5367694 5367690 5367695 +
agaatgcctaactttctgggaa

SEQ ID NO: 107596 - DNA, 22 bp, Artificial Sequence
  Synthetic oligonucleotide; CTA chr11 5367683 5367704 5367700 5367705 +
actttctgggaatacagcccag

SEQ ID NO: 107597 - DNA, 22 bp, Artificial Sequence
  Synthetic oligonucleotide; CTT chr11 5367687 5367708 5367704 5367709 +
tctgggaatacagcccagtagg

SEQ ID NO: 107598 - DNA, 22 bp, Artificial Sequence
  Synthetic oligonucleotide; TTT chr11 5367688 5367709 5367705 5367710 +
ctgggaatacagcccagtaggt

SEQ ID NO: 107599 - DNA, 22 bp, Artificial Sequence
  Synthetic oligonucleotide; TTC chr11 5367689 5367710 5367706 5367711 +
tgggaatacagcccagtaggtc

SEQ ID NO: 107600 - DNA, 22 bp, Artificial Sequence
  Synthetic oligonucleotide; CTG chr11 5367691 5367712 5367708 5367713 +
ggaatacagcccagtaggtctc

SEQ ID NO: 107601 - DNA, 22 bp, Artificial Sequence
  Synthetic oligonucleotide; CTC chr11 5367713 5367734 5367730 5367735 +
agccttattgtacccagctcct

SEQ ID NO: 107602 - DNA, 22 bp, Artificial Sequence
  Synthetic oligonucleotide; CTT chr11 5367719 5367740 5367736 5367741 +
attgtacccagctcctatttaa

SEQ ID NO: 107603 - DNA, 22 bp, Artificial Sequence
  Synthetic oligonucleotide; TTA chr11 5367720 5367741 5367737 5367742 +
ttgtacccagctcctatttaag

SEQ ID NO: 107604 - DNA, 22 bp, Artificial Sequence
  Synthetic oligonucleotide; TTG chr11 5367723 5367744 5367740 5367745 +
tacccagctcctatttaagatg

SEQ ID NO: 107605 - DNA, 22 bp, Artificial Sequence
  Synthetic oligonucleotide; CTC chr11 5367733 5367754 5367750 5367755 +
ctatttaagatggagttgctct

SEQ ID NO: 107606 - DNA, 22 bp, Artificial Sequence
  Synthetic oligonucleotide; CTA chr11 5367736 5367757 5367753 5367758 +
tttaagatggagttgctctggt

SEQ ID NO: 107607 - DNA, 22 bp, Artificial Sequence
  Synthetic oligonucleotide; TTT chr11 5367739 5367760 5367756 5367761 +
aagatggagttgctctggttca

SEQ ID NO: 107608 - DNA, 22 bp, Artificial Sequence
  Synthetic oligonucleotide; TTA chr11 5367740 5367761 5367757 5367762 +
agatggagttgctctggttcaa

SEQ ID NO: 107609 - DNA, 22 bp, Artificial Sequence
  Synthetic oligonucleotide; TTG chr11 5367751 5367772 5367768 5367773 +
ctctggttcaaatgcctctgac

SEQ ID NO: 107610 - DNA, 22 bp, Artificial Sequence
  Synthetic oligonucleotide; CTC chr11 5367754 5367775 5367771 5367776 +
tggttcaaatgcctctgacaaa

SEQ ID NO: 107611 - DNA, 22 bp, Artificial Sequence
  Synthetic oligonucleotide; CTG chr11 5367756 5367777 5367773 5367778 +
gttcaaatgcctctgacaaaag

SEQ ID NO: 107612 - DNA, 22 bp, Artificial Sequence
  Synthetic oligonucleotide; TTC chr11 5367760 5367781 5367777 5367782 +
aaatgcctctgacaaaaggaac

SEQ ID NO: 107613 - DNA, 22 bp, Artificial Sequence
  Synthetic oligonucleotide; CTC chr11 5367769 5367790 5367786 5367791 +
tgacaaaaggaacaaaaatgtt

SEQ ID NO: 107614 - DNA, 22 bp, Artificial Sequence
  Synthetic oligonucleotide; CTG chr11 5367771 5367792 5367788 5367793 +
acaaaaggaacaaaaatgttgt

SEQ ID NO: 107615 - DNA, 22 bp, Artificial Sequence
  Synthetic oligonucleotide; TTG chr11 5367792 5367813 5367809 5367814 +
tttctggtatgctagcacccag

SEQ ID NO: 107616 - DNA, 22 bp, Artificial Sequence
  Synthetic oligonucleotide; TTT chr11 5367795 5367816 5367812 5367817 +
ctggtatgctagcacccagaat

SEQ ID NO: 107617 - DNA, 22 bp, Artificial Sequence
  Synthetic oligonucleotide; TTC chr11 5367796 5367817 5367813 5367818 +
tggtatgctagcacccagaata

SEQ ID NO: 107618 - DNA, 22 bp, Artificial Sequence
  Synthetic oligonucleotide; CTG chr11 5367798 5367819 5367815 5367820 +
gtatgctagcacccagaataga

SEQ ID NO: 107619 - DNA, 22 bp, Artificial Sequence
  Synthetic oligonucleotide; CTA chr11 5367806 5367827 5367823 5367828 +
gcacccagaatagaggcacttg

SEQ ID NO: 107620 - DNA, 22 bp, Artificial Sequence
  Synthetic oligonucleotide; CTT chr11 5367827 5367848 5367844 5367849 +
gcacaatatatgcattcaaaaa

SEQ ID NO: 107621 - DNA, 22 bp, Artificial Sequence
  Synthetic oligonucleotide; TTG chr11 5367828 5367849 5367845 5367850 +
cacaatatatgcattcaaaaat

SEQ ID NO: 107622 - DNA, 22 bp, Artificial Sequence
  Synthetic oligonucleotide; TTC chr11 5367844 5367865 5367861 5367866 +
aaaaatgtattttttttcactt

SEQ ID NO: 107623 - DNA, 22 bp, Artificial Sequence
  Synthetic oligonucleotide; TTT chr11 5367856 5367877 5367873 5367878 +
tttttcacttgtgctttctgcc

SEQ ID NO: 107624 - DNA, 22 bp, Artificial Sequence
  Synthetic oligonucleotide; TTT chr11 5367857 5367878 5367874 5367879 +
ttttcacttgtgctttctgcct

SEQ ID NO: 107625 - DNA, 22 bp, Artificial Sequence
  Synthetic oligonucleotide; TTT chr11 5367858 5367879 5367875 5367880 +
tttcacttgtgctttctgccta

SEQ ID NO: 107626 - DNA, 22 bp, Artificial Sequence
  Synthetic oligonucleotide; TTT chr11 5367859 5367880 5367876 5367881 +
ttcacttgtgctttctgcctat

SEQ ID NO: 107627 - DNA, 22 bp, Artificial Sequence
  Synthetic oligonucleotide; TTT chr11 5367860 5367881 5367877 5367882 +
tcacttgtgctttctgcctata

SEQ ID NO: 107628 - DNA, 22 bp, Artificial Sequence
  Synthetic oligonucleotide; TTT chr11 5367861 5367882 5367878 5367883 +
cacttgtgctttctgcctatat

SEQ ID NO: 107629 - DNA, 22 bp, Artificial Sequence
  Synthetic oligonucleotide; TTC chr11 5367862 5367883 5367879 5367884 +
acttgtgctttctgcctatatc

SEQ ID NO: 107630 - DNA, 22 bp, Artificial Sequence
  Synthetic oligonucleotide; CTT chr11 5367866 5367887 5367883 5367888 +
gtgctttctgcctatatctatt

SEQ ID NO: 107631 - DNA, 22 bp, Artificial Sequence
  Synthetic oligonucleotide; TTG chr11 5367867 5367888 5367884 5367889 +
tgctttctgcctatatctattt

SEQ ID NO: 107632 - DNA, 22 bp, Artificial Sequence
  Synthetic oligonucleotide; CTT chr11 5367872 5367893 5367889 5367894 +
tctgcctatatctatttttatg

SEQ ID NO: 107633 - DNA, 22 bp, Artificial Sequence
  Synthetic oligonucleotide; TTT chr11 5367873 5367894 5367890 5367895 +
ctgcctatatctatttttatgt

SEQ ID NO: 107634 - DNA, 22 bp, Artificial Sequence
  Synthetic oligonucleotide; TTC chr11 5367874 5367895 5367891 5367896 +
tgcctatatctatttttatgtc

SEQ ID NO: 107635 - DNA, 22 bp, Artificial Sequence
  Synthetic oligonucleotide; CTG chr11 5367876 5367897 5367893 5367898 +
cctatatctatttttatgtcct

SEQ ID NO: 107636 - DNA, 22 bp, Artificial Sequence
  Synthetic oligonucleotide; CTA chr11 5367880 5367901 5367897 5367902 +
tatctatttttatgtcctcatg

SEQ ID NO: 107637 - DNA, 22 bp, Artificial Sequence
  Synthetic oligonucleotide; CTA chr11 5367886 5367907 5367903 5367908 +
tttttatgtcctcatgcttaaa

SEQ ID NO: 107638 - DNA, 22 bp, Artificial Sequence
  Synthetic oligonucleotide; TTT chr11 5367889 5367910 5367906 5367911 +
ttatgtcctcatgcttaaatct

SEQ ID NO: 107639 - DNA, 22 bp, Artificial Sequence
  Synthetic oligonucleotide; TTT chr11 5367890 5367911 5367907 5367912 +
tatgtcctcatgcttaaatctt

SEQ ID NO: 107640 - DNA, 22 bp, Artificial Sequence
  Synthetic oligonucleotide; TTT chr11 5367891 5367912 5367908 5367913 +
atgtcctcatgcttaaatcttg

SEQ ID NO: 107641 - DNA, 22 bp, Artificial Sequence
  Synthetic oligonucleotide; TTA chr11 5367892 5367913 5367909 5367914 +
tgtcctcatgcttaaatcttga

SEQ ID NO: 107642 - DNA, 22 bp, Artificial Sequence
  Synthetic oligonucleotide; CTC chr11 5367899 5367920 5367916 5367921 +
atgcttaaatcttgaccaaggc

SEQ ID NO: 107643 - DNA, 22 bp, Artificial Sequence
  Synthetic oligonucleotide; CTT chr11 5367905 5367926 5367922 5367927 +
aaatcttgaccaaggctatgca

SEQ ID NO: 107644 - DNA, 22 bp, Artificial Sequence
  Synthetic oligonucleotide; TTA chr11 5367906 5367927 5367923 5367928 +
aatcttgaccaaggctatgcat

SEQ ID NO: 107645 - DNA, 22 bp, Artificial Sequence
  Synthetic oligonucleotide; CTT chr11 5367912 5367933 5367929 5367934 +
gaccaaggctatgcattttcct

SEQ ID NO: 107646 - DNA, 22 bp, Artificial Sequence
  Synthetic oligonucleotide; TTG chr11 5367913 5367934 5367930 5367935 +
accaaggctatgcattttccta

SEQ ID NO: 107647 - DNA, 22 bp, Artificial Sequence
  Synthetic oligonucleotide; CTA chr11 5367923 5367944 5367940 5367945 +
tgcattttcctatccttactca

SEQ ID NO: 107648 - DNA, 22 bp, Artificial Sequence
  Synthetic oligonucleotide; TTT chr11 5367930 5367951 5367947 5367952 +
tcctatccttactcagcagttt

SEQ ID NO: 107649 - DNA, 22 bp, Artificial Sequence
  Synthetic oligonucleotide; TTT chr11 5367931 5367952 5367948 5367953 +
cctatccttactcagcagtttg

SEQ ID NO: 107650 - DNA, 22 bp, Artificial Sequence
  Synthetic oligonucleotide; TTC chr11 5367932 5367953 5367949 5367954 +
ctatccttactcagcagtttgt

SEQ ID NO: 107651 - DNA, 22 bp, Artificial Sequence
  Synthetic oligonucleotide; CTA chr11 5367935 5367956 5367952 5367957 +
tccttactcagcagtttgtgag

SEQ ID NO: 107652 - DNA, 22 bp, Artificial Sequence
  Synthetic oligonucleotide; CTT chr11 5367940 5367961 5367957 5367962 +
actcagcagtttgtgaggaatc

SEQ ID NO: 107653 - DNA, 22 bp, Artificial Sequence
  Synthetic oligonucleotide; TTA chr11 5367941 5367962 5367958 5367963 +
ctcagcagtttgtgaggaatca

SEQ ID NO: 107654 - DNA, 22 bp, Artificial Sequence
  Synthetic oligonucleotide; CTC chr11 5367944 5367965 5367961 5367966 +
agcagtttgtgaggaatcagac

SEQ ID NO: 107655 - DNA, 22 bp, Artificial Sequence
  Synthetic oligonucleotide; TTT chr11 5367952 5367973 5367969 5367974 +
gtgaggaatcagacattcttca

SEQ ID NO: 107656 - DNA, 22 bp, Artificial Sequence
  Synthetic oligonucleotide; TTG chr11 5367953 5367974 5367970 5367975 +
tgaggaatcagacattcttcaa

SEQ ID NO: 107657 - DNA, 22 bp, Artificial Sequence
  Synthetic oligonucleotide; TTC chr11 5367970 5367991 5367987 5367992 +
ttcaaagtttcacttctaccag

SEQ ID NO: 107658 - DNA, 22 bp, Artificial Sequence
  Synthetic oligonucleotide; CTT chr11 5367972 5367993 5367989 5367994 +
caaagtttcacttctaccagag

SEQ ID NO: 107659 - DNA, 22 bp, Artificial Sequence
  Synthetic oligonucleotide; TTC chr11 5367973 5367994 5367990 5367995 +
aaagtttcacttctaccagagt

SEQ ID NO: 107660 - DNA, 22 bp, Artificial Sequence
  Synthetic oligonucleotide; TTT chr11 5367980 5368001 5367997 5368002 +
cacttctaccagagtagagcta

SEQ ID NO: 107661 - DNA, 22 bp, Artificial Sequence
  Synthetic oligonucleotide; TTC chr11 5367981 5368002 5367998 5368003 +
acttctaccagagtagagctac

SEQ ID NO: 107662 - DNA, 22 bp, Artificial Sequence
  Synthetic oligonucleotide; CTT chr11 5367985 5368006 5368002 5368007 +
ctaccagagtagagctacttct

SEQ ID NO: 107663 - DNA, 22 bp, Artificial Sequence
  Synthetic oligonucleotide; TTC chr11 5367986 5368007 5368003 5368008 +
taccagagtagagctacttctc

SEQ ID NO: 107664 - DNA, 22 bp, Artificial Sequence
  Synthetic oligonucleotide; CTA chr11 5367988 5368009 5368005 5368010 +
ccagagtagagctacttctctt

SEQ ID NO: 107665 - DNA, 22 bp, Artificial Sequence
  Synthetic oligonucleotide; CTA chr11 5368002 5368023 5368019 5368024 +
cttctcttctaattatatctta

SEQ ID NO: 107666 - DNA, 22 bp, Artificial Sequence
  Synthetic oligonucleotide; CTT chr11 5368005 5368026 5368022 5368027 +
ctcttctaattatatcttacac

SEQ ID NO: 107667 - DNA, 22 bp, Artificial Sequence
  Synthetic oligonucleotide; TTC chr11 5368006 5368027 5368023 5368028 +
tcttctaattatatcttacacc

SEQ ID NO: 107668 - DNA, 22 bp, Artificial Sequence
  Synthetic oligonucleotide; CTC chr11 5368008 5368029 5368025 5368030 +
ttctaattatatcttacacccc

SEQ ID NO: 107669 - DNA, 22 bp, Artificial Sequence
  Synthetic oligonucleotide; CTT chr11 5368010 5368031 5368027 5368032 +
ctaattatatcttacaccccac

SEQ ID NO: 107670 - DNA, 22 bp, Artificial Sequence
  Synthetic oligonucleotide; TTC chr11 5368011 5368032 5368028 5368033 +
taattatatcttacaccccaca

SEQ ID NO: 107671 - DNA, 22 bp, Artificial Sequence
  Synthetic oligonucleotide; CTA chr11 5368013 5368034 5368030 5368035 +
attatatcttacaccccacaac

SEQ ID NO: 107672 - DNA, 22 bp, Artificial Sequence
  Synthetic oligonucleotide; TTA chr11 5368017 5368038 5368034 5368039 +
tatcttacaccccacaactaac

SEQ ID NO: 107673 - DNA, 22 bp, Artificial Sequence
  Synthetic oligonucleotide; CTT chr11 5368023 5368044 5368040 5368045 +
acaccccacaactaacccaagc

SEQ ID NO: 107674 - DNA, 22 bp, Artificial Sequence
  Synthetic oligonucleotide; TTA chr11 5368024 5368045 5368041 5368046 +
caccccacaactaacccaagct

SEQ ID NO: 107675 - DNA, 22 bp, Artificial Sequence
  Synthetic oligonucleotide; CTA chr11 5368037 5368058 5368054 5368059 +
acccaagcttcacttggttctt

SEQ ID NO: 107676 - DNA, 22 bp, Artificial Sequence
  Synthetic oligonucleotide; CTT chr11 5368047 5368068 5368064 5368069 +
cacttggttctttgctcctatg

SEQ ID NO: 107677 - DNA, 22 bp, Artificial Sequence
  Synthetic oligonucleotide; TTC chr11 5368048 5368069 5368065 5368070 +
acttggttctttgctcctatgg

SEQ ID NO: 107678 - DNA, 22 bp, Artificial Sequence
  Synthetic oligonucleotide; CTT chr11 5368052 5368073 5368069 5368074 +
ggttctttgctcctatggagac

SEQ ID NO: 107679 - DNA, 22 bp, Artificial Sequence
  Synthetic oligonucleotide; TTG chr11 5368053 5368074 5368070 5368075 +
gttctttgctcctatggagacc

SEQ ID NO: 107680 - DNA, 22 bp, Artificial Sequence
  Synthetic oligonucleotide; TTC chr11 5368057 5368078 5368074 5368079 +
tttgctcctatggagacccagg

SEQ ID NO: 107681 - DNA, 22 bp, Artificial Sequence
  Synthetic oligonucleotide; CTT chr11 5368059 5368080 5368076 5368081 +
tgctcctatggagacccaggct

SEQ ID NO: 107682 - DNA, 22 bp, Artificial Sequence
  Synthetic oligonucleotide; TTT chr11 5368060 5368081 5368077 5368082 +
gctcctatggagacccaggctc

SEQ ID NO: 107683 - DNA, 22 bp, Artificial Sequence
  Synthetic oligonucleotide; TTG chr11 5368061 5368082 5368078 5368083 +
ctcctatggagacccaggctca

SEQ ID NO: 107684 - DNA, 22 bp, Artificial Sequence
  Synthetic oligonucleotide; CTC chr11 5368064 5368085 5368081 5368086 +
ctatggagacccaggctcactc

SEQ ID NO: 107685 - DNA, 22 bp, Artificial Sequence
  Synthetic oligonucleotide; CTA chr11 5368067 5368088 5368084 5368089 +
tggagacccaggctcactcaga

SEQ ID NO: 107686 - DNA, 22 bp, Artificial Sequence
  Synthetic oligonucleotide; CTC chr11 5368082 5368103 5368099 5368104 +
actcagaactctctttctttgt

SEQ ID NO: 107687 - DNA, 22 bp, Artificial Sequence
  Synthetic oligonucleotide; CTC chr11 5368086 5368107 5368103 5368108 +
agaactctctttctttgttttt

SEQ ID NO: 107688 - DNA, 22 bp, Artificial Sequence
  Synthetic oligonucleotide; CTC chr11 5368093 5368114 5368110 5368115 +
tctttctttgttttttcctctg

SEQ ID NO: 107689 - DNA, 22 bp, Artificial Sequence
  Synthetic oligonucleotide; CTC chr11 5368095 5368116 5368112 5368117 +
tttctttgttttttcctctgcc

SEQ ID NO: 107690 - DNA, 22 bp, Artificial Sequence
  Synthetic oligonucleotide; CTT chr11 5368097 5368118 5368114 5368119 +
tctttgttttttcctctgccat

SEQ ID NO: 107691 - DNA, 22 bp, Artificial Sequence
  Synthetic oligonucleotide; TTT chr11 5368098 5368119 5368115 5368120 +
ctttgttttttcctctgccatt

SEQ ID NO: 107692 - DNA, 22 bp, Artificial Sequence
  Synthetic oligonucleotide; TTC chr11 5368099 5368120 5368116 5368121 +
tttgttttttcctctgccattc

SEQ ID NO: 107693 - DNA, 22 bp, Artificial Sequence
  Synthetic oligonucleotide; CTT chr11 5368101 5368122 5368118 5368123 +
tgttttttcctctgccattcag

SEQ ID NO: 107694 - DNA, 22 bp, Artificial Sequence
  Synthetic oligonucleotide; TTT chr11 5368102 5368123 5368119 5368124 +
gttttttcctctgccattcaga

SEQ ID NO: 107695 - DNA, 22 bp, Artificial Sequence
  Synthetic oligonucleotide; TTG chr11 5368103 5368124 5368120 5368125 +
ttttttcctctgccattcagat

SEQ ID NO: 107696 - DNA, 22 bp, Artificial Sequence
  Synthetic oligonucleotide; TTT chr11 5368106 5368127 5368123 5368128 +
tttcctctgccattcagatttg

SEQ ID NO: 107697 - DNA, 22 bp, Artificial Sequence
  Synthetic oligonucleotide; TTT chr11 5368107 5368128 5368124 5368129 +
ttcctctgccattcagatttgt

SEQ ID NO: 107698 - DNA, 22 bp, Artificial Sequence
  Synthetic oligonucleotide; TTT chr11 5368108 5368129 5368125 5368130 +
tcctctgccattcagatttgtt

SEQ ID NO: 107699 - DNA, 22 bp, Artificial Sequence
  Synthetic oligonucleotide; TTT chr11 5368109 5368130 5368126 5368131 +
cctctgccattcagatttgttg

SEQ ID NO: 107700 - DNA, 22 bp, Artificial Sequence
  Synthetic oligonucleotide; TTC chr11 5368110 5368131 5368127 5368132 +
ctctgccattcagatttgttgc

SEQ ID NO: 107701 - DNA, 22 bp, Artificial Sequence
  Synthetic oligonucleotide; CTC chr11 5368113 5368134 5368130 5368135 +
tgccattcagatttgttgcatc

SEQ ID NO: 107702 - DNA, 22 bp, Artificial Sequence
  Synthetic oligonucleotide; CTG chr11 5368115 5368136 5368132 5368137 +
ccattcagatttgttgcatctt

SEQ ID NO: 107703 - DNA, 22 bp, Artificial Sequence
  Synthetic oligonucleotide; TTC chr11 5368121 5368142 5368138 5368143 +
agatttgttgcatcttcaacca

SEQ ID NO: 107704 - DNA, 22 bp, Artificial Sequence
  Synthetic oligonucleotide; TTT chr11 5368127 5368148 5368144 5368149 +
gttgcatcttcaaccaataact

SEQ ID NO: 107705 - DNA, 22 bp, Artificial Sequence
  Synthetic oligonucleotide; TTG chr11 5368128 5368149 5368145 5368150 +
ttgcatcttcaaccaataactt

SEQ ID NO: 107706 - DNA, 22 bp, Artificial Sequence
  Synthetic oligonucleotide; TTG chr11 5368131 5368152 5368148 5368153 +
catcttcaaccaataacttaac

SEQ ID NO: 107707 - DNA, 22 bp, Artificial Sequence
  Synthetic oligonucleotide; CTT chr11 5368137 5368158 5368154 5368159 +
caaccaataacttaactatgaa

SEQ ID NO: 107708 - DNA, 22 bp, Artificial Sequence
  Synthetic oligonucleotide; TTC chr11 5368138 5368159 5368155 5368160 +
aaccaataacttaactatgaac

SEQ ID NO: 107709 - DNA, 22 bp, Artificial Sequence
  Synthetic oligonucleotide; CTT chr11 5368150 5368171 5368167 5368172 +
aactatgaaccagcatgaaaaa

SEQ ID NO: 107710 - DNA, 22 bp, Artificial Sequence
  Synthetic oligonucleotide; TTA chr11 5368151 5368172 5368168 5368173 +
actatgaaccagcatgaaaaat

SEQ ID NO: 107711 - DNA, 22 bp, Artificial Sequence
  Synthetic oligonucleotide; CTA chr11 5368155 5368176 5368172 5368177 +
tgaaccagcatgaaaaatcctg

SEQ ID NO: 107712 - DNA, 22 bp, Artificial Sequence
  Synthetic oligonucleotide; CTG chr11 5368177 5368198 5368194 5368199 +
ttaagtgttctgtaggcttctt

SEQ ID NO: 107713 - DNA, 22 bp, Artificial Sequence
  Synthetic oligonucleotide; TTA chr11 5368180 5368201 5368197 5368202 +
agtgttctgtaggcttcttgaa

SEQ ID NO: 107714 - DNA, 22 bp, Artificial Sequence
  Synthetic oligonucleotide; TTC chr11 5368187 5368208 5368204 5368209 +
tgtaggcttcttgaaacctatt

SEQ ID NO: 107715 - DNA, 22 bp, Artificial Sequence
  Synthetic oligonucleotide; CTG chr11 5368189 5368210 5368206 5368211 +
taggcttcttgaaacctattgt

SEQ ID NO: 107716 - DNA, 22 bp, Artificial Sequence
  Synthetic oligonucleotide; CTT chr11 5368196 5368217 5368213 5368218 +
cttgaaacctattgtttcatgc

SEQ ID NO: 107717 - DNA, 22 bp, Artificial Sequence
  Synthetic oligonucleotide; TTC chr11 5368197 5368218 5368214 5368219 +
ttgaaacctattgtttcatgct

SEQ ID NO: 107718 - DNA, 22 bp, Artificial Sequence
  Synthetic oligonucleotide; CTT chr11 5368199 5368220 5368216 5368221 +
gaaacctattgtttcatgcttc

SEQ ID NO: 107719 - DNA, 22 bp, Artificial Sequence
  Synthetic oligonucleotide; TTG chr11 5368200 5368221 5368217 5368222 +
aaacctattgtttcatgcttct

SEQ ID NO: 107720 - DNA, 22 bp, Artificial Sequence
  Synthetic oligonucleotide; CTA chr11 5368207 5368228 5368224 5368229 +
ttgtttcatgcttcttcataca

SEQ ID NO: 107721 - DNA, 22 bp, Artificial Sequence
  Synthetic oligonucleotide; TTG chr11 5368210 5368231 5368227 5368232 +
tttcatgcttcttcatacagtc

SEQ ID NO: 107722 - DNA, 22 bp, Artificial Sequence
  Synthetic oligonucleotide; TTT chr11 5368213 5368234 5368230 5368235 +
catgcttcttcatacagtctta

SEQ ID NO: 107723 - DNA, 22 bp, Artificial Sequence
  Synthetic oligonucleotide; TTC chr11 5368214 5368235 5368231 5368236 +
atgcttcttcatacagtcttat

SEQ ID NO: 107724 - DNA, 22 bp, Artificial Sequence
  Synthetic oligonucleotide; CTT chr11 5368220 5368241 5368237 5368242 +
cttcatacagtcttatgcagta

SEQ ID NO: 107725 - DNA, 22 bp, Artificial Sequence
  Synthetic oligonucleotide; TTC chr11 5368221 5368242 5368238 5368243 +
ttcatacagtcttatgcagtag

SEQ ID NO: 107726 - DNA, 22 bp, Artificial Sequence
  Synthetic oligonucleotide; CTT chr11 5368223 5368244 5368240 5368245 +
catacagtcttatgcagtagtt

SEQ ID NO: 107727 - DNA, 22 bp, Artificial Sequence
  Synthetic oligonucleotide; TTC chr11 5368224 5368245 5368241 5368246 +
atacagtcttatgcagtagttt

SEQ ID NO: 107728 - DNA, 22 bp, Artificial Sequence
  Synthetic oligonucleotide; CTT chr11 5368234 5368255 5368251 5368256 +
atgcagtagttttgggaattaa

SEQ ID NO: 107729 - DNA, 22 bp, Artificial Sequence
  Synthetic oligonucleotide; TTA chr11 5368235 5368256 5368252 5368257 +
tgcagtagttttgggaattaaa

SEQ ID NO: 107730 - DNA, 22 bp, Artificial Sequence
  Synthetic oligonucleotide; TTT chr11 5368246 5368267 5368263 5368268 +
tgggaattaaacagtttggttt

SEQ ID NO: 107731 - DNA, 22 bp, Artificial Sequence
  Synthetic oligonucleotide; TTT chr11 5368247 5368268 5368264 5368269 +
gggaattaaacagtttggttta

SEQ ID NO: 107732 - DNA, 22 bp, Artificial Sequence
  Synthetic oligonucleotide; TTG chr11 5368248 5368269 5368265 5368270 +
ggaattaaacagtttggtttac

SEQ ID NO: 107733 - DNA, 22 bp, Artificial Sequence
  Synthetic oligonucleotide; TTA chr11 5368255 5368276 5368272 5368277 +
aacagtttggtttacaatccca

SEQ ID NO: 107734 - DNA, 22 bp, Artificial Sequence
  Synthetic oligonucleotide; TTT chr11 5368263 5368284 5368280 5368285 +
ggtttacaatcccaccttccac

SEQ ID NO: 107735 - DNA, 22 bp, Artificial Sequence
  Synthetic oligonucleotide; TTG chr11 5368264 5368285 5368281 5368286 +
gtttacaatcccaccttccact

SEQ ID NO: 107736 - DNA, 22 bp, Artificial Sequence
  Synthetic oligonucleotide; TTT chr11 5368268 5368289 5368285 5368290 +
acaatcccaccttccacttatt

SEQ ID NO: 107737 - DNA, 22 bp, Artificial Sequence
  Synthetic oligonucleotide; TTA chr11 5368269 5368290 5368286 5368291 +
caatcccaccttccacttattg

SEQ ID NO: 107738 - DNA, 22 bp, Artificial Sequence
  Synthetic oligonucleotide; CTT chr11 5368281 5368302 5368298 5368303 +
ccacttattggctgcgtaccct

SEQ ID NO: 107739 - DNA, 22 bp, Artificial Sequence
  Synthetic oligonucleotide; TTC chr11 5368282 5368303 5368299 5368304 +
cacttattggctgcgtacccta

SEQ ID NO: 107740 - DNA, 22 bp, Artificial Sequence
  Synthetic oligonucleotide; CTT chr11 5368287 5368308 5368304 5368309 +
attggctgcgtaccctatagca

SEQ ID NO: 107741 - DNA, 22 bp, Artificial Sequence
  Synthetic oligonucleotide; TTA chr11 5368288 5368309 5368305 5368310 +
ttggctgcgtaccctatagcaa

SEQ ID NO: 107742 - DNA, 22 bp, Artificial Sequence
  Synthetic oligonucleotide; TTG chr11 5368291 5368312 5368308 5368313 +
gctgcgtaccctatagcaaagc

SEQ ID NO: 107743 - DNA, 22 bp, Artificial Sequence
  Synthetic oligonucleotide; CTG chr11 5368295 5368316 5368312 5368317 +
cgtaccctatagcaaagcaatt

SEQ ID NO: 107744 - DNA, 22 bp, Artificial Sequence
  Synthetic oligonucleotide; CTA chr11 5368304 5368325 5368321 5368326 +
tagcaaagcaatttatctttct

SEQ ID NO: 107745 - DNA, 22 bp, Artificial Sequence
  Synthetic oligonucleotide; TTT chr11 5368318 5368339 5368335 5368340 +
atctttctgtgttttggtccac

SEQ ID NO: 107746 - DNA, 22 bp, Artificial Sequence
  Synthetic oligonucleotide; TTA chr11 5368319 5368340 5368336 5368341 +
tctttctgtgttttggtccact

SEQ ID NO: 107747 - DNA, 22 bp, Artificial Sequence
  Synthetic oligonucleotide; CTT chr11 5368323 5368344 5368340 5368345 +
tctgtgttttggtccactcatc

SEQ ID NO: 107748 - DNA, 22 bp, Artificial Sequence
  Synthetic oligonucleotide; TTT chr11 5368324 5368345 5368341 5368346 +
ctgtgttttggtccactcatct

SEQ ID NO: 107749 - DNA, 22 bp, Artificial Sequence
  Synthetic oligonucleotide; TTC chr11 5368325 5368346 5368342 5368347 +
tgtgttttggtccactcatctt

SEQ ID NO: 107750 - DNA, 22 bp, Artificial Sequence
  Synthetic oligonucleotide; CTG chr11 5368327 5368348 5368344 5368349 +
tgttttggtccactcatcttta

SEQ ID NO: 107751 - DNA, 22 bp, Artificial Sequence
  Synthetic oligonucleotide; TTT chr11 5368332 5368353 5368349 5368354 +
tggtccactcatctttaagtgg

SEQ ID NO: 107752 - DNA, 22 bp, Artificial Sequence
  Synthetic oligonucleotide; TTT chr11 5368333 5368354 5368350 5368355 +
ggtccactcatctttaagtggg

SEQ ID NO: 107753 - DNA, 22 bp, Artificial Sequence
  Synthetic oligonucleotide; TTG chr11 5368334 5368355 5368351 5368356 +
gtccactcatctttaagtgggg

SEQ ID NO: 107754 - DNA, 22 bp, Artificial Sequence
  Synthetic oligonucleotide; CTC chr11 5368342 5368363 5368359 5368364 +
atctttaagtggggataccaat

SEQ ID NO: 107755 - DNA, 22 bp, Artificial Sequence
  Synthetic oligonucleotide; CTT chr11 5368347 5368368 5368364 5368369 +
taagtggggataccaatagtac

SEQ ID NO: 107756 - DNA, 22 bp, Artificial Sequence
  Synthetic oligonucleotide; TTT chr11 5368348 5368369 5368365 5368370 +
aagtggggataccaatagtacc

SEQ ID NO: 107757 - DNA, 22 bp, Artificial Sequence
  Synthetic oligonucleotide; TTA chr11 5368349 5368370 5368366 5368371 +
agtggggataccaatagtaccc

SEQ ID NO: 107758 - DNA, 22 bp, Artificial Sequence
  Synthetic oligonucleotide; TTG chr11 5368380 5368401 5368397 5368402 +
aattattttaatgattaaatac

SEQ ID NO: 107759 - DNA, 22 bp, Artificial Sequence
  Synthetic oligonucleotide; TTA chr11 5368385 5368406 5368402 5368407 +
ttttaatgattaaatacattaa

SEQ ID NO: 107760 - DNA, 22 bp, Artificial Sequence
  Synthetic oligonucleotide; TTT chr11 5368388 5368409 5368405 5368410 +
taatgattaaatacattaatat

SEQ ID NO: 107761 - DNA, 22 bp, Artificial Sequence
  Synthetic oligonucleotide; TTT chr11 5368389 5368410 5368406 5368411 +
aatgattaaatacattaatatg

SEQ ID NO: 107762 - DNA, 22 bp, Artificial Sequence
  Synthetic oligonucleotide; TTA chr11 5368390 5368411 5368407 5368412 +
atgattaaatacattaatatgt

SEQ ID NO: 107763 - DNA, 22 bp, Artificial Sequence
  Synthetic oligonucleotide; TTA chr11 5368397 5368418 5368414 5368419 +
aatacattaatatgtctaacgt

SEQ ID NO: 107764 - DNA, 22 bp, Artificial Sequence
  Synthetic oligonucleotide; TTA chr11 5368406 5368427 5368423 5368428 +
atatgtctaacgtgttcaatag

SEQ ID NO: 107765 - DNA, 22 bp, Artificial Sequence
  Synthetic oligonucleotide; CTA chr11 5368415 5368436 5368432 5368437 +
acgtgttcaatagtgcctggtc

SEQ ID NO: 107766 - DNA, 22 bp, Artificial Sequence
  Synthetic oligonucleotide; TTC chr11 5368423 5368444 5368440 5368445 +
aatagtgcctggtccattgtaa

SEQ ID NO: 107767 - DNA, 22 bp, Artificial Sequence
  Synthetic oligonucleotide; CTG chr11 5368434 5368455 5368451 5368456 +
gtccattgtaagtattatagaa

SEQ ID NO: 107768 - DNA, 22 bp, Artificial Sequence
  Synthetic oligonucleotide; TTG chr11 5368442 5368463 5368459 5368464 +
taagtattatagaaatcattgc

SEQ ID NO: 107769 - DNA, 22 bp, Artificial Sequence
  Synthetic oligonucleotide; TTA chr11 5368451 5368472 5368468 5368473 +
tagaaatcattgctattattac

SEQ ID NO: 107770 - DNA, 22 bp, Artificial Sequence
  Synthetic oligonucleotide; TTG chr11 5368463 5368484 5368480 5368485 +
ctattattactataatcatcat

SEQ ID NO: 107771 - DNA, 22 bp, Artificial Sequence
  Synthetic oligonucleotide; CTA chr11 5368466 5368487 5368483 5368488 +
ttattactataatcatcattga

SEQ ID NO: 107772 - DNA, 22 bp, Artificial Sequence
  Synthetic oligonucleotide; TTA chr11 5368469 5368490 5368486 5368491 +
ttactataatcatcattgaaaa

SEQ ID NO: 107773 - DNA, 22 bp, Artificial Sequence
  Synthetic oligonucleotide; TTA chr11 5368472 5368493 5368489 5368494 +
ctataatcatcattgaaaattt

SEQ ID NO: 107774 - DNA, 22 bp, Artificial Sequence
  Synthetic oligonucleotide; CTA chr11 5368475 5368496 5368492 5368497 +
taatcatcattgaaaattttgt

SEQ ID NO: 107775 - DNA, 22 bp, Artificial Sequence
  Synthetic oligonucleotide; TTG chr11 5368487 5368508 5368504 5368509 +
aaaattttgtgaaaatgagaca

SEQ ID NO: 107776 - DNA, 22 bp, Artificial Sequence
  Synthetic oligonucleotide; TTT chr11 5368494 5368515 5368511 5368516 +
tgtgaaaatgagacaatttgac

SEQ ID NO: 107777 - DNA, 22 bp, Artificial Sequence
  Synthetic oligonucleotide; TTT chr11 5368495 5368516 5368512 5368517 +
gtgaaaatgagacaatttgacc

SEQ ID NO: 107778 - DNA, 22 bp, Artificial Sequence
  Synthetic oligonucleotide; TTG chr11 5368496 5368517 5368513 5368518 +
tgaaaatgagacaatttgacct

SEQ ID NO: 107779 - DNA, 22 bp, Artificial Sequence
  Synthetic oligonucleotide; TTT chr11 5368513 5368534 5368530 5368535 +
gacctttgggctgagaagatac

SEQ ID NO: 107780 - DNA, 22 bp, Artificial Sequence
  Synthetic oligonucleotide; TTG chr11 5368514 5368535 5368531 5368536 +
acctttgggctgagaagatact

SEQ ID NO: 107781 - DNA, 22 bp, Artificial Sequence
  Synthetic oligonucleotide; CTT chr11 5368519 5368540 5368536 5368541 +
tgggctgagaagatactctgtc

SEQ ID NO: 107782 - DNA, 22 bp, Artificial Sequence
  Synthetic oligonucleotide; TTT chr11 5368520 5368541 5368537 5368542 +
gggctgagaagatactctgtct

SEQ ID NO: 107783 - DNA, 22 bp, Artificial Sequence
  Synthetic oligonucleotide; TTG chr11 5368521 5368542 5368538 5368543 +
ggctgagaagatactctgtcta

SEQ ID NO: 107784 - DNA, 22 bp, Artificial Sequence
  Synthetic oligonucleotide; CTG chr11 5368526 5368547 5368543 5368548 +
agaagatactctgtctagctct

SEQ ID NO: 107785 - DNA, 22 bp, Artificial Sequence
  Synthetic oligonucleotide; CTC chr11 5368537 5368558 5368554 5368559 +
tgtctagctctgacaaagaaaa

SEQ ID NO: 107786 - DNA, 22 bp, Artificial Sequence
  Synthetic oligonucleotide; CTG chr11 5368539 5368560 5368556 5368561 +
tctagctctgacaaagaaaata

SEQ ID NO: 107787 - DNA, 22 bp, Artificial Sequence
  Synthetic oligonucleotide; CTA chr11 5368543 5368564 5368560 5368565 +
gctctgacaaagaaaataaaaa

SEQ ID NO: 107788 - DNA, 22 bp, Artificial Sequence
  Synthetic oligonucleotide; CTC chr11 5368547 5368568 5368564 5368569 +
tgacaaagaaaataaaaacctt

SEQ ID NO: 107789 - DNA, 22 bp, Artificial Sequence
  Synthetic oligonucleotide; CTG chr11 5368549 5368570 5368566 5368571 +
acaaagaaaataaaaaccttta

SEQ ID NO: 107790 - DNA, 22 bp, Artificial Sequence
  Synthetic oligonucleotide; CTT chr11 5368569 5368590 5368586 5368591 +
taaaaagctctctcacaatcgt

SEQ ID NO: 107791 - DNA, 22 bp, Artificial Sequence
  Synthetic oligonucleotide; TTT chr11 5368570 5368591 5368587 5368592 +
aaaaagctctctcacaatcgta

SEQ ID NO: 107792 - DNA, 22 bp, Artificial Sequence
  Synthetic oligonucleotide; TTA chr11 5368571 5368592 5368588 5368593 +
aaaagctctctcacaatcgtaa

SEQ ID NO: 107793 - DNA, 22 bp, Artificial Sequence
  Synthetic oligonucleotide; CTC chr11 5368579 5368600 5368596 5368601 +
tctcacaatcgtaatacttgaa

SEQ ID NO: 107794 - DNA, 22 bp, Artificial Sequence
  Synthetic oligonucleotide; CTC chr11 5368581 5368602 5368598 5368603 +
tcacaatcgtaatacttgaagt

SEQ ID NO: 107795 - DNA, 22 bp, Artificial Sequence
  Synthetic oligonucleotide; CTC chr11 5368583 5368604 5368600 5368605 +
acaatcgtaatacttgaagtta

SEQ ID NO: 107796 - DNA, 22 bp, Artificial Sequence
  Synthetic oligonucleotide; CTT chr11 5368598 5368619 5368615 5368620 +
gaagttacacaagatattctaa

SEQ ID NO: 107797 - DNA, 22 bp, Artificial Sequence
  Synthetic oligonucleotide; TTG chr11 5368599 5368620 5368616 5368621 +
aagttacacaagatattctaac

SEQ ID NO: 107798 - DNA, 22 bp, Artificial Sequence
  Synthetic oligonucleotide; TTA chr11 5368605 5368626 5368622 5368627 +
cacaagatattctaacataaag

SEQ ID NO: 107799 - DNA, 22 bp, Artificial Sequence
  Synthetic oligonucleotide; TTC chr11 5368617 5368638 5368634 5368639 +
taacataaagactttgtgtttt

SEQ ID NO: 107800 - DNA, 22 bp, Artificial Sequence
  Synthetic oligonucleotide; CTA chr11 5368619 5368640 5368636 5368641 +
acataaagactttgtgttttat

SEQ ID NO: 107801 - DNA, 22 bp, Artificial Sequence
  Synthetic oligonucleotide; CTT chr11 5368631 5368652 5368648 5368653 +
tgtgttttattctcacatgcat

SEQ ID NO: 107802 - DNA, 22 bp, Artificial Sequence
  Synthetic oligonucleotide; TTT chr11 5368632 5368653 5368649 5368654 +
gtgttttattctcacatgcatc

SEQ ID NO: 107803 - DNA, 22 bp, Artificial Sequence
  Synthetic oligonucleotide; TTG chr11 5368633 5368654 5368650 5368655 +
tgttttattctcacatgcatcc

SEQ ID NO: 107804 - DNA, 22 bp, Artificial Sequence
  Synthetic oligonucleotide; TTT chr11 5368638 5368659 5368655 5368660 +
tattctcacatgcatcctgtga

SEQ ID NO: 107805 - DNA, 22 bp, Artificial Sequence
  Synthetic oligonucleotide; TTT chr11 5368639 5368660 5368656 5368661 +
attctcacatgcatcctgtgag

SEQ ID NO: 107806 - DNA, 22 bp, Artificial Sequence
  Synthetic oligonucleotide; TTA chr11 5368640 5368661 5368657 5368662 +
ttctcacatgcatcctgtgaga

SEQ ID NO: 107807 - DNA, 22 bp, Artificial Sequence
  Synthetic oligonucleotide; TTC chr11 5368643 5368664 5368660 5368665 +
tcacatgcatcctgtgagaaag

SEQ ID NO: 107808 - DNA, 22 bp, Artificial Sequence
  Synthetic oligonucleotide; CTC chr11 5368645 5368666 5368662 5368667 +
acatgcatcctgtgagaaagca

SEQ ID NO: 107809 - DNA, 22 bp, Artificial Sequence
  Synthetic oligonucleotide; CTG chr11 5368657 5368678 5368674 5368679 +
tgagaaagcagagcatagtaga

SEQ ID NO: 107810 - DNA, 22 bp, Artificial Sequence
  Synthetic oligonucleotide; TTT chr11 5368684 5368705 5368701 5368706 +
cagttttatctgtcaagagcaa

SEQ ID NO: 107811 - DNA, 22 bp, Artificial Sequence
  Synthetic oligonucleotide; TTC chr11 5368685 5368706 5368702 5368707 +
agttttatctgtcaagagcaaa

SEQ ID NO: 107812 - DNA, 22 bp, Artificial Sequence
  Synthetic oligonucleotide; TTT chr11 5368690 5368711 5368707 5368712 +
tatctgtcaagagcaaaatttg

SEQ ID NO: 107813 - DNA, 22 bp, Artificial Sequence
  Synthetic oligonucleotide; TTT chr11 5368691 5368712 5368708 5368713 +
atctgtcaagagcaaaatttga

SEQ ID NO: 107814 - DNA, 22 bp, Artificial Sequence
  Synthetic oligonucleotide; TTA chr11 5368692 5368713 5368709 5368714 +
tctgtcaagagcaaaatttgag

SEQ ID NO: 107815 - DNA, 22 bp, Artificial Sequence
  Synthetic oligonucleotide; CTG chr11 5368696 5368717 5368713 5368718 +
tcaagagcaaaatttgaggttt

SEQ ID NO: 107816 - DNA, 22 bp, Artificial Sequence
  Synthetic oligonucleotide; TTT chr11 5368711 5368732 5368728 5368733 +
gaggtttctaaacattgagtta

SEQ ID NO: 107817 - DNA, 22 bp, Artificial Sequence
  Synthetic oligonucleotide; TTG chr11 5368712 5368733 5368729 5368734 +
aggtttctaaacattgagttac

SEQ ID NO: 107818 - DNA, 22 bp, Artificial Sequence
  Synthetic oligonucleotide; TTT chr11 5368718 5368739 5368735 5368740 +
ctaaacattgagttactcaaaa

SEQ ID NO: 107819 - DNA, 22 bp, Artificial Sequence
  Synthetic oligonucleotide; TTC chr11 5368719 5368740 5368736 5368741 +
taaacattgagttactcaaaat

SEQ ID NO: 107820 - DNA, 22 bp, Artificial Sequence
  Synthetic oligonucleotide; CTA chr11 5368721 5368742 5368738 5368743 +
aacattgagttactcaaaatat

SEQ ID NO: 107821 - DNA, 22 bp, Artificial Sequence
  Synthetic oligonucleotide; TTG chr11 5368728 5368749 5368745 5368750 +
agttactcaaaatattatgctt

SEQ ID NO: 107822 - DNA, 22 bp, Artificial Sequence
  Synthetic oligonucleotide; TTA chr11 5368733 5368754 5368750 5368755 +
ctcaaaatattatgctttaaaa

SEQ ID NO: 107823 - DNA, 22 bp, Artificial Sequence
  Synthetic oligonucleotide; CTC chr11 5368736 5368757 5368753 5368758 +
aaaatattatgctttaaaactg

SEQ ID NO: 107824 - DNA, 22 bp, Artificial Sequence
  Synthetic oligonucleotide; TTA chr11 5368745 5368766 5368762 5368767 +
tgctttaaaactgaaggaagca

SEQ ID NO: 107825 - DNA, 22 bp, Artificial Sequence
  Synthetic oligonucleotide; CTT chr11 5368750 5368771 5368767 5368772 +
taaaactgaaggaagcaaaacc

SEQ ID NO: 107826 - DNA, 22 bp, Artificial Sequence
  Synthetic oligonucleotide; TTT chr11 5368751 5368772 5368768 5368773 +
aaaactgaaggaagcaaaacct

SEQ ID NO: 107827 - DNA, 22 bp, Artificial Sequence
  Synthetic oligonucleotide; TTA chr11 5368752 5368773 5368769 5368774 +
aaactgaaggaagcaaaacctc

SEQ ID NO: 107828 - DNA, 22 bp, Artificial Sequence
  Synthetic oligonucleotide; CTG chr11 5368758 5368779 5368775 5368780 +
aaggaagcaaaacctcagcata

SEQ ID NO: 107829 - DNA, 22 bp, Artificial Sequence
  Synthetic oligonucleotide; CTC chr11 5368774 5368795 5368791 5368796 +
agcataggccttctgaaagctt

SEQ ID NO: 107830 - DNA, 22 bp, Artificial Sequence
  Synthetic oligonucleotide; CTT chr11 5368786 5368807 5368803 5368808 +
ctgaaagcttacgatggctttt

SEQ ID NO: 107831 - DNA, 22 bp, Artificial Sequence
  Synthetic oligonucleotide; TTC chr11 5368787 5368808 5368804 5368809 +
tgaaagcttacgatggcttttc

SEQ ID NO: 107832 - DNA, 22 bp, Artificial Sequence
  Synthetic oligonucleotide; CTG chr11 5368789 5368810 5368806 5368811 +
aaagcttacgatggcttttctt

SEQ ID NO: 107833 - DNA, 22 bp, Artificial Sequence
  Synthetic oligonucleotide; CTT chr11 5368796 5368817 5368813 5368818 +
acgatggcttttctttttttcc

SEQ ID NO: 107834 - DNA, 22 bp, Artificial Sequence
  Synthetic oligonucleotide; TTA chr11 5368797 5368818 5368814 5368819 +
cgatggcttttctttttttccc

SEQ ID NO: 107835 - DNA, 22 bp, Artificial Sequence
  Synthetic oligonucleotide; CTT chr11 5368806 5368827 5368823 5368828 +
ttctttttttcccccagggcaa

SEQ ID NO: 107836 - DNA, 22 bp, Artificial Sequence
  Synthetic oligonucleotide; TTT chr11 5368807 5368828 5368824 5368829 +
tctttttttcccccagggcaaa

SEQ ID NO: 107837 - DNA, 22 bp, Artificial Sequence
  Synthetic oligonucleotide; TTT chr11 5368808 5368829 5368825 5368830 +
ctttttttcccccagggcaaag

SEQ ID NO: 107838 - DNA, 22 bp, Artificial Sequence
  Synthetic oligonucleotide; TTC chr11 5368809 5368830 5368826 5368831 +
tttttttcccccagggcaaagt

SEQ ID NO: 107839 - DNA, 22 bp, Artificial Sequence
  Synthetic oligonucleotide; CTT chr11 5368811 5368832 5368828 5368833 +
tttttcccccagggcaaagtgt

SEQ ID NO: 107840 - DNA, 22 bp, Artificial Sequence
  Synthetic oligonucleotide; TTT chr11 5368812 5368833 5368829 5368834 +
ttttcccccagggcaaagtgtt

SEQ ID NO: 107841 - DNA, 22 bp, Artificial Sequence
  Synthetic oligonucleotide; TTT chr11 5368813 5368834 5368830 5368835 +
tttcccccagggcaaagtgttc

SEQ ID NO: 107842 - DNA, 22 bp, Artificial Sequence
  Synthetic oligonucleotide; TTT chr11 5368814 5368835 5368831 5368836 +
ttcccccagggcaaagtgttct

SEQ ID NO: 107843 - DNA, 22 bp, Artificial Sequence
  Synthetic oligonucleotide; TTT chr11 5368815 5368836 5368832 5368837 +
tcccccagggcaaagtgttctt

SEQ ID NO: 107844 - DNA, 22 bp, Artificial Sequence
  Synthetic oligonucleotide; TTT chr11 5368816 5368837 5368833 5368838 +
cccccagggcaaagtgttctta

SEQ ID NO: 107845 - DNA, 22 bp, Artificial Sequence
  Synthetic oligonucleotide; TTC chr11 5368817 5368838 5368834 5368839 +
ccccagggcaaagtgttcttag

SEQ ID NO: 107846 - DNA, 22 bp, Artificial Sequence
  Synthetic oligonucleotide; TTC chr11 5368835 5368856 5368852 5368857 +
ttaggagcaagatgttggaatt

SEQ ID NO: 107847 - DNA, 22 bp, Artificial Sequence
  Synthetic oligonucleotide; CTT chr11 5368837 5368858 5368854 5368859 +
aggagcaagatgttggaattta

SEQ ID NO: 107848 - DNA, 22 bp, Artificial Sequence
  Synthetic oligonucleotide; TTA chr11 5368838 5368859 5368855 5368860 +
ggagcaagatgttggaatttac

SEQ ID NO: 107849 - DNA, 22 bp, Artificial Sequence
  Synthetic oligonucleotide; TTG chr11 5368852 5368873 5368869 5368874 +
gaatttacaccattcttatgtg

SEQ ID NO: 107850 - DNA, 22 bp, Artificial Sequence
  Synthetic oligonucleotide; TTT chr11 5368858 5368879 5368875 5368880 +
acaccattcttatgtggattaa

SEQ ID NO: 107851 - DNA, 22 bp, Artificial Sequence
  Synthetic oligonucleotide; TTA chr11 5368859 5368880 5368876 5368881 +
caccattcttatgtggattaag

SEQ ID NO: 107852 - DNA, 22 bp, Artificial Sequence
  Synthetic oligonucleotide; TTC chr11 5368867 5368888 5368884 5368889 +
ttatgtggattaagagaggttt

SEQ ID NO: 107853 - DNA, 22 bp, Artificial Sequence
  Synthetic oligonucleotide; CTT chr11 5368869 5368890 5368886 5368891 +
atgtggattaagagaggtttcc

SEQ ID NO: 107854 - DNA, 22 bp, Artificial Sequence
  Synthetic oligonucleotide; TTA chr11 5368870 5368891 5368887 5368892 +
tgtggattaagagaggtttcct

SEQ ID NO: 107855 - DNA, 22 bp, Artificial Sequence
  Synthetic oligonucleotide; TTA chr11 5368879 5368900 5368896 5368901 +
agagaggtttccttctgaggat

SEQ ID NO: 107856 - DNA, 22 bp, Artificial Sequence
  Synthetic oligonucleotide; TTT chr11 5368889 5368910 5368906 5368911 +
ccttctgaggatgttggaagcc

SEQ ID NO: 107857 - DNA, 22 bp, Artificial Sequence
  Synthetic oligonucleotide; TTC chr11 5368890 5368911 5368907 5368912 +
cttctgaggatgttggaagcct

SEQ ID NO: 107858 - DNA, 22 bp, Artificial Sequence
  Synthetic oligonucleotide; CTT chr11 5368893 5368914 5368910 5368915 +
ctgaggatgttggaagcctctg

SEQ ID NO: 107859 - DNA, 22 bp, Artificial Sequence
  Synthetic oligonucleotide; TTC chr11 5368894 5368915 5368911 5368916 +
tgaggatgttggaagcctctgt

SEQ ID NO: 107860 - DNA, 22 bp, Artificial Sequence
  Synthetic oligonucleotide; CTG chr11 5368896 5368917 5368913 5368918 +
aggatgttggaagcctctgttc

SEQ ID NO: 107861 - DNA, 22 bp, Artificial Sequence
  Synthetic oligonucleotide; TTG chr11 5368905 5368926 5368922 5368927 +
gaagcctctgttcaggaacttt

SEQ ID NO: 107862 - DNA, 22 bp, Artificial Sequence
  Synthetic oligonucleotide; CTC chr11 5368913 5368934 5368930 5368935 +
tgttcaggaactttttctttcc

SEQ ID NO: 107863 - DNA, 22 bp, Artificial Sequence
  Synthetic oligonucleotide; CTG chr11 5368915 5368936 5368932 5368937 +
ttcaggaactttttctttccgg

SEQ ID NO: 107864 - DNA, 22 bp, Artificial Sequence
  Synthetic oligonucleotide; TTC chr11 5368918 5368939 5368935 5368940 +
aggaactttttctttccggatc

SEQ ID NO: 107865 - DNA, 22 bp, Artificial Sequence
  Synthetic oligonucleotide; CTT chr11 5368926 5368947 5368943 5368948 +
tttctttccggatcatgcttac

SEQ ID NO: 107866 - DNA, 22 bp, Artificial Sequence
  Synthetic oligonucleotide; TTT chr11 5368927 5368948 5368944 5368949 +
ttctttccggatcatgcttaca

SEQ ID NO: 107867 - DNA, 22 bp, Artificial Sequence
  Synthetic oligonucleotide; TTT chr11 5368928 5368949 5368945 5368950 +
tctttccggatcatgcttacag

SEQ ID NO: 107868 - DNA, 22 bp, Artificial Sequence
  Synthetic oligonucleotide; TTT chr11 5368929 5368950 5368946 5368951 +
ctttccggatcatgcttacaga

SEQ ID NO: 107869 - DNA, 22 bp, Artificial Sequence
  Synthetic oligonucleotide; TTC chr11 5368930 5368951 5368947 5368952 +
tttccggatcatgcttacagat

SEQ ID NO: 107870 - DNA, 22 bp, Artificial Sequence
  Synthetic oligonucleotide; CTT chr11 5368932 5368953 5368949 5368954 +
tccggatcatgcttacagatct

SEQ ID NO: 107871 - DNA, 22 bp, Artificial Sequence
  Synthetic oligonucleotide; TTT chr11 5368933 5368954 5368950 5368955 +
ccggatcatgcttacagatctg

SEQ ID NO: 107872 - DNA, 22 bp, Artificial Sequence
  Synthetic oligonucleotide; TTC chr11 5368934 5368955 5368951 5368956 +
cggatcatgcttacagatctga

SEQ ID NO: 107873 - DNA, 22 bp, Artificial Sequence
  Synthetic oligonucleotide; CTT chr11 5368946 5368967 5368963 5368968 +
acagatctgattacacccaaga

SEQ ID NO: 107874 - DNA, 22 bp, Artificial Sequence
  Synthetic oligonucleotide; TTA chr11 5368947 5368968 5368964 5368969 +
cagatctgattacacccaagaa

SEQ ID NO: 107875 - DNA, 22 bp, Artificial Sequence
  Synthetic oligonucleotide; CTG chr11 5368955 5368976 5368972 5368977 +
attacacccaagaagcctaaat

SEQ ID NO: 107876 - DNA, 22 bp, Artificial Sequence
  Synthetic oligonucleotide; TTA chr11 5368959 5368980 5368976 5368981 +
cacccaagaagcctaaattgtg

SEQ ID NO: 107877 - DNA, 22 bp, Artificial Sequence
  Synthetic oligonucleotide; CTA chr11 5368974 5368995 5368991 5368996 +
aattgtgtgtcagccaactaga

SEQ ID NO: 107878 - DNA, 22 bp, Artificial Sequence
  Synthetic oligonucleotide; TTG chr11 5368979 5369000 5368996 5369001 +
tgtgtcagccaactagatgtgg

SEQ ID NO: 107879 - DNA, 22 bp, Artificial Sequence
  Synthetic oligonucleotide; CTA chr11 5368994 5369015 5369011 5369016 +
gatgtggacaagatagttttta

SEQ ID NO: 107880 - DNA, 22 bp, Artificial Sequence
  Synthetic oligonucleotide; TTT chr11 5369013 5369034 5369030 5369035 +
ttagcctccttctgggactaga

SEQ ID NO: 107881 - DNA, 22 bp, Artificial Sequence
  Synthetic oligonucleotide; TTT chr11 5369014 5369035 5369031 5369036 +
tagcctccttctgggactagat

SEQ ID NO: 107882 - DNA, 22 bp, Artificial Sequence
  Synthetic oligonucleotide; TTT chr11 5369015 5369036 5369032 5369037 +
agcctccttctgggactagata

SEQ ID NO: 107883 - DNA, 22 bp, Artificial Sequence
  Synthetic oligonucleotide; TTA chr11 5369016 5369037 5369033 5369038 +
gcctccttctgggactagatat

SEQ ID NO: 107884 - DNA, 22 bp, Artificial Sequence
  Synthetic oligonucleotide; CTC chr11 5369021 5369042 5369038 5369043 +
cttctgggactagatattcatt

SEQ ID NO: 107885 - DNA, 22 bp, Artificial Sequence
  Synthetic oligonucleotide; CTT chr11 5369024 5369045 5369041 5369046 +
ctgggactagatattcattcac

SEQ ID NO: 107886 - DNA, 22 bp, Artificial Sequence
  Synthetic oligonucleotide; TTC chr11 5369025 5369046 5369042 5369047 +
tgggactagatattcattcacc

SEQ ID NO: 107887 - DNA, 22 bp, Artificial Sequence
  Synthetic oligonucleotide; CTG chr11 5369027 5369048 5369044 5369049 +
ggactagatattcattcaccaa

SEQ ID NO: 107888 - DNA, 22 bp, Artificial Sequence
  Synthetic oligonucleotide; CTA chr11 5369033 5369054 5369050 5369055 +
gatattcattcaccaagatgag

SEQ ID NO: 107889 - DNA, 22 bp, Artificial Sequence
  Synthetic oligonucleotide; TTC chr11 5369040 5369061 5369057 5369062 +
attcaccaagatgagtgccttt

SEQ ID NO: 107890 - DNA, 22 bp, Artificial Sequence
  Synthetic oligonucleotide; TTC chr11 5369044 5369065 5369061 5369066 +
accaagatgagtgcctttgaag

SEQ ID NO: 107891 - DNA, 22 bp, Artificial Sequence
  Synthetic oligonucleotide; CTT chr11 5369061 5369082 5369078 5369083 +
tgaagcagaatctgtgataggg

SEQ ID NO: 107892 - DNA, 22 bp, Artificial Sequence
  Synthetic oligonucleotide; TTT chr11 5369062 5369083 5369079 5369084 +
gaagcagaatctgtgatagggt

SEQ ID NO: 107893 - DNA, 22 bp, Artificial Sequence
  Synthetic oligonucleotide; TTG chr11 5369063 5369084 5369080 5369085 +
aagcagaatctgtgatagggtg

SEQ ID NO: 107894 - DNA, 22 bp, Artificial Sequence
  Synthetic oligonucleotide; CTG chr11 5369075 5369096 5369092 5369097 +
tgatagggtggttgggccacct

SEQ ID NO: 107895 - DNA, 22 bp, Artificial Sequence
  Synthetic oligonucleotide; TTG chr11 5369089 5369110 5369106 5369111 +
ggccacctagagacatatggcc

SEQ ID NO: 107896 - DNA, 22 bp, Artificial Sequence
  Synthetic oligonucleotide; CTA chr11 5369098 5369119 5369115 5369120 +
gagacatatggccatgactaga

SEQ ID NO: 107897 - DNA, 22 bp, Artificial Sequence
  Synthetic oligonucleotide; CTA chr11 5369118 5369139 5369135 5369140 +
gaatctaaggttagacatacag

SEQ ID NO: 107898 - DNA, 22 bp, Artificial Sequence
  Synthetic oligonucleotide; CTA chr11 5369125 5369146 5369142 5369147 +
aggttagacatacagaaaggat

SEQ ID NO: 107899 - DNA, 22 bp, Artificial Sequence
  Synthetic oligonucleotide; TTA chr11 5369131 5369152 5369148 5369153 +
gacatacagaaaggatgaagtc

SEQ ID NO: 107900 - DNA, 22 bp, Artificial Sequence
  Synthetic oligonucleotide; CTT chr11 5369155 5369176 5369172 5369177 +
taaaaataggcattcattcatt

SEQ ID NO: 107901 - DNA, 22 bp, Artificial Sequence
  Synthetic oligonucleotide; TTT chr11 5369156 5369177 5369173 5369178 +
aaaaataggcattcattcattt

SEQ ID NO: 107902 - DNA, 22 bp, Artificial Sequence
  Synthetic oligonucleotide; TTA chr11 5369157 5369178 5369174 5369179 +
aaaataggcattcattcattta

SEQ ID NO: 107903 - DNA, 22 bp, Artificial Sequence
  Synthetic oligonucleotide; TTC chr11 5369170 5369191 5369187 5369192 +
attcatttattcatccattcac

SEQ ID NO: 107904 - DNA, 22 bp, Artificial Sequence
  Synthetic oligonucleotide; TTC chr11 5369174 5369195 5369191 5369196 +
atttattcatccattcacacat

SEQ ID NO: 107905 - DNA, 22 bp, Artificial Sequence
  Synthetic oligonucleotide; TTT chr11 5369178 5369199 5369195 5369200 +
attcatccattcacacatataa

SEQ ID NO: 107906 - DNA, 22 bp, Artificial Sequence
  Synthetic oligonucleotide; TTA chr11 5369179 5369200 5369196 5369201 +
ttcatccattcacacatataac

SEQ ID NO: 107907 - DNA, 22 bp, Artificial Sequence
  Synthetic oligonucleotide; TTC chr11 5369182 5369203 5369199 5369204 +
atccattcacacatataacctg

SEQ ID NO: 107908 - DNA, 22 bp, Artificial Sequence
  Synthetic oligonucleotide; TTC chr11 5369190 5369211 5369207 5369212 +
acacatataacctgagtcccta

SEQ ID NO: 107909 - DNA, 22 bp, Artificial Sequence
  Synthetic oligonucleotide; CTG chr11 5369204 5369225 5369221 5369226 +
agtccctactgattttctagta

SEQ ID NO: 107910 - DNA, 22 bp, Artificial Sequence
  Synthetic oligonucleotide; CTA chr11 5369212 5369233 5369229 5369234 +
ctgattttctagtactgtactg

SEQ ID NO: 107911 - DNA, 22 bp, Artificial Sequence
  Synthetic oligonucleotide; CTG chr11 5369215 5369236 5369232 5369237 +
attttctagtactgtactgaat

SEQ ID NO: 107912 - DNA, 22 bp, Artificial Sequence
  Synthetic oligonucleotide; TTT chr11 5369219 5369240 5369236 5369241 +
tctagtactgtactgaatgagg

SEQ ID NO: 107913 - DNA, 22 bp, Artificial Sequence
  Synthetic oligonucleotide; TTT chr11 5369220 5369241 5369237 5369242 +
ctagtactgtactgaatgaggc

SEQ ID NO: 107914 - DNA, 22 bp, Artificial Sequence
  Synthetic oligonucleotide; TTC chr11 5369221 5369242 5369238 5369243 +
tagtactgtactgaatgaggcc

SEQ ID NO: 107915 - DNA, 22 bp, Artificial Sequence
  Synthetic oligonucleotide; CTA chr11 5369223 5369244 5369240 5369245 +
gtactgtactgaatgaggccaa

SEQ ID NO: 107916 - DNA, 22 bp, Artificial Sequence
  Synthetic oligonucleotide; CTG chr11 5369229 5369250 5369246 5369251 +
tactgaatgaggccaacatgat

SEQ ID NO: 107917 - DNA, 22 bp, Artificial Sequence
  Synthetic oligonucleotide; CTG chr11 5369234 5369255 5369251 5369256 +
aatgaggccaacatgatagaag

SEQ ID NO: 107918 - DNA, 22 bp, Artificial Sequence
  Synthetic oligonucleotide; CTT chr11 5369306 5369327 5369323 5369328 +
aacaaatattaattaaagttat

SEQ ID NO: 107919 - DNA, 22 bp, Artificial Sequence
  Synthetic oligonucleotide; TTA chr11 5369307 5369328 5369324 5369329 +
acaaatattaattaaagttatt

SEQ ID NO: 107920 - DNA, 22 bp, Artificial Sequence
  Synthetic oligonucleotide; TTA chr11 5369317 5369338 5369334 5369339 +
attaaagttattattactagtt

SEQ ID NO: 107921 - DNA, 22 bp, Artificial Sequence
  Synthetic oligonucleotide; TTA chr11 5369321 5369342 5369338 5369343 +
aagttattattactagttagtg

SEQ ID NO: 107922 - DNA, 22 bp, Artificial Sequence
  Synthetic oligonucleotide; TTA chr11 5369327 5369348 5369344 5369349 +
ttattactagttagtggaatac

SEQ ID NO: 107923 - DNA, 22 bp, Artificial Sequence
  Synthetic oligonucleotide; TTA chr11 5369330 5369351 5369347 5369352 +
ttactagttagtggaatactat

SEQ ID NO: 107924 - DNA, 22 bp, Artificial Sequence
  Synthetic oligonucleotide; TTA chr11 5369333 5369354 5369350 5369355 +
ctagttagtggaatactattaa

SEQ ID NO: 107925 - DNA, 22 bp, Artificial Sequence
  Synthetic oligonucleotide; CTA chr11 5369336 5369357 5369353 5369358 +
gttagtggaatactattaacaa

SEQ ID NO: 107926 - DNA, 22 bp, Artificial Sequence
  Synthetic oligonucleotide; TTA chr11 5369340 5369361 5369357 5369362 +
gtggaatactattaacaataat

SEQ ID NO: 107927 - DNA, 22 bp, Artificial Sequence
  Synthetic oligonucleotide; CTA chr11 5369351 5369372 5369368 5369373 +
ttaacaataatattttagcagc

SEQ ID NO: 107928 - DNA, 22 bp, Artificial Sequence
  Synthetic oligonucleotide; TTA chr11 5369354 5369375 5369371 5369376 +
acaataatattttagcagccac

SEQ ID NO: 107929 - DNA, 22 bp, Artificial Sequence
  Synthetic oligonucleotide; TTT chr11 5369366 5369387 5369383 5369388 +
tagcagccactatttgcaaaat

SEQ ID NO: 107930 - DNA, 22 bp, Artificial Sequence
  Synthetic oligonucleotide; TTT chr11 5369367 5369388 5369384 5369389 +
agcagccactatttgcaaaata

SEQ ID NO: 107931 - DNA, 22 bp, Artificial Sequence
  Synthetic oligonucleotide; TTA chr11 5369368 5369389 5369385 5369390 +
gcagccactatttgcaaaatat

SEQ ID NO: 107932 - DNA, 22 bp, Artificial Sequence
  Synthetic oligonucleotide; CTA chr11 5369378 5369399 5369395 5369400 +
tttgcaaaatataacactttta

SEQ ID NO: 107933 - DNA, 22 bp, Artificial Sequence
  Synthetic oligonucleotide; TTT chr11 5369381 5369402 5369398 5369403 +
gcaaaatataacacttttagga

SEQ ID NO: 107934 - DNA, 22 bp, Artificial Sequence
  Synthetic oligonucleotide; TTG chr11 5369382 5369403 5369399 5369404 +
caaaatataacacttttaggag

SEQ ID NO: 107935 - DNA, 22 bp, Artificial Sequence
  Synthetic oligonucleotide; CTT chr11 5369397 5369418 5369414 5369419 +
ttaggagaattacatctattat

SEQ ID NO: 107936 - DNA, 22 bp, Artificial Sequence
  Synthetic oligonucleotide; TTT chr11 5369398 5369419 5369415 5369420 +
taggagaattacatctattata

SEQ ID NO: 107937 - DNA, 22 bp, Artificial Sequence
  Synthetic oligonucleotide; TTT chr11 5369399 5369420 5369416 5369421 +
aggagaattacatctattatac

SEQ ID NO: 107938 - DNA, 22 bp, Artificial Sequence
  Synthetic oligonucleotide; TTA chr11 5369400 5369421 5369417 5369422 +
ggagaattacatctattatacc

SEQ ID NO: 107939 - DNA, 22 bp, Artificial Sequence
  Synthetic oligonucleotide; TTA chr11 5369409 5369430 5369426 5369431 +
catctattatacctcagtaaaa

SEQ ID NO: 107940 - DNA, 22 bp, Artificial Sequence
  Synthetic oligonucleotide; CTA chr11 5369415 5369436 5369432 5369437 +
ttatacctcagtaaaactctat

SEQ ID NO: 107941 - DNA, 22 bp, Artificial Sequence
  Synthetic oligonucleotide; TTA chr11 5369418 5369439 5369435 5369440 +
tacctcagtaaaactctatgaa

SEQ ID NO: 107942 - DNA, 22 bp, Artificial Sequence
  Synthetic oligonucleotide; CTC chr11 5369424 5369445 5369441 5369446 +
agtaaaactctatgaaacagac

SEQ ID NO: 107943 - DNA, 22 bp, Artificial Sequence
  Synthetic oligonucleotide; CTC chr11 5369434 5369455 5369451 5369456 +
tatgaaacagactttttatata

SEQ ID NO: 107944 - DNA, 22 bp, Artificial Sequence
  Synthetic oligonucleotide; CTA chr11 5369436 5369457 5369453 5369458 +
tgaaacagactttttatatatt

SEQ ID NO: 107945 - DNA, 22 bp, Artificial Sequence
  Synthetic oligonucleotide; CTT chr11 5369448 5369469 5369465 5369470 +
tttatatattttttctggataa

SEQ ID NO: 107946 - DNA, 22 bp, Artificial Sequence
  Synthetic oligonucleotide; TTT chr11 5369449 5369470 5369466 5369471 +
ttatatattttttctggataaa

SEQ ID NO: 107947 - DNA, 22 bp, Artificial Sequence
  Synthetic oligonucleotide; TTT chr11 5369450 5369471 5369467 5369472 +
tatatattttttctggataaaa

SEQ ID NO: 107948 - DNA, 22 bp, Artificial Sequence
  Synthetic oligonucleotide; TTT chr11 5369451 5369472 5369468 5369473 +
atatattttttctggataaaaa

SEQ ID NO: 107949 - DNA, 22 bp, Artificial Sequence
  Synthetic oligonucleotide; TTA chr11 5369452 5369473 5369469 5369474 +
tatattttttctggataaaaaa

SEQ ID NO: 107950 - DNA, 22 bp, Artificial Sequence
  Synthetic oligonucleotide; TTT chr11 5369459 5369480 5369476 5369481 +
tttctggataaaaaataaaatc

SEQ ID NO: 107951 - DNA, 22 bp, Artificial Sequence
  Synthetic oligonucleotide; TTT chr11 5369460 5369481 5369477 5369482 +
ttctggataaaaaataaaatct

SEQ ID NO: 107952 - DNA, 22 bp, Artificial Sequence
  Synthetic oligonucleotide; TTT chr11 5369461 5369482 5369478 5369483 +
tctggataaaaaataaaatctg

SEQ ID NO: 107953 - DNA, 22 bp, Artificial Sequence
  Synthetic oligonucleotide; TTT chr11 5369462 5369483 5369479 5369484 +
ctggataaaaaataaaatctga

SEQ ID NO: 107954 - DNA, 22 bp, Artificial Sequence
  Synthetic oligonucleotide; TTC chr11 5369463 5369484 5369480 5369485 +
tggataaaaaataaaatctgat

SEQ ID NO: 107955 - DNA, 22 bp, Artificial Sequence
  Synthetic oligonucleotide; CTG chr11 5369465 5369486 5369482 5369487 +
gataaaaaataaaatctgataa

SEQ ID NO: 107956 - DNA, 22 bp, Artificial Sequence
  Synthetic oligonucleotide; CTG chr11 5369483 5369504 5369500 5369505 +
ataatttgagacatttaaaaaa

SEQ ID NO: 107957 - DNA, 22 bp, Artificial Sequence
  Synthetic oligonucleotide; TTT chr11 5369490 5369511 5369507 5369512 +
gagacatttaaaaaagtataca

SEQ ID NO: 107958 - DNA, 22 bp, Artificial Sequence
  Synthetic oligonucleotide; TTG chr11 5369491 5369512 5369508 5369513 +
agacatttaaaaaagtatacaa

SEQ ID NO: 107959 - DNA, 22 bp, Artificial Sequence
  Synthetic oligonucleotide; TTT chr11 5369499 5369520 5369516 5369521 +
aaaaaagtatacaactagtaag

SEQ ID NO: 107960 - DNA, 22 bp, Artificial Sequence
  Synthetic oligonucleotide; TTA chr11 5369500 5369521 5369517 5369522 +
aaaaagtatacaactagtaagt

SEQ ID NO: 107961 - DNA, 22 bp, Artificial Sequence
  Synthetic oligonucleotide; CTA chr11 5369516 5369537 5369533 5369538 +
gtaagtagttgtatttttaaaa

SEQ ID NO: 107962 - DNA, 22 bp, Artificial Sequence
  Synthetic oligonucleotide; TTG chr11 5369527 5369548 5369544 5369549 +
tatttttaaaattttccattca

SEQ ID NO: 107963 - DNA, 22 bp, Artificial Sequence
  Synthetic oligonucleotide; TTT chr11 5369532 5369553 5369549 5369554 +
ttaaaattttccattcactatc

SEQ ID NO: 107964 - DNA, 22 bp, Artificial Sequence
  Synthetic oligonucleotide; TTT chr11 5369533 5369554 5369550 5369555 +
taaaattttccattcactatcc

SEQ ID NO: 107965 - DNA, 22 bp, Artificial Sequence
  Synthetic oligonucleotide; TTT chr11 5369534 5369555 5369551 5369556 +
aaaattttccattcactatcct

SEQ ID NO: 107966 - DNA, 22 bp, Artificial Sequence
  Synthetic oligonucleotide; TTA chr11 5369535 5369556 5369552 5369557 +
aaattttccattcactatccta

SEQ ID NO: 107967 - DNA, 22 bp, Artificial Sequence
  Synthetic oligonucleotide; TTT chr11 5369541 5369562 5369558 5369563 +
tccattcactatcctaaatatg

SEQ ID NO: 107968 - DNA, 22 bp, Artificial Sequence
  Synthetic oligonucleotide; TTT chr11 5369542 5369563 5369559 5369564 +
ccattcactatcctaaatatgt

SEQ ID NO: 107969 - DNA, 22 bp, Artificial Sequence
  Synthetic oligonucleotide; TTC chr11 5369543 5369564 5369560 5369565 +
cattcactatcctaaatatgtc

SEQ ID NO: 107970 - DNA, 22 bp, Artificial Sequence
  Synthetic oligonucleotide; TTC chr11 5369548 5369569 5369565 5369570 +
actatcctaaatatgtctatga

SEQ ID NO: 107971 - DNA, 22 bp, Artificial Sequence
  Synthetic oligonucleotide; CTA chr11 5369552 5369573 5369569 5369574 +
tcctaaatatgtctatgatata

SEQ ID NO: 107972 - DNA, 22 bp, Artificial Sequence
  Synthetic oligonucleotide; CTA chr11 5369557 5369578 5369574 5369579 +
aatatgtctatgatataattta

SEQ ID NO: 107973 - DNA, 22 bp, Artificial Sequence
  Synthetic oligonucleotide; CTA chr11 5369567 5369588 5369584 5369589 +
tgatataatttaaaaaattata

SEQ ID NO: 107974 - DNA, 22 bp, Artificial Sequence
  Synthetic oligonucleotide; TTT chr11 5369578 5369599 5369595 5369600 +
aaaaaattatatatactccatg

SEQ ID NO: 107975 - DNA, 22 bp, Artificial Sequence
  Synthetic oligonucleotide; TTA chr11 5369579 5369600 5369596 5369601 +
aaaaattatatatactccatgt

SEQ ID NO: 107976 - DNA, 22 bp, Artificial Sequence
  Synthetic oligonucleotide; TTA chr11 5369587 5369608 5369604 5369609 +
tatatactccatgtatattaaa

SEQ ID NO: 107977 - DNA, 22 bp, Artificial Sequence
  Synthetic oligonucleotide; CTC chr11 5369596 5369617 5369613 5369618 +
catgtatattaaatataaagta

SEQ ID NO: 107978 - DNA, 22 bp, Artificial Sequence
  Synthetic oligonucleotide; TTA chr11 5369607 5369628 5369624 5369629 +
aatataaagtaaagacctttta

SEQ ID NO: 107979 - DNA, 22 bp, Artificial Sequence
  Synthetic oligonucleotide; CTT chr11 5369626 5369647 5369643 5369648 +
ttatccttacctttctatcctc

SEQ ID NO: 107980 - DNA, 22 bp, Artificial Sequence
  Synthetic oligonucleotide; TTT chr11 5369627 5369648 5369644 5369649 +
tatccttacctttctatcctcc

SEQ ID NO: 107981 - DNA, 22 bp, Artificial Sequence
  Synthetic oligonucleotide; TTT chr11 5369628 5369649 5369645 5369650 +
atccttacctttctatcctccc

SEQ ID NO: 107982 - DNA, 22 bp, Artificial Sequence
  Synthetic oligonucleotide; TTA chr11 5369629 5369650 5369646 5369651 +
tccttacctttctatcctccct

SEQ ID NO: 107983 - DNA, 22 bp, Artificial Sequence
  Synthetic oligonucleotide; CTT chr11 5369634 5369655 5369651 5369656 +
acctttctatcctccctggaga

SEQ ID NO: 107984 - DNA, 22 bp, Artificial Sequence
  Synthetic oligonucleotide; TTA chr11 5369635 5369656 5369652 5369657 +
cctttctatcctccctggagat

SEQ ID NO: 107985 - DNA, 22 bp, Artificial Sequence
  Synthetic oligonucleotide; CTT chr11 5369639 5369660 5369656 5369661 +
tctatcctccctggagataatt

SEQ ID NO: 107986 - DNA, 22 bp, Artificial Sequence
  Synthetic oligonucleotide; TTT chr11 5369640 5369661 5369657 5369662 +
ctatcctccctggagataattt

SEQ ID NO: 107987 - DNA, 22 bp, Artificial Sequence
  Synthetic oligonucleotide; TTC chr11 5369641 5369662 5369658 5369663 +
tatcctccctggagataatttc

SEQ ID NO: 107988 - DNA, 22 bp, Artificial Sequence
  Synthetic oligonucleotide; CTA chr11 5369643 5369664 5369660 5369665 +
tcctccctggagataatttccc

SEQ ID NO: 107989 - DNA, 22 bp, Artificial Sequence
  Synthetic oligonucleotide; CTC chr11 5369648 5369669 5369665 5369670 +
cctggagataatttccctttat

SEQ ID NO: 107990 - DNA, 22 bp, Artificial Sequence
  Synthetic oligonucleotide; CTG chr11 5369652 5369673 5369669 5369674 +
gagataatttccctttataatc

SEQ ID NO: 107991 - DNA, 22 bp, Artificial Sequence
  Synthetic oligonucleotide; TTT chr11 5369662 5369683 5369679 5369684 +
ccctttataatctgccatacat

SEQ ID NO: 107992 - DNA, 22 bp, Artificial Sequence
  Synthetic oligonucleotide; TTC chr11 5369663 5369684 5369680 5369685 +
cctttataatctgccatacatt

SEQ ID NO: 107993 - DNA, 22 bp, Artificial Sequence
  Synthetic oligonucleotide; CTT chr11 5369667 5369688 5369684 5369689 +
tataatctgccatacatttctc

SEQ ID NO: 107994 - DNA, 22 bp, Artificial Sequence
  Synthetic oligonucleotide; TTT chr11 5369668 5369689 5369685 5369690 +
ataatctgccatacatttctct

SEQ ID NO: 107995 - DNA, 22 bp, Artificial Sequence
  Synthetic oligonucleotide; TTA chr11 5369669 5369690 5369686 5369691 +
taatctgccatacatttctctg

SEQ ID NO: 107996 - DNA, 22 bp, Artificial Sequence
  Synthetic oligonucleotide; CTG chr11 5369676 5369697 5369693 5369698 +
ccatacatttctctgcaacttt

SEQ ID NO: 107997 - DNA, 22 bp, Artificial Sequence
  Synthetic oligonucleotide; TTT chr11 5369686 5369707 5369703 5369708 +
ctctgcaacttttctacacatt

SEQ ID NO: 107998 - DNA, 22 bp, Artificial Sequence
  Synthetic oligonucleotide; TTC chr11 5369687 5369708 5369704 5369709 +
tctgcaacttttctacacattt

SEQ ID NO: 107999 - DNA, 22 bp, Artificial Sequence
  Synthetic oligonucleotide; CTC chr11 5369689 5369710 5369706 5369711 +
tgcaacttttctacacatttat

SEQ ID NO: 108000 - DNA, 22 bp, Artificial Sequence
  Synthetic oligonucleotide; CTG chr11 5369691 5369712 5369708 5369713 +
caacttttctacacatttatat

SEQ ID NO: 108001 - DNA, 22 bp, Artificial Sequence
  Synthetic oligonucleotide; CTT chr11 5369697 5369718 5369714 5369719 +
ttctacacatttatatatacat

SEQ ID NO: 108002 - DNA, 22 bp, Artificial Sequence
  Synthetic oligonucleotide; TTT chr11 5369698 5369719 5369715 5369720 +
tctacacatttatatatacata

SEQ ID NO: 108003 - DNA, 22 bp, Artificial Sequence
  Synthetic oligonucleotide; TTT chr11 5369699 5369720 5369716 5369721 +
ctacacatttatatatacatat

SEQ ID NO: 108004 - DNA, 22 bp, Artificial Sequence
  Synthetic oligonucleotide; TTC chr11 5369700 5369721 5369717 5369722 +
tacacatttatatatacatata

SEQ ID NO: 108005 - DNA, 22 bp, Artificial Sequence
  Synthetic oligonucleotide; CTA chr11 5369702 5369723 5369719 5369724 +
cacatttatatatacatatatg

SEQ ID NO: 108006 - DNA, 22 bp, Artificial Sequence
  Synthetic oligonucleotide; TTT chr11 5369709 5369730 5369726 5369731 +
atatatacatatatgaacatac

SEQ ID NO: 108007 - DNA, 22 bp, Artificial Sequence
  Synthetic oligonucleotide; TTA chr11 5369710 5369731 5369727 5369732 +
tatatacatatatgaacatact

SEQ ID NO: 108008 - DNA, 22 bp, Artificial Sequence
  Synthetic oligonucleotide; CTC chr11 5369733 5369754 5369750 5369755 +
aaataaatagtcctattggctg

SEQ ID NO: 108009 - DNA, 22 bp, Artificial Sequence
  Synthetic oligonucleotide; CTA chr11 5369748 5369769 5369765 5369770 +
ttggctggtagcaagggctatg

SEQ ID NO: 108010 - DNA, 22 bp, Artificial Sequence
  Synthetic oligonucleotide; TTG chr11 5369751 5369772 5369768 5369773 +
gctggtagcaagggctatgtgt

SEQ ID NO: 108011 - DNA, 22 bp, Artificial Sequence
  Synthetic oligonucleotide; CTG chr11 5369755 5369776 5369772 5369777 +
gtagcaagggctatgtgtagca

SEQ ID NO: 108012 - DNA, 22 bp, Artificial Sequence
  Synthetic oligonucleotide; CTA chr11 5369768 5369789 5369785 5369790 +
tgtgtagcactgttatttccat

SEQ ID NO: 108013 - DNA, 22 bp, Artificial Sequence
  Synthetic oligonucleotide; CTG chr11 5369780 5369801 5369797 5369802 +
ttatttccatgatgccacacta

SEQ ID NO: 108014 - DNA, 22 bp, Artificial Sequence
  Synthetic oligonucleotide; TTA chr11 5369783 5369804 5369800 5369805 +
tttccatgatgccacactaaaa

SEQ ID NO: 108015 - DNA, 22 bp, Artificial Sequence
  Synthetic oligonucleotide; TTT chr11 5369786 5369807 5369803 5369808 +
ccatgatgccacactaaaatca

SEQ ID NO: 108016 - DNA, 22 bp, Artificial Sequence
  Synthetic oligonucleotide; TTC chr11 5369787 5369808 5369804 5369809 +
catgatgccacactaaaatcag

SEQ ID NO: 108017 - DNA, 22 bp, Artificial Sequence
  Synthetic oligonucleotide; CTA chr11 5369802 5369823 5369819 5369824 +
aaatcagtgctgcttgtctgca

SEQ ID NO: 108018 - DNA, 22 bp, Artificial Sequence
  Synthetic oligonucleotide; CTG chr11 5369814 5369835 5369831 5369836 +
cttgtctgcatttttgtgttac

SEQ ID NO: 108019 - DNA, 22 bp, Artificial Sequence
  Synthetic oligonucleotide; CTT chr11 5369817 5369838 5369834 5369839 +
gtctgcatttttgtgttacagt

SEQ ID NO: 108020 - DNA, 22 bp, Artificial Sequence
  Synthetic oligonucleotide; TTG chr11 5369818 5369839 5369835 5369840 +
tctgcatttttgtgttacagtg

SEQ ID NO: 108021 - DNA, 22 bp, Artificial Sequence
  Synthetic oligonucleotide; CTG chr11 5369822 5369843 5369839 5369844 +
catttttgtgttacagtgaatg

SEQ ID NO: 108022 - DNA, 22 bp, Artificial Sequence
  Synthetic oligonucleotide; TTT chr11 5369827 5369848 5369844 5369849 +
ttgtgttacagtgaatgtagac

SEQ ID NO: 108023 - DNA, 22 bp, Artificial Sequence
  Synthetic oligonucleotide; TTT chr11 5369828 5369849 5369845 5369850 +
tgtgttacagtgaatgtagact

SEQ ID NO: 108024 - DNA, 22 bp, Artificial Sequence
  Synthetic oligonucleotide; TTT chr11 5369829 5369850 5369846 5369851 +
gtgttacagtgaatgtagacta

SEQ ID NO: 108025 - DNA, 22 bp, Artificial Sequence
  Synthetic oligonucleotide; TTG chr11 5369830 5369851 5369847 5369852 +
tgttacagtgaatgtagactaa

SEQ ID NO: 108026 - DNA, 22 bp, Artificial Sequence
  Synthetic oligonucleotide; TTA chr11 5369835 5369856 5369852 5369857 +
cagtgaatgtagactaaaatcc

SEQ ID NO: 108027 - DNA, 22 bp, Artificial Sequence
  Synthetic oligonucleotide; CTA chr11 5369851 5369872 5369868 5369873 +
aaatccaaaataagtcaacagt

SEQ ID NO: 108028 - DNA, 22 bp, Artificial Sequence
  Synthetic oligonucleotide; TTG chr11 5369875 5369896 5369892 5369897 +
ttaaaagtgatgacctcattgg

SEQ ID NO: 108029 - DNA, 22 bp, Artificial Sequence
  Synthetic oligonucleotide; TTA chr11 5369878 5369899 5369895 5369900 +
aaagtgatgacctcattggttt

SEQ ID NO: 108030 - DNA, 22 bp, Artificial Sequence
  Synthetic oligonucleotide; CTC chr11 5369892 5369913 5369909 5369914 +
attggttttgctatcaacatag

SEQ ID NO: 108031 - DNA, 22 bp, Artificial Sequence
  Synthetic oligonucleotide; TTG chr11 5369896 5369917 5369913 5369918 +
gttttgctatcaacatagaaag

SEQ ID NO: 108032 - DNA, 22 bp, Artificial Sequence
  Synthetic oligonucleotide; TTT chr11 5369900 5369921 5369917 5369922 +
tgctatcaacatagaaagaaag

SEQ ID NO: 108033 - DNA, 22 bp, Artificial Sequence
  Synthetic oligonucleotide; TTT chr11 5369901 5369922 5369918 5369923 +
gctatcaacatagaaagaaagg

SEQ ID NO: 108034 - DNA, 22 bp, Artificial Sequence
  Synthetic oligonucleotide; TTG chr11 5369902 5369923 5369919 5369924 +
ctatcaacatagaaagaaaggg

SEQ ID NO: 108035 - DNA, 22 bp, Artificial Sequence
  Synthetic oligonucleotide; CTA chr11 5369905 5369926 5369922 5369927 +
tcaacatagaaagaaagggaag

SEQ ID NO: 108036 - DNA, 22 bp, Artificial Sequence
  Synthetic oligonucleotide; TTT chr11 5369933 5369954 5369950 5369955 +
tctcaggatttttactcaagga

SEQ ID NO: 108037 - DNA, 22 bp, Artificial Sequence
  Synthetic oligonucleotide; TTT chr11 5369934 5369955 5369951 5369956 +
ctcaggatttttactcaaggaa

SEQ ID NO: 108038 - DNA, 22 bp, Artificial Sequence
  Synthetic oligonucleotide; TTC chr11 5369935 5369956 5369952 5369957 +
tcaggatttttactcaaggaaa

SEQ ID NO: 108039 - DNA, 22 bp, Artificial Sequence
  Synthetic oligonucleotide; CTC chr11 5369937 5369958 5369954 5369959 +
aggatttttactcaaggaaagg

SEQ ID NO: 108040 - DNA, 22 bp, Artificial Sequence
  Synthetic oligonucleotide; TTT chr11 5369944 5369965 5369961 5369966 +
ttactcaaggaaaggcagtggg

SEQ ID NO: 108041 - DNA, 22 bp, Artificial Sequence
  Synthetic oligonucleotide; TTT chr11 5369945 5369966 5369962 5369967 +
tactcaaggaaaggcagtgggg

SEQ ID NO: 108042 - DNA, 22 bp, Artificial Sequence
  Synthetic oligonucleotide; TTT chr11 5369946 5369967 5369963 5369968 +
actcaaggaaaggcagtgggga

SEQ ID NO: 108043 - DNA, 22 bp, Artificial Sequence
  Synthetic oligonucleotide; TTA chr11 5369947 5369968 5369964 5369969 +
ctcaaggaaaggcagtggggaa

SEQ ID NO: 108044 - DNA, 22 bp, Artificial Sequence
  Synthetic oligonucleotide; CTC chr11 5369950 5369971 5369967 5369972 +
aaggaaaggcagtggggaaaga

SEQ ID NO: 108045 - DNA, 22 bp, Artificial Sequence
  Synthetic oligonucleotide; CTT chr11 5369977 5369998 5369994 5369999 +
tggtattctgtgtcaatctgta

SEQ ID NO: 108046 - DNA, 22 bp, Artificial Sequence
  Synthetic oligonucleotide; TTT chr11 5369978 5369999 5369995 5370000 +
ggtattctgtgtcaatctgtat

SEQ ID NO: 108047 - DNA, 22 bp, Artificial Sequence
  Synthetic oligonucleotide; TTG chr11 5369979 5370000 5369996 5370001 +
gtattctgtgtcaatctgtatc

SEQ ID NO: 108048 - DNA, 22 bp, Artificial Sequence
  Synthetic oligonucleotide; TTC chr11 5369985 5370006 5370002 5370007 +
tgtgtcaatctgtatcaacaag

SEQ ID NO: 108049 - DNA, 22 bp, Artificial Sequence
  Synthetic oligonucleotide; CTG chr11 5369987 5370008 5370004 5370009 +
tgtcaatctgtatcaacaagat

SEQ ID NO: 108050 - DNA, 22 bp, Artificial Sequence
  Synthetic oligonucleotide; CTG chr11 5369997 5370018 5370014 5370019 +
tatcaacaagatcttcaaacct

SEQ ID NO: 108051 - DNA, 22 bp, Artificial Sequence
  Synthetic oligonucleotide; CTT chr11 5370012 5370033 5370029 5370034 +
caaacctccctctgcatggccc

SEQ ID NO: 108052 - DNA, 22 bp, Artificial Sequence
  Synthetic oligonucleotide; TTC chr11 5370013 5370034 5370030 5370035 +
aaacctccctctgcatggcccc

SEQ ID NO: 108053 - DNA, 22 bp, Artificial Sequence
  Synthetic oligonucleotide; CTC chr11 5370020 5370041 5370037 5370042 +
cctctgcatggccccaggagag

SEQ ID NO: 108054 - DNA, 22 bp, Artificial Sequence
  Synthetic oligonucleotide; CTC chr11 5370024 5370045 5370041 5370046 +
tgcatggccccaggagagtcag

SEQ ID NO: 108055 - DNA, 22 bp, Artificial Sequence
  Synthetic oligonucleotide; CTG chr11 5370026 5370047 5370043 5370048 +
catggccccaggagagtcagtg

SEQ ID NO: 108056 - DNA, 22 bp, Artificial Sequence
  Synthetic oligonucleotide; TTC chr11 5370051 5370072 5370068 5370073 +
cacaaacctctcctgccatctt

SEQ ID NO: 108057 - DNA, 22 bp, Artificial Sequence
  Synthetic oligonucleotide; CTC chr11 5370061 5370082 5370078 5370083 +
tcctgccatcttatggtttgta

SEQ ID NO: 108058 - DNA, 22 bp, Artificial Sequence
  Synthetic oligonucleotide; CTC chr11 5370063 5370084 5370080 5370085 +
ctgccatcttatggtttgtaca

SEQ ID NO: 108059 - DNA, 22 bp, Artificial Sequence
  Synthetic oligonucleotide; CTG chr11 5370066 5370087 5370083 5370088 +
ccatcttatggtttgtacagca

SEQ ID NO: 108060 - DNA, 22 bp, Artificial Sequence
  Synthetic oligonucleotide; CTT chr11 5370073 5370094 5370090 5370095 +
atggtttgtacagcatgtgcaa

SEQ ID NO: 108061 - DNA, 22 bp, Artificial Sequence
  Synthetic oligonucleotide; TTA chr11 5370074 5370095 5370091 5370096 +
tggtttgtacagcatgtgcaag

SEQ ID NO: 108062 - DNA, 22 bp, Artificial Sequence
  Synthetic oligonucleotide; TTT chr11 5370080 5370101 5370097 5370102 +
gtacagcatgtgcaagctgctt

SEQ ID NO: 108063 - DNA, 22 bp, Artificial Sequence
  Synthetic oligonucleotide; TTG chr11 5370081 5370102 5370098 5370103 +
tacagcatgtgcaagctgcttc

SEQ ID NO: 108064 - DNA, 22 bp, Artificial Sequence
  Synthetic oligonucleotide; CTG chr11 5370099 5370120 5370116 5370121 +
cttctatagaaatgcatataga

SEQ ID NO: 108065 - DNA, 22 bp, Artificial Sequence
  Synthetic oligonucleotide; CTT chr11 5370102 5370123 5370119 5370124 +
ctatagaaatgcatatagaaaa

SEQ ID NO: 108066 - DNA, 22 bp, Artificial Sequence
  Synthetic oligonucleotide; TTC chr11 5370103 5370124 5370120 5370125 +
tatagaaatgcatatagaaaat

SEQ ID NO: 108067 - DNA, 22 bp, Artificial Sequence
  Synthetic oligonucleotide; CTA chr11 5370105 5370126 5370122 5370127 +
tagaaatgcatatagaaaatac

SEQ ID NO: 108068 - DNA, 22 bp, Artificial Sequence
  Synthetic oligonucleotide; CTA chr11 5370143 5370164 5370160 5370165 +
gaggctaccaagttgtaattta

SEQ ID NO: 108069 - DNA, 22 bp, Artificial Sequence
  Synthetic oligonucleotide; CTA chr11 5370150 5370171 5370167 5370172 +
ccaagttgtaatttaaaaataa

SEQ ID NO: 108070 - DNA, 22 bp, Artificial Sequence
  Synthetic oligonucleotide; TTG chr11 5370158 5370179 5370175 5370180 +
taatttaaaaataatgctcata

SEQ ID NO: 108071 - DNA, 22 bp, Artificial Sequence
  Synthetic oligonucleotide; TTT chr11 5370164 5370185 5370181 5370186 +
aaaaataatgctcataatcatc

SEQ ID NO: 108072 - DNA, 22 bp, Artificial Sequence
  Synthetic oligonucleotide; TTA chr11 5370165 5370186 5370182 5370187 +
aaaataatgctcataatcatca

SEQ ID NO: 108073 - DNA, 22 bp, Artificial Sequence
  Synthetic oligonucleotide; CTC chr11 5370177 5370198 5370194 5370199 +
ataatcatcaatgtatttatta

SEQ ID NO: 108074 - DNA, 22 bp, Artificial Sequence
  Synthetic oligonucleotide; TTT chr11 5370195 5370216 5370212 5370217 +
attattatcattaacagtcaca

SEQ ID NO: 108075 - DNA, 22 bp, Artificial Sequence
  Synthetic oligonucleotide; TTA chr11 5370196 5370217 5370213 5370218 +
ttattatcattaacagtcacag

SEQ ID NO: 108076 - DNA, 22 bp, Artificial Sequence
  Synthetic oligonucleotide; TTA chr11 5370199 5370220 5370216 5370221 +
ttatcattaacagtcacagtct

SEQ ID NO: 108077 - DNA, 22 bp, Artificial Sequence
  Synthetic oligonucleotide; TTA chr11 5370202 5370223 5370219 5370224 +
tcattaacagtcacagtctttt

SEQ ID NO: 108078 - DNA, 22 bp, Artificial Sequence
  Synthetic oligonucleotide; TTA chr11 5370208 5370229 5370225 5370230 +
acagtcacagtcttttatagta

SEQ ID NO: 108079 - DNA, 22 bp, Artificial Sequence
  Synthetic oligonucleotide; CTT chr11 5370222 5370243 5370239 5370244 +
ttatagtaaatcctaaagttga

SEQ ID NO: 108080 - DNA, 22 bp, Artificial Sequence
  Synthetic oligonucleotide; TTT chr11 5370223 5370244 5370240 5370245 +
tatagtaaatcctaaagttgaa

SEQ ID NO: 108081 - DNA, 22 bp, Artificial Sequence
  Synthetic oligonucleotide; TTT chr11 5370224 5370245 5370241 5370246 +
atagtaaatcctaaagttgaag

SEQ ID NO: 108082 - DNA, 22 bp, Artificial Sequence
  Synthetic oligonucleotide; TTA chr11 5370225 5370246 5370242 5370247 +
tagtaaatcctaaagttgaagg

SEQ ID NO: 108083 - DNA, 22 bp, Artificial Sequence
  Synthetic oligonucleotide; CTA chr11 5370237 5370258 5370254 5370259 +
aagttgaaggtttgaatgttta

SEQ ID NO: 108084 - DNA, 22 bp, Artificial Sequence
  Synthetic oligonucleotide; TTG chr11 5370243 5370264 5370260 5370265 +
aaggtttgaatgtttaatgcta

SEQ ID NO: 108085 - DNA, 22 bp, Artificial Sequence
  Synthetic oligonucleotide; TTT chr11 5370250 5370271 5370267 5370272 +
gaatgtttaatgctatgaaata

SEQ ID NO: 108086 - DNA, 22 bp, Artificial Sequence
  Synthetic oligonucleotide; TTG chr11 5370251 5370272 5370268 5370273 +
aatgtttaatgctatgaaatat

SEQ ID NO: 108087 - DNA, 22 bp, Artificial Sequence
  Synthetic oligonucleotide; TTT chr11 5370258 5370279 5370275 5370280 +
aatgctatgaaatattaaataa

SEQ ID NO: 108088 - DNA, 22 bp, Artificial Sequence
  Synthetic oligonucleotide; TTA chr11 5370259 5370280 5370276 5370281 +
atgctatgaaatattaaataag

SEQ ID NO: 108089 - DNA, 22 bp, Artificial Sequence
  Synthetic oligonucleotide; CTA chr11 5370265 5370286 5370282 5370287 +
tgaaatattaaataagtgacga

SEQ ID NO: 108090 - DNA, 22 bp, Artificial Sequence
  Synthetic oligonucleotide; TTA chr11 5370275 5370296 5370292 5370297 +
aataagtgacgatagtatcttt

SEQ ID NO: 108091 - DNA, 22 bp, Artificial Sequence
  Synthetic oligonucleotide; CTT chr11 5370296 5370317 5370313 5370318 +
ttatgctgactgtccaggattg

SEQ ID NO: 108092 - DNA, 22 bp, Artificial Sequence
  Synthetic oligonucleotide; TTT chr11 5370297 5370318 5370314 5370319 +
tatgctgactgtccaggattgg

SEQ ID NO: 108093 - DNA, 22 bp, Artificial Sequence
  Synthetic oligonucleotide; TTT chr11 5370298 5370319 5370315 5370320 +
atgctgactgtccaggattgga

SEQ ID NO: 108094 - DNA, 22 bp, Artificial Sequence
  Synthetic oligonucleotide; TTA chr11 5370299 5370320 5370316 5370321 +
tgctgactgtccaggattggaa

SEQ ID NO: 108095 - DNA, 22 bp, Artificial Sequence
  Synthetic oligonucleotide; CTG chr11 5370304 5370325 5370321 5370326 +
actgtccaggattggaaatgct

SEQ ID NO: 108096 - DNA, 22 bp, Artificial Sequence
  Synthetic oligonucleotide; CTG chr11 5370308 5370329 5370325 5370330 +
tccaggattggaaatgctacag

SEQ ID NO: 108097 - DNA, 22 bp, Artificial Sequence
  Synthetic oligonucleotide; TTG chr11 5370318 5370339 5370335 5370340 +
gaaatgctacagcaaagtgaga

SEQ ID NO: 108098 - DNA, 22 bp, Artificial Sequence
  Synthetic oligonucleotide; CTA chr11 5370327 5370348 5370344 5370349 +
cagcaaagtgagataggcattt

SEQ ID NO: 108099 - DNA, 22 bp, Artificial Sequence
  Synthetic oligonucleotide; TTT chr11 5370349 5370370 5370366 5370371 +
tatgtatatcatctgcaaagac

SEQ ID NO: 108100 - DNA, 22 bp, Artificial Sequence
  Synthetic oligonucleotide; TTT chr11 5370350 5370371 5370367 5370372 +
atgtatatcatctgcaaagact

SEQ ID NO: 108101 - DNA, 22 bp, Artificial Sequence
  Synthetic oligonucleotide; TTA chr11 5370351 5370372 5370368 5370373 +
tgtatatcatctgcaaagacta

SEQ ID NO: 108102 - DNA, 22 bp, Artificial Sequence
  Synthetic oligonucleotide; CTG chr11 5370364 5370385 5370381 5370386 +
caaagactaaactaaaatagct

SEQ ID NO: 108103 - DNA, 22 bp, Artificial Sequence
  Synthetic oligonucleotide; CTA chr11 5370373 5370394 5370390 5370395 +
aactaaaatagctgggttgtca

SEQ ID NO: 108104 - DNA, 22 bp, Artificial Sequence
  Synthetic oligonucleotide; CTA chr11 5370378 5370399 5370395 5370400 +
aaatagctgggttgtcaggtca

SEQ ID NO: 108105 - DNA, 22 bp, Artificial Sequence
  Synthetic oligonucleotide; CTG chr11 5370387 5370408 5370404 5370409 +
ggttgtcaggtcagagcaattt

SEQ ID NO: 108106 - DNA, 22 bp, Artificial Sequence
  Synthetic oligonucleotide; TTG chr11 5370392 5370413 5370409 5370414 +
tcaggtcagagcaatttacagg

SEQ ID NO: 108107 - DNA, 22 bp, Artificial Sequence
  Synthetic oligonucleotide; TTT chr11 5370409 5370430 5370426 5370431 +
acagggaaaattaaattcaaat

SEQ ID NO: 108108 - DNA, 22 bp, Artificial Sequence
  Synthetic oligonucleotide; TTA chr11 5370410 5370431 5370427 5370432 +
cagggaaaattaaattcaaatc

SEQ ID NO: 108109 - DNA, 22 bp, Artificial Sequence
  Synthetic oligonucleotide; TTA chr11 5370422 5370443 5370439 5370444 +
aattcaaatcttcagaggatca

SEQ ID NO: 108110 - DNA, 22 bp, Artificial Sequence
  Synthetic oligonucleotide; TTC chr11 5370427 5370448 5370444 5370449 +
aaatcttcagaggatcatttgt

SEQ ID NO: 108111 - DNA, 22 bp, Artificial Sequence
  Synthetic oligonucleotide; CTT chr11 5370434 5370455 5370451 5370456 +
cagaggatcatttgttggtatg

SEQ ID NO: 108112 - DNA, 22 bp, Artificial Sequence
  Synthetic oligonucleotide; TTC chr11 5370435 5370456 5370452 5370457 +
agaggatcatttgttggtatgt

SEQ ID NO: 108113 - DNA, 22 bp, Artificial Sequence
  Synthetic oligonucleotide; TTT chr11 5370447 5370468 5370464 5370469 +
gttggtatgtctctgtccaatt

SEQ ID NO: 108114 - DNA, 22 bp, Artificial Sequence
  Synthetic oligonucleotide; TTG chr11 5370448 5370469 5370465 5370470 +
ttggtatgtctctgtccaattt

SEQ ID NO: 108115 - DNA, 22 bp, Artificial Sequence
  Synthetic oligonucleotide; TTG chr11 5370451 5370472 5370468 5370473 +
gtatgtctctgtccaatttgag

SEQ ID NO: 108116 - DNA, 22 bp, Artificial Sequence
  Synthetic oligonucleotide; CTC chr11 5370460 5370481 5370477 5370482 +
tgtccaatttgagggcaataat

SEQ ID NO: 108117 - DNA, 22 bp, Artificial Sequence
  Synthetic oligonucleotide; CTG chr11 5370462 5370483 5370479 5370484 +
tccaatttgagggcaataattt

SEQ ID NO: 108118 - DNA, 22 bp, Artificial Sequence
  Synthetic oligonucleotide; TTT chr11 5370470 5370491 5370487 5370492 +
gagggcaataatttaatgccag

SEQ ID NO: 108119 - DNA, 22 bp, Artificial Sequence
  Synthetic oligonucleotide; TTG chr11 5370471 5370492 5370488 5370493 +
agggcaataatttaatgccaga

SEQ ID NO: 108120 - DNA, 22 bp, Artificial Sequence
  Synthetic oligonucleotide; TTT chr11 5370484 5370505 5370501 5370506 +
aatgccagaaaatatctattct

SEQ ID NO: 108121 - DNA, 22 bp, Artificial Sequence
  Synthetic oligonucleotide; TTA chr11 5370485 5370506 5370502 5370507 +
atgccagaaaatatctattctt

SEQ ID NO: 108122 - DNA, 22 bp, Artificial Sequence
  Synthetic oligonucleotide; CTA chr11 5370502 5370523 5370519 5370524 +
ttctttatctcactctctttct

SEQ ID NO: 108123 - DNA, 22 bp, Artificial Sequence
  Synthetic oligonucleotide; TTC chr11 5370505 5370526 5370522 5370527 +
tttatctcactctctttctttc

SEQ ID NO: 108124 - DNA, 22 bp, Artificial Sequence
  Synthetic oligonucleotide; CTT chr11 5370507 5370528 5370524 5370529 +
tatctcactctctttctttcat

SEQ ID NO: 108125 - DNA, 22 bp, Artificial Sequence
  Synthetic oligonucleotide; TTT chr11 5370508 5370529 5370525 5370530 +
atctcactctctttctttcatt

SEQ ID NO: 108126 - DNA, 22 bp, Artificial Sequence
  Synthetic oligonucleotide; TTA chr11 5370509 5370530 5370526 5370531 +
tctcactctctttctttcattc

SEQ ID NO: 108127 - DNA, 22 bp, Artificial Sequence
  Synthetic oligonucleotide; CTC chr11 5370513 5370534 5370530 5370535 +
actctctttctttcattcttac

SEQ ID NO: 108128 - DNA, 22 bp, Artificial Sequence
  Synthetic oligonucleotide; CTC chr11 5370517 5370538 5370534 5370539 +
tctttctttcattcttactttc

SEQ ID NO: 108129 - DNA, 22 bp, Artificial Sequence
  Synthetic oligonucleotide; CTC chr11 5370519 5370540 5370536 5370541 +
tttctttcattcttactttctg

SEQ ID NO: 108130 - DNA, 22 bp, Artificial Sequence
  Synthetic oligonucleotide; CTT chr11 5370521 5370542 5370538 5370543 +
tctttcattcttactttctgtc

SEQ ID NO: 108131 - DNA, 22 bp, Artificial Sequence
  Synthetic oligonucleotide; TTT chr11 5370522 5370543 5370539 5370544 +
ctttcattcttactttctgtct

SEQ ID NO: 108132 - DNA, 22 bp, Artificial Sequence
  Synthetic oligonucleotide; TTC chr11 5370523 5370544 5370540 5370545 +
tttcattcttactttctgtctt

SEQ ID NO: 108133 - DNA, 22 bp, Artificial Sequence
  Synthetic oligonucleotide; CTT chr11 5370525 5370546 5370542 5370547 +
tcattcttactttctgtctttc

SEQ ID NO: 108134 - DNA, 22 bp, Artificial Sequence
  Synthetic oligonucleotide; TTT chr11 5370526 5370547 5370543 5370548 +
cattcttactttctgtctttct

SEQ ID NO: 108135 - DNA, 22 bp, Artificial Sequence
  Synthetic oligonucleotide; TTC chr11 5370527 5370548 5370544 5370549 +
attcttactttctgtctttctc

SEQ ID NO: 108136 - DNA, 22 bp, Artificial Sequence
  Synthetic oligonucleotide; TTC chr11 5370531 5370552 5370548 5370553 +
ttactttctgtctttctccctt

SEQ ID NO: 108137 - DNA, 22 bp, Artificial Sequence
  Synthetic oligonucleotide; CTT chr11 5370533 5370554 5370550 5370555 +
actttctgtctttctccctttc

SEQ ID NO: 108138 - DNA, 22 bp, Artificial Sequence
  Synthetic oligonucleotide; TTA chr11 5370534 5370555 5370551 5370556 +
ctttctgtctttctccctttct

SEQ ID NO: 108139 - DNA, 22 bp, Artificial Sequence
  Synthetic oligonucleotide; CTT chr11 5370537 5370558 5370554 5370559 +
tctgtctttctccctttctcac

SEQ ID NO: 108140 - DNA, 22 bp, Artificial Sequence
  Synthetic oligonucleotide; TTT chr11 5370538 5370559 5370555 5370560 +
ctgtctttctccctttctcact

SEQ ID NO: 108141 - DNA, 22 bp, Artificial Sequence
  Synthetic oligonucleotide; TTC chr11 5370539 5370560 5370556 5370561 +
tgtctttctccctttctcactc

SEQ ID NO: 108142 - DNA, 22 bp, Artificial Sequence
  Synthetic oligonucleotide; CTG chr11 5370541 5370562 5370558 5370563 +
tctttctccctttctcactctt

SEQ ID NO: 108143 - DNA, 22 bp, Artificial Sequence
  Synthetic oligonucleotide; CTT chr11 5370545 5370566 5370562 5370567 +
tctccctttctcactctttctg

SEQ ID NO: 108144 - DNA, 22 bp, Artificial Sequence
  Synthetic oligonucleotide; TTT chr11 5370546 5370567 5370563 5370568 +
ctccctttctcactctttctgt

SEQ ID NO: 108145 - DNA, 22 bp, Artificial Sequence
  Synthetic oligonucleotide; TTC chr11 5370547 5370568 5370564 5370569 +
tccctttctcactctttctgtg

SEQ ID NO: 108146 - DNA, 22 bp, Artificial Sequence
  Synthetic oligonucleotide; CTC chr11 5370549 5370570 5370566 5370571 +
cctttctcactctttctgtgtt

SEQ ID NO: 108147 - DNA, 22 bp, Artificial Sequence
  Synthetic oligonucleotide; CTT chr11 5370553 5370574 5370570 5370575 +
tctcactctttctgtgtttaga

SEQ ID NO: 108148 - DNA, 22 bp, Artificial Sequence
  Synthetic oligonucleotide; TTT chr11 5370554 5370575 5370571 5370576 +
ctcactctttctgtgtttagaa

SEQ ID NO: 108149 - DNA, 22 bp, Artificial Sequence
  Synthetic oligonucleotide; TTC chr11 5370555 5370576 5370572 5370577 +
tcactctttctgtgtttagaaa

SEQ ID NO: 108150 - DNA, 22 bp, Artificial Sequence
  Synthetic oligonucleotide; CTC chr11 5370557 5370578 5370574 5370579 +
actctttctgtgtttagaaatg

SEQ ID NO: 108151 - DNA, 22 bp, Artificial Sequence
  Synthetic oligonucleotide; CTC chr11 5370561 5370582 5370578 5370583 +
tttctgtgtttagaaatgaata

SEQ ID NO: 108152 - DNA, 22 bp, Artificial Sequence
  Synthetic oligonucleotide; CTT chr11 5370563 5370584 5370580 5370585 +
tctgtgtttagaaatgaataat

SEQ ID NO: 108153 - DNA, 22 bp, Artificial Sequence
  Synthetic oligonucleotide; TTT chr11 5370564 5370585 5370581 5370586 +
ctgtgtttagaaatgaataata

SEQ ID NO: 108154 - DNA, 22 bp, Artificial Sequence
  Synthetic oligonucleotide; TTC chr11 5370565 5370586 5370582 5370587 +
tgtgtttagaaatgaataatag

SEQ ID NO: 108155 - DNA, 22 bp, Artificial Sequence
  Synthetic oligonucleotide; CTG chr11 5370567 5370588 5370584 5370589 +
tgtttagaaatgaataatagaa

SEQ ID NO: 108156 - DNA, 22 bp, Artificial Sequence
  Synthetic oligonucleotide; TTT chr11 5370572 5370593 5370589 5370594 +
agaaatgaataatagaataact

SEQ ID NO: 108157 - DNA, 22 bp, Artificial Sequence
  Synthetic oligonucleotide; TTA chr11 5370573 5370594 5370590 5370595 +
gaaatgaataatagaataacta

SEQ ID NO: 108158 - DNA, 22 bp, Artificial Sequence
  Synthetic oligonucleotide; CTA chr11 5370595 5370616 5370612 5370617 +
aatacatttatttaacaagcgg

SEQ ID NO: 108159 - DNA, 22 bp, Artificial Sequence
  Synthetic oligonucleotide; TTT chr11 5370604 5370625 5370621 5370626 +
atttaacaagcggtcattgttt

SEQ ID NO: 108160 - DNA, 22 bp, Artificial Sequence
  Synthetic oligonucleotide; TTA chr11 5370605 5370626 5370622 5370627 +
tttaacaagcggtcattgttta

SEQ ID NO: 108161 - DNA, 22 bp, Artificial Sequence
  Synthetic oligonucleotide; TTT chr11 5370608 5370629 5370625 5370630 +
aacaagcggtcattgtttagtt

SEQ ID NO: 108162 - DNA, 22 bp, Artificial Sequence
  Synthetic oligonucleotide; TTA chr11 5370609 5370630 5370626 5370631 +
acaagcggtcattgtttagttg

SEQ ID NO: 108163 - DNA, 22 bp, Artificial Sequence
  Synthetic oligonucleotide; TTG chr11 5370623 5370644 5370640 5370645 +
tttagttgtttgtttatctaat

SEQ ID NO: 108164 - DNA, 22 bp, Artificial Sequence
  Synthetic oligonucleotide; TTT chr11 5370626 5370647 5370643 5370648 +
agttgtttgtttatctaatgag

SEQ ID NO: 108165 - DNA, 22 bp, Artificial Sequence
  Synthetic oligonucleotide; TTA chr11 5370627 5370648 5370644 5370649 +
gttgtttgtttatctaatgaga

SEQ ID NO: 108166 - DNA, 22 bp, Artificial Sequence
  Synthetic oligonucleotide; TTG chr11 5370631 5370652 5370648 5370653 +
tttgtttatctaatgagaggct

SEQ ID NO: 108167 - DNA, 22 bp, Artificial Sequence
  Synthetic oligonucleotide; TTT chr11 5370634 5370655 5370651 5370656 +
gtttatctaatgagaggcttct

SEQ ID NO: 108168 - DNA, 22 bp, Artificial Sequence
  Synthetic oligonucleotide; TTG chr11 5370635 5370656 5370652 5370657 +
tttatctaatgagaggcttctc

SEQ ID NO: 108169 - DNA, 22 bp, Artificial Sequence
  Synthetic oligonucleotide; TTT chr11 5370638 5370659 5370655 5370660 +
atctaatgagaggcttctctat

SEQ ID NO: 108170 - DNA, 22 bp, Artificial Sequence
  Synthetic oligonucleotide; TTA chr11 5370639 5370660 5370656 5370661 +
tctaatgagaggcttctctatt

SEQ ID NO: 108171 - DNA, 22 bp, Artificial Sequence
  Synthetic oligonucleotide; CTA chr11 5370643 5370664 5370660 5370665 +
atgagaggcttctctattttag

SEQ ID NO: 108172 - DNA, 22 bp, Artificial Sequence
  Synthetic oligonucleotide; CTT chr11 5370654 5370675 5370671 5370676 +
ctctattttagcaactactggg

SEQ ID NO: 108173 - DNA, 22 bp, Artificial Sequence
  Synthetic oligonucleotide; TTC chr11 5370655 5370676 5370672 5370677 +
tctattttagcaactactgggt

SEQ ID NO: 108174 - DNA, 22 bp, Artificial Sequence
  Synthetic oligonucleotide; CTC chr11 5370657 5370678 5370674 5370679 +
tattttagcaactactgggtac

SEQ ID NO: 108175 - DNA, 22 bp, Artificial Sequence
  Synthetic oligonucleotide; CTA chr11 5370659 5370680 5370676 5370681 +
ttttagcaactactgggtacaa

SEQ ID NO: 108176 - DNA, 22 bp, Artificial Sequence
  Synthetic oligonucleotide; TTT chr11 5370662 5370683 5370679 5370684 +
tagcaactactgggtacaaaaa

SEQ ID NO: 108177 - DNA, 22 bp, Artificial Sequence
  Synthetic oligonucleotide; TTT chr11 5370663 5370684 5370680 5370685 +
agcaactactgggtacaaaaat

SEQ ID NO: 108178 - DNA, 22 bp, Artificial Sequence
  Synthetic oligonucleotide; TTA chr11 5370664 5370685 5370681 5370686 +
gcaactactgggtacaaaaata

SEQ ID NO: 108179 - DNA, 22 bp, Artificial Sequence
  Synthetic oligonucleotide; CTA chr11 5370671 5370692 5370688 5370693 +
ctgggtacaaaaatacattggt

SEQ ID NO: 108180 - DNA, 22 bp, Artificial Sequence
  Synthetic oligonucleotide; CTG chr11 5370674 5370695 5370691 5370696 +
ggtacaaaaatacattggtgca

SEQ ID NO: 108181 - DNA, 22 bp, Artificial Sequence
  Synthetic oligonucleotide; TTG chr11 5370691 5370712 5370708 5370713 +
gtgcatatattctctgttccta

SEQ ID NO: 108182 - DNA, 22 bp, Artificial Sequence
  Synthetic oligonucleotide; TTC chr11 5370703 5370724 5370720 5370725 +
tctgttcctatgaagcttgtat

SEQ ID NO: 108183 - DNA, 22 bp, Artificial Sequence
  Synthetic oligonucleotide; CTC chr11 5370705 5370726 5370722 5370727 +
tgttcctatgaagcttgtattt

SEQ ID NO: 108184 - DNA, 22 bp, Artificial Sequence
  Synthetic oligonucleotide; CTG chr11 5370707 5370728 5370724 5370729 +
ttcctatgaagcttgtatttta

SEQ ID NO: 108185 - DNA, 22 bp, Artificial Sequence
  Synthetic oligonucleotide; TTC chr11 5370710 5370731 5370727 5370732 +
ctatgaagcttgtattttaacg

SEQ ID NO: 108186 - DNA, 22 bp, Artificial Sequence
  Synthetic oligonucleotide; CTA chr11 5370713 5370734 5370730 5370735 +
tgaagcttgtattttaacggaa

SEQ ID NO: 108187 - DNA, 22 bp, Artificial Sequence
  Synthetic oligonucleotide; CTT chr11 5370721 5370742 5370738 5370743 +
gtattttaacggaaaggaaata

SEQ ID NO: 108188 - DNA, 22 bp, Artificial Sequence
  Synthetic oligonucleotide; TTG chr11 5370722 5370743 5370739 5370744 +
tattttaacggaaaggaaataa

SEQ ID NO: 108189 - DNA, 22 bp, Artificial Sequence
  Synthetic oligonucleotide; TTT chr11 5370727 5370748 5370744 5370749 +
taacggaaaggaaataataaaa

SEQ ID NO: 108190 - DNA, 22 bp, Artificial Sequence
  Synthetic oligonucleotide; TTT chr11 5370728 5370749 5370745 5370750 +
aacggaaaggaaataataaaaa

SEQ ID NO: 108191 - DNA, 22 bp, Artificial Sequence
  Synthetic oligonucleotide; TTA chr11 5370729 5370750 5370746 5370751 +
acggaaaggaaataataaaaaa

SEQ ID NO: 108192 - DNA, 22 bp, Artificial Sequence
  Synthetic oligonucleotide; TTA chr11 5370767 5370788 5370784 5370789 +
caacctcatatagctgctatga

SEQ ID NO: 108193 - DNA, 22 bp, Artificial Sequence
  Synthetic oligonucleotide; CTC chr11 5370774 5370795 5370791 5370796 +
atatagctgctatgaaagaaag

SEQ ID NO: 108194 - DNA, 22 bp, Artificial Sequence
  Synthetic oligonucleotide; CTG chr11 5370783 5370804 5370800 5370805 +
ctatgaaagaaagaaaaaattt

SEQ ID NO: 108195 - DNA, 22 bp, Artificial Sequence
  Synthetic oligonucleotide; CTA chr11 5370786 5370807 5370803 5370808 +
tgaaagaaagaaaaaatttgat

SEQ ID NO: 108196 - DNA, 22 bp, Artificial Sequence
  Synthetic oligonucleotide; TTT chr11 5370805 5370826 5370822 5370827 +
gatgcaatagagaataacaaaa

SEQ ID NO: 108197 - DNA, 22 bp, Artificial Sequence
  Synthetic oligonucleotide; TTG chr11 5370806 5370827 5370823 5370828 +
atgcaatagagaataacaaaat

SEQ ID NO: 108198 - DNA, 22 bp, Artificial Sequence
  Synthetic oligonucleotide; TTT chr11 5370830 5370851 5370847 5370852 +
atgtaagctagtgtgacaaatg

SEQ ID NO: 108199 - DNA, 22 bp, Artificial Sequence
  Synthetic oligonucleotide; TTA chr11 5370831 5370852 5370848 5370853 +
tgtaagctagtgtgacaaatgc

SEQ ID NO: 108200 - DNA, 22 bp, Artificial Sequence
  Synthetic oligonucleotide; CTA chr11 5370840 5370861 5370857 5370862 +
gtgtgacaaatgcgggttctga

SEQ ID NO: 108201 - DNA, 22 bp, Artificial Sequence
  Synthetic oligonucleotide; TTC chr11 5370859 5370880 5370876 5370881 +
tgagaggaggtaatatttcagc

SEQ ID NO: 108202 - DNA, 22 bp, Artificial Sequence
  Synthetic oligonucleotide; CTG chr11 5370861 5370882 5370878 5370883 +
agaggaggtaatatttcagctg

SEQ ID NO: 108203 - DNA, 22 bp, Artificial Sequence
  Synthetic oligonucleotide; TTT chr11 5370877 5370898 5370894 5370899 +
cagctgtgacctgagagttgta

SEQ ID NO: 108204 - DNA, 22 bp, Artificial Sequence
  Synthetic oligonucleotide; TTC chr11 5370878 5370899 5370895 5370900 +
agctgtgacctgagagttgtag

SEQ ID NO: 108205 - DNA, 22 bp, Artificial Sequence
  Synthetic oligonucleotide; CTG chr11 5370883 5370904 5370900 5370905 +
tgacctgagagttgtagaggca

SEQ ID NO: 108206 - DNA, 22 bp, Artificial Sequence
  Synthetic oligonucleotide; CTG chr11 5370890 5370911 5370907 5370912 +
agagttgtagaggcaaaagaag

SEQ ID NO: 108207 - DNA, 22 bp, Artificial Sequence
  Synthetic oligonucleotide; TTG chr11 5370897 5370918 5370914 5370919 +
tagaggcaaaagaagtattgcc

SEQ ID NO: 108208 - DNA, 22 bp, Artificial Sequence
  Synthetic oligonucleotide; TTG chr11 5370917 5370938 5370934 5370939 +
ccatagtggtattggtcctgga

SEQ ID NO: 108209 - DNA, 22 bp, Artificial Sequence
  Synthetic oligonucleotide; TTG chr11 5370931 5370952 5370948 5370953 +
gtcctggagctctggttcaatg

SEQ ID NO: 108210 - DNA, 22 bp, Artificial Sequence
  Synthetic oligonucleotide; CTG chr11 5370937 5370958 5370954 5370959 +
gagctctggttcaatgagcaga

SEQ ID NO: 108211 - DNA, 22 bp, Artificial Sequence
  Synthetic oligonucleotide; CTC chr11 5370943 5370964 5370960 5370965 +
tggttcaatgagcagacagaag

SEQ ID NO: 108212 - DNA, 22 bp, Artificial Sequence
  Synthetic oligonucleotide; CTG chr11 5370945 5370966 5370962 5370967 +
gttcaatgagcagacagaagga

SEQ ID NO: 108213 - DNA, 22 bp, Artificial Sequence
  Synthetic oligonucleotide; TTC chr11 5370949 5370970 5370966 5370971 +
aatgagcagacagaaggaagag

SEQ ID NO: 108214 - DNA, 22 bp, Artificial Sequence
  Synthetic oligonucleotide; CTT chr11 5370989 5371010 5371006 5371011 +
caggaaaaagacttacacatga

SEQ ID NO: 108215 - DNA, 22 bp, Artificial Sequence
  Synthetic oligonucleotide; TTC chr11 5370990 5371011 5371007 5371012 +
aggaaaaagacttacacatgat

SEQ ID NO: 108216 - DNA, 22 bp, Artificial Sequence
  Synthetic oligonucleotide; CTT chr11 5371003 5371024 5371020 5371025 +
acacatgattggggctacccaa

SEQ ID NO: 108217 - DNA, 22 bp, Artificial Sequence
  Synthetic oligonucleotide; TTA chr11 5371004 5371025 5371021 5371026 +
cacatgattggggctacccaaa

SEQ ID NO: 108218 - DNA, 22 bp, Artificial Sequence
  Synthetic oligonucleotide; TTG chr11 5371014 5371035 5371031 5371036 +
gggctacccaaagggactggtt

SEQ ID NO: 108219 - DNA, 22 bp, Artificial Sequence
  Synthetic oligonucleotide; CTA chr11 5371020 5371041 5371037 5371042 +
cccaaagggactggtttttcca

SEQ ID NO: 108220 - DNA, 22 bp, Artificial Sequence
  Synthetic oligonucleotide; CTG chr11 5371033 5371054 5371050 5371055 +
gtttttccaagagcagataatt

SEQ ID NO: 108221 - DNA, 22 bp, Artificial Sequence
  Synthetic oligonucleotide; TTT chr11 5371037 5371058 5371054 5371059 +
ttccaagagcagataatttgag

SEQ ID NO: 108222 - DNA, 22 bp, Artificial Sequence
  Synthetic oligonucleotide; TTT chr11 5371038 5371059 5371055 5371060 +
tccaagagcagataatttgagt

SEQ ID NO: 108223 - DNA, 22 bp, Artificial Sequence
  Synthetic oligonucleotide; TTT chr11 5371039 5371060 5371056 5371061 +
ccaagagcagataatttgagtg

SEQ ID NO: 108224 - DNA, 22 bp, Artificial Sequence
  Synthetic oligonucleotide; TTC chr11 5371040 5371061 5371057 5371062 +
caagagcagataatttgagtga

SEQ ID NO: 108225 - DNA, 22 bp, Artificial Sequence
  Synthetic oligonucleotide; TTT chr11 5371056 5371077 5371073 5371078 +
gagtgataaaaatagtgatttt

SEQ ID NO: 108226 - DNA, 22 bp, Artificial Sequence
  Synthetic oligonucleotide; TTG chr11 5371057 5371078 5371074 5371079 +
agtgataaaaatagtgattttg

SEQ ID NO: 108227 - DNA, 22 bp, Artificial Sequence
  Synthetic oligonucleotide; TTT chr11 5371077 5371098 5371094 5371099 +
tgaacccttccttctgctagcc

SEQ ID NO: 108228 - DNA, 22 bp, Artificial Sequence
  Synthetic oligonucleotide; TTT chr11 5371078 5371099 5371095 5371100 +
gaacccttccttctgctagccc

SEQ ID NO: 108229 - DNA, 22 bp, Artificial Sequence
  Synthetic oligonucleotide; TTG chr11 5371079 5371100 5371096 5371101 +
aacccttccttctgctagccct

SEQ ID NO: 108230 - DNA, 22 bp, Artificial Sequence
  Synthetic oligonucleotide; CTT chr11 5371086 5371107 5371103 5371108 +
ccttctgctagccctagctatg

SEQ ID NO: 108231 - DNA, 22 bp, Artificial Sequence
  Synthetic oligonucleotide; TTC chr11 5371087 5371108 5371104 5371109 +
cttctgctagccctagctatgg

SEQ ID NO: 108232 - DNA, 22 bp, Artificial Sequence
  Synthetic oligonucleotide; CTT chr11 5371090 5371111 5371107 5371112 +
ctgctagccctagctatggacc

SEQ ID NO: 108233 - DNA, 22 bp, Artificial Sequence
  Synthetic oligonucleotide; TTC chr11 5371091 5371112 5371108 5371113 +
tgctagccctagctatggacca

SEQ ID NO: 108234 - DNA, 22 bp, Artificial Sequence
  Synthetic oligonucleotide; CTG chr11 5371093 5371114 5371110 5371115 +
ctagccctagctatggaccacc

SEQ ID NO: 108235 - DNA, 22 bp, Artificial Sequence
  Synthetic oligonucleotide; CTA chr11 5371096 5371117 5371113 5371118 +
gccctagctatggaccaccatg

SEQ ID NO: 108236 - DNA, 22 bp, Artificial Sequence
  Synthetic oligonucleotide; CTA chr11 5371102 5371123 5371119 5371124 +
gctatggaccaccatggatatt

SEQ ID NO: 108237 - DNA, 22 bp, Artificial Sequence
  Synthetic oligonucleotide; CTA chr11 5371106 5371127 5371123 5371128 +
tggaccaccatggatattgaag

SEQ ID NO: 108238 - DNA, 22 bp, Artificial Sequence
  Synthetic oligonucleotide; TTG chr11 5371125 5371146 5371142 5371147 +
aagtaagggctttgttttggaa

SEQ ID NO: 108239 - DNA, 22 bp, Artificial Sequence
  Synthetic oligonucleotide; CTT chr11 5371137 5371158 5371154 5371159 +
tgttttggaattactctccaca

SEQ ID NO: 108240 - DNA, 22 bp, Artificial Sequence
  Synthetic oligonucleotide; TTT chr11 5371138 5371159 5371155 5371160 +
gttttggaattactctccacac

SEQ ID NO: 108241 - DNA, 22 bp, Artificial Sequence
  Synthetic oligonucleotide; TTG chr11 5371139 5371160 5371156 5371161 +
ttttggaattactctccacaca

SEQ ID NO: 108242 - DNA, 22 bp, Artificial Sequence
  Synthetic oligonucleotide; TTT chr11 5371142 5371163 5371159 5371164 +
tggaattactctccacacattc

SEQ ID NO: 108243 - DNA, 22 bp, Artificial Sequence
  Synthetic oligonucleotide; TTT chr11 5371143 5371164 5371160 5371165 +
ggaattactctccacacattct

SEQ ID NO: 108244 - DNA, 22 bp, Artificial Sequence
  Synthetic oligonucleotide; TTG chr11 5371144 5371165 5371161 5371166 +
gaattactctccacacattctg

SEQ ID NO: 108245 - DNA, 22 bp, Artificial Sequence
  Synthetic oligonucleotide; TTA chr11 5371150 5371171 5371167 5371172 +
ctctccacacattctgaggata

SEQ ID NO: 108246 - DNA, 22 bp, Artificial Sequence
  Synthetic oligonucleotide; CTC chr11 5371153 5371174 5371170 5371175 +
tccacacattctgaggatatac

SEQ ID NO: 108247 - DNA, 22 bp, Artificial Sequence
  Synthetic oligonucleotide; CTC chr11 5371155 5371176 5371172 5371177 +
cacacattctgaggatatacaa

SEQ ID NO: 108248 - DNA, 22 bp, Artificial Sequence
  Synthetic oligonucleotide; TTC chr11 5371164 5371185 5371181 5371186 +
tgaggatatacaagggcactga

SEQ ID NO: 108249 - DNA, 22 bp, Artificial Sequence
  Synthetic oligonucleotide; CTG chr11 5371166 5371187 5371183 5371188 +
aggatatacaagggcactgaaa

SEQ ID NO: 108250 - DNA, 22 bp, Artificial Sequence
  Synthetic oligonucleotide; CTG chr11 5371185 5371206 5371202 5371207 +
aaatattctagaaagtccatag

SEQ ID NO: 108251 - DNA, 22 bp, Artificial Sequence
  Synthetic oligonucleotide; TTC chr11 5371193 5371214 5371210 5371215 +
tagaaagtccatagcacattct

SEQ ID NO: 108252 - DNA, 22 bp, Artificial Sequence
  Synthetic oligonucleotide; CTA chr11 5371195 5371216 5371212 5371217 +
gaaagtccatagcacattctga

SEQ ID NO: 108253 - DNA, 22 bp, Artificial Sequence
  Synthetic oligonucleotide; TTC chr11 5371214 5371235 5371231 5371236 +
tgatgtttatactctaagccac

SEQ ID NO: 108254 - DNA, 22 bp, Artificial Sequence
  Synthetic oligonucleotide; CTG chr11 5371216 5371237 5371233 5371238 +
atgtttatactctaagccacac

SEQ ID NO: 108255 - DNA, 22 bp, Artificial Sequence
  Synthetic oligonucleotide; TTT chr11 5371222 5371243 5371239 5371244 +
atactctaagccacacagcacc

SEQ ID NO: 108256 - DNA, 22 bp, Artificial Sequence
  Synthetic oligonucleotide; TTA chr11 5371223 5371244 5371240 5371245 +
tactctaagccacacagcacct

SEQ ID NO: 108257 - DNA, 22 bp, Artificial Sequence
  Synthetic oligonucleotide; CTC chr11 5371228 5371249 5371245 5371250 +
taagccacacagcacctttccc

SEQ ID NO: 108258 - DNA, 22 bp, Artificial Sequence
  Synthetic oligonucleotide; CTA chr11 5371230 5371251 5371247 5371252 +
agccacacagcacctttccccg

SEQ ID NO: 108259 - DNA, 22 bp, Artificial Sequence
  Synthetic oligonucleotide; CTT chr11 5371246 5371267 5371263 5371268 +
tccccggatctagggtctttca

SEQ ID NO: 108260 - DNA, 22 bp, Artificial Sequence
  Synthetic oligonucleotide; TTT chr11 5371247 5371268 5371264 5371269 +
ccccggatctagggtctttcac

SEQ ID NO: 108261 - DNA, 22 bp, Artificial Sequence
  Synthetic oligonucleotide; TTC chr11 5371248 5371269 5371265 5371270 +
cccggatctagggtctttcaca

SEQ ID NO: 108262 - DNA, 22 bp, Artificial Sequence
  Synthetic oligonucleotide; CTA chr11 5371258 5371279 5371275 5371280 +
gggtctttcacattaggttaat

SEQ ID NO: 108263 - DNA, 22 bp, Artificial Sequence
  Synthetic oligonucleotide; CTT chr11 5371265 5371286 5371282 5371287 +
tcacattaggttaattttttta

SEQ ID NO: 108264 - DNA, 22 bp, Artificial Sequence
  Synthetic oligonucleotide; TTT chr11 5371266 5371287 5371283 5371288 +
cacattaggttaatttttttaa

SEQ ID NO: 108265 - DNA, 22 bp, Artificial Sequence
  Synthetic oligonucleotide; TTC chr11 5371267 5371288 5371284 5371289 +
acattaggttaatttttttaaa

SEQ ID NO: 108266 - DNA, 22 bp, Artificial Sequence
  Synthetic oligonucleotide; TTA chr11 5371273 5371294 5371290 5371295 +
ggttaatttttttaaaactcaa

SEQ ID NO: 108267 - DNA, 22 bp, Artificial Sequence
  Synthetic oligonucleotide; TTA chr11 5371278 5371299 5371295 5371300 +
atttttttaaaactcaaacaca

SEQ ID NO: 108268 - DNA, 22 bp, Artificial Sequence
  Synthetic oligonucleotide; TTT chr11 5371282 5371303 5371299 5371304 +
ttttaaaactcaaacacagaag

SEQ ID NO: 108269 - DNA, 22 bp, Artificial Sequence
  Synthetic oligonucleotide; TTT chr11 5371283 5371304 5371300 5371305 +
tttaaaactcaaacacagaagt

SEQ ID NO: 108270 - DNA, 22 bp, Artificial Sequence
  Synthetic oligonucleotide; TTT chr11 5371284 5371305 5371301 5371306 +
ttaaaactcaaacacagaagtt

SEQ ID NO: 108271 - DNA, 22 bp, Artificial Sequence
  Synthetic oligonucleotide; TTT chr11 5371285 5371306 5371302 5371307 +
taaaactcaaacacagaagttc

SEQ ID NO: 108272 - DNA, 22 bp, Artificial Sequence
  Synthetic oligonucleotide; TTT chr11 5371286 5371307 5371303 5371308 +
aaaactcaaacacagaagttca

SEQ ID NO: 108273 - DNA, 22 bp, Artificial Sequence
  Synthetic oligonucleotide; TTA chr11 5371287 5371308 5371304 5371309 +
aaactcaaacacagaagttcaa

SEQ ID NO: 108274 - DNA, 22 bp, Artificial Sequence
  Synthetic oligonucleotide; CTC chr11 5371293 5371314 5371310 5371315 +
aaacacagaagttcaaaaaaat

SEQ ID NO: 108275 - DNA, 22 bp, Artificial Sequence
  Synthetic oligonucleotide; TTC chr11 5371307 5371328 5371324 5371329 +
aaaaaaattgaacatataattc

SEQ ID NO: 108276 - DNA, 22 bp, Artificial Sequence
  Synthetic oligonucleotide; TTG chr11 5371317 5371338 5371334 5371339 +
aacatataattctcattctctg

SEQ ID NO: 108277 - DNA, 22 bp, Artificial Sequence
  Synthetic oligonucleotide; TTC chr11 5371329 5371350 5371346 5371351 +
tcattctctgtggctcataaac

SEQ ID NO: 108278 - DNA, 22 bp, Artificial Sequence
  Synthetic oligonucleotide; CTC chr11 5371331 5371352 5371348 5371353 +
attctctgtggctcataaacat

SEQ ID NO: 108279 - DNA, 22 bp, Artificial Sequence
  Synthetic oligonucleotide; TTC chr11 5371335 5371356 5371352 5371357 +
tctgtggctcataaacatttaa

SEQ ID NO: 108280 - DNA, 22 bp, Artificial Sequence
  Synthetic oligonucleotide; CTC chr11 5371337 5371358 5371354 5371359 +
tgtggctcataaacatttaata

SEQ ID NO: 108281 - DNA, 22 bp, Artificial Sequence
  Synthetic oligonucleotide; CTG chr11 5371339 5371360 5371356 5371361 +
tggctcataaacatttaataga

SEQ ID NO: 108282 - DNA, 22 bp, Artificial Sequence
  Synthetic oligonucleotide; CTC chr11 5371345 5371366 5371362 5371367 +
ataaacatttaatagagacatt

SEQ ID NO: 108283 - DNA, 22 bp, Artificial Sequence
  Synthetic oligonucleotide; TTT chr11 5371355 5371376 5371372 5371377 +
aatagagacattgatgaaactg

SEQ ID NO: 108284 - DNA, 22 bp, Artificial Sequence
  Synthetic oligonucleotide; TTA chr11 5371356 5371377 5371373 5371378 +
atagagacattgatgaaactgt

SEQ ID NO: 108285 - DNA, 22 bp, Artificial Sequence
  Synthetic oligonucleotide; TTG chr11 5371368 5371389 5371385 5371390 +
atgaaactgtaaaaccctgagt

SEQ ID NO: 108286 - DNA, 22 bp, Artificial Sequence
  Synthetic oligonucleotide; CTG chr11 5371377 5371398 5371394 5371399 +
taaaaccctgagttgtaggccg

SEQ ID NO: 108287 - DNA, 22 bp, Artificial Sequence
  Synthetic oligonucleotide; CTG chr11 5371387 5371408 5371404 5371409 +
agttgtaggccggagatataaa

SEQ ID NO: 108288 - DNA, 22 bp, Artificial Sequence
  Synthetic oligonucleotide; TTG chr11 5371392 5371413 5371409 5371414 +
taggccggagatataaaatttc

SEQ ID NO: 108289 - DNA, 22 bp, Artificial Sequence
  Synthetic oligonucleotide; TTT chr11 5371413 5371434 5371430 5371435 +
caacataaagaatgaacaaaat

SEQ ID NO: 108290 - DNA, 22 bp, Artificial Sequence
  Synthetic oligonucleotide; TTC chr11 5371414 5371435 5371431 5371436 +
aacataaagaatgaacaaaatg

SEQ ID NO: 108291 - DNA, 22 bp, Artificial Sequence
  Synthetic oligonucleotide; CTG chr11 5371457 5371478 5371474 5371479 +
agagacagtgatagctgtatct

SEQ ID NO: 108292 - DNA, 22 bp, Artificial Sequence
  Synthetic oligonucleotide; CTG chr11 5371474 5371495 5371491 5371496 +
tatctaaagagtactgatatta

SEQ ID NO: 108293 - DNA, 22 bp, Artificial Sequence
  Synthetic oligonucleotide; CTA chr11 5371480 5371501 5371497 5371502 +
aagagtactgatattaaaaata

SEQ ID NO: 108294 - DNA, 22 bp, Artificial Sequence
  Synthetic oligonucleotide; CTG chr11 5371490 5371511 5371507 5371512 +
atattaaaaatagagaaaaaca

SEQ ID NO: 108295 - DNA, 22 bp, Artificial Sequence
  Synthetic oligonucleotide; TTA chr11 5371496 5371517 5371513 5371518 +
aaaatagagaaaaacatatatc

SEQ ID NO: 108296 - DNA, 22 bp, Artificial Sequence
  Synthetic oligonucleotide; CTC chr11 5371520 5371541 5371537 5371542 +
attatatccaaagggttacata

SEQ ID NO: 108297 - DNA, 22 bp, Artificial Sequence
  Synthetic oligonucleotide; TTA chr11 5371524 5371545 5371541 5371546 +
tatccaaagggttacataagtt

SEQ ID NO: 108298 - DNA, 22 bp, Artificial Sequence
  Synthetic oligonucleotide; TTA chr11 5371538 5371559 5371555 5371560 +
cataagttttaagagtggaaat

SEQ ID NO: 108299 - DNA, 22 bp, Artificial Sequence
  Synthetic oligonucleotide; TTT chr11 5371547 5371568 5371564 5371569 +
taagagtggaaataacatgaag

SEQ ID NO: 108300 - DNA, 22 bp, Artificial Sequence
  Synthetic oligonucleotide; TTT chr11 5371548 5371569 5371565 5371570 +
aagagtggaaataacatgaagg

SEQ ID NO: 108301 - DNA, 22 bp, Artificial Sequence
  Synthetic oligonucleotide; TTA chr11 5371549 5371570 5371566 5371571 +
agagtggaaataacatgaagga

SEQ ID NO: 108302 - DNA, 22 bp, Artificial Sequence
  Synthetic oligonucleotide; CTA chr11 5371576 5371597 5371593 5371598 +
aacaattaggaaacagaaattt

SEQ ID NO: 108303 - DNA, 22 bp, Artificial Sequence
  Synthetic oligonucleotide; TTA chr11 5371584 5371605 5371601 5371606 +
ggaaacagaaatttgacttgct

SEQ ID NO: 108304 - DNA, 22 bp, Artificial Sequence
  Synthetic oligonucleotide; TTT chr11 5371598 5371619 5371615 5371620 +
gacttgcttcagataaaagctt

SEQ ID NO: 108305 - DNA, 22 bp, Artificial Sequence
  Synthetic oligonucleotide; TTG chr11 5371599 5371620 5371616 5371621 +
acttgcttcagataaaagcttt

SEQ ID NO: 108306 - DNA, 22 bp, Artificial Sequence
  Synthetic oligonucleotide; CTT chr11 5371603 5371624 5371620 5371625 +
gcttcagataaaagcttttaaa

SEQ ID NO: 108307 - DNA, 22 bp, Artificial Sequence
  Synthetic oligonucleotide; TTG chr11 5371604 5371625 5371621 5371626 +
cttcagataaaagcttttaaaa

SEQ ID NO: 108308 - DNA, 22 bp, Artificial Sequence
  Synthetic oligonucleotide; CTT chr11 5371607 5371628 5371624 5371629 +
cagataaaagcttttaaaatat

SEQ ID NO: 108309 - DNA, 22 bp, Artificial Sequence
  Synthetic oligonucleotide; TTC chr11 5371608 5371629 5371625 5371630 +
agataaaagcttttaaaatatt

SEQ ID NO: 108310 - DNA, 22 bp, Artificial Sequence
  Synthetic oligonucleotide; CTT chr11 5371620 5371641 5371637 5371642 +
ttaaaatattttatctgaaaca

SEQ ID NO: 108311 - DNA, 22 bp, Artificial Sequence
  Synthetic oligonucleotide; TTT chr11 5371621 5371642 5371638 5371643 +
taaaatattttatctgaaacaa

SEQ ID NO: 108312 - DNA, 22 bp, Artificial Sequence
  Synthetic oligonucleotide; TTT chr11 5371622 5371643 5371639 5371644 +
aaaatattttatctgaaacaag

SEQ ID NO: 108313 - DNA, 22 bp, Artificial Sequence
  Synthetic oligonucleotide; TTA chr11 5371623 5371644 5371640 5371645 +
aaatattttatctgaaacaagt

SEQ ID NO: 108314 - DNA, 22 bp, Artificial Sequence
  Synthetic oligonucleotide; TTT chr11 5371631 5371652 5371648 5371653 +
tatctgaaacaagtaagcttgt

SEQ ID NO: 108315 - DNA, 22 bp, Artificial Sequence
  Synthetic oligonucleotide; TTT chr11 5371632 5371653 5371649 5371654 +
atctgaaacaagtaagcttgtt

SEQ ID NO: 108316 - DNA, 22 bp, Artificial Sequence
  Synthetic oligonucleotide; TTA chr11 5371633 5371654 5371650 5371655 +
tctgaaacaagtaagcttgttc

SEQ ID NO: 108317 - DNA, 22 bp, Artificial Sequence
  Synthetic oligonucleotide; CTG chr11 5371637 5371658 5371654 5371659 +
aaacaagtaagcttgttcaaaa

SEQ ID NO: 108318 - DNA, 22 bp, Artificial Sequence
  Synthetic oligonucleotide; CTT chr11 5371651 5371672 5371668 5371673 +
gttcaaaaaatataggatatat

SEQ ID NO: 108319 - DNA, 22 bp, Artificial Sequence
  Synthetic oligonucleotide; TTG chr11 5371652 5371673 5371669 5371674 +
ttcaaaaaatataggatatatg

SEQ ID NO: 108320 - DNA, 22 bp, Artificial Sequence
  Synthetic oligonucleotide; TTC chr11 5371655 5371676 5371672 5371677 +
aaaaaatataggatatatgtgt

SEQ ID NO: 108321 - DNA, 22 bp, Artificial Sequence
  Synthetic oligonucleotide; TTA chr11 5371694 5371715 5371711 5371716 +
cttcaatcaagcaaattaacct

SEQ ID NO: 108322 - DNA, 22 bp, Artificial Sequence
  Synthetic oligonucleotide; CTT chr11 5371697 5371718 5371714 5371719 +
caatcaagcaaattaacctatc

SEQ ID NO: 108323 - DNA, 22 bp, Artificial Sequence
  Synthetic oligonucleotide; TTC chr11 5371698 5371719 5371715 5371720 +
aatcaagcaaattaacctatcc

SEQ ID NO: 108324 - DNA, 22 bp, Artificial Sequence
  Synthetic oligonucleotide; TTA chr11 5371712 5371733 5371729 5371734 +
acctatccatcaatacaacacc

SEQ ID NO: 108325 - DNA, 22 bp, Artificial Sequence
  Synthetic oligonucleotide; CTA chr11 5371717 5371738 5371734 5371739 +
tccatcaatacaacaccttcca

SEQ ID NO: 108326 - DNA, 22 bp, Artificial Sequence
  Synthetic oligonucleotide; CTT chr11 5371736 5371757 5371753 5371758 +
ccatagataccttttgcttttt

SEQ ID NO: 108327 - DNA, 22 bp, Artificial Sequence
  Synthetic oligonucleotide; TTC chr11 5371737 5371758 5371754 5371759 +
catagataccttttgctttttc

SEQ ID NO: 108328 - DNA, 22 bp, Artificial Sequence
  Synthetic oligonucleotide; CTT chr11 5371749 5371770 5371766 5371771 +
ttgctttttctttgtgtaaggg

SEQ ID NO: 108329 - DNA, 22 bp, Artificial Sequence
  Synthetic oligonucleotide; TTT chr11 5371750 5371771 5371767 5371772 +
tgctttttctttgtgtaagggc

SEQ ID NO: 108330 - DNA, 22 bp, Artificial Sequence
  Synthetic oligonucleotide; TTT chr11 5371751 5371772 5371768 5371773 +
gctttttctttgtgtaagggca

SEQ ID NO: 108331 - DNA, 22 bp, Artificial Sequence
  Synthetic oligonucleotide; TTG chr11 5371752 5371773 5371769 5371774 +
ctttttctttgtgtaagggcat

SEQ ID NO: 108332 - DNA, 22 bp, Artificial Sequence
  Synthetic oligonucleotide; CTT chr11 5371755 5371776 5371772 5371777 +
tttctttgtgtaagggcatcta

SEQ ID NO: 108333 - DNA, 22 bp, Artificial Sequence
  Synthetic oligonucleotide; TTT chr11 5371756 5371777 5371773 5371778 +
ttctttgtgtaagggcatctaa

SEQ ID NO: 108334 - DNA, 22 bp, Artificial Sequence
  Synthetic oligonucleotide; TTT chr11 5371757 5371778 5371774 5371779 +
tctttgtgtaagggcatctaac

SEQ ID NO: 108335 - DNA, 22 bp, Artificial Sequence
  Synthetic oligonucleotide; TTT chr11 5371758 5371779 5371775 5371780 +
ctttgtgtaagggcatctaaca

SEQ ID NO: 108336 - DNA, 22 bp, Artificial Sequence
  Synthetic oligonucleotide; TTC chr11 5371759 5371780 5371776 5371781 +
tttgtgtaagggcatctaacat

SEQ ID NO: 108337 - DNA, 22 bp, Artificial Sequence
  Synthetic oligonucleotide; CTT chr11 5371761 5371782 5371778 5371783 +
tgtgtaagggcatctaacatct

SEQ ID NO: 108338 - DNA, 22 bp, Artificial Sequence
  Synthetic oligonucleotide; TTT chr11 5371762 5371783 5371779 5371784 +
gtgtaagggcatctaacatcta

SEQ ID NO: 108339 - DNA, 22 bp, Artificial Sequence
  Synthetic oligonucleotide; TTG chr11 5371763 5371784 5371780 5371785 +
tgtaagggcatctaacatctac

SEQ ID NO: 108340 - DNA, 22 bp, Artificial Sequence
  Synthetic oligonucleotide; CTA chr11 5371777 5371798 5371794 5371799 +
acatctactgtcataacaaatg

SEQ ID NO: 108341 - DNA, 22 bp, Artificial Sequence
  Synthetic oligonucleotide; CTA chr11 5371784 5371805 5371801 5371806 +
ctgtcataacaaatgtttagtt

SEQ ID NO: 108342 - DNA, 22 bp, Artificial Sequence
  Synthetic oligonucleotide; CTG chr11 5371787 5371808 5371804 5371809 +
tcataacaaatgtttagtttac

SEQ ID NO: 108343 - DNA, 22 bp, Artificial Sequence
  Synthetic oligonucleotide; TTT chr11 5371802 5371823 5371819 5371824 +
agtttacagtacagtattaagt

SEQ ID NO: 108344 - DNA, 22 bp, Artificial Sequence
  Synthetic oligonucleotide; TTA chr11 5371803 5371824 5371820 5371825 +
gtttacagtacagtattaagtc

SEQ ID NO: 108345 - DNA, 22 bp, Artificial Sequence
  Synthetic oligonucleotide; TTT chr11 5371807 5371828 5371824 5371829 +
acagtacagtattaagtcttca

SEQ ID NO: 108346 - DNA, 22 bp, Artificial Sequence
  Synthetic oligonucleotide; TTA chr11 5371808 5371829 5371825 5371830 +
cagtacagtattaagtcttcat

SEQ ID NO: 108347 - DNA, 22 bp, Artificial Sequence
  Synthetic oligonucleotide; TTA chr11 5371821 5371842 5371838 5371843 +
agtcttcatgccatacactaga

SEQ ID NO: 108348 - DNA, 22 bp, Artificial Sequence
  Synthetic oligonucleotide; CTT chr11 5371827 5371848 5371844 5371849 +
catgccatacactagatctcta

SEQ ID NO: 108349 - DNA, 22 bp, Artificial Sequence
  Synthetic oligonucleotide; TTC chr11 5371828 5371849 5371845 5371850 +
atgccatacactagatctctaa

SEQ ID NO: 108350 - DNA, 22 bp, Artificial Sequence
  Synthetic oligonucleotide; CTA chr11 5371841 5371862 5371858 5371863 +
gatctctaaacttatttatcct

SEQ ID NO: 108351 - DNA, 22 bp, Artificial Sequence
  Synthetic oligonucleotide; CTC chr11 5371847 5371868 5371864 5371869 +
taaacttatttatcctatacag

SEQ ID NO: 108352 - DNA, 22 bp, Artificial Sequence
  Synthetic oligonucleotide; CTA chr11 5371849 5371870 5371866 5371871 +
aacttatttatcctatacagct

SEQ ID NO: 108353 - DNA, 22 bp, Artificial Sequence
  Synthetic oligonucleotide; CTT chr11 5371854 5371875 5371871 5371876 +
atttatcctatacagctgcaag

SEQ ID NO: 108354 - DNA, 22 bp, Artificial Sequence
  Synthetic oligonucleotide; TTA chr11 5371855 5371876 5371872 5371877 +
tttatcctatacagctgcaagt

SEQ ID NO: 108355 - DNA, 22 bp, Artificial Sequence
  Synthetic oligonucleotide; TTT chr11 5371858 5371879 5371875 5371880 +
atcctatacagctgcaagttta

SEQ ID NO: 108356 - DNA, 22 bp, Artificial Sequence
  Synthetic oligonucleotide; TTA chr11 5371859 5371880 5371876 5371881 +
tcctatacagctgcaagtttat

SEQ ID NO: 108357 - DNA, 22 bp, Artificial Sequence
  Synthetic oligonucleotide; CTA chr11 5371864 5371885 5371881 5371886 +
tacagctgcaagtttataacct

SEQ ID NO: 108358 - DNA, 22 bp, Artificial Sequence
  Synthetic oligonucleotide; CTG chr11 5371872 5371893 5371889 5371894 +
caagtttataacctttgaccta

SEQ ID NO: 108359 - DNA, 22 bp, Artificial Sequence
  Synthetic oligonucleotide; TTT chr11 5371879 5371900 5371896 5371901 +
ataacctttgacctacttctcc

SEQ ID NO: 108360 - DNA, 22 bp, Artificial Sequence
  Synthetic oligonucleotide; TTA chr11 5371880 5371901 5371897 5371902 +
taacctttgacctacttctccc

SEQ ID NO: 108361 - DNA, 22 bp, Artificial Sequence
  Synthetic oligonucleotide; CTT chr11 5371887 5371908 5371904 5371909 +
tgacctacttctccctattttc

SEQ ID NO: 108362 - DNA, 22 bp, Artificial Sequence
  Synthetic oligonucleotide; TTT chr11 5371888 5371909 5371905 5371910 +
gacctacttctccctattttct

SEQ ID NO: 108363 - DNA, 22 bp, Artificial Sequence
  Synthetic oligonucleotide; TTG chr11 5371889 5371910 5371906 5371911 +
acctacttctccctattttctc

SEQ ID NO: 108364 - DNA, 22 bp, Artificial Sequence
  Synthetic oligonucleotide; CTA chr11 5371894 5371915 5371911 5371916 +
cttctccctattttctctttct

SEQ ID NO: 108365 - DNA, 22 bp, Artificial Sequence
  Synthetic oligonucleotide; CTT chr11 5371897 5371918 5371914 5371919 +
ctccctattttctctttctttc

SEQ ID NO: 108366 - DNA, 22 bp, Artificial Sequence
  Synthetic oligonucleotide; TTC chr11 5371898 5371919 5371915 5371920 +
tccctattttctctttctttct

SEQ ID NO: 108367 - DNA, 22 bp, Artificial Sequence
  Synthetic oligonucleotide; CTC chr11 5371900 5371921 5371917 5371922 +
cctattttctctttctttcttc

SEQ ID NO: 108368 - DNA, 22 bp, Artificial Sequence
  Synthetic oligonucleotide; CTA chr11 5371904 5371925 5371921 5371926 +
ttttctctttctttcttcccct

SEQ ID NO: 108369 - DNA, 22 bp, Artificial Sequence
  Synthetic oligonucleotide; TTT chr11 5371907 5371928 5371924 5371929 +
tctctttctttcttcccctttt

SEQ ID NO: 108370 - DNA, 22 bp, Artificial Sequence
  Synthetic oligonucleotide; TTT chr11 5371908 5371929 5371925 5371930 +
ctctttctttcttccccttttt

SEQ ID NO: 108371 - DNA, 22 bp, Artificial Sequence
  Synthetic oligonucleotide; TTC chr11 5371909 5371930 5371926 5371931 +
tctttctttcttccccttttta

SEQ ID NO: 108372 - DNA, 22 bp, Artificial Sequence
  Synthetic oligonucleotide; CTC chr11 5371911 5371932 5371928 5371933 +
tttctttcttcccctttttaca

SEQ ID NO: 108373 - DNA, 22 bp, Artificial Sequence
  Synthetic oligonucleotide; CTT chr11 5371913 5371934 5371930 5371935 +
tctttcttcccctttttacact

SEQ ID NO: 108374 - DNA, 22 bp, Artificial Sequence
  Synthetic oligonucleotide; TTT chr11 5371914 5371935 5371931 5371936 +
ctttcttcccctttttacactg

SEQ ID NO: 108375 - DNA, 22 bp, Artificial Sequence
  Synthetic oligonucleotide; TTC chr11 5371915 5371936 5371932 5371937 +
tttcttcccctttttacactgt

SEQ ID NO: 108376 - DNA, 22 bp, Artificial Sequence
  Synthetic oligonucleotide; CTT chr11 5371917 5371938 5371934 5371939 +
tcttcccctttttacactgttt

SEQ ID NO: 108377 - DNA, 22 bp, Artificial Sequence
  Synthetic oligonucleotide; TTT chr11 5371918 5371939 5371935 5371940 +
cttcccctttttacactgtttc

SEQ ID NO: 108378 - DNA, 22 bp, Artificial Sequence
  Synthetic oligonucleotide; TTC chr11 5371919 5371940 5371936 5371941 +
ttcccctttttacactgtttct

SEQ ID NO: 108379 - DNA, 22 bp, Artificial Sequence
  Synthetic oligonucleotide; CTT chr11 5371921 5371942 5371938 5371943 +
cccctttttacactgtttctat

SEQ ID NO: 108380 - DNA, 22 bp, Artificial Sequence
  Synthetic oligonucleotide; TTC chr11 5371922 5371943 5371939 5371944 +
ccctttttacactgtttctatg

SEQ ID NO: 108381 - DNA, 22 bp, Artificial Sequence
  Synthetic oligonucleotide; CTT chr11 5371927 5371948 5371944 5371949 +
tttacactgtttctatgcattt

SEQ ID NO: 108382 - DNA, 22 bp, Artificial Sequence
  Synthetic oligonucleotide; TTT chr11 5371928 5371949 5371945 5371950 +
ttacactgtttctatgcatttg

SEQ ID NO: 108383 - DNA, 22 bp, Artificial Sequence
  Synthetic oligonucleotide; TTT chr11 5371929 5371950 5371946 5371951 +
tacactgtttctatgcatttga

SEQ ID NO: 108384 - DNA, 22 bp, Artificial Sequence
  Synthetic oligonucleotide; TTT chr11 5371930 5371951 5371947 5371952 +
acactgtttctatgcatttgac

SEQ ID NO: 108385 - DNA, 22 bp, Artificial Sequence
  Synthetic oligonucleotide; TTA chr11 5371931 5371952 5371948 5371953 +
cactgtttctatgcatttgacc

SEQ ID NO: 108386 - DNA, 22 bp, Artificial Sequence
  Synthetic oligonucleotide; CTG chr11 5371936 5371957 5371953 5371958 +
tttctatgcatttgaccttatt

SEQ ID NO: 108387 - DNA, 22 bp, Artificial Sequence
  Synthetic oligonucleotide; TTT chr11 5371939 5371960 5371956 5371961 +
ctatgcatttgaccttattttt

SEQ ID NO: 108388 - DNA, 22 bp, Artificial Sequence
  Synthetic oligonucleotide; TTC chr11 5371940 5371961 5371957 5371962 +
tatgcatttgaccttatttttc

SEQ ID NO: 108389 - DNA, 22 bp, Artificial Sequence
  Synthetic oligonucleotide; CTA chr11 5371942 5371963 5371959 5371964 +
tgcatttgaccttatttttctt

SEQ ID NO: 108390 - DNA, 22 bp, Artificial Sequence
  Synthetic oligonucleotide; TTT chr11 5371949 5371970 5371966 5371971 +
gaccttatttttcttttgagat

SEQ ID NO: 108391 - DNA, 22 bp, Artificial Sequence
  Synthetic oligonucleotide; TTG chr11 5371950 5371971 5371967 5371972 +
accttatttttcttttgagatt

SEQ ID NO: 108392 - DNA, 22 bp, Artificial Sequence
  Synthetic oligonucleotide; CTT chr11 5371955 5371976 5371972 5371977 +
atttttcttttgagattccaca

SEQ ID NO: 108393 - DNA, 22 bp, Artificial Sequence
  Synthetic oligonucleotide; TTA chr11 5371956 5371977 5371973 5371978 +
tttttcttttgagattccacat

SEQ ID NO: 108394 - DNA, 22 bp, Artificial Sequence
  Synthetic oligonucleotide; TTT chr11 5371959 5371980 5371976 5371981 +
ttcttttgagattccacatata

SEQ ID NO: 108395 - DNA, 22 bp, Artificial Sequence
  Synthetic oligonucleotide; TTT chr11 5371960 5371981 5371977 5371982 +
tcttttgagattccacatataa

SEQ ID NO: 108396 - DNA, 22 bp, Artificial Sequence
  Synthetic oligonucleotide; TTT chr11 5371961 5371982 5371978 5371983 +
cttttgagattccacatataag

SEQ ID NO: 108397 - DNA, 22 bp, Artificial Sequence
  Synthetic oligonucleotide; TTC chr11 5371962 5371983 5371979 5371984 +
ttttgagattccacatataagt

SEQ ID NO: 108398 - DNA, 22 bp, Artificial Sequence
  Synthetic oligonucleotide; CTT chr11 5371964 5371985 5371981 5371986 +
ttgagattccacatataagtaa

SEQ ID NO: 108399 - DNA, 22 bp, Artificial Sequence
  Synthetic oligonucleotide; TTT chr11 5371965 5371986 5371982 5371987 +
tgagattccacatataagtaat

SEQ ID NO: 108400 - DNA, 22 bp, Artificial Sequence
  Synthetic oligonucleotide; TTT chr11 5371966 5371987 5371983 5371988 +
gagattccacatataagtaata

SEQ ID NO: 108401 - DNA, 22 bp, Artificial Sequence
  Synthetic oligonucleotide; TTG chr11 5371967 5371988 5371984 5371989 +
agattccacatataagtaatat

SEQ ID NO: 108402 - DNA, 22 bp, Artificial Sequence
  Synthetic oligonucleotide; TTC chr11 5371973 5371994 5371990 5371995 +
cacatataagtaatatcatgcc

SEQ ID NO: 108403 - DNA, 22 bp, Artificial Sequence
  Synthetic oligonucleotide; CTT chr11 5371997 5372018 5372014 5372019 +
tatttgtttctgtgtctggttt

SEQ ID NO: 108404 - DNA, 22 bp, Artificial Sequence
  Synthetic oligonucleotide; TTT chr11 5371998 5372019 5372015 5372020 +
atttgtttctgtgtctggttta

SEQ ID NO: 108405 - DNA, 22 bp, Artificial Sequence
  Synthetic oligonucleotide; TTA chr11 5371999 5372020 5372016 5372021 +
tttgtttctgtgtctggtttat

SEQ ID NO: 108406 - DNA, 22 bp, Artificial Sequence
  Synthetic oligonucleotide; TTT chr11 5372002 5372023 5372019 5372024 +
gtttctgtgtctggtttatttc

SEQ ID NO: 108407 - DNA, 22 bp, Artificial Sequence
  Synthetic oligonucleotide; TTG chr11 5372003 5372024 5372020 5372025 +
tttctgtgtctggtttatttca

SEQ ID NO: 108408 - DNA, 22 bp, Artificial Sequence
  Synthetic oligonucleotide; TTT chr11 5372006 5372027 5372023 5372028 +
ctgtgtctggtttatttcactt

SEQ ID NO: 108409 - DNA, 22 bp, Artificial Sequence
  Synthetic oligonucleotide; TTC chr11 5372007 5372028 5372024 5372029 +
tgtgtctggtttatttcactta

SEQ ID NO: 108410 - DNA, 22 bp, Artificial Sequence
  Synthetic oligonucleotide; CTG chr11 5372009 5372030 5372026 5372031 +
tgtctggtttatttcacttagc

SEQ ID NO: 108411 - DNA, 22 bp, Artificial Sequence
  Synthetic oligonucleotide; CTG chr11 5372015 5372036 5372032 5372037 +
gtttatttcacttagcaaaatg

SEQ ID NO: 108412 - DNA, 22 bp, Artificial Sequence
  Synthetic oligonucleotide; TTT chr11 5372019 5372040 5372036 5372041 +
atttcacttagcaaaatgtact

SEQ ID NO: 108413 - DNA, 22 bp, Artificial Sequence
  Synthetic oligonucleotide; TTA chr11 5372020 5372041 5372037 5372042 +
tttcacttagcaaaatgtactc

SEQ ID NO: 108414 - DNA, 22 bp, Artificial Sequence
  Synthetic oligonucleotide; TTT chr11 5372023 5372044 5372040 5372045 +
cacttagcaaaatgtactctag

SEQ ID NO: 108415 - DNA, 22 bp, Artificial Sequence
  Synthetic oligonucleotide; TTC chr11 5372024 5372045 5372041 5372046 +
acttagcaaaatgtactctagg

SEQ ID NO: 108416 - DNA, 22 bp, Artificial Sequence
  Synthetic oligonucleotide; CTT chr11 5372028 5372049 5372045 5372050 +
agcaaaatgtactctaggttta

SEQ ID NO: 108417 - DNA, 22 bp, Artificial Sequence
  Synthetic oligonucleotide; TTA chr11 5372029 5372050 5372046 5372051 +
gcaaaatgtactctaggtttat

SEQ ID NO: 108418 - DNA, 22 bp, Artificial Sequence
  Synthetic oligonucleotide; CTC chr11 5372042 5372063 5372059 5372064 +
taggtttatacattccccccat

SEQ ID NO: 108419 - DNA, 22 bp, Artificial Sequence
  Synthetic oligonucleotide; CTA chr11 5372044 5372065 5372061 5372066 +
ggtttatacattccccccatct

SEQ ID NO: 108420 - DNA, 22 bp, Artificial Sequence
  Synthetic oligonucleotide; TTT chr11 5372049 5372070 5372066 5372071 +
atacattccccccatctccttt

SEQ ID NO: 108421 - DNA, 22 bp, Artificial Sequence
  Synthetic oligonucleotide; TTA chr11 5372050 5372071 5372067 5372072 +
tacattccccccatctcctttt

SEQ ID NO: 108422 - DNA, 22 bp, Artificial Sequence
  Synthetic oligonucleotide; TTC chr11 5372057 5372078 5372074 5372079 +
cccccatctccttttttaaggc

SEQ ID NO: 108423 - DNA, 22 bp, Artificial Sequence
  Synthetic oligonucleotide; CTC chr11 5372067 5372088 5372084 5372089 +
cttttttaaggctgaataatat

SEQ ID NO: 108424 - DNA, 22 bp, Artificial Sequence
  Synthetic oligonucleotide; CTT chr11 5372070 5372091 5372087 5372092 +
ttttaaggctgaataatattgt

SEQ ID NO: 108425 - DNA, 22 bp, Artificial Sequence
  Synthetic oligonucleotide; TTT chr11 5372071 5372092 5372088 5372093 +
tttaaggctgaataatattgtg

SEQ ID NO: 108426 - DNA, 22 bp, Artificial Sequence
  Synthetic oligonucleotide; TTT chr11 5372072 5372093 5372089 5372094 +
ttaaggctgaataatattgtga

SEQ ID NO: 108427 - DNA, 22 bp, Artificial Sequence
  Synthetic oligonucleotide; TTT chr11 5372073 5372094 5372090 5372095 +
taaggctgaataatattgtgat

SEQ ID NO: 108428 - DNA, 22 bp, Artificial Sequence
  Synthetic oligonucleotide; TTT chr11 5372074 5372095 5372091 5372096 +
aaggctgaataatattgtgata

SEQ ID NO: 108429 - DNA, 22 bp, Artificial Sequence
  Synthetic oligonucleotide; TTA chr11 5372075 5372096 5372092 5372097 +
aggctgaataatattgtgatat

SEQ ID NO: 108430 - DNA, 22 bp, Artificial Sequence
  Synthetic oligonucleotide; CTG chr11 5372081 5372102 5372098 5372103 +
aataatattgtgatatcataca

SEQ ID NO: 108431 - DNA, 22 bp, Artificial Sequence
  Synthetic oligonucleotide; TTG chr11 5372091 5372112 5372108 5372113 +
tgatatcatacatacatatgac

SEQ ID NO: 108432 - DNA, 22 bp, Artificial Sequence
  Synthetic oligonucleotide; CTG chr11 5372141 5372162 5372158 5372163 +
tcacaatgtctttatctgttca

SEQ ID NO: 108433 - DNA, 22 bp, Artificial Sequence
  Synthetic oligonucleotide; CTT chr11 5372153 5372174 5372170 5372175 +
tatctgttcatctatatataga

SEQ ID NO: 108434 - DNA, 22 bp, Artificial Sequence
  Synthetic oligonucleotide; TTT chr11 5372154 5372175 5372171 5372176 +
atctgttcatctatatatagat

SEQ ID NO: 108435 - DNA, 22 bp, Artificial Sequence
  Synthetic oligonucleotide; TTA chr11 5372155 5372176 5372172 5372177 +
tctgttcatctatatatagata

SEQ ID NO: 108436 - DNA, 22 bp, Artificial Sequence
  Synthetic oligonucleotide; CTG chr11 5372159 5372180 5372176 5372181 +
ttcatctatatatagataccac

SEQ ID NO: 108437 - DNA, 22 bp, Artificial Sequence
  Synthetic oligonucleotide; TTC chr11 5372162 5372183 5372179 5372184 +
atctatatatagataccactta

SEQ ID NO: 108438 - DNA, 22 bp, Artificial Sequence
  Synthetic oligonucleotide; CTA chr11 5372167 5372188 5372184 5372189 +
tatatagataccacttagattg

SEQ ID NO: 108439 - DNA, 22 bp, Artificial Sequence
  Synthetic oligonucleotide; CTT chr11 5372183 5372204 5372200 5372205 +
agattgtttccatgtcttggct

SEQ ID NO: 108440 - DNA, 22 bp, Artificial Sequence
  Synthetic oligonucleotide; TTA chr11 5372184 5372205 5372201 5372206 +
gattgtttccatgtcttggcta

SEQ ID NO: 108441 - DNA, 22 bp, Artificial Sequence
  Synthetic oligonucleotide; TTG chr11 5372189 5372210 5372206 5372211 +
tttccatgtcttggctattgtg

SEQ ID NO: 108442 - DNA, 22 bp, Artificial Sequence
  Synthetic oligonucleotide; TTT chr11 5372192 5372213 5372209 5372214 +
ccatgtcttggctattgtgaat

SEQ ID NO: 108443 - DNA, 22 bp, Artificial Sequence
  Synthetic oligonucleotide; TTC chr11 5372193 5372214 5372210 5372215 +
catgtcttggctattgtgaata

SEQ ID NO: 108444 - DNA, 22 bp, Artificial Sequence
  Synthetic oligonucleotide; CTT chr11 5372201 5372222 5372218 5372223 +
ggctattgtgaataatgctgca

SEQ ID NO: 108445 - DNA, 22 bp, Artificial Sequence
  Synthetic oligonucleotide; TTG chr11 5372202 5372223 5372219 5372224 +
gctattgtgaataatgctgcaa

SEQ ID NO: 108446 - DNA, 22 bp, Artificial Sequence
  Synthetic oligonucleotide; CTA chr11 5372206 5372227 5372223 5372228 +
ttgtgaataatgctgcaattaa

SEQ ID NO: 108447 - DNA, 22 bp, Artificial Sequence
  Synthetic oligonucleotide; TTG chr11 5372209 5372230 5372226 5372231 +
tgaataatgctgcaattaacat

SEQ ID NO: 108448 - DNA, 22 bp, Artificial Sequence
  Synthetic oligonucleotide; CTG chr11 5372221 5372242 5372238 5372243 +
caattaacatgagagtgcagat

SEQ ID NO: 108449 - DNA, 22 bp, Artificial Sequence
  Synthetic oligonucleotide; TTA chr11 5372227 5372248 5372244 5372249 +
acatgagagtgcagatagctct

SEQ ID NO: 108450 - DNA, 22 bp, Artificial Sequence
  Synthetic oligonucleotide; CTC chr11 5372248 5372269 5372265 5372270 +
tagaaaatgcggattttattta

SEQ ID NO: 108451 - DNA, 22 bp, Artificial Sequence
  Synthetic oligonucleotide; CTA chr11 5372250 5372271 5372267 5372272 +
gaaaatgcggattttatttatt

SEQ ID NO: 108452 - DNA, 22 bp, Artificial Sequence
  Synthetic oligonucleotide; TTT chr11 5372264 5372285 5372281 5372286 +
tatttattttggatacatatac

SEQ ID NO: 108453 - DNA, 22 bp, Artificial Sequence
  Synthetic oligonucleotide; TTT chr11 5372265 5372286 5372282 5372287 +
atttattttggatacatataca

SEQ ID NO: 108454 - DNA, 22 bp, Artificial Sequence
  Synthetic oligonucleotide; TTA chr11 5372266 5372287 5372283 5372288 +
tttattttggatacatatacag

SEQ ID NO: 108455 - DNA, 22 bp, Artificial Sequence
  Synthetic oligonucleotide; TTT chr11 5372269 5372290 5372286 5372291 +
attttggatacatatacagcag

SEQ ID NO: 108456 - DNA, 22 bp, Artificial Sequence
  Synthetic oligonucleotide; TTA chr11 5372270 5372291 5372287 5372292 +
ttttggatacatatacagcaga

SEQ ID NO: 108457 - DNA, 22 bp, Artificial Sequence
  Synthetic oligonucleotide; TTT chr11 5372273 5372294 5372290 5372295 +
tggatacatatacagcagagaa

SEQ ID NO: 108458 - DNA, 22 bp, Artificial Sequence
  Synthetic oligonucleotide; TTT chr11 5372274 5372295 5372291 5372296 +
ggatacatatacagcagagaaa

SEQ ID NO: 108459 - DNA, 22 bp, Artificial Sequence
  Synthetic oligonucleotide; TTG chr11 5372275 5372296 5372292 5372297 +
gatacatatacagcagagaaat

SEQ ID NO: 108460 - DNA, 22 bp, Artificial Sequence
  Synthetic oligonucleotide; TTT chr11 5372299 5372320 5372316 5372321 +
cttcatcatacaataactctat

SEQ ID NO: 108461 - DNA, 22 bp, Artificial Sequence
  Synthetic oligonucleotide; TTC chr11 5372300 5372321 5372317 5372322 +
ttcatcatacaataactctatt

SEQ ID NO: 108462 - DNA, 22 bp, Artificial Sequence
  Synthetic oligonucleotide; CTT chr11 5372302 5372323 5372319 5372324 +
catcatacaataactctatttt

SEQ ID NO: 108463 - DNA, 22 bp, Artificial Sequence
  Synthetic oligonucleotide; TTC chr11 5372303 5372324 5372320 5372325 +
atcatacaataactctattttt

SEQ ID NO: 108464 - DNA, 22 bp, Artificial Sequence
  Synthetic oligonucleotide; CTC chr11 5372318 5372339 5372335 5372340 +
tatttttagttgtttgagaaac

SEQ ID NO: 108465 - DNA, 22 bp, Artificial Sequence
  Synthetic oligonucleotide; CTA chr11 5372320 5372341 5372337 5372342 +
tttttagttgtttgagaaactt

SEQ ID NO: 108466 - DNA, 22 bp, Artificial Sequence
  Synthetic oligonucleotide; TTT chr11 5372323 5372344 5372340 5372345 +
ttagttgtttgagaaacttcca

SEQ ID NO: 108467 - DNA, 22 bp, Artificial Sequence
  Synthetic oligonucleotide; TTT chr11 5372324 5372345 5372341 5372346 +
tagttgtttgagaaacttccat

SEQ ID NO: 108468 - DNA, 22 bp, Artificial Sequence
  Synthetic oligonucleotide; TTT chr11 5372325 5372346 5372342 5372347 +
agttgtttgagaaacttccata

SEQ ID NO: 108469 - DNA, 22 bp, Artificial Sequence
  Synthetic oligonucleotide; TTA chr11 5372326 5372347 5372343 5372348 +
gttgtttgagaaacttccatac

SEQ ID NO: 108470 - DNA, 22 bp, Artificial Sequence
  Synthetic oligonucleotide; TTG chr11 5372330 5372351 5372347 5372352 +
tttgagaaacttccatacgttt

SEQ ID NO: 108471 - DNA, 22 bp, Artificial Sequence
  Synthetic oligonucleotide; TTT chr11 5372333 5372354 5372350 5372355 +
gagaaacttccatacgttttct

SEQ ID NO: 108472 - DNA, 22 bp, Artificial Sequence
  Synthetic oligonucleotide; TTG chr11 5372334 5372355 5372351 5372356 +
agaaacttccatacgttttcta

SEQ ID NO: 108473 - DNA, 22 bp, Artificial Sequence
  Synthetic oligonucleotide; CTT chr11 5372342 5372363 5372359 5372364 +
ccatacgttttctataatggct

SEQ ID NO: 108474 - DNA, 22 bp, Artificial Sequence
  Synthetic oligonucleotide; TTC chr11 5372343 5372364 5372360 5372365 +
catacgttttctataatggcta

SEQ ID NO: 108475 - DNA, 22 bp, Artificial Sequence
  Synthetic oligonucleotide; TTT chr11 5372352 5372373 5372369 5372374 +
tctataatggctatgttaactt

SEQ ID NO: 108476 - DNA, 22 bp, Artificial Sequence
  Synthetic oligonucleotide; TTT chr11 5372353 5372374 5372370 5372375 +
ctataatggctatgttaactta

SEQ ID NO: 108477 - DNA, 22 bp, Artificial Sequence
  Synthetic oligonucleotide; TTC chr11 5372354 5372375 5372371 5372376 +
tataatggctatgttaacttac

SEQ ID NO: 108478 - DNA, 22 bp, Artificial Sequence
  Synthetic oligonucleotide; CTA chr11 5372356 5372377 5372373 5372378 +
taatggctatgttaacttacat

SEQ ID NO: 108479 - DNA, 22 bp, Artificial Sequence
  Synthetic oligonucleotide; CTA chr11 5372365 5372386 5372382 5372387 +
tgttaacttacattcccaccag

SEQ ID NO: 108480 - DNA, 22 bp, Artificial Sequence
  Synthetic oligonucleotide; TTA chr11 5372370 5372391 5372387 5372392 +
acttacattcccaccagctatg

SEQ ID NO: 108481 - DNA, 22 bp, Artificial Sequence
  Synthetic oligonucleotide; CTT chr11 5372374 5372395 5372391 5372396 +
acattcccaccagctatgcaca

SEQ ID NO: 108482 - DNA, 22 bp, Artificial Sequence
  Synthetic oligonucleotide; TTA chr11 5372375 5372396 5372392 5372397 +
cattcccaccagctatgcacaa

SEQ ID NO: 108483 - DNA, 22 bp, Artificial Sequence
  Synthetic oligonucleotide; TTC chr11 5372380 5372401 5372397 5372402 +
ccaccagctatgcacaagagtt

SEQ ID NO: 108484 - DNA, 22 bp, Artificial Sequence
  Synthetic oligonucleotide; CTA chr11 5372390 5372411 5372407 5372412 +
tgcacaagagttctcctttctc

SEQ ID NO: 108485 - DNA, 22 bp, Artificial Sequence
  Synthetic oligonucleotide; TTC chr11 5372403 5372424 5372420 5372425 +
tcctttctccacagcctctcca

SEQ ID NO: 108486 - DNA, 22 bp, Artificial Sequence
  Synthetic oligonucleotide; CTC chr11 5372405 5372426 5372422 5372427 +
ctttctccacagcctctccaac

SEQ ID NO: 108487 - DNA, 22 bp, Artificial Sequence
  Synthetic oligonucleotide; CTT chr11 5372408 5372429 5372425 5372430 +
tctccacagcctctccaacccc

SEQ ID NO: 108488 - DNA, 22 bp, Artificial Sequence
  Synthetic oligonucleotide; TTT chr11 5372409 5372430 5372426 5372431 +
ctccacagcctctccaacccct

SEQ ID NO: 108489 - DNA, 22 bp, Artificial Sequence
  Synthetic oligonucleotide; TTC chr11 5372410 5372431 5372427 5372432 +
tccacagcctctccaaccccta

SEQ ID NO: 108490 - DNA, 22 bp, Artificial Sequence
  Synthetic oligonucleotide; CTC chr11 5372412 5372433 5372429 5372434 +
cacagcctctccaacccctatc

SEQ ID NO: 108491 - DNA, 22 bp, Artificial Sequence
  Synthetic oligonucleotide; CTC chr11 5372421 5372442 5372438 5372443 +
tccaacccctatctcttgtctt

SEQ ID NO: 108492 - DNA, 22 bp, Artificial Sequence
  Synthetic oligonucleotide; CTC chr11 5372423 5372444 5372440 5372445 +
caacccctatctcttgtctttt

SEQ ID NO: 108493 - DNA, 22 bp, Artificial Sequence
  Synthetic oligonucleotide; CTA chr11 5372432 5372453 5372449 5372454 +
tctcttgtcttttttgataata

SEQ ID NO: 108494 - DNA, 22 bp, Artificial Sequence
  Synthetic oligonucleotide; CTC chr11 5372436 5372457 5372453 5372458 +
ttgtcttttttgataatagcca

SEQ ID NO: 108495 - DNA, 22 bp, Artificial Sequence
  Synthetic oligonucleotide; CTT chr11 5372438 5372459 5372455 5372460 +
gtcttttttgataatagccatc

SEQ ID NO: 108496 - DNA, 22 bp, Artificial Sequence
  Synthetic oligonucleotide; TTG chr11 5372439 5372460 5372456 5372461 +
tcttttttgataatagccatct

SEQ ID NO: 108497 - DNA, 22 bp, Artificial Sequence
  Synthetic oligonucleotide; CTT chr11 5372443 5372464 5372460 5372465 +
ttttgataatagccatctcaac

SEQ ID NO: 108498 - DNA, 22 bp, Artificial Sequence
  Synthetic oligonucleotide; TTT chr11 5372444 5372465 5372461 5372466 +
tttgataatagccatctcaaca

SEQ ID NO: 108499 - DNA, 22 bp, Artificial Sequence
  Synthetic oligonucleotide; TTT chr11 5372445 5372466 5372462 5372467 +
ttgataatagccatctcaacag

SEQ ID NO: 108500 - DNA, 22 bp, Artificial Sequence
  Synthetic oligonucleotide; TTT chr11 5372446 5372467 5372463 5372468 +
tgataatagccatctcaacagg

SEQ ID NO: 108501 - DNA, 22 bp, Artificial Sequence
  Synthetic oligonucleotide; TTT chr11 5372447 5372468 5372464 5372469 +
gataatagccatctcaacaggt

SEQ ID NO: 108502 - DNA, 22 bp, Artificial Sequence
  Synthetic oligonucleotide; TTG chr11 5372448 5372469 5372465 5372470 +
ataatagccatctcaacaggtg

SEQ ID NO: 108503 - DNA, 22 bp, Artificial Sequence
  Synthetic oligonucleotide; CTC chr11 5372462 5372483 5372479 5372484 +
aacaggtgtgagtgatacttgt

SEQ ID NO: 108504 - DNA, 22 bp, Artificial Sequence
  Synthetic oligonucleotide; CTT chr11 5372482 5372503 5372499 5372504 +
gtggttttgatttgcattttcc

SEQ ID NO: 108505 - DNA, 22 bp, Artificial Sequence
  Synthetic oligonucleotide; TTG chr11 5372483 5372504 5372500 5372505 +
tggttttgatttgcattttcct

SEQ ID NO: 108506 - DNA, 22 bp, Artificial Sequence
  Synthetic oligonucleotide; TTT chr11 5372489 5372510 5372506 5372511 +
tgatttgcattttcctgatgat

SEQ ID NO: 108507 - DNA, 22 bp, Artificial Sequence
  Synthetic oligonucleotide; TTT chr11 5372490 5372511 5372507 5372512 +
gatttgcattttcctgatgatt

SEQ ID NO: 108508 - DNA, 22 bp, Artificial Sequence
  Synthetic oligonucleotide; TTG chr11 5372491 5372512 5372508 5372513 +
atttgcattttcctgatgattg

SEQ ID NO: 108509 - DNA, 22 bp, Artificial Sequence
  Synthetic oligonucleotide; TTT chr11 5372495 5372516 5372512 5372517 +
gcattttcctgatgattggtga

SEQ ID NO: 108510 - DNA, 22 bp, Artificial Sequence
  Synthetic oligonucleotide; TTG chr11 5372496 5372517 5372513 5372518 +
cattttcctgatgattggtgat

SEQ ID NO: 108511 - DNA, 22 bp, Artificial Sequence
  Synthetic oligonucleotide; TTT chr11 5372501 5372522 5372518 5372523 +
tcctgatgattggtgatgtagt

SEQ ID NO: 108512 - DNA, 22 bp, Artificial Sequence
  Synthetic oligonucleotide; TTT chr11 5372502 5372523 5372519 5372524 +
cctgatgattggtgatgtagtg

SEQ ID NO: 108513 - DNA, 22 bp, Artificial Sequence
  Synthetic oligonucleotide; TTC chr11 5372503 5372524 5372520 5372525 +
ctgatgattggtgatgtagtgc

SEQ ID NO: 108514 - DNA, 22 bp, Artificial Sequence
  Synthetic oligonucleotide; CTG chr11 5372506 5372527 5372523 5372528 +
atgattggtgatgtagtgcacc

SEQ ID NO: 108515 - DNA, 22 bp, Artificial Sequence
  Synthetic oligonucleotide; TTG chr11 5372513 5372534 5372530 5372535 +
gtgatgtagtgcaccttttcat

SEQ ID NO: 108516 - DNA, 22 bp, Artificial Sequence
  Synthetic oligonucleotide; CTT chr11 5372530 5372551 5372547 5372552 +
ttcatatgcctgctgaccattt

SEQ ID NO: 108517 - DNA, 22 bp, Artificial Sequence
  Synthetic oligonucleotide; TTT chr11 5372531 5372552 5372548 5372553 +
tcatatgcctgctgaccatttg

SEQ ID NO: 108518 - DNA, 22 bp, Artificial Sequence
  Synthetic oligonucleotide; TTT chr11 5372532 5372553 5372549 5372554 +
catatgcctgctgaccatttgc

SEQ ID NO: 108519 - DNA, 22 bp, Artificial Sequence
  Synthetic oligonucleotide; TTC chr11 5372533 5372554 5372550 5372555 +
atatgcctgctgaccatttgca

SEQ ID NO: 108520 - DNA, 22 bp, Artificial Sequence
  Synthetic oligonucleotide; CTG chr11 5372542 5372563 5372559 5372564 +
ctgaccatttgcatgtcttcag

SEQ ID NO: 108521 - DNA, 22 bp, Artificial Sequence
  Synthetic oligonucleotide; CTG chr11 5372545 5372566 5372562 5372567 +
accatttgcatgtcttcagaga

SEQ ID NO: 108522 - DNA, 22 bp, Artificial Sequence
  Synthetic oligonucleotide; TTT chr11 5372552 5372573 5372569 5372574 +
gcatgtcttcagagaaatgtat

SEQ ID NO: 108523 - DNA, 22 bp, Artificial Sequence
  Synthetic oligonucleotide; TTG chr11 5372553 5372574 5372570 5372575 +
catgtcttcagagaaatgtata

SEQ ID NO: 108524 - DNA, 22 bp, Artificial Sequence
  Synthetic oligonucleotide; CTT chr11 5372561 5372582 5372578 5372583 +
cagagaaatgtatattcagatc

SEQ ID NO: 108525 - DNA, 22 bp, Artificial Sequence
  Synthetic oligonucleotide; TTC chr11 5372562 5372583 5372579 5372584 +
agagaaatgtatattcagatcc

SEQ ID NO: 108526 - DNA, 22 bp, Artificial Sequence
  Synthetic oligonucleotide; TTC chr11 5372578 5372599 5372595 5372600 +
agatcctttgcccatttttact

SEQ ID NO: 108527 - DNA, 22 bp, Artificial Sequence
  Synthetic oligonucleotide; CTT chr11 5372586 5372607 5372603 5372608 +
tgcccatttttacttaggttac

SEQ ID NO: 108528 - DNA, 22 bp, Artificial Sequence
  Synthetic oligonucleotide; TTT chr11 5372587 5372608 5372604 5372609 +
gcccatttttacttaggttact

SEQ ID NO: 108529 - DNA, 22 bp, Artificial Sequence
  Synthetic oligonucleotide; TTG chr11 5372588 5372609 5372605 5372610 +
cccatttttacttaggttacta

SEQ ID NO: 108530 - DNA, 22 bp, Artificial Sequence
  Synthetic oligonucleotide; TTT chr11 5372595 5372616 5372612 5372617 +
ttacttaggttactattatatt

SEQ ID NO: 108531 - DNA, 22 bp, Artificial Sequence
  Synthetic oligonucleotide; TTT chr11 5372596 5372617 5372613 5372618 +
tacttaggttactattatattt

SEQ ID NO: 108532 - DNA, 22 bp, Artificial Sequence
  Synthetic oligonucleotide; TTT chr11 5372597 5372618 5372614 5372619 +
acttaggttactattatatttt

SEQ ID NO: 108533 - DNA, 22 bp, Artificial Sequence
  Synthetic oligonucleotide; TTA chr11 5372598 5372619 5372615 5372620 +
cttaggttactattatattttt

SEQ ID NO: 108534 - DNA, 22 bp, Artificial Sequence
  Synthetic oligonucleotide; CTT chr11 5372601 5372622 5372618 5372623 +
aggttactattatattttttca

SEQ ID NO: 108535 - DNA, 22 bp, Artificial Sequence
  Synthetic oligonucleotide; TTA chr11 5372602 5372623 5372619 5372624 +
ggttactattatattttttcat

SEQ ID NO: 108536 - DNA, 22 bp, Artificial Sequence
  Synthetic oligonucleotide; TTA chr11 5372607 5372628 5372624 5372629 +
ctattatattttttcatattta

SEQ ID NO: 108537 - DNA, 22 bp, Artificial Sequence
  Synthetic oligonucleotide; CTA chr11 5372610 5372631 5372627 5372632 +
ttatattttttcatatttagtt

SEQ ID NO: 108538 - DNA, 22 bp, Artificial Sequence
  Synthetic oligonucleotide; TTA chr11 5372613 5372634 5372630 5372635 +
tattttttcatatttagttgat

SEQ ID NO: 108539 - DNA, 22 bp, Artificial Sequence
  Synthetic oligonucleotide; TTT chr11 5372618 5372639 5372635 5372640 +
tttcatatttagttgattgagt

SEQ ID NO: 108540 - DNA, 22 bp, Artificial Sequence
  Synthetic oligonucleotide; TTT chr11 5372619 5372640 5372636 5372641 +
ttcatatttagttgattgagtt

SEQ ID NO: 108541 - DNA, 22 bp, Artificial Sequence
  Synthetic oligonucleotide; TTT chr11 5372620 5372641 5372637 5372642 +
tcatatttagttgattgagttc

SEQ ID NO: 108542 - DNA, 22 bp, Artificial Sequence
  Synthetic oligonucleotide; TTT chr11 5372621 5372642 5372638 5372643 +
catatttagttgattgagttcc

SEQ ID NO: 108543 - DNA, 22 bp, Artificial Sequence
  Synthetic oligonucleotide; TTC chr11 5372622 5372643 5372639 5372644 +
atatttagttgattgagttcct

SEQ ID NO: 108544 - DNA, 22 bp, Artificial Sequence
  Synthetic oligonucleotide; TTT chr11 5372628 5372649 5372645 5372650 +
agttgattgagttccttatata

SEQ ID NO: 108545 - DNA, 22 bp, Artificial Sequence
  Synthetic oligonucleotide; TTA chr11 5372629 5372650 5372646 5372651 +
gttgattgagttccttatatat

SEQ ID NO: 108546 - DNA, 22 bp, Artificial Sequence
  Synthetic oligonucleotide; TTG chr11 5372633 5372654 5372650 5372655 +
attgagttccttatatattttg

SEQ ID NO: 108547 - DNA, 22 bp, Artificial Sequence
  Synthetic oligonucleotide; TTG chr11 5372637 5372658 5372654 5372659 +
agttccttatatattttgggta

SEQ ID NO: 108548 - DNA, 22 bp, Artificial Sequence
  Synthetic oligonucleotide; TTC chr11 5372642 5372663 5372659 5372664 +
cttatatattttgggtattaga

SEQ ID NO: 108549 - DNA, 22 bp, Artificial Sequence
  Synthetic oligonucleotide; CTT chr11 5372645 5372666 5372662 5372667 +
atatattttgggtattagactt

SEQ ID NO: 108550 - DNA, 22 bp, Artificial Sequence
  Synthetic oligonucleotide; TTA chr11 5372646 5372667 5372663 5372668 +
tatattttgggtattagacttg

SEQ ID NO: 108551 - DNA, 22 bp, Artificial Sequence
  Synthetic oligonucleotide; TTT chr11 5372653 5372674 5372670 5372675 +
tgggtattagacttgtatcaga

SEQ ID NO: 108552 - DNA, 22 bp, Artificial Sequence
  Synthetic oligonucleotide; TTT chr11 5372654 5372675 5372671 5372676 +
gggtattagacttgtatcagat

SEQ ID NO: 108553 - DNA, 22 bp, Artificial Sequence
  Synthetic oligonucleotide; TTG chr11 5372655 5372676 5372672 5372677 +
ggtattagacttgtatcagata

SEQ ID NO: 108554 - DNA, 22 bp, Artificial Sequence
  Synthetic oligonucleotide; TTA chr11 5372662 5372683 5372679 5372684 +
gacttgtatcagatatatgatc

SEQ ID NO: 108555 - DNA, 22 bp, Artificial Sequence
  Synthetic oligonucleotide; CTT chr11 5372667 5372688 5372684 5372689 +
gtatcagatatatgatctgtaa

SEQ ID NO: 108556 - DNA, 22 bp, Artificial Sequence
  Synthetic oligonucleotide; TTG chr11 5372668 5372689 5372685 5372690 +
tatcagatatatgatctgtaaa

SEQ ID NO: 108557 - DNA, 22 bp, Artificial Sequence
  Synthetic oligonucleotide; CTG chr11 5372686 5372707 5372703 5372708 +
taaatattttctcccaaactgt

SEQ ID NO: 108558 - DNA, 22 bp, Artificial Sequence
  Synthetic oligonucleotide; TTT chr11 5372695 5372716 5372712 5372717 +
tctcccaaactgttccttttga

SEQ ID NO: 108559 - DNA, 22 bp, Artificial Sequence
  Synthetic oligonucleotide; TTT chr11 5372696 5372717 5372713 5372718 +
ctcccaaactgttccttttgat

SEQ ID NO: 108560 - DNA, 22 bp, Artificial Sequence
  Synthetic oligonucleotide; TTC chr11 5372697 5372718 5372714 5372719 +
tcccaaactgttccttttgatg

SEQ ID NO: 108561 - DNA, 22 bp, Artificial Sequence
  Synthetic oligonucleotide; CTC chr11 5372699 5372720 5372716 5372721 +
ccaaactgttccttttgatgat

SEQ ID NO: 108562 - DNA, 22 bp, Artificial Sequence
  Synthetic oligonucleotide; CTG chr11 5372707 5372728 5372724 5372729 +
ttccttttgatgattgttttct

SEQ ID NO: 108563 - DNA, 22 bp, Artificial Sequence
  Synthetic oligonucleotide; TTC chr11 5372710 5372731 5372727 5372732 +
cttttgatgattgttttctttg

SEQ ID NO: 108564 - DNA, 22 bp, Artificial Sequence
  Synthetic oligonucleotide; CTT chr11 5372713 5372734 5372730 5372735 +
ttgatgattgttttctttgctg

SEQ ID NO: 108565 - DNA, 22 bp, Artificial Sequence
  Synthetic oligonucleotide; TTT chr11 5372714 5372735 5372731 5372736 +
tgatgattgttttctttgctgt

SEQ ID NO: 108566 - DNA, 22 bp, Artificial Sequence
  Synthetic oligonucleotide; TTT chr11 5372715 5372736 5372732 5372737 +
gatgattgttttctttgctgtg

SEQ ID NO: 108567 - DNA, 22 bp, Artificial Sequence
  Synthetic oligonucleotide; TTG chr11 5372716 5372737 5372733 5372738 +
atgattgttttctttgctgtgc

SEQ ID NO: 108568 - DNA, 22 bp, Artificial Sequence
  Synthetic oligonucleotide; TTG chr11 5372723 5372744 5372740 5372745 +
ttttctttgctgtgcagaaaat

SEQ ID NO: 108569 - DNA, 22 bp, Artificial Sequence
  Synthetic oligonucleotide; TTT chr11 5372726 5372747 5372743 5372748 +
tctttgctgtgcagaaaatatt

SEQ ID NO: 108570 - DNA, 22 bp, Artificial Sequence
  Synthetic oligonucleotide; TTT chr11 5372727 5372748 5372744 5372749 +
ctttgctgtgcagaaaatattt

SEQ ID NO: 108571 - DNA, 22 bp, Artificial Sequence
  Synthetic oligonucleotide; TTC chr11 5372728 5372749 5372745 5372750 +
tttgctgtgcagaaaatattta

SEQ ID NO: 108572 - DNA, 22 bp, Artificial Sequence
  Synthetic oligonucleotide; CTT chr11 5372730 5372751 5372747 5372752 +
tgctgtgcagaaaatatttagt

SEQ ID NO: 108573 - DNA, 22 bp, Artificial Sequence
  Synthetic oligonucleotide; TTT chr11 5372731 5372752 5372748 5372753 +
gctgtgcagaaaatatttagtt

SEQ ID NO: 108574 - DNA, 22 bp, Artificial Sequence
  Synthetic oligonucleotide; TTG chr11 5372732 5372753 5372749 5372754 +
ctgtgcagaaaatatttagttt

SEQ ID NO: 108575 - DNA, 22 bp, Artificial Sequence
  Synthetic oligonucleotide; CTG chr11 5372735 5372756 5372752 5372757 +
tgcagaaaatatttagtttgat

SEQ ID NO: 108576 - DNA, 22 bp, Artificial Sequence
  Synthetic oligonucleotide; TTT chr11 5372749 5372770 5372766 5372771 +
agtttgatgttgctccacttgt

SEQ ID NO: 108577 - DNA, 22 bp, Artificial Sequence
  Synthetic oligonucleotide; TTA chr11 5372750 5372771 5372767 5372772 +
gtttgatgttgctccacttgtt

SEQ ID NO: 108578 - DNA, 22 bp, Artificial Sequence
  Synthetic oligonucleotide; TTT chr11 5372754 5372775 5372771 5372776 +
gatgttgctccacttgtttatt

SEQ ID NO: 108579 - DNA, 22 bp, Artificial Sequence
  Synthetic oligonucleotide; TTG chr11 5372755 5372776 5372772 5372777 +
atgttgctccacttgtttattt

SEQ ID NO: 108580 - DNA, 22 bp, Artificial Sequence
  Synthetic oligonucleotide; TTG chr11 5372761 5372782 5372778 5372783 +
ctccacttgtttatttttgctt

SEQ ID NO: 108581 - DNA, 22 bp, Artificial Sequence
  Synthetic oligonucleotide; CTC chr11 5372764 5372785 5372781 5372786 +
cacttgtttatttttgcttttg

SEQ ID NO: 108582 - DNA, 22 bp, Artificial Sequence
  Synthetic oligonucleotide; CTT chr11 5372769 5372790 5372786 5372791 +
gtttatttttgcttttgttacc

SEQ ID NO: 108583 - DNA, 22 bp, Artificial Sequence
  Synthetic oligonucleotide; TTG chr11 5372770 5372791 5372787 5372792 +
tttatttttgcttttgttacct

SEQ ID NO: 108584 - DNA, 22 bp, Artificial Sequence
  Synthetic oligonucleotide; TTT chr11 5372773 5372794 5372790 5372795 +
atttttgcttttgttacctgag

SEQ ID NO: 108585 - DNA, 22 bp, Artificial Sequence
  Synthetic oligonucleotide; TTA chr11 5372774 5372795 5372791 5372796 +
tttttgcttttgttacctgagc

SEQ ID NO: 108586 - DNA, 22 bp, Artificial Sequence
  Synthetic oligonucleotide; TTT chr11 5372777 5372798 5372794 5372799 +
ttgcttttgttacctgagctct

SEQ ID NO: 108587 - DNA, 22 bp, Artificial Sequence
  Synthetic oligonucleotide; TTT chr11 5372778 5372799 5372795 5372800 +
tgcttttgttacctgagctctg

SEQ ID NO: 108588 - DNA, 22 bp, Artificial Sequence
  Synthetic oligonucleotide; TTT chr11 5372779 5372800 5372796 5372801 +
gcttttgttacctgagctctgg

SEQ ID NO: 108589 - DNA, 22 bp, Artificial Sequence
  Synthetic oligonucleotide; TTG chr11 5372780 5372801 5372797 5372802 +
cttttgttacctgagctctggc

SEQ ID NO: 108590 - DNA, 22 bp, Artificial Sequence
  Synthetic oligonucleotide; CTT chr11 5372783 5372804 5372800 5372805 +
ttgttacctgagctctggcaca

SEQ ID NO: 108591 - DNA, 22 bp, Artificial Sequence
  Synthetic oligonucleotide; TTT chr11 5372784 5372805 5372801 5372806 +
tgttacctgagctctggcacat

SEQ ID NO: 108592 - DNA, 22 bp, Artificial Sequence
  Synthetic oligonucleotide; TTT chr11 5372785 5372806 5372802 5372807 +
gttacctgagctctggcacatt

SEQ ID NO: 108593 - DNA, 22 bp, Artificial Sequence
  Synthetic oligonucleotide; TTG chr11 5372786 5372807 5372803 5372808 +
ttacctgagctctggcacattt

SEQ ID NO: 108594 - DNA, 22 bp, Artificial Sequence
  Synthetic oligonucleotide; TTA chr11 5372789 5372810 5372806 5372811 +
cctgagctctggcacattttac

SEQ ID NO: 108595 - DNA, 22 bp, Artificial Sequence
  Synthetic oligonucleotide; CTG chr11 5372793 5372814 5372810 5372815 +
agctctggcacattttacagaa

SEQ ID NO: 108596 - DNA, 22 bp, Artificial Sequence
  Synthetic oligonucleotide; CTC chr11 5372798 5372819 5372815 5372820 +
tggcacattttacagaaaacaa

SEQ ID NO: 108597 - DNA, 22 bp, Artificial Sequence
  Synthetic oligonucleotide; CTG chr11 5372800 5372821 5372817 5372822 +
gcacattttacagaaaacaatt

SEQ ID NO: 108598 - DNA, 22 bp, Artificial Sequence
  Synthetic oligonucleotide; TTT chr11 5372808 5372829 5372825 5372830 +
tacagaaaacaatttgaaaatt

SEQ ID NO: 108599 - DNA, 22 bp, Artificial Sequence
  Synthetic oligonucleotide; TTT chr11 5372809 5372830 5372826 5372831 +
acagaaaacaatttgaaaattt

SEQ ID NO: 108600 - DNA, 22 bp, Artificial Sequence
  Synthetic oligonucleotide; TTA chr11 5372810 5372831 5372827 5372832 +
cagaaaacaatttgaaaatttg

SEQ ID NO: 108601 - DNA, 22 bp, Artificial Sequence
  Synthetic oligonucleotide; TTT chr11 5372823 5372844 5372840 5372845 +
gaaaatttgtatgaaaccacag

SEQ ID NO: 108602 - DNA, 22 bp, Artificial Sequence
  Synthetic oligonucleotide; TTG chr11 5372824 5372845 5372841 5372846 +
aaaatttgtatgaaaccacaga

SEQ ID NO: 108603 - DNA, 22 bp, Artificial Sequence
  Synthetic oligonucleotide; TTT chr11 5372831 5372852 5372848 5372853 +
gtatgaaaccacagaacacccc

SEQ ID NO: 108604 - DNA, 22 bp, Artificial Sequence
  Synthetic oligonucleotide; TTG chr11 5372832 5372853 5372849 5372854 +
tatgaaaccacagaacaccccc

SEQ ID NO: 108605 - DNA, 22 bp, Artificial Sequence
  Synthetic oligonucleotide; CTT chr11 5372873 5372894 5372890 5372895 +
gagaaagaaaaaccaacttgat

SEQ ID NO: 108606 - DNA, 22 bp, Artificial Sequence
  Synthetic oligonucleotide; TTG chr11 5372874 5372895 5372891 5372896 +
agaaagaaaaaccaacttgatg

SEQ ID NO: 108607 - DNA, 22 bp, Artificial Sequence
  Synthetic oligonucleotide; CTT chr11 5372892 5372913 5372909 5372914 +
gatggcagcacacgttctgatt

SEQ ID NO: 108608 - DNA, 22 bp, Artificial Sequence
  Synthetic oligonucleotide; TTG chr11 5372893 5372914 5372910 5372915 +
atggcagcacacgttctgattt

SEQ ID NO: 108609 - DNA, 22 bp, Artificial Sequence
  Synthetic oligonucleotide; TTC chr11 5372909 5372930 5372926 5372931 +
tgatttcaaattatattacaaa

SEQ ID NO: 108610 - DNA, 22 bp, Artificial Sequence
  Synthetic oligonucleotide; CTG chr11 5372911 5372932 5372928 5372933 +
atttcaaattatattacaaagc

SEQ ID NO: 108611 - DNA, 22 bp, Artificial Sequence
  Synthetic oligonucleotide; TTT chr11 5372915 5372936 5372932 5372937 +
caaattatattacaaagctata

SEQ ID NO: 108612 - DNA, 22 bp, Artificial Sequence
  Synthetic oligonucleotide; TTC chr11 5372916 5372937 5372933 5372938 +
aaattatattacaaagctatag

SEQ ID NO: 108613 - DNA, 22 bp, Artificial Sequence
  Synthetic oligonucleotide; TTA chr11 5372922 5372943 5372939 5372944 +
tattacaaagctatagtaacca

SEQ ID NO: 108614 - DNA, 22 bp, Artificial Sequence
  Synthetic oligonucleotide; TTA chr11 5372927 5372948 5372944 5372949 +
caaagctatagtaaccaaaaaa

SEQ ID NO: 108615 - DNA, 22 bp, Artificial Sequence
  Synthetic oligonucleotide; CTA chr11 5372935 5372956 5372952 5372957 +
tagtaaccaaaaaagtatggta

SEQ ID NO: 108616 - DNA, 22 bp, Artificial Sequence
  Synthetic oligonucleotide; CTA chr11 5372960 5372981 5372977 5372982 +
tcacataaatagacacatagac

SEQ ID NO: 108617 - DNA, 22 bp, Artificial Sequence
  Synthetic oligonucleotide; TTG chr11 5372989 5373010 5373006 5373011 +
aacagaataaagagcccagaaa

SEQ ID NO: 108618 - DNA, 22 bp, Artificial Sequence
  Synthetic oligonucleotide; TTT chr11 5373018 5373039 5373035 5373040 +
acgtatatacagtccagtaatt

SEQ ID NO: 108619 - DNA, 22 bp, Artificial Sequence
  Synthetic oligonucleotide; TTA chr11 5373019 5373040 5373036 5373041 +
cgtatatacagtccagtaattc

SEQ ID NO: 108620 - DNA, 22 bp, Artificial Sequence
  Synthetic oligonucleotide; TTC chr11 5373041 5373062 5373058 5373063 +
tcaacaaggccaccaacacaat

SEQ ID NO: 108621 - DNA, 22 bp, Artificial Sequence
  Synthetic oligonucleotide; CTC chr11 5373043 5373064 5373060 5373065 +
aacaaggccaccaacacaatag

SEQ ID NO: 108622 - DNA, 22 bp, Artificial Sequence
  Synthetic oligonucleotide; CTC chr11 5373080 5373101 5373097 5373102 +
ctcaacaaatagtgttgggaaa

SEQ ID NO: 108623 - DNA, 22 bp, Artificial Sequence
  Synthetic oligonucleotide; CTC chr11 5373083 5373104 5373100 5373105 +
aacaaatagtgttgggaaaact

SEQ ID NO: 108624 - DNA, 22 bp, Artificial Sequence
  Synthetic oligonucleotide; TTG chr11 5373097 5373118 5373114 5373119 +
ggaaaactggatatccaaatgc

SEQ ID NO: 108625 - DNA, 22 bp, Artificial Sequence
  Synthetic oligonucleotide; CTG chr11 5373106 5373127 5373123 5373128 +
gatatccaaatgcaaaagaata

SEQ ID NO: 108626 - DNA, 22 bp, Artificial Sequence
  Synthetic oligonucleotide; TTG chr11 5373134 5373155 5373151 5373156 +
gacctttaccttaagccataag

SEQ ID NO: 108627 - DNA, 22 bp, Artificial Sequence
  Synthetic oligonucleotide; CTT chr11 5373140 5373161 5373157 5373162 +
taccttaagccataagtcaact

SEQ ID NO: 108628 - DNA, 22 bp, Artificial Sequence
  Synthetic oligonucleotide; TTT chr11 5373141 5373162 5373158 5373163 +
accttaagccataagtcaactc

SEQ ID NO: 108629 - DNA, 22 bp, Artificial Sequence
  Synthetic oligonucleotide; TTA chr11 5373142 5373163 5373159 5373164 +
ccttaagccataagtcaactca

SEQ ID NO: 108630 - DNA, 22 bp, Artificial Sequence
  Synthetic oligonucleotide; CTT chr11 5373146 5373167 5373163 5373168 +
aagccataagtcaactcaaaat

SEQ ID NO: 108631 - DNA, 22 bp, Artificial Sequence
  Synthetic oligonucleotide; TTA chr11 5373147 5373168 5373164 5373169 +
agccataagtcaactcaaaata

SEQ ID NO: 108632 - DNA, 22 bp, Artificial Sequence
  Synthetic oligonucleotide; CTC chr11 5373163 5373184 5373180 5373185 +
aaaatagattaaagacataaat

SEQ ID NO: 108633 - DNA, 22 bp, Artificial Sequence
  Synthetic oligonucleotide; TTA chr11 5373174 5373195 5373191 5373196 +
aagacataaatgtaagacctga

SEQ ID NO: 108634 - DNA, 22 bp, Artificial Sequence
  Synthetic oligonucleotide; CTG chr11 5373195 5373216 5373212 5373217 +
aaatcacaaaactcctggaaga

SEQ ID NO: 108635 - DNA, 22 bp, Artificial Sequence
  Synthetic oligonucleotide; CTC chr11 5373209 5373230 5373226 5373231 +
ctggaagaacatgtatagagat

SEQ ID NO: 108636 - DNA, 22 bp, Artificial Sequence
  Synthetic oligonucleotide; CTG chr11 5373212 5373233 5373229 5373234 +
gaagaacatgtatagagatagc

SEQ ID NO: 108637 - DNA, 22 bp, Artificial Sequence
  Synthetic oligonucleotide; CTG chr11 5373236 5373257 5373253 5373258 +
cttgatatcagtctcggcaatt

SEQ ID NO: 108638 - DNA, 22 bp, Artificial Sequence
  Synthetic oligonucleotide; CTT chr11 5373239 5373260 5373256 5373261 +
gatatcagtctcggcaattttt

SEQ ID NO: 108639 - DNA, 22 bp, Artificial Sequence
  Synthetic oligonucleotide; TTG chr11 5373240 5373261 5373257 5373262 +
atatcagtctcggcaatttttt

SEQ ID NO: 108640 - DNA, 22 bp, Artificial Sequence
  Synthetic oligonucleotide; CTC chr11 5373251 5373272 5373268 5373273 +
ggcaattttttagatattgtct

SEQ ID NO: 108641 - DNA, 22 bp, Artificial Sequence
  Synthetic oligonucleotide; TTT chr11 5373259 5373280 5373276 5373281 +
tttagatattgtcttgatttga

SEQ ID NO: 108642 - DNA, 22 bp, Artificial Sequence
  Synthetic oligonucleotide; TTT chr11 5373260 5373281 5373277 5373282 +
ttagatattgtcttgatttgaa

SEQ ID NO: 108643 - DNA, 22 bp, Artificial Sequence
  Synthetic oligonucleotide; TTT chr11 5373261 5373282 5373278 5373283 +
tagatattgtcttgatttgaag

SEQ ID NO: 108644 - DNA, 22 bp, Artificial Sequence
  Synthetic oligonucleotide; TTT chr11 5373262 5373283 5373279 5373284 +
agatattgtcttgatttgaaga

SEQ ID NO: 108645 - DNA, 22 bp, Artificial Sequence
  Synthetic oligonucleotide; TTA chr11 5373263 5373284 5373280 5373285 +
gatattgtcttgatttgaagaa

SEQ ID NO: 108646 - DNA, 22 bp, Artificial Sequence
  Synthetic oligonucleotide; TTG chr11 5373270 5373291 5373287 5373292 +
tcttgatttgaagaaaattttc

SEQ ID NO: 108647 - DNA, 22 bp, Artificial Sequence
  Synthetic oligonucleotide; CTT chr11 5373274 5373295 5373291 5373296 +
gatttgaagaaaattttcactg

SEQ ID NO: 108648 - DNA, 22 bp, Artificial Sequence
  Synthetic oligonucleotide; TTG chr11 5373275 5373296 5373292 5373297 +
atttgaagaaaattttcactgg

SEQ ID NO: 108649 - DNA, 22 bp, Artificial Sequence
  Synthetic oligonucleotide; TTT chr11 5373279 5373300 5373296 5373301 +
gaagaaaattttcactggaagt

SEQ ID NO: 108650 - DNA, 22 bp, Artificial Sequence
  Synthetic oligonucleotide; TTG chr11 5373280 5373301 5373297 5373302 +
aagaaaattttcactggaagtc

SEQ ID NO: 108651 - DNA, 22 bp, Artificial Sequence
  Synthetic oligonucleotide; TTT chr11 5373290 5373311 5373307 5373312 +
tcactggaagtctatattgatc

SEQ ID NO: 108652 - DNA, 22 bp, Artificial Sequence
  Synthetic oligonucleotide; TTT chr11 5373291 5373312 5373308 5373313 +
cactggaagtctatattgatcg

SEQ ID NO: 108653 - DNA, 22 bp, Artificial Sequence
  Synthetic oligonucleotide; TTC chr11 5373292 5373313 5373309 5373314 +
actggaagtctatattgatcga

SEQ ID NO: 108654 - DNA, 22 bp, Artificial Sequence
  Synthetic oligonucleotide; CTG chr11 5373296 5373317 5373313 5373318 +
gaagtctatattgatcgatttt

SEQ ID NO: 108655 - DNA, 22 bp, Artificial Sequence
  Synthetic oligonucleotide; CTA chr11 5373304 5373325 5373321 5373326 +
tattgatcgattttttctttca

SEQ ID NO: 108656 - DNA, 22 bp, Artificial Sequence
  Synthetic oligonucleotide; TTG chr11 5373309 5373330 5373326 5373331 +
atcgattttttctttcacaaat

SEQ ID NO: 108657 - DNA, 22 bp, Artificial Sequence
  Synthetic oligonucleotide; TTT chr11 5373317 5373338 5373334 5373339 +
tttctttcacaaataaagttcc

SEQ ID NO: 108658 - DNA, 22 bp, Artificial Sequence
  Synthetic oligonucleotide; TTT chr11 5373318 5373339 5373335 5373340 +
ttctttcacaaataaagttcca

SEQ ID NO: 108659 - DNA, 22 bp, Artificial Sequence
  Synthetic oligonucleotide; TTT chr11 5373319 5373340 5373336 5373341 +
tctttcacaaataaagttccag

SEQ ID NO: 108660 - DNA, 22 bp, Artificial Sequence
  Synthetic oligonucleotide; TTT chr11 5373320 5373341 5373337 5373342 +
ctttcacaaataaagttccagt

SEQ ID NO: 108661 - DNA, 22 bp, Artificial Sequence
  Synthetic oligonucleotide; TTC chr11 5373321 5373342 5373338 5373343 +
tttcacaaataaagttccagtt

SEQ ID NO: 108662 - DNA, 22 bp, Artificial Sequence
  Synthetic oligonucleotide; CTT chr11 5373323 5373344 5373340 5373345 +
tcacaaataaagttccagtttt

SEQ ID NO: 108663 - DNA, 22 bp, Artificial Sequence
  Synthetic oligonucleotide; TTT chr11 5373324 5373345 5373341 5373346 +
cacaaataaagttccagttttt

SEQ ID NO: 108664 - DNA, 22 bp, Artificial Sequence
  Synthetic oligonucleotide; TTC chr11 5373325 5373346 5373342 5373347 +
acaaataaagttccagtttttg

SEQ ID NO: 108665 - DNA, 22 bp, Artificial Sequence
  Synthetic oligonucleotide; TTC chr11 5373338 5373359 5373355 5373360 +
cagtttttgagccaagatggcc

SEQ ID NO: 108666 - DNA, 22 bp, Artificial Sequence
  Synthetic oligonucleotide; TTT chr11 5373344 5373365 5373361 5373366 +
ttgagccaagatggccaaatag

SEQ ID NO: 108667 - DNA, 22 bp, Artificial Sequence
  Synthetic oligonucleotide; TTT chr11 5373345 5373366 5373362 5373367 +
tgagccaagatggccaaatagg

SEQ ID NO: 108668 - DNA, 22 bp, Artificial Sequence
  Synthetic oligonucleotide; TTT chr11 5373346 5373367 5373363 5373368 +
gagccaagatggccaaatagga

SEQ ID NO: 108669 - DNA, 22 bp, Artificial Sequence
  Synthetic oligonucleotide; TTG chr11 5373347 5373368 5373364 5373369 +
agccaagatggccaaataggaa

SEQ ID NO: 108670 - DNA, 22 bp, Artificial Sequence
  Synthetic oligonucleotide; CTC chr11 5373375 5373396 5373392 5373397 +
tggtctacagctcccagcgtga

SEQ ID NO: 108671 - DNA, 22 bp, Artificial Sequence
  Synthetic oligonucleotide; CTG chr11 5373377 5373398 5373394 5373399 +
gtctacagctcccagcgtgaac

SEQ ID NO: 108672 - DNA, 22 bp, Artificial Sequence
  Synthetic oligonucleotide; CTA chr11 5373382 5373403 5373399 5373404 +
cagctcccagcgtgaacaacac

SEQ ID NO: 108673 - DNA, 22 bp, Artificial Sequence
  Synthetic oligonucleotide; CTC chr11 5373388 5373409 5373405 5373410 +
ccagcgtgaacaacacagaaga

SEQ ID NO: 108674 - DNA, 22 bp, Artificial Sequence
  Synthetic oligonucleotide; TTT chr11 5373420 5373441 5373437 5373442 +
ctgcatttccatctgaggtatg

SEQ ID NO: 108675 - DNA, 22 bp, Artificial Sequence
  Synthetic oligonucleotide; TTC chr11 5373421 5373442 5373438 5373443 +
tgcatttccatctgaggtatgg

SEQ ID NO: 108676 - DNA, 22 bp, Artificial Sequence
  Synthetic oligonucleotide; CTG chr11 5373423 5373444 5373440 5373445 +
catttccatctgaggtatgggg

SEQ ID NO: 108677 - DNA, 22 bp, Artificial Sequence
  Synthetic oligonucleotide; TTT chr11 5373428 5373449 5373445 5373450 +
ccatctgaggtatggggttcat

SEQ ID NO: 108678 - DNA, 22 bp, Artificial Sequence
  Synthetic oligonucleotide; TTC chr11 5373429 5373450 5373446 5373451 +
catctgaggtatggggttcatc

SEQ ID NO: 108679 - DNA, 22 bp, Artificial Sequence
  Synthetic oligonucleotide; CTG chr11 5373435 5373456 5373452 5373457 +
aggtatggggttcatctcgcta

SEQ ID NO: 108680 - DNA, 22 bp, Artificial Sequence
  Synthetic oligonucleotide; TTC chr11 5373448 5373469 5373465 5373470 +
atctcgctagggagtgccagac

SEQ ID NO: 108681 - DNA, 22 bp, Artificial Sequence
  Synthetic oligonucleotide; CTC chr11 5373453 5373474 5373470 5373475 +
gctagggagtgccagacagtgg

SEQ ID NO: 108682 - DNA, 22 bp, Artificial Sequence
  Synthetic oligonucleotide; CTA chr11 5373457 5373478 5373474 5373479 +
gggagtgccagacagtgggcac

SEQ ID NO: 108683 - DNA, 22 bp, Artificial Sequence
  Synthetic oligonucleotide; TTG chr11 5373531 5373552 5373548 5373553 +
cctcacttgggaagcacaaggg

SEQ ID NO: 108684 - DNA, 22 bp, Artificial Sequence
  Synthetic oligonucleotide; CTC chr11 5373535 5373556 5373552 5373557 +
acttgggaagcacaaggggtca

SEQ ID NO: 108685 - DNA, 22 bp, Artificial Sequence
  Synthetic oligonucleotide; CTT chr11 5373539 5373560 5373556 5373561 +
gggaagcacaaggggtcatgga

SEQ ID NO: 108686 - DNA, 22 bp, Artificial Sequence
  Synthetic oligonucleotide; TTG chr11 5373540 5373561 5373557 5373562 +
ggaagcacaaggggtcatggag

SEQ ID NO: 108687 - DNA, 22 bp, Artificial Sequence
  Synthetic oligonucleotide; TTC chr11 5373565 5373586 5373582 5373587 +
cctttcctggtcaaggaaaggg

SEQ ID NO: 108688 - DNA, 22 bp, Artificial Sequence
  Synthetic oligonucleotide; CTT chr11 5373569 5373590 5373586 5373591 +
tcctggtcaaggaaaggggtga

SEQ ID NO: 108689 - DNA, 22 bp, Artificial Sequence
  Synthetic oligonucleotide; TTT chr11 5373570 5373591 5373587 5373592 +
cctggtcaaggaaaggggtgac

SEQ ID NO: 108690 - DNA, 22 bp, Artificial Sequence
  Synthetic oligonucleotide; TTC chr11 5373571 5373592 5373588 5373593 +
ctggtcaaggaaaggggtgaca

SEQ ID NO: 108691 - DNA, 22 bp, Artificial Sequence
  Synthetic oligonucleotide; CTG chr11 5373574 5373595 5373591 5373596 +
gtcaaggaaaggggtgacatac

SEQ ID NO: 108692 - DNA, 22 bp, Artificial Sequence
  Synthetic oligonucleotide; CTG chr11 5373604 5373625 5373621 5373626 +
gaaaattgggccactcccaccc

SEQ ID NO: 108693 - DNA, 22 bp, Artificial Sequence
  Synthetic oligonucleotide; TTG chr11 5373612 5373633 5373629 5373634 +
ggccactcccacccgaatactg

SEQ ID NO: 108694 - DNA, 22 bp, Artificial Sequence
  Synthetic oligonucleotide; CTC chr11 5373620 5373641 5373637 5373642 +
ccacccgaatactgtgcttttc

SEQ ID NO: 108695 - DNA, 22 bp, Artificial Sequence
  Synthetic oligonucleotide; CTG chr11 5373634 5373655 5373651 5373656 +
tgcttttctgacaggcttagga

SEQ ID NO: 108696 - DNA, 22 bp, Artificial Sequence
  Synthetic oligonucleotide; CTT chr11 5373639 5373660 5373656 5373661 +
ttctgacaggcttaggaaatgg

SEQ ID NO: 108697 - DNA, 22 bp, Artificial Sequence
  Synthetic oligonucleotide; TTT chr11 5373640 5373661 5373657 5373662 +
tctgacaggcttaggaaatggc

SEQ ID NO: 108698 - DNA, 22 bp, Artificial Sequence
  Synthetic oligonucleotide; TTT chr11 5373641 5373662 5373658 5373663 +
ctgacaggcttaggaaatggcg

SEQ ID NO: 108699 - DNA, 22 bp, Artificial Sequence
  Synthetic oligonucleotide; TTC chr11 5373642 5373663 5373659 5373664 +
tgacaggcttaggaaatggcgc

SEQ ID NO: 108700 - DNA, 22 bp, Artificial Sequence
  Synthetic oligonucleotide; CTG chr11 5373644 5373665 5373661 5373666 +
acaggcttaggaaatggcgcac

SEQ ID NO: 108701 - DNA, 22 bp, Artificial Sequence
  Synthetic oligonucleotide; CTT chr11 5373652 5373673 5373669 5373674 +
aggaaatggcgcaccaggagat

SEQ ID NO: 108702 - DNA, 22 bp, Artificial Sequence
  Synthetic oligonucleotide; TTA chr11 5373653 5373674 5373670 5373675 +
ggaaatggcgcaccaggagatt

SEQ ID NO: 108703 - DNA, 22 bp, Artificial Sequence
  Synthetic oligonucleotide; TTA chr11 5373676 5373697 5373693 5373698 +
tatcctgcacatggctccgagg

SEQ ID NO: 108704 - DNA, 22 bp, Artificial Sequence
  Synthetic oligonucleotide; CTG chr11 5373683 5373704 5373700 5373705 +
cacatggctccgagggtcctac

SEQ ID NO: 108705 - DNA, 22 bp, Artificial Sequence
  Synthetic oligonucleotide; CTC chr11 5373693 5373714 5373710 5373715 +
cgagggtcctacgcccacggag

SEQ ID NO: 108706 - DNA, 22 bp, Artificial Sequence
  Synthetic oligonucleotide; CTA chr11 5373704 5373725 5373721 5373726 +
cgcccacggagtctccctgatt

SEQ ID NO: 108707 - DNA, 22 bp, Artificial Sequence
  Synthetic oligonucleotide; CTC chr11 5373719 5373740 5373736 5373741 +
cctgattgctagcacagcagtc

SEQ ID NO: 108708 - DNA, 22 bp, Artificial Sequence
  Synthetic oligonucleotide; CTG chr11 5373723 5373744 5373740 5373745 +
attgctagcacagcagtctgag

SEQ ID NO: 108709 - DNA, 22 bp, Artificial Sequence
  Synthetic oligonucleotide; TTG chr11 5373727 5373748 5373744 5373749 +
ctagcacagcagtctgagatca

SEQ ID NO: 108710 - DNA, 22 bp, Artificial Sequence
  Synthetic oligonucleotide; CTA chr11 5373730 5373751 5373747 5373752 +
gcacagcagtctgagatcaaac

SEQ ID NO: 108711 - DNA, 22 bp, Artificial Sequence
  Synthetic oligonucleotide; CTG chr11 5373743 5373764 5373760 5373765 +
agatcaaactgcaaggtggcag

SEQ ID NO: 108712 - DNA, 22 bp, Artificial Sequence
  Synthetic oligonucleotide; CTG chr11 5373754 5373775 5373771 5373776 +
caaggtggcagcgaggctgggg

SEQ ID NO: 108713 - DNA, 22 bp, Artificial Sequence
  Synthetic oligonucleotide; CTG chr11 5373773 5373794 5373790 5373795 +
ggggaggggcagccgccattgc

SEQ ID NO: 108714 - DNA, 22 bp, Artificial Sequence
  Synthetic oligonucleotide; TTG chr11 5373794 5373815 5373811 5373816 +
cccaggcttgcttaggtaaaca

SEQ ID NO: 108715 - DNA, 22 bp, Artificial Sequence
  Synthetic oligonucleotide; CTT chr11 5373803 5373824 5373820 5373825 +
gcttaggtaaacaaagcagcca

SEQ ID NO: 108716 - DNA, 22 bp, Artificial Sequence
  Synthetic oligonucleotide; TTG chr11 5373804 5373825 5373821 5373826 +
cttaggtaaacaaagcagccag

SEQ ID NO: 108717 - DNA, 22 bp, Artificial Sequence
  Synthetic oligonucleotide; CTT chr11 5373807 5373828 5373824 5373829 +
aggtaaacaaagcagccaggaa

SEQ ID NO: 108718 - DNA, 22 bp, Artificial Sequence
  Synthetic oligonucleotide; TTA chr11 5373808 5373829 5373825 5373830 +
ggtaaacaaagcagccaggaag

SEQ ID NO: 108719 - DNA, 22 bp, Artificial Sequence
  Synthetic oligonucleotide; CTC chr11 5373833 5373854 5373850 5373855 +
aaactgggtggaccccaccaca

SEQ ID NO: 108720 - DNA, 22 bp, Artificial Sequence
  Synthetic oligonucleotide; CTG chr11 5373839 5373860 5373856 5373861 +
ggtggaccccaccacagctcaa

SEQ ID NO: 108721 - DNA, 22 bp, Artificial Sequence
  Synthetic oligonucleotide; CTC chr11 5373859 5373880 5373876 5373881 +
aaggaggcctgcctgcctctgt

SEQ ID NO: 108722 - DNA, 22 bp, Artificial Sequence
  Synthetic oligonucleotide; CTG chr11 5373870 5373891 5373887 5373892 +
cctgcctctgtaggctccacct

SEQ ID NO: 108723 - DNA, 22 bp, Artificial Sequence
  Synthetic oligonucleotide; CTG chr11 5373874 5373895 5373891 5373896 +
cctctgtaggctccacctttgg

SEQ ID NO: 108724 - DNA, 22 bp, Artificial Sequence
  Synthetic oligonucleotide; CTC chr11 5373878 5373899 5373895 5373900 +
tgtaggctccacctttgggggc

SEQ ID NO: 108725 - DNA, 22 bp, Artificial Sequence
  Synthetic oligonucleotide; CTG chr11 5373880 5373901 5373897 5373902 +
taggctccacctttgggggcag

SEQ ID NO: 108726 - DNA, 22 bp, Artificial Sequence
  Synthetic oligonucleotide; CTC chr11 5373887 5373908 5373904 5373909 +
cacctttgggggcagggcacag

SEQ ID NO: 108727 - DNA, 22 bp, Artificial Sequence
  Synthetic oligonucleotide; CTT chr11 5373893 5373914 5373910 5373915 +
tgggggcagggcacagacaaac

SEQ ID NO: 108728 - DNA, 22 bp, Artificial Sequence
  Synthetic oligonucleotide; TTT chr11 5373894 5373915 5373911 5373916 +
gggggcagggcacagacaaaca

SEQ ID NO: 108729 - DNA, 22 bp, Artificial Sequence
  Synthetic oligonucleotide; TTG chr11 5373895 5373916 5373912 5373917 +
ggggcagggcacagacaaacaa

SEQ ID NO: 108730 - DNA, 22 bp, Artificial Sequence
  Synthetic oligonucleotide; CTC chr11 5373935 5373956 5373952 5373957 +
tgcagacttaaatgtccctgtc

SEQ ID NO: 108731 - DNA, 22 bp, Artificial Sequence
  Synthetic oligonucleotide; CTG chr11 5373937 5373958 5373954 5373959 +
cagacttaaatgtccctgtctg

SEQ ID NO: 108732 - DNA, 22 bp, Artificial Sequence
  Synthetic oligonucleotide; CTT chr11 5373944 5373965 5373961 5373966 +
aaatgtccctgtctgacagctt

SEQ ID NO: 108733 - DNA, 22 bp, Artificial Sequence
  Synthetic oligonucleotide; TTA chr11 5373945 5373966 5373962 5373967 +
aatgtccctgtctgacagcttt

SEQ ID NO: 108734 - DNA, 22 bp, Artificial Sequence
  Synthetic oligonucleotide; CTG chr11 5373955 5373976 5373972 5373977 +
tctgacagctttgaggagagca

SEQ ID NO: 108735 - DNA, 22 bp, Artificial Sequence
  Synthetic oligonucleotide; CTG chr11 5373959 5373980 5373976 5373981 +
acagctttgaggagagcagtgg

SEQ ID NO: 108736 - DNA, 22 bp, Artificial Sequence
  Synthetic oligonucleotide; CTT chr11 5373966 5373987 5373983 5373988 +
tgaggagagcagtggttctccc

SEQ ID NO: 108737 - DNA, 22 bp, Artificial Sequence
  Synthetic oligonucleotide; TTT chr11 5373967 5373988 5373984 5373989 +
gaggagagcagtggttctccca

SEQ ID NO: 108738 - DNA, 22 bp, Artificial Sequence
  Synthetic oligonucleotide; TTG chr11 5373968 5373989 5373985 5373990 +
aggagagcagtggttctcccag

SEQ ID NO: 108739 - DNA, 22 bp, Artificial Sequence
  Synthetic oligonucleotide; TTC chr11 5373984 5374005 5374001 5374006 +
tcccagcacacagctggagatc

SEQ ID NO: 108740 - DNA, 22 bp, Artificial Sequence
  Synthetic oligonucleotide; CTC chr11 5373986 5374007 5374003 5374008 +
ccagcacacagctggagatctg

SEQ ID NO: 108741 - DNA, 22 bp, Artificial Sequence
  Synthetic oligonucleotide; CTG chr11 5374000 5374021 5374017 5374022 +
gagatctgagaacgggcagact

SEQ ID NO: 108742 - DNA, 22 bp, Artificial Sequence
  Synthetic oligonucleotide; CTG chr11 5374008 5374029 5374025 5374030 +
agaacgggcagactgcctcctc

SEQ ID NO: 108743 - DNA, 22 bp, Artificial Sequence
  Synthetic oligonucleotide; CTG chr11 5374023 5374044 5374040 5374045 +
cctcctcaagtgggtccctgac

SEQ ID NO: 108744 - DNA, 22 bp, Artificial Sequence
  Synthetic oligonucleotide; CTC chr11 5374027 5374048 5374044 5374049 +
ctcaagtgggtccctgacccct

SEQ ID NO: 108745 - DNA, 22 bp, Artificial Sequence
  Synthetic oligonucleotide; CTC chr11 5374030 5374051 5374047 5374052 +
aagtgggtccctgacccctgac

SEQ ID NO: 108746 - DNA, 22 bp, Artificial Sequence
  Synthetic oligonucleotide; CTG chr11 5374043 5374064 5374060 5374065 +
acccctgacccccgagcagcct

SEQ ID NO: 108747 - DNA, 22 bp, Artificial Sequence
  Synthetic oligonucleotide; CTG chr11 5374050 5374071 5374067 5374072 +
acccccgagcagcctaactggg

SEQ ID NO: 108748 - DNA, 22 bp, Artificial Sequence
  Synthetic oligonucleotide; CTA chr11 5374066 5374087 5374083 5374088 +
actgggaggcacccccaagtaa

SEQ ID NO: 108749 - DNA, 22 bp, Artificial Sequence
  Synthetic oligonucleotide; CTG chr11 5374070 5374091 5374087 5374092 +
ggaggcacccccaagtaagggc

SEQ ID NO: 108750 - DNA, 22 bp, Artificial Sequence
  Synthetic oligonucleotide; CTG chr11 5374098 5374119 5374115 5374120 +
acacctcacacggccaggtact

SEQ ID NO: 108751 - DNA, 22 bp, Artificial Sequence
  Synthetic oligonucleotide; CTC chr11 5374105 5374126 5374122 5374127 +
acacggccaggtactcctctga

SEQ ID NO: 108752 - DNA, 22 bp, Artificial Sequence
  Synthetic oligonucleotide; CTC chr11 5374121 5374142 5374138 5374143 +
ctctgagacaaaacttccagag

SEQ ID NO: 108753 - DNA, 22 bp, Artificial Sequence
  Synthetic oligonucleotide; CTC chr11 5374124 5374145 5374141 5374146 +
tgagacaaaacttccagaggaa

SEQ ID NO: 108754 - DNA, 22 bp, Artificial Sequence
  Synthetic oligonucleotide; CTG chr11 5374126 5374147 5374143 5374148 +
agacaaaacttccagaggaacg

SEQ ID NO: 108755 - DNA, 22 bp, Artificial Sequence
  Synthetic oligonucleotide; CTT chr11 5374137 5374158 5374154 5374159 +
ccagaggaacgatcagacagca

SEQ ID NO: 108756 - DNA, 22 bp, Artificial Sequence
  Synthetic oligonucleotide; TTC chr11 5374138 5374159 5374155 5374160 +
cagaggaacgatcagacagcag

SEQ ID NO: 108757 - DNA, 22 bp, Artificial Sequence
  Synthetic oligonucleotide; TTC chr11 5374165 5374186 5374182 5374187 +
gcggatcacgaaaatctgcggt

SEQ ID NO: 108758 - DNA, 22 bp, Artificial Sequence
  Synthetic oligonucleotide; CTG chr11 5374183 5374204 5374200 5374205 +
cggttctgcagacaccgctgct

SEQ ID NO: 108759 - DNA, 22 bp, Artificial Sequence
  Synthetic oligonucleotide; TTC chr11 5374189 5374210 5374206 5374211 +
tgcagacaccgctgctgatacc

SEQ ID NO: 108760 - DNA, 22 bp, Artificial Sequence
  Synthetic oligonucleotide; CTG chr11 5374191 5374212 5374208 5374213 +
cagacaccgctgctgataccca

SEQ ID NO: 108761 - DNA, 22 bp, Artificial Sequence
  Synthetic oligonucleotide; CTG chr11 5374203 5374224 5374220 5374225 +
ctgatacccaggcaaacagggt

SEQ ID NO: 108762 - DNA, 22 bp, Artificial Sequence
  Synthetic oligonucleotide; CTG chr11 5374206 5374227 5374223 5374228 +
atacccaggcaaacagggtctg

SEQ ID NO: 108763 - DNA, 22 bp, Artificial Sequence
  Synthetic oligonucleotide; CTG chr11 5374228 5374249 5374245 5374250 +
gagtggacctctagcaaactcc

SEQ ID NO: 108764 - DNA, 22 bp, Artificial Sequence
  Synthetic oligonucleotide; CTC chr11 5374239 5374260 5374256 5374261 +
tagcaaactccaacagacctgc

SEQ ID NO: 108765 - DNA, 22 bp, Artificial Sequence
  Synthetic oligonucleotide; CTA chr11 5374241 5374262 5374258 5374263 +
gcaaactccaacagacctgcag

SEQ ID NO: 108766 - DNA, 22 bp, Artificial Sequence
  Synthetic oligonucleotide; CTC chr11 5374249 5374270 5374266 5374271 +
caacagacctgcagctgagggt

SEQ ID NO: 108767 - DNA, 22 bp, Artificial Sequence
  Synthetic oligonucleotide; CTG chr11 5374260 5374281 5374277 5374282 +
cagctgagggtcctgtctgtta

SEQ ID NO: 108768 - DNA, 22 bp, Artificial Sequence
  Synthetic oligonucleotide; CTG chr11 5374266 5374287 5374283 5374288 +
agggtcctgtctgttagaagga

SEQ ID NO: 108769 - DNA, 22 bp, Artificial Sequence
  Synthetic oligonucleotide; CTG chr11 5374275 5374296 5374292 5374297 +
tctgttagaaggaaaactaaca

SEQ ID NO: 108770 - DNA, 22 bp, Artificial Sequence
  Synthetic oligonucleotide; CTG chr11 5374279 5374300 5374296 5374301 +
ttagaaggaaaactaacaaaca

SEQ ID NO: 108771 - DNA, 22 bp, Artificial Sequence
  Synthetic oligonucleotide; TTA chr11 5374282 5374303 5374299 5374304 +
gaaggaaaactaacaaacagaa

SEQ ID NO: 108772 - DNA, 22 bp, Artificial Sequence
  Synthetic oligonucleotide; CTA chr11 5374294 5374315 5374311 5374316 +
acaaacagaaaggacatccaca

SEQ ID NO: 108773 - DNA, 22 bp, Artificial Sequence
  Synthetic oligonucleotide; CTA chr11 5374341 5374362 5374358 5374363 +
tcatcaaagaccaaaagtagat

SEQ ID NO: 108774 - DNA, 22 bp, Artificial Sequence
  Synthetic oligonucleotide; TTG chr11 5374378 5374399 5374395 5374400 +
gggaaaaaacagagcagaaaaa

SEQ ID NO: 108775 - DNA, 22 bp, Artificial Sequence
  Synthetic oligonucleotide; CTG chr11 5374403 5374424 5374420 5374425 +
gaaactctaaaaagcagagcac

SEQ ID NO: 108776 - DNA, 22 bp, Artificial Sequence
  Synthetic oligonucleotide; CTC chr11 5374410 5374431 5374427 5374432 +
taaaaagcagagcacctttcct

SEQ ID NO: 108777 - DNA, 22 bp, Artificial Sequence
  Synthetic oligonucleotide; CTA chr11 5374412 5374433 5374429 5374434 +
aaaagcagagcacctttcctcc

SEQ ID NO: 108778 - DNA, 22 bp, Artificial Sequence
  Synthetic oligonucleotide; CTT chr11 5374428 5374449 5374445 5374450 +
tcctcctccaaaggaaagcagt

SEQ ID NO: 108779 - DNA, 22 bp, Artificial Sequence
  Synthetic oligonucleotide; TTT chr11 5374429 5374450 5374446 5374451 +
cctcctccaaaggaaagcagtt

SEQ ID NO: 108780 - DNA, 22 bp, Artificial Sequence
  Synthetic oligonucleotide; TTC chr11 5374430 5374451 5374447 5374452 +
ctcctccaaaggaaagcagttc

SEQ ID NO: 108781 - DNA, 22 bp, Artificial Sequence
  Synthetic oligonucleotide; CTC chr11 5374433 5374454 5374450 5374455 +
ctccaaaggaaagcagttcctc

SEQ ID NO: 108782 - DNA, 22 bp, Artificial Sequence
  Synthetic oligonucleotide; CTC chr11 5374436 5374457 5374453 5374458 +
caaaggaaagcagttcctcacc

SEQ ID NO: 108783 - DNA, 22 bp, Artificial Sequence
  Synthetic oligonucleotide; TTC chr11 5374452 5374473 5374469 5374474 +
ctcaccagcaacggaacaaagc

SEQ ID NO: 108784 - DNA, 22 bp, Artificial Sequence
  Synthetic oligonucleotide; CTC chr11 5374455 5374476 5374472 5374477 +
accagcaacggaacaaagctgg

SEQ ID NO: 108785 - DNA, 22 bp, Artificial Sequence
  Synthetic oligonucleotide; CTG chr11 5374476 5374497 5374493 5374498 +
gatggagaatgactttgacgag

SEQ ID NO: 108786 - DNA, 22 bp, Artificial Sequence
  Synthetic oligonucleotide; CTT chr11 5374491 5374512 5374508 5374513 +
tgacgagctgagagaagaagac

SEQ ID NO: 108787 - DNA, 22 bp, Artificial Sequence
  Synthetic oligonucleotide; TTT chr11 5374492 5374513 5374509 5374514 +
gacgagctgagagaagaagact

SEQ ID NO: 108788 - DNA, 22 bp, Artificial Sequence
  Synthetic oligonucleotide; TTG chr11 5374493 5374514 5374510 5374515 +
acgagctgagagaagaagactt

SEQ ID NO: 108789 - DNA, 22 bp, Artificial Sequence
  Synthetic oligonucleotide; CTG chr11 5374501 5374522 5374518 5374523 +
agagaagaagacttcagacgat

SEQ ID NO: 108790 - DNA, 22 bp, Artificial Sequence
  Synthetic oligonucleotide; CTT chr11 5374515 5374536 5374532 5374537 +
cagacgatgaaactactccgag

SEQ ID NO: 108791 - DNA, 22 bp, Artificial Sequence
  Synthetic oligonucleotide; TTC chr11 5374516 5374537 5374533 5374538 +
agacgatgaaactactccgagc

SEQ ID NO: 108792 - DNA, 22 bp, Artificial Sequence
  Synthetic oligonucleotide; CTA chr11 5374530 5374551 5374547 5374552 +
ctccgagctacaggaggaaatt

SEQ ID NO: 108793 - DNA, 22 bp, Artificial Sequence
  Synthetic oligonucleotide; CTC chr11 5374533 5374554 5374550 5374555 +
cgagctacaggaggaaattcaa

SEQ ID NO: 108794 - DNA, 22 bp, Artificial Sequence
  Synthetic oligonucleotide; CTA chr11 5374540 5374561 5374557 5374562 +
caggaggaaattcaaaccaaag

SEQ ID NO: 108795 - DNA, 22 bp, Artificial Sequence
  Synthetic oligonucleotide; TTC chr11 5374553 5374574 5374570 5374575 +
aaaccaaaggcaaagaagataa

SEQ ID NO: 108796 - DNA, 22 bp, Artificial Sequence
  Synthetic oligonucleotide; CTT chr11 5374581 5374602 5374598 5374603 +
tgaaaaaaaatttagatgaatg

SEQ ID NO: 108797 - DNA, 22 bp, Artificial Sequence
  Synthetic oligonucleotide; TTT chr11 5374582 5374603 5374599 5374604 +
gaaaaaaaatttagatgaatgt

SEQ ID NO: 108798 - DNA, 22 bp, Artificial Sequence
  Synthetic oligonucleotide; TTG chr11 5374583 5374604 5374600 5374605 +
aaaaaaaatttagatgaatgta

SEQ ID NO: 108799 - DNA, 22 bp, Artificial Sequence
  Synthetic oligonucleotide; TTT chr11 5374594 5374615 5374611 5374616 +
agatgaatgtataactagaata

SEQ ID NO: 108800 - DNA, 22 bp, Artificial Sequence
  Synthetic oligonucleotide; TTA chr11 5374595 5374616 5374612 5374617 +
gatgaatgtataactagaataa

SEQ ID NO: 108801 - DNA, 22 bp, Artificial Sequence
  Synthetic oligonucleotide; CTA chr11 5374611 5374632 5374628 5374633 +
gaataaccaatacagagaagtg

SEQ ID NO: 108802 - DNA, 22 bp, Artificial Sequence
  Synthetic oligonucleotide; CTT chr11 5374636 5374657 5374653 5374658 +
aaaggagctgatggagctgaaa

SEQ ID NO: 108803 - DNA, 22 bp, Artificial Sequence
  Synthetic oligonucleotide; TTA chr11 5374637 5374658 5374654 5374659 +
aaggagctgatggagctgaaag

SEQ ID NO: 108804 - DNA, 22 bp, Artificial Sequence
  Synthetic oligonucleotide; CTG chr11 5374646 5374667 5374663 5374668 +
atggagctgaaagccaaggctc

SEQ ID NO: 108805 - DNA, 22 bp, Artificial Sequence
  Synthetic oligonucleotide; CTG chr11 5374655 5374676 5374672 5374677 +
aaagccaaggctcgagaatgac

SEQ ID NO: 108806 - DNA, 22 bp, Artificial Sequence
  Synthetic oligonucleotide; CTC chr11 5374668 5374689 5374685 5374690 +
gagaatgacgtgaagaatggag

SEQ ID NO: 108807 - DNA, 22 bp, Artificial Sequence
  Synthetic oligonucleotide; CTC chr11 5374697 5374718 5374714 5374719 +
aggagctgatgcgatcaactgg

SEQ ID NO: 108808 - DNA, 22 bp, Artificial Sequence
  Synthetic oligonucleotide; CTG chr11 5374705 5374726 5374722 5374727 +
atgcgatcaactggaagaaagg

SEQ ID NO: 108809 - DNA, 22 bp, Artificial Sequence
  Synthetic oligonucleotide; CTG chr11 5374718 5374739 5374735 5374740 +
gaagaaagggtatcagtgatgg

SEQ ID NO: 108810 - DNA, 22 bp, Artificial Sequence
  Synthetic oligonucleotide; TTT chr11 5374778 5374799 5374795 5374800 +
agagaaaaaagaataaaaagaa

SEQ ID NO: 108811 - DNA, 22 bp, Artificial Sequence
  Synthetic oligonucleotide; TTA chr11 5374779 5374800 5374796 5374801 +
gagaaaaaagaataaaaagaaa

SEQ ID NO: 108812 - DNA, 22 bp, Artificial Sequence
  Synthetic oligonucleotide; CTC chr11 5374814 5374835 5374831 5374836 +
caagaaatatgggactatgtga

SEQ ID NO: 108813 - DNA, 22 bp, Artificial Sequence
  Synthetic oligonucleotide; CTA chr11 5374831 5374852 5374848 5374853 +
tgtgaaaagatcaaatctaggt

SEQ ID NO: 108814 - DNA, 22 bp, Artificial Sequence
  Synthetic oligonucleotide; CTA chr11 5374850 5374871 5374867 5374872 +
ggtctgattggtgtacctgaaa

SEQ ID NO: 108815 - DNA, 22 bp, Artificial Sequence
  Synthetic oligonucleotide; CTG chr11 5374856 5374877 5374873 5374878 +
attggtgtacctgaaagtgacg

SEQ ID NO: 108816 - DNA, 22 bp, Artificial Sequence
  Synthetic oligonucleotide; TTG chr11 5374860 5374881 5374877 5374882 +
gtgtacctgaaagtgacgggga

SEQ ID NO: 108817 - DNA, 22 bp, Artificial Sequence
  Synthetic oligonucleotide; CTG chr11 5374869 5374890 5374886 5374891 +
aaagtgacggggagaatcgaac

SEQ ID NO: 108818 - DNA, 22 bp, Artificial Sequence
  Synthetic oligonucleotide; TTG chr11 5374898 5374919 5374915 5374920 +
gaaaacactctgcaggatatta

SEQ ID NO: 108819 - DNA, 22 bp, Artificial Sequence
  Synthetic oligonucleotide; CTC chr11 5374908 5374929 5374925 5374930 +
tgcaggatattatccaggagaa

SEQ ID NO: 108820 - DNA, 22 bp, Artificial Sequence
  Synthetic oligonucleotide; CTG chr11 5374910 5374931 5374927 5374932 +
caggatattatccaggagaact

SEQ ID NO: 108821 - DNA, 22 bp, Artificial Sequence
  Synthetic oligonucleotide; TTA chr11 5374920 5374941 5374937 5374942 +
tccaggagaacttccccaatct

SEQ ID NO: 108822 - DNA, 22 bp, Artificial Sequence
  Synthetic oligonucleotide; CTT chr11 5374933 5374954 5374950 5374955 +
ccccaatctagcaaggcaggcc

SEQ ID NO: 108823 - DNA, 22 bp, Artificial Sequence
  Synthetic oligonucleotide; TTC chr11 5374934 5374955 5374951 5374956 +
cccaatctagcaaggcaggcca

SEQ ID NO: 108824 - DNA, 22 bp, Artificial Sequence
  Synthetic oligonucleotide; CTA chr11 5374943 5374964 5374960 5374965 +
gcaaggcaggccaacattcaga

SEQ ID NO: 108825 - DNA, 22 bp, Artificial Sequence
  Synthetic oligonucleotide; TTC chr11 5374962 5374983 5374979 5374984 +
agattcaggaaatacagagaac

SEQ ID NO: 108826 - DNA, 22 bp, Artificial Sequence
  Synthetic oligonucleotide; TTC chr11 5374968 5374989 5374985 5374990 +
aggaaatacagagaacgccaca

SEQ ID NO: 108827 - DNA, 22 bp, Artificial Sequence
  Synthetic oligonucleotide; CTC chr11 5374999 5375020 5375016 5375021 +
ctcgagaagagcaactccaaga

SEQ ID NO: 108828 - DNA, 22 bp, Artificial Sequence
  Synthetic oligonucleotide; CTC chr11 5375002 5375023 5375019 5375024 +
gagaagagcaactccaagacac

SEQ ID NO: 108829 - DNA, 22 bp, Artificial Sequence
  Synthetic oligonucleotide; CTC chr11 5375016 5375037 5375033 5375038 +
caagacacataattgtcagatt

SEQ ID NO: 108830 - DNA, 22 bp, Artificial Sequence
  Synthetic oligonucleotide; TTG chr11 5375031 5375052 5375048 5375053 +
tcagattcaccaaagttgaaat

SEQ ID NO: 108831 - DNA, 22 bp, Artificial Sequence
  Synthetic oligonucleotide; TTC chr11 5375039 5375060 5375056 5375061 +
accaaagttgaaatgaaggaaa

SEQ ID NO: 108832 - DNA, 22 bp, Artificial Sequence
  Synthetic oligonucleotide; TTG chr11 5375049 5375070 5375066 5375071 +
aaatgaaggaaaaaatgttaag

SEQ ID NO: 108833 - DNA, 22 bp, Artificial Sequence
  Synthetic oligonucleotide; TTA chr11 5375069 5375090 5375086 5375091 +
agggcagccagagagaaaggtc

SEQ ID NO: 108834 - DNA, 22 bp, Artificial Sequence
  Synthetic oligonucleotide; TTA chr11 5375097 5375118 5375114 5375119 +
cccacaaagggaagcccatcag

SEQ ID NO: 108835 - DNA, 22 bp, Artificial Sequence
  Synthetic oligonucleotide; CTA chr11 5375123 5375144 5375140 5375145 +
acagcagctctcttggcagaaa

SEQ ID NO: 108836 - DNA, 22 bp, Artificial Sequence
  Synthetic oligonucleotide; CTC chr11 5375133 5375154 5375150 5375155 +
tcttggcagaaactctacaagc

SEQ ID NO: 108837 - DNA, 22 bp, Artificial Sequence
  Synthetic oligonucleotide; CTC chr11 5375135 5375156 5375152 5375157 +
ttggcagaaactctacaagcca

SEQ ID NO: 108838 - DNA, 22 bp, Artificial Sequence
  Synthetic oligonucleotide; CTT chr11 5375137 5375158 5375154 5375159 +
ggcagaaactctacaagccaga

SEQ ID NO: 108839 - DNA, 22 bp, Artificial Sequence
  Synthetic oligonucleotide; TTG chr11 5375138 5375159 5375155 5375160 +
gcagaaactctacaagccagaa

SEQ ID NO: 108840 - DNA, 22 bp, Artificial Sequence
  Synthetic oligonucleotide; CTC chr11 5375148 5375169 5375165 5375170 +
tacaagccagaagagagtgggg

SEQ ID NO: 108841 - DNA, 22 bp, Artificial Sequence
  Synthetic oligonucleotide; CTA chr11 5375150 5375171 5375167 5375172 +
caagccagaagagagtgggggc

SEQ ID NO: 108842 - DNA, 22 bp, Artificial Sequence
  Synthetic oligonucleotide; TTC chr11 5375180 5375201 5375197 5375202 +
aacatccttaaaggaaagaatt

SEQ ID NO: 108843 - DNA, 22 bp, Artificial Sequence
  Synthetic oligonucleotide; CTT chr11 5375189 5375210 5375206 5375211 +
aaaggaaagaattttcaacaca

SEQ ID NO: 108844 - DNA, 22 bp, Artificial Sequence
  Synthetic oligonucleotide; TTA chr11 5375190 5375211 5375207 5375212 +
aaggaaagaattttcaacacag

SEQ ID NO: 108845 - DNA, 22 bp, Artificial Sequence
  Synthetic oligonucleotide; TTT chr11 5375203 5375224 5375220 5375225 +
tcaacacagaatttaatatcca

SEQ ID NO: 108846 - DNA, 22 bp, Artificial Sequence
  Synthetic oligonucleotide; TTT chr11 5375204 5375225 5375221 5375226 +
caacacagaatttaatatccag

SEQ ID NO: 108847 - DNA, 22 bp, Artificial Sequence
  Synthetic oligonucleotide; TTC chr11 5375205 5375226 5375222 5375227 +
aacacagaatttaatatccagc

SEQ ID NO: 108848 - DNA, 22 bp, Artificial Sequence
  Synthetic oligonucleotide; TTT chr11 5375217 5375238 5375234 5375239 +
aatatccagccaaactaagctt

SEQ ID NO: 108849 - DNA, 22 bp, Artificial Sequence
  Synthetic oligonucleotide; TTA chr11 5375218 5375239 5375235 5375240 +
atatccagccaaactaagcttc

SEQ ID NO: 108850 - DNA, 22 bp, Artificial Sequence
  Synthetic oligonucleotide; CTA chr11 5375234 5375255 5375251 5375256 +
agcttcataagtgaaggagaaa

SEQ ID NO: 108851 - DNA, 22 bp, Artificial Sequence
  Synthetic oligonucleotide; CTT chr11 5375239 5375260 5375256 5375261 +
cataagtgaaggagaaataaaa

SEQ ID NO: 108852 - DNA, 22 bp, Artificial Sequence
  Synthetic oligonucleotide; TTC chr11 5375240 5375261 5375257 5375262 +
ataagtgaaggagaaataaaat

SEQ ID NO: 108853 - DNA, 22 bp, Artificial Sequence
  Synthetic oligonucleotide; CTT chr11 5375266 5375287 5375283 5375288 +
tacagacaagcaaatgctgaga

SEQ ID NO: 108854 - DNA, 22 bp, Artificial Sequence
  Synthetic oligonucleotide; TTT chr11 5375267 5375288 5375284 5375289 +
acagacaagcaaatgctgagag

SEQ ID NO: 108855 - DNA, 22 bp, Artificial Sequence
  Synthetic oligonucleotide; TTA chr11 5375268 5375289 5375285 5375290 +
cagacaagcaaatgctgagaga

SEQ ID NO: 108856 - DNA, 22 bp, Artificial Sequence
  Synthetic oligonucleotide; CTG chr11 5375285 5375306 5375302 5375307 +
agagattttgtcatcaccaggc

SEQ ID NO: 108857 - DNA, 22 bp, Artificial Sequence
  Synthetic oligonucleotide; TTT chr11 5375293 5375314 5375310 5375315 +
tgtcatcaccaggcctgaccta

SEQ ID NO: 108858 - DNA, 22 bp, Artificial Sequence
  Synthetic oligonucleotide; TTT chr11 5375294 5375315 5375311 5375316 +
gtcatcaccaggcctgacctaa

SEQ ID NO: 108859 - DNA, 22 bp, Artificial Sequence
  Synthetic oligonucleotide; TTG chr11 5375295 5375316 5375312 5375317 +
tcatcaccaggcctgacctaaa

SEQ ID NO: 108860 - DNA, 22 bp, Artificial Sequence
  Synthetic oligonucleotide; CTG chr11 5375310 5375331 5375327 5375332 +
acctaaaagagctcctgaagga

SEQ ID NO: 108861 - DNA, 22 bp, Artificial Sequence
  Synthetic oligonucleotide; CTA chr11 5375315 5375336 5375332 5375337 +
aaagagctcctgaaggaagcac

SEQ ID NO: 108862 - DNA, 22 bp, Artificial Sequence
  Synthetic oligonucleotide; CTC chr11 5375324 5375345 5375341 5375346 +
ctgaaggaagcactaaacatgg

SEQ ID NO: 108863 - DNA, 22 bp, Artificial Sequence
  Synthetic oligonucleotide; CTG chr11 5375327 5375348 5375344 5375349 +
aaggaagcactaaacatggaaa

SEQ ID NO: 108864 - DNA, 22 bp, Artificial Sequence
  Synthetic oligonucleotide; CTA chr11 5375339 5375360 5375356 5375361 +
aacatggaaaggcacaaccggt

SEQ ID NO: 108865 - DNA, 22 bp, Artificial Sequence
  Synthetic oligonucleotide; CTG chr11 5375372 5375393 5375389 5375394 +
caaaatcaggccaaaatgtgaa

SEQ ID NO: 108866 - DNA, 22 bp, Artificial Sequence
  Synthetic oligonucleotide; CTA chr11 5375408 5375429 5375425 5375430 +
ggaagaaactgcatcaactaac

SEQ ID NO: 108867 - DNA, 22 bp, Artificial Sequence
  Synthetic oligonucleotide; CTG chr11 5375419 5375440 5375436 5375441 +
catcaactaacgagcaaaataa

SEQ ID NO: 108868 - DNA, 22 bp, Artificial Sequence
  Synthetic oligonucleotide; CTA chr11 5375428 5375449 5375445 5375450 +
acgagcaaaataaccagctatc

SEQ ID NO: 108869 - DNA, 22 bp, Artificial Sequence
  Synthetic oligonucleotide; CTA chr11 5375448 5375469 5375465 5375470 +
tcataatgacaggatcaaattc

SEQ ID NO: 108870 - DNA, 22 bp, Artificial Sequence
  Synthetic oligonucleotide; TTC chr11 5375470 5375491 5375487 5375492 +
acacatacaatattaactttaa

SEQ ID NO: 108871 - DNA, 22 bp, Artificial Sequence
  Synthetic oligonucleotide; TTA chr11 5375485 5375506 5375502 5375507 +
actttaaatgtaaatggactaa

SEQ ID NO: 108872 - DNA, 22 bp, Artificial Sequence
  Synthetic oligonucleotide; CTT chr11 5375489 5375510 5375506 5375511 +
taaatgtaaatggactaagtgc

SEQ ID NO: 108873 - DNA, 22 bp, Artificial Sequence
  Synthetic oligonucleotide; TTT chr11 5375490 5375511 5375507 5375512 +
aaatgtaaatggactaagtgct

SEQ ID NO: 108874 - DNA, 22 bp, Artificial Sequence
  Synthetic oligonucleotide; TTA chr11 5375491 5375512 5375508 5375513 +
aatgtaaatggactaagtgctc

SEQ ID NO: 108875 - DNA, 22 bp, Artificial Sequence
  Synthetic oligonucleotide; CTA chr11 5375506 5375527 5375523 5375528 +
agtgctccaattgaaagacaca

SEQ ID NO: 108876 - DNA, 22 bp, Artificial Sequence
  Synthetic oligonucleotide; CTC chr11 5375513 5375534 5375530 5375535 +
caattgaaagacacagactggc

SEQ ID NO: 108877 - DNA, 22 bp, Artificial Sequence
  Synthetic oligonucleotide; TTG chr11 5375519 5375540 5375536 5375541 +
aaagacacagactggcaaattg

SEQ ID NO: 108878 - DNA, 22 bp, Artificial Sequence
  Synthetic oligonucleotide; CTG chr11 5375533 5375554 5375550 5375555 +
gcaaattggataaagagtgtat

SEQ ID NO: 108879 - DNA, 22 bp, Artificial Sequence
  Synthetic oligonucleotide; TTG chr11 5375541 5375562 5375558 5375563 +
gataaagagtgtattcaggaaa

SEQ ID NO: 108880 - DNA, 22 bp, Artificial Sequence
  Synthetic oligonucleotide; TTC chr11 5375557 5375578 5375574 5375579 +
aggaaacccatctcatgtgcac

SEQ ID NO: 108881 - DNA, 22 bp, Artificial Sequence
  Synthetic oligonucleotide; CTC chr11 5375571 5375592 5375588 5375593 +
atgtgcacacacacacataggc

SEQ ID NO: 108882 - DNA, 22 bp, Artificial Sequence
  Synthetic oligonucleotide; CTC chr11 5375595 5375616 5375612 5375617 +
aaaataaaaggatggaggaaga

SEQ ID NO: 108883 - DNA, 22 bp, Artificial Sequence
  Synthetic oligonucleotide; CTA chr11 5375621 5375642 5375638 5375643 +
ccaagcaaatggaaaacaaaaa

SEQ ID NO: 108884 - DNA, 22 bp, Artificial Sequence
  Synthetic oligonucleotide; TTG chr11 5375656 5375677 5375673 5375678 +
caatcctagtctctgataaaac

SEQ ID NO: 108885 - DNA, 22 bp, Artificial Sequence
  Synthetic oligonucleotide; CTA chr11 5375664 5375685 5375681 5375686 +
gtctctgataaaacaggcttta

SEQ ID NO: 108886 - DNA, 22 bp, Artificial Sequence
  Synthetic oligonucleotide; CTC chr11 5375669 5375690 5375686 5375691 +
tgataaaacaggctttaaacca

SEQ ID NO: 108887 - DNA, 22 bp, Artificial Sequence
  Synthetic oligonucleotide; CTG chr11 5375671 5375692 5375688 5375693 +
ataaaacaggctttaaaccaac

SEQ ID NO: 108888 - DNA, 22 bp, Artificial Sequence
  Synthetic oligonucleotide; CTT chr11 5375684 5375705 5375701 5375706 +
taaaccaacaaagatcaaaaga

SEQ ID NO: 108889 - DNA, 22 bp, Artificial Sequence
  Synthetic oligonucleotide; TTT chr11 5375685 5375706 5375702 5375707 +
aaaccaacaaagatcaaaagag

SEQ ID NO: 108890 - DNA, 22 bp, Artificial Sequence
  Synthetic oligonucleotide; TTA chr11 5375686 5375707 5375703 5375708 +
aaccaacaaagatcaaaagaga

SEQ ID NO: 108891 - DNA, 22 bp, Artificial Sequence
  Synthetic oligonucleotide; TTA chr11 5375723 5375744 5375740 5375745 +
cataatggtaaagggatcaatt

SEQ ID NO: 108892 - DNA, 22 bp, Artificial Sequence
  Synthetic oligonucleotide; TTC chr11 5375746 5375767 5375763 5375768 +
aacaagaagagctaactatcct

SEQ ID NO: 108893 - DNA, 22 bp, Artificial Sequence
  Synthetic oligonucleotide; CTA chr11 5375760 5375781 5375777 5375782 +
actatcctaaatatatatgcac

SEQ ID NO: 108894 - DNA, 22 bp, Artificial Sequence
  Synthetic oligonucleotide; CTA chr11 5375764 5375785 5375781 5375786 +
tcctaaatatatatgcacccaa

SEQ ID NO: 108895 - DNA, 22 bp, Artificial Sequence
  Synthetic oligonucleotide; CTA chr11 5375769 5375790 5375786 5375791 +
aatatatatgcacccaatacag

SEQ ID NO: 108896 - DNA, 22 bp, Artificial Sequence
  Synthetic oligonucleotide; TTC chr11 5375805 5375826 5375822 5375827 +
ataaagcaagtccttagagacc

SEQ ID NO: 108897 - DNA, 22 bp, Artificial Sequence
  Synthetic oligonucleotide; CTT chr11 5375820 5375841 5375837 5375842 +
agagacctacaaagagacttag

SEQ ID NO: 108898 - DNA, 22 bp, Artificial Sequence
  Synthetic oligonucleotide; TTA chr11 5375821 5375842 5375838 5375843 +
gagacctacaaagagacttaga

SEQ ID NO: 108899 - DNA, 22 bp, Artificial Sequence
  Synthetic oligonucleotide; CTA chr11 5375829 5375850 5375846 5375851 +
caaagagacttagactcccaca

SEQ ID NO: 108900 - DNA, 22 bp, Artificial Sequence
  Synthetic oligonucleotide; CTT chr11 5375840 5375861 5375857 5375862 +
agactcccacactttaataatg

SEQ ID NO: 108901 - DNA, 22 bp, Artificial Sequence
  Synthetic oligonucleotide; TTA chr11 5375841 5375862 5375858 5375863 +
gactcccacactttaataatgg

SEQ ID NO: 108902 - DNA, 22 bp, Artificial Sequence
  Synthetic oligonucleotide; CTC chr11 5375846 5375867 5375863 5375868 +
ccacactttaataatgggagac

SEQ ID NO: 108903 - DNA, 22 bp, Artificial Sequence
  Synthetic oligonucleotide; CTT chr11 5375854 5375875 5375871 5375876 +
taataatgggagactttaatac

SEQ ID NO: 108904 - DNA, 22 bp, Artificial Sequence
  Synthetic oligonucleotide; TTT chr11 5375855 5375876 5375872 5375877 +
aataatgggagactttaatacc

SEQ ID NO: 108905 - DNA, 22 bp, Artificial Sequence
  Synthetic oligonucleotide; TTA chr11 5375856 5375877 5375873 5375878 +
ataatgggagactttaataccc

SEQ ID NO: 108906 - DNA, 22 bp, Artificial Sequence
  Synthetic oligonucleotide; CTT chr11 5375870 5375891 5375887 5375892 +
taataccccactgtcaacatta

SEQ ID NO: 108907 - DNA, 22 bp, Artificial Sequence
  Synthetic oligonucleotide; TTT chr11 5375871 5375892 5375888 5375893 +
aataccccactgtcaacattag

SEQ ID NO: 108908 - DNA, 22 bp, Artificial Sequence
  Synthetic oligonucleotide; TTA chr11 5375872 5375893 5375889 5375894 +
ataccccactgtcaacattaga

SEQ ID NO: 108909 - DNA, 22 bp, Artificial Sequence
  Synthetic oligonucleotide; CTG chr11 5375883 5375904 5375900 5375905 +
tcaacattagacagatcaacga

SEQ ID NO: 108910 - DNA, 22 bp, Artificial Sequence
  Synthetic oligonucleotide; TTA chr11 5375892 5375913 5375909 5375914 +
gacagatcaacgagacagaaag

SEQ ID NO: 108911 - DNA, 22 bp, Artificial Sequence
  Synthetic oligonucleotide; TTA chr11 5375917 5375938 5375934 5375939 +
acaaggatatccaggaattgaa

SEQ ID NO: 108912 - DNA, 22 bp, Artificial Sequence
  Synthetic oligonucleotide; TTG chr11 5375937 5375958 5375954 5375959 +
aacacagctctgcaccaagcag

SEQ ID NO: 108913 - DNA, 22 bp, Artificial Sequence
  Synthetic oligonucleotide; CTC chr11 5375947 5375968 5375964 5375969 +
tgcaccaagcagacctaataga

SEQ ID NO: 108914 - DNA, 22 bp, Artificial Sequence
  Synthetic oligonucleotide; CTG chr11 5375949 5375970 5375966 5375971 +
caccaagcagacctaatagaca

SEQ ID NO: 108915 - DNA, 22 bp, Artificial Sequence
  Synthetic oligonucleotide; CTA chr11 5375964 5375985 5375981 5375986 +
atagacatctacagaactctcc

SEQ ID NO: 108916 - DNA, 22 bp, Artificial Sequence
  Synthetic oligonucleotide; CTA chr11 5375975 5375996 5375992 5375997 +
cagaactctccaccccaaatca

SEQ ID NO: 108917 - DNA, 22 bp, Artificial Sequence
  Synthetic oligonucleotide; CTC chr11 5375983 5376004 5376000 5376005 +
tccaccccaaatcaacagaata

SEQ ID NO: 108918 - DNA, 22 bp, Artificial Sequence
  Synthetic oligonucleotide; CTC chr11 5375985 5376006 5376002 5376007 +
caccccaaatcaacagaatata

SEQ ID NO: 108919 - DNA, 22 bp, Artificial Sequence
  Synthetic oligonucleotide; TTT chr11 5376012 5376033 5376029 5376034 +
tttttcagcaccacacaacacc

SEQ ID NO: 108920 - DNA, 22 bp, Artificial Sequence
  Synthetic oligonucleotide; TTT chr11 5376013 5376034 5376030 5376035 +
ttttcagcaccacacaacacct

SEQ ID NO: 108921 - DNA, 22 bp, Artificial Sequence
  Synthetic oligonucleotide; TTT chr11 5376014 5376035 5376031 5376036 +
tttcagcaccacacaacaccta

SEQ ID NO: 108922 - DNA, 22 bp, Artificial Sequence
  Synthetic oligonucleotide; TTT chr11 5376015 5376036 5376032 5376037 +
ttcagcaccacacaacacctat

SEQ ID NO: 108923 - DNA, 22 bp, Artificial Sequence
  Synthetic oligonucleotide; TTT chr11 5376016 5376037 5376033 5376038 +
tcagcaccacacaacacctatt

SEQ ID NO: 108924 - DNA, 22 bp, Artificial Sequence
  Synthetic oligonucleotide; TTT chr11 5376017 5376038 5376034 5376039 +
cagcaccacacaacacctattc

SEQ ID NO: 108925 - DNA, 22 bp, Artificial Sequence
  Synthetic oligonucleotide; TTC chr11 5376018 5376039 5376035 5376040 +
agcaccacacaacacctattcc

SEQ ID NO: 108926 - DNA, 22 bp, Artificial Sequence
  Synthetic oligonucleotide; CTA chr11 5376036 5376057 5376053 5376058 +
ttccaaaattgaccacatactt

SEQ ID NO: 108927 - DNA, 22 bp, Artificial Sequence
  Synthetic oligonucleotide; TTC chr11 5376039 5376060 5376056 5376061 +
caaaattgaccacatacttgga

SEQ ID NO: 108928 - DNA, 22 bp, Artificial Sequence
  Synthetic oligonucleotide; TTG chr11 5376047 5376068 5376064 5376069 +
accacatacttggaagtaaagc

SEQ ID NO: 108929 - DNA, 22 bp, Artificial Sequence
  Synthetic oligonucleotide; CTT chr11 5376058 5376079 5376075 5376080 +
ggaagtaaagctctcctcagca

SEQ ID NO: 108930 - DNA, 22 bp, Artificial Sequence
  Synthetic oligonucleotide; TTG chr11 5376059 5376080 5376076 5376081 +
gaagtaaagctctcctcagcaa

SEQ ID NO: 108931 - DNA, 22 bp, Artificial Sequence
  Synthetic oligonucleotide; CTC chr11 5376071 5376092 5376088 5376093 +
tcctcagcaaatataaaagaac

SEQ ID NO: 108932 - DNA, 22 bp, Artificial Sequence
  Synthetic oligonucleotide; CTC chr11 5376073 5376094 5376090 5376095 +
ctcagcaaatataaaagaacag

SEQ ID NO: 108933 - DNA, 22 bp, Artificial Sequence
  Synthetic oligonucleotide; CTC chr11 5376076 5376097 5376093 5376098 +
agcaaatataaaagaacagaaa

SEQ ID NO: 108934 - DNA, 22 bp, Artificial Sequence
  Synthetic oligonucleotide; TTA chr11 5376101 5376122 5376118 5376123 +
taacaaactgtctctcagacca

SEQ ID NO: 108935 - DNA, 22 bp, Artificial Sequence
  Synthetic oligonucleotide; CTG chr11 5376111 5376132 5376128 5376133 +
tctctcagaccacagtgcaatc

SEQ ID NO: 108936 - DNA, 22 bp, Artificial Sequence
  Synthetic oligonucleotide; CTC chr11 5376115 5376136 5376132 5376137 +
tcagaccacagtgcaatcaaac

SEQ ID NO: 108937 - DNA, 22 bp, Artificial Sequence
  Synthetic oligonucleotide; CTC chr11 5376117 5376138 5376134 5376139 +
agaccacagtgcaatcaaacta

SEQ ID NO: 108938 - DNA, 22 bp, Artificial Sequence
  Synthetic oligonucleotide; CTA chr11 5376139 5376160 5376156 5376161 +
gaactcaggattaagaaactca

SEQ ID NO: 108939 - DNA, 22 bp, Artificial Sequence
  Synthetic oligonucleotide; CTC chr11 5376145 5376166 5376162 5376167 +
aggattaagaaactcactcaaa

SEQ ID NO: 108940 - DNA, 22 bp, Artificial Sequence
  Synthetic oligonucleotide; TTA chr11 5376152 5376173 5376169 5376174 +
agaaactcactcaaaaccactc

SEQ ID NO: 108941 - DNA, 22 bp, Artificial Sequence
  Synthetic oligonucleotide; CTC chr11 5376160 5376181 5376177 5376182 +
actcaaaaccactcaactacat

SEQ ID NO: 108942 - DNA, 22 bp, Artificial Sequence
  Synthetic oligonucleotide; CTC chr11 5376164 5376185 5376181 5376186 +
aaaaccactcaactacatggaa

SEQ ID NO: 108943 - DNA, 22 bp, Artificial Sequence
  Synthetic oligonucleotide; CTC chr11 5376174 5376195 5376191 5376196 +
aactacatggaaactgaacaac

SEQ ID NO: 108944 - DNA, 22 bp, Artificial Sequence
  Synthetic oligonucleotide; CTA chr11 5376179 5376200 5376196 5376201 +
catggaaactgaacaacctgct

SEQ ID NO: 108945 - DNA, 22 bp, Artificial Sequence
  Synthetic oligonucleotide; CTG chr11 5376190 5376211 5376207 5376212 +
aacaacctgctcctgaatgact

SEQ ID NO: 108946 - DNA, 22 bp, Artificial Sequence
  Synthetic oligonucleotide; CTG chr11 5376199 5376220 5376216 5376221 +
ctcctgaatgactactgggtac

SEQ ID NO: 108947 - DNA, 22 bp, Artificial Sequence
  Synthetic oligonucleotide; CTC chr11 5376202 5376223 5376219 5376224 +
ctgaatgactactgggtacata

SEQ ID NO: 108948 - DNA, 22 bp, Artificial Sequence
  Synthetic oligonucleotide; CTG chr11 5376205 5376226 5376222 5376227 +
aatgactactgggtacataacg

SEQ ID NO: 108949 - DNA, 22 bp, Artificial Sequence
  Synthetic oligonucleotide; CTA chr11 5376213 5376234 5376230 5376235 +
ctgggtacataacgaaatgaag

SEQ ID NO: 108950 - DNA, 22 bp, Artificial Sequence
  Synthetic oligonucleotide; CTG chr11 5376216 5376237 5376233 5376238 +
ggtacataacgaaatgaaggca

SEQ ID NO: 108951 - DNA, 22 bp, Artificial Sequence
  Synthetic oligonucleotide; TTC chr11 5376253 5376274 5376270 5376275 +
tttgaaaccaatgagaacaaag

SEQ ID NO: 108952 - DNA, 22 bp, Artificial Sequence
  Synthetic oligonucleotide; CTT chr11 5376255 5376276 5376272 5376277 +
tgaaaccaatgagaacaaagac

SEQ ID NO: 108953 - DNA, 22 bp, Artificial Sequence
  Synthetic oligonucleotide; TTT chr11 5376256 5376277 5376273 5376278 +
gaaaccaatgagaacaaagaca

SEQ ID NO: 108954 - DNA, 22 bp, Artificial Sequence
  Synthetic oligonucleotide; TTG chr11 5376257 5376278 5376274 5376279 +
aaaccaatgagaacaaagacac

SEQ ID NO: 108955 - DNA, 22 bp, Artificial Sequence
  Synthetic oligonucleotide; CTC chr11 5376295 5376316 5376312 5376317 +
tgggacacattcgaatcagtgt

SEQ ID NO: 108956 - DNA, 22 bp, Artificial Sequence
  Synthetic oligonucleotide; CTG chr11 5376297 5376318 5376314 5376319 +
ggacacattcgaatcagtgtgt

SEQ ID NO: 108957 - DNA, 22 bp, Artificial Sequence
  Synthetic oligonucleotide; TTC chr11 5376307 5376328 5376324 5376329 +
gaatcagtgtgtagggggaaat

SEQ ID NO: 108958 - DNA, 22 bp, Artificial Sequence
  Synthetic oligonucleotide; TTT chr11 5376331 5376352 5376348 5376353 +
atagcactaaacgcccacaaga

SEQ ID NO: 108959 - DNA, 22 bp, Artificial Sequence
  Synthetic oligonucleotide; TTA chr11 5376332 5376353 5376349 5376354 +
tagcactaaacgcccacaagag

SEQ ID NO: 108960 - DNA, 22 bp, Artificial Sequence
  Synthetic oligonucleotide; CTA chr11 5376340 5376361 5376357 5376362 +
aacgcccacaagagaaagcaag

SEQ ID NO: 108961 - DNA, 22 bp, Artificial Sequence
  Synthetic oligonucleotide; TTG chr11 5376377 5376398 5376394 5376399 +
acaccctaacatcacaattaaa

SEQ ID NO: 108962 - DNA, 22 bp, Artificial Sequence
  Synthetic oligonucleotide; CTA chr11 5376385 5376406 5376402 5376407 +
acatcacaattaaaagaactag

SEQ ID NO: 108963 - DNA, 22 bp, Artificial Sequence
  Synthetic oligonucleotide; TTA chr11 5376397 5376418 5376414 5376419 +
aaagaactagataagcaagagc

SEQ ID NO: 108964 - DNA, 22 bp, Artificial Sequence
  Synthetic oligonucleotide; CTA chr11 5376406 5376427 5376423 5376428 +
gataagcaagagcaaacacatt

SEQ ID NO: 108965 - DNA, 22 bp, Artificial Sequence
  Synthetic oligonucleotide; TTC chr11 5376429 5376450 5376446 5376451 +
aaaagctagcagaagtcaagaa

SEQ ID NO: 108966 - DNA, 22 bp, Artificial Sequence
  Synthetic oligonucleotide; CTA chr11 5376437 5376458 5376454 5376459 +
gcagaagtcaagaaataactaa

SEQ ID NO: 108967 - DNA, 22 bp, Artificial Sequence
  Synthetic oligonucleotide; CTA chr11 5376458 5376479 5376475 5376480 +
aaatcagagcagaactgaagga

SEQ ID NO: 108968 - DNA, 22 bp, Artificial Sequence
  Synthetic oligonucleotide; CTG chr11 5376475 5376496 5376492 5376497 +
aaggaaacagagacacaaaaaa

SEQ ID NO: 108969 - DNA, 22 bp, Artificial Sequence
  Synthetic oligonucleotide; CTT chr11 5376502 5376523 5376519 5376524 +
caaaaaattaatgaatctggga

SEQ ID NO: 108970 - DNA, 22 bp, Artificial Sequence
  Synthetic oligonucleotide; TTC chr11 5376503 5376524 5376520 5376525 +
aaaaaattaatgaatctgggag

SEQ ID NO: 108971 - DNA, 22 bp, Artificial Sequence
  Synthetic oligonucleotide; TTA chr11 5376512 5376533 5376529 5376534 +
atgaatctgggagctggttttt

SEQ ID NO: 108972 - DNA, 22 bp, Artificial Sequence
  Synthetic oligonucleotide; CTG chr11 5376521 5376542 5376538 5376543 +
ggagctggttttttgaaaggat

SEQ ID NO: 108973 - DNA, 22 bp, Artificial Sequence
  Synthetic oligonucleotide; CTG chr11 5376528 5376549 5376545 5376550 +
gttttttgaaaggatcaacaaa

SEQ ID NO: 108974 - DNA, 22 bp, Artificial Sequence
  Synthetic oligonucleotide; TTT chr11 5376532 5376553 5376549 5376554 +
tttgaaaggatcaacaaaactg

SEQ ID NO: 108975 - DNA, 22 bp, Artificial Sequence
  Synthetic oligonucleotide; TTT chr11 5376533 5376554 5376550 5376555 +
ttgaaaggatcaacaaaactga

SEQ ID NO: 108976 - DNA, 22 bp, Artificial Sequence
  Synthetic oligonucleotide; TTT chr11 5376534 5376555 5376551 5376556 +
tgaaaggatcaacaaaactgat

SEQ ID NO: 108977 - DNA, 22 bp, Artificial Sequence
  Synthetic oligonucleotide; TTT chr11 5376535 5376556 5376552 5376557 +
gaaaggatcaacaaaactgata

SEQ ID NO: 108978 - DNA, 22 bp, Artificial Sequence
  Synthetic oligonucleotide; TTG chr11 5376536 5376557 5376553 5376558 +
aaaggatcaacaaaactgatag

SEQ ID NO: 108979 - DNA, 22 bp, Artificial Sequence
  Synthetic oligonucleotide; CTG chr11 5376554 5376575 5376571 5376576 +
atagaccgctagcaagactaat

SEQ ID NO: 108980 - DNA, 22 bp, Artificial Sequence
  Synthetic oligonucleotide; CTA chr11 5376565 5376586 5376582 5376587 +
gcaagactaataagaaaagaga

SEQ ID NO: 108981 - DNA, 22 bp, Artificial Sequence
  Synthetic oligonucleotide; CTA chr11 5376574 5376595 5376591 5376596 +
ataagaaaagagagaagaatca

SEQ ID NO: 108982 - DNA, 22 bp, Artificial Sequence
  Synthetic oligonucleotide; CTG chr11 5376659 5376680 5376676 5376681 +
ccatcagagaatactacaaaca

SEQ ID NO: 108983 - DNA, 22 bp, Artificial Sequence
  Synthetic oligonucleotide; CTA chr11 5376675 5376696 5376692 5376697 +
caaacacctctacgcaaataaa

SEQ ID NO: 108984 - DNA, 22 bp, Artificial Sequence
  Synthetic oligonucleotide; CTC chr11 5376685 5376706 5376702 5376707 +
tacgcaaataaactagaaaatc

SEQ ID NO: 108985 - DNA, 22 bp, Artificial Sequence
  Synthetic oligonucleotide; CTA chr11 5376687 5376708 5376704 5376709 +
cgcaaataaactagaaaatcta

SEQ ID NO: 108986 - DNA, 22 bp, Artificial Sequence
  Synthetic oligonucleotide; CTA chr11 5376700 5376721 5376717 5376722 +
gaaaatctagaagaaatggata

SEQ ID NO: 108987 - DNA, 22 bp, Artificial Sequence
  Synthetic oligonucleotide; CTA chr11 5376709 5376730 5376726 5376731 +
gaagaaatggataaattcctgg

SEQ ID NO: 108988 - DNA, 22 bp, Artificial Sequence
  Synthetic oligonucleotide; TTC chr11 5376727 5376748 5376744 5376749 +
ctggacacatacactatcccaa

SEQ ID NO: 108989 - DNA, 22 bp, Artificial Sequence
  Synthetic oligonucleotide; CTG chr11 5376730 5376751 5376747 5376752 +
gacacatacactatcccaagac

SEQ ID NO: 108990 - DNA, 22 bp, Artificial Sequence
  Synthetic oligonucleotide; CTA chr11 5376743 5376764 5376760 5376765 +
tcccaagactaaaccaggaaga

SEQ ID NO: 108991 - DNA, 22 bp, Artificial Sequence
  Synthetic oligonucleotide; CTA chr11 5376754 5376775 5376771 5376776 +
aaccaggaagaagttgaatctc

SEQ ID NO: 108992 - DNA, 22 bp, Artificial Sequence
  Synthetic oligonucleotide; TTG chr11 5376770 5376791 5376787 5376792 +
aatctctgaatagaccaataac

SEQ ID NO: 108993 - DNA, 22 bp, Artificial Sequence
  Synthetic oligonucleotide; CTC chr11 5376776 5376797 5376793 5376798 +
tgaatagaccaataacaggatc

SEQ ID NO: 108994 - DNA, 22 bp, Artificial Sequence
  Synthetic oligonucleotide; CTG chr11 5376778 5376799 5376795 5376800 +
aatagaccaataacaggatctg

SEQ ID NO: 108995 - DNA, 22 bp, Artificial Sequence
  Synthetic oligonucleotide; CTG chr11 5376800 5376821 5376817 5376822 +
aaattgtggcaataatcaatag

SEQ ID NO: 108996 - DNA, 22 bp, Artificial Sequence
  Synthetic oligonucleotide; TTG chr11 5376806 5376827 5376823 5376828 +
tggcaataatcaatagcttacc

SEQ ID NO: 108997 - DNA, 22 bp, Artificial Sequence
  Synthetic oligonucleotide; CTT chr11 5376825 5376846 5376842 5376847 +
accaaccaaaaagagtccagga

SEQ ID NO: 108998 - DNA, 22 bp, Artificial Sequence
  Synthetic oligonucleotide; TTA chr11 5376826 5376847 5376843 5376848 +
ccaaccaaaaagagtccaggac

SEQ ID NO: 108999 - DNA, 22 bp, Artificial Sequence
  Synthetic oligonucleotide; TTC chr11 5376859 5376880 5376876 5376881 +
acagccaaattctaacagaggt

SEQ ID NO: 109000 - DNA, 22 bp, Artificial Sequence
  Synthetic oligonucleotide; TTC chr11 5376871 5376892 5376888 5376893 +
taacagaggtacaaggaggaat

SEQ ID NO: 109001 - DNA, 22 bp, Artificial Sequence
  Synthetic oligonucleotide; CTA chr11 5376873 5376894 5376890 5376895 +
acagaggtacaaggaggaattg

SEQ ID NO: 109002 - DNA, 22 bp, Artificial Sequence
  Synthetic oligonucleotide; TTG chr11 5376895 5376916 5376912 5376917 +
gtaccattccttctgaaactat

SEQ ID NO: 109003 - DNA, 22 bp, Artificial Sequence
  Synthetic oligonucleotide; TTC chr11 5376904 5376925 5376921 5376926 +
cttctgaaactattccaatcaa

SEQ ID NO: 109004 - DNA, 22 bp, Artificial Sequence
  Synthetic oligonucleotide; CTT chr11 5376907 5376928 5376924 5376929 +
ctgaaactattccaatcaacag

SEQ ID NO: 109005 - DNA, 22 bp, Artificial Sequence
  Synthetic oligonucleotide; TTC chr11 5376908 5376929 5376925 5376930 +
tgaaactattccaatcaacaga

SEQ ID NO: 109006 - DNA, 22 bp, Artificial Sequence
  Synthetic oligonucleotide; CTG chr11 5376910 5376931 5376927 5376932 +
aaactattccaatcaacagaaa

SEQ ID NO: 109007 - DNA, 22 bp, Artificial Sequence
  Synthetic oligonucleotide; CTA chr11 5376916 5376937 5376933 5376938 +
ttccaatcaacagaaaaagaag

SEQ ID NO: 109008 - DNA, 22 bp, Artificial Sequence
  Synthetic oligonucleotide; TTC chr11 5376919 5376940 5376936 5376941 +
caatcaacagaaaaagaaggaa

SEQ ID NO: 109009 - DNA, 22 bp, Artificial Sequence
  Synthetic oligonucleotide; CTC chr11 5376946 5376967 5376963 5376968 +
cctaactcattttatgaggcca

SEQ ID NO: 109010 - DNA, 22 bp, Artificial Sequence
  Synthetic oligonucleotide; CTA chr11 5376950 5376971 5376967 5376972 +
actcattttatgaggccagcat

SEQ ID NO: 109011 - DNA, 22 bp, Artificial Sequence
  Synthetic oligonucleotide; CTC chr11 5376954 5376975 5376971 5376976 +
attttatgaggccagcatcatc

SEQ ID NO: 109012 - DNA, 22 bp, Artificial Sequence
  Synthetic oligonucleotide; TTT chr11 5376958 5376979 5376975 5376980 +
tatgaggccagcatcatcctaa

SEQ ID NO: 109013 - DNA, 22 bp, Artificial Sequence
  Synthetic oligonucleotide; TTT chr11 5376959 5376980 5376976 5376981 +
atgaggccagcatcatcctaat

SEQ ID NO: 109014 - DNA, 22 bp, Artificial Sequence
  Synthetic oligonucleotide; TTA chr11 5376960 5376981 5376977 5376982 +
tgaggccagcatcatcctaata

SEQ ID NO: 109015 - DNA, 22 bp, Artificial Sequence
  Synthetic oligonucleotide; CTA chr11 5376979 5377000 5376996 5377001 +
ataccaaagccagaaagagaca

SEQ ID NO: 109016 - DNA, 22 bp, Artificial Sequence
  Synthetic oligonucleotide; TTT chr11 5377020 5377041 5377037 5377042 +
tagatgaatatccctgatgaac

SEQ ID NO: 109017 - DNA, 22 bp, Artificial Sequence
  Synthetic oligonucleotide; TTT chr11 5377021 5377042 5377038 5377043 +
agatgaatatccctgatgaaca

SEQ ID NO: 109018 - DNA, 22 bp, Artificial Sequence
  Synthetic oligonucleotide; TTA chr11 5377022 5377043 5377039 5377044 +
gatgaatatccctgatgaacat

SEQ ID NO: 109019 - DNA, 22 bp, Artificial Sequence
  Synthetic oligonucleotide; CTG chr11 5377036 5377057 5377053 5377058 +
atgaacatcgatgcaaaaatcc

SEQ ID NO: 109020 - DNA, 22 bp, Artificial Sequence
  Synthetic oligonucleotide; CTC chr11 5377060 5377081 5377077 5377082 +
aataaaatactggcaaaccgaa

SEQ ID NO: 109021 - DNA, 22 bp, Artificial Sequence
  Synthetic oligonucleotide; CTG chr11 5377072 5377093 5377089 5377094 +
gcaaaccgaatccagcagcaca

SEQ ID NO: 109022 - DNA, 22 bp, Artificial Sequence
  Synthetic oligonucleotide; CTT chr11 5377105 5377126 5377122 5377127 +
atccacgatgatcaagtggact

SEQ ID NO: 109023 - DNA, 22 bp, Artificial Sequence
  Synthetic oligonucleotide; TTA chr11 5377106 5377127 5377123 5377128 +
tccacgatgatcaagtggactt

SEQ ID NO: 109024 - DNA, 22 bp, Artificial Sequence
  Synthetic oligonucleotide; CTT chr11 5377128 5377149 5377145 5377150 +
catccctgggatgcaaggctgg

SEQ ID NO: 109025 - DNA, 22 bp, Artificial Sequence
  Synthetic oligonucleotide; TTC chr11 5377129 5377150 5377146 5377151 +
atccctgggatgcaaggctggt

SEQ ID NO: 109026 - DNA, 22 bp, Artificial Sequence
  Synthetic oligonucleotide; CTG chr11 5377136 5377157 5377153 5377158 +
ggatgcaaggctggttcaatat

SEQ ID NO: 109027 - DNA, 22 bp, Artificial Sequence
  Synthetic oligonucleotide; CTG chr11 5377149 5377170 5377166 5377171 +
gttcaatatatgcaaatcaata

SEQ ID NO: 109028 - DNA, 22 bp, Artificial Sequence
  Synthetic oligonucleotide; TTC chr11 5377153 5377174 5377170 5377175 +
aatatatgcaaatcaataaatg

SEQ ID NO: 109029 - DNA, 22 bp, Artificial Sequence
  Synthetic oligonucleotide; TTA chr11 5377220 5377241 5377237 5377242 +
tctcaatagatgcagaaaaggc

SEQ ID NO: 109030 - DNA, 22 bp, Artificial Sequence
  Synthetic oligonucleotide; CTC chr11 5377224 5377245 5377241 5377246 +
aatagatgcagaaaaggccttt

SEQ ID NO: 109031 - DNA, 22 bp, Artificial Sequence
  Synthetic oligonucleotide; CTT chr11 5377245 5377266 5377262 5377267 +
tgacaaaattcaacaacccttc

SEQ ID NO: 109032 - DNA, 22 bp, Artificial Sequence
  Synthetic oligonucleotide; TTT chr11 5377246 5377267 5377263 5377268 +
gacaaaattcaacaacccttca

SEQ ID NO: 109033 - DNA, 22 bp, Artificial Sequence
  Synthetic oligonucleotide; TTG chr11 5377247 5377268 5377264 5377269 +
acaaaattcaacaacccttcat

SEQ ID NO: 109034 - DNA, 22 bp, Artificial Sequence
  Synthetic oligonucleotide; TTC chr11 5377256 5377277 5377273 5377278 +
aacaacccttcatgctaaaaac

SEQ ID NO: 109035 - DNA, 22 bp, Artificial Sequence
  Synthetic oligonucleotide; CTT chr11 5377266 5377287 5377283 5377288 +
catgctaaaaactttcaataaa

SEQ ID NO: 109036 - DNA, 22 bp, Artificial Sequence
  Synthetic oligonucleotide; TTC chr11 5377267 5377288 5377284 5377289 +
atgctaaaaactttcaataaat

SEQ ID NO: 109037 - DNA, 22 bp, Artificial Sequence
  Synthetic oligonucleotide; CTA chr11 5377273 5377294 5377290 5377295 +
aaaactttcaataaattaggta

SEQ ID NO: 109038 - DNA, 22 bp, Artificial Sequence
  Synthetic oligonucleotide; CTT chr11 5377280 5377301 5377297 5377302 +
tcaataaattaggtattgatgg

SEQ ID NO: 109039 - DNA, 22 bp, Artificial Sequence
  Synthetic oligonucleotide; TTT chr11 5377281 5377302 5377298 5377303 +
caataaattaggtattgatggg

SEQ ID NO: 109040 - DNA, 22 bp, Artificial Sequence
  Synthetic oligonucleotide; TTC chr11 5377282 5377303 5377299 5377304 +
aataaattaggtattgatggga

SEQ ID NO: 109041 - DNA, 22 bp, Artificial Sequence
  Synthetic oligonucleotide; TTA chr11 5377291 5377312 5377308 5377313 +
ggtattgatgggacatatctca

SEQ ID NO: 109042 - DNA, 22 bp, Artificial Sequence
  Synthetic oligonucleotide; TTG chr11 5377298 5377319 5377315 5377320 +
atgggacatatctcaaaataat

SEQ ID NO: 109043 - DNA, 22 bp, Artificial Sequence
  Synthetic oligonucleotide; CTC chr11 5377312 5377333 5377329 5377334 +
aaaataataagagctatctatg

SEQ ID NO: 109044 - DNA, 22 bp, Artificial Sequence
  Synthetic oligonucleotide; CTA chr11 5377328 5377349 5377345 5377350 +
tctatgacaaacccacagccaa

SEQ ID NO: 109045 - DNA, 22 bp, Artificial Sequence
  Synthetic oligonucleotide; CTA chr11 5377332 5377353 5377349 5377354 +
tgacaaacccacagccaatatc

SEQ ID NO: 109046 - DNA, 22 bp, Artificial Sequence
  Synthetic oligonucleotide; CTG chr11 5377360 5377381 5377377 5377382 +
aatgggcaaaaactggaagcat

SEQ ID NO: 109047 - DNA, 22 bp, Artificial Sequence
  Synthetic oligonucleotide; CTG chr11 5377375 5377396 5377392 5377397 +
gaagcattccctttgtaaactg

SEQ ID NO: 109048 - DNA, 22 bp, Artificial Sequence
  Synthetic oligonucleotide; TTC chr11 5377384 5377405 5377401 5377406 +
cctttgtaaactggcacaagac

SEQ ID NO: 109049 - DNA, 22 bp, Artificial Sequence
  Synthetic oligonucleotide; CTT chr11 5377388 5377409 5377405 5377410 +
tgtaaactggcacaagacaggg

SEQ ID NO: 109050 - DNA, 22 bp, Artificial Sequence
  Synthetic oligonucleotide; TTT chr11 5377389 5377410 5377406 5377411 +
gtaaactggcacaagacaggga

SEQ ID NO: 109051 - DNA, 22 bp, Artificial Sequence
  Synthetic oligonucleotide; TTG chr11 5377390 5377411 5377407 5377412 +
taaactggcacaagacagggat

SEQ ID NO: 109052 - DNA, 22 bp, Artificial Sequence
  Synthetic oligonucleotide; CTG chr11 5377397 5377418 5377414 5377419 +
gcacaagacagggatgccctct

SEQ ID NO: 109053 - DNA, 22 bp, Artificial Sequence
  Synthetic oligonucleotide; CTC chr11 5377418 5377439 5377435 5377440 +
tctcactactcctattcaacat

SEQ ID NO: 109054 - DNA, 22 bp, Artificial Sequence
  Synthetic oligonucleotide; CTC chr11 5377420 5377441 5377437 5377442 +
tcactactcctattcaacatag

SEQ ID NO: 109055 - DNA, 22 bp, Artificial Sequence
  Synthetic oligonucleotide; CTC chr11 5377422 5377443 5377439 5377444 +
actactcctattcaacatagtg

SEQ ID NO: 109056 - DNA, 22 bp, Artificial Sequence
  Synthetic oligonucleotide; CTA chr11 5377426 5377447 5377443 5377448 +
ctcctattcaacatagtgttgg

SEQ ID NO: 109057 - DNA, 22 bp, Artificial Sequence
  Synthetic oligonucleotide; CTC chr11 5377429 5377450 5377446 5377451 +
ctattcaacatagtgttggaag

SEQ ID NO: 109058 - DNA, 22 bp, Artificial Sequence
  Synthetic oligonucleotide; CTA chr11 5377432 5377453 5377449 5377454 +
ttcaacatagtgttggaagttc

SEQ ID NO: 109059 - DNA, 22 bp, Artificial Sequence
  Synthetic oligonucleotide; TTC chr11 5377435 5377456 5377452 5377457 +
aacatagtgttggaagttctgg

SEQ ID NO: 109060 - DNA, 22 bp, Artificial Sequence
  Synthetic oligonucleotide; TTG chr11 5377447 5377468 5377464 5377469 +
gaagttctggccagggcaatta

SEQ ID NO: 109061 - DNA, 22 bp, Artificial Sequence
  Synthetic oligonucleotide; TTC chr11 5377454 5377475 5377471 5377476 +
tggccagggcaattaggcagaa

SEQ ID NO: 109062 - DNA, 22 bp, Artificial Sequence
  Synthetic oligonucleotide; CTG chr11 5377456 5377477 5377473 5377478 +
gccagggcaattaggcagaaga

SEQ ID NO: 109063 - DNA, 22 bp, Artificial Sequence
  Synthetic oligonucleotide; TTA chr11 5377469 5377490 5377486 5377491 +
ggcagaagacaggaaaaaaggg

SEQ ID NO: 109064 - DNA, 22 bp, Artificial Sequence
  Synthetic oligonucleotide; TTC chr11 5377496 5377517 5377513 5377518 +
aattaagaaaagaggaagtcaa

SEQ ID NO: 109065 - DNA, 22 bp, Artificial Sequence
  Synthetic oligonucleotide; TTA chr11 5377501 5377522 5377518 5377523 +
agaaaagaggaagtcaaattgt

SEQ ID NO: 109066 - DNA, 22 bp, Artificial Sequence
  Synthetic oligonucleotide; TTG chr11 5377522 5377543 5377539 5377544 +
tccctgtttgcagacgacatga

SEQ ID NO: 109067 - DNA, 22 bp, Artificial Sequence
  Synthetic oligonucleotide; CTG chr11 5377528 5377549 5377545 5377550 +
tttgcagacgacatgattgtat

SEQ ID NO: 109068 - DNA, 22 bp, Artificial Sequence
  Synthetic oligonucleotide; TTT chr11 5377531 5377552 5377548 5377553 +
gcagacgacatgattgtatatc

SEQ ID NO: 109069 - DNA, 22 bp, Artificial Sequence
  Synthetic oligonucleotide; TTG chr11 5377532 5377553 5377549 5377554 +
cagacgacatgattgtatatct

SEQ ID NO: 109070 - DNA, 22 bp, Artificial Sequence
  Synthetic oligonucleotide; TTG chr11 5377547 5377568 5377564 5377569 +
tatatctagaaaacccccttgt

SEQ ID NO: 109071 - DNA, 22 bp, Artificial Sequence
  Synthetic oligonucleotide; CTA chr11 5377555 5377576 5377572 5377577 +
gaaaacccccttgtctcagccc

SEQ ID NO: 109072 - DNA, 22 bp, Artificial Sequence
  Synthetic oligonucleotide; CTT chr11 5377567 5377588 5377584 5377589 +
gtctcagcccaaaatctcctta

SEQ ID NO: 109073 - DNA, 22 bp, Artificial Sequence
  Synthetic oligonucleotide; TTG chr11 5377568 5377589 5377585 5377590 +
tctcagcccaaaatctccttaa

SEQ ID NO: 109074 - DNA, 22 bp, Artificial Sequence
  Synthetic oligonucleotide; CTC chr11 5377572 5377593 5377589 5377594 +
agcccaaaatctccttaagctg

SEQ ID NO: 109075 - DNA, 22 bp, Artificial Sequence
  Synthetic oligonucleotide; CTC chr11 5377585 5377606 5377602 5377607 +
cttaagctgataagcaacttca

SEQ ID NO: 109076 - DNA, 22 bp, Artificial Sequence
  Synthetic oligonucleotide; CTT chr11 5377588 5377609 5377605 5377610 +
aagctgataagcaacttcagca

SEQ ID NO: 109077 - DNA, 22 bp, Artificial Sequence
  Synthetic oligonucleotide; TTA chr11 5377589 5377610 5377606 5377611 +
agctgataagcaacttcagcaa

SEQ ID NO: 109078 - DNA, 22 bp, Artificial Sequence
  Synthetic oligonucleotide; CTG chr11 5377594 5377615 5377611 5377616 +
ataagcaacttcagcaaagcct

SEQ ID NO: 109079 - DNA, 22 bp, Artificial Sequence
  Synthetic oligonucleotide; CTT chr11 5377605 5377626 5377622 5377627 +
cagcaaagcctcaggatacaaa

SEQ ID NO: 109080 - DNA, 22 bp, Artificial Sequence
  Synthetic oligonucleotide; TTC chr11 5377606 5377627 5377623 5377628 +
agcaaagcctcaggatacaaaa

SEQ ID NO: 109081 - DNA, 22 bp, Artificial Sequence
  Synthetic oligonucleotide; CTC chr11 5377617 5377638 5377634 5377639 +
aggatacaaaaccaatgtgcaa

SEQ ID NO: 109082 - DNA, 22 bp, Artificial Sequence
  Synthetic oligonucleotide; TTC chr11 5377654 5377675 5377671 5377676 +
ttatacaccaataacagacaaa

SEQ ID NO: 109083 - DNA, 22 bp, Artificial Sequence
  Synthetic oligonucleotide; CTT chr11 5377656 5377677 5377673 5377678 +
atacaccaataacagacaaaca

SEQ ID NO: 109084 - DNA, 22 bp, Artificial Sequence
  Synthetic oligonucleotide; TTA chr11 5377657 5377678 5377674 5377679 +
tacaccaataacagacaaacag

SEQ ID NO: 109085 - DNA, 22 bp, Artificial Sequence
  Synthetic oligonucleotide; CTC chr11 5377702 5377723 5377719 5377724 +
ccattcacaattgcttcaaaga

SEQ ID NO: 109086 - DNA, 22 bp, Artificial Sequence
  Synthetic oligonucleotide; TTC chr11 5377708 5377729 5377725 5377730 +
acaattgcttcaaagagaataa

SEQ ID NO: 109087 - DNA, 22 bp, Artificial Sequence
  Synthetic oligonucleotide; TTG chr11 5377715 5377736 5377732 5377737 +
cttcaaagagaataaaatacct

SEQ ID NO: 109088 - DNA, 22 bp, Artificial Sequence
  Synthetic oligonucleotide; CTT chr11 5377718 5377739 5377735 5377740 +
caaagagaataaaatacctagg

SEQ ID NO: 109089 - DNA, 22 bp, Artificial Sequence
  Synthetic oligonucleotide; TTC chr11 5377719 5377740 5377736 5377741 +
aaagagaataaaatacctagga

SEQ ID NO: 109090 - DNA, 22 bp, Artificial Sequence
  Synthetic oligonucleotide; CTA chr11 5377738 5377759 5377755 5377760 +
ggaatccaacttacaagggatg

SEQ ID NO: 109091 - DNA, 22 bp, Artificial Sequence
  Synthetic oligonucleotide; CTT chr11 5377750 5377771 5377767 5377772 +
acaagggatgtgaaggacctct

SEQ ID NO: 109092 - DNA, 22 bp, Artificial Sequence
  Synthetic oligonucleotide; TTA chr11 5377751 5377772 5377768 5377773 +
caagggatgtgaaggacctctt

SEQ ID NO: 109093 - DNA, 22 bp, Artificial Sequence
  Synthetic oligonucleotide; CTC chr11 5377771 5377792 5377788 5377793 +
ttcaaggagaactacaaaccac

SEQ ID NO: 109094 - DNA, 22 bp, Artificial Sequence
  Synthetic oligonucleotide; CTT chr11 5377773 5377794 5377790 5377795 +
caaggagaactacaaaccactg

SEQ ID NO: 109095 - DNA, 22 bp, Artificial Sequence
  Synthetic oligonucleotide; TTC chr11 5377774 5377795 5377791 5377796 +
aaggagaactacaaaccactgc

SEQ ID NO: 109096 - DNA, 22 bp, Artificial Sequence
  Synthetic oligonucleotide; CTA chr11 5377785 5377806 5377802 5377807 +
caaaccactgctcaatgaaata

SEQ ID NO: 109097 - DNA, 22 bp, Artificial Sequence
  Synthetic oligonucleotide; CTG chr11 5377795 5377816 5377812 5377817 +
ctcaatgaaataaaagaagata

SEQ ID NO: 109098 - DNA, 22 bp, Artificial Sequence
  Synthetic oligonucleotide; CTC chr11 5377798 5377819 5377815 5377820 +
aatgaaataaaagaagatacaa

SEQ ID NO: 109099 - DNA, 22 bp, Artificial Sequence
  Synthetic oligonucleotide; TTC chr11 5377838 5377859 5377855 5377860 +
catgcttatgggtaggaagaat

SEQ ID NO: 109100 - DNA, 22 bp, Artificial Sequence
  Synthetic oligonucleotide; CTT chr11 5377845 5377866 5377862 5377867 +
atgggtaggaagaatcaatatc

SEQ ID NO: 109101 - DNA, 22 bp, Artificial Sequence
  Synthetic oligonucleotide; TTA chr11 5377846 5377867 5377863 5377868 +
tgggtaggaagaatcaatatca

SEQ ID NO: 109102 - DNA, 22 bp, Artificial Sequence
  Synthetic oligonucleotide; TTT chr11 5377898 5377919 5377915 5377920 +
atagattcaatgccatccccat

SEQ ID NO: 109103 - DNA, 22 bp, Artificial Sequence
  Synthetic oligonucleotide; TTA chr11 5377899 5377920 5377916 5377921 +
tagattcaatgccatccccatc

SEQ ID NO: 109104 - DNA, 22 bp, Artificial Sequence
  Synthetic oligonucleotide; TTC chr11 5377906 5377927 5377923 5377928 +
aatgccatccccatcaagctac

SEQ ID NO: 109105 - DNA, 22 bp, Artificial Sequence
  Synthetic oligonucleotide; CTA chr11 5377927 5377948 5377944 5377949 +
ccaatgattttcttcacagaat

SEQ ID NO: 109106 - DNA, 22 bp, Artificial Sequence
  Synthetic oligonucleotide; TTT chr11 5377937 5377958 5377954 5377959 +
tcttcacagaattggaaaaacg

SEQ ID NO: 109107 - DNA, 22 bp, Artificial Sequence
  Synthetic oligonucleotide; TTT chr11 5377938 5377959 5377955 5377960 +
cttcacagaattggaaaaacga

SEQ ID NO: 109108 - DNA, 22 bp, Artificial Sequence
  Synthetic oligonucleotide; TTC chr11 5377939 5377960 5377956 5377961 +
ttcacagaattggaaaaacgac

SEQ ID NO: 109109 - DNA, 22 bp, Artificial Sequence
  Synthetic oligonucleotide; CTT chr11 5377941 5377962 5377958 5377963 +
cacagaattggaaaaacgactt

SEQ ID NO: 109110 - DNA, 22 bp, Artificial Sequence
  Synthetic oligonucleotide; TTC chr11 5377942 5377963 5377959 5377964 +
acagaattggaaaaacgacttt

SEQ ID NO: 109111 - DNA, 22 bp, Artificial Sequence
  Synthetic oligonucleotide; TTG chr11 5377951 5377972 5377968 5377973 +
gaaaaacgactttaaagttcat

SEQ ID NO: 109112 - DNA, 22 bp, Artificial Sequence
  Synthetic oligonucleotide; CTT chr11 5377963 5377984 5377980 5377985 +
taaagttcatatggaaccaaaa

SEQ ID NO: 109113 - DNA, 22 bp, Artificial Sequence
  Synthetic oligonucleotide; TTT chr11 5377964 5377985 5377981 5377986 +
aaagttcatatggaaccaaaaa

SEQ ID NO: 109114 - DNA, 22 bp, Artificial Sequence
  Synthetic oligonucleotide; TTA chr11 5377965 5377986 5377982 5377987 +
aagttcatatggaaccaaaaaa

SEQ ID NO: 109115 - DNA, 22 bp, Artificial Sequence
  Synthetic oligonucleotide; TTC chr11 5377971 5377992 5377988 5377993 +
atatggaaccaaaaaagagcct

SEQ ID NO: 109116 - DNA, 22 bp, Artificial Sequence
  Synthetic oligonucleotide; CTG chr11 5377994 5378015 5378011 5378016 +
cattgccaagtcaatcctaagc

SEQ ID NO: 109117 - DNA, 22 bp, Artificial Sequence
  Synthetic oligonucleotide; TTG chr11 5377999 5378020 5378016 5378021 +
ccaagtcaatcctaagccaaaa

SEQ ID NO: 109118 - DNA, 22 bp, Artificial Sequence
  Synthetic oligonucleotide; CTA chr11 5378013 5378034 5378030 5378035 +
agccaaaagaacaaagctggag

SEQ ID NO: 109119 - DNA, 22 bp, Artificial Sequence
  Synthetic oligonucleotide; CTG chr11 5378032 5378053 5378049 5378054 +
gaggcatcaggctacctcactt

SEQ ID NO: 109120 - DNA, 22 bp, Artificial Sequence
  Synthetic oligonucleotide; CTA chr11 5378046 5378067 5378063 5378068 +
cctcacttcaaactatactaca

SEQ ID NO: 109121 - DNA, 22 bp, Artificial Sequence
  Synthetic oligonucleotide; CTC chr11 5378050 5378071 5378067 5378072 +
acttcaaactatactacaaggc

SEQ ID NO: 109122 - DNA, 22 bp, Artificial Sequence
  Synthetic oligonucleotide; CTT chr11 5378054 5378075 5378071 5378076 +
caaactatactacaaggctaca

SEQ ID NO: 109123 - DNA, 22 bp, Artificial Sequence
  Synthetic oligonucleotide; TTC chr11 5378055 5378076 5378072 5378077 +
aaactatactacaaggctacag

SEQ ID NO: 109124 - DNA, 22 bp, Artificial Sequence
  Synthetic oligonucleotide; CTA chr11 5378061 5378082 5378078 5378083 +
tactacaaggctacagtaacca

SEQ ID NO: 109125 - DNA, 22 bp, Artificial Sequence
  Synthetic oligonucleotide; CTA chr11 5378066 5378087 5378083 5378088 +
caaggctacagtaaccaaaaca

SEQ ID NO: 109126 - DNA, 22 bp, Artificial Sequence
  Synthetic oligonucleotide; CTA chr11 5378074 5378095 5378091 5378096 +
cagtaaccaaaacagcatgtta

SEQ ID NO: 109127 - DNA, 22 bp, Artificial Sequence
  Synthetic oligonucleotide; TTA chr11 5378096 5378117 5378113 5378118 +
ctggtaccaaaacacagatata

SEQ ID NO: 109128 - DNA, 22 bp, Artificial Sequence
  Synthetic oligonucleotide; CTG chr11 5378099 5378120 5378116 5378121 +
gtaccaaaacacagatatagat

SEQ ID NO: 109129 - DNA, 22 bp, Artificial Sequence
  Synthetic oligonucleotide; CTC chr11 5378144 5378165 5378161 5378166 +
agaaataacgacgcatatctac

SEQ ID NO: 109130 - DNA, 22 bp, Artificial Sequence
  Synthetic oligonucleotide; CTA chr11 5378165 5378186 5378182 5378187 +
caactatctgatctttgaaaaa

SEQ ID NO: 109131 - DNA, 22 bp, Artificial Sequence
  Synthetic oligonucleotide; CTA chr11 5378171 5378192 5378188 5378193 +
tctgatctttgaaaaacctgag

SEQ ID NO: 109132 - DNA, 22 bp, Artificial Sequence
  Synthetic oligonucleotide; CTG chr11 5378175 5378196 5378192 5378197 +
atctttgaaaaacctgagaaaa

SEQ ID NO: 109133 - DNA, 22 bp, Artificial Sequence
  Synthetic oligonucleotide; CTT chr11 5378180 5378201 5378197 5378202 +
tgaaaaacctgagaaaaacaag

SEQ ID NO: 109134 - DNA, 22 bp, Artificial Sequence
  Synthetic oligonucleotide; TTT chr11 5378181 5378202 5378198 5378203 +
gaaaaacctgagaaaaacaaga

SEQ ID NO: 109135 - DNA, 22 bp, Artificial Sequence
  Synthetic oligonucleotide; TTG chr11 5378182 5378203 5378199 5378204 +
aaaaacctgagaaaaacaagaa

SEQ ID NO: 109136 - DNA, 22 bp, Artificial Sequence
  Synthetic oligonucleotide; CTG chr11 5378191 5378212 5378208 5378213 +
agaaaaacaagaaatggggaaa

SEQ ID NO: 109137 - DNA, 22 bp, Artificial Sequence
  Synthetic oligonucleotide; TTC chr11 5378219 5378240 5378236 5378241 +
cctatttaataaatggtgctgg

SEQ ID NO: 109138 - DNA, 22 bp, Artificial Sequence
  Synthetic oligonucleotide; CTA chr11 5378223 5378244 5378240 5378245 +
tttaataaatggtgctgggaga

SEQ ID NO: 109139 - DNA, 22 bp, Artificial Sequence
  Synthetic oligonucleotide; TTT chr11 5378226 5378247 5378243 5378248 +
aataaatggtgctgggagaact

SEQ ID NO: 109140 - DNA, 22 bp, Artificial Sequence
  Synthetic oligonucleotide; TTA chr11 5378227 5378248 5378244 5378249 +
ataaatggtgctgggagaactg

SEQ ID NO: 109141 - DNA, 22 bp, Artificial Sequence
  Synthetic oligonucleotide; CTG chr11 5378240 5378261 5378257 5378262 +
ggagaactggctagccatatgt

SEQ ID NO: 109142 - DNA, 22 bp, Artificial Sequence
  Synthetic oligonucleotide; CTG chr11 5378249 5378270 5378266 5378271 +
gctagccatatgtagaatgctg

SEQ ID NO: 109143 - DNA, 22 bp, Artificial Sequence
  Synthetic oligonucleotide; CTA chr11 5378253 5378274 5378270 5378275 +
gccatatgtagaatgctgaaac

SEQ ID NO: 109144 - DNA, 22 bp, Artificial Sequence
  Synthetic oligonucleotide; CTG chr11 5378271 5378292 5378288 5378293 +
aaactggatcccttccttacac

SEQ ID NO: 109145 - DNA, 22 bp, Artificial Sequence
  Synthetic oligonucleotide; CTG chr11 5378277 5378298 5378294 5378299 +
gatcccttccttacaccttata

SEQ ID NO: 109146 - DNA, 22 bp, Artificial Sequence
  Synthetic oligonucleotide; CTT chr11 5378285 5378306 5378302 5378307 +
ccttacaccttatacaaaaatt

SEQ ID NO: 109147 - DNA, 22 bp, Artificial Sequence
  Synthetic oligonucleotide; TTC chr11 5378286 5378307 5378303 5378308 +
cttacaccttatacaaaaatta

SEQ ID NO: 109148 - DNA, 22 bp, Artificial Sequence
  Synthetic oligonucleotide; CTT chr11 5378289 5378310 5378306 5378311 +
acaccttatacaaaaattaatt

SEQ ID NO: 109149 - DNA, 22 bp, Artificial Sequence
  Synthetic oligonucleotide; TTA chr11 5378290 5378311 5378307 5378312 +
caccttatacaaaaattaattc

SEQ ID NO: 109150 - DNA, 22 bp, Artificial Sequence
  Synthetic oligonucleotide; CTT chr11 5378296 5378317 5378313 5378318 +
atacaaaaattaattcaagatg

SEQ ID NO: 109151 - DNA, 22 bp, Artificial Sequence
  Synthetic oligonucleotide; TTA chr11 5378297 5378318 5378314 5378319 +
tacaaaaattaattcaagatgg

SEQ ID NO: 109152 - DNA, 22 bp, Artificial Sequence
  Synthetic oligonucleotide; TTA chr11 5378308 5378329 5378325 5378330 +
attcaagatggattaaagactt

SEQ ID NO: 109153 - DNA, 22 bp, Artificial Sequence
  Synthetic oligonucleotide; TTC chr11 5378312 5378333 5378329 5378334 +
aagatggattaaagacttaaac

SEQ ID NO: 109154 - DNA, 22 bp, Artificial Sequence
  Synthetic oligonucleotide; TTA chr11 5378323 5378344 5378340 5378345 +
aagacttaaacattagacctaa

SEQ ID NO: 109155 - DNA, 22 bp, Artificial Sequence
  Synthetic oligonucleotide; CTT chr11 5378330 5378351 5378347 5378352 +
aaacattagacctaaaaccata

SEQ ID NO: 109156 - DNA, 22 bp, Artificial Sequence
  Synthetic oligonucleotide; TTA chr11 5378331 5378352 5378348 5378353 +
aacattagacctaaaaccataa

SEQ ID NO: 109157 - DNA, 22 bp, Artificial Sequence
  Synthetic oligonucleotide; TTA chr11 5378338 5378359 5378355 5378360 +
gacctaaaaccataaaaaccct

SEQ ID NO: 109158 - DNA, 22 bp, Artificial Sequence
  Synthetic oligonucleotide; CTA chr11 5378344 5378365 5378361 5378366 +
aaaccataaaaaccctagaaga

SEQ ID NO: 109159 - DNA, 22 bp, Artificial Sequence
  Synthetic oligonucleotide; CTA chr11 5378361 5378382 5378378 5378383 +
gaagaaaacgcaggcattacca

SEQ ID NO: 109160 - DNA, 22 bp, Artificial Sequence
  Synthetic oligonucleotide; TTA chr11 5378380 5378401 5378397 5378402 +
ccattcaggacataggcatggg

SEQ ID NO: 109161 - DNA, 22 bp, Artificial Sequence
  Synthetic oligonucleotide; TTC chr11 5378386 5378407 5378403 5378408 +
aggacataggcatgggcaagga

SEQ ID NO: 109162 - DNA, 22 bp, Artificial Sequence
  Synthetic oligonucleotide; CTT chr11 5378411 5378432 5378428 5378433 +
catgtctaaaacaccaaaagcg

SEQ ID NO: 109163 - DNA, 22 bp, Artificial Sequence
  Synthetic oligonucleotide; TTC chr11 5378412 5378433 5378429 5378434 +
atgtctaaaacaccaaaagcga

SEQ ID NO: 109164 - DNA, 22 bp, Artificial Sequence
  Synthetic oligonucleotide; CTA chr11 5378419 5378440 5378436 5378441 +
aaacaccaaaagcgatggcaac

SEQ ID NO: 109165 - DNA, 22 bp, Artificial Sequence
  Synthetic oligonucleotide; TTC chr11 5378455 5378476 5378472 5378477 +
actaatgggatctaatgaaact

SEQ ID NO: 109166 - DNA, 22 bp, Artificial Sequence
  Synthetic oligonucleotide; CTA chr11 5378459 5378480 5378476 5378481 +
atgggatctaatgaaactaaag

SEQ ID NO: 109167 - DNA, 22 bp, Artificial Sequence
  Synthetic oligonucleotide; CTA chr11 5378469 5378490 5378486 5378491 +
atgaaactaaagagcttctgca

SEQ ID NO: 109168 - DNA, 22 bp, Artificial Sequence
  Synthetic oligonucleotide; CTA chr11 5378478 5378499 5378495 5378500 +
aagagcttctgcacagctaaag

SEQ ID NO: 109169 - DNA, 22 bp, Artificial Sequence
  Synthetic oligonucleotide; CTT chr11 5378486 5378507 5378503 5378508 +
ctgcacagctaaagaaactacc

SEQ ID NO: 109170 - DNA, 22 bp, Artificial Sequence
  Synthetic oligonucleotide; TTC chr11 5378487 5378508 5378504 5378509 +
tgcacagctaaagaaactacca

SEQ ID NO: 109171 - DNA, 22 bp, Artificial Sequence
  Synthetic oligonucleotide; CTG chr11 5378489 5378510 5378506 5378511 +
cacagctaaagaaactaccatc

SEQ ID NO: 109172 - DNA, 22 bp, Artificial Sequence
  Synthetic oligonucleotide; CTA chr11 5378497 5378518 5378514 5378519 +
aagaaactaccatcagagtgaa

SEQ ID NO: 109173 - DNA, 22 bp, Artificial Sequence
  Synthetic oligonucleotide; CTA chr11 5378506 5378527 5378523 5378528 +
ccatcagagtgaacaggcaacc

SEQ ID NO: 109174 - DNA, 22 bp, Artificial Sequence
  Synthetic oligonucleotide; CTA chr11 5378530 5378551 5378547 5378552 +
cacaatgggagaaaattttcac

SEQ ID NO: 109175 - DNA, 22 bp, Artificial Sequence
  Synthetic oligonucleotide; TTT chr11 5378548 5378569 5378565 5378570 +
tcacaacctactcatctgacaa

SEQ ID NO: 109176 - DNA, 22 bp, Artificial Sequence
  Synthetic oligonucleotide; TTT chr11 5378549 5378570 5378566 5378571 +
cacaacctactcatctgacaaa

SEQ ID NO: 109177 - DNA, 22 bp, Artificial Sequence
  Synthetic oligonucleotide; TTC chr11 5378550 5378571 5378567 5378572 +
acaacctactcatctgacaaag

SEQ ID NO: 109178 - DNA, 22 bp, Artificial Sequence
  Synthetic oligonucleotide; CTA chr11 5378558 5378579 5378575 5378580 +
ctcatctgacaaagggctaata

SEQ ID NO: 109179 - DNA, 22 bp, Artificial Sequence
  Synthetic oligonucleotide; CTC chr11 5378561 5378582 5378578 5378583 +
atctgacaaagggctaatatcc

SEQ ID NO: 109180 - DNA, 22 bp, Artificial Sequence
  Synthetic oligonucleotide; CTG chr11 5378566 5378587 5378583 5378588 +
acaaagggctaatatccagaat

SEQ ID NO: 109181 - DNA, 22 bp, Artificial Sequence
  Synthetic oligonucleotide; CTA chr11 5378577 5378598 5378594 5378599 +
atatccagaatctataatgaac

SEQ ID NO: 109182 - DNA, 22 bp, Artificial Sequence
  Synthetic oligonucleotide; CTA chr11 5378591 5378612 5378608 5378613 +
taatgaactcaaacaaatttac

SEQ ID NO: 109183 - DNA, 22 bp, Artificial Sequence
  Synthetic oligonucleotide; CTC chr11 5378601 5378622 5378618 5378623 +
aaacaaatttacaagaaaaaaa

SEQ ID NO: 109184 - DNA, 22 bp, Artificial Sequence
  Synthetic oligonucleotide; TTT chr11 5378611 5378632 5378628 5378633 +
acaagaaaaaaacaaacagccc

SEQ ID NO: 109185 - DNA, 22 bp, Artificial Sequence
  Synthetic oligonucleotide; TTA chr11 5378612 5378633 5378629 5378634 +
caagaaaaaaacaaacagcccc

SEQ ID NO: 109186 - DNA, 22 bp, Artificial Sequence
  Synthetic oligonucleotide; CTT chr11 5378669 5378690 5378686 5378691 +
ctcaaaagaaaacatttatgca

SEQ ID NO: 109187 - DNA, 22 bp, Artificial Sequence
  Synthetic oligonucleotide; TTC chr11 5378670 5378691 5378687 5378692 +
tcaaaagaaaacatttatgcaa

SEQ ID NO: 109188 - DNA, 22 bp, Artificial Sequence
  Synthetic oligonucleotide; CTC chr11 5378672 5378693 5378689 5378694 +
aaaagaaaacatttatgcaacc

SEQ ID NO: 109189 - DNA, 22 bp, Artificial Sequence
  Synthetic oligonucleotide; TTT chr11 5378686 5378707 5378703 5378708 +
atgcaaccaaaagacacatgaa

SEQ ID NO: 109190 - DNA, 22 bp, Artificial Sequence
  Synthetic oligonucleotide; TTA chr11 5378687 5378708 5378704 5378709 +
tgcaaccaaaagacacatgaaa

SEQ ID NO: 109191 - DNA, 22 bp, Artificial Sequence
  Synthetic oligonucleotide; CTC chr11 5378717 5378738 5378734 5378739 +
atcatcactggccatcagagaa

SEQ ID NO: 109192 - DNA, 22 bp, Artificial Sequence
  Synthetic oligonucleotide; CTG chr11 5378727 5378748 5378744 5378749 +
gccatcagagaaatgcaaatca

SEQ ID NO: 109193 - DNA, 22 bp, Artificial Sequence
  Synthetic oligonucleotide; CTC chr11 5378772 5378793 5378789 5378794 +
ataccagttagaatggcaatca

SEQ ID NO: 109194 - DNA, 22 bp, Artificial Sequence
  Synthetic oligonucleotide; TTA chr11 5378782 5378803 5378799 5378804 +
gaatggcaatcattaaaaagtc

SEQ ID NO: 109195 - DNA, 22 bp, Artificial Sequence
  Synthetic oligonucleotide; TTA chr11 5378797 5378818 5378814 5378819 +
aaaagtcaggaaacaacaggtg

SEQ ID NO: 109196 - DNA, 22 bp, Artificial Sequence
  Synthetic oligonucleotide; CTG chr11 5378822 5378843 5378839 5378844 +
gagaggatgtggagaaatagga

SEQ ID NO: 109197 - DNA, 22 bp, Artificial Sequence
  Synthetic oligonucleotide; CTT chr11 5378850 5378871 5378867 5378872 +
ttacactcttggtgggactgta

SEQ ID NO: 109198 - DNA, 22 bp, Artificial Sequence
  Synthetic oligonucleotide; TTT chr11 5378851 5378872 5378868 5378873 +
tacactcttggtgggactgtaa

SEQ ID NO: 109199 - DNA, 22 bp, Artificial Sequence
  Synthetic oligonucleotide; TTT chr11 5378852 5378873 5378869 5378874 +
acactcttggtgggactgtaaa

SEQ ID NO: 109200 - DNA, 22 bp, Artificial Sequence
  Synthetic oligonucleotide; TTA chr11 5378853 5378874 5378870 5378875 +
cactcttggtgggactgtaaac

SEQ ID NO: 109201 - DNA, 22 bp, Artificial Sequence
  Synthetic oligonucleotide; CTC chr11 5378858 5378879 5378875 5378880 +
ttggtgggactgtaaactagtt

SEQ ID NO: 109202 - DNA, 22 bp, Artificial Sequence
  Synthetic oligonucleotide; CTT chr11 5378860 5378881 5378877 5378882 +
ggtgggactgtaaactagttca

SEQ ID NO: 109203 - DNA, 22 bp, Artificial Sequence
  Synthetic oligonucleotide; TTG chr11 5378861 5378882 5378878 5378883 +
gtgggactgtaaactagttcaa

SEQ ID NO: 109204 - DNA, 22 bp, Artificial Sequence
  Synthetic oligonucleotide; CTG chr11 5378870 5378891 5378887 5378892 +
taaactagttcaaccattgtgg

SEQ ID NO: 109205 - DNA, 22 bp, Artificial Sequence
  Synthetic oligonucleotide; CTA chr11 5378877 5378898 5378894 5378899 +
gttcaaccattgtggaagtcag

SEQ ID NO: 109206 - DNA, 22 bp, Artificial Sequence
  Synthetic oligonucleotide; TTC chr11 5378881 5378902 5378898 5378903 +
aaccattgtggaagtcagtgtg

SEQ ID NO: 109207 - DNA, 22 bp, Artificial Sequence
  Synthetic oligonucleotide; TTG chr11 5378889 5378910 5378906 5378911 +
tggaagtcagtgtggcgattcc

SEQ ID NO: 109208 - DNA, 22 bp, Artificial Sequence
  Synthetic oligonucleotide; TTC chr11 5378910 5378931 5378927 5378932 +
ctcagggatctagaactagaaa

SEQ ID NO: 109209 - DNA, 22 bp, Artificial Sequence
  Synthetic oligonucleotide; CTC chr11 5378913 5378934 5378930 5378935 +
agggatctagaactagaaatac

SEQ ID NO: 109210 - DNA, 22 bp, Artificial Sequence
  Synthetic oligonucleotide; CTA chr11 5378922 5378943 5378939 5378944 +
gaactagaaataccatttgacc

SEQ ID NO: 109211 - DNA, 22 bp, Artificial Sequence
  Synthetic oligonucleotide; CTA chr11 5378928 5378949 5378945 5378950 +
gaaataccatttgacccagcca

SEQ ID NO: 109212 - DNA, 22 bp, Artificial Sequence
  Synthetic oligonucleotide; TTT chr11 5378940 5378961 5378957 5378962 +
gacccagccatcccattactgg

SEQ ID NO: 109213 - DNA, 22 bp, Artificial Sequence
  Synthetic oligonucleotide; TTG chr11 5378941 5378962 5378958 5378963 +
acccagccatcccattactggg

SEQ ID NO: 109214 - DNA, 22 bp, Artificial Sequence
  Synthetic oligonucleotide; TTA chr11 5378958 5378979 5378975 5378980 +
ctgggtatatacccaaaggaat

SEQ ID NO: 109215 - DNA, 22 bp, Artificial Sequence
  Synthetic oligonucleotide; CTG chr11 5378961 5378982 5378978 5378983 +
ggtatatacccaaaggaatata

SEQ ID NO: 109216 - DNA, 22 bp, Artificial Sequence
  Synthetic oligonucleotide; CTG chr11 5378993 5379014 5379010 5379015 +
ctataaagacacatgcacacgt

SEQ ID NO: 109217 - DNA, 22 bp, Artificial Sequence
  Synthetic oligonucleotide; CTA chr11 5378996 5379017 5379013 5379018 +
taaagacacatgcacacgtatg

SEQ ID NO: 109218 - DNA, 22 bp, Artificial Sequence
  Synthetic oligonucleotide; TTT chr11 5379021 5379042 5379038 5379043 +
attgcggtactattcacaatag

SEQ ID NO: 109219 - DNA, 22 bp, Artificial Sequence
  Synthetic oligonucleotide; TTA chr11 5379022 5379043 5379039 5379044 +
ttgcggtactattcacaatagc

SEQ ID NO: 109220 - DNA, 22 bp, Artificial Sequence
  Synthetic oligonucleotide; TTG chr11 5379025 5379046 5379042 5379047 +
cggtactattcacaatagcaaa

SEQ ID NO: 109221 - DNA, 22 bp, Artificial Sequence
  Synthetic oligonucleotide; CTA chr11 5379033 5379054 5379050 5379055 +
ttcacaatagcaaagacttgga

SEQ ID NO: 109222 - DNA, 22 bp, Artificial Sequence
  Synthetic oligonucleotide; TTC chr11 5379036 5379057 5379053 5379058 +
acaatagcaaagacttggaacc

SEQ ID NO: 109223 - DNA, 22 bp, Artificial Sequence
  Synthetic oligonucleotide; CTT chr11 5379052 5379073 5379069 5379074 +
ggaaccaacccaaatgtccaac

SEQ ID NO: 109224 - DNA, 22 bp, Artificial Sequence
  Synthetic oligonucleotide; TTG chr11 5379053 5379074 5379070 5379075 +
gaaccaacccaaatgtccaaca

SEQ ID NO: 109225 - DNA, 22 bp, Artificial Sequence
  Synthetic oligonucleotide; CTG chr11 5379086 5379107 5379103 5379108 +
gattaagaaaatgtggcacata

SEQ ID NO: 109226 - DNA, 22 bp, Artificial Sequence
  Synthetic oligonucleotide; TTA chr11 5379091 5379112 5379108 5379113 +
agaaaatgtggcacatatacac

SEQ ID NO: 109227 - DNA, 22 bp, Artificial Sequence
  Synthetic oligonucleotide; CTA chr11 5379125 5379146 5379142 5379147 +
tgcagccataaaaatgatgagt

SEQ ID NO: 109228 - DNA, 22 bp, Artificial Sequence
  Synthetic oligonucleotide; TTC chr11 5379149 5379170 5379166 5379171 +
atgtcctttgtagggacatgga

SEQ ID NO: 109229 - DNA, 22 bp, Artificial Sequence
  Synthetic oligonucleotide; CTT chr11 5379157 5379178 5379174 5379179 +
tgtagggacatggatgaaattg

SEQ ID NO: 109230 - DNA, 22 bp, Artificial Sequence
  Synthetic oligonucleotide; TTT chr11 5379158 5379179 5379175 5379180 +
gtagggacatggatgaaattgg

SEQ ID NO: 109231 - DNA, 22 bp, Artificial Sequence
  Synthetic oligonucleotide; TTG chr11 5379159 5379180 5379176 5379181 +
tagggacatggatgaaattgga

SEQ ID NO: 109232 - DNA, 22 bp, Artificial Sequence
  Synthetic oligonucleotide; TTG chr11 5379179 5379200 5379196 5379201 +
gaaatcatcattctcagtaaac

SEQ ID NO: 109233 - DNA, 22 bp, Artificial Sequence
  Synthetic oligonucleotide; TTC chr11 5379192 5379213 5379209 5379214 +
tcagtaaactatcgcaaggaca

SEQ ID NO: 109234 - DNA, 22 bp, Artificial Sequence
  Synthetic oligonucleotide; CTC chr11 5379194 5379215 5379211 5379216 +
agtaaactatcgcaaggacaaa

SEQ ID NO: 109235 - DNA, 22 bp, Artificial Sequence
  Synthetic oligonucleotide; CTA chr11 5379203 5379224 5379220 5379225 +
tcgcaaggacaaaaaaccaaac

SEQ ID NO: 109236 - DNA, 22 bp, Artificial Sequence
  Synthetic oligonucleotide; TTC chr11 5379236 5379257 5379253 5379258 +
tcactcatagatgggaactgaa

SEQ ID NO: 109237 - DNA, 22 bp, Artificial Sequence
  Synthetic oligonucleotide; CTC chr11 5379238 5379259 5379255 5379260 +
actcatagatgggaactgaaca

SEQ ID NO: 109238 - DNA, 22 bp, Artificial Sequence
  Synthetic oligonucleotide; CTC chr11 5379242 5379263 5379259 5379264 +
atagatgggaactgaacaatga

SEQ ID NO: 109239 - DNA, 22 bp, Artificial Sequence
  Synthetic oligonucleotide; CTG chr11 5379256 5379277 5379273 5379278 +
aacaatgagaacacatggacac

SEQ ID NO: 109240 - DNA, 22 bp, Artificial Sequence
  Synthetic oligonucleotide; CTC chr11 5379299 5379320 5379316 5379321 +
tggggactgttgtggggtgggg

SEQ ID NO: 109241 - DNA, 22 bp, Artificial Sequence
  Synthetic oligonucleotide; CTG chr11 5379301 5379322 5379318 5379323 +
gggactgttgtggggtgggggt

SEQ ID NO: 109242 - DNA, 22 bp, Artificial Sequence
  Synthetic oligonucleotide; CTG chr11 5379308 5379329 5379325 5379330 +
ttgtggggtgggggtgcaggga

SEQ ID NO: 109243 - DNA, 22 bp, Artificial Sequence
  Synthetic oligonucleotide; TTG chr11 5379311 5379332 5379328 5379333 +
tggggtgggggtgcagggaggg

SEQ ID NO: 109244 - DNA, 22 bp, Artificial Sequence
  Synthetic oligonucleotide; TTA chr11 5379342 5379363 5379359 5379364 +
ggagatatacctaatgctaaat

SEQ ID NO: 109245 - DNA, 22 bp, Artificial Sequence
  Synthetic oligonucleotide; CTA chr11 5379355 5379376 5379372 5379377 +
atgctaaattacgagttaatgg

SEQ ID NO: 109246 - DNA, 22 bp, Artificial Sequence
  Synthetic oligonucleotide; CTA chr11 5379361 5379382 5379378 5379383 +
aattacgagttaatgggtgcag

SEQ ID NO: 109247 - DNA, 22 bp, Artificial Sequence
  Synthetic oligonucleotide; TTA chr11 5379366 5379387 5379383 5379388 +
cgagttaatgggtgcagcacac

SEQ ID NO: 109248 - DNA, 22 bp, Artificial Sequence
  Synthetic oligonucleotide; TTA chr11 5379373 5379394 5379390 5379395 +
atgggtgcagcacaccaacatg

SEQ ID NO: 109249 - DNA, 22 bp, Artificial Sequence
  Synthetic oligonucleotide; CTA chr11 5379418 5379439 5379435 5379440 +
accggcacattatgcacatgta

SEQ ID NO: 109250 - DNA, 22 bp, Artificial Sequence
  Synthetic oligonucleotide; TTA chr11 5379430 5379451 5379447 5379452 +
tgcacatgtaccctaaatctta

SEQ ID NO: 109251 - DNA, 22 bp, Artificial Sequence
  Synthetic oligonucleotide; CTA chr11 5379445 5379466 5379462 5379467 +
aatcttaaagtataataataat

SEQ ID NO: 109252 - DNA, 22 bp, Artificial Sequence
  Synthetic oligonucleotide; CTT chr11 5379451 5379472 5379468 5379473 +
aaagtataataataataataaa

SEQ ID NO: 109253 - DNA, 22 bp, Artificial Sequence
  Synthetic oligonucleotide; TTA chr11 5379452 5379473 5379469 5379474 +
aagtataataataataataaat

SEQ ID NO: 109254 - DNA, 22 bp, Artificial Sequence
  Synthetic oligonucleotide; TTC chr11 5379505 5379526 5379522 5379527 +
cagtttattttttcaggtttcc

SEQ ID NO: 109255 - DNA, 22 bp, Artificial Sequence
  Synthetic oligonucleotide; TTT chr11 5379511 5379532 5379528 5379533 +
attttttcaggtttccgttgtt

SEQ ID NO: 109256 - DNA, 22 bp, Artificial Sequence
  Synthetic oligonucleotide; TTA chr11 5379512 5379533 5379529 5379534 +
ttttttcaggtttccgttgttt

SEQ ID NO: 109257 - DNA, 22 bp, Artificial Sequence
  Synthetic oligonucleotide; TTT chr11 5379515 5379536 5379532 5379537 +
tttcaggtttccgttgtttcct

SEQ ID NO: 109258 - DNA, 22 bp, Artificial Sequence
  Synthetic oligonucleotide; TTT chr11 5379516 5379537 5379533 5379538 +
ttcaggtttccgttgtttcctc

SEQ ID NO: 109259 - DNA, 22 bp, Artificial Sequence
  Synthetic oligonucleotide; TTT chr11 5379517 5379538 5379534 5379539 +
tcaggtttccgttgtttcctct

SEQ ID NO: 109260 - DNA, 22 bp, Artificial Sequence
  Synthetic oligonucleotide; TTT chr11 5379518 5379539 5379535 5379540 +
caggtttccgttgtttcctcta

SEQ ID NO: 109261 - DNA, 22 bp, Artificial Sequence
  Synthetic oligonucleotide; TTC chr11 5379519 5379540 5379536 5379541 +
aggtttccgttgtttcctctaa

SEQ ID NO: 109262 - DNA, 22 bp, Artificial Sequence
  Synthetic oligonucleotide; TTT chr11 5379525 5379546 5379542 5379547 +
ccgttgtttcctctaataattt

SEQ ID NO: 109263 - DNA, 22 bp, Artificial Sequence
  Synthetic oligonucleotide; TTC chr11 5379526 5379547 5379543 5379548 +
cgttgtttcctctaataatttt

SEQ ID NO: 109264 - DNA, 22 bp, Artificial Sequence
  Synthetic oligonucleotide; TTG chr11 5379531 5379552 5379548 5379553 +
tttcctctaataattttcttgt

SEQ ID NO: 109265 - DNA, 22 bp, Artificial Sequence
  Synthetic oligonucleotide; TTT chr11 5379534 5379555 5379551 5379556 +
cctctaataattttcttgtatg

SEQ ID NO: 109266 - DNA, 22 bp, Artificial Sequence
  Synthetic oligonucleotide; TTC chr11 5379535 5379556 5379552 5379557 +
ctctaataattttcttgtatgc

SEQ ID NO: 109267 - DNA, 22 bp, Artificial Sequence
  Synthetic oligonucleotide; CTC chr11 5379538 5379559 5379555 5379560 +
taataattttcttgtatgcaat

SEQ ID NO: 109268 - DNA, 22 bp, Artificial Sequence
  Synthetic oligonucleotide; CTA chr11 5379540 5379561 5379557 5379562 +
ataattttcttgtatgcaatgt

SEQ ID NO: 109269 - DNA, 22 bp, Artificial Sequence
  Synthetic oligonucleotide; TTT chr11 5379547 5379568 5379564 5379569 +
tcttgtatgcaatgtgtctttt

SEQ ID NO: 109270 - DNA, 22 bp, Artificial Sequence
  Synthetic oligonucleotide; TTT chr11 5379548 5379569 5379565 5379570 +
cttgtatgcaatgtgtcttttt

SEQ ID NO: 109271 - DNA, 22 bp, Artificial Sequence
  Synthetic oligonucleotide; TTC chr11 5379549 5379570 5379566 5379571 +
ttgtatgcaatgtgtctttttc

SEQ ID NO: 109272 - DNA, 22 bp, Artificial Sequence
  Synthetic oligonucleotide; CTT chr11 5379551 5379572 5379568 5379573 +
gtatgcaatgtgtctttttcta

SEQ ID NO: 109273 - DNA, 22 bp, Artificial Sequence
  Synthetic oligonucleotide; TTG chr11 5379552 5379573 5379569 5379574 +
tatgcaatgtgtctttttctat

SEQ ID NO: 109274 - DNA, 22 bp, Artificial Sequence
  Synthetic oligonucleotide; CTT chr11 5379567 5379588 5379584 5379589 +
tttctatgtctgcttttaagat

SEQ ID NO: 109275 - DNA, 22 bp, Artificial Sequence
  Synthetic oligonucleotide; TTT chr11 5379568 5379589 5379585 5379590 +
ttctatgtctgcttttaagatt

SEQ ID NO: 109276 - DNA, 22 bp, Artificial Sequence
  Synthetic oligonucleotide; TTT chr11 5379569 5379590 5379586 5379591 +
tctatgtctgcttttaagattg

SEQ ID NO: 109277 - DNA, 22 bp, Artificial Sequence
  Synthetic oligonucleotide; TTT chr11 5379570 5379591 5379587 5379592 +
ctatgtctgcttttaagattgg

SEQ ID NO: 109278 - DNA, 22 bp, Artificial Sequence
  Synthetic oligonucleotide; TTC chr11 5379571 5379592 5379588 5379593 +
tatgtctgcttttaagattggc

SEQ ID NO: 109279 - DNA, 22 bp, Artificial Sequence
  Synthetic oligonucleotide; CTA chr11 5379573 5379594 5379590 5379595 +
tgtctgcttttaagattggcat

SEQ ID NO: 109280 - DNA, 22 bp, Artificial Sequence
  Synthetic oligonucleotide; CTG chr11 5379579 5379600 5379596 5379601 +
cttttaagattggcatacattt

SEQ ID NO: 109281 - DNA, 22 bp, Artificial Sequence
  Synthetic oligonucleotide; CTT chr11 5379582 5379603 5379599 5379604 +
ttaagattggcatacatttgtt

SEQ ID NO: 109282 - DNA, 22 bp, Artificial Sequence
  Synthetic oligonucleotide; TTT chr11 5379583 5379604 5379600 5379605 +
taagattggcatacatttgttg

SEQ ID NO: 109283 - DNA, 22 bp, Artificial Sequence
  Synthetic oligonucleotide; TTT chr11 5379584 5379605 5379601 5379606 +
aagattggcatacatttgttgt

SEQ ID NO: 109284 - DNA, 22 bp, Artificial Sequence
  Synthetic oligonucleotide; TTA chr11 5379585 5379606 5379602 5379607 +
agattggcatacatttgttgtt

SEQ ID NO: 109285 - DNA, 22 bp, Artificial Sequence
  Synthetic oligonucleotide; TTG chr11 5379591 5379612 5379608 5379613 +
gcatacatttgttgtttatgcc

SEQ ID NO: 109286 - DNA, 22 bp, Artificial Sequence
  Synthetic oligonucleotide; TTT chr11 5379601 5379622 5379618 5379623 +
gttgtttatgccatttgtaaga

SEQ ID NO: 109287 - DNA, 22 bp, Artificial Sequence
  Synthetic oligonucleotide; TTG chr11 5379602 5379623 5379619 5379624 +
ttgtttatgccatttgtaagat

SEQ ID NO: 109288 - DNA, 22 bp, Artificial Sequence
  Synthetic oligonucleotide; TTG chr11 5379605 5379626 5379622 5379627 +
tttatgccatttgtaagatatg

SEQ ID NO: 109289 - DNA, 22 bp, Artificial Sequence
  Synthetic oligonucleotide; TTT chr11 5379608 5379629 5379625 5379630 +
atgccatttgtaagatatgcat

SEQ ID NO: 109290 - DNA, 22 bp, Artificial Sequence
  Synthetic oligonucleotide; TTA chr11 5379609 5379630 5379626 5379631 +
tgccatttgtaagatatgcatt

SEQ ID NO: 109291 - DNA, 22 bp, Artificial Sequence
  Synthetic oligonucleotide; TTT chr11 5379617 5379638 5379634 5379639 +
gtaagatatgcatttagttgtg

SEQ ID NO: 109292 - DNA, 22 bp, Artificial Sequence
  Synthetic oligonucleotide; TTG chr11 5379618 5379639 5379635 5379640 +
taagatatgcatttagttgtgt

SEQ ID NO: 109293 - DNA, 22 bp, Artificial Sequence
  Synthetic oligonucleotide; TTT chr11 5379632 5379653 5379649 5379654 +
agttgtgttttattttttaatt

SEQ ID NO: 109294 - DNA, 22 bp, Artificial Sequence
  Synthetic oligonucleotide; TTA chr11 5379633 5379654 5379650 5379655 +
gttgtgttttattttttaattg

SEQ ID NO: 109295 - DNA, 22 bp, Artificial Sequence
  Synthetic oligonucleotide; TTG chr11 5379637 5379658 5379654 5379659 +
tgttttattttttaattgacat

SEQ ID NO: 109296 - DNA, 22 bp, Artificial Sequence
  Synthetic oligonucleotide; TTT chr11 5379642 5379663 5379659 5379664 +
tattttttaattgacattgctc

SEQ ID NO: 109297 - DNA, 22 bp, Artificial Sequence
  Synthetic oligonucleotide; TTT chr11 5379643 5379664 5379660 5379665 +
attttttaattgacattgctca

SEQ ID NO: 109298 - DNA, 22 bp, Artificial Sequence
  Synthetic oligonucleotide; TTA chr11 5379644 5379665 5379661 5379666 +
ttttttaattgacattgctcaa

SEQ ID NO: 109299 - DNA, 22 bp, Artificial Sequence
  Synthetic oligonucleotide; TTT chr11 5379647 5379668 5379664 5379669 +
tttaattgacattgctcaaggt

SEQ ID NO: 109300 - DNA, 22 bp, Artificial Sequence
  Synthetic oligonucleotide; TTT chr11 5379648 5379669 5379665 5379670 +
ttaattgacattgctcaaggtt

SEQ ID NO: 109301 - DNA, 22 bp, Artificial Sequence
  Synthetic oligonucleotide; TTT chr11 5379649 5379670 5379666 5379671 +
taattgacattgctcaaggtta

SEQ ID NO: 109302 - DNA, 22 bp, Artificial Sequence
  Synthetic oligonucleotide; TTT chr11 5379650 5379671 5379667 5379672 +
aattgacattgctcaaggttag

SEQ ID NO: 109303 - DNA, 22 bp, Artificial Sequence
  Synthetic oligonucleotide; TTA chr11 5379651 5379672 5379668 5379673 +
attgacattgctcaaggttagc

SEQ ID NO: 109304 - DNA, 22 bp, Artificial Sequence
  Synthetic oligonucleotide; TTG chr11 5379655 5379676 5379672 5379677 +
acattgctcaaggttagctaaa

SEQ ID NO: 109305 - DNA, 22 bp, Artificial Sequence
  Synthetic oligonucleotide; TTG chr11 5379661 5379682 5379678 5379683 +
ctcaaggttagctaaagatatg

SEQ ID NO: 109306 - DNA, 22 bp, Artificial Sequence
  Synthetic oligonucleotide; CTC chr11 5379664 5379685 5379681 5379686 +
aaggttagctaaagatatgaat

SEQ ID NO: 109307 - DNA, 22 bp, Artificial Sequence
  Synthetic oligonucleotide; TTA chr11 5379671 5379692 5379688 5379693 +
gctaaagatatgaattaataga

SEQ ID NO: 109308 - DNA, 22 bp, Artificial Sequence
  Synthetic oligonucleotide; CTA chr11 5379675 5379696 5379692 5379697 +
aagatatgaattaatagatttt

SEQ ID NO: 109309 - DNA, 22 bp, Artificial Sequence
  Synthetic oligonucleotide; TTA chr11 5379688 5379709 5379705 5379710 +
atagattttatgtccagatgtt

SEQ ID NO: 109310 - DNA, 22 bp, Artificial Sequence
  Synthetic oligonucleotide; TTT chr11 5379696 5379717 5379713 5379718 +
tatgtccagatgttgaaacatt

SEQ ID NO: 109311 - DNA, 22 bp, Artificial Sequence
  Synthetic oligonucleotide; TTT chr11 5379697 5379718 5379714 5379719 +
atgtccagatgttgaaacattc

SEQ ID NO: 109312 - DNA, 22 bp, Artificial Sequence
  Synthetic oligonucleotide; TTA chr11 5379698 5379719 5379715 5379720 +
tgtccagatgttgaaacattca

SEQ ID NO: 109313 - DNA, 22 bp, Artificial Sequence
  Synthetic oligonucleotide; TTG chr11 5379711 5379732 5379728 5379733 +
aaacattcagtcaataattcct

SEQ ID NO: 109314 - DNA, 22 bp, Artificial Sequence
  Synthetic oligonucleotide; TTC chr11 5379719 5379740 5379736 5379741 +
agtcaataattcctcaaaaaac

SEQ ID NO: 109315 - DNA, 22 bp, Artificial Sequence
  Synthetic oligonucleotide; TTC chr11 5379731 5379752 5379748 5379753 +
ctcaaaaaacgtttaatccatt

SEQ ID NO: 109316 - DNA, 22 bp, Artificial Sequence
  Synthetic oligonucleotide; CTC chr11 5379734 5379755 5379751 5379756 +
aaaaaacgtttaatccattttt

SEQ ID NO: 109317 - DNA, 22 bp, Artificial Sequence
  Synthetic oligonucleotide; TTT chr11 5379745 5379766 5379762 5379767 +
aatccattttttgtttcctttt

SEQ ID NO: 109318 - DNA, 22 bp, Artificial Sequence
  Synthetic oligonucleotide; TTA chr11 5379746 5379767 5379763 5379768 +
atccattttttgtttcctttta

SEQ ID NO: 109319 - DNA, 22 bp, Artificial Sequence
  Synthetic oligonucleotide; TTT chr11 5379754 5379775 5379771 5379776 +
tttgtttccttttagaattcta

SEQ ID NO: 109320 - DNA, 22 bp, Artificial Sequence
  Synthetic oligonucleotide; TTT chr11 5379755 5379776 5379772 5379777 +
ttgtttccttttagaattctaa

SEQ ID NO: 109321 - DNA, 22 bp, Artificial Sequence
  Synthetic oligonucleotide; TTT chr11 5379756 5379777 5379773 5379778 +
tgtttccttttagaattctaat

SEQ ID NO: 109322 - DNA, 22 bp, Artificial Sequence
  Synthetic oligonucleotide; TTT chr11 5379757 5379778 5379774 5379779 +
gtttccttttagaattctaatt

SEQ ID NO: 109323 - DNA, 22 bp, Artificial Sequence
  Synthetic oligonucleotide; TTG chr11 5379758 5379779 5379775 5379780 +
tttccttttagaattctaattt

SEQ ID NO: 109324 - DNA, 22 bp, Artificial Sequence
  Synthetic oligonucleotide; TTT chr11 5379761 5379782 5379778 5379783 +
ccttttagaattctaatttcac

SEQ ID NO: 109325 - DNA, 22 bp, Artificial Sequence
  Synthetic oligonucleotide; TTC chr11 5379762 5379783 5379779 5379784 +
cttttagaattctaatttcaca

SEQ ID NO: 109326 - DNA, 22 bp, Artificial Sequence
  Synthetic oligonucleotide; CTT chr11 5379765 5379786 5379782 5379787 +
ttagaattctaatttcacatat

SEQ ID NO: 109327 - DNA, 22 bp, Artificial Sequence
  Synthetic oligonucleotide; TTT chr11 5379766 5379787 5379783 5379788 +
tagaattctaatttcacatatg

SEQ ID NO: 109328 - DNA, 22 bp, Artificial Sequence
  Synthetic oligonucleotide; TTT chr11 5379767 5379788 5379784 5379789 +
agaattctaatttcacatatgg

SEQ ID NO: 109329 - DNA, 22 bp, Artificial Sequence
  Synthetic oligonucleotide; TTA chr11 5379768 5379789 5379785 5379790 +
gaattctaatttcacatatggt

SEQ ID NO: 109330 - DNA, 22 bp, Artificial Sequence
  Synthetic oligonucleotide; TTC chr11 5379774 5379795 5379791 5379796 +
taatttcacatatggtggacag

SEQ ID NO: 109331 - DNA, 22 bp, Artificial Sequence
  Synthetic oligonucleotide; CTA chr11 5379776 5379797 5379793 5379798 +
atttcacatatggtggacagct

SEQ ID NO: 109332 - DNA, 22 bp, Artificial Sequence
  Synthetic oligonucleotide; TTT chr11 5379780 5379801 5379797 5379802 +
cacatatggtggacagcttgat

SEQ ID NO: 109333 - DNA, 22 bp, Artificial Sequence
  Synthetic oligonucleotide; TTC chr11 5379781 5379802 5379798 5379803 +
acatatggtggacagcttgata

SEQ ID NO: 109334 - DNA, 22 bp, Artificial Sequence
  Synthetic oligonucleotide; CTT chr11 5379799 5379820 5379816 5379821 +
gatactttcccatgagtctggc

SEQ ID NO: 109335 - DNA, 22 bp, Artificial Sequence
  Synthetic oligonucleotide; TTG chr11 5379800 5379821 5379817 5379822 +
atactttcccatgagtctggct

SEQ ID NO: 109336 - DNA, 22 bp, Artificial Sequence
  Synthetic oligonucleotide; CTT chr11 5379806 5379827 5379823 5379828 +
tcccatgagtctggctttctgg

SEQ ID NO: 109337 - DNA, 22 bp, Artificial Sequence
  Synthetic oligonucleotide; TTT chr11 5379807 5379828 5379824 5379829 +
cccatgagtctggctttctggg

SEQ ID NO: 109338 - DNA, 22 bp, Artificial Sequence
  Synthetic oligonucleotide; TTC chr11 5379808 5379829 5379825 5379830 +
ccatgagtctggctttctgggt

SEQ ID NO: 109339 - DNA, 22 bp, Artificial Sequence
  Synthetic oligonucleotide; CTG chr11 5379819 5379840 5379836 5379841 +
gctttctgggtttctctccctg

SEQ ID NO: 109340 - DNA, 22 bp, Artificial Sequence
  Synthetic oligonucleotide; CTT chr11 5379823 5379844 5379840 5379845 +
tctgggtttctctccctggcgt

SEQ ID NO: 109341 - DNA, 22 bp, Artificial Sequence
  Synthetic oligonucleotide; TTT chr11 5379824 5379845 5379841 5379846 +
ctgggtttctctccctggcgtc

SEQ ID NO: 109342 - DNA, 22 bp, Artificial Sequence
  Synthetic oligonucleotide; TTC chr11 5379825 5379846 5379842 5379847 +
tgggtttctctccctggcgtcc

SEQ ID NO: 109343 - DNA, 22 bp, Artificial Sequence
  Synthetic oligonucleotide; CTG chr11 5379827 5379848 5379844 5379849 +
ggtttctctccctggcgtcctc

SEQ ID NO: 109344 - DNA, 22 bp, Artificial Sequence
  Synthetic oligonucleotide; TTT chr11 5379832 5379853 5379849 5379854 +
ctctccctggcgtcctctctca

SEQ ID NO: 109345 - DNA, 22 bp, Artificial Sequence
  Synthetic oligonucleotide; TTC chr11 5379833 5379854 5379850 5379855 +
tctccctggcgtcctctctcat

SEQ ID NO: 109346 - DNA, 22 bp, Artificial Sequence
  Synthetic oligonucleotide; CTC chr11 5379835 5379856 5379852 5379857 +
tccctggcgtcctctctcatca

SEQ ID NO: 109347 - DNA, 22 bp, Artificial Sequence
  Synthetic oligonucleotide; CTC chr11 5379837 5379858 5379854 5379859 +
cctggcgtcctctctcatcatg

SEQ ID NO: 109348 - DNA, 22 bp, Artificial Sequence
  Synthetic oligonucleotide; CTG chr11 5379841 5379862 5379858 5379863 +
gcgtcctctctcatcatgtgat

SEQ ID NO: 109349 - DNA, 22 bp, Artificial Sequence
  Synthetic oligonucleotide; CTC chr11 5379849 5379870 5379866 5379871 +
tctcatcatgtgatctccttgc

SEQ ID NO: 109350 - DNA, 22 bp, Artificial Sequence
  Synthetic oligonucleotide; CTC chr11 5379851 5379872 5379868 5379873 +
tcatcatgtgatctccttgcat

SEQ ID NO: 109351 - DNA, 22 bp, Artificial Sequence
  Synthetic oligonucleotide; CTC chr11 5379853 5379874 5379870 5379875 +
atcatgtgatctccttgcatgc

SEQ ID NO: 109352 - DNA, 22 bp, Artificial Sequence
  Synthetic oligonucleotide; CTC chr11 5379866 5379887 5379883 5379888 +
cttgcatgcacttgctctttgt

SEQ ID NO: 109353 - DNA, 22 bp, Artificial Sequence
  Synthetic oligonucleotide; CTT chr11 5379869 5379890 5379886 5379891 +
gcatgcacttgctctttgtctg

SEQ ID NO: 109354 - DNA, 22 bp, Artificial Sequence
  Synthetic oligonucleotide; TTG chr11 5379870 5379891 5379887 5379892 +
catgcacttgctctttgtctgc

SEQ ID NO: 109355 - DNA, 22 bp, Artificial Sequence
  Synthetic oligonucleotide; CTT chr11 5379879 5379900 5379896 5379901 +
gctctttgtctgctttctgcca

SEQ ID NO: 109356 - DNA, 22 bp, Artificial Sequence
  Synthetic oligonucleotide; TTG chr11 5379880 5379901 5379897 5379902 +
ctctttgtctgctttctgccat

SEQ ID NO: 109357 - DNA, 22 bp, Artificial Sequence
  Synthetic oligonucleotide; CTC chr11 5379883 5379904 5379900 5379905 +
tttgtctgctttctgccatgtt

SEQ ID NO: 109358 - DNA, 22 bp, Artificial Sequence
  Synthetic oligonucleotide; CTT chr11 5379885 5379906 5379902 5379907 +
tgtctgctttctgccatgtttg

SEQ ID NO: 109359 - DNA, 22 bp, Artificial Sequence
  Synthetic oligonucleotide; TTT chr11 5379886 5379907 5379903 5379908 +
gtctgctttctgccatgtttgg

SEQ ID NO: 109360 - DNA, 22 bp, Artificial Sequence
  Synthetic oligonucleotide; TTG chr11 5379887 5379908 5379904 5379909 +
tctgctttctgccatgtttgga

SEQ ID NO: 109361 - DNA, 22 bp, Artificial Sequence
  Synthetic oligonucleotide; CTG chr11 5379891 5379912 5379908 5379913 +
ctttctgccatgtttggaacca

SEQ ID NO: 109362 - DNA, 22 bp, Artificial Sequence
  Synthetic oligonucleotide; CTT chr11 5379894 5379915 5379911 5379916 +
tctgccatgtttggaaccagca

SEQ ID NO: 109363 - DNA, 22 bp, Artificial Sequence
  Synthetic oligonucleotide; TTT chr11 5379895 5379916 5379912 5379917 +
ctgccatgtttggaaccagcat

SEQ ID NO: 109364 - DNA, 22 bp, Artificial Sequence
  Synthetic oligonucleotide; TTC chr11 5379896 5379917 5379913 5379918 +
tgccatgtttggaaccagcatg

SEQ ID NO: 109365 - DNA, 22 bp, Artificial Sequence
  Synthetic oligonucleotide; CTG chr11 5379898 5379919 5379915 5379920 +
ccatgtttggaaccagcatgag

SEQ ID NO: 109366 - DNA, 22 bp, Artificial Sequence
  Synthetic oligonucleotide; TTT chr11 5379906 5379927 5379923 5379928 +
ggaaccagcatgagacctttat

SEQ ID NO: 109367 - DNA, 22 bp, Artificial Sequence
  Synthetic oligonucleotide; TTG chr11 5379907 5379928 5379924 5379929 +
gaaccagcatgagacctttatc

SEQ ID NO: 109368 - DNA, 22 bp, Artificial Sequence
  Synthetic oligonucleotide; CTT chr11 5379925 5379946 5379942 5379947 +
tatcagatgcaaccgcccgatc

SEQ ID NO: 109369 - DNA, 22 bp, Artificial Sequence
  Synthetic oligonucleotide; TTT chr11 5379926 5379947 5379943 5379948 +
atcagatgcaaccgcccgatct

SEQ ID NO: 109370 - DNA, 22 bp, Artificial Sequence
  Synthetic oligonucleotide; TTA chr11 5379927 5379948 5379944 5379949 +
tcagatgcaaccgcccgatctt

SEQ ID NO: 109371 - DNA, 22 bp, Artificial Sequence
  Synthetic oligonucleotide; CTT chr11 5379949 5379970 5379966 5379971 +
ggacttttaagtcaccagaatc

SEQ ID NO: 109372 - DNA, 22 bp, Artificial Sequence
  Synthetic oligonucleotide; TTG chr11 5379950 5379971 5379967 5379972 +
gacttttaagtcaccagaatca

SEQ ID NO: 109373 - DNA, 22 bp, Artificial Sequence
  Synthetic oligonucleotide; CTT chr11 5379955 5379976 5379972 5379977 +
ttaagtcaccagaatcatgaac

SEQ ID NO: 109374 - DNA, 22 bp, Artificial Sequence
  Synthetic oligonucleotide; TTT chr11 5379956 5379977 5379973 5379978 +
taagtcaccagaatcatgaacc

SEQ ID NO: 109375 - DNA, 22 bp, Artificial Sequence
  Synthetic oligonucleotide; TTT chr11 5379957 5379978 5379974 5379979 +
aagtcaccagaatcatgaacca

SEQ ID NO: 109376 - DNA, 22 bp, Artificial Sequence
  Synthetic oligonucleotide; TTA chr11 5379958 5379979 5379975 5379980 +
agtcaccagaatcatgaaccaa

SEQ ID NO: 109377 - DNA, 22 bp, Artificial Sequence
  Synthetic oligonucleotide; CTT chr11 5379989 5380010 5380006 5380011 +
taaaaaaaaaaaataagctacc

SEQ ID NO: 109378 - DNA, 22 bp, Artificial Sequence
  Synthetic oligonucleotide; TTT chr11 5379990 5380011 5380007 5380012 +
aaaaaaaaaaaataagctaccc

SEQ ID NO: 109379 - DNA, 22 bp, Artificial Sequence
  Synthetic oligonucleotide; TTA chr11 5379991 5380012 5380008 5380013 +
aaaaaaaaaaataagctaccca

SEQ ID NO: 109380 - DNA, 22 bp, Artificial Sequence
  Synthetic oligonucleotide; CTA chr11 5380009 5380030 5380026 5380031 +
cccagactcaggtactctgtta

SEQ ID NO: 109381 - DNA, 22 bp, Artificial Sequence
  Synthetic oligonucleotide; CTC chr11 5380018 5380039 5380035 5380040 +
aggtactctgttatagcaaatc

SEQ ID NO: 109382 - DNA, 22 bp, Artificial Sequence
  Synthetic oligonucleotide; CTC chr11 5380026 5380047 5380043 5380048 +
tgttatagcaaatcaaaatatg

SEQ ID NO: 109383 - DNA, 22 bp, Artificial Sequence
  Synthetic oligonucleotide; CTG chr11 5380028 5380049 5380045 5380050 +
ttatagcaaatcaaaatatgca

SEQ ID NO: 109384 - DNA, 22 bp, Artificial Sequence
  Synthetic oligonucleotide; TTA chr11 5380031 5380052 5380048 5380053 +
tagcaaatcaaaatatgcaaaa

SEQ ID NO: 109385 - DNA, 22 bp, Artificial Sequence
  Synthetic oligonucleotide; CTA chr11 5380060 5380081 5380077 5380082 +
aaactttagcccaacttggagt

SEQ ID NO: 109386 - DNA, 22 bp, Artificial Sequence
  Synthetic oligonucleotide; CTT chr11 5380066 5380087 5380083 5380088 +
tagcccaacttggagtggggag

SEQ ID NO: 109387 - DNA, 22 bp, Artificial Sequence
  Synthetic oligonucleotide; TTT chr11 5380067 5380088 5380084 5380089 +
agcccaacttggagtggggaga

SEQ ID NO: 109388 - DNA, 22 bp, Artificial Sequence
  Synthetic oligonucleotide; TTA chr11 5380068 5380089 5380085 5380090 +
gcccaacttggagtggggagaa

SEQ ID NO: 109389 - DNA, 22 bp, Artificial Sequence
  Synthetic oligonucleotide; CTT chr11 5380077 5380098 5380094 5380099 +
ggagtggggagaagagatggtt

SEQ ID NO: 109390 - DNA, 22 bp, Artificial Sequence
  Synthetic oligonucleotide; TTG chr11 5380078 5380099 5380095 5380100 +
gagtggggagaagagatggttt

SEQ ID NO: 109391 - DNA, 22 bp, Artificial Sequence
  Synthetic oligonucleotide; TTT chr11 5380100 5380121 5380117 5380122 +
cccaaaaggggtctctctgaaa

SEQ ID NO: 109392 - DNA, 22 bp, Artificial Sequence
  Synthetic oligonucleotide; TTC chr11 5380101 5380122 5380118 5380123 +
ccaaaaggggtctctctgaaaa

SEQ ID NO: 109393 - DNA, 22 bp, Artificial Sequence
  Synthetic oligonucleotide; CTC chr11 5380115 5380136 5380132 5380137 +
tctgaaaagttttcacaatgaa

SEQ ID NO: 109394 - DNA, 22 bp, Artificial Sequence
  Synthetic oligonucleotide; CTC chr11 5380117 5380138 5380134 5380139 +
tgaaaagttttcacaatgaaaa

SEQ ID NO: 109395 - DNA, 22 bp, Artificial Sequence
  Synthetic oligonucleotide; CTG chr11 5380119 5380140 5380136 5380141 +
aaaagttttcacaatgaaaatg

SEQ ID NO: 109396 - DNA, 22 bp, Artificial Sequence
  Synthetic oligonucleotide; TTT chr11 5380127 5380148 5380144 5380149 +
tcacaatgaaaatgaaaatcgg

SEQ ID NO: 109397 - DNA, 22 bp, Artificial Sequence
  Synthetic oligonucleotide; TTT chr11 5380128 5380149 5380145 5380150 +
cacaatgaaaatgaaaatcggt

SEQ ID NO: 109398 - DNA, 22 bp, Artificial Sequence
  Synthetic oligonucleotide; TTC chr11 5380129 5380150 5380146 5380151 +
acaatgaaaatgaaaatcggtt

SEQ ID NO: 109399 - DNA, 22 bp, Artificial Sequence
  Synthetic oligonucleotide; TTC chr11 5380152 5380173 5380169 5380174 +
cctttcataatgactgaagaga

SEQ ID NO: 109400 - DNA, 22 bp, Artificial Sequence
  Synthetic oligonucleotide; CTT chr11 5380156 5380177 5380173 5380178 +
tcataatgactgaagagaggta

SEQ ID NO: 109401 - DNA, 22 bp, Artificial Sequence
  Synthetic oligonucleotide; TTT chr11 5380157 5380178 5380174 5380179 +
cataatgactgaagagaggtag

SEQ ID NO: 109402 - DNA, 22 bp, Artificial Sequence
  Synthetic oligonucleotide; TTC chr11 5380158 5380179 5380175 5380180 +
ataatgactgaagagaggtagg

SEQ ID NO: 109403 - DNA, 22 bp, Artificial Sequence
  Synthetic oligonucleotide; CTG chr11 5380168 5380189 5380185 5380190 +
aagagaggtaggatgttacgaa

SEQ ID NO: 109404 - DNA, 22 bp, Artificial Sequence
  Synthetic oligonucleotide; TTA chr11 5380186 5380207 5380203 5380208 +
cgaaagaaggcgtttctgaaag

SEQ ID NO: 109405 - DNA, 22 bp, Artificial Sequence
  Synthetic oligonucleotide; TTT chr11 5380201 5380222 5380218 5380223 +
ctgaaagagttgctgtgggaag

SEQ ID NO: 109406 - DNA, 22 bp, Artificial Sequence
  Synthetic oligonucleotide; TTC chr11 5380202 5380223 5380219 5380224 +
tgaaagagttgctgtgggaaga

SEQ ID NO: 109407 - DNA, 22 bp, Artificial Sequence
  Synthetic oligonucleotide; CTG chr11 5380204 5380225 5380221 5380226 +
aaagagttgctgtgggaagatg

SEQ ID NO: 109408 - DNA, 22 bp, Artificial Sequence
  Synthetic oligonucleotide; TTG chr11 5380213 5380234 5380230 5380235 +
ctgtgggaagatgtggagactt

SEQ ID NO: 109409 - DNA, 22 bp, Artificial Sequence
  Synthetic oligonucleotide; CTG chr11 5380216 5380237 5380233 5380238 +
tgggaagatgtggagacttctc

SEQ ID NO: 109410 - DNA, 22 bp, Artificial Sequence
  Synthetic oligonucleotide; CTT chr11 5380235 5380256 5380252 5380257 +
ctctgtaaaccttccagactct

SEQ ID NO: 109411 - DNA, 22 bp, Artificial Sequence
  Synthetic oligonucleotide; TTC chr11 5380236 5380257 5380253 5380258 +
tctgtaaaccttccagactctc

SEQ ID NO: 109412 - DNA, 22 bp, Artificial Sequence
  Synthetic oligonucleotide; CTC chr11 5380238 5380259 5380255 5380260 +
tgtaaaccttccagactctctg

SEQ ID NO: 109413 - DNA, 22 bp, Artificial Sequence
  Synthetic oligonucleotide; CTG chr11 5380240 5380261 5380257 5380262 +
taaaccttccagactctctgtg

SEQ ID NO: 109414 - DNA, 22 bp, Artificial Sequence
  Synthetic oligonucleotide; CTT chr11 5380248 5380269 5380265 5380270 +
ccagactctctgtgcacacaca

SEQ ID NO: 109415 - DNA, 22 bp, Artificial Sequence
  Synthetic oligonucleotide; TTC chr11 5380249 5380270 5380266 5380271 +
cagactctctgtgcacacacag

SEQ ID NO: 109416 - DNA, 22 bp, Artificial Sequence
  Synthetic oligonucleotide; CTC chr11 5380256 5380277 5380273 5380278 +
tctgtgcacacacagatgcagg

SEQ ID NO: 109417 - DNA, 22 bp, Artificial Sequence
  Synthetic oligonucleotide; CTC chr11 5380258 5380279 5380275 5380280 +
tgtgcacacacagatgcaggtg

SEQ ID NO: 109418 - DNA, 22 bp, Artificial Sequence
  Synthetic oligonucleotide; CTG chr11 5380260 5380281 5380277 5380282 +
tgcacacacagatgcaggtgtc

SEQ ID NO: 109419 - DNA, 22 bp, Artificial Sequence
  Synthetic oligonucleotide; TTG chr11 5380314 5380335 5380331 5380336 +
caacatgaaaatttcttagggg

SEQ ID NO: 109420 - DNA, 22 bp, Artificial Sequence
  Synthetic oligonucleotide; TTT chr11 5380328 5380349 5380345 5380350 +
cttaggggctgtggaccagtcc

SEQ ID NO: 109421 - DNA, 22 bp, Artificial Sequence
  Synthetic oligonucleotide; TTC chr11 5380329 5380350 5380346 5380351 +
ttaggggctgtggaccagtcca

SEQ ID NO: 109422 - DNA, 22 bp, Artificial Sequence
  Synthetic oligonucleotide; CTT chr11 5380331 5380352 5380348 5380353 +
aggggctgtggaccagtccaga

SEQ ID NO: 109423 - DNA, 22 bp, Artificial Sequence
  Synthetic oligonucleotide; TTA chr11 5380332 5380353 5380349 5380354 +
ggggctgtggaccagtccagaa

SEQ ID NO: 109424 - DNA, 22 bp, Artificial Sequence
  Synthetic oligonucleotide; CTG chr11 5380339 5380360 5380356 5380361 +
tggaccagtccagaagaccctt

SEQ ID NO: 109425 - DNA, 22 bp, Artificial Sequence
  Synthetic oligonucleotide; CTT chr11 5380361 5380382 5380378 5380383 +
ttggcaatcctaacttctgtgg

SEQ ID NO: 109426 - DNA, 22 bp, Artificial Sequence
  Synthetic oligonucleotide; TTT chr11 5380362 5380383 5380379 5380384 +
tggcaatcctaacttctgtggg

SEQ ID NO: 109427 - DNA, 22 bp, Artificial Sequence
  Synthetic oligonucleotide; TTT chr11 5380363 5380384 5380380 5380385 +
ggcaatcctaacttctgtgggt

SEQ ID NO: 109428 - DNA, 22 bp, Artificial Sequence
  Synthetic oligonucleotide; TTG chr11 5380364 5380385 5380381 5380386 +
gcaatcctaacttctgtgggtc

SEQ ID NO: 109429 - DNA, 22 bp, Artificial Sequence
  Synthetic oligonucleotide; CTA chr11 5380373 5380394 5380390 5380395 +
acttctgtgggtctctccagtc

SEQ ID NO: 109430 - DNA, 22 bp, Artificial Sequence
  Synthetic oligonucleotide; CTT chr11 5380377 5380398 5380394 5380399 +
ctgtgggtctctccagtctgaa

SEQ ID NO: 109431 - DNA, 22 bp, Artificial Sequence
  Synthetic oligonucleotide; TTC chr11 5380378 5380399 5380395 5380400 +
tgtgggtctctccagtctgaaa

SEQ ID NO: 109432 - DNA, 22 bp, Artificial Sequence
  Synthetic oligonucleotide; CTG chr11 5380380 5380401 5380397 5380402 +
tgggtctctccagtctgaaaga

SEQ ID NO: 109433 - DNA, 22 bp, Artificial Sequence
  Synthetic oligonucleotide; CTC chr11 5380388 5380409 5380405 5380410 +
tccagtctgaaagacccgcatc

SEQ ID NO: 109434 - DNA, 22 bp, Artificial Sequence
  Synthetic oligonucleotide; CTC chr11 5380390 5380411 5380407 5380412 +
cagtctgaaagacccgcatcga

SEQ ID NO: 109435 - DNA, 22 bp, Artificial Sequence
  Synthetic oligonucleotide; CTG chr11 5380397 5380418 5380414 5380419 +
aaagacccgcatcgatctcaca

SEQ ID NO: 109436 - DNA, 22 bp, Artificial Sequence
  Synthetic oligonucleotide; CTC chr11 5380416 5380437 5380433 5380438 +
acaccacaaaatggagttcttc

SEQ ID NO: 109437 - DNA, 22 bp, Artificial Sequence
  Synthetic oligonucleotide; TTC chr11 5380435 5380456 5380452 5380457 +
ttctgggaaggacttgttctaa

SEQ ID NO: 109438 - DNA, 22 bp, Artificial Sequence
  Synthetic oligonucleotide; CTT chr11 5380437 5380458 5380454 5380459 +
ctgggaaggacttgttctaaca

SEQ ID NO: 109439 - DNA, 22 bp, Artificial Sequence
  Synthetic oligonucleotide; TTC chr11 5380438 5380459 5380455 5380460 +
tgggaaggacttgttctaacag

SEQ ID NO: 109440 - DNA, 22 bp, Artificial Sequence
  Synthetic oligonucleotide; CTG chr11 5380440 5380461 5380457 5380462 +
ggaaggacttgttctaacaggc

SEQ ID NO: 109441 - DNA, 22 bp, Artificial Sequence
  Synthetic oligonucleotide; CTT chr11 5380450 5380471 5380467 5380472 +
gttctaacaggcctgagagtga

SEQ ID NO: 109442 - DNA, 22 bp, Artificial Sequence
  Synthetic oligonucleotide; TTG chr11 5380451 5380472 5380468 5380473 +
ttctaacaggcctgagagtgag

SEQ ID NO: 109443 - DNA, 22 bp, Artificial Sequence
  Synthetic oligonucleotide; TTC chr11 5380454 5380475 5380471 5380476 +
taacaggcctgagagtgaggtg

SEQ ID NO: 109444 - DNA, 22 bp, Artificial Sequence
  Synthetic oligonucleotide; CTA chr11 5380456 5380477 5380473 5380478 +
acaggcctgagagtgaggtgac

SEQ ID NO: 109445 - DNA, 22 bp, Artificial Sequence
  Synthetic oligonucleotide; CTG chr11 5380465 5380486 5380482 5380487 +
agagtgaggtgaccttgtggcc

SEQ ID NO: 109446 - DNA, 22 bp, Artificial Sequence
  Synthetic oligonucleotide; CTT chr11 5380481 5380502 5380498 5380503 +
gtggccattttctgtgacagag

SEQ ID NO: 109447 - DNA, 22 bp, Artificial Sequence
  Synthetic oligonucleotide; TTG chr11 5380482 5380503 5380499 5380504 +
tggccattttctgtgacagaga

SEQ ID NO: 109448 - DNA, 22 bp, Artificial Sequence
  Synthetic oligonucleotide; TTT chr11 5380491 5380512 5380508 5380513 +
tctgtgacagagacacctaaaa

SEQ ID NO: 109449 - DNA, 22 bp, Artificial Sequence
  Synthetic oligonucleotide; TTT chr11 5380492 5380513 5380509 5380514 +
ctgtgacagagacacctaaaaa

SEQ ID NO: 109450 - DNA, 22 bp, Artificial Sequence
  Synthetic oligonucleotide; TTC chr11 5380493 5380514 5380510 5380515 +
tgtgacagagacacctaaaaag

SEQ ID NO: 109451 - DNA, 22 bp, Artificial Sequence
  Synthetic oligonucleotide; CTG chr11 5380495 5380516 5380512 5380517 +
tgacagagacacctaaaaagag

SEQ ID NO: 109452 - DNA, 22 bp, Artificial Sequence
  Synthetic oligonucleotide; CTA chr11 5380510 5380531 5380527 5380532 +
aaaagagtctgttgtgagtctg

SEQ ID NO: 109453 - DNA, 22 bp, Artificial Sequence
  Synthetic oligonucleotide; CTG chr11 5380521 5380542 5380538 5380543 +
ttgtgagtctggagacattgag

SEQ ID NO: 109454 - DNA, 22 bp, Artificial Sequence
  Synthetic oligonucleotide; TTG chr11 5380524 5380545 5380541 5380546 +
tgagtctggagacattgagaac

SEQ ID NO: 109455 - DNA, 22 bp, Artificial Sequence
  Synthetic oligonucleotide; CTG chr11 5380532 5380553 5380549 5380554 +
gagacattgagaaccctgtgag

SEQ ID NO: 109456 - DNA, 22 bp, Artificial Sequence
  Synthetic oligonucleotide; TTG chr11 5380541 5380562 5380558 5380563 +
agaaccctgtgagtaaggattt

SEQ ID NO: 109457 - DNA, 22 bp, Artificial Sequence
  Synthetic oligonucleotide; CTG chr11 5380550 5380571 5380567 5380572 +
tgagtaaggattttatttaggt

SEQ ID NO: 109458 - DNA, 22 bp, Artificial Sequence
  Synthetic oligonucleotide; TTT chr11 5380563 5380584 5380580 5380585 +
tatttaggtctgtttctggtca

SEQ ID NO: 109459 - DNA, 22 bp, Artificial Sequence
  Synthetic oligonucleotide; TTT chr11 5380564 5380585 5380581 5380586 +
atttaggtctgtttctggtcag

SEQ ID NO: 109460 - DNA, 22 bp, Artificial Sequence
  Synthetic oligonucleotide; TTA chr11 5380565 5380586 5380582 5380587 +
tttaggtctgtttctggtcaga

SEQ ID NO: 109461 - DNA, 22 bp, Artificial Sequence
  Synthetic oligonucleotide; TTT chr11 5380568 5380589 5380585 5380590 +
aggtctgtttctggtcagagtg

SEQ ID NO: 109462 - DNA, 22 bp, Artificial Sequence
  Synthetic oligonucleotide; TTA chr11 5380569 5380590 5380586 5380591 +
ggtctgtttctggtcagagtgg

SEQ ID NO: 109463 - DNA, 22 bp, Artificial Sequence
  Synthetic oligonucleotide; CTG chr11 5380575 5380596 5380592 5380597 +
tttctggtcagagtggggattt

SEQ ID NO: 109464 - DNA, 22 bp, Artificial Sequence
  Synthetic oligonucleotide; TTT chr11 5380578 5380599 5380595 5380600 +
ctggtcagagtggggatttaag

SEQ ID NO: 109465 - DNA, 22 bp, Artificial Sequence
  Synthetic oligonucleotide; TTC chr11 5380579 5380600 5380596 5380601 +
tggtcagagtggggatttaagg

SEQ ID NO: 109466 - DNA, 22 bp, Artificial Sequence
  Synthetic oligonucleotide; CTG chr11 5380581 5380602 5380598 5380603 +
gtcagagtggggatttaaggct

SEQ ID NO: 109467 - DNA, 22 bp, Artificial Sequence
  Synthetic oligonucleotide; TTT chr11 5380597 5380618 5380614 5380619 +
aaggcttggtcaatatgattaa

SEQ ID NO: 109468 - DNA, 22 bp, Artificial Sequence
  Synthetic oligonucleotide; TTA chr11 5380598 5380619 5380615 5380620 +
aggcttggtcaatatgattaag

SEQ ID NO: 109469 - DNA, 22 bp, Artificial Sequence
  Synthetic oligonucleotide; CTT chr11 5380604 5380625 5380621 5380626 +
ggtcaatatgattaagactaaa

SEQ ID NO: 109470 - DNA, 22 bp, Artificial Sequence
  Synthetic oligonucleotide; TTG chr11 5380605 5380626 5380622 5380627 +
gtcaatatgattaagactaaag

SEQ ID NO: 109471 - DNA, 22 bp, Artificial Sequence
  Synthetic oligonucleotide; TTA chr11 5380618 5380639 5380635 5380640 +
agactaaaggccacacacatag

SEQ ID NO: 109472 - DNA, 22 bp, Artificial Sequence
  Synthetic oligonucleotide; CTA chr11 5380624 5380645 5380641 5380646 +
aaggccacacacatagatttgt

SEQ ID NO: 109473 - DNA, 22 bp, Artificial Sequence
  Synthetic oligonucleotide; TTT chr11 5380644 5380665 5380661 5380666 +
gtgtgagattaccatctgtaaa

SEQ ID NO: 109474 - DNA, 22 bp, Artificial Sequence
  Synthetic oligonucleotide; TTG chr11 5380645 5380666 5380662 5380667 +
tgtgagattaccatctgtaaaa

SEQ ID NO: 109475 - DNA, 22 bp, Artificial Sequence
  Synthetic oligonucleotide; TTA chr11 5380655 5380676 5380672 5380677 +
ccatctgtaaaaatctgaaaaa

SEQ ID NO: 109476 - DNA, 22 bp, Artificial Sequence
  Synthetic oligonucleotide; CTG chr11 5380662 5380683 5380679 5380684 +
taaaaatctgaaaaagctaaga

SEQ ID NO: 109477 - DNA, 22 bp, Artificial Sequence
  Synthetic oligonucleotide; CTG chr11 5380672 5380693 5380689 5380694 +
aaaaagctaagaaaacctatct

SEQ ID NO: 109478 - DNA, 22 bp, Artificial Sequence
  Synthetic oligonucleotide; CTA chr11 5380681 5380702 5380698 5380703 +
agaaaacctatctctctccatc

SEQ ID NO: 109479 - DNA, 22 bp, Artificial Sequence
  Synthetic oligonucleotide; CTA chr11 5380691 5380712 5380708 5380713 +
tctctctccatcaattttagtt

SEQ ID NO: 109480 - DNA, 22 bp, Artificial Sequence
  Synthetic oligonucleotide; CTC chr11 5380695 5380716 5380712 5380717 +
tctccatcaattttagttttta

SEQ ID NO: 109481 - DNA, 22 bp, Artificial Sequence
  Synthetic oligonucleotide; CTC chr11 5380697 5380718 5380714 5380719 +
tccatcaattttagtttttatg

SEQ ID NO: 109482 - DNA, 22 bp, Artificial Sequence
  Synthetic oligonucleotide; CTC chr11 5380699 5380720 5380716 5380721 +
catcaattttagtttttatgtg

SEQ ID NO: 109483 - DNA, 22 bp, Artificial Sequence
  Synthetic oligonucleotide; TTT chr11 5380708 5380729 5380725 5380730 +
tagtttttatgtgtttgtaaga

SEQ ID NO: 109484 - DNA, 22 bp, Artificial Sequence
  Synthetic oligonucleotide; TTT chr11 5380709 5380730 5380726 5380731 +
agtttttatgtgtttgtaagat

SEQ ID NO: 109485 - DNA, 22 bp, Artificial Sequence
  Synthetic oligonucleotide; TTA chr11 5380710 5380731 5380727 5380732 +
gtttttatgtgtttgtaagatg

SEQ ID NO: 109486 - DNA, 22 bp, Artificial Sequence
  Synthetic oligonucleotide; TTT chr11 5380714 5380735 5380731 5380736 +
ttatgtgtttgtaagatgtaga

SEQ ID NO: 109487 - DNA, 22 bp, Artificial Sequence
  Synthetic oligonucleotide; TTT chr11 5380715 5380736 5380732 5380737 +
tatgtgtttgtaagatgtagat

SEQ ID NO: 109488 - DNA, 22 bp, Artificial Sequence
  Synthetic oligonucleotide; TTT chr11 5380716 5380737 5380733 5380738 +
atgtgtttgtaagatgtagata

SEQ ID NO: 109489 - DNA, 22 bp, Artificial Sequence
  Synthetic oligonucleotide; TTA chr11 5380717 5380738 5380734 5380739 +
tgtgtttgtaagatgtagatat

SEQ ID NO: 109490 - DNA, 22 bp, Artificial Sequence
  Synthetic oligonucleotide; TTT chr11 5380724 5380745 5380741 5380746 +
gtaagatgtagatatgtctatt

SEQ ID NO: 109491 - DNA, 22 bp, Artificial Sequence
  Synthetic oligonucleotide; TTG chr11 5380725 5380746 5380742 5380747 +
taagatgtagatatgtctattt

SEQ ID NO: 109492 - DNA, 22 bp, Artificial Sequence
  Synthetic oligonucleotide; CTA chr11 5380744 5380765 5380761 5380766 +
ttttgtgcatgagagagaggaa

SEQ ID NO: 109493 - DNA, 22 bp, Artificial Sequence
  Synthetic oligonucleotide; TTT chr11 5380747 5380768 5380764 5380769 +
tgtgcatgagagagaggaagat

SEQ ID NO: 109494 - DNA, 22 bp, Artificial Sequence
  Synthetic oligonucleotide; TTT chr11 5380748 5380769 5380765 5380770 +
gtgcatgagagagaggaagatc

SEQ ID NO: 109495 - DNA, 22 bp, Artificial Sequence
  Synthetic oligonucleotide; TTG chr11 5380749 5380770 5380766 5380771 +
tgcatgagagagaggaagatca

SEQ ID NO: 109496 - DNA, 22 bp, Artificial Sequence
  Synthetic oligonucleotide; CTC chr11 5380776 5380797 5380793 5380798 +
aaaggaagaatgaactggttgg

SEQ ID NO: 109497 - DNA, 22 bp, Artificial Sequence
  Synthetic oligonucleotide; CTG chr11 5380793 5380814 5380810 5380815 +
gttggcagctttcagctgtgta

SEQ ID NO: 109498 - DNA, 22 bp, Artificial Sequence
  Synthetic oligonucleotide; TTG chr11 5380797 5380818 5380814 5380819 +
gcagctttcagctgtgtagtgg

SEQ ID NO: 109499 - DNA, 22 bp, Artificial Sequence
  Synthetic oligonucleotide; CTT chr11 5380804 5380825 5380821 5380826 +
tcagctgtgtagtgggtattga

SEQ ID NO: 109500 - DNA, 22 bp, Artificial Sequence
  Synthetic oligonucleotide; TTT chr11 5380805 5380826 5380822 5380827 +
cagctgtgtagtgggtattgag

SEQ ID NO: 109501 - DNA, 22 bp, Artificial Sequence
  Synthetic oligonucleotide; TTC chr11 5380806 5380827 5380823 5380828 +
agctgtgtagtgggtattgagg

SEQ ID NO: 109502 - DNA, 22 bp, Artificial Sequence
  Synthetic oligonucleotide; CTG chr11 5380811 5380832 5380828 5380833 +
tgtagtgggtattgaggacacg

SEQ ID NO: 109503 - DNA, 22 bp, Artificial Sequence
  Synthetic oligonucleotide; TTG chr11 5380825 5380846 5380842 5380847 +
aggacacgggaaggtggtgctg

SEQ ID NO: 109504 - DNA, 22 bp, Artificial Sequence
  Synthetic oligonucleotide; CTG chr11 5380847 5380868 5380864 5380869 +
gaagaaaagccacattttcttg

SEQ ID NO: 109505 - DNA, 22 bp, Artificial Sequence
  Synthetic oligonucleotide; TTT chr11 5380864 5380885 5380881 5380886 +
tcttgtgccctggggatagtag

SEQ ID NO: 109506 - DNA, 22 bp, Artificial Sequence
  Synthetic oligonucleotide; TTT chr11 5380865 5380886 5380882 5380887 +
cttgtgccctggggatagtagg

SEQ ID NO: 109507 - DNA, 22 bp, Artificial Sequence
  Synthetic oligonucleotide; TTC chr11 5380866 5380887 5380883 5380888 +
ttgtgccctggggatagtaggg

SEQ ID NO: 109508 - DNA, 22 bp, Artificial Sequence
  Synthetic oligonucleotide; CTT chr11 5380868 5380889 5380885 5380890 +
gtgccctggggatagtagggcc

SEQ ID NO: 109509 - DNA, 22 bp, Artificial Sequence
  Synthetic oligonucleotide; TTG chr11 5380869 5380890 5380886 5380891 +
tgccctggggatagtagggcct

SEQ ID NO: 109510 - DNA, 22 bp, Artificial Sequence
  Synthetic oligonucleotide; CTG chr11 5380876 5380897 5380893 5380898 +
gggatagtagggccttggtgct

SEQ ID NO: 109511 - DNA, 22 bp, Artificial Sequence
  Synthetic oligonucleotide; CTT chr11 5380892 5380913 5380909 5380914 +
ggtgctggtcagaatttaagcc

SEQ ID NO: 109512 - DNA, 22 bp, Artificial Sequence
  Synthetic oligonucleotide; TTG chr11 5380893 5380914 5380910 5380915 +
gtgctggtcagaatttaagcct

SEQ ID NO: 109513 - DNA, 22 bp, Artificial Sequence
  Synthetic oligonucleotide; CTG chr11 5380899 5380920 5380916 5380921 +
gtcagaatttaagcctatcctt

SEQ ID NO: 109514 - DNA, 22 bp, Artificial Sequence
  Synthetic oligonucleotide; TTT chr11 5380909 5380930 5380926 5380931 +
aagcctatccttgggctgaatg

SEQ ID NO: 109515 - DNA, 22 bp, Artificial Sequence
  Synthetic oligonucleotide; TTA chr11 5380910 5380931 5380927 5380932 +
agcctatccttgggctgaatgc

SEQ ID NO: 109516 - DNA, 22 bp, Artificial Sequence
  Synthetic oligonucleotide; CTA chr11 5380916 5380937 5380933 5380938 +
tccttgggctgaatgctccccc

SEQ ID NO: 109517 - DNA, 22 bp, Artificial Sequence
  Synthetic oligonucleotide; CTT chr11 5380921 5380942 5380938 5380943 +
gggctgaatgctccccctggtg

SEQ ID NO: 109518 - DNA, 22 bp, Artificial Sequence
  Synthetic oligonucleotide; TTG chr11 5380922 5380943 5380939 5380944 +
ggctgaatgctccccctggtgg

SEQ ID NO: 109519 - DNA, 22 bp, Artificial Sequence
  Synthetic oligonucleotide; CTG chr11 5380927 5380948 5380944 5380949 +
aatgctccccctggtggctaca

SEQ ID NO: 109520 - DNA, 22 bp, Artificial Sequence
  Synthetic oligonucleotide; CTC chr11 5380934 5380955 5380951 5380956 +
cccctggtggctacattggaaa

SEQ ID NO: 109521 - DNA, 22 bp, Artificial Sequence
  Synthetic oligonucleotide; CTG chr11 5380940 5380961 5380957 5380962 +
gtggctacattggaaaaccaca

SEQ ID NO: 109522 - DNA, 22 bp, Artificial Sequence
  Synthetic oligonucleotide; CTA chr11 5380947 5380968 5380964 5380969 +
cattggaaaaccacagcatgtg

SEQ ID NO: 109523 - DNA, 22 bp, Artificial Sequence
  Synthetic oligonucleotide; TTG chr11 5380952 5380973 5380969 5380974 +
gaaaaccacagcatgtgtacag

SEQ ID NO: 109524 - DNA, 22 bp, Artificial Sequence
  Synthetic oligonucleotide; CTT chr11 5380979 5381000 5380996 5381001 +
ggggattcagttctcctgaagg

SEQ ID NO: 109525 - DNA, 22 bp, Artificial Sequence
  Synthetic oligonucleotide; TTG chr11 5380980 5381001 5380997 5381002 +
gggattcagttctcctgaagga

SEQ ID NO: 109526 - DNA, 22 bp, Artificial Sequence
  Synthetic oligonucleotide; TTC chr11 5380987 5381008 5381004 5381009 +
agttctcctgaaggaatctcct

SEQ ID NO: 109527 - DNA, 22 bp, Artificial Sequence
  Synthetic oligonucleotide; TTC chr11 5380992 5381013 5381009 5381014 +
tcctgaaggaatctcctacttc

SEQ ID NO: 109528 - DNA, 22 bp, Artificial Sequence
  Synthetic oligonucleotide; CTC chr11 5380994 5381015 5381011 5381016 +
ctgaaggaatctcctacttcac

SEQ ID NO: 109529 - DNA, 22 bp, Artificial Sequence
  Synthetic oligonucleotide; CTG chr11 5380997 5381018 5381014 5381019 +
aaggaatctcctacttcaccaa

SEQ ID NO: 109530 - DNA, 22 bp, Artificial Sequence
  Synthetic oligonucleotide; CTC chr11 5381007 5381028 5381024 5381029 +
ctacttcaccaagcctggctca

SEQ ID NO: 109531 - DNA, 22 bp, Artificial Sequence
  Synthetic oligonucleotide; CTA chr11 5381010 5381031 5381027 5381032 +
cttcaccaagcctggctcagtg

SEQ ID NO: 109532 - DNA, 22 bp, Artificial Sequence
  Synthetic oligonucleotide; CTT chr11 5381013 5381034 5381030 5381035 +
caccaagcctggctcagtgggc

SEQ ID NO: 109533 - DNA, 22 bp, Artificial Sequence
  Synthetic oligonucleotide; TTC chr11 5381014 5381035 5381031 5381036 +
accaagcctggctcagtgggct

SEQ ID NO: 109534 - DNA, 22 bp, Artificial Sequence
  Synthetic oligonucleotide; CTG chr11 5381024 5381045 5381041 5381046 +
gctcagtgggctggctaggtat

SEQ ID NO: 109535 - DNA, 22 bp, Artificial Sequence
  Synthetic oligonucleotide; CTC chr11 5381028 5381049 5381045 5381050 +
agtgggctggctaggtatcaat

SEQ ID NO: 109536 - DNA, 22 bp, Artificial Sequence
  Synthetic oligonucleotide; CTG chr11 5381037 5381058 5381054 5381059 +
gctaggtatcaattctggatag

SEQ ID NO: 109537 - DNA, 22 bp, Artificial Sequence
  Synthetic oligonucleotide; CTA chr11 5381041 5381062 5381058 5381063 +
ggtatcaattctggatagaggt

SEQ ID NO: 109538 - DNA, 22 bp, Artificial Sequence
  Synthetic oligonucleotide; TTC chr11 5381052 5381073 5381069 5381074 +
tggatagaggttccttaaataa

SEQ ID NO: 109539 - DNA, 22 bp, Artificial Sequence
  Synthetic oligonucleotide; CTG chr11 5381054 5381075 5381071 5381076 +
gatagaggttccttaaataaaa

SEQ ID NO: 109540 - DNA, 22 bp, Artificial Sequence
  Synthetic oligonucleotide; TTC chr11 5381065 5381086 5381082 5381087 +
cttaaataaaacttatactggc

SEQ ID NO: 109541 - DNA, 22 bp, Artificial Sequence
  Synthetic oligonucleotide; CTT chr11 5381068 5381089 5381085 5381090 +
aaataaaacttatactggcccc

SEQ ID NO: 109542 - DNA, 22 bp, Artificial Sequence
  Synthetic oligonucleotide; TTA chr11 5381069 5381090 5381086 5381091 +
aataaaacttatactggcccct

SEQ ID NO: 109543 - DNA, 22 bp, Artificial Sequence
  Synthetic oligonucleotide; CTT chr11 5381079 5381100 5381096 5381101 +
atactggccccttgaaagccag

SEQ ID NO: 109544 - DNA, 22 bp, Artificial Sequence
  Synthetic oligonucleotide; TTA chr11 5381080 5381101 5381097 5381102 +
tactggccccttgaaagccagg

SEQ ID NO: 109545 - DNA, 22 bp, Artificial Sequence
  Synthetic oligonucleotide; CTG chr11 5381085 5381106 5381102 5381107 +
gccccttgaaagccaggctttc

SEQ ID NO: 109546 - DNA, 22 bp, Artificial Sequence
  Synthetic oligonucleotide; CTT chr11 5381092 5381113 5381109 5381114 +
gaaagccaggctttccacccca

SEQ ID NO: 109547 - DNA, 22 bp, Artificial Sequence
  Synthetic oligonucleotide; TTG chr11 5381093 5381114 5381110 5381115 +
aaagccaggctttccaccccac

SEQ ID NO: 109548 - DNA, 22 bp, Artificial Sequence
  Synthetic oligonucleotide; CTT chr11 5381105 5381126 5381122 5381127 +
tccaccccaccatacccccacc

SEQ ID NO: 109549 - DNA, 22 bp, Artificial Sequence
  Synthetic oligonucleotide; TTT chr11 5381106 5381127 5381123 5381128 +
ccaccccaccatacccccaccc

SEQ ID NO: 109550 - DNA, 22 bp, Artificial Sequence
  Synthetic oligonucleotide; TTC chr11 5381107 5381128 5381124 5381129 +
caccccaccatacccccacccc

SEQ ID NO: 109551 - DNA, 22 bp, Artificial Sequence
  Synthetic oligonucleotide; CTC chr11 5381134 5381155 5381151 5381156 +
tctctctctgtcgctcgctcgc

SEQ ID NO: 109552 - DNA, 22 bp, Artificial Sequence
  Synthetic oligonucleotide; CTC chr11 5381136 5381157 5381153 5381158 +
tctctctgtcgctcgctcgctg

SEQ ID NO: 109553 - DNA, 22 bp, Artificial Sequence
  Synthetic oligonucleotide; CTC chr11 5381138 5381159 5381155 5381160 +
tctctgtcgctcgctcgctgtt

SEQ ID NO: 109554 - DNA, 22 bp, Artificial Sequence
  Synthetic oligonucleotide; CTC chr11 5381140 5381161 5381157 5381162 +
tctgtcgctcgctcgctgtttc

SEQ ID NO: 109555 - DNA, 22 bp, Artificial Sequence
  Synthetic oligonucleotide; CTC chr11 5381142 5381163 5381159 5381164 +
tgtcgctcgctcgctgtttctc

SEQ ID NO: 109556 - DNA, 22 bp, Artificial Sequence
  Synthetic oligonucleotide; CTG chr11 5381144 5381165 5381161 5381166 +
tcgctcgctcgctgtttctctc

SEQ ID NO: 109557 - DNA, 22 bp, Artificial Sequence
  Synthetic oligonucleotide; CTC chr11 5381150 5381171 5381167 5381172 +
gctcgctgtttctctctctctc

SEQ ID NO: 109558 - DNA, 22 bp, Artificial Sequence
  Synthetic oligonucleotide; CTC chr11 5381154 5381175 5381171 5381176 +
gctgtttctctctctctctctc

SEQ ID NO: 109559 - DNA, 22 bp, Artificial Sequence
  Synthetic oligonucleotide; CTG chr11 5381158 5381179 5381175 5381180 +
tttctctctctctctctcacac

SEQ ID NO: 109560 - DNA, 22 bp, Artificial Sequence
  Synthetic oligonucleotide; TTT chr11 5381161 5381182 5381178 5381183 +
ctctctctctctctcacacaca

SEQ ID NO: 109561 - DNA, 22 bp, Artificial Sequence
  Synthetic oligonucleotide; TTC chr11 5381162 5381183 5381179 5381184 +
tctctctctctctcacacacac

SEQ ID NO: 109562 - DNA, 22 bp, Artificial Sequence
  Synthetic oligonucleotide; CTC chr11 5381164 5381185 5381181 5381186 +
tctctctctctcacacacacac

SEQ ID NO: 109563 - DNA, 22 bp, Artificial Sequence
  Synthetic oligonucleotide; CTC chr11 5381166 5381187 5381183 5381188 +
tctctctctcacacacacacaa

SEQ ID NO: 109564 - DNA, 22 bp, Artificial Sequence
  Synthetic oligonucleotide; CTC chr11 5381168 5381189 5381185 5381190 +
tctctctcacacacacacaaac

SEQ ID NO: 109565 - DNA, 22 bp, Artificial Sequence
  Synthetic oligonucleotide; CTC chr11 5381170 5381191 5381187 5381192 +
tctctcacacacacacaaacaa

SEQ ID NO: 109566 - DNA, 22 bp, Artificial Sequence
  Synthetic oligonucleotide; CTC chr11 5381172 5381193 5381189 5381194 +
tctcacacacacacaaacaata

SEQ ID NO: 109567 - DNA, 22 bp, Artificial Sequence
  Synthetic oligonucleotide; CTC chr11 5381174 5381195 5381191 5381196 +
tcacacacacacaaacaatatt

SEQ ID NO: 109568 - DNA, 22 bp, Artificial Sequence
  Synthetic oligonucleotide; CTC chr11 5381176 5381197 5381193 5381198 +
acacacacacaaacaatattac

SEQ ID NO: 109569 - DNA, 22 bp, Artificial Sequence
  Synthetic oligonucleotide; TTA chr11 5381197 5381218 5381214 5381219 +
catgcaatgaaaaccatttgca

SEQ ID NO: 109570 - DNA, 22 bp, Artificial Sequence
  Synthetic oligonucleotide; TTT chr11 5381216 5381237 5381233 5381238 +
gcacattaacaaataggtacac

SEQ ID NO: 109571 - DNA, 22 bp, Artificial Sequence
  Synthetic oligonucleotide; TTG chr11 5381217 5381238 5381234 5381239 +
cacattaacaaataggtacact

SEQ ID NO: 109572 - DNA, 22 bp, Artificial Sequence
  Synthetic oligonucleotide; TTA chr11 5381224 5381245 5381241 5381246 +
acaaataggtacactgttacag

SEQ ID NO: 109573 - DNA, 22 bp, Artificial Sequence
  Synthetic oligonucleotide; CTG chr11 5381240 5381261 5381257 5381262 +
ttacagtgacacttttcacttt

SEQ ID NO: 109574 - DNA, 22 bp, Artificial Sequence
  Synthetic oligonucleotide; TTA chr11 5381243 5381264 5381260 5381265 +
cagtgacacttttcacttttag

SEQ ID NO: 109575 - DNA, 22 bp, Artificial Sequence
  Synthetic oligonucleotide; CTT chr11 5381254 5381275 5381271 5381276 +
ttcacttttagtaatggattta

SEQ ID NO: 109576 - DNA, 22 bp, Artificial Sequence
  Synthetic oligonucleotide; TTT chr11 5381255 5381276 5381272 5381277 +
tcacttttagtaatggatttag

SEQ ID NO: 109577 - DNA, 22 bp, Artificial Sequence
  Synthetic oligonucleotide; TTT chr11 5381256 5381277 5381273 5381278 +
cacttttagtaatggatttaga

SEQ ID NO: 109578 - DNA, 22 bp, Artificial Sequence
  Synthetic oligonucleotide; TTC chr11 5381257 5381278 5381274 5381279 +
acttttagtaatggatttagat

SEQ ID NO: 109579 - DNA, 22 bp, Artificial Sequence
  Synthetic oligonucleotide; CTT chr11 5381261 5381282 5381278 5381283 +
ttagtaatggatttagattctt

SEQ ID NO: 109580 - DNA, 22 bp, Artificial Sequence
  Synthetic oligonucleotide; TTT chr11 5381262 5381283 5381279 5381284 +
tagtaatggatttagattcttt

SEQ ID NO: 109581 - DNA, 22 bp, Artificial Sequence
  Synthetic oligonucleotide; TTT chr11 5381263 5381284 5381280 5381285 +
agtaatggatttagattcttta

SEQ ID NO: 109582 - DNA, 22 bp, Artificial Sequence
  Synthetic oligonucleotide; TTA chr11 5381264 5381285 5381281 5381286 +
gtaatggatttagattctttaa

SEQ ID NO: 109583 - DNA, 22 bp, Artificial Sequence
  Synthetic oligonucleotide; TTT chr11 5381275 5381296 5381292 5381297 +
agattctttaataatgaattct

SEQ ID NO: 109584 - DNA, 22 bp, Artificial Sequence
  Synthetic oligonucleotide; TTA chr11 5381276 5381297 5381293 5381298 +
gattctttaataatgaattcta

SEQ ID NO: 109585 - DNA, 22 bp, Artificial Sequence
  Synthetic oligonucleotide; TTC chr11 5381281 5381302 5381298 5381303 +
tttaataatgaattctaatacc

SEQ ID NO: 109586 - DNA, 22 bp, Artificial Sequence
  Synthetic oligonucleotide; CTT chr11 5381283 5381304 5381300 5381305 +
taataatgaattctaatacctt

SEQ ID NO: 109587 - DNA, 22 bp, Artificial Sequence
  Synthetic oligonucleotide; TTT chr11 5381284 5381305 5381301 5381306 +
aataatgaattctaatacctta

SEQ ID NO: 109588 - DNA, 22 bp, Artificial Sequence
  Synthetic oligonucleotide; TTA chr11 5381285 5381306 5381302 5381307 +
ataatgaattctaataccttaa

SEQ ID NO: 109589 - DNA, 22 bp, Artificial Sequence
  Synthetic oligonucleotide; TTC chr11 5381296 5381317 5381313 5381318 +
taataccttaaaggttaaggcc

SEQ ID NO: 109590 - DNA, 22 bp, Artificial Sequence
  Synthetic oligonucleotide; CTA chr11 5381298 5381319 5381315 5381320 +
ataccttaaaggttaaggcctg

SEQ ID NO: 109591 - DNA, 22 bp, Artificial Sequence
  Synthetic oligonucleotide; CTT chr11 5381305 5381326 5381322 5381327 +
aaaggttaaggcctgaatgcct

SEQ ID NO: 109592 - DNA, 22 bp, Artificial Sequence
  Synthetic oligonucleotide; TTA chr11 5381306 5381327 5381323 5381328 +
aaggttaaggcctgaatgcctc

SEQ ID NO: 109593 - DNA, 22 bp, Artificial Sequence
  Synthetic oligonucleotide; TTA chr11 5381313 5381334 5381330 5381335 +
aggcctgaatgcctcacactaa

SEQ ID NO: 109594 - DNA, 22 bp, Artificial Sequence
  Synthetic oligonucleotide; CTG chr11 5381320 5381341 5381337 5381342 +
aatgcctcacactaatgtgttg

SEQ ID NO: 109595 - DNA, 22 bp, Artificial Sequence
  Synthetic oligonucleotide; CTC chr11 5381328 5381349 5381345 5381350 +
acactaatgtgttgatacttca

SEQ ID NO: 109596 - DNA, 22 bp, Artificial Sequence
  Synthetic oligonucleotide; CTA chr11 5381334 5381355 5381351 5381356 +
atgtgttgatacttcaccttcc

SEQ ID NO: 109597 - DNA, 22 bp, Artificial Sequence
  Synthetic oligonucleotide; TTG chr11 5381342 5381363 5381359 5381364 +
atacttcaccttccccaaccat

SEQ ID NO: 109598 - DNA, 22 bp, Artificial Sequence
  Synthetic oligonucleotide; CTT chr11 5381348 5381369 5381365 5381370 +
caccttccccaaccatcatgca

SEQ ID NO: 109599 - DNA, 22 bp, Artificial Sequence
  Synthetic oligonucleotide; TTC chr11 5381349 5381370 5381366 5381371 +
accttccccaaccatcatgcac

SEQ ID NO: 109600 - DNA, 22 bp, Artificial Sequence
  Synthetic oligonucleotide; CTT chr11 5381354 5381375 5381371 5381376 +
ccccaaccatcatgcacccaca

SEQ ID NO: 109601 - DNA, 22 bp, Artificial Sequence
  Synthetic oligonucleotide; TTC chr11 5381355 5381376 5381372 5381377 +
cccaaccatcatgcacccacat

SEQ ID NO: 109602 - DNA, 22 bp, Artificial Sequence
  Synthetic oligonucleotide; TTC chr11 5381379 5381400 5381396 5381401 +
acttcacctaatattcgcatga

SEQ ID NO: 109603 - DNA, 22 bp, Artificial Sequence
  Synthetic oligonucleotide; CTT chr11 5381383 5381404 5381400 5381405 +
cacctaatattcgcatgattac

SEQ ID NO: 109604 - DNA, 22 bp, Artificial Sequence
  Synthetic oligonucleotide; TTC chr11 5381384 5381405 5381401 5381406 +
acctaatattcgcatgattacc

SEQ ID NO: 109605 - DNA, 22 bp, Artificial Sequence
  Synthetic oligonucleotide; CTA chr11 5381389 5381410 5381406 5381411 +
atattcgcatgattacccacag

SEQ ID NO: 109606 - DNA, 22 bp, Artificial Sequence
  Synthetic oligonucleotide; TTC chr11 5381395 5381416 5381412 5381417 +
gcatgattacccacagtgatag

SEQ ID NO: 109607 - DNA, 22 bp, Artificial Sequence
  Synthetic oligonucleotide; TTA chr11 5381404 5381425 5381421 5381426 +
cccacagtgatagagataggtc

SEQ ID NO: 109608 - DNA, 22 bp, Artificial Sequence
  Synthetic oligonucleotide; CTT chr11 5381435 5381456 5381452 5381457 +
gctccttcattgtccccatcat

SEQ ID NO: 109609 - DNA, 22 bp, Artificial Sequence
  Synthetic oligonucleotide; TTG chr11 5381436 5381457 5381453 5381458 +
ctccttcattgtccccatcatc

SEQ ID NO: 109610 - DNA, 22 bp, Artificial Sequence
  Synthetic oligonucleotide; CTC chr11 5381439 5381460 5381456 5381461 +
cttcattgtccccatcatcctc

SEQ ID NO: 109611 - DNA, 22 bp, Artificial Sequence
  Synthetic oligonucleotide; CTT chr11 5381442 5381463 5381459 5381464 +
cattgtccccatcatcctcctc

SEQ ID NO: 109612 - DNA, 22 bp, Artificial Sequence
  Synthetic oligonucleotide; TTC chr11 5381443 5381464 5381460 5381465 +
attgtccccatcatcctcctct

SEQ ID NO: 109613 - DNA, 22 bp, Artificial Sequence
  Synthetic oligonucleotide; TTG chr11 5381447 5381468 5381464 5381469 +
tccccatcatcctcctcttggc

SEQ ID NO: 109614 - DNA, 22 bp, Artificial Sequence
  Synthetic oligonucleotide; CTC chr11 5381461 5381482 5381478 5381483 +
ctcttggcctccaggcttcaga

SEQ ID NO: 109615 - DNA, 22 bp, Artificial Sequence
  Synthetic oligonucleotide; CTC chr11 5381464 5381485 5381481 5381486 +
ttggcctccaggcttcagaaac

SEQ ID NO: 109616 - DNA, 22 bp, Artificial Sequence
  Synthetic oligonucleotide; CTT chr11 5381466 5381487 5381483 5381488 +
ggcctccaggcttcagaaacta

SEQ ID NO: 109617 - DNA, 22 bp, Artificial Sequence
  Synthetic oligonucleotide; TTG chr11 5381467 5381488 5381484 5381489 +
gcctccaggcttcagaaactac

SEQ ID NO: 109618 - DNA, 22 bp, Artificial Sequence
  Synthetic oligonucleotide; CTC chr11 5381472 5381493 5381489 5381494 +
caggcttcagaaactacctctg

SEQ ID NO: 109619 - DNA, 22 bp, Artificial Sequence
  Synthetic oligonucleotide; CTT chr11 5381479 5381500 5381496 5381501 +
cagaaactacctctgccttcct

SEQ ID NO: 109620 - DNA, 22 bp, Artificial Sequence
  Synthetic oligonucleotide; TTC chr11 5381480 5381501 5381497 5381502 +
agaaactacctctgccttccta

SEQ ID NO: 109621 - DNA, 22 bp, Artificial Sequence
  Synthetic oligonucleotide; CTA chr11 5381488 5381509 5381505 5381510 +
cctctgccttcctagcctgggc

SEQ ID NO: 109622 - DNA, 22 bp, Artificial Sequence
  Synthetic oligonucleotide; CTC chr11 5381492 5381513 5381509 5381514 +
tgccttcctagcctgggctagt

SEQ ID NO: 109623 - DNA, 22 bp, Artificial Sequence
  Synthetic oligonucleotide; CTG chr11 5381494 5381515 5381511 5381516 +
ccttcctagcctgggctagtga

SEQ ID NO: 109624 - DNA, 22 bp, Artificial Sequence
  Synthetic oligonucleotide; CTT chr11 5381498 5381519 5381515 5381520 +
cctagcctgggctagtgaccct

SEQ ID NO: 109625 - DNA, 22 bp, Artificial Sequence
  Synthetic oligonucleotide; TTC chr11 5381499 5381520 5381516 5381521 +
ctagcctgggctagtgacccta

SEQ ID NO: 109626 - DNA, 22 bp, Artificial Sequence
  Synthetic oligonucleotide; CTA chr11 5381502 5381523 5381519 5381524 +
gcctgggctagtgaccctattt

SEQ ID NO: 109627 - DNA, 22 bp, Artificial Sequence
  Synthetic oligonucleotide; CTG chr11 5381507 5381528 5381524 5381529 +
ggctagtgaccctattttggaa

SEQ ID NO: 109628 - DNA, 22 bp, Artificial Sequence
  Synthetic oligonucleotide; CTA chr11 5381512 5381533 5381529 5381534 +
gtgaccctattttggaaacttc

SEQ ID NO: 109629 - DNA, 22 bp, Artificial Sequence
  Synthetic oligonucleotide; CTA chr11 5381521 5381542 5381538 5381543 +
ttttggaaacttcgttgaacaa

SEQ ID NO: 109630 - DNA, 22 bp, Artificial Sequence
  Synthetic oligonucleotide; TTT chr11 5381524 5381545 5381541 5381546 +
tggaaacttcgttgaacaatct

SEQ ID NO: 109631 - DNA, 22 bp, Artificial Sequence
  Synthetic oligonucleotide; TTT chr11 5381525 5381546 5381542 5381547 +
ggaaacttcgttgaacaatcta

SEQ ID NO: 109632 - DNA, 22 bp, Artificial Sequence
  Synthetic oligonucleotide; TTG chr11 5381526 5381547 5381543 5381548 +
gaaacttcgttgaacaatctaa

SEQ ID NO: 109633 - DNA, 22 bp, Artificial Sequence
  Synthetic oligonucleotide; CTT chr11 5381533 5381554 5381550 5381555 +
cgttgaacaatctaacatcttt

SEQ ID NO: 109634 - DNA, 22 bp, Artificial Sequence
  Synthetic oligonucleotide; TTC chr11 5381534 5381555 5381551 5381556 +
gttgaacaatctaacatcttta

SEQ ID NO: 109635 - DNA, 22 bp, Artificial Sequence
  Synthetic oligonucleotide; TTG chr11 5381538 5381559 5381555 5381560 +
aacaatctaacatctttactca

SEQ ID NO: 109636 - DNA, 22 bp, Artificial Sequence
  Synthetic oligonucleotide; CTA chr11 5381547 5381568 5381564 5381569 +
acatctttactcaatgtgagct

SEQ ID NO: 109637 - DNA, 22 bp, Artificial Sequence
  Synthetic oligonucleotide; CTT chr11 5381554 5381575 5381571 5381576 +
tactcaatgtgagcttcataaa

SEQ ID NO: 109638 - DNA, 22 bp, Artificial Sequence
  Synthetic oligonucleotide; TTT chr11 5381555 5381576 5381572 5381577 +
actcaatgtgagcttcataaag

SEQ ID NO: 109639 - DNA, 22 bp, Artificial Sequence
  Synthetic oligonucleotide; TTA chr11 5381556 5381577 5381573 5381578 +
ctcaatgtgagcttcataaagg

SEQ ID NO: 109640 - DNA, 22 bp, Artificial Sequence
  Synthetic oligonucleotide; CTC chr11 5381559 5381580 5381576 5381581 +
aatgtgagcttcataaaggcaa

SEQ ID NO: 109641 - DNA, 22 bp, Artificial Sequence
  Synthetic oligonucleotide; CTT chr11 5381570 5381591 5381587 5381592 +
cataaaggcaagaccatgacat

SEQ ID NO: 109642 - DNA, 22 bp, Artificial Sequence
  Synthetic oligonucleotide; TTC chr11 5381571 5381592 5381588 5381593 +
ataaaggcaagaccatgacatg

SEQ ID NO: 109643 - DNA, 22 bp, Artificial Sequence
  Synthetic oligonucleotide; TTA chr11 5381596 5381617 5381613 5381618 +
atctgtctatcttcaagttctt

SEQ ID NO: 109644 - DNA, 22 bp, Artificial Sequence
  Synthetic oligonucleotide; CTG chr11 5381601 5381622 5381618 5381623 +
tctatcttcaagttcttgatca

SEQ ID NO: 109645 - DNA, 22 bp, Artificial Sequence
  Synthetic oligonucleotide; CTA chr11 5381605 5381626 5381622 5381627 +
tcttcaagttcttgatcagagt

SEQ ID NO: 109646 - DNA, 22 bp, Artificial Sequence
  Synthetic oligonucleotide; CTT chr11 5381609 5381630 5381626 5381631 +
caagttcttgatcagagtttct

SEQ ID NO: 109647 - DNA, 22 bp, Artificial Sequence
  Synthetic oligonucleotide; TTC chr11 5381610 5381631 5381627 5381632 +
aagttcttgatcagagtttctc

SEQ ID NO: 109648 - DNA, 22 bp, Artificial Sequence
  Synthetic oligonucleotide; TTC chr11 5381616 5381637 5381633 5381638 +
ttgatcagagtttctcacagga

SEQ ID NO: 109649 - DNA, 22 bp, Artificial Sequence
  Synthetic oligonucleotide; CTT chr11 5381618 5381639 5381635 5381640 +
gatcagagtttctcacaggacg

SEQ ID NO: 109650 - DNA, 22 bp, Artificial Sequence
  Synthetic oligonucleotide; TTG chr11 5381619 5381640 5381636 5381641 +
atcagagtttctcacaggacgc

SEQ ID NO: 109651 - DNA, 22 bp, Artificial Sequence
  Synthetic oligonucleotide; TTT chr11 5381629 5381650 5381646 5381651 +
ctcacaggacgcacttaatgca

SEQ ID NO: 109652 - DNA, 22 bp, Artificial Sequence
  Synthetic oligonucleotide; TTC chr11 5381630 5381651 5381647 5381652 +
tcacaggacgcacttaatgcac

SEQ ID NO: 109653 - DNA, 22 bp, Artificial Sequence
  Synthetic oligonucleotide; CTC chr11 5381632 5381653 5381649 5381654 +
acaggacgcacttaatgcacgt

SEQ ID NO: 109654 - DNA, 22 bp, Artificial Sequence
  Synthetic oligonucleotide; CTT chr11 5381645 5381666 5381662 5381667 +
aatgcacgtcaatgaaaattga

SEQ ID NO: 109655 - DNA, 22 bp, Artificial Sequence
  Synthetic oligonucleotide; TTA chr11 5381646 5381667 5381663 5381668 +
atgcacgtcaatgaaaattgat

SEQ ID NO: 109656 - DNA, 22 bp, Artificial Sequence
  Synthetic oligonucleotide; TTG chr11 5381666 5381687 5381683 5381688 +
atgagaatgtttaatgtaattt

SEQ ID NO: 109657 - DNA, 22 bp, Artificial Sequence
  Synthetic oligonucleotide; TTT chr11 5381678 5381699 5381695 5381700 +
aatgtaatttcagtcacacttc

SEQ ID NO: 109658 - DNA, 22 bp, Artificial Sequence
  Synthetic oligonucleotide; TTA chr11 5381679 5381700 5381696 5381701 +
atgtaatttcagtcacacttca

SEQ ID NO: 109659 - DNA, 22 bp, Artificial Sequence
  Synthetic oligonucleotide; TTT chr11 5381688 5381709 5381705 5381710 +
cagtcacacttcaaagaggact

SEQ ID NO: 109660 - DNA, 22 bp, Artificial Sequence
  Synthetic oligonucleotide; TTC chr11 5381689 5381710 5381706 5381711 +
agtcacacttcaaagaggacta

SEQ ID NO: 109661 - DNA, 22 bp, Artificial Sequence
  Synthetic oligonucleotide; CTT chr11 5381699 5381720 5381716 5381721 +
caaagaggactattttgtgata

SEQ ID NO: 109662 - DNA, 22 bp, Artificial Sequence
  Synthetic oligonucleotide; TTC chr11 5381700 5381721 5381717 5381722 +
aaagaggactattttgtgatat

SEQ ID NO: 109663 - DNA, 22 bp, Artificial Sequence
  Synthetic oligonucleotide; CTA chr11 5381711 5381732 5381728 5381733 +
ttttgtgatatgataaaacaaa

SEQ ID NO: 109664 - DNA, 22 bp, Artificial Sequence
  Synthetic oligonucleotide; TTT chr11 5381714 5381735 5381731 5381736 +
tgtgatatgataaaacaaatct

SEQ ID NO: 109665 - DNA, 22 bp, Artificial Sequence
  Synthetic oligonucleotide; TTT chr11 5381715 5381736 5381732 5381737 +
gtgatatgataaaacaaatcta

SEQ ID NO: 109666 - DNA, 22 bp, Artificial Sequence
  Synthetic oligonucleotide; TTG chr11 5381716 5381737 5381733 5381738 +
tgatatgataaaacaaatctaa

SEQ ID NO: 109667 - DNA, 22 bp, Artificial Sequence
  Synthetic oligonucleotide; CTA chr11 5381737 5381758 5381754 5381759 +
aaggtcatttagagcaataaag

SEQ ID NO: 109668 - DNA, 22 bp, Artificial Sequence
  Synthetic oligonucleotide; TTT chr11 5381747 5381768 5381764 5381769 +
agagcaataaagaatcaaaaat

SEQ ID NO: 109669 - DNA, 22 bp, Artificial Sequence
  Synthetic oligonucleotide; TTA chr11 5381748 5381769 5381765 5381770 +
gagcaataaagaatcaaaaatg

SEQ ID NO: 109670 - DNA, 22 bp, Artificial Sequence
  Synthetic oligonucleotide; CTG chr11 5381773 5381794 5381790 5381795 +
agttctttcatttggttttcaa

SEQ ID NO: 109671 - DNA, 22 bp, Artificial Sequence
  Synthetic oligonucleotide; TTC chr11 5381778 5381799 5381795 5381800 +
tttcatttggttttcaaataaa

SEQ ID NO: 109672 - DNA, 22 bp, Artificial Sequence
  Synthetic oligonucleotide; CTT chr11 5381780 5381801 5381797 5381802 +
tcatttggttttcaaataaatc

SEQ ID NO: 109673 - DNA, 22 bp, Artificial Sequence
  Synthetic oligonucleotide; TTT chr11 5381781 5381802 5381798 5381803 +
catttggttttcaaataaatct

SEQ ID NO: 109674 - DNA, 22 bp, Artificial Sequence
  Synthetic oligonucleotide; TTC chr11 5381782 5381803 5381799 5381804 +
atttggttttcaaataaatcta

SEQ ID NO: 109675 - DNA, 22 bp, Artificial Sequence
  Synthetic oligonucleotide; TTT chr11 5381786 5381807 5381803 5381808 +
ggttttcaaataaatctattgc

SEQ ID NO: 109676 - DNA, 22 bp, Artificial Sequence
  Synthetic oligonucleotide; TTG chr11 5381787 5381808 5381804 5381809 +
gttttcaaataaatctattgct

SEQ ID NO: 109677 - DNA, 22 bp, Artificial Sequence
  Synthetic oligonucleotide; TTT chr11 5381791 5381812 5381808 5381813 +
tcaaataaatctattgcttgga

SEQ ID NO: 109678 - DNA, 22 bp, Artificial Sequence
  Synthetic oligonucleotide; TTT chr11 5381792 5381813 5381809 5381814 +
caaataaatctattgcttggaa

SEQ ID NO: 109679 - DNA, 22 bp, Artificial Sequence
  Synthetic oligonucleotide; TTC chr11 5381793 5381814 5381810 5381815 +
aaataaatctattgcttggaaa

SEQ ID NO: 109680 - DNA, 22 bp, Artificial Sequence
  Synthetic oligonucleotide; CTA chr11 5381804 5381825 5381821 5381826 +
ttgcttggaaactggtccttca

SEQ ID NO: 109681 - DNA, 22 bp, Artificial Sequence
  Synthetic oligonucleotide; TTG chr11 5381807 5381828 5381824 5381829 +
cttggaaactggtccttcaatt

SEQ ID NO: 109682 - DNA, 22 bp, Artificial Sequence
  Synthetic oligonucleotide; CTT chr11 5381810 5381831 5381827 5381832 +
ggaaactggtccttcaattata

SEQ ID NO: 109683 - DNA, 22 bp, Artificial Sequence
  Synthetic oligonucleotide; TTG chr11 5381811 5381832 5381828 5381833 +
gaaactggtccttcaattatat

SEQ ID NO: 109684 - DNA, 22 bp, Artificial Sequence
  Synthetic oligonucleotide; CTG chr11 5381818 5381839 5381835 5381840 +
gtccttcaattatataattcag

SEQ ID NO: 109685 - DNA, 22 bp, Artificial Sequence
  Synthetic oligonucleotide; CTT chr11 5381824 5381845 5381841 5381846 +
caattatataattcagagaaat

SEQ ID NO: 109686 - DNA, 22 bp, Artificial Sequence
  Synthetic oligonucleotide; TTC chr11 5381825 5381846 5381842 5381847 +
aattatataattcagagaaata

SEQ ID NO: 109687 - DNA, 22 bp, Artificial Sequence
  Synthetic oligonucleotide; TTA chr11 5381830 5381851 5381847 5381852 +
tataattcagagaaatagaata

SEQ ID NO: 109688 - DNA, 22 bp, Artificial Sequence
  Synthetic oligonucleotide; TTC chr11 5381838 5381859 5381855 5381860 +
agagaaatagaatataaagcta

SEQ ID NO: 109689 - DNA, 22 bp, Artificial Sequence
  Synthetic oligonucleotide; CTA chr11 5381860 5381881 5381877 5381882 +
ttatacagatgttagtttaaaa

SEQ ID NO: 109690 - DNA, 22 bp, Artificial Sequence
  Synthetic oligonucleotide; TTA chr11 5381863 5381884 5381880 5381885 +
tacagatgttagtttaaaaaag

SEQ ID NO: 109691 - DNA, 22 bp, Artificial Sequence
  Synthetic oligonucleotide; TTA chr11 5381874 5381895 5381891 5381896 +
gtttaaaaaagtaagcaaatat

SEQ ID NO: 109692 - DNA, 22 bp, Artificial Sequence
  Synthetic oligonucleotide; TTT chr11 5381878 5381899 5381895 5381900 +
aaaaaagtaagcaaatattaga

SEQ ID NO: 109693 - DNA, 22 bp, Artificial Sequence
  Synthetic oligonucleotide; TTA chr11 5381879 5381900 5381896 5381901 +
aaaaagtaagcaaatattagag

SEQ ID NO: 109694 - DNA, 22 bp, Artificial Sequence
  Synthetic oligonucleotide; TTA chr11 5381898 5381919 5381915 5381920 +
gagatctctaaatggtaggtta

SEQ ID NO: 109695 - DNA, 22 bp, Artificial Sequence
  Synthetic oligonucleotide; CTC chr11 5381906 5381927 5381923 5381928 +
taaatggtaggttatccactaa

SEQ ID NO: 109696 - DNA, 22 bp, Artificial Sequence
  Synthetic oligonucleotide; CTA chr11 5381908 5381929 5381925 5381930 +
aatggtaggttatccactaaac

SEQ ID NO: 109697 - DNA, 22 bp, Artificial Sequence
  Synthetic oligonucleotide; TTA chr11 5381920 5381941 5381937 5381942 +
tccactaaacagtattgtttat

SEQ ID NO: 109698 - DNA, 22 bp, Artificial Sequence
  Synthetic oligonucleotide; CTA chr11 5381927 5381948 5381944 5381949 +
aacagtattgtttatctacgta

SEQ ID NO: 109699 - DNA, 22 bp, Artificial Sequence
  Synthetic oligonucleotide; TTG chr11 5381937 5381958 5381954 5381959 +
tttatctacgtaaaaagctgtc

SEQ ID NO: 109700 - DNA, 22 bp, Artificial Sequence
  Synthetic oligonucleotide; TTT chr11 5381940 5381961 5381957 5381962 +
atctacgtaaaaagctgtcaat

SEQ ID NO: 109701 - DNA, 22 bp, Artificial Sequence
  Synthetic oligonucleotide; TTA chr11 5381941 5381962 5381958 5381963 +
tctacgtaaaaagctgtcaatt

SEQ ID NO: 109702 - DNA, 22 bp, Artificial Sequence
  Synthetic oligonucleotide; CTA chr11 5381945 5381966 5381962 5381967 +
cgtaaaaagctgtcaattacat

SEQ ID NO: 109703 - DNA, 22 bp, Artificial Sequence
  Synthetic oligonucleotide; CTG chr11 5381957 5381978 5381974 5381979 +
tcaattacatatctgcatccag

SEQ ID NO: 109704 - DNA, 22 bp, Artificial Sequence
  Synthetic oligonucleotide; TTA chr11 5381964 5381985 5381981 5381986 +
catatctgcatccagctccata

SEQ ID NO: 109705 - DNA, 22 bp, Artificial Sequence
  Synthetic oligonucleotide; CTG chr11 5381972 5381993 5381989 5381994 +
catccagctccatacaccaaaa

SEQ ID NO: 109706 - DNA, 22 bp, Artificial Sequence
  Synthetic oligonucleotide; CTC chr11 5381982 5382003 5381999 5382004 +
catacaccaaaataacatctgt

SEQ ID NO: 109707 - DNA, 22 bp, Artificial Sequence
  Synthetic oligonucleotide; CTG chr11 5382003 5382024 5382020 5382025 +
tttccagtgcagactttaaatc

SEQ ID NO: 109708 - DNA, 22 bp, Artificial Sequence
  Synthetic oligonucleotide; TTT chr11 5382006 5382027 5382023 5382028 +
ccagtgcagactttaaatcctt

SEQ ID NO: 109709 - DNA, 22 bp, Artificial Sequence
  Synthetic oligonucleotide; TTC chr11 5382007 5382028 5382024 5382029 +
cagtgcagactttaaatccttc

SEQ ID NO: 109710 - DNA, 22 bp, Artificial Sequence
  Synthetic oligonucleotide; CTT chr11 5382019 5382040 5382036 5382041 +
taaatccttcctgcatattgtt

SEQ ID NO: 109711 - DNA, 22 bp, Artificial Sequence
  Synthetic oligonucleotide; TTT chr11 5382020 5382041 5382037 5382042 +
aaatccttcctgcatattgtta

SEQ ID NO: 109712 - DNA, 22 bp, Artificial Sequence
  Synthetic oligonucleotide; TTA chr11 5382021 5382042 5382038 5382043 +
aatccttcctgcatattgttaa

SEQ ID NO: 109713 - DNA, 22 bp, Artificial Sequence
  Synthetic oligonucleotide; CTT chr11 5382028 5382049 5382045 5382050 +
cctgcatattgttaacaatgta

SEQ ID NO: 109714 - DNA, 22 bp, Artificial Sequence
  Synthetic oligonucleotide; TTC chr11 5382029 5382050 5382046 5382051 +
ctgcatattgttaacaatgtac

SEQ ID NO: 109715 - DNA, 22 bp, Artificial Sequence
  Synthetic oligonucleotide; CTG chr11 5382032 5382053 5382049 5382054 +
catattgttaacaatgtactct

SEQ ID NO: 109716 - DNA, 22 bp, Artificial Sequence
  Synthetic oligonucleotide; TTG chr11 5382039 5382060 5382056 5382061 +
ttaacaatgtactctggaaaat

SEQ ID NO: 109717 - DNA, 22 bp, Artificial Sequence
  Synthetic oligonucleotide; TTA chr11 5382042 5382063 5382059 5382064 +
acaatgtactctggaaaatatg

SEQ ID NO: 109718 - DNA, 22 bp, Artificial Sequence
  Synthetic oligonucleotide; CTC chr11 5382053 5382074 5382070 5382075 +
tggaaaatatgattgttatctc

SEQ ID NO: 109719 - DNA, 22 bp, Artificial Sequence
  Synthetic oligonucleotide; CTG chr11 5382055 5382076 5382072 5382077 +
gaaaatatgattgttatctcct

SEQ ID NO: 109720 - DNA, 22 bp, Artificial Sequence
  Synthetic oligonucleotide; TTG chr11 5382068 5382089 5382085 5382090 +
ttatctcctgcctttttaaacc

SEQ ID NO: 109721 - DNA, 22 bp, Artificial Sequence
  Synthetic oligonucleotide; TTA chr11 5382071 5382092 5382088 5382093 +
tctcctgcctttttaaacccaa

SEQ ID NO: 109722 - DNA, 22 bp, Artificial Sequence
  Synthetic oligonucleotide; CTC chr11 5382075 5382096 5382092 5382097 +
ctgcctttttaaacccaaccat

SEQ ID NO: 109723 - DNA, 22 bp, Artificial Sequence
  Synthetic oligonucleotide; CTG chr11 5382078 5382099 5382095 5382100 +
cctttttaaacccaaccatcaa

SEQ ID NO: 109724 - DNA, 22 bp, Artificial Sequence
  Synthetic oligonucleotide; CTT chr11 5382082 5382103 5382099 5382104 +
tttaaacccaaccatcaaaatg

SEQ ID NO: 109725 - DNA, 22 bp, Artificial Sequence
  Synthetic oligonucleotide; TTT chr11 5382083 5382104 5382100 5382105 +
ttaaacccaaccatcaaaatgt

SEQ ID NO: 109726 - DNA, 22 bp, Artificial Sequence
  Synthetic oligonucleotide; TTT chr11 5382084 5382105 5382101 5382106 +
taaacccaaccatcaaaatgtg

SEQ ID NO: 109727 - DNA, 22 bp, Artificial Sequence
  Synthetic oligonucleotide; TTT chr11 5382085 5382106 5382102 5382107 +
aaacccaaccatcaaaatgtgt

SEQ ID NO: 109728 - DNA, 22 bp, Artificial Sequence
  Synthetic oligonucleotide; TTA chr11 5382086 5382107 5382103 5382108 +
aacccaaccatcaaaatgtgta

SEQ ID NO: 109729 - DNA, 22 bp, Artificial Sequence
  Synthetic oligonucleotide; TTT chr11 5382116 5382137 5382133 5382138 +
gacatgtcatataaactcattc

SEQ ID NO: 109730 - DNA, 22 bp, Artificial Sequence
  Synthetic oligonucleotide; TTG chr11 5382117 5382138 5382134 5382139 +
acatgtcatataaactcattca

SEQ ID NO: 109731 - DNA, 22 bp, Artificial Sequence
  Synthetic oligonucleotide; CTC chr11 5382134 5382155 5382151 5382156 +
attcagggtcttgcccctgcct

SEQ ID NO: 109732 - DNA, 22 bp, Artificial Sequence
  Synthetic oligonucleotide; TTC chr11 5382138 5382159 5382155 5382160 +
agggtcttgcccctgcctacct

SEQ ID NO: 109733 - DNA, 22 bp, Artificial Sequence
  Synthetic oligonucleotide; CTT chr11 5382146 5382167 5382163 5382168 +
gcccctgcctacctctactgtt

SEQ ID NO: 109734 - DNA, 22 bp, Artificial Sequence
  Synthetic oligonucleotide; TTG chr11 5382147 5382168 5382164 5382169 +
cccctgcctacctctactgttt

SEQ ID NO: 109735 - DNA, 22 bp, Artificial Sequence
  Synthetic oligonucleotide; CTG chr11 5382153 5382174 5382170 5382175 +
cctacctctactgttttattcc

SEQ ID NO: 109736 - DNA, 22 bp, Artificial Sequence
  Synthetic oligonucleotide; CTA chr11 5382157 5382178 5382174 5382179 +
cctctactgttttattccaagg

SEQ ID NO: 109737 - DNA, 22 bp, Artificial Sequence
  Synthetic oligonucleotide; CTC chr11 5382161 5382182 5382178 5382183 +
tactgttttattccaaggtatt

SEQ ID NO: 109738 - DNA, 22 bp, Artificial Sequence
  Synthetic oligonucleotide; CTA chr11 5382163 5382184 5382180 5382185 +
ctgttttattccaaggtattaa

SEQ ID NO: 109739 - DNA, 22 bp, Artificial Sequence
  Synthetic oligonucleotide; CTG chr11 5382166 5382187 5382183 5382188 +
ttttattccaaggtattaactc

SEQ ID NO: 109740 - DNA, 22 bp, Artificial Sequence
  Synthetic oligonucleotide; TTT chr11 5382169 5382190 5382186 5382191 +
tattccaaggtattaactctct

SEQ ID NO: 109741 - DNA, 22 bp, Artificial Sequence
  Synthetic oligonucleotide; TTT chr11 5382170 5382191 5382187 5382192 +
attccaaggtattaactctctt

SEQ ID NO: 109742 - DNA, 22 bp, Artificial Sequence
  Synthetic oligonucleotide; TTA chr11 5382171 5382192 5382188 5382193 +
ttccaaggtattaactctctta

SEQ ID NO: 109743 - DNA, 22 bp, Artificial Sequence
  Synthetic oligonucleotide; TTC chr11 5382174 5382195 5382191 5382196 +
caaggtattaactctcttaaat

SEQ ID NO: 109744 - DNA, 22 bp, Artificial Sequence
  Synthetic oligonucleotide; TTA chr11 5382184 5382205 5382201 5382206 +
actctcttaaatgttatatttg

SEQ ID NO: 109745 - DNA, 22 bp, Artificial Sequence
  Synthetic oligonucleotide; CTC chr11 5382188 5382209 5382205 5382210 +
tcttaaatgttatatttgatca

SEQ ID NO: 109746 - DNA, 22 bp, Artificial Sequence
  Synthetic oligonucleotide; CTC chr11 5382190 5382211 5382207 5382212 +
ttaaatgttatatttgatcacc

SEQ ID NO: 109747 - DNA, 22 bp, Artificial Sequence
  Synthetic oligonucleotide; CTT chr11 5382192 5382213 5382209 5382214 +
aaatgttatatttgatcaccgg

SEQ ID NO: 109748 - DNA, 22 bp, Artificial Sequence
  Synthetic oligonucleotide; TTA chr11 5382193 5382214 5382210 5382215 +
aatgttatatttgatcaccgga

SEQ ID NO: 109749 - DNA, 22 bp, Artificial Sequence
  Synthetic oligonucleotide; TTA chr11 5382200 5382221 5382217 5382222 +
tatttgatcaccggaaaatctt

SEQ ID NO: 109750 - DNA, 22 bp, Artificial Sequence
  Synthetic oligonucleotide; TTT chr11 5382205 5382226 5382222 5382227 +
gatcaccggaaaatcttatagt

SEQ ID NO: 109751 - DNA, 22 bp, Artificial Sequence
  Synthetic oligonucleotide; TTG chr11 5382206 5382227 5382223 5382228 +
atcaccggaaaatcttatagtt

SEQ ID NO: 109752 - DNA, 22 bp, Artificial Sequence
  Synthetic oligonucleotide; CTT chr11 5382222 5382243 5382239 5382244 +
atagttctcaaaacacataaac

SEQ ID NO: 109753 - DNA, 22 bp, Artificial Sequence
  Synthetic oligonucleotide; TTA chr11 5382223 5382244 5382240 5382245 +
tagttctcaaaacacataaaca

SEQ ID NO: 109754 - DNA, 22 bp, Artificial Sequence
  Synthetic oligonucleotide; TTC chr11 5382229 5382250 5382246 5382251 +
tcaaaacacataaacaactttt

SEQ ID NO: 109755 - DNA, 22 bp, Artificial Sequence
  Synthetic oligonucleotide; CTC chr11 5382231 5382252 5382248 5382253 +
aaaacacataaacaacttttcc

SEQ ID NO: 109756 - DNA, 22 bp, Artificial Sequence
  Synthetic oligonucleotide; CTT chr11 5382249 5382270 5382266 5382271 +
ttcctcacctccatgcccttgc

SEQ ID NO: 109757 - DNA, 22 bp, Artificial Sequence
  Synthetic oligonucleotide; TTT chr11 5382250 5382271 5382267 5382272 +
tcctcacctccatgcccttgct

SEQ ID NO: 109758 - DNA, 22 bp, Artificial Sequence
  Synthetic oligonucleotide; TTT chr11 5382251 5382272 5382268 5382273 +
cctcacctccatgcccttgctt

SEQ ID NO: 109759 - DNA, 22 bp, Artificial Sequence
  Synthetic oligonucleotide; TTC chr11 5382252 5382273 5382269 5382274 +
ctcacctccatgcccttgctta

SEQ ID NO: 109760 - DNA, 22 bp, Artificial Sequence
  Synthetic oligonucleotide; CTC chr11 5382255 5382276 5382272 5382277 +
acctccatgcccttgcttacac

SEQ ID NO: 109761 - DNA, 22 bp, Artificial Sequence
  Synthetic oligonucleotide; CTC chr11 5382260 5382281 5382277 5382282 +
catgcccttgcttacactaccc

SEQ ID NO: 109762 - DNA, 22 bp, Artificial Sequence
  Synthetic oligonucleotide; CTT chr11 5382269 5382290 5382286 5382291 +
gcttacactacccctccttttt

SEQ ID NO: 109763 - DNA, 22 bp, Artificial Sequence
  Synthetic oligonucleotide; TTG chr11 5382270 5382291 5382287 5382292 +
cttacactacccctcctttttg

SEQ ID NO: 109764 - DNA, 22 bp, Artificial Sequence
  Synthetic oligonucleotide; CTT chr11 5382273 5382294 5382290 5382295 +
acactacccctcctttttggaa

SEQ ID NO: 109765 - DNA, 22 bp, Artificial Sequence
  Synthetic oligonucleotide; TTA chr11 5382274 5382295 5382291 5382296 +
cactacccctcctttttggaaa

SEQ ID NO: 109766 - DNA, 22 bp, Artificial Sequence
  Synthetic oligonucleotide; CTA chr11 5382279 5382300 5382296 5382301 +
cccctcctttttggaaatacct

SEQ ID NO: 109767 - DNA, 22 bp, Artificial Sequence
  Synthetic oligonucleotide; CTC chr11 5382285 5382306 5382302 5382307 +
ctttttggaaatacctttctat

SEQ ID NO: 109768 - DNA, 22 bp, Artificial Sequence
  Synthetic oligonucleotide; CTT chr11 5382288 5382309 5382305 5382310 +
tttggaaatacctttctataaa

SEQ ID NO: 109769 - DNA, 22 bp, Artificial Sequence
  Synthetic oligonucleotide; TTT chr11 5382289 5382310 5382306 5382311 +
ttggaaatacctttctataaag

SEQ ID NO: 109770 - DNA, 22 bp, Artificial Sequence
  Synthetic oligonucleotide; TTT chr11 5382290 5382311 5382307 5382312 +
tggaaatacctttctataaagc

SEQ ID NO: 109771 - DNA, 22 bp, Artificial Sequence
  Synthetic oligonucleotide; TTT chr11 5382291 5382312 5382308 5382313 +
ggaaatacctttctataaagcc

SEQ ID NO: 109772 - DNA, 22 bp, Artificial Sequence
  Synthetic oligonucleotide; TTG chr11 5382292 5382313 5382309 5382314 +
gaaatacctttctataaagccc

SEQ ID NO: 109773 - DNA, 22 bp, Artificial Sequence
  Synthetic oligonucleotide; CTT chr11 5382302 5382323 5382319 5382324 +
tctataaagccctatctgtggt

SEQ ID NO: 109774 - DNA, 22 bp, Artificial Sequence
  Synthetic oligonucleotide; TTT chr11 5382303 5382324 5382320 5382325 +
ctataaagccctatctgtggtt

SEQ ID NO: 109775 - DNA, 22 bp, Artificial Sequence
  Synthetic oligonucleotide; TTC chr11 5382304 5382325 5382321 5382326 +
tataaagccctatctgtggttg

SEQ ID NO: 109776 - DNA, 22 bp, Artificial Sequence
  Synthetic oligonucleotide; CTA chr11 5382306 5382327 5382323 5382328 +
taaagccctatctgtggttgat

SEQ ID NO: 109777 - DNA, 22 bp, Artificial Sequence
  Synthetic oligonucleotide; CTA chr11 5382316 5382337 5382333 5382338 +
tctgtggttgattcttaattag

SEQ ID NO: 109778 - DNA, 22 bp, Artificial Sequence
  Synthetic oligonucleotide; CTG chr11 5382320 5382341 5382337 5382342 +
tggttgattcttaattagtctt

SEQ ID NO: 109779 - DNA, 22 bp, Artificial Sequence
  Synthetic oligonucleotide; TTG chr11 5382326 5382347 5382343 5382348 +
attcttaattagtcttcatagc

SEQ ID NO: 109780 - DNA, 22 bp, Artificial Sequence
  Synthetic oligonucleotide; TTC chr11 5382330 5382351 5382347 5382352 +
ttaattagtcttcatagctcag

SEQ ID NO: 109781 - DNA, 22 bp, Artificial Sequence
  Synthetic oligonucleotide; CTT chr11 5382332 5382353 5382349 5382354 +
aattagtcttcatagctcaggt

SEQ ID NO: 109782 - DNA, 22 bp, Artificial Sequence
  Synthetic oligonucleotide; TTA chr11 5382333 5382354 5382350 5382355 +
attagtcttcatagctcaggtt

SEQ ID NO: 109783 - DNA, 22 bp, Artificial Sequence
  Synthetic oligonucleotide; TTA chr11 5382337 5382358 5382354 5382359 +
gtcttcatagctcaggttgggg

SEQ ID NO: 109784 - DNA, 22 bp, Artificial Sequence
  Synthetic oligonucleotide; CTT chr11 5382342 5382363 5382359 5382364 +
catagctcaggttggggccttc

SEQ ID NO: 109785 - DNA, 22 bp, Artificial Sequence
  Synthetic oligonucleotide; TTC chr11 5382343 5382364 5382360 5382365 +
atagctcaggttggggccttcc

SEQ ID NO: 109786 - DNA, 22 bp, Artificial Sequence
  Synthetic oligonucleotide; CTC chr11 5382350 5382371 5382367 5382372 +
aggttggggccttccctggccc

SEQ ID NO: 109787 - DNA, 22 bp, Artificial Sequence
  Synthetic oligonucleotide; TTG chr11 5382356 5382377 5382373 5382378 +
gggccttccctggccctcacct

SEQ ID NO: 109788 - DNA, 22 bp, Artificial Sequence
  Synthetic oligonucleotide; CTT chr11 5382363 5382384 5382380 5382385 +
ccctggccctcacctgtgggcc

SEQ ID NO: 109789 - DNA, 22 bp, Artificial Sequence
  Synthetic oligonucleotide; TTC chr11 5382364 5382385 5382381 5382386 +
cctggccctcacctgtgggcca

SEQ ID NO: 109790 - DNA, 22 bp, Artificial Sequence
  Synthetic oligonucleotide; CTG chr11 5382368 5382389 5382385 5382390 +
gccctcacctgtgggccaggtg

SEQ ID NO: 109791 - DNA, 22 bp, Artificial Sequence
  Synthetic oligonucleotide; CTC chr11 5382374 5382395 5382391 5382396 +
acctgtgggccaggtgctaccc

SEQ ID NO: 109792 - DNA, 22 bp, Artificial Sequence
  Synthetic oligonucleotide; CTG chr11 5382379 5382400 5382396 5382401 +
tgggccaggtgctacccacaaa

SEQ ID NO: 109793 - DNA, 22 bp, Artificial Sequence
  Synthetic oligonucleotide; CTA chr11 5382393 5382414 5382410 5382415 +
cccacaaatattaatataattg

SEQ ID NO: 109794 - DNA, 22 bp, Artificial Sequence
  Synthetic oligonucleotide; TTA chr11 5382406 5382427 5382423 5382428 +
atataattgccatgtccatctc

SEQ ID NO: 109795 - DNA, 22 bp, Artificial Sequence
  Synthetic oligonucleotide; TTG chr11 5382415 5382436 5382432 5382437 +
ccatgtccatctcttacattgc

SEQ ID NO: 109796 - DNA, 22 bp, Artificial Sequence
  Synthetic oligonucleotide; CTC chr11 5382428 5382449 5382445 5382450 +
ttacattgcgctaagatagttg

SEQ ID NO: 109797 - DNA, 22 bp, Artificial Sequence
  Synthetic oligonucleotide; CTT chr11 5382430 5382451 5382447 5382452 +
acattgcgctaagatagttgtt

SEQ ID NO: 109798 - DNA, 22 bp, Artificial Sequence
  Synthetic oligonucleotide; TTA chr11 5382431 5382452 5382448 5382453 +
cattgcgctaagatagttgttt

SEQ ID NO: 109799 - DNA, 22 bp, Artificial Sequence
  Synthetic oligonucleotide; TTG chr11 5382436 5382457 5382453 5382458 +
cgctaagatagttgttttccta

SEQ ID NO: 109800 - DNA, 22 bp, Artificial Sequence
  Synthetic oligonucleotide; CTA chr11 5382441 5382462 5382458 5382463 +
agatagttgttttcctatctta

SEQ ID NO: 109801 - DNA, 22 bp, Artificial Sequence
  Synthetic oligonucleotide; TTG chr11 5382450 5382471 5382467 5382472 +
ttttcctatcttatgtgtgata

SEQ ID NO: 109802 - DNA, 22 bp, Artificial Sequence
  Synthetic oligonucleotide; TTT chr11 5382453 5382474 5382470 5382475 +
tcctatcttatgtgtgatagat

SEQ ID NO: 109803 - DNA, 22 bp, Artificial Sequence
  Synthetic oligonucleotide; TTT chr11 5382454 5382475 5382471 5382476 +
cctatcttatgtgtgatagatg

SEQ ID NO: 109804 - DNA, 22 bp, Artificial Sequence
  Synthetic oligonucleotide; TTC chr11 5382455 5382476 5382472 5382477 +
ctatcttatgtgtgatagatgc

SEQ ID NO: 109805 - DNA, 22 bp, Artificial Sequence
  Synthetic oligonucleotide; CTA chr11 5382458 5382479 5382475 5382480 +
tcttatgtgtgatagatgcccc

SEQ ID NO: 109806 - DNA, 22 bp, Artificial Sequence
  Synthetic oligonucleotide; CTT chr11 5382462 5382483 5382479 5382484 +
atgtgtgatagatgcccctgaa

SEQ ID NO: 109807 - DNA, 22 bp, Artificial Sequence
  Synthetic oligonucleotide; TTA chr11 5382463 5382484 5382480 5382485 +
tgtgtgatagatgcccctgaat

SEQ ID NO: 109808 - DNA, 22 bp, Artificial Sequence
  Synthetic oligonucleotide; CTG chr11 5382482 5382503 5382499 5382504 +
aataatagcaatatttgctgtt

SEQ ID NO: 109809 - DNA, 22 bp, Artificial Sequence
  Synthetic oligonucleotide; TTT chr11 5382498 5382519 5382515 5382520 +
gctgttgctggtaataatagca

SEQ ID NO: 109810 - DNA, 22 bp, Artificial Sequence
  Synthetic oligonucleotide; TTG chr11 5382499 5382520 5382516 5382521 +
ctgttgctggtaataatagcag

SEQ ID NO: 109811 - DNA, 22 bp, Artificial Sequence
  Synthetic oligonucleotide; CTG chr11 5382502 5382523 5382519 5382524 +
ttgctggtaataatagcagcat

SEQ ID NO: 109812 - DNA, 22 bp, Artificial Sequence
  Synthetic oligonucleotide; TTG chr11 5382505 5382526 5382522 5382527 +
ctggtaataatagcagcattgt

SEQ ID NO: 109813 - DNA, 22 bp, Artificial Sequence
  Synthetic oligonucleotide; CTG chr11 5382508 5382529 5382525 5382530 +
gtaataatagcagcattgttgc

SEQ ID NO: 109814 - DNA, 22 bp, Artificial Sequence
  Synthetic oligonucleotide; TTG chr11 5382526 5382547 5382543 5382548 +
ttgctgttatactgtccttggc

SEQ ID NO: 109815 - DNA, 22 bp, Artificial Sequence
  Synthetic oligonucleotide; TTG chr11 5382529 5382550 5382546 5382551 +
ctgttatactgtccttggctag

SEQ ID NO: 109816 - DNA, 22 bp, Artificial Sequence
  Synthetic oligonucleotide; CTG chr11 5382532 5382553 5382549 5382554 +
ttatactgtccttggctaggat

SEQ ID NO: 109817 - DNA, 22 bp, Artificial Sequence
  Synthetic oligonucleotide; TTA chr11 5382535 5382556 5382552 5382557 +
tactgtccttggctaggatccc

SEQ ID NO: 109818 - DNA, 22 bp, Artificial Sequence
  Synthetic oligonucleotide; CTG chr11 5382540 5382561 5382557 5382562 +
tccttggctaggatcccagtga

SEQ ID NO: 109819 - DNA, 22 bp, Artificial Sequence
  Synthetic oligonucleotide; CTT chr11 5382545 5382566 5382562 5382567 +
ggctaggatcccagtgaaatag

SEQ ID NO: 109820 - DNA, 22 bp, Artificial Sequence
  Synthetic oligonucleotide; TTG chr11 5382546 5382567 5382563 5382568 +
gctaggatcccagtgaaatagg

SEQ ID NO: 109821 - DNA, 22 bp, Artificial Sequence
  Synthetic oligonucleotide; CTA chr11 5382550 5382571 5382567 5382572 +
ggatcccagtgaaataggctaa

SEQ ID NO: 109822 - DNA, 22 bp, Artificial Sequence
  Synthetic oligonucleotide; CTA chr11 5382571 5382592 5382588 5382593 +
aaatcatgttcttaataaatgc

SEQ ID NO: 109823 - DNA, 22 bp, Artificial Sequence
  Synthetic oligonucleotide; TTC chr11 5382582 5382603 5382599 5382604 +
ttaataaatgcaggattttctg

SEQ ID NO: 109824 - DNA, 22 bp, Artificial Sequence
  Synthetic oligonucleotide; CTT chr11 5382584 5382605 5382601 5382606 +
aataaatgcaggattttctgaa

SEQ ID NO: 109825 - DNA, 22 bp, Artificial Sequence
  Synthetic oligonucleotide; TTA chr11 5382585 5382606 5382602 5382607 +
ataaatgcaggattttctgaaa

SEQ ID NO: 109826 - DNA, 22 bp, Artificial Sequence
  Synthetic oligonucleotide; TTT chr11 5382600 5382621 5382617 5382622 +
tctgaaatttttctggtagtgg

SEQ ID NO: 109827 - DNA, 22 bp, Artificial Sequence
  Synthetic oligonucleotide; TTT chr11 5382601 5382622 5382618 5382623 +
ctgaaatttttctggtagtggt

SEQ ID NO: 109828 - DNA, 22 bp, Artificial Sequence
  Synthetic oligonucleotide; TTC chr11 5382602 5382623 5382619 5382624 +
tgaaatttttctggtagtggtg

SEQ ID NO: 109829 - DNA, 22 bp, Artificial Sequence
  Synthetic oligonucleotide; CTG chr11 5382604 5382625 5382621 5382626 +
aaatttttctggtagtggtgcc

SEQ ID NO: 109830 - DNA, 22 bp, Artificial Sequence
  Synthetic oligonucleotide; TTT chr11 5382610 5382631 5382627 5382632 +
ttctggtagtggtgccctctcc

SEQ ID NO: 109831 - DNA, 22 bp, Artificial Sequence
  Synthetic oligonucleotide; TTT chr11 5382611 5382632 5382628 5382633 +
tctggtagtggtgccctctcct

SEQ ID NO: 109832 - DNA, 22 bp, Artificial Sequence
  Synthetic oligonucleotide; TTT chr11 5382612 5382633 5382629 5382634 +
ctggtagtggtgccctctccta

SEQ ID NO: 109833 - DNA, 22 bp, Artificial Sequence
  Synthetic oligonucleotide; TTC chr11 5382613 5382634 5382630 5382635 +
tggtagtggtgccctctcctac

SEQ ID NO: 109834 - DNA, 22 bp, Artificial Sequence
  Synthetic oligonucleotide; CTG chr11 5382615 5382636 5382632 5382637 +
gtagtggtgccctctcctacaa

SEQ ID NO: 109835 - DNA, 22 bp, Artificial Sequence
  Synthetic oligonucleotide; CTC chr11 5382629 5382650 5382646 5382651 +
tcctacaagcctaaatgaagat

SEQ ID NO: 109836 - DNA, 22 bp, Artificial Sequence
  Synthetic oligonucleotide; CTC chr11 5382631 5382652 5382648 5382653 +
ctacaagcctaaatgaagatgc

SEQ ID NO: 109837 - DNA, 22 bp, Artificial Sequence
  Synthetic oligonucleotide; CTA chr11 5382634 5382655 5382651 5382656 +
caagcctaaatgaagatgctca

SEQ ID NO: 109838 - DNA, 22 bp, Artificial Sequence
  Synthetic oligonucleotide; CTA chr11 5382642 5382663 5382659 5382664 +
aatgaagatgctcagctccttc

SEQ ID NO: 109839 - DNA, 22 bp, Artificial Sequence
  Synthetic oligonucleotide; CTC chr11 5382655 5382676 5382672 5382677 +
agctccttcctattgtaccgaa

SEQ ID NO: 109840 - DNA, 22 bp, Artificial Sequence
  Synthetic oligonucleotide; CTC chr11 5382660 5382681 5382677 5382682 +
cttcctattgtaccgaagccag

SEQ ID NO: 109841 - DNA, 22 bp, Artificial Sequence
  Synthetic oligonucleotide; CTT chr11 5382663 5382684 5382680 5382685 +
cctattgtaccgaagccagaac

SEQ ID NO: 109842 - DNA, 22 bp, Artificial Sequence
  Synthetic oligonucleotide; TTC chr11 5382664 5382685 5382681 5382686 +
ctattgtaccgaagccagaacc

SEQ ID NO: 109843 - DNA, 22 bp, Artificial Sequence
  Synthetic oligonucleotide; CTA chr11 5382667 5382688 5382684 5382689 +
ttgtaccgaagccagaaccttc

SEQ ID NO: 109844 - DNA, 22 bp, Artificial Sequence
  Synthetic oligonucleotide; TTG chr11 5382670 5382691 5382687 5382692 +
taccgaagccagaaccttcctc

SEQ ID NO: 109845 - DNA, 22 bp, Artificial Sequence
  Synthetic oligonucleotide; CTT chr11 5382688 5382709 5382705 5382710 +
cctcataactacaatttaataa

SEQ ID NO: 109846 - DNA, 22 bp, Artificial Sequence
  Synthetic oligonucleotide; TTC chr11 5382689 5382710 5382706 5382711 +
ctcataactacaatttaataag

SEQ ID NO: 109847 - DNA, 22 bp, Artificial Sequence
  Synthetic oligonucleotide; CTC chr11 5382692 5382713 5382709 5382714 +
ataactacaatttaataagaca

SEQ ID NO: 109848 - DNA, 22 bp, Artificial Sequence
  Synthetic oligonucleotide; CTA chr11 5382699 5382720 5382716 5382721 +
caatttaataagacatcctgct

SEQ ID NO: 109849 - DNA, 22 bp, Artificial Sequence
  Synthetic oligonucleotide; TTT chr11 5382705 5382726 5382722 5382727 +
aataagacatcctgctctctgc

SEQ ID NO: 109850 - DNA, 22 bp, Artificial Sequence
  Synthetic oligonucleotide; TTA chr11 5382706 5382727 5382723 5382728 +
ataagacatcctgctctctgca

SEQ ID NO: 109851 - DNA, 22 bp, Artificial Sequence
  Synthetic oligonucleotide; CTG chr11 5382719 5382740 5382736 5382741 +
ctctctgcatcttgtcctatca

SEQ ID NO: 109852 - DNA, 22 bp, Artificial Sequence
  Synthetic oligonucleotide; CTC chr11 5382722 5382743 5382739 5382744 +
tctgcatcttgtcctatcaccc

SEQ ID NO: 109853 - DNA, 22 bp, Artificial Sequence
  Synthetic oligonucleotide; CTC chr11 5382724 5382745 5382741 5382746 +
tgcatcttgtcctatcaccctg

SEQ ID NO: 109854 - DNA, 22 bp, Artificial Sequence
  Synthetic oligonucleotide; CTG chr11 5382726 5382747 5382743 5382748 +
catcttgtcctatcaccctgac

SEQ ID NO: 109855 - DNA, 22 bp, Artificial Sequence
  Synthetic oligonucleotide; CTT chr11 5382732 5382753 5382749 5382754 +
gtcctatcaccctgactctcct

SEQ ID NO: 109856 - DNA, 22 bp, Artificial Sequence
  Synthetic oligonucleotide; TTG chr11 5382733 5382754 5382750 5382755 +
tcctatcaccctgactctccta

SEQ ID NO: 109857 - DNA, 22 bp, Artificial Sequence
  Synthetic oligonucleotide; CTA chr11 5382738 5382759 5382755 5382760 +
tcaccctgactctcctacactc

SEQ ID NO: 109858 - DNA, 22 bp, Artificial Sequence
  Synthetic oligonucleotide; CTG chr11 5382746 5382767 5382763 5382768 +
actctcctacactctggcccta

SEQ ID NO: 109859 - DNA, 22 bp, Artificial Sequence
  Synthetic oligonucleotide; CTC chr11 5382750 5382771 5382767 5382772 +
tcctacactctggccctaacaa

SEQ ID NO: 109860 - DNA, 22 bp, Artificial Sequence
  Synthetic oligonucleotide; CTC chr11 5382752 5382773 5382769 5382774 +
ctacactctggccctaacaacc

SEQ ID NO: 109861 - DNA, 22 bp, Artificial Sequence
  Synthetic oligonucleotide; CTA chr11 5382755 5382776 5382772 5382777 +
cactctggccctaacaaccagt

SEQ ID NO: 109862 - DNA, 22 bp, Artificial Sequence
  Synthetic oligonucleotide; CTC chr11 5382760 5382781 5382777 5382782 +
tggccctaacaaccagttactt

SEQ ID NO: 109863 - DNA, 22 bp, Artificial Sequence
  Synthetic oligonucleotide; CTG chr11 5382762 5382783 5382779 5382784 +
gccctaacaaccagttacttac

SEQ ID NO: 109864 - DNA, 22 bp, Artificial Sequence
  Synthetic oligonucleotide; CTA chr11 5382768 5382789 5382785 5382790 +
acaaccagttacttacccggtg

SEQ ID NO: 109865 - DNA, 22 bp, Artificial Sequence
  Synthetic oligonucleotide; TTA chr11 5382779 5382800 5382796 5382801 +
cttacccggtgtaaggtggtgc

SEQ ID NO: 109866 - DNA, 22 bp, Artificial Sequence
  Synthetic oligonucleotide; CTT chr11 5382782 5382803 5382799 5382804 +
acccggtgtaaggtggtgccac

SEQ ID NO: 109867 - DNA, 22 bp, Artificial Sequence
  Synthetic oligonucleotide; TTA chr11 5382783 5382804 5382800 5382805 +
cccggtgtaaggtggtgccact

SEQ ID NO: 109868 - DNA, 22 bp, Artificial Sequence
  Synthetic oligonucleotide; CTT chr11 5382806 5382827 5382823 5382828 +
ctgtctgggtgtggtctgatca

SEQ ID NO: 109869 - DNA, 22 bp, Artificial Sequence
  Synthetic oligonucleotide; TTC chr11 5382807 5382828 5382824 5382829 +
tgtctgggtgtggtctgatcac

SEQ ID NO: 109870 - DNA, 22 bp, Artificial Sequence
  Synthetic oligonucleotide; CTG chr11 5382809 5382830 5382826 5382831 +
tctgggtgtggtctgatcacaa

SEQ ID NO: 109871 - DNA, 22 bp, Artificial Sequence
  Synthetic oligonucleotide; CTG chr11 5382813 5382834 5382830 5382835 +
ggtgtggtctgatcacaatggc

SEQ ID NO: 109872 - DNA, 22 bp, Artificial Sequence
  Synthetic oligonucleotide; CTG chr11 5382824 5382845 5382841 5382846 +
atcacaatggcatgtcataaac

SEQ ID NO: 109873 - DNA, 22 bp, Artificial Sequence
  Synthetic oligonucleotide; CTT chr11 5382848 5382869 5382865 5382870 +
catgggtctctgtcctggtttt

SEQ ID NO: 109874 - DNA, 22 bp, Artificial Sequence
  Synthetic oligonucleotide; TTC chr11 5382849 5382870 5382866 5382871 +
atgggtctctgtcctggtttta

SEQ ID NO: 109875 - DNA, 22 bp, Artificial Sequence
  Synthetic oligonucleotide; CTC chr11 5382858 5382879 5382875 5382880 +
tgtcctggttttagatctgtat

SEQ ID NO: 109876 - DNA, 22 bp, Artificial Sequence
  Synthetic oligonucleotide; CTG chr11 5382860 5382881 5382877 5382882 +
tcctggttttagatctgtatgc

SEQ ID NO: 109877 - DNA, 22 bp, Artificial Sequence
  Synthetic oligonucleotide; CTG chr11 5382865 5382886 5382882 5382887 +
gttttagatctgtatgccccgt

SEQ ID NO: 109878 - DNA, 22 bp, Artificial Sequence
  Synthetic oligonucleotide; TTT chr11 5382869 5382890 5382886 5382891 +
tagatctgtatgccccgttttg

SEQ ID NO: 109879 - DNA, 22 bp, Artificial Sequence
  Synthetic oligonucleotide; TTT chr11 5382870 5382891 5382887 5382892 +
agatctgtatgccccgttttgg

SEQ ID NO: 109880 - DNA, 22 bp, Artificial Sequence
  Synthetic oligonucleotide; TTA chr11 5382871 5382892 5382888 5382893 +
gatctgtatgccccgttttgga

SEQ ID NO: 109881 - DNA, 22 bp, Artificial Sequence
  Synthetic oligonucleotide; CTG chr11 5382877 5382898 5382894 5382899 +
tatgccccgttttggagctcat

SEQ ID NO: 109882 - DNA, 22 bp, Artificial Sequence
  Synthetic oligonucleotide; TTT chr11 5382889 5382910 5382906 5382911 +
tggagctcatccccacacaact

SEQ ID NO: 109883 - DNA, 22 bp, Artificial Sequence
  Synthetic oligonucleotide; TTT chr11 5382890 5382911 5382907 5382912 +
ggagctcatccccacacaactc

SEQ ID NO: 109884 - DNA, 22 bp, Artificial Sequence
  Synthetic oligonucleotide; TTG chr11 5382891 5382912 5382908 5382913 +
gagctcatccccacacaactct

SEQ ID NO: 109885 - DNA, 22 bp, Artificial Sequence
  Synthetic oligonucleotide; CTC chr11 5382897 5382918 5382914 5382919 +
atccccacacaactctaatcaa

SEQ ID NO: 109886 - DNA, 22 bp, Artificial Sequence
  Synthetic oligonucleotide; CTC chr11 5382912 5382933 5382929 5382934 +
taatcaaccatgccctatttaa

SEQ ID NO: 109887 - DNA, 22 bp, Artificial Sequence
  Synthetic oligonucleotide; CTA chr11 5382914 5382935 5382931 5382936 +
atcaaccatgccctatttaaag

SEQ ID NO: 109888 - DNA, 22 bp, Artificial Sequence
  Synthetic oligonucleotide; CTA chr11 5382929 5382950 5382946 5382951 +
tttaaaggatgtaataccttgc

SEQ ID NO: 109889 - DNA, 22 bp, Artificial Sequence
  Synthetic oligonucleotide; TTT chr11 5382932 5382953 5382949 5382954 +
aaaggatgtaataccttgcttc

SEQ ID NO: 109890 - DNA, 22 bp, Artificial Sequence
  Synthetic oligonucleotide; TTA chr11 5382933 5382954 5382950 5382955 +
aaggatgtaataccttgcttca

SEQ ID NO: 109891 - DNA, 22 bp, Artificial Sequence
  Synthetic oligonucleotide; CTT chr11 5382949 5382970 5382966 5382971 +
gcttcatgccagtctccaagag

SEQ ID NO: 109892 - DNA, 22 bp, Artificial Sequence
  Synthetic oligonucleotide; TTG chr11 5382950 5382971 5382967 5382972 +
cttcatgccagtctccaagagt

SEQ ID NO: 109893 - DNA, 22 bp, Artificial Sequence
  Synthetic oligonucleotide; CTT chr11 5382953 5382974 5382970 5382975 +
catgccagtctccaagagtgtg

SEQ ID NO: 109894 - DNA, 22 bp, Artificial Sequence
  Synthetic oligonucleotide; TTC chr11 5382954 5382975 5382971 5382976 +
atgccagtctccaagagtgtgt

SEQ ID NO: 109895 - DNA, 22 bp, Artificial Sequence
  Synthetic oligonucleotide; CTC chr11 5382965 5382986 5382982 5382987 +
caagagtgtgtgtgtgtttgtg

SEQ ID NO: 109896 - DNA, 22 bp, Artificial Sequence
  Synthetic oligonucleotide; TTT chr11 5382984 5383005 5383001 5383006 +
gtggtggagaggttgtgtgtga

SEQ ID NO: 109897 - DNA, 22 bp, Artificial Sequence
  Synthetic oligonucleotide; TTG chr11 5382985 5383006 5383002 5383007 +
tggtggagaggttgtgtgtgag

SEQ ID NO: 109898 - DNA, 22 bp, Artificial Sequence
  Synthetic oligonucleotide; TTG chr11 5382999 5383020 5383016 5383021 +
tgtgtgagttttgaaagaaaag

SEQ ID NO: 109899 - DNA, 22 bp, Artificial Sequence
  Synthetic oligonucleotide; TTT chr11 5383010 5383031 5383027 5383032 +
tgaaagaaaagagaaatgtaca

SEQ ID NO: 109900 - DNA, 22 bp, Artificial Sequence
  Synthetic oligonucleotide; TTT chr11 5383011 5383032 5383028 5383033 +
gaaagaaaagagaaatgtacac

SEQ ID NO: 109901 - DNA, 22 bp, Artificial Sequence
  Synthetic oligonucleotide; TTG chr11 5383012 5383033 5383029 5383034 +
aaagaaaagagaaatgtacaca

SEQ ID NO: 109902 - DNA, 22 bp, Artificial Sequence
  Synthetic oligonucleotide; CTG chr11 5383041 5383062 5383058 5383063 +
atcacattaactcaggttctgt

SEQ ID NO: 109903 - DNA, 22 bp, Artificial Sequence
  Synthetic oligonucleotide; TTA chr11 5383050 5383071 5383067 5383072 +
actcaggttctgtagcatagtc

SEQ ID NO: 109904 - DNA, 22 bp, Artificial Sequence
  Synthetic oligonucleotide; CTC chr11 5383054 5383075 5383071 5383076 +
aggttctgtagcatagtctggg

SEQ ID NO: 109905 - DNA, 22 bp, Artificial Sequence
  Synthetic oligonucleotide; TTC chr11 5383060 5383081 5383077 5383082 +
tgtagcatagtctggggaagaa

SEQ ID NO: 109906 - DNA, 22 bp, Artificial Sequence
  Synthetic oligonucleotide; CTG chr11 5383062 5383083 5383079 5383084 +
tagcatagtctggggaagaagt

SEQ ID NO: 109907 - DNA, 22 bp, Artificial Sequence
  Synthetic oligonucleotide; CTG chr11 5383074 5383095 5383091 5383096 +
gggaagaagtacaagactattt

SEQ ID NO: 109908 - DNA, 22 bp, Artificial Sequence
  Synthetic oligonucleotide; CTA chr11 5383093 5383114 5383110 5383115 +
tttttttttttctaaatgttga

SEQ ID NO: 109909 - DNA, 22 bp, Artificial Sequence
  Synthetic oligonucleotide; TTT chr11 5383096 5383117 5383113 5383118 +
ttttttttctaaatgttgatgg

SEQ ID NO: 109910 - DNA, 22 bp, Artificial Sequence
  Synthetic oligonucleotide; TTT chr11 5383097 5383118 5383114 5383119 +
tttttttctaaatgttgatggc

SEQ ID NO: 109911 - DNA, 22 bp, Artificial Sequence
  Synthetic oligonucleotide; TTT chr11 5383098 5383119 5383115 5383120 +
ttttttctaaatgttgatggca

SEQ ID NO: 109912 - DNA, 22 bp, Artificial Sequence
  Synthetic oligonucleotide; TTT chr11 5383099 5383120 5383116 5383121 +
tttttctaaatgttgatggcat

SEQ ID NO: 109913 - DNA, 22 bp, Artificial Sequence
  Synthetic oligonucleotide; TTT chr11 5383100 5383121 5383117 5383122 +
ttttctaaatgttgatggcatt

SEQ ID NO: 109914 - DNA, 22 bp, Artificial Sequence
  Synthetic oligonucleotide; TTT chr11 5383101 5383122 5383118 5383123 +
tttctaaatgttgatggcattt

SEQ ID NO: 109915 - DNA, 22 bp, Artificial Sequence
  Synthetic oligonucleotide; TTT chr11 5383102 5383123 5383119 5383124 +
ttctaaatgttgatggcatttg

SEQ ID NO: 109916 - DNA, 22 bp, Artificial Sequence
  Synthetic oligonucleotide; TTT chr11 5383103 5383124 5383120 5383125 +
tctaaatgttgatggcatttgc

SEQ ID NO: 109917 - DNA, 22 bp, Artificial Sequence
  Synthetic oligonucleotide; TTT chr11 5383104 5383125 5383121 5383126 +
ctaaatgttgatggcatttgct

SEQ ID NO: 109918 - DNA, 22 bp, Artificial Sequence
  Synthetic oligonucleotide; TTC chr11 5383105 5383126 5383122 5383127 +
taaatgttgatggcatttgcta

SEQ ID NO: 109919 - DNA, 22 bp, Artificial Sequence
  Synthetic oligonucleotide; CTA chr11 5383107 5383128 5383124 5383129 +
aatgttgatggcatttgctacc

SEQ ID NO: 109920 - DNA, 22 bp, Artificial Sequence
  Synthetic oligonucleotide; TTG chr11 5383114 5383135 5383131 5383136 +
atggcatttgctaccagaaaag

SEQ ID NO: 109921 - DNA, 22 bp, Artificial Sequence
  Synthetic oligonucleotide; TTT chr11 5383123 5383144 5383140 5383145 +
gctaccagaaaagaaggaaaaa

SEQ ID NO: 109922 - DNA, 22 bp, Artificial Sequence
  Synthetic oligonucleotide; TTG chr11 5383124 5383145 5383141 5383146 +
ctaccagaaaagaaggaaaaaa

SEQ ID NO: 109923 - DNA, 22 bp, Artificial Sequence
  Synthetic oligonucleotide; CTA chr11 5383127 5383148 5383144 5383149 +
ccagaaaagaaggaaaaaagtt

SEQ ID NO: 109924 - DNA, 22 bp, Artificial Sequence
  Synthetic oligonucleotide; TTT chr11 5383150 5383171 5383167 5383172 +
tgtaaaggctacttgttgtagg

SEQ ID NO: 109925 - DNA, 22 bp, Artificial Sequence
  Synthetic oligonucleotide; TTT chr11 5383151 5383172 5383168 5383173 +
gtaaaggctacttgttgtaggg

SEQ ID NO: 109926 - DNA, 22 bp, Artificial Sequence
  Synthetic oligonucleotide; TTG chr11 5383152 5383173 5383169 5383174 +
taaaggctacttgttgtagggc

SEQ ID NO: 109927 - DNA, 22 bp, Artificial Sequence
  Synthetic oligonucleotide; CTA chr11 5383161 5383182 5383178 5383183 +
cttgttgtagggctcattgaag

SEQ ID NO: 109928 - DNA, 22 bp, Artificial Sequence
  Synthetic oligonucleotide; CTT chr11 5383164 5383185 5383181 5383186 +
gttgtagggctcattgaaggaa

SEQ ID NO: 109929 - DNA, 22 bp, Artificial Sequence
  Synthetic oligonucleotide; TTG chr11 5383165 5383186 5383182 5383187 +
ttgtagggctcattgaaggaaa

SEQ ID NO: 109930 - DNA, 22 bp, Artificial Sequence
  Synthetic oligonucleotide; TTG chr11 5383168 5383189 5383185 5383190 +
tagggctcattgaaggaaagtc

SEQ ID NO: 109931 - DNA, 22 bp, Artificial Sequence
  Synthetic oligonucleotide; CTC chr11 5383176 5383197 5383193 5383198 +
attgaaggaaagtccagtgcat

SEQ ID NO: 109932 - DNA, 22 bp, Artificial Sequence
  Synthetic oligonucleotide; TTG chr11 5383180 5383201 5383197 5383202 +
aaggaaagtccagtgcattcaa

SEQ ID NO: 109933 - DNA, 22 bp, Artificial Sequence
  Synthetic oligonucleotide; TTC chr11 5383200 5383221 5383217 5383222 +
aaagatgaagtagagagctttg

SEQ ID NO: 109934 - DNA, 22 bp, Artificial Sequence
  Synthetic oligonucleotide; CTT chr11 5383220 5383241 5383237 5383242 +
tgggaaagcctgagacactgac

SEQ ID NO: 109935 - DNA, 22 bp, Artificial Sequence
  Synthetic oligonucleotide; TTT chr11 5383221 5383242 5383238 5383243 +
gggaaagcctgagacactgacc

SEQ ID NO: 109936 - DNA, 22 bp, Artificial Sequence
  Synthetic oligonucleotide; TTG chr11 5383222 5383243 5383239 5383244 +
ggaaagcctgagacactgacct

SEQ ID NO: 109937 - DNA, 22 bp, Artificial Sequence
  Synthetic oligonucleotide; CTG chr11 5383232 5383253 5383249 5383254 +
agacactgacctggacatttgt

SEQ ID NO: 109938 - DNA, 22 bp, Artificial Sequence
  Synthetic oligonucleotide; CTG chr11 5383240 5383261 5383257 5383262 +
acctggacatttgtttggggta

SEQ ID NO: 109939 - DNA, 22 bp, Artificial Sequence
  Synthetic oligonucleotide; CTG chr11 5383245 5383266 5383262 5383267 +
gacatttgtttggggtaggatt

SEQ ID NO: 109940 - DNA, 22 bp, Artificial Sequence
  Synthetic oligonucleotide; TTT chr11 5383252 5383273 5383269 5383274 +
gtttggggtaggattgaatatg

SEQ ID NO: 109941 - DNA, 22 bp, Artificial Sequence
  Synthetic oligonucleotide; TTG chr11 5383253 5383274 5383270 5383275 +
tttggggtaggattgaatatgc

SEQ ID NO: 109942 - DNA, 22 bp, Artificial Sequence
  Synthetic oligonucleotide; TTT chr11 5383256 5383277 5383273 5383278 +
ggggtaggattgaatatgcaag

SEQ ID NO: 109943 - DNA, 22 bp, Artificial Sequence
  Synthetic oligonucleotide; TTG chr11 5383257 5383278 5383274 5383279 +
gggtaggattgaatatgcaaga

SEQ ID NO: 109944 - DNA, 22 bp, Artificial Sequence
  Synthetic oligonucleotide; TTG chr11 5383268 5383289 5383285 5383290 +
aatatgcaagattgacttctag

SEQ ID NO: 109945 - DNA, 22 bp, Artificial Sequence
  Synthetic oligonucleotide; TTG chr11 5383282 5383303 5383299 5383304 +
acttctaggtccaaagatatag

SEQ ID NO: 109946 - DNA, 22 bp, Artificial Sequence
  Synthetic oligonucleotide; CTT chr11 5383286 5383307 5383303 5383308 +
ctaggtccaaagatatagaggc

SEQ ID NO: 109947 - DNA, 22 bp, Artificial Sequence
  Synthetic oligonucleotide; TTC chr11 5383287 5383308 5383304 5383309 +
taggtccaaagatatagaggct

SEQ ID NO: 109948 - DNA, 22 bp, Artificial Sequence
  Synthetic oligonucleotide; CTA chr11 5383289 5383310 5383306 5383311 +
ggtccaaagatatagaggctgg

SEQ ID NO: 109949 - DNA, 22 bp, Artificial Sequence
  Synthetic oligonucleotide; CTG chr11 5383310 5383331 5383327 5383332 +
gcagagatggagggcaatttaa

SEQ ID NO: 109950 - DNA, 22 bp, Artificial Sequence
  Synthetic oligonucleotide; TTT chr11 5383330 5383351 5383347 5383352 +
aattatctgcagtaaatggaaa

SEQ ID NO: 109951 - DNA, 22 bp, Artificial Sequence
  Synthetic oligonucleotide; TTA chr11 5383331 5383352 5383348 5383353 +
attatctgcagtaaatggaaat

SEQ ID NO: 109952 - DNA, 22 bp, Artificial Sequence
  Synthetic oligonucleotide; TTA chr11 5383335 5383356 5383352 5383357 +
tctgcagtaaatggaaatataa

SEQ ID NO: 109953 - DNA, 22 bp, Artificial Sequence
  Synthetic oligonucleotide; CTG chr11 5383339 5383360 5383356 5383361 +
cagtaaatggaaatataaaaat

SEQ ID NO: 109954 - DNA, 22 bp, Artificial Sequence
  Synthetic oligonucleotide; CTT chr11 5383396 5383417 5383413 5383418 +
gaagtagtggtgattgtggtgc

SEQ ID NO: 109955 - DNA, 22 bp, Artificial Sequence
  Synthetic oligonucleotide; TTG chr11 5383397 5383418 5383414 5383419 +
aagtagtggtgattgtggtgct

SEQ ID NO: 109956 - DNA, 22 bp, Artificial Sequence
  Synthetic oligonucleotide; TTG chr11 5383412 5383433 5383429 5383434 +
tggtgcttcaaggcagatgtgc

SEQ ID NO: 109957 - DNA, 22 bp, Artificial Sequence
  Synthetic oligonucleotide; CTT chr11 5383420 5383441 5383437 5383442 +
caaggcagatgtgcaatttaaa

SEQ ID NO: 109958 - DNA, 22 bp, Artificial Sequence
  Synthetic oligonucleotide; TTC chr11 5383421 5383442 5383438 5383443 +
aaggcagatgtgcaatttaaaa

SEQ ID NO: 109959 - DNA, 22 bp, Artificial Sequence
  Synthetic oligonucleotide; TTT chr11 5383439 5383460 5383456 5383461 +
aaaagccactgtgaacatcaca

SEQ ID NO: 109960 - DNA, 22 bp, Artificial Sequence
  Synthetic oligonucleotide; TTA chr11 5383440 5383461 5383457 5383462 +
aaagccactgtgaacatcacat

SEQ ID NO: 109961 - DNA, 22 bp, Artificial Sequence
  Synthetic oligonucleotide; CTG chr11 5383450 5383471 5383467 5383472 +
tgaacatcacatggataatcct

SEQ ID NO: 109962 - DNA, 22 bp, Artificial Sequence
  Synthetic oligonucleotide; CTC chr11 5383473 5383494 5383490 5383495 +
ttcatatactacatccgacctc

SEQ ID NO: 109963 - DNA, 22 bp, Artificial Sequence
  Synthetic oligonucleotide; CTT chr11 5383475 5383496 5383492 5383497 +
catatactacatccgacctctc

SEQ ID NO: 109964 - DNA, 22 bp, Artificial Sequence
  Synthetic oligonucleotide; TTC chr11 5383476 5383497 5383493 5383498 +
atatactacatccgacctctct

SEQ ID NO: 109965 - DNA, 22 bp, Artificial Sequence
  Synthetic oligonucleotide; CTA chr11 5383484 5383505 5383501 5383506 +
catccgacctctctggaaaacg

SEQ ID NO: 109966 - DNA, 22 bp, Artificial Sequence
  Synthetic oligonucleotide; CTC chr11 5383495 5383516 5383512 5383517 +
tctggaaaacgacgggtccatt

SEQ ID NO: 109967 - DNA, 22 bp, Artificial Sequence
  Synthetic oligonucleotide; CTC chr11 5383497 5383518 5383514 5383519 +
tggaaaacgacgggtccattac

SEQ ID NO: 109968 - DNA, 22 bp, Artificial Sequence
  Synthetic oligonucleotide; CTG chr11 5383499 5383520 5383516 5383521 +
gaaaacgacgggtccattacta

SEQ ID NO: 109969 - DNA, 22 bp, Artificial Sequence
  Synthetic oligonucleotide; TTA chr11 5383518 5383539 5383535 5383540 +
ctagtggataacagaagacagt

SEQ ID NO: 109970 - DNA, 22 bp, Artificial Sequence
  Synthetic oligonucleotide; CTA chr11 5383521 5383542 5383538 5383543 +
gtggataacagaagacagtaaa

SEQ ID NO: 109971 - DNA, 22 bp, Artificial Sequence
  Synthetic oligonucleotide; TTG chr11 5383567 5383588 5383584 5383589 +
acttctttatgaaattaaaaat

SEQ ID NO: 109972 - DNA, 22 bp, Artificial Sequence
  Synthetic oligonucleotide; CTT chr11 5383571 5383592 5383588 5383593 +
ctttatgaaattaaaaataaac

SEQ ID NO: 109973 - DNA, 22 bp, Artificial Sequence
  Synthetic oligonucleotide; TTC chr11 5383572 5383593 5383589 5383594 +
tttatgaaattaaaaataaaca

SEQ ID NO: 109974 - DNA, 22 bp, Artificial Sequence
  Synthetic oligonucleotide; CTT chr11 5383574 5383595 5383591 5383596 +
tatgaaattaaaaataaacaga

SEQ ID NO: 109975 - DNA, 22 bp, Artificial Sequence
  Synthetic oligonucleotide; TTT chr11 5383575 5383596 5383592 5383597 +
atgaaattaaaaataaacagat

SEQ ID NO: 109976 - DNA, 22 bp, Artificial Sequence
  Synthetic oligonucleotide; TTA chr11 5383576 5383597 5383593 5383598 +
tgaaattaaaaataaacagata

SEQ ID NO: 109977 - DNA, 22 bp, Artificial Sequence
  Synthetic oligonucleotide; TTA chr11 5383584 5383605 5383601 5383606 +
aaaataaacagataaggcagta

SEQ ID NO: 109978 - DNA, 22 bp, Artificial Sequence
  Synthetic oligonucleotide; CTT chr11 5383612 5383633 5383629 5383634 +
ttgttgcagcagatgtctgtgt

SEQ ID NO: 109979 - DNA, 22 bp, Artificial Sequence
  Synthetic oligonucleotide; TTT chr11 5383613 5383634 5383630 5383635 +
tgttgcagcagatgtctgtgta

SEQ ID NO: 109980 - DNA, 22 bp, Artificial Sequence
  Synthetic oligonucleotide; TTT chr11 5383614 5383635 5383631 5383636 +
gttgcagcagatgtctgtgtag

SEQ ID NO: 109981 - DNA, 22 bp, Artificial Sequence
  Synthetic oligonucleotide; TTG chr11 5383615 5383636 5383632 5383637 +
ttgcagcagatgtctgtgtagc

SEQ ID NO: 109982 - DNA, 22 bp, Artificial Sequence
  Synthetic oligonucleotide; TTG chr11 5383618 5383639 5383635 5383640 +
cagcagatgtctgtgtagccaa

SEQ ID NO: 109983 - DNA, 22 bp, Artificial Sequence
  Synthetic oligonucleotide; CTG chr11 5383631 5383652 5383648 5383653 +
tgtagccaaaacctggggactg

SEQ ID NO: 109984 - DNA, 22 bp, Artificial Sequence
  Synthetic oligonucleotide; CTG chr11 5383646 5383667 5383663 5383668 +
gggactgaatgctaaaaagtta

SEQ ID NO: 109985 - DNA, 22 bp, Artificial Sequence
  Synthetic oligonucleotide; CTG chr11 5383653 5383674 5383670 5383675 +
aatgctaaaaagttagggctct

SEQ ID NO: 109986 - DNA, 22 bp, Artificial Sequence
  Synthetic oligonucleotide; CTA chr11 5383660 5383681 5383677 5383682 +
aaaagttagggctcttcagctt

SEQ ID NO: 109987 - DNA, 22 bp, Artificial Sequence
  Synthetic oligonucleotide; TTA chr11 5383668 5383689 5383685 5383690 +
gggctcttcagcttcaggagac

SEQ ID NO: 109988 - DNA, 22 bp, Artificial Sequence
  Synthetic oligonucleotide; CTC chr11 5383674 5383695 5383691 5383696 +
ttcagcttcaggagacaggggt

SEQ ID NO: 109989 - DNA, 22 bp, Artificial Sequence
  Synthetic oligonucleotide; CTT chr11 5383676 5383697 5383693 5383698 +
cagcttcaggagacaggggtgg

SEQ ID NO: 109990 - DNA, 22 bp, Artificial Sequence
  Synthetic oligonucleotide; TTC chr11 5383677 5383698 5383694 5383699 +
agcttcaggagacaggggtgga

SEQ ID NO: 109991 - DNA, 22 bp, Artificial Sequence
  Synthetic oligonucleotide; CTT chr11 5383682 5383703 5383699 5383704 +
caggagacaggggtggagataa

SEQ ID NO: 109992 - DNA, 22 bp, Artificial Sequence
  Synthetic oligonucleotide; TTC chr11 5383683 5383704 5383700 5383705 +
aggagacaggggtggagataaa

SEQ ID NO: 109993 - DNA, 22 bp, Artificial Sequence
  Synthetic oligonucleotide; TTT chr11 5383713 5383734 5383730 5383735 +
cctgcccataggattcccagcc

SEQ ID NO: 109994 - DNA, 22 bp, Artificial Sequence
  Synthetic oligonucleotide; TTC chr11 5383714 5383735 5383731 5383736 +
ctgcccataggattcccagccc

SEQ ID NO: 109995 - DNA, 22 bp, Artificial Sequence
  Synthetic oligonucleotide; CTG chr11 5383717 5383738 5383734 5383739 +
cccataggattcccagccctgg

SEQ ID NO: 109996 - DNA, 22 bp, Artificial Sequence
  Synthetic oligonucleotide; TTC chr11 5383729 5383750 5383746 5383751 +
ccagccctggggaccctttgtt

SEQ ID NO: 109997 - DNA, 22 bp, Artificial Sequence
  Synthetic oligonucleotide; CTG chr11 5383738 5383759 5383755 5383760 +
gggaccctttgtttaccattaa

SEQ ID NO: 109998 - DNA, 22 bp, Artificial Sequence
  Synthetic oligonucleotide; CTT chr11 5383747 5383768 5383764 5383769 +
tgtttaccattaagttctccca

SEQ ID NO: 109999 - DNA, 22 bp, Artificial Sequence
  Synthetic oligonucleotide; TTT chr11 5383748 5383769 5383765 5383770 +
gtttaccattaagttctcccag

SEQ ID NO: 110000 - DNA, 22 bp, Artificial Sequence
  Synthetic oligonucleotide; TTG chr11 5383749 5383770 5383766 5383771 +
tttaccattaagttctcccagc

SEQ ID NO: 110001 - DNA, 22 bp, Artificial Sequence
  Synthetic oligonucleotide; TTT chr11 5383752 5383773 5383769 5383774 +
accattaagttctcccagctgg

SEQ ID NO: 110002 - DNA, 22 bp, Artificial Sequence
  Synthetic oligonucleotide; TTA chr11 5383753 5383774 5383770 5383775 +
ccattaagttctcccagctgga

SEQ ID NO: 110003 - DNA, 22 bp, Artificial Sequence
  Synthetic oligonucleotide; TTA chr11 5383759 5383780 5383776 5383781 +
agttctcccagctggagccatg

SEQ ID NO: 110004 - DNA, 22 bp, Artificial Sequence
  Synthetic oligonucleotide; TTC chr11 5383764 5383785 5383781 5383786 +
tcccagctggagccatggtctt

SEQ ID NO: 110005 - DNA, 22 bp, Artificial Sequence
  Synthetic oligonucleotide; CTC chr11 5383766 5383787 5383783 5383788 +
ccagctggagccatggtcttta

SEQ ID NO: 110006 - DNA, 22 bp, Artificial Sequence
  Synthetic oligonucleotide; CTG chr11 5383773 5383794 5383790 5383795 +
gagccatggtctttaggaggat

SEQ ID NO: 110007 - DNA, 22 bp, Artificial Sequence
  Synthetic oligonucleotide; CTT chr11 5383786 5383807 5383803 5383808 +
taggaggataaatccttctgtg

SEQ ID NO: 110008 - DNA, 22 bp, Artificial Sequence
  Synthetic oligonucleotide; TTT chr11 5383787 5383808 5383804 5383809 +
aggaggataaatccttctgtga

SEQ ID NO: 110009 - DNA, 22 bp, Artificial Sequence
  Synthetic oligonucleotide; TTA chr11 5383788 5383809 5383805 5383810 +
ggaggataaatccttctgtgac

SEQ ID NO: 110010 - DNA, 22 bp, Artificial Sequence
  Synthetic oligonucleotide; CTT chr11 5383803 5383824 5383820 5383825 +
ctgtgacagccacagccttgtg

SEQ ID NO: 110011 - DNA, 22 bp, Artificial Sequence
  Synthetic oligonucleotide; TTC chr11 5383804 5383825 5383821 5383826 +
tgtgacagccacagccttgtgc

SEQ ID NO: 110012 - DNA, 22 bp, Artificial Sequence
  Synthetic oligonucleotide; CTG chr11 5383806 5383827 5383823 5383828 +
tgacagccacagccttgtgcct

SEQ ID NO: 110013 - DNA, 22 bp, Artificial Sequence
  Synthetic oligonucleotide; CTT chr11 5383822 5383843 5383839 5383844 +
gtgcctctcagtgacccttgtg

SEQ ID NO: 110014 - DNA, 22 bp, Artificial Sequence
  Synthetic oligonucleotide; TTG chr11 5383823 5383844 5383840 5383845 +
tgcctctcagtgacccttgtgt

SEQ ID NO: 110015 - DNA, 22 bp, Artificial Sequence
  Synthetic oligonucleotide; CTC chr11 5383829 5383850 5383846 5383851 +
tcagtgacccttgtgtcatcct

SEQ ID NO: 110016 - DNA, 22 bp, Artificial Sequence
  Synthetic oligonucleotide; CTC chr11 5383831 5383852 5383848 5383853 +
agtgacccttgtgtcatcctta

SEQ ID NO: 110017 - DNA, 22 bp, Artificial Sequence
  Synthetic oligonucleotide; CTT chr11 5383841 5383862 5383858 5383863 +
gtgtcatccttatctatactct

SEQ ID NO: 110018 - DNA, 22 bp, Artificial Sequence
  Synthetic oligonucleotide; TTG chr11 5383842 5383863 5383859 5383864 +
tgtcatccttatctatactctt

SEQ ID NO: 110019 - DNA, 22 bp, Artificial Sequence
  Synthetic oligonucleotide; CTT chr11 5383852 5383873 5383869 5383874 +
atctatactcttctttcttcct

SEQ ID NO: 110020 - DNA, 22 bp, Artificial Sequence
  Synthetic oligonucleotide; TTA chr11 5383853 5383874 5383870 5383875 +
tctatactcttctttcttcctt

SEQ ID NO: 110021 - DNA, 22 bp, Artificial Sequence
  Synthetic oligonucleotide; CTA chr11 5383857 5383878 5383874 5383879 +
tactcttctttcttcctttgga

SEQ ID NO: 110022 - DNA, 22 bp, Artificial Sequence
  Synthetic oligonucleotide; CTC chr11 5383862 5383883 5383879 5383884 +
ttctttcttcctttggaaccta

SEQ ID NO: 110023 - DNA, 22 bp, Artificial Sequence
  Synthetic oligonucleotide; CTT chr11 5383864 5383885 5383881 5383886 +
ctttcttcctttggaacctact

SEQ ID NO: 110024 - DNA, 22 bp, Artificial Sequence
  Synthetic oligonucleotide; TTC chr11 5383865 5383886 5383882 5383887 +
tttcttcctttggaacctactc

SEQ ID NO: 110025 - DNA, 22 bp, Artificial Sequence
  Synthetic oligonucleotide; CTT chr11 5383867 5383888 5383884 5383889 +
tcttcctttggaacctactcat

SEQ ID NO: 110026 - DNA, 22 bp, Artificial Sequence
  Synthetic oligonucleotide; TTT chr11 5383868 5383889 5383885 5383890 +
cttcctttggaacctactcatt

SEQ ID NO: 110027 - DNA, 22 bp, Artificial Sequence
  Synthetic oligonucleotide; TTC chr11 5383869 5383890 5383886 5383891 +
ttcctttggaacctactcattg

SEQ ID NO: 110028 - DNA, 22 bp, Artificial Sequence
  Synthetic oligonucleotide; CTT chr11 5383871 5383892 5383888 5383893 +
cctttggaacctactcattggc

SEQ ID NO: 110029 - DNA, 22 bp, Artificial Sequence
  Synthetic oligonucleotide; TTC chr11 5383872 5383893 5383889 5383894 +
ctttggaacctactcattggct

SEQ ID NO: 110030 - DNA, 22 bp, Artificial Sequence
  Synthetic oligonucleotide; CTT chr11 5383875 5383896 5383892 5383897 +
tggaacctactcattggcttca

SEQ ID NO: 110031 - DNA, 22 bp, Artificial Sequence
  Synthetic oligonucleotide; TTT chr11 5383876 5383897 5383893 5383898 +
ggaacctactcattggcttcac

SEQ ID NO: 110032 - DNA, 22 bp, Artificial Sequence
  Synthetic oligonucleotide; TTG chr11 5383877 5383898 5383894 5383899 +
gaacctactcattggcttcaca

SEQ ID NO: 110033 - DNA, 22 bp, Artificial Sequence
  Synthetic oligonucleotide; CTA chr11 5383884 5383905 5383901 5383906 +
ctcattggcttcacatttttgt

SEQ ID NO: 110034 - DNA, 22 bp, Artificial Sequence
  Synthetic oligonucleotide; CTC chr11 5383887 5383908 5383904 5383909 +
attggcttcacatttttgttat

SEQ ID NO: 110035 - DNA, 22 bp, Artificial Sequence
  Synthetic oligonucleotide; TTG chr11 5383891 5383912 5383908 5383913 +
gcttcacatttttgttattacc

SEQ ID NO: 110036 - DNA, 22 bp, Artificial Sequence
  Synthetic oligonucleotide; CTT chr11 5383895 5383916 5383912 5383917 +
cacatttttgttattacctgct

SEQ ID NO: 110037 - DNA, 22 bp, Artificial Sequence
  Synthetic oligonucleotide; TTC chr11 5383896 5383917 5383913 5383918 +
acatttttgttattacctgctg

SEQ ID NO: 110038 - DNA, 22 bp, Artificial Sequence
  Synthetic oligonucleotide; TTT chr11 5383902 5383923 5383919 5383924 +
ttgttattacctgctggtgagt

SEQ ID NO: 110039 - DNA, 22 bp, Artificial Sequence
  Synthetic oligonucleotide; TTT chr11 5383903 5383924 5383920 5383925 +
tgttattacctgctggtgagtc

SEQ ID NO: 110040 - DNA, 22 bp, Artificial Sequence
  Synthetic oligonucleotide; TTT chr11 5383904 5383925 5383921 5383926 +
gttattacctgctggtgagtct

SEQ ID NO: 110041 - DNA, 22 bp, Artificial Sequence
  Synthetic oligonucleotide; TTG chr11 5383905 5383926 5383922 5383927 +
ttattacctgctggtgagtctc

SEQ ID NO: 110042 - DNA, 22 bp, Artificial Sequence
  Synthetic oligonucleotide; TTA chr11 5383908 5383929 5383925 5383930 +
ttacctgctggtgagtctcact

SEQ ID NO: 110043 - DNA, 22 bp, Artificial Sequence
  Synthetic oligonucleotide; TTA chr11 5383911 5383932 5383928 5383933 +
cctgctggtgagtctcactact

SEQ ID NO: 110044 - DNA, 22 bp, Artificial Sequence
  Synthetic oligonucleotide; CTG chr11 5383915 5383936 5383932 5383937 +
ctggtgagtctcactactgtct

SEQ ID NO: 110045 - DNA, 22 bp, Artificial Sequence
  Synthetic oligonucleotide; CTG chr11 5383918 5383939 5383935 5383940 +
gtgagtctcactactgtcttgt

SEQ ID NO: 110046 - DNA, 22 bp, Artificial Sequence
  Synthetic oligonucleotide; CTC chr11 5383927 5383948 5383944 5383949 +
actactgtcttgtgccggggtt

SEQ ID NO: 110047 - DNA, 22 bp, Artificial Sequence
  Synthetic oligonucleotide; CTA chr11 5383931 5383952 5383948 5383953 +
ctgtcttgtgccggggtttcag

SEQ ID NO: 110048 - DNA, 22 bp, Artificial Sequence
  Synthetic oligonucleotide; CTG chr11 5383934 5383955 5383951 5383956 +
tcttgtgccggggtttcaggag

SEQ ID NO: 110049 - DNA, 22 bp, Artificial Sequence
  Synthetic oligonucleotide; CTT chr11 5383938 5383959 5383955 5383960 +
gtgccggggtttcaggagtggg

SEQ ID NO: 110050 - DNA, 22 bp, Artificial Sequence
  Synthetic oligonucleotide; TTG chr11 5383939 5383960 5383956 5383961 +
tgccggggtttcaggagtgggt

SEQ ID NO: 110051 - DNA, 22 bp, Artificial Sequence
  Synthetic oligonucleotide; TTT chr11 5383950 5383971 5383967 5383972 +
caggagtgggtaattaggggga

SEQ ID NO: 110052 - DNA, 22 bp, Artificial Sequence
  Synthetic oligonucleotide; TTC chr11 5383951 5383972 5383968 5383973 +
aggagtgggtaattagggggac

SEQ ID NO: 110053 - DNA, 22 bp, Artificial Sequence
  Synthetic oligonucleotide; TTA chr11 5383966 5383987 5383983 5383988 +
gggggacatgggagagaggagg

SEQ ID NO: 110054 - DNA, 22 bp, Artificial Sequence
  Synthetic oligonucleotide; CTC chr11 5384056 5384077 5384073 5384078 +
agttacaattaaggcttttccc

SEQ ID NO: 110055 - DNA, 22 bp, Artificial Sequence
  Synthetic oligonucleotide; TTA chr11 5384061 5384082 5384078 5384083 +
caattaaggcttttcccccaaa

SEQ ID NO: 110056 - DNA, 22 bp, Artificial Sequence
  Synthetic oligonucleotide; TTA chr11 5384067 5384088 5384084 5384089 +
aggcttttcccccaaatgtttg

SEQ ID NO: 110057 - DNA, 22 bp, Artificial Sequence
  Synthetic oligonucleotide; CTT chr11 5384073 5384094 5384090 5384095 +
ttcccccaaatgtttgaatgtc

SEQ ID NO: 110058 - DNA, 22 bp, Artificial Sequence
  Synthetic oligonucleotide; TTT chr11 5384074 5384095 5384091 5384096 +
tcccccaaatgtttgaatgtcc

SEQ ID NO: 110059 - DNA, 22 bp, Artificial Sequence
  Synthetic oligonucleotide; TTT chr11 5384075 5384096 5384092 5384097 +
cccccaaatgtttgaatgtcct

SEQ ID NO: 110060 - DNA, 22 bp, Artificial Sequence
  Synthetic oligonucleotide; TTC chr11 5384076 5384097 5384093 5384098 +
ccccaaatgtttgaatgtcctt

SEQ ID NO: 110061 - DNA, 22 bp, Artificial Sequence
  Synthetic oligonucleotide; TTT chr11 5384088 5384109 5384105 5384110 +
gaatgtccttagccaaatggat

SEQ ID NO: 110062 - DNA, 22 bp, Artificial Sequence
  Synthetic oligonucleotide; TTG chr11 5384089 5384110 5384106 5384111 +
aatgtccttagccaaatggatt

SEQ ID NO: 110063 - DNA, 22 bp, Artificial Sequence
  Synthetic oligonucleotide; CTT chr11 5384098 5384119 5384115 5384120 +
agccaaatggattccccacatt

SEQ ID NO: 110064 - DNA, 22 bp, Artificial Sequence
  Synthetic oligonucleotide; TTA chr11 5384099 5384120 5384116 5384121 +
gccaaatggattccccacattc

SEQ ID NO: 110065 - DNA, 22 bp, Artificial Sequence
  Synthetic oligonucleotide; TTC chr11 5384112 5384133 5384129 5384134 +
cccacattccctgcactaagcc

SEQ ID NO: 110066 - DNA, 22 bp, Artificial Sequence
  Synthetic oligonucleotide; TTC chr11 5384121 5384142 5384138 5384143 +
cctgcactaagcctaatgggat

SEQ ID NO: 110067 - DNA, 22 bp, Artificial Sequence
  Synthetic oligonucleotide; CTG chr11 5384125 5384146 5384142 5384147 +
cactaagcctaatgggattttt

SEQ ID NO: 110068 - DNA, 22 bp, Artificial Sequence
  Synthetic oligonucleotide; CTA chr11 5384130 5384151 5384147 5384152 +
agcctaatgggatttttttttc

SEQ ID NO: 110069 - DNA, 22 bp, Artificial Sequence
  Synthetic oligonucleotide; CTA chr11 5384136 5384157 5384153 5384158 +
atgggatttttttttctttgtt

SEQ ID NO: 110070 - DNA, 22 bp, Artificial Sequence
  Synthetic oligonucleotide; TTT chr11 5384145 5384166 5384162 5384167 +
ttttttctttgttttcttttgt

SEQ ID NO: 110071 - DNA, 22 bp, Artificial Sequence
  Synthetic oligonucleotide; TTT chr11 5384146 5384167 5384163 5384168 +
tttttctttgttttcttttgtt

SEQ ID NO: 110072 - DNA, 22 bp, Artificial Sequence
  Synthetic oligonucleotide; TTT chr11 5384147 5384168 5384164 5384169 +
ttttctttgttttcttttgttg

SEQ ID NO: 110073 - DNA, 22 bp, Artificial Sequence
  Synthetic oligonucleotide; TTT chr11 5384148 5384169 5384165 5384170 +
tttctttgttttcttttgttgt

SEQ ID NO: 110074 - DNA, 22 bp, Artificial Sequence
  Synthetic oligonucleotide; TTT chr11 5384149 5384170 5384166 5384171 +
ttctttgttttcttttgttgtt

SEQ ID NO: 110075 - DNA, 22 bp, Artificial Sequence
  Synthetic oligonucleotide; TTT chr11 5384150 5384171 5384167 5384172 +
tctttgttttcttttgttgttg

SEQ ID NO: 110076 - DNA, 22 bp, Artificial Sequence
  Synthetic oligonucleotide; TTT chr11 5384151 5384172 5384168 5384173 +
ctttgttttcttttgttgttgt

SEQ ID NO: 110077 - DNA, 22 bp, Artificial Sequence
  Synthetic oligonucleotide; TTC chr11 5384152 5384173 5384169 5384174 +
tttgttttcttttgttgttgtt

SEQ ID NO: 110078 - DNA, 22 bp, Artificial Sequence
  Synthetic oligonucleotide; CTT chr11 5384154 5384175 5384171 5384176 +
tgttttcttttgttgttgtttc

SEQ ID NO: 110079 - DNA, 22 bp, Artificial Sequence
  Synthetic oligonucleotide; TTT chr11 5384155 5384176 5384172 5384177 +
gttttcttttgttgttgtttct

SEQ ID NO: 110080 - DNA, 22 bp, Artificial Sequence
  Synthetic oligonucleotide; TTG chr11 5384156 5384177 5384173 5384178 +
ttttcttttgttgttgtttctt

SEQ ID NO: 110081 - DNA, 22 bp, Artificial Sequence
  Synthetic oligonucleotide; TTT chr11 5384159 5384180 5384176 5384181 +
tcttttgttgttgtttctttgt

SEQ ID NO: 110082 - DNA, 22 bp, Artificial Sequence
  Synthetic oligonucleotide; TTT chr11 5384160 5384181 5384177 5384182 +
cttttgttgttgtttctttgtt

SEQ ID NO: 110083 - DNA, 22 bp, Artificial Sequence
  Synthetic oligonucleotide; TTC chr11 5384161 5384182 5384178 5384183 +
ttttgttgttgtttctttgttt

SEQ ID NO: 110084 - DNA, 22 bp, Artificial Sequence
  Synthetic oligonucleotide; CTT chr11 5384163 5384184 5384180 5384185 +
ttgttgttgtttctttgtttgt

SEQ ID NO: 110085 - DNA, 22 bp, Artificial Sequence
  Synthetic oligonucleotide; TTT chr11 5384164 5384185 5384181 5384186 +
tgttgttgtttctttgtttgtt

SEQ ID NO: 110086 - DNA, 22 bp, Artificial Sequence
  Synthetic oligonucleotide; TTT chr11 5384165 5384186 5384182 5384187 +
gttgttgtttctttgtttgttg

SEQ ID NO: 110087 - DNA, 22 bp, Artificial Sequence
  Synthetic oligonucleotide; TTG chr11 5384166 5384187 5384183 5384188 +
ttgttgtttctttgtttgttgt

SEQ ID NO: 110088 - DNA, 22 bp, Artificial Sequence
  Synthetic oligonucleotide; TTG chr11 5384169 5384190 5384186 5384191 +
ttgtttctttgtttgttgtttt

SEQ ID NO: 110089 - DNA, 22 bp, Artificial Sequence
  Synthetic oligonucleotide; TTG chr11 5384172 5384193 5384189 5384194 +
tttctttgtttgttgtttttag

SEQ ID NO: 110090 - DNA, 22 bp, Artificial Sequence
  Synthetic oligonucleotide; TTT chr11 5384175 5384196 5384192 5384197 +
ctttgtttgttgtttttagaaa

SEQ ID NO: 110091 - DNA, 22 bp, Artificial Sequence
  Synthetic oligonucleotide; TTC chr11 5384176 5384197 5384193 5384198 +
tttgtttgttgtttttagaaat

SEQ ID NO: 110092 - DNA, 22 bp, Artificial Sequence
  Synthetic oligonucleotide; CTT chr11 5384178 5384199 5384195 5384200 +
tgtttgttgtttttagaaatga

SEQ ID NO: 110093 - DNA, 22 bp, Artificial Sequence
  Synthetic oligonucleotide; TTT chr11 5384179 5384200 5384196 5384201 +
gtttgttgtttttagaaatgag

SEQ ID NO: 110094 - DNA, 22 bp, Artificial Sequence
  Synthetic oligonucleotide; TTG chr11 5384180 5384201 5384197 5384202 +
tttgttgtttttagaaatgagg

SEQ ID NO: 110095 - DNA, 22 bp, Artificial Sequence
  Synthetic oligonucleotide; TTT chr11 5384183 5384204 5384200 5384205 +
gttgtttttagaaatgaggtct

SEQ ID NO: 110096 - DNA, 22 bp, Artificial Sequence
  Synthetic oligonucleotide; TTG chr11 5384184 5384205 5384201 5384206 +
ttgtttttagaaatgaggtcta

SEQ ID NO: 110097 - DNA, 22 bp, Artificial Sequence
  Synthetic oligonucleotide; TTG chr11 5384187 5384208 5384204 5384209 +
tttttagaaatgaggtctagct

SEQ ID NO: 110098 - DNA, 22 bp, Artificial Sequence
  Synthetic oligonucleotide; TTT chr11 5384190 5384211 5384207 5384212 +
ttagaaatgaggtctagctctg

SEQ ID NO: 110099 - DNA, 22 bp, Artificial Sequence
  Synthetic oligonucleotide; TTT chr11 5384191 5384212 5384208 5384213 +
tagaaatgaggtctagctctgt

SEQ ID NO: 110100 - DNA, 22 bp, Artificial Sequence
  Synthetic oligonucleotide; TTT chr11 5384192 5384213 5384209 5384214 +
agaaatgaggtctagctctgtt

SEQ ID NO: 110101 - DNA, 22 bp, Artificial Sequence
  Synthetic oligonucleotide; TTA chr11 5384193 5384214 5384210 5384215 +
gaaatgaggtctagctctgtta

SEQ ID NO: 110102 - DNA, 22 bp, Artificial Sequence
  Synthetic oligonucleotide; CTA chr11 5384206 5384227 5384223 5384228 +
gctctgttacccaggctacagt

SEQ ID NO: 110103 - DNA, 22 bp, Artificial Sequence
  Synthetic oligonucleotide; CTC chr11 5384210 5384231 5384227 5384232 +
tgttacccaggctacagtgcag

SEQ ID NO: 110104 - DNA, 22 bp, Artificial Sequence
  Synthetic oligonucleotide; CTG chr11 5384212 5384233 5384229 5384234 +
ttacccaggctacagtgcagtg

SEQ ID NO: 110105 - DNA, 22 bp, Artificial Sequence
  Synthetic oligonucleotide; TTA chr11 5384215 5384236 5384232 5384237 +
cccaggctacagtgcagtggtg

SEQ ID NO: 110106 - DNA, 22 bp, Artificial Sequence
  Synthetic oligonucleotide; CTA chr11 5384224 5384245 5384241 5384246 +
cagtgcagtggtgtaatcatag

SEQ ID NO: 110107 - DNA, 22 bp, Artificial Sequence
  Synthetic oligonucleotide; CTC chr11 5384249 5384270 5384266 5384271 +
actgtaaactcaaaccggattc

SEQ ID NO: 110108 - DNA, 22 bp, Artificial Sequence
  Synthetic oligonucleotide; CTG chr11 5384253 5384274 5384270 5384275 +
taaactcaaaccggattcaagc

SEQ ID NO: 110109 - DNA, 22 bp, Artificial Sequence
  Synthetic oligonucleotide; CTC chr11 5384260 5384281 5384277 5384282 +
aaaccggattcaagcaatcctc

SEQ ID NO: 110110 - DNA, 22 bp, Artificial Sequence
  Synthetic oligonucleotide; TTC chr11 5384271 5384292 5384288 5384293 +
aagcaatcctcccaccttattc

SEQ ID NO: 110111 - DNA, 22 bp, Artificial Sequence
  Synthetic oligonucleotide; CTC chr11 5384282 5384303 5384299 5384304 +
ccaccttattcttccaagttgc

SEQ ID NO: 110112 - DNA, 22 bp, Artificial Sequence
  Synthetic oligonucleotide; CTT chr11 5384289 5384310 5384306 5384311 +
attcttccaagttgccaggatt

SEQ ID NO: 110113 - DNA, 22 bp, Artificial Sequence
  Synthetic oligonucleotide; TTA chr11 5384290 5384311 5384307 5384312 +
ttcttccaagttgccaggatta

SEQ ID NO: 110114 - DNA, 22 bp, Artificial Sequence
  Synthetic oligonucleotide; TTC chr11 5384293 5384314 5384310 5384315 +
ttccaagttgccaggattataa

SEQ ID NO: 110115 - DNA, 22 bp, Artificial Sequence
  Synthetic oligonucleotide; CTT chr11 5384295 5384316 5384312 5384317 +
ccaagttgccaggattataagt

SEQ ID NO: 110116 - DNA, 22 bp, Artificial Sequence
  Synthetic oligonucleotide; TTC chr11 5384296 5384317 5384313 5384318 +
caagttgccaggattataagtg

SEQ ID NO: 110117 - DNA, 22 bp, Artificial Sequence
  Synthetic oligonucleotide; TTG chr11 5384303 5384324 5384320 5384325 +
ccaggattataagtgtgaacca

SEQ ID NO: 110118 - DNA, 22 bp, Artificial Sequence
  Synthetic oligonucleotide; TTA chr11 5384312 5384333 5384329 5384334 +
taagtgtgaaccaccatataca

SEQ ID NO: 110119 - DNA, 22 bp, Artificial Sequence
  Synthetic oligonucleotide; CTG chr11 5384342 5384363 5384359 5384364 +
ggccttagatttttcacttgga

SEQ ID NO: 110120 - DNA, 22 bp, Artificial Sequence
  Synthetic oligonucleotide; CTT chr11 5384348 5384369 5384365 5384370 +
agatttttcacttggaaaatga

SEQ ID NO: 110121 - DNA, 22 bp, Artificial Sequence
  Synthetic oligonucleotide; TTA chr11 5384349 5384370 5384366 5384371 +
gatttttcacttggaaaatgaa

SEQ ID NO: 110122 - DNA, 22 bp, Artificial Sequence
  Synthetic oligonucleotide; TTT chr11 5384354 5384375 5384371 5384376 +
ttcacttggaaaatgaagtctt

SEQ ID NO: 110123 - DNA, 22 bp, Artificial Sequence
  Synthetic oligonucleotide; TTT chr11 5384355 5384376 5384372 5384377 +
tcacttggaaaatgaagtctta

SEQ ID NO: 110124 - DNA, 22 bp, Artificial Sequence
  Synthetic oligonucleotide; TTT chr11 5384356 5384377 5384373 5384378 +
cacttggaaaatgaagtcttag

SEQ ID NO: 110125 - DNA, 22 bp, Artificial Sequence
  Synthetic oligonucleotide; TTC chr11 5384357 5384378 5384374 5384379 +
acttggaaaatgaagtcttaga

SEQ ID NO: 110126 - DNA, 22 bp, Artificial Sequence
  Synthetic oligonucleotide; CTT chr11 5384361 5384382 5384378 5384383 +
ggaaaatgaagtcttagaaacc

SEQ ID NO: 110127 - DNA, 22 bp, Artificial Sequence
  Synthetic oligonucleotide; TTG chr11 5384362 5384383 5384379 5384384 +
gaaaatgaagtcttagaaacca

SEQ ID NO: 110128 - DNA, 22 bp, Artificial Sequence
  Synthetic oligonucleotide; CTT chr11 5384376 5384397 5384393 5384398 +
agaaaccagggttctcacagaa

SEQ ID NO: 110129 - DNA, 22 bp, Artificial Sequence
  Synthetic oligonucleotide; TTA chr11 5384377 5384398 5384394 5384399 +
gaaaccagggttctcacagaat

SEQ ID NO: 110130 - DNA, 22 bp, Artificial Sequence
  Synthetic oligonucleotide; TTC chr11 5384390 5384411 5384407 5384412 +
tcacagaatctcttctgatatt

SEQ ID NO: 110131 - DNA, 22 bp, Artificial Sequence
  Synthetic oligonucleotide; CTC chr11 5384392 5384413 5384409 5384414 +
acagaatctcttctgatattct

SEQ ID NO: 110132 - DNA, 22 bp, Artificial Sequence
  Synthetic oligonucleotide; CTC chr11 5384402 5384423 5384419 5384424 +
ttctgatattctcagagtctat

SEQ ID NO: 110133 - DNA, 22 bp, Artificial Sequence
  Synthetic oligonucleotide; CTT chr11 5384404 5384425 5384421 5384426 +
ctgatattctcagagtctatgc

SEQ ID NO: 110134 - DNA, 22 bp, Artificial Sequence
  Synthetic oligonucleotide; TTC chr11 5384405 5384426 5384422 5384427 +
tgatattctcagagtctatgca

SEQ ID NO: 110135 - DNA, 22 bp, Artificial Sequence
  Synthetic oligonucleotide; CTG chr11 5384407 5384428 5384424 5384429 +
atattctcagagtctatgcaca

SEQ ID NO: 110136 - DNA, 22 bp, Artificial Sequence
  Synthetic oligonucleotide; TTC chr11 5384413 5384434 5384430 5384435 +
tcagagtctatgcacagaacca

SEQ ID NO: 110137 - DNA, 22 bp, Artificial Sequence
  Synthetic oligonucleotide; CTC chr11 5384415 5384436 5384432 5384437 +
agagtctatgcacagaaccaga

SEQ ID NO: 110138 - DNA, 22 bp, Artificial Sequence
  Synthetic oligonucleotide; CTA chr11 5384423 5384444 5384440 5384445 +
tgcacagaaccagagccagaga

SEQ ID NO: 110139 - DNA, 22 bp, Artificial Sequence
  Synthetic oligonucleotide; CTT chr11 5384466 5384487 5384483 5384488 +
ctcttgctggaaaagaggcgag

SEQ ID NO: 110140 - DNA, 22 bp, Artificial Sequence
  Synthetic oligonucleotide; TTC chr11 5384467 5384488 5384484 5384489 +
tcttgctggaaaagaggcgagc

SEQ ID NO: 110141 - DNA, 22 bp, Artificial Sequence
  Synthetic oligonucleotide; CTC chr11 5384469 5384490 5384486 5384491 +
ttgctggaaaagaggcgagctc

SEQ ID NO: 110142 - DNA, 22 bp, Artificial Sequence
  Synthetic oligonucleotide; CTT chr11 5384471 5384492 5384488 5384493 +
gctggaaaagaggcgagctcat

SEQ ID NO: 110143 - DNA, 22 bp, Artificial Sequence
  Synthetic oligonucleotide; TTG chr11 5384472 5384493 5384489 5384494 +
ctggaaaagaggcgagctcatc

SEQ ID NO: 110144 - DNA, 22 bp, Artificial Sequence
  Synthetic oligonucleotide; CTG chr11 5384475 5384496 5384492 5384497 +
gaaaagaggcgagctcatctgc

SEQ ID NO: 110145 - DNA, 22 bp, Artificial Sequence
  Synthetic oligonucleotide; CTC chr11 5384491 5384512 5384508 5384513 +
atctgcagtattctgttaggaa

SEQ ID NO: 110146 - DNA, 22 bp, Artificial Sequence
  Synthetic oligonucleotide; CTG chr11 5384496 5384517 5384513 5384518 +
cagtattctgttaggaaggcca

SEQ ID NO: 110147 - DNA, 22 bp, Artificial Sequence
  Synthetic oligonucleotide; TTC chr11 5384504 5384525 5384521 5384526 +
tgttaggaaggccaggaggcag

SEQ ID NO: 110148 - DNA, 22 bp, Artificial Sequence
  Synthetic oligonucleotide; CTG chr11 5384506 5384527 5384523 5384528 +
ttaggaaggccaggaggcaggg

SEQ ID NO: 110149 - DNA, 22 bp, Artificial Sequence
  Synthetic oligonucleotide; TTA chr11 5384509 5384530 5384526 5384531 +
ggaaggccaggaggcagggctg

SEQ ID NO: 110150 - DNA, 22 bp, Artificial Sequence
  Synthetic oligonucleotide; CTG chr11 5384531 5384552 5384548 5384553 +
cctcactcccctgatgagtgcc

SEQ ID NO: 110151 - DNA, 22 bp, Artificial Sequence
  Synthetic oligonucleotide; CTC chr11 5384535 5384556 5384552 5384557 +
actcccctgatgagtgcctgca

SEQ ID NO: 110152 - DNA, 22 bp, Artificial Sequence
  Synthetic oligonucleotide; CTC chr11 5384539 5384560 5384556 5384561 +
ccctgatgagtgcctgcatggc

SEQ ID NO: 110153 - DNA, 22 bp, Artificial Sequence
  Synthetic oligonucleotide; CTG chr11 5384544 5384565 5384561 5384566 +
atgagtgcctgcatggccaggc

SEQ ID NO: 110154 - DNA, 22 bp, Artificial Sequence
  Synthetic oligonucleotide; CTG chr11 5384555 5384576 5384572 5384577 +
catggccaggccagcccctccc

SEQ ID NO: 110155 - DNA, 22 bp, Artificial Sequence
  Synthetic oligonucleotide; CTC chr11 5384575 5384596 5384592 5384597 +
cctggatcatgtctagaagtca

SEQ ID NO: 110156 - DNA, 22 bp, Artificial Sequence
  Synthetic oligonucleotide; CTG chr11 5384579 5384600 5384596 5384601 +
gatcatgtctagaagtcaggat

SEQ ID NO: 110157 - DNA, 22 bp, Artificial Sequence
  Synthetic oligonucleotide; CTA chr11 5384590 5384611 5384607 5384612 +
gaagtcaggatggcagaagccc

SEQ ID NO: 110158 - DNA, 22 bp, Artificial Sequence
  Synthetic oligonucleotide; CTC chr11 5384614 5384635 5384631 5384636 +
tggtctctatactctttcctgc

SEQ ID NO: 110159 - DNA, 22 bp, Artificial Sequence
  Synthetic oligonucleotide; CTG chr11 5384616 5384637 5384633 5384638 +
gtctctatactctttcctgccg

SEQ ID NO: 110160 - DNA, 22 bp, Artificial Sequence
  Synthetic oligonucleotide; CTC chr11 5384621 5384642 5384638 5384643 +
tatactctttcctgccgagcca

SEQ ID NO: 110161 - DNA, 22 bp, Artificial Sequence
  Synthetic oligonucleotide; CTA chr11 5384623 5384644 5384640 5384645 +
tactctttcctgccgagccatc

SEQ ID NO: 110162 - DNA, 22 bp, Artificial Sequence
  Synthetic oligonucleotide; CTC chr11 5384628 5384649 5384645 5384650 +
tttcctgccgagccatctggta

SEQ ID NO: 110163 - DNA, 22 bp, Artificial Sequence
  Synthetic oligonucleotide; CTT chr11 5384630 5384651 5384647 5384652 +
tcctgccgagccatctggtata

SEQ ID NO: 110164 - DNA, 22 bp, Artificial Sequence
  Synthetic oligonucleotide; TTT chr11 5384631 5384652 5384648 5384653 +
cctgccgagccatctggtatac

SEQ ID NO: 110165 - DNA, 22 bp, Artificial Sequence
  Synthetic oligonucleotide; TTC chr11 5384632 5384653 5384649 5384654 +
ctgccgagccatctggtataca

SEQ ID NO: 110166 - DNA, 22 bp, Artificial Sequence
  Synthetic oligonucleotide; CTG chr11 5384635 5384656 5384652 5384657 +
ccgagccatctggtatacacac

SEQ ID NO: 110167 - DNA, 22 bp, Artificial Sequence
  Synthetic oligonucleotide; CTG chr11 5384647 5384668 5384664 5384669 +
gtatacacaccctctccttact

SEQ ID NO: 110168 - DNA, 22 bp, Artificial Sequence
  Synthetic oligonucleotide; CTC chr11 5384661 5384682 5384678 5384683 +
tccttactctcatcagaaaaac

SEQ ID NO: 110169 - DNA, 22 bp, Artificial Sequence
  Synthetic oligonucleotide; CTC chr11 5384663 5384684 5384680 5384685 +
cttactctcatcagaaaaacag

SEQ ID NO: 110170 - DNA, 22 bp, Artificial Sequence
  Synthetic oligonucleotide; CTT chr11 5384666 5384687 5384683 5384688 +
actctcatcagaaaaacagtca

SEQ ID NO: 110171 - DNA, 22 bp, Artificial Sequence
  Synthetic oligonucleotide; TTA chr11 5384667 5384688 5384684 5384689 +
ctctcatcagaaaaacagtcat

SEQ ID NO: 110172 - DNA, 22 bp, Artificial Sequence
  Synthetic oligonucleotide; CTC chr11 5384670 5384691 5384687 5384692 +
tcatcagaaaaacagtcattca

SEQ ID NO: 110173 - DNA, 22 bp, Artificial Sequence
  Synthetic oligonucleotide; CTC chr11 5384672 5384693 5384689 5384694 +
atcagaaaaacagtcattcact

SEQ ID NO: 110174 - DNA, 22 bp, Artificial Sequence
  Synthetic oligonucleotide; TTC chr11 5384691 5384712 5384708 5384713 +
acttattcaacaaattattaaa

SEQ ID NO: 110175 - DNA, 22 bp, Artificial Sequence
  Synthetic oligonucleotide; CTT chr11 5384695 5384716 5384712 5384717 +
attcaacaaattattaaatgca

SEQ ID NO: 110176 - DNA, 22 bp, Artificial Sequence
  Synthetic oligonucleotide; TTA chr11 5384696 5384717 5384713 5384718 +
ttcaacaaattattaaatgcat

SEQ ID NO: 110177 - DNA, 22 bp, Artificial Sequence
  Synthetic oligonucleotide; TTC chr11 5384699 5384720 5384716 5384721 +
aacaaattattaaatgcatttt

SEQ ID NO: 110178 - DNA, 22 bp, Artificial Sequence
  Synthetic oligonucleotide; TTA chr11 5384708 5384729 5384725 5384730 +
ttaaatgcattttatatgctgg

SEQ ID NO: 110179 - DNA, 22 bp, Artificial Sequence
  Synthetic oligonucleotide; TTA chr11 5384711 5384732 5384728 5384733 +
aatgcattttatatgctggtcc

SEQ ID NO: 110180 - DNA, 22 bp, Artificial Sequence
  Synthetic oligonucleotide; TTT chr11 5384720 5384741 5384737 5384742 +
tatatgctggtccagttaacat

SEQ ID NO: 110181 - DNA, 22 bp, Artificial Sequence
  Synthetic oligonucleotide; TTT chr11 5384721 5384742 5384738 5384743 +
atatgctggtccagttaacata

SEQ ID NO: 110182 - DNA, 22 bp, Artificial Sequence
  Synthetic oligonucleotide; TTA chr11 5384722 5384743 5384739 5384744 +
tatgctggtccagttaacatag

SEQ ID NO: 110183 - DNA, 22 bp, Artificial Sequence
  Synthetic oligonucleotide; CTG chr11 5384729 5384750 5384746 5384751 +
gtccagttaacatagaaaagac

SEQ ID NO: 110184 - DNA, 22 bp, Artificial Sequence
  Synthetic oligonucleotide; TTA chr11 5384738 5384759 5384755 5384760 +
acatagaaaagaccccatcctc

SEQ ID NO: 110185 - DNA, 22 bp, Artificial Sequence
  Synthetic oligonucleotide; CTC chr11 5384760 5384781 5384777 5384782 +
aatctgcttattttaatccaaa

SEQ ID NO: 110186 - DNA, 22 bp, Artificial Sequence
  Synthetic oligonucleotide; CTG chr11 5384766 5384787 5384783 5384788 +
cttattttaatccaaacaacac

SEQ ID NO: 110187 - DNA, 22 bp, Artificial Sequence
  Synthetic oligonucleotide; CTT chr11 5384769 5384790 5384786 5384791 +
attttaatccaaacaacacctt

SEQ ID NO: 110188 - DNA, 22 bp, Artificial Sequence
  Synthetic oligonucleotide; TTA chr11 5384770 5384791 5384787 5384792 +
ttttaatccaaacaacaccttg

SEQ ID NO: 110189 - DNA, 22 bp, Artificial Sequence
  Synthetic oligonucleotide; TTT chr11 5384773 5384794 5384790 5384795 +
taatccaaacaacaccttgtaa

SEQ ID NO: 110190 - DNA, 22 bp, Artificial Sequence
  Synthetic oligonucleotide; TTT chr11 5384774 5384795 5384791 5384796 +
aatccaaacaacaccttgtaac

SEQ ID NO: 110191 - DNA, 22 bp, Artificial Sequence
  Synthetic oligonucleotide; TTA chr11 5384775 5384796 5384792 5384797 +
atccaaacaacaccttgtaact

SEQ ID NO: 110192 - DNA, 22 bp, Artificial Sequence
  Synthetic oligonucleotide; CTT chr11 5384791 5384812 5384808 5384813 +
gtaacttccccagtatccagga

SEQ ID NO: 110193 - DNA, 22 bp, Artificial Sequence
  Synthetic oligonucleotide; TTG chr11 5384792 5384813 5384809 5384814 +
taacttccccagtatccaggat

SEQ ID NO: 110194 - DNA, 22 bp, Artificial Sequence
  Synthetic oligonucleotide; CTT chr11 5384798 5384819 5384815 5384820 +
ccccagtatccaggatatggcc

SEQ ID NO: 110195 - DNA, 22 bp, Artificial Sequence
  Synthetic oligonucleotide; TTC chr11 5384799 5384820 5384816 5384821 +
cccagtatccaggatatggcct

SEQ ID NO: 110196 - DNA, 22 bp, Artificial Sequence
  Synthetic oligonucleotide; CTT chr11 5384822 5384843 5384839 5384844 +
cgccttccaaaatcctcctcta

SEQ ID NO: 110197 - DNA, 22 bp, Artificial Sequence
  Synthetic oligonucleotide; TTC chr11 5384823 5384844 5384840 5384845 +
gccttccaaaatcctcctctat

SEQ ID NO: 110198 - DNA, 22 bp, Artificial Sequence
  Synthetic oligonucleotide; CTT chr11 5384828 5384849 5384845 5384850 +
ccaaaatcctcctctatcctac

SEQ ID NO: 110199 - DNA, 22 bp, Artificial Sequence
  Synthetic oligonucleotide; TTC chr11 5384829 5384850 5384846 5384851 +
caaaatcctcctctatcctact

SEQ ID NO: 110200 - DNA, 22 bp, Artificial Sequence
  Synthetic oligonucleotide; CTC chr11 5384839 5384860 5384856 5384861 +
ctctatcctactaaaaacaggc

SEQ ID NO: 110201 - DNA, 22 bp, Artificial Sequence
  Synthetic oligonucleotide; CTC chr11 5384842 5384863 5384859 5384864 +
tatcctactaaaaacaggcatg

SEQ ID NO: 110202 - DNA, 22 bp, Artificial Sequence
  Synthetic oligonucleotide; CTA chr11 5384844 5384865 5384861 5384866 +
tcctactaaaaacaggcatgtt

SEQ ID NO: 110203 - DNA, 22 bp, Artificial Sequence
  Synthetic oligonucleotide; CTA chr11 5384849 5384870 5384866 5384871 +
ctaaaaacaggcatgtttacag

SEQ ID NO: 110204 - DNA, 22 bp, Artificial Sequence
  Synthetic oligonucleotide; CTA chr11 5384852 5384873 5384869 5384874 +
aaaacaggcatgtttacagatg

SEQ ID NO: 110205 - DNA, 22 bp, Artificial Sequence
  Synthetic oligonucleotide; TTT chr11 5384867 5384888 5384884 5384889 +
acagatgagtttgaccactgtg

SEQ ID NO: 110206 - DNA, 22 bp, Artificial Sequence
  Synthetic oligonucleotide; TTA chr11 5384868 5384889 5384885 5384890 +
cagatgagtttgaccactgtgg

SEQ ID NO: 110207 - DNA, 22 bp, Artificial Sequence
  Synthetic oligonucleotide; TTT chr11 5384879 5384900 5384896 5384901 +
gaccactgtggaaatgttctct

SEQ ID NO: 110208 - DNA, 22 bp, Artificial Sequence
  Synthetic oligonucleotide; TTG chr11 5384880 5384901 5384897 5384902 +
accactgtggaaatgttctcta

SEQ ID NO: 110209 - DNA, 22 bp, Artificial Sequence
  Synthetic oligonucleotide; CTG chr11 5384887 5384908 5384904 5384909 +
tggaaatgttctctaggggttc

SEQ ID NO: 110210 - DNA, 22 bp, Artificial Sequence
  Synthetic oligonucleotide; TTC chr11 5384898 5384919 5384915 5384920 +
tctaggggttcaaaaatgaata

SEQ ID NO: 110211 - DNA, 22 bp, Artificial Sequence
  Synthetic oligonucleotide; CTC chr11 5384900 5384921 5384917 5384922 +
taggggttcaaaaatgaataat

SEQ ID NO: 110212 - DNA, 22 bp, Artificial Sequence
  Synthetic oligonucleotide; CTA chr11 5384902 5384923 5384919 5384924 +
ggggttcaaaaatgaataatct

SEQ ID NO: 110213 - DNA, 22 bp, Artificial Sequence
  Synthetic oligonucleotide; TTC chr11 5384909 5384930 5384926 5384931 +
aaaaatgaataatctggttcaa

SEQ ID NO: 110214 - DNA, 22 bp, Artificial Sequence
  Synthetic oligonucleotide; CTG chr11 5384925 5384946 5384942 5384947 +
gttcaagtccttgtgtttaggt

SEQ ID NO: 110215 - DNA, 22 bp, Artificial Sequence
  Synthetic oligonucleotide; TTC chr11 5384929 5384950 5384946 5384951 +
aagtccttgtgtttaggtgcag

SEQ ID NO: 110216 - DNA, 22 bp, Artificial Sequence
  Synthetic oligonucleotide; CTT chr11 5384937 5384958 5384954 5384959 +
gtgtttaggtgcagcgtctttt

SEQ ID NO: 110217 - DNA, 22 bp, Artificial Sequence
  Synthetic oligonucleotide; TTG chr11 5384938 5384959 5384955 5384960 +
tgtttaggtgcagcgtcttttg

SEQ ID NO: 110218 - DNA, 22 bp, Artificial Sequence
  Synthetic oligonucleotide; TTT chr11 5384943 5384964 5384960 5384965 +
aggtgcagcgtcttttgcatat

SEQ ID NO: 110219 - DNA, 22 bp, Artificial Sequence
  Synthetic oligonucleotide; TTA chr11 5384944 5384965 5384961 5384966 +
ggtgcagcgtcttttgcatatt

SEQ ID NO: 110220 - DNA, 22 bp, Artificial Sequence
  Synthetic oligonucleotide; CTT chr11 5384957 5384978 5384974 5384979 +
ttgcatattctcctatttacaa

SEQ ID NO: 110221 - DNA, 22 bp, Artificial Sequence
  Synthetic oligonucleotide; TTT chr11 5384958 5384979 5384975 5384980 +
tgcatattctcctatttacaag

SEQ ID NO: 110222 - DNA, 22 bp, Artificial Sequence
  Synthetic oligonucleotide; TTT chr11 5384959 5384980 5384976 5384981 +
gcatattctcctatttacaaga

SEQ ID NO: 110223 - DNA, 22 bp, Artificial Sequence
  Synthetic oligonucleotide; TTG chr11 5384960 5384981 5384977 5384982 +
catattctcctatttacaagaa

SEQ ID NO: 110224 - DNA, 22 bp, Artificial Sequence
  Synthetic oligonucleotide; TTC chr11 5384967 5384988 5384984 5384989 +
tcctatttacaagaaacagtat

SEQ ID NO: 110225 - DNA, 22 bp, Artificial Sequence
  Synthetic oligonucleotide; CTC chr11 5384969 5384990 5384986 5384991 +
ctatttacaagaaacagtatcc

SEQ ID NO: 110226 - DNA, 22 bp, Artificial Sequence
  Synthetic oligonucleotide; CTA chr11 5384972 5384993 5384989 5384994 +
tttacaagaaacagtatcctcc

SEQ ID NO: 110227 - DNA, 22 bp, Artificial Sequence
  Synthetic oligonucleotide; TTT chr11 5384975 5384996 5384992 5384997 +
acaagaaacagtatcctccacc

SEQ ID NO: 110228 - DNA, 22 bp, Artificial Sequence
  Synthetic oligonucleotide; TTA chr11 5384976 5384997 5384993 5384998 +
caagaaacagtatcctccacca

SEQ ID NO: 110229 - DNA, 22 bp, Artificial Sequence
  Synthetic oligonucleotide; CTC chr11 5384993 5385014 5385010 5385015 +
caccaatgtagttcattaaaaa

SEQ ID NO: 110230 - DNA, 22 bp, Artificial Sequence
  Synthetic oligonucleotide; TTC chr11 5385007 5385028 5385024 5385029 +
attaaaaaataactaatattaa

SEQ ID NO: 110231 - DNA, 22 bp, Artificial Sequence
  Synthetic oligonucleotide; TTA chr11 5385011 5385032 5385028 5385033 +
aaaaataactaatattaaattc

SEQ ID NO: 110232 - DNA, 22 bp, Artificial Sequence
  Synthetic oligonucleotide; CTA chr11 5385022 5385043 5385039 5385044 +
atattaaattcaaacaaaagaa

SEQ ID NO: 110233 - DNA, 22 bp, Artificial Sequence
  Synthetic oligonucleotide; TTA chr11 5385028 5385049 5385045 5385050 +
aattcaaacaaaagaatattta

SEQ ID NO: 110234 - DNA, 22 bp, Artificial Sequence
  Synthetic oligonucleotide; TTC chr11 5385033 5385054 5385050 5385055 +
aaacaaaagaatatttagacac

SEQ ID NO: 110235 - DNA, 22 bp, Artificial Sequence
  Synthetic oligonucleotide; TTT chr11 5385049 5385070 5385066 5385071 +
agacacaggtgaggtagagagc

SEQ ID NO: 110236 - DNA, 22 bp, Artificial Sequence
  Synthetic oligonucleotide; TTA chr11 5385050 5385071 5385067 5385072 +
gacacaggtgaggtagagagcc

SEQ ID NO: 110237 - DNA, 22 bp, Artificial Sequence
  Synthetic oligonucleotide; TTA chr11 5385077 5385098 5385094 5385099 +
ctcattgtatactgaaaatctc

SEQ ID NO: 110238 - DNA, 22 bp, Artificial Sequence
  Synthetic oligonucleotide; CTC chr11 5385080 5385101 5385097 5385102 +
attgtatactgaaaatctcttt

SEQ ID NO: 110239 - DNA, 22 bp, Artificial Sequence
  Synthetic oligonucleotide; TTG chr11 5385084 5385105 5385101 5385106 +
tatactgaaaatctcttttcag

SEQ ID NO: 110240 - DNA, 22 bp, Artificial Sequence
  Synthetic oligonucleotide; CTG chr11 5385091 5385112 5385108 5385113 +
aaaatctcttttcaggaatttt

SEQ ID NO: 110241 - DNA, 22 bp, Artificial Sequence
  Synthetic oligonucleotide; CTC chr11 5385099 5385120 5385116 5385121 +
ttttcaggaattttctcctgtg

SEQ ID NO: 110242 - DNA, 22 bp, Artificial Sequence
  Synthetic oligonucleotide; CTT chr11 5385101 5385122 5385118 5385123 +
ttcaggaattttctcctgtgat

SEQ ID NO: 110243 - DNA, 22 bp, Artificial Sequence
  Synthetic oligonucleotide; TTT chr11 5385102 5385123 5385119 5385124 +
tcaggaattttctcctgtgatc

SEQ ID NO: 110244 - DNA, 22 bp, Artificial Sequence
  Synthetic oligonucleotide; TTT chr11 5385103 5385124 5385120 5385125 +
caggaattttctcctgtgatct

SEQ ID NO: 110245 - DNA, 22 bp, Artificial Sequence
  Synthetic oligonucleotide; TTC chr11 5385104 5385125 5385121 5385126 +
aggaattttctcctgtgatcta

SEQ ID NO: 110246 - DNA, 22 bp, Artificial Sequence
  Synthetic oligonucleotide; TTT chr11 5385112 5385133 5385129 5385134 +
tctcctgtgatctaagatgaat

SEQ ID NO: 110247 - DNA, 22 bp, Artificial Sequence
  Synthetic oligonucleotide; TTT chr11 5385113 5385134 5385130 5385135 +
ctcctgtgatctaagatgaatc

SEQ ID NO: 110248 - DNA, 22 bp, Artificial Sequence
  Synthetic oligonucleotide; TTC chr11 5385114 5385135 5385131 5385136 +
tcctgtgatctaagatgaatct

SEQ ID NO: 110249 - DNA, 22 bp, Artificial Sequence
  Synthetic oligonucleotide; CTC chr11 5385116 5385137 5385133 5385138 +
ctgtgatctaagatgaatctac

SEQ ID NO: 110250 - DNA, 22 bp, Artificial Sequence
  Synthetic oligonucleotide; CTG chr11 5385119 5385140 5385136 5385141 +
tgatctaagatgaatctactct

SEQ ID NO: 110251 - DNA, 22 bp, Artificial Sequence
  Synthetic oligonucleotide; CTA chr11 5385126 5385147 5385143 5385148 +
agatgaatctactctgccttga

SEQ ID NO: 110252 - DNA, 22 bp, Artificial Sequence
  Synthetic oligonucleotide; CTA chr11 5385137 5385158 5385154 5385159 +
ctctgccttgaatattttaatt

SEQ ID NO: 110253 - DNA, 22 bp, Artificial Sequence
  Synthetic oligonucleotide; CTC chr11 5385140 5385161 5385157 5385162 +
tgccttgaatattttaattatg

SEQ ID NO: 110254 - DNA, 22 bp, Artificial Sequence
  Synthetic oligonucleotide; CTG chr11 5385142 5385163 5385159 5385164 +
ccttgaatattttaattatgtt

SEQ ID NO: 110255 - DNA, 22 bp, Artificial Sequence
  Synthetic oligonucleotide; CTT chr11 5385146 5385167 5385163 5385168 +
gaatattttaattatgttgtaa

SEQ ID NO: 110256 - DNA, 22 bp, Artificial Sequence
  Synthetic oligonucleotide; TTG chr11 5385147 5385168 5385164 5385169 +
aatattttaattatgttgtaat

SEQ ID NO: 110257 - DNA, 22 bp, Artificial Sequence
  Synthetic oligonucleotide; TTT chr11 5385154 5385175 5385171 5385176 +
taattatgttgtaattagatgt

SEQ ID NO: 110258 - DNA, 22 bp, Artificial Sequence
  Synthetic oligonucleotide; TTT chr11 5385155 5385176 5385172 5385177 +
aattatgttgtaattagatgta

SEQ ID NO: 110259 - DNA, 22 bp, Artificial Sequence
  Synthetic oligonucleotide; TTA chr11 5385156 5385177 5385173 5385178 +
attatgttgtaattagatgtaa

SEQ ID NO: 110260 - DNA, 22 bp, Artificial Sequence
  Synthetic oligonucleotide; TTA chr11 5385160 5385181 5385177 5385182 +
tgttgtaattagatgtaactga

SEQ ID NO: 110261 - DNA, 22 bp, Artificial Sequence
  Synthetic oligonucleotide; TTG chr11 5385165 5385186 5385182 5385187 +
taattagatgtaactgactgct

SEQ ID NO: 110262 - DNA, 22 bp, Artificial Sequence
  Synthetic oligonucleotide; TTA chr11 5385171 5385192 5385188 5385193 +
gatgtaactgactgctctgagt

SEQ ID NO: 110263 - DNA, 22 bp, Artificial Sequence
  Synthetic oligonucleotide; CTG chr11 5385181 5385202 5385198 5385203 +
actgctctgagtggactcctcc

SEQ ID NO: 110264 - DNA, 22 bp, Artificial Sequence
  Synthetic oligonucleotide; CTG chr11 5385185 5385206 5385202 5385207 +
ctctgagtggactcctccattg

SEQ ID NO: 110265 - DNA, 22 bp, Artificial Sequence
  Synthetic oligonucleotide; CTC chr11 5385188 5385209 5385205 5385210 +
tgagtggactcctccattgctt

SEQ ID NO: 110266 - DNA, 22 bp, Artificial Sequence
  Synthetic oligonucleotide; CTG chr11 5385190 5385211 5385207 5385212 +
agtggactcctccattgcttag

SEQ ID NO: 110267 - DNA, 22 bp, Artificial Sequence
  Synthetic oligonucleotide; CTC chr11 5385199 5385220 5385216 5385221 +
ctccattgcttagtagacatga

SEQ ID NO: 110268 - DNA, 22 bp, Artificial Sequence
  Synthetic oligonucleotide; CTC chr11 5385202 5385223 5385219 5385224 +
cattgcttagtagacatgaaaa

SEQ ID NO: 110269 - DNA, 22 bp, Artificial Sequence
  Synthetic oligonucleotide; TTG chr11 5385207 5385228 5385224 5385229 +
cttagtagacatgaaaaaatga

SEQ ID NO: 110270 - DNA, 22 bp, Artificial Sequence
  Synthetic oligonucleotide; CTT chr11 5385210 5385231 5385227 5385232 +
agtagacatgaaaaaatgactg

SEQ ID NO: 110271 - DNA, 22 bp, Artificial Sequence
  Synthetic oligonucleotide; TTA chr11 5385211 5385232 5385228 5385233 +
gtagacatgaaaaaatgactgt

SEQ ID NO: 110272 - DNA, 22 bp, Artificial Sequence
  Synthetic oligonucleotide; CTG chr11 5385232 5385253 5385249 5385254 +
ttgctctcctatcatggataat

SEQ ID NO: 110273 - DNA, 22 bp, Artificial Sequence
  Synthetic oligonucleotide; TTG chr11 5385235 5385256 5385252 5385257 +
ctctcctatcatggataattat

SEQ ID NO: 110274 - DNA, 22 bp, Artificial Sequence
  Synthetic oligonucleotide; CTC chr11 5385238 5385259 5385255 5385260 +
tcctatcatggataattatctc

SEQ ID NO: 110275 - DNA, 22 bp, Artificial Sequence
  Synthetic oligonucleotide; CTC chr11 5385240 5385261 5385257 5385262 +
ctatcatggataattatctctc

SEQ ID NO: 110276 - DNA, 22 bp, Artificial Sequence
  Synthetic oligonucleotide; CTA chr11 5385243 5385264 5385260 5385265 +
tcatggataattatctctcttg

SEQ ID NO: 110277 - DNA, 22 bp, Artificial Sequence
  Synthetic oligonucleotide; TTA chr11 5385256 5385277 5385273 5385278 +
tctctcttgctaggagaaatcc

SEQ ID NO: 110278 - DNA, 22 bp, Artificial Sequence
  Synthetic oligonucleotide; CTC chr11 5385260 5385281 5385277 5385282 +
tcttgctaggagaaatccccta

SEQ ID NO: 110279 - DNA, 22 bp, Artificial Sequence
  Synthetic oligonucleotide; CTC chr11 5385262 5385283 5385279 5385284 +
ttgctaggagaaatcccctaaa

SEQ ID NO: 110280 - DNA, 22 bp, Artificial Sequence
  Synthetic oligonucleotide; CTT chr11 5385264 5385285 5385281 5385286 +
gctaggagaaatcccctaaagc

SEQ ID NO: 110281 - DNA, 22 bp, Artificial Sequence
  Synthetic oligonucleotide; TTG chr11 5385265 5385286 5385282 5385287 +
ctaggagaaatcccctaaagct

SEQ ID NO: 110282 - DNA, 22 bp, Artificial Sequence
  Synthetic oligonucleotide; CTA chr11 5385268 5385289 5385285 5385290 +
ggagaaatcccctaaagctttc

SEQ ID NO: 110283 - DNA, 22 bp, Artificial Sequence
  Synthetic oligonucleotide; CTA chr11 5385282 5385303 5385299 5385304 +
aagctttcttcccaagaggaag

SEQ ID NO: 110284 - DNA, 22 bp, Artificial Sequence
  Synthetic oligonucleotide; CTT chr11 5385288 5385309 5385305 5385310 +
tcttcccaagaggaagtatact

SEQ ID NO: 110285 - DNA, 22 bp, Artificial Sequence
  Synthetic oligonucleotide; TTT chr11 5385289 5385310 5385306 5385311 +
cttcccaagaggaagtatactt

SEQ ID NO: 110286 - DNA, 22 bp, Artificial Sequence
  Synthetic oligonucleotide; TTC chr11 5385290 5385311 5385307 5385312 +
ttcccaagaggaagtatacttt

SEQ ID NO: 110287 - DNA, 22 bp, Artificial Sequence
  Synthetic oligonucleotide; CTT chr11 5385292 5385313 5385309 5385314 +
cccaagaggaagtatactttcc

SEQ ID NO: 110288 - DNA, 22 bp, Artificial Sequence
  Synthetic oligonucleotide; TTC chr11 5385293 5385314 5385310 5385315 +
ccaagaggaagtatactttcca

SEQ ID NO: 110289 - DNA, 22 bp, Artificial Sequence
  Synthetic oligonucleotide; CTT chr11 5385311 5385332 5385328 5385333 +
tccaagagaaataatcccagcc

SEQ ID NO: 110290 - DNA, 22 bp, Artificial Sequence
  Synthetic oligonucleotide; TTT chr11 5385312 5385333 5385329 5385334 +
ccaagagaaataatcccagccc

SEQ ID NO: 110291 - DNA, 22 bp, Artificial Sequence
  Synthetic oligonucleotide; TTC chr11 5385313 5385334 5385330 5385335 +
caagagaaataatcccagccct

SEQ ID NO: 110292 - DNA, 22 bp, Artificial Sequence
  Synthetic oligonucleotide; CTG chr11 5385336 5385357 5385353 5385358 +
tcattgtctctgtatagacatc

SEQ ID NO: 110293 - DNA, 22 bp, Artificial Sequence
  Synthetic oligonucleotide; TTG chr11 5385342 5385363 5385359 5385364 +
tctctgtatagacatcttgttt

SEQ ID NO: 110294 - DNA, 22 bp, Artificial Sequence
  Synthetic oligonucleotide; CTC chr11 5385346 5385367 5385363 5385368 +
tgtatagacatcttgtttctac

SEQ ID NO: 110295 - DNA, 22 bp, Artificial Sequence
  Synthetic oligonucleotide; CTG chr11 5385348 5385369 5385365 5385370 +
tatagacatcttgtttctacca

SEQ ID NO: 110296 - DNA, 22 bp, Artificial Sequence
  Synthetic oligonucleotide; CTT chr11 5385360 5385381 5385377 5385382 +
gtttctaccagatccttctccc

SEQ ID NO: 110297 - DNA, 22 bp, Artificial Sequence
  Synthetic oligonucleotide; TTG chr11 5385361 5385382 5385378 5385383 +
tttctaccagatccttctccct

SEQ ID NO: 110298 - DNA, 22 bp, Artificial Sequence
  Synthetic oligonucleotide; TTT chr11 5385364 5385385 5385381 5385386 +
ctaccagatccttctccctgtc

SEQ ID NO: 110299 - DNA, 22 bp, Artificial Sequence
  Synthetic oligonucleotide; TTC chr11 5385365 5385386 5385382 5385387 +
taccagatccttctccctgtcc

SEQ ID NO: 110300 - DNA, 22 bp, Artificial Sequence
  Synthetic oligonucleotide; CTA chr11 5385367 5385388 5385384 5385389 +
ccagatccttctccctgtccat

SEQ ID NO: 110301 - DNA, 22 bp, Artificial Sequence
  Synthetic oligonucleotide; CTT chr11 5385377 5385398 5385394 5385399 +
ctccctgtccatctcatcactc

SEQ ID NO: 110302 - DNA, 22 bp, Artificial Sequence
  Synthetic oligonucleotide; TTC chr11 5385378 5385399 5385395 5385400 +
tccctgtccatctcatcactct

SEQ ID NO: 110303 - DNA, 22 bp, Artificial Sequence
  Synthetic oligonucleotide; CTC chr11 5385380 5385401 5385397 5385402 +
cctgtccatctcatcactctga

SEQ ID NO: 110304 - DNA, 22 bp, Artificial Sequence
  Synthetic oligonucleotide; CTG chr11 5385384 5385405 5385401 5385406 +
tccatctcatcactctgaagtt

SEQ ID NO: 110305 - DNA, 22 bp, Artificial Sequence
  Synthetic oligonucleotide; CTC chr11 5385392 5385413 5385409 5385414 +
atcactctgaagttggtgaaca

SEQ ID NO: 110306 - DNA, 22 bp, Artificial Sequence
  Synthetic oligonucleotide; CTC chr11 5385399 5385420 5385416 5385421 +
tgaagttggtgaacacagagct

SEQ ID NO: 110307 - DNA, 22 bp, Artificial Sequence
  Synthetic oligonucleotide; CTG chr11 5385401 5385422 5385418 5385423 +
aagttggtgaacacagagctga

SEQ ID NO: 110308 - DNA, 22 bp, Artificial Sequence
  Synthetic oligonucleotide; TTG chr11 5385407 5385428 5385424 5385429 +
gtgaacacagagctgacaacag

SEQ ID NO: 110309 - DNA, 22 bp, Artificial Sequence
  Synthetic oligonucleotide; CTG chr11 5385422 5385443 5385439 5385444 +
acaacagaaccccaggcacaaa

SEQ ID NO: 110310 - DNA, 22 bp, Artificial Sequence
  Synthetic oligonucleotide; CTT chr11 5385469 5385490 5385486 5385491 +
tatttattcacccatttagttt

SEQ ID NO: 110311 - DNA, 22 bp, Artificial Sequence
  Synthetic oligonucleotide; TTT chr11 5385470 5385491 5385487 5385492 +
atttattcacccatttagtttt

SEQ ID NO: 110312 - DNA, 22 bp, Artificial Sequence
  Synthetic oligonucleotide; TTA chr11 5385471 5385492 5385488 5385493 +
tttattcacccatttagttttt

SEQ ID NO: 110313 - DNA, 22 bp, Artificial Sequence
  Synthetic oligonucleotide; TTT chr11 5385474 5385495 5385491 5385496 +
attcacccatttagtttttcat

SEQ ID NO: 110314 - DNA, 22 bp, Artificial Sequence
  Synthetic oligonucleotide; TTA chr11 5385475 5385496 5385492 5385497 +
ttcacccatttagtttttcatg

SEQ ID NO: 110315 - DNA, 22 bp, Artificial Sequence
  Synthetic oligonucleotide; TTC chr11 5385478 5385499 5385495 5385500 +
acccatttagtttttcatgcaa

SEQ ID NO: 110316 - DNA, 22 bp, Artificial Sequence
  Synthetic oligonucleotide; TTT chr11 5385486 5385507 5385503 5385508 +
agtttttcatgcaaaaaaatat

SEQ ID NO: 110317 - DNA, 22 bp, Artificial Sequence
  Synthetic oligonucleotide; TTA chr11 5385487 5385508 5385504 5385509 +
gtttttcatgcaaaaaaatata

SEQ ID NO: 110318 - DNA, 22 bp, Artificial Sequence
  Synthetic oligonucleotide; TTT chr11 5385491 5385512 5385508 5385513 +
ttcatgcaaaaaaatatatata

SEQ ID NO: 110319 - DNA, 22 bp, Artificial Sequence
  Synthetic oligonucleotide; TTT chr11 5385492 5385513 5385509 5385514 +
tcatgcaaaaaaatatatatat

SEQ ID NO: 110320 - DNA, 22 bp, Artificial Sequence
  Synthetic oligonucleotide; TTT chr11 5385493 5385514 5385510 5385515 +
catgcaaaaaaatatatatata

SEQ ID NO: 110321 - DNA, 22 bp, Artificial Sequence
  Synthetic oligonucleotide; TTC chr11 5385494 5385515 5385511 5385516 +
atgcaaaaaaatatatatatag

SEQ ID NO: 110322 - DNA, 22 bp, Artificial Sequence
  Synthetic oligonucleotide; CTA chr11 5385525 5385546 5385542 5385547 +
ccacatcttagacactgtcagg

SEQ ID NO: 110323 - DNA, 22 bp, Artificial Sequence
  Synthetic oligonucleotide; CTT chr11 5385534 5385555 5385551 5385556 +
agacactgtcaggctccagggg

SEQ ID NO: 110324 - DNA, 22 bp, Artificial Sequence
  Synthetic oligonucleotide; TTA chr11 5385535 5385556 5385552 5385557 +
gacactgtcaggctccaggggc

SEQ ID NO: 110325 - DNA, 22 bp, Artificial Sequence
  Synthetic oligonucleotide; CTG chr11 5385542 5385563 5385559 5385564 +
tcaggctccaggggcctttaga

SEQ ID NO: 110326 - DNA, 22 bp, Artificial Sequence
  Synthetic oligonucleotide; CTC chr11 5385550 5385571 5385567 5385572 +
caggggcctttagagaattcca

SEQ ID NO: 110327 - DNA, 22 bp, Artificial Sequence
  Synthetic oligonucleotide; CTT chr11 5385560 5385581 5385577 5385582 +
tagagaattccagtctaatcaa

SEQ ID NO: 110328 - DNA, 22 bp, Artificial Sequence
  Synthetic oligonucleotide; TTT chr11 5385561 5385582 5385578 5385583 +
agagaattccagtctaatcaac

SEQ ID NO: 110329 - DNA, 22 bp, Artificial Sequence
  Synthetic oligonucleotide; TTA chr11 5385562 5385583 5385579 5385584 +
gagaattccagtctaatcaact

SEQ ID NO: 110330 - DNA, 22 bp, Artificial Sequence
  Synthetic oligonucleotide; TTC chr11 5385570 5385591 5385587 5385592 +
cagtctaatcaacttaaaaaat

SEQ ID NO: 110331 - DNA, 22 bp, Artificial Sequence
  Synthetic oligonucleotide; CTA chr11 5385577 5385598 5385594 5385599 +
atcaacttaaaaaatgaattat

SEQ ID NO: 110332 - DNA, 22 bp, Artificial Sequence
  Synthetic oligonucleotide; CTT chr11 5385585 5385606 5385602 5385607 +
aaaaaatgaattattaggttgg

SEQ ID NO: 110333 - DNA, 22 bp, Artificial Sequence
  Synthetic oligonucleotide; TTA chr11 5385586 5385607 5385603 5385608 +
aaaaatgaattattaggttggt

SEQ ID NO: 110334 - DNA, 22 bp, Artificial Sequence
  Synthetic oligonucleotide; TTA chr11 5385598 5385619 5385615 5385620 +
ttaggttggtgaaaaattaatg

SEQ ID NO: 110335 - DNA, 22 bp, Artificial Sequence
  Synthetic oligonucleotide; TTA chr11 5385601 5385622 5385618 5385623 +
ggttggtgaaaaattaatggca

SEQ ID NO: 110336 - DNA, 22 bp, Artificial Sequence
  Synthetic oligonucleotide; TTG chr11 5385606 5385627 5385623 5385628 +
gtgaaaaattaatggcagtttt

SEQ ID NO: 110337 - DNA, 22 bp, Artificial Sequence
  Synthetic oligonucleotide; TTA chr11 5385617 5385638 5385634 5385639 +
atggcagtttttgccaatataa

SEQ ID NO: 110338 - DNA, 22 bp, Artificial Sequence
  Synthetic oligonucleotide; TTT chr11 5385627 5385648 5385644 5385649 +
ttgccaatataaatttatgttc

SEQ ID NO: 110339 - DNA, 22 bp, Artificial Sequence
  Synthetic oligonucleotide; TTT chr11 5385628 5385649 5385645 5385650 +
tgccaatataaatttatgttct

SEQ ID NO: 110340 - DNA, 22 bp, Artificial Sequence
  Synthetic oligonucleotide; TTT chr11 5385629 5385650 5385646 5385651 +
gccaatataaatttatgttcta

SEQ ID NO: 110341 - DNA, 22 bp, Artificial Sequence
  Synthetic oligonucleotide; TTG chr11 5385630 5385651 5385647 5385652 +
ccaatataaatttatgttctaa

SEQ ID NO: 110342 - DNA, 22 bp, Artificial Sequence
  Synthetic oligonucleotide; TTT chr11 5385643 5385664 5385660 5385665 +
atgttctaaacatgtataataa

SEQ ID NO: 110343 - DNA, 22 bp, Artificial Sequence
  Synthetic oligonucleotide; TTA chr11 5385644 5385665 5385661 5385666 +
tgttctaaacatgtataataaa

SEQ ID NO: 110344 - DNA, 22 bp, Artificial Sequence
  Synthetic oligonucleotide; TTC chr11 5385649 5385670 5385666 5385671 +
taaacatgtataataaagaata

SEQ ID NO: 110345 - DNA, 22 bp, Artificial Sequence
  Synthetic oligonucleotide; CTA chr11 5385651 5385672 5385668 5385673 +
aacatgtataataaagaatacg

SEQ ID NO: 110346 - DNA, 22 bp, Artificial Sequence
  Synthetic oligonucleotide; CTA chr11 5385684 5385705 5385701 5385706 +
cctataatatatatgttgtaca

SEQ ID NO: 110347 - DNA, 22 bp, Artificial Sequence
  Synthetic oligonucleotide; CTA chr11 5385688 5385709 5385705 5385710 +
taatatatatgttgtacaaagt

SEQ ID NO: 110348 - DNA, 22 bp, Artificial Sequence
  Synthetic oligonucleotide; TTG chr11 5385702 5385723 5385719 5385724 +
tacaaagtatatatatgtgtac

SEQ ID NO: 110349 - DNA, 22 bp, Artificial Sequence
  Synthetic oligonucleotide; CTA chr11 5385733 5385754 5385750 5385755 +
atatttttgtatatttgtttac

SEQ ID NO: 110350 - DNA, 22 bp, Artificial Sequence
  Synthetic oligonucleotide; TTT chr11 5385739 5385760 5385756 5385761 +
ttgtatatttgtttacatatat

SEQ ID NO: 110351 - DNA, 22 bp, Artificial Sequence
  Synthetic oligonucleotide; TTT chr11 5385740 5385761 5385757 5385762 +
tgtatatttgtttacatatata

SEQ ID NO: 110352 - DNA, 22 bp, Artificial Sequence
  Synthetic oligonucleotide; TTT chr11 5385741 5385762 5385758 5385763 +
gtatatttgtttacatatataa

SEQ ID NO: 110353 - DNA, 22 bp, Artificial Sequence
  Synthetic oligonucleotide; TTG chr11 5385742 5385763 5385759 5385764 +
tatatttgtttacatatataaa

SEQ ID NO: 110354 - DNA, 22 bp, Artificial Sequence
  Synthetic oligonucleotide; TTT chr11 5385749 5385770 5385766 5385771 +
gtttacatatataaatatacag

SEQ ID NO: 110355 - DNA, 22 bp, Artificial Sequence
  Synthetic oligonucleotide; TTG chr11 5385750 5385771 5385767 5385772 +
tttacatatataaatatacaga

SEQ ID NO: 110356 - DNA, 22 bp, Artificial Sequence
  Synthetic oligonucleotide; TTT chr11 5385753 5385774 5385770 5385775 +
acatatataaatatacagacac

SEQ ID NO: 110357 - DNA, 22 bp, Artificial Sequence
  Synthetic oligonucleotide; TTA chr11 5385754 5385775 5385771 5385776 +
catatataaatatacagacaca

SEQ ID NO: 110358 - DNA, 22 bp, Artificial Sequence
  Synthetic oligonucleotide; CTA chr11 5385791 5385812 5385808 5385813 +
tacttatatataaaaaatctat

SEQ ID NO: 110359 - DNA, 22 bp, Artificial Sequence
  Synthetic oligonucleotide; CTT chr11 5385796 5385817 5385813 5385818 +
atatataaaaaatctataaagt

SEQ ID NO: 110360 - DNA, 22 bp, Artificial Sequence
  Synthetic oligonucleotide; TTA chr11 5385797 5385818 5385814 5385819 +
tatataaaaaatctataaagta

SEQ ID NO: 110361 - DNA, 22 bp, Artificial Sequence
  Synthetic oligonucleotide; CTA chr11 5385812 5385833 5385829 5385834 +
taaagtatataaagaatatata

SEQ ID NO: 110362 - DNA, 22 bp, Artificial Sequence
  Synthetic oligonucleotide; CTA chr11 5385846 5385867 5385863 5385868 +
aaatgtatattctataaagtat

SEQ ID NO: 110363 - DNA, 22 bp, Artificial Sequence
  Synthetic oligonucleotide; TTC chr11 5385858 5385879 5385875 5385880 +
tataaagtatttatgagtaaat

SEQ ID NO: 110364 - DNA, 22 bp, Artificial Sequence
  Synthetic oligonucleotide; CTA chr11 5385860 5385881 5385877 5385882 +
taaagtatttatgagtaaatct

SEQ ID NO: 110365 - DNA, 22 bp, Artificial Sequence
  Synthetic oligonucleotide; TTT chr11 5385870 5385891 5385887 5385892 +
atgagtaaatctatacacttat

SEQ ID NO: 110366 - DNA, 22 bp, Artificial Sequence
  Synthetic oligonucleotide; TTA chr11 5385871 5385892 5385888 5385893 +
tgagtaaatctatacacttata

SEQ ID NO: 110367 - DNA, 22 bp, Artificial Sequence
  Synthetic oligonucleotide; CTA chr11 5385883 5385904 5385900 5385905 +
tacacttatatgttatttaaac

SEQ ID NO: 110368 - DNA, 22 bp, Artificial Sequence
  Synthetic oligonucleotide; CTT chr11 5385890 5385911 5385907 5385912 +
atatgttatttaaacttataca

SEQ ID NO: 110369 - DNA, 22 bp, Artificial Sequence
  Synthetic oligonucleotide; TTA chr11 5385891 5385912 5385908 5385913 +
tatgttatttaaacttatacat

SEQ ID NO: 110370 - DNA, 22 bp, Artificial Sequence
  Synthetic oligonucleotide; TTA chr11 5385898 5385919 5385915 5385920 +
tttaaacttatacatatgtgta

SEQ ID NO: 110371 - DNA, 22 bp, Artificial Sequence
  Synthetic oligonucleotide; TTT chr11 5385901 5385922 5385918 5385923 +
aaacttatacatatgtgtactt

SEQ ID NO: 110372 - DNA, 22 bp, Artificial Sequence
  Synthetic oligonucleotide; TTA chr11 5385902 5385923 5385919 5385924 +
aacttatacatatgtgtactta

SEQ ID NO: 110373 - DNA, 22 bp, Artificial Sequence
  Synthetic oligonucleotide; CTT chr11 5385907 5385928 5385924 5385929 +
atacatatgtgtacttatatgg

SEQ ID NO: 110374 - DNA, 22 bp, Artificial Sequence
  Synthetic oligonucleotide; TTA chr11 5385908 5385929 5385925 5385930 +
tacatatgtgtacttatatgga

SEQ ID NO: 110375 - DNA, 22 bp, Artificial Sequence
  Synthetic oligonucleotide; CTT chr11 5385923 5385944 5385940 5385945 +
atatggatgtataagtatgttc

SEQ ID NO: 110376 - DNA, 22 bp, Artificial Sequence
  Synthetic oligonucleotide; TTA chr11 5385924 5385945 5385941 5385946 +
tatggatgtataagtatgttct

SEQ ID NO: 110377 - DNA, 22 bp, Artificial Sequence
  Synthetic oligonucleotide; TTC chr11 5385945 5385966 5385962 5385967 +
tatatatatatcaataagtata

SEQ ID NO: 110378 - DNA, 22 bp, Artificial Sequence
  Synthetic oligonucleotide; CTA chr11 5385947 5385968 5385964 5385969 +
tatatatatcaataagtatata

SEQ ID NO: 110379 - DNA, 22 bp, Artificial Sequence
  Synthetic oligonucleotide; TTT chr11 5386005 5386026 5386022 5386027 +
acaccttaatagtacattacag

SEQ ID NO: 110380 - DNA, 22 bp, Artificial Sequence
  Synthetic oligonucleotide; TTA chr11 5386006 5386027 5386023 5386028 +
caccttaatagtacattacagg

SEQ ID NO: 110381 - DNA, 22 bp, Artificial Sequence
  Synthetic oligonucleotide; CTT chr11 5386012 5386033 5386029 5386034 +
aatagtacattacaggtactac

SEQ ID NO: 110382 - DNA, 22 bp, Artificial Sequence
  Synthetic oligonucleotide; TTA chr11 5386013 5386034 5386030 5386035 +
atagtacattacaggtactacg

SEQ ID NO: 110383 - DNA, 22 bp, Artificial Sequence
  Synthetic oligonucleotide; TTA chr11 5386024 5386045 5386041 5386046 +
caggtactacgtgagaacagag

SEQ ID NO: 110384 - DNA, 22 bp, Artificial Sequence
  Synthetic oligonucleotide; CTA chr11 5386033 5386054 5386050 5386055 +
cgtgagaacagagaaagatgta

SEQ ID NO: 110385 - DNA, 22 bp, Artificial Sequence
  Synthetic oligonucleotide; CTA chr11 5386059 5386080 5386076 5386081 +
atgctacagaaggaagtcagga

SEQ ID NO: 110386 - DNA, 22 bp, Artificial Sequence
  Synthetic oligonucleotide; CTA chr11 5386065 5386086 5386082 5386087 +
cagaaggaagtcaggagagatt

SEQ ID NO: 110387 - DNA, 22 bp, Artificial Sequence
  Synthetic oligonucleotide; TTT chr11 5386088 5386109 5386105 5386110 +
gacagaagaagtgatatttgta

SEQ ID NO: 110388 - DNA, 22 bp, Artificial Sequence
  Synthetic oligonucleotide; TTG chr11 5386089 5386110 5386106 5386111 +
acagaagaagtgatatttgtac

SEQ ID NO: 110389 - DNA, 22 bp, Artificial Sequence
  Synthetic oligonucleotide; TTT chr11 5386107 5386128 5386124 5386129 +
gtactaagtcttaaaggatccg

SEQ ID NO: 110390 - DNA, 22 bp, Artificial Sequence
  Synthetic oligonucleotide; TTG chr11 5386108 5386129 5386125 5386130 +
tactaagtcttaaaggatccgc

SEQ ID NO: 110391 - DNA, 22 bp, Artificial Sequence
  Synthetic oligonucleotide; CTA chr11 5386113 5386134 5386130 5386135 +
agtcttaaaggatccgcaagtg

SEQ ID NO: 110392 - DNA, 22 bp, Artificial Sequence
  Synthetic oligonucleotide; CTT chr11 5386119 5386140 5386136 5386141 +
aaaggatccgcaagtgtttact

SEQ ID NO: 110393 - DNA, 22 bp, Artificial Sequence
  Synthetic oligonucleotide; TTA chr11 5386120 5386141 5386137 5386142 +
aaggatccgcaagtgtttactg

SEQ ID NO: 110394 - DNA, 22 bp, Artificial Sequence
  Synthetic oligonucleotide; TTT chr11 5386138 5386159 5386155 5386160 +
actggttggaaaaacaggggtg

SEQ ID NO: 110395 - DNA, 22 bp, Artificial Sequence
  Synthetic oligonucleotide; TTA chr11 5386139 5386160 5386156 5386161 +
ctggttggaaaaacaggggtgg

SEQ ID NO: 110396 - DNA, 22 bp, Artificial Sequence
  Synthetic oligonucleotide; CTG chr11 5386142 5386163 5386159 5386164 +
gttggaaaaacaggggtggttt

SEQ ID NO: 110397 - DNA, 22 bp, Artificial Sequence
  Synthetic oligonucleotide; TTG chr11 5386146 5386167 5386163 5386168 +
gaaaaacaggggtggtttttgc

SEQ ID NO: 110398 - DNA, 22 bp, Artificial Sequence
  Synthetic oligonucleotide; TTT chr11 5386164 5386185 5386181 5386186 +
ttgccaagaaagcaataaatat

SEQ ID NO: 110399 - DNA, 22 bp, Artificial Sequence
  Synthetic oligonucleotide; TTT chr11 5386165 5386186 5386182 5386187 +
tgccaagaaagcaataaatata

SEQ ID NO: 110400 - DNA, 22 bp, Artificial Sequence
  Synthetic oligonucleotide; TTT chr11 5386166 5386187 5386183 5386188 +
gccaagaaagcaataaatatag

SEQ ID NO: 110401 - DNA, 22 bp, Artificial Sequence
  Synthetic oligonucleotide; TTG chr11 5386167 5386188 5386184 5386189 +
ccaagaaagcaataaatataga

SEQ ID NO: 110402 - DNA, 22 bp, Artificial Sequence
  Synthetic oligonucleotide; TTG chr11 5386224 5386245 5386241 5386246 +
aagaaaaaaatgatatgggtgt

SEQ ID NO: 110403 - DNA, 22 bp, Artificial Sequence
  Synthetic oligonucleotide; TTG chr11 5386250 5386271 5386267 5386272 +
actgggaaaagatgggtttgga

SEQ ID NO: 110404 - DNA, 22 bp, Artificial Sequence
  Synthetic oligonucleotide; CTG chr11 5386254 5386275 5386271 5386276 +
ggaaaagatgggtttggaaagg

SEQ ID NO: 110405 - DNA, 22 bp, Artificial Sequence
  Synthetic oligonucleotide; TTT chr11 5386269 5386290 5386286 5386291 +
ggaaaggtgccaaaacaagaag

SEQ ID NO: 110406 - DNA, 22 bp, Artificial Sequence
  Synthetic oligonucleotide; TTG chr11 5386270 5386291 5386287 5386292 +
gaaaggtgccaaaacaagaagg

SEQ ID NO: 110407 - DNA, 22 bp, Artificial Sequence
  Synthetic oligonucleotide; CTA chr11 5386301 5386322 5386318 5386323 +
aagatggtgttacagggtgttt

SEQ ID NO: 110408 - DNA, 22 bp, Artificial Sequence
  Synthetic oligonucleotide; TTA chr11 5386313 5386334 5386330 5386335 +
cagggtgtttgaggctaccagg

SEQ ID NO: 110409 - DNA, 22 bp, Artificial Sequence
  Synthetic oligonucleotide; TTT chr11 5386323 5386344 5386340 5386345 +
gaggctaccagggccatgcata

SEQ ID NO: 110410 - DNA, 22 bp, Artificial Sequence
  Synthetic oligonucleotide; TTG chr11 5386324 5386345 5386341 5386346 +
aggctaccagggccatgcatag

SEQ ID NO: 110411 - DNA, 22 bp, Artificial Sequence
  Synthetic oligonucleotide; CTA chr11 5386330 5386351 5386347 5386352 +
ccagggccatgcatagagagac

SEQ ID NO: 110412 - DNA, 22 bp, Artificial Sequence
  Synthetic oligonucleotide; TTC chr11 5386360 5386381 5386377 5386382 +
atatcttatcctgattttcgct

SEQ ID NO: 110413 - DNA, 22 bp, Artificial Sequence
  Synthetic oligonucleotide; CTT chr11 5386367 5386388 5386384 5386389 +
atcctgattttcgctcactacc

SEQ ID NO: 110414 - DNA, 22 bp, Artificial Sequence
  Synthetic oligonucleotide; TTA chr11 5386368 5386389 5386385 5386390 +
tcctgattttcgctcactacca

SEQ ID NO: 110415 - DNA, 22 bp, Artificial Sequence
  Synthetic oligonucleotide; CTG chr11 5386373 5386394 5386390 5386395 +
attttcgctcactaccaggcct

SEQ ID NO: 110416 - DNA, 22 bp, Artificial Sequence
  Synthetic oligonucleotide; TTT chr11 5386377 5386398 5386394 5386399 +
tcgctcactaccaggccttggg

SEQ ID NO: 110417 - DNA, 22 bp, Artificial Sequence
  Synthetic oligonucleotide; TTT chr11 5386378 5386399 5386395 5386400 +
cgctcactaccaggccttggga

SEQ ID NO: 110418 - DNA, 22 bp, Artificial Sequence
  Synthetic oligonucleotide; TTC chr11 5386379 5386400 5386396 5386401 +
gctcactaccaggccttgggat

SEQ ID NO: 110419 - DNA, 22 bp, Artificial Sequence
  Synthetic oligonucleotide; CTC chr11 5386383 5386404 5386400 5386405 +
actaccaggccttgggatgatt

SEQ ID NO: 110420 - DNA, 22 bp, Artificial Sequence
  Synthetic oligonucleotide; CTA chr11 5386387 5386408 5386404 5386409 +
ccaggccttgggatgattgttt

SEQ ID NO: 110421 - DNA, 22 bp, Artificial Sequence
  Synthetic oligonucleotide; CTT chr11 5386396 5386417 5386413 5386418 +
gggatgattgtttacctttttg

SEQ ID NO: 110422 - DNA, 22 bp, Artificial Sequence
  Synthetic oligonucleotide; TTG chr11 5386397 5386418 5386414 5386419 +
ggatgattgtttacctttttgt

SEQ ID NO: 110423 - DNA, 22 bp, Artificial Sequence
  Synthetic oligonucleotide; TTG chr11 5386406 5386427 5386423 5386428 +
tttacctttttgtagttttctc

SEQ ID NO: 110424 - DNA, 22 bp, Artificial Sequence
  Synthetic oligonucleotide; TTT chr11 5386409 5386430 5386426 5386431 +
acctttttgtagttttctcctt

SEQ ID NO: 110425 - DNA, 22 bp, Artificial Sequence
  Synthetic oligonucleotide; TTA chr11 5386410 5386431 5386427 5386432 +
cctttttgtagttttctccttg

SEQ ID NO: 110426 - DNA, 22 bp, Artificial Sequence
  Synthetic oligonucleotide; CTT chr11 5386414 5386435 5386431 5386436 +
tttgtagttttctccttgtgaa

SEQ ID NO: 110427 - DNA, 22 bp, Artificial Sequence
  Synthetic oligonucleotide; TTT chr11 5386415 5386436 5386432 5386437 +
ttgtagttttctccttgtgaag

SEQ ID NO: 110428 - DNA, 22 bp, Artificial Sequence
  Synthetic oligonucleotide; TTT chr11 5386416 5386437 5386433 5386438 +
tgtagttttctccttgtgaagt

SEQ ID NO: 110429 - DNA, 22 bp, Artificial Sequence
  Synthetic oligonucleotide; TTT chr11 5386417 5386438 5386434 5386439 +
gtagttttctccttgtgaagta

SEQ ID NO: 110430 - DNA, 22 bp, Artificial Sequence
  Synthetic oligonucleotide; TTG chr11 5386418 5386439 5386435 5386440 +
tagttttctccttgtgaagtag

SEQ ID NO: 110431 - DNA, 22 bp, Artificial Sequence
  Synthetic oligonucleotide; TTT chr11 5386424 5386445 5386441 5386446 +
tctccttgtgaagtagtaataa

SEQ ID NO: 110432 - DNA, 22 bp, Artificial Sequence
  Synthetic oligonucleotide; TTT chr11 5386425 5386446 5386442 5386447 +
ctccttgtgaagtagtaataaa

SEQ ID NO: 110433 - DNA, 22 bp, Artificial Sequence
  Synthetic oligonucleotide; TTC chr11 5386426 5386447 5386443 5386448 +
tccttgtgaagtagtaataaaa

SEQ ID NO: 110434 - DNA, 22 bp, Artificial Sequence
  Synthetic oligonucleotide; CTC chr11 5386428 5386449 5386445 5386450 +
cttgtgaagtagtaataaaatg

SEQ ID NO: 110435 - DNA, 22 bp, Artificial Sequence
  Synthetic oligonucleotide; CTT chr11 5386431 5386452 5386448 5386453 +
gtgaagtagtaataaaatgttt

SEQ ID NO: 110436 - DNA, 22 bp, Artificial Sequence
  Synthetic oligonucleotide; TTG chr11 5386432 5386453 5386449 5386454 +
tgaagtagtaataaaatgtttc

SEQ ID NO: 110437 - DNA, 22 bp, Artificial Sequence
  Synthetic oligonucleotide; TTT chr11 5386453 5386474 5386470 5386475 +
catagttacatgaaatattcat

SEQ ID NO: 110438 - DNA, 22 bp, Artificial Sequence
  Synthetic oligonucleotide; TTC chr11 5386454 5386475 5386471 5386476 +
atagttacatgaaatattcatg

SEQ ID NO: 110439 - DNA, 22 bp, Artificial Sequence
  Synthetic oligonucleotide; TTA chr11 5386461 5386482 5386478 5386483 +
catgaaatattcatgattatgt

SEQ ID NO: 110440 - DNA, 22 bp, Artificial Sequence
  Synthetic oligonucleotide; TTC chr11 5386473 5386494 5386490 5386495 +
atgattatgtcaagcttttcac

SEQ ID NO: 110441 - DNA, 22 bp, Artificial Sequence
  Synthetic oligonucleotide; TTA chr11 5386480 5386501 5386497 5386502 +
tgtcaagcttttcacagcatct

SEQ ID NO: 110442 - DNA, 22 bp, Artificial Sequence
  Synthetic oligonucleotide; CTT chr11 5386490 5386511 5386507 5386512 +
ttcacagcatctaaatcatgta

SEQ ID NO: 110443 - DNA, 22 bp, Artificial Sequence
  Synthetic oligonucleotide; TTT chr11 5386491 5386512 5386508 5386513 +
tcacagcatctaaatcatgtat

SEQ ID NO: 110444 - DNA, 22 bp, Artificial Sequence
  Synthetic oligonucleotide; TTT chr11 5386492 5386513 5386509 5386514 +
cacagcatctaaatcatgtatg

SEQ ID NO: 110445 - DNA, 22 bp, Artificial Sequence
  Synthetic oligonucleotide; TTC chr11 5386493 5386514 5386510 5386515 +
acagcatctaaatcatgtatgg

SEQ ID NO: 110446 - DNA, 22 bp, Artificial Sequence
  Synthetic oligonucleotide; CTA chr11 5386503 5386524 5386520 5386525 +
aatcatgtatggcctcaataaa

SEQ ID NO: 110447 - DNA, 22 bp, Artificial Sequence
  Synthetic oligonucleotide; CTC chr11 5386519 5386540 5386536 5386541 +
aataaattggactatcaccaca

SEQ ID NO: 110448 - DNA, 22 bp, Artificial Sequence
  Synthetic oligonucleotide; TTG chr11 5386528 5386549 5386545 5386550 +
gactatcaccacagatctttta

SEQ ID NO: 110449 - DNA, 22 bp, Artificial Sequence
  Synthetic oligonucleotide; CTA chr11 5386533 5386554 5386550 5386555 +
tcaccacagatcttttacaagt

SEQ ID NO: 110450 - DNA, 22 bp, Artificial Sequence
  Synthetic oligonucleotide; CTT chr11 5386547 5386568 5386564 5386569 +
ttacaagtttgaactttattct

SEQ ID NO: 110451 - DNA, 22 bp, Artificial Sequence
  Synthetic oligonucleotide; TTT chr11 5386548 5386569 5386565 5386570 +
tacaagtttgaactttattcta

SEQ ID NO: 110452 - DNA, 22 bp, Artificial Sequence
  Synthetic oligonucleotide; TTT chr11 5386549 5386570 5386566 5386571 +
acaagtttgaactttattctaa

SEQ ID NO: 110453 - DNA, 22 bp, Artificial Sequence
  Synthetic oligonucleotide; TTA chr11 5386550 5386571 5386567 5386572 +
caagtttgaactttattctaat

SEQ ID NO: 110454 - DNA, 22 bp, Artificial Sequence
  Synthetic oligonucleotide; TTT chr11 5386557 5386578 5386574 5386579 +
gaactttattctaatgatagga

SEQ ID NO: 110455 - DNA, 22 bp, Artificial Sequence
  Synthetic oligonucleotide; TTG chr11 5386558 5386579 5386575 5386580 +
aactttattctaatgataggag

SEQ ID NO: 110456 - DNA, 22 bp, Artificial Sequence
  Synthetic oligonucleotide; CTT chr11 5386563 5386584 5386580 5386585 +
tattctaatgataggagctact

SEQ ID NO: 110457 - DNA, 22 bp, Artificial Sequence
  Synthetic oligonucleotide; TTT chr11 5386564 5386585 5386581 5386586 +
attctaatgataggagctactg

SEQ ID NO: 110458 - DNA, 22 bp, Artificial Sequence
  Synthetic oligonucleotide; TTA chr11 5386565 5386586 5386582 5386587 +
ttctaatgataggagctactga

SEQ ID NO: 110459 - DNA, 22 bp, Artificial Sequence
  Synthetic oligonucleotide; TTC chr11 5386568 5386589 5386585 5386590 +
taatgataggagctactgaagt

SEQ ID NO: 110460 - DNA, 22 bp, Artificial Sequence
  Synthetic oligonucleotide; CTA chr11 5386570 5386591 5386587 5386592 +
atgataggagctactgaagtac

SEQ ID NO: 110461 - DNA, 22 bp, Artificial Sequence
  Synthetic oligonucleotide; CTA chr11 5386583 5386604 5386600 5386605 +
ctgaagtactgaaaacagtgca

SEQ ID NO: 110462 - DNA, 22 bp, Artificial Sequence
  Synthetic oligonucleotide; CTG chr11 5386586 5386607 5386603 5386608 +
aagtactgaaaacagtgcagtg

SEQ ID NO: 110463 - DNA, 22 bp, Artificial Sequence
  Synthetic oligonucleotide; CTG chr11 5386594 5386615 5386611 5386616 +
aaaacagtgcagtgattcatag

SEQ ID NO: 110464 - DNA, 22 bp, Artificial Sequence
  Synthetic oligonucleotide; TTC chr11 5386612 5386633 5386629 5386634 +
atagagttagtactttctgcat

SEQ ID NO: 110465 - DNA, 22 bp, Artificial Sequence
  Synthetic oligonucleotide; TTA chr11 5386621 5386642 5386638 5386643 +
gtactttctgcataatctcggt

SEQ ID NO: 110466 - DNA, 22 bp, Artificial Sequence
  Synthetic oligonucleotide; CTT chr11 5386627 5386648 5386644 5386649 +
tctgcataatctcggtggctgc

SEQ ID NO: 110467 - DNA, 22 bp, Artificial Sequence
  Synthetic oligonucleotide; TTT chr11 5386628 5386649 5386645 5386650 +
ctgcataatctcggtggctgca

SEQ ID NO: 110468 - DNA, 22 bp, Artificial Sequence
  Synthetic oligonucleotide; TTC chr11 5386629 5386650 5386646 5386651 +
tgcataatctcggtggctgcag

SEQ ID NO: 110469 - DNA, 22 bp, Artificial Sequence
  Synthetic oligonucleotide; CTG chr11 5386631 5386652 5386648 5386653 +
cataatctcggtggctgcagta

SEQ ID NO: 110470 - DNA, 22 bp, Artificial Sequence
  Synthetic oligonucleotide; CTC chr11 5386640 5386661 5386657 5386662 +
ggtggctgcagtagaggatgga

SEQ ID NO: 110471 - DNA, 22 bp, Artificial Sequence
  Synthetic oligonucleotide; CTG chr11 5386648 5386669 5386665 5386670 +
cagtagaggatggaccaaggga

SEQ ID NO: 110472 - DNA, 22 bp, Artificial Sequence
  Synthetic oligonucleotide; CTG chr11 5386682 5386703 5386699 5386704 +
gctttgcatgttgaatgacagg

SEQ ID NO: 110473 - DNA, 22 bp, Artificial Sequence
  Synthetic oligonucleotide; CTT chr11 5386686 5386707 5386703 5386708 +
tgcatgttgaatgacaggtcag

SEQ ID NO: 110474 - DNA, 22 bp, Artificial Sequence
  Synthetic oligonucleotide; TTT chr11 5386687 5386708 5386704 5386709 +
gcatgttgaatgacaggtcagg

SEQ ID NO: 110475 - DNA, 22 bp, Artificial Sequence
  Synthetic oligonucleotide; TTG chr11 5386688 5386709 5386705 5386710 +
catgttgaatgacaggtcaggc

SEQ ID NO: 110476 - DNA, 22 bp, Artificial Sequence
  Synthetic oligonucleotide; TTG chr11 5386695 5386716 5386712 5386717 +
aatgacaggtcaggcaagcagg

SEQ ID NO: 110477 - DNA, 22 bp, Artificial Sequence
  Synthetic oligonucleotide; CTA chr11 5386730 5386751 5386747 5386752 +
agaacaaggacattggctacag

SEQ ID NO: 110478 - DNA, 22 bp, Artificial Sequence
  Synthetic oligonucleotide; TTG chr11 5386745 5386766 5386762 5386767 +
gctacagagatgaagatgaata

SEQ ID NO: 110479 - DNA, 22 bp, Artificial Sequence
  Synthetic oligonucleotide; CTA chr11 5386749 5386770 5386766 5386771 +
cagagatgaagatgaatagatt

SEQ ID NO: 110480 - DNA, 22 bp, Artificial Sequence
  Synthetic oligonucleotide; TTA chr11 5386772 5386793 5386789 5386794 +
cagggatagattaaaagaactt

SEQ ID NO: 110481 - DNA, 22 bp, Artificial Sequence
  Synthetic oligonucleotide; TTA chr11 5386785 5386806 5386802 5386807 +
aaagaacttagttaaaaattag

SEQ ID NO: 110482 - DNA, 22 bp, Artificial Sequence
  Synthetic oligonucleotide; CTT chr11 5386794 5386815 5386811 5386816 +
agttaaaaattagatacagaaa

SEQ ID NO: 110483 - DNA, 22 bp, Artificial Sequence
  Synthetic oligonucleotide; TTA chr11 5386795 5386816 5386812 5386817 +
gttaaaaattagatacagaaag

SEQ ID NO: 110484 - DNA, 22 bp, Artificial Sequence
  Synthetic oligonucleotide; TTA chr11 5386799 5386820 5386816 5386821 +
aaaattagatacagaaagaggg

SEQ ID NO: 110485 - DNA, 22 bp, Artificial Sequence
  Synthetic oligonucleotide; TTA chr11 5386806 5386827 5386823 5386828 +
gatacagaaagagggagagggt

SEQ ID NO: 110486 - DNA, 22 bp, Artificial Sequence
  Synthetic oligonucleotide; TTG chr11 5386830 5386851 5386847 5386852 +
agtagagcatcagctcaaaaat

SEQ ID NO: 110487 - DNA, 22 bp, Artificial Sequence
  Synthetic oligonucleotide; CTC chr11 5386846 5386867 5386863 5386868 +
aaaaatgttgtcttgaatggca

SEQ ID NO: 110488 - DNA, 22 bp, Artificial Sequence
  Synthetic oligonucleotide; TTG chr11 5386856 5386877 5386873 5386878 +
tcttgaatggcaggaaatggtg

SEQ ID NO: 110489 - DNA, 22 bp, Artificial Sequence
  Synthetic oligonucleotide; CTT chr11 5386860 5386881 5386877 5386882 +
gaatggcaggaaatggtgaata

SEQ ID NO: 110490 - DNA, 22 bp, Artificial Sequence
  Synthetic oligonucleotide; TTG chr11 5386861 5386882 5386878 5386883 +
aatggcaggaaatggtgaataa

SEQ ID NO: 110491 - DNA, 22 bp, Artificial Sequence
  Synthetic oligonucleotide; TTA chr11 5386888 5386909 5386905 5386910 +
taaaaaatgcataaatatgaga

SEQ ID NO: 110492 - DNA, 22 bp, Artificial Sequence
  Synthetic oligonucleotide; CTG chr11 5386938 5386959 5386955 5386960 +
ggctcaatattagacgtgttga

SEQ ID NO: 110493 - DNA, 22 bp, Artificial Sequence
  Synthetic oligonucleotide; CTC chr11 5386943 5386964 5386960 5386965 +
aatattagacgtgttgagtttc

SEQ ID NO: 110494 - DNA, 22 bp, Artificial Sequence
  Synthetic oligonucleotide; TTA chr11 5386950 5386971 5386967 5386972 +
gacgtgttgagtttcatcagta

SEQ ID NO: 110495 - DNA, 22 bp, Artificial Sequence
  Synthetic oligonucleotide; TTG chr11 5386959 5386980 5386976 5386981 +
agtttcatcagtatccttttgg

SEQ ID NO: 110496 - DNA, 22 bp, Artificial Sequence
  Synthetic oligonucleotide; TTT chr11 5386964 5386985 5386981 5386986 +
catcagtatccttttggaaaca

SEQ ID NO: 110497 - DNA, 22 bp, Artificial Sequence
  Synthetic oligonucleotide; TTC chr11 5386965 5386986 5386982 5386987 +
atcagtatccttttggaaacac

SEQ ID NO: 110498 - DNA, 22 bp, Artificial Sequence
  Synthetic oligonucleotide; CTT chr11 5386977 5386998 5386994 5386999 +
ttggaaacacctagtgagaagg

SEQ ID NO: 110499 - DNA, 22 bp, Artificial Sequence
  Synthetic oligonucleotide; TTT chr11 5386978 5386999 5386995 5387000 +
tggaaacacctagtgagaaggc

SEQ ID NO: 110500 - DNA, 22 bp, Artificial Sequence
  Synthetic oligonucleotide; TTT chr11 5386979 5387000 5386996 5387001 +
ggaaacacctagtgagaaggca

SEQ ID NO: 110501 - DNA, 22 bp, Artificial Sequence
  Synthetic oligonucleotide; TTG chr11 5386980 5387001 5386997 5387002 +
gaaacacctagtgagaaggcag

SEQ ID NO: 110502 - DNA, 22 bp, Artificial Sequence
  Synthetic oligonucleotide; CTA chr11 5386990 5387011 5387007 5387012 +
gtgagaaggcagaaactcaggc

SEQ ID NO: 110503 - DNA, 22 bp, Artificial Sequence
  Synthetic oligonucleotide; CTC chr11 5387008 5387029 5387025 5387030 +
aggcctgatatgtaacggagtt

SEQ ID NO: 110504 - DNA, 22 bp, Artificial Sequence
  Synthetic oligonucleotide; CTG chr11 5387015 5387036 5387032 5387037 +
atatgtaacggagttatctgga

SEQ ID NO: 110505 - DNA, 22 bp, Artificial Sequence
  Synthetic oligonucleotide; TTA chr11 5387031 5387052 5387048 5387053 +
tctggactagagattaatgtct

SEQ ID NO: 110506 - DNA, 22 bp, Artificial Sequence
  Synthetic oligonucleotide; CTG chr11 5387035 5387056 5387052 5387057 +
gactagagattaatgtctaaga

SEQ ID NO: 110507 - DNA, 22 bp, Artificial Sequence
  Synthetic oligonucleotide; CTA chr11 5387040 5387061 5387057 5387062 +
gagattaatgtctaagagccac

SEQ ID NO: 110508 - DNA, 22 bp, Artificial Sequence
  Synthetic oligonucleotide; TTA chr11 5387047 5387068 5387064 5387069 +
atgtctaagagccaccactgta

SEQ ID NO: 110509 - DNA, 22 bp, Artificial Sequence
  Synthetic oligonucleotide; CTA chr11 5387054 5387075 5387071 5387076 +
agagccaccactgtataagtaa

SEQ ID NO: 110510 - DNA, 22 bp, Artificial Sequence
  Synthetic oligonucleotide; CTG chr11 5387067 5387088 5387084 5387089 +
tataagtaataataataataga

SEQ ID NO: 110511 - DNA, 22 bp, Artificial Sequence
  Synthetic oligonucleotide; TTA chr11 5387111 5387132 5387128 5387133 +
aggtgttcaaggacagtaaact

SEQ ID NO: 110512 - DNA, 22 bp, Artificial Sequence
  Synthetic oligonucleotide; TTC chr11 5387119 5387140 5387136 5387141 +
aaggacagtaaactgaataaca

SEQ ID NO: 110513 - DNA, 22 bp, Artificial Sequence
  Synthetic oligonucleotide; CTG chr11 5387134 5387155 5387151 5387156 +
aataacataaatatttgagcaa

SEQ ID NO: 110514 - DNA, 22 bp, Artificial Sequence
  Synthetic oligonucleotide; TTT chr11 5387150 5387171 5387167 5387172 +
gagcaatggaaataagagagtg

SEQ ID NO: 110515 - DNA, 22 bp, Artificial Sequence
  Synthetic oligonucleotide; TTG chr11 5387151 5387172 5387168 5387173 +
agcaatggaaataagagagtgc

SEQ ID NO: 110516 - DNA, 22 bp, Artificial Sequence
  Synthetic oligonucleotide; CTA chr11 5387183 5387204 5387200 5387205 +
tcacaaaaatcagaagagaacc

SEQ ID NO: 110517 - DNA, 22 bp, Artificial Sequence
  Synthetic oligonucleotide; CTT chr11 5387215 5387236 5387232 5387237 +
ggcattaagaatttctagagag

SEQ ID NO: 110518 - DNA, 22 bp, Artificial Sequence
  Synthetic oligonucleotide; TTG chr11 5387216 5387237 5387233 5387238 +
gcattaagaatttctagagaga

SEQ ID NO: 110519 - DNA, 22 bp, Artificial Sequence
  Synthetic oligonucleotide; TTA chr11 5387222 5387243 5387239 5387244 +
agaatttctagagagagctcta

SEQ ID NO: 110520 - DNA, 22 bp, Artificial Sequence
  Synthetic oligonucleotide; TTT chr11 5387229 5387250 5387246 5387251 +
ctagagagagctctaaaaagga

SEQ ID NO: 110521 - DNA, 22 bp, Artificial Sequence
  Synthetic oligonucleotide; TTC chr11 5387230 5387251 5387247 5387252 +
tagagagagctctaaaaaggaa

SEQ ID NO: 110522 - DNA, 22 bp, Artificial Sequence
  Synthetic oligonucleotide; CTA chr11 5387232 5387253 5387249 5387254 +
gagagagctctaaaaaggaagg

SEQ ID NO: 110523 - DNA, 22 bp, Artificial Sequence
  Synthetic oligonucleotide; CTC chr11 5387242 5387263 5387259 5387264 +
taaaaaggaaggcatggccaga

SEQ ID NO: 110524 - DNA, 22 bp, Artificial Sequence
  Synthetic oligonucleotide; CTA chr11 5387244 5387265 5387261 5387266 +
aaaaggaaggcatggccagagc

SEQ ID NO: 110525 - DNA, 22 bp, Artificial Sequence
  Synthetic oligonucleotide; CTA chr11 5387275 5387296 5387292 5387297 +
ttgcacaaaaaaatcaataaaa

SEQ ID NO: 110526 - DNA, 22 bp, Artificial Sequence
  Synthetic oligonucleotide; TTG chr11 5387278 5387299 5387295 5387300 +
cacaaaaaaatcaataaaagca

SEQ ID NO: 110527 - DNA, 22 bp, Artificial Sequence
  Synthetic oligonucleotide; TTA chr11 5387310 5387331 5387327 5387332 +
agactctccattgcatttggcc

SEQ ID NO: 110528 - DNA, 22 bp, Artificial Sequence
  Synthetic oligonucleotide; CTC chr11 5387316 5387337 5387333 5387338 +
tccattgcatttggcccctaga

SEQ ID NO: 110529 - DNA, 22 bp, Artificial Sequence
  Synthetic oligonucleotide; CTC chr11 5387318 5387339 5387335 5387340 +
cattgcatttggcccctagaag

SEQ ID NO: 110530 - DNA, 22 bp, Artificial Sequence
  Synthetic oligonucleotide; TTG chr11 5387323 5387344 5387340 5387345 +
catttggcccctagaagtcact

SEQ ID NO: 110531 - DNA, 22 bp, Artificial Sequence
  Synthetic oligonucleotide; TTT chr11 5387328 5387349 5387345 5387350 +
ggcccctagaagtcactggtga

SEQ ID NO: 110532 - DNA, 22 bp, Artificial Sequence
  Synthetic oligonucleotide; TTG chr11 5387329 5387350 5387346 5387351 +
gcccctagaagtcactggtgaa

SEQ ID NO: 110533 - DNA, 22 bp, Artificial Sequence
  Synthetic oligonucleotide; CTA chr11 5387336 5387357 5387353 5387358 +
gaagtcactggtgaatttaagg

SEQ ID NO: 110534 - DNA, 22 bp, Artificial Sequence
  Synthetic oligonucleotide; CTG chr11 5387346 5387367 5387363 5387368 +
gtgaatttaaggagcattgctt

SEQ ID NO: 110535 - DNA, 22 bp, Artificial Sequence
  Synthetic oligonucleotide; TTT chr11 5387354 5387375 5387371 5387376 +
aaggagcattgctttagctaag

SEQ ID NO: 110536 - DNA, 22 bp, Artificial Sequence
  Synthetic oligonucleotide; TTA chr11 5387355 5387376 5387372 5387377 +
aggagcattgctttagctaagt

SEQ ID NO: 110537 - DNA, 22 bp, Artificial Sequence
  Synthetic oligonucleotide; TTG chr11 5387365 5387386 5387382 5387387 +
ctttagctaagtgggttttaaa

SEQ ID NO: 110538 - DNA, 22 bp, Artificial Sequence
  Synthetic oligonucleotide; CTT chr11 5387368 5387389 5387385 5387390 +
tagctaagtgggttttaaaaaa

SEQ ID NO: 110539 - DNA, 22 bp, Artificial Sequence
  Synthetic oligonucleotide; TTT chr11 5387369 5387390 5387386 5387391 +
agctaagtgggttttaaaaaaa

SEQ ID NO: 110540 - DNA, 22 bp, Artificial Sequence
  Synthetic oligonucleotide; TTA chr11 5387370 5387391 5387387 5387392 +
gctaagtgggttttaaaaaaaa

SEQ ID NO: 110541 - DNA, 22 bp, Artificial Sequence
  Synthetic oligonucleotide; CTA chr11 5387374 5387395 5387391 5387396 +
agtgggttttaaaaaaaacatt

SEQ ID NO: 110542 - DNA, 22 bp, Artificial Sequence
  Synthetic oligonucleotide; TTT chr11 5387383 5387404 5387400 5387405 +
taaaaaaaacattatagggtgg

SEQ ID NO: 110543 - DNA, 22 bp, Artificial Sequence
  Synthetic oligonucleotide; TTT chr11 5387384 5387405 5387401 5387406 +
aaaaaaaacattatagggtggt

SEQ ID NO: 110544 - DNA, 22 bp, Artificial Sequence
  Synthetic oligonucleotide; TTA chr11 5387385 5387406 5387402 5387407 +
aaaaaaacattatagggtggtt

SEQ ID NO: 110545 - DNA, 22 bp, Artificial Sequence
  Synthetic oligonucleotide; TTA chr11 5387397 5387418 5387414 5387419 +
tagggtggttggttgagtagta

SEQ ID NO: 110546 - DNA, 22 bp, Artificial Sequence
  Synthetic oligonucleotide; TTG chr11 5387408 5387429 5387425 5387430 +
gttgagtagtaaactgagaagt

SEQ ID NO: 110547 - DNA, 22 bp, Artificial Sequence
  Synthetic oligonucleotide; TTG chr11 5387412 5387433 5387429 5387434 +
agtagtaaactgagaagtaaag

SEQ ID NO: 110548 - DNA, 22 bp, Artificial Sequence
  Synthetic oligonucleotide; CTG chr11 5387424 5387445 5387441 5387446 +
agaagtaaagaaatggaaaaga

SEQ ID NO: 110549 - DNA, 22 bp, Artificial Sequence
  Synthetic oligonucleotide; CTA chr11 5387459 5387480 5387476 5387481 +
ttttttaccccttgccaaagtg

SEQ ID NO: 110550 - DNA, 22 bp, Artificial Sequence
  Synthetic oligonucleotide; TTT chr11 5387462 5387483 5387479 5387484 +
tttaccccttgccaaagtgatg

SEQ ID NO: 110551 - DNA, 22 bp, Artificial Sequence
  Synthetic oligonucleotide; TTT chr11 5387463 5387484 5387480 5387485 +
ttaccccttgccaaagtgatgt

SEQ ID NO: 110552 - DNA, 22 bp, Artificial Sequence
  Synthetic oligonucleotide; TTT chr11 5387464 5387485 5387481 5387486 +
taccccttgccaaagtgatgta

SEQ ID NO: 110553 - DNA, 22 bp, Artificial Sequence
  Synthetic oligonucleotide; TTT chr11 5387465 5387486 5387482 5387487 +
accccttgccaaagtgatgtaa

SEQ ID NO: 110554 - DNA, 22 bp, Artificial Sequence
  Synthetic oligonucleotide; TTA chr11 5387466 5387487 5387483 5387488 +
ccccttgccaaagtgatgtaag

SEQ ID NO: 110555 - DNA, 22 bp, Artificial Sequence
  Synthetic oligonucleotide; CTT chr11 5387472 5387493 5387489 5387494 +
gccaaagtgatgtaagccttat

SEQ ID NO: 110556 - DNA, 22 bp, Artificial Sequence
  Synthetic oligonucleotide; TTG chr11 5387473 5387494 5387490 5387495 +
ccaaagtgatgtaagccttata

SEQ ID NO: 110557 - DNA, 22 bp, Artificial Sequence
  Synthetic oligonucleotide; CTT chr11 5387492 5387513 5387509 5387514 +
atatccatgcagcacctctgct

SEQ ID NO: 110558 - DNA, 22 bp, Artificial Sequence
  Synthetic oligonucleotide; TTA chr11 5387493 5387514 5387510 5387515 +
tatccatgcagcacctctgctc

SEQ ID NO: 110559 - DNA, 22 bp, Artificial Sequence
  Synthetic oligonucleotide; CTC chr11 5387510 5387531 5387527 5387532 +
tgctctcaactcgaagctcaca

SEQ ID NO: 110560 - DNA, 22 bp, Artificial Sequence
  Synthetic oligonucleotide; CTG chr11 5387512 5387533 5387529 5387534 +
ctctcaactcgaagctcacaag

SEQ ID NO: 110561 - DNA, 22 bp, Artificial Sequence
  Synthetic oligonucleotide; CTC chr11 5387515 5387536 5387532 5387537 +
tcaactcgaagctcacaagtat

SEQ ID NO: 110562 - DNA, 22 bp, Artificial Sequence
  Synthetic oligonucleotide; CTC chr11 5387517 5387538 5387534 5387539 +
aactcgaagctcacaagtataa

SEQ ID NO: 110563 - DNA, 22 bp, Artificial Sequence
  Synthetic oligonucleotide; CTC chr11 5387522 5387543 5387539 5387544 +
gaagctcacaagtataataaaa

SEQ ID NO: 110564 - DNA, 22 bp, Artificial Sequence
  Synthetic oligonucleotide; CTC chr11 5387529 5387550 5387546 5387551 +
acaagtataataaaattcaaag

SEQ ID NO: 110565 - DNA, 22 bp, Artificial Sequence
  Synthetic oligonucleotide; TTC chr11 5387547 5387568 5387564 5387569 +
aaagtagcttgcgtgacctgca

SEQ ID NO: 110566 - DNA, 22 bp, Artificial Sequence
  Synthetic oligonucleotide; CTT chr11 5387557 5387578 5387574 5387579 +
gcgtgacctgcaagatcataca

SEQ ID NO: 110567 - DNA, 22 bp, Artificial Sequence
  Synthetic oligonucleotide; TTG chr11 5387558 5387579 5387575 5387580 +
cgtgacctgcaagatcatacat

SEQ ID NO: 110568 - DNA, 22 bp, Artificial Sequence
  Synthetic oligonucleotide; CTG chr11 5387567 5387588 5387584 5387589 +
caagatcatacatgacgtagca

SEQ ID NO: 110569 - DNA, 22 bp, Artificial Sequence
  Synthetic oligonucleotide; TTT chr11 5387592 5387613 5387609 5387614 +
agctgctacttcaagtggattt

SEQ ID NO: 110570 - DNA, 22 bp, Artificial Sequence
  Synthetic oligonucleotide; TTA chr11 5387593 5387614 5387610 5387615 +
gctgctacttcaagtggatttg

SEQ ID NO: 110571 - DNA, 22 bp, Artificial Sequence
  Synthetic oligonucleotide; CTG chr11 5387597 5387618 5387614 5387619 +
ctacttcaagtggatttgccac

SEQ ID NO: 110572 - DNA, 22 bp, Artificial Sequence
  Synthetic oligonucleotide; CTA chr11 5387600 5387621 5387617 5387622 +
cttcaagtggatttgccaccat

SEQ ID NO: 110573 - DNA, 22 bp, Artificial Sequence
  Synthetic oligonucleotide; CTT chr11 5387603 5387624 5387620 5387625 +
caagtggatttgccaccattcc

SEQ ID NO: 110574 - DNA, 22 bp, Artificial Sequence
  Synthetic oligonucleotide; TTC chr11 5387604 5387625 5387621 5387626 +
aagtggatttgccaccattccc

SEQ ID NO: 110575 - DNA, 22 bp, Artificial Sequence
  Synthetic oligonucleotide; TTT chr11 5387614 5387635 5387631 5387636 +
gccaccattccccaccttgctt

SEQ ID NO: 110576 - DNA, 22 bp, Artificial Sequence
  Synthetic oligonucleotide; TTG chr11 5387615 5387636 5387632 5387637 +
ccaccattccccaccttgcttc

SEQ ID NO: 110577 - DNA, 22 bp, Artificial Sequence
  Synthetic oligonucleotide; TTC chr11 5387624 5387645 5387641 5387646 +
cccaccttgcttcctccattga

SEQ ID NO: 110578 - DNA, 22 bp, Artificial Sequence
  Synthetic oligonucleotide; CTT chr11 5387632 5387653 5387649 5387654 +
gcttcctccattgaatatacat

SEQ ID NO: 110579 - DNA, 22 bp, Artificial Sequence
  Synthetic oligonucleotide; TTG chr11 5387633 5387654 5387650 5387655 +
cttcctccattgaatatacatt

SEQ ID NO: 110580 - DNA, 22 bp, Artificial Sequence
  Synthetic oligonucleotide; CTT chr11 5387636 5387657 5387653 5387658 +
cctccattgaatatacattggc

SEQ ID NO: 110581 - DNA, 22 bp, Artificial Sequence
  Synthetic oligonucleotide; TTC chr11 5387637 5387658 5387654 5387659 +
ctccattgaatatacattggcc

SEQ ID NO: 110582 - DNA, 22 bp, Artificial Sequence
  Synthetic oligonucleotide; CTC chr11 5387640 5387661 5387657 5387662 +
cattgaatatacattggccttc

SEQ ID NO: 110583 - DNA, 22 bp, Artificial Sequence
  Synthetic oligonucleotide; TTG chr11 5387645 5387666 5387662 5387667 +
aatatacattggccttcttttg

SEQ ID NO: 110584 - DNA, 22 bp, Artificial Sequence
  Synthetic oligonucleotide; TTG chr11 5387656 5387677 5387673 5387678 +
gccttcttttgtcttttaaact

SEQ ID NO: 110585 - DNA, 22 bp, Artificial Sequence
  Synthetic oligonucleotide; CTT chr11 5387661 5387682 5387678 5387683 +
cttttgtcttttaaacttgtca

SEQ ID NO: 110586 - DNA, 22 bp, Artificial Sequence
  Synthetic oligonucleotide; TTC chr11 5387662 5387683 5387679 5387684 +
ttttgtcttttaaacttgtcaa

SEQ ID NO: 110587 - DNA, 22 bp, Artificial Sequence
  Synthetic oligonucleotide; CTT chr11 5387664 5387685 5387681 5387686 +
ttgtcttttaaacttgtcaagc

SEQ ID NO: 110588 - DNA, 22 bp, Artificial Sequence
  Synthetic oligonucleotide; TTT chr11 5387665 5387686 5387682 5387687 +
tgtcttttaaacttgtcaagct

SEQ ID NO: 110589 - DNA, 22 bp, Artificial Sequence
  Synthetic oligonucleotide; TTT chr11 5387666 5387687 5387683 5387688 +
gtcttttaaacttgtcaagctg

SEQ ID NO: 110590 - DNA, 22 bp, Artificial Sequence
  Synthetic oligonucleotide; TTG chr11 5387667 5387688 5387684 5387689 +
tcttttaaacttgtcaagctgc

SEQ ID NO: 110591 - DNA, 22 bp, Artificial Sequence
  Synthetic oligonucleotide; CTT chr11 5387671 5387692 5387688 5387693 +
ttaaacttgtcaagctgctctc

SEQ ID NO: 110592 - DNA, 22 bp, Artificial Sequence
  Synthetic oligonucleotide; TTT chr11 5387672 5387693 5387689 5387694 +
taaacttgtcaagctgctctct

SEQ ID NO: 110593 - DNA, 22 bp, Artificial Sequence
  Synthetic oligonucleotide; TTT chr11 5387673 5387694 5387690 5387695 +
aaacttgtcaagctgctctctg

SEQ ID NO: 110594 - DNA, 22 bp, Artificial Sequence
  Synthetic oligonucleotide; TTA chr11 5387674 5387695 5387691 5387696 +
aacttgtcaagctgctctctgc

SEQ ID NO: 110595 - DNA, 22 bp, Artificial Sequence
  Synthetic oligonucleotide; CTT chr11 5387679 5387700 5387696 5387701 +
gtcaagctgctctctgcttcag

SEQ ID NO: 110596 - DNA, 22 bp, Artificial Sequence
  Synthetic oligonucleotide; TTG chr11 5387680 5387701 5387697 5387702 +
tcaagctgctctctgcttcagg

SEQ ID NO: 110597 - DNA, 22 bp, Artificial Sequence
  Synthetic oligonucleotide; CTG chr11 5387688 5387709 5387705 5387710 +
ctctctgcttcaggaactttca

SEQ ID NO: 110598 - DNA, 22 bp, Artificial Sequence
  Synthetic oligonucleotide; CTC chr11 5387691 5387712 5387708 5387713 +
tctgcttcaggaactttcactt

SEQ ID NO: 110599 - DNA, 22 bp, Artificial Sequence
  Synthetic oligonucleotide; CTC chr11 5387693 5387714 5387710 5387715 +
tgcttcaggaactttcacttgt

SEQ ID NO: 110600 - DNA, 22 bp, Artificial Sequence
  Synthetic oligonucleotide; CTG chr11 5387695 5387716 5387712 5387717 +
cttcaggaactttcacttgttc

SEQ ID NO: 110601 - DNA, 22 bp, Artificial Sequence
  Synthetic oligonucleotide; CTT chr11 5387698 5387719 5387715 5387720 +
caggaactttcacttgttcttc

SEQ ID NO: 110602 - DNA, 22 bp, Artificial Sequence
  Synthetic oligonucleotide; TTC chr11 5387699 5387720 5387716 5387721 +
aggaactttcacttgttcttcc

SEQ ID NO: 110603 - DNA, 22 bp, Artificial Sequence
  Synthetic oligonucleotide; CTT chr11 5387707 5387728 5387724 5387729 +
tcacttgttcttcctccttcct

SEQ ID NO: 110604 - DNA, 22 bp, Artificial Sequence
  Synthetic oligonucleotide; TTT chr11 5387708 5387729 5387725 5387730 +
cacttgttcttcctccttcctt

SEQ ID NO: 110605 - DNA, 22 bp, Artificial Sequence
  Synthetic oligonucleotide; TTC chr11 5387709 5387730 5387726 5387731 +
acttgttcttcctccttccttg

SEQ ID NO: 110606 - DNA, 22 bp, Artificial Sequence
  Synthetic oligonucleotide; CTT chr11 5387713 5387734 5387730 5387735 +
gttcttcctccttccttgaatg

SEQ ID NO: 110607 - DNA, 22 bp, Artificial Sequence
  Synthetic oligonucleotide; TTG chr11 5387714 5387735 5387731 5387736 +
ttcttcctccttccttgaatgt

SEQ ID NO: 110608 - DNA, 22 bp, Artificial Sequence
  Synthetic oligonucleotide; TTC chr11 5387717 5387738 5387734 5387739 +
ttcctccttccttgaatgtttt

SEQ ID NO: 110609 - DNA, 22 bp, Artificial Sequence
  Synthetic oligonucleotide; CTT chr11 5387719 5387740 5387736 5387741 +
cctccttccttgaatgtttttc

SEQ ID NO: 110610 - DNA, 22 bp, Artificial Sequence
  Synthetic oligonucleotide; TTC chr11 5387720 5387741 5387737 5387742 +
ctccttccttgaatgtttttcc

SEQ ID NO: 110611 - DNA, 22 bp, Artificial Sequence
  Synthetic oligonucleotide; CTC chr11 5387723 5387744 5387740 5387745 +
cttccttgaatgtttttcccta

SEQ ID NO: 110612 - DNA, 22 bp, Artificial Sequence
  Synthetic oligonucleotide; CTT chr11 5387726 5387747 5387743 5387748 +
ccttgaatgtttttccctaaga

SEQ ID NO: 110613 - DNA, 22 bp, Artificial Sequence
  Synthetic oligonucleotide; TTC chr11 5387727 5387748 5387744 5387749 +
cttgaatgtttttccctaagat

SEQ ID NO: 110614 - DNA, 22 bp, Artificial Sequence
  Synthetic oligonucleotide; CTT chr11 5387730 5387751 5387747 5387752 +
gaatgtttttccctaagatagc

SEQ ID NO: 110615 - DNA, 22 bp, Artificial Sequence
  Synthetic oligonucleotide; TTG chr11 5387731 5387752 5387748 5387753 +
aatgtttttccctaagatagcc

SEQ ID NO: 110616 - DNA, 22 bp, Artificial Sequence
  Synthetic oligonucleotide; TTT chr11 5387738 5387759 5387755 5387760 +
ttccctaagatagccacacact

SEQ ID NO: 110617 - DNA, 22 bp, Artificial Sequence
  Synthetic oligonucleotide; TTT chr11 5387739 5387760 5387756 5387761 +
tccctaagatagccacacactt

SEQ ID NO: 110618 - DNA, 22 bp, Artificial Sequence
  Synthetic oligonucleotide; TTT chr11 5387740 5387761 5387757 5387762 +
ccctaagatagccacacacttg

SEQ ID NO: 110619 - DNA, 22 bp, Artificial Sequence
  Synthetic oligonucleotide; TTC chr11 5387741 5387762 5387758 5387763 +
cctaagatagccacacacttgc

SEQ ID NO: 110620 - DNA, 22 bp, Artificial Sequence
  Synthetic oligonucleotide; CTA chr11 5387745 5387766 5387762 5387767 +
agatagccacacacttgccctc

SEQ ID NO: 110621 - DNA, 22 bp, Artificial Sequence
  Synthetic oligonucleotide; CTT chr11 5387761 5387782 5387778 5387783 +
gccctctgattttgatttcttc

SEQ ID NO: 110622 - DNA, 22 bp, Artificial Sequence
  Synthetic oligonucleotide; TTG chr11 5387762 5387783 5387779 5387784 +
ccctctgattttgatttcttct

SEQ ID NO: 110623 - DNA, 22 bp, Artificial Sequence
  Synthetic oligonucleotide; CTC chr11 5387767 5387788 5387784 5387789 +
tgattttgatttcttctctaaa

SEQ ID NO: 110624 - DNA, 22 bp, Artificial Sequence
  Synthetic oligonucleotide; CTG chr11 5387769 5387790 5387786 5387791 +
attttgatttcttctctaaaat

SEQ ID NO: 110625 - DNA, 22 bp, Artificial Sequence
  Synthetic oligonucleotide; TTT chr11 5387773 5387794 5387790 5387795 +
tgatttcttctctaaaattacc

SEQ ID NO: 110626 - DNA, 22 bp, Artificial Sequence
  Synthetic oligonucleotide; TTT chr11 5387774 5387795 5387791 5387796 +
gatttcttctctaaaattacct

SEQ ID NO: 110627 - DNA, 22 bp, Artificial Sequence
  Synthetic oligonucleotide; TTG chr11 5387775 5387796 5387792 5387797 +
atttcttctctaaaattaccta

SEQ ID NO: 110628 - DNA, 22 bp, Artificial Sequence
  Synthetic oligonucleotide; TTT chr11 5387779 5387800 5387796 5387801 +
cttctctaaaattacctactca

SEQ ID NO: 110629 - DNA, 22 bp, Artificial Sequence
  Synthetic oligonucleotide; TTC chr11 5387780 5387801 5387797 5387802 +
ttctctaaaattacctactcag

SEQ ID NO: 110630 - DNA, 22 bp, Artificial Sequence
  Synthetic oligonucleotide; CTT chr11 5387782 5387803 5387799 5387804 +
ctctaaaattacctactcagag

SEQ ID NO: 110631 - DNA, 22 bp, Artificial Sequence
  Synthetic oligonucleotide; TTC chr11 5387783 5387804 5387800 5387805 +
tctaaaattacctactcagaga

SEQ ID NO: 110632 - DNA, 22 bp, Artificial Sequence
  Synthetic oligonucleotide; CTC chr11 5387785 5387806 5387802 5387807 +
taaaattacctactcagagagg

SEQ ID NO: 110633 - DNA, 22 bp, Artificial Sequence
  Synthetic oligonucleotide; CTA chr11 5387787 5387808 5387804 5387809 +
aaattacctactcagagaggtc

SEQ ID NO: 110634 - DNA, 22 bp, Artificial Sequence
  Synthetic oligonucleotide; TTA chr11 5387793 5387814 5387810 5387815 +
cctactcagagaggtcttctct

SEQ ID NO: 110635 - DNA, 22 bp, Artificial Sequence
  Synthetic oligonucleotide; CTA chr11 5387797 5387818 5387814 5387819 +
ctcagagaggtcttctctgact

SEQ ID NO: 110636 - DNA, 22 bp, Artificial Sequence
  Synthetic oligonucleotide; CTC chr11 5387800 5387821 5387817 5387822 +
agagaggtcttctctgactacc

SEQ ID NO: 110637 - DNA, 22 bp, Artificial Sequence
  Synthetic oligonucleotide; CTT chr11 5387811 5387832 5387828 5387833 +
ctctgactaccctatataaaat

SEQ ID NO: 110638 - DNA, 22 bp, Artificial Sequence
  Synthetic oligonucleotide; TTC chr11 5387812 5387833 5387829 5387834 +
tctgactaccctatataaaatg

SEQ ID NO: 110639 - DNA, 22 bp, Artificial Sequence
  Synthetic oligonucleotide; CTC chr11 5387814 5387835 5387831 5387836 +
tgactaccctatataaaatgca

SEQ ID NO: 110640 - DNA, 22 bp, Artificial Sequence
  Synthetic oligonucleotide; CTG chr11 5387816 5387837 5387833 5387838 +
actaccctatataaaatgcatc

SEQ ID NO: 110641 - DNA, 22 bp, Artificial Sequence
  Synthetic oligonucleotide; CTA chr11 5387820 5387841 5387837 5387842 +
ccctatataaaatgcatcactc

SEQ ID NO: 110642 - DNA, 22 bp, Artificial Sequence
  Synthetic oligonucleotide; CTA chr11 5387825 5387846 5387842 5387847 +
tataaaatgcatcactcttacc

SEQ ID NO: 110643 - DNA, 22 bp, Artificial Sequence
  Synthetic oligonucleotide; CTC chr11 5387842 5387863 5387859 5387864 +
ttaccttcctcctttgctccct

SEQ ID NO: 110644 - DNA, 22 bp, Artificial Sequence
  Synthetic oligonucleotide; CTT chr11 5387844 5387865 5387861 5387866 +
accttcctcctttgctccctac

SEQ ID NO: 110645 - DNA, 22 bp, Artificial Sequence
  Synthetic oligonucleotide; TTA chr11 5387845 5387866 5387862 5387867 +
ccttcctcctttgctccctact

SEQ ID NO: 110646 - DNA, 22 bp, Artificial Sequence
  Synthetic oligonucleotide; CTT chr11 5387849 5387870 5387866 5387871 +
cctcctttgctccctacttctt

SEQ ID NO: 110647 - DNA, 22 bp, Artificial Sequence
  Synthetic oligonucleotide; TTC chr11 5387850 5387871 5387867 5387872 +
ctcctttgctccctacttcttt

SEQ ID NO: 110648 - DNA, 22 bp, Artificial Sequence
  Synthetic oligonucleotide; CTC chr11 5387853 5387874 5387870 5387875 +
ctttgctccctacttctttatt

SEQ ID NO: 110649 - DNA, 22 bp, Artificial Sequence
  Synthetic oligonucleotide; CTT chr11 5387856 5387877 5387873 5387878 +
tgctccctacttctttattgca

SEQ ID NO: 110650 - DNA, 22 bp, Artificial Sequence
  Synthetic oligonucleotide; TTT chr11 5387857 5387878 5387874 5387879 +
gctccctacttctttattgcat

SEQ ID NO: 110651 - DNA, 22 bp, Artificial Sequence
  Synthetic oligonucleotide; TTG chr11 5387858 5387879 5387875 5387880 +
ctccctacttctttattgcatt

SEQ ID NO: 110652 - DNA, 22 bp, Artificial Sequence
  Synthetic oligonucleotide; CTC chr11 5387861 5387882 5387878 5387883 +
cctacttctttattgcattaca

SEQ ID NO: 110653 - DNA, 22 bp, Artificial Sequence
  Synthetic oligonucleotide; CTA chr11 5387865 5387886 5387882 5387887 +
cttctttattgcattacattac

SEQ ID NO: 110654 - DNA, 22 bp, Artificial Sequence
  Synthetic oligonucleotide; CTT chr11 5387868 5387889 5387885 5387890 +
ctttattgcattacattacctt

SEQ ID NO: 110655 - DNA, 22 bp, Artificial Sequence
  Synthetic oligonucleotide; TTC chr11 5387869 5387890 5387886 5387891 +
tttattgcattacattaccttg

SEQ ID NO: 110656 - DNA, 22 bp, Artificial Sequence
  Synthetic oligonucleotide; CTT chr11 5387871 5387892 5387888 5387893 +
tattgcattacattaccttgca

SEQ ID NO: 110657 - DNA, 22 bp, Artificial Sequence
  Synthetic oligonucleotide; TTT chr11 5387872 5387893 5387889 5387894 +
attgcattacattaccttgcat

SEQ ID NO: 110658 - DNA, 22 bp, Artificial Sequence
  Synthetic oligonucleotide; TTA chr11 5387873 5387894 5387890 5387895 +
ttgcattacattaccttgcatt

SEQ ID NO: 110659 - DNA, 22 bp, Artificial Sequence
  Synthetic oligonucleotide; TTG chr11 5387876 5387897 5387893 5387898 +
cattacattaccttgcattgca

SEQ ID NO: 110660 - DNA, 22 bp, Artificial Sequence
  Synthetic oligonucleotide; TTA chr11 5387881 5387902 5387898 5387903 +
cattaccttgcattgcagtatg

SEQ ID NO: 110661 - DNA, 22 bp, Artificial Sequence
  Synthetic oligonucleotide; TTA chr11 5387886 5387907 5387903 5387908 +
ccttgcattgcagtatgtatgt

SEQ ID NO: 110662 - DNA, 22 bp, Artificial Sequence
  Synthetic oligonucleotide; CTT chr11 5387890 5387911 5387907 5387912 +
gcattgcagtatgtatgtatgt

SEQ ID NO: 110663 - DNA, 22 bp, Artificial Sequence
  Synthetic oligonucleotide; TTG chr11 5387891 5387912 5387908 5387913 +
cattgcagtatgtatgtatgtg

SEQ ID NO: 110664 - DNA, 22 bp, Artificial Sequence
  Synthetic oligonucleotide; TTG chr11 5387896 5387917 5387913 5387918 +
cagtatgtatgtatgtgtttat

SEQ ID NO: 110665 - DNA, 22 bp, Artificial Sequence
  Synthetic oligonucleotide; TTT chr11 5387916 5387937 5387933 5387938 +
atttttgtctctgttctgtttc

SEQ ID NO: 110666 - DNA, 22 bp, Artificial Sequence
  Synthetic oligonucleotide; TTA chr11 5387917 5387938 5387934 5387939 +
tttttgtctctgttctgtttct

SEQ ID NO: 110667 - DNA, 22 bp, Artificial Sequence
  Synthetic oligonucleotide; TTT chr11 5387920 5387941 5387937 5387942 +
ttgtctctgttctgtttctgtt

SEQ ID NO: 110668 - DNA, 22 bp, Artificial Sequence
  Synthetic oligonucleotide; TTT chr11 5387921 5387942 5387938 5387943 +
tgtctctgttctgtttctgttc

SEQ ID NO: 110669 - DNA, 22 bp, Artificial Sequence
  Synthetic oligonucleotide; TTT chr11 5387922 5387943 5387939 5387944 +
gtctctgttctgtttctgttca

SEQ ID NO: 110670 - DNA, 22 bp, Artificial Sequence
  Synthetic oligonucleotide; TTG chr11 5387923 5387944 5387940 5387945 +
tctctgttctgtttctgttcat

SEQ ID NO: 110671 - DNA, 22 bp, Artificial Sequence
  Synthetic oligonucleotide; CTC chr11 5387927 5387948 5387944 5387949 +
tgttctgtttctgttcattgta

SEQ ID NO: 110672 - DNA, 22 bp, Artificial Sequence
  Synthetic oligonucleotide; CTG chr11 5387929 5387950 5387946 5387951 +
ttctgtttctgttcattgtatt

SEQ ID NO: 110673 - DNA, 22 bp, Artificial Sequence
  Synthetic oligonucleotide; TTC chr11 5387932 5387953 5387949 5387954 +
tgtttctgttcattgtattttc

SEQ ID NO: 110674 - DNA, 22 bp, Artificial Sequence
  Synthetic oligonucleotide; CTG chr11 5387934 5387955 5387951 5387956 +
tttctgttcattgtattttcag

SEQ ID NO: 110675 - DNA, 22 bp, Artificial Sequence
  Synthetic oligonucleotide; TTT chr11 5387937 5387958 5387954 5387959 +
ctgttcattgtattttcagtac

SEQ ID NO: 110676 - DNA, 22 bp, Artificial Sequence
  Synthetic oligonucleotide; TTC chr11 5387938 5387959 5387955 5387960 +
tgttcattgtattttcagtacc

SEQ ID NO: 110677 - DNA, 22 bp, Artificial Sequence
  Synthetic oligonucleotide; CTG chr11 5387940 5387961 5387957 5387962 +
ttcattgtattttcagtaccta

SEQ ID NO: 110678 - DNA, 22 bp, Artificial Sequence
  Synthetic oligonucleotide; TTC chr11 5387943 5387964 5387960 5387965 +
attgtattttcagtacctaggt

SEQ ID NO: 110679 - DNA, 22 bp, Artificial Sequence
  Synthetic oligonucleotide; TTG chr11 5387947 5387968 5387964 5387969 +
tattttcagtacctaggtgtaa

SEQ ID NO: 110680 - DNA, 22 bp, Artificial Sequence
  Synthetic oligonucleotide; TTT chr11 5387952 5387973 5387969 5387974 +
tcagtacctaggtgtaaaagta

SEQ ID NO: 110681 - DNA, 22 bp, Artificial Sequence
  Synthetic oligonucleotide; TTT chr11 5387953 5387974 5387970 5387975 +
cagtacctaggtgtaaaagtaa

SEQ ID NO: 110682 - DNA, 22 bp, Artificial Sequence
  Synthetic oligonucleotide; TTC chr11 5387954 5387975 5387971 5387976 +
agtacctaggtgtaaaagtaat

SEQ ID NO: 110683 - DNA, 22 bp, Artificial Sequence
  Synthetic oligonucleotide; CTA chr11 5387962 5387983 5387979 5387984 +
ggtgtaaaagtaattgcagttc

SEQ ID NO: 110684 - DNA, 22 bp, Artificial Sequence
  Synthetic oligonucleotide; TTG chr11 5387978 5387999 5387995 5388000 +
cagttcttgccattgaaagtaa

SEQ ID NO: 110685 - DNA, 22 bp, Artificial Sequence
  Synthetic oligonucleotide; TTC chr11 5387984 5388005 5388001 5388006 +
ttgccattgaaagtaatggtaa

SEQ ID NO: 110686 - DNA, 22 bp, Artificial Sequence
  Synthetic oligonucleotide; CTT chr11 5387986 5388007 5388003 5388008 +
gccattgaaagtaatggtaaaa

SEQ ID NO: 110687 - DNA, 22 bp, Artificial Sequence
  Synthetic oligonucleotide; TTG chr11 5387987 5388008 5388004 5388009 +
ccattgaaagtaatggtaaaaa

SEQ ID NO: 110688 - DNA, 22 bp, Artificial Sequence
  Synthetic oligonucleotide; TTG chr11 5387993 5388014 5388010 5388015 +
aaagtaatggtaaaaaccacaa

SEQ ID NO: 110689 - DNA, 22 bp, Artificial Sequence
  Synthetic oligonucleotide; TTA chr11 5388018 5388039 5388035 5388040 +
cttttgcaccaacctaatagaa

SEQ ID NO: 110690 - DNA, 22 bp, Artificial Sequence
  Synthetic oligonucleotide; CTT chr11 5388021 5388042 5388038 5388043 +
ttgcaccaacctaatagaatta

SEQ ID NO: 110691 - DNA, 22 bp, Artificial Sequence
  Synthetic oligonucleotide; TTT chr11 5388022 5388043 5388039 5388044 +
tgcaccaacctaatagaattat

SEQ ID NO: 110692 - DNA, 22 bp, Artificial Sequence
  Synthetic oligonucleotide; TTT chr11 5388023 5388044 5388040 5388045 +
gcaccaacctaatagaattatg

SEQ ID NO: 110693 - DNA, 22 bp, Artificial Sequence
  Synthetic oligonucleotide; TTG chr11 5388024 5388045 5388041 5388046 +
caccaacctaatagaattatgt

SEQ ID NO: 110694 - DNA, 22 bp, Artificial Sequence
  Synthetic oligonucleotide; CTA chr11 5388034 5388055 5388051 5388056 +
atagaattatgtctgccatgta

SEQ ID NO: 110695 - DNA, 22 bp, Artificial Sequence
  Synthetic oligonucleotide; TTA chr11 5388043 5388064 5388060 5388065 +
tgtctgccatgtaatacaattt

SEQ ID NO: 110696 - DNA, 22 bp, Artificial Sequence
  Synthetic oligonucleotide; CTG chr11 5388049 5388070 5388066 5388071 +
ccatgtaatacaatttcaatat

SEQ ID NO: 110697 - DNA, 22 bp, Artificial Sequence
  Synthetic oligonucleotide; TTT chr11 5388065 5388086 5388082 5388087 +
caatatgtatttattgaatcaa

SEQ ID NO: 110698 - DNA, 22 bp, Artificial Sequence
  Synthetic oligonucleotide; TTC chr11 5388066 5388087 5388083 5388088 +
aatatgtatttattgaatcaat

SEQ ID NO: 110699 - DNA, 22 bp, Artificial Sequence
  Synthetic oligonucleotide; TTT chr11 5388077 5388098 5388094 5388099 +
attgaatcaattaatgaataat

SEQ ID NO: 110700 - DNA, 22 bp, Artificial Sequence
  Synthetic oligonucleotide; TTA chr11 5388078 5388099 5388095 5388100 +
ttgaatcaattaatgaataatt

SEQ ID NO: 110701 - DNA, 22 bp, Artificial Sequence
  Synthetic oligonucleotide; TTG chr11 5388081 5388102 5388098 5388103 +
aatcaattaatgaataattatt

SEQ ID NO: 110702 - DNA, 22 bp, Artificial Sequence
  Synthetic oligonucleotide; TTA chr11 5388090 5388111 5388107 5388112 +
atgaataattattgaaataatt

SEQ ID NO: 110703 - DNA, 22 bp, Artificial Sequence
  Synthetic oligonucleotide; TTA chr11 5388101 5388122 5388118 5388123 +
ttgaaataattgaatattgaaa

SEQ ID NO: 110704 - DNA, 22 bp, Artificial Sequence
  Synthetic oligonucleotide; TTG chr11 5388104 5388125 5388121 5388126 +
aaataattgaatattgaaataa

SEQ ID NO: 110705 - DNA, 22 bp, Artificial Sequence
  Synthetic oligonucleotide; TTG chr11 5388113 5388134 5388130 5388135 +
aatattgaaataattattgaaa

SEQ ID NO: 110706 - DNA, 22 bp, Artificial Sequence
  Synthetic oligonucleotide; TTG chr11 5388120 5388141 5388137 5388142 +
aaataattattgaaataagatt

SEQ ID NO: 110707 - DNA, 22 bp, Artificial Sequence
  Synthetic oligonucleotide; TTA chr11 5388129 5388150 5388146 5388151 +
ttgaaataagattaatggtaat

SEQ ID NO: 110708 - DNA, 22 bp, Artificial Sequence
  Synthetic oligonucleotide; TTG chr11 5388132 5388153 5388149 5388154 +
aaataagattaatggtaatgat

SEQ ID NO: 110709 - DNA, 22 bp, Artificial Sequence
  Synthetic oligonucleotide; TTA chr11 5388143 5388164 5388160 5388165 +
atggtaatgatacatatttaat

SEQ ID NO: 110710 - DNA, 22 bp, Artificial Sequence
  Synthetic oligonucleotide; TTT chr11 5388162 5388183 5388179 5388184 +
aataatttattcaaataatatt

SEQ ID NO: 110711 - DNA, 22 bp, Artificial Sequence
  Synthetic oligonucleotide; TTA chr11 5388163 5388184 5388180 5388185 +
ataatttattcaaataatattt

SEQ ID NO: 110712 - DNA, 22 bp, Artificial Sequence
  Synthetic oligonucleotide; TTT chr11 5388170 5388191 5388187 5388192 +
attcaaataatatttaaaggat

SEQ ID NO: 110713 - DNA, 22 bp, Artificial Sequence
  Synthetic oligonucleotide; TTA chr11 5388171 5388192 5388188 5388193 +
ttcaaataatatttaaaggatt

SEQ ID NO: 110714 - DNA, 22 bp, Artificial Sequence
  Synthetic oligonucleotide; TTC chr11 5388174 5388195 5388191 5388196 +
aaataatatttaaaggattcca

SEQ ID NO: 110715 - DNA, 22 bp, Artificial Sequence
  Synthetic oligonucleotide; TTT chr11 5388185 5388206 5388202 5388207 +
aaaggattccaatgatatggtg

SEQ ID NO: 110716 - DNA, 22 bp, Artificial Sequence
  Synthetic oligonucleotide; TTA chr11 5388186 5388207 5388203 5388208 +
aaggattccaatgatatggtgg

SEQ ID NO: 110717 - DNA, 22 bp, Artificial Sequence
  Synthetic oligonucleotide; TTC chr11 5388194 5388215 5388211 5388216 +
caatgatatggtggctaaaaaa

SEQ ID NO: 110718 - DNA, 22 bp, Artificial Sequence
  Synthetic oligonucleotide; CTA chr11 5388211 5388232 5388228 5388233 +
aaaaagtcaatccctagagcta

SEQ ID NO: 110719 - DNA, 22 bp, Artificial Sequence
  Synthetic oligonucleotide; CTA chr11 5388227 5388248 5388244 5388249 +
gagctaatattaaaattaaaaa

SEQ ID NO: 110720 - DNA, 22 bp, Artificial Sequence
  Synthetic oligonucleotide; CTA chr11 5388233 5388254 5388250 5388255 +
atattaaaattaaaaaagagac

SEQ ID NO: 110721 - DNA, 22 bp, Artificial Sequence
  Synthetic oligonucleotide; TTA chr11 5388239 5388260 5388256 5388261 +
aaattaaaaaagagacagtcat

SEQ ID NO: 110722 - DNA, 22 bp, Artificial Sequence
  Synthetic oligonucleotide; TTA chr11 5388245 5388266 5388262 5388267 +
aaaaagagacagtcatggttta

SEQ ID NO: 110723 - DNA, 22 bp, Artificial Sequence
  Synthetic oligonucleotide; TTT chr11 5388266 5388287 5388283 5388288 +
atgtccacaaggaattcacatt

SEQ ID NO: 110724 - DNA, 22 bp, Artificial Sequence
  Synthetic oligonucleotide; TTA chr11 5388267 5388288 5388284 5388289 +
tgtccacaaggaattcacatta

SEQ ID NO: 110725 - DNA, 22 bp, Artificial Sequence
  Synthetic oligonucleotide; TTC chr11 5388283 5388304 5388300 5388305 +
acattatagaagcaatacagaa

SEQ ID NO: 110726 - DNA, 22 bp, Artificial Sequence
  Synthetic oligonucleotide; TTA chr11 5388289 5388310 5388306 5388311 +
tagaagcaatacagaaattgac

SEQ ID NO: 110727 - DNA, 22 bp, Artificial Sequence
  Synthetic oligonucleotide; TTG chr11 5388309 5388330 5388326 5388331 +
acaatgctgcagggaaaatatc

SEQ ID NO: 110728 - DNA, 22 bp, Artificial Sequence
  Synthetic oligonucleotide; CTG chr11 5388318 5388339 5388335 5388340 +
cagggaaaatatcatggtaatt

SEQ ID NO: 110729 - DNA, 22 bp, Artificial Sequence
  Synthetic oligonucleotide; TTA chr11 5388341 5388362 5388358 5388363 +
gtgcatagtgaactacaggaac

SEQ ID NO: 110730 - DNA, 22 bp, Artificial Sequence
  Synthetic oligonucleotide; CTA chr11 5388356 5388377 5388373 5388378 +
caggaacacataggagagggta

SEQ ID NO: 110731 - DNA, 22 bp, Artificial Sequence
  Synthetic oligonucleotide; TTC chr11 5388381 5388402 5388398 5388403 +
aaactaaacttggggaatttaa

SEQ ID NO: 110732 - DNA, 22 bp, Artificial Sequence
  Synthetic oligonucleotide; CTA chr11 5388387 5388408 5388404 5388409 +
aacttggggaatttaagaaggc

SEQ ID NO: 110733 - DNA, 22 bp, Artificial Sequence
  Synthetic oligonucleotide; CTT chr11 5388392 5388413 5388409 5388414 +
ggggaatttaagaaggccttct

SEQ ID NO: 110734 - DNA, 22 bp, Artificial Sequence
  Synthetic oligonucleotide; TTG chr11 5388393 5388414 5388410 5388415 +
gggaatttaagaaggccttctg

SEQ ID NO: 110735 - DNA, 22 bp, Artificial Sequence
  Synthetic oligonucleotide; TTT chr11 5388401 5388422 5388418 5388423 +
aagaaggccttctgaaggacat

SEQ ID NO: 110736 - DNA, 22 bp, Artificial Sequence
  Synthetic oligonucleotide; TTA chr11 5388402 5388423 5388419 5388424 +
agaaggccttctgaaggacatc

SEQ ID NO: 110737 - DNA, 22 bp, Artificial Sequence
  Synthetic oligonucleotide; CTT chr11 5388412 5388433 5388429 5388434 +
ctgaaggacatcatatctaagc

SEQ ID NO: 110738 - DNA, 22 bp, Artificial Sequence
  Synthetic oligonucleotide; TTC chr11 5388413 5388434 5388430 5388435 +
tgaaggacatcatatctaagct

SEQ ID NO: 110739 - DNA, 22 bp, Artificial Sequence
  Synthetic oligonucleotide; CTG chr11 5388415 5388436 5388432 5388437 +
aaggacatcatatctaagctaa

SEQ ID NO: 110740 - DNA, 22 bp, Artificial Sequence
  Synthetic oligonucleotide; CTA chr11 5388431 5388452 5388448 5388453 +
agctaaggtgggttatattagt

SEQ ID NO: 110741 - DNA, 22 bp, Artificial Sequence
  Synthetic oligonucleotide; CTA chr11 5388436 5388457 5388453 5388458 +
aggtgggttatattagtagaag

SEQ ID NO: 110742 - DNA, 22 bp, Artificial Sequence
  Synthetic oligonucleotide; TTA chr11 5388446 5388467 5388463 5388468 +
tattagtagaagttaactagac

SEQ ID NO: 110743 - DNA, 22 bp, Artificial Sequence
  Synthetic oligonucleotide; TTA chr11 5388451 5388472 5388468 5388473 +
gtagaagttaactagacaaaga

SEQ ID NO: 110744 - DNA, 22 bp, Artificial Sequence
  Synthetic oligonucleotide; TTA chr11 5388461 5388482 5388478 5388483 +
actagacaaagattaagggaaa

SEQ ID NO: 110745 - DNA, 22 bp, Artificial Sequence
  Synthetic oligonucleotide; CTA chr11 5388465 5388486 5388482 5388487 +
gacaaagattaagggaaagcta

SEQ ID NO: 110746 - DNA, 22 bp, Artificial Sequence
  Synthetic oligonucleotide; TTA chr11 5388476 5388497 5388493 5388498 +
agggaaagctatttcaggaaaa

SEQ ID NO: 110747 - DNA, 22 bp, Artificial Sequence
  Synthetic oligonucleotide; CTA chr11 5388487 5388508 5388504 5388509 +
tttcaggaaaaaatgtttttat

SEQ ID NO: 110748 - DNA, 22 bp, Artificial Sequence
  Synthetic oligonucleotide; TTT chr11 5388490 5388511 5388507 5388512 +
caggaaaaaatgtttttattcc

SEQ ID NO: 110749 - DNA, 22 bp, Artificial Sequence
  Synthetic oligonucleotide; TTC chr11 5388491 5388512 5388508 5388513 +
aggaaaaaatgtttttattcca

SEQ ID NO: 110750 - DNA, 22 bp, Artificial Sequence
  Synthetic oligonucleotide; TTT chr11 5388505 5388526 5388522 5388527 +
ttattccaggaagaatgaaaat

SEQ ID NO: 110751 - DNA, 22 bp, Artificial Sequence
  Synthetic oligonucleotide; TTT chr11 5388506 5388527 5388523 5388528 +
tattccaggaagaatgaaaata

SEQ ID NO: 110752 - DNA, 22 bp, Artificial Sequence
  Synthetic oligonucleotide; TTT chr11 5388507 5388528 5388524 5388529 +
attccaggaagaatgaaaatac

SEQ ID NO: 110753 - DNA, 22 bp, Artificial Sequence
  Synthetic oligonucleotide; TTA chr11 5388508 5388529 5388525 5388530 +
ttccaggaagaatgaaaataca

SEQ ID NO: 110754 - DNA, 22 bp, Artificial Sequence
  Synthetic oligonucleotide; TTC chr11 5388511 5388532 5388528 5388533 +
caggaagaatgaaaatacaaat

SEQ ID NO: 110755 - DNA, 22 bp, Artificial Sequence
  Synthetic oligonucleotide; TTT chr11 5388537 5388558 5388554 5388559 +
acctatgagcaagcatactaga

SEQ ID NO: 110756 - DNA, 22 bp, Artificial Sequence
  Synthetic oligonucleotide; TTA chr11 5388538 5388559 5388555 5388560 +
cctatgagcaagcatactagat

SEQ ID NO: 110757 - DNA, 22 bp, Artificial Sequence
  Synthetic oligonucleotide; CTA chr11 5388542 5388563 5388559 5388564 +
tgagcaagcatactagataaac

SEQ ID NO: 110758 - DNA, 22 bp, Artificial Sequence
  Synthetic oligonucleotide; CTA chr11 5388557 5388578 5388574 5388579 +
gataaactggaagaattgttta

SEQ ID NO: 110759 - DNA, 22 bp, Artificial Sequence
  Synthetic oligonucleotide; CTG chr11 5388566 5388587 5388583 5388588 +
gaagaattgtttagtgtcatta

SEQ ID NO: 110760 - DNA, 22 bp, Artificial Sequence
  Synthetic oligonucleotide; TTG chr11 5388575 5388596 5388592 5388597 +
tttagtgtcattaacaccgtga

SEQ ID NO: 110761 - DNA, 22 bp, Artificial Sequence
  Synthetic oligonucleotide; TTT chr11 5388578 5388599 5388595 5388600 +
agtgtcattaacaccgtgaata

SEQ ID NO: 110762 - DNA, 22 bp, Artificial Sequence
  Synthetic oligonucleotide; TTA chr11 5388579 5388600 5388596 5388601 +
gtgtcattaacaccgtgaatat

SEQ ID NO: 110763 - DNA, 22 bp, Artificial Sequence
  Synthetic oligonucleotide; TTA chr11 5388588 5388609 5388605 5388610 +
acaccgtgaatatacagaggaa

SEQ ID NO: 110764 - DNA, 22 bp, Artificial Sequence
  Synthetic oligonucleotide; TTA chr11 5388614 5388635 5388631 5388636 +
ggatagataagaaaataggata

SEQ ID NO: 110765 - DNA, 22 bp, Artificial Sequence
  Synthetic oligonucleotide; CTT chr11 5388665 5388686 5388682 5388687 +
gaatgtcattttaaaccttttt

SEQ ID NO: 110766 - DNA, 22 bp, Artificial Sequence
  Synthetic oligonucleotide; TTG chr11 5388666 5388687 5388683 5388688 +
aatgtcattttaaacctttttt

SEQ ID NO: 110767 - DNA, 22 bp, Artificial Sequence
  Synthetic oligonucleotide; TTT chr11 5388676 5388697 5388693 5388698 +
taaaccttttttacttcattaa

SEQ ID NO: 110768 - DNA, 22 bp, Artificial Sequence
  Synthetic oligonucleotide; TTT chr11 5388677 5388698 5388694 5388699 +
aaaccttttttacttcattaaa

SEQ ID NO: 110769 - DNA, 22 bp, Artificial Sequence
  Synthetic oligonucleotide; TTA chr11 5388678 5388699 5388695 5388700 +
aaccttttttacttcattaaaa

SEQ ID NO: 110770 - DNA, 22 bp, Artificial Sequence
  Synthetic oligonucleotide; CTT chr11 5388684 5388705 5388701 5388706 +
ttttacttcattaaaaacttgt

SEQ ID NO: 110771 - DNA, 22 bp, Artificial Sequence
  Synthetic oligonucleotide; TTT chr11 5388685 5388706 5388702 5388707 +
tttacttcattaaaaacttgtt

SEQ ID NO: 110772 - DNA, 22 bp, Artificial Sequence
  Synthetic oligonucleotide; TTT chr11 5388686 5388707 5388703 5388708 +
ttacttcattaaaaacttgttt

SEQ ID NO: 110773 - DNA, 22 bp, Artificial Sequence
  Synthetic oligonucleotide; TTT chr11 5388687 5388708 5388704 5388709 +
tacttcattaaaaacttgttta

SEQ ID NO: 110774 - DNA, 22 bp, Artificial Sequence
  Synthetic oligonucleotide; TTT chr11 5388688 5388709 5388705 5388710 +
acttcattaaaaacttgtttat

SEQ ID NO: 110775 - DNA, 22 bp, Artificial Sequence
  Synthetic oligonucleotide; TTA chr11 5388689 5388710 5388706 5388711 +
cttcattaaaaacttgtttatg

SEQ ID NO: 110776 - DNA, 22 bp, Artificial Sequence
  Synthetic oligonucleotide; CTT chr11 5388692 5388713 5388709 5388714 +
cattaaaaacttgtttatgtat

SEQ ID NO: 110777 - DNA, 22 bp, Artificial Sequence
  Synthetic oligonucleotide; TTC chr11 5388693 5388714 5388710 5388715 +
attaaaaacttgtttatgtata

SEQ ID NO: 110778 - DNA, 22 bp, Artificial Sequence
  Synthetic oligonucleotide; TTA chr11 5388697 5388718 5388714 5388719 +
aaaacttgtttatgtatacgtc

SEQ ID NO: 110779 - DNA, 22 bp, Artificial Sequence
  Synthetic oligonucleotide; CTT chr11 5388704 5388725 5388721 5388726 +
gtttatgtatacgtctctcttg

SEQ ID NO: 110780 - DNA, 22 bp, Artificial Sequence
  Synthetic oligonucleotide; TTG chr11 5388705 5388726 5388722 5388727 +
tttatgtatacgtctctcttgc

SEQ ID NO: 110781 - DNA, 22 bp, Artificial Sequence
  Synthetic oligonucleotide; TTT chr11 5388708 5388729 5388725 5388730 +
atgtatacgtctctcttgctat

SEQ ID NO: 110782 - DNA, 22 bp, Artificial Sequence
  Synthetic oligonucleotide; TTA chr11 5388709 5388730 5388726 5388731 +
tgtatacgtctctcttgctata

SEQ ID NO: 110783 - DNA, 22 bp, Artificial Sequence
  Synthetic oligonucleotide; CTC chr11 5388721 5388742 5388738 5388743 +
tcttgctatatagtagtcaact

SEQ ID NO: 110784 - DNA, 22 bp, Artificial Sequence
  Synthetic oligonucleotide; CTC chr11 5388723 5388744 5388740 5388745 +
ttgctatatagtagtcaactga

SEQ ID NO: 110785 - DNA, 22 bp, Artificial Sequence
  Synthetic oligonucleotide; CTT chr11 5388725 5388746 5388742 5388747 +
gctatatagtagtcaactgaat

SEQ ID NO: 110786 - DNA, 22 bp, Artificial Sequence
  Synthetic oligonucleotide; TTG chr11 5388726 5388747 5388743 5388748 +
ctatatagtagtcaactgaata

SEQ ID NO: 110787 - DNA, 22 bp, Artificial Sequence
  Synthetic oligonucleotide; CTA chr11 5388729 5388750 5388746 5388751 +
tatagtagtcaactgaatacag

SEQ ID NO: 110788 - DNA, 22 bp, Artificial Sequence
  Synthetic oligonucleotide; CTG chr11 5388744 5388765 5388761 5388766 +
aatacagtagtacaaaagatga

SEQ ID NO: 110789 - DNA, 22 bp, Artificial Sequence
  Synthetic oligonucleotide; CTG chr11 5388773 5388794 5388790 5388795 +
gaatagtcctgaaagagtgatc

SEQ ID NO: 110790 - DNA, 22 bp, Artificial Sequence
  Synthetic oligonucleotide; CTG chr11 5388784 5388805 5388801 5388806 +
aaagagtgatctgaattagaat

SEQ ID NO: 110791 - DNA, 22 bp, Artificial Sequence
  Synthetic oligonucleotide; CTG chr11 5388797 5388818 5388814 5388819 +
aattagaatagcatcaatgaag

SEQ ID NO: 110792 - DNA, 22 bp, Artificial Sequence
  Synthetic oligonucleotide; TTA chr11 5388802 5388823 5388819 5388824 +
gaatagcatcaatgaaggtgac

SEQ ID NO: 110793 - DNA, 22 bp, Artificial Sequence
  Synthetic oligonucleotide; CTT chr11 5388841 5388862 5388858 5388863 +
gaggtattcagtaaacagaaac

SEQ ID NO: 110794 - DNA, 22 bp, Artificial Sequence
  Synthetic oligonucleotide; TTG chr11 5388842 5388863 5388859 5388864 +
aggtattcagtaaacagaaacc

SEQ ID NO: 110795 - DNA, 22 bp, Artificial Sequence
  Synthetic oligonucleotide; TTC chr11 5388850 5388871 5388867 5388872 +
agtaaacagaaaccctaggact

SEQ ID NO: 110796 - DNA, 22 bp, Artificial Sequence
  Synthetic oligonucleotide; CTA chr11 5388867 5388888 5388884 5388889 +
ggacttggtgattggttgatta

SEQ ID NO: 110797 - DNA, 22 bp, Artificial Sequence
  Synthetic oligonucleotide; CTT chr11 5388873 5388894 5388890 5388895 +
ggtgattggttgattagatact

SEQ ID NO: 110798 - DNA, 22 bp, Artificial Sequence
  Synthetic oligonucleotide; TTG chr11 5388874 5388895 5388891 5388896 +
gtgattggttgattagatacta

SEQ ID NO: 110799 - DNA, 22 bp, Artificial Sequence
  Synthetic oligonucleotide; TTG chr11 5388881 5388902 5388898 5388903 +
gttgattagatactatggagag

SEQ ID NO: 110800 - DNA, 22 bp, Artificial Sequence
  Synthetic oligonucleotide; TTG chr11 5388885 5388906 5388902 5388907 +
attagatactatggagagatgt

SEQ ID NO: 110801 - DNA, 22 bp, Artificial Sequence
  Synthetic oligonucleotide; TTA chr11 5388889 5388910 5388906 5388911 +
gatactatggagagatgtgata

SEQ ID NO: 110802 - DNA, 22 bp, Artificial Sequence
  Synthetic oligonucleotide; CTA chr11 5388896 5388917 5388913 5388918 +
tggagagatgtgatatggagaa

SEQ ID NO: 110803 - DNA, 22 bp, Artificial Sequence
  Synthetic oligonucleotide; CTA chr11 5388923 5388944 5388940 5388945 +
acataaaacatgacatttgact

SEQ ID NO: 110804 - DNA, 22 bp, Artificial Sequence
  Synthetic oligonucleotide; TTT chr11 5388941 5388962 5388958 5388963 +
gacttgagccactgagataatg

SEQ ID NO: 110805 - DNA, 22 bp, Artificial Sequence
  Synthetic oligonucleotide; TTG chr11 5388942 5388963 5388959 5388964 +
acttgagccactgagataatga

SEQ ID NO: 110806 - DNA, 22 bp, Artificial Sequence
  Synthetic oligonucleotide; CTT chr11 5388946 5388967 5388963 5388968 +
gagccactgagataatgaaaag

SEQ ID NO: 110807 - DNA, 22 bp, Artificial Sequence
  Synthetic oligonucleotide; TTG chr11 5388947 5388968 5388964 5388969 +
agccactgagataatgaaaagt

SEQ ID NO: 110808 - DNA, 22 bp, Artificial Sequence
  Synthetic oligonucleotide; CTG chr11 5388955 5388976 5388972 5388977 +
agataatgaaaagtacagatgt

SEQ ID NO: 110809 - DNA, 22 bp, Artificial Sequence
  Synthetic oligonucleotide; TTG chr11 5388979 5389000 5388996 5389001 +
ctagagtctggaaatcaaaaga

SEQ ID NO: 110810 - DNA, 22 bp, Artificial Sequence
  Synthetic oligonucleotide; CTA chr11 5388982 5389003 5388999 5389004 +
gagtctggaaatcaaaagagag

SEQ ID NO: 110811 - DNA, 22 bp, Artificial Sequence
  Synthetic oligonucleotide; CTG chr11 5388989 5389010 5389006 5389011 +
gaaatcaaaagagagaaagaca

SEQ ID NO: 110812 - DNA, 22 bp, Artificial Sequence
  Synthetic oligonucleotide; TTC chr11 5389016 5389037 5389033 5389038 +
tggaattatatatttgttattt

SEQ ID NO: 110813 - DNA, 22 bp, Artificial Sequence
  Synthetic oligonucleotide; CTG chr11 5389018 5389039 5389035 5389040 +
gaattatatatttgttatttat

SEQ ID NO: 110814 - DNA, 22 bp, Artificial Sequence
  Synthetic oligonucleotide; TTA chr11 5389024 5389045 5389041 5389046 +
tatatttgttatttatcaatat

SEQ ID NO: 110815 - DNA, 22 bp, Artificial Sequence
  Synthetic oligonucleotide; TTT chr11 5389031 5389052 5389048 5389053 +
gttatttatcaatatatggatg

SEQ ID NO: 110816 - DNA, 22 bp, Artificial Sequence
  Synthetic oligonucleotide; TTG chr11 5389032 5389053 5389049 5389054 +
ttatttatcaatatatggatgg

SEQ ID NO: 110817 - DNA, 22 bp, Artificial Sequence
  Synthetic oligonucleotide; TTA chr11 5389035 5389056 5389052 5389057 +
tttatcaatatatggatggtaa

SEQ ID NO: 110818 - DNA, 22 bp, Artificial Sequence
  Synthetic oligonucleotide; TTT chr11 5389038 5389059 5389055 5389060 +
atcaatatatggatggtaaatg

SEQ ID NO: 110819 - DNA, 22 bp, Artificial Sequence
  Synthetic oligonucleotide; TTA chr11 5389039 5389060 5389056 5389061 +
tcaatatatggatggtaaatga

SEQ ID NO: 110820 - DNA, 22 bp, Artificial Sequence
  Synthetic oligonucleotide; TTA chr11 5389084 5389105 5389101 5389106 +
agaagaaataatagaatatggc

SEQ ID NO: 110821 - DNA, 22 bp, Artificial Sequence
  Synthetic oligonucleotide; TTG chr11 5389116 5389137 5389133 5389138 +
ccaaggatgggaagaactatac

SEQ ID NO: 110822 - DNA, 22 bp, Artificial Sequence
  Synthetic oligonucleotide; CTA chr11 5389135 5389156 5389152 5389157 +
tacttaagggttgagcaataaa

SEQ ID NO: 110823 - DNA, 22 bp, Artificial Sequence
  Synthetic oligonucleotide; CTT chr11 5389140 5389161 5389157 5389162 +
aagggttgagcaataaaggcac

SEQ ID NO: 110824 - DNA, 22 bp, Artificial Sequence
  Synthetic oligonucleotide; TTA chr11 5389141 5389162 5389158 5389163 +
agggttgagcaataaaggcaca

SEQ ID NO: 110825 - DNA, 22 bp, Artificial Sequence
  Synthetic oligonucleotide; TTG chr11 5389148 5389169 5389165 5389170 +
agcaataaaggcacaccagcaa

SEQ ID NO: 110826 - DNA, 22 bp, Artificial Sequence
  Synthetic oligonucleotide; CTG chr11 5389188 5389209 5389205 5389210 +
aaataattgaaatacagaggaa

SEQ ID NO: 110827 - DNA, 22 bp, Artificial Sequence
  Synthetic oligonucleotide; TTG chr11 5389197 5389218 5389214 5389219 +
aaatacagaggaaaactggtga

SEQ ID NO: 110828 - DNA, 22 bp, Artificial Sequence
  Synthetic oligonucleotide; CTG chr11 5389215 5389236 5389232 5389237 +
gtgagggcgaggttatcaaaga

SEQ ID NO: 110829 - DNA, 22 bp, Artificial Sequence
  Synthetic oligonucleotide; TTA chr11 5389230 5389251 5389247 5389252 +
tcaaagaaagttcaataaagta

SEQ ID NO: 110830 - DNA, 22 bp, Artificial Sequence
  Synthetic oligonucleotide; TTC chr11 5389243 5389264 5389260 5389265 +
aataaagtagtgagattggcag

SEQ ID NO: 110831 - DNA, 22 bp, Artificial Sequence
  Synthetic oligonucleotide; TTG chr11 5389261 5389282 5389278 5389283 +
gcagaattcataagggtggagt

SEQ ID NO: 110832 - DNA, 22 bp, Artificial Sequence
  Synthetic oligonucleotide; TTC chr11 5389270 5389291 5389287 5389292 +
ataagggtggagtagataatac

SEQ ID NO: 110833 - DNA, 22 bp, Artificial Sequence
  Synthetic oligonucleotide; CTA chr11 5389294 5389315 5389311 5389316 +
aaggtgatgatgaccatggtac

SEQ ID NO: 110834 - DNA, 22 bp, Artificial Sequence
  Synthetic oligonucleotide; CTG chr11 5389318 5389339 5389335 5389340 +
cttgtgatgttgtgaatgttag

SEQ ID NO: 110835 - DNA, 22 bp, Artificial Sequence
  Synthetic oligonucleotide; CTT chr11 5389321 5389342 5389338 5389343 +
gtgatgttgtgaatgttagtga

SEQ ID NO: 110836 - DNA, 22 bp, Artificial Sequence
  Synthetic oligonucleotide; TTG chr11 5389322 5389343 5389339 5389344 +
tgatgttgtgaatgttagtgaa

SEQ ID NO: 110837 - DNA, 22 bp, Artificial Sequence
  Synthetic oligonucleotide; TTG chr11 5389330 5389351 5389347 5389352 +
tgaatgttagtgaagctgaaga

SEQ ID NO: 110838 - DNA, 22 bp, Artificial Sequence
  Synthetic oligonucleotide; TTA chr11 5389339 5389360 5389356 5389361 +
gtgaagctgaagaattaataac

SEQ ID NO: 110839 - DNA, 22 bp, Artificial Sequence
  Synthetic oligonucleotide; CTG chr11 5389348 5389369 5389365 5389370 +
aagaattaataaccagaaatat

SEQ ID NO: 110840 - DNA, 22 bp, Artificial Sequence
  Synthetic oligonucleotide; TTA chr11 5389356 5389377 5389373 5389378 +
ataaccagaaatatccatttat

SEQ ID NO: 110841 - DNA, 22 bp, Artificial Sequence
  Synthetic oligonucleotide; TTT chr11 5389376 5389397 5389393 5389398 +
attttcagctcaatccccgagg

SEQ ID NO: 110842 - DNA, 22 bp, Artificial Sequence
  Synthetic oligonucleotide; TTA chr11 5389377 5389398 5389394 5389399 +
ttttcagctcaatccccgagga

SEQ ID NO: 110843 - DNA, 22 bp, Artificial Sequence
  Synthetic oligonucleotide; TTT chr11 5389380 5389401 5389397 5389402 +
tcagctcaatccccgaggaatg

SEQ ID NO: 110844 - DNA, 22 bp, Artificial Sequence
  Synthetic oligonucleotide; TTT chr11 5389381 5389402 5389398 5389403 +
cagctcaatccccgaggaatgt

SEQ ID NO: 110845 - DNA, 22 bp, Artificial Sequence
  Synthetic oligonucleotide; TTC chr11 5389382 5389403 5389399 5389404 +
agctcaatccccgaggaatgtc

SEQ ID NO: 110846 - DNA, 22 bp, Artificial Sequence
  Synthetic oligonucleotide; CTC chr11 5389387 5389408 5389404 5389409 +
aatccccgaggaatgtcagtcc

SEQ ID NO: 110847 - DNA, 22 bp, Artificial Sequence
  Synthetic oligonucleotide; TTC chr11 5389416 5389437 5389433 5389438 +
gctcagtcctcaattcatgctg

SEQ ID NO: 110848 - DNA, 22 bp, Artificial Sequence
  Synthetic oligonucleotide; CTC chr11 5389420 5389441 5389437 5389442 +
agtcctcaattcatgctgctat

SEQ ID NO: 110849 - DNA, 22 bp, Artificial Sequence
  Synthetic oligonucleotide; CTC chr11 5389427 5389448 5389444 5389449 +
aattcatgctgctatccaacat

SEQ ID NO: 110850 - DNA, 22 bp, Artificial Sequence
  Synthetic oligonucleotide; TTC chr11 5389432 5389453 5389449 5389454 +
atgctgctatccaacattactc

SEQ ID NO: 110851 - DNA, 22 bp, Artificial Sequence
  Synthetic oligonucleotide; CTG chr11 5389438 5389459 5389455 5389460 +
ctatccaacattactcagttta

SEQ ID NO: 110852 - DNA, 22 bp, Artificial Sequence
  Synthetic oligonucleotide; CTA chr11 5389441 5389462 5389458 5389463 +
tccaacattactcagtttagcc

SEQ ID NO: 110853 - DNA, 22 bp, Artificial Sequence
  Synthetic oligonucleotide; TTA chr11 5389451 5389472 5389468 5389473 +
ctcagtttagccccatattcta

SEQ ID NO: 110854 - DNA, 22 bp, Artificial Sequence
  Synthetic oligonucleotide; CTC chr11 5389454 5389475 5389471 5389476 +
agtttagccccatattctatct

SEQ ID NO: 110855 - DNA, 22 bp, Artificial Sequence
  Synthetic oligonucleotide; TTT chr11 5389459 5389480 5389476 5389481 +
agccccatattctatctcacca

SEQ ID NO: 110856 - DNA, 22 bp, Artificial Sequence
  Synthetic oligonucleotide; TTA chr11 5389460 5389481 5389477 5389482 +
gccccatattctatctcaccag

SEQ ID NO: 110857 - DNA, 22 bp, Artificial Sequence
  Synthetic oligonucleotide; TTC chr11 5389471 5389492 5389488 5389493 +
tatctcaccagctttcctggat

SEQ ID NO: 110858 - DNA, 22 bp, Artificial Sequence
  Synthetic oligonucleotide; CTA chr11 5389473 5389494 5389490 5389495 +
tctcaccagctttcctggattg

SEQ ID NO: 110859 - DNA, 22 bp, Artificial Sequence
  Synthetic oligonucleotide; CTC chr11 5389477 5389498 5389494 5389499 +
accagctttcctggattggaag

SEQ ID NO: 110860 - DNA, 22 bp, Artificial Sequence
  Synthetic oligonucleotide; CTT chr11 5389485 5389506 5389502 5389507 +
tcctggattggaaggcatcaaa

SEQ ID NO: 110861 - DNA, 22 bp, Artificial Sequence
  Synthetic oligonucleotide; TTT chr11 5389486 5389507 5389503 5389508 +
cctggattggaaggcatcaaac

SEQ ID NO: 110862 - DNA, 22 bp, Artificial Sequence
  Synthetic oligonucleotide; TTC chr11 5389487 5389508 5389504 5389509 +
ctggattggaaggcatcaaaca

SEQ ID NO: 110863 - DNA, 22 bp, Artificial Sequence
  Synthetic oligonucleotide; CTG chr11 5389490 5389511 5389507 5389512 +
gattggaaggcatcaaacactg

SEQ ID NO: 110864 - DNA, 22 bp, Artificial Sequence
  Synthetic oligonucleotide; TTG chr11 5389495 5389516 5389512 5389517 +
gaaggcatcaaacactggattt

SEQ ID NO: 110865 - DNA, 22 bp, Artificial Sequence
  Synthetic oligonucleotide; CTG chr11 5389512 5389533 5389529 5389534 +
gattttcatcccctttttcttt

SEQ ID NO: 110866 - DNA, 22 bp, Artificial Sequence
  Synthetic oligonucleotide; TTT chr11 5389517 5389538 5389534 5389539 +
tcatcccctttttctttatgta

SEQ ID NO: 110867 - DNA, 22 bp, Artificial Sequence
  Synthetic oligonucleotide; TTT chr11 5389518 5389539 5389535 5389540 +
catcccctttttctttatgtac

SEQ ID NO: 110868 - DNA, 22 bp, Artificial Sequence
  Synthetic oligonucleotide; TTC chr11 5389519 5389540 5389536 5389541 +
atcccctttttctttatgtaca

SEQ ID NO: 110869 - DNA, 22 bp, Artificial Sequence
  Synthetic oligonucleotide; CTT chr11 5389527 5389548 5389544 5389549 +
tttctttatgtacatggttgcc

SEQ ID NO: 110870 - DNA, 22 bp, Artificial Sequence
  Synthetic oligonucleotide; TTT chr11 5389528 5389549 5389545 5389550 +
ttctttatgtacatggttgcca

SEQ ID NO: 110871 - DNA, 22 bp, Artificial Sequence
  Synthetic oligonucleotide; TTT chr11 5389529 5389550 5389546 5389551 +
tctttatgtacatggttgccat

SEQ ID NO: 110872 - DNA, 22 bp, Artificial Sequence
  Synthetic oligonucleotide; TTT chr11 5389530 5389551 5389547 5389552 +
ctttatgtacatggttgccatc

SEQ ID NO: 110873 - DNA, 22 bp, Artificial Sequence
  Synthetic oligonucleotide; TTC chr11 5389531 5389552 5389548 5389553 +
tttatgtacatggttgccatct

SEQ ID NO: 110874 - DNA, 22 bp, Artificial Sequence
  Synthetic oligonucleotide; CTT chr11 5389533 5389554 5389550 5389555 +
tatgtacatggttgccatctca

SEQ ID NO: 110875 - DNA, 22 bp, Artificial Sequence
  Synthetic oligonucleotide; TTT chr11 5389534 5389555 5389551 5389556 +
atgtacatggttgccatctcag

SEQ ID NO: 110876 - DNA, 22 bp, Artificial Sequence
  Synthetic oligonucleotide; TTA chr11 5389535 5389556 5389552 5389557 +
tgtacatggttgccatctcagg

SEQ ID NO: 110877 - DNA, 22 bp, Artificial Sequence
  Synthetic oligonucleotide; TTG chr11 5389547 5389568 5389564 5389569 +
ccatctcaggcaattgtttcat

SEQ ID NO: 110878 - DNA, 22 bp, Artificial Sequence
  Synthetic oligonucleotide; CTC chr11 5389554 5389575 5389571 5389576 +
aggcaattgtttcattctgatc

SEQ ID NO: 110879 - DNA, 22 bp, Artificial Sequence
  Synthetic oligonucleotide; TTG chr11 5389563 5389584 5389580 5389585 +
tttcattctgatcattattaag

SEQ ID NO: 110880 - DNA, 22 bp, Artificial Sequence
  Synthetic oligonucleotide; TTT chr11 5389566 5389587 5389583 5389588 +
cattctgatcattattaagacc

SEQ ID NO: 110881 - DNA, 22 bp, Artificial Sequence
  Synthetic oligonucleotide; TTC chr11 5389567 5389588 5389584 5389589 +
attctgatcattattaagacca

SEQ ID NO: 110882 - DNA, 22 bp, Artificial Sequence
  Synthetic oligonucleotide; TTC chr11 5389571 5389592 5389588 5389593 +
tgatcattattaagaccaaccc

SEQ ID NO: 110883 - DNA, 22 bp, Artificial Sequence
  Synthetic oligonucleotide; CTG chr11 5389573 5389594 5389590 5389595 +
atcattattaagaccaaccctc

SEQ ID NO: 110884 - DNA, 22 bp, Artificial Sequence
  Synthetic oligonucleotide; TTA chr11 5389580 5389601 5389597 5389602 +
ttaagaccaaccctcgtctgca

SEQ ID NO: 110885 - DNA, 22 bp, Artificial Sequence
  Synthetic oligonucleotide; TTA chr11 5389583 5389604 5389600 5389605 +
agaccaaccctcgtctgcacac

SEQ ID NO: 110886 - DNA, 22 bp, Artificial Sequence
  Synthetic oligonucleotide; CTC chr11 5389595 5389616 5389612 5389617 +
gtctgcacacacccatgtacta

SEQ ID NO: 110887 - DNA, 22 bp, Artificial Sequence
  Synthetic oligonucleotide; CTG chr11 5389600 5389621 5389617 5389622 +
cacacacccatgtactatctac

SEQ ID NO: 110888 - DNA, 22 bp, Artificial Sequence
  Synthetic oligonucleotide; CTA chr11 5389617 5389638 5389634 5389639 +
tctactatccttgctggccctc

SEQ ID NO: 110889 - DNA, 22 bp, Artificial Sequence
  Synthetic oligonucleotide; CTA chr11 5389621 5389642 5389638 5389643 +
ctatccttgctggccctcactg

SEQ ID NO: 110890 - DNA, 22 bp, Artificial Sequence
  Synthetic oligonucleotide; CTA chr11 5389624 5389645 5389641 5389646 +
tccttgctggccctcactgacc

SEQ ID NO: 110891 - DNA, 22 bp, Artificial Sequence
  Synthetic oligonucleotide; CTT chr11 5389629 5389650 5389646 5389651 +
gctggccctcactgacctgggg

SEQ ID NO: 110892 - DNA, 22 bp, Artificial Sequence
  Synthetic oligonucleotide; TTG chr11 5389630 5389651 5389647 5389652 +
ctggccctcactgacctggggc

SEQ ID NO: 110893 - DNA, 22 bp, Artificial Sequence
  Synthetic oligonucleotide; CTG chr11 5389633 5389654 5389650 5389655 +
gccctcactgacctggggctgt

SEQ ID NO: 110894 - DNA, 22 bp, Artificial Sequence
  Synthetic oligonucleotide; CTC chr11 5389639 5389660 5389656 5389661 +
actgacctggggctgtgtgtgt

SEQ ID NO: 110895 - DNA, 22 bp, Artificial Sequence
  Synthetic oligonucleotide; CTG chr11 5389643 5389664 5389660 5389665 +
acctggggctgtgtgtgtccac

SEQ ID NO: 110896 - DNA, 22 bp, Artificial Sequence
  Synthetic oligonucleotide; CTG chr11 5389648 5389669 5389665 5389670 +
gggctgtgtgtgtccacgttgc

SEQ ID NO: 110897 - DNA, 22 bp, Artificial Sequence
  Synthetic oligonucleotide; CTG chr11 5389654 5389675 5389671 5389676 +
tgtgtgtccacgttgcccacca

SEQ ID NO: 110898 - DNA, 22 bp, Artificial Sequence
  Synthetic oligonucleotide; TTG chr11 5389669 5389690 5389686 5389691 +
cccaccactatggggatcttct

SEQ ID NO: 110899 - DNA, 22 bp, Artificial Sequence
  Synthetic oligonucleotide; CTA chr11 5389679 5389700 5389696 5389701 +
tggggatcttctggtttaactc

SEQ ID NO: 110900 - DNA, 22 bp, Artificial Sequence
  Synthetic oligonucleotide; CTT chr11 5389689 5389710 5389706 5389711 +
ctggtttaactcccatagtatc

SEQ ID NO: 110901 - DNA, 22 bp, Artificial Sequence
  Synthetic oligonucleotide; TTC chr11 5389690 5389711 5389707 5389712 +
tggtttaactcccatagtatct

SEQ ID NO: 110902 - DNA, 22 bp, Artificial Sequence
  Synthetic oligonucleotide; CTG chr11 5389692 5389713 5389709 5389714 +
gtttaactcccatagtatctac

SEQ ID NO: 110903 - DNA, 22 bp, Artificial Sequence
  Synthetic oligonucleotide; TTT chr11 5389696 5389717 5389713 5389718 +
aactcccatagtatctactttg

SEQ ID NO: 110904 - DNA, 22 bp, Artificial Sequence
  Synthetic oligonucleotide; TTA chr11 5389697 5389718 5389714 5389719 +
actcccatagtatctactttgg

SEQ ID NO: 110905 - DNA, 22 bp, Artificial Sequence
  Synthetic oligonucleotide; CTC chr11 5389701 5389722 5389718 5389723 +
ccatagtatctactttggagcg

SEQ ID NO: 110906 - DNA, 22 bp, Artificial Sequence
  Synthetic oligonucleotide; CTA chr11 5389713 5389734 5389730 5389735 +
ctttggagcgtgtcaaatccag

SEQ ID NO: 110907 - DNA, 22 bp, Artificial Sequence
  Synthetic oligonucleotide; CTT chr11 5389716 5389737 5389733 5389738 +
tggagcgtgtcaaatccagatg

SEQ ID NO: 110908 - DNA, 22 bp, Artificial Sequence
  Synthetic oligonucleotide; TTT chr11 5389717 5389738 5389734 5389739 +
ggagcgtgtcaaatccagatgt

SEQ ID NO: 110909 - DNA, 22 bp, Artificial Sequence
  Synthetic oligonucleotide; TTG chr11 5389718 5389739 5389735 5389740 +
gagcgtgtcaaatccagatgtt

SEQ ID NO: 110910 - DNA, 22 bp, Artificial Sequence
  Synthetic oligonucleotide; TTC chr11 5389741 5389762 5389758 5389763 +
tgcatccactctttttccttca

SEQ ID NO: 110911 - DNA, 22 bp, Artificial Sequence
  Synthetic oligonucleotide; CTG chr11 5389743 5389764 5389760 5389765 +
catccactctttttccttcatg

SEQ ID NO: 110912 - DNA, 22 bp, Artificial Sequence
  Synthetic oligonucleotide; CTC chr11 5389752 5389773 5389769 5389774 +
tttttccttcatggagtcctca

SEQ ID NO: 110913 - DNA, 22 bp, Artificial Sequence
  Synthetic oligonucleotide; CTT chr11 5389754 5389775 5389771 5389776 +
tttccttcatggagtcctcagt

SEQ ID NO: 110914 - DNA, 22 bp, Artificial Sequence
  Synthetic oligonucleotide; TTT chr11 5389755 5389776 5389772 5389777 +
ttccttcatggagtcctcagtg

SEQ ID NO: 110915 - DNA, 22 bp, Artificial Sequence
  Synthetic oligonucleotide; TTT chr11 5389756 5389777 5389773 5389778 +
tccttcatggagtcctcagtgc

SEQ ID NO: 110916 - DNA, 22 bp, Artificial Sequence
  Synthetic oligonucleotide; TTT chr11 5389757 5389778 5389774 5389779 +
ccttcatggagtcctcagtgct

SEQ ID NO: 110917 - DNA, 22 bp, Artificial Sequence
  Synthetic oligonucleotide; TTC chr11 5389758 5389779 5389775 5389780 +
cttcatggagtcctcagtgctc

SEQ ID NO: 110918 - DNA, 22 bp, Artificial Sequence
  Synthetic oligonucleotide; CTT chr11 5389761 5389782 5389778 5389783 +
catggagtcctcagtgctcctc

SEQ ID NO: 110919 - DNA, 22 bp, Artificial Sequence
  Synthetic oligonucleotide; TTC chr11 5389762 5389783 5389779 5389784 +
atggagtcctcagtgctcctca

SEQ ID NO: 110920 - DNA, 22 bp, Artificial Sequence
  Synthetic oligonucleotide; CTC chr11 5389773 5389794 5389790 5389795 +
agtgctcctcatgatgtccttt

SEQ ID NO: 110921 - DNA, 22 bp, Artificial Sequence
  Synthetic oligonucleotide; CTC chr11 5389780 5389801 5389797 5389802 +
ctcatgatgtcctttgaccgcc

SEQ ID NO: 110922 - DNA, 22 bp, Artificial Sequence
  Synthetic oligonucleotide; CTC chr11 5389783 5389804 5389800 5389805 +
atgatgtcctttgaccgccttg

SEQ ID NO: 110923 - DNA, 22 bp, Artificial Sequence
  Synthetic oligonucleotide; CTT chr11 5389794 5389815 5389811 5389816 +
tgaccgccttgtggccatctgc

SEQ ID NO: 110924 - DNA, 22 bp, Artificial Sequence
  Synthetic oligonucleotide; TTT chr11 5389795 5389816 5389812 5389817 +
gaccgccttgtggccatctgcc

SEQ ID NO: 110925 - DNA, 22 bp, Artificial Sequence
  Synthetic oligonucleotide; TTG chr11 5389796 5389817 5389813 5389818 +
accgccttgtggccatctgcca

SEQ ID NO: 110926 - DNA, 22 bp, Artificial Sequence
  Synthetic oligonucleotide; CTT chr11 5389804 5389825 5389821 5389826 +
gtggccatctgccaccctctga

SEQ ID NO: 110927 - DNA, 22 bp, Artificial Sequence
  Synthetic oligonucleotide; TTG chr11 5389805 5389826 5389822 5389827 +
tggccatctgccaccctctgag

SEQ ID NO: 110928 - DNA, 22 bp, Artificial Sequence
  Synthetic oligonucleotide; CTG chr11 5389815 5389836 5389832 5389837 +
ccaccctctgaggtattcggtc

SEQ ID NO: 110929 - DNA, 22 bp, Artificial Sequence
  Synthetic oligonucleotide; CTC chr11 5389823 5389844 5389840 5389845 +
tgaggtattcggtcattatcac

SEQ ID NO: 110930 - DNA, 22 bp, Artificial Sequence
  Synthetic oligonucleotide; CTG chr11 5389825 5389846 5389842 5389847 +
aggtattcggtcattatcactg

SEQ ID NO: 110931 - DNA, 22 bp, Artificial Sequence
  Synthetic oligonucleotide; TTC chr11 5389833 5389854 5389850 5389855 +
ggtcattatcactggccagcaa

SEQ ID NO: 110932 - DNA, 22 bp, Artificial Sequence
  Synthetic oligonucleotide; TTA chr11 5389841 5389862 5389858 5389863 +
tcactggccagcaagtggtcag

SEQ ID NO: 110933 - DNA, 22 bp, Artificial Sequence
  Synthetic oligonucleotide; CTG chr11 5389847 5389868 5389864 5389869 +
gccagcaagtggtcagagcagg

SEQ ID NO: 110934 - DNA, 22 bp, Artificial Sequence
  Synthetic oligonucleotide; CTA chr11 5389873 5389894 5389890 5389895 +
attgtcatcttccggggacctg

SEQ ID NO: 110935 - DNA, 22 bp, Artificial Sequence
  Synthetic oligonucleotide; TTG chr11 5389877 5389898 5389894 5389899 +
tcatcttccggggacctgtggc

SEQ ID NO: 110936 - DNA, 22 bp, Artificial Sequence
  Synthetic oligonucleotide; CTT chr11 5389884 5389905 5389901 5389906 +
ccggggacctgtggccactatc

SEQ ID NO: 110937 - DNA, 22 bp, Artificial Sequence
  Synthetic oligonucleotide; TTC chr11 5389885 5389906 5389902 5389907 +
cggggacctgtggccactatcc

SEQ ID NO: 110938 - DNA, 22 bp, Artificial Sequence
  Synthetic oligonucleotide; CTG chr11 5389895 5389916 5389912 5389917 +
tggccactatccctattgtcct

SEQ ID NO: 110939 - DNA, 22 bp, Artificial Sequence
  Synthetic oligonucleotide; CTA chr11 5389904 5389925 5389921 5389926 +
tccctattgtcctcctcctgaa

SEQ ID NO: 110940 - DNA, 22 bp, Artificial Sequence
  Synthetic oligonucleotide; CTA chr11 5389910 5389931 5389927 5389932 +
ttgtcctcctcctgaaggcttt

SEQ ID NO: 110941 - DNA, 22 bp, Artificial Sequence
  Synthetic oligonucleotide; TTG chr11 5389913 5389934 5389930 5389935 +
tcctcctcctgaaggcttttcc

SEQ ID NO: 110942 - DNA, 22 bp, Artificial Sequence
  Synthetic oligonucleotide; CTC chr11 5389918 5389939 5389935 5389940 +
ctcctgaaggcttttccctact

SEQ ID NO: 110943 - DNA, 22 bp, Artificial Sequence
  Synthetic oligonucleotide; CTC chr11 5389921 5389942 5389938 5389943 +
ctgaaggcttttccctactgtg

SEQ ID NO: 110944 - DNA, 22 bp, Artificial Sequence
  Synthetic oligonucleotide; CTG chr11 5389924 5389945 5389941 5389946 +
aaggcttttccctactgtggat

SEQ ID NO: 110945 - DNA, 22 bp, Artificial Sequence
  Synthetic oligonucleotide; CTT chr11 5389931 5389952 5389948 5389953 +
ttccctactgtggatctgtggt

SEQ ID NO: 110946 - DNA, 22 bp, Artificial Sequence
  Synthetic oligonucleotide; TTT chr11 5389932 5389953 5389949 5389954 +
tccctactgtggatctgtggtc

SEQ ID NO: 110947 - DNA, 22 bp, Artificial Sequence
  Synthetic oligonucleotide; TTT chr11 5389933 5389954 5389950 5389955 +
ccctactgtggatctgtggtcc

SEQ ID NO: 110948 - DNA, 22 bp, Artificial Sequence
  Synthetic oligonucleotide; TTC chr11 5389934 5389955 5389951 5389956 +
cctactgtggatctgtggtcct

SEQ ID NO: 110949 - DNA, 22 bp, Artificial Sequence
  Synthetic oligonucleotide; CTA chr11 5389938 5389959 5389955 5389960 +
ctgtggatctgtggtcctctcc

SEQ ID NO: 110950 - DNA, 22 bp, Artificial Sequence
  Synthetic oligonucleotide; CTG chr11 5389941 5389962 5389958 5389963 +
tggatctgtggtcctctcccac

SEQ ID NO: 110951 - DNA, 22 bp, Artificial Sequence
  Synthetic oligonucleotide; CTG chr11 5389949 5389970 5389966 5389971 +
tggtcctctcccactcattttg

SEQ ID NO: 110952 - DNA, 22 bp, Artificial Sequence
  Synthetic oligonucleotide; CTC chr11 5389957 5389978 5389974 5389979 +
tcccactcattttgcctgcacc

SEQ ID NO: 110953 - DNA, 22 bp, Artificial Sequence
  Synthetic oligonucleotide; CTC chr11 5389959 5389980 5389976 5389981 +
ccactcattttgcctgcaccag

SEQ ID NO: 110954 - DNA, 22 bp, Artificial Sequence
  Synthetic oligonucleotide; CTC chr11 5389965 5389986 5389982 5389987 +
attttgcctgcaccaggaagtg

SEQ ID NO: 110955 - DNA, 22 bp, Artificial Sequence
  Synthetic oligonucleotide; TTT chr11 5389969 5389990 5389986 5389991 +
tgcctgcaccaggaagtgatac

SEQ ID NO: 110956 - DNA, 22 bp, Artificial Sequence
  Synthetic oligonucleotide; TTT chr11 5389970 5389991 5389987 5389992 +
gcctgcaccaggaagtgataca

SEQ ID NO: 110957 - DNA, 22 bp, Artificial Sequence
  Synthetic oligonucleotide; TTG chr11 5389971 5389992 5389988 5389993 +
cctgcaccaggaagtgatacag

SEQ ID NO: 110958 - DNA, 22 bp, Artificial Sequence
  Synthetic oligonucleotide; CTG chr11 5389975 5389996 5389992 5389997 +
caccaggaagtgatacagctgg

SEQ ID NO: 110959 - DNA, 22 bp, Artificial Sequence
  Synthetic oligonucleotide; CTG chr11 5389996 5390017 5390013 5390018 +
gcctgcacagatatcaccttca

SEQ ID NO: 110960 - DNA, 22 bp, Artificial Sequence
  Synthetic oligonucleotide; CTG chr11 5390001 5390022 5390018 5390023 +
cacagatatcaccttcaataat

SEQ ID NO: 110961 - DNA, 22 bp, Artificial Sequence
  Synthetic oligonucleotide; CTT chr11 5390016 5390037 5390033 5390038 +
caataatctgtatggactgatg

SEQ ID NO: 110962 - DNA, 22 bp, Artificial Sequence
  Synthetic oligonucleotide; TTC chr11 5390017 5390038 5390034 5390039 +
aataatctgtatggactgatgg

SEQ ID NO: 110963 - DNA, 22 bp, Artificial Sequence
  Synthetic oligonucleotide; CTG chr11 5390026 5390047 5390043 5390048 +
tatggactgatggtggtagttt

SEQ ID NO: 110964 - DNA, 22 bp, Artificial Sequence
  Synthetic oligonucleotide; CTG chr11 5390035 5390056 5390052 5390057 +
atggtggtagttttcactgtga

SEQ ID NO: 110965 - DNA, 22 bp, Artificial Sequence
  Synthetic oligonucleotide; TTT chr11 5390048 5390069 5390065 5390070 +
tcactgtgatgctggacctggt

SEQ ID NO: 110966 - DNA, 22 bp, Artificial Sequence
  Synthetic oligonucleotide; TTT chr11 5390049 5390070 5390066 5390071 +
cactgtgatgctggacctggtg

SEQ ID NO: 110967 - DNA, 22 bp, Artificial Sequence
  Synthetic oligonucleotide; TTC chr11 5390050 5390071 5390067 5390072 +
actgtgatgctggacctggtgc

SEQ ID NO: 110968 - DNA, 22 bp, Artificial Sequence
  Synthetic oligonucleotide; CTG chr11 5390054 5390075 5390071 5390076 +
tgatgctggacctggtgctcat

SEQ ID NO: 110969 - DNA, 22 bp, Artificial Sequence
  Synthetic oligonucleotide; CTG chr11 5390062 5390083 5390079 5390084 +
gacctggtgctcatcgcactgt

SEQ ID NO: 110970 - DNA, 22 bp, Artificial Sequence
  Synthetic oligonucleotide; CTG chr11 5390068 5390089 5390085 5390090 +
gtgctcatcgcactgtcctatg

SEQ ID NO: 110971 - DNA, 22 bp, Artificial Sequence
  Synthetic oligonucleotide; CTC chr11 5390074 5390095 5390091 5390096 +
atcgcactgtcctatggactca

SEQ ID NO: 110972 - DNA, 22 bp, Artificial Sequence
  Synthetic oligonucleotide; CTG chr11 5390083 5390104 5390100 5390105 +
tcctatggactcatcctgcaca
